United States Patent 7,655,785 (BIOINFORMATICALLY DETECTABLE GROUP OF NOVEL REGULATORY OLIGONUCLEOTIDES AND USES THEREOF) - sequence listing, part 15

SEQ ID NO: 579799 - RNA, 20 nt, Homo sapiens
cuugggaaacuauucaugaa

SEQ ID NO: 579800 - RNA, 15 nt, Homo sapiens
cuugggaacuccacu

SEQ ID NO: 579801 - RNA, 21 nt, Homo sapiens
cuugggaaggacacagcagua

SEQ ID NO: 579802 - RNA, 16 nt, Homo sapiens
cuugggaccgugccca

SEQ ID NO: 579803 - RNA, 18 nt, Homo sapiens
cuugggaggacaugcgug

SEQ ID NO: 579804 - RNA, 15 nt, Homo sapiens
cuugggauugucuua

SEQ ID NO: 579805 - RNA, 19 nt, Homo sapiens
cuugggcuacuggcagcuc

SEQ ID NO: 579806 - RNA, 13 nt, Homo sapiens
cuugggcucccug

SEQ ID NO: 579807 - RNA, 16 nt, Homo sapiens
cuuggggccaccaaag

SEQ ID NO: 579808 - RNA, 23 nt, Homo sapiens
cuugggggaggaggaacaaauaa

SEQ ID NO: 579809 - RNA, 21 nt, Homo sapiens
cuuggggguuuucaaugugaa

SEQ ID NO: 579810 - RNA, 17 nt, Homo sapiens
cuugggguaagccagag

SEQ ID NO: 579811 - RNA, 20 nt, Homo sapiens
cuugggucucagcugcugac

SEQ ID NO: 579812 - RNA, 14 nt, Homo sapiens
cuugguaugcaucu

SEQ ID NO: 579813 - RNA, 13 nt, Homo sapiens
cuugguaugugcc

SEQ ID NO: 579814 - RNA, 16 nt, Homo sapiens
cuuggucaccagcucc

SEQ ID NO: 579815 - RNA, 17 nt, Homo sapiens
cuugguccuaagcaccu

SEQ ID NO: 579816 - RNA, 17 nt, Homo sapiens
cuuggucugcagaccau

SEQ ID NO: 579817 - RNA, 13 nt, Homo sapiens
cuuggugcucugu

SEQ ID NO: 579818 - RNA, 14 nt, Homo sapiens
cuuggugguggaug

SEQ ID NO: 579819 - RNA, 22 nt, Homo sapiens
cuugguuaaaauggcuacacuc

SEQ ID NO: 579820 - RNA, 19 nt, Homo sapiens
cuugguuagacgccuucca

SEQ ID NO: 579821 - RNA, 15 nt, Homo sapiens
cuugguucaucagug

SEQ ID NO: 579822 - RNA, 18 nt, Homo sapiens
cuugguuguauaaagcaa

SEQ ID NO: 579823 - RNA, 19 nt, Homo sapiens
cuugguuucagccaagggg

SEQ ID NO: 579824 - RNA, 17 nt, Homo sapiens
cuugguuuucccuuugc

SEQ ID NO: 579825 - RNA, 21 nt, Homo sapiens
cuugguuuuuggcucuuucag

SEQ ID NO: 579826 - RNA, 19 nt, Homo sapiens
cuuguaacuuaauauacua

SEQ ID NO: 579827 - RNA, 20 nt, Homo sapiens
cuuguaauaccugauugauc

SEQ ID NO: 579828 - RNA, 18 nt, Homo sapiens
cuuguaauucuaaaugaa

SEQ ID NO: 579829 - RNA, 20 nt, Homo sapiens
cuuguaccacuucaucaaaa

SEQ ID NO: 579830 - RNA, 16 nt, Homo sapiens
cuuguagaguggugcu

SEQ ID NO: 579831 - RNA, 16 nt, Homo sapiens
cuuguagcaguuuuca

SEQ ID NO: 579832 - RNA, 20 nt, Homo sapiens
cuugucaacaugcauugcca

SEQ ID NO: 579833 - RNA, 13 nt, Homo sapiens
cuugucacacgag

SEQ ID NO: 579834 - RNA, 23 nt, Homo sapiens
cuugucaccaguuaaaagcauuu

SEQ ID NO: 579835 - RNA, 23 nt, Homo sapiens
cuugucaccauuggacagucucc

SEQ ID NO: 579836 - RNA, 13 nt, Homo sapiens
cuugucauaaaau

SEQ ID NO: 579837 - RNA, 14 nt, Homo sapiens
cuugucauuccaga

SEQ ID NO: 579838 - RNA, 16 nt, Homo sapiens
cuugucauuccagagu

SEQ ID NO: 579839 - RNA, 15 nt, Homo sapiens
cuugucauugccagc

SEQ ID NO: 579840 - RNA, 13 nt, Homo sapiens
uaauaacauauua

SEQ ID NO: 579841 - RNA, 18 nt, Homo sapiens
uaauaaccuuaaggagua

SEQ ID NO: 579842 - RNA, 18 nt, Homo sapiens
uaauaacugcuuacucaa

SEQ ID NO: 579843 - RNA, 17 nt, Homo sapiens
uaauaacuguguacugu

SEQ ID NO: 579844 - RNA, 17 nt, Homo sapiens
uaauaagauggcugugg

SEQ ID NO: 579845 - RNA, 23 nt, Homo sapiens
uaauaaguuuugauauaaucuug

SEQ ID NO: 579846 - RNA, 23 nt, Homo sapiens
uaauaauacaccuauuucacuaa

SEQ ID NO: 579847 - RNA, 17 nt, Homo sapiens
uaauaauacagccaaag

SEQ ID NO: 579848 - RNA, 13 nt, Homo sapiens
uaauaaugugcaa

SEQ ID NO: 579849 - RNA, 13 nt, Homo sapiens
uaauaauugauca

SEQ ID NO: 579850 - RNA, 22 nt, Homo sapiens
uaauacacagugagacacagua

SEQ ID NO: 579851 - RNA, 16 nt, Homo sapiens
uaauacagccaaagau

SEQ ID NO: 579852 - RNA, 23 nt, Homo sapiens
uaauacagccaaagauaaucucu

SEQ ID NO: 579853 - RNA, 14 nt, Homo sapiens
uaauaccaucucuu

SEQ ID NO: 579854 - RNA, 19 nt, Homo sapiens
uaauaccucuuacuuugcu

SEQ ID NO: 579855 - RNA, 22 nt, Homo sapiens
uaauacuauauuuauacuguau

SEQ ID NO: 579856 - RNA, 15 nt, Homo sapiens
uaauacuauucuuua

SEQ ID NO: 579857 - RNA, 19 nt, Homo sapiens
uaauacugccggucaccca

SEQ ID NO: 579858 - RNA, 11 nt, Homo sapiens
uaauacuguau

SEQ ID NO: 579859 - RNA, 19 nt, Homo sapiens
uaauacuuuugcugaugcu

SEQ ID NO: 579860 - RNA, 20 nt, Homo sapiens
uaauacuuuugcugaugcuu

SEQ ID NO: 579861 - RNA, 18 nt, Homo sapiens
uaauagaaauaaauuccu

SEQ ID NO: 579862 - RNA, 15 nt, Homo sapiens
uaauagacugaguca

SEQ ID NO: 579863 - RNA, 23 nt, Homo sapiens
uaauagauuguuuugccacuuag

SEQ ID NO: 579864 - RNA, 22 nt, Homo sapiens
uaauagcccauaaagucugaga

SEQ ID NO: 579865 - RNA, 23 nt, Homo sapiens
uaauagccuggguuaaguauuau

SEQ ID NO: 579866 - RNA, 12 nt, Homo sapiens
uaauagucauca

SEQ ID NO: 579867 - RNA, 16 nt, Homo sapiens
uaauagucauuccaaa

SEQ ID NO: 579868 - RNA, 17 nt, Homo sapiens
uaauagucuuugccagu

SEQ ID NO: 579869 - RNA, 14 nt, Homo sapiens
uaauauaagccaua

SEQ ID NO: 579870 - RNA, 13 nt, Homo sapiens
uaauauacuuuaa

SEQ ID NO: 579871 - RNA, 17 nt, Homo sapiens
uaauauaguuauugcac

SEQ ID NO: 579872 - RNA, 14 nt, Homo sapiens
uaauauauuguaca

SEQ ID NO: 579873 - RNA, 22 nt, Homo sapiens
uaauaugaaaaucuccaucuca

SEQ ID NO: 579874 - RNA, 15 nt, Homo sapiens
uaauaugaugccacu

SEQ ID NO: 579875 - RNA, 23 nt, Homo sapiens
uaauaugaugccacuuugcagcu

SEQ ID NO: 579876 - RNA, 13 nt, Homo sapiens
uaauaugcuuuac

SEQ ID NO: 579877 - RNA, 16 nt, Homo sapiens
uaauaugguauuugcu

SEQ ID NO: 579878 - RNA, 12 nt, Homo sapiens
uaauauguauau

SEQ ID NO: 579879 - RNA, 23 nt, Homo sapiens
uaauauguuuaguuuuacauuuu

SEQ ID NO: 579880 - RNA, 16 nt, Homo sapiens
uaauauuauuacuuua

SEQ ID NO: 579881 - RNA, 16 nt, Homo sapiens
uaauauugagaaucag

SEQ ID NO: 579882 - RNA, 15 nt, Homo sapiens
uaauauugugcaaac

SEQ ID NO: 579883 - RNA, 14 nt, Homo sapiens
uaauauuuuccaua

SEQ ID NO: 579884 - RNA, 17 nt, Homo sapiens
uaauauuuuccuaguag

SEQ ID NO: 579885 - RNA, 19 nt, Homo sapiens
uaauauuuuccuaguagau

SEQ ID NO: 579886 - RNA, 19 nt, Homo sapiens
uaauauuuuuccacuuaaa

SEQ ID NO: 579887 - RNA, 20 nt, Homo sapiens
uaauauuuuuguauuucucu

SEQ ID NO: 579888 - RNA, 13 nt, Homo sapiens
uaaucaagacucu

SEQ ID NO: 579889 - RNA, 20 nt, Homo sapiens
uaaucaagagaaacuucaaa

SEQ ID NO: 579890 - RNA, 22 nt, Homo sapiens
uaaucacucuaauuaauuguaa

SEQ ID NO: 579891 - RNA, 18 nt, Homo sapiens
uaaucagcaauauugccu

SEQ ID NO: 579892 - RNA, 22 nt, Homo sapiens
uaaucagcaauauugccugugc

SEQ ID NO: 579893 - RNA, 12 nt, Homo sapiens
uaaucagcauua

SEQ ID NO: 579894 - RNA, 22 nt, Homo sapiens
uaaucagggaggucauuuuggu

SEQ ID NO: 579895 - RNA, 22 nt, Homo sapiens
uaaucagguccucagagaauuu

SEQ ID NO: 579896 - RNA, 23 nt, Homo sapiens
uaaucaguucuuagauucagggg

SEQ ID NO: 579897 - RNA, 22 nt, Homo sapiens
uaaucaguuguuuaauaauuua

SEQ ID NO: 579898 - RNA, 15 nt, Homo sapiens
uaaucaucaaaaaga

SEQ ID NO: 579899 - RNA, 18 nt, Homo sapiens
uaaucaucuauaaagaag

SEQ ID NO: 579900 - RNA, 14 nt, Homo sapiens
uaaucaugcucaug

SEQ ID NO: 579901 - RNA, 20 nt, Homo sapiens
uaaucaugugggugagccag

SEQ ID NO: 579902 - RNA, 21 nt, Homo sapiens
uaaucauguuaccauuacaaa

SEQ ID NO: 579903 - RNA, 19 nt, Homo sapiens
uaaucauuuugaacaugug

SEQ ID NO: 579904 - RNA, 23 nt, Homo sapiens
uaauccacaucuuuacucaggca

SEQ ID NO: 579905 - RNA, 14 nt, Homo sapiens
uaaucccagcacuu

SEQ ID NO: 579906 - RNA, 20 nt, Homo sapiens
uaaucccagcuacuugggag

SEQ ID NO: 579907 - RNA, 15 nt, Homo sapiens
cuuucuuuccauuua

SEQ ID NO: 579908 - RNA, 20 nt, Homo sapiens
cuuugaaaacacuacacagg

SEQ ID NO: 579909 - RNA, 20 nt, Homo sapiens
cuuugaaaacugaaugucag

SEQ ID NO: 579910 - RNA, 17 nt, Homo sapiens
cuuugaacaugcugaaa

SEQ ID NO: 579911 - RNA, 17 nt, Homo sapiens
cuuugaagaccaguccu

SEQ ID NO: 579912 - RNA, 18 nt, Homo sapiens
cuuugaaucuaguuguua

SEQ ID NO: 579913 - RNA, 22 nt, Homo sapiens
cuuugacaauuacucagguuug

SEQ ID NO: 579914 - RNA, 23 nt, Homo sapiens
cuuugagaaggauaggccuucau

SEQ ID NO: 579915 - RNA, 22 nt, Homo sapiens
cuuugagauagaagaacugcaa

SEQ ID NO: 579916 - RNA, 17 nt, Homo sapiens
cuuugagcgagcccauu

SEQ ID NO: 579917 - RNA, 17 nt, Homo sapiens
cuuugaggaacauucaa

SEQ ID NO: 579918 - RNA, 24 nt, Homo sapiens
cuuugaggcucugucacugagcaa

SEQ ID NO: 579919 - RNA, 22 nt, Homo sapiens
cuuugauagauuucuacacuga

SEQ ID NO: 579920 - RNA, 17 nt, Homo sapiens
cuuugauauccaugcca

SEQ ID NO: 579921 - RNA, 14 nt, Homo sapiens
cuuugauaugacug

SEQ ID NO: 579922 - RNA, 20 nt, Homo sapiens
cuuugauccuucugagcucc

SEQ ID NO: 579923 - RNA, 18 nt, Homo sapiens
cuuugcacaggaugcugg

SEQ ID NO: 579924 - RNA, 17 nt, Homo sapiens
cuuugcaccaaagacau

SEQ ID NO: 579925 - RNA, 11 nt, Homo sapiens
cuuugcacuga

SEQ ID NO: 579926 - RNA, 11 nt, Homo sapiens
cuuugcaguau

SEQ ID NO: 579927 - RNA, 19 nt, Homo sapiens
cuuugcaguuggacucuca

SEQ ID NO: 579928 - RNA, 16 nt, Homo sapiens
cuuugcauauuauaaa

SEQ ID NO: 579929 - RNA, 15 nt, Homo sapiens
cuuugcaucucagua

SEQ ID NO: 579930 - RNA, 19 nt, Homo sapiens
cuuugcauguauuagcuca

SEQ ID NO: 579931 - RNA, 22 nt, Homo sapiens
cuuugccagagcgugcuuucaa

SEQ ID NO: 579932 - RNA, 22 nt, Homo sapiens
cuuugcccccgacggcugugac

SEQ ID NO: 579933 - RNA, 16 nt, Homo sapiens
cuuugcccccuugccc

SEQ ID NO: 579934 - RNA, 23 nt, Homo sapiens
cuuugccggaggaaaagcagcuc

SEQ ID NO: 579935 - RNA, 15 nt, Homo sapiens
cuuugccucccucag

SEQ ID NO: 579936 - RNA, 20 nt, Homo sapiens
cuuugccuucucuguucccu

SEQ ID NO: 579937 - RNA, 18 nt, Homo sapiens
cuuugccuuggcuuugcc

SEQ ID NO: 579938 - RNA, 15 nt, Homo sapiens
cuuugcgacuuguca

SEQ ID NO: 579939 - RNA, 18 nt, Homo sapiens
cuuugcuaacugugcucc

SEQ ID NO: 579940 - RNA, 22 nt, Homo sapiens
cuuugcuaaugcuaugcaaaaa

SEQ ID NO: 579941 - RNA, 18 nt, Homo sapiens
cuuugcucccugcaagaa

SEQ ID NO: 579942 - RNA, 20 nt, Homo sapiens
cuuugcugaaugucauuuua

SEQ ID NO: 579943 - RNA, 17 nt, Homo sapiens
cuuugcugcagucaucu

SEQ ID NO: 579944 - RNA, 20 nt, Homo sapiens
cuuuggaaacaggaccacaa

SEQ ID NO: 579945 - RNA, 14 nt, Homo sapiens
cuuuggaaagccau

SEQ ID NO: 579946 - RNA, 13 nt, Homo sapiens
cuuuggacacuca

SEQ ID NO: 579947 - RNA, 20 nt, Homo sapiens
cuuuggagcagcuucuggga

SEQ ID NO: 579948 - RNA, 17 nt, Homo sapiens
cuuuggauaauaggaau

SEQ ID NO: 579949 - RNA, 13 nt, Homo sapiens
cuuuggcauggga

SEQ ID NO: 579950 - RNA, 18 nt, Homo sapiens
cuuuggccccacuuugaa

SEQ ID NO: 579951 - RNA, 19 nt, Homo sapiens
cuuuggcuggaauuacaaa

SEQ ID NO: 579952 - RNA, 21 nt, Homo sapiens
cuuugggauugcuaugaauga

SEQ ID NO: 579953 - RNA, 23 nt, Homo sapiens
cuuuggggagcaggaggccaaua

SEQ ID NO: 579954 - RNA, 20 nt, Homo sapiens
cuuuggguccauucagauga

SEQ ID NO: 579955 - RNA, 21 nt, Homo sapiens
cuuuggguggcucacuacuga

SEQ ID NO: 579956 - RNA, 14 nt, Homo sapiens
cuuugguaaucucu

SEQ ID NO: 579957 - RNA, 16 nt, Homo sapiens
cuuugguaaucuucaa

SEQ ID NO: 579958 - RNA, 21 nt, Homo sapiens
cuuuguaagagcaaaagccuc

SEQ ID NO: 579959 - RNA, 19 nt, Homo sapiens
cuuuguagacuguuucaca

SEQ ID NO: 579960 - RNA, 21 nt, Homo sapiens
cuuuguauauaggcuucucac

SEQ ID NO: 579961 - RNA, 21 nt, Homo sapiens
uaaugguguagaacacuaauu

SEQ ID NO: 579962 - RNA, 22 nt, Homo sapiens
uaauguagagauaaaagcagua

SEQ ID NO: 579963 - RNA, 16 nt, Homo sapiens
uaauguauaauuugag

SEQ ID NO: 579964 - RNA, 21 nt, Homo sapiens
uaauguauaauuugaggugaa

SEQ ID NO: 579965 - RNA, 21 nt, Homo sapiens
uaauguauuuguuugcaauuu

SEQ ID NO: 579966 - RNA, 15 nt, Homo sapiens
uaaugucaccaccuu

SEQ ID NO: 579967 - RNA, 14 nt, Homo sapiens
uaaugucagugaca

SEQ ID NO: 579968 - RNA, 15 nt, Homo sapiens
uaauguguuugcaau

SEQ ID NO: 579969 - RNA, 13 nt, Homo sapiens
uaauguuacauua

SEQ ID NO: 579970 - RNA, 22 nt, Homo sapiens
uaauguuacugaucaugcauug

SEQ ID NO: 579971 - RNA, 20 nt, Homo sapiens
uaauguuauaucauauguau

SEQ ID NO: 579972 - RNA, 14 nt, Homo sapiens
uaauguuaugagga

SEQ ID NO: 579973 - RNA, 15 nt, Homo sapiens
uaauguuauucauuu

SEQ ID NO: 579974 - RNA, 12 nt, Homo sapiens
uaauguucacau

SEQ ID NO: 579975 - RNA, 14 nt, Homo sapiens
uaauguuccucaaa

SEQ ID NO: 579976 - RNA, 15 nt, Homo sapiens
uaauguucugugaua

SEQ ID NO: 579977 - RNA, 21 nt, Homo sapiens
uaauguugacuuuaauacucu

SEQ ID NO: 579978 - RNA, 22 nt, Homo sapiens
uaauguugcuuucuuaucccag

SEQ ID NO: 579979 - RNA, 14 nt, Homo sapiens
uaauguuggaugau

SEQ ID NO: 579980 - RNA, 19 nt, Homo sapiens
uaauguuuuauacuguuua

SEQ ID NO: 579981 - RNA, 22 nt, Homo sapiens
uaauuaaaaaaaaaacuucauu

SEQ ID NO: 579982 - RNA, 16 nt, Homo sapiens
uaauuaaaagacucca

SEQ ID NO: 579983 - RNA, 20 nt, Homo sapiens
uaauuaacuguaaacuugga

SEQ ID NO: 579984 - RNA, 12 nt, Homo sapiens
uaauuacauucc

SEQ ID NO: 579985 - RNA, 15 nt, Homo sapiens
uaauuagaccuaggc

SEQ ID NO: 579986 - RNA, 16 nt, Homo sapiens
uaauuaguaacaugug

SEQ ID NO: 579987 - RNA, 14 nt, Homo sapiens
uaauuaguuccuca

SEQ ID NO: 579988 - RNA, 17 nt, Homo sapiens
uaauuauacuacuuugu

SEQ ID NO: 579989 - RNA, 12 nt, Homo sapiens
uaauuauugcuu

SEQ ID NO: 579990 - RNA, 22 nt, Homo sapiens
uaauuauuguuauacacagcuu

SEQ ID NO: 579991 - RNA, 13 nt, Homo sapiens
uaauuauuuacuc

SEQ ID NO: 579992 - RNA, 16 nt, Homo sapiens
uaauuauuuugacaaa

SEQ ID NO: 579993 - RNA, 16 nt, Homo sapiens
uaauucacacaaagac

SEQ ID NO: 579994 - RNA, 14 nt, Homo sapiens
uaauucaccaaagu

SEQ ID NO: 579995 - RNA, 11 nt, Homo sapiens
uaauucauuaa

SEQ ID NO: 579996 - RNA, 18 nt, Homo sapiens
uaauucauugugauuuau

SEQ ID NO: 579997 - RNA, 19 nt, Homo sapiens
uaauucauugugauuuauu

SEQ ID NO: 579998 - RNA, 18 nt, Homo sapiens
uaauuccagucacaguuu

SEQ ID NO: 579999 - RNA, 13 nt, Homo sapiens
uaauuccuaugaa

SEQ ID NO: 580000 - RNA, 17 nt, Homo sapiens
uaauucuaagacuuuug

SEQ ID NO: 580001 - RNA, 15 nt, Homo sapiens
uaauucucuguggaa

SEQ ID NO: 580002 - RNA, 19 nt, Homo sapiens
uaauucucuguggaaugaa

SEQ ID NO: 580003 - RNA, 19 nt, Homo sapiens
uaauugaccuacuuuggua

SEQ ID NO: 580004 - RNA, 20 nt, Homo sapiens
uaauugagaucacauuucag

SEQ ID NO: 580005 - RNA, 19 nt, Homo sapiens
uaauugaucaaauucauuu

SEQ ID NO: 580006 - RNA, 20 nt, Homo sapiens
uaauugccuuugagguuauu

SEQ ID NO: 580007 - RNA, 18 nt, Homo sapiens
uaauugcuuugagcacaa

SEQ ID NO: 580008 - RNA, 23 nt, Homo sapiens
uaauugggcaggugaaaagggua

SEQ ID NO: 580009 - RNA, 18 nt, Homo sapiens
uaauugguuuaguucuua

SEQ ID NO: 580010 - RNA, 16 nt, Homo sapiens
uaauuguauugucaga

SEQ ID NO: 580011 - RNA, 15 nt, Homo sapiens
uaauuguguggauuc

SEQ ID NO: 580012 - RNA, 17 nt, Homo sapiens
uaauuguguugauucuu

SEQ ID NO: 580013 - RNA, 16 nt, Homo sapiens
uaauuuaaaagcacac

SEQ ID NO: 580014 - RNA, 16 nt, Homo sapiens
uaauuuauuuugucca

SEQ ID NO: 580015 - RNA, 17 nt, Homo sapiens
uaauuucaggaauugaa

SEQ ID NO: 580016 - RNA, 17 nt, Homo sapiens
uaauuuccucacugccu

SEQ ID NO: 580017 - RNA, 17 nt, Homo sapiens
uaauuucuuacuaaaca

SEQ ID NO: 580018 - RNA, 23 nt, Homo sapiens
uaauuugaaugugguuacuuccu

SEQ ID NO: 580019 - RNA, 18 nt, Homo sapiens
uaauuuguaaacuucuga

SEQ ID NO: 580020 - RNA, 14 nt, Homo sapiens
uaauuuguacaggg

SEQ ID NO: 580021 - RNA, 18 nt, Homo sapiens
uaauuuguacaggggcca

SEQ ID NO: 580022 - RNA, 15 nt, Homo sapiens
uaauuuguagacuua

SEQ ID NO: 580023 - RNA, 15 nt, Homo sapiens
uaauuuguaugcuaa

SEQ ID NO: 580024 - RNA, 17 nt, Homo sapiens
uaauuugugaauuugca

SEQ ID NO: 580025 - RNA, 17 nt, Homo sapiens
uaauuuuaaccaaucag

SEQ ID NO: 580026 - RNA, 14 nt, Homo sapiens
uaauuuuacacucu

SEQ ID NO: 580027 - RNA, 14 nt, Homo sapiens
uaauuuuacauguu

SEQ ID NO: 580028 - RNA, 21 nt, Homo sapiens
uaauuuugauauaaucuuuca

SEQ ID NO: 580029 - RNA, 13 nt, Homo sapiens
uaauuuugcuugc

SEQ ID NO: 580030 - RNA, 19 nt, Homo sapiens
uaauuuuggguggggagaa

SEQ ID NO: 580031 - RNA, 20 nt, Homo sapiens
cuuuuccuccaaccuguggc

SEQ ID NO: 580032 - RNA, 19 nt, Homo sapiens
cuuuuccugauaaagcaca

SEQ ID NO: 580033 - RNA, 16 nt, Homo sapiens
cuuuuccuuucugcca

SEQ ID NO: 580034 - RNA, 22 nt, Homo sapiens
cuuuucggccccauguaucuca

SEQ ID NO: 580035 - RNA, 19 nt, Homo sapiens
cuuuucucacaaaaaggca

SEQ ID NO: 580036 - RNA, 14 nt, Homo sapiens
cuuuucuccaugag

SEQ ID NO: 580037 - RNA, 17 nt, Homo sapiens
cuuuucucccacacaaa

SEQ ID NO: 580038 - RNA, 21 nt, Homo sapiens
cuuuucuccucacuguaucca

SEQ ID NO: 580039 - RNA, 22 nt, Homo sapiens
cuuuucuccucacuguauccag

SEQ ID NO: 580040 - RNA, 13 nt, Homo sapiens
cuuuucugaauua

SEQ ID NO: 580041 - RNA, 15 nt, Homo sapiens
cuuuucugugccaga

SEQ ID NO: 580042 - RNA, 16 nt, Homo sapiens
cuuuucugugccagac

SEQ ID NO: 580043 - RNA, 23 nt, Homo sapiens
cuuuucuuugaaggaugacuaca

SEQ ID NO: 580044 - RNA, 16 nt, Homo sapiens
cuuuugaacuugucac

SEQ ID NO: 580045 - RNA, 12 nt, Homo sapiens
cuuuugaagucc

SEQ ID NO: 580046 - RNA, 20 nt, Homo sapiens
cuuuugacacugcucuaaca

SEQ ID NO: 580047 - RNA, 13 nt, Homo sapiens
cuuuugaccaaau

SEQ ID NO: 580048 - RNA, 21 nt, Homo sapiens
cuuuugagcuauucaccucag

SEQ ID NO: 580049 - RNA, 20 nt, Homo sapiens
cuuuugaggggcugacuuca

SEQ ID NO: 580050 - RNA, 21 nt, Homo sapiens
cuuuugauccugggggaccaa

SEQ ID NO: 580051 - RNA, 23 nt, Homo sapiens
cuuuugaugccaggugcaaucua

SEQ ID NO: 580052 - RNA, 14 nt, Homo sapiens
cuuuugcaaacaau

SEQ ID NO: 580053 - RNA, 13 nt, Homo sapiens
cuuuugcaauaau

SEQ ID NO: 580054 - RNA, 22 nt, Homo sapiens
cuuuugcaggcucccaccuuua

SEQ ID NO: 580055 - RNA, 19 nt, Homo sapiens
cuuuugcaugucgcacaau

SEQ ID NO: 580056 - RNA, 22 nt, Homo sapiens
cuuuugccaguauuaugcauau

SEQ ID NO: 580057 - RNA, 19 nt, Homo sapiens
cuuuugcuaaugcaauuag

SEQ ID NO: 580058 - RNA, 16 nt, Homo sapiens
cuuuugcugaugcuuu

SEQ ID NO: 580059 - RNA, 20 nt, Homo sapiens
cuuuugcuucaguugcauau

SEQ ID NO: 580060 - RNA, 21 nt, Homo sapiens
cuuuuggaggaagauacauuu

SEQ ID NO: 580061 - RNA, 16 nt, Homo sapiens
cuuuuggauaugcuga

SEQ ID NO: 580062 - RNA, 18 nt, Homo sapiens
cuuuuggucccauccucu

SEQ ID NO: 580063 - RNA, 16 nt, Homo sapiens
cuuuuggucuucagcc

SEQ ID NO: 580064 - RNA, 20 nt, Homo sapiens
cuuuuguaaaaaugucccca

SEQ ID NO: 580065 - RNA, 13 nt, Homo sapiens
cuuuuguacugaa

SEQ ID NO: 580066 - RNA, 13 nt, Homo sapiens
cuuuuguguacag

SEQ ID NO: 580067 - RNA, 20 nt, Homo sapiens
cuuuugugugccugguagaa

SEQ ID NO: 580068 - RNA, 18 nt, Homo sapiens
cuuuuguguuccuaugga

SEQ ID NO: 580069 - RNA, 16 nt, Homo sapiens
cuuuuguucugagggg

SEQ ID NO: 580070 - RNA, 23 nt, Homo sapiens
cuuuuguuguacuuuauaucuug

SEQ ID NO: 580071 - RNA, 15 nt, Homo sapiens
cuuuuguuucuagaa

SEQ ID NO: 580072 - RNA, 17 nt, Homo sapiens
cuuuuuaaccauuccaa

SEQ ID NO: 580073 - RNA, 23 nt, Homo sapiens
cuuuuuaaccuuccaagacugaa

SEQ ID NO: 580074 - RNA, 21 nt, Homo sapiens
cuuuuuauuucucugugggcu

SEQ ID NO: 580075 - RNA, 13 nt, Homo sapiens
cuuuuuccacaag

SEQ ID NO: 580076 - RNA, 20 nt, Homo sapiens
cuuuuuccuggcucaucucu

SEQ ID NO: 580077 - RNA, 14 nt, Homo sapiens
cuuuuugacacuga

SEQ ID NO: 580078 - RNA, 15 nt, Homo sapiens
cuuuuugacacugaa

SEQ ID NO: 580079 - RNA, 15 nt, Homo sapiens
cuuuuugccuuacaa

SEQ ID NO: 580080 - RNA, 15 nt, Homo sapiens
cuuuuuggagagugc

SEQ ID NO: 580081 - RNA, 20 nt, Homo sapiens
cuuuuugggaccaucacuga

SEQ ID NO: 580082 - RNA, 16 nt, Homo sapiens
cuuuuuuaauuuccag

SEQ ID NO: 580083 - RNA, 16 nt, Homo sapiens
ggggagcacuugucca

SEQ ID NO: 580084 - RNA, 12 nt, Homo sapiens
ggggagguguau

SEQ ID NO: 580085 - RNA, 17 nt, Homo sapiens
ggggagugggcgcagug

SEQ ID NO: 580086 - RNA, 22 nt, Homo sapiens
ggggauuugaagaagaguuucu

SEQ ID NO: 580087 - RNA, 13 nt, Homo sapiens
ggggcagagccag

SEQ ID NO: 580088 - RNA, 17 nt, Homo sapiens
ggggcagggacuugccu

SEQ ID NO: 580089 - RNA, 16 nt, Homo sapiens
ggggcaggggugcuuc

SEQ ID NO: 580090 - RNA, 12 nt, Homo sapiens
ggggccacucca

SEQ ID NO: 580091 - RNA, 16 nt, Homo sapiens
ggggccauuugcaaua

SEQ ID NO: 580092 - RNA, 20 nt, Homo sapiens
ggggcccaagccccaucuca

SEQ ID NO: 580093 - RNA, 20 nt, Homo sapiens
ggggcccugcaccugugcag

SEQ ID NO: 580094 - RNA, 18 nt, Homo sapiens
ggggccgggcgcgguggc

SEQ ID NO: 580095 - RNA, 16 nt, Homo sapiens
ggggccuccucaguga

SEQ ID NO: 580096 - RNA, 17 nt, Homo sapiens
ggggcgaucgcggcgga

SEQ ID NO: 580097 - RNA, 15 nt, Homo sapiens
ggggcguucgcugcg

SEQ ID NO: 580098 - RNA, 14 nt, Homo sapiens
ggggcucccucucu

SEQ ID NO: 580099 - RNA, 16 nt, Homo sapiens
ggggcucucagcucag

SEQ ID NO: 580100 - RNA, 16 nt, Homo sapiens
ggggcucugugcaggg

SEQ ID NO: 580101 - RNA, 15 nt, Homo sapiens
ggggcugaggggcaa

SEQ ID NO: 580102 - RNA, 18 nt, Homo sapiens
ggggcuggccccaccccc

SEQ ID NO: 580103 - RNA, 18 nt, Homo sapiens
ggggcuuugggcccaaga

SEQ ID NO: 580104 - RNA, 13 nt, Homo sapiens
gggggaugccuuc

SEQ ID NO: 580105 - RNA, 20 nt, Homo sapiens
gggggcugcagcauguugcu

SEQ ID NO: 580106 - RNA, 17 nt, Homo sapiens
ggggguuuuuaaucuuu

SEQ ID NO: 580107 - RNA, 13 nt, Homo sapiens
gggguccaucccc

SEQ ID NO: 580108 - RNA, 14 nt, Homo sapiens
gggguccugacuca

SEQ ID NO: 580109 - RNA, 20 nt, Homo sapiens
ggggucgucaccaccucucc

SEQ ID NO: 580110 - RNA, 17 nt, Homo sapiens
ggggucuggacaugugg

SEQ ID NO: 580111 - RNA, 17 nt, Homo sapiens
ggggugaaucuugucua

SEQ ID NO: 580112 - RNA, 22 nt, Homo sapiens
gggguggaacugagugugcucu

SEQ ID NO: 580113 - RNA, 11 nt, Homo sapiens
gggguggagca

SEQ ID NO: 580114 - RNA, 13 nt, Homo sapiens
gggguggagcaug

SEQ ID NO: 580115 - RNA, 11 nt, Homo sapiens
gggguggcacc

SEQ ID NO: 580116 - RNA, 13 nt, Homo sapiens
gggguucuccccc

SEQ ID NO: 580117 - RNA, 13 nt, Homo sapiens
gggguugcugaag

SEQ ID NO: 580118 - RNA, 17 nt, Homo sapiens
ggguacagcgcggagga

SEQ ID NO: 580119 - RNA, 16 nt, Homo sapiens
ggguagacugagggau

SEQ ID NO: 580120 - RNA, 21 nt, Homo sapiens
ggguaguauuuuuuacauuuu

SEQ ID NO: 580121 - RNA, 20 nt, Homo sapiens
gggucaaagugguacaggaa

SEQ ID NO: 580122 - RNA, 14 nt, Homo sapiens
gggucaguaaggaa

SEQ ID NO: 580123 - RNA, 12 nt, Homo sapiens
ggguccaagugg

SEQ ID NO: 580124 - RNA, 14 nt, Homo sapiens
gggucccagggaag

SEQ ID NO: 580125 - RNA, 15 nt, Homo sapiens
gggucccuuaaagau

SEQ ID NO: 580126 - RNA, 16 nt, Homo sapiens
ggguccucagcugcuc

SEQ ID NO: 580127 - RNA, 14 nt, Homo sapiens
gggucgcugcauaa

SEQ ID NO: 580128 - RNA, 12 nt, Homo sapiens
gggucgucugcc

SEQ ID NO: 580129 - RNA, 13 nt, Homo sapiens
gggucgucugccc

SEQ ID NO: 580130 - RNA, 19 nt, Homo sapiens
gggucucacaguguugccc

SEQ ID NO: 580131 - RNA, 20 nt, Homo sapiens
gggucucacaguguugccca

SEQ ID NO: 580132 - RNA, 15 nt, Homo sapiens
gggucucacucucug

SEQ ID NO: 580133 - RNA, 21 nt, Homo sapiens
gggucucacucuguugcccag

SEQ ID NO: 580134 - RNA, 18 nt, Homo sapiens
gggucucgcagccugaag

SEQ ID NO: 580135 - RNA, 20 nt, Homo sapiens
gggucucuagugcugugaaa

SEQ ID NO: 580136 - RNA, 22 nt, Homo sapiens
gggucucucucccuaccucccu

SEQ ID NO: 580137 - RNA, 20 nt, Homo sapiens
gggucuugcuauauugccca

SEQ ID NO: 580138 - RNA, 16 nt, Homo sapiens
gggucuuugaacccuu

SEQ ID NO: 580139 - RNA, 18 nt, Homo sapiens
gggugacccugaagugag

SEQ ID NO: 580140 - RNA, 17 nt, Homo sapiens
gggugauggccagagga

SEQ ID NO: 580141 - RNA, 16 nt, Homo sapiens
gggugauuucagagag

SEQ ID NO: 580142 - RNA, 18 nt, Homo sapiens
gggugcaaagauguucau

SEQ ID NO: 580143 - RNA, 21 nt, Homo sapiens
gggugcagcugggcuuggccu

SEQ ID NO: 580144 - RNA, 14 nt, Homo sapiens
gggugcagcugggu

SEQ ID NO: 580145 - RNA, 21 nt, Homo sapiens
gggugcccuggcuccuugcag

SEQ ID NO: 580146 - RNA, 21 nt, Homo sapiens
ggguggccugcgcuagcuucu

SEQ ID NO: 580147 - RNA, 15 nt, Homo sapiens
gggugggacagggag

SEQ ID NO: 580148 - RNA, 12 nt, Homo sapiens
gggugggaccac

SEQ ID NO: 580149 - RNA, 19 nt, Homo sapiens
gggugggauccacacugag

SEQ ID NO: 580150 - RNA, 21 nt, Homo sapiens
ggguggggaagaagacacaga

SEQ ID NO: 580151 - RNA, 13 nt, Homo sapiens
ggguggguggugg

SEQ ID NO: 580152 - RNA, 19 nt, Homo sapiens
gggugguccgggaagugag

SEQ ID NO: 580153 - RNA, 22 nt, Homo sapiens
gggugucucccucgggggcucu

SEQ ID NO: 580154 - RNA, 17 nt, Homo sapiens
ggguucacuugggcucu

SEQ ID NO: 580155 - RNA, 20 nt, Homo sapiens
ggguugcuaggaaaagaaau

SEQ ID NO: 580156 - RNA, 15 nt, Homo sapiens
ggguuggacaucucu

SEQ ID NO: 580157 - RNA, 17 nt, Homo sapiens
ggguuggugcacaguga

SEQ ID NO: 580158 - RNA, 14 nt, Homo sapiens
ggguuguugucuca

SEQ ID NO: 580159 - RNA, 21 nt, Homo sapiens
ggguuuugcuuuagagugcaa

SEQ ID NO: 580160 - RNA, 22 nt, Homo sapiens
ggguuuuguggucaucuauucu

SEQ ID NO: 580161 - RNA, 13 nt, Homo sapiens
gguaaaacagggc

SEQ ID NO: 580162 - RNA, 16 nt, Homo sapiens
gguaaaacauuacuua

SEQ ID NO: 580163 - RNA, 17 nt, Homo sapiens
gguaaaacucacuguga

SEQ ID NO: 580164 - RNA, 15 nt, Homo sapiens
gguaaaaguuacuua

SEQ ID NO: 580165 - RNA, 12 nt, Homo sapiens
gguaaaguauca

SEQ ID NO: 580166 - RNA, 16 nt, Homo sapiens
gguaacaguggcugcu

SEQ ID NO: 580167 - RNA, 14 nt, Homo sapiens
gguaagaaguuuua

SEQ ID NO: 580168 - RNA, 14 nt, Homo sapiens
gguaagagcaaaag

SEQ ID NO: 580169 - RNA, 19 nt, Homo sapiens
gguaauaaguacuguguac

SEQ ID NO: 580170 - RNA, 16 nt, Homo sapiens
gguaauacaaacuaua

SEQ ID NO: 580171 - RNA, 15 nt, Homo sapiens
gguaaugugaauaaa

SEQ ID NO: 580172 - RNA, 21 nt, Homo sapiens
gguaauugccuaaaucuccag

SEQ ID NO: 580173 - RNA, 22 nt, Homo sapiens
gguacauaggcuucuauuaccu

SEQ ID NO: 580174 - RNA, 23 nt, Homo sapiens
gguacauucuagcugagaagcaa

SEQ ID NO: 580175 - RNA, 16 nt, Homo sapiens
gguacccagucaccuc

SEQ ID NO: 580176 - RNA, 21 nt, Homo sapiens
gguaccugguccccacugcug

SEQ ID NO: 580177 - RNA, 11 nt, Homo sapiens
gguacuuucau

SEQ ID NO: 580178 - RNA, 21 nt, Homo sapiens
gguagaaggggaggacacugg

SEQ ID NO: 580179 - RNA, 17 nt, Homo sapiens
gguagagucauguuugc

SEQ ID NO: 580180 - RNA, 13 nt, Homo sapiens
gguagcaacugaa

SEQ ID NO: 580181 - RNA, 18 nt, Homo sapiens
gguagcuauuuguuuaca

SEQ ID NO: 580182 - RNA, 19 nt, Homo sapiens
gguagcuggggcuacagga

SEQ ID NO: 580183 - RNA, 20 nt, Homo sapiens
gguaggcugucugugccaug

SEQ ID NO: 580184 - RNA, 22 nt, Homo sapiens
gguaguuuagaucccaugucac

SEQ ID NO: 580185 - RNA, 13 nt, Homo sapiens
gguauaaugauac

SEQ ID NO: 580186 - RNA, 18 nt, Homo sapiens
gguauauaaauuuuccca

SEQ ID NO: 580187 - RNA, 15 nt, Homo sapiens
gguauauccuugcga

SEQ ID NO: 580188 - RNA, 15 nt, Homo sapiens
gguaucuacuucuac

SEQ ID NO: 580189 - RNA, 14 nt, Homo sapiens
gguaucuccaggau

SEQ ID NO: 580190 - RNA, 14 nt, Homo sapiens
gguaugauauugca

SEQ ID NO: 580191 - RNA, 16 nt, Homo sapiens
gguaugucagugucac

SEQ ID NO: 580192 - RNA, 21 nt, Homo sapiens
gguaugucugccauguugccc

SEQ ID NO: 580193 - RNA, 22 nt, Homo sapiens
gguauguguggaugaugcugcc

SEQ ID NO: 580194 - RNA, 16 nt, Homo sapiens
gguauucugucauuua

SEQ ID NO: 580195 - RNA, 21 nt, Homo sapiens
gguauucuuaagggaacuucc

SEQ ID NO: 580196 - RNA, 23 nt, Homo sapiens
gguauuucaaaacacaucuuucc

SEQ ID NO: 580197 - RNA, 17 nt, Homo sapiens
ggucaaccuccuggaca

SEQ ID NO: 580198 - RNA, 12 nt, Homo sapiens
ggucacaugaug

SEQ ID NO: 580199 - RNA, 12 nt, Homo sapiens
ggucacccagga

SEQ ID NO: 580200 - RNA, 20 nt, Homo sapiens
ggucacucaggacagcccag

SEQ ID NO: 580201 - RNA, 14 nt, Homo sapiens
ggucagaacauguu

SEQ ID NO: 580202 - RNA, 22 nt, Homo sapiens
ggucagcugggagccagugugc

SEQ ID NO: 580203 - RNA, 20 nt, Homo sapiens
ggucagcuuuuguuguuuau

SEQ ID NO: 580204 - RNA, 15 nt, Homo sapiens
ggucaggcagggugc

SEQ ID NO: 580205 - RNA, 18 nt, Homo sapiens
ggucaggcagggugcagu

SEQ ID NO: 580206 - RNA, 17 nt, Homo sapiens
uacauauaucucugugu

SEQ ID NO: 580207 - RNA, 13 nt, Homo sapiens
uacauauaugcaa

SEQ ID NO: 580208 - RNA, 16 nt, Homo sapiens
uacauaucuuuauuaa

SEQ ID NO: 580209 - RNA, 15 nt, Homo sapiens
uacauaugaggacaa

SEQ ID NO: 580210 - RNA, 14 nt, Homo sapiens
uacauaugcuuuaa

SEQ ID NO: 580211 - RNA, 14 nt, Homo sapiens
uacauauguagaua

SEQ ID NO: 580212 - RNA, 13 nt, Homo sapiens
uacauaugugcug

SEQ ID NO: 580213 - RNA, 15 nt, Homo sapiens
uacauauuacuguug

SEQ ID NO: 580214 - RNA, 16 nt, Homo sapiens
uacauauuaucucauu

SEQ ID NO: 580215 - RNA, 20 nt, Homo sapiens
uacauauuccugguguagca

SEQ ID NO: 580216 - RNA, 13 nt, Homo sapiens
uacaucaaagagu

SEQ ID NO: 580217 - RNA, 18 nt, Homo sapiens
uacaucaaugguguguua

SEQ ID NO: 580218 - RNA, 13 nt, Homo sapiens
uacaucacuuugu

SEQ ID NO: 580219 - RNA, 16 nt, Homo sapiens
uacauccaaagcagac

SEQ ID NO: 580220 - RNA, 16 nt, Homo sapiens
uacaucccagccugug

SEQ ID NO: 580221 - RNA, 17 nt, Homo sapiens
uacaucucuacuaaaaa

SEQ ID NO: 580222 - RNA, 15 nt, Homo sapiens
uacaucugcaauaug

SEQ ID NO: 580223 - RNA, 23 nt, Homo sapiens
uacaucugcaauaugaauucaag

SEQ ID NO: 580224 - RNA, 15 nt, Homo sapiens
uacaucugcugugug

SEQ ID NO: 580225 - RNA, 18 nt, Homo sapiens
uacaucuuguaggaucua

SEQ ID NO: 580226 - RNA, 19 nt, Homo sapiens
uacaucuuuucuaaucaca

SEQ ID NO: 580227 - RNA, 21 nt, Homo sapiens
uacaucuuuuuuucuaugaaa

SEQ ID NO: 580228 - RNA, 19 nt, Homo sapiens
uacaugcagcccaugccca

SEQ ID NO: 580229 - RNA, 19 nt, Homo sapiens
uacaugcugugcucuuuga

SEQ ID NO: 580230 - RNA, 13 nt, Homo sapiens
uacauguaaucca

SEQ ID NO: 580231 - RNA, 16 nt, Homo sapiens
uacauguauugcacau

SEQ ID NO: 580232 - RNA, 21 nt, Homo sapiens
uacauguuuauaaaucuuaug

SEQ ID NO: 580233 - RNA, 14 nt, Homo sapiens
uacauuaaggagca

SEQ ID NO: 580234 - RNA, 16 nt, Homo sapiens
uacauucaaauuuguc

SEQ ID NO: 580235 - RNA, 16 nt, Homo sapiens
uacauucaacucugau

SEQ ID NO: 580236 - RNA, 20 nt, Homo sapiens
uacauucugcaagcacaucu

SEQ ID NO: 580237 - RNA, 16 nt, Homo sapiens
uacauucugcuuucau

SEQ ID NO: 580238 - RNA, 11 nt, Homo sapiens
uacauucuucc

SEQ ID NO: 580239 - RNA, 20 nt, Homo sapiens
uacauucuuuaucuugacau

SEQ ID NO: 580240 - RNA, 21 nt, Homo sapiens
uacauucuuuuuucuauucaa

SEQ ID NO: 580241 - RNA, 16 nt, Homo sapiens
uacauugagcauuuga

SEQ ID NO: 580242 - RNA, 17 nt, Homo sapiens
uacauuguauaggccau

SEQ ID NO: 580243 - RNA, 22 nt, Homo sapiens
uacauuguucuuauucuggcau

SEQ ID NO: 580244 - RNA, 21 nt, Homo sapiens
uacauuuaaaaauacuucucu

SEQ ID NO: 580245 - RNA, 17 nt, Homo sapiens
uacauuuaauaaaacug

SEQ ID NO: 580246 - RNA, 19 nt, Homo sapiens
uacauuuaauaauaucaaa

SEQ ID NO: 580247 - RNA, 15 nt, Homo sapiens
uacauuuaauacagc

SEQ ID NO: 580248 - RNA, 19 nt, Homo sapiens
uacauuuaauagacuuaca

SEQ ID NO: 580249 - RNA, 17 nt, Homo sapiens
uacauuucaccuacuuu

SEQ ID NO: 580250 - RNA, 14 nt, Homo sapiens
uacauuucauacaa

SEQ ID NO: 580251 - RNA, 13 nt, Homo sapiens
uacauuucauuaa

SEQ ID NO: 580252 - RNA, 15 nt, Homo sapiens
uacauuucuguucau

SEQ ID NO: 580253 - RNA, 18 nt, Homo sapiens
uacauuucuuagacuaca

SEQ ID NO: 580254 - RNA, 18 nt, Homo sapiens
uacauuugauuuguucau

SEQ ID NO: 580255 - RNA, 15 nt, Homo sapiens
uacauuuucagugag

SEQ ID NO: 580256 - RNA, 18 nt, Homo sapiens
uacauuuucguccuguag

SEQ ID NO: 580257 - RNA, 19 nt, Homo sapiens
uacauuuuuuaacuuucua

SEQ ID NO: 580258 - RNA, 23 nt, Homo sapiens
uacauuuuuugggcagcaauuua

SEQ ID NO: 580259 - RNA, 24 nt, Homo sapiens
uacauuuuuugggcagcaauuuaa

SEQ ID NO: 580260 - RNA, 22 nt, Homo sapiens
uacauuuuuuucuuugucuuau

SEQ ID NO: 580261 - RNA, 16 nt, Homo sapiens
uaccaaaaucauuucu

SEQ ID NO: 580262 - RNA, 14 nt, Homo sapiens
uaccaaacaaggaa

SEQ ID NO: 580263 - RNA, 18 nt, Homo sapiens
uaccaaaguaacugaauu

SEQ ID NO: 580264 - RNA, 21 nt, Homo sapiens
uaccaaaguguuuggucauuu

SEQ ID NO: 580265 - RNA, 23 nt, Homo sapiens
uaccaaaguguuuggucauuuua

SEQ ID NO: 580266 - RNA, 18 nt, Homo sapiens
uaccaaauagcaauacaa

SEQ ID NO: 580267 - RNA, 20 nt, Homo sapiens
uaccaaauccacaagccauu

SEQ ID NO: 580268 - RNA, 17 nt, Homo sapiens
uaccaaccugaagacac

SEQ ID NO: 580269 - RNA, 15 nt, Homo sapiens
uaccaagcagcucac

SEQ ID NO: 580270 - RNA, 22 nt, Homo sapiens
uaccaauaucuugccaguuuug

SEQ ID NO: 580271 - RNA, 13 nt, Homo sapiens
uaccaaucauuuu

SEQ ID NO: 580272 - RNA, 14 nt, Homo sapiens
uaccaaucauuuua

SEQ ID NO: 580273 - RNA, 17 nt, Homo sapiens
uaccacacauauugcac

SEQ ID NO: 580274 - RNA, 18 nt, Homo sapiens
uaccacacuagaauucau

SEQ ID NO: 580275 - RNA, 22 nt, Homo sapiens
uaccacacuagaauucauguga

SEQ ID NO: 580276 - RNA, 15 nt, Homo sapiens
uaccacagacuguac

SEQ ID NO: 580277 - RNA, 22 nt, Homo sapiens
uaccacagcucagccacuguga

SEQ ID NO: 580278 - RNA, 16 nt, Homo sapiens
uaccacaguguuuuau

SEQ ID NO: 580279 - RNA, 19 nt, Homo sapiens
uaccacaucugcucuaggg

SEQ ID NO: 580280 - RNA, 18 nt, Homo sapiens
gaaagccugggugacauu

SEQ ID NO: 580281 - RNA, 19 nt, Homo sapiens
gaaagccugggugacauuu

SEQ ID NO: 580282 - RNA, 15 nt, Homo sapiens
gaaagcucuaaagac

SEQ ID NO: 580283 - RNA, 17 nt, Homo sapiens
gaaagcugaaaagcaua

SEQ ID NO: 580284 - RNA, 22 nt, Homo sapiens
gaaagcuguggccagcuuguua

SEQ ID NO: 580285 - RNA, 18 nt, Homo sapiens
gaaagcuucaaacugcau

SEQ ID NO: 580286 - RNA, 23 nt, Homo sapiens
gaaagcuugagucucaagggugg

SEQ ID NO: 580287 - RNA, 19 nt, Homo sapiens
gaaagcuuuuauuccuuug

SEQ ID NO: 580288 - RNA, 23 nt, Homo sapiens
gaaaggaaaaccugaagacugag

SEQ ID NO: 580289 - RNA, 16 nt, Homo sapiens
gaaaggaacacgcggg

SEQ ID NO: 580290 - RNA, 17 nt, Homo sapiens
gaaaggacccugugagc

SEQ ID NO: 580291 - RNA, 21 nt, Homo sapiens
gaaaggagaacuauccaaaac

SEQ ID NO: 580292 - RNA, 11 nt, Homo sapiens
gaaaggccagu

SEQ ID NO: 580293 - RNA, 21 nt, Homo sapiens
gaaaggcuauuuucagaugaa

SEQ ID NO: 580294 - RNA, 23 nt, Homo sapiens
gaaaggcuguuaaauacaggaaa

SEQ ID NO: 580295 - RNA, 23 nt, Homo sapiens
gaaaggggccccaccggggucua

SEQ ID NO: 580296 - RNA, 14 nt, Homo sapiens
gaaaggucugagga

SEQ ID NO: 580297 - RNA, 20 nt, Homo sapiens
gaaaggugugcuagaacaag

SEQ ID NO: 580298 - RNA, 19 nt, Homo sapiens
gaaaguacacucugcuguu

SEQ ID NO: 580299 - RNA, 22 nt, Homo sapiens
gaaagucacggcugcgcacugu

SEQ ID NO: 580300 - RNA, 20 nt, Homo sapiens
gaaaguccaauuccaaagcc

SEQ ID NO: 580301 - RNA, 17 nt, Homo sapiens
gaaagugcguucuccca

SEQ ID NO: 580302 - RNA, 23 nt, Homo sapiens
gaaaguggccaugccacccuguu

SEQ ID NO: 580303 - RNA, 15 nt, Homo sapiens
gaaaguggugcuaua

SEQ ID NO: 580304 - RNA, 17 nt, Homo sapiens
gaaaguuucagauuugc

SEQ ID NO: 580305 - RNA, 18 nt, Homo sapiens
gaaauaaaacaacucuga

SEQ ID NO: 580306 - RNA, 16 nt, Homo sapiens
gaaauaaacuucacug

SEQ ID NO: 580307 - RNA, 23 nt, Homo sapiens
gaaauaaagagcuguuauacugu

SEQ ID NO: 580308 - RNA, 15 nt, Homo sapiens
gaaauaaauguaccu

SEQ ID NO: 580309 - RNA, 22 nt, Homo sapiens
gaaauaaauguaccugauguac

SEQ ID NO: 580310 - RNA, 14 nt, Homo sapiens
gaaauaacauugca

SEQ ID NO: 580311 - RNA, 19 nt, Homo sapiens
gaaauaacuaagagauucu

SEQ ID NO: 580312 - RNA, 15 nt, Homo sapiens
gaaauaccagugaac

SEQ ID NO: 580313 - RNA, 20 nt, Homo sapiens
gaaauaccagugaaccaaag

SEQ ID NO: 580314 - RNA, 13 nt, Homo sapiens
gaaauaccaguuc

SEQ ID NO: 580315 - RNA, 19 nt, Homo sapiens
gaaauaccaguucugggca

SEQ ID NO: 580316 - RNA, 20 nt, Homo sapiens
gaaauaccaguucugggcaa

SEQ ID NO: 580317 - RNA, 24 nt, Homo sapiens
gaaauacuccagcaccuguggcug

SEQ ID NO: 580318 - RNA, 14 nt, Homo sapiens
gaaauacuguacaa

SEQ ID NO: 580319 - RNA, 12 nt, Homo sapiens
gaaauacuuuug

SEQ ID NO: 580320 - RNA, 14 nt, Homo sapiens
gaaauagaagcaaa

SEQ ID NO: 580321 - RNA, 19 nt, Homo sapiens
gaaauagucggugaagaaa

SEQ ID NO: 580322 - RNA, 15 nt, Homo sapiens
gaaauagugacaagu

SEQ ID NO: 580323 - RNA, 13 nt, Homo sapiens
gaaauagugacau

SEQ ID NO: 580324 - RNA, 14 nt, Homo sapiens
gaaauauagccaaa

SEQ ID NO: 580325 - RNA, 23 nt, Homo sapiens
gaaauauaguaaacacuuggaaa

SEQ ID NO: 580326 - RNA, 17 nt, Homo sapiens
gaaauauauaauauuca

SEQ ID NO: 580327 - RNA, 13 nt, Homo sapiens
gaaccagccacga

SEQ ID NO: 580328 - RNA, 12 nt, Homo sapiens
gaaccagcccca

SEQ ID NO: 580329 - RNA, 19 nt, Homo sapiens
gaaccagugauccaugucc

SEQ ID NO: 580330 - RNA, 12 nt, Homo sapiens
gaaccauaucaa

SEQ ID NO: 580331 - RNA, 13 nt, Homo sapiens
gaaccauuuacuu

SEQ ID NO: 580332 - RNA, 15 nt, Homo sapiens
gaacccagaaggcag

SEQ ID NO: 580333 - RNA, 11 nt, Homo sapiens
gaacccaugag

SEQ ID NO: 580334 - RNA, 21 nt, Homo sapiens
gaacccccucccugucccagg

SEQ ID NO: 580335 - RNA, 20 nt, Homo sapiens
gaacccucaggucacaagag

SEQ ID NO: 580336 - RNA, 15 nt, Homo sapiens
gaacccucuugccau

SEQ ID NO: 580337 - RNA, 21 nt, Homo sapiens
gaacccugggaacaauuucca

SEQ ID NO: 580338 - RNA, 21 nt, Homo sapiens
gaacccugggccauccucaca

SEQ ID NO: 580339 - RNA, 22 nt, Homo sapiens
gaacccugggccauccucacau

SEQ ID NO: 580340 - RNA, 13 nt, Homo sapiens
gaacccugucccu

SEQ ID NO: 580341 - RNA, 13 nt, Homo sapiens
gaacccugugcug

SEQ ID NO: 580342 - RNA, 15 nt, Homo sapiens
gaacccuuguccucc

SEQ ID NO: 580343 - RNA, 22 nt, Homo sapiens
gaacccuuucgcuggcuuucca

SEQ ID NO: 580344 - RNA, 16 nt, Homo sapiens
gaaccgaacauaucau

SEQ ID NO: 580345 - RNA, 17 nt, Homo sapiens
gaaccgcacagcucagg

SEQ ID NO: 580346 - RNA, 13 nt, Homo sapiens
gaaccgugacauc

SEQ ID NO: 580347 - RNA, 13 nt, Homo sapiens
gaaccguuuugaa

SEQ ID NO: 580348 - RNA, 18 nt, Homo sapiens
gaaccuaggaggguguga

SEQ ID NO: 580349 - RNA, 15 nt, Homo sapiens
gaaccucacugaaaa

SEQ ID NO: 580350 - RNA, 21 nt, Homo sapiens
gaaccucuccaucaucuuccg

SEQ ID NO: 580351 - RNA, 11 nt, Homo sapiens
gaaccugacau

SEQ ID NO: 580352 - RNA, 22 nt, Homo sapiens
gaaccuuaaugacaacacuuaa

SEQ ID NO: 580353 - RNA, 21 nt, Homo sapiens
gaaccuucuggccucccacag

SEQ ID NO: 580354 - RNA, 17 nt, Homo sapiens
gaaccuugagcaaauua

SEQ ID NO: 580355 - RNA, 13 nt, Homo sapiens
gaacgcucuuagc

SEQ ID NO: 580356 - RNA, 13 nt, Homo sapiens
gaacggggagaaa

SEQ ID NO: 580357 - RNA, 22 nt, Homo sapiens
gaacgugugugcgcgugcuggu

SEQ ID NO: 580358 - RNA, 14 nt, Homo sapiens
gaacuaaagcaaau

SEQ ID NO: 580359 - RNA, 13 nt, Homo sapiens
gaacuaacaugca

SEQ ID NO: 580360 - RNA, 17 nt, Homo sapiens
gaacuaacuuacugucc

SEQ ID NO: 580361 - RNA, 16 nt, Homo sapiens
gaacuacagcucuuaa

SEQ ID NO: 580362 - RNA, 14 nt, Homo sapiens
gaacuaccaggugg

SEQ ID NO: 580363 - RNA, 15 nt, Homo sapiens
gaacuacgggcugcu

SEQ ID NO: 580364 - RNA, 13 nt, Homo sapiens
gaacuacuuugaa

SEQ ID NO: 580365 - RNA, 15 nt, Homo sapiens
gaacuagagaaggac

SEQ ID NO: 580366 - RNA, 12 nt, Homo sapiens
gaacuaggcucu

SEQ ID NO: 580367 - RNA, 14 nt, Homo sapiens
gaacuagugaugua

SEQ ID NO: 580368 - RNA, 19 nt, Homo sapiens
gaacuauacccgggaccaa

SEQ ID NO: 580369 - RNA, 14 nt, Homo sapiens
gaacuauaugugaa

SEQ ID NO: 580370 - RNA, 21 nt, Homo sapiens
gaacucaaggaaaucuguguc

SEQ ID NO: 580371 - RNA, 13 nt, Homo sapiens
gaacucacugcga

SEQ ID NO: 580372 - RNA, 14 nt, Homo sapiens
gaacuccugaccuu

SEQ ID NO: 580373 - RNA, 21 nt, Homo sapiens
gaacuccuggccucaagggau

SEQ ID NO: 580374 - RNA, 11 nt, Homo sapiens
gaacucuccau

SEQ ID NO: 580375 - RNA, 13 nt, Homo sapiens
gaacucuggucuc

SEQ ID NO: 580376 - RNA, 14 nt, Homo sapiens
gaacucugguggca

SEQ ID NO: 580377 - RNA, 16 nt, Homo sapiens
gaacucuuaggcacau

SEQ ID NO: 580378 - RNA, 16 nt, Homo sapiens
gaacugaacauuccag

SEQ ID NO: 580379 - RNA, 16 nt, Homo sapiens
gaacugaagaccucca

SEQ ID NO: 580380 - RNA, 17 nt, Homo sapiens
gaacugaaucacuuaaa

SEQ ID NO: 580381 - RNA, 23 nt, Homo sapiens
gaacugaggccuugugugucagg

SEQ ID NO: 580382 - RNA, 14 nt, Homo sapiens
gaacugagggcucu

SEQ ID NO: 580383 - RNA, 17 nt, Homo sapiens
gaacugagugugcucuu

SEQ ID NO: 580384 - RNA, 22 nt, Homo sapiens
gaacugaucauguuuaugagaa

SEQ ID NO: 580385 - RNA, 14 nt, Homo sapiens
gaacugcacuuuuu

SEQ ID NO: 580386 - RNA, 16 nt, Homo sapiens
gaacugcagucagcau

SEQ ID NO: 580387 - RNA, 24 nt, Homo sapiens
gaacugcguuaugaagagcuaauu

SEQ ID NO: 580388 - RNA, 23 nt, Homo sapiens
gaacugcuuuuccucaagcaaua

SEQ ID NO: 580389 - RNA, 22 nt, Homo sapiens
gaacugggagcagcucugugac

SEQ ID NO: 580390 - RNA, 19 nt, Homo sapiens
gaacuguccacaucugccu

SEQ ID NO: 580391 - RNA, 20 nt, Homo sapiens
gaacuguccacaucugccuc

SEQ ID NO: 580392 - RNA, 15 nt, Homo sapiens
gaacuguccagagag

SEQ ID NO: 580393 - RNA, 13 nt, Homo sapiens
gaacugucuguga

SEQ ID NO: 580394 - RNA, 17 nt, Homo sapiens
gaacuguguacgccauu

SEQ ID NO: 580395 - RNA, 13 nt, Homo sapiens
gaacuuacuguag

SEQ ID NO: 580396 - RNA, 22 nt, Homo sapiens
gaacuugagcgugaaucuguau

SEQ ID NO: 580397 - RNA, 22 nt, Homo sapiens
gaacuugccuuaaacacucacc

SEQ ID NO: 580398 - RNA, 20 nt, Homo sapiens
gaacuugcugcugagugcac

SEQ ID NO: 580399 - RNA, 15 nt, Homo sapiens
gaacuuggcacacuc

SEQ ID NO: 580400 - RNA, 14 nt, Homo sapiens
gaacuuuagugaaa

SEQ ID NO: 580401 - RNA, 15 nt, Homo sapiens
gaacuuucacauagc

SEQ ID NO: 580402 - RNA, 12 nt, Homo sapiens
gaacuuucuccc

SEQ ID NO: 580403 - RNA, 17 nt, Homo sapiens
gaacuuuuaaugaacuu

SEQ ID NO: 580404 - RNA, 20 nt, Homo sapiens
gaagaaaagaaaaaacaacu

SEQ ID NO: 580405 - RNA, 18 nt, Homo sapiens
gaagaaaagcaugcauau

SEQ ID NO: 580406 - RNA, 12 nt, Homo sapiens
uacucaaauggu

SEQ ID NO: 580407 - RNA, 13 nt, Homo sapiens
uacucaacauuau

SEQ ID NO: 580408 - RNA, 14 nt, Homo sapiens
uacucaacauuauu

SEQ ID NO: 580409 - RNA, 13 nt, Homo sapiens
uacucaacccauu

SEQ ID NO: 580410 - RNA, 20 nt, Homo sapiens
uacucaacccauuguuguca

SEQ ID NO: 580411 - RNA, 20 nt, Homo sapiens
uacucaaguguuaaauuauu

SEQ ID NO: 580412 - RNA, 13 nt, Homo sapiens
uacucaaguuuca

SEQ ID NO: 580413 - RNA, 15 nt, Homo sapiens
uacucacaccuguaa

SEQ ID NO: 580414 - RNA, 18 nt, Homo sapiens
uacucagugacuguugua

SEQ ID NO: 580415 - RNA, 13 nt, Homo sapiens
uacucagugcuaa

SEQ ID NO: 580416 - RNA, 17 nt, Homo sapiens
uacucagugcuaaacau

SEQ ID NO: 580417 - RNA, 20 nt, Homo sapiens
uacucaucgggcccagggac

SEQ ID NO: 580418 - RNA, 13 nt, Homo sapiens
uacucaugaucuu

SEQ ID NO: 580419 - RNA, 14 nt, Homo sapiens
uacuccagccuggg

SEQ ID NO: 580420 - RNA, 22 nt, Homo sapiens
uacuccaguauaugcugaugga

SEQ ID NO: 580421 - RNA, 20 nt, Homo sapiens
uacuccccauuguucuggaa

SEQ ID NO: 580422 - RNA, 15 nt, Homo sapiens
uacucccucuucacu

SEQ ID NO: 580423 - RNA, 13 nt, Homo sapiens
uacuccucugcag

SEQ ID NO: 580424 - RNA, 18 nt, Homo sapiens
uacucuaaaauggacauu

SEQ ID NO: 580425 - RNA, 19 nt, Homo sapiens
uacucuaaaauggacauuu

SEQ ID NO: 580426 - RNA, 12 nt, Homo sapiens
uacucucuugcc

SEQ ID NO: 580427 - RNA, 16 nt, Homo sapiens
uacucugcccucuaga

SEQ ID NO: 580428 - RNA, 19 nt, Homo sapiens
uacucuggcaaaugaugau

SEQ ID NO: 580429 - RNA, 23 nt, Homo sapiens
uacugaacaaucaaagcacuugg

SEQ ID NO: 580430 - RNA, 22 nt, Homo sapiens
uacugaacaugggagcucuuga

SEQ ID NO: 580431 - RNA, 20 nt, Homo sapiens
uacugaaucugcuaccaaaa

SEQ ID NO: 580432 - RNA, 19 nt, Homo sapiens
uacugacggaguccugugu

SEQ ID NO: 580433 - RNA, 22 nt, Homo sapiens
uacugacuuucugauuacuguc

SEQ ID NO: 580434 - RNA, 20 nt, Homo sapiens
uacugaggaaauauuuccau

SEQ ID NO: 580435 - RNA, 13 nt, Homo sapiens
uacugauacuaca

SEQ ID NO: 580436 - RNA, 13 nt, Homo sapiens
uacugaugcauug

SEQ ID NO: 580437 - RNA, 15 nt, Homo sapiens
uacugauucacugca

SEQ ID NO: 580438 - RNA, 20 nt, Homo sapiens
uacugcaagaaggagcucag

SEQ ID NO: 580439 - RNA, 12 nt, Homo sapiens
uacugcacugag

SEQ ID NO: 580440 - RNA, 16 nt, Homo sapiens
uacugcagcaccucca

SEQ ID NO: 580441 - RNA, 23 nt, Homo sapiens
uacugcagcuuuguuuguuguca

SEQ ID NO: 580442 - RNA, 23 nt, Homo sapiens
uacugccaagggcaggaccaaug

SEQ ID NO: 580443 - RNA, 16 nt, Homo sapiens
uacugcccacuuguca

SEQ ID NO: 580444 - RNA, 13 nt, Homo sapiens
uacugccuagaaa

SEQ ID NO: 580445 - RNA, 14 nt, Homo sapiens
uacugcucugagaa

SEQ ID NO: 580446 - RNA, 13 nt, Homo sapiens
uacugcugagguc

SEQ ID NO: 580447 - RNA, 19 nt, Homo sapiens
uacugcugcacuuucacua

SEQ ID NO: 580448 - RNA, 16 nt, Homo sapiens
uacugcugucuuccaa

SEQ ID NO: 580449 - RNA, 12 nt, Homo sapiens
uacugcuucauu

SEQ ID NO: 580450 - RNA, 16 nt, Homo sapiens
cuagcaacaaacaaua

SEQ ID NO: 580451 - RNA, 16 nt, Homo sapiens
cuagcaccaggacuca

SEQ ID NO: 580452 - RNA, 22 nt, Homo sapiens
cuagcacggccaccucucaggg

SEQ ID NO: 580453 - RNA, 16 nt, Homo sapiens
cuagcacuuggagcca

SEQ ID NO: 580454 - RNA, 16 nt, Homo sapiens
cuagcaggaauauuuc

SEQ ID NO: 580455 - RNA, 14 nt, Homo sapiens
cuagcaguaaauac

SEQ ID NO: 580456 - RNA, 14 nt, Homo sapiens
cuagcaucccugag

SEQ ID NO: 580457 - RNA, 15 nt, Homo sapiens
cuagcauuacauuau

SEQ ID NO: 580458 - RNA, 23 nt, Homo sapiens
cuagcauuguaaaauuauuucau

SEQ ID NO: 580459 - RNA, 22 nt, Homo sapiens
cuagcauuucccaacacaaaga

SEQ ID NO: 580460 - RNA, 22 nt, Homo sapiens
cuagcauuuucuugaaccaaua

SEQ ID NO: 580461 - RNA, 13 nt, Homo sapiens
cuagccagaguuu

SEQ ID NO: 580462 - RNA, 14 nt, Homo sapiens
cuagccagcuguca

SEQ ID NO: 580463 - RNA, 20 nt, Homo sapiens
cuagccaggaaguacuucca

SEQ ID NO: 580464 - RNA, 14 nt, Homo sapiens
cuagcccugggaca

SEQ ID NO: 580465 - RNA, 17 nt, Homo sapiens
cuagcccugggacauca

SEQ ID NO: 580466 - RNA, 19 nt, Homo sapiens
cuagccuggcuauguccua

SEQ ID NO: 580467 - RNA, 20 nt, Homo sapiens
cuagcugagcuuuaaaucau

SEQ ID NO: 580468 - RNA, 14 nt, Homo sapiens
cuagcugucccaug

SEQ ID NO: 580469 - RNA, 14 nt, Homo sapiens
cuagcugugggggu

SEQ ID NO: 580470 - RNA, 13 nt, Homo sapiens
cuagcugugucag

SEQ ID NO: 580471 - RNA, 23 nt, Homo sapiens
cuagcuuacugaguuaucaggug

SEQ ID NO: 580472 - RNA, 14 nt, Homo sapiens
cuagcuuagcuguc

SEQ ID NO: 580473 - RNA, 13 nt, Homo sapiens
cuagcuugaacuu

SEQ ID NO: 580474 - RNA, 19 nt, Homo sapiens
cuaggaaaaucacuugcca

SEQ ID NO: 580475 - RNA, 21 nt, Homo sapiens
cuaggaaacucacacuccccu

SEQ ID NO: 580476 - RNA, 18 nt, Homo sapiens
cuaggaagacauuuuucc

SEQ ID NO: 580477 - RNA, 18 nt, Homo sapiens
cuaggaagagcaggacuc

SEQ ID NO: 580478 - RNA, 15 nt, Homo sapiens
cuaggagaccaaggc

SEQ ID NO: 580479 - RNA, 18 nt, Homo sapiens
cuaggaguugaguacagu

SEQ ID NO: 580480 - RNA, 15 nt, Homo sapiens
cuaggaugugaugau

SEQ ID NO: 580481 - RNA, 19 nt, Homo sapiens
cuaggccuacaugcuuugu

SEQ ID NO: 580482 - RNA, 14 nt, Homo sapiens
cuaggcugagcaau

SEQ ID NO: 580483 - RNA, 22 nt, Homo sapiens
cuagggacaugaaauuuacaaa

SEQ ID NO: 580484 - RNA, 16 nt, Homo sapiens
cuagggagccauuuga

SEQ ID NO: 580485 - RNA, 18 nt, Homo sapiens
cuagggcacuuuaaguca

SEQ ID NO: 580486 - RNA, 20 nt, Homo sapiens
cuagggcacuuuaagucagu

SEQ ID NO: 580487 - RNA, 19 nt, Homo sapiens
cuagggcuaguagaacugg

SEQ ID NO: 580488 - RNA, 18 nt, Homo sapiens
cuaggggucaggcuccau

SEQ ID NO: 580489 - RNA, 19 nt, Homo sapiens
cuaggguccaccaggaguu

SEQ ID NO: 580490 - RNA, 22 nt, Homo sapiens
cuagguagugaccuaaccacuu

SEQ ID NO: 580491 - RNA, 20 nt, Homo sapiens
cuagguggagguugugcaug

SEQ ID NO: 580492 - RNA, 12 nt, Homo sapiens
cuagguguuguc

SEQ ID NO: 580493 - RNA, 23 nt, Homo sapiens
cuagguucuaaaaauugugauca

SEQ ID NO: 580494 - RNA, 17 nt, Homo sapiens
cuaguaagaugcacuga

SEQ ID NO: 580495 - RNA, 18 nt, Homo sapiens
cuaguaagaugcacugaa

SEQ ID NO: 580496 - RNA, 19 nt, Homo sapiens
cuaguaagaugcacugaaa

SEQ ID NO: 580497 - RNA, 11 nt, Homo sapiens
cuaguaaugcu

SEQ ID NO: 580498 - RNA, 23 nt, Homo sapiens
cuaguaauugccuagaaauaucu

SEQ ID NO: 580499 - RNA, 19 nt, Homo sapiens
cuaguagcugggauuacag

SEQ ID NO: 580500 - RNA, 17 nt, Homo sapiens
cuaguauaucagugaca

SEQ ID NO: 580501 - RNA, 20 nt, Homo sapiens
cuaguaucuucaaacuuuca

SEQ ID NO: 580502 - RNA, 16 nt, Homo sapiens
cuaguaugggguggga

SEQ ID NO: 580503 - RNA, 21 nt, Homo sapiens
cuaguauuucaugcugggaau

SEQ ID NO: 580504 - RNA, 14 nt, Homo sapiens
cuagucaagcuccu

SEQ ID NO: 580505 - RNA, 15 nt, Homo sapiens
cuagucaccagagac

SEQ ID NO: 580506 - RNA, 18 nt, Homo sapiens
cuagucacgcaugcagug

SEQ ID NO: 580507 - RNA, 21 nt, Homo sapiens
cuaguccuuggcuggacugua

SEQ ID NO: 580508 - RNA, 15 nt, Homo sapiens
cuagucugcuagcca

SEQ ID NO: 580509 - RNA, 14 nt, Homo sapiens
cuagucuguaacuc

SEQ ID NO: 580510 - RNA, 18 nt, Homo sapiens
cuagucuucccuuaccuc

SEQ ID NO: 580511 - RNA, 17 nt, Homo sapiens
cuagugccagagcuugc

SEQ ID NO: 580512 - RNA, 19 nt, Homo sapiens
cuagugcuuuucagugaua

SEQ ID NO: 580513 - RNA, 17 nt, Homo sapiens
cuaguggcucucaguua

SEQ ID NO: 580514 - RNA, 13 nt, Homo sapiens
cuagugggaguua

SEQ ID NO: 580515 - RNA, 21 nt, Homo sapiens
cuagugguaaaacauccaaga

SEQ ID NO: 580516 - RNA, 18 nt, Homo sapiens
cuaguguaccuccucuca

SEQ ID NO: 580517 - RNA, 16 nt, Homo sapiens
cuagugucuuuugccu

SEQ ID NO: 580518 - RNA, 22 nt, Homo sapiens
cuagugugaguggcagccaugc

SEQ ID NO: 580519 - RNA, 23 nt, Homo sapiens
cuaguuaaucauagguuugauau

SEQ ID NO: 580520 - RNA, 13 nt, Homo sapiens
cuaguuaauguca

SEQ ID NO: 580521 - RNA, 18 nt, Homo sapiens
cuaguuaucagauccuuu

SEQ ID NO: 580522 - RNA, 20 nt, Homo sapiens
cuaguucagacacuuuggaa

SEQ ID NO: 580523 - RNA, 12 nt, Homo sapiens
cuaguucagcug

SEQ ID NO: 580524 - RNA, 21 nt, Homo sapiens
cuaguucuccccgauggggca

SEQ ID NO: 580525 - RNA, 21 nt, Homo sapiens
cuaguuucacguaaauauuca

SEQ ID NO: 580526 - RNA, 11 nt, Homo sapiens
cuaguuugcaa

SEQ ID NO: 580527 - RNA, 12 nt, Homo sapiens
cuaguuugcacu

SEQ ID NO: 580528 - RNA, 21 nt, Homo sapiens
cuaguuugcacuauaugauca

SEQ ID NO: 580529 - RNA, 14 nt, Homo sapiens
cuaguuuucaauca

SEQ ID NO: 580530 - RNA, 16 nt, Homo sapiens
cuauaaaaaauaugua

SEQ ID NO: 580531 - RNA, 15 nt, Homo sapiens
cuauaaaagcuuucu

SEQ ID NO: 580532 - RNA, 19 nt, Homo sapiens
cuauaaaagcuuucugcca

SEQ ID NO: 580533 - RNA, 16 nt, Homo sapiens
cuauaaagaagaacuu

SEQ ID NO: 580534 - RNA, 22 nt, Homo sapiens
cuauaaagaagaacuugcaugg

SEQ ID NO: 580535 - RNA, 14 nt, Homo sapiens
cuauaacuaagcau

SEQ ID NO: 580536 - RNA, 20 nt, Homo sapiens
cuauaagaauaaggcuuuuu

SEQ ID NO: 580537 - RNA, 20 nt, Homo sapiens
cuauaagcaaauugcuuuuu

SEQ ID NO: 580538 - RNA, 15 nt, Homo sapiens
cuauaauacuugcaa

SEQ ID NO: 580539 - RNA, 13 nt, Homo sapiens
cuauaaucuguca

SEQ ID NO: 580540 - RNA, 17 nt, Homo sapiens
cuauaaugaucuaagaa

SEQ ID NO: 580541 - RNA, 21 nt, Homo sapiens
cuauaauuuaccuaagauuac

SEQ ID NO: 580542 - RNA, 18 nt, Homo sapiens
cuauacaaaaugauuuug

SEQ ID NO: 580543 - RNA, 23 nt, Homo sapiens
cuauacaaacuacagaguuuaug

SEQ ID NO: 580544 - RNA, 15 nt, Homo sapiens
cuauacacacacaca

SEQ ID NO: 580545 - RNA, 14 nt, Homo sapiens
cuauacacuagaca

SEQ ID NO: 580546 - RNA, 16 nt, Homo sapiens
cuauaccuuacugaca

SEQ ID NO: 580547 - RNA, 14 nt, Homo sapiens
cuauacuacauuau

SEQ ID NO: 580548 - RNA, 19 nt, Homo sapiens
cuauacuuaaucuaagaaa

SEQ ID NO: 580549 - RNA, 19 nt, Homo sapiens
cuauagcauagauugucaa

SEQ ID NO: 580550 - RNA, 20 nt, Homo sapiens
cuauagcuaaguacacaaua

SEQ ID NO: 580551 - RNA, 17 nt, Homo sapiens
cuauaggaacauaugaa

SEQ ID NO: 580552 - RNA, 20 nt, Homo sapiens
cuauaggugacaaacaucuc

SEQ ID NO: 580553 - RNA, 14 nt, Homo sapiens
cuauaguauuugau

SEQ ID NO: 580554 - RNA, 12 nt, Homo sapiens
cuauagucccag

SEQ ID NO: 580555 - RNA, 17 nt, Homo sapiens
cuauaguguaauaaugu

SEQ ID NO: 580556 - RNA, 16 nt, Homo sapiens
cuauauaaauauguca

SEQ ID NO: 580557 - RNA, 14 nt, Homo sapiens
cuauauaagacaag

SEQ ID NO: 580558 - RNA, 15 nt, Homo sapiens
cuauauaccaaagca

SEQ ID NO: 580559 - RNA, 18 nt, Homo sapiens
cuauauacuauaugauuc

SEQ ID NO: 580560 - RNA, 23 nt, Homo sapiens
cuauauaguuuauugacaauaau

SEQ ID NO: 580561 - RNA, 13 nt, Homo sapiens
ggccugagcaaca

SEQ ID NO: 580562 - RNA, 15 nt, Homo sapiens
ggccugcacuggugu

SEQ ID NO: 580563 - RNA, 19 nt, Homo sapiens
ggccugccuucuucuugug

SEQ ID NO: 580564 - RNA, 16 nt, Homo sapiens
ggccuggcccaaagca

SEQ ID NO: 580565 - RNA, 17 nt, Homo sapiens
ggccuggguuuguacuu

SEQ ID NO: 580566 - RNA, 14 nt, Homo sapiens
ggccugguagcaca

SEQ ID NO: 580567 - RNA, 17 nt, Homo sapiens
ggccuggucguuuucaa

SEQ ID NO: 580568 - RNA, 18 nt, Homo sapiens
ggccuguacggacacugu

SEQ ID NO: 580569 - RNA, 22 nt, Homo sapiens
ggccuguccaccugugcugcug

SEQ ID NO: 580570 - RNA, 16 nt, Homo sapiens
ggccugucgugccagu

SEQ ID NO: 580571 - RNA, 21 nt, Homo sapiens
ggccuguugaagaugcuugua

SEQ ID NO: 580572 - RNA, 19 nt, Homo sapiens
ggccuuccucucuccagau

SEQ ID NO: 580573 - RNA, 12 nt, Homo sapiens
ggccuucucacc

SEQ ID NO: 580574 - RNA, 20 nt, Homo sapiens
ggccuucugguuuuaggaaa

SEQ ID NO: 580575 - RNA, 18 nt, Homo sapiens
ggccuugcggaagccaua

SEQ ID NO: 580576 - RNA, 21 nt, Homo sapiens
ggccuugggaaggaaggcagu

SEQ ID NO: 580577 - RNA, 21 nt, Homo sapiens
ggccuugguggagcagccaga

SEQ ID NO: 580578 - RNA, 19 nt, Homo sapiens
ggccuuguccucagccagu

SEQ ID NO: 580579 - RNA, 12 nt, Homo sapiens
ggccuuuccuug

SEQ ID NO: 580580 - RNA, 22 nt, Homo sapiens
ggcgaacccugggccauccuca

SEQ ID NO: 580581 - RNA, 20 nt, Homo sapiens
ggcgacaguuuuccuucuca

SEQ ID NO: 580582 - RNA, 15 nt, Homo sapiens
ggcgacuccaucucu

SEQ ID NO: 580583 - RNA, 16 nt, Homo sapiens
ggcgcccugcaccuga

SEQ ID NO: 580584 - RNA, 20 nt, Homo sapiens
ggcgccgcaaaccacacugg

SEQ ID NO: 580585 - RNA, 22 nt, Homo sapiens
ggcgcguuugugcauaucugcc

SEQ ID NO: 580586 - RNA, 15 nt, Homo sapiens
ggcgcugagacugug

SEQ ID NO: 580587 - RNA, 20 nt, Homo sapiens
ggcggacggcucugaccuga

SEQ ID NO: 580588 - RNA, 16 nt, Homo sapiens
ggcggagguugcagua

SEQ ID NO: 580589 - RNA, 14 nt, Homo sapiens
ggcggaucaccuga

SEQ ID NO: 580590 - RNA, 16 nt, Homo sapiens
ggcggcccacacccag

SEQ ID NO: 580591 - RNA, 16 nt, Homo sapiens
ggcggcugugcaucag

SEQ ID NO: 580592 - RNA, 14 nt, Homo sapiens
ggcgggcauggcgu

SEQ ID NO: 580593 - RNA, 20 nt, Homo sapiens
ggcggguggaucacgagguc

SEQ ID NO: 580594 - RNA, 23 nt, Homo sapiens
ggcguagacuugacaacauccca

SEQ ID NO: 580595 - RNA, 14 nt, Homo sapiens
ggcgucccuaccuc

SEQ ID NO: 580596 - RNA, 23 nt, Homo sapiens
ggcgucugcugucucaucacaua

SEQ ID NO: 580597 - RNA, 17 nt, Homo sapiens
ggcgugagacccagugc

SEQ ID NO: 580598 - RNA, 13 nt, Homo sapiens
ggcgugggcgcuu

SEQ ID NO: 580599 - RNA, 13 nt, Homo sapiens
ggcuaaacucaag

SEQ ID NO: 580600 - RNA, 22 nt, Homo sapiens
ggcuaaaugcaccaagaaagcu

SEQ ID NO: 580601 - RNA, 14 nt, Homo sapiens
ggcuaacaucccac

SEQ ID NO: 580602 - RNA, 21 nt, Homo sapiens
ggcuaacuauauuugcuuuuu

SEQ ID NO: 580603 - RNA, 16 nt, Homo sapiens
ggcuaagucaagauca

SEQ ID NO: 580604 - RNA, 16 nt, Homo sapiens
ggcuaaugaagaucau

SEQ ID NO: 580605 - RNA, 17 nt, Homo sapiens
ggcuacacacaaaccag

SEQ ID NO: 580606 - RNA, 16 nt, Homo sapiens
ggcuacacucaucuga

SEQ ID NO: 580607 - RNA, 19 nt, Homo sapiens
ggcuacaguaaccaaaaca

SEQ ID NO: 580608 - RNA, 13 nt, Homo sapiens
ggcuacauauaca

SEQ ID NO: 580609 - RNA, 13 nt, Homo sapiens
ggcuaccuacaua

SEQ ID NO: 580610 - RNA, 21 nt, Homo sapiens
ggcuacuaccuagggcacuuu

SEQ ID NO: 580611 - RNA, 22 nt, Homo sapiens
ggcuacuaccuagggcacuuua

SEQ ID NO: 580612 - RNA, 18 nt, Homo sapiens
ggcuacuauagguccaga

SEQ ID NO: 580613 - RNA, 13 nt, Homo sapiens
ggcuacugaguca

SEQ ID NO: 580614 - RNA, 22 nt, Homo sapiens
ggcuagaagugugaagugcaga

SEQ ID NO: 580615 - RNA, 21 nt, Homo sapiens
ggcuagacacccauuuucaca

SEQ ID NO: 580616 - RNA, 20 nt, Homo sapiens
ggcuagagugcaauggcgcg

SEQ ID NO: 580617 - RNA, 16 nt, Homo sapiens
ggcuagguaucauuca

SEQ ID NO: 580618 - RNA, 18 nt, Homo sapiens
ggcuaguugggaugggca

SEQ ID NO: 580619 - RNA, 16 nt, Homo sapiens
ggcuauaagugcucaa

SEQ ID NO: 580620 - RNA, 13 nt, Homo sapiens
ggcuaugcaaggg

SEQ ID NO: 580621 - RNA, 19 nt, Homo sapiens
ggcuaugcgggggugccua

SEQ ID NO: 580622 - RNA, 19 nt, Homo sapiens
ggcuauggacacaggguga

SEQ ID NO: 580623 - RNA, 15 nt, Homo sapiens
ggcuaugguugccac

SEQ ID NO: 580624 - RNA, 15 nt, Homo sapiens
ggcuauuugaagaau

SEQ ID NO: 580625 - RNA, 17 nt, Homo sapiens
ggcuauuuucagaugaa

SEQ ID NO: 580626 - RNA, 20 nt, Homo sapiens
ggcucaagaauaaaauauga

SEQ ID NO: 580627 - RNA, 22 nt, Homo sapiens
ggcucaagcuauccuugcaccu

SEQ ID NO: 580628 - RNA, 16 nt, Homo sapiens
ggcucaaggcugugca

SEQ ID NO: 580629 - RNA, 17 nt, Homo sapiens
ggcucagacauguuuuc

SEQ ID NO: 580630 - RNA, 14 nt, Homo sapiens
ggcucagcacuuug

SEQ ID NO: 580631 - RNA, 17 nt, Homo sapiens
ggcucagccuugcacac

SEQ ID NO: 580632 - RNA, 21 nt, Homo sapiens
ggcucagccuugcacacccac

SEQ ID NO: 580633 - RNA, 21 nt, Homo sapiens
ggcucagguuuugagaagcca

SEQ ID NO: 580634 - RNA, 20 nt, Homo sapiens
ggcucagucgcuagcauuuc

SEQ ID NO: 580635 - RNA, 14 nt, Homo sapiens
ggcuccacugggau

SEQ ID NO: 580636 - RNA, 18 nt, Homo sapiens
ggcuccagaugcagggca

SEQ ID NO: 580637 - RNA, 24 nt, Homo sapiens
ggcucccaugucaagagucgcugu

SEQ ID NO: 580638 - RNA, 21 nt, Homo sapiens
ggcuccccuccucggcuuccu

SEQ ID NO: 580639 - RNA, 14 nt, Homo sapiens
ggcuccucagagcg

SEQ ID NO: 580640 - RNA, 23 nt, Homo sapiens
ggcuccuccugcccuccaucuca

SEQ ID NO: 580641 - RNA, 16 nt, Homo sapiens
ggcuccuggcugccag

SEQ ID NO: 580642 - RNA, 20 nt, Homo sapiens
ggcucgucagccaccuggga

SEQ ID NO: 580643 - RNA, 21 nt, Homo sapiens
ggcucuaauguacaauaaagc

SEQ ID NO: 580644 - RNA, 19 nt, Homo sapiens
ggcucuaauucacagugcu

SEQ ID NO: 580645 - RNA, 21 nt, Homo sapiens
ggcucuaccuccccugcguca

SEQ ID NO: 580646 - RNA, 14 nt, Homo sapiens
ggcucugaugcuga

SEQ ID NO: 580647 - RNA, 19 nt, Homo sapiens
ggcucuuagcagcuuccag

SEQ ID NO: 580648 - RNA, 15 nt, Homo sapiens
ggcucuuucagagag

SEQ ID NO: 580649 - RNA, 15 nt, Homo sapiens
ggcucuuuccuugcu

SEQ ID NO: 580650 - RNA, 12 nt, Homo sapiens
ggcugacaucug

SEQ ID NO: 580651 - RNA, 15 nt, Homo sapiens
ggcugaccaugcuca

SEQ ID NO: 580652 - RNA, 16 nt, Homo sapiens
ggcugaccgugucucu

SEQ ID NO: 580653 - RNA, 16 nt, Homo sapiens
ggcugagaaucugggg

SEQ ID NO: 580654 - RNA, 19 nt, Homo sapiens
ggcugagagaggaagagcu

SEQ ID NO: 580655 - RNA, 12 nt, Homo sapiens
ggcugagcucuu

SEQ ID NO: 580656 - RNA, 15 nt, Homo sapiens
ggcugagcugagcuu

SEQ ID NO: 580657 - RNA, 15 nt, Homo sapiens
ggcugagggugcccu

SEQ ID NO: 580658 - RNA, 13 nt, Homo sapiens
ggcugagugcagc

SEQ ID NO: 580659 - RNA, 10 nt, Homo sapiens
ggcugaugau

SEQ ID NO: 580660 - RNA, 18 nt, Homo sapiens
ggcugaugcugggacccu

SEQ ID NO: 580661 - RNA, 17 nt, Homo sapiens
ggcugcagcagccggaa

SEQ ID NO: 580662 - RNA, 19 nt, Homo sapiens
ggcugcagcagccggaaua

SEQ ID NO: 580663 - RNA, 21 nt, Homo sapiens
ggcugcaggcucuaugggguu

SEQ ID NO: 580664 - RNA, 19 nt, Homo sapiens
ggcugcagugagcugagau

SEQ ID NO: 580665 - RNA, 20 nt, Homo sapiens
ggcugcaugauguuugccca

SEQ ID NO: 580666 - RNA, 23 nt, Homo sapiens
ggcugccccucgcacacagggcu

SEQ ID NO: 580667 - RNA, 17 nt, Homo sapiens
ggcugccccucucacca

SEQ ID NO: 580668 - RNA, 21 nt, Homo sapiens
ggcugccuaccaggggccuuc

SEQ ID NO: 580669 - RNA, 17 nt, Homo sapiens
ggcugccugugugcaug

SEQ ID NO: 580670 - RNA, 18 nt, Homo sapiens
ggcugccuuugaucacag

SEQ ID NO: 580671 - RNA, 14 nt, Homo sapiens
ggcugcgcacugug

SEQ ID NO: 580672 - RNA, 12 nt, Homo sapiens
ggcugcugugaa

SEQ ID NO: 580673 - RNA, 18 nt, Homo sapiens
ggcugcuuccugugacag

SEQ ID NO: 580674 - RNA, 12 nt, Homo sapiens
ggcugcuugcuu

SEQ ID NO: 580675 - RNA, 22 nt, Homo sapiens
ggcuggaaugcaguggugugcu

SEQ ID NO: 580676 - RNA, 20 nt, Homo sapiens
ggcuggacuggaggugggca

SEQ ID NO: 580677 - RNA, 20 nt, Homo sapiens
ggcuggagauaacagccucu

SEQ ID NO: 580678 - RNA, 15 nt, Homo sapiens
ggcuggagccugggg

SEQ ID NO: 580679 - RNA, 13 nt, Homo sapiens
ggcuggagcugcc

SEQ ID NO: 580680 - RNA, 21 nt, Homo sapiens
ggcuggagcugccucucucau

SEQ ID NO: 580681 - RNA, 14 nt, Homo sapiens
ggcuggagugcaau

SEQ ID NO: 580682 - RNA, 20 nt, Homo sapiens
ggcuggagugcgguggcgca

SEQ ID NO: 580683 - RNA, 23 nt, Homo sapiens
gcccagggggagcuaucacugua

SEQ ID NO: 580684 - RNA, 22 nt, Homo sapiens
gcccaggucucucaacuucauc

SEQ ID NO: 580685 - RNA, 19 nt, Homo sapiens
gcccagugacaaagacucc

SEQ ID NO: 580686 - RNA, 13 nt, Homo sapiens
gcccagugcacug

SEQ ID NO: 580687 - RNA, 19 nt, Homo sapiens
gcccagugcauaugcaaug

SEQ ID NO: 580688 - RNA, 21 nt, Homo sapiens
gcccaguguuguuuguaaaua

SEQ ID NO: 580689 - RNA, 18 nt, Homo sapiens
gcccauaaccaguauuuu

SEQ ID NO: 580690 - RNA, 13 nt, Homo sapiens
gcccaucaacugu

SEQ ID NO: 580691 - RNA, 17 nt, Homo sapiens
gcccaucaagugcaguc

SEQ ID NO: 580692 - RNA, 18 nt, Homo sapiens
gcccaucagccauuugcc

SEQ ID NO: 580693 - RNA, 15 nt, Homo sapiens
gcccauccaucugcu

SEQ ID NO: 580694 - RNA, 21 nt, Homo sapiens
gcccauccccaggcaccucac

SEQ ID NO: 580695 - RNA, 12 nt, Homo sapiens
gcccauccugcc

SEQ ID NO: 580696 - RNA, 19 nt, Homo sapiens
gcccaugaugagaagcaga

SEQ ID NO: 580697 - RNA, 20 nt, Homo sapiens
gcccauggugagcucuggga

SEQ ID NO: 580698 - RNA, 21 nt, Homo sapiens
gcccauggugagcucugggaa

SEQ ID NO: 580699 - RNA, 15 nt, Homo sapiens
gcccaugugugagug

SEQ ID NO: 580700 - RNA, 19 nt, Homo sapiens
gcccauucgcaugaggaau

SEQ ID NO: 580701 - RNA, 13 nt, Homo sapiens
gcccauucuugag

SEQ ID NO: 580702 - RNA, 22 nt, Homo sapiens
gcccauugucuuauuggcacau

SEQ ID NO: 580703 - RNA, 14 nt, Homo sapiens
gccccaaucuugcc

SEQ ID NO: 580704 - RNA, 23 nt, Homo sapiens
gccccacccaccccacagacucc

SEQ ID NO: 580705 - RNA, 22 nt, Homo sapiens
gccccacccccaugaccacugc

SEQ ID NO: 580706 - RNA, 22 nt, Homo sapiens
gccccaccucggcacacacugu

SEQ ID NO: 580707 - RNA, 22 nt, Homo sapiens
gccccacuccucuccaccagac

SEQ ID NO: 580708 - RNA, 12 nt, Homo sapiens
gccccacuggac

SEQ ID NO: 580709 - RNA, 20 nt, Homo sapiens
gccccacuucacccccaacu

SEQ ID NO: 580710 - RNA, 13 nt, Homo sapiens
gccccacuugaag

SEQ ID NO: 580711 - RNA, 15 nt, Homo sapiens
gccccagaccccagg

SEQ ID NO: 580712 - RNA, 20 nt, Homo sapiens
gccccagacgcauagacuga

SEQ ID NO: 580713 - RNA, 11 nt, Homo sapiens
gccccagagac

SEQ ID NO: 580714 - RNA, 15 nt, Homo sapiens
gccccagagugcuuu

SEQ ID NO: 580715 - RNA, 23 nt, Homo sapiens
gccccagauaccagccccuguau

SEQ ID NO: 580716 - RNA, 16 nt, Homo sapiens
gccccagcacauggaa

SEQ ID NO: 580717 - RNA, 23 nt, Homo sapiens
gccccagcacuaaagcaguggac

SEQ ID NO: 580718 - RNA, 15 nt, Homo sapiens
gccgccuuaagcuga

SEQ ID NO: 580719 - RNA, 14 nt, Homo sapiens
gccgcggcccagac

SEQ ID NO: 580720 - RNA, 13 nt, Homo sapiens
gccgcuaccuccc

SEQ ID NO: 580721 - RNA, 14 nt, Homo sapiens
gccgcugcaccugc

SEQ ID NO: 580722 - RNA, 21 nt, Homo sapiens
gccggacacagcaccgugcca

SEQ ID NO: 580723 - RNA, 21 nt, Homo sapiens
gccggacugggcagauccuca

SEQ ID NO: 580724 - RNA, 19 nt, Homo sapiens
gccggaucucgaggcuugc

SEQ ID NO: 580725 - RNA, 22 nt, Homo sapiens
gccggcaaccccaguucugcuc

SEQ ID NO: 580726 - RNA, 16 nt, Homo sapiens
gccggccacacugguc

SEQ ID NO: 580727 - RNA, 21 nt, Homo sapiens
gccggcccgccucuccucggu

SEQ ID NO: 580728 - RNA, 12 nt, Homo sapiens
gccggcucuuuc

SEQ ID NO: 580729 - RNA, 17 nt, Homo sapiens
gccggcugugcucagag

SEQ ID NO: 580730 - RNA, 19 nt, Homo sapiens
gccgugccuucagcucuac

SEQ ID NO: 580731 - RNA, 17 nt, Homo sapiens
gccguggacuggcucau

SEQ ID NO: 580732 - RNA, 13 nt, Homo sapiens
gccuaaagugcug

SEQ ID NO: 580733 - RNA, 15 nt, Homo sapiens
gccuaaagugcugca

SEQ ID NO: 580734 - RNA, 19 nt, Homo sapiens
gccuaacaugauuauuuga

SEQ ID NO: 580735 - RNA, 15 nt, Homo sapiens
gccuaagcggcuguu

SEQ ID NO: 580736 - RNA, 19 nt, Homo sapiens
gccuaaguccaguguuucu

SEQ ID NO: 580737 - RNA, 15 nt, Homo sapiens
gccuaauaguaacug

SEQ ID NO: 580738 - RNA, 22 nt, Homo sapiens
gccuaaugagagugcacugcuc

SEQ ID NO: 580739 - RNA, 20 nt, Homo sapiens
gccuaaugcugugugaugca

SEQ ID NO: 580740 - RNA, 23 nt, Homo sapiens
gccuaaugcugugugaugcaccu

SEQ ID NO: 580741 - RNA, 14 nt, Homo sapiens
gccuaauggcaaaa

SEQ ID NO: 580742 - RNA, 15 nt, Homo sapiens
gccuacacacacagc

SEQ ID NO: 580743 - RNA, 17 nt, Homo sapiens
gccuacagaagggcagu

SEQ ID NO: 580744 - RNA, 12 nt, Homo sapiens
gccuacagccag

SEQ ID NO: 580745 - RNA, 21 nt, Homo sapiens
gccuacagcccucacuaacaa

SEQ ID NO: 580746 - RNA, 21 nt, Homo sapiens
gccuacagucaucugccacca

SEQ ID NO: 580747 - RNA, 21 nt, Homo sapiens
gccuaccucaaguucuuggac

SEQ ID NO: 580748 - RNA, 16 nt, Homo sapiens
gccuaccucagccucc

SEQ ID NO: 580749 - RNA, 14 nt, Homo sapiens
gccuacuccaaaau

SEQ ID NO: 580750 - RNA, 14 nt, Homo sapiens
gccuagaaauaucu

SEQ ID NO: 580751 - RNA, 14 nt, Homo sapiens
gccuagaacauccc

SEQ ID NO: 580752 - RNA, 18 nt, Homo sapiens
gccuagaacaucccuggg

SEQ ID NO: 580753 - RNA, 23 nt, Homo sapiens
gccuagacuucccaacagccuua

SEQ ID NO: 580754 - RNA, 23 nt, Homo sapiens
gccuagauccacacacagaggaa

SEQ ID NO: 580755 - RNA, 13 nt, Homo sapiens
gccuagcccuccc

SEQ ID NO: 580756 - RNA, 14 nt, Homo sapiens
gccuagcgaucucu

SEQ ID NO: 580757 - RNA, 22 nt, Homo sapiens
gccuagcgaucucuccuggccu

SEQ ID NO: 580758 - RNA, 16 nt, Homo sapiens
gccuaggaacauuuuu

SEQ ID NO: 580759 - RNA, 12 nt, Homo sapiens
gccuaggguaca

SEQ ID NO: 580760 - RNA, 18 nt, Homo sapiens
gccuauaauacaguuuuc

SEQ ID NO: 580761 - RNA, 20 nt, Homo sapiens
gccuauagucgcagcuacua

SEQ ID NO: 580762 - RNA, 15 nt, Homo sapiens
gccuauauauuuaau

SEQ ID NO: 580763 - RNA, 20 nt, Homo sapiens
gccuaugcaaaccagcuuua

SEQ ID NO: 580764 - RNA, 14 nt, Homo sapiens
gccucaaagcaagc

SEQ ID NO: 580765 - RNA, 14 nt, Homo sapiens
gccucaauucacau

SEQ ID NO: 580766 - RNA, 15 nt, Homo sapiens
gccucacccagauga

SEQ ID NO: 580767 - RNA, 19 nt, Homo sapiens
gccucacugaaacauggcu

SEQ ID NO: 580768 - RNA, 17 nt, Homo sapiens
gccucagaugauuuccc

SEQ ID NO: 580769 - RNA, 22 nt, Homo sapiens
gccucagccuggggcucucuga

SEQ ID NO: 580770 - RNA, 14 nt, Homo sapiens
gccucaggcacucu

SEQ ID NO: 580771 - RNA, 15 nt, Homo sapiens
gccucagucccccaa

SEQ ID NO: 580772 - RNA, 17 nt, Homo sapiens
gccucagugaaggacua

SEQ ID NO: 580773 - RNA, 17 nt, Homo sapiens
gccucaguuacacagga

SEQ ID NO: 580774 - RNA, 18 nt, Homo sapiens
gccucaguuacacaggaa

SEQ ID NO: 580775 - RNA, 19 nt, Homo sapiens
gccucaguuacacaggaac

SEQ ID NO: 580776 - RNA, 12 nt, Homo sapiens
gccucauuugaa

SEQ ID NO: 580777 - RNA, 15 nt, Homo sapiens
gccucauuugaaugu

SEQ ID NO: 580778 - RNA, 16 nt, Homo sapiens
gccuccaagcacagag

SEQ ID NO: 580779 - RNA, 16 nt, Homo sapiens
gccuccaagcuccauc

SEQ ID NO: 580780 - RNA, 19 nt, Homo sapiens
gccuccaccaccacuggcc

SEQ ID NO: 580781 - RNA, 17 nt, Homo sapiens
gccuccagcuucaggca

SEQ ID NO: 580782 - RNA, 12 nt, Homo sapiens
gccuccaugccc

SEQ ID NO: 580783 - RNA, 14 nt, Homo sapiens
gccuccaugcugcc

SEQ ID NO: 580784 - RNA, 19 nt, Homo sapiens
gccuccauguuuuaauauc

SEQ ID NO: 580785 - RNA, 20 nt, Homo sapiens
gccuccauucugaccauuuc

SEQ ID NO: 580786 - RNA, 22 nt, Homo sapiens
gccucccacacugaaaccaaaa

SEQ ID NO: 580787 - RNA, 19 nt, Homo sapiens
gccucccacccgaugcugc

SEQ ID NO: 580788 - RNA, 16 nt, Homo sapiens
gccucccauccagggc

SEQ ID NO: 580789 - RNA, 18 nt, Homo sapiens
gccuccccccucacuugu

SEQ ID NO: 580790 - RNA, 20 nt, Homo sapiens
gccucccccucagaugaucu

SEQ ID NO: 580791 - RNA, 21 nt, Homo sapiens
gccucccccucagaugaucuc

SEQ ID NO: 580792 - RNA, 19 nt, Homo sapiens
gccuccccgugccaaaaau

SEQ ID NO: 580793 - RNA, 16 nt, Homo sapiens
gccucccgaaugaagc

SEQ ID NO: 580794 - RNA, 17 nt, Homo sapiens
gccucccuugacuuugc

SEQ ID NO: 580795 - RNA, 19 nt, Homo sapiens
gccuccggcgucuugccca

SEQ ID NO: 580796 - RNA, 17 nt, Homo sapiens
gccuccuagagugcagg

SEQ ID NO: 580797 - RNA, 16 nt, Homo sapiens
gccuccucagccucug

SEQ ID NO: 580798 - RNA, 17 nt, Homo sapiens
gccuccugagggcucca

SEQ ID NO: 580799 - RNA, 20 nt, Homo sapiens
gccuccugggaacacaucug

SEQ ID NO: 580800 - RNA, 22 nt, Homo sapiens
gccuccugggaacacaucuggc

SEQ ID NO: 580801 - RNA, 13 nt, Homo sapiens
gccuccugugacg

SEQ ID NO: 580802 - RNA, 18 nt, Homo sapiens
gccuccuuuugcuugaaa

SEQ ID NO: 580803 - RNA, 15 nt, Homo sapiens
gccucgaaaaccauc

SEQ ID NO: 580804 - RNA, 17 nt, Homo sapiens
gccucgcagccuccgga

SEQ ID NO: 580805 - RNA, 17 nt, Homo sapiens
gccucgcggucuugggc

SEQ ID NO: 580806 - RNA, 9 nt, Homo sapiens
gccucggga

SEQ ID NO: 580807 - RNA, 13 nt, Homo sapiens
gccucgugccagc

SEQ ID NO: 580808 - RNA, 17 nt, Homo sapiens
gccucgugccaugaucu

SEQ ID NO: 580809 - RNA, 18 nt, Homo sapiens
ccauguaucaauauucac

SEQ ID NO: 580810 - RNA, 23 nt, Homo sapiens
ccauguaucuuuugaacuggcaa

SEQ ID NO: 580811 - RNA, 21 nt, Homo sapiens
ccauguccugaaaaaugcuca

SEQ ID NO: 580812 - RNA, 22 nt, Homo sapiens
ccaugucuccuggacucagggu

SEQ ID NO: 580813 - RNA, 15 nt, Homo sapiens
ccaugucugcauuuc

SEQ ID NO: 580814 - RNA, 23 nt, Homo sapiens
ccaugucuuucucucucacuccc

SEQ ID NO: 580815 - RNA, 23 nt, Homo sapiens
ccaugugauggacacuccaggga

SEQ ID NO: 580816 - RNA, 23 nt, Homo sapiens
ccauguggcugaagacauuccaa

SEQ ID NO: 580817 - RNA, 21 nt, Homo sapiens
ccaugugugagugugugcaag

SEQ ID NO: 580818 - RNA, 22 nt, Homo sapiens
ccaugugugagugugugcaagu

SEQ ID NO: 580819 - RNA, 15 nt, Homo sapiens
ccaugugugugcaag

SEQ ID NO: 580820 - RNA, 20 nt, Homo sapiens
ccaugugugugcaagugugu

SEQ ID NO: 580821 - RNA, 23 nt, Homo sapiens
ccaugugugugcaagugugugca

SEQ ID NO: 580822 - RNA, 14 nt, Homo sapiens
ccauguuagccuua

SEQ ID NO: 580823 - RNA, 22 nt, Homo sapiens
ccauguuauuuauaguguugcu

SEQ ID NO: 580824 - RNA, 23 nt, Homo sapiens
ccauguuauuuauaguguugcuu

SEQ ID NO: 580825 - RNA, 15 nt, Homo sapiens
ccauguucuccauga

SEQ ID NO: 580826 - RNA, 23 nt, Homo sapiens
ccauguucugcccccagcccaaa

SEQ ID NO: 580827 - RNA, 13 nt, Homo sapiens
ccauguugcugcc

SEQ ID NO: 580828 - RNA, 18 nt, Homo sapiens
ccauguuguaaugcugca

SEQ ID NO: 580829 - RNA, 19 nt, Homo sapiens
ccauguuguaaugcugcac

SEQ ID NO: 580830 - RNA, 15 nt, Homo sapiens
ccauguuuaaacuuu

SEQ ID NO: 580831 - RNA, 21 nt, Homo sapiens
ccauguuuagugaaugacuuu

SEQ ID NO: 580832 - RNA, 20 nt, Homo sapiens
ccauguuucagaagcauuca

SEQ ID NO: 580833 - RNA, 16 nt, Homo sapiens
ccauguuuuaauauca

SEQ ID NO: 580834 - RNA, 22 nt, Homo sapiens
ccauguuuucccuuuauucauc

SEQ ID NO: 580835 - RNA, 17 nt, Homo sapiens
ccauuaaaaacuaccac

SEQ ID NO: 580836 - RNA, 15 nt, Homo sapiens
ccauuaaaacugcuu

SEQ ID NO: 580837 - RNA, 19 nt, Homo sapiens
ccauuauguaauagugaca

SEQ ID NO: 580838 - RNA, 14 nt, Homo sapiens
ccauucacuccugc

SEQ ID NO: 580839 - RNA, 17 nt, Homo sapiens
gcuguugacaucagccu

SEQ ID NO: 580840 - RNA, 13 nt, Homo sapiens
gcuguugccucau

SEQ ID NO: 580841 - RNA, 22 nt, Homo sapiens
gcuguugcgcucccaccucagc

SEQ ID NO: 580842 - RNA, 13 nt, Homo sapiens
gcuguugcucagg

SEQ ID NO: 580843 - RNA, 19 nt, Homo sapiens
gcuguuggccucugcaaag

SEQ ID NO: 580844 - RNA, 16 nt, Homo sapiens
gcuguuggucaugugg

SEQ ID NO: 580845 - RNA, 20 nt, Homo sapiens
gcuguuguguuguuguuauu

SEQ ID NO: 580846 - RNA, 19 nt, Homo sapiens
gcuguuuuuuuugcugcua

SEQ ID NO: 580847 - RNA, 21 nt, Homo sapiens
gcuuaaaaaaauuacugugaa

SEQ ID NO: 580848 - RNA, 13 nt, Homo sapiens
gcuuaaaauaagc

SEQ ID NO: 580849 - RNA, 17 nt, Homo sapiens
gcuuaaaaucugugaag

SEQ ID NO: 580850 - RNA, 13 nt, Homo sapiens
gcuuaaacaaagu

SEQ ID NO: 580851 - RNA, 20 nt, Homo sapiens
gcuuaaacccauacaaugua

SEQ ID NO: 580852 - RNA, 20 nt, Homo sapiens
gcuuaaaggggcuagaguga

SEQ ID NO: 580853 - RNA, 18 nt, Homo sapiens
gcuuaaauaggaaaguuu

SEQ ID NO: 580854 - RNA, 22 nt, Homo sapiens
gcuuaaauuucuuaugugacau

SEQ ID NO: 580855 - RNA, 19 nt, Homo sapiens
gcuuaacacuugaccuaaa

SEQ ID NO: 580856 - RNA, 17 nt, Homo sapiens
gcuuaagugagcagaac

SEQ ID NO: 580857 - RNA, 18 nt, Homo sapiens
gcuuaauaaacaugucac

SEQ ID NO: 580858 - RNA, 20 nt, Homo sapiens
gcuuacagaaaugacugccg

SEQ ID NO: 580859 - RNA, 12 nt, Homo sapiens
gcuuacccuuca

SEQ ID NO: 580860 - RNA, 22 nt, Homo sapiens
gcuuaccuuuuccuauucuguu

SEQ ID NO: 580861 - RNA, 15 nt, Homo sapiens
gcuuacuacagugaa

SEQ ID NO: 580862 - RNA, 14 nt, Homo sapiens
gcuuacuccacuuc

SEQ ID NO: 580863 - RNA, 14 nt, Homo sapiens
gcuuagaaauucag

SEQ ID NO: 580864 - RNA, 13 nt, Homo sapiens
gcuuagaccucag

SEQ ID NO: 580865 - RNA, 21 nt, Homo sapiens
gcuuagacuaaggccauuauu

SEQ ID NO: 580866 - RNA, 22 nt, Homo sapiens
gcuuagaugagggugacuguca

SEQ ID NO: 580867 - RNA, 13 nt, Homo sapiens
gcuuagauuucau

SEQ ID NO: 580868 - RNA, 14 nt, Homo sapiens
gcuuagauuucaua

SEQ ID NO: 580869 - RNA, 19 nt, Homo sapiens
gcuuagccccgcugagcuu

SEQ ID NO: 580870 - RNA, 16 nt, Homo sapiens
gcuuagcugucucaga

SEQ ID NO: 580871 - RNA, 18 nt, Homo sapiens
gcuuaggugccaggcugu

SEQ ID NO: 580872 - RNA, 16 nt, Homo sapiens
gcuuagugcacaagca

SEQ ID NO: 580873 - RNA, 23 nt, Homo sapiens
gcuuaguucuucuccugccuaau

SEQ ID NO: 580874 - RNA, 21 nt, Homo sapiens
gcuuauacacuuacacuuuau

SEQ ID NO: 580875 - RNA, 12 nt, Homo sapiens
gcuuauauucau

SEQ ID NO: 580876 - RNA, 19 nt, Homo sapiens
gcuuauccccucagaaucc

SEQ ID NO: 580877 - RNA, 21 nt, Homo sapiens
gcuuaucuuugcacauguuaa

SEQ ID NO: 580878 - RNA, 12 nt, Homo sapiens
gcuuaugauuca

SEQ ID NO: 580879 - RNA, 18 nt, Homo sapiens
gcuuaugcuuguguauau

SEQ ID NO: 580880 - RNA, 17 nt, Homo sapiens
gcuuauuauagaauugc

SEQ ID NO: 580881 - RNA, 13 nt, Homo sapiens
gcuuauuauccaa

SEQ ID NO: 580882 - RNA, 19 nt, Homo sapiens
gcuuauuuugguugcaguu

SEQ ID NO: 580883 - RNA, 20 nt, Homo sapiens
gcuucaaggauauacugcag

SEQ ID NO: 580884 - RNA, 15 nt, Homo sapiens
gcuucaaggcuucca

SEQ ID NO: 580885 - RNA, 21 nt, Homo sapiens
gcuucacaguagagccagcuu

SEQ ID NO: 580886 - RNA, 18 nt, Homo sapiens
gcuucaccagagcauuuc

SEQ ID NO: 580887 - RNA, 19 nt, Homo sapiens
gcuucaccccugcacuuca

SEQ ID NO: 580888 - RNA, 21 nt, Homo sapiens
gcuucacuagaguucuuugaa

SEQ ID NO: 580889 - RNA, 22 nt, Homo sapiens
gcuucaggcagcagacugacca

SEQ ID NO: 580890 - RNA, 13 nt, Homo sapiens
gcuucagugacaa

SEQ ID NO: 580891 - RNA, 21 nt, Homo sapiens
gcuucauaaaugaagcagcuu

SEQ ID NO: 580892 - RNA, 16 nt, Homo sapiens
gcuucauauaccagca

SEQ ID NO: 580893 - RNA, 19 nt, Homo sapiens
gcuucaucagcugugugca

SEQ ID NO: 580894 - RNA, 16 nt, Homo sapiens
gcuucaugccagguua

SEQ ID NO: 580895 - RNA, 15 nt, Homo sapiens
gcuucauuuuacuaa

SEQ ID NO: 580896 - RNA, 23 nt, Homo sapiens
gcuuccauuugugugugugcaag

SEQ ID NO: 580897 - RNA, 18 nt, Homo sapiens
gcuucccugaaagacuga

SEQ ID NO: 580898 - RNA, 14 nt, Homo sapiens
gcuuccuaacugcu

SEQ ID NO: 580899 - RNA, 18 nt, Homo sapiens
gcuuccucuagaagccaa

SEQ ID NO: 580900 - RNA, 21 nt, Homo sapiens
gcuuccugucccacuacugua

SEQ ID NO: 580901 - RNA, 19 nt, Homo sapiens
gcuuccuuuuauuuuuaua

SEQ ID NO: 580902 - RNA, 13 nt, Homo sapiens
gcuucgcuggaaa

SEQ ID NO: 580903 - RNA, 14 nt, Homo sapiens
gcuucuaguuugca

SEQ ID NO: 580904 - RNA, 19 nt, Homo sapiens
gcuucuaucaggucccauc

SEQ ID NO: 580905 - RNA, 17 nt, Homo sapiens
gcuucuaugguugacau

SEQ ID NO: 580906 - RNA, 23 nt, Homo sapiens
gcuucucaucuaaauauuuccau

SEQ ID NO: 580907 - RNA, 18 nt, Homo sapiens
gcuucuccaagcuuucag

SEQ ID NO: 580908 - RNA, 15 nt, Homo sapiens
gcuucuccaugagac

SEQ ID NO: 580909 - RNA, 13 nt, Homo sapiens
gcuucucccauuu

SEQ ID NO: 580910 - RNA, 15 nt, Homo sapiens
gcuucucccauuucc

SEQ ID NO: 580911 - RNA, 20 nt, Homo sapiens
gcuucuccuucuccuuccca

SEQ ID NO: 580912 - RNA, 23 nt, Homo sapiens
gcuucuccuucuccuucccauuu

SEQ ID NO: 580913 - RNA, 17 nt, Homo sapiens
gcuucucuccacagugu

SEQ ID NO: 580914 - RNA, 18 nt, Homo sapiens
gcuucucugacuucugcc

SEQ ID NO: 580915 - RNA, 22 nt, Homo sapiens
gcuucucugcuccagguucacu

SEQ ID NO: 580916 - RNA, 15 nt, Homo sapiens
gcuucugaagagccu

SEQ ID NO: 580917 - RNA, 14 nt, Homo sapiens
gcuucugccuucaa

SEQ ID NO: 580918 - RNA, 17 nt, Homo sapiens
gcuucuucacaggcacu

SEQ ID NO: 580919 - RNA, 21 nt, Homo sapiens
gcuucuuccccucugcggcuu

SEQ ID NO: 580920 - RNA, 20 nt, Homo sapiens
gcuucuuccucacacugcug

SEQ ID NO: 580921 - RNA, 20 nt, Homo sapiens
gcuucuuggaccuuggcgcu

SEQ ID NO: 580922 - RNA, 13 nt, Homo sapiens
gcuucuuuucacu

SEQ ID NO: 580923 - RNA, 14 nt, Homo sapiens
gcuugaaccuggga

SEQ ID NO: 580924 - RNA, 15 nt, Homo sapiens
gcuugaagccaaaga

SEQ ID NO: 580925 - RNA, 14 nt, Homo sapiens
gcuugaauguuugu

SEQ ID NO: 580926 - RNA, 21 nt, Homo sapiens
gcuugagccuggcuguccaac

SEQ ID NO: 580927 - RNA, 22 nt, Homo sapiens
gcuugagucucaaggguggcag

SEQ ID NO: 580928 - RNA, 14 nt, Homo sapiens
gcuugcaugccaaa

SEQ ID NO: 580929 - RNA, 21 nt, Homo sapiens
gcuugccccacccaacaagcc

SEQ ID NO: 580930 - RNA, 21 nt, Homo sapiens
gcuugccccaggacucuggca

SEQ ID NO: 580931 - RNA, 15 nt, Homo sapiens
gcuugccugaagcuu

SEQ ID NO: 580932 - RNA, 10 nt, Homo sapiens
gcuugcucua

SEQ ID NO: 580933 - RNA, 10 nt, Homo sapiens
gcuugcucuu

SEQ ID NO: 580934 - RNA, 19 nt, Homo sapiens
gcuugcugguagcacuugc

SEQ ID NO: 580935 - RNA, 14 nt, Homo sapiens
gcuuggaagccagg

SEQ ID NO: 580936 - RNA, 17 nt, Homo sapiens
gcuuggcagauguggau

SEQ ID NO: 580937 - RNA, 23 nt, Homo sapiens
gcuuggccuacagucaucugcca

SEQ ID NO: 580938 - RNA, 22 nt, Homo sapiens
gcuuguaacuccaccaacccau

SEQ ID NO: 580939 - RNA, 22 nt, Homo sapiens
gcuuguaccacuuuugcaaaua

SEQ ID NO: 580940 - RNA, 16 nt, Homo sapiens
gcuuguaucaacacug

SEQ ID NO: 580941 - RNA, 14 nt, Homo sapiens
gcuugucacaggaa

SEQ ID NO: 580942 - RNA, 17 nt, Homo sapiens
cccugcaauguggugac

SEQ ID NO: 580943 - RNA, 19 nt, Homo sapiens
cccugcauugcugagucaa

SEQ ID NO: 580944 - RNA, 17 nt, Homo sapiens
cccugcauuucugaguu

SEQ ID NO: 580945 - RNA, 23 nt, Homo sapiens
cccugccaagacuccucaggcag

SEQ ID NO: 580946 - RNA, 17 nt, Homo sapiens
cccugccacauccagcu

SEQ ID NO: 580947 - RNA, 14 nt, Homo sapiens
cccugccauuuacc

SEQ ID NO: 580948 - RNA, 21 nt, Homo sapiens
cccugcccacguccccaccca

SEQ ID NO: 580949 - RNA, 22 nt, Homo sapiens
cccugcccagccccacuucucc

SEQ ID NO: 580950 - RNA, 23 nt, Homo sapiens
cccugccccgccccccagagcca

SEQ ID NO: 580951 - RNA, 11 nt, Homo sapiens
cccugccccug

SEQ ID NO: 580952 - RNA, 16 nt, Homo sapiens
cccugccuccugccac

SEQ ID NO: 580953 - RNA, 21 nt, Homo sapiens
cccugccugccccgacaccca

SEQ ID NO: 580954 - RNA, 11 nt, Homo sapiens
cccugccuuua

SEQ ID NO: 580955 - RNA, 20 nt, Homo sapiens
cccugcucaguaaagcacuu

SEQ ID NO: 580956 - RNA, 14 nt, Homo sapiens
cccugcuccagucc

SEQ ID NO: 580957 - RNA, 14 nt, Homo sapiens
cccugcuccugcag

SEQ ID NO: 580958 - RNA, 14 nt, Homo sapiens
cccugcucuugcag

SEQ ID NO: 580959 - RNA, 13 nt, Homo sapiens
cccugcugaccuc

SEQ ID NO: 580960 - RNA, 13 nt, Homo sapiens
cccuggaagcuga

SEQ ID NO: 580961 - RNA, 11 nt, Homo sapiens
ccgccuuccaa

SEQ ID NO: 580962 - RNA, 16 nt, Homo sapiens
ccgccuuccaaaaccu

SEQ ID NO: 580963 - RNA, 18 nt, Homo sapiens
ccgcgagccaggcugacc

SEQ ID NO: 580964 - RNA, 13 nt, Homo sapiens
ccgcggcccagac

SEQ ID NO: 580965 - RNA, 18 nt, Homo sapiens
ccgcguggcauccuguga

SEQ ID NO: 580966 - RNA, 16 nt, Homo sapiens
ccgcucacugaacucc

SEQ ID NO: 580967 - RNA, 21 nt, Homo sapiens
ccgcucugauuucaggcagca

SEQ ID NO: 580968 - RNA, 16 nt, Homo sapiens
ccgcugcgggcccacg

SEQ ID NO: 580969 - RNA, 20 nt, Homo sapiens
ccgcugcuuccaggcugggc

SEQ ID NO: 580970 - RNA, 14 nt, Homo sapiens
ccgcugggugguuu

SEQ ID NO: 580971 - RNA, 22 nt, Homo sapiens
ccggaagcucacagugacauua

SEQ ID NO: 580972 - RNA, 14 nt, Homo sapiens
ccggagaaacugag

SEQ ID NO: 580973 - RNA, 20 nt, Homo sapiens
ccggagcagcaggaaggccc

SEQ ID NO: 580974 - RNA, 15 nt, Homo sapiens
ccggaggacugagcc

SEQ ID NO: 580975 - RNA, 20 nt, Homo sapiens
ccggaggggccuaagugcca

SEQ ID NO: 580976 - RNA, 13 nt, Homo sapiens
ccggaggucauga

SEQ ID NO: 580977 - RNA, 19 nt, Homo sapiens
ccggcaacaucucugggaa

SEQ ID NO: 580978 - RNA, 13 nt, Homo sapiens
ccggccacacugg

SEQ ID NO: 580979 - RNA, 22 nt, Homo sapiens
ccggccgccgccaggacugugu

SEQ ID NO: 580980 - RNA, 17 nt, Homo sapiens
ccggcggcuacucugga

SEQ ID NO: 580981 - RNA, 14 nt, Homo sapiens
ccggcgucuugccc

SEQ ID NO: 580982 - RNA, 16 nt, Homo sapiens
ccggcgucuugcccag

SEQ ID NO: 580983 - RNA, 22 nt, Homo sapiens
ccggcgucuugcccagcagcuc

SEQ ID NO: 580984 - RNA, 15 nt, Homo sapiens
ccggcuccugugcug

SEQ ID NO: 580985 - RNA, 12 nt, Homo sapiens
ccggcucuuucc

SEQ ID NO: 580986 - RNA, 14 nt, Homo sapiens
ccggcuguggagca

SEQ ID NO: 580987 - RNA, 18 nt, Homo sapiens
ccggcuuccacuccccac

SEQ ID NO: 580988 - RNA, 14 nt, Homo sapiens
ccgggacacagaau

SEQ ID NO: 580989 - RNA, 21 nt, Homo sapiens
ccgggaggacagcugccuguu

SEQ ID NO: 580990 - RNA, 14 nt, Homo sapiens
ccgggauccagcuc

SEQ ID NO: 580991 - RNA, 20 nt, Homo sapiens
ccgggcacuggcacugcgau

SEQ ID NO: 580992 - RNA, 22 nt, Homo sapiens
ccggggcaagagggaaggugac

SEQ ID NO: 580993 - RNA, 15 nt, Homo sapiens
ccggggccagcacuu

SEQ ID NO: 580994 - RNA, 13 nt, Homo sapiens
ccggggguccagg

SEQ ID NO: 580995 - RNA, 13 nt, Homo sapiens
ccggguccuccua

SEQ ID NO: 580996 - RNA, 20 nt, Homo sapiens
ccggucguggggaaaucuca

SEQ ID NO: 580997 - RNA, 14 nt, Homo sapiens
ccggugugccugug

SEQ ID NO: 580998 - RNA, 18 nt, Homo sapiens
ccgguucaggaccacuuu

SEQ ID NO: 580999 - RNA, 12 nt, Homo sapiens
ccguacauucaa

SEQ ID NO: 581000 - RNA, 16 nt, Homo sapiens
ccguaccccacccuca

SEQ ID NO: 581001 - RNA, 16 nt, Homo sapiens
ccgucacccaacauca

SEQ ID NO: 581002 - RNA, 20 nt, Homo sapiens
ccguccacguccuccaagcu

SEQ ID NO: 581003 - RNA, 17 nt, Homo sapiens
ccgucgaggggcucuca

SEQ ID NO: 581004 - RNA, 13 nt, Homo sapiens
ccgucgugcaguc

SEQ ID NO: 581005 - RNA, 16 nt, Homo sapiens
ccgugacagaugccaa

SEQ ID NO: 581006 - RNA, 22 nt, Homo sapiens
ccgugacagcccgcaggaucag

SEQ ID NO: 581007 - RNA, 14 nt, Homo sapiens
ccgugagaacauca

SEQ ID NO: 581008 - RNA, 18 nt, Homo sapiens
ccgugaggcaaugggagc

SEQ ID NO: 581009 - RNA, 17 nt, Homo sapiens
ccgugagugacauagcc

SEQ ID NO: 581010 - RNA, 23 nt, Homo sapiens
ccgugcacccuggaagggcaggu

SEQ ID NO: 581011 - RNA, 13 nt, Homo sapiens
ccgugccaaaaau

SEQ ID NO: 581012 - RNA, 15 nt, Homo sapiens
ccguggaacauucug

SEQ ID NO: 581013 - RNA, 16 nt, Homo sapiens
ccguggacaccccaga

SEQ ID NO: 581014 - RNA, 12 nt, Homo sapiens
ccguggagccuu

SEQ ID NO: 581015 - RNA, 11 nt, Homo sapiens
ccgugguccaa

SEQ ID NO: 581016 - RNA, 16 nt, Homo sapiens
ccguggucccugagga

SEQ ID NO: 581017 - RNA, 17 nt, Homo sapiens
ccgugguuuguacucaa

SEQ ID NO: 581018 - RNA, 14 nt, Homo sapiens
ccgugucaagcugc

SEQ ID NO: 581019 - RNA, 13 nt, Homo sapiens
ccguguguuauau

SEQ ID NO: 581020 - RNA, 18 nt, Homo sapiens
ccguucugugcacaaaac

SEQ ID NO: 581021 - RNA, 13 nt, Homo sapiens
ccguugaccagau

SEQ ID NO: 581022 - RNA, 23 nt, Homo sapiens
ccguuucauuuagucaugugacc

SEQ ID NO: 581023 - RNA, 13 nt, Homo sapiens
ccguuucuuucaa

SEQ ID NO: 581024 - RNA, 20 nt, Homo sapiens
ccguuuuuuucuuuccugua

SEQ ID NO: 581025 - RNA, 18 nt, Homo sapiens
ccuaaaaagauugccaau

SEQ ID NO: 581026 - RNA, 14 nt, Homo sapiens
ccuaaaacaguauu

SEQ ID NO: 581027 - RNA, 16 nt, Homo sapiens
ccuaaaacaguauucu

SEQ ID NO: 581028 - RNA, 16 nt, Homo sapiens
ccuaaaagcacacuca

SEQ ID NO: 581029 - RNA, 18 nt, Homo sapiens
ccuaaaaggaaaucucac

SEQ ID NO: 581030 - RNA, 14 nt, Homo sapiens
ccuaaaaguauuau

SEQ ID NO: 581031 - RNA, 19 nt, Homo sapiens
ccuaaaagugggcuugauu

SEQ ID NO: 581032 - RNA, 18 nt, Homo sapiens
ccuaaaauggugauaucc

SEQ ID NO: 581033 - RNA, 21 nt, Homo sapiens
ccuaaaauuguaugaaaaucc

SEQ ID NO: 581034 - RNA, 12 nt, Homo sapiens
ccuaaacccaau

SEQ ID NO: 581035 - RNA, 15 nt, Homo sapiens
ccuaaacuccagggg

SEQ ID NO: 581036 - RNA, 13 nt, Homo sapiens
ccuaaacuuucca

SEQ ID NO: 581037 - RNA, 15 nt, Homo sapiens
ccuaaagacuguaua

SEQ ID NO: 581038 - RNA, 11 nt, Homo sapiens
ccuaaagccaa

SEQ ID NO: 581039 - RNA, 20 nt, Homo sapiens
ccuaaagccucaaaacaaag

SEQ ID NO: 581040 - RNA, 15 nt, Homo sapiens
ccuaaaucccaagaa

SEQ ID NO: 581041 - RNA, 16 nt, Homo sapiens
ccuaaaucuccagugg

SEQ ID NO: 581042 - RNA, 22 nt, Homo sapiens
ccuaaaucugccuuuucaucua

SEQ ID NO: 581043 - RNA, 12 nt, Homo sapiens
ccuaaaugaugg

SEQ ID NO: 581044 - RNA, 11 nt, Homo sapiens
ccuaacacagu

SEQ ID NO: 581045 - RNA, 11 nt, Homo sapiens
ccuaacacauu

SEQ ID NO: 581046 - RNA, 20 nt, Homo sapiens
ccuaacugaauacagucuca

SEQ ID NO: 581047 - RNA, 13 nt, Homo sapiens
ccuaacuucugua

SEQ ID NO: 581048 - RNA, 12 nt, Homo sapiens
ccuaacuuguaa

SEQ ID NO: 581049 - RNA, 18 nt, Homo sapiens
ccuaagacacaaaugcau

SEQ ID NO: 581050 - RNA, 13 nt, Homo sapiens
ccuaagaguggag

SEQ ID NO: 581051 - RNA, 15 nt, Homo sapiens
ccuaagcaaauagga

SEQ ID NO: 581052 - RNA, 17 nt, Homo sapiens
ccuaagcaccugccuca

SEQ ID NO: 581053 - RNA, 11 nt, Homo sapiens
ccuaagcacuu

SEQ ID NO: 581054 - RNA, 12 nt, Homo sapiens
ccuaagcacuuu

SEQ ID NO: 581055 - RNA, 14 nt, Homo sapiens
ccuaagcacuuuau

SEQ ID NO: 581056 - RNA, 18 nt, Homo sapiens
ccuaaggacacacuaauc

SEQ ID NO: 581057 - RNA, 18 nt, Homo sapiens
ccuaaggaucucucagga

SEQ ID NO: 581058 - RNA, 17 nt, Homo sapiens
ccuaaggcacccacaaa

SEQ ID NO: 581059 - RNA, 15 nt, Homo sapiens
ccuaaggcuccccac

SEQ ID NO: 581060 - RNA, 15 nt, Homo sapiens
ccuaagggagugucu

SEQ ID NO: 581061 - RNA, 20 nt, Homo sapiens
ccuaaguauaaaugguuguc

SEQ ID NO: 581062 - RNA, 16 nt, Homo sapiens
ccuaaguccuuuaugu

SEQ ID NO: 581063 - RNA, 20 nt, Homo sapiens
ccuaauacugucauccucaa

SEQ ID NO: 581064 - RNA, 19 nt, Homo sapiens
ccuaauagucauacuagua

SEQ ID NO: 581065 - RNA, 15 nt, Homo sapiens
ccuaauaucaauuug

SEQ ID NO: 581066 - RNA, 21 nt, Homo sapiens
ccuaauauuuuguucugcaaa

SEQ ID NO: 581067 - RNA, 20 nt, Homo sapiens
ccuaaucacaugugcugcaa

SEQ ID NO: 581068 - RNA, 22 nt, Homo sapiens
ccuaaucuauggucgggagaca

SEQ ID NO: 581069 - RNA, 16 nt, Homo sapiens
ccuaaucucuguaaag

SEQ ID NO: 581070 - RNA, 15 nt, Homo sapiens
ggaacuuuagugaaa

SEQ ID NO: 581071 - RNA, 18 nt, Homo sapiens
ggaagaaagaauguuacu

SEQ ID NO: 581072 - RNA, 18 nt, Homo sapiens
ggaagaagauagauccaa

SEQ ID NO: 581073 - RNA, 19 nt, Homo sapiens
ggaagacaacccaggcagu

SEQ ID NO: 581074 - RNA, 19 nt, Homo sapiens
ggaagacauuucugcacau

SEQ ID NO: 581075 - RNA, 13 nt, Homo sapiens
ggaagacuugaag

SEQ ID NO: 581076 - RNA, 16 nt, Homo sapiens
ggaagagcagugcugu

SEQ ID NO: 581077 - RNA, 15 nt, Homo sapiens
ggaagagcauuagcu

SEQ ID NO: 581078 - RNA, 12 nt, Homo sapiens
ggaagagcuaau

SEQ ID NO: 581079 - RNA, 18 nt, Homo sapiens
ggaagagcugcaacggaa

SEQ ID NO: 581080 - RNA, 21 nt, Homo sapiens
ggaagaggaacagcacugggg

SEQ ID NO: 581081 - RNA, 17 nt, Homo sapiens
ggaagagggugauugcu

SEQ ID NO: 581082 - RNA, 13 nt, Homo sapiens
ggaagaguguuuc

SEQ ID NO: 581083 - RNA, 14 nt, Homo sapiens
ggaagauacacuga

SEQ ID NO: 581084 - RNA, 23 nt, Homo sapiens
ggaagauauaacauucaguuccc

SEQ ID NO: 581085 - RNA, 19 nt, Homo sapiens
ggacgagacccuacaggag

SEQ ID NO: 581086 - RNA, 20 nt, Homo sapiens
ggacgaggaguaauggcauu

SEQ ID NO: 581087 - RNA, 16 nt, Homo sapiens
ggacgcacagugcagu

SEQ ID NO: 581088 - RNA, 17 nt, Homo sapiens
ggacgcacagugcaguu

SEQ ID NO: 581089 - RNA, 23 nt, Homo sapiens
ggacgccugcaggagagagcagc

SEQ ID NO: 581090 - RNA, 22 nt, Homo sapiens
ggacguggcucagccagcacuu

SEQ ID NO: 581091 - RNA, 23 nt, Homo sapiens
ggacuaagaugaaaugcacugua

SEQ ID NO: 581092 - RNA, 13 nt, Homo sapiens
ggacuacagacau

SEQ ID NO: 581093 - RNA, 12 nt, Homo sapiens
ggacuacaggug

SEQ ID NO: 581094 - RNA, 12 nt, Homo sapiens
ggacuacuccaa

SEQ ID NO: 581095 - RNA, 16 nt, Homo sapiens
ggacuaugaaaagcua

SEQ ID NO: 581096 - RNA, 22 nt, Homo sapiens
ggacuauuauaauuuaaugcau

SEQ ID NO: 581097 - RNA, 14 nt, Homo sapiens
ggacucaaacugcc

SEQ ID NO: 581098 - RNA, 15 nt, Homo sapiens
ggacuccauagcucc

SEQ ID NO: 581099 - RNA, 23 nt, Homo sapiens
ggacuccaucucucauccuccag

SEQ ID NO: 581100 - RNA, 21 nt, Homo sapiens
ggacuccccaggccaggccac

SEQ ID NO: 581101 - RNA, 17 nt, Homo sapiens
ggacucccgggccacgc

SEQ ID NO: 581102 - RNA, 20 nt, Homo sapiens
ggacucugccuuuuuucaca

SEQ ID NO: 581103 - RNA, 13 nt, Homo sapiens
ggacucuugcucu

SEQ ID NO: 581104 - RNA, 17 nt, Homo sapiens
ggacugaaugugccuaa

SEQ ID NO: 581105 - RNA, 18 nt, Homo sapiens
ggacugagcugggggaag

SEQ ID NO: 581106 - RNA, 17 nt, Homo sapiens
ggacugcauaaaccaau

SEQ ID NO: 581107 - RNA, 14 nt, Homo sapiens
ggacuguaagggau

SEQ ID NO: 581108 - RNA, 19 nt, Homo sapiens
ggacugugccucaggccag

SEQ ID NO: 581109 - RNA, 23 nt, Homo sapiens
ggacuguuccaggcccuccagug

SEQ ID NO: 581110 - RNA, 16 nt, Homo sapiens
ggacuuccuugcucuc

SEQ ID NO: 581111 - RNA, 18 nt, Homo sapiens
ggacuucuggcagggaag

SEQ ID NO: 581112 - RNA, 16 nt, Homo sapiens
ggacuugaaugcugcc

SEQ ID NO: 581113 - RNA, 16 nt, Homo sapiens
ggacuuggcuucagac

SEQ ID NO: 581114 - RNA, 20 nt, Homo sapiens
ggacuuuggaaaacuacuuu

SEQ ID NO: 581115 - RNA, 16 nt, Homo sapiens
ggacuuuucgaccaau

SEQ ID NO: 581116 - RNA, 15 nt, Homo sapiens
ggagaaaaagcuuaa

SEQ ID NO: 581117 - RNA, 18 nt, Homo sapiens
ggagaaagcucauggcug

SEQ ID NO: 581118 - RNA, 14 nt, Homo sapiens
ggagaacuauccaa

SEQ ID NO: 581119 - RNA, 20 nt, Homo sapiens
ggagaagagcgcaguguuuu

SEQ ID NO: 581120 - RNA, 15 nt, Homo sapiens
ggagaagagugucag

SEQ ID NO: 581121 - RNA, 19 nt, Homo sapiens
ggagaaugaagacuguuaa

SEQ ID NO: 581122 - RNA, 13 nt, Homo sapiens
ggagaaugcacag

SEQ ID NO: 581123 - RNA, 17 nt, Homo sapiens
ggagacaaaucucagaa

SEQ ID NO: 581124 - RNA, 14 nt, Homo sapiens
ggagacaacuggac

SEQ ID NO: 581125 - RNA, 13 nt, Homo sapiens
ggagacauaucac

SEQ ID NO: 581126 - RNA, 16 nt, Homo sapiens
ggagacaugugacauu

SEQ ID NO: 581127 - RNA, 14 nt, Homo sapiens
ggagaccagggacc

SEQ ID NO: 581128 - RNA, 21 nt, Homo sapiens
ggagacccucgcccaacucca

SEQ ID NO: 581129 - RNA, 15 nt, Homo sapiens
ggagaccugugcuag

SEQ ID NO: 581130 - RNA, 14 nt, Homo sapiens
ggagacgccucucc

SEQ ID NO: 581131 - RNA, 18 nt, Homo sapiens
ggagacguggaaccucug

SEQ ID NO: 581132 - RNA, 21 nt, Homo sapiens
ggagacucaccucugccucaa

SEQ ID NO: 581133 - RNA, 13 nt, Homo sapiens
ggagacugagauc

SEQ ID NO: 581134 - RNA, 16 nt, Homo sapiens
ggagacugucucaaga

SEQ ID NO: 581135 - RNA, 16 nt, Homo sapiens
ggagacuuggggccag

SEQ ID NO: 581136 - RNA, 15 nt, Homo sapiens
ggagagacaggcagc

SEQ ID NO: 581137 - RNA, 20 nt, Homo sapiens
ggagagagaggcugccucag

SEQ ID NO: 581138 - RNA, 23 nt, Homo sapiens
ggagagcccggcgccccugccac

SEQ ID NO: 581139 - RNA, 19 nt, Homo sapiens
ggagagcgaggccacgcac

SEQ ID NO: 581140 - RNA, 16 nt, Homo sapiens
ggagaggucaccagcu

SEQ ID NO: 581141 - RNA, 16 nt, Homo sapiens
ggagaguacagugagc

SEQ ID NO: 581142 - RNA, 18 nt, Homo sapiens
ggagagucucacuuugga

SEQ ID NO: 581143 - RNA, 16 nt, Homo sapiens
ggagauaauuguuuca

SEQ ID NO: 581144 - RNA, 22 nt, Homo sapiens
ggagaucagguaccaaggaaau

SEQ ID NO: 581145 - RNA, 21 nt, Homo sapiens
ggagaucgcaucauugcacuc

SEQ ID NO: 581146 - RNA, 16 nt, Homo sapiens
ggagaugaggugcuca

SEQ ID NO: 581147 - RNA, 17 nt, Homo sapiens
ggagaugaguugcaguu

SEQ ID NO: 581148 - RNA, 18 nt, Homo sapiens
ggagaugaguugcaguuu

SEQ ID NO: 581149 - RNA, 21 nt, Homo sapiens
ggagaugcuucucuccuugcc

SEQ ID NO: 581150 - RNA, 16 nt, Homo sapiens
ggagauggacaacuca

SEQ ID NO: 581151 - RNA, 18 nt, Homo sapiens
ggagauggcagcagugaa

SEQ ID NO: 581152 - RNA, 16 nt, Homo sapiens
ggagaugucucugcaa

SEQ ID NO: 581153 - RNA, 20 nt, Homo sapiens
ggagauuccagucuacuuga

SEQ ID NO: 581154 - RNA, 21 nt, Homo sapiens
ggagauuucuuguugcucaaa

SEQ ID NO: 581155 - RNA, 20 nt, Homo sapiens
ggagcaaaaucgaugcagug

SEQ ID NO: 581156 - RNA, 15 nt, Homo sapiens
ggagcaagcuugccc

SEQ ID NO: 581157 - RNA, 18 nt, Homo sapiens
ggagcaagggcacaaacu

SEQ ID NO: 581158 - RNA, 12 nt, Homo sapiens
ggagcacgugga

SEQ ID NO: 581159 - RNA, 19 nt, Homo sapiens
ggagcacuguucacaucau

SEQ ID NO: 581160 - RNA, 16 nt, Homo sapiens
ggagcagaugcaauga

SEQ ID NO: 581161 - RNA, 12 nt, Homo sapiens
ggagcagccagg

SEQ ID NO: 581162 - RNA, 22 nt, Homo sapiens
ggagcagcuauuuuaagccauc

SEQ ID NO: 581163 - RNA, 21 nt, Homo sapiens
ggagcaggagccugagccuug

SEQ ID NO: 581164 - RNA, 16 nt, Homo sapiens
ggagcaucaagccacu

SEQ ID NO: 581165 - RNA, 19 nt, Homo sapiens
ggagcaugggccuggccac

SEQ ID NO: 581166 - RNA, 14 nt, Homo sapiens
ggagccagugugcc

SEQ ID NO: 581167 - RNA, 20 nt, Homo sapiens
ggagcccccaccacaaacuu

SEQ ID NO: 581168 - RNA, 18 nt, Homo sapiens
ggagccccgccacagccu

SEQ ID NO: 581169 - RNA, 19 nt, Homo sapiens
ggagccccuucugcucagc

SEQ ID NO: 581170 - RNA, 22 nt, Homo sapiens
ggagccccuucugcucagcucu

SEQ ID NO: 581171 - RNA, 15 nt, Homo sapiens
ggagcccgugcagua

SEQ ID NO: 581172 - RNA, 20 nt, Homo sapiens
ggagccgggacccucaggug

SEQ ID NO: 581173 - RNA, 22 nt, Homo sapiens
ggagccuguguuagugucuguc

SEQ ID NO: 581174 - RNA, 13 nt, Homo sapiens
ggagcgcaccugc

SEQ ID NO: 581175 - RNA, 14 nt, Homo sapiens
ggagcuacugacau

SEQ ID NO: 581176 - RNA, 23 nt, Homo sapiens
ggagcucuucaggccucccucuc

SEQ ID NO: 581177 - RNA, 15 nt, Homo sapiens
ggagcugaggccaca

SEQ ID NO: 581178 - RNA, 14 nt, Homo sapiens
ggagcugauggcag

SEQ ID NO: 581179 - RNA, 21 nt, Homo sapiens
ggagcugccgugccugugucc

SEQ ID NO: 581180 - RNA, 16 nt, Homo sapiens
ggagcuggcccucucc

SEQ ID NO: 581181 - RNA, 19 nt, Homo sapiens
ggagcugggagccaggcuc

SEQ ID NO: 581182 - RNA, 22 nt, Homo sapiens
ggaggaaaagacuaacaggaga

SEQ ID NO: 581183 - RNA, 18 nt, Homo sapiens
ggaggaacacugcacucu

SEQ ID NO: 581184 - RNA, 20 nt, Homo sapiens
ggaggaaccacaauguuucu

SEQ ID NO: 581185 - RNA, 23 nt, Homo sapiens
ggaggaacuuuucaagcugcuga

SEQ ID NO: 581186 - RNA, 16 nt, Homo sapiens
ggaggacaguggcaca

SEQ ID NO: 581187 - RNA, 19 nt, Homo sapiens
ggaggacgguuaacuugua

SEQ ID NO: 581188 - RNA, 18 nt, Homo sapiens
ggaggacuccgggaccau

SEQ ID NO: 581189 - RNA, 14 nt, Homo sapiens
ggaggagcagcagc

SEQ ID NO: 581190 - RNA, 13 nt, Homo sapiens
ggaggaguggugg

SEQ ID NO: 581191 - RNA, 14 nt, Homo sapiens
ggaggaugaugcca

SEQ ID NO: 581192 - RNA, 14 nt, Homo sapiens
ggaggaugugggca

SEQ ID NO: 581193 - RNA, 14 nt, Homo sapiens
ggaggccaauaaaa

SEQ ID NO: 581194 - RNA, 19 nt, Homo sapiens
ggaggccuggggaggcccu

SEQ ID NO: 581195 - RNA, 20 nt, Homo sapiens
ggaggcggaccuuguaguga

SEQ ID NO: 581196 - RNA, 14 nt, Homo sapiens
ccucagaugaucuc

SEQ ID NO: 581197 - RNA, 22 nt, Homo sapiens
ccucagauuccaccuagagcua

SEQ ID NO: 581198 - RNA, 14 nt, Homo sapiens
ccucagccagagaa

SEQ ID NO: 581199 - RNA, 16 nt, Homo sapiens
ccucagccaguggcac

SEQ ID NO: 581200 - RNA, 15 nt, Homo sapiens
ccucagccaugggaa

SEQ ID NO: 581201 - RNA, 18 nt, Homo sapiens
ccucagccccuccagucg

SEQ ID NO: 581202 - RNA, 18 nt, Homo sapiens
ccucagccuccaccaucc

SEQ ID NO: 581203 - RNA, 19 nt, Homo sapiens
ccucagccugcccaccucu

SEQ ID NO: 581204 - RNA, 20 nt, Homo sapiens
ccucagcugccucacuuccu

SEQ ID NO: 581205 - RNA, 15 nt, Homo sapiens
ccucaggagaaagua

SEQ ID NO: 581206 - RNA, 17 nt, Homo sapiens
ccucaggcaggugggau

SEQ ID NO: 581207 - RNA, 21 nt, Homo sapiens
ccucucccccuccuccaggga

SEQ ID NO: 581208 - RNA, 20 nt, Homo sapiens
ccucucccgucagggcccaa

SEQ ID NO: 581209 - RNA, 23 nt, Homo sapiens
ccucuccuacucggcucugcagu

SEQ ID NO: 581210 - RNA, 17 nt, Homo sapiens
ccucuccuccucagcug

SEQ ID NO: 581211 - RNA, 20 nt, Homo sapiens
ccucuccuucccacaaaaga

SEQ ID NO: 581212 - RNA, 11 nt, Homo sapiens
ccucucuagca

SEQ ID NO: 581213 - RNA, 12 nt, Homo sapiens
ccucucucagga

SEQ ID NO: 581214 - RNA, 14 nt, Homo sapiens
ccucucucauuccc

SEQ ID NO: 581215 - RNA, 19 nt, Homo sapiens
ccucucucccuagugccuu

SEQ ID NO: 581216 - RNA, 22 nt, Homo sapiens
ccucucugaacugcaacacugg

SEQ ID NO: 581217 - RNA, 13 nt, Homo sapiens
ccucucugcuccu

SEQ ID NO: 581218 - RNA, 12 nt, Homo sapiens
ccucucuggaaa

SEQ ID NO: 581219 - RNA, 11 nt, Homo sapiens
ccucucuugcc

SEQ ID NO: 581220 - RNA, 12 nt, Homo sapiens
ccucucuugccc

SEQ ID NO: 581221 - RNA, 15 nt, Homo sapiens
ccucucuuucucugg

SEQ ID NO: 581222 - RNA, 14 nt, Homo sapiens
ccucugaaaaccaa

SEQ ID NO: 581223 - RNA, 14 nt, Homo sapiens
ccucugaacccccu

SEQ ID NO: 581224 - RNA, 16 nt, Homo sapiens
ccucugaacuugccuu

SEQ ID NO: 581225 - RNA, 17 nt, Homo sapiens
ccucugaacuugccuua

SEQ ID NO: 581226 - RNA, 17 nt, Homo sapiens
ccucugaccugcacugg

SEQ ID NO: 581227 - RNA, 20 nt, Homo sapiens
ccucugacuaguagauuucu

SEQ ID NO: 581228 - RNA, 22 nt, Homo sapiens
ccucugaguuuugaugcuguau

SEQ ID NO: 581229 - RNA, 19 nt, Homo sapiens
ccucugauacccagagcau

SEQ ID NO: 581230 - RNA, 14 nt, Homo sapiens
ccucugcagcacuu

SEQ ID NO: 581231 - RNA, 11 nt, Homo sapiens
ccucugcauuu

SEQ ID NO: 581232 - RNA, 20 nt, Homo sapiens
ccucugccagcgccaaaaca

SEQ ID NO: 581233 - RNA, 16 nt, Homo sapiens
ccucugccaggugcuu

SEQ ID NO: 581234 - RNA, 20 nt, Homo sapiens
ccucugccucuuggguucaa

SEQ ID NO: 581235 - RNA, 20 nt, Homo sapiens
ccucugccugggcucuggaa

SEQ ID NO: 581236 - RNA, 20 nt, Homo sapiens
ccucugccuuguccugaugc

SEQ ID NO: 581237 - RNA, 20 nt, Homo sapiens
ccucugcgucuuuuuacuca

SEQ ID NO: 581238 - RNA, 21 nt, Homo sapiens
ccucugcuacuccauccugaa

SEQ ID NO: 581239 - RNA, 12 nt, Homo sapiens
ccucugcucagg

SEQ ID NO: 581240 - RNA, 20 nt, Homo sapiens
ccucugcugagugcugggca

SEQ ID NO: 581241 - RNA, 13 nt, Homo sapiens
ccucugcugggaa

SEQ ID NO: 581242 - RNA, 19 nt, Homo sapiens
ccucuggaaucuuccccaa

SEQ ID NO: 581243 - RNA, 13 nt, Homo sapiens
ccucuggacaguu

SEQ ID NO: 581244 - RNA, 16 nt, Homo sapiens
ccucuggagcccuaac

SEQ ID NO: 581245 - RNA, 13 nt, Homo sapiens
ccucuggcucuca

SEQ ID NO: 581246 - RNA, 21 nt, Homo sapiens
ccucuggcuggcuaacuggaa

SEQ ID NO: 581247 - RNA, 18 nt, Homo sapiens
ccucugguaggaggcaaa

SEQ ID NO: 581248 - RNA, 21 nt, Homo sapiens
ccucuggucgcuccugcccac

SEQ ID NO: 581249 - RNA, 23 nt, Homo sapiens
ccucugguuuuccucugcuccuc

SEQ ID NO: 581250 - RNA, 22 nt, Homo sapiens
ccucuguccaaacauuucaucc

SEQ ID NO: 581251 - RNA, 21 nt, Homo sapiens
ccucugucggcuuuuugccau

SEQ ID NO: 581252 - RNA, 11 nt, Homo sapiens
ccucuguggac

SEQ ID NO: 581253 - RNA, 17 nt, Homo sapiens
ccucuguucauuucaca

SEQ ID NO: 581254 - RNA, 13 nt, Homo sapiens
ccucuuaaaucau

SEQ ID NO: 581255 - RNA, 16 nt, Homo sapiens
ccucuuaccaacaucu

SEQ ID NO: 581256 - RNA, 18 nt, Homo sapiens
ccucuuccagcaacugaa

SEQ ID NO: 581257 - RNA, 13 nt, Homo sapiens
ccucuucccauga

SEQ ID NO: 581258 - RNA, 17 nt, Homo sapiens
ccucuucccaugacugc

SEQ ID NO: 581259 - RNA, 20 nt, Homo sapiens
ccucuucucaagugccuuaa

SEQ ID NO: 581260 - RNA, 22 nt, Homo sapiens
ccucuucucuugacagucugaa

SEQ ID NO: 581261 - RNA, 23 nt, Homo sapiens
ccucuugaguuccucugcaguuu

SEQ ID NO: 581262 - RNA, 10 nt, Homo sapiens
ccucuugccc

SEQ ID NO: 581263 - RNA, 13 nt, Homo sapiens
ccucuugcugucu

SEQ ID NO: 581264 - RNA, 22 nt, Homo sapiens
ccucuuggagaagucucagcua

SEQ ID NO: 581265 - RNA, 23 nt, Homo sapiens
ccucuuguaagucaucuacuuaa

SEQ ID NO: 581266 - RNA, 22 nt, Homo sapiens
ccucuuguugcagagauuuccu

SEQ ID NO: 581267 - RNA, 13 nt, Homo sapiens
ccucuuguuucug

SEQ ID NO: 581268 - RNA, 23 nt, Homo sapiens
ccucuuuaaucaugaaacaccuu

SEQ ID NO: 581269 - RNA, 15 nt, Homo sapiens
ccucuuuacucuggg

SEQ ID NO: 581270 - RNA, 20 nt, Homo sapiens
ccucuuuauuuuuugauuga

SEQ ID NO: 581271 - RNA, 13 nt, Homo sapiens
ccucuuucaucca

SEQ ID NO: 581272 - RNA, 13 nt, Homo sapiens
ccucuuuguagca

SEQ ID NO: 581273 - RNA, 14 nt, Homo sapiens
ccucuuugucccag

SEQ ID NO: 581274 - RNA, 23 nt, Homo sapiens
ccucuuuucugcaucaucuguag

SEQ ID NO: 581275 - RNA, 21 nt, Homo sapiens
ccucuuuuguuguccuugccc

SEQ ID NO: 581276 - RNA, 16 nt, Homo sapiens
ccucuuuuucuuacca

SEQ ID NO: 581277 - RNA, 20 nt, Homo sapiens
ccugaaaaggacuucuggcu

SEQ ID NO: 581278 - RNA, 18 nt, Homo sapiens
ccugaaaaggguguugcu

SEQ ID NO: 581279 - RNA, 13 nt, Homo sapiens
ccugaaaauaugu

SEQ ID NO: 581280 - RNA, 14 nt, Homo sapiens
ccugaaacacugga

SEQ ID NO: 581281 - RNA, 16 nt, Homo sapiens
ccugaaacacuggacc

SEQ ID NO: 581282 - RNA, 19 nt, Homo sapiens
ccugaaacaugaacccaaa

SEQ ID NO: 581283 - RNA, 20 nt, Homo sapiens
ccugaaacaugaacccaaaa

SEQ ID NO: 581284 - RNA, 15 nt, Homo sapiens
ccugaaagacaguau

SEQ ID NO: 581285 - RNA, 12 nt, Homo sapiens
ccugaaagccac

SEQ ID NO: 581286 - RNA, 14 nt, Homo sapiens
ccugaaagccacaa

SEQ ID NO: 581287 - RNA, 22 nt, Homo sapiens
ccugaaaugccaagugccugcu

SEQ ID NO: 581288 - RNA, 23 nt, Homo sapiens
ccugaaauuucucauuaguggua

SEQ ID NO: 581289 - RNA, 19 nt, Homo sapiens
ccugaaccuggagcacuua

SEQ ID NO: 581290 - RNA, 13 nt, Homo sapiens
ccugaacuugccu

SEQ ID NO: 581291 - RNA, 21 nt, Homo sapiens
ccugaagaacaguaacugcca

SEQ ID NO: 581292 - RNA, 22 nt, Homo sapiens
ccugaagacugaggacaaagug

SEQ ID NO: 581293 - RNA, 22 nt, Homo sapiens
ccugaagaucaagccaguucuc

SEQ ID NO: 581294 - RNA, 13 nt, Homo sapiens
ccugaagcuggcc

SEQ ID NO: 581295 - RNA, 20 nt, Homo sapiens
ccugaagcuggccuggacca

SEQ ID NO: 581296 - RNA, 20 nt, Homo sapiens
ccugaaggaaaauaaacuga

SEQ ID NO: 581297 - RNA, 18 nt, Homo sapiens
ccugaaggaaaaugacuc

SEQ ID NO: 581298 - RNA, 21 nt, Homo sapiens
ccugaagggaaggcaaaggca

SEQ ID NO: 581299 - RNA, 15 nt, Homo sapiens
ccugaaggugccacu

SEQ ID NO: 581300 - RNA, 18 nt, Homo sapiens
ccugaauacaagccuaug

SEQ ID NO: 581301 - RNA, 14 nt, Homo sapiens
ccugaaucugugca

SEQ ID NO: 581302 - RNA, 22 nt, Homo sapiens
ccugaaucugugccugcacuga

SEQ ID NO: 581303 - RNA, 18 nt, Homo sapiens
ccugaaugguuccaugcc

SEQ ID NO: 581304 - RNA, 21 nt, Homo sapiens
ccugaauucuuuuucauuuga

SEQ ID NO: 581305 - RNA, 18 nt, Homo sapiens
ccugacaaaaacaagcaa

SEQ ID NO: 581306 - RNA, 19 nt, Homo sapiens
ccugacaaguuauuacugu

SEQ ID NO: 581307 - RNA, 17 nt, Homo sapiens
ccugacacccugggcuu

SEQ ID NO: 581308 - RNA, 15 nt, Homo sapiens
ccugacagaugucag

SEQ ID NO: 581309 - RNA, 14 nt, Homo sapiens
ccugaccacccucc

SEQ ID NO: 581310 - RNA, 14 nt, Homo sapiens
ccugaccauugccc

SEQ ID NO: 581311 - RNA, 15 nt, Homo sapiens
ccugacccaacaccc

SEQ ID NO: 581312 - RNA, 20 nt, Homo sapiens
ccugacccuccuccacucca

SEQ ID NO: 581313 - RNA, 12 nt, Homo sapiens
ccugacccugua

SEQ ID NO: 581314 - RNA, 18 nt, Homo sapiens
ccugaccgguuugcuaca

SEQ ID NO: 581315 - RNA, 22 nt, Homo sapiens
ccugaccgguuugcuacauucu

SEQ ID NO: 581316 - RNA, 15 nt, Homo sapiens
ccugaccuccgcccc

SEQ ID NO: 581317 - RNA, 16 nt, Homo sapiens
ccugaccugagacugu

SEQ ID NO: 581318 - RNA, 19 nt, Homo sapiens
ccugaccugucaccgugag

SEQ ID NO: 581319 - RNA, 23 nt, Homo sapiens
ccugacggcuggggacccaccca

SEQ ID NO: 581320 - RNA, 20 nt, Homo sapiens
ccugacuccucuaagccacu

SEQ ID NO: 581321 - RNA, 14 nt, Homo sapiens
ccugacuggccaaa

SEQ ID NO: 581322 - RNA, 16 nt, Homo sapiens
ggauuguuacagcuuc

SEQ ID NO: 581323 - RNA, 18 nt, Homo sapiens
ggauuuagagauacuguu

SEQ ID NO: 581324 - RNA, 14 nt, Homo sapiens
ggauuuaguguuuc

SEQ ID NO: 581325 - RNA, 17 nt, Homo sapiens
ggauuuauaaagcaaau

SEQ ID NO: 581326 - RNA, 15 nt, Homo sapiens
ggauuuccagggaua

SEQ ID NO: 581327 - RNA, 23 nt, Homo sapiens
ggauuugaagcaaagcaccagcu

SEQ ID NO: 581328 - RNA, 21 nt, Homo sapiens
ggauuuuaacuuaacugaaau

SEQ ID NO: 581329 - RNA, 23 nt, Homo sapiens
ccuuaagaagucuauaaugcaau

SEQ ID NO: 581330 - RNA, 12 nt, Homo sapiens
ccuuaagccaac

SEQ ID NO: 581331 - RNA, 15 nt, Homo sapiens
ccuuaagugcugcag

SEQ ID NO: 581332 - RNA, 23 nt, Homo sapiens
ccuuaauaacauacaaugaccac

SEQ ID NO: 581333 - RNA, 17 nt, Homo sapiens
ccuuaauagacuucucu

SEQ ID NO: 581334 - RNA, 16 nt, Homo sapiens
ccuuaauauacuacuu

SEQ ID NO: 581335 - RNA, 12 nt, Homo sapiens
ccuuaauaugcu

SEQ ID NO: 581336 - RNA, 15 nt, Homo sapiens
ccuuaauauguuaac

SEQ ID NO: 581337 - RNA, 16 nt, Homo sapiens
ccuuaaugacaacacu

SEQ ID NO: 581338 - RNA, 19 nt, Homo sapiens
ccuuaaugacaacacuuaa

SEQ ID NO: 581339 - RNA, 23 nt, Homo sapiens
ccuuaaugauccguuccauugca

SEQ ID NO: 581340 - RNA, 21 nt, Homo sapiens
ccuuaauuuaagucauuuuca

SEQ ID NO: 581341 - RNA, 16 nt, Homo sapiens
ccuuacaaguuagaaa

SEQ ID NO: 581342 - RNA, 18 nt, Homo sapiens
ccuuacagaacuacuucu

SEQ ID NO: 581343 - RNA, 16 nt, Homo sapiens
ccuuacucugccagag

SEQ ID NO: 581344 - RNA, 19 nt, Homo sapiens
ccuuagaaaacaaguauug

SEQ ID NO: 581345 - RNA, 19 nt, Homo sapiens
ccuuagagauugccccaga

SEQ ID NO: 581346 - RNA, 16 nt, Homo sapiens
ccuuagauaccuugaa

SEQ ID NO: 581347 - RNA, 17 nt, Homo sapiens
ccuuagauaccuugaaa

SEQ ID NO: 581348 - RNA, 23 nt, Homo sapiens
ccuuagcuauucccagggaaccc

SEQ ID NO: 581349 - RNA, 22 nt, Homo sapiens
ccuuagcuggcauuacagcugg

SEQ ID NO: 581350 - RNA, 13 nt, Homo sapiens
ccuuagucuuucc

SEQ ID NO: 581351 - RNA, 21 nt, Homo sapiens
ccuuagugccaggagggcaca

SEQ ID NO: 581352 - RNA, 12 nt, Homo sapiens
ccuuauaguguu

SEQ ID NO: 581353 - RNA, 14 nt, Homo sapiens
ccuuaucugucaca

SEQ ID NO: 581354 - RNA, 19 nt, Homo sapiens
ccuuaucuuucuaaaacug

SEQ ID NO: 581355 - RNA, 12 nt, Homo sapiens
ccuuauggagcu

SEQ ID NO: 581356 - RNA, 20 nt, Homo sapiens
ccuuaugucuccugaccuga

SEQ ID NO: 581357 - RNA, 21 nt, Homo sapiens
ccuuauuaaagguaugcauuu

SEQ ID NO: 581358 - RNA, 20 nt, Homo sapiens
ccuuauuagagugucuuucc

SEQ ID NO: 581359 - RNA, 22 nt, Homo sapiens
ccuuauuaguuacaaaguuaua

SEQ ID NO: 581360 - RNA, 16 nt, Homo sapiens
ccuuauucccaguguu

SEQ ID NO: 581361 - RNA, 22 nt, Homo sapiens
ccuuauugcugccaaaaccaca

SEQ ID NO: 581362 - RNA, 13 nt, Homo sapiens
ccuuauuucucuc

SEQ ID NO: 581363 - RNA, 14 nt, Homo sapiens
ccuuauuugucugu

SEQ ID NO: 581364 - RNA, 15 nt, Homo sapiens
ccuucaauacuuaaa

SEQ ID NO: 581365 - RNA, 15 nt, Homo sapiens
ccuucaauggaagga

SEQ ID NO: 581366 - RNA, 17 nt, Homo sapiens
ccuucaccuccagguuc

SEQ ID NO: 581367 - RNA, 18 nt, Homo sapiens
ccuucacuucugaccaca

SEQ ID NO: 581368 - RNA, 12 nt, Homo sapiens
ccuucacuuuac

SEQ ID NO: 581369 - RNA, 15 nt, Homo sapiens
ccuucagaagcuauu

SEQ ID NO: 581370 - RNA, 16 nt, Homo sapiens
ccuucagcgauuauuu

SEQ ID NO: 581371 - RNA, 16 nt, Homo sapiens
ccuucagcuccaggga

SEQ ID NO: 581372 - RNA, 19 nt, Homo sapiens
ccuucaggcagccagugug

SEQ ID NO: 581373 - RNA, 15 nt, Homo sapiens
ccuucagggacucaa

SEQ ID NO: 581374 - RNA, 22 nt, Homo sapiens
ccuucaggguuggauguaguuu

SEQ ID NO: 581375 - RNA, 22 nt, Homo sapiens
ccuucaggguuuaauagacuga

SEQ ID NO: 581376 - RNA, 15 nt, Homo sapiens
ccuucagucugcucc

SEQ ID NO: 581377 - RNA, 17 nt, Homo sapiens
ccuucaguuuauuucca

SEQ ID NO: 581378 - RNA, 12 nt, Homo sapiens
ccuucaucugaa

SEQ ID NO: 581379 - RNA, 18 nt, Homo sapiens
ccuucaucugggacaaaa

SEQ ID NO: 581380 - RNA, 19 nt, Homo sapiens
ccuucaucuucacugcaau

SEQ ID NO: 581381 - RNA, 21 nt, Homo sapiens
ccuucaucuuccuguguccug

SEQ ID NO: 581382 - RNA, 20 nt, Homo sapiens
ccuucauuaacaaaauguau

SEQ ID NO: 581383 - RNA, 21 nt, Homo sapiens
ccuucauuuuuaagacuguaa

SEQ ID NO: 581384 - RNA, 14 nt, Homo sapiens
ccuuccacagugaa

SEQ ID NO: 581385 - RNA, 13 nt, Homo sapiens
ccuuccacuguag

SEQ ID NO: 581386 - RNA, 20 nt, Homo sapiens
ccuuccacuuugaguaccaa

SEQ ID NO: 581387 - RNA, 18 nt, Homo sapiens
ccuuccagaucacugcca

SEQ ID NO: 581388 - RNA, 20 nt, Homo sapiens
ccuuccagaucacugccaca

SEQ ID NO: 581389 - RNA, 23 nt, Homo sapiens
ccuuccagcccagacccccagug

SEQ ID NO: 581390 - RNA, 21 nt, Homo sapiens
ccuuccauagccuaaucccug

SEQ ID NO: 581391 - RNA, 17 nt, Homo sapiens
ccuucccacacugucca

SEQ ID NO: 581392 - RNA, 12 nt, Homo sapiens
ccuucccagugg

SEQ ID NO: 581393 - RNA, 20 nt, Homo sapiens
ccuuccccaaaggaugguca

SEQ ID NO: 581394 - RNA, 20 nt, Homo sapiens
ccuuccccacuucugugcca

SEQ ID NO: 581395 - RNA, 23 nt, Homo sapiens
ccuucccuagcuuuagacccugg

SEQ ID NO: 581396 - RNA, 19 nt, Homo sapiens
ccuuccgacccucugggaa

SEQ ID NO: 581397 - RNA, 17 nt, Homo sapiens
ccuuccuaaacccaaug

SEQ ID NO: 581398 - RNA, 10 nt, Homo sapiens
ccuuccucac

SEQ ID NO: 581399 - RNA, 18 nt, Homo sapiens
ccuuccucaccacuuccc

SEQ ID NO: 581400 - RNA, 19 nt, Homo sapiens
ccuuccucagaacuuucua

SEQ ID NO: 581401 - RNA, 13 nt, Homo sapiens
ccuuccuccauug

SEQ ID NO: 581402 - RNA, 17 nt, Homo sapiens
ccuuccuccucugcucu

SEQ ID NO: 581403 - RNA, 21 nt, Homo sapiens
ccuuccucucaagcuagccag

SEQ ID NO: 581404 - RNA, 16 nt, Homo sapiens
ccuuccuggcacucuc

SEQ ID NO: 581405 - RNA, 17 nt, Homo sapiens
ccuuccuggcacucuca

SEQ ID NO: 581406 - RNA, 14 nt, Homo sapiens
ccuuccugggaccc

SEQ ID NO: 581407 - RNA, 21 nt, Homo sapiens
ccuuccuuuaggucugguugu

SEQ ID NO: 581408 - RNA, 15 nt, Homo sapiens
ccuucgaguccagga

SEQ ID NO: 581409 - RNA, 22 nt, Homo sapiens
ccuucgcuuaagccagcacuca

SEQ ID NO: 581410 - RNA, 18 nt, Homo sapiens
ccuucggagccaacaaga

SEQ ID NO: 581411 - RNA, 22 nt, Homo sapiens
ccuucuagaacaccugccuucu

SEQ ID NO: 581412 - RNA, 17 nt, Homo sapiens
ccuucuagugagccugg

SEQ ID NO: 581413 - RNA, 21 nt, Homo sapiens
ccuucuauguauuagugucaa

SEQ ID NO: 581414 - RNA, 12 nt, Homo sapiens
ccuucuccaaau

SEQ ID NO: 581415 - RNA, 15 nt, Homo sapiens
ccuucuccaccaaag

SEQ ID NO: 581416 - RNA, 16 nt, Homo sapiens
ccuucuccaccaaaga

SEQ ID NO: 581417 - RNA, 22 nt, Homo sapiens
ccuucuccaccaaagacaguug

SEQ ID NO: 581418 - RNA, 16 nt, Homo sapiens
ccuucucccacacugc

SEQ ID NO: 581419 - RNA, 18 nt, Homo sapiens
ccuucucccacacugcua

SEQ ID NO: 581420 - RNA, 21 nt, Homo sapiens
ccuucucgcuuuugccauuag

SEQ ID NO: 581421 - RNA, 19 nt, Homo sapiens
ccuucucggagacccauug

SEQ ID NO: 581422 - RNA, 19 nt, Homo sapiens
ccuucucuacacucuugua

SEQ ID NO: 581423 - RNA, 18 nt, Homo sapiens
ccuucucugcagcucuga

SEQ ID NO: 581424 - RNA, 23 nt, Homo sapiens
ccuucucuguagggaacucuggg

SEQ ID NO: 581425 - RNA, 23 nt, Homo sapiens
ccuucugauugauggugcuauuu

SEQ ID NO: 581426 - RNA, 12 nt, Homo sapiens
ccuucugccaac

SEQ ID NO: 581427 - RNA, 20 nt, Homo sapiens
ccuucugggacuggacagcu

SEQ ID NO: 581428 - RNA, 22 nt, Homo sapiens
ccuucugggacuggacagcuuu

SEQ ID NO: 581429 - RNA, 21 nt, Homo sapiens
ccuucugugccggcuuucaag

SEQ ID NO: 581430 - RNA, 14 nt, Homo sapiens
ccuucuguggcuca

SEQ ID NO: 581431 - RNA, 23 nt, Homo sapiens
ccuucuucccgccccaccuccca

SEQ ID NO: 581432 - RNA, 19 nt, Homo sapiens
ccuucuuggcuucugggac

SEQ ID NO: 581433 - RNA, 22 nt, Homo sapiens
ccuucuuuugaaggacuccuua

SEQ ID NO: 581434 - RNA, 13 nt, Homo sapiens
ccuugaaccaaua

SEQ ID NO: 581435 - RNA, 16 nt, Homo sapiens
ccuugacuucuuugag

SEQ ID NO: 581436 - RNA, 17 nt, Homo sapiens
ccuugacuuugcuccuc

SEQ ID NO: 581437 - RNA, 16 nt, Homo sapiens
ccuugaggaggggcag

SEQ ID NO: 581438 - RNA, 17 nt, Homo sapiens
ccuugaggauuguggaa

SEQ ID NO: 581439 - RNA, 13 nt, Homo sapiens
ccuugaggggcua

SEQ ID NO: 581440 - RNA, 15 nt, Homo sapiens
ccuugagucagaaaa

SEQ ID NO: 581441 - RNA, 14 nt, Homo sapiens
ccuugauaauacuu

SEQ ID NO: 581442 - RNA, 15 nt, Homo sapiens
ccuugaucagugaca

SEQ ID NO: 581443 - RNA, 17 nt, Homo sapiens
ccuugaucuuaacaaag

SEQ ID NO: 581444 - RNA, 19 nt, Homo sapiens
ccuugauggaaauugacca

SEQ ID NO: 581445 - RNA, 21 nt, Homo sapiens
ccuugaugggucaaccuuugu

SEQ ID NO: 581446 - RNA, 20 nt, Homo sapiens
ccuugcaaauaaucacagau

SEQ ID NO: 581447 - RNA, 14 nt, Homo sapiens
ccuugcaaccucac

SEQ ID NO: 581448 - RNA, 14 nt, Homo sapiens
ccuugcaagccaua

SEQ ID NO: 581449 - RNA, 21 nt, Homo sapiens
ccuugcaaucuucuacuuuaa

SEQ ID NO: 581450 - RNA, 17 nt, Homo sapiens
gagaagggggcucugcc

SEQ ID NO: 581451 - RNA, 18 nt, Homo sapiens
gagaagucaaacauuuca

SEQ ID NO: 581452 - RNA, 17 nt, Homo sapiens
gagaagucuaacgcuga

SEQ ID NO: 581453 - RNA, 20 nt, Homo sapiens
gagaagucuuagacuugaaa

SEQ ID NO: 581454 - RNA, 16 nt, Homo sapiens
gagaaguugcugcuug

SEQ ID NO: 581455 - RNA, 18 nt, Homo sapiens
gagaauaccuuggucuca

SEQ ID NO: 581456 - RNA, 14 nt, Homo sapiens
gagaauauaccuua

SEQ ID NO: 581457 - RNA, 17 nt, Homo sapiens
gagaauauguaauacuu

SEQ ID NO: 581458 - RNA, 17 nt, Homo sapiens
gagaaucacuugcacuc

SEQ ID NO: 581459 - RNA, 18 nt, Homo sapiens
gagaauccugccucuccc

SEQ ID NO: 581460 - RNA, 21 nt, Homo sapiens
gagaaucugagacaucuugcc

SEQ ID NO: 581461 - RNA, 21 nt, Homo sapiens
gagaauguguuucaaaaccau

SEQ ID NO: 581462 - RNA, 22 nt, Homo sapiens
gagaauguguuucaaaaccaug

SEQ ID NO: 581463 - RNA, 16 nt, Homo sapiens
gagaauguuccagaca

SEQ ID NO: 581464 - RNA, 22 nt, Homo sapiens
gagaauuccuuuuucuucuuua

SEQ ID NO: 581465 - RNA, 21 nt, Homo sapiens
gagaauuuccaaaacuuuaau

SEQ ID NO: 581466 - RNA, 13 nt, Homo sapiens
gagacaaagcagg

SEQ ID NO: 581467 - RNA, 13 nt, Homo sapiens
gagacaaaucuca

SEQ ID NO: 581468 - RNA, 13 nt, Homo sapiens
gagacaacaguac

SEQ ID NO: 581469 - RNA, 17 nt, Homo sapiens
gagacaccaccuauacc

SEQ ID NO: 581470 - RNA, 22 nt, Homo sapiens
gagacacuauuuaucugugcaa

SEQ ID NO: 581471 - RNA, 23 nt, Homo sapiens
gagacacuauuuaucugugcaaa

SEQ ID NO: 581472 - RNA, 11 nt, Homo sapiens
gagacacucca

SEQ ID NO: 581473 - RNA, 16 nt, Homo sapiens
gagacagaacugucca

SEQ ID NO: 581474 - RNA, 12 nt, Homo sapiens
gagacagaauag

SEQ ID NO: 581475 - RNA, 20 nt, Homo sapiens
gagacagaauagagugauag

SEQ ID NO: 581476 - RNA, 16 nt, Homo sapiens
gagacagaccacuugc

SEQ ID NO: 581477 - RNA, 18 nt, Homo sapiens
gagacagaccgggguuca

SEQ ID NO: 581478 - RNA, 19 nt, Homo sapiens
gagacagagacaaguaauu

SEQ ID NO: 581479 - RNA, 14 nt, Homo sapiens
gagacagauaccuc

SEQ ID NO: 581480 - RNA, 19 nt, Homo sapiens
gagacagcugauacuucau

SEQ ID NO: 581481 - RNA, 17 nt, Homo sapiens
gagacaggguuucaccg

SEQ ID NO: 581482 - RNA, 17 nt, Homo sapiens
gagacaggguuucacug

SEQ ID NO: 581483 - RNA, 21 nt, Homo sapiens
gagacagucuggaaagugaug

SEQ ID NO: 581484 - RNA, 14 nt, Homo sapiens
gagacaguugcccg

SEQ ID NO: 581485 - RNA, 20 nt, Homo sapiens
gagacaguuuacuuugccaa

SEQ ID NO: 581486 - RNA, 19 nt, Homo sapiens
gagacauguaccuugacca

SEQ ID NO: 581487 - RNA, 11 nt, Homo sapiens
gagacauguga

SEQ ID NO: 581488 - RNA, 16 nt, Homo sapiens
gagacaugugacauuu

SEQ ID NO: 581489 - RNA, 15 nt, Homo sapiens
gagaccacacauuuu

SEQ ID NO: 581490 - RNA, 20 nt, Homo sapiens
gagaccacaguuuaccucag

SEQ ID NO: 581491 - RNA, 22 nt, Homo sapiens
gagacccaccuucaagcagcug

SEQ ID NO: 581492 - RNA, 23 nt, Homo sapiens
gagacccccacaccucaguuccc

SEQ ID NO: 581493 - RNA, 22 nt, Homo sapiens
gagaccccuuguugcacugccc

SEQ ID NO: 581494 - RNA, 19 nt, Homo sapiens
gagaccuagagaucuggcu

SEQ ID NO: 581495 - RNA, 16 nt, Homo sapiens
gagaccucaugccaug

SEQ ID NO: 581496 - RNA, 13 nt, Homo sapiens
gagaccuccaaua

SEQ ID NO: 581497 - RNA, 16 nt, Homo sapiens
gagaccuggaaccaga

SEQ ID NO: 581498 - RNA, 21 nt, Homo sapiens
gagacgggguuucaccauguu

SEQ ID NO: 581499 - RNA, 17 nt, Homo sapiens
gagacguggaaccucug

SEQ ID NO: 581500 - RNA, 16 nt, Homo sapiens
gagacuccgucacaac

SEQ ID NO: 581501 - RNA, 20 nt, Homo sapiens
gagacuccgucacaacaaca

SEQ ID NO: 581502 - RNA, 18 nt, Homo sapiens
gagacugcccuucucacg

SEQ ID NO: 581503 - RNA, 20 nt, Homo sapiens
gagacugggagccacuucuc

SEQ ID NO: 581504 - RNA, 20 nt, Homo sapiens
gagacuucacgggcaaucau

SEQ ID NO: 581505 - RNA, 19 nt, Homo sapiens
gagacuugaaaccagaaga

SEQ ID NO: 581506 - RNA, 16 nt, Homo sapiens
gagacuuggggccagc

SEQ ID NO: 581507 - RNA, 15 nt, Homo sapiens
gagacuugggggcca

SEQ ID NO: 581508 - RNA, 15 nt, Homo sapiens
gagacuuuccauuaa

SEQ ID NO: 581509 - RNA, 12 nt, Homo sapiens
gagagaacugaa

SEQ ID NO: 581510 - RNA, 22 nt, Homo sapiens
gagagagauggacauggcucau

SEQ ID NO: 581511 - RNA, 14 nt, Homo sapiens
gagagagcucugca

SEQ ID NO: 581512 - RNA, 17 nt, Homo sapiens
gagagaggcugccucag

SEQ ID NO: 581513 - RNA, 18 nt, Homo sapiens
gagagaggcugccucagc

SEQ ID NO: 581514 - RNA, 16 nt, Homo sapiens
gagagauucugugauc

SEQ ID NO: 581515 - RNA, 15 nt, Homo sapiens
gagagauucuucccc

SEQ ID NO: 581516 - RNA, 17 nt, Homo sapiens
gagagcagcaggugcug

SEQ ID NO: 581517 - RNA, 20 nt, Homo sapiens
gagagcagcuggcucuccac

SEQ ID NO: 581518 - RNA, 22 nt, Homo sapiens
gagagcagcuuuaaacucaggg

SEQ ID NO: 581519 - RNA, 19 nt, Homo sapiens
cugagucucugaggggcua

SEQ ID NO: 581520 - RNA, 15 nt, Homo sapiens
cugagugcaccacuu

SEQ ID NO: 581521 - RNA, 15 nt, Homo sapiens
cugggagcacaggca

SEQ ID NO: 581522 - RNA, 20 nt, Homo sapiens
cugggagcacaggcacugca

SEQ ID NO: 581523 - RNA, 20 nt, Homo sapiens
cugggaggcaucaguugcua

SEQ ID NO: 581524 - RNA, 16 nt, Homo sapiens
cagagcgcacagggag

SEQ ID NO: 581525 - RNA, 15 nt, Homo sapiens
cagagcgugcuuuca

SEQ ID NO: 581526 - RNA, 17 nt, Homo sapiens
cagagcugaagaacuug

SEQ ID NO: 581527 - RNA, 22 nt, Homo sapiens
cagagcugccucucgguggcca

SEQ ID NO: 581528 - RNA, 16 nt, Homo sapiens
cagagcuggaaggcag

SEQ ID NO: 581529 - RNA, 15 nt, Homo sapiens
cagagcuucccugac

SEQ ID NO: 581530 - RNA, 13 nt, Homo sapiens
cagagcuuuucag

SEQ ID NO: 581531 - RNA, 14 nt, Homo sapiens
cagaggaaguggaa

SEQ ID NO: 581532 - RNA, 16 nt, Homo sapiens
cagaggaauccuggca

SEQ ID NO: 581533 - RNA, 17 nt, Homo sapiens
cagaggaaugaugggcu

SEQ ID NO: 581534 - RNA, 14 nt, Homo sapiens
cagaggacacagag

SEQ ID NO: 581535 - RNA, 22 nt, Homo sapiens
cagaggacacaggcagcuucca

SEQ ID NO: 581536 - RNA, 18 nt, Homo sapiens
cagaggagauguggucaa

SEQ ID NO: 581537 - RNA, 21 nt, Homo sapiens
cagaggagccaccaguucuca

SEQ ID NO: 581538 - RNA, 23 nt, Homo sapiens
cagaggagcggccagaagaucua

SEQ ID NO: 581539 - RNA, 22 nt, Homo sapiens
cagaggaggggccgcugccacc

SEQ ID NO: 581540 - RNA, 22 nt, Homo sapiens
cagaggauuucuuuagugucau

SEQ ID NO: 581541 - RNA, 22 nt, Homo sapiens
cagaggcagcccgcacaccugc

SEQ ID NO: 581542 - RNA, 20 nt, Homo sapiens
cagaggccgcgcguccagcu

SEQ ID NO: 581543 - RNA, 21 nt, Homo sapiens
cagaggccugcugccagugca

SEQ ID NO: 581544 - RNA, 15 nt, Homo sapiens
cagaggccuugucau

SEQ ID NO: 581545 - RNA, 14 nt, Homo sapiens
cagaggcucuaaug

SEQ ID NO: 581546 - RNA, 19 nt, Homo sapiens
cagaggcucuaauguacaa

SEQ ID NO: 581547 - RNA, 22 nt, Homo sapiens
cagaggcucuaauguacaauaa

SEQ ID NO: 581548 - RNA, 16 nt, Homo sapiens
cagaggcuggcacuga

SEQ ID NO: 581549 - RNA, 13 nt, Homo sapiens
cagagggagacag

SEQ ID NO: 581550 - RNA, 21 nt, Homo sapiens
cagagggcaguggcccuccac

SEQ ID NO: 581551 - RNA, 23 nt, Homo sapiens
cagagggccccgcccagugcagu

SEQ ID NO: 581552 - RNA, 14 nt, Homo sapiens
cagaggggaaacca

SEQ ID NO: 581553 - RNA, 15 nt, Homo sapiens
cagaggucucccaaa

SEQ ID NO: 581554 - RNA, 17 nt, Homo sapiens
cagaggucugugcugag

SEQ ID NO: 581555 - RNA, 16 nt, Homo sapiens
cagaggucuucagggc

SEQ ID NO: 581556 - RNA, 14 nt, Homo sapiens
cagaggucuuucag

SEQ ID NO: 581557 - RNA, 22 nt, Homo sapiens
cagaggugauucuuacauauga

SEQ ID NO: 581558 - RNA, 20 nt, Homo sapiens
cagaggugggcagguggugg

SEQ ID NO: 581559 - RNA, 15 nt, Homo sapiens
cagagguucauuuca

SEQ ID NO: 581560 - RNA, 18 nt, Homo sapiens
cagagguugcagugagcc

SEQ ID NO: 581561 - RNA, 18 nt, Homo sapiens
cagagguuuccucuuagg

SEQ ID NO: 581562 - RNA, 21 nt, Homo sapiens
cagagguuugcuuccucagua

SEQ ID NO: 581563 - RNA, 17 nt, Homo sapiens
cagaguccagugcucug

SEQ ID NO: 581564 - RNA, 15 nt, Homo sapiens
cagaguccuuuccaa

SEQ ID NO: 581565 - RNA, 23 nt, Homo sapiens
cagagucuaggcuaagcacuuua

SEQ ID NO: 581566 - RNA, 20 nt, Homo sapiens
cagagucucgcucuguugcc

SEQ ID NO: 581567 - RNA, 21 nt, Homo sapiens
cagagucucgcucuguugccc

SEQ ID NO: 581568 - RNA, 12 nt, Homo sapiens
cagagucugccc

SEQ ID NO: 581569 - RNA, 19 nt, Homo sapiens
cagagucugggccucugac

SEQ ID NO: 581570 - RNA, 14 nt, Homo sapiens
cagagucugucucu

SEQ ID NO: 581571 - RNA, 14 nt, Homo sapiens
cagagugacaguca

SEQ ID NO: 581572 - RNA, 16 nt, Homo sapiens
cagagugacagucaua

SEQ ID NO: 581573 - RNA, 21 nt, Homo sapiens
cagagugacccucagcuguca

SEQ ID NO: 581574 - RNA, 19 nt, Homo sapiens
cagagugagggaaugguag

SEQ ID NO: 581575 - RNA, 17 nt, Homo sapiens
cagagugagugagacuc

SEQ ID NO: 581576 - RNA, 20 nt, Homo sapiens
cagagugauguccucucuca

SEQ ID NO: 581577 - RNA, 11 nt, Homo sapiens
cagagugcaag

SEQ ID NO: 581578 - RNA, 22 nt, Homo sapiens
cagaguggaguugaaacugcua

SEQ ID NO: 581579 - RNA, 12 nt, Homo sapiens
cagaguggcuca

SEQ ID NO: 581580 - RNA, 16 nt, Homo sapiens
cagaguggggagcucc

SEQ ID NO: 581581 - RNA, 20 nt, Homo sapiens
cagagugguuuccaaugugu

SEQ ID NO: 581582 - RNA, 11 nt, Homo sapiens
cagagugugaa

SEQ ID NO: 581583 - RNA, 19 nt, Homo sapiens
cagagugugcagacugaug

SEQ ID NO: 581584 - RNA, 21 nt, Homo sapiens
cagaguuagguugucuccagg

SEQ ID NO: 581585 - RNA, 17 nt, Homo sapiens
cagaguucacccugugc

SEQ ID NO: 581586 - RNA, 15 nt, Homo sapiens
cagaguucugcucua

SEQ ID NO: 581587 - RNA, 15 nt, Homo sapiens
cagaguugcaaagau

SEQ ID NO: 581588 - RNA, 15 nt, Homo sapiens
cagauaaacaacaaa

SEQ ID NO: 581589 - RNA, 16 nt, Homo sapiens
cagauaacaccaaacc

SEQ ID NO: 581590 - RNA, 17 nt, Homo sapiens
cagauaagaaggugcga

SEQ ID NO: 581591 - RNA, 15 nt, Homo sapiens
cagauaaguguaaau

SEQ ID NO: 581592 - RNA, 13 nt, Homo sapiens
cagauaaugugaa

SEQ ID NO: 581593 - RNA, 16 nt, Homo sapiens
cagauacccaguggaa

SEQ ID NO: 581594 - RNA, 12 nt, Homo sapiens
cagauacugucu

SEQ ID NO: 581595 - RNA, 21 nt, Homo sapiens
cagauacuucccauuuuggaa

SEQ ID NO: 581596 - RNA, 12 nt, Homo sapiens
cagauacuuggg

SEQ ID NO: 581597 - RNA, 17 nt, Homo sapiens
cagauagaguuccauau

SEQ ID NO: 581598 - RNA, 17 nt, Homo sapiens
cagauagauauaugcuc

SEQ ID NO: 581599 - RNA, 12 nt, Homo sapiens
cagauagcaucu

SEQ ID NO: 581600 - RNA, 23 nt, Homo sapiens
cagauaucauuuaggaguauuau

SEQ ID NO: 581601 - RNA, 16 nt, Homo sapiens
cagauaucugcaugug

SEQ ID NO: 581602 - RNA, 13 nt, Homo sapiens
cagauauguauuu

SEQ ID NO: 581603 - RNA, 12 nt, Homo sapiens
cagauauuucac

SEQ ID NO: 581604 - RNA, 22 nt, Homo sapiens
cagaucaagaaaaaaagggaga

SEQ ID NO: 581605 - RNA, 16 nt, Homo sapiens
cagaucaagcugugag

SEQ ID NO: 581606 - RNA, 18 nt, Homo sapiens
cagaucaagcugugagac

SEQ ID NO: 581607 - RNA, 15 nt, Homo sapiens
cagaucacgaacuca

SEQ ID NO: 581608 - RNA, 15 nt, Homo sapiens
cagaucauauuucac

SEQ ID NO: 581609 - RNA, 16 nt, Homo sapiens
cagauccagacuguaa

SEQ ID NO: 581610 - RNA, 18 nt, Homo sapiens
cagaucccacuugcagcc

SEQ ID NO: 581611 - RNA, 15 nt, Homo sapiens
cagauccccacuguc

SEQ ID NO: 581612 - RNA, 22 nt, Homo sapiens
cagaucgauccuggauucacuc

SEQ ID NO: 581613 - RNA, 17 nt, Homo sapiens
cagaucgcaccacugca

SEQ ID NO: 581614 - RNA, 23 nt, Homo sapiens
cagaucuaucuugucaaucccaa

SEQ ID NO: 581615 - RNA, 13 nt, Homo sapiens
cagaucugcauuu

SEQ ID NO: 581616 - RNA, 18 nt, Homo sapiens
cagaucugcccacaucuu

SEQ ID NO: 581617 - RNA, 20 nt, Homo sapiens
cagaugaaauuuauuuccau

SEQ ID NO: 581618 - RNA, 20 nt, Homo sapiens
cagaugaacucuuucuggcc

SEQ ID NO: 581619 - RNA, 19 nt, Homo sapiens
cagaugacaaaaaggugca

SEQ ID NO: 581620 - RNA, 16 nt, Homo sapiens
cagaugacccccaucc

SEQ ID NO: 581621 - RNA, 19 nt, Homo sapiens
cagaugaggggccacugac

SEQ ID NO: 581622 - RNA, 17 nt, Homo sapiens
cagaugagucagucucu

SEQ ID NO: 581623 - RNA, 16 nt, Homo sapiens
cagaugauacuuccaa

SEQ ID NO: 581624 - RNA, 22 nt, Homo sapiens
cagaugaucagggauccaauau

SEQ ID NO: 581625 - RNA, 22 nt, Homo sapiens
cagaugaucccagucacuccuc

SEQ ID NO: 581626 - RNA, 14 nt, Homo sapiens
cagaugaucucucc

SEQ ID NO: 581627 - RNA, 16 nt, Homo sapiens
cagaugauuguucaaa

SEQ ID NO: 581628 - RNA, 22 nt, Homo sapiens
cagaugcaagacacugugccac

SEQ ID NO: 581629 - RNA, 15 nt, Homo sapiens
cagaugcagggcagu

SEQ ID NO: 581630 - RNA, 13 nt, Homo sapiens
cagaugcaguuug

SEQ ID NO: 581631 - RNA, 19 nt, Homo sapiens
cagaugccccagagcuguu

SEQ ID NO: 581632 - RNA, 22 nt, Homo sapiens
cagaugcccuuuggaaagccau

SEQ ID NO: 581633 - RNA, 22 nt, Homo sapiens
cagaugccuggacagaggacaa

SEQ ID NO: 581634 - RNA, 18 nt, Homo sapiens
cagaugcuacgcuccagc

SEQ ID NO: 581635 - RNA, 17 nt, Homo sapiens
cagauggaaaaacugag

SEQ ID NO: 581636 - RNA, 17 nt, Homo sapiens
cagauggcaauuucacu

SEQ ID NO: 581637 - RNA, 17 nt, Homo sapiens
cagaugggaauugcaca

SEQ ID NO: 581638 - RNA, 19 nt, Homo sapiens
cagauggggucugugacug

SEQ ID NO: 581639 - RNA, 16 nt, Homo sapiens
cagauguaacagaaca

SEQ ID NO: 581640 - RNA, 22 nt, Homo sapiens
cagaugucuucugccuguuaua

SEQ ID NO: 581641 - RNA, 20 nt, Homo sapiens
cagaugugagccaccgugcc

SEQ ID NO: 581642 - RNA, 13 nt, Homo sapiens
cagauguugcauc

SEQ ID NO: 581643 - RNA, 18 nt, Homo sapiens
cugugugguggagccagg

SEQ ID NO: 581644 - RNA, 16 nt, Homo sapiens
cuguguguccaaaacu

SEQ ID NO: 581645 - RNA, 20 nt, Homo sapiens
cugugugucgcuuaugucua

SEQ ID NO: 581646 - RNA, 18 nt, Homo sapiens
cugugugucucgugucag

SEQ ID NO: 581647 - RNA, 22 nt, Homo sapiens
cugugugugaaaggaagcucca

SEQ ID NO: 581648 - RNA, 17 nt, Homo sapiens
cugugugugauuugcua

SEQ ID NO: 581649 - RNA, 17 nt, Homo sapiens
cugugugugccuccagc

SEQ ID NO: 581650 - RNA, 17 nt, Homo sapiens
cuguguuaucugugguu

SEQ ID NO: 581651 - RNA, 21 nt, Homo sapiens
cuguguuauucuuugcgugua

SEQ ID NO: 581652 - RNA, 17 nt, Homo sapiens
cuguguugaagcacugu

SEQ ID NO: 581653 - RNA, 20 nt, Homo sapiens
cuguguuuguacugugcagu

SEQ ID NO: 581654 - RNA, 18 nt, Homo sapiens
cuguguuuuuuucuaaaa

SEQ ID NO: 581655 - RNA, 20 nt, Homo sapiens
cuguuaacuuaauaguauuu

SEQ ID NO: 581656 - RNA, 15 nt, Homo sapiens
cuguuaauauucuau

SEQ ID NO: 581657 - RNA, 17 nt, Homo sapiens
cuguuacugaauauuaa

SEQ ID NO: 581658 - RNA, 17 nt, Homo sapiens
cuguuacuuaccuaaac

SEQ ID NO: 581659 - RNA, 16 nt, Homo sapiens
cuguuagcaagugugu

SEQ ID NO: 581660 - RNA, 15 nt, Homo sapiens
cagggcuuaccugua

SEQ ID NO: 581661 - RNA, 18 nt, Homo sapiens
cagggcuuaccuguacac

SEQ ID NO: 581662 - RNA, 20 nt, Homo sapiens
cagggcuugcuccugccaac

SEQ ID NO: 581663 - RNA, 18 nt, Homo sapiens
caggggaaaaugaagguu

SEQ ID NO: 581664 - RNA, 23 nt, Homo sapiens
caggggaaggcccugaggcggag

SEQ ID NO: 581665 - RNA, 22 nt, Homo sapiens
caggggagcaagcuuacacaag

SEQ ID NO: 581666 - RNA, 18 nt, Homo sapiens
caggggaguaugcaaaag

SEQ ID NO: 581667 - RNA, 11 nt, Homo sapiens
caggggccaug

SEQ ID NO: 581668 - RNA, 18 nt, Homo sapiens
caggggggagaaguucuu

SEQ ID NO: 581669 - RNA, 21 nt, Homo sapiens
caggggguaggagagcacugc

SEQ ID NO: 581670 - RNA, 14 nt, Homo sapiens
cagggguacauucu

SEQ ID NO: 581671 - RNA, 18 nt, Homo sapiens
caggggucgucaccaccu

SEQ ID NO: 581672 - RNA, 21 nt, Homo sapiens
caggggucgucaccaccucuc

SEQ ID NO: 581673 - RNA, 22 nt, Homo sapiens
caggguccacgccucugcugua

SEQ ID NO: 581674 - RNA, 23 nt, Homo sapiens
caggguccagugggaacugaaga

SEQ ID NO: 581675 - RNA, 20 nt, Homo sapiens
caggguccucuucugggccu

SEQ ID NO: 581676 - RNA, 22 nt, Homo sapiens
cagggucucuagugcugugaaa

SEQ ID NO: 581677 - RNA, 16 nt, Homo sapiens
cagggucucucccuca

SEQ ID NO: 581678 - RNA, 20 nt, Homo sapiens
cagggucugcucuuucucug

SEQ ID NO: 581679 - RNA, 23 nt, Homo sapiens
cagggucugcucuuucucugcca

SEQ ID NO: 581680 - RNA, 16 nt, Homo sapiens
cagggucugugugaau

SEQ ID NO: 581681 - RNA, 17 nt, Homo sapiens
cagggucugugugaaug

SEQ ID NO: 581682 - RNA, 15 nt, Homo sapiens
cagggucuuaccucu

SEQ ID NO: 581683 - RNA, 15 nt, Homo sapiens
cagggucuugcucug

SEQ ID NO: 581684 - RNA, 17 nt, Homo sapiens
cagggucuugcucuguc

SEQ ID NO: 581685 - RNA, 12 nt, Homo sapiens
cagggugcagga

SEQ ID NO: 581686 - RNA, 15 nt, Homo sapiens
cagggugcaguauca

SEQ ID NO: 581687 - RNA, 12 nt, Homo sapiens
caggguggacca

SEQ ID NO: 581688 - RNA, 21 nt, Homo sapiens
caggguggagaugaggugcuc

SEQ ID NO: 581689 - RNA, 23 nt, Homo sapiens
cagggugggcuggggacucuggc

SEQ ID NO: 581690 - RNA, 20 nt, Homo sapiens
caggguggugguauucuguc

SEQ ID NO: 581691 - RNA, 14 nt, Homo sapiens
cagggugucccagg

SEQ ID NO: 581692 - RNA, 22 nt, Homo sapiens
caggguguguacugcacaagga

SEQ ID NO: 581693 - RNA, 21 nt, Homo sapiens
caggguuacaaaucuucuuga

SEQ ID NO: 581694 - RNA, 15 nt, Homo sapiens
caggguuaucugcaa

SEQ ID NO: 581695 - RNA, 14 nt, Homo sapiens
caggguugaucaca

SEQ ID NO: 581696 - RNA, 22 nt, Homo sapiens
caggguuugcuguuugcgugaa

SEQ ID NO: 581697 - RNA, 15 nt, Homo sapiens
cagguaaaacagggc

SEQ ID NO: 581698 - RNA, 19 nt, Homo sapiens
cagguaaaugguaugauca

SEQ ID NO: 581699 - RNA, 16 nt, Homo sapiens
cagguaauacaaacua

SEQ ID NO: 581700 - RNA, 13 nt, Homo sapiens
cagguaaugugaa

SEQ ID NO: 581701 - RNA, 14 nt, Homo sapiens
cagguaaugugaau

SEQ ID NO: 581702 - RNA, 19 nt, Homo sapiens
cagguaccucuuucagggu

SEQ ID NO: 581703 - RNA, 22 nt, Homo sapiens
cagguaggcccuuguccugcca

SEQ ID NO: 581704 - RNA, 20 nt, Homo sapiens
cagguauuacacaagccaaa

SEQ ID NO: 581705 - RNA, 14 nt, Homo sapiens
caggucaacuucag

SEQ ID NO: 581706 - RNA, 14 nt, Homo sapiens
caggucaccaagca

SEQ ID NO: 581707 - RNA, 14 nt, Homo sapiens
caggucaccauccu

SEQ ID NO: 581708 - RNA, 19 nt, Homo sapiens
caggucacccuuugcugug

SEQ ID NO: 581709 - RNA, 13 nt, Homo sapiens
caggucacuuuac

SEQ ID NO: 581710 - RNA, 17 nt, Homo sapiens
caggucaguuguaauaa

SEQ ID NO: 581711 - RNA, 14 nt, Homo sapiens
cagguccuuccuuu

SEQ ID NO: 581712 - RNA, 22 nt, Homo sapiens
caggucuuccugcuuuccaugg

SEQ ID NO: 581713 - RNA, 12 nt, Homo sapiens
caggucuuuucu

SEQ ID NO: 581714 - RNA, 14 nt, Homo sapiens
caggugaaaaucca

SEQ ID NO: 581715 - RNA, 19 nt, Homo sapiens
caggugaaaauccaucuca

SEQ ID NO: 581716 - RNA, 20 nt, Homo sapiens
caggugaaaauccaucucau

SEQ ID NO: 581717 - RNA, 14 nt, Homo sapiens
caggugaacagccu

SEQ ID NO: 581718 - RNA, 15 nt, Homo sapiens
caggugaacagccuc

SEQ ID NO: 581719 - RNA, 17 nt, Homo sapiens
caggugaacugggagca

SEQ ID NO: 581720 - RNA, 22 nt, Homo sapiens
caggugagcaauuagauuagua

SEQ ID NO: 581721 - RNA, 12 nt, Homo sapiens
caggugaugcuc

SEQ ID NO: 581722 - RNA, 12 nt, Homo sapiens
caggugcaaaag

SEQ ID NO: 581723 - RNA, 18 nt, Homo sapiens
caggugcaaucuacugga

SEQ ID NO: 581724 - RNA, 19 nt, Homo sapiens
caggugccaaguuccacuu

SEQ ID NO: 581725 - RNA, 16 nt, Homo sapiens
caggugcucuguggau

SEQ ID NO: 581726 - RNA, 14 nt, Homo sapiens
caggugcugacaau

SEQ ID NO: 581727 - RNA, 22 nt, Homo sapiens
caggugcugacuucaucuccca

SEQ ID NO: 581728 - RNA, 20 nt, Homo sapiens
cagguggacacacaaggugc

SEQ ID NO: 581729 - RNA, 14 nt, Homo sapiens
cagguggauguuua

SEQ ID NO: 581730 - RNA, 15 nt, Homo sapiens
cagguggcucagugc

SEQ ID NO: 581731 - RNA, 19 nt, Homo sapiens
cagguguaagccaccgugc

SEQ ID NO: 581732 - RNA, 18 nt, Homo sapiens
cagguguauaaauguaca

SEQ ID NO: 581733 - RNA, 20 nt, Homo sapiens
caggugugagccacagugcc

SEQ ID NO: 581734 - RNA, 20 nt, Homo sapiens
caggugugcaccaccaugcc

SEQ ID NO: 581735 - RNA, 14 nt, Homo sapiens
caggugugugugaa

SEQ ID NO: 581736 - RNA, 20 nt, Homo sapiens
cagguguuacuuacaguccc

SEQ ID NO: 581737 - RNA, 12 nt, Homo sapiens
cagguucacuuu

SEQ ID NO: 581738 - RNA, 17 nt, Homo sapiens
cagguuccaucccgaaa

SEQ ID NO: 581739 - RNA, 18 nt, Homo sapiens
cagguucucacuagauga

SEQ ID NO: 581740 - RNA, 13 nt, Homo sapiens
cagguucuucagg

SEQ ID NO: 581741 - RNA, 15 nt, Homo sapiens
cagguucuucagggc

SEQ ID NO: 581742 - RNA, 12 nt, Homo sapiens
cagguucuugcc

SEQ ID NO: 581743 - RNA, 13 nt, Homo sapiens
cagguugugaaau

SEQ ID NO: 581744 - RNA, 19 nt, Homo sapiens
cagguuuguuuucagcacu

SEQ ID NO: 581745 - RNA, 20 nt, Homo sapiens
cagguuuucuguuucugugu

SEQ ID NO: 581746 - RNA, 22 nt, Homo sapiens
caguaaaaauccuggaagacaa

SEQ ID NO: 581747 - RNA, 17 nt, Homo sapiens
caguaaaagaugaaguu

SEQ ID NO: 581748 - RNA, 20 nt, Homo sapiens
caguaaacgggaacaugccc

SEQ ID NO: 581749 - RNA, 22 nt, Homo sapiens
caguaaagcaggaagccuccaa

SEQ ID NO: 581750 - RNA, 17 nt, Homo sapiens
caguaaauaacuggaaa

SEQ ID NO: 581751 - RNA, 22 nt, Homo sapiens
caguaaauaacuggaaaacaga

SEQ ID NO: 581752 - RNA, 17 nt, Homo sapiens
caguaaauagugucaua

SEQ ID NO: 581753 - RNA, 16 nt, Homo sapiens
caguaaaucucacaaa

SEQ ID NO: 581754 - RNA, 23 nt, Homo sapiens
caguaaauguacaacugcaccug

SEQ ID NO: 581755 - RNA, 21 nt, Homo sapiens
caguaacauuucuguucucau

SEQ ID NO: 581756 - RNA, 17 nt, Homo sapiens
caguaacgcgucuuccu

SEQ ID NO: 581757 - RNA, 21 nt, Homo sapiens
caguaacggguagcagcagau

SEQ ID NO: 581758 - RNA, 17 nt, Homo sapiens
caguaacugcaccaacg

SEQ ID NO: 581759 - RNA, 17 nt, Homo sapiens
caguaacugugacugau

SEQ ID NO: 581760 - RNA, 21 nt, Homo sapiens
caguaacugugacugaugacu

SEQ ID NO: 581761 - RNA, 18 nt, Homo sapiens
caguaacuuuauguguaa

SEQ ID NO: 581762 - RNA, 16 nt, Homo sapiens
caguaaucagaguuac

SEQ ID NO: 581763 - RNA, 22 nt, Homo sapiens
caguaaugugcgagaaagugaa

SEQ ID NO: 581764 - RNA, 13 nt, Homo sapiens
cagugcagacuca

SEQ ID NO: 581765 - RNA, 12 nt, Homo sapiens
cagugcagugaa

SEQ ID NO: 581766 - RNA, 11 nt, Homo sapiens
cagugcaguuu

SEQ ID NO: 581767 - RNA, 16 nt, Homo sapiens
cagugcauuugccuug

SEQ ID NO: 581768 - RNA, 16 nt, Homo sapiens
cagugccaacuccuca

SEQ ID NO: 581769 - RNA, 15 nt, Homo sapiens
cagugccaccaucau

SEQ ID NO: 581770 - RNA, 20 nt, Homo sapiens
cagugccaccaucauagcuc

SEQ ID NO: 581771 - RNA, 13 nt, Homo sapiens
cagugccaccuau

SEQ ID NO: 581772 - RNA, 23 nt, Homo sapiens
cagugccaccuaugccuguggug

SEQ ID NO: 581773 - RNA, 22 nt, Homo sapiens
cagugccagcaaugacaucuca

SEQ ID NO: 581774 - RNA, 15 nt, Homo sapiens
cagugccauuccacu

SEQ ID NO: 581775 - RNA, 16 nt, Homo sapiens
cagugcccaugggcua

SEQ ID NO: 581776 - RNA, 16 nt, Homo sapiens
cagugcgguuccucau

SEQ ID NO: 581777 - RNA, 21 nt, Homo sapiens
cagugcuguaaacuuaacugu

SEQ ID NO: 581778 - RNA, 16 nt, Homo sapiens
cagugcuuuucacuac

SEQ ID NO: 581779 - RNA, 14 nt, Homo sapiens
caguggaaggcauu

SEQ ID NO: 581780 - RNA, 20 nt, Homo sapiens
caguggaauuccaacuugaa

SEQ ID NO: 581781 - RNA, 17 nt, Homo sapiens
caguggaauuggugauu

SEQ ID NO: 581782 - RNA, 14 nt, Homo sapiens
caguggacaccagg

SEQ ID NO: 581783 - RNA, 13 nt, Homo sapiens
caguggauguaua

SEQ ID NO: 581784 - RNA, 13 nt, Homo sapiens
cuuaagugacaaa

SEQ ID NO: 581785 - RNA, 23 nt, Homo sapiens
cuuaauaaaagaacaugcuugaa

SEQ ID NO: 581786 - RNA, 22 nt, Homo sapiens
cuuaauaaaggcccccacuucu

SEQ ID NO: 581787 - RNA, 20 nt, Homo sapiens
cuuaauaaauccuugaauca

SEQ ID NO: 581788 - RNA, 19 nt, Homo sapiens
cuuaauaaauuguguuucc

SEQ ID NO: 581789 - RNA, 17 nt, Homo sapiens
cuuaauaacaacagauc

SEQ ID NO: 581790 - RNA, 22 nt, Homo sapiens
cuuaauaagauauuuaguaaua

SEQ ID NO: 581791 - RNA, 16 nt, Homo sapiens
cuuaauacuaccuuga

SEQ ID NO: 581792 - RNA, 17 nt, Homo sapiens
cuuaauacuuuaugaug

SEQ ID NO: 581793 - RNA, 22 nt, Homo sapiens
cuuaauagcuauacauuaaucc

SEQ ID NO: 581794 - RNA, 21 nt, Homo sapiens
cuuaauauaaauucacuuuca

SEQ ID NO: 581795 - RNA, 14 nt, Homo sapiens
cuuaauauguuaac

SEQ ID NO: 581796 - RNA, 21 nt, Homo sapiens
cuuaaucaacagaaguaucaa

SEQ ID NO: 581797 - RNA, 11 nt, Homo sapiens
cuuaaucacac

SEQ ID NO: 581798 - RNA, 17 nt, Homo sapiens
cuuaaucacuacuguau

SEQ ID NO: 581799 - RNA, 19 nt, Homo sapiens
cuuaaucauuauccuucua

SEQ ID NO: 581800 - RNA, 17 nt, Homo sapiens
cuuaaugaaccuuagaa

SEQ ID NO: 581801 - RNA, 15 nt, Homo sapiens
cuuaaugacauuuca

SEQ ID NO: 581802 - RNA, 16 nt, Homo sapiens
cuuaaugauacauguu

SEQ ID NO: 581803 - RNA, 22 nt, Homo sapiens
cuuaaugauuuacagacugaug

SEQ ID NO: 581804 - RNA, 19 nt, Homo sapiens
cuuaaugguauccuacuga

SEQ ID NO: 581805 - RNA, 18 nt, Homo sapiens
cuuaauuuauuauuaaca

SEQ ID NO: 581806 - RNA, 18 nt, Homo sapiens
cuuaauuuauuucuuaac

SEQ ID NO: 581807 - RNA, 21 nt, Homo sapiens
cuuaauuucauagauuguguu

SEQ ID NO: 581808 - RNA, 13 nt, Homo sapiens
cuuaauuucugcc

SEQ ID NO: 581809 - RNA, 13 nt, Homo sapiens
cuuacaaccuucc

SEQ ID NO: 581810 - RNA, 22 nt, Homo sapiens
cuuacaagaaaggccugaaugg

SEQ ID NO: 581811 - RNA, 15 nt, Homo sapiens
cuuacaauucccugc

SEQ ID NO: 581812 - RNA, 20 nt, Homo sapiens
cuuacaauuggcacuaaaga

SEQ ID NO: 581813 - RNA, 15 nt, Homo sapiens
cuuacacagguuuca

SEQ ID NO: 581814 - RNA, 16 nt, Homo sapiens
cuuacagaacuacuuc

SEQ ID NO: 581815 - RNA, 17 nt, Homo sapiens
cuuacagaacuacuucu

SEQ ID NO: 581816 - RNA, 16 nt, Homo sapiens
cuuacaguuaggauuu

SEQ ID NO: 581817 - RNA, 14 nt, Homo sapiens
cuuacaucuguaaa

SEQ ID NO: 581818 - RNA, 20 nt, Homo sapiens
cuuacauuucagacauaucc

SEQ ID NO: 581819 - RNA, 15 nt, Homo sapiens
cuuacccgaaagcau

SEQ ID NO: 581820 - RNA, 18 nt, Homo sapiens
cuuacccuccuccagacc

SEQ ID NO: 581821 - RNA, 14 nt, Homo sapiens
cuuaccgcucuguu

SEQ ID NO: 581822 - RNA, 17 nt, Homo sapiens
cuuaccuagugaaacuu

SEQ ID NO: 581823 - RNA, 16 nt, Homo sapiens
cuuaccucacagugau

SEQ ID NO: 581824 - RNA, 17 nt, Homo sapiens
cuuaccugaccucuugc

SEQ ID NO: 581825 - RNA, 13 nt, Homo sapiens
cuuaccugugcuu

SEQ ID NO: 581826 - RNA, 21 nt, Homo sapiens
cuuacuaaaaaguauaaaaua

SEQ ID NO: 581827 - RNA, 18 nt, Homo sapiens
cuuacuaagcauagcaaa

SEQ ID NO: 581828 - RNA, 16 nt, Homo sapiens
cuuacuagaccuguaa

SEQ ID NO: 581829 - RNA, 15 nt, Homo sapiens
cuuacuccacuucgc

SEQ ID NO: 581830 - RNA, 18 nt, Homo sapiens
cuuacuccaucgugugug

SEQ ID NO: 581831 - RNA, 12 nt, Homo sapiens
cuuacucugaaa

SEQ ID NO: 581832 - RNA, 15 nt, Homo sapiens
cuuacuguacaugaa

SEQ ID NO: 581833 - RNA, 15 nt, Homo sapiens
cuuacuuaguguuau

SEQ ID NO: 581834 - RNA, 15 nt, Homo sapiens
cuuacuuaugccaua

SEQ ID NO: 581835 - RNA, 18 nt, Homo sapiens
cuuagaaaacaaguauug

SEQ ID NO: 581836 - RNA, 15 nt, Homo sapiens
cuuagaaauacuugu

SEQ ID NO: 581837 - RNA, 20 nt, Homo sapiens
cuuagaaaucauuguagaaa

SEQ ID NO: 581838 - RNA, 22 nt, Homo sapiens
cuuagaagccaugggaccuccu

SEQ ID NO: 581839 - RNA, 13 nt, Homo sapiens
cuuagaaugccau

SEQ ID NO: 581840 - RNA, 19 nt, Homo sapiens
cuuagaauuugggggaaaa

SEQ ID NO: 581841 - RNA, 14 nt, Homo sapiens
cuuagacucuugaa

SEQ ID NO: 581842 - RNA, 21 nt, Homo sapiens
cuuagagugggaccaacuucc

SEQ ID NO: 581843 - RNA, 18 nt, Homo sapiens
cuuagaguguagcuguaa

SEQ ID NO: 581844 - RNA, 20 nt, Homo sapiens
cuuagaucucuccugcaaaa

SEQ ID NO: 581845 - RNA, 22 nt, Homo sapiens
cuuagaugagggugacugucaa

SEQ ID NO: 581846 - RNA, 20 nt, Homo sapiens
cuuagauuagcucuggacca

SEQ ID NO: 581847 - RNA, 17 nt, Homo sapiens
cuuagcagcuuccagau

SEQ ID NO: 581848 - RNA, 14 nt, Homo sapiens
cuuagccagaguua

SEQ ID NO: 581849 - RNA, 15 nt, Homo sapiens
cuuagccuacagaug

SEQ ID NO: 581850 - RNA, 14 nt, Homo sapiens
cuuagccugugcug

SEQ ID NO: 581851 - RNA, 15 nt, Homo sapiens
cuuagcgggacaaag

SEQ ID NO: 581852 - RNA, 15 nt, Homo sapiens
cuuagcgucaagaca

SEQ ID NO: 581853 - RNA, 22 nt, Homo sapiens
cuuagcuauccuuggcuuucag

SEQ ID NO: 581854 - RNA, 11 nt, Homo sapiens
cuuagcugccu

SEQ ID NO: 581855 - RNA, 15 nt, Homo sapiens
cuuagcuuacaggaa

SEQ ID NO: 581856 - RNA, 17 nt, Homo sapiens
cuuagcuuagaccucag

SEQ ID NO: 581857 - RNA, 16 nt, Homo sapiens
cuuaggaaccuaccag

SEQ ID NO: 581858 - RNA, 15 nt, Homo sapiens
cuuaggaaggaguau

SEQ ID NO: 581859 - RNA, 20 nt, Homo sapiens
cuuaggaaggccuucaggag

SEQ ID NO: 581860 - RNA, 11 nt, Homo sapiens
cuuaggaccag

SEQ ID NO: 581861 - RNA, 15 nt, Homo sapiens
cuuagggaagaaaaa

SEQ ID NO: 581862 - RNA, 18 nt, Homo sapiens
cuuagggcagauuuucau

SEQ ID NO: 581863 - RNA, 11 nt, Homo sapiens
cuuaggugcca

SEQ ID NO: 581864 - RNA, 16 nt, Homo sapiens
cuuagguuuugcuugg

SEQ ID NO: 581865 - RNA, 22 nt, Homo sapiens
cuuaguaagugcuuuucuuaua

SEQ ID NO: 581866 - RNA, 23 nt, Homo sapiens
cuuaguaguuuuuacaaaacugc

SEQ ID NO: 581867 - RNA, 21 nt, Homo sapiens
cuuaguauugcagccaaagaa

SEQ ID NO: 581868 - RNA, 17 nt, Homo sapiens
cuuaguauuucucagga

SEQ ID NO: 581869 - RNA, 14 nt, Homo sapiens
cuuagugcaaaaaa

SEQ ID NO: 581870 - RNA, 18 nt, Homo sapiens
cuuagugcuucagaguuu

SEQ ID NO: 581871 - RNA, 18 nt, Homo sapiens
cuuaguguauaaaaacca

SEQ ID NO: 581872 - RNA, 20 nt, Homo sapiens
cuuaguguuguggacacugc

SEQ ID NO: 581873 - RNA, 12 nt, Homo sapiens
cuuaguucucac

SEQ ID NO: 581874 - RNA, 20 nt, Homo sapiens
cuuaguugcaugaccacaua

SEQ ID NO: 581875 - RNA, 18 nt, Homo sapiens
cuuauaagaaagaucaaa

SEQ ID NO: 581876 - RNA, 13 nt, Homo sapiens
cuuauaccaaagg

SEQ ID NO: 581877 - RNA, 20 nt, Homo sapiens
cuuauagacacuugcuccca

SEQ ID NO: 581878 - RNA, 16 nt, Homo sapiens
cuuauaggguaaaaaa

SEQ ID NO: 581879 - RNA, 23 nt, Homo sapiens
cuuauauugaagacaauuugaua

SEQ ID NO: 581880 - RNA, 22 nt, Homo sapiens
cuuauauuucuguguacacauc

SEQ ID NO: 581881 - RNA, 15 nt, Homo sapiens
cuuaucaacuaauga

SEQ ID NO: 581882 - RNA, 17 nt, Homo sapiens
cuuaucaggauaccaga

SEQ ID NO: 581883 - RNA, 15 nt, Homo sapiens
cuuaucccaagagaa

SEQ ID NO: 581884 - RNA, 20 nt, Homo sapiens
cuuaugaaaagaauuugaug

SEQ ID NO: 581885 - RNA, 22 nt, Homo sapiens
cuuaugauagcaaauggccuca

SEQ ID NO: 581886 - RNA, 13 nt, Homo sapiens
cauauauaugaaa

SEQ ID NO: 581887 - RNA, 13 nt, Homo sapiens
cauauauauuaca

SEQ ID NO: 581888 - RNA, 14 nt, Homo sapiens
cauauauauuacaa

SEQ ID NO: 581889 - RNA, 22 nt, Homo sapiens
cauauaucuacacauacagaaa

SEQ ID NO: 581890 - RNA, 13 nt, Homo sapiens
cauauaucuauua

SEQ ID NO: 581891 - RNA, 16 nt, Homo sapiens
cauauaucuauuacac

SEQ ID NO: 581892 - RNA, 14 nt, Homo sapiens
cauauaucucugug

SEQ ID NO: 581893 - RNA, 15 nt, Homo sapiens
cauauaugaccagaa

SEQ ID NO: 581894 - RNA, 21 nt, Homo sapiens
cauauauguauauauaugcac

SEQ ID NO: 581895 - RNA, 24 nt, Homo sapiens
cauauauguauauauaugcacaua

SEQ ID NO: 581896 - RNA, 17 nt, Homo sapiens
cauauauuuaauauguc

SEQ ID NO: 581897 - RNA, 20 nt, Homo sapiens
cauauauuuaauaugucaaa

SEQ ID NO: 581898 - RNA, 23 nt, Homo sapiens
cauauauuugaaguggagccaua

SEQ ID NO: 581899 - RNA, 16 nt, Homo sapiens
cauaucaauuggcagu

SEQ ID NO: 581900 - RNA, 15 nt, Homo sapiens
cauaucagaacugug

SEQ ID NO: 581901 - RNA, 20 nt, Homo sapiens
cauaucagggguacauucua

SEQ ID NO: 581902 - RNA, 14 nt, Homo sapiens
cauaucauuaaaca

SEQ ID NO: 581903 - RNA, 18 nt, Homo sapiens
cauaucauuaaacaaaua

SEQ ID NO: 581904 - RNA, 15 nt, Homo sapiens
cauauccaccaccuc

SEQ ID NO: 581905 - RNA, 12 nt, Homo sapiens
cauauccugccu

SEQ ID NO: 581906 - RNA, 21 nt, Homo sapiens
cauaucgcugacuucauggaa

SEQ ID NO: 581907 - RNA, 17 nt, Homo sapiens
cauaucguaaagcuguu

SEQ ID NO: 581908 - RNA, 20 nt, Homo sapiens
cauaucuaaagcuuuggaca

SEQ ID NO: 581909 - RNA, 22 nt, Homo sapiens
cauaucuacacuucgcaccgga

SEQ ID NO: 581910 - RNA, 15 nt, Homo sapiens
cuucccuacauggag

SEQ ID NO: 581911 - RNA, 17 nt, Homo sapiens
cuucccucucaugacuu

SEQ ID NO: 581912 - RNA, 21 nt, Homo sapiens
cuucccucucugaugucccag

SEQ ID NO: 581913 - RNA, 23 nt, Homo sapiens
cuucccugcauuaacugcacaaa

SEQ ID NO: 581914 - RNA, 13 nt, Homo sapiens
cuucccugcauuu

SEQ ID NO: 581915 - RNA, 18 nt, Homo sapiens
cuucccugggcugugcua

SEQ ID NO: 581916 - RNA, 13 nt, Homo sapiens
cuuccgaaaacca

SEQ ID NO: 581917 - RNA, 17 nt, Homo sapiens
cuuccgauggaugaauc

SEQ ID NO: 581918 - RNA, 22 nt, Homo sapiens
cuuccgcugaggggucucggau

SEQ ID NO: 581919 - RNA, 20 nt, Homo sapiens
cuuccgggaaaacagcuauu

SEQ ID NO: 581920 - RNA, 16 nt, Homo sapiens
cuuccgggaacuggag

SEQ ID NO: 581921 - RNA, 15 nt, Homo sapiens
cuuccuaaacccaau

SEQ ID NO: 581922 - RNA, 20 nt, Homo sapiens
cuuccuaauaugcuuuacaa

SEQ ID NO: 581923 - RNA, 23 nt, Homo sapiens
cuuccuacacguuagauuugccg

SEQ ID NO: 581924 - RNA, 16 nt, Homo sapiens
cuuccucacacugcug

SEQ ID NO: 581925 - RNA, 13 nt, Homo sapiens
cuuccucacaugg

SEQ ID NO: 581926 - RNA, 17 nt, Homo sapiens
cuuccuccuaccugggg

SEQ ID NO: 581927 - RNA, 17 nt, Homo sapiens
cuuccuccucgcugcca

SEQ ID NO: 581928 - RNA, 18 nt, Homo sapiens
cuuccucuccuucccaca

SEQ ID NO: 581929 - RNA, 13 nt, Homo sapiens
cuuccucuugacc

SEQ ID NO: 581930 - RNA, 23 nt, Homo sapiens
cuuccugaagggggacacuccau

SEQ ID NO: 581931 - RNA, 17 nt, Homo sapiens
cuuccugaguggugcca

SEQ ID NO: 581932 - RNA, 18 nt, Homo sapiens
cuuccugauuccuuuaaa

SEQ ID NO: 581933 - RNA, 19 nt, Homo sapiens
cuuccugcccuaacucugc

SEQ ID NO: 581934 - RNA, 15 nt, Homo sapiens
cuuccugcuugccaa

SEQ ID NO: 581935 - RNA, 15 nt, Homo sapiens
cuuccuggaagcaga

SEQ ID NO: 581936 - RNA, 17 nt, Homo sapiens
cuuccugggcaaagaag

SEQ ID NO: 581937 - RNA, 20 nt, Homo sapiens
cuuccuguaacacaagccac

SEQ ID NO: 581938 - RNA, 15 nt, Homo sapiens
cuuccuguccacucu

SEQ ID NO: 581939 - RNA, 14 nt, Homo sapiens
cuuccuguccagag

SEQ ID NO: 581940 - RNA, 16 nt, Homo sapiens
cuuccuguccagagag

SEQ ID NO: 581941 - RNA, 15 nt, Homo sapiens
cuuccugucugagua

SEQ ID NO: 581942 - RNA, 22 nt, Homo sapiens
cuuccuguguguccaaaacugc

SEQ ID NO: 581943 - RNA, 20 nt, Homo sapiens
cuuccuuaaagcauuugcaa

SEQ ID NO: 581944 - RNA, 12 nt, Homo sapiens
cuuccuucaggg

SEQ ID NO: 581945 - RNA, 22 nt, Homo sapiens
cuuccuuccacucccuuugcca

SEQ ID NO: 581946 - RNA, 12 nt, Homo sapiens
cuuccuugcucu

SEQ ID NO: 581947 - RNA, 22 nt, Homo sapiens
cuuccuuucuccaggaccaaua

SEQ ID NO: 581948 - RNA, 17 nt, Homo sapiens
cuuccuuuuaacugcca

SEQ ID NO: 581949 - RNA, 15 nt, Homo sapiens
cuucgaccacagcaa

SEQ ID NO: 581950 - RNA, 13 nt, Homo sapiens
cuucgacugugac

SEQ ID NO: 581951 - RNA, 15 nt, Homo sapiens
cuucgaggcccagcg

SEQ ID NO: 581952 - RNA, 19 nt, Homo sapiens
cuucgaggcuuuacagugu

SEQ ID NO: 581953 - RNA, 17 nt, Homo sapiens
cuucggaguuucuuagu

SEQ ID NO: 581954 - RNA, 18 nt, Homo sapiens
cuucggcagggaggugaa

SEQ ID NO: 581955 - RNA, 13 nt, Homo sapiens
cuucuaaaagcua

SEQ ID NO: 581956 - RNA, 13 nt, Homo sapiens
cuucuaagccaaa

SEQ ID NO: 581957 - RNA, 10 nt, Homo sapiens
cuucuaauau

SEQ ID NO: 581958 - RNA, 15 nt, Homo sapiens
cuucuacagaagcca

SEQ ID NO: 581959 - RNA, 19 nt, Homo sapiens
cuucuaccuuaaaauguaa

SEQ ID NO: 581960 - RNA, 17 nt, Homo sapiens
cuucuacggccaugaga

SEQ ID NO: 581961 - RNA, 16 nt, Homo sapiens
cuucuacugcuaucua

SEQ ID NO: 581962 - RNA, 23 nt, Homo sapiens
cuucuagaaucucguuucuccuc

SEQ ID NO: 581963 - RNA, 16 nt, Homo sapiens
cuucuagagcuuagca

SEQ ID NO: 581964 - RNA, 20 nt, Homo sapiens
cuucuagcagagacccuggu

SEQ ID NO: 581965 - RNA, 18 nt, Homo sapiens
cuucuaggucacuucuca

SEQ ID NO: 581966 - RNA, 22 nt, Homo sapiens
cuucuaggucacuucucacaau

SEQ ID NO: 581967 - RNA, 13 nt, Homo sapiens
cuucuaguuuuau

SEQ ID NO: 581968 - RNA, 20 nt, Homo sapiens
cuucuaugguugacauugua

SEQ ID NO: 581969 - RNA, 15 nt, Homo sapiens
cuucuauuucuugga

SEQ ID NO: 581970 - RNA, 11 nt, Homo sapiens
cuucucaagac

SEQ ID NO: 581971 - RNA, 23 nt, Homo sapiens
cuucucaauagaguguuguugcu

SEQ ID NO: 581972 - RNA, 17 nt, Homo sapiens
cuucucacauccaucua

SEQ ID NO: 581973 - RNA, 18 nt, Homo sapiens
cuucucagaagcacagaa

SEQ ID NO: 581974 - RNA, 18 nt, Homo sapiens
cuucucaucauauuguau

SEQ ID NO: 581975 - RNA, 15 nt, Homo sapiens
cuucuccaaaugaga

SEQ ID NO: 581976 - RNA, 15 nt, Homo sapiens
cuucuccaguuagaa

SEQ ID NO: 581977 - RNA, 15 nt, Homo sapiens
cuucuccccauucug

SEQ ID NO: 581978 - RNA, 17 nt, Homo sapiens
cuucuccgccagccucc

SEQ ID NO: 581979 - RNA, 12 nt, Homo sapiens
cuucuccugacc

SEQ ID NO: 581980 - RNA, 19 nt, Homo sapiens
cuucucgugacaccaccaa

SEQ ID NO: 581981 - RNA, 16 nt, Homo sapiens
cuucucuacagacucc

SEQ ID NO: 581982 - RNA, 20 nt, Homo sapiens
cuucucuacagacuccaaaa

SEQ ID NO: 581983 - RNA, 17 nt, Homo sapiens
cuucucucacuguguua

SEQ ID NO: 581984 - RNA, 16 nt, Homo sapiens
cuucucugcacuuaua

SEQ ID NO: 581985 - RNA, 13 nt, Homo sapiens
cuucucugcucca

SEQ ID NO: 581986 - RNA, 23 nt, Homo sapiens
cuucucuguaaguaauugccaca

SEQ ID NO: 581987 - RNA, 23 nt, Homo sapiens
cuucucuucccugcgccugugau

SEQ ID NO: 581988 - RNA, 14 nt, Homo sapiens
cuucucuucuuuau

SEQ ID NO: 581989 - RNA, 21 nt, Homo sapiens
cuucucuucuuuauugcacua

SEQ ID NO: 581990 - RNA, 16 nt, Homo sapiens
cuucucuugacagucu

SEQ ID NO: 581991 - RNA, 16 nt, Homo sapiens
cuucucuugagucaca

SEQ ID NO: 581992 - RNA, 22 nt, Homo sapiens
cuucucuugggaacuccacucu

SEQ ID NO: 581993 - RNA, 15 nt, Homo sapiens
cuucugaagauggaa

SEQ ID NO: 581994 - RNA, 19 nt, Homo sapiens
cuucugaaguguguccauc

SEQ ID NO: 581995 - RNA, 23 nt, Homo sapiens
cuucugagcacagcugcauuaaa

SEQ ID NO: 581996 - RNA, 14 nt, Homo sapiens
cuucugagcacugu

SEQ ID NO: 581997 - RNA, 18 nt, Homo sapiens
cuucugagcacuguuuau

SEQ ID NO: 581998 - RNA, 16 nt, Homo sapiens
cuucugaguugcacau

SEQ ID NO: 581999 - RNA, 23 nt, Homo sapiens
cuucugauacguguaugagacua

SEQ ID NO: 582000 - RNA, 17 nt, Homo sapiens
cuucugcaccaacucac

SEQ ID NO: 582001 - RNA, 11 nt, Homo sapiens
cuucugccaac

SEQ ID NO: 582002 - RNA, 15 nt, Homo sapiens
cuucugccccggagc

SEQ ID NO: 582003 - RNA, 17 nt, Homo sapiens
cuucugccuaacuugua

SEQ ID NO: 582004 - RNA, 18 nt, Homo sapiens
cuucugccuucucaggaa

SEQ ID NO: 582005 - RNA, 17 nt, Homo sapiens
cuucugcuccauagaca

SEQ ID NO: 582006 - RNA, 18 nt, Homo sapiens
cuucugcugucucuccua

SEQ ID NO: 582007 - RNA, 13 nt, Homo sapiens
cuucugcuucaaa

SEQ ID NO: 582008 - RNA, 22 nt, Homo sapiens
cucugcaguaaaacacauuugg

SEQ ID NO: 582009 - RNA, 15 nt, Homo sapiens
cucugcaguccuccg

SEQ ID NO: 582010 - RNA, 12 nt, Homo sapiens
cucugcaguuuu

SEQ ID NO: 582011 - RNA, 22 nt, Homo sapiens
cucugcauccauuugaacacau

SEQ ID NO: 582012 - RNA, 18 nt, Homo sapiens
cucugcaugacaaacaca

SEQ ID NO: 582013 - RNA, 14 nt, Homo sapiens
cucugcauguuaca

SEQ ID NO: 582014 - RNA, 15 nt, Homo sapiens
cucugcauucuagua

SEQ ID NO: 582015 - RNA, 21 nt, Homo sapiens
cucugcauuuauaaagaccgu

SEQ ID NO: 582016 - RNA, 20 nt, Homo sapiens
cucugccaaaggaugugaua

SEQ ID NO: 582017 - RNA, 13 nt, Homo sapiens
cucuuuggggcua

SEQ ID NO: 582018 - RNA, 15 nt, Homo sapiens
cucuuuggucauuga

SEQ ID NO: 582019 - RNA, 23 nt, Homo sapiens
cucuuuggucuauuuucugcaga

SEQ ID NO: 582020 - RNA, 12 nt, Homo sapiens
cucuuuggugua

SEQ ID NO: 582021 - RNA, 13 nt, Homo sapiens
cucuuuguagcag

SEQ ID NO: 582022 - RNA, 17 nt, Homo sapiens
cucuuugugauaauucu

SEQ ID NO: 582023 - RNA, 18 nt, Homo sapiens
cucuuuguggucauguga

SEQ ID NO: 582024 - RNA, 12 nt, Homo sapiens
cucuuuuaccaa

SEQ ID NO: 582025 - RNA, 17 nt, Homo sapiens
cucuuuuagcugaugaa

SEQ ID NO: 582026 - RNA, 19 nt, Homo sapiens
cucuuuuaggaggcacaac

SEQ ID NO: 582027 - RNA, 14 nt, Homo sapiens
cucuuuucaaugug

SEQ ID NO: 582028 - RNA, 20 nt, Homo sapiens
cucuuuuccacuccaagaug

SEQ ID NO: 582029 - RNA, 17 nt, Homo sapiens
cucuuuugaauccaugc

SEQ ID NO: 582030 - RNA, 13 nt, Homo sapiens
cucuuuugagcua

SEQ ID NO: 582031 - RNA, 14 nt, Homo sapiens
cucuuuugagcuaa

SEQ ID NO: 582032 - RNA, 22 nt, Homo sapiens
cucuuuuggguaaaaucuguaa

SEQ ID NO: 582033 - RNA, 15 nt, Homo sapiens
cugaaaaacuuaccu

SEQ ID NO: 582034 - RNA, 21 nt, Homo sapiens
cugaaaaaugcucaaucucag

SEQ ID NO: 582035 - RNA, 14 nt, Homo sapiens
cugaaaacuacaca

SEQ ID NO: 582036 - RNA, 17 nt, Homo sapiens
cugaaaacuacacaaau

SEQ ID NO: 582037 - RNA, 14 nt, Homo sapiens
cugaaaacuacagu

SEQ ID NO: 582038 - RNA, 22 nt, Homo sapiens
cugaaaagaucugaagguccca

SEQ ID NO: 582039 - RNA, 17 nt, Homo sapiens
cugaaaaggacuucugg

SEQ ID NO: 582040 - RNA, 12 nt, Homo sapiens
cugaaaagggaa

SEQ ID NO: 582041 - RNA, 18 nt, Homo sapiens
cugaaaagggacugugag

SEQ ID NO: 582042 - RNA, 15 nt, Homo sapiens
cugaaaaucuaauau

SEQ ID NO: 582043 - RNA, 21 nt, Homo sapiens
cugaaaaucuccuuccagggc

SEQ ID NO: 582044 - RNA, 13 nt, Homo sapiens
cugaaacacugga

SEQ ID NO: 582045 - RNA, 20 nt, Homo sapiens
cugaaacacuggaccugggg

SEQ ID NO: 582046 - RNA, 20 nt, Homo sapiens
cugaaacaugaacccaaaaa

SEQ ID NO: 582047 - RNA, 20 nt, Homo sapiens
cugaaacauucacacagggc

SEQ ID NO: 582048 - RNA, 14 nt, Homo sapiens
cugaaaccaaaaca

SEQ ID NO: 582049 - RNA, 24 nt, Homo sapiens
cugaaaccucugggucaucucuca

SEQ ID NO: 582050 - RNA, 15 nt, Homo sapiens
cugaaagaugaucau

SEQ ID NO: 582051 - RNA, 15 nt, Homo sapiens
cugaaagcaguguau

SEQ ID NO: 582052 - RNA, 12 nt, Homo sapiens
cugaaagccugu

SEQ ID NO: 582053 - RNA, 16 nt, Homo sapiens
cugaaagccuuaggga

SEQ ID NO: 582054 - RNA, 16 nt, Homo sapiens
cugaaaggaacacugg

SEQ ID NO: 582055 - RNA, 22 nt, Homo sapiens
cugaaaguaacucauaaucuau

SEQ ID NO: 582056 - RNA, 23 nt, Homo sapiens
cugaaaguaauauaaugaugcug

SEQ ID NO: 582057 - RNA, 17 nt, Homo sapiens
cugaaauaaaauucauu

SEQ ID NO: 582058 - RNA, 21 nt, Homo sapiens
cugaaaucuccuuuagccauc

SEQ ID NO: 582059 - RNA, 22 nt, Homo sapiens
cugaaaugcaagaccccaagag

SEQ ID NO: 582060 - RNA, 13 nt, Homo sapiens
cugaaauuuagua

SEQ ID NO: 582061 - RNA, 20 nt, Homo sapiens
cugaaauuuuuuuccuaagu

SEQ ID NO: 582062 - RNA, 14 nt, Homo sapiens
cugaacaaacuaaa

SEQ ID NO: 582063 - RNA, 16 nt, Homo sapiens
cugaacaaacuaaagg

SEQ ID NO: 582064 - RNA, 20 nt, Homo sapiens
cugaacaaucaaagcacuug

SEQ ID NO: 582065 - RNA, 16 nt, Homo sapiens
cugaacacacacgcca

SEQ ID NO: 582066 - RNA, 21 nt, Homo sapiens
cugaacacacccugaagaaau

SEQ ID NO: 582067 - RNA, 15 nt, Homo sapiens
cugaacacuuuaggu

SEQ ID NO: 582068 - RNA, 12 nt, Homo sapiens
cugaacagugga

SEQ ID NO: 582069 - RNA, 23 nt, Homo sapiens
cugaacauaggaaaauagaaacu

SEQ ID NO: 582070 - RNA, 18 nt, Homo sapiens
cugaacaugccugccaaa

SEQ ID NO: 582071 - RNA, 15 nt, Homo sapiens
cugaacauugcauau

SEQ ID NO: 582072 - RNA, 11 nt, Homo sapiens
cugaaccacaa

SEQ ID NO: 582073 - RNA, 18 nt, Homo sapiens
cugaacccacaccugggc

SEQ ID NO: 582074 - RNA, 13 nt, Homo sapiens
cugaacccacugc

SEQ ID NO: 582075 - RNA, 17 nt, Homo sapiens
cugaacccugccucuug

SEQ ID NO: 582076 - RNA, 17 nt, Homo sapiens
cugaaccgcacagcuca

SEQ ID NO: 582077 - RNA, 20 nt, Homo sapiens
cugaaccucaguuuccucau

SEQ ID NO: 582078 - RNA, 16 nt, Homo sapiens
cugaaccuugagcaaa

SEQ ID NO: 582079 - RNA, 16 nt, Homo sapiens
cugaacuacacugcau

SEQ ID NO: 582080 - RNA, 20 nt, Homo sapiens
cugaacuacauaacuuccua

SEQ ID NO: 582081 - RNA, 19 nt, Homo sapiens
cugaacucaaacugaggaa

SEQ ID NO: 582082 - RNA, 15 nt, Homo sapiens
cugaacucagcacau

SEQ ID NO: 582083 - RNA, 12 nt, Homo sapiens
cugaacuccaua

SEQ ID NO: 582084 - RNA, 16 nt, Homo sapiens
cugaacucuuaggcac

SEQ ID NO: 582085 - RNA, 19 nt, Homo sapiens
cugaacugacaaugaaggg

SEQ ID NO: 582086 - RNA, 15 nt, Homo sapiens
cugaacuugccuuaa

SEQ ID NO: 582087 - RNA, 13 nt, Homo sapiens
cugaagaaaccuu

SEQ ID NO: 582088 - RNA, 14 nt, Homo sapiens
cugaagaaaguuau

SEQ ID NO: 582089 - RNA, 20 nt, Homo sapiens
cugaagaauuuugagugaau

SEQ ID NO: 582090 - RNA, 14 nt, Homo sapiens
cugaagacauucaa

SEQ ID NO: 582091 - RNA, 13 nt, Homo sapiens
cugaagaccucca

SEQ ID NO: 582092 - RNA, 14 nt, Homo sapiens
cugaagaccuccac

SEQ ID NO: 582093 - RNA, 14 nt, Homo sapiens
cugaagauggcauc

SEQ ID NO: 582094 - RNA, 21 nt, Homo sapiens
cugaagauggcauccugugaa

SEQ ID NO: 582095 - RNA, 23 nt, Homo sapiens
cugaagauugcgguuuacagcua

SEQ ID NO: 582096 - RNA, 13 nt, Homo sapiens
cugaagcagguuc

SEQ ID NO: 582097 - RNA, 21 nt, Homo sapiens
cugaagcccucugucuaccug

SEQ ID NO: 582098 - RNA, 23 nt, Homo sapiens
cugaagccuccguggaacauucu

SEQ ID NO: 582099 - RNA, 20 nt, Homo sapiens
cugaaggaauagccagagag

SEQ ID NO: 582100 - RNA, 16 nt, Homo sapiens
cugaaggacacuuccu

SEQ ID NO: 582101 - RNA, 12 nt, Homo sapiens
cugaaggcuaaa

SEQ ID NO: 582102 - RNA, 19 nt, Homo sapiens
cugaagggggacacuccau

SEQ ID NO: 582103 - RNA, 15 nt, Homo sapiens
cugaaggucccaccu

SEQ ID NO: 582104 - RNA, 20 nt, Homo sapiens
cugaaggugauucaccaaaa

SEQ ID NO: 582105 - RNA, 22 nt, Homo sapiens
cugaaggugauucaccaaaaua

SEQ ID NO: 582106 - RNA, 19 nt, Homo sapiens
cugaaguacaaacaugaaa

SEQ ID NO: 582107 - RNA, 23 nt, Homo sapiens
cugaaguaugguauuacaaaaca

SEQ ID NO: 582108 - RNA, 19 nt, Homo sapiens
cugaagucaguguagaccu

SEQ ID NO: 582109 - RNA, 22 nt, Homo sapiens
cugaagucuucuccuccaugaa

SEQ ID NO: 582110 - RNA, 17 nt, Homo sapiens
cugaagugaacuaugaa

SEQ ID NO: 582111 - RNA, 21 nt, Homo sapiens
cugaaguguccuaaauauuaa

SEQ ID NO: 582112 - RNA, 22 nt, Homo sapiens
cugaauaaacucaaaacucuug

SEQ ID NO: 582113 - RNA, 15 nt, Homo sapiens
cugaauaacuugaag

SEQ ID NO: 582114 - RNA, 18 nt, Homo sapiens
cugaauacacaguauuca

SEQ ID NO: 582115 - RNA, 20 nt, Homo sapiens
cugaauaguuacugcugcac

SEQ ID NO: 582116 - RNA, 15 nt, Homo sapiens
cugaauaucuguuca

SEQ ID NO: 582117 - RNA, 12 nt, Homo sapiens
cugaauauugcc

SEQ ID NO: 582118 - RNA, 15 nt, Homo sapiens
cugaaucaagcacac

SEQ ID NO: 582119 - RNA, 20 nt, Homo sapiens
cugaaucaagcacacuguau

SEQ ID NO: 582120 - RNA, 20 nt, Homo sapiens
cugaaucaaggaaagccagg

SEQ ID NO: 582121 - RNA, 22 nt, Homo sapiens
cugaaucagaaaagcuauuaaa

SEQ ID NO: 582122 - RNA, 20 nt, Homo sapiens
cugaaucagcuggacauacu

SEQ ID NO: 582123 - RNA, 17 nt, Homo sapiens
cugaaucuauggcuuua

SEQ ID NO: 582124 - RNA, 16 nt, Homo sapiens
cugaaucugcuaccaa

SEQ ID NO: 582125 - RNA, 18 nt, Homo sapiens
cugaaugauuuccaaaga

SEQ ID NO: 582126 - RNA, 18 nt, Homo sapiens
cugaaugccucaauguga

SEQ ID NO: 582127 - RNA, 19 nt, Homo sapiens
cugaaugcuccauuaaucc

SEQ ID NO: 582128 - RNA, 15 nt, Homo sapiens
cugaaugguuuucaa

SEQ ID NO: 582129 - RNA, 18 nt, Homo sapiens
cugaaugugccuaaugga

SEQ ID NO: 582130 - RNA, 15 nt, Homo sapiens
cugaauuacagugaa

SEQ ID NO: 582131 - RNA, 17 nt, Homo sapiens
cugaauuaugcuuccac

SEQ ID NO: 582132 - RNA, 17 nt, Homo sapiens
cugaauucuggaaucac

SEQ ID NO: 582133 - RNA, 19 nt, Homo sapiens
cugaauucuucuagcuccu

SEQ ID NO: 582134 - RNA, 23 nt, Homo sapiens
cugaauuuggagucugacugugc

SEQ ID NO: 582135 - RNA, 19 nt, Homo sapiens
cugaauuuggccugcacua

SEQ ID NO: 582136 - RNA, 22 nt, Homo sapiens
cugaauuuuuaaaacccauuua

SEQ ID NO: 582137 - RNA, 16 nt, Homo sapiens
cugacaagauggucca

SEQ ID NO: 582138 - RNA, 14 nt, Homo sapiens
cugacaagcacugc

SEQ ID NO: 582139 - RNA, 19 nt, Homo sapiens
caaguccauguuauucucu

SEQ ID NO: 582140 - RNA, 16 nt, Homo sapiens
caaguccuguucuguu

SEQ ID NO: 582141 - RNA, 15 nt, Homo sapiens
caagucgaugaacua

SEQ ID NO: 582142 - RNA, 17 nt, Homo sapiens
caagucuaacaguuaau

SEQ ID NO: 582143 - RNA, 12 nt, Homo sapiens
caagucuucccu

SEQ ID NO: 582144 - RNA, 19 nt, Homo sapiens
caagucuugaaacaagcaa

SEQ ID NO: 582145 - RNA, 17 nt, Homo sapiens
caagugaaaaacaucca

SEQ ID NO: 582146 - RNA, 18 nt, Homo sapiens
caagugaaaaacauccag

SEQ ID NO: 582147 - RNA, 15 nt, Homo sapiens
caagugaauacauuu

SEQ ID NO: 582148 - RNA, 16 nt, Homo sapiens
caagugacucuccugc

SEQ ID NO: 582149 - RNA, 17 nt, Homo sapiens
caagugagacaaaaagc

SEQ ID NO: 582150 - RNA, 21 nt, Homo sapiens
caagugagcagagauguacug

SEQ ID NO: 582151 - RNA, 23 nt, Homo sapiens
caagugagcagagauguacugca

SEQ ID NO: 582152 - RNA, 20 nt, Homo sapiens
caagugagucugguggagga

SEQ ID NO: 582153 - RNA, 18 nt, Homo sapiens
caagugauccacccaccu

SEQ ID NO: 582154 - RNA, 21 nt, Homo sapiens
caagugauccuuccaccucag

SEQ ID NO: 582155 - RNA, 15 nt, Homo sapiens
caagugccuuagcaa

SEQ ID NO: 582156 - RNA, 17 nt, Homo sapiens
caagugcgugccgugug

SEQ ID NO: 582157 - RNA, 13 nt, Homo sapiens
caagugcuaccuu

SEQ ID NO: 582158 - RNA, 12 nt, Homo sapiens
caaguggcaugu

SEQ ID NO: 582159 - RNA, 22 nt, Homo sapiens
caaguguaaaauauuuugaauc

SEQ ID NO: 582160 - RNA, 14 nt, Homo sapiens
caaguguacaguga

SEQ ID NO: 582161 - RNA, 16 nt, Homo sapiens
caagugucuagaguca

SEQ ID NO: 582162 - RNA, 13 nt, Homo sapiens
caagugucuucca

SEQ ID NO: 582163 - RNA, 17 nt, Homo sapiens
caagugugcacuccagc

SEQ ID NO: 582164 - RNA, 21 nt, Homo sapiens
caagugugggccacuguggug

SEQ ID NO: 582165 - RNA, 14 nt, Homo sapiens
caagugugucuuac

SEQ ID NO: 582166 - RNA, 13 nt, Homo sapiens
caagugugugcac

SEQ ID NO: 582167 - RNA, 14 nt, Homo sapiens
caagugugugcaca

SEQ ID NO: 582168 - RNA, 16 nt, Homo sapiens
caagugugugcacaug

SEQ ID NO: 582169 - RNA, 22 nt, Homo sapiens
caagugugugcaugugugcgag

SEQ ID NO: 582170 - RNA, 22 nt, Homo sapiens
caaguuagaaaacauaaucuuc

SEQ ID NO: 582171 - RNA, 17 nt, Homo sapiens
caaguuauagauucaau

SEQ ID NO: 582172 - RNA, 15 nt, Homo sapiens
caaguuauauugaau

SEQ ID NO: 582173 - RNA, 21 nt, Homo sapiens
caaguucgucuguugugcgaa

SEQ ID NO: 582174 - RNA, 20 nt, Homo sapiens
caaguucuuagggcacauga

SEQ ID NO: 582175 - RNA, 16 nt, Homo sapiens
caaguugcugucacug

SEQ ID NO: 582176 - RNA, 18 nt, Homo sapiens
caaguugcuuuuaccuga

SEQ ID NO: 582177 - RNA, 18 nt, Homo sapiens
caaguuggguucacuugc

SEQ ID NO: 582178 - RNA, 18 nt, Homo sapiens
caaguuguugacugugau

SEQ ID NO: 582179 - RNA, 13 nt, Homo sapiens
caaguuuacuuuu

SEQ ID NO: 582180 - RNA, 17 nt, Homo sapiens
caaguuucaucagucaa

SEQ ID NO: 582181 - RNA, 13 nt, Homo sapiens
caaguuuccauag

SEQ ID NO: 582182 - RNA, 16 nt, Homo sapiens
caaguuuccccagcuu

SEQ ID NO: 582183 - RNA, 18 nt, Homo sapiens
caaguuugaccagugcag

SEQ ID NO: 582184 - RNA, 14 nt, Homo sapiens
caaguuugcuaaaa

SEQ ID NO: 582185 - RNA, 21 nt, Homo sapiens
caaguuuuuuaauuaagcaga

SEQ ID NO: 582186 - RNA, 17 nt, Homo sapiens
caauaaaaagcucuuaa

SEQ ID NO: 582187 - RNA, 21 nt, Homo sapiens
caauaaaaccugggugucaga

SEQ ID NO: 582188 - RNA, 17 nt, Homo sapiens
caauaaaaccuuugcca

SEQ ID NO: 582189 - RNA, 12 nt, Homo sapiens
caauaaaagagc

SEQ ID NO: 582190 - RNA, 16 nt, Homo sapiens
caauaaaaugucuucu

SEQ ID NO: 582191 - RNA, 18 nt, Homo sapiens
caauaaaaugucuucucc

SEQ ID NO: 582192 - RNA, 16 nt, Homo sapiens
caauaaacuccuacua

SEQ ID NO: 582193 - RNA, 22 nt, Homo sapiens
caauaaagcagccucauucuga

SEQ ID NO: 582194 - RNA, 23 nt, Homo sapiens
caauaaaggacaggcuggugcua

SEQ ID NO: 582195 - RNA, 18 nt, Homo sapiens
caauaaaguuauucagaa

SEQ ID NO: 582196 - RNA, 21 nt, Homo sapiens
caauaaaguuccccugugaca

SEQ ID NO: 582197 - RNA, 19 nt, Homo sapiens
caauaaauaccagacacgu

SEQ ID NO: 582198 - RNA, 17 nt, Homo sapiens
caauaaaugccacuuca

SEQ ID NO: 582199 - RNA, 19 nt, Homo sapiens
caauaacaaagcacauaac

SEQ ID NO: 582200 - RNA, 16 nt, Homo sapiens
caauaacuucuauguu

SEQ ID NO: 582201 - RNA, 20 nt, Homo sapiens
caauaacuuuucaccaauga

SEQ ID NO: 582202 - RNA, 22 nt, Homo sapiens
caauaacuuuucaccaaugagc

SEQ ID NO: 582203 - RNA, 20 nt, Homo sapiens
caauaagaaaugaacaaaag

SEQ ID NO: 582204 - RNA, 22 nt, Homo sapiens
caauaaucaacugaauugcaaa

SEQ ID NO: 582205 - RNA, 20 nt, Homo sapiens
caauaaugacaaaugcccug

SEQ ID NO: 582206 - RNA, 21 nt, Homo sapiens
caauaaugugcaaauuuugca

SEQ ID NO: 582207 - RNA, 16 nt, Homo sapiens
caauaauuuuaacuuu

SEQ ID NO: 582208 - RNA, 14 nt, Homo sapiens
caauacaaccagcc

SEQ ID NO: 582209 - RNA, 13 nt, Homo sapiens
caauacaauguac

SEQ ID NO: 582210 - RNA, 20 nt, Homo sapiens
caauacagaucaucuuggaa

SEQ ID NO: 582211 - RNA, 13 nt, Homo sapiens
caauacagugaag

SEQ ID NO: 582212 - RNA, 19 nt, Homo sapiens
caauacauauaucuacaca

SEQ ID NO: 582213 - RNA, 15 nt, Homo sapiens
caauacaugcugcua

SEQ ID NO: 582214 - RNA, 14 nt, Homo sapiens
caauaccaaauagc

SEQ ID NO: 582215 - RNA, 15 nt, Homo sapiens
caauacucaaaagag

SEQ ID NO: 582216 - RNA, 14 nt, Homo sapiens
caauacugagccau

SEQ ID NO: 582217 - RNA, 14 nt, Homo sapiens
caauacugcccaag

SEQ ID NO: 582218 - RNA, 11 nt, Homo sapiens
caauacuguag

SEQ ID NO: 582219 - RNA, 21 nt, Homo sapiens
caauacuguaggaacaagcau

SEQ ID NO: 582220 - RNA, 14 nt, Homo sapiens
caauagaguucucc

SEQ ID NO: 582221 - RNA, 18 nt, Homo sapiens
caauagaguugggacaau

SEQ ID NO: 582222 - RNA, 14 nt, Homo sapiens
caauagaucuccag

SEQ ID NO: 582223 - RNA, 14 nt, Homo sapiens
caauaggagucuua

SEQ ID NO: 582224 - RNA, 15 nt, Homo sapiens
caauaggcauuugau

SEQ ID NO: 582225 - RNA, 20 nt, Homo sapiens
caauagggugcaguuuucca

SEQ ID NO: 582226 - RNA, 22 nt, Homo sapiens
caauaggucuuucucucaguga

SEQ ID NO: 582227 - RNA, 18 nt, Homo sapiens
caauaggugcugagugua

SEQ ID NO: 582228 - RNA, 16 nt, Homo sapiens
caauagugcaacaucu

SEQ ID NO: 582229 - RNA, 15 nt, Homo sapiens
caauagugucauccu

SEQ ID NO: 582230 - RNA, 17 nt, Homo sapiens
caauagugucauccuca

SEQ ID NO: 582231 - RNA, 14 nt, Homo sapiens
caauauacaagcuu

SEQ ID NO: 582232 - RNA, 12 nt, Homo sapiens
caauauacuuca

SEQ ID NO: 582233 - RNA, 20 nt, Homo sapiens
caauaucaugucuugugcau

SEQ ID NO: 582234 - RNA, 21 nt, Homo sapiens
caauaucaugucuugugcaua

SEQ ID NO: 582235 - RNA, 17 nt, Homo sapiens
caauaucccaacauucu

SEQ ID NO: 582236 - RNA, 12 nt, Homo sapiens
caauaugacuca

SEQ ID NO: 582237 - RNA, 12 nt, Homo sapiens
caauaugcauuu

SEQ ID NO: 582238 - RNA, 18 nt, Homo sapiens
caauaugggcucaaguca

SEQ ID NO: 582239 - RNA, 16 nt, Homo sapiens
caauaugugccaauca

SEQ ID NO: 582240 - RNA, 19 nt, Homo sapiens
caauauuaacacgcugccu

SEQ ID NO: 582241 - RNA, 21 nt, Homo sapiens
caauauuaaguccaaauccaa

SEQ ID NO: 582242 - RNA, 23 nt, Homo sapiens
caauauugggccuaaaacaguau

SEQ ID NO: 582243 - RNA, 20 nt, Homo sapiens
caauauuuaguaaagcuuuu

SEQ ID NO: 582244 - RNA, 14 nt, Homo sapiens
caaucaaagcacuu

SEQ ID NO: 582245 - RNA, 15 nt, Homo sapiens
caaucaaagcacuug

SEQ ID NO: 582246 - RNA, 22 nt, Homo sapiens
caaucaauucauaucuauuuau

SEQ ID NO: 582247 - RNA, 21 nt, Homo sapiens
caaucagagagccuagaacau

SEQ ID NO: 582248 - RNA, 13 nt, Homo sapiens
caaucagccuuua

SEQ ID NO: 582249 - RNA, 19 nt, Homo sapiens
caaucaugagcaagugaac

SEQ ID NO: 582250 - RNA, 17 nt, Homo sapiens
caaucauuuauucauug

SEQ ID NO: 582251 - RNA, 15 nt, Homo sapiens
caauccaucucucaa

SEQ ID NO: 582252 - RNA, 14 nt, Homo sapiens
caauccuaagcaaa

SEQ ID NO: 582253 - RNA, 13 nt, Homo sapiens
caauccuauguuu

SEQ ID NO: 582254 - RNA, 13 nt, Homo sapiens
caauccugucaua

SEQ ID NO: 582255 - RNA, 15 nt, Homo sapiens
caauccuuuaccacu

SEQ ID NO: 582256 - RNA, 20 nt, Homo sapiens
caaucucagcuaacauucca

SEQ ID NO: 582257 - RNA, 19 nt, Homo sapiens
caaucucuguuuguaugug

SEQ ID NO: 582258 - RNA, 21 nt, Homo sapiens
caaucugagccagugcuuuaa

SEQ ID NO: 582259 - RNA, 19 nt, Homo sapiens
caaucuuaaaacaaauuca

SEQ ID NO: 582260 - RNA, 13 nt, Homo sapiens
caaucuuugccuu

SEQ ID NO: 582261 - RNA, 18 nt, Homo sapiens
caaugaaauauugcugua

SEQ ID NO: 582262 - RNA, 16 nt, Homo sapiens
caaugaacaucccuuu

SEQ ID NO: 582263 - RNA, 18 nt, Homo sapiens
caaugaaggagauagauu

SEQ ID NO: 582264 - RNA, 17 nt, Homo sapiens
caaugaccacauccuga

SEQ ID NO: 582265 - RNA, 13 nt, Homo sapiens
caaugagcaauga

SEQ ID NO: 582266 - RNA, 13 nt, Homo sapiens
caaugagccuuag

SEQ ID NO: 582267 - RNA, 12 nt, Homo sapiens
caaugauaugca

SEQ ID NO: 582268 - RNA, 22 nt, Homo sapiens
caaugaugugucuucaauguca

SEQ ID NO: 582269 - RNA, 17 nt, Homo sapiens
caaugcaaaguacaugu

SEQ ID NO: 582270 - RNA, 22 nt, Homo sapiens
caaugcaccuagcugugcaaga

SEQ ID NO: 582271 - RNA, 13 nt, Homo sapiens
caaugcauacaau

SEQ ID NO: 582272 - RNA, 20 nt, Homo sapiens
caaugcccugugcaugccau

SEQ ID NO: 582273 - RNA, 23 nt, Homo sapiens
caaugcugccugggagccagggu

SEQ ID NO: 582274 - RNA, 18 nt, Homo sapiens
caauggaacaguagcuuu

SEQ ID NO: 582275 - RNA, 16 nt, Homo sapiens
caauggagacugucuc

SEQ ID NO: 582276 - RNA, 14 nt, Homo sapiens
caauggcggacuca

SEQ ID NO: 582277 - RNA, 21 nt, Homo sapiens
caauggcuuguucaucaucca

SEQ ID NO: 582278 - RNA, 11 nt, Homo sapiens
caaugggaccg

SEQ ID NO: 582279 - RNA, 19 nt, Homo sapiens
caaugggagcugaggccac

SEQ ID NO: 582280 - RNA, 18 nt, Homo sapiens
caaugggccuccagagac

SEQ ID NO: 582281 - RNA, 15 nt, Homo sapiens
caauggugcaaaaaa

SEQ ID NO: 582282 - RNA, 17 nt, Homo sapiens
caaugguuaacaucuuc

SEQ ID NO: 582283 - RNA, 17 nt, Homo sapiens
caaugguucucuucccu

SEQ ID NO: 582284 - RNA, 22 nt, Homo sapiens
caaugguuugugucaaaacugg

SEQ ID NO: 582285 - RNA, 23 nt, Homo sapiens
caaugguuugugucaaaacuggu

SEQ ID NO: 582286 - RNA, 19 nt, Homo sapiens
caauguaaauaguauaaag

SEQ ID NO: 582287 - RNA, 14 nt, Homo sapiens
caauguaagcauac

SEQ ID NO: 582288 - RNA, 14 nt, Homo sapiens
caauguaugaauua

SEQ ID NO: 582289 - RNA, 13 nt, Homo sapiens
caaugucacuuaa

SEQ ID NO: 582290 - RNA, 21 nt, Homo sapiens
caauguccugaaacaugaacc

SEQ ID NO: 582291 - RNA, 16 nt, Homo sapiens
caaugucugcugagga

SEQ ID NO: 582292 - RNA, 17 nt, Homo sapiens
caaugucugguuaguua

SEQ ID NO: 582293 - RNA, 18 nt, Homo sapiens
caaugucuucaagacuuu

SEQ ID NO: 582294 - RNA, 17 nt, Homo sapiens
caaugucuuuugacagg

SEQ ID NO: 582295 - RNA, 19 nt, Homo sapiens
caaugugaaacacaugcca

SEQ ID NO: 582296 - RNA, 19 nt, Homo sapiens
caaugugaaaccaucacag

SEQ ID NO: 582297 - RNA, 15 nt, Homo sapiens
caaugugaacacugg

SEQ ID NO: 582298 - RNA, 21 nt, Homo sapiens
caaugugauucuaaugucuuc

SEQ ID NO: 582299 - RNA, 14 nt, Homo sapiens
caaugugauucuuc

SEQ ID NO: 582300 - RNA, 15 nt, Homo sapiens
caauguggacgugca

SEQ ID NO: 582301 - RNA, 21 nt, Homo sapiens
caauguucauagcaacauuau

SEQ ID NO: 582302 - RNA, 17 nt, Homo sapiens
caauguuccauucuucg

SEQ ID NO: 582303 - RNA, 21 nt, Homo sapiens
caauguucuuugucucaaaau

SEQ ID NO: 582304 - RNA, 23 nt, Homo sapiens
caauguuucuguuucaggcuucc

SEQ ID NO: 582305 - RNA, 22 nt, Homo sapiens
caauguuuguaauaauugcuca

SEQ ID NO: 582306 - RNA, 23 nt, Homo sapiens
caauuaaacauuacuguuuucca

SEQ ID NO: 582307 - RNA, 18 nt, Homo sapiens
caauuaaguccuacuuua

SEQ ID NO: 582308 - RNA, 19 nt, Homo sapiens
caauuaagugcuuuaccua

SEQ ID NO: 582309 - RNA, 23 nt, Homo sapiens
caauuaauuccuguuugucuaca

SEQ ID NO: 582310 - RNA, 18 nt, Homo sapiens
caauuacaacagugagaa

SEQ ID NO: 582311 - RNA, 13 nt, Homo sapiens
caauuagcauuau

SEQ ID NO: 582312 - RNA, 15 nt, Homo sapiens
caauuaguggucaua

SEQ ID NO: 582313 - RNA, 22 nt, Homo sapiens
caauuauacuaaaccucacaaa

SEQ ID NO: 582314 - RNA, 23 nt, Homo sapiens
caauuauaucaguccucuuucaa

SEQ ID NO: 582315 - RNA, 15 nt, Homo sapiens
caauuaucuguguca

SEQ ID NO: 582316 - RNA, 19 nt, Homo sapiens
caauucaaaacauugugcc

SEQ ID NO: 582317 - RNA, 23 nt, Homo sapiens
caauucacuagaccagaagugga

SEQ ID NO: 582318 - RNA, 16 nt, Homo sapiens
caauucagacaggcaa

SEQ ID NO: 582319 - RNA, 17 nt, Homo sapiens
caauuccaaagccagac

SEQ ID NO: 582320 - RNA, 17 nt, Homo sapiens
caauuccugacacuuga

SEQ ID NO: 582321 - RNA, 18 nt, Homo sapiens
caauuccugugauuuaug

SEQ ID NO: 582322 - RNA, 22 nt, Homo sapiens
caauucguuggauuuuuguuua

SEQ ID NO: 582323 - RNA, 20 nt, Homo sapiens
caauucucaaaagaaaaggc

SEQ ID NO: 582324 - RNA, 18 nt, Homo sapiens
caauucuguaauuacaua

SEQ ID NO: 582325 - RNA, 20 nt, Homo sapiens
caauucugugacauacauau

SEQ ID NO: 582326 - RNA, 21 nt, Homo sapiens
caauucuuuguauaugcauuc

SEQ ID NO: 582327 - RNA, 20 nt, Homo sapiens
caauugacugucacuguucc

SEQ ID NO: 582328 - RNA, 20 nt, Homo sapiens
caauugagcaagaugcugau

SEQ ID NO: 582329 - RNA, 20 nt, Homo sapiens
caauugauguuuuacgugca

SEQ ID NO: 582330 - RNA, 21 nt, Homo sapiens
caauugucauuuauaaaacca

SEQ ID NO: 582331 - RNA, 13 nt, Homo sapiens
caauugugcugcc

SEQ ID NO: 582332 - RNA, 11 nt, Homo sapiens
caauuguguag

SEQ ID NO: 582333 - RNA, 14 nt, Homo sapiens
caauuuacacugcc

SEQ ID NO: 582334 - RNA, 23 nt, Homo sapiens
caauuucacgcuuuuaauucuca

SEQ ID NO: 582335 - RNA, 18 nt, Homo sapiens
caauuuccucuccacugc

SEQ ID NO: 582336 - RNA, 14 nt, Homo sapiens
caauuucuaaauac

SEQ ID NO: 582337 - RNA, 13 nt, Homo sapiens
caauuucuuccuu

SEQ ID NO: 582338 - RNA, 22 nt, Homo sapiens
caauuugagccagagagcaucu

SEQ ID NO: 582339 - RNA, 21 nt, Homo sapiens
caauuuggacuggugugcucu

SEQ ID NO: 582340 - RNA, 16 nt, Homo sapiens
caauuuguauaucaug

SEQ ID NO: 582341 - RNA, 16 nt, Homo sapiens
caauuuuaaacauauc

SEQ ID NO: 582342 - RNA, 23 nt, Homo sapiens
caauuuucuuuuuuauacucaau

SEQ ID NO: 582343 - RNA, 20 nt, Homo sapiens
caauuuuucaagagcuccuu

SEQ ID NO: 582344 - RNA, 17 nt, Homo sapiens
caauuuuugacauuaau

SEQ ID NO: 582345 - RNA, 18 nt, Homo sapiens
caauuuuugucucagaag

SEQ ID NO: 582346 - RNA, 12 nt, Homo sapiens
cacaaaacagaa

SEQ ID NO: 582347 - RNA, 13 nt, Homo sapiens
cacaaaacccaga

SEQ ID NO: 582348 - RNA, 19 nt, Homo sapiens
cacaaaagcagauacuuga

SEQ ID NO: 582349 - RNA, 20 nt, Homo sapiens
cacaaaagcagauacuugag

SEQ ID NO: 582350 - RNA, 15 nt, Homo sapiens
cacaaaauuaugcaa

SEQ ID NO: 582351 - RNA, 13 nt, Homo sapiens
cacaaacauauaa

SEQ ID NO: 582352 - RNA, 14 nt, Homo sapiens
cacaaacauucaaa

SEQ ID NO: 582353 - RNA, 13 nt, Homo sapiens
cacaaaccaguau

SEQ ID NO: 582354 - RNA, 21 nt, Homo sapiens
cacaaacgauuuggaucaaaa

SEQ ID NO: 582355 - RNA, 13 nt, Homo sapiens
cacaaacuugaca

SEQ ID NO: 582356 - RNA, 17 nt, Homo sapiens
cacaaagcaaaggcagu

SEQ ID NO: 582357 - RNA, 21 nt, Homo sapiens
cacaaaguagaggaauccaug

SEQ ID NO: 582358 - RNA, 13 nt, Homo sapiens
cacaaaguguaua

SEQ ID NO: 582359 - RNA, 22 nt, Homo sapiens
cuaauuccuggcaugacacucu

SEQ ID NO: 582360 - RNA, 23 nt, Homo sapiens
cuaauuccuggcaugacacucua

SEQ ID NO: 582361 - RNA, 19 nt, Homo sapiens
cuaauucuucuguccugag

SEQ ID NO: 582362 - RNA, 18 nt, Homo sapiens
cuaauucuuguagaugca

SEQ ID NO: 582363 - RNA, 14 nt, Homo sapiens
cuaauugcuuucug

SEQ ID NO: 582364 - RNA, 19 nt, Homo sapiens
cuaauuggaagaaauuccu

SEQ ID NO: 582365 - RNA, 15 nt, Homo sapiens
cuaauugugcacauc

SEQ ID NO: 582366 - RNA, 12 nt, Homo sapiens
cuaauuguggau

SEQ ID NO: 582367 - RNA, 18 nt, Homo sapiens
cuaauuuauaacuauuau

SEQ ID NO: 582368 - RNA, 14 nt, Homo sapiens
cuaauuuauucaaa

SEQ ID NO: 582369 - RNA, 22 nt, Homo sapiens
cuaauuucugaaaugugcagcu

SEQ ID NO: 582370 - RNA, 23 nt, Homo sapiens
cuaauuugaauggaaaacacaug

SEQ ID NO: 582371 - RNA, 21 nt, Homo sapiens
cuaauuugcacuaauguguua

SEQ ID NO: 582372 - RNA, 16 nt, Homo sapiens
cuaauuuuaguauuca

SEQ ID NO: 582373 - RNA, 19 nt, Homo sapiens
cuaauuuuaguauucauuc

SEQ ID NO: 582374 - RNA, 20 nt, Homo sapiens
cuaauuuucuagauuuucua

SEQ ID NO: 582375 - RNA, 22 nt, Homo sapiens
cuaauuuuguacauacuguauu

SEQ ID NO: 582376 - RNA, 15 nt, Homo sapiens
cuaauuuuucagcuc

SEQ ID NO: 582377 - RNA, 21 nt, Homo sapiens
cuaauuuuucagcuccuucaa

SEQ ID NO: 582378 - RNA, 22 nt, Homo sapiens
cuaauuuuucagcuccuucaau

SEQ ID NO: 582379 - RNA, 15 nt, Homo sapiens
cuaauuuuugcaaau

SEQ ID NO: 582380 - RNA, 20 nt, Homo sapiens
cuacaaaaaaugcagaacuu

SEQ ID NO: 582381 - RNA, 19 nt, Homo sapiens
cuacaaaaccucaaaccag

SEQ ID NO: 582382 - RNA, 19 nt, Homo sapiens
cuagacuucccagggcaag

SEQ ID NO: 582383 - RNA, 12 nt, Homo sapiens
cuagacuugaaa

SEQ ID NO: 582384 - RNA, 17 nt, Homo sapiens
cuagagaaaagucuacc

SEQ ID NO: 582385 - RNA, 16 nt, Homo sapiens
cuagagaaggcuguga

SEQ ID NO: 582386 - RNA, 22 nt, Homo sapiens
cuagagacaggcaaacugcaaa

SEQ ID NO: 582387 - RNA, 22 nt, Homo sapiens
cuagagagggaggcaagcccug

SEQ ID NO: 582388 - RNA, 18 nt, Homo sapiens
cuagagcacacuguagca

SEQ ID NO: 582389 - RNA, 18 nt, Homo sapiens
cuagagcugagagucuga

SEQ ID NO: 582390 - RNA, 13 nt, Homo sapiens
cuagagggacaaa

SEQ ID NO: 582391 - RNA, 14 nt, Homo sapiens
cuagaguccucacu

SEQ ID NO: 582392 - RNA, 17 nt, Homo sapiens
cuagaguccucacuccc

SEQ ID NO: 582393 - RNA, 20 nt, Homo sapiens
cuagagugcaauggcgcgau

SEQ ID NO: 582394 - RNA, 12 nt, Homo sapiens
cuagaguuuuau

SEQ ID NO: 582395 - RNA, 12 nt, Homo sapiens
cuagauacugga

SEQ ID NO: 582396 - RNA, 15 nt, Homo sapiens
cuagauagcuauuaa

SEQ ID NO: 582397 - RNA, 17 nt, Homo sapiens
cuagaugauugauuacc

SEQ ID NO: 582398 - RNA, 20 nt, Homo sapiens
cuagaugauugauuaccaag

SEQ ID NO: 582399 - RNA, 18 nt, Homo sapiens
cuagaugcaucacugggu

SEQ ID NO: 582400 - RNA, 22 nt, Homo sapiens
cuagauggagaaaguaacacaa

SEQ ID NO: 582401 - RNA, 20 nt, Homo sapiens
cuagaugugcaaaugcaagc

SEQ ID NO: 582402 - RNA, 14 nt, Homo sapiens
cuagaugugucuua

SEQ ID NO: 582403 - RNA, 17 nt, Homo sapiens
cuagaugugucuuacca

SEQ ID NO: 582404 - RNA, 18 nt, Homo sapiens
cuagauuuucuacuuuau

SEQ ID NO: 582405 - RNA, 16 nt, Homo sapiens
cuagauuuuguugacc

SEQ ID NO: 582406 - RNA, 20 nt, Homo sapiens
cuagcaaaggaaaauugcac

SEQ ID NO: 582407 - RNA, 19 nt, Homo sapiens
cuagcaauugguuguuuaa

SEQ ID NO: 582408 - RNA, 13 nt, Homo sapiens
cuagcacaguaaa

SEQ ID NO: 582409 - RNA, 20 nt, Homo sapiens
cuagcacuuugggaggccaa

SEQ ID NO: 582410 - RNA, 14 nt, Homo sapiens
cuagcagaaaucua

SEQ ID NO: 582411 - RNA, 23 nt, Homo sapiens
cuagcagaaaucuagaagacugu

SEQ ID NO: 582412 - RNA, 23 nt, Homo sapiens
cuagcaggccuaagacaugugag

SEQ ID NO: 582413 - RNA, 17 nt, Homo sapiens
cuagcaugaacuugugg

SEQ ID NO: 582414 - RNA, 15 nt, Homo sapiens
cuagcauuacuagau

SEQ ID NO: 582415 - RNA, 21 nt, Homo sapiens
cuagcauuacuagauauuaaa

SEQ ID NO: 582416 - RNA, 17 nt, Homo sapiens
cuagcauuccucaggaa

SEQ ID NO: 582417 - RNA, 13 nt, Homo sapiens
cuagcauugcacu

SEQ ID NO: 582418 - RNA, 16 nt, Homo sapiens
cuagccagaggcucua

SEQ ID NO: 582419 - RNA, 15 nt, Homo sapiens
cuagccaucuugauc

SEQ ID NO: 582420 - RNA, 22 nt, Homo sapiens
cuagccaugauaacugcaauuu

SEQ ID NO: 582421 - RNA, 19 nt, Homo sapiens
cuagcccuccccccagcuc

SEQ ID NO: 582422 - RNA, 18 nt, Homo sapiens
cuagccugggccagagaa

SEQ ID NO: 582423 - RNA, 22 nt, Homo sapiens
cuagccuuggccucuuuccuca

SEQ ID NO: 582424 - RNA, 19 nt, Homo sapiens
cuagcuagaaauaugauuu

SEQ ID NO: 582425 - RNA, 15 nt, Homo sapiens
cuagcugugcaagac

SEQ ID NO: 582426 - RNA, 15 nt, Homo sapiens
cuagcuuacugauga

SEQ ID NO: 582427 - RNA, 19 nt, Homo sapiens
cuaggagcugggaggaaaa

SEQ ID NO: 582428 - RNA, 18 nt, Homo sapiens
cuaggaggucaucaaccg

SEQ ID NO: 582429 - RNA, 13 nt, Homo sapiens
cuaggaugugaug

SEQ ID NO: 582430 - RNA, 17 nt, Homo sapiens
cuaggcauuugcugaau

SEQ ID NO: 582431 - RNA, 18 nt, Homo sapiens
cuaggcuaagcacuuuau

SEQ ID NO: 582432 - RNA, 19 nt, Homo sapiens
cuaggcuggaagccauggu

SEQ ID NO: 582433 - RNA, 21 nt, Homo sapiens
cuaggcuggaggacaguggca

SEQ ID NO: 582434 - RNA, 17 nt, Homo sapiens
cuagggaggaccuuauc

SEQ ID NO: 582435 - RNA, 14 nt, Homo sapiens
cuagggaucccuca

SEQ ID NO: 582436 - RNA, 19 nt, Homo sapiens
cuagggauucaggcugcuu

SEQ ID NO: 582437 - RNA, 13 nt, Homo sapiens
cuagggcacuucu

SEQ ID NO: 582438 - RNA, 16 nt, Homo sapiens
cuagggccaagcccag

SEQ ID NO: 582439 - RNA, 17 nt, Homo sapiens
cuaggggcagccugaau

SEQ ID NO: 582440 - RNA, 22 nt, Homo sapiens
cuagggucuugggggucagggg

SEQ ID NO: 582441 - RNA, 16 nt, Homo sapiens
cuagguagugaccuaa

SEQ ID NO: 582442 - RNA, 22 nt, Homo sapiens
cuagguaucauucaacucucca

SEQ ID NO: 582443 - RNA, 17 nt, Homo sapiens
cuaggucuccucagggu

SEQ ID NO: 582444 - RNA, 20 nt, Homo sapiens
cuagguggguugaaagccaa

SEQ ID NO: 582445 - RNA, 23 nt, Homo sapiens
cuagguggguugaaagccaagga

SEQ ID NO: 582446 - RNA, 17 nt, Homo sapiens
cuagguuuuauucauac

SEQ ID NO: 582447 - RNA, 11 nt, Homo sapiens
cuaguacaaaa

SEQ ID NO: 582448 - RNA, 21 nt, Homo sapiens
cuaguagaacucacagaaaua

SEQ ID NO: 582449 - RNA, 16 nt, Homo sapiens
cuaguagcuaaccauc

SEQ ID NO: 582450 - RNA, 22 nt, Homo sapiens
cuaguauuuauggguggauuua

SEQ ID NO: 582451 - RNA, 19 nt, Homo sapiens
cuagucuccuuugcacuga

SEQ ID NO: 582452 - RNA, 20 nt, Homo sapiens
cuagucuguguaacuuuaaa

SEQ ID NO: 582453 - RNA, 18 nt, Homo sapiens
cuagugacuuccugguga

SEQ ID NO: 582454 - RNA, 23 nt, Homo sapiens
cuagugagcaaaauaugccccuu

SEQ ID NO: 582455 - RNA, 22 nt, Homo sapiens
cuagugccccagacugagcucu

SEQ ID NO: 582456 - RNA, 11 nt, Homo sapiens
cuagugccuuc

SEQ ID NO: 582457 - RNA, 17 nt, Homo sapiens
cuagugcugcugaagau

SEQ ID NO: 582458 - RNA, 23 nt, Homo sapiens
cuagugcuuuucagugauacuca

SEQ ID NO: 582459 - RNA, 14 nt, Homo sapiens
cuaguguugcuugg

SEQ ID NO: 582460 - RNA, 15 nt, Homo sapiens
cuaguuacuguggua

SEQ ID NO: 582461 - RNA, 20 nt, Homo sapiens
cuaguucuuuucauuuggaa

SEQ ID NO: 582462 - RNA, 14 nt, Homo sapiens
cuaguuugaccuca

SEQ ID NO: 582463 - RNA, 15 nt, Homo sapiens
cuaguuugaccucau

SEQ ID NO: 582464 - RNA, 13 nt, Homo sapiens
cuaguuugcacua

SEQ ID NO: 582465 - RNA, 21 nt, Homo sapiens
cuaguuugcuuugcugaccaa

SEQ ID NO: 582466 - RNA, 15 nt, Homo sapiens
cuaguuuugcugaaa

SEQ ID NO: 582467 - RNA, 22 nt, Homo sapiens
cuauaaaauaaacuucuuaaca

SEQ ID NO: 582468 - RNA, 17 nt, Homo sapiens
cuauaaaaugacagauc

SEQ ID NO: 582469 - RNA, 17 nt, Homo sapiens
cuauaacaugucuuuca

SEQ ID NO: 582470 - RNA, 15 nt, Homo sapiens
cuauaacuuuggcca

SEQ ID NO: 582471 - RNA, 21 nt, Homo sapiens
cuauaacuuuugguaucuacu

SEQ ID NO: 582472 - RNA, 16 nt, Homo sapiens
cuauaagcccacuguu

SEQ ID NO: 582473 - RNA, 20 nt, Homo sapiens
cuauaaguuguaccaaaaca

SEQ ID NO: 582474 - RNA, 14 nt, Homo sapiens
cuauaaguuuuaga

SEQ ID NO: 582475 - RNA, 20 nt, Homo sapiens
cuauaauaaguuuugauaua

SEQ ID NO: 582476 - RNA, 21 nt, Homo sapiens
cuauaauuuugccuuuaacag

SEQ ID NO: 582477 - RNA, 13 nt, Homo sapiens
cuauacacacaca

SEQ ID NO: 582478 - RNA, 19 nt, Homo sapiens
cuauacacuuaaugauaca

SEQ ID NO: 582479 - RNA, 14 nt, Homo sapiens
cuauacagccauaa

SEQ ID NO: 582480 - RNA, 18 nt, Homo sapiens
cuauacagccauaaaaag

SEQ ID NO: 582481 - RNA, 18 nt, Homo sapiens
cuauacguuucuguggag

SEQ ID NO: 582482 - RNA, 16 nt, Homo sapiens
cacagcccuaccccgc

SEQ ID NO: 582483 - RNA, 22 nt, Homo sapiens
cacagcccugagagucagggug

SEQ ID NO: 582484 - RNA, 16 nt, Homo sapiens
cacagccucagaauaa

SEQ ID NO: 582485 - RNA, 15 nt, Homo sapiens
cacagccuggccccu

SEQ ID NO: 582486 - RNA, 19 nt, Homo sapiens
cacagcguccuguccacac

SEQ ID NO: 582487 - RNA, 23 nt, Homo sapiens
cacagcugagagacuuuuaauca

SEQ ID NO: 582488 - RNA, 19 nt, Homo sapiens
cacagcugcagcugaucca

SEQ ID NO: 582489 - RNA, 22 nt, Homo sapiens
cacagcuguaaucccagcacuu

SEQ ID NO: 582490 - RNA, 11 nt, Homo sapiens
cacagcugucu

SEQ ID NO: 582491 - RNA, 17 nt, Homo sapiens
cacagcuucuccaagca

SEQ ID NO: 582492 - RNA, 19 nt, Homo sapiens
cacagcuucucuacagacu

SEQ ID NO: 582493 - RNA, 18 nt, Homo sapiens
cacagcuuuaugauauca

SEQ ID NO: 582494 - RNA, 20 nt, Homo sapiens
cacaggaacaacagcaucuu

SEQ ID NO: 582495 - RNA, 19 nt, Homo sapiens
cacaggaagccugcagucc

SEQ ID NO: 582496 - RNA, 18 nt, Homo sapiens
cacaggacaacuuuacaa

SEQ ID NO: 582497 - RNA, 14 nt, Homo sapiens
cacaggagacauua

SEQ ID NO: 582498 - RNA, 20 nt, Homo sapiens
cacaggagacauuacuauag

SEQ ID NO: 582499 - RNA, 14 nt, Homo sapiens
cacaggaguguccu

SEQ ID NO: 582500 - RNA, 16 nt, Homo sapiens
cacaggcacugcagga

SEQ ID NO: 582501 - RNA, 15 nt, Homo sapiens
cacaggcagcuucca

SEQ ID NO: 582502 - RNA, 17 nt, Homo sapiens
cacaggcaggggugaga

SEQ ID NO: 582503 - RNA, 15 nt, Homo sapiens
caucuuuaacacagc

SEQ ID NO: 582504 - RNA, 22 nt, Homo sapiens
caucuuuacaaaacuacaugag

SEQ ID NO: 582505 - RNA, 13 nt, Homo sapiens
caucuuugccaua

SEQ ID NO: 582506 - RNA, 13 nt, Homo sapiens
caucuuuucaagg

SEQ ID NO: 582507 - RNA, 19 nt, Homo sapiens
caucuuuuccucauuuuca

SEQ ID NO: 582508 - RNA, 18 nt, Homo sapiens
caucuuuucuagagacac

SEQ ID NO: 582509 - RNA, 17 nt, Homo sapiens
caucuuuugaagcuuuc

SEQ ID NO: 582510 - RNA, 18 nt, Homo sapiens
caucuuuugaagcuuucu

SEQ ID NO: 582511 - RNA, 17 nt, Homo sapiens
caucuuuuuaugcaaaa

SEQ ID NO: 582512 - RNA, 21 nt, Homo sapiens
caugaaaaaauacaggugucu

SEQ ID NO: 582513 - RNA, 18 nt, Homo sapiens
caugaaaaacaggugaca

SEQ ID NO: 582514 - RNA, 15 nt, Homo sapiens
caugaaacacuucuc

SEQ ID NO: 582515 - RNA, 13 nt, Homo sapiens
caugaaacagagu

SEQ ID NO: 582516 - RNA, 18 nt, Homo sapiens
caugaaacauguucucaa

SEQ ID NO: 582517 - RNA, 23 nt, Homo sapiens
caugaaagaacccaagacaucau

SEQ ID NO: 582518 - RNA, 14 nt, Homo sapiens
caugaaauaaaaua

SEQ ID NO: 582519 - RNA, 15 nt, Homo sapiens
caugaaaugcuucca

SEQ ID NO: 582520 - RNA, 14 nt, Homo sapiens
caugaaauuguuca

SEQ ID NO: 582521 - RNA, 15 nt, Homo sapiens
caugaacacacugug

SEQ ID NO: 582522 - RNA, 17 nt, Homo sapiens
caugaacagcucugaga

SEQ ID NO: 582523 - RNA, 19 nt, Homo sapiens
caugaacaucauggacuga

SEQ ID NO: 582524 - RNA, 15 nt, Homo sapiens
caugaacccaaaaag

SEQ ID NO: 582525 - RNA, 18 nt, Homo sapiens
caugaacccucuugccau

SEQ ID NO: 582526 - RNA, 24 nt, Homo sapiens
caugaacguuauuauauugucgaa

SEQ ID NO: 582527 - RNA, 13 nt, Homo sapiens
caugaagaccaca

SEQ ID NO: 582528 - RNA, 16 nt, Homo sapiens
caugaagagcuugugu

SEQ ID NO: 582529 - RNA, 15 nt, Homo sapiens
caugaagcacugagc

SEQ ID NO: 582530 - RNA, 18 nt, Homo sapiens
caugaagcccaagugaaa

SEQ ID NO: 582531 - RNA, 18 nt, Homo sapiens
caugaagccuugcugaac

SEQ ID NO: 582532 - RNA, 15 nt, Homo sapiens
cuugcuuuccccggg

SEQ ID NO: 582533 - RNA, 17 nt, Homo sapiens
cuugcuuucuucuuucc

SEQ ID NO: 582534 - RNA, 23 nt, Homo sapiens
cuuggaaagcaucaccucaggcc

SEQ ID NO: 582535 - RNA, 21 nt, Homo sapiens
cuuggaaauagaaagaagcca

SEQ ID NO: 582536 - RNA, 14 nt, Homo sapiens
cuuggaaaugacca

SEQ ID NO: 582537 - RNA, 21 nt, Homo sapiens
cuuggaaauuggaagagcaca

SEQ ID NO: 582538 - RNA, 17 nt, Homo sapiens
cuuggaacacauaagaa

SEQ ID NO: 582539 - RNA, 22 nt, Homo sapiens
cuuggaacauacuguucacuca

SEQ ID NO: 582540 - RNA, 14 nt, Homo sapiens
cuuggaacugcauu

SEQ ID NO: 582541 - RNA, 12 nt, Homo sapiens
cuuggaccucag

SEQ ID NO: 582542 - RNA, 19 nt, Homo sapiens
cuuggaccucagugacuca

SEQ ID NO: 582543 - RNA, 13 nt, Homo sapiens
cuuggacuccucc

SEQ ID NO: 582544 - RNA, 22 nt, Homo sapiens
cuuggagaaaauggguuuauuc

SEQ ID NO: 582545 - RNA, 14 nt, Homo sapiens
cuuggagacuccug

SEQ ID NO: 582546 - RNA, 18 nt, Homo sapiens
cuuggaguaaaacuguau

SEQ ID NO: 582547 - RNA, 19 nt, Homo sapiens
cuuggaucccaggggcuua

SEQ ID NO: 582548 - RNA, 16 nt, Homo sapiens
cuuggauucucuaacc

SEQ ID NO: 582549 - RNA, 23 nt, Homo sapiens
cuuggauuucauuuguaacuuua

SEQ ID NO: 582550 - RNA, 23 nt, Homo sapiens
cuuggauuuggacugauucucca

SEQ ID NO: 582551 - RNA, 19 nt, Homo sapiens
cuuggcaaauuccuaguca

SEQ ID NO: 582552 - RNA, 13 nt, Homo sapiens
cuuggcacacucu

SEQ ID NO: 582553 - RNA, 12 nt, Homo sapiens
cuuggccagaag

SEQ ID NO: 582554 - RNA, 21 nt, Homo sapiens
cuuggccagaagggggccaug

SEQ ID NO: 582555 - RNA, 15 nt, Homo sapiens
cuuggcccacacuga

SEQ ID NO: 582556 - RNA, 17 nt, Homo sapiens
cuuggcccaggagcucu

SEQ ID NO: 582557 - RNA, 19 nt, Homo sapiens
cuuggccccagaggaccga

SEQ ID NO: 582558 - RNA, 21 nt, Homo sapiens
cuuggccccucccucccggcu

SEQ ID NO: 582559 - RNA, 13 nt, Homo sapiens
cuuggccucccaa

SEQ ID NO: 582560 - RNA, 16 nt, Homo sapiens
cuuggcugauguugca

SEQ ID NO: 582561 - RNA, 22 nt, Homo sapiens
cuuggcugcagccaucccgcuu

SEQ ID NO: 582562 - RNA, 18 nt, Homo sapiens
cuuggcuggggaggacca

SEQ ID NO: 582563 - RNA, 22 nt, Homo sapiens
cuuggcuucugugaugagcuga

SEQ ID NO: 582564 - RNA, 14 nt, Homo sapiens
cuugggaccguguu

SEQ ID NO: 582565 - RNA, 18 nt, Homo sapiens
cuugggagaccuguaauc

SEQ ID NO: 582566 - RNA, 17 nt, Homo sapiens
cuugggcacaucugcug

SEQ ID NO: 582567 - RNA, 18 nt, Homo sapiens
cuugggccagagcucaac

SEQ ID NO: 582568 - RNA, 20 nt, Homo sapiens
cuugggcgucucccccagag

SEQ ID NO: 582569 - RNA, 17 nt, Homo sapiens
cuugggcugacugccug

SEQ ID NO: 582570 - RNA, 22 nt, Homo sapiens
cuuggggaaaauggccaugcag

SEQ ID NO: 582571 - RNA, 17 nt, Homo sapiens
cuuggggaacccaugag

SEQ ID NO: 582572 - RNA, 20 nt, Homo sapiens
cuugggggaacgaugugucu

SEQ ID NO: 582573 - RNA, 12 nt, Homo sapiens
cuuggggggcca

SEQ ID NO: 582574 - RNA, 16 nt, Homo sapiens
cuugggggucaggggg

SEQ ID NO: 582575 - RNA, 15 nt, Homo sapiens
cuuggggucacuccu

SEQ ID NO: 582576 - RNA, 13 nt, Homo sapiens
cuuggguggggga

SEQ ID NO: 582577 - RNA, 18 nt, Homo sapiens
cuugggugguuccuaagg

SEQ ID NO: 582578 - RNA, 17 nt, Homo sapiens
cuuggguucaagugauu

SEQ ID NO: 582579 - RNA, 20 nt, Homo sapiens
cuugguaagaugacucugag

SEQ ID NO: 582580 - RNA, 18 nt, Homo sapiens
cuugguacugaaaaugag

SEQ ID NO: 582581 - RNA, 16 nt, Homo sapiens
cuugguaugugccagg

SEQ ID NO: 582582 - RNA, 20 nt, Homo sapiens
cuuggucuaugugcucugua

SEQ ID NO: 582583 - RNA, 14 nt, Homo sapiens
cuuggugggagaaa

SEQ ID NO: 582584 - RNA, 15 nt, Homo sapiens
cuugguguaauuuga

SEQ ID NO: 582585 - RNA, 14 nt, Homo sapiens
cuugguguuuguga

SEQ ID NO: 582586 - RNA, 17 nt, Homo sapiens
cuugguuaaaauggcua

SEQ ID NO: 582587 - RNA, 21 nt, Homo sapiens
cuugguucaucaguguuaaaa

SEQ ID NO: 582588 - RNA, 14 nt, Homo sapiens
cuugguuguauaaa

SEQ ID NO: 582589 - RNA, 20 nt, Homo sapiens
cuugguuguauaaagcaaaa

SEQ ID NO: 582590 - RNA, 16 nt, Homo sapiens
cuugguuucagccaag

SEQ ID NO: 582591 - RNA, 18 nt, Homo sapiens
cuugguuuccaaaggcau

SEQ ID NO: 582592 - RNA, 21 nt, Homo sapiens
cuugguuuuuauaccauucag

SEQ ID NO: 582593 - RNA, 16 nt, Homo sapiens
cuuguaaagacugguu

SEQ ID NO: 582594 - RNA, 23 nt, Homo sapiens
cuuguaacuaaaauaauuuugua

SEQ ID NO: 582595 - RNA, 17 nt, Homo sapiens
cuuguaaucaagccuuu

SEQ ID NO: 582596 - RNA, 15 nt, Homo sapiens
cuuguaccauauaga

SEQ ID NO: 582597 - RNA, 17 nt, Homo sapiens
cuuguagaguggugcug

SEQ ID NO: 582598 - RNA, 20 nt, Homo sapiens
cuuguagcuagaacuucucu

SEQ ID NO: 582599 - RNA, 19 nt, Homo sapiens
cuuguagcuguuacugcaa

SEQ ID NO: 582600 - RNA, 23 nt, Homo sapiens
cuuguauagcaugaaauaaaaua

SEQ ID NO: 582601 - RNA, 16 nt, Homo sapiens
cuuguauaguguaaaa

SEQ ID NO: 582602 - RNA, 10 nt, Homo sapiens
cuuguauuca

SEQ ID NO: 582603 - RNA, 17 nt, Homo sapiens
cuugucaaagaaggugc

SEQ ID NO: 582604 - RNA, 20 nt, Homo sapiens
cuugucauggaaaauguccu

SEQ ID NO: 582605 - RNA, 15 nt, Homo sapiens
cuugucauuccagag

SEQ ID NO: 582606 - RNA, 20 nt, Homo sapiens
cuugucccuuucccuaccuu

SEQ ID NO: 582607 - RNA, 13 nt, Homo sapiens
cuuguccuaauaa

SEQ ID NO: 582608 - RNA, 21 nt, Homo sapiens
cuuguccugggucugugucag

SEQ ID NO: 582609 - RNA, 14 nt, Homo sapiens
cuuguccugugcuu

SEQ ID NO: 582610 - RNA, 19 nt, Homo sapiens
cuuguccuugagugcucuu

SEQ ID NO: 582611 - RNA, 19 nt, Homo sapiens
cuugucucucacugcauuu

SEQ ID NO: 582612 - RNA, 16 nt, Homo sapiens
cuugucugucuaguua

SEQ ID NO: 582613 - RNA, 22 nt, Homo sapiens
cuugugaaaacgcaaacaugaa

SEQ ID NO: 582614 - RNA, 22 nt, Homo sapiens
cuugugauuuuuauaauacaaa

SEQ ID NO: 582615 - RNA, 23 nt, Homo sapiens
cuugugccaaaccuacuaggcca

SEQ ID NO: 582616 - RNA, 15 nt, Homo sapiens
cuugugccaggucaa

SEQ ID NO: 582617 - RNA, 21 nt, Homo sapiens
cuugugcuccucucgcacaau

SEQ ID NO: 582618 - RNA, 16 nt, Homo sapiens
cuuguggauaagggag

SEQ ID NO: 582619 - RNA, 21 nt, Homo sapiens
cuugugucucauauacccuau

SEQ ID NO: 582620 - RNA, 18 nt, Homo sapiens
cuugugugugggcuguga

SEQ ID NO: 582621 - RNA, 21 nt, Homo sapiens
cuugugugugggcugugagug

SEQ ID NO: 582622 - RNA, 17 nt, Homo sapiens
cuuguguugcacugaac

SEQ ID NO: 582623 - RNA, 17 nt, Homo sapiens
cuuguguugugugaucu

SEQ ID NO: 582624 - RNA, 18 nt, Homo sapiens
cuuguuaauugauuuggg

SEQ ID NO: 582625 - RNA, 18 nt, Homo sapiens
cauuaauagcagccuuuc

SEQ ID NO: 582626 - RNA, 19 nt, Homo sapiens
cauuaauauugcagucaau

SEQ ID NO: 582627 - RNA, 14 nt, Homo sapiens
cauuaaugcacauc

SEQ ID NO: 582628 - RNA, 15 nt, Homo sapiens
cauuaauguuaauuc

SEQ ID NO: 582629 - RNA, 13 nt, Homo sapiens
cauuaauguuucu

SEQ ID NO: 582630 - RNA, 20 nt, Homo sapiens
cauuaauuaguuccaguuuc

SEQ ID NO: 582631 - RNA, 23 nt, Homo sapiens
cauuacaauccugcauuguuuca

SEQ ID NO: 582632 - RNA, 13 nt, Homo sapiens
cauuacaguucuu

SEQ ID NO: 582633 - RNA, 13 nt, Homo sapiens
cauuaccccauac

SEQ ID NO: 582634 - RNA, 20 nt, Homo sapiens
cauuaccuguucuugccuaa

SEQ ID NO: 582635 - RNA, 23 nt, Homo sapiens
cauuaccuguucuugccuaauaa

SEQ ID NO: 582636 - RNA, 13 nt, Homo sapiens
cauuacuacugua

SEQ ID NO: 582637 - RNA, 14 nt, Homo sapiens
cauuacuacuguac

SEQ ID NO: 582638 - RNA, 14 nt, Homo sapiens
cauuacuauucacu

SEQ ID NO: 582639 - RNA, 20 nt, Homo sapiens
cauuacugaggggauucucu

SEQ ID NO: 582640 - RNA, 17 nt, Homo sapiens
cauuacuuuuucauaua

SEQ ID NO: 582641 - RNA, 19 nt, Homo sapiens
cauuagaacacugcauuag

SEQ ID NO: 582642 - RNA, 16 nt, Homo sapiens
cauuagaauagucaua

SEQ ID NO: 582643 - RNA, 18 nt, Homo sapiens
cauuagagaaaugaauua

SEQ ID NO: 582644 - RNA, 18 nt, Homo sapiens
cauuagcaguugcucaca

SEQ ID NO: 582645 - RNA, 20 nt, Homo sapiens
cauuagcauucugguuuuga

SEQ ID NO: 582646 - RNA, 21 nt, Homo sapiens
cauuaggaagaaaggagcucc

SEQ ID NO: 582647 - RNA, 19 nt, Homo sapiens
cauuaggaguaacuuucaa

SEQ ID NO: 582648 - RNA, 22 nt, Homo sapiens
cauuagggaaaugcaagucaaa

SEQ ID NO: 582649 - RNA, 18 nt, Homo sapiens
cauuaguauuucacaaga

SEQ ID NO: 582650 - RNA, 19 nt, Homo sapiens
cauuagucaauaacuaaac

SEQ ID NO: 582651 - RNA, 15 nt, Homo sapiens
cauuagucacuuuga

SEQ ID NO: 582652 - RNA, 14 nt, Homo sapiens
cauuauaacuguau

SEQ ID NO: 582653 - RNA, 15 nt, Homo sapiens
cauuauacauuugau

SEQ ID NO: 582654 - RNA, 17 nt, Homo sapiens
cauuaucacagugaaug

SEQ ID NO: 582655 - RNA, 21 nt, Homo sapiens
cauuaucuggaauauugugau

SEQ ID NO: 582656 - RNA, 15 nt, Homo sapiens
cauuauuacugguau

SEQ ID NO: 582657 - RNA, 17 nt, Homo sapiens
cauuauucaagaaugaa

SEQ ID NO: 582658 - RNA, 15 nt, Homo sapiens
cuuucugggccaagu

SEQ ID NO: 582659 - RNA, 16 nt, Homo sapiens
cuuucuguaaccaaaa

SEQ ID NO: 582660 - RNA, 11 nt, Homo sapiens
cuuucugugac

SEQ ID NO: 582661 - RNA, 14 nt, Homo sapiens
cuuucugugcccua

SEQ ID NO: 582662 - RNA, 21 nt, Homo sapiens
cuuucuguugaaaagcacaca

SEQ ID NO: 582663 - RNA, 16 nt, Homo sapiens
cuuucuguugccaugg

SEQ ID NO: 582664 - RNA, 22 nt, Homo sapiens
cuuucuuacauuagcaguuugc

SEQ ID NO: 582665 - RNA, 14 nt, Homo sapiens
cuuucuucagcucu

SEQ ID NO: 582666 - RNA, 11 nt, Homo sapiens
cuuucuucccu

SEQ ID NO: 582667 - RNA, 15 nt, Homo sapiens
cuuucuuccuuucua

SEQ ID NO: 582668 - RNA, 16 nt, Homo sapiens
cuuucuucuagugcuu

SEQ ID NO: 582669 - RNA, 14 nt, Homo sapiens
cuuucuucugaaua

SEQ ID NO: 582670 - RNA, 20 nt, Homo sapiens
cuuucuugaauuagcauuuu

SEQ ID NO: 582671 - RNA, 11 nt, Homo sapiens
cuuucuugcag

SEQ ID NO: 582672 - RNA, 14 nt, Homo sapiens
cuuucuuguugcug

SEQ ID NO: 582673 - RNA, 22 nt, Homo sapiens
cuuucuuuagaauuuuuaccca

SEQ ID NO: 582674 - RNA, 21 nt, Homo sapiens
cuuugaaaauauuucuaugua

SEQ ID NO: 582675 - RNA, 23 nt, Homo sapiens
cuuugaaacuccaugcaaaccau

SEQ ID NO: 582676 - RNA, 14 nt, Homo sapiens
cuuugaagccucag

SEQ ID NO: 582677 - RNA, 13 nt, Homo sapiens
cuuugaauguggc

SEQ ID NO: 582678 - RNA, 23 nt, Homo sapiens
cuuugaauuaaaauaaaacacau

SEQ ID NO: 582679 - RNA, 15 nt, Homo sapiens
cuuugacacuuuuca

SEQ ID NO: 582680 - RNA, 17 nt, Homo sapiens
cuuugacucaccuguua

SEQ ID NO: 582681 - RNA, 21 nt, Homo sapiens
cuuugagaagccuucagcucc

SEQ ID NO: 582682 - RNA, 15 nt, Homo sapiens
cuuugagauuauucu

SEQ ID NO: 582683 - RNA, 22 nt, Homo sapiens
cuuugagcccauucuucugggu

SEQ ID NO: 582684 - RNA, 20 nt, Homo sapiens
cuuugagcugagugcugaaa

SEQ ID NO: 582685 - RNA, 22 nt, Homo sapiens
cuuugagcugagugcugaaaua

SEQ ID NO: 582686 - RNA, 16 nt, Homo sapiens
cuuugaggaacauuca

SEQ ID NO: 582687 - RNA, 21 nt, Homo sapiens
cuuugaggcucugucacugag

SEQ ID NO: 582688 - RNA, 17 nt, Homo sapiens
cuuugaguuuuguauuc

SEQ ID NO: 582689 - RNA, 18 nt, Homo sapiens
cuuugaguuuuguauuca

SEQ ID NO: 582690 - RNA, 14 nt, Homo sapiens
cuuugaucaguaua

SEQ ID NO: 582691 - RNA, 22 nt, Homo sapiens
cuuugaucccugacaucuggaa

SEQ ID NO: 582692 - RNA, 18 nt, Homo sapiens
cuuugauuauuugcaugu

SEQ ID NO: 582693 - RNA, 11 nt, Homo sapiens
cuuugcaaaau

SEQ ID NO: 582694 - RNA, 12 nt, Homo sapiens
cuuugcaaagac

SEQ ID NO: 582695 - RNA, 21 nt, Homo sapiens
cuuugccacaagaccuagccu

SEQ ID NO: 582696 - RNA, 14 nt, Homo sapiens
cuuugccacacaca

SEQ ID NO: 582697 - RNA, 16 nt, Homo sapiens
cuuugccaucggaacu

SEQ ID NO: 582698 - RNA, 18 nt, Homo sapiens
cuuugcccccuugcccau

SEQ ID NO: 582699 - RNA, 22 nt, Homo sapiens
cuuugccucucaauugucauug

SEQ ID NO: 582700 - RNA, 15 nt, Homo sapiens
cuuugcucccugcaa

SEQ ID NO: 582701 - RNA, 20 nt, Homo sapiens
cuuugcucccuguugcugaa

SEQ ID NO: 582702 - RNA, 21 nt, Homo sapiens
cuuugcucccuguugcugaaa

SEQ ID NO: 582703 - RNA, 23 nt, Homo sapiens
cuuugcucuuacuacacugagga

SEQ ID NO: 582704 - RNA, 20 nt, Homo sapiens
cuuugcugcauuuuacacau

SEQ ID NO: 582705 - RNA, 14 nt, Homo sapiens
cuuugcugccugag

SEQ ID NO: 582706 - RNA, 11 nt, Homo sapiens
cuuugcugcua

SEQ ID NO: 582707 - RNA, 16 nt, Homo sapiens
cuuugcugcuaugaaa

SEQ ID NO: 582708 - RNA, 21 nt, Homo sapiens
cuuugcugucaaaacuacuga

SEQ ID NO: 582709 - RNA, 16 nt, Homo sapiens
cuuuggaaauacacag

SEQ ID NO: 582710 - RNA, 14 nt, Homo sapiens
cuuuggaaguccag

SEQ ID NO: 582711 - RNA, 15 nt, Homo sapiens
cuuuggagcaaagaa

SEQ ID NO: 582712 - RNA, 16 nt, Homo sapiens
cuuuggaggauuucac

SEQ ID NO: 582713 - RNA, 15 nt, Homo sapiens
cuuuggcgaccuccu

SEQ ID NO: 582714 - RNA, 15 nt, Homo sapiens
cuuugggaucagccu

SEQ ID NO: 582715 - RNA, 23 nt, Homo sapiens
cuuuggggcauagaucagaagac

SEQ ID NO: 582716 - RNA, 21 nt, Homo sapiens
cuuugguaaucucugugaaau

SEQ ID NO: 582717 - RNA, 15 nt, Homo sapiens
cuuugguaaucuuca

SEQ ID NO: 582718 - RNA, 12 nt, Homo sapiens
cuuugguuaaua

SEQ ID NO: 582719 - RNA, 21 nt, Homo sapiens
cuuugguuauuggaaggcaag

SEQ ID NO: 582720 - RNA, 15 nt, Homo sapiens
cuuuguauaugcauu

SEQ ID NO: 582721 - RNA, 16 nt, Homo sapiens
cuuuguauaugcauuc

SEQ ID NO: 582722 - RNA, 19 nt, Homo sapiens
cuuuguauauuacauacau

SEQ ID NO: 582723 - RNA, 14 nt, Homo sapiens
cuuuguaugacagu

SEQ ID NO: 582724 - RNA, 22 nt, Homo sapiens
cuuugucaccacguggggcuca

SEQ ID NO: 582725 - RNA, 15 nt, Homo sapiens
cuuugucagcaauac

SEQ ID NO: 582726 - RNA, 21 nt, Homo sapiens
cuuuguccacugucaggguug

SEQ ID NO: 582727 - RNA, 23 nt, Homo sapiens
cuuugucccggggcuccacugaa

SEQ ID NO: 582728 - RNA, 17 nt, Homo sapiens
cuuugucccguggcauu

SEQ ID NO: 582729 - RNA, 15 nt, Homo sapiens
cuuugucucaccuca

SEQ ID NO: 582730 - RNA, 12 nt, Homo sapiens
cuuugucugugg

SEQ ID NO: 582731 - RNA, 20 nt, Homo sapiens
cuuugugaacaagucccugu

SEQ ID NO: 582732 - RNA, 13 nt, Homo sapiens
cuuugugcugcgc

SEQ ID NO: 582733 - RNA, 20 nt, Homo sapiens
cuuugugcuugucauuccag

SEQ ID NO: 582734 - RNA, 13 nt, Homo sapiens
cuuuguguagaaa

SEQ ID NO: 582735 - RNA, 18 nt, Homo sapiens
cuuuguguagaaagccaa

SEQ ID NO: 582736 - RNA, 20 nt, Homo sapiens
cuuuguguagaaagccaaau

SEQ ID NO: 582737 - RNA, 21 nt, Homo sapiens
cuuuguguagaaagccaaaua

SEQ ID NO: 582738 - RNA, 14 nt, Homo sapiens
cuuuguguggcucc

SEQ ID NO: 582739 - RNA, 16 nt, Homo sapiens
cuuuguuaucuuccac

SEQ ID NO: 582740 - RNA, 17 nt, Homo sapiens
cuuuguuaugacaguga

SEQ ID NO: 582741 - RNA, 16 nt, Homo sapiens
cuuuguugaguauuau

SEQ ID NO: 582742 - RNA, 17 nt, Homo sapiens
cuuuguuuaaaugccaa

SEQ ID NO: 582743 - RNA, 15 nt, Homo sapiens
cuuuguuuaugcaua

SEQ ID NO: 582744 - RNA, 17 nt, Homo sapiens
cuuuguuuuggggguca

SEQ ID NO: 582745 - RNA, 18 nt, Homo sapiens
cuuuuaaaaaauucuugu

SEQ ID NO: 582746 - RNA, 17 nt, Homo sapiens
cuuuuaaaagcacguau

SEQ ID NO: 582747 - RNA, 17 nt, Homo sapiens
gaauaaaaguuccucuc

SEQ ID NO: 582748 - RNA, 14 nt, Homo sapiens
gaauaaaauugcac

SEQ ID NO: 582749 - RNA, 15 nt, Homo sapiens
gaauaaaauugcacu

SEQ ID NO: 582750 - RNA, 17 nt, Homo sapiens
gaauaaaauugcacuuu

SEQ ID NO: 582751 - RNA, 21 nt, Homo sapiens
gaauaaaccaucaucuugcca

SEQ ID NO: 582752 - RNA, 12 nt, Homo sapiens
gaauaaagucaa

SEQ ID NO: 582753 - RNA, 16 nt, Homo sapiens
gaauaaaguccaaagu

SEQ ID NO: 582754 - RNA, 18 nt, Homo sapiens
gaauaaaguuccugucau

SEQ ID NO: 582755 - RNA, 14 nt, Homo sapiens
gaauaaauaauucu

SEQ ID NO: 582756 - RNA, 13 nt, Homo sapiens
gaauaaauaccuc

SEQ ID NO: 582757 - RNA, 14 nt, Homo sapiens
gaauaaauucccaa

SEQ ID NO: 582758 - RNA, 15 nt, Homo sapiens
gaauaaauucccaac

SEQ ID NO: 582759 - RNA, 20 nt, Homo sapiens
gaauaacaacuuucaguggc

SEQ ID NO: 582760 - RNA, 14 nt, Homo sapiens
gaauaacauuuaaa

SEQ ID NO: 582761 - RNA, 12 nt, Homo sapiens
gaauaaccacuu

SEQ ID NO: 582762 - RNA, 22 nt, Homo sapiens
gaauaauccaguauugcugauu

SEQ ID NO: 582763 - RNA, 18 nt, Homo sapiens
gaauaaugcuguuuuaua

SEQ ID NO: 582764 - RNA, 22 nt, Homo sapiens
gaauacaguaagcugcucuauu

SEQ ID NO: 582765 - RNA, 23 nt, Homo sapiens
gaauacauuguauuaauaccaaa

SEQ ID NO: 582766 - RNA, 14 nt, Homo sapiens
gaauaccaccuaau

SEQ ID NO: 582767 - RNA, 16 nt, Homo sapiens
gaauaccacucuguaa

SEQ ID NO: 582768 - RNA, 18 nt, Homo sapiens
gaauacuauacagccaua

SEQ ID NO: 582769 - RNA, 18 nt, Homo sapiens
gaauacugcuacagcaau

SEQ ID NO: 582770 - RNA, 17 nt, Homo sapiens
gaauacuggccaugccu

SEQ ID NO: 582771 - RNA, 18 nt, Homo sapiens
gaauagaggggcauucac

SEQ ID NO: 582772 - RNA, 15 nt, Homo sapiens
gaauagaugcugacu

SEQ ID NO: 582773 - RNA, 22 nt, Homo sapiens
gaauagcaauuagugauauagu

SEQ ID NO: 582774 - RNA, 16 nt, Homo sapiens
gaauagcauuugccac

SEQ ID NO: 582775 - RNA, 13 nt, Homo sapiens
gaauaggcauuug

SEQ ID NO: 582776 - RNA, 13 nt, Homo sapiens
gaauagucucauc

SEQ ID NO: 582777 - RNA, 23 nt, Homo sapiens
gaauaguguuggaaaaugugcaa

SEQ ID NO: 582778 - RNA, 18 nt, Homo sapiens
gaauauaaaacagucaug

SEQ ID NO: 582779 - RNA, 19 nt, Homo sapiens
gaauauaaaugggaaauca

SEQ ID NO: 582780 - RNA, 17 nt, Homo sapiens
gaauauaagaaaucuuu

SEQ ID NO: 582781 - RNA, 16 nt, Homo sapiens
gaauauaauacuguau

SEQ ID NO: 582782 - RNA, 13 nt, Homo sapiens
gaauauaauuuca

SEQ ID NO: 582783 - RNA, 14 nt, Homo sapiens
gaauauaggucucu

SEQ ID NO: 582784 - RNA, 18 nt, Homo sapiens
gaauaucuaaacaucuuu

SEQ ID NO: 582785 - RNA, 20 nt, Homo sapiens
gaauaugaucccuaaugugu

SEQ ID NO: 582786 - RNA, 23 nt, Homo sapiens
gaauauggugggcacagaaguag

SEQ ID NO: 582787 - RNA, 12 nt, Homo sapiens
gaauauucccaa

SEQ ID NO: 582788 - RNA, 18 nt, Homo sapiens
gaauauucccaagcccau

SEQ ID NO: 582789 - RNA, 18 nt, Homo sapiens
gaauauugccaaugcuac

SEQ ID NO: 582790 - RNA, 18 nt, Homo sapiens
gaauauugucugccuuaa

SEQ ID NO: 582791 - RNA, 19 nt, Homo sapiens
ccaauaaaaaguucagagu

SEQ ID NO: 582792 - RNA, 17 nt, Homo sapiens
ccaauaaaaaugucuca

SEQ ID NO: 582793 - RNA, 18 nt, Homo sapiens
ccaauaaagaguuccuuc

SEQ ID NO: 582794 - RNA, 19 nt, Homo sapiens
ccaauaaaggcagcugccu

SEQ ID NO: 582795 - RNA, 19 nt, Homo sapiens
ccaauaaagugaucugugu

SEQ ID NO: 582796 - RNA, 15 nt, Homo sapiens
ccaauaacuuuucac

SEQ ID NO: 582797 - RNA, 22 nt, Homo sapiens
ccaauaauaaagacauuuccua

SEQ ID NO: 582798 - RNA, 12 nt, Homo sapiens
ccaauaccuccu

SEQ ID NO: 582799 - RNA, 21 nt, Homo sapiens
ccaauaccuccuccagaucag

SEQ ID NO: 582800 - RNA, 10 nt, Homo sapiens
ccaauacugc

SEQ ID NO: 582801 - RNA, 18 nt, Homo sapiens
ccaauagggcugagcucu

SEQ ID NO: 582802 - RNA, 15 nt, Homo sapiens
ccaauaucuugccag

SEQ ID NO: 582803 - RNA, 15 nt, Homo sapiens
ccaauaugacucaga

SEQ ID NO: 582804 - RNA, 14 nt, Homo sapiens
ccaauauuguaauc

SEQ ID NO: 582805 - RNA, 21 nt, Homo sapiens
ccaauauuuaccagaccacaa

SEQ ID NO: 582806 - RNA, 16 nt, Homo sapiens
ccaaucagagagccua

SEQ ID NO: 582807 - RNA, 19 nt, Homo sapiens
ccaaucagcuuuuguucua

SEQ ID NO: 582808 - RNA, 20 nt, Homo sapiens
ccaaucagcuuuuguucuag

SEQ ID NO: 582809 - RNA, 15 nt, Homo sapiens
ccaauccaacaucca

SEQ ID NO: 582810 - RNA, 23 nt, Homo sapiens
ccaaucccucuccacucuucucu

SEQ ID NO: 582811 - RNA, 23 nt, Homo sapiens
ccaaucucugccauaucagugaa

SEQ ID NO: 582812 - RNA, 17 nt, Homo sapiens
ccaaugaaauacugaga

SEQ ID NO: 582813 - RNA, 12 nt, Homo sapiens
ccaaugaccccc

SEQ ID NO: 582814 - RNA, 13 nt, Homo sapiens
ccaaugcaugcag

SEQ ID NO: 582815 - RNA, 20 nt, Homo sapiens
ccaaugcucuggagugugca

SEQ ID NO: 582816 - RNA, 14 nt, Homo sapiens
ccaaugggccucca

SEQ ID NO: 582817 - RNA, 19 nt, Homo sapiens
ccaauggugauccucuauu

SEQ ID NO: 582818 - RNA, 16 nt, Homo sapiens
ccaaugucucccacac

SEQ ID NO: 582819 - RNA, 23 nt, Homo sapiens
ccaauguucuauuaaucaccucu

SEQ ID NO: 582820 - RNA, 22 nt, Homo sapiens
ccaauguuugacaaaacacagc

SEQ ID NO: 582821 - RNA, 18 nt, Homo sapiens
ccaauuaaaaacaugaau

SEQ ID NO: 582822 - RNA, 22 nt, Homo sapiens
ccaauuaaguccuacuuuacau

SEQ ID NO: 582823 - RNA, 24 nt, Homo sapiens
ccaauuaauuccuguuugucuaca

SEQ ID NO: 582824 - RNA, 19 nt, Homo sapiens
ccaauuacagggugacuca

SEQ ID NO: 582825 - RNA, 15 nt, Homo sapiens
ccaauuagcucuaua

SEQ ID NO: 582826 - RNA, 17 nt, Homo sapiens
ccaauuagucacugcug

SEQ ID NO: 582827 - RNA, 16 nt, Homo sapiens
ccaauuccaaguuuua

SEQ ID NO: 582828 - RNA, 22 nt, Homo sapiens
ccaauucuaacagcaaauaaca

SEQ ID NO: 582829 - RNA, 21 nt, Homo sapiens
ccaauugacucucacacugaa

SEQ ID NO: 582830 - RNA, 17 nt, Homo sapiens
ccaauuggcucuaguca

SEQ ID NO: 582831 - RNA, 19 nt, Homo sapiens
ccaauuggcucuagucacu

SEQ ID NO: 582832 - RNA, 15 nt, Homo sapiens
ccaauugugcugcca

SEQ ID NO: 582833 - RNA, 16 nt, Homo sapiens
ccaauuugacaaaacc

SEQ ID NO: 582834 - RNA, 20 nt, Homo sapiens
ccaauuuucuucaucuuugc

SEQ ID NO: 582835 - RNA, 23 nt, Homo sapiens
ccacaaagcacaguuugaacaaa

SEQ ID NO: 582836 - RNA, 21 nt, Homo sapiens
ccacaaaggcauaaacuugaa

SEQ ID NO: 582837 - RNA, 16 nt, Homo sapiens
ccacaaccgaccagau

SEQ ID NO: 582838 - RNA, 16 nt, Homo sapiens
ccacaaccucuugggc

SEQ ID NO: 582839 - RNA, 20 nt, Homo sapiens
ccacaagcugcacugugaac

SEQ ID NO: 582840 - RNA, 18 nt, Homo sapiens
ccacaaguccuuguucca

SEQ ID NO: 582841 - RNA, 14 nt, Homo sapiens
ccacaagucuucca

SEQ ID NO: 582842 - RNA, 12 nt, Homo sapiens
ccacaccacagg

SEQ ID NO: 582843 - RNA, 22 nt, Homo sapiens
ccacaccagccucccaaaauac

SEQ ID NO: 582844 - RNA, 13 nt, Homo sapiens
ccacacccaggaa

SEQ ID NO: 582845 - RNA, 20 nt, Homo sapiens
ccacacccgugugguaccuu

SEQ ID NO: 582846 - RNA, 22 nt, Homo sapiens
ccacacccuggaggauuucauc

SEQ ID NO: 582847 - RNA, 19 nt, Homo sapiens
ccacaccgagacaccaccu

SEQ ID NO: 582848 - RNA, 19 nt, Homo sapiens
ccacaccgucuuccuucag

SEQ ID NO: 582849 - RNA, 22 nt, Homo sapiens
ccacaccgucuuccuucaggga

SEQ ID NO: 582850 - RNA, 21 nt, Homo sapiens
ccacaccuggaaacagaccaa

SEQ ID NO: 582851 - RNA, 23 nt, Homo sapiens
ccacaccuggcauggugcaggga

SEQ ID NO: 582852 - RNA, 22 nt, Homo sapiens
ccacaccuggcccuugcaaucu

SEQ ID NO: 582853 - RNA, 16 nt, Homo sapiens
ccacaccugggcauuu

SEQ ID NO: 582854 - RNA, 23 nt, Homo sapiens
ccacacgcugcaccuaaagccua

SEQ ID NO: 582855 - RNA, 16 nt, Homo sapiens
ccacacggaggcaucu

SEQ ID NO: 582856 - RNA, 11 nt, Homo sapiens
ccacacuauuc

SEQ ID NO: 582857 - RNA, 14 nt, Homo sapiens
ccacacucagcaca

SEQ ID NO: 582858 - RNA, 14 nt, Homo sapiens
ccacacucuccauc

SEQ ID NO: 582859 - RNA, 16 nt, Homo sapiens
ccacacugaaaccaaa

SEQ ID NO: 582860 - RNA, 17 nt, Homo sapiens
ccacacugaaaccaaaa

SEQ ID NO: 582861 - RNA, 21 nt, Homo sapiens
ccacacuguggccaggccuua

SEQ ID NO: 582862 - RNA, 14 nt, Homo sapiens
ccacacuuccauga

SEQ ID NO: 582863 - RNA, 21 nt, Homo sapiens
ccacacuuccuguccagagag

SEQ ID NO: 582864 - RNA, 14 nt, Homo sapiens
ccacacuucuugaa

SEQ ID NO: 582865 - RNA, 15 nt, Homo sapiens
ccacagaaauacaug

SEQ ID NO: 582866 - RNA, 23 nt, Homo sapiens
ccacagaacacagcaauuccuca

SEQ ID NO: 582867 - RNA, 17 nt, Homo sapiens
ccacagacgggcacaca

SEQ ID NO: 582868 - RNA, 18 nt, Homo sapiens
gaaugguguuguaugccu

SEQ ID NO: 582869 - RNA, 14 nt, Homo sapiens
gaauguacucuguu

SEQ ID NO: 582870 - RNA, 16 nt, Homo sapiens
gaauguagcagauccc

SEQ ID NO: 582871 - RNA, 16 nt, Homo sapiens
gaauguaguauucaau

SEQ ID NO: 582872 - RNA, 16 nt, Homo sapiens
gaaugugcaacauucu

SEQ ID NO: 582873 - RNA, 13 nt, Homo sapiens
gaaugugcacucu

SEQ ID NO: 582874 - RNA, 21 nt, Homo sapiens
gaaugugcacucucugcuuag

SEQ ID NO: 582875 - RNA, 16 nt, Homo sapiens
gaauguggucucagga

SEQ ID NO: 582876 - RNA, 11 nt, Homo sapiens
gaauguguucu

SEQ ID NO: 582877 - RNA, 22 nt, Homo sapiens
gaauguuaauuuuuugguacaa

SEQ ID NO: 582878 - RNA, 14 nt, Homo sapiens
gaauguucaucucu

SEQ ID NO: 582879 - RNA, 16 nt, Homo sapiens
gaauguugcaauguga

SEQ ID NO: 582880 - RNA, 17 nt, Homo sapiens
gaauguuuacacucuuu

SEQ ID NO: 582881 - RNA, 19 nt, Homo sapiens
gaauguuugucucauccca

SEQ ID NO: 582882 - RNA, 17 nt, Homo sapiens
gaauguuuuacugugaa

SEQ ID NO: 582883 - RNA, 15 nt, Homo sapiens
gaauuaaaguacuuu

SEQ ID NO: 582884 - RNA, 14 nt, Homo sapiens
gaauuaaccuggug

SEQ ID NO: 582885 - RNA, 13 nt, Homo sapiens
gaauuaacugcau

SEQ ID NO: 582886 - RNA, 18 nt, Homo sapiens
gaauuaagaaauacucau

SEQ ID NO: 582887 - RNA, 20 nt, Homo sapiens
gaauuaagcguuguaguaaa

SEQ ID NO: 582888 - RNA, 18 nt, Homo sapiens
gaauuacaaccacagaaa

SEQ ID NO: 582889 - RNA, 14 nt, Homo sapiens
gaauuacacugugc

SEQ ID NO: 582890 - RNA, 17 nt, Homo sapiens
gaauuacacugugccuu

SEQ ID NO: 582891 - RNA, 21 nt, Homo sapiens
gaauuaggcuguaacuacuuu

SEQ ID NO: 582892 - RNA, 15 nt, Homo sapiens
gaauuauaacccaga

SEQ ID NO: 582893 - RNA, 17 nt, Homo sapiens
gaauuauauguucagau

SEQ ID NO: 582894 - RNA, 15 nt, Homo sapiens
gaauuaucaucccaa

SEQ ID NO: 582895 - RNA, 15 nt, Homo sapiens
gaauuaucuauuuca

SEQ ID NO: 582896 - RNA, 15 nt, Homo sapiens
gaauuaugucugcug

SEQ ID NO: 582897 - RNA, 17 nt, Homo sapiens
gaauuaugucugcugaa

SEQ ID NO: 582898 - RNA, 17 nt, Homo sapiens
gaauuauuguaccauuu

SEQ ID NO: 582899 - RNA, 20 nt, Homo sapiens
gaauuauuuugaaugucaca

SEQ ID NO: 582900 - RNA, 14 nt, Homo sapiens
gaauucaauuuggc

SEQ ID NO: 582901 - RNA, 15 nt, Homo sapiens
gaauucacacaacua

SEQ ID NO: 582902 - RNA, 21 nt, Homo sapiens
gaauucaccuugguguuucuc

SEQ ID NO: 582903 - RNA, 20 nt, Homo sapiens
gaauucagcaccagugaaag

SEQ ID NO: 582904 - RNA, 15 nt, Homo sapiens
gaauucagcucagcu

SEQ ID NO: 582905 - RNA, 14 nt, Homo sapiens
gaauucauguuggu

SEQ ID NO: 582906 - RNA, 15 nt, Homo sapiens
gaauucccuugaauu

SEQ ID NO: 582907 - RNA, 21 nt, Homo sapiens
gaauucgaugcguauucugug

SEQ ID NO: 582908 - RNA, 15 nt, Homo sapiens
gaauucuacuggaaa

SEQ ID NO: 582909 - RNA, 23 nt, Homo sapiens
gaauucucaagaccugaguauuu

SEQ ID NO: 582910 - RNA, 21 nt, Homo sapiens
gaauucucgaacugcauguau

SEQ ID NO: 582911 - RNA, 22 nt, Homo sapiens
gaauucugcuaccucacugggg

SEQ ID NO: 582912 - RNA, 21 nt, Homo sapiens
gaauucuugaucucuaaugag

SEQ ID NO: 582913 - RNA, 19 nt, Homo sapiens
gaauucuuuuucauuugag

SEQ ID NO: 582914 - RNA, 13 nt, Homo sapiens
gaauugaagccaa

SEQ ID NO: 582915 - RNA, 16 nt, Homo sapiens
gaauugaccccuuccu

SEQ ID NO: 582916 - RNA, 17 nt, Homo sapiens
gaauugaccccuuccuc

SEQ ID NO: 582917 - RNA, 15 nt, Homo sapiens
gaauugacucaaaaa

SEQ ID NO: 582918 - RNA, 21 nt, Homo sapiens
gaauugauauguauguuguga

SEQ ID NO: 582919 - RNA, 16 nt, Homo sapiens
gaauugcacaguagga

SEQ ID NO: 582920 - RNA, 22 nt, Homo sapiens
gaauugcuccugcaugcaacua

SEQ ID NO: 582921 - RNA, 23 nt, Homo sapiens
gaauuggauacauacaccagcau

SEQ ID NO: 582922 - RNA, 13 nt, Homo sapiens
gaauuggguuucu

SEQ ID NO: 582923 - RNA, 14 nt, Homo sapiens
gaauugguugccau

SEQ ID NO: 582924 - RNA, 15 nt, Homo sapiens
gaauugucuugcaag

SEQ ID NO: 582925 - RNA, 22 nt, Homo sapiens
gaauuguuguauuccuucugca

SEQ ID NO: 582926 - RNA, 14 nt, Homo sapiens
gaauuuauaucuaa

SEQ ID NO: 582927 - RNA, 20 nt, Homo sapiens
gaauuucaauguccagugag

SEQ ID NO: 582928 - RNA, 18 nt, Homo sapiens
gaauuucacaagcuauuu

SEQ ID NO: 582929 - RNA, 18 nt, Homo sapiens
gaauuucaguaaacaaug

SEQ ID NO: 582930 - RNA, 18 nt, Homo sapiens
gaauuuccucuauugaug

SEQ ID NO: 582931 - RNA, 12 nt, Homo sapiens
gaauuugagugc

SEQ ID NO: 582932 - RNA, 16 nt, Homo sapiens
gaauuugcaacaguaa

SEQ ID NO: 582933 - RNA, 16 nt, Homo sapiens
gaauuugccuguaaca

SEQ ID NO: 582934 - RNA, 16 nt, Homo sapiens
gaauuugggccucuug

SEQ ID NO: 582935 - RNA, 19 nt, Homo sapiens
gaauuugggccucuuguac

SEQ ID NO: 582936 - RNA, 20 nt, Homo sapiens
gaauuuguuaucaguaagaa

SEQ ID NO: 582937 - RNA, 18 nt, Homo sapiens
gaauuuguuuugguacuc

SEQ ID NO: 582938 - RNA, 15 nt, Homo sapiens
gaauuuuaagugcuu

SEQ ID NO: 582939 - RNA, 15 nt, Homo sapiens
gaauuuuauaaucug

SEQ ID NO: 582940 - RNA, 23 nt, Homo sapiens
gaauuuucucccuuuauguaucu

SEQ ID NO: 582941 - RNA, 13 nt, Homo sapiens
gaauuuuguugcu

SEQ ID NO: 582942 - RNA, 18 nt, Homo sapiens
gaauuuuguuuuacuuuu

SEQ ID NO: 582943 - RNA, 16 nt, Homo sapiens
gaauuuuuaaacaagu

SEQ ID NO: 582944 - RNA, 22 nt, Homo sapiens
gaauuuuuacuuagauacuaau

SEQ ID NO: 582945 - RNA, 21 nt, Homo sapiens
gaauuuuuuaaauugacaguu

SEQ ID NO: 582946 - RNA, 19 nt, Homo sapiens
gaauuuuuuuuaacauucc

SEQ ID NO: 582947 - RNA, 22 nt, Homo sapiens
gaauuuuuuuuuuuaagcucaa

SEQ ID NO: 582948 - RNA, 17 nt, Homo sapiens
gacaaaaacaagcaaug

SEQ ID NO: 582949 - RNA, 17 nt, Homo sapiens
gacaaaagcagcacaag

SEQ ID NO: 582950 - RNA, 18 nt, Homo sapiens
gacaaaauccaugaacaa

SEQ ID NO: 582951 - RNA, 17 nt, Homo sapiens
gacaaacagaccauaaa

SEQ ID NO: 582952 - RNA, 13 nt, Homo sapiens
gacaaaccagagc

SEQ ID NO: 582953 - RNA, 16 nt, Homo sapiens
gacaaaccgagugcaa

SEQ ID NO: 582954 - RNA, 17 nt, Homo sapiens
gacaaaccgagugcaau

SEQ ID NO: 582955 - RNA, 21 nt, Homo sapiens
gacaaacuaacaggaacaaaa

SEQ ID NO: 582956 - RNA, 17 nt, Homo sapiens
gacaaagugagacuccg

SEQ ID NO: 582957 - RNA, 18 nt, Homo sapiens
gacaaauaggagugagug

SEQ ID NO: 582958 - RNA, 16 nt, Homo sapiens
gacaaaucaacagaag

SEQ ID NO: 582959 - RNA, 18 nt, Homo sapiens
gacaaaucuuuaagaaua

SEQ ID NO: 582960 - RNA, 18 nt, Homo sapiens
gacaaaugccacacggcu

SEQ ID NO: 582961 - RNA, 16 nt, Homo sapiens
gacaaauguugaccuu

SEQ ID NO: 582962 - RNA, 21 nt, Homo sapiens
gacaaauuagcaugcaagcuu

SEQ ID NO: 582963 - RNA, 11 nt, Homo sapiens
gacaacacuga

SEQ ID NO: 582964 - RNA, 12 nt, Homo sapiens
gacaacacuuaa

SEQ ID NO: 582965 - RNA, 18 nt, Homo sapiens
gacaacaguucugagcug

SEQ ID NO: 582966 - RNA, 16 nt, Homo sapiens
gacaaccgaugcucca

SEQ ID NO: 582967 - RNA, 13 nt, Homo sapiens
gacaacgaugaau

SEQ ID NO: 582968 - RNA, 14 nt, Homo sapiens
gacaacgaugaauu

SEQ ID NO: 582969 - RNA, 15 nt, Homo sapiens
gacaacgaugaugcu

SEQ ID NO: 582970 - RNA, 22 nt, Homo sapiens
gacaacuaucaauucuugagac

SEQ ID NO: 582971 - RNA, 11 nt, Homo sapiens
gacaacucugu

SEQ ID NO: 582972 - RNA, 17 nt, Homo sapiens
gacaacugcacaugaaa

SEQ ID NO: 582973 - RNA, 14 nt, Homo sapiens
gacaagaacaaagc

SEQ ID NO: 582974 - RNA, 18 nt, Homo sapiens
gacaagaaugugcacucu

SEQ ID NO: 582975 - RNA, 22 nt, Homo sapiens
gacaagacgcugcccacccgcg

SEQ ID NO: 582976 - RNA, 22 nt, Homo sapiens
gacaagagaugggaaugaggug

SEQ ID NO: 582977 - RNA, 13 nt, Homo sapiens
gacaagauuuaug

SEQ ID NO: 582978 - RNA, 23 nt, Homo sapiens
gacaagauuuuuuaauuguuuaa

SEQ ID NO: 582979 - RNA, 18 nt, Homo sapiens
gacaagcagugucuguca

SEQ ID NO: 582980 - RNA, 20 nt, Homo sapiens
gacaagcagugucugucagc

SEQ ID NO: 582981 - RNA, 16 nt, Homo sapiens
gacaagggaaauguca

SEQ ID NO: 582982 - RNA, 18 nt, Homo sapiens
gacaagguucugcccuua

SEQ ID NO: 582983 - RNA, 19 nt, Homo sapiens
gacaaguauuaauaguuca

SEQ ID NO: 582984 - RNA, 22 nt, Homo sapiens
gacaaguguuaaggcaacauuc

SEQ ID NO: 582985 - RNA, 17 nt, Homo sapiens
gacaaguuccuaggaaa

SEQ ID NO: 582986 - RNA, 15 nt, Homo sapiens
gacaauauacuucac

SEQ ID NO: 582987 - RNA, 17 nt, Homo sapiens
gacaauauacuucacug

SEQ ID NO: 582988 - RNA, 13 nt, Homo sapiens
gacaaucacuaca

SEQ ID NO: 582989 - RNA, 18 nt, Homo sapiens
gacaaucacuacaaguca

SEQ ID NO: 582990 - RNA, 19 nt, Homo sapiens
gacgugauuuugcuguaga

SEQ ID NO: 582991 - RNA, 20 nt, Homo sapiens
gacgugauuuugcuguagaa

SEQ ID NO: 582992 - RNA, 15 nt, Homo sapiens
gacgugcagccacac

SEQ ID NO: 582993 - RNA, 22 nt, Homo sapiens
gacgugcugggcggcugugcuu

SEQ ID NO: 582994 - RNA, 14 nt, Homo sapiens
gacguguacagcac

SEQ ID NO: 582995 - RNA, 19 nt, Homo sapiens
gacguucauuauguaugaa

SEQ ID NO: 582996 - RNA, 15 nt, Homo sapiens
gacguuuucuuuauc

SEQ ID NO: 582997 - RNA, 13 nt, Homo sapiens
gacuaacccaaug

SEQ ID NO: 582998 - RNA, 18 nt, Homo sapiens
gacuaacccaaugccugu

SEQ ID NO: 582999 - RNA, 22 nt, Homo sapiens
gacuaacccaaugccugugaag

SEQ ID NO: 583000 - RNA, 14 nt, Homo sapiens
gacuaauuucaaaa

SEQ ID NO: 583001 - RNA, 22 nt, Homo sapiens
gacuaauuucaaaaugcuuuuu

SEQ ID NO: 583002 - RNA, 14 nt, Homo sapiens
gacuacacccaagc

SEQ ID NO: 583003 - RNA, 17 nt, Homo sapiens
gacuacuccaagggaau

SEQ ID NO: 583004 - RNA, 19 nt, Homo sapiens
gacuacuuggaacuaggcu

SEQ ID NO: 583005 - RNA, 17 nt, Homo sapiens
gacuagaggcuugcaua

SEQ ID NO: 583006 - RNA, 18 nt, Homo sapiens
gacuagaggcuugcauaa

SEQ ID NO: 583007 - RNA, 16 nt, Homo sapiens
gacuagaugauggaug

SEQ ID NO: 583008 - RNA, 16 nt, Homo sapiens
gacuaggugcuugcuu

SEQ ID NO: 583009 - RNA, 17 nt, Homo sapiens
gacuaugcagaggccug

SEQ ID NO: 583010 - RNA, 22 nt, Homo sapiens
gacuauggagugcaccaaagag

SEQ ID NO: 583011 - RNA, 22 nt, Homo sapiens
gacuauggauguguucucuagg

SEQ ID NO: 583012 - RNA, 12 nt, Homo sapiens
gacuauguuugg

SEQ ID NO: 583013 - RNA, 20 nt, Homo sapiens
gacuauuauagaauggaacu

SEQ ID NO: 583014 - RNA, 21 nt, Homo sapiens
gacucaaggucacacagugau

SEQ ID NO: 583015 - RNA, 18 nt, Homo sapiens
gacucaaguccuuaccuc

SEQ ID NO: 583016 - RNA, 15 nt, Homo sapiens
gacucaaguguagaa

SEQ ID NO: 583017 - RNA, 21 nt, Homo sapiens
gacucacacuuacugcaaagg

SEQ ID NO: 583018 - RNA, 19 nt, Homo sapiens
gacucacccuccacaaagc

SEQ ID NO: 583019 - RNA, 14 nt, Homo sapiens
gacucacuucucag

SEQ ID NO: 583020 - RNA, 16 nt, Homo sapiens
gacucagaaagccaac

SEQ ID NO: 583021 - RNA, 18 nt, Homo sapiens
gacucagaugaggacaga

SEQ ID NO: 583022 - RNA, 13 nt, Homo sapiens
gacucagcugcca

SEQ ID NO: 583023 - RNA, 17 nt, Homo sapiens
gacucagggccaugccu

SEQ ID NO: 583024 - RNA, 13 nt, Homo sapiens
gacucauuucaca

SEQ ID NO: 583025 - RNA, 15 nt, Homo sapiens
gacuccaaaaggccc

SEQ ID NO: 583026 - RNA, 19 nt, Homo sapiens
gacuccaaaaggcccuuuu

SEQ ID NO: 583027 - RNA, 13 nt, Homo sapiens
gacuccaaccuca

SEQ ID NO: 583028 - RNA, 12 nt, Homo sapiens
gacuccaucuca

SEQ ID NO: 583029 - RNA, 20 nt, Homo sapiens
gacuccauuucuuucuucca

SEQ ID NO: 583030 - RNA, 14 nt, Homo sapiens
gacucccacaacaa

SEQ ID NO: 583031 - RNA, 15 nt, Homo sapiens
gacuccccugaagaa

SEQ ID NO: 583032 - RNA, 15 nt, Homo sapiens
gacuccucaaaagca

SEQ ID NO: 583033 - RNA, 12 nt, Homo sapiens
gacuccucauca

SEQ ID NO: 583034 - RNA, 15 nt, Homo sapiens
gacuccuggcccaag

SEQ ID NO: 583035 - RNA, 17 nt, Homo sapiens
gacuccugugcaacuuu

SEQ ID NO: 583036 - RNA, 18 nt, Homo sapiens
gacucgacaaaggccaca

SEQ ID NO: 583037 - RNA, 19 nt, Homo sapiens
gacucggagacuauggccu

SEQ ID NO: 583038 - RNA, 13 nt, Homo sapiens
gacucuaaaaaga

SEQ ID NO: 583039 - RNA, 16 nt, Homo sapiens
auccaugcacuuuaau

SEQ ID NO: 583040 - RNA, 20 nt, Homo sapiens
auccaugcuuggguguaaca

SEQ ID NO: 583041 - RNA, 18 nt, Homo sapiens
auccauguaaauugcaaa

SEQ ID NO: 583042 - RNA, 16 nt, Homo sapiens
auccauguccugaaaa

SEQ ID NO: 583043 - RNA, 23 nt, Homo sapiens
auccaugugauuaauguuuucau

SEQ ID NO: 583044 - RNA, 23 nt, Homo sapiens
auccauuccucagggacagagac

SEQ ID NO: 583045 - RNA, 15 nt, Homo sapiens
auccauugaacuaaa

SEQ ID NO: 583046 - RNA, 18 nt, Homo sapiens
auccauugaacuaaaaua

SEQ ID NO: 583047 - RNA, 13 nt, Homo sapiens
auccauuuuacac

SEQ ID NO: 583048 - RNA, 13 nt, Homo sapiens
aucccaaaccauu

SEQ ID NO: 583049 - RNA, 22 nt, Homo sapiens
aucccaaaggaugagaauguga

SEQ ID NO: 583050 - RNA, 12 nt, Homo sapiens
aucccaacauuc

SEQ ID NO: 583051 - RNA, 12 nt, Homo sapiens
aucccaagagaa

SEQ ID NO: 583052 - RNA, 19 nt, Homo sapiens
aucccaaucaaagaauuac

SEQ ID NO: 583053 - RNA, 16 nt, Homo sapiens
aucccacccaacagcu

SEQ ID NO: 583054 - RNA, 20 nt, Homo sapiens
aucccacccaacagcucaga

SEQ ID NO: 583055 - RNA, 18 nt, Homo sapiens
aucccaccugacaugucc

SEQ ID NO: 583056 - RNA, 19 nt, Homo sapiens
aucccaccugacauguccu

SEQ ID NO: 583057 - RNA, 18 nt, Homo sapiens
aucccacuucacugugag

SEQ ID NO: 583058 - RNA, 14 nt, Homo sapiens
aucccagcuacuca

SEQ ID NO: 583059 - RNA, 15 nt, Homo sapiens
aucccagcuacucaa

SEQ ID NO: 583060 - RNA, 22 nt, Homo sapiens
aucccagcuacucagguggcua

SEQ ID NO: 583061 - RNA, 15 nt, Homo sapiens
aucccagcuacucga

SEQ ID NO: 583062 - RNA, 17 nt, Homo sapiens
aucccagcuacucgaga

SEQ ID NO: 583063 - RNA, 19 nt, Homo sapiens
aucccagcuucggcauuug

SEQ ID NO: 583064 - RNA, 22 nt, Homo sapiens
aucccaggggcuuaucucuuca

SEQ ID NO: 583065 - RNA, 12 nt, Homo sapiens
aucccaucucuc

SEQ ID NO: 583066 - RNA, 15 nt, Homo sapiens
aucccaucucuccca

SEQ ID NO: 583067 - RNA, 21 nt, Homo sapiens
aucccaugauguagugccucu

SEQ ID NO: 583068 - RNA, 15 nt, Homo sapiens
aucccauuucuugaa

SEQ ID NO: 583069 - RNA, 14 nt, Homo sapiens
auccccaccacuga

SEQ ID NO: 583070 - RNA, 18 nt, Homo sapiens
auccccaccacugauauc

SEQ ID NO: 583071 - RNA, 19 nt, Homo sapiens
auccccaccacugauauca

SEQ ID NO: 583072 - RNA, 13 nt, Homo sapiens
auccccaccuacu

SEQ ID NO: 583073 - RNA, 17 nt, Homo sapiens
auccccaccuacuccug

SEQ ID NO: 583074 - RNA, 22 nt, Homo sapiens
auccccagggacagaaaccaag

SEQ ID NO: 583075 - RNA, 12 nt, Homo sapiens
auccccaucucc

SEQ ID NO: 583076 - RNA, 15 nt, Homo sapiens
aucccccagccucaa

SEQ ID NO: 583077 - RNA, 12 nt, Homo sapiens
auccccccaugc

SEQ ID NO: 583078 - RNA, 23 nt, Homo sapiens
auccccccgccaaaagcugcuca

SEQ ID NO: 583079 - RNA, 15 nt, Homo sapiens
auccccucccaucau

SEQ ID NO: 583080 - RNA, 15 nt, Homo sapiens
auccccucucuuccu

SEQ ID NO: 583081 - RNA, 19 nt, Homo sapiens
auccccuggacugggaggu

SEQ ID NO: 583082 - RNA, 17 nt, Homo sapiens
auccccuuggcugugag

SEQ ID NO: 583083 - RNA, 19 nt, Homo sapiens
auccccuuuggcuaccuga

SEQ ID NO: 583084 - RNA, 22 nt, Homo sapiens
aucccgccucuucuucuucaga

SEQ ID NO: 583085 - RNA, 18 nt, Homo sapiens
aucccguaccucuuccca

SEQ ID NO: 583086 - RNA, 13 nt, Homo sapiens
aucccuacaugua

SEQ ID NO: 583087 - RNA, 13 nt, Homo sapiens
aucccuacuguaa

SEQ ID NO: 583088 - RNA, 18 nt, Homo sapiens
aucccucgggugugcuau

SEQ ID NO: 583089 - RNA, 14 nt, Homo sapiens
aucccucuaaugag

SEQ ID NO: 583090 - RNA, 19 nt, Homo sapiens
aucccugaaacaucucaac

SEQ ID NO: 583091 - RNA, 23 nt, Homo sapiens
aucccugaaccccuggccagcuc

SEQ ID NO: 583092 - RNA, 20 nt, Homo sapiens
aucccugcagccugguagaa

SEQ ID NO: 583093 - RNA, 14 nt, Homo sapiens
aucccugcagcuca

SEQ ID NO: 583094 - RNA, 23 nt, Homo sapiens
aucccugcggaggguuugguucu

SEQ ID NO: 583095 - RNA, 15 nt, Homo sapiens
aucccuggaaggaca

SEQ ID NO: 583096 - RNA, 22 nt, Homo sapiens
aucccuggugaaggaucuugcc

SEQ ID NO: 583097 - RNA, 18 nt, Homo sapiens
aucccuguacucugaccc

SEQ ID NO: 583098 - RNA, 19 nt, Homo sapiens
aucccugucauuuuuaaca

SEQ ID NO: 583099 - RNA, 12 nt, Homo sapiens
aucccuguucau

SEQ ID NO: 583100 - RNA, 20 nt, Homo sapiens
aucccuuccucucaggcucu

SEQ ID NO: 583101 - RNA, 15 nt, Homo sapiens
aucccuuccuggaaa

SEQ ID NO: 583102 - RNA, 15 nt, Homo sapiens
aucccuuguucucag

SEQ ID NO: 583103 - RNA, 18 nt, Homo sapiens
aucccuuugcaccugaga

SEQ ID NO: 583104 - RNA, 15 nt, Homo sapiens
auccgaggcaggguc

SEQ ID NO: 583105 - RNA, 20 nt, Homo sapiens
auccgguggccuauuccagg

SEQ ID NO: 583106 - RNA, 13 nt, Homo sapiens
auccguggcugca

SEQ ID NO: 583107 - RNA, 17 nt, Homo sapiens
auccuaaaaaguuccau

SEQ ID NO: 583108 - RNA, 21 nt, Homo sapiens
auccuaacugacaugcagauu

SEQ ID NO: 583109 - RNA, 16 nt, Homo sapiens
auccuaagucucuuac

SEQ ID NO: 583110 - RNA, 15 nt, Homo sapiens
auccuacaagacaca

SEQ ID NO: 583111 - RNA, 16 nt, Homo sapiens
auccuacaagacacag

SEQ ID NO: 583112 - RNA, 22 nt, Homo sapiens
auccuacaaggcuggcagugac

SEQ ID NO: 583113 - RNA, 19 nt, Homo sapiens
auccuacaguacaaucagc

SEQ ID NO: 583114 - RNA, 13 nt, Homo sapiens
auccuaccuugcu

SEQ ID NO: 583115 - RNA, 20 nt, Homo sapiens
auccuacugagcauuugcac

SEQ ID NO: 583116 - RNA, 14 nt, Homo sapiens
auccuauaagcuua

SEQ ID NO: 583117 - RNA, 20 nt, Homo sapiens
auccucaaaucagucuuccu

SEQ ID NO: 583118 - RNA, 15 nt, Homo sapiens
auccucacaaccacc

SEQ ID NO: 583119 - RNA, 13 nt, Homo sapiens
auccuccacagag

SEQ ID NO: 583120 - RNA, 15 nt, Homo sapiens
auccuccccaggacc

SEQ ID NO: 583121 - RNA, 16 nt, Homo sapiens
auccucccuacuucca

SEQ ID NO: 583122 - RNA, 19 nt, Homo sapiens
auccuccuaccuccaaagc

SEQ ID NO: 583123 - RNA, 23 nt, Homo sapiens
auccuccugcccagcuccucaca

SEQ ID NO: 583124 - RNA, 22 nt, Homo sapiens
auccucugagugugaccaggca

SEQ ID NO: 583125 - RNA, 23 nt, Homo sapiens
auccugaaaaggguguugcuaag

SEQ ID NO: 583126 - RNA, 20 nt, Homo sapiens
auccugcauuuaugguguag

SEQ ID NO: 583127 - RNA, 22 nt, Homo sapiens
auccuggaaggacacagugaug

SEQ ID NO: 583128 - RNA, 14 nt, Homo sapiens
auccuggaugauuu

SEQ ID NO: 583129 - RNA, 18 nt, Homo sapiens
auccuggaugauuucauc

SEQ ID NO: 583130 - RNA, 21 nt, Homo sapiens
auccuggccaacauggugaaa

SEQ ID NO: 583131 - RNA, 11 nt, Homo sapiens
auccugggcug

SEQ ID NO: 583132 - RNA, 22 nt, Homo sapiens
auccuguaacuacaaugauggu

SEQ ID NO: 583133 - RNA, 15 nt, Homo sapiens
auccuguaguacaag

SEQ ID NO: 583134 - RNA, 20 nt, Homo sapiens
auccuguauaagcacugaaa

SEQ ID NO: 583135 - RNA, 15 nt, Homo sapiens
auccugucauauaau

SEQ ID NO: 583136 - RNA, 18 nt, Homo sapiens
auccugucugaggaguaa

SEQ ID NO: 583137 - RNA, 18 nt, Homo sapiens
auccuguguuaucugugg

SEQ ID NO: 583138 - RNA, 22 nt, Homo sapiens
auccuuaaugguguucucucuc

SEQ ID NO: 583139 - RNA, 13 nt, Homo sapiens
auccuuauuccuc

SEQ ID NO: 583140 - RNA, 16 nt, Homo sapiens
auccuucagcacagga

SEQ ID NO: 583141 - RNA, 14 nt, Homo sapiens
auccuuccaccuca

SEQ ID NO: 583142 - RNA, 18 nt, Homo sapiens
auccuuccuaaacccaau

SEQ ID NO: 583143 - RNA, 15 nt, Homo sapiens
auccuucuacuuguc

SEQ ID NO: 583144 - RNA, 18 nt, Homo sapiens
auccuucuccaccaaaga

SEQ ID NO: 583145 - RNA, 19 nt, Homo sapiens
auccuucugucuccagggc

SEQ ID NO: 583146 - RNA, 18 nt, Homo sapiens
auccuucuuucuaguuca

SEQ ID NO: 583147 - RNA, 13 nt, Homo sapiens
auccuugugacuu

SEQ ID NO: 583148 - RNA, 14 nt, Homo sapiens
auccuuuaccacuc

SEQ ID NO: 583149 - RNA, 15 nt, Homo sapiens
auccuuuacuguuag

SEQ ID NO: 583150 - RNA, 14 nt, Homo sapiens
auccuuucaagaca

SEQ ID NO: 583151 - RNA, 19 nt, Homo sapiens
auccuuucaagacagaaag

SEQ ID NO: 583152 - RNA, 22 nt, Homo sapiens
auccuuuccacccuauucccua

SEQ ID NO: 583153 - RNA, 16 nt, Homo sapiens
aucgaaucuacuaauu

SEQ ID NO: 583154 - RNA, 21 nt, Homo sapiens
aucgacuuguuuuugcacaug

SEQ ID NO: 583155 - RNA, 19 nt, Homo sapiens
aucgagaccauccuggcua

SEQ ID NO: 583156 - RNA, 20 nt, Homo sapiens
aucgauccuggauucacuca

SEQ ID NO: 583157 - RNA, 22 nt, Homo sapiens
aucgauggaugggaugcacucu

SEQ ID NO: 583158 - RNA, 23 nt, Homo sapiens
aucgauggaugggaugcacucuc

SEQ ID NO: 583159 - RNA, 12 nt, Homo sapiens
aucgaugugcuc

SEQ ID NO: 583160 - RNA, 15 nt, Homo sapiens
aucgauuugucuguc

SEQ ID NO: 583161 - RNA, 15 nt, Homo sapiens
aucgcaccacugcac

SEQ ID NO: 583162 - RNA, 19 nt, Homo sapiens
ccgcaggaucaggugacuu

SEQ ID NO: 583163 - RNA, 18 nt, Homo sapiens
ccgcaggugggugcugcc

SEQ ID NO: 583164 - RNA, 22 nt, Homo sapiens
ccgcaggugggugcugcccugu

SEQ ID NO: 583165 - RNA, 15 nt, Homo sapiens
ccgcauuggugacuc

SEQ ID NO: 583166 - RNA, 20 nt, Homo sapiens
ccgccaccaugcccggcuaa

SEQ ID NO: 583167 - RNA, 12 nt, Homo sapiens
ccgccaccucag

SEQ ID NO: 583168 - RNA, 19 nt, Homo sapiens
ccgccacugggccugucac

SEQ ID NO: 583169 - RNA, 23 nt, Homo sapiens
ccgccauccaccccguugcucaa

SEQ ID NO: 583170 - RNA, 21 nt, Homo sapiens
ccgccauugccaccaggagaa

SEQ ID NO: 583171 - RNA, 18 nt, Homo sapiens
ccgccuccaaaugccaac

SEQ ID NO: 583172 - RNA, 18 nt, Homo sapiens
ccgccuuccuggagaccc

SEQ ID NO: 583173 - RNA, 23 nt, Homo sapiens
ccgcgugaucaaagccacacucu

SEQ ID NO: 583174 - RNA, 14 nt, Homo sapiens
ccgcucuggaccaa

SEQ ID NO: 583175 - RNA, 17 nt, Homo sapiens
ccgcugauaagcauuga

SEQ ID NO: 583176 - RNA, 18 nt, Homo sapiens
ccgcugcccuuuggccaa

SEQ ID NO: 583177 - RNA, 22 nt, Homo sapiens
ccgcuucaaaauaaguguaauc

SEQ ID NO: 583178 - RNA, 16 nt, Homo sapiens
ccgcuuccccuugcca

SEQ ID NO: 583179 - RNA, 15 nt, Homo sapiens
ccgcuuggcacauga

SEQ ID NO: 583180 - RNA, 16 nt, Homo sapiens
ccgcuuguggggaccc

SEQ ID NO: 583181 - RNA, 16 nt, Homo sapiens
ccggaaggaaugucag

SEQ ID NO: 583182 - RNA, 21 nt, Homo sapiens
ccggaaggaggccaaccagcc

SEQ ID NO: 583183 - RNA, 15 nt, Homo sapiens
ccggaggcugcagug

SEQ ID NO: 583184 - RNA, 13 nt, Homo sapiens
ccggaggggaccc

SEQ ID NO: 583185 - RNA, 22 nt, Homo sapiens
ccggaucagagcaggaccuccc

SEQ ID NO: 583186 - RNA, 21 nt, Homo sapiens
ccggaucuacacccaccagag

SEQ ID NO: 583187 - RNA, 23 nt, Homo sapiens
ccggcgaaauaaaaucagaguug

SEQ ID NO: 583188 - RNA, 18 nt, Homo sapiens
ccggcgcugauuccucgu

SEQ ID NO: 583189 - RNA, 22 nt, Homo sapiens
ccggcugcccccaucaccucua

SEQ ID NO: 583190 - RNA, 16 nt, Homo sapiens
ccgggacccucaggug

SEQ ID NO: 583191 - RNA, 15 nt, Homo sapiens
ccgggcccugcugag

SEQ ID NO: 583192 - RNA, 23 nt, Homo sapiens
ccgggccugcacagauaccucau

SEQ ID NO: 583193 - RNA, 18 nt, Homo sapiens
ccgggcuggcccugugca

SEQ ID NO: 583194 - RNA, 20 nt, Homo sapiens
ccgggcugggagcucugcag

SEQ ID NO: 583195 - RNA, 22 nt, Homo sapiens
ccgggcuuuuccaagcugccac

SEQ ID NO: 583196 - RNA, 15 nt, Homo sapiens
ccggggaaaggcaag

SEQ ID NO: 583197 - RNA, 17 nt, Homo sapiens
ccgggucccugagcucc

SEQ ID NO: 583198 - RNA, 20 nt, Homo sapiens
ccggguucaagcaauucucc

SEQ ID NO: 583199 - RNA, 17 nt, Homo sapiens
ccgguucaggaccacuu

SEQ ID NO: 583200 - RNA, 13 nt, Homo sapiens
ccgguuugccaug

SEQ ID NO: 583201 - RNA, 17 nt, Homo sapiens
ccguaacaacugugguc

SEQ ID NO: 583202 - RNA, 14 nt, Homo sapiens
ccguaucacagugu

SEQ ID NO: 583203 - RNA, 16 nt, Homo sapiens
ccguauugguauacuu

SEQ ID NO: 583204 - RNA, 23 nt, Homo sapiens
ccgucagccaaauguaauugaau

SEQ ID NO: 583205 - RNA, 12 nt, Homo sapiens
ccguccacccuu

SEQ ID NO: 583206 - RNA, 13 nt, Homo sapiens
ccguccauuccag

SEQ ID NO: 583207 - RNA, 14 nt, Homo sapiens
ccgucccucaguga

SEQ ID NO: 583208 - RNA, 14 nt, Homo sapiens
ccgucucuuuaaaa

SEQ ID NO: 583209 - RNA, 15 nt, Homo sapiens
ccgucugugacaugg

SEQ ID NO: 583210 - RNA, 21 nt, Homo sapiens
ccgucuucucccuauucccuc

SEQ ID NO: 583211 - RNA, 23 nt, Homo sapiens
ccgucuuggcuuauccacuuuga

SEQ ID NO: 583212 - RNA, 13 nt, Homo sapiens
ccgugacccugag

SEQ ID NO: 583213 - RNA, 21 nt, Homo sapiens
ccgugagugaaccaucauuau

SEQ ID NO: 583214 - RNA, 21 nt, Homo sapiens
ccgugccaaaaaucuuuucau

SEQ ID NO: 583215 - RNA, 11 nt, Homo sapiens
ccgugccuuca

SEQ ID NO: 583216 - RNA, 17 nt, Homo sapiens
ccgugcuccucagcagu

SEQ ID NO: 583217 - RNA, 20 nt, Homo sapiens
ccguggagagggacuggcag

SEQ ID NO: 583218 - RNA, 14 nt, Homo sapiens
ccguggcugcaggg

SEQ ID NO: 583219 - RNA, 14 nt, Homo sapiens
ccguggcuuggcau

SEQ ID NO: 583220 - RNA, 17 nt, Homo sapiens
ccgugggcugugccaag

SEQ ID NO: 583221 - RNA, 12 nt, Homo sapiens
ccguguccuccu

SEQ ID NO: 583222 - RNA, 21 nt, Homo sapiens
ccgugucucgcgcgacugaga

SEQ ID NO: 583223 - RNA, 20 nt, Homo sapiens
ccgugugagugugacagggc

SEQ ID NO: 583224 - RNA, 14 nt, Homo sapiens
ccguguggacugug

SEQ ID NO: 583225 - RNA, 11 nt, Homo sapiens
ccguguugcag

SEQ ID NO: 583226 - RNA, 15 nt, Homo sapiens
ccguguugcaugaag

SEQ ID NO: 583227 - RNA, 22 nt, Homo sapiens
ccguuaucauggagaacagcau

SEQ ID NO: 583228 - RNA, 12 nt, Homo sapiens
ccguucacauac

SEQ ID NO: 583229 - RNA, 13 nt, Homo sapiens
ccguuuuccucau

SEQ ID NO: 583230 - RNA, 15 nt, Homo sapiens
ccuaaaaaguuccau

SEQ ID NO: 583231 - RNA, 23 nt, Homo sapiens
ccuaaaacucaaaacacccaaaa

SEQ ID NO: 583232 - RNA, 13 nt, Homo sapiens
ccuaaaaucacag

SEQ ID NO: 583233 - RNA, 16 nt, Homo sapiens
ccuaaaauuguaugaa

SEQ ID NO: 583234 - RNA, 17 nt, Homo sapiens
ccuaaacaucauucauu

SEQ ID NO: 583235 - RNA, 18 nt, Homo sapiens
ccuaaagcaaaucugcca

SEQ ID NO: 583236 - RNA, 23 nt, Homo sapiens
ccuaaagggcagggcccacgugu

SEQ ID NO: 583237 - RNA, 14 nt, Homo sapiens
ccuaaauauaauua

SEQ ID NO: 583238 - RNA, 20 nt, Homo sapiens
ccuaaauauaauuauccaaa

SEQ ID NO: 583239 - RNA, 14 nt, Homo sapiens
auuacaauugucau

SEQ ID NO: 583240 - RNA, 17 nt, Homo sapiens
auuacacuuugaaguau

SEQ ID NO: 583241 - RNA, 17 nt, Homo sapiens
auuacagauucugcuag

SEQ ID NO: 583242 - RNA, 17 nt, Homo sapiens
auuacagcuuucacagu

SEQ ID NO: 583243 - RNA, 16 nt, Homo sapiens
auuacaggcacccacc

SEQ ID NO: 583244 - RNA, 17 nt, Homo sapiens
auuacaggcaugagcca

SEQ ID NO: 583245 - RNA, 19 nt, Homo sapiens
auuacaggcaugagccauu

SEQ ID NO: 583246 - RNA, 17 nt, Homo sapiens
auuacaggcgugaucca

SEQ ID NO: 583247 - RNA, 15 nt, Homo sapiens
auuacagucaucugu

SEQ ID NO: 583248 - RNA, 16 nt, Homo sapiens
auuacagugcaguuua

SEQ ID NO: 583249 - RNA, 22 nt, Homo sapiens
auuacauaaucuguacaaugaa

SEQ ID NO: 583250 - RNA, 14 nt, Homo sapiens
auuacauacagauu

SEQ ID NO: 583251 - RNA, 17 nt, Homo sapiens
auuacauggaacuuuuc

SEQ ID NO: 583252 - RNA, 22 nt, Homo sapiens
auuaccaccugaccucuugcug

SEQ ID NO: 583253 - RNA, 16 nt, Homo sapiens
auuaccagacaaaaaa

SEQ ID NO: 583254 - RNA, 16 nt, Homo sapiens
auuaccauauaaugua

SEQ ID NO: 583255 - RNA, 18 nt, Homo sapiens
auuacccaaauauaacca

SEQ ID NO: 583256 - RNA, 17 nt, Homo sapiens
auuaccgcguuguaaaa

SEQ ID NO: 583257 - RNA, 16 nt, Homo sapiens
auuacggggugaccuu

SEQ ID NO: 583258 - RNA, 14 nt, Homo sapiens
auuacguuuuacaa

SEQ ID NO: 583259 - RNA, 14 nt, Homo sapiens
auuacuaaauugac

SEQ ID NO: 583260 - RNA, 21 nt, Homo sapiens
auuacuaaggaagauuacuca

SEQ ID NO: 583261 - RNA, 13 nt, Homo sapiens
auuacuacuguac

SEQ ID NO: 583262 - RNA, 22 nt, Homo sapiens
auuacugaaauuuaagaaaaag

SEQ ID NO: 583263 - RNA, 18 nt, Homo sapiens
auuacugccuuacuguac

SEQ ID NO: 583264 - RNA, 21 nt, Homo sapiens
auuacuggccuuuuucauuua

SEQ ID NO: 583265 - RNA, 23 nt, Homo sapiens
auuacuggugugagccacugugu

SEQ ID NO: 583266 - RNA, 12 nt, Homo sapiens
auuacuguguaa

SEQ ID NO: 583267 - RNA, 20 nt, Homo sapiens
auuacuguuuauuacuucca

SEQ ID NO: 583268 - RNA, 14 nt, Homo sapiens
auuagaaaguuaac

SEQ ID NO: 583269 - RNA, 17 nt, Homo sapiens
auuagaaauuuaauuuc

SEQ ID NO: 583270 - RNA, 24 nt, Homo sapiens
auuagaagacaacaggcauagcaa

SEQ ID NO: 583271 - RNA, 17 nt, Homo sapiens
auuagaaggcaaguuuc

SEQ ID NO: 583272 - RNA, 16 nt, Homo sapiens
auuagaagucuuucag

SEQ ID NO: 583273 - RNA, 16 nt, Homo sapiens
auuagaauauccauga

SEQ ID NO: 583274 - RNA, 17 nt, Homo sapiens
auuagaauauccaugac

SEQ ID NO: 583275 - RNA, 15 nt, Homo sapiens
auuagaaugcaugua

SEQ ID NO: 583276 - RNA, 22 nt, Homo sapiens
auuagacagaacaccuaugcaa

SEQ ID NO: 583277 - RNA, 22 nt, Homo sapiens
auuagacuggaacuugaacuga

SEQ ID NO: 583278 - RNA, 22 nt, Homo sapiens
auuagagaauuuucugcauuau

SEQ ID NO: 583279 - RNA, 13 nt, Homo sapiens
auuagagccugua

SEQ ID NO: 583280 - RNA, 18 nt, Homo sapiens
auuagaggucuccaaaau

SEQ ID NO: 583281 - RNA, 23 nt, Homo sapiens
auuagcagcaucuuuaacacagc

SEQ ID NO: 583282 - RNA, 20 nt, Homo sapiens
auuagcauucugguuuugac

SEQ ID NO: 583283 - RNA, 22 nt, Homo sapiens
auuagcauucugguuuugacau

SEQ ID NO: 583284 - RNA, 14 nt, Homo sapiens
cggaggcugcagug

SEQ ID NO: 583285 - RNA, 16 nt, Homo sapiens
cggagggaguggcacu

SEQ ID NO: 583286 - RNA, 15 nt, Homo sapiens
cggaguccccggggu

SEQ ID NO: 583287 - RNA, 21 nt, Homo sapiens
cggaguggacaccgcucagua

SEQ ID NO: 583288 - RNA, 21 nt, Homo sapiens
cggaucuggggcucugggaua

SEQ ID NO: 583289 - RNA, 16 nt, Homo sapiens
cggaugaccaaaccag

SEQ ID NO: 583290 - RNA, 21 nt, Homo sapiens
cggauggaccaaccugcucug

SEQ ID NO: 583291 - RNA, 23 nt, Homo sapiens
cggauggaccaaccugcucuguc

SEQ ID NO: 583292 - RNA, 21 nt, Homo sapiens
cggauguuucuggaauugaua

SEQ ID NO: 583293 - RNA, 17 nt, Homo sapiens
cggcaacaucaacccga

SEQ ID NO: 583294 - RNA, 13 nt, Homo sapiens
cggcaagaaggaa

SEQ ID NO: 583295 - RNA, 19 nt, Homo sapiens
cggcaggugcucuguggau

SEQ ID NO: 583296 - RNA, 15 nt, Homo sapiens
cggccacagggcggu

SEQ ID NO: 583297 - RNA, 16 nt, Homo sapiens
cggccacucuaccuga

SEQ ID NO: 583298 - RNA, 16 nt, Homo sapiens
cggcccacagguuucc

SEQ ID NO: 583299 - RNA, 16 nt, Homo sapiens
cggcccucagaugucc

SEQ ID NO: 583300 - RNA, 13 nt, Homo sapiens
cggccgacugccu

SEQ ID NO: 583301 - RNA, 23 nt, Homo sapiens
cggccgaggccugcgcccugaca

SEQ ID NO: 583302 - RNA, 14 nt, Homo sapiens
cggccucccaaagu

SEQ ID NO: 583303 - RNA, 21 nt, Homo sapiens
cggccuccucuccuacuuugg

SEQ ID NO: 583304 - RNA, 18 nt, Homo sapiens
cggccucucaguucuuga

SEQ ID NO: 583305 - RNA, 21 nt, Homo sapiens
cggccugcaccgaccccgggc

SEQ ID NO: 583306 - RNA, 12 nt, Homo sapiens
cggccugcagug

SEQ ID NO: 583307 - RNA, 14 nt, Homo sapiens
cggcgccaccaucc

SEQ ID NO: 583308 - RNA, 19 nt, Homo sapiens
cggcuaugggacugcagug

SEQ ID NO: 583309 - RNA, 14 nt, Homo sapiens
cggcucacugcaac

SEQ ID NO: 583310 - RNA, 15 nt, Homo sapiens
cggcucagccuugca

SEQ ID NO: 583311 - RNA, 13 nt, Homo sapiens
cggcucugcaguc

SEQ ID NO: 583312 - RNA, 14 nt, Homo sapiens
cggcugccaagaca

SEQ ID NO: 583313 - RNA, 12 nt, Homo sapiens
cggcugccuagc

SEQ ID NO: 583314 - RNA, 23 nt, Homo sapiens
cggcugguuuuguaagaugcugg

SEQ ID NO: 583315 - RNA, 16 nt, Homo sapiens
cggcuguuuacugcuu

SEQ ID NO: 583316 - RNA, 21 nt, Homo sapiens
cgggaaaauaaaccacugguc

SEQ ID NO: 583317 - RNA, 13 nt, Homo sapiens
cgggaaacacaca

SEQ ID NO: 583318 - RNA, 22 nt, Homo sapiens
cgggaacuggagucugucucuu

SEQ ID NO: 583319 - RNA, 21 nt, Homo sapiens
cgggagaccccuuguugcacu

SEQ ID NO: 583320 - RNA, 16 nt, Homo sapiens
cgggagaccugugcua

SEQ ID NO: 583321 - RNA, 13 nt, Homo sapiens
cgggagcacagcu

SEQ ID NO: 583322 - RNA, 23 nt, Homo sapiens
cgggaugggacacccaacacuuu

SEQ ID NO: 583323 - RNA, 15 nt, Homo sapiens
cgggaugggggaaaa

SEQ ID NO: 583324 - RNA, 15 nt, Homo sapiens
cgggcacccacaagc

SEQ ID NO: 583325 - RNA, 13 nt, Homo sapiens
cgggcaccuguaa

SEQ ID NO: 583326 - RNA, 15 nt, Homo sapiens
cgggcagucugcucu

SEQ ID NO: 583327 - RNA, 18 nt, Homo sapiens
cgggcugggagcucugca

SEQ ID NO: 583328 - RNA, 20 nt, Homo sapiens
cgggcuguagaucagguuug

SEQ ID NO: 583329 - RNA, 17 nt, Homo sapiens
cgggcugugcccgggga

SEQ ID NO: 583330 - RNA, 19 nt, Homo sapiens
cgggcuuuuccaagcugcc

SEQ ID NO: 583331 - RNA, 21 nt, Homo sapiens
cggggacguagggcuaaggga

SEQ ID NO: 583332 - RNA, 13 nt, Homo sapiens
cggggacugcugg

SEQ ID NO: 583333 - RNA, 15 nt, Homo sapiens
cggggcuccacugaa

SEQ ID NO: 583334 - RNA, 20 nt, Homo sapiens
cggggguucauaggucacug

SEQ ID NO: 583335 - RNA, 21 nt, Homo sapiens
cgggguuucaccauguuggcc

SEQ ID NO: 583336 - RNA, 21 nt, Homo sapiens
cggguaauucuauugggauau

SEQ ID NO: 583337 - RNA, 23 nt, Homo sapiens
cgggugagcugagcuuggcguuu

SEQ ID NO: 583338 - RNA, 18 nt, Homo sapiens
cgggugauuggugcugag

SEQ ID NO: 583339 - RNA, 16 nt, Homo sapiens
cgggugccaggacaau

SEQ ID NO: 583340 - RNA, 20 nt, Homo sapiens
cggguggaucacaaggucaa

SEQ ID NO: 583341 - RNA, 15 nt, Homo sapiens
cggguggaucaccug

SEQ ID NO: 583342 - RNA, 19 nt, Homo sapiens
cggguguguacaccaaggu

SEQ ID NO: 583343 - RNA, 13 nt, Homo sapiens
cggguugggucac

SEQ ID NO: 583344 - RNA, 18 nt, Homo sapiens
cgguaccuggcaauguuu

SEQ ID NO: 583345 - RNA, 14 nt, Homo sapiens
cgguaccuguguuu

SEQ ID NO: 583346 - RNA, 19 nt, Homo sapiens
cggucaauccuguggguga

SEQ ID NO: 583347 - RNA, 18 nt, Homo sapiens
cggucauuugaaugagac

SEQ ID NO: 583348 - RNA, 14 nt, Homo sapiens
cggugagccggggc

SEQ ID NO: 583349 - RNA, 22 nt, Homo sapiens
cggugaugaggaaggacuugac

SEQ ID NO: 583350 - RNA, 16 nt, Homo sapiens
cggugcaugaugcugc

SEQ ID NO: 583351 - RNA, 14 nt, Homo sapiens
cggugcucuggaag

SEQ ID NO: 583352 - RNA, 15 nt, Homo sapiens
cgguguauccuggcc

SEQ ID NO: 583353 - RNA, 13 nt, Homo sapiens
cgguguucugucc

SEQ ID NO: 583354 - RNA, 20 nt, Homo sapiens
cgguguuuggcaaugcuaau

SEQ ID NO: 583355 - RNA, 14 nt, Homo sapiens
cgguuaccucugca

SEQ ID NO: 583356 - RNA, 14 nt, Homo sapiens
cgguuuaauucugu

SEQ ID NO: 583357 - RNA, 20 nt, Homo sapiens
cgguuugaaaauaugccugc

SEQ ID NO: 583358 - RNA, 23 nt, Homo sapiens
cgguuugugagagcccagucauu

SEQ ID NO: 583359 - RNA, 20 nt, Homo sapiens
cguaauuaaaggaacagagu

SEQ ID NO: 583360 - RNA, 12 nt, Homo sapiens
cguacauucaau

SEQ ID NO: 583361 - RNA, 20 nt, Homo sapiens
cguaccaccaugcacuguaa

SEQ ID NO: 583362 - RNA, 18 nt, Homo sapiens
cguaccucuucccaugac

SEQ ID NO: 583363 - RNA, 17 nt, Homo sapiens
cguacuguaacugcuca

SEQ ID NO: 583364 - RNA, 20 nt, Homo sapiens
cguagaaagauccuucgggu

SEQ ID NO: 583365 - RNA, 13 nt, Homo sapiens
cguagacuugaca

SEQ ID NO: 583366 - RNA, 19 nt, Homo sapiens
cguagcuucuaccaugaac

SEQ ID NO: 583367 - RNA, 12 nt, Homo sapiens
cguauaucacau

SEQ ID NO: 583368 - RNA, 14 nt, Homo sapiens
cguaucacaguguu

SEQ ID NO: 583369 - RNA, 19 nt, Homo sapiens
cguaucccgagucugggac

SEQ ID NO: 583370 - RNA, 21 nt, Homo sapiens
cguaucugcucuuaggugcuu

SEQ ID NO: 583371 - RNA, 16 nt, Homo sapiens
cguaugugaaacacac

SEQ ID NO: 583372 - RNA, 16 nt, Homo sapiens
cguauuuuacaugaag

SEQ ID NO: 583373 - RNA, 19 nt, Homo sapiens
cgucacugcccaccaaagg

SEQ ID NO: 583374 - RNA, 16 nt, Homo sapiens
cgucagaccaguacug

SEQ ID NO: 583375 - RNA, 22 nt, Homo sapiens
cgucagggagaggucaccagcu

SEQ ID NO: 583376 - RNA, 23 nt, Homo sapiens
cgucauaauuccugcuauuguua

SEQ ID NO: 583377 - RNA, 18 nt, Homo sapiens
caaagggcccacagugac

SEQ ID NO: 583378 - RNA, 17 nt, Homo sapiens
caaaggugauugugcca

SEQ ID NO: 583379 - RNA, 12 nt, Homo sapiens
caaaggugugcu

SEQ ID NO: 583380 - RNA, 21 nt, Homo sapiens
caaagguuggcaacauuguac

SEQ ID NO: 583381 - RNA, 19 nt, Homo sapiens
caaagguuuauuccagaga

SEQ ID NO: 583382 - RNA, 17 nt, Homo sapiens
caaaguaaauucuuagc

SEQ ID NO: 583383 - RNA, 11 nt, Homo sapiens
caaaguacaga

SEQ ID NO: 583384 - RNA, 20 nt, Homo sapiens
caaaguaccacacugaguuc

SEQ ID NO: 583385 - RNA, 17 nt, Homo sapiens
caaaguaccuugaacuc

SEQ ID NO: 583386 - RNA, 17 nt, Homo sapiens
caaaguacuugucauag

SEQ ID NO: 583387 - RNA, 16 nt, Homo sapiens
caaaguauauguucag

SEQ ID NO: 583388 - RNA, 14 nt, Homo sapiens
caaaguccaaaagu

SEQ ID NO: 583389 - RNA, 18 nt, Homo sapiens
caaaguccucugcuccag

SEQ ID NO: 583390 - RNA, 20 nt, Homo sapiens
caaaguccuuuuuuuccauc

SEQ ID NO: 583391 - RNA, 21 nt, Homo sapiens
caaagucgccagucacugcug

SEQ ID NO: 583392 - RNA, 16 nt, Homo sapiens
caaagugacuauucag

SEQ ID NO: 583393 - RNA, 12 nt, Homo sapiens
caaagugcaagg

SEQ ID NO: 583394 - RNA, 21 nt, Homo sapiens
caaagugccagagucuaggcu

SEQ ID NO: 583395 - RNA, 19 nt, Homo sapiens
caaagugcuaggauuacag

SEQ ID NO: 583396 - RNA, 18 nt, Homo sapiens
caaagugcugggauuaca

SEQ ID NO: 583397 - RNA, 22 nt, Homo sapiens
caaaguuaaaagccuaccuaag

SEQ ID NO: 583398 - RNA, 19 nt, Homo sapiens
caaaguucuucauaucauc

SEQ ID NO: 583399 - RNA, 20 nt, Homo sapiens
caaaguuugcucaaggagaa

SEQ ID NO: 583400 - RNA, 13 nt, Homo sapiens
caaauaaaagcca

SEQ ID NO: 583401 - RNA, 14 nt, Homo sapiens
caaauaaauggagu

SEQ ID NO: 583402 - RNA, 22 nt, Homo sapiens
caaauaaauguucaauggaugc

SEQ ID NO: 583403 - RNA, 13 nt, Homo sapiens
caaauaacagucu

SEQ ID NO: 583404 - RNA, 22 nt, Homo sapiens
caaauaagauauauaugugcuc

SEQ ID NO: 583405 - RNA, 16 nt, Homo sapiens
caaauaauccauucca

SEQ ID NO: 583406 - RNA, 19 nt, Homo sapiens
cgugcugcaugccuggucu

SEQ ID NO: 583407 - RNA, 22 nt, Homo sapiens
cguggacagucaggguucacuu

SEQ ID NO: 583408 - RNA, 17 nt, Homo sapiens
cguggacucauuucacu

SEQ ID NO: 583409 - RNA, 21 nt, Homo sapiens
cguggagacugagaucacuga

SEQ ID NO: 583410 - RNA, 13 nt, Homo sapiens
cguggcauuucaa

SEQ ID NO: 583411 - RNA, 15 nt, Homo sapiens
cguggcugcaggggu

SEQ ID NO: 583412 - RNA, 15 nt, Homo sapiens
cgugggaacaacugg

SEQ ID NO: 583413 - RNA, 13 nt, Homo sapiens
cgugggcucccug

SEQ ID NO: 583414 - RNA, 14 nt, Homo sapiens
cgugggggcacuga

SEQ ID NO: 583415 - RNA, 15 nt, Homo sapiens
cgugggggcacugac

SEQ ID NO: 583416 - RNA, 16 nt, Homo sapiens
cgugggggcacugacc

SEQ ID NO: 583417 - RNA, 22 nt, Homo sapiens
cgugggucacuacagggagaaa

SEQ ID NO: 583418 - RNA, 16 nt, Homo sapiens
cgugggucauuacaaa

SEQ ID NO: 583419 - RNA, 15 nt, Homo sapiens
cgugguagaagccag

SEQ ID NO: 583420 - RNA, 19 nt, Homo sapiens
cgugguaggacuguagaaa

SEQ ID NO: 583421 - RNA, 15 nt, Homo sapiens
cgugguauaaucucc

SEQ ID NO: 583422 - RNA, 12 nt, Homo sapiens
cguggucccuga

SEQ ID NO: 583423 - RNA, 22 nt, Homo sapiens
cguguaaauaauuuauuacaag

SEQ ID NO: 583424 - RNA, 20 nt, Homo sapiens
cguguaauuggcccaaguca

SEQ ID NO: 583425 - RNA, 22 nt, Homo sapiens
cgugucucgcgcgacugagaac

SEQ ID NO: 583426 - RNA, 14 nt, Homo sapiens
cgugugcgugcaug

SEQ ID NO: 583427 - RNA, 22 nt, Homo sapiens
cgugugcgugcaugugcacuug

SEQ ID NO: 583428 - RNA, 23 nt, Homo sapiens
cguguggcucacgugugugacuc

SEQ ID NO: 583429 - RNA, 14 nt, Homo sapiens
cguguguccaugug

SEQ ID NO: 583430 - RNA, 18 nt, Homo sapiens
cguguguguucacguguu

SEQ ID NO: 583431 - RNA, 20 nt, Homo sapiens
cguguuccccucuugucucc

SEQ ID NO: 583432 - RNA, 11 nt, Homo sapiens
cguguuugcuu

SEQ ID NO: 583433 - RNA, 17 nt, Homo sapiens
cguguuuggagcucuau

SEQ ID NO: 583434 - RNA, 22 nt, Homo sapiens
cguuaagggaaggaacucuggc

SEQ ID NO: 583435 - RNA, 18 nt, Homo sapiens
cguuagggugaagcauua

SEQ ID NO: 583436 - RNA, 17 nt, Homo sapiens
cguuauauuaaaacacu

SEQ ID NO: 583437 - RNA, 13 nt, Homo sapiens
cguucaccaguug

SEQ ID NO: 583438 - RNA, 20 nt, Homo sapiens
cguucaccuccaagcauuuc

SEQ ID NO: 583439 - RNA, 17 nt, Homo sapiens
cguuccaccccaagaga

SEQ ID NO: 583440 - RNA, 21 nt, Homo sapiens
cguucccaguguggcugaggc

SEQ ID NO: 583441 - RNA, 13 nt, Homo sapiens
cguuccuauuguc

SEQ ID NO: 583442 - RNA, 19 nt, Homo sapiens
cguuccuauugucauuaaa

SEQ ID NO: 583443 - RNA, 21 nt, Homo sapiens
cguugaauugaugaugcaguu

SEQ ID NO: 583444 - RNA, 23 nt, Homo sapiens
cguuggagagcagcaggugcugu

SEQ ID NO: 583445 - RNA, 22 nt, Homo sapiens
cguuggccggaggucaugauga

SEQ ID NO: 583446 - RNA, 16 nt, Homo sapiens
cguuggguuugcucau

SEQ ID NO: 583447 - RNA, 14 nt, Homo sapiens
cguugugcauuugg

SEQ ID NO: 583448 - RNA, 21 nt, Homo sapiens
cguuucauuuuuacaccaauu

SEQ ID NO: 583449 - RNA, 23 nt, Homo sapiens
cguuuccugagaagugucuaaaa

SEQ ID NO: 583450 - RNA, 16 nt, Homo sapiens
cguuugugcauaucug

SEQ ID NO: 583451 - RNA, 14 nt, Homo sapiens
cguuuuccaaagag

SEQ ID NO: 583452 - RNA, 19 nt, Homo sapiens
cguuuuuuuaaauuagcaa

SEQ ID NO: 583453 - RNA, 23 nt, Homo sapiens
cuaaaaaaaaaauccagccucau

SEQ ID NO: 583454 - RNA, 14 nt, Homo sapiens
cuaaaaaaaugcaa

SEQ ID NO: 583455 - RNA, 15 nt, Homo sapiens
cuaaaaagcaaaaau

SEQ ID NO: 583456 - RNA, 13 nt, Homo sapiens
cuaaaaauccaga

SEQ ID NO: 583457 - RNA, 18 nt, Homo sapiens
cuaaaaaugaaaauucua

SEQ ID NO: 583458 - RNA, 15 nt, Homo sapiens
cuaaaaaugcaacuu

SEQ ID NO: 583459 - RNA, 20 nt, Homo sapiens
cuaaaaauggcuaacugaug

SEQ ID NO: 583460 - RNA, 18 nt, Homo sapiens
cuaaaacaagaggacaca

SEQ ID NO: 583461 - RNA, 15 nt, Homo sapiens
cuaaaacugcugaac

SEQ ID NO: 583462 - RNA, 14 nt, Homo sapiens
cuaaaacuuaacau

SEQ ID NO: 583463 - RNA, 17 nt, Homo sapiens
cuaaaacuuaacauuca

SEQ ID NO: 583464 - RNA, 19 nt, Homo sapiens
cuaaaacuuggauggacuu

SEQ ID NO: 583465 - RNA, 18 nt, Homo sapiens
cuaaaagacaauuuuccu

SEQ ID NO: 583466 - RNA, 12 nt, Homo sapiens
cuaaaagauuau

SEQ ID NO: 583467 - RNA, 22 nt, Homo sapiens
cuaaaagcguuggauguagcau

SEQ ID NO: 583468 - RNA, 14 nt, Homo sapiens
cuaaaagcuuuaaa

SEQ ID NO: 583469 - RNA, 18 nt, Homo sapiens
cuaaaagcuuucaugucc

SEQ ID NO: 583470 - RNA, 16 nt, Homo sapiens
cuaaaagguaugcaau

SEQ ID NO: 583471 - RNA, 21 nt, Homo sapiens
cuaaaaggugaccaaugaugg

SEQ ID NO: 583472 - RNA, 18 nt, Homo sapiens
cuaaaagugggcuugauu

SEQ ID NO: 583473 - RNA, 21 nt, Homo sapiens
cuaaaaguuacuuaccacaga

SEQ ID NO: 583474 - RNA, 20 nt, Homo sapiens
cuaaaaucuguuaccauucu

SEQ ID NO: 583475 - RNA, 20 nt, Homo sapiens
cuaaaauggacgaaucuaua

SEQ ID NO: 583476 - RNA, 17 nt, Homo sapiens
cuaaaauuauggaaaca

SEQ ID NO: 583477 - RNA, 17 nt, Homo sapiens
cuaaaauucugauuuau

SEQ ID NO: 583478 - RNA, 16 nt, Homo sapiens
cuaaaauuuaaugcau

SEQ ID NO: 583479 - RNA, 14 nt, Homo sapiens
cuaaacaacccaga

SEQ ID NO: 583480 - RNA, 17 nt, Homo sapiens
cuaaacaacuaccuccu

SEQ ID NO: 583481 - RNA, 17 nt, Homo sapiens
cuaaacacaacaauaac

SEQ ID NO: 583482 - RNA, 12 nt, Homo sapiens
cuaaaccaaaaa

SEQ ID NO: 583483 - RNA, 16 nt, Homo sapiens
cuaaaccaacugaagg

SEQ ID NO: 583484 - RNA, 18 nt, Homo sapiens
cuaaaccaaggacugagc

SEQ ID NO: 583485 - RNA, 17 nt, Homo sapiens
cuaaaccacuucucugc

SEQ ID NO: 583486 - RNA, 20 nt, Homo sapiens
cuaaacccgcaccccagugc

SEQ ID NO: 583487 - RNA, 15 nt, Homo sapiens
cuaaaccuuacaugu

SEQ ID NO: 583488 - RNA, 19 nt, Homo sapiens
cuaaacgcaaugucauuuu

SEQ ID NO: 583489 - RNA, 16 nt, Homo sapiens
cuaaacggauuccaaa

SEQ ID NO: 583490 - RNA, 21 nt, Homo sapiens
cuaaacuacaacgaacacaag

SEQ ID NO: 583491 - RNA, 15 nt, Homo sapiens
cuaaacuacauuuua

SEQ ID NO: 583492 - RNA, 23 nt, Homo sapiens
cuaaacuccuuccuggccugaga

SEQ ID NO: 583493 - RNA, 13 nt, Homo sapiens
cuaaacugcgguc

SEQ ID NO: 583494 - RNA, 14 nt, Homo sapiens
cuaaacugguguuu

SEQ ID NO: 583495 - RNA, 18 nt, Homo sapiens
cuaaacuuuccaaaaccu

SEQ ID NO: 583496 - RNA, 16 nt, Homo sapiens
cuaaagaaaaaugccu

SEQ ID NO: 583497 - RNA, 19 nt, Homo sapiens
cuaaagagcugcacagcaa

SEQ ID NO: 583498 - RNA, 14 nt, Homo sapiens
cuaaagaguuuauu

SEQ ID NO: 583499 - RNA, 18 nt, Homo sapiens
cuaaagauugcagcauuu

SEQ ID NO: 583500 - RNA, 20 nt, Homo sapiens
caacacgccuaaaacucaaa

SEQ ID NO: 583501 - RNA, 11 nt, Homo sapiens
caacacuggaa

SEQ ID NO: 583502 - RNA, 22 nt, Homo sapiens
caacacugugcccugguggaga

SEQ ID NO: 583503 - RNA, 10 nt, Homo sapiens
caacacuuaa

SEQ ID NO: 583504 - RNA, 18 nt, Homo sapiens
caacagaaaccagaaaag

SEQ ID NO: 583505 - RNA, 22 nt, Homo sapiens
caacagaaguaucaagccaugu

SEQ ID NO: 583506 - RNA, 19 nt, Homo sapiens
caacagagcgagauuccau

SEQ ID NO: 583507 - RNA, 18 nt, Homo sapiens
caacagauccgacuuugg

SEQ ID NO: 583508 - RNA, 17 nt, Homo sapiens
caacagcaaaucacgac

SEQ ID NO: 583509 - RNA, 13 nt, Homo sapiens
caacagcagugau

SEQ ID NO: 583510 - RNA, 16 nt, Homo sapiens
caacagcauaacuaaa

SEQ ID NO: 583511 - RNA, 16 nt, Homo sapiens
caacagcgcuuuaaaa

SEQ ID NO: 583512 - RNA, 18 nt, Homo sapiens
caacagcucagagaugaa

SEQ ID NO: 583513 - RNA, 11 nt, Homo sapiens
caacaggaaau

SEQ ID NO: 583514 - RNA, 14 nt, Homo sapiens
caacaggaaggaac

SEQ ID NO: 583515 - RNA, 19 nt, Homo sapiens
caacaggcaggggcccacu

SEQ ID NO: 583516 - RNA, 23 nt, Homo sapiens
caacaggccauugugaaccaaug

SEQ ID NO: 583517 - RNA, 19 nt, Homo sapiens
caacaggcuuaugaauaua

SEQ ID NO: 583518 - RNA, 18 nt, Homo sapiens
caacagguaaaacagggc

SEQ ID NO: 583519 - RNA, 20 nt, Homo sapiens
caacauaacugaaggcauau

SEQ ID NO: 583520 - RNA, 13 nt, Homo sapiens
caacauagucaua

SEQ ID NO: 583521 - RNA, 22 nt, Homo sapiens
caacauagucauaaaauaguau

SEQ ID NO: 583522 - RNA, 16 nt, Homo sapiens
caacaucgcaauaguu

SEQ ID NO: 583523 - RNA, 16 nt, Homo sapiens
caacaucucgagcccc

SEQ ID NO: 583524 - RNA, 23 nt, Homo sapiens
caacaugaugugaaaacccaucu

SEQ ID NO: 583525 - RNA, 21 nt, Homo sapiens
caacaugguaaaaccccaucu

SEQ ID NO: 583526 - RNA, 20 nt, Homo sapiens
caacaugugacuaauuggaa

SEQ ID NO: 583527 - RNA, 15 nt, Homo sapiens
caacauguuauuugu

SEQ ID NO: 583528 - RNA, 15 nt, Homo sapiens
cccauaucuugccuu

SEQ ID NO: 583529 - RNA, 15 nt, Homo sapiens
cccaucaagugcagu

SEQ ID NO: 583530 - RNA, 16 nt, Homo sapiens
cccaucaagugcaguc

SEQ ID NO: 583531 - RNA, 20 nt, Homo sapiens
cccaucacugcgccacugcu

SEQ ID NO: 583532 - RNA, 16 nt, Homo sapiens
cccaucagccauuugc

SEQ ID NO: 583533 - RNA, 19 nt, Homo sapiens
cccaucagccuuguccuaa

SEQ ID NO: 583534 - RNA, 15 nt, Homo sapiens
cccaucccugucauu

SEQ ID NO: 583535 - RNA, 19 nt, Homo sapiens
cccaucgccccaccgcagc

SEQ ID NO: 583536 - RNA, 15 nt, Homo sapiens
cccaucucccugcuu

SEQ ID NO: 583537 - RNA, 16 nt, Homo sapiens
cccaucucccugcuuu

SEQ ID NO: 583538 - RNA, 22 nt, Homo sapiens
cccaucucuacaaaaauaaaga

SEQ ID NO: 583539 - RNA, 16 nt, Homo sapiens
cccaucucuacuaaaa

SEQ ID NO: 583540 - RNA, 13 nt, Homo sapiens
cccaucugggagu

SEQ ID NO: 583541 - RNA, 24 nt, Homo sapiens
cccaucuuggccucccagaguauu

SEQ ID NO: 583542 - RNA, 21 nt, Homo sapiens
cccaugaaucaaagacaugga

SEQ ID NO: 583543 - RNA, 12 nt, Homo sapiens
cccaugagauuc

SEQ ID NO: 583544 - RNA, 16 nt, Homo sapiens
cccaugaguccuugaa

SEQ ID NO: 583545 - RNA, 16 nt, Homo sapiens
cccaugcaggcccuuu

SEQ ID NO: 583546 - RNA, 13 nt, Homo sapiens
cccauggccacuu

SEQ ID NO: 583547 - RNA, 22 nt, Homo sapiens
cccauggcccccaauaaaggca

SEQ ID NO: 583548 - RNA, 21 nt, Homo sapiens
cccauggcuuuagcuaccuca

SEQ ID NO: 583549 - RNA, 17 nt, Homo sapiens
cccaugggaagggucca

SEQ ID NO: 583550 - RNA, 23 nt, Homo sapiens
cccaugggaucuugagggaccaa

SEQ ID NO: 583551 - RNA, 17 nt, Homo sapiens
cccaugggauugcacag

SEQ ID NO: 583552 - RNA, 21 nt, Homo sapiens
cccaugggggcugucuuugca

SEQ ID NO: 583553 - RNA, 23 nt, Homo sapiens
cccauguauuuaucucuauuuaa

SEQ ID NO: 583554 - RNA, 13 nt, Homo sapiens
cccauguguaggu

SEQ ID NO: 583555 - RNA, 20 nt, Homo sapiens
cccauguugaucuuucucaa

SEQ ID NO: 583556 - RNA, 19 nt, Homo sapiens
cccauucuacacagagcag

SEQ ID NO: 583557 - RNA, 19 nt, Homo sapiens
cccauucuuguucagauua

SEQ ID NO: 583558 - RNA, 19 nt, Homo sapiens
cccauugcugccaaggugg

SEQ ID NO: 583559 - RNA, 21 nt, Homo sapiens
cccauugcugccaagguggag

SEQ ID NO: 583560 - RNA, 21 nt, Homo sapiens
cccauuucaauuccugugauu

SEQ ID NO: 583561 - RNA, 13 nt, Homo sapiens
cccauuuccugau

SEQ ID NO: 583562 - RNA, 13 nt, Homo sapiens
cccauuuccugua

SEQ ID NO: 583563 - RNA, 15 nt, Homo sapiens
cccauuucuauuuau

SEQ ID NO: 583564 - RNA, 22 nt, Homo sapiens
cccauuugcuuacuuugcauuu

SEQ ID NO: 583565 - RNA, 23 nt, Homo sapiens
cccauuugugaucagcauuguga

SEQ ID NO: 583566 - RNA, 21 nt, Homo sapiens
cccauuuucaacugcuuugaa

SEQ ID NO: 583567 - RNA, 14 nt, Homo sapiens
cccauuuugcaaaa

SEQ ID NO: 583568 - RNA, 20 nt, Homo sapiens
cccauuuuugcuuagcucaa

SEQ ID NO: 583569 - RNA, 22 nt, Homo sapiens
ccccaaaccuggcaagucaccu

SEQ ID NO: 583570 - RNA, 13 nt, Homo sapiens
ccccaaagaucuc

SEQ ID NO: 583571 - RNA, 16 nt, Homo sapiens
ccccaacaugcacuga

SEQ ID NO: 583572 - RNA, 17 nt, Homo sapiens
ccccaacaugcacugau

SEQ ID NO: 583573 - RNA, 12 nt, Homo sapiens
ccccaagaauga

SEQ ID NO: 583574 - RNA, 19 nt, Homo sapiens
ccccaagcagccagccagu

SEQ ID NO: 583575 - RNA, 20 nt, Homo sapiens
ccccaaggacugagggcagu

SEQ ID NO: 583576 - RNA, 18 nt, Homo sapiens
ccccaauaaaggcagcug

SEQ ID NO: 583577 - RNA, 22 nt, Homo sapiens
ccccaccaaugggccuccagag

SEQ ID NO: 583578 - RNA, 15 nt, Homo sapiens
ccccaccacauagca

SEQ ID NO: 583579 - RNA, 16 nt, Homo sapiens
ccccaccaccacuuac

SEQ ID NO: 583580 - RNA, 13 nt, Homo sapiens
ccccaccacugau

SEQ ID NO: 583581 - RNA, 11 nt, Homo sapiens
ccccaccagca

SEQ ID NO: 583582 - RNA, 19 nt, Homo sapiens
ccccaccauccagguggag

SEQ ID NO: 583583 - RNA, 15 nt, Homo sapiens
ccccaccccaguggg

SEQ ID NO: 583584 - RNA, 17 nt, Homo sapiens
ccccacccccagugcag

SEQ ID NO: 583585 - RNA, 20 nt, Homo sapiens
ccccacccuggccuagacca

SEQ ID NO: 583586 - RNA, 13 nt, Homo sapiens
ccccaccuucaau

SEQ ID NO: 583587 - RNA, 21 nt, Homo sapiens
ccccaccuuugggaucagccu

SEQ ID NO: 583588 - RNA, 23 nt, Homo sapiens
ccccacgagggucaggacuguga

SEQ ID NO: 583589 - RNA, 14 nt, Homo sapiens
ccccacgcugacca

SEQ ID NO: 583590 - RNA, 18 nt, Homo sapiens
ccccacuaggcacugugg

SEQ ID NO: 583591 - RNA, 11 nt, Homo sapiens
ccccacuccag

SEQ ID NO: 583592 - RNA, 14 nt, Homo sapiens
ccccacugcucucu

SEQ ID NO: 583593 - RNA, 16 nt, Homo sapiens
ccccacugcugagcug

SEQ ID NO: 583594 - RNA, 12 nt, Homo sapiens
ccccacuuugaa

SEQ ID NO: 583595 - RNA, 22 nt, Homo sapiens
ccccagaaaaaggccgggugac

SEQ ID NO: 583596 - RNA, 18 nt, Homo sapiens
ccccagaaagcugccaga

SEQ ID NO: 583597 - RNA, 15 nt, Homo sapiens
ccccagacucaagau

SEQ ID NO: 583598 - RNA, 17 nt, Homo sapiens
ccccagagcaggagcuu

SEQ ID NO: 583599 - RNA, 14 nt, Homo sapiens
ccccagagcucuuu

SEQ ID NO: 583600 - RNA, 19 nt, Homo sapiens
ccccagaggcucagcacuu

SEQ ID NO: 583601 - RNA, 11 nt, Homo sapiens
ccccagcacuu

SEQ ID NO: 583602 - RNA, 17 nt, Homo sapiens
ccccagcccuaaucuca

SEQ ID NO: 583603 - RNA, 14 nt, Homo sapiens
ccccagcucuggau

SEQ ID NO: 583604 - RNA, 12 nt, Homo sapiens
ccccagcuuucu

SEQ ID NO: 583605 - RNA, 15 nt, Homo sapiens
ccccaggaacaauaa

SEQ ID NO: 583606 - RNA, 20 nt, Homo sapiens
ccccaggcaaggaugucuga

SEQ ID NO: 583607 - RNA, 22 nt, Homo sapiens
ccccaggcaucuguuagcagag

SEQ ID NO: 583608 - RNA, 19 nt, Homo sapiens
ccccaggcuggagugcagu

SEQ ID NO: 583609 - RNA, 12 nt, Homo sapiens
ccccagucccag

SEQ ID NO: 583610 - RNA, 16 nt, Homo sapiens
ccccaguucagucugu

SEQ ID NO: 583611 - RNA, 15 nt, Homo sapiens
ccccaguucugcucc

SEQ ID NO: 583612 - RNA, 15 nt, Homo sapiens
ccccaugccugucca

SEQ ID NO: 583613 - RNA, 21 nt, Homo sapiens
ccccauggcuuguucucugga

SEQ ID NO: 583614 - RNA, 23 nt, Homo sapiens
ccccauggguuuugcuuaggcac

SEQ ID NO: 583615 - RNA, 22 nt, Homo sapiens
ccccauucucugccuguacuga

SEQ ID NO: 583616 - RNA, 21 nt, Homo sapiens
ccccauuuccuguacaaucau

SEQ ID NO: 583617 - RNA, 17 nt, Homo sapiens
cccccaaaguucacaau

SEQ ID NO: 583618 - RNA, 18 nt, Homo sapiens
cccccaacccccugcaag

SEQ ID NO: 583619 - RNA, 17 nt, Homo sapiens
cccccaaugucuucaag

SEQ ID NO: 583620 - RNA, 23 nt, Homo sapiens
cccccacccgggagcaguguccu

SEQ ID NO: 583621 - RNA, 15 nt, Homo sapiens
cccccaccuuuggga

SEQ ID NO: 583622 - RNA, 14 nt, Homo sapiens
cccccagagcucuu

SEQ ID NO: 583623 - RNA, 20 nt, Homo sapiens
cccccagccuggccagacaa

SEQ ID NO: 583624 - RNA, 15 nt, Homo sapiens
cccccaguccucacu

SEQ ID NO: 583625 - RNA, 19 nt, Homo sapiens
cccccaucuuuacaaagaa

SEQ ID NO: 583626 - RNA, 14 nt, Homo sapiens
cccccaugcugccu

SEQ ID NO: 583627 - RNA, 17 nt, Homo sapiens
ccccccaacuccaggaa

SEQ ID NO: 583628 - RNA, 19 nt, Homo sapiens
ccccccagccuccagagaa

SEQ ID NO: 583629 - RNA, 23 nt, Homo sapiens
cccccucaaaccuccucuucuga

SEQ ID NO: 583630 - RNA, 18 nt, Homo sapiens
cccccucccagacaggcc

SEQ ID NO: 583631 - RNA, 13 nt, Homo sapiens
cccccugcaagaa

SEQ ID NO: 583632 - RNA, 22 nt, Homo sapiens
cccccuggaagcugauucacua

SEQ ID NO: 583633 - RNA, 20 nt, Homo sapiens
cccccugggcuggggccuca

SEQ ID NO: 583634 - RNA, 14 nt, Homo sapiens
cccccuucagugcc

SEQ ID NO: 583635 - RNA, 17 nt, Homo sapiens
cccccuuuggcacugga

SEQ ID NO: 583636 - RNA, 12 nt, Homo sapiens
ccccgacuuccu

SEQ ID NO: 583637 - RNA, 12 nt, Homo sapiens
ccccgagcucag

SEQ ID NO: 583638 - RNA, 19 nt, Homo sapiens
ccccgccuccacucuaguu

SEQ ID NO: 583639 - RNA, 23 nt, Homo sapiens
ccccgccugagucagugcucuca

SEQ ID NO: 583640 - RNA, 16 nt, Homo sapiens
ccccgccuuccugggc

SEQ ID NO: 583641 - RNA, 17 nt, Homo sapiens
ccccggggugcccacag

SEQ ID NO: 583642 - RNA, 14 nt, Homo sapiens
ccccguaccaccau

SEQ ID NO: 583643 - RNA, 19 nt, Homo sapiens
ccccuaaaaagauugccaa

SEQ ID NO: 583644 - RNA, 16 nt, Homo sapiens
ccccuaaaccaacuga

SEQ ID NO: 583645 - RNA, 14 nt, Homo sapiens
ccccuaagagccau

SEQ ID NO: 583646 - RNA, 15 nt, Homo sapiens
ccccuacugcuguga

SEQ ID NO: 583647 - RNA, 19 nt, Homo sapiens
ccccuagaauaaucucauc

SEQ ID NO: 583648 - RNA, 22 nt, Homo sapiens
ccccuagugcuauucuguguug

SEQ ID NO: 583649 - RNA, 22 nt, Homo sapiens
ccccucagagcucuuaugugga

SEQ ID NO: 583650 - RNA, 16 nt, Homo sapiens
ccccucagauuccacc

SEQ ID NO: 583651 - RNA, 22 nt, Homo sapiens
auguuccagugaggaacccuga

SEQ ID NO: 583652 - RNA, 17 nt, Homo sapiens
auguucccccuguuuca

SEQ ID NO: 583653 - RNA, 21 nt, Homo sapiens
auguuccucccaggguuucca

SEQ ID NO: 583654 - RNA, 19 nt, Homo sapiens
auguuccugaaaauugcaa

SEQ ID NO: 583655 - RNA, 13 nt, Homo sapiens
auguucugcuuuc

SEQ ID NO: 583656 - RNA, 19 nt, Homo sapiens
auguucuuggaacauggaa

SEQ ID NO: 583657 - RNA, 13 nt, Homo sapiens
auguucuuuggaa

SEQ ID NO: 583658 - RNA, 21 nt, Homo sapiens
auguucuuuuccaacacaucu

SEQ ID NO: 583659 - RNA, 22 nt, Homo sapiens
auguugauacuagcauacuuaa

SEQ ID NO: 583660 - RNA, 14 nt, Homo sapiens
auguugcacaauga

SEQ ID NO: 583661 - RNA, 16 nt, Homo sapiens
auguugcaucccugaa

SEQ ID NO: 583662 - RNA, 15 nt, Homo sapiens
auguugccuuuaugg

SEQ ID NO: 583663 - RNA, 12 nt, Homo sapiens
auguugcuuaga

SEQ ID NO: 583664 - RNA, 23 nt, Homo sapiens
auguugcuuucuuaucccaguga

SEQ ID NO: 583665 - RNA, 21 nt, Homo sapiens
auguuggaugaugaaacauuc

SEQ ID NO: 583666 - RNA, 23 nt, Homo sapiens
auguuggaugaugaaacauucau

SEQ ID NO: 583667 - RNA, 18 nt, Homo sapiens
auguugggaaacuuggcu

SEQ ID NO: 583668 - RNA, 13 nt, Homo sapiens
auguuggucaaaa

SEQ ID NO: 583669 - RNA, 23 nt, Homo sapiens
auguugguguuccacguguuuua

SEQ ID NO: 583670 - RNA, 16 nt, Homo sapiens
auguuguaaugcugca

SEQ ID NO: 583671 - RNA, 21 nt, Homo sapiens
auguuguguuuuuaacauguc

SEQ ID NO: 583672 - RNA, 21 nt, Homo sapiens
auguuguuccuuuugaaagaa

SEQ ID NO: 583673 - RNA, 17 nt, Homo sapiens
auguuguuuuaggggcu

SEQ ID NO: 583674 - RNA, 16 nt, Homo sapiens
auguuuaaauagccua

SEQ ID NO: 583675 - RNA, 18 nt, Homo sapiens
auguuuaaauagccuaaa

SEQ ID NO: 583676 - RNA, 18 nt, Homo sapiens
auguuuacagacugugag

SEQ ID NO: 583677 - RNA, 15 nt, Homo sapiens
auguuuagauuccag

SEQ ID NO: 583678 - RNA, 18 nt, Homo sapiens
auguuuauuuagcucuga

SEQ ID NO: 583679 - RNA, 19 nt, Homo sapiens
auguuuauuuuucuugucu

SEQ ID NO: 583680 - RNA, 15 nt, Homo sapiens
auguuucaaauacuu

SEQ ID NO: 583681 - RNA, 13 nt, Homo sapiens
auguuucuauucu

SEQ ID NO: 583682 - RNA, 15 nt, Homo sapiens
auguuugaaugauuu

SEQ ID NO: 583683 - RNA, 15 nt, Homo sapiens
auguuugcaaacuug

SEQ ID NO: 583684 - RNA, 12 nt, Homo sapiens
auguuugcacac

SEQ ID NO: 583685 - RNA, 18 nt, Homo sapiens
auguuugcacacuugugu

SEQ ID NO: 583686 - RNA, 18 nt, Homo sapiens
auguuugcacuugugcuu

SEQ ID NO: 583687 - RNA, 15 nt, Homo sapiens
auguuugccaugagu

SEQ ID NO: 583688 - RNA, 17 nt, Homo sapiens
auguuugcuauugacaa

SEQ ID NO: 583689 - RNA, 22 nt, Homo sapiens
auguuugcuauugacaagucau

SEQ ID NO: 583690 - RNA, 18 nt, Homo sapiens
auguuuguaagacuuaca

SEQ ID NO: 583691 - RNA, 17 nt, Homo sapiens
auguuugucucauccca

SEQ ID NO: 583692 - RNA, 20 nt, Homo sapiens
auguuuguuauuuacacugg

SEQ ID NO: 583693 - RNA, 15 nt, Homo sapiens
auguuuuauuuugcc

SEQ ID NO: 583694 - RNA, 13 nt, Homo sapiens
auguuuucuaauu

SEQ ID NO: 583695 - RNA, 14 nt, Homo sapiens
auguuuucuaguca

SEQ ID NO: 583696 - RNA, 22 nt, Homo sapiens
auguuuugcuuaaacuaaugaa

SEQ ID NO: 583697 - RNA, 19 nt, Homo sapiens
auguuuuuggggacacuga

SEQ ID NO: 583698 - RNA, 21 nt, Homo sapiens
auguuuuuuaaacuaguuuau

SEQ ID NO: 583699 - RNA, 21 nt, Homo sapiens
auguuuuuugccacagcuuuu

SEQ ID NO: 583700 - RNA, 13 nt, Homo sapiens
auuaaaacaaauc

SEQ ID NO: 583701 - RNA, 16 nt, Homo sapiens
cccggggugaguccau

SEQ ID NO: 583702 - RNA, 18 nt, Homo sapiens
cccgucgaggggcucuca

SEQ ID NO: 583703 - RNA, 21 nt, Homo sapiens
cccgucucuacuaaaaauaca

SEQ ID NO: 583704 - RNA, 13 nt, Homo sapiens
cccgugccaaaaa

SEQ ID NO: 583705 - RNA, 18 nt, Homo sapiens
cccguggagguucuguau

SEQ ID NO: 583706 - RNA, 19 nt, Homo sapiens
cccguggccuggcaucugu

SEQ ID NO: 583707 - RNA, 22 nt, Homo sapiens
cccguuucuuaaaaaacauaua

SEQ ID NO: 583708 - RNA, 18 nt, Homo sapiens
cccuaaaaagauugccaa

SEQ ID NO: 583709 - RNA, 17 nt, Homo sapiens
cccuaaaagcacacuca

SEQ ID NO: 583710 - RNA, 15 nt, Homo sapiens
cccuaaaccaaaaac

SEQ ID NO: 583711 - RNA, 21 nt, Homo sapiens
cccuaaaccaaaaacugaaag

SEQ ID NO: 583712 - RNA, 15 nt, Homo sapiens
cccuaacuucuguaa

SEQ ID NO: 583713 - RNA, 16 nt, Homo sapiens
cccuaaucacaugugc

SEQ ID NO: 583714 - RNA, 14 nt, Homo sapiens
cccuacaaugcuca

SEQ ID NO: 583715 - RNA, 13 nt, Homo sapiens
cccuacacuguga

SEQ ID NO: 583716 - RNA, 17 nt, Homo sapiens
cccuaccaaaaauugcc

SEQ ID NO: 583717 - RNA, 21 nt, Homo sapiens
cccuacuuucuggaaguggag

SEQ ID NO: 583718 - RNA, 15 nt, Homo sapiens
cccuagaucaacaga

SEQ ID NO: 583719 - RNA, 18 nt, Homo sapiens
cccuagaucaacagauca

SEQ ID NO: 583720 - RNA, 16 nt, Homo sapiens
cccuagaugcacgugg

SEQ ID NO: 583721 - RNA, 17 nt, Homo sapiens
cccuagcauugcacuug

SEQ ID NO: 583722 - RNA, 19 nt, Homo sapiens
cccuagccuugcuuguuaa

SEQ ID NO: 583723 - RNA, 20 nt, Homo sapiens
cccuaggauaaaaagccagg

SEQ ID NO: 583724 - RNA, 17 nt, Homo sapiens
cccuaggggacacuucc

SEQ ID NO: 583725 - RNA, 21 nt, Homo sapiens
cccuauugcugcuugaggcaa

SEQ ID NO: 583726 - RNA, 17 nt, Homo sapiens
cccuauuuauugacuuu

SEQ ID NO: 583727 - RNA, 14 nt, Homo sapiens
cccucaaaucugag

SEQ ID NO: 583728 - RNA, 19 nt, Homo sapiens
cccucaacccuugagauga

SEQ ID NO: 583729 - RNA, 13 nt, Homo sapiens
cccucaagcaaua

SEQ ID NO: 583730 - RNA, 17 nt, Homo sapiens
cccucacacacacagcu

SEQ ID NO: 583731 - RNA, 20 nt, Homo sapiens
cccucaccugggcaccuggg

SEQ ID NO: 583732 - RNA, 14 nt, Homo sapiens
cccucagacauccc

SEQ ID NO: 583733 - RNA, 17 nt, Homo sapiens
cccucagagugcaagcc

SEQ ID NO: 583734 - RNA, 17 nt, Homo sapiens
cccucagauuccaccua

SEQ ID NO: 583735 - RNA, 17 nt, Homo sapiens
cccucagauuuccauug

SEQ ID NO: 583736 - RNA, 16 nt, Homo sapiens
cccucagcccuggccu

SEQ ID NO: 583737 - RNA, 11 nt, Homo sapiens
cccucagggau

SEQ ID NO: 583738 - RNA, 18 nt, Homo sapiens
cccucauccuuuacauuu

SEQ ID NO: 583739 - RNA, 13 nt, Homo sapiens
cccucaugaaaac

SEQ ID NO: 583740 - RNA, 16 nt, Homo sapiens
cccucauucaucuugc

SEQ ID NO: 583741 - RNA, 10 nt, Homo sapiens
cccuccaaaa

SEQ ID NO: 583742 - RNA, 11 nt, Homo sapiens
cccuccaaaga

SEQ ID NO: 583743 - RNA, 14 nt, Homo sapiens
cccuccaagccugg

SEQ ID NO: 583744 - RNA, 14 nt, Homo sapiens
cccuccacauccca

SEQ ID NO: 583745 - RNA, 15 nt, Homo sapiens
cccuccacccaucca

SEQ ID NO: 583746 - RNA, 14 nt, Homo sapiens
cccuccacccccau

SEQ ID NO: 583747 - RNA, 22 nt, Homo sapiens
cccuccacucacugcugugagu

SEQ ID NO: 583748 - RNA, 14 nt, Homo sapiens
cccuccaguccucu

SEQ ID NO: 583749 - RNA, 12 nt, Homo sapiens
cccuccaucccc

SEQ ID NO: 583750 - RNA, 13 nt, Homo sapiens
cccucccaacagc

SEQ ID NO: 583751 - RNA, 15 nt, Homo sapiens
cccucccacggugcc

SEQ ID NO: 583752 - RNA, 15 nt, Homo sapiens
cccuccccagagcac

SEQ ID NO: 583753 - RNA, 16 nt, Homo sapiens
cccuccccagauauca

SEQ ID NO: 583754 - RNA, 17 nt, Homo sapiens
cccucccccagcuccuu

SEQ ID NO: 583755 - RNA, 14 nt, Homo sapiens
cccuccgaccacuu

SEQ ID NO: 583756 - RNA, 13 nt, Homo sapiens
cccuccgccaugg

SEQ ID NO: 583757 - RNA, 14 nt, Homo sapiens
cccuccugagggag

SEQ ID NO: 583758 - RNA, 22 nt, Homo sapiens
cccuccugcccaggacugcauu

SEQ ID NO: 583759 - RNA, 13 nt, Homo sapiens
cccuccugcuccu

SEQ ID NO: 583760 - RNA, 13 nt, Homo sapiens
cccucgacacuca

SEQ ID NO: 583761 - RNA, 19 nt, Homo sapiens
cccucgcaugacuguuaca

SEQ ID NO: 583762 - RNA, 23 nt, Homo sapiens
cccucggagcuggcugugccugc

SEQ ID NO: 583763 - RNA, 19 nt, Homo sapiens
cccucggcucuggaggcaa

SEQ ID NO: 583764 - RNA, 17 nt, Homo sapiens
cccucgucccauccagc

SEQ ID NO: 583765 - RNA, 21 nt, Homo sapiens
cccucguugcccagcacuguc

SEQ ID NO: 583766 - RNA, 17 nt, Homo sapiens
cccucuaccuccuggag

SEQ ID NO: 583767 - RNA, 19 nt, Homo sapiens
cccucuagaaauuuuucag

SEQ ID NO: 583768 - RNA, 14 nt, Homo sapiens
cccucucacuccag

SEQ ID NO: 583769 - RNA, 22 nt, Homo sapiens
cccucucccagggaugcucuuu

SEQ ID NO: 583770 - RNA, 17 nt, Homo sapiens
cccucucccgccagacu

SEQ ID NO: 583771 - RNA, 21 nt, Homo sapiens
cccucuccugcccaagcacuu

SEQ ID NO: 583772 - RNA, 21 nt, Homo sapiens
cccucuccugcccagaugccc

SEQ ID NO: 583773 - RNA, 21 nt, Homo sapiens
cccucuccuucuccuagcucu

SEQ ID NO: 583774 - RNA, 22 nt, Homo sapiens
cccucugaguuuuuguauguau

SEQ ID NO: 583775 - RNA, 11 nt, Homo sapiens
cccucuggaaa

SEQ ID NO: 583776 - RNA, 21 nt, Homo sapiens
cccucuguaacaacucuaguc

SEQ ID NO: 583777 - RNA, 15 nt, Homo sapiens
cccucugucuuguga

SEQ ID NO: 583778 - RNA, 18 nt, Homo sapiens
cccucuuaguagggacuu

SEQ ID NO: 583779 - RNA, 12 nt, Homo sapiens
cccucuugccag

SEQ ID NO: 583780 - RNA, 17 nt, Homo sapiens
cccucuuucacuucaua

SEQ ID NO: 583781 - RNA, 15 nt, Homo sapiens
cccugaaacaucuca

SEQ ID NO: 583782 - RNA, 13 nt, Homo sapiens
cccugaaagccau

SEQ ID NO: 583783 - RNA, 15 nt, Homo sapiens
cccugaaauuucuca

SEQ ID NO: 583784 - RNA, 13 nt, Homo sapiens
cccugaauucuuc

SEQ ID NO: 583785 - RNA, 21 nt, Homo sapiens
cccugacagggccagugcagu

SEQ ID NO: 583786 - RNA, 15 nt, Homo sapiens
cccugacauuuaguu

SEQ ID NO: 583787 - RNA, 13 nt, Homo sapiens
cccugacauuucu

SEQ ID NO: 583788 - RNA, 16 nt, Homo sapiens
cccugacucuuagccc

SEQ ID NO: 583789 - RNA, 17 nt, Homo sapiens
cccugacuggccaaacc

SEQ ID NO: 583790 - RNA, 17 nt, Homo sapiens
cccugacuucuggagau

SEQ ID NO: 583791 - RNA, 19 nt, Homo sapiens
cccugagauucagauguca

SEQ ID NO: 583792 - RNA, 15 nt, Homo sapiens
cccugagcaaugucu

SEQ ID NO: 583793 - RNA, 19 nt, Homo sapiens
cccugagcagaauacuggu

SEQ ID NO: 583794 - RNA, 16 nt, Homo sapiens
cccugagcauucuugg

SEQ ID NO: 583795 - RNA, 14 nt, Homo sapiens
cccugaucaaguca

SEQ ID NO: 583796 - RNA, 16 nt, Homo sapiens
cccugaugcagccugu

SEQ ID NO: 583797 - RNA, 13 nt, Homo sapiens
cccugaugcucca

SEQ ID NO: 583798 - RNA, 15 nt, Homo sapiens
cccugaugugacauu

SEQ ID NO: 583799 - RNA, 15 nt, Homo sapiens
cccugauugaccugc

SEQ ID NO: 583800 - RNA, 21 nt, Homo sapiens
cccugcaaagcccagcuugaa

SEQ ID NO: 583801 - RNA, 13 nt, Homo sapiens
cccugcaaccaac

SEQ ID NO: 583802 - RNA, 17 nt, Homo sapiens
cccugcacaggcacaca

SEQ ID NO: 583803 - RNA, 17 nt, Homo sapiens
cccugcacuaaagccag

SEQ ID NO: 583804 - RNA, 15 nt, Homo sapiens
cccugcacuaggcag

SEQ ID NO: 583805 - RNA, 16 nt, Homo sapiens
cccugcagagcaauaa

SEQ ID NO: 583806 - RNA, 17 nt, Homo sapiens
cccugcaguuugagaca

SEQ ID NO: 583807 - RNA, 12 nt, Homo sapiens
cccugcauuuau

SEQ ID NO: 583808 - RNA, 14 nt, Homo sapiens
cccugccacucuca

SEQ ID NO: 583809 - RNA, 15 nt, Homo sapiens
cccugccauuuacca

SEQ ID NO: 583810 - RNA, 15 nt, Homo sapiens
cccugcccaccaaga

SEQ ID NO: 583811 - RNA, 17 nt, Homo sapiens
cccugccccguggagcc

SEQ ID NO: 583812 - RNA, 22 nt, Homo sapiens
cccugccccuggugcccugaga

SEQ ID NO: 583813 - RNA, 22 nt, Homo sapiens
cccugcccuucccccugcaaaa

SEQ ID NO: 583814 - RNA, 15 nt, Homo sapiens
cccugcccuuggcac

SEQ ID NO: 583815 - RNA, 23 nt, Homo sapiens
cccugccgucaccaccaccccua

SEQ ID NO: 583816 - RNA, 11 nt, Homo sapiens
cccugccugag

SEQ ID NO: 583817 - RNA, 14 nt, Homo sapiens
cccugccugagggu

SEQ ID NO: 583818 - RNA, 19 nt, Homo sapiens
cccugcgcuucaucucaug

SEQ ID NO: 583819 - RNA, 15 nt, Homo sapiens
cccugcucagugcuu

SEQ ID NO: 583820 - RNA, 20 nt, Homo sapiens
cccugcuccacgaagccuua

SEQ ID NO: 583821 - RNA, 13 nt, Homo sapiens
cccugcucccaca

SEQ ID NO: 583822 - RNA, 16 nt, Homo sapiens
cccugcucccauuccu

SEQ ID NO: 583823 - RNA, 19 nt, Homo sapiens
cccugcuccucccuggcug

SEQ ID NO: 583824 - RNA, 14 nt, Homo sapiens
cccugcugaccucc

SEQ ID NO: 583825 - RNA, 22 nt, Homo sapiens
cccugcugaccucccagugacc

SEQ ID NO: 583826 - RNA, 21 nt, Homo sapiens
cccugcugccacagcaaggaa

SEQ ID NO: 583827 - RNA, 13 nt, Homo sapiens
cccugcuugcaca

SEQ ID NO: 583828 - RNA, 16 nt, Homo sapiens
cccugcuugcacuuug

SEQ ID NO: 583829 - RNA, 13 nt, Homo sapiens
cccuggaagcuua

SEQ ID NO: 583830 - RNA, 18 nt, Homo sapiens
cccuggaccuugggccua

SEQ ID NO: 583831 - RNA, 21 nt, Homo sapiens
cccuggaugugaagcucacac

SEQ ID NO: 583832 - RNA, 15 nt, Homo sapiens
cccuggcagcugccc

SEQ ID NO: 583833 - RNA, 13 nt, Homo sapiens
cccuggcaggcag

SEQ ID NO: 583834 - RNA, 16 nt, Homo sapiens
cccuggccgaguccaa

SEQ ID NO: 583835 - RNA, 15 nt, Homo sapiens
cccugggaagccugu

SEQ ID NO: 583836 - RNA, 14 nt, Homo sapiens
cccugggaccacag

SEQ ID NO: 583837 - RNA, 20 nt, Homo sapiens
cccugggaugccucaccaca

SEQ ID NO: 583838 - RNA, 16 nt, Homo sapiens
cccugggccucagugu

SEQ ID NO: 583839 - RNA, 16 nt, Homo sapiens
cccugggcuggacugg

SEQ ID NO: 583840 - RNA, 20 nt, Homo sapiens
cccuggggagucugggcaca

SEQ ID NO: 583841 - RNA, 21 nt, Homo sapiens
cccuggggcuucuccugaccc

SEQ ID NO: 583842 - RNA, 22 nt, Homo sapiens
cccugguggagaaagcacugac

SEQ ID NO: 583843 - RNA, 14 nt, Homo sapiens
cccuggugguggau

SEQ ID NO: 583844 - RNA, 18 nt, Homo sapiens
cccuguaguugacaauuc

SEQ ID NO: 583845 - RNA, 19 nt, Homo sapiens
cccuguaguugacaauucu

SEQ ID NO: 583846 - RNA, 13 nt, Homo sapiens
cccugucauccag

SEQ ID NO: 583847 - RNA, 17 nt, Homo sapiens
cccugucauccagcuca

SEQ ID NO: 583848 - RNA, 20 nt, Homo sapiens
cccuguccugcagucccaca

SEQ ID NO: 583849 - RNA, 18 nt, Homo sapiens
cccugucucuacuaaaaa

SEQ ID NO: 583850 - RNA, 23 nt, Homo sapiens
cccugucuggugccccuuugccc

SEQ ID NO: 583851 - RNA, 12 nt, Homo sapiens
cccugugccugg

SEQ ID NO: 583852 - RNA, 21 nt, Homo sapiens
cccuguggccaacugcaaaaa

SEQ ID NO: 583853 - RNA, 18 nt, Homo sapiens
cccugugucugcuguaga

SEQ ID NO: 583854 - RNA, 23 nt, Homo sapiens
cccuguguggucuccaugcucac

SEQ ID NO: 583855 - RNA, 21 nt, Homo sapiens
cccuguguguuugacauguga

SEQ ID NO: 583856 - RNA, 19 nt, Homo sapiens
cccuguuucucuugaagaa

SEQ ID NO: 583857 - RNA, 22 nt, Homo sapiens
cccuguuuuaauucaacccagc

SEQ ID NO: 583858 - RNA, 23 nt, Homo sapiens
cccuguuuucugagcccgggcug

SEQ ID NO: 583859 - RNA, 17 nt, Homo sapiens
cccuuaacugcauccag

SEQ ID NO: 583860 - RNA, 11 nt, Homo sapiens
cccuuacacaa

SEQ ID NO: 583861 - RNA, 22 nt, Homo sapiens
cccuuacagagcauacaacaga

SEQ ID NO: 583862 - RNA, 17 nt, Homo sapiens
cccuuagccucccugaa

SEQ ID NO: 583863 - RNA, 19 nt, Homo sapiens
cccuuaguuuccacugccu

SEQ ID NO: 583864 - RNA, 13 nt, Homo sapiens
cccuucacaaagc

SEQ ID NO: 583865 - RNA, 17 nt, Homo sapiens
cccuucacauacccucc

SEQ ID NO: 583866 - RNA, 20 nt, Homo sapiens
cccuucaguacccucucagc

SEQ ID NO: 583867 - RNA, 20 nt, Homo sapiens
cccuucauccgccugugggc

SEQ ID NO: 583868 - RNA, 23 nt, Homo sapiens
cccuucaucuuccuguguccuga

SEQ ID NO: 583869 - RNA, 22 nt, Homo sapiens
cccuuccaggugggugugggac

SEQ ID NO: 583870 - RNA, 13 nt, Homo sapiens
cccuuccaguggg

SEQ ID NO: 583871 - RNA, 15 nt, Homo sapiens
cccuucccacacugu

SEQ ID NO: 583872 - RNA, 18 nt, Homo sapiens
cccuucccccugcaaaaa

SEQ ID NO: 583873 - RNA, 21 nt, Homo sapiens
cccuucccugcacuaaagcca

SEQ ID NO: 583874 - RNA, 18 nt, Homo sapiens
cccuuccuaagucuguca

SEQ ID NO: 583875 - RNA, 21 nt, Homo sapiens
cccuuccucagaacuuucuag

SEQ ID NO: 583876 - RNA, 23 nt, Homo sapiens
cccuuccugcauuucucuucuca

SEQ ID NO: 583877 - RNA, 22 nt, Homo sapiens
cccuuccuggaaacagcaugaa

SEQ ID NO: 583878 - RNA, 15 nt, Homo sapiens
cccuuccuguuucag

SEQ ID NO: 583879 - RNA, 14 nt, Homo sapiens
cccuucguguuucc

SEQ ID NO: 583880 - RNA, 13 nt, Homo sapiens
cccuugaagcaau

SEQ ID NO: 583881 - RNA, 13 nt, Homo sapiens
cccuugcagcuag

SEQ ID NO: 583882 - RNA, 13 nt, Homo sapiens
cccuugcugcuuu

SEQ ID NO: 583883 - RNA, 22 nt, Homo sapiens
cccuugcuguaugcugaucauc

SEQ ID NO: 583884 - RNA, 18 nt, Homo sapiens
cccuugcuuguugggauu

SEQ ID NO: 583885 - RNA, 22 nt, Homo sapiens
cccuuggaauaaaaacauuucu

SEQ ID NO: 583886 - RNA, 23 nt, Homo sapiens
cccuuggagagagaggcugccuc

SEQ ID NO: 583887 - RNA, 14 nt, Homo sapiens
cccuuggagcugcc

SEQ ID NO: 583888 - RNA, 19 nt, Homo sapiens
cccuuggcaguguggcagu

SEQ ID NO: 583889 - RNA, 20 nt, Homo sapiens
cccuuggccuccauuucugu

SEQ ID NO: 583890 - RNA, 18 nt, Homo sapiens
cccuuggcuucugugaug

SEQ ID NO: 583891 - RNA, 23 nt, Homo sapiens
cccuuggucuuuucuugccuuuu

SEQ ID NO: 583892 - RNA, 18 nt, Homo sapiens
cccuuguggcuugggaca

SEQ ID NO: 583893 - RNA, 14 nt, Homo sapiens
cccuuuauguaucu

SEQ ID NO: 583894 - RNA, 20 nt, Homo sapiens
cccuuuauucauccuaaaaa

SEQ ID NO: 583895 - RNA, 16 nt, Homo sapiens
cccuuucacacuggau

SEQ ID NO: 583896 - RNA, 12 nt, Homo sapiens
cccuuugccaua

SEQ ID NO: 583897 - RNA, 12 nt, Homo sapiens
cccuuuuacuuu

SEQ ID NO: 583898 - RNA, 17 nt, Homo sapiens
augcugggcucuguucu

SEQ ID NO: 583899 - RNA, 15 nt, Homo sapiens
augcuguacaugaca

SEQ ID NO: 583900 - RNA, 17 nt, Homo sapiens
augcuguacaugacauc

SEQ ID NO: 583901 - RNA, 19 nt, Homo sapiens
augcuguauccacaaauca

SEQ ID NO: 583902 - RNA, 22 nt, Homo sapiens
augcugucauuaguauuucaca

SEQ ID NO: 583903 - RNA, 21 nt, Homo sapiens
augcugucccuauacacuaga

SEQ ID NO: 583904 - RNA, 15 nt, Homo sapiens
augcugugcuaugaa

SEQ ID NO: 583905 - RNA, 14 nt, Homo sapiens
augcugugcucaau

SEQ ID NO: 583906 - RNA, 15 nt, Homo sapiens
augcuguuaacuuaa

SEQ ID NO: 583907 - RNA, 21 nt, Homo sapiens
augcuguuaguaccuacauca

SEQ ID NO: 583908 - RNA, 19 nt, Homo sapiens
augcuguuuguagugaaau

SEQ ID NO: 583909 - RNA, 14 nt, Homo sapiens
augcuucaugugcu

SEQ ID NO: 583910 - RNA, 15 nt, Homo sapiens
augcuucaugugcug

SEQ ID NO: 583911 - RNA, 15 nt, Homo sapiens
augcuuccugacaau

SEQ ID NO: 583912 - RNA, 22 nt, Homo sapiens
augcuucuauaauuuugccuuu

SEQ ID NO: 583913 - RNA, 22 nt, Homo sapiens
augcuugacauaccuaccagua

SEQ ID NO: 583914 - RNA, 14 nt, Homo sapiens
augcuugauuccag

SEQ ID NO: 583915 - RNA, 15 nt, Homo sapiens
augcuugauuccagu

SEQ ID NO: 583916 - RNA, 15 nt, Homo sapiens
augcuuguacauaau

SEQ ID NO: 583917 - RNA, 23 nt, Homo sapiens
augcuuucuuuggccuacauucu

SEQ ID NO: 583918 - RNA, 18 nt, Homo sapiens
augcuuuuagaguugcaa

SEQ ID NO: 583919 - RNA, 15 nt, Homo sapiens
augcuuuugccacuu

SEQ ID NO: 583920 - RNA, 20 nt, Homo sapiens
augcuuuugcuugcaaugua

SEQ ID NO: 583921 - RNA, 16 nt, Homo sapiens
auggaaaaauugacaa

SEQ ID NO: 583922 - RNA, 23 nt, Homo sapiens
auggaaaaccuucaagaucucau

SEQ ID NO: 583923 - RNA, 19 nt, Homo sapiens
auggaaaauaaacaucagu

SEQ ID NO: 583924 - RNA, 21 nt, Homo sapiens
auggaaacauuuuauacugua

SEQ ID NO: 583925 - RNA, 18 nt, Homo sapiens
auggaaauguagugcucg

SEQ ID NO: 583926 - RNA, 22 nt, Homo sapiens
auggaacacuggaacauuccag

SEQ ID NO: 583927 - RNA, 16 nt, Homo sapiens
auggaagggcaaguuu

SEQ ID NO: 583928 - RNA, 18 nt, Homo sapiens
auggaaguaaagccucaa

SEQ ID NO: 583929 - RNA, 15 nt, Homo sapiens
auggaauaguuuugu

SEQ ID NO: 583930 - RNA, 20 nt, Homo sapiens
auggaauauuccccuaucuc

SEQ ID NO: 583931 - RNA, 22 nt, Homo sapiens
auggaaugaccagccuguccaa

SEQ ID NO: 583932 - RNA, 15 nt, Homo sapiens
auggaauuacaugua

SEQ ID NO: 583933 - RNA, 17 nt, Homo sapiens
auggaauucacaaagua

SEQ ID NO: 583934 - RNA, 16 nt, Homo sapiens
auggaauugauuugca

SEQ ID NO: 583935 - RNA, 18 nt, Homo sapiens
auggaauuuugcaaagau

SEQ ID NO: 583936 - RNA, 12 nt, Homo sapiens
auggacaacuua

SEQ ID NO: 583937 - RNA, 15 nt, Homo sapiens
auggacacacaguca

SEQ ID NO: 583938 - RNA, 21 nt, Homo sapiens
auggacacuccagugccagca

SEQ ID NO: 583939 - RNA, 18 nt, Homo sapiens
auggaccacacuuugaga

SEQ ID NO: 583940 - RNA, 18 nt, Homo sapiens
auggaccagugguuucca

SEQ ID NO: 583941 - RNA, 21 nt, Homo sapiens
auggacuaagaugaaaugcac

SEQ ID NO: 583942 - RNA, 16 nt, Homo sapiens
auggacucucuaagga

SEQ ID NO: 583943 - RNA, 20 nt, Homo sapiens
auggacucugaaaaacauuc

SEQ ID NO: 583944 - RNA, 17 nt, Homo sapiens
auggacucuguggugcc

SEQ ID NO: 583945 - RNA, 12 nt, Homo sapiens
auggacuuguau

SEQ ID NO: 583946 - RNA, 22 nt, Homo sapiens
auggagaagcaccuuugcucuc

SEQ ID NO: 583947 - RNA, 19 nt, Homo sapiens
auggagaggcggccucgug

SEQ ID NO: 583948 - RNA, 21 nt, Homo sapiens
auggagauauuuacaugaauu

SEQ ID NO: 583949 - RNA, 18 nt, Homo sapiens
auggagcaucaagccacu

SEQ ID NO: 583950 - RNA, 17 nt, Homo sapiens
auggagcaugaauggua

SEQ ID NO: 583951 - RNA, 18 nt, Homo sapiens
auggagccagcucugcau

SEQ ID NO: 583952 - RNA, 15 nt, Homo sapiens
auggagccaugacaa

SEQ ID NO: 583953 - RNA, 17 nt, Homo sapiens
auggaggccugcuucau

SEQ ID NO: 583954 - RNA, 20 nt, Homo sapiens
auggagguuuccuuuuggaa

SEQ ID NO: 583955 - RNA, 11 nt, Homo sapiens
auggagucuug

SEQ ID NO: 583956 - RNA, 17 nt, Homo sapiens
auggauaagcuugucua

SEQ ID NO: 583957 - RNA, 16 nt, Homo sapiens
auggauagucugucca

SEQ ID NO: 583958 - RNA, 18 nt, Homo sapiens
auggaucccuggggccaa

SEQ ID NO: 583959 - RNA, 14 nt, Homo sapiens
auggauccuuccau

SEQ ID NO: 583960 - RNA, 18 nt, Homo sapiens
auggaugcaucacacuca

SEQ ID NO: 583961 - RNA, 17 nt, Homo sapiens
auggauucucuauucaa

SEQ ID NO: 583962 - RNA, 14 nt, Homo sapiens
auggauuuaugaca

SEQ ID NO: 583963 - RNA, 20 nt, Homo sapiens
auggauuuuucuuuaacugc

SEQ ID NO: 583964 - RNA, 23 nt, Homo sapiens
auggcaaaaccccaucuuuacua

SEQ ID NO: 583965 - RNA, 15 nt, Homo sapiens
auggcaccaaagcca

SEQ ID NO: 583966 - RNA, 20 nt, Homo sapiens
auggcaccuuuugcacauaa

SEQ ID NO: 583967 - RNA, 15 nt, Homo sapiens
auggcagaaccaaag

SEQ ID NO: 583968 - RNA, 16 nt, Homo sapiens
auggcagaggugcaag

SEQ ID NO: 583969 - RNA, 20 nt, Homo sapiens
auggcagaggugcaagaccu

SEQ ID NO: 583970 - RNA, 23 nt, Homo sapiens
auggcagcccuucccuagcacac

SEQ ID NO: 583971 - RNA, 13 nt, Homo sapiens
auggcagcugcca

SEQ ID NO: 583972 - RNA, 12 nt, Homo sapiens
auggcagggaua

SEQ ID NO: 583973 - RNA, 18 nt, Homo sapiens
auggcaguuugaagucaa

SEQ ID NO: 583974 - RNA, 14 nt, Homo sapiens
auggcauccaagac

SEQ ID NO: 583975 - RNA, 14 nt, Homo sapiens
auggcaugcugaaa

SEQ ID NO: 583976 - RNA, 15 nt, Homo sapiens
auggccagagccucu

SEQ ID NO: 583977 - RNA, 14 nt, Homo sapiens
auggccagcaaaug

SEQ ID NO: 583978 - RNA, 12 nt, Homo sapiens
auggccauuucu

SEQ ID NO: 583979 - RNA, 14 nt, Homo sapiens
auggcccaggucuc

SEQ ID NO: 583980 - RNA, 23 nt, Homo sapiens
auggcccauuggagcaccugggc

SEQ ID NO: 583981 - RNA, 18 nt, Homo sapiens
auggccccaguccaugcu

SEQ ID NO: 583982 - RNA, 23 nt, Homo sapiens
auggcccccaauaaaggcagcug

SEQ ID NO: 583983 - RNA, 17 nt, Homo sapiens
auggcccugcaaaagga

SEQ ID NO: 583984 - RNA, 23 nt, Homo sapiens
auggccggcuggaaaugcugggc

SEQ ID NO: 583985 - RNA, 20 nt, Homo sapiens
auggccuuaauauacuacuu

SEQ ID NO: 583986 - RNA, 16 nt, Homo sapiens
auggcgaccaccaaag

SEQ ID NO: 583987 - RNA, 17 nt, Homo sapiens
auggcgaccaccaaagu

SEQ ID NO: 583988 - RNA, 20 nt, Homo sapiens
auggcuacuaagcacaugaa

SEQ ID NO: 583989 - RNA, 16 nt, Homo sapiens
auggcuaguacuguau

SEQ ID NO: 583990 - RNA, 18 nt, Homo sapiens
auggcucaggcaagcccc

SEQ ID NO: 583991 - RNA, 13 nt, Homo sapiens
auggcucccaagg

SEQ ID NO: 583992 - RNA, 18 nt, Homo sapiens
auggcuccuugcccucaa

SEQ ID NO: 583993 - RNA, 14 nt, Homo sapiens
auggcucugcaauu

SEQ ID NO: 583994 - RNA, 16 nt, Homo sapiens
auggcuguguuugcag

SEQ ID NO: 583995 - RNA, 22 nt, Homo sapiens
auggcuuaauguuuauuccuga

SEQ ID NO: 583996 - RNA, 18 nt, Homo sapiens
auggcuuguucaucaucc

SEQ ID NO: 583997 - RNA, 16 nt, Homo sapiens
auggcuuuugugcauu

SEQ ID NO: 583998 - RNA, 14 nt, Homo sapiens
augggaacacuggu

SEQ ID NO: 583999 - RNA, 15 nt, Homo sapiens
augggaagcagggaa

SEQ ID NO: 584000 - RNA, 20 nt, Homo sapiens
augggaaggguccaucucag

SEQ ID NO: 584001 - RNA, 16 nt, Homo sapiens
augggacucugagaac

SEQ ID NO: 584002 - RNA, 19 nt, Homo sapiens
augggagaguuucuuuaca

SEQ ID NO: 584003 - RNA, 15 nt, Homo sapiens
augggaggcugugau

SEQ ID NO: 584004 - RNA, 16 nt, Homo sapiens
augggagggcauucca

SEQ ID NO: 584005 - RNA, 14 nt, Homo sapiens
augggagugggcac

SEQ ID NO: 584006 - RNA, 18 nt, Homo sapiens
augggagugggcaccuca

SEQ ID NO: 584007 - RNA, 15 nt, Homo sapiens
augggcacacacacc

SEQ ID NO: 584008 - RNA, 14 nt, Homo sapiens
augggccuccagag

SEQ ID NO: 584009 - RNA, 15 nt, Homo sapiens
augggccuccagaga

SEQ ID NO: 584010 - RNA, 14 nt, Homo sapiens
augggccuggccac

SEQ ID NO: 584011 - RNA, 19 nt, Homo sapiens
augggcgcaggcccaguga

SEQ ID NO: 584012 - RNA, 18 nt, Homo sapiens
augggcucccacccuccc

SEQ ID NO: 584013 - RNA, 19 nt, Homo sapiens
auggggaagguuaucagug

SEQ ID NO: 584014 - RNA, 22 nt, Homo sapiens
auggggauggcuggggcucucu

SEQ ID NO: 584015 - RNA, 19 nt, Homo sapiens
augggggcaggaaagccac

SEQ ID NO: 584016 - RNA, 14 nt, Homo sapiens
augggguagaaaca

SEQ ID NO: 584017 - RNA, 13 nt, Homo sapiens
auggguccagggc

SEQ ID NO: 584018 - RNA, 18 nt, Homo sapiens
auggguccauuuugcccu

SEQ ID NO: 584019 - RNA, 21 nt, Homo sapiens
auggguccuugaugccagagg

SEQ ID NO: 584020 - RNA, 14 nt, Homo sapiens
augggucuaggaca

SEQ ID NO: 584021 - RNA, 22 nt, Homo sapiens
augggugauacuggagucuuau

SEQ ID NO: 584022 - RNA, 15 nt, Homo sapiens
auggguugcauuugg

SEQ ID NO: 584023 - RNA, 18 nt, Homo sapiens
augguaaaaccccaucuc

SEQ ID NO: 584024 - RNA, 16 nt, Homo sapiens
augguaaauccuuuug

SEQ ID NO: 584025 - RNA, 18 nt, Homo sapiens
augguaaucaguuggaau

SEQ ID NO: 584026 - RNA, 16 nt, Homo sapiens
augguaauuguugcua

SEQ ID NO: 584027 - RNA, 15 nt, Homo sapiens
augguacuacaacca

SEQ ID NO: 584028 - RNA, 20 nt, Homo sapiens
augguaggauaucuuggcuu

SEQ ID NO: 584029 - RNA, 17 nt, Homo sapiens
auggucauagcccagau

SEQ ID NO: 584030 - RNA, 12 nt, Homo sapiens
augguccagaaa

SEQ ID NO: 584031 - RNA, 15 nt, Homo sapiens
augguccugucuguc

SEQ ID NO: 584032 - RNA, 17 nt, Homo sapiens
auggucucuaccuaaug

SEQ ID NO: 584033 - RNA, 20 nt, Homo sapiens
auggucugcauuagucucau

SEQ ID NO: 584034 - RNA, 19 nt, Homo sapiens
auggugaaaccccaucucu

SEQ ID NO: 584035 - RNA, 20 nt, Homo sapiens
auggugaaaccccaucucua

SEQ ID NO: 584036 - RNA, 19 nt, Homo sapiens
auggugaaaccccgucucu

SEQ ID NO: 584037 - RNA, 20 nt, Homo sapiens
auggugaaacuccaucucua

SEQ ID NO: 584038 - RNA, 14 nt, Homo sapiens
auggugaagugcuu

SEQ ID NO: 584039 - RNA, 14 nt, Homo sapiens
auggugacccagaa

SEQ ID NO: 584040 - RNA, 17 nt, Homo sapiens
auggugagcucugggaa

SEQ ID NO: 584041 - RNA, 15 nt, Homo sapiens
auggugauugucaug

SEQ ID NO: 584042 - RNA, 20 nt, Homo sapiens
auggugcaaauccuacugaa

SEQ ID NO: 584043 - RNA, 19 nt, Homo sapiens
augguggaaaagaacugua

SEQ ID NO: 584044 - RNA, 18 nt, Homo sapiens
augguggagggcacuuca

SEQ ID NO: 584045 - RNA, 20 nt, Homo sapiens
augguggcgcgcaccuguaa

SEQ ID NO: 584046 - RNA, 13 nt, Homo sapiens
augguggguacaa

SEQ ID NO: 584047 - RNA, 15 nt, Homo sapiens
augguggguacaaaa

SEQ ID NO: 584048 - RNA, 19 nt, Homo sapiens
augguguagaacacuaauu

SEQ ID NO: 584049 - RNA, 17 nt, Homo sapiens
augguguggucaagccc

SEQ ID NO: 584050 - RNA, 16 nt, Homo sapiens
augguguuuugucaga

SEQ ID NO: 584051 - RNA, 13 nt, Homo sapiens
augguuagacagc

SEQ ID NO: 584052 - RNA, 19 nt, Homo sapiens
augguuaguuucacuuuuu

SEQ ID NO: 584053 - RNA, 22 nt, Homo sapiens
augguuauuuaugcacuguggg

SEQ ID NO: 584054 - RNA, 18 nt, Homo sapiens
augguucccaagcgucau

SEQ ID NO: 584055 - RNA, 20 nt, Homo sapiens
augguucucagaucuugaca

SEQ ID NO: 584056 - RNA, 19 nt, Homo sapiens
augguuuccacaggaacaa

SEQ ID NO: 584057 - RNA, 15 nt, Homo sapiens
augguuuccauuuac

SEQ ID NO: 584058 - RNA, 13 nt, Homo sapiens
augguuuguguca

SEQ ID NO: 584059 - RNA, 21 nt, Homo sapiens
auguaaaaagaucuacauaca

SEQ ID NO: 584060 - RNA, 20 nt, Homo sapiens
auguaaaacauucuuuugca

SEQ ID NO: 584061 - RNA, 15 nt, Homo sapiens
auguaaaacccaaaa

SEQ ID NO: 584062 - RNA, 17 nt, Homo sapiens
auguaaacagugccugc

SEQ ID NO: 584063 - RNA, 14 nt, Homo sapiens
auguaaacugccau

SEQ ID NO: 584064 - RNA, 13 nt, Homo sapiens
auguaaagccagc

SEQ ID NO: 584065 - RNA, 14 nt, Homo sapiens
auguaaaguauguu

SEQ ID NO: 584066 - RNA, 14 nt, Homo sapiens
auguaaauacaaau

SEQ ID NO: 584067 - RNA, 17 nt, Homo sapiens
auguaaauacucaugaa

SEQ ID NO: 584068 - RNA, 17 nt, Homo sapiens
auguaaauagaugacaa

SEQ ID NO: 584069 - RNA, 22 nt, Homo sapiens
auguaaauguguuagcacugau

SEQ ID NO: 584070 - RNA, 23 nt, Homo sapiens
auguaacaucauaauuacauucc

SEQ ID NO: 584071 - RNA, 15 nt, Homo sapiens
auguaagcucuacug

SEQ ID NO: 584072 - RNA, 16 nt, Homo sapiens
auguaaggagccuuuc

SEQ ID NO: 584073 - RNA, 24 nt, Homo sapiens
auguaaggucuucuuguguccuga

SEQ ID NO: 584074 - RNA, 15 nt, Homo sapiens
auguaauacuggaau

SEQ ID NO: 584075 - RNA, 16 nt, Homo sapiens
auguaaucucaccuca

SEQ ID NO: 584076 - RNA, 23 nt, Homo sapiens
auguaaugcauaggaaguauggc

SEQ ID NO: 584077 - RNA, 23 nt, Homo sapiens
auguaauuggaaucuucaccuca

SEQ ID NO: 584078 - RNA, 15 nt, Homo sapiens
auguaauuuaugcaa

SEQ ID NO: 584079 - RNA, 14 nt, Homo sapiens
auguacaacugcac

SEQ ID NO: 584080 - RNA, 20 nt, Homo sapiens
auguacaauaaagcaaugug

SEQ ID NO: 584081 - RNA, 13 nt, Homo sapiens
auguacacuacca

SEQ ID NO: 584082 - RNA, 18 nt, Homo sapiens
auguacagaagagcaaaa

SEQ ID NO: 584083 - RNA, 15 nt, Homo sapiens
auguacagacauaca

SEQ ID NO: 584084 - RNA, 15 nt, Homo sapiens
auguacagcauuaaa

SEQ ID NO: 584085 - RNA, 17 nt, Homo sapiens
auguacagggguaguuu

SEQ ID NO: 584086 - RNA, 21 nt, Homo sapiens
auguacaugaagaagcuaaau

SEQ ID NO: 584087 - RNA, 18 nt, Homo sapiens
auguaccguaggcuuugu

SEQ ID NO: 584088 - RNA, 14 nt, Homo sapiens
auguacuaugucug

SEQ ID NO: 584089 - RNA, 16 nt, Homo sapiens
auguacucuacgccaa

SEQ ID NO: 584090 - RNA, 19 nt, Homo sapiens
auguacuuaagaguggcau

SEQ ID NO: 584091 - RNA, 18 nt, Homo sapiens
auguacuucagugcaccu

SEQ ID NO: 584092 - RNA, 14 nt, Homo sapiens
auguacuucucacc

SEQ ID NO: 584093 - RNA, 16 nt, Homo sapiens
auguagcaaaacgcau

SEQ ID NO: 584094 - RNA, 15 nt, Homo sapiens
auguagcccauccuu

SEQ ID NO: 584095 - RNA, 22 nt, Homo sapiens
auguagccuuuacuguuugaua

SEQ ID NO: 584096 - RNA, 23 nt, Homo sapiens
auguagcuauuuuucuuguugca

SEQ ID NO: 584097 - RNA, 13 nt, Homo sapiens
auguagcucagua

SEQ ID NO: 584098 - RNA, 19 nt, Homo sapiens
auguagcuucagucauuaa

SEQ ID NO: 584099 - RNA, 18 nt, Homo sapiens
auguaggguaaggugccu

SEQ ID NO: 584100 - RNA, 13 nt, Homo sapiens
auguaggugagcc

SEQ ID NO: 584101 - RNA, 21 nt, Homo sapiens
auguaguaguuugggugugua

SEQ ID NO: 584102 - RNA, 20 nt, Homo sapiens
auguaguccgugcugacagc

SEQ ID NO: 584103 - RNA, 22 nt, Homo sapiens
auguaguuugaauauuuuccac

SEQ ID NO: 584104 - RNA, 17 nt, Homo sapiens
auguauauaaagcuuuu

SEQ ID NO: 584105 - RNA, 16 nt, Homo sapiens
auguauauuuugauga

SEQ ID NO: 584106 - RNA, 18 nt, Homo sapiens
auguaucaaugaguaaca

SEQ ID NO: 584107 - RNA, 20 nt, Homo sapiens
auguaucccaacuccuauaa

SEQ ID NO: 584108 - RNA, 16 nt, Homo sapiens
auguauccccacuuau

SEQ ID NO: 584109 - RNA, 20 nt, Homo sapiens
auguauccccacuuaucucg

SEQ ID NO: 584110 - RNA, 19 nt, Homo sapiens
auguaucuauuuguacaau

SEQ ID NO: 584111 - RNA, 17 nt, Homo sapiens
auguaucugaguugcca

SEQ ID NO: 584112 - RNA, 21 nt, Homo sapiens
auguaucuuggugcugcugaa

SEQ ID NO: 584113 - RNA, 12 nt, Homo sapiens
auguaugaugcu

SEQ ID NO: 584114 - RNA, 17 nt, Homo sapiens
auguauggggaaucuaa

SEQ ID NO: 584115 - RNA, 23 nt, Homo sapiens
auguauguguaaaacaaucuguu

SEQ ID NO: 584116 - RNA, 15 nt, Homo sapiens
auguauuacaugacu

SEQ ID NO: 584117 - RNA, 15 nt, Homo sapiens
auguauugauuacaa

SEQ ID NO: 584118 - RNA, 19 nt, Homo sapiens
auguauuuguaguguuauu

SEQ ID NO: 584119 - RNA, 17 nt, Homo sapiens
auguauuuugacacugg

SEQ ID NO: 584120 - RNA, 16 nt, Homo sapiens
augucaaacaguaaua

SEQ ID NO: 584121 - RNA, 23 nt, Homo sapiens
augucaaagcaggggaguaugca

SEQ ID NO: 584122 - RNA, 19 nt, Homo sapiens
augucaaauugaugugccc

SEQ ID NO: 584123 - RNA, 14 nt, Homo sapiens
augucaagccauaa

SEQ ID NO: 584124 - RNA, 15 nt, Homo sapiens
augucaauauuuagu

SEQ ID NO: 584125 - RNA, 20 nt, Homo sapiens
augucacaguaaugcaagca

SEQ ID NO: 584126 - RNA, 17 nt, Homo sapiens
augucagaaaccaguua

SEQ ID NO: 584127 - RNA, 19 nt, Homo sapiens
augucagacacuacaugau

SEQ ID NO: 584128 - RNA, 18 nt, Homo sapiens
augucagaggaccccagg

SEQ ID NO: 584129 - RNA, 19 nt, Homo sapiens
augucagaguagaagauuu

SEQ ID NO: 584130 - RNA, 18 nt, Homo sapiens
augucagcacacacuuac

SEQ ID NO: 584131 - RNA, 18 nt, Homo sapiens
augucagugucacuggau

SEQ ID NO: 584132 - RNA, 12 nt, Homo sapiens
augucauaucau

SEQ ID NO: 584133 - RNA, 20 nt, Homo sapiens
augucauugucuacuccuag

SEQ ID NO: 584134 - RNA, 12 nt, Homo sapiens
auguccauacua

SEQ ID NO: 584135 - RNA, 22 nt, Homo sapiens
auguccaugauggaauauuccc

SEQ ID NO: 584136 - RNA, 17 nt, Homo sapiens
auguccauuuauaucau

SEQ ID NO: 584137 - RNA, 16 nt, Homo sapiens
auguccccugucccac

SEQ ID NO: 584138 - RNA, 15 nt, Homo sapiens
augucccugggccag

SEQ ID NO: 584139 - RNA, 21 nt, Homo sapiens
augucccuuucuuggccaguu

SEQ ID NO: 584140 - RNA, 19 nt, Homo sapiens
auguccgugagaacaucau

SEQ ID NO: 584141 - RNA, 19 nt, Homo sapiens
auguccuaaggacacacua

SEQ ID NO: 584142 - RNA, 23 nt, Homo sapiens
auguccuauucccugucacuaca

SEQ ID NO: 584143 - RNA, 16 nt, Homo sapiens
auguccuuucauuugu

SEQ ID NO: 584144 - RNA, 16 nt, Homo sapiens
augucgaugacuucau

SEQ ID NO: 584145 - RNA, 19 nt, Homo sapiens
augucgaugcacaguaucu

SEQ ID NO: 584146 - RNA, 13 nt, Homo sapiens
augucgcacaaug

SEQ ID NO: 584147 - RNA, 17 nt, Homo sapiens
augucuaauagcccaua

SEQ ID NO: 584148 - RNA, 14 nt, Homo sapiens
augucuagcuuuca

SEQ ID NO: 584149 - RNA, 19 nt, Homo sapiens
augucuaucaacuuuaauc

SEQ ID NO: 584150 - RNA, 20 nt, Homo sapiens
augucuauuauauuuacuua

SEQ ID NO: 584151 - RNA, 15 nt, Homo sapiens
augucuauucagcuu

SEQ ID NO: 584152 - RNA, 20 nt, Homo sapiens
augucucugcuuccauggcu

SEQ ID NO: 584153 - RNA, 17 nt, Homo sapiens
augucucuucugagcua

SEQ ID NO: 584154 - RNA, 18 nt, Homo sapiens
augucucuugagcaucaa

SEQ ID NO: 584155 - RNA, 16 nt, Homo sapiens
augucucuuguagaag

SEQ ID NO: 584156 - RNA, 14 nt, Homo sapiens
augucuggucuguc

SEQ ID NO: 584157 - RNA, 22 nt, Homo sapiens
augucuguagcuccucaacuca

SEQ ID NO: 584158 - RNA, 19 nt, Homo sapiens
augucuguucuacauagau

SEQ ID NO: 584159 - RNA, 17 nt, Homo sapiens
augucuuaacugucacc

SEQ ID NO: 584160 - RNA, 14 nt, Homo sapiens
augucuucacucua

SEQ ID NO: 584161 - RNA, 22 nt, Homo sapiens
augucuucaucacuucuuccac

SEQ ID NO: 584162 - RNA, 20 nt, Homo sapiens
augucuucucguuaaggaga

SEQ ID NO: 584163 - RNA, 22 nt, Homo sapiens
augucuugcuguugacauauuu

SEQ ID NO: 584164 - RNA, 16 nt, Homo sapiens
augucuuuucuuccac

SEQ ID NO: 584165 - RNA, 19 nt, Homo sapiens
augucuuuucuuccacugc

SEQ ID NO: 584166 - RNA, 17 nt, Homo sapiens
augugaaaacaucucaa

SEQ ID NO: 584167 - RNA, 14 nt, Homo sapiens
augugaaaagaaua

SEQ ID NO: 584168 - RNA, 13 nt, Homo sapiens
augugaaacacac

SEQ ID NO: 584169 - RNA, 19 nt, Homo sapiens
augugaaacacaugccagu

SEQ ID NO: 584170 - RNA, 20 nt, Homo sapiens
augugaagaguuucacaaau

SEQ ID NO: 584171 - RNA, 12 nt, Homo sapiens
augugaagccaa

SEQ ID NO: 584172 - RNA, 22 nt, Homo sapiens
augugacccuccaaauggagaa

SEQ ID NO: 584173 - RNA, 16 nt, Homo sapiens
augugacuuaaaguca

SEQ ID NO: 584174 - RNA, 16 nt, Homo sapiens
augugagcgagcaagc

SEQ ID NO: 584175 - RNA, 19 nt, Homo sapiens
augugagcugucacugugg

SEQ ID NO: 584176 - RNA, 14 nt, Homo sapiens
augugaguccuguu

SEQ ID NO: 584177 - RNA, 18 nt, Homo sapiens
augugagugccuuuugca

SEQ ID NO: 584178 - RNA, 22 nt, Homo sapiens
augugauaaaaccccaucucua

SEQ ID NO: 584179 - RNA, 16 nt, Homo sapiens
augugaucauagcuca

SEQ ID NO: 584180 - RNA, 11 nt, Homo sapiens
augugaugaau

SEQ ID NO: 584181 - RNA, 22 nt, Homo sapiens
augugauucaccucuucuuucc

SEQ ID NO: 584182 - RNA, 17 nt, Homo sapiens
augugauuuacauuuca

SEQ ID NO: 584183 - RNA, 19 nt, Homo sapiens
augugcaaguauauagauu

SEQ ID NO: 584184 - RNA, 14 nt, Homo sapiens
augugcaaguuuau

SEQ ID NO: 584185 - RNA, 15 nt, Homo sapiens
augugcaaguuuauc

SEQ ID NO: 584186 - RNA, 15 nt, Homo sapiens
augugcaauaagauu

SEQ ID NO: 584187 - RNA, 16 nt, Homo sapiens
augugcacacuuacag

SEQ ID NO: 584188 - RNA, 13 nt, Homo sapiens
augugcagauauc

SEQ ID NO: 584189 - RNA, 14 nt, Homo sapiens
augugcaguacuua

SEQ ID NO: 584190 - RNA, 16 nt, Homo sapiens
augugcaguacuuaau

SEQ ID NO: 584191 - RNA, 12 nt, Homo sapiens
augugcauuaaa

SEQ ID NO: 584192 - RNA, 17 nt, Homo sapiens
augugccaggcuugccu

SEQ ID NO: 584193 - RNA, 20 nt, Homo sapiens
augugccuugauugauuaga

SEQ ID NO: 584194 - RNA, 17 nt, Homo sapiens
augugccuuguccagga

SEQ ID NO: 584195 - RNA, 16 nt, Homo sapiens
augugcggcugaacug

SEQ ID NO: 584196 - RNA, 15 nt, Homo sapiens
augugcgucucucuu

SEQ ID NO: 584197 - RNA, 16 nt, Homo sapiens
augugcucagccaaau

SEQ ID NO: 584198 - RNA, 17 nt, Homo sapiens
auguggaaccuguuuaa

SEQ ID NO: 584199 - RNA, 23 nt, Homo sapiens
cccacggggaucacagcguuuca

SEQ ID NO: 584200 - RNA, 23 nt, Homo sapiens
cccacgugggccuuuugcucagu

SEQ ID NO: 584201 - RNA, 18 nt, Homo sapiens
cccacuaaaacugcauuu

SEQ ID NO: 584202 - RNA, 16 nt, Homo sapiens
cccacucggagggugc

SEQ ID NO: 584203 - RNA, 13 nt, Homo sapiens
cccacugagauuu

SEQ ID NO: 584204 - RNA, 13 nt, Homo sapiens
cccacugcuucua

SEQ ID NO: 584205 - RNA, 18 nt, Homo sapiens
cccacuggacaacacuga

SEQ ID NO: 584206 - RNA, 16 nt, Homo sapiens
cccacuggucugcuua

SEQ ID NO: 584207 - RNA, 19 nt, Homo sapiens
cccacuguuucucuugagc

SEQ ID NO: 584208 - RNA, 10 nt, Homo sapiens
cccacuuccu

SEQ ID NO: 584209 - RNA, 14 nt, Homo sapiens
cccacuucuggcca

SEQ ID NO: 584210 - RNA, 16 nt, Homo sapiens
cccacuugacacuauu

SEQ ID NO: 584211 - RNA, 19 nt, Homo sapiens
cccagaaaagaaagcuaca

SEQ ID NO: 584212 - RNA, 18 nt, Homo sapiens
cccagaaacaaaucucaa

SEQ ID NO: 584213 - RNA, 21 nt, Homo sapiens
cccagaaacaaaucucaaagu

SEQ ID NO: 584214 - RNA, 19 nt, Homo sapiens
cccagaaccacagaugugu

SEQ ID NO: 584215 - RNA, 20 nt, Homo sapiens
cccagaacuucccugauuga

SEQ ID NO: 584216 - RNA, 12 nt, Homo sapiens
cccagaaggcag

SEQ ID NO: 584217 - RNA, 14 nt, Homo sapiens
cccagaaguggcua

SEQ ID NO: 584218 - RNA, 14 nt, Homo sapiens
cccagaauagcuuu

SEQ ID NO: 584219 - RNA, 14 nt, Homo sapiens
cccagacaaccaaa

SEQ ID NO: 584220 - RNA, 22 nt, Homo sapiens
cccagacaauggcccaggucuc

SEQ ID NO: 584221 - RNA, 18 nt, Homo sapiens
cccagacaccaugugcaa

SEQ ID NO: 584222 - RNA, 20 nt, Homo sapiens
cccagaccaacccugggacc

SEQ ID NO: 584223 - RNA, 17 nt, Homo sapiens
cccagacuagauguagu

SEQ ID NO: 584224 - RNA, 18 nt, Homo sapiens
cccagagcaaaauaauuu

SEQ ID NO: 584225 - RNA, 13 nt, Homo sapiens
cccagagcacugg

SEQ ID NO: 584226 - RNA, 12 nt, Homo sapiens
cccagagcagga

SEQ ID NO: 584227 - RNA, 22 nt, Homo sapiens
cccagaggcagcagagcauuca

SEQ ID NO: 584228 - RNA, 19 nt, Homo sapiens
cccagaggcucccaaucag

SEQ ID NO: 584229 - RNA, 20 nt, Homo sapiens
cccagagguuaucugccugg

SEQ ID NO: 584230 - RNA, 17 nt, Homo sapiens
cccagaguauugggauu

SEQ ID NO: 584231 - RNA, 17 nt, Homo sapiens
cccagaucaaauucuau

SEQ ID NO: 584232 - RNA, 14 nt, Homo sapiens
cccagaugugacgg

SEQ ID NO: 584233 - RNA, 17 nt, Homo sapiens
cccagauucuucagcuu

SEQ ID NO: 584234 - RNA, 20 nt, Homo sapiens
cccagauucuucagcuugau

SEQ ID NO: 584235 - RNA, 13 nt, Homo sapiens
cccagauuucagg

SEQ ID NO: 584236 - RNA, 16 nt, Homo sapiens
cccagcaacacaagcu

SEQ ID NO: 584237 - RNA, 15 nt, Homo sapiens
cccagcaacucuggc

SEQ ID NO: 584238 - RNA, 14 nt, Homo sapiens
cccagcaauagaga

SEQ ID NO: 584239 - RNA, 14 nt, Homo sapiens
cccagcacacggcu

SEQ ID NO: 584240 - RNA, 13 nt, Homo sapiens
cccagcacauggc

SEQ ID NO: 584241 - RNA, 19 nt, Homo sapiens
cccagcaccucaugcagag

SEQ ID NO: 584242 - RNA, 11 nt, Homo sapiens
cccagcacugc

SEQ ID NO: 584243 - RNA, 12 nt, Homo sapiens
cccagcacuguc

SEQ ID NO: 584244 - RNA, 23 nt, Homo sapiens
cccagcagaggcaggcugggacg

SEQ ID NO: 584245 - RNA, 19 nt, Homo sapiens
cccagcagcgguaccccag

SEQ ID NO: 584246 - RNA, 16 nt, Homo sapiens
cccagcagugccuugu

SEQ ID NO: 584247 - RNA, 15 nt, Homo sapiens
cccagcagugucacu

SEQ ID NO: 584248 - RNA, 16 nt, Homo sapiens
cccagcaucagccugu

SEQ ID NO: 584249 - RNA, 15 nt, Homo sapiens
cccagccacucggga

SEQ ID NO: 584250 - RNA, 21 nt, Homo sapiens
cccagccaggcuaugguugcc

SEQ ID NO: 584251 - RNA, 23 nt, Homo sapiens
cccagccaucugcccaggggugc

SEQ ID NO: 584252 - RNA, 14 nt, Homo sapiens
cccagccccuccaa

SEQ ID NO: 584253 - RNA, 19 nt, Homo sapiens
cccagccccuccaaagguc

SEQ ID NO: 584254 - RNA, 14 nt, Homo sapiens
cccagccccuucca

SEQ ID NO: 584255 - RNA, 20 nt, Homo sapiens
cccagcccugggaaccacuc

SEQ ID NO: 584256 - RNA, 22 nt, Homo sapiens
cccagccggccaauggaaaccu

SEQ ID NO: 584257 - RNA, 15 nt, Homo sapiens
cccagccucaucucu

SEQ ID NO: 584258 - RNA, 20 nt, Homo sapiens
cccagccuccccgugccaaa

SEQ ID NO: 584259 - RNA, 13 nt, Homo sapiens
cccagccucuggc

SEQ ID NO: 584260 - RNA, 22 nt, Homo sapiens
cccagccugcucccuagccaga

SEQ ID NO: 584261 - RNA, 17 nt, Homo sapiens
cccagccugguuugcaa

SEQ ID NO: 584262 - RNA, 16 nt, Homo sapiens
cccagccuguggugcu

SEQ ID NO: 584263 - RNA, 18 nt, Homo sapiens
cccagcuaccucaaccaa

SEQ ID NO: 584264 - RNA, 13 nt, Homo sapiens
cccagcuacucag

SEQ ID NO: 584265 - RNA, 15 nt, Homo sapiens
cccagcuacucggga

SEQ ID NO: 584266 - RNA, 19 nt, Homo sapiens
cccagcugguccuguggau

SEQ ID NO: 584267 - RNA, 21 nt, Homo sapiens
cccagcuuaauggcucaugac

SEQ ID NO: 584268 - RNA, 19 nt, Homo sapiens
cccagcuucggcauuugau

SEQ ID NO: 584269 - RNA, 19 nt, Homo sapiens
cccagcuugggcccagcug

SEQ ID NO: 584270 - RNA, 13 nt, Homo sapiens
cccaggaacaaua

SEQ ID NO: 584271 - RNA, 20 nt, Homo sapiens
cccaggaccccuguccagga

SEQ ID NO: 584272 - RNA, 15 nt, Homo sapiens
cccaggaccuggcug

SEQ ID NO: 584273 - RNA, 22 nt, Homo sapiens
cccaggacgccacucauuucau

SEQ ID NO: 584274 - RNA, 16 nt, Homo sapiens
cccaggacgcuucuga

SEQ ID NO: 584275 - RNA, 15 nt, Homo sapiens
cccaggagcagcauc

SEQ ID NO: 584276 - RNA, 19 nt, Homo sapiens
cccaggaggagaugaccag

SEQ ID NO: 584277 - RNA, 22 nt, Homo sapiens
cccaggaggauuugucugagac

SEQ ID NO: 584278 - RNA, 21 nt, Homo sapiens
cccaggagguggcuauggcca

SEQ ID NO: 584279 - RNA, 14 nt, Homo sapiens
cccaggaguuugag

SEQ ID NO: 584280 - RNA, 20 nt, Homo sapiens
cccaggccacccccauggaa

SEQ ID NO: 584281 - RNA, 18 nt, Homo sapiens
cccaggcccaccaucacc

SEQ ID NO: 584282 - RNA, 19 nt, Homo sapiens
cccaggccgggguggagca

SEQ ID NO: 584283 - RNA, 21 nt, Homo sapiens
cccaggccugggaugcaguga

SEQ ID NO: 584284 - RNA, 20 nt, Homo sapiens
cccaggcuggagugcaauga

SEQ ID NO: 584285 - RNA, 15 nt, Homo sapiens
cccaggcugggugca

SEQ ID NO: 584286 - RNA, 16 nt, Homo sapiens
cccaggcugugcagcg

SEQ ID NO: 584287 - RNA, 23 nt, Homo sapiens
cccagggagaaucugagacaucu

SEQ ID NO: 584288 - RNA, 18 nt, Homo sapiens
cccagggagaggccauga

SEQ ID NO: 584289 - RNA, 14 nt, Homo sapiens
cccagggagcucug

SEQ ID NO: 584290 - RNA, 16 nt, Homo sapiens
cccagggccccuguga

SEQ ID NO: 584291 - RNA, 17 nt, Homo sapiens
cccagggccccugugac

SEQ ID NO: 584292 - RNA, 18 nt, Homo sapiens
cccagggccugacuugag

SEQ ID NO: 584293 - RNA, 19 nt, Homo sapiens
cccagggcuccugcacuua

SEQ ID NO: 584294 - RNA, 20 nt, Homo sapiens
cccagggcugcaaaacugga

SEQ ID NO: 584295 - RNA, 18 nt, Homo sapiens
cccaggggacaagggauu

SEQ ID NO: 584296 - RNA, 15 nt, Homo sapiens
cccagggggcaacug

SEQ ID NO: 584297 - RNA, 15 nt, Homo sapiens
cccaggguuuugccc

SEQ ID NO: 584298 - RNA, 17 nt, Homo sapiens
cccagguaacauguuua

SEQ ID NO: 584299 - RNA, 24 nt, Homo sapiens
cccaggucagcccugugucuguca

SEQ ID NO: 584300 - RNA, 19 nt, Homo sapiens
cccaggugcgugugucucu

SEQ ID NO: 584301 - RNA, 18 nt, Homo sapiens
cccaguaacugcaccaac

SEQ ID NO: 584302 - RNA, 20 nt, Homo sapiens
cccaguacaggggugcugca

SEQ ID NO: 584303 - RNA, 23 nt, Homo sapiens
cccaguccaagaccccaaaucac

SEQ ID NO: 584304 - RNA, 13 nt, Homo sapiens
cccaguccaugcu

SEQ ID NO: 584305 - RNA, 19 nt, Homo sapiens
cccagucuccccacuccac

SEQ ID NO: 584306 - RNA, 12 nt, Homo sapiens
cccagucuuccu

SEQ ID NO: 584307 - RNA, 15 nt, Homo sapiens
cccagugaucaccug

SEQ ID NO: 584308 - RNA, 16 nt, Homo sapiens
cccagugcugcuguaa

SEQ ID NO: 584309 - RNA, 18 nt, Homo sapiens
cccagugcugcuguaaau

SEQ ID NO: 584310 - RNA, 17 nt, Homo sapiens
cccaguggggacaggga

SEQ ID NO: 584311 - RNA, 22 nt, Homo sapiens
cccaguguguguuuaacauuca

SEQ ID NO: 584312 - RNA, 13 nt, Homo sapiens
cccaguguucucc

SEQ ID NO: 584313 - RNA, 22 nt, Homo sapiens
cccaguuaauacuccagagaca

SEQ ID NO: 584314 - RNA, 21 nt, Homo sapiens
cccaguuauaaagaggucaca

SEQ ID NO: 584315 - RNA, 21 nt, Homo sapiens
cccaguucauugcacuuugau

SEQ ID NO: 584316 - RNA, 19 nt, Homo sapiens
cccaguuggugacugggaa

SEQ ID NO: 584317 - RNA, 19 nt, Homo sapiens
cccaguuucuucuuacacu

SEQ ID NO: 584318 - RNA, 17 nt, Homo sapiens
cccauaauuuucuucau

SEQ ID NO: 584319 - RNA, 22 nt, Homo sapiens
cccauacaauguauguacaaua

SEQ ID NO: 584320 - RNA, 16 nt, Homo sapiens
cccauagcccuuaccu

SEQ ID NO: 584321 - RNA, 15 nt, Homo sapiens
cccauaucugugaaa

SEQ ID NO: 584322 - RNA, 22 nt, Homo sapiens
aucaggauccagucuggaaaac

SEQ ID NO: 584323 - RNA, 13 nt, Homo sapiens
aucaggcuguuau

SEQ ID NO: 584324 - RNA, 21 nt, Homo sapiens
aucagggaaaaggaguaggga

SEQ ID NO: 584325 - RNA, 14 nt, Homo sapiens
aucagggaauccag

SEQ ID NO: 584326 - RNA, 15 nt, Homo sapiens
aucagggacaggaug

SEQ ID NO: 584327 - RNA, 17 nt, Homo sapiens
aucagggaggucauuuu

SEQ ID NO: 584328 - RNA, 16 nt, Homo sapiens
aucagggguuagggug

SEQ ID NO: 584329 - RNA, 18 nt, Homo sapiens
aucagggucuaagcaccu

SEQ ID NO: 584330 - RNA, 15 nt, Homo sapiens
aucaggucauuauuu

SEQ ID NO: 584331 - RNA, 13 nt, Homo sapiens
aucaggucccauc

SEQ ID NO: 584332 - RNA, 15 nt, Homo sapiens
aucaggucccaucaa

SEQ ID NO: 584333 - RNA, 15 nt, Homo sapiens
aucaguaaauaccuu

SEQ ID NO: 584334 - RNA, 22 nt, Homo sapiens
aucaguaauguauucuaucucu

SEQ ID NO: 584335 - RNA, 16 nt, Homo sapiens
aucaguaccucucaag

SEQ ID NO: 584336 - RNA, 15 nt, Homo sapiens
aucaguacugacuuu

SEQ ID NO: 584337 - RNA, 17 nt, Homo sapiens
aucaguagcaucuguaa

SEQ ID NO: 584338 - RNA, 14 nt, Homo sapiens
aucaguaucagaau

SEQ ID NO: 584339 - RNA, 22 nt, Homo sapiens
aucaguccaucccagagggacc

SEQ ID NO: 584340 - RNA, 18 nt, Homo sapiens
aucaguccauugcucuug

SEQ ID NO: 584341 - RNA, 21 nt, Homo sapiens
aucagugaagccaaagggacu

SEQ ID NO: 584342 - RNA, 20 nt, Homo sapiens
aucagugacugaauucugcc

SEQ ID NO: 584343 - RNA, 20 nt, Homo sapiens
aucaguguccucuugcucaa

SEQ ID NO: 584344 - RNA, 16 nt, Homo sapiens
aucaguguuguugcuc

SEQ ID NO: 584345 - RNA, 14 nt, Homo sapiens
aucaguuaacuauu

SEQ ID NO: 584346 - RNA, 12 nt, Homo sapiens
aucaguugguuu

SEQ ID NO: 584347 - RNA, 20 nt, Homo sapiens
aucaguuugcuaauguuucc

SEQ ID NO: 584348 - RNA, 18 nt, Homo sapiens
aucaguuuuggaaucuaa

SEQ ID NO: 584349 - RNA, 13 nt, Homo sapiens
aucauaaagucag

SEQ ID NO: 584350 - RNA, 17 nt, Homo sapiens
aucauaauucagcacuu

SEQ ID NO: 584351 - RNA, 16 nt, Homo sapiens
aucauacuuacuaguu

SEQ ID NO: 584352 - RNA, 13 nt, Homo sapiens
aucauagcucacu

SEQ ID NO: 584353 - RNA, 17 nt, Homo sapiens
aucauagcucacugcag

SEQ ID NO: 584354 - RNA, 17 nt, Homo sapiens
aucauagcucacuguaa

SEQ ID NO: 584355 - RNA, 16 nt, Homo sapiens
aucauagguaacaguu

SEQ ID NO: 584356 - RNA, 16 nt, Homo sapiens
aucauaugauucugcu

SEQ ID NO: 584357 - RNA, 16 nt, Homo sapiens
aucauauucauaugca

SEQ ID NO: 584358 - RNA, 18 nt, Homo sapiens
aucauauugaauguuucc

SEQ ID NO: 584359 - RNA, 23 nt, Homo sapiens
aucaucaaagcucacaccaaauu

SEQ ID NO: 584360 - RNA, 15 nt, Homo sapiens
aucaucaaguaauac

SEQ ID NO: 584361 - RNA, 13 nt, Homo sapiens
aucaucacuguaa

SEQ ID NO: 584362 - RNA, 16 nt, Homo sapiens
aucaucagugccucuu

SEQ ID NO: 584363 - RNA, 20 nt, Homo sapiens
aucaucaucgaagucuuccc

SEQ ID NO: 584364 - RNA, 13 nt, Homo sapiens
aucaucauucuca

SEQ ID NO: 584365 - RNA, 14 nt, Homo sapiens
aucaucauucucau

SEQ ID NO: 584366 - RNA, 22 nt, Homo sapiens
aucaucccuuucucccagugaa

SEQ ID NO: 584367 - RNA, 13 nt, Homo sapiens
aucaucuguagau

SEQ ID NO: 584368 - RNA, 17 nt, Homo sapiens
aucaucuuaccugugcu

SEQ ID NO: 584369 - RNA, 23 nt, Homo sapiens
aucaugaaaguccagcacuggaa

SEQ ID NO: 584370 - RNA, 17 nt, Homo sapiens
aucaugccauugcacuc

SEQ ID NO: 584371 - RNA, 15 nt, Homo sapiens
aucauggacugagcu

SEQ ID NO: 584372 - RNA, 21 nt, Homo sapiens
aucauggagaacagcaugaca

SEQ ID NO: 584373 - RNA, 23 nt, Homo sapiens
aucauggggaguaauaggaccag

SEQ ID NO: 584374 - RNA, 16 nt, Homo sapiens
aucaugguacauuuau

SEQ ID NO: 584375 - RNA, 18 nt, Homo sapiens
aucaugguagucacuaac

SEQ ID NO: 584376 - RNA, 17 nt, Homo sapiens
aucaugguauuugacca

SEQ ID NO: 584377 - RNA, 13 nt, Homo sapiens
aucauguaccuca

SEQ ID NO: 584378 - RNA, 16 nt, Homo sapiens
aucauguccauacacu

SEQ ID NO: 584379 - RNA, 19 nt, Homo sapiens
aucauguccauacacuuug

SEQ ID NO: 584380 - RNA, 16 nt, Homo sapiens
aucaugucuugugcau

SEQ ID NO: 584381 - RNA, 17 nt, Homo sapiens
aucauguuaauagacag

SEQ ID NO: 584382 - RNA, 19 nt, Homo sapiens
aucauguuaccauuacaaa

SEQ ID NO: 584383 - RNA, 18 nt, Homo sapiens
aucauuaaaauauauguu

SEQ ID NO: 584384 - RNA, 15 nt, Homo sapiens
aucauuaaugcacau

SEQ ID NO: 584385 - RNA, 13 nt, Homo sapiens
aucauuacagauu

SEQ ID NO: 584386 - RNA, 17 nt, Homo sapiens
aucauuccuucuggccu

SEQ ID NO: 584387 - RNA, 13 nt, Homo sapiens
aucauuccuugag

SEQ ID NO: 584388 - RNA, 14 nt, Homo sapiens
aucauuccuugaga

SEQ ID NO: 584389 - RNA, 15 nt, Homo sapiens
aucauugcauuucca

SEQ ID NO: 584390 - RNA, 22 nt, Homo sapiens
aucauugcuuaugucaaaugga

SEQ ID NO: 584391 - RNA, 19 nt, Homo sapiens
aucauuguagaaacacagu

SEQ ID NO: 584392 - RNA, 14 nt, Homo sapiens
aucauuuaauguga

SEQ ID NO: 584393 - RNA, 21 nt, Homo sapiens
aucauuucaaaacucauuucc

SEQ ID NO: 584394 - RNA, 13 nt, Homo sapiens
aucauuucacugu

SEQ ID NO: 584395 - RNA, 22 nt, Homo sapiens
aucauuugugaagaauuauuca

SEQ ID NO: 584396 - RNA, 19 nt, Homo sapiens
auccaaaaagcucugaaaa

SEQ ID NO: 584397 - RNA, 15 nt, Homo sapiens
auccaaaacacaaac

SEQ ID NO: 584398 - RNA, 18 nt, Homo sapiens
auccaaaucuugaauuuc

SEQ ID NO: 584399 - RNA, 13 nt, Homo sapiens
auccaaauuucuc

SEQ ID NO: 584400 - RNA, 19 nt, Homo sapiens
auccaaccccccaccugcc

SEQ ID NO: 584401 - RNA, 23 nt, Homo sapiens
auccaaggguugagagccagugg

SEQ ID NO: 584402 - RNA, 12 nt, Homo sapiens
auccaauacugc

SEQ ID NO: 584403 - RNA, 18 nt, Homo sapiens
auccaauggguuuuuccc

SEQ ID NO: 584404 - RNA, 15 nt, Homo sapiens
auccacaaaucaucu

SEQ ID NO: 584405 - RNA, 15 nt, Homo sapiens
auccacaacuuguac

SEQ ID NO: 584406 - RNA, 14 nt, Homo sapiens
auccacaguacuca

SEQ ID NO: 584407 - RNA, 14 nt, Homo sapiens
auccacaugggagc

SEQ ID NO: 584408 - RNA, 15 nt, Homo sapiens
auccaccccauccaa

SEQ ID NO: 584409 - RNA, 23 nt, Homo sapiens
auccacccgggggagcccaguga

SEQ ID NO: 584410 - RNA, 20 nt, Homo sapiens
auccacccucaaaugucaga

SEQ ID NO: 584411 - RNA, 23 nt, Homo sapiens
auccaccgccacugggccuguca

SEQ ID NO: 584412 - RNA, 13 nt, Homo sapiens
auccacuccuucc

SEQ ID NO: 584413 - RNA, 20 nt, Homo sapiens
auccacucuucuagggauau

SEQ ID NO: 584414 - RNA, 16 nt, Homo sapiens
auccagaaauaaugaa

SEQ ID NO: 584415 - RNA, 14 nt, Homo sapiens
auccagaacagugg

SEQ ID NO: 584416 - RNA, 20 nt, Homo sapiens
auccagaacucaaaugagcc

SEQ ID NO: 584417 - RNA, 15 nt, Homo sapiens
auccagaggaacaag

SEQ ID NO: 584418 - RNA, 20 nt, Homo sapiens
auccagauguuaugcuccug

SEQ ID NO: 584419 - RNA, 22 nt, Homo sapiens
auccagauugggugccagcaua

SEQ ID NO: 584420 - RNA, 13 nt, Homo sapiens
auccagcacuggu

SEQ ID NO: 584421 - RNA, 15 nt, Homo sapiens
auccagcccaggacu

SEQ ID NO: 584422 - RNA, 18 nt, Homo sapiens
auccagcccugguucugg

SEQ ID NO: 584423 - RNA, 16 nt, Homo sapiens
auccagccucauaaag

SEQ ID NO: 584424 - RNA, 19 nt, Homo sapiens
auccagccucccacaagaa

SEQ ID NO: 584425 - RNA, 18 nt, Homo sapiens
auccagccuccugcuaac

SEQ ID NO: 584426 - RNA, 15 nt, Homo sapiens
auccagccuuuccaa

SEQ ID NO: 584427 - RNA, 19 nt, Homo sapiens
auccagccuuuccaaguca

SEQ ID NO: 584428 - RNA, 16 nt, Homo sapiens
auccagcuaugaauau

SEQ ID NO: 584429 - RNA, 15 nt, Homo sapiens
auccagcucaucccc

SEQ ID NO: 584430 - RNA, 20 nt, Homo sapiens
auccaggaucaugagacauu

SEQ ID NO: 584431 - RNA, 14 nt, Homo sapiens
auccaggcauuucu

SEQ ID NO: 584432 - RNA, 21 nt, Homo sapiens
auccaggccggcuugccacac

SEQ ID NO: 584433 - RNA, 13 nt, Homo sapiens
auccaggugccaa

SEQ ID NO: 584434 - RNA, 20 nt, Homo sapiens
auccagguuuaugaaugaca

SEQ ID NO: 584435 - RNA, 16 nt, Homo sapiens
auccagucucccaacu

SEQ ID NO: 584436 - RNA, 20 nt, Homo sapiens
auccauaaagaagcaauaaa

SEQ ID NO: 584437 - RNA, 16 nt, Homo sapiens
auccauaaauguguuc

SEQ ID NO: 584438 - RNA, 18 nt, Homo sapiens
auccauauaacaauucag

SEQ ID NO: 584439 - RNA, 19 nt, Homo sapiens
auccauauagaaaucuaga

SEQ ID NO: 584440 - RNA, 19 nt, Homo sapiens
auccauauuuuauuacugu

SEQ ID NO: 584441 - RNA, 16 nt, Homo sapiens
auccauccugcucagg

SEQ ID NO: 584442 - RNA, 18 nt, Homo sapiens
auccaucugaggcuucau

SEQ ID NO: 584443 - RNA, 18 nt, Homo sapiens
auccaucuugagccacag

SEQ ID NO: 584444 - RNA, 18 nt, Homo sapiens
auccaugcaccuaccuua

SEQ ID NO: 584445 - RNA, 12 nt, Homo sapiens
auccaugcacuu

SEQ ID NO: 584446 - RNA, 11 nt, Homo sapiens
cccaaggagcu

SEQ ID NO: 584447 - RNA, 16 nt, Homo sapiens
cccaaggaugcuguca

SEQ ID NO: 584448 - RNA, 22 nt, Homo sapiens
cccaaggccaagauuguccuuu

SEQ ID NO: 584449 - RNA, 17 nt, Homo sapiens
cccaaggccccagggac

SEQ ID NO: 584450 - RNA, 21 nt, Homo sapiens
cccaagggccucccaccagag

SEQ ID NO: 584451 - RNA, 19 nt, Homo sapiens
cccaagguucugguuccau

SEQ ID NO: 584452 - RNA, 15 nt, Homo sapiens
cccaaguaugccuua

SEQ ID NO: 584453 - RNA, 21 nt, Homo sapiens
cccaaguaugccuuaagcaga

SEQ ID NO: 584454 - RNA, 15 nt, Homo sapiens
cccaaguccucauuu

SEQ ID NO: 584455 - RNA, 15 nt, Homo sapiens
cccaauaaaggcagc

SEQ ID NO: 584456 - RNA, 13 nt, Homo sapiens
cccaaucccucuc

SEQ ID NO: 584457 - RNA, 17 nt, Homo sapiens
cccaaucugaaauucaa

SEQ ID NO: 584458 - RNA, 17 nt, Homo sapiens
cccaaucugccagacuu

SEQ ID NO: 584459 - RNA, 16 nt, Homo sapiens
cccaaugaaauacuga

SEQ ID NO: 584460 - RNA, 12 nt, Homo sapiens
cccaaugaauua

SEQ ID NO: 584461 - RNA, 16 nt, Homo sapiens
cccacaacgacuuuau

SEQ ID NO: 584462 - RNA, 20 nt, Homo sapiens
cccacaagugccacugcccg

SEQ ID NO: 584463 - RNA, 22 nt, Homo sapiens
cccacacccuggaggauuucau

SEQ ID NO: 584464 - RNA, 22 nt, Homo sapiens
cccacacgcccuccccagacuc

SEQ ID NO: 584465 - RNA, 15 nt, Homo sapiens
cccacacuguggcca

SEQ ID NO: 584466 - RNA, 14 nt, Homo sapiens
cccacagacugguu

SEQ ID NO: 584467 - RNA, 23 nt, Homo sapiens
cccacagcugagaauguggaaua

SEQ ID NO: 584468 - RNA, 16 nt, Homo sapiens
cccacaggacuuugau

SEQ ID NO: 584469 - RNA, 22 nt, Homo sapiens
cccacagugccuguacaggaag

SEQ ID NO: 584470 - RNA, 21 nt, Homo sapiens
cccacauccuucucacugcca

SEQ ID NO: 584471 - RNA, 14 nt, Homo sapiens
cccacaugggaccu

SEQ ID NO: 584472 - RNA, 13 nt, Homo sapiens
cccacauucuaua

SEQ ID NO: 584473 - RNA, 15 nt, Homo sapiens
cccaccaaugggccu

SEQ ID NO: 584474 - RNA, 22 nt, Homo sapiens
cccaccaaugggccuccagaga

SEQ ID NO: 584475 - RNA, 14 nt, Homo sapiens
cccaccaccugucc

SEQ ID NO: 584476 - RNA, 18 nt, Homo sapiens
cccaccagagugaugugu

SEQ ID NO: 584477 - RNA, 20 nt, Homo sapiens
cccaccagagugaugugugg

SEQ ID NO: 584478 - RNA, 22 nt, Homo sapiens
cccaccagcuaaggacauuucc

SEQ ID NO: 584479 - RNA, 17 nt, Homo sapiens
cccacccaacaagccau

SEQ ID NO: 584480 - RNA, 14 nt, Homo sapiens
cccacccaccuccu

SEQ ID NO: 584481 - RNA, 17 nt, Homo sapiens
cccacccccagucucca

SEQ ID NO: 584482 - RNA, 15 nt, Homo sapiens
cccacccccaguuca

SEQ ID NO: 584483 - RNA, 17 nt, Homo sapiens
cccaccccuuccaauga

SEQ ID NO: 584484 - RNA, 17 nt, Homo sapiens
cccacccgggagcagug

SEQ ID NO: 584485 - RNA, 15 nt, Homo sapiens
cccacccgucuucaa

SEQ ID NO: 584486 - RNA, 23 nt, Homo sapiens
cccacccuacgcucaucucugga

SEQ ID NO: 584487 - RNA, 17 nt, Homo sapiens
cccaccgcucaguguca

SEQ ID NO: 584488 - RNA, 16 nt, Homo sapiens
cccaccuacugcacuu

SEQ ID NO: 584489 - RNA, 21 nt, Homo sapiens
cccacgacugcccggcagggu

SEQ ID NO: 584490 - RNA, 13 nt, Homo sapiens
cccacgagggugc

SEQ ID NO: 584491 - RNA, 12 nt, Homo sapiens
cccacggcaccu

SEQ ID NO: 584492 - RNA, 18 nt, Homo sapiens
aucaaagaacagaugggg

SEQ ID NO: 584493 - RNA, 18 nt, Homo sapiens
aucaaagacucauugcuu

SEQ ID NO: 584494 - RNA, 23 nt, Homo sapiens
aucaaagauuugucacaucccua

SEQ ID NO: 584495 - RNA, 17 nt, Homo sapiens
aucaaaggacaccauuu

SEQ ID NO: 584496 - RNA, 12 nt, Homo sapiens
aucaaauacuuu

SEQ ID NO: 584497 - RNA, 18 nt, Homo sapiens
aucaaaucuccugcugau

SEQ ID NO: 584498 - RNA, 22 nt, Homo sapiens
aucaaauugugcaguacuuugu

SEQ ID NO: 584499 - RNA, 12 nt, Homo sapiens
aucaacaaagaa

SEQ ID NO: 584500 - RNA, 16 nt, Homo sapiens
aucaacaagauuucca

SEQ ID NO: 584501 - RNA, 23 nt, Homo sapiens
aucaacaagauuuccacaauucu

SEQ ID NO: 584502 - RNA, 23 nt, Homo sapiens
aucaacagaaguaucaagccaug

SEQ ID NO: 584503 - RNA, 14 nt, Homo sapiens
aucaacccacuuaa

SEQ ID NO: 584504 - RNA, 20 nt, Homo sapiens
aucaacuuguguacugauaa

SEQ ID NO: 584505 - RNA, 13 nt, Homo sapiens
aucaacuuuagcu

SEQ ID NO: 584506 - RNA, 13 nt, Homo sapiens
aucaagaagggcu

SEQ ID NO: 584507 - RNA, 12 nt, Homo sapiens
aucaagauauau

SEQ ID NO: 584508 - RNA, 22 nt, Homo sapiens
aucaagcugugagacaguggga

SEQ ID NO: 584509 - RNA, 22 nt, Homo sapiens
aucaaggaguacaaugcccaga

SEQ ID NO: 584510 - RNA, 22 nt, Homo sapiens
aucaaggucuuuggucuucucc

SEQ ID NO: 584511 - RNA, 11 nt, Homo sapiens
aucaaguaaua

SEQ ID NO: 584512 - RNA, 22 nt, Homo sapiens
aucaagucuuuuuuauauuuau

SEQ ID NO: 584513 - RNA, 12 nt, Homo sapiens
aucaagugcagu

SEQ ID NO: 584514 - RNA, 14 nt, Homo sapiens
aucaagugcagucg

SEQ ID NO: 584515 - RNA, 18 nt, Homo sapiens
aucaagugucuuccauca

SEQ ID NO: 584516 - RNA, 23 nt, Homo sapiens
aucaagugugcuuuagcuugaaa

SEQ ID NO: 584517 - RNA, 20 nt, Homo sapiens
aucaaguuguugacugugau

SEQ ID NO: 584518 - RNA, 17 nt, Homo sapiens
aucaaguuugaccagug

SEQ ID NO: 584519 - RNA, 18 nt, Homo sapiens
aucaaguuugaccagugc

SEQ ID NO: 584520 - RNA, 16 nt, Homo sapiens
aucaauacaaccagcc

SEQ ID NO: 584521 - RNA, 18 nt, Homo sapiens
aucaauaucccaacauuc

SEQ ID NO: 584522 - RNA, 19 nt, Homo sapiens
aucaauaucccaacauucu

SEQ ID NO: 584523 - RNA, 22 nt, Homo sapiens
aucaauccugggcaaucagaca

SEQ ID NO: 584524 - RNA, 22 nt, Homo sapiens
aucaaucuuguuacugcugauu

SEQ ID NO: 584525 - RNA, 18 nt, Homo sapiens
aucaaugaagcaaguaca

SEQ ID NO: 584526 - RNA, 21 nt, Homo sapiens
aucaaugcaagagugauugca

SEQ ID NO: 584527 - RNA, 11 nt, Homo sapiens
aucaaugucac

SEQ ID NO: 584528 - RNA, 13 nt, Homo sapiens
aucaaugucacuu

SEQ ID NO: 584529 - RNA, 15 nt, Homo sapiens
aucaaugucacuuaa

SEQ ID NO: 584530 - RNA, 12 nt, Homo sapiens
aucaauguuucu

SEQ ID NO: 584531 - RNA, 18 nt, Homo sapiens
aucaauuauuacauuuau

SEQ ID NO: 584532 - RNA, 18 nt, Homo sapiens
aucaauucuuagaauauc

SEQ ID NO: 584533 - RNA, 19 nt, Homo sapiens
aucaauucuuagaauaucu

SEQ ID NO: 584534 - RNA, 17 nt, Homo sapiens
aucaauuuguaauugcu

SEQ ID NO: 584535 - RNA, 14 nt, Homo sapiens
aucaauuuuuccca

SEQ ID NO: 584536 - RNA, 20 nt, Homo sapiens
aucaauuuuucccaguauuu

SEQ ID NO: 584537 - RNA, 10 nt, Homo sapiens
aucacaaaaa

SEQ ID NO: 584538 - RNA, 11 nt, Homo sapiens
aucacaacauu

SEQ ID NO: 584539 - RNA, 14 nt, Homo sapiens
aucacaccucagug

SEQ ID NO: 584540 - RNA, 15 nt, Homo sapiens
aucacaccucagugg

SEQ ID NO: 584541 - RNA, 17 nt, Homo sapiens
aucacaccucaguggga

SEQ ID NO: 584542 - RNA, 19 nt, Homo sapiens
aucacacugggugguggcc

SEQ ID NO: 584543 - RNA, 16 nt, Homo sapiens
aucacaggacauuaag

SEQ ID NO: 584544 - RNA, 23 nt, Homo sapiens
aucacagggccccagaaggcagg

SEQ ID NO: 584545 - RNA, 19 nt, Homo sapiens
aucacagucucaguucucu

SEQ ID NO: 584546 - RNA, 23 nt, Homo sapiens
aucacauucuguuuaucaagcca

SEQ ID NO: 584547 - RNA, 15 nt, Homo sapiens
aucacauucuuucca

SEQ ID NO: 584548 - RNA, 12 nt, Homo sapiens
aucacauuguuu

SEQ ID NO: 584549 - RNA, 17 nt, Homo sapiens
aucaccaaacaacuuca

SEQ ID NO: 584550 - RNA, 23 nt, Homo sapiens
aucaccacaguaaguuccuacua

SEQ ID NO: 584551 - RNA, 18 nt, Homo sapiens
aucaccaggaugucacau

SEQ ID NO: 584552 - RNA, 16 nt, Homo sapiens
aucaccaggugcaucu

SEQ ID NO: 584553 - RNA, 19 nt, Homo sapiens
aucaccauguuagccuuag

SEQ ID NO: 584554 - RNA, 18 nt, Homo sapiens
aucacccuaccaacuuua

SEQ ID NO: 584555 - RNA, 20 nt, Homo sapiens
aucacccucuuccugugauc

SEQ ID NO: 584556 - RNA, 20 nt, Homo sapiens
aucaccgugggcucccugac

SEQ ID NO: 584557 - RNA, 15 nt, Homo sapiens
aucaccucaggccag

SEQ ID NO: 584558 - RNA, 21 nt, Homo sapiens
aucaccuccccuccuugccuc

SEQ ID NO: 584559 - RNA, 16 nt, Homo sapiens
aucaccucuacugucu

SEQ ID NO: 584560 - RNA, 18 nt, Homo sapiens
aucaccugaaacacugga

SEQ ID NO: 584561 - RNA, 22 nt, Homo sapiens
aucaccuuuuugacuuuuccaa

SEQ ID NO: 584562 - RNA, 12 nt, Homo sapiens
aucacgaccacu

SEQ ID NO: 584563 - RNA, 19 nt, Homo sapiens
aucacgcuuuccugaaucc

SEQ ID NO: 584564 - RNA, 21 nt, Homo sapiens
aucacgucacugcacuccagc

SEQ ID NO: 584565 - RNA, 23 nt, Homo sapiens
aucacgucacugcacuccagcuu

SEQ ID NO: 584566 - RNA, 19 nt, Homo sapiens
aucacuaaauaaacacgau

SEQ ID NO: 584567 - RNA, 16 nt, Homo sapiens
aucacucaaccauaac

SEQ ID NO: 584568 - RNA, 20 nt, Homo sapiens
aucacucaaccauaacacuu

SEQ ID NO: 584569 - RNA, 23 nt, Homo sapiens
aucacucuaauucggauuugcca

SEQ ID NO: 584570 - RNA, 13 nt, Homo sapiens
aucacucugaguc

SEQ ID NO: 584571 - RNA, 12 nt, Homo sapiens
aucacugaacaa

SEQ ID NO: 584572 - RNA, 18 nt, Homo sapiens
aucacugaacaaacuaaa

SEQ ID NO: 584573 - RNA, 18 nt, Homo sapiens
aucacugacucugacuca

SEQ ID NO: 584574 - RNA, 23 nt, Homo sapiens
aucacugaucuaagcaguggcau

SEQ ID NO: 584575 - RNA, 14 nt, Homo sapiens
aucacugcauuuca

SEQ ID NO: 584576 - RNA, 14 nt, Homo sapiens
aucacugccacacu

SEQ ID NO: 584577 - RNA, 19 nt, Homo sapiens
aucacugccacacucucca

SEQ ID NO: 584578 - RNA, 16 nt, Homo sapiens
aucacugccaucacau

SEQ ID NO: 584579 - RNA, 19 nt, Homo sapiens
aucacuggcuggccugagc

SEQ ID NO: 584580 - RNA, 22 nt, Homo sapiens
aucacuggggggcucucaggga

SEQ ID NO: 584581 - RNA, 13 nt, Homo sapiens
aucacugucaaua

SEQ ID NO: 584582 - RNA, 14 nt, Homo sapiens
aucacugucaauau

SEQ ID NO: 584583 - RNA, 16 nt, Homo sapiens
aucacuuaaaugucac

SEQ ID NO: 584584 - RNA, 14 nt, Homo sapiens
aucacuugagguca

SEQ ID NO: 584585 - RNA, 15 nt, Homo sapiens
aucagaaaaguaauu

SEQ ID NO: 584586 - RNA, 17 nt, Homo sapiens
aucagaacugugccaca

SEQ ID NO: 584587 - RNA, 17 nt, Homo sapiens
aucagaaggacauggug

SEQ ID NO: 584588 - RNA, 19 nt, Homo sapiens
aucagaauagccacauuug

SEQ ID NO: 584589 - RNA, 18 nt, Homo sapiens
aucagaauuuguguugaa

SEQ ID NO: 584590 - RNA, 15 nt, Homo sapiens
aucagacaagcacua

SEQ ID NO: 584591 - RNA, 17 nt, Homo sapiens
aucagacuccugugcaa

SEQ ID NO: 584592 - RNA, 18 nt, Homo sapiens
aucagacuccugugcaac

SEQ ID NO: 584593 - RNA, 14 nt, Homo sapiens
aucagacucuguaa

SEQ ID NO: 584594 - RNA, 13 nt, Homo sapiens
aucagacugacag

SEQ ID NO: 584595 - RNA, 12 nt, Homo sapiens
aucagacuguag

SEQ ID NO: 584596 - RNA, 11 nt, Homo sapiens
aucagagccuu

SEQ ID NO: 584597 - RNA, 14 nt, Homo sapiens
aucagauacaucac

SEQ ID NO: 584598 - RNA, 18 nt, Homo sapiens
aucagcagagaacuggaa

SEQ ID NO: 584599 - RNA, 19 nt, Homo sapiens
aucagcaggaaugcucuga

SEQ ID NO: 584600 - RNA, 18 nt, Homo sapiens
aucagcaucucuucuucc

SEQ ID NO: 584601 - RNA, 17 nt, Homo sapiens
aucagcauuuuacuacu

SEQ ID NO: 584602 - RNA, 12 nt, Homo sapiens
aucagccaguga

SEQ ID NO: 584603 - RNA, 14 nt, Homo sapiens
aucagcccaucuca

SEQ ID NO: 584604 - RNA, 15 nt, Homo sapiens
aucagcccaucucaa

SEQ ID NO: 584605 - RNA, 20 nt, Homo sapiens
aucagccuccgccauuccaa

SEQ ID NO: 584606 - RNA, 17 nt, Homo sapiens
aucagccugcuccagcu

SEQ ID NO: 584607 - RNA, 20 nt, Homo sapiens
aucagccuuuaggucuuuag

SEQ ID NO: 584608 - RNA, 18 nt, Homo sapiens
aucagcgccgcaccagcc

SEQ ID NO: 584609 - RNA, 20 nt, Homo sapiens
aucaggaaaacaaaucacug

SEQ ID NO: 584610 - RNA, 18 nt, Homo sapiens
aucaggaauauuuuccaa

SEQ ID NO: 584611 - RNA, 19 nt, Homo sapiens
aucaggaauauuuuccaaa

SEQ ID NO: 584612 - RNA, 18 nt, Homo sapiens
aucaggacagguggugca

SEQ ID NO: 584613 - RNA, 15 nt, Homo sapiens
aucaggacccagagg

SEQ ID NO: 584614 - RNA, 21 nt, Homo sapiens
aucaggacucugacgucucuu

SEQ ID NO: 584615 - RNA, 13 nt, Homo sapiens
uugacaacauguu

SEQ ID NO: 584616 - RNA, 17 nt, Homo sapiens
uugacaaccaugagacc

SEQ ID NO: 584617 - RNA, 15 nt, Homo sapiens
uugacaauaauuuca

SEQ ID NO: 584618 - RNA, 14 nt, Homo sapiens
uugacaaucaaaga

SEQ ID NO: 584619 - RNA, 18 nt, Homo sapiens
uugacaauugggagcugc

SEQ ID NO: 584620 - RNA, 17 nt, Homo sapiens
uugacacauaugaacac

SEQ ID NO: 584621 - RNA, 19 nt, Homo sapiens
uugacacuauucacuaaaa

SEQ ID NO: 584622 - RNA, 17 nt, Homo sapiens
uugacacuuguugucca

SEQ ID NO: 584623 - RNA, 19 nt, Homo sapiens
uugacagaucaagcuguga

SEQ ID NO: 584624 - RNA, 19 nt, Homo sapiens
uugacagcuuugcugcuga

SEQ ID NO: 584625 - RNA, 14 nt, Homo sapiens
uugacauaacacua

SEQ ID NO: 584626 - RNA, 15 nt, Homo sapiens
uugacaucagcauua

SEQ ID NO: 584627 - RNA, 12 nt, Homo sapiens
uugaccaaauaa

SEQ ID NO: 584628 - RNA, 19 nt, Homo sapiens
uugaccaaauaaaguacca

SEQ ID NO: 584629 - RNA, 13 nt, Homo sapiens
uugaccacccacc

SEQ ID NO: 584630 - RNA, 16 nt, Homo sapiens
uugacccauguucccu

SEQ ID NO: 584631 - RNA, 17 nt, Homo sapiens
uugaccccuuccuccag

SEQ ID NO: 584632 - RNA, 11 nt, Homo sapiens
uugacccugca

SEQ ID NO: 584633 - RNA, 19 nt, Homo sapiens
uugacccuugcugugaauu

SEQ ID NO: 584634 - RNA, 15 nt, Homo sapiens
uugaccucagcugca

SEQ ID NO: 584635 - RNA, 22 nt, Homo sapiens
uugacuagggauucaggcugcu

SEQ ID NO: 584636 - RNA, 12 nt, Homo sapiens
uugacucaaaaa

SEQ ID NO: 584637 - RNA, 14 nt, Homo sapiens
uugacucauggcag

SEQ ID NO: 584638 - RNA, 20 nt, Homo sapiens
uugacuccuuuccaauagaa

SEQ ID NO: 584639 - RNA, 19 nt, Homo sapiens
uugacucuaaaugcaguuu

SEQ ID NO: 584640 - RNA, 22 nt, Homo sapiens
uugacuggguuucucuguauag

SEQ ID NO: 584641 - RNA, 23 nt, Homo sapiens
uugacugucacuguuccuuguca

SEQ ID NO: 584642 - RNA, 15 nt, Homo sapiens
uugacugucagcaag

SEQ ID NO: 584643 - RNA, 12 nt, Homo sapiens
uugacugugcau

SEQ ID NO: 584644 - RNA, 21 nt, Homo sapiens
uugacuuccccacugcucucu

SEQ ID NO: 584645 - RNA, 12 nt, Homo sapiens
uugacuuucuaa

SEQ ID NO: 584646 - RNA, 13 nt, Homo sapiens
uugagaaugguua

SEQ ID NO: 584647 - RNA, 16 nt, Homo sapiens
uugagaaugguuacaa

SEQ ID NO: 584648 - RNA, 17 nt, Homo sapiens
uugagaaugguuacaaa

SEQ ID NO: 584649 - RNA, 16 nt, Homo sapiens
uugagacagucucacu

SEQ ID NO: 584650 - RNA, 19 nt, Homo sapiens
uugagaccuaaucucugua

SEQ ID NO: 584651 - RNA, 16 nt, Homo sapiens
uugagacuccccaaua

SEQ ID NO: 584652 - RNA, 14 nt, Homo sapiens
uugagagccagugg

SEQ ID NO: 584653 - RNA, 12 nt, Homo sapiens
uugagauccaaa

SEQ ID NO: 584654 - RNA, 13 nt, Homo sapiens
uugagcacaaaau

SEQ ID NO: 584655 - RNA, 17 nt, Homo sapiens
uugagcacacuuuacac

SEQ ID NO: 584656 - RNA, 18 nt, Homo sapiens
uugagcaccgucauggcu

SEQ ID NO: 584657 - RNA, 16 nt, Homo sapiens
uugagcaggucucaua

SEQ ID NO: 584658 - RNA, 16 nt, Homo sapiens
uugagcaguuagcuca

SEQ ID NO: 584659 - RNA, 18 nt, Homo sapiens
uugagcaguuagcucauu

SEQ ID NO: 584660 - RNA, 19 nt, Homo sapiens
uugagccaacaacucugau

SEQ ID NO: 584661 - RNA, 22 nt, Homo sapiens
uugagccacuccuuccuucagg

SEQ ID NO: 584662 - RNA, 13 nt, Homo sapiens
uugagcucuguaa

SEQ ID NO: 584663 - RNA, 22 nt, Homo sapiens
uugagcuggauggguacagcuu

SEQ ID NO: 584664 - RNA, 14 nt, Homo sapiens
uugagcuucugggg

SEQ ID NO: 584665 - RNA, 18 nt, Homo sapiens
uugaggaaacaacagcuu

SEQ ID NO: 584666 - RNA, 14 nt, Homo sapiens
uugaggaacauuca

SEQ ID NO: 584667 - RNA, 20 nt, Homo sapiens
uugaggcaaauuaacuguau

SEQ ID NO: 584668 - RNA, 19 nt, Homo sapiens
uugaggcauuuccagacuu

SEQ ID NO: 584669 - RNA, 20 nt, Homo sapiens
uugaggccugcccucaggga

SEQ ID NO: 584670 - RNA, 12 nt, Homo sapiens
uugagggccaaa

SEQ ID NO: 584671 - RNA, 18 nt, Homo sapiens
uugagguugugggccuuc

SEQ ID NO: 584672 - RNA, 21 nt, Homo sapiens
uugagguuuccuucagacaga

SEQ ID NO: 584673 - RNA, 20 nt, Homo sapiens
uugaguccagaaguuugaga

SEQ ID NO: 584674 - RNA, 19 nt, Homo sapiens
uugagucuccauagaguaa

SEQ ID NO: 584675 - RNA, 18 nt, Homo sapiens
uugagugacagcuuucug

SEQ ID NO: 584676 - RNA, 22 nt, Homo sapiens
uugagugguaaucauauguguc

SEQ ID NO: 584677 - RNA, 22 nt, Homo sapiens
uugaguuuuuccucccagugag

SEQ ID NO: 584678 - RNA, 17 nt, Homo sapiens
uugauaagcacauuaaa

SEQ ID NO: 584679 - RNA, 13 nt, Homo sapiens
uugauacaaagua

SEQ ID NO: 584680 - RNA, 22 nt, Homo sapiens
uugauacaacauuaaggaauuu

SEQ ID NO: 584681 - RNA, 16 nt, Homo sapiens
uugauaccaccuauau

SEQ ID NO: 584682 - RNA, 13 nt, Homo sapiens
uugauaccuguag

SEQ ID NO: 584683 - RNA, 13 nt, Homo sapiens
uugauagauuucu

SEQ ID NO: 584684 - RNA, 13 nt, Homo sapiens
uugauagcugucc

SEQ ID NO: 584685 - RNA, 18 nt, Homo sapiens
uugauauaaaacucuggg

SEQ ID NO: 584686 - RNA, 11 nt, Homo sapiens
uugauaucuca

SEQ ID NO: 584687 - RNA, 12 nt, Homo sapiens
uugauaucucaa

SEQ ID NO: 584688 - RNA, 19 nt, Homo sapiens
uugauauuuauuuuuugcc

SEQ ID NO: 584689 - RNA, 21 nt, Homo sapiens
uugauauuuauuuuuugccau

SEQ ID NO: 584690 - RNA, 15 nt, Homo sapiens
uugaucaagaaugca

SEQ ID NO: 584691 - RNA, 12 nt, Homo sapiens
uugaucagugac

SEQ ID NO: 584692 - RNA, 14 nt, Homo sapiens
uugaucuacuugcc

SEQ ID NO: 584693 - RNA, 21 nt, Homo sapiens
uugaucuucagggaacugcau

SEQ ID NO: 584694 - RNA, 17 nt, Homo sapiens
uugaugacccucugacc

SEQ ID NO: 584695 - RNA, 14 nt, Homo sapiens
uugaugacuaccuc

SEQ ID NO: 584696 - RNA, 14 nt, Homo sapiens
uugauggucucaag

SEQ ID NO: 584697 - RNA, 12 nt, Homo sapiens
uugauguaucug

SEQ ID NO: 584698 - RNA, 19 nt, Homo sapiens
uugaugucaagcaaugggg

SEQ ID NO: 584699 - RNA, 20 nt, Homo sapiens
uugauguuuuacgugcaaac

SEQ ID NO: 584700 - RNA, 15 nt, Homo sapiens
uugauuagacuccua

SEQ ID NO: 584701 - RNA, 18 nt, Homo sapiens
uugauuauuugcauguua

SEQ ID NO: 584702 - RNA, 23 nt, Homo sapiens
uugauuuaaucaccacucaaaaa

SEQ ID NO: 584703 - RNA, 10 nt, Homo sapiens
uugauuucaa

SEQ ID NO: 584704 - RNA, 15 nt, Homo sapiens
uugauuucauuaaua

SEQ ID NO: 584705 - RNA, 15 nt, Homo sapiens
uugauuucuuuccag

SEQ ID NO: 584706 - RNA, 13 nt, Homo sapiens
uugauuugcucuu

SEQ ID NO: 584707 - RNA, 16 nt, Homo sapiens
uugcaaauaaaccacu

SEQ ID NO: 584708 - RNA, 16 nt, Homo sapiens
uugcaaaucuugaaau

SEQ ID NO: 584709 - RNA, 14 nt, Homo sapiens
uugcaacacacaga

SEQ ID NO: 584710 - RNA, 16 nt, Homo sapiens
uugcaacagaagcaaa

SEQ ID NO: 584711 - RNA, 14 nt, Homo sapiens
uugcaaccucgcug

SEQ ID NO: 584712 - RNA, 16 nt, Homo sapiens
uugcaacucuguaaau

SEQ ID NO: 584713 - RNA, 20 nt, Homo sapiens
uugcaagaugugaauuauug

SEQ ID NO: 584714 - RNA, 13 nt, Homo sapiens
uugcaaggcauuu

SEQ ID NO: 584715 - RNA, 13 nt, Homo sapiens
uugcaagugcugg

SEQ ID NO: 584716 - RNA, 21 nt, Homo sapiens
uugcaauaacagcugcaauuc

SEQ ID NO: 584717 - RNA, 14 nt, Homo sapiens
uugcaauguaguca

SEQ ID NO: 584718 - RNA, 17 nt, Homo sapiens
uugcaauugcucuucuc

SEQ ID NO: 584719 - RNA, 23 nt, Homo sapiens
uugcacagcucuccggucucucu

SEQ ID NO: 584720 - RNA, 22 nt, Homo sapiens
uugcacauaguagguacccaau

SEQ ID NO: 584721 - RNA, 12 nt, Homo sapiens
uugcacauuaau

SEQ ID NO: 584722 - RNA, 12 nt, Homo sapiens
uugcaccaaaga

SEQ ID NO: 584723 - RNA, 19 nt, Homo sapiens
uugcaccuaucucagccau

SEQ ID NO: 584724 - RNA, 22 nt, Homo sapiens
uugcaccucuguucauuucaca

SEQ ID NO: 584725 - RNA, 20 nt, Homo sapiens
uugcaccuguccccacccuc

SEQ ID NO: 584726 - RNA, 14 nt, Homo sapiens
uugcacugcugcau

SEQ ID NO: 584727 - RNA, 18 nt, Homo sapiens
uugcagaaaauucugugc

SEQ ID NO: 584728 - RNA, 20 nt, Homo sapiens
uugcagcagugagucucuuc

SEQ ID NO: 584729 - RNA, 21 nt, Homo sapiens
uugcagcuuauauucauccau

SEQ ID NO: 584730 - RNA, 19 nt, Homo sapiens
uugcaggaggcccaaccuc

SEQ ID NO: 584731 - RNA, 15 nt, Homo sapiens
aaaaauccuacaagg

SEQ ID NO: 584732 - RNA, 16 nt, Homo sapiens
aaaaaucucccaguga

SEQ ID NO: 584733 - RNA, 22 nt, Homo sapiens
aaaaaucuugugcuagaauacu

SEQ ID NO: 584734 - RNA, 17 nt, Homo sapiens
aaaaaugaaauccagug

SEQ ID NO: 584735 - RNA, 14 nt, Homo sapiens
aaaaaugacuaaaa

SEQ ID NO: 584736 - RNA, 12 nt, Homo sapiens
aaaaaugaguaa

SEQ ID NO: 584737 - RNA, 22 nt, Homo sapiens
aaaaaugcacaccucaugaguc

SEQ ID NO: 584738 - RNA, 17 nt, Homo sapiens
aaaaaugcucaaucuca

SEQ ID NO: 584739 - RNA, 17 nt, Homo sapiens
aaaaaugcugaacauug

SEQ ID NO: 584740 - RNA, 16 nt, Homo sapiens
aaaaauggauagcuca

SEQ ID NO: 584741 - RNA, 18 nt, Homo sapiens
aaaaaugucucaugucaa

SEQ ID NO: 584742 - RNA, 17 nt, Homo sapiens
aaaaauguugcagcuca

SEQ ID NO: 584743 - RNA, 18 nt, Homo sapiens
aaaaauguuugaguauuc

SEQ ID NO: 584744 - RNA, 19 nt, Homo sapiens
aaaaauuaacagcagucua

SEQ ID NO: 584745 - RNA, 15 nt, Homo sapiens
aaaaauuacugugaa

SEQ ID NO: 584746 - RNA, 15 nt, Homo sapiens
aaaaauuagugagua

SEQ ID NO: 584747 - RNA, 14 nt, Homo sapiens
aaaaauucacaaau

SEQ ID NO: 584748 - RNA, 23 nt, Homo sapiens
aaaaauucuagauuaccaugaag

SEQ ID NO: 584749 - RNA, 16 nt, Homo sapiens
aaaaauucugaaugua

SEQ ID NO: 584750 - RNA, 20 nt, Homo sapiens
aaaaauucuguuguuccauu

SEQ ID NO: 584751 - RNA, 12 nt, Homo sapiens
aaaaauugauua

SEQ ID NO: 584752 - RNA, 23 nt, Homo sapiens
aaaaauugcucuuggcugugaaa

SEQ ID NO: 584753 - RNA, 15 nt, Homo sapiens
aaaacaaaaccaagc

SEQ ID NO: 584754 - RNA, 11 nt, Homo sapiens
aaaacaaacuc

SEQ ID NO: 584755 - RNA, 18 nt, Homo sapiens
aaaacaaaggagcauuaa

SEQ ID NO: 584756 - RNA, 20 nt, Homo sapiens
aaaacaaaugggaaaauguc

SEQ ID NO: 584757 - RNA, 20 nt, Homo sapiens
aaaacaaguuuagaaagcug

SEQ ID NO: 584758 - RNA, 13 nt, Homo sapiens
aaaacaauaauuu

SEQ ID NO: 584759 - RNA, 13 nt, Homo sapiens
aaaacacacauac

SEQ ID NO: 584760 - RNA, 16 nt, Homo sapiens
aaaacacagccucccu

SEQ ID NO: 584761 - RNA, 15 nt, Homo sapiens
aaaacacaucuuucc

SEQ ID NO: 584762 - RNA, 22 nt, Homo sapiens
aaaacaccacuaauuguguaca

SEQ ID NO: 584763 - RNA, 19 nt, Homo sapiens
aaaacaccgcuucugccuu

SEQ ID NO: 584764 - RNA, 17 nt, Homo sapiens
aaaacaccuagcuuuau

SEQ ID NO: 584765 - RNA, 22 nt, Homo sapiens
aaaacacugaaaaauauuccaa

SEQ ID NO: 584766 - RNA, 11 nt, Homo sapiens
aaaacacugcc

SEQ ID NO: 584767 - RNA, 11 nt, Homo sapiens
aaaacacugug

SEQ ID NO: 584768 - RNA, 13 nt, Homo sapiens
aaaacacugugga

SEQ ID NO: 584769 - RNA, 12 nt, Homo sapiens
aaaacacuuuca

SEQ ID NO: 584770 - RNA, 16 nt, Homo sapiens
aaaacagaauuugaga

SEQ ID NO: 584771 - RNA, 19 nt, Homo sapiens
aaaacagagggcugcauuc

SEQ ID NO: 584772 - RNA, 14 nt, Homo sapiens
aaaacagaugucag

SEQ ID NO: 584773 - RNA, 18 nt, Homo sapiens
aaaacagauuguuugcaa

SEQ ID NO: 584774 - RNA, 22 nt, Homo sapiens
aaaacagcagcucauagaauuu

SEQ ID NO: 584775 - RNA, 20 nt, Homo sapiens
aaaacagcccccacuccagu

SEQ ID NO: 584776 - RNA, 18 nt, Homo sapiens
aaaacagccucacagaag

SEQ ID NO: 584777 - RNA, 20 nt, Homo sapiens
aaaacagucuacauugagca

SEQ ID NO: 584778 - RNA, 19 nt, Homo sapiens
aaaacaguugccagugaua

SEQ ID NO: 584779 - RNA, 22 nt, Homo sapiens
aaaacaguuuuccaaauaacau

SEQ ID NO: 584780 - RNA, 17 nt, Homo sapiens
aaaacauaaaaaccaaa

SEQ ID NO: 584781 - RNA, 20 nt, Homo sapiens
aaaacauaugaccauugagu

SEQ ID NO: 584782 - RNA, 17 nt, Homo sapiens
aaaacaucccaaacuuu

SEQ ID NO: 584783 - RNA, 11 nt, Homo sapiens
aaaacauucac

SEQ ID NO: 584784 - RNA, 21 nt, Homo sapiens
aaaacauuguccccaaugaau

SEQ ID NO: 584785 - RNA, 22 nt, Homo sapiens
aaaaccaaaagaacaagaauuu

SEQ ID NO: 584786 - RNA, 12 nt, Homo sapiens
aaaaccaaagag

SEQ ID NO: 584787 - RNA, 20 nt, Homo sapiens
aaaaccaaauuuguauuuaa

SEQ ID NO: 584788 - RNA, 18 nt, Homo sapiens
aaaaccacagcugggcag

SEQ ID NO: 584789 - RNA, 18 nt, Homo sapiens
aaaaccagaacaguauga

SEQ ID NO: 584790 - RNA, 17 nt, Homo sapiens
aaaaccagcgugugacu

SEQ ID NO: 584791 - RNA, 19 nt, Homo sapiens
aaaaccaggccuuaucucc

SEQ ID NO: 584792 - RNA, 17 nt, Homo sapiens
aaaaccaucuugugucu

SEQ ID NO: 584793 - RNA, 14 nt, Homo sapiens
aaaacccacagaag

SEQ ID NO: 584794 - RNA, 13 nt, Homo sapiens
aaaacccagagag

SEQ ID NO: 584795 - RNA, 23 nt, Homo sapiens
aaaaccccaucucuacaaaaagc

SEQ ID NO: 584796 - RNA, 20 nt, Homo sapiens
aaaaccccaucucuacuaaa

SEQ ID NO: 584797 - RNA, 21 nt, Homo sapiens
aaaaccccaucuuuacuaaaa

SEQ ID NO: 584798 - RNA, 16 nt, Homo sapiens
aaaacccuugggccag

SEQ ID NO: 584799 - RNA, 17 nt, Homo sapiens
aaaaccuaccagccaga

SEQ ID NO: 584800 - RNA, 11 nt, Homo sapiens
aaaaccugcuu

SEQ ID NO: 584801 - RNA, 18 nt, Homo sapiens
aaaaccugugugccauuu

SEQ ID NO: 584802 - RNA, 14 nt, Homo sapiens
aaaaccuuccccag

SEQ ID NO: 584803 - RNA, 19 nt, Homo sapiens
aaaacgcaaacaugaauau

SEQ ID NO: 584804 - RNA, 22 nt, Homo sapiens
aaaacguugaauugaugaugca

SEQ ID NO: 584805 - RNA, 21 nt, Homo sapiens
aaaacuaaugaguaugaacuu

SEQ ID NO: 584806 - RNA, 21 nt, Homo sapiens
aaaacuaauguacuguacaua

SEQ ID NO: 584807 - RNA, 12 nt, Homo sapiens
aaaaaaaagccu

SEQ ID NO: 584808 - RNA, 11 nt, Homo sapiens
aaaaaaacuga

SEQ ID NO: 584809 - RNA, 14 nt, Homo sapiens
aaaaaaagaaucac

SEQ ID NO: 584810 - RNA, 13 nt, Homo sapiens
aaaaaaagucaga

SEQ ID NO: 584811 - RNA, 17 nt, Homo sapiens
aaaaaaaucaguguuua

SEQ ID NO: 584812 - RNA, 13 nt, Homo sapiens
aaaaaaaugaugc

SEQ ID NO: 584813 - RNA, 13 nt, Homo sapiens
aaaaaaauuacuu

SEQ ID NO: 584814 - RNA, 12 nt, Homo sapiens
aaaaaacagagg

SEQ ID NO: 584815 - RNA, 13 nt, Homo sapiens
aaaaaagaacaca

SEQ ID NO: 584816 - RNA, 18 nt, Homo sapiens
aaaaaagagaacaccucc

SEQ ID NO: 584817 - RNA, 14 nt, Homo sapiens
aaaaaagccuacau

SEQ ID NO: 584818 - RNA, 12 nt, Homo sapiens
aaaaaaguggaa

SEQ ID NO: 584819 - RNA, 12 nt, Homo sapiens
aaaaaaugcaca

SEQ ID NO: 584820 - RNA, 12 nt, Homo sapiens
aaaaaauuccgg

SEQ ID NO: 584821 - RNA, 14 nt, Homo sapiens
aaaaacaaauggga

SEQ ID NO: 584822 - RNA, 15 nt, Homo sapiens
aaaaacaagacugcc

SEQ ID NO: 584823 - RNA, 13 nt, Homo sapiens
aaaaacaauucca

SEQ ID NO: 584824 - RNA, 18 nt, Homo sapiens
aaaaacagaaccaaauaa

SEQ ID NO: 584825 - RNA, 15 nt, Homo sapiens
aaaaacaggucuuca

SEQ ID NO: 584826 - RNA, 19 nt, Homo sapiens
aaaaacaugagcaucccca

SEQ ID NO: 584827 - RNA, 11 nt, Homo sapiens
aaaaacaugua

SEQ ID NO: 584828 - RNA, 23 nt, Homo sapiens
aaaaaccaaacccagacaaccaa

SEQ ID NO: 584829 - RNA, 22 nt, Homo sapiens
aaaaaccaaacuguagcaagau

SEQ ID NO: 584830 - RNA, 18 nt, Homo sapiens
aaaaaccaauagcuuuaa

SEQ ID NO: 584831 - RNA, 23 nt, Homo sapiens
aaaaaccaucaaguugugccaaa

SEQ ID NO: 584832 - RNA, 17 nt, Homo sapiens
aaaaaccccaaacuguu

SEQ ID NO: 584833 - RNA, 20 nt, Homo sapiens
aaaaaccccguuucccugaa

SEQ ID NO: 584834 - RNA, 23 nt, Homo sapiens
aaaaaccucuaugcaaucugagu

SEQ ID NO: 584835 - RNA, 18 nt, Homo sapiens
aaaaacuaacacccaguc

SEQ ID NO: 584836 - RNA, 22 nt, Homo sapiens
aaaaacuacagcaucauugcau

SEQ ID NO: 584837 - RNA, 15 nt, Homo sapiens
aaaaacuagagcaca

SEQ ID NO: 584838 - RNA, 18 nt, Homo sapiens
aaaaacucaggcaaagaa

SEQ ID NO: 584839 - RNA, 11 nt, Homo sapiens
aaaaacugaag

SEQ ID NO: 584840 - RNA, 14 nt, Homo sapiens
aaaaacuguacugu

SEQ ID NO: 584841 - RNA, 15 nt, Homo sapiens
aaaaacuguacugug

SEQ ID NO: 584842 - RNA, 11 nt, Homo sapiens
aaaaacuuaaa

SEQ ID NO: 584843 - RNA, 12 nt, Homo sapiens
aaaaacuuccuu

SEQ ID NO: 584844 - RNA, 22 nt, Homo sapiens
aaaaacuuccuucaaucuucau

SEQ ID NO: 584845 - RNA, 12 nt, Homo sapiens
aaaaagaacaaa

SEQ ID NO: 584846 - RNA, 14 nt, Homo sapiens
aaaaagaaccaaaa

SEQ ID NO: 584847 - RNA, 17 nt, Homo sapiens
aaaaagaagcaaccuca

SEQ ID NO: 584848 - RNA, 19 nt, Homo sapiens
aaaaagagaauauacauga

SEQ ID NO: 584849 - RNA, 17 nt, Homo sapiens
aaaaagaggcauuccag

SEQ ID NO: 584850 - RNA, 19 nt, Homo sapiens
aaaaagauccugcauuuau

SEQ ID NO: 584851 - RNA, 18 nt, Homo sapiens
aaaaagaucuacauacaa

SEQ ID NO: 584852 - RNA, 20 nt, Homo sapiens
aaaaagauggcuuaugucau

SEQ ID NO: 584853 - RNA, 12 nt, Homo sapiens
aaaaagcacaaa

SEQ ID NO: 584854 - RNA, 13 nt, Homo sapiens
aaaaagcauacuu

SEQ ID NO: 584855 - RNA, 16 nt, Homo sapiens
aaaaagcaugaucuga

SEQ ID NO: 584856 - RNA, 14 nt, Homo sapiens
aaaaagccagggcu

SEQ ID NO: 584857 - RNA, 17 nt, Homo sapiens
aaaaagcuaaugugcag

SEQ ID NO: 584858 - RNA, 15 nt, Homo sapiens
aaaaagcuagcacua

SEQ ID NO: 584859 - RNA, 15 nt, Homo sapiens
aaaaaggaauacauu

SEQ ID NO: 584860 - RNA, 13 nt, Homo sapiens
aaaaaggacucug

SEQ ID NO: 584861 - RNA, 15 nt, Homo sapiens
aaaaaggacucugcu

SEQ ID NO: 584862 - RNA, 17 nt, Homo sapiens
aaaaaggacucugcuuc

SEQ ID NO: 584863 - RNA, 14 nt, Homo sapiens
aaaaaggcugugcu

SEQ ID NO: 584864 - RNA, 19 nt, Homo sapiens
aaaaagggggcugcauucu

SEQ ID NO: 584865 - RNA, 22 nt, Homo sapiens
aaaaaggucucaccacauacca

SEQ ID NO: 584866 - RNA, 17 nt, Homo sapiens
aaaaaggugccaucuca

SEQ ID NO: 584867 - RNA, 12 nt, Homo sapiens
aaaaagguuuaa

SEQ ID NO: 584868 - RNA, 21 nt, Homo sapiens
aaaaagucaccaaauagugug

SEQ ID NO: 584869 - RNA, 16 nt, Homo sapiens
aaaaagucagagacag

SEQ ID NO: 584870 - RNA, 17 nt, Homo sapiens
aaaaagucagagacaga

SEQ ID NO: 584871 - RNA, 13 nt, Homo sapiens
aaaaagugaacag

SEQ ID NO: 584872 - RNA, 13 nt, Homo sapiens
aaaaagugucuca

SEQ ID NO: 584873 - RNA, 14 nt, Homo sapiens
aaaaagugucucaa

SEQ ID NO: 584874 - RNA, 16 nt, Homo sapiens
aaaaaguuaaacauug

SEQ ID NO: 584875 - RNA, 12 nt, Homo sapiens
aaaaaguuccau

SEQ ID NO: 584876 - RNA, 19 nt, Homo sapiens
aaaaauaaaagaucuugaa

SEQ ID NO: 584877 - RNA, 17 nt, Homo sapiens
aaaaauaaguacauaua

SEQ ID NO: 584878 - RNA, 23 nt, Homo sapiens
aaaaauaaugguguccagucuuu

SEQ ID NO: 584879 - RNA, 11 nt, Homo sapiens
aaaaauacuug

SEQ ID NO: 584880 - RNA, 15 nt, Homo sapiens
aaaaauagacacucc

SEQ ID NO: 584881 - RNA, 15 nt, Homo sapiens
aaaaauagacaugua

SEQ ID NO: 584882 - RNA, 19 nt, Homo sapiens
aaaaauaggauugcuucaa

SEQ ID NO: 584883 - RNA, 14 nt, Homo sapiens
aaaaauauguacaa

SEQ ID NO: 584884 - RNA, 15 nt, Homo sapiens
aaaaauauugcuaaa

SEQ ID NO: 584885 - RNA, 15 nt, Homo sapiens
aaaaauauugcugaa

SEQ ID NO: 584886 - RNA, 19 nt, Homo sapiens
aaaaauauuguuucugcau

SEQ ID NO: 584887 - RNA, 16 nt, Homo sapiens
aaaaaucaaguuuaau

SEQ ID NO: 584888 - RNA, 15 nt, Homo sapiens
aaaaaucagugaaua

SEQ ID NO: 584889 - RNA, 11 nt, Homo sapiens
aaaaauccauu

SEQ ID NO: 584890 - RNA, 18 nt, Homo sapiens
aaaaaucccuuguucuca

SEQ ID NO: 584891 - RNA, 17 nt, Homo sapiens
uuucuccuuuaauugua

SEQ ID NO: 584892 - RNA, 21 nt, Homo sapiens
uuucuccuuuugaccaaauaa

SEQ ID NO: 584893 - RNA, 18 nt, Homo sapiens
uuucucgggugcauuuga

SEQ ID NO: 584894 - RNA, 15 nt, Homo sapiens
uuucucguuccagaa

SEQ ID NO: 584895 - RNA, 18 nt, Homo sapiens
uuucucuugaagaacuga

SEQ ID NO: 584896 - RNA, 19 nt, Homo sapiens
uuucucuugaagaacugac

SEQ ID NO: 584897 - RNA, 20 nt, Homo sapiens
uuucugaauacaaagugaug

SEQ ID NO: 584898 - RNA, 22 nt, Homo sapiens
uuucugacaggcgcaacuccuc

SEQ ID NO: 584899 - RNA, 13 nt, Homo sapiens
uuucugaguucuu

SEQ ID NO: 584900 - RNA, 14 nt, Homo sapiens
uuucugaugauguc

SEQ ID NO: 584901 - RNA, 17 nt, Homo sapiens
uuucugcaaacaccaac

SEQ ID NO: 584902 - RNA, 16 nt, Homo sapiens
uuucugcagauggaaa

SEQ ID NO: 584903 - RNA, 19 nt, Homo sapiens
uuucugcuaaaaaguccuu

SEQ ID NO: 584904 - RNA, 22 nt, Homo sapiens
uuucugcugauuaucacacauc

SEQ ID NO: 584905 - RNA, 17 nt, Homo sapiens
uuucuggaaaacugccu

SEQ ID NO: 584906 - RNA, 22 nt, Homo sapiens
uuucuggacuggcguucaccuc

SEQ ID NO: 584907 - RNA, 21 nt, Homo sapiens
uuucuggauaucaagauguua

SEQ ID NO: 584908 - RNA, 17 nt, Homo sapiens
uuucuggccugccuucg

SEQ ID NO: 584909 - RNA, 21 nt, Homo sapiens
uuucugggucuuuugcuacua

SEQ ID NO: 584910 - RNA, 16 nt, Homo sapiens
uuucugguauucacag

SEQ ID NO: 584911 - RNA, 21 nt, Homo sapiens
uuucugucagaugagaacaaa

SEQ ID NO: 584912 - RNA, 21 nt, Homo sapiens
uuucugucguuaaaaacagau

SEQ ID NO: 584913 - RNA, 19 nt, Homo sapiens
uuucugugaagcuaauaca

SEQ ID NO: 584914 - RNA, 22 nt, Homo sapiens
uuucuguggucuuacugaucuu

SEQ ID NO: 584915 - RNA, 19 nt, Homo sapiens
uuucuguuauuaacaaaca

SEQ ID NO: 584916 - RNA, 17 nt, Homo sapiens
uuucuguugccacaacc

SEQ ID NO: 584917 - RNA, 14 nt, Homo sapiens
uuucuuacauuagc

SEQ ID NO: 584918 - RNA, 22 nt, Homo sapiens
uuucuuagaauugaccaaauaa

SEQ ID NO: 584919 - RNA, 23 nt, Homo sapiens
uuucuuaguguuguggacacugc

SEQ ID NO: 584920 - RNA, 18 nt, Homo sapiens
uuucuucaguccagagaa

SEQ ID NO: 584921 - RNA, 13 nt, Homo sapiens
uuucuuccuuuga

SEQ ID NO: 584922 - RNA, 22 nt, Homo sapiens
uuucuugaacauacuugguuuc

SEQ ID NO: 584923 - RNA, 17 nt, Homo sapiens
uuucuugaaccaauaau

SEQ ID NO: 584924 - RNA, 22 nt, Homo sapiens
uuucuugccuuaaccagucucu

SEQ ID NO: 584925 - RNA, 19 nt, Homo sapiens
uuucuugcuuggaagccag

SEQ ID NO: 584926 - RNA, 13 nt, Homo sapiens
uuucuugcuuuca

SEQ ID NO: 584927 - RNA, 20 nt, Homo sapiens
uuucuugucuauaaagcauu

SEQ ID NO: 584928 - RNA, 21 nt, Homo sapiens
uuucuuguuugauuuuugaca

SEQ ID NO: 584929 - RNA, 23 nt, Homo sapiens
uuucuuucaaaaguagagcaaaa

SEQ ID NO: 584930 - RNA, 17 nt, Homo sapiens
uuucuuugcaccaaaga

SEQ ID NO: 584931 - RNA, 16 nt, Homo sapiens
uuucuuuuacagacua

SEQ ID NO: 584932 - RNA, 14 nt, Homo sapiens
uuucuuuucacaua

SEQ ID NO: 584933 - RNA, 19 nt, Homo sapiens
uuucuuuuucccaggccag

SEQ ID NO: 584934 - RNA, 17 nt, Homo sapiens
uuucuuuuuuauacuca

SEQ ID NO: 584935 - RNA, 18 nt, Homo sapiens
uuucuuuuuuauacucaa

SEQ ID NO: 584936 - RNA, 20 nt, Homo sapiens
uuugaaaaauauugcuaaaa

SEQ ID NO: 584937 - RNA, 23 nt, Homo sapiens
uuugaaaaaugagagcuguaacu

SEQ ID NO: 584938 - RNA, 23 nt, Homo sapiens
uuugaaaaugggcucaaccagaa

SEQ ID NO: 584939 - RNA, 14 nt, Homo sapiens
uuugaaacuuugaa

SEQ ID NO: 584940 - RNA, 20 nt, Homo sapiens
uuugaaauaaauuuuaauuc

SEQ ID NO: 584941 - RNA, 21 nt, Homo sapiens
uuugaaauaaauuuuaauucg

SEQ ID NO: 584942 - RNA, 20 nt, Homo sapiens
uuugaaauagucugugugaa

SEQ ID NO: 584943 - RNA, 13 nt, Homo sapiens
uuugaaaugucau

SEQ ID NO: 584944 - RNA, 16 nt, Homo sapiens
uuugaaccaacaucuu

SEQ ID NO: 584945 - RNA, 18 nt, Homo sapiens
uuugaagaacaugugaga

SEQ ID NO: 584946 - RNA, 19 nt, Homo sapiens
uuugaagacguggacuccu

SEQ ID NO: 584947 - RNA, 17 nt, Homo sapiens
uuugaagcagucuugcu

SEQ ID NO: 584948 - RNA, 18 nt, Homo sapiens
uuugaagcaucacauaaa

SEQ ID NO: 584949 - RNA, 22 nt, Homo sapiens
uuugaagcuacuguguguguga

SEQ ID NO: 584950 - RNA, 13 nt, Homo sapiens
uuugaagucagag

SEQ ID NO: 584951 - RNA, 15 nt, Homo sapiens
uuugaauacugugaa

SEQ ID NO: 584952 - RNA, 20 nt, Homo sapiens
uuugaaugagaccuggaaca

SEQ ID NO: 584953 - RNA, 15 nt, Homo sapiens
uuugaauucuugaua

SEQ ID NO: 584954 - RNA, 23 nt, Homo sapiens
uuugaauuucaguaaacaaugaa

SEQ ID NO: 584955 - RNA, 19 nt, Homo sapiens
uuugacaaaacccacuguu

SEQ ID NO: 584956 - RNA, 20 nt, Homo sapiens
uuugacacuucccaguggaa

SEQ ID NO: 584957 - RNA, 17 nt, Homo sapiens
uuugacagcugugcugu

SEQ ID NO: 584958 - RNA, 18 nt, Homo sapiens
uuugacauuaauuaugaa

SEQ ID NO: 584959 - RNA, 12 nt, Homo sapiens
uuugaccaaaua

SEQ ID NO: 584960 - RNA, 20 nt, Homo sapiens
uuugaccaaauaaaguacca

SEQ ID NO: 584961 - RNA, 18 nt, Homo sapiens
uuugacccuugcugugaa

SEQ ID NO: 584962 - RNA, 21 nt, Homo sapiens
uuugacgacagugcauuugcc

SEQ ID NO: 584963 - RNA, 22 nt, Homo sapiens
uuugacgacagugcauuugccu

SEQ ID NO: 584964 - RNA, 14 nt, Homo sapiens
uuugacugucagca

SEQ ID NO: 584965 - RNA, 14 nt, Homo sapiens
uuugacuugaauau

SEQ ID NO: 584966 - RNA, 20 nt, Homo sapiens
uuugacuuucuucugaauau

SEQ ID NO: 584967 - RNA, 14 nt, Homo sapiens
uuugagacaggaga

SEQ ID NO: 584968 - RNA, 18 nt, Homo sapiens
uuugagacagggucucac

SEQ ID NO: 584969 - RNA, 20 nt, Homo sapiens
uuugagauuaagaaugccag

SEQ ID NO: 584970 - RNA, 21 nt, Homo sapiens
uuugagcaagccgagcucucc

SEQ ID NO: 584971 - RNA, 14 nt, Homo sapiens
uuugagcacacuuu

SEQ ID NO: 584972 - RNA, 23 nt, Homo sapiens
uuugagcccacaaagccuuauca

SEQ ID NO: 584973 - RNA, 19 nt, Homo sapiens
uuugagcugagugcugaaa

SEQ ID NO: 584974 - RNA, 20 nt, Homo sapiens
uuugagcugcugacugccaa

SEQ ID NO: 584975 - RNA, 16 nt, Homo sapiens
uuugagguuuccuuca

SEQ ID NO: 584976 - RNA, 19 nt, Homo sapiens
uuugauacaagaaagcaau

SEQ ID NO: 584977 - RNA, 21 nt, Homo sapiens
uuugauaccuguaguggaacu

SEQ ID NO: 584978 - RNA, 19 nt, Homo sapiens
uuugauagggaacugggga

SEQ ID NO: 584979 - RNA, 21 nt, Homo sapiens
uuugauauacuauuuucauuc

SEQ ID NO: 584980 - RNA, 17 nt, Homo sapiens
uuugaucaagaaugcaa

SEQ ID NO: 584981 - RNA, 18 nt, Homo sapiens
uuugaucuacuugccuca

SEQ ID NO: 584982 - RNA, 15 nt, Homo sapiens
uuugaugaaacucau

SEQ ID NO: 584983 - RNA, 21 nt, Homo sapiens
uugcagugagccgagauugca

SEQ ID NO: 584984 - RNA, 17 nt, Homo sapiens
uugcaguugugauauaa

SEQ ID NO: 584985 - RNA, 15 nt, Homo sapiens
uugcaguuuugccua

SEQ ID NO: 584986 - RNA, 17 nt, Homo sapiens
uugcauacccaaaccag

SEQ ID NO: 584987 - RNA, 21 nt, Homo sapiens
uugcauauuuuuaaacaaaga

SEQ ID NO: 584988 - RNA, 22 nt, Homo sapiens
uugcauccaugcccagccaaua

SEQ ID NO: 584989 - RNA, 21 nt, Homo sapiens
uugcaucccugaaacaucuca

SEQ ID NO: 584990 - RNA, 16 nt, Homo sapiens
uugcaucgauguaauc

SEQ ID NO: 584991 - RNA, 21 nt, Homo sapiens
uugcaugaagagaagcaauuu

SEQ ID NO: 584992 - RNA, 22 nt, Homo sapiens
uugcaugauaucuucaagccug

SEQ ID NO: 584993 - RNA, 20 nt, Homo sapiens
uugcauggaaaucagccaag

SEQ ID NO: 584994 - RNA, 15 nt, Homo sapiens
uugcauguacuugaa

SEQ ID NO: 584995 - RNA, 14 nt, Homo sapiens
uugcauuaauauug

SEQ ID NO: 584996 - RNA, 10 nt, Homo sapiens
uugcauuugg

SEQ ID NO: 584997 - RNA, 14 nt, Homo sapiens
uugcauuuucacaa

SEQ ID NO: 584998 - RNA, 21 nt, Homo sapiens
uugcauuuugauaaaauuaau

SEQ ID NO: 584999 - RNA, 16 nt, Homo sapiens
uugccaaaaacaaaaa

SEQ ID NO: 585000 - RNA, 22 nt, Homo sapiens
uugccaaacagccacacugugg

SEQ ID NO: 585001 - RNA, 22 nt, Homo sapiens
uugccaauagugucauccucac

SEQ ID NO: 585002 - RNA, 16 nt, Homo sapiens
uugccacaacccuguu

SEQ ID NO: 585003 - RNA, 18 nt, Homo sapiens
uugccagagaaacuaacu

SEQ ID NO: 585004 - RNA, 18 nt, Homo sapiens
uugccaggggcauccaag

SEQ ID NO: 585005 - RNA, 15 nt, Homo sapiens
uugccauaaagucaa

SEQ ID NO: 585006 - RNA, 19 nt, Homo sapiens
uugccauuaaacuuaccug

SEQ ID NO: 585007 - RNA, 18 nt, Homo sapiens
uugccauuuguagcuuug

SEQ ID NO: 585008 - RNA, 14 nt, Homo sapiens
uugcccacauuaag

SEQ ID NO: 585009 - RNA, 21 nt, Homo sapiens
uugcccacccccaccaugcag

SEQ ID NO: 585010 - RNA, 20 nt, Homo sapiens
uugcccaggcuggucucaaa

SEQ ID NO: 585011 - RNA, 19 nt, Homo sapiens
uugcccccagauacauggu

SEQ ID NO: 585012 - RNA, 23 nt, Homo sapiens
uugcccccagauacauggugaug

SEQ ID NO: 585013 - RNA, 15 nt, Homo sapiens
uugcccuuggagcug

SEQ ID NO: 585014 - RNA, 18 nt, Homo sapiens
uugccuaacuaacuggca

SEQ ID NO: 585015 - RNA, 23 nt, Homo sapiens
uugccuaaggugcguaguccaac

SEQ ID NO: 585016 - RNA, 19 nt, Homo sapiens
uugccuaauaaacauccuu

SEQ ID NO: 585017 - RNA, 16 nt, Homo sapiens
uugccucaaguuccau

SEQ ID NO: 585018 - RNA, 15 nt, Homo sapiens
uugccucucaauugu

SEQ ID NO: 585019 - RNA, 21 nt, Homo sapiens
uugccucucuugccccuuguc

SEQ ID NO: 585020 - RNA, 15 nt, Homo sapiens
uugccucugugcugu

SEQ ID NO: 585021 - RNA, 14 nt, Homo sapiens
uugccugccauuuu

SEQ ID NO: 585022 - RNA, 16 nt, Homo sapiens
uugccuucacccauaa

SEQ ID NO: 585023 - RNA, 22 nt, Homo sapiens
uugccuucaucuucacugcaau

SEQ ID NO: 585024 - RNA, 16 nt, Homo sapiens
uugccuucuaggucac

SEQ ID NO: 585025 - RNA, 23 nt, Homo sapiens
uugccuucugguuucuuccagcc

SEQ ID NO: 585026 - RNA, 12 nt, Homo sapiens
uugccuuuccag

SEQ ID NO: 585027 - RNA, 16 nt, Homo sapiens
uugccuuugaauguua

SEQ ID NO: 585028 - RNA, 16 nt, Homo sapiens
uugcgcucucaagacc

SEQ ID NO: 585029 - RNA, 14 nt, Homo sapiens
uugcggaagccaua

SEQ ID NO: 585030 - RNA, 15 nt, Homo sapiens
uugcggaagccauag

SEQ ID NO: 585031 - RNA, 16 nt, Homo sapiens
uugcgggacagaguag

SEQ ID NO: 585032 - RNA, 13 nt, Homo sapiens
uugcguacacaga

SEQ ID NO: 585033 - RNA, 14 nt, Homo sapiens
uugcguucaaagag

SEQ ID NO: 585034 - RNA, 15 nt, Homo sapiens
uugcuaaaagauuau

SEQ ID NO: 585035 - RNA, 14 nt, Homo sapiens
uugcuaaagcacuu

SEQ ID NO: 585036 - RNA, 17 nt, Homo sapiens
uugcuaacaaugcucug

SEQ ID NO: 585037 - RNA, 13 nt, Homo sapiens
uugcuaagcauau

SEQ ID NO: 585038 - RNA, 18 nt, Homo sapiens
uugcuaagugaaagaagc

SEQ ID NO: 585039 - RNA, 14 nt, Homo sapiens
uugcuacauucuaa

SEQ ID NO: 585040 - RNA, 13 nt, Homo sapiens
uugcuaccaguau

SEQ ID NO: 585041 - RNA, 13 nt, Homo sapiens
uugcuagauuucu

SEQ ID NO: 585042 - RNA, 13 nt, Homo sapiens
uugcuagcaguaa

SEQ ID NO: 585043 - RNA, 14 nt, Homo sapiens
uugcuagccagcau

SEQ ID NO: 585044 - RNA, 18 nt, Homo sapiens
uugcuauaauaaagaagu

SEQ ID NO: 585045 - RNA, 12 nt, Homo sapiens
uugcuauauucc

SEQ ID NO: 585046 - RNA, 22 nt, Homo sapiens
uugcucccucuguuagguccau

SEQ ID NO: 585047 - RNA, 22 nt, Homo sapiens
uugcuccuggcuggggccuguu

SEQ ID NO: 585048 - RNA, 20 nt, Homo sapiens
uugcucuaugucugccuucg

SEQ ID NO: 585049 - RNA, 19 nt, Homo sapiens
uugcucucgacaguaucca

SEQ ID NO: 585050 - RNA, 14 nt, Homo sapiens
uugcucugcauuua

SEQ ID NO: 585051 - RNA, 21 nt, Homo sapiens
uugcucuuggaaagcugauga

SEQ ID NO: 585052 - RNA, 16 nt, Homo sapiens
uugcucuuucaucucu

SEQ ID NO: 585053 - RNA, 13 nt, Homo sapiens
uugcugaaaccau

SEQ ID NO: 585054 - RNA, 14 nt, Homo sapiens
uugcugacagguga

SEQ ID NO: 585055 - RNA, 12 nt, Homo sapiens
uugcugacuuua

SEQ ID NO: 585056 - RNA, 13 nt, Homo sapiens
uugcugaugcuuu

SEQ ID NO: 585057 - RNA, 21 nt, Homo sapiens
uugcugcauugauccaggaga

SEQ ID NO: 585058 - RNA, 18 nt, Homo sapiens
uugcugcuugugaucuca

SEQ ID NO: 585059 - RNA, 16 nt, Homo sapiens
uugcugucuugcccca

SEQ ID NO: 585060 - RNA, 13 nt, Homo sapiens
uugcugugagcaa

SEQ ID NO: 585061 - RNA, 23 nt, Homo sapiens
uugcuguggacuauuauuacaua

SEQ ID NO: 585062 - RNA, 17 nt, Homo sapiens
uugcugugggugcagcu

SEQ ID NO: 585063 - RNA, 20 nt, Homo sapiens
uugcugugucuccucucaga

SEQ ID NO: 585064 - RNA, 16 nt, Homo sapiens
uugcuguucacccaca

SEQ ID NO: 585065 - RNA, 15 nt, Homo sapiens
uugcuguuuacuuga

SEQ ID NO: 585066 - RNA, 17 nt, Homo sapiens
uugcuuaaaauugugag

SEQ ID NO: 585067 - RNA, 20 nt, Homo sapiens
uugcuuagccugugcuggac

SEQ ID NO: 585068 - RNA, 13 nt, Homo sapiens
uugcuucacuuug

SEQ ID NO: 585069 - RNA, 23 nt, Homo sapiens
uugcuucccggcgucccuaccuc

SEQ ID NO: 585070 - RNA, 18 nt, Homo sapiens
uugcuuccgccacucagc

SEQ ID NO: 585071 - RNA, 10 nt, Homo sapiens
uugcuucuag

SEQ ID NO: 585072 - RNA, 18 nt, Homo sapiens
uugcuucuccagugguga

SEQ ID NO: 585073 - RNA, 14 nt, Homo sapiens
uugcuucucuagcu

SEQ ID NO: 585074 - RNA, 14 nt, Homo sapiens
uugcuugagcccag

SEQ ID NO: 585075 - RNA, 12 nt, Homo sapiens
uugcuugcugaa

SEQ ID NO: 585076 - RNA, 16 nt, Homo sapiens
uugcuuggugcacaga

SEQ ID NO: 585077 - RNA, 14 nt, Homo sapiens
uugcuuuaaaguac

SEQ ID NO: 585078 - RNA, 20 nt, Homo sapiens
uugcuuuagguaucacugga

SEQ ID NO: 585079 - RNA, 15 nt, Homo sapiens
uugcuuuauuccaga

SEQ ID NO: 585080 - RNA, 16 nt, Homo sapiens
uugcuuugcugaccaa

SEQ ID NO: 585081 - RNA, 15 nt, Homo sapiens
uugcuuuuccuucag

SEQ ID NO: 585082 - RNA, 12 nt, Homo sapiens
uugcuuuugccu

SEQ ID NO: 585083 - RNA, 17 nt, Homo sapiens
uugcuuuugugaacuuu

SEQ ID NO: 585084 - RNA, 17 nt, Homo sapiens
uuggaaaaaacucugaa

SEQ ID NO: 585085 - RNA, 17 nt, Homo sapiens
uuggaaaacacuuucau

SEQ ID NO: 585086 - RNA, 13 nt, Homo sapiens
uuggaaccagacu

SEQ ID NO: 585087 - RNA, 16 nt, Homo sapiens
uuggaacggcaaaaaa

SEQ ID NO: 585088 - RNA, 23 nt, Homo sapiens
uuggaagacuuggguugaucucu

SEQ ID NO: 585089 - RNA, 12 nt, Homo sapiens
uuggaagcacug

SEQ ID NO: 585090 - RNA, 22 nt, Homo sapiens
uuggaagccagguacaggagag

SEQ ID NO: 585091 - RNA, 15 nt, Homo sapiens
uuggaaucagaauug

SEQ ID NO: 585092 - RNA, 19 nt, Homo sapiens
uuggaaucuaacgggcauu

SEQ ID NO: 585093 - RNA, 21 nt, Homo sapiens
uuggacaaguccuugaccucu

SEQ ID NO: 585094 - RNA, 19 nt, Homo sapiens
uuggacauagcgaauacaa

SEQ ID NO: 585095 - RNA, 19 nt, Homo sapiens
uuggacaugaaggaugugg

SEQ ID NO: 585096 - RNA, 12 nt, Homo sapiens
uuggacucuaaa

SEQ ID NO: 585097 - RNA, 17 nt, Homo sapiens
uuggacugauaaucucu

SEQ ID NO: 585098 - RNA, 19 nt, Homo sapiens
uuggacuguaagggauuga

SEQ ID NO: 585099 - RNA, 16 nt, Homo sapiens
uuggacuucucugaaa

SEQ ID NO: 585100 - RNA, 22 nt, Homo sapiens
uuggagagagaggcugccucag

SEQ ID NO: 585101 - RNA, 20 nt, Homo sapiens
uuggagagagauguuccucu

SEQ ID NO: 585102 - RNA, 21 nt, Homo sapiens
uuggagagcagcaggugcugu

SEQ ID NO: 585103 - RNA, 18 nt, Homo sapiens
uuggagcagcuucuggga

SEQ ID NO: 585104 - RNA, 19 nt, Homo sapiens
uuggagcagugcuuuucac

SEQ ID NO: 585105 - RNA, 16 nt, Homo sapiens
uuggagccacuccugu

SEQ ID NO: 585106 - RNA, 17 nt, Homo sapiens
uuggagcucauucuguc

SEQ ID NO: 585107 - RNA, 15 nt, Homo sapiens
uucuucacucuuuga

SEQ ID NO: 585108 - RNA, 15 nt, Homo sapiens
uucuucacuuaccca

SEQ ID NO: 585109 - RNA, 14 nt, Homo sapiens
uucuucagagacag

SEQ ID NO: 585110 - RNA, 17 nt, Homo sapiens
uucuucagggccagucc

SEQ ID NO: 585111 - RNA, 18 nt, Homo sapiens
uucuucccaguucuugac

SEQ ID NO: 585112 - RNA, 23 nt, Homo sapiens
uucuucccccacuuccccuccaa

SEQ ID NO: 585113 - RNA, 18 nt, Homo sapiens
uucuuccccuuacucuca

SEQ ID NO: 585114 - RNA, 17 nt, Homo sapiens
uucuucccuuaacucca

SEQ ID NO: 585115 - RNA, 15 nt, Homo sapiens
uucuucuacugcuau

SEQ ID NO: 585116 - RNA, 15 nt, Homo sapiens
uucuucuagugcuuu

SEQ ID NO: 585117 - RNA, 13 nt, Homo sapiens
uucuucuauucca

SEQ ID NO: 585118 - RNA, 13 nt, Homo sapiens
uucuucucuguga

SEQ ID NO: 585119 - RNA, 23 nt, Homo sapiens
uucuucuucaagacucugaacaa

SEQ ID NO: 585120 - RNA, 13 nt, Homo sapiens
uucuucuuuuugc

SEQ ID NO: 585121 - RNA, 16 nt, Homo sapiens
uucuugaaaagccuug

SEQ ID NO: 585122 - RNA, 20 nt, Homo sapiens
uucuugaagaauaaauucua

SEQ ID NO: 585123 - RNA, 19 nt, Homo sapiens
uucuugaguugucuuuugc

SEQ ID NO: 585124 - RNA, 12 nt, Homo sapiens
uucuugaucucu

SEQ ID NO: 585125 - RNA, 20 nt, Homo sapiens
uucuugccuuaaccagucuc

SEQ ID NO: 585126 - RNA, 18 nt, Homo sapiens
uucuugcuacccaugacu

SEQ ID NO: 585127 - RNA, 19 nt, Homo sapiens
uucuugcuggucuagucac

SEQ ID NO: 585128 - RNA, 20 nt, Homo sapiens
uucuugcuuucaauuacaaa

SEQ ID NO: 585129 - RNA, 15 nt, Homo sapiens
uucuuggaccaguuu

SEQ ID NO: 585130 - RNA, 20 nt, Homo sapiens
uucuuggaccccugaauuca

SEQ ID NO: 585131 - RNA, 15 nt, Homo sapiens
uucuuggugguggau

SEQ ID NO: 585132 - RNA, 17 nt, Homo sapiens
uucuugguuuuccgaca

SEQ ID NO: 585133 - RNA, 14 nt, Homo sapiens
uucuuguaucugga

SEQ ID NO: 585134 - RNA, 13 nt, Homo sapiens
uucuuguauucau

SEQ ID NO: 585135 - RNA, 20 nt, Homo sapiens
uucuuguccucauucuugcc

SEQ ID NO: 585136 - RNA, 22 nt, Homo sapiens
uucuuguguugugugaucuuga

SEQ ID NO: 585137 - RNA, 12 nt, Homo sapiens
uucuuguugcau

SEQ ID NO: 585138 - RNA, 15 nt, Homo sapiens
uucuuguugcugcau

SEQ ID NO: 585139 - RNA, 19 nt, Homo sapiens
uucuuuaaauaaaacccuu

SEQ ID NO: 585140 - RNA, 15 nt, Homo sapiens
uucuuuacaauuuca

SEQ ID NO: 585141 - RNA, 17 nt, Homo sapiens
uucuuuaccaaggauau

SEQ ID NO: 585142 - RNA, 13 nt, Homo sapiens
uucuuuauacugu

SEQ ID NO: 585143 - RNA, 18 nt, Homo sapiens
uucuuuaucgcccugaga

SEQ ID NO: 585144 - RNA, 19 nt, Homo sapiens
uucuuuauugcacuaggaa

SEQ ID NO: 585145 - RNA, 20 nt, Homo sapiens
uucuuuauuuucuucuccag

SEQ ID NO: 585146 - RNA, 22 nt, Homo sapiens
uucuuucaauauuuauuuccag

SEQ ID NO: 585147 - RNA, 18 nt, Homo sapiens
uucuuucagauguuuauu

SEQ ID NO: 585148 - RNA, 18 nt, Homo sapiens
uucuuucaugcuccuuac

SEQ ID NO: 585149 - RNA, 14 nt, Homo sapiens
uucuuuccauaaua

SEQ ID NO: 585150 - RNA, 19 nt, Homo sapiens
uucuuucggcuuucugcua

SEQ ID NO: 585151 - RNA, 12 nt, Homo sapiens
uucuuugcaaag

SEQ ID NO: 585152 - RNA, 22 nt, Homo sapiens
uucuuugcaccaaagacaucag

SEQ ID NO: 585153 - RNA, 15 nt, Homo sapiens
uucuuugcugcugcu

SEQ ID NO: 585154 - RNA, 14 nt, Homo sapiens
uucuuuggaggcag

SEQ ID NO: 585155 - RNA, 15 nt, Homo sapiens
uucuuuguaugauug

SEQ ID NO: 585156 - RNA, 13 nt, Homo sapiens
uucuuuugaacug

SEQ ID NO: 585157 - RNA, 13 nt, Homo sapiens
uucuuuugacuga

SEQ ID NO: 585158 - RNA, 16 nt, Homo sapiens
uucuuuuucuguugaa

SEQ ID NO: 585159 - RNA, 15 nt, Homo sapiens
uucuuuuuugccaaa

SEQ ID NO: 585160 - RNA, 17 nt, Homo sapiens
uugaaaaaauagaucca

SEQ ID NO: 585161 - RNA, 12 nt, Homo sapiens
uugaaaaacuaa

SEQ ID NO: 585162 - RNA, 21 nt, Homo sapiens
uugaaaaacuuuuagguuguu

SEQ ID NO: 585163 - RNA, 13 nt, Homo sapiens
uugaaaaaguaua

SEQ ID NO: 585164 - RNA, 23 nt, Homo sapiens
uugaaaaaguuuggaagcacuga

SEQ ID NO: 585165 - RNA, 18 nt, Homo sapiens
uugaaaaauggcaaagaa

SEQ ID NO: 585166 - RNA, 20 nt, Homo sapiens
uugaaaacagaaucaguguu

SEQ ID NO: 585167 - RNA, 13 nt, Homo sapiens
uugaaaaccuggc

SEQ ID NO: 585168 - RNA, 18 nt, Homo sapiens
uugaaaagaaaaccacag

SEQ ID NO: 585169 - RNA, 11 nt, Homo sapiens
uugaaaagccu

SEQ ID NO: 585170 - RNA, 15 nt, Homo sapiens
uugaaaaugggcuca

SEQ ID NO: 585171 - RNA, 20 nt, Homo sapiens
uugaaaauguauuuccugaa

SEQ ID NO: 585172 - RNA, 17 nt, Homo sapiens
uugaaaauguccaggaa

SEQ ID NO: 585173 - RNA, 14 nt, Homo sapiens
uugaaacaaacaug

SEQ ID NO: 585174 - RNA, 20 nt, Homo sapiens
uugaaacagauucaggccag

SEQ ID NO: 585175 - RNA, 17 nt, Homo sapiens
uugaaacguuaugauga

SEQ ID NO: 585176 - RNA, 16 nt, Homo sapiens
uugaaacuuugaaugu

SEQ ID NO: 585177 - RNA, 21 nt, Homo sapiens
uugaaagaaauuuggcuauaa

SEQ ID NO: 585178 - RNA, 19 nt, Homo sapiens
uugaaagagucugggaccc

SEQ ID NO: 585179 - RNA, 14 nt, Homo sapiens
uugaaagaugcagu

SEQ ID NO: 585180 - RNA, 15 nt, Homo sapiens
uugaaagaugcagug

SEQ ID NO: 585181 - RNA, 21 nt, Homo sapiens
uugaaaguuuauaugcuucua

SEQ ID NO: 585182 - RNA, 21 nt, Homo sapiens
uugaaauaccagugaaccaaa

SEQ ID NO: 585183 - RNA, 20 nt, Homo sapiens
uugaaauauaggaacuuaaa

SEQ ID NO: 585184 - RNA, 20 nt, Homo sapiens
uugaaaugauaugaccaaaa

SEQ ID NO: 585185 - RNA, 21 nt, Homo sapiens
uugaaaugaugguaaguuaau

SEQ ID NO: 585186 - RNA, 17 nt, Homo sapiens
uugaaauuaaccauaga

SEQ ID NO: 585187 - RNA, 14 nt, Homo sapiens
uugaacaaccagau

SEQ ID NO: 585188 - RNA, 19 nt, Homo sapiens
uugaacacuagucugugua

SEQ ID NO: 585189 - RNA, 15 nt, Homo sapiens
uugaacauacuucaa

SEQ ID NO: 585190 - RNA, 22 nt, Homo sapiens
uugaaccacuucccucaucucu

SEQ ID NO: 585191 - RNA, 15 nt, Homo sapiens
uugaaccagugaucc

SEQ ID NO: 585192 - RNA, 22 nt, Homo sapiens
uugaaccugugcucauuuugca

SEQ ID NO: 585193 - RNA, 18 nt, Homo sapiens
uugaacggauaagaaucu

SEQ ID NO: 585194 - RNA, 12 nt, Homo sapiens
uugaacuaugaa

SEQ ID NO: 585195 - RNA, 23 nt, Homo sapiens
uugaacuccugaccuugugaucc

SEQ ID NO: 585196 - RNA, 20 nt, Homo sapiens
uugaacucuuagugauugag

SEQ ID NO: 585197 - RNA, 17 nt, Homo sapiens
uugaacuugauugccua

SEQ ID NO: 585198 - RNA, 15 nt, Homo sapiens
uugaagaacugcacu

SEQ ID NO: 585199 - RNA, 11 nt, Homo sapiens
uugaagaccag

SEQ ID NO: 585200 - RNA, 19 nt, Homo sapiens
uugaagacguggacuccuc

SEQ ID NO: 585201 - RNA, 14 nt, Homo sapiens
uugaagagauuuua

SEQ ID NO: 585202 - RNA, 18 nt, Homo sapiens
uugaagauaguaacugua

SEQ ID NO: 585203 - RNA, 18 nt, Homo sapiens
uugaagauaucuugaaau

SEQ ID NO: 585204 - RNA, 21 nt, Homo sapiens
uugaagaugcuuguauuuuac

SEQ ID NO: 585205 - RNA, 17 nt, Homo sapiens
uugaagauuauaugaag

SEQ ID NO: 585206 - RNA, 14 nt, Homo sapiens
uugaagcagauuuc

SEQ ID NO: 585207 - RNA, 14 nt, Homo sapiens
uugaagcccaagaa

SEQ ID NO: 585208 - RNA, 16 nt, Homo sapiens
uugaagcugacucaaa

SEQ ID NO: 585209 - RNA, 15 nt, Homo sapiens
uugaaggauggauga

SEQ ID NO: 585210 - RNA, 15 nt, Homo sapiens
uugaaguagcucuuu

SEQ ID NO: 585211 - RNA, 18 nt, Homo sapiens
uugaauaaaagugcacac

SEQ ID NO: 585212 - RNA, 20 nt, Homo sapiens
uugaauaggcaaacccaaau

SEQ ID NO: 585213 - RNA, 15 nt, Homo sapiens
uugaauagucucauc

SEQ ID NO: 585214 - RNA, 19 nt, Homo sapiens
uugaauauuuguauacaca

SEQ ID NO: 585215 - RNA, 17 nt, Homo sapiens
uugaaucacaugaauua

SEQ ID NO: 585216 - RNA, 15 nt, Homo sapiens
uugaaucugagugaa

SEQ ID NO: 585217 - RNA, 16 nt, Homo sapiens
uugaaugcuaagaaug

SEQ ID NO: 585218 - RNA, 17 nt, Homo sapiens
uugaaugcugccagugu

SEQ ID NO: 585219 - RNA, 18 nt, Homo sapiens
uugaauggaaaacacaug

SEQ ID NO: 585220 - RNA, 15 nt, Homo sapiens
uugaauggguuugcu

SEQ ID NO: 585221 - RNA, 17 nt, Homo sapiens
uugaauguggucucagg

SEQ ID NO: 585222 - RNA, 21 nt, Homo sapiens
uugaaugugguuacuuccuac

SEQ ID NO: 585223 - RNA, 14 nt, Homo sapiens
uugaaugugucagg

SEQ ID NO: 585224 - RNA, 16 nt, Homo sapiens
uuaauauaucaauauu

SEQ ID NO: 585225 - RNA, 17 nt, Homo sapiens
uuaauaucaacucugaa

SEQ ID NO: 585226 - RNA, 15 nt, Homo sapiens
uuaauauccaagacu

SEQ ID NO: 585227 - RNA, 13 nt, Homo sapiens
uuaauaucuucac

SEQ ID NO: 585228 - RNA, 15 nt, Homo sapiens
uuaauaugagcuuca

SEQ ID NO: 585229 - RNA, 15 nt, Homo sapiens
uuaauaugauucuag

SEQ ID NO: 585230 - RNA, 18 nt, Homo sapiens
uuaaucaagacucuugaa

SEQ ID NO: 585231 - RNA, 16 nt, Homo sapiens
uuaaucaccacucaaa

SEQ ID NO: 585232 - RNA, 15 nt, Homo sapiens
uuaaucacuacugua

SEQ ID NO: 585233 - RNA, 21 nt, Homo sapiens
uuaaucagugaagaugcaauc

SEQ ID NO: 585234 - RNA, 15 nt, Homo sapiens
uuaaucauuauccuu

SEQ ID NO: 585235 - RNA, 17 nt, Homo sapiens
uuaauccaauauuuugc

SEQ ID NO: 585236 - RNA, 20 nt, Homo sapiens
uuaauccaauauuuugccuu

SEQ ID NO: 585237 - RNA, 21 nt, Homo sapiens
uuaauccacaucuuuacucag

SEQ ID NO: 585238 - RNA, 16 nt, Homo sapiens
uuaaucccuuugucug

SEQ ID NO: 585239 - RNA, 14 nt, Homo sapiens
uuaauccuaccuca

SEQ ID NO: 585240 - RNA, 21 nt, Homo sapiens
uuaaucuuaguguaugauuac

SEQ ID NO: 585241 - RNA, 15 nt, Homo sapiens
uuaaugacaacacuu

SEQ ID NO: 585242 - RNA, 14 nt, Homo sapiens
uuaaugacucuuuc

SEQ ID NO: 585243 - RNA, 15 nt, Homo sapiens
uuaaugagacaugaa

SEQ ID NO: 585244 - RNA, 12 nt, Homo sapiens
uuaaugagauag

SEQ ID NO: 585245 - RNA, 23 nt, Homo sapiens
uuaaugagauguuauuacuguuu

SEQ ID NO: 585246 - RNA, 16 nt, Homo sapiens
uuaaugauaaacucag

SEQ ID NO: 585247 - RNA, 21 nt, Homo sapiens
uuaauggcagcuagugccuuu

SEQ ID NO: 585248 - RNA, 16 nt, Homo sapiens
uuaauggcuaguacug

SEQ ID NO: 585249 - RNA, 20 nt, Homo sapiens
uuaauggcucaugaccugga

SEQ ID NO: 585250 - RNA, 17 nt, Homo sapiens
uuaauggggaggacaaa

SEQ ID NO: 585251 - RNA, 15 nt, Homo sapiens
uuaauggucacaaua

SEQ ID NO: 585252 - RNA, 18 nt, Homo sapiens
uuaauggugaugggguaa

SEQ ID NO: 585253 - RNA, 13 nt, Homo sapiens
uuaauguacaagu

SEQ ID NO: 585254 - RNA, 21 nt, Homo sapiens
uuaauguauuuguuugcaauu

SEQ ID NO: 585255 - RNA, 15 nt, Homo sapiens
uuaaugucagugaca

SEQ ID NO: 585256 - RNA, 17 nt, Homo sapiens
uuaauguuauaucauau

SEQ ID NO: 585257 - RNA, 15 nt, Homo sapiens
uuaauuaaagcacac

SEQ ID NO: 585258 - RNA, 12 nt, Homo sapiens
uuaauuacauaa

SEQ ID NO: 585259 - RNA, 22 nt, Homo sapiens
uuaauucacagaauagcacaaa

SEQ ID NO: 585260 - RNA, 22 nt, Homo sapiens
uuaauucaccccacacuagaaa

SEQ ID NO: 585261 - RNA, 15 nt, Homo sapiens
uuaauucaguacaac

SEQ ID NO: 585262 - RNA, 12 nt, Homo sapiens
uuaauucuagua

SEQ ID NO: 585263 - RNA, 16 nt, Homo sapiens
uuaauuguaauugcau

SEQ ID NO: 585264 - RNA, 18 nt, Homo sapiens
uuaauuguuuugcacuuu

SEQ ID NO: 585265 - RNA, 15 nt, Homo sapiens
uuaauuuaauugcuu

SEQ ID NO: 585266 - RNA, 14 nt, Homo sapiens
uuaauuuauuuugc

SEQ ID NO: 585267 - RNA, 22 nt, Homo sapiens
uuaauuuccuuuuugacacuga

SEQ ID NO: 585268 - RNA, 21 nt, Homo sapiens
uuaauuucugucaaaugcagu

SEQ ID NO: 585269 - RNA, 20 nt, Homo sapiens
uuaauuuuaaccaaaacaug

SEQ ID NO: 585270 - RNA, 19 nt, Homo sapiens
uuaauuuuuauacugacaa

SEQ ID NO: 585271 - RNA, 18 nt, Homo sapiens
uuaauuuuuauuucuucc

SEQ ID NO: 585272 - RNA, 19 nt, Homo sapiens
uuaauuuuugauacuaagc

SEQ ID NO: 585273 - RNA, 18 nt, Homo sapiens
uuaauuuuuuacuuucag

SEQ ID NO: 585274 - RNA, 19 nt, Homo sapiens
uuaauuuuuuuuacuauaa

SEQ ID NO: 585275 - RNA, 16 nt, Homo sapiens
uuacaaaccauuaccu

SEQ ID NO: 585276 - RNA, 20 nt, Homo sapiens
uuacaaaccauuaccuguac

SEQ ID NO: 585277 - RNA, 15 nt, Homo sapiens
uuacaaacugcaaua

SEQ ID NO: 585278 - RNA, 15 nt, Homo sapiens
uuacaaaguguguau

SEQ ID NO: 585279 - RNA, 15 nt, Homo sapiens
uuacaaaugugaaac

SEQ ID NO: 585280 - RNA, 23 nt, Homo sapiens
uuacaacuugaaauugcuuugcu

SEQ ID NO: 585281 - RNA, 15 nt, Homo sapiens
uuacaagcauaacau

SEQ ID NO: 585282 - RNA, 19 nt, Homo sapiens
uuacaaggcccuuuccuuu

SEQ ID NO: 585283 - RNA, 23 nt, Homo sapiens
uuacaauaaaaccuuugccacuu

SEQ ID NO: 585284 - RNA, 23 nt, Homo sapiens
uuacaaucaaaucuccugcugau

SEQ ID NO: 585285 - RNA, 14 nt, Homo sapiens
uuacaaucauugcu

SEQ ID NO: 585286 - RNA, 18 nt, Homo sapiens
uuacaauuuacaaagugu

SEQ ID NO: 585287 - RNA, 17 nt, Homo sapiens
uuacacaaauuugccug

SEQ ID NO: 585288 - RNA, 22 nt, Homo sapiens
uuacacagagaaauacaaaaua

SEQ ID NO: 585289 - RNA, 21 nt, Homo sapiens
uuacacagccuaaagcuaaaa

SEQ ID NO: 585290 - RNA, 19 nt, Homo sapiens
uuacacaguugcugucaua

SEQ ID NO: 585291 - RNA, 14 nt, Homo sapiens
uuacacaugugcug

SEQ ID NO: 585292 - RNA, 18 nt, Homo sapiens
uuacacugaucaauuuca

SEQ ID NO: 585293 - RNA, 17 nt, Homo sapiens
uuacacugugucauucu

SEQ ID NO: 585294 - RNA, 19 nt, Homo sapiens
uuacacugugucauucugu

SEQ ID NO: 585295 - RNA, 21 nt, Homo sapiens
uuacagaaaagacucugacca

SEQ ID NO: 585296 - RNA, 20 nt, Homo sapiens
uuacagagaggagaaacaca

SEQ ID NO: 585297 - RNA, 23 nt, Homo sapiens
uuacagagaggagaaacacaucu

SEQ ID NO: 585298 - RNA, 17 nt, Homo sapiens
uuacagaggacccuuac

SEQ ID NO: 585299 - RNA, 12 nt, Homo sapiens
uuacagcccagg

SEQ ID NO: 585300 - RNA, 13 nt, Homo sapiens
uuacagcuuucug

SEQ ID NO: 585301 - RNA, 17 nt, Homo sapiens
uuacaggcgugagccac

SEQ ID NO: 585302 - RNA, 21 nt, Homo sapiens
uuacaguaaucccauuuccca

SEQ ID NO: 585303 - RNA, 16 nt, Homo sapiens
uuacagugcagacagg

SEQ ID NO: 585304 - RNA, 18 nt, Homo sapiens
uuacagugccacugcaau

SEQ ID NO: 585305 - RNA, 12 nt, Homo sapiens
uuacaguuuaca

SEQ ID NO: 585306 - RNA, 16 nt, Homo sapiens
uuacaguuugagacuu

SEQ ID NO: 585307 - RNA, 22 nt, Homo sapiens
uuacauaaaaccaaguuuuacu

SEQ ID NO: 585308 - RNA, 18 nt, Homo sapiens
uuacauacaugcuuugaa

SEQ ID NO: 585309 - RNA, 23 nt, Homo sapiens
uuacauagaugauaaaagagaag

SEQ ID NO: 585310 - RNA, 18 nt, Homo sapiens
uuacauagguauauauau

SEQ ID NO: 585311 - RNA, 13 nt, Homo sapiens
uuacauauacauu

SEQ ID NO: 585312 - RNA, 16 nt, Homo sapiens
uuacaucacuuuguga

SEQ ID NO: 585313 - RNA, 17 nt, Homo sapiens
uuaccaaacauuacaaa

SEQ ID NO: 585314 - RNA, 20 nt, Homo sapiens
uuaccaaagcaucaauacaa

SEQ ID NO: 585315 - RNA, 13 nt, Homo sapiens
uuaccaaaggaua

SEQ ID NO: 585316 - RNA, 20 nt, Homo sapiens
uuaccagcuuaagaguccaa

SEQ ID NO: 585317 - RNA, 16 nt, Homo sapiens
uuaccauacugucucu

SEQ ID NO: 585318 - RNA, 18 nt, Homo sapiens
uuaccauacugucucugg

SEQ ID NO: 585319 - RNA, 10 nt, Homo sapiens
uuaccaucug

SEQ ID NO: 585320 - RNA, 15 nt, Homo sapiens
uuaccauguauguau

SEQ ID NO: 585321 - RNA, 17 nt, Homo sapiens
uuaccaugucacugugg

SEQ ID NO: 585322 - RNA, 19 nt, Homo sapiens
uuacccacacacagauaaa

SEQ ID NO: 585323 - RNA, 22 nt, Homo sapiens
uuacccagagaauauauacauu

SEQ ID NO: 585324 - RNA, 20 nt, Homo sapiens
uuacccaguauuacugcugc

SEQ ID NO: 585325 - RNA, 22 nt, Homo sapiens
uuacccgaaagcaucacugccu

SEQ ID NO: 585326 - RNA, 17 nt, Homo sapiens
uuacccucuuugcugca

SEQ ID NO: 585327 - RNA, 15 nt, Homo sapiens
uuaccgacacuguca

SEQ ID NO: 585328 - RNA, 14 nt, Homo sapiens
uuaccuaaacugag

SEQ ID NO: 585329 - RNA, 13 nt, Homo sapiens
uuaccuauacauu

SEQ ID NO: 585330 - RNA, 16 nt, Homo sapiens
uuaccuauguaacaaa

SEQ ID NO: 585331 - RNA, 18 nt, Homo sapiens
uuaccucauccaugcacu

SEQ ID NO: 585332 - RNA, 14 nt, Homo sapiens
uuaccuccuaucag

SEQ ID NO: 585333 - RNA, 17 nt, Homo sapiens
uuaccucucugggaccu

SEQ ID NO: 585334 - RNA, 22 nt, Homo sapiens
uuaccucugaguuguguuccac

SEQ ID NO: 585335 - RNA, 22 nt, Homo sapiens
uuaccugaaauaaaauucauua

SEQ ID NO: 585336 - RNA, 18 nt, Homo sapiens
uuaccuguucaguacucu

SEQ ID NO: 585337 - RNA, 23 nt, Homo sapiens
uuaccuucugcuguuuguuccag

SEQ ID NO: 585338 - RNA, 22 nt, Homo sapiens
uuaccuuuuauuuuaauguuuc

SEQ ID NO: 585339 - RNA, 22 nt, Homo sapiens
uuaaaguucucaaugcaaccau

SEQ ID NO: 585340 - RNA, 16 nt, Homo sapiens
uuaaauaaaagcacaa

SEQ ID NO: 585341 - RNA, 17 nt, Homo sapiens
uuaaauaaacuguuuuc

SEQ ID NO: 585342 - RNA, 18 nt, Homo sapiens
uuaaauaaaguuacuuga

SEQ ID NO: 585343 - RNA, 19 nt, Homo sapiens
uuaaauaauagacauacag

SEQ ID NO: 585344 - RNA, 18 nt, Homo sapiens
uuaaauaauucccuaugc

SEQ ID NO: 585345 - RNA, 15 nt, Homo sapiens
uuaaauacauaugga

SEQ ID NO: 585346 - RNA, 17 nt, Homo sapiens
uuaaauauauaauguug

SEQ ID NO: 585347 - RNA, 17 nt, Homo sapiens
uuaaauauauuguacuc

SEQ ID NO: 585348 - RNA, 21 nt, Homo sapiens
uuaaaucaacgaguacuucaa

SEQ ID NO: 585349 - RNA, 22 nt, Homo sapiens
uuaaaucaaucaggaaugaguc

SEQ ID NO: 585350 - RNA, 22 nt, Homo sapiens
uuaaaucacagauggguauuaa

SEQ ID NO: 585351 - RNA, 24 nt, Homo sapiens
uuaaaucagccguguaaccaugga

SEQ ID NO: 585352 - RNA, 18 nt, Homo sapiens
uuaaauccugaagagcau

SEQ ID NO: 585353 - RNA, 14 nt, Homo sapiens
uuaaaucuagacau

SEQ ID NO: 585354 - RNA, 17 nt, Homo sapiens
uuaaaucucaaauuuau

SEQ ID NO: 585355 - RNA, 21 nt, Homo sapiens
uuaaaucugaauaaauaauuc

SEQ ID NO: 585356 - RNA, 19 nt, Homo sapiens
uuaaaucuuuggauuugau

SEQ ID NO: 585357 - RNA, 16 nt, Homo sapiens
uuaaaugacaauuuau

SEQ ID NO: 585358 - RNA, 16 nt, Homo sapiens
uuaaaugauacaguau

SEQ ID NO: 585359 - RNA, 22 nt, Homo sapiens
uuaaaugccccccucccaacag

SEQ ID NO: 585360 - RNA, 19 nt, Homo sapiens
uuaaauggaaacagacuca

SEQ ID NO: 585361 - RNA, 22 nt, Homo sapiens
uuaaauguagcaauggcacugu

SEQ ID NO: 585362 - RNA, 13 nt, Homo sapiens
uuaaauguggaag

SEQ ID NO: 585363 - RNA, 23 nt, Homo sapiens
uuaaauguuuuuuuuaaucauca

SEQ ID NO: 585364 - RNA, 17 nt, Homo sapiens
uuaaauuacaauuuuau

SEQ ID NO: 585365 - RNA, 18 nt, Homo sapiens
uuaaauuauacuggagaa

SEQ ID NO: 585366 - RNA, 12 nt, Homo sapiens
uuaaauuccaca

SEQ ID NO: 585367 - RNA, 14 nt, Homo sapiens
uuaaauuccacaga

SEQ ID NO: 585368 - RNA, 16 nt, Homo sapiens
uuaaauuguaaaugaa

SEQ ID NO: 585369 - RNA, 18 nt, Homo sapiens
uuaaauuguuucauaucu

SEQ ID NO: 585370 - RNA, 17 nt, Homo sapiens
uuaaauuugauuuccau

SEQ ID NO: 585371 - RNA, 13 nt, Homo sapiens
uuaacaaacucuu

SEQ ID NO: 585372 - RNA, 15 nt, Homo sapiens
uuaacaaaucagauc

SEQ ID NO: 585373 - RNA, 18 nt, Homo sapiens
uuaacaaaugugcugcuu

SEQ ID NO: 585374 - RNA, 15 nt, Homo sapiens
uuaacaacaauaaca

SEQ ID NO: 585375 - RNA, 16 nt, Homo sapiens
uuaacacugcaaauaa

SEQ ID NO: 585376 - RNA, 21 nt, Homo sapiens
uuaacacuuuggacuucucug

SEQ ID NO: 585377 - RNA, 21 nt, Homo sapiens
uuaacagauggaaaaacugag

SEQ ID NO: 585378 - RNA, 15 nt, Homo sapiens
uuaacaguuuuccau

SEQ ID NO: 585379 - RNA, 15 nt, Homo sapiens
uuaacaucacugucu

SEQ ID NO: 585380 - RNA, 21 nt, Homo sapiens
uuaacauuguuuuuguauauu

SEQ ID NO: 585381 - RNA, 14 nt, Homo sapiens
uuaacauuugccuu

SEQ ID NO: 585382 - RNA, 19 nt, Homo sapiens
uuaaccaaggaggggccag

SEQ ID NO: 585383 - RNA, 20 nt, Homo sapiens
uuaaccacauuucugaaugu

SEQ ID NO: 585384 - RNA, 18 nt, Homo sapiens
uuaaccagucugaaguuu

SEQ ID NO: 585385 - RNA, 15 nt, Homo sapiens
uuaacccggagcuaa

SEQ ID NO: 585386 - RNA, 13 nt, Homo sapiens
uuaaccuuuccag

SEQ ID NO: 585387 - RNA, 13 nt, Homo sapiens
uuaacggugcuaa

SEQ ID NO: 585388 - RNA, 14 nt, Homo sapiens
uuaacggugcuaaa

SEQ ID NO: 585389 - RNA, 16 nt, Homo sapiens
uuaacuaaaugcucau

SEQ ID NO: 585390 - RNA, 20 nt, Homo sapiens
uuaacuagucuauaaugaac

SEQ ID NO: 585391 - RNA, 12 nt, Homo sapiens
uuaacucaggag

SEQ ID NO: 585392 - RNA, 15 nt, Homo sapiens
uuaacucucaagcua

SEQ ID NO: 585393 - RNA, 23 nt, Homo sapiens
uuaacugaauaccacucuguaau

SEQ ID NO: 585394 - RNA, 10 nt, Homo sapiens
uuaacuguau

SEQ ID NO: 585395 - RNA, 19 nt, Homo sapiens
uuaacuguuguagaagaca

SEQ ID NO: 585396 - RNA, 21 nt, Homo sapiens
uuaagaaauacucaugugcaa

SEQ ID NO: 585397 - RNA, 13 nt, Homo sapiens
uuaagaaauucca

SEQ ID NO: 585398 - RNA, 16 nt, Homo sapiens
uuaagaagaaacuagg

SEQ ID NO: 585399 - RNA, 23 nt, Homo sapiens
uuaagaagaaauacccacuaaca

SEQ ID NO: 585400 - RNA, 17 nt, Homo sapiens
uuaagaaugucgauuaa

SEQ ID NO: 585401 - RNA, 14 nt, Homo sapiens
uuaagacacuguga

SEQ ID NO: 585402 - RNA, 12 nt, Homo sapiens
uuaagacuaaaa

SEQ ID NO: 585403 - RNA, 17 nt, Homo sapiens
uuaagagugaagucaug

SEQ ID NO: 585404 - RNA, 23 nt, Homo sapiens
uuaagaucugacugccaaauaaa

SEQ ID NO: 585405 - RNA, 14 nt, Homo sapiens
uuaagcacuacaua

SEQ ID NO: 585406 - RNA, 14 nt, Homo sapiens
uuaagcagucucac

SEQ ID NO: 585407 - RNA, 18 nt, Homo sapiens
uuaagcauggauuuuccc

SEQ ID NO: 585408 - RNA, 23 nt, Homo sapiens
uuaagcguucauaugcucugcuu

SEQ ID NO: 585409 - RNA, 12 nt, Homo sapiens
uuaagcucaaaa

SEQ ID NO: 585410 - RNA, 18 nt, Homo sapiens
uuaagcuccaugugcaua

SEQ ID NO: 585411 - RNA, 19 nt, Homo sapiens
uuaagcuuccgccgucuca

SEQ ID NO: 585412 - RNA, 17 nt, Homo sapiens
uuaagcuuuauugugau

SEQ ID NO: 585413 - RNA, 12 nt, Homo sapiens
uuaaggagccua

SEQ ID NO: 585414 - RNA, 14 nt, Homo sapiens
uuaaggauguugcc

SEQ ID NO: 585415 - RNA, 13 nt, Homo sapiens
uuaaggcacagug

SEQ ID NO: 585416 - RNA, 14 nt, Homo sapiens
uuaaggccugaauc

SEQ ID NO: 585417 - RNA, 21 nt, Homo sapiens
uuaagguauuucgaaacugcc

SEQ ID NO: 585418 - RNA, 23 nt, Homo sapiens
uuaaguaucuuuuuucaaaaaca

SEQ ID NO: 585419 - RNA, 14 nt, Homo sapiens
uuaagucagugaca

SEQ ID NO: 585420 - RNA, 23 nt, Homo sapiens
uuaagugaaagagauuacuuaaa

SEQ ID NO: 585421 - RNA, 13 nt, Homo sapiens
uuaagugauguca

SEQ ID NO: 585422 - RNA, 21 nt, Homo sapiens
uuaagugccauuacuacugua

SEQ ID NO: 585423 - RNA, 13 nt, Homo sapiens
uuaagugcuuaca

SEQ ID NO: 585424 - RNA, 12 nt, Homo sapiens
uuaaguguaaau

SEQ ID NO: 585425 - RNA, 22 nt, Homo sapiens
uuaaguuacacauuuuucagau

SEQ ID NO: 585426 - RNA, 20 nt, Homo sapiens
uuaaguucaggcagcacauc

SEQ ID NO: 585427 - RNA, 23 nt, Homo sapiens
uuaaguucaggcagcacaucaau

SEQ ID NO: 585428 - RNA, 23 nt, Homo sapiens
uuaaguugagaacuuauguguuu

SEQ ID NO: 585429 - RNA, 14 nt, Homo sapiens
uuaaguuguauuaa

SEQ ID NO: 585430 - RNA, 22 nt, Homo sapiens
uuaaguuugaaacuaacucaua

SEQ ID NO: 585431 - RNA, 12 nt, Homo sapiens
uuaaguuuugau

SEQ ID NO: 585432 - RNA, 19 nt, Homo sapiens
uuaauaaaacaacaacaaa

SEQ ID NO: 585433 - RNA, 21 nt, Homo sapiens
uuaauaaaacugcacagugcu

SEQ ID NO: 585434 - RNA, 21 nt, Homo sapiens
uuaauaaaacuuuauguacug

SEQ ID NO: 585435 - RNA, 14 nt, Homo sapiens
uuaauaaaaguaca

SEQ ID NO: 585436 - RNA, 22 nt, Homo sapiens
uuaauaaacaugucacaauaca

SEQ ID NO: 585437 - RNA, 15 nt, Homo sapiens
uuaauaaacuacucu

SEQ ID NO: 585438 - RNA, 21 nt, Homo sapiens
uuaauaaagaauuaacagaga

SEQ ID NO: 585439 - RNA, 23 nt, Homo sapiens
uuaauaaagaugaguugguucuc

SEQ ID NO: 585440 - RNA, 16 nt, Homo sapiens
uuaauaaagcauucuu

SEQ ID NO: 585441 - RNA, 20 nt, Homo sapiens
uuaauaaagcauucuuuaac

SEQ ID NO: 585442 - RNA, 16 nt, Homo sapiens
uuaauaaaggccacag

SEQ ID NO: 585443 - RNA, 20 nt, Homo sapiens
uuaauaaauauuacagugaa

SEQ ID NO: 585444 - RNA, 13 nt, Homo sapiens
uuaauaaauugcu

SEQ ID NO: 585445 - RNA, 15 nt, Homo sapiens
uuaauaacagcuccu

SEQ ID NO: 585446 - RNA, 21 nt, Homo sapiens
uuaauaagaaacaugauguga

SEQ ID NO: 585447 - RNA, 17 nt, Homo sapiens
uuaauaagcuacuagca

SEQ ID NO: 585448 - RNA, 16 nt, Homo sapiens
uuaauaagucauugaa

SEQ ID NO: 585449 - RNA, 23 nt, Homo sapiens
uuaauaaucagcaagaauuugau

SEQ ID NO: 585450 - RNA, 13 nt, Homo sapiens
uuaauacaaagaa

SEQ ID NO: 585451 - RNA, 21 nt, Homo sapiens
uuaauacauaguguauuuugc

SEQ ID NO: 585452 - RNA, 13 nt, Homo sapiens
uuaauacauucua

SEQ ID NO: 585453 - RNA, 18 nt, Homo sapiens
uguuucacaauaccucau

SEQ ID NO: 585454 - RNA, 15 nt, Homo sapiens
uguuucacagagugu

SEQ ID NO: 585455 - RNA, 15 nt, Homo sapiens
uguuucacauugcac

SEQ ID NO: 585456 - RNA, 16 nt, Homo sapiens
uguuuccacgggucuc

SEQ ID NO: 585457 - RNA, 23 nt, Homo sapiens
uguuuccccccuuuucagaauag

SEQ ID NO: 585458 - RNA, 15 nt, Homo sapiens
uguuuccguucacau

SEQ ID NO: 585459 - RNA, 21 nt, Homo sapiens
uguuuccuucuccgaggggcu

SEQ ID NO: 585460 - RNA, 21 nt, Homo sapiens
uguuucuaaaacuaugguucc

SEQ ID NO: 585461 - RNA, 21 nt, Homo sapiens
uguuucuuucucugaggacaa

SEQ ID NO: 585462 - RNA, 14 nt, Homo sapiens
uguuugaccccagu

SEQ ID NO: 585463 - RNA, 19 nt, Homo sapiens
uguuugauaugaaguguua

SEQ ID NO: 585464 - RNA, 18 nt, Homo sapiens
uguuugauuucaacauga

SEQ ID NO: 585465 - RNA, 22 nt, Homo sapiens
uguuugcugauuauuuaugacc

SEQ ID NO: 585466 - RNA, 18 nt, Homo sapiens
uguuuggaauaaagucaa

SEQ ID NO: 585467 - RNA, 21 nt, Homo sapiens
uguuugggggacguuucucau

SEQ ID NO: 585468 - RNA, 18 nt, Homo sapiens
uguuuggguauccugccc

SEQ ID NO: 585469 - RNA, 23 nt, Homo sapiens
uguuugguaguuagccaucuaau

SEQ ID NO: 585470 - RNA, 22 nt, Homo sapiens
uguuugguggggguagagcuga

SEQ ID NO: 585471 - RNA, 16 nt, Homo sapiens
uguuuguacugugcag

SEQ ID NO: 585472 - RNA, 17 nt, Homo sapiens
uguuugucagauaugau

SEQ ID NO: 585473 - RNA, 21 nt, Homo sapiens
uguuuuaaacucuccuaguca

SEQ ID NO: 585474 - RNA, 17 nt, Homo sapiens
uguuuuaaauguacaga

SEQ ID NO: 585475 - RNA, 20 nt, Homo sapiens
uguuuuaacguucugcugcu

SEQ ID NO: 585476 - RNA, 16 nt, Homo sapiens
uguuuuaagacugaau

SEQ ID NO: 585477 - RNA, 23 nt, Homo sapiens
uguuuuaauuccaauaugaugac

SEQ ID NO: 585478 - RNA, 21 nt, Homo sapiens
uguuuuacuaaagaaagauua

SEQ ID NO: 585479 - RNA, 11 nt, Homo sapiens
uguuuucacaa

SEQ ID NO: 585480 - RNA, 15 nt, Homo sapiens
uguuuucaccauuca

SEQ ID NO: 585481 - RNA, 18 nt, Homo sapiens
uguuuucauaauaccuca

SEQ ID NO: 585482 - RNA, 22 nt, Homo sapiens
uguuuucgaaaaucaaauggua

SEQ ID NO: 585483 - RNA, 14 nt, Homo sapiens
uguuuucucuugag

SEQ ID NO: 585484 - RNA, 22 nt, Homo sapiens
uguuuucugacuaggcugauca

SEQ ID NO: 585485 - RNA, 23 nt, Homo sapiens
uguuuucuguagacucuaagaua

SEQ ID NO: 585486 - RNA, 22 nt, Homo sapiens
uguuuucuuaggcacugaggga

SEQ ID NO: 585487 - RNA, 12 nt, Homo sapiens
uguuuugacaca

SEQ ID NO: 585488 - RNA, 17 nt, Homo sapiens
uguuuugacacaccccu

SEQ ID NO: 585489 - RNA, 20 nt, Homo sapiens
uguuuugauauggguaguau

SEQ ID NO: 585490 - RNA, 20 nt, Homo sapiens
uguuuugccauguuggccag

SEQ ID NO: 585491 - RNA, 15 nt, Homo sapiens
uguuuuggcuuuaug

SEQ ID NO: 585492 - RNA, 20 nt, Homo sapiens
uguuuuguaagugcugcuau

SEQ ID NO: 585493 - RNA, 14 nt, Homo sapiens
uguuuuuaaacuaa

SEQ ID NO: 585494 - RNA, 20 nt, Homo sapiens
uguuuuuccuuuaauccagu

SEQ ID NO: 585495 - RNA, 22 nt, Homo sapiens
uguuuuucguuuuuuuggucac

SEQ ID NO: 585496 - RNA, 20 nt, Homo sapiens
uguuuuucuuuuuccacaag

SEQ ID NO: 585497 - RNA, 20 nt, Homo sapiens
uguuuuuucagucugugaaa

SEQ ID NO: 585498 - RNA, 20 nt, Homo sapiens
uuaaaaaaaaagucagagac

SEQ ID NO: 585499 - RNA, 19 nt, Homo sapiens
uuaaaaaaaacaauuccac

SEQ ID NO: 585500 - RNA, 22 nt, Homo sapiens
uuaaaaaaaauuaaaaccaauu

SEQ ID NO: 585501 - RNA, 15 nt, Homo sapiens
uuaaaaaaacugaag

SEQ ID NO: 585502 - RNA, 19 nt, Homo sapiens
uuaaaaaaagaacauaaaa

SEQ ID NO: 585503 - RNA, 17 nt, Homo sapiens
uuaaaaaaauaagaaga

SEQ ID NO: 585504 - RNA, 14 nt, Homo sapiens
uuaaaaaacuucau

SEQ ID NO: 585505 - RNA, 12 nt, Homo sapiens
uuaaaaaagccu

SEQ ID NO: 585506 - RNA, 19 nt, Homo sapiens
uuaaaaaagccuguaagag

SEQ ID NO: 585507 - RNA, 19 nt, Homo sapiens
uuaaaaaauaaaaacugac

SEQ ID NO: 585508 - RNA, 23 nt, Homo sapiens
uuaaaaacuaaaaagccaucuga

SEQ ID NO: 585509 - RNA, 13 nt, Homo sapiens
uuaaaaacuacca

SEQ ID NO: 585510 - RNA, 18 nt, Homo sapiens
uuaaaaacuaccacaugu

SEQ ID NO: 585511 - RNA, 15 nt, Homo sapiens
uuaaaaagaaugacg

SEQ ID NO: 585512 - RNA, 16 nt, Homo sapiens
uuaaaaagcacagggg

SEQ ID NO: 585513 - RNA, 17 nt, Homo sapiens
uuaaaaagucuucacuc

SEQ ID NO: 585514 - RNA, 23 nt, Homo sapiens
uuaaaaauaaaaaacauauacaa

SEQ ID NO: 585515 - RNA, 22 nt, Homo sapiens
uuaaaaauggcucaaguagaaa

SEQ ID NO: 585516 - RNA, 19 nt, Homo sapiens
uuaaaacaauucugugaca

SEQ ID NO: 585517 - RNA, 16 nt, Homo sapiens
uuaaaacagacacugg

SEQ ID NO: 585518 - RNA, 10 nt, Homo sapiens
uuaaaaccaa

SEQ ID NO: 585519 - RNA, 20 nt, Homo sapiens
uuaaaacugaguccaugaaa

SEQ ID NO: 585520 - RNA, 12 nt, Homo sapiens
uuaaaagaauuu

SEQ ID NO: 585521 - RNA, 23 nt, Homo sapiens
uuaaaagggaacacaaaacauuu

SEQ ID NO: 585522 - RNA, 15 nt, Homo sapiens
uuaaaagucauuauu

SEQ ID NO: 585523 - RNA, 19 nt, Homo sapiens
uuaaaagugacauuugucu

SEQ ID NO: 585524 - RNA, 21 nt, Homo sapiens
uuaaaaguguauuuuauucag

SEQ ID NO: 585525 - RNA, 19 nt, Homo sapiens
uuaaaaguugugauuccag

SEQ ID NO: 585526 - RNA, 18 nt, Homo sapiens
uuaaaauaaaaauuuaau

SEQ ID NO: 585527 - RNA, 14 nt, Homo sapiens
uuaaaauaagaaca

SEQ ID NO: 585528 - RNA, 22 nt, Homo sapiens
uuaaaauaaugaacacuacaga

SEQ ID NO: 585529 - RNA, 21 nt, Homo sapiens
uuaaaauaaugaauacauuuc

SEQ ID NO: 585530 - RNA, 17 nt, Homo sapiens
uuaaaauacauuuggcc

SEQ ID NO: 585531 - RNA, 14 nt, Homo sapiens
uuaaaauagcaaaa

SEQ ID NO: 585532 - RNA, 19 nt, Homo sapiens
uuaaaauagcaaaagaaga

SEQ ID NO: 585533 - RNA, 19 nt, Homo sapiens
uuaaaauagcauacugugu

SEQ ID NO: 585534 - RNA, 13 nt, Homo sapiens
uuaaaauaucucu

SEQ ID NO: 585535 - RNA, 22 nt, Homo sapiens
uuaaaauauuuaucugauuaag

SEQ ID NO: 585536 - RNA, 18 nt, Homo sapiens
uuaaaauauuugaaugaa

SEQ ID NO: 585537 - RNA, 17 nt, Homo sapiens
uuaaaaucacuauugaa

SEQ ID NO: 585538 - RNA, 16 nt, Homo sapiens
uuaaaaucacugucaa

SEQ ID NO: 585539 - RNA, 14 nt, Homo sapiens
uuaaaaugacaaaa

SEQ ID NO: 585540 - RNA, 12 nt, Homo sapiens
uuaaaaugguua

SEQ ID NO: 585541 - RNA, 12 nt, Homo sapiens
uuaaaaugugua

SEQ ID NO: 585542 - RNA, 15 nt, Homo sapiens
uuaaaauuacauucu

SEQ ID NO: 585543 - RNA, 18 nt, Homo sapiens
uuaaaauuguaaccugca

SEQ ID NO: 585544 - RNA, 15 nt, Homo sapiens
uuaaacaaaaacuag

SEQ ID NO: 585545 - RNA, 17 nt, Homo sapiens
uuaaacaaagcaguaua

SEQ ID NO: 585546 - RNA, 16 nt, Homo sapiens
uuaaacaugcuguuac

SEQ ID NO: 585547 - RNA, 16 nt, Homo sapiens
uuaaaccaagcagcuu

SEQ ID NO: 585548 - RNA, 19 nt, Homo sapiens
uuaaacccauacaauguau

SEQ ID NO: 585549 - RNA, 18 nt, Homo sapiens
uuaaaccugaacucagac

SEQ ID NO: 585550 - RNA, 12 nt, Homo sapiens
uuaaacucaggg

SEQ ID NO: 585551 - RNA, 19 nt, Homo sapiens
uuaaacucuggacacucua

SEQ ID NO: 585552 - RNA, 22 nt, Homo sapiens
uuaaacucuguuguaaguaaua

SEQ ID NO: 585553 - RNA, 20 nt, Homo sapiens
uuaaacuuucaauugucacu

SEQ ID NO: 585554 - RNA, 17 nt, Homo sapiens
uuaaacuuuuuuaacca

SEQ ID NO: 585555 - RNA, 16 nt, Homo sapiens
uuaaagaaagaagugu

SEQ ID NO: 585556 - RNA, 16 nt, Homo sapiens
uuaaagaaagaaugca

SEQ ID NO: 585557 - RNA, 14 nt, Homo sapiens
uuaaagaaccaaaa

SEQ ID NO: 585558 - RNA, 14 nt, Homo sapiens
uuaaagaagcugca

SEQ ID NO: 585559 - RNA, 15 nt, Homo sapiens
uuaaagaauaugacu

SEQ ID NO: 585560 - RNA, 11 nt, Homo sapiens
uuaaagaccaa

SEQ ID NO: 585561 - RNA, 17 nt, Homo sapiens
uuaaagacucaaggugg

SEQ ID NO: 585562 - RNA, 19 nt, Homo sapiens
uuaaagagaguuugccacu

SEQ ID NO: 585563 - RNA, 16 nt, Homo sapiens
uuaaagaugcacagaa

SEQ ID NO: 585564 - RNA, 19 nt, Homo sapiens
uuaaagauggauuugaaaa

SEQ ID NO: 585565 - RNA, 16 nt, Homo sapiens
aacacccuuucaucuc

SEQ ID NO: 585566 - RNA, 17 nt, Homo sapiens
aacacccuuucaucuca

SEQ ID NO: 585567 - RNA, 13 nt, Homo sapiens
aacaccuccucau

SEQ ID NO: 585568 - RNA, 13 nt, Homo sapiens
aacaccucugcac

SEQ ID NO: 585569 - RNA, 13 nt, Homo sapiens
aacaccugccucu

SEQ ID NO: 585570 - RNA, 14 nt, Homo sapiens
aacaccuucaucca

SEQ ID NO: 585571 - RNA, 22 nt, Homo sapiens
aacaccuucuuggcuucuggga

SEQ ID NO: 585572 - RNA, 20 nt, Homo sapiens
aacacgccuuguuccugcuc

SEQ ID NO: 585573 - RNA, 22 nt, Homo sapiens
aacacggugaaaccccaucucu

SEQ ID NO: 585574 - RNA, 22 nt, Homo sapiens
aacacuauuuccaaaagcacau

SEQ ID NO: 585575 - RNA, 24 nt, Homo sapiens
aacacucaguggcccauggcauuu

SEQ ID NO: 585576 - RNA, 15 nt, Homo sapiens
aacacucuucuugag

SEQ ID NO: 585577 - RNA, 11 nt, Homo sapiens
aacacugccuc

SEQ ID NO: 585578 - RNA, 22 nt, Homo sapiens
aacacugugauuuaucuuucaa

SEQ ID NO: 585579 - RNA, 14 nt, Homo sapiens
aacacugugcaaag

SEQ ID NO: 585580 - RNA, 18 nt, Homo sapiens
aacacuguggaacuaaua

SEQ ID NO: 585581 - RNA, 20 nt, Homo sapiens
aacacuguuggcacuuauag

SEQ ID NO: 585582 - RNA, 16 nt, Homo sapiens
aacacuuagugaucau

SEQ ID NO: 585583 - RNA, 13 nt, Homo sapiens
aacacuucugcuu

SEQ ID NO: 585584 - RNA, 16 nt, Homo sapiens
aacacuucugcuuuca

SEQ ID NO: 585585 - RNA, 23 nt, Homo sapiens
aacacuugaugccguuucuuuca

SEQ ID NO: 585586 - RNA, 20 nt, Homo sapiens
aacagaaaugaccacgugaa

SEQ ID NO: 585587 - RNA, 20 nt, Homo sapiens
aacagaaauuagaauugugu

SEQ ID NO: 585588 - RNA, 14 nt, Homo sapiens
aacagaaauuguau

SEQ ID NO: 585589 - RNA, 18 nt, Homo sapiens
aacagaaauuguauauug

SEQ ID NO: 585590 - RNA, 14 nt, Homo sapiens
aacagaacuaugga

SEQ ID NO: 585591 - RNA, 23 nt, Homo sapiens
aacagaagccugaugcugacauu

SEQ ID NO: 585592 - RNA, 19 nt, Homo sapiens
aacagaauggauugccagu

SEQ ID NO: 585593 - RNA, 16 nt, Homo sapiens
aacagacaacugguaa

SEQ ID NO: 585594 - RNA, 20 nt, Homo sapiens
aacagacaagugacuguauc

SEQ ID NO: 585595 - RNA, 16 nt, Homo sapiens
aacagacucgauucau

SEQ ID NO: 585596 - RNA, 13 nt, Homo sapiens
aacagacucucac

SEQ ID NO: 585597 - RNA, 19 nt, Homo sapiens
aacagagcaagacuccauc

SEQ ID NO: 585598 - RNA, 22 nt, Homo sapiens
aacagaggaagaauuuguuauc

SEQ ID NO: 585599 - RNA, 13 nt, Homo sapiens
aacagaggccaug

SEQ ID NO: 585600 - RNA, 16 nt, Homo sapiens
aacagagggaguuuaa

SEQ ID NO: 585601 - RNA, 19 nt, Homo sapiens
aacagagggugaaagggac

SEQ ID NO: 585602 - RNA, 13 nt, Homo sapiens
aacagauaauccc

SEQ ID NO: 585603 - RNA, 19 nt, Homo sapiens
aacagaucaggaauucuaa

SEQ ID NO: 585604 - RNA, 14 nt, Homo sapiens
aacagaucuuuacu

SEQ ID NO: 585605 - RNA, 19 nt, Homo sapiens
aacagaucuuuacucuuga

SEQ ID NO: 585606 - RNA, 22 nt, Homo sapiens
aacagauggauagucuguccaa

SEQ ID NO: 585607 - RNA, 15 nt, Homo sapiens
aacagauugaaaaga

SEQ ID NO: 585608 - RNA, 16 nt, Homo sapiens
aacagauuguuugcaa

SEQ ID NO: 585609 - RNA, 17 nt, Homo sapiens
aacagcaauggugucag

SEQ ID NO: 585610 - RNA, 18 nt, Homo sapiens
aacagcacuggcucucuc

SEQ ID NO: 585611 - RNA, 13 nt, Homo sapiens
aacagcagaacuu

SEQ ID NO: 585612 - RNA, 18 nt, Homo sapiens
aacagcagaacuucugaa

SEQ ID NO: 585613 - RNA, 14 nt, Homo sapiens
aacagcaggccauc

SEQ ID NO: 585614 - RNA, 22 nt, Homo sapiens
aacagcagucccaguauucuca

SEQ ID NO: 585615 - RNA, 19 nt, Homo sapiens
aacagcagugaucucaggg

SEQ ID NO: 585616 - RNA, 16 nt, Homo sapiens
aacagcaucaauuuuc

SEQ ID NO: 585617 - RNA, 22 nt, Homo sapiens
aacagcaucuucccaaaaccau

SEQ ID NO: 585618 - RNA, 21 nt, Homo sapiens
aacagcauucuugucacaaua

SEQ ID NO: 585619 - RNA, 23 nt, Homo sapiens
aacagccaaaacuccacagucaa

SEQ ID NO: 585620 - RNA, 20 nt, Homo sapiens
aacagccacgucagcuuuuc

SEQ ID NO: 585621 - RNA, 18 nt, Homo sapiens
aacagcccuccucugcac

SEQ ID NO: 585622 - RNA, 23 nt, Homo sapiens
aacagccuaaucccgugccccuu

SEQ ID NO: 585623 - RNA, 16 nt, Homo sapiens
aacagccugacaacau

SEQ ID NO: 585624 - RNA, 21 nt, Homo sapiens
aacagcgggagaccugugcua

SEQ ID NO: 585625 - RNA, 22 nt, Homo sapiens
aacagcgggagaccugugcuag

SEQ ID NO: 585626 - RNA, 21 nt, Homo sapiens
aacagcuauuauaucagcuuu

SEQ ID NO: 585627 - RNA, 14 nt, Homo sapiens
aacagcucugagau

SEQ ID NO: 585628 - RNA, 21 nt, Homo sapiens
aacagcucuucucccagaugu

SEQ ID NO: 585629 - RNA, 20 nt, Homo sapiens
aacagcuguaaucuaugaau

SEQ ID NO: 585630 - RNA, 19 nt, Homo sapiens
aacagcuuauugacuuaau

SEQ ID NO: 585631 - RNA, 16 nt, Homo sapiens
aacaggaaaccacuua

SEQ ID NO: 585632 - RNA, 16 nt, Homo sapiens
aacaggaaacugggaa

SEQ ID NO: 585633 - RNA, 23 nt, Homo sapiens
aacaggaaacugggaaucucaua

SEQ ID NO: 585634 - RNA, 18 nt, Homo sapiens
aacaggaaggaaccagaa

SEQ ID NO: 585635 - RNA, 12 nt, Homo sapiens
aacaggcauuug

SEQ ID NO: 585636 - RNA, 14 nt, Homo sapiens
aacaggccauugug

SEQ ID NO: 585637 - RNA, 17 nt, Homo sapiens
aacaggcuuggcaaaga

SEQ ID NO: 585638 - RNA, 22 nt, Homo sapiens
aacagggagaaguagcuaguag

SEQ ID NO: 585639 - RNA, 16 nt, Homo sapiens
aacaguagcuuugcuu

SEQ ID NO: 585640 - RNA, 18 nt, Homo sapiens
aacagugagaaagggcau

SEQ ID NO: 585641 - RNA, 13 nt, Homo sapiens
aacagugccaugu

SEQ ID NO: 585642 - RNA, 10 nt, Homo sapiens
aacagugccc

SEQ ID NO: 585643 - RNA, 13 nt, Homo sapiens
aacagugcccaag

SEQ ID NO: 585644 - RNA, 19 nt, Homo sapiens
aacaguggaaacuaugugu

SEQ ID NO: 585645 - RNA, 23 nt, Homo sapiens
aacagugggcguugggagccuag

SEQ ID NO: 585646 - RNA, 18 nt, Homo sapiens
aacaguuaccugagagau

SEQ ID NO: 585647 - RNA, 19 nt, Homo sapiens
aacaguugccagugauaau

SEQ ID NO: 585648 - RNA, 15 nt, Homo sapiens
aacaguuguuacuua

SEQ ID NO: 585649 - RNA, 15 nt, Homo sapiens
aacaguuuuacaaua

SEQ ID NO: 585650 - RNA, 21 nt, Homo sapiens
aacauaaaaaauaaaguacca

SEQ ID NO: 585651 - RNA, 20 nt, Homo sapiens
aacauaaaaucugugaauua

SEQ ID NO: 585652 - RNA, 19 nt, Homo sapiens
aacauaaagagaacucugg

SEQ ID NO: 585653 - RNA, 17 nt, Homo sapiens
aacauaagguacuagca

SEQ ID NO: 585654 - RNA, 14 nt, Homo sapiens
aacauaaugcacuu

SEQ ID NO: 585655 - RNA, 20 nt, Homo sapiens
aacauacacugugaacucaa

SEQ ID NO: 585656 - RNA, 16 nt, Homo sapiens
aacauacaugagauaa

SEQ ID NO: 585657 - RNA, 20 nt, Homo sapiens
aacauaccuaagaaguacau

SEQ ID NO: 585658 - RNA, 14 nt, Homo sapiens
aacauagcagaccu

SEQ ID NO: 585659 - RNA, 20 nt, Homo sapiens
aacauaggccugcucagccu

SEQ ID NO: 585660 - RNA, 14 nt, Homo sapiens
aacauauguccauc

SEQ ID NO: 585661 - RNA, 12 nt, Homo sapiens
aacauauuucau

SEQ ID NO: 585662 - RNA, 23 nt, Homo sapiens
aacaucaacuggggaauugaagc

SEQ ID NO: 585663 - RNA, 18 nt, Homo sapiens
aacaucacugucuugcca

SEQ ID NO: 585664 - RNA, 22 nt, Homo sapiens
aacaucacugucuugccagauu

SEQ ID NO: 585665 - RNA, 13 nt, Homo sapiens
aacaucaguuucu

SEQ ID NO: 585666 - RNA, 15 nt, Homo sapiens
aacaucauaacccau

SEQ ID NO: 585667 - RNA, 18 nt, Homo sapiens
aacaucauggacugagcu

SEQ ID NO: 585668 - RNA, 16 nt, Homo sapiens
aacaucauucuugaga

SEQ ID NO: 585669 - RNA, 17 nt, Homo sapiens
aacauccaagucuuucu

SEQ ID NO: 585670 - RNA, 20 nt, Homo sapiens
aacauccagaagguuugcac

SEQ ID NO: 585671 - RNA, 13 nt, Homo sapiens
aacauccagaucu

SEQ ID NO: 585672 - RNA, 22 nt, Homo sapiens
aacauccuacaagacacaguga

SEQ ID NO: 585673 - RNA, 15 nt, Homo sapiens
aacaucgauauguau

SEQ ID NO: 585674 - RNA, 15 nt, Homo sapiens
aacaucuacaaucag

SEQ ID NO: 585675 - RNA, 16 nt, Homo sapiens
aacaucuagcaguaaa

SEQ ID NO: 585676 - RNA, 19 nt, Homo sapiens
aacaucucaucaguaucca

SEQ ID NO: 585677 - RNA, 21 nt, Homo sapiens
aacaucuccccucucaccuca

SEQ ID NO: 585678 - RNA, 14 nt, Homo sapiens
aacaucucugggaa

SEQ ID NO: 585679 - RNA, 21 nt, Homo sapiens
aacaucuuggucagauuugaa

SEQ ID NO: 585680 - RNA, 16 nt, Homo sapiens
aacaugaaacuuguca

SEQ ID NO: 585681 - RNA, 17 nt, Homo sapiens
aacaugaaaugcuucca

SEQ ID NO: 585682 - RNA, 17 nt, Homo sapiens
aacaugaacccaaaaag

SEQ ID NO: 585683 - RNA, 23 nt, Homo sapiens
aacaugaacucuugaagucacac

SEQ ID NO: 585684 - RNA, 12 nt, Homo sapiens
aacaugaugaaa

SEQ ID NO: 585685 - RNA, 15 nt, Homo sapiens
aacaugcacauuuau

SEQ ID NO: 585686 - RNA, 20 nt, Homo sapiens
aacaugccaggccucaggga

SEQ ID NO: 585687 - RNA, 14 nt, Homo sapiens
acugggccugaugg

SEQ ID NO: 585688 - RNA, 21 nt, Homo sapiens
acugggccugcuagucuguca

SEQ ID NO: 585689 - RNA, 17 nt, Homo sapiens
acugggccuuagugggc

SEQ ID NO: 585690 - RNA, 20 nt, Homo sapiens
acugggccuuagugggccag

SEQ ID NO: 585691 - RNA, 17 nt, Homo sapiens
acugggcgucugacucc

SEQ ID NO: 585692 - RNA, 18 nt, Homo sapiens
acugggcugggccucgug

SEQ ID NO: 585693 - RNA, 17 nt, Homo sapiens
acuggggcugggagcag

SEQ ID NO: 585694 - RNA, 22 nt, Homo sapiens
acugggguggaacugagugugc

SEQ ID NO: 585695 - RNA, 15 nt, Homo sapiens
acugggucucacucc

SEQ ID NO: 585696 - RNA, 18 nt, Homo sapiens
acuggguguaaacacauc

SEQ ID NO: 585697 - RNA, 20 nt, Homo sapiens
acugguaaagccucauuuga

SEQ ID NO: 585698 - RNA, 16 nt, Homo sapiens
acugguauguguggau

SEQ ID NO: 585699 - RNA, 22 nt, Homo sapiens
acuggucacaggcaaaguccag

SEQ ID NO: 585700 - RNA, 19 nt, Homo sapiens
acuggucaccuugcacucc

SEQ ID NO: 585701 - RNA, 18 nt, Homo sapiens
acuggucagcuugcucag

SEQ ID NO: 585702 - RNA, 12 nt, Homo sapiens
acugguccaaaa

SEQ ID NO: 585703 - RNA, 21 nt, Homo sapiens
acuggucuuguggaauuggga

SEQ ID NO: 585704 - RNA, 13 nt, Homo sapiens
acuggugggccau

SEQ ID NO: 585705 - RNA, 16 nt, Homo sapiens
acuggugugagccacu

SEQ ID NO: 585706 - RNA, 16 nt, Homo sapiens
acugguucacauccua

SEQ ID NO: 585707 - RNA, 20 nt, Homo sapiens
acugguugacuuucuaauua

SEQ ID NO: 585708 - RNA, 19 nt, Homo sapiens
acugguuuggucaguuaca

SEQ ID NO: 585709 - RNA, 21 nt, Homo sapiens
acuguaauggguaauucugac

SEQ ID NO: 585710 - RNA, 18 nt, Homo sapiens
acuguaauuuucaugaua

SEQ ID NO: 585711 - RNA, 14 nt, Homo sapiens
acuguacccucgca

SEQ ID NO: 585712 - RNA, 15 nt, Homo sapiens
acuguacuacaucua

SEQ ID NO: 585713 - RNA, 23 nt, Homo sapiens
acuguacuuguagaguggugcug

SEQ ID NO: 585714 - RNA, 19 nt, Homo sapiens
acuguagaaggccagcuga

SEQ ID NO: 585715 - RNA, 12 nt, Homo sapiens
acuguagccuca

SEQ ID NO: 585716 - RNA, 16 nt, Homo sapiens
acuguaggcagggaac

SEQ ID NO: 585717 - RNA, 18 nt, Homo sapiens
acuguauauuuguaugau

SEQ ID NO: 585718 - RNA, 21 nt, Homo sapiens
acuguauuggcucugugaaaa

SEQ ID NO: 585719 - RNA, 23 nt, Homo sapiens
acugucaagaagaggaaagggag

SEQ ID NO: 585720 - RNA, 18 nt, Homo sapiens
acugucaagcugcugaaa

SEQ ID NO: 585721 - RNA, 21 nt, Homo sapiens
acugucacugccgacaucccu

SEQ ID NO: 585722 - RNA, 13 nt, Homo sapiens
acugucacuuugc

SEQ ID NO: 585723 - RNA, 14 nt, Homo sapiens
acugucaguucucu

SEQ ID NO: 585724 - RNA, 17 nt, Homo sapiens
acuguccacaucugccu

SEQ ID NO: 585725 - RNA, 17 nt, Homo sapiens
acuguccaccaguuuau

SEQ ID NO: 585726 - RNA, 15 nt, Homo sapiens
acuguccaugaagca

SEQ ID NO: 585727 - RNA, 21 nt, Homo sapiens
acugucccucaaaugacccaa

SEQ ID NO: 585728 - RNA, 19 nt, Homo sapiens
acuguccuguccugcucau

SEQ ID NO: 585729 - RNA, 21 nt, Homo sapiens
acuguccuguuuucuuaggca

SEQ ID NO: 585730 - RNA, 12 nt, Homo sapiens
acugucucaaga

SEQ ID NO: 585731 - RNA, 13 nt, Homo sapiens
acugucuccaugg

SEQ ID NO: 585732 - RNA, 21 nt, Homo sapiens
acugucucucuucucagagug

SEQ ID NO: 585733 - RNA, 21 nt, Homo sapiens
acugucugggauuaagggcaa

SEQ ID NO: 585734 - RNA, 14 nt, Homo sapiens
acugucugucucca

SEQ ID NO: 585735 - RNA, 21 nt, Homo sapiens
acugucugugaacagagagac

SEQ ID NO: 585736 - RNA, 16 nt, Homo sapiens
acugucuuccucaaaa

SEQ ID NO: 585737 - RNA, 11 nt, Homo sapiens
acugucuuuca

SEQ ID NO: 585738 - RNA, 21 nt, Homo sapiens
acugucuuucagauacauggu

SEQ ID NO: 585739 - RNA, 19 nt, Homo sapiens
acugugaaaauaguguaag

SEQ ID NO: 585740 - RNA, 20 nt, Homo sapiens
acugugagaggugacacugu

SEQ ID NO: 585741 - RNA, 14 nt, Homo sapiens
acugugagcaagga

SEQ ID NO: 585742 - RNA, 12 nt, Homo sapiens
acugugauuaga

SEQ ID NO: 585743 - RNA, 23 nt, Homo sapiens
acuguggagacuuucuguuacua

SEQ ID NO: 585744 - RNA, 21 nt, Homo sapiens
acuguggcuagugacaaauaa

SEQ ID NO: 585745 - RNA, 23 nt, Homo sapiens
acugugucauucuguuagauacu

SEQ ID NO: 585746 - RNA, 19 nt, Homo sapiens
acugugucuggcguucuca

SEQ ID NO: 585747 - RNA, 18 nt, Homo sapiens
acugugugucucguguca

SEQ ID NO: 585748 - RNA, 14 nt, Homo sapiens
acuguguguugaca

SEQ ID NO: 585749 - RNA, 16 nt, Homo sapiens
acuguguguugacacu

SEQ ID NO: 585750 - RNA, 22 nt, Homo sapiens
acuguguguuuucccaaagcac

SEQ ID NO: 585751 - RNA, 18 nt, Homo sapiens
acuguguuuaucuugaua

SEQ ID NO: 585752 - RNA, 18 nt, Homo sapiens
acuguguuucgcauuaag

SEQ ID NO: 585753 - RNA, 24 nt, Homo sapiens
acuguuacagcuuucugugcagag

SEQ ID NO: 585754 - RNA, 22 nt, Homo sapiens
acuguucaauacuguaugccuu

SEQ ID NO: 585755 - RNA, 17 nt, Homo sapiens
acuguucacacugcaga

SEQ ID NO: 585756 - RNA, 19 nt, Homo sapiens
acuguugcaaacucagugc

SEQ ID NO: 585757 - RNA, 10 nt, Homo sapiens
acuguugcau

SEQ ID NO: 585758 - RNA, 13 nt, Homo sapiens
acuguugcucaaa

SEQ ID NO: 585759 - RNA, 20 nt, Homo sapiens
acuguuggagcuacugcaaa

SEQ ID NO: 585760 - RNA, 20 nt, Homo sapiens
acuguugguuaaaugacaau

SEQ ID NO: 585761 - RNA, 20 nt, Homo sapiens
acuguuuauacacuguguaa

SEQ ID NO: 585762 - RNA, 23 nt, Homo sapiens
acuguuucaaaaauaaauuugca

SEQ ID NO: 585763 - RNA, 17 nt, Homo sapiens
acuguuucauucacugu

SEQ ID NO: 585764 - RNA, 21 nt, Homo sapiens
acuguuuccccagagcaggag

SEQ ID NO: 585765 - RNA, 18 nt, Homo sapiens
acuguuucuugcacugaa

SEQ ID NO: 585766 - RNA, 19 nt, Homo sapiens
acuguuugauauaccaaau

SEQ ID NO: 585767 - RNA, 15 nt, Homo sapiens
acuguuuuuaaucuc

SEQ ID NO: 585768 - RNA, 19 nt, Homo sapiens
acuguuuuuaauguucaca

SEQ ID NO: 585769 - RNA, 22 nt, Homo sapiens
acuguuuuugauaaaguaauaa

SEQ ID NO: 585770 - RNA, 15 nt, Homo sapiens
acuuaaaaguauuca

SEQ ID NO: 585771 - RNA, 17 nt, Homo sapiens
acuuaaauaaacaugac

SEQ ID NO: 585772 - RNA, 20 nt, Homo sapiens
acuuaacaaaacaagugcaa

SEQ ID NO: 585773 - RNA, 18 nt, Homo sapiens
acuuaacuauuaaggccu

SEQ ID NO: 585774 - RNA, 15 nt, Homo sapiens
acuuaagacugugua

SEQ ID NO: 585775 - RNA, 22 nt, Homo sapiens
acuuaagcccagugcacugaaa

SEQ ID NO: 585776 - RNA, 17 nt, Homo sapiens
acuuaaggaaguuugau

SEQ ID NO: 585777 - RNA, 20 nt, Homo sapiens
acuuaagggaaaaguucucc

SEQ ID NO: 585778 - RNA, 18 nt, Homo sapiens
acuuaagggaacugaauc

SEQ ID NO: 585779 - RNA, 23 nt, Homo sapiens
acuuaaugaaaacaaugcaguac

SEQ ID NO: 585780 - RNA, 21 nt, Homo sapiens
acuuaauguuuguaagacuua

SEQ ID NO: 585781 - RNA, 19 nt, Homo sapiens
acuuaauugccagcaaaua

SEQ ID NO: 585782 - RNA, 17 nt, Homo sapiens
acuuacauguguguaua

SEQ ID NO: 585783 - RNA, 13 nt, Homo sapiens
acuuacauuucag

SEQ ID NO: 585784 - RNA, 23 nt, Homo sapiens
acuuacuauaauuugacuugaau

SEQ ID NO: 585785 - RNA, 14 nt, Homo sapiens
acuuacuguagccu

SEQ ID NO: 585786 - RNA, 23 nt, Homo sapiens
acuuagaaauugcauuuccugac

SEQ ID NO: 585787 - RNA, 20 nt, Homo sapiens
acuuagaauccgaagggaau

SEQ ID NO: 585788 - RNA, 12 nt, Homo sapiens
acuuagacuccc

SEQ ID NO: 585789 - RNA, 15 nt, Homo sapiens
acuuagccauugaaa

SEQ ID NO: 585790 - RNA, 17 nt, Homo sapiens
acuuagcgucaagacau

SEQ ID NO: 585791 - RNA, 23 nt, Homo sapiens
acuuaggaaauggcuuugugauu

SEQ ID NO: 585792 - RNA, 18 nt, Homo sapiens
acuuagguuauuuugcuu

SEQ ID NO: 585793 - RNA, 23 nt, Homo sapiens
acuuaguccuuuaucauccuuaa

SEQ ID NO: 585794 - RNA, 14 nt, Homo sapiens
acuuauaccaaagg

SEQ ID NO: 585795 - RNA, 18 nt, Homo sapiens
acuuauaguacaugauaa

SEQ ID NO: 585796 - RNA, 22 nt, Homo sapiens
acuuauauggaaauucugcuca

SEQ ID NO: 585797 - RNA, 15 nt, Homo sapiens
acuuauauuuugauu

SEQ ID NO: 585798 - RNA, 20 nt, Homo sapiens
acuuaucacgccuacuuaag

SEQ ID NO: 585799 - RNA, 17 nt, Homo sapiens
acauguggggccagguc

SEQ ID NO: 585800 - RNA, 22 nt, Homo sapiens
acauguguuuuaauuccaauau

SEQ ID NO: 585801 - RNA, 23 nt, Homo sapiens
acauguuaagagaaugcuuugaa

SEQ ID NO: 585802 - RNA, 18 nt, Homo sapiens
acauguuacugaccagca

SEQ ID NO: 585803 - RNA, 17 nt, Homo sapiens
acauguuacugcuucau

SEQ ID NO: 585804 - RNA, 15 nt, Homo sapiens
acauguuaucaaauc

SEQ ID NO: 585805 - RNA, 15 nt, Homo sapiens
acauguucugugccu

SEQ ID NO: 585806 - RNA, 18 nt, Homo sapiens
acauguuuaaauagccua

SEQ ID NO: 585807 - RNA, 16 nt, Homo sapiens
acauuaaacacuguaa

SEQ ID NO: 585808 - RNA, 14 nt, Homo sapiens
acauuaagcacugu

SEQ ID NO: 585809 - RNA, 17 nt, Homo sapiens
acauuaaggaauuugau

SEQ ID NO: 585810 - RNA, 13 nt, Homo sapiens
acauuaaggacca

SEQ ID NO: 585811 - RNA, 21 nt, Homo sapiens
acauuacaauccugcauuguu

SEQ ID NO: 585812 - RNA, 12 nt, Homo sapiens
acauuaccaaaa

SEQ ID NO: 585813 - RNA, 13 nt, Homo sapiens
acauuaccauaua

SEQ ID NO: 585814 - RNA, 16 nt, Homo sapiens
acauuaccauauaaug

SEQ ID NO: 585815 - RNA, 20 nt, Homo sapiens
acauuauaaaaauugacaau

SEQ ID NO: 585816 - RNA, 22 nt, Homo sapiens
acauuaucgggagcagugucuu

SEQ ID NO: 585817 - RNA, 16 nt, Homo sapiens
acauuauuagcacuuc

SEQ ID NO: 585818 - RNA, 23 nt, Homo sapiens
acauuauuauguauucacuuuaa

SEQ ID NO: 585819 - RNA, 17 nt, Homo sapiens
acauuauucaucucucc

SEQ ID NO: 585820 - RNA, 22 nt, Homo sapiens
acauucacagcccagaaccaca

SEQ ID NO: 585821 - RNA, 14 nt, Homo sapiens
acauucacugcuga

SEQ ID NO: 585822 - RNA, 21 nt, Homo sapiens
acauucagugaaaaacuugua

SEQ ID NO: 585823 - RNA, 18 nt, Homo sapiens
acauucagugauaaagcu

SEQ ID NO: 585824 - RNA, 18 nt, Homo sapiens
acauucaguucccaccau

SEQ ID NO: 585825 - RNA, 22 nt, Homo sapiens
acauucauagucuuuggagaaa

SEQ ID NO: 585826 - RNA, 20 nt, Homo sapiens
acauucauuuucucaguuga

SEQ ID NO: 585827 - RNA, 20 nt, Homo sapiens
acauuccaaugcauugcuaa

SEQ ID NO: 585828 - RNA, 12 nt, Homo sapiens
acauuccagggg

SEQ ID NO: 585829 - RNA, 17 nt, Homo sapiens
acauuccauuugaagca

SEQ ID NO: 585830 - RNA, 18 nt, Homo sapiens
acauuccccucccaccuc

SEQ ID NO: 585831 - RNA, 20 nt, Homo sapiens
acauucccuugauggucuca

SEQ ID NO: 585832 - RNA, 15 nt, Homo sapiens
acauucgucacagau

SEQ ID NO: 585833 - RNA, 20 nt, Homo sapiens
acauucugaaucaagcacac

SEQ ID NO: 585834 - RNA, 23 nt, Homo sapiens
acauucugcaagcacaucugcau

SEQ ID NO: 585835 - RNA, 21 nt, Homo sapiens
acauucuuagcuguaacuuaa

SEQ ID NO: 585836 - RNA, 22 nt, Homo sapiens
acauucuuuuuucuauucaaua

SEQ ID NO: 585837 - RNA, 19 nt, Homo sapiens
acauugaaacuacacuaaa

SEQ ID NO: 585838 - RNA, 19 nt, Homo sapiens
acauugaaagagaaccagu

SEQ ID NO: 585839 - RNA, 20 nt, Homo sapiens
acauugaccaagaacugcau

SEQ ID NO: 585840 - RNA, 19 nt, Homo sapiens
acauugaguuggaaucacu

SEQ ID NO: 585841 - RNA, 19 nt, Homo sapiens
acauugaucuuuugcuaau

SEQ ID NO: 585842 - RNA, 19 nt, Homo sapiens
acauugauuuuucuauaau

SEQ ID NO: 585843 - RNA, 19 nt, Homo sapiens
acauugcagcuucaacuuu

SEQ ID NO: 585844 - RNA, 14 nt, Homo sapiens
acauugccaucacu

SEQ ID NO: 585845 - RNA, 15 nt, Homo sapiens
acauugccuguucug

SEQ ID NO: 585846 - RNA, 13 nt, Homo sapiens
acauugcugauau

SEQ ID NO: 585847 - RNA, 17 nt, Homo sapiens
acauuggaaugccuugg

SEQ ID NO: 585848 - RNA, 16 nt, Homo sapiens
acauugguucuuucau

SEQ ID NO: 585849 - RNA, 23 nt, Homo sapiens
acauuguguucccauuucagcug

SEQ ID NO: 585850 - RNA, 15 nt, Homo sapiens
acauuguuaccucua

SEQ ID NO: 585851 - RNA, 20 nt, Homo sapiens
acauuguuugucugucuuca

SEQ ID NO: 585852 - RNA, 18 nt, Homo sapiens
acauuguuuuuguauauu

SEQ ID NO: 585853 - RNA, 14 nt, Homo sapiens
acauuuaaauucca

SEQ ID NO: 585854 - RNA, 16 nt, Homo sapiens
acauuuaaauuccaca

SEQ ID NO: 585855 - RNA, 17 nt, Homo sapiens
acauuuacauagugcaa

SEQ ID NO: 585856 - RNA, 15 nt, Homo sapiens
acauuuaucacugaa

SEQ ID NO: 585857 - RNA, 23 nt, Homo sapiens
acauuucaaaauuaauagcuuuu

SEQ ID NO: 585858 - RNA, 16 nt, Homo sapiens
acauuucacugaugcu

SEQ ID NO: 585859 - RNA, 17 nt, Homo sapiens
acauuucagaaauucca

SEQ ID NO: 585860 - RNA, 24 nt, Homo sapiens
acauuucauuguacaaguauuaca

SEQ ID NO: 585861 - RNA, 17 nt, Homo sapiens
acauuuccaaaugaacu

SEQ ID NO: 585862 - RNA, 13 nt, Homo sapiens
acauuuccuuaca

SEQ ID NO: 585863 - RNA, 16 nt, Homo sapiens
acauuucuaaaccaga

SEQ ID NO: 585864 - RNA, 12 nt, Homo sapiens
acauuugcccaa

SEQ ID NO: 585865 - RNA, 18 nt, Homo sapiens
acauuugcccaauuccag

SEQ ID NO: 585866 - RNA, 16 nt, Homo sapiens
acauuugcuguuuuaa

SEQ ID NO: 585867 - RNA, 15 nt, Homo sapiens
acauuugucagugau

SEQ ID NO: 585868 - RNA, 21 nt, Homo sapiens
acauuuguuucccccacaguu

SEQ ID NO: 585869 - RNA, 21 nt, Homo sapiens
acauuuuaauuuuaguuucau

SEQ ID NO: 585870 - RNA, 23 nt, Homo sapiens
acauuuuaauuuuaguuucauga

SEQ ID NO: 585871 - RNA, 15 nt, Homo sapiens
acauuuuacuacuga

SEQ ID NO: 585872 - RNA, 18 nt, Homo sapiens
acauuuuauuaagcuuuu

SEQ ID NO: 585873 - RNA, 19 nt, Homo sapiens
acauuuucguccuguagca

SEQ ID NO: 585874 - RNA, 23 nt, Homo sapiens
acauuuuuaaagguacacuggua

SEQ ID NO: 585875 - RNA, 23 nt, Homo sapiens
acauuuuuauaaaaaugagugcu

SEQ ID NO: 585876 - RNA, 20 nt, Homo sapiens
acauuuuuauuuaguugaaa

SEQ ID NO: 585877 - RNA, 17 nt, Homo sapiens
acauuuuucaacauuuu

SEQ ID NO: 585878 - RNA, 16 nt, Homo sapiens
acauuuuuguacuaac

SEQ ID NO: 585879 - RNA, 15 nt, Homo sapiens
acauuuuuuaccaaa

SEQ ID NO: 585880 - RNA, 23 nt, Homo sapiens
acauuuuuugggcagcaauuuaa

SEQ ID NO: 585881 - RNA, 21 nt, Homo sapiens
acauuuuuuucuaugcauaaa

SEQ ID NO: 585882 - RNA, 15 nt, Homo sapiens
accaaaaaaccucac

SEQ ID NO: 585883 - RNA, 16 nt, Homo sapiens
accaaaacuaguucaa

SEQ ID NO: 585884 - RNA, 22 nt, Homo sapiens
accaaaaguuacauguuugcac

SEQ ID NO: 585885 - RNA, 18 nt, Homo sapiens
accaaaauagucuucuca

SEQ ID NO: 585886 - RNA, 15 nt, Homo sapiens
accaaaauccgacug

SEQ ID NO: 585887 - RNA, 21 nt, Homo sapiens
accaaaauguauaaauguuau

SEQ ID NO: 585888 - RNA, 15 nt, Homo sapiens
accaaacuacuucau

SEQ ID NO: 585889 - RNA, 14 nt, Homo sapiens
accaaagacaucag

SEQ ID NO: 585890 - RNA, 14 nt, Homo sapiens
accaaagagacugg

SEQ ID NO: 585891 - RNA, 15 nt, Homo sapiens
accaaagagacugga

SEQ ID NO: 585892 - RNA, 15 nt, Homo sapiens
accaaagcaucaaua

SEQ ID NO: 585893 - RNA, 13 nt, Homo sapiens
accaaagcugccc

SEQ ID NO: 585894 - RNA, 16 nt, Homo sapiens
accaaagcugcccacu

SEQ ID NO: 585895 - RNA, 20 nt, Homo sapiens
accaaagggaaaacucuuca

SEQ ID NO: 585896 - RNA, 13 nt, Homo sapiens
accaaaguaacug

SEQ ID NO: 585897 - RNA, 19 nt, Homo sapiens
accaaaucuggaagccaaa

SEQ ID NO: 585898 - RNA, 14 nt, Homo sapiens
accaaaugauuuca

SEQ ID NO: 585899 - RNA, 13 nt, Homo sapiens
accaaauggccag

SEQ ID NO: 585900 - RNA, 21 nt, Homo sapiens
accaaauuagcaggugcaccu

SEQ ID NO: 585901 - RNA, 16 nt, Homo sapiens
accaaauuaucuugau

SEQ ID NO: 585902 - RNA, 20 nt, Homo sapiens
accaaauugaacucacugcu

SEQ ID NO: 585903 - RNA, 14 nt, Homo sapiens
accaaauugcuucu

SEQ ID NO: 585904 - RNA, 15 nt, Homo sapiens
accaaccacagcauc

SEQ ID NO: 585905 - RNA, 11 nt, Homo sapiens
accaaccuggg

SEQ ID NO: 585906 - RNA, 23 nt, Homo sapiens
accaaccuuccauucacaccagc

SEQ ID NO: 585907 - RNA, 13 nt, Homo sapiens
accaacuaagaaa

SEQ ID NO: 585908 - RNA, 21 nt, Homo sapiens
accaacuacggauugcugcaa

SEQ ID NO: 585909 - RNA, 16 nt, Homo sapiens
accaacugaaggcuaa

SEQ ID NO: 585910 - RNA, 17 nt, Homo sapiens
accaacugaaggcuaaa

SEQ ID NO: 585911 - RNA, 20 nt, Homo sapiens
accaacugcugcugugcaca

SEQ ID NO: 585912 - RNA, 22 nt, Homo sapiens
accaacugcugcugugcacauu

SEQ ID NO: 585913 - RNA, 14 nt, Homo sapiens
accaagaacugcau

SEQ ID NO: 585914 - RNA, 15 nt, Homo sapiens
accaagacucugaaa

SEQ ID NO: 585915 - RNA, 16 nt, Homo sapiens
accaagacugagccag

SEQ ID NO: 585916 - RNA, 19 nt, Homo sapiens
accaagacugagccagcuu

SEQ ID NO: 585917 - RNA, 17 nt, Homo sapiens
accaagagauaacugua

SEQ ID NO: 585918 - RNA, 14 nt, Homo sapiens
accaagcacagcag

SEQ ID NO: 585919 - RNA, 16 nt, Homo sapiens
accaagcagcaggaau

SEQ ID NO: 585920 - RNA, 21 nt, Homo sapiens
accaaggacugagcacccucu

SEQ ID NO: 585921 - RNA, 13 nt, Homo sapiens
aaauuccacagau

SEQ ID NO: 585922 - RNA, 15 nt, Homo sapiens
aaauuccacagauua

SEQ ID NO: 585923 - RNA, 22 nt, Homo sapiens
aaauucccaacuucucuugcuu

SEQ ID NO: 585924 - RNA, 23 nt, Homo sapiens
aaauucccucauuuaaacccaau

SEQ ID NO: 585925 - RNA, 16 nt, Homo sapiens
aaauuccuacaacuua

SEQ ID NO: 585926 - RNA, 18 nt, Homo sapiens
aaauuccuacaacuuaau

SEQ ID NO: 585927 - RNA, 14 nt, Homo sapiens
aaauuccuaucuca

SEQ ID NO: 585928 - RNA, 15 nt, Homo sapiens
aaauuccuaucucau

SEQ ID NO: 585929 - RNA, 23 nt, Homo sapiens
aaauuccuuagcuuagaccucag

SEQ ID NO: 585930 - RNA, 17 nt, Homo sapiens
aaauucgacaacuugua

SEQ ID NO: 585931 - RNA, 15 nt, Homo sapiens
aaauucuaagccaua

SEQ ID NO: 585932 - RNA, 12 nt, Homo sapiens
aaauucuaccuc

SEQ ID NO: 585933 - RNA, 18 nt, Homo sapiens
aaauucugaugagcauua

SEQ ID NO: 585934 - RNA, 24 nt, Homo sapiens
aaauucugaugagcauuacuauuc

SEQ ID NO: 585935 - RNA, 17 nt, Homo sapiens
aaauucugguauacauu

SEQ ID NO: 585936 - RNA, 17 nt, Homo sapiens
aaauucuugaaguucau

SEQ ID NO: 585937 - RNA, 20 nt, Homo sapiens
aaauugaacuaaauccaaac

SEQ ID NO: 585938 - RNA, 22 nt, Homo sapiens
aaauugacguacuugcaguuua

SEQ ID NO: 585939 - RNA, 20 nt, Homo sapiens
aaauugaguucuuccuguaa

SEQ ID NO: 585940 - RNA, 16 nt, Homo sapiens
aaauugaugugcccua

SEQ ID NO: 585941 - RNA, 12 nt, Homo sapiens
aaauugauucau

SEQ ID NO: 585942 - RNA, 17 nt, Homo sapiens
aaauugauuucuucuca

SEQ ID NO: 585943 - RNA, 20 nt, Homo sapiens
aaauugcacuuuuaaaccuc

SEQ ID NO: 585944 - RNA, 22 nt, Homo sapiens
aaauugccaagugccuaugcaa

SEQ ID NO: 585945 - RNA, 23 nt, Homo sapiens
aaauugccugcaaaaaugaaauc

SEQ ID NO: 585946 - RNA, 15 nt, Homo sapiens
aaauugcuccuugac

SEQ ID NO: 585947 - RNA, 21 nt, Homo sapiens
aaauugcucuuggcugugaaa

SEQ ID NO: 585948 - RNA, 13 nt, Homo sapiens
aaauugcuucuag

SEQ ID NO: 585949 - RNA, 20 nt, Homo sapiens
aaauugcuucuuuaccaagg

SEQ ID NO: 585950 - RNA, 20 nt, Homo sapiens
aaauugggaaaggaguagaa

SEQ ID NO: 585951 - RNA, 13 nt, Homo sapiens
aaauuguguuucc

SEQ ID NO: 585952 - RNA, 15 nt, Homo sapiens
aaauuuaaaauuacg

SEQ ID NO: 585953 - RNA, 16 nt, Homo sapiens
aaauuucuacaccaag

SEQ ID NO: 585954 - RNA, 21 nt, Homo sapiens
aaauuucuguaaaacagguua

SEQ ID NO: 585955 - RNA, 18 nt, Homo sapiens
aaauuucuucugguagug

SEQ ID NO: 585956 - RNA, 23 nt, Homo sapiens
aaauuugauuugaaaaguauuau

SEQ ID NO: 585957 - RNA, 22 nt, Homo sapiens
aaauuuggccuuaagaacugug

SEQ ID NO: 585958 - RNA, 16 nt, Homo sapiens
aaauuugggaggguga

SEQ ID NO: 585959 - RNA, 16 nt, Homo sapiens
aaauuuggugcuuaua

SEQ ID NO: 585960 - RNA, 23 nt, Homo sapiens
aaauuuguaccucuaaguacaua

SEQ ID NO: 585961 - RNA, 22 nt, Homo sapiens
aaauuuuaauauuccagaagaa

SEQ ID NO: 585962 - RNA, 20 nt, Homo sapiens
aaauuuuaggcaaccuucua

SEQ ID NO: 585963 - RNA, 21 nt, Homo sapiens
aaauuuuauuaauauuuuaag

SEQ ID NO: 585964 - RNA, 13 nt, Homo sapiens
aaauuuucaccug

SEQ ID NO: 585965 - RNA, 19 nt, Homo sapiens
aaauuuucuuuuaagcauu

SEQ ID NO: 585966 - RNA, 21 nt, Homo sapiens
aaauuuuuacaaaacugccaa

SEQ ID NO: 585967 - RNA, 19 nt, Homo sapiens
aaauuuuucuuaagacaga

SEQ ID NO: 585968 - RNA, 18 nt, Homo sapiens
aaauuuuugucauuuuaa

SEQ ID NO: 585969 - RNA, 22 nt, Homo sapiens
aaauuuuuuguugacauuaguc

SEQ ID NO: 585970 - RNA, 15 nt, Homo sapiens
aacaaaaaaccacaa

SEQ ID NO: 585971 - RNA, 17 nt, Homo sapiens
aacaaaaaacuauguga

SEQ ID NO: 585972 - RNA, 14 nt, Homo sapiens
aacaaaaaacugcc

SEQ ID NO: 585973 - RNA, 16 nt, Homo sapiens
aacaaaaauuagcuua

SEQ ID NO: 585974 - RNA, 15 nt, Homo sapiens
aacaaaacaaacuuc

SEQ ID NO: 585975 - RNA, 22 nt, Homo sapiens
aacaaaacccucagcacuguua

SEQ ID NO: 585976 - RNA, 13 nt, Homo sapiens
aacaaaaggacuu

SEQ ID NO: 585977 - RNA, 13 nt, Homo sapiens
aacaaacaaugaa

SEQ ID NO: 585978 - RNA, 13 nt, Homo sapiens
aacaaacauggau

SEQ ID NO: 585979 - RNA, 12 nt, Homo sapiens
aacaaaccaagc

SEQ ID NO: 585980 - RNA, 23 nt, Homo sapiens
aacaaacuacauguaauccauca

SEQ ID NO: 585981 - RNA, 22 nt, Homo sapiens
aacaaacugaauuaaacaugaa

SEQ ID NO: 585982 - RNA, 22 nt, Homo sapiens
aacaaacuuccaaacagugugu

SEQ ID NO: 585983 - RNA, 17 nt, Homo sapiens
aacaaagaacaagcauu

SEQ ID NO: 585984 - RNA, 16 nt, Homo sapiens
aacaaaucguuucuca

SEQ ID NO: 585985 - RNA, 17 nt, Homo sapiens
aacaaaugggucccuca

SEQ ID NO: 585986 - RNA, 17 nt, Homo sapiens
acugagaaccgugacau

SEQ ID NO: 585987 - RNA, 13 nt, Homo sapiens
acugagaauauaa

SEQ ID NO: 585988 - RNA, 14 nt, Homo sapiens
acugagagcccacu

SEQ ID NO: 585989 - RNA, 14 nt, Homo sapiens
acugagaugucaga

SEQ ID NO: 585990 - RNA, 20 nt, Homo sapiens
acugagauuuugguauuaca

SEQ ID NO: 585991 - RNA, 15 nt, Homo sapiens
acugagcaaugguaa

SEQ ID NO: 585992 - RNA, 15 nt, Homo sapiens
acugagcgaccccag

SEQ ID NO: 585993 - RNA, 14 nt, Homo sapiens
acugaggaccagcc

SEQ ID NO: 585994 - RNA, 14 nt, Homo sapiens
acugaggcagacag

SEQ ID NO: 585995 - RNA, 16 nt, Homo sapiens
acugaggcccugugau

SEQ ID NO: 585996 - RNA, 23 nt, Homo sapiens
acugaggccuugugugucaggcc

SEQ ID NO: 585997 - RNA, 15 nt, Homo sapiens
acugagguccacaga

SEQ ID NO: 585998 - RNA, 12 nt, Homo sapiens
acugaggugccu

SEQ ID NO: 585999 - RNA, 19 nt, Homo sapiens
acugaguacguugugcauu

SEQ ID NO: 586000 - RNA, 16 nt, Homo sapiens
acugagugacucuaua

SEQ ID NO: 586001 - RNA, 14 nt, Homo sapiens
acugagugugcucu

SEQ ID NO: 586002 - RNA, 23 nt, Homo sapiens
acugagugugggagugcagagaa

SEQ ID NO: 586003 - RNA, 16 nt, Homo sapiens
acugaguuaucaggug

SEQ ID NO: 586004 - RNA, 14 nt, Homo sapiens
acugaguucuauca

SEQ ID NO: 586005 - RNA, 12 nt, Homo sapiens
acugauacuaca

SEQ ID NO: 586006 - RNA, 15 nt, Homo sapiens
acugauagaugucua

SEQ ID NO: 586007 - RNA, 18 nt, Homo sapiens
acugauagcuuacacuga

SEQ ID NO: 586008 - RNA, 20 nt, Homo sapiens
acugaucuaagcaguggcau

SEQ ID NO: 586009 - RNA, 19 nt, Homo sapiens
acugaucuuauguguuaca

SEQ ID NO: 586010 - RNA, 17 nt, Homo sapiens
acugaugaaaucugcua

SEQ ID NO: 586011 - RNA, 15 nt, Homo sapiens
acugaugagcacauc

SEQ ID NO: 586012 - RNA, 22 nt, Homo sapiens
acugaugccauguuuagauucc

SEQ ID NO: 586013 - RNA, 17 nt, Homo sapiens
acugauggcagacaucu

SEQ ID NO: 586014 - RNA, 14 nt, Homo sapiens
acugauguacaauu

SEQ ID NO: 586015 - RNA, 16 nt, Homo sapiens
acugauguuacuagcc

SEQ ID NO: 586016 - RNA, 18 nt, Homo sapiens
acugauguuacuagccuc

SEQ ID NO: 586017 - RNA, 14 nt, Homo sapiens
acugcaacacugga

SEQ ID NO: 586018 - RNA, 14 nt, Homo sapiens
acugcaacuuguga

SEQ ID NO: 586019 - RNA, 21 nt, Homo sapiens
acugcaacuugugaacuccau

SEQ ID NO: 586020 - RNA, 22 nt, Homo sapiens
acugcaagaaggagcucaguua

SEQ ID NO: 586021 - RNA, 20 nt, Homo sapiens
acugcacacugccuggccca

SEQ ID NO: 586022 - RNA, 13 nt, Homo sapiens
acugcacacuucc

SEQ ID NO: 586023 - RNA, 20 nt, Homo sapiens
acugcacuccaaucugggug

SEQ ID NO: 586024 - RNA, 20 nt, Homo sapiens
acugcacuccagccugggug

SEQ ID NO: 586025 - RNA, 22 nt, Homo sapiens
acugcagaacagcaucauguca

SEQ ID NO: 586026 - RNA, 18 nt, Homo sapiens
acugcagauagcccagga

SEQ ID NO: 586027 - RNA, 20 nt, Homo sapiens
acugcagccugggcucccuc

SEQ ID NO: 586028 - RNA, 14 nt, Homo sapiens
acugcagcugugag

SEQ ID NO: 586029 - RNA, 22 nt, Homo sapiens
acugcagggaaaauuauuugca

SEQ ID NO: 586030 - RNA, 21 nt, Homo sapiens
acugcaggguauggugagaaa

SEQ ID NO: 586031 - RNA, 14 nt, Homo sapiens
acugcagucagcau

SEQ ID NO: 586032 - RNA, 20 nt, Homo sapiens
acugcagugaacacaugcca

SEQ ID NO: 586033 - RNA, 14 nt, Homo sapiens
acugcagugagaau

SEQ ID NO: 586034 - RNA, 23 nt, Homo sapiens
acugcaguuagagcugagcacuu

SEQ ID NO: 586035 - RNA, 17 nt, Homo sapiens
acugcauaauagccuaa

SEQ ID NO: 586036 - RNA, 14 nt, Homo sapiens
acugcauacaaucu

SEQ ID NO: 586037 - RNA, 21 nt, Homo sapiens
acugcauaugaaaggacacua

SEQ ID NO: 586038 - RNA, 16 nt, Homo sapiens
acugcaugaaugaaac

SEQ ID NO: 586039 - RNA, 23 nt, Homo sapiens
acugcauucuucugagcacuguu

SEQ ID NO: 586040 - RNA, 17 nt, Homo sapiens
acugcauuuuacuguac

SEQ ID NO: 586041 - RNA, 12 nt, Homo sapiens
acugccaagaaa

SEQ ID NO: 586042 - RNA, 20 nt, Homo sapiens
acugccaagccccugcccug

SEQ ID NO: 586043 - RNA, 13 nt, Homo sapiens
acugccacccaca

SEQ ID NO: 586044 - RNA, 21 nt, Homo sapiens
acugccaucaagaugagagaa

SEQ ID NO: 586045 - RNA, 21 nt, Homo sapiens
acugccaucuuuaucaugaag

SEQ ID NO: 586046 - RNA, 15 nt, Homo sapiens
acugccaugccagcu

SEQ ID NO: 586047 - RNA, 20 nt, Homo sapiens
acugccaugcuagacaagcu

SEQ ID NO: 586048 - RNA, 19 nt, Homo sapiens
acugcccauggacaggcug

SEQ ID NO: 586049 - RNA, 18 nt, Homo sapiens
acugccccacuucuggca

SEQ ID NO: 586050 - RNA, 13 nt, Homo sapiens
acugcccuaagcc

SEQ ID NO: 586051 - RNA, 12 nt, Homo sapiens
acugcccuggca

SEQ ID NO: 586052 - RNA, 19 nt, Homo sapiens
acugccguccucagguggg

SEQ ID NO: 586053 - RNA, 16 nt, Homo sapiens
acugccuccugugacg

SEQ ID NO: 586054 - RNA, 20 nt, Homo sapiens
acugccucuuccucccucau

SEQ ID NO: 586055 - RNA, 18 nt, Homo sapiens
acugccuuccucucucua

SEQ ID NO: 586056 - RNA, 22 nt, Homo sapiens
acugccuuccucucucuaccag

SEQ ID NO: 586057 - RNA, 17 nt, Homo sapiens
acugcgcaucaccuacc

SEQ ID NO: 586058 - RNA, 19 nt, Homo sapiens
acugcgccgaccccgccac

SEQ ID NO: 586059 - RNA, 21 nt, Homo sapiens
acugcucagaacuugcugcug

SEQ ID NO: 586060 - RNA, 16 nt, Homo sapiens
acugcuccaagggaca

SEQ ID NO: 586061 - RNA, 17 nt, Homo sapiens
acugcucguggccaaaa

SEQ ID NO: 586062 - RNA, 12 nt, Homo sapiens
acugcugagcug

SEQ ID NO: 586063 - RNA, 20 nt, Homo sapiens
acugcugagguuuuauacuc

SEQ ID NO: 586064 - RNA, 15 nt, Homo sapiens
acugcugcuccccac

SEQ ID NO: 586065 - RNA, 17 nt, Homo sapiens
acugcuggggagacaaa

SEQ ID NO: 586066 - RNA, 23 nt, Homo sapiens
acugcuggggagacaaaucucag

SEQ ID NO: 586067 - RNA, 20 nt, Homo sapiens
acugcuguucauguuacuca

SEQ ID NO: 586068 - RNA, 15 nt, Homo sapiens
acuggaacauuccag

SEQ ID NO: 586069 - RNA, 17 nt, Homo sapiens
acuggaacggugaaggu

SEQ ID NO: 586070 - RNA, 22 nt, Homo sapiens
acuggaagcacagccucgggga

SEQ ID NO: 586071 - RNA, 23 nt, Homo sapiens
acuggaauauaauuucaaaccac

SEQ ID NO: 586072 - RNA, 20 nt, Homo sapiens
acuggaaugaagaccaugcc

SEQ ID NO: 586073 - RNA, 16 nt, Homo sapiens
acuggacucauuauca

SEQ ID NO: 586074 - RNA, 20 nt, Homo sapiens
acuggacuugagcuuggcag

SEQ ID NO: 586075 - RNA, 15 nt, Homo sapiens
acuggagaagucuua

SEQ ID NO: 586076 - RNA, 15 nt, Homo sapiens
acuggaggugggcau

SEQ ID NO: 586077 - RNA, 19 nt, Homo sapiens
acuggagguugaagccaag

SEQ ID NO: 586078 - RNA, 18 nt, Homo sapiens
acuggaguaaaccaugua

SEQ ID NO: 586079 - RNA, 17 nt, Homo sapiens
acuggaguuagaucucu

SEQ ID NO: 586080 - RNA, 19 nt, Homo sapiens
acuggauauguuguuaaac

SEQ ID NO: 586081 - RNA, 20 nt, Homo sapiens
acuggaucucuuaagacagc

SEQ ID NO: 586082 - RNA, 13 nt, Homo sapiens
acuggauguacca

SEQ ID NO: 586083 - RNA, 20 nt, Homo sapiens
acuggcaauaaacuccuacu

SEQ ID NO: 586084 - RNA, 22 nt, Homo sapiens
acuggcaauaaacuccuacuaa

SEQ ID NO: 586085 - RNA, 13 nt, Homo sapiens
acuggcacaaaaa

SEQ ID NO: 586086 - RNA, 19 nt, Homo sapiens
acuggcacacugcucuuaa

SEQ ID NO: 586087 - RNA, 21 nt, Homo sapiens
acuggcacagagguagucuca

SEQ ID NO: 586088 - RNA, 16 nt, Homo sapiens
acuggcagcaucuuca

SEQ ID NO: 586089 - RNA, 14 nt, Homo sapiens
acuggcagcuccuc

SEQ ID NO: 586090 - RNA, 16 nt, Homo sapiens
acuggcaguuuuccau

SEQ ID NO: 586091 - RNA, 12 nt, Homo sapiens
acuggcauuaau

SEQ ID NO: 586092 - RNA, 17 nt, Homo sapiens
acuggccauuugccaau

SEQ ID NO: 586093 - RNA, 16 nt, Homo sapiens
acuggcuaguguggaa

SEQ ID NO: 586094 - RNA, 13 nt, Homo sapiens
acuggcucuccaa

SEQ ID NO: 586095 - RNA, 21 nt, Homo sapiens
acuggcuggaggaaguggggu

SEQ ID NO: 586096 - RNA, 22 nt, Homo sapiens
acuggcugggaguccuuaccuc

SEQ ID NO: 586097 - RNA, 17 nt, Homo sapiens
acuggcugucaguauga

SEQ ID NO: 586098 - RNA, 17 nt, Homo sapiens
acuggcuucucuugagu

SEQ ID NO: 586099 - RNA, 17 nt, Homo sapiens
aaccagagccauggacu

SEQ ID NO: 586100 - RNA, 18 nt, Homo sapiens
aaccagaucugucuccaa

SEQ ID NO: 586101 - RNA, 18 nt, Homo sapiens
aaccagauggaacacugg

SEQ ID NO: 586102 - RNA, 21 nt, Homo sapiens
aaccagcccgucuucucucuc

SEQ ID NO: 586103 - RNA, 16 nt, Homo sapiens
aaccaggaaccuccuc

SEQ ID NO: 586104 - RNA, 18 nt, Homo sapiens
aaccaggcaccucuuccu

SEQ ID NO: 586105 - RNA, 23 nt, Homo sapiens
aaccaggcagcugagaccagggu

SEQ ID NO: 586106 - RNA, 17 nt, Homo sapiens
aaccagggcucuucuca

SEQ ID NO: 586107 - RNA, 16 nt, Homo sapiens
aaccaggucaccaucc

SEQ ID NO: 586108 - RNA, 18 nt, Homo sapiens
aaccagguuaagugguaa

SEQ ID NO: 586109 - RNA, 15 nt, Homo sapiens
aaccaguacuaaccu

SEQ ID NO: 586110 - RNA, 19 nt, Homo sapiens
aaccaguauuuuugcugcu

SEQ ID NO: 586111 - RNA, 16 nt, Homo sapiens
aaccagugauccaugu

SEQ ID NO: 586112 - RNA, 16 nt, Homo sapiens
aaccauaacacuugau

SEQ ID NO: 586113 - RNA, 13 nt, Homo sapiens
aaccaucacagcu

SEQ ID NO: 586114 - RNA, 16 nt, Homo sapiens
aaccaucacagcuggg

SEQ ID NO: 586115 - RNA, 16 nt, Homo sapiens
aaccaucaucuugcca

SEQ ID NO: 586116 - RNA, 16 nt, Homo sapiens
aaccauccagugacaa

SEQ ID NO: 586117 - RNA, 23 nt, Homo sapiens
aaccaucucagaccuuuacugau

SEQ ID NO: 586118 - RNA, 13 nt, Homo sapiens
aaccaugaacuca

SEQ ID NO: 586119 - RNA, 12 nt, Homo sapiens
aaccaugacugu

SEQ ID NO: 586120 - RNA, 15 nt, Homo sapiens
aaccaugagaauuug

SEQ ID NO: 586121 - RNA, 16 nt, Homo sapiens
aaccaugguaacaaua

SEQ ID NO: 586122 - RNA, 19 nt, Homo sapiens
aaccauggugaagugcuug

SEQ ID NO: 586123 - RNA, 18 nt, Homo sapiens
aaccauguauaugagcuu

SEQ ID NO: 586124 - RNA, 23 nt, Homo sapiens
aaccauguauaugagcuuauaaa

SEQ ID NO: 586125 - RNA, 20 nt, Homo sapiens
aaccauuccaacuucaauuu

SEQ ID NO: 586126 - RNA, 11 nt, Homo sapiens
aaccauuguug

SEQ ID NO: 586127 - RNA, 15 nt, Homo sapiens
aaccauuuaccaucu

SEQ ID NO: 586128 - RNA, 12 nt, Homo sapiens
aaccauuugcac

SEQ ID NO: 586129 - RNA, 12 nt, Homo sapiens
aacccaaaaaga

SEQ ID NO: 586130 - RNA, 16 nt, Homo sapiens
aacccaaaacaguaaa

SEQ ID NO: 586131 - RNA, 16 nt, Homo sapiens
aacccaagcucugggg

SEQ ID NO: 586132 - RNA, 22 nt, Homo sapiens
aacccacaagcugccucugaca

SEQ ID NO: 586133 - RNA, 19 nt, Homo sapiens
aacccacaccgucuuccuu

SEQ ID NO: 586134 - RNA, 23 nt, Homo sapiens
aacccacagaccucacaccuggg

SEQ ID NO: 586135 - RNA, 19 nt, Homo sapiens
aacccaccccgcuuucgua

SEQ ID NO: 586136 - RNA, 17 nt, Homo sapiens
aacccagagguggaugu

SEQ ID NO: 586137 - RNA, 21 nt, Homo sapiens
aacccagccacugccaagcuu

SEQ ID NO: 586138 - RNA, 17 nt, Homo sapiens
aacccaggggacagcug

SEQ ID NO: 586139 - RNA, 16 nt, Homo sapiens
aacccagucucagaca

SEQ ID NO: 586140 - RNA, 18 nt, Homo sapiens
aacccaucgguaggcaaa

SEQ ID NO: 586141 - RNA, 19 nt, Homo sapiens
aacccauguugaucuuucu

SEQ ID NO: 586142 - RNA, 16 nt, Homo sapiens
aaccccaaacuguuga

SEQ ID NO: 586143 - RNA, 16 nt, Homo sapiens
aaccccaagcugccuc

SEQ ID NO: 586144 - RNA, 22 nt, Homo sapiens
aaccccagccugaccugagacu

SEQ ID NO: 586145 - RNA, 17 nt, Homo sapiens
aacccccgccaccucag

SEQ ID NO: 586146 - RNA, 17 nt, Homo sapiens
aaccccgcggugcucug

SEQ ID NO: 586147 - RNA, 17 nt, Homo sapiens
aaccccgggcaagacuu

SEQ ID NO: 586148 - RNA, 21 nt, Homo sapiens
aaccccuuccagaucacugcc

SEQ ID NO: 586149 - RNA, 18 nt, Homo sapiens
aaccccuugguacugaaa

SEQ ID NO: 586150 - RNA, 20 nt, Homo sapiens
aacccggcuaugggacugca

SEQ ID NO: 586151 - RNA, 13 nt, Homo sapiens
aacccuaccuguc

SEQ ID NO: 586152 - RNA, 13 nt, Homo sapiens
aacccuagcaaaa

SEQ ID NO: 586153 - RNA, 20 nt, Homo sapiens
aacccucccaaaacagggaa

SEQ ID NO: 586154 - RNA, 17 nt, Homo sapiens
aacccugccccugcccc

SEQ ID NO: 586155 - RNA, 16 nt, Homo sapiens
aacccugccugucacc

SEQ ID NO: 586156 - RNA, 22 nt, Homo sapiens
aacccugcuugcacuuuguaac

SEQ ID NO: 586157 - RNA, 22 nt, Homo sapiens
aacccuggaucaguccuuugau

SEQ ID NO: 586158 - RNA, 18 nt, Homo sapiens
aacccuggugguugcugu

SEQ ID NO: 586159 - RNA, 14 nt, Homo sapiens
aauccuauuuauca

SEQ ID NO: 586160 - RNA, 23 nt, Homo sapiens
aauccuauuuaucagacucugua

SEQ ID NO: 586161 - RNA, 12 nt, Homo sapiens
aauccucaggaa

SEQ ID NO: 586162 - RNA, 22 nt, Homo sapiens
aauccucagguaguacugggaa

SEQ ID NO: 586163 - RNA, 23 nt, Homo sapiens
aauccucagguaguacugggaau

SEQ ID NO: 586164 - RNA, 19 nt, Homo sapiens
aauccuccaggcccuucuc

SEQ ID NO: 586165 - RNA, 18 nt, Homo sapiens
aauccucccuacuuccaa

SEQ ID NO: 586166 - RNA, 14 nt, Homo sapiens
aauccuccuaccuc

SEQ ID NO: 586167 - RNA, 19 nt, Homo sapiens
aauccugaaagggcacuua

SEQ ID NO: 586168 - RNA, 15 nt, Homo sapiens
aauccugaagagcau

SEQ ID NO: 586169 - RNA, 23 nt, Homo sapiens
aauccugaauaaaccaguaucgu

SEQ ID NO: 586170 - RNA, 21 nt, Homo sapiens
aauccugucgauuagacugga

SEQ ID NO: 586171 - RNA, 17 nt, Homo sapiens
aauccuuccacuaucau

SEQ ID NO: 586172 - RNA, 20 nt, Homo sapiens
aauccuucccugcucuugca

SEQ ID NO: 586173 - RNA, 22 nt, Homo sapiens
aauccuucccugcucuugcagu

SEQ ID NO: 586174 - RNA, 14 nt, Homo sapiens
aauccuugacugga

SEQ ID NO: 586175 - RNA, 18 nt, Homo sapiens
aauccuuuacuguuaguc

SEQ ID NO: 586176 - RNA, 22 nt, Homo sapiens
aauccuuucacccgcuccuaca

SEQ ID NO: 586177 - RNA, 15 nt, Homo sapiens
aauccuuucugccca

SEQ ID NO: 586178 - RNA, 14 nt, Homo sapiens
aaucgaacuaugaa

SEQ ID NO: 586179 - RNA, 14 nt, Homo sapiens
aaucgaauagggaa

SEQ ID NO: 586180 - RNA, 22 nt, Homo sapiens
aaucgacuguauucgugcauuu

SEQ ID NO: 586181 - RNA, 17 nt, Homo sapiens
aaucgagagaagcugcc

SEQ ID NO: 586182 - RNA, 21 nt, Homo sapiens
aaucguccagcgaccuuccuc

SEQ ID NO: 586183 - RNA, 16 nt, Homo sapiens
aaucuacuaauuccac

SEQ ID NO: 586184 - RNA, 17 nt, Homo sapiens
aaucuaggaagcucaga

SEQ ID NO: 586185 - RNA, 17 nt, Homo sapiens
aaucuaguuuuggcaag

SEQ ID NO: 586186 - RNA, 21 nt, Homo sapiens
aaucuauccauugaacuaaaa

SEQ ID NO: 586187 - RNA, 16 nt, Homo sapiens
aaucuaugccuaaaaa

SEQ ID NO: 586188 - RNA, 15 nt, Homo sapiens
aaucuauguuugcac

SEQ ID NO: 586189 - RNA, 17 nt, Homo sapiens
aaucucaaaguguacaa

SEQ ID NO: 586190 - RNA, 18 nt, Homo sapiens
aaucucaaaguguacaaa

SEQ ID NO: 586191 - RNA, 19 nt, Homo sapiens
aaucucaaugaagccagcu

SEQ ID NO: 586192 - RNA, 11 nt, Homo sapiens
aaucucacaaa

SEQ ID NO: 586193 - RNA, 14 nt, Homo sapiens
aaucucacauucau

SEQ ID NO: 586194 - RNA, 19 nt, Homo sapiens
aaucucagaugcaguuugg

SEQ ID NO: 586195 - RNA, 14 nt, Homo sapiens
aaucucagcacugc

SEQ ID NO: 586196 - RNA, 14 nt, Homo sapiens
aaucucagcacuuu

SEQ ID NO: 586197 - RNA, 22 nt, Homo sapiens
aaucucagcuaacauuccaugu

SEQ ID NO: 586198 - RNA, 15 nt, Homo sapiens
aaucuccagucucau

SEQ ID NO: 586199 - RNA, 16 nt, Homo sapiens
aaucucccacuccagc

SEQ ID NO: 586200 - RNA, 13 nt, Homo sapiens
aaucucccaguga

SEQ ID NO: 586201 - RNA, 18 nt, Homo sapiens
acagcuuuugcaacuuaa

SEQ ID NO: 586202 - RNA, 14 nt, Homo sapiens
acaggaaaaaccaa

SEQ ID NO: 586203 - RNA, 13 nt, Homo sapiens
acaggaaaccacu

SEQ ID NO: 586204 - RNA, 13 nt, Homo sapiens
acaggaaagggca

SEQ ID NO: 586205 - RNA, 18 nt, Homo sapiens
acaggaaggaaccagaag

SEQ ID NO: 586206 - RNA, 19 nt, Homo sapiens
acaggaauacuuaacucaa

SEQ ID NO: 586207 - RNA, 21 nt, Homo sapiens
acaggaauacuuaacucaaua

SEQ ID NO: 586208 - RNA, 16 nt, Homo sapiens
acaggacaacuuuaca

SEQ ID NO: 586209 - RNA, 21 nt, Homo sapiens
acaggaccccaagaaugagcu

SEQ ID NO: 586210 - RNA, 18 nt, Homo sapiens
acaggacccugggaccac

SEQ ID NO: 586211 - RNA, 20 nt, Homo sapiens
acaggacccugggaccacag

SEQ ID NO: 586212 - RNA, 13 nt, Homo sapiens
acaggacucugcc

SEQ ID NO: 586213 - RNA, 19 nt, Homo sapiens
acaggagaaugcacagugg

SEQ ID NO: 586214 - RNA, 22 nt, Homo sapiens
acaggagaaugggguuccugcu

SEQ ID NO: 586215 - RNA, 15 nt, Homo sapiens
acaggagacuugagc

SEQ ID NO: 586216 - RNA, 20 nt, Homo sapiens
acaggagacuugagcuugac

SEQ ID NO: 586217 - RNA, 13 nt, Homo sapiens
acaggagauucca

SEQ ID NO: 586218 - RNA, 21 nt, Homo sapiens
acaggaggaagacaggcaaau

SEQ ID NO: 586219 - RNA, 13 nt, Homo sapiens
acaggaguguccu

SEQ ID NO: 586220 - RNA, 17 nt, Homo sapiens
acaggaugaccuggaua

SEQ ID NO: 586221 - RNA, 16 nt, Homo sapiens
acaggauggugggcag

SEQ ID NO: 586222 - RNA, 19 nt, Homo sapiens
acaggauuauuggaaauuu

SEQ ID NO: 586223 - RNA, 18 nt, Homo sapiens
acaggcaaagacugcagu

SEQ ID NO: 586224 - RNA, 15 nt, Homo sapiens
acaggcaaauguacu

SEQ ID NO: 586225 - RNA, 13 nt, Homo sapiens
acaggcaccugcc

SEQ ID NO: 586226 - RNA, 20 nt, Homo sapiens
acaggcacugaacaggcugg

SEQ ID NO: 586227 - RNA, 14 nt, Homo sapiens
acaggccauuguga

SEQ ID NO: 586228 - RNA, 14 nt, Homo sapiens
acaggcccaagaga

SEQ ID NO: 586229 - RNA, 21 nt, Homo sapiens
acaggcccuggagaagcagcu

SEQ ID NO: 586230 - RNA, 16 nt, Homo sapiens
acaggcccuuccucuc

SEQ ID NO: 586231 - RNA, 22 nt, Homo sapiens
acaggcccuuccucuccacugc

SEQ ID NO: 586232 - RNA, 18 nt, Homo sapiens
acaggccucccaaguuuu

SEQ ID NO: 586233 - RNA, 14 nt, Homo sapiens
acaggcgaggaccc

SEQ ID NO: 586234 - RNA, 12 nt, Homo sapiens
acauacaauuau

SEQ ID NO: 586235 - RNA, 22 nt, Homo sapiens
acauacaccucgucaagagcau

SEQ ID NO: 586236 - RNA, 13 nt, Homo sapiens
acauacagagaua

SEQ ID NO: 586237 - RNA, 14 nt, Homo sapiens
acauacauacacau

SEQ ID NO: 586238 - RNA, 19 nt, Homo sapiens
acauacauauauaucugau

SEQ ID NO: 586239 - RNA, 17 nt, Homo sapiens
acauacauauuaucuca

SEQ ID NO: 586240 - RNA, 20 nt, Homo sapiens
acauacauuguauaggccau

SEQ ID NO: 586241 - RNA, 18 nt, Homo sapiens
acauacccacacauucca

SEQ ID NO: 586242 - RNA, 19 nt, Homo sapiens
acauaccuaagaaguacau

SEQ ID NO: 586243 - RNA, 16 nt, Homo sapiens
acauaccuucaugugg

SEQ ID NO: 586244 - RNA, 14 nt, Homo sapiens
acauacgugcacag

SEQ ID NO: 586245 - RNA, 16 nt, Homo sapiens
acauacuccuuccauc

SEQ ID NO: 586246 - RNA, 21 nt, Homo sapiens
acauacucugcuuagaauuug

SEQ ID NO: 586247 - RNA, 20 nt, Homo sapiens
acauacuggccucugugauu

SEQ ID NO: 586248 - RNA, 14 nt, Homo sapiens
acauacuguucacu

SEQ ID NO: 586249 - RNA, 21 nt, Homo sapiens
acauagaggccuucccaucca

SEQ ID NO: 586250 - RNA, 13 nt, Homo sapiens
acauagcaucuca

SEQ ID NO: 586251 - RNA, 15 nt, Homo sapiens
acauagcgaauacaa

SEQ ID NO: 586252 - RNA, 21 nt, Homo sapiens
acauaggaaaaugccaugaaa

SEQ ID NO: 586253 - RNA, 18 nt, Homo sapiens
acauaggcaucauuucac

SEQ ID NO: 586254 - RNA, 23 nt, Homo sapiens
acauagugaaaccccaucucuac

SEQ ID NO: 586255 - RNA, 19 nt, Homo sapiens
acauagugugagaacuucc

SEQ ID NO: 586256 - RNA, 20 nt, Homo sapiens
acauagugugagaacuucca

SEQ ID NO: 586257 - RNA, 18 nt, Homo sapiens
acauauaaagcacuauac

SEQ ID NO: 586258 - RNA, 13 nt, Homo sapiens
acauauacauacu

SEQ ID NO: 586259 - RNA, 22 nt, Homo sapiens
acauauauacccacauguacag

SEQ ID NO: 586260 - RNA, 13 nt, Homo sapiens
acauauauauuac

SEQ ID NO: 586261 - RNA, 20 nt, Homo sapiens
acauaucaccucauggccua

SEQ ID NO: 586262 - RNA, 17 nt, Homo sapiens
acauauccuuucaagac

SEQ ID NO: 586263 - RNA, 14 nt, Homo sapiens
ugggagcugccaag

SEQ ID NO: 586264 - RNA, 17 nt, Homo sapiens
ugggagcugcugggcua

SEQ ID NO: 586265 - RNA, 11 nt, Homo sapiens
ugggaggacag

SEQ ID NO: 586266 - RNA, 21 nt, Homo sapiens
ugggaggacaugcguguguca

SEQ ID NO: 586267 - RNA, 20 nt, Homo sapiens
ugggaggagagccacugggc

SEQ ID NO: 586268 - RNA, 14 nt, Homo sapiens
ugggaggauuugac

SEQ ID NO: 586269 - RNA, 21 nt, Homo sapiens
ugggaggcaagaaaaggacaa

SEQ ID NO: 586270 - RNA, 23 nt, Homo sapiens
ugggaggcagaaaccuaucucag

SEQ ID NO: 586271 - RNA, 15 nt, Homo sapiens
ugggaggcugugauu

SEQ ID NO: 586272 - RNA, 14 nt, Homo sapiens
ugggaggcuucccc

SEQ ID NO: 586273 - RNA, 21 nt, Homo sapiens
ugggagggggcuugaagccaa

SEQ ID NO: 586274 - RNA, 13 nt, Homo sapiens
ugggagggggucc

SEQ ID NO: 586275 - RNA, 19 nt, Homo sapiens
ugggaggguaccagcagaa

SEQ ID NO: 586276 - RNA, 18 nt, Homo sapiens
ugggaggguggcaaggga

SEQ ID NO: 586277 - RNA, 18 nt, Homo sapiens
ugggagggugggaccaau

SEQ ID NO: 586278 - RNA, 16 nt, Homo sapiens
ugggaguaacagggca

SEQ ID NO: 586279 - RNA, 16 nt, Homo sapiens
ugggaguauguuguca

SEQ ID NO: 586280 - RNA, 12 nt, Homo sapiens
ugggaguguccu

SEQ ID NO: 586281 - RNA, 20 nt, Homo sapiens
ugggaguucagcugcuucuc

SEQ ID NO: 586282 - RNA, 23 nt, Homo sapiens
ugggauacuuagugguaugucuc

SEQ ID NO: 586283 - RNA, 14 nt, Homo sapiens
ugggaucagaucaa

SEQ ID NO: 586284 - RNA, 15 nt, Homo sapiens
ugggauccacacuga

SEQ ID NO: 586285 - RNA, 13 nt, Homo sapiens
ugggaugagaaaa

SEQ ID NO: 586286 - RNA, 15 nt, Homo sapiens
ugggauggauuucca

SEQ ID NO: 586287 - RNA, 22 nt, Homo sapiens
ugggauggggcuucacugcugu

SEQ ID NO: 586288 - RNA, 19 nt, Homo sapiens
ugggauguccuacuaucac

SEQ ID NO: 586289 - RNA, 14 nt, Homo sapiens
ugggauuacaggca

SEQ ID NO: 586290 - RNA, 14 nt, Homo sapiens
ugggauuacaggga

SEQ ID NO: 586291 - RNA, 13 nt, Homo sapiens
ugggauuacaggu

SEQ ID NO: 586292 - RNA, 17 nt, Homo sapiens
ugggauuauucuuugaa

SEQ ID NO: 586293 - RNA, 21 nt, Homo sapiens
ugggauugggggcuggugcca

SEQ ID NO: 586294 - RNA, 16 nt, Homo sapiens
ugggauugugguacaa

SEQ ID NO: 586295 - RNA, 15 nt, Homo sapiens
ugggauuuaccagcu

SEQ ID NO: 586296 - RNA, 14 nt, Homo sapiens
ugggcaaaggacau

SEQ ID NO: 586297 - RNA, 19 nt, Homo sapiens
ugggcaacaacagcaaaac

SEQ ID NO: 586298 - RNA, 16 nt, Homo sapiens
ugggcaccccacugca

SEQ ID NO: 586299 - RNA, 21 nt, Homo sapiens
ugggcaccuggggagugggac

SEQ ID NO: 586300 - RNA, 21 nt, Homo sapiens
ugggcaccuuccuaauaugcu

SEQ ID NO: 586301 - RNA, 14 nt, Homo sapiens
ugggcagaaagugg

SEQ ID NO: 586302 - RNA, 21 nt, Homo sapiens
ugggcagcaaaacgacacugc

SEQ ID NO: 586303 - RNA, 18 nt, Homo sapiens
ugggcagggugacccuga

SEQ ID NO: 586304 - RNA, 13 nt, Homo sapiens
ugggcagugccac

SEQ ID NO: 586305 - RNA, 19 nt, Homo sapiens
ugggcauggccgcuucuag

SEQ ID NO: 586306 - RNA, 22 nt, Homo sapiens
ugggcauuaagucaguggcuuu

SEQ ID NO: 586307 - RNA, 21 nt, Homo sapiens
ugggcauuuauauuccacuug

SEQ ID NO: 586308 - RNA, 19 nt, Homo sapiens
ugggcauuucacgaacugu

SEQ ID NO: 586309 - RNA, 14 nt, Homo sapiens
ugggccacugugaa

SEQ ID NO: 586310 - RNA, 15 nt, Homo sapiens
ugggccauguccaaa

SEQ ID NO: 586311 - RNA, 16 nt, Homo sapiens
ugggccccaccaccua

SEQ ID NO: 586312 - RNA, 15 nt, Homo sapiens
ugggccccacuggac

SEQ ID NO: 586313 - RNA, 19 nt, Homo sapiens
ugggccguaucugucacaa

SEQ ID NO: 586314 - RNA, 20 nt, Homo sapiens
ugggccuccugacagcaaua

SEQ ID NO: 586315 - RNA, 15 nt, Homo sapiens
ugggccugugaauca

SEQ ID NO: 586316 - RNA, 22 nt, Homo sapiens
ugggcgacagagcgagacucca

SEQ ID NO: 586317 - RNA, 16 nt, Homo sapiens
ugggcuagauuacaga

SEQ ID NO: 586318 - RNA, 22 nt, Homo sapiens
ugggcucccucuugugggauaa

SEQ ID NO: 586319 - RNA, 23 nt, Homo sapiens
ugggcuccuccugcccuccaucu

SEQ ID NO: 586320 - RNA, 15 nt, Homo sapiens
ugggcucgcacugcc

SEQ ID NO: 586321 - RNA, 23 nt, Homo sapiens
ugggcucugccuuaaacacacau

SEQ ID NO: 586322 - RNA, 15 nt, Homo sapiens
ugggcucuucuggac

SEQ ID NO: 586323 - RNA, 16 nt, Homo sapiens
ugggcugagacuggau

SEQ ID NO: 586324 - RNA, 21 nt, Homo sapiens
ugggcugagugacacaagcac

SEQ ID NO: 586325 - RNA, 19 nt, Homo sapiens
ugggcugaugcugggaccc

SEQ ID NO: 586326 - RNA, 21 nt, Homo sapiens
ugggcuggaggcugagcugca

SEQ ID NO: 586327 - RNA, 22 nt, Homo sapiens
ugggcuggaggcugagcugcau

SEQ ID NO: 586328 - RNA, 21 nt, Homo sapiens
ugggcugguaucucagaaagu

SEQ ID NO: 586329 - RNA, 21 nt, Homo sapiens
ugggcugucucucccuuccag

SEQ ID NO: 586330 - RNA, 14 nt, Homo sapiens
ugggcugucuguca

SEQ ID NO: 586331 - RNA, 15 nt, Homo sapiens
ugggcugucugucac

SEQ ID NO: 586332 - RNA, 19 nt, Homo sapiens
ugggcugugggcaagccua

SEQ ID NO: 586333 - RNA, 14 nt, Homo sapiens
ugggcuugauucug

SEQ ID NO: 586334 - RNA, 20 nt, Homo sapiens
ugggcuuucacaaaaggcau

SEQ ID NO: 586335 - RNA, 20 nt, Homo sapiens
uggggaaaauggccaugcag

SEQ ID NO: 586336 - RNA, 20 nt, Homo sapiens
uggggaaacagaugccucag

SEQ ID NO: 586337 - RNA, 18 nt, Homo sapiens
uggggaagagguuuuauu

SEQ ID NO: 586338 - RNA, 19 nt, Homo sapiens
uggggaagaguggucuuga

SEQ ID NO: 586339 - RNA, 15 nt, Homo sapiens
uggggaagcugugaa

SEQ ID NO: 586340 - RNA, 15 nt, Homo sapiens
uggggaaguguucca

SEQ ID NO: 586341 - RNA, 16 nt, Homo sapiens
uggggaaguguuccag

SEQ ID NO: 586342 - RNA, 14 nt, Homo sapiens
uggggaaguuuauu

SEQ ID NO: 586343 - RNA, 16 nt, Homo sapiens
uggggaaugcucccag

SEQ ID NO: 586344 - RNA, 21 nt, Homo sapiens
uggggaauucacuucucuucc

SEQ ID NO: 586345 - RNA, 20 nt, Homo sapiens
uggggaccaaaggucaggga

SEQ ID NO: 586346 - RNA, 14 nt, Homo sapiens
uggggagaaaggga

SEQ ID NO: 586347 - RNA, 19 nt, Homo sapiens
uggggagcuccugggaccc

SEQ ID NO: 586348 - RNA, 16 nt, Homo sapiens
uggggaggagggggcc

SEQ ID NO: 586349 - RNA, 14 nt, Homo sapiens
uggggaggccagug

SEQ ID NO: 586350 - RNA, 15 nt, Homo sapiens
uggggaggggugcuc

SEQ ID NO: 586351 - RNA, 16 nt, Homo sapiens
uggggauaaagacaga

SEQ ID NO: 586352 - RNA, 23 nt, Homo sapiens
uggggaucuugcccccuuugacc

SEQ ID NO: 586353 - RNA, 17 nt, Homo sapiens
uggggauguaaccaagc

SEQ ID NO: 586354 - RNA, 19 nt, Homo sapiens
uggggauuccacuaucuca

SEQ ID NO: 586355 - RNA, 14 nt, Homo sapiens
uggggcaaagccuc

SEQ ID NO: 586356 - RNA, 14 nt, Homo sapiens
uggggcaagccagg

SEQ ID NO: 586357 - RNA, 15 nt, Homo sapiens
uggggcaccaugaga

SEQ ID NO: 586358 - RNA, 19 nt, Homo sapiens
uggggcacuuucauccuca

SEQ ID NO: 586359 - RNA, 22 nt, Homo sapiens
uggggccaccaaagcugcccac

SEQ ID NO: 586360 - RNA, 21 nt, Homo sapiens
uggggccugccuggucucuag

SEQ ID NO: 586361 - RNA, 18 nt, Homo sapiens
uggggcuccuuucuccag

SEQ ID NO: 586362 - RNA, 15 nt, Homo sapiens
uggggcucucuccau

SEQ ID NO: 586363 - RNA, 15 nt, Homo sapiens
uggggcucucucuuc

SEQ ID NO: 586364 - RNA, 23 nt, Homo sapiens
uggggcugccauagggucugcag

SEQ ID NO: 586365 - RNA, 22 nt, Homo sapiens
uggggcugcuuaggaaaccuca

SEQ ID NO: 586366 - RNA, 22 nt, Homo sapiens
ugggggaaugcaccuccccaaa

SEQ ID NO: 586367 - RNA, 19 nt, Homo sapiens
ugggggacgugggcauuuu

SEQ ID NO: 586368 - RNA, 19 nt, Homo sapiens
ugggggagggaagaccaga

SEQ ID NO: 586369 - RNA, 22 nt, Homo sapiens
ugggggaucacagccucugaaa

SEQ ID NO: 586370 - RNA, 15 nt, Homo sapiens
ugggggccuccucag

SEQ ID NO: 586371 - RNA, 14 nt, Homo sapiens
ugggggcucgggga

SEQ ID NO: 586372 - RNA, 14 nt, Homo sapiens
uggggggacugccu

SEQ ID NO: 586373 - RNA, 18 nt, Homo sapiens
ugggguauacagcauuga

SEQ ID NO: 586374 - RNA, 17 nt, Homo sapiens
ugggguauaggucucau

SEQ ID NO: 586375 - RNA, 21 nt, Homo sapiens
ugggguauuuaccacagcagc

SEQ ID NO: 586376 - RNA, 16 nt, Homo sapiens
uggggucuccuauacu

SEQ ID NO: 586377 - RNA, 17 nt, Homo sapiens
ugcauuaaccacucuac

SEQ ID NO: 586378 - RNA, 14 nt, Homo sapiens
ugcauuaagugaaa

SEQ ID NO: 586379 - RNA, 18 nt, Homo sapiens
ugcauuaguguugaacca

SEQ ID NO: 586380 - RNA, 14 nt, Homo sapiens
ugcauuccagaaca

SEQ ID NO: 586381 - RNA, 15 nt, Homo sapiens
ugcauuccauuuaau

SEQ ID NO: 586382 - RNA, 19 nt, Homo sapiens
ugcauuccuuacuugcacu

SEQ ID NO: 586383 - RNA, 20 nt, Homo sapiens
ugcauuccuuacuugcacug

SEQ ID NO: 586384 - RNA, 16 nt, Homo sapiens
ugcauucuacuagcag

SEQ ID NO: 586385 - RNA, 14 nt, Homo sapiens
ugcauucucuccca

SEQ ID NO: 586386 - RNA, 16 nt, Homo sapiens
ugcauugaaagaauua

SEQ ID NO: 586387 - RNA, 14 nt, Homo sapiens
ugcauugcucuuau

SEQ ID NO: 586388 - RNA, 21 nt, Homo sapiens
ugcauuggaagaccccaccca

SEQ ID NO: 586389 - RNA, 21 nt, Homo sapiens
ugcauuguuaaucauccauca

SEQ ID NO: 586390 - RNA, 16 nt, Homo sapiens
ugcauuucaccuguga

SEQ ID NO: 586391 - RNA, 16 nt, Homo sapiens
ugcauuuccuuucuac

SEQ ID NO: 586392 - RNA, 21 nt, Homo sapiens
ugcauuugugaggguccagcu

SEQ ID NO: 586393 - RNA, 21 nt, Homo sapiens
ugcauuugugcccacucucca

SEQ ID NO: 586394 - RNA, 21 nt, Homo sapiens
ugcauuuucccagauacuucc

SEQ ID NO: 586395 - RNA, 14 nt, Homo sapiens
ugcauuuuccucuu

SEQ ID NO: 586396 - RNA, 15 nt, Homo sapiens
ugcauuuugcuauug

SEQ ID NO: 586397 - RNA, 15 nt, Homo sapiens
ugccaaaaaaagaca

SEQ ID NO: 586398 - RNA, 20 nt, Homo sapiens
ugccaaaauccaaggcaauu

SEQ ID NO: 586399 - RNA, 20 nt, Homo sapiens
ugccaaacacauuuacccuu

SEQ ID NO: 586400 - RNA, 14 nt, Homo sapiens
ugccaaaccacaag

SEQ ID NO: 586401 - RNA, 19 nt, Homo sapiens
ugccaaaguagcugaugua

SEQ ID NO: 586402 - RNA, 13 nt, Homo sapiens
ugccaaaguaguc

SEQ ID NO: 586403 - RNA, 17 nt, Homo sapiens
ugccaaauugacuguca

SEQ ID NO: 586404 - RNA, 16 nt, Homo sapiens
ugccaacauacuuuaa

SEQ ID NO: 586405 - RNA, 14 nt, Homo sapiens
ugccaaccagacac

SEQ ID NO: 586406 - RNA, 20 nt, Homo sapiens
ugccaaccggucacccagga

SEQ ID NO: 586407 - RNA, 21 nt, Homo sapiens
ugccaaccggucacccaggag

SEQ ID NO: 586408 - RNA, 14 nt, Homo sapiens
ugccaacuccucac

SEQ ID NO: 586409 - RNA, 18 nt, Homo sapiens
ugccaagaauaaagaagu

SEQ ID NO: 586410 - RNA, 16 nt, Homo sapiens
ugccaagacaaaucaa

SEQ ID NO: 586411 - RNA, 16 nt, Homo sapiens
ugccaagagccgacaa

SEQ ID NO: 586412 - RNA, 19 nt, Homo sapiens
ugccaagagccgacaaugc

SEQ ID NO: 586413 - RNA, 23 nt, Homo sapiens
ugccaagggaggcggauuucccu

SEQ ID NO: 586414 - RNA, 21 nt, Homo sapiens
ugccaagggggugacuggaag

SEQ ID NO: 586415 - RNA, 20 nt, Homo sapiens
ugccaauagugucauccuca

SEQ ID NO: 586416 - RNA, 15 nt, Homo sapiens
ugccaauuagcaauu

SEQ ID NO: 586417 - RNA, 23 nt, Homo sapiens
ugccaauuauuguuacacauuaa

SEQ ID NO: 586418 - RNA, 12 nt, Homo sapiens
ugccacaaccag

SEQ ID NO: 586419 - RNA, 22 nt, Homo sapiens
ugccacaaugcaguucugagca

SEQ ID NO: 586420 - RNA, 22 nt, Homo sapiens
ugccacacccugcucugggcac

SEQ ID NO: 586421 - RNA, 16 nt, Homo sapiens
ugccacagaugauacu

SEQ ID NO: 586422 - RNA, 21 nt, Homo sapiens
ugccacagaugauacuuccaa

SEQ ID NO: 586423 - RNA, 20 nt, Homo sapiens
ugccacagcaaggaaauguc

SEQ ID NO: 586424 - RNA, 17 nt, Homo sapiens
ugccacagccagaggag

SEQ ID NO: 586425 - RNA, 21 nt, Homo sapiens
uggcaaggcuuaggaaaguga

SEQ ID NO: 586426 - RNA, 19 nt, Homo sapiens
uggcaagucuagagucuca

SEQ ID NO: 586427 - RNA, 21 nt, Homo sapiens
uggcaagugaauuugccugua

SEQ ID NO: 586428 - RNA, 14 nt, Homo sapiens
uggcaauaaacucc

SEQ ID NO: 586429 - RNA, 22 nt, Homo sapiens
uggcaauaaacuccuacuaaau

SEQ ID NO: 586430 - RNA, 15 nt, Homo sapiens
uggcaauaggacaaa

SEQ ID NO: 586431 - RNA, 20 nt, Homo sapiens
uggcaauauaaggggaugag

SEQ ID NO: 586432 - RNA, 23 nt, Homo sapiens
uggcaaucucagaugcaguuugg

SEQ ID NO: 586433 - RNA, 23 nt, Homo sapiens
uggcacaaaaaaauaucagacaa

SEQ ID NO: 586434 - RNA, 16 nt, Homo sapiens
uggcacagaugcccac

SEQ ID NO: 586435 - RNA, 13 nt, Homo sapiens
uggcacaggagac

SEQ ID NO: 586436 - RNA, 16 nt, Homo sapiens
uggcacaggagacucc

SEQ ID NO: 586437 - RNA, 16 nt, Homo sapiens
uggcacaugccuguaa

SEQ ID NO: 586438 - RNA, 22 nt, Homo sapiens
uggcacauggguggacacggau

SEQ ID NO: 586439 - RNA, 15 nt, Homo sapiens
uggcaccagaugcaa

SEQ ID NO: 586440 - RNA, 17 nt, Homo sapiens
uggcaccccagcuaccc

SEQ ID NO: 586441 - RNA, 15 nt, Homo sapiens
uggcaccgagacaau

SEQ ID NO: 586442 - RNA, 14 nt, Homo sapiens
uggcaccucugccc

SEQ ID NO: 586443 - RNA, 19 nt, Homo sapiens
uggcaccuuaguugcauga

SEQ ID NO: 586444 - RNA, 20 nt, Homo sapiens
uggcaccuuaguugcaugac

SEQ ID NO: 586445 - RNA, 22 nt, Homo sapiens
uggcaccuuaguugcaugacca

SEQ ID NO: 586446 - RNA, 12 nt, Homo sapiens
uggcacuauccg

SEQ ID NO: 586447 - RNA, 15 nt, Homo sapiens
uggcacucagucucu

SEQ ID NO: 586448 - RNA, 16 nt, Homo sapiens
uggcacucuguaguca

SEQ ID NO: 586449 - RNA, 17 nt, Homo sapiens
uggcacuggaugcagaa

SEQ ID NO: 586450 - RNA, 19 nt, Homo sapiens
uggcacuuugaaggggccu

SEQ ID NO: 586451 - RNA, 19 nt, Homo sapiens
uggcagaaccaaagcucaa

SEQ ID NO: 586452 - RNA, 12 nt, Homo sapiens
uggcagacaucu

SEQ ID NO: 586453 - RNA, 22 nt, Homo sapiens
uggcagacuagagucugagaug

SEQ ID NO: 586454 - RNA, 19 nt, Homo sapiens
uggcagaguuacaguucug

SEQ ID NO: 586455 - RNA, 12 nt, Homo sapiens
uggcagaugucu

SEQ ID NO: 586456 - RNA, 15 nt, Homo sapiens
uggcagauuuuacaa

SEQ ID NO: 586457 - RNA, 17 nt, Homo sapiens
uggcagcauacacagau

SEQ ID NO: 586458 - RNA, 18 nt, Homo sapiens
uggcagcuggaccaucuc

SEQ ID NO: 586459 - RNA, 17 nt, Homo sapiens
uggcaggaaucuaucca

SEQ ID NO: 586460 - RNA, 12 nt, Homo sapiens
uggcaggcccac

SEQ ID NO: 586461 - RNA, 23 nt, Homo sapiens
uggcagggccagggcaaugccau

SEQ ID NO: 586462 - RNA, 17 nt, Homo sapiens
uggcagucccuuauaau

SEQ ID NO: 586463 - RNA, 19 nt, Homo sapiens
uggcaguguggcagugacc

SEQ ID NO: 586464 - RNA, 21 nt, Homo sapiens
uggcaguguggcagugaccau

SEQ ID NO: 586465 - RNA, 17 nt, Homo sapiens
uggcaguuugaagucaa

SEQ ID NO: 586466 - RNA, 19 nt, Homo sapiens
uggcauacgccuguagucc

SEQ ID NO: 586467 - RNA, 21 nt, Homo sapiens
uggcauaggccuuagcaguaa

SEQ ID NO: 586468 - RNA, 22 nt, Homo sapiens
uggcauccaagacucuuuauga

SEQ ID NO: 586469 - RNA, 16 nt, Homo sapiens
uggcaucccaguggcc

SEQ ID NO: 586470 - RNA, 14 nt, Homo sapiens
uggcaucuaucugg

SEQ ID NO: 586471 - RNA, 16 nt, Homo sapiens
uggcaucucacuuuau

SEQ ID NO: 586472 - RNA, 16 nt, Homo sapiens
uggcaucuccauguag

SEQ ID NO: 586473 - RNA, 12 nt, Homo sapiens
uggcaucugugu

SEQ ID NO: 586474 - RNA, 17 nt, Homo sapiens
uggcauggauuaauaga

SEQ ID NO: 586475 - RNA, 14 nt, Homo sapiens
uggcaugggacaga

SEQ ID NO: 586476 - RNA, 21 nt, Homo sapiens
uggcauugucuguaaugacaa

SEQ ID NO: 586477 - RNA, 17 nt, Homo sapiens
uggcauuuccuggucag

SEQ ID NO: 586478 - RNA, 23 nt, Homo sapiens
uggcauuuuauaggcauaccucc

SEQ ID NO: 586479 - RNA, 22 nt, Homo sapiens
uggcauuuuccucgccuaggcc

SEQ ID NO: 586480 - RNA, 17 nt, Homo sapiens
uggccaaauagcaaaga

SEQ ID NO: 586481 - RNA, 18 nt, Homo sapiens
uggccaaauaugcacuuu

SEQ ID NO: 586482 - RNA, 19 nt, Homo sapiens
uggccaaauaugcacuuuc

SEQ ID NO: 586483 - RNA, 14 nt, Homo sapiens
uggccaacugcaaa

SEQ ID NO: 586484 - RNA, 14 nt, Homo sapiens
uggccaacuguuac

SEQ ID NO: 586485 - RNA, 17 nt, Homo sapiens
uggccaagagaccagcc

SEQ ID NO: 586486 - RNA, 20 nt, Homo sapiens
uggccaagcaauuccucuga

SEQ ID NO: 586487 - RNA, 19 nt, Homo sapiens
uggccaaggagcugcuaua

SEQ ID NO: 586488 - RNA, 15 nt, Homo sapiens
uggccaaggugucca

SEQ ID NO: 586489 - RNA, 22 nt, Homo sapiens
uggccaauaacuuuucaccaau

SEQ ID NO: 586490 - RNA, 18 nt, Homo sapiens
ugggaagcagucucuucc

SEQ ID NO: 586491 - RNA, 15 nt, Homo sapiens
ugggaauaauugcuu

SEQ ID NO: 586492 - RNA, 20 nt, Homo sapiens
ugggacacaaaacuccgccc

SEQ ID NO: 586493 - RNA, 19 nt, Homo sapiens
ugggacauggcacaggccc

SEQ ID NO: 586494 - RNA, 18 nt, Homo sapiens
ugggacaugguaccuaag

SEQ ID NO: 586495 - RNA, 12 nt, Homo sapiens
ugggaccacaga

SEQ ID NO: 586496 - RNA, 19 nt, Homo sapiens
ugggaccagaaguguuuca

SEQ ID NO: 586497 - RNA, 15 nt, Homo sapiens
ugggaccgugcccac

SEQ ID NO: 586498 - RNA, 16 nt, Homo sapiens
ugggacuccuuugcau

SEQ ID NO: 586499 - RNA, 12 nt, Homo sapiens
ugggacugagaa

SEQ ID NO: 586500 - RNA, 18 nt, Homo sapiens
ugggagaaggacuaucaa

SEQ ID NO: 586501 - RNA, 18 nt, Homo sapiens
ugggagacaacuggacaa

SEQ ID NO: 586502 - RNA, 18 nt, Homo sapiens
ugggagacugaagacuca

SEQ ID NO: 586503 - RNA, 14 nt, Homo sapiens
ugggagacuuugaa

SEQ ID NO: 586504 - RNA, 21 nt, Homo sapiens
ugggagagccagcuuugcuau

SEQ ID NO: 586505 - RNA, 20 nt, Homo sapiens
ugggagauucaagggaccca

SEQ ID NO: 586506 - RNA, 19 nt, Homo sapiens
ugggagcacggacugucag

SEQ ID NO: 586507 - RNA, 18 nt, Homo sapiens
ugggagcaggaacaauga

SEQ ID NO: 586508 - RNA, 20 nt, Homo sapiens
ugggagcccugaccuuggcu

SEQ ID NO: 586509 - RNA, 18 nt, Homo sapiens
ugggaggagggagaggga

SEQ ID NO: 586510 - RNA, 16 nt, Homo sapiens
ugggaggagugguggg

SEQ ID NO: 586511 - RNA, 13 nt, Homo sapiens
ugggaggcaagaa

SEQ ID NO: 586512 - RNA, 16 nt, Homo sapiens
ugggaggccaaggugg

SEQ ID NO: 586513 - RNA, 17 nt, Homo sapiens
ugggaggcuguggagcc

SEQ ID NO: 586514 - RNA, 16 nt, Homo sapiens
ugggaggguaccagca

SEQ ID NO: 586515 - RNA, 23 nt, Homo sapiens
ugggagguagaaggggaggacac

SEQ ID NO: 586516 - RNA, 16 nt, Homo sapiens
ugggaggucuugcuag

SEQ ID NO: 586517 - RNA, 18 nt, Homo sapiens
ugggagucugaggccuga

SEQ ID NO: 586518 - RNA, 23 nt, Homo sapiens
ugggauauccuuucacucugcau

SEQ ID NO: 586519 - RNA, 19 nt, Homo sapiens
ugggaucgcaccuuuuaua

SEQ ID NO: 586520 - RNA, 17 nt, Homo sapiens
ugggaucugucuuggca

SEQ ID NO: 586521 - RNA, 17 nt, Homo sapiens
ugggaugagagggccca

SEQ ID NO: 586522 - RNA, 15 nt, Homo sapiens
ugggaugcacucuca

SEQ ID NO: 586523 - RNA, 21 nt, Homo sapiens
ugggauguccuacuaucacug

SEQ ID NO: 586524 - RNA, 17 nt, Homo sapiens
ugggauguucagcacug

SEQ ID NO: 586525 - RNA, 12 nt, Homo sapiens
ugggauucccac

SEQ ID NO: 586526 - RNA, 17 nt, Homo sapiens
ugggauuggcugugaac

SEQ ID NO: 586527 - RNA, 23 nt, Homo sapiens
ugggauuucucccucucagugga

SEQ ID NO: 586528 - RNA, 21 nt, Homo sapiens
ugggcaaaacccacagaagac

SEQ ID NO: 586529 - RNA, 16 nt, Homo sapiens
ugggcaaacaggcagu

SEQ ID NO: 586530 - RNA, 23 nt, Homo sapiens
ugggcaaaggacaugaacagaca

SEQ ID NO: 586531 - RNA, 23 nt, Homo sapiens
ugggcaaaggcagggccacuuuu

SEQ ID NO: 586532 - RNA, 23 nt, Homo sapiens
ugggcaacagagcaagacuccau

SEQ ID NO: 586533 - RNA, 18 nt, Homo sapiens
ugggcaacagagcaagau

SEQ ID NO: 586534 - RNA, 18 nt, Homo sapiens
ugggcaacauaccaagac

SEQ ID NO: 586535 - RNA, 17 nt, Homo sapiens
ugggcaacauagugaga

SEQ ID NO: 586536 - RNA, 15 nt, Homo sapiens
ugggcacaucugcug

SEQ ID NO: 586537 - RNA, 16 nt, Homo sapiens
ugggcaccucagaaag

SEQ ID NO: 586538 - RNA, 13 nt, Homo sapiens
ugggcacuggccc

SEQ ID NO: 586539 - RNA, 15 nt, Homo sapiens
ugggcagauccucaa

SEQ ID NO: 586540 - RNA, 13 nt, Homo sapiens
ugggcagccagga

SEQ ID NO: 586541 - RNA, 20 nt, Homo sapiens
ugggcagcuauccagugacu

SEQ ID NO: 586542 - RNA, 14 nt, Homo sapiens
ugggcagggaugau

SEQ ID NO: 586543 - RNA, 12 nt, Homo sapiens
ugggcaggguga

SEQ ID NO: 586544 - RNA, 12 nt, Homo sapiens
ugggcaggugaa

SEQ ID NO: 586545 - RNA, 21 nt, Homo sapiens
ugggcaggugguggcacugag

SEQ ID NO: 586546 - RNA, 20 nt, Homo sapiens
ugggcaucccagcuugcccc

SEQ ID NO: 586547 - RNA, 12 nt, Homo sapiens
ugggcaugugau

SEQ ID NO: 586548 - RNA, 19 nt, Homo sapiens
ugggcauuuuucuuacuuu

SEQ ID NO: 586549 - RNA, 14 nt, Homo sapiens
ugaugacuuacuau

SEQ ID NO: 586550 - RNA, 23 nt, Homo sapiens
ugaugagacccuuuuaucugcug

SEQ ID NO: 586551 - RNA, 23 nt, Homo sapiens
ugaugagagaauggagacagagu

SEQ ID NO: 586552 - RNA, 13 nt, Homo sapiens
ugaugagcacauc

SEQ ID NO: 586553 - RNA, 12 nt, Homo sapiens
ugaugagcuuag

SEQ ID NO: 586554 - RNA, 20 nt, Homo sapiens
ugaugaggaaggacuugacu

SEQ ID NO: 586555 - RNA, 21 nt, Homo sapiens
ugaugaucaaaaccugugcca

SEQ ID NO: 586556 - RNA, 17 nt, Homo sapiens
ugaugauuaauucaccu

SEQ ID NO: 586557 - RNA, 14 nt, Homo sapiens
ugaugcaccugcag

SEQ ID NO: 586558 - RNA, 14 nt, Homo sapiens
ugaugcauugaccu

SEQ ID NO: 586559 - RNA, 23 nt, Homo sapiens
ugaugccagagggccagcaggcu

SEQ ID NO: 586560 - RNA, 13 nt, Homo sapiens
ugaugccauguaa

SEQ ID NO: 586561 - RNA, 15 nt, Homo sapiens
ugaugcccaggucac

SEQ ID NO: 586562 - RNA, 17 nt, Homo sapiens
ugaugccccuuccccaa

SEQ ID NO: 586563 - RNA, 22 nt, Homo sapiens
ugaugccuuuauaaaucuuucu

SEQ ID NO: 586564 - RNA, 16 nt, Homo sapiens
ugaugcuaaucuuguc

SEQ ID NO: 586565 - RNA, 13 nt, Homo sapiens
ugaugcuaugguu

SEQ ID NO: 586566 - RNA, 23 nt, Homo sapiens
ugaugcucccuccccugcccugg

SEQ ID NO: 586567 - RNA, 14 nt, Homo sapiens
ugaugcucccuuga

SEQ ID NO: 586568 - RNA, 21 nt, Homo sapiens
ugauggaaaauaaacaucagu

SEQ ID NO: 586569 - RNA, 15 nt, Homo sapiens
ugauggaacugugua

SEQ ID NO: 586570 - RNA, 16 nt, Homo sapiens
ugauggacaaaggccu

SEQ ID NO: 586571 - RNA, 21 nt, Homo sapiens
ugauggagauauuuacaugaa

SEQ ID NO: 586572 - RNA, 13 nt, Homo sapiens
ugauggaugucuu

SEQ ID NO: 586573 - RNA, 13 nt, Homo sapiens
ugauggcaaaaaa

SEQ ID NO: 586574 - RNA, 20 nt, Homo sapiens
ugauggcgggcacuggguac

SEQ ID NO: 586575 - RNA, 14 nt, Homo sapiens
ugauggcuaugccu

SEQ ID NO: 586576 - RNA, 12 nt, Homo sapiens
ugauggcugaag

SEQ ID NO: 586577 - RNA, 19 nt, Homo sapiens
ugauggggaaggaguacaa

SEQ ID NO: 586578 - RNA, 23 nt, Homo sapiens
ugauggggugggagacuuuccau

SEQ ID NO: 586579 - RNA, 21 nt, Homo sapiens
ugauggucuuaaggaacaucu

SEQ ID NO: 586580 - RNA, 19 nt, Homo sapiens
ugaugguggacuaagcaau

SEQ ID NO: 586581 - RNA, 19 nt, Homo sapiens
ugauguacagucugucaug

SEQ ID NO: 586582 - RNA, 21 nt, Homo sapiens
ugauguauuucaagucucuca

SEQ ID NO: 586583 - RNA, 19 nt, Homo sapiens
ugaugucagaaacaaugac

SEQ ID NO: 586584 - RNA, 22 nt, Homo sapiens
ugaugucauaucauuucacugu

SEQ ID NO: 586585 - RNA, 13 nt, Homo sapiens
ugauguccagaag

SEQ ID NO: 586586 - RNA, 13 nt, Homo sapiens
ugauguccccaaa

SEQ ID NO: 586587 - RNA, 16 nt, Homo sapiens
ugauguccucucucag

SEQ ID NO: 586588 - RNA, 15 nt, Homo sapiens
ugauguggcaaaagg

SEQ ID NO: 586589 - RNA, 16 nt, Homo sapiens
ugauguguccucaggg

SEQ ID NO: 586590 - RNA, 14 nt, Homo sapiens
ugaugugucuucaa

SEQ ID NO: 586591 - RNA, 19 nt, Homo sapiens
ugauguuuggggaucgaug

SEQ ID NO: 586592 - RNA, 19 nt, Homo sapiens
ugauguuuuacgugcaaac

SEQ ID NO: 586593 - RNA, 16 nt, Homo sapiens
ugcaauauuuacauuu

SEQ ID NO: 586594 - RNA, 16 nt, Homo sapiens
ugcaauguaagcauac

SEQ ID NO: 586595 - RNA, 13 nt, Homo sapiens
ugcaaugucacaa

SEQ ID NO: 586596 - RNA, 14 nt, Homo sapiens
ugcaauuccaagaa

SEQ ID NO: 586597 - RNA, 19 nt, Homo sapiens
ugcaauugacauaggcaau

SEQ ID NO: 586598 - RNA, 14 nt, Homo sapiens
ugcaauugaccucu

SEQ ID NO: 586599 - RNA, 12 nt, Homo sapiens
ugcacaacagcc

SEQ ID NO: 586600 - RNA, 17 nt, Homo sapiens
ugcacaagcacuaucac

SEQ ID NO: 586601 - RNA, 14 nt, Homo sapiens
ugcacaauauuucu

SEQ ID NO: 586602 - RNA, 20 nt, Homo sapiens
ugcacacacacacaucucau

SEQ ID NO: 586603 - RNA, 17 nt, Homo sapiens
ugcacacauauacaugu

SEQ ID NO: 586604 - RNA, 15 nt, Homo sapiens
ugcacaccucaugag

SEQ ID NO: 586605 - RNA, 14 nt, Homo sapiens
ugcacaccuuggaa

SEQ ID NO: 586606 - RNA, 22 nt, Homo sapiens
ugcacacuaguuuaugcuaccu

SEQ ID NO: 586607 - RNA, 13 nt, Homo sapiens
ugcacacugccug

SEQ ID NO: 586608 - RNA, 17 nt, Homo sapiens
ugcacacuuacaguaua

SEQ ID NO: 586609 - RNA, 14 nt, Homo sapiens
ugcacacuuugcca

SEQ ID NO: 586610 - RNA, 20 nt, Homo sapiens
ugcacagaaacuugaacucc

SEQ ID NO: 586611 - RNA, 20 nt, Homo sapiens
ugcacagauaaguaggccau

SEQ ID NO: 586612 - RNA, 21 nt, Homo sapiens
ugcacagaucugcuugaucaa

SEQ ID NO: 586613 - RNA, 16 nt, Homo sapiens
ugcacagauugcugaa

SEQ ID NO: 586614 - RNA, 17 nt, Homo sapiens
ugcacagauugcugaaa

SEQ ID NO: 586615 - RNA, 21 nt, Homo sapiens
ugcacagcaaaagaaacuauc

SEQ ID NO: 586616 - RNA, 21 nt, Homo sapiens
ugcacagcaggaccugugcuu

SEQ ID NO: 586617 - RNA, 24 nt, Homo sapiens
ugcacagccuaguuaucaagggga

SEQ ID NO: 586618 - RNA, 13 nt, Homo sapiens
ugcacaguacugu

SEQ ID NO: 586619 - RNA, 15 nt, Homo sapiens
ugcacaguacuguuu

SEQ ID NO: 586620 - RNA, 22 nt, Homo sapiens
ugcacaguacuguuucaaauca

SEQ ID NO: 586621 - RNA, 20 nt, Homo sapiens
ugcacagucacugcucuuca

SEQ ID NO: 586622 - RNA, 14 nt, Homo sapiens
ugcacagugauaua

SEQ ID NO: 586623 - RNA, 17 nt, Homo sapiens
ugcacagugugugacuu

SEQ ID NO: 586624 - RNA, 18 nt, Homo sapiens
ugcacagugugugacuua

SEQ ID NO: 586625 - RNA, 17 nt, Homo sapiens
ugcacaucauauucuau

SEQ ID NO: 586626 - RNA, 19 nt, Homo sapiens
ugcacaugauaaacaucaa

SEQ ID NO: 586627 - RNA, 13 nt, Homo sapiens
ugcacauugccug

SEQ ID NO: 586628 - RNA, 12 nt, Homo sapiens
ugcaccaaagac

SEQ ID NO: 586629 - RNA, 12 nt, Homo sapiens
ugcaccaaagau

SEQ ID NO: 586630 - RNA, 14 nt, Homo sapiens
ugcaccaccaagcc

SEQ ID NO: 586631 - RNA, 14 nt, Homo sapiens
ugcaccacugcacu

SEQ ID NO: 586632 - RNA, 14 nt, Homo sapiens
ugcaccagagcaac

SEQ ID NO: 586633 - RNA, 14 nt, Homo sapiens
ugcaccauggagac

SEQ ID NO: 586634 - RNA, 14 nt, Homo sapiens
ugcaccauugcacu

SEQ ID NO: 586635 - RNA, 15 nt, Homo sapiens
ugcacccacccagga

SEQ ID NO: 586636 - RNA, 19 nt, Homo sapiens
ugcaccccucugcccucau

SEQ ID NO: 586637 - RNA, 20 nt, Homo sapiens
ugcaccccuuuccuccccau

SEQ ID NO: 586638 - RNA, 19 nt, Homo sapiens
ugcaccgucucacugugug

SEQ ID NO: 586639 - RNA, 22 nt, Homo sapiens
ugcaccuacugcuuacuguugc

SEQ ID NO: 586640 - RNA, 20 nt, Homo sapiens
ugcaccuaucucagccauag

SEQ ID NO: 586641 - RNA, 20 nt, Homo sapiens
ugcaccucccuccccagcuc

SEQ ID NO: 586642 - RNA, 16 nt, Homo sapiens
ugcaccuguaauccca

SEQ ID NO: 586643 - RNA, 23 nt, Homo sapiens
ugcaccuuacaacucggggacaa

SEQ ID NO: 586644 - RNA, 17 nt, Homo sapiens
ugcaccuuugaaaugca

SEQ ID NO: 586645 - RNA, 17 nt, Homo sapiens
ugcacgucaccaaguaa

SEQ ID NO: 586646 - RNA, 15 nt, Homo sapiens
ugcacgucuugcuau

SEQ ID NO: 586647 - RNA, 13 nt, Homo sapiens
ugcacuacuccuc

SEQ ID NO: 586648 - RNA, 23 nt, Homo sapiens
ugcacuacuccucugcagugccu

SEQ ID NO: 586649 - RNA, 13 nt, Homo sapiens
ugcacuacugaca

SEQ ID NO: 586650 - RNA, 15 nt, Homo sapiens
ugcacuagugcaauu

SEQ ID NO: 586651 - RNA, 20 nt, Homo sapiens
ugcacuauguauauacauau

SEQ ID NO: 586652 - RNA, 15 nt, Homo sapiens
ugcacucacuccuga

SEQ ID NO: 586653 - RNA, 15 nt, Homo sapiens
ugcacucccaccuga

SEQ ID NO: 586654 - RNA, 18 nt, Homo sapiens
ugcacuccggucccaaau

SEQ ID NO: 586655 - RNA, 18 nt, Homo sapiens
ugcacucuagccuggcaa

SEQ ID NO: 586656 - RNA, 19 nt, Homo sapiens
ugcacucuagccuggcaac

SEQ ID NO: 586657 - RNA, 22 nt, Homo sapiens
ugcacucuugaacugggcgaau

SEQ ID NO: 586658 - RNA, 14 nt, Homo sapiens
ugcacugaccugua

SEQ ID NO: 586659 - RNA, 20 nt, Homo sapiens
ugcacugaccuguaggucag

SEQ ID NO: 586660 - RNA, 14 nt, Homo sapiens
ugcacugacuguga

SEQ ID NO: 586661 - RNA, 15 nt, Homo sapiens
ugcacugacugugaa

SEQ ID NO: 586662 - RNA, 23 nt, Homo sapiens
ugcacugacugugaaaccuuuac

SEQ ID NO: 586663 - RNA, 23 nt, Homo sapiens
ugcacuggaaccauugcuuuacu

SEQ ID NO: 586664 - RNA, 18 nt, Homo sapiens
ugcacuguaaauaucccu

SEQ ID NO: 586665 - RNA, 21 nt, Homo sapiens
ugcacuguauauagaagucua

SEQ ID NO: 586666 - RNA, 18 nt, Homo sapiens
ugcacuguauugcuccuc

SEQ ID NO: 586667 - RNA, 16 nt, Homo sapiens
ugcacugucacuuugc

SEQ ID NO: 586668 - RNA, 21 nt, Homo sapiens
ugcacugucgauaaucagaga

SEQ ID NO: 586669 - RNA, 15 nt, Homo sapiens
ugcacugucugagaa

SEQ ID NO: 586670 - RNA, 23 nt, Homo sapiens
ugcacuuaaagaaguauuuuuag

SEQ ID NO: 586671 - RNA, 22 nt, Homo sapiens
ugcacuuauaagaaagaucaaa

SEQ ID NO: 586672 - RNA, 18 nt, Homo sapiens
ugcacuuauacccaugaa

SEQ ID NO: 586673 - RNA, 22 nt, Homo sapiens
ugcacuuucccuagaaagccau

SEQ ID NO: 586674 - RNA, 17 nt, Homo sapiens
ugcacuuuuaaaccucu

SEQ ID NO: 586675 - RNA, 15 nt, Homo sapiens
ugcagaaacuacuga

SEQ ID NO: 586676 - RNA, 20 nt, Homo sapiens
ugcagaacaucgauauguau

SEQ ID NO: 586677 - RNA, 13 nt, Homo sapiens
ugcagaacugcca

SEQ ID NO: 586678 - RNA, 19 nt, Homo sapiens
ugcagaagagaaacugagg

SEQ ID NO: 586679 - RNA, 20 nt, Homo sapiens
ugcagaagagaaacugaggc

SEQ ID NO: 586680 - RNA, 14 nt, Homo sapiens
ugcagaagcacaug

SEQ ID NO: 586681 - RNA, 22 nt, Homo sapiens
ugcagaagcacaugauggugaa

SEQ ID NO: 586682 - RNA, 13 nt, Homo sapiens
ugcagaaggcaau

SEQ ID NO: 586683 - RNA, 16 nt, Homo sapiens
ugcagaaguacuccua

SEQ ID NO: 586684 - RNA, 15 nt, Homo sapiens
ugcagaaugacucca

SEQ ID NO: 586685 - RNA, 13 nt, Homo sapiens
ugcagaauggcau

SEQ ID NO: 586686 - RNA, 20 nt, Homo sapiens
ugcagaauuguuuuuugcuc

SEQ ID NO: 586687 - RNA, 16 nt, Homo sapiens
ugcagacaacaccuuc

SEQ ID NO: 586688 - RNA, 21 nt, Homo sapiens
ugcagacagaagucuccucaa

SEQ ID NO: 586689 - RNA, 23 nt, Homo sapiens
ugcagacaggccaugugagccac

SEQ ID NO: 586690 - RNA, 22 nt, Homo sapiens
ugcagacagucuguuaugcacu

SEQ ID NO: 586691 - RNA, 15 nt, Homo sapiens
ugcagacaucucugg

SEQ ID NO: 586692 - RNA, 22 nt, Homo sapiens
ugcagacaucucuggagccaga

SEQ ID NO: 586693 - RNA, 13 nt, Homo sapiens
ugcagaccucacu

SEQ ID NO: 586694 - RNA, 22 nt, Homo sapiens
ugcagagaaacuuaagcaaagg

SEQ ID NO: 586695 - RNA, 15 nt, Homo sapiens
ugcagagaugacugu

SEQ ID NO: 586696 - RNA, 16 nt, Homo sapiens
ugcagagaugacuguc

SEQ ID NO: 586697 - RNA, 12 nt, Homo sapiens
ugcagagcaaug

SEQ ID NO: 586698 - RNA, 17 nt, Homo sapiens
ugcagagcccauagcca

SEQ ID NO: 586699 - RNA, 20 nt, Homo sapiens
ugcagagggacagaugacca

SEQ ID NO: 586700 - RNA, 17 nt, Homo sapiens
ugcagaugaucagggau

SEQ ID NO: 586701 - RNA, 20 nt, Homo sapiens
ugcagaugccacccuagcca

SEQ ID NO: 586702 - RNA, 18 nt, Homo sapiens
ugcagaugguugcaauug

SEQ ID NO: 586703 - RNA, 17 nt, Homo sapiens
ugcagauucagugcaau

SEQ ID NO: 586704 - RNA, 18 nt, Homo sapiens
ugcagcaaggggacaucu

SEQ ID NO: 586705 - RNA, 19 nt, Homo sapiens
ugcagcacucuuaucuaca

SEQ ID NO: 586706 - RNA, 18 nt, Homo sapiens
ugcagcagggaugcccug

SEQ ID NO: 586707 - RNA, 16 nt, Homo sapiens
ugcagcaggugaccuc

SEQ ID NO: 586708 - RNA, 22 nt, Homo sapiens
ugcagcagugagucucuucaga

SEQ ID NO: 586709 - RNA, 22 nt, Homo sapiens
ugcagcauggucccugccuuag

SEQ ID NO: 586710 - RNA, 16 nt, Homo sapiens
ugcagccaaccaagau

SEQ ID NO: 586711 - RNA, 18 nt, Homo sapiens
ugcagccacugugcugaa

SEQ ID NO: 586712 - RNA, 14 nt, Homo sapiens
ugcagcccaugccc

SEQ ID NO: 586713 - RNA, 20 nt, Homo sapiens
ugcagcucuugggaccgugu

SEQ ID NO: 586714 - RNA, 11 nt, Homo sapiens
ugcagcuguca

SEQ ID NO: 586715 - RNA, 13 nt, Homo sapiens
ugcagcugugagu

SEQ ID NO: 586716 - RNA, 16 nt, Homo sapiens
uuaauacauugaucag

SEQ ID NO: 586717 - RNA, 12 nt, Homo sapiens
uuaauaccaaag

SEQ ID NO: 586718 - RNA, 19 nt, Homo sapiens
uuaauacucaaaugaguaa

SEQ ID NO: 586719 - RNA, 19 nt, Homo sapiens
uuaauacugacucaguguc

SEQ ID NO: 586720 - RNA, 20 nt, Homo sapiens
uuaauacugacucagugucu

SEQ ID NO: 586721 - RNA, 13 nt, Homo sapiens
uuaauacuguuua

SEQ ID NO: 586722 - RNA, 19 nt, Homo sapiens
uuaauagaaauaaauuccu

SEQ ID NO: 586723 - RNA, 20 nt, Homo sapiens
uuaauagaaauaaauuccua

SEQ ID NO: 586724 - RNA, 18 nt, Homo sapiens
uuaauagacugagucaga

SEQ ID NO: 586725 - RNA, 14 nt, Homo sapiens
uuaauagacuucuc

SEQ ID NO: 586726 - RNA, 17 nt, Homo sapiens
uuaauagcuauggaauc

SEQ ID NO: 586727 - RNA, 14 nt, Homo sapiens
uuaauaguauuuau

SEQ ID NO: 586728 - RNA, 17 nt, Homo sapiens
uuaauagucauuccaaa

SEQ ID NO: 586729 - RNA, 14 nt, Homo sapiens
uuaauauaaaccca

SEQ ID NO: 586730 - RNA, 14 nt, Homo sapiens
uuaauauaucccag

SEQ ID NO: 586731 - RNA, 23 nt, Homo sapiens
uuaauauaugcaucccuggugaa

SEQ ID NO: 586732 - RNA, 20 nt, Homo sapiens
uuaauaugauucuaguacau

SEQ ID NO: 586733 - RNA, 13 nt, Homo sapiens
uuaauaugcugca

SEQ ID NO: 586734 - RNA, 20 nt, Homo sapiens
uuaauauuaccaacuacauu

SEQ ID NO: 586735 - RNA, 13 nt, Homo sapiens
uuaauauugcagu

SEQ ID NO: 586736 - RNA, 17 nt, Homo sapiens
uuaauauuuuaagcacu

SEQ ID NO: 586737 - RNA, 12 nt, Homo sapiens
uuaaucacuacu

SEQ ID NO: 586738 - RNA, 18 nt, Homo sapiens
uuaaucacuacuguaugu

SEQ ID NO: 586739 - RNA, 20 nt, Homo sapiens
uuaaucaguuguuuaauaau

SEQ ID NO: 586740 - RNA, 16 nt, Homo sapiens
uuaaucaucaaaaaga

SEQ ID NO: 586741 - RNA, 15 nt, Homo sapiens
uuaauccaauccacu

SEQ ID NO: 586742 - RNA, 16 nt, Homo sapiens
uuaauccaauccacua

SEQ ID NO: 586743 - RNA, 12 nt, Homo sapiens
uuaauccagcug

SEQ ID NO: 586744 - RNA, 14 nt, Homo sapiens
uuaauccagggaag

SEQ ID NO: 586745 - RNA, 20 nt, Homo sapiens
uuaaucccuuugucugucaa

SEQ ID NO: 586746 - RNA, 19 nt, Homo sapiens
uuaauccuguuuuuagugc

SEQ ID NO: 586747 - RNA, 15 nt, Homo sapiens
uuaauccuucuaguu

SEQ ID NO: 586748 - RNA, 22 nt, Homo sapiens
uuaaucuagagaaggcauuuca

SEQ ID NO: 586749 - RNA, 15 nt, Homo sapiens
uuaaucugcugccau

SEQ ID NO: 586750 - RNA, 22 nt, Homo sapiens
uuaaucuggacacacuguuaca

SEQ ID NO: 586751 - RNA, 13 nt, Homo sapiens
uuaaugaacuaac

SEQ ID NO: 586752 - RNA, 20 nt, Homo sapiens
uuaaugaaugccuaaauaua

SEQ ID NO: 586753 - RNA, 19 nt, Homo sapiens
uuaaugcacagugcauuau

SEQ ID NO: 586754 - RNA, 21 nt, Homo sapiens
uuaaugccuagagaaugggau

SEQ ID NO: 586755 - RNA, 14 nt, Homo sapiens
uuaauggacuguga

SEQ ID NO: 586756 - RNA, 19 nt, Homo sapiens
uuaaugggagcuuugccug

SEQ ID NO: 586757 - RNA, 21 nt, Homo sapiens
uuaaugguagcaacugaaaga

SEQ ID NO: 586758 - RNA, 13 nt, Homo sapiens
uuaaugguagcau

SEQ ID NO: 586759 - RNA, 17 nt, Homo sapiens
uuaauguauaauuugag

SEQ ID NO: 586760 - RNA, 13 nt, Homo sapiens
uuaaugucuucac

SEQ ID NO: 586761 - RNA, 19 nt, Homo sapiens
uuaauguguuaagugcagg

SEQ ID NO: 586762 - RNA, 16 nt, Homo sapiens
uuaauguuaacaagac

SEQ ID NO: 586763 - RNA, 16 nt, Homo sapiens
uuaauguucugugaua

SEQ ID NO: 586764 - RNA, 17 nt, Homo sapiens
uuaauguuuacagugga

SEQ ID NO: 586765 - RNA, 23 nt, Homo sapiens
uuaauguuuuuuaaacuaguuua

SEQ ID NO: 586766 - RNA, 13 nt, Homo sapiens
uuaauuaagcaaa

SEQ ID NO: 586767 - RNA, 21 nt, Homo sapiens
uuaauuaugaaaacuagcauu

SEQ ID NO: 586768 - RNA, 16 nt, Homo sapiens
uuaauucacucccaca

SEQ ID NO: 586769 - RNA, 19 nt, Homo sapiens
uuaauuccaauaugaugac

SEQ ID NO: 586770 - RNA, 18 nt, Homo sapiens
uuaauuccaugucagaua

SEQ ID NO: 586771 - RNA, 19 nt, Homo sapiens
uuaauuguuuaaaaaccga

SEQ ID NO: 586772 - RNA, 14 nt, Homo sapiens
uuaauuuccagggu

SEQ ID NO: 586773 - RNA, 19 nt, Homo sapiens
uuaauuuccuuuuugacac

SEQ ID NO: 586774 - RNA, 16 nt, Homo sapiens
uuaauuugcacagugu

SEQ ID NO: 586775 - RNA, 17 nt, Homo sapiens
uuaauuuucaguauaau

SEQ ID NO: 586776 - RNA, 15 nt, Homo sapiens
uuaauuuugauauaa

SEQ ID NO: 586777 - RNA, 17 nt, Homo sapiens
uuaauuuuuugguacaa

SEQ ID NO: 586778 - RNA, 23 nt, Homo sapiens
uuacaaaacaaacucauucauua

SEQ ID NO: 586779 - RNA, 21 nt, Homo sapiens
uuacaaaacugcuuugugcau

SEQ ID NO: 586780 - RNA, 15 nt, Homo sapiens
uuacaaaaugccaag

SEQ ID NO: 586781 - RNA, 12 nt, Homo sapiens
uuacaaacugca

SEQ ID NO: 586782 - RNA, 15 nt, Homo sapiens
uuacaaauagguaga

SEQ ID NO: 586783 - RNA, 13 nt, Homo sapiens
uuacaaauauugu

SEQ ID NO: 586784 - RNA, 18 nt, Homo sapiens
uuacaagagagugaaauu

SEQ ID NO: 586785 - RNA, 23 nt, Homo sapiens
uuacaagauggcgaccaccaaag

SEQ ID NO: 586786 - RNA, 21 nt, Homo sapiens
uguuucuuaagggcacacaca

SEQ ID NO: 586787 - RNA, 13 nt, Homo sapiens
uguuucuuccaaa

SEQ ID NO: 586788 - RNA, 11 nt, Homo sapiens
uguuucuugcu

SEQ ID NO: 586789 - RNA, 13 nt, Homo sapiens
uguuucuugcugc

SEQ ID NO: 586790 - RNA, 12 nt, Homo sapiens
uguuucuuuaua

SEQ ID NO: 586791 - RNA, 18 nt, Homo sapiens
uguuucuuuuguauguaa

SEQ ID NO: 586792 - RNA, 9 nt, Homo sapiens
uguuugaug

SEQ ID NO: 586793 - RNA, 14 nt, Homo sapiens
uguuuggagcucua

SEQ ID NO: 586794 - RNA, 15 nt, Homo sapiens
uguuuggccucucua

SEQ ID NO: 586795 - RNA, 19 nt, Homo sapiens
uguuuguaaauaagagauu

SEQ ID NO: 586796 - RNA, 15 nt, Homo sapiens
uguuugucauaugga

SEQ ID NO: 586797 - RNA, 20 nt, Homo sapiens
uguuugucauauggaauuua

SEQ ID NO: 586798 - RNA, 20 nt, Homo sapiens
uguuuguugagugcacugac

SEQ ID NO: 586799 - RNA, 21 nt, Homo sapiens
uguuuuaaacacaugccuuaa

SEQ ID NO: 586800 - RNA, 23 nt, Homo sapiens
uguuuuaaagaauaugacuuuuu

SEQ ID NO: 586801 - RNA, 13 nt, Homo sapiens
uguuuuaaagcac

SEQ ID NO: 586802 - RNA, 14 nt, Homo sapiens
uguuuuaaagcacu

SEQ ID NO: 586803 - RNA, 17 nt, Homo sapiens
uguuuuaaguugcuuua

SEQ ID NO: 586804 - RNA, 20 nt, Homo sapiens
uguuuuacccuauacaucca

SEQ ID NO: 586805 - RNA, 23 nt, Homo sapiens
uguuuuacucagaggagcugcaa

SEQ ID NO: 586806 - RNA, 12 nt, Homo sapiens
uguuuuagauau

SEQ ID NO: 586807 - RNA, 14 nt, Homo sapiens
uguuuuagauaucc

SEQ ID NO: 586808 - RNA, 16 nt, Homo sapiens
uguuuuauauguugcu

SEQ ID NO: 586809 - RNA, 13 nt, Homo sapiens
uguuuucagugaa

SEQ ID NO: 586810 - RNA, 16 nt, Homo sapiens
uguuuuccacugugcu

SEQ ID NO: 586811 - RNA, 19 nt, Homo sapiens
uguuuucccaaagcacuuu

SEQ ID NO: 586812 - RNA, 19 nt, Homo sapiens
uguuuuccuuugucaucau

SEQ ID NO: 586813 - RNA, 20 nt, Homo sapiens
uguuuucgcaccuaccauca

SEQ ID NO: 586814 - RNA, 17 nt, Homo sapiens
uguuuucuaaagccagg

SEQ ID NO: 586815 - RNA, 19 nt, Homo sapiens
uguuuucucagaacagcug

SEQ ID NO: 586816 - RNA, 16 nt, Homo sapiens
uguuuucucuaagaua

SEQ ID NO: 586817 - RNA, 24 nt, Homo sapiens
uguuuugauucccgggcuuaccag

SEQ ID NO: 586818 - RNA, 22 nt, Homo sapiens
uguuuugauuuguagcacugag

SEQ ID NO: 586819 - RNA, 14 nt, Homo sapiens
uguuuugcacuuuu

SEQ ID NO: 586820 - RNA, 13 nt, Homo sapiens
uguuuugcucaau

SEQ ID NO: 586821 - RNA, 17 nt, Homo sapiens
uguuuugggaucaggag

SEQ ID NO: 586822 - RNA, 21 nt, Homo sapiens
uguuuuguaagugcugcuaua

SEQ ID NO: 586823 - RNA, 12 nt, Homo sapiens
uguuuuguacaa

SEQ ID NO: 586824 - RNA, 22 nt, Homo sapiens
uguuuuuaaagaaaagcauuca

SEQ ID NO: 586825 - RNA, 13 nt, Homo sapiens
uguuuuuaagcug

SEQ ID NO: 586826 - RNA, 20 nt, Homo sapiens
uguuuuugcuuuuccuucag

SEQ ID NO: 586827 - RNA, 20 nt, Homo sapiens
uguuuuuguacaguuaucau

SEQ ID NO: 586828 - RNA, 17 nt, Homo sapiens
uguuuuuuaaagcaagu

SEQ ID NO: 586829 - RNA, 14 nt, Homo sapiens
uguuuuuuacucaa

SEQ ID NO: 586830 - RNA, 23 nt, Homo sapiens
uuaaaaaaaacaaaaagaacaaa

SEQ ID NO: 586831 - RNA, 22 nt, Homo sapiens
uuaaaaaaaagaauaaagguau

SEQ ID NO: 586832 - RNA, 20 nt, Homo sapiens
uuaaaaaaaauuaaaaccaa

SEQ ID NO: 586833 - RNA, 14 nt, Homo sapiens
uuaaaaaaacugaa

SEQ ID NO: 586834 - RNA, 16 nt, Homo sapiens
uuaaaaaaagcacaug

SEQ ID NO: 586835 - RNA, 22 nt, Homo sapiens
uuaaaaaaaugugguacauaca

SEQ ID NO: 586836 - RNA, 16 nt, Homo sapiens
uuaaaaaacguauuau

SEQ ID NO: 586837 - RNA, 14 nt, Homo sapiens
uuaaaaaagcaaau

SEQ ID NO: 586838 - RNA, 15 nt, Homo sapiens
uuaaaaaauucuugu

SEQ ID NO: 586839 - RNA, 20 nt, Homo sapiens
uuaaaaacuagagcacagaa

SEQ ID NO: 586840 - RNA, 20 nt, Homo sapiens
uuaaaaagaagagacugcua

SEQ ID NO: 586841 - RNA, 20 nt, Homo sapiens
uuaaaaagcucacugcugau

SEQ ID NO: 586842 - RNA, 15 nt, Homo sapiens
uuaaaaaggaaauuu

SEQ ID NO: 586843 - RNA, 19 nt, Homo sapiens
uuaaaaagugggcaaagga

SEQ ID NO: 586844 - RNA, 18 nt, Homo sapiens
uuaaaaaguucauaacag

SEQ ID NO: 586845 - RNA, 14 nt, Homo sapiens
uuaaaaaguuucac

SEQ ID NO: 586846 - RNA, 16 nt, Homo sapiens
uuaaaaauaaauucaa

SEQ ID NO: 586847 - RNA, 16 nt, Homo sapiens
uuaaaaauagacacuc

SEQ ID NO: 586848 - RNA, 13 nt, Homo sapiens
uuaaaacaaaaga

SEQ ID NO: 586849 - RNA, 20 nt, Homo sapiens
uuaaaacaaaggaaguucuc

SEQ ID NO: 586850 - RNA, 14 nt, Homo sapiens
uuaaaacacuuuca

SEQ ID NO: 586851 - RNA, 13 nt, Homo sapiens
uuaaaacagucua

SEQ ID NO: 586852 - RNA, 18 nt, Homo sapiens
uuaaaaccagaaagguga

SEQ ID NO: 586853 - RNA, 12 nt, Homo sapiens
uuacaagccuaa

SEQ ID NO: 586854 - RNA, 14 nt, Homo sapiens
uuacaauaagcuaa

SEQ ID NO: 586855 - RNA, 21 nt, Homo sapiens
uuacaauaaucauucuggaua

SEQ ID NO: 586856 - RNA, 21 nt, Homo sapiens
uuacaauugcaguuuugccua

SEQ ID NO: 586857 - RNA, 14 nt, Homo sapiens
uuacacaagaaucu

SEQ ID NO: 586858 - RNA, 17 nt, Homo sapiens
uuacacacaugagggcu

SEQ ID NO: 586859 - RNA, 12 nt, Homo sapiens
uuacacauagca

SEQ ID NO: 586860 - RNA, 20 nt, Homo sapiens
uuacacccuuucuugacaaa

SEQ ID NO: 586861 - RNA, 15 nt, Homo sapiens
uuacacguaccucuc

SEQ ID NO: 586862 - RNA, 15 nt, Homo sapiens
uuacagaacuacuuc

SEQ ID NO: 586863 - RNA, 12 nt, Homo sapiens
uuacagaauuau

SEQ ID NO: 586864 - RNA, 14 nt, Homo sapiens
uuacagacugugag

SEQ ID NO: 586865 - RNA, 18 nt, Homo sapiens
uuacagagaaaagacaua

SEQ ID NO: 586866 - RNA, 20 nt, Homo sapiens
uuacagagagcuugcuguga

SEQ ID NO: 586867 - RNA, 21 nt, Homo sapiens
uuacagagaggagaaacacau

SEQ ID NO: 586868 - RNA, 18 nt, Homo sapiens
uuacagcuuucugugcag

SEQ ID NO: 586869 - RNA, 20 nt, Homo sapiens
uuacaggauaucacauugga

SEQ ID NO: 586870 - RNA, 14 nt, Homo sapiens
uuacaggcacgugc

SEQ ID NO: 586871 - RNA, 22 nt, Homo sapiens
uuacaggugugagccaccgugc

SEQ ID NO: 586872 - RNA, 19 nt, Homo sapiens
uuacaguaaucccauuucc

SEQ ID NO: 586873 - RNA, 12 nt, Homo sapiens
uuacaguguaug

SEQ ID NO: 586874 - RNA, 14 nt, Homo sapiens
uuacauaucaccuc

SEQ ID NO: 586875 - RNA, 14 nt, Homo sapiens
uuacauauuugacu

SEQ ID NO: 586876 - RNA, 20 nt, Homo sapiens
uuacaucugggaucaugaua

SEQ ID NO: 586877 - RNA, 17 nt, Homo sapiens
uuacaugaagcuguaua

SEQ ID NO: 586878 - RNA, 16 nt, Homo sapiens
uuacauguaauuugau

SEQ ID NO: 586879 - RNA, 14 nt, Homo sapiens
uuacauucaucuca

SEQ ID NO: 586880 - RNA, 15 nt, Homo sapiens
uuacauuccauuuca

SEQ ID NO: 586881 - RNA, 10 nt, Homo sapiens
uuaccaaagc

SEQ ID NO: 586882 - RNA, 15 nt, Homo sapiens
uuaccaauugcuaag

SEQ ID NO: 586883 - RNA, 20 nt, Homo sapiens
uuaccagaugcuacuggacu

SEQ ID NO: 586884 - RNA, 22 nt, Homo sapiens
uuaccaggaagcagauacauau

SEQ ID NO: 586885 - RNA, 20 nt, Homo sapiens
uuaccaggcaccaaaagaag

SEQ ID NO: 586886 - RNA, 15 nt, Homo sapiens
uuaccaggugagaag

SEQ ID NO: 586887 - RNA, 19 nt, Homo sapiens
uuaccauauaauguaaaaa

SEQ ID NO: 586888 - RNA, 23 nt, Homo sapiens
uuaccauucauaguaagaauucu

SEQ ID NO: 586889 - RNA, 22 nt, Homo sapiens
uuaccauucugauggcacagaa

SEQ ID NO: 586890 - RNA, 14 nt, Homo sapiens
uuacccaagcugug

SEQ ID NO: 586891 - RNA, 19 nt, Homo sapiens
uuacccaggcuggagugca

SEQ ID NO: 586892 - RNA, 14 nt, Homo sapiens
uuaccccugcacag

SEQ ID NO: 586893 - RNA, 23 nt, Homo sapiens
uuacccuuuggccccacuuugaa

SEQ ID NO: 586894 - RNA, 17 nt, Homo sapiens
uuaccuacaagaacaau

SEQ ID NO: 586895 - RNA, 21 nt, Homo sapiens
uuaccuagauuuacagccuca

SEQ ID NO: 586896 - RNA, 15 nt, Homo sapiens
uuaccucacagugau

SEQ ID NO: 586897 - RNA, 12 nt, Homo sapiens
uuaccucugaua

SEQ ID NO: 586898 - RNA, 23 nt, Homo sapiens
uuaccucuuuaaaaacaaaacaa

SEQ ID NO: 586899 - RNA, 21 nt, Homo sapiens
uuaccugauuugaugauacau

SEQ ID NO: 586900 - RNA, 22 nt, Homo sapiens
uuaccugauuugaugauacauu

SEQ ID NO: 586901 - RNA, 20 nt, Homo sapiens
uuaccuguacacugacuuga

SEQ ID NO: 586902 - RNA, 14 nt, Homo sapiens
uuaccuuguauacu

SEQ ID NO: 586903 - RNA, 15 nt, Homo sapiens
uuaccuuuucagggc

SEQ ID NO: 586904 - RNA, 16 nt, Homo sapiens
uuacgaaaccucuuuu

SEQ ID NO: 586905 - RNA, 23 nt, Homo sapiens
uuagacucaugguguguuacaca

SEQ ID NO: 586906 - RNA, 13 nt, Homo sapiens
uuagacuugaaau

SEQ ID NO: 586907 - RNA, 13 nt, Homo sapiens
uuagagaauguuc

SEQ ID NO: 586908 - RNA, 15 nt, Homo sapiens
uuagagagagaacuu

SEQ ID NO: 586909 - RNA, 16 nt, Homo sapiens
uuagagagggaccaug

SEQ ID NO: 586910 - RNA, 23 nt, Homo sapiens
uuagagcacagcuucuucugccc

SEQ ID NO: 586911 - RNA, 23 nt, Homo sapiens
uuagagcccauuucaauucucaa

SEQ ID NO: 586912 - RNA, 14 nt, Homo sapiens
uuagagcuuccaaa

SEQ ID NO: 586913 - RNA, 15 nt, Homo sapiens
uuagaggaaggagau

SEQ ID NO: 586914 - RNA, 22 nt, Homo sapiens
uuagaggagaaaaagcuuaaug

SEQ ID NO: 586915 - RNA, 22 nt, Homo sapiens
uuagagggaaguugaaagccaa

SEQ ID NO: 586916 - RNA, 17 nt, Homo sapiens
uuagagugucuuuccac

SEQ ID NO: 586917 - RNA, 17 nt, Homo sapiens
uuagaguugcucuacaa

SEQ ID NO: 586918 - RNA, 12 nt, Homo sapiens
uuagaguuuacu

SEQ ID NO: 586919 - RNA, 21 nt, Homo sapiens
uuagauaaauuguagggcuuu

SEQ ID NO: 586920 - RNA, 18 nt, Homo sapiens
uuagauauuaggucccau

SEQ ID NO: 586921 - RNA, 19 nt, Homo sapiens
uuagaucaaauaguugcau

SEQ ID NO: 586922 - RNA, 12 nt, Homo sapiens
uuagauugcaaa

SEQ ID NO: 586923 - RNA, 12 nt, Homo sapiens
uuagauugugag

SEQ ID NO: 586924 - RNA, 20 nt, Homo sapiens
uuagauuguuaaaauaacua

SEQ ID NO: 586925 - RNA, 20 nt, Homo sapiens
uuagcaaaagcguccagaaa

SEQ ID NO: 586926 - RNA, 22 nt, Homo sapiens
uuagcaaacuguuuugacaaau

SEQ ID NO: 586927 - RNA, 16 nt, Homo sapiens
uuagcaauaacauaca

SEQ ID NO: 586928 - RNA, 17 nt, Homo sapiens
uuagcaauaacauacau

SEQ ID NO: 586929 - RNA, 17 nt, Homo sapiens
uuagcaauugacuguca

SEQ ID NO: 586930 - RNA, 14 nt, Homo sapiens
uuagcacacucaca

SEQ ID NO: 586931 - RNA, 16 nt, Homo sapiens
uuagcagcccagcaca

SEQ ID NO: 586932 - RNA, 16 nt, Homo sapiens
uuagcaguucugcaaa

SEQ ID NO: 586933 - RNA, 22 nt, Homo sapiens
uuagcauaaaauuuucuacucu

SEQ ID NO: 586934 - RNA, 17 nt, Homo sapiens
uuagcaugcuacaguua

SEQ ID NO: 586935 - RNA, 21 nt, Homo sapiens
uuagcauuuuucaaaugaucu

SEQ ID NO: 586936 - RNA, 22 nt, Homo sapiens
uuagcauuuuucaaaugaucuu

SEQ ID NO: 586937 - RNA, 21 nt, Homo sapiens
uuagccauugaaaugucaaau

SEQ ID NO: 586938 - RNA, 16 nt, Homo sapiens
uuagccauuucacucu

SEQ ID NO: 586939 - RNA, 20 nt, Homo sapiens
uuagccauuuuucaaagcaa

SEQ ID NO: 586940 - RNA, 12 nt, Homo sapiens
uuagcccaagag

SEQ ID NO: 586941 - RNA, 17 nt, Homo sapiens
uuagccuugaacaacca

SEQ ID NO: 586942 - RNA, 20 nt, Homo sapiens
uuagcuaggcuaaaacaccu

SEQ ID NO: 586943 - RNA, 12 nt, Homo sapiens
uuagcuauuacu

SEQ ID NO: 586944 - RNA, 23 nt, Homo sapiens
uuagcucucccaacucuugcaca

SEQ ID NO: 586945 - RNA, 16 nt, Homo sapiens
uuagcugaagaaguua

SEQ ID NO: 586946 - RNA, 22 nt, Homo sapiens
uuagcugauaaggaaacuuuau

SEQ ID NO: 586947 - RNA, 15 nt, Homo sapiens
uuagcugucugcuca

SEQ ID NO: 586948 - RNA, 21 nt, Homo sapiens
uuagcuuacccaaugggaccg

SEQ ID NO: 586949 - RNA, 17 nt, Homo sapiens
uuagcuuagaccucagc

SEQ ID NO: 586950 - RNA, 15 nt, Homo sapiens
uuagcuuguuccacu

SEQ ID NO: 586951 - RNA, 14 nt, Homo sapiens
uuagcuuuacaaau

SEQ ID NO: 586952 - RNA, 17 nt, Homo sapiens
uuagcuuuuguuuacac

SEQ ID NO: 586953 - RNA, 20 nt, Homo sapiens
uuaggaaggcagcauuccau

SEQ ID NO: 586954 - RNA, 18 nt, Homo sapiens
uuaggaaguauggcaaaa

SEQ ID NO: 586955 - RNA, 17 nt, Homo sapiens
uugauaccucugcuggg

SEQ ID NO: 586956 - RNA, 17 nt, Homo sapiens
uugauagauuucuacac

SEQ ID NO: 586957 - RNA, 17 nt, Homo sapiens
uugauaguaaggcaauc

SEQ ID NO: 586958 - RNA, 12 nt, Homo sapiens
uugauagucaau

SEQ ID NO: 586959 - RNA, 18 nt, Homo sapiens
uugauaguuuggcuauaa

SEQ ID NO: 586960 - RNA, 22 nt, Homo sapiens
uugauauacuauuuucauucuc

SEQ ID NO: 586961 - RNA, 12 nt, Homo sapiens
uugauauacuuu

SEQ ID NO: 586962 - RNA, 12 nt, Homo sapiens
uugauaucugau

SEQ ID NO: 586963 - RNA, 14 nt, Homo sapiens
uugauauguaagag

SEQ ID NO: 586964 - RNA, 18 nt, Homo sapiens
uugauauuuaauuaugaa

SEQ ID NO: 586965 - RNA, 20 nt, Homo sapiens
uugauauuuauuuuuugcca

SEQ ID NO: 586966 - RNA, 23 nt, Homo sapiens
uugauauuucaauguuagccuca

SEQ ID NO: 586967 - RNA, 22 nt, Homo sapiens
uugauauuucuagcuuaucuac

SEQ ID NO: 586968 - RNA, 13 nt, Homo sapiens
uugaucacuacaa

SEQ ID NO: 586969 - RNA, 23 nt, Homo sapiens
uugaucagaccaaacagugcugu

SEQ ID NO: 586970 - RNA, 20 nt, Homo sapiens
uugaucccacuucacuguga

SEQ ID NO: 586971 - RNA, 17 nt, Homo sapiens
uugauccugggggacca

SEQ ID NO: 586972 - RNA, 14 nt, Homo sapiens
uugaucucugcuua

SEQ ID NO: 586973 - RNA, 15 nt, Homo sapiens
uugaucuuuuaguuu

SEQ ID NO: 586974 - RNA, 17 nt, Homo sapiens
uugaugacccuuuucau

SEQ ID NO: 586975 - RNA, 14 nt, Homo sapiens
uugaugcaugcacu

SEQ ID NO: 586976 - RNA, 18 nt, Homo sapiens
uugaugccagagggccag

SEQ ID NO: 586977 - RNA, 11 nt, Homo sapiens
uugauggaccc

SEQ ID NO: 586978 - RNA, 13 nt, Homo sapiens
uugauguaucuga

SEQ ID NO: 586979 - RNA, 18 nt, Homo sapiens
uugauguuuguggccuca

SEQ ID NO: 586980 - RNA, 23 nt, Homo sapiens
uugauuauucugauuccacuuuu

SEQ ID NO: 586981 - RNA, 14 nt, Homo sapiens
uugauucaacacuu

SEQ ID NO: 586982 - RNA, 13 nt, Homo sapiens
uugauucacucaa

SEQ ID NO: 586983 - RNA, 22 nt, Homo sapiens
uugauuccugguuugacucagu

SEQ ID NO: 586984 - RNA, 20 nt, Homo sapiens
uugauucugauaaugcucac

SEQ ID NO: 586985 - RNA, 13 nt, Homo sapiens
uugauucuugauu

SEQ ID NO: 586986 - RNA, 11 nt, Homo sapiens
uugauugcuaa

SEQ ID NO: 586987 - RNA, 14 nt, Homo sapiens
uugauuggugauua

SEQ ID NO: 586988 - RNA, 20 nt, Homo sapiens
uugauuuaaaauuguucuac

SEQ ID NO: 586989 - RNA, 14 nt, Homo sapiens
uugauuucacugga

SEQ ID NO: 586990 - RNA, 16 nt, Homo sapiens
uugauuuguucaugaa

SEQ ID NO: 586991 - RNA, 17 nt, Homo sapiens
uugauuuuuaauggaaa

SEQ ID NO: 586992 - RNA, 13 nt, Homo sapiens
uugcaaagauuua

SEQ ID NO: 586993 - RNA, 12 nt, Homo sapiens
uugcuuuccacu

SEQ ID NO: 586994 - RNA, 18 nt, Homo sapiens
uugcuuucgguacuguaa

SEQ ID NO: 586995 - RNA, 11 nt, Homo sapiens
uugcuuucuau

SEQ ID NO: 586996 - RNA, 16 nt, Homo sapiens
uugcuuuuccauuucg

SEQ ID NO: 586997 - RNA, 15 nt, Homo sapiens
uugcuuuugcuucua

SEQ ID NO: 586998 - RNA, 18 nt, Homo sapiens
uuggaaaaaauguuguaa

SEQ ID NO: 586999 - RNA, 21 nt, Homo sapiens
uuggaaaaccaaacuaguauc

SEQ ID NO: 587000 - RNA, 17 nt, Homo sapiens
uuggaaagaaauucuga

SEQ ID NO: 587001 - RNA, 17 nt, Homo sapiens
uuggaaagcaucaccuc

SEQ ID NO: 587002 - RNA, 23 nt, Homo sapiens
uuggaaagcaucaccucaggcca

SEQ ID NO: 587003 - RNA, 14 nt, Homo sapiens
uuggaaaugugaau

SEQ ID NO: 587004 - RNA, 14 nt, Homo sapiens
uuggaacagaaugu

SEQ ID NO: 587005 - RNA, 21 nt, Homo sapiens
uuggaacuuuuauuacugggg

SEQ ID NO: 587006 - RNA, 21 nt, Homo sapiens
uuggaagaggaacagcacugg

SEQ ID NO: 587007 - RNA, 19 nt, Homo sapiens
uuggaagaggcugagacau

SEQ ID NO: 587008 - RNA, 18 nt, Homo sapiens
uuggaagcugucauaaaa

SEQ ID NO: 587009 - RNA, 13 nt, Homo sapiens
uuggaagucuaag

SEQ ID NO: 587010 - RNA, 20 nt, Homo sapiens
uuggaagugaaaacuuugua

SEQ ID NO: 587011 - RNA, 22 nt, Homo sapiens
uuggaagugauuucagcacauu

SEQ ID NO: 587012 - RNA, 14 nt, Homo sapiens
uuggaauauuacaa

SEQ ID NO: 587013 - RNA, 18 nt, Homo sapiens
uuggaaucuucaccucag

SEQ ID NO: 587014 - RNA, 20 nt, Homo sapiens
uuggaauuaugucugcugaa

SEQ ID NO: 587015 - RNA, 19 nt, Homo sapiens
uuggaauuuguaaccucag

SEQ ID NO: 587016 - RNA, 23 nt, Homo sapiens
uuggacaaucaugaaauaugcau

SEQ ID NO: 587017 - RNA, 11 nt, Homo sapiens
uuggacacuug

SEQ ID NO: 587018 - RNA, 21 nt, Homo sapiens
uuggacagacacuguugcaaa

SEQ ID NO: 587019 - RNA, 16 nt, Homo sapiens
uuggacauuuucuuca

SEQ ID NO: 587020 - RNA, 17 nt, Homo sapiens
uuggacccaaaaaauca

SEQ ID NO: 587021 - RNA, 16 nt, Homo sapiens
uuggaccguaucacug

SEQ ID NO: 587022 - RNA, 23 nt, Homo sapiens
uuggacuaugauuaucuacagaa

SEQ ID NO: 587023 - RNA, 20 nt, Homo sapiens
uuggacucuaaaaucucagc

SEQ ID NO: 587024 - RNA, 19 nt, Homo sapiens
uuggacuggauaagugcua

SEQ ID NO: 587025 - RNA, 18 nt, Homo sapiens
uuggacuguaagggauug

SEQ ID NO: 587026 - RNA, 14 nt, Homo sapiens
uuggacugucuaua

SEQ ID NO: 587027 - RNA, 17 nt, Homo sapiens
uuggacugucuauauca

SEQ ID NO: 587028 - RNA, 15 nt, Homo sapiens
uuggagaaaguauuu

SEQ ID NO: 587029 - RNA, 21 nt, Homo sapiens
uuggagaccgaagacugggau

SEQ ID NO: 587030 - RNA, 16 nt, Homo sapiens
uuggagaguuugccug

SEQ ID NO: 587031 - RNA, 14 nt, Homo sapiens
uuggagcaaaccau

SEQ ID NO: 587032 - RNA, 22 nt, Homo sapiens
uuggagcucauucugucucuuu

SEQ ID NO: 587033 - RNA, 17 nt, Homo sapiens
uuggagcuuuuucaaaa

SEQ ID NO: 587034 - RNA, 13 nt, Homo sapiens
uuggaggauuuca

SEQ ID NO: 587035 - RNA, 19 nt, Homo sapiens
uuggaggcagggcugggaa

SEQ ID NO: 587036 - RNA, 17 nt, Homo sapiens
uuggaggggaaaugggg

SEQ ID NO: 587037 - RNA, 23 nt, Homo sapiens
uuggagggguauuuuugcccuga

SEQ ID NO: 587038 - RNA, 17 nt, Homo sapiens
uuggagguuaaggcaua

SEQ ID NO: 587039 - RNA, 22 nt, Homo sapiens
uuggaguaaauauauaugucaa

SEQ ID NO: 587040 - RNA, 20 nt, Homo sapiens
uuggagucugacugugccca

SEQ ID NO: 587041 - RNA, 18 nt, Homo sapiens
uuggaguuagguccucac

SEQ ID NO: 587042 - RNA, 19 nt, Homo sapiens
uuggaucuucaauggcuuu

SEQ ID NO: 587043 - RNA, 17 nt, Homo sapiens
uuggaugagaagugucu

SEQ ID NO: 587044 - RNA, 21 nt, Homo sapiens
uuggaugggagugggcaccuc

SEQ ID NO: 587045 - RNA, 16 nt, Homo sapiens
uuggauucucugagaa

SEQ ID NO: 587046 - RNA, 15 nt, Homo sapiens
uuggauugggguccc

SEQ ID NO: 587047 - RNA, 18 nt, Homo sapiens
uuggauuuauucugccaa

SEQ ID NO: 587048 - RNA, 12 nt, Homo sapiens
uuggauuugaca

SEQ ID NO: 587049 - RNA, 23 nt, Homo sapiens
uuggauuuuugacucuggcaaag

SEQ ID NO: 587050 - RNA, 22 nt, Homo sapiens
uuggcacuuauagguaacguga

SEQ ID NO: 587051 - RNA, 17 nt, Homo sapiens
uuggcagagcuuuugca

SEQ ID NO: 587052 - RNA, 16 nt, Homo sapiens
uuggcagauguggauu

SEQ ID NO: 587053 - RNA, 16 nt, Homo sapiens
uuggcaguguggcagu

SEQ ID NO: 587054 - RNA, 15 nt, Homo sapiens
uuggcauugcaauga

SEQ ID NO: 587055 - RNA, 15 nt, Homo sapiens
uuggccaggcuguuc

SEQ ID NO: 587056 - RNA, 17 nt, Homo sapiens
uuggccaggcuguucuc

SEQ ID NO: 587057 - RNA, 23 nt, Homo sapiens
uuggcccccgagcugggggccau

SEQ ID NO: 587058 - RNA, 23 nt, Homo sapiens
uuggcccgcggccugcaccgacc

SEQ ID NO: 587059 - RNA, 14 nt, Homo sapiens
uuggccucccaaag

SEQ ID NO: 587060 - RNA, 14 nt, Homo sapiens
uuggccucugcccu

SEQ ID NO: 587061 - RNA, 17 nt, Homo sapiens
uuggccucugcuaaggu

SEQ ID NO: 587062 - RNA, 20 nt, Homo sapiens
uuggccuguagaguugcuga

SEQ ID NO: 587063 - RNA, 17 nt, Homo sapiens
uuggccuucagaaccau

SEQ ID NO: 587064 - RNA, 14 nt, Homo sapiens
uuggcgcucucagc

SEQ ID NO: 587065 - RNA, 17 nt, Homo sapiens
uuggcguuuggacccag

SEQ ID NO: 587066 - RNA, 22 nt, Homo sapiens
uuggcuacacacaaaccaguau

SEQ ID NO: 587067 - RNA, 23 nt, Homo sapiens
uuggcucaggcagacaagagcug

SEQ ID NO: 587068 - RNA, 13 nt, Homo sapiens
uuggcucuacucc

SEQ ID NO: 587069 - RNA, 13 nt, Homo sapiens
uuggcucuaguca

SEQ ID NO: 587070 - RNA, 14 nt, Homo sapiens
uuggcugaccccuc

SEQ ID NO: 587071 - RNA, 15 nt, Homo sapiens
uuggcugugugacag

SEQ ID NO: 587072 - RNA, 17 nt, Homo sapiens
uuggcuuaaauaaucuc

SEQ ID NO: 587073 - RNA, 18 nt, Homo sapiens
uuggcuuaaauaaucucu

SEQ ID NO: 587074 - RNA, 15 nt, Homo sapiens
uuggcuuccaugaug

SEQ ID NO: 587075 - RNA, 21 nt, Homo sapiens
uuggcuucuuaaaaacugugu

SEQ ID NO: 587076 - RNA, 10 nt, Homo sapiens
uuggcuugac

SEQ ID NO: 587077 - RNA, 12 nt, Homo sapiens
uuggcuuucaua

SEQ ID NO: 587078 - RNA, 22 nt, Homo sapiens
uuggcuuuuuucacauugauca

SEQ ID NO: 587079 - RNA, 13 nt, Homo sapiens
uugggaagaccag

SEQ ID NO: 587080 - RNA, 16 nt, Homo sapiens
uuggucuuuucuugcc

SEQ ID NO: 587081 - RNA, 21 nt, Homo sapiens
uuggugaaauaauaaaaugca

SEQ ID NO: 587082 - RNA, 11 nt, Homo sapiens
uuggugaauga

SEQ ID NO: 587083 - RNA, 22 nt, Homo sapiens
uuggugaauuucacaagcuauu

SEQ ID NO: 587084 - RNA, 23 nt, Homo sapiens
uuggugaggaaaagcggacauca

SEQ ID NO: 587085 - RNA, 15 nt, Homo sapiens
uuggugauucugaau

SEQ ID NO: 587086 - RNA, 11 nt, Homo sapiens
uuggugccacu

SEQ ID NO: 587087 - RNA, 13 nt, Homo sapiens
uuggugcuagaaa

SEQ ID NO: 587088 - RNA, 20 nt, Homo sapiens
uugguggcagugacuucuuu

SEQ ID NO: 587089 - RNA, 20 nt, Homo sapiens
uugguggcgcgcaccuguag

SEQ ID NO: 587090 - RNA, 17 nt, Homo sapiens
uugguuagugacugaug

SEQ ID NO: 587091 - RNA, 21 nt, Homo sapiens
uugguucaauaaagcacugag

SEQ ID NO: 587092 - RNA, 12 nt, Homo sapiens
uugguuguuuaa

SEQ ID NO: 587093 - RNA, 13 nt, Homo sapiens
uugguuucacuga

SEQ ID NO: 587094 - RNA, 15 nt, Homo sapiens
uugguuucagccaag

SEQ ID NO: 587095 - RNA, 18 nt, Homo sapiens
uugguuuccaaaggcauu

SEQ ID NO: 587096 - RNA, 17 nt, Homo sapiens
uugguuuuaauacuuga

SEQ ID NO: 587097 - RNA, 20 nt, Homo sapiens
uugguuuuuuuuugagacag

SEQ ID NO: 587098 - RNA, 14 nt, Homo sapiens
uuguaaaagcauuu

SEQ ID NO: 587099 - RNA, 21 nt, Homo sapiens
uuguaaaagggaaagaaggcc

SEQ ID NO: 587100 - RNA, 21 nt, Homo sapiens
uuguaaaguucaauuucaaca

SEQ ID NO: 587101 - RNA, 21 nt, Homo sapiens
uuguaaauauucuacacaugu

SEQ ID NO: 587102 - RNA, 17 nt, Homo sapiens
uuguaacauaaugcacu

SEQ ID NO: 587103 - RNA, 14 nt, Homo sapiens
uuguaacucuauga

SEQ ID NO: 587104 - RNA, 20 nt, Homo sapiens
uuguaagaguggaaccaaca

SEQ ID NO: 587105 - RNA, 15 nt, Homo sapiens
uuguaauaauaaaga

SEQ ID NO: 587106 - RNA, 21 nt, Homo sapiens
uuguaauaguccauggacaau

SEQ ID NO: 587107 - RNA, 19 nt, Homo sapiens
uuguaauauuuuccauaaa

SEQ ID NO: 587108 - RNA, 15 nt, Homo sapiens
uuguaaucaagccuu

SEQ ID NO: 587109 - RNA, 13 nt, Homo sapiens
uuguaaucacauu

SEQ ID NO: 587110 - RNA, 23 nt, Homo sapiens
uuguaaucauguuaccauuacaa

SEQ ID NO: 587111 - RNA, 13 nt, Homo sapiens
uuguaaugcaaaa

SEQ ID NO: 587112 - RNA, 15 nt, Homo sapiens
uuguaauuccuuacu

SEQ ID NO: 587113 - RNA, 21 nt, Homo sapiens
uuguacaacucuuacacaaau

SEQ ID NO: 587114 - RNA, 18 nt, Homo sapiens
uuguacagugucugugcc

SEQ ID NO: 587115 - RNA, 13 nt, Homo sapiens
uuguacauaguag

SEQ ID NO: 587116 - RNA, 19 nt, Homo sapiens
uuguacccccagguggaag

SEQ ID NO: 587117 - RNA, 15 nt, Homo sapiens
uuguacugauauaau

SEQ ID NO: 587118 - RNA, 17 nt, Homo sapiens
uuguacuguaauggagu

SEQ ID NO: 587119 - RNA, 21 nt, Homo sapiens
uuguagagauggggucucaca

SEQ ID NO: 587120 - RNA, 16 nt, Homo sapiens
uuguagaugugauuaa

SEQ ID NO: 587121 - RNA, 18 nt, Homo sapiens
uuguagcacaauccuauu

SEQ ID NO: 587122 - RNA, 12 nt, Homo sapiens
uuguagcacauu

SEQ ID NO: 587123 - RNA, 22 nt, Homo sapiens
uuguagcacugaggguggcacu

SEQ ID NO: 587124 - RNA, 15 nt, Homo sapiens
uuguagcagugugcu

SEQ ID NO: 587125 - RNA, 18 nt, Homo sapiens
uuguagcuguuacugcaa

SEQ ID NO: 587126 - RNA, 18 nt, Homo sapiens
uuguaggagaaacuccca

SEQ ID NO: 587127 - RNA, 21 nt, Homo sapiens
uuguagugguauagaguacug

SEQ ID NO: 587128 - RNA, 22 nt, Homo sapiens
uuguauaaacauaaacuguaug

SEQ ID NO: 587129 - RNA, 24 nt, Homo sapiens
uuguauaaagcauuuguagcaauu

SEQ ID NO: 587130 - RNA, 21 nt, Homo sapiens
uuguauaacccauauacucuu

SEQ ID NO: 587131 - RNA, 17 nt, Homo sapiens
uuguauacuaccauagu

SEQ ID NO: 587132 - RNA, 19 nt, Homo sapiens
uuguauaggccaucuguaa

SEQ ID NO: 587133 - RNA, 20 nt, Homo sapiens
uuguauaggggcaacuguau

SEQ ID NO: 587134 - RNA, 14 nt, Homo sapiens
uuguauaucaugaa

SEQ ID NO: 587135 - RNA, 13 nt, Homo sapiens
uuguaugguucca

SEQ ID NO: 587136 - RNA, 22 nt, Homo sapiens
uuguauguggguuuuacacuaa

SEQ ID NO: 587137 - RNA, 19 nt, Homo sapiens
uuguauucucuccuguacc

SEQ ID NO: 587138 - RNA, 15 nt, Homo sapiens
uugucaaaaggaagu

SEQ ID NO: 587139 - RNA, 13 nt, Homo sapiens
uugucaaagaagg

SEQ ID NO: 587140 - RNA, 22 nt, Homo sapiens
uugucaagaagcguuaugugca

SEQ ID NO: 587141 - RNA, 18 nt, Homo sapiens
uugucaagccugugcaaa

SEQ ID NO: 587142 - RNA, 21 nt, Homo sapiens
uugucaauauuaaauacagac

SEQ ID NO: 587143 - RNA, 19 nt, Homo sapiens
uugucagaaaccugcaggg

SEQ ID NO: 587144 - RNA, 12 nt, Homo sapiens
uugucagaauuu

SEQ ID NO: 587145 - RNA, 20 nt, Homo sapiens
uugucagaauuucuuuguca

SEQ ID NO: 587146 - RNA, 15 nt, Homo sapiens
uugucagacuuccaa

SEQ ID NO: 587147 - RNA, 18 nt, Homo sapiens
uugucaguauuuuugccg

SEQ ID NO: 587148 - RNA, 16 nt, Homo sapiens
uugucauauacugcuu

SEQ ID NO: 587149 - RNA, 15 nt, Homo sapiens
uugucaucugcaugu

SEQ ID NO: 587150 - RNA, 15 nt, Homo sapiens
uuguccaucuugaga

SEQ ID NO: 587151 - RNA, 19 nt, Homo sapiens
uugucccaaguuccacugc

SEQ ID NO: 587152 - RNA, 14 nt, Homo sapiens
uugucccccaacuu

SEQ ID NO: 587153 - RNA, 16 nt, Homo sapiens
uugucccugugccuaa

SEQ ID NO: 587154 - RNA, 22 nt, Homo sapiens
uuguccguguucauacauuuga

SEQ ID NO: 587155 - RNA, 19 nt, Homo sapiens
uuguccuccugauccugac

SEQ ID NO: 587156 - RNA, 17 nt, Homo sapiens
uuguccugcagugcuca

SEQ ID NO: 587157 - RNA, 20 nt, Homo sapiens
uuguccugcccuguggaaug

SEQ ID NO: 587158 - RNA, 15 nt, Homo sapiens
uuguccugcucucuu

SEQ ID NO: 587159 - RNA, 15 nt, Homo sapiens
uuguccugugcuugc

SEQ ID NO: 587160 - RNA, 16 nt, Homo sapiens
uuguccuucagccaaa

SEQ ID NO: 587161 - RNA, 14 nt, Homo sapiens
uuguccuugcccca

SEQ ID NO: 587162 - RNA, 14 nt, Homo sapiens
uugucgcuauguga

SEQ ID NO: 587163 - RNA, 20 nt, Homo sapiens
uugucuaaaguuacuacuga

SEQ ID NO: 587164 - RNA, 15 nt, Homo sapiens
uugucuaauuuucac

SEQ ID NO: 587165 - RNA, 13 nt, Homo sapiens
uugucuacacucu

SEQ ID NO: 587166 - RNA, 14 nt, Homo sapiens
uugucuacucugaa

SEQ ID NO: 587167 - RNA, 23 nt, Homo sapiens
uugucuaugaauaugaucccuaa

SEQ ID NO: 587168 - RNA, 18 nt, Homo sapiens
uugucucguguacagcuc

SEQ ID NO: 587169 - RNA, 22 nt, Homo sapiens
uugucugaacuugcauugugau

SEQ ID NO: 587170 - RNA, 16 nt, Homo sapiens
uugucugggugcagcu

SEQ ID NO: 587171 - RNA, 20 nt, Homo sapiens
uugucuguaaaaaauggagc

SEQ ID NO: 587172 - RNA, 15 nt, Homo sapiens
uugucuguucacuuu

SEQ ID NO: 587173 - RNA, 16 nt, Homo sapiens
uugucuuacuguugca

SEQ ID NO: 587174 - RNA, 13 nt, Homo sapiens
uugucuugauuaa

SEQ ID NO: 587175 - RNA, 21 nt, Homo sapiens
uugugaaaucaauguguacaa

SEQ ID NO: 587176 - RNA, 22 nt, Homo sapiens
uugugaaauguaacaugaagca

SEQ ID NO: 587177 - RNA, 18 nt, Homo sapiens
uugugaacaagucccugu

SEQ ID NO: 587178 - RNA, 22 nt, Homo sapiens
uugugaacccuagcugugucag

SEQ ID NO: 587179 - RNA, 20 nt, Homo sapiens
uugugacaggaaagcccucc

SEQ ID NO: 587180 - RNA, 17 nt, Homo sapiens
uugugaguuuaccuugu

SEQ ID NO: 587181 - RNA, 18 nt, Homo sapiens
uugugauauauucuguac

SEQ ID NO: 587182 - RNA, 15 nt, Homo sapiens
uugugaugaugcugu

SEQ ID NO: 587183 - RNA, 14 nt, Homo sapiens
uugugccaauaugu

SEQ ID NO: 587184 - RNA, 16 nt, Homo sapiens
uugugcuccaaacaaa

SEQ ID NO: 587185 - RNA, 21 nt, Homo sapiens
uugugcuucacaguagagcca

SEQ ID NO: 587186 - RNA, 16 nt, Homo sapiens
uugugcuuucaccaga

SEQ ID NO: 587187 - RNA, 14 nt, Homo sapiens
uuguggaagcacuu

SEQ ID NO: 587188 - RNA, 15 nt, Homo sapiens
uuguggacuugucug

SEQ ID NO: 587189 - RNA, 15 nt, Homo sapiens
uuguggcccaugaaa

SEQ ID NO: 587190 - RNA, 17 nt, Homo sapiens
uuguguaauaugaaaua

SEQ ID NO: 587191 - RNA, 14 nt, Homo sapiens
uuguguacugauaa

SEQ ID NO: 587192 - RNA, 12 nt, Homo sapiens
uugugucacugg

SEQ ID NO: 587193 - RNA, 16 nt, Homo sapiens
uugugucagaaacaug

SEQ ID NO: 587194 - RNA, 16 nt, Homo sapiens
uugugucagauuacca

SEQ ID NO: 587195 - RNA, 15 nt, Homo sapiens
uuguguccugaugaa

SEQ ID NO: 587196 - RNA, 18 nt, Homo sapiens
uuguguggcuccugguaa

SEQ ID NO: 587197 - RNA, 16 nt, Homo sapiens
uugugugugugcaagu

SEQ ID NO: 587198 - RNA, 15 nt, Homo sapiens
uuguguguugugucc

SEQ ID NO: 587199 - RNA, 23 nt, Homo sapiens
uuguguuuuuuuuuuaaauagac

SEQ ID NO: 587200 - RNA, 16 nt, Homo sapiens
uuguuaaugagauaaa

SEQ ID NO: 587201 - RNA, 18 nt, Homo sapiens
uuguuaauuguaauugca

SEQ ID NO: 587202 - RNA, 20 nt, Homo sapiens
gauaauaugaaaaucuccau

SEQ ID NO: 587203 - RNA, 15 nt, Homo sapiens
gauaauaugcuaaau

SEQ ID NO: 587204 - RNA, 18 nt, Homo sapiens
gauaaucucuccauuccc

SEQ ID NO: 587205 - RNA, 20 nt, Homo sapiens
gauaauuuauuauacaccuu

SEQ ID NO: 587206 - RNA, 17 nt, Homo sapiens
gauacaaaccacuguga

SEQ ID NO: 587207 - RNA, 13 nt, Homo sapiens
gauacaacagcug

SEQ ID NO: 587208 - RNA, 17 nt, Homo sapiens
gauacacaccuuucaca

SEQ ID NO: 587209 - RNA, 15 nt, Homo sapiens
gauacacagauauau

SEQ ID NO: 587210 - RNA, 17 nt, Homo sapiens
gauacacaggacugaaa

SEQ ID NO: 587211 - RNA, 17 nt, Homo sapiens
gauacauacaccagcau

SEQ ID NO: 587212 - RNA, 20 nt, Homo sapiens
gauacaugguugugaccuga

SEQ ID NO: 587213 - RNA, 13 nt, Homo sapiens
gauacauguaauu

SEQ ID NO: 587214 - RNA, 12 nt, Homo sapiens
gauacauuuaau

SEQ ID NO: 587215 - RNA, 11 nt, Homo sapiens
gauaccaucuc

SEQ ID NO: 587216 - RNA, 11 nt, Homo sapiens
gauaccauuca

SEQ ID NO: 587217 - RNA, 17 nt, Homo sapiens
gauacccagagcauuac

SEQ ID NO: 587218 - RNA, 12 nt, Homo sapiens
gauaccuccaac

SEQ ID NO: 587219 - RNA, 20 nt, Homo sapiens
gauacgacaguacacuguca

SEQ ID NO: 587220 - RNA, 16 nt, Homo sapiens
gauacgggggcuguga

SEQ ID NO: 587221 - RNA, 22 nt, Homo sapiens
gauacugcucaucauuccuuga

SEQ ID NO: 587222 - RNA, 16 nt, Homo sapiens
gauacugcuuuucacc

SEQ ID NO: 587223 - RNA, 18 nt, Homo sapiens
gauacuguuucuugcacu

SEQ ID NO: 587224 - RNA, 15 nt, Homo sapiens
gauacuucacuacuu

SEQ ID NO: 587225 - RNA, 18 nt, Homo sapiens
gauacuucuaaaagcuaa

SEQ ID NO: 587226 - RNA, 16 nt, Homo sapiens
gauacuuugacagugu

SEQ ID NO: 587227 - RNA, 14 nt, Homo sapiens
gauagaacuacuuu

SEQ ID NO: 587228 - RNA, 17 nt, Homo sapiens
gauagaacuacuuugaa

SEQ ID NO: 587229 - RNA, 12 nt, Homo sapiens
gauagacacugg

SEQ ID NO: 587230 - RNA, 13 nt, Homo sapiens
gauagacuuggga

SEQ ID NO: 587231 - RNA, 20 nt, Homo sapiens
gauagaugcacuuaugcagu

SEQ ID NO: 587232 - RNA, 12 nt, Homo sapiens
gauagcacuuuc

SEQ ID NO: 587233 - RNA, 14 nt, Homo sapiens
gauagcagauauca

SEQ ID NO: 587234 - RNA, 23 nt, Homo sapiens
gauagcaucuuauacgaguaaua

SEQ ID NO: 587235 - RNA, 14 nt, Homo sapiens
gauagcuacagugu

SEQ ID NO: 587236 - RNA, 19 nt, Homo sapiens
gauagggagcagaugcaau

SEQ ID NO: 587237 - RNA, 17 nt, Homo sapiens
gauaguagaaccaguga

SEQ ID NO: 587238 - RNA, 11 nt, Homo sapiens
gauagucacag

SEQ ID NO: 587239 - RNA, 14 nt, Homo sapiens
gauaguccaaagac

SEQ ID NO: 587240 - RNA, 12 nt, Homo sapiens
gauagucugucc

SEQ ID NO: 587241 - RNA, 23 nt, Homo sapiens
gauaguggggagacuucuuggcu

SEQ ID NO: 587242 - RNA, 15 nt, Homo sapiens
gauaguuuaccugaa

SEQ ID NO: 587243 - RNA, 22 nt, Homo sapiens
gauauaacauucaguucccacc

SEQ ID NO: 587244 - RNA, 13 nt, Homo sapiens
gauauacauauca

SEQ ID NO: 587245 - RNA, 12 nt, Homo sapiens
gauauaccaaau

SEQ ID NO: 587246 - RNA, 20 nt, Homo sapiens
gauauacuauuuucauucuc

SEQ ID NO: 587247 - RNA, 13 nt, Homo sapiens
gauauacuggccc

SEQ ID NO: 587248 - RNA, 22 nt, Homo sapiens
gauauaugcucugcauguuaca

SEQ ID NO: 587249 - RNA, 21 nt, Homo sapiens
gauauauguguauacauacau

SEQ ID NO: 587250 - RNA, 22 nt, Homo sapiens
gauauauuagggacacuuucac

SEQ ID NO: 587251 - RNA, 12 nt, Homo sapiens
gauaucaccucu

SEQ ID NO: 587252 - RNA, 14 nt, Homo sapiens
gauaucaugcaaau

SEQ ID NO: 587253 - RNA, 21 nt, Homo sapiens
gauaucaugccccuguacucc

SEQ ID NO: 587254 - RNA, 23 nt, Homo sapiens
gauaucauucagcaucuacucua

SEQ ID NO: 587255 - RNA, 18 nt, Homo sapiens
gauaucuuggcuuugcca

SEQ ID NO: 587256 - RNA, 22 nt, Homo sapiens
gauauggcaggacuccuggcag

SEQ ID NO: 587257 - RNA, 20 nt, Homo sapiens
gauauuaaaaguuaagcaaa

SEQ ID NO: 587258 - RNA, 14 nt, Homo sapiens
gauauuagguccca

SEQ ID NO: 587259 - RNA, 16 nt, Homo sapiens
gauauuaucuaccugu

SEQ ID NO: 587260 - RNA, 16 nt, Homo sapiens
gauauucagaaguaua

SEQ ID NO: 587261 - RNA, 13 nt, Homo sapiens
gauauugcagcuu

SEQ ID NO: 587262 - RNA, 16 nt, Homo sapiens
gauauugucagucuuu

SEQ ID NO: 587263 - RNA, 21 nt, Homo sapiens
gauauuguggguaacgugaga

SEQ ID NO: 587264 - RNA, 15 nt, Homo sapiens
gauauuuagcucugu

SEQ ID NO: 587265 - RNA, 16 nt, Homo sapiens
gauauuuaguaauauu

SEQ ID NO: 587266 - RNA, 18 nt, Homo sapiens
gauauuuauuuuuugcca

SEQ ID NO: 587267 - RNA, 22 nt, Homo sapiens
gaucaaaauaaaaagugacaca

SEQ ID NO: 587268 - RNA, 23 nt, Homo sapiens
gaucaaauauauuucaagcuaua

SEQ ID NO: 587269 - RNA, 14 nt, Homo sapiens
gaucaacaauaccu

SEQ ID NO: 587270 - RNA, 15 nt, Homo sapiens
gaucaacaauaccuu

SEQ ID NO: 587271 - RNA, 22 nt, Homo sapiens
gaucaagcugugagacaguggg

SEQ ID NO: 587272 - RNA, 21 nt, Homo sapiens
gaucaaguccuaguuguucag

SEQ ID NO: 587273 - RNA, 21 nt, Homo sapiens
gaucaauaaaugucagcauug

SEQ ID NO: 587274 - RNA, 13 nt, Homo sapiens
gaucaauuguuaa

SEQ ID NO: 587275 - RNA, 13 nt, Homo sapiens
gaucacacagugu

SEQ ID NO: 587276 - RNA, 16 nt, Homo sapiens
gaucacagacacugca

SEQ ID NO: 587277 - RNA, 18 nt, Homo sapiens
gaucacagcguuucagga

SEQ ID NO: 587278 - RNA, 13 nt, Homo sapiens
cucguuagccuuc

SEQ ID NO: 587279 - RNA, 16 nt, Homo sapiens
cucguuagccuuccuc

SEQ ID NO: 587280 - RNA, 20 nt, Homo sapiens
cucguuggaugucugugagu

SEQ ID NO: 587281 - RNA, 12 nt, Homo sapiens
cucuaaacacac

SEQ ID NO: 587282 - RNA, 13 nt, Homo sapiens
cucuaaagagcau

SEQ ID NO: 587283 - RNA, 17 nt, Homo sapiens
cucuaaagccaagcacu

SEQ ID NO: 587284 - RNA, 13 nt, Homo sapiens
cucuaacauuucc

SEQ ID NO: 587285 - RNA, 18 nt, Homo sapiens
cucuaaugagacugacca

SEQ ID NO: 587286 - RNA, 22 nt, Homo sapiens
cucuaaugagcuagugucuuau

SEQ ID NO: 587287 - RNA, 15 nt, Homo sapiens
cucuaauguacaaua

SEQ ID NO: 587288 - RNA, 20 nt, Homo sapiens
cucuaauuagagaacuggag

SEQ ID NO: 587289 - RNA, 12 nt, Homo sapiens
cucuacaaaaag

SEQ ID NO: 587290 - RNA, 15 nt, Homo sapiens
cucuacacccugaag

SEQ ID NO: 587291 - RNA, 17 nt, Homo sapiens
cucuacagacuccaaaa

SEQ ID NO: 587292 - RNA, 19 nt, Homo sapiens
cucuacagacuccaaaagg

SEQ ID NO: 587293 - RNA, 20 nt, Homo sapiens
cucuacagacuccaaaaggc

SEQ ID NO: 587294 - RNA, 17 nt, Homo sapiens
cucuacccaucuuaaaa

SEQ ID NO: 587295 - RNA, 22 nt, Homo sapiens
cucuacccuauacaacuggaca

SEQ ID NO: 587296 - RNA, 20 nt, Homo sapiens
cucuacccuggcacuauaau

SEQ ID NO: 587297 - RNA, 17 nt, Homo sapiens
cucuacuaaaaacacaa

SEQ ID NO: 587298 - RNA, 18 nt, Homo sapiens
cucuacuaaaacauacaa

SEQ ID NO: 587299 - RNA, 14 nt, Homo sapiens
cucuacucuaggga

SEQ ID NO: 587300 - RNA, 13 nt, Homo sapiens
cucuacucuuaca

SEQ ID NO: 587301 - RNA, 13 nt, Homo sapiens
cucuacucuuccu

SEQ ID NO: 587302 - RNA, 14 nt, Homo sapiens
cucuacugccucaa

SEQ ID NO: 587303 - RNA, 18 nt, Homo sapiens
cucuacuguuuaacaaca

SEQ ID NO: 587304 - RNA, 15 nt, Homo sapiens
cucuacuuaauccaa

SEQ ID NO: 587305 - RNA, 19 nt, Homo sapiens
cucuacuuccccuucuugc

SEQ ID NO: 587306 - RNA, 22 nt, Homo sapiens
cucuacuugcaagccucaaaga

SEQ ID NO: 587307 - RNA, 12 nt, Homo sapiens
cucuacuuugag

SEQ ID NO: 587308 - RNA, 21 nt, Homo sapiens
cucuagaacaugcacauuuau

SEQ ID NO: 587309 - RNA, 22 nt, Homo sapiens
cucuagagagaugagaagccag

SEQ ID NO: 587310 - RNA, 14 nt, Homo sapiens
cucuagauugagag

SEQ ID NO: 587311 - RNA, 20 nt, Homo sapiens
cucuagcauucuaguuucau

SEQ ID NO: 587312 - RNA, 21 nt, Homo sapiens
cucuagccuggcaacagagcg

SEQ ID NO: 587313 - RNA, 20 nt, Homo sapiens
cucuagccugggccagagaa

SEQ ID NO: 587314 - RNA, 20 nt, Homo sapiens
cucuagcuuaaguguaaaug

SEQ ID NO: 587315 - RNA, 22 nt, Homo sapiens
cucuagguacgaugacaguguu

SEQ ID NO: 587316 - RNA, 23 nt, Homo sapiens
cucuaguaucacuuuugcuguga

SEQ ID NO: 587317 - RNA, 19 nt, Homo sapiens
cucuaguccuuggcuggac

SEQ ID NO: 587318 - RNA, 13 nt, Homo sapiens
cucuagugcugug

SEQ ID NO: 587319 - RNA, 20 nt, Homo sapiens
cucuaguugaacccugggaa

SEQ ID NO: 587320 - RNA, 17 nt, Homo sapiens
cucuauaagauuccaaa

SEQ ID NO: 587321 - RNA, 21 nt, Homo sapiens
cucuauaagauuccaaaaagc

SEQ ID NO: 587322 - RNA, 24 nt, Homo sapiens
cucuaugaccucgcccuccacaaa

SEQ ID NO: 587323 - RNA, 12 nt, Homo sapiens
cucuaugccugc

SEQ ID NO: 587324 - RNA, 19 nt, Homo sapiens
cucuauugauguacagucu

SEQ ID NO: 587325 - RNA, 19 nt, Homo sapiens
cucuauugcugcucucuca

SEQ ID NO: 587326 - RNA, 21 nt, Homo sapiens
cucuauuuagcaacagaauua

SEQ ID NO: 587327 - RNA, 22 nt, Homo sapiens
cucuauuuugugaugaugcugu

SEQ ID NO: 587328 - RNA, 16 nt, Homo sapiens
cucuauuuuuacauuu

SEQ ID NO: 587329 - RNA, 22 nt, Homo sapiens
cucucaacauuaccaaaaucau

SEQ ID NO: 587330 - RNA, 16 nt, Homo sapiens
cucucacccaccagcu

SEQ ID NO: 587331 - RNA, 23 nt, Homo sapiens
cucucaccccaacuaguagcuaa

SEQ ID NO: 587332 - RNA, 13 nt, Homo sapiens
cucucacccucau

SEQ ID NO: 587333 - RNA, 17 nt, Homo sapiens
cucucacuauaccagua

SEQ ID NO: 587334 - RNA, 13 nt, Homo sapiens
cucucagccagcu

SEQ ID NO: 587335 - RNA, 21 nt, Homo sapiens
cucucagcuuucccugccaca

SEQ ID NO: 587336 - RNA, 23 nt, Homo sapiens
cucucaggaucaagaaaguguug

SEQ ID NO: 587337 - RNA, 13 nt, Homo sapiens
cucucaggggcca

SEQ ID NO: 587338 - RNA, 18 nt, Homo sapiens
cucucauaaugaagacau

SEQ ID NO: 587339 - RNA, 15 nt, Homo sapiens
cucucaucaacugaa

SEQ ID NO: 587340 - RNA, 22 nt, Homo sapiens
cucuccaccacccaacccaaac

SEQ ID NO: 587341 - RNA, 13 nt, Homo sapiens
cucuccacuccau

SEQ ID NO: 587342 - RNA, 16 nt, Homo sapiens
cucuccagcugacuaa

SEQ ID NO: 587343 - RNA, 13 nt, Homo sapiens
cucuccauauccc

SEQ ID NO: 587344 - RNA, 17 nt, Homo sapiens
cucucccaacucuugca

SEQ ID NO: 587345 - RNA, 18 nt, Homo sapiens
cucucccaacucuugcac

SEQ ID NO: 587346 - RNA, 14 nt, Homo sapiens
cucucccacaccac

SEQ ID NO: 587347 - RNA, 20 nt, Homo sapiens
cucucccaccccggccucca

SEQ ID NO: 587348 - RNA, 15 nt, Homo sapiens
cucucccaguccauu

SEQ ID NO: 587349 - RNA, 17 nt, Homo sapiens
cucucccuagugccuuc

SEQ ID NO: 587350 - RNA, 18 nt, Homo sapiens
cucucccugggucugggg

SEQ ID NO: 587351 - RNA, 21 nt, Homo sapiens
cucuccgaaagaagacacaga

SEQ ID NO: 587352 - RNA, 21 nt, Homo sapiens
cucuccggggccauuugcaau

SEQ ID NO: 587353 - RNA, 13 nt, Homo sapiens
cucuccuauguag

SEQ ID NO: 587354 - RNA, 22 nt, Homo sapiens
cucuccugauuauuuaucacau

SEQ ID NO: 587355 - RNA, 19 nt, Homo sapiens
cucuccugcccaagcacuu

SEQ ID NO: 587356 - RNA, 21 nt, Homo sapiens
cucuccuuauagacacuugcu

SEQ ID NO: 587357 - RNA, 16 nt, Homo sapiens
cucuccuucccacaaa

SEQ ID NO: 587358 - RNA, 19 nt, Homo sapiens
cucuccuuuggccauucca

SEQ ID NO: 587359 - RNA, 15 nt, Homo sapiens
cucucgcacaaugca

SEQ ID NO: 587360 - RNA, 22 nt, Homo sapiens
cucucgcacaccucugcaccuu

SEQ ID NO: 587361 - RNA, 20 nt, Homo sapiens
cucucggccuugggaaggaa

SEQ ID NO: 587362 - RNA, 19 nt, Homo sapiens
cucucggcuggaagaacau

SEQ ID NO: 587363 - RNA, 20 nt, Homo sapiens
cucucuaguugaacccuggg

SEQ ID NO: 587364 - RNA, 15 nt, Homo sapiens
cucucuccacccuau

SEQ ID NO: 587365 - RNA, 13 nt, Homo sapiens
cucucucucucuc

SEQ ID NO: 587366 - RNA, 15 nt, Homo sapiens
cucucugaacugcaa

SEQ ID NO: 587367 - RNA, 20 nt, Homo sapiens
cucucugaugucccagugcu

SEQ ID NO: 587368 - RNA, 13 nt, Homo sapiens
cucucugcagcug

SEQ ID NO: 587369 - RNA, 16 nt, Homo sapiens
cucucugcugggucuc

SEQ ID NO: 587370 - RNA, 19 nt, Homo sapiens
cucucuggaaggagacuga

SEQ ID NO: 587371 - RNA, 23 nt, Homo sapiens
cucucugggccucaguuuuccca

SEQ ID NO: 587372 - RNA, 14 nt, Homo sapiens
cucucuucucucca

SEQ ID NO: 587373 - RNA, 15 nt, Homo sapiens
cucucuucucuccag

SEQ ID NO: 587374 - RNA, 15 nt, Homo sapiens
cucucuucuggaauc

SEQ ID NO: 587375 - RNA, 21 nt, Homo sapiens
cucucuugccccuuguccuga

SEQ ID NO: 587376 - RNA, 17 nt, Homo sapiens
cucugaaaccaguguua

SEQ ID NO: 587377 - RNA, 15 nt, Homo sapiens
cucugaaagaccuau

SEQ ID NO: 587378 - RNA, 15 nt, Homo sapiens
cucugaacaauugcu

SEQ ID NO: 587379 - RNA, 18 nt, Homo sapiens
cucugaacacacacgcca

SEQ ID NO: 587380 - RNA, 12 nt, Homo sapiens
cucugaacacau

SEQ ID NO: 587381 - RNA, 22 nt, Homo sapiens
cucugaagaguggguuucacaa

SEQ ID NO: 587382 - RNA, 15 nt, Homo sapiens
cucugaagcaagagu

SEQ ID NO: 587383 - RNA, 12 nt, Homo sapiens
cucugaagucac

SEQ ID NO: 587384 - RNA, 20 nt, Homo sapiens
cucugaaguugguugugauu

SEQ ID NO: 587385 - RNA, 16 nt, Homo sapiens
cucugaaucagaaaag

SEQ ID NO: 587386 - RNA, 16 nt, Homo sapiens
cucugacccuagcucu

SEQ ID NO: 587387 - RNA, 17 nt, Homo sapiens
cucugacgcaccacugc

SEQ ID NO: 587388 - RNA, 17 nt, Homo sapiens
cucugacguugauccca

SEQ ID NO: 587389 - RNA, 18 nt, Homo sapiens
cucugacucagggcuccu

SEQ ID NO: 587390 - RNA, 12 nt, Homo sapiens
cucugauagcau

SEQ ID NO: 587391 - RNA, 14 nt, Homo sapiens
cucugauagcuguu

SEQ ID NO: 587392 - RNA, 19 nt, Homo sapiens
cucugauucaccucuuccu

SEQ ID NO: 587393 - RNA, 17 nt, Homo sapiens
uaagcucuuuaugacug

SEQ ID NO: 587394 - RNA, 16 nt, Homo sapiens
uaagcugacucuuugc

SEQ ID NO: 587395 - RNA, 22 nt, Homo sapiens
uaagcugggaaaaaaguuuuga

SEQ ID NO: 587396 - RNA, 18 nt, Homo sapiens
uaagcugggauaaucaca

SEQ ID NO: 587397 - RNA, 20 nt, Homo sapiens
uaagcugggauaaucacauu

SEQ ID NO: 587398 - RNA, 16 nt, Homo sapiens
uaagcuguaaccgaua

SEQ ID NO: 587399 - RNA, 22 nt, Homo sapiens
uaagcuguaaccgauaugcacu

SEQ ID NO: 587400 - RNA, 16 nt, Homo sapiens
uaagcugucugccaca

SEQ ID NO: 587401 - RNA, 16 nt, Homo sapiens
uaagcuuucucucaga

SEQ ID NO: 587402 - RNA, 22 nt, Homo sapiens
uaaggaauuuccucccaauuca

SEQ ID NO: 587403 - RNA, 18 nt, Homo sapiens
uaaggacaagacacugag

SEQ ID NO: 587404 - RNA, 15 nt, Homo sapiens
uaaggacauuuccca

SEQ ID NO: 587405 - RNA, 12 nt, Homo sapiens
uaaggagcaaaa

SEQ ID NO: 587406 - RNA, 12 nt, Homo sapiens
uaaggcaaaaaa

SEQ ID NO: 587407 - RNA, 18 nt, Homo sapiens
uaaggcagcuaagacaua

SEQ ID NO: 587408 - RNA, 13 nt, Homo sapiens
uaaggcaugaagg

SEQ ID NO: 587409 - RNA, 18 nt, Homo sapiens
uaaggcauguggccuuua

SEQ ID NO: 587410 - RNA, 18 nt, Homo sapiens
uaaccuguaaaaugucaa

SEQ ID NO: 587411 - RNA, 16 nt, Homo sapiens
uaaccuuuuagauggu

SEQ ID NO: 587412 - RNA, 18 nt, Homo sapiens
uaacgaaugguacuacaa

SEQ ID NO: 587413 - RNA, 14 nt, Homo sapiens
uaacgacuucaggg

SEQ ID NO: 587414 - RNA, 13 nt, Homo sapiens
uaacgauacaaau

SEQ ID NO: 587415 - RNA, 17 nt, Homo sapiens
uaacguccacuagcuua

SEQ ID NO: 587416 - RNA, 14 nt, Homo sapiens
uaacguggcacugg

SEQ ID NO: 587417 - RNA, 21 nt, Homo sapiens
uaacuaaaagguaugcaauca

SEQ ID NO: 587418 - RNA, 14 nt, Homo sapiens
uaacuaacuggcag

SEQ ID NO: 587419 - RNA, 16 nt, Homo sapiens
uaacuaagagauucuu

SEQ ID NO: 587420 - RNA, 15 nt, Homo sapiens
uaacuaaucaagaaa

SEQ ID NO: 587421 - RNA, 21 nt, Homo sapiens
uaacuacuuuuuauacuccau

SEQ ID NO: 587422 - RNA, 12 nt, Homo sapiens
uaacuagaauuu

SEQ ID NO: 587423 - RNA, 17 nt, Homo sapiens
uaacuagacaucugcug

SEQ ID NO: 587424 - RNA, 13 nt, Homo sapiens
uaacuaguacaaa

SEQ ID NO: 587425 - RNA, 16 nt, Homo sapiens
uaacuauaaggugccu

SEQ ID NO: 587426 - RNA, 15 nt, Homo sapiens
uaacuauauuugcuu

SEQ ID NO: 587427 - RNA, 23 nt, Homo sapiens
uaacuaugaucaucuugaugucu

SEQ ID NO: 587428 - RNA, 19 nt, Homo sapiens
uaacucaccccucagcaaa

SEQ ID NO: 587429 - RNA, 13 nt, Homo sapiens
uaacucacuggaa

SEQ ID NO: 587430 - RNA, 15 nt, Homo sapiens
uaacucagacauucc

SEQ ID NO: 587431 - RNA, 17 nt, Homo sapiens
uaacucagacauuccaa

SEQ ID NO: 587432 - RNA, 20 nt, Homo sapiens
uaacucccuccaccagccug

SEQ ID NO: 587433 - RNA, 18 nt, Homo sapiens
uaacucguguuuggagcu

SEQ ID NO: 587434 - RNA, 12 nt, Homo sapiens
uaacucuagaau

SEQ ID NO: 587435 - RNA, 14 nt, Homo sapiens
uaacucuagaauuu

SEQ ID NO: 587436 - RNA, 15 nt, Homo sapiens
uaacucuagaauuug

SEQ ID NO: 587437 - RNA, 19 nt, Homo sapiens
uaacucuauuaaugagguc

SEQ ID NO: 587438 - RNA, 22 nt, Homo sapiens
uaacucugcccacccuccugua

SEQ ID NO: 587439 - RNA, 15 nt, Homo sapiens
uaacucuggugcucu

SEQ ID NO: 587440 - RNA, 20 nt, Homo sapiens
uaacucuuuauuuuuugcca

SEQ ID NO: 587441 - RNA, 22 nt, Homo sapiens
uaacugaggacuguuugcaauu

SEQ ID NO: 587442 - RNA, 14 nt, Homo sapiens
uaacugaggcucag

SEQ ID NO: 587443 - RNA, 19 nt, Homo sapiens
uaacugcaccaacgagcug

SEQ ID NO: 587444 - RNA, 14 nt, Homo sapiens
uaacugcauccagc

SEQ ID NO: 587445 - RNA, 14 nt, Homo sapiens
uaacugccaagaaa

SEQ ID NO: 587446 - RNA, 16 nt, Homo sapiens
uaacugccaauccuua

SEQ ID NO: 587447 - RNA, 21 nt, Homo sapiens
uaacugcuuucuguuccaaau

SEQ ID NO: 587448 - RNA, 20 nt, Homo sapiens
uaacugggguugagggccaa

SEQ ID NO: 587449 - RNA, 22 nt, Homo sapiens
uaacuggguaaugaaacaaaga

SEQ ID NO: 587450 - RNA, 17 nt, Homo sapiens
uaacuguaaacuuggaa

SEQ ID NO: 587451 - RNA, 15 nt, Homo sapiens
uaacuguagugccuc

SEQ ID NO: 587452 - RNA, 21 nt, Homo sapiens
uaacuguauuuuugaagacua

SEQ ID NO: 587453 - RNA, 22 nt, Homo sapiens
uaacuguccguaguaucagaga

SEQ ID NO: 587454 - RNA, 23 nt, Homo sapiens
uaacuguucucauuuuauugcua

SEQ ID NO: 587455 - RNA, 17 nt, Homo sapiens
uaacuugaaccuaugaa

SEQ ID NO: 587456 - RNA, 16 nt, Homo sapiens
uaacuugauauagaaa

SEQ ID NO: 587457 - RNA, 16 nt, Homo sapiens
uaacuuuaacuuuuga

SEQ ID NO: 587458 - RNA, 15 nt, Homo sapiens
uaacuuuaccaugcu

SEQ ID NO: 587459 - RNA, 20 nt, Homo sapiens
uaacuuuauacacuuggauu

SEQ ID NO: 587460 - RNA, 17 nt, Homo sapiens
uaacuuucauaccacuu

SEQ ID NO: 587461 - RNA, 22 nt, Homo sapiens
uaacuuucauaccacuugaauu

SEQ ID NO: 587462 - RNA, 9 nt, Homo sapiens
uaacuuuga

SEQ ID NO: 587463 - RNA, 11 nt, Homo sapiens
uaacuuugaaa

SEQ ID NO: 587464 - RNA, 15 nt, Homo sapiens
uaacuuuucaccaau

SEQ ID NO: 587465 - RNA, 19 nt, Homo sapiens
uaacuuuucaccaaugagc

SEQ ID NO: 587466 - RNA, 23 nt, Homo sapiens
uaacuuuugggcguaagaccaaa

SEQ ID NO: 587467 - RNA, 18 nt, Homo sapiens
uaacuuuugguaucuacu

SEQ ID NO: 587468 - RNA, 15 nt, Homo sapiens
uaacuuuuugcacua

SEQ ID NO: 587469 - RNA, 16 nt, Homo sapiens
uaacuuuuuuggauaa

SEQ ID NO: 587470 - RNA, 22 nt, Homo sapiens
uaagaaaaaauucuuucacuug

SEQ ID NO: 587471 - RNA, 18 nt, Homo sapiens
uaagaaaaagaagaacua

SEQ ID NO: 587472 - RNA, 14 nt, Homo sapiens
uaagaaagcacuau

SEQ ID NO: 587473 - RNA, 18 nt, Homo sapiens
uaagaaauaaugccucca

SEQ ID NO: 587474 - RNA, 13 nt, Homo sapiens
uaagaaauacuca

SEQ ID NO: 587475 - RNA, 17 nt, Homo sapiens
uaagaaauagacagcau

SEQ ID NO: 587476 - RNA, 19 nt, Homo sapiens
uaagaaaucaaguaaugaa

SEQ ID NO: 587477 - RNA, 19 nt, Homo sapiens
uaagaagauacacugcagc

SEQ ID NO: 587478 - RNA, 12 nt, Homo sapiens
uaagaagcaaua

SEQ ID NO: 587479 - RNA, 23 nt, Homo sapiens
uaagaagcaauaacuauuuuucc

SEQ ID NO: 587480 - RNA, 22 nt, Homo sapiens
uaagaagccuuaauuugcacag

SEQ ID NO: 587481 - RNA, 19 nt, Homo sapiens
uaagaaugguuuguaaaau

SEQ ID NO: 587482 - RNA, 23 nt, Homo sapiens
uaagaauucucucuucuggaauc

SEQ ID NO: 587483 - RNA, 17 nt, Homo sapiens
uaagaauugucucuggg

SEQ ID NO: 587484 - RNA, 12 nt, Homo sapiens
uaagaauuucac

SEQ ID NO: 587485 - RNA, 20 nt, Homo sapiens
uaagaauuucacaagcuauu

SEQ ID NO: 587486 - RNA, 23 nt, Homo sapiens
uaagacaaacuccugaaaugcca

SEQ ID NO: 587487 - RNA, 19 nt, Homo sapiens
uaagacaauggacccuuuu

SEQ ID NO: 587488 - RNA, 13 nt, Homo sapiens
uaagacacuguga

SEQ ID NO: 587489 - RNA, 12 nt, Homo sapiens
uaagacauguga

SEQ ID NO: 587490 - RNA, 17 nt, Homo sapiens
uaagaccauaacagcca

SEQ ID NO: 587491 - RNA, 18 nt, Homo sapiens
uaagacuaaaaguugcau

SEQ ID NO: 587492 - RNA, 23 nt, Homo sapiens
uaagacuguaauguguacugguc

SEQ ID NO: 587493 - RNA, 17 nt, Homo sapiens
uaagagacaacuaucaa

SEQ ID NO: 587494 - RNA, 14 nt, Homo sapiens
uaagagacacucca

SEQ ID NO: 587495 - RNA, 13 nt, Homo sapiens
uaagagagccuug

SEQ ID NO: 587496 - RNA, 17 nt, Homo sapiens
uaagagcagaacagauc

SEQ ID NO: 587497 - RNA, 19 nt, Homo sapiens
uaagagcgaacuucacaua

SEQ ID NO: 587498 - RNA, 21 nt, Homo sapiens
uaagaggauagaauacaugga

SEQ ID NO: 587499 - RNA, 17 nt, Homo sapiens
uaagaggcuuucuccag

SEQ ID NO: 587500 - RNA, 19 nt, Homo sapiens
uaagagugccguaacaacu

SEQ ID NO: 587501 - RNA, 13 nt, Homo sapiens
uaagaguuacuua

SEQ ID NO: 587502 - RNA, 22 nt, Homo sapiens
uaagauacuggacuccucuucc

SEQ ID NO: 587503 - RNA, 20 nt, Homo sapiens
uaagauauucagaaguauau

SEQ ID NO: 587504 - RNA, 19 nt, Homo sapiens
uaagaucauuuaauaucuu

SEQ ID NO: 587505 - RNA, 13 nt, Homo sapiens
uaagauccacaaa

SEQ ID NO: 587506 - RNA, 21 nt, Homo sapiens
uaagaucguucucugccucac

SEQ ID NO: 587507 - RNA, 13 nt, Homo sapiens
uaagaugcacuga

SEQ ID NO: 587508 - RNA, 14 nt, Homo sapiens
uaagaugcacugaa

SEQ ID NO: 587509 - RNA, 15 nt, Homo sapiens
uaagaugcacugaaa

SEQ ID NO: 587510 - RNA, 19 nt, Homo sapiens
uaagauguccuccuugaua

SEQ ID NO: 587511 - RNA, 18 nt, Homo sapiens
uaagauguucacuguggc

SEQ ID NO: 587512 - RNA, 20 nt, Homo sapiens
uaagauguuuuaauauguau

SEQ ID NO: 587513 - RNA, 16 nt, Homo sapiens
uaagauuccaaaaagc

SEQ ID NO: 587514 - RNA, 19 nt, Homo sapiens
uaagauuccaaaaagcaca

SEQ ID NO: 587515 - RNA, 21 nt, Homo sapiens
uaagauuccaaaaagcacaua

SEQ ID NO: 587516 - RNA, 16 nt, Homo sapiens
uaagcaaagacuauga

SEQ ID NO: 587517 - RNA, 16 nt, Homo sapiens
uaagcagaccacugau

SEQ ID NO: 587518 - RNA, 15 nt, Homo sapiens
uaagcauaaaagauc

SEQ ID NO: 587519 - RNA, 18 nt, Homo sapiens
uaagcaugugucccagga

SEQ ID NO: 587520 - RNA, 15 nt, Homo sapiens
uaagcauuuguauau

SEQ ID NO: 587521 - RNA, 22 nt, Homo sapiens
uaagccaacuuuaauugcuuaa

SEQ ID NO: 587522 - RNA, 22 nt, Homo sapiens
uaagccacauggcugggauuua

SEQ ID NO: 587523 - RNA, 14 nt, Homo sapiens
uaagccacucuucc

SEQ ID NO: 587524 - RNA, 16 nt, Homo sapiens
uaagccagaauccaga

SEQ ID NO: 587525 - RNA, 20 nt, Homo sapiens
uaagcccggauagacuuauu

SEQ ID NO: 587526 - RNA, 14 nt, Homo sapiens
uaagcccucaggag

SEQ ID NO: 587527 - RNA, 15 nt, Homo sapiens
uaagccuaaaugccu

SEQ ID NO: 587528 - RNA, 17 nt, Homo sapiens
uaagccuuuugcucaca

SEQ ID NO: 587529 - RNA, 21 nt, Homo sapiens
uaagcgugcugacaucagauu

SEQ ID NO: 587530 - RNA, 19 nt, Homo sapiens
uaagcuagccagaguuuuc

SEQ ID NO: 587531 - RNA, 14 nt, Homo sapiens
uaagcucagugaua

SEQ ID NO: 587532 - RNA, 19 nt, Homo sapiens
uaagcuccaugugcauaua

SEQ ID NO: 587533 - RNA, 18 nt, Homo sapiens
uaaaauauauuucagaua

SEQ ID NO: 587534 - RNA, 22 nt, Homo sapiens
uaaaauauccagugagcucuuu

SEQ ID NO: 587535 - RNA, 16 nt, Homo sapiens
uaaaauauccugugua

SEQ ID NO: 587536 - RNA, 14 nt, Homo sapiens
uaaaauauggcuau

SEQ ID NO: 587537 - RNA, 21 nt, Homo sapiens
uaaaauauuuuuaugugcaau

SEQ ID NO: 587538 - RNA, 20 nt, Homo sapiens
uaaaauauuuuuugcuauau

SEQ ID NO: 587539 - RNA, 13 nt, Homo sapiens
uaaaaucacucaa

SEQ ID NO: 587540 - RNA, 16 nt, Homo sapiens
uaaaauccaguauuau

SEQ ID NO: 587541 - RNA, 19 nt, Homo sapiens
uaaaauccuaagacacaaa

SEQ ID NO: 587542 - RNA, 19 nt, Homo sapiens
uaaaaucuuggcacagaaa

SEQ ID NO: 587543 - RNA, 19 nt, Homo sapiens
uaaaaugaaauuacuacaa

SEQ ID NO: 587544 - RNA, 20 nt, Homo sapiens
uaaaaugaaggaaaagcaug

SEQ ID NO: 587545 - RNA, 16 nt, Homo sapiens
uaaaaugacuauuucu

SEQ ID NO: 587546 - RNA, 12 nt, Homo sapiens
uaaaaugauaaa

SEQ ID NO: 587547 - RNA, 21 nt, Homo sapiens
uaaaaugauuuuaucugugaa

SEQ ID NO: 587548 - RNA, 17 nt, Homo sapiens
uaaaaugcauacuguug

SEQ ID NO: 587549 - RNA, 16 nt, Homo sapiens
uaaaauggcaguuuga

SEQ ID NO: 587550 - RNA, 19 nt, Homo sapiens
uaaaauggugauauccucu

SEQ ID NO: 587551 - RNA, 14 nt, Homo sapiens
uaaaaugucuucuc

SEQ ID NO: 587552 - RNA, 17 nt, Homo sapiens
uaaaaugucuucuccca

SEQ ID NO: 587553 - RNA, 18 nt, Homo sapiens
uaaaauguguacagugaa

SEQ ID NO: 587554 - RNA, 20 nt, Homo sapiens
uaaaauguugaaaagucaaa

SEQ ID NO: 587555 - RNA, 16 nt, Homo sapiens
uaaaauguuuaaugaa

SEQ ID NO: 587556 - RNA, 20 nt, Homo sapiens
uaaaauuacauugagguucc

SEQ ID NO: 587557 - RNA, 18 nt, Homo sapiens
uaaaauuaggacuguaua

SEQ ID NO: 587558 - RNA, 17 nt, Homo sapiens
uaaaauuauacugugug

SEQ ID NO: 587559 - RNA, 20 nt, Homo sapiens
uaaaauuccucuuacuguaa

SEQ ID NO: 587560 - RNA, 16 nt, Homo sapiens
uaaaauugaguuugua

SEQ ID NO: 587561 - RNA, 19 nt, Homo sapiens
uaaaauugcuucuuuacca

SEQ ID NO: 587562 - RNA, 20 nt, Homo sapiens
uaaaauugggcuugugauuu

SEQ ID NO: 587563 - RNA, 15 nt, Homo sapiens
uaaaauuguaugaaa

SEQ ID NO: 587564 - RNA, 14 nt, Homo sapiens
uaaaauuugugcug

SEQ ID NO: 587565 - RNA, 21 nt, Homo sapiens
uaaaauuuuaaaaagucaauu

SEQ ID NO: 587566 - RNA, 17 nt, Homo sapiens
uaaacaaauaacaaugu

SEQ ID NO: 587567 - RNA, 14 nt, Homo sapiens
uaaacaacuaccuc

SEQ ID NO: 587568 - RNA, 16 nt, Homo sapiens
uaaacaacuaccuccu

SEQ ID NO: 587569 - RNA, 18 nt, Homo sapiens
uaaacaagggucaauuca

SEQ ID NO: 587570 - RNA, 22 nt, Homo sapiens
uaaacaagucauuuuucuugau

SEQ ID NO: 587571 - RNA, 20 nt, Homo sapiens
uaaacacaaagcuguugaaa

SEQ ID NO: 587572 - RNA, 16 nt, Homo sapiens
uaaacacaugccuuaa

SEQ ID NO: 587573 - RNA, 17 nt, Homo sapiens
uaaacacccaugaauca

SEQ ID NO: 587574 - RNA, 17 nt, Homo sapiens
uaaacacuccacagugu

SEQ ID NO: 587575 - RNA, 18 nt, Homo sapiens
uaaacagacaggaauuua

SEQ ID NO: 587576 - RNA, 12 nt, Homo sapiens
uaaacagaggau

SEQ ID NO: 587577 - RNA, 20 nt, Homo sapiens
uaaacagauggcacuuugaa

SEQ ID NO: 587578 - RNA, 18 nt, Homo sapiens
uaaacagccucuuuuuga

SEQ ID NO: 587579 - RNA, 17 nt, Homo sapiens
uaaacagcuucaugccu

SEQ ID NO: 587580 - RNA, 20 nt, Homo sapiens
uaaacagcuucaugccuuug

SEQ ID NO: 587581 - RNA, 11 nt, Homo sapiens
uaaacaggguc

SEQ ID NO: 587582 - RNA, 17 nt, Homo sapiens
uaaacauaaagaauuca

SEQ ID NO: 587583 - RNA, 23 nt, Homo sapiens
uaaacauauuuuuauacuuuauu

SEQ ID NO: 587584 - RNA, 17 nt, Homo sapiens
uaaacaucacaugagac

SEQ ID NO: 587585 - RNA, 19 nt, Homo sapiens
uaaacaucagcaagacuuu

SEQ ID NO: 587586 - RNA, 12 nt, Homo sapiens
uaaacaugucac

SEQ ID NO: 587587 - RNA, 22 nt, Homo sapiens
uaaacauuaaguaaaugcugua

SEQ ID NO: 587588 - RNA, 11 nt, Homo sapiens
uaaacauuuau

SEQ ID NO: 587589 - RNA, 21 nt, Homo sapiens
uaaacauuugagagcuaacua

SEQ ID NO: 587590 - RNA, 14 nt, Homo sapiens
uaaaccaaggacug

SEQ ID NO: 587591 - RNA, 23 nt, Homo sapiens
uaaaccagguuuagacaguauga

SEQ ID NO: 587592 - RNA, 15 nt, Homo sapiens
uaaacccaaucagau

SEQ ID NO: 587593 - RNA, 19 nt, Homo sapiens
uaaaccgcaugugaucucc

SEQ ID NO: 587594 - RNA, 16 nt, Homo sapiens
uaaaccugauuuacua

SEQ ID NO: 587595 - RNA, 23 nt, Homo sapiens
uaaacgaagagacagaacugucc

SEQ ID NO: 587596 - RNA, 20 nt, Homo sapiens
uaaacgacaagaauaauuca

SEQ ID NO: 587597 - RNA, 22 nt, Homo sapiens
uaaacgaggaaaagguccuugc

SEQ ID NO: 587598 - RNA, 15 nt, Homo sapiens
uaaacgggaacaugc

SEQ ID NO: 587599 - RNA, 22 nt, Homo sapiens
uaaacuacaacgaacacaagaa

SEQ ID NO: 587600 - RNA, 14 nt, Homo sapiens
uaaacuaggaauuu

SEQ ID NO: 587601 - RNA, 13 nt, Homo sapiens
uaaacuaguuuaa

SEQ ID NO: 587602 - RNA, 14 nt, Homo sapiens
uaaacucaagacaa

SEQ ID NO: 587603 - RNA, 18 nt, Homo sapiens
uaaacucaagacaaugca

SEQ ID NO: 587604 - RNA, 15 nt, Homo sapiens
uaaacuccuacuaaa

SEQ ID NO: 587605 - RNA, 23 nt, Homo sapiens
uaaacuccuuccuggccugagag

SEQ ID NO: 587606 - RNA, 12 nt, Homo sapiens
uaaacucggggg

SEQ ID NO: 587607 - RNA, 13 nt, Homo sapiens
uaaacucugucca

SEQ ID NO: 587608 - RNA, 23 nt, Homo sapiens
uaaacucuguccacgauucacuc

SEQ ID NO: 587609 - RNA, 17 nt, Homo sapiens
uaaacugaaaaauguca

SEQ ID NO: 587610 - RNA, 16 nt, Homo sapiens
uaaacugaaaauggac

SEQ ID NO: 587611 - RNA, 18 nt, Homo sapiens
uaaacugaaucuauggcu

SEQ ID NO: 587612 - RNA, 19 nt, Homo sapiens
uaaacugguugucaguuac

SEQ ID NO: 587613 - RNA, 15 nt, Homo sapiens
uaaacuguacagugu

SEQ ID NO: 587614 - RNA, 21 nt, Homo sapiens
uaaacuguaucaaaucuguau

SEQ ID NO: 587615 - RNA, 23 nt, Homo sapiens
uaaacuguuagcacuguugaugu

SEQ ID NO: 587616 - RNA, 11 nt, Homo sapiens
uaaacuguugu

SEQ ID NO: 587617 - RNA, 22 nt, Homo sapiens
uaaacuuaagggaaaaguucuc

SEQ ID NO: 587618 - RNA, 22 nt, Homo sapiens
uaaacuucaccuacauuaucuc

SEQ ID NO: 587619 - RNA, 23 nt, Homo sapiens
uaaacuucaccuacauuaucuca

SEQ ID NO: 587620 - RNA, 22 nt, Homo sapiens
uaaacuugaguuggaguacuau

SEQ ID NO: 587621 - RNA, 20 nt, Homo sapiens
uaaacuuggaaccuuggaaa

SEQ ID NO: 587622 - RNA, 14 nt, Homo sapiens
uaaacuuguuuaca

SEQ ID NO: 587623 - RNA, 16 nt, Homo sapiens
uaaacuuuaucacuua

SEQ ID NO: 587624 - RNA, 18 nt, Homo sapiens
uaaacuuuccaaaaccuu

SEQ ID NO: 587625 - RNA, 20 nt, Homo sapiens
uaaagaaaaauaugauacuc

SEQ ID NO: 587626 - RNA, 20 nt, Homo sapiens
uaaagaaaauaaacaccauu

SEQ ID NO: 587627 - RNA, 19 nt, Homo sapiens
uaaagaaagaaugcauucc

SEQ ID NO: 587628 - RNA, 20 nt, Homo sapiens
uaaagaaaggaacuaaguca

SEQ ID NO: 587629 - RNA, 15 nt, Homo sapiens
uaaagaaauugcaau

SEQ ID NO: 587630 - RNA, 15 nt, Homo sapiens
uaaagaagaacuugc

SEQ ID NO: 587631 - RNA, 16 nt, Homo sapiens
uaaagaagauaaacac

SEQ ID NO: 587632 - RNA, 13 nt, Homo sapiens
uaaagaagcugca

SEQ ID NO: 587633 - RNA, 20 nt, Homo sapiens
guauauuuguaaacuacaaa

SEQ ID NO: 587634 - RNA, 15 nt, Homo sapiens
guaucaacacuguua

SEQ ID NO: 587635 - RNA, 22 nt, Homo sapiens
guaucaagcccugaaaauaugg

SEQ ID NO: 587636 - RNA, 23 nt, Homo sapiens
guaucaaguggcaugugcuguga

SEQ ID NO: 587637 - RNA, 24 nt, Homo sapiens
guaucacagacuggcaacaagaag

SEQ ID NO: 587638 - RNA, 22 nt, Homo sapiens
guaucacugguccaccuccuga

SEQ ID NO: 587639 - RNA, 22 nt, Homo sapiens
guaucagaucuaucuugucaau

SEQ ID NO: 587640 - RNA, 19 nt, Homo sapiens
guaucaguuauaugauauu

SEQ ID NO: 587641 - RNA, 12 nt, Homo sapiens
guaucaucagau

SEQ ID NO: 587642 - RNA, 18 nt, Homo sapiens
guaucaugcccugugcaa

SEQ ID NO: 587643 - RNA, 20 nt, Homo sapiens
guaucaugcccugugcaacc

SEQ ID NO: 587644 - RNA, 11 nt, Homo sapiens
guauccaaaaa

SEQ ID NO: 587645 - RNA, 20 nt, Homo sapiens
guauccaauaggcauuugau

SEQ ID NO: 587646 - RNA, 19 nt, Homo sapiens
guauccccccaucuugcuu

SEQ ID NO: 587647 - RNA, 15 nt, Homo sapiens
guaucccuuauccaa

SEQ ID NO: 587648 - RNA, 23 nt, Homo sapiens
guauccuacugagcauuugcacc

SEQ ID NO: 587649 - RNA, 22 nt, Homo sapiens
guaucgcauauuaguuaaucuc

SEQ ID NO: 587650 - RNA, 18 nt, Homo sapiens
guaucuauuuguacaauu

SEQ ID NO: 587651 - RNA, 20 nt, Homo sapiens
guaucucuuuugaauccaug

SEQ ID NO: 587652 - RNA, 12 nt, Homo sapiens
guaucugucaca

SEQ ID NO: 587653 - RNA, 20 nt, Homo sapiens
guaucuuccuuucuugucuu

SEQ ID NO: 587654 - RNA, 18 nt, Homo sapiens
guaugaaagagcaaguga

SEQ ID NO: 587655 - RNA, 16 nt, Homo sapiens
guaugauaagcuuuau

SEQ ID NO: 587656 - RNA, 19 nt, Homo sapiens
guaugaucaauaaaggaca

SEQ ID NO: 587657 - RNA, 22 nt, Homo sapiens
guaugaugucacacaagcuccu

SEQ ID NO: 587658 - RNA, 18 nt, Homo sapiens
guaugcaacucugacguu

SEQ ID NO: 587659 - RNA, 18 nt, Homo sapiens
guauggaauacaguguua

SEQ ID NO: 587660 - RNA, 18 nt, Homo sapiens
guauggcaugaacaucuu

SEQ ID NO: 587661 - RNA, 21 nt, Homo sapiens
guauggggaggcaaguguggg

SEQ ID NO: 587662 - RNA, 22 nt, Homo sapiens
guauguagaagccuaggaucac

SEQ ID NO: 587663 - RNA, 19 nt, Homo sapiens
guauguauuuaaggagaac

SEQ ID NO: 587664 - RNA, 20 nt, Homo sapiens
guauguauuuucaguuacaa

SEQ ID NO: 587665 - RNA, 14 nt, Homo sapiens
guaugucuguuacc

SEQ ID NO: 587666 - RNA, 22 nt, Homo sapiens
guaugugaaacacacauggaca

SEQ ID NO: 587667 - RNA, 13 nt, Homo sapiens
guaugugccaaag

SEQ ID NO: 587668 - RNA, 20 nt, Homo sapiens
guauguguguagacuguaac

SEQ ID NO: 587669 - RNA, 21 nt, Homo sapiens
uaaaugauucuuagugacuuu

SEQ ID NO: 587670 - RNA, 16 nt, Homo sapiens
uaaaugcaugucuuaa

SEQ ID NO: 587671 - RNA, 12 nt, Homo sapiens
uaaaugcauuag

SEQ ID NO: 587672 - RNA, 14 nt, Homo sapiens
uaaaugccuuccac

SEQ ID NO: 587673 - RNA, 18 nt, Homo sapiens
uaaaugcuacauacucca

SEQ ID NO: 587674 - RNA, 23 nt, Homo sapiens
uaaaugcuauuuuuuauuuuacu

SEQ ID NO: 587675 - RNA, 24 nt, Homo sapiens
uaaaugcucgugugauuuccuaca

SEQ ID NO: 587676 - RNA, 21 nt, Homo sapiens
uaaaugcugucaacuaugaua

SEQ ID NO: 587677 - RNA, 22 nt, Homo sapiens
uaaaugcuucauuuguauguca

SEQ ID NO: 587678 - RNA, 24 nt, Homo sapiens
uaaauggcuuuugccacauacaua

SEQ ID NO: 587679 - RNA, 19 nt, Homo sapiens
uaaaugggggugcauuuga

SEQ ID NO: 587680 - RNA, 14 nt, Homo sapiens
uaaauguacauuaa

SEQ ID NO: 587681 - RNA, 22 nt, Homo sapiens
uaaauguagcaauggcacuguu

SEQ ID NO: 587682 - RNA, 21 nt, Homo sapiens
uaaauguagcgacugucaaca

SEQ ID NO: 587683 - RNA, 17 nt, Homo sapiens
uaaauguauacuauagu

SEQ ID NO: 587684 - RNA, 14 nt, Homo sapiens
uaaauguaucuuau

SEQ ID NO: 587685 - RNA, 15 nt, Homo sapiens
uaaauguauguauuu

SEQ ID NO: 587686 - RNA, 17 nt, Homo sapiens
uaaaugucacugccaac

SEQ ID NO: 587687 - RNA, 21 nt, Homo sapiens
uaaaugugaaugaugauccua

SEQ ID NO: 587688 - RNA, 15 nt, Homo sapiens
gcccaucaccucuaa

SEQ ID NO: 587689 - RNA, 14 nt, Homo sapiens
gcccaucacuguau

SEQ ID NO: 587690 - RNA, 18 nt, Homo sapiens
gcccauccccaggcaccu

SEQ ID NO: 587691 - RNA, 12 nt, Homo sapiens
gcccaucucaac

SEQ ID NO: 587692 - RNA, 16 nt, Homo sapiens
gcccauucuucugggu

SEQ ID NO: 587693 - RNA, 20 nt, Homo sapiens
gcccauuggccgagcuccug

SEQ ID NO: 587694 - RNA, 16 nt, Homo sapiens
gccccaacuccagggg

SEQ ID NO: 587695 - RNA, 19 nt, Homo sapiens
gccccacagggcaaggaca

SEQ ID NO: 587696 - RNA, 23 nt, Homo sapiens
gccccaccaaugggccuccagag

SEQ ID NO: 587697 - RNA, 19 nt, Homo sapiens
gccccacuucuggccacau

SEQ ID NO: 587698 - RNA, 14 nt, Homo sapiens
gccccagaucugcc

SEQ ID NO: 587699 - RNA, 17 nt, Homo sapiens
gccccagcagugccuug

SEQ ID NO: 587700 - RNA, 16 nt, Homo sapiens
gccccaggcauugcca

SEQ ID NO: 587701 - RNA, 21 nt, Homo sapiens
gccccaggcucguggacugag

SEQ ID NO: 587702 - RNA, 19 nt, Homo sapiens
gccccagggaguccagggu

SEQ ID NO: 587703 - RNA, 12 nt, Homo sapiens
gccccaucacug

SEQ ID NO: 587704 - RNA, 23 nt, Homo sapiens
gccccauccuguguuaucugugg

SEQ ID NO: 587705 - RNA, 15 nt, Homo sapiens
gccccaugccugucc

SEQ ID NO: 587706 - RNA, 15 nt, Homo sapiens
gccccauuccuugcg

SEQ ID NO: 587707 - RNA, 14 nt, Homo sapiens
gcccccacccggga

SEQ ID NO: 587708 - RNA, 22 nt, Homo sapiens
gcccccacugucccccuaccca

SEQ ID NO: 587709 - RNA, 17 nt, Homo sapiens
gcccccagccuggccag

SEQ ID NO: 587710 - RNA, 19 nt, Homo sapiens
gcccccagggccuccaggg

SEQ ID NO: 587711 - RNA, 21 nt, Homo sapiens
gccccccccuugaaucugcag

SEQ ID NO: 587712 - RNA, 13 nt, Homo sapiens
gcccccccuucca

SEQ ID NO: 587713 - RNA, 22 nt, Homo sapiens
gccccccguguggacacagauc

SEQ ID NO: 587714 - RNA, 21 nt, Homo sapiens
gcccccgagcugggggccaug

SEQ ID NO: 587715 - RNA, 20 nt, Homo sapiens
gcccccggcuuuccuccgga

SEQ ID NO: 587716 - RNA, 17 nt, Homo sapiens
gcccccuguacauuugu

SEQ ID NO: 587717 - RNA, 16 nt, Homo sapiens
gcccccuuucagaugu

SEQ ID NO: 587718 - RNA, 20 nt, Homo sapiens
gccccgcaggguccaaaggc

SEQ ID NO: 587719 - RNA, 16 nt, Homo sapiens
gccccgccccccagag

SEQ ID NO: 587720 - RNA, 20 nt, Homo sapiens
gccccgugggcugugccaag

SEQ ID NO: 587721 - RNA, 15 nt, Homo sapiens
gccccuagcuuuaua

SEQ ID NO: 587722 - RNA, 13 nt, Homo sapiens
gccccucacccac

SEQ ID NO: 587723 - RNA, 12 nt, Homo sapiens
gccccucagggg

SEQ ID NO: 587724 - RNA, 18 nt, Homo sapiens
gccccuccacuggggaau

SEQ ID NO: 587725 - RNA, 14 nt, Homo sapiens
gccccucugaccug

SEQ ID NO: 587726 - RNA, 17 nt, Homo sapiens
gccccucugaccugcac

SEQ ID NO: 587727 - RNA, 17 nt, Homo sapiens
gccccucugcccagcuu

SEQ ID NO: 587728 - RNA, 22 nt, Homo sapiens
gccccucuuccccaaugcucca

SEQ ID NO: 587729 - RNA, 15 nt, Homo sapiens
gccccucuuggagaa

SEQ ID NO: 587730 - RNA, 19 nt, Homo sapiens
gccccugacuuaacuuuaa

SEQ ID NO: 587731 - RNA, 16 nt, Homo sapiens
gccccugagcccagag

SEQ ID NO: 587732 - RNA, 18 nt, Homo sapiens
gccccugccucccaaacc

SEQ ID NO: 587733 - RNA, 22 nt, Homo sapiens
gccccuggacuauggugcugua

SEQ ID NO: 587734 - RNA, 12 nt, Homo sapiens
gccccuucaucc

SEQ ID NO: 587735 - RNA, 17 nt, Homo sapiens
gccccuucauggaagaa

SEQ ID NO: 587736 - RNA, 18 nt, Homo sapiens
gccccuugagccaggugg

SEQ ID NO: 587737 - RNA, 15 nt, Homo sapiens
gccccuuuuacuuuu

SEQ ID NO: 587738 - RNA, 13 nt, Homo sapiens
gcccgaaaagcau

SEQ ID NO: 587739 - RNA, 14 nt, Homo sapiens
gcccgcagcacauu

SEQ ID NO: 587740 - RNA, 16 nt, Homo sapiens
gcccgcagcacauuuc

SEQ ID NO: 587741 - RNA, 20 nt, Homo sapiens
gcccgcagccuggcaucugu

SEQ ID NO: 587742 - RNA, 19 nt, Homo sapiens
gcccgccuccagcaccaag

SEQ ID NO: 587743 - RNA, 17 nt, Homo sapiens
gcccgcugccugcacug

SEQ ID NO: 587744 - RNA, 21 nt, Homo sapiens
gcccgcugcgugccaucacuc

SEQ ID NO: 587745 - RNA, 18 nt, Homo sapiens
gcccggcgccgggcacca

SEQ ID NO: 587746 - RNA, 20 nt, Homo sapiens
gcccggcugcugcuuggaug

SEQ ID NO: 587747 - RNA, 17 nt, Homo sapiens
gcccgggagccuaggac

SEQ ID NO: 587748 - RNA, 16 nt, Homo sapiens
gcccggggcagcugcc

SEQ ID NO: 587749 - RNA, 19 nt, Homo sapiens
gcccggugguuugccaugu

SEQ ID NO: 587750 - RNA, 13 nt, Homo sapiens
ggagaggccauga

SEQ ID NO: 587751 - RNA, 16 nt, Homo sapiens
ggagagggacuggcag

SEQ ID NO: 587752 - RNA, 14 nt, Homo sapiens
ggagaguacuuugg

SEQ ID NO: 587753 - RNA, 15 nt, Homo sapiens
ggagagucacuugaa

SEQ ID NO: 587754 - RNA, 20 nt, Homo sapiens
ggagaucagcagcgugcaca

SEQ ID NO: 587755 - RNA, 14 nt, Homo sapiens
ggagaugggaugcu

SEQ ID NO: 587756 - RNA, 20 nt, Homo sapiens
ggagaugucucugcaaccau

SEQ ID NO: 587757 - RNA, 14 nt, Homo sapiens
ggagcaaauguuuc

SEQ ID NO: 587758 - RNA, 21 nt, Homo sapiens
ggagcaagggcacaaacugca

SEQ ID NO: 587759 - RNA, 16 nt, Homo sapiens
ggagcacggacuguca

SEQ ID NO: 587760 - RNA, 23 nt, Homo sapiens
ggagcacguggagauagugccag

SEQ ID NO: 587761 - RNA, 15 nt, Homo sapiens
ggagcacuguucaca

SEQ ID NO: 587762 - RNA, 19 nt, Homo sapiens
ggagcagcagccagcacca

SEQ ID NO: 587763 - RNA, 23 nt, Homo sapiens
ggagcagcuucugggaccauaag

SEQ ID NO: 587764 - RNA, 15 nt, Homo sapiens
ggagcaggaggccaa

SEQ ID NO: 587765 - RNA, 22 nt, Homo sapiens
ggagcagucuccugcccucucc

SEQ ID NO: 587766 - RNA, 16 nt, Homo sapiens
ggagcagugcuuuuca

SEQ ID NO: 587767 - RNA, 23 nt, Homo sapiens
ggagcagugugaccuccugugac

SEQ ID NO: 587768 - RNA, 22 nt, Homo sapiens
ggagcaugcuuaccuucugcug

SEQ ID NO: 587769 - RNA, 21 nt, Homo sapiens
ggagcauucugccuaacagaa

SEQ ID NO: 587770 - RNA, 18 nt, Homo sapiens
ggagccaaaaucucaaga

SEQ ID NO: 587771 - RNA, 16 nt, Homo sapiens
ggagccaauccacucc

SEQ ID NO: 587772 - RNA, 12 nt, Homo sapiens
ggagcccaguga

SEQ ID NO: 587773 - RNA, 19 nt, Homo sapiens
ggagcccccaccacaaacu

SEQ ID NO: 587774 - RNA, 16 nt, Homo sapiens
ggagcccuggugcuac

SEQ ID NO: 587775 - RNA, 18 nt, Homo sapiens
ggagccucccccucagau

SEQ ID NO: 587776 - RNA, 21 nt, Homo sapiens
ggagccugguccuucccugau

SEQ ID NO: 587777 - RNA, 21 nt, Homo sapiens
ggagcucuacgugcuccucag

SEQ ID NO: 587778 - RNA, 17 nt, Homo sapiens
ggagcuggggaaacuca

SEQ ID NO: 587779 - RNA, 13 nt, Homo sapiens
ggagcuggggucu

SEQ ID NO: 587780 - RNA, 15 nt, Homo sapiens
ggagcuucggggccu

SEQ ID NO: 587781 - RNA, 16 nt, Homo sapiens
ggagcuugcagugagc

SEQ ID NO: 587782 - RNA, 22 nt, Homo sapiens
ggagcuugcagugagccgagau

SEQ ID NO: 587783 - RNA, 14 nt, Homo sapiens
ggaggaacccaaga

SEQ ID NO: 587784 - RNA, 15 nt, Homo sapiens
ggaggaauacauuuu

SEQ ID NO: 587785 - RNA, 12 nt, Homo sapiens
ggaggacaagca

SEQ ID NO: 587786 - RNA, 17 nt, Homo sapiens
ggaggacaguggcacaa

SEQ ID NO: 587787 - RNA, 15 nt, Homo sapiens
ggaggaccagagcua

SEQ ID NO: 587788 - RNA, 22 nt, Homo sapiens
ggaggaggcugaggccugugaa

SEQ ID NO: 587789 - RNA, 19 nt, Homo sapiens
ggaggagggcucagggagc

SEQ ID NO: 587790 - RNA, 15 nt, Homo sapiens
ggaggaucaguuuuu

SEQ ID NO: 587791 - RNA, 15 nt, Homo sapiens
ggaggaugaugccag

SEQ ID NO: 587792 - RNA, 21 nt, Homo sapiens
ggaggcacaacgcaccagaca

SEQ ID NO: 587793 - RNA, 13 nt, Homo sapiens
ggaggcacuggga

SEQ ID NO: 587794 - RNA, 12 nt, Homo sapiens
ggaggcacuuua

SEQ ID NO: 587795 - RNA, 22 nt, Homo sapiens
ggaggcagagguugcagugaac

SEQ ID NO: 587796 - RNA, 19 nt, Homo sapiens
ggaggcagggcagccucgc

SEQ ID NO: 587797 - RNA, 15 nt, Homo sapiens
ggaggccaaccagcc

SEQ ID NO: 587798 - RNA, 14 nt, Homo sapiens
ggaggccaaggugg

SEQ ID NO: 587799 - RNA, 23 nt, Homo sapiens
ggaggccauccaagauggcauga

SEQ ID NO: 587800 - RNA, 15 nt, Homo sapiens
ggaggcccuccugug

SEQ ID NO: 587801 - RNA, 19 nt, Homo sapiens
ggaggcggagcuugcagug

SEQ ID NO: 587802 - RNA, 20 nt, Homo sapiens
ggaggcggagcuugcaguga

SEQ ID NO: 587803 - RNA, 22 nt, Homo sapiens
ggaggcuuuggguggcucacua

SEQ ID NO: 587804 - RNA, 18 nt, Homo sapiens
ggagggaaaagagugccu

SEQ ID NO: 587805 - RNA, 17 nt, Homo sapiens
ggagggaacagugccca

SEQ ID NO: 587806 - RNA, 13 nt, Homo sapiens
ggagggacaagug

SEQ ID NO: 587807 - RNA, 14 nt, Homo sapiens
ggagggagggacaa

SEQ ID NO: 587808 - RNA, 14 nt, Homo sapiens
ggagggcaguuuuc

SEQ ID NO: 587809 - RNA, 17 nt, Homo sapiens
ggagggccagcgcugug

SEQ ID NO: 587810 - RNA, 21 nt, Homo sapiens
ggagggcugucaucugugcac

SEQ ID NO: 587811 - RNA, 12 nt, Homo sapiens
ggaggggaccaa

SEQ ID NO: 587812 - RNA, 16 nt, Homo sapiens
ggaggggcagagccag

SEQ ID NO: 587813 - RNA, 16 nt, Homo sapiens
ggagggggaagcaaag

SEQ ID NO: 587814 - RNA, 12 nt, Homo sapiens
ggaggggguccu

SEQ ID NO: 587815 - RNA, 16 nt, Homo sapiens
ggagggugagugcaag

SEQ ID NO: 587816 - RNA, 13 nt, Homo sapiens
ggaggguggcaag

SEQ ID NO: 587817 - RNA, 20 nt, Homo sapiens
ggagggugguucaacaaaga

SEQ ID NO: 587818 - RNA, 16 nt, Homo sapiens
ggaggugaagguugcu

SEQ ID NO: 587819 - RNA, 14 nt, Homo sapiens
ggaggugcugcucu

SEQ ID NO: 587820 - RNA, 19 nt, Homo sapiens
ggagguggagcuugcagug

SEQ ID NO: 587821 - RNA, 20 nt, Homo sapiens
ggagguggagcuugcaguga

SEQ ID NO: 587822 - RNA, 20 nt, Homo sapiens
ggagguggaggcugcaguga

SEQ ID NO: 587823 - RNA, 20 nt, Homo sapiens
ggagguggagguugcaguga

SEQ ID NO: 587824 - RNA, 20 nt, Homo sapiens
gccgagaucacaccacugua

SEQ ID NO: 587825 - RNA, 15 nt, Homo sapiens
gccgaguccaagcug

SEQ ID NO: 587826 - RNA, 20 nt, Homo sapiens
gccgauaucaacacuuguau

SEQ ID NO: 587827 - RNA, 18 nt, Homo sapiens
gccgcaguuuggagucac

SEQ ID NO: 587828 - RNA, 22 nt, Homo sapiens
gccgcauuggugacucacuuca

SEQ ID NO: 587829 - RNA, 15 nt, Homo sapiens
gccgccgaccuguga

SEQ ID NO: 587830 - RNA, 17 nt, Homo sapiens
gccgccgaccugugacu

SEQ ID NO: 587831 - RNA, 21 nt, Homo sapiens
gccgccucccaccacuccacu

SEQ ID NO: 587832 - RNA, 18 nt, Homo sapiens
gccgcggacgcaccuggg

SEQ ID NO: 587833 - RNA, 12 nt, Homo sapiens
gccgcucugauu

SEQ ID NO: 587834 - RNA, 21 nt, Homo sapiens
gccggaaaaggcgcaucuaac

SEQ ID NO: 587835 - RNA, 18 nt, Homo sapiens
gccggaggucaugaugau

SEQ ID NO: 587836 - RNA, 16 nt, Homo sapiens
gccggaucugagggag

SEQ ID NO: 587837 - RNA, 16 nt, Homo sapiens
gccggccggaccucug

SEQ ID NO: 587838 - RNA, 16 nt, Homo sapiens
gccgggaccacccuga

SEQ ID NO: 587839 - RNA, 19 nt, Homo sapiens
gccgggcaccaacuccaug

SEQ ID NO: 587840 - RNA, 20 nt, Homo sapiens
gccgggcaggguguggggcc

SEQ ID NO: 587841 - RNA, 16 nt, Homo sapiens
gccgggcugacugccc

SEQ ID NO: 587842 - RNA, 23 nt, Homo sapiens
gccgguccuucccucucaugacu

SEQ ID NO: 587843 - RNA, 16 nt, Homo sapiens
gccggugcucuggaag

SEQ ID NO: 587844 - RNA, 15 nt, Homo sapiens
gccgucacgcuuuca

SEQ ID NO: 587845 - RNA, 21 nt, Homo sapiens
gccguccuggcgccuggcagu

SEQ ID NO: 587846 - RNA, 17 nt, Homo sapiens
gccgucuccucccucag

SEQ ID NO: 587847 - RNA, 22 nt, Homo sapiens
gccguggggccgccgccucuuu

SEQ ID NO: 587848 - RNA, 19 nt, Homo sapiens
gccgugugagugugacagg

SEQ ID NO: 587849 - RNA, 22 nt, Homo sapiens
gccuaaaaaguaucauuacaua

SEQ ID NO: 587850 - RNA, 17 nt, Homo sapiens
gccuaaaaaugcaacuu

SEQ ID NO: 587851 - RNA, 21 nt, Homo sapiens
gccuaaaagugggcuugauuc

SEQ ID NO: 587852 - RNA, 17 nt, Homo sapiens
gccuaaaucccaagaaa

SEQ ID NO: 587853 - RNA, 16 nt, Homo sapiens
gccuaaaucuccagug

SEQ ID NO: 587854 - RNA, 14 nt, Homo sapiens
gccuaaaugccuua

SEQ ID NO: 587855 - RNA, 15 nt, Homo sapiens
gccuaacacacucca

SEQ ID NO: 587856 - RNA, 20 nt, Homo sapiens
gccuaacacacuccaagaua

SEQ ID NO: 587857 - RNA, 23 nt, Homo sapiens
gccuaauaguaacugguuaaaaa

SEQ ID NO: 587858 - RNA, 19 nt, Homo sapiens
gccuacacccgucuugggg

SEQ ID NO: 587859 - RNA, 18 nt, Homo sapiens
gccuacuuaagagugcug

SEQ ID NO: 587860 - RNA, 14 nt, Homo sapiens
gccuagagcacucu

SEQ ID NO: 587861 - RNA, 16 nt, Homo sapiens
gccuagccgaccucag

SEQ ID NO: 587862 - RNA, 21 nt, Homo sapiens
gccuagcuccugccacaugga

SEQ ID NO: 587863 - RNA, 16 nt, Homo sapiens
gccuaggggucaggga

SEQ ID NO: 587864 - RNA, 23 nt, Homo sapiens
gccuaguaagggaacuauggaaa

SEQ ID NO: 587865 - RNA, 18 nt, Homo sapiens
gccuauaauacuugcaac

SEQ ID NO: 587866 - RNA, 18 nt, Homo sapiens
gccuauaucaaacaugca

SEQ ID NO: 587867 - RNA, 14 nt, Homo sapiens
gccuaugagggccu

SEQ ID NO: 587868 - RNA, 18 nt, Homo sapiens
gccuaugcagacaucucu

SEQ ID NO: 587869 - RNA, 23 nt, Homo sapiens
gccuauguuugcggaaugcauug

SEQ ID NO: 587870 - RNA, 20 nt, Homo sapiens
gccuauuguuuguaaaacca

SEQ ID NO: 587871 - RNA, 16 nt, Homo sapiens
gccucaagaacaaaca

SEQ ID NO: 587872 - RNA, 15 nt, Homo sapiens
gccucaagacuauag

SEQ ID NO: 587873 - RNA, 19 nt, Homo sapiens
gccucaagaugaaggcaaa

SEQ ID NO: 587874 - RNA, 17 nt, Homo sapiens
gccucaagugagccaag

SEQ ID NO: 587875 - RNA, 16 nt, Homo sapiens
gccucaaguuauuuca

SEQ ID NO: 587876 - RNA, 14 nt, Homo sapiens
gccucaaguuccau

SEQ ID NO: 587877 - RNA, 16 nt, Homo sapiens
gccucaaguuccaugc

SEQ ID NO: 587878 - RNA, 15 nt, Homo sapiens
gccucaaugccagua

SEQ ID NO: 587879 - RNA, 14 nt, Homo sapiens
gccucaaugugacc

SEQ ID NO: 587880 - RNA, 19 nt, Homo sapiens
gccucaaugugaccagggg

SEQ ID NO: 587881 - RNA, 20 nt, Homo sapiens
gccucaccuccucugugauu

SEQ ID NO: 587882 - RNA, 12 nt, Homo sapiens
gccucaccucua

SEQ ID NO: 587883 - RNA, 22 nt, Homo sapiens
gccucagaauaaaagaugauuu

SEQ ID NO: 587884 - RNA, 14 nt, Homo sapiens
gccucagcuaccca

SEQ ID NO: 587885 - RNA, 11 nt, Homo sapiens
gccucagugac

SEQ ID NO: 587886 - RNA, 19 nt, Homo sapiens
ggcaacguagccugggcuc

SEQ ID NO: 587887 - RNA, 21 nt, Homo sapiens
ggcaagccugucuucagagaa

SEQ ID NO: 587888 - RNA, 22 nt, Homo sapiens
ggcaaguagcaggacuaggcau

SEQ ID NO: 587889 - RNA, 18 nt, Homo sapiens
ggcaagucuagagucuca

SEQ ID NO: 587890 - RNA, 19 nt, Homo sapiens
ggcaagugugggggguccu

SEQ ID NO: 587891 - RNA, 20 nt, Homo sapiens
ggcaagugugggggguccuu

SEQ ID NO: 587892 - RNA, 16 nt, Homo sapiens
ggcaauaguguguucu

SEQ ID NO: 587893 - RNA, 19 nt, Homo sapiens
ggcaaucaauacagcuuca

SEQ ID NO: 587894 - RNA, 20 nt, Homo sapiens
ggcaaucaugagcaagugaa

SEQ ID NO: 587895 - RNA, 17 nt, Homo sapiens
ggcaauccuaagcaaaa

SEQ ID NO: 587896 - RNA, 19 nt, Homo sapiens
ggcaauuauuccccuaggc

SEQ ID NO: 587897 - RNA, 19 nt, Homo sapiens
ggcaauuucaccaccaaau

SEQ ID NO: 587898 - RNA, 12 nt, Homo sapiens
ggcacacacugu

SEQ ID NO: 587899 - RNA, 21 nt, Homo sapiens
ggcacauaggcugguggccuu

SEQ ID NO: 587900 - RNA, 14 nt, Homo sapiens
ggcaccaaccugca

SEQ ID NO: 587901 - RNA, 13 nt, Homo sapiens
ggcaccaugcaaa

SEQ ID NO: 587902 - RNA, 22 nt, Homo sapiens
ggcacccaaaacucaagcaaga

SEQ ID NO: 587903 - RNA, 22 nt, Homo sapiens
ggcacccacaaauaaaugacaa

SEQ ID NO: 587904 - RNA, 23 nt, Homo sapiens
ggcacccacaaauaaaugacaag

SEQ ID NO: 587905 - RNA, 15 nt, Homo sapiens
ggcacccccaugcug

SEQ ID NO: 587906 - RNA, 15 nt, Homo sapiens
ggcacccucagggag

SEQ ID NO: 587907 - RNA, 21 nt, Homo sapiens
ggcacgucgcccgcugagcug

SEQ ID NO: 587908 - RNA, 13 nt, Homo sapiens
ggcacuacaggca

SEQ ID NO: 587909 - RNA, 17 nt, Homo sapiens
ggcacucccauccaucc

SEQ ID NO: 587910 - RNA, 19 nt, Homo sapiens
ggcacucugugggugcuac

SEQ ID NO: 587911 - RNA, 20 nt, Homo sapiens
ggcacugcccuuuucaggaa

SEQ ID NO: 587912 - RNA, 16 nt, Homo sapiens
ggcacugggaagccua

SEQ ID NO: 587913 - RNA, 11 nt, Homo sapiens
ggcacugggau

SEQ ID NO: 587914 - RNA, 15 nt, Homo sapiens
ggcacuggggcacuu

SEQ ID NO: 587915 - RNA, 16 nt, Homo sapiens
ggcacuggugggccau

SEQ ID NO: 587916 - RNA, 13 nt, Homo sapiens
ggcacuucauuga

SEQ ID NO: 587917 - RNA, 21 nt, Homo sapiens
ggcacuuuaagucagugacag

SEQ ID NO: 587918 - RNA, 17 nt, Homo sapiens
ggcacuuuuauuuucau

SEQ ID NO: 587919 - RNA, 23 nt, Homo sapiens
ggcagaaacaaaaugacuguaga

SEQ ID NO: 587920 - RNA, 20 nt, Homo sapiens
ggcagacacagggacuugaa

SEQ ID NO: 587921 - RNA, 19 nt, Homo sapiens
ggcagaccgugaccaucuu

SEQ ID NO: 587922 - RNA, 13 nt, Homo sapiens
ggcagagcacagc

SEQ ID NO: 587923 - RNA, 15 nt, Homo sapiens
ggcagagccaugggc

SEQ ID NO: 587924 - RNA, 21 nt, Homo sapiens
ggcagagcuuuugcauuuccu

SEQ ID NO: 587925 - RNA, 19 nt, Homo sapiens
ggcagaucccacuugcagc

SEQ ID NO: 587926 - RNA, 21 nt, Homo sapiens
ggcagaugaaauuuauuucca

SEQ ID NO: 587927 - RNA, 20 nt, Homo sapiens
ggcagcaagguggccacagu

SEQ ID NO: 587928 - RNA, 12 nt, Homo sapiens
ggcagcaauuua

SEQ ID NO: 587929 - RNA, 14 nt, Homo sapiens
ggcagcaccaucuc

SEQ ID NO: 587930 - RNA, 14 nt, Homo sapiens
ggcagcacugggaa

SEQ ID NO: 587931 - RNA, 23 nt, Homo sapiens
ggcagcagcucccgcagggcuga

SEQ ID NO: 587932 - RNA, 11 nt, Homo sapiens
ggcagcauuuu

SEQ ID NO: 587933 - RNA, 18 nt, Homo sapiens
gucccuccaccccacaga

SEQ ID NO: 587934 - RNA, 13 nt, Homo sapiens
gucccuccaggga

SEQ ID NO: 587935 - RNA, 18 nt, Homo sapiens
gucccugcagaagccaga

SEQ ID NO: 587936 - RNA, 18 nt, Homo sapiens
gucccugccacacucagu

SEQ ID NO: 587937 - RNA, 16 nt, Homo sapiens
gucccugcugcugcca

SEQ ID NO: 587938 - RNA, 18 nt, Homo sapiens
gucccuggaaccuucuag

SEQ ID NO: 587939 - RNA, 22 nt, Homo sapiens
gucccugguucauugauggaug

SEQ ID NO: 587940 - RNA, 20 nt, Homo sapiens
gucccugucaggacacaugg

SEQ ID NO: 587941 - RNA, 22 nt, Homo sapiens
gucccuguccuucccuguucuc

SEQ ID NO: 587942 - RNA, 20 nt, Homo sapiens
gucccuugaugcacagagaa

SEQ ID NO: 587943 - RNA, 17 nt, Homo sapiens
gucccuugcugugagca

SEQ ID NO: 587944 - RNA, 13 nt, Homo sapiens
gucccuuggcaca

SEQ ID NO: 587945 - RNA, 17 nt, Homo sapiens
guccgcgcgccagcaca

SEQ ID NO: 587946 - RNA, 18 nt, Homo sapiens
guccuaaggacacacuaa

SEQ ID NO: 587947 - RNA, 17 nt, Homo sapiens
guccuaauaauauccca

SEQ ID NO: 587948 - RNA, 18 nt, Homo sapiens
guccuagaaguucaguuu

SEQ ID NO: 587949 - RNA, 22 nt, Homo sapiens
guccuagacuucccagggcaag

SEQ ID NO: 587950 - RNA, 17 nt, Homo sapiens
guccucacucccagucc

SEQ ID NO: 587951 - RNA, 17 nt, Homo sapiens
guccucagagcaggggc

SEQ ID NO: 587952 - RNA, 21 nt, Homo sapiens
guccucagagcaggggccaga

SEQ ID NO: 587953 - RNA, 23 nt, Homo sapiens
guccucagcuugggcuucuuccu

SEQ ID NO: 587954 - RNA, 12 nt, Homo sapiens
guccucaucucu

SEQ ID NO: 587955 - RNA, 13 nt, Homo sapiens
guccuccaagcuc

SEQ ID NO: 587956 - RNA, 19 nt, Homo sapiens
guccuccacgccauuuccu

SEQ ID NO: 587957 - RNA, 19 nt, Homo sapiens
guccuccagaccaccagcc

SEQ ID NO: 587958 - RNA, 19 nt, Homo sapiens
guccuccaucuuccaggau

SEQ ID NO: 587959 - RNA, 16 nt, Homo sapiens
guccuccuuuucacuu

SEQ ID NO: 587960 - RNA, 13 nt, Homo sapiens
guccucuacugcu

SEQ ID NO: 587961 - RNA, 19 nt, Homo sapiens
guccucuacuuaaugagau

SEQ ID NO: 587962 - RNA, 17 nt, Homo sapiens
guccucuagugaaugua

SEQ ID NO: 587963 - RNA, 14 nt, Homo sapiens
guccucucaacucu

SEQ ID NO: 587964 - RNA, 22 nt, Homo sapiens
guccucugccugggcucuggaa

SEQ ID NO: 587965 - RNA, 15 nt, Homo sapiens
guccucuucugggcc

SEQ ID NO: 587966 - RNA, 12 nt, Homo sapiens
guccucuuuaca

SEQ ID NO: 587967 - RNA, 17 nt, Homo sapiens
guccugaaacaugaacc

SEQ ID NO: 587968 - RNA, 18 nt, Homo sapiens
guccugaaaguaacucau

SEQ ID NO: 587969 - RNA, 20 nt, Homo sapiens
guccugaagaucaagccagu

SEQ ID NO: 587970 - RNA, 15 nt, Homo sapiens
guccugacacuauuc

SEQ ID NO: 587971 - RNA, 21 nt, Homo sapiens
guccugacacuauucauuuga

SEQ ID NO: 587972 - RNA, 12 nt, Homo sapiens
guccugaccacc

SEQ ID NO: 587973 - RNA, 14 nt, Homo sapiens
guccugagcaccug

SEQ ID NO: 587974 - RNA, 18 nt, Homo sapiens
guccugaugcugugcuca

SEQ ID NO: 587975 - RNA, 20 nt, Homo sapiens
guccugaugcugugcucaau

SEQ ID NO: 587976 - RNA, 20 nt, Homo sapiens
guccugcagcaaacacucca

SEQ ID NO: 587977 - RNA, 19 nt, Homo sapiens
guccugcagugcucauuca

SEQ ID NO: 587978 - RNA, 16 nt, Homo sapiens
guccugcccuguggaa

SEQ ID NO: 587979 - RNA, 13 nt, Homo sapiens
guccugccggugg

SEQ ID NO: 587980 - RNA, 16 nt, Homo sapiens
guccugcucucuucag

SEQ ID NO: 587981 - RNA, 18 nt, Homo sapiens
guccugcugucccuguca

SEQ ID NO: 587982 - RNA, 18 nt, Homo sapiens
guccuggaggcacuggga

SEQ ID NO: 587983 - RNA, 16 nt, Homo sapiens
guccuggcugcacucu

SEQ ID NO: 587984 - RNA, 23 nt, Homo sapiens
guccugggguauaaaacuuuccu

SEQ ID NO: 587985 - RNA, 12 nt, Homo sapiens
guccuggucaag

SEQ ID NO: 587986 - RNA, 15 nt, Homo sapiens
guccuguacauugug

SEQ ID NO: 587987 - RNA, 18 nt, Homo sapiens
guccugucacugagcaca

SEQ ID NO: 587988 - RNA, 19 nt, Homo sapiens
guccuuaggugugaggucc

SEQ ID NO: 587989 - RNA, 22 nt, Homo sapiens
guccuucaaguuagcucaggag

SEQ ID NO: 587990 - RNA, 16 nt, Homo sapiens
guccuuccacugugca

SEQ ID NO: 587991 - RNA, 22 nt, Homo sapiens
guccuuccugugcccugcaaau

SEQ ID NO: 587992 - RNA, 21 nt, Homo sapiens
guccuugugaguccaucuaac

SEQ ID NO: 587993 - RNA, 21 nt, Homo sapiens
guccuuuaauuaagacugaaa

SEQ ID NO: 587994 - RNA, 16 nt, Homo sapiens
gucgagacauuccugc

SEQ ID NO: 587995 - RNA, 18 nt, Homo sapiens
gucgagauugcacugcug

SEQ ID NO: 587996 - RNA, 18 nt, Homo sapiens
gucgcaucucagugcagg

SEQ ID NO: 587997 - RNA, 15 nt, Homo sapiens
gucggaaaacaugcu

SEQ ID NO: 587998 - RNA, 20 nt, Homo sapiens
gucggaacccaagcuuagaa

SEQ ID NO: 587999 - RNA, 14 nt, Homo sapiens
gucggauccuguga

SEQ ID NO: 588000 - RNA, 19 nt, Homo sapiens
gucgucaaugaugaguccu

SEQ ID NO: 588001 - RNA, 17 nt, Homo sapiens
gucguuuuuagcuuugu

SEQ ID NO: 588002 - RNA, 18 nt, Homo sapiens
gucuaaagcuuuggggga

SEQ ID NO: 588003 - RNA, 19 nt, Homo sapiens
gucuaacauauucaaugca

SEQ ID NO: 588004 - RNA, 21 nt, Homo sapiens
gucuaacauauucaaugcaag

SEQ ID NO: 588005 - RNA, 22 nt, Homo sapiens
gucuaacuggggauauaauacu

SEQ ID NO: 588006 - RNA, 13 nt, Homo sapiens
gucuaauuuucac

SEQ ID NO: 588007 - RNA, 14 nt, Homo sapiens
gucuacaugugcca

SEQ ID NO: 588008 - RNA, 19 nt, Homo sapiens
gucuacauugagcauuuga

SEQ ID NO: 588009 - RNA, 14 nt, Homo sapiens
gucuagacugccag

SEQ ID NO: 588010 - RNA, 13 nt, Homo sapiens
gucuagagucuca

SEQ ID NO: 588011 - RNA, 15 nt, Homo sapiens
gucuaggacugcagu

SEQ ID NO: 588012 - RNA, 19 nt, Homo sapiens
gucuaggucuccucagggu

SEQ ID NO: 588013 - RNA, 18 nt, Homo sapiens
gucuagucacgcaugcag

SEQ ID NO: 588014 - RNA, 19 nt, Homo sapiens
gucuaugcccacauaccca

SEQ ID NO: 588015 - RNA, 16 nt, Homo sapiens
gucuauuuccacugaa

SEQ ID NO: 588016 - RNA, 21 nt, Homo sapiens
gucuauuuucucagucauuuu

SEQ ID NO: 588017 - RNA, 19 nt, Homo sapiens
gucucaaacucccgaccuc

SEQ ID NO: 588018 - RNA, 20 nt, Homo sapiens
gucucaaaggagcuuucuca

SEQ ID NO: 588019 - RNA, 17 nt, Homo sapiens
gucucacaguguugccc

SEQ ID NO: 588020 - RNA, 22 nt, Homo sapiens
gucucacugugggaaggccagc

SEQ ID NO: 588021 - RNA, 17 nt, Homo sapiens
gucucagcuaagcucac

SEQ ID NO: 588022 - RNA, 17 nt, Homo sapiens
gucucauccuccuuuca

SEQ ID NO: 588023 - RNA, 18 nt, Homo sapiens
gucucaucuccugacccu

SEQ ID NO: 588024 - RNA, 16 nt, Homo sapiens
gucucaucuucucuca

SEQ ID NO: 588025 - RNA, 13 nt, Homo sapiens
gucuccacugugc

SEQ ID NO: 588026 - RNA, 14 nt, Homo sapiens
gucuccaugcucac

SEQ ID NO: 588027 - RNA, 15 nt, Homo sapiens
gucuccaugcuggau

SEQ ID NO: 588028 - RNA, 20 nt, Homo sapiens
gucucccuccgacuccagau

SEQ ID NO: 588029 - RNA, 16 nt, Homo sapiens
gucucccuucuugggu

SEQ ID NO: 588030 - RNA, 22 nt, Homo sapiens
gucuccuaccugcugcugcuau

SEQ ID NO: 588031 - RNA, 23 nt, Homo sapiens
gucuccucaauuuuugucucaga

SEQ ID NO: 588032 - RNA, 18 nt, Homo sapiens
gucuccucccugggcuaa

SEQ ID NO: 588033 - RNA, 13 nt, Homo sapiens
gucuccucuccau

SEQ ID NO: 588034 - RNA, 23 nt, Homo sapiens
gucuccuuauucggcagccuuau

SEQ ID NO: 588035 - RNA, 18 nt, Homo sapiens
gucuccuuggcugucugu

SEQ ID NO: 588036 - RNA, 17 nt, Homo sapiens
gucuccuuucugacugu

SEQ ID NO: 588037 - RNA, 17 nt, Homo sapiens
gucucgcuuuguugccc

SEQ ID NO: 588038 - RNA, 14 nt, Homo sapiens
gucucuacuaaaaa

SEQ ID NO: 588039 - RNA, 18 nt, Homo sapiens
gucucuacuaaaaauaca

SEQ ID NO: 588040 - RNA, 18 nt, Homo sapiens
gucucuagugcugugaaa

SEQ ID NO: 588041 - RNA, 21 nt, Homo sapiens
gucucuauaccaaccaaacca

SEQ ID NO: 588042 - RNA, 15 nt, Homo sapiens
gucucuccugcucuc

SEQ ID NO: 588043 - RNA, 18 nt, Homo sapiens
gucucucuucucagagug

SEQ ID NO: 588044 - RNA, 14 nt, Homo sapiens
gucucucuucugcu

SEQ ID NO: 588045 - RNA, 17 nt, Homo sapiens
gucucugccucccucac

SEQ ID NO: 588046 - RNA, 18 nt, Homo sapiens
gucucugcuaaaccacca

SEQ ID NO: 588047 - RNA, 15 nt, Homo sapiens
gucucuggcauuugu

SEQ ID NO: 588048 - RNA, 14 nt, Homo sapiens
gucucuggcgugug

SEQ ID NO: 588049 - RNA, 22 nt, Homo sapiens
gucucuguacgggccaguuucu

SEQ ID NO: 588050 - RNA, 17 nt, Homo sapiens
gucucuuccuggucuga

SEQ ID NO: 588051 - RNA, 21 nt, Homo sapiens
gucucuugugacucagcagag

SEQ ID NO: 588052 - RNA, 16 nt, Homo sapiens
gucugagacuccucau

SEQ ID NO: 588053 - RNA, 14 nt, Homo sapiens
gucugagacugaaa

SEQ ID NO: 588054 - RNA, 16 nt, Homo sapiens
gucugagcuucaguau

SEQ ID NO: 588055 - RNA, 13 nt, Homo sapiens
gucugaggacuga

SEQ ID NO: 588056 - RNA, 20 nt, Homo sapiens
cuccacugugccuuugcaaa

SEQ ID NO: 588057 - RNA, 17 nt, Homo sapiens
cuccacuugaagcacuu

SEQ ID NO: 588058 - RNA, 12 nt, Homo sapiens
cuccacuuguau

SEQ ID NO: 588059 - RNA, 19 nt, Homo sapiens
cuccagaagaugccagcuu

SEQ ID NO: 588060 - RNA, 17 nt, Homo sapiens
cuccagaaucugcuguu

SEQ ID NO: 588061 - RNA, 23 nt, Homo sapiens
cuccagaauggucuuucuaaugu

SEQ ID NO: 588062 - RNA, 21 nt, Homo sapiens
cuccagaauuuggaaauccua

SEQ ID NO: 588063 - RNA, 14 nt, Homo sapiens
cuccagacaccagu

SEQ ID NO: 588064 - RNA, 19 nt, Homo sapiens
cuccagaccagaccccaaa

SEQ ID NO: 588065 - RNA, 14 nt, Homo sapiens
cuccagacccagag

SEQ ID NO: 588066 - RNA, 15 nt, Homo sapiens
cuccagagacaggga

SEQ ID NO: 588067 - RNA, 21 nt, Homo sapiens
cuccagagaccccaggaacaa

SEQ ID NO: 588068 - RNA, 21 nt, Homo sapiens
cuccagagggccuucccugac

SEQ ID NO: 588069 - RNA, 14 nt, Homo sapiens
cuccagauguuaau

SEQ ID NO: 588070 - RNA, 14 nt, Homo sapiens
cuccagauucugau

SEQ ID NO: 588071 - RNA, 15 nt, Homo sapiens
cuccagcaccauaga

SEQ ID NO: 588072 - RNA, 13 nt, Homo sapiens
cuccagcccuuca

SEQ ID NO: 588073 - RNA, 23 nt, Homo sapiens
cuccagccucccugucuccagcu

SEQ ID NO: 588074 - RNA, 21 nt, Homo sapiens
cuccagccugggggacagaaa

SEQ ID NO: 588075 - RNA, 22 nt, Homo sapiens
cuccagcugggagacacagcaa

SEQ ID NO: 588076 - RNA, 21 nt, Homo sapiens
cuccagcuuuuccucagggug

SEQ ID NO: 588077 - RNA, 15 nt, Homo sapiens
cuccaggaaugaucu

SEQ ID NO: 588078 - RNA, 20 nt, Homo sapiens
cuccaggaugaguuacuuga

SEQ ID NO: 588079 - RNA, 19 nt, Homo sapiens
cuccaggcagcagacacau

SEQ ID NO: 588080 - RNA, 19 nt, Homo sapiens
cuccaggccaugauggccu

SEQ ID NO: 588081 - RNA, 14 nt, Homo sapiens
cuccaggcucuuug

SEQ ID NO: 588082 - RNA, 16 nt, Homo sapiens
cuccagggacaaagag

SEQ ID NO: 588083 - RNA, 19 nt, Homo sapiens
cuccaggggcagggccuug

SEQ ID NO: 588084 - RNA, 19 nt, Homo sapiens
cuccaggguggcagcaaca

SEQ ID NO: 588085 - RNA, 23 nt, Homo sapiens
cuccaggguggcagcaacaauaa

SEQ ID NO: 588086 - RNA, 22 nt, Homo sapiens
cuccagguggcucugaggugcc

SEQ ID NO: 588087 - RNA, 23 nt, Homo sapiens
cuccaguauaugcugauggacca

SEQ ID NO: 588088 - RNA, 15 nt, Homo sapiens
cuccaguaucuccaa

SEQ ID NO: 588089 - RNA, 23 nt, Homo sapiens
cuccagucucaucuaugucauau

SEQ ID NO: 588090 - RNA, 18 nt, Homo sapiens
cuccagucuggcaacaga

SEQ ID NO: 588091 - RNA, 12 nt, Homo sapiens
cuccagugcagg

SEQ ID NO: 588092 - RNA, 19 nt, Homo sapiens
cuccaguuuuuuguuauau

SEQ ID NO: 588093 - RNA, 20 nt, Homo sapiens
cuccauaaacagacuguuaa

SEQ ID NO: 588094 - RNA, 15 nt, Homo sapiens
cuccauaaacaugaa

SEQ ID NO: 588095 - RNA, 17 nt, Homo sapiens
cuccauacauaacuuga

SEQ ID NO: 588096 - RNA, 23 nt, Homo sapiens
cuccauaccugccccugccugac

SEQ ID NO: 588097 - RNA, 14 nt, Homo sapiens
cuccauaucugauu

SEQ ID NO: 588098 - RNA, 17 nt, Homo sapiens
cuccaucucucauccuc

SEQ ID NO: 588099 - RNA, 22 nt, Homo sapiens
cuccaucuuauuuucauguaua

SEQ ID NO: 588100 - RNA, 22 nt, Homo sapiens
cuccaucuuuauagaaggaauu

SEQ ID NO: 588101 - RNA, 20 nt, Homo sapiens
cuccaugaauuaguucuccu

SEQ ID NO: 588102 - RNA, 16 nt, Homo sapiens
cuccaugagacacauc

SEQ ID NO: 588103 - RNA, 19 nt, Homo sapiens
cuccauguauauauucuuc

SEQ ID NO: 588104 - RNA, 15 nt, Homo sapiens
cuccauuuaccagua

SEQ ID NO: 588105 - RNA, 15 nt, Homo sapiens
cuccauuugagaaaa

SEQ ID NO: 588106 - RNA, 14 nt, Homo sapiens
cuccauuuuagccc

SEQ ID NO: 588107 - RNA, 19 nt, Homo sapiens
cucccaaaaaacuacuucu

SEQ ID NO: 588108 - RNA, 15 nt, Homo sapiens
cucccaaaguaccuu

SEQ ID NO: 588109 - RNA, 16 nt, Homo sapiens
cucccaaagugcuagu

SEQ ID NO: 588110 - RNA, 16 nt, Homo sapiens
cucccaacccauucac

SEQ ID NO: 588111 - RNA, 14 nt, Homo sapiens
cucccaagcguucc

SEQ ID NO: 588112 - RNA, 14 nt, Homo sapiens
cucccaagguccuc

SEQ ID NO: 588113 - RNA, 14 nt, Homo sapiens
cucccacaaaggag

SEQ ID NO: 588114 - RNA, 17 nt, Homo sapiens
cucccacaaugcugaau

SEQ ID NO: 588115 - RNA, 14 nt, Homo sapiens
cucccacacugaaa

SEQ ID NO: 588116 - RNA, 19 nt, Homo sapiens
cucccacacugaaaccaaa

SEQ ID NO: 588117 - RNA, 19 nt, Homo sapiens
cucccacacuugugccagc

SEQ ID NO: 588118 - RNA, 12 nt, Homo sapiens
cucccacagaac

SEQ ID NO: 588119 - RNA, 13 nt, Homo sapiens
cucccacagcuuc

SEQ ID NO: 588120 - RNA, 22 nt, Homo sapiens
cucccacauugucaccauuuca

SEQ ID NO: 588121 - RNA, 20 nt, Homo sapiens
cucccacugucugcccugaa

SEQ ID NO: 588122 - RNA, 12 nt, Homo sapiens
cucccacuuccu

SEQ ID NO: 588123 - RNA, 22 nt, Homo sapiens
cucccagaggagccaccaguuc

SEQ ID NO: 588124 - RNA, 20 nt, Homo sapiens
cucccagagugcugggauua

SEQ ID NO: 588125 - RNA, 12 nt, Homo sapiens
cucccagcauag

SEQ ID NO: 588126 - RNA, 15 nt, Homo sapiens
cucccagcauaggau

SEQ ID NO: 588127 - RNA, 23 nt, Homo sapiens
cucccagcuccuuucuccuguga

SEQ ID NO: 588128 - RNA, 19 nt, Homo sapiens
cucccaggcuggagugcag

SEQ ID NO: 588129 - RNA, 12 nt, Homo sapiens
cucccaguacua

SEQ ID NO: 588130 - RNA, 21 nt, Homo sapiens
cucccaguccauuuccaaaug

SEQ ID NO: 588131 - RNA, 11 nt, Homo sapiens
cucccagugac

SEQ ID NO: 588132 - RNA, 22 nt, Homo sapiens
cucccagugaccccugaccuca

SEQ ID NO: 588133 - RNA, 16 nt, Homo sapiens
cucccaguucuacaag

SEQ ID NO: 588134 - RNA, 21 nt, Homo sapiens
cucccauccuugaugcaagug

SEQ ID NO: 588135 - RNA, 23 nt, Homo sapiens
cucccaucuccuuaccucuggaa

SEQ ID NO: 588136 - RNA, 15 nt, Homo sapiens
cucccaugggcugag

SEQ ID NO: 588137 - RNA, 16 nt, Homo sapiens
cucccauuacuuugau

SEQ ID NO: 588138 - RNA, 13 nt, Homo sapiens
cuccccaauccag

SEQ ID NO: 588139 - RNA, 15 nt, Homo sapiens
cuccccacucuaggg

SEQ ID NO: 588140 - RNA, 15 nt, Homo sapiens
cuccccacugcucau

SEQ ID NO: 588141 - RNA, 14 nt, Homo sapiens
cuccccagagcacu

SEQ ID NO: 588142 - RNA, 12 nt, Homo sapiens
cuccccauggag

SEQ ID NO: 588143 - RNA, 15 nt, Homo sapiens
cucccccaacacaaa

SEQ ID NO: 588144 - RNA, 19 nt, Homo sapiens
cucccccacugcaccccaa

SEQ ID NO: 588145 - RNA, 17 nt, Homo sapiens
cucccccugccagugcc

SEQ ID NO: 588146 - RNA, 16 nt, Homo sapiens
cuccccgagggcucag

SEQ ID NO: 588147 - RNA, 15 nt, Homo sapiens
cuccccggcacuucc

SEQ ID NO: 588148 - RNA, 20 nt, Homo sapiens
cuccccggcaggccugagaa

SEQ ID NO: 588149 - RNA, 14 nt, Homo sapiens
cuccccgucccugu

SEQ ID NO: 588150 - RNA, 18 nt, Homo sapiens
cuccccugccacacugau

SEQ ID NO: 588151 - RNA, 17 nt, Homo sapiens
cuccccugcccuggucc

SEQ ID NO: 588152 - RNA, 15 nt, Homo sapiens
cuccccuguaccuuu

SEQ ID NO: 588153 - RNA, 17 nt, Homo sapiens
cuccccuucccugggga

SEQ ID NO: 588154 - RNA, 22 nt, Homo sapiens
cuccccuuuuauaccugcucuu

SEQ ID NO: 588155 - RNA, 19 nt, Homo sapiens
cucccgaguagcugggauu

SEQ ID NO: 588156 - RNA, 16 nt, Homo sapiens
cucccgccacauuuua

SEQ ID NO: 588157 - RNA, 14 nt, Homo sapiens
cucccuacauuccc

SEQ ID NO: 588158 - RNA, 15 nt, Homo sapiens
cucccuacauucccc

SEQ ID NO: 588159 - RNA, 20 nt, Homo sapiens
cucccuacccaaugucuccc

SEQ ID NO: 588160 - RNA, 16 nt, Homo sapiens
cucccuaggagaccaa

SEQ ID NO: 588161 - RNA, 20 nt, Homo sapiens
cucccuaguagcugggauua

SEQ ID NO: 588162 - RNA, 15 nt, Homo sapiens
cucccucacccugag

SEQ ID NO: 588163 - RNA, 15 nt, Homo sapiens
cucccucagcucucu

SEQ ID NO: 588164 - RNA, 12 nt, Homo sapiens
cucccucggggg

SEQ ID NO: 588165 - RNA, 17 nt, Homo sapiens
cucccucuccauaucuc

SEQ ID NO: 588166 - RNA, 16 nt, Homo sapiens
cucccucuuucuuccc

SEQ ID NO: 588167 - RNA, 16 nt, Homo sapiens
cucccugaaacacugc

SEQ ID NO: 588168 - RNA, 23 nt, Homo sapiens
cucccugcagaugccacccuagc

SEQ ID NO: 588169 - RNA, 12 nt, Homo sapiens
cucccugcaguc

SEQ ID NO: 588170 - RNA, 21 nt, Homo sapiens
cucccugcgaggaggggagaa

SEQ ID NO: 588171 - RNA, 19 nt, Homo sapiens
cucccugcugugugacuuu

SEQ ID NO: 588172 - RNA, 14 nt, Homo sapiens
cucccuggcacuga

SEQ ID NO: 588173 - RNA, 15 nt, Homo sapiens
caggguuucucugca

SEQ ID NO: 588174 - RNA, 15 nt, Homo sapiens
cagguaaugagggac

SEQ ID NO: 588175 - RNA, 23 nt, Homo sapiens
cagguaccaucuuguauacacau

SEQ ID NO: 588176 - RNA, 21 nt, Homo sapiens
cagguaggucggcacuuggac

SEQ ID NO: 588177 - RNA, 19 nt, Homo sapiens
cagguaguauuacaccacc

SEQ ID NO: 588178 - RNA, 21 nt, Homo sapiens
caggucaacuucagagacuau

SEQ ID NO: 588179 - RNA, 16 nt, Homo sapiens
caggucaguuguaaua

SEQ ID NO: 588180 - RNA, 20 nt, Homo sapiens
cagguccaccgagccccuga

SEQ ID NO: 588181 - RNA, 12 nt, Homo sapiens
cagguccuccau

SEQ ID NO: 588182 - RNA, 15 nt, Homo sapiens
caggucuagacuuuc

SEQ ID NO: 588183 - RNA, 19 nt, Homo sapiens
caggucucuuccuuugcuc

SEQ ID NO: 588184 - RNA, 21 nt, Homo sapiens
caggucucuuccuuugcucug

SEQ ID NO: 588185 - RNA, 14 nt, Homo sapiens
caggucugggcaag

SEQ ID NO: 588186 - RNA, 15 nt, Homo sapiens
caggucuugacucau

SEQ ID NO: 588187 - RNA, 17 nt, Homo sapiens
caggugaaaaggguaca

SEQ ID NO: 588188 - RNA, 13 nt, Homo sapiens
caggugacaugaa

SEQ ID NO: 588189 - RNA, 13 nt, Homo sapiens
caggugaccuccc

SEQ ID NO: 588190 - RNA, 14 nt, Homo sapiens
caggugagcaauua

SEQ ID NO: 588191 - RNA, 18 nt, Homo sapiens
caggugauccgccuaccu

SEQ ID NO: 588192 - RNA, 11 nt, Homo sapiens
caggugcaaaa

SEQ ID NO: 588193 - RNA, 22 nt, Homo sapiens
caggugccaucacgcuugugau

SEQ ID NO: 588194 - RNA, 16 nt, Homo sapiens
caggugccuucccaga

SEQ ID NO: 588195 - RNA, 17 nt, Homo sapiens
caggugccuucccagac

SEQ ID NO: 588196 - RNA, 17 nt, Homo sapiens
caggugcgguuccucau

SEQ ID NO: 588197 - RNA, 17 nt, Homo sapiens
cagguggcucagugcca

SEQ ID NO: 588198 - RNA, 13 nt, Homo sapiens
caggugggcugua

SEQ ID NO: 588199 - RNA, 23 nt, Homo sapiens
caggugggugguggcucuuaagg

SEQ ID NO: 588200 - RNA, 19 nt, Homo sapiens
caggugguaagcaccagga

SEQ ID NO: 588201 - RNA, 17 nt, Homo sapiens
caggugguccugagacc

SEQ ID NO: 588202 - RNA, 13 nt, Homo sapiens
caggugguugugg

SEQ ID NO: 588203 - RNA, 17 nt, Homo sapiens
caggugugguugcucac

SEQ ID NO: 588204 - RNA, 15 nt, Homo sapiens
cagguguguauuuac

SEQ ID NO: 588205 - RNA, 15 nt, Homo sapiens
caggugugugugaac

SEQ ID NO: 588206 - RNA, 22 nt, Homo sapiens
cagguguucuacacucaucuua

SEQ ID NO: 588207 - RNA, 14 nt, Homo sapiens
cagguucagguguu

SEQ ID NO: 588208 - RNA, 22 nt, Homo sapiens
cagguucaugccaccauggcca

SEQ ID NO: 588209 - RNA, 19 nt, Homo sapiens
cagguuccuuaucugucac

SEQ ID NO: 588210 - RNA, 17 nt, Homo sapiens
caccuguagcugaagca

SEQ ID NO: 588211 - RNA, 16 nt, Homo sapiens
caccuuaagaagucua

SEQ ID NO: 588212 - RNA, 14 nt, Homo sapiens
caccuuaauaugcu

SEQ ID NO: 588213 - RNA, 16 nt, Homo sapiens
caccuucaaaauguuc

SEQ ID NO: 588214 - RNA, 16 nt, Homo sapiens
caccuucaagcagcug

SEQ ID NO: 588215 - RNA, 19 nt, Homo sapiens
caccuucagaggcugaggu

SEQ ID NO: 588216 - RNA, 20 nt, Homo sapiens
caccuuccuaauaugcuuua

SEQ ID NO: 588217 - RNA, 21 nt, Homo sapiens
caccuugccacccauucuucc

SEQ ID NO: 588218 - RNA, 17 nt, Homo sapiens
caccuugccuugcuguu

SEQ ID NO: 588219 - RNA, 13 nt, Homo sapiens
caccuugcugugu

SEQ ID NO: 588220 - RNA, 16 nt, Homo sapiens
caccuuggaauucgcu

SEQ ID NO: 588221 - RNA, 20 nt, Homo sapiens
caccuuggaauucgcuuucu

SEQ ID NO: 588222 - RNA, 14 nt, Homo sapiens
caccuugucaugua

SEQ ID NO: 588223 - RNA, 21 nt, Homo sapiens
caccuuuggugcagagguuuc

SEQ ID NO: 588224 - RNA, 14 nt, Homo sapiens
caccuuuuaacuca

SEQ ID NO: 588225 - RNA, 21 nt, Homo sapiens
caccuuuuccccaaccacaga

SEQ ID NO: 588226 - RNA, 21 nt, Homo sapiens
cacgaaacuuguuauugugaa

SEQ ID NO: 588227 - RNA, 21 nt, Homo sapiens
cacgaaaugggccauuccagu

SEQ ID NO: 588228 - RNA, 12 nt, Homo sapiens
cacgaagcaauu

SEQ ID NO: 588229 - RNA, 17 nt, Homo sapiens
cacgacucuuccugcaa

SEQ ID NO: 588230 - RNA, 12 nt, Homo sapiens
cacgagaucaag

SEQ ID NO: 588231 - RNA, 18 nt, Homo sapiens
cacgauugagaacugaca

SEQ ID NO: 588232 - RNA, 15 nt, Homo sapiens
cacgauuggagaaua

SEQ ID NO: 588233 - RNA, 20 nt, Homo sapiens
cacgcacacacacaaacaca

SEQ ID NO: 588234 - RNA, 19 nt, Homo sapiens
cacgcaccuguagucccag

SEQ ID NO: 588235 - RNA, 17 nt, Homo sapiens
cacgcaugugugcugca

SEQ ID NO: 588236 - RNA, 14 nt, Homo sapiens
cacgccaacagccc

SEQ ID NO: 588237 - RNA, 13 nt, Homo sapiens
cacgccuacuuaa

SEQ ID NO: 588238 - RNA, 15 nt, Homo sapiens
cacgccuacuuaaga

SEQ ID NO: 588239 - RNA, 17 nt, Homo sapiens
cacgccugcaggcugga

SEQ ID NO: 588240 - RNA, 16 nt, Homo sapiens
cacgccuguaauccca

SEQ ID NO: 588241 - RNA, 22 nt, Homo sapiens
cacgccuguauucccacaccag

SEQ ID NO: 588242 - RNA, 15 nt, Homo sapiens
cacgcucgcugccau

SEQ ID NO: 588243 - RNA, 16 nt, Homo sapiens
cacgcucgcugccauc

SEQ ID NO: 588244 - RNA, 17 nt, Homo sapiens
cacgcucgcugccauca

SEQ ID NO: 588245 - RNA, 12 nt, Homo sapiens
cacgcuuucaug

SEQ ID NO: 588246 - RNA, 18 nt, Homo sapiens
cacgcuuuuugaaaaagc

SEQ ID NO: 588247 - RNA, 18 nt, Homo sapiens
cacggaugacuuaacugc

SEQ ID NO: 588248 - RNA, 19 nt, Homo sapiens
cacggcagcuguagcuccc

SEQ ID NO: 588249 - RNA, 20 nt, Homo sapiens
cacggccacauuugguucua

SEQ ID NO: 588250 - RNA, 19 nt, Homo sapiens
cacggccaccacugcagcc

SEQ ID NO: 588251 - RNA, 21 nt, Homo sapiens
cacggccuguacggacacugu

SEQ ID NO: 588252 - RNA, 23 nt, Homo sapiens
cacggugcccaaacaccagucac

SEQ ID NO: 588253 - RNA, 16 nt, Homo sapiens
cacgguggcggcugca

SEQ ID NO: 588254 - RNA, 21 nt, Homo sapiens
cacguaugguggcucaugucu

SEQ ID NO: 588255 - RNA, 15 nt, Homo sapiens
cacgucuugcuauuu

SEQ ID NO: 588256 - RNA, 12 nt, Homo sapiens
cacgucuuuucu

SEQ ID NO: 588257 - RNA, 20 nt, Homo sapiens
cacgucuuuucucauaucau

SEQ ID NO: 588258 - RNA, 16 nt, Homo sapiens
cacagauaaaguuuuc

SEQ ID NO: 588259 - RNA, 12 nt, Homo sapiens
cacagauaagua

SEQ ID NO: 588260 - RNA, 21 nt, Homo sapiens
cacagauaccucaucauccac

SEQ ID NO: 588261 - RNA, 17 nt, Homo sapiens
cacagauauuguuauaa

SEQ ID NO: 588262 - RNA, 17 nt, Homo sapiens
cacagaugauacuucca

SEQ ID NO: 588263 - RNA, 16 nt, Homo sapiens
cacagaugaugaagaa

SEQ ID NO: 588264 - RNA, 21 nt, Homo sapiens
cacagaugaugaagaaaugau

SEQ ID NO: 588265 - RNA, 22 nt, Homo sapiens
cacagauguuugaggcuuucag

SEQ ID NO: 588266 - RNA, 13 nt, Homo sapiens
cacagauuaucaa

SEQ ID NO: 588267 - RNA, 22 nt, Homo sapiens
cacagauuccuggcagagccau

SEQ ID NO: 588268 - RNA, 19 nt, Homo sapiens
cacagauuuccucucuaaa

SEQ ID NO: 588269 - RNA, 15 nt, Homo sapiens
cacagcaacaaugac

SEQ ID NO: 588270 - RNA, 17 nt, Homo sapiens
cacagcaacaaugacuu

SEQ ID NO: 588271 - RNA, 15 nt, Homo sapiens
cacagcaacuauaua

SEQ ID NO: 588272 - RNA, 17 nt, Homo sapiens
cacagcaagaugaauuu

SEQ ID NO: 588273 - RNA, 22 nt, Homo sapiens
cacagcaaggaaauguccugca

SEQ ID NO: 588274 - RNA, 22 nt, Homo sapiens
cacagcagguccuccaucccaa

SEQ ID NO: 588275 - RNA, 18 nt, Homo sapiens
cacagcaucauuuugcau

SEQ ID NO: 588276 - RNA, 23 nt, Homo sapiens
cacagcaucgggagcacccagag

SEQ ID NO: 588277 - RNA, 16 nt, Homo sapiens
cacagcaugugccaag

SEQ ID NO: 588278 - RNA, 18 nt, Homo sapiens
cacagcauguguauuucc

SEQ ID NO: 588279 - RNA, 18 nt, Homo sapiens
cacagcccagaaccacag

SEQ ID NO: 588280 - RNA, 17 nt, Homo sapiens
cacagcccgggugugcc

SEQ ID NO: 588281 - RNA, 15 nt, Homo sapiens
cacagccuagcacag

SEQ ID NO: 588282 - RNA, 20 nt, Homo sapiens
cacagccuuggaucaggaca

SEQ ID NO: 588283 - RNA, 17 nt, Homo sapiens
cacagcgcuaugcaauu

SEQ ID NO: 588284 - RNA, 18 nt, Homo sapiens
cacagcucaacucggggg

SEQ ID NO: 588285 - RNA, 20 nt, Homo sapiens
cacagcugaacuuguugaga

SEQ ID NO: 588286 - RNA, 15 nt, Homo sapiens
cacagcugcauuaaa

SEQ ID NO: 588287 - RNA, 16 nt, Homo sapiens
cacagcugcuggagaa

SEQ ID NO: 588288 - RNA, 17 nt, Homo sapiens
cacagcuggcucugaca

SEQ ID NO: 588289 - RNA, 22 nt, Homo sapiens
cacagcuguaguaccccaagaa

SEQ ID NO: 588290 - RNA, 18 nt, Homo sapiens
cacagcuuagauuucaua

SEQ ID NO: 588291 - RNA, 17 nt, Homo sapiens
cacagcuuauuauccaa

SEQ ID NO: 588292 - RNA, 18 nt, Homo sapiens
cacagcuucucuacagac

SEQ ID NO: 588293 - RNA, 22 nt, Homo sapiens
cacagcuucucuacagacucca

SEQ ID NO: 588294 - RNA, 12 nt, Homo sapiens
cacagcuuuaug

SEQ ID NO: 588295 - RNA, 13 nt, Homo sapiens
cacagcuuuauga

SEQ ID NO: 588296 - RNA, 19 nt, Homo sapiens
cacaggacugaaaagggaa

SEQ ID NO: 588297 - RNA, 23 nt, Homo sapiens
cacaggagauuccagucuacuug

SEQ ID NO: 588298 - RNA, 23 nt, Homo sapiens
cacaggauauuuuggggggcaga

SEQ ID NO: 588299 - RNA, 13 nt, Homo sapiens
cacaggaugcugg

SEQ ID NO: 588300 - RNA, 18 nt, Homo sapiens
cacaggcaaaacucagua

SEQ ID NO: 588301 - RNA, 13 nt, Homo sapiens
cacaggcaaagau

SEQ ID NO: 588302 - RNA, 22 nt, Homo sapiens
cacaggcagcuggaugagacuu

SEQ ID NO: 588303 - RNA, 23 nt, Homo sapiens
cacaggcccuggcugaggucucu

SEQ ID NO: 588304 - RNA, 17 nt, Homo sapiens
cacaggccuguucccuu

SEQ ID NO: 588305 - RNA, 15 nt, Homo sapiens
cacagggacugaaaa

SEQ ID NO: 588306 - RNA, 13 nt, Homo sapiens
cacaggggcccca

SEQ ID NO: 588307 - RNA, 15 nt, Homo sapiens
cacaggggcccugua

SEQ ID NO: 588308 - RNA, 21 nt, Homo sapiens
cacagggguucccuucucuca

SEQ ID NO: 588309 - RNA, 23 nt, Homo sapiens
cacaggguuuuguauucuuuacu

SEQ ID NO: 588310 - RNA, 13 nt, Homo sapiens
cacaggugacaag

SEQ ID NO: 588311 - RNA, 19 nt, Homo sapiens
cacaguaaugcaagcaaag

SEQ ID NO: 588312 - RNA, 20 nt, Homo sapiens
cacagucacugauguacaau

SEQ ID NO: 588313 - RNA, 15 nt, Homo sapiens
cacagucuuggguuu

SEQ ID NO: 588314 - RNA, 11 nt, Homo sapiens
cacagugcagu

SEQ ID NO: 588315 - RNA, 16 nt, Homo sapiens
cacagugcugccccuu

SEQ ID NO: 588316 - RNA, 20 nt, Homo sapiens
cacaguggcaaaacaaaagu

SEQ ID NO: 588317 - RNA, 24 nt, Homo sapiens
cacaguggguggugaguucugacu

SEQ ID NO: 588318 - RNA, 23 nt, Homo sapiens
cacagugguucguuuaccaaaua

SEQ ID NO: 588319 - RNA, 13 nt, Homo sapiens
cacagugucacug

SEQ ID NO: 588320 - RNA, 22 nt, Homo sapiens
cacaguuuuaauaagaacagau

SEQ ID NO: 588321 - RNA, 16 nt, Homo sapiens
cacauaacaugcuuua

SEQ ID NO: 588322 - RNA, 23 nt, Homo sapiens
cacauaagccaaaacugagcaua

SEQ ID NO: 588323 - RNA, 19 nt, Homo sapiens
cacauaagcccaguucauc

SEQ ID NO: 588324 - RNA, 21 nt, Homo sapiens
cacauaauuuugugcaugaaa

SEQ ID NO: 588325 - RNA, 21 nt, Homo sapiens
cacauaauuuuuguacauccc

SEQ ID NO: 588326 - RNA, 13 nt, Homo sapiens
cacauacaaauca

SEQ ID NO: 588327 - RNA, 17 nt, Homo sapiens
cacauacauacacauac

SEQ ID NO: 588328 - RNA, 12 nt, Homo sapiens
cacauaccuuca

SEQ ID NO: 588329 - RNA, 14 nt, Homo sapiens
cacauacgugcaca

SEQ ID NO: 588330 - RNA, 15 nt, Homo sapiens
cacauacgugcacag

SEQ ID NO: 588331 - RNA, 22 nt, Homo sapiens
cacauagcgccgugcuguaaau

SEQ ID NO: 588332 - RNA, 21 nt, Homo sapiens
cacauaggaaaaugccaugaa

SEQ ID NO: 588333 - RNA, 15 nt, Homo sapiens
cacauaggcuggugg

SEQ ID NO: 588334 - RNA, 17 nt, Homo sapiens
cacauagguaaaaacug

SEQ ID NO: 588335 - RNA, 16 nt, Homo sapiens
cacauaguguccugcc

SEQ ID NO: 588336 - RNA, 22 nt, Homo sapiens
cacauauaucaaagugagaaaa

SEQ ID NO: 588337 - RNA, 18 nt, Homo sapiens
cacaucaagacuaucuac

SEQ ID NO: 588338 - RNA, 11 nt, Homo sapiens
cacaucaccuc

SEQ ID NO: 588339 - RNA, 21 nt, Homo sapiens
cacaucccauugggacuccau

SEQ ID NO: 588340 - RNA, 23 nt, Homo sapiens
cacaucccuggaaggacauccau

SEQ ID NO: 588341 - RNA, 17 nt, Homo sapiens
cacauccugaccuugca

SEQ ID NO: 588342 - RNA, 11 nt, Homo sapiens
cacaucuccag

SEQ ID NO: 588343 - RNA, 19 nt, Homo sapiens
cacaucucguauaauauuc

SEQ ID NO: 588344 - RNA, 20 nt, Homo sapiens
cacaucucguauaauauuca

SEQ ID NO: 588345 - RNA, 21 nt, Homo sapiens
cacaucucguauaauauucac

SEQ ID NO: 588346 - RNA, 13 nt, Homo sapiens
cacaucugcauuu

SEQ ID NO: 588347 - RNA, 15 nt, Homo sapiens
cacaucuuaaauuca

SEQ ID NO: 588348 - RNA, 13 nt, Homo sapiens
cacaucuuaccuc

SEQ ID NO: 588349 - RNA, 16 nt, Homo sapiens
cacaugaauauaaaug

SEQ ID NO: 588350 - RNA, 19 nt, Homo sapiens
cacaugacaacuuugccag

SEQ ID NO: 588351 - RNA, 14 nt, Homo sapiens
cacaugaggccauc

SEQ ID NO: 588352 - RNA, 11 nt, Homo sapiens
cacaugcacag

SEQ ID NO: 588353 - RNA, 13 nt, Homo sapiens
cacaugcccauga

SEQ ID NO: 588354 - RNA, 12 nt, Homo sapiens
cacaugcugucu

SEQ ID NO: 588355 - RNA, 22 nt, Homo sapiens
cacaugggcagaaaaauggugg

SEQ ID NO: 588356 - RNA, 16 nt, Homo sapiens
cacaugucuguccuca

SEQ ID NO: 588357 - RNA, 18 nt, Homo sapiens
cacauuaaauguggaagg

SEQ ID NO: 588358 - RNA, 15 nt, Homo sapiens
cacauuaacucccuc

SEQ ID NO: 588359 - RNA, 23 nt, Homo sapiens
cacauuaacucccuccaccagcc

SEQ ID NO: 588360 - RNA, 22 nt, Homo sapiens
cacauuaucaguugacagugua

SEQ ID NO: 588361 - RNA, 19 nt, Homo sapiens
cacauucaugugggcauuu

SEQ ID NO: 588362 - RNA, 23 nt, Homo sapiens
cacauucuguuuaucaagccaua

SEQ ID NO: 588363 - RNA, 23 nt, Homo sapiens
cacauucuuaacacauguccuug

SEQ ID NO: 588364 - RNA, 23 nt, Homo sapiens
cacauugauguaaggacuguaaa

SEQ ID NO: 588365 - RNA, 13 nt, Homo sapiens
cacauuguacuua

SEQ ID NO: 588366 - RNA, 14 nt, Homo sapiens
cacauuguacuuaa

SEQ ID NO: 588367 - RNA, 21 nt, Homo sapiens
cacauuuagauccugguuuca

SEQ ID NO: 588368 - RNA, 19 nt, Homo sapiens
cacauuugaauucuugauc

SEQ ID NO: 588369 - RNA, 21 nt, Homo sapiens
cacauuugaauucuugaucuc

SEQ ID NO: 588370 - RNA, 12 nt, Homo sapiens
cacauuugccca

SEQ ID NO: 588371 - RNA, 23 nt, Homo sapiens
cacauuugucaguauuuuugccg

SEQ ID NO: 588372 - RNA, 22 nt, Homo sapiens
cacauuuuaccaauaugcauuu

SEQ ID NO: 588373 - RNA, 13 nt, Homo sapiens
caccaaagcuggc

SEQ ID NO: 588374 - RNA, 18 nt, Homo sapiens
caccaaaucuauuugaaa

SEQ ID NO: 588375 - RNA, 16 nt, Homo sapiens
caccaaccuccagugu

SEQ ID NO: 588376 - RNA, 15 nt, Homo sapiens
caccaaccugcauuu

SEQ ID NO: 588377 - RNA, 20 nt, Homo sapiens
caccaagcagcaacagcaaa

SEQ ID NO: 588378 - RNA, 17 nt, Homo sapiens
caccaagcuaggugcua

SEQ ID NO: 588379 - RNA, 20 nt, Homo sapiens
caccaaggaacucuacuuca

SEQ ID NO: 588380 - RNA, 15 nt, Homo sapiens
caccaaguaccagua

SEQ ID NO: 588381 - RNA, 22 nt, Homo sapiens
caccaaguaccaguauaagcau

SEQ ID NO: 588382 - RNA, 15 nt, Homo sapiens
caccaaguuaccuac

SEQ ID NO: 588383 - RNA, 21 nt, Homo sapiens
caccaauuccaccaagacagu

SEQ ID NO: 588384 - RNA, 20 nt, Homo sapiens
caccaauucuaaaguagcuu

SEQ ID NO: 588385 - RNA, 11 nt, Homo sapiens
caccaccaggg

SEQ ID NO: 588386 - RNA, 15 nt, Homo sapiens
caccacgacuggcca

SEQ ID NO: 588387 - RNA, 17 nt, Homo sapiens
caccacuaacaugcccu

SEQ ID NO: 588388 - RNA, 23 nt, Homo sapiens
caccacuaacaugcccuguucag

SEQ ID NO: 588389 - RNA, 21 nt, Homo sapiens
caccacuuauuuauuguugcc

SEQ ID NO: 588390 - RNA, 21 nt, Homo sapiens
caccacuuuacuuguguuaua

SEQ ID NO: 588391 - RNA, 15 nt, Homo sapiens
caccagaaccaguua

SEQ ID NO: 588392 - RNA, 18 nt, Homo sapiens
caccagaggcugcagaag

SEQ ID NO: 588393 - RNA, 21 nt, Homo sapiens
caccagaggcugcagaaggcc

SEQ ID NO: 588394 - RNA, 23 nt, Homo sapiens
caccagaggcugcagaaggccaa

SEQ ID NO: 588395 - RNA, 22 nt, Homo sapiens
caccagagggauaaaaacaaua

SEQ ID NO: 588396 - RNA, 21 nt, Homo sapiens
caccagaggucagguguucaa

SEQ ID NO: 588397 - RNA, 22 nt, Homo sapiens
caccagccccacuucuggguca

SEQ ID NO: 588398 - RNA, 12 nt, Homo sapiens
caccagcuccac

SEQ ID NO: 588399 - RNA, 23 nt, Homo sapiens
caccaggaaggaagcuguugcuu

SEQ ID NO: 588400 - RNA, 19 nt, Homo sapiens
caccaggacugaaagaaga

SEQ ID NO: 588401 - RNA, 22 nt, Homo sapiens
caccaggacuuggggucaggaa

SEQ ID NO: 588402 - RNA, 18 nt, Homo sapiens
caccaggccgugccuugu

SEQ ID NO: 588403 - RNA, 22 nt, Homo sapiens
caccagggaauacuauacagcc

SEQ ID NO: 588404 - RNA, 15 nt, Homo sapiens
caccagggacugcag

SEQ ID NO: 588405 - RNA, 18 nt, Homo sapiens
caccagggcaacucuugg

SEQ ID NO: 588406 - RNA, 15 nt, Homo sapiens
caccagucuguaaaa

SEQ ID NO: 588407 - RNA, 22 nt, Homo sapiens
caccaguguccccuccacuguc

SEQ ID NO: 588408 - RNA, 15 nt, Homo sapiens
caccaguuauuccuu

SEQ ID NO: 588409 - RNA, 20 nt, Homo sapiens
caccauacacacuguuguca

SEQ ID NO: 588410 - RNA, 16 nt, Homo sapiens
caccauccuauugcaa

SEQ ID NO: 588411 - RNA, 18 nt, Homo sapiens
caccaucguguuugcaaa

SEQ ID NO: 588412 - RNA, 15 nt, Homo sapiens
caccaucugauuaaa

SEQ ID NO: 588413 - RNA, 13 nt, Homo sapiens
caccaucuggaag

SEQ ID NO: 588414 - RNA, 20 nt, Homo sapiens
caccaugaugugaagaguuu

SEQ ID NO: 588415 - RNA, 23 nt, Homo sapiens
caccauggcaccuuuugcacaua

SEQ ID NO: 588416 - RNA, 16 nt, Homo sapiens
caccauguuagccuua

SEQ ID NO: 588417 - RNA, 15 nt, Homo sapiens
caccauguuggccag

SEQ ID NO: 588418 - RNA, 18 nt, Homo sapiens
caccauucgucaucacuc

SEQ ID NO: 588419 - RNA, 14 nt, Homo sapiens
cacccaaaagucaa

SEQ ID NO: 588420 - RNA, 16 nt, Homo sapiens
cacccaagaugaauua

SEQ ID NO: 588421 - RNA, 20 nt, Homo sapiens
cacccaagccugauccagcc

SEQ ID NO: 588422 - RNA, 17 nt, Homo sapiens
cacccaaguauuuuaaa

SEQ ID NO: 588423 - RNA, 16 nt, Homo sapiens
cacccaccuccaccca

SEQ ID NO: 588424 - RNA, 15 nt, Homo sapiens
cacccacgcauacac

SEQ ID NO: 588425 - RNA, 15 nt, Homo sapiens
cacccacgggugcua

SEQ ID NO: 588426 - RNA, 13 nt, Homo sapiens
cacccacucagga

SEQ ID NO: 588427 - RNA, 14 nt, Homo sapiens
cacccacuugguau

SEQ ID NO: 588428 - RNA, 17 nt, Homo sapiens
cacccaggugauuuccu

SEQ ID NO: 588429 - RNA, 16 nt, Homo sapiens
cacccagugacugaca

SEQ ID NO: 588430 - RNA, 16 nt, Homo sapiens
cacccaucuuccugcu

SEQ ID NO: 588431 - RNA, 21 nt, Homo sapiens
caccccaagagaacucgcgcu

SEQ ID NO: 588432 - RNA, 14 nt, Homo sapiens
caccccagagccau

SEQ ID NO: 588433 - RNA, 17 nt, Homo sapiens
caccccagagugggaga

SEQ ID NO: 588434 - RNA, 13 nt, Homo sapiens
cacccccauggaa

SEQ ID NO: 588435 - RNA, 23 nt, Homo sapiens
cacccccgcuuugguucuucaga

SEQ ID NO: 588436 - RNA, 21 nt, Homo sapiens
cacccccugcuccaccagcag

SEQ ID NO: 588437 - RNA, 18 nt, Homo sapiens
caccccgccugcccucau

SEQ ID NO: 588438 - RNA, 18 nt, Homo sapiens
caccccuacacugugaag

SEQ ID NO: 588439 - RNA, 12 nt, Homo sapiens
caccccuaccac

SEQ ID NO: 588440 - RNA, 18 nt, Homo sapiens
caccccuagcaugaacuu

SEQ ID NO: 588441 - RNA, 15 nt, Homo sapiens
caccccucccugcuu

SEQ ID NO: 588442 - RNA, 18 nt, Homo sapiens
caccccucccugcuugca

SEQ ID NO: 588443 - RNA, 12 nt, Homo sapiens
caccccugaguu

SEQ ID NO: 588444 - RNA, 23 nt, Homo sapiens
caccccugcccugguuccugucu

SEQ ID NO: 588445 - RNA, 18 nt, Homo sapiens
cacccgccgccucccacg

SEQ ID NO: 588446 - RNA, 13 nt, Homo sapiens
cacccgugagaaa

SEQ ID NO: 588447 - RNA, 17 nt, Homo sapiens
cacccuccaugcuccuc

SEQ ID NO: 588448 - RNA, 17 nt, Homo sapiens
cacccucuguccccacg

SEQ ID NO: 588449 - RNA, 15 nt, Homo sapiens
cacccugaaagcccu

SEQ ID NO: 588450 - RNA, 21 nt, Homo sapiens
cacccugccaagacuccucag

SEQ ID NO: 588451 - RNA, 23 nt, Homo sapiens
cacccuggaaucaagaugucaga

SEQ ID NO: 588452 - RNA, 16 nt, Homo sapiens
cacccuggaggauuuc

SEQ ID NO: 588453 - RNA, 22 nt, Homo sapiens
cacccugggcagugagugccau

SEQ ID NO: 588454 - RNA, 21 nt, Homo sapiens
cacccugggcuuccugagcca

SEQ ID NO: 588455 - RNA, 21 nt, Homo sapiens
cacccuggggcugcuuaggaa

SEQ ID NO: 588456 - RNA, 16 nt, Homo sapiens
cacccuucucauucca

SEQ ID NO: 588457 - RNA, 15 nt, Homo sapiens
caccgacaacaugcu

SEQ ID NO: 588458 - RNA, 12 nt, Homo sapiens
caccgacugccc

SEQ ID NO: 588459 - RNA, 16 nt, Homo sapiens
caccgcccuccuccac

SEQ ID NO: 588460 - RNA, 22 nt, Homo sapiens
caccggagaagaaccauuuaca

SEQ ID NO: 588461 - RNA, 14 nt, Homo sapiens
caccgguuaacugu

SEQ ID NO: 588462 - RNA, 18 nt, Homo sapiens
caccguacaucugcaaua

SEQ ID NO: 588463 - RNA, 19 nt, Homo sapiens
caccguccacguccacaag

SEQ ID NO: 588464 - RNA, 12 nt, Homo sapiens
caccgucuuccu

SEQ ID NO: 588465 - RNA, 12 nt, Homo sapiens
caccgucuuucu

SEQ ID NO: 588466 - RNA, 22 nt, Homo sapiens
caccuaccaucagggacaggau

SEQ ID NO: 588467 - RNA, 18 nt, Homo sapiens
caccuacgggggcaucug

SEQ ID NO: 588468 - RNA, 16 nt, Homo sapiens
caccuacuaugugcug

SEQ ID NO: 588469 - RNA, 20 nt, Homo sapiens
caccuagaaaggaacugcaa

SEQ ID NO: 588470 - RNA, 12 nt, Homo sapiens
caccuagccucg

SEQ ID NO: 588471 - RNA, 20 nt, Homo sapiens
caccucacaggccccaggaa

SEQ ID NO: 588472 - RNA, 21 nt, Homo sapiens
caccucaccucccgaagccac

SEQ ID NO: 588473 - RNA, 22 nt, Homo sapiens
caccucacgcucuggacaugau

SEQ ID NO: 588474 - RNA, 12 nt, Homo sapiens
caccucacugaa

SEQ ID NO: 588475 - RNA, 21 nt, Homo sapiens
caccucaugagucuaccugag

SEQ ID NO: 588476 - RNA, 19 nt, Homo sapiens
caccucauucugaacccuu

SEQ ID NO: 588477 - RNA, 18 nt, Homo sapiens
caccuccaccacaucugc

SEQ ID NO: 588478 - RNA, 19 nt, Homo sapiens
caccuccaccacaucugcc

SEQ ID NO: 588479 - RNA, 19 nt, Homo sapiens
caccuccagguucaaguga

SEQ ID NO: 588480 - RNA, 19 nt, Homo sapiens
caccucccauuacuuugau

SEQ ID NO: 588481 - RNA, 16 nt, Homo sapiens
caccucccccuaccca

SEQ ID NO: 588482 - RNA, 15 nt, Homo sapiens
caccuccuaccccuu

SEQ ID NO: 588483 - RNA, 22 nt, Homo sapiens
caccucuaaucuggauguuaag

SEQ ID NO: 588484 - RNA, 15 nt, Homo sapiens
caccucucccugacc

SEQ ID NO: 588485 - RNA, 16 nt, Homo sapiens
caccucugcacaagcu

SEQ ID NO: 588486 - RNA, 21 nt, Homo sapiens
caccucugugggcacuggugg

SEQ ID NO: 588487 - RNA, 14 nt, Homo sapiens
caccucuuccuuga

SEQ ID NO: 588488 - RNA, 17 nt, Homo sapiens
caccucuuccuugaugu

SEQ ID NO: 588489 - RNA, 22 nt, Homo sapiens
caccucuucucuuccuguaaca

SEQ ID NO: 588490 - RNA, 16 nt, Homo sapiens
caccugaaacacugga

SEQ ID NO: 588491 - RNA, 15 nt, Homo sapiens
caccugcaugugcug

SEQ ID NO: 588492 - RNA, 21 nt, Homo sapiens
caccugcggggccacccaucg

SEQ ID NO: 588493 - RNA, 17 nt, Homo sapiens
caccugcucacagggau

SEQ ID NO: 588494 - RNA, 14 nt, Homo sapiens
caccugcuccagaa

SEQ ID NO: 588495 - RNA, 23 nt, Homo sapiens
caccugcuccaggagguuugcag

SEQ ID NO: 588496 - RNA, 16 nt, Homo sapiens
caccugcuggagugaa

SEQ ID NO: 588497 - RNA, 17 nt, Homo sapiens
caccuggacacacacuc

SEQ ID NO: 588498 - RNA, 21 nt, Homo sapiens
caccuggcagggcucacacuc

SEQ ID NO: 588499 - RNA, 18 nt, Homo sapiens
caccuguaaaacuuuauu

SEQ ID NO: 588500 - RNA, 11 nt, Homo sapiens
caccuguaauc

SEQ ID NO: 588501 - RNA, 14 nt, Homo sapiens
caccuguaauccca

SEQ ID NO: 588502 - RNA, 12 nt, Homo sapiens
cauacugcagug

SEQ ID NO: 588503 - RNA, 13 nt, Homo sapiens
cauacugcuggag

SEQ ID NO: 588504 - RNA, 21 nt, Homo sapiens
cauacugcuggaguccagugc

SEQ ID NO: 588505 - RNA, 19 nt, Homo sapiens
cauagaaauuacacccaaa

SEQ ID NO: 588506 - RNA, 22 nt, Homo sapiens
cauagaaggaaguguguuugcc

SEQ ID NO: 588507 - RNA, 20 nt, Homo sapiens
cauagaaguguugagccaug

SEQ ID NO: 588508 - RNA, 15 nt, Homo sapiens
cauagacuccuuugc

SEQ ID NO: 588509 - RNA, 13 nt, Homo sapiens
cauagagacuuug

SEQ ID NO: 588510 - RNA, 20 nt, Homo sapiens
cauagauccuaagccauaaa

SEQ ID NO: 588511 - RNA, 16 nt, Homo sapiens
cauagauucaccugua

SEQ ID NO: 588512 - RNA, 22 nt, Homo sapiens
cauagauucaccuguaaaacuu

SEQ ID NO: 588513 - RNA, 17 nt, Homo sapiens
cauagcaagauugcuua

SEQ ID NO: 588514 - RNA, 18 nt, Homo sapiens
cauagcagaugguuucca

SEQ ID NO: 588515 - RNA, 14 nt, Homo sapiens
cauagcauagccag

SEQ ID NO: 588516 - RNA, 21 nt, Homo sapiens
cauagccauggaacccugcca

SEQ ID NO: 588517 - RNA, 20 nt, Homo sapiens
cauagcccucagacauuuau

SEQ ID NO: 588518 - RNA, 17 nt, Homo sapiens
cauagccgauucucugc

SEQ ID NO: 588519 - RNA, 19 nt, Homo sapiens
cauagccugccugaucccu

SEQ ID NO: 588520 - RNA, 15 nt, Homo sapiens
cauagcucacuguaa

SEQ ID NO: 588521 - RNA, 20 nt, Homo sapiens
cauaggaaaaugccaugaaa

SEQ ID NO: 588522 - RNA, 21 nt, Homo sapiens
cauaggcaaagcaaucaagca

SEQ ID NO: 588523 - RNA, 14 nt, Homo sapiens
cauaggccaugaaa

SEQ ID NO: 588524 - RNA, 22 nt, Homo sapiens
cauagggauugucccuguguug

SEQ ID NO: 588525 - RNA, 20 nt, Homo sapiens
cauaggggacugaggagcaa

SEQ ID NO: 588526 - RNA, 14 nt, Homo sapiens
cauagggggcugca

SEQ ID NO: 588527 - RNA, 13 nt, Homo sapiens
cauagggucugca

SEQ ID NO: 588528 - RNA, 15 nt, Homo sapiens
cauaggucacuggcu

SEQ ID NO: 588529 - RNA, 14 nt, Homo sapiens
cauaggucuguaug

SEQ ID NO: 588530 - RNA, 13 nt, Homo sapiens
cauaggugcaguu

SEQ ID NO: 588531 - RNA, 20 nt, Homo sapiens
cauagguuaaaaaaaaaagu

SEQ ID NO: 588532 - RNA, 16 nt, Homo sapiens
cauaguacuggcacaa

SEQ ID NO: 588533 - RNA, 23 nt, Homo sapiens
cauaguacuggcacaaaaacaca

SEQ ID NO: 588534 - RNA, 22 nt, Homo sapiens
cauagugaccaacauagugaaa

SEQ ID NO: 588535 - RNA, 18 nt, Homo sapiens
cauaguggagagaacuga

SEQ ID NO: 588536 - RNA, 20 nt, Homo sapiens
ccaguaaaugggggugcauu

SEQ ID NO: 588537 - RNA, 22 nt, Homo sapiens
ccaguacugggagauacagcca

SEQ ID NO: 588538 - RNA, 21 nt, Homo sapiens
ccaguagcugcccuuccugcc

SEQ ID NO: 588539 - RNA, 13 nt, Homo sapiens
ccaguaucgcuca

SEQ ID NO: 588540 - RNA, 22 nt, Homo sapiens
ccaguauucuaaaguuuugcaa

SEQ ID NO: 588541 - RNA, 17 nt, Homo sapiens
ccagucaccuucugggc

SEQ ID NO: 588542 - RNA, 15 nt, Homo sapiens
ccagucacugcugca

SEQ ID NO: 588543 - RNA, 15 nt, Homo sapiens
ccagucauuguacug

SEQ ID NO: 588544 - RNA, 16 nt, Homo sapiens
ccagucauuguacugu

SEQ ID NO: 588545 - RNA, 16 nt, Homo sapiens
ccagucccacacugug

SEQ ID NO: 588546 - RNA, 19 nt, Homo sapiens
ccaguccccagcccugggc

SEQ ID NO: 588547 - RNA, 15 nt, Homo sapiens
ccaguccucacuguc

SEQ ID NO: 588548 - RNA, 16 nt, Homo sapiens
ccagucgagaccucac

SEQ ID NO: 588549 - RNA, 22 nt, Homo sapiens
ccagucuauuuccacugaacaa

SEQ ID NO: 588550 - RNA, 23 nt, Homo sapiens
ccagucuauuuccacugaacaaa

SEQ ID NO: 588551 - RNA, 14 nt, Homo sapiens
ccagucucagacac

SEQ ID NO: 588552 - RNA, 14 nt, Homo sapiens
ccagucucuggcag

SEQ ID NO: 588553 - RNA, 20 nt, Homo sapiens
ccagucucuuguacagcguu

SEQ ID NO: 588554 - RNA, 18 nt, Homo sapiens
ccagucugucuacugugg

SEQ ID NO: 588555 - RNA, 16 nt, Homo sapiens
ccagugaaccaaagag

SEQ ID NO: 588556 - RNA, 14 nt, Homo sapiens
ccagugacaacauc

SEQ ID NO: 588557 - RNA, 20 nt, Homo sapiens
ccagugacacuaaaacaaga

SEQ ID NO: 588558 - RNA, 15 nt, Homo sapiens
ccagugagaagcuga

SEQ ID NO: 588559 - RNA, 19 nt, Homo sapiens
ccagugagauuacagagga

SEQ ID NO: 588560 - RNA, 19 nt, Homo sapiens
ccagugauccauguccuga

SEQ ID NO: 588561 - RNA, 18 nt, Homo sapiens
ccagugcaacagcacugg

SEQ ID NO: 588562 - RNA, 16 nt, Homo sapiens
ccagugcaguccauuu

SEQ ID NO: 588563 - RNA, 13 nt, Homo sapiens
ccagugccagcuc

SEQ ID NO: 588564 - RNA, 15 nt, Homo sapiens
ccagugcuccaggca

SEQ ID NO: 588565 - RNA, 14 nt, Homo sapiens
ccagugcugcugua

SEQ ID NO: 588566 - RNA, 17 nt, Homo sapiens
ccagugcuuuaauggca

SEQ ID NO: 588567 - RNA, 14 nt, Homo sapiens
ccaguggaugccac

SEQ ID NO: 588568 - RNA, 9 nt, Homo sapiens
ccagugggc

SEQ ID NO: 588569 - RNA, 20 nt, Homo sapiens
ccaguggggaaggaggccaa

SEQ ID NO: 588570 - RNA, 18 nt, Homo sapiens
ccagugguacuaagcaca

SEQ ID NO: 588571 - RNA, 19 nt, Homo sapiens
ccaguggugaagaaaacuc

SEQ ID NO: 588572 - RNA, 17 nt, Homo sapiens
ccaguguauaaauccaa

SEQ ID NO: 588573 - RNA, 18 nt, Homo sapiens
ccagugucaggguccagg

SEQ ID NO: 588574 - RNA, 23 nt, Homo sapiens
ccaguguccccuccacugucaca

SEQ ID NO: 588575 - RNA, 21 nt, Homo sapiens
ccagugugcaagggcagugaa

SEQ ID NO: 588576 - RNA, 16 nt, Homo sapiens
ccaguguggugucuug

SEQ ID NO: 588577 - RNA, 21 nt, Homo sapiens
ccaguguguguuuaacauuca

SEQ ID NO: 588578 - RNA, 22 nt, Homo sapiens
ccaguuaaagauuauugugacu

SEQ ID NO: 588579 - RNA, 15 nt, Homo sapiens
ccaguuacucaggag

SEQ ID NO: 588580 - RNA, 20 nt, Homo sapiens
ccaguucagcuuggugggag

SEQ ID NO: 588581 - RNA, 14 nt, Homo sapiens
ccaguucuacugac

SEQ ID NO: 588582 - RNA, 15 nt, Homo sapiens
ccaguucugcaaaga

SEQ ID NO: 588583 - RNA, 15 nt, Homo sapiens
ccaguucugucuuca

SEQ ID NO: 588584 - RNA, 11 nt, Homo sapiens
ccaguuugcac

SEQ ID NO: 588585 - RNA, 20 nt, Homo sapiens
ccaguuuucguuuuuucuaa

SEQ ID NO: 588586 - RNA, 18 nt, Homo sapiens
ccauaacccccugcccac

SEQ ID NO: 588587 - RNA, 14 nt, Homo sapiens
ccauaacugaacau

SEQ ID NO: 588588 - RNA, 14 nt, Homo sapiens
ccauaacuugaaaa

SEQ ID NO: 588589 - RNA, 22 nt, Homo sapiens
ccauaagccccucgcacucugg

SEQ ID NO: 588590 - RNA, 15 nt, Homo sapiens
ccauaaggccagaaa

SEQ ID NO: 588591 - RNA, 13 nt, Homo sapiens
ccauaaucaugua

SEQ ID NO: 588592 - RNA, 14 nt, Homo sapiens
ccauaauguuacau

SEQ ID NO: 588593 - RNA, 15 nt, Homo sapiens
ccauaauuauuauuu

SEQ ID NO: 588594 - RNA, 20 nt, Homo sapiens
ccauacacacuguugucaaa

SEQ ID NO: 588595 - RNA, 17 nt, Homo sapiens
ccauacugucucuggag

SEQ ID NO: 588596 - RNA, 20 nt, Homo sapiens
ccauagccaaccuguaguuu

SEQ ID NO: 588597 - RNA, 17 nt, Homo sapiens
ccauaggugagauucaa

SEQ ID NO: 588598 - RNA, 22 nt, Homo sapiens
ccauaguuuuguuuaauuugcu

SEQ ID NO: 588599 - RNA, 13 nt, Homo sapiens
ccauauaaaugaa

SEQ ID NO: 588600 - RNA, 20 nt, Homo sapiens
ccauauagucuauucauuaa

SEQ ID NO: 588601 - RNA, 18 nt, Homo sapiens
ccauauauaacagauaca

SEQ ID NO: 588602 - RNA, 18 nt, Homo sapiens
ccauaugucugcuucugu

SEQ ID NO: 588603 - RNA, 23 nt, Homo sapiens
ccauauucuuccccgaaucacac

SEQ ID NO: 588604 - RNA, 19 nt, Homo sapiens
ccaucaaacauaauucucu

SEQ ID NO: 588605 - RNA, 13 nt, Homo sapiens
ccaucaaagaguc

SEQ ID NO: 588606 - RNA, 14 nt, Homo sapiens
ccaucaacaagucu

SEQ ID NO: 588607 - RNA, 15 nt, Homo sapiens
ccaucaagugcaguc

SEQ ID NO: 588608 - RNA, 16 nt, Homo sapiens
ccaucaaguugugcca

SEQ ID NO: 588609 - RNA, 21 nt, Homo sapiens
ccaucaauaaagaagcauucu

SEQ ID NO: 588610 - RNA, 19 nt, Homo sapiens
ccaucaauucuuagaauau

SEQ ID NO: 588611 - RNA, 12 nt, Homo sapiens
ccaucacacugu

SEQ ID NO: 588612 - RNA, 22 nt, Homo sapiens
ccaucaggauccagucuggaaa

SEQ ID NO: 588613 - RNA, 13 nt, Homo sapiens
ccaucaggguucu

SEQ ID NO: 588614 - RNA, 23 nt, Homo sapiens
ccaucaugggcuggacauuggac

SEQ ID NO: 588615 - RNA, 14 nt, Homo sapiens
ccaucaugucugua

SEQ ID NO: 588616 - RNA, 18 nt, Homo sapiens
ccauccagggucuggcag

SEQ ID NO: 588617 - RNA, 20 nt, Homo sapiens
ccauccaggucuugacucau

SEQ ID NO: 588618 - RNA, 14 nt, Homo sapiens
ccauccccuggacu

SEQ ID NO: 588619 - RNA, 18 nt, Homo sapiens
ccauccccuggacuggga

SEQ ID NO: 588620 - RNA, 19 nt, Homo sapiens
ccauccccuggacugggag

SEQ ID NO: 588621 - RNA, 23 nt, Homo sapiens
ccauccgguggccuauuccagga

SEQ ID NO: 588622 - RNA, 20 nt, Homo sapiens
ccauccuaccaaugcaugca

SEQ ID NO: 588623 - RNA, 20 nt, Homo sapiens
ccauccucacaugugacaaa

SEQ ID NO: 588624 - RNA, 17 nt, Homo sapiens
ccauccugucaccauga

SEQ ID NO: 588625 - RNA, 15 nt, Homo sapiens
ccauccuguuugaaa

SEQ ID NO: 588626 - RNA, 21 nt, Homo sapiens
ccaucggguaagaugcuccug

SEQ ID NO: 588627 - RNA, 18 nt, Homo sapiens
ccaucgucucggccuuca

SEQ ID NO: 588628 - RNA, 17 nt, Homo sapiens
ccaucuccuuucaggga

SEQ ID NO: 588629 - RNA, 15 nt, Homo sapiens
ccaucucgggcacag

SEQ ID NO: 588630 - RNA, 19 nt, Homo sapiens
ccaucucuauuaaaauaca

SEQ ID NO: 588631 - RNA, 21 nt, Homo sapiens
ccaucucuauuaaaauacaaa

SEQ ID NO: 588632 - RNA, 12 nt, Homo sapiens
ccaucucuguag

SEQ ID NO: 588633 - RNA, 12 nt, Homo sapiens
ccaucucugucu

SEQ ID NO: 588634 - RNA, 12 nt, Homo sapiens
ccaucuguagag

SEQ ID NO: 588635 - RNA, 23 nt, Homo sapiens
ccaucugucuucagcacauucca

SEQ ID NO: 588636 - RNA, 17 nt, Homo sapiens
ccaucugugugcaacua

SEQ ID NO: 588637 - RNA, 21 nt, Homo sapiens
ccaucuuccaggauggcagca

SEQ ID NO: 588638 - RNA, 22 nt, Homo sapiens
ccaucuucuaaacccaauccaa

SEQ ID NO: 588639 - RNA, 17 nt, Homo sapiens
ccaucuugaucuuugag

SEQ ID NO: 588640 - RNA, 17 nt, Homo sapiens
ccaucuugugguaacuu

SEQ ID NO: 588641 - RNA, 11 nt, Homo sapiens
ccaucuuuaca

SEQ ID NO: 588642 - RNA, 22 nt, Homo sapiens
ccaucuuuugugagauguaauu

SEQ ID NO: 588643 - RNA, 23 nt, Homo sapiens
ccaugaacaucuuuagugucuga

SEQ ID NO: 588644 - RNA, 15 nt, Homo sapiens
ccaugaacuuaaaau

SEQ ID NO: 588645 - RNA, 22 nt, Homo sapiens
ccaugaagcgaaacacagagaa

SEQ ID NO: 588646 - RNA, 16 nt, Homo sapiens
ccaugaaucaaagaca

SEQ ID NO: 588647 - RNA, 17 nt, Homo sapiens
ccaugacauuucaucug

SEQ ID NO: 588648 - RNA, 19 nt, Homo sapiens
ccaugacgacauacaugcu

SEQ ID NO: 588649 - RNA, 19 nt, Homo sapiens
ccaugacguguuucuugaa

SEQ ID NO: 588650 - RNA, 19 nt, Homo sapiens
ccaugacugugaccaccuu

SEQ ID NO: 588651 - RNA, 13 nt, Homo sapiens
ccaugacuuccuc

SEQ ID NO: 588652 - RNA, 11 nt, Homo sapiens
ccaugagacac

SEQ ID NO: 588653 - RNA, 22 nt, Homo sapiens
ccaugagagaaggaggggagca

SEQ ID NO: 588654 - RNA, 20 nt, Homo sapiens
ccaugagaugauacauccaa

SEQ ID NO: 588655 - RNA, 15 nt, Homo sapiens
ccaugaggucuuccc

SEQ ID NO: 588656 - RNA, 22 nt, Homo sapiens
ccaugauggccuuacacugaaa

SEQ ID NO: 588657 - RNA, 21 nt, Homo sapiens
ccaugauguccuuggacucca

SEQ ID NO: 588658 - RNA, 21 nt, Homo sapiens
ccaugaugugaagaguuucac

SEQ ID NO: 588659 - RNA, 20 nt, Homo sapiens
ccaugcauuuaaaguauucu

SEQ ID NO: 588660 - RNA, 19 nt, Homo sapiens
ccaugccagacccacugaa

SEQ ID NO: 588661 - RNA, 17 nt, Homo sapiens
ccaugccccuggaccag

SEQ ID NO: 588662 - RNA, 14 nt, Homo sapiens
ccaugccugagggu

SEQ ID NO: 588663 - RNA, 19 nt, Homo sapiens
ccaugcgcagaugaggggc

SEQ ID NO: 588664 - RNA, 15 nt, Homo sapiens
ccaugcgggugcaca

SEQ ID NO: 588665 - RNA, 11 nt, Homo sapiens
ccaugcucaau

SEQ ID NO: 588666 - RNA, 17 nt, Homo sapiens
ccaugcucaccaaggaa

SEQ ID NO: 588667 - RNA, 20 nt, Homo sapiens
ccaugcugaaggcucccauu

SEQ ID NO: 588668 - RNA, 19 nt, Homo sapiens
ccaugcugcccgcuucuca

SEQ ID NO: 588669 - RNA, 13 nt, Homo sapiens
ccaugcugugcug

SEQ ID NO: 588670 - RNA, 20 nt, Homo sapiens
ccaugcuucacucaugcaaa

SEQ ID NO: 588671 - RNA, 14 nt, Homo sapiens
ccauggacaggcug

SEQ ID NO: 588672 - RNA, 22 nt, Homo sapiens
ccauggagacaagggcaucauc

SEQ ID NO: 588673 - RNA, 16 nt, Homo sapiens
ccauggaggcaugcca

SEQ ID NO: 588674 - RNA, 22 nt, Homo sapiens
ccauggcaccuuuugcacauaa

SEQ ID NO: 588675 - RNA, 22 nt, Homo sapiens
ccauggccaccccagagccauc

SEQ ID NO: 588676 - RNA, 23 nt, Homo sapiens
ccaugggaaggguccaucucaga

SEQ ID NO: 588677 - RNA, 23 nt, Homo sapiens
ccaugggcuagugugaguggcag

SEQ ID NO: 588678 - RNA, 14 nt, Homo sapiens
ccauggugagcucu

SEQ ID NO: 588679 - RNA, 13 nt, Homo sapiens
ccaugguuuuacu

SEQ ID NO: 588680 - RNA, 14 nt, Homo sapiens
ccauguaaauugca

SEQ ID NO: 588681 - RNA, 16 nt, Homo sapiens
ccauguacaugaagaa

SEQ ID NO: 588682 - RNA, 20 nt, Homo sapiens
ccaugucagcaaaaagcaaa

SEQ ID NO: 588683 - RNA, 13 nt, Homo sapiens
ccauguccaaaga

SEQ ID NO: 588684 - RNA, 19 nt, Homo sapiens
ccauguccuccuagaguuu

SEQ ID NO: 588685 - RNA, 20 nt, Homo sapiens
ccauguccugaaaaaugcuc

SEQ ID NO: 588686 - RNA, 22 nt, Homo sapiens
ccauguguaagaacaaugccag

SEQ ID NO: 588687 - RNA, 19 nt, Homo sapiens
ccaugugugagugugugca

SEQ ID NO: 588688 - RNA, 15 nt, Homo sapiens
ccaugugugcuaaua

SEQ ID NO: 588689 - RNA, 15 nt, Homo sapiens
ccauguuauucucuc

SEQ ID NO: 588690 - RNA, 17 nt, Homo sapiens
ccauguuauucucucac

SEQ ID NO: 588691 - RNA, 20 nt, Homo sapiens
ccauguucacaccgcugcac

SEQ ID NO: 588692 - RNA, 20 nt, Homo sapiens
ccauguucauuauaaucuca

SEQ ID NO: 588693 - RNA, 18 nt, Homo sapiens
ccauguuugguuguaaau

SEQ ID NO: 588694 - RNA, 21 nt, Homo sapiens
ccauuaaaauaaaacaagccu

SEQ ID NO: 588695 - RNA, 23 nt, Homo sapiens
ccauuaaaauaaaacaagccuua

SEQ ID NO: 588696 - RNA, 15 nt, Homo sapiens
ccauuaaaguucuca

SEQ ID NO: 588697 - RNA, 22 nt, Homo sapiens
ccauuaagugguaguaauuucc

SEQ ID NO: 588698 - RNA, 12 nt, Homo sapiens
ccauuaccaaaa

SEQ ID NO: 588699 - RNA, 13 nt, Homo sapiens
ccauuaccuguac

SEQ ID NO: 588700 - RNA, 11 nt, Homo sapiens
ccauuagccaa

SEQ ID NO: 588701 - RNA, 21 nt, Homo sapiens
ccauuagcccuucaccaucua

SEQ ID NO: 588702 - RNA, 10 nt, Homo sapiens
ccauuauuca

SEQ ID NO: 588703 - RNA, 21 nt, Homo sapiens
ccauucaacccagcaaucuca

SEQ ID NO: 588704 - RNA, 14 nt, Homo sapiens
ccauucacuacuca

SEQ ID NO: 588705 - RNA, 18 nt, Homo sapiens
ccauucagaaagcuucaa

SEQ ID NO: 588706 - RNA, 23 nt, Homo sapiens
ccauucagaugaauagauggaau

SEQ ID NO: 588707 - RNA, 12 nt, Homo sapiens
ccauucaggaca

SEQ ID NO: 588708 - RNA, 22 nt, Homo sapiens
ccauucauauuaagacagugua

SEQ ID NO: 588709 - RNA, 22 nt, Homo sapiens
ccauuccaagucaacacucuuc

SEQ ID NO: 588710 - RNA, 17 nt, Homo sapiens
ccauuccagacugcuuc

SEQ ID NO: 588711 - RNA, 23 nt, Homo sapiens
ccauucgguguggugcaguguga

SEQ ID NO: 588712 - RNA, 16 nt, Homo sapiens
ccauucuccugccuca

SEQ ID NO: 588713 - RNA, 13 nt, Homo sapiens
ccauucugaccau

SEQ ID NO: 588714 - RNA, 21 nt, Homo sapiens
ccauucuucagacaucaguca

SEQ ID NO: 588715 - RNA, 16 nt, Homo sapiens
ccauugcauuccagcc

SEQ ID NO: 588716 - RNA, 12 nt, Homo sapiens
ccauugcugcca

SEQ ID NO: 588717 - RNA, 19 nt, Homo sapiens
ccauuguccuccuuuucac

SEQ ID NO: 588718 - RNA, 13 nt, Homo sapiens
ccauugugaacca

SEQ ID NO: 588719 - RNA, 14 nt, Homo sapiens
ccauugugaaccaa

SEQ ID NO: 588720 - RNA, 19 nt, Homo sapiens
ccauuuacaugcaccuuau

SEQ ID NO: 588721 - RNA, 14 nt, Homo sapiens
ccauuuaccagcag

SEQ ID NO: 588722 - RNA, 22 nt, Homo sapiens
ccauuuccuccuuuaccuuuca

SEQ ID NO: 588723 - RNA, 23 nt, Homo sapiens
ccauuucucucuuguuugagaga

SEQ ID NO: 588724 - RNA, 15 nt, Homo sapiens
ccauuugaacacauu

SEQ ID NO: 588725 - RNA, 11 nt, Homo sapiens
ccauuugcaau

SEQ ID NO: 588726 - RNA, 13 nt, Homo sapiens
ccauuuguuccug

SEQ ID NO: 588727 - RNA, 21 nt, Homo sapiens
ccauuuucaacugcuuugaaa

SEQ ID NO: 588728 - RNA, 16 nt, Homo sapiens
ccauuuuuaaaauaca

SEQ ID NO: 588729 - RNA, 17 nt, Homo sapiens
ccauuuuucaaagcaau

SEQ ID NO: 588730 - RNA, 17 nt, Homo sapiens
cccaaaaauuacuuugg

SEQ ID NO: 588731 - RNA, 23 nt, Homo sapiens
cccaaaacgucuuauugugguag

SEQ ID NO: 588732 - RNA, 15 nt, Homo sapiens
cccaaacaccaguca

SEQ ID NO: 588733 - RNA, 13 nt, Homo sapiens
cccaaaccuagcu

SEQ ID NO: 588734 - RNA, 12 nt, Homo sapiens
cccaaacuguau

SEQ ID NO: 588735 - RNA, 15 nt, Homo sapiens
cccaaagcacuugcu

SEQ ID NO: 588736 - RNA, 13 nt, Homo sapiens
cccaaagcacuuu

SEQ ID NO: 588737 - RNA, 17 nt, Homo sapiens
cccaaagccaagaaaga

SEQ ID NO: 588738 - RNA, 15 nt, Homo sapiens
cccaaaggagucaga

SEQ ID NO: 588739 - RNA, 19 nt, Homo sapiens
cccaaaggagucagagcau

SEQ ID NO: 588740 - RNA, 20 nt, Homo sapiens
cccaaauuaagaaucuagga

SEQ ID NO: 588741 - RNA, 16 nt, Homo sapiens
cccaacaaaccaucca

SEQ ID NO: 588742 - RNA, 19 nt, Homo sapiens
cccaacaccugccucugac

SEQ ID NO: 588743 - RNA, 14 nt, Homo sapiens
cccaacaugcacug

SEQ ID NO: 588744 - RNA, 13 nt, Homo sapiens
cccaacccauuca

SEQ ID NO: 588745 - RNA, 19 nt, Homo sapiens
cccaacccccugcaagaag

SEQ ID NO: 588746 - RNA, 23 nt, Homo sapiens
cccaaccucaaugcccugccauu

SEQ ID NO: 588747 - RNA, 21 nt, Homo sapiens
cccaaccuucuugucauugaa

SEQ ID NO: 588748 - RNA, 22 nt, Homo sapiens
cccaacucuccuggccuggcca

SEQ ID NO: 588749 - RNA, 17 nt, Homo sapiens
cccaacugaccugccag

SEQ ID NO: 588750 - RNA, 17 nt, Homo sapiens
cccaacuugagauguau

SEQ ID NO: 588751 - RNA, 12 nt, Homo sapiens
cccaacuugcca

SEQ ID NO: 588752 - RNA, 21 nt, Homo sapiens
cccaagacaugacauucuuag

SEQ ID NO: 588753 - RNA, 22 nt, Homo sapiens
cccaagagauuguuguuugcca

SEQ ID NO: 588754 - RNA, 17 nt, Homo sapiens
cccaagaugucaaaaca

SEQ ID NO: 588755 - RNA, 22 nt, Homo sapiens
cccaagccugauacuuuagcca

SEQ ID NO: 588756 - RNA, 20 nt, Homo sapiens
cccaagccuggcaagggaau

SEQ ID NO: 588757 - RNA, 23 nt, Homo sapiens
cccaagccugggcuugagcugca

SEQ ID NO: 588758 - RNA, 22 nt, Homo sapiens
cccaagcugccucugggccaug

SEQ ID NO: 588759 - RNA, 16 nt, Homo sapiens
cccaagcuguggcagc

SEQ ID NO: 588760 - RNA, 12 nt, Homo sapiens
caguucaugcag

SEQ ID NO: 588761 - RNA, 18 nt, Homo sapiens
caguucccaccaucugau

SEQ ID NO: 588762 - RNA, 20 nt, Homo sapiens
caguucccuccugcccagga

SEQ ID NO: 588763 - RNA, 18 nt, Homo sapiens
caguucuacacugauaca

SEQ ID NO: 588764 - RNA, 19 nt, Homo sapiens
caguucucacuccuaggag

SEQ ID NO: 588765 - RNA, 20 nt, Homo sapiens
caguucugaauaacuugaag

SEQ ID NO: 588766 - RNA, 14 nt, Homo sapiens
caguucugacacac

SEQ ID NO: 588767 - RNA, 19 nt, Homo sapiens
caguucugucauauguuaa

SEQ ID NO: 588768 - RNA, 17 nt, Homo sapiens
caguugaagcugacuca

SEQ ID NO: 588769 - RNA, 15 nt, Homo sapiens
caguugcauaucuua

SEQ ID NO: 588770 - RNA, 18 nt, Homo sapiens
caguugggauggaaaucu

SEQ ID NO: 588771 - RNA, 14 nt, Homo sapiens
caguuggugcugcu

SEQ ID NO: 588772 - RNA, 23 nt, Homo sapiens
caguugguuuggauuuuuggacc

SEQ ID NO: 588773 - RNA, 20 nt, Homo sapiens
caguuguaacaauagcacaa

SEQ ID NO: 588774 - RNA, 18 nt, Homo sapiens
caguugugucagcuacug

SEQ ID NO: 588775 - RNA, 23 nt, Homo sapiens
caguuguugauugacugcaugaa

SEQ ID NO: 588776 - RNA, 16 nt, Homo sapiens
caguuuaauauuccaa

SEQ ID NO: 588777 - RNA, 22 nt, Homo sapiens
caguuuaaugaacuaccaucug

SEQ ID NO: 588778 - RNA, 20 nt, Homo sapiens
caguuuagcaagaacaccua

SEQ ID NO: 588779 - RNA, 17 nt, Homo sapiens
caguuuggagucacugu

SEQ ID NO: 588780 - RNA, 20 nt, Homo sapiens
caguuuguaaaaguguaaca

SEQ ID NO: 588781 - RNA, 23 nt, Homo sapiens
caguuuguauuuagcugccaaau

SEQ ID NO: 588782 - RNA, 14 nt, Homo sapiens
caguuuguggcauc

SEQ ID NO: 588783 - RNA, 22 nt, Homo sapiens
caguuuuaaaaaaaacaauucc

SEQ ID NO: 588784 - RNA, 14 nt, Homo sapiens
caguuuuaccucuu

SEQ ID NO: 588785 - RNA, 20 nt, Homo sapiens
caguuuuaccucuucucucu

SEQ ID NO: 588786 - RNA, 17 nt, Homo sapiens
caguuuuagauacucau

SEQ ID NO: 588787 - RNA, 18 nt, Homo sapiens
caguuuuauuuuugccaa

SEQ ID NO: 588788 - RNA, 19 nt, Homo sapiens
caguuuucaggaugagaug

SEQ ID NO: 588789 - RNA, 23 nt, Homo sapiens
caguuuucaggaugauacacuau

SEQ ID NO: 588790 - RNA, 20 nt, Homo sapiens
caguuuugccuaauggcaaa

SEQ ID NO: 588791 - RNA, 14 nt, Homo sapiens
caguuuuguugccc

SEQ ID NO: 588792 - RNA, 15 nt, Homo sapiens
caguuuuuaaacuag

SEQ ID NO: 588793 - RNA, 17 nt, Homo sapiens
caguuuuuauauagucu

SEQ ID NO: 588794 - RNA, 18 nt, Homo sapiens
caguuuuuuuuuuuccag

SEQ ID NO: 588795 - RNA, 12 nt, Homo sapiens
ccugauuuacua

SEQ ID NO: 588796 - RNA, 19 nt, Homo sapiens
ccugauuuagauaugcaaa

SEQ ID NO: 588797 - RNA, 14 nt, Homo sapiens
ccugauuucucuga

SEQ ID NO: 588798 - RNA, 12 nt, Homo sapiens
ccugcaaaaaga

SEQ ID NO: 588799 - RNA, 16 nt, Homo sapiens
ccugcaagaguggucc

SEQ ID NO: 588800 - RNA, 15 nt, Homo sapiens
ccugcaagucagucc

SEQ ID NO: 588801 - RNA, 16 nt, Homo sapiens
ccugcaaucccagcua

SEQ ID NO: 588802 - RNA, 18 nt, Homo sapiens
ccugcacaaccuggauuu

SEQ ID NO: 588803 - RNA, 15 nt, Homo sapiens
ccugcacagugacuu

SEQ ID NO: 588804 - RNA, 16 nt, Homo sapiens
ccugcacuaaagccag

SEQ ID NO: 588805 - RNA, 14 nt, Homo sapiens
ccugcagaagaugu

SEQ ID NO: 588806 - RNA, 18 nt, Homo sapiens
ccugcagacagaccucaa

SEQ ID NO: 588807 - RNA, 19 nt, Homo sapiens
ccugcagaggucugugcug

SEQ ID NO: 588808 - RNA, 20 nt, Homo sapiens
ccugcagaggucugugcuga

SEQ ID NO: 588809 - RNA, 17 nt, Homo sapiens
ccugcaggcaggaacaa

SEQ ID NO: 588810 - RNA, 19 nt, Homo sapiens
ccugcaggcuggagacugg

SEQ ID NO: 588811 - RNA, 19 nt, Homo sapiens
ccugcagugcucauucauc

SEQ ID NO: 588812 - RNA, 20 nt, Homo sapiens
ccugcauagucuguuccuuu

SEQ ID NO: 588813 - RNA, 16 nt, Homo sapiens
ccugcaucaucuugaa

SEQ ID NO: 588814 - RNA, 13 nt, Homo sapiens
ccugcauguucug

SEQ ID NO: 588815 - RNA, 13 nt, Homo sapiens
ccugcauuaacug

SEQ ID NO: 588816 - RNA, 21 nt, Homo sapiens
ccugcauuguaaauagguucu

SEQ ID NO: 588817 - RNA, 21 nt, Homo sapiens
ccugcauuguuucaagacuga

SEQ ID NO: 588818 - RNA, 23 nt, Homo sapiens
ccugccaaaugaauaagacaaca

SEQ ID NO: 588819 - RNA, 18 nt, Homo sapiens
ccugccaccagucacugu

SEQ ID NO: 588820 - RNA, 19 nt, Homo sapiens
ccugccagugccagggugg

SEQ ID NO: 588821 - RNA, 23 nt, Homo sapiens
ccugccauaauccuuuggaaaag

SEQ ID NO: 588822 - RNA, 14 nt, Homo sapiens
ccugccauagucuu

SEQ ID NO: 588823 - RNA, 15 nt, Homo sapiens
ccugccauggaucuc

SEQ ID NO: 588824 - RNA, 21 nt, Homo sapiens
ccugcccacuuagccguccau

SEQ ID NO: 588825 - RNA, 15 nt, Homo sapiens
ccugcccaugugucc

SEQ ID NO: 588826 - RNA, 22 nt, Homo sapiens
ccugccccaaacaaauaugcaa

SEQ ID NO: 588827 - RNA, 16 nt, Homo sapiens
ccugcccccacuuccu

SEQ ID NO: 588828 - RNA, 19 nt, Homo sapiens
ccugcccccgcucccgcuc

SEQ ID NO: 588829 - RNA, 12 nt, Homo sapiens
ccugccccggga

SEQ ID NO: 588830 - RNA, 18 nt, Homo sapiens
ccugcccgccacauggug

SEQ ID NO: 588831 - RNA, 14 nt, Homo sapiens
ccugcccugccuca

SEQ ID NO: 588832 - RNA, 16 nt, Homo sapiens
ccugcccugcugccgc

SEQ ID NO: 588833 - RNA, 17 nt, Homo sapiens
ccugcccuguccaaaag

SEQ ID NO: 588834 - RNA, 10 nt, Homo sapiens
ccugcccuug

SEQ ID NO: 588835 - RNA, 14 nt, Homo sapiens
ccugccgcugcacc

SEQ ID NO: 588836 - RNA, 17 nt, Homo sapiens
ccugccgucaccaccac

SEQ ID NO: 588837 - RNA, 15 nt, Homo sapiens
ccugccucagcaauu

SEQ ID NO: 588838 - RNA, 20 nt, Homo sapiens
ccugccucagccucccaauu

SEQ ID NO: 588839 - RNA, 23 nt, Homo sapiens
ccugccucccacuucacugcgaa

SEQ ID NO: 588840 - RNA, 14 nt, Homo sapiens
ccugccuccugcca

SEQ ID NO: 588841 - RNA, 18 nt, Homo sapiens
ccugccuuuucauugccc

SEQ ID NO: 588842 - RNA, 19 nt, Homo sapiens
ccugcgcgucaucucugac

SEQ ID NO: 588843 - RNA, 22 nt, Homo sapiens
ccugcggcucagccuugcacac

SEQ ID NO: 588844 - RNA, 18 nt, Homo sapiens
ccugcgugggggccaguc

SEQ ID NO: 588845 - RNA, 23 nt, Homo sapiens
ccugcucaacauaggccugcuca

SEQ ID NO: 588846 - RNA, 15 nt, Homo sapiens
ccugcucagcagcca

SEQ ID NO: 588847 - RNA, 15 nt, Homo sapiens
ccugcucccagacau

SEQ ID NO: 588848 - RNA, 15 nt, Homo sapiens
ccugcuccugcagca

SEQ ID NO: 588849 - RNA, 19 nt, Homo sapiens
ccugcucugggcacuggga

SEQ ID NO: 588850 - RNA, 21 nt, Homo sapiens
ccugcucuucuaccauuugaa

SEQ ID NO: 588851 - RNA, 16 nt, Homo sapiens
ccugcugccccagcug

SEQ ID NO: 588852 - RNA, 19 nt, Homo sapiens
ccugcugcgucagaccagu

SEQ ID NO: 588853 - RNA, 17 nt, Homo sapiens
ccugcuggcagggccag

SEQ ID NO: 588854 - RNA, 13 nt, Homo sapiens
ccugcuggcauca

SEQ ID NO: 588855 - RNA, 16 nt, Homo sapiens
ccugcugggaagagcu

SEQ ID NO: 588856 - RNA, 23 nt, Homo sapiens
ccugcugggacugagaaggcuca

SEQ ID NO: 588857 - RNA, 20 nt, Homo sapiens
ccugcuguauccagaagcca

SEQ ID NO: 588858 - RNA, 13 nt, Homo sapiens
ccugcugugauga

SEQ ID NO: 588859 - RNA, 19 nt, Homo sapiens
ccugcuucucucagccagc

SEQ ID NO: 588860 - RNA, 16 nt, Homo sapiens
ccugcuugcacuuugu

SEQ ID NO: 588861 - RNA, 22 nt, Homo sapiens
ccugcuuggucuuucauugcua

SEQ ID NO: 588862 - RNA, 18 nt, Homo sapiens
ccugcuuuggcagugcca

SEQ ID NO: 588863 - RNA, 22 nt, Homo sapiens
ccuggaaauaucaguuacucag

SEQ ID NO: 588864 - RNA, 22 nt, Homo sapiens
ccuggaagacaacccaggcagu

SEQ ID NO: 588865 - RNA, 19 nt, Homo sapiens
ccuggaagcaggugcuaca

SEQ ID NO: 588866 - RNA, 18 nt, Homo sapiens
ccuggaaggacacaguga

SEQ ID NO: 588867 - RNA, 14 nt, Homo sapiens
ccuggaaggugcca

SEQ ID NO: 588868 - RNA, 21 nt, Homo sapiens
ccuggacaaccuggacccaga

SEQ ID NO: 588869 - RNA, 23 nt, Homo sapiens
ccuggacaaggcuaacaucccac

SEQ ID NO: 588870 - RNA, 16 nt, Homo sapiens
ccuggacacaacacca

SEQ ID NO: 588871 - RNA, 21 nt, Homo sapiens
ccuggacacgcugguggugcu

SEQ ID NO: 588872 - RNA, 16 nt, Homo sapiens
ccuggacacucagacc

SEQ ID NO: 588873 - RNA, 14 nt, Homo sapiens
ccuggacacuguac

SEQ ID NO: 588874 - RNA, 22 nt, Homo sapiens
ccuggacaguaucccacaucca

SEQ ID NO: 588875 - RNA, 14 nt, Homo sapiens
ccuggaccauuuga

SEQ ID NO: 588876 - RNA, 15 nt, Homo sapiens
ccuggacucaggguc

SEQ ID NO: 588877 - RNA, 14 nt, Homo sapiens
ccuggacuccagua

SEQ ID NO: 588878 - RNA, 20 nt, Homo sapiens
ccuggacuccggaggacuga

SEQ ID NO: 588879 - RNA, 13 nt, Homo sapiens
ccuggacuuuccu

SEQ ID NO: 588880 - RNA, 22 nt, Homo sapiens
ccuggagaagaauggcuuucaa

SEQ ID NO: 588881 - RNA, 23 nt, Homo sapiens
ccuggagaugcagcuacuggaau

SEQ ID NO: 588882 - RNA, 16 nt, Homo sapiens
ccuggagccagggcag

SEQ ID NO: 588883 - RNA, 14 nt, Homo sapiens
ccuggagccuuuga

SEQ ID NO: 588884 - RNA, 17 nt, Homo sapiens
ccuggaggaaucacugg

SEQ ID NO: 588885 - RNA, 15 nt, Homo sapiens
ccuggaggcacugaa

SEQ ID NO: 588886 - RNA, 12 nt, Homo sapiens
ccuggauaggca

SEQ ID NO: 588887 - RNA, 23 nt, Homo sapiens
ccuggaucaguccuuugaucagu

SEQ ID NO: 588888 - RNA, 16 nt, Homo sapiens
ccuggauccagcacug

SEQ ID NO: 588889 - RNA, 18 nt, Homo sapiens
ccuggcaagugggugaaa

SEQ ID NO: 588890 - RNA, 18 nt, Homo sapiens
ccuggcacuaacguugag

SEQ ID NO: 588891 - RNA, 17 nt, Homo sapiens
ccuggcagggcccagug

SEQ ID NO: 588892 - RNA, 14 nt, Homo sapiens
ccuggcaucugugc

SEQ ID NO: 588893 - RNA, 14 nt, Homo sapiens
ccuggcaucugugu

SEQ ID NO: 588894 - RNA, 16 nt, Homo sapiens
ccuggccaacauguca

SEQ ID NO: 588895 - RNA, 15 nt, Homo sapiens
ccuggccgaguccaa

SEQ ID NO: 588896 - RNA, 19 nt, Homo sapiens
ccuggcuaagaucaugucu

SEQ ID NO: 588897 - RNA, 21 nt, Homo sapiens
ccuggcuccaacacugcugcu

SEQ ID NO: 588898 - RNA, 17 nt, Homo sapiens
ccuggcuccuucacuga

SEQ ID NO: 588899 - RNA, 16 nt, Homo sapiens
ccuggcucugcaaugg

SEQ ID NO: 588900 - RNA, 17 nt, Homo sapiens
ccuggcucugcaauggg

SEQ ID NO: 588901 - RNA, 18 nt, Homo sapiens
ccuggcucugggggaccc

SEQ ID NO: 588902 - RNA, 13 nt, Homo sapiens
ccuggcugaugau

SEQ ID NO: 588903 - RNA, 12 nt, Homo sapiens
ccuggcuggcau

SEQ ID NO: 588904 - RNA, 21 nt, Homo sapiens
ccugggaaggcuaaguucagu

SEQ ID NO: 588905 - RNA, 19 nt, Homo sapiens
ccugggaauguauuauucu

SEQ ID NO: 588906 - RNA, 14 nt, Homo sapiens
ccugggacacacac

SEQ ID NO: 588907 - RNA, 13 nt, Homo sapiens
ccugggacaucag

SEQ ID NO: 588908 - RNA, 17 nt, Homo sapiens
ccugggaccugaaccug

SEQ ID NO: 588909 - RNA, 23 nt, Homo sapiens
ccuuaggaaaaugcuucuguugu

SEQ ID NO: 588910 - RNA, 14 nt, Homo sapiens
ccuuaggugugagg

SEQ ID NO: 588911 - RNA, 13 nt, Homo sapiens
ccuuagugccagg

SEQ ID NO: 588912 - RNA, 13 nt, Homo sapiens
ccuuaguugaaau

SEQ ID NO: 588913 - RNA, 17 nt, Homo sapiens
ccuuauccuaaugaugc

SEQ ID NO: 588914 - RNA, 13 nt, Homo sapiens
ccuuauggccaau

SEQ ID NO: 588915 - RNA, 22 nt, Homo sapiens
ccuuauggccaauaacuuuuca

SEQ ID NO: 588916 - RNA, 18 nt, Homo sapiens
ccuuauuaaggccccaga

SEQ ID NO: 588917 - RNA, 18 nt, Homo sapiens
ccuuauucuacaucauua

SEQ ID NO: 588918 - RNA, 16 nt, Homo sapiens
ccuuauucuucauuuc

SEQ ID NO: 588919 - RNA, 14 nt, Homo sapiens
ccuuauuguaccuc

SEQ ID NO: 588920 - RNA, 21 nt, Homo sapiens
ccuuauuguaccucucuuaua

SEQ ID NO: 588921 - RNA, 15 nt, Homo sapiens
ccuuauuugucugua

SEQ ID NO: 588922 - RNA, 22 nt, Homo sapiens
ccuucaaaauguucuauuuaac

SEQ ID NO: 588923 - RNA, 23 nt, Homo sapiens
ccuucaaauaaagaaauuuggua

SEQ ID NO: 588924 - RNA, 21 nt, Homo sapiens
ccuucaacuggcuacugaguc

SEQ ID NO: 588925 - RNA, 14 nt, Homo sapiens
ccuucaaugaauua

SEQ ID NO: 588926 - RNA, 22 nt, Homo sapiens
ccuucaccucacugaaaacauc

SEQ ID NO: 588927 - RNA, 20 nt, Homo sapiens
ccuucacuccccuaucccau

SEQ ID NO: 588928 - RNA, 14 nt, Homo sapiens
ccuucacuuuacaa

SEQ ID NO: 588929 - RNA, 20 nt, Homo sapiens
ccuucagaacagaggcauuu

SEQ ID NO: 588930 - RNA, 22 nt, Homo sapiens
ccuucagaacagaggcauuuaa

SEQ ID NO: 588931 - RNA, 13 nt, Homo sapiens
ccuucagagccag

SEQ ID NO: 588932 - RNA, 20 nt, Homo sapiens
ccuucagcccuggccaagcu

SEQ ID NO: 588933 - RNA, 14 nt, Homo sapiens
ccuucagccuuaau

SEQ ID NO: 588934 - RNA, 20 nt, Homo sapiens
ccuucaucuucacugcaauu

SEQ ID NO: 588935 - RNA, 14 nt, Homo sapiens
ccuucauugccaca

SEQ ID NO: 588936 - RNA, 21 nt, Homo sapiens
ccuucauugccacacuuggug

SEQ ID NO: 588937 - RNA, 13 nt, Homo sapiens
ccuuccacccuuu

SEQ ID NO: 588938 - RNA, 19 nt, Homo sapiens
ccuuccacggauccaugua

SEQ ID NO: 588939 - RNA, 17 nt, Homo sapiens
ccuuccaggaaugcugg

SEQ ID NO: 588940 - RNA, 11 nt, Homo sapiens
ccuuccagggc

SEQ ID NO: 588941 - RNA, 16 nt, Homo sapiens
ccuuccaggugggugu

SEQ ID NO: 588942 - RNA, 15 nt, Homo sapiens
ccuuccccucucuca

SEQ ID NO: 588943 - RNA, 16 nt, Homo sapiens
ccuuccccuucccaca

SEQ ID NO: 588944 - RNA, 18 nt, Homo sapiens
ccuuccuaauaugcuuua

SEQ ID NO: 588945 - RNA, 17 nt, Homo sapiens
ccuuccucacuuccaua

SEQ ID NO: 588946 - RNA, 16 nt, Homo sapiens
ccuuccucucaggcuc

SEQ ID NO: 588947 - RNA, 18 nt, Homo sapiens
ccuuccugccugaugugg

SEQ ID NO: 588948 - RNA, 20 nt, Homo sapiens
ccuuccuggacacacucuca

SEQ ID NO: 588949 - RNA, 16 nt, Homo sapiens
ccuuccuuaugccaua

SEQ ID NO: 588950 - RNA, 22 nt, Homo sapiens
ccuuccuuaugccauauacaaa

SEQ ID NO: 588951 - RNA, 17 nt, Homo sapiens
ccuucgcuucuugccuc

SEQ ID NO: 588952 - RNA, 15 nt, Homo sapiens
ccuucguguggcucc

SEQ ID NO: 588953 - RNA, 20 nt, Homo sapiens
ccuucguguggcuccuggua

SEQ ID NO: 588954 - RNA, 17 nt, Homo sapiens
ccuucguuaacugugua

SEQ ID NO: 588955 - RNA, 19 nt, Homo sapiens
ccuucuacauuugagggcc

SEQ ID NO: 588956 - RNA, 16 nt, Homo sapiens
ccuucuaguuaccaca

SEQ ID NO: 588957 - RNA, 15 nt, Homo sapiens
ccuucucaagacuuu

SEQ ID NO: 588958 - RNA, 16 nt, Homo sapiens
ccuucucaagacuuua

SEQ ID NO: 588959 - RNA, 15 nt, Homo sapiens
ccuucucugcuccac

SEQ ID NO: 588960 - RNA, 14 nt, Homo sapiens
ccuucucugcuccu

SEQ ID NO: 588961 - RNA, 23 nt, Homo sapiens
ccuucucuugaggccugugcucu

SEQ ID NO: 588962 - RNA, 14 nt, Homo sapiens
ccuucugaccccac

SEQ ID NO: 588963 - RNA, 19 nt, Homo sapiens
ccuucugacugagcaauau

SEQ ID NO: 588964 - RNA, 17 nt, Homo sapiens
ccuucugaggagaggca

SEQ ID NO: 588965 - RNA, 21 nt, Homo sapiens
ccuucugcuaugacaaaaccu

SEQ ID NO: 588966 - RNA, 23 nt, Homo sapiens
ccuucugcuaugacaaaaccuuu

SEQ ID NO: 588967 - RNA, 23 nt, Homo sapiens
ccuucugcucagcucugggccau

SEQ ID NO: 588968 - RNA, 21 nt, Homo sapiens
ccuucuggacacugagagggc

SEQ ID NO: 588969 - RNA, 17 nt, Homo sapiens
ccuucuuaaagccuuau

SEQ ID NO: 588970 - RNA, 14 nt, Homo sapiens
ccuucuugacauuu

SEQ ID NO: 588971 - RNA, 11 nt, Homo sapiens
ccuucuuucac

SEQ ID NO: 588972 - RNA, 19 nt, Homo sapiens
ccuucuuugcugcugcuuc

SEQ ID NO: 588973 - RNA, 22 nt, Homo sapiens
ccuugaacaaccagauggugac

SEQ ID NO: 588974 - RNA, 16 nt, Homo sapiens
ccuugaaccacuuccc

SEQ ID NO: 588975 - RNA, 23 nt, Homo sapiens
ccuugaacugaggcccugugaua

SEQ ID NO: 588976 - RNA, 13 nt, Homo sapiens
ccuugaagacaga

SEQ ID NO: 588977 - RNA, 11 nt, Homo sapiens
ccuugagaaac

SEQ ID NO: 588978 - RNA, 16 nt, Homo sapiens
ccuugagaagugggag

SEQ ID NO: 588979 - RNA, 16 nt, Homo sapiens
ccuugaguguguuacc

SEQ ID NO: 588980 - RNA, 17 nt, Homo sapiens
ccuugaucccaauccuu

SEQ ID NO: 588981 - RNA, 18 nt, Homo sapiens
ccuugcagaacugccauu

SEQ ID NO: 588982 - RNA, 22 nt, Homo sapiens
ccuugcccacggcaacugccuu

SEQ ID NO: 588983 - RNA, 15 nt, Homo sapiens
ccuugcggaagccau

SEQ ID NO: 588984 - RNA, 17 nt, Homo sapiens
ccuugcuaaaagauuau

SEQ ID NO: 588985 - RNA, 21 nt, Homo sapiens
ccuugcucacucacucacucc

SEQ ID NO: 588986 - RNA, 16 nt, Homo sapiens
ccuugcucagugccuc

SEQ ID NO: 588987 - RNA, 20 nt, Homo sapiens
ccuugcucucccucuucuca

SEQ ID NO: 588988 - RNA, 13 nt, Homo sapiens
ccuugcugggacu

SEQ ID NO: 588989 - RNA, 18 nt, Homo sapiens
ccuugcugggccagggaa

SEQ ID NO: 588990 - RNA, 19 nt, Homo sapiens
ccuugcuuagccugugcug

SEQ ID NO: 588991 - RNA, 17 nt, Homo sapiens
ccuugcuuuugcuucua

SEQ ID NO: 588992 - RNA, 15 nt, Homo sapiens
ccuuggaaaacaaaa

SEQ ID NO: 588993 - RNA, 21 nt, Homo sapiens
ccuuggaagggcguucuaggu

SEQ ID NO: 588994 - RNA, 15 nt, Homo sapiens
ccuuggaaggugaca

SEQ ID NO: 588995 - RNA, 19 nt, Homo sapiens
ccuuggagggacaugacua

SEQ ID NO: 588996 - RNA, 17 nt, Homo sapiens
ccuuggagucuguucua

SEQ ID NO: 588997 - RNA, 22 nt, Homo sapiens
ccuuggcucccauucacucuuc

SEQ ID NO: 588998 - RNA, 19 nt, Homo sapiens
ccuugggcagaaugaauuc

SEQ ID NO: 588999 - RNA, 16 nt, Homo sapiens
ccuugggcaguucuca

SEQ ID NO: 589000 - RNA, 17 nt, Homo sapiens
ccuugguaugugccagg

SEQ ID NO: 589001 - RNA, 17 nt, Homo sapiens
ccuugguggagcagcca

SEQ ID NO: 589002 - RNA, 14 nt, Homo sapiens
ccuuguaguucuca

SEQ ID NO: 589003 - RNA, 22 nt, Homo sapiens
ccuuguccugaugcugugcuca

SEQ ID NO: 589004 - RNA, 21 nt, Homo sapiens
ccuugucucucacugcauuug

SEQ ID NO: 589005 - RNA, 22 nt, Homo sapiens
ccuuguggcuugggacauggca

SEQ ID NO: 589006 - RNA, 21 nt, Homo sapiens
ccuuguguuuaggaucaucuc

SEQ ID NO: 589007 - RNA, 20 nt, Homo sapiens
ccuuguucaauaauuacugu

SEQ ID NO: 589008 - RNA, 13 nt, Homo sapiens
ccuuguugcacug

SEQ ID NO: 589009 - RNA, 18 nt, Homo sapiens
ccuuguuggggagugggu

SEQ ID NO: 589010 - RNA, 15 nt, Homo sapiens
ccuuguuuguacugu

SEQ ID NO: 589011 - RNA, 18 nt, Homo sapiens
ccuuguuuuuaaucuccu

SEQ ID NO: 589012 - RNA, 17 nt, Homo sapiens
ccuuuaaauauuucaca

SEQ ID NO: 589013 - RNA, 22 nt, Homo sapiens
ccuuuaacuuucagaggcaaua

SEQ ID NO: 589014 - RNA, 18 nt, Homo sapiens
ccuuuaauguugcccaca

SEQ ID NO: 589015 - RNA, 14 nt, Homo sapiens
ccuuuaccccucau

SEQ ID NO: 589016 - RNA, 22 nt, Homo sapiens
ccuuuacgguccaugccuuuaa

SEQ ID NO: 589017 - RNA, 18 nt, Homo sapiens
ccuuuagaguguagguga

SEQ ID NO: 589018 - RNA, 16 nt, Homo sapiens
ccuuuaggguucugcc

SEQ ID NO: 589019 - RNA, 15 nt, Homo sapiens
ccuuuaguggagcca

SEQ ID NO: 589020 - RNA, 21 nt, Homo sapiens
ccuuuaucaaaaaaagacuca

SEQ ID NO: 589021 - RNA, 18 nt, Homo sapiens
ccuuuaucaccucauucu

SEQ ID NO: 589022 - RNA, 15 nt, Homo sapiens
ccuuucacacuggau

SEQ ID NO: 589023 - RNA, 23 nt, Homo sapiens
ccuuucacccucaugaaaacaca

SEQ ID NO: 589024 - RNA, 19 nt, Homo sapiens
ccuuucauggucugcugag

SEQ ID NO: 589025 - RNA, 13 nt, Homo sapiens
ccuuucauuugaa

SEQ ID NO: 589026 - RNA, 23 nt, Homo sapiens
ccuuuccagaguccuccuuugcc

SEQ ID NO: 589027 - RNA, 13 nt, Homo sapiens
ccuuuccauuuau

SEQ ID NO: 589028 - RNA, 20 nt, Homo sapiens
ccuuucccagguaauuuaaa

SEQ ID NO: 589029 - RNA, 15 nt, Homo sapiens
ccuuuccccccucac

SEQ ID NO: 589030 - RNA, 17 nt, Homo sapiens
ccuuuccucuagcuuuu

SEQ ID NO: 589031 - RNA, 22 nt, Homo sapiens
ccuuuccucugcagcacuuuaa

SEQ ID NO: 589032 - RNA, 22 nt, Homo sapiens
ccuuuccugaucacuaugcauu

SEQ ID NO: 589033 - RNA, 18 nt, Homo sapiens
ccuuuccuuuucuuuaaa

SEQ ID NO: 589034 - RNA, 17 nt, Homo sapiens
ccuuucgacuugcauuu

SEQ ID NO: 589035 - RNA, 13 nt, Homo sapiens
ccuuucgagcucu

SEQ ID NO: 589036 - RNA, 21 nt, Homo sapiens
ccuuucguucugcugaccaaa

SEQ ID NO: 589037 - RNA, 17 nt, Homo sapiens
ccuuucucuaaaacugc

SEQ ID NO: 589038 - RNA, 24 nt, Homo sapiens
ccuuucucucuccucucugcuuca

SEQ ID NO: 589039 - RNA, 16 nt, Homo sapiens
ccuuucuucaccaaau

SEQ ID NO: 589040 - RNA, 18 nt, Homo sapiens
ccuuucuugacaaaaccu

SEQ ID NO: 589041 - RNA, 22 nt, Homo sapiens
ccuuugaaguagacucauucuu

SEQ ID NO: 589042 - RNA, 21 nt, Homo sapiens
ccuuugagcccacaaagccuu

SEQ ID NO: 589043 - RNA, 22 nt, Homo sapiens
ccuuugagcugcugacugccaa

SEQ ID NO: 589044 - RNA, 19 nt, Homo sapiens
ccuuugaguuuuguauuca

SEQ ID NO: 589045 - RNA, 19 nt, Homo sapiens
ccuuugccuuccaccccca

SEQ ID NO: 589046 - RNA, 12 nt, Homo sapiens
ccuuugcuaaug

SEQ ID NO: 589047 - RNA, 21 nt, Homo sapiens
ccuuugcuaaugcuaugcaaa

SEQ ID NO: 589048 - RNA, 19 nt, Homo sapiens
ccuuugcucccuguugcug

SEQ ID NO: 589049 - RNA, 19 nt, Homo sapiens
ccuuuggaugcacuuuaua

SEQ ID NO: 589050 - RNA, 21 nt, Homo sapiens
ccuuuguaaccacaacuuuca

SEQ ID NO: 589051 - RNA, 21 nt, Homo sapiens
ccuuuguauuauaaaagcuca

SEQ ID NO: 589052 - RNA, 19 nt, Homo sapiens
ccuuuguguagaaagccaa

SEQ ID NO: 589053 - RNA, 18 nt, Homo sapiens
ccuuuguguauucaucuu

SEQ ID NO: 589054 - RNA, 14 nt, Homo sapiens
ccuuuguuaccaua

SEQ ID NO: 589055 - RNA, 13 nt, Homo sapiens
ccuuuguugcaca

SEQ ID NO: 589056 - RNA, 14 nt, Homo sapiens
ccuuuuaacugcca

SEQ ID NO: 589057 - RNA, 21 nt, Homo sapiens
ccuuuuacagcucuuggcauu

SEQ ID NO: 589058 - RNA, 17 nt, Homo sapiens
ccuuuuaccacucccag

SEQ ID NO: 589059 - RNA, 14 nt, Homo sapiens
ccuuuuauaccugc

SEQ ID NO: 589060 - RNA, 14 nt, Homo sapiens
ccuuuucaaaaccu

SEQ ID NO: 589061 - RNA, 21 nt, Homo sapiens
ccuuuucacaauggaaaaccu

SEQ ID NO: 589062 - RNA, 11 nt, Homo sapiens
ccuuuucauag

SEQ ID NO: 589063 - RNA, 14 nt, Homo sapiens
ccuuuucaugauuu

SEQ ID NO: 589064 - RNA, 13 nt, Homo sapiens
ccuuuucauuuaa

SEQ ID NO: 589065 - RNA, 15 nt, Homo sapiens
ccuuuuccacuuuaa

SEQ ID NO: 589066 - RNA, 22 nt, Homo sapiens
ccuuuuccccaaccacagagaa

SEQ ID NO: 589067 - RNA, 13 nt, Homo sapiens
ccuuuucuguucu

SEQ ID NO: 589068 - RNA, 17 nt, Homo sapiens
ccuuuugaacuugucac

SEQ ID NO: 589069 - RNA, 16 nt, Homo sapiens
ccuuuugaccaaauaa

SEQ ID NO: 589070 - RNA, 20 nt, Homo sapiens
ccuuuugaccaaauaaagua

SEQ ID NO: 589071 - RNA, 17 nt, Homo sapiens
ccuuuuggaacauuucu

SEQ ID NO: 589072 - RNA, 12 nt, Homo sapiens
ccuuuugugcaa

SEQ ID NO: 589073 - RNA, 16 nt, Homo sapiens
ccuuuuucacuuugaa

SEQ ID NO: 589074 - RNA, 17 nt, Homo sapiens
ccuuuuuguuucaauga

SEQ ID NO: 589075 - RNA, 17 nt, Homo sapiens
ccuuuuuucaauaugca

SEQ ID NO: 589076 - RNA, 13 nt, Homo sapiens
cgaaaaaagagac

SEQ ID NO: 589077 - RNA, 12 nt, Homo sapiens
cgaaacaguaag

SEQ ID NO: 589078 - RNA, 10 nt, Homo sapiens
cgaaacugcc

SEQ ID NO: 589079 - RNA, 23 nt, Homo sapiens
cgaaagccucucaguacagcacu

SEQ ID NO: 589080 - RNA, 16 nt, Homo sapiens
cgaacaauucauauau

SEQ ID NO: 589081 - RNA, 15 nt, Homo sapiens
cgaacauucuuugcc

SEQ ID NO: 589082 - RNA, 13 nt, Homo sapiens
cgaacuguucaca

SEQ ID NO: 589083 - RNA, 20 nt, Homo sapiens
cgaacuguucacacugcaga

SEQ ID NO: 589084 - RNA, 19 nt, Homo sapiens
cgaagccuuauuucuagaa

SEQ ID NO: 589085 - RNA, 15 nt, Homo sapiens
cgaaggauauuguca

SEQ ID NO: 589086 - RNA, 14 nt, Homo sapiens
cgaaguagcuugcu

SEQ ID NO: 589087 - RNA, 14 nt, Homo sapiens
cgaaguguugcaug

SEQ ID NO: 589088 - RNA, 22 nt, Homo sapiens
cgaauaugaaugucacauuuga

SEQ ID NO: 589089 - RNA, 17 nt, Homo sapiens
cgaaucuacuaauucca

SEQ ID NO: 589090 - RNA, 23 nt, Homo sapiens
cgaaucuuccgauggaugaaucu

SEQ ID NO: 589091 - RNA, 13 nt, Homo sapiens
cgaaugacacugu

SEQ ID NO: 589092 - RNA, 23 nt, Homo sapiens
cgaaugcauuuggaaccaaaguc

SEQ ID NO: 589093 - RNA, 18 nt, Homo sapiens
cgaaugguuccauucucu

SEQ ID NO: 589094 - RNA, 12 nt, Homo sapiens
cgaauucauccc

SEQ ID NO: 589095 - RNA, 18 nt, Homo sapiens
cgaauuuuaucuguggag

SEQ ID NO: 589096 - RNA, 22 nt, Homo sapiens
cgacaaagccaaacucugccag

SEQ ID NO: 589097 - RNA, 12 nt, Homo sapiens
cgacacauuuac

SEQ ID NO: 589098 - RNA, 14 nt, Homo sapiens
cgacacauuuacca

SEQ ID NO: 589099 - RNA, 17 nt, Homo sapiens
cgacagcccaucaccuc

SEQ ID NO: 589100 - RNA, 20 nt, Homo sapiens
cgacaucuuggcguggcagc

SEQ ID NO: 589101 - RNA, 19 nt, Homo sapiens
cgaccaaggaugggccauc

SEQ ID NO: 589102 - RNA, 19 nt, Homo sapiens
cgaccacuuccaggggaac

SEQ ID NO: 589103 - RNA, 23 nt, Homo sapiens
cgacgguuucaaaccaggauuuu

SEQ ID NO: 589104 - RNA, 15 nt, Homo sapiens
cgacuacugcuccug

SEQ ID NO: 589105 - RNA, 21 nt, Homo sapiens
cgacuccugccugaguuucca

SEQ ID NO: 589106 - RNA, 15 nt, Homo sapiens
cgacugaagucagug

SEQ ID NO: 589107 - RNA, 16 nt, Homo sapiens
cgacugaugaaggcau

SEQ ID NO: 589108 - RNA, 22 nt, Homo sapiens
cgacugccugugaaguggaugg

SEQ ID NO: 589109 - RNA, 19 nt, Homo sapiens
cgacuuguuuuugcacaug

SEQ ID NO: 589110 - RNA, 12 nt, Homo sapiens
cgagaagccagg

SEQ ID NO: 589111 - RNA, 20 nt, Homo sapiens
cgagaccgggcccuggguuc

SEQ ID NO: 589112 - RNA, 17 nt, Homo sapiens
cgagacuccgucucaaa

SEQ ID NO: 589113 - RNA, 17 nt, Homo sapiens
cgagacugagaggcaga

SEQ ID NO: 589114 - RNA, 17 nt, Homo sapiens
cgagagcagacaccagc

SEQ ID NO: 589115 - RNA, 17 nt, Homo sapiens
cgagaucacaccacugu

SEQ ID NO: 589116 - RNA, 21 nt, Homo sapiens
cgagaucaugccauugcauuc

SEQ ID NO: 589117 - RNA, 19 nt, Homo sapiens
cgagaucgcgccacugcac

SEQ ID NO: 589118 - RNA, 20 nt, Homo sapiens
cgagauugcaccacugcacu

SEQ ID NO: 589119 - RNA, 21 nt, Homo sapiens
cgagcaccuccagccugaaca

SEQ ID NO: 589120 - RNA, 16 nt, Homo sapiens
cgagcacugaacuuug

SEQ ID NO: 589121 - RNA, 16 nt, Homo sapiens
cgagcacuguccagua

SEQ ID NO: 589122 - RNA, 15 nt, Homo sapiens
cgagcagaugaugcc

SEQ ID NO: 589123 - RNA, 23 nt, Homo sapiens
cgagccccucggcucuggaggca

SEQ ID NO: 589124 - RNA, 21 nt, Homo sapiens
cgagccucugguuuuccucug

SEQ ID NO: 589125 - RNA, 19 nt, Homo sapiens
cgagcugggggccaugagc

SEQ ID NO: 589126 - RNA, 14 nt, Homo sapiens
cgaggaaaagaaca

SEQ ID NO: 589127 - RNA, 14 nt, Homo sapiens
cgaggccacgcacc

SEQ ID NO: 589128 - RNA, 18 nt, Homo sapiens
cgaggccucucucaggag

SEQ ID NO: 589129 - RNA, 21 nt, Homo sapiens
cgaggcugagaaucagacuga

SEQ ID NO: 589130 - RNA, 20 nt, Homo sapiens
cgagggcaaagcggccucau

SEQ ID NO: 589131 - RNA, 20 nt, Homo sapiens
cgagggccgcccgcucccuu

SEQ ID NO: 589132 - RNA, 16 nt, Homo sapiens
cgagggcgccaugcag

SEQ ID NO: 589133 - RNA, 14 nt, Homo sapiens
cgagggcggccagg

SEQ ID NO: 589134 - RNA, 19 nt, Homo sapiens
cgaguaacuccccucaggg

SEQ ID NO: 589135 - RNA, 13 nt, Homo sapiens
cgaguaucuguaa

SEQ ID NO: 589136 - RNA, 15 nt, Homo sapiens
cgaguggccauggca

SEQ ID NO: 589137 - RNA, 16 nt, Homo sapiens
cgaguuuucugaccag

SEQ ID NO: 589138 - RNA, 24 nt, Homo sapiens
cgaucaagagaaucaacagaugau

SEQ ID NO: 589139 - RNA, 22 nt, Homo sapiens
cgaucaaguuguugacugugau

SEQ ID NO: 589140 - RNA, 17 nt, Homo sapiens
aaagcuuucaacaugua

SEQ ID NO: 589141 - RNA, 24 nt, Homo sapiens
aaagcuuugggggagugggcgcag

SEQ ID NO: 589142 - RNA, 20 nt, Homo sapiens
aaaggaaaaucacaucucca

SEQ ID NO: 589143 - RNA, 17 nt, Homo sapiens
aaaggaaacauugccau

SEQ ID NO: 589144 - RNA, 17 nt, Homo sapiens
aaaggaaaccacaguga

SEQ ID NO: 589145 - RNA, 22 nt, Homo sapiens
aaaggaaauaagagcagucaca

SEQ ID NO: 589146 - RNA, 14 nt, Homo sapiens
aaaggaagacuaga

SEQ ID NO: 589147 - RNA, 18 nt, Homo sapiens
aaaggacaacaguucuga

SEQ ID NO: 589148 - RNA, 22 nt, Homo sapiens
aaaggacaucagcaaacaggau

SEQ ID NO: 589149 - RNA, 12 nt, Homo sapiens
aaaggacgaugg

SEQ ID NO: 589150 - RNA, 15 nt, Homo sapiens
aaaggacucuccaaa

SEQ ID NO: 589151 - RNA, 12 nt, Homo sapiens
aaaggacuguaa

SEQ ID NO: 589152 - RNA, 16 nt, Homo sapiens
aaaggagaacuaucca

SEQ ID NO: 589153 - RNA, 17 nt, Homo sapiens
aaaggagaacuauccaa

SEQ ID NO: 589154 - RNA, 12 nt, Homo sapiens
aaaggagcauua

SEQ ID NO: 589155 - RNA, 15 nt, Homo sapiens
aaaggagccuugaua

SEQ ID NO: 589156 - RNA, 17 nt, Homo sapiens
aaaggauaauuauccaa

SEQ ID NO: 589157 - RNA, 15 nt, Homo sapiens
aaaggauaugcagua

SEQ ID NO: 589158 - RNA, 21 nt, Homo sapiens
aaaggaucucuauaacagauc

SEQ ID NO: 589159 - RNA, 13 nt, Homo sapiens
aaaggauuuuaca

SEQ ID NO: 589160 - RNA, 11 nt, Homo sapiens
aaaggcaguuc

SEQ ID NO: 589161 - RNA, 13 nt, Homo sapiens
aaaggcauaugca

SEQ ID NO: 589162 - RNA, 22 nt, Homo sapiens
aaaggcauccauagugcacuag

SEQ ID NO: 589163 - RNA, 15 nt, Homo sapiens
aaaggccacaggaga

SEQ ID NO: 589164 - RNA, 17 nt, Homo sapiens
aaaggcccccacuucuc

SEQ ID NO: 589165 - RNA, 17 nt, Homo sapiens
aaaggcccuuuucaggg

SEQ ID NO: 589166 - RNA, 15 nt, Homo sapiens
aaaggccgggugaca

SEQ ID NO: 589167 - RNA, 15 nt, Homo sapiens
aaaggccucuuguaa

SEQ ID NO: 589168 - RNA, 19 nt, Homo sapiens
aaaggcgguacuaguucag

SEQ ID NO: 589169 - RNA, 15 nt, Homo sapiens
aaaggcucagucuca

SEQ ID NO: 589170 - RNA, 19 nt, Homo sapiens
aaaggcugauuacugaaau

SEQ ID NO: 589171 - RNA, 21 nt, Homo sapiens
aaagggaacacaaaacauuua

SEQ ID NO: 589172 - RNA, 18 nt, Homo sapiens
aaagggaaugggucugca

SEQ ID NO: 589173 - RNA, 16 nt, Homo sapiens
aaagggaccaucugcu

SEQ ID NO: 589174 - RNA, 20 nt, Homo sapiens
aaagggagaauaaaauuccu

SEQ ID NO: 589175 - RNA, 16 nt, Homo sapiens
aaagggagugcaugug

SEQ ID NO: 589176 - RNA, 16 nt, Homo sapiens
aaagggccauguuuca

SEQ ID NO: 589177 - RNA, 21 nt, Homo sapiens
aaagggccugcccagacaaga

SEQ ID NO: 589178 - RNA, 20 nt, Homo sapiens
aaaggggcccaagccccauc

SEQ ID NO: 589179 - RNA, 13 nt, Homo sapiens
aaagggggcugca

SEQ ID NO: 589180 - RNA, 15 nt, Homo sapiens
aaaggguaauuuccu

SEQ ID NO: 589181 - RNA, 16 nt, Homo sapiens
aaagguacacugguau

SEQ ID NO: 589182 - RNA, 23 nt, Homo sapiens
aaagguacgauuauacuugagau

SEQ ID NO: 589183 - RNA, 14 nt, Homo sapiens
aaagguaugcauuu

SEQ ID NO: 589184 - RNA, 14 nt, Homo sapiens
aaaggucuguuaau

SEQ ID NO: 589185 - RNA, 12 nt, Homo sapiens
aaaggucuuaaa

SEQ ID NO: 589186 - RNA, 18 nt, Homo sapiens
aaagguuaaaacaaaaac

SEQ ID NO: 589187 - RNA, 14 nt, Homo sapiens
aaagguugcagugc

SEQ ID NO: 589188 - RNA, 23 nt, Homo sapiens
aaagguuggccuuaguagucaaa

SEQ ID NO: 589189 - RNA, 13 nt, Homo sapiens
aaagguuguguag

SEQ ID NO: 589190 - RNA, 23 nt, Homo sapiens
aaagguuucauguucacugugag

SEQ ID NO: 589191 - RNA, 19 nt, Homo sapiens
aaagguuuuggaucuugaa

SEQ ID NO: 589192 - RNA, 19 nt, Homo sapiens
aaaguaaaaacacuaccuc

SEQ ID NO: 589193 - RNA, 17 nt, Homo sapiens
aaaguaaauucauguaa

SEQ ID NO: 589194 - RNA, 15 nt, Homo sapiens
aaaguaacacaaaca

SEQ ID NO: 589195 - RNA, 17 nt, Homo sapiens
aaaguaagcauuuccag

SEQ ID NO: 589196 - RNA, 19 nt, Homo sapiens
aaaguaaguuaauaaugua

SEQ ID NO: 589197 - RNA, 19 nt, Homo sapiens
aaaguaauauaaugaugcu

SEQ ID NO: 589198 - RNA, 14 nt, Homo sapiens
aaaguacaaaaauu

SEQ ID NO: 589199 - RNA, 17 nt, Homo sapiens
aaaguacaagagcuuaa

SEQ ID NO: 589200 - RNA, 13 nt, Homo sapiens
aaaguacagaaaa

SEQ ID NO: 589201 - RNA, 13 nt, Homo sapiens
aaaguacauaaca

SEQ ID NO: 589202 - RNA, 21 nt, Homo sapiens
aaaguacauugcuuaaaauau

SEQ ID NO: 589203 - RNA, 13 nt, Homo sapiens
aaaguaccacaca

SEQ ID NO: 589204 - RNA, 15 nt, Homo sapiens
aaaguaccacacaaa

SEQ ID NO: 589205 - RNA, 18 nt, Homo sapiens
aaaguaccacacugaguu

SEQ ID NO: 589206 - RNA, 17 nt, Homo sapiens
aaaguacccucuuuuac

SEQ ID NO: 589207 - RNA, 21 nt, Homo sapiens
aaaguagaggaauccauguaa

SEQ ID NO: 589208 - RNA, 13 nt, Homo sapiens
aaaguagauugag

SEQ ID NO: 589209 - RNA, 19 nt, Homo sapiens
aaaguagguuuacauucau

SEQ ID NO: 589210 - RNA, 14 nt, Homo sapiens
aaaguaguauugca

SEQ ID NO: 589211 - RNA, 16 nt, Homo sapiens
aaaguauaaaauagua

SEQ ID NO: 589212 - RNA, 21 nt, Homo sapiens
aaaguauagauggccaaagga

SEQ ID NO: 589213 - RNA, 13 nt, Homo sapiens
aaaguaucuuuaa

SEQ ID NO: 589214 - RNA, 18 nt, Homo sapiens
aaaguauguuguacauac

SEQ ID NO: 589215 - RNA, 17 nt, Homo sapiens
aaaguauuagaaauauu

SEQ ID NO: 589216 - RNA, 15 nt, Homo sapiens
aaaguauuauucaaa

SEQ ID NO: 589217 - RNA, 11 nt, Homo sapiens
aaaguauucca

SEQ ID NO: 589218 - RNA, 22 nt, Homo sapiens
aaagucaauaaaagagcugucu

SEQ ID NO: 589219 - RNA, 23 nt, Homo sapiens
aaagucagugcccaacuguuaua

SEQ ID NO: 589220 - RNA, 17 nt, Homo sapiens
aaagucccaacccaaug

SEQ ID NO: 589221 - RNA, 16 nt, Homo sapiens
aaagucuauucaaaag

SEQ ID NO: 589222 - RNA, 14 nt, Homo sapiens
aaagugaaaucaga

SEQ ID NO: 589223 - RNA, 17 nt, Homo sapiens
aaagugacucucacuaa

SEQ ID NO: 589224 - RNA, 12 nt, Homo sapiens
aaagugcaauua

SEQ ID NO: 589225 - RNA, 17 nt, Homo sapiens
aaagugcagcccuuccu

SEQ ID NO: 589226 - RNA, 11 nt, Homo sapiens
aaagugcauau

SEQ ID NO: 589227 - RNA, 21 nt, Homo sapiens
aaagugcauaugaaauccuug

SEQ ID NO: 589228 - RNA, 18 nt, Homo sapiens
aaagugcauauuuaucca

SEQ ID NO: 589229 - RNA, 20 nt, Homo sapiens
aaagugccagaaaguguuua

SEQ ID NO: 589230 - RNA, 19 nt, Homo sapiens
aaagugcugagauugcaga

SEQ ID NO: 589231 - RNA, 22 nt, Homo sapiens
aaagugcugauaaguagcauga

SEQ ID NO: 589232 - RNA, 21 nt, Homo sapiens
aaagugcugggauuacaggca

SEQ ID NO: 589233 - RNA, 15 nt, Homo sapiens
aaagugcuuuccaug

SEQ ID NO: 589234 - RNA, 18 nt, Homo sapiens
aaaguggacaaggagugu

SEQ ID NO: 589235 - RNA, 15 nt, Homo sapiens
aaaguggcaaucuca

SEQ ID NO: 589236 - RNA, 14 nt, Homo sapiens
aaaguggccaugcc

SEQ ID NO: 589237 - RNA, 19 nt, Homo sapiens
aaaguguaacaauugugua

SEQ ID NO: 589238 - RNA, 17 nt, Homo sapiens
aaaguguaaguucacaa

SEQ ID NO: 589239 - RNA, 19 nt, Homo sapiens
aaaguguaauagcauacau

SEQ ID NO: 589240 - RNA, 17 nt, Homo sapiens
aaaguguaccaacauaa

SEQ ID NO: 589241 - RNA, 16 nt, Homo sapiens
aaagugucuacaugug

SEQ ID NO: 589242 - RNA, 17 nt, Homo sapiens
aaagugugucacccuuu

SEQ ID NO: 589243 - RNA, 13 nt, Homo sapiens
aaaguuaagcaaa

SEQ ID NO: 589244 - RNA, 19 nt, Homo sapiens
aaaguuaauaacagcuccu

SEQ ID NO: 589245 - RNA, 22 nt, Homo sapiens
aaaguuaauucucaccauuccu

SEQ ID NO: 589246 - RNA, 15 nt, Homo sapiens
aaaguuacaaacaga

SEQ ID NO: 589247 - RNA, 23 nt, Homo sapiens
aaaguuaccuggaaucaaauaaa

SEQ ID NO: 589248 - RNA, 19 nt, Homo sapiens
aaaguuacuugaauuucaa

SEQ ID NO: 589249 - RNA, 20 nt, Homo sapiens
aaaguuagucaauccuguca

SEQ ID NO: 589250 - RNA, 17 nt, Homo sapiens
aaaguuauauucacagu

SEQ ID NO: 589251 - RNA, 21 nt, Homo sapiens
aaaguuauauucacaguuuuu

SEQ ID NO: 589252 - RNA, 17 nt, Homo sapiens
aaaguuccccugugaca

SEQ ID NO: 589253 - RNA, 22 nt, Homo sapiens
aaaguucggugcuacuccaguu

SEQ ID NO: 589254 - RNA, 22 nt, Homo sapiens
aaaguucugacuugacuuuagu

SEQ ID NO: 589255 - RNA, 17 nt, Homo sapiens
aaaguucuucauaucau

SEQ ID NO: 589256 - RNA, 21 nt, Homo sapiens
aaaguugcuuuuauugcacca

SEQ ID NO: 589257 - RNA, 15 nt, Homo sapiens
aaaguuguuugugcc

SEQ ID NO: 589258 - RNA, 14 nt, Homo sapiens
aaaguuuguugaaa

SEQ ID NO: 589259 - RNA, 21 nt, Homo sapiens
aaaguuuuaggguacaguuug

SEQ ID NO: 589260 - RNA, 16 nt, Homo sapiens
aaauaaaaaagcaaaa

SEQ ID NO: 589261 - RNA, 14 nt, Homo sapiens
aaauaaaaacuuau

SEQ ID NO: 589262 - RNA, 20 nt, Homo sapiens
aaauaaaaagccucagugac

SEQ ID NO: 589263 - RNA, 18 nt, Homo sapiens
aaauaaaaaggaaguacu

SEQ ID NO: 589264 - RNA, 16 nt, Homo sapiens
aaauaaaaaucucuuu

SEQ ID NO: 589265 - RNA, 14 nt, Homo sapiens
aaauaaaacugaau

SEQ ID NO: 589266 - RNA, 23 nt, Homo sapiens
aaauaaaagaucuugaauagucu

SEQ ID NO: 589267 - RNA, 15 nt, Homo sapiens
aaauaaaaugacguc

SEQ ID NO: 589268 - RNA, 13 nt, Homo sapiens
aaauaaacacaca

SEQ ID NO: 589269 - RNA, 14 nt, Homo sapiens
aaauaaacaucagu

SEQ ID NO: 589270 - RNA, 18 nt, Homo sapiens
aaauaaagaaauugcaau

SEQ ID NO: 589271 - RNA, 19 nt, Homo sapiens
aaauaaagaucacacauca

SEQ ID NO: 589272 - RNA, 18 nt, Homo sapiens
aaauaaaguaccacacau

SEQ ID NO: 589273 - RNA, 17 nt, Homo sapiens
aaauaaaguaucaugca

SEQ ID NO: 589274 - RNA, 16 nt, Homo sapiens
aaauaaauauaccacu

SEQ ID NO: 589275 - RNA, 13 nt, Homo sapiens
aaauaaaugacaa

SEQ ID NO: 589276 - RNA, 16 nt, Homo sapiens
aaauaaauuugcacug

SEQ ID NO: 589277 - RNA, 15 nt, Homo sapiens
aaauaacaggcauuu

SEQ ID NO: 589278 - RNA, 12 nt, Homo sapiens
aaauaacauugc

SEQ ID NO: 589279 - RNA, 16 nt, Homo sapiens
aaauaacgccccagau

SEQ ID NO: 589280 - RNA, 12 nt, Homo sapiens
aaauaacuagua

SEQ ID NO: 589281 - RNA, 15 nt, Homo sapiens
aaauaacuaguacaa

SEQ ID NO: 589282 - RNA, 12 nt, Homo sapiens
aaauaacuggaa

SEQ ID NO: 589283 - RNA, 13 nt, Homo sapiens
aaauaacuggaaa

SEQ ID NO: 589284 - RNA, 15 nt, Homo sapiens
aaauaagaaugauuu

SEQ ID NO: 589285 - RNA, 16 nt, Homo sapiens
aaauaaggaauuuccu

SEQ ID NO: 589286 - RNA, 23 nt, Homo sapiens
aaauaaggacaagccuaacuuca

SEQ ID NO: 589287 - RNA, 15 nt, Homo sapiens
aaauaagggcuuuaa

SEQ ID NO: 589288 - RNA, 18 nt, Homo sapiens
aaauaauaaaaugcaaau

SEQ ID NO: 589289 - RNA, 12 nt, Homo sapiens
aaauaauaugca

SEQ ID NO: 589290 - RNA, 14 nt, Homo sapiens
aaauaaucagugac

SEQ ID NO: 589291 - RNA, 20 nt, Homo sapiens
aaauaauuauauaacuguau

SEQ ID NO: 589292 - RNA, 15 nt, Homo sapiens
aaauaauuauuuucc

SEQ ID NO: 589293 - RNA, 12 nt, Homo sapiens
aaauaauuugaa

SEQ ID NO: 589294 - RNA, 13 nt, Homo sapiens
aaauacaacacug

SEQ ID NO: 589295 - RNA, 16 nt, Homo sapiens
aaauacaagacugcca

SEQ ID NO: 589296 - RNA, 21 nt, Homo sapiens
aaauacaauaaacuuacuaua

SEQ ID NO: 589297 - RNA, 14 nt, Homo sapiens
aaauacacaaugaa

SEQ ID NO: 589298 - RNA, 21 nt, Homo sapiens
aaauacagucuuccauuugca

SEQ ID NO: 589299 - RNA, 16 nt, Homo sapiens
aaauaccaaguauuua

SEQ ID NO: 589300 - RNA, 19 nt, Homo sapiens
aaauaccagugaaccaaag

SEQ ID NO: 589301 - RNA, 20 nt, Homo sapiens
aaauaccucuuagcugagug

SEQ ID NO: 589302 - RNA, 14 nt, Homo sapiens
aaauacuaccuaua

SEQ ID NO: 589303 - RNA, 9 nt, Homo sapiens
aaauacuug

SEQ ID NO: 589304 - RNA, 22 nt, Homo sapiens
aaauacuuuuguacuuaaucca

SEQ ID NO: 589305 - RNA, 23 nt, Homo sapiens
aaauacuuuuucaguuguuuaga

SEQ ID NO: 589306 - RNA, 19 nt, Homo sapiens
aaauagaacaaccugcaca

SEQ ID NO: 589307 - RNA, 15 nt, Homo sapiens
aaauagaacauucca

SEQ ID NO: 589308 - RNA, 14 nt, Homo sapiens
aaauagacauguag

SEQ ID NO: 589309 - RNA, 23 nt, Homo sapiens
aaauagagcuuuuaaaaaugucc

SEQ ID NO: 589310 - RNA, 14 nt, Homo sapiens
aaauagaugacaaa

SEQ ID NO: 589311 - RNA, 19 nt, Homo sapiens
aaauagauuucuuugcaca

SEQ ID NO: 589312 - RNA, 14 nt, Homo sapiens
aaauagcaaaagaa

SEQ ID NO: 589313 - RNA, 14 nt, Homo sapiens
aaauagccccagac

SEQ ID NO: 589314 - RNA, 15 nt, Homo sapiens
aaauagcugccuuuu

SEQ ID NO: 589315 - RNA, 11 nt, Homo sapiens
aaauagcuuua

SEQ ID NO: 589316 - RNA, 15 nt, Homo sapiens
aaauaggauccugga

SEQ ID NO: 589317 - RNA, 14 nt, Homo sapiens
aaauaguaauguga

SEQ ID NO: 589318 - RNA, 21 nt, Homo sapiens
aaauaguaccuucaauacuua

SEQ ID NO: 589319 - RNA, 14 nt, Homo sapiens
aaauauaacaggug

SEQ ID NO: 589320 - RNA, 21 nt, Homo sapiens
aaauauaauuauccaaauuga

SEQ ID NO: 589321 - RNA, 18 nt, Homo sapiens
aaauauacaaaacuuuau

SEQ ID NO: 589322 - RNA, 13 nt, Homo sapiens
aaauauacauuca

SEQ ID NO: 589323 - RNA, 14 nt, Homo sapiens
aaauauacauucaa

SEQ ID NO: 589324 - RNA, 15 nt, Homo sapiens
aaauauauaagcuca

SEQ ID NO: 589325 - RNA, 15 nt, Homo sapiens
aaauauauaugauau

SEQ ID NO: 589326 - RNA, 22 nt, Homo sapiens
aaauauauauuauauauuuaca

SEQ ID NO: 589327 - RNA, 17 nt, Homo sapiens
aaauaucauaaagcauu

SEQ ID NO: 589328 - RNA, 16 nt, Homo sapiens
aaauaucauuuacucu

SEQ ID NO: 589329 - RNA, 15 nt, Homo sapiens
aaauaucccagagaa

SEQ ID NO: 589330 - RNA, 20 nt, Homo sapiens
aaauaucuccuccaaugucc

SEQ ID NO: 589331 - RNA, 15 nt, Homo sapiens
aaauaucugucauau

SEQ ID NO: 589332 - RNA, 17 nt, Homo sapiens
aaauaugccuaguaaca

SEQ ID NO: 589333 - RNA, 16 nt, Homo sapiens
aaauauggaacuuaca

SEQ ID NO: 589334 - RNA, 20 nt, Homo sapiens
aaauauggaacuucuaauau

SEQ ID NO: 589335 - RNA, 16 nt, Homo sapiens
aaauauggacugcuca

SEQ ID NO: 589336 - RNA, 16 nt, Homo sapiens
aaauauguauaugaca

SEQ ID NO: 589337 - RNA, 22 nt, Homo sapiens
aaauaugugcuugaaaugagaa

SEQ ID NO: 589338 - RNA, 19 nt, Homo sapiens
aaauauuaauauccuguaa

SEQ ID NO: 589339 - RNA, 19 nt, Homo sapiens
aaauauuagaagccugcag

SEQ ID NO: 589340 - RNA, 13 nt, Homo sapiens
aaauauuccugca

SEQ ID NO: 589341 - RNA, 13 nt, Homo sapiens
aaauauucucucu

SEQ ID NO: 589342 - RNA, 12 nt, Homo sapiens
aaauauugucau

SEQ ID NO: 589343 - RNA, 16 nt, Homo sapiens
aaauauuuagauguaa

SEQ ID NO: 589344 - RNA, 21 nt, Homo sapiens
aaauauuuauaaaacuucuca

SEQ ID NO: 589345 - RNA, 15 nt, Homo sapiens
aaauauuuaugagaa

SEQ ID NO: 589346 - RNA, 20 nt, Homo sapiens
aaauauuuauugucuguaaa

SEQ ID NO: 589347 - RNA, 12 nt, Homo sapiens
aaauauuucaca

SEQ ID NO: 589348 - RNA, 20 nt, Homo sapiens
aaauauuuccuuaaacugug

SEQ ID NO: 589349 - RNA, 17 nt, Homo sapiens
aaauauuugacuugcau

SEQ ID NO: 589350 - RNA, 12 nt, Homo sapiens
aaaucaaaaagg

SEQ ID NO: 589351 - RNA, 14 nt, Homo sapiens
aaaucaaagauuug

SEQ ID NO: 589352 - RNA, 16 nt, Homo sapiens
aaaucaaauauauguc

SEQ ID NO: 589353 - RNA, 19 nt, Homo sapiens
aaaucaacccugcaaucac

SEQ ID NO: 589354 - RNA, 18 nt, Homo sapiens
aaaucaauacacuaguug

SEQ ID NO: 589355 - RNA, 14 nt, Homo sapiens
aaaucaauguguac

SEQ ID NO: 589356 - RNA, 19 nt, Homo sapiens
aaaucacaaggcaacugug

SEQ ID NO: 589357 - RNA, 22 nt, Homo sapiens
aaaucacacagccaagccaguc

SEQ ID NO: 589358 - RNA, 19 nt, Homo sapiens
aaaucacguugcugguggu

SEQ ID NO: 589359 - RNA, 16 nt, Homo sapiens
aaaucacucacaagca

SEQ ID NO: 589360 - RNA, 16 nt, Homo sapiens
aaaucacucucagugc

SEQ ID NO: 589361 - RNA, 21 nt, Homo sapiens
aaaucagacccacaacgaaug

SEQ ID NO: 589362 - RNA, 14 nt, Homo sapiens
aaaucagagacaaa

SEQ ID NO: 589363 - RNA, 23 nt, Homo sapiens
aaaucagcaugcccgccuaguua

SEQ ID NO: 589364 - RNA, 17 nt, Homo sapiens
aaaucagcugcuacuac

SEQ ID NO: 589365 - RNA, 22 nt, Homo sapiens
aaaucagugccugguguucuga

SEQ ID NO: 589366 - RNA, 14 nt, Homo sapiens
aaaucaguuacuaa

SEQ ID NO: 589367 - RNA, 13 nt, Homo sapiens
aaaucauagcugg

SEQ ID NO: 589368 - RNA, 18 nt, Homo sapiens
aaaucauuucaguaucau

SEQ ID NO: 589369 - RNA, 21 nt, Homo sapiens
aaaucauuucaguaucaucuc

SEQ ID NO: 589370 - RNA, 16 nt, Homo sapiens
aaauccagaacucaaa

SEQ ID NO: 589371 - RNA, 18 nt, Homo sapiens
aaauccagugagcacuag

SEQ ID NO: 589372 - RNA, 15 nt, Homo sapiens
aaauccaguuuccca

SEQ ID NO: 589373 - RNA, 15 nt, Homo sapiens
aaauccauaucuuaa

SEQ ID NO: 589374 - RNA, 20 nt, Homo sapiens
aaauccauuccagguagcuc

SEQ ID NO: 589375 - RNA, 22 nt, Homo sapiens
aaauccccucagccucuucucu

SEQ ID NO: 589376 - RNA, 23 nt, Homo sapiens
aaaucccuuucaugucuuuccac

SEQ ID NO: 589377 - RNA, 17 nt, Homo sapiens
aaauccuaagacacaaa

SEQ ID NO: 589378 - RNA, 16 nt, Homo sapiens
aaauccuagacuugaa

SEQ ID NO: 589379 - RNA, 23 nt, Homo sapiens
aaauccucagguaguacugggaa

SEQ ID NO: 589380 - RNA, 22 nt, Homo sapiens
aaauccuggaaggacacaguga

SEQ ID NO: 589381 - RNA, 23 nt, Homo sapiens
aaauccuggaaggacacagugau

SEQ ID NO: 589382 - RNA, 11 nt, Homo sapiens
aaauccuugau

SEQ ID NO: 589383 - RNA, 14 nt, Homo sapiens
aaaucgugccuugu

SEQ ID NO: 589384 - RNA, 17 nt, Homo sapiens
aaaucuaauaauuauuc

SEQ ID NO: 589385 - RNA, 17 nt, Homo sapiens
aaaucuagaagacuguc

SEQ ID NO: 589386 - RNA, 23 nt, Homo sapiens
aaaucuauguguuuuagacuuag

SEQ ID NO: 589387 - RNA, 15 nt, Homo sapiens
aaaucucacagaugu

SEQ ID NO: 589388 - RNA, 16 nt, Homo sapiens
aaaucucagcaaugau

SEQ ID NO: 589389 - RNA, 14 nt, Homo sapiens
aaaucuccaucuca

SEQ ID NO: 589390 - RNA, 20 nt, Homo sapiens
aaaucugagaaacucuacau

SEQ ID NO: 589391 - RNA, 18 nt, Homo sapiens
aaaucugccaugagcaca

SEQ ID NO: 589392 - RNA, 18 nt, Homo sapiens
aaaucuguguaacuguaa

SEQ ID NO: 589393 - RNA, 18 nt, Homo sapiens
aaaucuguuuauaugaca

SEQ ID NO: 589394 - RNA, 18 nt, Homo sapiens
aaaucuguuucaacagau

SEQ ID NO: 589395 - RNA, 21 nt, Homo sapiens
aaaucuguuuuucuaacuggg

SEQ ID NO: 589396 - RNA, 22 nt, Homo sapiens
aaaucuuaaaagcccuaaguga

SEQ ID NO: 589397 - RNA, 16 nt, Homo sapiens
aaaucuugucuuacca

SEQ ID NO: 589398 - RNA, 19 nt, Homo sapiens
aaaucuuuggauuugauca

SEQ ID NO: 589399 - RNA, 19 nt, Homo sapiens
aaaucuuuuaaaaauucaa

SEQ ID NO: 589400 - RNA, 23 nt, Homo sapiens
aaaucuuuuugcuucuacuuuca

SEQ ID NO: 589401 - RNA, 20 nt, Homo sapiens
aaaugaaaagagaaugaugc

SEQ ID NO: 589402 - RNA, 17 nt, Homo sapiens
aaaugaaaaugucuugu

SEQ ID NO: 589403 - RNA, 15 nt, Homo sapiens
aaaugaaaauuccau

SEQ ID NO: 589404 - RNA, 16 nt, Homo sapiens
aaaugaaauccaguga

SEQ ID NO: 589405 - RNA, 17 nt, Homo sapiens
aaaugaaguauuucuca

SEQ ID NO: 589406 - RNA, 16 nt, Homo sapiens
aaaugaauaaugccuu

SEQ ID NO: 589407 - RNA, 24 nt, Homo sapiens
aaaugaauagccaggccugaccuc

SEQ ID NO: 589408 - RNA, 14 nt, Homo sapiens
aaaugaauguuguc

SEQ ID NO: 589409 - RNA, 15 nt, Homo sapiens
aaaugaccuaucaaa

SEQ ID NO: 589410 - RNA, 17 nt, Homo sapiens
aaaugaccuguuuucac

SEQ ID NO: 589411 - RNA, 20 nt, Homo sapiens
aaaugacuauuucuacccuu

SEQ ID NO: 589412 - RNA, 13 nt, Homo sapiens
aaaugagaacuaa

SEQ ID NO: 589413 - RNA, 14 nt, Homo sapiens
aaaugagcaaaagu

SEQ ID NO: 589414 - RNA, 20 nt, Homo sapiens
aaaugagcaccagugguacu

SEQ ID NO: 589415 - RNA, 15 nt, Homo sapiens
aaaugagccaugaga

SEQ ID NO: 589416 - RNA, 20 nt, Homo sapiens
aaaugaggagguacauugaa

SEQ ID NO: 589417 - RNA, 17 nt, Homo sapiens
aaaugagggaagaacau

SEQ ID NO: 589418 - RNA, 13 nt, Homo sapiens
aaaugaguauuuc

SEQ ID NO: 589419 - RNA, 14 nt, Homo sapiens
aaaugagugcuuaa

SEQ ID NO: 589420 - RNA, 15 nt, Homo sapiens
aaaugagugcuuaaa

SEQ ID NO: 589421 - RNA, 19 nt, Homo sapiens
aaaugauaaggcucugaaa

SEQ ID NO: 589422 - RNA, 21 nt, Homo sapiens
aaaugauaagugacaaaagca

SEQ ID NO: 589423 - RNA, 17 nt, Homo sapiens
aaaugaucgcuaucuag

SEQ ID NO: 589424 - RNA, 22 nt, Homo sapiens
aaaugauugacaguaaguuuau

SEQ ID NO: 589425 - RNA, 15 nt, Homo sapiens
aaaugauugugccuc

SEQ ID NO: 589426 - RNA, 12 nt, Homo sapiens
aaaugauuucag

SEQ ID NO: 589427 - RNA, 17 nt, Homo sapiens
aaaugcaaagcacaccu

SEQ ID NO: 589428 - RNA, 21 nt, Homo sapiens
aaaugcagacaacaccuuccu

SEQ ID NO: 589429 - RNA, 14 nt, Homo sapiens
aaaugcagugaauu

SEQ ID NO: 589430 - RNA, 17 nt, Homo sapiens
aaaugcauggugcaguu

SEQ ID NO: 589431 - RNA, 11 nt, Homo sapiens
aaaugcauucg

SEQ ID NO: 589432 - RNA, 20 nt, Homo sapiens
aaaugccacuucaccaagga

SEQ ID NO: 589433 - RNA, 21 nt, Homo sapiens
aaaugcccaaaagagguguca

SEQ ID NO: 589434 - RNA, 17 nt, Homo sapiens
aaaugcccccauucucc

SEQ ID NO: 589435 - RNA, 13 nt, Homo sapiens
aaaugccucagcu

SEQ ID NO: 589436 - RNA, 16 nt, Homo sapiens
aaaugccucagcuaug

SEQ ID NO: 589437 - RNA, 19 nt, Homo sapiens
aaaugccugcuuugaauaa

SEQ ID NO: 589438 - RNA, 18 nt, Homo sapiens
aaaugccugucucuagcu

SEQ ID NO: 589439 - RNA, 17 nt, Homo sapiens
aaaugcucaauuucagc

SEQ ID NO: 589440 - RNA, 18 nt, Homo sapiens
aaaugcucaauuucagca

SEQ ID NO: 589441 - RNA, 17 nt, Homo sapiens
aaaugcugcaggauuaa

SEQ ID NO: 589442 - RNA, 16 nt, Homo sapiens
aaaugcugguuuuuca

SEQ ID NO: 589443 - RNA, 14 nt, Homo sapiens
aaaugcuguagaag

SEQ ID NO: 589444 - RNA, 20 nt, Homo sapiens
aaaugcugucccuauacacu

SEQ ID NO: 589445 - RNA, 22 nt, Homo sapiens
aaauggaacuaucuccaaauuu

SEQ ID NO: 589446 - RNA, 19 nt, Homo sapiens
aaauggaagcaaagacaaa

SEQ ID NO: 589447 - RNA, 18 nt, Homo sapiens
aaauggaccauccuugac

SEQ ID NO: 589448 - RNA, 14 nt, Homo sapiens
aaauggacuuucag

SEQ ID NO: 589449 - RNA, 18 nt, Homo sapiens
aaauggcaucagcacuuu

SEQ ID NO: 589450 - RNA, 21 nt, Homo sapiens
aaaugggggaaaaguuaguca

SEQ ID NO: 589451 - RNA, 18 nt, Homo sapiens
aaaugggggugcauuuga

SEQ ID NO: 589452 - RNA, 15 nt, Homo sapiens
aaauggguuuauuca

SEQ ID NO: 589453 - RNA, 17 nt, Homo sapiens
aaaugguagcauacuuu

SEQ ID NO: 589454 - RNA, 18 nt, Homo sapiens
aaaugguaggcauuuccu

SEQ ID NO: 589455 - RNA, 12 nt, Homo sapiens
aaauggucccaa

SEQ ID NO: 589456 - RNA, 11 nt, Homo sapiens
aaauggugguc

SEQ ID NO: 589457 - RNA, 21 nt, Homo sapiens
aaaugguucagaauuaaacuu

SEQ ID NO: 589458 - RNA, 15 nt, Homo sapiens
aaauguaaagccagc

SEQ ID NO: 589459 - RNA, 15 nt, Homo sapiens
aaauguaacugugcc

SEQ ID NO: 589460 - RNA, 20 nt, Homo sapiens
aaauguaauacuccuaagac

SEQ ID NO: 589461 - RNA, 13 nt, Homo sapiens
aaauguacacugg

SEQ ID NO: 589462 - RNA, 15 nt, Homo sapiens
aaauguacauuucca

SEQ ID NO: 589463 - RNA, 17 nt, Homo sapiens
aaauguaccggcuucca

SEQ ID NO: 589464 - RNA, 22 nt, Homo sapiens
aaauguaucauuuuugugcaca

SEQ ID NO: 589465 - RNA, 12 nt, Homo sapiens
aaauguaugugc

SEQ ID NO: 589466 - RNA, 16 nt, Homo sapiens
aaauguauuaaugcua

SEQ ID NO: 589467 - RNA, 19 nt, Homo sapiens
aaauguauucaaauaccaa

SEQ ID NO: 589468 - RNA, 14 nt, Homo sapiens
aaaugucaucaggu

SEQ ID NO: 589469 - RNA, 13 nt, Homo sapiens
aaauguccaugau

SEQ ID NO: 589470 - RNA, 20 nt, Homo sapiens
aaauguccucuugaagcaua

SEQ ID NO: 589471 - RNA, 21 nt, Homo sapiens
aaaugucucugcuccuacauc

SEQ ID NO: 589472 - RNA, 16 nt, Homo sapiens
aaaugucuggucuguc

SEQ ID NO: 589473 - RNA, 18 nt, Homo sapiens
aaaugucuggucugucca

SEQ ID NO: 589474 - RNA, 16 nt, Homo sapiens
aaaugucuuacuccug

SEQ ID NO: 589475 - RNA, 23 nt, Homo sapiens
aaaugucuugcuguugacauauu

SEQ ID NO: 589476 - RNA, 22 nt, Homo sapiens
aaaugugaagggucaacuccaa

SEQ ID NO: 589477 - RNA, 15 nt, Homo sapiens
aaaugugaauuucaa

SEQ ID NO: 589478 - RNA, 13 nt, Homo sapiens
aaaugugaugaau

SEQ ID NO: 589479 - RNA, 13 nt, Homo sapiens
aaaugugauuucc

SEQ ID NO: 589480 - RNA, 22 nt, Homo sapiens
aaaugugcacacauauacaugu

SEQ ID NO: 589481 - RNA, 22 nt, Homo sapiens
aaauguguaauuuuguuuauau

SEQ ID NO: 589482 - RNA, 21 nt, Homo sapiens
aaaugugucauuggaagccau

SEQ ID NO: 589483 - RNA, 19 nt, Homo sapiens
aaauguguuagcacugaua

SEQ ID NO: 589484 - RNA, 23 nt, Homo sapiens
aaauguuagaaaaauagcuguga

SEQ ID NO: 589485 - RNA, 18 nt, Homo sapiens
aaauguuaugacuaugua

SEQ ID NO: 589486 - RNA, 16 nt, Homo sapiens
aaauguucaagucaug

SEQ ID NO: 589487 - RNA, 19 nt, Homo sapiens
aaauguucagaagguugcu

SEQ ID NO: 589488 - RNA, 15 nt, Homo sapiens
aaauguucucaugaa

SEQ ID NO: 589489 - RNA, 20 nt, Homo sapiens
aaauguucucaugaacuacc

SEQ ID NO: 589490 - RNA, 18 nt, Homo sapiens
aaauguugagaaucccaa

SEQ ID NO: 589491 - RNA, 15 nt, Homo sapiens
aaauguugcuuuaac

SEQ ID NO: 589492 - RNA, 15 nt, Homo sapiens
aaauguuggagugga

SEQ ID NO: 589493 - RNA, 19 nt, Homo sapiens
aaauguuuauacguggaaa

SEQ ID NO: 589494 - RNA, 15 nt, Homo sapiens
aaauguuugaguauu

SEQ ID NO: 589495 - RNA, 20 nt, Homo sapiens
aaauguuuugaaaagaacaa

SEQ ID NO: 589496 - RNA, 18 nt, Homo sapiens
aaauuaaacaaauaugca

SEQ ID NO: 589497 - RNA, 20 nt, Homo sapiens
aaauuaaacaugcuguuacc

SEQ ID NO: 589498 - RNA, 17 nt, Homo sapiens
aaauuaaccuggucaau

SEQ ID NO: 589499 - RNA, 16 nt, Homo sapiens
aaauuaacugcuccaa

SEQ ID NO: 589500 - RNA, 12 nt, Homo sapiens
aaauuaagaagg

SEQ ID NO: 589501 - RNA, 12 nt, Homo sapiens
aaauuaagcauu

SEQ ID NO: 589502 - RNA, 21 nt, Homo sapiens
aaauuaaguuguaucauuuca

SEQ ID NO: 589503 - RNA, 20 nt, Homo sapiens
aaauuacacaguuaaugcca

SEQ ID NO: 589504 - RNA, 19 nt, Homo sapiens
aaauuacagcuucacccug

SEQ ID NO: 589505 - RNA, 12 nt, Homo sapiens
aaauuacaguca

SEQ ID NO: 589506 - RNA, 14 nt, Homo sapiens
aaauuacagucauc

SEQ ID NO: 589507 - RNA, 16 nt, Homo sapiens
aaauuacagugcaguu

SEQ ID NO: 589508 - RNA, 12 nt, Homo sapiens
aaauuacuaauu

SEQ ID NO: 589509 - RNA, 18 nt, Homo sapiens
aaauuacugauccucgca

SEQ ID NO: 589510 - RNA, 20 nt, Homo sapiens
aaauuacugcccacuuguca

SEQ ID NO: 589511 - RNA, 21 nt, Homo sapiens
aaauuacuucccccacuacuu

SEQ ID NO: 589512 - RNA, 20 nt, Homo sapiens
aaauuagaauuguguguuaa

SEQ ID NO: 589513 - RNA, 16 nt, Homo sapiens
aaauuaggacuguaua

SEQ ID NO: 589514 - RNA, 19 nt, Homo sapiens
aaauuauaucaaggucuca

SEQ ID NO: 589515 - RNA, 17 nt, Homo sapiens
aaauuaugagugauuaa

SEQ ID NO: 589516 - RNA, 14 nt, Homo sapiens
aaauuaugccauag

SEQ ID NO: 589517 - RNA, 16 nt, Homo sapiens
aaauuaugugacauuu

SEQ ID NO: 589518 - RNA, 19 nt, Homo sapiens
aaauuauuacuaaugaugc

SEQ ID NO: 589519 - RNA, 18 nt, Homo sapiens
aaauuauuagaacauuca

SEQ ID NO: 589520 - RNA, 22 nt, Homo sapiens
aaauuauuguuaaagaauacac

SEQ ID NO: 589521 - RNA, 22 nt, Homo sapiens
aaauuauuuauuacuugugcac

SEQ ID NO: 589522 - RNA, 23 nt, Homo sapiens
aaauuauuuauuacuugugcacu

SEQ ID NO: 589523 - RNA, 19 nt, Homo sapiens
aaauucaaauuauucuacc

SEQ ID NO: 589524 - RNA, 21 nt, Homo sapiens
aaauucacagcgcuaugcaau

SEQ ID NO: 589525 - RNA, 13 nt, Homo sapiens
aaauucacuuuca

SEQ ID NO: 589526 - RNA, 15 nt, Homo sapiens
aaauucagaugcugu

SEQ ID NO: 589527 - RNA, 14 nt, Homo sapiens
aaauucaucuagac

SEQ ID NO: 589528 - RNA, 13 nt, Homo sapiens
aaauucauuauuc

SEQ ID NO: 589529 - RNA, 20 nt, Homo sapiens
aaauucauuugcuugcaauc

SEQ ID NO: 589530 - RNA, 20 nt, Homo sapiens
aaauuccacacuaccacauu

SEQ ID NO: 589531 - RNA, 19 nt, Homo sapiens
aaauuccacagauuaucaa

SEQ ID NO: 589532 - RNA, 19 nt, Homo sapiens
aaauuccaguaaauccuca

SEQ ID NO: 589533 - RNA, 16 nt, Homo sapiens
aaauuccuccuucccc

SEQ ID NO: 589534 - RNA, 12 nt, Homo sapiens
aaauuccuguag

SEQ ID NO: 589535 - RNA, 13 nt, Homo sapiens
aaauucuaauggu

SEQ ID NO: 589536 - RNA, 15 nt, Homo sapiens
aaauucuacaacuuu

SEQ ID NO: 589537 - RNA, 18 nt, Homo sapiens
aaauucuaguguccauaa

SEQ ID NO: 589538 - RNA, 21 nt, Homo sapiens
aaauucuauaggaacauauga

SEQ ID NO: 589539 - RNA, 22 nt, Homo sapiens
aaauucucuuaaucacuacugu

SEQ ID NO: 589540 - RNA, 17 nt, Homo sapiens
aaauucugaugagcauu

SEQ ID NO: 589541 - RNA, 21 nt, Homo sapiens
aaauucugguauacauugaau

SEQ ID NO: 589542 - RNA, 16 nt, Homo sapiens
aaauucugucaggggu

SEQ ID NO: 589543 - RNA, 15 nt, Homo sapiens
aaauugacagaucaa

SEQ ID NO: 589544 - RNA, 14 nt, Homo sapiens
aaauugcaaucuac

SEQ ID NO: 589545 - RNA, 14 nt, Homo sapiens
aaauugcagaauuc

SEQ ID NO: 589546 - RNA, 14 nt, Homo sapiens
aaauugccugcaaa

SEQ ID NO: 589547 - RNA, 22 nt, Homo sapiens
aaauugcuuuugaaaaacaacu

SEQ ID NO: 589548 - RNA, 16 nt, Homo sapiens
aaauugggcaugccau

SEQ ID NO: 589549 - RNA, 22 nt, Homo sapiens
aaauuguaucaaaugugacauu

SEQ ID NO: 589550 - RNA, 22 nt, Homo sapiens
aaauuguauuaucaacagcauu

SEQ ID NO: 589551 - RNA, 18 nt, Homo sapiens
aaauuuaaaacuguugga

SEQ ID NO: 589552 - RNA, 13 nt, Homo sapiens
aaauuuaagcaaa

SEQ ID NO: 589553 - RNA, 14 nt, Homo sapiens
aaauuuaagcuuaa

SEQ ID NO: 589554 - RNA, 15 nt, Homo sapiens
aaauuuaaugcugcc

SEQ ID NO: 589555 - RNA, 22 nt, Homo sapiens
aaauuuaggaccaauaccuccu

SEQ ID NO: 589556 - RNA, 22 nt, Homo sapiens
aaauuuauaaaggucugcacuc

SEQ ID NO: 589557 - RNA, 13 nt, Homo sapiens
aaauuucauagcu

SEQ ID NO: 589558 - RNA, 13 nt, Homo sapiens
aaauuuccagaga

SEQ ID NO: 589559 - RNA, 14 nt, Homo sapiens
aaauuuccagagaa

SEQ ID NO: 589560 - RNA, 23 nt, Homo sapiens
aaauuuccaguaccuuugucaca

SEQ ID NO: 589561 - RNA, 12 nt, Homo sapiens
aaauuugcacug

SEQ ID NO: 589562 - RNA, 20 nt, Homo sapiens
aaauuuguaaacaaucuaau

SEQ ID NO: 589563 - RNA, 22 nt, Homo sapiens
aaauuuuagagcauaccaguac

SEQ ID NO: 589564 - RNA, 18 nt, Homo sapiens
aaauuuuagugugccuuc

SEQ ID NO: 589565 - RNA, 22 nt, Homo sapiens
aaauuuuauuuuuauuacuuuu

SEQ ID NO: 589566 - RNA, 23 nt, Homo sapiens
aaauuuucuuuuuauacuauuaa

SEQ ID NO: 589567 - RNA, 15 nt, Homo sapiens
aaauuuuuaccuuua

SEQ ID NO: 589568 - RNA, 13 nt, Homo sapiens
aacaaaaaccaaa

SEQ ID NO: 589569 - RNA, 16 nt, Homo sapiens
aacaaaaaccaaaaaa

SEQ ID NO: 589570 - RNA, 13 nt, Homo sapiens
aacaaaaagucau

SEQ ID NO: 589571 - RNA, 19 nt, Homo sapiens
aacaaaaauguaaugauca

SEQ ID NO: 589572 - RNA, 15 nt, Homo sapiens
aacaaaaccaacuca

SEQ ID NO: 589573 - RNA, 22 nt, Homo sapiens
aacaaaaccuacacacauaccu

SEQ ID NO: 589574 - RNA, 19 nt, Homo sapiens
aacaaaaugaaaauaucuu

SEQ ID NO: 589575 - RNA, 18 nt, Homo sapiens
aacaaaauguaaagccag

SEQ ID NO: 589576 - RNA, 13 nt, Homo sapiens
aacaaacaaaagc

SEQ ID NO: 589577 - RNA, 15 nt, Homo sapiens
aacaaacaaacaauu

SEQ ID NO: 589578 - RNA, 14 nt, Homo sapiens
aacaaacaaugaaa

SEQ ID NO: 589579 - RNA, 13 nt, Homo sapiens
aacaaacagggcu

SEQ ID NO: 589580 - RNA, 23 nt, Homo sapiens
aacaaacuggcugcuuuguucaa

SEQ ID NO: 589581 - RNA, 12 nt, Homo sapiens
aacaaagacagg

SEQ ID NO: 589582 - RNA, 15 nt, Homo sapiens
aacaaagcacauaac

SEQ ID NO: 589583 - RNA, 16 nt, Homo sapiens
aacaaagcagccacga

SEQ ID NO: 589584 - RNA, 13 nt, Homo sapiens
aacaaaguccaca

SEQ ID NO: 589585 - RNA, 15 nt, Homo sapiens
aacaaauaauuuaga

SEQ ID NO: 589586 - RNA, 12 nt, Homo sapiens
aacaaauaugca

SEQ ID NO: 589587 - RNA, 13 nt, Homo sapiens
aacaaauaugcuu

SEQ ID NO: 589588 - RNA, 14 nt, Homo sapiens
aacaaauggccuuu

SEQ ID NO: 589589 - RNA, 15 nt, Homo sapiens
aacaaauuauguuac

SEQ ID NO: 589590 - RNA, 15 nt, Homo sapiens
aacaaauuguuuaca

SEQ ID NO: 589591 - RNA, 17 nt, Homo sapiens
aacaacaaaaaccaaaa

SEQ ID NO: 589592 - RNA, 20 nt, Homo sapiens
aacaacauggggaccaguca

SEQ ID NO: 589593 - RNA, 17 nt, Homo sapiens
aacaacauguaccugua

SEQ ID NO: 589594 - RNA, 12 nt, Homo sapiens
aacaacauuuau

SEQ ID NO: 589595 - RNA, 18 nt, Homo sapiens
aacaaccaugucauuuca

SEQ ID NO: 589596 - RNA, 19 nt, Homo sapiens
aacaaccuggucacaggac

SEQ ID NO: 589597 - RNA, 22 nt, Homo sapiens
aacaaccuggucacaggacucu

SEQ ID NO: 589598 - RNA, 14 nt, Homo sapiens
aacaacuacuguga

SEQ ID NO: 589599 - RNA, 21 nt, Homo sapiens
aacaacugcauaaccuuuaca

SEQ ID NO: 589600 - RNA, 17 nt, Homo sapiens
aacaacuguggucaauc

SEQ ID NO: 589601 - RNA, 15 nt, Homo sapiens
aacaacuugcuacuu

SEQ ID NO: 589602 - RNA, 15 nt, Homo sapiens
aacaacuuguagcag

SEQ ID NO: 589603 - RNA, 18 nt, Homo sapiens
aacaagaaugcauucccu

SEQ ID NO: 589604 - RNA, 22 nt, Homo sapiens
aacaagauuuccacaauucuuc

SEQ ID NO: 589605 - RNA, 23 nt, Homo sapiens
aacaagauuuuaaagacauguag

SEQ ID NO: 589606 - RNA, 18 nt, Homo sapiens
aacaagcuccaccuucca

SEQ ID NO: 589607 - RNA, 23 nt, Homo sapiens
aacaagguccucugucagucaca

SEQ ID NO: 589608 - RNA, 22 nt, Homo sapiens
aacaagguggugugaucuuaau

SEQ ID NO: 589609 - RNA, 21 nt, Homo sapiens
aacaaguauuuguuaauuuag

SEQ ID NO: 589610 - RNA, 22 nt, Homo sapiens
aacaauaaaaugucuucuccca

SEQ ID NO: 589611 - RNA, 23 nt, Homo sapiens
aacaauaagacaugcuuacuuuu

SEQ ID NO: 589612 - RNA, 12 nt, Homo sapiens
aacaauaaggag

SEQ ID NO: 589613 - RNA, 13 nt, Homo sapiens
aacaauagcacaa

SEQ ID NO: 589614 - RNA, 17 nt, Homo sapiens
aacaauauauguccuau

SEQ ID NO: 589615 - RNA, 11 nt, Homo sapiens
aacaaucaaag

SEQ ID NO: 589616 - RNA, 13 nt, Homo sapiens
aacaaucacaaag

SEQ ID NO: 589617 - RNA, 14 nt, Homo sapiens
aacaauccaucucu

SEQ ID NO: 589618 - RNA, 20 nt, Homo sapiens
aacaaucuaagggucucuca

SEQ ID NO: 589619 - RNA, 15 nt, Homo sapiens
aacaaucucucaaca

SEQ ID NO: 589620 - RNA, 13 nt, Homo sapiens
aacaaugcauuuu

SEQ ID NO: 589621 - RNA, 12 nt, Homo sapiens
aacaauucagug

SEQ ID NO: 589622 - RNA, 14 nt, Homo sapiens
aacaauucugugac

SEQ ID NO: 589623 - RNA, 13 nt, Homo sapiens
aacaauugguaaa

SEQ ID NO: 589624 - RNA, 24 nt, Homo sapiens
aacaauugguaaaacucacuguga

SEQ ID NO: 589625 - RNA, 15 nt, Homo sapiens
aacaauugucuuaaa

SEQ ID NO: 589626 - RNA, 23 nt, Homo sapiens
aacaauuuuaggaggaccagagc

SEQ ID NO: 589627 - RNA, 23 nt, Homo sapiens
aacaauuuuuuuuuuccucuuca

SEQ ID NO: 589628 - RNA, 16 nt, Homo sapiens
aacacaaaacuugaaa

SEQ ID NO: 589629 - RNA, 15 nt, Homo sapiens
aacacaaaguguaua

SEQ ID NO: 589630 - RNA, 22 nt, Homo sapiens
aacacaacuuuauugauugaau

SEQ ID NO: 589631 - RNA, 13 nt, Homo sapiens
aacacaagccaca

SEQ ID NO: 589632 - RNA, 12 nt, Homo sapiens
aacacacaaaaa

SEQ ID NO: 589633 - RNA, 20 nt, Homo sapiens
aacacacacaaaaugcucaa

SEQ ID NO: 589634 - RNA, 20 nt, Homo sapiens
aacacacgagcaaacccaga

SEQ ID NO: 589635 - RNA, 15 nt, Homo sapiens
aacacacgugcugug

SEQ ID NO: 589636 - RNA, 13 nt, Homo sapiens
aacacacugauua

SEQ ID NO: 589637 - RNA, 14 nt, Homo sapiens
aacacaggaaguca

SEQ ID NO: 589638 - RNA, 14 nt, Homo sapiens
aacacaguguuuca

SEQ ID NO: 589639 - RNA, 19 nt, Homo sapiens
aacacaugugcagucacug

SEQ ID NO: 589640 - RNA, 23 nt, Homo sapiens
aacacauucuuauuaauucuuca

SEQ ID NO: 589641 - RNA, 21 nt, Homo sapiens
aacacauuugcccaauuccag

SEQ ID NO: 589642 - RNA, 16 nt, Homo sapiens
aacaccaaacucuuaa

SEQ ID NO: 589643 - RNA, 18 nt, Homo sapiens
aacaccaacauguuggga

SEQ ID NO: 589644 - RNA, 14 nt, Homo sapiens
aacaccaagcacag

SEQ ID NO: 589645 - RNA, 20 nt, Homo sapiens
aacaccaucgaucaugaugu

SEQ ID NO: 589646 - RNA, 15 nt, Homo sapiens
aacacccaugaauca

SEQ ID NO: 589647 - RNA, 18 nt, Homo sapiens
aacacccaugaaucaaag

SEQ ID NO: 589648 - RNA, 20 nt, Homo sapiens
aacacccaugaaucaaagac

SEQ ID NO: 589649 - RNA, 20 nt, Homo sapiens
aacacccgacuccucaaaag

SEQ ID NO: 589650 - RNA, 22 nt, Homo sapiens
aacacccuguagguucuugaua

SEQ ID NO: 589651 - RNA, 13 nt, Homo sapiens
aacacccuuucau

SEQ ID NO: 589652 - RNA, 15 nt, Homo sapiens
aacaccuagcuuuau

SEQ ID NO: 589653 - RNA, 21 nt, Homo sapiens
aacaccuuccuccugcagaca

SEQ ID NO: 589654 - RNA, 23 nt, Homo sapiens
aacaccuucuuggcuucugggac

SEQ ID NO: 589655 - RNA, 19 nt, Homo sapiens
aacacgccuaaaacucaaa

SEQ ID NO: 589656 - RNA, 13 nt, Homo sapiens
aacacgcugccug

SEQ ID NO: 589657 - RNA, 19 nt, Homo sapiens
aacacggugaaacccgucu

SEQ ID NO: 589658 - RNA, 17 nt, Homo sapiens
aacacguggagauggaa

SEQ ID NO: 589659 - RNA, 23 nt, Homo sapiens
aacacuagucuguguaacuuuaa

SEQ ID NO: 589660 - RNA, 19 nt, Homo sapiens
aacacuaguuuugugccag

SEQ ID NO: 589661 - RNA, 14 nt, Homo sapiens
aacacucaguccac

SEQ ID NO: 589662 - RNA, 12 nt, Homo sapiens
aacacucaugaa

SEQ ID NO: 589663 - RNA, 15 nt, Homo sapiens
aacacuccacagugu

SEQ ID NO: 589664 - RNA, 15 nt, Homo sapiens
aacacugaagugcuu

SEQ ID NO: 589665 - RNA, 14 nt, Homo sapiens
aacacugaaucaug

SEQ ID NO: 589666 - RNA, 18 nt, Homo sapiens
aacacugacuccugugga

SEQ ID NO: 589667 - RNA, 14 nt, Homo sapiens
aacacugcacucuu

SEQ ID NO: 589668 - RNA, 11 nt, Homo sapiens
aacacugcugc

SEQ ID NO: 589669 - RNA, 21 nt, Homo sapiens
aacacugcugcuccagugcag

SEQ ID NO: 589670 - RNA, 21 nt, Homo sapiens
aacacuggugggcagcugagg

SEQ ID NO: 589671 - RNA, 17 nt, Homo sapiens
aacacuuauguuauaca

SEQ ID NO: 589672 - RNA, 20 nt, Homo sapiens
aacacuuauguuauacaaua

SEQ ID NO: 589673 - RNA, 16 nt, Homo sapiens
aacacuucgagcacug

SEQ ID NO: 589674 - RNA, 21 nt, Homo sapiens
aacacuuuuuccauuucuuca

SEQ ID NO: 589675 - RNA, 16 nt, Homo sapiens
aacagaaacacaaacg

SEQ ID NO: 589676 - RNA, 21 nt, Homo sapiens
aacagaaaccagaaaagcaau

SEQ ID NO: 589677 - RNA, 18 nt, Homo sapiens
aacagaaaccuauccuca

SEQ ID NO: 589678 - RNA, 18 nt, Homo sapiens
aacagaaagcauccuaaa

SEQ ID NO: 589679 - RNA, 18 nt, Homo sapiens
aacagaaauagacuuaau

SEQ ID NO: 589680 - RNA, 14 nt, Homo sapiens
aacagaaauuagaa

SEQ ID NO: 589681 - RNA, 18 nt, Homo sapiens
aacagaacaucauuagaa

SEQ ID NO: 589682 - RNA, 14 nt, Homo sapiens
aacagaagcaguug

SEQ ID NO: 589683 - RNA, 21 nt, Homo sapiens
aacagaauuaaaaugucuagc

SEQ ID NO: 589684 - RNA, 21 nt, Homo sapiens
aacagacgggucugagacuga

SEQ ID NO: 589685 - RNA, 21 nt, Homo sapiens
aacagacucauaccacacuua

SEQ ID NO: 589686 - RNA, 12 nt, Homo sapiens
aacagacucuca

SEQ ID NO: 589687 - RNA, 13 nt, Homo sapiens
aacagacuugaau

SEQ ID NO: 589688 - RNA, 20 nt, Homo sapiens
aacagaggcaggaguggcag

SEQ ID NO: 589689 - RNA, 22 nt, Homo sapiens
aacagaggggcagccaggacau

SEQ ID NO: 589690 - RNA, 22 nt, Homo sapiens
aacagaguuuuuguauaagaag

SEQ ID NO: 589691 - RNA, 14 nt, Homo sapiens
aacagauaacacca

SEQ ID NO: 589692 - RNA, 14 nt, Homo sapiens
aacagauauuguca

SEQ ID NO: 589693 - RNA, 21 nt, Homo sapiens
aacagauggauagucugucca

SEQ ID NO: 589694 - RNA, 21 nt, Homo sapiens
aacagauggggucugugacug

SEQ ID NO: 589695 - RNA, 23 nt, Homo sapiens
aacagauggggucugugacugga

SEQ ID NO: 589696 - RNA, 20 nt, Homo sapiens
aacagauucaggccagccca

SEQ ID NO: 589697 - RNA, 21 nt, Homo sapiens
aacagauuuuagacuuaccuu

SEQ ID NO: 589698 - RNA, 20 nt, Homo sapiens
aacagauuuuguuggcauag

SEQ ID NO: 589699 - RNA, 16 nt, Homo sapiens
aacagcauaacuaaau

SEQ ID NO: 589700 - RNA, 14 nt, Homo sapiens
aacagcaucuuuca

SEQ ID NO: 589701 - RNA, 21 nt, Homo sapiens
aacagcaugggccucaccucc

SEQ ID NO: 589702 - RNA, 12 nt, Homo sapiens
aacagcauguac

SEQ ID NO: 589703 - RNA, 22 nt, Homo sapiens
aacagcauuacccuccucucuc

SEQ ID NO: 589704 - RNA, 15 nt, Homo sapiens
aacagccaaaugcau

SEQ ID NO: 589705 - RNA, 17 nt, Homo sapiens
aacagccaacagguggc

SEQ ID NO: 589706 - RNA, 15 nt, Homo sapiens
aacagccaacuagcc

SEQ ID NO: 589707 - RNA, 20 nt, Homo sapiens
aacagcccaaacuguauaca

SEQ ID NO: 589708 - RNA, 18 nt, Homo sapiens
aacagccccagucuuccu

SEQ ID NO: 589709 - RNA, 21 nt, Homo sapiens
aacagccuaucuuugugugac

SEQ ID NO: 589710 - RNA, 18 nt, Homo sapiens
aacagcguggaugucgau

SEQ ID NO: 589711 - RNA, 12 nt, Homo sapiens
aacagcugugag

SEQ ID NO: 589712 - RNA, 15 nt, Homo sapiens
aacagcuugcuguca

SEQ ID NO: 589713 - RNA, 19 nt, Homo sapiens
aacaggaauucuauaguaa

SEQ ID NO: 589714 - RNA, 19 nt, Homo sapiens
aacaggacagcacugggaa

SEQ ID NO: 589715 - RNA, 21 nt, Homo sapiens
aacagggcugccuucuggccu

SEQ ID NO: 589716 - RNA, 16 nt, Homo sapiens
aacaggguaccucaag

SEQ ID NO: 589717 - RNA, 18 nt, Homo sapiens
aacagguaaaacagggcc

SEQ ID NO: 589718 - RNA, 15 nt, Homo sapiens
aacagguauauacuu

SEQ ID NO: 589719 - RNA, 18 nt, Homo sapiens
aacagguauauacuuuga

SEQ ID NO: 589720 - RNA, 19 nt, Homo sapiens
aacagguauauacuuugaa

SEQ ID NO: 589721 - RNA, 18 nt, Homo sapiens
aacagguuauaacagugu

SEQ ID NO: 589722 - RNA, 23 nt, Homo sapiens
aacaguagcuuagcaucagaggu

SEQ ID NO: 589723 - RNA, 14 nt, Homo sapiens
aacaguaguuucuc

SEQ ID NO: 589724 - RNA, 20 nt, Homo sapiens
aacagucacccuucugggca

SEQ ID NO: 589725 - RNA, 17 nt, Homo sapiens
aacaguuaccugagaga

SEQ ID NO: 589726 - RNA, 14 nt, Homo sapiens
aacaguuguauguu

SEQ ID NO: 589727 - RNA, 21 nt, Homo sapiens
aacaguuguauguuugcugau

SEQ ID NO: 589728 - RNA, 18 nt, Homo sapiens
aacaguugugaugacuau

SEQ ID NO: 589729 - RNA, 23 nt, Homo sapiens
aacaguuugccugcuguauuuau

SEQ ID NO: 589730 - RNA, 22 nt, Homo sapiens
aacaguuuuuuaugcuaaucag

SEQ ID NO: 589731 - RNA, 16 nt, Homo sapiens
aacauaaaaaccaaac

SEQ ID NO: 589732 - RNA, 19 nt, Homo sapiens
aacauaacugcuucuugga

SEQ ID NO: 589733 - RNA, 19 nt, Homo sapiens
aacauaagguacuagcagu

SEQ ID NO: 589734 - RNA, 15 nt, Homo sapiens
aacauaaucuaguuu

SEQ ID NO: 589735 - RNA, 18 nt, Homo sapiens
aacauaaucuaguuuaca

SEQ ID NO: 589736 - RNA, 18 nt, Homo sapiens
aacauaaugcacuuuaga

SEQ ID NO: 589737 - RNA, 16 nt, Homo sapiens
aacauaauucucucac

SEQ ID NO: 589738 - RNA, 19 nt, Homo sapiens
aacauaccuaagaaguaca

SEQ ID NO: 589739 - RNA, 16 nt, Homo sapiens
aacauacuuacauuuc

SEQ ID NO: 589740 - RNA, 18 nt, Homo sapiens
aacauacuuacauuucag

SEQ ID NO: 589741 - RNA, 23 nt, Homo sapiens
aacauacuucaaaaauaaugugc

SEQ ID NO: 589742 - RNA, 16 nt, Homo sapiens
aacauagagaucuaug

SEQ ID NO: 589743 - RNA, 14 nt, Homo sapiens
aacauauggcuuua

SEQ ID NO: 589744 - RNA, 17 nt, Homo sapiens
aacaucacacaguauac

SEQ ID NO: 589745 - RNA, 18 nt, Homo sapiens
aacaucauaacccaugaa

SEQ ID NO: 589746 - RNA, 20 nt, Homo sapiens
aacaucauuacugccaucuu

SEQ ID NO: 589747 - RNA, 19 nt, Homo sapiens
aacaucauuauuggcaguu

SEQ ID NO: 589748 - RNA, 20 nt, Homo sapiens
aacaucccuuauuaguuaca

SEQ ID NO: 589749 - RNA, 19 nt, Homo sapiens
aacauccuucaagaacucu

SEQ ID NO: 589750 - RNA, 21 nt, Homo sapiens
aacauccuugucugggucuac

SEQ ID NO: 589751 - RNA, 22 nt, Homo sapiens
aacaucucaacaaccugaaugu

SEQ ID NO: 589752 - RNA, 20 nt, Homo sapiens
aacaucuuuacguacuguaa

SEQ ID NO: 589753 - RNA, 18 nt, Homo sapiens
aacaucuuuuacauucug

SEQ ID NO: 589754 - RNA, 20 nt, Homo sapiens
aacaugaaaaacacggcagc

SEQ ID NO: 589755 - RNA, 20 nt, Homo sapiens
aacaugaaaaacaggugaca

SEQ ID NO: 589756 - RNA, 18 nt, Homo sapiens
aacaugaagaaugcauuc

SEQ ID NO: 589757 - RNA, 17 nt, Homo sapiens
aacaugacaguauucca

SEQ ID NO: 589758 - RNA, 18 nt, Homo sapiens
aacaugacauccagagau

SEQ ID NO: 589759 - RNA, 17 nt, Homo sapiens
aacaugcccacagauca

SEQ ID NO: 589760 - RNA, 19 nt, Homo sapiens
aacaugcugaaaacuacac

SEQ ID NO: 589761 - RNA, 16 nt, Homo sapiens
aacauggauacuuccu

SEQ ID NO: 589762 - RNA, 13 nt, Homo sapiens
aacaugguacaaa

SEQ ID NO: 589763 - RNA, 23 nt, Homo sapiens
aacauguaauaaaaaguauaugu

SEQ ID NO: 589764 - RNA, 11 nt, Homo sapiens
aacauguaauu

SEQ ID NO: 589765 - RNA, 14 nt, Homo sapiens
aacauguacaggaa

SEQ ID NO: 589766 - RNA, 16 nt, Homo sapiens
aacauguaugugcauu

SEQ ID NO: 589767 - RNA, 19 nt, Homo sapiens
aacauguaugugcauuuca

SEQ ID NO: 589768 - RNA, 23 nt, Homo sapiens
aacaugugagagguuugacuaga

SEQ ID NO: 589769 - RNA, 14 nt, Homo sapiens
aacauguguaugua

SEQ ID NO: 589770 - RNA, 17 nt, Homo sapiens
aacauguguuucugaca

SEQ ID NO: 589771 - RNA, 22 nt, Homo sapiens
aacauguguuuucaucauuuca

SEQ ID NO: 589772 - RNA, 15 nt, Homo sapiens
aacauguugugccug

SEQ ID NO: 589773 - RNA, 20 nt, Homo sapiens
aacauguuugggaaguccua

SEQ ID NO: 589774 - RNA, 20 nt, Homo sapiens
aacauguuuuguauguuaaa

SEQ ID NO: 589775 - RNA, 22 nt, Homo sapiens
aacauguuuugugcagcacagu

SEQ ID NO: 589776 - RNA, 18 nt, Homo sapiens
aacauuaaaacucauaau

SEQ ID NO: 589777 - RNA, 18 nt, Homo sapiens
aacauuaaacacuguaau

SEQ ID NO: 589778 - RNA, 18 nt, Homo sapiens
aacauuacuuauuuaacu

SEQ ID NO: 589779 - RNA, 14 nt, Homo sapiens
aacauuaugccuua

SEQ ID NO: 589780 - RNA, 20 nt, Homo sapiens
aacauucacacagggcucuu

SEQ ID NO: 589781 - RNA, 16 nt, Homo sapiens
aacauuccaaugcauu

SEQ ID NO: 589782 - RNA, 17 nt, Homo sapiens
aacauuccuuagucuca

SEQ ID NO: 589783 - RNA, 15 nt, Homo sapiens
aacauugacuucuug

SEQ ID NO: 589784 - RNA, 20 nt, Homo sapiens
aacauuguaaauauuuacuc

SEQ ID NO: 589785 - RNA, 20 nt, Homo sapiens
aacauuguacuguaauggag

SEQ ID NO: 589786 - RNA, 22 nt, Homo sapiens
aacauuguucugaacacuuuag

SEQ ID NO: 589787 - RNA, 21 nt, Homo sapiens
aacauuuaaauuccacagauu

SEQ ID NO: 589788 - RNA, 21 nt, Homo sapiens
aacauuucagaagguaucagu

SEQ ID NO: 589789 - RNA, 16 nt, Homo sapiens
aacauuucuguucuca

SEQ ID NO: 589790 - RNA, 17 nt, Homo sapiens
aacauuucuuaugauuu

SEQ ID NO: 589791 - RNA, 14 nt, Homo sapiens
aacauuugccaagu

SEQ ID NO: 589792 - RNA, 18 nt, Homo sapiens
aacauuuuucacaucucu

SEQ ID NO: 589793 - RNA, 22 nt, Homo sapiens
aacauuuuuuauuugagaauuu

SEQ ID NO: 589794 - RNA, 17 nt, Homo sapiens
aacauuuuuucccagug

SEQ ID NO: 589795 - RNA, 13 nt, Homo sapiens
aaccaaaacagag

SEQ ID NO: 589796 - RNA, 18 nt, Homo sapiens
aaccaaaagaauuugcac

SEQ ID NO: 589797 - RNA, 15 nt, Homo sapiens
aaccaaacccagaca

SEQ ID NO: 589798 - RNA, 17 nt, Homo sapiens
aaccaaacuuguucauu

SEQ ID NO: 589799 - RNA, 22 nt, Homo sapiens
aaccaaagcugccugugccaug

SEQ ID NO: 589800 - RNA, 14 nt, Homo sapiens
aaccaaagucacaa

SEQ ID NO: 589801 - RNA, 19 nt, Homo sapiens
aaccaaagucacaaaucau

SEQ ID NO: 589802 - RNA, 23 nt, Homo sapiens
aaccaaauuuguauuuaagguau

SEQ ID NO: 589803 - RNA, 14 nt, Homo sapiens
aaccaacugcacaa

SEQ ID NO: 589804 - RNA, 17 nt, Homo sapiens
aaccaacugcacaauca

SEQ ID NO: 589805 - RNA, 24 nt, Homo sapiens
aaccaagauuaugugacuugcaau

SEQ ID NO: 589806 - RNA, 22 nt, Homo sapiens
aaccaagccuuggcucguucuc

SEQ ID NO: 589807 - RNA, 17 nt, Homo sapiens
aaccaagcuguacccuu

SEQ ID NO: 589808 - RNA, 22 nt, Homo sapiens
aaccaagcuguacccuugagac

SEQ ID NO: 589809 - RNA, 15 nt, Homo sapiens
aaccaaggacugagc

SEQ ID NO: 589810 - RNA, 23 nt, Homo sapiens
aaccaaggccccgagcucagggc

SEQ ID NO: 589811 - RNA, 22 nt, Homo sapiens
aaccaauaauggucaguccuca

SEQ ID NO: 589812 - RNA, 20 nt, Homo sapiens
aaccaauagugaaaugccac

SEQ ID NO: 589813 - RNA, 13 nt, Homo sapiens
aaccaaugcuuuc

SEQ ID NO: 589814 - RNA, 14 nt, Homo sapiens
aaccaauguagcac

SEQ ID NO: 589815 - RNA, 17 nt, Homo sapiens
aaccaauuuacacugcc

SEQ ID NO: 589816 - RNA, 16 nt, Homo sapiens
aaccacaaacggagcc

SEQ ID NO: 589817 - RNA, 21 nt, Homo sapiens
aaccacaaccuugcaguauuu

SEQ ID NO: 589818 - RNA, 19 nt, Homo sapiens
aaccacaagcaaaaucugg

SEQ ID NO: 589819 - RNA, 21 nt, Homo sapiens
aaccacaagcaaaaucuggau

SEQ ID NO: 589820 - RNA, 12 nt, Homo sapiens
aaccacacugga

SEQ ID NO: 589821 - RNA, 15 nt, Homo sapiens
aaccacacuucuuga

SEQ ID NO: 589822 - RNA, 12 nt, Homo sapiens
aaccaccagcgu

SEQ ID NO: 589823 - RNA, 13 nt, Homo sapiens
aaccacccaaaac

SEQ ID NO: 589824 - RNA, 21 nt, Homo sapiens
aaccaccuggucugcauguau

SEQ ID NO: 589825 - RNA, 22 nt, Homo sapiens
aaccacuaugaagcuaccucaa

SEQ ID NO: 589826 - RNA, 16 nt, Homo sapiens
aaccacugcuaugcca

SEQ ID NO: 589827 - RNA, 14 nt, Homo sapiens
aaccacuguacaca

SEQ ID NO: 589828 - RNA, 14 nt, Homo sapiens
aaccacugugccac

SEQ ID NO: 589829 - RNA, 17 nt, Homo sapiens
aaccagaagaaguguga

SEQ ID NO: 589830 - RNA, 16 nt, Homo sapiens
aaccagagccacaggc

SEQ ID NO: 589831 - RNA, 17 nt, Homo sapiens
aaccagauggugaccca

SEQ ID NO: 589832 - RNA, 15 nt, Homo sapiens
aaccagcccagccug

SEQ ID NO: 589833 - RNA, 23 nt, Homo sapiens
aaccagcuucugauaaacacaau

SEQ ID NO: 589834 - RNA, 14 nt, Homo sapiens
aaccaggugcaauu

SEQ ID NO: 589835 - RNA, 17 nt, Homo sapiens
aaccagugauccauguc

SEQ ID NO: 589836 - RNA, 16 nt, Homo sapiens
aaccaguuaugugaau

SEQ ID NO: 589837 - RNA, 19 nt, Homo sapiens
aaccauaccuuccuucccu

SEQ ID NO: 589838 - RNA, 14 nt, Homo sapiens
aaccauagcacagg

SEQ ID NO: 589839 - RNA, 20 nt, Homo sapiens
aaccauccauaguaguauga

SEQ ID NO: 589840 - RNA, 13 nt, Homo sapiens
aaccaucccugau

SEQ ID NO: 589841 - RNA, 22 nt, Homo sapiens
aaccaugagaccacuguuauca

SEQ ID NO: 589842 - RNA, 15 nt, Homo sapiens
aaccaugcccaagaa

SEQ ID NO: 589843 - RNA, 13 nt, Homo sapiens
aaccaugccuuuu

SEQ ID NO: 589844 - RNA, 15 nt, Homo sapiens
aaccauuccaacuuc

SEQ ID NO: 589845 - RNA, 18 nt, Homo sapiens
aaccauuguaacuauuaa

SEQ ID NO: 589846 - RNA, 22 nt, Homo sapiens
aaccauuguuucuuauucuuuc

SEQ ID NO: 589847 - RNA, 14 nt, Homo sapiens
aacccaaaccauga

SEQ ID NO: 589848 - RNA, 11 nt, Homo sapiens
aacccaaagug

SEQ ID NO: 589849 - RNA, 18 nt, Homo sapiens
aacccaagugcugcacaa

SEQ ID NO: 589850 - RNA, 20 nt, Homo sapiens
aacccaaucccucuccacuc

SEQ ID NO: 589851 - RNA, 14 nt, Homo sapiens
aacccaaugccugu

SEQ ID NO: 589852 - RNA, 15 nt, Homo sapiens
aacccaaugccugug

SEQ ID NO: 589853 - RNA, 19 nt, Homo sapiens
aacccacagaugucucugg

SEQ ID NO: 589854 - RNA, 21 nt, Homo sapiens
aacccacugaaccuucugagc

SEQ ID NO: 589855 - RNA, 11 nt, Homo sapiens
aacccacugcu

SEQ ID NO: 589856 - RNA, 18 nt, Homo sapiens
aacccagccacugccaag

SEQ ID NO: 589857 - RNA, 22 nt, Homo sapiens
aacccagggcucugccccaguc

SEQ ID NO: 589858 - RNA, 19 nt, Homo sapiens
aacccauauacucuucgau

SEQ ID NO: 589859 - RNA, 23 nt, Homo sapiens
aacccauuuuuguuuauuuuccu

SEQ ID NO: 589860 - RNA, 23 nt, Homo sapiens
aaccccaacaauugugugaauua

SEQ ID NO: 589861 - RNA, 12 nt, Homo sapiens
aaccccaucucu

SEQ ID NO: 589862 - RNA, 19 nt, Homo sapiens
aaccccaucucuacugaaa

SEQ ID NO: 589863 - RNA, 13 nt, Homo sapiens
aaccccaugggcu

SEQ ID NO: 589864 - RNA, 16 nt, Homo sapiens
aacccccagagguggc

SEQ ID NO: 589865 - RNA, 18 nt, Homo sapiens
aaccccccacacuccacu

SEQ ID NO: 589866 - RNA, 14 nt, Homo sapiens
aaccccugcuccag

SEQ ID NO: 589867 - RNA, 14 nt, Homo sapiens
aaccccuucuuuac

SEQ ID NO: 589868 - RNA, 14 nt, Homo sapiens
aacccgacaugugu

SEQ ID NO: 589869 - RNA, 17 nt, Homo sapiens
aacccgcaccccagugc

SEQ ID NO: 589870 - RNA, 19 nt, Homo sapiens
aacccuaaauuaauaaaag

SEQ ID NO: 589871 - RNA, 23 nt, Homo sapiens
aacccuaaggugagugugcagua

SEQ ID NO: 589872 - RNA, 19 nt, Homo sapiens
aacccuaaucuuucacuug

SEQ ID NO: 589873 - RNA, 17 nt, Homo sapiens
aacccuaucuccugaca

SEQ ID NO: 589874 - RNA, 22 nt, Homo sapiens
aacccugccugccgcugcaccu

SEQ ID NO: 589875 - RNA, 19 nt, Homo sapiens
aacccuguauggcacuuau

SEQ ID NO: 589876 - RNA, 13 nt, Homo sapiens
aacccuguguuca

SEQ ID NO: 589877 - RNA, 14 nt, Homo sapiens
aacccuuauacuca

SEQ ID NO: 589878 - RNA, 15 nt, Homo sapiens
aacccuugagcucaa

SEQ ID NO: 589879 - RNA, 18 nt, Homo sapiens
aaccgaauaaauguuuua

SEQ ID NO: 589880 - RNA, 23 nt, Homo sapiens
aaccgagaauauucaaaauucca

SEQ ID NO: 589881 - RNA, 19 nt, Homo sapiens
aaccgaguagaaaauguga

SEQ ID NO: 589882 - RNA, 18 nt, Homo sapiens
aaccgaugguccucacaa

SEQ ID NO: 589883 - RNA, 16 nt, Homo sapiens
aaccggucacccagga

SEQ ID NO: 589884 - RNA, 20 nt, Homo sapiens
aaccggucccuuccaugccc

SEQ ID NO: 589885 - RNA, 16 nt, Homo sapiens
aaccuaccagccagag

SEQ ID NO: 589886 - RNA, 21 nt, Homo sapiens
aaccuagaaguauuuuugucu

SEQ ID NO: 589887 - RNA, 20 nt, Homo sapiens
aaccuagauugcaccauugc

SEQ ID NO: 589888 - RNA, 14 nt, Homo sapiens
aaccuaguacugcc

SEQ ID NO: 589889 - RNA, 16 nt, Homo sapiens
aaccuauccuguucuu

SEQ ID NO: 589890 - RNA, 15 nt, Homo sapiens
aaccuauccuuccag

SEQ ID NO: 589891 - RNA, 15 nt, Homo sapiens
aaccuaucucaggga

SEQ ID NO: 589892 - RNA, 20 nt, Homo sapiens
aaccuauggaaguuguugcu

SEQ ID NO: 589893 - RNA, 11 nt, Homo sapiens
aaccucacaaa

SEQ ID NO: 589894 - RNA, 18 nt, Homo sapiens
aaccucacgacuggucac

SEQ ID NO: 589895 - RNA, 17 nt, Homo sapiens
aaccucaggaugggcca

SEQ ID NO: 589896 - RNA, 22 nt, Homo sapiens
aaccucagggcucccagggguc

SEQ ID NO: 589897 - RNA, 23 nt, Homo sapiens
aaccucaguaauuuagaaaucau

SEQ ID NO: 589898 - RNA, 12 nt, Homo sapiens
aaccucauuaau

SEQ ID NO: 589899 - RNA, 12 nt, Homo sapiens
aaccucauucuc

SEQ ID NO: 589900 - RNA, 12 nt, Homo sapiens
aaccuccagugu

SEQ ID NO: 589901 - RNA, 16 nt, Homo sapiens
aaccuccagugucagg

SEQ ID NO: 589902 - RNA, 19 nt, Homo sapiens
aaccuccccauugcacaga

SEQ ID NO: 589903 - RNA, 18 nt, Homo sapiens
aaccuccuggguucaagc

SEQ ID NO: 589904 - RNA, 18 nt, Homo sapiens
aaccucuagagucacuga

SEQ ID NO: 589905 - RNA, 14 nt, Homo sapiens
aaccucuaugcaau

SEQ ID NO: 589906 - RNA, 13 nt, Homo sapiens
aaccucucgccau

SEQ ID NO: 589907 - RNA, 22 nt, Homo sapiens
aaccucugggucaucucucaca

SEQ ID NO: 589908 - RNA, 20 nt, Homo sapiens
aaccucuucaugagcuugaa

SEQ ID NO: 589909 - RNA, 17 nt, Homo sapiens
aaccucuucuggcucaa

SEQ ID NO: 589910 - RNA, 21 nt, Homo sapiens
aaccugaugccccuuccccaa

SEQ ID NO: 589911 - RNA, 21 nt, Homo sapiens
aaccugcagggacuccaugcu

SEQ ID NO: 589912 - RNA, 22 nt, Homo sapiens
aaccugcaguacaacaguuuua

SEQ ID NO: 589913 - RNA, 14 nt, Homo sapiens
aaccugcugaaggg

SEQ ID NO: 589914 - RNA, 20 nt, Homo sapiens
aaccuggaaucuacaagcca

SEQ ID NO: 589915 - RNA, 15 nt, Homo sapiens
aaccuggacccagau

SEQ ID NO: 589916 - RNA, 19 nt, Homo sapiens
aaccuggggugaauacuua

SEQ ID NO: 589917 - RNA, 20 nt, Homo sapiens
aaccuggguaacuagggaag

SEQ ID NO: 589918 - RNA, 17 nt, Homo sapiens
aaccugguggcaccaga

SEQ ID NO: 589919 - RNA, 13 nt, Homo sapiens
aaccugugccagg

SEQ ID NO: 589920 - RNA, 18 nt, Homo sapiens
aaccugugcucauuuugc

SEQ ID NO: 589921 - RNA, 19 nt, Homo sapiens
aaccugugcucauuuugca

SEQ ID NO: 589922 - RNA, 14 nt, Homo sapiens
aaccugugugccau

SEQ ID NO: 589923 - RNA, 18 nt, Homo sapiens
aaccuguuaaaacaacca

SEQ ID NO: 589924 - RNA, 21 nt, Homo sapiens
aaccuuaaccucucuaagcca

SEQ ID NO: 589925 - RNA, 22 nt, Homo sapiens
aaccuuacuaauuauacuacuu

SEQ ID NO: 589926 - RNA, 23 nt, Homo sapiens
aaccuuagaaagacuacauguua

SEQ ID NO: 589927 - RNA, 19 nt, Homo sapiens
aaccuuccuuccugcuuga

SEQ ID NO: 589928 - RNA, 20 nt, Homo sapiens
aaccuucuggccucccacag

SEQ ID NO: 589929 - RNA, 23 nt, Homo sapiens
aaccuuggagaggagaguggcag

SEQ ID NO: 589930 - RNA, 20 nt, Homo sapiens
aaccuugggaagauguauca

SEQ ID NO: 589931 - RNA, 17 nt, Homo sapiens
aaccuuuaaugagaaaa

SEQ ID NO: 589932 - RNA, 17 nt, Homo sapiens
aaccuuuagaauaucuu

SEQ ID NO: 589933 - RNA, 11 nt, Homo sapiens
aaccuuucaaa

SEQ ID NO: 589934 - RNA, 16 nt, Homo sapiens
aaccuuucaaauuuca

SEQ ID NO: 589935 - RNA, 16 nt, Homo sapiens
aacgaaugguacuaca

SEQ ID NO: 589936 - RNA, 13 nt, Homo sapiens
aacgacacauuca

SEQ ID NO: 589937 - RNA, 21 nt, Homo sapiens
aacgacgguuucaaaccagga

SEQ ID NO: 589938 - RNA, 17 nt, Homo sapiens
aacgagauaccaucuca

SEQ ID NO: 589939 - RNA, 22 nt, Homo sapiens
aacgagauugcuggaaaccaag

SEQ ID NO: 589940 - RNA, 20 nt, Homo sapiens
aacgcacaacaggaaacugg

SEQ ID NO: 589941 - RNA, 14 nt, Homo sapiens
aacgcaccagacac

SEQ ID NO: 589942 - RNA, 22 nt, Homo sapiens
aacgcagaagaaaggguggaaa

SEQ ID NO: 589943 - RNA, 13 nt, Homo sapiens
aacgcagccucca

SEQ ID NO: 589944 - RNA, 15 nt, Homo sapiens
aacgcaucacugggg

SEQ ID NO: 589945 - RNA, 13 nt, Homo sapiens
aacgcauugccac

SEQ ID NO: 589946 - RNA, 19 nt, Homo sapiens
aacgccaagggcagcacca

SEQ ID NO: 589947 - RNA, 23 nt, Homo sapiens
aacgccgcugacugccacccaca

SEQ ID NO: 589948 - RNA, 13 nt, Homo sapiens
aacgcgacuucca

SEQ ID NO: 589949 - RNA, 23 nt, Homo sapiens
aacgcgacuuccacaaaccugga

SEQ ID NO: 589950 - RNA, 16 nt, Homo sapiens
aacgcguaucuaggcu

SEQ ID NO: 589951 - RNA, 17 nt, Homo sapiens
aacgcuuaagucaucau

SEQ ID NO: 589952 - RNA, 15 nt, Homo sapiens
aacggagagugcuug

SEQ ID NO: 589953 - RNA, 16 nt, Homo sapiens
aacggauaagaaucua

SEQ ID NO: 589954 - RNA, 23 nt, Homo sapiens
aacggcuaaccuggaccuggaac

SEQ ID NO: 589955 - RNA, 18 nt, Homo sapiens
aacggcuccaggauuuua

SEQ ID NO: 589956 - RNA, 18 nt, Homo sapiens
aacgguuuaauucugucu

SEQ ID NO: 589957 - RNA, 16 nt, Homo sapiens
aacgguuuuuagucuc

SEQ ID NO: 589958 - RNA, 14 nt, Homo sapiens
aacguaugcaugug

SEQ ID NO: 589959 - RNA, 22 nt, Homo sapiens
aacguaugugguuaucugugaa

SEQ ID NO: 589960 - RNA, 22 nt, Homo sapiens
aacgucauguguuuugccaaag

SEQ ID NO: 589961 - RNA, 14 nt, Homo sapiens
aacguggcacuggu

SEQ ID NO: 589962 - RNA, 15 nt, Homo sapiens
aacguggcacuggua

SEQ ID NO: 589963 - RNA, 11 nt, Homo sapiens
aacguguaugu

SEQ ID NO: 589964 - RNA, 22 nt, Homo sapiens
aacguuuacuuaucuuaugcca

SEQ ID NO: 589965 - RNA, 15 nt, Homo sapiens
aacuaaacagauaaa

SEQ ID NO: 589966 - RNA, 21 nt, Homo sapiens
aacuaaagcuggagagaccug

SEQ ID NO: 589967 - RNA, 17 nt, Homo sapiens
aacuaagaaauaugcac

SEQ ID NO: 589968 - RNA, 21 nt, Homo sapiens
aacuaagccaacuugauguga

SEQ ID NO: 589969 - RNA, 22 nt, Homo sapiens
aacuaagcccccgcuguaauga

SEQ ID NO: 589970 - RNA, 20 nt, Homo sapiens
aacuaagucaggauguuaac

SEQ ID NO: 589971 - RNA, 22 nt, Homo sapiens
aacuaaucaagaaaaacaucuu

SEQ ID NO: 589972 - RNA, 23 nt, Homo sapiens
aacuaauuuuuauuuuugcugag

SEQ ID NO: 589973 - RNA, 14 nt, Homo sapiens
aacuacaaugaugg

SEQ ID NO: 589974 - RNA, 12 nt, Homo sapiens
aacuacauguaa

SEQ ID NO: 589975 - RNA, 13 nt, Homo sapiens
aacuaccaggugg

SEQ ID NO: 589976 - RNA, 11 nt, Homo sapiens
aacuaccuccu

SEQ ID NO: 589977 - RNA, 17 nt, Homo sapiens
aacuaccuccucagucu

SEQ ID NO: 589978 - RNA, 22 nt, Homo sapiens
aacuacgggcugcucuacugcu

SEQ ID NO: 589979 - RNA, 16 nt, Homo sapiens
aacuacugccuuuaga

SEQ ID NO: 589980 - RNA, 19 nt, Homo sapiens
aacuacuucuuacuucuuu

SEQ ID NO: 589981 - RNA, 17 nt, Homo sapiens
aacuagaaaucugccaa

SEQ ID NO: 589982 - RNA, 21 nt, Homo sapiens
aacuagacuaagaagauuuag

SEQ ID NO: 589983 - RNA, 12 nt, Homo sapiens
aacuagccaaac

SEQ ID NO: 589984 - RNA, 12 nt, Homo sapiens
aacuagugaaau

SEQ ID NO: 589985 - RNA, 13 nt, Homo sapiens
aacuagugaugua

SEQ ID NO: 589986 - RNA, 16 nt, Homo sapiens
aacuaguguugcuugg

SEQ ID NO: 589987 - RNA, 15 nt, Homo sapiens
aacuauaacuuaaag

SEQ ID NO: 589988 - RNA, 21 nt, Homo sapiens
aacuauacauuuauuguuacg

SEQ ID NO: 589989 - RNA, 13 nt, Homo sapiens
aacuauacuugau

SEQ ID NO: 589990 - RNA, 17 nt, Homo sapiens
aacuauaggcuucuucc

SEQ ID NO: 589991 - RNA, 20 nt, Homo sapiens
aacuauauauaaaugaccug

SEQ ID NO: 589992 - RNA, 11 nt, Homo sapiens
aacuauggaaa

SEQ ID NO: 589993 - RNA, 19 nt, Homo sapiens
aacuaugguucccaauaaa

SEQ ID NO: 589994 - RNA, 16 nt, Homo sapiens
aacuauguaacaugua

SEQ ID NO: 589995 - RNA, 15 nt, Homo sapiens
aacuauuaaggccuu

SEQ ID NO: 589996 - RNA, 16 nt, Homo sapiens
aacuauuuaaaggaaa

SEQ ID NO: 589997 - RNA, 10 nt, Homo sapiens
aacuauuuau

SEQ ID NO: 589998 - RNA, 17 nt, Homo sapiens
aacucaaaacucuugaa

SEQ ID NO: 589999 - RNA, 16 nt, Homo sapiens
aacucaaacucuuaaa

SEQ ID NO: 590000 - RNA, 14 nt, Homo sapiens
aacucaacuucuuu

SEQ ID NO: 590001 - RNA, 15 nt, Homo sapiens
aacucaagacaaugc

SEQ ID NO: 590002 - RNA, 13 nt, Homo sapiens
aacucaagauuug

SEQ ID NO: 590003 - RNA, 18 nt, Homo sapiens
aacucaaggacuuugcag

SEQ ID NO: 590004 - RNA, 14 nt, Homo sapiens
aacucaaugcuuua

SEQ ID NO: 590005 - RNA, 21 nt, Homo sapiens
aacucaccagccccacugcca

SEQ ID NO: 590006 - RNA, 12 nt, Homo sapiens
aacucaccaggg

SEQ ID NO: 590007 - RNA, 21 nt, Homo sapiens
aacucacugaggguaucugac

SEQ ID NO: 590008 - RNA, 14 nt, Homo sapiens
aacucacugccuag

SEQ ID NO: 590009 - RNA, 23 nt, Homo sapiens
aacucagaauauugucugccuua

SEQ ID NO: 590010 - RNA, 12 nt, Homo sapiens
aacucagggaca

SEQ ID NO: 590011 - RNA, 19 nt, Homo sapiens
aacucagggacagagccau

SEQ ID NO: 590012 - RNA, 20 nt, Homo sapiens
aacucagggacagagccaug

SEQ ID NO: 590013 - RNA, 13 nt, Homo sapiens
aacucccugcccc

SEQ ID NO: 590014 - RNA, 15 nt, Homo sapiens
aacuccuacuaaauc

SEQ ID NO: 590015 - RNA, 16 nt, Homo sapiens
aacuccuacuaaaucc

SEQ ID NO: 590016 - RNA, 17 nt, Homo sapiens
aacuccuacuaaauccc

SEQ ID NO: 590017 - RNA, 16 nt, Homo sapiens
aacuccuauaauuccc

SEQ ID NO: 590018 - RNA, 18 nt, Homo sapiens
aacuccugaaaugccaag

SEQ ID NO: 590019 - RNA, 11 nt, Homo sapiens
aacuccugacc

SEQ ID NO: 590020 - RNA, 19 nt, Homo sapiens
aacuccugaccuugugauc

SEQ ID NO: 590021 - RNA, 22 nt, Homo sapiens
aacuccuggcuuuccaggagac

SEQ ID NO: 590022 - RNA, 23 nt, Homo sapiens
aacuccuuguuucagaugauucu

SEQ ID NO: 590023 - RNA, 17 nt, Homo sapiens
aacucgggcucccgggu

SEQ ID NO: 590024 - RNA, 14 nt, Homo sapiens
aacucggggacaaa

SEQ ID NO: 590025 - RNA, 22 nt, Homo sapiens
aacucuagcauucuaguuucau

SEQ ID NO: 590026 - RNA, 22 nt, Homo sapiens
aacucucaccaugaugugaaga

SEQ ID NO: 590027 - RNA, 13 nt, Homo sapiens
aacucucauuucu

SEQ ID NO: 590028 - RNA, 15 nt, Homo sapiens
aacucuccacuccau

SEQ ID NO: 590029 - RNA, 20 nt, Homo sapiens
aacucuccccuugucugcac

SEQ ID NO: 590030 - RNA, 16 nt, Homo sapiens
aacucucuaaacuggu

SEQ ID NO: 590031 - RNA, 16 nt, Homo sapiens
aacucugaagccacaa

SEQ ID NO: 590032 - RNA, 23 nt, Homo sapiens
aacucugagcaguuucauuguga

SEQ ID NO: 590033 - RNA, 16 nt, Homo sapiens
aacucugccagccaca

SEQ ID NO: 590034 - RNA, 21 nt, Homo sapiens
aacucugccugagacuuucag

SEQ ID NO: 590035 - RNA, 16 nt, Homo sapiens
aacucuguaaaaccuc

SEQ ID NO: 590036 - RNA, 20 nt, Homo sapiens
aacucuguauuacagcuuuc

SEQ ID NO: 590037 - RNA, 21 nt, Homo sapiens
aacucuguccacgauucacuc

SEQ ID NO: 590038 - RNA, 16 nt, Homo sapiens
aacucuucagugcaaa

SEQ ID NO: 590039 - RNA, 19 nt, Homo sapiens
aacucuugaagacuccagu

SEQ ID NO: 590040 - RNA, 16 nt, Homo sapiens
aacucuugaccucagg

SEQ ID NO: 590041 - RNA, 22 nt, Homo sapiens
aacucuugacuuccugccaugg

SEQ ID NO: 590042 - RNA, 17 nt, Homo sapiens
aacugaaaugccugcuu

SEQ ID NO: 590043 - RNA, 21 nt, Homo sapiens
aacugaaaugccugcuuugaa

SEQ ID NO: 590044 - RNA, 13 nt, Homo sapiens
aacugaaccacaa

SEQ ID NO: 590045 - RNA, 14 nt, Homo sapiens
aacugaacucacuu

SEQ ID NO: 590046 - RNA, 20 nt, Homo sapiens
aacugaaggcuaaaaagcaa

SEQ ID NO: 590047 - RNA, 15 nt, Homo sapiens
aacugaauaaauacc

SEQ ID NO: 590048 - RNA, 13 nt, Homo sapiens
aacugacaguaaa

SEQ ID NO: 590049 - RNA, 13 nt, Homo sapiens
aacugacaugccc

SEQ ID NO: 590050 - RNA, 22 nt, Homo sapiens
aacugacuagugagauggccug

SEQ ID NO: 590051 - RNA, 13 nt, Homo sapiens
aacugacugccuu

SEQ ID NO: 590052 - RNA, 23 nt, Homo sapiens
aacugacugccuugcuaaaagau

SEQ ID NO: 590053 - RNA, 20 nt, Homo sapiens
aacugacuucauuugugcca

SEQ ID NO: 590054 - RNA, 22 nt, Homo sapiens
aacugagacacauuggcuuugu

SEQ ID NO: 590055 - RNA, 16 nt, Homo sapiens
aacugagagucauaua

SEQ ID NO: 590056 - RNA, 16 nt, Homo sapiens
aacugagcuacuagag

SEQ ID NO: 590057 - RNA, 16 nt, Homo sapiens
aacugaggcccuguga

SEQ ID NO: 590058 - RNA, 18 nt, Homo sapiens
aacugaggguuaucuuug

SEQ ID NO: 590059 - RNA, 21 nt, Homo sapiens
aacugagugugcucuuagcuc

SEQ ID NO: 590060 - RNA, 21 nt, Homo sapiens
aacugaugaguaaacugaggc

SEQ ID NO: 590061 - RNA, 16 nt, Homo sapiens
aacugcagcaguggcu

SEQ ID NO: 590062 - RNA, 15 nt, Homo sapiens
aacugcauggaccua

SEQ ID NO: 590063 - RNA, 19 nt, Homo sapiens
aacugccugggccaugcga

SEQ ID NO: 590064 - RNA, 21 nt, Homo sapiens
aacugccuuggcuucagggga

SEQ ID NO: 590065 - RNA, 18 nt, Homo sapiens
aacugcugcugugcacau

SEQ ID NO: 590066 - RNA, 18 nt, Homo sapiens
aacugcuguugggaacca

SEQ ID NO: 590067 - RNA, 22 nt, Homo sapiens
aacugcuuuauacacugucacg

SEQ ID NO: 590068 - RNA, 17 nt, Homo sapiens
aacugcuuuauuuuccc

SEQ ID NO: 590069 - RNA, 14 nt, Homo sapiens
aacuggaaggccuu

SEQ ID NO: 590070 - RNA, 23 nt, Homo sapiens
aacuggacucauuaucacaguga

SEQ ID NO: 590071 - RNA, 20 nt, Homo sapiens
aacuggaggaguuccuugau

SEQ ID NO: 590072 - RNA, 21 nt, Homo sapiens
aacuggaggaguuccuugauc

SEQ ID NO: 590073 - RNA, 22 nt, Homo sapiens
aacuggcccguggagacugaga

SEQ ID NO: 590074 - RNA, 14 nt, Homo sapiens
aacuggcucugauu

SEQ ID NO: 590075 - RNA, 23 nt, Homo sapiens
aacuggggaaugggguauggaag

SEQ ID NO: 590076 - RNA, 18 nt, Homo sapiens
aacuggggauauaauacu

SEQ ID NO: 590077 - RNA, 21 nt, Homo sapiens
aacugggggcucuguauauag

SEQ ID NO: 590078 - RNA, 23 nt, Homo sapiens
aacugguuccuagggauguguga

SEQ ID NO: 590079 - RNA, 21 nt, Homo sapiens
aacuguaaaugugacauugau

SEQ ID NO: 590080 - RNA, 21 nt, Homo sapiens
aacuguaacguuuucuuucac

SEQ ID NO: 590081 - RNA, 23 nt, Homo sapiens
aacuguacauuuaaaauugcuau

SEQ ID NO: 590082 - RNA, 14 nt, Homo sapiens
aacuguacuacauc

SEQ ID NO: 590083 - RNA, 15 nt, Homo sapiens
aacuguacuguguuu

SEQ ID NO: 590084 - RNA, 21 nt, Homo sapiens
aacuguauacauuacaaucau

SEQ ID NO: 590085 - RNA, 18 nt, Homo sapiens
aacuguaugggagcuuaa

SEQ ID NO: 590086 - RNA, 20 nt, Homo sapiens
aacugucacucauugcugag

SEQ ID NO: 590087 - RNA, 13 nt, Homo sapiens
aacuguccaccaa

SEQ ID NO: 590088 - RNA, 15 nt, Homo sapiens
aacugucuuguuuca

SEQ ID NO: 590089 - RNA, 19 nt, Homo sapiens
aacugucuuguuucaguga

SEQ ID NO: 590090 - RNA, 20 nt, Homo sapiens
aacugugaauacuugaacuc

SEQ ID NO: 590091 - RNA, 22 nt, Homo sapiens
aacugugacugcagugcuguaa

SEQ ID NO: 590092 - RNA, 12 nt, Homo sapiens
aacugugacugu

SEQ ID NO: 590093 - RNA, 15 nt, Homo sapiens
aacugugcuccucac

SEQ ID NO: 590094 - RNA, 19 nt, Homo sapiens
aacugugcuccucacuucc

SEQ ID NO: 590095 - RNA, 15 nt, Homo sapiens
aacuguggugccaca

SEQ ID NO: 590096 - RNA, 17 nt, Homo sapiens
aacuguguauguacaua

SEQ ID NO: 590097 - RNA, 14 nt, Homo sapiens
aacuguguauuuau

SEQ ID NO: 590098 - RNA, 21 nt, Homo sapiens
aacugugucuggcguucucaa

SEQ ID NO: 590099 - RNA, 18 nt, Homo sapiens
aacuguuagcacuguuga

SEQ ID NO: 590100 - RNA, 13 nt, Homo sapiens
aacuguuaugaaa

SEQ ID NO: 590101 - RNA, 12 nt, Homo sapiens
aacuguucucuu

SEQ ID NO: 590102 - RNA, 19 nt, Homo sapiens
aacuuaacuguucuuugcc

SEQ ID NO: 590103 - RNA, 14 nt, Homo sapiens
aacuuaagcaaagg

SEQ ID NO: 590104 - RNA, 12 nt, Homo sapiens
aacuuaauguuc

SEQ ID NO: 590105 - RNA, 14 nt, Homo sapiens
aacuuacaccugga

SEQ ID NO: 590106 - RNA, 18 nt, Homo sapiens
aacuuacuguauauguau

SEQ ID NO: 590107 - RNA, 16 nt, Homo sapiens
aacuuacuuaguguua

SEQ ID NO: 590108 - RNA, 14 nt, Homo sapiens
aacuuagugacaaa

SEQ ID NO: 590109 - RNA, 22 nt, Homo sapiens
aacuuauucucuguaggccaaa

SEQ ID NO: 590110 - RNA, 13 nt, Homo sapiens
aacuucaaagagg

SEQ ID NO: 590111 - RNA, 15 nt, Homo sapiens
aacuucaaagaggaa

SEQ ID NO: 590112 - RNA, 13 nt, Homo sapiens
aacuucaagcaaa

SEQ ID NO: 590113 - RNA, 16 nt, Homo sapiens
aacuucaauuuacuua

SEQ ID NO: 590114 - RNA, 20 nt, Homo sapiens
aacuucaccuacauuaucuc

SEQ ID NO: 590115 - RNA, 13 nt, Homo sapiens
aacuucagggauc

SEQ ID NO: 590116 - RNA, 12 nt, Homo sapiens
acaagagcugcu

SEQ ID NO: 590117 - RNA, 19 nt, Homo sapiens
acaagagcugcuguccuuu

SEQ ID NO: 590118 - RNA, 22 nt, Homo sapiens
acaagaggccauuuaaguaucu

SEQ ID NO: 590119 - RNA, 21 nt, Homo sapiens
acaagauaaugcuggcuccaa

SEQ ID NO: 590120 - RNA, 14 nt, Homo sapiens
acaagauaccggug

SEQ ID NO: 590121 - RNA, 19 nt, Homo sapiens
acaagauauuguacauaaa

SEQ ID NO: 590122 - RNA, 13 nt, Homo sapiens
acaagaugagauu

SEQ ID NO: 590123 - RNA, 21 nt, Homo sapiens
acaagauggcgaccaccaaag

SEQ ID NO: 590124 - RNA, 11 nt, Homo sapiens
acaagauuccc

SEQ ID NO: 590125 - RNA, 17 nt, Homo sapiens
acaagauuuccuacuuu

SEQ ID NO: 590126 - RNA, 17 nt, Homo sapiens
acaagcagugucuguca

SEQ ID NO: 590127 - RNA, 20 nt, Homo sapiens
acaagccaacgacaaagcca

SEQ ID NO: 590128 - RNA, 15 nt, Homo sapiens
acaagccaagaaaga

SEQ ID NO: 590129 - RNA, 19 nt, Homo sapiens
acaagcccguuagccccag

SEQ ID NO: 590130 - RNA, 19 nt, Homo sapiens
acaagcgaaucucugccuu

SEQ ID NO: 590131 - RNA, 15 nt, Homo sapiens
acaagcuuacaaaga

SEQ ID NO: 590132 - RNA, 17 nt, Homo sapiens
acaagcuuguccaugua

SEQ ID NO: 590133 - RNA, 16 nt, Homo sapiens
acaaggcccugagcuu

SEQ ID NO: 590134 - RNA, 16 nt, Homo sapiens
acaaggcugaccaaga

SEQ ID NO: 590135 - RNA, 18 nt, Homo sapiens
acaaggcugaccaagaga

SEQ ID NO: 590136 - RNA, 15 nt, Homo sapiens
acaaggcugaggaua

SEQ ID NO: 590137 - RNA, 13 nt, Homo sapiens
acaaggugacaaa

SEQ ID NO: 590138 - RNA, 20 nt, Homo sapiens
acaagguucccucugagaau

SEQ ID NO: 590139 - RNA, 16 nt, Homo sapiens
acaaguaaaacugugg

SEQ ID NO: 590140 - RNA, 17 nt, Homo sapiens
acaaguaaaacuguggu

SEQ ID NO: 590141 - RNA, 14 nt, Homo sapiens
acaaguacuaauaa

SEQ ID NO: 590142 - RNA, 21 nt, Homo sapiens
acaaguauuauuuuacaauca

SEQ ID NO: 590143 - RNA, 22 nt, Homo sapiens
acaaguauucauuuuuucuacc

SEQ ID NO: 590144 - RNA, 20 nt, Homo sapiens
acaagucaguaggacuccuu

SEQ ID NO: 590145 - RNA, 13 nt, Homo sapiens
acaagugacugua

SEQ ID NO: 590146 - RNA, 14 nt, Homo sapiens
acaagugagacaaa

SEQ ID NO: 590147 - RNA, 18 nt, Homo sapiens
acaagugggugaaugugg

SEQ ID NO: 590148 - RNA, 12 nt, Homo sapiens
acaagugucuaa

SEQ ID NO: 590149 - RNA, 17 nt, Homo sapiens
acaagugugaugccaua

SEQ ID NO: 590150 - RNA, 20 nt, Homo sapiens
acaaguuccaguucugcaaa

SEQ ID NO: 590151 - RNA, 23 nt, Homo sapiens
acaaguuucugauaccacugcac

SEQ ID NO: 590152 - RNA, 22 nt, Homo sapiens
acaauaaaaccugggugucaga

SEQ ID NO: 590153 - RNA, 15 nt, Homo sapiens
acaauaaaaugucuu

SEQ ID NO: 590154 - RNA, 17 nt, Homo sapiens
acaauaaaaugucuucu

SEQ ID NO: 590155 - RNA, 22 nt, Homo sapiens
acaauaaaaugucuucucccac

SEQ ID NO: 590156 - RNA, 21 nt, Homo sapiens
acaauaaacgguacuugucau

SEQ ID NO: 590157 - RNA, 18 nt, Homo sapiens
acaauaaagcaguccugu

SEQ ID NO: 590158 - RNA, 21 nt, Homo sapiens
acaauaaauauucugcaugga

SEQ ID NO: 590159 - RNA, 15 nt, Homo sapiens
acaauaaaugccacu

SEQ ID NO: 590160 - RNA, 20 nt, Homo sapiens
acaauaaauggccagugcug

SEQ ID NO: 590161 - RNA, 21 nt, Homo sapiens
acaauaaauguauucaaauac

SEQ ID NO: 590162 - RNA, 14 nt, Homo sapiens
acaauaacacuaaa

SEQ ID NO: 590163 - RNA, 15 nt, Homo sapiens
acaauaacacugucu

SEQ ID NO: 590164 - RNA, 21 nt, Homo sapiens
acaauaccguguggugaaaau

SEQ ID NO: 590165 - RNA, 17 nt, Homo sapiens
acaauagacauugcaaa

SEQ ID NO: 590166 - RNA, 23 nt, Homo sapiens
acaauaggucuuucucucaguga

SEQ ID NO: 590167 - RNA, 14 nt, Homo sapiens
acaauauacuucac

SEQ ID NO: 590168 - RNA, 13 nt, Homo sapiens
acaauauaugucc

SEQ ID NO: 590169 - RNA, 13 nt, Homo sapiens
acaauaucugcag

SEQ ID NO: 590170 - RNA, 17 nt, Homo sapiens
acaauauguaaucaaac

SEQ ID NO: 590171 - RNA, 19 nt, Homo sapiens
acaaucaaagaaaagacuu

SEQ ID NO: 590172 - RNA, 16 nt, Homo sapiens
acaaucaaagcacuug

SEQ ID NO: 590173 - RNA, 19 nt, Homo sapiens
acaaucaucaucauucuca

SEQ ID NO: 590174 - RNA, 18 nt, Homo sapiens
acaaucaugaaauaugca

SEQ ID NO: 590175 - RNA, 15 nt, Homo sapiens
acaauccaucucuca

SEQ ID NO: 590176 - RNA, 23 nt, Homo sapiens
acaauccuucuauucuagccugc

SEQ ID NO: 590177 - RNA, 12 nt, Homo sapiens
acaaugaaauau

SEQ ID NO: 590178 - RNA, 17 nt, Homo sapiens
acaaugacuuacuguac

SEQ ID NO: 590179 - RNA, 16 nt, Homo sapiens
acaaugagcaaugagg

SEQ ID NO: 590180 - RNA, 14 nt, Homo sapiens
acaaugauaugcaa

SEQ ID NO: 590181 - RNA, 14 nt, Homo sapiens
acaaugcaugugcu

SEQ ID NO: 590182 - RNA, 16 nt, Homo sapiens
acaaugcaugugcugu

SEQ ID NO: 590183 - RNA, 21 nt, Homo sapiens
acaaugccagaccgcagagag

SEQ ID NO: 590184 - RNA, 21 nt, Homo sapiens
acaaugccuuugaugaacugu

SEQ ID NO: 590185 - RNA, 21 nt, Homo sapiens
acaauggcccaggucucucaa

SEQ ID NO: 590186 - RNA, 18 nt, Homo sapiens
acaauggcuaauucccag

SEQ ID NO: 590187 - RNA, 22 nt, Homo sapiens
acaauggucauuuccagacaaa

SEQ ID NO: 590188 - RNA, 13 nt, Homo sapiens
acaaugucccuuc

SEQ ID NO: 590189 - RNA, 13 nt, Homo sapiens
acaaugugaaaag

SEQ ID NO: 590190 - RNA, 15 nt, Homo sapiens
acaauguucauccca

SEQ ID NO: 590191 - RNA, 22 nt, Homo sapiens
acaauguugcauuuaugaugca

SEQ ID NO: 590192 - RNA, 19 nt, Homo sapiens
acaauguuucuucauuucu

SEQ ID NO: 590193 - RNA, 22 nt, Homo sapiens
acaauuaaaaugacaagcacua

SEQ ID NO: 590194 - RNA, 19 nt, Homo sapiens
acaauuaaaccgcauguga

SEQ ID NO: 590195 - RNA, 17 nt, Homo sapiens
acaauucaguaacaaag

SEQ ID NO: 590196 - RNA, 10 nt, Homo sapiens
acaauuccac

SEQ ID NO: 590197 - RNA, 12 nt, Homo sapiens
acaauuccacac

SEQ ID NO: 590198 - RNA, 16 nt, Homo sapiens
acaauuccuagauaaa

SEQ ID NO: 590199 - RNA, 13 nt, Homo sapiens
acaauucuguccc

SEQ ID NO: 590200 - RNA, 23 nt, Homo sapiens
acaauucugugacauacauauua

SEQ ID NO: 590201 - RNA, 15 nt, Homo sapiens
acaauugcaguuuug

SEQ ID NO: 590202 - RNA, 17 nt, Homo sapiens
acaauugcaguuuugcc

SEQ ID NO: 590203 - RNA, 22 nt, Homo sapiens
acaauuguaaaauuuaaaucau

SEQ ID NO: 590204 - RNA, 17 nt, Homo sapiens
acaauuuauaugcuuca

SEQ ID NO: 590205 - RNA, 17 nt, Homo sapiens
acaauuuucugcaggau

SEQ ID NO: 590206 - RNA, 9 nt, Homo sapiens
acacaaaac

SEQ ID NO: 590207 - RNA, 18 nt, Homo sapiens
acacaaaauccauuccag

SEQ ID NO: 590208 - RNA, 17 nt, Homo sapiens
acacaaaccacaccaca

SEQ ID NO: 590209 - RNA, 12 nt, Homo sapiens
acacaaagggaa

SEQ ID NO: 590210 - RNA, 13 nt, Homo sapiens
acacaaaugcaug

SEQ ID NO: 590211 - RNA, 14 nt, Homo sapiens
acacaaauucuaaa

SEQ ID NO: 590212 - RNA, 15 nt, Homo sapiens
acacaaauuugccug

SEQ ID NO: 590213 - RNA, 15 nt, Homo sapiens
acacaaauuuguaaa

SEQ ID NO: 590214 - RNA, 14 nt, Homo sapiens
acacaacuuugcaa

SEQ ID NO: 590215 - RNA, 13 nt, Homo sapiens
acacaagcacuuu

SEQ ID NO: 590216 - RNA, 16 nt, Homo sapiens
acacaauccuccaaga

SEQ ID NO: 590217 - RNA, 13 nt, Homo sapiens
acacaaucucugu

SEQ ID NO: 590218 - RNA, 19 nt, Homo sapiens
acacaauuguuuuaccugu

SEQ ID NO: 590219 - RNA, 20 nt, Homo sapiens
acacaauuguuuuaccuguu

SEQ ID NO: 590220 - RNA, 13 nt, Homo sapiens
acacacaauaaag

SEQ ID NO: 590221 - RNA, 11 nt, Homo sapiens
acacacacagg

SEQ ID NO: 590222 - RNA, 14 nt, Homo sapiens
acacacacgaugca

SEQ ID NO: 590223 - RNA, 14 nt, Homo sapiens
acacacacugucug

SEQ ID NO: 590224 - RNA, 18 nt, Homo sapiens
acacacacugucuggggc

SEQ ID NO: 590225 - RNA, 20 nt, Homo sapiens
acacacagacuuucugugac

SEQ ID NO: 590226 - RNA, 17 nt, Homo sapiens
acacacauacaaaaugu

SEQ ID NO: 590227 - RNA, 17 nt, Homo sapiens
acacacauauacauaua

SEQ ID NO: 590228 - RNA, 19 nt, Homo sapiens
acacaccccaacaugccug

SEQ ID NO: 590229 - RNA, 13 nt, Homo sapiens
acacaccuagcca

SEQ ID NO: 590230 - RNA, 17 nt, Homo sapiens
acacacgaugcauuuaa

SEQ ID NO: 590231 - RNA, 15 nt, Homo sapiens
acacacguaccuuca

SEQ ID NO: 590232 - RNA, 16 nt, Homo sapiens
acacacguaccuucau

SEQ ID NO: 590233 - RNA, 20 nt, Homo sapiens
acacacgugagcaacugugc

SEQ ID NO: 590234 - RNA, 18 nt, Homo sapiens
acacacgugcugugggcc

SEQ ID NO: 590235 - RNA, 13 nt, Homo sapiens
acacacuggaccc

SEQ ID NO: 590236 - RNA, 11 nt, Homo sapiens
acacacugugc

SEQ ID NO: 590237 - RNA, 23 nt, Homo sapiens
acacacuuguugauuaauggaaa

SEQ ID NO: 590238 - RNA, 17 nt, Homo sapiens
acacagaagccuuugau

SEQ ID NO: 590239 - RNA, 15 nt, Homo sapiens
acacagacaguuucu

SEQ ID NO: 590240 - RNA, 14 nt, Homo sapiens
acacagacuggcaa

SEQ ID NO: 590241 - RNA, 22 nt, Homo sapiens
acacagacuggcaauaaacucc

SEQ ID NO: 590242 - RNA, 18 nt, Homo sapiens
acacagagaaauacaaaa

SEQ ID NO: 590243 - RNA, 17 nt, Homo sapiens
acacagcaggacuccau

SEQ ID NO: 590244 - RNA, 14 nt, Homo sapiens
acacagcauuguau

SEQ ID NO: 590245 - RNA, 18 nt, Homo sapiens
acacagccaagccaguca

SEQ ID NO: 590246 - RNA, 12 nt, Homo sapiens
acacagcuccuc

SEQ ID NO: 590247 - RNA, 19 nt, Homo sapiens
acacagcucucuccacaac

SEQ ID NO: 590248 - RNA, 20 nt, Homo sapiens
acacagcugaugaacugugg

SEQ ID NO: 590249 - RNA, 23 nt, Homo sapiens
acacagcugcccuagcugacccc

SEQ ID NO: 590250 - RNA, 16 nt, Homo sapiens
acacagcuuuaugaua

SEQ ID NO: 590251 - RNA, 12 nt, Homo sapiens
acacaggaugag

SEQ ID NO: 590252 - RNA, 11 nt, Homo sapiens
acacaggguga

SEQ ID NO: 590253 - RNA, 19 nt, Homo sapiens
acacaguaauugugacaau

SEQ ID NO: 590254 - RNA, 16 nt, Homo sapiens
acacagucacuuggga

SEQ ID NO: 590255 - RNA, 11 nt, Homo sapiens
acacagugaaa

SEQ ID NO: 590256 - RNA, 19 nt, Homo sapiens
acacagugaccauacuaau

SEQ ID NO: 590257 - RNA, 20 nt, Homo sapiens
acacagugagaguacucacu

SEQ ID NO: 590258 - RNA, 13 nt, Homo sapiens
acacagugaugaa

SEQ ID NO: 590259 - RNA, 13 nt, Homo sapiens
acacauacagagc

SEQ ID NO: 590260 - RNA, 22 nt, Homo sapiens
acacauauacauguaggagugu

SEQ ID NO: 590261 - RNA, 23 nt, Homo sapiens
acacaucagcucaaaauuugcaa

SEQ ID NO: 590262 - RNA, 22 nt, Homo sapiens
acacauccccagaauccauaaa

SEQ ID NO: 590263 - RNA, 15 nt, Homo sapiens
acacaucuuaccucu

SEQ ID NO: 590264 - RNA, 22 nt, Homo sapiens
acacaugagaugguauauccuu

SEQ ID NO: 590265 - RNA, 16 nt, Homo sapiens
acacaugugcagucac

SEQ ID NO: 590266 - RNA, 19 nt, Homo sapiens
acacaugugcagucacugg

SEQ ID NO: 590267 - RNA, 22 nt, Homo sapiens
acacaugugcugauguuuacaa

SEQ ID NO: 590268 - RNA, 13 nt, Homo sapiens
acacauguucugu

SEQ ID NO: 590269 - RNA, 22 nt, Homo sapiens
acacauucaggaguuaaauauu

SEQ ID NO: 590270 - RNA, 20 nt, Homo sapiens
acacauuccugcauucaugu

SEQ ID NO: 590271 - RNA, 19 nt, Homo sapiens
acacauugaaugcgcuuua

SEQ ID NO: 590272 - RNA, 17 nt, Homo sapiens
acacauuggaaugccuu

SEQ ID NO: 590273 - RNA, 21 nt, Homo sapiens
acacauuguacaugguacgaa

SEQ ID NO: 590274 - RNA, 13 nt, Homo sapiens
acacauuugccca

SEQ ID NO: 590275 - RNA, 17 nt, Homo sapiens
acacauuuggcaguuua

SEQ ID NO: 590276 - RNA, 21 nt, Homo sapiens
acacauuuuuuaaaugcaccu

SEQ ID NO: 590277 - RNA, 18 nt, Homo sapiens
acaccaaauuuuucuauc

SEQ ID NO: 590278 - RNA, 19 nt, Homo sapiens
acaccaaguaccaguauaa

SEQ ID NO: 590279 - RNA, 23 nt, Homo sapiens
acaccacaucuaagccugaaggg

SEQ ID NO: 590280 - RNA, 16 nt, Homo sapiens
acaccacuguugccuu

SEQ ID NO: 590281 - RNA, 23 nt, Homo sapiens
acaccagacugaaguaaacagcu

SEQ ID NO: 590282 - RNA, 13 nt, Homo sapiens
acaccaggcugug

SEQ ID NO: 590283 - RNA, 13 nt, Homo sapiens
acaccaugugcaa

SEQ ID NO: 590284 - RNA, 14 nt, Homo sapiens
acaccauuuuggca

SEQ ID NO: 590285 - RNA, 16 nt, Homo sapiens
acaccauuuuggcaag

SEQ ID NO: 590286 - RNA, 23 nt, Homo sapiens
acacccaaguugaagacuuuguu

SEQ ID NO: 590287 - RNA, 19 nt, Homo sapiens
acacccagcccagcuugcc

SEQ ID NO: 590288 - RNA, 22 nt, Homo sapiens
acacccagugcgugaagaccaa

SEQ ID NO: 590289 - RNA, 17 nt, Homo sapiens
acacccaugcacacuca

SEQ ID NO: 590290 - RNA, 23 nt, Homo sapiens
acaccccugcucuacccaugagc

SEQ ID NO: 590291 - RNA, 16 nt, Homo sapiens
acaccccuuuuccagu

SEQ ID NO: 590292 - RNA, 16 nt, Homo sapiens
acacccgacuccucaa

SEQ ID NO: 590293 - RNA, 19 nt, Homo sapiens
acacccugccccuggugcc

SEQ ID NO: 590294 - RNA, 17 nt, Homo sapiens
acaccgagacaccaccu

SEQ ID NO: 590295 - RNA, 13 nt, Homo sapiens
acaccuaagagaa

SEQ ID NO: 590296 - RNA, 22 nt, Homo sapiens
acaccuagaaaggaacugcaau

SEQ ID NO: 590297 - RNA, 18 nt, Homo sapiens
acaccuagccagcuguca

SEQ ID NO: 590298 - RNA, 16 nt, Homo sapiens
acaccuccuucuuccu

SEQ ID NO: 590299 - RNA, 21 nt, Homo sapiens
acaccugggcaaacuuucuuc

SEQ ID NO: 590300 - RNA, 15 nt, Homo sapiens
acaccuguaauccca

SEQ ID NO: 590301 - RNA, 12 nt, Homo sapiens
acaccuucaucc

SEQ ID NO: 590302 - RNA, 18 nt, Homo sapiens
acaccuuuuauugacaca

SEQ ID NO: 590303 - RNA, 20 nt, Homo sapiens
acaccuuuuccccaaccaca

SEQ ID NO: 590304 - RNA, 14 nt, Homo sapiens
acacgaguuccaga

SEQ ID NO: 590305 - RNA, 15 nt, Homo sapiens
acacgauaaagggau

SEQ ID NO: 590306 - RNA, 15 nt, Homo sapiens
acacgcacacaucuu

SEQ ID NO: 590307 - RNA, 20 nt, Homo sapiens
acacgcacacaucuuaccuc

SEQ ID NO: 590308 - RNA, 19 nt, Homo sapiens
acacgcaccugccucagga

SEQ ID NO: 590309 - RNA, 12 nt, Homo sapiens
acacgcauuaau

SEQ ID NO: 590310 - RNA, 22 nt, Homo sapiens
acacgcccuccccagacuccac

SEQ ID NO: 590311 - RNA, 19 nt, Homo sapiens
acacgcgugugcuccucuc

SEQ ID NO: 590312 - RNA, 14 nt, Homo sapiens
acacggcagguagc

SEQ ID NO: 590313 - RNA, 21 nt, Homo sapiens
acacggcugugacgagguggc

SEQ ID NO: 590314 - RNA, 16 nt, Homo sapiens
acacguaaguauaaau

SEQ ID NO: 590315 - RNA, 18 nt, Homo sapiens
acacguaccuucauguga

SEQ ID NO: 590316 - RNA, 22 nt, Homo sapiens
acacguaucucuugguaugcau

SEQ ID NO: 590317 - RNA, 20 nt, Homo sapiens
acacgugcgugcgagcacac

SEQ ID NO: 590318 - RNA, 14 nt, Homo sapiens
acacguguguauga

SEQ ID NO: 590319 - RNA, 19 nt, Homo sapiens
acacuaaaacuuuccugac

SEQ ID NO: 590320 - RNA, 22 nt, Homo sapiens
acacuaacgaaauaucaaaguc

SEQ ID NO: 590321 - RNA, 20 nt, Homo sapiens
acacuacaaauuuauucuug

SEQ ID NO: 590322 - RNA, 13 nt, Homo sapiens
acacuacagauca

SEQ ID NO: 590323 - RNA, 16 nt, Homo sapiens
acacuaccacauuaaa

SEQ ID NO: 590324 - RNA, 20 nt, Homo sapiens
acacuacugcuaaauccuca

SEQ ID NO: 590325 - RNA, 18 nt, Homo sapiens
acacuagaaaacuugacu

SEQ ID NO: 590326 - RNA, 19 nt, Homo sapiens
acacuagaauucaugugag

SEQ ID NO: 590327 - RNA, 22 nt, Homo sapiens
acacuagagaccaaaaagggga

SEQ ID NO: 590328 - RNA, 19 nt, Homo sapiens
acacuauaaagguugacaa

SEQ ID NO: 590329 - RNA, 15 nt, Homo sapiens
acacuaugugcaaaa

SEQ ID NO: 590330 - RNA, 20 nt, Homo sapiens
acacuauuuaucugugcaaa

SEQ ID NO: 590331 - RNA, 16 nt, Homo sapiens
acacucaaaagcuggg

SEQ ID NO: 590332 - RNA, 15 nt, Homo sapiens
acacucaccaguggc

SEQ ID NO: 590333 - RNA, 23 nt, Homo sapiens
acacucaccugcacuaacagagu

SEQ ID NO: 590334 - RNA, 11 nt, Homo sapiens
acacucagggc

SEQ ID NO: 590335 - RNA, 20 nt, Homo sapiens
acacuccacuccacacucuu

SEQ ID NO: 590336 - RNA, 20 nt, Homo sapiens
acacuccacuugaagcacuu

SEQ ID NO: 590337 - RNA, 23 nt, Homo sapiens
acacuccacuugaagcacuuaag

SEQ ID NO: 590338 - RNA, 12 nt, Homo sapiens
acacuccagugc

SEQ ID NO: 590339 - RNA, 12 nt, Homo sapiens
acacuccaugag

SEQ ID NO: 590340 - RNA, 18 nt, Homo sapiens
acacuccugggcucugaa

SEQ ID NO: 590341 - RNA, 19 nt, Homo sapiens
acacucgggcccaugggau

SEQ ID NO: 590342 - RNA, 18 nt, Homo sapiens
acacucuagugacuuccu

SEQ ID NO: 590343 - RNA, 16 nt, Homo sapiens
acacucuccaaacagu

SEQ ID NO: 590344 - RNA, 17 nt, Homo sapiens
acacucuccaaacaguc

SEQ ID NO: 590345 - RNA, 22 nt, Homo sapiens
acacucuccaaacagucaccau

SEQ ID NO: 590346 - RNA, 22 nt, Homo sapiens
acacucuggcugcucccugaca

SEQ ID NO: 590347 - RNA, 21 nt, Homo sapiens
acacugaaaaaauacuaccua

SEQ ID NO: 590348 - RNA, 15 nt, Homo sapiens
acacugaaaauguca

SEQ ID NO: 590349 - RNA, 13 nt, Homo sapiens
acacugaaaccaa

SEQ ID NO: 590350 - RNA, 14 nt, Homo sapiens
acacugaaaccaaa

SEQ ID NO: 590351 - RNA, 18 nt, Homo sapiens
acacugaauugaaucuac

SEQ ID NO: 590352 - RNA, 20 nt, Homo sapiens
acacugaauugaaucuacaa

SEQ ID NO: 590353 - RNA, 19 nt, Homo sapiens
acacugacaaagucauccc

SEQ ID NO: 590354 - RNA, 21 nt, Homo sapiens
acacugaggagagauucccgc

SEQ ID NO: 590355 - RNA, 13 nt, Homo sapiens
acacugauuccuu

SEQ ID NO: 590356 - RNA, 16 nt, Homo sapiens
acacugauuccuuuau

SEQ ID NO: 590357 - RNA, 17 nt, Homo sapiens
acacugcacacagugac

SEQ ID NO: 590358 - RNA, 21 nt, Homo sapiens
acacugcacagaccuuaggga

SEQ ID NO: 590359 - RNA, 19 nt, Homo sapiens
acacugcaguuuccuggaa

SEQ ID NO: 590360 - RNA, 17 nt, Homo sapiens
acacugccgacaucagc

SEQ ID NO: 590361 - RNA, 20 nt, Homo sapiens
acacugcuaggugggccagc

SEQ ID NO: 590362 - RNA, 12 nt, Homo sapiens
acacugcugcuc

SEQ ID NO: 590363 - RNA, 21 nt, Homo sapiens
acacugcugcuccagugcagg

SEQ ID NO: 590364 - RNA, 22 nt, Homo sapiens
acacugcugcuccagugcagga

SEQ ID NO: 590365 - RNA, 18 nt, Homo sapiens
acacuggaacauuccagu

SEQ ID NO: 590366 - RNA, 23 nt, Homo sapiens
acacuggaccccacuggcugaga

SEQ ID NO: 590367 - RNA, 13 nt, Homo sapiens
acacuggauccau

SEQ ID NO: 590368 - RNA, 18 nt, Homo sapiens
acacuggcguuacugcuu

SEQ ID NO: 590369 - RNA, 21 nt, Homo sapiens
acacuggcguuacugcuugac

SEQ ID NO: 590370 - RNA, 21 nt, Homo sapiens
acacugguuuggucaguuaca

SEQ ID NO: 590371 - RNA, 21 nt, Homo sapiens
acacuguauguuauagaacuu

SEQ ID NO: 590372 - RNA, 21 nt, Homo sapiens
acacuguauuguaaguggaaa

SEQ ID NO: 590373 - RNA, 9 nt, Homo sapiens
acacugucc

SEQ ID NO: 590374 - RNA, 11 nt, Homo sapiens
acacuguccau

SEQ ID NO: 590375 - RNA, 18 nt, Homo sapiens
acacugugauuuugcccu

SEQ ID NO: 590376 - RNA, 19 nt, Homo sapiens
acacugugcccagcccgga

SEQ ID NO: 590377 - RNA, 13 nt, Homo sapiens
acacugugcccug

SEQ ID NO: 590378 - RNA, 19 nt, Homo sapiens
acacuguggccaggccuua

SEQ ID NO: 590379 - RNA, 20 nt, Homo sapiens
acacuguguaaauacccaua

SEQ ID NO: 590380 - RNA, 15 nt, Homo sapiens
acacuguucugaaag

SEQ ID NO: 590381 - RNA, 14 nt, Homo sapiens
acacuuaacagaug

SEQ ID NO: 590382 - RNA, 15 nt, Homo sapiens
acacuuacacuuuau

SEQ ID NO: 590383 - RNA, 17 nt, Homo sapiens
acacuuacaguauacau

SEQ ID NO: 590384 - RNA, 14 nt, Homo sapiens
acacuuaguaugca

SEQ ID NO: 590385 - RNA, 18 nt, Homo sapiens
acacuuauguuauacaau

SEQ ID NO: 590386 - RNA, 16 nt, Homo sapiens
acacuuccauuaacuu

SEQ ID NO: 590387 - RNA, 16 nt, Homo sapiens
acacuuccugauuuca

SEQ ID NO: 590388 - RNA, 16 nt, Homo sapiens
acacuucggcucucug

SEQ ID NO: 590389 - RNA, 18 nt, Homo sapiens
acacuucugcuuucacuu

SEQ ID NO: 590390 - RNA, 24 nt, Homo sapiens
acacuugcucccaacccauucacu

SEQ ID NO: 590391 - RNA, 21 nt, Homo sapiens
acacuuggagcccgugcagua

SEQ ID NO: 590392 - RNA, 19 nt, Homo sapiens
acacuugguuagacgccuu

SEQ ID NO: 590393 - RNA, 14 nt, Homo sapiens
acacuugucuuuac

SEQ ID NO: 590394 - RNA, 21 nt, Homo sapiens
acacuuguugauuaauggaaa

SEQ ID NO: 590395 - RNA, 22 nt, Homo sapiens
acacuuuaaaaccaguuaccca

SEQ ID NO: 590396 - RNA, 21 nt, Homo sapiens
acacuuuggacuucucugaaa

SEQ ID NO: 590397 - RNA, 17 nt, Homo sapiens
acagaaaagacucugac

SEQ ID NO: 590398 - RNA, 14 nt, Homo sapiens
acagaaacugcaug

SEQ ID NO: 590399 - RNA, 21 nt, Homo sapiens
acagaaagagacuccgucuca

SEQ ID NO: 590400 - RNA, 14 nt, Homo sapiens
acagaaagcacuca

SEQ ID NO: 590401 - RNA, 20 nt, Homo sapiens
acagaaagccugggugacau

SEQ ID NO: 590402 - RNA, 19 nt, Homo sapiens
acagaaaguaucacaaaug

SEQ ID NO: 590403 - RNA, 14 nt, Homo sapiens
acagaaauaaagag

SEQ ID NO: 590404 - RNA, 21 nt, Homo sapiens
acagaaauaaagagcuguuau

SEQ ID NO: 590405 - RNA, 13 nt, Homo sapiens
acagaaauaacag

SEQ ID NO: 590406 - RNA, 16 nt, Homo sapiens
acagaaauacaugaaa

SEQ ID NO: 590407 - RNA, 19 nt, Homo sapiens
acagaaauacugcucugaa

SEQ ID NO: 590408 - RNA, 13 nt, Homo sapiens
acagaaaugacug

SEQ ID NO: 590409 - RNA, 22 nt, Homo sapiens
acagaaauuaucugucauuuga

SEQ ID NO: 590410 - RNA, 15 nt, Homo sapiens
acagaaauuguauau

SEQ ID NO: 590411 - RNA, 12 nt, Homo sapiens
acagaacaaagu

SEQ ID NO: 590412 - RNA, 17 nt, Homo sapiens
acagaacaccuaugcaa

SEQ ID NO: 590413 - RNA, 20 nt, Homo sapiens
acagaacagaauaauaugaa

SEQ ID NO: 590414 - RNA, 23 nt, Homo sapiens
acagaaccuucaacccagugggu

SEQ ID NO: 590415 - RNA, 16 nt, Homo sapiens
acagaacuaagaugau

SEQ ID NO: 590416 - RNA, 12 nt, Homo sapiens
acagaacuacuu

SEQ ID NO: 590417 - RNA, 18 nt, Homo sapiens
acagaacuauguacuuua

SEQ ID NO: 590418 - RNA, 22 nt, Homo sapiens
acagaagcacagcacccauggg

SEQ ID NO: 590419 - RNA, 15 nt, Homo sapiens
acagaagcagacuuu

SEQ ID NO: 590420 - RNA, 16 nt, Homo sapiens
acagaagccaggagca

SEQ ID NO: 590421 - RNA, 22 nt, Homo sapiens
acagaagcuuuagcaagugugc

SEQ ID NO: 590422 - RNA, 16 nt, Homo sapiens
acagaaggaugaauga

SEQ ID NO: 590423 - RNA, 14 nt, Homo sapiens
acagaagggcagug

SEQ ID NO: 590424 - RNA, 12 nt, Homo sapiens
acagaagguccu

SEQ ID NO: 590425 - RNA, 20 nt, Homo sapiens
acagaaguaucaagccaugu

SEQ ID NO: 590426 - RNA, 18 nt, Homo sapiens
acagaaugguggagugua

SEQ ID NO: 590427 - RNA, 20 nt, Homo sapiens
acagaauguuuuacugugaa

SEQ ID NO: 590428 - RNA, 14 nt, Homo sapiens
acagaauuugucag

SEQ ID NO: 590429 - RNA, 17 nt, Homo sapiens
acagaauuugucagaaa

SEQ ID NO: 590430 - RNA, 20 nt, Homo sapiens
acagaauuuuaaagagcaua

SEQ ID NO: 590431 - RNA, 23 nt, Homo sapiens
acagaauuuuuuaaauugacagu

SEQ ID NO: 590432 - RNA, 14 nt, Homo sapiens
acagacacuuuuca

SEQ ID NO: 590433 - RNA, 14 nt, Homo sapiens
acagacaggcucuu

SEQ ID NO: 590434 - RNA, 18 nt, Homo sapiens
acagaccacaucuuuauc

SEQ ID NO: 590435 - RNA, 20 nt, Homo sapiens
acagaccuacugcacugagu

SEQ ID NO: 590436 - RNA, 10 nt, Homo sapiens
acagacuccg

SEQ ID NO: 590437 - RNA, 12 nt, Homo sapiens
acagacucucac

SEQ ID NO: 590438 - RNA, 13 nt, Homo sapiens
acagacucucaca

SEQ ID NO: 590439 - RNA, 23 nt, Homo sapiens
acagacugaauuuuaaauguuca

SEQ ID NO: 590440 - RNA, 20 nt, Homo sapiens
acagacugaugccagacaaa

SEQ ID NO: 590441 - RNA, 14 nt, Homo sapiens
acagacuggcaaua

SEQ ID NO: 590442 - RNA, 12 nt, Homo sapiens
acagacugugag

SEQ ID NO: 590443 - RNA, 22 nt, Homo sapiens
acagacugugaguacagcagaa

SEQ ID NO: 590444 - RNA, 17 nt, Homo sapiens
acagacuucuccagacc

SEQ ID NO: 590445 - RNA, 16 nt, Homo sapiens
acagacuugaaugcua

SEQ ID NO: 590446 - RNA, 21 nt, Homo sapiens
acagagaagaccuucuaguga

SEQ ID NO: 590447 - RNA, 19 nt, Homo sapiens
acagagaagcggauuucca

SEQ ID NO: 590448 - RNA, 12 nt, Homo sapiens
acagagaagcug

SEQ ID NO: 590449 - RNA, 19 nt, Homo sapiens
acagagaaguuuguagcca

SEQ ID NO: 590450 - RNA, 17 nt, Homo sapiens
acagagacuuuaaucac

SEQ ID NO: 590451 - RNA, 20 nt, Homo sapiens
acagagagacagacuugaga

SEQ ID NO: 590452 - RNA, 15 nt, Homo sapiens
acagagaugugauaa

SEQ ID NO: 590453 - RNA, 16 nt, Homo sapiens
acagagauugaacucc

SEQ ID NO: 590454 - RNA, 21 nt, Homo sapiens
acagagcaagacuccaucuca

SEQ ID NO: 590455 - RNA, 20 nt, Homo sapiens
acagagcaagacucugucuc

SEQ ID NO: 590456 - RNA, 20 nt, Homo sapiens
acagagcaggggcuccagca

SEQ ID NO: 590457 - RNA, 20 nt, Homo sapiens
acagagcgagacuccaucuc

SEQ ID NO: 590458 - RNA, 21 nt, Homo sapiens
acagagcgagacuccgucuca

SEQ ID NO: 590459 - RNA, 17 nt, Homo sapiens
acagagcugaguccucu

SEQ ID NO: 590460 - RNA, 16 nt, Homo sapiens
acagagcuucccugac

SEQ ID NO: 590461 - RNA, 18 nt, Homo sapiens
acagaggaagagcaggca

SEQ ID NO: 590462 - RNA, 22 nt, Homo sapiens
acagaggagaugccacuucuca

SEQ ID NO: 590463 - RNA, 20 nt, Homo sapiens
acagaggagcuuuucuggaa

SEQ ID NO: 590464 - RNA, 16 nt, Homo sapiens
acagaggcccugccac

SEQ ID NO: 590465 - RNA, 20 nt, Homo sapiens
acagaggccgggguccaggc

SEQ ID NO: 590466 - RNA, 17 nt, Homo sapiens
acagagggagagacuaa

SEQ ID NO: 590467 - RNA, 22 nt, Homo sapiens
acagagggcaggaacuugcaca

SEQ ID NO: 590468 - RNA, 15 nt, Homo sapiens
acagaggucucugcc

SEQ ID NO: 590469 - RNA, 14 nt, Homo sapiens
acagaguacgugaa

SEQ ID NO: 590470 - RNA, 21 nt, Homo sapiens
acagagucccuggcuccucua

SEQ ID NO: 590471 - RNA, 15 nt, Homo sapiens
acagagucgcuggca

SEQ ID NO: 590472 - RNA, 19 nt, Homo sapiens
acagagugaacacucuacu

SEQ ID NO: 590473 - RNA, 22 nt, Homo sapiens
acagaguugccaggcacuuuga

SEQ ID NO: 590474 - RNA, 17 nt, Homo sapiens
acagaguugcuuaauga

SEQ ID NO: 590475 - RNA, 21 nt, Homo sapiens
acagauagacagugcugcccu

SEQ ID NO: 590476 - RNA, 21 nt, Homo sapiens
acagauauuuagcucugugga

SEQ ID NO: 590477 - RNA, 16 nt, Homo sapiens
acagaucaucuuggaa

SEQ ID NO: 590478 - RNA, 17 nt, Homo sapiens
acagaucaucuuggaac

SEQ ID NO: 590479 - RNA, 23 nt, Homo sapiens
acagaucuuuacucuugagaaau

SEQ ID NO: 590480 - RNA, 18 nt, Homo sapiens
acagaugaagacaucagg

SEQ ID NO: 590481 - RNA, 17 nt, Homo sapiens
acagaugauaauaugcu

SEQ ID NO: 590482 - RNA, 13 nt, Homo sapiens
acagaugccccag

SEQ ID NO: 590483 - RNA, 12 nt, Homo sapiens
acagaugcugag

SEQ ID NO: 590484 - RNA, 21 nt, Homo sapiens
acagaugcuuuucugucucug

SEQ ID NO: 590485 - RNA, 23 nt, Homo sapiens
acagaugcuuuucugucucugcc

SEQ ID NO: 590486 - RNA, 20 nt, Homo sapiens
acagauggauagucugucca

SEQ ID NO: 590487 - RNA, 18 nt, Homo sapiens
acagauggcagugccaua

SEQ ID NO: 590488 - RNA, 20 nt, Homo sapiens
acagauggcccaagggaugg

SEQ ID NO: 590489 - RNA, 13 nt, Homo sapiens
acagaugucucug

SEQ ID NO: 590490 - RNA, 21 nt, Homo sapiens
acagauuccaggcgaugugca

SEQ ID NO: 590491 - RNA, 21 nt, Homo sapiens
acagauuccuggcagagccau

SEQ ID NO: 590492 - RNA, 23 nt, Homo sapiens
acagauuccuggcagagccaugg

SEQ ID NO: 590493 - RNA, 18 nt, Homo sapiens
acagauucugacauuuau

SEQ ID NO: 590494 - RNA, 18 nt, Homo sapiens
acagauucugauucccuu

SEQ ID NO: 590495 - RNA, 19 nt, Homo sapiens
acagauugcugcuucugcu

SEQ ID NO: 590496 - RNA, 15 nt, Homo sapiens
acagauuuggaaaga

SEQ ID NO: 590497 - RNA, 23 nt, Homo sapiens
acagauuuugaaucugugugcau

SEQ ID NO: 590498 - RNA, 13 nt, Homo sapiens
acagcaaaaccau

SEQ ID NO: 590499 - RNA, 20 nt, Homo sapiens
acagcaaaacuccaucucaa

SEQ ID NO: 590500 - RNA, 13 nt, Homo sapiens
acagcaaaggaac

SEQ ID NO: 590501 - RNA, 23 nt, Homo sapiens
acagcaaccucuucaugagcuug

SEQ ID NO: 590502 - RNA, 20 nt, Homo sapiens
acagcaaguacgcaagaaau

SEQ ID NO: 590503 - RNA, 13 nt, Homo sapiens
acagcacagccaa

SEQ ID NO: 590504 - RNA, 14 nt, Homo sapiens
acagcacagccaac

SEQ ID NO: 590505 - RNA, 15 nt, Homo sapiens
acagcacaucaccuc

SEQ ID NO: 590506 - RNA, 12 nt, Homo sapiens
acagcacuccug

SEQ ID NO: 590507 - RNA, 16 nt, Homo sapiens
acagcacuggggaguc

SEQ ID NO: 590508 - RNA, 17 nt, Homo sapiens
acagcagcaguuacaaa

SEQ ID NO: 590509 - RNA, 16 nt, Homo sapiens
acagcagccucugaag

SEQ ID NO: 590510 - RNA, 15 nt, Homo sapiens
acagcagccuggggc

SEQ ID NO: 590511 - RNA, 20 nt, Homo sapiens
acagcagcugaacagccaaa

SEQ ID NO: 590512 - RNA, 14 nt, Homo sapiens
acagcagggacaag

SEQ ID NO: 590513 - RNA, 18 nt, Homo sapiens
acagcagggacaagauac

SEQ ID NO: 590514 - RNA, 18 nt, Homo sapiens
acagcagucccaguauuc

SEQ ID NO: 590515 - RNA, 22 nt, Homo sapiens
acagcaguccuucagaauuaaa

SEQ ID NO: 590516 - RNA, 18 nt, Homo sapiens
acagcagugaucucaggg

SEQ ID NO: 590517 - RNA, 14 nt, Homo sapiens
acagcauacuucaa

SEQ ID NO: 590518 - RNA, 20 nt, Homo sapiens
acagcauaguacuggcacaa

SEQ ID NO: 590519 - RNA, 15 nt, Homo sapiens
acagcaucauugcau

SEQ ID NO: 590520 - RNA, 14 nt, Homo sapiens
acagcauguguauu

SEQ ID NO: 590521 - RNA, 11 nt, Homo sapiens
acagcauuaaa

SEQ ID NO: 590522 - RNA, 16 nt, Homo sapiens
acagcccagaaccaca

SEQ ID NO: 590523 - RNA, 19 nt, Homo sapiens
acagcccccacuccagucc

SEQ ID NO: 590524 - RNA, 18 nt, Homo sapiens
acagccccuuauuugcac

SEQ ID NO: 590525 - RNA, 15 nt, Homo sapiens
acagcccgcucucug

SEQ ID NO: 590526 - RNA, 12 nt, Homo sapiens
acagccucagaa

SEQ ID NO: 590527 - RNA, 13 nt, Homo sapiens
acagccucagaau

SEQ ID NO: 590528 - RNA, 17 nt, Homo sapiens
acagccucuuacuugcc

SEQ ID NO: 590529 - RNA, 14 nt, Homo sapiens
acagccuggcacag

SEQ ID NO: 590530 - RNA, 20 nt, Homo sapiens
acagccuggccccugugcac

SEQ ID NO: 590531 - RNA, 23 nt, Homo sapiens
acagccuggccccugugcaccga

SEQ ID NO: 590532 - RNA, 14 nt, Homo sapiens
acagccuugcccac

SEQ ID NO: 590533 - RNA, 21 nt, Homo sapiens
acagccuuucguucugcugac

SEQ ID NO: 590534 - RNA, 18 nt, Homo sapiens
acagcgguuugcagagaa

SEQ ID NO: 590535 - RNA, 22 nt, Homo sapiens
acagcuagaaagcugcacuggu

SEQ ID NO: 590536 - RNA, 18 nt, Homo sapiens
acagcucagccacuguga

SEQ ID NO: 590537 - RNA, 12 nt, Homo sapiens
acagcucaguuc

SEQ ID NO: 590538 - RNA, 19 nt, Homo sapiens
acagcucuacguggcaaau

SEQ ID NO: 590539 - RNA, 13 nt, Homo sapiens
acagcucucaccu

SEQ ID NO: 590540 - RNA, 20 nt, Homo sapiens
acagcucuuaaauguagcaa

SEQ ID NO: 590541 - RNA, 13 nt, Homo sapiens
acagcucuuggca

SEQ ID NO: 590542 - RNA, 21 nt, Homo sapiens
acagcucuuggcauuuuccuc

SEQ ID NO: 590543 - RNA, 18 nt, Homo sapiens
acagcugaaaagagcuuu

SEQ ID NO: 590544 - RNA, 20 nt, Homo sapiens
acagcugaaaagagcuuugu

SEQ ID NO: 590545 - RNA, 15 nt, Homo sapiens
acagcugaguuauga

SEQ ID NO: 590546 - RNA, 15 nt, Homo sapiens
acagcugcccuagcu

SEQ ID NO: 590547 - RNA, 17 nt, Homo sapiens
acagcugcucaauaaag

SEQ ID NO: 590548 - RNA, 14 nt, Homo sapiens
acagcugcuccuag

SEQ ID NO: 590549 - RNA, 18 nt, Homo sapiens
acagcugcugcuggaaau

SEQ ID NO: 590550 - RNA, 14 nt, Homo sapiens
acagcuguauuuau

SEQ ID NO: 590551 - RNA, 17 nt, Homo sapiens
acagcuuauuauccaau

SEQ ID NO: 590552 - RNA, 15 nt, Homo sapiens
acagcuucaugccuu

SEQ ID NO: 590553 - RNA, 21 nt, Homo sapiens
acagcuugaguggguucucug

SEQ ID NO: 590554 - RNA, 23 nt, Homo sapiens
acagcuuuugcaacuuaauacuc

SEQ ID NO: 590555 - RNA, 21 nt, Homo sapiens
acaggaaaauguauccagagg

SEQ ID NO: 590556 - RNA, 16 nt, Homo sapiens
acaggaaaggccccaa

SEQ ID NO: 590557 - RNA, 16 nt, Homo sapiens
acaggaaaguuccaga

SEQ ID NO: 590558 - RNA, 22 nt, Homo sapiens
acaggaagccugcaguccugga

SEQ ID NO: 590559 - RNA, 18 nt, Homo sapiens
acaggaagucccuugcca

SEQ ID NO: 590560 - RNA, 16 nt, Homo sapiens
acaggaccccagcucu

SEQ ID NO: 590561 - RNA, 17 nt, Homo sapiens
acaggacugguacucaa

SEQ ID NO: 590562 - RNA, 18 nt, Homo sapiens
acaggacuuaaaaugaca

SEQ ID NO: 590563 - RNA, 12 nt, Homo sapiens
acaggagccuag

SEQ ID NO: 590564 - RNA, 18 nt, Homo sapiens
acaggaggaaucauguca

SEQ ID NO: 590565 - RNA, 22 nt, Homo sapiens
acaggaggaggagauggccaua

SEQ ID NO: 590566 - RNA, 22 nt, Homo sapiens
acaggauauuaaacguguaaau

SEQ ID NO: 590567 - RNA, 18 nt, Homo sapiens
acaggauuuguaauuccu

SEQ ID NO: 590568 - RNA, 19 nt, Homo sapiens
acaggcaaaacucaguaga

SEQ ID NO: 590569 - RNA, 16 nt, Homo sapiens
acaggcaaacugcaaa

SEQ ID NO: 590570 - RNA, 14 nt, Homo sapiens
acaggcaccugcca

SEQ ID NO: 590571 - RNA, 12 nt, Homo sapiens
acaggcacucca

SEQ ID NO: 590572 - RNA, 19 nt, Homo sapiens
acaggcauuuguucacuga

SEQ ID NO: 590573 - RNA, 15 nt, Homo sapiens
acaggccauacuuua

SEQ ID NO: 590574 - RNA, 15 nt, Homo sapiens
acaggccauggugca

SEQ ID NO: 590575 - RNA, 22 nt, Homo sapiens
acaggccauggugcacaaaagg

SEQ ID NO: 590576 - RNA, 21 nt, Homo sapiens
acaggccauugugaaccaaug

SEQ ID NO: 590577 - RNA, 21 nt, Homo sapiens
acaggcccuuccucuccacug

SEQ ID NO: 590578 - RNA, 16 nt, Homo sapiens
acaggccuguucccuu

SEQ ID NO: 590579 - RNA, 20 nt, Homo sapiens
acaggcgccugccaucaugc

SEQ ID NO: 590580 - RNA, 18 nt, Homo sapiens
acaggcucugaggggcac

SEQ ID NO: 590581 - RNA, 15 nt, Homo sapiens
acagggaaaggucag

SEQ ID NO: 590582 - RNA, 20 nt, Homo sapiens
acagggacaugcccugugug

SEQ ID NO: 590583 - RNA, 14 nt, Homo sapiens
acagggauucucac

SEQ ID NO: 590584 - RNA, 19 nt, Homo sapiens
acagggcaugcauuuugca

SEQ ID NO: 590585 - RNA, 13 nt, Homo sapiens
acagggcauucaa

SEQ ID NO: 590586 - RNA, 12 nt, Homo sapiens
acagggccagug

SEQ ID NO: 590587 - RNA, 23 nt, Homo sapiens
acagggccaguggggccugugga

SEQ ID NO: 590588 - RNA, 18 nt, Homo sapiens
acaggggccaugccccac

SEQ ID NO: 590589 - RNA, 22 nt, Homo sapiens
acaggggcccauggacucuuca

SEQ ID NO: 590590 - RNA, 23 nt, Homo sapiens
acaggggguccccuucuguuacc

SEQ ID NO: 590591 - RNA, 18 nt, Homo sapiens
acagggucauguuugcag

SEQ ID NO: 590592 - RNA, 22 nt, Homo sapiens
acaggguccccacacaacagug

SEQ ID NO: 590593 - RNA, 23 nt, Homo sapiens
acagggucucuagugcugugaaa

SEQ ID NO: 590594 - RNA, 21 nt, Homo sapiens
acagggucuugcuauauugcc

SEQ ID NO: 590595 - RNA, 21 nt, Homo sapiens
acagguaaaaagccucaccca

SEQ ID NO: 590596 - RNA, 16 nt, Homo sapiens
acagguaaaacagggc

SEQ ID NO: 590597 - RNA, 18 nt, Homo sapiens
acagguaaugaagcuauu

SEQ ID NO: 590598 - RNA, 21 nt, Homo sapiens
acagguauuuuuuuaaaucaa

SEQ ID NO: 590599 - RNA, 16 nt, Homo sapiens
acaggucggggaccaa

SEQ ID NO: 590600 - RNA, 20 nt, Homo sapiens
acaggugcugaacugugcau

SEQ ID NO: 590601 - RNA, 15 nt, Homo sapiens
acagguggugcaaau

SEQ ID NO: 590602 - RNA, 18 nt, Homo sapiens
acaggugucuagacugcc

SEQ ID NO: 590603 - RNA, 20 nt, Homo sapiens
acaggugucuagacugccag

SEQ ID NO: 590604 - RNA, 21 nt, Homo sapiens
acaggugugagccacagugcc

SEQ ID NO: 590605 - RNA, 22 nt, Homo sapiens
acagguguggggacacagcagu

SEQ ID NO: 590606 - RNA, 22 nt, Homo sapiens
acaggugugugugaacugggca

SEQ ID NO: 590607 - RNA, 23 nt, Homo sapiens
acagguuacuacccucacccuuu

SEQ ID NO: 590608 - RNA, 18 nt, Homo sapiens
acagguuauaacaguguu

SEQ ID NO: 590609 - RNA, 16 nt, Homo sapiens
acaguaaaaacuugua

SEQ ID NO: 590610 - RNA, 15 nt, Homo sapiens
acaguaaaauuaacu

SEQ ID NO: 590611 - RNA, 13 nt, Homo sapiens
acaguaaaucuca

SEQ ID NO: 590612 - RNA, 14 nt, Homo sapiens
acaguaacugccau

SEQ ID NO: 590613 - RNA, 22 nt, Homo sapiens
acaguaacugugacugaugacu

SEQ ID NO: 590614 - RNA, 19 nt, Homo sapiens
acaguaaugaaauguuuac

SEQ ID NO: 590615 - RNA, 13 nt, Homo sapiens
acaguagagccag

SEQ ID NO: 590616 - RNA, 14 nt, Homo sapiens
acaguagcauuaug

SEQ ID NO: 590617 - RNA, 18 nt, Homo sapiens
acaguaggauaagccacu

SEQ ID NO: 590618 - RNA, 22 nt, Homo sapiens
acaguaguuagaauuauaucac

SEQ ID NO: 590619 - RNA, 21 nt, Homo sapiens
acaguaucccacauccaacuc

SEQ ID NO: 590620 - RNA, 23 nt, Homo sapiens
acaguaugagucaaugugcagug

SEQ ID NO: 590621 - RNA, 14 nt, Homo sapiens
acaguaugaugaaa

SEQ ID NO: 590622 - RNA, 15 nt, Homo sapiens
acaguauuuugacaa

SEQ ID NO: 590623 - RNA, 15 nt, Homo sapiens
acagucaaggugaua

SEQ ID NO: 590624 - RNA, 13 nt, Homo sapiens
acagucaaucuau

SEQ ID NO: 590625 - RNA, 11 nt, Homo sapiens
acagucacuga

SEQ ID NO: 590626 - RNA, 19 nt, Homo sapiens
acagucacugacucaagac

SEQ ID NO: 590627 - RNA, 16 nt, Homo sapiens
acagucacugauguac

SEQ ID NO: 590628 - RNA, 22 nt, Homo sapiens
acagucacugcucuucagccau

SEQ ID NO: 590629 - RNA, 12 nt, Homo sapiens
acagucacugga

SEQ ID NO: 590630 - RNA, 14 nt, Homo sapiens
acagucagcucucu

SEQ ID NO: 590631 - RNA, 15 nt, Homo sapiens
acagucagcucucuc

SEQ ID NO: 590632 - RNA, 15 nt, Homo sapiens
acagucaucugccac

SEQ ID NO: 590633 - RNA, 13 nt, Homo sapiens
acagucauuuaaa

SEQ ID NO: 590634 - RNA, 17 nt, Homo sapiens
acagucccagauacacu

SEQ ID NO: 590635 - RNA, 17 nt, Homo sapiens
acagucccauuccucca

SEQ ID NO: 590636 - RNA, 17 nt, Homo sapiens
acagucccccacccacc

SEQ ID NO: 590637 - RNA, 18 nt, Homo sapiens
acaguccuggacuccugc

SEQ ID NO: 590638 - RNA, 18 nt, Homo sapiens
acaguccuguccucugga

SEQ ID NO: 590639 - RNA, 19 nt, Homo sapiens
acaguccuguccucuggau

SEQ ID NO: 590640 - RNA, 17 nt, Homo sapiens
acagucgagaagccagg

SEQ ID NO: 590641 - RNA, 16 nt, Homo sapiens
acagucguucccagug

SEQ ID NO: 590642 - RNA, 21 nt, Homo sapiens
acagucguucccaguguggcu

SEQ ID NO: 590643 - RNA, 14 nt, Homo sapiens
acagucucacuuug

SEQ ID NO: 590644 - RNA, 20 nt, Homo sapiens
acagucucugagaaguacuu

SEQ ID NO: 590645 - RNA, 16 nt, Homo sapiens
acagucuggcucauga

SEQ ID NO: 590646 - RNA, 18 nt, Homo sapiens
acagucuuccauuugcaa

SEQ ID NO: 590647 - RNA, 21 nt, Homo sapiens
acagugaaguucaaaugcccu

SEQ ID NO: 590648 - RNA, 11 nt, Homo sapiens
acagugaaugg

SEQ ID NO: 590649 - RNA, 22 nt, Homo sapiens
acagugacggcugcgccuccac

SEQ ID NO: 590650 - RNA, 17 nt, Homo sapiens
acagugagagacuccau

SEQ ID NO: 590651 - RNA, 14 nt, Homo sapiens
acagugaggcugca

SEQ ID NO: 590652 - RNA, 21 nt, Homo sapiens
acagugaugcugugcuaugaa

SEQ ID NO: 590653 - RNA, 10 nt, Homo sapiens
acagugcaag

SEQ ID NO: 590654 - RNA, 18 nt, Homo sapiens
acagugcagcuugcaguc

SEQ ID NO: 590655 - RNA, 22 nt, Homo sapiens
acagugcagugaauuggaagac

SEQ ID NO: 590656 - RNA, 11 nt, Homo sapiens
acagugcauuu

SEQ ID NO: 590657 - RNA, 14 nt, Homo sapiens
acagugcauuugcc

SEQ ID NO: 590658 - RNA, 21 nt, Homo sapiens
acagugccauccccaccuuca

SEQ ID NO: 590659 - RNA, 14 nt, Homo sapiens
acagugccucuucc

SEQ ID NO: 590660 - RNA, 19 nt, Homo sapiens
acagugccucuuccaguga

SEQ ID NO: 590661 - RNA, 12 nt, Homo sapiens
acagugccugua

SEQ ID NO: 590662 - RNA, 15 nt, Homo sapiens
acaguggcucuccaa

SEQ ID NO: 590663 - RNA, 14 nt, Homo sapiens
acagugggaaauau

SEQ ID NO: 590664 - RNA, 21 nt, Homo sapiens
acaguggucccagaaccuauu

SEQ ID NO: 590665 - RNA, 15 nt, Homo sapiens
acaguguacaaugcc

SEQ ID NO: 590666 - RNA, 23 nt, Homo sapiens
acaguguuggagguuaaggcaua

SEQ ID NO: 590667 - RNA, 13 nt, Homo sapiens
acaguuaaggaau

SEQ ID NO: 590668 - RNA, 13 nt, Homo sapiens
acaguuacaguug

SEQ ID NO: 590669 - RNA, 16 nt, Homo sapiens
acaguuaucauuauca

SEQ ID NO: 590670 - RNA, 16 nt, Homo sapiens
acaguucuacagaaaa

SEQ ID NO: 590671 - RNA, 17 nt, Homo sapiens
acaguucuuggugacug

SEQ ID NO: 590672 - RNA, 13 nt, Homo sapiens
acaguugccaugu

SEQ ID NO: 590673 - RNA, 17 nt, Homo sapiens
acaguuggaacuuacau

SEQ ID NO: 590674 - RNA, 13 nt, Homo sapiens
acaguuugagacu

SEQ ID NO: 590675 - RNA, 14 nt, Homo sapiens
acaguuuuaacugu

SEQ ID NO: 590676 - RNA, 24 nt, Homo sapiens
acaguuuugaaagaaaaauaccau

SEQ ID NO: 590677 - RNA, 18 nt, Homo sapiens
acauaaaaaagaagcacu

SEQ ID NO: 590678 - RNA, 21 nt, Homo sapiens
acauaaaauaagagauccuuu

SEQ ID NO: 590679 - RNA, 21 nt, Homo sapiens
acauaaauuacuuuuucauuc

SEQ ID NO: 590680 - RNA, 13 nt, Homo sapiens
acauaacucugua

SEQ ID NO: 590681 - RNA, 20 nt, Homo sapiens
acauaacucuguaaaaacac

SEQ ID NO: 590682 - RNA, 21 nt, Homo sapiens
acauaacucuguaaaaacacu

SEQ ID NO: 590683 - RNA, 15 nt, Homo sapiens
acauaagacagacag

SEQ ID NO: 590684 - RNA, 20 nt, Homo sapiens
acauaagcucagaauccaag

SEQ ID NO: 590685 - RNA, 21 nt, Homo sapiens
acauaaguguugguagcacuu

SEQ ID NO: 590686 - RNA, 18 nt, Homo sapiens
acauaauaauaauggguu

SEQ ID NO: 590687 - RNA, 14 nt, Homo sapiens
acauaauaauagca

SEQ ID NO: 590688 - RNA, 15 nt, Homo sapiens
acauaauaccaccau

SEQ ID NO: 590689 - RNA, 17 nt, Homo sapiens
acauaaucuaguuuaca

SEQ ID NO: 590690 - RNA, 21 nt, Homo sapiens
acauaaucuguacaaugaacc

SEQ ID NO: 590691 - RNA, 19 nt, Homo sapiens
acauaauuuugugcaugaa

SEQ ID NO: 590692 - RNA, 12 nt, Homo sapiens
acauacaaauca

SEQ ID NO: 590693 - RNA, 15 nt, Homo sapiens
acauacauacauaca

SEQ ID NO: 590694 - RNA, 20 nt, Homo sapiens
acauacauuaaacacacuua

SEQ ID NO: 590695 - RNA, 13 nt, Homo sapiens
acauacauucccu

SEQ ID NO: 590696 - RNA, 14 nt, Homo sapiens
acauaccuucaugu

SEQ ID NO: 590697 - RNA, 17 nt, Homo sapiens
acauacgugcacagggu

SEQ ID NO: 590698 - RNA, 19 nt, Homo sapiens
acauacuccuuccaucaaa

SEQ ID NO: 590699 - RNA, 15 nt, Homo sapiens
acauagaagagccaa

SEQ ID NO: 590700 - RNA, 15 nt, Homo sapiens
acauagacagaagaa

SEQ ID NO: 590701 - RNA, 22 nt, Homo sapiens
acauagagcuuuuuaauagcac

SEQ ID NO: 590702 - RNA, 12 nt, Homo sapiens
acauagcacaga

SEQ ID NO: 590703 - RNA, 14 nt, Homo sapiens
acauagcagacuuu

SEQ ID NO: 590704 - RNA, 23 nt, Homo sapiens
acauaggaaaaugccaugaaaau

SEQ ID NO: 590705 - RNA, 16 nt, Homo sapiens
acauaggaagggaucu

SEQ ID NO: 590706 - RNA, 17 nt, Homo sapiens
acauaggcaaagcaauc

SEQ ID NO: 590707 - RNA, 16 nt, Homo sapiens
acauagguaaaaacug

SEQ ID NO: 590708 - RNA, 18 nt, Homo sapiens
acauagguaaaaacugga

SEQ ID NO: 590709 - RNA, 14 nt, Homo sapiens
acauagucuguucc

SEQ ID NO: 590710 - RNA, 17 nt, Homo sapiens
acauagucuguuccuuu

SEQ ID NO: 590711 - RNA, 18 nt, Homo sapiens
acauaguugcuucuuucc

SEQ ID NO: 590712 - RNA, 14 nt, Homo sapiens
acauauaaagcacu

SEQ ID NO: 590713 - RNA, 16 nt, Homo sapiens
acauauaaaugaaucu

SEQ ID NO: 590714 - RNA, 21 nt, Homo sapiens
acauauauaagguaugugcua

SEQ ID NO: 590715 - RNA, 22 nt, Homo sapiens
acauauauauauacacauacau

SEQ ID NO: 590716 - RNA, 16 nt, Homo sapiens
acauauauaugucagg

SEQ ID NO: 590717 - RNA, 15 nt, Homo sapiens
acauauauauuacaa

SEQ ID NO: 590718 - RNA, 22 nt, Homo sapiens
acauauaucuacacauacagaa

SEQ ID NO: 590719 - RNA, 18 nt, Homo sapiens
acauaucgcugacuucau

SEQ ID NO: 590720 - RNA, 12 nt, Homo sapiens
acauaugacaau

SEQ ID NO: 590721 - RNA, 17 nt, Homo sapiens
acauaugaucugucugu

SEQ ID NO: 590722 - RNA, 20 nt, Homo sapiens
acauauuacuguugcauuua

SEQ ID NO: 590723 - RNA, 23 nt, Homo sapiens
acauauuacuguugcauuuacuu

SEQ ID NO: 590724 - RNA, 13 nt, Homo sapiens
acauauuaucuca

SEQ ID NO: 590725 - RNA, 21 nt, Homo sapiens
acauauuuguggaauaaugua

SEQ ID NO: 590726 - RNA, 18 nt, Homo sapiens
acauauuuuuauacuuua

SEQ ID NO: 590727 - RNA, 23 nt, Homo sapiens
acauauuuuuauacuuuauugaa

SEQ ID NO: 590728 - RNA, 15 nt, Homo sapiens
acaucaaaccugagu

SEQ ID NO: 590729 - RNA, 14 nt, Homo sapiens
acaucaaauuugcc

SEQ ID NO: 590730 - RNA, 20 nt, Homo sapiens
acaucaagacuaucuacaaa

SEQ ID NO: 590731 - RNA, 18 nt, Homo sapiens
acaucaauccuuuaccac

SEQ ID NO: 590732 - RNA, 15 nt, Homo sapiens
acaucacacaguaua

SEQ ID NO: 590733 - RNA, 19 nt, Homo sapiens
acaucacucucaccuucca

SEQ ID NO: 590734 - RNA, 19 nt, Homo sapiens
acaucacugucuugccaga

SEQ ID NO: 590735 - RNA, 14 nt, Homo sapiens
acaucacuuuguga

SEQ ID NO: 590736 - RNA, 15 nt, Homo sapiens
acaucagcaagacuu

SEQ ID NO: 590737 - RNA, 23 nt, Homo sapiens
acaucagcuaguggcucuucuca

SEQ ID NO: 590738 - RNA, 19 nt, Homo sapiens
acaucaggagacugggcuc

SEQ ID NO: 590739 - RNA, 14 nt, Homo sapiens
acaucagucuccaa

SEQ ID NO: 590740 - RNA, 18 nt, Homo sapiens
acaucaguuacucugaag

SEQ ID NO: 590741 - RNA, 16 nt, Homo sapiens
acaucaucuuagacuu

SEQ ID NO: 590742 - RNA, 22 nt, Homo sapiens
acaucauuacagauucugcuag

SEQ ID NO: 590743 - RNA, 23 nt, Homo sapiens
acaucauuacuuaugaugaugaa

SEQ ID NO: 590744 - RNA, 22 nt, Homo sapiens
acaucauuagaacaaaggacag

SEQ ID NO: 590745 - RNA, 17 nt, Homo sapiens
acauccaacuccagcaa

SEQ ID NO: 590746 - RNA, 21 nt, Homo sapiens
acauccaaggagaaacagaga

SEQ ID NO: 590747 - RNA, 15 nt, Homo sapiens
acauccagucacuuu

SEQ ID NO: 590748 - RNA, 20 nt, Homo sapiens
acaucccaagaaaaucacau

SEQ ID NO: 590749 - RNA, 21 nt, Homo sapiens
acaucccaagaaaaucacauc

SEQ ID NO: 590750 - RNA, 22 nt, Homo sapiens
acauccccagagcccagcucuu

SEQ ID NO: 590751 - RNA, 20 nt, Homo sapiens
acauccccuuuguguagaaa

SEQ ID NO: 590752 - RNA, 22 nt, Homo sapiens
acauccuaccccuuugcacuug

SEQ ID NO: 590753 - RNA, 17 nt, Homo sapiens
acauccucucaaguuag

SEQ ID NO: 590754 - RNA, 19 nt, Homo sapiens
acauccuggccuggcacau

SEQ ID NO: 590755 - RNA, 19 nt, Homo sapiens
acauccuucucacugccau

SEQ ID NO: 590756 - RNA, 23 nt, Homo sapiens
acauccuugucugggucuaccag

SEQ ID NO: 590757 - RNA, 17 nt, Homo sapiens
acaucgucuacaaggag

SEQ ID NO: 590758 - RNA, 17 nt, Homo sapiens
acaucguuguuuugcug

SEQ ID NO: 590759 - RNA, 19 nt, Homo sapiens
acaucuaaaagaugaaguu

SEQ ID NO: 590760 - RNA, 14 nt, Homo sapiens
acaucuauucucaa

SEQ ID NO: 590761 - RNA, 20 nt, Homo sapiens
acaucucaaggagggagaac

SEQ ID NO: 590762 - RNA, 22 nt, Homo sapiens
acaucucagacccuuuagccaa

SEQ ID NO: 590763 - RNA, 18 nt, Homo sapiens
acaucuccaggcuuucaa

SEQ ID NO: 590764 - RNA, 22 nt, Homo sapiens
acaucuccaggcuuucaauguu

SEQ ID NO: 590765 - RNA, 18 nt, Homo sapiens
acaucuccagugugccag

SEQ ID NO: 590766 - RNA, 21 nt, Homo sapiens
acaucucguauaauauucaca

SEQ ID NO: 590767 - RNA, 18 nt, Homo sapiens
acaucucuaguguagcug

SEQ ID NO: 590768 - RNA, 16 nt, Homo sapiens
acaucucugcuuucac

SEQ ID NO: 590769 - RNA, 12 nt, Homo sapiens
acaucugcaaua

SEQ ID NO: 590770 - RNA, 15 nt, Homo sapiens
acaucugcugugguc

SEQ ID NO: 590771 - RNA, 22 nt, Homo sapiens
acaucuggccuugaaaccaccu

SEQ ID NO: 590772 - RNA, 15 nt, Homo sapiens
acaucuggucuucca

SEQ ID NO: 590773 - RNA, 12 nt, Homo sapiens
acaucuguaaag

SEQ ID NO: 590774 - RNA, 12 nt, Homo sapiens
acaucugucacg

SEQ ID NO: 590775 - RNA, 13 nt, Homo sapiens
acaucuuccacca

SEQ ID NO: 590776 - RNA, 23 nt, Homo sapiens
acaucuucugccuuagucucagu

SEQ ID NO: 590777 - RNA, 15 nt, Homo sapiens
acaucuugaaaauau

SEQ ID NO: 590778 - RNA, 18 nt, Homo sapiens
acaucuuggucagauuug

SEQ ID NO: 590779 - RNA, 23 nt, Homo sapiens
acaucuuggucagauuugaacuc

SEQ ID NO: 590780 - RNA, 15 nt, Homo sapiens
acaucuuuaaacagu

SEQ ID NO: 590781 - RNA, 13 nt, Homo sapiens
acaucuuuacuca

SEQ ID NO: 590782 - RNA, 17 nt, Homo sapiens
acaucuuuacucaggca

SEQ ID NO: 590783 - RNA, 16 nt, Homo sapiens
acaucuuuauugaaau

SEQ ID NO: 590784 - RNA, 13 nt, Homo sapiens
acaucuuuuacau

SEQ ID NO: 590785 - RNA, 19 nt, Homo sapiens
acaucuuuuacauucugca

SEQ ID NO: 590786 - RNA, 18 nt, Homo sapiens
acaucuuuucuaaucaca

SEQ ID NO: 590787 - RNA, 20 nt, Homo sapiens
acaugaaacugaauaaggag

SEQ ID NO: 590788 - RNA, 19 nt, Homo sapiens
acaugaaaggacccuguga

SEQ ID NO: 590789 - RNA, 12 nt, Homo sapiens
acaugaaaguuu

SEQ ID NO: 590790 - RNA, 15 nt, Homo sapiens
acaugaaaguuuugc

SEQ ID NO: 590791 - RNA, 20 nt, Homo sapiens
acaugaaaugcccuccuaaa

SEQ ID NO: 590792 - RNA, 14 nt, Homo sapiens
acaugaacccaaaa

SEQ ID NO: 590793 - RNA, 15 nt, Homo sapiens
acaugaacccaaaaa

SEQ ID NO: 590794 - RNA, 16 nt, Homo sapiens
acaugaacccaaaaag

SEQ ID NO: 590795 - RNA, 13 nt, Homo sapiens
acaugaaugcaca

SEQ ID NO: 590796 - RNA, 15 nt, Homo sapiens
acaugacaacuuugc

SEQ ID NO: 590797 - RNA, 17 nt, Homo sapiens
acaugacaacuuugcca

SEQ ID NO: 590798 - RNA, 18 nt, Homo sapiens
acaugacaacuuugccag

SEQ ID NO: 590799 - RNA, 17 nt, Homo sapiens
acaugacaguauuccau

SEQ ID NO: 590800 - RNA, 15 nt, Homo sapiens
acaugagaaagggag

SEQ ID NO: 590801 - RNA, 12 nt, Homo sapiens
acaugagcagag

SEQ ID NO: 590802 - RNA, 16 nt, Homo sapiens
acaugagcuauuucca

SEQ ID NO: 590803 - RNA, 17 nt, Homo sapiens
acaugaugacucaaggc

SEQ ID NO: 590804 - RNA, 17 nt, Homo sapiens
acaugaugcacuucaaa

SEQ ID NO: 590805 - RNA, 22 nt, Homo sapiens
acaugauggagcgcaccugccc

SEQ ID NO: 590806 - RNA, 13 nt, Homo sapiens
acaugauguauug

SEQ ID NO: 590807 - RNA, 17 nt, Homo sapiens
acaugcagcccaugccc

SEQ ID NO: 590808 - RNA, 20 nt, Homo sapiens
acaugcauugccaugaauuu

SEQ ID NO: 590809 - RNA, 22 nt, Homo sapiens
acaugcauugcucuuauucugu

SEQ ID NO: 590810 - RNA, 22 nt, Homo sapiens
acaugcccccucccuucacagg

SEQ ID NO: 590811 - RNA, 23 nt, Homo sapiens
acaugccgcagggagggcugugg

SEQ ID NO: 590812 - RNA, 19 nt, Homo sapiens
acaugccucugccaaagga

SEQ ID NO: 590813 - RNA, 15 nt, Homo sapiens
acaugcgcacucuca

SEQ ID NO: 590814 - RNA, 18 nt, Homo sapiens
acaugcuaugcugaagac

SEQ ID NO: 590815 - RNA, 18 nt, Homo sapiens
acaugcuauguucugucu

SEQ ID NO: 590816 - RNA, 18 nt, Homo sapiens
acaugcugccuggcacag

SEQ ID NO: 590817 - RNA, 16 nt, Homo sapiens
acaugcugcuugccuc

SEQ ID NO: 590818 - RNA, 14 nt, Homo sapiens
acaugcuggugcau

SEQ ID NO: 590819 - RNA, 16 nt, Homo sapiens
acaugcuuugaaguuu

SEQ ID NO: 590820 - RNA, 17 nt, Homo sapiens
acauggaacgcuuucau

SEQ ID NO: 590821 - RNA, 21 nt, Homo sapiens
acauggaaucgaaguguuuau

SEQ ID NO: 590822 - RNA, 14 nt, Homo sapiens
acauggaauuaccu

SEQ ID NO: 590823 - RNA, 22 nt, Homo sapiens
acauggagaaaaccaaaaugau

SEQ ID NO: 590824 - RNA, 18 nt, Homo sapiens
acauggcccgcaguggcu

SEQ ID NO: 590825 - RNA, 14 nt, Homo sapiens
acauggcuaaauac

SEQ ID NO: 590826 - RNA, 17 nt, Homo sapiens
acaugggcucuucacua

SEQ ID NO: 590827 - RNA, 16 nt, Homo sapiens
acauggggcaagccag

SEQ ID NO: 590828 - RNA, 19 nt, Homo sapiens
acaugggugcaaucuuuag

SEQ ID NO: 590829 - RNA, 20 nt, Homo sapiens
acauggugaaaccccgucuc

SEQ ID NO: 590830 - RNA, 17 nt, Homo sapiens
acauggugaaacuccau

SEQ ID NO: 590831 - RNA, 17 nt, Homo sapiens
acauggugccccuagcu

SEQ ID NO: 590832 - RNA, 13 nt, Homo sapiens
acauggugugagu

SEQ ID NO: 590833 - RNA, 17 nt, Homo sapiens
acaugguucaccaugca

SEQ ID NO: 590834 - RNA, 20 nt, Homo sapiens
acaugguucaccaugcagug

SEQ ID NO: 590835 - RNA, 15 nt, Homo sapiens
acauguaacauuaaa

SEQ ID NO: 590836 - RNA, 13 nt, Homo sapiens
acauguacagaca

SEQ ID NO: 590837 - RNA, 19 nt, Homo sapiens
acauguaguaguacuugaa

SEQ ID NO: 590838 - RNA, 13 nt, Homo sapiens
acauguaugugca

SEQ ID NO: 590839 - RNA, 18 nt, Homo sapiens
acauguauugcacauugu

SEQ ID NO: 590840 - RNA, 18 nt, Homo sapiens
acauguauuuauggagug

SEQ ID NO: 590841 - RNA, 13 nt, Homo sapiens
acaugucuuucag

SEQ ID NO: 590842 - RNA, 23 nt, Homo sapiens
acaugucuuuucuuccacugccu

SEQ ID NO: 590843 - RNA, 14 nt, Homo sapiens
acaugugaaaagcu

SEQ ID NO: 590844 - RNA, 23 nt, Homo sapiens
acauguggugggacagggaccca

SEQ ID NO: 590845 - RNA, 15 nt, Homo sapiens
acauguguaccucag

SEQ ID NO: 590846 - RNA, 23 nt, Homo sapiens
acaugugugcgugugcgugcaug

SEQ ID NO: 590847 - RNA, 13 nt, Homo sapiens
acauguguguaua

SEQ ID NO: 590848 - RNA, 18 nt, Homo sapiens
acauguucuugucauaaa

SEQ ID NO: 590849 - RNA, 23 nt, Homo sapiens
acauguuuccaucauuucugucu

SEQ ID NO: 590850 - RNA, 18 nt, Homo sapiens
acauguuuuuucauuugu

SEQ ID NO: 590851 - RNA, 14 nt, Homo sapiens
acauuaaacacaaa

SEQ ID NO: 590852 - RNA, 18 nt, Homo sapiens
acauuaacaaaagcaauu

SEQ ID NO: 590853 - RNA, 14 nt, Homo sapiens
acauuaacggugcu

SEQ ID NO: 590854 - RNA, 16 nt, Homo sapiens
acauuaacggugcuaa

SEQ ID NO: 590855 - RNA, 13 nt, Homo sapiens
acauuaaugccug

SEQ ID NO: 590856 - RNA, 12 nt, Homo sapiens
acauuacaauca

SEQ ID NO: 590857 - RNA, 19 nt, Homo sapiens
acauuaggaguaacuuuca

SEQ ID NO: 590858 - RNA, 16 nt, Homo sapiens
acauuauucaucucuc

SEQ ID NO: 590859 - RNA, 18 nt, Homo sapiens
acauuauucuucacuuaa

SEQ ID NO: 590860 - RNA, 19 nt, Homo sapiens
acauuauucuucacuuaaa

SEQ ID NO: 590861 - RNA, 22 nt, Homo sapiens
acauuauuuguaauagccaaaa

SEQ ID NO: 590862 - RNA, 18 nt, Homo sapiens
acauuauuuuuuauuucu

SEQ ID NO: 590863 - RNA, 19 nt, Homo sapiens
acauucacacagggcucuu

SEQ ID NO: 590864 - RNA, 17 nt, Homo sapiens
acauucauguaacucuc

SEQ ID NO: 590865 - RNA, 13 nt, Homo sapiens
acauuccaggaaa

SEQ ID NO: 590866 - RNA, 22 nt, Homo sapiens
acauucccucuaauuugaacug

SEQ ID NO: 590867 - RNA, 23 nt, Homo sapiens
acauucccuuggauguagucuga

SEQ ID NO: 590868 - RNA, 17 nt, Homo sapiens
acauucuauagccauaa

SEQ ID NO: 590869 - RNA, 18 nt, Homo sapiens
acauucucuucccaguga

SEQ ID NO: 590870 - RNA, 23 nt, Homo sapiens
acauucugaaucaagcacacugu

SEQ ID NO: 590871 - RNA, 19 nt, Homo sapiens
acauucugaguaacaucag

SEQ ID NO: 590872 - RNA, 19 nt, Homo sapiens
acauucuggaucugacccu

SEQ ID NO: 590873 - RNA, 22 nt, Homo sapiens
acauucuguuuaucaagccaua

SEQ ID NO: 590874 - RNA, 21 nt, Homo sapiens
acauucuuguuuuaagugccu

SEQ ID NO: 590875 - RNA, 23 nt, Homo sapiens
acauucuuguuuuaagugccuuu

SEQ ID NO: 590876 - RNA, 13 nt, Homo sapiens
acauugaguuuaa

SEQ ID NO: 590877 - RNA, 22 nt, Homo sapiens
acauugaucauuuuuauaugaa

SEQ ID NO: 590878 - RNA, 12 nt, Homo sapiens
acauugcacuuu

SEQ ID NO: 590879 - RNA, 18 nt, Homo sapiens
acauugccuucuggagcu

SEQ ID NO: 590880 - RNA, 16 nt, Homo sapiens
acauugguauucuggg

SEQ ID NO: 590881 - RNA, 15 nt, Homo sapiens
acauuguacuguaau

SEQ ID NO: 590882 - RNA, 12 nt, Homo sapiens
acauuguagccu

SEQ ID NO: 590883 - RNA, 13 nt, Homo sapiens
acauuguauauau

SEQ ID NO: 590884 - RNA, 17 nt, Homo sapiens
acauugugagcucuggu

SEQ ID NO: 590885 - RNA, 16 nt, Homo sapiens
acauuuaaaccuuuua

SEQ ID NO: 590886 - RNA, 17 nt, Homo sapiens
acauuuacaaacugaag

SEQ ID NO: 590887 - RNA, 18 nt, Homo sapiens
acauuuacauagugcaaa

SEQ ID NO: 590888 - RNA, 20 nt, Homo sapiens
acauuuacugaccauguacu

SEQ ID NO: 590889 - RNA, 17 nt, Homo sapiens
acauuuagaguauuuac

SEQ ID NO: 590890 - RNA, 19 nt, Homo sapiens
acauuuagccaaucuuucu

SEQ ID NO: 590891 - RNA, 17 nt, Homo sapiens
acauuuaugcacauuca

SEQ ID NO: 590892 - RNA, 16 nt, Homo sapiens
acauuucauaguuuca

SEQ ID NO: 590893 - RNA, 22 nt, Homo sapiens
acauuucaucuggguggucuga

SEQ ID NO: 590894 - RNA, 22 nt, Homo sapiens
acauuucauugucuuagucaaa

SEQ ID NO: 590895 - RNA, 13 nt, Homo sapiens
acauuuccaugca

SEQ ID NO: 590896 - RNA, 13 nt, Homo sapiens
acauuucucaccc

SEQ ID NO: 590897 - RNA, 14 nt, Homo sapiens
acauuucucacuga

SEQ ID NO: 590898 - RNA, 17 nt, Homo sapiens
acauuucugcacauggu

SEQ ID NO: 590899 - RNA, 18 nt, Homo sapiens
acauuucugcacaugguu

SEQ ID NO: 590900 - RNA, 12 nt, Homo sapiens
acauuugccaag

SEQ ID NO: 590901 - RNA, 13 nt, Homo sapiens
acauuugggagac

SEQ ID NO: 590902 - RNA, 19 nt, Homo sapiens
acauuugggagacauguga

SEQ ID NO: 590903 - RNA, 20 nt, Homo sapiens
acauuugggagacaugugac

SEQ ID NO: 590904 - RNA, 15 nt, Homo sapiens
acauuugggcucagg

SEQ ID NO: 590905 - RNA, 13 nt, Homo sapiens
acauuugugcucc

SEQ ID NO: 590906 - RNA, 19 nt, Homo sapiens
acauuuuaaaagugccauu

SEQ ID NO: 590907 - RNA, 16 nt, Homo sapiens
acauuuuaaaugaaag

SEQ ID NO: 590908 - RNA, 16 nt, Homo sapiens
acauuuuaucauuaaa

SEQ ID NO: 590909 - RNA, 16 nt, Homo sapiens
acauuuucauugauga

SEQ ID NO: 590910 - RNA, 14 nt, Homo sapiens
acauuuucuuucau

SEQ ID NO: 590911 - RNA, 15 nt, Homo sapiens
acauuuugacacaaa

SEQ ID NO: 590912 - RNA, 23 nt, Homo sapiens
acauuuuuaagugcugcauuuaa

SEQ ID NO: 590913 - RNA, 19 nt, Homo sapiens
acauuuuucccuauuuucc

SEQ ID NO: 590914 - RNA, 13 nt, Homo sapiens
accaaaaagggau

SEQ ID NO: 590915 - RNA, 20 nt, Homo sapiens
accaaaacuuccaaggcccu

SEQ ID NO: 590916 - RNA, 21 nt, Homo sapiens
accaaaagaucucuugcuaga

SEQ ID NO: 590917 - RNA, 13 nt, Homo sapiens
accaaaauuacua

SEQ ID NO: 590918 - RNA, 17 nt, Homo sapiens
accaaaauuacuaauaa

SEQ ID NO: 590919 - RNA, 13 nt, Homo sapiens
accaaacaaggaa

SEQ ID NO: 590920 - RNA, 14 nt, Homo sapiens
accaaacaaggaag

SEQ ID NO: 590921 - RNA, 17 nt, Homo sapiens
accaaacagugcuguuu

SEQ ID NO: 590922 - RNA, 20 nt, Homo sapiens
accaaagacaucagucucca

SEQ ID NO: 590923 - RNA, 13 nt, Homo sapiens
accaaagagacug

SEQ ID NO: 590924 - RNA, 16 nt, Homo sapiens
accaaagagggcuucc

SEQ ID NO: 590925 - RNA, 16 nt, Homo sapiens
accaaagucacaucca

SEQ ID NO: 590926 - RNA, 19 nt, Homo sapiens
accaaauagcaauacaaac

SEQ ID NO: 590927 - RNA, 14 nt, Homo sapiens
accaaauaguuugu

SEQ ID NO: 590928 - RNA, 17 nt, Homo sapiens
accaaaucagcugcuac

SEQ ID NO: 590929 - RNA, 23 nt, Homo sapiens
accaaaucauccugaaucugauc

SEQ ID NO: 590930 - RNA, 13 nt, Homo sapiens
accaaaucucagu

SEQ ID NO: 590931 - RNA, 23 nt, Homo sapiens
accaaaucuugguugaugccaaa

SEQ ID NO: 590932 - RNA, 12 nt, Homo sapiens
accaaauugcuu

SEQ ID NO: 590933 - RNA, 13 nt, Homo sapiens
accaacaaaaaga

SEQ ID NO: 590934 - RNA, 23 nt, Homo sapiens
accaacaaaauccaugugaccau

SEQ ID NO: 590935 - RNA, 13 nt, Homo sapiens
accaacaugguga

SEQ ID NO: 590936 - RNA, 11 nt, Homo sapiens
accaaccaaac

SEQ ID NO: 590937 - RNA, 17 nt, Homo sapiens
accaaccccgcggccca

SEQ ID NO: 590938 - RNA, 15 nt, Homo sapiens
accaacccucagagc

SEQ ID NO: 590939 - RNA, 13 nt, Homo sapiens
accaaccuguuac

SEQ ID NO: 590940 - RNA, 19 nt, Homo sapiens
accaacgcacaacaggaaa

SEQ ID NO: 590941 - RNA, 17 nt, Homo sapiens
accaacuacuaccugua

SEQ ID NO: 590942 - RNA, 21 nt, Homo sapiens
accaacugcacaaucaguuua

SEQ ID NO: 590943 - RNA, 15 nt, Homo sapiens
accaacuuuacuguc

SEQ ID NO: 590944 - RNA, 12 nt, Homo sapiens
accaacuuucug

SEQ ID NO: 590945 - RNA, 13 nt, Homo sapiens
accaagacagugc

SEQ ID NO: 590946 - RNA, 13 nt, Homo sapiens
accaagacugagc

SEQ ID NO: 590947 - RNA, 13 nt, Homo sapiens
accaagagcaauu

SEQ ID NO: 590948 - RNA, 18 nt, Homo sapiens
accaagauuaugugacuu

SEQ ID NO: 590949 - RNA, 18 nt, Homo sapiens
accaagcguuucccaguc

SEQ ID NO: 590950 - RNA, 21 nt, Homo sapiens
accaaggaccccucaccuugc

SEQ ID NO: 590951 - RNA, 15 nt, Homo sapiens
accaaggacugagca

SEQ ID NO: 590952 - RNA, 16 nt, Homo sapiens
accaaggcagugcaug

SEQ ID NO: 590953 - RNA, 17 nt, Homo sapiens
accaaggcagugcaugc

SEQ ID NO: 590954 - RNA, 21 nt, Homo sapiens
accaaggcagugcaugcaugu

SEQ ID NO: 590955 - RNA, 17 nt, Homo sapiens
accaagucaaacuugga

SEQ ID NO: 590956 - RNA, 19 nt, Homo sapiens
accaagucaggccaggugg

SEQ ID NO: 590957 - RNA, 12 nt, Homo sapiens
accaagugcaau

SEQ ID NO: 590958 - RNA, 14 nt, Homo sapiens
accaaguugugcuu

SEQ ID NO: 590959 - RNA, 14 nt, Homo sapiens
accaauacuacuga

SEQ ID NO: 590960 - RNA, 15 nt, Homo sapiens
accaauagcaucugu

SEQ ID NO: 590961 - RNA, 13 nt, Homo sapiens
accaauauuguac

SEQ ID NO: 590962 - RNA, 14 nt, Homo sapiens
accaaucauuuuaa

SEQ ID NO: 590963 - RNA, 16 nt, Homo sapiens
accaauccaacaucca

SEQ ID NO: 590964 - RNA, 21 nt, Homo sapiens
accaaugccaaaaaaagacag

SEQ ID NO: 590965 - RNA, 22 nt, Homo sapiens
accaaugccaaaaaaagacagg

SEQ ID NO: 590966 - RNA, 13 nt, Homo sapiens
accaaugcuguug

SEQ ID NO: 590967 - RNA, 22 nt, Homo sapiens
accaauggcuccuugcccucaa

SEQ ID NO: 590968 - RNA, 20 nt, Homo sapiens
accaaugggccuccagagac

SEQ ID NO: 590969 - RNA, 22 nt, Homo sapiens
accaaugggccuccagagaccc

SEQ ID NO: 590970 - RNA, 22 nt, Homo sapiens
accaauguucauagcaacauua

SEQ ID NO: 590971 - RNA, 20 nt, Homo sapiens
accaauuccaccaagacagu

SEQ ID NO: 590972 - RNA, 20 nt, Homo sapiens
accaauuccugacacuugau

SEQ ID NO: 590973 - RNA, 14 nt, Homo sapiens
accaauucuaacag

SEQ ID NO: 590974 - RNA, 16 nt, Homo sapiens
accaauugugcugcca

SEQ ID NO: 590975 - RNA, 18 nt, Homo sapiens
accaauugugcugccauu

SEQ ID NO: 590976 - RNA, 23 nt, Homo sapiens
accaauuugguaaaaaugcugcu

SEQ ID NO: 590977 - RNA, 12 nt, Homo sapiens
accacaaggaaa

SEQ ID NO: 590978 - RNA, 13 nt, Homo sapiens
accacaccacagg

SEQ ID NO: 590979 - RNA, 22 nt, Homo sapiens
accacaccuggcauggugcagg

SEQ ID NO: 590980 - RNA, 17 nt, Homo sapiens
accacaggcuuguuacc

SEQ ID NO: 590981 - RNA, 15 nt, Homo sapiens
accacagguucucac

SEQ ID NO: 590982 - RNA, 22 nt, Homo sapiens
accacagguucucacuagauga

SEQ ID NO: 590983 - RNA, 14 nt, Homo sapiens
accacaguuuaccu

SEQ ID NO: 590984 - RNA, 15 nt, Homo sapiens
accacauccugaaaa

SEQ ID NO: 590985 - RNA, 14 nt, Homo sapiens
accaccaagccaag

SEQ ID NO: 590986 - RNA, 22 nt, Homo sapiens
accaccaugcacuguaaauauc

SEQ ID NO: 590987 - RNA, 16 nt, Homo sapiens
accacccacaaucaca

SEQ ID NO: 590988 - RNA, 23 nt, Homo sapiens
accacccccuguucccuguucug

SEQ ID NO: 590989 - RNA, 13 nt, Homo sapiens
accaccccuacca

SEQ ID NO: 590990 - RNA, 18 nt, Homo sapiens
accaccgucugucucaga

SEQ ID NO: 590991 - RNA, 14 nt, Homo sapiens
accaccuaauccuu

SEQ ID NO: 590992 - RNA, 13 nt, Homo sapiens
accaccucagaaa

SEQ ID NO: 590993 - RNA, 16 nt, Homo sapiens
accaccucugugggca

SEQ ID NO: 590994 - RNA, 17 nt, Homo sapiens
accaccucugugggcac

SEQ ID NO: 590995 - RNA, 13 nt, Homo sapiens
accaccuuuuuga

SEQ ID NO: 590996 - RNA, 14 nt, Homo sapiens
accacgcccagcua

SEQ ID NO: 590997 - RNA, 21 nt, Homo sapiens
accacguccuuauuggaauaa

SEQ ID NO: 590998 - RNA, 23 nt, Homo sapiens
accacuacaugcagcccaugccc

SEQ ID NO: 590999 - RNA, 14 nt, Homo sapiens
accacucaaaaaug

SEQ ID NO: 591000 - RNA, 23 nt, Homo sapiens
accacucaggccaacaagccaac

SEQ ID NO: 591001 - RNA, 15 nt, Homo sapiens
accacuccacuggcc

SEQ ID NO: 591002 - RNA, 20 nt, Homo sapiens
accacucuucuuuaagccau

SEQ ID NO: 591003 - RNA, 17 nt, Homo sapiens
accacugacuacuggcu

SEQ ID NO: 591004 - RNA, 22 nt, Homo sapiens
accacugcacuucagucugugu

SEQ ID NO: 591005 - RNA, 11 nt, Homo sapiens
accacuggcag

SEQ ID NO: 591006 - RNA, 23 nt, Homo sapiens
accacugguuaaaauaaagccua

SEQ ID NO: 591007 - RNA, 15 nt, Homo sapiens
accacuguacuccag

SEQ ID NO: 591008 - RNA, 14 nt, Homo sapiens
accacuuaucacau

SEQ ID NO: 591009 - RNA, 16 nt, Homo sapiens
accagaaaagcaauac

SEQ ID NO: 591010 - RNA, 15 nt, Homo sapiens
accagaaaggugauu

SEQ ID NO: 591011 - RNA, 16 nt, Homo sapiens
accagaaauuccagua

SEQ ID NO: 591012 - RNA, 20 nt, Homo sapiens
accagaauuguuuugcauuu

SEQ ID NO: 591013 - RNA, 21 nt, Homo sapiens
accagacacucacagcaagga

SEQ ID NO: 591014 - RNA, 13 nt, Homo sapiens
accagacagacaa

SEQ ID NO: 591015 - RNA, 22 nt, Homo sapiens
accagacagacaacacugggaa

SEQ ID NO: 591016 - RNA, 20 nt, Homo sapiens
accagagaggcucugagaaa

SEQ ID NO: 591017 - RNA, 13 nt, Homo sapiens
accagagcauuuc

SEQ ID NO: 591018 - RNA, 14 nt, Homo sapiens
accagagcauuucc

SEQ ID NO: 591019 - RNA, 15 nt, Homo sapiens
accagagcauuucca

SEQ ID NO: 591020 - RNA, 16 nt, Homo sapiens
accagagcgguaucuc

SEQ ID NO: 591021 - RNA, 13 nt, Homo sapiens
accagagcugucu

SEQ ID NO: 591022 - RNA, 14 nt, Homo sapiens
accagaggacaaag

SEQ ID NO: 591023 - RNA, 22 nt, Homo sapiens
accagaggcugcagaaggccaa

SEQ ID NO: 591024 - RNA, 12 nt, Homo sapiens
accagaggucag

SEQ ID NO: 591025 - RNA, 16 nt, Homo sapiens
accagaggugcuucug

SEQ ID NO: 591026 - RNA, 17 nt, Homo sapiens
accagagugauguccuc

SEQ ID NO: 591027 - RNA, 20 nt, Homo sapiens
accagauccuuuuccagaaa

SEQ ID NO: 591028 - RNA, 21 nt, Homo sapiens
accagaucugucuccaagacc

SEQ ID NO: 591029 - RNA, 18 nt, Homo sapiens
accagaugcuacuggacu

SEQ ID NO: 591030 - RNA, 12 nt, Homo sapiens
accagauuugcu

SEQ ID NO: 591031 - RNA, 21 nt, Homo sapiens
accagcaaacagcugaaagag

SEQ ID NO: 591032 - RNA, 17 nt, Homo sapiens
accagcacggugacucu

SEQ ID NO: 591033 - RNA, 17 nt, Homo sapiens
accagccccacugccag

SEQ ID NO: 591034 - RNA, 21 nt, Homo sapiens
accagccguauuuuacaugaa

SEQ ID NO: 591035 - RNA, 22 nt, Homo sapiens
accagccuggccaacaugguga

SEQ ID NO: 591036 - RNA, 19 nt, Homo sapiens
accagcgcccgcugggcug

SEQ ID NO: 591037 - RNA, 21 nt, Homo sapiens
accagcuaucugucaucucuc

SEQ ID NO: 591038 - RNA, 15 nt, Homo sapiens
accagcucccagggu

SEQ ID NO: 591039 - RNA, 21 nt, Homo sapiens
accagcuucugauaaacacaa

SEQ ID NO: 591040 - RNA, 17 nt, Homo sapiens
accaggacuauagccca

SEQ ID NO: 591041 - RNA, 14 nt, Homo sapiens
accaggccgugccu

SEQ ID NO: 591042 - RNA, 21 nt, Homo sapiens
accaggggugauuucagagag

SEQ ID NO: 591043 - RNA, 21 nt, Homo sapiens
accaggucuuguuucucucuc

SEQ ID NO: 591044 - RNA, 22 nt, Homo sapiens
accaguacucccccagcuuucc

SEQ ID NO: 591045 - RNA, 22 nt, Homo sapiens
accaguaucgcucauagaucag

SEQ ID NO: 591046 - RNA, 19 nt, Homo sapiens
accagucuauuuccacuga

SEQ ID NO: 591047 - RNA, 12 nt, Homo sapiens
accagugaaagg

SEQ ID NO: 591048 - RNA, 22 nt, Homo sapiens
accagugaccaucacaucccuu

SEQ ID NO: 591049 - RNA, 18 nt, Homo sapiens
accagugauccauguccu

SEQ ID NO: 591050 - RNA, 22 nt, Homo sapiens
accagugcaagcagaugacaaa

SEQ ID NO: 591051 - RNA, 19 nt, Homo sapiens
accagugguuuccagucau

SEQ ID NO: 591052 - RNA, 13 nt, Homo sapiens
accaguguagccu

SEQ ID NO: 591053 - RNA, 22 nt, Homo sapiens
accaguguccccuccacuguca

SEQ ID NO: 591054 - RNA, 16 nt, Homo sapiens
accagugugacaucua

SEQ ID NO: 591055 - RNA, 18 nt, Homo sapiens
accaguuaauuuuuccaa

SEQ ID NO: 591056 - RNA, 13 nt, Homo sapiens
accaguugcccua

SEQ ID NO: 591057 - RNA, 13 nt, Homo sapiens
accaguugccguu

SEQ ID NO: 591058 - RNA, 19 nt, Homo sapiens
accaguugggagcacugga

SEQ ID NO: 591059 - RNA, 16 nt, Homo sapiens
accaguuucagagaaa

SEQ ID NO: 591060 - RNA, 19 nt, Homo sapiens
accauaaauuggcuuuuca

SEQ ID NO: 591061 - RNA, 16 nt, Homo sapiens
accauaacaacuucau

SEQ ID NO: 591062 - RNA, 12 nt, Homo sapiens
accauaacacuu

SEQ ID NO: 591063 - RNA, 13 nt, Homo sapiens
accauaacacuug

SEQ ID NO: 591064 - RNA, 21 nt, Homo sapiens
accauaagugacaccaauaaa

SEQ ID NO: 591065 - RNA, 22 nt, Homo sapiens
accauacucccuuucagggcca

SEQ ID NO: 591066 - RNA, 17 nt, Homo sapiens
accauauuuuuuguaaa

SEQ ID NO: 591067 - RNA, 19 nt, Homo sapiens
accaucaaguugugccaaa

SEQ ID NO: 591068 - RNA, 17 nt, Homo sapiens
accaucagggacaggau

SEQ ID NO: 591069 - RNA, 12 nt, Homo sapiens
accaucauagcu

SEQ ID NO: 591070 - RNA, 22 nt, Homo sapiens
accauccagaggaauaaaaagg

SEQ ID NO: 591071 - RNA, 20 nt, Homo sapiens
accauccuggcuaacacggu

SEQ ID NO: 591072 - RNA, 20 nt, Homo sapiens
accaucucaggccaccugcc

SEQ ID NO: 591073 - RNA, 13 nt, Homo sapiens
accaucugauguu

SEQ ID NO: 591074 - RNA, 17 nt, Homo sapiens
accaucugcugcaguua

SEQ ID NO: 591075 - RNA, 11 nt, Homo sapiens
accaugaagcg

SEQ ID NO: 591076 - RNA, 11 nt, Homo sapiens
accaugacaaa

SEQ ID NO: 591077 - RNA, 18 nt, Homo sapiens
accaugacgcacugcuca

SEQ ID NO: 591078 - RNA, 20 nt, Homo sapiens
accaugacgcacugcucaag

SEQ ID NO: 591079 - RNA, 11 nt, Homo sapiens
accaugacugu

SEQ ID NO: 591080 - RNA, 22 nt, Homo sapiens
accaugagcaccuccagcugua

SEQ ID NO: 591081 - RNA, 22 nt, Homo sapiens
accaugcagccgcaccagagag

SEQ ID NO: 591082 - RNA, 20 nt, Homo sapiens
accaugcauuuaaaguauuc

SEQ ID NO: 591083 - RNA, 21 nt, Homo sapiens
accaugccagacccacugaaa

SEQ ID NO: 591084 - RNA, 15 nt, Homo sapiens
accaugccaggcuaa

SEQ ID NO: 591085 - RNA, 15 nt, Homo sapiens
accaugcccagcuag

SEQ ID NO: 591086 - RNA, 16 nt, Homo sapiens
accaugcucaaugaaa

SEQ ID NO: 591087 - RNA, 9 nt, Homo sapiens
accaugcug

SEQ ID NO: 591088 - RNA, 15 nt, Homo sapiens
accauggacacuaca

SEQ ID NO: 591089 - RNA, 15 nt, Homo sapiens
accauggacaugugu

SEQ ID NO: 591090 - RNA, 18 nt, Homo sapiens
accauggaccagcccauu

SEQ ID NO: 591091 - RNA, 23 nt, Homo sapiens
accauggaguuaacaucaugaau

SEQ ID NO: 591092 - RNA, 21 nt, Homo sapiens
accaugguuuuggcucuccca

SEQ ID NO: 591093 - RNA, 22 nt, Homo sapiens
agagauccuuuagugcacccag

SEQ ID NO: 591094 - RNA, 15 nt, Homo sapiens
agagaucuauguacu

SEQ ID NO: 591095 - RNA, 19 nt, Homo sapiens
agagaucuuucuuuccaaa

SEQ ID NO: 591096 - RNA, 15 nt, Homo sapiens
agagaugaaagaggg

SEQ ID NO: 591097 - RNA, 18 nt, Homo sapiens
agagauggauauugaaau

SEQ ID NO: 591098 - RNA, 14 nt, Homo sapiens
agagaugggacaag

SEQ ID NO: 591099 - RNA, 12 nt, Homo sapiens
agagauguuaaa

SEQ ID NO: 591100 - RNA, 17 nt, Homo sapiens
agagauuuggagcacuc

SEQ ID NO: 591101 - RNA, 16 nt, Homo sapiens
agagcaaaggagacaa

SEQ ID NO: 591102 - RNA, 13 nt, Homo sapiens
agagcaaaugcua

SEQ ID NO: 591103 - RNA, 22 nt, Homo sapiens
agagcaacaauccaucucucaa

SEQ ID NO: 591104 - RNA, 14 nt, Homo sapiens
agagcaaccucuca

SEQ ID NO: 591105 - RNA, 21 nt, Homo sapiens
agagcaacucugagaucuaag

SEQ ID NO: 591106 - RNA, 15 nt, Homo sapiens
agagcaagacuccau

SEQ ID NO: 591107 - RNA, 14 nt, Homo sapiens
agagcacaaacuuc

SEQ ID NO: 591108 - RNA, 13 nt, Homo sapiens
agagcacacugua

SEQ ID NO: 591109 - RNA, 23 nt, Homo sapiens
agagcaccuuugcacaggaugcu

SEQ ID NO: 591110 - RNA, 16 nt, Homo sapiens
agagcacucauuccuu

SEQ ID NO: 591111 - RNA, 15 nt, Homo sapiens
agagcagaguuuacg

SEQ ID NO: 591112 - RNA, 12 nt, Homo sapiens
agagcagcagca

SEQ ID NO: 591113 - RNA, 14 nt, Homo sapiens
agagcagcuggcuc

SEQ ID NO: 591114 - RNA, 16 nt, Homo sapiens
agagcagcuucaguga

SEQ ID NO: 591115 - RNA, 16 nt, Homo sapiens
agagcaggacugcaca

SEQ ID NO: 591116 - RNA, 12 nt, Homo sapiens
agagcaggcuca

SEQ ID NO: 591117 - RNA, 21 nt, Homo sapiens
agagcaggcuggcagcucucc

SEQ ID NO: 591118 - RNA, 15 nt, Homo sapiens
agagcaggggcucca

SEQ ID NO: 591119 - RNA, 15 nt, Homo sapiens
agagcaugcacaugc

SEQ ID NO: 591120 - RNA, 12 nt, Homo sapiens
agagccacuggg

SEQ ID NO: 591121 - RNA, 17 nt, Homo sapiens
agagccagcagcaaaaa

SEQ ID NO: 591122 - RNA, 15 nt, Homo sapiens
agagccagcucucuc

SEQ ID NO: 591123 - RNA, 11 nt, Homo sapiens
agagccaguga

SEQ ID NO: 591124 - RNA, 12 nt, Homo sapiens
agagccagugaa

SEQ ID NO: 591125 - RNA, 12 nt, Homo sapiens
agagccaugcca

SEQ ID NO: 591126 - RNA, 14 nt, Homo sapiens
agagcccagucauu

SEQ ID NO: 591127 - RNA, 18 nt, Homo sapiens
agagccccacuugacacu

SEQ ID NO: 591128 - RNA, 17 nt, Homo sapiens
agagcccgcagggccau

SEQ ID NO: 591129 - RNA, 17 nt, Homo sapiens
agagcccucagaaccau

SEQ ID NO: 591130 - RNA, 21 nt, Homo sapiens
agagcccuucacugccaugau

SEQ ID NO: 591131 - RNA, 14 nt, Homo sapiens
agagcccuugccuc

SEQ ID NO: 591132 - RNA, 18 nt, Homo sapiens
agagccuauuuuggugag

SEQ ID NO: 591133 - RNA, 21 nt, Homo sapiens
agagccucggcccuagcauug

SEQ ID NO: 591134 - RNA, 13 nt, Homo sapiens
agagccucugggc

SEQ ID NO: 591135 - RNA, 18 nt, Homo sapiens
agagccugaagcuggccu

SEQ ID NO: 591136 - RNA, 14 nt, Homo sapiens
agagccuggagaag

SEQ ID NO: 591137 - RNA, 17 nt, Homo sapiens
agagccuuuugugcaaa

SEQ ID NO: 591138 - RNA, 15 nt, Homo sapiens
agagcgagacuccau

SEQ ID NO: 591139 - RNA, 19 nt, Homo sapiens
agagcgagauuccgucuca

SEQ ID NO: 591140 - RNA, 17 nt, Homo sapiens
agagcgaggaaaggauu

SEQ ID NO: 591141 - RNA, 20 nt, Homo sapiens
agagcgcaagcugggagcac

SEQ ID NO: 591142 - RNA, 21 nt, Homo sapiens
agagcuaauuuacuggacaaa

SEQ ID NO: 591143 - RNA, 23 nt, Homo sapiens
agagcuauggugagguguggaua

SEQ ID NO: 591144 - RNA, 20 nt, Homo sapiens
agagcuauugccaaccaguu

SEQ ID NO: 591145 - RNA, 14 nt, Homo sapiens
agagcucagcuuuc

SEQ ID NO: 591146 - RNA, 11 nt, Homo sapiens
agagcucuuaa

SEQ ID NO: 591147 - RNA, 15 nt, Homo sapiens
agagcuggaucucuc

SEQ ID NO: 591148 - RNA, 19 nt, Homo sapiens
agagcuggcacccugucau

SEQ ID NO: 591149 - RNA, 19 nt, Homo sapiens
agagcuggggagggagagc

SEQ ID NO: 591150 - RNA, 15 nt, Homo sapiens
agagcuggggcugcc

SEQ ID NO: 591151 - RNA, 12 nt, Homo sapiens
agagcuuuggua

SEQ ID NO: 591152 - RNA, 13 nt, Homo sapiens
agaggaaacugaa

SEQ ID NO: 591153 - RNA, 20 nt, Homo sapiens
agaggaaacugaaguucuga

SEQ ID NO: 591154 - RNA, 13 nt, Homo sapiens
agaggaaauucuu

SEQ ID NO: 591155 - RNA, 13 nt, Homo sapiens
agaggaacagcac

SEQ ID NO: 591156 - RNA, 18 nt, Homo sapiens
agaggaacccagaugcuc

SEQ ID NO: 591157 - RNA, 19 nt, Homo sapiens
agaggaagagcugcaacgg

SEQ ID NO: 591158 - RNA, 16 nt, Homo sapiens
agaggaaguucagauc

SEQ ID NO: 591159 - RNA, 15 nt, Homo sapiens
agaggaauccaugua

SEQ ID NO: 591160 - RNA, 16 nt, Homo sapiens
agaggaccccagggug

SEQ ID NO: 591161 - RNA, 13 nt, Homo sapiens
agaggacugagac

SEQ ID NO: 591162 - RNA, 13 nt, Homo sapiens
agaggagaaaaag

SEQ ID NO: 591163 - RNA, 21 nt, Homo sapiens
agaggagauuggccagugaga

SEQ ID NO: 591164 - RNA, 23 nt, Homo sapiens
agaggagguuuggggucugccac

SEQ ID NO: 591165 - RNA, 18 nt, Homo sapiens
agaggaucuccuguccau

SEQ ID NO: 591166 - RNA, 19 nt, Homo sapiens
agaggaugcugggcucugu

SEQ ID NO: 591167 - RNA, 13 nt, Homo sapiens
agaggaugucaca

SEQ ID NO: 591168 - RNA, 17 nt, Homo sapiens
agaggaugucacaaaga

SEQ ID NO: 591169 - RNA, 22 nt, Homo sapiens
agaggcaaugauuguuaauuua

SEQ ID NO: 591170 - RNA, 20 nt, Homo sapiens
agaggcagcaagguggccac

SEQ ID NO: 591171 - RNA, 24 nt, Homo sapiens
agaggcagcagagcauucagacuc

SEQ ID NO: 591172 - RNA, 22 nt, Homo sapiens
agaggccuggagcccacaaccu

SEQ ID NO: 591173 - RNA, 15 nt, Homo sapiens
agaggcucugagaaa

SEQ ID NO: 591174 - RNA, 13 nt, Homo sapiens
agaggcugagaca

SEQ ID NO: 591175 - RNA, 19 nt, Homo sapiens
agaggcugaggcuggcaca

SEQ ID NO: 591176 - RNA, 19 nt, Homo sapiens
agaggcugcagaaggccaa

SEQ ID NO: 591177 - RNA, 21 nt, Homo sapiens
agaggcugccccucucaccaa

SEQ ID NO: 591178 - RNA, 11 nt, Homo sapiens
agaggcugcug

SEQ ID NO: 591179 - RNA, 13 nt, Homo sapiens
agaggcugcugca

SEQ ID NO: 591180 - RNA, 18 nt, Homo sapiens
agaggcugggagguuggg

SEQ ID NO: 591181 - RNA, 17 nt, Homo sapiens
agaggcuguggcuggug

SEQ ID NO: 591182 - RNA, 13 nt, Homo sapiens
agaggcuuuccaa

SEQ ID NO: 591183 - RNA, 14 nt, Homo sapiens
agagggaagccaug

SEQ ID NO: 591184 - RNA, 18 nt, Homo sapiens
agagggacagaugaccaa

SEQ ID NO: 591185 - RNA, 21 nt, Homo sapiens
agagggaccaaauugcuucua

SEQ ID NO: 591186 - RNA, 15 nt, Homo sapiens
agagggcccaucagg

SEQ ID NO: 591187 - RNA, 19 nt, Homo sapiens
agagggcuagcccugagcc

SEQ ID NO: 591188 - RNA, 15 nt, Homo sapiens
agagggcugguccuu

SEQ ID NO: 591189 - RNA, 22 nt, Homo sapiens
agagggcuguuggacagcugcu

SEQ ID NO: 591190 - RNA, 16 nt, Homo sapiens
agaggggaagggccag

SEQ ID NO: 591191 - RNA, 23 nt, Homo sapiens
agaggggcagccaggacaucucu

SEQ ID NO: 591192 - RNA, 15 nt, Homo sapiens
agaggggcagccgcu

SEQ ID NO: 591193 - RNA, 19 nt, Homo sapiens
agaggggguagcuagccug

SEQ ID NO: 591194 - RNA, 22 nt, Homo sapiens
agagggucuuacuguuccaggg

SEQ ID NO: 591195 - RNA, 14 nt, Homo sapiens
agaggguguuugca

SEQ ID NO: 591196 - RNA, 21 nt, Homo sapiens
agagguaaaagugugagcagu

SEQ ID NO: 591197 - RNA, 22 nt, Homo sapiens
agagguagguaggaucauccca

SEQ ID NO: 591198 - RNA, 15 nt, Homo sapiens
agaggucaccagcug

SEQ ID NO: 591199 - RNA, 17 nt, Homo sapiens
agaggucaccagcugcu

SEQ ID NO: 591200 - RNA, 18 nt, Homo sapiens
agaggucagacuaagaaa

SEQ ID NO: 591201 - RNA, 18 nt, Homo sapiens
agaggucccucagcugcg

SEQ ID NO: 591202 - RNA, 22 nt, Homo sapiens
agagguccuaaagaugcugacu

SEQ ID NO: 591203 - RNA, 20 nt, Homo sapiens
agaggucuuaucuguucagu

SEQ ID NO: 591204 - RNA, 18 nt, Homo sapiens
agaggucuucagggcucu

SEQ ID NO: 591205 - RNA, 13 nt, Homo sapiens
agaggugcuucug

SEQ ID NO: 591206 - RNA, 21 nt, Homo sapiens
agagguggagugucacaucuc

SEQ ID NO: 591207 - RNA, 22 nt, Homo sapiens
agagguggcaggaauacuucac

SEQ ID NO: 591208 - RNA, 22 nt, Homo sapiens
agagguuacagguuacagugag

SEQ ID NO: 591209 - RNA, 14 nt, Homo sapiens
agagguuaucugcc

SEQ ID NO: 591210 - RNA, 14 nt, Homo sapiens
agagguuucuugaa

SEQ ID NO: 591211 - RNA, 22 nt, Homo sapiens
agagguuugcugacaggugaug

SEQ ID NO: 591212 - RNA, 12 nt, Homo sapiens
agagguuugcuu

SEQ ID NO: 591213 - RNA, 21 nt, Homo sapiens
agaguacgugaaaugcucaag

SEQ ID NO: 591214 - RNA, 16 nt, Homo sapiens
agaguauaugcacuuu

SEQ ID NO: 591215 - RNA, 15 nt, Homo sapiens
agaguauccuaccca

SEQ ID NO: 591216 - RNA, 17 nt, Homo sapiens
agagucagcccuuggcu

SEQ ID NO: 591217 - RNA, 21 nt, Homo sapiens
agagucauauugcccaguggu

SEQ ID NO: 591218 - RNA, 12 nt, Homo sapiens
agagucaucuga

SEQ ID NO: 591219 - RNA, 14 nt, Homo sapiens
agaguccucugaau

SEQ ID NO: 591220 - RNA, 15 nt, Homo sapiens
agaguccugcacagu

SEQ ID NO: 591221 - RNA, 21 nt, Homo sapiens
agaguccugcacaguuuucug

SEQ ID NO: 591222 - RNA, 16 nt, Homo sapiens
agagucgcugugccac

SEQ ID NO: 591223 - RNA, 18 nt, Homo sapiens
agagucucugauacacag

SEQ ID NO: 591224 - RNA, 14 nt, Homo sapiens
agagugacaugugc

SEQ ID NO: 591225 - RNA, 15 nt, Homo sapiens
agagugagacuccac

SEQ ID NO: 591226 - RNA, 16 nt, Homo sapiens
agagugagagggcaug

SEQ ID NO: 591227 - RNA, 21 nt, Homo sapiens
agagugccguaacaacugugg

SEQ ID NO: 591228 - RNA, 22 nt, Homo sapiens
agagugccguaacaacuguggu

SEQ ID NO: 591229 - RNA, 19 nt, Homo sapiens
agagugcugccaguccucu

SEQ ID NO: 591230 - RNA, 20 nt, Homo sapiens
agagugcuggacuguuccag

SEQ ID NO: 591231 - RNA, 22 nt, Homo sapiens
agaguggaaccaacacuaacau

SEQ ID NO: 591232 - RNA, 20 nt, Homo sapiens
agaguggcugcaccacuucc

SEQ ID NO: 591233 - RNA, 17 nt, Homo sapiens
agaguggucgagugaca

SEQ ID NO: 591234 - RNA, 16 nt, Homo sapiens
agaguggugaguggaa

SEQ ID NO: 591235 - RNA, 14 nt, Homo sapiens
agaguggugcugcu

SEQ ID NO: 591236 - RNA, 15 nt, Homo sapiens
agaguggugcugcuu

SEQ ID NO: 591237 - RNA, 15 nt, Homo sapiens
agaguguagcuguaa

SEQ ID NO: 591238 - RNA, 18 nt, Homo sapiens
agaguguauuacaacaau

SEQ ID NO: 591239 - RNA, 23 nt, Homo sapiens
agaguguauuacaacaaucugga

SEQ ID NO: 591240 - RNA, 11 nt, Homo sapiens
agagugugagc

SEQ ID NO: 591241 - RNA, 17 nt, Homo sapiens
agaguguggauuguaua

SEQ ID NO: 591242 - RNA, 19 nt, Homo sapiens
agaguguuaucagucauaa

SEQ ID NO: 591243 - RNA, 16 nt, Homo sapiens
agaguguuucuuccac

SEQ ID NO: 591244 - RNA, 22 nt, Homo sapiens
agaguguuucuuccacaacaga

SEQ ID NO: 591245 - RNA, 19 nt, Homo sapiens
agaguuagguugucuccag

SEQ ID NO: 591246 - RNA, 18 nt, Homo sapiens
agaguuauagugagggaa

SEQ ID NO: 591247 - RNA, 20 nt, Homo sapiens
agaguuauucaaaugaaggu

SEQ ID NO: 591248 - RNA, 14 nt, Homo sapiens
agaguucagacuca

SEQ ID NO: 591249 - RNA, 17 nt, Homo sapiens
agaguucuauccccaag

SEQ ID NO: 591250 - RNA, 19 nt, Homo sapiens
agaguugagauuuugcaau

SEQ ID NO: 591251 - RNA, 16 nt, Homo sapiens
agaguugcuuaaugaa

SEQ ID NO: 591252 - RNA, 13 nt, Homo sapiens
agaguuguucucu

SEQ ID NO: 591253 - RNA, 13 nt, Homo sapiens
agaguuugcucaa

SEQ ID NO: 591254 - RNA, 21 nt, Homo sapiens
agaguuuggaauuauuguaga

SEQ ID NO: 591255 - RNA, 15 nt, Homo sapiens
agaguuuguuaccua

SEQ ID NO: 591256 - RNA, 17 nt, Homo sapiens
agaguuuuaacuuuuaa

SEQ ID NO: 591257 - RNA, 23 nt, Homo sapiens
agauaaaagaaccgagcaauuuu

SEQ ID NO: 591258 - RNA, 15 nt, Homo sapiens
agauaaaauguguaa

SEQ ID NO: 591259 - RNA, 16 nt, Homo sapiens
agauaaaauuguucaa

SEQ ID NO: 591260 - RNA, 20 nt, Homo sapiens
agauaaaccaauaaauccac

SEQ ID NO: 591261 - RNA, 22 nt, Homo sapiens
agauaaauagaacuaucugcau

SEQ ID NO: 591262 - RNA, 13 nt, Homo sapiens
agauaaaugugcu

SEQ ID NO: 591263 - RNA, 17 nt, Homo sapiens
agauaacagauuauuug

SEQ ID NO: 591264 - RNA, 15 nt, Homo sapiens
agauaagaaggugcg

SEQ ID NO: 591265 - RNA, 17 nt, Homo sapiens
agauaauaaucuuggcu

SEQ ID NO: 591266 - RNA, 21 nt, Homo sapiens
agauaaucauugcuuauguca

SEQ ID NO: 591267 - RNA, 15 nt, Homo sapiens
agauaaucucucagc

SEQ ID NO: 591268 - RNA, 13 nt, Homo sapiens
agauaauguugcu

SEQ ID NO: 591269 - RNA, 17 nt, Homo sapiens
agauaauuguuucauuc

SEQ ID NO: 591270 - RNA, 15 nt, Homo sapiens
agauacaaaugucua

SEQ ID NO: 591271 - RNA, 19 nt, Homo sapiens
agauacacagauauauaca

SEQ ID NO: 591272 - RNA, 16 nt, Homo sapiens
agauaccuccaacccu

SEQ ID NO: 591273 - RNA, 16 nt, Homo sapiens
agauacuaaaucuggg

SEQ ID NO: 591274 - RNA, 14 nt, Homo sapiens
agauacuagcuauc

SEQ ID NO: 591275 - RNA, 17 nt, Homo sapiens
agauacuucccaaagcc

SEQ ID NO: 591276 - RNA, 20 nt, Homo sapiens
agauagaaccuggagccacu

SEQ ID NO: 591277 - RNA, 16 nt, Homo sapiens
agauagauauaugcuc

SEQ ID NO: 591278 - RNA, 14 nt, Homo sapiens
agauagauuuggaa

SEQ ID NO: 591279 - RNA, 17 nt, Homo sapiens
agauagguggugccagu

SEQ ID NO: 591280 - RNA, 20 nt, Homo sapiens
agauagugccagguggcuca

SEQ ID NO: 591281 - RNA, 22 nt, Homo sapiens
agauagugccagguggcucagu

SEQ ID NO: 591282 - RNA, 22 nt, Homo sapiens
agauagugcuggaacacugcug

SEQ ID NO: 591283 - RNA, 20 nt, Homo sapiens
agauauacgcccucuuucau

SEQ ID NO: 591284 - RNA, 17 nt, Homo sapiens
agauauacugggagaaa

SEQ ID NO: 591285 - RNA, 16 nt, Homo sapiens
agauauauaugugcuc

SEQ ID NO: 591286 - RNA, 23 nt, Homo sapiens
agauauaucccggaugaggcuga

SEQ ID NO: 591287 - RNA, 13 nt, Homo sapiens
agauauaugcucu

SEQ ID NO: 591288 - RNA, 11 nt, Homo sapiens
agauaugauau

SEQ ID NO: 591289 - RNA, 18 nt, Homo sapiens
agauauggacacacggga

SEQ ID NO: 591290 - RNA, 20 nt, Homo sapiens
agauauggacucucuaagga

SEQ ID NO: 591291 - RNA, 15 nt, Homo sapiens
agauauggcacuucu

SEQ ID NO: 591292 - RNA, 14 nt, Homo sapiens
agauauguauuuaa

SEQ ID NO: 591293 - RNA, 17 nt, Homo sapiens
agauauuaggggggaaa

SEQ ID NO: 591294 - RNA, 24 nt, Homo sapiens
agauauucauuggcagcucaaaga

SEQ ID NO: 591295 - RNA, 14 nt, Homo sapiens
agauauugauuacu

SEQ ID NO: 591296 - RNA, 17 nt, Homo sapiens
agauauugauuacuauc

SEQ ID NO: 591297 - RNA, 12 nt, Homo sapiens
agauauuucaca

SEQ ID NO: 591298 - RNA, 14 nt, Homo sapiens
agauauuucacauu

SEQ ID NO: 591299 - RNA, 15 nt, Homo sapiens
agauauuuuugcaac

SEQ ID NO: 591300 - RNA, 13 nt, Homo sapiens
agaucaacagauc

SEQ ID NO: 591301 - RNA, 14 nt, Homo sapiens
agaucaacauucca

SEQ ID NO: 591302 - RNA, 18 nt, Homo sapiens
agaucaacauuccagggu

SEQ ID NO: 591303 - RNA, 20 nt, Homo sapiens
agaucaaggaguacaaugcc

SEQ ID NO: 591304 - RNA, 13 nt, Homo sapiens
agaucaaugguuu

SEQ ID NO: 591305 - RNA, 13 nt, Homo sapiens
agaucacaccacu

SEQ ID NO: 591306 - RNA, 15 nt, Homo sapiens
agaucaccaccugaa

SEQ ID NO: 591307 - RNA, 17 nt, Homo sapiens
agaucacgccacugcac

SEQ ID NO: 591308 - RNA, 17 nt, Homo sapiens
agaucacugacucugac

SEQ ID NO: 591309 - RNA, 15 nt, Homo sapiens
agaucacugccacac

SEQ ID NO: 591310 - RNA, 20 nt, Homo sapiens
agaucacuuucucaguuuuc

SEQ ID NO: 591311 - RNA, 15 nt, Homo sapiens
agaucagacuuuaau

SEQ ID NO: 591312 - RNA, 21 nt, Homo sapiens
agaucagagguuacuaggguu

SEQ ID NO: 591313 - RNA, 21 nt, Homo sapiens
agaucaguauuucacugauac

SEQ ID NO: 591314 - RNA, 11 nt, Homo sapiens
agaucagucag

SEQ ID NO: 591315 - RNA, 18 nt, Homo sapiens
agaucauauacgugaaaa

SEQ ID NO: 591316 - RNA, 15 nt, Homo sapiens
agaucauauuucaca

SEQ ID NO: 591317 - RNA, 15 nt, Homo sapiens
agaucaucagucacc

SEQ ID NO: 591318 - RNA, 18 nt, Homo sapiens
agaucaugaaaguccagc

SEQ ID NO: 591319 - RNA, 17 nt, Homo sapiens
agaucauuuucuuaucu

SEQ ID NO: 591320 - RNA, 18 nt, Homo sapiens
agauccacccuaucccug

SEQ ID NO: 591321 - RNA, 14 nt, Homo sapiens
agauccacgugugg

SEQ ID NO: 591322 - RNA, 14 nt, Homo sapiens
agauccaguauuug

SEQ ID NO: 591323 - RNA, 14 nt, Homo sapiens
agaucccagaggau

SEQ ID NO: 591324 - RNA, 17 nt, Homo sapiens
agauccgagucuaccca

SEQ ID NO: 591325 - RNA, 20 nt, Homo sapiens
agauccugcauuuauggugu

SEQ ID NO: 591326 - RNA, 17 nt, Homo sapiens
agauccuuaaugcagag

SEQ ID NO: 591327 - RNA, 20 nt, Homo sapiens
agauccuucgggugcuggaa

SEQ ID NO: 591328 - RNA, 20 nt, Homo sapiens
agaucgauccuggauucacu

SEQ ID NO: 591329 - RNA, 14 nt, Homo sapiens
agaucgcaccacug

SEQ ID NO: 591330 - RNA, 19 nt, Homo sapiens
agaucgcaccauugcacuc

SEQ ID NO: 591331 - RNA, 16 nt, Homo sapiens
agaucgcaguuugccu

SEQ ID NO: 591332 - RNA, 19 nt, Homo sapiens
agaucgcaucauugcacuc

SEQ ID NO: 591333 - RNA, 22 nt, Homo sapiens
agaucguucauugccuuuccag

SEQ ID NO: 591334 - RNA, 17 nt, Homo sapiens
agaucuaaggaugucac

SEQ ID NO: 591335 - RNA, 18 nt, Homo sapiens
agaucuaaggaugucaca

SEQ ID NO: 591336 - RNA, 20 nt, Homo sapiens
agaucuaccccagggagaau

SEQ ID NO: 591337 - RNA, 17 nt, Homo sapiens
agaucuauguacuguaa

SEQ ID NO: 591338 - RNA, 18 nt, Homo sapiens
agaucuauguacuguaau

SEQ ID NO: 591339 - RNA, 18 nt, Homo sapiens
agaucucaucucaugaca

SEQ ID NO: 591340 - RNA, 19 nt, Homo sapiens
agaucuccaacagccagug

SEQ ID NO: 591341 - RNA, 20 nt, Homo sapiens
agaucuccaacagccagugu

SEQ ID NO: 591342 - RNA, 24 nt, Homo sapiens
agaucucccacugcggggagacag

SEQ ID NO: 591343 - RNA, 16 nt, Homo sapiens
agaucucuaacuucac

SEQ ID NO: 591344 - RNA, 18 nt, Homo sapiens
agaucucuccugcaaaag

SEQ ID NO: 591345 - RNA, 21 nt, Homo sapiens
agaucucuuucuaaagacagg

SEQ ID NO: 591346 - RNA, 22 nt, Homo sapiens
agaucugcaccaccaugcccag

SEQ ID NO: 591347 - RNA, 19 nt, Homo sapiens
agaucugcaggcugccucu

SEQ ID NO: 591348 - RNA, 12 nt, Homo sapiens
agaucugugccu

SEQ ID NO: 591349 - RNA, 14 nt, Homo sapiens
agaucugugccugg

SEQ ID NO: 591350 - RNA, 16 nt, Homo sapiens
agaucuugaauagucu

SEQ ID NO: 591351 - RNA, 17 nt, Homo sapiens
agaucuuucaggaaaga

SEQ ID NO: 591352 - RNA, 20 nt, Homo sapiens
agaucuuucaggaaagacgg

SEQ ID NO: 591353 - RNA, 16 nt, Homo sapiens
agaugaaaugcacugu

SEQ ID NO: 591354 - RNA, 14 nt, Homo sapiens
agaugaaauugcca

SEQ ID NO: 591355 - RNA, 17 nt, Homo sapiens
agaugaacuuugucauu

SEQ ID NO: 591356 - RNA, 18 nt, Homo sapiens
agaugaagacaacagcau

SEQ ID NO: 591357 - RNA, 23 nt, Homo sapiens
agaugacaaaccauaacugacaa

SEQ ID NO: 591358 - RNA, 20 nt, Homo sapiens
agaugacaaccuccauucua

SEQ ID NO: 591359 - RNA, 15 nt, Homo sapiens
agaugaccagugccu

SEQ ID NO: 591360 - RNA, 16 nt, Homo sapiens
agaugagaacaaagcu

SEQ ID NO: 591361 - RNA, 20 nt, Homo sapiens
agaugagauuggcauggcuu

SEQ ID NO: 591362 - RNA, 21 nt, Homo sapiens
agaugaggacaagagggacaa

SEQ ID NO: 591363 - RNA, 17 nt, Homo sapiens
agaugaggcacuggaag

SEQ ID NO: 591364 - RNA, 15 nt, Homo sapiens
agaugauacauccaa

SEQ ID NO: 591365 - RNA, 22 nt, Homo sapiens
agaugauacauccaaagcagac

SEQ ID NO: 591366 - RNA, 14 nt, Homo sapiens
agaugauaccugaa

SEQ ID NO: 591367 - RNA, 22 nt, Homo sapiens
agaugauugaauaacaguaguc

SEQ ID NO: 591368 - RNA, 14 nt, Homo sapiens
agaugauuguucaa

SEQ ID NO: 591369 - RNA, 14 nt, Homo sapiens
agaugauuugguca

SEQ ID NO: 591370 - RNA, 12 nt, Homo sapiens
agaugcacugaa

SEQ ID NO: 591371 - RNA, 14 nt, Homo sapiens
agaugcagcauuuu

SEQ ID NO: 591372 - RNA, 11 nt, Homo sapiens
agaugccaaac

SEQ ID NO: 591373 - RNA, 16 nt, Homo sapiens
agaugccagcuucucu

SEQ ID NO: 591374 - RNA, 18 nt, Homo sapiens
agaugccccagagcuguu

SEQ ID NO: 591375 - RNA, 16 nt, Homo sapiens
agaugcccuuuggaaa

SEQ ID NO: 591376 - RNA, 20 nt, Homo sapiens
agaugccuccucuccaaaga

SEQ ID NO: 591377 - RNA, 20 nt, Homo sapiens
agaugccucgcucuuuucaa

SEQ ID NO: 591378 - RNA, 16 nt, Homo sapiens
agaugcggccaaagau

SEQ ID NO: 591379 - RNA, 22 nt, Homo sapiens
agaugcgugcccagcucuucac

SEQ ID NO: 591380 - RNA, 18 nt, Homo sapiens
agaugcuaaaaucccugg

SEQ ID NO: 591381 - RNA, 14 nt, Homo sapiens
agaugcugauucau

SEQ ID NO: 591382 - RNA, 19 nt, Homo sapiens
agaugcuggugagguugug

SEQ ID NO: 591383 - RNA, 21 nt, Homo sapiens
agauggaaaaacuugugcuau

SEQ ID NO: 591384 - RNA, 15 nt, Homo sapiens
agauggaacacugga

SEQ ID NO: 591385 - RNA, 23 nt, Homo sapiens
agauggaacacuggaacauucca

SEQ ID NO: 591386 - RNA, 18 nt, Homo sapiens
agauggacucaggaucca

SEQ ID NO: 591387 - RNA, 19 nt, Homo sapiens
agauggauagucuguccaa

SEQ ID NO: 591388 - RNA, 12 nt, Homo sapiens
agauggccauau

SEQ ID NO: 591389 - RNA, 19 nt, Homo sapiens
agauggcgaccaccaaagu

SEQ ID NO: 591390 - RNA, 17 nt, Homo sapiens
agauggcgauguguuau

SEQ ID NO: 591391 - RNA, 16 nt, Homo sapiens
agauggcucuuucuau

SEQ ID NO: 591392 - RNA, 15 nt, Homo sapiens
agaugggacaagcag

SEQ ID NO: 591393 - RNA, 22 nt, Homo sapiens
agaugggcaaauuaaggcauaa

SEQ ID NO: 591394 - RNA, 15 nt, Homo sapiens
agauggggcauauuc

SEQ ID NO: 591395 - RNA, 14 nt, Homo sapiens
agaugguccauuug

SEQ ID NO: 591396 - RNA, 14 nt, Homo sapiens
agaugguguaugcu

SEQ ID NO: 591397 - RNA, 20 nt, Homo sapiens
agaugguguaugcuguaucc

SEQ ID NO: 591398 - RNA, 21 nt, Homo sapiens
agaugguguaugcuguaucca

SEQ ID NO: 591399 - RNA, 18 nt, Homo sapiens
agauguacaaaacaguuu

SEQ ID NO: 591400 - RNA, 12 nt, Homo sapiens
agauguacugca

SEQ ID NO: 591401 - RNA, 21 nt, Homo sapiens
agauguagauaaacucagaaa

SEQ ID NO: 591402 - RNA, 15 nt, Homo sapiens
agauguagcauuguu

SEQ ID NO: 591403 - RNA, 18 nt, Homo sapiens
agauguauaaaucuuucu

SEQ ID NO: 591404 - RNA, 12 nt, Homo sapiens
agauguauuaaa

SEQ ID NO: 591405 - RNA, 19 nt, Homo sapiens
agauguauuugaacacuug

SEQ ID NO: 591406 - RNA, 12 nt, Homo sapiens
agaugucaaaac

SEQ ID NO: 591407 - RNA, 22 nt, Homo sapiens
agaugucaugaggaaacuacug

SEQ ID NO: 591408 - RNA, 17 nt, Homo sapiens
agauguccaaacuaauu

SEQ ID NO: 591409 - RNA, 18 nt, Homo sapiens
agaugucuuggaacauug

SEQ ID NO: 591410 - RNA, 16 nt, Homo sapiens
agaugugaaaacaucu

SEQ ID NO: 591411 - RNA, 18 nt, Homo sapiens
agaugugaaaacaucuca

SEQ ID NO: 591412 - RNA, 19 nt, Homo sapiens
agaugugaaaacaucucaa

SEQ ID NO: 591413 - RNA, 22 nt, Homo sapiens
agaugugaauuauugacacuga

SEQ ID NO: 591414 - RNA, 20 nt, Homo sapiens
agaugugaguccuguugaag

SEQ ID NO: 591415 - RNA, 17 nt, Homo sapiens
agaugugaucacugaga

SEQ ID NO: 591416 - RNA, 18 nt, Homo sapiens
agaugugaugaauuaucc

SEQ ID NO: 591417 - RNA, 18 nt, Homo sapiens
agauguggucaauggaag

SEQ ID NO: 591418 - RNA, 15 nt, Homo sapiens
agaugugucuuacca

SEQ ID NO: 591419 - RNA, 15 nt, Homo sapiens
agauguuacuaccuu

SEQ ID NO: 591420 - RNA, 19 nt, Homo sapiens
agauguuaguaguuucuca

SEQ ID NO: 591421 - RNA, 22 nt, Homo sapiens
agauguucauccuaacaugaca

SEQ ID NO: 591422 - RNA, 20 nt, Homo sapiens
agauguucgcucgugcagua

SEQ ID NO: 591423 - RNA, 16 nt, Homo sapiens
agauguugugugcaau

SEQ ID NO: 591424 - RNA, 16 nt, Homo sapiens
agauuaaacaaacaaa

SEQ ID NO: 591425 - RNA, 12 nt, Homo sapiens
agauuaacaaca

SEQ ID NO: 591426 - RNA, 12 nt, Homo sapiens
agauuacccaaa

SEQ ID NO: 591427 - RNA, 20 nt, Homo sapiens
agauuacugaaaaaugcaaa

SEQ ID NO: 591428 - RNA, 17 nt, Homo sapiens
agauuagagccuguaaa

SEQ ID NO: 591429 - RNA, 19 nt, Homo sapiens
agauuagucucuucugugu

SEQ ID NO: 591430 - RNA, 22 nt, Homo sapiens
agauuauagaaguagcaaaaag

SEQ ID NO: 591431 - RNA, 21 nt, Homo sapiens
agauuauugugacuucacugu

SEQ ID NO: 591432 - RNA, 21 nt, Homo sapiens
agauuauuucuguauuuggcu

SEQ ID NO: 591433 - RNA, 17 nt, Homo sapiens
agauucagguaauacaa

SEQ ID NO: 591434 - RNA, 22 nt, Homo sapiens
agauucagguauguugccuuua

SEQ ID NO: 591435 - RNA, 14 nt, Homo sapiens
agauucagugcaau

SEQ ID NO: 591436 - RNA, 13 nt, Homo sapiens
agauuccaaaaag

SEQ ID NO: 591437 - RNA, 19 nt, Homo sapiens
agauuccaaaaagcacaua

SEQ ID NO: 591438 - RNA, 12 nt, Homo sapiens
agauuccaccua

SEQ ID NO: 591439 - RNA, 21 nt, Homo sapiens
agauuccaggcgaugugcaag

SEQ ID NO: 591440 - RNA, 21 nt, Homo sapiens
agauucccacccaauucaaaa

SEQ ID NO: 591441 - RNA, 15 nt, Homo sapiens
agauucccacugccg

SEQ ID NO: 591442 - RNA, 18 nt, Homo sapiens
agauuccccugugucauc

SEQ ID NO: 591443 - RNA, 19 nt, Homo sapiens
agauuccuggcagagccau

SEQ ID NO: 591444 - RNA, 14 nt, Homo sapiens
agauucuaccacac

SEQ ID NO: 591445 - RNA, 19 nt, Homo sapiens
agauucuccacuuggccaa

SEQ ID NO: 591446 - RNA, 23 nt, Homo sapiens
agauucuggagcaaucugacccu

SEQ ID NO: 591447 - RNA, 20 nt, Homo sapiens
agauucuguuaacucuugaa

SEQ ID NO: 591448 - RNA, 19 nt, Homo sapiens
agauugcaccauugcgcuc

SEQ ID NO: 591449 - RNA, 20 nt, Homo sapiens
agauugcgccauugcacucc

SEQ ID NO: 591450 - RNA, 19 nt, Homo sapiens
agauugcuggaaaccaagu

SEQ ID NO: 591451 - RNA, 20 nt, Homo sapiens
agauuggaccagacccugaa

SEQ ID NO: 591452 - RNA, 15 nt, Homo sapiens
agauuggccagugag

SEQ ID NO: 591453 - RNA, 19 nt, Homo sapiens
agauuguccuuuucuccca

SEQ ID NO: 591454 - RNA, 23 nt, Homo sapiens
agauugugccacuucacuccagc

SEQ ID NO: 591455 - RNA, 16 nt, Homo sapiens
agauuguggggugcag

SEQ ID NO: 591456 - RNA, 19 nt, Homo sapiens
agauuguuuugccacuuag

SEQ ID NO: 591457 - RNA, 20 nt, Homo sapiens
agauuuaacaccccacaggc

SEQ ID NO: 591458 - RNA, 18 nt, Homo sapiens
agauuuacacugggagag

SEQ ID NO: 591459 - RNA, 22 nt, Homo sapiens
agauuuagaaaaaaguuuacaa

SEQ ID NO: 591460 - RNA, 21 nt, Homo sapiens
agauuuauuuuugaaacaaac

SEQ ID NO: 591461 - RNA, 15 nt, Homo sapiens
agauuucaugucacu

SEQ ID NO: 591462 - RNA, 16 nt, Homo sapiens
agauuucugucuacua

SEQ ID NO: 591463 - RNA, 18 nt, Homo sapiens
agauuugcuguucaccca

SEQ ID NO: 591464 - RNA, 23 nt, Homo sapiens
agauuuggaagcucuucuuccca

SEQ ID NO: 591465 - RNA, 18 nt, Homo sapiens
agauuuggcuugacaaag

SEQ ID NO: 591466 - RNA, 23 nt, Homo sapiens
agauuugggguauaggucucauc

SEQ ID NO: 591467 - RNA, 15 nt, Homo sapiens
agauuuuaugcugcu

SEQ ID NO: 591468 - RNA, 15 nt, Homo sapiens
agauuuucaaacaaa

SEQ ID NO: 591469 - RNA, 15 nt, Homo sapiens
agauuuucuuuugcc

SEQ ID NO: 591470 - RNA, 18 nt, Homo sapiens
agauuuucuuuugccuuu

SEQ ID NO: 591471 - RNA, 15 nt, Homo sapiens
agauuuuguugaccu

SEQ ID NO: 591472 - RNA, 15 nt, Homo sapiens
agauuuuuuccucug

SEQ ID NO: 591473 - RNA, 17 nt, Homo sapiens
agcaaaaaauaaugaca

SEQ ID NO: 591474 - RNA, 19 nt, Homo sapiens
agcaaaaacauguaugugc

SEQ ID NO: 591475 - RNA, 16 nt, Homo sapiens
agcaaaaaguauugaa

SEQ ID NO: 591476 - RNA, 16 nt, Homo sapiens
agcaaaaaugacaaca

SEQ ID NO: 591477 - RNA, 16 nt, Homo sapiens
agcaaaaauucacaaa

SEQ ID NO: 591478 - RNA, 19 nt, Homo sapiens
agcaaaacgacacugcgca

SEQ ID NO: 591479 - RNA, 18 nt, Homo sapiens
agcaaaacuccaucucaa

SEQ ID NO: 591480 - RNA, 13 nt, Homo sapiens
agcaaaaggcagc

SEQ ID NO: 591481 - RNA, 20 nt, Homo sapiens
agcaaaauacaugacauuua

SEQ ID NO: 591482 - RNA, 14 nt, Homo sapiens
agcaaaaugccaaa

SEQ ID NO: 591483 - RNA, 12 nt, Homo sapiens
agcaaaccauua

SEQ ID NO: 591484 - RNA, 16 nt, Homo sapiens
agcaaagauuaaaugu

SEQ ID NO: 591485 - RNA, 16 nt, Homo sapiens
agcaaagggaaugggu

SEQ ID NO: 591486 - RNA, 17 nt, Homo sapiens
agcaaaguuuuaccugu

SEQ ID NO: 591487 - RNA, 19 nt, Homo sapiens
agcaaauaaaugccuucca

SEQ ID NO: 591488 - RNA, 16 nt, Homo sapiens
agcaaauagaucaugc

SEQ ID NO: 591489 - RNA, 15 nt, Homo sapiens
agcaaauaggcaaaa

SEQ ID NO: 591490 - RNA, 16 nt, Homo sapiens
agcaaaucgugccuug

SEQ ID NO: 591491 - RNA, 17 nt, Homo sapiens
agcaaaucgugccuugu

SEQ ID NO: 591492 - RNA, 22 nt, Homo sapiens
agcaaaucuacuucaacacuuc

SEQ ID NO: 591493 - RNA, 14 nt, Homo sapiens
agcaaaucuaugag

SEQ ID NO: 591494 - RNA, 20 nt, Homo sapiens
agcaaauggcagaaccaaag

SEQ ID NO: 591495 - RNA, 14 nt, Homo sapiens
agcaaauggccuca

SEQ ID NO: 591496 - RNA, 20 nt, Homo sapiens
agcaaauguuucugcaguag

SEQ ID NO: 591497 - RNA, 16 nt, Homo sapiens
agcaaauuuucagcau

SEQ ID NO: 591498 - RNA, 15 nt, Homo sapiens
agcaacaagaccacc

SEQ ID NO: 591499 - RNA, 22 nt, Homo sapiens
agcaacaauaaauagacacgca

SEQ ID NO: 591500 - RNA, 12 nt, Homo sapiens
agcaacaaugac

SEQ ID NO: 591501 - RNA, 16 nt, Homo sapiens
agcaacagagcacuug

SEQ ID NO: 591502 - RNA, 15 nt, Homo sapiens
agcaacaggccauug

SEQ ID NO: 591503 - RNA, 23 nt, Homo sapiens
agcaacaggccauugugaaccaa

SEQ ID NO: 591504 - RNA, 13 nt, Homo sapiens
agcaacauuauuu

SEQ ID NO: 591505 - RNA, 23 nt, Homo sapiens
agcaacgccccuccaaaccucca

SEQ ID NO: 591506 - RNA, 16 nt, Homo sapiens
agcaacuaggaaaauc

SEQ ID NO: 591507 - RNA, 13 nt, Homo sapiens
agcaacucagaga

SEQ ID NO: 591508 - RNA, 17 nt, Homo sapiens
agcaacuccgugugccu

SEQ ID NO: 591509 - RNA, 19 nt, Homo sapiens
agcaacucugagaucuaag

SEQ ID NO: 591510 - RNA, 13 nt, Homo sapiens
agcaacucuggcc

SEQ ID NO: 591511 - RNA, 17 nt, Homo sapiens
agcaacugcccuuccag

SEQ ID NO: 591512 - RNA, 17 nt, Homo sapiens
agcaacuguuaugaaau

SEQ ID NO: 591513 - RNA, 20 nt, Homo sapiens
agcaacuucuucuccauccc

SEQ ID NO: 591514 - RNA, 20 nt, Homo sapiens
agcaagacauacuuaaugca

SEQ ID NO: 591515 - RNA, 14 nt, Homo sapiens
agcaagaccuggag

SEQ ID NO: 591516 - RNA, 22 nt, Homo sapiens
agcaagaucccauggguugugu

SEQ ID NO: 591517 - RNA, 18 nt, Homo sapiens
agcaagaugcaaaugcau

SEQ ID NO: 591518 - RNA, 15 nt, Homo sapiens
agcaagccagaccua

SEQ ID NO: 591519 - RNA, 13 nt, Homo sapiens
agcaaggagcaca

SEQ ID NO: 591520 - RNA, 17 nt, Homo sapiens
agcaaggccuuggugga

SEQ ID NO: 591521 - RNA, 17 nt, Homo sapiens
agcaagggacagugagg

SEQ ID NO: 591522 - RNA, 20 nt, Homo sapiens
agcaagggcaagaacccaag

SEQ ID NO: 591523 - RNA, 16 nt, Homo sapiens
agcaagggggcccaaa

SEQ ID NO: 591524 - RNA, 16 nt, Homo sapiens
agcaaggugcucuuga

SEQ ID NO: 591525 - RNA, 14 nt, Homo sapiens
agcaaggugguuua

SEQ ID NO: 591526 - RNA, 18 nt, Homo sapiens
agcaaguaagcuagccag

SEQ ID NO: 591527 - RNA, 16 nt, Homo sapiens
agcaagugugcacucc

SEQ ID NO: 591528 - RNA, 18 nt, Homo sapiens
agcaaguguucacugcuc

SEQ ID NO: 591529 - RNA, 15 nt, Homo sapiens
agcaaguuagaacua

SEQ ID NO: 591530 - RNA, 21 nt, Homo sapiens
agcaaguuugacacaaacuca

SEQ ID NO: 591531 - RNA, 16 nt, Homo sapiens
agcaaguuuucuucca

SEQ ID NO: 591532 - RNA, 15 nt, Homo sapiens
agcaauaaaaugcua

SEQ ID NO: 591533 - RNA, 16 nt, Homo sapiens
agcaauaacucucuac

SEQ ID NO: 591534 - RNA, 22 nt, Homo sapiens
agcaauauaucugaagagcuau

SEQ ID NO: 591535 - RNA, 16 nt, Homo sapiens
agcaauaugcauuuaa

SEQ ID NO: 591536 - RNA, 18 nt, Homo sapiens
agcaauccuccuaccuca

SEQ ID NO: 591537 - RNA, 18 nt, Homo sapiens
agcaaucucgcaguacau

SEQ ID NO: 591538 - RNA, 17 nt, Homo sapiens
agcaaugacaucucagg

SEQ ID NO: 591539 - RNA, 18 nt, Homo sapiens
agcaaugacaucucaggg

SEQ ID NO: 591540 - RNA, 20 nt, Homo sapiens
agcaaugcaagcagccuagc

SEQ ID NO: 591541 - RNA, 15 nt, Homo sapiens
agcaaugccauuuca

SEQ ID NO: 591542 - RNA, 17 nt, Homo sapiens
agcaauggcacuguugc

SEQ ID NO: 591543 - RNA, 14 nt, Homo sapiens
agcaauggccagag

SEQ ID NO: 591544 - RNA, 16 nt, Homo sapiens
agcaaugucugugcua

SEQ ID NO: 591545 - RNA, 13 nt, Homo sapiens
agcaaugugguag

SEQ ID NO: 591546 - RNA, 20 nt, Homo sapiens
agcaauugacugucacuguu

SEQ ID NO: 591547 - RNA, 24 nt, Homo sapiens
agcaauuucccccuaaaccaacug

SEQ ID NO: 591548 - RNA, 21 nt, Homo sapiens
agcaauuugaagagaaucuuu

SEQ ID NO: 591549 - RNA, 14 nt, Homo sapiens
agcacaaacauugc

SEQ ID NO: 591550 - RNA, 22 nt, Homo sapiens
agcacaagccacaagucuucca

SEQ ID NO: 591551 - RNA, 23 nt, Homo sapiens
agcacaaggagugcccgccuuga

SEQ ID NO: 591552 - RNA, 20 nt, Homo sapiens
agcacaaggccaucugggcu

SEQ ID NO: 591553 - RNA, 22 nt, Homo sapiens
agcacaauccuauuacucuucc

SEQ ID NO: 591554 - RNA, 13 nt, Homo sapiens
agcacagaauuug

SEQ ID NO: 591555 - RNA, 19 nt, Homo sapiens
agcacagauuuugaaucug

SEQ ID NO: 591556 - RNA, 17 nt, Homo sapiens
agcacagcacccauggg

SEQ ID NO: 591557 - RNA, 18 nt, Homo sapiens
agcacagcacccauggga

SEQ ID NO: 591558 - RNA, 14 nt, Homo sapiens
agcacagccucaga

SEQ ID NO: 591559 - RNA, 15 nt, Homo sapiens
agcacagcuccugcc

SEQ ID NO: 591560 - RNA, 16 nt, Homo sapiens
agcacagcuugaccug

SEQ ID NO: 591561 - RNA, 15 nt, Homo sapiens
agcacagugccugac

SEQ ID NO: 591562 - RNA, 12 nt, Homo sapiens
agcacagugugu

SEQ ID NO: 591563 - RNA, 22 nt, Homo sapiens
agcacauauggaauuuugcaaa

SEQ ID NO: 591564 - RNA, 16 nt, Homo sapiens
agcacaucaauuacaa

SEQ ID NO: 591565 - RNA, 12 nt, Homo sapiens
agcacaucucuc

SEQ ID NO: 591566 - RNA, 14 nt, Homo sapiens
agcacauuaccaau

SEQ ID NO: 591567 - RNA, 11 nt, Homo sapiens
agcacauucca

SEQ ID NO: 591568 - RNA, 14 nt, Homo sapiens
agcacauucgggac

SEQ ID NO: 591569 - RNA, 21 nt, Homo sapiens
agcacauuuuaaaagugccau

SEQ ID NO: 591570 - RNA, 17 nt, Homo sapiens
agcaccacagugaaucc

SEQ ID NO: 591571 - RNA, 13 nt, Homo sapiens
agcaccaccuaca

SEQ ID NO: 591572 - RNA, 18 nt, Homo sapiens
agcaccaggaaguguuua

SEQ ID NO: 591573 - RNA, 15 nt, Homo sapiens
agcacccaagccagg

SEQ ID NO: 591574 - RNA, 14 nt, Homo sapiens
agcaccccuugccg

SEQ ID NO: 591575 - RNA, 19 nt, Homo sapiens
agcacccugcccaccaaga

SEQ ID NO: 591576 - RNA, 21 nt, Homo sapiens
agcacccuucucggagaccca

SEQ ID NO: 591577 - RNA, 16 nt, Homo sapiens
agcaccgcuuaucccc

SEQ ID NO: 591578 - RNA, 21 nt, Homo sapiens
agcaccguucugugcacaaaa

SEQ ID NO: 591579 - RNA, 20 nt, Homo sapiens
agcaccuccccgcugggaag

SEQ ID NO: 591580 - RNA, 21 nt, Homo sapiens
agcaccugggccccacuggac

SEQ ID NO: 591581 - RNA, 18 nt, Homo sapiens
agcacgcggccuugucug

SEQ ID NO: 591582 - RNA, 17 nt, Homo sapiens
agcacggccaccucuca

SEQ ID NO: 591583 - RNA, 24 nt, Homo sapiens
agcacgugucucagacugcaugua

SEQ ID NO: 591584 - RNA, 17 nt, Homo sapiens
agcacuaaagcagugga

SEQ ID NO: 591585 - RNA, 23 nt, Homo sapiens
agcacuacauaaacugacuuuau

SEQ ID NO: 591586 - RNA, 14 nt, Homo sapiens
agcacucauuccuu

SEQ ID NO: 591587 - RNA, 23 nt, Homo sapiens
agcacuccccagagcugugccag

SEQ ID NO: 591588 - RNA, 18 nt, Homo sapiens
agcacucccgcugcacac

SEQ ID NO: 591589 - RNA, 18 nt, Homo sapiens
agcacugaaaauaguguu

SEQ ID NO: 591590 - RNA, 17 nt, Homo sapiens
agcacuggggagucuuu

SEQ ID NO: 591591 - RNA, 21 nt, Homo sapiens
agcacugguuucaagaauaug

SEQ ID NO: 591592 - RNA, 11 nt, Homo sapiens
agcacugugag

SEQ ID NO: 591593 - RNA, 21 nt, Homo sapiens
agcacuguuggagcuacugca

SEQ ID NO: 591594 - RNA, 15 nt, Homo sapiens
agcacuguuuauaca

SEQ ID NO: 591595 - RNA, 15 nt, Homo sapiens
agcacuugagaacca

SEQ ID NO: 591596 - RNA, 15 nt, Homo sapiens
agcacuuuaaccaau

SEQ ID NO: 591597 - RNA, 22 nt, Homo sapiens
agcacuuuaacccucucuuccc

SEQ ID NO: 591598 - RNA, 15 nt, Homo sapiens
agcacuuugccaugc

SEQ ID NO: 591599 - RNA, 23 nt, Homo sapiens
agcacuuugggaggccaaggugg

SEQ ID NO: 591600 - RNA, 21 nt, Homo sapiens
agcagaaaaaaaagugucuca

SEQ ID NO: 591601 - RNA, 22 nt, Homo sapiens
agcagaaaguaagcauuuccag

SEQ ID NO: 591602 - RNA, 21 nt, Homo sapiens
agcagaaauauagugcaauag

SEQ ID NO: 591603 - RNA, 14 nt, Homo sapiens
agcagaaaugccuu

SEQ ID NO: 591604 - RNA, 18 nt, Homo sapiens
agcagaacaaauguguuu

SEQ ID NO: 591605 - RNA, 21 nt, Homo sapiens
agcagaacucuugacuuccug

SEQ ID NO: 591606 - RNA, 20 nt, Homo sapiens
agcagaagcacauaugaacu

SEQ ID NO: 591607 - RNA, 14 nt, Homo sapiens
agcagaaggccauc

SEQ ID NO: 591608 - RNA, 17 nt, Homo sapiens
agcagacaaaaugaaag

SEQ ID NO: 591609 - RNA, 23 nt, Homo sapiens
agcagaccaccccgccugcccuc

SEQ ID NO: 591610 - RNA, 20 nt, Homo sapiens
agcagacccauaccuuucca

SEQ ID NO: 591611 - RNA, 18 nt, Homo sapiens
agcagacugaccaucucc

SEQ ID NO: 591612 - RNA, 21 nt, Homo sapiens
agcagacuggauuuuugcucu

SEQ ID NO: 591613 - RNA, 22 nt, Homo sapiens
agcagagaccuuccaaggacau

SEQ ID NO: 591614 - RNA, 24 nt, Homo sapiens
agcagagcuggcacccugucauca

SEQ ID NO: 591615 - RNA, 22 nt, Homo sapiens
agcagaugacaaaaaggugcag

SEQ ID NO: 591616 - RNA, 15 nt, Homo sapiens
agcagaugccaguga

SEQ ID NO: 591617 - RNA, 18 nt, Homo sapiens
agcagauuaccucuugcc

SEQ ID NO: 591618 - RNA, 13 nt, Homo sapiens
agcagauuugcac

SEQ ID NO: 591619 - RNA, 15 nt, Homo sapiens
agcagauuugcacug

SEQ ID NO: 591620 - RNA, 17 nt, Homo sapiens
agcagcaaaaacuacau

SEQ ID NO: 591621 - RNA, 14 nt, Homo sapiens
agcagcagagguga

SEQ ID NO: 591622 - RNA, 15 nt, Homo sapiens
agcagcaucuucaaa

SEQ ID NO: 591623 - RNA, 18 nt, Homo sapiens
agcagccacaaccaaaaa

SEQ ID NO: 591624 - RNA, 18 nt, Homo sapiens
agcagccagagcugugcc

SEQ ID NO: 591625 - RNA, 18 nt, Homo sapiens
agcagcccuaaggaucuc

SEQ ID NO: 591626 - RNA, 22 nt, Homo sapiens
agcagcccuacaacaaccugaa

SEQ ID NO: 591627 - RNA, 23 nt, Homo sapiens
agcagccugccaagaauuuuauu

SEQ ID NO: 591628 - RNA, 16 nt, Homo sapiens
agcagcgguaccccag

SEQ ID NO: 591629 - RNA, 13 nt, Homo sapiens
agcagcucaagaa

SEQ ID NO: 591630 - RNA, 15 nt, Homo sapiens
agcagcucugugacu

SEQ ID NO: 591631 - RNA, 20 nt, Homo sapiens
agcagcugucagaacacucc

SEQ ID NO: 591632 - RNA, 21 nt, Homo sapiens
agcagcuucuuuugucuccca

SEQ ID NO: 591633 - RNA, 19 nt, Homo sapiens
agcagcuuuaaacucaggg

SEQ ID NO: 591634 - RNA, 17 nt, Homo sapiens
agcaggaccugugcuuu

SEQ ID NO: 591635 - RNA, 19 nt, Homo sapiens
agcaggacuuugaggcaag

SEQ ID NO: 591636 - RNA, 18 nt, Homo sapiens
agcaggagagacugagca

SEQ ID NO: 591637 - RNA, 15 nt, Homo sapiens
agcaggaggccaaua

SEQ ID NO: 591638 - RNA, 23 nt, Homo sapiens
agcaggaggccaauaaaaaguuc

SEQ ID NO: 591639 - RNA, 14 nt, Homo sapiens
agcaggaguggugc

SEQ ID NO: 591640 - RNA, 15 nt, Homo sapiens
agcaggaguggugca

SEQ ID NO: 591641 - RNA, 14 nt, Homo sapiens
agcaggcacgggug

SEQ ID NO: 591642 - RNA, 18 nt, Homo sapiens
agcaggcagaacucuccu

SEQ ID NO: 591643 - RNA, 20 nt, Homo sapiens
agcaggcccagcaugcaggu

SEQ ID NO: 591644 - RNA, 18 nt, Homo sapiens
agcaggccuaagacaugu

SEQ ID NO: 591645 - RNA, 20 nt, Homo sapiens
agcaggcuggcagcucucca

SEQ ID NO: 591646 - RNA, 14 nt, Homo sapiens
agcagggacuguaa

SEQ ID NO: 591647 - RNA, 14 nt, Homo sapiens
agcagggaugaagg

SEQ ID NO: 591648 - RNA, 19 nt, Homo sapiens
agcagggauuaaccucugc

SEQ ID NO: 591649 - RNA, 19 nt, Homo sapiens
agcagggauuagguguuca

SEQ ID NO: 591650 - RNA, 22 nt, Homo sapiens
agcagggcgaggaccaauaauu

SEQ ID NO: 591651 - RNA, 12 nt, Homo sapiens
agcaggggagcu

SEQ ID NO: 591652 - RNA, 19 nt, Homo sapiens
agcaggggcuccagcaccu

SEQ ID NO: 591653 - RNA, 14 nt, Homo sapiens
agcaggugaccucc

SEQ ID NO: 591654 - RNA, 16 nt, Homo sapiens
agcagguggcaucucu

SEQ ID NO: 591655 - RNA, 13 nt, Homo sapiens
agcagguggcuug

SEQ ID NO: 591656 - RNA, 16 nt, Homo sapiens
agcaguaaauuugcua

SEQ ID NO: 591657 - RNA, 23 nt, Homo sapiens
agcaguaguuuguuguagguuuc

SEQ ID NO: 591658 - RNA, 12 nt, Homo sapiens
agcagucagggu

SEQ ID NO: 591659 - RNA, 18 nt, Homo sapiens
agcaguccuucagaauua

SEQ ID NO: 591660 - RNA, 16 nt, Homo sapiens
agcagugaugaaaaug

SEQ ID NO: 591661 - RNA, 17 nt, Homo sapiens
agcagugccagcuuucu

SEQ ID NO: 591662 - RNA, 12 nt, Homo sapiens
agcagugccuug

SEQ ID NO: 591663 - RNA, 22 nt, Homo sapiens
agcaguggcuggugcccaugaa

SEQ ID NO: 591664 - RNA, 14 nt, Homo sapiens
agcagugucuguca

SEQ ID NO: 591665 - RNA, 22 nt, Homo sapiens
agcagugugaccuccugugacc

SEQ ID NO: 591666 - RNA, 22 nt, Homo sapiens
agcaguuacaaaaaccuucccc

SEQ ID NO: 591667 - RNA, 14 nt, Homo sapiens
agcaguucagcucc

SEQ ID NO: 591668 - RNA, 19 nt, Homo sapiens
agcaguuggccaagcagaa

SEQ ID NO: 591669 - RNA, 22 nt, Homo sapiens
agcaguuggggcccucuugcca

SEQ ID NO: 591670 - RNA, 14 nt, Homo sapiens
agcaguugugucag

SEQ ID NO: 591671 - RNA, 13 nt, Homo sapiens
agcauaacagcca

SEQ ID NO: 591672 - RNA, 21 nt, Homo sapiens
agcauaaugcucccaucuccu

SEQ ID NO: 591673 - RNA, 20 nt, Homo sapiens
agcauacccuuacucugcca

SEQ ID NO: 591674 - RNA, 21 nt, Homo sapiens
agcauacgguaugauauugca

SEQ ID NO: 591675 - RNA, 13 nt, Homo sapiens
agcauacuucaaa

SEQ ID NO: 591676 - RNA, 12 nt, Homo sapiens
agcauacuuugu

SEQ ID NO: 591677 - RNA, 16 nt, Homo sapiens
agcauagccagcauuc

SEQ ID NO: 591678 - RNA, 20 nt, Homo sapiens
agcauaggaggggucuggac

SEQ ID NO: 591679 - RNA, 20 nt, Homo sapiens
agcauaggcucuuuuugcug

SEQ ID NO: 591680 - RNA, 14 nt, Homo sapiens
agcaucaagccacu

SEQ ID NO: 591681 - RNA, 16 nt, Homo sapiens
agcaucaccucaggcc

SEQ ID NO: 591682 - RNA, 15 nt, Homo sapiens
agcaucagggggaag

SEQ ID NO: 591683 - RNA, 18 nt, Homo sapiens
agcauccucucucacaug

SEQ ID NO: 591684 - RNA, 19 nt, Homo sapiens
agcauccugcaaggugaaa

SEQ ID NO: 591685 - RNA, 19 nt, Homo sapiens
agcaucgggagcacccaga

SEQ ID NO: 591686 - RNA, 15 nt, Homo sapiens
agcaucucaggagau

SEQ ID NO: 591687 - RNA, 18 nt, Homo sapiens
agcaucucccagcaagac

SEQ ID NO: 591688 - RNA, 19 nt, Homo sapiens
agcaucugacucacaagaa

SEQ ID NO: 591689 - RNA, 14 nt, Homo sapiens
agcaucugcaacaa

SEQ ID NO: 591690 - RNA, 15 nt, Homo sapiens
agcaucuguuuaccu

SEQ ID NO: 591691 - RNA, 22 nt, Homo sapiens
agcaucuucacuucuaaaugca

SEQ ID NO: 591692 - RNA, 22 nt, Homo sapiens
agcaugaaauguccucuugaag

SEQ ID NO: 591693 - RNA, 20 nt, Homo sapiens
agcaugaaccuuguuuaaau

SEQ ID NO: 591694 - RNA, 10 nt, Homo sapiens
agcaugaacu

SEQ ID NO: 591695 - RNA, 17 nt, Homo sapiens
agcaugaagacccugga

SEQ ID NO: 591696 - RNA, 23 nt, Homo sapiens
agcaugaauaacauuuaaauucc

SEQ ID NO: 591697 - RNA, 16 nt, Homo sapiens
agcaugaauccagucc

SEQ ID NO: 591698 - RNA, 15 nt, Homo sapiens
agcaugacauacuuu

SEQ ID NO: 591699 - RNA, 17 nt, Homo sapiens
agcaugaggacagacca

SEQ ID NO: 591700 - RNA, 11 nt, Homo sapiens
agcaugaucuu

SEQ ID NO: 591701 - RNA, 15 nt, Homo sapiens
agcaugcagguggug

SEQ ID NO: 591702 - RNA, 11 nt, Homo sapiens
agcauggaaaa

SEQ ID NO: 591703 - RNA, 16 nt, Homo sapiens
agcauggacucugggu

SEQ ID NO: 591704 - RNA, 15 nt, Homo sapiens
agcauguacuccccu

SEQ ID NO: 591705 - RNA, 12 nt, Homo sapiens
agcaugugccaa

SEQ ID NO: 591706 - RNA, 16 nt, Homo sapiens
agcauuaacugucuua

SEQ ID NO: 591707 - RNA, 14 nt, Homo sapiens
agcauuacaguauu

SEQ ID NO: 591708 - RNA, 16 nt, Homo sapiens
agcauuacaguauuuu

SEQ ID NO: 591709 - RNA, 23 nt, Homo sapiens
agcauuacccuccucucucccca

SEQ ID NO: 591710 - RNA, 20 nt, Homo sapiens
agcauuagcuggcgcauauu

SEQ ID NO: 591711 - RNA, 21 nt, Homo sapiens
agcauuaguuguuauuauuaa

SEQ ID NO: 591712 - RNA, 20 nt, Homo sapiens
agcauuuaagagugaaguca

SEQ ID NO: 591713 - RNA, 18 nt, Homo sapiens
agcauuuaggaaugugac

SEQ ID NO: 591714 - RNA, 17 nt, Homo sapiens
agcauuucaaaauggac

SEQ ID NO: 591715 - RNA, 18 nt, Homo sapiens
agcauuuccaacaccaca

SEQ ID NO: 591716 - RNA, 22 nt, Homo sapiens
agcauuuccaacaccacagaca

SEQ ID NO: 591717 - RNA, 23 nt, Homo sapiens
agcauuuccaacaccacagacac

SEQ ID NO: 591718 - RNA, 17 nt, Homo sapiens
agcauuuccacaccaag

SEQ ID NO: 591719 - RNA, 16 nt, Homo sapiens
agcauuucuagcagug

SEQ ID NO: 591720 - RNA, 18 nt, Homo sapiens
agcauuucuagcagugau

SEQ ID NO: 591721 - RNA, 22 nt, Homo sapiens
agcauuucuagcagugaugaaa

SEQ ID NO: 591722 - RNA, 23 nt, Homo sapiens
agcauuucugauacuuucuguca

SEQ ID NO: 591723 - RNA, 19 nt, Homo sapiens
agcauuucuugauguugcu

SEQ ID NO: 591724 - RNA, 19 nt, Homo sapiens
agcauuucuuuucuggcca

SEQ ID NO: 591725 - RNA, 20 nt, Homo sapiens
agcauuugaaaggugugcua

SEQ ID NO: 591726 - RNA, 17 nt, Homo sapiens
agcauuugaguuugcaa

SEQ ID NO: 591727 - RNA, 14 nt, Homo sapiens
agcauuugcaccuc

SEQ ID NO: 591728 - RNA, 18 nt, Homo sapiens
agcauuuucaaugauguu

SEQ ID NO: 591729 - RNA, 23 nt, Homo sapiens
agcauuuugaaacaaaguacucu

SEQ ID NO: 591730 - RNA, 18 nt, Homo sapiens
agccaaaacugagcauaa

SEQ ID NO: 591731 - RNA, 16 nt, Homo sapiens
agccaaacucugccag

SEQ ID NO: 591732 - RNA, 21 nt, Homo sapiens
agccaaacucugccagccaca

SEQ ID NO: 591733 - RNA, 18 nt, Homo sapiens
agccaaagauaaucucuc

SEQ ID NO: 591734 - RNA, 19 nt, Homo sapiens
agccaaagauaaucucuca

SEQ ID NO: 591735 - RNA, 22 nt, Homo sapiens
agccaaagggacuggcagucug

SEQ ID NO: 591736 - RNA, 23 nt, Homo sapiens
agccaaauaaaaucuauacauac

SEQ ID NO: 591737 - RNA, 15 nt, Homo sapiens
agccaaaugcaggga

SEQ ID NO: 591738 - RNA, 17 nt, Homo sapiens
agccaacacccugucua

SEQ ID NO: 591739 - RNA, 20 nt, Homo sapiens
agccaacacccugucuaaaa

SEQ ID NO: 591740 - RNA, 16 nt, Homo sapiens
agccaacuuuaauugc

SEQ ID NO: 591741 - RNA, 14 nt, Homo sapiens
agccaacuuuugca

SEQ ID NO: 591742 - RNA, 23 nt, Homo sapiens
agccaagaagaauuuauuacaaa

SEQ ID NO: 591743 - RNA, 20 nt, Homo sapiens
agccaagaucgcgccacugc

SEQ ID NO: 591744 - RNA, 22 nt, Homo sapiens
agccaaggauagaagcugcagu

SEQ ID NO: 591745 - RNA, 16 nt, Homo sapiens
agccaaggucaugcca

SEQ ID NO: 591746 - RNA, 19 nt, Homo sapiens
agccaaggucaugccacug

SEQ ID NO: 591747 - RNA, 18 nt, Homo sapiens
agccaagugcccucucug

SEQ ID NO: 591748 - RNA, 21 nt, Homo sapiens
agccaaguuuuauaauccuua

SEQ ID NO: 591749 - RNA, 14 nt, Homo sapiens
agccaaucugcaau

SEQ ID NO: 591750 - RNA, 17 nt, Homo sapiens
agccaauucacaaguua

SEQ ID NO: 591751 - RNA, 14 nt, Homo sapiens
agccacaacugcca

SEQ ID NO: 591752 - RNA, 16 nt, Homo sapiens
agccacaagucuucca

SEQ ID NO: 591753 - RNA, 19 nt, Homo sapiens
agccacacaaacguuuacu

SEQ ID NO: 591754 - RNA, 19 nt, Homo sapiens
agccacagcagguccucca

SEQ ID NO: 591755 - RNA, 19 nt, Homo sapiens
agccacagcuucuucaucu

SEQ ID NO: 591756 - RNA, 23 nt, Homo sapiens
agccacaggacugagcccucuca

SEQ ID NO: 591757 - RNA, 16 nt, Homo sapiens
agccacaguggccaaa

SEQ ID NO: 591758 - RNA, 23 nt, Homo sapiens
agccaccacaucccuucauauca

SEQ ID NO: 591759 - RNA, 15 nt, Homo sapiens
agccaccacauuuag

SEQ ID NO: 591760 - RNA, 18 nt, Homo sapiens
agccacccaagccugcug

SEQ ID NO: 591761 - RNA, 14 nt, Homo sapiens
agccaccgcugcca

SEQ ID NO: 591762 - RNA, 21 nt, Homo sapiens
agccacucggggcaggccagc

SEQ ID NO: 591763 - RNA, 16 nt, Homo sapiens
agccacuguaugauuc

SEQ ID NO: 591764 - RNA, 23 nt, Homo sapiens
agccacuguaugauucucuuaau

SEQ ID NO: 591765 - RNA, 16 nt, Homo sapiens
agccagaagucacauu

SEQ ID NO: 591766 - RNA, 13 nt, Homo sapiens
agccagacccaga

SEQ ID NO: 591767 - RNA, 16 nt, Homo sapiens
agccagaggcaucuga

SEQ ID NO: 591768 - RNA, 19 nt, Homo sapiens
agccagaggcucuaaugua

SEQ ID NO: 591769 - RNA, 18 nt, Homo sapiens
agccagaggguagggcac

SEQ ID NO: 591770 - RNA, 22 nt, Homo sapiens
agccagaugugaaaacaucuca

SEQ ID NO: 591771 - RNA, 19 nt, Homo sapiens
agccagcagccagcucuca

SEQ ID NO: 591772 - RNA, 12 nt, Homo sapiens
agccagccugac

SEQ ID NO: 591773 - RNA, 18 nt, Homo sapiens
agccagccugaccuuccu

SEQ ID NO: 591774 - RNA, 16 nt, Homo sapiens
agccagcucugcauua

SEQ ID NO: 591775 - RNA, 18 nt, Homo sapiens
agccagcuuaaacccaua

SEQ ID NO: 591776 - RNA, 13 nt, Homo sapiens
agccaggagcaaa

SEQ ID NO: 591777 - RNA, 16 nt, Homo sapiens
agccaggagcucucca

SEQ ID NO: 591778 - RNA, 19 nt, Homo sapiens
agccaggcaugguggcaca

SEQ ID NO: 591779 - RNA, 18 nt, Homo sapiens
agccaggccaacagcacc

SEQ ID NO: 591780 - RNA, 17 nt, Homo sapiens
agccaggccugaccuca

SEQ ID NO: 591781 - RNA, 21 nt, Homo sapiens
agccaggcuaugguugccacc

SEQ ID NO: 591782 - RNA, 21 nt, Homo sapiens
agccaggcucucugcugccca

SEQ ID NO: 591783 - RNA, 19 nt, Homo sapiens
agccaggcugcuaaccugg

SEQ ID NO: 591784 - RNA, 20 nt, Homo sapiens
agccagggcccagagcccuu

SEQ ID NO: 591785 - RNA, 21 nt, Homo sapiens
agccaggguggucuugaucuc

SEQ ID NO: 591786 - RNA, 23 nt, Homo sapiens
agccagguucccaggaggccuca

SEQ ID NO: 591787 - RNA, 15 nt, Homo sapiens
agccaguacagagaa

SEQ ID NO: 591788 - RNA, 18 nt, Homo sapiens
agccagugaggaugacag

SEQ ID NO: 591789 - RNA, 17 nt, Homo sapiens
agccagugccauuccac

SEQ ID NO: 591790 - RNA, 22 nt, Homo sapiens
agccaguuggcuucuaagccaa

SEQ ID NO: 591791 - RNA, 14 nt, Homo sapiens
agccauaacuugaa

SEQ ID NO: 591792 - RNA, 23 nt, Homo sapiens
agccauaagaaagcacuauuaau

SEQ ID NO: 591793 - RNA, 23 nt, Homo sapiens
agccauaguggagagaacugaau

SEQ ID NO: 591794 - RNA, 20 nt, Homo sapiens
agccauaguggaucacucac

SEQ ID NO: 591795 - RNA, 13 nt, Homo sapiens
agccauaugaaug

SEQ ID NO: 591796 - RNA, 17 nt, Homo sapiens
agccauauguacauaau

SEQ ID NO: 591797 - RNA, 23 nt, Homo sapiens
agccaucaaauagugaauggucu

SEQ ID NO: 591798 - RNA, 19 nt, Homo sapiens
agccaucaagagacugagu

SEQ ID NO: 591799 - RNA, 20 nt, Homo sapiens
agccaucaagagacugaguc

SEQ ID NO: 591800 - RNA, 14 nt, Homo sapiens
agccaucacccuca

SEQ ID NO: 591801 - RNA, 19 nt, Homo sapiens
agccaucccauuggcaaaa

SEQ ID NO: 591802 - RNA, 16 nt, Homo sapiens
agccaucccgcuuagc

SEQ ID NO: 591803 - RNA, 17 nt, Homo sapiens
agccaucguccugggac

SEQ ID NO: 591804 - RNA, 21 nt, Homo sapiens
agccaucuaaugcuuguuuau

SEQ ID NO: 591805 - RNA, 14 nt, Homo sapiens
agccaucucagguu

SEQ ID NO: 591806 - RNA, 15 nt, Homo sapiens
agccaucuugaucug

SEQ ID NO: 591807 - RNA, 16 nt, Homo sapiens
agccaugaucaugcca

SEQ ID NO: 591808 - RNA, 17 nt, Homo sapiens
agccauggaaggugcca

SEQ ID NO: 591809 - RNA, 22 nt, Homo sapiens
agccaugggaaccucauaugca

SEQ ID NO: 591810 - RNA, 11 nt, Homo sapiens
agccaugggcc

SEQ ID NO: 591811 - RNA, 20 nt, Homo sapiens
agccauguaaucagauuuau

SEQ ID NO: 591812 - RNA, 20 nt, Homo sapiens
agccauguuaaaugacuuga

SEQ ID NO: 591813 - RNA, 12 nt, Homo sapiens
agccauuccaaa

SEQ ID NO: 591814 - RNA, 21 nt, Homo sapiens
agccauugaacagcugugagc

SEQ ID NO: 591815 - RNA, 15 nt, Homo sapiens
agccauuuagggcag

SEQ ID NO: 591816 - RNA, 22 nt, Homo sapiens
agcccaaaggggacaggccuca

SEQ ID NO: 591817 - RNA, 18 nt, Homo sapiens
agcccaagggcuccagac

SEQ ID NO: 591818 - RNA, 20 nt, Homo sapiens
agcccaaucugccagacuua

SEQ ID NO: 591819 - RNA, 17 nt, Homo sapiens
agcccaauguaaugcau

SEQ ID NO: 591820 - RNA, 17 nt, Homo sapiens
agcccaauuaauuccug

SEQ ID NO: 591821 - RNA, 13 nt, Homo sapiens
agcccacaaagcc

SEQ ID NO: 591822 - RNA, 23 nt, Homo sapiens
agcccacauuggauucaucagca

SEQ ID NO: 591823 - RNA, 16 nt, Homo sapiens
agcccaccagacguca

SEQ ID NO: 591824 - RNA, 17 nt, Homo sapiens
agcccacucccugccua

SEQ ID NO: 591825 - RNA, 18 nt, Homo sapiens
agcccacucccugccuac

SEQ ID NO: 591826 - RNA, 14 nt, Homo sapiens
agcccagaaccaca

SEQ ID NO: 591827 - RNA, 18 nt, Homo sapiens
agcccagacucugagcug

SEQ ID NO: 591828 - RNA, 19 nt, Homo sapiens
agcccagacucugagcugc

SEQ ID NO: 591829 - RNA, 15 nt, Homo sapiens
agcccagccugggag

SEQ ID NO: 591830 - RNA, 17 nt, Homo sapiens
agcccagcuacauuccu

SEQ ID NO: 591831 - RNA, 19 nt, Homo sapiens
agcccagcugggucaggca

SEQ ID NO: 591832 - RNA, 17 nt, Homo sapiens
agcccagcuugccaaug

SEQ ID NO: 591833 - RNA, 22 nt, Homo sapiens
agcccagggcuccugcacuuac

SEQ ID NO: 591834 - RNA, 18 nt, Homo sapiens
agcccagucgagaccuca

SEQ ID NO: 591835 - RNA, 14 nt, Homo sapiens
agcccagugcacug

SEQ ID NO: 591836 - RNA, 17 nt, Homo sapiens
agcccagugcacugaaa

SEQ ID NO: 591837 - RNA, 21 nt, Homo sapiens
agcccauaaagucugagaaau

SEQ ID NO: 591838 - RNA, 23 nt, Homo sapiens
agcccauaaagucugagaaauag

SEQ ID NO: 591839 - RNA, 17 nt, Homo sapiens
agcccauaucacuaaga

SEQ ID NO: 591840 - RNA, 15 nt, Homo sapiens
agcccaucucaacaa

SEQ ID NO: 591841 - RNA, 21 nt, Homo sapiens
agcccauggcccccaauaaag

SEQ ID NO: 591842 - RNA, 14 nt, Homo sapiens
agcccauggcuuua

SEQ ID NO: 591843 - RNA, 18 nt, Homo sapiens
agcccauugcugccaagg

SEQ ID NO: 591844 - RNA, 14 nt, Homo sapiens
agccccaccaaugg

SEQ ID NO: 591845 - RNA, 20 nt, Homo sapiens
agccccacccugcagaguau

SEQ ID NO: 591846 - RNA, 14 nt, Homo sapiens
agccccacuugaag

SEQ ID NO: 591847 - RNA, 16 nt, Homo sapiens
agccccagcaccucau

SEQ ID NO: 591848 - RNA, 16 nt, Homo sapiens
agccccaggggacaag

SEQ ID NO: 591849 - RNA, 16 nt, Homo sapiens
agccccagucuuccuu

SEQ ID NO: 591850 - RNA, 20 nt, Homo sapiens
agcccccccaacacugugcc

SEQ ID NO: 591851 - RNA, 14 nt, Homo sapiens
agcccccucuuccu

SEQ ID NO: 591852 - RNA, 18 nt, Homo sapiens
agccccgccccguuguga

SEQ ID NO: 591853 - RNA, 17 nt, Homo sapiens
agccccuagaaacccaa

SEQ ID NO: 591854 - RNA, 18 nt, Homo sapiens
agccccuagaaacccaag

SEQ ID NO: 591855 - RNA, 18 nt, Homo sapiens
agccccucaauccuauca

SEQ ID NO: 591856 - RNA, 22 nt, Homo sapiens
agccccucuucccuuccuccau

SEQ ID NO: 591857 - RNA, 16 nt, Homo sapiens
agccccugaaagccau

SEQ ID NO: 591858 - RNA, 23 nt, Homo sapiens
agccccugaccccugucuguccc

SEQ ID NO: 591859 - RNA, 19 nt, Homo sapiens
agccccuuccucugccagg

SEQ ID NO: 591860 - RNA, 15 nt, Homo sapiens
agcccgacagugcca

SEQ ID NO: 591861 - RNA, 14 nt, Homo sapiens
agcccgagcagggu

SEQ ID NO: 591862 - RNA, 18 nt, Homo sapiens
agcccgcagcacauuucc

SEQ ID NO: 591863 - RNA, 15 nt, Homo sapiens
agcccggcacuccag

SEQ ID NO: 591864 - RNA, 23 nt, Homo sapiens
agcccguccuccucuaccucucu

SEQ ID NO: 591865 - RNA, 13 nt, Homo sapiens
agcccucaucccg

SEQ ID NO: 591866 - RNA, 14 nt, Homo sapiens
agcccucauuuuua

SEQ ID NO: 591867 - RNA, 22 nt, Homo sapiens
agcccucauuuuuauaaccugg

SEQ ID NO: 591868 - RNA, 17 nt, Homo sapiens
agcccuccuuaucaaag

SEQ ID NO: 591869 - RNA, 20 nt, Homo sapiens
agcccucgucuagagcagac

SEQ ID NO: 591870 - RNA, 13 nt, Homo sapiens
agcccucuugccc

SEQ ID NO: 591871 - RNA, 15 nt, Homo sapiens
agcccugaggugaaa

SEQ ID NO: 591872 - RNA, 18 nt, Homo sapiens
agcccugauguguccuca

SEQ ID NO: 591873 - RNA, 12 nt, Homo sapiens
agcccugcauuu

SEQ ID NO: 591874 - RNA, 20 nt, Homo sapiens
agcccugcucccagacauaa

SEQ ID NO: 591875 - RNA, 18 nt, Homo sapiens
agcccugcuuaccagaua

SEQ ID NO: 591876 - RNA, 19 nt, Homo sapiens
agcccugguaaaagggaua

SEQ ID NO: 591877 - RNA, 18 nt, Homo sapiens
agcccugucgagacacuu

SEQ ID NO: 591878 - RNA, 14 nt, Homo sapiens
agcccugucugcua

SEQ ID NO: 591879 - RNA, 14 nt, Homo sapiens
agcccuguguccug

SEQ ID NO: 591880 - RNA, 15 nt, Homo sapiens
agcccuguugacaca

SEQ ID NO: 591881 - RNA, 22 nt, Homo sapiens
agcccuuauggccaauaacuuu

SEQ ID NO: 591882 - RNA, 17 nt, Homo sapiens
agcccuuauguuuaauc

SEQ ID NO: 591883 - RNA, 23 nt, Homo sapiens
agcccuugagucugucacacucu

SEQ ID NO: 591884 - RNA, 21 nt, Homo sapiens
agcccuuuuguugagccaggc

SEQ ID NO: 591885 - RNA, 15 nt, Homo sapiens
agccgaaaagcuuuu

SEQ ID NO: 591886 - RNA, 13 nt, Homo sapiens
agccgaccucagc

SEQ ID NO: 591887 - RNA, 13 nt, Homo sapiens
agccgacucuggc

SEQ ID NO: 591888 - RNA, 20 nt, Homo sapiens
agccgagaucacaccacugu

SEQ ID NO: 591889 - RNA, 21 nt, Homo sapiens
agccgagaucgcgccacugca

SEQ ID NO: 591890 - RNA, 15 nt, Homo sapiens
agccgccauugccac

SEQ ID NO: 591891 - RNA, 12 nt, Homo sapiens
agccgcccugag

SEQ ID NO: 591892 - RNA, 16 nt, Homo sapiens
agccgcugcacaucac

SEQ ID NO: 591893 - RNA, 14 nt, Homo sapiens
agccggcacagggu

SEQ ID NO: 591894 - RNA, 15 nt, Homo sapiens
agccggccacuuugg

SEQ ID NO: 591895 - RNA, 17 nt, Homo sapiens
agccgggcaugguggca

SEQ ID NO: 591896 - RNA, 19 nt, Homo sapiens
agccgggguguaacuuccu

SEQ ID NO: 591897 - RNA, 15 nt, Homo sapiens
agccgguaacugucc

SEQ ID NO: 591898 - RNA, 20 nt, Homo sapiens
agccgguggugcccgugccc

SEQ ID NO: 591899 - RNA, 21 nt, Homo sapiens
agccguacuuugcuaacugug

SEQ ID NO: 591900 - RNA, 14 nt, Homo sapiens
agccgugaugcuca

SEQ ID NO: 591901 - RNA, 15 nt, Homo sapiens
agccguuuuccucau

SEQ ID NO: 591902 - RNA, 20 nt, Homo sapiens
agccuaaaagugggcuugau

SEQ ID NO: 591903 - RNA, 14 nt, Homo sapiens
agccuaaaauuacu

SEQ ID NO: 591904 - RNA, 19 nt, Homo sapiens
agccuaacaugauuauuug

SEQ ID NO: 591905 - RNA, 21 nt, Homo sapiens
agccuaauaacgugaaacuua

SEQ ID NO: 591906 - RNA, 22 nt, Homo sapiens
agccuaaugagagugcacugcu

SEQ ID NO: 591907 - RNA, 16 nt, Homo sapiens
agccuaccaauguaga

SEQ ID NO: 591908 - RNA, 17 nt, Homo sapiens
agccuagcccuucucuc

SEQ ID NO: 591909 - RNA, 18 nt, Homo sapiens
agccuagccgaccucagc

SEQ ID NO: 591910 - RNA, 16 nt, Homo sapiens
agccuagcggagccca

SEQ ID NO: 591911 - RNA, 14 nt, Homo sapiens
agccuauaguaaau

SEQ ID NO: 591912 - RNA, 19 nt, Homo sapiens
agccuaugauauuccccau

SEQ ID NO: 591913 - RNA, 20 nt, Homo sapiens
agccuauuugaacuacuuaa

SEQ ID NO: 591914 - RNA, 16 nt, Homo sapiens
agccucaagaugaagg

SEQ ID NO: 591915 - RNA, 12 nt, Homo sapiens
agccucaagucu

SEQ ID NO: 591916 - RNA, 18 nt, Homo sapiens
agccucacggagggccgu

SEQ ID NO: 591917 - RNA, 22 nt, Homo sapiens
agccucacguauuucacagagc

SEQ ID NO: 591918 - RNA, 13 nt, Homo sapiens
agccucagaaagg

SEQ ID NO: 591919 - RNA, 21 nt, Homo sapiens
agccucagaaagggauugcuu

SEQ ID NO: 591920 - RNA, 15 nt, Homo sapiens
agccucagugccacu

SEQ ID NO: 591921 - RNA, 14 nt, Homo sapiens
agccuccaguugua

SEQ ID NO: 591922 - RNA, 14 nt, Homo sapiens
agccucccaaagug

SEQ ID NO: 591923 - RNA, 17 nt, Homo sapiens
agccucccaaguagcua

SEQ ID NO: 591924 - RNA, 15 nt, Homo sapiens
agccuccccgugcca

SEQ ID NO: 591925 - RNA, 20 nt, Homo sapiens
agccuccccgugccaaaaau

SEQ ID NO: 591926 - RNA, 17 nt, Homo sapiens
agccucccgaguagcug

SEQ ID NO: 591927 - RNA, 18 nt, Homo sapiens
agccucccugcagccacc

SEQ ID NO: 591928 - RNA, 18 nt, Homo sapiens
agccuccggcggggaccc

SEQ ID NO: 591929 - RNA, 14 nt, Homo sapiens
agccuccucagggg

SEQ ID NO: 591930 - RNA, 15 nt, Homo sapiens
agccuccucucccua

SEQ ID NO: 591931 - RNA, 19 nt, Homo sapiens
agccuccuuuugcuugaaa

SEQ ID NO: 591932 - RNA, 14 nt, Homo sapiens
agccucgacacccc

SEQ ID NO: 591933 - RNA, 22 nt, Homo sapiens
agccucggcccuagcauugcac

SEQ ID NO: 591934 - RNA, 20 nt, Homo sapiens
agccucguuucugcuuucag

SEQ ID NO: 591935 - RNA, 17 nt, Homo sapiens
agccucuacaccaacgc

SEQ ID NO: 591936 - RNA, 14 nt, Homo sapiens
agccucuccaggaa

SEQ ID NO: 591937 - RNA, 23 nt, Homo sapiens
agccucugaucuggcagacucau

SEQ ID NO: 591938 - RNA, 14 nt, Homo sapiens
agccucugcugcca

SEQ ID NO: 591939 - RNA, 13 nt, Homo sapiens
agccucuggcuag

SEQ ID NO: 591940 - RNA, 22 nt, Homo sapiens
agccucuuuccuaacuuccuuu

SEQ ID NO: 591941 - RNA, 20 nt, Homo sapiens
agccugaagagccccaaagc

SEQ ID NO: 591942 - RNA, 19 nt, Homo sapiens
agccugaauuuuguugcug

SEQ ID NO: 591943 - RNA, 17 nt, Homo sapiens
agccugagguacagaga

SEQ ID NO: 591944 - RNA, 23 nt, Homo sapiens
agccugcaaacucacugcucaag

SEQ ID NO: 591945 - RNA, 15 nt, Homo sapiens
agccugcauucugca

SEQ ID NO: 591946 - RNA, 20 nt, Homo sapiens
agccugcauugagcuugcau

SEQ ID NO: 591947 - RNA, 18 nt, Homo sapiens
agccugccauauuuguca

SEQ ID NO: 591948 - RNA, 18 nt, Homo sapiens
agccugcccucacucccu

SEQ ID NO: 591949 - RNA, 16 nt, Homo sapiens
agccugccucccaagg

SEQ ID NO: 591950 - RNA, 23 nt, Homo sapiens
agccugccucccaagguccucuc

SEQ ID NO: 591951 - RNA, 18 nt, Homo sapiens
agccugccucuuccagga

SEQ ID NO: 591952 - RNA, 20 nt, Homo sapiens
agccugcucuagugggacag

SEQ ID NO: 591953 - RNA, 15 nt, Homo sapiens
agccugcuguuucca

SEQ ID NO: 591954 - RNA, 21 nt, Homo sapiens
agccuggcacagggcaguggg

SEQ ID NO: 591955 - RNA, 19 nt, Homo sapiens
agccuggccaagagaccag

SEQ ID NO: 591956 - RNA, 20 nt, Homo sapiens
agccuggccccggccuuuau

SEQ ID NO: 591957 - RNA, 16 nt, Homo sapiens
agccuggccccugugc

SEQ ID NO: 591958 - RNA, 15 nt, Homo sapiens
agccuggcuggagag

SEQ ID NO: 591959 - RNA, 20 nt, Homo sapiens
agccuggcuggagagcugcu

SEQ ID NO: 591960 - RNA, 22 nt, Homo sapiens
agccuggcuggagagcugcuau

SEQ ID NO: 591961 - RNA, 13 nt, Homo sapiens
agccugggacaca

SEQ ID NO: 591962 - RNA, 22 nt, Homo sapiens
agccugggcguacagagcacau

SEQ ID NO: 591963 - RNA, 22 nt, Homo sapiens
agccuggggugaccucuagagc

SEQ ID NO: 591964 - RNA, 15 nt, Homo sapiens
agccugggguguccu

SEQ ID NO: 591965 - RNA, 21 nt, Homo sapiens
agccugggugagaauccugcc

SEQ ID NO: 591966 - RNA, 17 nt, Homo sapiens
agccuggguuaaguauu

SEQ ID NO: 591967 - RNA, 16 nt, Homo sapiens
agccuggugcugcugc

SEQ ID NO: 591968 - RNA, 19 nt, Homo sapiens
agccugucacccagcuccu

SEQ ID NO: 591969 - RNA, 15 nt, Homo sapiens
agccugucccaugga

SEQ ID NO: 591970 - RNA, 22 nt, Homo sapiens
agccugucucuuuccacuuugu

SEQ ID NO: 591971 - RNA, 20 nt, Homo sapiens
agccugugaauaaaaacccu

SEQ ID NO: 591972 - RNA, 15 nt, Homo sapiens
agccugugcaaaaaa

SEQ ID NO: 591973 - RNA, 11 nt, Homo sapiens
agccugugcug

SEQ ID NO: 591974 - RNA, 15 nt, Homo sapiens
agccuuagacaaaug

SEQ ID NO: 591975 - RNA, 23 nt, Homo sapiens
agccuucacacagauagaccuuu

SEQ ID NO: 591976 - RNA, 14 nt, Homo sapiens
agccuucagaucuu

SEQ ID NO: 591977 - RNA, 17 nt, Homo sapiens
agccuuccaugaccucc

SEQ ID NO: 591978 - RNA, 16 nt, Homo sapiens
agccuucguguggcuc

SEQ ID NO: 591979 - RNA, 16 nt, Homo sapiens
agccuugagagaccca

SEQ ID NO: 591980 - RNA, 17 nt, Homo sapiens
agccuugauaauacuug

SEQ ID NO: 591981 - RNA, 20 nt, Homo sapiens
agccuugcacacccacugcc

SEQ ID NO: 591982 - RNA, 19 nt, Homo sapiens
agccuugcauguacuugaa

SEQ ID NO: 591983 - RNA, 20 nt, Homo sapiens
agccuugggggggcugccuu

SEQ ID NO: 591984 - RNA, 17 nt, Homo sapiens
agccuuugucaauaaac

SEQ ID NO: 591985 - RNA, 16 nt, Homo sapiens
agcgaacugucagccu

SEQ ID NO: 591986 - RNA, 12 nt, Homo sapiens
agcgaagucuca

SEQ ID NO: 591987 - RNA, 13 nt, Homo sapiens
agcgaaucucugc

SEQ ID NO: 591988 - RNA, 14 nt, Homo sapiens
agcgaccucucugc

SEQ ID NO: 591989 - RNA, 22 nt, Homo sapiens
agcgacguuuauuucaucucuu

SEQ ID NO: 591990 - RNA, 16 nt, Homo sapiens
agcgagccacaggaac

SEQ ID NO: 591991 - RNA, 16 nt, Homo sapiens
agcgagcugcucugcu

SEQ ID NO: 591992 - RNA, 15 nt, Homo sapiens
agcgaggucagagga

SEQ ID NO: 591993 - RNA, 18 nt, Homo sapiens
agcgaugaauuuggagac

SEQ ID NO: 591994 - RNA, 19 nt, Homo sapiens
agcgcagguuuaguuuacu

SEQ ID NO: 591995 - RNA, 20 nt, Homo sapiens
agcgcauugagccaguggug

SEQ ID NO: 591996 - RNA, 17 nt, Homo sapiens
agcgccagcucuaccag

SEQ ID NO: 591997 - RNA, 18 nt, Homo sapiens
agcgccucccuugucuca

SEQ ID NO: 591998 - RNA, 20 nt, Homo sapiens
agcgccugacccuggugggc

SEQ ID NO: 591999 - RNA, 12 nt, Homo sapiens
agcgcucgccac

SEQ ID NO: 592000 - RNA, 19 nt, Homo sapiens
agcgcugagcuaucuccua

SEQ ID NO: 592001 - RNA, 23 nt, Homo sapiens
agcggagaucgcaucauugcacu

SEQ ID NO: 592002 - RNA, 21 nt, Homo sapiens
agcggccuccggcgucuugcc

SEQ ID NO: 592003 - RNA, 22 nt, Homo sapiens
agcggccuccggcgucuugccc

SEQ ID NO: 592004 - RNA, 23 nt, Homo sapiens
agcggggccaccgcgacguugca

SEQ ID NO: 592005 - RNA, 13 nt, Homo sapiens
agcgguccauggg

SEQ ID NO: 592006 - RNA, 23 nt, Homo sapiens
agcggucccugcagaagccagaa

SEQ ID NO: 592007 - RNA, 14 nt, Homo sapiens
agcguagcagcuca

SEQ ID NO: 592008 - RNA, 17 nt, Homo sapiens
agcguagcuaagugaaa

SEQ ID NO: 592009 - RNA, 16 nt, Homo sapiens
agcgucaagguggcau

SEQ ID NO: 592010 - RNA, 13 nt, Homo sapiens
agcgucugggaac

SEQ ID NO: 592011 - RNA, 15 nt, Homo sapiens
agcgugaaucuguau

SEQ ID NO: 592012 - RNA, 20 nt, Homo sapiens
agcgugacaauauacuucac

SEQ ID NO: 592013 - RNA, 16 nt, Homo sapiens
agcgugcucacugacc

SEQ ID NO: 592014 - RNA, 22 nt, Homo sapiens
agcgugcuggcgacacucaggg

SEQ ID NO: 592015 - RNA, 16 nt, Homo sapiens
agcgugggacccuuca

SEQ ID NO: 592016 - RNA, 16 nt, Homo sapiens
agcgugugacuacucc

SEQ ID NO: 592017 - RNA, 15 nt, Homo sapiens
agcguguuuuugcuc

SEQ ID NO: 592018 - RNA, 16 nt, Homo sapiens
agcuaaacgcaauguc

SEQ ID NO: 592019 - RNA, 18 nt, Homo sapiens
agcuaaacggauuccaaa

SEQ ID NO: 592020 - RNA, 16 nt, Homo sapiens
agcuaaacuccuuccu

SEQ ID NO: 592021 - RNA, 20 nt, Homo sapiens
agcuaacccucacaagcaug

SEQ ID NO: 592022 - RNA, 21 nt, Homo sapiens
agcuaagggugggugcucaga

SEQ ID NO: 592023 - RNA, 23 nt, Homo sapiens
agcuaaggucacauugugccuuu

SEQ ID NO: 592024 - RNA, 20 nt, Homo sapiens
agcuaaguacacaauaagca

SEQ ID NO: 592025 - RNA, 19 nt, Homo sapiens
agcuaauguaggacuguau

SEQ ID NO: 592026 - RNA, 13 nt, Homo sapiens
agcuaaugugcag

SEQ ID NO: 592027 - RNA, 20 nt, Homo sapiens
agcuaauuguacuaaucuga

SEQ ID NO: 592028 - RNA, 12 nt, Homo sapiens
agcuaauuugca

SEQ ID NO: 592029 - RNA, 19 nt, Homo sapiens
agcuacaacaacauguacc

SEQ ID NO: 592030 - RNA, 22 nt, Homo sapiens
agcuacaaucuguucaauguuu

SEQ ID NO: 592031 - RNA, 12 nt, Homo sapiens
agcuacaguaga

SEQ ID NO: 592032 - RNA, 12 nt, Homo sapiens
agcuacauuccu

SEQ ID NO: 592033 - RNA, 14 nt, Homo sapiens
agcuaccagguguu

SEQ ID NO: 592034 - RNA, 17 nt, Homo sapiens
agcuaccucaaccaaug

SEQ ID NO: 592035 - RNA, 17 nt, Homo sapiens
agcuacuagcaaaauaa

SEQ ID NO: 592036 - RNA, 15 nt, Homo sapiens
agcuacuaugcccaa

SEQ ID NO: 592037 - RNA, 19 nt, Homo sapiens
agcuacucagaagccugag

SEQ ID NO: 592038 - RNA, 17 nt, Homo sapiens
agcuacucuaguucugu

SEQ ID NO: 592039 - RNA, 16 nt, Homo sapiens
agcuagauaugccuua

SEQ ID NO: 592040 - RNA, 20 nt, Homo sapiens
agcuaggaagagcaggacuc

SEQ ID NO: 592041 - RNA, 17 nt, Homo sapiens
agcuaggugcuauuugu

SEQ ID NO: 592042 - RNA, 17 nt, Homo sapiens
agcuaguguaccuccuc

SEQ ID NO: 592043 - RNA, 17 nt, Homo sapiens
agcuaguuaggagccca

SEQ ID NO: 592044 - RNA, 23 nt, Homo sapiens
agcuauccagugacuuguucuga

SEQ ID NO: 592045 - RNA, 16 nt, Homo sapiens
agcuaucugucaucuc

SEQ ID NO: 592046 - RNA, 17 nt, Homo sapiens
agcuaugaaaccacugc

SEQ ID NO: 592047 - RNA, 20 nt, Homo sapiens
agcuaugaagaaaacacaaa

SEQ ID NO: 592048 - RNA, 14 nt, Homo sapiens
agcuaugaauauag

SEQ ID NO: 592049 - RNA, 21 nt, Homo sapiens
agcuaugaucagaagacuuua

SEQ ID NO: 592050 - RNA, 21 nt, Homo sapiens
agcuauggcccagaaacaaca

SEQ ID NO: 592051 - RNA, 21 nt, Homo sapiens
agcuauuaagaaaaucacauu

SEQ ID NO: 592052 - RNA, 14 nt, Homo sapiens
agcuauuacugucc

SEQ ID NO: 592053 - RNA, 16 nt, Homo sapiens
agcuauuacuguccac

SEQ ID NO: 592054 - RNA, 16 nt, Homo sapiens
agcuauucaccucagu

SEQ ID NO: 592055 - RNA, 14 nt, Homo sapiens
agcuauuuccauuc

SEQ ID NO: 592056 - RNA, 13 nt, Homo sapiens
agcucaacucggg

SEQ ID NO: 592057 - RNA, 15 nt, Homo sapiens
agcucaagaacacau

SEQ ID NO: 592058 - RNA, 19 nt, Homo sapiens
agcucaagucuucccugau

SEQ ID NO: 592059 - RNA, 21 nt, Homo sapiens
agcucaagucuucccugauca

SEQ ID NO: 592060 - RNA, 12 nt, Homo sapiens
agcucacaaaua

SEQ ID NO: 592061 - RNA, 13 nt, Homo sapiens
agcucacaaauag

SEQ ID NO: 592062 - RNA, 13 nt, Homo sapiens
agcucacacugau

SEQ ID NO: 592063 - RNA, 18 nt, Homo sapiens
agcucacagugacauuac

SEQ ID NO: 592064 - RNA, 21 nt, Homo sapiens
agcucacccugcccgcuccca

SEQ ID NO: 592065 - RNA, 15 nt, Homo sapiens
agcucacugcugauc

SEQ ID NO: 592066 - RNA, 16 nt, Homo sapiens
agcucagaacccaggg

SEQ ID NO: 592067 - RNA, 18 nt, Homo sapiens
auacagagcucucugagg

SEQ ID NO: 592068 - RNA, 16 nt, Homo sapiens
auacagauagauauau

SEQ ID NO: 592069 - RNA, 14 nt, Homo sapiens
auacagauuuuacc

SEQ ID NO: 592070 - RNA, 22 nt, Homo sapiens
auacagcaggcagaacucuccu

SEQ ID NO: 592071 - RNA, 11 nt, Homo sapiens
auacagcauug

SEQ ID NO: 592072 - RNA, 18 nt, Homo sapiens
auacagcauugacucaga

SEQ ID NO: 592073 - RNA, 16 nt, Homo sapiens
auacagcuucauaaau

SEQ ID NO: 592074 - RNA, 22 nt, Homo sapiens
auacaguagaagcucacaaaua

SEQ ID NO: 592075 - RNA, 23 nt, Homo sapiens
auacaguauaccuggcaauucac

SEQ ID NO: 592076 - RNA, 22 nt, Homo sapiens
auacaguauauucuuuccucaa

SEQ ID NO: 592077 - RNA, 14 nt, Homo sapiens
auacaguaucucag

SEQ ID NO: 592078 - RNA, 15 nt, Homo sapiens
auacaguaucucagg

SEQ ID NO: 592079 - RNA, 16 nt, Homo sapiens
auacaguaucucaggg

SEQ ID NO: 592080 - RNA, 14 nt, Homo sapiens
auacagucuuccac

SEQ ID NO: 592081 - RNA, 17 nt, Homo sapiens
auacauaaguuuaggau

SEQ ID NO: 592082 - RNA, 13 nt, Homo sapiens
auacauacauaca

SEQ ID NO: 592083 - RNA, 13 nt, Homo sapiens
auacauacauaua

SEQ ID NO: 592084 - RNA, 13 nt, Homo sapiens
auacauauauauc

SEQ ID NO: 592085 - RNA, 20 nt, Homo sapiens
auacauaucgcugacuucau

SEQ ID NO: 592086 - RNA, 15 nt, Homo sapiens
auacauauuaucuca

SEQ ID NO: 592087 - RNA, 18 nt, Homo sapiens
auacauauuuuuauuuga

SEQ ID NO: 592088 - RNA, 14 nt, Homo sapiens
auacaugcauauaa

SEQ ID NO: 592089 - RNA, 13 nt, Homo sapiens
auacaugcuacuu

SEQ ID NO: 592090 - RNA, 19 nt, Homo sapiens
auacaugcuuugaaguuuc

SEQ ID NO: 592091 - RNA, 12 nt, Homo sapiens
auacauugcaau

SEQ ID NO: 592092 - RNA, 17 nt, Homo sapiens
auacauuguauaggcca

SEQ ID NO: 592093 - RNA, 14 nt, Homo sapiens
auacauuucaauua

SEQ ID NO: 592094 - RNA, 22 nt, Homo sapiens
auacauuuucuggugggccuua

SEQ ID NO: 592095 - RNA, 20 nt, Homo sapiens
auacauuuuuagaaaucaca

SEQ ID NO: 592096 - RNA, 22 nt, Homo sapiens
auacauuuuuuaggacaucuua

SEQ ID NO: 592097 - RNA, 17 nt, Homo sapiens
auaccaaccaaaccaau

SEQ ID NO: 592098 - RNA, 22 nt, Homo sapiens
auaccaaccugaagacaccguu

SEQ ID NO: 592099 - RNA, 15 nt, Homo sapiens
auaccaacucaguga

SEQ ID NO: 592100 - RNA, 21 nt, Homo sapiens
auaccaacuguacaaaauaac

SEQ ID NO: 592101 - RNA, 22 nt, Homo sapiens
auaccaauuacauggaacuuuu

SEQ ID NO: 592102 - RNA, 13 nt, Homo sapiens
auaccaccuuuac

SEQ ID NO: 592103 - RNA, 16 nt, Homo sapiens
auaccagaauguugcu

SEQ ID NO: 592104 - RNA, 18 nt, Homo sapiens
auaccagaugaacauuuc

SEQ ID NO: 592105 - RNA, 16 nt, Homo sapiens
auaccagcucagggga

SEQ ID NO: 592106 - RNA, 15 nt, Homo sapiens
auaccaucuguagag

SEQ ID NO: 592107 - RNA, 15 nt, Homo sapiens
auaccauuuccucag

SEQ ID NO: 592108 - RNA, 23 nt, Homo sapiens
auacccaaauuuuaauauuccag

SEQ ID NO: 592109 - RNA, 21 nt, Homo sapiens
auacccaaguuauugggaugu

SEQ ID NO: 592110 - RNA, 14 nt, Homo sapiens
auacccagugaugu

SEQ ID NO: 592111 - RNA, 18 nt, Homo sapiens
auacccaguggaauucca

SEQ ID NO: 592112 - RNA, 13 nt, Homo sapiens
auacccaucuagg

SEQ ID NO: 592113 - RNA, 21 nt, Homo sapiens
auacccuccuuccaccaaguu

SEQ ID NO: 592114 - RNA, 20 nt, Homo sapiens
auacccuggagcaagaccug

SEQ ID NO: 592115 - RNA, 16 nt, Homo sapiens
auaccgcucaguauuu

SEQ ID NO: 592116 - RNA, 15 nt, Homo sapiens
auaccuaauugugga

SEQ ID NO: 592117 - RNA, 21 nt, Homo sapiens
auaccucaacccccauuucua

SEQ ID NO: 592118 - RNA, 14 nt, Homo sapiens
auaccuccaacccu

SEQ ID NO: 592119 - RNA, 15 nt, Homo sapiens
auaccuccaacccug

SEQ ID NO: 592120 - RNA, 22 nt, Homo sapiens
auaccuccaacccugccgucac

SEQ ID NO: 592121 - RNA, 14 nt, Homo sapiens
auaccuccuauggg

SEQ ID NO: 592122 - RNA, 17 nt, Homo sapiens
auaccugaagcugucac

SEQ ID NO: 592123 - RNA, 21 nt, Homo sapiens
auaccugaguacccaugggaa

SEQ ID NO: 592124 - RNA, 14 nt, Homo sapiens
auaccugcucuugu

SEQ ID NO: 592125 - RNA, 21 nt, Homo sapiens
auaccuguugagacugauuca

SEQ ID NO: 592126 - RNA, 19 nt, Homo sapiens
auaccuucuuaaguuuuca

SEQ ID NO: 592127 - RNA, 17 nt, Homo sapiens
auacgcuuuuaaugaaa

SEQ ID NO: 592128 - RNA, 18 nt, Homo sapiens
auacggaagagcagguga

SEQ ID NO: 592129 - RNA, 23 nt, Homo sapiens
auacgggggcugugacucugggc

SEQ ID NO: 592130 - RNA, 14 nt, Homo sapiens
auacgguaugauau

SEQ ID NO: 592131 - RNA, 15 nt, Homo sapiens
auacgugcacagggu

SEQ ID NO: 592132 - RNA, 12 nt, Homo sapiens
auacguguauga

SEQ ID NO: 592133 - RNA, 17 nt, Homo sapiens
auacuaaaguaguuuaa

SEQ ID NO: 592134 - RNA, 16 nt, Homo sapiens
auacuaaaugugcaag

SEQ ID NO: 592135 - RNA, 19 nt, Homo sapiens
auacuacaguaacugugac

SEQ ID NO: 592136 - RNA, 22 nt, Homo sapiens
auacuacauucgugugugucug

SEQ ID NO: 592137 - RNA, 15 nt, Homo sapiens
auacuagauguuaag

SEQ ID NO: 592138 - RNA, 16 nt, Homo sapiens
auacuagggagccauu

SEQ ID NO: 592139 - RNA, 23 nt, Homo sapiens
auacuaguuugcuuugcugacca

SEQ ID NO: 592140 - RNA, 19 nt, Homo sapiens
auacuauauuuauacugua

SEQ ID NO: 592141 - RNA, 21 nt, Homo sapiens
auacuauauuuauacuguaua

SEQ ID NO: 592142 - RNA, 15 nt, Homo sapiens
auacuauuauuugcu

SEQ ID NO: 592143 - RNA, 22 nt, Homo sapiens
auacuauuuaaagccuccucau

SEQ ID NO: 592144 - RNA, 17 nt, Homo sapiens
auacucaaaugguguca

SEQ ID NO: 592145 - RNA, 22 nt, Homo sapiens
auacucacguuugcuuaaaccc

SEQ ID NO: 592146 - RNA, 17 nt, Homo sapiens
auacucccuuuaaagag

SEQ ID NO: 592147 - RNA, 22 nt, Homo sapiens
auacucccuuucagggccaggg

SEQ ID NO: 592148 - RNA, 23 nt, Homo sapiens
auacucuagaugaaguuuuacau

SEQ ID NO: 592149 - RNA, 19 nt, Homo sapiens
auacucuugaaauguagaa

SEQ ID NO: 592150 - RNA, 18 nt, Homo sapiens
auacugacuucaguggga

SEQ ID NO: 592151 - RNA, 20 nt, Homo sapiens
auacugcaauuaaagugaua

SEQ ID NO: 592152 - RNA, 22 nt, Homo sapiens
auacugcauguaagccaaguca

SEQ ID NO: 592153 - RNA, 21 nt, Homo sapiens
auacugcauuagcccaagaga

SEQ ID NO: 592154 - RNA, 15 nt, Homo sapiens
auacugccuuugcag

SEQ ID NO: 592155 - RNA, 21 nt, Homo sapiens
auacugcucaucauuccuuga

SEQ ID NO: 592156 - RNA, 14 nt, Homo sapiens
auacuggaaaccua

SEQ ID NO: 592157 - RNA, 17 nt, Homo sapiens
auacuggccucugugau

SEQ ID NO: 592158 - RNA, 18 nt, Homo sapiens
auacuguauauucaggac

SEQ ID NO: 592159 - RNA, 16 nt, Homo sapiens
auacuguauuuuuacc

SEQ ID NO: 592160 - RNA, 14 nt, Homo sapiens
auacugucaaacaa

SEQ ID NO: 592161 - RNA, 12 nt, Homo sapiens
auacugugaaau

SEQ ID NO: 592162 - RNA, 15 nt, Homo sapiens
auacuguucacucac

SEQ ID NO: 592163 - RNA, 18 nt, Homo sapiens
auacuguucuauacgagu

SEQ ID NO: 592164 - RNA, 13 nt, Homo sapiens
auacuguuuauuu

SEQ ID NO: 592165 - RNA, 17 nt, Homo sapiens
auacuuaaaauaucucu

SEQ ID NO: 592166 - RNA, 16 nt, Homo sapiens
auacuuaacauuucau

SEQ ID NO: 592167 - RNA, 15 nt, Homo sapiens
auacuuaaugcauau

SEQ ID NO: 592168 - RNA, 14 nt, Homo sapiens
auacuuagugguau

SEQ ID NO: 592169 - RNA, 18 nt, Homo sapiens
auacuuaugaaaucucac

SEQ ID NO: 592170 - RNA, 19 nt, Homo sapiens
auacuucucuauuaucuca

SEQ ID NO: 592171 - RNA, 22 nt, Homo sapiens
auacuugagcgcugcugaaaag

SEQ ID NO: 592172 - RNA, 18 nt, Homo sapiens
auacuugccuucugauag

SEQ ID NO: 592173 - RNA, 20 nt, Homo sapiens
auacuuggaugcagcucuug

SEQ ID NO: 592174 - RNA, 9 nt, Homo sapiens
auacuuguc

SEQ ID NO: 592175 - RNA, 15 nt, Homo sapiens
auacuuuaaaggaaa

SEQ ID NO: 592176 - RNA, 13 nt, Homo sapiens
auacuuuacaaag

SEQ ID NO: 592177 - RNA, 13 nt, Homo sapiens
auacuuucaggca

SEQ ID NO: 592178 - RNA, 13 nt, Homo sapiens
auacuuugcauau

SEQ ID NO: 592179 - RNA, 18 nt, Homo sapiens
auacuuugcauauugucu

SEQ ID NO: 592180 - RNA, 18 nt, Homo sapiens
auacuuuggggacuugua

SEQ ID NO: 592181 - RNA, 19 nt, Homo sapiens
auacuuuuacucugccuac

SEQ ID NO: 592182 - RNA, 15 nt, Homo sapiens
auacuuuugcuuuca

SEQ ID NO: 592183 - RNA, 13 nt, Homo sapiens
auacuuuuuacaa

SEQ ID NO: 592184 - RNA, 14 nt, Homo sapiens
auagaaaaauguau

SEQ ID NO: 592185 - RNA, 14 nt, Homo sapiens
auagaaaacugaaa

SEQ ID NO: 592186 - RNA, 17 nt, Homo sapiens
auagaaaaguauguucu

SEQ ID NO: 592187 - RNA, 19 nt, Homo sapiens
auagaaagugccagaaagu

SEQ ID NO: 592188 - RNA, 14 nt, Homo sapiens
auagaaaucuagaa

SEQ ID NO: 592189 - RNA, 13 nt, Homo sapiens
auagaacacuuca

SEQ ID NO: 592190 - RNA, 15 nt, Homo sapiens
auagaaccacuauga

SEQ ID NO: 592191 - RNA, 20 nt, Homo sapiens
auagaacucugggcugccau

SEQ ID NO: 592192 - RNA, 18 nt, Homo sapiens
auagaagagaaaugcugc

SEQ ID NO: 592193 - RNA, 19 nt, Homo sapiens
auagaagcaaaugacaaaa

SEQ ID NO: 592194 - RNA, 18 nt, Homo sapiens
auagaaguguugagccau

SEQ ID NO: 592195 - RNA, 22 nt, Homo sapiens
auagaaugagcacccauuccaa

SEQ ID NO: 592196 - RNA, 13 nt, Homo sapiens
auagacacuggac

SEQ ID NO: 592197 - RNA, 16 nt, Homo sapiens
auagacacuggacaug

SEQ ID NO: 592198 - RNA, 16 nt, Homo sapiens
auagacggugcucacu

SEQ ID NO: 592199 - RNA, 19 nt, Homo sapiens
auagacucugguguucuau

SEQ ID NO: 592200 - RNA, 24 nt, Homo sapiens
auagacugauugauuauucaacac

SEQ ID NO: 592201 - RNA, 23 nt, Homo sapiens
auagagaccaucuuugccaacau

SEQ ID NO: 592202 - RNA, 21 nt, Homo sapiens
auagagauagcuacaguguaa

SEQ ID NO: 592203 - RNA, 22 nt, Homo sapiens
auagagccccuccugguugaua

SEQ ID NO: 592204 - RNA, 13 nt, Homo sapiens
auagagccucguc

SEQ ID NO: 592205 - RNA, 20 nt, Homo sapiens
auagagcuuucaaguacaug

SEQ ID NO: 592206 - RNA, 23 nt, Homo sapiens
auagagcuuuuaaaaauguccug

SEQ ID NO: 592207 - RNA, 16 nt, Homo sapiens
auagaggggcauucac

SEQ ID NO: 592208 - RNA, 18 nt, Homo sapiens
auagaggugaugcugcua

SEQ ID NO: 592209 - RNA, 14 nt, Homo sapiens
auagagugucucag

SEQ ID NO: 592210 - RNA, 13 nt, Homo sapiens
auagaucuuuuca

SEQ ID NO: 592211 - RNA, 14 nt, Homo sapiens
auagaugcacuuau

SEQ ID NO: 592212 - RNA, 21 nt, Homo sapiens
auagauggauuuguaucaaua

SEQ ID NO: 592213 - RNA, 14 nt, Homo sapiens
auagauguguuauu

SEQ ID NO: 592214 - RNA, 17 nt, Homo sapiens
auagauuucuacacuga

SEQ ID NO: 592215 - RNA, 14 nt, Homo sapiens
auagauuugcagcu

SEQ ID NO: 592216 - RNA, 21 nt, Homo sapiens
auagcaaaugcagaaccacaa

SEQ ID NO: 592217 - RNA, 16 nt, Homo sapiens
auagcaaauggccuca

SEQ ID NO: 592218 - RNA, 19 nt, Homo sapiens
auagcaacagagcacuuga

SEQ ID NO: 592219 - RNA, 14 nt, Homo sapiens
auagcaauuucgcc

SEQ ID NO: 592220 - RNA, 11 nt, Homo sapiens
auagcacuuuc

SEQ ID NO: 592221 - RNA, 20 nt, Homo sapiens
auagcagagggguaagagag

SEQ ID NO: 592222 - RNA, 22 nt, Homo sapiens
auagcagccuuucucucuuuau

SEQ ID NO: 592223 - RNA, 13 nt, Homo sapiens
auagcauacugug

SEQ ID NO: 592224 - RNA, 15 nt, Homo sapiens
auagcauacugugua

SEQ ID NO: 592225 - RNA, 21 nt, Homo sapiens
auagcauggggccccuggccc

SEQ ID NO: 592226 - RNA, 15 nt, Homo sapiens
auagcauguaauggu

SEQ ID NO: 592227 - RNA, 14 nt, Homo sapiens
auagccaacugcug

SEQ ID NO: 592228 - RNA, 18 nt, Homo sapiens
auagcccgagcagggucu

SEQ ID NO: 592229 - RNA, 22 nt, Homo sapiens
auagccugaggugggagaauca

SEQ ID NO: 592230 - RNA, 23 nt, Homo sapiens
auagccuggacuuuccuguuguc

SEQ ID NO: 592231 - RNA, 20 nt, Homo sapiens
auagccuuuguuuucuaaua

SEQ ID NO: 592232 - RNA, 15 nt, Homo sapiens
auagcgaauacaaaa

SEQ ID NO: 592233 - RNA, 19 nt, Homo sapiens
auagcuaaguacacaauaa

SEQ ID NO: 592234 - RNA, 18 nt, Homo sapiens
auagcuauauccauguac

SEQ ID NO: 592235 - RNA, 21 nt, Homo sapiens
auagcuauggaaucaauucaa

SEQ ID NO: 592236 - RNA, 16 nt, Homo sapiens
auagcuauuaagauac

SEQ ID NO: 592237 - RNA, 14 nt, Homo sapiens
auagcuuccaugag

SEQ ID NO: 592238 - RNA, 22 nt, Homo sapiens
auagcuugccuaauggcuuuca

SEQ ID NO: 592239 - RNA, 19 nt, Homo sapiens
auagcuuuauacucucucc

SEQ ID NO: 592240 - RNA, 15 nt, Homo sapiens
auaggaauaguccau

SEQ ID NO: 592241 - RNA, 23 nt, Homo sapiens
auaggagcugcaggggugccugg

SEQ ID NO: 592242 - RNA, 21 nt, Homo sapiens
auaggaguggguauuaugcaa

SEQ ID NO: 592243 - RNA, 15 nt, Homo sapiens
auaggauugcuucaa

SEQ ID NO: 592244 - RNA, 19 nt, Homo sapiens
auaggcauagaucuuugua

SEQ ID NO: 592245 - RNA, 21 nt, Homo sapiens
auaggccagggcauguguaug

SEQ ID NO: 592246 - RNA, 16 nt, Homo sapiens
auaggccaucuguaaa

SEQ ID NO: 592247 - RNA, 18 nt, Homo sapiens
auaggccugcucagccuc

SEQ ID NO: 592248 - RNA, 16 nt, Homo sapiens
auaggccuuagcagua

SEQ ID NO: 592249 - RNA, 17 nt, Homo sapiens
auaggccuucauuaaca

SEQ ID NO: 592250 - RNA, 21 nt, Homo sapiens
auaggcuucucacggcgacca

SEQ ID NO: 592251 - RNA, 13 nt, Homo sapiens
auagggcaagaau

SEQ ID NO: 592252 - RNA, 19 nt, Homo sapiens
auagggguucaugcuuaau

SEQ ID NO: 592253 - RNA, 19 nt, Homo sapiens
auagggugcaguuuuccag

SEQ ID NO: 592254 - RNA, 17 nt, Homo sapiens
auagguaaaaacuggaa

SEQ ID NO: 592255 - RNA, 12 nt, Homo sapiens
auaggugcaguu

SEQ ID NO: 592256 - RNA, 18 nt, Homo sapiens
auagguuccagugaugaa

SEQ ID NO: 592257 - RNA, 16 nt, Homo sapiens
auagguugagcaauuu

SEQ ID NO: 592258 - RNA, 17 nt, Homo sapiens
auaguacagacagaagg

SEQ ID NO: 592259 - RNA, 18 nt, Homo sapiens
auagucaauuucuacuuc

SEQ ID NO: 592260 - RNA, 21 nt, Homo sapiens
auagucauuccaaauaugaga

SEQ ID NO: 592261 - RNA, 16 nt, Homo sapiens
auaguccagacacuua

SEQ ID NO: 592262 - RNA, 17 nt, Homo sapiens
auagucccagcuacuca

SEQ ID NO: 592263 - RNA, 16 nt, Homo sapiens
auagucgcagcuacua

SEQ ID NO: 592264 - RNA, 14 nt, Homo sapiens
auagucuuugccag

SEQ ID NO: 592265 - RNA, 19 nt, Homo sapiens
auagugaaaccccaucucu

SEQ ID NO: 592266 - RNA, 19 nt, Homo sapiens
auagugaauggucucucuu

SEQ ID NO: 592267 - RNA, 18 nt, Homo sapiens
auagugaccuguguuuca

SEQ ID NO: 592268 - RNA, 17 nt, Homo sapiens
auagugacuaugaacuu

SEQ ID NO: 592269 - RNA, 23 nt, Homo sapiens
auagugauugauagaguguuauc

SEQ ID NO: 592270 - RNA, 17 nt, Homo sapiens
auagugcaauagugcaa

SEQ ID NO: 592271 - RNA, 22 nt, Homo sapiens
auagugccagguggcucagugc

SEQ ID NO: 592272 - RNA, 19 nt, Homo sapiens
auagugcuggaacacugcu

SEQ ID NO: 592273 - RNA, 14 nt, Homo sapiens
auagugcuguuuaa

SEQ ID NO: 592274 - RNA, 21 nt, Homo sapiens
auagugggguuccaugaguua

SEQ ID NO: 592275 - RNA, 15 nt, Homo sapiens
auaguggugugauuu

SEQ ID NO: 592276 - RNA, 12 nt, Homo sapiens
auaguguccaaa

SEQ ID NO: 592277 - RNA, 13 nt, Homo sapiens
auagugugagaac

SEQ ID NO: 592278 - RNA, 21 nt, Homo sapiens
auaguguucacaaacugugaa

SEQ ID NO: 592279 - RNA, 23 nt, Homo sapiens
auaguguuggaaaaugugcaaua

SEQ ID NO: 592280 - RNA, 21 nt, Homo sapiens
auaguuacaaaauacaaaagu

SEQ ID NO: 592281 - RNA, 17 nt, Homo sapiens
auaguucacuccauuug

SEQ ID NO: 592282 - RNA, 16 nt, Homo sapiens
auaguuccuugccuua

SEQ ID NO: 592283 - RNA, 18 nt, Homo sapiens
auaguucuaucaggaaaa

SEQ ID NO: 592284 - RNA, 14 nt, Homo sapiens
auaguuuaccugaa

SEQ ID NO: 592285 - RNA, 19 nt, Homo sapiens
auaguuucaaaucuguaau

SEQ ID NO: 592286 - RNA, 22 nt, Homo sapiens
auaguuuggcuauaagugcuca

SEQ ID NO: 592287 - RNA, 17 nt, Homo sapiens
auaguuugugaauccuu

SEQ ID NO: 592288 - RNA, 23 nt, Homo sapiens
auaguuuucuccuuuuacuucac

SEQ ID NO: 592289 - RNA, 17 nt, Homo sapiens
auaguuuuuuacuucuc

SEQ ID NO: 592290 - RNA, 17 nt, Homo sapiens
auauaaaaaaucuuuag

SEQ ID NO: 592291 - RNA, 19 nt, Homo sapiens
auauaaaaacuccugggcu

SEQ ID NO: 592292 - RNA, 16 nt, Homo sapiens
auauaaauacaugcac

SEQ ID NO: 592293 - RNA, 16 nt, Homo sapiens
auauaaauauccccag

SEQ ID NO: 592294 - RNA, 13 nt, Homo sapiens
auauaaaugggaa

SEQ ID NO: 592295 - RNA, 17 nt, Homo sapiens
auauaaauuuucccaaa

SEQ ID NO: 592296 - RNA, 20 nt, Homo sapiens
auauaaauuuuuugugauca

SEQ ID NO: 592297 - RNA, 15 nt, Homo sapiens
auauaaccauuacau

SEQ ID NO: 592298 - RNA, 23 nt, Homo sapiens
auauaacccuaggaauuuagaca

SEQ ID NO: 592299 - RNA, 14 nt, Homo sapiens
auauaacuaucucu

SEQ ID NO: 592300 - RNA, 12 nt, Homo sapiens
auauaacuugaa

SEQ ID NO: 592301 - RNA, 13 nt, Homo sapiens
auauaagccauag

SEQ ID NO: 592302 - RNA, 18 nt, Homo sapiens
auauaaguuugaaggaaa

SEQ ID NO: 592303 - RNA, 22 nt, Homo sapiens
auauaauacuauauuuauacug

SEQ ID NO: 592304 - RNA, 14 nt, Homo sapiens
auauaaugaugcug

SEQ ID NO: 592305 - RNA, 21 nt, Homo sapiens
auauaauuguaccaaccucau

SEQ ID NO: 592306 - RNA, 19 nt, Homo sapiens
auauacaaaaauuaacuca

SEQ ID NO: 592307 - RNA, 18 nt, Homo sapiens
auauacaaaacaauuaau

SEQ ID NO: 592308 - RNA, 17 nt, Homo sapiens
auauacaauaacauaau

SEQ ID NO: 592309 - RNA, 14 nt, Homo sapiens
auauacacauacau

SEQ ID NO: 592310 - RNA, 17 nt, Homo sapiens
auauacacauacauaca

SEQ ID NO: 592311 - RNA, 14 nt, Homo sapiens
auauacacauugcu

SEQ ID NO: 592312 - RNA, 13 nt, Homo sapiens
auauaccaaagca

SEQ ID NO: 592313 - RNA, 16 nt, Homo sapiens
auauaccaaagcacau

SEQ ID NO: 592314 - RNA, 12 nt, Homo sapiens
auauaccaucuc

SEQ ID NO: 592315 - RNA, 22 nt, Homo sapiens
auauaccuggcuuuuacuuuau

SEQ ID NO: 592316 - RNA, 21 nt, Homo sapiens
auauacgcccuugagcuacuu

SEQ ID NO: 592317 - RNA, 12 nt, Homo sapiens
auauacuaugaa

SEQ ID NO: 592318 - RNA, 18 nt, Homo sapiens
auauacuauuuucauucu

SEQ ID NO: 592319 - RNA, 14 nt, Homo sapiens
auauacucaugucc

SEQ ID NO: 592320 - RNA, 12 nt, Homo sapiens
auauacuuugaa

SEQ ID NO: 592321 - RNA, 20 nt, Homo sapiens
auauacuuuuacaaguaaca

SEQ ID NO: 592322 - RNA, 16 nt, Homo sapiens
auauagacauucucac

SEQ ID NO: 592323 - RNA, 22 nt, Homo sapiens
auauagagggcuuaugauucag

SEQ ID NO: 592324 - RNA, 19 nt, Homo sapiens
auauagggaucaaccagcu

SEQ ID NO: 592325 - RNA, 17 nt, Homo sapiens
auauaguaugaaugcag

SEQ ID NO: 592326 - RNA, 14 nt, Homo sapiens
auauaguccagaca

SEQ ID NO: 592327 - RNA, 19 nt, Homo sapiens
auauagugcaauagugcaa

SEQ ID NO: 592328 - RNA, 16 nt, Homo sapiens
auauaguggaugauau

SEQ ID NO: 592329 - RNA, 16 nt, Homo sapiens
auauaguuauugcaca

SEQ ID NO: 592330 - RNA, 13 nt, Homo sapiens
auauauaaacaga

SEQ ID NO: 592331 - RNA, 15 nt, Homo sapiens
auauauaaaugaccu

SEQ ID NO: 592332 - RNA, 13 nt, Homo sapiens
auauauaaucauc

SEQ ID NO: 592333 - RNA, 21 nt, Homo sapiens
auauauaauuuccucacugcc

SEQ ID NO: 592334 - RNA, 14 nt, Homo sapiens
auauauaccacuuu

SEQ ID NO: 592335 - RNA, 15 nt, Homo sapiens
auauauacuaaacaa

SEQ ID NO: 592336 - RNA, 12 nt, Homo sapiens
auauauaugcac

SEQ ID NO: 592337 - RNA, 13 nt, Homo sapiens
auauauaugucaa

SEQ ID NO: 592338 - RNA, 14 nt, Homo sapiens
auauauauuacaag

SEQ ID NO: 592339 - RNA, 19 nt, Homo sapiens
auauauauuuuugugcaca

SEQ ID NO: 592340 - RNA, 13 nt, Homo sapiens
auauauccaagaa

SEQ ID NO: 592341 - RNA, 14 nt, Homo sapiens
auauaugcaauaua

SEQ ID NO: 592342 - RNA, 21 nt, Homo sapiens
auauaugcuaagcauaauuaa

SEQ ID NO: 592343 - RNA, 12 nt, Homo sapiens
auauauggacau

SEQ ID NO: 592344 - RNA, 13 nt, Homo sapiens
auauauggaccua

SEQ ID NO: 592345 - RNA, 14 nt, Homo sapiens
auauaugucaauau

SEQ ID NO: 592346 - RNA, 23 nt, Homo sapiens
auauauuguaaucacauuccuua

SEQ ID NO: 592347 - RNA, 19 nt, Homo sapiens
auauauuuaauaugucaaa

SEQ ID NO: 592348 - RNA, 17 nt, Homo sapiens
auauauuuacagaagaa

SEQ ID NO: 592349 - RNA, 17 nt, Homo sapiens
auauauuucagauauca

SEQ ID NO: 592350 - RNA, 17 nt, Homo sapiens
auaucaaaaaguauuaa

SEQ ID NO: 592351 - RNA, 18 nt, Homo sapiens
auaucaaaucuaccacug

SEQ ID NO: 592352 - RNA, 13 nt, Homo sapiens
auaucaagauguu

SEQ ID NO: 592353 - RNA, 17 nt, Homo sapiens
auaucaagauguuaaau

SEQ ID NO: 592354 - RNA, 19 nt, Homo sapiens
auaucacauuggagucacu

SEQ ID NO: 592355 - RNA, 11 nt, Homo sapiens
auaucagggaa

SEQ ID NO: 592356 - RNA, 16 nt, Homo sapiens
auaucaguaccucuca

SEQ ID NO: 592357 - RNA, 18 nt, Homo sapiens
auaucaguccucuuucaa

SEQ ID NO: 592358 - RNA, 19 nt, Homo sapiens
auaucauaacuauacuuga

SEQ ID NO: 592359 - RNA, 13 nt, Homo sapiens
auaucaugucuug

SEQ ID NO: 592360 - RNA, 21 nt, Homo sapiens
auaucauuuuaaaaacuuuau

SEQ ID NO: 592361 - RNA, 23 nt, Homo sapiens
auauccaagaagcaugcagagaa

SEQ ID NO: 592362 - RNA, 14 nt, Homo sapiens
auauccaagacuua

SEQ ID NO: 592363 - RNA, 18 nt, Homo sapiens
auauccaggcaccaggac

SEQ ID NO: 592364 - RNA, 13 nt, Homo sapiens
auauccccaggga

SEQ ID NO: 592365 - RNA, 21 nt, Homo sapiens
auaucccuacauguauugcac

SEQ ID NO: 592366 - RNA, 16 nt, Homo sapiens
auaucccuuacuccag

SEQ ID NO: 592367 - RNA, 18 nt, Homo sapiens
auauccuuucaagacaga

SEQ ID NO: 592368 - RNA, 18 nt, Homo sapiens
auaucuaauauauaugaa

SEQ ID NO: 592369 - RNA, 18 nt, Homo sapiens
auaucucaacagaauuaa

SEQ ID NO: 592370 - RNA, 23 nt, Homo sapiens
auaucuccauggcccugucccag

SEQ ID NO: 592371 - RNA, 14 nt, Homo sapiens
auaucugaaccaag

SEQ ID NO: 592372 - RNA, 17 nt, Homo sapiens
auaucugguauauguca

SEQ ID NO: 592373 - RNA, 20 nt, Homo sapiens
auaucuuuaugggcucuguu

SEQ ID NO: 592374 - RNA, 20 nt, Homo sapiens
auaucuuugcugcuuuccag

SEQ ID NO: 592375 - RNA, 14 nt, Homo sapiens
auaugaagacauaa

SEQ ID NO: 592376 - RNA, 17 nt, Homo sapiens
auaugaggcuugauaau

SEQ ID NO: 592377 - RNA, 18 nt, Homo sapiens
auaugaguaauacaucaa

SEQ ID NO: 592378 - RNA, 21 nt, Homo sapiens
auaugaguuacugaaggugau

SEQ ID NO: 592379 - RNA, 14 nt, Homo sapiens
auaugauaaaacac

SEQ ID NO: 592380 - RNA, 14 nt, Homo sapiens
auaugauacucuca

SEQ ID NO: 592381 - RNA, 13 nt, Homo sapiens
auaugaugccacu

SEQ ID NO: 592382 - RNA, 18 nt, Homo sapiens
auaugauguggacauaug

SEQ ID NO: 592383 - RNA, 11 nt, Homo sapiens
auaugcaaauc

SEQ ID NO: 592384 - RNA, 19 nt, Homo sapiens
auaugcaccccuggaacca

SEQ ID NO: 592385 - RNA, 21 nt, Homo sapiens
auaugcacuuucccuagaaag

SEQ ID NO: 592386 - RNA, 19 nt, Homo sapiens
auaugcagccaaccaagau

SEQ ID NO: 592387 - RNA, 19 nt, Homo sapiens
auaugccaagcuaauuuau

SEQ ID NO: 592388 - RNA, 18 nt, Homo sapiens
auaugcuaacccccaaau

SEQ ID NO: 592389 - RNA, 22 nt, Homo sapiens
auaugcuaauuaaauaauacaa

SEQ ID NO: 592390 - RNA, 20 nt, Homo sapiens
auaugcuuggcuaacuauau

SEQ ID NO: 592391 - RNA, 16 nt, Homo sapiens
auaugcuuuacaaucu

SEQ ID NO: 592392 - RNA, 15 nt, Homo sapiens
auauggaauuuugca

SEQ ID NO: 592393 - RNA, 13 nt, Homo sapiens
auauggcugccca

SEQ ID NO: 592394 - RNA, 16 nt, Homo sapiens
auauggugggcacaga

SEQ ID NO: 592395 - RNA, 17 nt, Homo sapiens
auauguaaguacuucca

SEQ ID NO: 592396 - RNA, 15 nt, Homo sapiens
auauguacuugucaa

SEQ ID NO: 592397 - RNA, 21 nt, Homo sapiens
auauguagccuucacacagau

SEQ ID NO: 592398 - RNA, 14 nt, Homo sapiens
auauguagcucauc

SEQ ID NO: 592399 - RNA, 20 nt, Homo sapiens
auauguauacuuaucuugcu

SEQ ID NO: 592400 - RNA, 17 nt, Homo sapiens
auauguaugcaccucaa

SEQ ID NO: 592401 - RNA, 16 nt, Homo sapiens
auauguauuuaccaaa

SEQ ID NO: 592402 - RNA, 13 nt, Homo sapiens
auauguccaguca

SEQ ID NO: 592403 - RNA, 22 nt, Homo sapiens
auaugucuauauacacagacau

SEQ ID NO: 592404 - RNA, 20 nt, Homo sapiens
auaugucucaggucccugca

SEQ ID NO: 592405 - RNA, 14 nt, Homo sapiens
auaugugcuugccu

SEQ ID NO: 592406 - RNA, 23 nt, Homo sapiens
auauguguaugcacaguaaaaau

SEQ ID NO: 592407 - RNA, 16 nt, Homo sapiens
auauguguucauuaaa

SEQ ID NO: 592408 - RNA, 11 nt, Homo sapiens
auauguuacaa

SEQ ID NO: 592409 - RNA, 16 nt, Homo sapiens
auauguucaacuggag

SEQ ID NO: 592410 - RNA, 13 nt, Homo sapiens
auauguugcuaua

SEQ ID NO: 592411 - RNA, 14 nt, Homo sapiens
auauguugcucagu

SEQ ID NO: 592412 - RNA, 22 nt, Homo sapiens
auauguuuccccaucucugucu

SEQ ID NO: 592413 - RNA, 22 nt, Homo sapiens
auauuaaaaauaggugugauuu

SEQ ID NO: 592414 - RNA, 15 nt, Homo sapiens
auauuaaaagaacuc

SEQ ID NO: 592415 - RNA, 21 nt, Homo sapiens
auauuaaaaguuaagcaaaua

SEQ ID NO: 592416 - RNA, 14 nt, Homo sapiens
auauuaacauauuc

SEQ ID NO: 592417 - RNA, 16 nt, Homo sapiens
auauuaagaagcaaua

SEQ ID NO: 592418 - RNA, 19 nt, Homo sapiens
auauuaagacaauagcacu

SEQ ID NO: 592419 - RNA, 14 nt, Homo sapiens
auauuaagcacuuu

SEQ ID NO: 592420 - RNA, 22 nt, Homo sapiens
auauuaauaaaacuuuauguac

SEQ ID NO: 592421 - RNA, 19 nt, Homo sapiens
auauuacugucuuuauucu

SEQ ID NO: 592422 - RNA, 12 nt, Homo sapiens
auauuacuuguu

SEQ ID NO: 592423 - RNA, 15 nt, Homo sapiens
auauuaggucccauc

SEQ ID NO: 592424 - RNA, 15 nt, Homo sapiens
auauuaugucuucau

SEQ ID NO: 592425 - RNA, 15 nt, Homo sapiens
auauucaacucauaa

SEQ ID NO: 592426 - RNA, 18 nt, Homo sapiens
auauucaagccuguuguc

SEQ ID NO: 592427 - RNA, 17 nt, Homo sapiens
auauucacuaaggacuu

SEQ ID NO: 592428 - RNA, 20 nt, Homo sapiens
auauucauguaccugugauc

SEQ ID NO: 592429 - RNA, 23 nt, Homo sapiens
auauucauuggcagcucaaagac

SEQ ID NO: 592430 - RNA, 15 nt, Homo sapiens
auauuccagguuuaa

SEQ ID NO: 592431 - RNA, 22 nt, Homo sapiens
auauuccugguguagcacuuaa

SEQ ID NO: 592432 - RNA, 20 nt, Homo sapiens
auauucuaaguuagacucuu

SEQ ID NO: 592433 - RNA, 20 nt, Homo sapiens
auauucuuaaugacauuuca

SEQ ID NO: 592434 - RNA, 16 nt, Homo sapiens
auauucuuauuucacu

SEQ ID NO: 592435 - RNA, 21 nt, Homo sapiens
auauucuuccccgaaucacac

SEQ ID NO: 592436 - RNA, 21 nt, Homo sapiens
auauucuuuugaucacauugu

SEQ ID NO: 592437 - RNA, 20 nt, Homo sapiens
auauugaaaguugcuuuuau

SEQ ID NO: 592438 - RNA, 14 nt, Homo sapiens
auauugacuuguau

SEQ ID NO: 592439 - RNA, 18 nt, Homo sapiens
auauugagcaauauguca

SEQ ID NO: 592440 - RNA, 20 nt, Homo sapiens
auauugagcaauaugucagu

SEQ ID NO: 592441 - RNA, 19 nt, Homo sapiens
auauugcagcuuauauuca

SEQ ID NO: 592442 - RNA, 20 nt, Homo sapiens
auauugcagcuuauauucau

SEQ ID NO: 592443 - RNA, 13 nt, Homo sapiens
auauugcagucaa

SEQ ID NO: 592444 - RNA, 11 nt, Homo sapiens
auauugcccag

SEQ ID NO: 592445 - RNA, 11 nt, Homo sapiens
auauugccuua

SEQ ID NO: 592446 - RNA, 15 nt, Homo sapiens
auauuggacugauaa

SEQ ID NO: 592447 - RNA, 22 nt, Homo sapiens
auauugggccuaaaacaguauu

SEQ ID NO: 592448 - RNA, 21 nt, Homo sapiens
auauuguaauccuagcacuuu

SEQ ID NO: 592449 - RNA, 13 nt, Homo sapiens
auauugugaaaag

SEQ ID NO: 592450 - RNA, 16 nt, Homo sapiens
auauugugauucugcc

SEQ ID NO: 592451 - RNA, 19 nt, Homo sapiens
auauuguguugacuuuaua

SEQ ID NO: 592452 - RNA, 15 nt, Homo sapiens
auauuuaaugcauua

SEQ ID NO: 592453 - RNA, 20 nt, Homo sapiens
auauuuaauggcacugagaa

SEQ ID NO: 592454 - RNA, 22 nt, Homo sapiens
auauuuaauuaaagcacacuuu

SEQ ID NO: 592455 - RNA, 17 nt, Homo sapiens
auauuuaccagaccaca

SEQ ID NO: 592456 - RNA, 19 nt, Homo sapiens
auauuuauaaaugagcaaa

SEQ ID NO: 592457 - RNA, 19 nt, Homo sapiens
auauuuauacagcagagaa

SEQ ID NO: 592458 - RNA, 15 nt, Homo sapiens
auauuuauagcaauc

SEQ ID NO: 592459 - RNA, 15 nt, Homo sapiens
auauuuauauauuaa

SEQ ID NO: 592460 - RNA, 19 nt, Homo sapiens
auauuuauggggggagaac

SEQ ID NO: 592461 - RNA, 18 nt, Homo sapiens
auauuuaugucuauuuaa

SEQ ID NO: 592462 - RNA, 19 nt, Homo sapiens
auauuuauuagauagcccu

SEQ ID NO: 592463 - RNA, 23 nt, Homo sapiens
auauuuauucauuauuugucaaa

SEQ ID NO: 592464 - RNA, 23 nt, Homo sapiens
auauuuccaucagcccaucucaa

SEQ ID NO: 592465 - RNA, 19 nt, Homo sapiens
auauuucuaccugagugaa

SEQ ID NO: 592466 - RNA, 17 nt, Homo sapiens
auauuucugaaaaccua

SEQ ID NO: 592467 - RNA, 19 nt, Homo sapiens
auauuucugauacugcuga

SEQ ID NO: 592468 - RNA, 20 nt, Homo sapiens
auauuucuguguacacaucu

SEQ ID NO: 592469 - RNA, 13 nt, Homo sapiens
auauuugaaugaa

SEQ ID NO: 592470 - RNA, 18 nt, Homo sapiens
auauuugcugagugaaug

SEQ ID NO: 592471 - RNA, 16 nt, Homo sapiens
auauuuguauacacau

SEQ ID NO: 592472 - RNA, 13 nt, Homo sapiens
auauuugugaaaa

SEQ ID NO: 592473 - RNA, 19 nt, Homo sapiens
auauuuuaaaaucugucac

SEQ ID NO: 592474 - RNA, 23 nt, Homo sapiens
auauuuuaagaaagagaaugaac

SEQ ID NO: 592475 - RNA, 23 nt, Homo sapiens
auauuuuaagaauuucacaagcu

SEQ ID NO: 592476 - RNA, 17 nt, Homo sapiens
auauuuuagccacucaa

SEQ ID NO: 592477 - RNA, 22 nt, Homo sapiens
auauuuuauaaagauacuaaac

SEQ ID NO: 592478 - RNA, 14 nt, Homo sapiens
auauuuuaucucaa

SEQ ID NO: 592479 - RNA, 17 nt, Homo sapiens
auauuuuaugaacauug

SEQ ID NO: 592480 - RNA, 23 nt, Homo sapiens
auauuuucuggguuaaaacccca

SEQ ID NO: 592481 - RNA, 14 nt, Homo sapiens
auauuuucugugcc

SEQ ID NO: 592482 - RNA, 23 nt, Homo sapiens
auauuuuggggggcagagaauaa

SEQ ID NO: 592483 - RNA, 20 nt, Homo sapiens
auauuuuguucugcaaauua

SEQ ID NO: 592484 - RNA, 18 nt, Homo sapiens
auauuuuguuuugugcag

SEQ ID NO: 592485 - RNA, 18 nt, Homo sapiens
auauuuuuaaagcuuuca

SEQ ID NO: 592486 - RNA, 18 nt, Homo sapiens
auauuuuuagauaguuag

SEQ ID NO: 592487 - RNA, 16 nt, Homo sapiens
auauuuuuccacuuaa

SEQ ID NO: 592488 - RNA, 16 nt, Homo sapiens
auauuuuucugagauu

SEQ ID NO: 592489 - RNA, 19 nt, Homo sapiens
auauuuuugguugucaaua

SEQ ID NO: 592490 - RNA, 17 nt, Homo sapiens
auauuuuuuuaacuuua

SEQ ID NO: 592491 - RNA, 14 nt, Homo sapiens
aucaaaaaguauua

SEQ ID NO: 592492 - RNA, 19 nt, Homo sapiens
aucaaaaauauuccaucca

SEQ ID NO: 592493 - RNA, 20 nt, Homo sapiens
aucaaaacuaaccaucugaa

SEQ ID NO: 592494 - RNA, 14 nt, Homo sapiens
aucaaaacucuccu

SEQ ID NO: 592495 - RNA, 11 nt, Homo sapiens
aucaaacauuu

SEQ ID NO: 592496 - RNA, 21 nt, Homo sapiens
aucaaagacauggaauuaccu

SEQ ID NO: 592497 - RNA, 13 nt, Homo sapiens
aucaaagcacuug

SEQ ID NO: 592498 - RNA, 16 nt, Homo sapiens
aucaaagccacacucu

SEQ ID NO: 592499 - RNA, 15 nt, Homo sapiens
aucaaaucucuucca

SEQ ID NO: 592500 - RNA, 22 nt, Homo sapiens
aucaaaucucuuccacaugggu

SEQ ID NO: 592501 - RNA, 15 nt, Homo sapiens
aucaaauuuugccag

SEQ ID NO: 592502 - RNA, 17 nt, Homo sapiens
aucaacaagauuuccac

SEQ ID NO: 592503 - RNA, 18 nt, Homo sapiens
aucaacaucuuggucaga

SEQ ID NO: 592504 - RNA, 13 nt, Homo sapiens
aucaacaugacug

SEQ ID NO: 592505 - RNA, 19 nt, Homo sapiens
aucaacauuuagucuucau

SEQ ID NO: 592506 - RNA, 21 nt, Homo sapiens
aucaaccaggaagaguucuau

SEQ ID NO: 592507 - RNA, 20 nt, Homo sapiens
aucaacgccucacugaaaca

SEQ ID NO: 592508 - RNA, 14 nt, Homo sapiens
aucaacucuaauag

SEQ ID NO: 592509 - RNA, 20 nt, Homo sapiens
aucaacuuauuauaugacua

SEQ ID NO: 592510 - RNA, 18 nt, Homo sapiens
aucaagaaaaaaagggag

SEQ ID NO: 592511 - RNA, 22 nt, Homo sapiens
aucaagaauuagaagucuuuca

SEQ ID NO: 592512 - RNA, 17 nt, Homo sapiens
aucaagagaauauacug

SEQ ID NO: 592513 - RNA, 18 nt, Homo sapiens
aucaagagaguaaacaga

SEQ ID NO: 592514 - RNA, 11 nt, Homo sapiens
aucaagccaua

SEQ ID NO: 592515 - RNA, 14 nt, Homo sapiens
aucaagccaugugc

SEQ ID NO: 592516 - RNA, 14 nt, Homo sapiens
aucaagcugugaga

SEQ ID NO: 592517 - RNA, 13 nt, Homo sapiens
aucaaguaauaca

SEQ ID NO: 592518 - RNA, 22 nt, Homo sapiens
aucaagucaucuauaguugaua

SEQ ID NO: 592519 - RNA, 17 nt, Homo sapiens
aucaaguccaucugaca

SEQ ID NO: 592520 - RNA, 22 nt, Homo sapiens
aucaaguccuaguuguucagca

SEQ ID NO: 592521 - RNA, 19 nt, Homo sapiens
aucaaguuguugacuguga

SEQ ID NO: 592522 - RNA, 20 nt, Homo sapiens
aucaauaaagaaaacuucca

SEQ ID NO: 592523 - RNA, 16 nt, Homo sapiens
aucaauacagcuucau

SEQ ID NO: 592524 - RNA, 23 nt, Homo sapiens
aucaauaggaaagcauaugcagc

SEQ ID NO: 592525 - RNA, 23 nt, Homo sapiens
aucaauaguugaauuagugagua

SEQ ID NO: 592526 - RNA, 12 nt, Homo sapiens
aucaauauacau

SEQ ID NO: 592527 - RNA, 15 nt, Homo sapiens
aucaauggugcaaaa

SEQ ID NO: 592528 - RNA, 10 nt, Homo sapiens
aucaaugugu

SEQ ID NO: 592529 - RNA, 20 nt, Homo sapiens
aucaauuacugguccaaaag

SEQ ID NO: 592530 - RNA, 18 nt, Homo sapiens
aucacaaaccaagccaug

SEQ ID NO: 592531 - RNA, 20 nt, Homo sapiens
aucacaaaccaagccaugcu

SEQ ID NO: 592532 - RNA, 16 nt, Homo sapiens
aucacaagauggaauu

SEQ ID NO: 592533 - RNA, 17 nt, Homo sapiens
aucacacagacaguuuc

SEQ ID NO: 592534 - RNA, 15 nt, Homo sapiens
aucacaccucugggc

SEQ ID NO: 592535 - RNA, 16 nt, Homo sapiens
aucacagacacugcac

SEQ ID NO: 592536 - RNA, 23 nt, Homo sapiens
aucacaggagcaaucacaggaaa

SEQ ID NO: 592537 - RNA, 17 nt, Homo sapiens
aucacaguguuugcaau

SEQ ID NO: 592538 - RNA, 19 nt, Homo sapiens
aucacaucuaaagcuuuau

SEQ ID NO: 592539 - RNA, 21 nt, Homo sapiens
aucacaugaccacauagcaug

SEQ ID NO: 592540 - RNA, 15 nt, Homo sapiens
aucacauuaucaucu

SEQ ID NO: 592541 - RNA, 18 nt, Homo sapiens
aucacauuuuaagugcuu

SEQ ID NO: 592542 - RNA, 11 nt, Homo sapiens
aucaccagaca

SEQ ID NO: 592543 - RNA, 13 nt, Homo sapiens
aucaccagagguc

SEQ ID NO: 592544 - RNA, 15 nt, Homo sapiens
aucaccauauuguaa

SEQ ID NO: 592545 - RNA, 17 nt, Homo sapiens
aucaccauuucuuggca

SEQ ID NO: 592546 - RNA, 21 nt, Homo sapiens
aucaccuguuagcauugccau

SEQ ID NO: 592547 - RNA, 21 nt, Homo sapiens
aucaccuugauaaugggauga

SEQ ID NO: 592548 - RNA, 18 nt, Homo sapiens
aucaccuuguauucucuu

SEQ ID NO: 592549 - RNA, 17 nt, Homo sapiens
aucacggauggugcaug

SEQ ID NO: 592550 - RNA, 19 nt, Homo sapiens
aucacuaaauaagcuucca

SEQ ID NO: 592551 - RNA, 12 nt, Homo sapiens
aucacuacugua

SEQ ID NO: 592552 - RNA, 13 nt, Homo sapiens
aucacuacuguau

SEQ ID NO: 592553 - RNA, 23 nt, Homo sapiens
aucacuagccaugauaacugcaa

SEQ ID NO: 592554 - RNA, 19 nt, Homo sapiens
aucacuagguaacuuauua

SEQ ID NO: 592555 - RNA, 19 nt, Homo sapiens
aucacucucaccuuccaaa

SEQ ID NO: 592556 - RNA, 19 nt, Homo sapiens
aucacugacucugacucau

SEQ ID NO: 592557 - RNA, 22 nt, Homo sapiens
aucacugccacacucuccauca

SEQ ID NO: 592558 - RNA, 19 nt, Homo sapiens
aucacuggguguugaucuu

SEQ ID NO: 592559 - RNA, 19 nt, Homo sapiens
aucacugguauuaacuuua

SEQ ID NO: 592560 - RNA, 12 nt, Homo sapiens
aucacugugaaa

SEQ ID NO: 592561 - RNA, 17 nt, Homo sapiens
aucacuuaaacuugcau

SEQ ID NO: 592562 - RNA, 23 nt, Homo sapiens
aucacuuaaacuugcaucacuua

SEQ ID NO: 592563 - RNA, 18 nt, Homo sapiens
aucacuucccuacaugga

SEQ ID NO: 592564 - RNA, 18 nt, Homo sapiens
aucacuuguggagcgcca

SEQ ID NO: 592565 - RNA, 18 nt, Homo sapiens
aucacuuuaaagcccuuu

SEQ ID NO: 592566 - RNA, 20 nt, Homo sapiens
aucacuuucucaguuuucau

SEQ ID NO: 592567 - RNA, 11 nt, Homo sapiens
aucacuuugac

SEQ ID NO: 592568 - RNA, 19 nt, Homo sapiens
aucagaaaaagcaguauua

SEQ ID NO: 592569 - RNA, 15 nt, Homo sapiens
aucagacagcuugaa

SEQ ID NO: 592570 - RNA, 22 nt, Homo sapiens
aucagaccauaauguuacauua

SEQ ID NO: 592571 - RNA, 18 nt, Homo sapiens
aucagacugacaguuuac

SEQ ID NO: 592572 - RNA, 16 nt, Homo sapiens
aucagagaacuuuccc

SEQ ID NO: 592573 - RNA, 13 nt, Homo sapiens
aucagagagccua

SEQ ID NO: 592574 - RNA, 22 nt, Homo sapiens
aucagaggucuauuuuuaccua

SEQ ID NO: 592575 - RNA, 12 nt, Homo sapiens
aucagaguugcu

SEQ ID NO: 592576 - RNA, 18 nt, Homo sapiens
aucagaugacucucucca

SEQ ID NO: 592577 - RNA, 12 nt, Homo sapiens
aucagcaaauuu

SEQ ID NO: 592578 - RNA, 21 nt, Homo sapiens
aucagcaauuucagaaccaaa

SEQ ID NO: 592579 - RNA, 13 nt, Homo sapiens
aucagcauuaguc

SEQ ID NO: 592580 - RNA, 15 nt, Homo sapiens
aucagcauugucucg

SEQ ID NO: 592581 - RNA, 15 nt, Homo sapiens
aucagcauuuuacua

SEQ ID NO: 592582 - RNA, 16 nt, Homo sapiens
aucagccaaguuuuau

SEQ ID NO: 592583 - RNA, 21 nt, Homo sapiens
aucagccauaagaaagcacua

SEQ ID NO: 592584 - RNA, 14 nt, Homo sapiens
aucagccauuugcc

SEQ ID NO: 592585 - RNA, 19 nt, Homo sapiens
aucagccuccgccauucca

SEQ ID NO: 592586 - RNA, 21 nt, Homo sapiens
aucagccuccgccauuccaag

SEQ ID NO: 592587 - RNA, 17 nt, Homo sapiens
aucagcgggucuccucc

SEQ ID NO: 592588 - RNA, 19 nt, Homo sapiens
aucagcucuugaugccuuu

SEQ ID NO: 592589 - RNA, 15 nt, Homo sapiens
aucaggaaacucaaa

SEQ ID NO: 592590 - RNA, 15 nt, Homo sapiens
aucaggaaccacaga

SEQ ID NO: 592591 - RNA, 13 nt, Homo sapiens
aucaggacgagaa

SEQ ID NO: 592592 - RNA, 22 nt, Homo sapiens
aucagggauccaauaugacuca

SEQ ID NO: 592593 - RNA, 16 nt, Homo sapiens
aucagggcccugcccc

SEQ ID NO: 592594 - RNA, 17 nt, Homo sapiens
aucagguagacuuuuaa

SEQ ID NO: 592595 - RNA, 19 nt, Homo sapiens
aucaggugacuucuagcag

SEQ ID NO: 592596 - RNA, 21 nt, Homo sapiens
aucaggugcaggucagacucu

SEQ ID NO: 592597 - RNA, 21 nt, Homo sapiens
aucaggugcauagcaagugaa

SEQ ID NO: 592598 - RNA, 15 nt, Homo sapiens
aucagguuugcccac

SEQ ID NO: 592599 - RNA, 23 nt, Homo sapiens
aucaguaucagaauacuugcacu

SEQ ID NO: 592600 - RNA, 14 nt, Homo sapiens
aucaguauugugaa

SEQ ID NO: 592601 - RNA, 18 nt, Homo sapiens
aucaguauuuaauaucug

SEQ ID NO: 592602 - RNA, 23 nt, Homo sapiens
aucagucaacaacuuacacuuau

SEQ ID NO: 592603 - RNA, 15 nt, Homo sapiens
aucagucaaugagga

SEQ ID NO: 592604 - RNA, 20 nt, Homo sapiens
aucaguccaucccagaggga

SEQ ID NO: 592605 - RNA, 21 nt, Homo sapiens
aucagugaaaaagauguacag

SEQ ID NO: 592606 - RNA, 17 nt, Homo sapiens
aucagugaagaugccag

SEQ ID NO: 592607 - RNA, 15 nt, Homo sapiens
aucagugcagugaua

SEQ ID NO: 592608 - RNA, 11 nt, Homo sapiens
aucagugcaug

SEQ ID NO: 592609 - RNA, 15 nt, Homo sapiens
aucagugccucuuug

SEQ ID NO: 592610 - RNA, 20 nt, Homo sapiens
aucagugucuguuucagaau

SEQ ID NO: 592611 - RNA, 11 nt, Homo sapiens
aucaguguuua

SEQ ID NO: 592612 - RNA, 12 nt, Homo sapiens
aucaguugcuau

SEQ ID NO: 592613 - RNA, 18 nt, Homo sapiens
aucaguugguuuggauuu

SEQ ID NO: 592614 - RNA, 15 nt, Homo sapiens
aucauaaccauguga

SEQ ID NO: 592615 - RNA, 19 nt, Homo sapiens
aucauaaccaugugaaaag

SEQ ID NO: 592616 - RNA, 20 nt, Homo sapiens
aucauacuaaacuucaccua

SEQ ID NO: 592617 - RNA, 14 nt, Homo sapiens
aucauaugccugac

SEQ ID NO: 592618 - RNA, 20 nt, Homo sapiens
aucauauggagcucauguca

SEQ ID NO: 592619 - RNA, 10 nt, Homo sapiens
aucauauuca

SEQ ID NO: 592620 - RNA, 18 nt, Homo sapiens
aucaucuuaccugugcuu

SEQ ID NO: 592621 - RNA, 14 nt, Homo sapiens
aucaugaagcacau

SEQ ID NO: 592622 - RNA, 22 nt, Homo sapiens
aucaugaagcacaucaauuaca

SEQ ID NO: 592623 - RNA, 14 nt, Homo sapiens
aucaugagacauua

SEQ ID NO: 592624 - RNA, 17 nt, Homo sapiens
aucaugcacaacuauaa

SEQ ID NO: 592625 - RNA, 20 nt, Homo sapiens
aucaugccccuguacuccag

SEQ ID NO: 592626 - RNA, 18 nt, Homo sapiens
aucaugcccugugcaacc

SEQ ID NO: 592627 - RNA, 11 nt, Homo sapiens
aucauggaaua

SEQ ID NO: 592628 - RNA, 24 nt, Homo sapiens
aucauggagaacagcaugacagcu

SEQ ID NO: 592629 - RNA, 22 nt, Homo sapiens
aucaugggagcaugcuuaccuu

SEQ ID NO: 592630 - RNA, 18 nt, Homo sapiens
aucaugggccagagccuc

SEQ ID NO: 592631 - RNA, 17 nt, Homo sapiens
aucauggggaguaauag

SEQ ID NO: 592632 - RNA, 19 nt, Homo sapiens
aucaugguagucacuaaca

SEQ ID NO: 592633 - RNA, 17 nt, Homo sapiens
aucauguaccucagauc

SEQ ID NO: 592634 - RNA, 20 nt, Homo sapiens
aucauguccuauucccuguc

SEQ ID NO: 592635 - RNA, 23 nt, Homo sapiens
aucauuauuuaagccguucuuau

SEQ ID NO: 592636 - RNA, 15 nt, Homo sapiens
aucauucaacucucc

SEQ ID NO: 592637 - RNA, 22 nt, Homo sapiens
aucauuccccugcccaccuccu

SEQ ID NO: 592638 - RNA, 20 nt, Homo sapiens
aucauuguuauaaagacaca

SEQ ID NO: 592639 - RNA, 21 nt, Homo sapiens
aucauuuguuuacauuugaug

SEQ ID NO: 592640 - RNA, 22 nt, Homo sapiens
aucauuuuacucuuaugaucaa

SEQ ID NO: 592641 - RNA, 23 nt, Homo sapiens
aucauuuuacucuuaugaucaau

SEQ ID NO: 592642 - RNA, 20 nt, Homo sapiens
auccaaaauauuuuuugcaa

SEQ ID NO: 592643 - RNA, 14 nt, Homo sapiens
auccaaaucugucc

SEQ ID NO: 592644 - RNA, 14 nt, Homo sapiens
auccaacauccaga

SEQ ID NO: 592645 - RNA, 17 nt, Homo sapiens
auccaacuccagcaacu

SEQ ID NO: 592646 - RNA, 16 nt, Homo sapiens
auccaagaaucaguga

SEQ ID NO: 592647 - RNA, 23 nt, Homo sapiens
auccaagacuuagagcugggaau

SEQ ID NO: 592648 - RNA, 23 nt, Homo sapiens
auccaagcaucccuuugcccaga

SEQ ID NO: 592649 - RNA, 18 nt, Homo sapiens
auccaauccucacugggu

SEQ ID NO: 592650 - RNA, 14 nt, Homo sapiens
auccaauguaugaa

SEQ ID NO: 592651 - RNA, 21 nt, Homo sapiens
auccacaccguacaucugcaa

SEQ ID NO: 592652 - RNA, 12 nt, Homo sapiens
auccacacugag

SEQ ID NO: 592653 - RNA, 13 nt, Homo sapiens
auccacacugaga

SEQ ID NO: 592654 - RNA, 14 nt, Homo sapiens
auccacacugagag

SEQ ID NO: 592655 - RNA, 13 nt, Homo sapiens
auccacauccucu

SEQ ID NO: 592656 - RNA, 14 nt, Homo sapiens
auccacauccucua

SEQ ID NO: 592657 - RNA, 12 nt, Homo sapiens
auccacauggga

SEQ ID NO: 592658 - RNA, 21 nt, Homo sapiens
auccacccaacccuaucuccu

SEQ ID NO: 592659 - RNA, 22 nt, Homo sapiens
auccacccaacccuaucuccug

SEQ ID NO: 592660 - RNA, 16 nt, Homo sapiens
auccacccaccucagc

SEQ ID NO: 592661 - RNA, 22 nt, Homo sapiens
auccaccugcuuaugcauuuau

SEQ ID NO: 592662 - RNA, 14 nt, Homo sapiens
auccacuucucuca

SEQ ID NO: 592663 - RNA, 14 nt, Homo sapiens
auccacuuugacuc

SEQ ID NO: 592664 - RNA, 14 nt, Homo sapiens
auccagaagccagu

SEQ ID NO: 592665 - RNA, 21 nt, Homo sapiens
auccagaagguuugcaccccu

SEQ ID NO: 592666 - RNA, 18 nt, Homo sapiens
auccagaccaaccuucca

SEQ ID NO: 592667 - RNA, 16 nt, Homo sapiens
auccagagcagaguuu

SEQ ID NO: 592668 - RNA, 19 nt, Homo sapiens
auccagauguuaugcuccu

SEQ ID NO: 592669 - RNA, 15 nt, Homo sapiens
auccagccagacccc

SEQ ID NO: 592670 - RNA, 14 nt, Homo sapiens
auccagcuaugaau

SEQ ID NO: 592671 - RNA, 19 nt, Homo sapiens
auccaggcccaacugugag

SEQ ID NO: 592672 - RNA, 14 nt, Homo sapiens
auccaggcuuugua

SEQ ID NO: 592673 - RNA, 16 nt, Homo sapiens
auccaggcuuuguaca

SEQ ID NO: 592674 - RNA, 19 nt, Homo sapiens
auccagguaauccaagaua

SEQ ID NO: 592675 - RNA, 12 nt, Homo sapiens
auccagugacaa

SEQ ID NO: 592676 - RNA, 13 nt, Homo sapiens
auccagugacaug

SEQ ID NO: 592677 - RNA, 18 nt, Homo sapiens
auccaguguauaaaucca

SEQ ID NO: 592678 - RNA, 18 nt, Homo sapiens
auccauaaauguguuccu

SEQ ID NO: 592679 - RNA, 14 nt, Homo sapiens
auccauaacugaac

SEQ ID NO: 592680 - RNA, 16 nt, Homo sapiens
auccauauuuuacuga

SEQ ID NO: 592681 - RNA, 24 nt, Homo sapiens
auccauccuugccaauagugucau

SEQ ID NO: 592682 - RNA, 12 nt, Homo sapiens
auccaucucuca

SEQ ID NO: 592683 - RNA, 20 nt, Homo sapiens
auccaugcaccuaccuuaga

SEQ ID NO: 592684 - RNA, 12 nt, Homo sapiens
auccaugcccuc

SEQ ID NO: 592685 - RNA, 18 nt, Homo sapiens
auccauuccaaaauacaa

SEQ ID NO: 592686 - RNA, 23 nt, Homo sapiens
auccauuuguuuucacacugaua

SEQ ID NO: 592687 - RNA, 14 nt, Homo sapiens
auccauuuuacaca

SEQ ID NO: 592688 - RNA, 17 nt, Homo sapiens
auccauuuuacacagca

SEQ ID NO: 592689 - RNA, 23 nt, Homo sapiens
aucccaaacuuuaaaaugcgaaa

SEQ ID NO: 592690 - RNA, 18 nt, Homo sapiens
aucccaagcaucauauca

SEQ ID NO: 592691 - RNA, 15 nt, Homo sapiens
aucccaagucauuuc

SEQ ID NO: 592692 - RNA, 15 nt, Homo sapiens
aucccaauaggcaga

SEQ ID NO: 592693 - RNA, 18 nt, Homo sapiens
aucccaauccuuauccca

SEQ ID NO: 592694 - RNA, 23 nt, Homo sapiens
aucccacucuucuugcagcuguu

SEQ ID NO: 592695 - RNA, 13 nt, Homo sapiens
aucccacuguaug

SEQ ID NO: 592696 - RNA, 17 nt, Homo sapiens
aucccagcuacucaaga

SEQ ID NO: 592697 - RNA, 21 nt, Homo sapiens
aucccaggggaccacaccucc

SEQ ID NO: 592698 - RNA, 21 nt, Homo sapiens
aucccagucacuccucucuag

SEQ ID NO: 592699 - RNA, 22 nt, Homo sapiens
aucccaucgucucggccuucac

SEQ ID NO: 592700 - RNA, 16 nt, Homo sapiens
aucccauggaaccacu

SEQ ID NO: 592701 - RNA, 15 nt, Homo sapiens
aucccauuggcaaaa

SEQ ID NO: 592702 - RNA, 16 nt, Homo sapiens
aucccauuuuauccca

SEQ ID NO: 592703 - RNA, 23 nt, Homo sapiens
auccccaacuaugcaugccaagg

SEQ ID NO: 592704 - RNA, 11 nt, Homo sapiens
auccccacugu

SEQ ID NO: 592705 - RNA, 20 nt, Homo sapiens
auccccagccacaacugcca

SEQ ID NO: 592706 - RNA, 21 nt, Homo sapiens
aucccccacagccacuacuga

SEQ ID NO: 592707 - RNA, 17 nt, Homo sapiens
aucccccucuuugcaca

SEQ ID NO: 592708 - RNA, 14 nt, Homo sapiens
aucccccuguggaa

SEQ ID NO: 592709 - RNA, 22 nt, Homo sapiens
auccccggugguuuugugcuca

SEQ ID NO: 592710 - RNA, 22 nt, Homo sapiens
auccccuaagcagaccacugau

SEQ ID NO: 592711 - RNA, 16 nt, Homo sapiens
auccccuggacuggga

SEQ ID NO: 592712 - RNA, 17 nt, Homo sapiens
auccccuggacugggag

SEQ ID NO: 592713 - RNA, 18 nt, Homo sapiens
aucccgagguauggcaga

SEQ ID NO: 592714 - RNA, 18 nt, Homo sapiens
aucccgugaaagaauuau

SEQ ID NO: 592715 - RNA, 14 nt, Homo sapiens
aucccuacaaaaaa

SEQ ID NO: 592716 - RNA, 14 nt, Homo sapiens
aucccuacauguau

SEQ ID NO: 592717 - RNA, 12 nt, Homo sapiens
aucccuaccccc

SEQ ID NO: 592718 - RNA, 22 nt, Homo sapiens
aucccuccacccccauguggca

SEQ ID NO: 592719 - RNA, 19 nt, Homo sapiens
aucccucuccaacugccua

SEQ ID NO: 592720 - RNA, 18 nt, Homo sapiens
aucccugaaacaucucaa

SEQ ID NO: 592721 - RNA, 21 nt, Homo sapiens
aucccugaaacaucucaacaa

SEQ ID NO: 592722 - RNA, 22 nt, Homo sapiens
aucccugacaucuggaaucugg

SEQ ID NO: 592723 - RNA, 13 nt, Homo sapiens
aucccugccacug

SEQ ID NO: 592724 - RNA, 16 nt, Homo sapiens
aucccugccuguuaag

SEQ ID NO: 592725 - RNA, 18 nt, Homo sapiens
aucccugucauuuuuaac

SEQ ID NO: 592726 - RNA, 17 nt, Homo sapiens
aucccuuaacaguugua

SEQ ID NO: 592727 - RNA, 22 nt, Homo sapiens
aucccuuaaccugccaccagug

SEQ ID NO: 592728 - RNA, 13 nt, Homo sapiens
aucccuuacucca

SEQ ID NO: 592729 - RNA, 13 nt, Homo sapiens
aucccuuccccag

SEQ ID NO: 592730 - RNA, 23 nt, Homo sapiens
aucccuuugucugucaaucacag

SEQ ID NO: 592731 - RNA, 20 nt, Homo sapiens
aucccuuuuucaaugaauuu

SEQ ID NO: 592732 - RNA, 22 nt, Homo sapiens
auccgaggcagggucaggagag

SEQ ID NO: 592733 - RNA, 19 nt, Homo sapiens
auccgauuccccuguagca

SEQ ID NO: 592734 - RNA, 18 nt, Homo sapiens
auccgggagacugacacg

SEQ ID NO: 592735 - RNA, 17 nt, Homo sapiens
auccguaguucccugaa

SEQ ID NO: 592736 - RNA, 15 nt, Homo sapiens
auccuaacacauuau

SEQ ID NO: 592737 - RNA, 13 nt, Homo sapiens
auccuaagacaca

SEQ ID NO: 592738 - RNA, 15 nt, Homo sapiens
auccuaagacacaaa

SEQ ID NO: 592739 - RNA, 13 nt, Homo sapiens
auccuaagcaaaa

SEQ ID NO: 592740 - RNA, 12 nt, Homo sapiens
auccuaccccac

SEQ ID NO: 592741 - RNA, 20 nt, Homo sapiens
auccuaccccuuugcacuug

SEQ ID NO: 592742 - RNA, 21 nt, Homo sapiens
auccuaccccuuugcacuugu

SEQ ID NO: 592743 - RNA, 12 nt, Homo sapiens
auccuaggacag

SEQ ID NO: 592744 - RNA, 18 nt, Homo sapiens
auccuauaagaugacaau

SEQ ID NO: 592745 - RNA, 20 nt, Homo sapiens
auccuaucacagucuacuga

SEQ ID NO: 592746 - RNA, 20 nt, Homo sapiens
auccuauccuccuaccucca

SEQ ID NO: 592747 - RNA, 15 nt, Homo sapiens
auccuaucuggggag

SEQ ID NO: 592748 - RNA, 13 nt, Homo sapiens
auccuauggaaaa

SEQ ID NO: 592749 - RNA, 18 nt, Homo sapiens
auccucaaacgacagagg

SEQ ID NO: 592750 - RNA, 17 nt, Homo sapiens
auccucaagcucagggc

SEQ ID NO: 592751 - RNA, 23 nt, Homo sapiens
auccucaauucaauguggugaug

SEQ ID NO: 592752 - RNA, 14 nt, Homo sapiens
auccucacagugaa

SEQ ID NO: 592753 - RNA, 13 nt, Homo sapiens
auccucacugugg

SEQ ID NO: 592754 - RNA, 17 nt, Homo sapiens
auccucaugguucccaa

SEQ ID NO: 592755 - RNA, 13 nt, Homo sapiens
auccuccacugac

SEQ ID NO: 592756 - RNA, 22 nt, Homo sapiens
auccuccacugacuuccuccca

SEQ ID NO: 592757 - RNA, 12 nt, Homo sapiens
auccuccauugc

SEQ ID NO: 592758 - RNA, 15 nt, Homo sapiens
auccuccauugcucc

SEQ ID NO: 592759 - RNA, 21 nt, Homo sapiens
auccuccccaggaccccuguc

SEQ ID NO: 592760 - RNA, 15 nt, Homo sapiens
auccuccuaccucca

SEQ ID NO: 592761 - RNA, 23 nt, Homo sapiens
auccucucccccuccuccaggga

SEQ ID NO: 592762 - RNA, 23 nt, Homo sapiens
auccucuguaaaaagaucccuga

SEQ ID NO: 592763 - RNA, 23 nt, Homo sapiens
auccugaauuccagcaaaagagc

SEQ ID NO: 592764 - RNA, 13 nt, Homo sapiens
auccugaccagcu

SEQ ID NO: 592765 - RNA, 23 nt, Homo sapiens
auccugagcagugccagcuuucu

SEQ ID NO: 592766 - RNA, 12 nt, Homo sapiens
auccugauccca

SEQ ID NO: 592767 - RNA, 21 nt, Homo sapiens
auccugauuccaaauauguau

SEQ ID NO: 592768 - RNA, 14 nt, Homo sapiens
auccugcaaaggcc

SEQ ID NO: 592769 - RNA, 17 nt, Homo sapiens
auccugcaaggugaaac

SEQ ID NO: 592770 - RNA, 14 nt, Homo sapiens
auccugcccagugu

SEQ ID NO: 592771 - RNA, 22 nt, Homo sapiens
auccugcccucacaucuuccac

SEQ ID NO: 592772 - RNA, 17 nt, Homo sapiens
auccugccucuccccaa

SEQ ID NO: 592773 - RNA, 18 nt, Homo sapiens
auccugcuagcuguagaa

SEQ ID NO: 592774 - RNA, 15 nt, Homo sapiens
auccugcucuucugu

SEQ ID NO: 592775 - RNA, 23 nt, Homo sapiens
auccuggaaggacacagugauga

SEQ ID NO: 592776 - RNA, 15 nt, Homo sapiens
auccuggagugauau

SEQ ID NO: 592777 - RNA, 16 nt, Homo sapiens
auccugggauccagug

SEQ ID NO: 592778 - RNA, 20 nt, Homo sapiens
auccugggggaccaaugagg

SEQ ID NO: 592779 - RNA, 22 nt, Homo sapiens
auccugggggacccaauguagg

SEQ ID NO: 592780 - RNA, 19 nt, Homo sapiens
auccugggggccuggguug

SEQ ID NO: 592781 - RNA, 21 nt, Homo sapiens
auccuggguacugaaagccuu

SEQ ID NO: 592782 - RNA, 22 nt, Homo sapiens
auccuggguacugaaagccuua

SEQ ID NO: 592783 - RNA, 22 nt, Homo sapiens
auccugguuucauaacuuccug

SEQ ID NO: 592784 - RNA, 23 nt, Homo sapiens
auccuguaguacaagauuaucuu

SEQ ID NO: 592785 - RNA, 11 nt, Homo sapiens
auccugugaag

SEQ ID NO: 592786 - RNA, 16 nt, Homo sapiens
auccugugacauguaa

SEQ ID NO: 592787 - RNA, 22 nt, Homo sapiens
auccuguuacuugcuucagugg

SEQ ID NO: 592788 - RNA, 20 nt, Homo sapiens
auccuguuuuuagugcugac

SEQ ID NO: 592789 - RNA, 17 nt, Homo sapiens
auccuuaaaacaauucu

SEQ ID NO: 592790 - RNA, 20 nt, Homo sapiens
auccuucacaggcagugcau

SEQ ID NO: 592791 - RNA, 21 nt, Homo sapiens
auccuuccacuaucauuccca

SEQ ID NO: 592792 - RNA, 18 nt, Homo sapiens
auccuucuaguuucccac

SEQ ID NO: 592793 - RNA, 22 nt, Homo sapiens
auccuucuccaccaaagacagu

SEQ ID NO: 592794 - RNA, 18 nt, Homo sapiens
auccuugcuuuaccacaa

SEQ ID NO: 592795 - RNA, 13 nt, Homo sapiens
auccuuuacuguu

SEQ ID NO: 592796 - RNA, 19 nt, Homo sapiens
auccuuuagugcacccagu

SEQ ID NO: 592797 - RNA, 21 nt, Homo sapiens
auccuuuagugcacccaguga

SEQ ID NO: 592798 - RNA, 15 nt, Homo sapiens
auccuuuccucuagc

SEQ ID NO: 592799 - RNA, 14 nt, Homo sapiens
aucgaacacauuca

SEQ ID NO: 592800 - RNA, 14 nt, Homo sapiens
aucgagagaagcug

SEQ ID NO: 592801 - RNA, 17 nt, Homo sapiens
aucgagagugugcucuc

SEQ ID NO: 592802 - RNA, 16 nt, Homo sapiens
aucgauauuagaagcu

SEQ ID NO: 592803 - RNA, 22 nt, Homo sapiens
aucgcauauuaguuaaucuccu

SEQ ID NO: 592804 - RNA, 17 nt, Homo sapiens
aucggagacagugaucu

SEQ ID NO: 592805 - RNA, 18 nt, Homo sapiens
aucggccaucaagggaag

SEQ ID NO: 592806 - RNA, 14 nt, Homo sapiens
aucgggaagcagaa

SEQ ID NO: 592807 - RNA, 16 nt, Homo sapiens
aucgggagcagugucu

SEQ ID NO: 592808 - RNA, 13 nt, Homo sapiens
aucgguaggcaaa

SEQ ID NO: 592809 - RNA, 20 nt, Homo sapiens
aucgucacugcuuaacuuca

SEQ ID NO: 592810 - RNA, 21 nt, Homo sapiens
aucgucacugcuuaacuucac

SEQ ID NO: 592811 - RNA, 19 nt, Homo sapiens
aucgucaggaaaccaaaua

SEQ ID NO: 592812 - RNA, 17 nt, Homo sapiens
aucgugaucacugagcc

SEQ ID NO: 592813 - RNA, 12 nt, Homo sapiens
aucgugcuaaau

SEQ ID NO: 592814 - RNA, 17 nt, Homo sapiens
aucguguccugaaaauc

SEQ ID NO: 592815 - RNA, 14 nt, Homo sapiens
aucguuuugcccga

SEQ ID NO: 592816 - RNA, 17 nt, Homo sapiens
aucuaaaaacuuagaaa

SEQ ID NO: 592817 - RNA, 13 nt, Homo sapiens
aucuaaccacuua

SEQ ID NO: 592818 - RNA, 17 nt, Homo sapiens
aucuaagaaaaggggag

SEQ ID NO: 592819 - RNA, 13 nt, Homo sapiens
aucuaagaccacg

SEQ ID NO: 592820 - RNA, 14 nt, Homo sapiens
aucuaaggauguca

SEQ ID NO: 592821 - RNA, 16 nt, Homo sapiens
aucuaaugugaaguag

SEQ ID NO: 592822 - RNA, 17 nt, Homo sapiens
aucuaauuacagccuua

SEQ ID NO: 592823 - RNA, 14 nt, Homo sapiens
aucuacaacuccaa

SEQ ID NO: 592824 - RNA, 21 nt, Homo sapiens
aucuacaagauccuccugcug

SEQ ID NO: 592825 - RNA, 17 nt, Homo sapiens
aucuacaauacauauau

SEQ ID NO: 592826 - RNA, 13 nt, Homo sapiens
aucuacacuucgc

SEQ ID NO: 592827 - RNA, 14 nt, Homo sapiens
aucuacagaacugg

SEQ ID NO: 592828 - RNA, 15 nt, Homo sapiens
aucuacaguaaugaa

SEQ ID NO: 592829 - RNA, 14 nt, Homo sapiens
aucuaccacuguau

SEQ ID NO: 592830 - RNA, 14 nt, Homo sapiens
aucuaccagcauaa

SEQ ID NO: 592831 - RNA, 18 nt, Homo sapiens
aucuacccugcugaccuc

SEQ ID NO: 592832 - RNA, 16 nt, Homo sapiens
aucuacuaauuccaca

SEQ ID NO: 592833 - RNA, 21 nt, Homo sapiens
aucuacuacaaacuucaaaga

SEQ ID NO: 592834 - RNA, 19 nt, Homo sapiens
aucuacugaaugaccucuc

SEQ ID NO: 592835 - RNA, 18 nt, Homo sapiens
aucuacuuuuuguauuua

SEQ ID NO: 592836 - RNA, 14 nt, Homo sapiens
aucuagaagacugu

SEQ ID NO: 592837 - RNA, 13 nt, Homo sapiens
aucuaguuuacag

SEQ ID NO: 592838 - RNA, 15 nt, Homo sapiens
aucuauaaacagaca

SEQ ID NO: 592839 - RNA, 19 nt, Homo sapiens
aucuauaauuuaccuaaga

SEQ ID NO: 592840 - RNA, 16 nt, Homo sapiens
aucuauagaacaucca

SEQ ID NO: 592841 - RNA, 18 nt, Homo sapiens
aucuauagcuaaguacac

SEQ ID NO: 592842 - RNA, 22 nt, Homo sapiens
aucuauagcuaaguacacaaua

SEQ ID NO: 592843 - RNA, 17 nt, Homo sapiens
aucuauaggcagcuucu

SEQ ID NO: 592844 - RNA, 18 nt, Homo sapiens
aucuauaguucacugaca

SEQ ID NO: 592845 - RNA, 20 nt, Homo sapiens
aucuauauauguguauguac

SEQ ID NO: 592846 - RNA, 22 nt, Homo sapiens
aucuauauguacuugucaaaga

SEQ ID NO: 592847 - RNA, 21 nt, Homo sapiens
aucuaugccuaaaaaguauca

SEQ ID NO: 592848 - RNA, 19 nt, Homo sapiens
aucuauggaaaugugagaa

SEQ ID NO: 592849 - RNA, 13 nt, Homo sapiens
aucuauuaucuca

SEQ ID NO: 592850 - RNA, 15 nt, Homo sapiens
aucuauuauuacaca

SEQ ID NO: 592851 - RNA, 16 nt, Homo sapiens
aucuauuccuguaaau

SEQ ID NO: 592852 - RNA, 13 nt, Homo sapiens
aucuauuuauuaa

SEQ ID NO: 592853 - RNA, 16 nt, Homo sapiens
aucuauuucugagaag

SEQ ID NO: 592854 - RNA, 15 nt, Homo sapiens
aucucaaacuacugg

SEQ ID NO: 592855 - RNA, 15 nt, Homo sapiens
aucucaaagaaggca

SEQ ID NO: 592856 - RNA, 16 nt, Homo sapiens
aucucaacagaauuaa

SEQ ID NO: 592857 - RNA, 22 nt, Homo sapiens
aucucacaccaguccaaauggc

SEQ ID NO: 592858 - RNA, 21 nt, Homo sapiens
aucucacuggaugcaaagaaa

SEQ ID NO: 592859 - RNA, 16 nt, Homo sapiens
aucucagagcauuuca

SEQ ID NO: 592860 - RNA, 17 nt, Homo sapiens
aucucagagcauuucaa

SEQ ID NO: 592861 - RNA, 16 nt, Homo sapiens
aucucagcaaugauua

SEQ ID NO: 592862 - RNA, 13 nt, Homo sapiens
aucucagcacuuu

SEQ ID NO: 592863 - RNA, 14 nt, Homo sapiens
aucucagcacuuug

SEQ ID NO: 592864 - RNA, 22 nt, Homo sapiens
aucucagcuaacauuccauguu

SEQ ID NO: 592865 - RNA, 22 nt, Homo sapiens
aucucaggaaaaucugugauua

SEQ ID NO: 592866 - RNA, 20 nt, Homo sapiens
aucucaggauuucaccagaa

SEQ ID NO: 592867 - RNA, 18 nt, Homo sapiens
aucucaggccaccugccc

SEQ ID NO: 592868 - RNA, 19 nt, Homo sapiens
aucucaggccaccugcccc

SEQ ID NO: 592869 - RNA, 19 nt, Homo sapiens
aucucauacugucugggau

SEQ ID NO: 592870 - RNA, 23 nt, Homo sapiens
aucucauaggaagagccaggaca

SEQ ID NO: 592871 - RNA, 22 nt, Homo sapiens
aucucaugccccuggcugggac

SEQ ID NO: 592872 - RNA, 22 nt, Homo sapiens
aucucauuuuacacaaagggaa

SEQ ID NO: 592873 - RNA, 20 nt, Homo sapiens
aucuccaguauucuugucaa

SEQ ID NO: 592874 - RNA, 15 nt, Homo sapiens
aucuccagugugcca

SEQ ID NO: 592875 - RNA, 17 nt, Homo sapiens
aucuccauaaacaugaa

SEQ ID NO: 592876 - RNA, 15 nt, Homo sapiens
aucuccaucucaaaa

SEQ ID NO: 592877 - RNA, 15 nt, Homo sapiens
aucucccagcaagac

SEQ ID NO: 592878 - RNA, 18 nt, Homo sapiens
aucucccagugacaacau

SEQ ID NO: 592879 - RNA, 15 nt, Homo sapiens
aucucccauguguag

SEQ ID NO: 592880 - RNA, 18 nt, Homo sapiens
aucuccccucagauucca

SEQ ID NO: 592881 - RNA, 20 nt, Homo sapiens
aucuccuccaauguccugaa

SEQ ID NO: 592882 - RNA, 15 nt, Homo sapiens
aucuccugcugccuu

SEQ ID NO: 592883 - RNA, 20 nt, Homo sapiens
aucucgcaguacauguuacu

SEQ ID NO: 592884 - RNA, 17 nt, Homo sapiens
aucucggcucacugcaa

SEQ ID NO: 592885 - RNA, 22 nt, Homo sapiens
aucucggcucacugcaaccucu

SEQ ID NO: 592886 - RNA, 17 nt, Homo sapiens
aucucggcuuauggcaa

SEQ ID NO: 592887 - RNA, 16 nt, Homo sapiens
aucucuaauauggcaa

SEQ ID NO: 592888 - RNA, 19 nt, Homo sapiens
aucucuaauuagucuauca

SEQ ID NO: 592889 - RNA, 23 nt, Homo sapiens
aucucuaauuggaagaaauuccu

SEQ ID NO: 592890 - RNA, 16 nt, Homo sapiens
aucucuacuaccacaa

SEQ ID NO: 592891 - RNA, 17 nt, Homo sapiens
aucucuagaugcaaaua

SEQ ID NO: 592892 - RNA, 18 nt, Homo sapiens
aucucuagaugcaaauac

SEQ ID NO: 592893 - RNA, 20 nt, Homo sapiens
aucucuauuaaaauacaaaa

SEQ ID NO: 592894 - RNA, 15 nt, Homo sapiens
aucucucccacuucc

SEQ ID NO: 592895 - RNA, 22 nt, Homo sapiens
aucucucccuccccugccauuu

SEQ ID NO: 592896 - RNA, 14 nt, Homo sapiens
aucucucuacucag

SEQ ID NO: 592897 - RNA, 14 nt, Homo sapiens
aucucucuuuacau

SEQ ID NO: 592898 - RNA, 20 nt, Homo sapiens
aucucugaagcauguuucau

SEQ ID NO: 592899 - RNA, 13 nt, Homo sapiens
aucucugccauau

SEQ ID NO: 592900 - RNA, 17 nt, Homo sapiens
aucucugccauaucagu

SEQ ID NO: 592901 - RNA, 18 nt, Homo sapiens
aucucugcccucuucuca

SEQ ID NO: 592902 - RNA, 16 nt, Homo sapiens
aucucuguuucuucaa

SEQ ID NO: 592903 - RNA, 22 nt, Homo sapiens
aucucuuaauauugagaaucag

SEQ ID NO: 592904 - RNA, 19 nt, Homo sapiens
aucucuucaugcuugacau

SEQ ID NO: 592905 - RNA, 16 nt, Homo sapiens
aucucuuccacauggg

SEQ ID NO: 592906 - RNA, 15 nt, Homo sapiens
aucucuuccccagag

SEQ ID NO: 592907 - RNA, 22 nt, Homo sapiens
aucucuucuuugcugcagucau

SEQ ID NO: 592908 - RNA, 16 nt, Homo sapiens
aucucuugaaaccugu

SEQ ID NO: 592909 - RNA, 14 nt, Homo sapiens
aucugaaauucaaa

SEQ ID NO: 592910 - RNA, 13 nt, Homo sapiens
aucugaacucuca

SEQ ID NO: 592911 - RNA, 16 nt, Homo sapiens
aucugacucacaagaa

SEQ ID NO: 592912 - RNA, 22 nt, Homo sapiens
aucugacugagagcccacugca

SEQ ID NO: 592913 - RNA, 19 nt, Homo sapiens
aucugagaaaaaaagugag

SEQ ID NO: 592914 - RNA, 18 nt, Homo sapiens
aucugagggaagauuuau

SEQ ID NO: 592915 - RNA, 16 nt, Homo sapiens
aucugagguuggauuu

SEQ ID NO: 592916 - RNA, 15 nt, Homo sapiens
aucugaguuacagaa

SEQ ID NO: 592917 - RNA, 19 nt, Homo sapiens
aucugaguugccaagacaa

SEQ ID NO: 592918 - RNA, 23 nt, Homo sapiens
aucugaguugccaagacaaauca

SEQ ID NO: 592919 - RNA, 20 nt, Homo sapiens
aucugauuguugucaggcca

SEQ ID NO: 592920 - RNA, 20 nt, Homo sapiens
aucugauuuccuaaugucag

SEQ ID NO: 592921 - RNA, 18 nt, Homo sapiens
aucugcaaacaugccagg

SEQ ID NO: 592922 - RNA, 16 nt, Homo sapiens
aucugcaacaaaaagu

SEQ ID NO: 592923 - RNA, 16 nt, Homo sapiens
aucugcaccaccaugc

SEQ ID NO: 592924 - RNA, 14 nt, Homo sapiens
aucugcagcuaacu

SEQ ID NO: 592925 - RNA, 22 nt, Homo sapiens
aucugcagggagcaacucucca

SEQ ID NO: 592926 - RNA, 22 nt, Homo sapiens
aucugcauccagccuccugcua

SEQ ID NO: 592927 - RNA, 18 nt, Homo sapiens
aucugcauuuucacccca

SEQ ID NO: 592928 - RNA, 15 nt, Homo sapiens
aucugccacaaaaac

SEQ ID NO: 592929 - RNA, 16 nt, Homo sapiens
aucugccuaugucaua

SEQ ID NO: 592930 - RNA, 17 nt, Homo sapiens
aucugccuuaaaaccaa

SEQ ID NO: 592931 - RNA, 20 nt, Homo sapiens
aucugcuagggaauaucaau

SEQ ID NO: 592932 - RNA, 21 nt, Homo sapiens
aucugcucuuaggugcuucuu

SEQ ID NO: 592933 - RNA, 20 nt, Homo sapiens
aucugcugcaguuaccacag

SEQ ID NO: 592934 - RNA, 20 nt, Homo sapiens
aucuggaacaacuuguagca

SEQ ID NO: 592935 - RNA, 22 nt, Homo sapiens
aucuggaaguaaccauuugcac

SEQ ID NO: 592936 - RNA, 13 nt, Homo sapiens
aucuggaaguuga

SEQ ID NO: 592937 - RNA, 20 nt, Homo sapiens
aucuggacauucgaggaauu

SEQ ID NO: 592938 - RNA, 21 nt, Homo sapiens
aucuggaccccaucugugaau

SEQ ID NO: 592939 - RNA, 13 nt, Homo sapiens
aucuggacuuccu

SEQ ID NO: 592940 - RNA, 18 nt, Homo sapiens
aucuggcccucgacacuc

SEQ ID NO: 592941 - RNA, 23 nt, Homo sapiens
aucuggcccuugcuuaccucuca

SEQ ID NO: 592942 - RNA, 18 nt, Homo sapiens
aucuggccuaauguucca

SEQ ID NO: 592943 - RNA, 15 nt, Homo sapiens
aucugggauucccac

SEQ ID NO: 592944 - RNA, 18 nt, Homo sapiens
aucugggucuuaguucug

SEQ ID NO: 592945 - RNA, 20 nt, Homo sapiens
aucuggguuaauucauuugg

SEQ ID NO: 592946 - RNA, 19 nt, Homo sapiens
aucugguauaugucauuau

SEQ ID NO: 592947 - RNA, 14 nt, Homo sapiens
aucuguacauauua

SEQ ID NO: 592948 - RNA, 15 nt, Homo sapiens
aucuguaccaugacc

SEQ ID NO: 592949 - RNA, 14 nt, Homo sapiens
aucugucauuugag

SEQ ID NO: 592950 - RNA, 18 nt, Homo sapiens
aucugucuguccuacccg

SEQ ID NO: 592951 - RNA, 21 nt, Homo sapiens
aucugucuucagcacauucca

SEQ ID NO: 592952 - RNA, 18 nt, Homo sapiens
aucugucuuucacuggaa

SEQ ID NO: 592953 - RNA, 19 nt, Homo sapiens
aucugucuuuuauuuaaca

SEQ ID NO: 592954 - RNA, 22 nt, Homo sapiens
aucuguguuuuauugacaucuc

SEQ ID NO: 592955 - RNA, 20 nt, Homo sapiens
aucuguuaccagaggacaaa

SEQ ID NO: 592956 - RNA, 15 nt, Homo sapiens
aucuguucaauguuu

SEQ ID NO: 592957 - RNA, 14 nt, Homo sapiens
aucuguucaguguu

SEQ ID NO: 592958 - RNA, 11 nt, Homo sapiens
aucuguugccu

SEQ ID NO: 592959 - RNA, 23 nt, Homo sapiens
aucuguuugugcaaacauaauac

SEQ ID NO: 592960 - RNA, 16 nt, Homo sapiens
aucuguuuuucaugua

SEQ ID NO: 592961 - RNA, 21 nt, Homo sapiens
aucuuaaaaaucuaugccuaa

SEQ ID NO: 592962 - RNA, 17 nt, Homo sapiens
aucuuaaaagcuaucuu

SEQ ID NO: 592963 - RNA, 13 nt, Homo sapiens
aucuuaaacaaug

SEQ ID NO: 592964 - RNA, 19 nt, Homo sapiens
aucuuaaaugacagugaau

SEQ ID NO: 592965 - RNA, 14 nt, Homo sapiens
aucuuaagauccac

SEQ ID NO: 592966 - RNA, 12 nt, Homo sapiens
aucuuaauguau

SEQ ID NO: 592967 - RNA, 23 nt, Homo sapiens
aucuuaauucccaucucuauacu

SEQ ID NO: 592968 - RNA, 15 nt, Homo sapiens
aucuuacaaaauccu

SEQ ID NO: 592969 - RNA, 23 nt, Homo sapiens
aucuuaccagaugcuacuggacu

SEQ ID NO: 592970 - RNA, 12 nt, Homo sapiens
aucuuacuguac

SEQ ID NO: 592971 - RNA, 15 nt, Homo sapiens
aucuuacuguaccug

SEQ ID NO: 592972 - RNA, 20 nt, Homo sapiens
aucuuagacccgguccugcc

SEQ ID NO: 592973 - RNA, 23 nt, Homo sapiens
aucuuagcuucuauuauagccac

SEQ ID NO: 592974 - RNA, 16 nt, Homo sapiens
aucuuaguguucaaaa

SEQ ID NO: 592975 - RNA, 19 nt, Homo sapiens
aucuuauacuguacaauaa

SEQ ID NO: 592976 - RNA, 18 nt, Homo sapiens
aucuuaucccuugacaaa

SEQ ID NO: 592977 - RNA, 13 nt, Homo sapiens
aucuuaugcuauu

SEQ ID NO: 592978 - RNA, 15 nt, Homo sapiens
aucuucaaacuuuca

SEQ ID NO: 592979 - RNA, 19 nt, Homo sapiens
aucuucaaagcuugaagau

SEQ ID NO: 592980 - RNA, 17 nt, Homo sapiens
aucuucacaaaacacuu

SEQ ID NO: 592981 - RNA, 18 nt, Homo sapiens
aucuucacugucugacuu

SEQ ID NO: 592982 - RNA, 23 nt, Homo sapiens
aucuucacuucuaaaugcauauc

SEQ ID NO: 592983 - RNA, 18 nt, Homo sapiens
aucuucaggugaacacuu

SEQ ID NO: 592984 - RNA, 13 nt, Homo sapiens
aucuuccaagggu

SEQ ID NO: 592985 - RNA, 22 nt, Homo sapiens
aucuuccaaggguacuaaggaa

SEQ ID NO: 592986 - RNA, 15 nt, Homo sapiens
aucuuccaccagcac

SEQ ID NO: 592987 - RNA, 20 nt, Homo sapiens
aucuucuaaacccaauccaa

SEQ ID NO: 592988 - RNA, 13 nt, Homo sapiens
aucuucugaauuu

SEQ ID NO: 592989 - RNA, 21 nt, Homo sapiens
aucuucugugcccagcacagu

SEQ ID NO: 592990 - RNA, 15 nt, Homo sapiens
aucuucuuaugcaau

SEQ ID NO: 592991 - RNA, 21 nt, Homo sapiens
aucuucuucauccaacuucca

SEQ ID NO: 592992 - RNA, 22 nt, Homo sapiens
aucuucuuuauaauucuacuuu

SEQ ID NO: 592993 - RNA, 14 nt, Homo sapiens
aucuugaauagucu

SEQ ID NO: 592994 - RNA, 15 nt, Homo sapiens
aucuugauacauuca

SEQ ID NO: 592995 - RNA, 18 nt, Homo sapiens
aucuugcaacucuguaaa

SEQ ID NO: 592996 - RNA, 19 nt, Homo sapiens
aucuugcaacuuguuaaau

SEQ ID NO: 592997 - RNA, 15 nt, Homo sapiens
aucuugcaagcaaau

SEQ ID NO: 592998 - RNA, 16 nt, Homo sapiens
aucuugcaguuuugua

SEQ ID NO: 592999 - RNA, 20 nt, Homo sapiens
aucuugccuaaaucccaaga

SEQ ID NO: 593000 - RNA, 15 nt, Homo sapiens
aucuugccugcauga

SEQ ID NO: 593001 - RNA, 17 nt, Homo sapiens
aucuugcuuuuuuucac

SEQ ID NO: 593002 - RNA, 18 nt, Homo sapiens
aucuuggagggaccaagg

SEQ ID NO: 593003 - RNA, 14 nt, Homo sapiens
aucuuguaaaggau

SEQ ID NO: 593004 - RNA, 15 nt, Homo sapiens
aucuuguaggaucua

SEQ ID NO: 593005 - RNA, 15 nt, Homo sapiens
aucuugucucaaaaa

SEQ ID NO: 593006 - RNA, 13 nt, Homo sapiens
aucuugugcucag

SEQ ID NO: 593007 - RNA, 13 nt, Homo sapiens
aucuugugugauu

SEQ ID NO: 593008 - RNA, 16 nt, Homo sapiens
aucuuguuacugcuga

SEQ ID NO: 593009 - RNA, 15 nt, Homo sapiens
aucuuguuacuguga

SEQ ID NO: 593010 - RNA, 17 nt, Homo sapiens
aucuuguuacugugaua

SEQ ID NO: 593011 - RNA, 22 nt, Homo sapiens
aucuuguuuugaaaauaaccua

SEQ ID NO: 593012 - RNA, 17 nt, Homo sapiens
aucuuuaaacauuucaa

SEQ ID NO: 593013 - RNA, 16 nt, Homo sapiens
aucuuuaaacugcuuu

SEQ ID NO: 593014 - RNA, 15 nt, Homo sapiens
aucuuuaacacagcc

SEQ ID NO: 593015 - RNA, 16 nt, Homo sapiens
aucuuuaccacugcag

SEQ ID NO: 593016 - RNA, 23 nt, Homo sapiens
aucuuuaggagacuaauggaaau

SEQ ID NO: 593017 - RNA, 15 nt, Homo sapiens
aucuuuaggcuuuca

SEQ ID NO: 593018 - RNA, 15 nt, Homo sapiens
aucuuuagggaauga

SEQ ID NO: 593019 - RNA, 17 nt, Homo sapiens
aucuuucaccuuucuag

SEQ ID NO: 593020 - RNA, 21 nt, Homo sapiens
aucuuucaggacucuaccuca

SEQ ID NO: 593021 - RNA, 19 nt, Homo sapiens
aucuuuccaaauacccaaa

SEQ ID NO: 593022 - RNA, 13 nt, Homo sapiens
aucuuucuaggag

SEQ ID NO: 593023 - RNA, 14 nt, Homo sapiens
aucuuucuguuacu

SEQ ID NO: 593024 - RNA, 20 nt, Homo sapiens
aucuuugacaauucugggug

SEQ ID NO: 593025 - RNA, 14 nt, Homo sapiens
aucuuugugacagg

SEQ ID NO: 593026 - RNA, 20 nt, Homo sapiens
aucuuuguuuaaaugccaaa

SEQ ID NO: 593027 - RNA, 18 nt, Homo sapiens
aucuuuuaggccaaggaa

SEQ ID NO: 593028 - RNA, 13 nt, Homo sapiens
aucuuuucaaggc

SEQ ID NO: 593029 - RNA, 13 nt, Homo sapiens
aucuuuucauuaa

SEQ ID NO: 593030 - RNA, 16 nt, Homo sapiens
aucuuuucauuaaaga

SEQ ID NO: 593031 - RNA, 19 nt, Homo sapiens
aucuuuuccagaguaugca

SEQ ID NO: 593032 - RNA, 20 nt, Homo sapiens
aucuuuucuaaucacagugu

SEQ ID NO: 593033 - RNA, 19 nt, Homo sapiens
aucuuuuuaccuuucauac

SEQ ID NO: 593034 - RNA, 14 nt, Homo sapiens
aucuuuuucuauau

SEQ ID NO: 593035 - RNA, 19 nt, Homo sapiens
aucuuuuucuauauucuca

SEQ ID NO: 593036 - RNA, 20 nt, Homo sapiens
augaaaaaaaguacauguau

SEQ ID NO: 593037 - RNA, 19 nt, Homo sapiens
augaaaaaauacagguguc

SEQ ID NO: 593038 - RNA, 18 nt, Homo sapiens
augaaaaacaggugacau

SEQ ID NO: 593039 - RNA, 14 nt, Homo sapiens
augaaaaagauuau

SEQ ID NO: 593040 - RNA, 12 nt, Homo sapiens
augaaaaauugg

SEQ ID NO: 593041 - RNA, 17 nt, Homo sapiens
caaagugcugagauuac

SEQ ID NO: 593042 - RNA, 21 nt, Homo sapiens
caaagugcugcuggaaguaga

SEQ ID NO: 593043 - RNA, 19 nt, Homo sapiens
caaagugcugggauuacag

SEQ ID NO: 593044 - RNA, 15 nt, Homo sapiens
caaaguguauacaug

SEQ ID NO: 593045 - RNA, 17 nt, Homo sapiens
caaagugugugugugca

SEQ ID NO: 593046 - RNA, 16 nt, Homo sapiens
caaaguguuaaucuua

SEQ ID NO: 593047 - RNA, 21 nt, Homo sapiens
caaaguguuuuuuauugaaug

SEQ ID NO: 593048 - RNA, 16 nt, Homo sapiens
caaaguuaauucaccu

SEQ ID NO: 593049 - RNA, 22 nt, Homo sapiens
caaaguuacugauucacugcau

SEQ ID NO: 593050 - RNA, 11 nt, Homo sapiens
caaaguuucaa

SEQ ID NO: 593051 - RNA, 18 nt, Homo sapiens
caaauaaaacaaaaccaa

SEQ ID NO: 593052 - RNA, 23 nt, Homo sapiens
caaauaaaacaaaaccaacucag

SEQ ID NO: 593053 - RNA, 17 nt, Homo sapiens
caaauaaacucuaaaca

SEQ ID NO: 593054 - RNA, 17 nt, Homo sapiens
caaauaaaguaccauua

SEQ ID NO: 593055 - RNA, 20 nt, Homo sapiens
caaauaaaugauuauauuca

SEQ ID NO: 593056 - RNA, 22 nt, Homo sapiens
caaauaaaugauuauauucaca

SEQ ID NO: 593057 - RNA, 17 nt, Homo sapiens
caaauaaaugccuucca

SEQ ID NO: 593058 - RNA, 14 nt, Homo sapiens
caaauaagaaaccu

SEQ ID NO: 593059 - RNA, 22 nt, Homo sapiens
caaauaaguauuuauaauagca

SEQ ID NO: 593060 - RNA, 16 nt, Homo sapiens
caaauaauuaaaucuc

SEQ ID NO: 593061 - RNA, 12 nt, Homo sapiens
caaauagauuaa

SEQ ID NO: 593062 - RNA, 20 nt, Homo sapiens
caaauaggagugaguguaug

SEQ ID NO: 593063 - RNA, 15 nt, Homo sapiens
caaauagucuaucaa

SEQ ID NO: 593064 - RNA, 18 nt, Homo sapiens
caaauauuagcaaagaag

SEQ ID NO: 593065 - RNA, 17 nt, Homo sapiens
caaauauuauucuuaau

SEQ ID NO: 593066 - RNA, 18 nt, Homo sapiens
caaaucagaaacuuguga

SEQ ID NO: 593067 - RNA, 15 nt, Homo sapiens
caaaucagucuuccu

SEQ ID NO: 593068 - RNA, 21 nt, Homo sapiens
caaaucaguuggcaggcacca

SEQ ID NO: 593069 - RNA, 19 nt, Homo sapiens
caaaucccuuucaugucuu

SEQ ID NO: 593070 - RNA, 15 nt, Homo sapiens
caaauccgcucucuu

SEQ ID NO: 593071 - RNA, 17 nt, Homo sapiens
caaauccucccuacuuc

SEQ ID NO: 593072 - RNA, 22 nt, Homo sapiens
caaauccuucaaaauaaaaagu

SEQ ID NO: 593073 - RNA, 15 nt, Homo sapiens
caaaucgugccuugu

SEQ ID NO: 593074 - RNA, 21 nt, Homo sapiens
caaaucuacgguuaugaaggc

SEQ ID NO: 593075 - RNA, 17 nt, Homo sapiens
caaaucuggaagccaaa

SEQ ID NO: 593076 - RNA, 18 nt, Homo sapiens
caaaucuguaaucagcaa

SEQ ID NO: 593077 - RNA, 22 nt, Homo sapiens
caaaucuuguuauugaaguguu

SEQ ID NO: 593078 - RNA, 15 nt, Homo sapiens
caaaugaaauguaug

SEQ ID NO: 593079 - RNA, 15 nt, Homo sapiens
caaaugaaggaugaa

SEQ ID NO: 593080 - RNA, 14 nt, Homo sapiens
caaaugacccaaag

SEQ ID NO: 593081 - RNA, 15 nt, Homo sapiens
caaaugacccaaaga

SEQ ID NO: 593082 - RNA, 23 nt, Homo sapiens
caaaugaccgcacguucucugcc

SEQ ID NO: 593083 - RNA, 14 nt, Homo sapiens
caaaugagccauga

SEQ ID NO: 593084 - RNA, 16 nt, Homo sapiens
caaaugagccaugaga

SEQ ID NO: 593085 - RNA, 20 nt, Homo sapiens
caaaugaugaagaccaaaga

SEQ ID NO: 593086 - RNA, 21 nt, Homo sapiens
caaaugaugaagaccaaagac

SEQ ID NO: 593087 - RNA, 13 nt, Homo sapiens
caaaugcaauuuu

SEQ ID NO: 593088 - RNA, 15 nt, Homo sapiens
caaaugcaugaacaa

SEQ ID NO: 593089 - RNA, 14 nt, Homo sapiens
caaaugcccagcuu

SEQ ID NO: 593090 - RNA, 17 nt, Homo sapiens
caaaugccuucaugaau

SEQ ID NO: 593091 - RNA, 12 nt, Homo sapiens
caaaugcuauau

SEQ ID NO: 593092 - RNA, 13 nt, Homo sapiens
caaauggacauaa

SEQ ID NO: 593093 - RNA, 23 nt, Homo sapiens
caaauggcagaaccaaagcucaa

SEQ ID NO: 593094 - RNA, 16 nt, Homo sapiens
caaauggggacaggaa

SEQ ID NO: 593095 - RNA, 16 nt, Homo sapiens
caaaugggucccucag

SEQ ID NO: 593096 - RNA, 15 nt, Homo sapiens
caaauguauagacuu

SEQ ID NO: 593097 - RNA, 13 nt, Homo sapiens
caaaugucccugc

SEQ ID NO: 593098 - RNA, 14 nt, Homo sapiens
caaauguccuccag

SEQ ID NO: 593099 - RNA, 18 nt, Homo sapiens
caaaugucuaccaacuga

SEQ ID NO: 593100 - RNA, 17 nt, Homo sapiens
caaaugucuaguuucua

SEQ ID NO: 593101 - RNA, 13 nt, Homo sapiens
caaaugugacauu

SEQ ID NO: 593102 - RNA, 11 nt, Homo sapiens
caaaugugcug

SEQ ID NO: 593103 - RNA, 18 nt, Homo sapiens
caaauguuacaguuuaua

SEQ ID NO: 593104 - RNA, 16 nt, Homo sapiens
caaauguuaugcauaa

SEQ ID NO: 593105 - RNA, 20 nt, Homo sapiens
caaauguuuuaaaguuuaau

SEQ ID NO: 593106 - RNA, 17 nt, Homo sapiens
caaauguuuugcucaau

SEQ ID NO: 593107 - RNA, 20 nt, Homo sapiens
caaauuacuccaagguuuau

SEQ ID NO: 593108 - RNA, 16 nt, Homo sapiens
caaauuagccauuuca

SEQ ID NO: 593109 - RNA, 21 nt, Homo sapiens
caaauuaucuugauacauuca

SEQ ID NO: 593110 - RNA, 19 nt, Homo sapiens
caaauuauucuccuauguu

SEQ ID NO: 593111 - RNA, 22 nt, Homo sapiens
caaauucauuuuuuucacugga

SEQ ID NO: 593112 - RNA, 23 nt, Homo sapiens
caaauucauuuuuuucacuggag

SEQ ID NO: 593113 - RNA, 22 nt, Homo sapiens
caaauucgcugcaaccuguuga

SEQ ID NO: 593114 - RNA, 18 nt, Homo sapiens
caaauucuucugaacuca

SEQ ID NO: 593115 - RNA, 15 nt, Homo sapiens
caaauugauagucaa

SEQ ID NO: 593116 - RNA, 16 nt, Homo sapiens
caaauugauagucaau

SEQ ID NO: 593117 - RNA, 14 nt, Homo sapiens
caaauugccugcaa

SEQ ID NO: 593118 - RNA, 19 nt, Homo sapiens
caaauuggugaacagugua

SEQ ID NO: 593119 - RNA, 21 nt, Homo sapiens
caaauuuagaagaaaaaacca

SEQ ID NO: 593120 - RNA, 17 nt, Homo sapiens
caaauuuaugcauuuca

SEQ ID NO: 593121 - RNA, 11 nt, Homo sapiens
caaauuucaca

SEQ ID NO: 593122 - RNA, 19 nt, Homo sapiens
caaauuucuagucaaugug

SEQ ID NO: 593123 - RNA, 14 nt, Homo sapiens
caaauuugccauga

SEQ ID NO: 593124 - RNA, 22 nt, Homo sapiens
caaauuuggcucacuugccuua

SEQ ID NO: 593125 - RNA, 16 nt, Homo sapiens
caaauuuuaucuccag

SEQ ID NO: 593126 - RNA, 19 nt, Homo sapiens
caaauuuucacugcugcuc

SEQ ID NO: 593127 - RNA, 14 nt, Homo sapiens
caacaaaaagaaca

SEQ ID NO: 593128 - RNA, 15 nt, Homo sapiens
caacaaaaagaacaa

SEQ ID NO: 593129 - RNA, 18 nt, Homo sapiens
caacaaaaagaacaaauc

SEQ ID NO: 593130 - RNA, 14 nt, Homo sapiens
caacaaaagcuuuu

SEQ ID NO: 593131 - RNA, 23 nt, Homo sapiens
caacaaaauggucauccaaacuc

SEQ ID NO: 593132 - RNA, 22 nt, Homo sapiens
caacaaaugggucccucagucu

SEQ ID NO: 593133 - RNA, 22 nt, Homo sapiens
caacaaccggccaccagauguc

SEQ ID NO: 593134 - RNA, 13 nt, Homo sapiens
caacaacgacaca

SEQ ID NO: 593135 - RNA, 23 nt, Homo sapiens
caacaacgagauaccaucucaca

SEQ ID NO: 593136 - RNA, 19 nt, Homo sapiens
caacaacuuacacuuauuu

SEQ ID NO: 593137 - RNA, 21 nt, Homo sapiens
caacaagauccuuaaugcaga

SEQ ID NO: 593138 - RNA, 13 nt, Homo sapiens
caacaauacaugc

SEQ ID NO: 593139 - RNA, 14 nt, Homo sapiens
caacaaugacuuaa

SEQ ID NO: 593140 - RNA, 22 nt, Homo sapiens
caacaaugacuuaaccauauaa

SEQ ID NO: 593141 - RNA, 23 nt, Homo sapiens
caacacaagcuggaagcacaugu

SEQ ID NO: 593142 - RNA, 21 nt, Homo sapiens
caacacagagcugaguccucu

SEQ ID NO: 593143 - RNA, 15 nt, Homo sapiens
caacaccacuaggaa

SEQ ID NO: 593144 - RNA, 19 nt, Homo sapiens
caacaccccucccugccac

SEQ ID NO: 593145 - RNA, 17 nt, Homo sapiens
caacaccuuaauaugcu

SEQ ID NO: 593146 - RNA, 17 nt, Homo sapiens
caacacgccuaaaacuc

SEQ ID NO: 593147 - RNA, 21 nt, Homo sapiens
caacacggugaaaccccaucu

SEQ ID NO: 593148 - RNA, 10 nt, Homo sapiens
caacacugcu

SEQ ID NO: 593149 - RNA, 14 nt, Homo sapiens
caacacugcugcuc

SEQ ID NO: 593150 - RNA, 22 nt, Homo sapiens
caacacugcugcuccagugcag

SEQ ID NO: 593151 - RNA, 15 nt, Homo sapiens
caacacugcugucca

SEQ ID NO: 593152 - RNA, 15 nt, Homo sapiens
caacagaagcaaaaa

SEQ ID NO: 593153 - RNA, 21 nt, Homo sapiens
caacagaaguauuucugugga

SEQ ID NO: 593154 - RNA, 13 nt, Homo sapiens
caacagagcaaga

SEQ ID NO: 593155 - RNA, 19 nt, Homo sapiens
caacagagcaagacuccau

SEQ ID NO: 593156 - RNA, 22 nt, Homo sapiens
caacagaugaccguguacaaua

SEQ ID NO: 593157 - RNA, 11 nt, Homo sapiens
caacagcauuu

SEQ ID NO: 593158 - RNA, 15 nt, Homo sapiens
caacagcauuuucaa

SEQ ID NO: 593159 - RNA, 12 nt, Homo sapiens
caacagccaugc

SEQ ID NO: 593160 - RNA, 22 nt, Homo sapiens
caacagccaugcccgcauuagc

SEQ ID NO: 593161 - RNA, 14 nt, Homo sapiens
caacagcugccgac

SEQ ID NO: 593162 - RNA, 19 nt, Homo sapiens
caacaggaaggaaccagaa

SEQ ID NO: 593163 - RNA, 18 nt, Homo sapiens
caacagugagagacucca

SEQ ID NO: 593164 - RNA, 17 nt, Homo sapiens
caacagugagucuguca

SEQ ID NO: 593165 - RNA, 21 nt, Homo sapiens
caacauaaaacaaaaccaagc

SEQ ID NO: 593166 - RNA, 15 nt, Homo sapiens
caacauaggccugcu

SEQ ID NO: 593167 - RNA, 17 nt, Homo sapiens
caacaucacagcccagc

SEQ ID NO: 593168 - RNA, 14 nt, Homo sapiens
caacauccaaaaua

SEQ ID NO: 593169 - RNA, 16 nt, Homo sapiens
caacaucccacagugg

SEQ ID NO: 593170 - RNA, 14 nt, Homo sapiens
caacaucuggucuu

SEQ ID NO: 593171 - RNA, 18 nt, Homo sapiens
caacaucuggucuuccag

SEQ ID NO: 593172 - RNA, 21 nt, Homo sapiens
caacaugaugaaaccccaucu

SEQ ID NO: 593173 - RNA, 15 nt, Homo sapiens
caacaugcacugaug

SEQ ID NO: 593174 - RNA, 16 nt, Homo sapiens
caacaugcacugaugu

SEQ ID NO: 593175 - RNA, 16 nt, Homo sapiens
caacaugcgaccguga

SEQ ID NO: 593176 - RNA, 23 nt, Homo sapiens
caacauggagaagccccgucucu

SEQ ID NO: 593177 - RNA, 15 nt, Homo sapiens
caacauggcuuucuu

SEQ ID NO: 593178 - RNA, 22 nt, Homo sapiens
caacauuaggaguaacuuucaa

SEQ ID NO: 593179 - RNA, 10 nt, Homo sapiens
caacauucau

SEQ ID NO: 593180 - RNA, 15 nt, Homo sapiens
caacauucauagucu

SEQ ID NO: 593181 - RNA, 13 nt, Homo sapiens
caacauucuuugc

SEQ ID NO: 593182 - RNA, 18 nt, Homo sapiens
caacauugcuugugccac

SEQ ID NO: 593183 - RNA, 16 nt, Homo sapiens
caacauuucucacuga

SEQ ID NO: 593184 - RNA, 18 nt, Homo sapiens
caacauuuuuucccagug

SEQ ID NO: 593185 - RNA, 24 nt, Homo sapiens
caaccaacggccgacugccuguga

SEQ ID NO: 593186 - RNA, 22 nt, Homo sapiens
caaccaagaauguuaugugcaa

SEQ ID NO: 593187 - RNA, 21 nt, Homo sapiens
caaccacuguaaaaugaaauu

SEQ ID NO: 593188 - RNA, 20 nt, Homo sapiens
caaccagccuuuggguccug

SEQ ID NO: 593189 - RNA, 20 nt, Homo sapiens
caaccaggcagcugagacca

SEQ ID NO: 593190 - RNA, 22 nt, Homo sapiens
caaccaguuuauccaccaagaa

SEQ ID NO: 593191 - RNA, 20 nt, Homo sapiens
caaccauaaaauugucauaa

SEQ ID NO: 593192 - RNA, 21 nt, Homo sapiens
caacccaauaaaacugauguu

SEQ ID NO: 593193 - RNA, 22 nt, Homo sapiens
caacccauauuucauccaggag

SEQ ID NO: 593194 - RNA, 18 nt, Homo sapiens
caacccauucacuacagg

SEQ ID NO: 593195 - RNA, 14 nt, Homo sapiens
caaccccacccagc

SEQ ID NO: 593196 - RNA, 17 nt, Homo sapiens
caaccccugcuccaguc

SEQ ID NO: 593197 - RNA, 17 nt, Homo sapiens
caacccgaggcaauaaa

SEQ ID NO: 593198 - RNA, 22 nt, Homo sapiens
caacccgaguuaccacuuucca

SEQ ID NO: 593199 - RNA, 14 nt, Homo sapiens
caacccggcacugc

SEQ ID NO: 593200 - RNA, 17 nt, Homo sapiens
caacccggcacugcccu

SEQ ID NO: 593201 - RNA, 14 nt, Homo sapiens
caacccugccccug

SEQ ID NO: 593202 - RNA, 15 nt, Homo sapiens
caacccuuugcccca

SEQ ID NO: 593203 - RNA, 22 nt, Homo sapiens
caacccuuugccccaccuuuau

SEQ ID NO: 593204 - RNA, 23 nt, Homo sapiens
caaccgguaaccaaagucacaaa

SEQ ID NO: 593205 - RNA, 17 nt, Homo sapiens
caaccuaaccccuuucc

SEQ ID NO: 593206 - RNA, 19 nt, Homo sapiens
caaccucaaugcccugcca

SEQ ID NO: 593207 - RNA, 12 nt, Homo sapiens
caaccucaguga

SEQ ID NO: 593208 - RNA, 15 nt, Homo sapiens
caaccuccacauguu

SEQ ID NO: 593209 - RNA, 13 nt, Homo sapiens
caaccuccagugu

SEQ ID NO: 593210 - RNA, 15 nt, Homo sapiens
caaccuccccauugc

SEQ ID NO: 593211 - RNA, 17 nt, Homo sapiens
caaccucuuuuuccucc

SEQ ID NO: 593212 - RNA, 21 nt, Homo sapiens
caaccugaaauuuauucacau

SEQ ID NO: 593213 - RNA, 20 nt, Homo sapiens
caaccugacuuccucugcca

SEQ ID NO: 593214 - RNA, 22 nt, Homo sapiens
caaccugaugccccuuccccaa

SEQ ID NO: 593215 - RNA, 17 nt, Homo sapiens
caaccugcacaaccugg

SEQ ID NO: 593216 - RNA, 18 nt, Homo sapiens
caaccugccugacauuug

SEQ ID NO: 593217 - RNA, 20 nt, Homo sapiens
caaccugcucuccucuugcc

SEQ ID NO: 593218 - RNA, 19 nt, Homo sapiens
caaccugggacuuccuaaa

SEQ ID NO: 593219 - RNA, 23 nt, Homo sapiens
caaccuggucacaggacucugcc

SEQ ID NO: 593220 - RNA, 16 nt, Homo sapiens
caaccuugcugggacu

SEQ ID NO: 593221 - RNA, 19 nt, Homo sapiens
caacgagacacauugccuu

SEQ ID NO: 593222 - RNA, 16 nt, Homo sapiens
caacgagauaccaucu

SEQ ID NO: 593223 - RNA, 18 nt, Homo sapiens
caacgagauaccaucuca

SEQ ID NO: 593224 - RNA, 13 nt, Homo sapiens
caacgaugaauuu

SEQ ID NO: 593225 - RNA, 14 nt, Homo sapiens
caacgaugaugcuu

SEQ ID NO: 593226 - RNA, 18 nt, Homo sapiens
caacgccucacugaaaca

SEQ ID NO: 593227 - RNA, 16 nt, Homo sapiens
caacggcuuagacuuc

SEQ ID NO: 593228 - RNA, 21 nt, Homo sapiens
caacuaaaaaaauuuuugaca

SEQ ID NO: 593229 - RNA, 19 nt, Homo sapiens
caacuaaaacccccaauaa

SEQ ID NO: 593230 - RNA, 14 nt, Homo sapiens
caacuaaggacaaa

SEQ ID NO: 593231 - RNA, 17 nt, Homo sapiens
caacuaccuagacugga

SEQ ID NO: 593232 - RNA, 17 nt, Homo sapiens
caacuauauuaucaugc

SEQ ID NO: 593233 - RNA, 13 nt, Homo sapiens
caacuaugauuau

SEQ ID NO: 593234 - RNA, 16 nt, Homo sapiens
caacucaucuucacag

SEQ ID NO: 593235 - RNA, 19 nt, Homo sapiens
caacuccauguuugguguu

SEQ ID NO: 593236 - RNA, 16 nt, Homo sapiens
caacucuccaauguuc

SEQ ID NO: 593237 - RNA, 17 nt, Homo sapiens
caacucugccuuuauga

SEQ ID NO: 593238 - RNA, 16 nt, Homo sapiens
caacucuucgaagccu

SEQ ID NO: 593239 - RNA, 22 nt, Homo sapiens
caacucuugugaauuauucuga

SEQ ID NO: 593240 - RNA, 19 nt, Homo sapiens
caacugaauaaauaccucu

SEQ ID NO: 593241 - RNA, 13 nt, Homo sapiens
caacugaccagcc

SEQ ID NO: 593242 - RNA, 17 nt, Homo sapiens
caacugauacuucacua

SEQ ID NO: 593243 - RNA, 13 nt, Homo sapiens
caacugccaagaa

SEQ ID NO: 593244 - RNA, 18 nt, Homo sapiens
caacuggcuacugaguca

SEQ ID NO: 593245 - RNA, 13 nt, Homo sapiens
caacugugacugu

SEQ ID NO: 593246 - RNA, 11 nt, Homo sapiens
caacuguguug

SEQ ID NO: 593247 - RNA, 13 nt, Homo sapiens
caacuguuucuac

SEQ ID NO: 593248 - RNA, 19 nt, Homo sapiens
caacuuaaguugguccuuu

SEQ ID NO: 593249 - RNA, 14 nt, Homo sapiens
caacuucaagggac

SEQ ID NO: 593250 - RNA, 19 nt, Homo sapiens
caacuucagcaaugaauug

SEQ ID NO: 593251 - RNA, 15 nt, Homo sapiens
caacuucaucagugu

SEQ ID NO: 593252 - RNA, 14 nt, Homo sapiens
caacuucauuugac

SEQ ID NO: 593253 - RNA, 16 nt, Homo sapiens
caacuucuuuccucug

SEQ ID NO: 593254 - RNA, 12 nt, Homo sapiens
caacuugauguu

SEQ ID NO: 593255 - RNA, 15 nt, Homo sapiens
caacuugccaaaaug

SEQ ID NO: 593256 - RNA, 21 nt, Homo sapiens
caacuugccaaaauguuggcu

SEQ ID NO: 593257 - RNA, 14 nt, Homo sapiens
caacuugcuucuaa

SEQ ID NO: 593258 - RNA, 15 nt, Homo sapiens
caacuuuaagauaga

SEQ ID NO: 593259 - RNA, 23 nt, Homo sapiens
caacuuuaauugcuuaaaagaca

SEQ ID NO: 593260 - RNA, 22 nt, Homo sapiens
caacuuuagcuaguaucuucaa

SEQ ID NO: 593261 - RNA, 13 nt, Homo sapiens
caacuuucuguaa

SEQ ID NO: 593262 - RNA, 19 nt, Homo sapiens
caacuuugaaacuggaaua

SEQ ID NO: 593263 - RNA, 12 nt, Homo sapiens
caacuuugacaa

SEQ ID NO: 593264 - RNA, 21 nt, Homo sapiens
caacuuuguggaugucuuccu

SEQ ID NO: 593265 - RNA, 17 nt, Homo sapiens
caagaaaaacaucuuug

SEQ ID NO: 593266 - RNA, 22 nt, Homo sapiens
caagaaaagggcugacauuuuc

SEQ ID NO: 593267 - RNA, 19 nt, Homo sapiens
caagaaagccucagccauu

SEQ ID NO: 593268 - RNA, 14 nt, Homo sapiens
caagaaagcucacu

SEQ ID NO: 593269 - RNA, 16 nt, Homo sapiens
caagaaauauugagua

SEQ ID NO: 593270 - RNA, 12 nt, Homo sapiens
caagaaauuacu

SEQ ID NO: 593271 - RNA, 19 nt, Homo sapiens
caagaacacacacauauac

SEQ ID NO: 593272 - RNA, 16 nt, Homo sapiens
caagaaccgguuucca

SEQ ID NO: 593273 - RNA, 22 nt, Homo sapiens
caagaaccgguuuccaaagaca

SEQ ID NO: 593274 - RNA, 20 nt, Homo sapiens
caagaagaaugggagcugca

SEQ ID NO: 593275 - RNA, 22 nt, Homo sapiens
caagaagccauuuagggcagca

SEQ ID NO: 593276 - RNA, 21 nt, Homo sapiens
caagaagcguuaugugcagua

SEQ ID NO: 593277 - RNA, 16 nt, Homo sapiens
caagaagggacugaga

SEQ ID NO: 593278 - RNA, 18 nt, Homo sapiens
caagaagggacugagaga

SEQ ID NO: 593279 - RNA, 21 nt, Homo sapiens
caagaagugaagaaugcacaa

SEQ ID NO: 593280 - RNA, 18 nt, Homo sapiens
caagaaguuuauucucau

SEQ ID NO: 593281 - RNA, 20 nt, Homo sapiens
caagaauauuguauguuaaa

SEQ ID NO: 593282 - RNA, 13 nt, Homo sapiens
caagaaucuccca

SEQ ID NO: 593283 - RNA, 17 nt, Homo sapiens
caagaaugugcacucuc

SEQ ID NO: 593284 - RNA, 22 nt, Homo sapiens
caagacaauucuucuucuucca

SEQ ID NO: 593285 - RNA, 16 nt, Homo sapiens
caagacaauuguugaa

SEQ ID NO: 593286 - RNA, 15 nt, Homo sapiens
caagacacagugacc

SEQ ID NO: 593287 - RNA, 17 nt, Homo sapiens
caagacaccaaauugaa

SEQ ID NO: 593288 - RNA, 18 nt, Homo sapiens
caagacacugaggagaua

SEQ ID NO: 593289 - RNA, 22 nt, Homo sapiens
caagacagugccuauacugccu

SEQ ID NO: 593290 - RNA, 22 nt, Homo sapiens
caagacagugcugagauuggaa

SEQ ID NO: 593291 - RNA, 17 nt, Homo sapiens
caagacauuugcugaac

SEQ ID NO: 593292 - RNA, 20 nt, Homo sapiens
caagacauuugcugaacuca

SEQ ID NO: 593293 - RNA, 11 nt, Homo sapiens
caagaccaaag

SEQ ID NO: 593294 - RNA, 13 nt, Homo sapiens
caagaccaaagca

SEQ ID NO: 593295 - RNA, 20 nt, Homo sapiens
caagaccagccugggcaaca

SEQ ID NO: 593296 - RNA, 22 nt, Homo sapiens
caagaccuucuccccauucugc

SEQ ID NO: 593297 - RNA, 12 nt, Homo sapiens
caagacgcugcc

SEQ ID NO: 593298 - RNA, 19 nt, Homo sapiens
caagacucugucucaaaaa

SEQ ID NO: 593299 - RNA, 17 nt, Homo sapiens
caagacugaagacugca

SEQ ID NO: 593300 - RNA, 19 nt, Homo sapiens
caagacuuagagcugggaa

SEQ ID NO: 593301 - RNA, 21 nt, Homo sapiens
caagacuuauggaacagggau

SEQ ID NO: 593302 - RNA, 13 nt, Homo sapiens
caagagaccagcc

SEQ ID NO: 593303 - RNA, 23 nt, Homo sapiens
caagagauuguuguuugccauac

SEQ ID NO: 593304 - RNA, 22 nt, Homo sapiens
caagagcacuaggauugugaua

SEQ ID NO: 593305 - RNA, 13 nt, Homo sapiens
caagagcugagaa

SEQ ID NO: 593306 - RNA, 17 nt, Homo sapiens
caagagcuggcaaaggu

SEQ ID NO: 593307 - RNA, 18 nt, Homo sapiens
caagagcuuaacagugug

SEQ ID NO: 593308 - RNA, 16 nt, Homo sapiens
caagaggacugagacu

SEQ ID NO: 593309 - RNA, 16 nt, Homo sapiens
caagaggagacuuuaa

SEQ ID NO: 593310 - RNA, 16 nt, Homo sapiens
caagagggaaggugac

SEQ ID NO: 593311 - RNA, 22 nt, Homo sapiens
caagaggguccuuuaguaccug

SEQ ID NO: 593312 - RNA, 19 nt, Homo sapiens
caagaguaagcaguguuac

SEQ ID NO: 593313 - RNA, 20 nt, Homo sapiens
caagaguccugaagaucaag

SEQ ID NO: 593314 - RNA, 22 nt, Homo sapiens
caagagugagacuccaccucaa

SEQ ID NO: 593315 - RNA, 15 nt, Homo sapiens
caagagugauugcag

SEQ ID NO: 593316 - RNA, 13 nt, Homo sapiens
caagagugggggg

SEQ ID NO: 593317 - RNA, 17 nt, Homo sapiens
caagaguuuguucuguu

SEQ ID NO: 593318 - RNA, 23 nt, Homo sapiens
caagaguuuguucuguucugggg

SEQ ID NO: 593319 - RNA, 22 nt, Homo sapiens
caagauacacucaagcaugaag

SEQ ID NO: 593320 - RNA, 21 nt, Homo sapiens
caagauacauaugaggacaag

SEQ ID NO: 593321 - RNA, 20 nt, Homo sapiens
caagauaccuuugcguggau

SEQ ID NO: 593322 - RNA, 21 nt, Homo sapiens
caagauacugcuacuguaauu

SEQ ID NO: 593323 - RNA, 14 nt, Homo sapiens
caagauauggacac

SEQ ID NO: 593324 - RNA, 14 nt, Homo sapiens
caagaucaacauuc

SEQ ID NO: 593325 - RNA, 20 nt, Homo sapiens
caagauccgagucuacccag

SEQ ID NO: 593326 - RNA, 19 nt, Homo sapiens
caagauccuccugcugcag

SEQ ID NO: 593327 - RNA, 20 nt, Homo sapiens
caagaucgccccacugcacu

SEQ ID NO: 593328 - RNA, 17 nt, Homo sapiens
caagaucuuucaggaaa

SEQ ID NO: 593329 - RNA, 13 nt, Homo sapiens
caagaugcaaaug

SEQ ID NO: 593330 - RNA, 20 nt, Homo sapiens
caagauggacacgagccaca

SEQ ID NO: 593331 - RNA, 16 nt, Homo sapiens
caagauguguucuccu

SEQ ID NO: 593332 - RNA, 12 nt, Homo sapiens
caagauuuccac

SEQ ID NO: 593333 - RNA, 21 nt, Homo sapiens
caagcaaaaacaaaugggaaa

SEQ ID NO: 593334 - RNA, 23 nt, Homo sapiens
caagcaaaccaauggugauccuc

SEQ ID NO: 593335 - RNA, 19 nt, Homo sapiens
caagcaaaugggggaaaag

SEQ ID NO: 593336 - RNA, 14 nt, Homo sapiens
caagcaagugcaca

SEQ ID NO: 593337 - RNA, 19 nt, Homo sapiens
caagcaauccuccuaccuc

SEQ ID NO: 593338 - RNA, 20 nt, Homo sapiens
caagcaauucuccugccuca

SEQ ID NO: 593339 - RNA, 15 nt, Homo sapiens
caagcacacuggaau

SEQ ID NO: 593340 - RNA, 12 nt, Homo sapiens
caagcaccucca

SEQ ID NO: 593341 - RNA, 14 nt, Homo sapiens
caagcaccugcuca

SEQ ID NO: 593342 - RNA, 18 nt, Homo sapiens
caagcacuuuaauggccu

SEQ ID NO: 593343 - RNA, 16 nt, Homo sapiens
caagcagugucuguca

SEQ ID NO: 593344 - RNA, 21 nt, Homo sapiens
caagcaucagggggaagaagc

SEQ ID NO: 593345 - RNA, 21 nt, Homo sapiens
caagcaugcaauaaugugcaa

SEQ ID NO: 593346 - RNA, 11 nt, Homo sapiens
caagcauguau

SEQ ID NO: 593347 - RNA, 21 nt, Homo sapiens
caagcauucagaagaaaaaga

SEQ ID NO: 593348 - RNA, 21 nt, Homo sapiens
caagcauuucaugaaaaagcu

SEQ ID NO: 593349 - RNA, 20 nt, Homo sapiens
caagcauuucuagcagugau

SEQ ID NO: 593350 - RNA, 21 nt, Homo sapiens
caagccacagcagguccucca

SEQ ID NO: 593351 - RNA, 22 nt, Homo sapiens
caagccaugcuggugggccauu

SEQ ID NO: 593352 - RNA, 17 nt, Homo sapiens
caagccccauuuccuca

SEQ ID NO: 593353 - RNA, 17 nt, Homo sapiens
caagcccccccuuccac

SEQ ID NO: 593354 - RNA, 17 nt, Homo sapiens
caagccccucagcccuu

SEQ ID NO: 593355 - RNA, 21 nt, Homo sapiens
caagccgagcucuccuuguua

SEQ ID NO: 593356 - RNA, 21 nt, Homo sapiens
caagccuagcccuucucucau

SEQ ID NO: 593357 - RNA, 20 nt, Homo sapiens
caagccuguccuuccugacc

SEQ ID NO: 593358 - RNA, 17 nt, Homo sapiens
caagccugugcaaaaaa

SEQ ID NO: 593359 - RNA, 20 nt, Homo sapiens
caagccuguugucuuaacau

SEQ ID NO: 593360 - RNA, 20 nt, Homo sapiens
caagcgacgacagaugcuaa

SEQ ID NO: 593361 - RNA, 18 nt, Homo sapiens
caagcgucaucuguguaa

SEQ ID NO: 593362 - RNA, 13 nt, Homo sapiens
caagcuaggguuu

SEQ ID NO: 593363 - RNA, 17 nt, Homo sapiens
caagcucaaaaggguuu

SEQ ID NO: 593364 - RNA, 21 nt, Homo sapiens
caagcuccuuaaccuuccaug

SEQ ID NO: 593365 - RNA, 19 nt, Homo sapiens
caagcucuaucaccaagga

SEQ ID NO: 593366 - RNA, 15 nt, Homo sapiens
caagcucuucacuga

SEQ ID NO: 593367 - RNA, 23 nt, Homo sapiens
caagcugagaaaaguauucucaa

SEQ ID NO: 593368 - RNA, 21 nt, Homo sapiens
caagcugccgaaccaaaagaa

SEQ ID NO: 593369 - RNA, 17 nt, Homo sapiens
caagcugggagcacagg

SEQ ID NO: 593370 - RNA, 21 nt, Homo sapiens
caagcugguggccucugcagg

SEQ ID NO: 593371 - RNA, 21 nt, Homo sapiens
caagcugugacuucuccaggu

SEQ ID NO: 593372 - RNA, 16 nt, Homo sapiens
caagcuguugaagucu

SEQ ID NO: 593373 - RNA, 18 nt, Homo sapiens
caagcuuaauagcccucc

SEQ ID NO: 593374 - RNA, 15 nt, Homo sapiens
caagcuuacuacagu

SEQ ID NO: 593375 - RNA, 13 nt, Homo sapiens
caagcuuccugug

SEQ ID NO: 593376 - RNA, 11 nt, Homo sapiens
caagcuuucag

SEQ ID NO: 593377 - RNA, 20 nt, Homo sapiens
caaggaaagccccagcacua

SEQ ID NO: 593378 - RNA, 18 nt, Homo sapiens
caaggaaauguccugcau

SEQ ID NO: 593379 - RNA, 21 nt, Homo sapiens
caaggaaccucaagucaugcu

SEQ ID NO: 593380 - RNA, 22 nt, Homo sapiens
caaggaauccauccugcaaagg

SEQ ID NO: 593381 - RNA, 18 nt, Homo sapiens
caaggaaugccugugcca

SEQ ID NO: 593382 - RNA, 17 nt, Homo sapiens
caaggacgaauuugcac

SEQ ID NO: 593383 - RNA, 23 nt, Homo sapiens
caaggagaagccccuacccugug

SEQ ID NO: 593384 - RNA, 20 nt, Homo sapiens
caaggagcaaacacugaaau

SEQ ID NO: 593385 - RNA, 18 nt, Homo sapiens
caaggagcacaagccaca

SEQ ID NO: 593386 - RNA, 14 nt, Homo sapiens
caaggaggggccag

SEQ ID NO: 593387 - RNA, 19 nt, Homo sapiens
caaggaguacaaugcccag

SEQ ID NO: 593388 - RNA, 16 nt, Homo sapiens
caaggaguguaaaaug

SEQ ID NO: 593389 - RNA, 23 nt, Homo sapiens
caaggauagaagcugcaguggua

SEQ ID NO: 593390 - RNA, 19 nt, Homo sapiens
caaggauccucuccacucc

SEQ ID NO: 593391 - RNA, 18 nt, Homo sapiens
caaggauccugugcugcu

SEQ ID NO: 593392 - RNA, 15 nt, Homo sapiens
caaggauggagcuga

SEQ ID NO: 593393 - RNA, 19 nt, Homo sapiens
caaggaugucugagaccac

SEQ ID NO: 593394 - RNA, 16 nt, Homo sapiens
caaggauuuuuagccc

SEQ ID NO: 593395 - RNA, 19 nt, Homo sapiens
caaggcagcccugucugaa

SEQ ID NO: 593396 - RNA, 20 nt, Homo sapiens
caaggcagcccugucugaag

SEQ ID NO: 593397 - RNA, 11 nt, Homo sapiens
caaggcauuua

SEQ ID NO: 593398 - RNA, 15 nt, Homo sapiens
caaggccagaaggag

SEQ ID NO: 593399 - RNA, 17 nt, Homo sapiens
caaggccagaugcacau

SEQ ID NO: 593400 - RNA, 19 nt, Homo sapiens
caaggcccauaucugugaa

SEQ ID NO: 593401 - RNA, 15 nt, Homo sapiens
caaggccccagagac

SEQ ID NO: 593402 - RNA, 18 nt, Homo sapiens
caaggcccccacugccug

SEQ ID NO: 593403 - RNA, 16 nt, Homo sapiens
caaggcuacgcugaca

SEQ ID NO: 593404 - RNA, 17 nt, Homo sapiens
caaggcugcacagcuca

SEQ ID NO: 593405 - RNA, 14 nt, Homo sapiens
caaggcugcaguga

SEQ ID NO: 593406 - RNA, 19 nt, Homo sapiens
caaggcugcagugagccau

SEQ ID NO: 593407 - RNA, 18 nt, Homo sapiens
caaggcugggcagugucc

SEQ ID NO: 593408 - RNA, 20 nt, Homo sapiens
caaggcuuaggaaagugaua

SEQ ID NO: 593409 - RNA, 21 nt, Homo sapiens
caagggaacuugagcgugaau

SEQ ID NO: 593410 - RNA, 14 nt, Homo sapiens
caagggaaucugua

SEQ ID NO: 593411 - RNA, 16 nt, Homo sapiens
caagggacccaugagu

SEQ ID NO: 593412 - RNA, 14 nt, Homo sapiens
caagggagggugca

SEQ ID NO: 593413 - RNA, 19 nt, Homo sapiens
caaggguaugggaagccau

SEQ ID NO: 593414 - RNA, 21 nt, Homo sapiens
caagggucaauuguaacuaau

SEQ ID NO: 593415 - RNA, 18 nt, Homo sapiens
caaggguuggaggcaaug

SEQ ID NO: 593416 - RNA, 14 nt, Homo sapiens
caagguauuacacu

SEQ ID NO: 593417 - RNA, 14 nt, Homo sapiens
caaggucaugccac

SEQ ID NO: 593418 - RNA, 20 nt, Homo sapiens
caaggucaugccacugcacu

SEQ ID NO: 593419 - RNA, 21 nt, Homo sapiens
caaggucaugccacugcacuc

SEQ ID NO: 593420 - RNA, 19 nt, Homo sapiens
caagguccccuccacaucc

SEQ ID NO: 593421 - RNA, 16 nt, Homo sapiens
caaggucgagacauuc

SEQ ID NO: 593422 - RNA, 17 nt, Homo sapiens
caaggugacauuuccau

SEQ ID NO: 593423 - RNA, 19 nt, Homo sapiens
caaggugggccuugcuacc

SEQ ID NO: 593424 - RNA, 22 nt, Homo sapiens
caagguggugugaucuuaauau

SEQ ID NO: 593425 - RNA, 15 nt, Homo sapiens
caagguuauaugcac

SEQ ID NO: 593426 - RNA, 12 nt, Homo sapiens
caagguuuacau

SEQ ID NO: 593427 - RNA, 19 nt, Homo sapiens
caagguuuuggagucagua

SEQ ID NO: 593428 - RNA, 23 nt, Homo sapiens
caaguaaaaaggcuaaauggaag

SEQ ID NO: 593429 - RNA, 17 nt, Homo sapiens
caaguaaguuauagaag

SEQ ID NO: 593430 - RNA, 12 nt, Homo sapiens
caaguaauacaa

SEQ ID NO: 593431 - RNA, 22 nt, Homo sapiens
caaguacaaguauauaauaugu

SEQ ID NO: 593432 - RNA, 23 nt, Homo sapiens
caaguacaaguauauaauauguc

SEQ ID NO: 593433 - RNA, 21 nt, Homo sapiens
caaguacaccagccaccucca

SEQ ID NO: 593434 - RNA, 13 nt, Homo sapiens
caaguagcuuucc

SEQ ID NO: 593435 - RNA, 19 nt, Homo sapiens
caaguauauaauaugucac

SEQ ID NO: 593436 - RNA, 16 nt, Homo sapiens
caaguauauaauuuac

SEQ ID NO: 593437 - RNA, 19 nt, Homo sapiens
caaguauguugauaaauga

SEQ ID NO: 593438 - RNA, 20 nt, Homo sapiens
caaguauuacaaccauauau

SEQ ID NO: 593439 - RNA, 14 nt, Homo sapiens
caaguauugcgaau

SEQ ID NO: 593440 - RNA, 20 nt, Homo sapiens
caaguauugcgaaugugcag

SEQ ID NO: 593441 - RNA, 17 nt, Homo sapiens
caagucaccggagcuuu

SEQ ID NO: 593442 - RNA, 14 nt, Homo sapiens
caagucagcuccag

SEQ ID NO: 593443 - RNA, 14 nt, Homo sapiens
caagucaugccuga

SEQ ID NO: 593444 - RNA, 21 nt, Homo sapiens
caaguccacuguccuccuugg

SEQ ID NO: 593445 - RNA, 21 nt, Homo sapiens
caaguccauguuauucucuca

SEQ ID NO: 593446 - RNA, 21 nt, Homo sapiens
caagucgagagggcuguugga

SEQ ID NO: 593447 - RNA, 20 nt, Homo sapiens
caagucggggccugggacac

SEQ ID NO: 593448 - RNA, 20 nt, Homo sapiens
caagucuuuacagaaucaaa

SEQ ID NO: 593449 - RNA, 16 nt, Homo sapiens
caagugaaaucaaagg

SEQ ID NO: 593450 - RNA, 14 nt, Homo sapiens
caagugacuuucua

SEQ ID NO: 593451 - RNA, 16 nt, Homo sapiens
caagugagacaaaaag

SEQ ID NO: 593452 - RNA, 22 nt, Homo sapiens
caagugagcagagauguacugc

SEQ ID NO: 593453 - RNA, 13 nt, Homo sapiens
caagugauacucc

SEQ ID NO: 593454 - RNA, 17 nt, Homo sapiens
caagugauaucaccucu

SEQ ID NO: 593455 - RNA, 18 nt, Homo sapiens
caagugauaucaccucuc

SEQ ID NO: 593456 - RNA, 19 nt, Homo sapiens
caagugaucuguccaccuc

SEQ ID NO: 593457 - RNA, 16 nt, Homo sapiens
caagugcaagacugaa

SEQ ID NO: 593458 - RNA, 11 nt, Homo sapiens
caagugcaguc

SEQ ID NO: 593459 - RNA, 17 nt, Homo sapiens
caagugccacaugccua

SEQ ID NO: 593460 - RNA, 15 nt, Homo sapiens
caagugccuaugcaa

SEQ ID NO: 593461 - RNA, 22 nt, Homo sapiens
caagugccucuuguugcagaga

SEQ ID NO: 593462 - RNA, 17 nt, Homo sapiens
caagugcugcacaaaag

SEQ ID NO: 593463 - RNA, 22 nt, Homo sapiens
caaguggaccuuaggccuuccu

SEQ ID NO: 593464 - RNA, 23 nt, Homo sapiens
caaguggguccaaguggcuguga

SEQ ID NO: 593465 - RNA, 15 nt, Homo sapiens
caaguguacaugugu

SEQ ID NO: 593466 - RNA, 20 nt, Homo sapiens
caaguguaugcacgugugca

SEQ ID NO: 593467 - RNA, 22 nt, Homo sapiens
caaguguaugcacgugugcaca

SEQ ID NO: 593468 - RNA, 21 nt, Homo sapiens
caaguguccuggaaauucugc

SEQ ID NO: 593469 - RNA, 16 nt, Homo sapiens
caaguguguaugugcg

SEQ ID NO: 593470 - RNA, 13 nt, Homo sapiens
caagugugugcau

SEQ ID NO: 593471 - RNA, 18 nt, Homo sapiens
caagugugugcaugugug

SEQ ID NO: 593472 - RNA, 15 nt, Homo sapiens
caagugugugugcgu

SEQ ID NO: 593473 - RNA, 19 nt, Homo sapiens
caaguguguguguguuuua

SEQ ID NO: 593474 - RNA, 19 nt, Homo sapiens
caaguguucacugcuccuu

SEQ ID NO: 593475 - RNA, 17 nt, Homo sapiens
caaguuacagugaugcu

SEQ ID NO: 593476 - RNA, 18 nt, Homo sapiens
caaguuacucugccuuuc

SEQ ID NO: 593477 - RNA, 18 nt, Homo sapiens
caaguuaucaucucacca

SEQ ID NO: 593478 - RNA, 21 nt, Homo sapiens
caaguucaugcagcuguggca

SEQ ID NO: 593479 - RNA, 23 nt, Homo sapiens
caaguucauugaugacccucuga

SEQ ID NO: 593480 - RNA, 23 nt, Homo sapiens
caaguuccccaucccugucauuu

SEQ ID NO: 593481 - RNA, 18 nt, Homo sapiens
caaguuccgucaguccaa

SEQ ID NO: 593482 - RNA, 13 nt, Homo sapiens
caaguucucccca

SEQ ID NO: 593483 - RNA, 20 nt, Homo sapiens
caaguucuuaguugcuguau

SEQ ID NO: 593484 - RNA, 21 nt, Homo sapiens
caaguucuucaccucuaucca

SEQ ID NO: 593485 - RNA, 22 nt, Homo sapiens
caaguuggaaauauucaugcuu

SEQ ID NO: 593486 - RNA, 20 nt, Homo sapiens
caaguuggguucacuugcca

SEQ ID NO: 593487 - RNA, 20 nt, Homo sapiens
caaguuguaacuuauauuga

SEQ ID NO: 593488 - RNA, 17 nt, Homo sapiens
caaguuguagagagaaa

SEQ ID NO: 593489 - RNA, 18 nt, Homo sapiens
caaguuucuagcuagaaa

SEQ ID NO: 593490 - RNA, 19 nt, Homo sapiens
caauaaaaacaacuuucac

SEQ ID NO: 593491 - RNA, 14 nt, Homo sapiens
caauaaaaacaauu

SEQ ID NO: 593492 - RNA, 16 nt, Homo sapiens
caauaaaaacugucug

SEQ ID NO: 593493 - RNA, 12 nt, Homo sapiens
caauaaaacuga

SEQ ID NO: 593494 - RNA, 21 nt, Homo sapiens
caauaaaagaauaguugccaa

SEQ ID NO: 593495 - RNA, 14 nt, Homo sapiens
caauaaaaguguga

SEQ ID NO: 593496 - RNA, 13 nt, Homo sapiens
caauaaacuccua

SEQ ID NO: 593497 - RNA, 18 nt, Homo sapiens
caauaaagcaauguggua

SEQ ID NO: 593498 - RNA, 19 nt, Homo sapiens
caauaaagcaaugugguag

SEQ ID NO: 593499 - RNA, 13 nt, Homo sapiens
caauaaagcugaa

SEQ ID NO: 593500 - RNA, 18 nt, Homo sapiens
caauaaaggcagcugccu

SEQ ID NO: 593501 - RNA, 16 nt, Homo sapiens
caauaaagugaucugu

SEQ ID NO: 593502 - RNA, 19 nt, Homo sapiens
caauaaauaagugcauuug

SEQ ID NO: 593503 - RNA, 22 nt, Homo sapiens
caauaaauacagaaaagucaua

SEQ ID NO: 593504 - RNA, 21 nt, Homo sapiens
caauaaauggccagugcugcu

SEQ ID NO: 593505 - RNA, 13 nt, Homo sapiens
caauaacagguca

SEQ ID NO: 593506 - RNA, 21 nt, Homo sapiens
caauaacauacaugagauaac

SEQ ID NO: 593507 - RNA, 20 nt, Homo sapiens
caauaacucucuacaggaau

SEQ ID NO: 593508 - RNA, 19 nt, Homo sapiens
caauaagacaugcuuacuu

SEQ ID NO: 593509 - RNA, 14 nt, Homo sapiens
caauaagcuggacu

SEQ ID NO: 593510 - RNA, 13 nt, Homo sapiens
caauaaugugcaa

SEQ ID NO: 593511 - RNA, 16 nt, Homo sapiens
caauaauuaccaauau

SEQ ID NO: 593512 - RNA, 14 nt, Homo sapiens
caauaauuacugua

SEQ ID NO: 593513 - RNA, 16 nt, Homo sapiens
caauacaaagaugacu

SEQ ID NO: 593514 - RNA, 14 nt, Homo sapiens
caauacaaauagau

SEQ ID NO: 593515 - RNA, 14 nt, Homo sapiens
caauacaaauggau

SEQ ID NO: 593516 - RNA, 14 nt, Homo sapiens
caauacaacuuuac

SEQ ID NO: 593517 - RNA, 19 nt, Homo sapiens
caauacaauguacaauuau

SEQ ID NO: 593518 - RNA, 14 nt, Homo sapiens
caauacagcuucau

SEQ ID NO: 593519 - RNA, 12 nt, Homo sapiens
caauacagugaa

SEQ ID NO: 593520 - RNA, 17 nt, Homo sapiens
caauacaugcugcuaau

SEQ ID NO: 593521 - RNA, 18 nt, Homo sapiens
caauacaugcugcuaauu

SEQ ID NO: 593522 - RNA, 13 nt, Homo sapiens
caauacauuugau

SEQ ID NO: 593523 - RNA, 21 nt, Homo sapiens
caauacccuuuuaaguuuaaa

SEQ ID NO: 593524 - RNA, 19 nt, Homo sapiens
caauacggcuaaucuuuca

SEQ ID NO: 593525 - RNA, 12 nt, Homo sapiens
caauacuacuga

SEQ ID NO: 593526 - RNA, 22 nt, Homo sapiens
caauagacauugcaaacucuca

SEQ ID NO: 593527 - RNA, 14 nt, Homo sapiens
caauagccauauaa

SEQ ID NO: 593528 - RNA, 12 nt, Homo sapiens
caauagcuugaa

SEQ ID NO: 593529 - RNA, 14 nt, Homo sapiens
caauaggacaaaac

SEQ ID NO: 593530 - RNA, 13 nt, Homo sapiens
caauauaagcaua

SEQ ID NO: 593531 - RNA, 22 nt, Homo sapiens
caauauacaacuguaaagcaaa

SEQ ID NO: 593532 - RNA, 13 nt, Homo sapiens
caauauacuucac

SEQ ID NO: 593533 - RNA, 13 nt, Homo sapiens
caauaucaugucu

SEQ ID NO: 593534 - RNA, 19 nt, Homo sapiens
caauaucccaacauucugc

SEQ ID NO: 593535 - RNA, 23 nt, Homo sapiens
caauaucuaauauauaugaauaa

SEQ ID NO: 593536 - RNA, 23 nt, Homo sapiens
caauaugaaaacgaaguuaaaua

SEQ ID NO: 593537 - RNA, 18 nt, Homo sapiens
caauaugaugacucccuu

SEQ ID NO: 593538 - RNA, 13 nt, Homo sapiens
caauaugugccaa

SEQ ID NO: 593539 - RNA, 16 nt, Homo sapiens
caauauuaaauacaga

SEQ ID NO: 593540 - RNA, 16 nt, Homo sapiens
caauauuaaugaagua

SEQ ID NO: 593541 - RNA, 19 nt, Homo sapiens
caauauugccaugguuuua

SEQ ID NO: 593542 - RNA, 24 nt, Homo sapiens
caauauuguauacuaccauaguga

SEQ ID NO: 593543 - RNA, 15 nt, Homo sapiens
caauauuuacauuuu

SEQ ID NO: 593544 - RNA, 15 nt, Homo sapiens
caauauuuauuucca

SEQ ID NO: 593545 - RNA, 16 nt, Homo sapiens
caauauuuauuuccag

SEQ ID NO: 593546 - RNA, 15 nt, Homo sapiens
caauauuucuucaca

SEQ ID NO: 593547 - RNA, 18 nt, Homo sapiens
caauauuuuuauaucaug

SEQ ID NO: 593548 - RNA, 19 nt, Homo sapiens
caaucaaauauuugcugaa

SEQ ID NO: 593549 - RNA, 16 nt, Homo sapiens
caaucaauggugcaaa

SEQ ID NO: 593550 - RNA, 13 nt, Homo sapiens
caaucacaagaag

SEQ ID NO: 593551 - RNA, 14 nt, Homo sapiens
caaucacaagaaga

SEQ ID NO: 593552 - RNA, 17 nt, Homo sapiens
caaucagccacauucua

SEQ ID NO: 593553 - RNA, 15 nt, Homo sapiens
caaucagugcaguga

SEQ ID NO: 593554 - RNA, 15 nt, Homo sapiens
caaucaguugacuuu

SEQ ID NO: 593555 - RNA, 17 nt, Homo sapiens
caaucaugaaauaugca

SEQ ID NO: 593556 - RNA, 22 nt, Homo sapiens
caaucaugaaauaugcaucuca

SEQ ID NO: 593557 - RNA, 14 nt, Homo sapiens
caauccaacaucca

SEQ ID NO: 593558 - RNA, 21 nt, Homo sapiens
caauccacaaugagaugcaug

SEQ ID NO: 593559 - RNA, 16 nt, Homo sapiens
caauccagcuauguua

SEQ ID NO: 593560 - RNA, 15 nt, Homo sapiens
caauccccagcccuu

SEQ ID NO: 593561 - RNA, 19 nt, Homo sapiens
caaucccucuccacucuuc

SEQ ID NO: 593562 - RNA, 22 nt, Homo sapiens
caaucccucuccacucuucucu

SEQ ID NO: 593563 - RNA, 22 nt, Homo sapiens
caaucccugaggacugauuuca

SEQ ID NO: 593564 - RNA, 20 nt, Homo sapiens
caauccuccuaccucagccu

SEQ ID NO: 593565 - RNA, 13 nt, Homo sapiens
caauccugcauug

SEQ ID NO: 593566 - RNA, 12 nt, Homo sapiens
caauccugugga

SEQ ID NO: 593567 - RNA, 19 nt, Homo sapiens
caaucuaagggucucucau

SEQ ID NO: 593568 - RNA, 20 nt, Homo sapiens
caaucuaauuaaauggcauc

SEQ ID NO: 593569 - RNA, 13 nt, Homo sapiens
caaucucacaccu

SEQ ID NO: 593570 - RNA, 15 nt, Homo sapiens
caaucucuggugccu

SEQ ID NO: 593571 - RNA, 12 nt, Homo sapiens
caaucucuuaau

SEQ ID NO: 593572 - RNA, 15 nt, Homo sapiens
caaucugcagccauu

SEQ ID NO: 593573 - RNA, 21 nt, Homo sapiens
caaucugccuuugaaucugga

SEQ ID NO: 593574 - RNA, 20 nt, Homo sapiens
caaucuguccguucacaugu

SEQ ID NO: 593575 - RNA, 21 nt, Homo sapiens
caaucuguguucgauggcuca

SEQ ID NO: 593576 - RNA, 17 nt, Homo sapiens
caaucuguucaauguuu

SEQ ID NO: 593577 - RNA, 23 nt, Homo sapiens
caaucuuaaaacagaaaggugca

SEQ ID NO: 593578 - RNA, 22 nt, Homo sapiens
caaucuuauguuuccaagagaa

SEQ ID NO: 593579 - RNA, 14 nt, Homo sapiens
caaucuucuacuuu

SEQ ID NO: 593580 - RNA, 14 nt, Homo sapiens
caaucuugaacuca

SEQ ID NO: 593581 - RNA, 14 nt, Homo sapiens
caaucuuugacaau

SEQ ID NO: 593582 - RNA, 22 nt, Homo sapiens
caaugaaaaaaaguacauguau

SEQ ID NO: 593583 - RNA, 16 nt, Homo sapiens
caaugaaauacugaga

SEQ ID NO: 593584 - RNA, 21 nt, Homo sapiens
caaugaaggagauagauuugu

SEQ ID NO: 593585 - RNA, 19 nt, Homo sapiens
caaugaauuuuauaaucug

SEQ ID NO: 593586 - RNA, 13 nt, Homo sapiens
caaugaccaaaca

SEQ ID NO: 593587 - RNA, 19 nt, Homo sapiens
caaugaccacauccugaaa

SEQ ID NO: 593588 - RNA, 22 nt, Homo sapiens
caaugaccuguauuuugccaga

SEQ ID NO: 593589 - RNA, 16 nt, Homo sapiens
caaugacgugugccua

SEQ ID NO: 593590 - RNA, 22 nt, Homo sapiens
caaugagaaugaugcacacuga

SEQ ID NO: 593591 - RNA, 22 nt, Homo sapiens
caaugagcuccuuguuuuugcc

SEQ ID NO: 593592 - RNA, 17 nt, Homo sapiens
caaugauacagucccua

SEQ ID NO: 593593 - RNA, 19 nt, Homo sapiens
caaugaucaccgacugaaa

SEQ ID NO: 593594 - RNA, 16 nt, Homo sapiens
caaugauggcaauuuu

SEQ ID NO: 593595 - RNA, 17 nt, Homo sapiens
caaugcaaaguaaaaaa

SEQ ID NO: 593596 - RNA, 22 nt, Homo sapiens
caaugcaguacaggacauauau

SEQ ID NO: 593597 - RNA, 14 nt, Homo sapiens
caaugcaugugcug

SEQ ID NO: 593598 - RNA, 14 nt, Homo sapiens
caaugcauugcuaa

SEQ ID NO: 593599 - RNA, 11 nt, Homo sapiens
caaugccagua

SEQ ID NO: 593600 - RNA, 15 nt, Homo sapiens
caaugcccagaucaa

SEQ ID NO: 593601 - RNA, 23 nt, Homo sapiens
caaugccccuggaucuaccagca

SEQ ID NO: 593602 - RNA, 14 nt, Homo sapiens
caaugccugugaag

SEQ ID NO: 593603 - RNA, 11 nt, Homo sapiens
caaugcuauaa

SEQ ID NO: 593604 - RNA, 12 nt, Homo sapiens
caaugcugaggu

SEQ ID NO: 593605 - RNA, 21 nt, Homo sapiens
caaugcugcaggucaacagcu

SEQ ID NO: 593606 - RNA, 21 nt, Homo sapiens
caaugcuuugggaggccaagg

SEQ ID NO: 593607 - RNA, 16 nt, Homo sapiens
caaugcuuuuaaugaa

SEQ ID NO: 593608 - RNA, 18 nt, Homo sapiens
caauggaaaaauagguaa

SEQ ID NO: 593609 - RNA, 18 nt, Homo sapiens
caauggaguggcugccau

SEQ ID NO: 593610 - RNA, 21 nt, Homo sapiens
caaugggaagcagacaauaac

SEQ ID NO: 593611 - RNA, 19 nt, Homo sapiens
caaugggaccgugccccac

SEQ ID NO: 593612 - RNA, 13 nt, Homo sapiens
caaugggagcuga

SEQ ID NO: 593613 - RNA, 18 nt, Homo sapiens
caaugggaggcugugauu

SEQ ID NO: 593614 - RNA, 16 nt, Homo sapiens
caaugggcucuuccaa

SEQ ID NO: 593615 - RNA, 16 nt, Homo sapiens
caauggggguguagua

SEQ ID NO: 593616 - RNA, 16 nt, Homo sapiens
caaugguaacugcacc

SEQ ID NO: 593617 - RNA, 13 nt, Homo sapiens
caauggugcaaaa

SEQ ID NO: 593618 - RNA, 19 nt, Homo sapiens
caauggugcaaucacagcu

SEQ ID NO: 593619 - RNA, 14 nt, Homo sapiens
caauggugcuuccc

SEQ ID NO: 593620 - RNA, 15 nt, Homo sapiens
caaugguugaugaua

SEQ ID NO: 593621 - RNA, 19 nt, Homo sapiens
caaugguugaugauacuuc

SEQ ID NO: 593622 - RNA, 13 nt, Homo sapiens
caauguacaauua

SEQ ID NO: 593623 - RNA, 15 nt, Homo sapiens
caaugucaaugugaa

SEQ ID NO: 593624 - RNA, 20 nt, Homo sapiens
caaugucacaaccucucuga

SEQ ID NO: 593625 - RNA, 18 nt, Homo sapiens
caaugucauuacauagaa

SEQ ID NO: 593626 - RNA, 20 nt, Homo sapiens
caauguccagugagugaggu

SEQ ID NO: 593627 - RNA, 17 nt, Homo sapiens
caaugucuaaaauggac

SEQ ID NO: 593628 - RNA, 14 nt, Homo sapiens
caauguguucuuaa

SEQ ID NO: 593629 - RNA, 19 nt, Homo sapiens
caauguuaaagaugcacag

SEQ ID NO: 593630 - RNA, 11 nt, Homo sapiens
caauguuccau

SEQ ID NO: 593631 - RNA, 13 nt, Homo sapiens
caauguucuauua

SEQ ID NO: 593632 - RNA, 22 nt, Homo sapiens
caauguugcuuaggaugugugc

SEQ ID NO: 593633 - RNA, 16 nt, Homo sapiens
caauguugugugcaug

SEQ ID NO: 593634 - RNA, 19 nt, Homo sapiens
caauguuuuuaaaaaucug

SEQ ID NO: 593635 - RNA, 22 nt, Homo sapiens
caauuaaaaaaaauuaaaacca

SEQ ID NO: 593636 - RNA, 20 nt, Homo sapiens
caauuaaaacuaagcacaaa

SEQ ID NO: 593637 - RNA, 21 nt, Homo sapiens
caauuaaaaugacaagcacua

SEQ ID NO: 593638 - RNA, 12 nt, Homo sapiens
caauuaaugaca

SEQ ID NO: 593639 - RNA, 21 nt, Homo sapiens
caauuagcauuauguuuugca

SEQ ID NO: 593640 - RNA, 16 nt, Homo sapiens
caauuagggaugcuca

SEQ ID NO: 593641 - RNA, 18 nt, Homo sapiens
caauuauaaggugaagaa

SEQ ID NO: 593642 - RNA, 17 nt, Homo sapiens
caauucaccaacacagu

SEQ ID NO: 593643 - RNA, 17 nt, Homo sapiens
caauucacuagaccaga

SEQ ID NO: 593644 - RNA, 19 nt, Homo sapiens
caauucagauugucuugca

SEQ ID NO: 593645 - RNA, 20 nt, Homo sapiens
caauucaguggacuauaaua

SEQ ID NO: 593646 - RNA, 14 nt, Homo sapiens
caauuccaccaaga

SEQ ID NO: 593647 - RNA, 23 nt, Homo sapiens
caauuccaccaagacagugcuga

SEQ ID NO: 593648 - RNA, 16 nt, Homo sapiens
caauuccucugaacaa

SEQ ID NO: 593649 - RNA, 12 nt, Homo sapiens
caauucugugac

SEQ ID NO: 593650 - RNA, 15 nt, Homo sapiens
caauucuucugucaa

SEQ ID NO: 593651 - RNA, 12 nt, Homo sapiens
caauucuugaga

SEQ ID NO: 593652 - RNA, 19 nt, Homo sapiens
caauugacucucacacuga

SEQ ID NO: 593653 - RNA, 14 nt, Homo sapiens
caauugauacuuca

SEQ ID NO: 593654 - RNA, 20 nt, Homo sapiens
caauugauccucccaucuca

SEQ ID NO: 593655 - RNA, 14 nt, Homo sapiens
caauugcucaugca

SEQ ID NO: 593656 - RNA, 16 nt, Homo sapiens
caauugggagcugcca

SEQ ID NO: 593657 - RNA, 12 nt, Homo sapiens
caauugucauug

SEQ ID NO: 593658 - RNA, 19 nt, Homo sapiens
caauugucauugauacaug

SEQ ID NO: 593659 - RNA, 20 nt, Homo sapiens
caauugucuauuuaucuuuu

SEQ ID NO: 593660 - RNA, 21 nt, Homo sapiens
caauugucugccucagccucc

SEQ ID NO: 593661 - RNA, 12 nt, Homo sapiens
caauugucuuaa

SEQ ID NO: 593662 - RNA, 17 nt, Homo sapiens
caauuuacgaaaccaaa

SEQ ID NO: 593663 - RNA, 19 nt, Homo sapiens
caauuuacgaaaccaaaaa

SEQ ID NO: 593664 - RNA, 14 nt, Homo sapiens
caauuuaugcugcu

SEQ ID NO: 593665 - RNA, 19 nt, Homo sapiens
caauuucacuuagucugua

SEQ ID NO: 593666 - RNA, 14 nt, Homo sapiens
caauuucaguguau

SEQ ID NO: 593667 - RNA, 22 nt, Homo sapiens
caauuuccauauagucuauuca

SEQ ID NO: 593668 - RNA, 23 nt, Homo sapiens
caauuucccccuaaaccaacuga

SEQ ID NO: 593669 - RNA, 18 nt, Homo sapiens
caauuucucugaggacac

SEQ ID NO: 593670 - RNA, 14 nt, Homo sapiens
caauuucuugguau

SEQ ID NO: 593671 - RNA, 13 nt, Homo sapiens
caauuugaagaga

SEQ ID NO: 593672 - RNA, 19 nt, Homo sapiens
caauuugaauuuaucuuuc

SEQ ID NO: 593673 - RNA, 17 nt, Homo sapiens
caauuugacaaaaccca

SEQ ID NO: 593674 - RNA, 22 nt, Homo sapiens
caauuugguaaaaaugcugcuc

SEQ ID NO: 593675 - RNA, 19 nt, Homo sapiens
caauuuguaauugcuuaca

SEQ ID NO: 593676 - RNA, 23 nt, Homo sapiens
caauuuuaauugauuauucugau

SEQ ID NO: 593677 - RNA, 19 nt, Homo sapiens
caauuuugcuucacuuugc

SEQ ID NO: 593678 - RNA, 22 nt, Homo sapiens
caauuuuucaagagcuccuuga

SEQ ID NO: 593679 - RNA, 19 nt, Homo sapiens
cacaaaaaggcauaugcaa

SEQ ID NO: 593680 - RNA, 14 nt, Homo sapiens
cacaaaacuugaaa

SEQ ID NO: 593681 - RNA, 21 nt, Homo sapiens
cacaaaaguccacugaugcaa

SEQ ID NO: 593682 - RNA, 16 nt, Homo sapiens
cacaaaaucacuuuaa

SEQ ID NO: 593683 - RNA, 18 nt, Homo sapiens
cacaaaaugauaaucaau

SEQ ID NO: 593684 - RNA, 17 nt, Homo sapiens
cacaaaaugcucaagga

SEQ ID NO: 593685 - RNA, 14 nt, Homo sapiens
cacaaaauugggaa

SEQ ID NO: 593686 - RNA, 12 nt, Homo sapiens
cacaaacaauau

SEQ ID NO: 593687 - RNA, 19 nt, Homo sapiens
cacaaacaauauguuugca

SEQ ID NO: 593688 - RNA, 13 nt, Homo sapiens
cacaaacugugaa

SEQ ID NO: 593689 - RNA, 16 nt, Homo sapiens
cacaaagcauuuucau

SEQ ID NO: 593690 - RNA, 21 nt, Homo sapiens
cacaaaucauccuaguaauaa

SEQ ID NO: 593691 - RNA, 22 nt, Homo sapiens
cacaaauucagucucugaauac

SEQ ID NO: 593692 - RNA, 20 nt, Homo sapiens
cacaaauuugggagggugag

SEQ ID NO: 593693 - RNA, 23 nt, Homo sapiens
cacaaauuugggagggugagaca

SEQ ID NO: 593694 - RNA, 17 nt, Homo sapiens
cacaacauuuacuuaac

SEQ ID NO: 593695 - RNA, 17 nt, Homo sapiens
cacaaccuugcaguauu

SEQ ID NO: 593696 - RNA, 22 nt, Homo sapiens
cacaacuuguaccaaguuuccc

SEQ ID NO: 593697 - RNA, 17 nt, Homo sapiens
cacaagaaguagcuuca

SEQ ID NO: 593698 - RNA, 22 nt, Homo sapiens
cacaagauggaaaucacauuua

SEQ ID NO: 593699 - RNA, 15 nt, Homo sapiens
cacaagcaaccaaug

SEQ ID NO: 593700 - RNA, 14 nt, Homo sapiens
cacaagccagaccc

SEQ ID NO: 593701 - RNA, 22 nt, Homo sapiens
cacaagcugagcaggacagcca

SEQ ID NO: 593702 - RNA, 20 nt, Homo sapiens
cacaaggcacaccagugcaa

SEQ ID NO: 593703 - RNA, 21 nt, Homo sapiens
cacaaggcacaccagugcaag

SEQ ID NO: 593704 - RNA, 15 nt, Homo sapiens
cacaaggcugaccaa

SEQ ID NO: 593705 - RNA, 23 nt, Homo sapiens
cacaaggggaaggguacugaaaa

SEQ ID NO: 593706 - RNA, 15 nt, Homo sapiens
cacaagguccacucc

SEQ ID NO: 593707 - RNA, 16 nt, Homo sapiens
cacaagguccacuccc

SEQ ID NO: 593708 - RNA, 17 nt, Homo sapiens
cacaaggugcaaaucaa

SEQ ID NO: 593709 - RNA, 14 nt, Homo sapiens
cacaaguuacacug

SEQ ID NO: 593710 - RNA, 16 nt, Homo sapiens
cacaaguuaguagcaa

SEQ ID NO: 593711 - RNA, 13 nt, Homo sapiens
cacaauaaacucg

SEQ ID NO: 593712 - RNA, 20 nt, Homo sapiens
cacaauaaaggcugagcucu

SEQ ID NO: 593713 - RNA, 21 nt, Homo sapiens
cacaauaaauggccagugcug

SEQ ID NO: 593714 - RNA, 14 nt, Homo sapiens
cacaauaaauguau

SEQ ID NO: 593715 - RNA, 14 nt, Homo sapiens
cacaauaggucuuu

SEQ ID NO: 593716 - RNA, 13 nt, Homo sapiens
cacaauaugaaua

SEQ ID NO: 593717 - RNA, 17 nt, Homo sapiens
cacaauccuauuacucu

SEQ ID NO: 593718 - RNA, 18 nt, Homo sapiens
cacaaugauuuuuugcaa

SEQ ID NO: 593719 - RNA, 18 nt, Homo sapiens
cacaaugcgcguugacua

SEQ ID NO: 593720 - RNA, 17 nt, Homo sapiens
cacaauguggauuuggg

SEQ ID NO: 593721 - RNA, 15 nt, Homo sapiens
cacaauuauuccaaa

SEQ ID NO: 593722 - RNA, 14 nt, Homo sapiens
cacaauucuguccc

SEQ ID NO: 593723 - RNA, 17 nt, Homo sapiens
cacaauucuucugucaa

SEQ ID NO: 593724 - RNA, 21 nt, Homo sapiens
cacacaaaaagugucucugcc

SEQ ID NO: 593725 - RNA, 19 nt, Homo sapiens
cacacaaaauaguuuuagu

SEQ ID NO: 593726 - RNA, 13 nt, Homo sapiens
cacacaaaccagu

SEQ ID NO: 593727 - RNA, 22 nt, Homo sapiens
cacacaagcuuuuuuacacaaa

SEQ ID NO: 593728 - RNA, 14 nt, Homo sapiens
cacacaauguggac

SEQ ID NO: 593729 - RNA, 12 nt, Homo sapiens
cacacacacaaa

SEQ ID NO: 593730 - RNA, 13 nt, Homo sapiens
cacacacacaugc

SEQ ID NO: 593731 - RNA, 15 nt, Homo sapiens
cacacacaccacaca

SEQ ID NO: 593732 - RNA, 15 nt, Homo sapiens
cacacaccacacaua

SEQ ID NO: 593733 - RNA, 18 nt, Homo sapiens
cacacaccuguagcacuu

SEQ ID NO: 593734 - RNA, 18 nt, Homo sapiens
cacacacgaugcauuuaa

SEQ ID NO: 593735 - RNA, 21 nt, Homo sapiens
cacacacgcuuucuuaugcaa

SEQ ID NO: 593736 - RNA, 20 nt, Homo sapiens
cacacacgugcgugcgagca

SEQ ID NO: 593737 - RNA, 22 nt, Homo sapiens
cacacacuguucugaaagugac

SEQ ID NO: 593738 - RNA, 21 nt, Homo sapiens
cacacagaaaaggcugcugug

SEQ ID NO: 593739 - RNA, 16 nt, Homo sapiens
cacacagacaguuucu

SEQ ID NO: 593740 - RNA, 14 nt, Homo sapiens
cacacagacucuag

SEQ ID NO: 593741 - RNA, 19 nt, Homo sapiens
cacacagacuuucugugac

SEQ ID NO: 593742 - RNA, 15 nt, Homo sapiens
cacacagcugcccua

SEQ ID NO: 593743 - RNA, 19 nt, Homo sapiens
cacacagggcucacagggc

SEQ ID NO: 593744 - RNA, 23 nt, Homo sapiens
cacacauacacacacacaagcuu

SEQ ID NO: 593745 - RNA, 14 nt, Homo sapiens
cacacauacaguau

SEQ ID NO: 593746 - RNA, 15 nt, Homo sapiens
cacacaucuuaccuc

SEQ ID NO: 593747 - RNA, 16 nt, Homo sapiens
cacacaucuuaccucu

SEQ ID NO: 593748 - RNA, 12 nt, Homo sapiens
cacacaugcuag

SEQ ID NO: 593749 - RNA, 21 nt, Homo sapiens
cacacauuuaaaacauuugaa

SEQ ID NO: 593750 - RNA, 17 nt, Homo sapiens
cacacauuuuaugagag

SEQ ID NO: 593751 - RNA, 18 nt, Homo sapiens
cacaccaaguaccaguau

SEQ ID NO: 593752 - RNA, 15 nt, Homo sapiens
cacaccagaaagcua

SEQ ID NO: 593753 - RNA, 12 nt, Homo sapiens
cacaccaucucc

SEQ ID NO: 593754 - RNA, 17 nt, Homo sapiens
cacaccccuaaguacaa

SEQ ID NO: 593755 - RNA, 12 nt, Homo sapiens
cacaccucuaaa

SEQ ID NO: 593756 - RNA, 20 nt, Homo sapiens
cacaccugaacacaucguga

SEQ ID NO: 593757 - RNA, 17 nt, Homo sapiens
cacaccugccgucuuca

SEQ ID NO: 593758 - RNA, 22 nt, Homo sapiens
cacaccuggcauggugcaggga

SEQ ID NO: 593759 - RNA, 15 nt, Homo sapiens
cacaccuggccuuaa

SEQ ID NO: 593760 - RNA, 22 nt, Homo sapiens
cacaccugggcauuuggugaga

SEQ ID NO: 593761 - RNA, 18 nt, Homo sapiens
cacaccugggggacagag

SEQ ID NO: 593762 - RNA, 19 nt, Homo sapiens
cacaccugugccuccucag

SEQ ID NO: 593763 - RNA, 16 nt, Homo sapiens
cacacgaguuccagac

SEQ ID NO: 593764 - RNA, 16 nt, Homo sapiens
cacacgauaaagggau

SEQ ID NO: 593765 - RNA, 16 nt, Homo sapiens
cacacgccuccuguag

SEQ ID NO: 593766 - RNA, 22 nt, Homo sapiens
cacacgcuuucuuaugcaaucu

SEQ ID NO: 593767 - RNA, 17 nt, Homo sapiens
cacacuaagagggcaga

SEQ ID NO: 593768 - RNA, 17 nt, Homo sapiens
cacacugaaaccaaaac

SEQ ID NO: 593769 - RNA, 18 nt, Homo sapiens
cacacugccagaagagaa

SEQ ID NO: 593770 - RNA, 21 nt, Homo sapiens
cacacuguagcauuacagugg

SEQ ID NO: 593771 - RNA, 15 nt, Homo sapiens
cacacugugccccac

SEQ ID NO: 593772 - RNA, 19 nt, Homo sapiens
cacacuguucugaaaguga

SEQ ID NO: 593773 - RNA, 19 nt, Homo sapiens
cacacuguugucaaaaagu

SEQ ID NO: 593774 - RNA, 20 nt, Homo sapiens
cacacuucuugaaacagccu

SEQ ID NO: 593775 - RNA, 14 nt, Homo sapiens
cacacuuggaugca

SEQ ID NO: 593776 - RNA, 15 nt, Homo sapiens
cacacuugugugugg

SEQ ID NO: 593777 - RNA, 16 nt, Homo sapiens
cacacuuucauuuagu

SEQ ID NO: 593778 - RNA, 12 nt, Homo sapiens
cacacuuugcca

SEQ ID NO: 593779 - RNA, 16 nt, Homo sapiens
cacagaaaauaaggca

SEQ ID NO: 593780 - RNA, 19 nt, Homo sapiens
cacagaaaucacagucaau

SEQ ID NO: 593781 - RNA, 16 nt, Homo sapiens
cacagaaauuuucaau

SEQ ID NO: 593782 - RNA, 15 nt, Homo sapiens
cacagaagacccgcu

SEQ ID NO: 593783 - RNA, 14 nt, Homo sapiens
cacagaaggaauaa

SEQ ID NO: 593784 - RNA, 17 nt, Homo sapiens
cacagaauagcacaaac

SEQ ID NO: 593785 - RNA, 22 nt, Homo sapiens
cacagaauauuuuuauauuucc

SEQ ID NO: 593786 - RNA, 16 nt, Homo sapiens
cacagaauuuaagcaa

SEQ ID NO: 593787 - RNA, 15 nt, Homo sapiens
cacagacaaagugcu

SEQ ID NO: 593788 - RNA, 22 nt, Homo sapiens
cacagacacacacacgcacgca

SEQ ID NO: 593789 - RNA, 20 nt, Homo sapiens
cacagacuauuuuuagauuu

SEQ ID NO: 593790 - RNA, 15 nt, Homo sapiens
cacagacugaccccc

SEQ ID NO: 593791 - RNA, 16 nt, Homo sapiens
cacagacugcgauuug

SEQ ID NO: 593792 - RNA, 14 nt, Homo sapiens
cacagagaugcaug

SEQ ID NO: 593793 - RNA, 23 nt, Homo sapiens
cacagagugcauugugaggguua

SEQ ID NO: 593794 - RNA, 22 nt, Homo sapiens
cacagagugcuggacuguucca

SEQ ID NO: 593795 - RNA, 20 nt, Homo sapiens
cacagauccgcaagaguaaa

SEQ ID NO: 593796 - RNA, 18 nt, Homo sapiens
cacagaugauaauaugcu

SEQ ID NO: 593797 - RNA, 23 nt, Homo sapiens
cacagauuguucuaaaguaaaau

SEQ ID NO: 593798 - RNA, 19 nt, Homo sapiens
cacagauuugagcucagcc

SEQ ID NO: 593799 - RNA, 13 nt, Homo sapiens
cacagcacagcca

SEQ ID NO: 593800 - RNA, 13 nt, Homo sapiens
cacagcacuccug

SEQ ID NO: 593801 - RNA, 20 nt, Homo sapiens
cacagcagcugaacagccaa

SEQ ID NO: 593802 - RNA, 17 nt, Homo sapiens
cacagcaggacuccauc

SEQ ID NO: 593803 - RNA, 13 nt, Homo sapiens
cacagcauuguau

SEQ ID NO: 593804 - RNA, 11 nt, Homo sapiens
cacagccagag

SEQ ID NO: 593805 - RNA, 13 nt, Homo sapiens
cacagcccaagag

SEQ ID NO: 593806 - RNA, 14 nt, Homo sapiens
cacagcccaagagg

SEQ ID NO: 593807 - RNA, 23 nt, Homo sapiens
cacagccgcagccucccucugac

SEQ ID NO: 593808 - RNA, 20 nt, Homo sapiens
cacagccgccugaaagccac

SEQ ID NO: 593809 - RNA, 14 nt, Homo sapiens
cacagccucagaau

SEQ ID NO: 593810 - RNA, 15 nt, Homo sapiens
cacagccucagaaua

SEQ ID NO: 593811 - RNA, 15 nt, Homo sapiens
cacagccuccagggc

SEQ ID NO: 593812 - RNA, 17 nt, Homo sapiens
cacagccuccccugcca

SEQ ID NO: 593813 - RNA, 21 nt, Homo sapiens
cacagccucuaagcgugcuga

SEQ ID NO: 593814 - RNA, 19 nt, Homo sapiens
cacagcgaagacugcuaaa

SEQ ID NO: 593815 - RNA, 17 nt, Homo sapiens
cacagcggagucugucc

SEQ ID NO: 593816 - RNA, 16 nt, Homo sapiens
cacagcugaacuuguu

SEQ ID NO: 593817 - RNA, 13 nt, Homo sapiens
cacagcugcccua

SEQ ID NO: 593818 - RNA, 23 nt, Homo sapiens
cacagcugcuuucuguugucauu

SEQ ID NO: 593819 - RNA, 18 nt, Homo sapiens
cacagcugggcaggguga

SEQ ID NO: 593820 - RNA, 18 nt, Homo sapiens
cacagcuucuccaagcau

SEQ ID NO: 593821 - RNA, 21 nt, Homo sapiens
cacagcuucuccaagcaucac

SEQ ID NO: 593822 - RNA, 16 nt, Homo sapiens
cacaggaauucucaag

SEQ ID NO: 593823 - RNA, 23 nt, Homo sapiens
cacaggauauuaaacguguaaau

SEQ ID NO: 593824 - RNA, 18 nt, Homo sapiens
cacaggauccuauucuca

SEQ ID NO: 593825 - RNA, 14 nt, Homo sapiens
cacaggauuuguaa

SEQ ID NO: 593826 - RNA, 19 nt, Homo sapiens
cacaggcagugcaugugaa

SEQ ID NO: 593827 - RNA, 17 nt, Homo sapiens
cacaggcgaggacccug

SEQ ID NO: 593828 - RNA, 23 nt, Homo sapiens
cacaggcuggcgcucggcuccac

SEQ ID NO: 593829 - RNA, 20 nt, Homo sapiens
cacaggcuuggggguuuuca

SEQ ID NO: 593830 - RNA, 22 nt, Homo sapiens
cacagggcgagacuccgucuca

SEQ ID NO: 593831 - RNA, 15 nt, Homo sapiens
cacagggucugcucu

SEQ ID NO: 593832 - RNA, 24 nt, Homo sapiens
cacagguguguuucccaucccacu

SEQ ID NO: 593833 - RNA, 18 nt, Homo sapiens
cacaguaaaaguaaagac

SEQ ID NO: 593834 - RNA, 16 nt, Homo sapiens
cacaguacuguuucaa

SEQ ID NO: 593835 - RNA, 16 nt, Homo sapiens
cacaguagucuugaug

SEQ ID NO: 593836 - RNA, 12 nt, Homo sapiens
cacagucacugc

SEQ ID NO: 593837 - RNA, 14 nt, Homo sapiens
cacagucacuggau

SEQ ID NO: 593838 - RNA, 18 nt, Homo sapiens
cacagucccauuccucca

SEQ ID NO: 593839 - RNA, 18 nt, Homo sapiens
cacagucucauuuugaca

SEQ ID NO: 593840 - RNA, 19 nt, Homo sapiens
cacagugacuucugagauc

SEQ ID NO: 593841 - RNA, 13 nt, Homo sapiens
cacagugcaucuc

SEQ ID NO: 593842 - RNA, 15 nt, Homo sapiens
cacagugcaucucag

SEQ ID NO: 593843 - RNA, 21 nt, Homo sapiens
cacagugcccaagaguggggu

SEQ ID NO: 593844 - RNA, 18 nt, Homo sapiens
cacaguguugcauaugag

SEQ ID NO: 593845 - RNA, 16 nt, Homo sapiens
cacaguuggauuuauu

SEQ ID NO: 593846 - RNA, 18 nt, Homo sapiens
cacaguuggcuggaugaa

SEQ ID NO: 593847 - RNA, 23 nt, Homo sapiens
cacaguuuauuuuuauacuuuca

SEQ ID NO: 593848 - RNA, 18 nt, Homo sapiens
cacauaauuuugugcaug

SEQ ID NO: 593849 - RNA, 15 nt, Homo sapiens
cacauaccuucaugu

SEQ ID NO: 593850 - RNA, 23 nt, Homo sapiens
cacauagaggccuucccauccag

SEQ ID NO: 593851 - RNA, 15 nt, Homo sapiens
cacauagauucaccu

SEQ ID NO: 593852 - RNA, 12 nt, Homo sapiens
cacauagcacag

SEQ ID NO: 593853 - RNA, 20 nt, Homo sapiens
cacauagcaggggcaccuuc

SEQ ID NO: 593854 - RNA, 20 nt, Homo sapiens
cacauagcgccgugcuguaa

SEQ ID NO: 593855 - RNA, 20 nt, Homo sapiens
cacauaggaaaaugccauga

SEQ ID NO: 593856 - RNA, 22 nt, Homo sapiens
cacauaguagguacccaauuca

SEQ ID NO: 593857 - RNA, 22 nt, Homo sapiens
cacauaguuaaaaaagaaacaa

SEQ ID NO: 593858 - RNA, 22 nt, Homo sapiens
cacauauauauuacaagggaua

SEQ ID NO: 593859 - RNA, 13 nt, Homo sapiens
cacauaugacaau

SEQ ID NO: 593860 - RNA, 16 nt, Homo sapiens
cacauauguaguauaa

SEQ ID NO: 593861 - RNA, 23 nt, Homo sapiens
cacaucaugagcugagugacugc

SEQ ID NO: 593862 - RNA, 12 nt, Homo sapiens
cacauccagcuu

SEQ ID NO: 593863 - RNA, 19 nt, Homo sapiens
cacauccaggaaggaccuu

SEQ ID NO: 593864 - RNA, 21 nt, Homo sapiens
cacauccucugucuauuugag

SEQ ID NO: 593865 - RNA, 18 nt, Homo sapiens
cacaucuaaagcuuuauc

SEQ ID NO: 593866 - RNA, 13 nt, Homo sapiens
cacaucugucacg

SEQ ID NO: 593867 - RNA, 12 nt, Homo sapiens
cacaucuugacu

SEQ ID NO: 593868 - RNA, 17 nt, Homo sapiens
cacaucuugcucugcau

SEQ ID NO: 593869 - RNA, 15 nt, Homo sapiens
cacaucuuguaacuu

SEQ ID NO: 593870 - RNA, 21 nt, Homo sapiens
cacaugaagguaaauaaaaag

SEQ ID NO: 593871 - RNA, 17 nt, Homo sapiens
cacaugcaaggucauuu

SEQ ID NO: 593872 - RNA, 23 nt, Homo sapiens
cacaugcacacacacacaucuca

SEQ ID NO: 593873 - RNA, 20 nt, Homo sapiens
cacaugccuguaaucccagc

SEQ ID NO: 593874 - RNA, 15 nt, Homo sapiens
cacaugcgcacucuc

SEQ ID NO: 593875 - RNA, 18 nt, Homo sapiens
cacauggaacgcuuucau

SEQ ID NO: 593876 - RNA, 14 nt, Homo sapiens
cacauggaacuuua

SEQ ID NO: 593877 - RNA, 17 nt, Homo sapiens
cacauggaggacccaac

SEQ ID NO: 593878 - RNA, 14 nt, Homo sapiens
cacauggugccccu

SEQ ID NO: 593879 - RNA, 20 nt, Homo sapiens
cacaugguucaccaugcagu

SEQ ID NO: 593880 - RNA, 13 nt, Homo sapiens
cacaugugcaguc

SEQ ID NO: 593881 - RNA, 20 nt, Homo sapiens
cacaugugcugauguuuaca

SEQ ID NO: 593882 - RNA, 17 nt, Homo sapiens
cacauguguaugauacu

SEQ ID NO: 593883 - RNA, 23 nt, Homo sapiens
cacauguguaugauacuaaagac

SEQ ID NO: 593884 - RNA, 23 nt, Homo sapiens
cacauguguuucugucucuccau

SEQ ID NO: 593885 - RNA, 15 nt, Homo sapiens
cacauuaccauucau

SEQ ID NO: 593886 - RNA, 17 nt, Homo sapiens
cacauuaccauucauag

SEQ ID NO: 593887 - RNA, 14 nt, Homo sapiens
cacauuaucuucau

SEQ ID NO: 593888 - RNA, 18 nt, Homo sapiens
cacauucccaucugucac

SEQ ID NO: 593889 - RNA, 23 nt, Homo sapiens
cacauucuacuucagcuuuggau

SEQ ID NO: 593890 - RNA, 13 nt, Homo sapiens
cacauugauguaa

SEQ ID NO: 593891 - RNA, 20 nt, Homo sapiens
cacauuggucauugugaaua

SEQ ID NO: 593892 - RNA, 22 nt, Homo sapiens
cacauuggucauugugaauauu

SEQ ID NO: 593893 - RNA, 20 nt, Homo sapiens
cacauuuacaaaauuacaca

SEQ ID NO: 593894 - RNA, 20 nt, Homo sapiens
cacauuuauuuuuauaucua

SEQ ID NO: 593895 - RNA, 22 nt, Homo sapiens
cacauuucauugucuuagucaa

SEQ ID NO: 593896 - RNA, 14 nt, Homo sapiens
cacauuugauucug

SEQ ID NO: 593897 - RNA, 19 nt, Homo sapiens
cacauuugguuucugaaua

SEQ ID NO: 593898 - RNA, 19 nt, Homo sapiens
cacauuuuuaaaagaacaa

SEQ ID NO: 593899 - RNA, 20 nt, Homo sapiens
cacauuuuuuucuaugcaua

SEQ ID NO: 593900 - RNA, 15 nt, Homo sapiens
caccaaaaagggauc

SEQ ID NO: 593901 - RNA, 14 nt, Homo sapiens
caccaaacucuuaa

SEQ ID NO: 593902 - RNA, 15 nt, Homo sapiens
caccaaagacaucag

SEQ ID NO: 593903 - RNA, 18 nt, Homo sapiens
caccaaagagaaugcccu

SEQ ID NO: 593904 - RNA, 15 nt, Homo sapiens
caccaaaguauuaau

SEQ ID NO: 593905 - RNA, 14 nt, Homo sapiens
caccaaaugugcuu

SEQ ID NO: 593906 - RNA, 22 nt, Homo sapiens
caccaacauugcuugugccaca

SEQ ID NO: 593907 - RNA, 21 nt, Homo sapiens
caccaacgagcuguacaugau

SEQ ID NO: 593908 - RNA, 19 nt, Homo sapiens
caccaacucugcacuccau

SEQ ID NO: 593909 - RNA, 13 nt, Homo sapiens
caccaacuugcca

SEQ ID NO: 593910 - RNA, 19 nt, Homo sapiens
caccaacuugccacauguu

SEQ ID NO: 593911 - RNA, 19 nt, Homo sapiens
caccaagaucaagcagaga

SEQ ID NO: 593912 - RNA, 22 nt, Homo sapiens
caccaaggcagugcaugcaugu

SEQ ID NO: 593913 - RNA, 18 nt, Homo sapiens
caccaaggcccagaggaa

SEQ ID NO: 593914 - RNA, 13 nt, Homo sapiens
caccaagugcaau

SEQ ID NO: 593915 - RNA, 17 nt, Homo sapiens
caccaaucauaguguac

SEQ ID NO: 593916 - RNA, 20 nt, Homo sapiens
caccaauggauuguggaaaa

SEQ ID NO: 593917 - RNA, 21 nt, Homo sapiens
caccaaugggccuccagagac

SEQ ID NO: 593918 - RNA, 17 nt, Homo sapiens
caccaauuaucaucuuu

SEQ ID NO: 593919 - RNA, 14 nt, Homo sapiens
caccacacacacac

SEQ ID NO: 593920 - RNA, 14 nt, Homo sapiens
caccacacccaggu

SEQ ID NO: 593921 - RNA, 16 nt, Homo sapiens
caccacaccuggcuaa

SEQ ID NO: 593922 - RNA, 17 nt, Homo sapiens
caccacagccagcaccu

SEQ ID NO: 593923 - RNA, 16 nt, Homo sapiens
caccaccacacuacac

SEQ ID NO: 593924 - RNA, 12 nt, Homo sapiens
caccaccaggag

SEQ ID NO: 593925 - RNA, 20 nt, Homo sapiens
caccacccccacuggugaga

SEQ ID NO: 593926 - RNA, 21 nt, Homo sapiens
caccaccucugugggcacugg

SEQ ID NO: 593927 - RNA, 21 nt, Homo sapiens
caccacgcagaccaccagcau

SEQ ID NO: 593928 - RNA, 23 nt, Homo sapiens
caccacggggucugcagcaauga

SEQ ID NO: 593929 - RNA, 20 nt, Homo sapiens
caccacuagguggugcugga

SEQ ID NO: 593930 - RNA, 14 nt, Homo sapiens
caccacucaaaaau

SEQ ID NO: 593931 - RNA, 15 nt, Homo sapiens
caccacucaaaaaug

SEQ ID NO: 593932 - RNA, 15 nt, Homo sapiens
caccacugauaucau

SEQ ID NO: 593933 - RNA, 14 nt, Homo sapiens
caccacuggccacc

SEQ ID NO: 593934 - RNA, 23 nt, Homo sapiens
caccacuuccgucccauccuugc

SEQ ID NO: 593935 - RNA, 17 nt, Homo sapiens
caccagagcaaccucuc

SEQ ID NO: 593936 - RNA, 13 nt, Homo sapiens
caccagcagccug

SEQ ID NO: 593937 - RNA, 14 nt, Homo sapiens
caccagccauccuc

SEQ ID NO: 593938 - RNA, 17 nt, Homo sapiens
caccagccccagcaaga

SEQ ID NO: 593939 - RNA, 18 nt, Homo sapiens
caccaggacucagaggau

SEQ ID NO: 593940 - RNA, 21 nt, Homo sapiens
caccaggcccacgaggagcag

SEQ ID NO: 593941 - RNA, 16 nt, Homo sapiens
caccagugcgugcucc

SEQ ID NO: 593942 - RNA, 20 nt, Homo sapiens
caccagugguacuaagcaca

SEQ ID NO: 593943 - RNA, 14 nt, Homo sapiens
caccaguugccguu

SEQ ID NO: 593944 - RNA, 13 nt, Homo sapiens
caccauauugcua

SEQ ID NO: 593945 - RNA, 15 nt, Homo sapiens
caccaugaacuugau

SEQ ID NO: 593946 - RNA, 23 nt, Homo sapiens
caccaugcacuguaaauaucccu

SEQ ID NO: 593947 - RNA, 23 nt, Homo sapiens
caccaugcugaauguacacugau

SEQ ID NO: 593948 - RNA, 15 nt, Homo sapiens
caccauggugacugc

SEQ ID NO: 593949 - RNA, 20 nt, Homo sapiens
caccauucacauuugaugua

SEQ ID NO: 593950 - RNA, 22 nt, Homo sapiens
caccauugcacuccacccuggg

SEQ ID NO: 593951 - RNA, 21 nt, Homo sapiens
caccauuuuguuuagacaauu

SEQ ID NO: 593952 - RNA, 22 nt, Homo sapiens
cacccaaagccugucccaggac

SEQ ID NO: 593953 - RNA, 11 nt, Homo sapiens
cacccaaaugu

SEQ ID NO: 593954 - RNA, 15 nt, Homo sapiens
cacccaacuuuguca

SEQ ID NO: 593955 - RNA, 14 nt, Homo sapiens
cacccacaacaucu

SEQ ID NO: 593956 - RNA, 21 nt, Homo sapiens
cacccaccagaaauuccagua

SEQ ID NO: 593957 - RNA, 13 nt, Homo sapiens
cacccaccagagu

SEQ ID NO: 593958 - RNA, 13 nt, Homo sapiens
cacccaccuccac

SEQ ID NO: 593959 - RNA, 11 nt, Homo sapiens
cacccacguga

SEQ ID NO: 593960 - RNA, 19 nt, Homo sapiens
cacccagagggaguagaau

SEQ ID NO: 593961 - RNA, 23 nt, Homo sapiens
cacccagggagcugaugccccuu

SEQ ID NO: 593962 - RNA, 13 nt, Homo sapiens
cacccauaucaug

SEQ ID NO: 593963 - RNA, 20 nt, Homo sapiens
cacccauggggagacaguug

SEQ ID NO: 593964 - RNA, 14 nt, Homo sapiens
cacccaugugccaa

SEQ ID NO: 593965 - RNA, 13 nt, Homo sapiens
caccccaacaucu

SEQ ID NO: 593966 - RNA, 12 nt, Homo sapiens
caccccaagaga

SEQ ID NO: 593967 - RNA, 18 nt, Homo sapiens
caccccaaucccugccac

SEQ ID NO: 593968 - RNA, 16 nt, Homo sapiens
cacccccaccauccag

SEQ ID NO: 593969 - RNA, 19 nt, Homo sapiens
cacccccaccauccaggug

SEQ ID NO: 593970 - RNA, 22 nt, Homo sapiens
cacccccgacggccuccaggag

SEQ ID NO: 593971 - RNA, 20 nt, Homo sapiens
cacccccuucucugcuccac

SEQ ID NO: 593972 - RNA, 16 nt, Homo sapiens
caccccgagggcugag

SEQ ID NO: 593973 - RNA, 12 nt, Homo sapiens
caccccgugcca

SEQ ID NO: 593974 - RNA, 19 nt, Homo sapiens
caccccucuucugcuccuu

SEQ ID NO: 593975 - RNA, 23 nt, Homo sapiens
caccccugugcuccgugccucca

SEQ ID NO: 593976 - RNA, 16 nt, Homo sapiens
caccccuuauccagga

SEQ ID NO: 593977 - RNA, 15 nt, Homo sapiens
caccccuuccaauga

SEQ ID NO: 593978 - RNA, 17 nt, Homo sapiens
caccccuuuucgucacg

SEQ ID NO: 593979 - RNA, 17 nt, Homo sapiens
cacccgcccacagccag

SEQ ID NO: 593980 - RNA, 15 nt, Homo sapiens
cacccgcuuccuccc

SEQ ID NO: 593981 - RNA, 13 nt, Homo sapiens
cacccggacaggu

SEQ ID NO: 593982 - RNA, 13 nt, Homo sapiens
cacccgggagcag

SEQ ID NO: 593983 - RNA, 19 nt, Homo sapiens
cacccuacaaaccuguauu

SEQ ID NO: 593984 - RNA, 15 nt, Homo sapiens
cacccucaaauguca

SEQ ID NO: 593985 - RNA, 13 nt, Homo sapiens
cacccuccacaaa

SEQ ID NO: 593986 - RNA, 15 nt, Homo sapiens
cacccuccaccucuc

SEQ ID NO: 593987 - RNA, 18 nt, Homo sapiens
cacccuccaccucuucac

SEQ ID NO: 593988 - RNA, 23 nt, Homo sapiens
cacccuccagaauccugauggua

SEQ ID NO: 593989 - RNA, 21 nt, Homo sapiens
cacccuccagcuuuuccucag

SEQ ID NO: 593990 - RNA, 19 nt, Homo sapiens
cacccuccccucucuugca

SEQ ID NO: 593991 - RNA, 16 nt, Homo sapiens
cacccucuuccuguga

SEQ ID NO: 593992 - RNA, 24 nt, Homo sapiens
cacccugaguugcuuuucagcuga

SEQ ID NO: 593993 - RNA, 19 nt, Homo sapiens
cacccugcaggacuugcca

SEQ ID NO: 593994 - RNA, 13 nt, Homo sapiens
cacccuguggucu

SEQ ID NO: 593995 - RNA, 21 nt, Homo sapiens
cacccuuccccuccuucuccc

SEQ ID NO: 593996 - RNA, 15 nt, Homo sapiens
cacccuuucuugaca

SEQ ID NO: 593997 - RNA, 23 nt, Homo sapiens
cacccuuugugguuacaguuuga

SEQ ID NO: 593998 - RNA, 20 nt, Homo sapiens
caccgagaauguuguauuca

SEQ ID NO: 593999 - RNA, 22 nt, Homo sapiens
caccgcgcccagccucaucucu

SEQ ID NO: 594000 - RNA, 15 nt, Homo sapiens
caccggcucucaccu

SEQ ID NO: 594001 - RNA, 20 nt, Homo sapiens
caccgggcuggcugcuugca

SEQ ID NO: 594002 - RNA, 17 nt, Homo sapiens
caccguacaucugcaau

SEQ ID NO: 594003 - RNA, 22 nt, Homo sapiens
caccguacaucugcaauaugaa

SEQ ID NO: 594004 - RNA, 20 nt, Homo sapiens
caccgugccugaucugcaca

SEQ ID NO: 594005 - RNA, 19 nt, Homo sapiens
caccuaagucucugugaau

SEQ ID NO: 594006 - RNA, 14 nt, Homo sapiens
caccuaauaucaau

SEQ ID NO: 594007 - RNA, 21 nt, Homo sapiens
caccuaauguuuaugagccag

SEQ ID NO: 594008 - RNA, 17 nt, Homo sapiens
caccuacauuaucucac

SEQ ID NO: 594009 - RNA, 11 nt, Homo sapiens
caccuacuccu

SEQ ID NO: 594010 - RNA, 14 nt, Homo sapiens
caccuacugcacuu

SEQ ID NO: 594011 - RNA, 15 nt, Homo sapiens
caccuacugcuuacu

SEQ ID NO: 594012 - RNA, 21 nt, Homo sapiens
caccuagaaaggaacugcaau

SEQ ID NO: 594013 - RNA, 22 nt, Homo sapiens
caccuagaaaggaacugcaaua

SEQ ID NO: 594014 - RNA, 13 nt, Homo sapiens
caccuagacugua

SEQ ID NO: 594015 - RNA, 22 nt, Homo sapiens
caugugugugcaagugugugca

SEQ ID NO: 594016 - RNA, 11 nt, Homo sapiens
cauguguuucu

SEQ ID NO: 594017 - RNA, 19 nt, Homo sapiens
cauguguuuuaauuccaau

SEQ ID NO: 594018 - RNA, 19 nt, Homo sapiens
cauguuacuaagcaggcca

SEQ ID NO: 594019 - RNA, 16 nt, Homo sapiens
cauguuacucaugacu

SEQ ID NO: 594020 - RNA, 21 nt, Homo sapiens
cauguuaggaaaauuucacau

SEQ ID NO: 594021 - RNA, 20 nt, Homo sapiens
cauguuauauuuaaugcauu

SEQ ID NO: 594022 - RNA, 13 nt, Homo sapiens
cauguucacugug

SEQ ID NO: 594023 - RNA, 15 nt, Homo sapiens
cauguucacugugag

SEQ ID NO: 594024 - RNA, 14 nt, Homo sapiens
cauguucauugcaa

SEQ ID NO: 594025 - RNA, 19 nt, Homo sapiens
cauguucugugacugaaga

SEQ ID NO: 594026 - RNA, 19 nt, Homo sapiens
cauguucuugucauaaaau

SEQ ID NO: 594027 - RNA, 24 nt, Homo sapiens
cauguuggccaggcuggucucaaa

SEQ ID NO: 594028 - RNA, 22 nt, Homo sapiens
cauguuguugaggcugucacag

SEQ ID NO: 594029 - RNA, 24 nt, Homo sapiens
cauguuugagaacccccuaaccuc

SEQ ID NO: 594030 - RNA, 17 nt, Homo sapiens
cauguuugcagggguga

SEQ ID NO: 594031 - RNA, 22 nt, Homo sapiens
cauguuuuguauguuaaauuca

SEQ ID NO: 594032 - RNA, 12 nt, Homo sapiens
cauguuuuuacc

SEQ ID NO: 594033 - RNA, 14 nt, Homo sapiens
cauguuuuugccaa

SEQ ID NO: 594034 - RNA, 22 nt, Homo sapiens
cauuaaaaaaauuagaaaguag

SEQ ID NO: 594035 - RNA, 18 nt, Homo sapiens
cauuaaaaagugggcaaa

SEQ ID NO: 594036 - RNA, 20 nt, Homo sapiens
cauuaaaacaaauccauaau

SEQ ID NO: 594037 - RNA, 17 nt, Homo sapiens
cauuaaaauccaguauu

SEQ ID NO: 594038 - RNA, 23 nt, Homo sapiens
cauuaaaccugucuccacugugc

SEQ ID NO: 594039 - RNA, 13 nt, Homo sapiens
cauuaacacaaag

SEQ ID NO: 594040 - RNA, 23 nt, Homo sapiens
cauuaagagguuuauuuggguac

SEQ ID NO: 594041 - RNA, 13 nt, Homo sapiens
cauuaagcacugu

SEQ ID NO: 594042 - RNA, 14 nt, Homo sapiens
cauuaagcacugug

SEQ ID NO: 594043 - RNA, 17 nt, Homo sapiens
cauuaagcacuguggau

SEQ ID NO: 594044 - RNA, 16 nt, Homo sapiens
cauuaaguaaucaaua

SEQ ID NO: 594045 - RNA, 12 nt, Homo sapiens
cauuaagugaaa

SEQ ID NO: 594046 - RNA, 14 nt, Homo sapiens
cauuaauauaugga

SEQ ID NO: 594047 - RNA, 16 nt, Homo sapiens
cauuaauauuugcuga

SEQ ID NO: 594048 - RNA, 19 nt, Homo sapiens
cauuaauccacauguuuca

SEQ ID NO: 594049 - RNA, 23 nt, Homo sapiens
cauuaaugagauguuauuacugu

SEQ ID NO: 594050 - RNA, 18 nt, Homo sapiens
cauuaaugcacaucugca

SEQ ID NO: 594051 - RNA, 17 nt, Homo sapiens
cauuacaaaaaaacacg

SEQ ID NO: 594052 - RNA, 15 nt, Homo sapiens
cauuacaauccugca

SEQ ID NO: 594053 - RNA, 18 nt, Homo sapiens
cauuacaauugcaguuuu

SEQ ID NO: 594054 - RNA, 16 nt, Homo sapiens
cauuacaguucuuucc

SEQ ID NO: 594055 - RNA, 13 nt, Homo sapiens
cauuaccauauaa

SEQ ID NO: 594056 - RNA, 15 nt, Homo sapiens
cauuacgugcauuua

SEQ ID NO: 594057 - RNA, 22 nt, Homo sapiens
cauuacugccaucuuuaucaug

SEQ ID NO: 594058 - RNA, 16 nt, Homo sapiens
cauuacuuguauaaau

SEQ ID NO: 594059 - RNA, 19 nt, Homo sapiens
cauuacuuugauaucugau

SEQ ID NO: 594060 - RNA, 13 nt, Homo sapiens
cauuagagucagc

SEQ ID NO: 594061 - RNA, 23 nt, Homo sapiens
cauuagcauucugguuuugacau

SEQ ID NO: 594062 - RNA, 20 nt, Homo sapiens
cauuagcuuugggugccuuu

SEQ ID NO: 594063 - RNA, 19 nt, Homo sapiens
cauuaggucccucacucca

SEQ ID NO: 594064 - RNA, 16 nt, Homo sapiens
cauuagucacuuugaa

SEQ ID NO: 594065 - RNA, 15 nt, Homo sapiens
cauuaguuguuauua

SEQ ID NO: 594066 - RNA, 19 nt, Homo sapiens
cauuaguuuuaaucucuua

SEQ ID NO: 594067 - RNA, 17 nt, Homo sapiens
cauuauaaaccuucaga

SEQ ID NO: 594068 - RNA, 18 nt, Homo sapiens
cauuauaacugaaggaga

SEQ ID NO: 594069 - RNA, 22 nt, Homo sapiens
cauuauaucauuggaacaacug

SEQ ID NO: 594070 - RNA, 14 nt, Homo sapiens
cauuauauuugcau

SEQ ID NO: 594071 - RNA, 15 nt, Homo sapiens
cauuaucacagugaa

SEQ ID NO: 594072 - RNA, 18 nt, Homo sapiens
cauuaucauaugaacuug

SEQ ID NO: 594073 - RNA, 13 nt, Homo sapiens
cauuauccuugcu

SEQ ID NO: 594074 - RNA, 18 nt, Homo sapiens
cauuaucgggagcagugu

SEQ ID NO: 594075 - RNA, 21 nt, Homo sapiens
cauuaugaguaguguggaauu

SEQ ID NO: 594076 - RNA, 12 nt, Homo sapiens
cauuauguauga

SEQ ID NO: 594077 - RNA, 15 nt, Homo sapiens
cauuauuacuuuucc

SEQ ID NO: 594078 - RNA, 19 nt, Homo sapiens
cauuauuucagugugcaua

SEQ ID NO: 594079 - RNA, 19 nt, Homo sapiens
cauuauuuuuccacuuugu

SEQ ID NO: 594080 - RNA, 22 nt, Homo sapiens
cauuauuuuuguuagcaaagau

SEQ ID NO: 594081 - RNA, 17 nt, Homo sapiens
cauucaacucuccaaug

SEQ ID NO: 594082 - RNA, 23 nt, Homo sapiens
cauucaauaaauauuaguuaaua

SEQ ID NO: 594083 - RNA, 14 nt, Homo sapiens
cauucacaccagcu

SEQ ID NO: 594084 - RNA, 15 nt, Homo sapiens
cauucacaccagcua

SEQ ID NO: 594085 - RNA, 15 nt, Homo sapiens
cauucacagcccaga

SEQ ID NO: 594086 - RNA, 22 nt, Homo sapiens
cauucacagcccagaaccacag

SEQ ID NO: 594087 - RNA, 22 nt, Homo sapiens
cauucacugugcacuuugcuca

SEQ ID NO: 594088 - RNA, 23 nt, Homo sapiens
cauucagaagaaaaagaagcaac

SEQ ID NO: 594089 - RNA, 22 nt, Homo sapiens
cauucaguggcccacauuuucc

SEQ ID NO: 594090 - RNA, 23 nt, Homo sapiens
cauucaguuaauucaaugugaac

SEQ ID NO: 594091 - RNA, 23 nt, Homo sapiens
cauucauaggcaguaauguuccu

SEQ ID NO: 594092 - RNA, 14 nt, Homo sapiens
cauucaucuugcaa

SEQ ID NO: 594093 - RNA, 23 nt, Homo sapiens
cauucaugacaacaugaaaccua

SEQ ID NO: 594094 - RNA, 21 nt, Homo sapiens
cauuccaaaauacaauguuau

SEQ ID NO: 594095 - RNA, 23 nt, Homo sapiens
cauuccaaaguucaacuugguga

SEQ ID NO: 594096 - RNA, 14 nt, Homo sapiens
cauuccagcucugc

SEQ ID NO: 594097 - RNA, 19 nt, Homo sapiens
cauuccaggaaaacuggga

SEQ ID NO: 594098 - RNA, 23 nt, Homo sapiens
cauuccauuuugugaauugugac

SEQ ID NO: 594099 - RNA, 15 nt, Homo sapiens
cauucccaucuguca

SEQ ID NO: 594100 - RNA, 23 nt, Homo sapiens
cauucccauguugucaauaacag

SEQ ID NO: 594101 - RNA, 13 nt, Homo sapiens
cauucccccaugu

SEQ ID NO: 594102 - RNA, 21 nt, Homo sapiens
cauucccugagucaccaggaa

SEQ ID NO: 594103 - RNA, 22 nt, Homo sapiens
cauuccucagcuucuucacagg

SEQ ID NO: 594104 - RNA, 15 nt, Homo sapiens
cauuccugaagggaa

SEQ ID NO: 594105 - RNA, 14 nt, Homo sapiens
cauuccugacaaag

SEQ ID NO: 594106 - RNA, 15 nt, Homo sapiens
cauuccuuacuugca

SEQ ID NO: 594107 - RNA, 21 nt, Homo sapiens
cauuccuuagcuauuuauccc

SEQ ID NO: 594108 - RNA, 19 nt, Homo sapiens
cauuccuucacucauccag

SEQ ID NO: 594109 - RNA, 14 nt, Homo sapiens
cauuccuucccacc

SEQ ID NO: 594110 - RNA, 18 nt, Homo sapiens
cauucgaucgagcuauuc

SEQ ID NO: 594111 - RNA, 21 nt, Homo sapiens
cauucggggaagcugcacaug

SEQ ID NO: 594112 - RNA, 14 nt, Homo sapiens
cauucuacuagcag

SEQ ID NO: 594113 - RNA, 15 nt, Homo sapiens
cauucuagauccugc

SEQ ID NO: 594114 - RNA, 20 nt, Homo sapiens
cauucuagcugagaagcaau

SEQ ID NO: 594115 - RNA, 13 nt, Homo sapiens
cauucuagguagg

SEQ ID NO: 594116 - RNA, 13 nt, Homo sapiens
cauucucacauaa

SEQ ID NO: 594117 - RNA, 20 nt, Homo sapiens
cauucuccagggguuuacag

SEQ ID NO: 594118 - RNA, 21 nt, Homo sapiens
cauucuccucaugcuuagaaa

SEQ ID NO: 594119 - RNA, 19 nt, Homo sapiens
cauucuccuuguguuacua

SEQ ID NO: 594120 - RNA, 18 nt, Homo sapiens
cauucucuucccagugaa

SEQ ID NO: 594121 - RNA, 24 nt, Homo sapiens
cauucugaaccuuaucaagaggau

SEQ ID NO: 594122 - RNA, 19 nt, Homo sapiens
cauucugaaucaagcacac

SEQ ID NO: 594123 - RNA, 16 nt, Homo sapiens
cauucugaccauuuca

SEQ ID NO: 594124 - RNA, 18 nt, Homo sapiens
cauucugcaagcacaucu

SEQ ID NO: 594125 - RNA, 16 nt, Homo sapiens
cauucugcaaguauac

SEQ ID NO: 594126 - RNA, 17 nt, Homo sapiens
cauucuggaaaagcaaa

SEQ ID NO: 594127 - RNA, 22 nt, Homo sapiens
cauucugguuuugacaucagca

SEQ ID NO: 594128 - RNA, 17 nt, Homo sapiens
cauucuucagugucucu

SEQ ID NO: 594129 - RNA, 22 nt, Homo sapiens
cauucuuccaucaucacuguaa

SEQ ID NO: 594130 - RNA, 18 nt, Homo sapiens
cauucuucugagcacugu

SEQ ID NO: 594131 - RNA, 11 nt, Homo sapiens
cauucuuguuc

SEQ ID NO: 594132 - RNA, 18 nt, Homo sapiens
cauucuuuaucuugacau

SEQ ID NO: 594133 - RNA, 17 nt, Homo sapiens
cauugaaacuacacuaa

SEQ ID NO: 594134 - RNA, 23 nt, Homo sapiens
cauugaacagcugugagccaugc

SEQ ID NO: 594135 - RNA, 21 nt, Homo sapiens
cauugaagauccgagugugau

SEQ ID NO: 594136 - RNA, 19 nt, Homo sapiens
cauugaagccgacucuggc

SEQ ID NO: 594137 - RNA, 14 nt, Homo sapiens
cauugaauucauua

SEQ ID NO: 594138 - RNA, 20 nt, Homo sapiens
cauugaccaagaacugcaug

SEQ ID NO: 594139 - RNA, 23 nt, Homo sapiens
cauugagaacugcauauguuucg

SEQ ID NO: 594140 - RNA, 12 nt, Homo sapiens
cauugagcauuu

SEQ ID NO: 594141 - RNA, 18 nt, Homo sapiens
cauugauacaaaguacag

SEQ ID NO: 594142 - RNA, 21 nt, Homo sapiens
cauugauguaaggacuguaaa

SEQ ID NO: 594143 - RNA, 21 nt, Homo sapiens
cauugccauagcugacuacaa

SEQ ID NO: 594144 - RNA, 15 nt, Homo sapiens
cauugccuucucugc

SEQ ID NO: 594145 - RNA, 14 nt, Homo sapiens
cauugccuuuccag

SEQ ID NO: 594146 - RNA, 17 nt, Homo sapiens
cauugccuuuccagggu

SEQ ID NO: 594147 - RNA, 21 nt, Homo sapiens
cauugcuaaacugaugacuua

SEQ ID NO: 594148 - RNA, 14 nt, Homo sapiens
cauugcucuaugaa

SEQ ID NO: 594149 - RNA, 17 nt, Homo sapiens
cauugcucuugagucuu

SEQ ID NO: 594150 - RNA, 14 nt, Homo sapiens
cauugcugcugcua

SEQ ID NO: 594151 - RNA, 20 nt, Homo sapiens
cauugcuuaugucaaaugga

SEQ ID NO: 594152 - RNA, 17 nt, Homo sapiens
cauugcuucacuaccca

SEQ ID NO: 594153 - RNA, 17 nt, Homo sapiens
cauugcuuuccacugag

SEQ ID NO: 594154 - RNA, 15 nt, Homo sapiens
cauugcuuucgugua

SEQ ID NO: 594155 - RNA, 17 nt, Homo sapiens
cauuggaacaacugaua

SEQ ID NO: 594156 - RNA, 13 nt, Homo sapiens
cauuggaagccau

SEQ ID NO: 594157 - RNA, 19 nt, Homo sapiens
cauuggaauucuacuggaa

SEQ ID NO: 594158 - RNA, 18 nt, Homo sapiens
cauuggagcaagcuugcc

SEQ ID NO: 594159 - RNA, 22 nt, Homo sapiens
cauuggauucaucagcauuugg

SEQ ID NO: 594160 - RNA, 16 nt, Homo sapiens
cauuggccgacaucac

SEQ ID NO: 594161 - RNA, 17 nt, Homo sapiens
cauuggccgacaucaca

SEQ ID NO: 594162 - RNA, 14 nt, Homo sapiens
cauugggauauucu

SEQ ID NO: 594163 - RNA, 19 nt, Homo sapiens
cauuggguuguagccaaag

SEQ ID NO: 594164 - RNA, 19 nt, Homo sapiens
cauuggguuuggggccaug

SEQ ID NO: 594165 - RNA, 21 nt, Homo sapiens
cauugguacacguguaacaag

SEQ ID NO: 594166 - RNA, 17 nt, Homo sapiens
cauuggucauugugaau

SEQ ID NO: 594167 - RNA, 22 nt, Homo sapiens
cauugguuaauuuuuacaugga

SEQ ID NO: 594168 - RNA, 14 nt, Homo sapiens
cauuguaaaccaca

SEQ ID NO: 594169 - RNA, 16 nt, Homo sapiens
cauuguagccucaauc

SEQ ID NO: 594170 - RNA, 13 nt, Homo sapiens
cauuguaguuaau

SEQ ID NO: 594171 - RNA, 21 nt, Homo sapiens
cauuguauauauguguaugca

SEQ ID NO: 594172 - RNA, 21 nt, Homo sapiens
cauuguccuccuuuucacuuu

SEQ ID NO: 594173 - RNA, 22 nt, Homo sapiens
cauugucguauaggcauguaaa

SEQ ID NO: 594174 - RNA, 15 nt, Homo sapiens
cauugucuacuccua

SEQ ID NO: 594175 - RNA, 21 nt, Homo sapiens
cauugucucguguacagcucc

SEQ ID NO: 594176 - RNA, 20 nt, Homo sapiens
cauugugaagcaccuacuau

SEQ ID NO: 594177 - RNA, 15 nt, Homo sapiens
cauugugaggguuaa

SEQ ID NO: 594178 - RNA, 14 nt, Homo sapiens
cauugugauuuauu

SEQ ID NO: 594179 - RNA, 21 nt, Homo sapiens
cauuguggcuccuaucugugu

SEQ ID NO: 594180 - RNA, 18 nt, Homo sapiens
cauuguggucauagcacc

SEQ ID NO: 594181 - RNA, 21 nt, Homo sapiens
cauuguuaccucuauauacca

SEQ ID NO: 594182 - RNA, 22 nt, Homo sapiens
cauuguuauaaagacacaugca

SEQ ID NO: 594183 - RNA, 19 nt, Homo sapiens
cauuguuccacacauuuaa

SEQ ID NO: 594184 - RNA, 14 nt, Homo sapiens
cauuguugucaagg

SEQ ID NO: 594185 - RNA, 20 nt, Homo sapiens
cauuuaaagaaagaaugcau

SEQ ID NO: 594186 - RNA, 16 nt, Homo sapiens
cauuuaaauuccacag

SEQ ID NO: 594187 - RNA, 23 nt, Homo sapiens
cauuuaaccccuugguacugaaa

SEQ ID NO: 594188 - RNA, 23 nt, Homo sapiens
cauuuacagucucuuucuuccuu

SEQ ID NO: 594189 - RNA, 20 nt, Homo sapiens
cauuuacucuauaaucugca

SEQ ID NO: 594190 - RNA, 20 nt, Homo sapiens
cauuuacuuagcagaaccac

SEQ ID NO: 594191 - RNA, 22 nt, Homo sapiens
cauuuacuuagcagaaccacau

SEQ ID NO: 594192 - RNA, 11 nt, Homo sapiens
cauuuacuuuu

SEQ ID NO: 594193 - RNA, 15 nt, Homo sapiens
cauuuagaacuugca

SEQ ID NO: 594194 - RNA, 21 nt, Homo sapiens
cauuuagaacuugcagcugau

SEQ ID NO: 594195 - RNA, 16 nt, Homo sapiens
cauuuagaacuuuaag

SEQ ID NO: 594196 - RNA, 15 nt, Homo sapiens
cauuuagcccucaca

SEQ ID NO: 594197 - RNA, 22 nt, Homo sapiens
cauuuaggaaaaauaauucuau

SEQ ID NO: 594198 - RNA, 13 nt, Homo sapiens
cauuuaguuuaaa

SEQ ID NO: 594199 - RNA, 15 nt, Homo sapiens
cauuuauaaaaccau

SEQ ID NO: 594200 - RNA, 12 nt, Homo sapiens
cauuuauagaau

SEQ ID NO: 594201 - RNA, 17 nt, Homo sapiens
cauuuauccacaggaaa

SEQ ID NO: 594202 - RNA, 18 nt, Homo sapiens
cauuuaugaugcaguuuc

SEQ ID NO: 594203 - RNA, 20 nt, Homo sapiens
cauuuauuauuucaauguga

SEQ ID NO: 594204 - RNA, 19 nt, Homo sapiens
cauuuauuucaugauucaa

SEQ ID NO: 594205 - RNA, 16 nt, Homo sapiens
cauuuauuuuuaguua

SEQ ID NO: 594206 - RNA, 16 nt, Homo sapiens
cauuucaaucauugaa

SEQ ID NO: 594207 - RNA, 22 nt, Homo sapiens
cauuucaauuagggaugcucaa

SEQ ID NO: 594208 - RNA, 20 nt, Homo sapiens
cauuucaccugugacaaagg

SEQ ID NO: 594209 - RNA, 17 nt, Homo sapiens
cauuucaggggucguca

SEQ ID NO: 594210 - RNA, 15 nt, Homo sapiens
cauuucaggugugag

SEQ ID NO: 594211 - RNA, 20 nt, Homo sapiens
cauuucaucagcaaguuugg

SEQ ID NO: 594212 - RNA, 20 nt, Homo sapiens
cauuuccaacaccacagaca

SEQ ID NO: 594213 - RNA, 15 nt, Homo sapiens
cauuuccaagcacuu

SEQ ID NO: 594214 - RNA, 12 nt, Homo sapiens
cauuuccaugca

SEQ ID NO: 594215 - RNA, 15 nt, Homo sapiens
cauuuccuaugcaaa

SEQ ID NO: 594216 - RNA, 19 nt, Homo sapiens
cauuuccugacagaaggac

SEQ ID NO: 594217 - RNA, 16 nt, Homo sapiens
cauuuccuggucagug

SEQ ID NO: 594218 - RNA, 23 nt, Homo sapiens
cauuucuacuaugaucagaagaa

SEQ ID NO: 594219 - RNA, 14 nt, Homo sapiens
cauuucuacuguga

SEQ ID NO: 594220 - RNA, 14 nt, Homo sapiens
cauuucuaucacau

SEQ ID NO: 594221 - RNA, 19 nt, Homo sapiens
cauuucucaaaugcacauc

SEQ ID NO: 594222 - RNA, 22 nt, Homo sapiens
cauuucucaucaguaguucaca

SEQ ID NO: 594223 - RNA, 16 nt, Homo sapiens
cauuucugagaucaaa

SEQ ID NO: 594224 - RNA, 14 nt, Homo sapiens
cauuucugucucca

SEQ ID NO: 594225 - RNA, 20 nt, Homo sapiens
cauuucuguucucauuugau

SEQ ID NO: 594226 - RNA, 21 nt, Homo sapiens
cauuucuucucguuuucacag

SEQ ID NO: 594227 - RNA, 16 nt, Homo sapiens
cauuugaaccagugau

SEQ ID NO: 594228 - RNA, 22 nt, Homo sapiens
cauuugaauaggcaaacccaaa

SEQ ID NO: 594229 - RNA, 19 nt, Homo sapiens
cauuugaggggaaaacacc

SEQ ID NO: 594230 - RNA, 14 nt, Homo sapiens
cauuugaggggcca

SEQ ID NO: 594231 - RNA, 16 nt, Homo sapiens
cauuugaguauuacaa

SEQ ID NO: 594232 - RNA, 15 nt, Homo sapiens
cauuugaguuugcaa

SEQ ID NO: 594233 - RNA, 15 nt, Homo sapiens
cauuugauguacaug

SEQ ID NO: 594234 - RNA, 17 nt, Homo sapiens
cauuugauugucauuuu

SEQ ID NO: 594235 - RNA, 15 nt, Homo sapiens
cauuugcaccuaccu

SEQ ID NO: 594236 - RNA, 16 nt, Homo sapiens
cauuugccacuuagua

SEQ ID NO: 594237 - RNA, 15 nt, Homo sapiens
cauuugccuaauucc

SEQ ID NO: 594238 - RNA, 20 nt, Homo sapiens
cauuugcugaacucagcaca

SEQ ID NO: 594239 - RNA, 21 nt, Homo sapiens
cauuugguagaaggacugaac

SEQ ID NO: 594240 - RNA, 14 nt, Homo sapiens
cauuuggucucagg

SEQ ID NO: 594241 - RNA, 16 nt, Homo sapiens
cauuuggugacugugu

SEQ ID NO: 594242 - RNA, 16 nt, Homo sapiens
cauuuguaccucgagu

SEQ ID NO: 594243 - RNA, 12 nt, Homo sapiens
cauuuguagcaa

SEQ ID NO: 594244 - RNA, 17 nt, Homo sapiens
cauuuguagcaauuuaa

SEQ ID NO: 594245 - RNA, 21 nt, Homo sapiens
cauuuguagcucuggaccugu

SEQ ID NO: 594246 - RNA, 14 nt, Homo sapiens
cauuuguagcuuug

SEQ ID NO: 594247 - RNA, 14 nt, Homo sapiens
cauuugugcaaaau

SEQ ID NO: 594248 - RNA, 11 nt, Homo sapiens
cauuugugccc

SEQ ID NO: 594249 - RNA, 15 nt, Homo sapiens
cauuugugucaaugg

SEQ ID NO: 594250 - RNA, 16 nt, Homo sapiens
cauuugugugugugca

SEQ ID NO: 594251 - RNA, 18 nt, Homo sapiens
cauuuguucucacaccaa

SEQ ID NO: 594252 - RNA, 21 nt, Homo sapiens
cauuuguucucacaccaacag

SEQ ID NO: 594253 - RNA, 21 nt, Homo sapiens
cauuuguuucccccacaguuu

SEQ ID NO: 594254 - RNA, 14 nt, Homo sapiens
cauuuuaaaacuua

SEQ ID NO: 594255 - RNA, 18 nt, Homo sapiens
cauuuuaacgcugccuaa

SEQ ID NO: 594256 - RNA, 20 nt, Homo sapiens
cauuuuaagaagacaugaca

SEQ ID NO: 594257 - RNA, 15 nt, Homo sapiens
cauuuuaagaguuac

SEQ ID NO: 594258 - RNA, 22 nt, Homo sapiens
cauuuuaaguuuguaguaaaag

SEQ ID NO: 594259 - RNA, 22 nt, Homo sapiens
cauuuuaauaucuuaugcuauu

SEQ ID NO: 594260 - RNA, 19 nt, Homo sapiens
cauuuuagugguagcauau

SEQ ID NO: 594261 - RNA, 14 nt, Homo sapiens
cauuuuaugcagaa

SEQ ID NO: 594262 - RNA, 14 nt, Homo sapiens
cauuuuauugacug

SEQ ID NO: 594263 - RNA, 14 nt, Homo sapiens
cauuuucaauuugg

SEQ ID NO: 594264 - RNA, 20 nt, Homo sapiens
cauuuuccuuaggaaaaaca

SEQ ID NO: 594265 - RNA, 18 nt, Homo sapiens
cauuuucuucucugugaa

SEQ ID NO: 594266 - RNA, 15 nt, Homo sapiens
cauuuuuaacagcau

SEQ ID NO: 594267 - RNA, 14 nt, Homo sapiens
cauuuuuaaccacu

SEQ ID NO: 594268 - RNA, 21 nt, Homo sapiens
cauuuuuagauugguucuguu

SEQ ID NO: 594269 - RNA, 22 nt, Homo sapiens
cauuuuuauuuuauggaauaga

SEQ ID NO: 594270 - RNA, 19 nt, Homo sapiens
cauuuuucaaagcaauuga

SEQ ID NO: 594271 - RNA, 16 nt, Homo sapiens
cauuuuucacaucucu

SEQ ID NO: 594272 - RNA, 22 nt, Homo sapiens
cauuuuucacuuugcucucaau

SEQ ID NO: 594273 - RNA, 21 nt, Homo sapiens
cauuuuugaugacuaccucag

SEQ ID NO: 594274 - RNA, 20 nt, Homo sapiens
cauuuuugucagagugcaca

SEQ ID NO: 594275 - RNA, 16 nt, Homo sapiens
cauuuuuucccaguga

SEQ ID NO: 594276 - RNA, 19 nt, Homo sapiens
cauuuuuugggcagcaauu

SEQ ID NO: 594277 - RNA, 23 nt, Homo sapiens
cauuuuuuucuaauggaauguga

SEQ ID NO: 594278 - RNA, 18 nt, Homo sapiens
cauuuuuuuuucaaucaa

SEQ ID NO: 594279 - RNA, 17 nt, Homo sapiens
ccaaaaauaugguugau

SEQ ID NO: 594280 - RNA, 15 nt, Homo sapiens
ccaaaaauuacuuug

SEQ ID NO: 594281 - RNA, 18 nt, Homo sapiens
ccaaaacaagccaaagag

SEQ ID NO: 594282 - RNA, 14 nt, Homo sapiens
ccaaaacaauuucu

SEQ ID NO: 594283 - RNA, 14 nt, Homo sapiens
ccaaaacaguuaau

SEQ ID NO: 594284 - RNA, 11 nt, Homo sapiens
ccaaaaccuuc

SEQ ID NO: 594285 - RNA, 16 nt, Homo sapiens
ccaaaacuuuaaugaa

SEQ ID NO: 594286 - RNA, 24 nt, Homo sapiens
ccaaaacuuuaaugaacuaacuga

SEQ ID NO: 594287 - RNA, 13 nt, Homo sapiens
ccaaaagcacuua

SEQ ID NO: 594288 - RNA, 19 nt, Homo sapiens
ccaaaagcugcucagggaa

SEQ ID NO: 594289 - RNA, 13 nt, Homo sapiens
ccaaaauaaucua

SEQ ID NO: 594290 - RNA, 19 nt, Homo sapiens
ccaaaauaguuaagacaug

SEQ ID NO: 594291 - RNA, 19 nt, Homo sapiens
ccaaaauauuuuuugcaag

SEQ ID NO: 594292 - RNA, 18 nt, Homo sapiens
ccaaaaucggaucugggg

SEQ ID NO: 594293 - RNA, 21 nt, Homo sapiens
ccaaaaugacuuugaacugaa

SEQ ID NO: 594294 - RNA, 13 nt, Homo sapiens
ccaaaauggucuc

SEQ ID NO: 594295 - RNA, 23 nt, Homo sapiens
ccaaaauggucucuaacauuucc

SEQ ID NO: 594296 - RNA, 13 nt, Homo sapiens
ccaaaaugucauu

SEQ ID NO: 594297 - RNA, 15 nt, Homo sapiens
ccaaaauucauuucu

SEQ ID NO: 594298 - RNA, 18 nt, Homo sapiens
ccaaacacauacaggaag

SEQ ID NO: 594299 - RNA, 11 nt, Homo sapiens
ccaaacacuuc

SEQ ID NO: 594300 - RNA, 12 nt, Homo sapiens
ccaaacacuucu

SEQ ID NO: 594301 - RNA, 23 nt, Homo sapiens
ccaaacaggacagcacugggaac

SEQ ID NO: 594302 - RNA, 15 nt, Homo sapiens
ccaaacauccuacaa

SEQ ID NO: 594303 - RNA, 11 nt, Homo sapiens
ccaaacauguu

SEQ ID NO: 594304 - RNA, 21 nt, Homo sapiens
ccaaacauguuguacauuuca

SEQ ID NO: 594305 - RNA, 22 nt, Homo sapiens
ccaaacccaugaggcaauguca

SEQ ID NO: 594306 - RNA, 17 nt, Homo sapiens
ccaaacccuugucagug

SEQ ID NO: 594307 - RNA, 20 nt, Homo sapiens
ccaaaccugucuuggggcca

SEQ ID NO: 594308 - RNA, 14 nt, Homo sapiens
ccaaacuacuucau

SEQ ID NO: 594309 - RNA, 17 nt, Homo sapiens
ccaaacucaaacuugag

SEQ ID NO: 594310 - RNA, 18 nt, Homo sapiens
ccaaacugggggcucugu

SEQ ID NO: 594311 - RNA, 15 nt, Homo sapiens
ccaaacuuguucauu

SEQ ID NO: 594312 - RNA, 14 nt, Homo sapiens
ccaaagacaucagu

SEQ ID NO: 594313 - RNA, 16 nt, Homo sapiens
ccaaagacguguccga

SEQ ID NO: 594314 - RNA, 23 nt, Homo sapiens
ccaaagagacuggagcaucugac

SEQ ID NO: 594315 - RNA, 16 nt, Homo sapiens
ccaaagaguguggugu

SEQ ID NO: 594316 - RNA, 23 nt, Homo sapiens
ccaaagcaaaacaucacauucca

SEQ ID NO: 594317 - RNA, 22 nt, Homo sapiens
ccaaagcacuugcuuacauccu

SEQ ID NO: 594318 - RNA, 15 nt, Homo sapiens
ccaaagcagaaaaga

SEQ ID NO: 594319 - RNA, 13 nt, Homo sapiens
ccaaagcaucaau

SEQ ID NO: 594320 - RNA, 18 nt, Homo sapiens
ccaaagccagaccagaag

SEQ ID NO: 594321 - RNA, 19 nt, Homo sapiens
ccaaagcccaaagugguau

SEQ ID NO: 594322 - RNA, 16 nt, Homo sapiens
ccaaagcucagacuug

SEQ ID NO: 594323 - RNA, 20 nt, Homo sapiens
ccaaagcuuuacuacugugg

SEQ ID NO: 594324 - RNA, 15 nt, Homo sapiens
ccaaaggaaugucca

SEQ ID NO: 594325 - RNA, 23 nt, Homo sapiens
ccaaaggauagugcgauguuuca

SEQ ID NO: 594326 - RNA, 18 nt, Homo sapiens
ccaaaggcauaagacccu

SEQ ID NO: 594327 - RNA, 20 nt, Homo sapiens
ccaaaggcauccauagugca

SEQ ID NO: 594328 - RNA, 20 nt, Homo sapiens
ccaaagggaaaacucuucau

SEQ ID NO: 594329 - RNA, 20 nt, Homo sapiens
ccaaagggaagugaggccca

SEQ ID NO: 594330 - RNA, 22 nt, Homo sapiens
ccaaaggugugcccuguacaca

SEQ ID NO: 594331 - RNA, 15 nt, Homo sapiens
ccaaaguaacugaau

SEQ ID NO: 594332 - RNA, 20 nt, Homo sapiens
ccaaagugccacucauuccu

SEQ ID NO: 594333 - RNA, 18 nt, Homo sapiens
ccaaagugucuuuugaca

SEQ ID NO: 594334 - RNA, 19 nt, Homo sapiens
ccaaaguucccacuccuuc

SEQ ID NO: 594335 - RNA, 16 nt, Homo sapiens
ccaaauaaaacuugag

SEQ ID NO: 594336 - RNA, 14 nt, Homo sapiens
ccaaauaaacucca

SEQ ID NO: 594337 - RNA, 15 nt, Homo sapiens
ccaaauaaauauauu

SEQ ID NO: 594338 - RNA, 20 nt, Homo sapiens
ccaaauaacaucaacaacac

SEQ ID NO: 594339 - RNA, 22 nt, Homo sapiens
ccaaauacgaagcccucuugca

SEQ ID NO: 594340 - RNA, 12 nt, Homo sapiens
ccaaauagcaaa

SEQ ID NO: 594341 - RNA, 16 nt, Homo sapiens
ccaaaucccagggaag

SEQ ID NO: 594342 - RNA, 16 nt, Homo sapiens
ccaaauggcagggaua

SEQ ID NO: 594343 - RNA, 18 nt, Homo sapiens
ccaaauguagcaggugua

SEQ ID NO: 594344 - RNA, 16 nt, Homo sapiens
ccaaaugucaucaggu

SEQ ID NO: 594345 - RNA, 19 nt, Homo sapiens
ccaaauucagccuacugcc

SEQ ID NO: 594346 - RNA, 14 nt, Homo sapiens
ccaaauugaacuca

SEQ ID NO: 594347 - RNA, 14 nt, Homo sapiens
ccaaauugcagcuu

SEQ ID NO: 594348 - RNA, 20 nt, Homo sapiens
ccaaauuguguauauaucuu

SEQ ID NO: 594349 - RNA, 21 nt, Homo sapiens
ccaaauuguguauauaucuua

SEQ ID NO: 594350 - RNA, 19 nt, Homo sapiens
ccaaauuuagucccagaaa

SEQ ID NO: 594351 - RNA, 18 nt, Homo sapiens
ccaaauuuuaucuggaag

SEQ ID NO: 594352 - RNA, 23 nt, Homo sapiens
ccaacaauuggagggucuugagg

SEQ ID NO: 594353 - RNA, 11 nt, Homo sapiens
ccaacacaaag

SEQ ID NO: 594354 - RNA, 13 nt, Homo sapiens
ccaacaccacaga

SEQ ID NO: 594355 - RNA, 18 nt, Homo sapiens
ccaacagaagcagacuuu

SEQ ID NO: 594356 - RNA, 21 nt, Homo sapiens
ccaacagaagcuuccauucca

SEQ ID NO: 594357 - RNA, 15 nt, Homo sapiens
ccaacagccagugug

SEQ ID NO: 594358 - RNA, 16 nt, Homo sapiens
ccaacagcuuuuccca

SEQ ID NO: 594359 - RNA, 17 nt, Homo sapiens
ccaacaugucagaacua

SEQ ID NO: 594360 - RNA, 17 nt, Homo sapiens
ccaacauuaaaacucau

SEQ ID NO: 594361 - RNA, 16 nt, Homo sapiens
ccaacauuucucacug

SEQ ID NO: 594362 - RNA, 14 nt, Homo sapiens
ccaacccaucagaa

SEQ ID NO: 594363 - RNA, 22 nt, Homo sapiens
ccaacccccgccaccucagggc

SEQ ID NO: 594364 - RNA, 16 nt, Homo sapiens
ccaaccccucagauuu

SEQ ID NO: 594365 - RNA, 16 nt, Homo sapiens
ccaacccgaggcaaua

SEQ ID NO: 594366 - RNA, 14 nt, Homo sapiens
ccaacccuauccca

SEQ ID NO: 594367 - RNA, 15 nt, Homo sapiens
ccaacccugccguca

SEQ ID NO: 594368 - RNA, 21 nt, Homo sapiens
ccaacccugccgucaccacca

SEQ ID NO: 594369 - RNA, 15 nt, Homo sapiens
ccaaccuaaugcucu

SEQ ID NO: 594370 - RNA, 23 nt, Homo sapiens
ccaacgcgccucgccggaucuga

SEQ ID NO: 594371 - RNA, 16 nt, Homo sapiens
ccaacuacaaccaagc

SEQ ID NO: 594372 - RNA, 13 nt, Homo sapiens
ccaacuccaggaa

SEQ ID NO: 594373 - RNA, 13 nt, Homo sapiens
ccaacucugggaa

SEQ ID NO: 594374 - RNA, 18 nt, Homo sapiens
ccaacugaaggcuaaaaa

SEQ ID NO: 594375 - RNA, 21 nt, Homo sapiens
ccaacugauuuuguauguaaa

SEQ ID NO: 594376 - RNA, 16 nt, Homo sapiens
ccaacugcuaaugcaa

SEQ ID NO: 594377 - RNA, 16 nt, Homo sapiens
ccaacuggaaauucca

SEQ ID NO: 594378 - RNA, 19 nt, Homo sapiens
ccaacuguauauauuccca

SEQ ID NO: 594379 - RNA, 19 nt, Homo sapiens
ccaacuguuggauucagaa

SEQ ID NO: 594380 - RNA, 23 nt, Homo sapiens
ccaacuuacaaaaacacuucguu

SEQ ID NO: 594381 - RNA, 17 nt, Homo sapiens
ccaacuucaauuuacuu

SEQ ID NO: 594382 - RNA, 19 nt, Homo sapiens
ccaacuucauuugaugcua

SEQ ID NO: 594383 - RNA, 19 nt, Homo sapiens
ccaacuucucuugcuuucu

SEQ ID NO: 594384 - RNA, 14 nt, Homo sapiens
ccaacuugagaugu

SEQ ID NO: 594385 - RNA, 15 nt, Homo sapiens
ccaacuugccaaaau

SEQ ID NO: 594386 - RNA, 20 nt, Homo sapiens
ccaacuugguucugcuucaa

SEQ ID NO: 594387 - RNA, 16 nt, Homo sapiens
ccaacuuuuuguuaca

SEQ ID NO: 594388 - RNA, 17 nt, Homo sapiens
ccaagaaaauaucacug

SEQ ID NO: 594389 - RNA, 15 nt, Homo sapiens
ccaagaagcaugcag

SEQ ID NO: 594390 - RNA, 18 nt, Homo sapiens
ccaagaaugagaagaaug

SEQ ID NO: 594391 - RNA, 14 nt, Homo sapiens
ccaagaaugagcuu

SEQ ID NO: 594392 - RNA, 13 nt, Homo sapiens
ccaagaauguuau

SEQ ID NO: 594393 - RNA, 17 nt, Homo sapiens
ccaagaauucuccaaaa

SEQ ID NO: 594394 - RNA, 16 nt, Homo sapiens
ccaagacacagaucac

SEQ ID NO: 594395 - RNA, 13 nt, Homo sapiens
ccaagacagugag

SEQ ID NO: 594396 - RNA, 16 nt, Homo sapiens
ccaagacucuuuauga

SEQ ID NO: 594397 - RNA, 12 nt, Homo sapiens
ccaagagaccag

SEQ ID NO: 594398 - RNA, 23 nt, Homo sapiens
ccaagagccgacaaugcccugcu

SEQ ID NO: 594399 - RNA, 20 nt, Homo sapiens
ccaagaggaaccucugauuu

SEQ ID NO: 594400 - RNA, 19 nt, Homo sapiens
ccaagaggacugagacugg

SEQ ID NO: 594401 - RNA, 18 nt, Homo sapiens
ccaagaggagacuuuaau

SEQ ID NO: 594402 - RNA, 17 nt, Homo sapiens
ccaagagguacuguaau

SEQ ID NO: 594403 - RNA, 15 nt, Homo sapiens
ccaagagugaaggga

SEQ ID NO: 594404 - RNA, 16 nt, Homo sapiens
ccaagauacucuuugu

SEQ ID NO: 594405 - RNA, 17 nt, Homo sapiens
ccaagauggguggcacc

SEQ ID NO: 594406 - RNA, 13 nt, Homo sapiens
ccaagauguguuc

SEQ ID NO: 594407 - RNA, 21 nt, Homo sapiens
ccaagcaaaaacaaaugggaa

SEQ ID NO: 594408 - RNA, 15 nt, Homo sapiens
ccaagcacuucacag

SEQ ID NO: 594409 - RNA, 23 nt, Homo sapiens
ccaagcagccuggagacuuccua

SEQ ID NO: 594410 - RNA, 22 nt, Homo sapiens
ccaagcaggaaaugaaaauguc

SEQ ID NO: 594411 - RNA, 23 nt, Homo sapiens
ccaagcagugccugccuaugaaa

SEQ ID NO: 594412 - RNA, 17 nt, Homo sapiens
ccaagcccuaagccugu

SEQ ID NO: 594413 - RNA, 13 nt, Homo sapiens
ccaagccugacca

SEQ ID NO: 594414 - RNA, 17 nt, Homo sapiens
ccaagccugauacuuua

SEQ ID NO: 594415 - RNA, 14 nt, Homo sapiens
ccaagcugaagcua

SEQ ID NO: 594416 - RNA, 16 nt, Homo sapiens
ccaagcugcugggauu

SEQ ID NO: 594417 - RNA, 21 nt, Homo sapiens
ccaagcuggucuuaaacuccu

SEQ ID NO: 594418 - RNA, 18 nt, Homo sapiens
ccaaggacugagggcagu

SEQ ID NO: 594419 - RNA, 20 nt, Homo sapiens
ccaaggagggugagugcaag

SEQ ID NO: 594420 - RNA, 20 nt, Homo sapiens
ccaaggauagaagcugcagu

SEQ ID NO: 594421 - RNA, 17 nt, Homo sapiens
ccaaggccccgagcuca

SEQ ID NO: 594422 - RNA, 14 nt, Homo sapiens
ccaagggagggaag

SEQ ID NO: 594423 - RNA, 22 nt, Homo sapiens
ccaagggggcggggacugcugg

SEQ ID NO: 594424 - RNA, 18 nt, Homo sapiens
ccaaggguugagagccag

SEQ ID NO: 594425 - RNA, 19 nt, Homo sapiens
ccaaggugcacauuuucca

SEQ ID NO: 594426 - RNA, 19 nt, Homo sapiens
ccaagguggagggaaggau

SEQ ID NO: 594427 - RNA, 19 nt, Homo sapiens
ccaagguuuuggagucagu

SEQ ID NO: 594428 - RNA, 14 nt, Homo sapiens
ccaaguaccaguau

SEQ ID NO: 594429 - RNA, 15 nt, Homo sapiens
ccaaguagcugggau

SEQ ID NO: 594430 - RNA, 14 nt, Homo sapiens
ccaagucacuagaa

SEQ ID NO: 594431 - RNA, 13 nt, Homo sapiens
ccaagucauggag

SEQ ID NO: 594432 - RNA, 15 nt, Homo sapiens
ccaagucaugugcau

SEQ ID NO: 594433 - RNA, 18 nt, Homo sapiens
ccaaguccucccucucua

SEQ ID NO: 594434 - RNA, 17 nt, Homo sapiens
ccaagucuccaccccuu

SEQ ID NO: 594435 - RNA, 21 nt, Homo sapiens
ccaagugaagguucccaagga

SEQ ID NO: 594436 - RNA, 17 nt, Homo sapiens
ccaagugccggacuagc

SEQ ID NO: 594437 - RNA, 15 nt, Homo sapiens
ccaaguggacuugga

SEQ ID NO: 594438 - RNA, 13 nt, Homo sapiens
ccaaguguuauac

SEQ ID NO: 594439 - RNA, 16 nt, Homo sapiens
ccaaguuaucaucuca

SEQ ID NO: 594440 - RNA, 20 nt, Homo sapiens
ccaaguucuucaccucuauc

SEQ ID NO: 594441 - RNA, 23 nt, Homo sapiens
ccaaguugagauuuuaauucugu

SEQ ID NO: 594442 - RNA, 19 nt, Homo sapiens
ccaaguuuauauacaauua

SEQ ID NO: 594443 - RNA, 16 nt, Homo sapiens
ccaauaaaaaguucag

SEQ ID NO: 594444 - RNA, 21 nt, Homo sapiens
ccaauaaaacugauguuacua

SEQ ID NO: 594445 - RNA, 18 nt, Homo sapiens
ccaauaaaagugacucuc

SEQ ID NO: 594446 - RNA, 14 nt, Homo sapiens
ccaauaaaauuucu

SEQ ID NO: 594447 - RNA, 21 nt, Homo sapiens
ccaauaaaccuuccuucuuaa

SEQ ID NO: 594448 - RNA, 19 nt, Homo sapiens
ccaauacaaagaugacugg

SEQ ID NO: 594449 - RNA, 12 nt, Homo sapiens
ccaauagcuuua

SEQ ID NO: 594450 - RNA, 17 nt, Homo sapiens
ccaauaggcauuugauu

SEQ ID NO: 594451 - RNA, 14 nt, Homo sapiens
ccaauauuuugccu

SEQ ID NO: 594452 - RNA, 14 nt, Homo sapiens
ccaaucaacagcag

SEQ ID NO: 594453 - RNA, 16 nt, Homo sapiens
ccaaucagaacuggcu

SEQ ID NO: 594454 - RNA, 20 nt, Homo sapiens
ccaauccauccugcucagga

SEQ ID NO: 594455 - RNA, 12 nt, Homo sapiens
ccaauccccucc

SEQ ID NO: 594456 - RNA, 14 nt, Homo sapiens
ccaaucccgugaaa

SEQ ID NO: 594457 - RNA, 22 nt, Homo sapiens
ccaaucccugccacugggcucu

SEQ ID NO: 594458 - RNA, 23 nt, Homo sapiens
ccaaucccuuuauuacccccucc

SEQ ID NO: 594459 - RNA, 15 nt, Homo sapiens
ccaauccuuuccacc

SEQ ID NO: 594460 - RNA, 21 nt, Homo sapiens
ccaaugacacccaugccagag

SEQ ID NO: 594461 - RNA, 23 nt, Homo sapiens
ccaaugcauugcuaaaauauuau

SEQ ID NO: 594462 - RNA, 18 nt, Homo sapiens
ccaaugccaaaaaaagac

SEQ ID NO: 594463 - RNA, 14 nt, Homo sapiens
ccaaugccuugaca

SEQ ID NO: 594464 - RNA, 19 nt, Homo sapiens
ccaaugcgacaaguaguuc

SEQ ID NO: 594465 - RNA, 15 nt, Homo sapiens
ccaaugcucuuuuca

SEQ ID NO: 594466 - RNA, 16 nt, Homo sapiens
ccaauggcggacucaa

SEQ ID NO: 594467 - RNA, 11 nt, Homo sapiens
ccaauggcucc

SEQ ID NO: 594468 - RNA, 23 nt, Homo sapiens
ccaaugggccuccagagacccca

SEQ ID NO: 594469 - RNA, 16 nt, Homo sapiens
ccaaugucuuuugaca

SEQ ID NO: 594470 - RNA, 11 nt, Homo sapiens
ccaauguuuca

SEQ ID NO: 594471 - RNA, 22 nt, Homo sapiens
ccaauuauuguuacacauuaag

SEQ ID NO: 594472 - RNA, 19 nt, Homo sapiens
ccaauucaauuacuauuga

SEQ ID NO: 594473 - RNA, 16 nt, Homo sapiens
ccaauucagugucugu

SEQ ID NO: 594474 - RNA, 15 nt, Homo sapiens
ccaauuccaccaaga

SEQ ID NO: 594475 - RNA, 13 nt, Homo sapiens
ccaauuccugaca

SEQ ID NO: 594476 - RNA, 16 nt, Homo sapiens
ccaauuccuugcacau

SEQ ID NO: 594477 - RNA, 17 nt, Homo sapiens
ccaauugccucuugcag

SEQ ID NO: 594478 - RNA, 13 nt, Homo sapiens
ccaauuuauaugu

SEQ ID NO: 594479 - RNA, 23 nt, Homo sapiens
ccaauuugguaaaaaugcugcuc

SEQ ID NO: 594480 - RNA, 23 nt, Homo sapiens
ccaauuuucuucaucuuugccau

SEQ ID NO: 594481 - RNA, 15 nt, Homo sapiens
ccaauuuuguugcau

SEQ ID NO: 594482 - RNA, 16 nt, Homo sapiens
ccacaaaaaauacuuu

SEQ ID NO: 594483 - RNA, 18 nt, Homo sapiens
ccacaaccgaccagaugc

SEQ ID NO: 594484 - RNA, 22 nt, Homo sapiens
ccacaacuugucacccaaagcc

SEQ ID NO: 594485 - RNA, 15 nt, Homo sapiens
ccacaagucuuccag

SEQ ID NO: 594486 - RNA, 14 nt, Homo sapiens
ccacaaugccagac

SEQ ID NO: 594487 - RNA, 20 nt, Homo sapiens
ccacaauucacuagaccaga

SEQ ID NO: 594488 - RNA, 14 nt, Homo sapiens
ccacacaaauucag

SEQ ID NO: 594489 - RNA, 11 nt, Homo sapiens
ccacacaagcg

SEQ ID NO: 594490 - RNA, 16 nt, Homo sapiens
ccacacauuaguacuu

SEQ ID NO: 594491 - RNA, 18 nt, Homo sapiens
ccacacauuaguacuuau

SEQ ID NO: 594492 - RNA, 19 nt, Homo sapiens
ccacacauuaguacuuaug

SEQ ID NO: 594493 - RNA, 15 nt, Homo sapiens
ccacacccagcucag

SEQ ID NO: 594494 - RNA, 12 nt, Homo sapiens
ccacacucagca

SEQ ID NO: 594495 - RNA, 12 nt, Homo sapiens
ccacacuccacu

SEQ ID NO: 594496 - RNA, 15 nt, Homo sapiens
ccacacucuccauca

SEQ ID NO: 594497 - RNA, 20 nt, Homo sapiens
ccacacugagagaguggaga

SEQ ID NO: 594498 - RNA, 12 nt, Homo sapiens
ccacacugaggc

SEQ ID NO: 594499 - RNA, 23 nt, Homo sapiens
ccacacugauggcucaagacaag

SEQ ID NO: 594500 - RNA, 19 nt, Homo sapiens
ccacacuggucacaggcaa

SEQ ID NO: 594501 - RNA, 16 nt, Homo sapiens
ccacacuugugccagc

SEQ ID NO: 594502 - RNA, 14 nt, Homo sapiens
ccacacuuuguaca

SEQ ID NO: 594503 - RNA, 20 nt, Homo sapiens
ccacagaccuacugcacuga

SEQ ID NO: 594504 - RNA, 14 nt, Homo sapiens
ccacagcacagcca

SEQ ID NO: 594505 - RNA, 20 nt, Homo sapiens
ccacagccaaacuaggacac

SEQ ID NO: 594506 - RNA, 21 nt, Homo sapiens
ccacagccgccugaaagccac

SEQ ID NO: 594507 - RNA, 20 nt, Homo sapiens
ccacagcgaaggcacaugcc

SEQ ID NO: 594508 - RNA, 20 nt, Homo sapiens
ccacagcuucucuacagacu

SEQ ID NO: 594509 - RNA, 17 nt, Homo sapiens
ccacaggaccccaagaa

SEQ ID NO: 594510 - RNA, 21 nt, Homo sapiens
ccacaggagugggaaaacacu

SEQ ID NO: 594511 - RNA, 22 nt, Homo sapiens
ccacaggcaguccaggccucuc

SEQ ID NO: 594512 - RNA, 19 nt, Homo sapiens
ccacagguucucacuagau

SEQ ID NO: 594513 - RNA, 17 nt, Homo sapiens
ccacauaagaaggcaau

SEQ ID NO: 594514 - RNA, 22 nt, Homo sapiens
ccacauagguaaaaacuggaau

SEQ ID NO: 594515 - RNA, 19 nt, Homo sapiens
ccacauauuuuagacacuu

SEQ ID NO: 594516 - RNA, 21 nt, Homo sapiens
ccacauauuuuagacacuucc

SEQ ID NO: 594517 - RNA, 18 nt, Homo sapiens
ccacauccaacuccagca

SEQ ID NO: 594518 - RNA, 23 nt, Homo sapiens
ccacaucugccuuaaaaccaaag

SEQ ID NO: 594519 - RNA, 17 nt, Homo sapiens
ccacaugaccuccauuu

SEQ ID NO: 594520 - RNA, 13 nt, Homo sapiens
ccacaugggaccu

SEQ ID NO: 594521 - RNA, 11 nt, Homo sapiens
ccacauggugu

SEQ ID NO: 594522 - RNA, 16 nt, Homo sapiens
ccacauugagacuuuc

SEQ ID NO: 594523 - RNA, 17 nt, Homo sapiens
ccaccaaagcugcccac

SEQ ID NO: 594524 - RNA, 13 nt, Homo sapiens
ccaccaacauaaa

SEQ ID NO: 594525 - RNA, 13 nt, Homo sapiens
ccaccacauagca

SEQ ID NO: 594526 - RNA, 19 nt, Homo sapiens
ccaccacauuuagaacuuu

SEQ ID NO: 594527 - RNA, 22 nt, Homo sapiens
ccaccacauuuagaacuuuggc

SEQ ID NO: 594528 - RNA, 16 nt, Homo sapiens
ccaccaccucaccagu

SEQ ID NO: 594529 - RNA, 17 nt, Homo sapiens
ccaccaccucaccaguu

SEQ ID NO: 594530 - RNA, 15 nt, Homo sapiens
ccaccacugccugac

SEQ ID NO: 594531 - RNA, 16 nt, Homo sapiens
ccaccagaaauuccag

SEQ ID NO: 594532 - RNA, 20 nt, Homo sapiens
ccaccaucaaaggaauauaa

SEQ ID NO: 594533 - RNA, 16 nt, Homo sapiens
ccaccaucauagcuca

SEQ ID NO: 594534 - RNA, 15 nt, Homo sapiens
ccaccaugauugaug

SEQ ID NO: 594535 - RNA, 19 nt, Homo sapiens
ccaccauuccugccuuuaa

SEQ ID NO: 594536 - RNA, 19 nt, Homo sapiens
ccaccauuguucauuugug

SEQ ID NO: 594537 - RNA, 15 nt, Homo sapiens
ccacccaacaagcca

SEQ ID NO: 594538 - RNA, 14 nt, Homo sapiens
ccacccaacccaaa

SEQ ID NO: 594539 - RNA, 14 nt, Homo sapiens
ccaccccaccucuu

SEQ ID NO: 594540 - RNA, 14 nt, Homo sapiens
ccaccccauuaaaa

SEQ ID NO: 594541 - RNA, 23 nt, Homo sapiens
ccacccccaaauuuucuuuuuau

SEQ ID NO: 594542 - RNA, 17 nt, Homo sapiens
ccaccccuaaagagaua

SEQ ID NO: 594543 - RNA, 21 nt, Homo sapiens
ccaccccuacauuuuuugaaa

SEQ ID NO: 594544 - RNA, 18 nt, Homo sapiens
ccacccgaguaccuccag

SEQ ID NO: 594545 - RNA, 17 nt, Homo sapiens
ccacccucaaaugucag

SEQ ID NO: 594546 - RNA, 22 nt, Homo sapiens
ccacccuuuacuccccagagca

SEQ ID NO: 594547 - RNA, 18 nt, Homo sapiens
ccaccgagccccugaccc

SEQ ID NO: 594548 - RNA, 14 nt, Homo sapiens
ccaccgcccagaga

SEQ ID NO: 594549 - RNA, 23 nt, Homo sapiens
ccaccgucucggcccugaaccac

SEQ ID NO: 594550 - RNA, 21 nt, Homo sapiens
ccaccuaaaaacauuuacuga

SEQ ID NO: 594551 - RNA, 14 nt, Homo sapiens
ccaccuagucugua

SEQ ID NO: 594552 - RNA, 14 nt, Homo sapiens
ccaccuauccccau

SEQ ID NO: 594553 - RNA, 21 nt, Homo sapiens
ccaccuccuuccagcacugac

SEQ ID NO: 594554 - RNA, 18 nt, Homo sapiens
ccaccucggucacuccaa

SEQ ID NO: 594555 - RNA, 16 nt, Homo sapiens
ccaccugacaauggca

SEQ ID NO: 594556 - RNA, 20 nt, Homo sapiens
ccaccugacaauggcagcua

SEQ ID NO: 594557 - RNA, 24 nt, Homo sapiens
ccaccugccugcaucugugaaaag

SEQ ID NO: 594558 - RNA, 15 nt, Homo sapiens
ccaccuggcauuccu

SEQ ID NO: 594559 - RNA, 14 nt, Homo sapiens
ccaccugugcugcu

SEQ ID NO: 594560 - RNA, 16 nt, Homo sapiens
ccaccuuccuccagac

SEQ ID NO: 594561 - RNA, 16 nt, Homo sapiens
ccaccuuggaccucag

SEQ ID NO: 594562 - RNA, 23 nt, Homo sapiens
ccaccuuuuccuuauacuguaua

SEQ ID NO: 594563 - RNA, 16 nt, Homo sapiens
ccacgaccuuugaaga

SEQ ID NO: 594564 - RNA, 20 nt, Homo sapiens
ccacgaccuuugaagagcuu

SEQ ID NO: 594565 - RNA, 20 nt, Homo sapiens
ccacgagccugcuguuucca

SEQ ID NO: 594566 - RNA, 15 nt, Homo sapiens
ccacgaggugcaaca

SEQ ID NO: 594567 - RNA, 18 nt, Homo sapiens
ccacgauuuucuccagcu

SEQ ID NO: 594568 - RNA, 22 nt, Homo sapiens
ccacgauuuucuccagcucaga

SEQ ID NO: 594569 - RNA, 15 nt, Homo sapiens
ccacgcagcacccuu

SEQ ID NO: 594570 - RNA, 15 nt, Homo sapiens
ccacgcagugccugg

SEQ ID NO: 594571 - RNA, 19 nt, Homo sapiens
ccacgcagugugcuuaggg

SEQ ID NO: 594572 - RNA, 23 nt, Homo sapiens
ccacggccuguacggacacugug

SEQ ID NO: 594573 - RNA, 23 nt, Homo sapiens
ccacgggcccggguugggucacc

SEQ ID NO: 594574 - RNA, 16 nt, Homo sapiens
ccacgugaaacugcug

SEQ ID NO: 594575 - RNA, 20 nt, Homo sapiens
ccacgugagagaaucugccu

SEQ ID NO: 594576 - RNA, 15 nt, Homo sapiens
ccacgugguguguuu

SEQ ID NO: 594577 - RNA, 20 nt, Homo sapiens
ccacguguccguccacccuu

SEQ ID NO: 594578 - RNA, 19 nt, Homo sapiens
ccacguugccucuacuuua

SEQ ID NO: 594579 - RNA, 15 nt, Homo sapiens
ccacuaaaauacaua

SEQ ID NO: 594580 - RNA, 15 nt, Homo sapiens
ccacuaaccaucccc

SEQ ID NO: 594581 - RNA, 14 nt, Homo sapiens
ccacuaagaauuca

SEQ ID NO: 594582 - RNA, 18 nt, Homo sapiens
ccacuaucccaaucaaag

SEQ ID NO: 594583 - RNA, 17 nt, Homo sapiens
ccacuauccuucgugaa

SEQ ID NO: 594584 - RNA, 17 nt, Homo sapiens
ccacuauuuucaaagaa

SEQ ID NO: 594585 - RNA, 17 nt, Homo sapiens
ccacucaaaauauguca

SEQ ID NO: 594586 - RNA, 16 nt, Homo sapiens
ccacucaccacaagcu

SEQ ID NO: 594587 - RNA, 13 nt, Homo sapiens
ccacucacuccag

SEQ ID NO: 594588 - RNA, 15 nt, Homo sapiens
ccacucaggccaaca

SEQ ID NO: 594589 - RNA, 19 nt, Homo sapiens
ccacucaggccacaguggg

SEQ ID NO: 594590 - RNA, 17 nt, Homo sapiens
ccacucagguucuucag

SEQ ID NO: 594591 - RNA, 17 nt, Homo sapiens
ccacucauuucaucuca

SEQ ID NO: 594592 - RNA, 15 nt, Homo sapiens
ccacuccaccuccac

SEQ ID NO: 594593 - RNA, 13 nt, Homo sapiens
ccacuccagugcc

SEQ ID NO: 594594 - RNA, 11 nt, Homo sapiens
ccacuccaguu

SEQ ID NO: 594595 - RNA, 14 nt, Homo sapiens
ccacucccaaagcu

SEQ ID NO: 594596 - RNA, 17 nt, Homo sapiens
ccacucccaaagcucag

SEQ ID NO: 594597 - RNA, 16 nt, Homo sapiens
ccacucccugcuccac

SEQ ID NO: 594598 - RNA, 20 nt, Homo sapiens
ccacucccuggccaucucaa

SEQ ID NO: 594599 - RNA, 15 nt, Homo sapiens
ccacucccuuugcca

SEQ ID NO: 594600 - RNA, 22 nt, Homo sapiens
ccacuccugaccccucuccuca

SEQ ID NO: 594601 - RNA, 16 nt, Homo sapiens
ccacucggcggcagca

SEQ ID NO: 594602 - RNA, 16 nt, Homo sapiens
ccacugaaaagcuuuc

SEQ ID NO: 594603 - RNA, 19 nt, Homo sapiens
ccacugaaaugaccaagac

SEQ ID NO: 594604 - RNA, 18 nt, Homo sapiens
ccacugaagcaccacagg

SEQ ID NO: 594605 - RNA, 21 nt, Homo sapiens
ccacugagaagugcacuuuaa

SEQ ID NO: 594606 - RNA, 17 nt, Homo sapiens
ccacugauggugacagg

SEQ ID NO: 594607 - RNA, 14 nt, Homo sapiens
ccacugcaaaacac

SEQ ID NO: 594608 - RNA, 23 nt, Homo sapiens
ccacugcugcccugggcagugag

SEQ ID NO: 594609 - RNA, 18 nt, Homo sapiens
ccacuggaaaaguguaau

SEQ ID NO: 594610 - RNA, 14 nt, Homo sapiens
ccacuggacuugag

SEQ ID NO: 594611 - RNA, 10 nt, Homo sapiens
ccacugggag

SEQ ID NO: 594612 - RNA, 19 nt, Homo sapiens
ccacuggggaaugcuccca

SEQ ID NO: 594613 - RNA, 18 nt, Homo sapiens
ccacugggucucacuccu

SEQ ID NO: 594614 - RNA, 16 nt, Homo sapiens
ccacuggucugcuuaa

SEQ ID NO: 594615 - RNA, 14 nt, Homo sapiens
ccacuguaugagug

SEQ ID NO: 594616 - RNA, 20 nt, Homo sapiens
ccacuguaugauucucuuaa

SEQ ID NO: 594617 - RNA, 19 nt, Homo sapiens
ccacugucaaggcagggaa

SEQ ID NO: 594618 - RNA, 16 nt, Homo sapiens
ccacugucuccacuca

SEQ ID NO: 594619 - RNA, 19 nt, Homo sapiens
ccacugugcugaauucugc

SEQ ID NO: 594620 - RNA, 18 nt, Homo sapiens
ccacuguggagaugcugu

SEQ ID NO: 594621 - RNA, 14 nt, Homo sapiens
ccacuguguacugu

SEQ ID NO: 594622 - RNA, 14 nt, Homo sapiens
ccacuguguauaga

SEQ ID NO: 594623 - RNA, 19 nt, Homo sapiens
ccacuuagaaauugcauuu

SEQ ID NO: 594624 - RNA, 14 nt, Homo sapiens
ccacuuaugcugcu

SEQ ID NO: 594625 - RNA, 14 nt, Homo sapiens
ccacuucauuccag

SEQ ID NO: 594626 - RNA, 16 nt, Homo sapiens
ccacuucucucaggau

SEQ ID NO: 594627 - RNA, 22 nt, Homo sapiens
ccacuucugggucaugcacuga

SEQ ID NO: 594628 - RNA, 16 nt, Homo sapiens
ccacuucugugggcau

SEQ ID NO: 594629 - RNA, 17 nt, Homo sapiens
ccacuucugugggcaug

SEQ ID NO: 594630 - RNA, 18 nt, Homo sapiens
ccacuugccugugcuaca

SEQ ID NO: 594631 - RNA, 24 nt, Homo sapiens
ccacuugccugugcuacaauucau

SEQ ID NO: 594632 - RNA, 14 nt, Homo sapiens
ccacuuugcugguu

SEQ ID NO: 594633 - RNA, 20 nt, Homo sapiens
ccacuuugucuguacauacu

SEQ ID NO: 594634 - RNA, 21 nt, Homo sapiens
ccagaaaaccucuccugaccc

SEQ ID NO: 594635 - RNA, 23 nt, Homo sapiens
ccagaaaagauggaaaagaaauu

SEQ ID NO: 594636 - RNA, 14 nt, Homo sapiens
ccagaaaaggcauu

SEQ ID NO: 594637 - RNA, 20 nt, Homo sapiens
ccagaaacaaaucucaaagu

SEQ ID NO: 594638 - RNA, 13 nt, Homo sapiens
ccagaaacuuuaa

SEQ ID NO: 594639 - RNA, 12 nt, Homo sapiens
ccagaaaugucu

SEQ ID NO: 594640 - RNA, 19 nt, Homo sapiens
ccagaaccacagauguguc

SEQ ID NO: 594641 - RNA, 16 nt, Homo sapiens
ccagaagaauauucag

SEQ ID NO: 594642 - RNA, 15 nt, Homo sapiens
ccagaagauucuauc

SEQ ID NO: 594643 - RNA, 18 nt, Homo sapiens
ccagaaggaaucuucuca

SEQ ID NO: 594644 - RNA, 14 nt, Homo sapiens
ccagaaggugcagg

SEQ ID NO: 594645 - RNA, 13 nt, Homo sapiens
ccagaauagcuuu

SEQ ID NO: 594646 - RNA, 19 nt, Homo sapiens
ccagaaugcugcaggacuu

SEQ ID NO: 594647 - RNA, 16 nt, Homo sapiens
ccagacaaaauuugag

SEQ ID NO: 594648 - RNA, 15 nt, Homo sapiens
ccagacaaccaaaac

SEQ ID NO: 594649 - RNA, 20 nt, Homo sapiens
ccagacacagacuggcaaua

SEQ ID NO: 594650 - RNA, 19 nt, Homo sapiens
ccagacaccaugugcaaua

SEQ ID NO: 594651 - RNA, 11 nt, Homo sapiens
ccagacauucu

SEQ ID NO: 594652 - RNA, 16 nt, Homo sapiens
ccagacauugcucuca

SEQ ID NO: 594653 - RNA, 19 nt, Homo sapiens
ccagacccaccacaccgca

SEQ ID NO: 594654 - RNA, 17 nt, Homo sapiens
ccagagagagcucugca

SEQ ID NO: 594655 - RNA, 19 nt, Homo sapiens
ccagagaguccugugcuga

SEQ ID NO: 594656 - RNA, 14 nt, Homo sapiens
ccagagaugacuau

SEQ ID NO: 594657 - RNA, 15 nt, Homo sapiens
ccagagcauuuccaa

SEQ ID NO: 594658 - RNA, 21 nt, Homo sapiens
ccagagcccaaggucagggag

SEQ ID NO: 594659 - RNA, 23 nt, Homo sapiens
ccagagcgguaucucuggcacca

SEQ ID NO: 594660 - RNA, 11 nt, Homo sapiens
ccagagcucag

SEQ ID NO: 594661 - RNA, 18 nt, Homo sapiens
ccagagcuggaaggcagg

SEQ ID NO: 594662 - RNA, 17 nt, Homo sapiens
ccagaggaaacuugcau

SEQ ID NO: 594663 - RNA, 17 nt, Homo sapiens
ccagaggaauccuggca

SEQ ID NO: 594664 - RNA, 13 nt, Homo sapiens
ccagaggacacag

SEQ ID NO: 594665 - RNA, 14 nt, Homo sapiens
ccagaggagggcag

SEQ ID NO: 594666 - RNA, 22 nt, Homo sapiens
ccagaggcaggcggagguugaa

SEQ ID NO: 594667 - RNA, 17 nt, Homo sapiens
ccagaggcucagcacuu

SEQ ID NO: 594668 - RNA, 14 nt, Homo sapiens
ccagaggcucuaau

SEQ ID NO: 594669 - RNA, 14 nt, Homo sapiens
ccagaggcugcaga

SEQ ID NO: 594670 - RNA, 16 nt, Homo sapiens
ccagaggcuggaccac

SEQ ID NO: 594671 - RNA, 14 nt, Homo sapiens
ccagaggcuuuaaa

SEQ ID NO: 594672 - RNA, 24 nt, Homo sapiens
ccagagggaccggaguuaugacaa

SEQ ID NO: 594673 - RNA, 17 nt, Homo sapiens
ccagagguuaucugccu

SEQ ID NO: 594674 - RNA, 16 nt, Homo sapiens
ccagaguagagccagg

SEQ ID NO: 594675 - RNA, 17 nt, Homo sapiens
ccagagucaaauuugaa

SEQ ID NO: 594676 - RNA, 15 nt, Homo sapiens
ccagaguccggaggc

SEQ ID NO: 594677 - RNA, 19 nt, Homo sapiens
ccagaguugcugugccgug

SEQ ID NO: 594678 - RNA, 15 nt, Homo sapiens
ccagaguuguucucu

SEQ ID NO: 594679 - RNA, 21 nt, Homo sapiens
ccagauacacuaaaguuacaa

SEQ ID NO: 594680 - RNA, 15 nt, Homo sapiens
ccagauacaugguga

SEQ ID NO: 594681 - RNA, 14 nt, Homo sapiens
ccagauauccacau

SEQ ID NO: 594682 - RNA, 19 nt, Homo sapiens
ccagauauucaagucaccu

SEQ ID NO: 594683 - RNA, 15 nt, Homo sapiens
ccagaucacugccac

SEQ ID NO: 594684 - RNA, 22 nt, Homo sapiens
ccagaucagacuuuaauuucuc

SEQ ID NO: 594685 - RNA, 18 nt, Homo sapiens
ccagaucgauccuggauu

SEQ ID NO: 594686 - RNA, 13 nt, Homo sapiens
ccagaugauccca

SEQ ID NO: 594687 - RNA, 17 nt, Homo sapiens
ccagaugaucccaguca

SEQ ID NO: 594688 - RNA, 18 nt, Homo sapiens
ccagauggcucuuucuau

SEQ ID NO: 594689 - RNA, 18 nt, Homo sapiens
ccagauguaaauagaaca

SEQ ID NO: 594690 - RNA, 19 nt, Homo sapiens
ccagaugucgcccuacuca

SEQ ID NO: 594691 - RNA, 20 nt, Homo sapiens
ccagauguuaugcuccugcu

SEQ ID NO: 594692 - RNA, 15 nt, Homo sapiens
ccagauguuggacca

SEQ ID NO: 594693 - RNA, 20 nt, Homo sapiens
ccagauucuaccacacagca

SEQ ID NO: 594694 - RNA, 18 nt, Homo sapiens
ccagauuuacacugggag

SEQ ID NO: 594695 - RNA, 12 nt, Homo sapiens
ccagcaaagagu

SEQ ID NO: 594696 - RNA, 23 nt, Homo sapiens
ccagcaacugaauaaauaccucu

SEQ ID NO: 594697 - RNA, 13 nt, Homo sapiens
ccagcaacugccc

SEQ ID NO: 594698 - RNA, 16 nt, Homo sapiens
ccagcaagcucuucac

SEQ ID NO: 594699 - RNA, 16 nt, Homo sapiens
ccagcaaucugcauuu

SEQ ID NO: 594700 - RNA, 17 nt, Homo sapiens
ccagcaauuuagacaaa

SEQ ID NO: 594701 - RNA, 20 nt, Homo sapiens
ccagcacacggcugccugac

SEQ ID NO: 594702 - RNA, 22 nt, Homo sapiens
ccagcaccaagggcgggcagca

SEQ ID NO: 594703 - RNA, 12 nt, Homo sapiens
ccagcaccaccu

SEQ ID NO: 594704 - RNA, 21 nt, Homo sapiens
ccagcacuuuagaucacuuga

SEQ ID NO: 594705 - RNA, 12 nt, Homo sapiens
ccagcacuuugg

SEQ ID NO: 594706 - RNA, 16 nt, Homo sapiens
ccagcacuuugggagg

SEQ ID NO: 594707 - RNA, 19 nt, Homo sapiens
ccagcacuuugguaggcaa

SEQ ID NO: 594708 - RNA, 20 nt, Homo sapiens
ccagcagaagcaggguaccc

SEQ ID NO: 594709 - RNA, 21 nt, Homo sapiens
ccagcagagggggaguagcca

SEQ ID NO: 594710 - RNA, 21 nt, Homo sapiens
ccagcagcacagucacccaug

SEQ ID NO: 594711 - RNA, 15 nt, Homo sapiens
ccagcagcagcuuuc

SEQ ID NO: 594712 - RNA, 15 nt, Homo sapiens
ccagcagcgccuuuc

SEQ ID NO: 594713 - RNA, 15 nt, Homo sapiens
ccagcagcucaagaa

SEQ ID NO: 594714 - RNA, 18 nt, Homo sapiens
ccagcaggcaacucaaag

SEQ ID NO: 594715 - RNA, 18 nt, Homo sapiens
ccagcagggccucaaagu

SEQ ID NO: 594716 - RNA, 19 nt, Homo sapiens
ccagcauccccaacugcga

SEQ ID NO: 594717 - RNA, 16 nt, Homo sapiens
ccagcauccugauuaa

SEQ ID NO: 594718 - RNA, 19 nt, Homo sapiens
ccagcaucgggggccugca

SEQ ID NO: 594719 - RNA, 16 nt, Homo sapiens
ccagcaugacgguguc

SEQ ID NO: 594720 - RNA, 22 nt, Homo sapiens
ccagcauucagcacacacaaac

SEQ ID NO: 594721 - RNA, 13 nt, Homo sapiens
ccagcauuuggca

SEQ ID NO: 594722 - RNA, 13 nt, Homo sapiens
ccagccacagugu

SEQ ID NO: 594723 - RNA, 22 nt, Homo sapiens
ccagccacggagggaggcacca

SEQ ID NO: 594724 - RNA, 22 nt, Homo sapiens
ccagccagaggguagggcacaa

SEQ ID NO: 594725 - RNA, 22 nt, Homo sapiens
ccagccagggugugacucggga

SEQ ID NO: 594726 - RNA, 14 nt, Homo sapiens
ccagccaugcauug

SEQ ID NO: 594727 - RNA, 18 nt, Homo sapiens
ccagccauuguaauuuga

SEQ ID NO: 594728 - RNA, 16 nt, Homo sapiens
ccagcccagcacugga

SEQ ID NO: 594729 - RNA, 17 nt, Homo sapiens
ccagccccacugccagc

SEQ ID NO: 594730 - RNA, 15 nt, Homo sapiens
ccagccccagcaccu

SEQ ID NO: 594731 - RNA, 21 nt, Homo sapiens
ccagccccagcaccucaugca

SEQ ID NO: 594732 - RNA, 18 nt, Homo sapiens
ccagccccuuugccauag

SEQ ID NO: 594733 - RNA, 17 nt, Homo sapiens
ccagcccgcagcacauu

SEQ ID NO: 594734 - RNA, 14 nt, Homo sapiens
ccagcccuccccau

SEQ ID NO: 594735 - RNA, 15 nt, Homo sapiens
ccagccgauguggua

SEQ ID NO: 594736 - RNA, 14 nt, Homo sapiens
ccagccucccacaa

SEQ ID NO: 594737 - RNA, 15 nt, Homo sapiens
ccagccugcucccua

SEQ ID NO: 594738 - RNA, 15 nt, Homo sapiens
ccagccuggccaaca

SEQ ID NO: 594739 - RNA, 20 nt, Homo sapiens
ccagccugggcagcauagca

SEQ ID NO: 594740 - RNA, 20 nt, Homo sapiens
ccagccugggugacagagca

SEQ ID NO: 594741 - RNA, 19 nt, Homo sapiens
ccagccuguccaacagagg

SEQ ID NO: 594742 - RNA, 23 nt, Homo sapiens
ccagccugugguuacagugcaga

SEQ ID NO: 594743 - RNA, 19 nt, Homo sapiens
ccagccuugagaugcuuca

SEQ ID NO: 594744 - RNA, 16 nt, Homo sapiens
ccagccuuguuucuga

SEQ ID NO: 594745 - RNA, 24 nt, Homo sapiens
ccagcggcccugucauccagcuca

SEQ ID NO: 594746 - RNA, 15 nt, Homo sapiens
ccagcgucaaggugg

SEQ ID NO: 594747 - RNA, 23 nt, Homo sapiens
ccagcuacauuccucagcugcca

SEQ ID NO: 594748 - RNA, 15 nt, Homo sapiens
ccagcuagugccaaa

SEQ ID NO: 594749 - RNA, 21 nt, Homo sapiens
ccagcucagucccaucagaga

SEQ ID NO: 594750 - RNA, 19 nt, Homo sapiens
ccagcucccuaggagacca

SEQ ID NO: 594751 - RNA, 19 nt, Homo sapiens
ccagcuccuuggcugcagc

SEQ ID NO: 594752 - RNA, 15 nt, Homo sapiens
ccagcugacauggaa

SEQ ID NO: 594753 - RNA, 22 nt, Homo sapiens
ccagcugcagaccaugccagac

SEQ ID NO: 594754 - RNA, 15 nt, Homo sapiens
ccagcugccuuggac

SEQ ID NO: 594755 - RNA, 18 nt, Homo sapiens
ccagcugcucccaaauaa

SEQ ID NO: 594756 - RNA, 16 nt, Homo sapiens
ccagcugcugucuucu

SEQ ID NO: 594757 - RNA, 21 nt, Homo sapiens
ccagcuggccuggacaguauc

SEQ ID NO: 594758 - RNA, 17 nt, Homo sapiens
ccagcugggguccuguc

SEQ ID NO: 594759 - RNA, 22 nt, Homo sapiens
ccagcugucgucugacucuggg

SEQ ID NO: 594760 - RNA, 12 nt, Homo sapiens
ccagcugugcug

SEQ ID NO: 594761 - RNA, 22 nt, Homo sapiens
ccagcugugggacaauuaucug

SEQ ID NO: 594762 - RNA, 20 nt, Homo sapiens
ccagcuucucucuccagggu

SEQ ID NO: 594763 - RNA, 18 nt, Homo sapiens
ccaggaaagagcagucag

SEQ ID NO: 594764 - RNA, 13 nt, Homo sapiens
ccaggaacaagcu

SEQ ID NO: 594765 - RNA, 21 nt, Homo sapiens
ccaggaaggaagcuguugcuu

SEQ ID NO: 594766 - RNA, 16 nt, Homo sapiens
ccaggaauaggcauuu

SEQ ID NO: 594767 - RNA, 19 nt, Homo sapiens
ccaggacaccuuucucugc

SEQ ID NO: 594768 - RNA, 17 nt, Homo sapiens
ccaggacagcugugcuc

SEQ ID NO: 594769 - RNA, 23 nt, Homo sapiens
ccaggaccagccuguaccuugcu

SEQ ID NO: 594770 - RNA, 19 nt, Homo sapiens
ccaggacgcccucacugca

SEQ ID NO: 594771 - RNA, 17 nt, Homo sapiens
ccaggacugaccucuuc

SEQ ID NO: 594772 - RNA, 14 nt, Homo sapiens
ccaggacugcauug

SEQ ID NO: 594773 - RNA, 12 nt, Homo sapiens
ccaggacugugu

SEQ ID NO: 594774 - RNA, 20 nt, Homo sapiens
ccaggacuguugaugccuuu

SEQ ID NO: 594775 - RNA, 14 nt, Homo sapiens
ccaggagacauaua

SEQ ID NO: 594776 - RNA, 16 nt, Homo sapiens
ccaggagagagccagg

SEQ ID NO: 594777 - RNA, 23 nt, Homo sapiens
ccaggagcaggaccuacuaggag

SEQ ID NO: 594778 - RNA, 22 nt, Homo sapiens
ccaggagcccacagugccugua

SEQ ID NO: 594779 - RNA, 11 nt, Homo sapiens
ccaggagcuca

SEQ ID NO: 594780 - RNA, 11 nt, Homo sapiens
ccaggagcucu

SEQ ID NO: 594781 - RNA, 13 nt, Homo sapiens
ccaggagcucuuc

SEQ ID NO: 594782 - RNA, 22 nt, Homo sapiens
ccaggaggcggagguugcagua

SEQ ID NO: 594783 - RNA, 15 nt, Homo sapiens
ccaggaguaccugga

SEQ ID NO: 594784 - RNA, 22 nt, Homo sapiens
ccaggaugcccagaugaacuga

SEQ ID NO: 594785 - RNA, 14 nt, Homo sapiens
ccaggauucagcua

SEQ ID NO: 594786 - RNA, 11 nt, Homo sapiens
ccaggauuuug

SEQ ID NO: 594787 - RNA, 13 nt, Homo sapiens
ccaggcacucuca

SEQ ID NO: 594788 - RNA, 14 nt, Homo sapiens
ccaggcaggggugg

SEQ ID NO: 594789 - RNA, 23 nt, Homo sapiens
ccaggcaggggugggagagccag

SEQ ID NO: 594790 - RNA, 13 nt, Homo sapiens
ccaggccaaagcc

SEQ ID NO: 594791 - RNA, 14 nt, Homo sapiens
ccaggccaauguca

SEQ ID NO: 594792 - RNA, 15 nt, Homo sapiens
ccaggccaccuccag

SEQ ID NO: 594793 - RNA, 21 nt, Homo sapiens
ccaggccaccuccccagcauu

SEQ ID NO: 594794 - RNA, 18 nt, Homo sapiens
ccaggccagagggcagug

SEQ ID NO: 594795 - RNA, 21 nt, Homo sapiens
ccaggcccacgaggagcagca

SEQ ID NO: 594796 - RNA, 19 nt, Homo sapiens
ccaggccccugaugcucca

SEQ ID NO: 594797 - RNA, 23 nt, Homo sapiens
ccaggcccuacuacccauuguuc

SEQ ID NO: 594798 - RNA, 16 nt, Homo sapiens
ccaggcccugccauug

SEQ ID NO: 594799 - RNA, 15 nt, Homo sapiens
ccaggccguccuccc

SEQ ID NO: 594800 - RNA, 18 nt, Homo sapiens
ccaggccugcagacagac

SEQ ID NO: 594801 - RNA, 15 nt, Homo sapiens
ccaggccugccuguu

SEQ ID NO: 594802 - RNA, 19 nt, Homo sapiens
ccaggcgagccugacucug

SEQ ID NO: 594803 - RNA, 20 nt, Homo sapiens
ccaggcgggcggcacgccaa

SEQ ID NO: 594804 - RNA, 14 nt, Homo sapiens
ccaggcgggcucaa

SEQ ID NO: 594805 - RNA, 20 nt, Homo sapiens
ccaggcuacaaucuucauuu

SEQ ID NO: 594806 - RNA, 19 nt, Homo sapiens
ccaggcuagagugcaaugg

SEQ ID NO: 594807 - RNA, 20 nt, Homo sapiens
ccaggcuagagugcaauggc

SEQ ID NO: 594808 - RNA, 19 nt, Homo sapiens
ccaggcugcagaugaucag

SEQ ID NO: 594809 - RNA, 17 nt, Homo sapiens
ccaggcugcuagaggug

SEQ ID NO: 594810 - RNA, 20 nt, Homo sapiens
ccaggcugcuagaggugcuc

SEQ ID NO: 594811 - RNA, 20 nt, Homo sapiens
ccaggcuggacugcaaugac

SEQ ID NO: 594812 - RNA, 15 nt, Homo sapiens
ccaggcuggagugca

SEQ ID NO: 594813 - RNA, 18 nt, Homo sapiens
ccaggcuggagugcagua

SEQ ID NO: 594814 - RNA, 19 nt, Homo sapiens
ccaggcuggagugcagugg

SEQ ID NO: 594815 - RNA, 20 nt, Homo sapiens
ccaggcuggagugcaguggc

SEQ ID NO: 594816 - RNA, 23 nt, Homo sapiens
ccaggcuggagugcaguggcaca

SEQ ID NO: 594817 - RNA, 16 nt, Homo sapiens
ccaggcuggucucaaa

SEQ ID NO: 594818 - RNA, 20 nt, Homo sapiens
ccaggcuggucuugaacugg

SEQ ID NO: 594819 - RNA, 20 nt, Homo sapiens
ccagggagcacccugcccac

SEQ ID NO: 594820 - RNA, 21 nt, Homo sapiens
ccagggaggcgcagggacaug

SEQ ID NO: 594821 - RNA, 16 nt, Homo sapiens
ccagggagugguuugg

SEQ ID NO: 594822 - RNA, 16 nt, Homo sapiens
ccagggccuccagggc

SEQ ID NO: 594823 - RNA, 21 nt, Homo sapiens
ccagggccugggggcagugac

SEQ ID NO: 594824 - RNA, 14 nt, Homo sapiens
ccagggcuccaaau

SEQ ID NO: 594825 - RNA, 23 nt, Homo sapiens
ccaggggaaggaaggagggcaca

SEQ ID NO: 594826 - RNA, 22 nt, Homo sapiens
ccaggggcccuugggacagcca

SEQ ID NO: 594827 - RNA, 20 nt, Homo sapiens
ccagggugggaagagaagaa

SEQ ID NO: 594828 - RNA, 16 nt, Homo sapiens
ccagguauuacacaag

SEQ ID NO: 594829 - RNA, 20 nt, Homo sapiens
ccaggucucucaacuucauc

SEQ ID NO: 594830 - RNA, 17 nt, Homo sapiens
ccaggugagaacaucca

SEQ ID NO: 594831 - RNA, 11 nt, Homo sapiens
ccaggugggaa

SEQ ID NO: 594832 - RNA, 22 nt, Homo sapiens
ccagguguucuacacucaucuu

SEQ ID NO: 594833 - RNA, 14 nt, Homo sapiens
ccagguguugccau

SEQ ID NO: 594834 - RNA, 15 nt, Homo sapiens
ccagguucucauuag

SEQ ID NO: 594835 - RNA, 19 nt, Homo sapiens
ccagguugggggcaguguu

SEQ ID NO: 594836 - RNA, 22 nt, Homo sapiens
ccagguugggggcaguguugug

SEQ ID NO: 594837 - RNA, 23 nt, Homo sapiens
ccagguuuuacacuugcaucucu

SEQ ID NO: 594838 - RNA, 21 nt, Homo sapiens
ccaguaaaugggggugcauuu

SEQ ID NO: 594839 - RNA, 13 nt, Homo sapiens
ccaguacugggaa

SEQ ID NO: 594840 - RNA, 12 nt, Homo sapiens
ccaguaguggga

SEQ ID NO: 594841 - RNA, 15 nt, Homo sapiens
ccaguaugacaguau

SEQ ID NO: 594842 - RNA, 13 nt, Homo sapiens
ccaguauguccuu

SEQ ID NO: 594843 - RNA, 23 nt, Homo sapiens
ccaguauuacugcugcugugcuu

SEQ ID NO: 594844 - RNA, 13 nt, Homo sapiens
ccaguauuagcaa

SEQ ID NO: 594845 - RNA, 16 nt, Homo sapiens
ccagucacugcugcaa

SEQ ID NO: 594846 - RNA, 21 nt, Homo sapiens
ccagucacugcugcaaggugg

SEQ ID NO: 594847 - RNA, 22 nt, Homo sapiens
ccagucacugucccucaaauga

SEQ ID NO: 594848 - RNA, 17 nt, Homo sapiens
ccagucacuuugccaga

SEQ ID NO: 594849 - RNA, 19 nt, Homo sapiens
ccaguccagauauuucaca

SEQ ID NO: 594850 - RNA, 13 nt, Homo sapiens
ccaguccauuucc

SEQ ID NO: 594851 - RNA, 14 nt, Homo sapiens
ccaguccuguccua

SEQ ID NO: 594852 - RNA, 15 nt, Homo sapiens
ccagucucaccuuca

SEQ ID NO: 594853 - RNA, 19 nt, Homo sapiens
ccagucuuccugacacuuu

SEQ ID NO: 594854 - RNA, 20 nt, Homo sapiens
ccagucuugucauugccagc

SEQ ID NO: 594855 - RNA, 14 nt, Homo sapiens
ccagugaaccaaag

SEQ ID NO: 594856 - RNA, 15 nt, Homo sapiens
ccagugaaccaaaga

SEQ ID NO: 594857 - RNA, 13 nt, Homo sapiens
ccagugaaucugu

SEQ ID NO: 594858 - RNA, 13 nt, Homo sapiens
ccagugacaaaga

SEQ ID NO: 594859 - RNA, 19 nt, Homo sapiens
ccagugacaaggcccugag

SEQ ID NO: 594860 - RNA, 16 nt, Homo sapiens
ccagugagaagcugag

SEQ ID NO: 594861 - RNA, 14 nt, Homo sapiens
ccagugagcucuuu

SEQ ID NO: 594862 - RNA, 22 nt, Homo sapiens
ccagugaggaacccugaucucu

SEQ ID NO: 594863 - RNA, 20 nt, Homo sapiens
ccagugaggaugcugcagug

SEQ ID NO: 594864 - RNA, 15 nt, Homo sapiens
ccagugcaacagcac

SEQ ID NO: 594865 - RNA, 13 nt, Homo sapiens
ccagugcagccac

SEQ ID NO: 594866 - RNA, 18 nt, Homo sapiens
ccagugcagggcuggucu

SEQ ID NO: 594867 - RNA, 11 nt, Homo sapiens
ccagugcaguc

SEQ ID NO: 594868 - RNA, 11 nt, Homo sapiens
ccagugccauu

SEQ ID NO: 594869 - RNA, 17 nt, Homo sapiens
ccagugcgguuccucau

SEQ ID NO: 594870 - RNA, 18 nt, Homo sapiens
ccaguggaucauaagaca

SEQ ID NO: 594871 - RNA, 20 nt, Homo sapiens
ccaguggccuugguccuuaa

SEQ ID NO: 594872 - RNA, 19 nt, Homo sapiens
ccagugggaacugugcaaa

SEQ ID NO: 594873 - RNA, 22 nt, Homo sapiens
ccaguguccccuccacugucac

SEQ ID NO: 594874 - RNA, 19 nt, Homo sapiens
ccagugugacacugcuuua

SEQ ID NO: 594875 - RNA, 18 nt, Homo sapiens
ccaguguuauuaaugaca

SEQ ID NO: 594876 - RNA, 22 nt, Homo sapiens
ccaguguuccugaagcugcugu

SEQ ID NO: 594877 - RNA, 14 nt, Homo sapiens
ccaguguucuauga

SEQ ID NO: 594878 - RNA, 18 nt, Homo sapiens
ccaguguucuaugaacaa

SEQ ID NO: 594879 - RNA, 22 nt, Homo sapiens
ccaguuagauagaagaauuuua

SEQ ID NO: 594880 - RNA, 12 nt, Homo sapiens
ccaguucaucuu

SEQ ID NO: 594881 - RNA, 12 nt, Homo sapiens
ccaguuugcaug

SEQ ID NO: 594882 - RNA, 18 nt, Homo sapiens
ccaguuuuuguugcuuga

SEQ ID NO: 594883 - RNA, 16 nt, Homo sapiens
ccauaaacacccauga

SEQ ID NO: 594884 - RNA, 23 nt, Homo sapiens
ccauaaacacccaugaaucaaag

SEQ ID NO: 594885 - RNA, 13 nt, Homo sapiens
ccauaaaggcaua

SEQ ID NO: 594886 - RNA, 18 nt, Homo sapiens
ccauaaauacaagauucu

SEQ ID NO: 594887 - RNA, 14 nt, Homo sapiens
ccauaaauguguuc

SEQ ID NO: 594888 - RNA, 12 nt, Homo sapiens
ccauaacagcca

SEQ ID NO: 594889 - RNA, 15 nt, Homo sapiens
ccauaagaggugauc

SEQ ID NO: 594890 - RNA, 23 nt, Homo sapiens
ccauaauucuaaguuauuuacuu

SEQ ID NO: 594891 - RNA, 13 nt, Homo sapiens
ccauacuucucuc

SEQ ID NO: 594892 - RNA, 14 nt, Homo sapiens
ccauacuucucuca

SEQ ID NO: 594893 - RNA, 18 nt, Homo sapiens
ccauacuuugucugaaaa

SEQ ID NO: 594894 - RNA, 23 nt, Homo sapiens
ccauagaggucaagaacaugcaa

SEQ ID NO: 594895 - RNA, 19 nt, Homo sapiens
ccauagcaagauugcuuaa

SEQ ID NO: 594896 - RNA, 20 nt, Homo sapiens
ccauagcaagauugcuuaaa

SEQ ID NO: 594897 - RNA, 11 nt, Homo sapiens
ccauagcuauu

SEQ ID NO: 594898 - RNA, 16 nt, Homo sapiens
ccauagcuuccaugag

SEQ ID NO: 594899 - RNA, 21 nt, Homo sapiens
ccauaggacauacugcaugua

SEQ ID NO: 594900 - RNA, 14 nt, Homo sapiens
ccauaggugcaguu

SEQ ID NO: 594901 - RNA, 16 nt, Homo sapiens
ccauaguaccauuuau

SEQ ID NO: 594902 - RNA, 21 nt, Homo sapiens
ccauaguaguaugaugauaca

SEQ ID NO: 594903 - RNA, 14 nt, Homo sapiens
ccauaguauaauca

SEQ ID NO: 594904 - RNA, 23 nt, Homo sapiens
ccauauaccaucuccagcuauuu

SEQ ID NO: 594905 - RNA, 15 nt, Homo sapiens
ccauauagaaaucua

SEQ ID NO: 594906 - RNA, 21 nt, Homo sapiens
ccauauauaacagauacauuu

SEQ ID NO: 594907 - RNA, 19 nt, Homo sapiens
ccauauauuuaauauguca

SEQ ID NO: 594908 - RNA, 13 nt, Homo sapiens
ccauaucagugaa

SEQ ID NO: 594909 - RNA, 19 nt, Homo sapiens
ccauaucccuuccucucag

SEQ ID NO: 594910 - RNA, 15 nt, Homo sapiens
ccauauucacaccuc

SEQ ID NO: 594911 - RNA, 19 nt, Homo sapiens
ccauauuccagcagugaaa

SEQ ID NO: 594912 - RNA, 14 nt, Homo sapiens
ccauauugaugaag

SEQ ID NO: 594913 - RNA, 16 nt, Homo sapiens
ccauauuguagcucaa

SEQ ID NO: 594914 - RNA, 18 nt, Homo sapiens
ccauauuuuacugaucuc

SEQ ID NO: 594915 - RNA, 12 nt, Homo sapiens
ccauauuuucac

SEQ ID NO: 594916 - RNA, 20 nt, Homo sapiens
ccauauuuucaccauuugau

SEQ ID NO: 594917 - RNA, 20 nt, Homo sapiens
ccaucaaacauaauucucuc

SEQ ID NO: 594918 - RNA, 21 nt, Homo sapiens
ccaucaaacauaauucucuca

SEQ ID NO: 594919 - RNA, 20 nt, Homo sapiens
ccaucacaucccuucaagag

SEQ ID NO: 594920 - RNA, 12 nt, Homo sapiens
ccaucaccaccg

SEQ ID NO: 594921 - RNA, 15 nt, Homo sapiens
ccaucaccgcugggu

SEQ ID NO: 594922 - RNA, 20 nt, Homo sapiens
ccaucaccugaaacacugga

SEQ ID NO: 594923 - RNA, 12 nt, Homo sapiens
ccaucagacugu

SEQ ID NO: 594924 - RNA, 15 nt, Homo sapiens
ccaucagagaggcaa

SEQ ID NO: 594925 - RNA, 20 nt, Homo sapiens
ccaucagcaaauauuauucu

SEQ ID NO: 594926 - RNA, 16 nt, Homo sapiens
ccaucagcccaucuca

SEQ ID NO: 594927 - RNA, 14 nt, Homo sapiens
ccaucagugaaaaa

SEQ ID NO: 594928 - RNA, 16 nt, Homo sapiens
ccaucauuacugguaa

SEQ ID NO: 594929 - RNA, 16 nt, Homo sapiens
ccauccaagauggcau

SEQ ID NO: 594930 - RNA, 14 nt, Homo sapiens
ccauccagccagac

SEQ ID NO: 594931 - RNA, 13 nt, Homo sapiens
ccauccaguuccu

SEQ ID NO: 594932 - RNA, 16 nt, Homo sapiens
ccauccccaggcaccu

SEQ ID NO: 594933 - RNA, 17 nt, Homo sapiens
ccaucccucggacccac

SEQ ID NO: 594934 - RNA, 14 nt, Homo sapiens
ccaucccuucucug

SEQ ID NO: 594935 - RNA, 14 nt, Homo sapiens
ccauccgugcugca

SEQ ID NO: 594936 - RNA, 15 nt, Homo sapiens
ccauccugaaagcca

SEQ ID NO: 594937 - RNA, 16 nt, Homo sapiens
ccauccuggggcagca

SEQ ID NO: 594938 - RNA, 17 nt, Homo sapiens
ccaucgcaggaugacag

SEQ ID NO: 594939 - RNA, 19 nt, Homo sapiens
ccaucggugaaacuaacag

SEQ ID NO: 594940 - RNA, 20 nt, Homo sapiens
ccaucguuuucuucacuguc

SEQ ID NO: 594941 - RNA, 23 nt, Homo sapiens
ccaucucaacaauauauguccua

SEQ ID NO: 594942 - RNA, 12 nt, Homo sapiens
ccaucucagguu

SEQ ID NO: 594943 - RNA, 19 nt, Homo sapiens
ccaucucuacaaaaagcau

SEQ ID NO: 594944 - RNA, 14 nt, Homo sapiens
ccaucucuacugaa

SEQ ID NO: 594945 - RNA, 22 nt, Homo sapiens
ccaucucuacugaaaguacaaa

SEQ ID NO: 594946 - RNA, 19 nt, Homo sapiens
ccaucucucccacuuccuc

SEQ ID NO: 594947 - RNA, 16 nt, Homo sapiens
ccaucucugauuuuca

SEQ ID NO: 594948 - RNA, 19 nt, Homo sapiens
ccaucugaagaaacuuccc

SEQ ID NO: 594949 - RNA, 21 nt, Homo sapiens
ccaucugccaaaaauuacuga

SEQ ID NO: 594950 - RNA, 23 nt, Homo sapiens
ccaucugggcuccuccagggugu

SEQ ID NO: 594951 - RNA, 21 nt, Homo sapiens
ccaucugguaucaucuucuca

SEQ ID NO: 594952 - RNA, 21 nt, Homo sapiens
ccaucuuguaaaggauauuaa

SEQ ID NO: 594953 - RNA, 12 nt, Homo sapiens
ccaucuuuacaa

SEQ ID NO: 594954 - RNA, 22 nt, Homo sapiens
ccaucuuuaucaugaagcacau

SEQ ID NO: 594955 - RNA, 12 nt, Homo sapiens
ccaugaacauca

SEQ ID NO: 594956 - RNA, 14 nt, Homo sapiens
ccaugaaucucugc

SEQ ID NO: 594957 - RNA, 10 nt, Homo sapiens
ccaugaauua

SEQ ID NO: 594958 - RNA, 17 nt, Homo sapiens
ccaugaccccuucucuc

SEQ ID NO: 594959 - RNA, 16 nt, Homo sapiens
ccaugacgcacugcuc

SEQ ID NO: 594960 - RNA, 23 nt, Homo sapiens
ccaugagagaaggaggggagcag

SEQ ID NO: 594961 - RNA, 21 nt, Homo sapiens
ccaugagcaccccaaggcugc

SEQ ID NO: 594962 - RNA, 19 nt, Homo sapiens
ccaugaggaaggaacagca

SEQ ID NO: 594963 - RNA, 17 nt, Homo sapiens
ccaugaggcaaugucag

SEQ ID NO: 594964 - RNA, 19 nt, Homo sapiens
ccaugauaacugcaauuuu

SEQ ID NO: 594965 - RNA, 15 nt, Homo sapiens
ccaugauauaacuuu

SEQ ID NO: 594966 - RNA, 16 nt, Homo sapiens
ccaugaucacuuauca

SEQ ID NO: 594967 - RNA, 20 nt, Homo sapiens
ccaugauggccuuacacuga

SEQ ID NO: 594968 - RNA, 23 nt, Homo sapiens
ccaugcacccucauacacagaaa

SEQ ID NO: 594969 - RNA, 14 nt, Homo sapiens
ccaugcaccucagg

SEQ ID NO: 594970 - RNA, 21 nt, Homo sapiens
ccaugcagccgcaccagagag

SEQ ID NO: 594971 - RNA, 22 nt, Homo sapiens
ccaugcagcggccugagcagua

SEQ ID NO: 594972 - RNA, 10 nt, Homo sapiens
ccaugccacc

SEQ ID NO: 594973 - RNA, 17 nt, Homo sapiens
ccaugcguccuggucaa

SEQ ID NO: 594974 - RNA, 22 nt, Homo sapiens
ccaugcgugccgccugcuccuc

SEQ ID NO: 594975 - RNA, 21 nt, Homo sapiens
ccaugcguguuucugacucug

SEQ ID NO: 594976 - RNA, 16 nt, Homo sapiens
ccaugcuagacaagcu

SEQ ID NO: 594977 - RNA, 20 nt, Homo sapiens
ccaugcucuuguucuguucc

SEQ ID NO: 594978 - RNA, 19 nt, Homo sapiens
ccaugcuugccugaagcuu

SEQ ID NO: 594979 - RNA, 18 nt, Homo sapiens
ccaugcuuuguagguguc

SEQ ID NO: 594980 - RNA, 18 nt, Homo sapiens
ccauggacacuacaccca

SEQ ID NO: 594981 - RNA, 14 nt, Homo sapiens
ccauggacacucca

SEQ ID NO: 594982 - RNA, 22 nt, Homo sapiens
ccauggacgaauaugaauguca

SEQ ID NO: 594983 - RNA, 16 nt, Homo sapiens
ccauggccaccccaga

SEQ ID NO: 594984 - RNA, 23 nt, Homo sapiens
ccauggcccccaauaaaggcagc

SEQ ID NO: 594985 - RNA, 22 nt, Homo sapiens
ccaugggaaacguaugugugca

SEQ ID NO: 594986 - RNA, 15 nt, Homo sapiens
ccaugggcacagugg

SEQ ID NO: 594987 - RNA, 14 nt, Homo sapiens
ccaugggcccgcug

SEQ ID NO: 594988 - RNA, 17 nt, Homo sapiens
ccaugggccugggccug

SEQ ID NO: 594989 - RNA, 21 nt, Homo sapiens
ccauggugaaaggguuugaua

SEQ ID NO: 594990 - RNA, 15 nt, Homo sapiens
cuaacaccaacauaa

SEQ ID NO: 594991 - RNA, 11 nt, Homo sapiens
cuaacacuggc

SEQ ID NO: 594992 - RNA, 15 nt, Homo sapiens
cuaacaggccaaaga

SEQ ID NO: 594993 - RNA, 16 nt, Homo sapiens
cuaacauguaauugca

SEQ ID NO: 594994 - RNA, 17 nt, Homo sapiens
cuaacauguaauugcag

SEQ ID NO: 594995 - RNA, 17 nt, Homo sapiens
cuaacauguugugccug

SEQ ID NO: 594996 - RNA, 12 nt, Homo sapiens
cuaaccaagaga

SEQ ID NO: 594997 - RNA, 22 nt, Homo sapiens
cuaaccacuggucaugccccca

SEQ ID NO: 594998 - RNA, 15 nt, Homo sapiens
cuaaccauguguuau

SEQ ID NO: 594999 - RNA, 22 nt, Homo sapiens
cuaacccaagacaugacauucu

SEQ ID NO: 595000 - RNA, 20 nt, Homo sapiens
cuaacccaaugccugugaag

SEQ ID NO: 595001 - RNA, 19 nt, Homo sapiens
cuaaccugcgucauuucag

SEQ ID NO: 595002 - RNA, 18 nt, Homo sapiens
cuaaccuugaaugcugcc

SEQ ID NO: 595003 - RNA, 17 nt, Homo sapiens
cuaacgcugaacugaca

SEQ ID NO: 595004 - RNA, 18 nt, Homo sapiens
cuaacguccacuagcuua

SEQ ID NO: 595005 - RNA, 15 nt, Homo sapiens
cuaacuagcauugua

SEQ ID NO: 595006 - RNA, 19 nt, Homo sapiens
cuaacuauauuugcuuuuu

SEQ ID NO: 595007 - RNA, 14 nt, Homo sapiens
cuaacucuggugcu

SEQ ID NO: 595008 - RNA, 15 nt, Homo sapiens
cuaacugcagaccau

SEQ ID NO: 595009 - RNA, 16 nt, Homo sapiens
cuaacugcagaccaug

SEQ ID NO: 595010 - RNA, 20 nt, Homo sapiens
cuaacuggcaggggagacag

SEQ ID NO: 595011 - RNA, 15 nt, Homo sapiens
cuaacuuaagacaga

SEQ ID NO: 595012 - RNA, 17 nt, Homo sapiens
cuaacuucaaggcccau

SEQ ID NO: 595013 - RNA, 21 nt, Homo sapiens
cuaacuugaaaagaaaaccac

SEQ ID NO: 595014 - RNA, 17 nt, Homo sapiens
cuaacuuuucuuaaggu

SEQ ID NO: 595015 - RNA, 20 nt, Homo sapiens
cuaagaaaaaaagcacaaag

SEQ ID NO: 595016 - RNA, 15 nt, Homo sapiens
cuaagaaauauucca

SEQ ID NO: 595017 - RNA, 20 nt, Homo sapiens
cuaagaaaugcugaaaauca

SEQ ID NO: 595018 - RNA, 13 nt, Homo sapiens
cuaagaaccaaaa

SEQ ID NO: 595019 - RNA, 14 nt, Homo sapiens
cuaagaaccaaaaa

SEQ ID NO: 595020 - RNA, 13 nt, Homo sapiens
cuaagaagacauu

SEQ ID NO: 595021 - RNA, 21 nt, Homo sapiens
cuaagagaaugugcucaugca

SEQ ID NO: 595022 - RNA, 19 nt, Homo sapiens
cuaagagacaguucucugu

SEQ ID NO: 595023 - RNA, 17 nt, Homo sapiens
cuaagauaaaaauaaua

SEQ ID NO: 595024 - RNA, 21 nt, Homo sapiens
cuaagauccuccugaccucaa

SEQ ID NO: 595025 - RNA, 20 nt, Homo sapiens
cuaagaucucgguuugccaa

SEQ ID NO: 595026 - RNA, 19 nt, Homo sapiens
cuaagaugaaauugccaaa

SEQ ID NO: 595027 - RNA, 14 nt, Homo sapiens
cuaagauggcuuuu

SEQ ID NO: 595028 - RNA, 12 nt, Homo sapiens
cuaagcacaaag

SEQ ID NO: 595029 - RNA, 21 nt, Homo sapiens
cuaagcaguuauggugaugac

SEQ ID NO: 595030 - RNA, 17 nt, Homo sapiens
cuaagccacucuuccaa

SEQ ID NO: 595031 - RNA, 16 nt, Homo sapiens
cuaagcccuuugccau

SEQ ID NO: 595032 - RNA, 18 nt, Homo sapiens
cuaagccgaaguuuugua

SEQ ID NO: 595033 - RNA, 18 nt, Homo sapiens
cuaagcuauucaguaaua

SEQ ID NO: 595034 - RNA, 20 nt, Homo sapiens
cuaagcugaguuaggugucu

SEQ ID NO: 595035 - RNA, 22 nt, Homo sapiens
cuaagcuggugccccacugaau

SEQ ID NO: 595036 - RNA, 19 nt, Homo sapiens
cuaagcuuugccagcugcu

SEQ ID NO: 595037 - RNA, 18 nt, Homo sapiens
cuaaggacaagacacuga

SEQ ID NO: 595038 - RNA, 13 nt, Homo sapiens
cuaaggaguaauc

SEQ ID NO: 595039 - RNA, 17 nt, Homo sapiens
cuaaggauaugcauuaa

SEQ ID NO: 595040 - RNA, 19 nt, Homo sapiens
cuaaggcaggagaaucacu

SEQ ID NO: 595041 - RNA, 22 nt, Homo sapiens
cuaagguuuagauaaauauuga

SEQ ID NO: 595042 - RNA, 22 nt, Homo sapiens
cuaaguagaccaaaucuuguua

SEQ ID NO: 595043 - RNA, 22 nt, Homo sapiens
cuaagucccuuccuauucuccu

SEQ ID NO: 595044 - RNA, 15 nt, Homo sapiens
cuaagucucugugaa

SEQ ID NO: 595045 - RNA, 16 nt, Homo sapiens
cuaagucucugugaau

SEQ ID NO: 595046 - RNA, 13 nt, Homo sapiens
cuaagugcuuauu

SEQ ID NO: 595047 - RNA, 19 nt, Homo sapiens
cuaaguguaugaugucaca

SEQ ID NO: 595048 - RNA, 17 nt, Homo sapiens
cuaaguuauuuacuuuu

SEQ ID NO: 595049 - RNA, 16 nt, Homo sapiens
cuaaguuggugcuuuu

SEQ ID NO: 595050 - RNA, 18 nt, Homo sapiens
cuaaguuuuuauaccagc

SEQ ID NO: 595051 - RNA, 14 nt, Homo sapiens
cuaauaaacugugu

SEQ ID NO: 595052 - RNA, 18 nt, Homo sapiens
cuaauaaacuguguaguu

SEQ ID NO: 595053 - RNA, 17 nt, Homo sapiens
cuaauaaauugacauaa

SEQ ID NO: 595054 - RNA, 20 nt, Homo sapiens
cuaauacccaguuacuuaug

SEQ ID NO: 595055 - RNA, 12 nt, Homo sapiens
cuaauacuacug

SEQ ID NO: 595056 - RNA, 22 nt, Homo sapiens
cuaauagaauaaaggcaguuuu

SEQ ID NO: 595057 - RNA, 16 nt, Homo sapiens
cuaauauaacuugaaa

SEQ ID NO: 595058 - RNA, 14 nt, Homo sapiens
cuaauaucuuuaaa

SEQ ID NO: 595059 - RNA, 13 nt, Homo sapiens
cuaauaugccuag

SEQ ID NO: 595060 - RNA, 14 nt, Homo sapiens
cuaauauggcaaaa

SEQ ID NO: 595061 - RNA, 19 nt, Homo sapiens
cuaauauuagggaguaaaa

SEQ ID NO: 595062 - RNA, 23 nt, Homo sapiens
cuaauauuaguuggcuuucauaa

SEQ ID NO: 595063 - RNA, 20 nt, Homo sapiens
cuaaucacaugugcugcaaa

SEQ ID NO: 595064 - RNA, 20 nt, Homo sapiens
cuaaucaccauguaagcacu

SEQ ID NO: 595065 - RNA, 13 nt, Homo sapiens
cuaaucacucuga

SEQ ID NO: 595066 - RNA, 16 nt, Homo sapiens
cuaaucagcauucuca

SEQ ID NO: 595067 - RNA, 14 nt, Homo sapiens
cuaaucaguccuua

SEQ ID NO: 595068 - RNA, 19 nt, Homo sapiens
cuaaucaguuguaacaaua

SEQ ID NO: 595069 - RNA, 19 nt, Homo sapiens
cuaaucucuguaaagcuaa

SEQ ID NO: 595070 - RNA, 20 nt, Homo sapiens
cuaaucuugaauguuuguga

SEQ ID NO: 595071 - RNA, 19 nt, Homo sapiens
cuaaugagacugaccauau

SEQ ID NO: 595072 - RNA, 20 nt, Homo sapiens
cuaaugagagugcacugcuc

SEQ ID NO: 595073 - RNA, 20 nt, Homo sapiens
cuaaugauauuuuaugcaaa

SEQ ID NO: 595074 - RNA, 22 nt, Homo sapiens
cuaaugauuuagugaucaaauu

SEQ ID NO: 595075 - RNA, 12 nt, Homo sapiens
cuaaugcucaac

SEQ ID NO: 595076 - RNA, 14 nt, Homo sapiens
cuaaugcucucagg

SEQ ID NO: 595077 - RNA, 13 nt, Homo sapiens
cuaaugggcuaaa

SEQ ID NO: 595078 - RNA, 15 nt, Homo sapiens
cuaauguacaauaaa

SEQ ID NO: 595079 - RNA, 14 nt, Homo sapiens
cuaauguacuguac

SEQ ID NO: 595080 - RNA, 19 nt, Homo sapiens
cuaauguacuguacauaaa

SEQ ID NO: 595081 - RNA, 17 nt, Homo sapiens
cuaaugugaaaaucauc

SEQ ID NO: 595082 - RNA, 11 nt, Homo sapiens
cuaaugugcag

SEQ ID NO: 595083 - RNA, 11 nt, Homo sapiens
cuaaugugcau

SEQ ID NO: 595084 - RNA, 14 nt, Homo sapiens
cuaaugugcauuaa

SEQ ID NO: 595085 - RNA, 15 nt, Homo sapiens
cuaauguugacuuua

SEQ ID NO: 595086 - RNA, 21 nt, Homo sapiens
cuaauguuggacagacacugu

SEQ ID NO: 595087 - RNA, 15 nt, Homo sapiens
cuaauguuuugcuua

SEQ ID NO: 595088 - RNA, 21 nt, Homo sapiens
cuaauuaaucuggaauaugca

SEQ ID NO: 595089 - RNA, 22 nt, Homo sapiens
cuaauuagagaacuggaggaac

SEQ ID NO: 595090 - RNA, 20 nt, Homo sapiens
cuaauuagaucaauuacuua

SEQ ID NO: 595091 - RNA, 13 nt, Homo sapiens
cuaauuaggcaag

SEQ ID NO: 595092 - RNA, 16 nt, Homo sapiens
cuaauuagucuaucaa

SEQ ID NO: 595093 - RNA, 18 nt, Homo sapiens
cuaauuauacuacuuugu

SEQ ID NO: 595094 - RNA, 19 nt, Homo sapiens
cuaauuauuuacucaaaga

SEQ ID NO: 595095 - RNA, 22 nt, Homo sapiens
cuaauuccacagcugcucaaua

SEQ ID NO: 595096 - RNA, 23 nt, Homo sapiens
cuaauucggauuugccauagccu

SEQ ID NO: 595097 - RNA, 18 nt, Homo sapiens
cuaauucugggaagggag

SEQ ID NO: 595098 - RNA, 23 nt, Homo sapiens
cuaauugucuuuguucugugauu

SEQ ID NO: 595099 - RNA, 11 nt, Homo sapiens
cuaauugugga

SEQ ID NO: 595100 - RNA, 14 nt, Homo sapiens
cuaauuguguacau

SEQ ID NO: 595101 - RNA, 22 nt, Homo sapiens
cuaauuuacuggacaaagaauu

SEQ ID NO: 595102 - RNA, 19 nt, Homo sapiens
cuaauuuguaggaaaaagc

SEQ ID NO: 595103 - RNA, 20 nt, Homo sapiens
cuaauuuguaggaaaaagca

SEQ ID NO: 595104 - RNA, 20 nt, Homo sapiens
cuaauuuuaguauucauucu

SEQ ID NO: 595105 - RNA, 16 nt, Homo sapiens
cuaauuuuuaagaauu

SEQ ID NO: 595106 - RNA, 20 nt, Homo sapiens
cuaauuuuucagcuccuuca

SEQ ID NO: 595107 - RNA, 15 nt, Homo sapiens
cuacaaaaaugaagc

SEQ ID NO: 595108 - RNA, 15 nt, Homo sapiens
cuacaacaaccugaa

SEQ ID NO: 595109 - RNA, 14 nt, Homo sapiens
cuacaagauuuaga

SEQ ID NO: 595110 - RNA, 23 nt, Homo sapiens
cuacaaggcuacaguaaccaaaa

SEQ ID NO: 595111 - RNA, 13 nt, Homo sapiens
cuacaaguauuau

SEQ ID NO: 595112 - RNA, 16 nt, Homo sapiens
cuacaagucagcucca

SEQ ID NO: 595113 - RNA, 14 nt, Homo sapiens
cuacaaugauggua

SEQ ID NO: 595114 - RNA, 16 nt, Homo sapiens
cuacaaugcucauguc

SEQ ID NO: 595115 - RNA, 20 nt, Homo sapiens
cuacaauuuguuuuugcauu

SEQ ID NO: 595116 - RNA, 23 nt, Homo sapiens
cuacacaaauuauaagcauacaa

SEQ ID NO: 595117 - RNA, 14 nt, Homo sapiens
cuacacaauuuaau

SEQ ID NO: 595118 - RNA, 12 nt, Homo sapiens
cuacacacaaac

SEQ ID NO: 595119 - RNA, 14 nt, Homo sapiens
cuacacacauaccu

SEQ ID NO: 595120 - RNA, 19 nt, Homo sapiens
cuacacacccugcauauca

SEQ ID NO: 595121 - RNA, 17 nt, Homo sapiens
cuacacaggagucuuca

SEQ ID NO: 595122 - RNA, 16 nt, Homo sapiens
cuacacagggcugcug

SEQ ID NO: 595123 - RNA, 20 nt, Homo sapiens
cuacacaguaaaaacuugua

SEQ ID NO: 595124 - RNA, 21 nt, Homo sapiens
cuacacucuugacuagugcaa

SEQ ID NO: 595125 - RNA, 19 nt, Homo sapiens
cuacacugagcagggagac

SEQ ID NO: 595126 - RNA, 13 nt, Homo sapiens
cuacacugugaag

SEQ ID NO: 595127 - RNA, 13 nt, Homo sapiens
cuacagacuccaa

SEQ ID NO: 595128 - RNA, 22 nt, Homo sapiens
cuacagagcuucccugacucau

SEQ ID NO: 595129 - RNA, 17 nt, Homo sapiens
cuacagaguacgugaaa

SEQ ID NO: 595130 - RNA, 22 nt, Homo sapiens
cuacagagucuggugaagcuca

SEQ ID NO: 595131 - RNA, 14 nt, Homo sapiens
cuacagauagaaaa

SEQ ID NO: 595132 - RNA, 14 nt, Homo sapiens
cuacagaugaguca

SEQ ID NO: 595133 - RNA, 17 nt, Homo sapiens
cuacagcacuacugggu

SEQ ID NO: 595134 - RNA, 15 nt, Homo sapiens
cuacagcagcacugu

SEQ ID NO: 595135 - RNA, 23 nt, Homo sapiens
cuacagcagcacuguucuguccu

SEQ ID NO: 595136 - RNA, 20 nt, Homo sapiens
cuacagcaguagggagguca

SEQ ID NO: 595137 - RNA, 19 nt, Homo sapiens
cuacagcuaacccucacaa

SEQ ID NO: 595138 - RNA, 19 nt, Homo sapiens
cuacagggagaaaauccag

SEQ ID NO: 595139 - RNA, 19 nt, Homo sapiens
cuacaggugaaggcucuca

SEQ ID NO: 595140 - RNA, 17 nt, Homo sapiens
cuacagguugugaaaua

SEQ ID NO: 595141 - RNA, 18 nt, Homo sapiens
cuacaguaaccaaaacag

SEQ ID NO: 595142 - RNA, 16 nt, Homo sapiens
cuacaguaaugaaaug

SEQ ID NO: 595143 - RNA, 15 nt, Homo sapiens
cuacaguagcugcua

SEQ ID NO: 595144 - RNA, 23 nt, Homo sapiens
cuacauacaaacaaugcaaccaa

SEQ ID NO: 595145 - RNA, 17 nt, Homo sapiens
cuacauccaauguauga

SEQ ID NO: 595146 - RNA, 17 nt, Homo sapiens
cuacaugaugcccugcu

SEQ ID NO: 595147 - RNA, 21 nt, Homo sapiens
cuacaugccucagugaaggac

SEQ ID NO: 595148 - RNA, 14 nt, Homo sapiens
cuacaugcugaaaa

SEQ ID NO: 595149 - RNA, 14 nt, Homo sapiens
cuacauguauugca

SEQ ID NO: 595150 - RNA, 16 nt, Homo sapiens
cuacauguauugcaca

SEQ ID NO: 595151 - RNA, 18 nt, Homo sapiens
cuacauguauugcacauu

SEQ ID NO: 595152 - RNA, 22 nt, Homo sapiens
cuacaugugccaccaacauaaa

SEQ ID NO: 595153 - RNA, 23 nt, Homo sapiens
cuacauuaguacacagcaccaga

SEQ ID NO: 595154 - RNA, 11 nt, Homo sapiens
cuacauuccuc

SEQ ID NO: 595155 - RNA, 15 nt, Homo sapiens
cuacauucuaaugca

SEQ ID NO: 595156 - RNA, 23 nt, Homo sapiens
cuacauuguacaaggaaugaaag

SEQ ID NO: 595157 - RNA, 20 nt, Homo sapiens
cuacauuuaaaaauacuucu

SEQ ID NO: 595158 - RNA, 16 nt, Homo sapiens
cuacauuugcuccauc

SEQ ID NO: 595159 - RNA, 19 nt, Homo sapiens
cuaccaagaacugaaggca

SEQ ID NO: 595160 - RNA, 13 nt, Homo sapiens
cuaccacaguguc

SEQ ID NO: 595161 - RNA, 13 nt, Homo sapiens
cuaccagagcucu

SEQ ID NO: 595162 - RNA, 21 nt, Homo sapiens
cuaccagguguucuacacuca

SEQ ID NO: 595163 - RNA, 13 nt, Homo sapiens
cuaccaucaggga

SEQ ID NO: 595164 - RNA, 14 nt, Homo sapiens
cuaccaucagggac

SEQ ID NO: 595165 - RNA, 22 nt, Homo sapiens
cuaccauuugcagaguccugca

SEQ ID NO: 595166 - RNA, 19 nt, Homo sapiens
cuacccaucuuaaaaacaa

SEQ ID NO: 595167 - RNA, 16 nt, Homo sapiens
cuacccccucaucccc

SEQ ID NO: 595168 - RNA, 18 nt, Homo sapiens
cuaccccucaaacugcac

SEQ ID NO: 595169 - RNA, 15 nt, Homo sapiens
cuacccuaaagggag

SEQ ID NO: 595170 - RNA, 18 nt, Homo sapiens
cuacccuauucuauccau

SEQ ID NO: 595171 - RNA, 18 nt, Homo sapiens
cuacccugcugaccuccc

SEQ ID NO: 595172 - RNA, 16 nt, Homo sapiens
cuacccuggcacuaua

SEQ ID NO: 595173 - RNA, 19 nt, Homo sapiens
cuacccuguccuuugcaau

SEQ ID NO: 595174 - RNA, 23 nt, Homo sapiens
cuaccgagucucuucuccacugg

SEQ ID NO: 595175 - RNA, 15 nt, Homo sapiens
cuaccguaaaugucc

SEQ ID NO: 595176 - RNA, 16 nt, Homo sapiens
cuaccuagggcacuuu

SEQ ID NO: 595177 - RNA, 17 nt, Homo sapiens
cuaccuagggcacuuua

SEQ ID NO: 595178 - RNA, 13 nt, Homo sapiens
cuaccuagucucc

SEQ ID NO: 595179 - RNA, 19 nt, Homo sapiens
cuaccucacuaugcugcuu

SEQ ID NO: 595180 - RNA, 10 nt, Homo sapiens
cuaccucagc

SEQ ID NO: 595181 - RNA, 18 nt, Homo sapiens
cuaccucaggcagcucaa

SEQ ID NO: 595182 - RNA, 14 nt, Homo sapiens
cuaccugagcauuc

SEQ ID NO: 595183 - RNA, 15 nt, Homo sapiens
cuaccugagcauuca

SEQ ID NO: 595184 - RNA, 23 nt, Homo sapiens
cuaccugggagaccagggaccac

SEQ ID NO: 595185 - RNA, 20 nt, Homo sapiens
cuaccuuagaaaacaaguau

SEQ ID NO: 595186 - RNA, 23 nt, Homo sapiens
cuaccuuuauauuugggguccuu

SEQ ID NO: 595187 - RNA, 17 nt, Homo sapiens
cuacgaauauagagggu

SEQ ID NO: 595188 - RNA, 14 nt, Homo sapiens
cuacgaaucuuccg

SEQ ID NO: 595189 - RNA, 14 nt, Homo sapiens
cuacgcacauaccu

SEQ ID NO: 595190 - RNA, 22 nt, Homo sapiens
cuacgguuuuauaaaagccuug

SEQ ID NO: 595191 - RNA, 22 nt, Homo sapiens
cuacgugggagucugugcauuu

SEQ ID NO: 595192 - RNA, 15 nt, Homo sapiens
cuacuaaaacauaca

SEQ ID NO: 595193 - RNA, 15 nt, Homo sapiens
cuacuaaagugccua

SEQ ID NO: 595194 - RNA, 21 nt, Homo sapiens
cuacuaaagugccuaccccag

SEQ ID NO: 595195 - RNA, 16 nt, Homo sapiens
cuacuaagauacucca

SEQ ID NO: 595196 - RNA, 16 nt, Homo sapiens
cuacuacccccacaga

SEQ ID NO: 595197 - RNA, 20 nt, Homo sapiens
cuacuaccuagggcacuuua

SEQ ID NO: 595198 - RNA, 13 nt, Homo sapiens
cuacuauauugau

SEQ ID NO: 595199 - RNA, 21 nt, Homo sapiens
cuacuaucacugaacaaacua

SEQ ID NO: 595200 - RNA, 16 nt, Homo sapiens
cuacucagguggcuaa

SEQ ID NO: 595201 - RNA, 20 nt, Homo sapiens
cuacuccuuguaaagacugu

SEQ ID NO: 595202 - RNA, 19 nt, Homo sapiens
cuacucgagaggcugaggc

SEQ ID NO: 595203 - RNA, 19 nt, Homo sapiens
cuacucgggaggcugaggc

SEQ ID NO: 595204 - RNA, 14 nt, Homo sapiens
cuacucugugccag

SEQ ID NO: 595205 - RNA, 14 nt, Homo sapiens
cuacugaacccugc

SEQ ID NO: 595206 - RNA, 12 nt, Homo sapiens
cuacugacgucc

SEQ ID NO: 595207 - RNA, 14 nt, Homo sapiens
cuacugagccuuca

SEQ ID NO: 595208 - RNA, 19 nt, Homo sapiens
cuacugagggcaguucuga

SEQ ID NO: 595209 - RNA, 16 nt, Homo sapiens
cuacugaggugcuaug

SEQ ID NO: 595210 - RNA, 20 nt, Homo sapiens
cuacugcacguaacacuccu

SEQ ID NO: 595211 - RNA, 18 nt, Homo sapiens
cuacugcagcaccuccag

SEQ ID NO: 595212 - RNA, 12 nt, Homo sapiens
cuacugcuaaau

SEQ ID NO: 595213 - RNA, 18 nt, Homo sapiens
cuacugcuaaauccucau

SEQ ID NO: 595214 - RNA, 22 nt, Homo sapiens
cuacuggggacugugcucacua

SEQ ID NO: 595215 - RNA, 20 nt, Homo sapiens
cuacuguauguaauauuuac

SEQ ID NO: 595216 - RNA, 14 nt, Homo sapiens
cuacugucaaauga

SEQ ID NO: 595217 - RNA, 13 nt, Homo sapiens
cuacuucaguaca

SEQ ID NO: 595218 - RNA, 13 nt, Homo sapiens
cuacuucagucuu

SEQ ID NO: 595219 - RNA, 16 nt, Homo sapiens
cuacuucuacauccaa

SEQ ID NO: 595220 - RNA, 19 nt, Homo sapiens
cuacuugggaggcugaggc

SEQ ID NO: 595221 - RNA, 20 nt, Homo sapiens
cuacuugggaggcugaggca

SEQ ID NO: 595222 - RNA, 15 nt, Homo sapiens
cuacuugucauauca

SEQ ID NO: 595223 - RNA, 15 nt, Homo sapiens
cuacuuuaagcacua

SEQ ID NO: 595224 - RNA, 20 nt, Homo sapiens
cuacuuuaaguauacaaucu

SEQ ID NO: 595225 - RNA, 13 nt, Homo sapiens
cuacuuuuaguug

SEQ ID NO: 595226 - RNA, 16 nt, Homo sapiens
cuacuuuuuauacucc

SEQ ID NO: 595227 - RNA, 18 nt, Homo sapiens
cuacuuuuugcaccuuau

SEQ ID NO: 595228 - RNA, 19 nt, Homo sapiens
cuacuuuuuuuugacauaa

SEQ ID NO: 595229 - RNA, 16 nt, Homo sapiens
cuagaaagacagaagc

SEQ ID NO: 595230 - RNA, 21 nt, Homo sapiens
cuagaaagagaucacccacuc

SEQ ID NO: 595231 - RNA, 22 nt, Homo sapiens
cuagaaagcugcacuggugcua

SEQ ID NO: 595232 - RNA, 18 nt, Homo sapiens
cuagaaaggaacugcaau

SEQ ID NO: 595233 - RNA, 19 nt, Homo sapiens
cuagaaaggaacugcaaua

SEQ ID NO: 595234 - RNA, 17 nt, Homo sapiens
cuagaaagucucugaua

SEQ ID NO: 595235 - RNA, 16 nt, Homo sapiens
cuagaaauagauuuaa

SEQ ID NO: 595236 - RNA, 16 nt, Homo sapiens
cuagaaaucuauuuau

SEQ ID NO: 595237 - RNA, 15 nt, Homo sapiens
cuagaaaucugccaa

SEQ ID NO: 595238 - RNA, 16 nt, Homo sapiens
cuagaaaucugccaau

SEQ ID NO: 595239 - RNA, 17 nt, Homo sapiens
cuagaaaucuguugcua

SEQ ID NO: 595240 - RNA, 22 nt, Homo sapiens
cuagaacaaugggaggcuguga

SEQ ID NO: 595241 - RNA, 12 nt, Homo sapiens
cuagaaggccac

SEQ ID NO: 595242 - RNA, 18 nt, Homo sapiens
cuagaauagucucacugu

SEQ ID NO: 595243 - RNA, 22 nt, Homo sapiens
cuagaauguggauuugauucau

SEQ ID NO: 595244 - RNA, 14 nt, Homo sapiens
cuagaauucuagug

SEQ ID NO: 595245 - RNA, 21 nt, Homo sapiens
cuagaauuugggcuuggacca

SEQ ID NO: 595246 - RNA, 21 nt, Homo sapiens
cuagacauucuuuuaaugcca

SEQ ID NO: 595247 - RNA, 17 nt, Homo sapiens
cuagaccucaguuauuu

SEQ ID NO: 595248 - RNA, 12 nt, Homo sapiens
cuagacuauaaa

SEQ ID NO: 595249 - RNA, 19 nt, Homo sapiens
cuagacuucccaacagccu

SEQ ID NO: 595250 - RNA, 17 nt, Homo sapiens
cuagacuucugaguaau

SEQ ID NO: 595251 - RNA, 12 nt, Homo sapiens
cuagacuuucug

SEQ ID NO: 595252 - RNA, 15 nt, Homo sapiens
cuagagacaggcaaa

SEQ ID NO: 595253 - RNA, 23 nt, Homo sapiens
cuagagauauggcagcgaaagga

SEQ ID NO: 595254 - RNA, 18 nt, Homo sapiens
cuagagaucuggcugugg

SEQ ID NO: 595255 - RNA, 15 nt, Homo sapiens
cuagagccagaccaa

SEQ ID NO: 595256 - RNA, 22 nt, Homo sapiens
cuagaggcuugcauaauaagcu

SEQ ID NO: 595257 - RNA, 12 nt, Homo sapiens
cuagagggccca

SEQ ID NO: 595258 - RNA, 12 nt, Homo sapiens
cuagaggugcuc

SEQ ID NO: 595259 - RNA, 15 nt, Homo sapiens
cuagagugcaauggu

SEQ ID NO: 595260 - RNA, 18 nt, Homo sapiens
cuagauacuggaaaccua

SEQ ID NO: 595261 - RNA, 15 nt, Homo sapiens
cuagauaugccuuaa

SEQ ID NO: 595262 - RNA, 19 nt, Homo sapiens
cuagaugauggaugccaau

SEQ ID NO: 595263 - RNA, 18 nt, Homo sapiens
cuagaugauugaauaaca

SEQ ID NO: 595264 - RNA, 13 nt, Homo sapiens
cuagaugcacgug

SEQ ID NO: 595265 - RNA, 23 nt, Homo sapiens
cuagauggagaaaguaacacaaa

SEQ ID NO: 595266 - RNA, 15 nt, Homo sapiens
cuagauggcuccucu

SEQ ID NO: 595267 - RNA, 13 nt, Homo sapiens
cuagauuacuuuu

SEQ ID NO: 595268 - RNA, 18 nt, Homo sapiens
cuagauuuugcugagaug

SEQ ID NO: 595269 - RNA, 19 nt, Homo sapiens
cuagauuuuguugaccuca

SEQ ID NO: 595270 - RNA, 20 nt, Homo sapiens
cuagcaaauguuaugcauaa

SEQ ID NO: 595271 - RNA, 22 nt, Homo sapiens
cuagcaaccuccacauguucaa

SEQ ID NO: 595272 - RNA, 23 nt, Homo sapiens
cuagcacaauuugcacuaaauca

SEQ ID NO: 595273 - RNA, 18 nt, Homo sapiens
cuagcaggccuaagacau

SEQ ID NO: 595274 - RNA, 22 nt, Homo sapiens
cuagccaucuugaucuguguuu

SEQ ID NO: 595275 - RNA, 15 nt, Homo sapiens
cuagccccucucuca

SEQ ID NO: 595276 - RNA, 23 nt, Homo sapiens
cuagcccuuccagccugggacac

SEQ ID NO: 595277 - RNA, 14 nt, Homo sapiens
cuagccgaccucag

SEQ ID NO: 595278 - RNA, 14 nt, Homo sapiens
cuagccuugcuugu

SEQ ID NO: 595279 - RNA, 15 nt, Homo sapiens
cuagcgugugccagg

SEQ ID NO: 595280 - RNA, 17 nt, Homo sapiens
cuagcugccucaaguga

SEQ ID NO: 595281 - RNA, 16 nt, Homo sapiens
cuagcugucugugaau

SEQ ID NO: 595282 - RNA, 17 nt, Homo sapiens
cuagcugucugugaaua

SEQ ID NO: 595283 - RNA, 20 nt, Homo sapiens
cuagcugugucagaaucucc

SEQ ID NO: 595284 - RNA, 18 nt, Homo sapiens
cuagcuuaucuacuucca

SEQ ID NO: 595285 - RNA, 20 nt, Homo sapiens
cuagcuuugcagucguguaa

SEQ ID NO: 595286 - RNA, 17 nt, Homo sapiens
cuaggaaaauuauucua

SEQ ID NO: 595287 - RNA, 20 nt, Homo sapiens
cuaggaagagucuacccgac

SEQ ID NO: 595288 - RNA, 21 nt, Homo sapiens
cuaggacuccaaccucaggga

SEQ ID NO: 595289 - RNA, 22 nt, Homo sapiens
cuaggacuccaaccucagggac

SEQ ID NO: 595290 - RNA, 13 nt, Homo sapiens
cuaggagaccaag

SEQ ID NO: 595291 - RNA, 13 nt, Homo sapiens
cuaggagcacugu

SEQ ID NO: 595292 - RNA, 17 nt, Homo sapiens
cuaggagguaaugacca

SEQ ID NO: 595293 - RNA, 19 nt, Homo sapiens
cuaggaguugaguacagug

SEQ ID NO: 595294 - RNA, 17 nt, Homo sapiens
cuaggauccccccaugc

SEQ ID NO: 595295 - RNA, 17 nt, Homo sapiens
cuaggcaacauggugaa

SEQ ID NO: 595296 - RNA, 15 nt, Homo sapiens
cuaggccagagccau

SEQ ID NO: 595297 - RNA, 19 nt, Homo sapiens
cuaggccauuagcccuuca

SEQ ID NO: 595298 - RNA, 18 nt, Homo sapiens
cuaggccucaauuguucc

SEQ ID NO: 595299 - RNA, 21 nt, Homo sapiens
cuaggccucuccaguuugcac

SEQ ID NO: 595300 - RNA, 22 nt, Homo sapiens
cuagggaauuccugcuaugaca

SEQ ID NO: 595301 - RNA, 21 nt, Homo sapiens
cuagggagacgccaugugaug

SEQ ID NO: 595302 - RNA, 13 nt, Homo sapiens
cuagggagccauu

SEQ ID NO: 595303 - RNA, 22 nt, Homo sapiens
cuagggcacuuuaagucaguga

SEQ ID NO: 595304 - RNA, 14 nt, Homo sapiens
cuaggggacacuuc

SEQ ID NO: 595305 - RNA, 16 nt, Homo sapiens
cuagggucuugggggu

SEQ ID NO: 595306 - RNA, 17 nt, Homo sapiens
cuagguaacgagggcaa

SEQ ID NO: 595307 - RNA, 15 nt, Homo sapiens
cuaggugacauauac

SEQ ID NO: 595308 - RNA, 17 nt, Homo sapiens
cuaggugcuauuuguca

SEQ ID NO: 595309 - RNA, 12 nt, Homo sapiens
cuagguggugcu

SEQ ID NO: 595310 - RNA, 13 nt, Homo sapiens
cuagguucaggaa

SEQ ID NO: 595311 - RNA, 20 nt, Homo sapiens
cuaguaagaugcacugaaaa

SEQ ID NO: 595312 - RNA, 22 nt, Homo sapiens
cuaguacagguuuugcccugau

SEQ ID NO: 595313 - RNA, 19 nt, Homo sapiens
cuaguacugccccccauga

SEQ ID NO: 595314 - RNA, 12 nt, Homo sapiens
cuaguacuguau

SEQ ID NO: 595315 - RNA, 14 nt, Homo sapiens
cuaguagaacugga

SEQ ID NO: 595316 - RNA, 15 nt, Homo sapiens
cuaguagccaaaagg

SEQ ID NO: 595317 - RNA, 22 nt, Homo sapiens
cuaguagcugggauuacaggcg

SEQ ID NO: 595318 - RNA, 17 nt, Homo sapiens
cuaguauggggugggag

SEQ ID NO: 595319 - RNA, 22 nt, Homo sapiens
cuaguccccagccugcucccua

SEQ ID NO: 595320 - RNA, 23 nt, Homo sapiens
cuaguccccagccugcucccuag

SEQ ID NO: 595321 - RNA, 12 nt, Homo sapiens
cuagucuacuuc

SEQ ID NO: 595322 - RNA, 19 nt, Homo sapiens
cuagucugcuagccaggau

SEQ ID NO: 595323 - RNA, 18 nt, Homo sapiens
cuagugacaccucaguca

SEQ ID NO: 595324 - RNA, 22 nt, Homo sapiens
cuagugccuugcccacaggugc

SEQ ID NO: 595325 - RNA, 12 nt, Homo sapiens
cuagugccuuua

SEQ ID NO: 595326 - RNA, 14 nt, Homo sapiens
cuaguguaccuccu

SEQ ID NO: 595327 - RNA, 12 nt, Homo sapiens
cuaguguagcug

SEQ ID NO: 595328 - RNA, 18 nt, Homo sapiens
cuagugucacugaugaac

SEQ ID NO: 595329 - RNA, 13 nt, Homo sapiens
cuaguuaaucaua

SEQ ID NO: 595330 - RNA, 13 nt, Homo sapiens
cuaguucuaccuc

SEQ ID NO: 595331 - RNA, 14 nt, Homo sapiens
cuaguugagagcac

SEQ ID NO: 595332 - RNA, 16 nt, Homo sapiens
cuauaaaguaaagcua

SEQ ID NO: 595333 - RNA, 18 nt, Homo sapiens
cuauaaaucaacaccuua

SEQ ID NO: 595334 - RNA, 22 nt, Homo sapiens
cuauaaauggaccauccuugac

SEQ ID NO: 595335 - RNA, 12 nt, Homo sapiens
cuauaacacauc

SEQ ID NO: 595336 - RNA, 18 nt, Homo sapiens
cuauaagcaugacauacu

SEQ ID NO: 595337 - RNA, 17 nt, Homo sapiens
cuauaagcccacuguua

SEQ ID NO: 595338 - RNA, 17 nt, Homo sapiens
cuauaaggaagauuugg

SEQ ID NO: 595339 - RNA, 17 nt, Homo sapiens
cuauaauacaguuuucu

SEQ ID NO: 595340 - RNA, 16 nt, Homo sapiens
cuauacacauaagcau

SEQ ID NO: 595341 - RNA, 22 nt, Homo sapiens
cuauacacuuaaugauacaugu

SEQ ID NO: 595342 - RNA, 15 nt, Homo sapiens
cuauacucuaaaaug

SEQ ID NO: 595343 - RNA, 15 nt, Homo sapiens
cuauacuuaaucuca

SEQ ID NO: 595344 - RNA, 22 nt, Homo sapiens
cuauagaaauagaacacugccu

SEQ ID NO: 595345 - RNA, 13 nt, Homo sapiens
cuauagcucagga

SEQ ID NO: 595346 - RNA, 17 nt, Homo sapiens
cuauagguccagaaguc

SEQ ID NO: 595347 - RNA, 21 nt, Homo sapiens
cuauagucccagcuacucaga

SEQ ID NO: 595348 - RNA, 21 nt, Homo sapiens
cuauauaguuccuugccuuaa

SEQ ID NO: 595349 - RNA, 23 nt, Homo sapiens
cuauauauaaucaucaaguaaua

SEQ ID NO: 595350 - RNA, 17 nt, Homo sapiens
cuauaucaaaaaaccuu

SEQ ID NO: 595351 - RNA, 13 nt, Homo sapiens
cuauauccaugua

SEQ ID NO: 595352 - RNA, 19 nt, Homo sapiens
cuauauccauguacuguag

SEQ ID NO: 595353 - RNA, 22 nt, Homo sapiens
cuauauccugugacugucucac

SEQ ID NO: 595354 - RNA, 22 nt, Homo sapiens
cuauaucucauuucauucucac

SEQ ID NO: 595355 - RNA, 14 nt, Homo sapiens
cuauaugauaugca

SEQ ID NO: 595356 - RNA, 22 nt, Homo sapiens
cuauauuccuuuuucuaugaaa

SEQ ID NO: 595357 - RNA, 17 nt, Homo sapiens
cuauauucucaguguag

SEQ ID NO: 595358 - RNA, 24 nt, Homo sapiens
cuauauuuuuuguaacauaaugca

SEQ ID NO: 595359 - RNA, 22 nt, Homo sapiens
cuaucaaaugaaacucuuucau

SEQ ID NO: 595360 - RNA, 16 nt, Homo sapiens
cuaucaagagaguaaa

SEQ ID NO: 595361 - RNA, 20 nt, Homo sapiens
cuaucaaguauuauaccuuu

SEQ ID NO: 595362 - RNA, 16 nt, Homo sapiens
cuaucaauucuugaga

SEQ ID NO: 595363 - RNA, 17 nt, Homo sapiens
cuaucagcaauacucau

SEQ ID NO: 595364 - RNA, 23 nt, Homo sapiens
cuaucagcauuuuacuacuuuaa

SEQ ID NO: 595365 - RNA, 15 nt, Homo sapiens
cuaucaggucccauc

SEQ ID NO: 595366 - RNA, 18 nt, Homo sapiens
cuaucauuggccuccaaa

SEQ ID NO: 595367 - RNA, 18 nt, Homo sapiens
cuauccagcagaucauuu

SEQ ID NO: 595368 - RNA, 19 nt, Homo sapiens
cuauccagcagaucauuua

SEQ ID NO: 595369 - RNA, 22 nt, Homo sapiens
cuaucccccgcagcgcucuccu

SEQ ID NO: 595370 - RNA, 17 nt, Homo sapiens
cuaucccuaggcacuua

SEQ ID NO: 595371 - RNA, 18 nt, Homo sapiens
cuaucccugcggccucca

SEQ ID NO: 595372 - RNA, 20 nt, Homo sapiens
cuauccguguugcagguuca

SEQ ID NO: 595373 - RNA, 21 nt, Homo sapiens
cuauccuccccuuuuaccacu

SEQ ID NO: 595374 - RNA, 18 nt, Homo sapiens
cuauccugauuccaaaua

SEQ ID NO: 595375 - RNA, 21 nt, Homo sapiens
cuauccugugcuugaugcuag

SEQ ID NO: 595376 - RNA, 15 nt, Homo sapiens
cuaucgcaccacugu

SEQ ID NO: 595377 - RNA, 21 nt, Homo sapiens
cuaucgucaggaaaccaaaua

SEQ ID NO: 595378 - RNA, 22 nt, Homo sapiens
cuaucuaauuuuacacucugua

SEQ ID NO: 595379 - RNA, 14 nt, Homo sapiens
cuaucuagcauuua

SEQ ID NO: 595380 - RNA, 20 nt, Homo sapiens
cuaucugcuguauauggaau

SEQ ID NO: 595381 - RNA, 15 nt, Homo sapiens
cuaucuggaagccac

SEQ ID NO: 595382 - RNA, 16 nt, Homo sapiens
cuaucugguauuaaau

SEQ ID NO: 595383 - RNA, 21 nt, Homo sapiens
cuaugaaauuucaacuuuucc

SEQ ID NO: 595384 - RNA, 19 nt, Homo sapiens
cuaugaacaacaguaguuu

SEQ ID NO: 595385 - RNA, 13 nt, Homo sapiens
cuaugaacaacuc

SEQ ID NO: 595386 - RNA, 19 nt, Homo sapiens
cuaugaaguuggcacauuu

SEQ ID NO: 595387 - RNA, 22 nt, Homo sapiens
cuaugagaccguucgcauggca

SEQ ID NO: 595388 - RNA, 16 nt, Homo sapiens
cuaugagcacauagga

SEQ ID NO: 595389 - RNA, 20 nt, Homo sapiens
cuaugauaaaguuguaaaua

SEQ ID NO: 595390 - RNA, 17 nt, Homo sapiens
cuaugauauaacaugug

SEQ ID NO: 595391 - RNA, 22 nt, Homo sapiens
cuaugauauuuucugugccuga

SEQ ID NO: 595392 - RNA, 23 nt, Homo sapiens
cuaugaucacagugacuuuacag

SEQ ID NO: 595393 - RNA, 20 nt, Homo sapiens
cuaugaucagaagacuuuaa

SEQ ID NO: 595394 - RNA, 15 nt, Homo sapiens
cuaugcaauucuuaa

SEQ ID NO: 595395 - RNA, 15 nt, Homo sapiens
cuaugcagacaucuc

SEQ ID NO: 595396 - RNA, 12 nt, Homo sapiens
cuaugcauuuga

SEQ ID NO: 595397 - RNA, 18 nt, Homo sapiens
cuaugccauuucuucucu

SEQ ID NO: 595398 - RNA, 12 nt, Homo sapiens
cuaugccuaaaa

SEQ ID NO: 595399 - RNA, 22 nt, Homo sapiens
cuaugcgggggugccuaaggag

SEQ ID NO: 595400 - RNA, 18 nt, Homo sapiens
cuaugcuacccuuaauaa

SEQ ID NO: 595401 - RNA, 13 nt, Homo sapiens
cuauggaaaaaag

SEQ ID NO: 595402 - RNA, 19 nt, Homo sapiens
cuauggaaaugugagaaau

SEQ ID NO: 595403 - RNA, 21 nt, Homo sapiens
cuaugggaacaauugaaguaa

SEQ ID NO: 595404 - RNA, 16 nt, Homo sapiens
cuaugggacugcagug

SEQ ID NO: 595405 - RNA, 15 nt, Homo sapiens
cuauguacuguaaua

SEQ ID NO: 595406 - RNA, 13 nt, Homo sapiens
cuaugugauuaca

SEQ ID NO: 595407 - RNA, 14 nt, Homo sapiens
cuaugugauuacaa

SEQ ID NO: 595408 - RNA, 16 nt, Homo sapiens
cuauguguaugcagaa

SEQ ID NO: 595409 - RNA, 18 nt, Homo sapiens
cuauguguuuuagacuua

SEQ ID NO: 595410 - RNA, 16 nt, Homo sapiens
cuauguuacauguaca

SEQ ID NO: 595411 - RNA, 14 nt, Homo sapiens
cuauguuauauuga

SEQ ID NO: 595412 - RNA, 14 nt, Homo sapiens
cuauguucaaagac

SEQ ID NO: 595413 - RNA, 20 nt, Homo sapiens
cuauguucaaagacugugaa

SEQ ID NO: 595414 - RNA, 11 nt, Homo sapiens
cuauguucccu

SEQ ID NO: 595415 - RNA, 13 nt, Homo sapiens
cuauguucuuagu

SEQ ID NO: 595416 - RNA, 14 nt, Homo sapiens
cuauguugcccaag

SEQ ID NO: 595417 - RNA, 20 nt, Homo sapiens
cuauguuugcggaaugcauu

SEQ ID NO: 595418 - RNA, 22 nt, Homo sapiens
cuauguuuuuguucaaagccag

SEQ ID NO: 595419 - RNA, 23 nt, Homo sapiens
cuauuaacuuuaauucucuuuca

SEQ ID NO: 595420 - RNA, 18 nt, Homo sapiens
cuauuaagauacuuagau

SEQ ID NO: 595421 - RNA, 22 nt, Homo sapiens
cuauuaagauacuuagauuaga

SEQ ID NO: 595422 - RNA, 12 nt, Homo sapiens
cuauuaagguga

SEQ ID NO: 595423 - RNA, 20 nt, Homo sapiens
cuauuaauaucaacucugaa

SEQ ID NO: 595424 - RNA, 16 nt, Homo sapiens
cuauuagagcauugaa

SEQ ID NO: 595425 - RNA, 15 nt, Homo sapiens
cuauuagauuuuaga

SEQ ID NO: 595426 - RNA, 22 nt, Homo sapiens
cuauuauuuggagccugccaag

SEQ ID NO: 595427 - RNA, 18 nt, Homo sapiens
cuauucaauucuuuuaac

SEQ ID NO: 595428 - RNA, 23 nt, Homo sapiens
cuauucaggcuguuguuggcuua

SEQ ID NO: 595429 - RNA, 14 nt, Homo sapiens
cuauuccaaagugc

SEQ ID NO: 595430 - RNA, 15 nt, Homo sapiens
cuauuccauauuaaa

SEQ ID NO: 595431 - RNA, 20 nt, Homo sapiens
cuauucccugucacuacaca

SEQ ID NO: 595432 - RNA, 15 nt, Homo sapiens
cuauucuaauaacug

SEQ ID NO: 595433 - RNA, 16 nt, Homo sapiens
cuauucuccugccaug

SEQ ID NO: 595434 - RNA, 21 nt, Homo sapiens
cuauucuuaagcacuuugaaa

SEQ ID NO: 595435 - RNA, 19 nt, Homo sapiens
cuauugacaagucauuuua

SEQ ID NO: 595436 - RNA, 16 nt, Homo sapiens
cuauugacuucaauga

SEQ ID NO: 595437 - RNA, 23 nt, Homo sapiens
cuauugggauauccuuucacucu

SEQ ID NO: 595438 - RNA, 12 nt, Homo sapiens
cuauuggucucc

SEQ ID NO: 595439 - RNA, 16 nt, Homo sapiens
cuauuguuaccucuga

SEQ ID NO: 595440 - RNA, 20 nt, Homo sapiens
cuauuuaaaaaaaaagucag

SEQ ID NO: 595441 - RNA, 19 nt, Homo sapiens
cuauuuaaaauaagcacac

SEQ ID NO: 595442 - RNA, 21 nt, Homo sapiens
cuauuuaaaggaaaaucacau

SEQ ID NO: 595443 - RNA, 22 nt, Homo sapiens
cuauuuauuacugaacuauuau

SEQ ID NO: 595444 - RNA, 23 nt, Homo sapiens
cuauuucaucuauuuuuggcagu

SEQ ID NO: 595445 - RNA, 13 nt, Homo sapiens
cuauuuccacuga

SEQ ID NO: 595446 - RNA, 17 nt, Homo sapiens
cuauuuccacugaacaa

SEQ ID NO: 595447 - RNA, 23 nt, Homo sapiens
cuauuuccacugaacaaaaccua

SEQ ID NO: 595448 - RNA, 12 nt, Homo sapiens
cuauuuccagag

SEQ ID NO: 595449 - RNA, 17 nt, Homo sapiens
cuauuuccauuccagaa

SEQ ID NO: 595450 - RNA, 16 nt, Homo sapiens
cuauuucuccaaagcc

SEQ ID NO: 595451 - RNA, 17 nt, Homo sapiens
cuauuucuccaaagccu

SEQ ID NO: 595452 - RNA, 22 nt, Homo sapiens
cuauuucuguauauaaaggugc

SEQ ID NO: 595453 - RNA, 16 nt, Homo sapiens
cuauuucuguuccagu

SEQ ID NO: 595454 - RNA, 15 nt, Homo sapiens
cuauuuuaagccauc

SEQ ID NO: 595455 - RNA, 19 nt, Homo sapiens
cuauuuuauaaaacaaaua

SEQ ID NO: 595456 - RNA, 21 nt, Homo sapiens
cuauuuucagagcaugauaca

SEQ ID NO: 595457 - RNA, 13 nt, Homo sapiens
cuauuuucauucu

SEQ ID NO: 595458 - RNA, 17 nt, Homo sapiens
cuauuuuuauacuuuau

SEQ ID NO: 595459 - RNA, 14 nt, Homo sapiens
cuauuuuugaggaa

SEQ ID NO: 595460 - RNA, 18 nt, Homo sapiens
cuauuuuuuaaagacugu

SEQ ID NO: 595461 - RNA, 22 nt, Homo sapiens
cucaaaacagagggcugcauuc

SEQ ID NO: 595462 - RNA, 20 nt, Homo sapiens
cucaaaaccucuuaaaucau

SEQ ID NO: 595463 - RNA, 13 nt, Homo sapiens
cucaaaaucuuuc

SEQ ID NO: 595464 - RNA, 20 nt, Homo sapiens
cucaaacucccgaccucagg

SEQ ID NO: 595465 - RNA, 22 nt, Homo sapiens
cucaaacucccgaccucaggug

SEQ ID NO: 595466 - RNA, 18 nt, Homo sapiens
cucaaacuccugaccuca

SEQ ID NO: 595467 - RNA, 22 nt, Homo sapiens
cucaaacuccugaccucaggug

SEQ ID NO: 595468 - RNA, 16 nt, Homo sapiens
cucaaacuuccaguca

SEQ ID NO: 595469 - RNA, 14 nt, Homo sapiens
cucaaagaaagugu

SEQ ID NO: 595470 - RNA, 22 nt, Homo sapiens
cucaaagagcaaccaguaucac

SEQ ID NO: 595471 - RNA, 20 nt, Homo sapiens
cucaaagaugcguuugccuc

SEQ ID NO: 595472 - RNA, 13 nt, Homo sapiens
cucaaaucagucu

SEQ ID NO: 595473 - RNA, 23 nt, Homo sapiens
cucaaaucuauucagacaagcaa

SEQ ID NO: 595474 - RNA, 12 nt, Homo sapiens
cucaaaugucag

SEQ ID NO: 595475 - RNA, 20 nt, Homo sapiens
cucaaauuggugaacagugu

SEQ ID NO: 595476 - RNA, 22 nt, Homo sapiens
cucaacaagggagagaccucau

SEQ ID NO: 595477 - RNA, 15 nt, Homo sapiens
cucaacacuauugua

SEQ ID NO: 595478 - RNA, 20 nt, Homo sapiens
cucaacagaauuaaaauguc

SEQ ID NO: 595479 - RNA, 16 nt, Homo sapiens
cucaacagcuacucaa

SEQ ID NO: 595480 - RNA, 17 nt, Homo sapiens
cucaacauuaccaaaau

SEQ ID NO: 595481 - RNA, 13 nt, Homo sapiens
cucaacauugugu

SEQ ID NO: 595482 - RNA, 20 nt, Homo sapiens
cucaaccucaccauugugaa

SEQ ID NO: 595483 - RNA, 15 nt, Homo sapiens
cucaaccugggacuu

SEQ ID NO: 595484 - RNA, 20 nt, Homo sapiens
cucaaccugggucaaagugg

SEQ ID NO: 595485 - RNA, 18 nt, Homo sapiens
cucaacguugcuccccau

SEQ ID NO: 595486 - RNA, 12 nt, Homo sapiens
cucaacuucuuu

SEQ ID NO: 595487 - RNA, 23 nt, Homo sapiens
cucaacuucuuuccucuggagac

SEQ ID NO: 595488 - RNA, 21 nt, Homo sapiens
cucaagaacaaacacugcagu

SEQ ID NO: 595489 - RNA, 14 nt, Homo sapiens
cucaagaacacaug

SEQ ID NO: 595490 - RNA, 16 nt, Homo sapiens
cucaagaagugaagaa

SEQ ID NO: 595491 - RNA, 23 nt, Homo sapiens
cucaagaccagagacccaacagc

SEQ ID NO: 595492 - RNA, 22 nt, Homo sapiens
cucaagacuuauggaacaggga

SEQ ID NO: 595493 - RNA, 12 nt, Homo sapiens
cucaagacuuua

SEQ ID NO: 595494 - RNA, 20 nt, Homo sapiens
cucaagagacaccccuuccu

SEQ ID NO: 595495 - RNA, 16 nt, Homo sapiens
cucaagaugaaggcaa

SEQ ID NO: 595496 - RNA, 18 nt, Homo sapiens
cucaagauggauuaaaga

SEQ ID NO: 595497 - RNA, 19 nt, Homo sapiens
cucaaggacuuugcagccg

SEQ ID NO: 595498 - RNA, 18 nt, Homo sapiens
cucaagugagccaagaaa

SEQ ID NO: 595499 - RNA, 23 nt, Homo sapiens
cucaauaaaguuccccugugaca

SEQ ID NO: 595500 - RNA, 16 nt, Homo sapiens
cucaauauuaaagggu

SEQ ID NO: 595501 - RNA, 14 nt, Homo sapiens
cucaauccuaucac

SEQ ID NO: 595502 - RNA, 14 nt, Homo sapiens
cucaaugccaguaa

SEQ ID NO: 595503 - RNA, 10 nt, Homo sapiens
cucaauguuu

SEQ ID NO: 595504 - RNA, 23 nt, Homo sapiens
cucaauuuaguuuguuauuuauc

SEQ ID NO: 595505 - RNA, 14 nt, Homo sapiens
cucaauuugcagua

SEQ ID NO: 595506 - RNA, 16 nt, Homo sapiens
cucacaaaaaggcaaa

SEQ ID NO: 595507 - RNA, 12 nt, Homo sapiens
cucacaaacagu

SEQ ID NO: 595508 - RNA, 23 nt, Homo sapiens
cucacaacuuggguucuucucag

SEQ ID NO: 595509 - RNA, 23 nt, Homo sapiens
cucacaaugucccuucagcaccu

SEQ ID NO: 595510 - RNA, 13 nt, Homo sapiens
cucacaccuguaa

SEQ ID NO: 595511 - RNA, 19 nt, Homo sapiens
cucacaccuguaaucccaa

SEQ ID NO: 595512 - RNA, 22 nt, Homo sapiens
cucacacggacacucaaaagcu

SEQ ID NO: 595513 - RNA, 16 nt, Homo sapiens
cucacacucucugcag

SEQ ID NO: 595514 - RNA, 16 nt, Homo sapiens
cucacagaacuaugua

SEQ ID NO: 595515 - RNA, 18 nt, Homo sapiens
cucacagaagaauaugac

SEQ ID NO: 595516 - RNA, 19 nt, Homo sapiens
cucacagagugcauuguga

SEQ ID NO: 595517 - RNA, 21 nt, Homo sapiens
cucacagagugcauugugagg

SEQ ID NO: 595518 - RNA, 14 nt, Homo sapiens
cucacagcuguaau

SEQ ID NO: 595519 - RNA, 18 nt, Homo sapiens
cucacaggccccaggaaa

SEQ ID NO: 595520 - RNA, 22 nt, Homo sapiens
cucacauaaaaaagaagcacuu

SEQ ID NO: 595521 - RNA, 16 nt, Homo sapiens
cucacaugcacagggg

SEQ ID NO: 595522 - RNA, 15 nt, Homo sapiens
cucacaugugacaaa

SEQ ID NO: 595523 - RNA, 21 nt, Homo sapiens
cucacauuagaucuaguuacu

SEQ ID NO: 595524 - RNA, 12 nt, Homo sapiens
cucacauucauu

SEQ ID NO: 595525 - RNA, 14 nt, Homo sapiens
cucaccacacccag

SEQ ID NO: 595526 - RNA, 19 nt, Homo sapiens
cucaccagccccacugcca

SEQ ID NO: 595527 - RNA, 20 nt, Homo sapiens
cucaccagccccacugccag

SEQ ID NO: 595528 - RNA, 22 nt, Homo sapiens
cucaccccagccucauugugcc

SEQ ID NO: 595529 - RNA, 19 nt, Homo sapiens
cucaccuagccugaugaga

SEQ ID NO: 595530 - RNA, 17 nt, Homo sapiens
cucaccucucccucgau

SEQ ID NO: 595531 - RNA, 15 nt, Homo sapiens
cucaccucucgcaag

SEQ ID NO: 595532 - RNA, 17 nt, Homo sapiens
cucaccugguugaccca

SEQ ID NO: 595533 - RNA, 15 nt, Homo sapiens
cucaccuugucucau

SEQ ID NO: 595534 - RNA, 19 nt, Homo sapiens
cucacgcccuaagcgcaca

SEQ ID NO: 595535 - RNA, 14 nt, Homo sapiens
cucacggaccccau

SEQ ID NO: 595536 - RNA, 13 nt, Homo sapiens
cucacuacugaac

SEQ ID NO: 595537 - RNA, 15 nt, Homo sapiens
cucacucaccaucug

SEQ ID NO: 595538 - RNA, 20 nt, Homo sapiens
cucacucccucccuuucuau

SEQ ID NO: 595539 - RNA, 21 nt, Homo sapiens
cucacugaggguaucugacaa

SEQ ID NO: 595540 - RNA, 20 nt, Homo sapiens
cucacugccguccucaggug

SEQ ID NO: 595541 - RNA, 13 nt, Homo sapiens
cucacugccuagg

SEQ ID NO: 595542 - RNA, 18 nt, Homo sapiens
cucacuggaggagcagcu

SEQ ID NO: 595543 - RNA, 14 nt, Homo sapiens
cucacuguauccag

SEQ ID NO: 595544 - RNA, 16 nt, Homo sapiens
cucacuguucugcaaa

SEQ ID NO: 595545 - RNA, 16 nt, Homo sapiens
cucacuuaguccuuua

SEQ ID NO: 595546 - RNA, 14 nt, Homo sapiens
cucacuuaucccaa

SEQ ID NO: 595547 - RNA, 14 nt, Homo sapiens
cucacuuccagugc

SEQ ID NO: 595548 - RNA, 12 nt, Homo sapiens
cucacuuuggaa

SEQ ID NO: 595549 - RNA, 14 nt, Homo sapiens
cucagaaaagugac

SEQ ID NO: 595550 - RNA, 13 nt, Homo sapiens
cucagaaagccaa

SEQ ID NO: 595551 - RNA, 17 nt, Homo sapiens
cucagaacaauccgauu

SEQ ID NO: 595552 - RNA, 19 nt, Homo sapiens
cucagaacaccaacuuaag

SEQ ID NO: 595553 - RNA, 12 nt, Homo sapiens
cucagaacauaa

SEQ ID NO: 595554 - RNA, 14 nt, Homo sapiens
cucagaagcacaga

SEQ ID NO: 595555 - RNA, 17 nt, Homo sapiens
cucagaaggccccagag

SEQ ID NO: 595556 - RNA, 21 nt, Homo sapiens
cucagaagugaaaaucuugga

SEQ ID NO: 595557 - RNA, 16 nt, Homo sapiens
cucagaauagcuguuu

SEQ ID NO: 595558 - RNA, 14 nt, Homo sapiens
cucagaauccacaa

SEQ ID NO: 595559 - RNA, 18 nt, Homo sapiens
cucagaaugcacuugauu

SEQ ID NO: 595560 - RNA, 14 nt, Homo sapiens
cucagacccaacag

SEQ ID NO: 595561 - RNA, 12 nt, Homo sapiens
cucagaccugaa

SEQ ID NO: 595562 - RNA, 23 nt, Homo sapiens
cucagagaauuucuaccauuuca

SEQ ID NO: 595563 - RNA, 12 nt, Homo sapiens
cucagagcccau

SEQ ID NO: 595564 - RNA, 22 nt, Homo sapiens
cucagaggcgcacugugacccc

SEQ ID NO: 595565 - RNA, 18 nt, Homo sapiens
cucagagguagcaguaaa

SEQ ID NO: 595566 - RNA, 17 nt, Homo sapiens
cucagagugacagucau

SEQ ID NO: 595567 - RNA, 22 nt, Homo sapiens
cucagaguguggguccuucaaa

SEQ ID NO: 595568 - RNA, 23 nt, Homo sapiens
cucagauauagauccugagcuca

SEQ ID NO: 595569 - RNA, 17 nt, Homo sapiens
cucagaugaggacagag

SEQ ID NO: 595570 - RNA, 12 nt, Homo sapiens
cucagaugucca

SEQ ID NO: 595571 - RNA, 23 nt, Homo sapiens
cucagauuccaccuagagcuaga

SEQ ID NO: 595572 - RNA, 13 nt, Homo sapiens
cucagcaacaagg

SEQ ID NO: 595573 - RNA, 13 nt, Homo sapiens
cucagcaacagug

SEQ ID NO: 595574 - RNA, 17 nt, Homo sapiens
cucagcaacaguggaau

SEQ ID NO: 595575 - RNA, 23 nt, Homo sapiens
cucagcacauucgggaccaauau

SEQ ID NO: 595576 - RNA, 12 nt, Homo sapiens
cucagcacuguu

SEQ ID NO: 595577 - RNA, 14 nt, Homo sapiens
cucagcaugcaucc

SEQ ID NO: 595578 - RNA, 23 nt, Homo sapiens
cucagcaugcauccuuugcacug

SEQ ID NO: 595579 - RNA, 14 nt, Homo sapiens
cucagcauuuccac

SEQ ID NO: 595580 - RNA, 23 nt, Homo sapiens
cucagcauuucuuuucuggccaa

SEQ ID NO: 595581 - RNA, 15 nt, Homo sapiens
cucagccacuugccu

SEQ ID NO: 595582 - RNA, 14 nt, Homo sapiens
cucagccagcacuu

SEQ ID NO: 595583 - RNA, 23 nt, Homo sapiens
cucagcccugggccccaccaccu

SEQ ID NO: 595584 - RNA, 20 nt, Homo sapiens
cucagccucccaaguagcug

SEQ ID NO: 595585 - RNA, 17 nt, Homo sapiens
cucagccucuucucugc

SEQ ID NO: 595586 - RNA, 18 nt, Homo sapiens
cucagccuguuccaugaa

SEQ ID NO: 595587 - RNA, 20 nt, Homo sapiens
cucagccuugggaccgugcc

SEQ ID NO: 595588 - RNA, 19 nt, Homo sapiens
cucagcuaacauuccaugu

SEQ ID NO: 595589 - RNA, 22 nt, Homo sapiens
cucagcuacuucuccugcacuu

SEQ ID NO: 595590 - RNA, 14 nt, Homo sapiens
cucagcucaccuca

SEQ ID NO: 595591 - RNA, 20 nt, Homo sapiens
cucagcuccagaauaccuuc

SEQ ID NO: 595592 - RNA, 14 nt, Homo sapiens
cucagcucuuggcu

SEQ ID NO: 595593 - RNA, 20 nt, Homo sapiens
cucagcugccaagcacucga

SEQ ID NO: 595594 - RNA, 19 nt, Homo sapiens
cucagcuguccugcagcaa

SEQ ID NO: 595595 - RNA, 13 nt, Homo sapiens
cucagcuuaucuc

SEQ ID NO: 595596 - RNA, 18 nt, Homo sapiens
cucagcuuuaaugggugu

SEQ ID NO: 595597 - RNA, 16 nt, Homo sapiens
cucagcuuuuaaaugg

SEQ ID NO: 595598 - RNA, 15 nt, Homo sapiens
cucaggaaaccacaa

SEQ ID NO: 595599 - RNA, 17 nt, Homo sapiens
cucaggaggccgaggca

SEQ ID NO: 595600 - RNA, 17 nt, Homo sapiens
cucaggagucucuggua

SEQ ID NO: 595601 - RNA, 18 nt, Homo sapiens
cucaggaguuugagacca

SEQ ID NO: 595602 - RNA, 16 nt, Homo sapiens
cucaggauccagugac

SEQ ID NO: 595603 - RNA, 22 nt, Homo sapiens
cucaggcaaagaaaaugaaaug

SEQ ID NO: 595604 - RNA, 14 nt, Homo sapiens
cucaggcacacagc

SEQ ID NO: 595605 - RNA, 17 nt, Homo sapiens
cucaggcuuccuuggca

SEQ ID NO: 595606 - RNA, 15 nt, Homo sapiens
cucagggaaagccuc

SEQ ID NO: 595607 - RNA, 20 nt, Homo sapiens
cucagggcagcgccaggcug

SEQ ID NO: 595608 - RNA, 16 nt, Homo sapiens
cucaggggacuugaau

SEQ ID NO: 595609 - RNA, 21 nt, Homo sapiens
cucaggggagcaagcuuacac

SEQ ID NO: 595610 - RNA, 18 nt, Homo sapiens
cucagguaguacugggaa

SEQ ID NO: 595611 - RNA, 14 nt, Homo sapiens
cucaggucccugca

SEQ ID NO: 595612 - RNA, 14 nt, Homo sapiens
cucaggugcugucc

SEQ ID NO: 595613 - RNA, 22 nt, Homo sapiens
cucagguuuguuuugugaauuu

SEQ ID NO: 595614 - RNA, 15 nt, Homo sapiens
cucaguaaaaguaaa

SEQ ID NO: 595615 - RNA, 22 nt, Homo sapiens
cucaguaaacgggaacaugccc

SEQ ID NO: 595616 - RNA, 12 nt, Homo sapiens
cucaguaauucc

SEQ ID NO: 595617 - RNA, 17 nt, Homo sapiens
cucaguagagaucuaua

SEQ ID NO: 595618 - RNA, 18 nt, Homo sapiens
cucaguagauacuaaagc

SEQ ID NO: 595619 - RNA, 22 nt, Homo sapiens
cucaguagauacuaaagcaaau

SEQ ID NO: 595620 - RNA, 10 nt, Homo sapiens
cucaguauua

SEQ ID NO: 595621 - RNA, 14 nt, Homo sapiens
cucagucucaggag

SEQ ID NO: 595622 - RNA, 13 nt, Homo sapiens
cucagugaaggcu

SEQ ID NO: 595623 - RNA, 16 nt, Homo sapiens
cucagugaagguggug

SEQ ID NO: 595624 - RNA, 11 nt, Homo sapiens
cucagugcagg

SEQ ID NO: 595625 - RNA, 21 nt, Homo sapiens
cucagugccaccuaugccugu

SEQ ID NO: 595626 - RNA, 20 nt, Homo sapiens
cucaguggacuuuccacccc

SEQ ID NO: 595627 - RNA, 22 nt, Homo sapiens
cucaguucguguuugauuccau

SEQ ID NO: 595628 - RNA, 17 nt, Homo sapiens
cucaguucuacacugau

SEQ ID NO: 595629 - RNA, 19 nt, Homo sapiens
cucaguucucuugcuuuca

SEQ ID NO: 595630 - RNA, 21 nt, Homo sapiens
cucaguucucuugcuuucaca

SEQ ID NO: 595631 - RNA, 20 nt, Homo sapiens
cucaguuggugcugcuuucu

SEQ ID NO: 595632 - RNA, 22 nt, Homo sapiens
cucaguuguuugcuucuugcca

SEQ ID NO: 595633 - RNA, 21 nt, Homo sapiens
cucaguuuccucaucugcaaa

SEQ ID NO: 595634 - RNA, 15 nt, Homo sapiens
cucaguuucuaggca

SEQ ID NO: 595635 - RNA, 21 nt, Homo sapiens
cucaguuugucagacuuuaaa

SEQ ID NO: 595636 - RNA, 16 nt, Homo sapiens
cucauaaaguagauua

SEQ ID NO: 595637 - RNA, 13 nt, Homo sapiens
cucauaagcaaua

SEQ ID NO: 595638 - RNA, 10 nt, Homo sapiens
cucauaauag

SEQ ID NO: 595639 - RNA, 14 nt, Homo sapiens
cucauacacagaaa

SEQ ID NO: 595640 - RNA, 19 nt, Homo sapiens
cucauacugucugggauua

SEQ ID NO: 595641 - RNA, 17 nt, Homo sapiens
cucauacuuaagcaaaa

SEQ ID NO: 595642 - RNA, 21 nt, Homo sapiens
cucauagcuaauuuuugcaaa

SEQ ID NO: 595643 - RNA, 22 nt, Homo sapiens
cucauagguugagcaauuuccc

SEQ ID NO: 595644 - RNA, 17 nt, Homo sapiens
cucauaguaauaagaug

SEQ ID NO: 595645 - RNA, 22 nt, Homo sapiens
cucauaguucucuuuaagccag

SEQ ID NO: 595646 - RNA, 20 nt, Homo sapiens
cucauaucaugguagucacu

SEQ ID NO: 595647 - RNA, 21 nt, Homo sapiens
cucaucaacugaaugagguca

SEQ ID NO: 595648 - RNA, 20 nt, Homo sapiens
cucaucaauggggccaguca

SEQ ID NO: 595649 - RNA, 21 nt, Homo sapiens
cucaucaauggggccagucag

SEQ ID NO: 595650 - RNA, 15 nt, Homo sapiens
cucaucacauaaaag

SEQ ID NO: 595651 - RNA, 23 nt, Homo sapiens
cucaucaguguccucuugcucaa

SEQ ID NO: 595652 - RNA, 22 nt, Homo sapiens
cucaucauagcaauaacauucc

SEQ ID NO: 595653 - RNA, 23 nt, Homo sapiens
cucaucauagcaauaacauuccc

SEQ ID NO: 595654 - RNA, 13 nt, Homo sapiens
cucauccaaaguu

SEQ ID NO: 595655 - RNA, 15 nt, Homo sapiens
cucauccacuuucca

SEQ ID NO: 595656 - RNA, 15 nt, Homo sapiens
cucaucccucuguca

SEQ ID NO: 595657 - RNA, 23 nt, Homo sapiens
cucaucccuggucgucuauccca

SEQ ID NO: 595658 - RNA, 18 nt, Homo sapiens
cucauccuccuggaaccu

SEQ ID NO: 595659 - RNA, 19 nt, Homo sapiens
cucaucuccuuccugagga

SEQ ID NO: 595660 - RNA, 12 nt, Homo sapiens
cucaucugcaaa

SEQ ID NO: 595661 - RNA, 20 nt, Homo sapiens
cucaucuggagggaugagug

SEQ ID NO: 595662 - RNA, 13 nt, Homo sapiens
cucaucugggcaa

SEQ ID NO: 595663 - RNA, 14 nt, Homo sapiens
cucaucugggucuc

SEQ ID NO: 595664 - RNA, 14 nt, Homo sapiens
cucaugaagcauac

SEQ ID NO: 595665 - RNA, 20 nt, Homo sapiens
cucaugaugccuuuuuauau

SEQ ID NO: 595666 - RNA, 14 nt, Homo sapiens
cucaugauguauug

SEQ ID NO: 595667 - RNA, 15 nt, Homo sapiens
cucaugccuguaauc

SEQ ID NO: 595668 - RNA, 16 nt, Homo sapiens
cucauggauugccaca

SEQ ID NO: 595669 - RNA, 13 nt, Homo sapiens
cucaugugcagua

SEQ ID NO: 595670 - RNA, 16 nt, Homo sapiens
cucauguuccuuuuga

SEQ ID NO: 595671 - RNA, 12 nt, Homo sapiens
cucauuaauucu

SEQ ID NO: 595672 - RNA, 10 nt, Homo sapiens
cucauuccac

SEQ ID NO: 595673 - RNA, 13 nt, Homo sapiens
cucauuccaccuu

SEQ ID NO: 595674 - RNA, 18 nt, Homo sapiens
cucauuccccaaccacuu

SEQ ID NO: 595675 - RNA, 19 nt, Homo sapiens
cucauuccuucccagagau

SEQ ID NO: 595676 - RNA, 17 nt, Homo sapiens
cucauucugaggccuga

SEQ ID NO: 595677 - RNA, 18 nt, Homo sapiens
cucauugacaagaacuga

SEQ ID NO: 595678 - RNA, 21 nt, Homo sapiens
cucauuggacccuuccauggu

SEQ ID NO: 595679 - RNA, 15 nt, Homo sapiens
cucauuuaagggaaa

SEQ ID NO: 595680 - RNA, 22 nt, Homo sapiens
cucauuucaaauuugugcagug

SEQ ID NO: 595681 - RNA, 22 nt, Homo sapiens
cucauuucuggaaagugcaauu

SEQ ID NO: 595682 - RNA, 19 nt, Homo sapiens
cucauuugagauaaaguca

SEQ ID NO: 595683 - RNA, 23 nt, Homo sapiens
cucauuuguuuuucucacuccuu

SEQ ID NO: 595684 - RNA, 16 nt, Homo sapiens
cucauuuuacacaaag

SEQ ID NO: 595685 - RNA, 14 nt, Homo sapiens
cucauuuugcaauu

SEQ ID NO: 595686 - RNA, 14 nt, Homo sapiens
cuccaaaagcacuu

SEQ ID NO: 595687 - RNA, 15 nt, Homo sapiens
cuccaaaagcacuua

SEQ ID NO: 595688 - RNA, 14 nt, Homo sapiens
cuccaaaaggcccu

SEQ ID NO: 595689 - RNA, 19 nt, Homo sapiens
cuccaaaaggcccuuuuca

SEQ ID NO: 595690 - RNA, 20 nt, Homo sapiens
cuccaaaaggcccuuuucag

SEQ ID NO: 595691 - RNA, 17 nt, Homo sapiens
cuccaaaccuccagccu

SEQ ID NO: 595692 - RNA, 16 nt, Homo sapiens
cuccaaaccugaaguu

SEQ ID NO: 595693 - RNA, 15 nt, Homo sapiens
cuccaaauccaagga

SEQ ID NO: 595694 - RNA, 13 nt, Homo sapiens
cuccaaaugagau

SEQ ID NO: 595695 - RNA, 20 nt, Homo sapiens
cuccaaauuacagcccagga

SEQ ID NO: 595696 - RNA, 18 nt, Homo sapiens
cuccaaauuuuuuuuacu

SEQ ID NO: 595697 - RNA, 13 nt, Homo sapiens
cuccaacuggauu

SEQ ID NO: 595698 - RNA, 21 nt, Homo sapiens
cuccaagaggcugaggacuuu

SEQ ID NO: 595699 - RNA, 18 nt, Homo sapiens
cuccaagcucacgaccuu

SEQ ID NO: 595700 - RNA, 18 nt, Homo sapiens
cuccaaggaccucucuca

SEQ ID NO: 595701 - RNA, 22 nt, Homo sapiens
cuccaaggauccucuccacucc

SEQ ID NO: 595702 - RNA, 15 nt, Homo sapiens
cuccaagggacaggu

SEQ ID NO: 595703 - RNA, 23 nt, Homo sapiens
cuccaaggguuucgacuggucca

SEQ ID NO: 595704 - RNA, 17 nt, Homo sapiens
cuccaaucuugagauug

SEQ ID NO: 595705 - RNA, 19 nt, Homo sapiens
cuccaaugucugcugagga

SEQ ID NO: 595706 - RNA, 17 nt, Homo sapiens
cuccaauuggugcuuca

SEQ ID NO: 595707 - RNA, 18 nt, Homo sapiens
cuccaauuucaagaguga

SEQ ID NO: 595708 - RNA, 19 nt, Homo sapiens
cuccacaaagcaaaggcag

SEQ ID NO: 595709 - RNA, 20 nt, Homo sapiens
cuccacaaaugggaaaacca

SEQ ID NO: 595710 - RNA, 15 nt, Homo sapiens
cuccacaccucuaaa

SEQ ID NO: 595711 - RNA, 16 nt, Homo sapiens
cuccacauaaguccau

SEQ ID NO: 595712 - RNA, 15 nt, Homo sapiens
cuccacaugcuggug

SEQ ID NO: 595713 - RNA, 12 nt, Homo sapiens
cuccacauguuc

SEQ ID NO: 595714 - RNA, 20 nt, Homo sapiens
cuccacauguucaacuauua

SEQ ID NO: 595715 - RNA, 14 nt, Homo sapiens
cuccaccccacaga

SEQ ID NO: 595716 - RNA, 21 nt, Homo sapiens
cuccaccccauuuuacagagg

SEQ ID NO: 595717 - RNA, 12 nt, Homo sapiens
cuccacccuaua

SEQ ID NO: 595718 - RNA, 22 nt, Homo sapiens
cuccaccgaccaacugcccuaa

SEQ ID NO: 595719 - RNA, 17 nt, Homo sapiens
cuccaccuagacuguaa

SEQ ID NO: 595720 - RNA, 18 nt, Homo sapiens
cuccaccuagacuguaaa

SEQ ID NO: 595721 - RNA, 21 nt, Homo sapiens
cuccaccucugguggcuccuc

SEQ ID NO: 595722 - RNA, 21 nt, Homo sapiens
cuccacgugauuuccagugag

SEQ ID NO: 595723 - RNA, 13 nt, Homo sapiens
cuccacucagguu

SEQ ID NO: 595724 - RNA, 14 nt, Homo sapiens
cuccacucuucucu

SEQ ID NO: 595725 - RNA, 20 nt, Homo sapiens
cuccacugaaagaaguggga

SEQ ID NO: 595726 - RNA, 19 nt, Homo sapiens
cuccacugcgcuuacuccu

SEQ ID NO: 595727 - RNA, 13 nt, Homo sapiens
cuccacugucacc

SEQ ID NO: 595728 - RNA, 16 nt, Homo sapiens
cuccagaaacuuucca

SEQ ID NO: 595729 - RNA, 20 nt, Homo sapiens
cuccagaauuuggaaauccu

SEQ ID NO: 595730 - RNA, 22 nt, Homo sapiens
cuccagacacaccugaacacau

SEQ ID NO: 595731 - RNA, 14 nt, Homo sapiens
cuccagacauacaa

SEQ ID NO: 595732 - RNA, 17 nt, Homo sapiens
cuccagaccauucagga

SEQ ID NO: 595733 - RNA, 19 nt, Homo sapiens
cuccagaccccaugccuua

SEQ ID NO: 595734 - RNA, 16 nt, Homo sapiens
cuccagacucacuugc

SEQ ID NO: 595735 - RNA, 22 nt, Homo sapiens
cuccagacuugggaaacuauuc

SEQ ID NO: 595736 - RNA, 16 nt, Homo sapiens
cuccagagaaccuuua

SEQ ID NO: 595737 - RNA, 18 nt, Homo sapiens
cuccagaugcagggcagu

SEQ ID NO: 595738 - RNA, 19 nt, Homo sapiens
cuccagaugccacaaugga

SEQ ID NO: 595739 - RNA, 14 nt, Homo sapiens
cuccagcagggucu

SEQ ID NO: 595740 - RNA, 23 nt, Homo sapiens
cuccagccaccacccacaaucac

SEQ ID NO: 595741 - RNA, 14 nt, Homo sapiens
cuccagccaucuca

SEQ ID NO: 595742 - RNA, 17 nt, Homo sapiens
cuccagcucuggcuucc

SEQ ID NO: 595743 - RNA, 16 nt, Homo sapiens
cuccagcugauccaga

SEQ ID NO: 595744 - RNA, 20 nt, Homo sapiens
cuccagcugggcucugcaau

SEQ ID NO: 595745 - RNA, 22 nt, Homo sapiens
cuccagcuguacuagugccauu

SEQ ID NO: 595746 - RNA, 23 nt, Homo sapiens
cuccaggaagaaagaauguuacu

SEQ ID NO: 595747 - RNA, 16 nt, Homo sapiens
cuccaggaauacugaa

SEQ ID NO: 595748 - RNA, 14 nt, Homo sapiens
cuccaggaaugccu

SEQ ID NO: 595749 - RNA, 21 nt, Homo sapiens
cuccaggaugaguuacuugaa

SEQ ID NO: 595750 - RNA, 22 nt, Homo sapiens
cuccaggaugaguuacuugaaa

SEQ ID NO: 595751 - RNA, 19 nt, Homo sapiens
cuccaggauugaagagcau

SEQ ID NO: 595752 - RNA, 13 nt, Homo sapiens
cuccaggcaaaau

SEQ ID NO: 595753 - RNA, 18 nt, Homo sapiens
cuccaggcccaaggcucc

SEQ ID NO: 595754 - RNA, 22 nt, Homo sapiens
cuccagggaaaaugacuuuauu

SEQ ID NO: 595755 - RNA, 21 nt, Homo sapiens
cuccaggguggcagcaacaau

SEQ ID NO: 595756 - RNA, 21 nt, Homo sapiens
cuccaguguaucucaaaagac

SEQ ID NO: 595757 - RNA, 21 nt, Homo sapiens
cuccaguuagaaugcaccaug

SEQ ID NO: 595758 - RNA, 20 nt, Homo sapiens
cuccaguuuauagaccagaa

SEQ ID NO: 595759 - RNA, 17 nt, Homo sapiens
cuccaguuugcauuugg

SEQ ID NO: 595760 - RNA, 18 nt, Homo sapiens
cuccauaaaguacaaaug

SEQ ID NO: 595761 - RNA, 18 nt, Homo sapiens
cuccauacauaacuugau

SEQ ID NO: 595762 - RNA, 14 nt, Homo sapiens
cuccauaccugccc

SEQ ID NO: 595763 - RNA, 21 nt, Homo sapiens
cuccauaugcuguacaugaca

SEQ ID NO: 595764 - RNA, 23 nt, Homo sapiens
cuccaucaccugaaacacuggac

SEQ ID NO: 595765 - RNA, 20 nt, Homo sapiens
cuccauccugaaagccaaga

SEQ ID NO: 595766 - RNA, 15 nt, Homo sapiens
cuccaucucaaaaag

SEQ ID NO: 595767 - RNA, 20 nt, Homo sapiens
cuccaucuuucuacagagau

SEQ ID NO: 595768 - RNA, 15 nt, Homo sapiens
cuccaugagguacug

SEQ ID NO: 595769 - RNA, 21 nt, Homo sapiens
cuccaugcuccucaccugucu

SEQ ID NO: 595770 - RNA, 14 nt, Homo sapiens
cuccaugcugcaaa

SEQ ID NO: 595771 - RNA, 21 nt, Homo sapiens
cuccauguagaagccacuauu

SEQ ID NO: 595772 - RNA, 20 nt, Homo sapiens
cuccauuaaagucugaauca

SEQ ID NO: 595773 - RNA, 19 nt, Homo sapiens
cuccauucugaccauuuca

SEQ ID NO: 595774 - RNA, 14 nt, Homo sapiens
cuccauuggaucuu

SEQ ID NO: 595775 - RNA, 18 nt, Homo sapiens
cuccauugucaugagucc

SEQ ID NO: 595776 - RNA, 20 nt, Homo sapiens
cuccauuuaccaguaacuua

SEQ ID NO: 595777 - RNA, 14 nt, Homo sapiens
cucccaaaacauuu

SEQ ID NO: 595778 - RNA, 20 nt, Homo sapiens
cucccaaaauacugggauua

SEQ ID NO: 595779 - RNA, 15 nt, Homo sapiens
cucccaaaugaaaac

SEQ ID NO: 595780 - RNA, 18 nt, Homo sapiens
cucccaaccaaccagcag

SEQ ID NO: 595781 - RNA, 14 nt, Homo sapiens
cucccaaccucaau

SEQ ID NO: 595782 - RNA, 19 nt, Homo sapiens
cucccaaggcucugagcaa

SEQ ID NO: 595783 - RNA, 20 nt, Homo sapiens
cucccaaguagcuaggacua

SEQ ID NO: 595784 - RNA, 19 nt, Homo sapiens
cucccaaguagcugggauu

SEQ ID NO: 595785 - RNA, 17 nt, Homo sapiens
cucccaauggauaaauc

SEQ ID NO: 595786 - RNA, 22 nt, Homo sapiens
cucccacaaccccccacacucc

SEQ ID NO: 595787 - RNA, 14 nt, Homo sapiens
cucccacacuuccc

SEQ ID NO: 595788 - RNA, 21 nt, Homo sapiens
cucccacagaccugcagugag

SEQ ID NO: 595789 - RNA, 17 nt, Homo sapiens
cucccacaucccacugg

SEQ ID NO: 595790 - RNA, 21 nt, Homo sapiens
cucccacaugaggccaucuca

SEQ ID NO: 595791 - RNA, 19 nt, Homo sapiens
cucccaccaccucaccagu

SEQ ID NO: 595792 - RNA, 22 nt, Homo sapiens
cucccaccccggccuccacucc

SEQ ID NO: 595793 - RNA, 16 nt, Homo sapiens
cucccagaaucccagc

SEQ ID NO: 595794 - RNA, 17 nt, Homo sapiens
cucccagauaaugugaa

SEQ ID NO: 595795 - RNA, 20 nt, Homo sapiens
cucccagcuaauugagacca

SEQ ID NO: 595796 - RNA, 13 nt, Homo sapiens
cucccagcuccuu

SEQ ID NO: 595797 - RNA, 14 nt, Homo sapiens
cucccagcuccuuu

SEQ ID NO: 595798 - RNA, 23 nt, Homo sapiens
cucccagcucuagacaacccugc

SEQ ID NO: 595799 - RNA, 22 nt, Homo sapiens
cucccaggcugcuggagugcag

SEQ ID NO: 595800 - RNA, 12 nt, Homo sapiens
cucccagggugg

SEQ ID NO: 595801 - RNA, 22 nt, Homo sapiens
cucccaggguggacuucagugu

SEQ ID NO: 595802 - RNA, 23 nt, Homo sapiens
cucccaggguggacuucagugug

SEQ ID NO: 595803 - RNA, 22 nt, Homo sapiens
cucccaguccaaauguccucca

SEQ ID NO: 595804 - RNA, 15 nt, Homo sapiens
cucccaguccaagac

SEQ ID NO: 595805 - RNA, 21 nt, Homo sapiens
cucccagucucugucguggag

SEQ ID NO: 595806 - RNA, 11 nt, Homo sapiens
cucccauuucc

SEQ ID NO: 595807 - RNA, 18 nt, Homo sapiens
cuccccaauaccuaauaa

SEQ ID NO: 595808 - RNA, 21 nt, Homo sapiens
cuccccacaccucccuacucc

SEQ ID NO: 595809 - RNA, 16 nt, Homo sapiens
cuccccacccaagaga

SEQ ID NO: 595810 - RNA, 19 nt, Homo sapiens
cuccccaccuggacacaca

SEQ ID NO: 595811 - RNA, 22 nt, Homo sapiens
cuccccacuccacccuguuagu

SEQ ID NO: 595812 - RNA, 20 nt, Homo sapiens
cuccccacucccccacccau

SEQ ID NO: 595813 - RNA, 20 nt, Homo sapiens
cuccccacuuguccgcuggg

SEQ ID NO: 595814 - RNA, 18 nt, Homo sapiens
cuccccagaaucaagcuu

SEQ ID NO: 595815 - RNA, 12 nt, Homo sapiens
cuccccauuugc

SEQ ID NO: 595816 - RNA, 15 nt, Homo sapiens
cucccccaaccaagg

SEQ ID NO: 595817 - RNA, 14 nt, Homo sapiens
cuccccccacugca

SEQ ID NO: 595818 - RNA, 15 nt, Homo sapiens
cuccccccagacccc

SEQ ID NO: 595819 - RNA, 19 nt, Homo sapiens
cucccccuccuccagggaa

SEQ ID NO: 595820 - RNA, 15 nt, Homo sapiens
cucccccuucuccca

SEQ ID NO: 595821 - RNA, 16 nt, Homo sapiens
cuccccgucccugucc

SEQ ID NO: 595822 - RNA, 20 nt, Homo sapiens
cuccccuagggggagaagaa

SEQ ID NO: 595823 - RNA, 13 nt, Homo sapiens
cuccccucagagc

SEQ ID NO: 595824 - RNA, 17 nt, Homo sapiens
cuccccucagauuccac

SEQ ID NO: 595825 - RNA, 16 nt, Homo sapiens
cuccccucucaccuca

SEQ ID NO: 595826 - RNA, 17 nt, Homo sapiens
cuccccuugucugcacu

SEQ ID NO: 595827 - RNA, 19 nt, Homo sapiens
cuccccuugucugcacugu

SEQ ID NO: 595828 - RNA, 16 nt, Homo sapiens
cuccccuuucacaggu

SEQ ID NO: 595829 - RNA, 17 nt, Homo sapiens
cucccuagccagaggcu

SEQ ID NO: 595830 - RNA, 15 nt, Homo sapiens
cucccucauuccacc

SEQ ID NO: 595831 - RNA, 15 nt, Homo sapiens
cucccuccccaaaug

SEQ ID NO: 595832 - RNA, 23 nt, Homo sapiens
cucccuccccagaaacagugugc

SEQ ID NO: 595833 - RNA, 14 nt, Homo sapiens
cucccucccuagcc

SEQ ID NO: 595834 - RNA, 15 nt, Homo sapiens
cucccucccuuucua

SEQ ID NO: 595835 - RNA, 18 nt, Homo sapiens
cucccucugcuacuccau

SEQ ID NO: 595836 - RNA, 21 nt, Homo sapiens
cucccugagccugcauucugc

SEQ ID NO: 595837 - RNA, 12 nt, Homo sapiens
cucccugagucu

SEQ ID NO: 595838 - RNA, 22 nt, Homo sapiens
cucccugcaagaaaucagccau

SEQ ID NO: 595839 - RNA, 15 nt, Homo sapiens
cucccugccaucccc

SEQ ID NO: 595840 - RNA, 16 nt, Homo sapiens
cucccugcuccucaug

SEQ ID NO: 595841 - RNA, 16 nt, Homo sapiens
cucccugcuugcacac

SEQ ID NO: 595842 - RNA, 21 nt, Homo sapiens
cucccuggccuguucuguuuu

SEQ ID NO: 595843 - RNA, 18 nt, Homo sapiens
cucccugggccaccuccu

SEQ ID NO: 595844 - RNA, 21 nt, Homo sapiens
cucccugggccaccuccuacc

SEQ ID NO: 595845 - RNA, 19 nt, Homo sapiens
cucccugguguaguguauu

SEQ ID NO: 595846 - RNA, 23 nt, Homo sapiens
cucccugguugccucucuugccc

SEQ ID NO: 595847 - RNA, 19 nt, Homo sapiens
cucccuucacagggguaca

SEQ ID NO: 595848 - RNA, 17 nt, Homo sapiens
cucccuuggguucugau

SEQ ID NO: 595849 - RNA, 15 nt, Homo sapiens
cucccuuuaguggag

SEQ ID NO: 595850 - RNA, 22 nt, Homo sapiens
cucccuuucagguuuacuaugu

SEQ ID NO: 595851 - RNA, 19 nt, Homo sapiens
cuccgcagaccugcuguga

SEQ ID NO: 595852 - RNA, 16 nt, Homo sapiens
cuccggccugaugaca

SEQ ID NO: 595853 - RNA, 18 nt, Homo sapiens
cuccgggcaaauggcuga

SEQ ID NO: 595854 - RNA, 19 nt, Homo sapiens
cuccggggucugugcugug

SEQ ID NO: 595855 - RNA, 23 nt, Homo sapiens
cuccgguuugggcugucuuacca

SEQ ID NO: 595856 - RNA, 17 nt, Homo sapiens
cuccgucauccaugccc

SEQ ID NO: 595857 - RNA, 22 nt, Homo sapiens
cuccguggccaaaaaguaccau

SEQ ID NO: 595858 - RNA, 23 nt, Homo sapiens
cuccgugucucgcgcgacugaga

SEQ ID NO: 595859 - RNA, 17 nt, Homo sapiens
cuccguguggacugugc

SEQ ID NO: 595860 - RNA, 22 nt, Homo sapiens
cuccuaagcaacuaggccuuca

SEQ ID NO: 595861 - RNA, 21 nt, Homo sapiens
cuccuacccuuccagugcccu

SEQ ID NO: 595862 - RNA, 20 nt, Homo sapiens
cuccuaccugcugcugcuau

SEQ ID NO: 595863 - RNA, 22 nt, Homo sapiens
cuccuaccuggggacuccucaa

SEQ ID NO: 595864 - RNA, 14 nt, Homo sapiens
cuccuacuuugaaa

SEQ ID NO: 595865 - RNA, 14 nt, Homo sapiens
cuccuagagugcag

SEQ ID NO: 595866 - RNA, 19 nt, Homo sapiens
cuccuagccccuucuucca

SEQ ID NO: 595867 - RNA, 18 nt, Homo sapiens
cuccuaggaaaccagcuc

SEQ ID NO: 595868 - RNA, 14 nt, Homo sapiens
cuccuauucaccca

SEQ ID NO: 595869 - RNA, 17 nt, Homo sapiens
cuccuauugaaagacca

SEQ ID NO: 595870 - RNA, 12 nt, Homo sapiens
cuccucaaaagc

SEQ ID NO: 595871 - RNA, 15 nt, Homo sapiens
cuccucaaaccacuu

SEQ ID NO: 595872 - RNA, 21 nt, Homo sapiens
cuccucacuggaggagcagcu

SEQ ID NO: 595873 - RNA, 20 nt, Homo sapiens
cuccucacuguauccagguu

SEQ ID NO: 595874 - RNA, 18 nt, Homo sapiens
cuccucagccucugcaac

SEQ ID NO: 595875 - RNA, 19 nt, Homo sapiens
cuccucauagugcugaaaa

SEQ ID NO: 595876 - RNA, 20 nt, Homo sapiens
cuccuccagggccacgugcc

SEQ ID NO: 595877 - RNA, 19 nt, Homo sapiens
cuccucccaggaacugggc

SEQ ID NO: 595878 - RNA, 18 nt, Homo sapiens
cuccucccuaaugcucac

SEQ ID NO: 595879 - RNA, 18 nt, Homo sapiens
cuccuccguguggacugu

SEQ ID NO: 595880 - RNA, 22 nt, Homo sapiens
cuccuccuacccuuccagugcc

SEQ ID NO: 595881 - RNA, 16 nt, Homo sapiens
cuccucguccauuuua

SEQ ID NO: 595882 - RNA, 19 nt, Homo sapiens
cuccucuacaauuugccau

SEQ ID NO: 595883 - RNA, 21 nt, Homo sapiens
cuccucuaguaagaugcacug

SEQ ID NO: 595884 - RNA, 14 nt, Homo sapiens
cuccucucaucccc

SEQ ID NO: 595885 - RNA, 19 nt, Homo sapiens
cuccucucuagaaccuccu

SEQ ID NO: 595886 - RNA, 22 nt, Homo sapiens
cuccucuguccaggcacugcug

SEQ ID NO: 595887 - RNA, 22 nt, Homo sapiens
cuccucuucagaggagaaagaa

SEQ ID NO: 595888 - RNA, 12 nt, Homo sapiens
cuccucuugacu

SEQ ID NO: 595889 - RNA, 20 nt, Homo sapiens
cuccugaaccgcacagcuca

SEQ ID NO: 595890 - RNA, 22 nt, Homo sapiens
cuccugaagggaaggcaaaggc

SEQ ID NO: 595891 - RNA, 14 nt, Homo sapiens
cuccugaauucagu

SEQ ID NO: 595892 - RNA, 13 nt, Homo sapiens
cuccugacuuuua

SEQ ID NO: 595893 - RNA, 20 nt, Homo sapiens
cuccugaguagcugggauua

SEQ ID NO: 595894 - RNA, 14 nt, Homo sapiens
cuccugauccacuu

SEQ ID NO: 595895 - RNA, 21 nt, Homo sapiens
cuccugcacacagggcagucc

SEQ ID NO: 595896 - RNA, 21 nt, Homo sapiens
cuccugccucccaauaccagc

SEQ ID NO: 595897 - RNA, 14 nt, Homo sapiens
cuccugcugaucca

SEQ ID NO: 595898 - RNA, 12 nt, Homo sapiens
cuccugcugcag

SEQ ID NO: 595899 - RNA, 15 nt, Homo sapiens
cuccugcugcuccug

SEQ ID NO: 595900 - RNA, 22 nt, Homo sapiens
cuccugcugggcgugugugaca

SEQ ID NO: 595901 - RNA, 19 nt, Homo sapiens
cuccuggaagcgagcuuug

SEQ ID NO: 595902 - RNA, 19 nt, Homo sapiens
cuccuggagaaagacuucc

SEQ ID NO: 595903 - RNA, 17 nt, Homo sapiens
cuccuggaucuaugugu

SEQ ID NO: 595904 - RNA, 19 nt, Homo sapiens
cuccuggccucaagcaauc

SEQ ID NO: 595905 - RNA, 16 nt, Homo sapiens
cuccugggcucaagug

SEQ ID NO: 595906 - RNA, 19 nt, Homo sapiens
cuccuggguucaagcaauc

SEQ ID NO: 595907 - RNA, 20 nt, Homo sapiens
cuccuggguucaagugauuc

SEQ ID NO: 595908 - RNA, 14 nt, Homo sapiens
cuccuggucuguga

SEQ ID NO: 595909 - RNA, 23 nt, Homo sapiens
cuccugguguggguaaagggaca

SEQ ID NO: 595910 - RNA, 21 nt, Homo sapiens
cuccuguauuuaacaaaaagu

SEQ ID NO: 595911 - RNA, 19 nt, Homo sapiens
cuccugucccuugaccuua

SEQ ID NO: 595912 - RNA, 15 nt, Homo sapiens
cuccugucugcccua

SEQ ID NO: 595913 - RNA, 14 nt, Homo sapiens
cuccugugcaacuu

SEQ ID NO: 595914 - RNA, 17 nt, Homo sapiens
cuccugugugcuuguca

SEQ ID NO: 595915 - RNA, 20 nt, Homo sapiens
cuccuguucacaccagagaa

SEQ ID NO: 595916 - RNA, 22 nt, Homo sapiens
cuccuguuuguugagugcacug

SEQ ID NO: 595917 - RNA, 23 nt, Homo sapiens
cuccuuacccugccccagcuggg

SEQ ID NO: 595918 - RNA, 22 nt, Homo sapiens
cuccuuacgcuuugucacacaa

SEQ ID NO: 595919 - RNA, 16 nt, Homo sapiens
cuccuuagagacauca

SEQ ID NO: 595920 - RNA, 17 nt, Homo sapiens
cuccuuaucaaaggaca

SEQ ID NO: 595921 - RNA, 20 nt, Homo sapiens
cuccuucagcagcuacugac

SEQ ID NO: 595922 - RNA, 13 nt, Homo sapiens
cuccuucauuuca

SEQ ID NO: 595923 - RNA, 19 nt, Homo sapiens
cuccuuccacauguacaua

SEQ ID NO: 595924 - RNA, 16 nt, Homo sapiens
cuccuuccaccucccu

SEQ ID NO: 595925 - RNA, 21 nt, Homo sapiens
cuccuucccagggaccagcac

SEQ ID NO: 595926 - RNA, 15 nt, Homo sapiens
cuccuucccauuucu

SEQ ID NO: 595927 - RNA, 13 nt, Homo sapiens
cuccuucccgccg

SEQ ID NO: 595928 - RNA, 18 nt, Homo sapiens
cuccuucccuucuuugcu

SEQ ID NO: 595929 - RNA, 17 nt, Homo sapiens
cuccuucuccuagcucu

SEQ ID NO: 595930 - RNA, 13 nt, Homo sapiens
cuccuugaagcaa

SEQ ID NO: 595931 - RNA, 20 nt, Homo sapiens
cuccuugaauaucuuucgau

SEQ ID NO: 595932 - RNA, 20 nt, Homo sapiens
cuccuugacucaauugaucc

SEQ ID NO: 595933 - RNA, 18 nt, Homo sapiens
cuccuugcccucaagcaa

SEQ ID NO: 595934 - RNA, 12 nt, Homo sapiens
cuccuugcugca

SEQ ID NO: 595935 - RNA, 15 nt, Homo sapiens
cuccuuggccacaga

SEQ ID NO: 595936 - RNA, 20 nt, Homo sapiens
cuccuuggcugucugugggc

SEQ ID NO: 595937 - RNA, 14 nt, Homo sapiens
cuccuugguauuuc

SEQ ID NO: 595938 - RNA, 18 nt, Homo sapiens
cuccuugucuuaaucguc

SEQ ID NO: 595939 - RNA, 16 nt, Homo sapiens
cuccuuuaauuaaugg

SEQ ID NO: 595940 - RNA, 15 nt, Homo sapiens
cuccuuuaguuucag

SEQ ID NO: 595941 - RNA, 15 nt, Homo sapiens
cuccuuucaugcucc

SEQ ID NO: 595942 - RNA, 16 nt, Homo sapiens
cuccuuugcaccugau

SEQ ID NO: 595943 - RNA, 22 nt, Homo sapiens
cuccuuugcuaaugcuaugcaa

SEQ ID NO: 595944 - RNA, 17 nt, Homo sapiens
cuccuuuuccacuuuaa

SEQ ID NO: 595945 - RNA, 14 nt, Homo sapiens
cuccuuuugaccaa

SEQ ID NO: 595946 - RNA, 15 nt, Homo sapiens
cuccuuuugaccaaa

SEQ ID NO: 595947 - RNA, 17 nt, Homo sapiens
cuccuuuugaccaaaua

SEQ ID NO: 595948 - RNA, 19 nt, Homo sapiens
cuccuuuugcuugaaacca

SEQ ID NO: 595949 - RNA, 17 nt, Homo sapiens
cucgacauuuggugaga

SEQ ID NO: 595950 - RNA, 14 nt, Homo sapiens
cucgagauguaucc

SEQ ID NO: 595951 - RNA, 15 nt, Homo sapiens
cucgaucauauuucc

SEQ ID NO: 595952 - RNA, 15 nt, Homo sapiens
cucgaugacugugaa

SEQ ID NO: 595953 - RNA, 19 nt, Homo sapiens
cucgcaacccugccuguca

SEQ ID NO: 595954 - RNA, 14 nt, Homo sapiens
cucgcacucuggug

SEQ ID NO: 595955 - RNA, 21 nt, Homo sapiens
cucgcaguacauguuacuugu

SEQ ID NO: 595956 - RNA, 13 nt, Homo sapiens
cucgcaugacugu

SEQ ID NO: 595957 - RNA, 17 nt, Homo sapiens
cucgccggaucugaggg

SEQ ID NO: 595958 - RNA, 23 nt, Homo sapiens
cucgcgauucaggacguccuucc

SEQ ID NO: 595959 - RNA, 19 nt, Homo sapiens
cucgcucgaugacugugaa

SEQ ID NO: 595960 - RNA, 18 nt, Homo sapiens
cucgcugccaucaccgcu

SEQ ID NO: 595961 - RNA, 15 nt, Homo sapiens
cucggauacuugcca

SEQ ID NO: 595962 - RNA, 12 nt, Homo sapiens
cucggaugacac

SEQ ID NO: 595963 - RNA, 22 nt, Homo sapiens
ugucugggugaccucacuuuag

SEQ ID NO: 595964 - RNA, 15 nt, Homo sapiens
ugucuggugguggca

SEQ ID NO: 595965 - RNA, 17 nt, Homo sapiens
ugucugguucacaguuu

SEQ ID NO: 595966 - RNA, 19 nt, Homo sapiens
ugucuguaaaagagccuag

SEQ ID NO: 595967 - RNA, 21 nt, Homo sapiens
ugucuguaauaauagacugua

SEQ ID NO: 595968 - RNA, 22 nt, Homo sapiens
ugucuguaucggagacagugau

SEQ ID NO: 595969 - RNA, 15 nt, Homo sapiens
ugucugucaccagcu

SEQ ID NO: 595970 - RNA, 20 nt, Homo sapiens
ugucuguccugauuucuaca

SEQ ID NO: 595971 - RNA, 16 nt, Homo sapiens
ugucuguccuuuauga

SEQ ID NO: 595972 - RNA, 14 nt, Homo sapiens
ugucuguucacuuu

SEQ ID NO: 595973 - RNA, 21 nt, Homo sapiens
ugucuguuucaaugaccugua

SEQ ID NO: 595974 - RNA, 19 nt, Homo sapiens
ugucuguuuguuucaagaa

SEQ ID NO: 595975 - RNA, 22 nt, Homo sapiens
ugucuuaaugguauccuacuga

SEQ ID NO: 595976 - RNA, 23 nt, Homo sapiens
ugucuuacagagaaaagacauaa

SEQ ID NO: 595977 - RNA, 22 nt, Homo sapiens
ugucuuacuauuauagcaacuu

SEQ ID NO: 595978 - RNA, 18 nt, Homo sapiens
ugucuuauggucuugauc

SEQ ID NO: 595979 - RNA, 16 nt, Homo sapiens
ugucuucaaacuguga

SEQ ID NO: 595980 - RNA, 14 nt, Homo sapiens
ugucuucaauguca

SEQ ID NO: 595981 - RNA, 22 nt, Homo sapiens
ugucuucagcuguacauacuca

SEQ ID NO: 595982 - RNA, 18 nt, Homo sapiens
ugucuucauagcagauuu

SEQ ID NO: 595983 - RNA, 19 nt, Homo sapiens
ugucuuccacuuugcauau

SEQ ID NO: 595984 - RNA, 22 nt, Homo sapiens
ugucuucccaaacccagucucc

SEQ ID NO: 595985 - RNA, 23 nt, Homo sapiens
ugucuugaguagacuuggaccca

SEQ ID NO: 595986 - RNA, 16 nt, Homo sapiens
ugucuuggacucuagu

SEQ ID NO: 595987 - RNA, 22 nt, Homo sapiens
ugucuugggaauuuucuuccaa

SEQ ID NO: 595988 - RNA, 20 nt, Homo sapiens
ugucuugugcauaauucuuc

SEQ ID NO: 595989 - RNA, 22 nt, Homo sapiens
ugucuuguucauuuugaguauu

SEQ ID NO: 595990 - RNA, 23 nt, Homo sapiens
ugucuuguugcggauggauggaa

SEQ ID NO: 595991 - RNA, 20 nt, Homo sapiens
ugucuuuacuaaacagauuu

SEQ ID NO: 595992 - RNA, 17 nt, Homo sapiens
ugucuuuauucuuauua

SEQ ID NO: 595993 - RNA, 19 nt, Homo sapiens
ugucuuuccagaaggucac

SEQ ID NO: 595994 - RNA, 13 nt, Homo sapiens
ugucuuuugccau

SEQ ID NO: 595995 - RNA, 17 nt, Homo sapiens
ugugaaacaguugcugu

SEQ ID NO: 595996 - RNA, 18 nt, Homo sapiens
ugugaaacucuacccuga

SEQ ID NO: 595997 - RNA, 23 nt, Homo sapiens
ugugaaacuggauuaaacuuaau

SEQ ID NO: 595998 - RNA, 15 nt, Homo sapiens
ugugaaacuuucauu

SEQ ID NO: 595999 - RNA, 16 nt, Homo sapiens
ugugaaagaaccaaaa

SEQ ID NO: 596000 - RNA, 17 nt, Homo sapiens
ugugaaauaauuccucu

SEQ ID NO: 596001 - RNA, 19 nt, Homo sapiens
ugugaaauaccaaccugaa

SEQ ID NO: 596002 - RNA, 16 nt, Homo sapiens
ugugaaauaucaucac

SEQ ID NO: 596003 - RNA, 24 nt, Homo sapiens
ugugaaaucucagauacuuaugaa

SEQ ID NO: 596004 - RNA, 17 nt, Homo sapiens
ugugaaaugcuuuuaua

SEQ ID NO: 596005 - RNA, 21 nt, Homo sapiens
ugugaaaugcuuuuauauucu

SEQ ID NO: 596006 - RNA, 15 nt, Homo sapiens
ugugaacaucccuua

SEQ ID NO: 596007 - RNA, 16 nt, Homo sapiens
ugugaacaucccuuau

SEQ ID NO: 596008 - RNA, 23 nt, Homo sapiens
ugugaaccgaggggcucaggaaa

SEQ ID NO: 596009 - RNA, 16 nt, Homo sapiens
ugugaagcaaacucua

SEQ ID NO: 596010 - RNA, 18 nt, Homo sapiens
ugugaagcaccuacuaug

SEQ ID NO: 596011 - RNA, 18 nt, Homo sapiens
ugugaaguuuaauugacu

SEQ ID NO: 596012 - RNA, 19 nt, Homo sapiens
ugugaaguuugcuuuguac

SEQ ID NO: 596013 - RNA, 16 nt, Homo sapiens
ugugaauaaaaacccu

SEQ ID NO: 596014 - RNA, 20 nt, Homo sapiens
ugugaauaaaaacccuguau

SEQ ID NO: 596015 - RNA, 13 nt, Homo sapiens
ugugaauauuccu

SEQ ID NO: 596016 - RNA, 15 nt, Homo sapiens
ugugaaucaauccug

SEQ ID NO: 596017 - RNA, 22 nt, Homo sapiens
ugugaaucucuucucccuuuga

SEQ ID NO: 596018 - RNA, 21 nt, Homo sapiens
ugugaaucugaaagacuugaa

SEQ ID NO: 596019 - RNA, 23 nt, Homo sapiens
ugugaaugaugauccuaggcauu

SEQ ID NO: 596020 - RNA, 17 nt, Homo sapiens
ugugaauguggauucuu

SEQ ID NO: 596021 - RNA, 20 nt, Homo sapiens
ugugacaaucugccuuucac

SEQ ID NO: 596022 - RNA, 22 nt, Homo sapiens
ugugacauacauauuaucucau

SEQ ID NO: 596023 - RNA, 15 nt, Homo sapiens
uguuagcacuguuga

SEQ ID NO: 596024 - RNA, 16 nt, Homo sapiens
uguuagcccaagguua

SEQ ID NO: 596025 - RNA, 17 nt, Homo sapiens
uguuagugguuacccag

SEQ ID NO: 596026 - RNA, 15 nt, Homo sapiens
uguuauaucagggaa

SEQ ID NO: 596027 - RNA, 15 nt, Homo sapiens
uguuaucagucaaua

SEQ ID NO: 596028 - RNA, 15 nt, Homo sapiens
uguuaugacagugaa

SEQ ID NO: 596029 - RNA, 12 nt, Homo sapiens
uguuauugcaug

SEQ ID NO: 596030 - RNA, 21 nt, Homo sapiens
uguuauugccucuacuuugau

SEQ ID NO: 596031 - RNA, 22 nt, Homo sapiens
uguuauuuaaugagucagucaa

SEQ ID NO: 596032 - RNA, 15 nt, Homo sapiens
uguuauuuagacuca

SEQ ID NO: 596033 - RNA, 18 nt, Homo sapiens
uguucaaacccagucuug

SEQ ID NO: 596034 - RNA, 12 nt, Homo sapiens
uguucaaaugua

SEQ ID NO: 596035 - RNA, 22 nt, Homo sapiens
uguucaacuauuaauggaucau

SEQ ID NO: 596036 - RNA, 14 nt, Homo sapiens
uguucaaggcagug

SEQ ID NO: 596037 - RNA, 22 nt, Homo sapiens
uguucaauggaugaauuucuaa

SEQ ID NO: 596038 - RNA, 18 nt, Homo sapiens
uguucacaaacuaccucu

SEQ ID NO: 596039 - RNA, 13 nt, Homo sapiens
uguucacacugca

SEQ ID NO: 596040 - RNA, 17 nt, Homo sapiens
uguucacugcuccuugc

SEQ ID NO: 596041 - RNA, 12 nt, Homo sapiens
uguucacuuuau

SEQ ID NO: 596042 - RNA, 18 nt, Homo sapiens
uguucagagaggccuuuu

SEQ ID NO: 596043 - RNA, 23 nt, Homo sapiens
uguucagaggcagcaccaccaca

SEQ ID NO: 596044 - RNA, 15 nt, Homo sapiens
uguucagaugugcau

SEQ ID NO: 596045 - RNA, 17 nt, Homo sapiens
uguucagugucccgggc

SEQ ID NO: 596046 - RNA, 17 nt, Homo sapiens
uguucauccuaacauga

SEQ ID NO: 596047 - RNA, 19 nt, Homo sapiens
uguucauccuaacaugaca

SEQ ID NO: 596048 - RNA, 11 nt, Homo sapiens
uguucaucucu

SEQ ID NO: 596049 - RNA, 12 nt, Homo sapiens
uguucauuucac

SEQ ID NO: 596050 - RNA, 21 nt, Homo sapiens
uguuccacggaaaaugcuauc

SEQ ID NO: 596051 - RNA, 20 nt, Homo sapiens
uguuccacugcaaauaaagc

SEQ ID NO: 596052 - RNA, 15 nt, Homo sapiens
uguuccagacauucu

SEQ ID NO: 596053 - RNA, 14 nt, Homo sapiens
uguuccagacucag

SEQ ID NO: 596054 - RNA, 17 nt, Homo sapiens
uguuccagugucuauaa

SEQ ID NO: 596055 - RNA, 15 nt, Homo sapiens
uguucccaaauuuuc

SEQ ID NO: 596056 - RNA, 14 nt, Homo sapiens
uguuccccacugac

SEQ ID NO: 596057 - RNA, 15 nt, Homo sapiens
uguuccccucaccca

SEQ ID NO: 596058 - RNA, 21 nt, Homo sapiens
uguucccuaggggacacuucc

SEQ ID NO: 596059 - RNA, 22 nt, Homo sapiens
uguucccuccagcagugguauu

SEQ ID NO: 596060 - RNA, 14 nt, Homo sapiens
uguucccucuggcu

SEQ ID NO: 596061 - RNA, 20 nt, Homo sapiens
uguuccucaagguccauuau

SEQ ID NO: 596062 - RNA, 16 nt, Homo sapiens
uguucgacuaccuuuu

SEQ ID NO: 596063 - RNA, 17 nt, Homo sapiens
uguucgcucgugcagua

SEQ ID NO: 596064 - RNA, 22 nt, Homo sapiens
uguucuaagucuuuccauugga

SEQ ID NO: 596065 - RNA, 14 nt, Homo sapiens
uguucuacugagaa

SEQ ID NO: 596066 - RNA, 22 nt, Homo sapiens
uguucuaguaacaauacaugag

SEQ ID NO: 596067 - RNA, 14 nt, Homo sapiens
uguucuauugcuga

SEQ ID NO: 596068 - RNA, 18 nt, Homo sapiens
uguucucagaaucccuua

SEQ ID NO: 596069 - RNA, 17 nt, Homo sapiens
uguucucgcaaaaacgu

SEQ ID NO: 596070 - RNA, 21 nt, Homo sapiens
uguucucuaggccuucaggac

SEQ ID NO: 596071 - RNA, 16 nt, Homo sapiens
uguucugcacacagca

SEQ ID NO: 596072 - RNA, 19 nt, Homo sapiens
uguucugccuggagacaag

SEQ ID NO: 596073 - RNA, 16 nt, Homo sapiens
uguucuggaagccaua

SEQ ID NO: 596074 - RNA, 19 nt, Homo sapiens
uguucugggggacagagaa

SEQ ID NO: 596075 - RNA, 12 nt, Homo sapiens
uguucuguacaa

SEQ ID NO: 596076 - RNA, 20 nt, Homo sapiens
uguucuugcugagcacccuc

SEQ ID NO: 596077 - RNA, 15 nt, Homo sapiens
uguucuuuugcaaua

SEQ ID NO: 596078 - RNA, 15 nt, Homo sapiens
uguugaaacuuugaa

SEQ ID NO: 596079 - RNA, 21 nt, Homo sapiens
uguugaaagcugaaaagcaua

SEQ ID NO: 596080 - RNA, 15 nt, Homo sapiens
uguugaagcacuguu

SEQ ID NO: 596081 - RNA, 23 nt, Homo sapiens
uguugaccaucacugccaucaca

SEQ ID NO: 596082 - RNA, 19 nt, Homo sapiens
uguugaccuuccuucaaga

SEQ ID NO: 596083 - RNA, 13 nt, Homo sapiens
uguugacugugau

SEQ ID NO: 596084 - RNA, 14 nt, Homo sapiens
uguugacugugauu

SEQ ID NO: 596085 - RNA, 21 nt, Homo sapiens
uguugagccaggccugggucu

SEQ ID NO: 596086 - RNA, 20 nt, Homo sapiens
uguugauaaauuccacugga

SEQ ID NO: 596087 - RNA, 16 nt, Homo sapiens
uguugaucagcaaauu

SEQ ID NO: 596088 - RNA, 15 nt, Homo sapiens
cuugugaauuauucu

SEQ ID NO: 596089 - RNA, 18 nt, Homo sapiens
cuugugaauuauucugau

SEQ ID NO: 596090 - RNA, 14 nt, Homo sapiens
cuugugaggcuucc

SEQ ID NO: 596091 - RNA, 23 nt, Homo sapiens
cuuguggagagcuuauacagagc

SEQ ID NO: 596092 - RNA, 15 nt, Homo sapiens
cuuguggcacuccaa

SEQ ID NO: 596093 - RNA, 17 nt, Homo sapiens
cuuguggcuugggacau

SEQ ID NO: 596094 - RNA, 16 nt, Homo sapiens
cuugugggagacagca

SEQ ID NO: 596095 - RNA, 18 nt, Homo sapiens
cuuguggguccaugcuaa

SEQ ID NO: 596096 - RNA, 15 nt, Homo sapiens
cuugugucccaugau

SEQ ID NO: 596097 - RNA, 15 nt, Homo sapiens
cuuguguccugauga

SEQ ID NO: 596098 - RNA, 22 nt, Homo sapiens
cuugugucugcggggaucagag

SEQ ID NO: 596099 - RNA, 19 nt, Homo sapiens
cuugugucuuuggugggga

SEQ ID NO: 596100 - RNA, 13 nt, Homo sapiens
cuugugugugaug

SEQ ID NO: 596101 - RNA, 19 nt, Homo sapiens
cuugugugugggcugugag

SEQ ID NO: 596102 - RNA, 23 nt, Homo sapiens
cuuguguguguguguugauccca

SEQ ID NO: 596103 - RNA, 15 nt, Homo sapiens
cuuguguguuuugag

SEQ ID NO: 596104 - RNA, 16 nt, Homo sapiens
cuuguguuacuugcca

SEQ ID NO: 596105 - RNA, 13 nt, Homo sapiens
cuuguuagauuca

SEQ ID NO: 596106 - RNA, 20 nt, Homo sapiens
cuuguuauugccucuacuuu

SEQ ID NO: 596107 - RNA, 20 nt, Homo sapiens
cuuguucaauaauuacugua

SEQ ID NO: 596108 - RNA, 16 nt, Homo sapiens
cuuguuccccacugac

SEQ ID NO: 596109 - RNA, 16 nt, Homo sapiens
cuuguucuacugagaa

SEQ ID NO: 596110 - RNA, 19 nt, Homo sapiens
cuuguucugagauucaaua

SEQ ID NO: 596111 - RNA, 12 nt, Homo sapiens
cuuguugcacug

SEQ ID NO: 596112 - RNA, 12 nt, Homo sapiens
cuuguugcugca

SEQ ID NO: 596113 - RNA, 12 nt, Homo sapiens
cuuguuggccau

SEQ ID NO: 596114 - RNA, 23 nt, Homo sapiens
cuuguuggugacaccucaccuca

SEQ ID NO: 596115 - RNA, 21 nt, Homo sapiens
cuuguuguaccgaaucaacug

SEQ ID NO: 596116 - RNA, 16 nt, Homo sapiens
cuuguuguuucuugcc

SEQ ID NO: 596117 - RNA, 16 nt, Homo sapiens
cuuguuuaacauauau

SEQ ID NO: 596118 - RNA, 14 nt, Homo sapiens
cuuguuuacagcac

SEQ ID NO: 596119 - RNA, 21 nt, Homo sapiens
cuuguuucaccuuccauguca

SEQ ID NO: 596120 - RNA, 20 nt, Homo sapiens
cuuguuugguaguuagccau

SEQ ID NO: 596121 - RNA, 18 nt, Homo sapiens
cuuguuuuacccuauaca

SEQ ID NO: 596122 - RNA, 20 nt, Homo sapiens
cuuguuuuauauaccuggcu

SEQ ID NO: 596123 - RNA, 15 nt, Homo sapiens
cuuguuuuccagucu

SEQ ID NO: 596124 - RNA, 21 nt, Homo sapiens
cuuuaaaaaagcaaauuucau

SEQ ID NO: 596125 - RNA, 23 nt, Homo sapiens
cuuuaaaauuuguccuacauucg

SEQ ID NO: 596126 - RNA, 16 nt, Homo sapiens
cuuuaaacaaauucau

SEQ ID NO: 596127 - RNA, 16 nt, Homo sapiens
cuuuaaaccacuaaaa

SEQ ID NO: 596128 - RNA, 13 nt, Homo sapiens
cuuuaaacucagg

SEQ ID NO: 596129 - RNA, 15 nt, Homo sapiens
cuuuaaaucaagucc

SEQ ID NO: 596130 - RNA, 19 nt, Homo sapiens
cuuuaaaucaccauagggc

SEQ ID NO: 596131 - RNA, 22 nt, Homo sapiens
cuuuaaaucacucuucuguaaa

SEQ ID NO: 596132 - RNA, 14 nt, Homo sapiens
cuuuaaaucuguga

SEQ ID NO: 596133 - RNA, 16 nt, Homo sapiens
cuuuaaaucugugaug

SEQ ID NO: 596134 - RNA, 14 nt, Homo sapiens
cuuuaacagucaaa

SEQ ID NO: 596135 - RNA, 16 nt, Homo sapiens
cuuuaaccauggugcu

SEQ ID NO: 596136 - RNA, 14 nt, Homo sapiens
cuuuaacucaggag

SEQ ID NO: 596137 - RNA, 15 nt, Homo sapiens
cuuuaagcaacacag

SEQ ID NO: 596138 - RNA, 15 nt, Homo sapiens
cuuuaagccaaagaa

SEQ ID NO: 596139 - RNA, 14 nt, Homo sapiens
cuuuaagccugcau

SEQ ID NO: 596140 - RNA, 18 nt, Homo sapiens
cuuuaaguaaaaauccaa

SEQ ID NO: 596141 - RNA, 14 nt, Homo sapiens
cuuuaaguauacaa

SEQ ID NO: 596142 - RNA, 16 nt, Homo sapiens
cuuuaauaaaggccac

SEQ ID NO: 596143 - RNA, 18 nt, Homo sapiens
cuuuaauagaaguuuuau

SEQ ID NO: 596144 - RNA, 21 nt, Homo sapiens
cuuuaaucaugaaacaccuua

SEQ ID NO: 596145 - RNA, 12 nt, Homo sapiens
cuuuaaucugca

SEQ ID NO: 596146 - RNA, 19 nt, Homo sapiens
cuuuaaucuucaguuuuau

SEQ ID NO: 596147 - RNA, 20 nt, Homo sapiens
cuuuaaugauaugcuuguaa

SEQ ID NO: 596148 - RNA, 14 nt, Homo sapiens
cuuuaauguugccc

SEQ ID NO: 596149 - RNA, 12 nt, Homo sapiens
cuuuaauguugu

SEQ ID NO: 596150 - RNA, 21 nt, Homo sapiens
cuuuaauucauaaaucacaaa

SEQ ID NO: 596151 - RNA, 19 nt, Homo sapiens
cuuuaauuugcuacuguca

SEQ ID NO: 596152 - RNA, 15 nt, Homo sapiens
cuuuacacucaggcu

SEQ ID NO: 596153 - RNA, 17 nt, Homo sapiens
cuuuacaguggcaaaaa

SEQ ID NO: 596154 - RNA, 12 nt, Homo sapiens
cuuuaccaugcu

SEQ ID NO: 596155 - RNA, 17 nt, Homo sapiens
cuuuacccaccuagaac

SEQ ID NO: 596156 - RNA, 15 nt, Homo sapiens
cuuuacguacuguaa

SEQ ID NO: 596157 - RNA, 15 nt, Homo sapiens
cuuuacuaacacugg

SEQ ID NO: 596158 - RNA, 15 nt, Homo sapiens
cuuuacuaauggugu

SEQ ID NO: 596159 - RNA, 14 nt, Homo sapiens
cuuuacuacugugg

SEQ ID NO: 596160 - RNA, 23 nt, Homo sapiens
cuuuacucacacuaugugcaaaa

SEQ ID NO: 596161 - RNA, 16 nt, Homo sapiens
cuuuacugauacuaca

SEQ ID NO: 596162 - RNA, 14 nt, Homo sapiens
cuuuacugccugaa

SEQ ID NO: 596163 - RNA, 13 nt, Homo sapiens
cuuuacuucccag

SEQ ID NO: 596164 - RNA, 18 nt, Homo sapiens
cuuuagaaagcugacauu

SEQ ID NO: 596165 - RNA, 14 nt, Homo sapiens
cuuuagaacaggga

SEQ ID NO: 596166 - RNA, 16 nt, Homo sapiens
cuuuagagaaugccac

SEQ ID NO: 596167 - RNA, 23 nt, Homo sapiens
cuuuagcuuggguccaccaugca

SEQ ID NO: 596168 - RNA, 18 nt, Homo sapiens
cuuuaggcagcagcuuuu

SEQ ID NO: 596169 - RNA, 14 nt, Homo sapiens
cuuuaggcuuucaa

SEQ ID NO: 596170 - RNA, 16 nt, Homo sapiens
cuuuagguauuacaca

SEQ ID NO: 596171 - RNA, 23 nt, Homo sapiens
cuuuagucagggcaugcuuuauu

SEQ ID NO: 596172 - RNA, 19 nt, Homo sapiens
cuuuagucucccacuaaaa

SEQ ID NO: 596173 - RNA, 18 nt, Homo sapiens
cuuuagugcuuugugaua

SEQ ID NO: 596174 - RNA, 22 nt, Homo sapiens
cuuuaguggugguauguaaugg

SEQ ID NO: 596175 - RNA, 18 nt, Homo sapiens
cuuuagugucugagcuuc

SEQ ID NO: 596176 - RNA, 22 nt, Homo sapiens
cuuuaguuuuugugaaguuuaa

SEQ ID NO: 596177 - RNA, 21 nt, Homo sapiens
cuuuauaaauguaccagagag

SEQ ID NO: 596178 - RNA, 13 nt, Homo sapiens
cuuuauaacccau

SEQ ID NO: 596179 - RNA, 15 nt, Homo sapiens
cuuuauaaccugaug

SEQ ID NO: 596180 - RNA, 20 nt, Homo sapiens
cuuuauagagugucucaggg

SEQ ID NO: 596181 - RNA, 14 nt, Homo sapiens
cuuuauaucugucu

SEQ ID NO: 596182 - RNA, 18 nt, Homo sapiens
cuuuauaugauauacuau

SEQ ID NO: 596183 - RNA, 18 nt, Homo sapiens
cuuuauauggaugauuca

SEQ ID NO: 596184 - RNA, 22 nt, Homo sapiens
cuuuaucaaaaaguacaauaau

SEQ ID NO: 596185 - RNA, 12 nt, Homo sapiens
cuuuaucaaaga

SEQ ID NO: 596186 - RNA, 14 nt, Homo sapiens
cuuuaucaccucau

SEQ ID NO: 596187 - RNA, 14 nt, Homo sapiens
cuuuaucauugcua

SEQ ID NO: 596188 - RNA, 15 nt, Homo sapiens
cuuuauccacuuuuc

SEQ ID NO: 596189 - RNA, 13 nt, Homo sapiens
cuuuaucucaggg

SEQ ID NO: 596190 - RNA, 19 nt, Homo sapiens
cuuuaugaucuggcccuug

SEQ ID NO: 596191 - RNA, 18 nt, Homo sapiens
cuuuaugcagagccacag

SEQ ID NO: 596192 - RNA, 17 nt, Homo sapiens
cuuuaugguuucuccag

SEQ ID NO: 596193 - RNA, 14 nt, Homo sapiens
cuuuauguaucucu

SEQ ID NO: 596194 - RNA, 15 nt, Homo sapiens
cuuuaugugcaaaau

SEQ ID NO: 596195 - RNA, 14 nt, Homo sapiens
cuuuauuauuccua

SEQ ID NO: 596196 - RNA, 24 nt, Homo sapiens
cuuuauugcaucuggguagcugua

SEQ ID NO: 596197 - RNA, 21 nt, Homo sapiens
cuuuauugcuuaauuucugcc

SEQ ID NO: 596198 - RNA, 17 nt, Homo sapiens
cuuuauuggcugagaua

SEQ ID NO: 596199 - RNA, 12 nt, Homo sapiens
cuuuauuguaca

SEQ ID NO: 596200 - RNA, 20 nt, Homo sapiens
cuuuauuuaaaaagaaugga

SEQ ID NO: 596201 - RNA, 19 nt, Homo sapiens
cuuuauuuauaauacauuu

SEQ ID NO: 596202 - RNA, 20 nt, Homo sapiens
cuuuauuucuagcagaguga

SEQ ID NO: 596203 - RNA, 14 nt, Homo sapiens
cuuucaaacauaua

SEQ ID NO: 596204 - RNA, 18 nt, Homo sapiens
cuuucaaagcuaaauucc

SEQ ID NO: 596205 - RNA, 15 nt, Homo sapiens
cuuucaacuugcauc

SEQ ID NO: 596206 - RNA, 20 nt, Homo sapiens
cuuucaaguuugucacuaaa

SEQ ID NO: 596207 - RNA, 21 nt, Homo sapiens
cuuucaaguuugucacuaaac

SEQ ID NO: 596208 - RNA, 15 nt, Homo sapiens
cuuucacaaaaggca

SEQ ID NO: 596209 - RNA, 14 nt, Homo sapiens
cuuucacacacaca

SEQ ID NO: 596210 - RNA, 13 nt, Homo sapiens
cuuucacaguccu

SEQ ID NO: 596211 - RNA, 15 nt, Homo sapiens
cuuugugaaucugaa

SEQ ID NO: 596212 - RNA, 14 nt, Homo sapiens
cuuugugccuuuga

SEQ ID NO: 596213 - RNA, 14 nt, Homo sapiens
cuuugugggcucca

SEQ ID NO: 596214 - RNA, 21 nt, Homo sapiens
cuuuguggggcucaaaaccuc

SEQ ID NO: 596215 - RNA, 19 nt, Homo sapiens
cuuuguguagaaagccaaa

SEQ ID NO: 596216 - RNA, 15 nt, Homo sapiens
cuuuguguguauuca

SEQ ID NO: 596217 - RNA, 19 nt, Homo sapiens
cuuuguuaccauacugucu

SEQ ID NO: 596218 - RNA, 15 nt, Homo sapiens
cuuuguucugugauu

SEQ ID NO: 596219 - RNA, 18 nt, Homo sapiens
cuuuuaaaauacauuugg

SEQ ID NO: 596220 - RNA, 16 nt, Homo sapiens
cuuuuaaaauauucua

SEQ ID NO: 596221 - RNA, 16 nt, Homo sapiens
cuuuuaaaaugcccuu

SEQ ID NO: 596222 - RNA, 22 nt, Homo sapiens
cuuuuaaagccagaagucacau

SEQ ID NO: 596223 - RNA, 15 nt, Homo sapiens
cuuuuaaaugcauaa

SEQ ID NO: 596224 - RNA, 14 nt, Homo sapiens
cuuuuaacaugcau

SEQ ID NO: 596225 - RNA, 15 nt, Homo sapiens
cuuuuaagaaacaca

SEQ ID NO: 596226 - RNA, 17 nt, Homo sapiens
cuuuuaagaaacacagg

SEQ ID NO: 596227 - RNA, 18 nt, Homo sapiens
cuuuuaagaaacacaggg

SEQ ID NO: 596228 - RNA, 20 nt, Homo sapiens
cuuuuaagaugugucuucaa

SEQ ID NO: 596229 - RNA, 15 nt, Homo sapiens
cuuuuaaggcuaaaa

SEQ ID NO: 596230 - RNA, 17 nt, Homo sapiens
cuuuuaaucaacuguag

SEQ ID NO: 596231 - RNA, 19 nt, Homo sapiens
cuuuuaauccaauccacua

SEQ ID NO: 596232 - RNA, 21 nt, Homo sapiens
cuuuuacagaaugcauuaaaa

SEQ ID NO: 596233 - RNA, 13 nt, Homo sapiens
cuuuuacauucug

SEQ ID NO: 596234 - RNA, 21 nt, Homo sapiens
cuuuuaccuagccacuuaaua

SEQ ID NO: 596235 - RNA, 22 nt, Homo sapiens
cuuuuacuuuuugccccuucca

SEQ ID NO: 596236 - RNA, 17 nt, Homo sapiens
cuuuuagaaauacugca

SEQ ID NO: 596237 - RNA, 21 nt, Homo sapiens
cuuuuagaaauacugcaagaa

SEQ ID NO: 596238 - RNA, 15 nt, Homo sapiens
cuuuuaggccaagga

SEQ ID NO: 596239 - RNA, 16 nt, Homo sapiens
cuuuuaggccaaggaa

SEQ ID NO: 596240 - RNA, 13 nt, Homo sapiens
cuuuuauguagca

SEQ ID NO: 596241 - RNA, 19 nt, Homo sapiens
cuuuuauguagcacauaaa

SEQ ID NO: 596242 - RNA, 23 nt, Homo sapiens
cuuuuauuuuuuaagguaacaaa

SEQ ID NO: 596243 - RNA, 13 nt, Homo sapiens
cuuuucaaaaccu

SEQ ID NO: 596244 - RNA, 13 nt, Homo sapiens
cuuuucaaugugu

SEQ ID NO: 596245 - RNA, 18 nt, Homo sapiens
cuuuucaccaaugagccu

SEQ ID NO: 596246 - RNA, 15 nt, Homo sapiens
cuuuucagauugugg

SEQ ID NO: 596247 - RNA, 22 nt, Homo sapiens
cuuuucagcgauguaugcagcu

SEQ ID NO: 596248 - RNA, 16 nt, Homo sapiens
cuuuucagugauacuc

SEQ ID NO: 596249 - RNA, 18 nt, Homo sapiens
cuuuucagugauacucac

SEQ ID NO: 596250 - RNA, 17 nt, Homo sapiens
cuuuucaucuaauguga

SEQ ID NO: 596251 - RNA, 18 nt, Homo sapiens
cuuuucauguacagcauu

SEQ ID NO: 596252 - RNA, 18 nt, Homo sapiens
cuuuucauugcuaccucu

SEQ ID NO: 596253 - RNA, 16 nt, Homo sapiens
cuuuuccaagcuccuu

SEQ ID NO: 596254 - RNA, 22 nt, Homo sapiens
cuuuuccaugcacccucauaca

SEQ ID NO: 596255 - RNA, 14 nt, Homo sapiens
cuuuucccauuuca

SEQ ID NO: 596256 - RNA, 15 nt, Homo sapiens
cuuuuccccaaccac

SEQ ID NO: 596257 - RNA, 15 nt, Homo sapiens
cuuuuccccagggau

SEQ ID NO: 596258 - RNA, 16 nt, Homo sapiens
cuuuuccccaguccca

SEQ ID NO: 596259 - RNA, 16 nt, Homo sapiens
cuuuuccucaccagga

SEQ ID NO: 596260 - RNA, 19 nt, Homo sapiens
cuuuuccuuauacuguaua

SEQ ID NO: 596261 - RNA, 23 nt, Homo sapiens
cuuuucggccccauguaucucag

SEQ ID NO: 596262 - RNA, 19 nt, Homo sapiens
cuuuucggucuuucccauu

SEQ ID NO: 596263 - RNA, 19 nt, Homo sapiens
cuuuucuaaucacaguguu

SEQ ID NO: 596264 - RNA, 14 nt, Homo sapiens
cuuuucucaggacc

SEQ ID NO: 596265 - RNA, 13 nt, Homo sapiens
cuuuucucucaaa

SEQ ID NO: 596266 - RNA, 22 nt, Homo sapiens
cuuuucugccacuccauauuaa

SEQ ID NO: 596267 - RNA, 22 nt, Homo sapiens
cuuuucugccugcuccugcuua

SEQ ID NO: 596268 - RNA, 23 nt, Homo sapiens
cuuuucuggccaaaagcaguaaa

SEQ ID NO: 596269 - RNA, 22 nt, Homo sapiens
cuuuucuuuuucccaggccaga

SEQ ID NO: 596270 - RNA, 20 nt, Homo sapiens
cuuuucuuuuuuaauuucca

SEQ ID NO: 596271 - RNA, 15 nt, Homo sapiens
cuuuugaacuuguca

SEQ ID NO: 596272 - RNA, 16 nt, Homo sapiens
cuuuugaaguaauccc

SEQ ID NO: 596273 - RNA, 15 nt, Homo sapiens
cuuuugaaugaugcc

SEQ ID NO: 596274 - RNA, 18 nt, Homo sapiens
cuuuugaauuuuugguua

SEQ ID NO: 596275 - RNA, 17 nt, Homo sapiens
cuuuugacaaaggcaag

SEQ ID NO: 596276 - RNA, 23 nt, Homo sapiens
cuuuugacagcugugcuguaaca

SEQ ID NO: 596277 - RNA, 14 nt, Homo sapiens
cuuuugacauuuua

SEQ ID NO: 596278 - RNA, 14 nt, Homo sapiens
cuuuugaccaaaua

SEQ ID NO: 596279 - RNA, 23 nt, Homo sapiens
cuuuugaccaaauaaaguaccau

SEQ ID NO: 596280 - RNA, 17 nt, Homo sapiens
cuuuugagaaccaagua

SEQ ID NO: 596281 - RNA, 22 nt, Homo sapiens
cuuuugagccaacaacucugau

SEQ ID NO: 596282 - RNA, 21 nt, Homo sapiens
cuuuugauagagguaacuuaa

SEQ ID NO: 596283 - RNA, 15 nt, Homo sapiens
cuuuugcaauaauaa

SEQ ID NO: 596284 - RNA, 11 nt, Homo sapiens
cuuuugcacau

SEQ ID NO: 596285 - RNA, 16 nt, Homo sapiens
cuuuugcauaaaagac

SEQ ID NO: 596286 - RNA, 16 nt, Homo sapiens
cuuuugcauuaaucua

SEQ ID NO: 596287 - RNA, 16 nt, Homo sapiens
cuuuugccauuagcca

SEQ ID NO: 596288 - RNA, 20 nt, Homo sapiens
cuuuugccccagaaagggga

SEQ ID NO: 596289 - RNA, 23 nt, Homo sapiens
cuuuugcuagagcugacagcuuu

SEQ ID NO: 596290 - RNA, 13 nt, Homo sapiens
cuuuugcugugau

SEQ ID NO: 596291 - RNA, 15 nt, Homo sapiens
cuuuugcuuaccuuu

SEQ ID NO: 596292 - RNA, 19 nt, Homo sapiens
cuuuuggaccuugggauca

SEQ ID NO: 596293 - RNA, 21 nt, Homo sapiens
cuuuugguuuaaaaaguuuca

SEQ ID NO: 596294 - RNA, 15 nt, Homo sapiens
cuuuuguaauaucaa

SEQ ID NO: 596295 - RNA, 15 nt, Homo sapiens
cuuuuguaccaaaua

SEQ ID NO: 596296 - RNA, 21 nt, Homo sapiens
cuuuugucuaauuaaaacacu

SEQ ID NO: 596297 - RNA, 19 nt, Homo sapiens
cuuuuguggaguuugacac

SEQ ID NO: 596298 - RNA, 14 nt, Homo sapiens
cuuuuguguagcuc

SEQ ID NO: 596299 - RNA, 22 nt, Homo sapiens
cuuuuguuuugaagcuguugcu

SEQ ID NO: 596300 - RNA, 18 nt, Homo sapiens
cuuuuuaaagaaugcucu

SEQ ID NO: 596301 - RNA, 23 nt, Homo sapiens
cuuuuuaaaguguuucuguuauu

SEQ ID NO: 596302 - RNA, 17 nt, Homo sapiens
cuuuuuaaaugugauca

SEQ ID NO: 596303 - RNA, 18 nt, Homo sapiens
cuuuuuaaccugcaaaau

SEQ ID NO: 596304 - RNA, 15 nt, Homo sapiens
cuuuuuauacuauua

SEQ ID NO: 596305 - RNA, 21 nt, Homo sapiens
cuuuuuaucuucuuagcucau

SEQ ID NO: 596306 - RNA, 19 nt, Homo sapiens
cuuuuuauucccugcccaa

SEQ ID NO: 596307 - RNA, 16 nt, Homo sapiens
cuuuuucaaugaauuu

SEQ ID NO: 596308 - RNA, 13 nt, Homo sapiens
cuuuuucuggaaa

SEQ ID NO: 596309 - RNA, 13 nt, Homo sapiens
cuuuuucuuugaa

SEQ ID NO: 596310 - RNA, 14 nt, Homo sapiens
cuuuuugaguuuca

SEQ ID NO: 596311 - RNA, 20 nt, Homo sapiens
cuuuuugcugccugugagca

SEQ ID NO: 596312 - RNA, 13 nt, Homo sapiens
cuuuuugggacca

SEQ ID NO: 596313 - RNA, 13 nt, Homo sapiens
cuuuuuguacuga

SEQ ID NO: 596314 - RNA, 21 nt, Homo sapiens
cuuuuuguacugaaaacaauu

SEQ ID NO: 596315 - RNA, 18 nt, Homo sapiens
cuuuuuguuacagauuaa

SEQ ID NO: 596316 - RNA, 19 nt, Homo sapiens
cuuuuuuaagacucaauca

SEQ ID NO: 596317 - RNA, 14 nt, Homo sapiens
cuuuuuuauacuca

SEQ ID NO: 596318 - RNA, 16 nt, Homo sapiens
cuuuuuuaucuugcac

SEQ ID NO: 596319 - RNA, 16 nt, Homo sapiens
cuuuuuucaauaugca

SEQ ID NO: 596320 - RNA, 15 nt, Homo sapiens
cuuuuuucuauucaa

SEQ ID NO: 596321 - RNA, 14 nt, Homo sapiens
cuuuuuucuuacca

SEQ ID NO: 596322 - RNA, 22 nt, Homo sapiens
cuuuuuugaggccuuuuuugcc

SEQ ID NO: 596323 - RNA, 11 nt, Homo sapiens
cuuuuuugcca

SEQ ID NO: 596324 - RNA, 12 nt, Homo sapiens
cuuuuuugccaa

SEQ ID NO: 596325 - RNA, 19 nt, Homo sapiens
cuuuuuuguuguuguuggc

SEQ ID NO: 596326 - RNA, 17 nt, Homo sapiens
cuuuuuuucuguaccag

SEQ ID NO: 596327 - RNA, 14 nt, Homo sapiens
cuuuuuuucuuugg

SEQ ID NO: 596328 - RNA, 14 nt, Homo sapiens
cuuuuuuuuaagga

SEQ ID NO: 596329 - RNA, 23 nt, Homo sapiens
cuuuuuuuuuuuuuaaagacaga

SEQ ID NO: 596330 - RNA, 22 nt, Homo sapiens
gaaaaaaaaaaaaaagaacaac

SEQ ID NO: 596331 - RNA, 18 nt, Homo sapiens
gaaaaaaaaaacuaucaa

SEQ ID NO: 596332 - RNA, 14 nt, Homo sapiens
gaaaaaaaaauuca

SEQ ID NO: 596333 - RNA, 21 nt, Homo sapiens
gaaaaaaaagagacugguuag

SEQ ID NO: 596334 - RNA, 13 nt, Homo sapiens
gaaaaaaacugaa

SEQ ID NO: 596335 - RNA, 17 nt, Homo sapiens
gaaaaaaagaaguaugu

SEQ ID NO: 596336 - RNA, 13 nt, Homo sapiens
gaaaaaaagugag

SEQ ID NO: 596337 - RNA, 16 nt, Homo sapiens
gaaaaaaagugcuaaa

SEQ ID NO: 596338 - RNA, 16 nt, Homo sapiens
gaaaaaaucacuguuu

SEQ ID NO: 596339 - RNA, 15 nt, Homo sapiens
gaaaaacaaacaaaa

SEQ ID NO: 596340 - RNA, 15 nt, Homo sapiens
gaaaaacaaauaaaa

SEQ ID NO: 596341 - RNA, 19 nt, Homo sapiens
gaaaaacaccgcuucugcc

SEQ ID NO: 596342 - RNA, 21 nt, Homo sapiens
gaaaaacuaacuagacuaaga

SEQ ID NO: 596343 - RNA, 23 nt, Homo sapiens
gaaaaacuguucuuuugcaauaa

SEQ ID NO: 596344 - RNA, 15 nt, Homo sapiens
gaaaaacuuccauga

SEQ ID NO: 596345 - RNA, 21 nt, Homo sapiens
gaaaaagaaugaugcuaugaa

SEQ ID NO: 596346 - RNA, 13 nt, Homo sapiens
gaaaaagacugau

SEQ ID NO: 596347 - RNA, 17 nt, Homo sapiens
gaaaaauaccaacucag

SEQ ID NO: 596348 - RNA, 12 nt, Homo sapiens
gaaaaauacuuu

SEQ ID NO: 596349 - RNA, 16 nt, Homo sapiens
gaaaaauagcugugaa

SEQ ID NO: 596350 - RNA, 22 nt, Homo sapiens
gaaaaauauaauguugauaaua

SEQ ID NO: 596351 - RNA, 17 nt, Homo sapiens
gaaaaauaucuuggccu

SEQ ID NO: 596352 - RNA, 12 nt, Homo sapiens
gaaaaaugccug

SEQ ID NO: 596353 - RNA, 14 nt, Homo sapiens
gaaaaaugcuguuu

SEQ ID NO: 596354 - RNA, 17 nt, Homo sapiens
gaaaaaugguggucauu

SEQ ID NO: 596355 - RNA, 12 nt, Homo sapiens
gaaaaauuauua

SEQ ID NO: 596356 - RNA, 14 nt, Homo sapiens
gaaaacaaauaaaa

SEQ ID NO: 596357 - RNA, 12 nt, Homo sapiens
gaaaacaaugca

SEQ ID NO: 596358 - RNA, 12 nt, Homo sapiens
gaaaacaauuca

SEQ ID NO: 596359 - RNA, 19 nt, Homo sapiens
gaaaacgguggaggccagg

SEQ ID NO: 596360 - RNA, 13 nt, Homo sapiens
gaaaacuacaguu

SEQ ID NO: 596361 - RNA, 21 nt, Homo sapiens
gaaaacucaugaucaagauau

SEQ ID NO: 596362 - RNA, 12 nt, Homo sapiens
gaaaacugcuga

SEQ ID NO: 596363 - RNA, 18 nt, Homo sapiens
gaaaacuguagucucuga

SEQ ID NO: 596364 - RNA, 15 nt, Homo sapiens
gaaaacuugugcccu

SEQ ID NO: 596365 - RNA, 17 nt, Homo sapiens
gaaaacuugugcccuug

SEQ ID NO: 596366 - RNA, 20 nt, Homo sapiens
gaaaacuuuuguaaauuauu

SEQ ID NO: 596367 - RNA, 20 nt, Homo sapiens
gaaaagaaaccagagucaaa

SEQ ID NO: 596368 - RNA, 14 nt, Homo sapiens
gaaaagaaaccugg

SEQ ID NO: 596369 - RNA, 20 nt, Homo sapiens
gaaaagaaaucagcagacac

SEQ ID NO: 596370 - RNA, 23 nt, Homo sapiens
gaaaagaacacuagagucuguca

SEQ ID NO: 596371 - RNA, 19 nt, Homo sapiens
gaaaagacuuuuguugaaa

SEQ ID NO: 596372 - RNA, 19 nt, Homo sapiens
gaaaagagaauauuuacaa

SEQ ID NO: 596373 - RNA, 14 nt, Homo sapiens
gaaaagaugaauuu

SEQ ID NO: 596374 - RNA, 18 nt, Homo sapiens
gaaaagcacagcuguaua

SEQ ID NO: 596375 - RNA, 22 nt, Homo sapiens
gaaaagcuaguguaccuccucu

SEQ ID NO: 596376 - RNA, 15 nt, Homo sapiens
gaaaagcugccauuu

SEQ ID NO: 596377 - RNA, 16 nt, Homo sapiens
gaaaaggaagacuaga

SEQ ID NO: 596378 - RNA, 17 nt, Homo sapiens
gaaaaggcugcugugaa

SEQ ID NO: 596379 - RNA, 18 nt, Homo sapiens
gaaaaggcugcugugaac

SEQ ID NO: 596380 - RNA, 13 nt, Homo sapiens
gaaaaggcuuuca

SEQ ID NO: 596381 - RNA, 17 nt, Homo sapiens
gaaaagggaacugaaca

SEQ ID NO: 596382 - RNA, 15 nt, Homo sapiens
gaaaagggaucugcu

SEQ ID NO: 596383 - RNA, 18 nt, Homo sapiens
gaaaagguccuugccucc

SEQ ID NO: 596384 - RNA, 16 nt, Homo sapiens
gaaaaggugauuguca

SEQ ID NO: 596385 - RNA, 16 nt, Homo sapiens
gaaaagguugccugaa

SEQ ID NO: 596386 - RNA, 14 nt, Homo sapiens
gaaaaguauucuca

SEQ ID NO: 596387 - RNA, 17 nt, Homo sapiens
gaaaagugaaucuugcu

SEQ ID NO: 596388 - RNA, 20 nt, Homo sapiens
gaaaaguggagaaauggcaa

SEQ ID NO: 596389 - RNA, 16 nt, Homo sapiens
gaaaaguguaauagca

SEQ ID NO: 596390 - RNA, 23 nt, Homo sapiens
gaaaaguguguaucuagcuucuu

SEQ ID NO: 596391 - RNA, 13 nt, Homo sapiens
gaaaaguuaguca

SEQ ID NO: 596392 - RNA, 15 nt, Homo sapiens
gaaaaguuagucaau

SEQ ID NO: 596393 - RNA, 21 nt, Homo sapiens
gaaaaguuagucaauccuguc

SEQ ID NO: 596394 - RNA, 16 nt, Homo sapiens
gaaaauaaaguguaua

SEQ ID NO: 596395 - RNA, 19 nt, Homo sapiens
gaaaauaacaaagcccuua

SEQ ID NO: 596396 - RNA, 17 nt, Homo sapiens
gaaaauaauuguuccaa

SEQ ID NO: 596397 - RNA, 20 nt, Homo sapiens
gaaaauagaauugacauuga

SEQ ID NO: 596398 - RNA, 19 nt, Homo sapiens
gaaaauaguggugugauuu

SEQ ID NO: 596399 - RNA, 15 nt, Homo sapiens
gaaaauauaguuccu

SEQ ID NO: 596400 - RNA, 18 nt, Homo sapiens
gaaaauaucuugcuuuca

SEQ ID NO: 596401 - RNA, 17 nt, Homo sapiens
gaaaauaugauguuuca

SEQ ID NO: 596402 - RNA, 17 nt, Homo sapiens
gaaaauccaggucaugc

SEQ ID NO: 596403 - RNA, 15 nt, Homo sapiens
gaaaauccaucucau

SEQ ID NO: 596404 - RNA, 19 nt, Homo sapiens
gaaaaucccggugcuugca

SEQ ID NO: 596405 - RNA, 23 nt, Homo sapiens
gaaaaucuagaggaaaagaaaga

SEQ ID NO: 596406 - RNA, 23 nt, Homo sapiens
gaaaaucuauauuugucuuccga

SEQ ID NO: 596407 - RNA, 17 nt, Homo sapiens
gaaaaucucagcaauga

SEQ ID NO: 596408 - RNA, 19 nt, Homo sapiens
gaaaaucugcacugugggc

SEQ ID NO: 596409 - RNA, 16 nt, Homo sapiens
gaaaaugaaacuagaa

SEQ ID NO: 596410 - RNA, 17 nt, Homo sapiens
gaaaaugaaaugcauau

SEQ ID NO: 596411 - RNA, 18 nt, Homo sapiens
gaaaaugaauuuuuucca

SEQ ID NO: 596412 - RNA, 17 nt, Homo sapiens
gaaaaugagagcagaaa

SEQ ID NO: 596413 - RNA, 13 nt, Homo sapiens
gaaaaugccauga

SEQ ID NO: 596414 - RNA, 12 nt, Homo sapiens
gaaaaugccuca

SEQ ID NO: 596415 - RNA, 20 nt, Homo sapiens
gaaaaugccucaauucacau

SEQ ID NO: 596416 - RNA, 16 nt, Homo sapiens
gaaaauggaauugcuu

SEQ ID NO: 596417 - RNA, 16 nt, Homo sapiens
gaaaauggccaugcag

SEQ ID NO: 596418 - RNA, 14 nt, Homo sapiens
gaaaauguacaaua

SEQ ID NO: 596419 - RNA, 17 nt, Homo sapiens
gaaaauguauugauuca

SEQ ID NO: 596420 - RNA, 20 nt, Homo sapiens
gaaaaugucagaaaccaguu

SEQ ID NO: 596421 - RNA, 18 nt, Homo sapiens
gaaaauuaugcaaaagca

SEQ ID NO: 596422 - RNA, 22 nt, Homo sapiens
gaaaauucaagcauuuaggaau

SEQ ID NO: 596423 - RNA, 21 nt, Homo sapiens
gaaaauuccuagaaauugaac

SEQ ID NO: 596424 - RNA, 14 nt, Homo sapiens
gaaaauugcaugaa

SEQ ID NO: 596425 - RNA, 20 nt, Homo sapiens
gaaaauuggaacucuacuca

SEQ ID NO: 596426 - RNA, 18 nt, Homo sapiens
gaaacaagccugccauaa

SEQ ID NO: 596427 - RNA, 15 nt, Homo sapiens
gaaacaagguuuuca

SEQ ID NO: 596428 - RNA, 17 nt, Homo sapiens
gaaacaauaaaaccugg

SEQ ID NO: 596429 - RNA, 17 nt, Homo sapiens
gaaacacagaaaccuuu

SEQ ID NO: 596430 - RNA, 18 nt, Homo sapiens
gaaacaccccucugucua

SEQ ID NO: 596431 - RNA, 21 nt, Homo sapiens
gaaacaccccucugucuagga

SEQ ID NO: 596432 - RNA, 19 nt, Homo sapiens
gaaacacguaucccaccug

SEQ ID NO: 596433 - RNA, 18 nt, Homo sapiens
gaaacacugccugcccuc

SEQ ID NO: 596434 - RNA, 16 nt, Homo sapiens
gaaacagaaauagacu

SEQ ID NO: 596435 - RNA, 22 nt, Homo sapiens
gaaacagcaggacuuguuuaca

SEQ ID NO: 596436 - RNA, 13 nt, Homo sapiens
gaaacagugugca

SEQ ID NO: 596437 - RNA, 17 nt, Homo sapiens
gaaacaguuaauaccau

SEQ ID NO: 596438 - RNA, 22 nt, Homo sapiens
gaaacauaguaauuaguagaaa

SEQ ID NO: 596439 - RNA, 13 nt, Homo sapiens
gaaacaucagcuu

SEQ ID NO: 596440 - RNA, 20 nt, Homo sapiens
gaaacaucucaacaaccuga

SEQ ID NO: 596441 - RNA, 16 nt, Homo sapiens
gaaacauuacaguuca

SEQ ID NO: 596442 - RNA, 17 nt, Homo sapiens
gaaacauuaugccuuaa

SEQ ID NO: 596443 - RNA, 21 nt, Homo sapiens
gaaacauuuuguggucauuaa

SEQ ID NO: 596444 - RNA, 17 nt, Homo sapiens
gaaaccaaaacauaaaa

SEQ ID NO: 596445 - RNA, 23 nt, Homo sapiens
gaaaccagaaggauauuuacuac

SEQ ID NO: 596446 - RNA, 15 nt, Homo sapiens
gaaaccagagucaaa

SEQ ID NO: 596447 - RNA, 22 nt, Homo sapiens
gaaaccagagucaaauuugaaa

SEQ ID NO: 596448 - RNA, 12 nt, Homo sapiens
gaaaccaugaca

SEQ ID NO: 596449 - RNA, 14 nt, Homo sapiens
gaaaccccaucucu

SEQ ID NO: 596450 - RNA, 20 nt, Homo sapiens
gaaaccccaucucuacuaaa

SEQ ID NO: 596451 - RNA, 17 nt, Homo sapiens
gaaacccuauuucccca

SEQ ID NO: 596452 - RNA, 14 nt, Homo sapiens
gaaacccucuguca

SEQ ID NO: 596453 - RNA, 15 nt, Homo sapiens
gaaaccuacaagauu

SEQ ID NO: 596454 - RNA, 17 nt, Homo sapiens
gaaaccuguacauaugu

SEQ ID NO: 596455 - RNA, 12 nt, Homo sapiens
gaaaucugacaa

SEQ ID NO: 596456 - RNA, 12 nt, Homo sapiens
gaaaucugccaa

SEQ ID NO: 596457 - RNA, 12 nt, Homo sapiens
gaaaucuugcaa

SEQ ID NO: 596458 - RNA, 23 nt, Homo sapiens
gaaaucuugucuuaccacagugu

SEQ ID NO: 596459 - RNA, 19 nt, Homo sapiens
gaaaugaauaagcuuucuc

SEQ ID NO: 596460 - RNA, 21 nt, Homo sapiens
gaaaugacuuugaaaaccugg

SEQ ID NO: 596461 - RNA, 13 nt, Homo sapiens
gaaaugcaaccaa

SEQ ID NO: 596462 - RNA, 17 nt, Homo sapiens
gaaaugcauauuugcaa

SEQ ID NO: 596463 - RNA, 20 nt, Homo sapiens
gaaaugccugcuuugaauaa

SEQ ID NO: 596464 - RNA, 19 nt, Homo sapiens
gaaaugcuuuuauauucua

SEQ ID NO: 596465 - RNA, 20 nt, Homo sapiens
gaaauggaacagugaggaau

SEQ ID NO: 596466 - RNA, 17 nt, Homo sapiens
gaaauggcuaugaacag

SEQ ID NO: 596467 - RNA, 19 nt, Homo sapiens
gaaauguaaaauugaaaau

SEQ ID NO: 596468 - RNA, 18 nt, Homo sapiens
gaaauguaaacugccaua

SEQ ID NO: 596469 - RNA, 12 nt, Homo sapiens
gaaauguagaau

SEQ ID NO: 596470 - RNA, 17 nt, Homo sapiens
gaaauguagcccugggu

SEQ ID NO: 596471 - RNA, 19 nt, Homo sapiens
gaaaugucuggucugucca

SEQ ID NO: 596472 - RNA, 15 nt, Homo sapiens
gaaauguucucauga

SEQ ID NO: 596473 - RNA, 22 nt, Homo sapiens
gaaauguucucaugaacuaccc

SEQ ID NO: 596474 - RNA, 15 nt, Homo sapiens
gaaauuaagacuuua

SEQ ID NO: 596475 - RNA, 17 nt, Homo sapiens
gaaauuaccagauauaa

SEQ ID NO: 596476 - RNA, 22 nt, Homo sapiens
gaaauuagguugaaacauaucu

SEQ ID NO: 596477 - RNA, 17 nt, Homo sapiens
gaaauuaguuuaccuca

SEQ ID NO: 596478 - RNA, 22 nt, Homo sapiens
gaaauuaguuuaccucauccau

SEQ ID NO: 596479 - RNA, 21 nt, Homo sapiens
gaaauuaguuucaaauuuacc

SEQ ID NO: 596480 - RNA, 20 nt, Homo sapiens
gaaauuccaaauggugugaa

SEQ ID NO: 596481 - RNA, 17 nt, Homo sapiens
gaaauuccagcaauaag

SEQ ID NO: 596482 - RNA, 19 nt, Homo sapiens
gaaauuccaggaaccaaaa

SEQ ID NO: 596483 - RNA, 19 nt, Homo sapiens
gaaauugaaaaugaccaaa

SEQ ID NO: 596484 - RNA, 19 nt, Homo sapiens
gaaauugcauuuccugaca

SEQ ID NO: 596485 - RNA, 22 nt, Homo sapiens
gaaauuuaaacuauaagcaaga

SEQ ID NO: 596486 - RNA, 16 nt, Homo sapiens
gaaauuuaaacucuga

SEQ ID NO: 596487 - RNA, 17 nt, Homo sapiens
gaaauuuaagacuagau

SEQ ID NO: 596488 - RNA, 16 nt, Homo sapiens
gaaauuuacugugaga

SEQ ID NO: 596489 - RNA, 16 nt, Homo sapiens
gaaauuuagagucaau

SEQ ID NO: 596490 - RNA, 20 nt, Homo sapiens
gaaauuugcaacucacugau

SEQ ID NO: 596491 - RNA, 13 nt, Homo sapiens
gaaauuuggcaaa

SEQ ID NO: 596492 - RNA, 17 nt, Homo sapiens
gaaauuuggcuauaauc

SEQ ID NO: 596493 - RNA, 21 nt, Homo sapiens
gaaauuuuaguuauaguguuu

SEQ ID NO: 596494 - RNA, 23 nt, Homo sapiens
gaaauuuucaauuugagauucua

SEQ ID NO: 596495 - RNA, 20 nt, Homo sapiens
gaacaaaaugaauucuggga

SEQ ID NO: 596496 - RNA, 21 nt, Homo sapiens
gaacaaaaugaauucugggaa

SEQ ID NO: 596497 - RNA, 21 nt, Homo sapiens
gaacaaacacugcaguuuccu

SEQ ID NO: 596498 - RNA, 13 nt, Homo sapiens
gaacaaacagggc

SEQ ID NO: 596499 - RNA, 14 nt, Homo sapiens
gaacaaacucugaa

SEQ ID NO: 596500 - RNA, 18 nt, Homo sapiens
gaacaaagccacugacug

SEQ ID NO: 596501 - RNA, 19 nt, Homo sapiens
gaacaaaucuaccagguga

SEQ ID NO: 596502 - RNA, 21 nt, Homo sapiens
gaacaaauguguuuuucuaua

SEQ ID NO: 596503 - RNA, 19 nt, Homo sapiens
gaacaaauuauaaaaacca

SEQ ID NO: 596504 - RNA, 15 nt, Homo sapiens
gaacaacauaucuca

SEQ ID NO: 596505 - RNA, 17 nt, Homo sapiens
gaacaaccagaugguga

SEQ ID NO: 596506 - RNA, 16 nt, Homo sapiens
gaacaagcauuaguuu

SEQ ID NO: 596507 - RNA, 15 nt, Homo sapiens
gaacaagcuaauugg

SEQ ID NO: 596508 - RNA, 20 nt, Homo sapiens
gaacaagcuggcuucuguga

SEQ ID NO: 596509 - RNA, 19 nt, Homo sapiens
gaacaaggaguucucuucc

SEQ ID NO: 596510 - RNA, 15 nt, Homo sapiens
gaacaauaaaauguc

SEQ ID NO: 596511 - RNA, 20 nt, Homo sapiens
gaacaauaaaaugucuucuc

SEQ ID NO: 596512 - RNA, 17 nt, Homo sapiens
gaacaauccauaacuuu

SEQ ID NO: 596513 - RNA, 16 nt, Homo sapiens
gaacaauuaugaacau

SEQ ID NO: 596514 - RNA, 16 nt, Homo sapiens
gaacacaaaacauuua

SEQ ID NO: 596515 - RNA, 14 nt, Homo sapiens
gaacacacagacuu

SEQ ID NO: 596516 - RNA, 21 nt, Homo sapiens
gaacacacagacuuucuguga

SEQ ID NO: 596517 - RNA, 19 nt, Homo sapiens
gaacacagcaugugccaag

SEQ ID NO: 596518 - RNA, 15 nt, Homo sapiens
gaacacauuugccca

SEQ ID NO: 596519 - RNA, 18 nt, Homo sapiens
gaacacucuacuacaugu

SEQ ID NO: 596520 - RNA, 20 nt, Homo sapiens
gaacacucuuuugcuuuauu

SEQ ID NO: 596521 - RNA, 16 nt, Homo sapiens
gaacacuggaacauuc

SEQ ID NO: 596522 - RNA, 15 nt, Homo sapiens
gaacagaaaacaaca

SEQ ID NO: 596523 - RNA, 17 nt, Homo sapiens
gaacagaaauuggguga

SEQ ID NO: 596524 - RNA, 16 nt, Homo sapiens
gaacagacaacagaag

SEQ ID NO: 596525 - RNA, 17 nt, Homo sapiens
gaacagaggcauuuaaa

SEQ ID NO: 596526 - RNA, 20 nt, Homo sapiens
gaacagagggugaaagggac

SEQ ID NO: 596527 - RNA, 17 nt, Homo sapiens
gaacagcgggagaccug

SEQ ID NO: 596528 - RNA, 17 nt, Homo sapiens
gaacagcucuucuccca

SEQ ID NO: 596529 - RNA, 17 nt, Homo sapiens
gaacagcugugagccau

SEQ ID NO: 596530 - RNA, 20 nt, Homo sapiens
gaacagggucauguuugcag

SEQ ID NO: 596531 - RNA, 14 nt, Homo sapiens
gaacaguaugaauu

SEQ ID NO: 596532 - RNA, 20 nt, Homo sapiens
gaacagucacccuucugggc

SEQ ID NO: 596533 - RNA, 15 nt, Homo sapiens
gaacaguccuguuca

SEQ ID NO: 596534 - RNA, 22 nt, Homo sapiens
gaacaguuucaucaggaccaaa

SEQ ID NO: 596535 - RNA, 19 nt, Homo sapiens
gaacaguuuuacaauagac

SEQ ID NO: 596536 - RNA, 11 nt, Homo sapiens
gaacauaaaaa

SEQ ID NO: 596537 - RNA, 20 nt, Homo sapiens
gaacauaaaaaggacaucag

SEQ ID NO: 596538 - RNA, 15 nt, Homo sapiens
gaacauacacuguga

SEQ ID NO: 596539 - RNA, 16 nt, Homo sapiens
gaacauacuguucacu

SEQ ID NO: 596540 - RNA, 22 nt, Homo sapiens
gaacauaucauuugugaagaau

SEQ ID NO: 596541 - RNA, 17 nt, Homo sapiens
gaacauccuccacugac

SEQ ID NO: 596542 - RNA, 19 nt, Homo sapiens
gaacaugacccagccugaa

SEQ ID NO: 596543 - RNA, 13 nt, Homo sapiens
gaacaugcaguuc

SEQ ID NO: 596544 - RNA, 15 nt, Homo sapiens
gaacaugcccacaac

SEQ ID NO: 596545 - RNA, 21 nt, Homo sapiens
gaacaugcccacaacuuguca

SEQ ID NO: 596546 - RNA, 22 nt, Homo sapiens
gaacaugcccacaacuugucac

SEQ ID NO: 596547 - RNA, 23 nt, Homo sapiens
gaacaugcccacaacuugucacc

SEQ ID NO: 596548 - RNA, 22 nt, Homo sapiens
gaacauuaauccacauguuuca

SEQ ID NO: 596549 - RNA, 16 nt, Homo sapiens
gaacauuauucaucuc

SEQ ID NO: 596550 - RNA, 15 nt, Homo sapiens
gaacauucgaggugu

SEQ ID NO: 596551 - RNA, 16 nt, Homo sapiens
gaacauugccuuccuc

SEQ ID NO: 596552 - RNA, 19 nt, Homo sapiens
gaacauuucuuucuugcug

SEQ ID NO: 596553 - RNA, 16 nt, Homo sapiens
gaacauuuuuuaccaa

SEQ ID NO: 596554 - RNA, 10 nt, Homo sapiens
gaaccaaaac

SEQ ID NO: 596555 - RNA, 13 nt, Homo sapiens
gaaccacuaugaa

SEQ ID NO: 596556 - RNA, 19 nt, Homo sapiens
gaaccagcaagucccagac

SEQ ID NO: 596557 - RNA, 19 nt, Homo sapiens
gaaccagcagaaaugcccc

SEQ ID NO: 596558 - RNA, 18 nt, Homo sapiens
gaaccagcaucucagcgc

SEQ ID NO: 596559 - RNA, 23 nt, Homo sapiens
gaaccaucauuggaaaugaaacu

SEQ ID NO: 596560 - RNA, 21 nt, Homo sapiens
gaaccauguggauaacuuuac

SEQ ID NO: 596561 - RNA, 14 nt, Homo sapiens
gaacccaagugccu

SEQ ID NO: 596562 - RNA, 21 nt, Homo sapiens
gaacccauuuugagugacucg

SEQ ID NO: 596563 - RNA, 14 nt, Homo sapiens
gaaccccaggagau

SEQ ID NO: 596564 - RNA, 23 nt, Homo sapiens
gaaccccgucgaggggcucucag

SEQ ID NO: 596565 - RNA, 14 nt, Homo sapiens
gaaccccuucugac

SEQ ID NO: 596566 - RNA, 17 nt, Homo sapiens
gaacccuagcuguguca

SEQ ID NO: 596567 - RNA, 19 nt, Homo sapiens
gaacccugccaggcugcua

SEQ ID NO: 596568 - RNA, 18 nt, Homo sapiens
gaaccgaggggcucagga

SEQ ID NO: 596569 - RNA, 15 nt, Homo sapiens
gaaccuagugcauuu

SEQ ID NO: 596570 - RNA, 19 nt, Homo sapiens
gaaccucaguuuccucauc

SEQ ID NO: 596571 - RNA, 18 nt, Homo sapiens
gaaccucgccauaaggca

SEQ ID NO: 596572 - RNA, 22 nt, Homo sapiens
gaaccucucguaguccaucacc

SEQ ID NO: 596573 - RNA, 16 nt, Homo sapiens
gaaccugacaaaaaca

SEQ ID NO: 596574 - RNA, 21 nt, Homo sapiens
gaaccugagcuauuuuccucu

SEQ ID NO: 596575 - RNA, 21 nt, Homo sapiens
gaaccuggaaaaauuccagaa

SEQ ID NO: 596576 - RNA, 15 nt, Homo sapiens
gcacagucacugcuc

SEQ ID NO: 596577 - RNA, 12 nt, Homo sapiens
gcacagugcagu

SEQ ID NO: 596578 - RNA, 21 nt, Homo sapiens
gcacagugcugccccuugcaa

SEQ ID NO: 596579 - RNA, 19 nt, Homo sapiens
gcacaguguaauccagggg

SEQ ID NO: 596580 - RNA, 13 nt, Homo sapiens
gcacauaacaugc

SEQ ID NO: 596581 - RNA, 17 nt, Homo sapiens
gcacaucacaacauuua

SEQ ID NO: 596582 - RNA, 21 nt, Homo sapiens
gcacaucuugucuaauuuuca

SEQ ID NO: 596583 - RNA, 12 nt, Homo sapiens
gcacaugcacac

SEQ ID NO: 596584 - RNA, 18 nt, Homo sapiens
gcacaugccuacugcugc

SEQ ID NO: 596585 - RNA, 19 nt, Homo sapiens
gcacaugccuuaagccagu

SEQ ID NO: 596586 - RNA, 12 nt, Homo sapiens
gcacaugccuuc

SEQ ID NO: 596587 - RNA, 16 nt, Homo sapiens
gcacaugcgcacucuc

SEQ ID NO: 596588 - RNA, 22 nt, Homo sapiens
gcacaugguucaccaugcagug

SEQ ID NO: 596589 - RNA, 12 nt, Homo sapiens
gcacaugugugc

SEQ ID NO: 596590 - RNA, 19 nt, Homo sapiens
gcacauucauuuucucagu

SEQ ID NO: 596591 - RNA, 20 nt, Homo sapiens
gcacauucuuaaauauuucc

SEQ ID NO: 596592 - RNA, 13 nt, Homo sapiens
gcacauuucugga

SEQ ID NO: 596593 - RNA, 17 nt, Homo sapiens
gcacauuuggacauuuc

SEQ ID NO: 596594 - RNA, 17 nt, Homo sapiens
gcaccaacaucuacaag

SEQ ID NO: 596595 - RNA, 21 nt, Homo sapiens
gcaccaaccacagcaucggga

SEQ ID NO: 596596 - RNA, 10 nt, Homo sapiens
gcaccaccuc

SEQ ID NO: 596597 - RNA, 19 nt, Homo sapiens
gcaccacugcacuccagcu

SEQ ID NO: 596598 - RNA, 14 nt, Homo sapiens
gcaccagacacuca

SEQ ID NO: 596599 - RNA, 21 nt, Homo sapiens
gcaccaggcacgaacccaccu

SEQ ID NO: 596600 - RNA, 22 nt, Homo sapiens
gcaccaucuggaaggacaucua

SEQ ID NO: 596601 - RNA, 21 nt, Homo sapiens
gcaccauggugacugccacau

SEQ ID NO: 596602 - RNA, 13 nt, Homo sapiens
gcaccauucugac

SEQ ID NO: 596603 - RNA, 15 nt, Homo sapiens
gcaccauugcgcucu

SEQ ID NO: 596604 - RNA, 16 nt, Homo sapiens
gcacccacaaccagag

SEQ ID NO: 596605 - RNA, 18 nt, Homo sapiens
gcacccauuucaaugugu

SEQ ID NO: 596606 - RNA, 19 nt, Homo sapiens
gcaccccagcaauuaugaa

SEQ ID NO: 596607 - RNA, 20 nt, Homo sapiens
gcacccccugcuccaccagc

SEQ ID NO: 596608 - RNA, 17 nt, Homo sapiens
gcacccgccaccaugcc

SEQ ID NO: 596609 - RNA, 13 nt, Homo sapiens
gcacccuacaggg

SEQ ID NO: 596610 - RNA, 19 nt, Homo sapiens
gcacccuaguucuaccuca

SEQ ID NO: 596611 - RNA, 16 nt, Homo sapiens
gcacccugacaagugu

SEQ ID NO: 596612 - RNA, 17 nt, Homo sapiens
gcacccugcccaccaag

SEQ ID NO: 596613 - RNA, 22 nt, Homo sapiens
gcacccugcccaccaagaagca

SEQ ID NO: 596614 - RNA, 21 nt, Homo sapiens
gcacccuggauugaucggagc

SEQ ID NO: 596615 - RNA, 21 nt, Homo sapiens
gcacccuguaucacagacugg

SEQ ID NO: 596616 - RNA, 21 nt, Homo sapiens
gcaccuaccuuagaaaacaag

SEQ ID NO: 596617 - RNA, 15 nt, Homo sapiens
gcaccuagcugugca

SEQ ID NO: 596618 - RNA, 23 nt, Homo sapiens
gcaccuaugagauggccaugcuc

SEQ ID NO: 596619 - RNA, 17 nt, Homo sapiens
gcaccucaugcagaggg

SEQ ID NO: 596620 - RNA, 13 nt, Homo sapiens
gcaccucuuccuu

SEQ ID NO: 596621 - RNA, 17 nt, Homo sapiens
gcaccugcaugugcugu

SEQ ID NO: 596622 - RNA, 13 nt, Homo sapiens
gcaccugccucag

SEQ ID NO: 596623 - RNA, 23 nt, Homo sapiens
gcaccugccuccucguuccuuuc

SEQ ID NO: 596624 - RNA, 13 nt, Homo sapiens
gcaccugcgcaca

SEQ ID NO: 596625 - RNA, 15 nt, Homo sapiens
gcaccuguaauccca

SEQ ID NO: 596626 - RNA, 21 nt, Homo sapiens
gcaccuguaaucccagcuacu

SEQ ID NO: 596627 - RNA, 17 nt, Homo sapiens
gcaccuguacucaggag

SEQ ID NO: 596628 - RNA, 12 nt, Homo sapiens
gcaccugugcag

SEQ ID NO: 596629 - RNA, 14 nt, Homo sapiens
gcaccuucagacuu

SEQ ID NO: 596630 - RNA, 16 nt, Homo sapiens
gcaccuuugcacagga

SEQ ID NO: 596631 - RNA, 12 nt, Homo sapiens
gcacgcacacac

SEQ ID NO: 596632 - RNA, 14 nt, Homo sapiens
gcacgcccaugugu

SEQ ID NO: 596633 - RNA, 19 nt, Homo sapiens
gcacggccaccucucaggg

SEQ ID NO: 596634 - RNA, 17 nt, Homo sapiens
gcacgggaugcguggga

SEQ ID NO: 596635 - RNA, 13 nt, Homo sapiens
gcacgguuuguga

SEQ ID NO: 596636 - RNA, 16 nt, Homo sapiens
gcacgucuugcuauuu

SEQ ID NO: 596637 - RNA, 13 nt, Homo sapiens
gcacuaaagccag

SEQ ID NO: 596638 - RNA, 18 nt, Homo sapiens
gcacuacaggcacccgcc

SEQ ID NO: 596639 - RNA, 22 nt, Homo sapiens
gcacuacugggugucauuucau

SEQ ID NO: 596640 - RNA, 13 nt, Homo sapiens
gcacuagcauuuu

SEQ ID NO: 596641 - RNA, 14 nt, Homo sapiens
gcacuauugcacau

SEQ ID NO: 596642 - RNA, 17 nt, Homo sapiens
gcacuauuuauuuacaa

SEQ ID NO: 596643 - RNA, 20 nt, Homo sapiens
gcacucacccaugugccaag

SEQ ID NO: 596644 - RNA, 21 nt, Homo sapiens
gcacucacuccugacugcccg

SEQ ID NO: 596645 - RNA, 16 nt, Homo sapiens
gcacucaucuacugaa

SEQ ID NO: 596646 - RNA, 15 nt, Homo sapiens
gcacucauggguaau

SEQ ID NO: 596647 - RNA, 22 nt, Homo sapiens
gcacucauuuggauugccuuac

SEQ ID NO: 596648 - RNA, 23 nt, Homo sapiens
gcacucgauuguuguaaacuguu

SEQ ID NO: 596649 - RNA, 16 nt, Homo sapiens
gcacucugguggcagg

SEQ ID NO: 596650 - RNA, 22 nt, Homo sapiens
gcacugaccccccccauuagaa

SEQ ID NO: 596651 - RNA, 14 nt, Homo sapiens
gcacugagcagaag

SEQ ID NO: 596652 - RNA, 16 nt, Homo sapiens
gcacugaggaccagcc

SEQ ID NO: 596653 - RNA, 16 nt, Homo sapiens
gcacugaucacccaau

SEQ ID NO: 596654 - RNA, 18 nt, Homo sapiens
gcacugcccuuuucagga

SEQ ID NO: 596655 - RNA, 19 nt, Homo sapiens
gcacugccuccuguuuucu

SEQ ID NO: 596656 - RNA, 19 nt, Homo sapiens
gcacugugacccccagcuc

SEQ ID NO: 596657 - RNA, 23 nt, Homo sapiens
gcacuguggaucacgacaggaaa

SEQ ID NO: 596658 - RNA, 13 nt, Homo sapiens
gcacuguucaaua

SEQ ID NO: 596659 - RNA, 15 nt, Homo sapiens
gcacuuagcccaaga

SEQ ID NO: 596660 - RNA, 22 nt, Homo sapiens
gcacuuaguaguuuuuacaaaa

SEQ ID NO: 596661 - RNA, 14 nt, Homo sapiens
gcacuucacagcug

SEQ ID NO: 596662 - RNA, 15 nt, Homo sapiens
gcacuucagaauucc

SEQ ID NO: 596663 - RNA, 14 nt, Homo sapiens
gcacuucauaucca

SEQ ID NO: 596664 - RNA, 16 nt, Homo sapiens
gcacuugugcuuucag

SEQ ID NO: 596665 - RNA, 15 nt, Homo sapiens
gcacuuuaacugacu

SEQ ID NO: 596666 - RNA, 20 nt, Homo sapiens
gcacuuuauaaacacuguau

SEQ ID NO: 596667 - RNA, 21 nt, Homo sapiens
gcacuuucccuagaaagccau

SEQ ID NO: 596668 - RNA, 21 nt, Homo sapiens
gcacuuugaaggggccucacc

SEQ ID NO: 596669 - RNA, 18 nt, Homo sapiens
gcacuuugggaggccaag

SEQ ID NO: 596670 - RNA, 15 nt, Homo sapiens
gcagaaacagcauau

SEQ ID NO: 596671 - RNA, 18 nt, Homo sapiens
gcagaaauauagugcaau

SEQ ID NO: 596672 - RNA, 21 nt, Homo sapiens
gcagaaauauuugugacaaaa

SEQ ID NO: 596673 - RNA, 20 nt, Homo sapiens
gcagaaauccugcaaugaaa

SEQ ID NO: 596674 - RNA, 19 nt, Homo sapiens
gcagaacagcaucauguca

SEQ ID NO: 596675 - RNA, 19 nt, Homo sapiens
gcagaacguauuuagccau

SEQ ID NO: 596676 - RNA, 22 nt, Homo sapiens
gcagaacucuugacuuccugcc

SEQ ID NO: 596677 - RNA, 13 nt, Homo sapiens
gcagaacugccau

SEQ ID NO: 596678 - RNA, 17 nt, Homo sapiens
gcagaagagaaaagcug

SEQ ID NO: 596679 - RNA, 13 nt, Homo sapiens
gcagaagcagcug

SEQ ID NO: 596680 - RNA, 20 nt, Homo sapiens
gcagaagcaggguacccuuu

SEQ ID NO: 596681 - RNA, 17 nt, Homo sapiens
gcagaagccugagcuca

SEQ ID NO: 596682 - RNA, 15 nt, Homo sapiens
gcagaaggaaaugau

SEQ ID NO: 596683 - RNA, 18 nt, Homo sapiens
gcagaaugaacccauagg

SEQ ID NO: 596684 - RNA, 13 nt, Homo sapiens
gcagaaugaaucu

SEQ ID NO: 596685 - RNA, 15 nt, Homo sapiens
gcagaauggcauuug

SEQ ID NO: 596686 - RNA, 16 nt, Homo sapiens
gcagaauggcauuugc

SEQ ID NO: 596687 - RNA, 15 nt, Homo sapiens
gcagacaaguggaca

SEQ ID NO: 596688 - RNA, 13 nt, Homo sapiens
gcagacaccagca

SEQ ID NO: 596689 - RNA, 21 nt, Homo sapiens
gcagacaccagcagcccuguc

SEQ ID NO: 596690 - RNA, 21 nt, Homo sapiens
gcagacagcuccacccuggcc

SEQ ID NO: 596691 - RNA, 19 nt, Homo sapiens
gcagacauagaagagccaa

SEQ ID NO: 596692 - RNA, 20 nt, Homo sapiens
gcagacauagaagagccaag

SEQ ID NO: 596693 - RNA, 14 nt, Homo sapiens
gcagacccugagca

SEQ ID NO: 596694 - RNA, 14 nt, Homo sapiens
gcagaccucaugcc

SEQ ID NO: 596695 - RNA, 17 nt, Homo sapiens
gcagacuacacaggaug

SEQ ID NO: 596696 - RNA, 13 nt, Homo sapiens
gcagacuaugaau

SEQ ID NO: 596697 - RNA, 15 nt, Homo sapiens
gcagacucauugcag

SEQ ID NO: 596698 - RNA, 23 nt, Homo sapiens
gcagucuucucuucugccuuuau

SEQ ID NO: 596699 - RNA, 15 nt, Homo sapiens
gcagucuuguagcua

SEQ ID NO: 596700 - RNA, 16 nt, Homo sapiens
gcagugagcugagauc

SEQ ID NO: 596701 - RNA, 17 nt, Homo sapiens
gcagugagcuguguucu

SEQ ID NO: 596702 - RNA, 18 nt, Homo sapiens
gcagugagugccaugcuu

SEQ ID NO: 596703 - RNA, 22 nt, Homo sapiens
gcagugaugugaucauagcuca

SEQ ID NO: 596704 - RNA, 12 nt, Homo sapiens
gcagugcaaugc

SEQ ID NO: 596705 - RNA, 20 nt, Homo sapiens
gcagugcuuuucacuacuuu

SEQ ID NO: 596706 - RNA, 20 nt, Homo sapiens
gcaguggagaagacauucug

SEQ ID NO: 596707 - RNA, 23 nt, Homo sapiens
gcaguggcuaguggggugaacag

SEQ ID NO: 596708 - RNA, 16 nt, Homo sapiens
gcaguggcuuuugccc

SEQ ID NO: 596709 - RNA, 22 nt, Homo sapiens
gcaguggugcaaucacagcuca

SEQ ID NO: 596710 - RNA, 14 nt, Homo sapiens
gcaguggugugaaa

SEQ ID NO: 596711 - RNA, 22 nt, Homo sapiens
gcaguggugugaaacacacaau

SEQ ID NO: 596712 - RNA, 20 nt, Homo sapiens
gcaguuacuggggucaccca

SEQ ID NO: 596713 - RNA, 20 nt, Homo sapiens
gcaguuagagcugagcacuu

SEQ ID NO: 596714 - RNA, 17 nt, Homo sapiens
gcaguuccugucccuuc

SEQ ID NO: 596715 - RNA, 12 nt, Homo sapiens
gcaguucuccca

SEQ ID NO: 596716 - RNA, 14 nt, Homo sapiens
gcaguugaguuucu

SEQ ID NO: 596717 - RNA, 17 nt, Homo sapiens
gcaguugauaagaggaa

SEQ ID NO: 596718 - RNA, 18 nt, Homo sapiens
gcaguuuaagagcagaac

SEQ ID NO: 596719 - RNA, 18 nt, Homo sapiens
gcaguuucuaagcaugua

SEQ ID NO: 596720 - RNA, 21 nt, Homo sapiens
gcaguuugcuuuguaugcacu

SEQ ID NO: 596721 - RNA, 21 nt, Homo sapiens
gcaguuuugcuaucugggcug

SEQ ID NO: 596722 - RNA, 15 nt, Homo sapiens
gcauaaaagacuuuu

SEQ ID NO: 596723 - RNA, 13 nt, Homo sapiens
gcauaaagccaaa

SEQ ID NO: 596724 - RNA, 23 nt, Homo sapiens
gcauaaaguaaauacaugcauau

SEQ ID NO: 596725 - RNA, 13 nt, Homo sapiens
gcauaaccugucu

SEQ ID NO: 596726 - RNA, 18 nt, Homo sapiens
gcauaaguuaacuuccaa

SEQ ID NO: 596727 - RNA, 23 nt, Homo sapiens
gcauacaaagagguguacaggua

SEQ ID NO: 596728 - RNA, 15 nt, Homo sapiens
gcauacagagacaga

SEQ ID NO: 596729 - RNA, 20 nt, Homo sapiens
gcauacgguaugauauugca

SEQ ID NO: 596730 - RNA, 21 nt, Homo sapiens
gcauacuacaguaacugugac

SEQ ID NO: 596731 - RNA, 14 nt, Homo sapiens
gcauagauuugcag

SEQ ID NO: 596732 - RNA, 14 nt, Homo sapiens
gcauagcaaacaga

SEQ ID NO: 596733 - RNA, 22 nt, Homo sapiens
gcauagcaguuuguaaaagugu

SEQ ID NO: 596734 - RNA, 20 nt, Homo sapiens
gcauaggccuuagcaguaac

SEQ ID NO: 596735 - RNA, 14 nt, Homo sapiens
gcauaggcucuuaa

SEQ ID NO: 596736 - RNA, 20 nt, Homo sapiens
gcauaggcugacuuuugcag

SEQ ID NO: 596737 - RNA, 15 nt, Homo sapiens
gcauaggugacaggg

SEQ ID NO: 596738 - RNA, 17 nt, Homo sapiens
gcauauauucaguuaua

SEQ ID NO: 596739 - RNA, 21 nt, Homo sapiens
gcauauccaccaccucccuca

SEQ ID NO: 596740 - RNA, 16 nt, Homo sapiens
gcauaugcacagucaa

SEQ ID NO: 596741 - RNA, 15 nt, Homo sapiens
gcauauguugaauac

SEQ ID NO: 596742 - RNA, 21 nt, Homo sapiens
gcauauuggaaagugauuuua

SEQ ID NO: 596743 - RNA, 21 nt, Homo sapiens
gcauauuuauugcauugcugg

SEQ ID NO: 596744 - RNA, 15 nt, Homo sapiens
gcaucaaauauuugu

SEQ ID NO: 596745 - RNA, 13 nt, Homo sapiens
gcaucaaggucag

SEQ ID NO: 596746 - RNA, 14 nt, Homo sapiens
gcaucaaguucucc

SEQ ID NO: 596747 - RNA, 23 nt, Homo sapiens
gcaucaauauacauaauacauga

SEQ ID NO: 596748 - RNA, 21 nt, Homo sapiens
gcaucacgucagugcucagaa

SEQ ID NO: 596749 - RNA, 17 nt, Homo sapiens
gcaucaguagcaucugu

SEQ ID NO: 596750 - RNA, 22 nt, Homo sapiens
gcaucagugggaucccagacau

SEQ ID NO: 596751 - RNA, 15 nt, Homo sapiens
gcaucauaauggacu

SEQ ID NO: 596752 - RNA, 15 nt, Homo sapiens
gcaucaucaaaaacu

SEQ ID NO: 596753 - RNA, 22 nt, Homo sapiens
gcaucauuaaugcacaucugca

SEQ ID NO: 596754 - RNA, 17 nt, Homo sapiens
gcaucauuaguacaucu

SEQ ID NO: 596755 - RNA, 17 nt, Homo sapiens
gcauccaauuuauuaua

SEQ ID NO: 596756 - RNA, 22 nt, Homo sapiens
gcaucccaaaccacgccucuug

SEQ ID NO: 596757 - RNA, 19 nt, Homo sapiens
gcauccccuuggcugugag

SEQ ID NO: 596758 - RNA, 15 nt, Homo sapiens
gcauccugugcuucu

SEQ ID NO: 596759 - RNA, 16 nt, Homo sapiens
gcauccugugcuucua

SEQ ID NO: 596760 - RNA, 19 nt, Homo sapiens
gcauccuguguaaauggaa

SEQ ID NO: 596761 - RNA, 18 nt, Homo sapiens
gcauccuuuucaaaaccu

SEQ ID NO: 596762 - RNA, 19 nt, Homo sapiens
gcauccuuuucaaaaccua

SEQ ID NO: 596763 - RNA, 22 nt, Homo sapiens
gcauccuuuucaaaaccuaaaa

SEQ ID NO: 596764 - RNA, 21 nt, Homo sapiens
gcaucgacacuaaaaacugau

SEQ ID NO: 596765 - RNA, 13 nt, Homo sapiens
gcaucuacucuaa

SEQ ID NO: 596766 - RNA, 20 nt, Homo sapiens
gcaucuagauuauggagcuu

SEQ ID NO: 596767 - RNA, 12 nt, Homo sapiens
gcaucuaucugg

SEQ ID NO: 596768 - RNA, 21 nt, Homo sapiens
gcaucucaaaauuauucugcc

SEQ ID NO: 596769 - RNA, 19 nt, Homo sapiens
gcaucuccccucagauucc

SEQ ID NO: 596770 - RNA, 13 nt, Homo sapiens
gcaucuccugugc

SEQ ID NO: 596771 - RNA, 16 nt, Homo sapiens
gcaucucuucuucccu

SEQ ID NO: 596772 - RNA, 15 nt, Homo sapiens
gcaucugaccagcag

SEQ ID NO: 596773 - RNA, 21 nt, Homo sapiens
gcaucuggguagcuguaaggc

SEQ ID NO: 596774 - RNA, 14 nt, Homo sapiens
gcaucugucagcca

SEQ ID NO: 596775 - RNA, 12 nt, Homo sapiens
gcaucugugaug

SEQ ID NO: 596776 - RNA, 14 nt, Homo sapiens
gcaucuuguuucau

SEQ ID NO: 596777 - RNA, 15 nt, Homo sapiens
gcaucuuguuucaua

SEQ ID NO: 596778 - RNA, 13 nt, Homo sapiens
gcaugaaacaugu

SEQ ID NO: 596779 - RNA, 20 nt, Homo sapiens
gcaugaacccucuugccauc

SEQ ID NO: 596780 - RNA, 13 nt, Homo sapiens
gcaugacacucua

SEQ ID NO: 596781 - RNA, 20 nt, Homo sapiens
gcaugagagaauuguaucau

SEQ ID NO: 596782 - RNA, 20 nt, Homo sapiens
gcaugagccacugcaccuga

SEQ ID NO: 596783 - RNA, 13 nt, Homo sapiens
gcaugagugcuga

SEQ ID NO: 596784 - RNA, 20 nt, Homo sapiens
gcaugaucuuguuacuguga

SEQ ID NO: 596785 - RNA, 16 nt, Homo sapiens
gcaugaugauagcaua

SEQ ID NO: 596786 - RNA, 20 nt, Homo sapiens
gcaugcaccuguagucucac

SEQ ID NO: 596787 - RNA, 23 nt, Homo sapiens
gcaugcagccagccaucaaauag

SEQ ID NO: 596788 - RNA, 21 nt, Homo sapiens
gcaugcauuuugcagcaguga

SEQ ID NO: 596789 - RNA, 17 nt, Homo sapiens
gcaugccaaauguucca

SEQ ID NO: 596790 - RNA, 18 nt, Homo sapiens
gcaugccacccucacaca

SEQ ID NO: 596791 - RNA, 21 nt, Homo sapiens
gcaugcucaguuggugcugcu

SEQ ID NO: 596792 - RNA, 13 nt, Homo sapiens
gcaugcugaaugc

SEQ ID NO: 596793 - RNA, 16 nt, Homo sapiens
gcaugcuuugcugcua

SEQ ID NO: 596794 - RNA, 23 nt, Homo sapiens
gcauggaaaaaugguugauggaa

SEQ ID NO: 596795 - RNA, 17 nt, Homo sapiens
gcauggaaaucagccaa

SEQ ID NO: 596796 - RNA, 18 nt, Homo sapiens
gcauggcaaaucaggggc

SEQ ID NO: 596797 - RNA, 20 nt, Homo sapiens
gcauggccccaguccaugcu

SEQ ID NO: 596798 - RNA, 22 nt, Homo sapiens
gcaugggcuuugucuuggacuc

SEQ ID NO: 596799 - RNA, 21 nt, Homo sapiens
gcauggugcagggagacaucu

SEQ ID NO: 596800 - RNA, 17 nt, Homo sapiens
gcauguauuagcucacu

SEQ ID NO: 596801 - RNA, 18 nt, Homo sapiens
gcauguauuuuugucaau

SEQ ID NO: 596802 - RNA, 22 nt, Homo sapiens
gcauguccuuugcgccugugac

SEQ ID NO: 596803 - RNA, 21 nt, Homo sapiens
gcaugugaagaaaggguguuu

SEQ ID NO: 596804 - RNA, 13 nt, Homo sapiens
gcaugugaucucc

SEQ ID NO: 596805 - RNA, 10 nt, Homo sapiens
gcaugugcag

SEQ ID NO: 596806 - RNA, 14 nt, Homo sapiens
gcaugugcagcuau

SEQ ID NO: 596807 - RNA, 17 nt, Homo sapiens
gcaugugcagcuauuua

SEQ ID NO: 596808 - RNA, 22 nt, Homo sapiens
gcaugugccaagauucuacucu

SEQ ID NO: 596809 - RNA, 15 nt, Homo sapiens
gcaugugcggcugaa

SEQ ID NO: 596810 - RNA, 15 nt, Homo sapiens
gcauguuugugauug

SEQ ID NO: 596811 - RNA, 21 nt, Homo sapiens
gcauuaaaaaaaaaaucaaug

SEQ ID NO: 596812 - RNA, 13 nt, Homo sapiens
gcauuaaauucac

SEQ ID NO: 596813 - RNA, 23 nt, Homo sapiens
gcauuaaccacucuacagacucc

SEQ ID NO: 596814 - RNA, 17 nt, Homo sapiens
gcauuaauagucccauu

SEQ ID NO: 596815 - RNA, 18 nt, Homo sapiens
gcauuacuauucacugau

SEQ ID NO: 596816 - RNA, 16 nt, Homo sapiens
gcauuacuugcuuuca

SEQ ID NO: 596817 - RNA, 15 nt, Homo sapiens
gcauuauggucuaau

SEQ ID NO: 596818 - RNA, 20 nt, Homo sapiens
gcauuauguccacuguguau

SEQ ID NO: 596819 - RNA, 13 nt, Homo sapiens
gccacuguguacu

SEQ ID NO: 596820 - RNA, 22 nt, Homo sapiens
gccacugugucuuaugaggaau

SEQ ID NO: 596821 - RNA, 19 nt, Homo sapiens
gccacuuagaauagcauuu

SEQ ID NO: 596822 - RNA, 12 nt, Homo sapiens
gccacuucucac

SEQ ID NO: 596823 - RNA, 14 nt, Homo sapiens
gccacuugacauuc

SEQ ID NO: 596824 - RNA, 16 nt, Homo sapiens
gccagaaaaggcauuu

SEQ ID NO: 596825 - RNA, 22 nt, Homo sapiens
gccagaaagcauaaaauucuua

SEQ ID NO: 596826 - RNA, 23 nt, Homo sapiens
gccagaagucacauuuuaccaau

SEQ ID NO: 596827 - RNA, 13 nt, Homo sapiens
gccagaauacugg

SEQ ID NO: 596828 - RNA, 20 nt, Homo sapiens
gccagaaucagguuuccaau

SEQ ID NO: 596829 - RNA, 17 nt, Homo sapiens
gccagacaaaauuugag

SEQ ID NO: 596830 - RNA, 18 nt, Homo sapiens
gccagaccauggacacua

SEQ ID NO: 596831 - RNA, 12 nt, Homo sapiens
gccagaccucaa

SEQ ID NO: 596832 - RNA, 23 nt, Homo sapiens
gccagagaauagaucaguauuuc

SEQ ID NO: 596833 - RNA, 13 nt, Homo sapiens
gccagagccucug

SEQ ID NO: 596834 - RNA, 18 nt, Homo sapiens
gccagagcgugcuuucaa

SEQ ID NO: 596835 - RNA, 17 nt, Homo sapiens
gccagaggagaagacaa

SEQ ID NO: 596836 - RNA, 18 nt, Homo sapiens
gccagaggcucuaaugua

SEQ ID NO: 596837 - RNA, 16 nt, Homo sapiens
gccagaggugcuucac

SEQ ID NO: 596838 - RNA, 12 nt, Homo sapiens
gccagagucucc

SEQ ID NO: 596839 - RNA, 16 nt, Homo sapiens
gccagauccacccuau

SEQ ID NO: 596840 - RNA, 16 nt, Homo sapiens
gccagaugauuguuca

SEQ ID NO: 596841 - RNA, 22 nt, Homo sapiens
gccagauggccccuccacuggg

SEQ ID NO: 596842 - RNA, 14 nt, Homo sapiens
gccagcaaugacau

SEQ ID NO: 596843 - RNA, 11 nt, Homo sapiens
gccagcacuuc

SEQ ID NO: 596844 - RNA, 11 nt, Homo sapiens
gccagcauuuu

SEQ ID NO: 596845 - RNA, 16 nt, Homo sapiens
gccagccagugccauu

SEQ ID NO: 596846 - RNA, 15 nt, Homo sapiens
gccagcccacugccu

SEQ ID NO: 596847 - RNA, 21 nt, Homo sapiens
gccagcccacugccuccugcc

SEQ ID NO: 596848 - RNA, 19 nt, Homo sapiens
gccagcccuccuugaccca

SEQ ID NO: 596849 - RNA, 13 nt, Homo sapiens
gccagccucagug

SEQ ID NO: 596850 - RNA, 17 nt, Homo sapiens
gccagccucagugccac

SEQ ID NO: 596851 - RNA, 20 nt, Homo sapiens
gccagccugguccaugcagg

SEQ ID NO: 596852 - RNA, 21 nt, Homo sapiens
gccagccugucccauggacac

SEQ ID NO: 596853 - RNA, 23 nt, Homo sapiens
gccagcuaauaagaagugccaag

SEQ ID NO: 596854 - RNA, 18 nt, Homo sapiens
gccagcuccucucugaag

SEQ ID NO: 596855 - RNA, 15 nt, Homo sapiens
gccagcucucucuac

SEQ ID NO: 596856 - RNA, 22 nt, Homo sapiens
gccagcugaagaguaaaggaaa

SEQ ID NO: 596857 - RNA, 22 nt, Homo sapiens
gccagcugcugcuggaucacag

SEQ ID NO: 596858 - RNA, 23 nt, Homo sapiens
gccagcuuaaacccauacaaugu

SEQ ID NO: 596859 - RNA, 17 nt, Homo sapiens
gccaggaaguacuucca

SEQ ID NO: 596860 - RNA, 12 nt, Homo sapiens
gccaggacugug

SEQ ID NO: 596861 - RNA, 16 nt, Homo sapiens
gccaggagaagcucag

SEQ ID NO: 596862 - RNA, 17 nt, Homo sapiens
gccaggaggccugcuag

SEQ ID NO: 596863 - RNA, 20 nt, Homo sapiens
gccaggagguuggugacuga

SEQ ID NO: 596864 - RNA, 17 nt, Homo sapiens
gccaggcacugcccuuu

SEQ ID NO: 596865 - RNA, 13 nt, Homo sapiens
gccaggcagaucc

SEQ ID NO: 596866 - RNA, 17 nt, Homo sapiens
gccaggcaugguggcac

SEQ ID NO: 596867 - RNA, 15 nt, Homo sapiens
gccaggccaccagga

SEQ ID NO: 596868 - RNA, 21 nt, Homo sapiens
gccaggccucuuggcagucac

SEQ ID NO: 596869 - RNA, 18 nt, Homo sapiens
gccaggcguuggugccac

SEQ ID NO: 596870 - RNA, 23 nt, Homo sapiens
gccaggcugccucggacuccaug

SEQ ID NO: 596871 - RNA, 19 nt, Homo sapiens
gccaggcugccugugugca

SEQ ID NO: 596872 - RNA, 20 nt, Homo sapiens
gccaggcuggagugcagugg

SEQ ID NO: 596873 - RNA, 23 nt, Homo sapiens
gccaggcuguuggaaaauccaga

SEQ ID NO: 596874 - RNA, 13 nt, Homo sapiens
gccagggacccaa

SEQ ID NO: 596875 - RNA, 18 nt, Homo sapiens
gccagggcaaugaugaau

SEQ ID NO: 596876 - RNA, 15 nt, Homo sapiens
gccagggcagaggaa

SEQ ID NO: 596877 - RNA, 16 nt, Homo sapiens
gccagggcugcccuga

SEQ ID NO: 596878 - RNA, 17 nt, Homo sapiens
gccaggggcgaggcccu

SEQ ID NO: 596879 - RNA, 21 nt, Homo sapiens
gccaggggcuucccacuuugg

SEQ ID NO: 596880 - RNA, 21 nt, Homo sapiens
gccagggggaugccacuccuc

SEQ ID NO: 596881 - RNA, 14 nt, Homo sapiens
gccagggugacaga

SEQ ID NO: 596882 - RNA, 22 nt, Homo sapiens
gccagggugggaagagaagaaa

SEQ ID NO: 596883 - RNA, 13 nt, Homo sapiens
gccagggugggcu

SEQ ID NO: 596884 - RNA, 21 nt, Homo sapiens
gccaggguggucuugaucucc

SEQ ID NO: 596885 - RNA, 13 nt, Homo sapiens
gccaggugcaaaa

SEQ ID NO: 596886 - RNA, 23 nt, Homo sapiens
gccaggugcaaucuacuggaaau

SEQ ID NO: 596887 - RNA, 12 nt, Homo sapiens
gccagguggcca

SEQ ID NO: 596888 - RNA, 13 nt, Homo sapiens
gccaguacagccu

SEQ ID NO: 596889 - RNA, 20 nt, Homo sapiens
gccaguagcuaaagugcaag

SEQ ID NO: 596890 - RNA, 15 nt, Homo sapiens
gccaguauuaugcau

SEQ ID NO: 596891 - RNA, 20 nt, Homo sapiens
gccagucaggcccaggcacu

SEQ ID NO: 596892 - RNA, 18 nt, Homo sapiens
gccagucagguuauuuaa

SEQ ID NO: 596893 - RNA, 14 nt, Homo sapiens
gccagugacacuaa

SEQ ID NO: 596894 - RNA, 12 nt, Homo sapiens
gccagugacaga

SEQ ID NO: 596895 - RNA, 11 nt, Homo sapiens
gccagugacuu

SEQ ID NO: 596896 - RNA, 17 nt, Homo sapiens
gccagugagcugugauc

SEQ ID NO: 596897 - RNA, 15 nt, Homo sapiens
gccagugccauucca

SEQ ID NO: 596898 - RNA, 16 nt, Homo sapiens
gccagugccauuccac

SEQ ID NO: 596899 - RNA, 21 nt, Homo sapiens
gccagugccauuccacuccac

SEQ ID NO: 596900 - RNA, 23 nt, Homo sapiens
gccagugcuuuaauggcauguca

SEQ ID NO: 596901 - RNA, 17 nt, Homo sapiens
gccaguggagcuggucu

SEQ ID NO: 596902 - RNA, 13 nt, Homo sapiens
gccaguggugcua

SEQ ID NO: 596903 - RNA, 10 nt, Homo sapiens
gccagugugu

SEQ ID NO: 596904 - RNA, 15 nt, Homo sapiens
gccaguuaauuuuaa

SEQ ID NO: 596905 - RNA, 22 nt, Homo sapiens
gccaguucuccuucccugcaga

SEQ ID NO: 596906 - RNA, 14 nt, Homo sapiens
gccauaacagacca

SEQ ID NO: 596907 - RNA, 14 nt, Homo sapiens
gccauaacuugaaa

SEQ ID NO: 596908 - RNA, 18 nt, Homo sapiens
gccauaagcaagucuaua

SEQ ID NO: 596909 - RNA, 13 nt, Homo sapiens
gccauacugccuu

SEQ ID NO: 596910 - RNA, 15 nt, Homo sapiens
gccauaggugcaguu

SEQ ID NO: 596911 - RNA, 21 nt, Homo sapiens
gccauauaaguuugaaggaaa

SEQ ID NO: 596912 - RNA, 14 nt, Homo sapiens
gccauauauauuuc

SEQ ID NO: 596913 - RNA, 23 nt, Homo sapiens
gccauauuaauugccuguuaaau

SEQ ID NO: 596914 - RNA, 18 nt, Homo sapiens
gccauauucacaccucac

SEQ ID NO: 596915 - RNA, 18 nt, Homo sapiens
gccaucacuagaagaaaa

SEQ ID NO: 596916 - RNA, 21 nt, Homo sapiens
gccaucacucuuguacugccu

SEQ ID NO: 596917 - RNA, 16 nt, Homo sapiens
gccauccccaccuuca

SEQ ID NO: 596918 - RNA, 15 nt, Homo sapiens
gccauccuacccagc

SEQ ID NO: 596919 - RNA, 17 nt, Homo sapiens
gccauccucccaagggg

SEQ ID NO: 596920 - RNA, 15 nt, Homo sapiens
gccaucgccaaguaa

SEQ ID NO: 596921 - RNA, 20 nt, Homo sapiens
gccaucggugaaacuaacag

SEQ ID NO: 596922 - RNA, 14 nt, Homo sapiens
gccaucguccuggg

SEQ ID NO: 596923 - RNA, 17 nt, Homo sapiens
gccaucguccugggacu

SEQ ID NO: 596924 - RNA, 22 nt, Homo sapiens
gccaucucaacgccucuccuca

SEQ ID NO: 596925 - RNA, 15 nt, Homo sapiens
gccaucucuuccuca

SEQ ID NO: 596926 - RNA, 16 nt, Homo sapiens
gccaucucuuccucau

SEQ ID NO: 596927 - RNA, 15 nt, Homo sapiens
gccaugacauuucau

SEQ ID NO: 596928 - RNA, 22 nt, Homo sapiens
gccaugagaugauacauccaaa

SEQ ID NO: 596929 - RNA, 22 nt, Homo sapiens
gccaugauggccuuacacugaa

SEQ ID NO: 596930 - RNA, 22 nt, Homo sapiens
gccaugauguauauccauauaa

SEQ ID NO: 596931 - RNA, 21 nt, Homo sapiens
gccaugcagaccucaugccca

SEQ ID NO: 596932 - RNA, 19 nt, Homo sapiens
gccauggacucuacacugu

SEQ ID NO: 596933 - RNA, 22 nt, Homo sapiens
gccaugggaccuccucccucau

SEQ ID NO: 596934 - RNA, 14 nt, Homo sapiens
gccaugggguccau

SEQ ID NO: 596935 - RNA, 20 nt, Homo sapiens
gccauguaccuccccugccu

SEQ ID NO: 596936 - RNA, 21 nt, Homo sapiens
gccaugucaccuggcugcuag

SEQ ID NO: 596937 - RNA, 15 nt, Homo sapiens
gccauguccaaagag

SEQ ID NO: 596938 - RNA, 16 nt, Homo sapiens
gccauguccaaagagg

SEQ ID NO: 596939 - RNA, 17 nt, Homo sapiens
gccauguuuagauucca

SEQ ID NO: 596940 - RNA, 14 nt, Homo sapiens
gccauuacuacugu

SEQ ID NO: 596941 - RNA, 19 nt, Homo sapiens
gcccgcugccugcacugga

SEQ ID NO: 596942 - RNA, 18 nt, Homo sapiens
gcccggaccuccaucaga

SEQ ID NO: 596943 - RNA, 21 nt, Homo sapiens
gcccgucauguuccucaaaag

SEQ ID NO: 596944 - RNA, 21 nt, Homo sapiens
gcccgugcccccgccugccac

SEQ ID NO: 596945 - RNA, 15 nt, Homo sapiens
gcccuaaaagcacac

SEQ ID NO: 596946 - RNA, 20 nt, Homo sapiens
gcccuaaaagcacacucauc

SEQ ID NO: 596947 - RNA, 21 nt, Homo sapiens
gcccuaaccccuuccagauca

SEQ ID NO: 596948 - RNA, 16 nt, Homo sapiens
gcccuaagggacuuaa

SEQ ID NO: 596949 - RNA, 16 nt, Homo sapiens
gcccuacaaugcucau

SEQ ID NO: 596950 - RNA, 21 nt, Homo sapiens
gcccuaccccgccccaguauc

SEQ ID NO: 596951 - RNA, 22 nt, Homo sapiens
gcccuaccccgccccaguauca

SEQ ID NO: 596952 - RNA, 21 nt, Homo sapiens
gcccuaccugauuggugcaac

SEQ ID NO: 596953 - RNA, 16 nt, Homo sapiens
gcccuacucccugcag

SEQ ID NO: 596954 - RNA, 19 nt, Homo sapiens
gcccuaggggagcaccgug

SEQ ID NO: 596955 - RNA, 20 nt, Homo sapiens
gcccuauucuuucuauucag

SEQ ID NO: 596956 - RNA, 17 nt, Homo sapiens
gcccucacaucuuccac

SEQ ID NO: 596957 - RNA, 11 nt, Homo sapiens
gcccucaccag

SEQ ID NO: 596958 - RNA, 16 nt, Homo sapiens
gcccucagacauuuau

SEQ ID NO: 596959 - RNA, 18 nt, Homo sapiens
gcccuccaaaagcacuua

SEQ ID NO: 596960 - RNA, 18 nt, Homo sapiens
gcccuccccacaaugcca

SEQ ID NO: 596961 - RNA, 16 nt, Homo sapiens
gcccuccccagacucc

SEQ ID NO: 596962 - RNA, 20 nt, Homo sapiens
gcccuccccagagcacuggg

SEQ ID NO: 596963 - RNA, 16 nt, Homo sapiens
gcccucccgcaccuuc

SEQ ID NO: 596964 - RNA, 16 nt, Homo sapiens
gcccuccgaccucucu

SEQ ID NO: 596965 - RNA, 17 nt, Homo sapiens
gcccuccucccugucau

SEQ ID NO: 596966 - RNA, 13 nt, Homo sapiens
gcccucuaccuga

SEQ ID NO: 596967 - RNA, 12 nt, Homo sapiens
gcccucucaggu

SEQ ID NO: 596968 - RNA, 21 nt, Homo sapiens
gcccucuuaucucauccuuuc

SEQ ID NO: 596969 - RNA, 20 nt, Homo sapiens
gcccugaauccauaaaggca

SEQ ID NO: 596970 - RNA, 14 nt, Homo sapiens
gcccugacccugug

SEQ ID NO: 596971 - RNA, 16 nt, Homo sapiens
gcccugaggaccucuc

SEQ ID NO: 596972 - RNA, 17 nt, Homo sapiens
gcccugaggccuagacu

SEQ ID NO: 596973 - RNA, 18 nt, Homo sapiens
gcccugaucuagugcagu

SEQ ID NO: 596974 - RNA, 18 nt, Homo sapiens
gcccugcaccugacagcu

SEQ ID NO: 596975 - RNA, 16 nt, Homo sapiens
gcccugcagagcaaua

SEQ ID NO: 596976 - RNA, 18 nt, Homo sapiens
gcccugcagagcaauaac

SEQ ID NO: 596977 - RNA, 18 nt, Homo sapiens
gcccugcagggaguaccg

SEQ ID NO: 596978 - RNA, 22 nt, Homo sapiens
gcccugcaugcugcccagccac

SEQ ID NO: 596979 - RNA, 16 nt, Homo sapiens
gcccugcccauacuga

SEQ ID NO: 596980 - RNA, 20 nt, Homo sapiens
gcccugcccuccuuugccuu

SEQ ID NO: 596981 - RNA, 18 nt, Homo sapiens
gcccugcgaaguggcucu

SEQ ID NO: 596982 - RNA, 20 nt, Homo sapiens
gcccugcucccagacauaaa

SEQ ID NO: 596983 - RNA, 20 nt, Homo sapiens
gcccuggaaggugccacucc

SEQ ID NO: 596984 - RNA, 15 nt, Homo sapiens
gcccuggaggcggug

SEQ ID NO: 596985 - RNA, 18 nt, Homo sapiens
gcccuggagggaggcucu

SEQ ID NO: 596986 - RNA, 14 nt, Homo sapiens
gcccuggauccauc

SEQ ID NO: 596987 - RNA, 18 nt, Homo sapiens
gcccuggaugcccaggaa

SEQ ID NO: 596988 - RNA, 22 nt, Homo sapiens
gcccuggcaggcagguguuuau

SEQ ID NO: 596989 - RNA, 20 nt, Homo sapiens
gcccuggcugaccccaaaga

SEQ ID NO: 596990 - RNA, 16 nt, Homo sapiens
gcccuggcuggguuca

SEQ ID NO: 596991 - RNA, 19 nt, Homo sapiens
gcccuggguuuaaugucaa

SEQ ID NO: 596992 - RNA, 17 nt, Homo sapiens
gcccuggugcuccugcc

SEQ ID NO: 596993 - RNA, 19 nt, Homo sapiens
gcccugguguguuuccaga

SEQ ID NO: 596994 - RNA, 13 nt, Homo sapiens
gcccugugcaacc

SEQ ID NO: 596995 - RNA, 22 nt, Homo sapiens
gcccuguguguuugacauguga

SEQ ID NO: 596996 - RNA, 16 nt, Homo sapiens
gcccuguucagcuacu

SEQ ID NO: 596997 - RNA, 22 nt, Homo sapiens
gcccuuacuugcuucucuagcu

SEQ ID NO: 596998 - RNA, 15 nt, Homo sapiens
gcccuucccacugga

SEQ ID NO: 596999 - RNA, 18 nt, Homo sapiens
gcccuucccccugcaaaa

SEQ ID NO: 597000 - RNA, 23 nt, Homo sapiens
gcccuuccccuucccacacuguc

SEQ ID NO: 597001 - RNA, 22 nt, Homo sapiens
gcccuuccuccugaagccucug

SEQ ID NO: 597002 - RNA, 18 nt, Homo sapiens
gcccuuccucuccacugc

SEQ ID NO: 597003 - RNA, 22 nt, Homo sapiens
gcccuucucucauuauuucucu

SEQ ID NO: 597004 - RNA, 20 nt, Homo sapiens
gcccuugagugcuuguuaga

SEQ ID NO: 597005 - RNA, 21 nt, Homo sapiens
gcccuugcccugaccucccag

SEQ ID NO: 597006 - RNA, 18 nt, Homo sapiens
gcccuuggcaccaccagg

SEQ ID NO: 597007 - RNA, 19 nt, Homo sapiens
gcccuuggcuucugugaug

SEQ ID NO: 597008 - RNA, 14 nt, Homo sapiens
gcccuuguccugcc

SEQ ID NO: 597009 - RNA, 22 nt, Homo sapiens
gcccuuguugucucugucucuc

SEQ ID NO: 597010 - RNA, 23 nt, Homo sapiens
gcccuuuauuuauaauacauuuc

SEQ ID NO: 597011 - RNA, 17 nt, Homo sapiens
gcccuuuggaaagccau

SEQ ID NO: 597012 - RNA, 18 nt, Homo sapiens
gccgaaaaggauaugcag

SEQ ID NO: 597013 - RNA, 19 nt, Homo sapiens
gccgacugccugugaagug

SEQ ID NO: 597014 - RNA, 23 nt, Homo sapiens
gccgagaacaccgagcacugaac

SEQ ID NO: 597015 - RNA, 21 nt, Homo sapiens
gccgagaucacgccacugcac

SEQ ID NO: 597016 - RNA, 21 nt, Homo sapiens
gccgagaucgcgccacugcac

SEQ ID NO: 597017 - RNA, 21 nt, Homo sapiens
gccgagauugcaccacugcac

SEQ ID NO: 597018 - RNA, 19 nt, Homo sapiens
gccgagccugcacuggggc

SEQ ID NO: 597019 - RNA, 17 nt, Homo sapiens
gccgaggccugcauguc

SEQ ID NO: 597020 - RNA, 19 nt, Homo sapiens
gccgcauucccugagucac

SEQ ID NO: 597021 - RNA, 17 nt, Homo sapiens
gccgccaggacuguguu

SEQ ID NO: 597022 - RNA, 17 nt, Homo sapiens
gccgccaguacuuguca

SEQ ID NO: 597023 - RNA, 15 nt, Homo sapiens
gccgcgugugcgugg

SEQ ID NO: 597024 - RNA, 17 nt, Homo sapiens
gccgcugggguguuaau

SEQ ID NO: 597025 - RNA, 17 nt, Homo sapiens
gccggaggcugcaguga

SEQ ID NO: 597026 - RNA, 23 nt, Homo sapiens
gccggcaaccccaguucugcucc

SEQ ID NO: 597027 - RNA, 18 nt, Homo sapiens
gccgggcaugguggcaca

SEQ ID NO: 597028 - RNA, 13 nt, Homo sapiens
gccgggcgcagug

SEQ ID NO: 597029 - RNA, 14 nt, Homo sapiens
gccgggcgcagugg

SEQ ID NO: 597030 - RNA, 21 nt, Homo sapiens
gccgggcuuuuccaagcugcc

SEQ ID NO: 597031 - RNA, 13 nt, Homo sapiens
gccggggacugcc

SEQ ID NO: 597032 - RNA, 23 nt, Homo sapiens
gccggucauggugguggacaccu

SEQ ID NO: 597033 - RNA, 20 nt, Homo sapiens
gccgugauuuucauugcugg

SEQ ID NO: 597034 - RNA, 23 nt, Homo sapiens
gccuaaaaguuacuuaccacaga

SEQ ID NO: 597035 - RNA, 23 nt, Homo sapiens
gccuaaaucccaagaaauggaau

SEQ ID NO: 597036 - RNA, 22 nt, Homo sapiens
gccuaaauuuaaugcugccuuu

SEQ ID NO: 597037 - RNA, 16 nt, Homo sapiens
gccuaaggugucugag

SEQ ID NO: 597038 - RNA, 17 nt, Homo sapiens
gccuaauacaacaugua

SEQ ID NO: 597039 - RNA, 16 nt, Homo sapiens
gccuaaucacucugag

SEQ ID NO: 597040 - RNA, 21 nt, Homo sapiens
gccuacuuucacacuaagaaa

SEQ ID NO: 597041 - RNA, 22 nt, Homo sapiens
gccuagcccuccccccagcucc

SEQ ID NO: 597042 - RNA, 20 nt, Homo sapiens
gccuaggggucagggaccaa

SEQ ID NO: 597043 - RNA, 14 nt, Homo sapiens
gccuauaauacuug

SEQ ID NO: 597044 - RNA, 16 nt, Homo sapiens
gccuaugcaaaccagc

SEQ ID NO: 597045 - RNA, 21 nt, Homo sapiens
gccucaagcaauccaccugcc

SEQ ID NO: 597046 - RNA, 19 nt, Homo sapiens
gccucaccguccucaccca

SEQ ID NO: 597047 - RNA, 20 nt, Homo sapiens
gccucaccguccucacccau

SEQ ID NO: 597048 - RNA, 19 nt, Homo sapiens
gccucacuugauucaucuc

SEQ ID NO: 597049 - RNA, 16 nt, Homo sapiens
gccucagaauaaaaga

SEQ ID NO: 597050 - RNA, 15 nt, Homo sapiens
gccucagccagagaa

SEQ ID NO: 597051 - RNA, 18 nt, Homo sapiens
gccucagccauucacugc

SEQ ID NO: 597052 - RNA, 16 nt, Homo sapiens
gccucaggcacucucc

SEQ ID NO: 597053 - RNA, 14 nt, Homo sapiens
gccucagugccacu

SEQ ID NO: 597054 - RNA, 22 nt, Homo sapiens
gccucauugugccaagccuucu

SEQ ID NO: 597055 - RNA, 16 nt, Homo sapiens
gccuccaaacacagau

SEQ ID NO: 597056 - RNA, 17 nt, Homo sapiens
gccuccaaaguggagcu

SEQ ID NO: 597057 - RNA, 19 nt, Homo sapiens
gccuccagagaccccagga

SEQ ID NO: 597058 - RNA, 14 nt, Homo sapiens
gccuccauccaucu

SEQ ID NO: 597059 - RNA, 22 nt, Homo sapiens
gccuccaugauggaagaugaua

SEQ ID NO: 597060 - RNA, 21 nt, Homo sapiens
gccucccaaagugcugggaug

SEQ ID NO: 597061 - RNA, 17 nt, Homo sapiens
guaaaauccacagcuau

SEQ ID NO: 597062 - RNA, 14 nt, Homo sapiens
guaaaaucuuggca

SEQ ID NO: 597063 - RNA, 17 nt, Homo sapiens
guaaaauggaggccauu

SEQ ID NO: 597064 - RNA, 13 nt, Homo sapiens
guaaaauugaaag

SEQ ID NO: 597065 - RNA, 14 nt, Homo sapiens
guaaacaaaccaca

SEQ ID NO: 597066 - RNA, 12 nt, Homo sapiens
guaaacaaugaa

SEQ ID NO: 597067 - RNA, 23 nt, Homo sapiens
guaaacacauguucugugccugc

SEQ ID NO: 597068 - RNA, 12 nt, Homo sapiens
guaaacagauuu

SEQ ID NO: 597069 - RNA, 14 nt, Homo sapiens
guaaacgacacucu

SEQ ID NO: 597070 - RNA, 12 nt, Homo sapiens
guaaacugccau

SEQ ID NO: 597071 - RNA, 14 nt, Homo sapiens
guaaacugugcacc

SEQ ID NO: 597072 - RNA, 20 nt, Homo sapiens
guaaacugugcuagugcuga

SEQ ID NO: 597073 - RNA, 14 nt, Homo sapiens
guaaagaaaaccau

SEQ ID NO: 597074 - RNA, 14 nt, Homo sapiens
guaaagauauuuga

SEQ ID NO: 597075 - RNA, 17 nt, Homo sapiens
guaaagauuaaaaccaa

SEQ ID NO: 597076 - RNA, 15 nt, Homo sapiens
guaaagcaaauauag

SEQ ID NO: 597077 - RNA, 19 nt, Homo sapiens
guaaagccagccaugcauu

SEQ ID NO: 597078 - RNA, 15 nt, Homo sapiens
guaaaggccuuuaau

SEQ ID NO: 597079 - RNA, 13 nt, Homo sapiens
guaaagguuucaa

SEQ ID NO: 597080 - RNA, 22 nt, Homo sapiens
guaaauaaaugugaaacaucuu

SEQ ID NO: 597081 - RNA, 14 nt, Homo sapiens
guaaauaacaggca

SEQ ID NO: 597082 - RNA, 20 nt, Homo sapiens
guaaauaauuuucuaagaca

SEQ ID NO: 597083 - RNA, 13 nt, Homo sapiens
guaaauacaguag

SEQ ID NO: 597084 - RNA, 20 nt, Homo sapiens
guaaauacuguaaaugcauu

SEQ ID NO: 597085 - RNA, 18 nt, Homo sapiens
guaaaucaggacaggugg

SEQ ID NO: 597086 - RNA, 21 nt, Homo sapiens
guaaaugcucgugugauuucc

SEQ ID NO: 597087 - RNA, 14 nt, Homo sapiens
guaaaugguguaca

SEQ ID NO: 597088 - RNA, 15 nt, Homo sapiens
guaaauguccugcua

SEQ ID NO: 597089 - RNA, 23 nt, Homo sapiens
guaaaugugacauugauuugcuc

SEQ ID NO: 597090 - RNA, 18 nt, Homo sapiens
guaaauguggauuuugua

SEQ ID NO: 597091 - RNA, 18 nt, Homo sapiens
guaaauguguuagcacug

SEQ ID NO: 597092 - RNA, 20 nt, Homo sapiens
guaaauguguuagcacugau

SEQ ID NO: 597093 - RNA, 15 nt, Homo sapiens
guaaauguuuagguu

SEQ ID NO: 597094 - RNA, 21 nt, Homo sapiens
guaaauugacguacuugcagu

SEQ ID NO: 597095 - RNA, 13 nt, Homo sapiens
guaacaacugugg

SEQ ID NO: 597096 - RNA, 19 nt, Homo sapiens
guaacaacuguggucaauc

SEQ ID NO: 597097 - RNA, 18 nt, Homo sapiens
guaacaauuauguuuuca

SEQ ID NO: 597098 - RNA, 15 nt, Homo sapiens
guaacaguuauauca

SEQ ID NO: 597099 - RNA, 13 nt, Homo sapiens
guaacauaaugca

SEQ ID NO: 597100 - RNA, 16 nt, Homo sapiens
guaacauuugcuguuu

SEQ ID NO: 597101 - RNA, 16 nt, Homo sapiens
guaaccacaacuuuca

SEQ ID NO: 597102 - RNA, 21 nt, Homo sapiens
guaaccaggucguccaagcaa

SEQ ID NO: 597103 - RNA, 16 nt, Homo sapiens
guaacccugucuggau

SEQ ID NO: 597104 - RNA, 13 nt, Homo sapiens
guaacuacugcua

SEQ ID NO: 597105 - RNA, 21 nt, Homo sapiens
guaacucagacauuccaaggg

SEQ ID NO: 597106 - RNA, 16 nt, Homo sapiens
guaacuccaccaaccc

SEQ ID NO: 597107 - RNA, 19 nt, Homo sapiens
guaacuccccucagggaua

SEQ ID NO: 597108 - RNA, 16 nt, Homo sapiens
guaacucuaugaacuu

SEQ ID NO: 597109 - RNA, 23 nt, Homo sapiens
guaacugcucuugaacauugugg

SEQ ID NO: 597110 - RNA, 16 nt, Homo sapiens
guaacuggggggccac

SEQ ID NO: 597111 - RNA, 19 nt, Homo sapiens
guaacugugccaguucuuu

SEQ ID NO: 597112 - RNA, 18 nt, Homo sapiens
guaacuuucauaccacuu

SEQ ID NO: 597113 - RNA, 18 nt, Homo sapiens
guaagaaaagcugaugag

SEQ ID NO: 597114 - RNA, 12 nt, Homo sapiens
guaagaaaguga

SEQ ID NO: 597115 - RNA, 18 nt, Homo sapiens
guaagaaagugaagcaaa

SEQ ID NO: 597116 - RNA, 18 nt, Homo sapiens
guaagaacuguacauugu

SEQ ID NO: 597117 - RNA, 13 nt, Homo sapiens
guaagaagagcca

SEQ ID NO: 597118 - RNA, 14 nt, Homo sapiens
guaagaaggcaaua

SEQ ID NO: 597119 - RNA, 13 nt, Homo sapiens
guaagaaguaaua

SEQ ID NO: 597120 - RNA, 14 nt, Homo sapiens
guaagaauauagua

SEQ ID NO: 597121 - RNA, 15 nt, Homo sapiens
guaagacgaaugauu

SEQ ID NO: 597122 - RNA, 14 nt, Homo sapiens
guaagaugcacuga

SEQ ID NO: 597123 - RNA, 14 nt, Homo sapiens
guaagcauucugag

SEQ ID NO: 597124 - RNA, 20 nt, Homo sapiens
guaagccaguuggcuucuaa

SEQ ID NO: 597125 - RNA, 16 nt, Homo sapiens
guaagccaugaucaua

SEQ ID NO: 597126 - RNA, 15 nt, Homo sapiens
guaagcgauuugaaa

SEQ ID NO: 597127 - RNA, 14 nt, Homo sapiens
guaaggacuguaaa

SEQ ID NO: 597128 - RNA, 19 nt, Homo sapiens
guaaggaguuuuuuuguca

SEQ ID NO: 597129 - RNA, 21 nt, Homo sapiens
guaaggaguuuuuuugucaga

SEQ ID NO: 597130 - RNA, 23 nt, Homo sapiens
guaaggauguauguggugaaaac

SEQ ID NO: 597131 - RNA, 15 nt, Homo sapiens
guaaggcacacccaa

SEQ ID NO: 597132 - RNA, 22 nt, Homo sapiens
guaaguaaauugccugauuugu

SEQ ID NO: 597133 - RNA, 20 nt, Homo sapiens
guaaguaccacucaggccaa

SEQ ID NO: 597134 - RNA, 17 nt, Homo sapiens
guaaguauaaaugaauu

SEQ ID NO: 597135 - RNA, 13 nt, Homo sapiens
guaagugcugcua

SEQ ID NO: 597136 - RNA, 15 nt, Homo sapiens
guaagugcugcuaua

SEQ ID NO: 597137 - RNA, 19 nt, Homo sapiens
guaaguuauagaagagaaa

SEQ ID NO: 597138 - RNA, 16 nt, Homo sapiens
guaaguuaucuuugaa

SEQ ID NO: 597139 - RNA, 18 nt, Homo sapiens
guaaguuuaccuauguaa

SEQ ID NO: 597140 - RNA, 20 nt, Homo sapiens
guaauaaaagugguuugugg

SEQ ID NO: 597141 - RNA, 20 nt, Homo sapiens
guaauaaaccuccuucggga

SEQ ID NO: 597142 - RNA, 21 nt, Homo sapiens
guaauaaaucuaggaugugau

SEQ ID NO: 597143 - RNA, 22 nt, Homo sapiens
guaauaacauuuuauacaauuu

SEQ ID NO: 597144 - RNA, 17 nt, Homo sapiens
guaauaagcaaucaagg

SEQ ID NO: 597145 - RNA, 14 nt, Homo sapiens
guaauaagcacuug

SEQ ID NO: 597146 - RNA, 19 nt, Homo sapiens
guaauaauacagccaaaga

SEQ ID NO: 597147 - RNA, 22 nt, Homo sapiens
guaauaauguuauuauuacucu

SEQ ID NO: 597148 - RNA, 16 nt, Homo sapiens
guaauacaucaaagag

SEQ ID NO: 597149 - RNA, 18 nt, Homo sapiens
guaauaccugauugauca

SEQ ID NO: 597150 - RNA, 13 nt, Homo sapiens
guaauacuggaau

SEQ ID NO: 597151 - RNA, 20 nt, Homo sapiens
guaauagauuguuuugccac

SEQ ID NO: 597152 - RNA, 21 nt, Homo sapiens
guaauagauuguuuugccacu

SEQ ID NO: 597153 - RNA, 16 nt, Homo sapiens
guaauaugaaugcugu

SEQ ID NO: 597154 - RNA, 14 nt, Homo sapiens
guaauauguuacaa

SEQ ID NO: 597155 - RNA, 16 nt, Homo sapiens
guaaucaagggucauu

SEQ ID NO: 597156 - RNA, 22 nt, Homo sapiens
guaaucagcaauaaaaauccua

SEQ ID NO: 597157 - RNA, 16 nt, Homo sapiens
guaaucccaacacuuu

SEQ ID NO: 597158 - RNA, 15 nt, Homo sapiens
guaaucccagcacuu

SEQ ID NO: 597159 - RNA, 16 nt, Homo sapiens
guaaucccagcacuuu

SEQ ID NO: 597160 - RNA, 18 nt, Homo sapiens
guaaucuuuuucuccacc

SEQ ID NO: 597161 - RNA, 21 nt, Homo sapiens
guaaugacaaauaaguggaaa

SEQ ID NO: 597162 - RNA, 21 nt, Homo sapiens
guaaugauguugauaauuuca

SEQ ID NO: 597163 - RNA, 20 nt, Homo sapiens
guaauuaaguacuauguauc

SEQ ID NO: 597164 - RNA, 12 nt, Homo sapiens
guaauugcacau

SEQ ID NO: 597165 - RNA, 16 nt, Homo sapiens
guaauugccuacaaua

SEQ ID NO: 597166 - RNA, 22 nt, Homo sapiens
guaauuggaaucuucaccucag

SEQ ID NO: 597167 - RNA, 19 nt, Homo sapiens
guaauuuaaaaagugcuau

SEQ ID NO: 597168 - RNA, 13 nt, Homo sapiens
guaauuuaugcaa

SEQ ID NO: 597169 - RNA, 14 nt, Homo sapiens
guaauuuaugcaag

SEQ ID NO: 597170 - RNA, 15 nt, Homo sapiens
guaauuuuaucuaaa

SEQ ID NO: 597171 - RNA, 19 nt, Homo sapiens
guacaaaaaaaaaguuuua

SEQ ID NO: 597172 - RNA, 22 nt, Homo sapiens
guacaaaaauaaauuuauauga

SEQ ID NO: 597173 - RNA, 21 nt, Homo sapiens
guacaaaagaagggcugguau

SEQ ID NO: 597174 - RNA, 21 nt, Homo sapiens
guacaaaauacguuuuguaaa

SEQ ID NO: 597175 - RNA, 16 nt, Homo sapiens
guacaaaauugccuau

SEQ ID NO: 597176 - RNA, 20 nt, Homo sapiens
guacaaacucagauccuugg

SEQ ID NO: 597177 - RNA, 16 nt, Homo sapiens
guacaaagguugcagu

SEQ ID NO: 597178 - RNA, 15 nt, Homo sapiens
guacaacuuaacuca

SEQ ID NO: 597179 - RNA, 22 nt, Homo sapiens
guacaaguauauaauaugucac

SEQ ID NO: 597180 - RNA, 17 nt, Homo sapiens
guacaauaaagcaaugu

SEQ ID NO: 597181 - RNA, 14 nt, Homo sapiens
guacaauacaaugu

SEQ ID NO: 597182 - RNA, 12 nt, Homo sapiens
guacaaucucaa

SEQ ID NO: 597183 - RNA, 17 nt, Homo sapiens
guacacaauaagcaaaa

SEQ ID NO: 597184 - RNA, 12 nt, Homo sapiens
guauuuuugccg

SEQ ID NO: 597185 - RNA, 21 nt, Homo sapiens
guauuuuuuacauuuuacaca

SEQ ID NO: 597186 - RNA, 15 nt, Homo sapiens
guauuuuuuccuuaa

SEQ ID NO: 597187 - RNA, 15 nt, Homo sapiens
gucaaaaaguuccau

SEQ ID NO: 597188 - RNA, 15 nt, Homo sapiens
gucaaaacacugugg

SEQ ID NO: 597189 - RNA, 16 nt, Homo sapiens
gucaaaacacugugga

SEQ ID NO: 597190 - RNA, 21 nt, Homo sapiens
gucaaaacacuguggaacuaa

SEQ ID NO: 597191 - RNA, 22 nt, Homo sapiens
gucaaaauaaaggauaacucug

SEQ ID NO: 597192 - RNA, 22 nt, Homo sapiens
gucaaaauuguuuaccauagaa

SEQ ID NO: 597193 - RNA, 14 nt, Homo sapiens
gucaaaccaagaag

SEQ ID NO: 597194 - RNA, 16 nt, Homo sapiens
gucaaacugaaauuca

SEQ ID NO: 597195 - RNA, 22 nt, Homo sapiens
gucaaagaagcuuccacaaaau

SEQ ID NO: 597196 - RNA, 21 nt, Homo sapiens
gucaaagaaggugcugauccu

SEQ ID NO: 597197 - RNA, 14 nt, Homo sapiens
gucaaaggcauuuu

SEQ ID NO: 597198 - RNA, 17 nt, Homo sapiens
gucaaauguuuccuuaa

SEQ ID NO: 597199 - RNA, 15 nt, Homo sapiens
gucaacaacuuacac

SEQ ID NO: 597200 - RNA, 21 nt, Homo sapiens
gucaacaucuuuuacauucug

SEQ ID NO: 597201 - RNA, 22 nt, Homo sapiens
gucaacuccaacguaugugguu

SEQ ID NO: 597202 - RNA, 22 nt, Homo sapiens
gucaacuucagagacuaucuga

SEQ ID NO: 597203 - RNA, 17 nt, Homo sapiens
gucaagaauagcauugu

SEQ ID NO: 597204 - RNA, 19 nt, Homo sapiens
gucaagccugugcaaaaaa

SEQ ID NO: 597205 - RNA, 22 nt, Homo sapiens
gucaagcuuacuacagugaaag

SEQ ID NO: 597206 - RNA, 12 nt, Homo sapiens
gucaaggaauaa

SEQ ID NO: 597207 - RNA, 22 nt, Homo sapiens
gucaaguucccaacugagucau

SEQ ID NO: 597208 - RNA, 19 nt, Homo sapiens
gucaauaaaagagcugucu

SEQ ID NO: 597209 - RNA, 18 nt, Homo sapiens
gucaaugcaggacaacuc

SEQ ID NO: 597210 - RNA, 16 nt, Homo sapiens
gucaauuaaacagcug

SEQ ID NO: 597211 - RNA, 15 nt, Homo sapiens
gucaauuguaacuaa

SEQ ID NO: 597212 - RNA, 14 nt, Homo sapiens
gucaauuuaugaau

SEQ ID NO: 597213 - RNA, 16 nt, Homo sapiens
gucaauuucaguguau

SEQ ID NO: 597214 - RNA, 21 nt, Homo sapiens
gucaauuuguauaucaugaaa

SEQ ID NO: 597215 - RNA, 14 nt, Homo sapiens
gucacacacuggac

SEQ ID NO: 597216 - RNA, 14 nt, Homo sapiens
gucacacucucuug

SEQ ID NO: 597217 - RNA, 17 nt, Homo sapiens
gucacagaagcagcuaa

SEQ ID NO: 597218 - RNA, 18 nt, Homo sapiens
gucacagaagcagcuaaa

SEQ ID NO: 597219 - RNA, 19 nt, Homo sapiens
gucacagaagcagcuaaac

SEQ ID NO: 597220 - RNA, 11 nt, Homo sapiens
gucacagggac

SEQ ID NO: 597221 - RNA, 19 nt, Homo sapiens
gucaccagcaacaucucga

SEQ ID NO: 597222 - RNA, 21 nt, Homo sapiens
gucaccaguuaaaagcauuuu

SEQ ID NO: 597223 - RNA, 17 nt, Homo sapiens
gucaccauacacacugu

SEQ ID NO: 597224 - RNA, 15 nt, Homo sapiens
gucaccaucucaggc

SEQ ID NO: 597225 - RNA, 14 nt, Homo sapiens
gucaccaugaucac

SEQ ID NO: 597226 - RNA, 21 nt, Homo sapiens
gucacccaaacacuucugcuu

SEQ ID NO: 597227 - RNA, 13 nt, Homo sapiens
gucacccaaccug

SEQ ID NO: 597228 - RNA, 14 nt, Homo sapiens
gucacccuccucac

SEQ ID NO: 597229 - RNA, 21 nt, Homo sapiens
gucaccgggaugaaccuaucc

SEQ ID NO: 597230 - RNA, 19 nt, Homo sapiens
gucaccugcucacagggau

SEQ ID NO: 597231 - RNA, 16 nt, Homo sapiens
gucaccugcuccagaa

SEQ ID NO: 597232 - RNA, 17 nt, Homo sapiens
gucaccuucccuugcca

SEQ ID NO: 597233 - RNA, 19 nt, Homo sapiens
gucaccuucuaccaccagg

SEQ ID NO: 597234 - RNA, 22 nt, Homo sapiens
gucacgaacuugaaaguuuucu

SEQ ID NO: 597235 - RNA, 20 nt, Homo sapiens
gucacggcugcgcacugugu

SEQ ID NO: 597236 - RNA, 16 nt, Homo sapiens
gucacuaaacucucau

SEQ ID NO: 597237 - RNA, 20 nt, Homo sapiens
gucacuacacacuaaaacuu

SEQ ID NO: 597238 - RNA, 15 nt, Homo sapiens
gucacucauugcuga

SEQ ID NO: 597239 - RNA, 21 nt, Homo sapiens
gucacucuguaguuacugugg

SEQ ID NO: 597240 - RNA, 16 nt, Homo sapiens
gucacugacaguuaau

SEQ ID NO: 597241 - RNA, 18 nt, Homo sapiens
gucacugagcacagucag

SEQ ID NO: 597242 - RNA, 13 nt, Homo sapiens
gucacugaugaac

SEQ ID NO: 597243 - RNA, 18 nt, Homo sapiens
gucacugcccaccaaagg

SEQ ID NO: 597244 - RNA, 16 nt, Homo sapiens
gucacuggcucuccaa

SEQ ID NO: 597245 - RNA, 12 nt, Homo sapiens
gucacuguaguu

SEQ ID NO: 597246 - RNA, 17 nt, Homo sapiens
gucacuuuuuggccaug

SEQ ID NO: 597247 - RNA, 21 nt, Homo sapiens
gucagaaaaaggaaaccacag

SEQ ID NO: 597248 - RNA, 23 nt, Homo sapiens
gucagaagcuuggcaugaccuca

SEQ ID NO: 597249 - RNA, 19 nt, Homo sapiens
gucagaccaguacugggaa

SEQ ID NO: 597250 - RNA, 22 nt, Homo sapiens
gucagacucuuggcuacaguga

SEQ ID NO: 597251 - RNA, 22 nt, Homo sapiens
gucagacugaaacgccuugcac

SEQ ID NO: 597252 - RNA, 18 nt, Homo sapiens
gucagacuuccaaauccu

SEQ ID NO: 597253 - RNA, 13 nt, Homo sapiens
gucagacuuugcu

SEQ ID NO: 597254 - RNA, 18 nt, Homo sapiens
gucagagacagauaccuc

SEQ ID NO: 597255 - RNA, 15 nt, Homo sapiens
gucagagagaccuca

SEQ ID NO: 597256 - RNA, 13 nt, Homo sapiens
gucagagcuaaac

SEQ ID NO: 597257 - RNA, 13 nt, Homo sapiens
gucagaguucugc

SEQ ID NO: 597258 - RNA, 21 nt, Homo sapiens
gucagcacaggccauggugca

SEQ ID NO: 597259 - RNA, 15 nt, Homo sapiens
gucagccacacuggg

SEQ ID NO: 597260 - RNA, 19 nt, Homo sapiens
gucagccugacucuucccu

SEQ ID NO: 597261 - RNA, 20 nt, Homo sapiens
gucagccuugcaucaagggc

SEQ ID NO: 597262 - RNA, 21 nt, Homo sapiens
gucagcuacuaaugauguuuu

SEQ ID NO: 597263 - RNA, 14 nt, Homo sapiens
gucagcugcucccu

SEQ ID NO: 597264 - RNA, 22 nt, Homo sapiens
gucagcuguaacccucacccac

SEQ ID NO: 597265 - RNA, 23 nt, Homo sapiens
gucaggaacagaaggaugaauga

SEQ ID NO: 597266 - RNA, 21 nt, Homo sapiens
gucaggacaagggcucagagg

SEQ ID NO: 597267 - RNA, 13 nt, Homo sapiens
gucaggacuguga

SEQ ID NO: 597268 - RNA, 23 nt, Homo sapiens
gucaggaguucaagacuagccug

SEQ ID NO: 597269 - RNA, 15 nt, Homo sapiens
gucaggcugcagagg

SEQ ID NO: 597270 - RNA, 16 nt, Homo sapiens
gucaggcuggucucaa

SEQ ID NO: 597271 - RNA, 19 nt, Homo sapiens
gucagggcccaagucccug

SEQ ID NO: 597272 - RNA, 20 nt, Homo sapiens
gucagggugaacugcaaagc

SEQ ID NO: 597273 - RNA, 16 nt, Homo sapiens
gucaggguucacuugg

SEQ ID NO: 597274 - RNA, 16 nt, Homo sapiens
gucagguaguugcaau

SEQ ID NO: 597275 - RNA, 16 nt, Homo sapiens
gucaguauuuuugccg

SEQ ID NO: 597276 - RNA, 11 nt, Homo sapiens
gucagugcagc

SEQ ID NO: 597277 - RNA, 19 nt, Homo sapiens
gucagugcccaacuguuau

SEQ ID NO: 597278 - RNA, 16 nt, Homo sapiens
gucaguggcuuugcau

SEQ ID NO: 597279 - RNA, 19 nt, Homo sapiens
gucaguggcuuugcauagc

SEQ ID NO: 597280 - RNA, 12 nt, Homo sapiens
gucaguuucacu

SEQ ID NO: 597281 - RNA, 18 nt, Homo sapiens
gucaguuugguugggcua

SEQ ID NO: 597282 - RNA, 20 nt, Homo sapiens
gucauaaaaugcauacuguu

SEQ ID NO: 597283 - RNA, 19 nt, Homo sapiens
gucauaaaucagaaaguuu

SEQ ID NO: 597284 - RNA, 14 nt, Homo sapiens
gucauagacuccuu

SEQ ID NO: 597285 - RNA, 21 nt, Homo sapiens
gucauagacuccuuugcuaau

SEQ ID NO: 597286 - RNA, 19 nt, Homo sapiens
gucauauauggggggccaa

SEQ ID NO: 597287 - RNA, 14 nt, Homo sapiens
gucauaugacugau

SEQ ID NO: 597288 - RNA, 22 nt, Homo sapiens
gucauauucgauguacuuuaag

SEQ ID NO: 597289 - RNA, 15 nt, Homo sapiens
gucauauuuugccac

SEQ ID NO: 597290 - RNA, 19 nt, Homo sapiens
gucaucaaacauuugccaa

SEQ ID NO: 597291 - RNA, 16 nt, Homo sapiens
gucaucaaagcagaag

SEQ ID NO: 597292 - RNA, 16 nt, Homo sapiens
gucaucacccagccuc

SEQ ID NO: 597293 - RNA, 19 nt, Homo sapiens
gucaucacuccucugucau

SEQ ID NO: 597294 - RNA, 17 nt, Homo sapiens
gucaucaggugcauagc

SEQ ID NO: 597295 - RNA, 22 nt, Homo sapiens
gucauccaaacucaaacuugag

SEQ ID NO: 597296 - RNA, 15 nt, Homo sapiens
gucauccagcucacu

SEQ ID NO: 597297 - RNA, 16 nt, Homo sapiens
gucaucuucaauuuau

SEQ ID NO: 597298 - RNA, 19 nt, Homo sapiens
gucaugagcugucugggaa

SEQ ID NO: 597299 - RNA, 16 nt, Homo sapiens
gucaugcuucaucauu

SEQ ID NO: 597300 - RNA, 17 nt, Homo sapiens
gucauggaaaauguccu

SEQ ID NO: 597301 - RNA, 13 nt, Homo sapiens
gucauggaugucc

SEQ ID NO: 597302 - RNA, 23 nt, Homo sapiens
gucauggccugagaugcagguga

SEQ ID NO: 597303 - RNA, 17 nt, Homo sapiens
gucaugugggucuucca

SEQ ID NO: 597304 - RNA, 17 nt, Homo sapiens
gucaugugguacuugag

SEQ ID NO: 597305 - RNA, 16 nt, Homo sapiens
gucauguguuuugcca

SEQ ID NO: 597306 - RNA, 20 nt, Homo sapiens
guccuuacucccccaccacu

SEQ ID NO: 597307 - RNA, 22 nt, Homo sapiens
guccuugaugccagagggccag

SEQ ID NO: 597308 - RNA, 17 nt, Homo sapiens
guccuuggaaguuucau

SEQ ID NO: 597309 - RNA, 20 nt, Homo sapiens
guccuuuaaucacugcauuu

SEQ ID NO: 597310 - RNA, 11 nt, Homo sapiens
guccuuuaugu

SEQ ID NO: 597311 - RNA, 13 nt, Homo sapiens
guccuuucuugca

SEQ ID NO: 597312 - RNA, 14 nt, Homo sapiens
guccuuucuugcag

SEQ ID NO: 597313 - RNA, 14 nt, Homo sapiens
guccuuuucuccca

SEQ ID NO: 597314 - RNA, 20 nt, Homo sapiens
guccuuuugugaaaucagua

SEQ ID NO: 597315 - RNA, 18 nt, Homo sapiens
guccuuuuucacuuugaa

SEQ ID NO: 597316 - RNA, 17 nt, Homo sapiens
gucgaauguuagauucc

SEQ ID NO: 597317 - RNA, 19 nt, Homo sapiens
gucgaauuccuacugacaa

SEQ ID NO: 597318 - RNA, 14 nt, Homo sapiens
gucgagaagccagg

SEQ ID NO: 597319 - RNA, 23 nt, Homo sapiens
gucgagacuucacgggcaaucau

SEQ ID NO: 597320 - RNA, 16 nt, Homo sapiens
gucgaggggcucucag

SEQ ID NO: 597321 - RNA, 17 nt, Homo sapiens
gucgaugaucaccaagc

SEQ ID NO: 597322 - RNA, 18 nt, Homo sapiens
gucgaugcguucacucca

SEQ ID NO: 597323 - RNA, 20 nt, Homo sapiens
gucgauuaguaaaagugcuu

SEQ ID NO: 597324 - RNA, 15 nt, Homo sapiens
gucgcccuacucacc

SEQ ID NO: 597325 - RNA, 15 nt, Homo sapiens
gucgcgcgucuccca

SEQ ID NO: 597326 - RNA, 22 nt, Homo sapiens
gucgcuaacuuaguaagugcuu

SEQ ID NO: 597327 - RNA, 14 nt, Homo sapiens
gucggagucuguaa

SEQ ID NO: 597328 - RNA, 14 nt, Homo sapiens
gucgggacaugguu

SEQ ID NO: 597329 - RNA, 15 nt, Homo sapiens
gucgggagagccagg

SEQ ID NO: 597330 - RNA, 23 nt, Homo sapiens
gucgggauauuugggugcagagg

SEQ ID NO: 597331 - RNA, 16 nt, Homo sapiens
gucgggggcuguggau

SEQ ID NO: 597332 - RNA, 13 nt, Homo sapiens
gucgugcagucag

SEQ ID NO: 597333 - RNA, 22 nt, Homo sapiens
gucuaaauaaaugaaguauuuc

SEQ ID NO: 597334 - RNA, 21 nt, Homo sapiens
gucuaaccugcgucauuucag

SEQ ID NO: 597335 - RNA, 23 nt, Homo sapiens
gucuaacuggggauauaauacua

SEQ ID NO: 597336 - RNA, 15 nt, Homo sapiens
gucuaagagugaagu

SEQ ID NO: 597337 - RNA, 19 nt, Homo sapiens
gucuaauagucuuugccag

SEQ ID NO: 597338 - RNA, 18 nt, Homo sapiens
gucuaauuuauuaaucua

SEQ ID NO: 597339 - RNA, 15 nt, Homo sapiens
gucuaauuuauucaa

SEQ ID NO: 597340 - RNA, 22 nt, Homo sapiens
gucuacauugagcauuugaaag

SEQ ID NO: 597341 - RNA, 19 nt, Homo sapiens
gucuacuggacaaucuuau

SEQ ID NO: 597342 - RNA, 17 nt, Homo sapiens
gucuacuguggugaucu

SEQ ID NO: 597343 - RNA, 18 nt, Homo sapiens
gucuacuugaguuagcau

SEQ ID NO: 597344 - RNA, 14 nt, Homo sapiens
gucuagacauauuu

SEQ ID NO: 597345 - RNA, 21 nt, Homo sapiens
gucuagacuuucucaguggga

SEQ ID NO: 597346 - RNA, 22 nt, Homo sapiens
gucuaggauaacuugcuuucuu

SEQ ID NO: 597347 - RNA, 11 nt, Homo sapiens
gucuagucaag

SEQ ID NO: 597348 - RNA, 22 nt, Homo sapiens
gucuauaacuccuuguuucaga

SEQ ID NO: 597349 - RNA, 14 nt, Homo sapiens
gucuauaaugcaau

SEQ ID NO: 597350 - RNA, 18 nt, Homo sapiens
gucuauuuaagugcaauu

SEQ ID NO: 597351 - RNA, 12 nt, Homo sapiens
gucuauuuccac

SEQ ID NO: 597352 - RNA, 19 nt, Homo sapiens
gucuauuuucucagucauu

SEQ ID NO: 597353 - RNA, 15 nt, Homo sapiens
gucuauuuuguauau

SEQ ID NO: 597354 - RNA, 20 nt, Homo sapiens
gucuauuuuuuuaacugaaa

SEQ ID NO: 597355 - RNA, 21 nt, Homo sapiens
gucucaaacucccgaccucag

SEQ ID NO: 597356 - RNA, 21 nt, Homo sapiens
gucucaaacuccugaccucaa

SEQ ID NO: 597357 - RNA, 19 nt, Homo sapiens
gucucaagagggcacuggu

SEQ ID NO: 597358 - RNA, 23 nt, Homo sapiens
gucucaccccucauccuuuuacu

SEQ ID NO: 597359 - RNA, 23 nt, Homo sapiens
gucucacgggcaugggcacuccc

SEQ ID NO: 597360 - RNA, 23 nt, Homo sapiens
gucucagaaacugcgaggccagu

SEQ ID NO: 597361 - RNA, 23 nt, Homo sapiens
gucucaucuccugacccucccac

SEQ ID NO: 597362 - RNA, 20 nt, Homo sapiens
gucucaugcggacccucaca

SEQ ID NO: 597363 - RNA, 13 nt, Homo sapiens
gucucaugugguc

SEQ ID NO: 597364 - RNA, 14 nt, Homo sapiens
gucucauuuugaca

SEQ ID NO: 597365 - RNA, 22 nt, Homo sapiens
gucuccaaauuacagcccagga

SEQ ID NO: 597366 - RNA, 19 nt, Homo sapiens
gucuccagaguuguucucu

SEQ ID NO: 597367 - RNA, 22 nt, Homo sapiens
gucuccagauguuaauuuacuu

SEQ ID NO: 597368 - RNA, 18 nt, Homo sapiens
gucuccagucaucuguaa

SEQ ID NO: 597369 - RNA, 20 nt, Homo sapiens
gucuccaugcucaccaagga

SEQ ID NO: 597370 - RNA, 16 nt, Homo sapiens
gucucccuguguuacc

SEQ ID NO: 597371 - RNA, 23 nt, Homo sapiens
gucuccuggaccuugacagagca

SEQ ID NO: 597372 - RNA, 22 nt, Homo sapiens
gucuccuuuaguuucagagugu

SEQ ID NO: 597373 - RNA, 15 nt, Homo sapiens
gucucgcagccugaa

SEQ ID NO: 597374 - RNA, 16 nt, Homo sapiens
gucucgggcugacccu

SEQ ID NO: 597375 - RNA, 17 nt, Homo sapiens
gucucggggcuugcccc

SEQ ID NO: 597376 - RNA, 23 nt, Homo sapiens
gucucgugguaggacuguagaaa

SEQ ID NO: 597377 - RNA, 17 nt, Homo sapiens
gucucuaccuaaggaca

SEQ ID NO: 597378 - RNA, 18 nt, Homo sapiens
gucucuaguuccacgccu

SEQ ID NO: 597379 - RNA, 15 nt, Homo sapiens
gucucuauacuacau

SEQ ID NO: 597380 - RNA, 22 nt, Homo sapiens
gucucucccaccccggccucca

SEQ ID NO: 597381 - RNA, 13 nt, Homo sapiens
gucucucccucag

SEQ ID NO: 597382 - RNA, 18 nt, Homo sapiens
gucucucccuuccaggaa

SEQ ID NO: 597383 - RNA, 16 nt, Homo sapiens
gucucugaugcagcuu

SEQ ID NO: 597384 - RNA, 23 nt, Homo sapiens
gucucugcauccauuugaacaca

SEQ ID NO: 597385 - RNA, 18 nt, Homo sapiens
gucucugccggcucuuuc

SEQ ID NO: 597386 - RNA, 14 nt, Homo sapiens
gucucuggggaccc

SEQ ID NO: 597387 - RNA, 16 nt, Homo sapiens
gucucuggucuuccag

SEQ ID NO: 597388 - RNA, 22 nt, Homo sapiens
gucucuucggcagggaggugaa

SEQ ID NO: 597389 - RNA, 22 nt, Homo sapiens
gucucuuguaauccgaaucucu

SEQ ID NO: 597390 - RNA, 15 nt, Homo sapiens
gucugaaagacagaa

SEQ ID NO: 597391 - RNA, 18 nt, Homo sapiens
gucugaacaaagugcuag

SEQ ID NO: 597392 - RNA, 19 nt, Homo sapiens
gucugaacaaagugcuaga

SEQ ID NO: 597393 - RNA, 19 nt, Homo sapiens
gucugaacggcugaauaug

SEQ ID NO: 597394 - RNA, 21 nt, Homo sapiens
gucugaacgucuccuagccaa

SEQ ID NO: 597395 - RNA, 21 nt, Homo sapiens
gucugaaggacacuuccugcc

SEQ ID NO: 597396 - RNA, 23 nt, Homo sapiens
gucugaauauuaaagcucuucau

SEQ ID NO: 597397 - RNA, 21 nt, Homo sapiens
gucugacauguuugugcucug

SEQ ID NO: 597398 - RNA, 16 nt, Homo sapiens
gucugagaauuuccaa

SEQ ID NO: 597399 - RNA, 19 nt, Homo sapiens
gucugagauauauuugcua

SEQ ID NO: 597400 - RNA, 15 nt, Homo sapiens
gucugauuggcucac

SEQ ID NO: 597401 - RNA, 21 nt, Homo sapiens
gucugauuggcucacccaagc

SEQ ID NO: 597402 - RNA, 14 nt, Homo sapiens
gucugcacagauuc

SEQ ID NO: 597403 - RNA, 15 nt, Homo sapiens
gucugcagcaaugaa

SEQ ID NO: 597404 - RNA, 13 nt, Homo sapiens
gucugcaggguga

SEQ ID NO: 597405 - RNA, 18 nt, Homo sapiens
gucugccagccagcagcc

SEQ ID NO: 597406 - RNA, 15 nt, Homo sapiens
gucugccccacccuc

SEQ ID NO: 597407 - RNA, 15 nt, Homo sapiens
gucugcccugcccau

SEQ ID NO: 597408 - RNA, 14 nt, Homo sapiens
gucugcccuuguca

SEQ ID NO: 597409 - RNA, 16 nt, Homo sapiens
gucugcuagccaggau

SEQ ID NO: 597410 - RNA, 19 nt, Homo sapiens
gucugcuuauccuuggaag

SEQ ID NO: 597411 - RNA, 23 nt, Homo sapiens
gucuggaaaacagaaaccauucu

SEQ ID NO: 597412 - RNA, 22 nt, Homo sapiens
gucuggcaaugggacucugaga

SEQ ID NO: 597413 - RNA, 14 nt, Homo sapiens
gucuggcauuacaa

SEQ ID NO: 597414 - RNA, 21 nt, Homo sapiens
gucuggcccgcaauacuguag

SEQ ID NO: 597415 - RNA, 22 nt, Homo sapiens
gucuggcuagguuaaaggccag

SEQ ID NO: 597416 - RNA, 15 nt, Homo sapiens
gucugggacuuccuu

SEQ ID NO: 597417 - RNA, 18 nt, Homo sapiens
gucuggggucuccuauac

SEQ ID NO: 597418 - RNA, 19 nt, Homo sapiens
gucuggugccccuuugccc

SEQ ID NO: 597419 - RNA, 19 nt, Homo sapiens
gucugguugggcagccaga

SEQ ID NO: 597420 - RNA, 15 nt, Homo sapiens
gucuguaaaaccagc

SEQ ID NO: 597421 - RNA, 20 nt, Homo sapiens
gucuguagcuccucaacuca

SEQ ID NO: 597422 - RNA, 17 nt, Homo sapiens
gucuguagggagugaag

SEQ ID NO: 597423 - RNA, 15 nt, Homo sapiens
gucuguccaccccau

SEQ ID NO: 597424 - RNA, 21 nt, Homo sapiens
gucugucucgaugccugauuc

SEQ ID NO: 597425 - RNA, 11 nt, Homo sapiens
gucugucuucu

SEQ ID NO: 597426 - RNA, 21 nt, Homo sapiens
gucugugaguaccuggucaua

SEQ ID NO: 597427 - RNA, 22 nt, Homo sapiens
uaccuuuuauuuuaauguuucc

SEQ ID NO: 597428 - RNA, 18 nt, Homo sapiens
uaccuuuucucacaaaaa

SEQ ID NO: 597429 - RNA, 13 nt, Homo sapiens
uacgaaccaugcc

SEQ ID NO: 597430 - RNA, 12 nt, Homo sapiens
uacgaagacaaa

SEQ ID NO: 597431 - RNA, 15 nt, Homo sapiens
uacgaaucgaauaca

SEQ ID NO: 597432 - RNA, 15 nt, Homo sapiens
uacgaugacaguguu

SEQ ID NO: 597433 - RNA, 13 nt, Homo sapiens
uacgcacauaccu

SEQ ID NO: 597434 - RNA, 15 nt, Homo sapiens
uacgcucaucaccua

SEQ ID NO: 597435 - RNA, 17 nt, Homo sapiens
uacggcaaccacauguc

SEQ ID NO: 597436 - RNA, 20 nt, Homo sapiens
uacggcaaccacauguccca

SEQ ID NO: 597437 - RNA, 19 nt, Homo sapiens
uacguaauuuaaacaaauu

SEQ ID NO: 597438 - RNA, 14 nt, Homo sapiens
uacguauaccuugu

SEQ ID NO: 597439 - RNA, 18 nt, Homo sapiens
uacgugagaaauagcuga

SEQ ID NO: 597440 - RNA, 19 nt, Homo sapiens
uacgugauuuggcugcacu

SEQ ID NO: 597441 - RNA, 11 nt, Homo sapiens
uacgugcaaac

SEQ ID NO: 597442 - RNA, 21 nt, Homo sapiens
uacguggcaaauuaacuugag

SEQ ID NO: 597443 - RNA, 21 nt, Homo sapiens
uacgugggagucugugcauuu

SEQ ID NO: 597444 - RNA, 12 nt, Homo sapiens
uacgugucaaaa

SEQ ID NO: 597445 - RNA, 20 nt, Homo sapiens
uacguucaucaccugcuaga

SEQ ID NO: 597446 - RNA, 20 nt, Homo sapiens
uacguuuccugagaaguguc

SEQ ID NO: 597447 - RNA, 19 nt, Homo sapiens
uacguuugaaauaguugau

SEQ ID NO: 597448 - RNA, 16 nt, Homo sapiens
uacuaaaaauacaaaa

SEQ ID NO: 597449 - RNA, 16 nt, Homo sapiens
uacuaaaaauacagaa

SEQ ID NO: 597450 - RNA, 15 nt, Homo sapiens
uacuaaaccaccuca

SEQ ID NO: 597451 - RNA, 15 nt, Homo sapiens
uacuaaagacgguau

SEQ ID NO: 597452 - RNA, 13 nt, Homo sapiens
uacuaaaguauug

SEQ ID NO: 597453 - RNA, 12 nt, Homo sapiens
uacuaacaaagc

SEQ ID NO: 597454 - RNA, 18 nt, Homo sapiens
uacuaacaaauguaaaau

SEQ ID NO: 597455 - RNA, 13 nt, Homo sapiens
uacuaacacuggc

SEQ ID NO: 597456 - RNA, 19 nt, Homo sapiens
uacuaacauuuucauugau

SEQ ID NO: 597457 - RNA, 14 nt, Homo sapiens
uacuaagggaacaa

SEQ ID NO: 597458 - RNA, 20 nt, Homo sapiens
uacuaagugaugcugugaua

SEQ ID NO: 597459 - RNA, 13 nt, Homo sapiens
uacuaaucuuucu

SEQ ID NO: 597460 - RNA, 13 nt, Homo sapiens
uacuaaugugccc

SEQ ID NO: 597461 - RNA, 21 nt, Homo sapiens
uacuacaguaacugugacuga

SEQ ID NO: 597462 - RNA, 13 nt, Homo sapiens
uacuacauuauua

SEQ ID NO: 597463 - RNA, 15 nt, Homo sapiens
uacuaccacaaggaa

SEQ ID NO: 597464 - RNA, 22 nt, Homo sapiens
uacuaccugucaagguuugugu

SEQ ID NO: 597465 - RNA, 14 nt, Homo sapiens
uacuaccuguguau

SEQ ID NO: 597466 - RNA, 13 nt, Homo sapiens
uacuacggagaaa

SEQ ID NO: 597467 - RNA, 14 nt, Homo sapiens
uacuagcaggcaau

SEQ ID NO: 597468 - RNA, 20 nt, Homo sapiens
uacuagcaggcaaugcugua

SEQ ID NO: 597469 - RNA, 14 nt, Homo sapiens
uacuagcaguguuu

SEQ ID NO: 597470 - RNA, 16 nt, Homo sapiens
uacuagggagccauuu

SEQ ID NO: 597471 - RNA, 12 nt, Homo sapiens
uacuaguacagg

SEQ ID NO: 597472 - RNA, 17 nt, Homo sapiens
uacuagucaccagagac

SEQ ID NO: 597473 - RNA, 22 nt, Homo sapiens
uacuaguuuuaguuuucucuua

SEQ ID NO: 597474 - RNA, 16 nt, Homo sapiens
uacuaguuuucaauca

SEQ ID NO: 597475 - RNA, 13 nt, Homo sapiens
uacuauaaaagcu

SEQ ID NO: 597476 - RNA, 14 nt, Homo sapiens
uacuauacagccau

SEQ ID NO: 597477 - RNA, 15 nt, Homo sapiens
uacuauacagccaua

SEQ ID NO: 597478 - RNA, 19 nt, Homo sapiens
uacuauauuuauacuguau

SEQ ID NO: 597479 - RNA, 19 nt, Homo sapiens
uacuaucacugaacaaacu

SEQ ID NO: 597480 - RNA, 13 nt, Homo sapiens
uacuauccccaaa

SEQ ID NO: 597481 - RNA, 18 nt, Homo sapiens
uacuaugcucuagagaaa

SEQ ID NO: 597482 - RNA, 14 nt, Homo sapiens
uacuauugcaaaag

SEQ ID NO: 597483 - RNA, 16 nt, Homo sapiens
uacuauuuucauucuc

SEQ ID NO: 597484 - RNA, 16 nt, Homo sapiens
uacuauuuuuacuaau

SEQ ID NO: 597485 - RNA, 21 nt, Homo sapiens
uacuauuuuuacuaaucuuuc

SEQ ID NO: 597486 - RNA, 23 nt, Homo sapiens
uacucaaggaauuugcauuuagu

SEQ ID NO: 597487 - RNA, 16 nt, Homo sapiens
uacucacuuuuuccaa

SEQ ID NO: 597488 - RNA, 21 nt, Homo sapiens
uacucacuuuuuccaaaugau

SEQ ID NO: 597489 - RNA, 14 nt, Homo sapiens
uacucagaacuguc

SEQ ID NO: 597490 - RNA, 21 nt, Homo sapiens
uacucagggcuccucccagcu

SEQ ID NO: 597491 - RNA, 15 nt, Homo sapiens
uacucaugaaugaaa

SEQ ID NO: 597492 - RNA, 15 nt, Homo sapiens
uacucauuagugacu

SEQ ID NO: 597493 - RNA, 14 nt, Homo sapiens
uacucccagcacuu

SEQ ID NO: 597494 - RNA, 17 nt, Homo sapiens
uacuccccaacugaguu

SEQ ID NO: 597495 - RNA, 15 nt, Homo sapiens
uacuccuaccucagc

SEQ ID NO: 597496 - RNA, 16 nt, Homo sapiens
uacuccuuccaucaaa

SEQ ID NO: 597497 - RNA, 22 nt, Homo sapiens
uacuccuuuugccacugcugug

SEQ ID NO: 597498 - RNA, 20 nt, Homo sapiens
uacucuaucagagaaaaaca

SEQ ID NO: 597499 - RNA, 13 nt, Homo sapiens
uacucucuugcac

SEQ ID NO: 597500 - RNA, 23 nt, Homo sapiens
uacucugcccucuagagccuuca

SEQ ID NO: 597501 - RNA, 14 nt, Homo sapiens
uacucuguccaggc

SEQ ID NO: 597502 - RNA, 13 nt, Homo sapiens
uacucuguguaaa

SEQ ID NO: 597503 - RNA, 18 nt, Homo sapiens
uacucuguuccuucacau

SEQ ID NO: 597504 - RNA, 21 nt, Homo sapiens
uacugaaaaaugcaaauugca

SEQ ID NO: 597505 - RNA, 21 nt, Homo sapiens
uacugaacaaucaaagcacuu

SEQ ID NO: 597506 - RNA, 18 nt, Homo sapiens
uacugaacacauguguau

SEQ ID NO: 597507 - RNA, 13 nt, Homo sapiens
uacugaagcuuua

SEQ ID NO: 597508 - RNA, 23 nt, Homo sapiens
uacugacaacauuauaacuguau

SEQ ID NO: 597509 - RNA, 23 nt, Homo sapiens
uacugacacauugcugauaugca

SEQ ID NO: 597510 - RNA, 12 nt, Homo sapiens
uacugacauaua

SEQ ID NO: 597511 - RNA, 13 nt, Homo sapiens
uacugaccagcaa

SEQ ID NO: 597512 - RNA, 19 nt, Homo sapiens
uacugagcauuugcaccuc

SEQ ID NO: 597513 - RNA, 16 nt, Homo sapiens
uacugauaauuuugcu

SEQ ID NO: 597514 - RNA, 14 nt, Homo sapiens
uacugaucucuuua

SEQ ID NO: 597515 - RNA, 17 nt, Homo sapiens
uacugaucuuuguauau

SEQ ID NO: 597516 - RNA, 17 nt, Homo sapiens
uacugaugauguagaua

SEQ ID NO: 597517 - RNA, 13 nt, Homo sapiens
uacugcaaaucag

SEQ ID NO: 597518 - RNA, 16 nt, Homo sapiens
uacugcaauguaaaua

SEQ ID NO: 597519 - RNA, 19 nt, Homo sapiens
uacugcaauuaaagugaua

SEQ ID NO: 597520 - RNA, 18 nt, Homo sapiens
uacugcacccagcagugu

SEQ ID NO: 597521 - RNA, 23 nt, Homo sapiens
uacugcagagggacagaugacca

SEQ ID NO: 597522 - RNA, 22 nt, Homo sapiens
uacugccaagccccugcccugg

SEQ ID NO: 597523 - RNA, 16 nt, Homo sapiens
uacugccgaagaauug

SEQ ID NO: 597524 - RNA, 17 nt, Homo sapiens
uacugccggucacccag

SEQ ID NO: 597525 - RNA, 14 nt, Homo sapiens
uacugccuuuagaa

SEQ ID NO: 597526 - RNA, 19 nt, Homo sapiens
uacugcuaucuacuacaaa

SEQ ID NO: 597527 - RNA, 16 nt, Homo sapiens
uacugcugcacuuuca

SEQ ID NO: 597528 - RNA, 15 nt, Homo sapiens
uacugcugucuucca

SEQ ID NO: 597529 - RNA, 12 nt, Homo sapiens
uacugcugugaa

SEQ ID NO: 597530 - RNA, 13 nt, Homo sapiens
uacugcuucccau

SEQ ID NO: 597531 - RNA, 15 nt, Homo sapiens
uacugggagaaucac

SEQ ID NO: 597532 - RNA, 19 nt, Homo sapiens
uacugggagauacagccau

SEQ ID NO: 597533 - RNA, 16 nt, Homo sapiens
uacuggggaucagagu

SEQ ID NO: 597534 - RNA, 17 nt, Homo sapiens
uacugggugucauuuca

SEQ ID NO: 597535 - RNA, 15 nt, Homo sapiens
uacuggucucaggcc

SEQ ID NO: 597536 - RNA, 19 nt, Homo sapiens
uacuggugugagccacugu

SEQ ID NO: 597537 - RNA, 17 nt, Homo sapiens
uacugguugacuuucua

SEQ ID NO: 597538 - RNA, 18 nt, Homo sapiens
uacugguugcauggaaau

SEQ ID NO: 597539 - RNA, 13 nt, Homo sapiens
uacuguaauuccu

SEQ ID NO: 597540 - RNA, 21 nt, Homo sapiens
uacuguacccucgcaugacug

SEQ ID NO: 597541 - RNA, 23 nt, Homo sapiens
uacuguaggcacacuuugcacug

SEQ ID NO: 597542 - RNA, 17 nt, Homo sapiens
uacuguaguucacugua

SEQ ID NO: 597543 - RNA, 17 nt, Homo sapiens
uacugucucacugaaac

SEQ ID NO: 597544 - RNA, 15 nt, Homo sapiens
uacugucucuggcau

SEQ ID NO: 597545 - RNA, 17 nt, Homo sapiens
uacugugaaacuggcac

SEQ ID NO: 597546 - RNA, 14 nt, Homo sapiens
uacugugagacugu

SEQ ID NO: 597547 - RNA, 17 nt, Homo sapiens
uacugugcaguuuucag

SEQ ID NO: 597548 - RNA, 16 nt, Homo sapiens
uacuguugauacaaac

SEQ ID NO: 597549 - RNA, 16 nt, Homo sapiens
uacuguuuacaguuua

SEQ ID NO: 597550 - RNA, 19 nt, Homo sapiens
uagcaguuuguaaaagugu

SEQ ID NO: 597551 - RNA, 13 nt, Homo sapiens
uagcauacgguau

SEQ ID NO: 597552 - RNA, 15 nt, Homo sapiens
uagcauccugugacc

SEQ ID NO: 597553 - RNA, 14 nt, Homo sapiens
uagcauugaaaaau

SEQ ID NO: 597554 - RNA, 13 nt, Homo sapiens
uagcauuugccac

SEQ ID NO: 597555 - RNA, 21 nt, Homo sapiens
uagccacagcugcuguucuca

SEQ ID NO: 597556 - RNA, 19 nt, Homo sapiens
uagccacugaucauuuuua

SEQ ID NO: 597557 - RNA, 14 nt, Homo sapiens
uagccagacacucu

SEQ ID NO: 597558 - RNA, 22 nt, Homo sapiens
uagccagccccucuuccccaau

SEQ ID NO: 597559 - RNA, 17 nt, Homo sapiens
uagccaggaaguacuuc

SEQ ID NO: 597560 - RNA, 19 nt, Homo sapiens
uagccaggcaugguggcac

SEQ ID NO: 597561 - RNA, 17 nt, Homo sapiens
uagccaggcuaucuggc

SEQ ID NO: 597562 - RNA, 23 nt, Homo sapiens
uagccaggguggucuugaucucc

SEQ ID NO: 597563 - RNA, 15 nt, Homo sapiens
uagccauaauuuugc

SEQ ID NO: 597564 - RNA, 12 nt, Homo sapiens
uagccauaugca

SEQ ID NO: 597565 - RNA, 19 nt, Homo sapiens
uagccaugauaacugcaau

SEQ ID NO: 597566 - RNA, 20 nt, Homo sapiens
uagccauuuuucaaagcaau

SEQ ID NO: 597567 - RNA, 22 nt, Homo sapiens
uagccauuuuucaaagcaauug

SEQ ID NO: 597568 - RNA, 19 nt, Homo sapiens
uagcccagacucugagcug

SEQ ID NO: 597569 - RNA, 15 nt, Homo sapiens
uagcccaggagcaac

SEQ ID NO: 597570 - RNA, 14 nt, Homo sapiens
uagcccagugcuuc

SEQ ID NO: 597571 - RNA, 18 nt, Homo sapiens
uagcccauaaggggucaa

SEQ ID NO: 597572 - RNA, 20 nt, Homo sapiens
uagcccaucugaugcuucua

SEQ ID NO: 597573 - RNA, 14 nt, Homo sapiens
uagcccauguuaag

SEQ ID NO: 597574 - RNA, 20 nt, Homo sapiens
uagccccuuagccaguugua

SEQ ID NO: 597575 - RNA, 20 nt, Homo sapiens
uagcccguuuucacacugcu

SEQ ID NO: 597576 - RNA, 21 nt, Homo sapiens
uagcccucccccucaaccuca

SEQ ID NO: 597577 - RNA, 17 nt, Homo sapiens
uagcccuucaagugcac

SEQ ID NO: 597578 - RNA, 22 nt, Homo sapiens
uagccuaaaagacaauuuuccu

SEQ ID NO: 597579 - RNA, 16 nt, Homo sapiens
uagccuaauacaacau

SEQ ID NO: 597580 - RNA, 17 nt, Homo sapiens
uagccuauacugcauua

SEQ ID NO: 597581 - RNA, 22 nt, Homo sapiens
uagccuggauauuauucuugua

SEQ ID NO: 597582 - RNA, 16 nt, Homo sapiens
uagccugggguggggu

SEQ ID NO: 597583 - RNA, 22 nt, Homo sapiens
uagccuuuauuuuuaaccugcc

SEQ ID NO: 597584 - RNA, 23 nt, Homo sapiens
uagccuuuauuuuuaaccugcca

SEQ ID NO: 597585 - RNA, 17 nt, Homo sapiens
uagcgaccccagacugu

SEQ ID NO: 597586 - RNA, 18 nt, Homo sapiens
uagcgaguuuucugacca

SEQ ID NO: 597587 - RNA, 19 nt, Homo sapiens
uagcgauugauugauguac

SEQ ID NO: 597588 - RNA, 16 nt, Homo sapiens
uagcgcucucuuccag

SEQ ID NO: 597589 - RNA, 14 nt, Homo sapiens
uagcgggacaaagc

SEQ ID NO: 597590 - RNA, 14 nt, Homo sapiens
uagcuaauaacaug

SEQ ID NO: 597591 - RNA, 19 nt, Homo sapiens
uagcuaauuuuugcaaaua

SEQ ID NO: 597592 - RNA, 23 nt, Homo sapiens
uagcuacauagcagacuuuccca

SEQ ID NO: 597593 - RNA, 18 nt, Homo sapiens
uagcuaccucacuaugcu

SEQ ID NO: 597594 - RNA, 21 nt, Homo sapiens
uagcuaccucacuaugcugcu

SEQ ID NO: 597595 - RNA, 22 nt, Homo sapiens
uagcuaccucacuaugcugcuu

SEQ ID NO: 597596 - RNA, 20 nt, Homo sapiens
uagcuauggaaucaauucaa

SEQ ID NO: 597597 - RNA, 19 nt, Homo sapiens
uagcucaauuaguguggcu

SEQ ID NO: 597598 - RNA, 23 nt, Homo sapiens
uagcucauuugagauaaagucaa

SEQ ID NO: 597599 - RNA, 15 nt, Homo sapiens
uagcuccccugcuga

SEQ ID NO: 597600 - RNA, 12 nt, Homo sapiens
uagcuccuuccc

SEQ ID NO: 597601 - RNA, 18 nt, Homo sapiens
uagcucucacaugcacag

SEQ ID NO: 597602 - RNA, 15 nt, Homo sapiens
uagcucugccuuacc

SEQ ID NO: 597603 - RNA, 17 nt, Homo sapiens
uagcucuggugaccuug

SEQ ID NO: 597604 - RNA, 20 nt, Homo sapiens
uagcucuuaauuguucauuu

SEQ ID NO: 597605 - RNA, 23 nt, Homo sapiens
uagcugaagaaguuauucucaag

SEQ ID NO: 597606 - RNA, 17 nt, Homo sapiens
uagcugagcgugguggc

SEQ ID NO: 597607 - RNA, 12 nt, Homo sapiens
uagcugccaaau

SEQ ID NO: 597608 - RNA, 20 nt, Homo sapiens
uagcugcccaggaugcugcu

SEQ ID NO: 597609 - RNA, 19 nt, Homo sapiens
uagcuggauauaauguauu

SEQ ID NO: 597610 - RNA, 18 nt, Homo sapiens
uagcugggauuacaggcg

SEQ ID NO: 597611 - RNA, 14 nt, Homo sapiens
uagcugugaacaga

SEQ ID NO: 597612 - RNA, 11 nt, Homo sapiens
uagcuguucug

SEQ ID NO: 597613 - RNA, 15 nt, Homo sapiens
uagcuuaaguguaaa

SEQ ID NO: 597614 - RNA, 22 nt, Homo sapiens
uagcuuacacugaggacugugg

SEQ ID NO: 597615 - RNA, 14 nt, Homo sapiens
uagcuuagaccuca

SEQ ID NO: 597616 - RNA, 17 nt, Homo sapiens
uagcuuagcaucagagg

SEQ ID NO: 597617 - RNA, 18 nt, Homo sapiens
uagcuuagcugucucaga

SEQ ID NO: 597618 - RNA, 21 nt, Homo sapiens
uagcuuccaccucauggauug

SEQ ID NO: 597619 - RNA, 19 nt, Homo sapiens
uagcuugcaccuugucaca

SEQ ID NO: 597620 - RNA, 23 nt, Homo sapiens
uagcuuggguccaccaugcagaa

SEQ ID NO: 597621 - RNA, 17 nt, Homo sapiens
uagcuuguuccacugca

SEQ ID NO: 597622 - RNA, 17 nt, Homo sapiens
uagcuuuaaaaccacag

SEQ ID NO: 597623 - RNA, 13 nt, Homo sapiens
uagcuuuacaaau

SEQ ID NO: 597624 - RNA, 22 nt, Homo sapiens
uagcuuuccacauuugucacag

SEQ ID NO: 597625 - RNA, 15 nt, Homo sapiens
uagcuuuucauuucu

SEQ ID NO: 597626 - RNA, 16 nt, Homo sapiens
uaggaaaacauugcaa

SEQ ID NO: 597627 - RNA, 21 nt, Homo sapiens
uaggaaaauauggguugcauu

SEQ ID NO: 597628 - RNA, 15 nt, Homo sapiens
uaggaaaaucacuug

SEQ ID NO: 597629 - RNA, 18 nt, Homo sapiens
uaggaaacucacacuccc

SEQ ID NO: 597630 - RNA, 18 nt, Homo sapiens
uaggaaagaggaagcaaa

SEQ ID NO: 597631 - RNA, 12 nt, Homo sapiens
uaggaacaagca

SEQ ID NO: 597632 - RNA, 21 nt, Homo sapiens
uaggaaccuucucccuucuug

SEQ ID NO: 597633 - RNA, 16 nt, Homo sapiens
uaggaacgguaaauuu

SEQ ID NO: 597634 - RNA, 16 nt, Homo sapiens
uaggaagaccaagaca

SEQ ID NO: 597635 - RNA, 23 nt, Homo sapiens
uaggaagagccaggacaugaaga

SEQ ID NO: 597636 - RNA, 16 nt, Homo sapiens
uaggaagcacugaaaa

SEQ ID NO: 597637 - RNA, 17 nt, Homo sapiens
uaggaaggcagcauucc

SEQ ID NO: 597638 - RNA, 19 nt, Homo sapiens
uaggaaggcuacuggcauu

SEQ ID NO: 597639 - RNA, 22 nt, Homo sapiens
uaggaaggggccucaggagcag

SEQ ID NO: 597640 - RNA, 19 nt, Homo sapiens
uaggaagguuaauguucau

SEQ ID NO: 597641 - RNA, 20 nt, Homo sapiens
uaggaaguauggcaugaaca

SEQ ID NO: 597642 - RNA, 22 nt, Homo sapiens
uaggaaucaacuuaacaaaaca

SEQ ID NO: 597643 - RNA, 24 nt, Homo sapiens
uaggaaucccagaggugggauccu

SEQ ID NO: 597644 - RNA, 18 nt, Homo sapiens
uaggaauguccaccauga

SEQ ID NO: 597645 - RNA, 19 nt, Homo sapiens
uaggaauguccaccaugaa

SEQ ID NO: 597646 - RNA, 15 nt, Homo sapiens
uaggaauucuuugca

SEQ ID NO: 597647 - RNA, 12 nt, Homo sapiens
uaggacuccauu

SEQ ID NO: 597648 - RNA, 23 nt, Homo sapiens
uaggagagagugcugcagagcca

SEQ ID NO: 597649 - RNA, 12 nt, Homo sapiens
uaggagcaagaa

SEQ ID NO: 597650 - RNA, 18 nt, Homo sapiens
uaggagcagaaaugcaag

SEQ ID NO: 597651 - RNA, 15 nt, Homo sapiens
uaggaggcuggccaa

SEQ ID NO: 597652 - RNA, 17 nt, Homo sapiens
uaggagggagacacugg

SEQ ID NO: 597653 - RNA, 16 nt, Homo sapiens
uaggagguuauuucaa

SEQ ID NO: 597654 - RNA, 19 nt, Homo sapiens
uaggagugaguguaugugu

SEQ ID NO: 597655 - RNA, 15 nt, Homo sapiens
uaggauauaagaggg

SEQ ID NO: 597656 - RNA, 18 nt, Homo sapiens
uaggaugacugcugugaa

SEQ ID NO: 597657 - RNA, 13 nt, Homo sapiens
uaggcaaaguaca

SEQ ID NO: 597658 - RNA, 23 nt, Homo sapiens
uaggcagagccauaauggacuaa

SEQ ID NO: 597659 - RNA, 16 nt, Homo sapiens
uaggcaggaagcccaa

SEQ ID NO: 597660 - RNA, 19 nt, Homo sapiens
uaggcaggaaggacugucc

SEQ ID NO: 597661 - RNA, 19 nt, Homo sapiens
uaggcaguaauguuccucc

SEQ ID NO: 597662 - RNA, 15 nt, Homo sapiens
uaggcauacacugua

SEQ ID NO: 597663 - RNA, 14 nt, Homo sapiens
uaggcauaccuccu

SEQ ID NO: 597664 - RNA, 23 nt, Homo sapiens
uaggcauugcaggaccuugggca

SEQ ID NO: 597665 - RNA, 23 nt, Homo sapiens
uaggcauuucauuaugcuuugaa

SEQ ID NO: 597666 - RNA, 21 nt, Homo sapiens
uaggccagaguugcaaagauc

SEQ ID NO: 597667 - RNA, 19 nt, Homo sapiens
uaggccagggcauguguau

SEQ ID NO: 597668 - RNA, 15 nt, Homo sapiens
uaggccucucugccu

SEQ ID NO: 597669 - RNA, 19 nt, Homo sapiens
uaggcgggaugggcucgcu

SEQ ID NO: 597670 - RNA, 17 nt, Homo sapiens
uaggcuaagcacuuuau

SEQ ID NO: 597671 - RNA, 17 nt, Homo sapiens
uauaggauagacacugg

SEQ ID NO: 597672 - RNA, 22 nt, Homo sapiens
uauaggcuucucacggcgacca

SEQ ID NO: 597673 - RNA, 15 nt, Homo sapiens
uauaggucacuccug

SEQ ID NO: 597674 - RNA, 14 nt, Homo sapiens
uauaguagcauuuc

SEQ ID NO: 597675 - RNA, 14 nt, Homo sapiens
uauaguaugugacu

SEQ ID NO: 597676 - RNA, 15 nt, Homo sapiens
uauagucgcagcuac

SEQ ID NO: 597677 - RNA, 20 nt, Homo sapiens
uauagugaaaaaugucacua

SEQ ID NO: 597678 - RNA, 22 nt, Homo sapiens
uauagugaacucccaucuauua

SEQ ID NO: 597679 - RNA, 18 nt, Homo sapiens
uauagugcaauagugcaa

SEQ ID NO: 597680 - RNA, 18 nt, Homo sapiens
uauaguuaugcauacaua

SEQ ID NO: 597681 - RNA, 14 nt, Homo sapiens
uauaguugcuugcc

SEQ ID NO: 597682 - RNA, 23 nt, Homo sapiens
uauaguuguuuuauauguugcua

SEQ ID NO: 597683 - RNA, 18 nt, Homo sapiens
uauauaaaugugauugca

SEQ ID NO: 597684 - RNA, 17 nt, Homo sapiens
uauauaagguaugugcu

SEQ ID NO: 597685 - RNA, 15 nt, Homo sapiens
uauauaauaugucac

SEQ ID NO: 597686 - RNA, 17 nt, Homo sapiens
uauauaauguugccagc

SEQ ID NO: 597687 - RNA, 20 nt, Homo sapiens
uauauaauuuccucacugcc

SEQ ID NO: 597688 - RNA, 22 nt, Homo sapiens
uauauaauuuuaugguggaaaa

SEQ ID NO: 597689 - RNA, 13 nt, Homo sapiens
uauauacaaggug

SEQ ID NO: 597690 - RNA, 20 nt, Homo sapiens
uauauacaguaacuuuaugu

SEQ ID NO: 597691 - RNA, 13 nt, Homo sapiens
uauauacauucuu

SEQ ID NO: 597692 - RNA, 13 nt, Homo sapiens
uauauacuuugaa

SEQ ID NO: 597693 - RNA, 21 nt, Homo sapiens
uauauagggaucaaccagcua

SEQ ID NO: 597694 - RNA, 17 nt, Homo sapiens
uauauaguaugaaugca

SEQ ID NO: 597695 - RNA, 21 nt, Homo sapiens
uauauauaauuugaguguaua

SEQ ID NO: 597696 - RNA, 17 nt, Homo sapiens
uauauauguguaugcac

SEQ ID NO: 597697 - RNA, 18 nt, Homo sapiens
uauauauguguguguaua

SEQ ID NO: 597698 - RNA, 13 nt, Homo sapiens
uauauauuuacau

SEQ ID NO: 597699 - RNA, 19 nt, Homo sapiens
uauauauuuauaacucauc

SEQ ID NO: 597700 - RNA, 21 nt, Homo sapiens
uauauauuucuuuaaaccuug

SEQ ID NO: 597701 - RNA, 20 nt, Homo sapiens
uauauauuucuuuguuauca

SEQ ID NO: 597702 - RNA, 15 nt, Homo sapiens
uauaucaagaagucu

SEQ ID NO: 597703 - RNA, 17 nt, Homo sapiens
uauaucacaaucucugu

SEQ ID NO: 597704 - RNA, 12 nt, Homo sapiens
uauauccaugua

SEQ ID NO: 597705 - RNA, 20 nt, Homo sapiens
uauaucgcuggccagcauua

SEQ ID NO: 597706 - RNA, 15 nt, Homo sapiens
uauaucuauauguac

SEQ ID NO: 597707 - RNA, 14 nt, Homo sapiens
uauaucuaugcaaa

SEQ ID NO: 597708 - RNA, 17 nt, Homo sapiens
uauaucuguacagauca

SEQ ID NO: 597709 - RNA, 16 nt, Homo sapiens
uauaugaauuuccacu

SEQ ID NO: 597710 - RNA, 15 nt, Homo sapiens
uauaugacauuguua

SEQ ID NO: 597711 - RNA, 23 nt, Homo sapiens
uauaugaugauuuuuuucucaau

SEQ ID NO: 597712 - RNA, 14 nt, Homo sapiens
uauaugcacauaua

SEQ ID NO: 597713 - RNA, 16 nt, Homo sapiens
uauaugcaccccugga

SEQ ID NO: 597714 - RNA, 18 nt, Homo sapiens
uauauguagaguguuuua

SEQ ID NO: 597715 - RNA, 18 nt, Homo sapiens
uauauguauauacauaua

SEQ ID NO: 597716 - RNA, 14 nt, Homo sapiens
uauaugugugccua

SEQ ID NO: 597717 - RNA, 15 nt, Homo sapiens
uauaugugugccuau

SEQ ID NO: 597718 - RNA, 14 nt, Homo sapiens
uauauguugcuaua

SEQ ID NO: 597719 - RNA, 15 nt, Homo sapiens
uauauuaaaauacca

SEQ ID NO: 597720 - RNA, 13 nt, Homo sapiens
uauauuaauauca

SEQ ID NO: 597721 - RNA, 17 nt, Homo sapiens
uauauuaaucagcauua

SEQ ID NO: 597722 - RNA, 15 nt, Homo sapiens
uauauucaacucaua

SEQ ID NO: 597723 - RNA, 16 nt, Homo sapiens
uauauucaggaguugg

SEQ ID NO: 597724 - RNA, 14 nt, Homo sapiens
uauauucuaagcca

SEQ ID NO: 597725 - RNA, 20 nt, Homo sapiens
uauauugaagacaauuugau

SEQ ID NO: 597726 - RNA, 21 nt, Homo sapiens
uauauugcuuaccugaucuca

SEQ ID NO: 597727 - RNA, 16 nt, Homo sapiens
uauauuuauacuguau

SEQ ID NO: 597728 - RNA, 16 nt, Homo sapiens
uauauuucuguguaca

SEQ ID NO: 597729 - RNA, 19 nt, Homo sapiens
uauauuugcagauaauucu

SEQ ID NO: 597730 - RNA, 11 nt, Homo sapiens
uauauuugcua

SEQ ID NO: 597731 - RNA, 19 nt, Homo sapiens
uauauuugugauagcacuu

SEQ ID NO: 597732 - RNA, 20 nt, Homo sapiens
uauauuugugugugugauau

SEQ ID NO: 597733 - RNA, 16 nt, Homo sapiens
uauauuuuuacuucuu

SEQ ID NO: 597734 - RNA, 17 nt, Homo sapiens
uauauuuuucugagauu

SEQ ID NO: 597735 - RNA, 23 nt, Homo sapiens
uauauuuuuuguaacauaaugca

SEQ ID NO: 597736 - RNA, 11 nt, Homo sapiens
uaucaaaaagc

SEQ ID NO: 597737 - RNA, 23 nt, Homo sapiens
uaucaaacagccccagucuuccu

SEQ ID NO: 597738 - RNA, 18 nt, Homo sapiens
uaucaaagaaagaugaaa

SEQ ID NO: 597739 - RNA, 11 nt, Homo sapiens
uaucaaagugu

SEQ ID NO: 597740 - RNA, 21 nt, Homo sapiens
uaucaaagugugauauacaaa

SEQ ID NO: 597741 - RNA, 20 nt, Homo sapiens
uaucaaaugaaacucuuuca

SEQ ID NO: 597742 - RNA, 12 nt, Homo sapiens
uaucaacuuuag

SEQ ID NO: 597743 - RNA, 14 nt, Homo sapiens
uaucaagccaaaga

SEQ ID NO: 597744 - RNA, 23 nt, Homo sapiens
uaucacaugaauauaaaugggaa

SEQ ID NO: 597745 - RNA, 13 nt, Homo sapiens
uaucacgcagauc

SEQ ID NO: 597746 - RNA, 18 nt, Homo sapiens
uaucacucccacuuccuu

SEQ ID NO: 597747 - RNA, 19 nt, Homo sapiens
uaucacugaacaaacuaaa

SEQ ID NO: 597748 - RNA, 21 nt, Homo sapiens
uaucacugguccaccuccuga

SEQ ID NO: 597749 - RNA, 19 nt, Homo sapiens
uaucacuucacuguucucu

SEQ ID NO: 597750 - RNA, 18 nt, Homo sapiens
uaucagaauacuugcacu

SEQ ID NO: 597751 - RNA, 16 nt, Homo sapiens
uaucagacaagcacua

SEQ ID NO: 597752 - RNA, 18 nt, Homo sapiens
uaucagagucaugaugaa

SEQ ID NO: 597753 - RNA, 18 nt, Homo sapiens
uaucagaucuaucuuguc

SEQ ID NO: 597754 - RNA, 21 nt, Homo sapiens
uaucaggaguucuaggaacuc

SEQ ID NO: 597755 - RNA, 16 nt, Homo sapiens
uaucaguaccucucaa

SEQ ID NO: 597756 - RNA, 14 nt, Homo sapiens
uaucagucauaacu

SEQ ID NO: 597757 - RNA, 21 nt, Homo sapiens
uaucagugcuucccgagugag

SEQ ID NO: 597758 - RNA, 19 nt, Homo sapiens
uaucauaauucagcacuua

SEQ ID NO: 597759 - RNA, 22 nt, Homo sapiens
uaucauaucucucuuuacuucc

SEQ ID NO: 597760 - RNA, 20 nt, Homo sapiens
uaucaucucaccacaccaca

SEQ ID NO: 597761 - RNA, 20 nt, Homo sapiens
uaucaucuucucauuuugca

SEQ ID NO: 597762 - RNA, 11 nt, Homo sapiens
uaucaucuuuu

SEQ ID NO: 597763 - RNA, 18 nt, Homo sapiens
uaucaugaagauguuggu

SEQ ID NO: 597764 - RNA, 17 nt, Homo sapiens
uaucaugcccugugcaa

SEQ ID NO: 597765 - RNA, 19 nt, Homo sapiens
uaucaugcccugugcaacc

SEQ ID NO: 597766 - RNA, 17 nt, Homo sapiens
uaucauggugaaaagcu

SEQ ID NO: 597767 - RNA, 20 nt, Homo sapiens
uaucauggugaaaagcucca

SEQ ID NO: 597768 - RNA, 15 nt, Homo sapiens
uaucauguaccucag

SEQ ID NO: 597769 - RNA, 22 nt, Homo sapiens
uaucauuaaacaaauaaaauac

SEQ ID NO: 597770 - RNA, 16 nt, Homo sapiens
uaucauuccaauucua

SEQ ID NO: 597771 - RNA, 13 nt, Homo sapiens
uaucauugcuaaa

SEQ ID NO: 597772 - RNA, 21 nt, Homo sapiens
uaucauuuuaaaaacuuuauu

SEQ ID NO: 597773 - RNA, 15 nt, Homo sapiens
uauccaaagacugua

SEQ ID NO: 597774 - RNA, 19 nt, Homo sapiens
uauccaagaaucagugaag

SEQ ID NO: 597775 - RNA, 13 nt, Homo sapiens
uauccaagacuua

SEQ ID NO: 597776 - RNA, 23 nt, Homo sapiens
uauccaagacuuagagcugggaa

SEQ ID NO: 597777 - RNA, 19 nt, Homo sapiens
uauccaaguguuauaccaa

SEQ ID NO: 597778 - RNA, 18 nt, Homo sapiens
uauccaauaggcauuuga

SEQ ID NO: 597779 - RNA, 14 nt, Homo sapiens
uauccaccaccucc

SEQ ID NO: 597780 - RNA, 17 nt, Homo sapiens
uauccaggacucuguca

SEQ ID NO: 597781 - RNA, 15 nt, Homo sapiens
uauccaggacuguuu

SEQ ID NO: 597782 - RNA, 23 nt, Homo sapiens
uauccauauuuuacugaucucuu

SEQ ID NO: 597783 - RNA, 19 nt, Homo sapiens
uauccauguaauaagcacu

SEQ ID NO: 597784 - RNA, 16 nt, Homo sapiens
uauccauugaacuaaa

SEQ ID NO: 597785 - RNA, 16 nt, Homo sapiens
uaucccaacauucugc

SEQ ID NO: 597786 - RNA, 18 nt, Homo sapiens
uaucccauugaaacaaaa

SEQ ID NO: 597787 - RNA, 21 nt, Homo sapiens
uauccccauucucugccugua

SEQ ID NO: 597788 - RNA, 20 nt, Homo sapiens
uauccuccccuuuuaccacu

SEQ ID NO: 597789 - RNA, 18 nt, Homo sapiens
uauccuccuguucugaaa

SEQ ID NO: 597790 - RNA, 23 nt, Homo sapiens
uauccugcgaccuugcaaccuca

SEQ ID NO: 597791 - RNA, 16 nt, Homo sapiens
uauccugcuagcugua

SEQ ID NO: 597792 - RNA, 20 nt, Homo sapiens
uauccugcuagcuguagaaa

SEQ ID NO: 597793 - RNA, 19 nt, Homo sapiens
uccuuccccagcuuugcug

SEQ ID NO: 597794 - RNA, 17 nt, Homo sapiens
uccuucccucucugaug

SEQ ID NO: 597795 - RNA, 15 nt, Homo sapiens
uccuuccugggaccc

SEQ ID NO: 597796 - RNA, 14 nt, Homo sapiens
uccuuccuuaucac

SEQ ID NO: 597797 - RNA, 15 nt, Homo sapiens
uccuuccuucagggu

SEQ ID NO: 597798 - RNA, 13 nt, Homo sapiens
uccuucgcuggaa

SEQ ID NO: 597799 - RNA, 17 nt, Homo sapiens
uccuucgggugcuggaa

SEQ ID NO: 597800 - RNA, 18 nt, Homo sapiens
uccuucuauucuagccug

SEQ ID NO: 597801 - RNA, 19 nt, Homo sapiens
uccuucucucacuguguua

SEQ ID NO: 597802 - RNA, 16 nt, Homo sapiens
uccuucugaccacagc

SEQ ID NO: 597803 - RNA, 22 nt, Homo sapiens
uccuucugggacuggacagcuu

SEQ ID NO: 597804 - RNA, 13 nt, Homo sapiens
uccuucuuccuag

SEQ ID NO: 597805 - RNA, 20 nt, Homo sapiens
uccuucuuucuaguucagcu

SEQ ID NO: 597806 - RNA, 21 nt, Homo sapiens
uccuugaaaaacaaaguuucu

SEQ ID NO: 597807 - RNA, 15 nt, Homo sapiens
uccuugaaaaugugu

SEQ ID NO: 597808 - RNA, 20 nt, Homo sapiens
uccuugacccugcuuuuugc

SEQ ID NO: 597809 - RNA, 19 nt, Homo sapiens
uccuugacuucuuugagaa

SEQ ID NO: 597810 - RNA, 19 nt, Homo sapiens
uccuugauacuaaaaguuc

SEQ ID NO: 597811 - RNA, 19 nt, Homo sapiens
uccuugauaucauucagca

SEQ ID NO: 597812 - RNA, 11 nt, Homo sapiens
uccuugcaaau

SEQ ID NO: 597813 - RNA, 19 nt, Homo sapiens
uccuugcaaccaggcagcu

SEQ ID NO: 597814 - RNA, 18 nt, Homo sapiens
uccuugcacaaauggagg

SEQ ID NO: 597815 - RNA, 14 nt, Homo sapiens
uccuugcaccugca

SEQ ID NO: 597816 - RNA, 19 nt, Homo sapiens
uccuuggaacacauaagaa

SEQ ID NO: 597817 - RNA, 16 nt, Homo sapiens
uccuuggaccguauca

SEQ ID NO: 597818 - RNA, 20 nt, Homo sapiens
uccuuggagggacaugacua

SEQ ID NO: 597819 - RNA, 22 nt, Homo sapiens
uccuuggauaauuccccaagag

SEQ ID NO: 597820 - RNA, 15 nt, Homo sapiens
uccuuggauguaguc

SEQ ID NO: 597821 - RNA, 21 nt, Homo sapiens
uccuugguugggucaaggaca

SEQ ID NO: 597822 - RNA, 17 nt, Homo sapiens
uccuuguaaagacugua

SEQ ID NO: 597823 - RNA, 13 nt, Homo sapiens
uccuugucaauac

SEQ ID NO: 597824 - RNA, 20 nt, Homo sapiens
uccuugucucugcuaagaaa

SEQ ID NO: 597825 - RNA, 16 nt, Homo sapiens
uccuuguggucuuugc

SEQ ID NO: 597826 - RNA, 13 nt, Homo sapiens
uccuugugguuuu

SEQ ID NO: 597827 - RNA, 20 nt, Homo sapiens
uccuuguguuuuguccugcc

SEQ ID NO: 597828 - RNA, 20 nt, Homo sapiens
uccuuguuagaaugcaagca

SEQ ID NO: 597829 - RNA, 23 nt, Homo sapiens
uccuuuaaaaaacuuagugacaa

SEQ ID NO: 597830 - RNA, 21 nt, Homo sapiens
uccuuuacgguccaugccuuu

SEQ ID NO: 597831 - RNA, 22 nt, Homo sapiens
uccuuuacuaaugguguugagu

SEQ ID NO: 597832 - RNA, 18 nt, Homo sapiens
uccuuuaguaccugaaaa

SEQ ID NO: 597833 - RNA, 20 nt, Homo sapiens
uccuuuauacacaguggauu

SEQ ID NO: 597834 - RNA, 21 nt, Homo sapiens
uccuuuauuauaaucaaagcu

SEQ ID NO: 597835 - RNA, 18 nt, Homo sapiens
uccuuucacccgcuccua

SEQ ID NO: 597836 - RNA, 17 nt, Homo sapiens
uccuuucagaacacuca

SEQ ID NO: 597837 - RNA, 21 nt, Homo sapiens
uccuuucagaacacucaaagg

SEQ ID NO: 597838 - RNA, 15 nt, Homo sapiens
uccuuuccauuguag

SEQ ID NO: 597839 - RNA, 16 nt, Homo sapiens
uccuuucuccagccag

SEQ ID NO: 597840 - RNA, 15 nt, Homo sapiens
uccuuucuugcagau

SEQ ID NO: 597841 - RNA, 19 nt, Homo sapiens
uccuuugagaaugugauuc

SEQ ID NO: 597842 - RNA, 15 nt, Homo sapiens
uccuuugaucccaga

SEQ ID NO: 597843 - RNA, 17 nt, Homo sapiens
uccuuugaucccagaaa

SEQ ID NO: 597844 - RNA, 12 nt, Homo sapiens
uccuuugcacug

SEQ ID NO: 597845 - RNA, 15 nt, Homo sapiens
uccuuugcauggcag

SEQ ID NO: 597846 - RNA, 15 nt, Homo sapiens
uccuuugcugcugag

SEQ ID NO: 597847 - RNA, 22 nt, Homo sapiens
uccuuuggaacaagacagccuu

SEQ ID NO: 597848 - RNA, 18 nt, Homo sapiens
uccuuuggcaugggaugg

SEQ ID NO: 597849 - RNA, 13 nt, Homo sapiens
uccuuugucuuaa

SEQ ID NO: 597850 - RNA, 17 nt, Homo sapiens
uccuuuuaaccauuuua

SEQ ID NO: 597851 - RNA, 16 nt, Homo sapiens
uccuuuuaauuuuccu

SEQ ID NO: 597852 - RNA, 15 nt, Homo sapiens
uccuuuuccacuuua

SEQ ID NO: 597853 - RNA, 22 nt, Homo sapiens
uccuuuucccaggaaagaagca

SEQ ID NO: 597854 - RNA, 19 nt, Homo sapiens
uccuuuuccuaauucacac

SEQ ID NO: 597855 - RNA, 18 nt, Homo sapiens
uccuuuucuacaugaugc

SEQ ID NO: 597856 - RNA, 18 nt, Homo sapiens
uccuuuucuccuugccuu

SEQ ID NO: 597857 - RNA, 23 nt, Homo sapiens
uccuuuugaaagaaucagucuug

SEQ ID NO: 597858 - RNA, 19 nt, Homo sapiens
uccuuuugaaauuguagug

SEQ ID NO: 597859 - RNA, 14 nt, Homo sapiens
uccuuuugaccaaa

SEQ ID NO: 597860 - RNA, 24 nt, Homo sapiens
uccuuuugaccaaauaaaguacca

SEQ ID NO: 597861 - RNA, 15 nt, Homo sapiens
uccuuuuguguacag

SEQ ID NO: 597862 - RNA, 19 nt, Homo sapiens
uccuuuuuuauacaggaaa

SEQ ID NO: 597863 - RNA, 19 nt, Homo sapiens
uccuuuuuucaauaugcaa

SEQ ID NO: 597864 - RNA, 22 nt, Homo sapiens
uccuuuuuucaauaugcaagca

SEQ ID NO: 597865 - RNA, 17 nt, Homo sapiens
uccuuuuuugcaugugc

SEQ ID NO: 597866 - RNA, 16 nt, Homo sapiens
ucgaaacugacaguau

SEQ ID NO: 597867 - RNA, 17 nt, Homo sapiens
ucgaaacugacaguauu

SEQ ID NO: 597868 - RNA, 13 nt, Homo sapiens
ucgaacacauuca

SEQ ID NO: 597869 - RNA, 19 nt, Homo sapiens
ucgaagcuccgugagugaa

SEQ ID NO: 597870 - RNA, 18 nt, Homo sapiens
ucgacacuaaaaacugau

SEQ ID NO: 597871 - RNA, 17 nt, Homo sapiens
ucgaccaggaaagccac

SEQ ID NO: 597872 - RNA, 19 nt, Homo sapiens
ucgacuguauucgugcauu

SEQ ID NO: 597873 - RNA, 22 nt, Homo sapiens
ucgacuugaucgugcagcugcu

SEQ ID NO: 597874 - RNA, 15 nt, Homo sapiens
ucgagagcuggccaa

SEQ ID NO: 597875 - RNA, 23 nt, Homo sapiens
ucgagauguucgcucgugcagua

SEQ ID NO: 597876 - RNA, 21 nt, Homo sapiens
ucgagcauguuguuuuuucau

SEQ ID NO: 597877 - RNA, 21 nt, Homo sapiens
ucgagccacaaccgaccagau

SEQ ID NO: 597878 - RNA, 14 nt, Homo sapiens
ucgaggggcucuca

SEQ ID NO: 597879 - RNA, 15 nt, Homo sapiens
ucgaggggcucucag

SEQ ID NO: 597880 - RNA, 16 nt, Homo sapiens
ucgaguaaacuugaaa

SEQ ID NO: 597881 - RNA, 18 nt, Homo sapiens
ucgaugcguucacuccaa

SEQ ID NO: 597882 - RNA, 19 nt, Homo sapiens
ucgauggcucaaucuaucc

SEQ ID NO: 597883 - RNA, 14 nt, Homo sapiens
ucgauuagacugga

SEQ ID NO: 597884 - RNA, 16 nt, Homo sapiens
ucgauuuaugccucag

SEQ ID NO: 597885 - RNA, 12 nt, Homo sapiens
ucgcaccuacca

SEQ ID NO: 597886 - RNA, 14 nt, Homo sapiens
ucgcauccagacag

SEQ ID NO: 597887 - RNA, 19 nt, Homo sapiens
ucgcaucucagugcaggag

SEQ ID NO: 597888 - RNA, 20 nt, Homo sapiens
ucgcaucuugugucgcugaa

SEQ ID NO: 597889 - RNA, 21 nt, Homo sapiens
ucgcauggcagccaucaaaga

SEQ ID NO: 597890 - RNA, 14 nt, Homo sapiens
ucgcauuugucaau

SEQ ID NO: 597891 - RNA, 22 nt, Homo sapiens
ucgccccuccaguguugccucc

SEQ ID NO: 597892 - RNA, 21 nt, Homo sapiens
ucgcccugcgguagaugggag

SEQ ID NO: 597893 - RNA, 16 nt, Homo sapiens
ucgccuaggccuguga

SEQ ID NO: 597894 - RNA, 23 nt, Homo sapiens
ucgccuccucuacaauuugccau

SEQ ID NO: 597895 - RNA, 16 nt, Homo sapiens
ucgcgcgacugagaac

SEQ ID NO: 597896 - RNA, 13 nt, Homo sapiens
ucgcucuuuucaa

SEQ ID NO: 597897 - RNA, 10 nt, Homo sapiens
ucgcuuuaug

SEQ ID NO: 597898 - RNA, 23 nt, Homo sapiens
ucggacaugaaaggacccuguga

SEQ ID NO: 597899 - RNA, 18 nt, Homo sapiens
ucggagucuguaaaacca

SEQ ID NO: 597900 - RNA, 22 nt, Homo sapiens
ucggaucucacaggcugagaac

SEQ ID NO: 597901 - RNA, 13 nt, Homo sapiens
ucggaucucucca

SEQ ID NO: 597902 - RNA, 15 nt, Homo sapiens
ucggccccucugauu

SEQ ID NO: 597903 - RNA, 13 nt, Homo sapiens
ucggcucacugca

SEQ ID NO: 597904 - RNA, 17 nt, Homo sapiens
ucggcuucuuggaccuu

SEQ ID NO: 597905 - RNA, 18 nt, Homo sapiens
ucggcuugaucacagcuc

SEQ ID NO: 597906 - RNA, 11 nt, Homo sapiens
ucgggacauca

SEQ ID NO: 597907 - RNA, 18 nt, Homo sapiens
ucgggaguucgagaccag

SEQ ID NO: 597908 - RNA, 17 nt, Homo sapiens
ucgggccccauccucau

SEQ ID NO: 597909 - RNA, 21 nt, Homo sapiens
ucgggccccgaaugucacugg

SEQ ID NO: 597910 - RNA, 16 nt, Homo sapiens
ucgggcgccccugugg

SEQ ID NO: 597911 - RNA, 18 nt, Homo sapiens
ucgggcugagaaggcagu

SEQ ID NO: 597912 - RNA, 15 nt, Homo sapiens
ucgggcuucaccgcc

SEQ ID NO: 597913 - RNA, 15 nt, Homo sapiens
ucggggccugcugga

SEQ ID NO: 597914 - RNA, 21 nt, Homo sapiens
ucgguauccccccaucuugcu

SEQ ID NO: 597915 - RNA, 16 nt, Homo sapiens
ucuacuuaaugagaua

SEQ ID NO: 597916 - RNA, 20 nt, Homo sapiens
ucuacuucaaaaacauuuca

SEQ ID NO: 597917 - RNA, 18 nt, Homo sapiens
ucuacuucauagcuccuu

SEQ ID NO: 597918 - RNA, 17 nt, Homo sapiens
ucuacuuccccauuuca

SEQ ID NO: 597919 - RNA, 18 nt, Homo sapiens
ucuacuuccccauuucag

SEQ ID NO: 597920 - RNA, 18 nt, Homo sapiens
ucuacuuggugguuugcu

SEQ ID NO: 597921 - RNA, 13 nt, Homo sapiens
ucuacuuguaaaa

SEQ ID NO: 597922 - RNA, 17 nt, Homo sapiens
ucuacuuugauucugau

SEQ ID NO: 597923 - RNA, 12 nt, Homo sapiens
ucuacuuuuuga

SEQ ID NO: 597924 - RNA, 17 nt, Homo sapiens
ucuagaaaggaguguga

SEQ ID NO: 597925 - RNA, 15 nt, Homo sapiens
ucuagaacaugcaca

SEQ ID NO: 597926 - RNA, 22 nt, Homo sapiens
ucuagacucaaaaccuggagau

SEQ ID NO: 597927 - RNA, 20 nt, Homo sapiens
ucuagacugccagggagacc

SEQ ID NO: 597928 - RNA, 22 nt, Homo sapiens
ucuagacugucucuguggaaua

SEQ ID NO: 597929 - RNA, 16 nt, Homo sapiens
ucuagagcagggauua

SEQ ID NO: 597930 - RNA, 15 nt, Homo sapiens
ucuagaggcaaggag

SEQ ID NO: 597931 - RNA, 18 nt, Homo sapiens
ucuagauccugcacccca

SEQ ID NO: 597932 - RNA, 21 nt, Homo sapiens
ucuagcaaauguuaugcauaa

SEQ ID NO: 597933 - RNA, 14 nt, Homo sapiens
ucuagcaagggagg

SEQ ID NO: 597934 - RNA, 14 nt, Homo sapiens
ucuagcaguaaaag

SEQ ID NO: 597935 - RNA, 19 nt, Homo sapiens
ucuagcauucuaguuucau

SEQ ID NO: 597936 - RNA, 18 nt, Homo sapiens
ucuagcugucugugaaua

SEQ ID NO: 597937 - RNA, 15 nt, Homo sapiens
ucuagcugugggggu

SEQ ID NO: 597938 - RNA, 22 nt, Homo sapiens
ucuaggaaauauacuuuuacaa

SEQ ID NO: 597939 - RNA, 21 nt, Homo sapiens
ucuaggacuagaaaaacuugg

SEQ ID NO: 597940 - RNA, 18 nt, Homo sapiens
ucuaggagucaacuggcu

SEQ ID NO: 597941 - RNA, 21 nt, Homo sapiens
ucuaggccuucaggacucuag

SEQ ID NO: 597942 - RNA, 13 nt, Homo sapiens
ucuaggcuaagca

SEQ ID NO: 597943 - RNA, 17 nt, Homo sapiens
ucuaggcuaagcacuuu

SEQ ID NO: 597944 - RNA, 15 nt, Homo sapiens
ucuagggaaucugga

SEQ ID NO: 597945 - RNA, 18 nt, Homo sapiens
ucuagggaaucuggauua

SEQ ID NO: 597946 - RNA, 16 nt, Homo sapiens
ucuagggccucuccag

SEQ ID NO: 597947 - RNA, 19 nt, Homo sapiens
ucuaguaagaugcacugaa

SEQ ID NO: 597948 - RNA, 21 nt, Homo sapiens
ucuagucuccuuugcacugag

SEQ ID NO: 597949 - RNA, 21 nt, Homo sapiens
ucuagucucucuggggccaca

SEQ ID NO: 597950 - RNA, 13 nt, Homo sapiens
ucuagugaaugaa

SEQ ID NO: 597951 - RNA, 17 nt, Homo sapiens
ucuagugcaguaaaggg

SEQ ID NO: 597952 - RNA, 20 nt, Homo sapiens
ucuaguuaaccuagaaguau

SEQ ID NO: 597953 - RNA, 17 nt, Homo sapiens
ucuaguucauugaauca

SEQ ID NO: 597954 - RNA, 14 nt, Homo sapiens
ucuauaaacagaca

SEQ ID NO: 597955 - RNA, 20 nt, Homo sapiens
ucuauaccaaccaaaccaau

SEQ ID NO: 597956 - RNA, 22 nt, Homo sapiens
ucuauacuuaaucucacauuca

SEQ ID NO: 597957 - RNA, 19 nt, Homo sapiens
ucuauagcugcuauagcaa

SEQ ID NO: 597958 - RNA, 21 nt, Homo sapiens
ucuauauaguuccuugccuua

SEQ ID NO: 597959 - RNA, 23 nt, Homo sapiens
ucuauaucucauuucauucucac

SEQ ID NO: 597960 - RNA, 17 nt, Homo sapiens
ucuauauggaauugcuu

SEQ ID NO: 597961 - RNA, 15 nt, Homo sapiens
ucuaucaacuuuaau

SEQ ID NO: 597962 - RNA, 19 nt, Homo sapiens
ucuaucaccaaggagccaa

SEQ ID NO: 597963 - RNA, 23 nt, Homo sapiens
ucuaucaccaaggagccaaacau

SEQ ID NO: 597964 - RNA, 23 nt, Homo sapiens
ucuaucucucuuuacauuuuggu

SEQ ID NO: 597965 - RNA, 18 nt, Homo sapiens
ucuaucugguuggauggu

SEQ ID NO: 597966 - RNA, 17 nt, Homo sapiens
ucuaugaacaacuccaa

SEQ ID NO: 597967 - RNA, 20 nt, Homo sapiens
ucuaugaacuuagaguuuac

SEQ ID NO: 597968 - RNA, 20 nt, Homo sapiens
ucuaugacuuagguaaaaua

SEQ ID NO: 597969 - RNA, 23 nt, Homo sapiens
ucuaugagcccagaucaccaccu

SEQ ID NO: 597970 - RNA, 14 nt, Homo sapiens
ucuaugccaaagau

SEQ ID NO: 597971 - RNA, 21 nt, Homo sapiens
ucuaugccuaaaaaguaucau

SEQ ID NO: 597972 - RNA, 23 nt, Homo sapiens
ucuaugcucucgcaccuuuccaa

SEQ ID NO: 597973 - RNA, 18 nt, Homo sapiens
ucuauggggagaaaggga

SEQ ID NO: 597974 - RNA, 19 nt, Homo sapiens
ucuaugguacuaaggaagu

SEQ ID NO: 597975 - RNA, 14 nt, Homo sapiens
ucuauguggcugua

SEQ ID NO: 597976 - RNA, 11 nt, Homo sapiens
ucuauguuaau

SEQ ID NO: 597977 - RNA, 21 nt, Homo sapiens
ucuauguucaaagacugugaa

SEQ ID NO: 597978 - RNA, 18 nt, Homo sapiens
ucuauguuuguauuugga

SEQ ID NO: 597979 - RNA, 16 nt, Homo sapiens
ucuauuacgugcaaua

SEQ ID NO: 597980 - RNA, 14 nt, Homo sapiens
ucuauuauagccac

SEQ ID NO: 597981 - RNA, 12 nt, Homo sapiens
ucuauucuugga

SEQ ID NO: 597982 - RNA, 23 nt, Homo sapiens
ucuauugcuucaccauggccuua

SEQ ID NO: 597983 - RNA, 19 nt, Homo sapiens
ucuauugucgcuaugugac

SEQ ID NO: 597984 - RNA, 21 nt, Homo sapiens
ucuauuugccuccagugcagu

SEQ ID NO: 597985 - RNA, 14 nt, Homo sapiens
ucuauuuguacaau

SEQ ID NO: 597986 - RNA, 21 nt, Homo sapiens
ucuauuuuaguugguuuguau

SEQ ID NO: 597987 - RNA, 14 nt, Homo sapiens
ucuauuuucucagu

SEQ ID NO: 597988 - RNA, 16 nt, Homo sapiens
ucuauuuugugaugau

SEQ ID NO: 597989 - RNA, 20 nt, Homo sapiens
ucuauuuuuaucaugaauuc

SEQ ID NO: 597990 - RNA, 22 nt, Homo sapiens
ucucaaacacaguuacacuugu

SEQ ID NO: 597991 - RNA, 20 nt, Homo sapiens
ucucaaaccgccggccacac

SEQ ID NO: 597992 - RNA, 19 nt, Homo sapiens
ucucaaacucccgaccuca

SEQ ID NO: 597993 - RNA, 16 nt, Homo sapiens
ucucaaacuccugacc

SEQ ID NO: 597994 - RNA, 20 nt, Homo sapiens
ucucaaacuccugaccucag

SEQ ID NO: 597995 - RNA, 16 nt, Homo sapiens
ucucaaacuucacuaa

SEQ ID NO: 597996 - RNA, 16 nt, Homo sapiens
ucucaaaugcacaucu

SEQ ID NO: 597997 - RNA, 21 nt, Homo sapiens
ucucaaauucucaaccuacca

SEQ ID NO: 597998 - RNA, 12 nt, Homo sapiens
ucucaagagcca

SEQ ID NO: 597999 - RNA, 20 nt, Homo sapiens
ucucaaggggcccagccucc

SEQ ID NO: 598000 - RNA, 14 nt, Homo sapiens
ucucaauaguaaaa

SEQ ID NO: 598001 - RNA, 17 nt, Homo sapiens
ucucaaucagugcagug

SEQ ID NO: 598002 - RNA, 17 nt, Homo sapiens
ucucaaugaagccagcu

SEQ ID NO: 598003 - RNA, 16 nt, Homo sapiens
ucucaauugucauuga

SEQ ID NO: 598004 - RNA, 17 nt, Homo sapiens
ucucacaaaaaggcaaa

SEQ ID NO: 598005 - RNA, 12 nt, Homo sapiens
ucucacaaauga

SEQ ID NO: 598006 - RNA, 19 nt, Homo sapiens
ucucacaaggaaaaggcca

SEQ ID NO: 598007 - RNA, 20 nt, Homo sapiens
ucucacauaagcccaguuca

SEQ ID NO: 598008 - RNA, 22 nt, Homo sapiens
ucucacauaagcccaguucauc

SEQ ID NO: 598009 - RNA, 14 nt, Homo sapiens
ucucacauguggca

SEQ ID NO: 598010 - RNA, 17 nt, Homo sapiens
ucucaccacgggaaagc

SEQ ID NO: 598011 - RNA, 15 nt, Homo sapiens
ucucacccauuaucu

SEQ ID NO: 598012 - RNA, 21 nt, Homo sapiens
ucucaccugccgugcguacug

SEQ ID NO: 598013 - RNA, 15 nt, Homo sapiens
ucucacuauaccagu

SEQ ID NO: 598014 - RNA, 14 nt, Homo sapiens
ucucacuccagcca

SEQ ID NO: 598015 - RNA, 20 nt, Homo sapiens
ucucacuuauaccaaaggga

SEQ ID NO: 598016 - RNA, 14 nt, Homo sapiens
ucucacuugucuca

SEQ ID NO: 598017 - RNA, 22 nt, Homo sapiens
ucucacuuugguuggaacuuua

SEQ ID NO: 598018 - RNA, 17 nt, Homo sapiens
ucucagaaccacuccug

SEQ ID NO: 598019 - RNA, 23 nt, Homo sapiens
ucucagaacccaucgguaggcaa

SEQ ID NO: 598020 - RNA, 12 nt, Homo sapiens
ucucagaaccuu

SEQ ID NO: 598021 - RNA, 16 nt, Homo sapiens
ucucagacgacaccug

SEQ ID NO: 598022 - RNA, 13 nt, Homo sapiens
ucucagagcaugu

SEQ ID NO: 598023 - RNA, 13 nt, Homo sapiens
ucucagagcauuu

SEQ ID NO: 598024 - RNA, 16 nt, Homo sapiens
ucucagauacuuauga

SEQ ID NO: 598025 - RNA, 12 nt, Homo sapiens
ucucagcacuuu

SEQ ID NO: 598026 - RNA, 13 nt, Homo sapiens
ucucagcacuuug

SEQ ID NO: 598027 - RNA, 16 nt, Homo sapiens
ucucagccuaccauga

SEQ ID NO: 598028 - RNA, 16 nt, Homo sapiens
ucucagcucaccucaa

SEQ ID NO: 598029 - RNA, 15 nt, Homo sapiens
ucucagcugaaauua

SEQ ID NO: 598030 - RNA, 14 nt, Homo sapiens
ucucaggaccaaag

SEQ ID NO: 598031 - RNA, 19 nt, Homo sapiens
ucucaggaccaaagcuuuc

SEQ ID NO: 598032 - RNA, 21 nt, Homo sapiens
ucucagggaaagccucuggca

SEQ ID NO: 598033 - RNA, 14 nt, Homo sapiens
ucucagggugcaga

SEQ ID NO: 598034 - RNA, 21 nt, Homo sapiens
ucucagucauuuuuaaccucu

SEQ ID NO: 598035 - RNA, 15 nt, Homo sapiens
ucucaguucuugagg

SEQ ID NO: 598036 - RNA, 17 nt, Homo sapiens
ucucauaaugaagacau

SEQ ID NO: 598037 - RNA, 23 nt, Homo sapiens
ucugcaagugaggugugucacaa

SEQ ID NO: 598038 - RNA, 21 nt, Homo sapiens
ucugcaauggcagcaggaucu

SEQ ID NO: 598039 - RNA, 20 nt, Homo sapiens
ucugcaaugggcacugggau

SEQ ID NO: 598040 - RNA, 13 nt, Homo sapiens
ucugcacacagca

SEQ ID NO: 598041 - RNA, 19 nt, Homo sapiens
ucugcaccaacucaccugg

SEQ ID NO: 598042 - RNA, 18 nt, Homo sapiens
ucugcaccacaccuggca

SEQ ID NO: 598043 - RNA, 17 nt, Homo sapiens
ucugcagaaacuacuga

SEQ ID NO: 598044 - RNA, 20 nt, Homo sapiens
ucugcagcacucuuaucuac

SEQ ID NO: 598045 - RNA, 21 nt, Homo sapiens
ucugcagggggugugucugcu

SEQ ID NO: 598046 - RNA, 23 nt, Homo sapiens
ucugcagggggugugucugcuca

SEQ ID NO: 598047 - RNA, 17 nt, Homo sapiens
ucugcagggugacgccu

SEQ ID NO: 598048 - RNA, 16 nt, Homo sapiens
ucugcaguccuacuca

SEQ ID NO: 598049 - RNA, 20 nt, Homo sapiens
ucugcauccagagauucauu

SEQ ID NO: 598050 - RNA, 22 nt, Homo sapiens
ucugcauccauuugaacacauu

SEQ ID NO: 598051 - RNA, 22 nt, Homo sapiens
ucugcaugucuacucagcauuu

SEQ ID NO: 598052 - RNA, 17 nt, Homo sapiens
ucugcauuaucuaugca

SEQ ID NO: 598053 - RNA, 21 nt, Homo sapiens
ucugcauuaucugaggucaca

SEQ ID NO: 598054 - RNA, 19 nt, Homo sapiens
ucugcauuccugaugacca

SEQ ID NO: 598055 - RNA, 20 nt, Homo sapiens
ucugccaaaggaugugauau

SEQ ID NO: 598056 - RNA, 13 nt, Homo sapiens
ucugccacccacu

SEQ ID NO: 598057 - RNA, 17 nt, Homo sapiens
ucugccacccuaccugu

SEQ ID NO: 598058 - RNA, 17 nt, Homo sapiens
ucugccauaucagugaa

SEQ ID NO: 598059 - RNA, 19 nt, Homo sapiens
ucugccauuaaaacauuac

SEQ ID NO: 598060 - RNA, 15 nt, Homo sapiens
ucugcccacagucuu

SEQ ID NO: 598061 - RNA, 16 nt, Homo sapiens
ucugcccagaauucua

SEQ ID NO: 598062 - RNA, 21 nt, Homo sapiens
ucugcccccgcggguucuaga

SEQ ID NO: 598063 - RNA, 16 nt, Homo sapiens
ucugccccucaggggg

SEQ ID NO: 598064 - RNA, 23 nt, Homo sapiens
ucugcccuagcgcucucuuccag

SEQ ID NO: 598065 - RNA, 15 nt, Homo sapiens
ucugcccucauuacu

SEQ ID NO: 598066 - RNA, 14 nt, Homo sapiens
ucugcccucuagag

SEQ ID NO: 598067 - RNA, 19 nt, Homo sapiens
ucugcccuguguacuuccc

SEQ ID NO: 598068 - RNA, 16 nt, Homo sapiens
ucugcccuuguucccu

SEQ ID NO: 598069 - RNA, 22 nt, Homo sapiens
ucugccgcccuccacaccucua

SEQ ID NO: 598070 - RNA, 20 nt, Homo sapiens
ucugccuguggaguagccau

SEQ ID NO: 598071 - RNA, 16 nt, Homo sapiens
ucugccuucaacuuca

SEQ ID NO: 598072 - RNA, 20 nt, Homo sapiens
ucugccuugguucuggccac

SEQ ID NO: 598073 - RNA, 15 nt, Homo sapiens
ucugccuuuucacug

SEQ ID NO: 598074 - RNA, 23 nt, Homo sapiens
ucugcgcaccaaggaauggagag

SEQ ID NO: 598075 - RNA, 18 nt, Homo sapiens
ucugcggaucucagcuuu

SEQ ID NO: 598076 - RNA, 23 nt, Homo sapiens
ucugcggcuguguaguaaaucuc

SEQ ID NO: 598077 - RNA, 13 nt, Homo sapiens
ucugcgugacaau

SEQ ID NO: 598078 - RNA, 23 nt, Homo sapiens
ucugcuccaaaggaaauccaaaa

SEQ ID NO: 598079 - RNA, 10 nt, Homo sapiens
ucugcuccac

SEQ ID NO: 598080 - RNA, 16 nt, Homo sapiens
ucugcuccagccccuu

SEQ ID NO: 598081 - RNA, 22 nt, Homo sapiens
ucugcuccccugugaacccacu

SEQ ID NO: 598082 - RNA, 15 nt, Homo sapiens
ucugcuccuguucac

SEQ ID NO: 598083 - RNA, 21 nt, Homo sapiens
ucugcucugguuagaaaaagg

SEQ ID NO: 598084 - RNA, 20 nt, Homo sapiens
ucugcugaaggcagucauau

SEQ ID NO: 598085 - RNA, 21 nt, Homo sapiens
ucugcugaaucaaaucucuuc

SEQ ID NO: 598086 - RNA, 15 nt, Homo sapiens
ucugcugaccaaaug

SEQ ID NO: 598087 - RNA, 15 nt, Homo sapiens
ucugcugcuucucca

SEQ ID NO: 598088 - RNA, 19 nt, Homo sapiens
ucugcuggccuggaucucc

SEQ ID NO: 598089 - RNA, 13 nt, Homo sapiens
ucugcuguagcuu

SEQ ID NO: 598090 - RNA, 21 nt, Homo sapiens
ucugcugugagccgccaggaa

SEQ ID NO: 598091 - RNA, 19 nt, Homo sapiens
ucugcuguggucugaagug

SEQ ID NO: 598092 - RNA, 16 nt, Homo sapiens
ucugcuguucuucacu

SEQ ID NO: 598093 - RNA, 18 nt, Homo sapiens
ucugcuguucuucacuuc

SEQ ID NO: 598094 - RNA, 22 nt, Homo sapiens
ucugcuguuuuuuuugcugcua

SEQ ID NO: 598095 - RNA, 19 nt, Homo sapiens
ucugcuugcucuuguccua

SEQ ID NO: 598096 - RNA, 16 nt, Homo sapiens
ucugcuuuccuuuucu

SEQ ID NO: 598097 - RNA, 22 nt, Homo sapiens
ucuggaaagaggcucuggacag

SEQ ID NO: 598098 - RNA, 14 nt, Homo sapiens
ucuggaacaacuug

SEQ ID NO: 598099 - RNA, 17 nt, Homo sapiens
ucuggaagaccugaaag

SEQ ID NO: 598100 - RNA, 23 nt, Homo sapiens
ucuggaagggauggguggugcuc

SEQ ID NO: 598101 - RNA, 14 nt, Homo sapiens
ucuggaagucaucu

SEQ ID NO: 598102 - RNA, 16 nt, Homo sapiens
ucuggaagucaucuca

SEQ ID NO: 598103 - RNA, 14 nt, Homo sapiens
ucuggaauugcuca

SEQ ID NO: 598104 - RNA, 14 nt, Homo sapiens
ucuggacacagccc

SEQ ID NO: 598105 - RNA, 17 nt, Homo sapiens
ucuggaccagccuguug

SEQ ID NO: 598106 - RNA, 21 nt, Homo sapiens
ucuggaccauauaccaucucc

SEQ ID NO: 598107 - RNA, 21 nt, Homo sapiens
ucuggaccccaucugugaaua

SEQ ID NO: 598108 - RNA, 13 nt, Homo sapiens
ucuggacugcaca

SEQ ID NO: 598109 - RNA, 17 nt, Homo sapiens
ucuggacuuucucuaau

SEQ ID NO: 598110 - RNA, 20 nt, Homo sapiens
ucuggagaagcucccaggaa

SEQ ID NO: 598111 - RNA, 14 nt, Homo sapiens
ucuggagccagaga

SEQ ID NO: 598112 - RNA, 15 nt, Homo sapiens
ucuggagcuugucac

SEQ ID NO: 598113 - RNA, 15 nt, Homo sapiens
ucuggaggcaaucaa

SEQ ID NO: 598114 - RNA, 23 nt, Homo sapiens
ucuggagggguguggcuccuucc

SEQ ID NO: 598115 - RNA, 19 nt, Homo sapiens
ucuggagguacugagacag

SEQ ID NO: 598116 - RNA, 12 nt, Homo sapiens
ucuggaggucau

SEQ ID NO: 598117 - RNA, 16 nt, Homo sapiens
ucuggauacugcaaag

SEQ ID NO: 598118 - RNA, 19 nt, Homo sapiens
ucuggaucuccugcugccu

SEQ ID NO: 598119 - RNA, 17 nt, Homo sapiens
ucuggauggcaccagag

SEQ ID NO: 598120 - RNA, 18 nt, Homo sapiens
ucuggcaaauaacaguaa

SEQ ID NO: 598121 - RNA, 19 nt, Homo sapiens
ucuggcaaugggacucuga

SEQ ID NO: 598122 - RNA, 19 nt, Homo sapiens
ucuggcagagccucugaga

SEQ ID NO: 598123 - RNA, 19 nt, Homo sapiens
ucuggcaggaaucuaucca

SEQ ID NO: 598124 - RNA, 23 nt, Homo sapiens
ucuggcaucacgucagugcucag

SEQ ID NO: 598125 - RNA, 20 nt, Homo sapiens
ucuggcaucuuagaccucca

SEQ ID NO: 598126 - RNA, 13 nt, Homo sapiens
ucuggcauuacaa

SEQ ID NO: 598127 - RNA, 23 nt, Homo sapiens
ucuggcccacccccaacaggaau

SEQ ID NO: 598128 - RNA, 15 nt, Homo sapiens
ucuggcccacugagc

SEQ ID NO: 598129 - RNA, 16 nt, Homo sapiens
ucuggcccuucuugcc

SEQ ID NO: 598130 - RNA, 22 nt, Homo sapiens
ucuggccguccuugucucuggg

SEQ ID NO: 598131 - RNA, 20 nt, Homo sapiens
ucuggccuugaaaccaccuu

SEQ ID NO: 598132 - RNA, 17 nt, Homo sapiens
ucuggcuaugcauuuga

SEQ ID NO: 598133 - RNA, 18 nt, Homo sapiens
ucuggcucuaauucacag

SEQ ID NO: 598134 - RNA, 19 nt, Homo sapiens
ucuggcucuugaggcauuu

SEQ ID NO: 598135 - RNA, 20 nt, Homo sapiens
ucuggcugaacccugugcug

SEQ ID NO: 598136 - RNA, 13 nt, Homo sapiens
ucuggcuggaaag

SEQ ID NO: 598137 - RNA, 19 nt, Homo sapiens
ucuggcuggaacacuuuca

SEQ ID NO: 598138 - RNA, 17 nt, Homo sapiens
ucuggcuugccccagga

SEQ ID NO: 598139 - RNA, 23 nt, Homo sapiens
ucugggagaaaugagauaaaaga

SEQ ID NO: 598140 - RNA, 21 nt, Homo sapiens
ucugggagacuuugaagacca

SEQ ID NO: 598141 - RNA, 16 nt, Homo sapiens
ucugggagcucaaggc

SEQ ID NO: 598142 - RNA, 17 nt, Homo sapiens
ucugggagucacacagu

SEQ ID NO: 598143 - RNA, 19 nt, Homo sapiens
ucugggcacaguggacuca

SEQ ID NO: 598144 - RNA, 19 nt, Homo sapiens
ucugggcagcgcuaucuag

SEQ ID NO: 598145 - RNA, 13 nt, Homo sapiens
ucugggccagugc

SEQ ID NO: 598146 - RNA, 21 nt, Homo sapiens
ucugggccuucucaccacaga

SEQ ID NO: 598147 - RNA, 17 nt, Homo sapiens
ucuggggccccaucagc

SEQ ID NO: 598148 - RNA, 21 nt, Homo sapiens
ucuggggccuuuaucaaaaaa

SEQ ID NO: 598149 - RNA, 16 nt, Homo sapiens
ucugggggaaaaaaga

SEQ ID NO: 598150 - RNA, 12 nt, Homo sapiens
ucugggggaccc

SEQ ID NO: 598151 - RNA, 21 nt, Homo sapiens
ucugggguccauucucugagu

SEQ ID NO: 598152 - RNA, 22 nt, Homo sapiens
ucuggggugggaguaacagggc

SEQ ID NO: 598153 - RNA, 18 nt, Homo sapiens
ucugggucaugcacugag

SEQ ID NO: 598154 - RNA, 14 nt, Homo sapiens
ucuggguccuugca

SEQ ID NO: 598155 - RNA, 23 nt, Homo sapiens
ucugggucuuucugacaucagca

SEQ ID NO: 598156 - RNA, 19 nt, Homo sapiens
ucugggugaccucacuuua

SEQ ID NO: 598157 - RNA, 22 nt, Homo sapiens
ucugguaauauugacuuguaua

SEQ ID NO: 598158 - RNA, 16 nt, Homo sapiens
ucugguagccugcaga

SEQ ID NO: 598159 - RNA, 21 nt, Homo sapiens
ucugguaguuguggcuuuuau

SEQ ID NO: 598160 - RNA, 12 nt, Homo sapiens
ucugguauuucc

SEQ ID NO: 598161 - RNA, 12 nt, Homo sapiens
ucuggucugucc

SEQ ID NO: 598162 - RNA, 23 nt, Homo sapiens
ucuggugauggauuaacauauag

SEQ ID NO: 598163 - RNA, 17 nt, Homo sapiens
ucugguuugagcaauuu

SEQ ID NO: 598164 - RNA, 19 nt, Homo sapiens
ucuguaaaaaauggagcuc

SEQ ID NO: 598165 - RNA, 14 nt, Homo sapiens
ucuguaaacucaaa

SEQ ID NO: 598166 - RNA, 15 nt, Homo sapiens
ucuguaaacuuccaa

SEQ ID NO: 598167 - RNA, 16 nt, Homo sapiens
ucuguaaagaaaacca

SEQ ID NO: 598168 - RNA, 13 nt, Homo sapiens
ucuguaaauaucc

SEQ ID NO: 598169 - RNA, 13 nt, Homo sapiens
ucuguaacagacu

SEQ ID NO: 598170 - RNA, 18 nt, Homo sapiens
ucuguaacccuugaauuu

SEQ ID NO: 598171 - RNA, 17 nt, Homo sapiens
ucuguaaguguagcuca

SEQ ID NO: 598172 - RNA, 14 nt, Homo sapiens
ucuguaauguaggc

SEQ ID NO: 598173 - RNA, 21 nt, Homo sapiens
ucuguacauguucuugucaua

SEQ ID NO: 598174 - RNA, 22 nt, Homo sapiens
ucuguacccuuuuccaucaugu

SEQ ID NO: 598175 - RNA, 23 nt, Homo sapiens
ucuguagacugaauucagcacca

SEQ ID NO: 598176 - RNA, 19 nt, Homo sapiens
ucuguagcucaaucugcaa

SEQ ID NO: 598177 - RNA, 21 nt, Homo sapiens
ucuguagcucaaucugcaaac

SEQ ID NO: 598178 - RNA, 18 nt, Homo sapiens
ucuguagugagauagcau

SEQ ID NO: 598179 - RNA, 14 nt, Homo sapiens
ucuguauauacuca

SEQ ID NO: 598180 - RNA, 11 nt, Homo sapiens
ucuguaucugc

SEQ ID NO: 598181 - RNA, 15 nt, Homo sapiens
ucuguaucugccaug

SEQ ID NO: 598182 - RNA, 23 nt, Homo sapiens
ucuguauuauaauaagcaaaaag

SEQ ID NO: 598183 - RNA, 20 nt, Homo sapiens
ucuguauugggguacaggaa

SEQ ID NO: 598184 - RNA, 23 nt, Homo sapiens
ucuguauuuuaauggaguggaua

SEQ ID NO: 598185 - RNA, 19 nt, Homo sapiens
ucuguauuuuauuuagaca

SEQ ID NO: 598186 - RNA, 18 nt, Homo sapiens
ucugucaaaacacugugg

SEQ ID NO: 598187 - RNA, 13 nt, Homo sapiens
ucugucaccaacu

SEQ ID NO: 598188 - RNA, 16 nt, Homo sapiens
ucugucagaaucacau

SEQ ID NO: 598189 - RNA, 12 nt, Homo sapiens
ucugucaugaac

SEQ ID NO: 598190 - RNA, 18 nt, Homo sapiens
ucuguccugauuucuaca

SEQ ID NO: 598191 - RNA, 17 nt, Homo sapiens
ucugucuggugccccua

SEQ ID NO: 598192 - RNA, 15 nt, Homo sapiens
ucugucuguggcaaa

SEQ ID NO: 598193 - RNA, 20 nt, Homo sapiens
ucugucuucagcacauucca

SEQ ID NO: 598194 - RNA, 21 nt, Homo sapiens
ucugugagacccccacaccuc

SEQ ID NO: 598195 - RNA, 20 nt, Homo sapiens
ucugugauuacauagaucag

SEQ ID NO: 598196 - RNA, 14 nt, Homo sapiens
ucugugccccaugc

SEQ ID NO: 598197 - RNA, 11 nt, Homo sapiens
ucugugccugg

SEQ ID NO: 598198 - RNA, 17 nt, Homo sapiens
ucugugcgcguggcgug

SEQ ID NO: 598199 - RNA, 19 nt, Homo sapiens
ucugugcucugaaugggag

SEQ ID NO: 598200 - RNA, 17 nt, Homo sapiens
ucugugcuggacuuuaa

SEQ ID NO: 598201 - RNA, 17 nt, Homo sapiens
ucugugcuuugacucac

SEQ ID NO: 598202 - RNA, 14 nt, Homo sapiens
ucuguggaaugauu

SEQ ID NO: 598203 - RNA, 17 nt, Homo sapiens
ucuguggaccacugcau

SEQ ID NO: 598204 - RNA, 21 nt, Homo sapiens
ucuguggagggagggcagcug

SEQ ID NO: 598205 - RNA, 17 nt, Homo sapiens
ucugugggcacuggugg

SEQ ID NO: 598206 - RNA, 14 nt, Homo sapiens
ucugugggugcuac

SEQ ID NO: 598207 - RNA, 21 nt, Homo sapiens
ucuguggugagaaauuugccu

SEQ ID NO: 598208 - RNA, 12 nt, Homo sapiens
ucuguguacaaa

SEQ ID NO: 598209 - RNA, 16 nt, Homo sapiens
ucuguguagaaacugg

SEQ ID NO: 598210 - RNA, 20 nt, Homo sapiens
ucugugugguggagccaggg

SEQ ID NO: 598211 - RNA, 17 nt, Homo sapiens
ucuguguguguggcgug

SEQ ID NO: 598212 - RNA, 19 nt, Homo sapiens
ucuguguugcaagauauca

SEQ ID NO: 598213 - RNA, 20 nt, Homo sapiens
ucuguuaauagucaucacau

SEQ ID NO: 598214 - RNA, 16 nt, Homo sapiens
ucuguuauauagugga

SEQ ID NO: 598215 - RNA, 18 nt, Homo sapiens
ucuguuaucgaacacauu

SEQ ID NO: 598216 - RNA, 12 nt, Homo sapiens
ucuguucacuuu

SEQ ID NO: 598217 - RNA, 22 nt, Homo sapiens
ucuguucaucaccagucuguaa

SEQ ID NO: 598218 - RNA, 17 nt, Homo sapiens
ucuguucccugggcuga

SEQ ID NO: 598219 - RNA, 17 nt, Homo sapiens
ucuguucccuuccucac

SEQ ID NO: 598220 - RNA, 15 nt, Homo sapiens
ucuguuccuuuugca

SEQ ID NO: 598221 - RNA, 18 nt, Homo sapiens
ucuguucugcacacagca

SEQ ID NO: 598222 - RNA, 21 nt, Homo sapiens
ucuguucuguugaucccacuu

SEQ ID NO: 598223 - RNA, 13 nt, Homo sapiens
ucuguugccaguc

SEQ ID NO: 598224 - RNA, 13 nt, Homo sapiens
ucuguugccaugg

SEQ ID NO: 598225 - RNA, 22 nt, Homo sapiens
ucuguuggcaggcuggccaguc

SEQ ID NO: 598226 - RNA, 22 nt, Homo sapiens
ucuguuuauaugacauuguuaa

SEQ ID NO: 598227 - RNA, 20 nt, Homo sapiens
ucuguuuauggccacauuua

SEQ ID NO: 598228 - RNA, 19 nt, Homo sapiens
ucuguuuauucuuccagaa

SEQ ID NO: 598229 - RNA, 21 nt, Homo sapiens
ucuguuuccuggucagcaugu

SEQ ID NO: 598230 - RNA, 12 nt, Homo sapiens
ucuguuugaaac

SEQ ID NO: 598231 - RNA, 22 nt, Homo sapiens
ucuguuugcuguggaacuacau

SEQ ID NO: 598232 - RNA, 14 nt, Homo sapiens
ucuguuuugcacag

SEQ ID NO: 598233 - RNA, 13 nt, Homo sapiens
ucuuaaaaacugu

SEQ ID NO: 598234 - RNA, 19 nt, Homo sapiens
ucuuaaaaaucuaugccua

SEQ ID NO: 598235 - RNA, 21 nt, Homo sapiens
ucuuaaaaaucuaugccuaaa

SEQ ID NO: 598236 - RNA, 15 nt, Homo sapiens
ucuuaaaaccagaga

SEQ ID NO: 598237 - RNA, 15 nt, Homo sapiens
ucuuaaauauuucca

SEQ ID NO: 598238 - RNA, 18 nt, Homo sapiens
ucuuaaauauuuccauca

SEQ ID NO: 598239 - RNA, 14 nt, Homo sapiens
ucuuaacaaacucu

SEQ ID NO: 598240 - RNA, 20 nt, Homo sapiens
ucuuaaccuuugcuauguaa

SEQ ID NO: 598241 - RNA, 21 nt, Homo sapiens
ucuuaacuggucuccuugcuu

SEQ ID NO: 598242 - RNA, 16 nt, Homo sapiens
ucuuaagcacuuugaa

SEQ ID NO: 598243 - RNA, 18 nt, Homo sapiens
ucuuaagcagcauggaaa

SEQ ID NO: 598244 - RNA, 14 nt, Homo sapiens
ucuuaaguggucua

SEQ ID NO: 598245 - RNA, 22 nt, Homo sapiens
ucuuaauacuuuaugaugcuau

SEQ ID NO: 598246 - RNA, 24 nt, Homo sapiens
ucuuaauauaaauucacuuucauu

SEQ ID NO: 598247 - RNA, 15 nt, Homo sapiens
ucuuaaugacauuuc

SEQ ID NO: 598248 - RNA, 13 nt, Homo sapiens
ucuuaauguuccu

SEQ ID NO: 598249 - RNA, 12 nt, Homo sapiens
ucuuaauuccca

SEQ ID NO: 598250 - RNA, 21 nt, Homo sapiens
ucuuacaaccaagaacauuau

SEQ ID NO: 598251 - RNA, 14 nt, Homo sapiens
ucuuacacauagca

SEQ ID NO: 598252 - RNA, 22 nt, Homo sapiens
ucuuacauaauuuuuuauucaa

SEQ ID NO: 598253 - RNA, 14 nt, Homo sapiens
ucuuacaugcauuu

SEQ ID NO: 598254 - RNA, 15 nt, Homo sapiens
ucuuacauuagcagu

SEQ ID NO: 598255 - RNA, 13 nt, Homo sapiens
ucuuaccagaugc

SEQ ID NO: 598256 - RNA, 17 nt, Homo sapiens
ucuuacuacagcuucag

SEQ ID NO: 598257 - RNA, 20 nt, Homo sapiens
ucuuacuacagcuucaguga

SEQ ID NO: 598258 - RNA, 17 nt, Homo sapiens
ucuuacuccuggcuuua

SEQ ID NO: 598259 - RNA, 14 nt, Homo sapiens
ucuuacuuaugugu

SEQ ID NO: 598260 - RNA, 16 nt, Homo sapiens
ucuuagaaaaaccacc

SEQ ID NO: 598261 - RNA, 16 nt, Homo sapiens
ucuuagaaauacuugu

SEQ ID NO: 598262 - RNA, 18 nt, Homo sapiens
ucuuagaaauacuuguga

SEQ ID NO: 598263 - RNA, 17 nt, Homo sapiens
ucuuagaguuuacaguu

SEQ ID NO: 598264 - RNA, 20 nt, Homo sapiens
ucuuagaguuuacaguuugu

SEQ ID NO: 598265 - RNA, 21 nt, Homo sapiens
ucuuagauaugauaccaaaga

SEQ ID NO: 598266 - RNA, 11 nt, Homo sapiens
ucuuagcuguc

SEQ ID NO: 598267 - RNA, 20 nt, Homo sapiens
ucuuaggcaugugcugguau

SEQ ID NO: 598268 - RNA, 19 nt, Homo sapiens
ucuuagugcaaaaaacaua

SEQ ID NO: 598269 - RNA, 20 nt, Homo sapiens
ucuuagugcuucagaguuug

SEQ ID NO: 598270 - RNA, 20 nt, Homo sapiens
ucuuagugugccaagaguuc

SEQ ID NO: 598271 - RNA, 16 nt, Homo sapiens
ucuuaguucucacugu

SEQ ID NO: 598272 - RNA, 14 nt, Homo sapiens
ucuuaguuguucag

SEQ ID NO: 598273 - RNA, 21 nt, Homo sapiens
ucuuauaacacaacaauaagg

SEQ ID NO: 598274 - RNA, 13 nt, Homo sapiens
ucuuauacaacag

SEQ ID NO: 598275 - RNA, 17 nt, Homo sapiens
ucuuaucaauucugaug

SEQ ID NO: 598276 - RNA, 17 nt, Homo sapiens
ucuuaugauuacuauca

SEQ ID NO: 598277 - RNA, 12 nt, Homo sapiens
ucuuauggggcc

SEQ ID NO: 598278 - RNA, 18 nt, Homo sapiens
ucuuauuaguuccccaaa

SEQ ID NO: 598279 - RNA, 15 nt, Homo sapiens
ucuuauuccaggaga

SEQ ID NO: 598280 - RNA, 23 nt, Homo sapiens
ucuuauucuggcggcagcgccuu

SEQ ID NO: 598281 - RNA, 23 nt, Homo sapiens
ucuuauuuaaugaaagacuguac

SEQ ID NO: 598282 - RNA, 22 nt, Homo sapiens
ucuuauuuucaaagcaguauag

SEQ ID NO: 598283 - RNA, 17 nt, Homo sapiens
ucuuauuuugugaacua

SEQ ID NO: 598284 - RNA, 13 nt, Homo sapiens
ucuucaacaugac

SEQ ID NO: 598285 - RNA, 16 nt, Homo sapiens
ucuucaaccucauuga

SEQ ID NO: 598286 - RNA, 14 nt, Homo sapiens
ucuucaagaccaaa

SEQ ID NO: 598287 - RNA, 22 nt, Homo sapiens
ucuucaagacgacagcucugua

SEQ ID NO: 598288 - RNA, 15 nt, Homo sapiens
ucuucaagacucuga

SEQ ID NO: 598289 - RNA, 12 nt, Homo sapiens
ucuucaauguca

SEQ ID NO: 598290 - RNA, 15 nt, Homo sapiens
ucuucaauuuggaua

SEQ ID NO: 598291 - RNA, 23 nt, Homo sapiens
ucuucaccacuguaguucucuca

SEQ ID NO: 598292 - RNA, 20 nt, Homo sapiens
ucuucaccucuauccaaaga

SEQ ID NO: 598293 - RNA, 15 nt, Homo sapiens
ucuucaccucuucca

SEQ ID NO: 598294 - RNA, 15 nt, Homo sapiens
ucuucacucccaaua

SEQ ID NO: 598295 - RNA, 18 nt, Homo sapiens
ucuucagaggagaaagaa

SEQ ID NO: 598296 - RNA, 18 nt, Homo sapiens
ucuucagauacaaacugc

SEQ ID NO: 598297 - RNA, 11 nt, Homo sapiens
ucuucagccau

SEQ ID NO: 598298 - RNA, 14 nt, Homo sapiens
ucuucagcucugaa

SEQ ID NO: 598299 - RNA, 12 nt, Homo sapiens
ucuucagugaau

SEQ ID NO: 598300 - RNA, 21 nt, Homo sapiens
ucuucauauucuaaaaccauu

SEQ ID NO: 598301 - RNA, 13 nt, Homo sapiens
ucuucauccauuu

SEQ ID NO: 598302 - RNA, 15 nt, Homo sapiens
ucuucaucuuugcca

SEQ ID NO: 598303 - RNA, 16 nt, Homo sapiens
ucuucaucuuugccau

SEQ ID NO: 598304 - RNA, 14 nt, Homo sapiens
ucuucaugcuugac

SEQ ID NO: 598305 - RNA, 12 nt, Homo sapiens
ucuucauggaau

SEQ ID NO: 598306 - RNA, 13 nt, Homo sapiens
ucuucauugcagu

SEQ ID NO: 598307 - RNA, 12 nt, Homo sapiens
ucuucauuucua

SEQ ID NO: 598308 - RNA, 19 nt, Homo sapiens
ucuuccacaaaaaauacuu

SEQ ID NO: 598309 - RNA, 19 nt, Homo sapiens
ucuuccagaagaugcccuc

SEQ ID NO: 598310 - RNA, 20 nt, Homo sapiens
ucuuccagaaggcaaaaaga

SEQ ID NO: 598311 - RNA, 16 nt, Homo sapiens
ucuucccaaacccagu

SEQ ID NO: 598312 - RNA, 17 nt, Homo sapiens
ucuucccauacuugcau

SEQ ID NO: 598313 - RNA, 18 nt, Homo sapiens
ucuucccuaccucaggca

SEQ ID NO: 598314 - RNA, 14 nt, Homo sapiens
ucuucccugaccuc

SEQ ID NO: 598315 - RNA, 15 nt, Homo sapiens
ucuucccugaccucc

SEQ ID NO: 598316 - RNA, 19 nt, Homo sapiens
ucuucccugggcugccacc

SEQ ID NO: 598317 - RNA, 17 nt, Homo sapiens
ucuucccuuaacuccaa

SEQ ID NO: 598318 - RNA, 21 nt, Homo sapiens
ucuuccucccucauuccaccu

SEQ ID NO: 598319 - RNA, 19 nt, Homo sapiens
ucuuccucccugggggccc

SEQ ID NO: 598320 - RNA, 20 nt, Homo sapiens
ucuuccugaguggugccaaa

SEQ ID NO: 598321 - RNA, 16 nt, Homo sapiens
ucuuccugauuccuuu

SEQ ID NO: 598322 - RNA, 18 nt, Homo sapiens
ucuuccugcuuuccaugg

SEQ ID NO: 598323 - RNA, 20 nt, Homo sapiens
ucuuccugucuccuuugaag

SEQ ID NO: 598324 - RNA, 15 nt, Homo sapiens
ucuuccuguguccug

SEQ ID NO: 598325 - RNA, 16 nt, Homo sapiens
ucuuccuuagacuuac

SEQ ID NO: 598326 - RNA, 22 nt, Homo sapiens
ucuuccuuccacaguuaucuua

SEQ ID NO: 598327 - RNA, 15 nt, Homo sapiens
ucuuccuuugcucug

SEQ ID NO: 598328 - RNA, 14 nt, Homo sapiens
ucuucuaaacuucc

SEQ ID NO: 598329 - RNA, 15 nt, Homo sapiens
ucuucuaaacuuccc

SEQ ID NO: 598330 - RNA, 14 nt, Homo sapiens
ucuucuaacacaaa

SEQ ID NO: 598331 - RNA, 16 nt, Homo sapiens
ucuucuaccauuugaa

SEQ ID NO: 598332 - RNA, 14 nt, Homo sapiens
ucuucuauaucuga

SEQ ID NO: 598333 - RNA, 19 nt, Homo sapiens
ucuucuauuaaucaagaga

SEQ ID NO: 598334 - RNA, 13 nt, Homo sapiens
ucuucuccacugg

SEQ ID NO: 598335 - RNA, 14 nt, Homo sapiens
ucuucuccacugga

SEQ ID NO: 598336 - RNA, 16 nt, Homo sapiens
ucuucuccuccaugaa

SEQ ID NO: 598337 - RNA, 14 nt, Homo sapiens
ucuucucguuuuca

SEQ ID NO: 598338 - RNA, 19 nt, Homo sapiens
ucuucugccuuuaugagau

SEQ ID NO: 598339 - RNA, 18 nt, Homo sapiens
ucuucugggcuacugcca

SEQ ID NO: 598340 - RNA, 19 nt, Homo sapiens
ucuucugggcuacugccac

SEQ ID NO: 598341 - RNA, 12 nt, Homo sapiens
ucuucuguaaau

SEQ ID NO: 598342 - RNA, 14 nt, Homo sapiens
ucuucugucucaua

SEQ ID NO: 598343 - RNA, 14 nt, Homo sapiens
ucuucuucauugca

SEQ ID NO: 598344 - RNA, 13 nt, Homo sapiens
ucuucuuccugaa

SEQ ID NO: 598345 - RNA, 18 nt, Homo sapiens
ucuucuugggcuuugcua

SEQ ID NO: 598346 - RNA, 19 nt, Homo sapiens
ucuucuuguguccugauga

SEQ ID NO: 598347 - RNA, 14 nt, Homo sapiens
ucuucuuguugacc

SEQ ID NO: 598348 - RNA, 18 nt, Homo sapiens
ucuucuuuaagccauaga

SEQ ID NO: 598349 - RNA, 14 nt, Homo sapiens
ucuucuuugcugca

SEQ ID NO: 598350 - RNA, 14 nt, Homo sapiens
ucuugaaaagccuu

SEQ ID NO: 598351 - RNA, 14 nt, Homo sapiens
ucuugaaacaagca

SEQ ID NO: 598352 - RNA, 21 nt, Homo sapiens
ucuugaaauuaagaaggcaaa

SEQ ID NO: 598353 - RNA, 22 nt, Homo sapiens
ucuugaaauuaguuuaccucau

SEQ ID NO: 598354 - RNA, 20 nt, Homo sapiens
ucuugaacucauagauuauu

SEQ ID NO: 598355 - RNA, 13 nt, Homo sapiens
ucuugaagcagua

SEQ ID NO: 598356 - RNA, 15 nt, Homo sapiens
ucuugaaguucaugg

SEQ ID NO: 598357 - RNA, 13 nt, Homo sapiens
ucuugaauagucu

SEQ ID NO: 598358 - RNA, 15 nt, Homo sapiens
ucuugaauguggucu

SEQ ID NO: 598359 - RNA, 23 nt, Homo sapiens
ucuugaccuaguauaucagugac

SEQ ID NO: 598360 - RNA, 12 nt, Homo sapiens
ucuugacuuccc

SEQ ID NO: 598361 - RNA, 16 nt, Homo sapiens
ucuugagcaguggcug

SEQ ID NO: 598362 - RNA, 21 nt, Homo sapiens
ucuugaggauguaaugcauua

SEQ ID NO: 598363 - RNA, 16 nt, Homo sapiens
ucuugaggcauuucca

SEQ ID NO: 598364 - RNA, 15 nt, Homo sapiens
ucuugagggaguuca

SEQ ID NO: 598365 - RNA, 17 nt, Homo sapiens
ucuugaucuguguuuua

SEQ ID NO: 598366 - RNA, 22 nt, Homo sapiens
ucuugauguuuagaaaaguauu

SEQ ID NO: 598367 - RNA, 19 nt, Homo sapiens
ucuugcaaagcgacagauu

SEQ ID NO: 598368 - RNA, 18 nt, Homo sapiens
ucuugcaacucuguaaau

SEQ ID NO: 598369 - RNA, 23 nt, Homo sapiens
ucuugcacuggccuucugaugaa

SEQ ID NO: 598370 - RNA, 16 nt, Homo sapiens
ucuugcauucccagug

SEQ ID NO: 598371 - RNA, 20 nt, Homo sapiens
ucuugccagccucaggcuug

SEQ ID NO: 598372 - RNA, 17 nt, Homo sapiens
ucuugcccgcaccccuc

SEQ ID NO: 598373 - RNA, 17 nt, Homo sapiens
ucuugccuaaaucccaa

SEQ ID NO: 598374 - RNA, 21 nt, Homo sapiens
ucuugcggcugaagugucaca

SEQ ID NO: 598375 - RNA, 17 nt, Homo sapiens
ucuugcuagauuuugcu

SEQ ID NO: 598376 - RNA, 13 nt, Homo sapiens
ucuugcucuguca

SEQ ID NO: 598377 - RNA, 17 nt, Homo sapiens
ucuugcugaaagccaag

SEQ ID NO: 598378 - RNA, 22 nt, Homo sapiens
ucuugcuguaacucagacauuc

SEQ ID NO: 598379 - RNA, 16 nt, Homo sapiens
ucuugcuguugacaua

SEQ ID NO: 598380 - RNA, 16 nt, Homo sapiens
ucuugcuucagaccau

SEQ ID NO: 598381 - RNA, 18 nt, Homo sapiens
ucuuggagaaaauaacaa

SEQ ID NO: 598382 - RNA, 16 nt, Homo sapiens
ucuuggcugaccccuc

SEQ ID NO: 598383 - RNA, 17 nt, Homo sapiens
ucuuggcuuaaucauuu

SEQ ID NO: 598384 - RNA, 14 nt, Homo sapiens
ucuuggcuuaucca

SEQ ID NO: 598385 - RNA, 20 nt, Homo sapiens
ucuugggacccccacuaaga

SEQ ID NO: 598386 - RNA, 13 nt, Homo sapiens
ucuugggcacugg

SEQ ID NO: 598387 - RNA, 20 nt, Homo sapiens
ucuugggcuacuggcagcuc

SEQ ID NO: 598388 - RNA, 19 nt, Homo sapiens
ucuuggggacuaacccaau

SEQ ID NO: 598389 - RNA, 23 nt, Homo sapiens
ucuuggggacuaacccaaugccu

SEQ ID NO: 598390 - RNA, 21 nt, Homo sapiens
ucuuggggcaagacugcaaac

SEQ ID NO: 598391 - RNA, 22 nt, Homo sapiens
ucuuggggggucagggugcugu

SEQ ID NO: 598392 - RNA, 24 nt, Homo sapiens
ucuugggggguuuuuacuccagug

SEQ ID NO: 598393 - RNA, 19 nt, Homo sapiens
ucuuggggucccagggaag

SEQ ID NO: 598394 - RNA, 21 nt, Homo sapiens
ucuugggguuuucaguaugaa

SEQ ID NO: 598395 - RNA, 18 nt, Homo sapiens
ucuuggguucaagugauu

SEQ ID NO: 598396 - RNA, 16 nt, Homo sapiens
ucuugguauuacccuc

SEQ ID NO: 598397 - RNA, 12 nt, Homo sapiens
ucuugguauuau

SEQ ID NO: 598398 - RNA, 17 nt, Homo sapiens
ucuugguuucagccaag

SEQ ID NO: 598399 - RNA, 22 nt, Homo sapiens
ucuuguaagucaucuacuuaau

SEQ ID NO: 598400 - RNA, 18 nt, Homo sapiens
ucuuguaggucauugcac

SEQ ID NO: 598401 - RNA, 14 nt, Homo sapiens
ucuuguauacacau

SEQ ID NO: 598402 - RNA, 20 nt, Homo sapiens
uggacuuuugaaaagcuuuu

SEQ ID NO: 598403 - RNA, 23 nt, Homo sapiens
uggacuuuugaaguccacuuguu

SEQ ID NO: 598404 - RNA, 22 nt, Homo sapiens
uggagaaauaaaaauaccucuu

SEQ ID NO: 598405 - RNA, 22 nt, Homo sapiens
uggagaaccagggcucuucuca

SEQ ID NO: 598406 - RNA, 22 nt, Homo sapiens
uggagacuuuuaucuacuucuc

SEQ ID NO: 598407 - RNA, 12 nt, Homo sapiens
uggagagccacc

SEQ ID NO: 598408 - RNA, 16 nt, Homo sapiens
uggagaggacagagca

SEQ ID NO: 598409 - RNA, 18 nt, Homo sapiens
uggagaggaggggaccca

SEQ ID NO: 598410 - RNA, 17 nt, Homo sapiens
uggagaguaaucuggga

SEQ ID NO: 598411 - RNA, 19 nt, Homo sapiens
uggagagucagaucuuucu

SEQ ID NO: 598412 - RNA, 20 nt, Homo sapiens
uggagagucagaucuuucuc

SEQ ID NO: 598413 - RNA, 16 nt, Homo sapiens
uggagaugaggugcuc

SEQ ID NO: 598414 - RNA, 15 nt, Homo sapiens
uggagauucucauaa

SEQ ID NO: 598415 - RNA, 21 nt, Homo sapiens
uggagcaagaggggcauacua

SEQ ID NO: 598416 - RNA, 13 nt, Homo sapiens
uggagcagcagcc

SEQ ID NO: 598417 - RNA, 16 nt, Homo sapiens
uggagcagcagccacu

SEQ ID NO: 598418 - RNA, 14 nt, Homo sapiens
uggagcagccagag

SEQ ID NO: 598419 - RNA, 13 nt, Homo sapiens
uggagcagcuauu

SEQ ID NO: 598420 - RNA, 17 nt, Homo sapiens
uggagcauuucucauca

SEQ ID NO: 598421 - RNA, 15 nt, Homo sapiens
uggagccauccuccu

SEQ ID NO: 598422 - RNA, 21 nt, Homo sapiens
uggagccauugaacagcugug

SEQ ID NO: 598423 - RNA, 19 nt, Homo sapiens
uggagcccauccagucucc

SEQ ID NO: 598424 - RNA, 17 nt, Homo sapiens
uggagccccaggggaca

SEQ ID NO: 598425 - RNA, 21 nt, Homo sapiens
uggagccccauccuguguuau

SEQ ID NO: 598426 - RNA, 22 nt, Homo sapiens
uggagcccuaaccccuuccaga

SEQ ID NO: 598427 - RNA, 19 nt, Homo sapiens
uggagccuacauuccuuga

SEQ ID NO: 598428 - RNA, 23 nt, Homo sapiens
uggagcucacacuccaguggcag

SEQ ID NO: 598429 - RNA, 15 nt, Homo sapiens
uggagcugaauuuga

SEQ ID NO: 598430 - RNA, 12 nt, Homo sapiens
uggagcuuccaa

SEQ ID NO: 598431 - RNA, 18 nt, Homo sapiens
uggaggaaagugauaucc

SEQ ID NO: 598432 - RNA, 16 nt, Homo sapiens
uggaggaacuuuccaa

SEQ ID NO: 598433 - RNA, 20 nt, Homo sapiens
uggaggaaguucuccagcuu

SEQ ID NO: 598434 - RNA, 15 nt, Homo sapiens
uggaggaaucacugg

SEQ ID NO: 598435 - RNA, 12 nt, Homo sapiens
uggaggaccaga

SEQ ID NO: 598436 - RNA, 21 nt, Homo sapiens
uggaggaccuggcgugcucag

SEQ ID NO: 598437 - RNA, 14 nt, Homo sapiens
uggaggagacauga

SEQ ID NO: 598438 - RNA, 15 nt, Homo sapiens
uggaggagacaugag

SEQ ID NO: 598439 - RNA, 21 nt, Homo sapiens
uggaggagaggagaaaugucc

SEQ ID NO: 598440 - RNA, 22 nt, Homo sapiens
uggaggaggcaagauacaacag

SEQ ID NO: 598441 - RNA, 16 nt, Homo sapiens
uggaggagguggcuuc

SEQ ID NO: 598442 - RNA, 18 nt, Homo sapiens
uggaggauggcacagccu

SEQ ID NO: 598443 - RNA, 22 nt, Homo sapiens
uggaggcacaacgcaccagaca

SEQ ID NO: 598444 - RNA, 23 nt, Homo sapiens
uggaggcacaacgcaccagacac

SEQ ID NO: 598445 - RNA, 20 nt, Homo sapiens
uggaggccagagucucccag

SEQ ID NO: 598446 - RNA, 16 nt, Homo sapiens
uggaggccgcagccaa

SEQ ID NO: 598447 - RNA, 19 nt, Homo sapiens
uggaggcugcagugagcug

SEQ ID NO: 598448 - RNA, 22 nt, Homo sapiens
uggagggaaggauaaagccacu

SEQ ID NO: 598449 - RNA, 19 nt, Homo sapiens
uggagggaaugcucagaaa

SEQ ID NO: 598450 - RNA, 18 nt, Homo sapiens
uggagggagcuccagaaa

SEQ ID NO: 598451 - RNA, 18 nt, Homo sapiens
uggagggcucagggcagu

SEQ ID NO: 598452 - RNA, 17 nt, Homo sapiens
uggagggucuugagggg

SEQ ID NO: 598453 - RNA, 18 nt, Homo sapiens
uggagggucuugagggga

SEQ ID NO: 598454 - RNA, 20 nt, Homo sapiens
uggaggucacauucaggaag

SEQ ID NO: 598455 - RNA, 17 nt, Homo sapiens
uggaggucagcauuuga

SEQ ID NO: 598456 - RNA, 16 nt, Homo sapiens
uggaggugcugcucua

SEQ ID NO: 598457 - RNA, 22 nt, Homo sapiens
uggagguggaaaagcaacauuc

SEQ ID NO: 598458 - RNA, 20 nt, Homo sapiens
uggaggugggcaaagggaag

SEQ ID NO: 598459 - RNA, 16 nt, Homo sapiens
uggagguugaagccaa

SEQ ID NO: 598460 - RNA, 14 nt, Homo sapiens
uggagguugugcau

SEQ ID NO: 598461 - RNA, 14 nt, Homo sapiens
uggaguaaaccaug

SEQ ID NO: 598462 - RNA, 18 nt, Homo sapiens
uggaguaaaccauguauu

SEQ ID NO: 598463 - RNA, 20 nt, Homo sapiens
uggaguaaauauauauguca

SEQ ID NO: 598464 - RNA, 15 nt, Homo sapiens
uggagucacuguagu

SEQ ID NO: 598465 - RNA, 13 nt, Homo sapiens
uggaguccagcuc

SEQ ID NO: 598466 - RNA, 21 nt, Homo sapiens
uggagucccacccggacaggu

SEQ ID NO: 598467 - RNA, 12 nt, Homo sapiens
uggagugcaaug

SEQ ID NO: 598468 - RNA, 16 nt, Homo sapiens
uggagugcaguggcac

SEQ ID NO: 598469 - RNA, 18 nt, Homo sapiens
uggagugcaguggcacaa

SEQ ID NO: 598470 - RNA, 16 nt, Homo sapiens
uggagugucacaucuc

SEQ ID NO: 598471 - RNA, 19 nt, Homo sapiens
uggaguguuauguauuucc

SEQ ID NO: 598472 - RNA, 19 nt, Homo sapiens
uggaguguuggcuucucaa

SEQ ID NO: 598473 - RNA, 20 nt, Homo sapiens
uggaguguuuuuacauugau

SEQ ID NO: 598474 - RNA, 14 nt, Homo sapiens
uggaguuaacauca

SEQ ID NO: 598475 - RNA, 20 nt, Homo sapiens
uggauaaaucauuucaguau

SEQ ID NO: 598476 - RNA, 17 nt, Homo sapiens
uggauaccauuauaugu

SEQ ID NO: 598477 - RNA, 20 nt, Homo sapiens
uggauacuucuaaaagcuaa

SEQ ID NO: 598478 - RNA, 18 nt, Homo sapiens
uggauauuauucuuguag

SEQ ID NO: 598479 - RNA, 16 nt, Homo sapiens
uggauauuuguacugu

SEQ ID NO: 598480 - RNA, 19 nt, Homo sapiens
uggauauuuguacuguuua

SEQ ID NO: 598481 - RNA, 20 nt, Homo sapiens
uggaucacagacacugcaca

SEQ ID NO: 598482 - RNA, 17 nt, Homo sapiens
uggaucacucaccauuc

SEQ ID NO: 598483 - RNA, 21 nt, Homo sapiens
uggaucacucaccauucccag

SEQ ID NO: 598484 - RNA, 16 nt, Homo sapiens
uggaucagaugaacuc

SEQ ID NO: 598485 - RNA, 16 nt, Homo sapiens
uggaucagcauuuuag

SEQ ID NO: 598486 - RNA, 20 nt, Homo sapiens
uggaucaguccuuugaucag

SEQ ID NO: 598487 - RNA, 16 nt, Homo sapiens
uggauccugcacucua

SEQ ID NO: 598488 - RNA, 19 nt, Homo sapiens
uggaucuggggacugagug

SEQ ID NO: 598489 - RNA, 15 nt, Homo sapiens
uggaugaggagacag

SEQ ID NO: 598490 - RNA, 22 nt, Homo sapiens
uggaugccaaccggucacccag

SEQ ID NO: 598491 - RNA, 20 nt, Homo sapiens
uggaugccgauuucuguaaa

SEQ ID NO: 598492 - RNA, 21 nt, Homo sapiens
uggaugcuagugcuguagagu

SEQ ID NO: 598493 - RNA, 14 nt, Homo sapiens
uggauggaauauca

SEQ ID NO: 598494 - RNA, 16 nt, Homo sapiens
uggauggcaccucagg

SEQ ID NO: 598495 - RNA, 23 nt, Homo sapiens
uggaugggaggagagccacuggg

SEQ ID NO: 598496 - RNA, 23 nt, Homo sapiens
uggauguauggggaaucuaagag

SEQ ID NO: 598497 - RNA, 14 nt, Homo sapiens
uggauguucacugc

SEQ ID NO: 598498 - RNA, 23 nt, Homo sapiens
uggauuaaaaaaaugugguacau

SEQ ID NO: 598499 - RNA, 20 nt, Homo sapiens
uggauuaaacuuaaucuaaa

SEQ ID NO: 598500 - RNA, 15 nt, Homo sapiens
uggauuauguugaca

SEQ ID NO: 598501 - RNA, 17 nt, Homo sapiens
uggauucauauaggcca

SEQ ID NO: 598502 - RNA, 15 nt, Homo sapiens
uggauucccacagca

SEQ ID NO: 598503 - RNA, 15 nt, Homo sapiens
uggauugcacguggc

SEQ ID NO: 598504 - RNA, 22 nt, Homo sapiens
uggauugcacguggccucuuga

SEQ ID NO: 598505 - RNA, 17 nt, Homo sapiens
uggauugccaguuacau

SEQ ID NO: 598506 - RNA, 23 nt, Homo sapiens
uggauuggaaugcagaggucucc

SEQ ID NO: 598507 - RNA, 23 nt, Homo sapiens
uggauugggacgcacagugcagu

SEQ ID NO: 598508 - RNA, 17 nt, Homo sapiens
uggauuggucugagggg

SEQ ID NO: 598509 - RNA, 13 nt, Homo sapiens
uggauugugcuuu

SEQ ID NO: 598510 - RNA, 17 nt, Homo sapiens
uggauuguuacagcuuc

SEQ ID NO: 598511 - RNA, 15 nt, Homo sapiens
uggauuuauagcuau

SEQ ID NO: 598512 - RNA, 20 nt, Homo sapiens
uggauuucauuaucauauga

SEQ ID NO: 598513 - RNA, 16 nt, Homo sapiens
uggauuugauucauuu

SEQ ID NO: 598514 - RNA, 17 nt, Homo sapiens
uggauuugccugugcca

SEQ ID NO: 598515 - RNA, 22 nt, Homo sapiens
uggauuuuaaaaaaucaaucaa

SEQ ID NO: 598516 - RNA, 15 nt, Homo sapiens
uggauuuuuccuuaa

SEQ ID NO: 598517 - RNA, 23 nt, Homo sapiens
uggcaaaacaaaaguacauugcu

SEQ ID NO: 598518 - RNA, 13 nt, Homo sapiens
uggcaaagcagaa

SEQ ID NO: 598519 - RNA, 14 nt, Homo sapiens
uggcaaagugcugu

SEQ ID NO: 598520 - RNA, 16 nt, Homo sapiens
uggcaaaucacuucaa

SEQ ID NO: 598521 - RNA, 19 nt, Homo sapiens
uggcaacagagcaagacuc

SEQ ID NO: 598522 - RNA, 12 nt, Homo sapiens
uggcaagagccc

SEQ ID NO: 598523 - RNA, 15 nt, Homo sapiens
uggcaagcagggaaa

SEQ ID NO: 598524 - RNA, 17 nt, Homo sapiens
uggcaagggaugugcuu

SEQ ID NO: 598525 - RNA, 23 nt, Homo sapiens
uggcaagucuagagucucagaaa

SEQ ID NO: 598526 - RNA, 13 nt, Homo sapiens
uggcaagugaauu

SEQ ID NO: 598527 - RNA, 16 nt, Homo sapiens
uggcaaucaauacagc

SEQ ID NO: 598528 - RNA, 19 nt, Homo sapiens
uggcaaucaauacagcuuc

SEQ ID NO: 598529 - RNA, 17 nt, Homo sapiens
uggcaaucccaccaaau

SEQ ID NO: 598530 - RNA, 18 nt, Homo sapiens
uggcaaucccaccaaauc

SEQ ID NO: 598531 - RNA, 14 nt, Homo sapiens
uggcaaugggacuc

SEQ ID NO: 598532 - RNA, 20 nt, Homo sapiens
uggcaauuuaacauguguau

SEQ ID NO: 598533 - RNA, 16 nt, Homo sapiens
uggcaauuuagcaaac

SEQ ID NO: 598534 - RNA, 13 nt, Homo sapiens
uggcacacaccug

SEQ ID NO: 598535 - RNA, 15 nt, Homo sapiens
uggcacacucuccaa

SEQ ID NO: 598536 - RNA, 23 nt, Homo sapiens
uggcacaugacaacuuugccagc

SEQ ID NO: 598537 - RNA, 23 nt, Homo sapiens
uggcaccgagacaaugauaugca

SEQ ID NO: 598538 - RNA, 17 nt, Homo sapiens
uggcacucaacucugag

SEQ ID NO: 598539 - RNA, 14 nt, Homo sapiens
uggcacugcgauca

SEQ ID NO: 598540 - RNA, 17 nt, Homo sapiens
uggcacuuauaaccaaa

SEQ ID NO: 598541 - RNA, 12 nt, Homo sapiens
uggcacuuguau

SEQ ID NO: 598542 - RNA, 10 nt, Homo sapiens
uggcacuuug

SEQ ID NO: 598543 - RNA, 22 nt, Homo sapiens
uggcagaaauacagucuuccac

SEQ ID NO: 598544 - RNA, 20 nt, Homo sapiens
uggcagaagggaauugcuca

SEQ ID NO: 598545 - RNA, 21 nt, Homo sapiens
uggcagaagggaauugcucag

SEQ ID NO: 598546 - RNA, 20 nt, Homo sapiens
uggcagaccgugaccaucuu

SEQ ID NO: 598547 - RNA, 16 nt, Homo sapiens
uggcagagcacagccc

SEQ ID NO: 598548 - RNA, 19 nt, Homo sapiens
uggcagauguggauuugaa

SEQ ID NO: 598549 - RNA, 15 nt, Homo sapiens
uggcagcaacaauaa

SEQ ID NO: 598550 - RNA, 16 nt, Homo sapiens
uggcagcauacacaga

SEQ ID NO: 598551 - RNA, 20 nt, Homo sapiens
uggcagcauacacagaugaa

SEQ ID NO: 598552 - RNA, 20 nt, Homo sapiens
uggcagcccuguguguguca

SEQ ID NO: 598553 - RNA, 16 nt, Homo sapiens
uggcagccgugccuuc

SEQ ID NO: 598554 - RNA, 15 nt, Homo sapiens
uggcaggacuccaga

SEQ ID NO: 598555 - RNA, 15 nt, Homo sapiens
uggcaguacuguugc

SEQ ID NO: 598556 - RNA, 18 nt, Homo sapiens
uggcagugaccauggcac

SEQ ID NO: 598557 - RNA, 16 nt, Homo sapiens
uggcaguuugaaguca

SEQ ID NO: 598558 - RNA, 15 nt, Homo sapiens
uggcauaaccugucu

SEQ ID NO: 598559 - RNA, 17 nt, Homo sapiens
uggcauaaccugucuca

SEQ ID NO: 598560 - RNA, 21 nt, Homo sapiens
uggcaucugagugggcccagc

SEQ ID NO: 598561 - RNA, 10 nt, Homo sapiens
uggcaucugu

SEQ ID NO: 598562 - RNA, 17 nt, Homo sapiens
uggcaugacaacuacuu

SEQ ID NO: 598563 - RNA, 15 nt, Homo sapiens
uggcaugauuuauau

SEQ ID NO: 598564 - RNA, 19 nt, Homo sapiens
uggcaugcgccaccaugcc

SEQ ID NO: 598565 - RNA, 21 nt, Homo sapiens
uggcauugucccugugccuaa

SEQ ID NO: 598566 - RNA, 11 nt, Homo sapiens
uggcauuucaa

SEQ ID NO: 598567 - RNA, 23 nt, Homo sapiens
uggcauuugggugaacuguggac

SEQ ID NO: 598568 - RNA, 22 nt, Homo sapiens
uggccaacugcaaaaaaagccu

SEQ ID NO: 598569 - RNA, 22 nt, Homo sapiens
uggccaagaagcaguggccuua

SEQ ID NO: 598570 - RNA, 22 nt, Homo sapiens
uggccaagcaauuccucugaac

SEQ ID NO: 598571 - RNA, 16 nt, Homo sapiens
uggccaaggagcugcu

SEQ ID NO: 598572 - RNA, 15 nt, Homo sapiens
uggccaccaguauga

SEQ ID NO: 598573 - RNA, 21 nt, Homo sapiens
uggccaccaguaugacaguau

SEQ ID NO: 598574 - RNA, 20 nt, Homo sapiens
uggccacgggggcaguguga

SEQ ID NO: 598575 - RNA, 16 nt, Homo sapiens
uggccacugaaaagcu

SEQ ID NO: 598576 - RNA, 13 nt, Homo sapiens
uggccacugcucc

SEQ ID NO: 598577 - RNA, 23 nt, Homo sapiens
uggccacugggucucacuccuga

SEQ ID NO: 598578 - RNA, 21 nt, Homo sapiens
uggccacugucuccacucaca

SEQ ID NO: 598579 - RNA, 17 nt, Homo sapiens
uggccagacaagaagac

SEQ ID NO: 598580 - RNA, 15 nt, Homo sapiens
uggccagagccucug

SEQ ID NO: 598581 - RNA, 14 nt, Homo sapiens
uggccagcaaaaac

SEQ ID NO: 598582 - RNA, 17 nt, Homo sapiens
uggccagccagugccau

SEQ ID NO: 598583 - RNA, 22 nt, Homo sapiens
uggccagccagugccauuccac

SEQ ID NO: 598584 - RNA, 17 nt, Homo sapiens
uggccagugugauccca

SEQ ID NO: 598585 - RNA, 21 nt, Homo sapiens
uggccauggacgaauaugaau

SEQ ID NO: 598586 - RNA, 18 nt, Homo sapiens
uggccauuccaacagcuc

SEQ ID NO: 598587 - RNA, 13 nt, Homo sapiens
uggccauuuggcc

SEQ ID NO: 598588 - RNA, 14 nt, Homo sapiens
uggcccaaagcagu

SEQ ID NO: 598589 - RNA, 14 nt, Homo sapiens
uggcccaacacugu

SEQ ID NO: 598590 - RNA, 13 nt, Homo sapiens
uggcccacgcacu

SEQ ID NO: 598591 - RNA, 13 nt, Homo sapiens
uggcccagccaaa

SEQ ID NO: 598592 - RNA, 23 nt, Homo sapiens
uggcccagccggccucucuggcc

SEQ ID NO: 598593 - RNA, 13 nt, Homo sapiens
uggcccagccuug

SEQ ID NO: 598594 - RNA, 17 nt, Homo sapiens
uggcccagggaagccaa

SEQ ID NO: 598595 - RNA, 17 nt, Homo sapiens
uggcccaggucucucaa

SEQ ID NO: 598596 - RNA, 17 nt, Homo sapiens
uggccccaguccaugcu

SEQ ID NO: 598597 - RNA, 19 nt, Homo sapiens
uggccccaguccaugcuuc

SEQ ID NO: 598598 - RNA, 18 nt, Homo sapiens
uggccccggccuuuaugu

SEQ ID NO: 598599 - RNA, 18 nt, Homo sapiens
uggccccgggcucuggcc

SEQ ID NO: 598600 - RNA, 17 nt, Homo sapiens
uggccccucaccugggc

SEQ ID NO: 598601 - RNA, 20 nt, Homo sapiens
uggcccgaggaagcuggaca

SEQ ID NO: 598602 - RNA, 17 nt, Homo sapiens
uggcccgcaauacugua

SEQ ID NO: 598603 - RNA, 18 nt, Homo sapiens
uggcccguggccuggcau

SEQ ID NO: 598604 - RNA, 22 nt, Homo sapiens
uggcccuauuuaaggcagauuu

SEQ ID NO: 598605 - RNA, 24 nt, Homo sapiens
uggcccucccagugccuccuagcc

SEQ ID NO: 598606 - RNA, 22 nt, Homo sapiens
uggcccuccccacaaugccaga

SEQ ID NO: 598607 - RNA, 16 nt, Homo sapiens
uggcccucgacacuca

SEQ ID NO: 598608 - RNA, 23 nt, Homo sapiens
uggcccuuaauuauuaacaaagu

SEQ ID NO: 598609 - RNA, 14 nt, Homo sapiens
uggcccuucuugcc

SEQ ID NO: 598610 - RNA, 19 nt, Homo sapiens
uggcccuugcuuaccucuc

SEQ ID NO: 598611 - RNA, 20 nt, Homo sapiens
uggccgcggagccugcauuu

SEQ ID NO: 598612 - RNA, 15 nt, Homo sapiens
uggccgggagccuga

SEQ ID NO: 598613 - RNA, 18 nt, Homo sapiens
uggccgggcccugcugag

SEQ ID NO: 598614 - RNA, 17 nt, Homo sapiens
uggccuccccugccacc

SEQ ID NO: 598615 - RNA, 22 nt, Homo sapiens
uggccuccccugccaccaggcc

SEQ ID NO: 598616 - RNA, 14 nt, Homo sapiens
uggccucccgccaa

SEQ ID NO: 598617 - RNA, 21 nt, Homo sapiens
uggccuccgcagugucuccac

SEQ ID NO: 598618 - RNA, 16 nt, Homo sapiens
uggccucugcaacugc

SEQ ID NO: 598619 - RNA, 21 nt, Homo sapiens
uggccucugugccuucuuuug

SEQ ID NO: 598620 - RNA, 23 nt, Homo sapiens
uggccucuugaguuccucugcag

SEQ ID NO: 598621 - RNA, 13 nt, Homo sapiens
uggccugagacaa

SEQ ID NO: 598622 - RNA, 18 nt, Homo sapiens
uggccugcuaauagcugc

SEQ ID NO: 598623 - RNA, 19 nt, Homo sapiens
uggccugcugggcucucca

SEQ ID NO: 598624 - RNA, 23 nt, Homo sapiens
uggccugcugggcucuccaccuc

SEQ ID NO: 598625 - RNA, 22 nt, Homo sapiens
uggccuggauucacgcccucuu

SEQ ID NO: 598626 - RNA, 23 nt, Homo sapiens
uggccuggccauacuguguccca

SEQ ID NO: 598627 - RNA, 19 nt, Homo sapiens
uggccugggaucuggcaca

SEQ ID NO: 598628 - RNA, 23 nt, Homo sapiens
uggccuggggcaggucacuuuac

SEQ ID NO: 598629 - RNA, 14 nt, Homo sapiens
uggccugggguccc

SEQ ID NO: 598630 - RNA, 15 nt, Homo sapiens
uggccuggggucccu

SEQ ID NO: 598631 - RNA, 21 nt, Homo sapiens
uggccugugccagcaccacag

SEQ ID NO: 598632 - RNA, 15 nt, Homo sapiens
uggccuuacacugaa

SEQ ID NO: 598633 - RNA, 17 nt, Homo sapiens
uggccuugcaaccucuu

SEQ ID NO: 598634 - RNA, 14 nt, Homo sapiens
uggccuuguaagac

SEQ ID NO: 598635 - RNA, 14 nt, Homo sapiens
uggccuuuaggaag

SEQ ID NO: 598636 - RNA, 14 nt, Homo sapiens
uggcgaccaccaaa

SEQ ID NO: 598637 - RNA, 16 nt, Homo sapiens
uggcgaccaccaaagu

SEQ ID NO: 598638 - RNA, 15 nt, Homo sapiens
uggcgcaucauaugc

SEQ ID NO: 598639 - RNA, 22 nt, Homo sapiens
uggcguuacugcuugaccaaag

SEQ ID NO: 598640 - RNA, 23 nt, Homo sapiens
uggcguuacugcuugaccaaaga

SEQ ID NO: 598641 - RNA, 20 nt, Homo sapiens
uggcguuuggacccaguuca

SEQ ID NO: 598642 - RNA, 17 nt, Homo sapiens
uggcuacacacaaacca

SEQ ID NO: 598643 - RNA, 15 nt, Homo sapiens
uggcuagaguuucca

SEQ ID NO: 598644 - RNA, 17 nt, Homo sapiens
ugggauuugagauacca

SEQ ID NO: 598645 - RNA, 19 nt, Homo sapiens
ugggcaaagggaaguaaca

SEQ ID NO: 598646 - RNA, 18 nt, Homo sapiens
ugggcaacagagcaagac

SEQ ID NO: 598647 - RNA, 21 nt, Homo sapiens
ugggcaacagagcaagacucc

SEQ ID NO: 598648 - RNA, 20 nt, Homo sapiens
ugggcaagagaugggacaag

SEQ ID NO: 598649 - RNA, 17 nt, Homo sapiens
ugggcaaguagcaggac

SEQ ID NO: 598650 - RNA, 14 nt, Homo sapiens
ugggcaaugugaua

SEQ ID NO: 598651 - RNA, 11 nt, Homo sapiens
ugggcacagug

SEQ ID NO: 598652 - RNA, 14 nt, Homo sapiens
ugggcacaugccuu

SEQ ID NO: 598653 - RNA, 13 nt, Homo sapiens
ugggcagagccca

SEQ ID NO: 598654 - RNA, 22 nt, Homo sapiens
ugggcagcaaaacgacacugcg

SEQ ID NO: 598655 - RNA, 18 nt, Homo sapiens
ugggcagcauagcaagac

SEQ ID NO: 598656 - RNA, 20 nt, Homo sapiens
ugggcagccguuuuccucau

SEQ ID NO: 598657 - RNA, 18 nt, Homo sapiens
ugggcagcuaagcagucu

SEQ ID NO: 598658 - RNA, 16 nt, Homo sapiens
ugggcaggaagugaag

SEQ ID NO: 598659 - RNA, 12 nt, Homo sapiens
ugggcagggaug

SEQ ID NO: 598660 - RNA, 19 nt, Homo sapiens
ugggcaggugguggcacug

SEQ ID NO: 598661 - RNA, 17 nt, Homo sapiens
ugggcauagccauggaa

SEQ ID NO: 598662 - RNA, 15 nt, Homo sapiens
ugggcaucccagcuu

SEQ ID NO: 598663 - RNA, 15 nt, Homo sapiens
ugggcaucuccgugu

SEQ ID NO: 598664 - RNA, 13 nt, Homo sapiens
ugggcaugccacc

SEQ ID NO: 598665 - RNA, 16 nt, Homo sapiens
ugggcaugccauuaca

SEQ ID NO: 598666 - RNA, 22 nt, Homo sapiens
ugggcauugcagccuugcgcug

SEQ ID NO: 598667 - RNA, 17 nt, Homo sapiens
ugggccaaaaucaugcc

SEQ ID NO: 598668 - RNA, 18 nt, Homo sapiens
ugggccaaaaucaugcca

SEQ ID NO: 598669 - RNA, 14 nt, Homo sapiens
ugggccacagccau

SEQ ID NO: 598670 - RNA, 20 nt, Homo sapiens
ugggccagaaguaccagacu

SEQ ID NO: 598671 - RNA, 16 nt, Homo sapiens
ugggccagugcaccuu

SEQ ID NO: 598672 - RNA, 14 nt, Homo sapiens
ugggccauccucac

SEQ ID NO: 598673 - RNA, 17 nt, Homo sapiens
ugggcccaggacuguug

SEQ ID NO: 598674 - RNA, 17 nt, Homo sapiens
ugggccccacuggacaa

SEQ ID NO: 598675 - RNA, 17 nt, Homo sapiens
ugggccccccuugccuc

SEQ ID NO: 598676 - RNA, 23 nt, Homo sapiens
ugggccgggaggcagugcugauc

SEQ ID NO: 598677 - RNA, 14 nt, Homo sapiens
ugggccuccaugcc

SEQ ID NO: 598678 - RNA, 15 nt, Homo sapiens
ugggccuccaugccc

SEQ ID NO: 598679 - RNA, 21 nt, Homo sapiens
ugggccuccugacagcaauaa

SEQ ID NO: 598680 - RNA, 22 nt, Homo sapiens
ugggccucuccugcccucugcu

SEQ ID NO: 598681 - RNA, 14 nt, Homo sapiens
ugggccuggcagga

SEQ ID NO: 598682 - RNA, 16 nt, Homo sapiens
ugggccugguagcaca

SEQ ID NO: 598683 - RNA, 15 nt, Homo sapiens
ugggccugugcacug

SEQ ID NO: 598684 - RNA, 18 nt, Homo sapiens
ugggcgacagagcgagac

SEQ ID NO: 598685 - RNA, 17 nt, Homo sapiens
ugggcguccagcucagc

SEQ ID NO: 598686 - RNA, 17 nt, Homo sapiens
ugggcgugugugacacu

SEQ ID NO: 598687 - RNA, 18 nt, Homo sapiens
ugggcuacccuaaaggga

SEQ ID NO: 598688 - RNA, 19 nt, Homo sapiens
ugggcuacccuaaagggag

SEQ ID NO: 598689 - RNA, 22 nt, Homo sapiens
ugggcuaggcauaggucucuuu

SEQ ID NO: 598690 - RNA, 20 nt, Homo sapiens
ugggcucaagcuucccaagu

SEQ ID NO: 598691 - RNA, 17 nt, Homo sapiens
ugggcuccaggccugua

SEQ ID NO: 598692 - RNA, 14 nt, Homo sapiens
ugggcucuccgggg

SEQ ID NO: 598693 - RNA, 16 nt, Homo sapiens
ugggcucugaacacac

SEQ ID NO: 598694 - RNA, 16 nt, Homo sapiens
ugggcugcugcaguga

SEQ ID NO: 598695 - RNA, 16 nt, Homo sapiens
ugggcuggacuggcca

SEQ ID NO: 598696 - RNA, 13 nt, Homo sapiens
ugggcuggggccu

SEQ ID NO: 598697 - RNA, 21 nt, Homo sapiens
ugggcuuaguauuucucagga

SEQ ID NO: 598698 - RNA, 15 nt, Homo sapiens
ugggcuugagcugca

SEQ ID NO: 598699 - RNA, 19 nt, Homo sapiens
ugggcuuggccuuguguca

SEQ ID NO: 598700 - RNA, 16 nt, Homo sapiens
uggggaagaagacaca

SEQ ID NO: 598701 - RNA, 18 nt, Homo sapiens
uggggaagaagacacaga

SEQ ID NO: 598702 - RNA, 14 nt, Homo sapiens
uggggaagacugug

SEQ ID NO: 598703 - RNA, 22 nt, Homo sapiens
uggggaauacuggccaugccug

SEQ ID NO: 598704 - RNA, 19 nt, Homo sapiens
uggggacaucucuuugaau

SEQ ID NO: 598705 - RNA, 15 nt, Homo sapiens
uggggacauugcucu

SEQ ID NO: 598706 - RNA, 15 nt, Homo sapiens
uggggacuaacccaa

SEQ ID NO: 598707 - RNA, 16 nt, Homo sapiens
uggggagacuuggggc

SEQ ID NO: 598708 - RNA, 19 nt, Homo sapiens
uggggagacuuggggccag

SEQ ID NO: 598709 - RNA, 18 nt, Homo sapiens
uggggagcaggaggccaa

SEQ ID NO: 598710 - RNA, 23 nt, Homo sapiens
uggggagcgccggauuugcuccc

SEQ ID NO: 598711 - RNA, 14 nt, Homo sapiens
uggggaggcccaaa

SEQ ID NO: 598712 - RNA, 19 nt, Homo sapiens
uggggagggagagccauca

SEQ ID NO: 598713 - RNA, 19 nt, Homo sapiens
uggggaguaggacauacca

SEQ ID NO: 598714 - RNA, 20 nt, Homo sapiens
uggggaguuguuaugccaug

SEQ ID NO: 598715 - RNA, 21 nt, Homo sapiens
uggggauccccgccuggccag

SEQ ID NO: 598716 - RNA, 17 nt, Homo sapiens
uggggaucgaugugcuc

SEQ ID NO: 598717 - RNA, 17 nt, Homo sapiens
uggggaucucaggggcu

SEQ ID NO: 598718 - RNA, 16 nt, Homo sapiens
uggggauuuucacuga

SEQ ID NO: 598719 - RNA, 21 nt, Homo sapiens
uggggcaacagauugaaaaga

SEQ ID NO: 598720 - RNA, 23 nt, Homo sapiens
uggggcagcacccuauaaaucaa

SEQ ID NO: 598721 - RNA, 15 nt, Homo sapiens
uggggcaggggugcu

SEQ ID NO: 598722 - RNA, 17 nt, Homo sapiens
uggggcauauucaucua

SEQ ID NO: 598723 - RNA, 18 nt, Homo sapiens
uggggcaugaccucaguc

SEQ ID NO: 598724 - RNA, 21 nt, Homo sapiens
uggggcauggcaaaucagggg

SEQ ID NO: 598725 - RNA, 18 nt, Homo sapiens
uggggccaggaccauggc

SEQ ID NO: 598726 - RNA, 18 nt, Homo sapiens
uggggcccaaguugcagu

SEQ ID NO: 598727 - RNA, 15 nt, Homo sapiens
uggggccucagacga

SEQ ID NO: 598728 - RNA, 18 nt, Homo sapiens
uggggccuccagaacuca

SEQ ID NO: 598729 - RNA, 22 nt, Homo sapiens
uggggccucuccuacuaugcaa

SEQ ID NO: 598730 - RNA, 21 nt, Homo sapiens
uggggcucagccacagccuga

SEQ ID NO: 598731 - RNA, 19 nt, Homo sapiens
uggggcugaacaugccugc

SEQ ID NO: 598732 - RNA, 13 nt, Homo sapiens
uggggcugccaua

SEQ ID NO: 598733 - RNA, 17 nt, Homo sapiens
uggggcugcuccccuaa

SEQ ID NO: 598734 - RNA, 23 nt, Homo sapiens
ugggggaaaaguuagucaauccu

SEQ ID NO: 598735 - RNA, 15 nt, Homo sapiens
ugggggaacugugaa

SEQ ID NO: 598736 - RNA, 23 nt, Homo sapiens
ugggggaagacuuuaaaccaccu

SEQ ID NO: 598737 - RNA, 20 nt, Homo sapiens
ugggggaccaaugaggugag

SEQ ID NO: 598738 - RNA, 18 nt, Homo sapiens
ugggggacccugugcauc

SEQ ID NO: 598739 - RNA, 18 nt, Homo sapiens
ugggggacgugggcauuu

SEQ ID NO: 598740 - RNA, 22 nt, Homo sapiens
ugggggcagggcugugcuugaa

SEQ ID NO: 598741 - RNA, 14 nt, Homo sapiens
ugggggccuccuca

SEQ ID NO: 598742 - RNA, 18 nt, Homo sapiens
ugggggccuggccuugca

SEQ ID NO: 598743 - RNA, 21 nt, Homo sapiens
ugggggccuuguggcacucca

SEQ ID NO: 598744 - RNA, 16 nt, Homo sapiens
ugggggcugugauauu

SEQ ID NO: 598745 - RNA, 18 nt, Homo sapiens
uggggggcucucagggaa

SEQ ID NO: 598746 - RNA, 13 nt, Homo sapiens
ugggggucagggg

SEQ ID NO: 598747 - RNA, 12 nt, Homo sapiens
ugggggucccuu

SEQ ID NO: 598748 - RNA, 17 nt, Homo sapiens
uggggguucuggcagga

SEQ ID NO: 598749 - RNA, 19 nt, Homo sapiens
ugggguaaaguaucacuuu

SEQ ID NO: 598750 - RNA, 13 nt, Homo sapiens
uggggucaugccc

SEQ ID NO: 598751 - RNA, 14 nt, Homo sapiens
ugggguccagggag

SEQ ID NO: 598752 - RNA, 13 nt, Homo sapiens
uggggucugggag

SEQ ID NO: 598753 - RNA, 14 nt, Homo sapiens
uggggucuguaaau

SEQ ID NO: 598754 - RNA, 15 nt, Homo sapiens
uggggucuuuuuaug

SEQ ID NO: 598755 - RNA, 23 nt, Homo sapiens
uggggugggagggcgucaggcag

SEQ ID NO: 598756 - RNA, 15 nt, Homo sapiens
ugggguuauguauca

SEQ ID NO: 598757 - RNA, 13 nt, Homo sapiens
ugggguuccugcu

SEQ ID NO: 598758 - RNA, 15 nt, Homo sapiens
ugggguucucuacag

SEQ ID NO: 598759 - RNA, 22 nt, Homo sapiens
ugggguugaaaauucaaaaagu

SEQ ID NO: 598760 - RNA, 18 nt, Homo sapiens
ugggguuugaagcugacu

SEQ ID NO: 598761 - RNA, 21 nt, Homo sapiens
uggguacugaaagccuuaggg

SEQ ID NO: 598762 - RNA, 14 nt, Homo sapiens
uggguaguaccugu

SEQ ID NO: 598763 - RNA, 16 nt, Homo sapiens
uggguauguguuuauu

SEQ ID NO: 598764 - RNA, 17 nt, Homo sapiens
ugggucaaggacagggc

SEQ ID NO: 598765 - RNA, 19 nt, Homo sapiens
ugggucagagcuaaacucc

SEQ ID NO: 598766 - RNA, 17 nt, Homo sapiens
ugguuacaaucauugcu

SEQ ID NO: 598767 - RNA, 19 nt, Homo sapiens
ugguuaccaccagccuuuc

SEQ ID NO: 598768 - RNA, 23 nt, Homo sapiens
ugguuacgucagccgguccaugg

SEQ ID NO: 598769 - RNA, 17 nt, Homo sapiens
ugguuacuaguacaggu

SEQ ID NO: 598770 - RNA, 14 nt, Homo sapiens
ugguuagacgccuu

SEQ ID NO: 598771 - RNA, 13 nt, Homo sapiens
ugguuaugaacuu

SEQ ID NO: 598772 - RNA, 17 nt, Homo sapiens
ugguuauggagucuugu

SEQ ID NO: 598773 - RNA, 22 nt, Homo sapiens
ugguuauggccgaaaaggauau

SEQ ID NO: 598774 - RNA, 20 nt, Homo sapiens
ugguuauuucucaacaaagc

SEQ ID NO: 598775 - RNA, 22 nt, Homo sapiens
ugguucaauuucagaaguaaug

SEQ ID NO: 598776 - RNA, 23 nt, Homo sapiens
ugguucagugccuuccucucucu

SEQ ID NO: 598777 - RNA, 15 nt, Homo sapiens
ugguuccaaagacac

SEQ ID NO: 598778 - RNA, 19 nt, Homo sapiens
ugguuccaagaaagaucca

SEQ ID NO: 598779 - RNA, 15 nt, Homo sapiens
ugguuccuaagccug

SEQ ID NO: 598780 - RNA, 12 nt, Homo sapiens
ugguucuuucau

SEQ ID NO: 598781 - RNA, 21 nt, Homo sapiens
ugguugauuuugugcuguugu

SEQ ID NO: 598782 - RNA, 16 nt, Homo sapiens
ugguuggucaaaucaa

SEQ ID NO: 598783 - RNA, 14 nt, Homo sapiens
ugguuuaaagcaaa

SEQ ID NO: 598784 - RNA, 16 nt, Homo sapiens
ugguuuaaaugauaca

SEQ ID NO: 598785 - RNA, 22 nt, Homo sapiens
ugguuuaccuggggauccaauu

SEQ ID NO: 598786 - RNA, 21 nt, Homo sapiens
ugguuucauuucuacugugac

SEQ ID NO: 598787 - RNA, 20 nt, Homo sapiens
ugguuuccuggugcuuccca

SEQ ID NO: 598788 - RNA, 13 nt, Homo sapiens
ugguuugagacac

SEQ ID NO: 598789 - RNA, 15 nt, Homo sapiens
ugguuugugucaaaa

SEQ ID NO: 598790 - RNA, 15 nt, Homo sapiens
ugguuuuuacauuca

SEQ ID NO: 598791 - RNA, 18 nt, Homo sapiens
ugguuuuuguagccuucc

SEQ ID NO: 598792 - RNA, 19 nt, Homo sapiens
ugguuuuuuuuugagacag

SEQ ID NO: 598793 - RNA, 13 nt, Homo sapiens
uguaaaaaaugga

SEQ ID NO: 598794 - RNA, 23 nt, Homo sapiens
uguaaaaauuuuguuauuuuugc

SEQ ID NO: 598795 - RNA, 18 nt, Homo sapiens
uguaaaagagucaucugg

SEQ ID NO: 598796 - RNA, 13 nt, Homo sapiens
uguaaaauccaca

SEQ ID NO: 598797 - RNA, 19 nt, Homo sapiens
uguaaaaucccaucugcua

SEQ ID NO: 598798 - RNA, 23 nt, Homo sapiens
uguaaaauuuaaaucauauccua

SEQ ID NO: 598799 - RNA, 19 nt, Homo sapiens
uguaaacauaauucuugua

SEQ ID NO: 598800 - RNA, 18 nt, Homo sapiens
uguaaacaucagcaagac

SEQ ID NO: 598801 - RNA, 22 nt, Homo sapiens
uguaaacgacaagaauaauuca

SEQ ID NO: 598802 - RNA, 19 nt, Homo sapiens
uguaaacuacaaaguaaaa

SEQ ID NO: 598803 - RNA, 17 nt, Homo sapiens
uguaaagaagggauauu

SEQ ID NO: 598804 - RNA, 16 nt, Homo sapiens
uguaaagacaaauaaa

SEQ ID NO: 598805 - RNA, 23 nt, Homo sapiens
uguaaagauguucuggauaccau

SEQ ID NO: 598806 - RNA, 12 nt, Homo sapiens
uguaaagccagc

SEQ ID NO: 598807 - RNA, 15 nt, Homo sapiens
uguaaaggccuuuaa

SEQ ID NO: 598808 - RNA, 20 nt, Homo sapiens
uguaaaguaaaagcuauaaa

SEQ ID NO: 598809 - RNA, 20 nt, Homo sapiens
uguaaaguagaauaagccuu

SEQ ID NO: 598810 - RNA, 13 nt, Homo sapiens
uguaaagugcaau

SEQ ID NO: 598811 - RNA, 18 nt, Homo sapiens
uguaaagugcaaucauuu

SEQ ID NO: 598812 - RNA, 12 nt, Homo sapiens
uguaaauaaaua

SEQ ID NO: 598813 - RNA, 19 nt, Homo sapiens
uguaaauaauuugcacuga

SEQ ID NO: 598814 - RNA, 17 nt, Homo sapiens
uguaaauacacauagca

SEQ ID NO: 598815 - RNA, 18 nt, Homo sapiens
uguaaauacacauagcau

SEQ ID NO: 598816 - RNA, 20 nt, Homo sapiens
uguaaauacucaugaaugaa

SEQ ID NO: 598817 - RNA, 19 nt, Homo sapiens
uguaaauacuguaaaugca

SEQ ID NO: 598818 - RNA, 15 nt, Homo sapiens
uguaaauaguauaaa

SEQ ID NO: 598819 - RNA, 22 nt, Homo sapiens
uguaaauaucccagagaacaau

SEQ ID NO: 598820 - RNA, 23 nt, Homo sapiens
uguaaauauuuauuuauguguuc

SEQ ID NO: 598821 - RNA, 17 nt, Homo sapiens
uguaaaucaaauuugaa

SEQ ID NO: 598822 - RNA, 21 nt, Homo sapiens
uguaaauccuagacuugaaag

SEQ ID NO: 598823 - RNA, 14 nt, Homo sapiens
uguaaaugcauuag

SEQ ID NO: 598824 - RNA, 17 nt, Homo sapiens
uguaaaugcucguguga

SEQ ID NO: 598825 - RNA, 13 nt, Homo sapiens
uguaaaugugaca

SEQ ID NO: 598826 - RNA, 13 nt, Homo sapiens
uguaaaugugcau

SEQ ID NO: 598827 - RNA, 16 nt, Homo sapiens
uguaaauuaauacuuc

SEQ ID NO: 598828 - RNA, 17 nt, Homo sapiens
uguaaauugcaaauaaa

SEQ ID NO: 598829 - RNA, 23 nt, Homo sapiens
uguaaauugcaaauaaaccacuu

SEQ ID NO: 598830 - RNA, 13 nt, Homo sapiens
uguaaauugcaca

SEQ ID NO: 598831 - RNA, 15 nt, Homo sapiens
uguaacaagccagau

SEQ ID NO: 598832 - RNA, 21 nt, Homo sapiens
uguaacacagucauucuagga

SEQ ID NO: 598833 - RNA, 13 nt, Homo sapiens
uguaacagcauua

SEQ ID NO: 598834 - RNA, 23 nt, Homo sapiens
uguaacagcggcaggguguccca

SEQ ID NO: 598835 - RNA, 17 nt, Homo sapiens
uguaacagucaaauauc

SEQ ID NO: 598836 - RNA, 14 nt, Homo sapiens
uguaacagugcaag

SEQ ID NO: 598837 - RNA, 19 nt, Homo sapiens
uguaacauuguaaaguaug

SEQ ID NO: 598838 - RNA, 17 nt, Homo sapiens
uguaacccagauuuugc

SEQ ID NO: 598839 - RNA, 21 nt, Homo sapiens
uguaacccccaguucaagacu

SEQ ID NO: 598840 - RNA, 16 nt, Homo sapiens
uguaacguggcacugg

SEQ ID NO: 598841 - RNA, 21 nt, Homo sapiens
uguaacugacugccuugcuaa

SEQ ID NO: 598842 - RNA, 23 nt, Homo sapiens
uguaacugugccaguucuuucca

SEQ ID NO: 598843 - RNA, 16 nt, Homo sapiens
uguaacuuauauugaa

SEQ ID NO: 598844 - RNA, 15 nt, Homo sapiens
uguaacuuccugcug

SEQ ID NO: 598845 - RNA, 16 nt, Homo sapiens
uguaacuuuacaguua

SEQ ID NO: 598846 - RNA, 12 nt, Homo sapiens
uguaacuuucau

SEQ ID NO: 598847 - RNA, 20 nt, Homo sapiens
uguaacuuucauaccacuug

SEQ ID NO: 598848 - RNA, 22 nt, Homo sapiens
uguaagaaauacagacuggaug

SEQ ID NO: 598849 - RNA, 12 nt, Homo sapiens
uguaagaacaac

SEQ ID NO: 598850 - RNA, 13 nt, Homo sapiens
uguaagaacugua

SEQ ID NO: 598851 - RNA, 18 nt, Homo sapiens
uguaagaaggcaauauua

SEQ ID NO: 598852 - RNA, 18 nt, Homo sapiens
uguaagagcaaaagccuc

SEQ ID NO: 598853 - RNA, 18 nt, Homo sapiens
uguaagauuuuccauugu

SEQ ID NO: 598854 - RNA, 20 nt, Homo sapiens
uguaagcaacuugcuucuaa

SEQ ID NO: 598855 - RNA, 15 nt, Homo sapiens
uguaaggagccuuuc

SEQ ID NO: 598856 - RNA, 19 nt, Homo sapiens
uguaagggcagugcccaug

SEQ ID NO: 598857 - RNA, 14 nt, Homo sapiens
uguaaggugcuaca

SEQ ID NO: 598858 - RNA, 15 nt, Homo sapiens
uguaagugcugcuau

SEQ ID NO: 598859 - RNA, 16 nt, Homo sapiens
uguaagugcugcuaua

SEQ ID NO: 598860 - RNA, 23 nt, Homo sapiens
uguaauaaaucuaggaugugaug

SEQ ID NO: 598861 - RNA, 14 nt, Homo sapiens
uguaauaagcacuu

SEQ ID NO: 598862 - RNA, 12 nt, Homo sapiens
uguaauaccaga

SEQ ID NO: 598863 - RNA, 21 nt, Homo sapiens
uguaauaccugauugaucaca

SEQ ID NO: 598864 - RNA, 11 nt, Homo sapiens
uguaauacugg

SEQ ID NO: 598865 - RNA, 15 nt, Homo sapiens
uguaauagcauacau

SEQ ID NO: 598866 - RNA, 14 nt, Homo sapiens
uguaauagccaaaa

SEQ ID NO: 598867 - RNA, 20 nt, Homo sapiens
uguaauauuguaaauacugg

SEQ ID NO: 598868 - RNA, 16 nt, Homo sapiens
uguaaucaaacugcaa

SEQ ID NO: 598869 - RNA, 14 nt, Homo sapiens
uguaaucauauaau

SEQ ID NO: 598870 - RNA, 22 nt, Homo sapiens
uguaaucccaacacuguggaag

SEQ ID NO: 598871 - RNA, 19 nt, Homo sapiens
uguaaucccagcacuuugg

SEQ ID NO: 598872 - RNA, 19 nt, Homo sapiens
uguaauccuagcacuuugg

SEQ ID NO: 598873 - RNA, 21 nt, Homo sapiens
uguaaucucucugcagcugcc

SEQ ID NO: 598874 - RNA, 18 nt, Homo sapiens
uguaaugaaaaugaauau

SEQ ID NO: 598875 - RNA, 21 nt, Homo sapiens
uguaaugaaaaugaauaucua

SEQ ID NO: 598876 - RNA, 16 nt, Homo sapiens
uguaaugacagugcua

SEQ ID NO: 598877 - RNA, 12 nt, Homo sapiens
uguaaugcauag

SEQ ID NO: 598878 - RNA, 16 nt, Homo sapiens
uguaauggaagcuacc

SEQ ID NO: 598879 - RNA, 15 nt, Homo sapiens
uguaauggaucuuaa

SEQ ID NO: 598880 - RNA, 22 nt, Homo sapiens
uguaaugguaucuuaaagugug

SEQ ID NO: 598881 - RNA, 18 nt, Homo sapiens
uguaaugucagacuuugc

SEQ ID NO: 598882 - RNA, 22 nt, Homo sapiens
uguaauugcaugacaaaccuua

SEQ ID NO: 598883 - RNA, 21 nt, Homo sapiens
uguaauuucgccuuaaacucu

SEQ ID NO: 598884 - RNA, 20 nt, Homo sapiens
uguaauuuguacaggggcca

SEQ ID NO: 598885 - RNA, 17 nt, Homo sapiens
uguacaaaacaguuuga

SEQ ID NO: 598886 - RNA, 18 nt, Homo sapiens
uguacaaauauaagaaua

SEQ ID NO: 598887 - RNA, 16 nt, Homo sapiens
uguacaaauccacgaa

SEQ ID NO: 598888 - RNA, 16 nt, Homo sapiens
uguacaacuuaacuca

SEQ ID NO: 598889 - RNA, 21 nt, Homo sapiens
uguacaaguauuacaaccaua

SEQ ID NO: 598890 - RNA, 21 nt, Homo sapiens
uguacaauaaaaacauugccu

SEQ ID NO: 598891 - RNA, 18 nt, Homo sapiens
uguacaauaaagcaaugu

SEQ ID NO: 598892 - RNA, 21 nt, Homo sapiens
uguacaaugacuuuauugcau

SEQ ID NO: 598893 - RNA, 19 nt, Homo sapiens
uguacagaaaguaucacaa

SEQ ID NO: 598894 - RNA, 21 nt, Homo sapiens
uguacagaaaguaucacaaau

SEQ ID NO: 598895 - RNA, 15 nt, Homo sapiens
uguacagacauauuu

SEQ ID NO: 598896 - RNA, 13 nt, Homo sapiens
uguacagacuguu

SEQ ID NO: 598897 - RNA, 15 nt, Homo sapiens
uguacagagugcuuu

SEQ ID NO: 598898 - RNA, 22 nt, Homo sapiens
uguacagcucuccccucccuug

SEQ ID NO: 598899 - RNA, 14 nt, Homo sapiens
uguacaggggccau

SEQ ID NO: 598900 - RNA, 13 nt, Homo sapiens
uguacagugaauu

SEQ ID NO: 598901 - RNA, 22 nt, Homo sapiens
uguacauacugcagugugaauu

SEQ ID NO: 598902 - RNA, 23 nt, Homo sapiens
uguacauacuggccucugugauu

SEQ ID NO: 598903 - RNA, 23 nt, Homo sapiens
uguacaucuauuuuggauuguau

SEQ ID NO: 598904 - RNA, 17 nt, Homo sapiens
uguacauguucuuguca

SEQ ID NO: 598905 - RNA, 18 nt, Homo sapiens
uguacauguucuugucau

SEQ ID NO: 598906 - RNA, 20 nt, Homo sapiens
uguacauuuaauaauaucaa

SEQ ID NO: 598907 - RNA, 10 nt, Homo sapiens
uguacauuuc

SEQ ID NO: 598908 - RNA, 19 nt, Homo sapiens
uguaccaaaaaauauugcu

SEQ ID NO: 598909 - RNA, 13 nt, Homo sapiens
uguaccaaaagau

SEQ ID NO: 598910 - RNA, 12 nt, Homo sapiens
uguaccacacua

SEQ ID NO: 598911 - RNA, 20 nt, Homo sapiens
uguaccaccaacuacuaccu

SEQ ID NO: 598912 - RNA, 14 nt, Homo sapiens
uguaccaggcucuc

SEQ ID NO: 598913 - RNA, 13 nt, Homo sapiens
uguaccauuccuu

SEQ ID NO: 598914 - RNA, 16 nt, Homo sapiens
uguacccgagcacaua

SEQ ID NO: 598915 - RNA, 19 nt, Homo sapiens
uguacccucgcaugacugu

SEQ ID NO: 598916 - RNA, 15 nt, Homo sapiens
uguaccucaaucuau

SEQ ID NO: 598917 - RNA, 15 nt, Homo sapiens
uguaccugaugcuau

SEQ ID NO: 598918 - RNA, 17 nt, Homo sapiens
uguacgcuuugcucaaa

SEQ ID NO: 598919 - RNA, 23 nt, Homo sapiens
uguacuaaaccaccucagaaagg

SEQ ID NO: 598920 - RNA, 21 nt, Homo sapiens
uguacuacaucuaguuaauca

SEQ ID NO: 598921 - RNA, 22 nt, Homo sapiens
uguacuauccccaaacuccuuu

SEQ ID NO: 598922 - RNA, 20 nt, Homo sapiens
uguacuuagcuguacuauaa

SEQ ID NO: 598923 - RNA, 17 nt, Homo sapiens
uguacuuccuguguacu

SEQ ID NO: 598924 - RNA, 19 nt, Homo sapiens
uguagaaaaaaaaauucac

SEQ ID NO: 598925 - RNA, 15 nt, Homo sapiens
uguagaagauggacu

SEQ ID NO: 598926 - RNA, 15 nt, Homo sapiens
uguagaauaaaugaa

SEQ ID NO: 598927 - RNA, 17 nt, Homo sapiens
uguagaauaaaugaaga

SEQ ID NO: 598928 - RNA, 15 nt, Homo sapiens
uguagaaugauuuca

SEQ ID NO: 598929 - RNA, 20 nt, Homo sapiens
uguagaaugauuucaugcua

SEQ ID NO: 598930 - RNA, 16 nt, Homo sapiens
uguagacaaaguacau

SEQ ID NO: 598931 - RNA, 15 nt, Homo sapiens
uguagacuauuugcu

SEQ ID NO: 598932 - RNA, 20 nt, Homo sapiens
uguagacugaauucagcacc

SEQ ID NO: 598933 - RNA, 19 nt, Homo sapiens
uguagacuuuugcuuuaug

SEQ ID NO: 598934 - RNA, 17 nt, Homo sapiens
uguagauauugugaagu

SEQ ID NO: 598935 - RNA, 17 nt, Homo sapiens
uguagaugacaaccucc

SEQ ID NO: 598936 - RNA, 20 nt, Homo sapiens
uguagauucagguaauacaa

SEQ ID NO: 598937 - RNA, 14 nt, Homo sapiens
uguagauuugaaaa

SEQ ID NO: 598938 - RNA, 15 nt, Homo sapiens
uguagcaauauauca

SEQ ID NO: 598939 - RNA, 14 nt, Homo sapiens
uguagcaucuuccu

SEQ ID NO: 598940 - RNA, 13 nt, Homo sapiens
uguagcaugaugu

SEQ ID NO: 598941 - RNA, 19 nt, Homo sapiens
uguagccauggcucaggca

SEQ ID NO: 598942 - RNA, 14 nt, Homo sapiens
uguagccccaguga

SEQ ID NO: 598943 - RNA, 21 nt, Homo sapiens
uguagcuaucauuacuggcug

SEQ ID NO: 598944 - RNA, 15 nt, Homo sapiens
uguagcuuugcucuu

SEQ ID NO: 598945 - RNA, 23 nt, Homo sapiens
uguagcuuugcucuuugguagaa

SEQ ID NO: 598946 - RNA, 14 nt, Homo sapiens
uguaggcauuuuaa

SEQ ID NO: 598947 - RNA, 20 nt, Homo sapiens
uguagggccugcauggagaa

SEQ ID NO: 598948 - RNA, 19 nt, Homo sapiens
uguagguaauauuguucua

SEQ ID NO: 598949 - RNA, 16 nt, Homo sapiens
uguaguaaacuauuua

SEQ ID NO: 598950 - RNA, 13 nt, Homo sapiens
uguaguagucuca

SEQ ID NO: 598951 - RNA, 17 nt, Homo sapiens
uguaguccgugcugaca

SEQ ID NO: 598952 - RNA, 22 nt, Homo sapiens
uguagucuccaugcaagauuuc

SEQ ID NO: 598953 - RNA, 21 nt, Homo sapiens
uguagugcauuuuuaaacuug

SEQ ID NO: 598954 - RNA, 23 nt, Homo sapiens
uguaguuuucccugcacuguguc

SEQ ID NO: 598955 - RNA, 15 nt, Homo sapiens
uguauaaacuaucag

SEQ ID NO: 598956 - RNA, 15 nt, Homo sapiens
uguauaaacugucaa

SEQ ID NO: 598957 - RNA, 20 nt, Homo sapiens
uguauaaagcaacuguuaug

SEQ ID NO: 598958 - RNA, 14 nt, Homo sapiens
uguauaagcacuga

SEQ ID NO: 598959 - RNA, 17 nt, Homo sapiens
uguauacacacauauac

SEQ ID NO: 598960 - RNA, 14 nt, Homo sapiens
uguauacacauaua

SEQ ID NO: 598961 - RNA, 18 nt, Homo sapiens
uguauacugaguuggaag

SEQ ID NO: 598962 - RNA, 13 nt, Homo sapiens
uguauacuuguau

SEQ ID NO: 598963 - RNA, 15 nt, Homo sapiens
uguauacuuguauuc

SEQ ID NO: 598964 - RNA, 15 nt, Homo sapiens
uguauaguguucaca

SEQ ID NO: 598965 - RNA, 20 nt, Homo sapiens
uguauaguuuugaauccuuu

SEQ ID NO: 598966 - RNA, 15 nt, Homo sapiens
uguauauacauauau

SEQ ID NO: 598967 - RNA, 20 nt, Homo sapiens
uguauaucaugaaacacuuc

SEQ ID NO: 598968 - RNA, 15 nt, Homo sapiens
uguauauccuauaua

SEQ ID NO: 598969 - RNA, 18 nt, Homo sapiens
uguauaucguuaucacug

SEQ ID NO: 598970 - RNA, 13 nt, Homo sapiens
uguauauguauuc

SEQ ID NO: 598971 - RNA, 21 nt, Homo sapiens
uguauauuaagguguggcuuu

SEQ ID NO: 598972 - RNA, 12 nt, Homo sapiens
uguauauuacau

SEQ ID NO: 598973 - RNA, 19 nt, Homo sapiens
uguauauucaggacuugaa

SEQ ID NO: 598974 - RNA, 13 nt, Homo sapiens
uguauauugcuaa

SEQ ID NO: 598975 - RNA, 21 nt, Homo sapiens
uguauauuuuuuaauguauuc

SEQ ID NO: 598976 - RNA, 15 nt, Homo sapiens
uguaucaaguggcau

SEQ ID NO: 598977 - RNA, 20 nt, Homo sapiens
uguaucagcucucugcuggg

SEQ ID NO: 598978 - RNA, 16 nt, Homo sapiens
uguauccagaagccag

SEQ ID NO: 598979 - RNA, 13 nt, Homo sapiens
uguauccaugcac

SEQ ID NO: 598980 - RNA, 15 nt, Homo sapiens
uguaucuacaguaau

SEQ ID NO: 598981 - RNA, 23 nt, Homo sapiens
uguaucuagcuucuucagagauc

SEQ ID NO: 598982 - RNA, 20 nt, Homo sapiens
uguaucuguaauuaauauuc

SEQ ID NO: 598983 - RNA, 17 nt, Homo sapiens
uguaucuuaaaaaucua

SEQ ID NO: 598984 - RNA, 19 nt, Homo sapiens
uguaugaaagagcaaguga

SEQ ID NO: 598985 - RNA, 17 nt, Homo sapiens
uguaugagacuaugcaa

SEQ ID NO: 598986 - RNA, 12 nt, Homo sapiens
uguaugcacuuu

SEQ ID NO: 598987 - RNA, 11 nt, Homo sapiens
uguauguauag

SEQ ID NO: 598988 - RNA, 16 nt, Homo sapiens
uguaugugcgugugug

SEQ ID NO: 598989 - RNA, 13 nt, Homo sapiens
uguauguggguuu

SEQ ID NO: 598990 - RNA, 16 nt, Homo sapiens
uguaugugugugcaug

SEQ ID NO: 598991 - RNA, 17 nt, Homo sapiens
uguaugugugugcaugu

SEQ ID NO: 598992 - RNA, 19 nt, Homo sapiens
uguauguuaugaacaugca

SEQ ID NO: 598993 - RNA, 15 nt, Homo sapiens
uguauguuugcugau

SEQ ID NO: 598994 - RNA, 17 nt, Homo sapiens
uguauguuuuauaucaa

SEQ ID NO: 598995 - RNA, 18 nt, Homo sapiens
uguauuaaagacagaggc

SEQ ID NO: 598996 - RNA, 19 nt, Homo sapiens
uguauuaauaaagcauucu

SEQ ID NO: 598997 - RNA, 13 nt, Homo sapiens
uguauuacugcuu

SEQ ID NO: 598998 - RNA, 18 nt, Homo sapiens
uguauuaguuuuugauca

SEQ ID NO: 598999 - RNA, 14 nt, Homo sapiens
uguauuaugagcca

SEQ ID NO: 599000 - RNA, 15 nt, Homo sapiens
uguauucaccaccaa

SEQ ID NO: 599001 - RNA, 17 nt, Homo sapiens
uguauucucuuccucau

SEQ ID NO: 599002 - RNA, 23 nt, Homo sapiens
uguauucuguuugcguacuugua

SEQ ID NO: 599003 - RNA, 17 nt, Homo sapiens
uguauugaaaacacuua

SEQ ID NO: 599004 - RNA, 13 nt, Homo sapiens
uguauugagcaag

SEQ ID NO: 599005 - RNA, 18 nt, Homo sapiens
uguauuuaauuuuaacug

SEQ ID NO: 599006 - RNA, 19 nt, Homo sapiens
uguauuuauaguaaccauu

SEQ ID NO: 599007 - RNA, 14 nt, Homo sapiens
uguauuuauuucau

SEQ ID NO: 599008 - RNA, 16 nt, Homo sapiens
uguauuucuagcauua

SEQ ID NO: 599009 - RNA, 15 nt, Homo sapiens
uguauuugaacacuu

SEQ ID NO: 599010 - RNA, 18 nt, Homo sapiens
uguauuuuacaagucaaa

SEQ ID NO: 599011 - RNA, 19 nt, Homo sapiens
uugcaaacugaaagaucug

SEQ ID NO: 599012 - RNA, 21 nt, Homo sapiens
uugcaaaguagccucuuucau

SEQ ID NO: 599013 - RNA, 21 nt, Homo sapiens
uugcaaauaccuccucccuaa

SEQ ID NO: 599014 - RNA, 22 nt, Homo sapiens
uugcaaauauugguuaguauuu

SEQ ID NO: 599015 - RNA, 17 nt, Homo sapiens
uugcaaccacugcaacg

SEQ ID NO: 599016 - RNA, 22 nt, Homo sapiens
uugcaaccucgcuggacucuca

SEQ ID NO: 599017 - RNA, 17 nt, Homo sapiens
uugcaagaugugaauua

SEQ ID NO: 599018 - RNA, 19 nt, Homo sapiens
uugcaauuuuuccaugaag

SEQ ID NO: 599019 - RNA, 21 nt, Homo sapiens
uugcacaaaaucacacagcca

SEQ ID NO: 599020 - RNA, 14 nt, Homo sapiens
uugcacagcagcaa

SEQ ID NO: 599021 - RNA, 14 nt, Homo sapiens
uugcacagccaaau

SEQ ID NO: 599022 - RNA, 14 nt, Homo sapiens
uugcacagccagaa

SEQ ID NO: 599023 - RNA, 13 nt, Homo sapiens
uugcacagugaua

SEQ ID NO: 599024 - RNA, 13 nt, Homo sapiens
uugcacaugugac

SEQ ID NO: 599025 - RNA, 22 nt, Homo sapiens
uugcaccccaaagcuuuccugc

SEQ ID NO: 599026 - RNA, 20 nt, Homo sapiens
uugcaccccuccuauaccau

SEQ ID NO: 599027 - RNA, 23 nt, Homo sapiens
uugcaccccuccuauaccauaug

SEQ ID NO: 599028 - RNA, 14 nt, Homo sapiens
uugcaccuuucuag

SEQ ID NO: 599029 - RNA, 16 nt, Homo sapiens
uugcacuauugcacau

SEQ ID NO: 599030 - RNA, 14 nt, Homo sapiens
uugcagaacugcca

SEQ ID NO: 599031 - RNA, 17 nt, Homo sapiens
uugcagauaacuuugac

SEQ ID NO: 599032 - RNA, 12 nt, Homo sapiens
uugcagccaaag

SEQ ID NO: 599033 - RNA, 20 nt, Homo sapiens
uugcagcuguuuuguugaca

SEQ ID NO: 599034 - RNA, 18 nt, Homo sapiens
uugcagcuuuauguucau

SEQ ID NO: 599035 - RNA, 20 nt, Homo sapiens
uugcaggaccucaggugaga

SEQ ID NO: 599036 - RNA, 22 nt, Homo sapiens
uugcagggaagccccacuugaa

SEQ ID NO: 599037 - RNA, 21 nt, Homo sapiens
uugcaguaagccaaggucaug

SEQ ID NO: 599038 - RNA, 20 nt, Homo sapiens
uugcagugagcugagaucac

SEQ ID NO: 599039 - RNA, 21 nt, Homo sapiens
uugcaguucccacauuaaaga

SEQ ID NO: 599040 - RNA, 13 nt, Homo sapiens
uugcaguucugua

SEQ ID NO: 599041 - RNA, 15 nt, Homo sapiens
uugcauacugaaaau

SEQ ID NO: 599042 - RNA, 21 nt, Homo sapiens
uugcauaucuuaaaacuaaau

SEQ ID NO: 599043 - RNA, 13 nt, Homo sapiens
uugcauccauugu

SEQ ID NO: 599044 - RNA, 14 nt, Homo sapiens
uugcauccauuguu

SEQ ID NO: 599045 - RNA, 20 nt, Homo sapiens
uugcaucucaguaugaauua

SEQ ID NO: 599046 - RNA, 23 nt, Homo sapiens
uugcaucucaguaugaauuauuc

SEQ ID NO: 599047 - RNA, 15 nt, Homo sapiens
uugcaucuuuucuac

SEQ ID NO: 599048 - RNA, 13 nt, Homo sapiens
uugcaugcugaaa

SEQ ID NO: 599049 - RNA, 14 nt, Homo sapiens
uugcaugcuugcau

SEQ ID NO: 599050 - RNA, 21 nt, Homo sapiens
uugcauggauguuuuagccau

SEQ ID NO: 599051 - RNA, 21 nt, Homo sapiens
uugcauggauuucuuugaaaa

SEQ ID NO: 599052 - RNA, 14 nt, Homo sapiens
uugcauguacuuga

SEQ ID NO: 599053 - RNA, 20 nt, Homo sapiens
uugcauuugucaaagcauug

SEQ ID NO: 599054 - RNA, 21 nt, Homo sapiens
uugccaaaauaucauguucaa

SEQ ID NO: 599055 - RNA, 20 nt, Homo sapiens
uugccaaacagccacacugu

SEQ ID NO: 599056 - RNA, 19 nt, Homo sapiens
uugccaaauugacugucac

SEQ ID NO: 599057 - RNA, 18 nt, Homo sapiens
uugccaagaaaaugaagg

SEQ ID NO: 599058 - RNA, 20 nt, Homo sapiens
uugccaauuuuuguuuuccc

SEQ ID NO: 599059 - RNA, 21 nt, Homo sapiens
uugccaccagccccacccugc

SEQ ID NO: 599060 - RNA, 12 nt, Homo sapiens
uugccacuuaac

SEQ ID NO: 599061 - RNA, 14 nt, Homo sapiens
uugccagagccaaa

SEQ ID NO: 599062 - RNA, 21 nt, Homo sapiens
uugccagauuaccgacacugu

SEQ ID NO: 599063 - RNA, 16 nt, Homo sapiens
uugccauacagcuuca

SEQ ID NO: 599064 - RNA, 19 nt, Homo sapiens
uugccaucaccccaaacaa

SEQ ID NO: 599065 - RNA, 19 nt, Homo sapiens
uugccauggugauggugua

SEQ ID NO: 599066 - RNA, 22 nt, Homo sapiens
uugcccaagauaggaguucucu

SEQ ID NO: 599067 - RNA, 20 nt, Homo sapiens
uugcccacccccaccaugca

SEQ ID NO: 599068 - RNA, 14 nt, Homo sapiens
uugcccacuggccg

SEQ ID NO: 599069 - RNA, 19 nt, Homo sapiens
uugcccacuugauugagaa

SEQ ID NO: 599070 - RNA, 17 nt, Homo sapiens
uugcccagacuacaggg

SEQ ID NO: 599071 - RNA, 17 nt, Homo sapiens
uugcccagagaugccuc

SEQ ID NO: 599072 - RNA, 20 nt, Homo sapiens
uugcccaggcuagagugcaa

SEQ ID NO: 599073 - RNA, 22 nt, Homo sapiens
uugcccaggcuagagugcaaug

SEQ ID NO: 599074 - RNA, 21 nt, Homo sapiens
uugcccaggcuggagugcaau

SEQ ID NO: 599075 - RNA, 17 nt, Homo sapiens
uugcccaguguucuccu

SEQ ID NO: 599076 - RNA, 13 nt, Homo sapiens
uugcccaucagcc

SEQ ID NO: 599077 - RNA, 16 nt, Homo sapiens
uugcccaucagccauu

SEQ ID NO: 599078 - RNA, 19 nt, Homo sapiens
uugccccacuccucuccac

SEQ ID NO: 599079 - RNA, 14 nt, Homo sapiens
uugccccacucugc

SEQ ID NO: 599080 - RNA, 19 nt, Homo sapiens
uugccccaggacucuggca

SEQ ID NO: 599081 - RNA, 17 nt, Homo sapiens
uugcccccagacuuccu

SEQ ID NO: 599082 - RNA, 14 nt, Homo sapiens
uugcccccauuuca

SEQ ID NO: 599083 - RNA, 18 nt, Homo sapiens
uugccccuuccacuuuga

SEQ ID NO: 599084 - RNA, 17 nt, Homo sapiens
uugcccuucacaguguu

SEQ ID NO: 599085 - RNA, 19 nt, Homo sapiens
uugcccuugcccugaccuc

SEQ ID NO: 599086 - RNA, 14 nt, Homo sapiens
uugccuaaguauuc

SEQ ID NO: 599087 - RNA, 17 nt, Homo sapiens
uugccuaauggcaaaac

SEQ ID NO: 599088 - RNA, 22 nt, Homo sapiens
uugccuccuguucugcccacga

SEQ ID NO: 599089 - RNA, 21 nt, Homo sapiens
uugccucugaagccuauguau

SEQ ID NO: 599090 - RNA, 17 nt, Homo sapiens
uugccugcaugaaacau

SEQ ID NO: 599091 - RNA, 16 nt, Homo sapiens
uugccugccacugagc

SEQ ID NO: 599092 - RNA, 13 nt, Homo sapiens
uugccugccauuu

SEQ ID NO: 599093 - RNA, 17 nt, Homo sapiens
uugccuggagugugaac

SEQ ID NO: 599094 - RNA, 24 nt, Homo sapiens
uugccuuaaaccugaagaugucuc

SEQ ID NO: 599095 - RNA, 17 nt, Homo sapiens
uugccuuccuuucucca

SEQ ID NO: 599096 - RNA, 18 nt, Homo sapiens
uugccuucucuguucccu

SEQ ID NO: 599097 - RNA, 15 nt, Homo sapiens
uugccuugggcugcu

SEQ ID NO: 599098 - RNA, 17 nt, Homo sapiens
uugccuuucuucugccc

SEQ ID NO: 599099 - RNA, 14 nt, Homo sapiens
uugcgaaugugcag

SEQ ID NO: 599100 - RNA, 22 nt, Homo sapiens
uugcgcucucaagaccagagac

SEQ ID NO: 599101 - RNA, 12 nt, Homo sapiens
uugcgcugcuaa

SEQ ID NO: 599102 - RNA, 23 nt, Homo sapiens
uugcuaaaagauuauagaaguag

SEQ ID NO: 599103 - RNA, 15 nt, Homo sapiens
uugcuaaugcaauua

SEQ ID NO: 599104 - RNA, 15 nt, Homo sapiens
uugcuauagagccua

SEQ ID NO: 599105 - RNA, 11 nt, Homo sapiens
uugcucaaggc

SEQ ID NO: 599106 - RNA, 14 nt, Homo sapiens
uugcucagugccuc

SEQ ID NO: 599107 - RNA, 21 nt, Homo sapiens
uugcucaguguccagcuucca

SEQ ID NO: 599108 - RNA, 14 nt, Homo sapiens
uugcuccauuguca

SEQ ID NO: 599109 - RNA, 14 nt, Homo sapiens
uugcuccuugacau

SEQ ID NO: 599110 - RNA, 23 nt, Homo sapiens
uugcugacaaccauuaaagucag

SEQ ID NO: 599111 - RNA, 22 nt, Homo sapiens
uugcugaguccaacaauguugu

SEQ ID NO: 599112 - RNA, 22 nt, Homo sapiens
uugcugauaaauauaaccauca

SEQ ID NO: 599113 - RNA, 12 nt, Homo sapiens
uugcugcacuuu

SEQ ID NO: 599114 - RNA, 12 nt, Homo sapiens
uugcugccacau

SEQ ID NO: 599115 - RNA, 14 nt, Homo sapiens
uugcugcgugacau

SEQ ID NO: 599116 - RNA, 9 nt, Homo sapiens
uugcugcug

SEQ ID NO: 599117 - RNA, 14 nt, Homo sapiens
uugcugcugugaau

SEQ ID NO: 599118 - RNA, 23 nt, Homo sapiens
uugcuggggcucgugcccugcau

SEQ ID NO: 599119 - RNA, 16 nt, Homo sapiens
uugcugguagcacuug

SEQ ID NO: 599120 - RNA, 18 nt, Homo sapiens
uugcuguaacucagacau

SEQ ID NO: 599121 - RNA, 11 nt, Homo sapiens
uugcuguauau

SEQ ID NO: 599122 - RNA, 13 nt, Homo sapiens
uugcugugaauua

SEQ ID NO: 599123 - RNA, 17 nt, Homo sapiens
uugcugugggccaaaau

SEQ ID NO: 599124 - RNA, 17 nt, Homo sapiens
uugcugugugucugucc

SEQ ID NO: 599125 - RNA, 19 nt, Homo sapiens
uugcuguuccuuacuuuac

SEQ ID NO: 599126 - RNA, 14 nt, Homo sapiens
uugcuguuuacucc

SEQ ID NO: 599127 - RNA, 13 nt, Homo sapiens
uugcuuaaacccu

SEQ ID NO: 599128 - RNA, 22 nt, Homo sapiens
uugcuuaaacccuuuagugcuu

SEQ ID NO: 599129 - RNA, 20 nt, Homo sapiens
uugcuuaugacaugaucgcu

SEQ ID NO: 599130 - RNA, 20 nt, Homo sapiens
uugcuuccccuuuugccaau

SEQ ID NO: 599131 - RNA, 20 nt, Homo sapiens
uugcuuccugauuaccaguc

SEQ ID NO: 599132 - RNA, 20 nt, Homo sapiens
uugcuuuaccuuuucagggc

SEQ ID NO: 599133 - RNA, 15 nt, Homo sapiens
uugguuguacuuugg

SEQ ID NO: 599134 - RNA, 12 nt, Homo sapiens
uugguugugaau

SEQ ID NO: 599135 - RNA, 22 nt, Homo sapiens
uugguuguuugguuagugacug

SEQ ID NO: 599136 - RNA, 17 nt, Homo sapiens
uugguuuggauuacuau

SEQ ID NO: 599137 - RNA, 22 nt, Homo sapiens
uugguuuuauuuuauacuugcc

SEQ ID NO: 599138 - RNA, 16 nt, Homo sapiens
uugguuuugacuucag

SEQ ID NO: 599139 - RNA, 18 nt, Homo sapiens
uuguaaaauaauucugag

SEQ ID NO: 599140 - RNA, 20 nt, Homo sapiens
uuguaaaauauuuaugagaa

SEQ ID NO: 599141 - RNA, 14 nt, Homo sapiens
uuguaaacuguugu

SEQ ID NO: 599142 - RNA, 20 nt, Homo sapiens
uuguaaauaaagcccuggga

SEQ ID NO: 599143 - RNA, 15 nt, Homo sapiens
uuguaaauaggauuu

SEQ ID NO: 599144 - RNA, 15 nt, Homo sapiens
uuguaaauaugcaaa

SEQ ID NO: 599145 - RNA, 13 nt, Homo sapiens
uuguaaccugcau

SEQ ID NO: 599146 - RNA, 21 nt, Homo sapiens
uuguaacgacuucuccaucuc

SEQ ID NO: 599147 - RNA, 12 nt, Homo sapiens
uuguaacuaaua

SEQ ID NO: 599148 - RNA, 18 nt, Homo sapiens
uuguaacuuuuugcacua

SEQ ID NO: 599149 - RNA, 15 nt, Homo sapiens
uuguaagacuuacaa

SEQ ID NO: 599150 - RNA, 17 nt, Homo sapiens
uuguaaguaaauugccu

SEQ ID NO: 599151 - RNA, 23 nt, Homo sapiens
uuguaaguggucgcuuacuuuga

SEQ ID NO: 599152 - RNA, 22 nt, Homo sapiens
uuguaauaaaggucuuugcaca

SEQ ID NO: 599153 - RNA, 16 nt, Homo sapiens
uuguaauagccaaaaa

SEQ ID NO: 599154 - RNA, 19 nt, Homo sapiens
uuguacaaauguaagcaaa

SEQ ID NO: 599155 - RNA, 21 nt, Homo sapiens
uuguacauaaugcgugcauac

SEQ ID NO: 599156 - RNA, 22 nt, Homo sapiens
uuguacauaguaggcacuaaau

SEQ ID NO: 599157 - RNA, 17 nt, Homo sapiens
uuguaccaaaagaucuc

SEQ ID NO: 599158 - RNA, 20 nt, Homo sapiens
uuguaccacuucaucaaaau

SEQ ID NO: 599159 - RNA, 21 nt, Homo sapiens
uuguaccauauagagguguaa

SEQ ID NO: 599160 - RNA, 23 nt, Homo sapiens
uuguaccauauagagguguaaca

SEQ ID NO: 599161 - RNA, 18 nt, Homo sapiens
uuguaccucuaaguacau

SEQ ID NO: 599162 - RNA, 18 nt, Homo sapiens
uuguacuaaucugagauu

SEQ ID NO: 599163 - RNA, 17 nt, Homo sapiens
uuguacugugcaguuuu

SEQ ID NO: 599164 - RNA, 15 nt, Homo sapiens
uuguacuucugcucc

SEQ ID NO: 599165 - RNA, 19 nt, Homo sapiens
uuguagaaaugagccagaa

SEQ ID NO: 599166 - RNA, 14 nt, Homo sapiens
uuguagacaugccc

SEQ ID NO: 599167 - RNA, 14 nt, Homo sapiens
uuguagaugcauua

SEQ ID NO: 599168 - RNA, 18 nt, Homo sapiens
uuguagauggaguuucac

SEQ ID NO: 599169 - RNA, 14 nt, Homo sapiens
uuguagccagguac

SEQ ID NO: 599170 - RNA, 21 nt, Homo sapiens
uuguagcucaauacaauguga

SEQ ID NO: 599171 - RNA, 11 nt, Homo sapiens
uuguagcuuuu

SEQ ID NO: 599172 - RNA, 21 nt, Homo sapiens
uuguagggcuuuagcuuucuu

SEQ ID NO: 599173 - RNA, 22 nt, Homo sapiens
uuguaguauuuugggagcaaaa

SEQ ID NO: 599174 - RNA, 22 nt, Homo sapiens
uuguauauuuguaaacuacaaa

SEQ ID NO: 599175 - RNA, 16 nt, Homo sapiens
uuguaucaaaguguga

SEQ ID NO: 599176 - RNA, 10 nt, Homo sapiens
uuguaucauu

SEQ ID NO: 599177 - RNA, 18 nt, Homo sapiens
uuguauccacacaaauuc

SEQ ID NO: 599178 - RNA, 16 nt, Homo sapiens
uuguaucugucuuucc

SEQ ID NO: 599179 - RNA, 19 nt, Homo sapiens
uuguaugaaauauauguga

SEQ ID NO: 599180 - RNA, 15 nt, Homo sapiens
uuguauuaagccaau

SEQ ID NO: 599181 - RNA, 17 nt, Homo sapiens
uuguauuaucaacagca

SEQ ID NO: 599182 - RNA, 12 nt, Homo sapiens
uuguauugcaag

SEQ ID NO: 599183 - RNA, 22 nt, Homo sapiens
uuguauuuuaacucauaccuuu

SEQ ID NO: 599184 - RNA, 19 nt, Homo sapiens
uuguauuuuauuguuucuu

SEQ ID NO: 599185 - RNA, 17 nt, Homo sapiens
uuguauuuugugugacc

SEQ ID NO: 599186 - RNA, 21 nt, Homo sapiens
uugucaaaaggaagucucuag

SEQ ID NO: 599187 - RNA, 13 nt, Homo sapiens
uugucaaacugua

SEQ ID NO: 599188 - RNA, 20 nt, Homo sapiens
uugucaaagaaggugcugau

SEQ ID NO: 599189 - RNA, 17 nt, Homo sapiens
uugucaaagcauugaga

SEQ ID NO: 599190 - RNA, 17 nt, Homo sapiens
uugucaacaaaccaagc

SEQ ID NO: 599191 - RNA, 19 nt, Homo sapiens
uugucaacaaaccaagcau

SEQ ID NO: 599192 - RNA, 21 nt, Homo sapiens
uugucaagccugugcaaaaaa

SEQ ID NO: 599193 - RNA, 19 nt, Homo sapiens
uugucacagggacugaaaa

SEQ ID NO: 599194 - RNA, 15 nt, Homo sapiens
uugucaccagcaaca

SEQ ID NO: 599195 - RNA, 14 nt, Homo sapiens
uugucaccaugauc

SEQ ID NO: 599196 - RNA, 14 nt, Homo sapiens
uugucaccauugga

SEQ ID NO: 599197 - RNA, 18 nt, Homo sapiens
uugucacccaaagccugu

SEQ ID NO: 599198 - RNA, 19 nt, Homo sapiens
uugucagaguucugcucua

SEQ ID NO: 599199 - RNA, 14 nt, Homo sapiens
uugucauauggaau

SEQ ID NO: 599200 - RNA, 22 nt, Homo sapiens
uugucauauucgauguacuuua

SEQ ID NO: 599201 - RNA, 14 nt, Homo sapiens
uugucauccuuuga

SEQ ID NO: 599202 - RNA, 18 nt, Homo sapiens
uugucauuuuuaauauua

SEQ ID NO: 599203 - RNA, 21 nt, Homo sapiens
uuguccaggcuggagugcaau

SEQ ID NO: 599204 - RNA, 18 nt, Homo sapiens
uugucccccaacuugaga

SEQ ID NO: 599205 - RNA, 15 nt, Homo sapiens
uugucccguggcauu

SEQ ID NO: 599206 - RNA, 17 nt, Homo sapiens
uuguccugggucugugu

SEQ ID NO: 599207 - RNA, 20 nt, Homo sapiens
uuguccuuuuucacuuugaa

SEQ ID NO: 599208 - RNA, 17 nt, Homo sapiens
uugucgcucaugugugc

SEQ ID NO: 599209 - RNA, 21 nt, Homo sapiens
uugucuaaaguuacuacugau

SEQ ID NO: 599210 - RNA, 20 nt, Homo sapiens
uugucucuagagcagggauu

SEQ ID NO: 599211 - RNA, 17 nt, Homo sapiens
uugucucugugacugaa

SEQ ID NO: 599212 - RNA, 15 nt, Homo sapiens
uugucugauguggca

SEQ ID NO: 599213 - RNA, 21 nt, Homo sapiens
uugucuggcaaggacuuugua

SEQ ID NO: 599214 - RNA, 13 nt, Homo sapiens
uugucuguaaaua

SEQ ID NO: 599215 - RNA, 22 nt, Homo sapiens
uugucugucaaauguuuccuua

SEQ ID NO: 599216 - RNA, 13 nt, Homo sapiens
uugucuguucacu

SEQ ID NO: 599217 - RNA, 20 nt, Homo sapiens
uugucuguuuguuucaagaa

SEQ ID NO: 599218 - RNA, 20 nt, Homo sapiens
uugucuguuuuuguaacuua

SEQ ID NO: 599219 - RNA, 13 nt, Homo sapiens
uugucuucaugaa

SEQ ID NO: 599220 - RNA, 23 nt, Homo sapiens
uugugaacccuagcugugucaga

SEQ ID NO: 599221 - RNA, 23 nt, Homo sapiens
uugugaaguggaaauguucuaaa

SEQ ID NO: 599222 - RNA, 18 nt, Homo sapiens
uugugaauuaggcuguaa

SEQ ID NO: 599223 - RNA, 17 nt, Homo sapiens
uugugaauuauucugau

SEQ ID NO: 599224 - RNA, 20 nt, Homo sapiens
uugugaguuuaccuuguaua

SEQ ID NO: 599225 - RNA, 16 nt, Homo sapiens
uugugauaauucucag

SEQ ID NO: 599226 - RNA, 14 nt, Homo sapiens
uugugaucucacac

SEQ ID NO: 599227 - RNA, 15 nt, Homo sapiens
uugugaugaacauau

SEQ ID NO: 599228 - RNA, 15 nt, Homo sapiens
uugugauuauuucac

SEQ ID NO: 599229 - RNA, 12 nt, Homo sapiens
uugugauugccu

SEQ ID NO: 599230 - RNA, 16 nt, Homo sapiens
uugugauuucuuuaaa

SEQ ID NO: 599231 - RNA, 15 nt, Homo sapiens
uugugcaaagccaaa

SEQ ID NO: 599232 - RNA, 14 nt, Homo sapiens
uugugcacaucucg

SEQ ID NO: 599233 - RNA, 23 nt, Homo sapiens
uugugcaggguguguacugcaca

SEQ ID NO: 599234 - RNA, 21 nt, Homo sapiens
uugugccaaauuauucuccua

SEQ ID NO: 599235 - RNA, 18 nt, Homo sapiens
uuguggcuuuuaugcuuu

SEQ ID NO: 599236 - RNA, 14 nt, Homo sapiens
uuguggugcauuga

SEQ ID NO: 599237 - RNA, 14 nt, Homo sapiens
uugugguuaaucug

SEQ ID NO: 599238 - RNA, 19 nt, Homo sapiens
uuguguaagaaauacagac

SEQ ID NO: 599239 - RNA, 21 nt, Homo sapiens
uuguguaaugaaaaugaauau

SEQ ID NO: 599240 - RNA, 17 nt, Homo sapiens
uugugucaaaacugguu

SEQ ID NO: 599241 - RNA, 20 nt, Homo sapiens
uugugucauaaauuacacaa

SEQ ID NO: 599242 - RNA, 11 nt, Homo sapiens
uugugugcaug

SEQ ID NO: 599243 - RNA, 14 nt, Homo sapiens
uugugugucacaag

SEQ ID NO: 599244 - RNA, 21 nt, Homo sapiens
uugugugugaugugaagccaa

SEQ ID NO: 599245 - RNA, 20 nt, Homo sapiens
uuguguuccuggcugaugau

SEQ ID NO: 599246 - RNA, 14 nt, Homo sapiens
uuguguugucacua

SEQ ID NO: 599247 - RNA, 21 nt, Homo sapiens
uuguuaaacacgugucuauaa

SEQ ID NO: 599248 - RNA, 23 nt, Homo sapiens
uuguuaaguauugugcacuguau

SEQ ID NO: 599249 - RNA, 13 nt, Homo sapiens
uuguuacagcuuc

SEQ ID NO: 599250 - RNA, 17 nt, Homo sapiens
uuguuacuucugaggua

SEQ ID NO: 599251 - RNA, 13 nt, Homo sapiens
uuguuauuuacac

SEQ ID NO: 599252 - RNA, 11 nt, Homo sapiens
uuguucaauua

SEQ ID NO: 599253 - RNA, 20 nt, Homo sapiens
uuguucauuauuggagggua

SEQ ID NO: 599254 - RNA, 23 nt, Homo sapiens
uuguuccagcaguuuucaaguca

SEQ ID NO: 599255 - RNA, 21 nt, Homo sapiens
uuuaaugugaggaacucacau

SEQ ID NO: 599256 - RNA, 14 nt, Homo sapiens
uuuaauguugccca

SEQ ID NO: 599257 - RNA, 16 nt, Homo sapiens
uuuaauguuuccuuua

SEQ ID NO: 599258 - RNA, 19 nt, Homo sapiens
uuuaauuaaaaacuuuaaa

SEQ ID NO: 599259 - RNA, 14 nt, Homo sapiens
uuuaauuaaaucuc

SEQ ID NO: 599260 - RNA, 22 nt, Homo sapiens
uuuaauucaccccacacuagaa

SEQ ID NO: 599261 - RNA, 20 nt, Homo sapiens
uuuaauuccaugucagauaa

SEQ ID NO: 599262 - RNA, 16 nt, Homo sapiens
uuuaauucugucuugu

SEQ ID NO: 599263 - RNA, 13 nt, Homo sapiens
uuuaauuuugaca

SEQ ID NO: 599264 - RNA, 11 nt, Homo sapiens
uuuaauuuugu

SEQ ID NO: 599265 - RNA, 20 nt, Homo sapiens
uuuacaaaacuacaugagaa

SEQ ID NO: 599266 - RNA, 12 nt, Homo sapiens
uuuacaaaguau

SEQ ID NO: 599267 - RNA, 12 nt, Homo sapiens
uuuacaacuggg

SEQ ID NO: 599268 - RNA, 17 nt, Homo sapiens
uuuacaaguguauauca

SEQ ID NO: 599269 - RNA, 23 nt, Homo sapiens
uuuacaauaaaacuuugcugcca

SEQ ID NO: 599270 - RNA, 13 nt, Homo sapiens
uuuacacugggag

SEQ ID NO: 599271 - RNA, 11 nt, Homo sapiens
uuuacacuuua

SEQ ID NO: 599272 - RNA, 23 nt, Homo sapiens
uuuacagccagugggagauguua

SEQ ID NO: 599273 - RNA, 21 nt, Homo sapiens
uuuacagcuaucgaacuucac

SEQ ID NO: 599274 - RNA, 16 nt, Homo sapiens
uuuacagcucuuggca

SEQ ID NO: 599275 - RNA, 12 nt, Homo sapiens
uuuacagucucu

SEQ ID NO: 599276 - RNA, 18 nt, Homo sapiens
uuuacagugcuauuuacu

SEQ ID NO: 599277 - RNA, 18 nt, Homo sapiens
uuuacauaaagacugugc

SEQ ID NO: 599278 - RNA, 20 nt, Homo sapiens
uuuacauacacuguauguua

SEQ ID NO: 599279 - RNA, 20 nt, Homo sapiens
uuuacauaucaccucauggc

SEQ ID NO: 599280 - RNA, 23 nt, Homo sapiens
uuuacauguauuuaaaguagcau

SEQ ID NO: 599281 - RNA, 15 nt, Homo sapiens
uuuacauuaugcaaa

SEQ ID NO: 599282 - RNA, 11 nt, Homo sapiens
uuuacauucau

SEQ ID NO: 599283 - RNA, 15 nt, Homo sapiens
uuuacauucaucuca

SEQ ID NO: 599284 - RNA, 12 nt, Homo sapiens
uuuacauuugau

SEQ ID NO: 599285 - RNA, 15 nt, Homo sapiens
uuuaccaauaugcau

SEQ ID NO: 599286 - RNA, 20 nt, Homo sapiens
uuuaccauagaaagaugaca

SEQ ID NO: 599287 - RNA, 17 nt, Homo sapiens
uuuaccuaguuugcacu

SEQ ID NO: 599288 - RNA, 15 nt, Homo sapiens
uuuaccuauccacaa

SEQ ID NO: 599289 - RNA, 19 nt, Homo sapiens
uuuaccuguauacagugca

SEQ ID NO: 599290 - RNA, 22 nt, Homo sapiens
uuuacggacacccccucgcuug

SEQ ID NO: 599291 - RNA, 17 nt, Homo sapiens
uuuacgguccaugccuu

SEQ ID NO: 599292 - RNA, 19 nt, Homo sapiens
uuuacguggcaaaaugaac

SEQ ID NO: 599293 - RNA, 23 nt, Homo sapiens
uuuacguuugauacaacauuaag

SEQ ID NO: 599294 - RNA, 13 nt, Homo sapiens
uuuacuacugugg

SEQ ID NO: 599295 - RNA, 14 nt, Homo sapiens
uuuacuagugugug

SEQ ID NO: 599296 - RNA, 23 nt, Homo sapiens
uuuacugcucugagaauuguuga

SEQ ID NO: 599297 - RNA, 21 nt, Homo sapiens
uuuacuggugcagaugguuga

SEQ ID NO: 599298 - RNA, 23 nt, Homo sapiens
uuuacuugaaauuaaauuuggcu

SEQ ID NO: 599299 - RNA, 11 nt, Homo sapiens
uuuacuuuaaa

SEQ ID NO: 599300 - RNA, 11 nt, Homo sapiens
uuuacuuuguu

SEQ ID NO: 599301 - RNA, 18 nt, Homo sapiens
uuuagaaaaaaaacugaa

SEQ ID NO: 599302 - RNA, 18 nt, Homo sapiens
uuuagaaaugagaccaca

SEQ ID NO: 599303 - RNA, 19 nt, Homo sapiens
uuuagaaauuauauuuuag

SEQ ID NO: 599304 - RNA, 15 nt, Homo sapiens
uuuagaacaggagac

SEQ ID NO: 599305 - RNA, 14 nt, Homo sapiens
uuuagaacagggaa

SEQ ID NO: 599306 - RNA, 20 nt, Homo sapiens
uuuagaauaagaauuugcau

SEQ ID NO: 599307 - RNA, 21 nt, Homo sapiens
uuuagaccuguguuacuaaaa

SEQ ID NO: 599308 - RNA, 15 nt, Homo sapiens
uuuagauauacauau

SEQ ID NO: 599309 - RNA, 13 nt, Homo sapiens
uuuagauuguuaa

SEQ ID NO: 599310 - RNA, 19 nt, Homo sapiens
uuuagccccugaaagccau

SEQ ID NO: 599311 - RNA, 16 nt, Homo sapiens
uuuagcucugaagcaa

SEQ ID NO: 599312 - RNA, 19 nt, Homo sapiens
uuuaggaaaugggcaguga

SEQ ID NO: 599313 - RNA, 20 nt, Homo sapiens
uuuaggaaaugggcagugaa

SEQ ID NO: 599314 - RNA, 13 nt, Homo sapiens
uuuaggaagcaag

SEQ ID NO: 599315 - RNA, 20 nt, Homo sapiens
uuuaggaaguauggcaaaaa

SEQ ID NO: 599316 - RNA, 14 nt, Homo sapiens
uuuaggaguauuau

SEQ ID NO: 599317 - RNA, 16 nt, Homo sapiens
uuuaggagucugagca

SEQ ID NO: 599318 - RNA, 13 nt, Homo sapiens
uuuagggcagcuu

SEQ ID NO: 599319 - RNA, 21 nt, Homo sapiens
uuuaguagagaugggguuuca

SEQ ID NO: 599320 - RNA, 14 nt, Homo sapiens
uuuaguagcaacua

SEQ ID NO: 599321 - RNA, 14 nt, Homo sapiens
uuuaguaguuuaau

SEQ ID NO: 599322 - RNA, 24 nt, Homo sapiens
uuuagucgguucuguaucuccagu

SEQ ID NO: 599323 - RNA, 16 nt, Homo sapiens
uuuagucuguauugau

SEQ ID NO: 599324 - RNA, 12 nt, Homo sapiens
uuuagucuugau

SEQ ID NO: 599325 - RNA, 13 nt, Homo sapiens
uuuaguuacuuua

SEQ ID NO: 599326 - RNA, 17 nt, Homo sapiens
uuuaguuauauucacug

SEQ ID NO: 599327 - RNA, 23 nt, Homo sapiens
uuuaguugauuauuuucugcuac

SEQ ID NO: 599328 - RNA, 16 nt, Homo sapiens
uuuaguuuugauuuug

SEQ ID NO: 599329 - RNA, 16 nt, Homo sapiens
uuuauaaauggacaaa

SEQ ID NO: 599330 - RNA, 15 nt, Homo sapiens
uuuauaaccuggcaa

SEQ ID NO: 599331 - RNA, 16 nt, Homo sapiens
uuuauaagagcuaaag

SEQ ID NO: 599332 - RNA, 10 nt, Homo sapiens
uuuauacaau

SEQ ID NO: 599333 - RNA, 15 nt, Homo sapiens
uuuauacaauguucu

SEQ ID NO: 599334 - RNA, 15 nt, Homo sapiens
uuuauacaguugaaa

SEQ ID NO: 599335 - RNA, 13 nt, Homo sapiens
uuuauacauucua

SEQ ID NO: 599336 - RNA, 21 nt, Homo sapiens
uuuauagaccagaaccagagc

SEQ ID NO: 599337 - RNA, 22 nt, Homo sapiens
uuuauagaugggcaacuggcug

SEQ ID NO: 599338 - RNA, 18 nt, Homo sapiens
uuuauagaugucaggaaa

SEQ ID NO: 599339 - RNA, 14 nt, Homo sapiens
uuuauaguguugcu

SEQ ID NO: 599340 - RNA, 18 nt, Homo sapiens
uuuauauaagucuguuau

SEQ ID NO: 599341 - RNA, 16 nt, Homo sapiens
uuuauauaauaucuaa

SEQ ID NO: 599342 - RNA, 13 nt, Homo sapiens
uuuauauacuggg

SEQ ID NO: 599343 - RNA, 15 nt, Homo sapiens
uuuauauauaugaug

SEQ ID NO: 599344 - RNA, 14 nt, Homo sapiens
uuuauauauuggaa

SEQ ID NO: 599345 - RNA, 19 nt, Homo sapiens
uuuauaugauucacaugcu

SEQ ID NO: 599346 - RNA, 15 nt, Homo sapiens
uuuauauuacuuuug

SEQ ID NO: 599347 - RNA, 14 nt, Homo sapiens
uuuauauucaacuc

SEQ ID NO: 599348 - RNA, 22 nt, Homo sapiens
uuuauauuguauauucuggaaa

SEQ ID NO: 599349 - RNA, 18 nt, Homo sapiens
uuuauauuuuuauagaca

SEQ ID NO: 599350 - RNA, 17 nt, Homo sapiens
uuuaucaaaauguagcu

SEQ ID NO: 599351 - RNA, 14 nt, Homo sapiens
uuuaucaagccaua

SEQ ID NO: 599352 - RNA, 13 nt, Homo sapiens
uuuaucaccucau

SEQ ID NO: 599353 - RNA, 12 nt, Homo sapiens
uuuaucacugaa

SEQ ID NO: 599354 - RNA, 17 nt, Homo sapiens
uuuauccaaaaugugua

SEQ ID NO: 599355 - RNA, 18 nt, Homo sapiens
uuuaucccccgcaaagac

SEQ ID NO: 599356 - RNA, 20 nt, Homo sapiens
uuuaucccuuuccugguuuc

SEQ ID NO: 599357 - RNA, 20 nt, Homo sapiens
uuuaucuaaauuacagugca

SEQ ID NO: 599358 - RNA, 13 nt, Homo sapiens
uuuaucugugcaa

SEQ ID NO: 599359 - RNA, 16 nt, Homo sapiens
uuuaucuucuucacgg

SEQ ID NO: 599360 - RNA, 15 nt, Homo sapiens
uuuaugaaguuaaau

SEQ ID NO: 599361 - RNA, 17 nt, Homo sapiens
uuuaugacauuacaauc

SEQ ID NO: 599362 - RNA, 12 nt, Homo sapiens
uuuaugcugcug

SEQ ID NO: 599363 - RNA, 13 nt, Homo sapiens
uuuauggccucag

SEQ ID NO: 599364 - RNA, 16 nt, Homo sapiens
uuuaugucuguaauca

SEQ ID NO: 599365 - RNA, 11 nt, Homo sapiens
uuuaugugcaa

SEQ ID NO: 599366 - RNA, 13 nt, Homo sapiens
uuuauguuguaug

SEQ ID NO: 599367 - RNA, 19 nt, Homo sapiens
uuuauguuugaaugauuua

SEQ ID NO: 599368 - RNA, 21 nt, Homo sapiens
uuuauguuuggaauaaaguca

SEQ ID NO: 599369 - RNA, 12 nt, Homo sapiens
uuuauuacaacu

SEQ ID NO: 599370 - RNA, 19 nt, Homo sapiens
uuuauuacauugcugccuu

SEQ ID NO: 599371 - RNA, 13 nt, Homo sapiens
uuuauuaccucug

SEQ ID NO: 599372 - RNA, 18 nt, Homo sapiens
uuuauuaggguacuuuau

SEQ ID NO: 599373 - RNA, 15 nt, Homo sapiens
uuuauuauacaccuu

SEQ ID NO: 599374 - RNA, 14 nt, Homo sapiens
uuuauuccuuugaa

SEQ ID NO: 599375 - RNA, 15 nt, Homo sapiens
uuuauuccuuugaau

SEQ ID NO: 599376 - RNA, 23 nt, Homo sapiens
uuuauugacugggcaacacugca

SEQ ID NO: 599377 - RNA, 13 nt, Homo sapiens
uuuauuucaucuc

SEQ ID NO: 599378 - RNA, 13 nt, Homo sapiens
uuuauuucucggg

SEQ ID NO: 599379 - RNA, 19 nt, Homo sapiens
uuugcaacucccuggguaa

SEQ ID NO: 599380 - RNA, 13 nt, Homo sapiens
uuugcaacuuaau

SEQ ID NO: 599381 - RNA, 13 nt, Homo sapiens
uuugcaagacaua

SEQ ID NO: 599382 - RNA, 13 nt, Homo sapiens
uuugcacaggaug

SEQ ID NO: 599383 - RNA, 23 nt, Homo sapiens
uuugcaccccuuuccuccccaua

SEQ ID NO: 599384 - RNA, 19 nt, Homo sapiens
uuugcagcagugagucucu

SEQ ID NO: 599385 - RNA, 14 nt, Homo sapiens
uuugcagcuaaaau

SEQ ID NO: 599386 - RNA, 21 nt, Homo sapiens
uuugcaggguccucuucuggg

SEQ ID NO: 599387 - RNA, 16 nt, Homo sapiens
uuugcaguaugaacua

SEQ ID NO: 599388 - RNA, 23 nt, Homo sapiens
uuugcauuugcucuuucaucucu

SEQ ID NO: 599389 - RNA, 17 nt, Homo sapiens
uuugccaaggcaaaaaa

SEQ ID NO: 599390 - RNA, 19 nt, Homo sapiens
uuugccaccagaaaccaca

SEQ ID NO: 599391 - RNA, 10 nt, Homo sapiens
uuugccacuu

SEQ ID NO: 599392 - RNA, 23 nt, Homo sapiens
uuugccauauuuucaccauuuga

SEQ ID NO: 599393 - RNA, 13 nt, Homo sapiens
uuugccauucaag

SEQ ID NO: 599394 - RNA, 23 nt, Homo sapiens
uuugcccccauucacuuugucag

SEQ ID NO: 599395 - RNA, 16 nt, Homo sapiens
uuugccgacauguuug

SEQ ID NO: 599396 - RNA, 18 nt, Homo sapiens
uuugccuccagugcaguc

SEQ ID NO: 599397 - RNA, 14 nt, Homo sapiens
uuugccugccauuu

SEQ ID NO: 599398 - RNA, 13 nt, Homo sapiens
uuugccugugauu

SEQ ID NO: 599399 - RNA, 15 nt, Homo sapiens
uuugccuucacccau

SEQ ID NO: 599400 - RNA, 22 nt, Homo sapiens
uuugcguacacagagaaggcua

SEQ ID NO: 599401 - RNA, 20 nt, Homo sapiens
uuugcguuugguuuacuugu

SEQ ID NO: 599402 - RNA, 21 nt, Homo sapiens
uuugcuaaaugugaaugauga

SEQ ID NO: 599403 - RNA, 19 nt, Homo sapiens
uuugcuagacucuagacaa

SEQ ID NO: 599404 - RNA, 18 nt, Homo sapiens
uuugcuagcagaaaucua

SEQ ID NO: 599405 - RNA, 19 nt, Homo sapiens
uuugcuauuagagcauuga

SEQ ID NO: 599406 - RNA, 22 nt, Homo sapiens
uuugcucuuagcugucugcuca

SEQ ID NO: 599407 - RNA, 19 nt, Homo sapiens
uuugcugauuucuagugua

SEQ ID NO: 599408 - RNA, 15 nt, Homo sapiens
uuugcugcuuuccag

SEQ ID NO: 599409 - RNA, 11 nt, Homo sapiens
uuugcuguaga

SEQ ID NO: 599410 - RNA, 12 nt, Homo sapiens
uuugcuguagaa

SEQ ID NO: 599411 - RNA, 23 nt, Homo sapiens
uuugcugugaugauguguucuug

SEQ ID NO: 599412 - RNA, 21 nt, Homo sapiens
uuugcuuccucccaacaagca

SEQ ID NO: 599413 - RNA, 16 nt, Homo sapiens
uuuggaaagacuggac

SEQ ID NO: 599414 - RNA, 14 nt, Homo sapiens
uuuggaaagccauu

SEQ ID NO: 599415 - RNA, 16 nt, Homo sapiens
uuuggaagucaugagc

SEQ ID NO: 599416 - RNA, 20 nt, Homo sapiens
uuuggaaguccagagcugga

SEQ ID NO: 599417 - RNA, 15 nt, Homo sapiens
uuuggaauauuaaaa

SEQ ID NO: 599418 - RNA, 17 nt, Homo sapiens
uuuggaauuacaaccau

SEQ ID NO: 599419 - RNA, 17 nt, Homo sapiens
uuuggaauugucuugau

SEQ ID NO: 599420 - RNA, 21 nt, Homo sapiens
uuuggaccaccguucagucau

SEQ ID NO: 599421 - RNA, 23 nt, Homo sapiens
uuuggacccagggccugacuuga

SEQ ID NO: 599422 - RNA, 16 nt, Homo sapiens
uuuggaguaaucagaa

SEQ ID NO: 599423 - RNA, 17 nt, Homo sapiens
uuuggaugaccagaaca

SEQ ID NO: 599424 - RNA, 14 nt, Homo sapiens
uuuggauguuucca

SEQ ID NO: 599425 - RNA, 18 nt, Homo sapiens
uuuggauuacuauugcaa

SEQ ID NO: 599426 - RNA, 23 nt, Homo sapiens
uuuggccaguagcuaaagugcaa

SEQ ID NO: 599427 - RNA, 15 nt, Homo sapiens
uuuggccuccuccag

SEQ ID NO: 599428 - RNA, 19 nt, Homo sapiens
uuugggaccaucacugaga

SEQ ID NO: 599429 - RNA, 21 nt, Homo sapiens
uuugggagacugugcucucug

SEQ ID NO: 599430 - RNA, 13 nt, Homo sapiens
uuugggaugacca

SEQ ID NO: 599431 - RNA, 22 nt, Homo sapiens
uuuggggaccaaaggucaggga

SEQ ID NO: 599432 - RNA, 12 nt, Homo sapiens
uuuggggagcag

SEQ ID NO: 599433 - RNA, 15 nt, Homo sapiens
uuuggggggcagaga

SEQ ID NO: 599434 - RNA, 16 nt, Homo sapiens
uuuggggggcagagaa

SEQ ID NO: 599435 - RNA, 11 nt, Homo sapiens
uuugggguccc

SEQ ID NO: 599436 - RNA, 21 nt, Homo sapiens
uuugguagaaggacugaacaa

SEQ ID NO: 599437 - RNA, 15 nt, Homo sapiens
uuugguaugugcuag

SEQ ID NO: 599438 - RNA, 22 nt, Homo sapiens
uuuggucuauuuucugcagaaa

SEQ ID NO: 599439 - RNA, 20 nt, Homo sapiens
uuuggugagagaaguacaaa

SEQ ID NO: 599440 - RNA, 19 nt, Homo sapiens
uuugguguuuuuacagagg

SEQ ID NO: 599441 - RNA, 18 nt, Homo sapiens
uuugguuuaccuggggau

SEQ ID NO: 599442 - RNA, 13 nt, Homo sapiens
uuugguuugaccc

SEQ ID NO: 599443 - RNA, 15 nt, Homo sapiens
uuuguaaacuucuga

SEQ ID NO: 599444 - RNA, 17 nt, Homo sapiens
uuuguaaaucugccaca

SEQ ID NO: 599445 - RNA, 20 nt, Homo sapiens
uuuguaaauuaauacuucau

SEQ ID NO: 599446 - RNA, 13 nt, Homo sapiens
uuuguaacauaau

SEQ ID NO: 599447 - RNA, 15 nt, Homo sapiens
uuuguaagaugcugg

SEQ ID NO: 599448 - RNA, 14 nt, Homo sapiens
uuuguaagugcugc

SEQ ID NO: 599449 - RNA, 18 nt, Homo sapiens
uuuguaagugcugcuaua

SEQ ID NO: 599450 - RNA, 19 nt, Homo sapiens
uuuguaauaauaaagaaua

SEQ ID NO: 599451 - RNA, 15 nt, Homo sapiens
uuuguaaugcaaaag

SEQ ID NO: 599452 - RNA, 18 nt, Homo sapiens
uuuguacaauuacuaaau

SEQ ID NO: 599453 - RNA, 21 nt, Homo sapiens
uuuguacaucccaaaggauga

SEQ ID NO: 599454 - RNA, 13 nt, Homo sapiens
uuuguagcacuga

SEQ ID NO: 599455 - RNA, 19 nt, Homo sapiens
uuuguagcucuggaccugu

SEQ ID NO: 599456 - RNA, 17 nt, Homo sapiens
uuuguauaaaaguguga

SEQ ID NO: 599457 - RNA, 17 nt, Homo sapiens
uuuguaugacagugaag

SEQ ID NO: 599458 - RNA, 16 nt, Homo sapiens
uuuguauuauuacaaa

SEQ ID NO: 599459 - RNA, 14 nt, Homo sapiens
uuuguauucaugaa

SEQ ID NO: 599460 - RNA, 17 nt, Homo sapiens
uuuguauugagggccag

SEQ ID NO: 599461 - RNA, 19 nt, Homo sapiens
uuuguauuuuuaguagaga

SEQ ID NO: 599462 - RNA, 21 nt, Homo sapiens
uuugucagggauuuagcccau

SEQ ID NO: 599463 - RNA, 18 nt, Homo sapiens
uuugucauauggaauuua

SEQ ID NO: 599464 - RNA, 23 nt, Homo sapiens
uuugucccagcgauggugccugc

SEQ ID NO: 599465 - RNA, 15 nt, Homo sapiens
uuugucucaccucau

SEQ ID NO: 599466 - RNA, 14 nt, Homo sapiens
uuugucucauccca

SEQ ID NO: 599467 - RNA, 19 nt, Homo sapiens
uuugucugcccaauccauc

SEQ ID NO: 599468 - RNA, 15 nt, Homo sapiens
uuugucuuauauaua

SEQ ID NO: 599469 - RNA, 14 nt, Homo sapiens
uuugucuucaugaa

SEQ ID NO: 599470 - RNA, 13 nt, Homo sapiens
uuugucuugaaug

SEQ ID NO: 599471 - RNA, 23 nt, Homo sapiens
uuugugaaaugaaaacauguaau

SEQ ID NO: 599472 - RNA, 19 nt, Homo sapiens
uuugugauagcacuuucua

SEQ ID NO: 599473 - RNA, 22 nt, Homo sapiens
uuugugcagagauaaagaccuu

SEQ ID NO: 599474 - RNA, 15 nt, Homo sapiens
uuugugcagcacagu

SEQ ID NO: 599475 - RNA, 16 nt, Homo sapiens
uuuguggucacagcca

SEQ ID NO: 599476 - RNA, 20 nt, Homo sapiens
uuuguuaccauacugucucu

SEQ ID NO: 599477 - RNA, 16 nt, Homo sapiens
uuuguuauccuguaua

SEQ ID NO: 599478 - RNA, 17 nt, Homo sapiens
uuuguuaugacagugaa

SEQ ID NO: 599479 - RNA, 22 nt, Homo sapiens
uuuguucaaugcuagaacaacg

SEQ ID NO: 599480 - RNA, 11 nt, Homo sapiens
uuuguugacau

SEQ ID NO: 599481 - RNA, 17 nt, Homo sapiens
uuuguugacauuagucu

SEQ ID NO: 599482 - RNA, 15 nt, Homo sapiens
uuuguugagcaugac

SEQ ID NO: 599483 - RNA, 18 nt, Homo sapiens
uuuguugagugcacugac

SEQ ID NO: 599484 - RNA, 21 nt, Homo sapiens
uuuguugagugcacugacugu

SEQ ID NO: 599485 - RNA, 17 nt, Homo sapiens
uuuguugcuaauuugcc

SEQ ID NO: 599486 - RNA, 13 nt, Homo sapiens
uuuguuguucuga

SEQ ID NO: 599487 - RNA, 24 nt, Homo sapiens
uuuguuuaaacccaagugcugcac

SEQ ID NO: 599488 - RNA, 13 nt, Homo sapiens
uuuguuuaacaaa

SEQ ID NO: 599489 - RNA, 16 nt, Homo sapiens
uuuguuugauuacugu

SEQ ID NO: 599490 - RNA, 14 nt, Homo sapiens
uuuguuuuaaauac

SEQ ID NO: 599491 - RNA, 17 nt, Homo sapiens
uuuguuuuccccacauu

SEQ ID NO: 599492 - RNA, 22 nt, Homo sapiens
uuuuaaaaaaaacaauuccaca

SEQ ID NO: 599493 - RNA, 17 nt, Homo sapiens
uuuuaaaaacucuucag

SEQ ID NO: 599494 - RNA, 17 nt, Homo sapiens
uuuuaaaacccauuuaa

SEQ ID NO: 599495 - RNA, 20 nt, Homo sapiens
uuuuaaaguaaagauguauu

SEQ ID NO: 599496 - RNA, 14 nt, Homo sapiens
uuuuaaaugacuug

SEQ ID NO: 599497 - RNA, 15 nt, Homo sapiens
uuuuaaaugcaccug

SEQ ID NO: 599498 - RNA, 18 nt, Homo sapiens
uuuuaaauguauacuaua

SEQ ID NO: 599499 - RNA, 16 nt, Homo sapiens
uuuuaaauuuugacaa

SEQ ID NO: 599500 - RNA, 20 nt, Homo sapiens
uuuuaacaaacgcauuaaga

SEQ ID NO: 599501 - RNA, 19 nt, Homo sapiens
aaaauaaaugucacugcca

SEQ ID NO: 599502 - RNA, 17 nt, Homo sapiens
aaaauaacaaagcccuu

SEQ ID NO: 599503 - RNA, 21 nt, Homo sapiens
aaaauaaccaugaauacacuu

SEQ ID NO: 599504 - RNA, 14 nt, Homo sapiens
aaaauaagcucagu

SEQ ID NO: 599505 - RNA, 12 nt, Homo sapiens
aaaauaaucaug

SEQ ID NO: 599506 - RNA, 17 nt, Homo sapiens
aaaauacaaaaagcaaa

SEQ ID NO: 599507 - RNA, 18 nt, Homo sapiens
aaaauacaacacugagcc

SEQ ID NO: 599508 - RNA, 13 nt, Homo sapiens
aaaauacaugaca

SEQ ID NO: 599509 - RNA, 13 nt, Homo sapiens
aaaauaccuucua

SEQ ID NO: 599510 - RNA, 13 nt, Homo sapiens
aaaauacuaccua

SEQ ID NO: 599511 - RNA, 13 nt, Homo sapiens
aaaauacuuugau

SEQ ID NO: 599512 - RNA, 19 nt, Homo sapiens
aaaauacuuuuacucugcc

SEQ ID NO: 599513 - RNA, 11 nt, Homo sapiens
aaaauagcuua

SEQ ID NO: 599514 - RNA, 23 nt, Homo sapiens
aaaauagggaccuagaagcuuaa

SEQ ID NO: 599515 - RNA, 16 nt, Homo sapiens
aaaauaguaaagccaa

SEQ ID NO: 599516 - RNA, 21 nt, Homo sapiens
aaaauaguaaaugcuuugugu

SEQ ID NO: 599517 - RNA, 14 nt, Homo sapiens
aaaauagucuucca

SEQ ID NO: 599518 - RNA, 23 nt, Homo sapiens
aaaauaguucccuuugccaacag

SEQ ID NO: 599519 - RNA, 14 nt, Homo sapiens
aaaauaguuuuaaa

SEQ ID NO: 599520 - RNA, 14 nt, Homo sapiens
aaaauauauauuaa

SEQ ID NO: 599521 - RNA, 14 nt, Homo sapiens
aaaauauauuucag

SEQ ID NO: 599522 - RNA, 22 nt, Homo sapiens
aaaauaucagacaagcacuauu

SEQ ID NO: 599523 - RNA, 15 nt, Homo sapiens
aaaauaucauguuca

SEQ ID NO: 599524 - RNA, 16 nt, Homo sapiens
aaaauaucugcucaaa

SEQ ID NO: 599525 - RNA, 17 nt, Homo sapiens
aaaauauguucuuuaaa

SEQ ID NO: 599526 - RNA, 22 nt, Homo sapiens
aaaauauuaagacaauagcacu

SEQ ID NO: 599527 - RNA, 13 nt, Homo sapiens
aaaauauugcuuc

SEQ ID NO: 599528 - RNA, 20 nt, Homo sapiens
aaaauauuucagauaucaaa

SEQ ID NO: 599529 - RNA, 21 nt, Homo sapiens
aaaauauuuccugacuugagu

SEQ ID NO: 599530 - RNA, 21 nt, Homo sapiens
aaaauauuuuuagaacuccaa

SEQ ID NO: 599531 - RNA, 19 nt, Homo sapiens
aaaauauuuuuaugugcaa

SEQ ID NO: 599532 - RNA, 22 nt, Homo sapiens
aaaauauuuuuaugugcaauaa

SEQ ID NO: 599533 - RNA, 21 nt, Homo sapiens
aaaaucaaacccacauauuaa

SEQ ID NO: 599534 - RNA, 22 nt, Homo sapiens
aaaaucacaaggcaacugugag

SEQ ID NO: 599535 - RNA, 18 nt, Homo sapiens
aaaaucacauccuggccu

SEQ ID NO: 599536 - RNA, 13 nt, Homo sapiens
aaaaucacucuca

SEQ ID NO: 599537 - RNA, 14 nt, Homo sapiens
aaaauccaaaugag

SEQ ID NO: 599538 - RNA, 16 nt, Homo sapiens
aaaauccaauaaucag

SEQ ID NO: 599539 - RNA, 23 nt, Homo sapiens
aaaauccaugugaccauucugcc

SEQ ID NO: 599540 - RNA, 11 nt, Homo sapiens
aaaauccauuu

SEQ ID NO: 599541 - RNA, 13 nt, Homo sapiens
aaaauccauuuua

SEQ ID NO: 599542 - RNA, 18 nt, Homo sapiens
aaaaucccaagucauuuc

SEQ ID NO: 599543 - RNA, 22 nt, Homo sapiens
aaaauccccucagccucuucuc

SEQ ID NO: 599544 - RNA, 16 nt, Homo sapiens
aaaaucccuuguucuc

SEQ ID NO: 599545 - RNA, 20 nt, Homo sapiens
aaaauccugaacuuucuccc

SEQ ID NO: 599546 - RNA, 23 nt, Homo sapiens
aaaauccuggaagacaacccagg

SEQ ID NO: 599547 - RNA, 23 nt, Homo sapiens
aaacaagcauagaaauggaagaa

SEQ ID NO: 599548 - RNA, 15 nt, Homo sapiens
aaacaagcauuucaa

SEQ ID NO: 599549 - RNA, 15 nt, Homo sapiens
aaacaaggaagccaa

SEQ ID NO: 599550 - RNA, 23 nt, Homo sapiens
aaacaaguauauaauuuacuuug

SEQ ID NO: 599551 - RNA, 17 nt, Homo sapiens
aaacaagugaccccagg

SEQ ID NO: 599552 - RNA, 19 nt, Homo sapiens
aaacaaguuuuucugucaa

SEQ ID NO: 599553 - RNA, 22 nt, Homo sapiens
aaacacaaauagaacauuccau

SEQ ID NO: 599554 - RNA, 14 nt, Homo sapiens
aaacacacauacac

SEQ ID NO: 599555 - RNA, 19 nt, Homo sapiens
aaacacacgugcugugggc

SEQ ID NO: 599556 - RNA, 15 nt, Homo sapiens
aaacacauauucaaa

SEQ ID NO: 599557 - RNA, 16 nt, Homo sapiens
aaacacaugccuuaaa

SEQ ID NO: 599558 - RNA, 21 nt, Homo sapiens
aaacaccacuaauuguguaca

SEQ ID NO: 599559 - RNA, 14 nt, Homo sapiens
aaacacccaaaaau

SEQ ID NO: 599560 - RNA, 19 nt, Homo sapiens
aaacacccaaaaauaucuc

SEQ ID NO: 599561 - RNA, 18 nt, Homo sapiens
aaacacgaaacuuguuau

SEQ ID NO: 599562 - RNA, 19 nt, Homo sapiens
aaacacgucgauucugucc

SEQ ID NO: 599563 - RNA, 13 nt, Homo sapiens
aaacacuaccucu

SEQ ID NO: 599564 - RNA, 17 nt, Homo sapiens
aaacacuuacagaauua

SEQ ID NO: 599565 - RNA, 15 nt, Homo sapiens
aaacagaaaggugca

SEQ ID NO: 599566 - RNA, 23 nt, Homo sapiens
aaacagacgggucugagacugaa

SEQ ID NO: 599567 - RNA, 22 nt, Homo sapiens
aaacagauuuuagacuuaccuu

SEQ ID NO: 599568 - RNA, 20 nt, Homo sapiens
aaacagcagauuucagauca

SEQ ID NO: 599569 - RNA, 18 nt, Homo sapiens
aaacagcaguuugugaua

SEQ ID NO: 599570 - RNA, 20 nt, Homo sapiens
aaacagccaagauuuuccuc

SEQ ID NO: 599571 - RNA, 10 nt, Homo sapiens
aaacagccac

SEQ ID NO: 599572 - RNA, 15 nt, Homo sapiens
aaacagccaugucca

SEQ ID NO: 599573 - RNA, 20 nt, Homo sapiens
aaacagcccccacuccaguc

SEQ ID NO: 599574 - RNA, 17 nt, Homo sapiens
aaacagccccucuggac

SEQ ID NO: 599575 - RNA, 23 nt, Homo sapiens
aaacagcuccucuauauuuccac

SEQ ID NO: 599576 - RNA, 16 nt, Homo sapiens
aaacaggaacaaucca

SEQ ID NO: 599577 - RNA, 18 nt, Homo sapiens
aaacaggcugacuggcag

SEQ ID NO: 599578 - RNA, 15 nt, Homo sapiens
aaacagggugggcaa

SEQ ID NO: 599579 - RNA, 12 nt, Homo sapiens
aaacaguucuug

SEQ ID NO: 599580 - RNA, 22 nt, Homo sapiens
aaacauaaaaaccaaacccaga

SEQ ID NO: 599581 - RNA, 18 nt, Homo sapiens
aaacauaacuccaucuac

SEQ ID NO: 599582 - RNA, 18 nt, Homo sapiens
aaacauaaucuucugccu

SEQ ID NO: 599583 - RNA, 14 nt, Homo sapiens
aaacauagcaucuc

SEQ ID NO: 599584 - RNA, 17 nt, Homo sapiens
aaacauagcaucucagg

SEQ ID NO: 599585 - RNA, 17 nt, Homo sapiens
aaacaucacaccugccc

SEQ ID NO: 599586 - RNA, 14 nt, Homo sapiens
aaacaucauuacag

SEQ ID NO: 599587 - RNA, 14 nt, Homo sapiens
aaacaucccaagaa

SEQ ID NO: 599588 - RNA, 18 nt, Homo sapiens
aaacaucuccccucucac

SEQ ID NO: 599589 - RNA, 23 nt, Homo sapiens
aaacaugacccugggcuucugua

SEQ ID NO: 599590 - RNA, 17 nt, Homo sapiens
aaacaugcggugccaug

SEQ ID NO: 599591 - RNA, 17 nt, Homo sapiens
aaacauguaugugcauu

SEQ ID NO: 599592 - RNA, 17 nt, Homo sapiens
aaacugcuuacuuaugc

SEQ ID NO: 599593 - RNA, 23 nt, Homo sapiens
aaacugcuuuauacacugucacg

SEQ ID NO: 599594 - RNA, 13 nt, Homo sapiens
aaacugcuuugag

SEQ ID NO: 599595 - RNA, 17 nt, Homo sapiens
aaacuggaaaaucuucu

SEQ ID NO: 599596 - RNA, 22 nt, Homo sapiens
aaacuggcaaaauaguucugca

SEQ ID NO: 599597 - RNA, 21 nt, Homo sapiens
aaacuggcugcuuuguucaau

SEQ ID NO: 599598 - RNA, 22 nt, Homo sapiens
aaacuggcugcuuuguucaaug

SEQ ID NO: 599599 - RNA, 21 nt, Homo sapiens
aaacugggggcucuguauaua

SEQ ID NO: 599600 - RNA, 14 nt, Homo sapiens
aaacugucuugccc

SEQ ID NO: 599601 - RNA, 18 nt, Homo sapiens
aaacugucuuuaaaagag

SEQ ID NO: 599602 - RNA, 21 nt, Homo sapiens
aaacugugaagcauuuacaga

SEQ ID NO: 599603 - RNA, 12 nt, Homo sapiens
aaacugugcacc

SEQ ID NO: 599604 - RNA, 14 nt, Homo sapiens
aaacuguguugcca

SEQ ID NO: 599605 - RNA, 17 nt, Homo sapiens
aaacuguuuugacaaau

SEQ ID NO: 599606 - RNA, 13 nt, Homo sapiens
aaacuuacuuugg

SEQ ID NO: 599607 - RNA, 19 nt, Homo sapiens
aaacuuagaucaucaguca

SEQ ID NO: 599608 - RNA, 19 nt, Homo sapiens
aaacuuagugacaaaauag

SEQ ID NO: 599609 - RNA, 13 nt, Homo sapiens
aaacuucaaagag

SEQ ID NO: 599610 - RNA, 12 nt, Homo sapiens
aaacuucaccua

SEQ ID NO: 599611 - RNA, 21 nt, Homo sapiens
aaacuucaccuacauuaucuc

SEQ ID NO: 599612 - RNA, 23 nt, Homo sapiens
aaacuucaccuacauuaucucac

SEQ ID NO: 599613 - RNA, 13 nt, Homo sapiens
aaacuucagggau

SEQ ID NO: 599614 - RNA, 22 nt, Homo sapiens
aaacuucaugguuugcauuuaa

SEQ ID NO: 599615 - RNA, 14 nt, Homo sapiens
aaacuuccaaagcu

SEQ ID NO: 599616 - RNA, 14 nt, Homo sapiens
aaacuugaacucca

SEQ ID NO: 599617 - RNA, 20 nt, Homo sapiens
aaacuugaaucaaagcaguu

SEQ ID NO: 599618 - RNA, 15 nt, Homo sapiens
aaacuugcuuaucaa

SEQ ID NO: 599619 - RNA, 22 nt, Homo sapiens
aaacuuguaaagacacaucuua

SEQ ID NO: 599620 - RNA, 19 nt, Homo sapiens
aaacuuguaaaugcuguca

SEQ ID NO: 599621 - RNA, 17 nt, Homo sapiens
aaacuuuaagaacaaac

SEQ ID NO: 599622 - RNA, 17 nt, Homo sapiens
aaacuuuaucacuuaaa

SEQ ID NO: 599623 - RNA, 17 nt, Homo sapiens
aaacuuuauguacugcu

SEQ ID NO: 599624 - RNA, 22 nt, Homo sapiens
aaacuuuauuuguaaaccauug

SEQ ID NO: 599625 - RNA, 18 nt, Homo sapiens
aaacuuuccugacuuaca

SEQ ID NO: 599626 - RNA, 20 nt, Homo sapiens
aaacuuuucuaauacucuac

SEQ ID NO: 599627 - RNA, 23 nt, Homo sapiens
aaacuuuuguaaauuauugauga

SEQ ID NO: 599628 - RNA, 23 nt, Homo sapiens
aaacuuuuuuuuccuacuaucau

SEQ ID NO: 599629 - RNA, 15 nt, Homo sapiens
aaagaaaaguauugu

SEQ ID NO: 599630 - RNA, 21 nt, Homo sapiens
aaagaaaauuccuauaaggaa

SEQ ID NO: 599631 - RNA, 15 nt, Homo sapiens
aaagaaacacgcacu

SEQ ID NO: 599632 - RNA, 16 nt, Homo sapiens
aaagaaagaaacugau

SEQ ID NO: 599633 - RNA, 16 nt, Homo sapiens
aaagaaaucagccaug

SEQ ID NO: 599634 - RNA, 20 nt, Homo sapiens
aaagaaauccauaucuuaaa

SEQ ID NO: 599635 - RNA, 16 nt, Homo sapiens
aaagaaaugcccaucu

SEQ ID NO: 599636 - RNA, 19 nt, Homo sapiens
aaagaaauuuagagucaau

SEQ ID NO: 599637 - RNA, 14 nt, Homo sapiens
aaagaaauuuugcc

SEQ ID NO: 599638 - RNA, 15 nt, Homo sapiens
aaagaacaucugcac

SEQ ID NO: 599639 - RNA, 13 nt, Homo sapiens
aaagaaccaaaag

SEQ ID NO: 599640 - RNA, 20 nt, Homo sapiens
aaagaagaagagaugacaaa

SEQ ID NO: 599641 - RNA, 17 nt, Homo sapiens
aaagaagacaucugugg

SEQ ID NO: 599642 - RNA, 21 nt, Homo sapiens
aaagaagacgcucagcacugu

SEQ ID NO: 599643 - RNA, 12 nt, Homo sapiens
aaagaagccagc

SEQ ID NO: 599644 - RNA, 22 nt, Homo sapiens
aaagaagcuucaugccagguua

SEQ ID NO: 599645 - RNA, 15 nt, Homo sapiens
aaagaaguacuuuau

SEQ ID NO: 599646 - RNA, 20 nt, Homo sapiens
aaagaaguacuuuauugcaa

SEQ ID NO: 599647 - RNA, 22 nt, Homo sapiens
aaagaaguaugguaaucuuuac

SEQ ID NO: 599648 - RNA, 18 nt, Homo sapiens
aaagaaugaugcuaugaa

SEQ ID NO: 599649 - RNA, 13 nt, Homo sapiens
aaagaauguuacu

SEQ ID NO: 599650 - RNA, 16 nt, Homo sapiens
aaagaauuccaaagca

SEQ ID NO: 599651 - RNA, 18 nt, Homo sapiens
aaagaauuccaaagcaaa

SEQ ID NO: 599652 - RNA, 17 nt, Homo sapiens
aaagaauuggacaugau

SEQ ID NO: 599653 - RNA, 22 nt, Homo sapiens
aaagaauuggccaggcauggug

SEQ ID NO: 599654 - RNA, 22 nt, Homo sapiens
aaagaauuuucagauggacaug

SEQ ID NO: 599655 - RNA, 23 nt, Homo sapiens
aaagaauuuuuuaagaacuguau

SEQ ID NO: 599656 - RNA, 20 nt, Homo sapiens
aaagacaaaacuuccuguuu

SEQ ID NO: 599657 - RNA, 12 nt, Homo sapiens
aaagacacaucu

SEQ ID NO: 599658 - RNA, 9 nt, Homo sapiens
aaagacaga

SEQ ID NO: 599659 - RNA, 21 nt, Homo sapiens
aaagacagagauaccauucaa

SEQ ID NO: 599660 - RNA, 12 nt, Homo sapiens
aaagacagugac

SEQ ID NO: 599661 - RNA, 12 nt, Homo sapiens
aaagacaugggg

SEQ ID NO: 599662 - RNA, 20 nt, Homo sapiens
aaagaccaauauucaaaugc

SEQ ID NO: 599663 - RNA, 20 nt, Homo sapiens
aaagaccaguuuccauuuau

SEQ ID NO: 599664 - RNA, 14 nt, Homo sapiens
aaagaccuaugagc

SEQ ID NO: 599665 - RNA, 21 nt, Homo sapiens
aaagaccuggccuuucacuuu

SEQ ID NO: 599666 - RNA, 22 nt, Homo sapiens
aaagaccuuuuccaugcacccu

SEQ ID NO: 599667 - RNA, 13 nt, Homo sapiens
uuucaaagcuaaa

SEQ ID NO: 599668 - RNA, 18 nt, Homo sapiens
uuucaaauuggagcuuca

SEQ ID NO: 599669 - RNA, 23 nt, Homo sapiens
uuucaacaaauggcaccgagaca

SEQ ID NO: 599670 - RNA, 18 nt, Homo sapiens
uuucaacucagaaugcac

SEQ ID NO: 599671 - RNA, 17 nt, Homo sapiens
uuucaacugugcucuug

SEQ ID NO: 599672 - RNA, 13 nt, Homo sapiens
uuucaacuugcau

SEQ ID NO: 599673 - RNA, 15 nt, Homo sapiens
uuucaagaacuauau

SEQ ID NO: 599674 - RNA, 12 nt, Homo sapiens
uuucaagagauc

SEQ ID NO: 599675 - RNA, 12 nt, Homo sapiens
uuucaagucaaa

SEQ ID NO: 599676 - RNA, 14 nt, Homo sapiens
uuucaagugcuaaa

SEQ ID NO: 599677 - RNA, 19 nt, Homo sapiens
uuucaaguguaacuuauua

SEQ ID NO: 599678 - RNA, 17 nt, Homo sapiens
uuucaauaaugugaaug

SEQ ID NO: 599679 - RNA, 15 nt, Homo sapiens
uuucaauagcacaua

SEQ ID NO: 599680 - RNA, 22 nt, Homo sapiens
uuucacaaaaaggcauaugcaa

SEQ ID NO: 599681 - RNA, 20 nt, Homo sapiens
uuucacaaaaggcaucugaa

SEQ ID NO: 599682 - RNA, 16 nt, Homo sapiens
uuucacaacauuugca

SEQ ID NO: 599683 - RNA, 16 nt, Homo sapiens
uuucacauucuuggcu

SEQ ID NO: 599684 - RNA, 19 nt, Homo sapiens
uuucaccauguuggccagg

SEQ ID NO: 599685 - RNA, 13 nt, Homo sapiens
uuucaccauuuga

SEQ ID NO: 599686 - RNA, 23 nt, Homo sapiens
uuucaccccagaggacacaggca

SEQ ID NO: 599687 - RNA, 12 nt, Homo sapiens
uuucaccugaga

SEQ ID NO: 599688 - RNA, 13 nt, Homo sapiens
uuucaccuguaaa

SEQ ID NO: 599689 - RNA, 21 nt, Homo sapiens
uuucaccuguuuuuaagcugu

SEQ ID NO: 599690 - RNA, 20 nt, Homo sapiens
uuucacgccugaggcaauua

SEQ ID NO: 599691 - RNA, 13 nt, Homo sapiens
uuucacucuuuag

SEQ ID NO: 599692 - RNA, 21 nt, Homo sapiens
uuucacuuucugucuagguua

SEQ ID NO: 599693 - RNA, 17 nt, Homo sapiens
uuucacuuugugauuau

SEQ ID NO: 599694 - RNA, 18 nt, Homo sapiens
uuucacuuuuaauuugcu

SEQ ID NO: 599695 - RNA, 14 nt, Homo sapiens
uuucagaauuuugu

SEQ ID NO: 599696 - RNA, 14 nt, Homo sapiens
uuucagacuuuaaa

SEQ ID NO: 599697 - RNA, 20 nt, Homo sapiens
uuucagagaaauacuuucag

SEQ ID NO: 599698 - RNA, 17 nt, Homo sapiens
uuucagagccagugaag

SEQ ID NO: 599699 - RNA, 18 nt, Homo sapiens
uuucagauaaacaacaaa

SEQ ID NO: 599700 - RNA, 19 nt, Homo sapiens
uuucagaugauucuauguc

SEQ ID NO: 599701 - RNA, 20 nt, Homo sapiens
uuucagauuguggaauguug

SEQ ID NO: 599702 - RNA, 22 nt, Homo sapiens
uuucaguauaauuuaacuucag

SEQ ID NO: 599703 - RNA, 23 nt, Homo sapiens
uuucaguguaugauauacuuuau

SEQ ID NO: 599704 - RNA, 11 nt, Homo sapiens
uuucaguucau

SEQ ID NO: 599705 - RNA, 18 nt, Homo sapiens
uuucauaaacuucaggga

SEQ ID NO: 599706 - RNA, 16 nt, Homo sapiens
uuucauaccacuugaa

SEQ ID NO: 599707 - RNA, 19 nt, Homo sapiens
uuucauacccaugucagau

SEQ ID NO: 599708 - RNA, 16 nt, Homo sapiens
uuucauagugcucaga

SEQ ID NO: 599709 - RNA, 15 nt, Homo sapiens
uuucaucacacuggg

SEQ ID NO: 599710 - RNA, 23 nt, Homo sapiens
uuucaucaggcucuguuccucaa

SEQ ID NO: 599711 - RNA, 14 nt, Homo sapiens
uuucaucagucaau

SEQ ID NO: 599712 - RNA, 16 nt, Homo sapiens
uuucaucccauuuccc

SEQ ID NO: 599713 - RNA, 19 nt, Homo sapiens
uuucauccugauacuguag

SEQ ID NO: 599714 - RNA, 22 nt, Homo sapiens
uuucauccugguuuccacuguc

SEQ ID NO: 599715 - RNA, 20 nt, Homo sapiens
uuucaucugggaaagacauc

SEQ ID NO: 599716 - RNA, 19 nt, Homo sapiens
uuucaucuuuugaagagca

SEQ ID NO: 599717 - RNA, 15 nt, Homo sapiens
uuucaugcuccauuu

SEQ ID NO: 599718 - RNA, 22 nt, Homo sapiens
uuucauggaaguggcagugaaa

SEQ ID NO: 599719 - RNA, 14 nt, Homo sapiens
uuucauggacacuu

SEQ ID NO: 599720 - RNA, 16 nt, Homo sapiens
uuucaugggacuaaau

SEQ ID NO: 599721 - RNA, 18 nt, Homo sapiens
uuucauuaaagaauguuu

SEQ ID NO: 599722 - RNA, 20 nt, Homo sapiens
uuucauuaaauaaauuugac

SEQ ID NO: 599723 - RNA, 11 nt, Homo sapiens
uuucauuccau

SEQ ID NO: 599724 - RNA, 17 nt, Homo sapiens
uuucauuuaauggggau

SEQ ID NO: 599725 - RNA, 15 nt, Homo sapiens
uuuccaacuacuaau

SEQ ID NO: 599726 - RNA, 22 nt, Homo sapiens
uuuccacaagauucccagagac

SEQ ID NO: 599727 - RNA, 21 nt, Homo sapiens
uuuccacaauucuucugucaa

SEQ ID NO: 599728 - RNA, 17 nt, Homo sapiens
uuuccacauuugucaca

SEQ ID NO: 599729 - RNA, 14 nt, Homo sapiens
uuuccaccaagugu

SEQ ID NO: 599730 - RNA, 18 nt, Homo sapiens
uuuccacuacugcuacca

SEQ ID NO: 599731 - RNA, 13 nt, Homo sapiens
uuuccacucugga

SEQ ID NO: 599732 - RNA, 20 nt, Homo sapiens
uuuccacuugcccuguucuc

SEQ ID NO: 599733 - RNA, 20 nt, Homo sapiens
uuuccagaacuaccaugaga

SEQ ID NO: 599734 - RNA, 15 nt, Homo sapiens
uuuccagagcagagc

SEQ ID NO: 599735 - RNA, 16 nt, Homo sapiens
uuuccaggagcauaga

SEQ ID NO: 599736 - RNA, 12 nt, Homo sapiens
uuuccaggguug

SEQ ID NO: 599737 - RNA, 17 nt, Homo sapiens
uuuccaggguugcuuga

SEQ ID NO: 599738 - RNA, 17 nt, Homo sapiens
uuuccaucagugaaaac

SEQ ID NO: 599739 - RNA, 14 nt, Homo sapiens
uuuccauccuccaa

SEQ ID NO: 599740 - RNA, 17 nt, Homo sapiens
uuuccauguugcugcca

SEQ ID NO: 599741 - RNA, 17 nt, Homo sapiens
uuuccauuauguucauc

SEQ ID NO: 599742 - RNA, 17 nt, Homo sapiens
uuuccauuuaguaacag

SEQ ID NO: 599743 - RNA, 17 nt, Homo sapiens
uuuccauuuuaaggaua

SEQ ID NO: 599744 - RNA, 15 nt, Homo sapiens
uuucccaaagcacuu

SEQ ID NO: 599745 - RNA, 18 nt, Homo sapiens
uuucccaaagccagaacc

SEQ ID NO: 599746 - RNA, 22 nt, Homo sapiens
uuucccaccaccuuggacuccu

SEQ ID NO: 599747 - RNA, 20 nt, Homo sapiens
uuucccauaagacaaugaca

SEQ ID NO: 599748 - RNA, 16 nt, Homo sapiens
uuucccauaguuuauu

SEQ ID NO: 599749 - RNA, 18 nt, Homo sapiens
uuuccccaccccagcuca

SEQ ID NO: 599750 - RNA, 15 nt, Homo sapiens
uuuccccagucccag

SEQ ID NO: 599751 - RNA, 23 nt, Homo sapiens
uuucccggggaggaaacacuuuu

SEQ ID NO: 599752 - RNA, 14 nt, Homo sapiens
uuucccuacugaac

SEQ ID NO: 599753 - RNA, 23 nt, Homo sapiens
uuucccuaggaaacucacacucc

SEQ ID NO: 599754 - RNA, 17 nt, Homo sapiens
uuucccucucccagucc

SEQ ID NO: 599755 - RNA, 22 nt, Homo sapiens
uuucccucuucccugaccuccc

SEQ ID NO: 599756 - RNA, 16 nt, Homo sapiens
uuuccuaacugugauu

SEQ ID NO: 599757 - RNA, 12 nt, Homo sapiens
uuuccuacuguc

SEQ ID NO: 599758 - RNA, 22 nt, Homo sapiens
uuuccuaucauguuaaccucug

SEQ ID NO: 599759 - RNA, 13 nt, Homo sapiens
uuuccuaugcaaa

SEQ ID NO: 599760 - RNA, 16 nt, Homo sapiens
uuuccuccccaggaau

SEQ ID NO: 599761 - RNA, 18 nt, Homo sapiens
uuuccucccuucugcuac

SEQ ID NO: 599762 - RNA, 14 nt, Homo sapiens
uuuccucugugcaa

SEQ ID NO: 599763 - RNA, 20 nt, Homo sapiens
uuuccucugugcaaagggaa

SEQ ID NO: 599764 - RNA, 21 nt, Homo sapiens
uuuccucuuccccuugcccuu

SEQ ID NO: 599765 - RNA, 15 nt, Homo sapiens
uuuccugacaauaaa

SEQ ID NO: 599766 - RNA, 19 nt, Homo sapiens
uuuccugaggguuuucuca

SEQ ID NO: 599767 - RNA, 18 nt, Homo sapiens
uuuccugcccuuccucag

SEQ ID NO: 599768 - RNA, 14 nt, Homo sapiens
uuuccugcuacuua

SEQ ID NO: 599769 - RNA, 14 nt, Homo sapiens
uuuccugcuccagu

SEQ ID NO: 599770 - RNA, 20 nt, Homo sapiens
uuuccuggucagcauguacu

SEQ ID NO: 599771 - RNA, 22 nt, Homo sapiens
uuuccuguucuauuaauacaua

SEQ ID NO: 599772 - RNA, 20 nt, Homo sapiens
uuuccuguuugaaauaucau

SEQ ID NO: 599773 - RNA, 16 nt, Homo sapiens
uuuccuuaaacugugu

SEQ ID NO: 599774 - RNA, 15 nt, Homo sapiens
uuuccuuaguuuucu

SEQ ID NO: 599775 - RNA, 15 nt, Homo sapiens
uuuccuucagguuuu

SEQ ID NO: 599776 - RNA, 11 nt, Homo sapiens
uuuccuuccau

SEQ ID NO: 599777 - RNA, 12 nt, Homo sapiens
uuuccuugcuca

SEQ ID NO: 599778 - RNA, 18 nt, Homo sapiens
uuuccuuugguccuucaa

SEQ ID NO: 599779 - RNA, 19 nt, Homo sapiens
uuuccuuuuugacacugaa

SEQ ID NO: 599780 - RNA, 13 nt, Homo sapiens
uuucgaacauucu

SEQ ID NO: 599781 - RNA, 22 nt, Homo sapiens
uuucgcaccuaccaucagggac

SEQ ID NO: 599782 - RNA, 16 nt, Homo sapiens
uuucgggauucuuuga

SEQ ID NO: 599783 - RNA, 16 nt, Homo sapiens
uuucgugcacucugcu

SEQ ID NO: 599784 - RNA, 21 nt, Homo sapiens
uuucuaaaaaggcugcucaca

SEQ ID NO: 599785 - RNA, 16 nt, Homo sapiens
uuucuaaaacugccuu

SEQ ID NO: 599786 - RNA, 14 nt, Homo sapiens
uuucuaaaccuugu

SEQ ID NO: 599787 - RNA, 14 nt, Homo sapiens
uuucuaaacuacaa

SEQ ID NO: 599788 - RNA, 20 nt, Homo sapiens
uucauagugucaagaaggaa

SEQ ID NO: 599789 - RNA, 17 nt, Homo sapiens
uucauauaccagcaaua

SEQ ID NO: 599790 - RNA, 22 nt, Homo sapiens
uucauauaggccagaguugcaa

SEQ ID NO: 599791 - RNA, 20 nt, Homo sapiens
uucauauauggacauggaaa

SEQ ID NO: 599792 - RNA, 17 nt, Homo sapiens
uucauauuugucuuuga

SEQ ID NO: 599793 - RNA, 15 nt, Homo sapiens
uucaucaggaccaaa

SEQ ID NO: 599794 - RNA, 14 nt, Homo sapiens
uucaucaugacaac

SEQ ID NO: 599795 - RNA, 13 nt, Homo sapiens
uucaucauuucag

SEQ ID NO: 599796 - RNA, 18 nt, Homo sapiens
uucauccaggacugagau

SEQ ID NO: 599797 - RNA, 21 nt, Homo sapiens
uucauccaggcccaacuguga

SEQ ID NO: 599798 - RNA, 22 nt, Homo sapiens
uucauccaguuuguucuccggg

SEQ ID NO: 599799 - RNA, 14 nt, Homo sapiens
uucaucuaauguga

SEQ ID NO: 599800 - RNA, 20 nt, Homo sapiens
uucaucugaaacccacagau

SEQ ID NO: 599801 - RNA, 21 nt, Homo sapiens
uucaucugggaaagacaucca

SEQ ID NO: 599802 - RNA, 21 nt, Homo sapiens
uucaucuuugggaaagcuuac

SEQ ID NO: 599803 - RNA, 13 nt, Homo sapiens
uucaugaaacugu

SEQ ID NO: 599804 - RNA, 15 nt, Homo sapiens
uucaugaacuuggcu

SEQ ID NO: 599805 - RNA, 19 nt, Homo sapiens
uucaugcuugacauaccua

SEQ ID NO: 599806 - RNA, 17 nt, Homo sapiens
uucaugggaaaacagac

SEQ ID NO: 599807 - RNA, 16 nt, Homo sapiens
uucauggucugcugag

SEQ ID NO: 599808 - RNA, 14 nt, Homo sapiens
uucaugucuuucca

SEQ ID NO: 599809 - RNA, 19 nt, Homo sapiens
uucauguggcucagugccu

SEQ ID NO: 599810 - RNA, 20 nt, Homo sapiens
uucauguggcucagugccuu

SEQ ID NO: 599811 - RNA, 19 nt, Homo sapiens
uucaugugguucagugccu

SEQ ID NO: 599812 - RNA, 21 nt, Homo sapiens
uucauguuggucugacaucaa

SEQ ID NO: 599813 - RNA, 17 nt, Homo sapiens
uucauuaauuaguucca

SEQ ID NO: 599814 - RNA, 23 nt, Homo sapiens
uucauuaauuaguuccaguuucu

SEQ ID NO: 599815 - RNA, 15 nt, Homo sapiens
uucauuacagcuuaa

SEQ ID NO: 599816 - RNA, 14 nt, Homo sapiens
uucauuaggcaaag

SEQ ID NO: 599817 - RNA, 21 nt, Homo sapiens
uucauuauagacaacgaugaa

SEQ ID NO: 599818 - RNA, 16 nt, Homo sapiens
uucauuaugcuuugaa

SEQ ID NO: 599819 - RNA, 20 nt, Homo sapiens
uucauuauuggaauuaaccu

SEQ ID NO: 599820 - RNA, 21 nt, Homo sapiens
uucauucccaagguuacugga

SEQ ID NO: 599821 - RNA, 23 nt, Homo sapiens
uucauuccuaacacagcaugugu

SEQ ID NO: 599822 - RNA, 16 nt, Homo sapiens
uucauucuaaaccaaa

SEQ ID NO: 599823 - RNA, 13 nt, Homo sapiens
uucauucugcaag

SEQ ID NO: 599824 - RNA, 13 nt, Homo sapiens
uucauucugcauu

SEQ ID NO: 599825 - RNA, 22 nt, Homo sapiens
uucauucugcauugcuagauaa

SEQ ID NO: 599826 - RNA, 20 nt, Homo sapiens
uucauugagcaguuagcuca

SEQ ID NO: 599827 - RNA, 19 nt, Homo sapiens
uucauugauggaugucuuc

SEQ ID NO: 599828 - RNA, 12 nt, Homo sapiens
uucauugcaaac

SEQ ID NO: 599829 - RNA, 13 nt, Homo sapiens
uucauugcacuuu

SEQ ID NO: 599830 - RNA, 16 nt, Homo sapiens
uucauuguaugaugug

SEQ ID NO: 599831 - RNA, 23 nt, Homo sapiens
uucauugugagauugcaguucug

SEQ ID NO: 599832 - RNA, 17 nt, Homo sapiens
uucauugugaucacugu

SEQ ID NO: 599833 - RNA, 15 nt, Homo sapiens
uucauuguguucucu

SEQ ID NO: 599834 - RNA, 16 nt, Homo sapiens
uucauuguuucaacuc

SEQ ID NO: 599835 - RNA, 19 nt, Homo sapiens
uucauuucagauaaacaac

SEQ ID NO: 599836 - RNA, 23 nt, Homo sapiens
uucauuucagauaaacaacaaau

SEQ ID NO: 599837 - RNA, 15 nt, Homo sapiens
uucauuugcuugcaa

SEQ ID NO: 599838 - RNA, 15 nt, Homo sapiens
uucauuuguaacuuu

SEQ ID NO: 599839 - RNA, 22 nt, Homo sapiens
uucauuugugcaccaauuauca

SEQ ID NO: 599840 - RNA, 21 nt, Homo sapiens
uucauuuucucaaagggcaua

SEQ ID NO: 599841 - RNA, 17 nt, Homo sapiens
uucauuuugagaucaag

SEQ ID NO: 599842 - RNA, 15 nt, Homo sapiens
uuccaaaacuuuaau

SEQ ID NO: 599843 - RNA, 23 nt, Homo sapiens
uuccaaaacuuuaaugaacuaac

SEQ ID NO: 599844 - RNA, 16 nt, Homo sapiens
uuccaaacacauacag

SEQ ID NO: 599845 - RNA, 12 nt, Homo sapiens
uuccaaacacca

SEQ ID NO: 599846 - RNA, 21 nt, Homo sapiens
uuccaaaccugacagauguca

SEQ ID NO: 599847 - RNA, 19 nt, Homo sapiens
uuccaaagcagccugugaa

SEQ ID NO: 599848 - RNA, 16 nt, Homo sapiens
uuccaaauaacaucaa

SEQ ID NO: 599849 - RNA, 14 nt, Homo sapiens
uuccaaauacccaa

SEQ ID NO: 599850 - RNA, 14 nt, Homo sapiens
uuccaaauucacaa

SEQ ID NO: 599851 - RNA, 12 nt, Homo sapiens
uuccaaauucau

SEQ ID NO: 599852 - RNA, 21 nt, Homo sapiens
uuccaaauugcccuaugcugu

SEQ ID NO: 599853 - RNA, 23 nt, Homo sapiens
uuccaacaauggggugggcccau

SEQ ID NO: 599854 - RNA, 14 nt, Homo sapiens
uuccaacaccacag

SEQ ID NO: 599855 - RNA, 21 nt, Homo sapiens
uuccaacucgaaucuguguga

SEQ ID NO: 599856 - RNA, 22 nt, Homo sapiens
uuccaagacugaagacugcaca

SEQ ID NO: 599857 - RNA, 15 nt, Homo sapiens
uuccaagcuccuuau

SEQ ID NO: 599858 - RNA, 14 nt, Homo sapiens
uuccaagugccaau

SEQ ID NO: 599859 - RNA, 18 nt, Homo sapiens
uuccaagugcuacucuca

SEQ ID NO: 599860 - RNA, 14 nt, Homo sapiens
uuccaauuuacaua

SEQ ID NO: 599861 - RNA, 11 nt, Homo sapiens
uuccacaaaau

SEQ ID NO: 599862 - RNA, 19 nt, Homo sapiens
uuccacaaagaaaauuccu

SEQ ID NO: 599863 - RNA, 17 nt, Homo sapiens
uuccacaagagugaauu

SEQ ID NO: 599864 - RNA, 15 nt, Homo sapiens
uuccacagauuauca

SEQ ID NO: 599865 - RNA, 16 nt, Homo sapiens
uuccacagauuaucaa

SEQ ID NO: 599866 - RNA, 16 nt, Homo sapiens
uuccacagcugcucaa

SEQ ID NO: 599867 - RNA, 12 nt, Homo sapiens
uuccacauguac

SEQ ID NO: 599868 - RNA, 20 nt, Homo sapiens
uuccaccaagacagugcuga

SEQ ID NO: 599869 - RNA, 19 nt, Homo sapiens
uuccaccaggccgugccuu

SEQ ID NO: 599870 - RNA, 17 nt, Homo sapiens
uuccaccuccaccacau

SEQ ID NO: 599871 - RNA, 11 nt, Homo sapiens
uuccacuccac

SEQ ID NO: 599872 - RNA, 23 nt, Homo sapiens
uuccacucccuuugccagugccu

SEQ ID NO: 599873 - RNA, 13 nt, Homo sapiens
uuccacugaaaau

SEQ ID NO: 599874 - RNA, 10 nt, Homo sapiens
uuccacugag

SEQ ID NO: 599875 - RNA, 20 nt, Homo sapiens
uuccacuggaaaaguguaau

SEQ ID NO: 599876 - RNA, 17 nt, Homo sapiens
uuccacuuguguauauu

SEQ ID NO: 599877 - RNA, 18 nt, Homo sapiens
uuccacuuugaguaccaa

SEQ ID NO: 599878 - RNA, 22 nt, Homo sapiens
uuccagaagaagagaagcugcu

SEQ ID NO: 599879 - RNA, 14 nt, Homo sapiens
uuccagaagaucug

SEQ ID NO: 599880 - RNA, 13 nt, Homo sapiens
uuccagacauucu

SEQ ID NO: 599881 - RNA, 13 nt, Homo sapiens
uuccagacugcuu

SEQ ID NO: 599882 - RNA, 19 nt, Homo sapiens
uuccagacuuccuugagac

SEQ ID NO: 599883 - RNA, 17 nt, Homo sapiens
uuccagaguccuccuuu

SEQ ID NO: 599884 - RNA, 15 nt, Homo sapiens
uuccagaugagucag

SEQ ID NO: 599885 - RNA, 16 nt, Homo sapiens
uuccagccuaucuaau

SEQ ID NO: 599886 - RNA, 16 nt, Homo sapiens
uuccagcuccuguaac

SEQ ID NO: 599887 - RNA, 17 nt, Homo sapiens
uuccaggcgaugugcaa

SEQ ID NO: 599888 - RNA, 19 nt, Homo sapiens
uuccagggucaaaguacag

SEQ ID NO: 599889 - RNA, 22 nt, Homo sapiens
uuccagguccaaacccuucaac

SEQ ID NO: 599890 - RNA, 14 nt, Homo sapiens
uuccaguaaucuga

SEQ ID NO: 599891 - RNA, 22 nt, Homo sapiens
uuccaguguccuuagaacauuu

SEQ ID NO: 599892 - RNA, 12 nt, Homo sapiens
uuccaguguuug

SEQ ID NO: 599893 - RNA, 22 nt, Homo sapiens
uuccaguuccucuuuugugcug

SEQ ID NO: 599894 - RNA, 20 nt, Homo sapiens
uuccauaguguuaacuguca

SEQ ID NO: 599895 - RNA, 17 nt, Homo sapiens
uuccauauguuauauca

SEQ ID NO: 599896 - RNA, 17 nt, Homo sapiens
uuccauauuaguuuuac

SEQ ID NO: 599897 - RNA, 23 nt, Homo sapiens
uuccauauuuauacagcagagaa

SEQ ID NO: 599898 - RNA, 14 nt, Homo sapiens
uuccaucagcccau

SEQ ID NO: 599899 - RNA, 14 nt, Homo sapiens
uuccaucugcaucu

SEQ ID NO: 599900 - RNA, 13 nt, Homo sapiens
uuccaucuuguaa

SEQ ID NO: 599901 - RNA, 15 nt, Homo sapiens
uuccaugaagaccac

SEQ ID NO: 599902 - RNA, 16 nt, Homo sapiens
uuccaugaguuaucau

SEQ ID NO: 599903 - RNA, 17 nt, Homo sapiens
uuccauguugcugccaa

SEQ ID NO: 599904 - RNA, 15 nt, Homo sapiens
uuccauuaacagcaa

SEQ ID NO: 599905 - RNA, 21 nt, Homo sapiens
uuccauuaaguacaugugcca

SEQ ID NO: 599906 - RNA, 21 nt, Homo sapiens
uuccauuuauucuuugaucuu

SEQ ID NO: 599907 - RNA, 20 nt, Homo sapiens
uuccauuucuggacaugacg

SEQ ID NO: 599908 - RNA, 20 nt, Homo sapiens
uuccauuugugugugugcaa

SEQ ID NO: 599909 - RNA, 18 nt, Homo sapiens
uucccaagcgucaucugu

SEQ ID NO: 599910 - RNA, 13 nt, Homo sapiens
uuaguugcaugac

SEQ ID NO: 599911 - RNA, 22 nt, Homo sapiens
uuaguuuauauuacucucauuc

SEQ ID NO: 599912 - RNA, 11 nt, Homo sapiens
uuaguuucaug

SEQ ID NO: 599913 - RNA, 18 nt, Homo sapiens
uuaguuuucuaguaacua

SEQ ID NO: 599914 - RNA, 15 nt, Homo sapiens
uuaguuuuugaucaa

SEQ ID NO: 599915 - RNA, 19 nt, Homo sapiens
uuaugugugaggagcugcu

SEQ ID NO: 599916 - RNA, 14 nt, Homo sapiens
uuaugugugccuuu

SEQ ID NO: 599917 - RNA, 13 nt, Homo sapiens
uuauguucaguca

SEQ ID NO: 599918 - RNA, 13 nt, Homo sapiens
uuauguuugccac

SEQ ID NO: 599919 - RNA, 17 nt, Homo sapiens
uucaauugcaucuccca

SEQ ID NO: 599920 - RNA, 18 nt, Homo sapiens
uucaauuguaaauugaau

SEQ ID NO: 599921 - RNA, 23 nt, Homo sapiens
uucaauuuggacuggugugcucu

SEQ ID NO: 599922 - RNA, 20 nt, Homo sapiens
uucacaaaaaggcauaugca

SEQ ID NO: 599923 - RNA, 23 nt, Homo sapiens
uucacaaaaaggcauaugcaaua

SEQ ID NO: 599924 - RNA, 15 nt, Homo sapiens
uucacaaacugugaa

SEQ ID NO: 599925 - RNA, 16 nt, Homo sapiens
uucacaaccucaccaa

SEQ ID NO: 599926 - RNA, 23 nt, Homo sapiens
uucacaagccuccuguaccucag

SEQ ID NO: 599927 - RNA, 20 nt, Homo sapiens
uucacacagggcucuuugau

SEQ ID NO: 599928 - RNA, 18 nt, Homo sapiens
uucacacaguaaagcagg

SEQ ID NO: 599929 - RNA, 16 nt, Homo sapiens
uucacagaauagcaca

SEQ ID NO: 599930 - RNA, 17 nt, Homo sapiens
uucacagaggucuuuca

SEQ ID NO: 599931 - RNA, 16 nt, Homo sapiens
uucacagauuguucua

SEQ ID NO: 599932 - RNA, 21 nt, Homo sapiens
uucacaggcagugcaugugaa

SEQ ID NO: 599933 - RNA, 18 nt, Homo sapiens
uucacauaaaaccucauu

SEQ ID NO: 599934 - RNA, 15 nt, Homo sapiens
uucacauaugacaau

SEQ ID NO: 599935 - RNA, 13 nt, Homo sapiens
uucacauuuugcc

SEQ ID NO: 599936 - RNA, 21 nt, Homo sapiens
uucaccaaaauagucuucuca

SEQ ID NO: 599937 - RNA, 22 nt, Homo sapiens
uucaccaaaucuugguugaugc

SEQ ID NO: 599938 - RNA, 23 nt, Homo sapiens
uucaccaacaugcccacagauca

SEQ ID NO: 599939 - RNA, 13 nt, Homo sapiens
uucaccacuccuc

SEQ ID NO: 599940 - RNA, 20 nt, Homo sapiens
uucaccccacucagcucacc

SEQ ID NO: 599941 - RNA, 20 nt, Homo sapiens
uucaccccuacacugugaag

SEQ ID NO: 599942 - RNA, 17 nt, Homo sapiens
uucacccuuaacccaag

SEQ ID NO: 599943 - RNA, 19 nt, Homo sapiens
uucaccuaagucucuguga

SEQ ID NO: 599944 - RNA, 22 nt, Homo sapiens
uucaccuaagucucugugaauu

SEQ ID NO: 599945 - RNA, 17 nt, Homo sapiens
uucaccuagcaacauau

SEQ ID NO: 599946 - RNA, 22 nt, Homo sapiens
uucaccuccagguucaagugau

SEQ ID NO: 599947 - RNA, 23 nt, Homo sapiens
uucaccuccagguucaagugauu

SEQ ID NO: 599948 - RNA, 14 nt, Homo sapiens
uucaccucuaucca

SEQ ID NO: 599949 - RNA, 14 nt, Homo sapiens
uucaccugaaucau

SEQ ID NO: 599950 - RNA, 11 nt, Homo sapiens
uucaccuguaa

SEQ ID NO: 599951 - RNA, 17 nt, Homo sapiens
uucacgaacaugggcau

SEQ ID NO: 599952 - RNA, 20 nt, Homo sapiens
uucacgaaguguugcaugga

SEQ ID NO: 599953 - RNA, 17 nt, Homo sapiens
uucacggugacacaggu

SEQ ID NO: 599954 - RNA, 12 nt, Homo sapiens
uucacuacaggu

SEQ ID NO: 599955 - RNA, 19 nt, Homo sapiens
uucacuagaguucuuugaa

SEQ ID NO: 599956 - RNA, 16 nt, Homo sapiens
uucacuaggaggucau

SEQ ID NO: 599957 - RNA, 20 nt, Homo sapiens
uucacuccagccugggugac

SEQ ID NO: 599958 - RNA, 13 nt, Homo sapiens
uucacucugucau

SEQ ID NO: 599959 - RNA, 14 nt, Homo sapiens
uucacugagcaugu

SEQ ID NO: 599960 - RNA, 13 nt, Homo sapiens
uucacugaugcuu

SEQ ID NO: 599961 - RNA, 11 nt, Homo sapiens
uucacugcugc

SEQ ID NO: 599962 - RNA, 12 nt, Homo sapiens
uucacuggccac

SEQ ID NO: 599963 - RNA, 15 nt, Homo sapiens
uucacugguguacau

SEQ ID NO: 599964 - RNA, 15 nt, Homo sapiens
uucacuguacugcau

SEQ ID NO: 599965 - RNA, 19 nt, Homo sapiens
uucacuguacugcauguga

SEQ ID NO: 599966 - RNA, 14 nt, Homo sapiens
uucacuguugaaaa

SEQ ID NO: 599967 - RNA, 14 nt, Homo sapiens
uucacuuauugacu

SEQ ID NO: 599968 - RNA, 16 nt, Homo sapiens
uucacuuauugacuau

SEQ ID NO: 599969 - RNA, 10 nt, Homo sapiens
uucacuuuga

SEQ ID NO: 599970 - RNA, 15 nt, Homo sapiens
uucacuuuugacaaa

SEQ ID NO: 599971 - RNA, 23 nt, Homo sapiens
uucacuuuuggcaaugacucaaa

SEQ ID NO: 599972 - RNA, 17 nt, Homo sapiens
uucagaaaacuucaaga

SEQ ID NO: 599973 - RNA, 20 nt, Homo sapiens
uucagaaaagaugugcagau

SEQ ID NO: 599974 - RNA, 13 nt, Homo sapiens
uucagaaagacag

SEQ ID NO: 599975 - RNA, 14 nt, Homo sapiens
uucagaaagcaaua

SEQ ID NO: 599976 - RNA, 20 nt, Homo sapiens
uucagaacagaggcauuuaa

SEQ ID NO: 599977 - RNA, 18 nt, Homo sapiens
uucagaagaaaaagaagc

SEQ ID NO: 599978 - RNA, 24 nt, Homo sapiens
uucagaagcuagugaccaucuuca

SEQ ID NO: 599979 - RNA, 14 nt, Homo sapiens
uucagacaaaaugg

SEQ ID NO: 599980 - RNA, 14 nt, Homo sapiens
uucagacacuuugg

SEQ ID NO: 599981 - RNA, 13 nt, Homo sapiens
uucagagcacuca

SEQ ID NO: 599982 - RNA, 16 nt, Homo sapiens
uucagaggauaaauau

SEQ ID NO: 599983 - RNA, 14 nt, Homo sapiens
uucagaggcagcac

SEQ ID NO: 599984 - RNA, 12 nt, Homo sapiens
uucagaguauau

SEQ ID NO: 599985 - RNA, 13 nt, Homo sapiens
uucagaguccuca

SEQ ID NO: 599986 - RNA, 18 nt, Homo sapiens
uucagaguccuugcaaaa

SEQ ID NO: 599987 - RNA, 23 nt, Homo sapiens
uucagaguugcuuuaaaguaccu

SEQ ID NO: 599988 - RNA, 23 nt, Homo sapiens
uucagauaauugaauaaguaccu

SEQ ID NO: 599989 - RNA, 17 nt, Homo sapiens
uucagauacaaacugca

SEQ ID NO: 599990 - RNA, 19 nt, Homo sapiens
uucagauauuauugcuuua

SEQ ID NO: 599991 - RNA, 19 nt, Homo sapiens
uucagaucauauuucacaa

SEQ ID NO: 599992 - RNA, 20 nt, Homo sapiens
uucagaucgaaauuggacug

SEQ ID NO: 599993 - RNA, 20 nt, Homo sapiens
uucagaugcuguuaguaccu

SEQ ID NO: 599994 - RNA, 18 nt, Homo sapiens
uucagauggcaauuucac

SEQ ID NO: 599995 - RNA, 18 nt, Homo sapiens
uucagauuugccauucaa

SEQ ID NO: 599996 - RNA, 14 nt, Homo sapiens
uucagcacauucca

SEQ ID NO: 599997 - RNA, 16 nt, Homo sapiens
uucagcagacuaugaa

SEQ ID NO: 599998 - RNA, 19 nt, Homo sapiens
uucagcagacuaugaauau

SEQ ID NO: 599999 - RNA, 14 nt, Homo sapiens
uucagcauugccua

SEQ ID NO: 600000 - RNA, 13 nt, Homo sapiens
uucagccaugaua

SEQ ID NO: 600001 - RNA, 15 nt, Homo sapiens
uucagcuccuuccac

SEQ ID NO: 600002 - RNA, 13 nt, Homo sapiens
uucagcucugaaa

SEQ ID NO: 600003 - RNA, 13 nt, Homo sapiens
uucagcucuuaaa

SEQ ID NO: 600004 - RNA, 13 nt, Homo sapiens
uucagcucuugcu

SEQ ID NO: 600005 - RNA, 19 nt, Homo sapiens
uucagcuucuaugcauuaa

SEQ ID NO: 600006 - RNA, 19 nt, Homo sapiens
uucaggaaaauguauugau

SEQ ID NO: 600007 - RNA, 17 nt, Homo sapiens
uucaggaagaugaaaga

SEQ ID NO: 600008 - RNA, 17 nt, Homo sapiens
uucaggaauacuuggac

SEQ ID NO: 600009 - RNA, 16 nt, Homo sapiens
uucaggacucuaccuc

SEQ ID NO: 600010 - RNA, 18 nt, Homo sapiens
uucaggagcgcaagauag

SEQ ID NO: 600011 - RNA, 19 nt, Homo sapiens
uucaggaggaauacugaac

SEQ ID NO: 600012 - RNA, 14 nt, Homo sapiens
uucaggagugcaag

SEQ ID NO: 600013 - RNA, 14 nt, Homo sapiens
uucaggauacaugu

SEQ ID NO: 600014 - RNA, 18 nt, Homo sapiens
uucagggccagggcucca

SEQ ID NO: 600015 - RNA, 18 nt, Homo sapiens
uucagguaauacaaacua

SEQ ID NO: 600016 - RNA, 18 nt, Homo sapiens
uucagguacuaaauaccu

SEQ ID NO: 600017 - RNA, 13 nt, Homo sapiens
uucaggugcuuuu

SEQ ID NO: 600018 - RNA, 12 nt, Homo sapiens
uucagguuucca

SEQ ID NO: 600019 - RNA, 21 nt, Homo sapiens
uucaguagaauuaccauuaau

SEQ ID NO: 600020 - RNA, 20 nt, Homo sapiens
uucaguagaauuuuaguccu

SEQ ID NO: 600021 - RNA, 11 nt, Homo sapiens
uucaguaggau

SEQ ID NO: 600022 - RNA, 13 nt, Homo sapiens
uucaguauacugu

SEQ ID NO: 600023 - RNA, 15 nt, Homo sapiens
uucagucuucugacu

SEQ ID NO: 600024 - RNA, 23 nt, Homo sapiens
uucagucuuguagugugugcuua

SEQ ID NO: 600025 - RNA, 19 nt, Homo sapiens
uucagugaaauuuucaggu

SEQ ID NO: 600026 - RNA, 14 nt, Homo sapiens
uucagugcaguuuc

SEQ ID NO: 600027 - RNA, 23 nt, Homo sapiens
uucagugcaguuucuuuucacau

SEQ ID NO: 600028 - RNA, 13 nt, Homo sapiens
uucagugcaucau

SEQ ID NO: 600029 - RNA, 20 nt, Homo sapiens
uucagugcuuuuacuaucug

SEQ ID NO: 600030 - RNA, 21 nt, Homo sapiens
uucagugucgggaauuuuccc

SEQ ID NO: 600031 - RNA, 13 nt, Homo sapiens
uucaguuccaaga

SEQ ID NO: 600032 - RNA, 23 nt, Homo sapiens
uucaguucccaccaucugauuaa

SEQ ID NO: 600033 - RNA, 13 nt, Homo sapiens
uucaguugccaag

SEQ ID NO: 600034 - RNA, 21 nt, Homo sapiens
uucaguugcuuugcccaagau

SEQ ID NO: 600035 - RNA, 14 nt, Homo sapiens
uucaguuucacaga

SEQ ID NO: 600036 - RNA, 22 nt, Homo sapiens
uucaguuucuucugcgccucag

SEQ ID NO: 600037 - RNA, 13 nt, Homo sapiens
uucauacaacaga

SEQ ID NO: 600038 - RNA, 19 nt, Homo sapiens
uucauacgcaucccaucuc

SEQ ID NO: 600039 - RNA, 13 nt, Homo sapiens
uucauacugugaa

SEQ ID NO: 600040 - RNA, 15 nt, Homo sapiens
uucauagaaaccucu

SEQ ID NO: 600041 - RNA, 15 nt, Homo sapiens
uguggcaaagcucac

SEQ ID NO: 600042 - RNA, 14 nt, Homo sapiens
uguggcaacugaga

SEQ ID NO: 600043 - RNA, 15 nt, Homo sapiens
uguggcaaugggauu

SEQ ID NO: 600044 - RNA, 12 nt, Homo sapiens
uguggcacucca

SEQ ID NO: 600045 - RNA, 14 nt, Homo sapiens
uguggcagccacac

SEQ ID NO: 600046 - RNA, 21 nt, Homo sapiens
uguggcauaaauuacagucau

SEQ ID NO: 600047 - RNA, 22 nt, Homo sapiens
uguggcauaaauuacagucauc

SEQ ID NO: 600048 - RNA, 20 nt, Homo sapiens
uguggcauuuccaaacaucc

SEQ ID NO: 600049 - RNA, 11 nt, Homo sapiens
uguggccacaa

SEQ ID NO: 600050 - RNA, 19 nt, Homo sapiens
uguggcccagggaagccaa

SEQ ID NO: 600051 - RNA, 16 nt, Homo sapiens
uguggcucacgugugu

SEQ ID NO: 600052 - RNA, 18 nt, Homo sapiens
uguggcuggaagauccug

SEQ ID NO: 600053 - RNA, 18 nt, Homo sapiens
uguggcuuuuaugcuuuc

SEQ ID NO: 600054 - RNA, 19 nt, Homo sapiens
ugugggaaugcggcaagaa

SEQ ID NO: 600055 - RNA, 20 nt, Homo sapiens
ugugggaaugcggcaagaag

SEQ ID NO: 600056 - RNA, 16 nt, Homo sapiens
uuacuaagcauagcaa

SEQ ID NO: 600057 - RNA, 21 nt, Homo sapiens
uuacuaagcuuugccagcugc

SEQ ID NO: 600058 - RNA, 22 nt, Homo sapiens
uuacuaaugugccccaugucca

SEQ ID NO: 600059 - RNA, 17 nt, Homo sapiens
uuacuaauuauacuacu

SEQ ID NO: 600060 - RNA, 14 nt, Homo sapiens
uuacuacauuucca

SEQ ID NO: 600061 - RNA, 16 nt, Homo sapiens
uuacuacuauuaaggu

SEQ ID NO: 600062 - RNA, 15 nt, Homo sapiens
uuacuauaaacauuu

SEQ ID NO: 600063 - RNA, 23 nt, Homo sapiens
uuacuauucacugaugcagaaag

SEQ ID NO: 600064 - RNA, 13 nt, Homo sapiens
uuacuauugcaaa

SEQ ID NO: 600065 - RNA, 18 nt, Homo sapiens
uuacuauuucacaacagc

SEQ ID NO: 600066 - RNA, 23 nt, Homo sapiens
uuacucacaccuguaaucccagc

SEQ ID NO: 600067 - RNA, 17 nt, Homo sapiens
uuacucagguuugagaa

SEQ ID NO: 600068 - RNA, 12 nt, Homo sapiens
uuacuccagugg

SEQ ID NO: 600069 - RNA, 21 nt, Homo sapiens
uuacugaaagaaaaagaccua

SEQ ID NO: 600070 - RNA, 12 nt, Homo sapiens
uuacugaaucuu

SEQ ID NO: 600071 - RNA, 17 nt, Homo sapiens
uuacugagcaguaggua

SEQ ID NO: 600072 - RNA, 17 nt, Homo sapiens
uuacuggacaaagaauu

SEQ ID NO: 600073 - RNA, 21 nt, Homo sapiens
uuacuguauauaaacuccuua

SEQ ID NO: 600074 - RNA, 20 nt, Homo sapiens
uuacuguugcuuuagucacu

SEQ ID NO: 600075 - RNA, 13 nt, Homo sapiens
uuacuguuuuuga

SEQ ID NO: 600076 - RNA, 16 nt, Homo sapiens
uuacuguuuuugauaa

SEQ ID NO: 600077 - RNA, 22 nt, Homo sapiens
uuacuuuagauggcaagcaugu

SEQ ID NO: 600078 - RNA, 16 nt, Homo sapiens
uuacuuuuaccacuau

SEQ ID NO: 600079 - RNA, 16 nt, Homo sapiens
uuacuuuucacacugu

SEQ ID NO: 600080 - RNA, 19 nt, Homo sapiens
uuacuuuuuugguacuaua

SEQ ID NO: 600081 - RNA, 19 nt, Homo sapiens
uuagaaaaaccaccaccau

SEQ ID NO: 600082 - RNA, 18 nt, Homo sapiens
uuagaaaaauagcuguga

SEQ ID NO: 600083 - RNA, 21 nt, Homo sapiens
uuagaaacugauuucuucaga

SEQ ID NO: 600084 - RNA, 17 nt, Homo sapiens
uuagaaauucagcauuu

SEQ ID NO: 600085 - RNA, 19 nt, Homo sapiens
uuagaacacacacacuuac

SEQ ID NO: 600086 - RNA, 12 nt, Homo sapiens
uuagaacaggga

SEQ ID NO: 600087 - RNA, 15 nt, Homo sapiens
uuagaacauucacuu

SEQ ID NO: 600088 - RNA, 20 nt, Homo sapiens
uuagaacugucaagauguca

SEQ ID NO: 600089 - RNA, 21 nt, Homo sapiens
uuagaacuucuacagaagcca

SEQ ID NO: 600090 - RNA, 23 nt, Homo sapiens
uuagaauauccaugaccuaguuu

SEQ ID NO: 600091 - RNA, 13 nt, Homo sapiens
uuagaauaucuaa

SEQ ID NO: 600092 - RNA, 13 nt, Homo sapiens
uuagaaugugauu

SEQ ID NO: 600093 - RNA, 15 nt, Homo sapiens
uuagaauuauaucac

SEQ ID NO: 600094 - RNA, 14 nt, Homo sapiens
uuagacauaacaaa

SEQ ID NO: 600095 - RNA, 16 nt, Homo sapiens
uuagacccgguccugc

SEQ ID NO: 600096 - RNA, 12 nt, Homo sapiens
uuagacuugaaa

SEQ ID NO: 600097 - RNA, 13 nt, Homo sapiens
uuagagaaaugca

SEQ ID NO: 600098 - RNA, 17 nt, Homo sapiens
uuagagaaugcuugaau

SEQ ID NO: 600099 - RNA, 20 nt, Homo sapiens
uuagagagcaucugcaacaa

SEQ ID NO: 600100 - RNA, 16 nt, Homo sapiens
uuagagcugagcacuu

SEQ ID NO: 600101 - RNA, 20 nt, Homo sapiens
uuagagcugagcacuuuuga

SEQ ID NO: 600102 - RNA, 13 nt, Homo sapiens
uuagagcugggaa

SEQ ID NO: 600103 - RNA, 22 nt, Homo sapiens
uuagaguugcucuacaaugaca

SEQ ID NO: 600104 - RNA, 22 nt, Homo sapiens
uuagauacagagacuuggggaa

SEQ ID NO: 600105 - RNA, 13 nt, Homo sapiens
uuagauacuaaua

SEQ ID NO: 600106 - RNA, 19 nt, Homo sapiens
uuagauaugauaccaaaga

SEQ ID NO: 600107 - RNA, 17 nt, Homo sapiens
uuagauauguuaagcau

SEQ ID NO: 600108 - RNA, 20 nt, Homo sapiens
uuagauauuaggggggaaag

SEQ ID NO: 600109 - RNA, 12 nt, Homo sapiens
uuagaugugcaa

SEQ ID NO: 600110 - RNA, 19 nt, Homo sapiens
uuagaugugcaaccugugg

SEQ ID NO: 600111 - RNA, 23 nt, Homo sapiens
uuagauguucuaagucuuuccau

SEQ ID NO: 600112 - RNA, 17 nt, Homo sapiens
uuagauuagcucuggac

SEQ ID NO: 600113 - RNA, 15 nt, Homo sapiens
uuagauucacuuuga

SEQ ID NO: 600114 - RNA, 20 nt, Homo sapiens
uuagcaagcaacugagauuu

SEQ ID NO: 600115 - RNA, 13 nt, Homo sapiens
uuagcaauacugg

SEQ ID NO: 600116 - RNA, 15 nt, Homo sapiens
uuagcauuuugcuaa

SEQ ID NO: 600117 - RNA, 19 nt, Homo sapiens
uuagccaaucuuucuagau

SEQ ID NO: 600118 - RNA, 15 nt, Homo sapiens
uuagcccaaaaccaa

SEQ ID NO: 600119 - RNA, 15 nt, Homo sapiens
uuagccccagggauc

SEQ ID NO: 600120 - RNA, 19 nt, Homo sapiens
uuagccugcaaacaacauu

SEQ ID NO: 600121 - RNA, 16 nt, Homo sapiens
uuagcgucaagacauu

SEQ ID NO: 600122 - RNA, 13 nt, Homo sapiens
uuagcguggguua

SEQ ID NO: 600123 - RNA, 13 nt, Homo sapiens
uuagcuaccucac

SEQ ID NO: 600124 - RNA, 12 nt, Homo sapiens
uuagcucugaag

SEQ ID NO: 600125 - RNA, 18 nt, Homo sapiens
uuagcugucucagagaua

SEQ ID NO: 600126 - RNA, 12 nt, Homo sapiens
uuagcuuuacaa

SEQ ID NO: 600127 - RNA, 17 nt, Homo sapiens
uuaggaaaggagaucaa

SEQ ID NO: 600128 - RNA, 16 nt, Homo sapiens
uuaggaaggccuucag

SEQ ID NO: 600129 - RNA, 21 nt, Homo sapiens
uuaggaccaauaccuccucca

SEQ ID NO: 600130 - RNA, 14 nt, Homo sapiens
uuaggagaaaccag

SEQ ID NO: 600131 - RNA, 23 nt, Homo sapiens
uuaggaggcugcaugcucuggaa

SEQ ID NO: 600132 - RNA, 17 nt, Homo sapiens
uuaggaguaacuuucaa

SEQ ID NO: 600133 - RNA, 16 nt, Homo sapiens
uuaggauaauacauaa

SEQ ID NO: 600134 - RNA, 16 nt, Homo sapiens
uuaggauuugugguaa

SEQ ID NO: 600135 - RNA, 23 nt, Homo sapiens
uuaggauuuucacauucuuggcu

SEQ ID NO: 600136 - RNA, 15 nt, Homo sapiens
uuaggcacugaggga

SEQ ID NO: 600137 - RNA, 20 nt, Homo sapiens
uuaggccuccggaugacugc

SEQ ID NO: 600138 - RNA, 15 nt, Homo sapiens
uuagggacacuuuca

SEQ ID NO: 600139 - RNA, 22 nt, Homo sapiens
uuagggggagcccuggugcuac

SEQ ID NO: 600140 - RNA, 21 nt, Homo sapiens
uuaggucaguuuagcaagaac

SEQ ID NO: 600141 - RNA, 18 nt, Homo sapiens
uuagguugaaacauaucu

SEQ ID NO: 600142 - RNA, 22 nt, Homo sapiens
uuagguuuuuuuuuuuuuuaac

SEQ ID NO: 600143 - RNA, 20 nt, Homo sapiens
uuaguacacagcaccagaau

SEQ ID NO: 600144 - RNA, 18 nt, Homo sapiens
uuaguaccucaaaguaaa

SEQ ID NO: 600145 - RNA, 21 nt, Homo sapiens
uuaguagaaacgggguuucac

SEQ ID NO: 600146 - RNA, 21 nt, Homo sapiens
uuaguagagacgggguuucac

SEQ ID NO: 600147 - RNA, 14 nt, Homo sapiens
uuaguauagcuuua

SEQ ID NO: 600148 - RNA, 17 nt, Homo sapiens
uuaguauugcagccaaa

SEQ ID NO: 600149 - RNA, 11 nt, Homo sapiens
uuaguauuuau

SEQ ID NO: 600150 - RNA, 17 nt, Homo sapiens
uuaguccaauuccuugc

SEQ ID NO: 600151 - RNA, 16 nt, Homo sapiens
uuaguccccacccaaa

SEQ ID NO: 600152 - RNA, 22 nt, Homo sapiens
uuagucccgauaggguauuuga

SEQ ID NO: 600153 - RNA, 13 nt, Homo sapiens
uuagucucuggaa

SEQ ID NO: 600154 - RNA, 22 nt, Homo sapiens
uuagucucuggaaaaagacuga

SEQ ID NO: 600155 - RNA, 19 nt, Homo sapiens
uuagucuuaauguacacau

SEQ ID NO: 600156 - RNA, 19 nt, Homo sapiens
uuagugaccauuauucaca

SEQ ID NO: 600157 - RNA, 13 nt, Homo sapiens
uuagugacuucaa

SEQ ID NO: 600158 - RNA, 13 nt, Homo sapiens
uuagugaguauaa

SEQ ID NO: 600159 - RNA, 15 nt, Homo sapiens
uuagugaugcaguua

SEQ ID NO: 600160 - RNA, 18 nt, Homo sapiens
uuagugcacaagcacuau

SEQ ID NO: 600161 - RNA, 18 nt, Homo sapiens
uuaguggauggaauauca

SEQ ID NO: 600162 - RNA, 18 nt, Homo sapiens
uuaguggauuacugccau

SEQ ID NO: 600163 - RNA, 18 nt, Homo sapiens
uuagugucucauguggaa

SEQ ID NO: 600164 - RNA, 13 nt, Homo sapiens
uuagugugccuuc

SEQ ID NO: 600165 - RNA, 19 nt, Homo sapiens
uuagugugugugcaugugu

SEQ ID NO: 600166 - RNA, 23 nt, Homo sapiens
uuaguguucuguuugaaacuaau

SEQ ID NO: 600167 - RNA, 13 nt, Homo sapiens
uuaguguugugga

SEQ ID NO: 600168 - RNA, 19 nt, Homo sapiens
uuaguuaaaacacauauca

SEQ ID NO: 600169 - RNA, 13 nt, Homo sapiens
uuaguuaaucucc

SEQ ID NO: 600170 - RNA, 16 nt, Homo sapiens
uuaguuccacugagac

SEQ ID NO: 600171 - RNA, 22 nt, Homo sapiens
uuaguucugguugauucacuca

SEQ ID NO: 600172 - RNA, 18 nt, Homo sapiens
uuaguugaggccuucuag

SEQ ID NO: 600173 - RNA, 22 nt, Homo sapiens
ugucuuccacagccgccugaaa

SEQ ID NO: 600174 - RNA, 13 nt, Homo sapiens
ugucuuccacuuu

SEQ ID NO: 600175 - RNA, 21 nt, Homo sapiens
ugucuucugcuguucuucacu

SEQ ID NO: 600176 - RNA, 22 nt, Homo sapiens
ugucuuguccccucuugaccca

SEQ ID NO: 600177 - RNA, 17 nt, Homo sapiens
ugucuuuaauuucagga

SEQ ID NO: 600178 - RNA, 20 nt, Homo sapiens
ugucuuuggcagucugucau

SEQ ID NO: 600179 - RNA, 18 nt, Homo sapiens
ugucuuuucuuccacugc

SEQ ID NO: 600180 - RNA, 15 nt, Homo sapiens
ugugaaaacaucuca

SEQ ID NO: 600181 - RNA, 14 nt, Homo sapiens
ugugaaacacacaa

SEQ ID NO: 600182 - RNA, 15 nt, Homo sapiens
ugugaaacacaugcc

SEQ ID NO: 600183 - RNA, 18 nt, Homo sapiens
ugugaaacacaugccagu

SEQ ID NO: 600184 - RNA, 13 nt, Homo sapiens
ugugaaagcccag

SEQ ID NO: 600185 - RNA, 16 nt, Homo sapiens
ugugaaaucucagaau

SEQ ID NO: 600186 - RNA, 17 nt, Homo sapiens
ugugaaaugaauguaau

SEQ ID NO: 600187 - RNA, 21 nt, Homo sapiens
ugugaacagcuugcugucacu

SEQ ID NO: 600188 - RNA, 12 nt, Homo sapiens
ugugaacccugg

SEQ ID NO: 600189 - RNA, 16 nt, Homo sapiens
uccccuucaguaccac

SEQ ID NO: 600190 - RNA, 19 nt, Homo sapiens
uccccuugcccuugcccug

SEQ ID NO: 600191 - RNA, 15 nt, Homo sapiens
uccccuuggcuguga

SEQ ID NO: 600192 - RNA, 15 nt, Homo sapiens
uccccuugucugcac

SEQ ID NO: 600193 - RNA, 20 nt, Homo sapiens
uccccuugucugcacuguuc

SEQ ID NO: 600194 - RNA, 21 nt, Homo sapiens
uccccuuuggcuaccugaugg

SEQ ID NO: 600195 - RNA, 13 nt, Homo sapiens
ucccgaagccacc

SEQ ID NO: 600196 - RNA, 19 nt, Homo sapiens
ucccgaagccugagcucau

SEQ ID NO: 600197 - RNA, 21 nt, Homo sapiens
ucccgacauaacauuguacug

SEQ ID NO: 600198 - RNA, 12 nt, Homo sapiens
ucccgaccucag

SEQ ID NO: 600199 - RNA, 17 nt, Homo sapiens
ucccgaguagcugggau

SEQ ID NO: 600200 - RNA, 14 nt, Homo sapiens
ucccgaugcugcua

SEQ ID NO: 600201 - RNA, 15 nt, Homo sapiens
ucccgaugcugcuau

SEQ ID NO: 600202 - RNA, 13 nt, Homo sapiens
ucccggcccucac

SEQ ID NO: 600203 - RNA, 16 nt, Homo sapiens
ucccggcgcgcccucu

SEQ ID NO: 600204 - RNA, 20 nt, Homo sapiens
ucccggcgucccuaccuccu

SEQ ID NO: 600205 - RNA, 19 nt, Homo sapiens
ucccggggaggaaacacuu

SEQ ID NO: 600206 - RNA, 18 nt, Homo sapiens
ucccggggccagcacuuc

SEQ ID NO: 600207 - RNA, 23 nt, Homo sapiens
ucccuagccagaggcucuaaugu

SEQ ID NO: 600208 - RNA, 16 nt, Homo sapiens
ucccuaggggacacuu

SEQ ID NO: 600209 - RNA, 19 nt, Homo sapiens
ucccuaggggacacuuccc

SEQ ID NO: 600210 - RNA, 16 nt, Homo sapiens
ucccuagguaggcacc

SEQ ID NO: 600211 - RNA, 13 nt, Homo sapiens
ucccuauuuuccu

SEQ ID NO: 600212 - RNA, 20 nt, Homo sapiens
ucccucaaaugacccaaaga

SEQ ID NO: 600213 - RNA, 18 nt, Homo sapiens
ucccucacuguugaauuu

SEQ ID NO: 600214 - RNA, 12 nt, Homo sapiens
ucccucacuugu

SEQ ID NO: 600215 - RNA, 20 nt, Homo sapiens
ucccucagaaaaaggcagug

SEQ ID NO: 600216 - RNA, 15 nt, Homo sapiens
ucccucagauuucca

SEQ ID NO: 600217 - RNA, 18 nt, Homo sapiens
ucccucaggggcaggugg

SEQ ID NO: 600218 - RNA, 13 nt, Homo sapiens
ucccucccagaaa

SEQ ID NO: 600219 - RNA, 17 nt, Homo sapiens
ucccuccccacccaaga

SEQ ID NO: 600220 - RNA, 18 nt, Homo sapiens
ucccuccgggcaggggag

SEQ ID NO: 600221 - RNA, 23 nt, Homo sapiens
ucccuccugugccccagcugcca

SEQ ID NO: 600222 - RNA, 16 nt, Homo sapiens
ucccucgcaugucucc

SEQ ID NO: 600223 - RNA, 22 nt, Homo sapiens
ucccucgccccaagguuccaga

SEQ ID NO: 600224 - RNA, 17 nt, Homo sapiens
ucccucgggugugcuau

SEQ ID NO: 600225 - RNA, 19 nt, Homo sapiens
ucccucguccgucugucuc

SEQ ID NO: 600226 - RNA, 15 nt, Homo sapiens
ucccucuaaguggaa

SEQ ID NO: 600227 - RNA, 23 nt, Homo sapiens
ucccucucagaggccugcugcca

SEQ ID NO: 600228 - RNA, 19 nt, Homo sapiens
ucccucucaugacuugcag

SEQ ID NO: 600229 - RNA, 21 nt, Homo sapiens
ucccucucaugacuugcaggg

SEQ ID NO: 600230 - RNA, 16 nt, Homo sapiens
ucccucucaugguacc

SEQ ID NO: 600231 - RNA, 23 nt, Homo sapiens
ucccucucaugucccuccaggga

SEQ ID NO: 600232 - RNA, 20 nt, Homo sapiens
ucccucucccggcaacaucu

SEQ ID NO: 600233 - RNA, 21 nt, Homo sapiens
ucccucugagaauuccaagga

SEQ ID NO: 600234 - RNA, 13 nt, Homo sapiens
ucccucugcagaa

SEQ ID NO: 600235 - RNA, 21 nt, Homo sapiens
ucccucuggaaagaaacaugu

SEQ ID NO: 600236 - RNA, 14 nt, Homo sapiens
ucccucuucacucc

SEQ ID NO: 600237 - RNA, 12 nt, Homo sapiens
ucccucuuccaa

SEQ ID NO: 600238 - RNA, 23 nt, Homo sapiens
ucccugaaaauguuuuucugcca

SEQ ID NO: 600239 - RNA, 16 nt, Homo sapiens
ucccugacacccuggg

SEQ ID NO: 600240 - RNA, 14 nt, Homo sapiens
ucccugacuguaaa

SEQ ID NO: 600241 - RNA, 17 nt, Homo sapiens
ucccugcacagugacuu

SEQ ID NO: 600242 - RNA, 22 nt, Homo sapiens
ucccugcacagugacuucugag

SEQ ID NO: 600243 - RNA, 17 nt, Homo sapiens
ucccugcaccgucucac

SEQ ID NO: 600244 - RNA, 24 nt, Homo sapiens
ucccugcacuaaagccagccugac

SEQ ID NO: 600245 - RNA, 15 nt, Homo sapiens
ucccugcagaagcca

SEQ ID NO: 600246 - RNA, 15 nt, Homo sapiens
ucccugcagaccuca

SEQ ID NO: 600247 - RNA, 15 nt, Homo sapiens
ucccugcagaugcca

SEQ ID NO: 600248 - RNA, 16 nt, Homo sapiens
ucccugcagaugccac

SEQ ID NO: 600249 - RNA, 14 nt, Homo sapiens
ucccugccacuggg

SEQ ID NO: 600250 - RNA, 22 nt, Homo sapiens
ucccugcccagccuguggugcu

SEQ ID NO: 600251 - RNA, 15 nt, Homo sapiens
ucccugccccuuaac

SEQ ID NO: 600252 - RNA, 19 nt, Homo sapiens
ucccugcuuaaauuucucc

SEQ ID NO: 600253 - RNA, 14 nt, Homo sapiens
ucccugcuugcaca

SEQ ID NO: 600254 - RNA, 18 nt, Homo sapiens
ucccuggacaggcagccu

SEQ ID NO: 600255 - RNA, 23 nt, Homo sapiens
ucccuggcuccuccgucugaccc

SEQ ID NO: 600256 - RNA, 16 nt, Homo sapiens
ucccugggccaacaga

SEQ ID NO: 600257 - RNA, 24 nt, Homo sapiens
ucccuggggaaaacuugcagcuaa

SEQ ID NO: 600258 - RNA, 19 nt, Homo sapiens
ucccugggggaagcccugg

SEQ ID NO: 600259 - RNA, 17 nt, Homo sapiens
ucccugucacacacugg

SEQ ID NO: 600260 - RNA, 16 nt, Homo sapiens
ucccugucauuugaac

SEQ ID NO: 600261 - RNA, 21 nt, Homo sapiens
ucccuguguauucuagugaau

SEQ ID NO: 600262 - RNA, 20 nt, Homo sapiens
ucccugugugugugugugcu

SEQ ID NO: 600263 - RNA, 14 nt, Homo sapiens
ucccuguguucucu

SEQ ID NO: 600264 - RNA, 20 nt, Homo sapiens
ucuucaagucccaucauaga

SEQ ID NO: 600265 - RNA, 16 nt, Homo sapiens
ucuucaaugguucucu

SEQ ID NO: 600266 - RNA, 20 nt, Homo sapiens
ucuucaauuuauuacugaaa

SEQ ID NO: 600267 - RNA, 12 nt, Homo sapiens
ucuucacaggca

SEQ ID NO: 600268 - RNA, 18 nt, Homo sapiens
ucuucaccaagugcaaua

SEQ ID NO: 600269 - RNA, 14 nt, Homo sapiens
ucuucaccauuugg

SEQ ID NO: 600270 - RNA, 18 nt, Homo sapiens
ucuucaccccccacucac

SEQ ID NO: 600271 - RNA, 12 nt, Homo sapiens
ucuucaccucag

SEQ ID NO: 600272 - RNA, 17 nt, Homo sapiens
ucuucacuccaaaaaga

SEQ ID NO: 600273 - RNA, 12 nt, Homo sapiens
ucuucagaacac

SEQ ID NO: 600274 - RNA, 12 nt, Homo sapiens
ucuucagaauua

SEQ ID NO: 600275 - RNA, 21 nt, Homo sapiens
ucuucagagagcuaaauuaca

SEQ ID NO: 600276 - RNA, 17 nt, Homo sapiens
ucuucagaggagaaaga

SEQ ID NO: 600277 - RNA, 23 nt, Homo sapiens
ucuucagaugcucuugggguuca

SEQ ID NO: 600278 - RNA, 12 nt, Homo sapiens
ucuucagccuag

SEQ ID NO: 600279 - RNA, 15 nt, Homo sapiens
ucuucagggccaguc

SEQ ID NO: 600280 - RNA, 16 nt, Homo sapiens
ucuucagggccagucc

SEQ ID NO: 600281 - RNA, 14 nt, Homo sapiens
ucuucagugucucu

SEQ ID NO: 600282 - RNA, 19 nt, Homo sapiens
ucuucaguugucucugaug

SEQ ID NO: 600283 - RNA, 22 nt, Homo sapiens
ucuucaucacuucuuccacugu

SEQ ID NO: 600284 - RNA, 13 nt, Homo sapiens
ucuucaugagcuu

SEQ ID NO: 600285 - RNA, 17 nt, Homo sapiens
ucuucaugcgugcccuu

SEQ ID NO: 600286 - RNA, 15 nt, Homo sapiens
ucuucauggccucag

SEQ ID NO: 600287 - RNA, 18 nt, Homo sapiens
ucuuccaaagcacauuga

SEQ ID NO: 600288 - RNA, 11 nt, Homo sapiens
ucuuccacugc

SEQ ID NO: 600289 - RNA, 23 nt, Homo sapiens
ucuuccacuggaaaaguguaaua

SEQ ID NO: 600290 - RNA, 15 nt, Homo sapiens
ucuuccagaaggcaa

SEQ ID NO: 600291 - RNA, 22 nt, Homo sapiens
ucuucccacacagaauauacau

SEQ ID NO: 600292 - RNA, 15 nt, Homo sapiens
ucuucccacauacau

SEQ ID NO: 600293 - RNA, 20 nt, Homo sapiens
ucuucccagcacuaugcuuu

SEQ ID NO: 600294 - RNA, 13 nt, Homo sapiens
ucuuccccagaga

SEQ ID NO: 600295 - RNA, 13 nt, Homo sapiens
ucuuccccagaua

SEQ ID NO: 600296 - RNA, 20 nt, Homo sapiens
ucuucccgcacaaauuccac

SEQ ID NO: 600297 - RNA, 11 nt, Homo sapiens
ucuucccuacc

SEQ ID NO: 600298 - RNA, 14 nt, Homo sapiens
ucuucccuaccuca

SEQ ID NO: 600299 - RNA, 19 nt, Homo sapiens
ucuucccucagaaacuaga

SEQ ID NO: 600300 - RNA, 22 nt, Homo sapiens
ucuucccucuccccauucggug

SEQ ID NO: 600301 - RNA, 15 nt, Homo sapiens
ucuucccuuaccuca

SEQ ID NO: 600302 - RNA, 20 nt, Homo sapiens
ucuucccuuccuccauugca

SEQ ID NO: 600303 - RNA, 20 nt, Homo sapiens
ucuuccgggagcuggugaca

SEQ ID NO: 600304 - RNA, 23 nt, Homo sapiens
ucuuccuccgaggccaguaccuu

SEQ ID NO: 600305 - RNA, 20 nt, Homo sapiens
ucuuccugcuuuccaugggc

SEQ ID NO: 600306 - RNA, 22 nt, Homo sapiens
ucuuccuggcuccaacacugcu

SEQ ID NO: 600307 - RNA, 12 nt, Homo sapiens
ucuuccugucuc

SEQ ID NO: 600308 - RNA, 22 nt, Homo sapiens
ucuuccuuagcuaaaugcaauu

SEQ ID NO: 600309 - RNA, 19 nt, Homo sapiens
ucuuccuugaccugcauug

SEQ ID NO: 600310 - RNA, 23 nt, Homo sapiens
ucuuccuuucuugucuuuccucc

SEQ ID NO: 600311 - RNA, 21 nt, Homo sapiens
ucuucgacauccgucauugcu

SEQ ID NO: 600312 - RNA, 21 nt, Homo sapiens
ucuucggcuugugaggcuucc

SEQ ID NO: 600313 - RNA, 21 nt, Homo sapiens
ucuucguacauagucuguucc

SEQ ID NO: 600314 - RNA, 22 nt, Homo sapiens
ucuucguguauagcugugugaa

SEQ ID NO: 600315 - RNA, 15 nt, Homo sapiens
ucuucuaaauggcaa

SEQ ID NO: 600316 - RNA, 13 nt, Homo sapiens
ucuucuaacacaa

SEQ ID NO: 600317 - RNA, 21 nt, Homo sapiens
ucuucuacagaugagucacac

SEQ ID NO: 600318 - RNA, 20 nt, Homo sapiens
ucuucuagcugagcuuuaaa

SEQ ID NO: 600319 - RNA, 22 nt, Homo sapiens
ucuucuagugcuuuucagugau

SEQ ID NO: 600320 - RNA, 21 nt, Homo sapiens
ucuucucacauccaucuacuu

SEQ ID NO: 600321 - RNA, 12 nt, Homo sapiens
ucuucucccacc

SEQ ID NO: 600322 - RNA, 13 nt, Homo sapiens
ucuucucuacucu

SEQ ID NO: 600323 - RNA, 15 nt, Homo sapiens
ucuucucucaucuga

SEQ ID NO: 600324 - RNA, 12 nt, Homo sapiens
ucuucuggucug

SEQ ID NO: 600325 - RNA, 16 nt, Homo sapiens
ucuucuggugucaugg

SEQ ID NO: 600326 - RNA, 16 nt, Homo sapiens
ucuucuucaagacucu

SEQ ID NO: 600327 - RNA, 17 nt, Homo sapiens
ucuucuuccccuuuguc

SEQ ID NO: 600328 - RNA, 18 nt, Homo sapiens
ucuucuuuuccuuuaucc

SEQ ID NO: 600329 - RNA, 17 nt, Homo sapiens
ucuugaaagacagucca

SEQ ID NO: 600330 - RNA, 22 nt, Homo sapiens
ucuugaaauauaggaacuuaaa

SEQ ID NO: 600331 - RNA, 17 nt, Homo sapiens
ucuugaaaucugaaugc

SEQ ID NO: 600332 - RNA, 18 nt, Homo sapiens
ucuugaaccugugcucau

SEQ ID NO: 600333 - RNA, 19 nt, Homo sapiens
ucuugaaccugugcucauu

SEQ ID NO: 600334 - RNA, 12 nt, Homo sapiens
ucuuuaccugag

SEQ ID NO: 600335 - RNA, 18 nt, Homo sapiens
ucuuuacuaaacagauuu

SEQ ID NO: 600336 - RNA, 16 nt, Homo sapiens
ucuuuacuaacacugg

SEQ ID NO: 600337 - RNA, 15 nt, Homo sapiens
ucuuuagaacaggga

SEQ ID NO: 600338 - RNA, 19 nt, Homo sapiens
ucuuuaugaaguuugcuau

SEQ ID NO: 600339 - RNA, 16 nt, Homo sapiens
ucuuucaauucuucau

SEQ ID NO: 600340 - RNA, 20 nt, Homo sapiens
ucuuucaugggcaccaaccu

SEQ ID NO: 600341 - RNA, 20 nt, Homo sapiens
ucuuucccuuuaucaguuug

SEQ ID NO: 600342 - RNA, 23 nt, Homo sapiens
ucuuuccuggcacuaacguugag

SEQ ID NO: 600343 - RNA, 23 nt, Homo sapiens
ucuuucuauauaaaauguauuca

SEQ ID NO: 600344 - RNA, 19 nt, Homo sapiens
ucuuucucccucaccccca

SEQ ID NO: 600345 - RNA, 15 nt, Homo sapiens
ucuuucucucacugu

SEQ ID NO: 600346 - RNA, 20 nt, Homo sapiens
ucuuucucugccagugacag

SEQ ID NO: 600347 - RNA, 19 nt, Homo sapiens
ucuuucugaauugcacaug

SEQ ID NO: 600348 - RNA, 19 nt, Homo sapiens
ucuuucuuugcaccaaaga

SEQ ID NO: 600349 - RNA, 17 nt, Homo sapiens
ucuuugaaaacagauga

SEQ ID NO: 600350 - RNA, 23 nt, Homo sapiens
ucuuugaagcgagcagucagcau

SEQ ID NO: 600351 - RNA, 18 nt, Homo sapiens
ucuuugacugucagcaag

SEQ ID NO: 600352 - RNA, 21 nt, Homo sapiens
ucuuugagcgcccacuagacc

SEQ ID NO: 600353 - RNA, 19 nt, Homo sapiens
ucuuugauauuggcuuaaa

SEQ ID NO: 600354 - RNA, 14 nt, Homo sapiens
ucuuugcaaaguau

SEQ ID NO: 600355 - RNA, 16 nt, Homo sapiens
ucuuugcaacugucuc

SEQ ID NO: 600356 - RNA, 14 nt, Homo sapiens
ucuuugcaccaaag

SEQ ID NO: 600357 - RNA, 15 nt, Homo sapiens
ucuuugcaccaaaga

SEQ ID NO: 600358 - RNA, 23 nt, Homo sapiens
ucuuugccagacaacuuguccug

SEQ ID NO: 600359 - RNA, 17 nt, Homo sapiens
ucuuugccuuuaucucu

SEQ ID NO: 600360 - RNA, 19 nt, Homo sapiens
ucuuugcucccugcaagaa

SEQ ID NO: 600361 - RNA, 19 nt, Homo sapiens
ucuuuggaaaguacacucu

SEQ ID NO: 600362 - RNA, 17 nt, Homo sapiens
ucuuuggaggcuuuuaa

SEQ ID NO: 600363 - RNA, 19 nt, Homo sapiens
ucuuuggccccuggacuau

SEQ ID NO: 600364 - RNA, 17 nt, Homo sapiens
ucuuuggccuacauucu

SEQ ID NO: 600365 - RNA, 17 nt, Homo sapiens
ucuuuggggucagccag

SEQ ID NO: 600366 - RNA, 18 nt, Homo sapiens
ucuuuggguccauucaga

SEQ ID NO: 600367 - RNA, 14 nt, Homo sapiens
ucuuugguggcaug

SEQ ID NO: 600368 - RNA, 21 nt, Homo sapiens
ucuuuguaaugucaccaccuu

SEQ ID NO: 600369 - RNA, 16 nt, Homo sapiens
ucuuuguauaugcauu

SEQ ID NO: 600370 - RNA, 19 nt, Homo sapiens
ucuuuguaugucuguuacc

SEQ ID NO: 600371 - RNA, 19 nt, Homo sapiens
ucuuugucaccacgugggg

SEQ ID NO: 600372 - RNA, 15 nt, Homo sapiens
ucuuugugugacaug

SEQ ID NO: 600373 - RNA, 14 nt, Homo sapiens
ucuuuguucaagau

SEQ ID NO: 600374 - RNA, 16 nt, Homo sapiens
ucuuuuaagcuaucca

SEQ ID NO: 600375 - RNA, 21 nt, Homo sapiens
ucuuuuaagcuauccacagcu

SEQ ID NO: 600376 - RNA, 11 nt, Homo sapiens
ucuuuuaccaa

SEQ ID NO: 600377 - RNA, 18 nt, Homo sapiens
ucuuuuacccugugucag

SEQ ID NO: 600378 - RNA, 23 nt, Homo sapiens
ucuuuuaggaggcacaacaguuc

SEQ ID NO: 600379 - RNA, 20 nt, Homo sapiens
ucuuuuccaacacaucuaua

SEQ ID NO: 600380 - RNA, 10 nt, Homo sapiens
ucuuuuccau

SEQ ID NO: 600381 - RNA, 23 nt, Homo sapiens
ucuuuucuaaguggcgugugcau

SEQ ID NO: 600382 - RNA, 18 nt, Homo sapiens
ucuuuucuacccuagcca

SEQ ID NO: 600383 - RNA, 18 nt, Homo sapiens
ucuuuucugaucugcagu

SEQ ID NO: 600384 - RNA, 13 nt, Homo sapiens
ucuuuucuuucaa

SEQ ID NO: 600385 - RNA, 18 nt, Homo sapiens
ucuuuugaaggacuccuu

SEQ ID NO: 600386 - RNA, 19 nt, Homo sapiens
ucuuuugagcuaaucuuca

SEQ ID NO: 600387 - RNA, 13 nt, Homo sapiens
ucuuuugcaauaa

SEQ ID NO: 600388 - RNA, 13 nt, Homo sapiens
ucuuuugccauua

SEQ ID NO: 600389 - RNA, 12 nt, Homo sapiens
ucuuuugccuuu

SEQ ID NO: 600390 - RNA, 20 nt, Homo sapiens
ucuuuugcuaaugcaauuag

SEQ ID NO: 600391 - RNA, 21 nt, Homo sapiens
ucuuuuuagagaaauuugcca

SEQ ID NO: 600392 - RNA, 13 nt, Homo sapiens
ucuuuuugcugcc

SEQ ID NO: 600393 - RNA, 23 nt, Homo sapiens
ucuuuuugguagaugcugggcuc

SEQ ID NO: 600394 - RNA, 16 nt, Homo sapiens
ucuuuuuuaugcagaa

SEQ ID NO: 600395 - RNA, 14 nt, Homo sapiens
ucuuuuuugccaaa

SEQ ID NO: 600396 - RNA, 22 nt, Homo sapiens
ucuuuuuuuuuaaguucuuaug

SEQ ID NO: 600397 - RNA, 14 nt, Homo sapiens
ugaaaaaaaaaugg

SEQ ID NO: 600398 - RNA, 16 nt, Homo sapiens
ugaaaaaaaacagugg

SEQ ID NO: 600399 - RNA, 15 nt, Homo sapiens
ugaaaaaaaugcauu

SEQ ID NO: 600400 - RNA, 18 nt, Homo sapiens
ugaaaaaacaccuagcuu

SEQ ID NO: 600401 - RNA, 16 nt, Homo sapiens
ugaaaaaauacuaccu

SEQ ID NO: 600402 - RNA, 17 nt, Homo sapiens
ugaaaaaauacuaccua

SEQ ID NO: 600403 - RNA, 19 nt, Homo sapiens
ugaaaaaauauauguauau

SEQ ID NO: 600404 - RNA, 22 nt, Homo sapiens
ugaaaaacagaaagcauccuaa

SEQ ID NO: 600405 - RNA, 12 nt, Homo sapiens
ugaaaaacauuc

SEQ ID NO: 600406 - RNA, 18 nt, Homo sapiens
uccauagaguaacaguaa

SEQ ID NO: 600407 - RNA, 22 nt, Homo sapiens
uccauagccuaaucccugggca

SEQ ID NO: 600408 - RNA, 19 nt, Homo sapiens
uccauaguaguaugaugau

SEQ ID NO: 600409 - RNA, 21 nt, Homo sapiens
uccauagugcacuagcauuuu

SEQ ID NO: 600410 - RNA, 20 nt, Homo sapiens
uccauaguggaccacuugga

SEQ ID NO: 600411 - RNA, 20 nt, Homo sapiens
uccauauaacaauucaguaa

SEQ ID NO: 600412 - RNA, 24 nt, Homo sapiens
uccauauaacaauucaguaacaaa

SEQ ID NO: 600413 - RNA, 22 nt, Homo sapiens
uccauauagucuauucauuaag

SEQ ID NO: 600414 - RNA, 23 nt, Homo sapiens
uccauaucccuuccucucaggcu

SEQ ID NO: 600415 - RNA, 23 nt, Homo sapiens
uccauauguuauaucaacagaua

SEQ ID NO: 600416 - RNA, 17 nt, Homo sapiens
uccauauuuuacugauc

SEQ ID NO: 600417 - RNA, 14 nt, Homo sapiens
uccaucauaugccu

SEQ ID NO: 600418 - RNA, 16 nt, Homo sapiens
uccaucaucacuguaa

SEQ ID NO: 600419 - RNA, 19 nt, Homo sapiens
uccaucauucauccaggac

SEQ ID NO: 600420 - RNA, 15 nt, Homo sapiens
uccaucccgaaaauc

SEQ ID NO: 600421 - RNA, 15 nt, Homo sapiens
uccaucucaaaaaau

SEQ ID NO: 600422 - RNA, 13 nt, Homo sapiens
uccaucucucauc

SEQ ID NO: 600423 - RNA, 17 nt, Homo sapiens
uccaucuguccguccag

SEQ ID NO: 600424 - RNA, 15 nt, Homo sapiens
uccaugaacaucaug

SEQ ID NO: 600425 - RNA, 22 nt, Homo sapiens
uccaugaaguuugaacuucaua

SEQ ID NO: 600426 - RNA, 14 nt, Homo sapiens
uccaugaauguauc

SEQ ID NO: 600427 - RNA, 15 nt, Homo sapiens
uccaugaauucuuga

SEQ ID NO: 600428 - RNA, 16 nt, Homo sapiens
uccaugagacacaucu

SEQ ID NO: 600429 - RNA, 15 nt, Homo sapiens
uccaugcaaaccaug

SEQ ID NO: 600430 - RNA, 22 nt, Homo sapiens
uccaugccucuggaggccucug

SEQ ID NO: 600431 - RNA, 14 nt, Homo sapiens
uccaugccuuccau

SEQ ID NO: 600432 - RNA, 13 nt, Homo sapiens
uccaugccuuuaa

SEQ ID NO: 600433 - RNA, 19 nt, Homo sapiens
uccaugcugcaaaggagaa

SEQ ID NO: 600434 - RNA, 16 nt, Homo sapiens
uccauggcaaaugggc

SEQ ID NO: 600435 - RNA, 22 nt, Homo sapiens
uccauggccaccccgugccacc

SEQ ID NO: 600436 - RNA, 20 nt, Homo sapiens
uccaugguccugucuguccu

SEQ ID NO: 600437 - RNA, 21 nt, Homo sapiens
uccauguagaauaaaugaaga

SEQ ID NO: 600438 - RNA, 21 nt, Homo sapiens
uccaugucagauaaguguaaa

SEQ ID NO: 600439 - RNA, 11 nt, Homo sapiens
uccaugucucg

SEQ ID NO: 600440 - RNA, 15 nt, Homo sapiens
uccaugugcauauaa

SEQ ID NO: 600441 - RNA, 15 nt, Homo sapiens
uccaugugugugcaa

SEQ ID NO: 600442 - RNA, 22 nt, Homo sapiens
uccauguuucagaagcauucag

SEQ ID NO: 600443 - RNA, 22 nt, Homo sapiens
uccauguuugcaccugugcauu

SEQ ID NO: 600444 - RNA, 16 nt, Homo sapiens
uccauuaaguacaugu

SEQ ID NO: 600445 - RNA, 16 nt, Homo sapiens
uccauuacgugcauuu

SEQ ID NO: 600446 - RNA, 18 nt, Homo sapiens
uccauuacgugcauuuaa

SEQ ID NO: 600447 - RNA, 14 nt, Homo sapiens
uccauuauuuauau

SEQ ID NO: 600448 - RNA, 15 nt, Homo sapiens
uccauucacaccagc

SEQ ID NO: 600449 - RNA, 13 nt, Homo sapiens
uccauucagaaag

SEQ ID NO: 600450 - RNA, 14 nt, Homo sapiens
uccauuccauggaa

SEQ ID NO: 600451 - RNA, 18 nt, Homo sapiens
uccauuccccugcugcca

SEQ ID NO: 600452 - RNA, 15 nt, Homo sapiens
uccauucugcaccuc

SEQ ID NO: 600453 - RNA, 17 nt, Homo sapiens
uccauucuucagugucu

SEQ ID NO: 600454 - RNA, 14 nt, Homo sapiens
uccauucuucgaca

SEQ ID NO: 600455 - RNA, 15 nt, Homo sapiens
uccauucuucuugcu

SEQ ID NO: 600456 - RNA, 13 nt, Homo sapiens
uccauugucuuau

SEQ ID NO: 600457 - RNA, 21 nt, Homo sapiens
uccauuuacuuaagacuuaau

SEQ ID NO: 600458 - RNA, 20 nt, Homo sapiens
uccauuuauucuuugaucuu

SEQ ID NO: 600459 - RNA, 17 nt, Homo sapiens
uccauuugaaccaguga

SEQ ID NO: 600460 - RNA, 16 nt, Homo sapiens
uccauuugcaaauaua

SEQ ID NO: 600461 - RNA, 18 nt, Homo sapiens
uccauuugugugugugca

SEQ ID NO: 600462 - RNA, 20 nt, Homo sapiens
uccauuugugugugugcaag

SEQ ID NO: 600463 - RNA, 22 nt, Homo sapiens
uccauuugugugugugcaagug

SEQ ID NO: 600464 - RNA, 19 nt, Homo sapiens
uccauuuuuguaagccaua

SEQ ID NO: 600465 - RNA, 22 nt, Homo sapiens
ucccaaaauuguuuugagcuuu

SEQ ID NO: 600466 - RNA, 13 nt, Homo sapiens
ucccaaagcacuu

SEQ ID NO: 600467 - RNA, 21 nt, Homo sapiens
ucccaaaggaugagaauguga

SEQ ID NO: 600468 - RNA, 10 nt, Homo sapiens
ucccaaagug

SEQ ID NO: 600469 - RNA, 15 nt, Homo sapiens
ucccaaagugcuagu

SEQ ID NO: 600470 - RNA, 20 nt, Homo sapiens
ucccaaagugcugggauuac

SEQ ID NO: 600471 - RNA, 15 nt, Homo sapiens
ucccaaauaaacucc

SEQ ID NO: 600472 - RNA, 13 nt, Homo sapiens
ucccaaaugaaaa

SEQ ID NO: 600473 - RNA, 14 nt, Homo sapiens
ucccaacauaugcc

SEQ ID NO: 600474 - RNA, 13 nt, Homo sapiens
ucccaacccauuc

SEQ ID NO: 600475 - RNA, 23 nt, Homo sapiens
ucccaaccucaaugcccugccau

SEQ ID NO: 600476 - RNA, 14 nt, Homo sapiens
ucccaacguuuuac

SEQ ID NO: 600477 - RNA, 17 nt, Homo sapiens
ucccaacguuuuacaua

SEQ ID NO: 600478 - RNA, 15 nt, Homo sapiens
ucccaagaaauggaa

SEQ ID NO: 600479 - RNA, 17 nt, Homo sapiens
ucccaagaaauggaauc

SEQ ID NO: 600480 - RNA, 23 nt, Homo sapiens
ucccaagagcauaacuguucuca

SEQ ID NO: 600481 - RNA, 13 nt, Homo sapiens
ucccaagagccau

SEQ ID NO: 600482 - RNA, 13 nt, Homo sapiens
ucccaagcucaga

SEQ ID NO: 600483 - RNA, 17 nt, Homo sapiens
ucccaaguaugccuuaa

SEQ ID NO: 600484 - RNA, 23 nt, Homo sapiens
ucccaaguauugcgaaugugcag

SEQ ID NO: 600485 - RNA, 16 nt, Homo sapiens
ucccaaucaaagaauu

SEQ ID NO: 600486 - RNA, 15 nt, Homo sapiens
ucccaaucggccuua

SEQ ID NO: 600487 - RNA, 19 nt, Homo sapiens
uccacagcuauauccugau

SEQ ID NO: 600488 - RNA, 22 nt, Homo sapiens
uccacaggaacaacagcaucuu

SEQ ID NO: 600489 - RNA, 20 nt, Homo sapiens
uucacagcccagaaccacag

SEQ ID NO: 600490 - RNA, 16 nt, Homo sapiens
uucacaggcacuccug

SEQ ID NO: 600491 - RNA, 20 nt, Homo sapiens
uucacaggcagugcauguga

SEQ ID NO: 600492 - RNA, 19 nt, Homo sapiens
uucacaguaauaugguucc

SEQ ID NO: 600493 - RNA, 15 nt, Homo sapiens
uucacagucacugau

SEQ ID NO: 600494 - RNA, 21 nt, Homo sapiens
uucacauacaaaucauccauc

SEQ ID NO: 600495 - RNA, 19 nt, Homo sapiens
uucacauucccaucuguca

SEQ ID NO: 600496 - RNA, 14 nt, Homo sapiens
uucacauuguacuu

SEQ ID NO: 600497 - RNA, 16 nt, Homo sapiens
uucacauuguacuuaa

SEQ ID NO: 600498 - RNA, 21 nt, Homo sapiens
uucacauuugauguacaugug

SEQ ID NO: 600499 - RNA, 22 nt, Homo sapiens
uucacauuuuuaaaagaacaau

SEQ ID NO: 600500 - RNA, 13 nt, Homo sapiens
uucaccaccaaau

SEQ ID NO: 600501 - RNA, 19 nt, Homo sapiens
uucaccacuguaguucucu

SEQ ID NO: 600502 - RNA, 14 nt, Homo sapiens
uucaccagagcauu

SEQ ID NO: 600503 - RNA, 22 nt, Homo sapiens
uucaccagucugucuacugugg

SEQ ID NO: 600504 - RNA, 12 nt, Homo sapiens
uucaccaugcag

SEQ ID NO: 600505 - RNA, 17 nt, Homo sapiens
uucaccauguuggucag

SEQ ID NO: 600506 - RNA, 19 nt, Homo sapiens
uucaccccuacacugugaa

SEQ ID NO: 600507 - RNA, 12 nt, Homo sapiens
uucacccugugc

SEQ ID NO: 600508 - RNA, 16 nt, Homo sapiens
uucaccuaacuagaga

SEQ ID NO: 600509 - RNA, 13 nt, Homo sapiens
uucaccuguaaac

SEQ ID NO: 600510 - RNA, 15 nt, Homo sapiens
uucaccugugacaaa

SEQ ID NO: 600511 - RNA, 17 nt, Homo sapiens
uucaccugugacaaagg

SEQ ID NO: 600512 - RNA, 14 nt, Homo sapiens
uucaccuuccaugu

SEQ ID NO: 600513 - RNA, 17 nt, Homo sapiens
uucacgaacuguucaca

SEQ ID NO: 600514 - RNA, 21 nt, Homo sapiens
uucacgaacuguucacacugc

SEQ ID NO: 600515 - RNA, 19 nt, Homo sapiens
uucacgcuguuuguuucau

SEQ ID NO: 600516 - RNA, 19 nt, Homo sapiens
uucacgggcaaucaugagc

SEQ ID NO: 600517 - RNA, 19 nt, Homo sapiens
uucacguaaauauucauau

SEQ ID NO: 600518 - RNA, 18 nt, Homo sapiens
uucacuaccaagcagcuc

SEQ ID NO: 600519 - RNA, 14 nt, Homo sapiens
uucacuacuuuaau

SEQ ID NO: 600520 - RNA, 18 nt, Homo sapiens
uucacuauaaaugguguu

SEQ ID NO: 600521 - RNA, 14 nt, Homo sapiens
uucacuauguuaca

SEQ ID NO: 600522 - RNA, 15 nt, Homo sapiens
uucacuauguuacau

SEQ ID NO: 600523 - RNA, 16 nt, Homo sapiens
uucacucccaaccuga

SEQ ID NO: 600524 - RNA, 18 nt, Homo sapiens
uucacugaaggugauuca

SEQ ID NO: 600525 - RNA, 10 nt, Homo sapiens
uucacugagc

SEQ ID NO: 600526 - RNA, 19 nt, Homo sapiens
uucacugagcuccccagau

SEQ ID NO: 600527 - RNA, 22 nt, Homo sapiens
uucacugauaaaugaagaaaag

SEQ ID NO: 600528 - RNA, 18 nt, Homo sapiens
uucacuguaagacucauu

SEQ ID NO: 600529 - RNA, 16 nt, Homo sapiens
uucacuguacugcaug

SEQ ID NO: 600530 - RNA, 20 nt, Homo sapiens
uucacuguacugcaugugac

SEQ ID NO: 600531 - RNA, 15 nt, Homo sapiens
uucacugucaccacc

SEQ ID NO: 600532 - RNA, 22 nt, Homo sapiens
uucacugucaggaagaaaucac

SEQ ID NO: 600533 - RNA, 13 nt, Homo sapiens
uucacuucagagc

SEQ ID NO: 600534 - RNA, 18 nt, Homo sapiens
uucacuugaugauacaau

SEQ ID NO: 600535 - RNA, 15 nt, Homo sapiens
uucacuugccaugca

SEQ ID NO: 600536 - RNA, 16 nt, Homo sapiens
uucacuuguauugacu

SEQ ID NO: 600537 - RNA, 12 nt, Homo sapiens
uucacuuuacaa

SEQ ID NO: 600538 - RNA, 13 nt, Homo sapiens
uucacuuuacaaa

SEQ ID NO: 600539 - RNA, 21 nt, Homo sapiens
uucacuuuuuacagugcuauu

SEQ ID NO: 600540 - RNA, 22 nt, Homo sapiens
uucagaaaauaaaugguuucau

SEQ ID NO: 600541 - RNA, 12 nt, Homo sapiens
uucagaaacuca

SEQ ID NO: 600542 - RNA, 14 nt, Homo sapiens
uucagaaauuccaa

SEQ ID NO: 600543 - RNA, 19 nt, Homo sapiens
uucagaagccuaauuccag

SEQ ID NO: 600544 - RNA, 18 nt, Homo sapiens
uucagacaagaaugugca

SEQ ID NO: 600545 - RNA, 18 nt, Homo sapiens
uucagacuccaaacagac

SEQ ID NO: 600546 - RNA, 20 nt, Homo sapiens
uucagacuuuaaaauucuaa

SEQ ID NO: 600547 - RNA, 15 nt, Homo sapiens
uucagagaacccacu

SEQ ID NO: 600548 - RNA, 15 nt, Homo sapiens
uucagagaauuacua

SEQ ID NO: 600549 - RNA, 22 nt, Homo sapiens
uucagagacagcugauacuuca

SEQ ID NO: 600550 - RNA, 23 nt, Homo sapiens
uucagagagcagcuuuaaacuca

SEQ ID NO: 600551 - RNA, 17 nt, Homo sapiens
uucagagaucaaguccu

SEQ ID NO: 600552 - RNA, 19 nt, Homo sapiens
uucagaggagcaacccuau

SEQ ID NO: 600553 - RNA, 22 nt, Homo sapiens
uucagagggcguguuguuuuac

SEQ ID NO: 600554 - RNA, 17 nt, Homo sapiens
uucagaguccuugcaaa

SEQ ID NO: 600555 - RNA, 17 nt, Homo sapiens
uucagagugacuacaca

SEQ ID NO: 600556 - RNA, 16 nt, Homo sapiens
uucagaguggacuugu

SEQ ID NO: 600557 - RNA, 16 nt, Homo sapiens
uucagauacaaacugc

SEQ ID NO: 600558 - RNA, 19 nt, Homo sapiens
uucagauauauuuuucaca

SEQ ID NO: 600559 - RNA, 22 nt, Homo sapiens
uucagauccugaauuccagcaa

SEQ ID NO: 600560 - RNA, 19 nt, Homo sapiens
uucagaugauucuaugucu

SEQ ID NO: 600561 - RNA, 19 nt, Homo sapiens
uucagaugcuucugggaga

SEQ ID NO: 600562 - RNA, 22 nt, Homo sapiens
uucagauuauccuuccuccuca

SEQ ID NO: 600563 - RNA, 12 nt, Homo sapiens
uucagcacacac

SEQ ID NO: 600564 - RNA, 20 nt, Homo sapiens
uucagcacccugggugccau

SEQ ID NO: 600565 - RNA, 18 nt, Homo sapiens
uucagcaccgauggccau

SEQ ID NO: 600566 - RNA, 14 nt, Homo sapiens
uucagcaguaccua

SEQ ID NO: 600567 - RNA, 15 nt, Homo sapiens
uucagcagucaauac

SEQ ID NO: 600568 - RNA, 21 nt, Homo sapiens
uucagcauccgcaggugcugg

SEQ ID NO: 600569 - RNA, 23 nt, Homo sapiens
uucagcccacugcccaaugccug

SEQ ID NO: 600570 - RNA, 19 nt, Homo sapiens
uucagccccuagugcuauu

SEQ ID NO: 600571 - RNA, 12 nt, Homo sapiens
uucagccuuaau

SEQ ID NO: 600572 - RNA, 17 nt, Homo sapiens
uucagcgaagucucaug

SEQ ID NO: 600573 - RNA, 16 nt, Homo sapiens
uucagcuagaauccug

SEQ ID NO: 600574 - RNA, 16 nt, Homo sapiens
uucagcucuguuuuac

SEQ ID NO: 600575 - RNA, 19 nt, Homo sapiens
uucaggaagcucucuuaaa

SEQ ID NO: 600576 - RNA, 20 nt, Homo sapiens
uucaggacacagggaaauca

SEQ ID NO: 600577 - RNA, 20 nt, Homo sapiens
uucaggacuuaacggcucca

SEQ ID NO: 600578 - RNA, 16 nt, Homo sapiens
uagcgauugauugaug

SEQ ID NO: 600579 - RNA, 13 nt, Homo sapiens
uagcggucaauuu

SEQ ID NO: 600580 - RNA, 17 nt, Homo sapiens
uagcgucaagacauuug

SEQ ID NO: 600581 - RNA, 19 nt, Homo sapiens
uagcuaaacggauuccaaa

SEQ ID NO: 600582 - RNA, 23 nt, Homo sapiens
uagcuaaauaaauggguguauau

SEQ ID NO: 600583 - RNA, 11 nt, Homo sapiens
uagcuaggcau

SEQ ID NO: 600584 - RNA, 15 nt, Homo sapiens
uagcuaggugacaua

SEQ ID NO: 600585 - RNA, 18 nt, Homo sapiens
uagcuaggugacauauac

SEQ ID NO: 600586 - RNA, 14 nt, Homo sapiens
uagcuaguaucuuc

SEQ ID NO: 600587 - RNA, 17 nt, Homo sapiens
uagcuauauccauguac

SEQ ID NO: 600588 - RNA, 20 nt, Homo sapiens
uagcuauuuuucuuguugca

SEQ ID NO: 600589 - RNA, 18 nt, Homo sapiens
uagcucaauacaauguga

SEQ ID NO: 600590 - RNA, 14 nt, Homo sapiens
uagcucaaucugca

SEQ ID NO: 600591 - RNA, 20 nt, Homo sapiens
uagcucaggaccugggaccu

SEQ ID NO: 600592 - RNA, 22 nt, Homo sapiens
uagcuccauaaaguacaaauga

SEQ ID NO: 600593 - RNA, 20 nt, Homo sapiens
uagcucucccaacucuugca

SEQ ID NO: 600594 - RNA, 18 nt, Homo sapiens
uagcucugccuuacccug

SEQ ID NO: 600595 - RNA, 17 nt, Homo sapiens
uagcucuggaccugucu

SEQ ID NO: 600596 - RNA, 21 nt, Homo sapiens
uagcucuguggaauucaguga

SEQ ID NO: 600597 - RNA, 22 nt, Homo sapiens
uagcugacggcuggguguuuca

SEQ ID NO: 600598 - RNA, 15 nt, Homo sapiens
uagcugagaagcaau

SEQ ID NO: 600599 - RNA, 23 nt, Homo sapiens
uagcugagaagcaaugggucacu

SEQ ID NO: 600600 - RNA, 19 nt, Homo sapiens
uagcugauuuaacuuguau

SEQ ID NO: 600601 - RNA, 16 nt, Homo sapiens
uagcugcaaguguauc

SEQ ID NO: 600602 - RNA, 16 nt, Homo sapiens
uagcugggacuacagg

SEQ ID NO: 600603 - RNA, 18 nt, Homo sapiens
uagcugggacuacagggg

SEQ ID NO: 600604 - RNA, 18 nt, Homo sapiens
uagcugggacuacaggug

SEQ ID NO: 600605 - RNA, 15 nt, Homo sapiens
uagcugugucagaau

SEQ ID NO: 600606 - RNA, 19 nt, Homo sapiens
uagcugugugaacguguau

SEQ ID NO: 600607 - RNA, 12 nt, Homo sapiens
uagcuguuucaa

SEQ ID NO: 600608 - RNA, 21 nt, Homo sapiens
uagcuguuucaaaugugcauu

SEQ ID NO: 600609 - RNA, 15 nt, Homo sapiens
uagcuuagaccucag

SEQ ID NO: 600610 - RNA, 19 nt, Homo sapiens
uagcuuagaccucagccug

SEQ ID NO: 600611 - RNA, 18 nt, Homo sapiens
uuggauacauacaccagc

SEQ ID NO: 600612 - RNA, 12 nt, Homo sapiens
uuggaucuugaa

SEQ ID NO: 600613 - RNA, 20 nt, Homo sapiens
uuggaugaugaaacauucau

SEQ ID NO: 600614 - RNA, 12 nt, Homo sapiens
uuggauuccagu

SEQ ID NO: 600615 - RNA, 14 nt, Homo sapiens
uuggauugauaucg

SEQ ID NO: 600616 - RNA, 13 nt, Homo sapiens
uuggcaacagaag

SEQ ID NO: 600617 - RNA, 19 nt, Homo sapiens
uuggcaaguaacuucugac

SEQ ID NO: 600618 - RNA, 12 nt, Homo sapiens
uuggcacacuug

SEQ ID NO: 600619 - RNA, 21 nt, Homo sapiens
uuggcagcucaaagacuucca

SEQ ID NO: 600620 - RNA, 12 nt, Homo sapiens
uuggcauacaaa

SEQ ID NO: 600621 - RNA, 16 nt, Homo sapiens
uuggcauccugugcuu

SEQ ID NO: 600622 - RNA, 22 nt, Homo sapiens
uuggcauuggaauucuacugga

SEQ ID NO: 600623 - RNA, 19 nt, Homo sapiens
uuggccaccaggugccuuu

SEQ ID NO: 600624 - RNA, 15 nt, Homo sapiens
uuggccagcaaaaac

SEQ ID NO: 600625 - RNA, 16 nt, Homo sapiens
uuggccauguucucca

SEQ ID NO: 600626 - RNA, 22 nt, Homo sapiens
uuggccucagaauucacaaaau

SEQ ID NO: 600627 - RNA, 13 nt, Homo sapiens
uuggccucuccuu

SEQ ID NO: 600628 - RNA, 21 nt, Homo sapiens
uuggccuuguggauaagggag

SEQ ID NO: 600629 - RNA, 14 nt, Homo sapiens
uuggcgggccaagg

SEQ ID NO: 600630 - RNA, 23 nt, Homo sapiens
uuggcgugguccaugcugaugau

SEQ ID NO: 600631 - RNA, 19 nt, Homo sapiens
uuggcuaauaaauguugcc

SEQ ID NO: 600632 - RNA, 14 nt, Homo sapiens
uuggcucaauccuc

SEQ ID NO: 600633 - RNA, 14 nt, Homo sapiens
uuggcucccugugu

SEQ ID NO: 600634 - RNA, 16 nt, Homo sapiens
uuggcucuagucacug

SEQ ID NO: 600635 - RNA, 16 nt, Homo sapiens
uuggcugaacuacaag

SEQ ID NO: 600636 - RNA, 11 nt, Homo sapiens
uuggcugugag

SEQ ID NO: 600637 - RNA, 15 nt, Homo sapiens
uuggcuucugugaug

SEQ ID NO: 600638 - RNA, 12 nt, Homo sapiens
uugggaagacca

SEQ ID NO: 600639 - RNA, 20 nt, Homo sapiens
uugggacauggcacaggccc

SEQ ID NO: 600640 - RNA, 16 nt, Homo sapiens
uugggaccaucacuga

SEQ ID NO: 600641 - RNA, 22 nt, Homo sapiens
uugggacgcacagugcaguuga

SEQ ID NO: 600642 - RNA, 22 nt, Homo sapiens
uugggacucaaggcuugaguca

SEQ ID NO: 600643 - RNA, 15 nt, Homo sapiens
uugggacucaggaua

SEQ ID NO: 600644 - RNA, 12 nt, Homo sapiens
uugggagcaaaa

SEQ ID NO: 600645 - RNA, 23 nt, Homo sapiens
uugggaucaauaggaaagcauau

SEQ ID NO: 600646 - RNA, 23 nt, Homo sapiens
uugggauugucuuacuguugcau

SEQ ID NO: 600647 - RNA, 13 nt, Homo sapiens
uugggauuuuucu

SEQ ID NO: 600648 - RNA, 14 nt, Homo sapiens
uugggcaacagagc

SEQ ID NO: 600649 - RNA, 13 nt, Homo sapiens
uugggcaagccaa

SEQ ID NO: 600650 - RNA, 13 nt, Homo sapiens
uugggcacagucc

SEQ ID NO: 600651 - RNA, 16 nt, Homo sapiens
uugggcagacccugag

SEQ ID NO: 600652 - RNA, 22 nt, Homo sapiens
uugggcagagcuggcucugagc

SEQ ID NO: 600653 - RNA, 13 nt, Homo sapiens
uugggcaugccau

SEQ ID NO: 600654 - RNA, 14 nt, Homo sapiens
uugggcaugccauu

SEQ ID NO: 600655 - RNA, 15 nt, Homo sapiens
uugggccauggcuuu

SEQ ID NO: 600656 - RNA, 14 nt, Homo sapiens
uugggcccaggacu

SEQ ID NO: 600657 - RNA, 15 nt, Homo sapiens
uugggcucgcacugc

SEQ ID NO: 600658 - RNA, 22 nt, Homo sapiens
uuggggaaaccuucaucugaaa

SEQ ID NO: 600659 - RNA, 14 nt, Homo sapiens
uuggggacuaaccc

SEQ ID NO: 600660 - RNA, 20 nt, Homo sapiens
uuggggcuaauuuaacaaga

SEQ ID NO: 600661 - RNA, 16 nt, Homo sapiens
uuggggcuuuacauac

SEQ ID NO: 600662 - RNA, 15 nt, Homo sapiens
uugggggaaccagca

SEQ ID NO: 600663 - RNA, 20 nt, Homo sapiens
uugggggggguggucucuuc

SEQ ID NO: 600664 - RNA, 18 nt, Homo sapiens
uuggguacugggugcugu

SEQ ID NO: 600665 - RNA, 13 nt, Homo sapiens
uugggucuuugaa

SEQ ID NO: 600666 - RNA, 14 nt, Homo sapiens
uuggguugaucucu

SEQ ID NO: 600667 - RNA, 21 nt, Homo sapiens
uugguacuacuagaugucuuu

SEQ ID NO: 600668 - RNA, 12 nt, Homo sapiens
uugguacugaaa

SEQ ID NO: 600669 - RNA, 17 nt, Homo sapiens
uugguagaaggacugaa

SEQ ID NO: 600670 - RNA, 14 nt, Homo sapiens
uugguaugugcuag

SEQ ID NO: 600671 - RNA, 22 nt, Homo sapiens
uuggucagaaagauaagccagu

SEQ ID NO: 600672 - RNA, 16 nt, Homo sapiens
uugguccuaagcaccu

SEQ ID NO: 600673 - RNA, 16 nt, Homo sapiens
uuggucuguugcccag

SEQ ID NO: 600674 - RNA, 23 nt, Homo sapiens
uuggugaaucgguuguucuuucc

SEQ ID NO: 600675 - RNA, 15 nt, Homo sapiens
uuggugaauuucaca

SEQ ID NO: 600676 - RNA, 18 nt, Homo sapiens
uuggugacaaaauucauu

SEQ ID NO: 600677 - RNA, 20 nt, Homo sapiens
uugguggacgagaaggugcu

SEQ ID NO: 600678 - RNA, 15 nt, Homo sapiens
uugguggaugugaug

SEQ ID NO: 600679 - RNA, 20 nt, Homo sapiens
uuggugucugguuucugucc

SEQ ID NO: 600680 - RNA, 13 nt, Homo sapiens
uugguuacuucau

SEQ ID NO: 600681 - RNA, 16 nt, Homo sapiens
uugguuccuucugccc

SEQ ID NO: 600682 - RNA, 14 nt, Homo sapiens
uugguugugauuga

SEQ ID NO: 600683 - RNA, 18 nt, Homo sapiens
uugguuuaaagaaagugu

SEQ ID NO: 600684 - RNA, 16 nt, Homo sapiens
uugguuucacugagag

SEQ ID NO: 600685 - RNA, 18 nt, Homo sapiens
uugguuuuggggguguga

SEQ ID NO: 600686 - RNA, 21 nt, Homo sapiens
uugguuuuguuuucuucacua

SEQ ID NO: 600687 - RNA, 13 nt, Homo sapiens
uuguaaaauccac

SEQ ID NO: 600688 - RNA, 17 nt, Homo sapiens
uuguaaaauuauuucau

SEQ ID NO: 600689 - RNA, 17 nt, Homo sapiens
uuguaaacagaagcaac

SEQ ID NO: 600690 - RNA, 20 nt, Homo sapiens
uuguaaauacacauagcaug

SEQ ID NO: 600691 - RNA, 19 nt, Homo sapiens
uuguaaauacugcuugacc

SEQ ID NO: 600692 - RNA, 14 nt, Homo sapiens
uuguaaauaugcaa

SEQ ID NO: 600693 - RNA, 23 nt, Homo sapiens
uuguaaauuauauuugugcuaua

SEQ ID NO: 600694 - RNA, 19 nt, Homo sapiens
uuguaaauuuuagagcaua

SEQ ID NO: 600695 - RNA, 17 nt, Homo sapiens
uuguaacaauagcacaa

SEQ ID NO: 600696 - RNA, 18 nt, Homo sapiens
uuguaaccugcugugaua

SEQ ID NO: 600697 - RNA, 20 nt, Homo sapiens
uuguaacgaagacacagacu

SEQ ID NO: 600698 - RNA, 17 nt, Homo sapiens
uuguaagaaauacugua

SEQ ID NO: 600699 - RNA, 13 nt, Homo sapiens
uuguaagccauaa

SEQ ID NO: 600700 - RNA, 15 nt, Homo sapiens
uuguaagugcugcua

SEQ ID NO: 600701 - RNA, 17 nt, Homo sapiens
uuguaaguugaagcaaa

SEQ ID NO: 600702 - RNA, 18 nt, Homo sapiens
uuguaauauuaacuaaau

SEQ ID NO: 600703 - RNA, 15 nt, Homo sapiens
uuguaaugaauuccu

SEQ ID NO: 600704 - RNA, 19 nt, Homo sapiens
uuguaaugacagugcuaaa

SEQ ID NO: 600705 - RNA, 13 nt, Homo sapiens
uuguaaugcugca

SEQ ID NO: 600706 - RNA, 17 nt, Homo sapiens
uuguaaugcugcacaga

SEQ ID NO: 600707 - RNA, 14 nt, Homo sapiens
uuguaauugcauga

SEQ ID NO: 600708 - RNA, 16 nt, Homo sapiens
uuguaauugcaugaca

SEQ ID NO: 600709 - RNA, 20 nt, Homo sapiens
uuguacagugucugugccau

SEQ ID NO: 600710 - RNA, 14 nt, Homo sapiens
uuguaccauauaga

SEQ ID NO: 600711 - RNA, 17 nt, Homo sapiens
uuguaccauuuucuauc

SEQ ID NO: 600712 - RNA, 19 nt, Homo sapiens
uuguacugugcaguuuuca

SEQ ID NO: 600713 - RNA, 23 nt, Homo sapiens
uuguagaaauuaacaaaugugcu

SEQ ID NO: 600714 - RNA, 17 nt, Homo sapiens
uuguagacaaaguacau

SEQ ID NO: 600715 - RNA, 19 nt, Homo sapiens
uuguagagauggggucuca

SEQ ID NO: 600716 - RNA, 22 nt, Homo sapiens
uuguagagauggggucucacag

SEQ ID NO: 600717 - RNA, 20 nt, Homo sapiens
ucaaguaguguaucacagua

SEQ ID NO: 600718 - RNA, 14 nt, Homo sapiens
ucaaguaguuugac

SEQ ID NO: 600719 - RNA, 20 nt, Homo sapiens
ucaaguauaacaacuuugaa

SEQ ID NO: 600720 - RNA, 19 nt, Homo sapiens
ucaaguccuacaagcuaaa

SEQ ID NO: 600721 - RNA, 13 nt, Homo sapiens
ucaagucucucac

SEQ ID NO: 600722 - RNA, 23 nt, Homo sapiens
ucaagucuucccugaucaaguca

SEQ ID NO: 600723 - RNA, 19 nt, Homo sapiens
ucaagugaggggcccuuug

SEQ ID NO: 600724 - RNA, 18 nt, Homo sapiens
ucaagugauccacccacc

SEQ ID NO: 600725 - RNA, 21 nt, Homo sapiens
ucaagugauucuccugccuca

SEQ ID NO: 600726 - RNA, 11 nt, Homo sapiens
ucaagugcagu

SEQ ID NO: 600727 - RNA, 23 nt, Homo sapiens
ucaagugccucuuguugcagaga

SEQ ID NO: 600728 - RNA, 13 nt, Homo sapiens
ucaagugccuuaa

SEQ ID NO: 600729 - RNA, 11 nt, Homo sapiens
ucaaguggcag

SEQ ID NO: 600730 - RNA, 14 nt, Homo sapiens
ucaagugucuucca

SEQ ID NO: 600731 - RNA, 16 nt, Homo sapiens
ucaaguuauacaucuu

SEQ ID NO: 600732 - RNA, 20 nt, Homo sapiens
ucaaguuguugacugugauu

SEQ ID NO: 600733 - RNA, 20 nt, Homo sapiens
ucaaguuugaccagugcagu

SEQ ID NO: 600734 - RNA, 12 nt, Homo sapiens
uuguaugccuuu

SEQ ID NO: 600735 - RNA, 21 nt, Homo sapiens
uuguauguuaaagcaucagag

SEQ ID NO: 600736 - RNA, 15 nt, Homo sapiens
uuguauuaugcugga

SEQ ID NO: 600737 - RNA, 18 nt, Homo sapiens
uuguauuucucuuguccu

SEQ ID NO: 600738 - RNA, 17 nt, Homo sapiens
uugucaaaaaguuccau

SEQ ID NO: 600739 - RNA, 14 nt, Homo sapiens
uugucaauuaccag

SEQ ID NO: 600740 - RNA, 20 nt, Homo sapiens
uugucacaaauaaacauaau

SEQ ID NO: 600741 - RNA, 15 nt, Homo sapiens
uugucacacgauaaa

SEQ ID NO: 600742 - RNA, 22 nt, Homo sapiens
uugucacccaaagccuguccca

SEQ ID NO: 600743 - RNA, 13 nt, Homo sapiens
uugucaccuguga

SEQ ID NO: 600744 - RNA, 16 nt, Homo sapiens
uugucagaaaccugca

SEQ ID NO: 600745 - RNA, 16 nt, Homo sapiens
uugucagccaccuccc

SEQ ID NO: 600746 - RNA, 21 nt, Homo sapiens
uugucagccaucguccuggga

SEQ ID NO: 600747 - RNA, 18 nt, Homo sapiens
uugucaguucuuggugcu

SEQ ID NO: 600748 - RNA, 16 nt, Homo sapiens
uugucauaaaaugcau

SEQ ID NO: 600749 - RNA, 16 nt, Homo sapiens
uugucauagacuccuu

SEQ ID NO: 600750 - RNA, 22 nt, Homo sapiens
uugucauggaaaauguccugug

SEQ ID NO: 600751 - RNA, 12 nt, Homo sapiens
uugucauucaag

SEQ ID NO: 600752 - RNA, 19 nt, Homo sapiens
uugucauugaaauuuggca

SEQ ID NO: 600753 - RNA, 19 nt, Homo sapiens
uugucauugagccuggcaa

SEQ ID NO: 600754 - RNA, 20 nt, Homo sapiens
uugucauuuuaaaaucugau

SEQ ID NO: 600755 - RNA, 20 nt, Homo sapiens
uuguccaggaacugccuggg

SEQ ID NO: 600756 - RNA, 22 nt, Homo sapiens
uuguccaggcuggagugcaaug

SEQ ID NO: 600757 - RNA, 20 nt, Homo sapiens
uuguccauuacuugccaggg

SEQ ID NO: 600758 - RNA, 18 nt, Homo sapiens
uuguccccacuuacagau

SEQ ID NO: 600759 - RNA, 14 nt, Homo sapiens
uugucccucugccc

SEQ ID NO: 600760 - RNA, 14 nt, Homo sapiens
uugucccucugcua

SEQ ID NO: 600761 - RNA, 15 nt, Homo sapiens
uugucccucugcuac

SEQ ID NO: 600762 - RNA, 18 nt, Homo sapiens
uugucccucuuugaggga

SEQ ID NO: 600763 - RNA, 18 nt, Homo sapiens
uugucccugugccuaaca

SEQ ID NO: 600764 - RNA, 14 nt, Homo sapiens
uuguccuaugucaa

SEQ ID NO: 600765 - RNA, 23 nt, Homo sapiens
uuguccuccugauccugacacau

SEQ ID NO: 600766 - RNA, 18 nt, Homo sapiens
uugucuaaacaaugcuga

SEQ ID NO: 600767 - RNA, 23 nt, Homo sapiens
uugucuaauuaaaacacuuucaa

SEQ ID NO: 600768 - RNA, 15 nt, Homo sapiens
uugucuacucugaag

SEQ ID NO: 600769 - RNA, 12 nt, Homo sapiens
uugucucagaug

SEQ ID NO: 600770 - RNA, 17 nt, Homo sapiens
uugucucugaugcagcu

SEQ ID NO: 600771 - RNA, 13 nt, Homo sapiens
uugucucugucac

SEQ ID NO: 600772 - RNA, 20 nt, Homo sapiens
uugucuguacauacuggccu

SEQ ID NO: 600773 - RNA, 22 nt, Homo sapiens
uugucuuuaaauagauacaaau

SEQ ID NO: 600774 - RNA, 20 nt, Homo sapiens
uugucuuuccuggcacuaac

SEQ ID NO: 600775 - RNA, 21 nt, Homo sapiens
uugucuuuuuuuucauccuuu

SEQ ID NO: 600776 - RNA, 21 nt, Homo sapiens
uugugaaaacgcaaacaugaa

SEQ ID NO: 600777 - RNA, 21 nt, Homo sapiens
uugugaacgcugugaugcugu

SEQ ID NO: 600778 - RNA, 15 nt, Homo sapiens
uugugaauuugggua

SEQ ID NO: 600779 - RNA, 16 nt, Homo sapiens
uugugacucuuuccua

SEQ ID NO: 600780 - RNA, 15 nt, Homo sapiens
uugugauagcacuuu

SEQ ID NO: 600781 - RNA, 17 nt, Homo sapiens
uugugauauagaacaaa

SEQ ID NO: 600782 - RNA, 16 nt, Homo sapiens
uugugauccaccccgc

SEQ ID NO: 600783 - RNA, 19 nt, Homo sapiens
uugugaucucacacacaga

SEQ ID NO: 600784 - RNA, 16 nt, Homo sapiens
uugugaugaacauauu

SEQ ID NO: 600785 - RNA, 19 nt, Homo sapiens
uugugaugaugcugugaca

SEQ ID NO: 600786 - RNA, 20 nt, Homo sapiens
uugugaugaugcugugacaa

SEQ ID NO: 600787 - RNA, 20 nt, Homo sapiens
uugugauuuuuauaauacaa

SEQ ID NO: 600788 - RNA, 24 nt, Homo sapiens
uugugcaggguguguacugcacaa

SEQ ID NO: 600789 - RNA, 12 nt, Homo sapiens
uugugcauuugg

SEQ ID NO: 600790 - RNA, 19 nt, Homo sapiens
uugugccacuacacuccag

SEQ ID NO: 600791 - RNA, 11 nt, Homo sapiens
uugugccaggu

SEQ ID NO: 600792 - RNA, 14 nt, Homo sapiens
uugugcccauuccu

SEQ ID NO: 600793 - RNA, 23 nt, Homo sapiens
uugugcuauuaggaaauucugau

SEQ ID NO: 600794 - RNA, 22 nt, Homo sapiens
uugugcucaaaauaaaaagccu

SEQ ID NO: 600795 - RNA, 16 nt, Homo sapiens
uugugcugccauuuga

SEQ ID NO: 600796 - RNA, 23 nt, Homo sapiens
uugugcuuaguccaauuccuugc

SEQ ID NO: 600797 - RNA, 18 nt, Homo sapiens
uuguggaagcacuugcua

SEQ ID NO: 600798 - RNA, 19 nt, Homo sapiens
uugugggacacaacacaga

SEQ ID NO: 600799 - RNA, 17 nt, Homo sapiens
uuguggguccaugcuaa

SEQ ID NO: 600800 - RNA, 19 nt, Homo sapiens
uugugguaacuugcugcuu

SEQ ID NO: 600801 - RNA, 16 nt, Homo sapiens
uuguguauccaugcac

SEQ ID NO: 600802 - RNA, 21 nt, Homo sapiens
uuguguauuccacuuaggaag

SEQ ID NO: 600803 - RNA, 14 nt, Homo sapiens
uugugucaaaacug

SEQ ID NO: 600804 - RNA, 19 nt, Homo sapiens
uugugucuuuuaaacugga

SEQ ID NO: 600805 - RNA, 18 nt, Homo sapiens
uuguguggaugaccacau

SEQ ID NO: 600806 - RNA, 16 nt, Homo sapiens
uuguguguaugcugau

SEQ ID NO: 600807 - RNA, 19 nt, Homo sapiens
uuguguguauuuguauuaa

SEQ ID NO: 600808 - RNA, 17 nt, Homo sapiens
uugugugugggcuguga

SEQ ID NO: 600809 - RNA, 12 nt, Homo sapiens
uuguguguucua

SEQ ID NO: 600810 - RNA, 21 nt, Homo sapiens
uuguguguuuauuucacuuga

SEQ ID NO: 600811 - RNA, 22 nt, Homo sapiens
uuguguugacacauaugaacac

SEQ ID NO: 600812 - RNA, 13 nt, Homo sapiens
uuguuaaugucau

SEQ ID NO: 600813 - RNA, 18 nt, Homo sapiens
uuguuaccuuuaugguuu

SEQ ID NO: 600814 - RNA, 15 nt, Homo sapiens
uuguuaucagucaau

SEQ ID NO: 600815 - RNA, 19 nt, Homo sapiens
uuguuaucuuccacuggaa

SEQ ID NO: 600816 - RNA, 12 nt, Homo sapiens
uuguuauuucag

SEQ ID NO: 600817 - RNA, 17 nt, Homo sapiens
uuguucaaagcacagaa

SEQ ID NO: 600818 - RNA, 14 nt, Homo sapiens
uuguucaaauguuc

SEQ ID NO: 600819 - RNA, 17 nt, Homo sapiens
uuguuccagauggggcc

SEQ ID NO: 600820 - RNA, 17 nt, Homo sapiens
uuguucccgauggucuc

SEQ ID NO: 600821 - RNA, 14 nt, Homo sapiens
uuguuccuggggcu

SEQ ID NO: 600822 - RNA, 12 nt, Homo sapiens
uuguucugagua

SEQ ID NO: 600823 - RNA, 19 nt, Homo sapiens
uuguucuguuuugugagaa

SEQ ID NO: 600824 - RNA, 22 nt, Homo sapiens
uuguugaaagcugaaaagcaua

SEQ ID NO: 600825 - RNA, 12 nt, Homo sapiens
uuguugcacugc

SEQ ID NO: 600826 - RNA, 18 nt, Homo sapiens
uuguugccuucaucuuca

SEQ ID NO: 600827 - RNA, 16 nt, Homo sapiens
uuguuggauaaaucag

SEQ ID NO: 600828 - RNA, 14 nt, Homo sapiens
uuguuguugccaaa

SEQ ID NO: 600829 - RNA, 15 nt, Homo sapiens
uuguuguuucuugcc

SEQ ID NO: 600830 - RNA, 23 nt, Homo sapiens
uuguuuaaagaauaaaguccaaa

SEQ ID NO: 600831 - RNA, 23 nt, Homo sapiens
uuguuuaccauagaaagaugaca

SEQ ID NO: 600832 - RNA, 20 nt, Homo sapiens
uuguuuagauaugacauuua

SEQ ID NO: 600833 - RNA, 13 nt, Homo sapiens
uuguuuauacaca

SEQ ID NO: 600834 - RNA, 22 nt, Homo sapiens
uuguuuccucuuccaaaguaaa

SEQ ID NO: 600835 - RNA, 16 nt, Homo sapiens
uuguuucugcauucau

SEQ ID NO: 600836 - RNA, 14 nt, Homo sapiens
uuguuucuugccug

SEQ ID NO: 600837 - RNA, 12 nt, Homo sapiens
uuguuugcuuac

SEQ ID NO: 600838 - RNA, 15 nt, Homo sapiens
uuguuugcuucuugc

SEQ ID NO: 600839 - RNA, 12 nt, Homo sapiens
uuguuugggauu

SEQ ID NO: 600840 - RNA, 14 nt, Homo sapiens
uuguuuggugaauu

SEQ ID NO: 600841 - RNA, 20 nt, Homo sapiens
ucaccaacugaaguggcuaa

SEQ ID NO: 600842 - RNA, 20 nt, Homo sapiens
ucaccaagcuaggugcuauu

SEQ ID NO: 600843 - RNA, 19 nt, Homo sapiens
ucaccaagcucacaguucc

SEQ ID NO: 600844 - RNA, 21 nt, Homo sapiens
ucaccaaggaaacgcuaccuc

SEQ ID NO: 600845 - RNA, 22 nt, Homo sapiens
ucaccaauaaauaagugcauuu

SEQ ID NO: 600846 - RNA, 16 nt, Homo sapiens
ucaccaaugagccuua

SEQ ID NO: 600847 - RNA, 17 nt, Homo sapiens
ucaccaaugagccuuag

SEQ ID NO: 600848 - RNA, 18 nt, Homo sapiens
ucaccaauuccaccaaga

SEQ ID NO: 600849 - RNA, 15 nt, Homo sapiens
ucaccacccugcuca

SEQ ID NO: 600850 - RNA, 16 nt, Homo sapiens
ucaccacuaccagcca

SEQ ID NO: 600851 - RNA, 14 nt, Homo sapiens
ucaccacucaaaaa

SEQ ID NO: 600852 - RNA, 15 nt, Homo sapiens
ucaccagaaccaguu

SEQ ID NO: 600853 - RNA, 15 nt, Homo sapiens
ucaccagagcauuuc

SEQ ID NO: 600854 - RNA, 19 nt, Homo sapiens
ucaccagccccacugccag

SEQ ID NO: 600855 - RNA, 20 nt, Homo sapiens
ucaccauaguuuuguuuaau

SEQ ID NO: 600856 - RNA, 19 nt, Homo sapiens
uuuaaaaauaaauucaaau

SEQ ID NO: 600857 - RNA, 20 nt, Homo sapiens
uuuaaaaauguuuuccccaa

SEQ ID NO: 600858 - RNA, 22 nt, Homo sapiens
uuuaaaaauuauauacauauau

SEQ ID NO: 600859 - RNA, 20 nt, Homo sapiens
uuuaaaaccugugugccauu

SEQ ID NO: 600860 - RNA, 18 nt, Homo sapiens
uuuaaaacgcaugugcag

SEQ ID NO: 600861 - RNA, 22 nt, Homo sapiens
uuuaaaaggcccuguggucugg

SEQ ID NO: 600862 - RNA, 17 nt, Homo sapiens
uuuaaaauaagaucucu

SEQ ID NO: 600863 - RNA, 19 nt, Homo sapiens
uuuaaaauaagcuuucuca

SEQ ID NO: 600864 - RNA, 20 nt, Homo sapiens
uuuaaaaugcugcuuugucc

SEQ ID NO: 600865 - RNA, 15 nt, Homo sapiens
uuuaaaauucaauua

SEQ ID NO: 600866 - RNA, 14 nt, Homo sapiens
uuuaaaauucuaau

SEQ ID NO: 600867 - RNA, 16 nt, Homo sapiens
uuuaaaauuuguccua

SEQ ID NO: 600868 - RNA, 12 nt, Homo sapiens
uuuaaacaguga

SEQ ID NO: 600869 - RNA, 21 nt, Homo sapiens
uuuaaaccaccuaguucuccc

SEQ ID NO: 600870 - RNA, 12 nt, Homo sapiens
uuuaaacccaau

SEQ ID NO: 600871 - RNA, 19 nt, Homo sapiens
uuuaaaccugauuuacuag

SEQ ID NO: 600872 - RNA, 12 nt, Homo sapiens
uuuaaacuaaga

SEQ ID NO: 600873 - RNA, 16 nt, Homo sapiens
uuuaaacuauaagcaa

SEQ ID NO: 600874 - RNA, 22 nt, Homo sapiens
uuuaaacucaagacaaugcacc

SEQ ID NO: 600875 - RNA, 13 nt, Homo sapiens
uuuaaacuguaca

SEQ ID NO: 600876 - RNA, 23 nt, Homo sapiens
uuuaaagaaaaauaugauacucu

SEQ ID NO: 600877 - RNA, 22 nt, Homo sapiens
uuuaaagaauaugaaguucuau

SEQ ID NO: 600878 - RNA, 16 nt, Homo sapiens
uuuaaagacucaaggu

SEQ ID NO: 600879 - RNA, 19 nt, Homo sapiens
uuuaaagagaguuugccac

SEQ ID NO: 600880 - RNA, 18 nt, Homo sapiens
uuuaaagauguaaaaccu

SEQ ID NO: 600881 - RNA, 17 nt, Homo sapiens
uuuaaagcacaugccuu

SEQ ID NO: 600882 - RNA, 22 nt, Homo sapiens
uuuaaagccagaagucacauuu

SEQ ID NO: 600883 - RNA, 14 nt, Homo sapiens
uuuaaagccuccuc

SEQ ID NO: 600884 - RNA, 20 nt, Homo sapiens
uuuaaaggaaaaucacaucu

SEQ ID NO: 600885 - RNA, 11 nt, Homo sapiens
uuuaaaguaaa

SEQ ID NO: 600886 - RNA, 21 nt, Homo sapiens
uuuaaaguauguuauugcaua

SEQ ID NO: 600887 - RNA, 14 nt, Homo sapiens
uuuaaagugauuaa

SEQ ID NO: 600888 - RNA, 23 nt, Homo sapiens
uuuaaauaaacgucuuugcugcg

SEQ ID NO: 600889 - RNA, 23 nt, Homo sapiens
uuuaaauacagucuuccauuugc

SEQ ID NO: 600890 - RNA, 14 nt, Homo sapiens
uuuaaauagaccuc

SEQ ID NO: 600891 - RNA, 13 nt, Homo sapiens
uuuaaaucaagga

SEQ ID NO: 600892 - RNA, 18 nt, Homo sapiens
uuuaaauguguacaaugu

SEQ ID NO: 600893 - RNA, 13 nt, Homo sapiens
uuuaaauguuacu

SEQ ID NO: 600894 - RNA, 14 nt, Homo sapiens
uuuaaauguucaca

SEQ ID NO: 600895 - RNA, 22 nt, Homo sapiens
uuuaaauuacaauuuuaucugu

SEQ ID NO: 600896 - RNA, 15 nt, Homo sapiens
uuuaaauuauacugu

SEQ ID NO: 600897 - RNA, 14 nt, Homo sapiens
uuuaaauuccacag

SEQ ID NO: 600898 - RNA, 15 nt, Homo sapiens
uuuaaauugauagca

SEQ ID NO: 600899 - RNA, 18 nt, Homo sapiens
uuuaaauugauagcagau

SEQ ID NO: 600900 - RNA, 13 nt, Homo sapiens
uuuaacaauaacu

SEQ ID NO: 600901 - RNA, 19 nt, Homo sapiens
uuuaacauuguugauuuca

SEQ ID NO: 600902 - RNA, 18 nt, Homo sapiens
uuuaacccuaaucuuuca

SEQ ID NO: 600903 - RNA, 20 nt, Homo sapiens
uuuaacccugauucauacuc

SEQ ID NO: 600904 - RNA, 17 nt, Homo sapiens
uuuaaccgcacaugcac

SEQ ID NO: 600905 - RNA, 14 nt, Homo sapiens
uuuaacuacuuuac

SEQ ID NO: 600906 - RNA, 21 nt, Homo sapiens
uuuaacuagaauuuauucaau

SEQ ID NO: 600907 - RNA, 14 nt, Homo sapiens
uuuaacugcauaau

SEQ ID NO: 600908 - RNA, 17 nt, Homo sapiens
uuuaacuuaacauucug

SEQ ID NO: 600909 - RNA, 19 nt, Homo sapiens
uuuaacuuaagggagaaaa

SEQ ID NO: 600910 - RNA, 20 nt, Homo sapiens
uuuaacuucuuucuauuuga

SEQ ID NO: 600911 - RNA, 22 nt, Homo sapiens
uuuaagaaaacaaguauauaau

SEQ ID NO: 600912 - RNA, 19 nt, Homo sapiens
uuuaagaacaaacucugaa

SEQ ID NO: 600913 - RNA, 12 nt, Homo sapiens
uuuaagaagcau

SEQ ID NO: 600914 - RNA, 15 nt, Homo sapiens
uuuaagaauugccag

SEQ ID NO: 600915 - RNA, 17 nt, Homo sapiens
uuuaagacuaugauuua

SEQ ID NO: 600916 - RNA, 21 nt, Homo sapiens
uuuaagacugauaauuuuaca

SEQ ID NO: 600917 - RNA, 22 nt, Homo sapiens
uuuaagaggcuuuggcccaaug

SEQ ID NO: 600918 - RNA, 16 nt, Homo sapiens
uuuaagauaaacagaa

SEQ ID NO: 600919 - RNA, 17 nt, Homo sapiens
uuuaagauguacauuua

SEQ ID NO: 600920 - RNA, 17 nt, Homo sapiens
uuuaagccgaagggcaa

SEQ ID NO: 600921 - RNA, 23 nt, Homo sapiens
uuuaagccgaagggcaauaucua

SEQ ID NO: 600922 - RNA, 14 nt, Homo sapiens
uuuaagcuaccaau

SEQ ID NO: 600923 - RNA, 23 nt, Homo sapiens
uuuaagcuaucagcaauacucau

SEQ ID NO: 600924 - RNA, 14 nt, Homo sapiens
uuuaaggagcaaaa

SEQ ID NO: 600925 - RNA, 23 nt, Homo sapiens
uuuaaggauguugccacuggcaa

SEQ ID NO: 600926 - RNA, 12 nt, Homo sapiens
uuuaaggcaaaa

SEQ ID NO: 600927 - RNA, 12 nt, Homo sapiens
uuuaaggcuaaa

SEQ ID NO: 600928 - RNA, 14 nt, Homo sapiens
uuuaagguaacaaa

SEQ ID NO: 600929 - RNA, 13 nt, Homo sapiens
uuuaagguacuga

SEQ ID NO: 600930 - RNA, 19 nt, Homo sapiens
uuuaaguaaaaauccaaaa

SEQ ID NO: 600931 - RNA, 12 nt, Homo sapiens
uuuaaguaggaa

SEQ ID NO: 600932 - RNA, 17 nt, Homo sapiens
uuuaaguaguaagaaua

SEQ ID NO: 600933 - RNA, 17 nt, Homo sapiens
uuuaaguauauaguaua

SEQ ID NO: 600934 - RNA, 14 nt, Homo sapiens
uuuaagugcaauua

SEQ ID NO: 600935 - RNA, 22 nt, Homo sapiens
uuuaauacaggguagauaaccu

SEQ ID NO: 600936 - RNA, 14 nt, Homo sapiens
uuuaauacauuaag

SEQ ID NO: 600937 - RNA, 19 nt, Homo sapiens
uuuaauagaaauaaauucc

SEQ ID NO: 600938 - RNA, 16 nt, Homo sapiens
uuuaauagaauauaau

SEQ ID NO: 600939 - RNA, 22 nt, Homo sapiens
uuuaauagcacuaaccaaugcc

SEQ ID NO: 600940 - RNA, 21 nt, Homo sapiens
uuuaauaggugcagucuuuga

SEQ ID NO: 600941 - RNA, 13 nt, Homo sapiens
uuuaauagucauu

SEQ ID NO: 600942 - RNA, 13 nt, Homo sapiens
uuuaauauaugca

SEQ ID NO: 600943 - RNA, 14 nt, Homo sapiens
uuuaaucaccacuc

SEQ ID NO: 600944 - RNA, 14 nt, Homo sapiens
uuuaaucucuaaca

SEQ ID NO: 600945 - RNA, 19 nt, Homo sapiens
uuuaaucucuaacagugga

SEQ ID NO: 600946 - RNA, 20 nt, Homo sapiens
uuuaaugaauuuaaggcaaa

SEQ ID NO: 600947 - RNA, 12 nt, Homo sapiens
uuuaaugaguca

SEQ ID NO: 600948 - RNA, 17 nt, Homo sapiens
uuuaauggauauuucuc

SEQ ID NO: 600949 - RNA, 22 nt, Homo sapiens
uuuaaugguuaagaacugugaa

SEQ ID NO: 600950 - RNA, 19 nt, Homo sapiens
uuuaauguaauagggaaaa

SEQ ID NO: 600951 - RNA, 21 nt, Homo sapiens
uuuaauguugcccacauuaag

SEQ ID NO: 600952 - RNA, 21 nt, Homo sapiens
uuuaauguuuauuauuuacau

SEQ ID NO: 600953 - RNA, 19 nt, Homo sapiens
uuuaauguuuuuugccaca

SEQ ID NO: 600954 - RNA, 22 nt, Homo sapiens
uuuaauucucauuuguucucac

SEQ ID NO: 600955 - RNA, 14 nt, Homo sapiens
uuuaauuuugagau

SEQ ID NO: 600956 - RNA, 16 nt, Homo sapiens
uuuacaaaagauguau

SEQ ID NO: 600957 - RNA, 20 nt, Homo sapiens
uuuacaauuugacauacaaa

SEQ ID NO: 600958 - RNA, 16 nt, Homo sapiens
uuuacacuacauugua

SEQ ID NO: 600959 - RNA, 22 nt, Homo sapiens
uuuacacugggagaggugccag

SEQ ID NO: 600960 - RNA, 20 nt, Homo sapiens
uuuacagaaaagacucugac

SEQ ID NO: 600961 - RNA, 14 nt, Homo sapiens
uuuacagacuguga

SEQ ID NO: 600962 - RNA, 19 nt, Homo sapiens
uuuacagcacuacucugug

SEQ ID NO: 600963 - RNA, 18 nt, Homo sapiens
uuuacagucaaucuauga

SEQ ID NO: 600964 - RNA, 21 nt, Homo sapiens
ucacuuagaauccgaagggaa

SEQ ID NO: 600965 - RNA, 15 nt, Homo sapiens
ucacuuauaccaaag

SEQ ID NO: 600966 - RNA, 19 nt, Homo sapiens
ucacuucauagcucaccag

SEQ ID NO: 600967 - RNA, 15 nt, Homo sapiens
ucacuuccccacagg

SEQ ID NO: 600968 - RNA, 14 nt, Homo sapiens
ucacuugagaccag

SEQ ID NO: 600969 - RNA, 17 nt, Homo sapiens
ucacuugaggucaggag

SEQ ID NO: 600970 - RNA, 12 nt, Homo sapiens
ucacuugcucaa

SEQ ID NO: 600971 - RNA, 13 nt, Homo sapiens
ucacuugcucaaa

SEQ ID NO: 600972 - RNA, 17 nt, Homo sapiens
ucacuuuaaagcccuuu

SEQ ID NO: 600973 - RNA, 21 nt, Homo sapiens
ucacuuucauuuuugauagcu

SEQ ID NO: 600974 - RNA, 23 nt, Homo sapiens
ucacuuugcagaggcuggaagac

SEQ ID NO: 600975 - RNA, 14 nt, Homo sapiens
ucacuuugccauua

SEQ ID NO: 600976 - RNA, 20 nt, Homo sapiens
ucacuuuucaauuugucaug

SEQ ID NO: 600977 - RNA, 14 nt, Homo sapiens
ucagaaaaguaauu

SEQ ID NO: 600978 - RNA, 23 nt, Homo sapiens
uuuaccuuguggaugcuagugcu

SEQ ID NO: 600979 - RNA, 13 nt, Homo sapiens
uuuacuaacacug

SEQ ID NO: 600980 - RNA, 16 nt, Homo sapiens
uuuacucuuaugauca

SEQ ID NO: 600981 - RNA, 24 nt, Homo sapiens
uuuacuuccauaggacauacugca

SEQ ID NO: 600982 - RNA, 13 nt, Homo sapiens
uuuacuuccucag

SEQ ID NO: 600983 - RNA, 13 nt, Homo sapiens
uuuacuucuuuag

SEQ ID NO: 600984 - RNA, 22 nt, Homo sapiens
uuuagaaaaacaucccaagaaa

SEQ ID NO: 600985 - RNA, 15 nt, Homo sapiens
uuuagaaaaagucaa

SEQ ID NO: 600986 - RNA, 15 nt, Homo sapiens
uuuagaaaacauucu

SEQ ID NO: 600987 - RNA, 23 nt, Homo sapiens
uuuagaaaagaaagcaaacuuaa

SEQ ID NO: 600988 - RNA, 18 nt, Homo sapiens
uuuagaacuugcagcuga

SEQ ID NO: 600989 - RNA, 20 nt, Homo sapiens
uuuagaacuuuggcugccuu

SEQ ID NO: 600990 - RNA, 19 nt, Homo sapiens
uuuagaagaaaaaaccacc

SEQ ID NO: 600991 - RNA, 21 nt, Homo sapiens
uuuagaagauagaugcacuua

SEQ ID NO: 600992 - RNA, 14 nt, Homo sapiens
uuuagaagcaaaga

SEQ ID NO: 600993 - RNA, 21 nt, Homo sapiens
uuuagaaggacucaguauuau

SEQ ID NO: 600994 - RNA, 22 nt, Homo sapiens
uuuagaauaagaauuugcauac

SEQ ID NO: 600995 - RNA, 14 nt, Homo sapiens
uuuagagaaguaua

SEQ ID NO: 600996 - RNA, 18 nt, Homo sapiens
uuuagauaugacauuuau

SEQ ID NO: 600997 - RNA, 18 nt, Homo sapiens
uuuagauuuucuuuugcc

SEQ ID NO: 600998 - RNA, 16 nt, Homo sapiens
uuuagcagaggagcca

SEQ ID NO: 600999 - RNA, 19 nt, Homo sapiens
uuuagccacucaaagucaa

SEQ ID NO: 601000 - RNA, 16 nt, Homo sapiens
uuuagccagugacuuu

SEQ ID NO: 601001 - RNA, 13 nt, Homo sapiens
uuuagcccuaaaa

SEQ ID NO: 601002 - RNA, 18 nt, Homo sapiens
uuuagccuaggaguaaga

SEQ ID NO: 601003 - RNA, 19 nt, Homo sapiens
uuuagcguagcuaagugaa

SEQ ID NO: 601004 - RNA, 14 nt, Homo sapiens
uuuagcuaccucac

SEQ ID NO: 601005 - RNA, 22 nt, Homo sapiens
uuuagcuaccucacuaugcugc

SEQ ID NO: 601006 - RNA, 21 nt, Homo sapiens
uuuaggaaaaauaauucuauu

SEQ ID NO: 601007 - RNA, 22 nt, Homo sapiens
uuuaggaaaaucacuuugucua

SEQ ID NO: 601008 - RNA, 13 nt, Homo sapiens
uuuaggagugugu

SEQ ID NO: 601009 - RNA, 15 nt, Homo sapiens
uuuaggauuacuuag

SEQ ID NO: 601010 - RNA, 21 nt, Homo sapiens
uuuaguaauauuuuacuuuga

SEQ ID NO: 601011 - RNA, 13 nt, Homo sapiens
uuuaguauccaca

SEQ ID NO: 601012 - RNA, 17 nt, Homo sapiens
uuuagugcuuugugaua

SEQ ID NO: 601013 - RNA, 12 nt, Homo sapiens
uuuaguggcuca

SEQ ID NO: 601014 - RNA, 17 nt, Homo sapiens
uuuaguguuuuuaccuc

SEQ ID NO: 601015 - RNA, 16 nt, Homo sapiens
uuuaguuacguauaau

SEQ ID NO: 601016 - RNA, 14 nt, Homo sapiens
uuuaguuauaaaca

SEQ ID NO: 601017 - RNA, 13 nt, Homo sapiens
uuuaguuauauuc

SEQ ID NO: 601018 - RNA, 19 nt, Homo sapiens
uuuaguuugaucagacagc

SEQ ID NO: 601019 - RNA, 20 nt, Homo sapiens
uuuaguuuuucccucaguga

SEQ ID NO: 601020 - RNA, 19 nt, Homo sapiens
uuuaguuuuuuuaaugugu

SEQ ID NO: 601021 - RNA, 13 nt, Homo sapiens
uuuauaaaaucaa

SEQ ID NO: 601022 - RNA, 16 nt, Homo sapiens
uuuauaaaauuuugcu

SEQ ID NO: 601023 - RNA, 13 nt, Homo sapiens
uuuauaaauuacu

SEQ ID NO: 601024 - RNA, 17 nt, Homo sapiens
uuuauaaccugaugcca

SEQ ID NO: 601025 - RNA, 13 nt, Homo sapiens
uuuauaacuaagg

SEQ ID NO: 601026 - RNA, 13 nt, Homo sapiens
uuuauaagucauu

SEQ ID NO: 601027 - RNA, 14 nt, Homo sapiens
uuuauaauacccuu

SEQ ID NO: 601028 - RNA, 13 nt, Homo sapiens
uuuauaauguugu

SEQ ID NO: 601029 - RNA, 23 nt, Homo sapiens
uuuauacaauuuccauauagucu

SEQ ID NO: 601030 - RNA, 12 nt, Homo sapiens
uuuauacaggaa

SEQ ID NO: 601031 - RNA, 22 nt, Homo sapiens
uuuauacucuagaacaugcaca

SEQ ID NO: 601032 - RNA, 18 nt, Homo sapiens
uuuauagaggcuagcuuc

SEQ ID NO: 601033 - RNA, 14 nt, Homo sapiens
uuuauagagugucu

SEQ ID NO: 601034 - RNA, 12 nt, Homo sapiens
uuuauagcuguu

SEQ ID NO: 601035 - RNA, 19 nt, Homo sapiens
uuuauaggcauaccuccua

SEQ ID NO: 601036 - RNA, 22 nt, Homo sapiens
uuuauaucaaaugccuucauga

SEQ ID NO: 601037 - RNA, 11 nt, Homo sapiens
uuuauaugcac

SEQ ID NO: 601038 - RNA, 17 nt, Homo sapiens
uuuauauguacaugaga

SEQ ID NO: 601039 - RNA, 13 nt, Homo sapiens
uuuauauguugcu

SEQ ID NO: 601040 - RNA, 19 nt, Homo sapiens
uuuauauguugcuauaaua

SEQ ID NO: 601041 - RNA, 19 nt, Homo sapiens
uuuaucacacuucugugag

SEQ ID NO: 601042 - RNA, 23 nt, Homo sapiens
uuuaucagagucaugaugaauca

SEQ ID NO: 601043 - RNA, 17 nt, Homo sapiens
uuuaucaugaagcacau

SEQ ID NO: 601044 - RNA, 20 nt, Homo sapiens
uuuaucaugaagcacaucaa

SEQ ID NO: 601045 - RNA, 12 nt, Homo sapiens
uuuauccacuuu

SEQ ID NO: 601046 - RNA, 19 nt, Homo sapiens
uuuauccugagucccuuaa

SEQ ID NO: 601047 - RNA, 14 nt, Homo sapiens
uuuaucuauuggcc

SEQ ID NO: 601048 - RNA, 16 nt, Homo sapiens
uuuaucuuuauaugaa

SEQ ID NO: 601049 - RNA, 14 nt, Homo sapiens
uuuaugaaguuaaa

SEQ ID NO: 601050 - RNA, 14 nt, Homo sapiens
uuuaugaauaucau

SEQ ID NO: 601051 - RNA, 17 nt, Homo sapiens
uuuaugagaaacuuaaa

SEQ ID NO: 601052 - RNA, 13 nt, Homo sapiens
uuuaugaggaaac

SEQ ID NO: 601053 - RNA, 13 nt, Homo sapiens
uuuaugaguacuu

SEQ ID NO: 601054 - RNA, 19 nt, Homo sapiens
uuuaugaucuuggcuguau

SEQ ID NO: 601055 - RNA, 15 nt, Homo sapiens
uuuaugcacuucaaa

SEQ ID NO: 601056 - RNA, 22 nt, Homo sapiens
uuuaugcagaagcauauuuugc

SEQ ID NO: 601057 - RNA, 21 nt, Homo sapiens
uuuaugccacagaauuugcua

SEQ ID NO: 601058 - RNA, 22 nt, Homo sapiens
uuuaugguauuugagugugcaa

SEQ ID NO: 601059 - RNA, 11 nt, Homo sapiens
uuuauggugua

SEQ ID NO: 601060 - RNA, 15 nt, Homo sapiens
uuuauguaaaaccaa

SEQ ID NO: 601061 - RNA, 11 nt, Homo sapiens
uuuauucacau

SEQ ID NO: 601062 - RNA, 20 nt, Homo sapiens
uuuauuccagagaagccagg

SEQ ID NO: 601063 - RNA, 22 nt, Homo sapiens
uuuauucccaaguaugccuuaa

SEQ ID NO: 601064 - RNA, 16 nt, Homo sapiens
uuuauugauucaccuc

SEQ ID NO: 601065 - RNA, 16 nt, Homo sapiens
uuuauugcauugcugg

SEQ ID NO: 601066 - RNA, 13 nt, Homo sapiens
uuuauugccauga

SEQ ID NO: 601067 - RNA, 17 nt, Homo sapiens
uuuauuguuuucaacuc

SEQ ID NO: 601068 - RNA, 17 nt, Homo sapiens
uuuauuuguaaaccauu

SEQ ID NO: 601069 - RNA, 16 nt, Homo sapiens
uuucaaaaccuuuuga

SEQ ID NO: 601070 - RNA, 20 nt, Homo sapiens
uuucaaaagaagaguuuuag

SEQ ID NO: 601071 - RNA, 17 nt, Homo sapiens
uuucaaagaaauccaaa

SEQ ID NO: 601072 - RNA, 13 nt, Homo sapiens
uuucaaagcacaa

SEQ ID NO: 601073 - RNA, 14 nt, Homo sapiens
uuucaaagucucac

SEQ ID NO: 601074 - RNA, 14 nt, Homo sapiens
uuucaaaucauucc

SEQ ID NO: 601075 - RNA, 16 nt, Homo sapiens
uuucaacaaguaacuu

SEQ ID NO: 601076 - RNA, 15 nt, Homo sapiens
uuucaaccuugccag

SEQ ID NO: 601077 - RNA, 13 nt, Homo sapiens
uuucaacugccaa

SEQ ID NO: 601078 - RNA, 19 nt, Homo sapiens
uuucaacugucuuccucaa

SEQ ID NO: 601079 - RNA, 20 nt, Homo sapiens
uuucaagagugagcuaucaa

SEQ ID NO: 601080 - RNA, 24 nt, Homo sapiens
uuucaaguuauucaaauuuguaca

SEQ ID NO: 601081 - RNA, 19 nt, Homo sapiens
uuucaauuagggaugcuca

SEQ ID NO: 601082 - RNA, 20 nt, Homo sapiens
uuucaauucuguaauuacau

SEQ ID NO: 601083 - RNA, 12 nt, Homo sapiens
uuucaauugcau

SEQ ID NO: 601084 - RNA, 11 nt, Homo sapiens
uuucacaagcu

SEQ ID NO: 601085 - RNA, 22 nt, Homo sapiens
uuucacacuggauccaucuuga

SEQ ID NO: 601086 - RNA, 15 nt, Homo sapiens
uuucacauaaaaccu

SEQ ID NO: 601087 - RNA, 16 nt, Homo sapiens
uuucacauuguacuua

SEQ ID NO: 601088 - RNA, 19 nt, Homo sapiens
uuucaccaaugagccuuag

SEQ ID NO: 601089 - RNA, 16 nt, Homo sapiens
ucagcuacacaaggaa

SEQ ID NO: 601090 - RNA, 20 nt, Homo sapiens
ucagcuacuucugaaacugc

SEQ ID NO: 601091 - RNA, 16 nt, Homo sapiens
ucagcucaggcagcuc

SEQ ID NO: 601092 - RNA, 20 nt, Homo sapiens
ucagcuccuucaaugcaaag

SEQ ID NO: 601093 - RNA, 12 nt, Homo sapiens
ucagcuccuucc

SEQ ID NO: 601094 - RNA, 23 nt, Homo sapiens
ucagcucuuuggaucagucuuug

SEQ ID NO: 601095 - RNA, 15 nt, Homo sapiens
ucagcugaaugccuc

SEQ ID NO: 601096 - RNA, 15 nt, Homo sapiens
ucagcugcucccaca

SEQ ID NO: 601097 - RNA, 17 nt, Homo sapiens
ucagcuuucccugccac

SEQ ID NO: 601098 - RNA, 13 nt, Homo sapiens
ucagcuuugccuu

SEQ ID NO: 601099 - RNA, 18 nt, Homo sapiens
ucagcuuuuguucuagac

SEQ ID NO: 601100 - RNA, 19 nt, Homo sapiens
ucagcuuuuguucuagacu

SEQ ID NO: 601101 - RNA, 20 nt, Homo sapiens
ucauuccuuagauaccuuga

SEQ ID NO: 601102 - RNA, 17 nt, Homo sapiens
ucauucucauaauuccu

SEQ ID NO: 601103 - RNA, 15 nt, Homo sapiens
ucauucucauucuca

SEQ ID NO: 601104 - RNA, 17 nt, Homo sapiens
ucauucugccugcucca

SEQ ID NO: 601105 - RNA, 18 nt, Homo sapiens
ucauucugccugcuccau

SEQ ID NO: 601106 - RNA, 18 nt, Homo sapiens
ucauucuguuagauacua

SEQ ID NO: 601107 - RNA, 19 nt, Homo sapiens
ucauugcccgaaaccagag

SEQ ID NO: 601108 - RNA, 13 nt, Homo sapiens
ucauugcuaccuc

SEQ ID NO: 601109 - RNA, 19 nt, Homo sapiens
ucauugcuguaccacaucu

SEQ ID NO: 601110 - RNA, 15 nt, Homo sapiens
ucauuggaagccauc

SEQ ID NO: 601111 - RNA, 12 nt, Homo sapiens
ucauuggcucca

SEQ ID NO: 601112 - RNA, 11 nt, Homo sapiens
ucauuguacug

SEQ ID NO: 601113 - RNA, 17 nt, Homo sapiens
ucauuguagaaacacag

SEQ ID NO: 601114 - RNA, 13 nt, Homo sapiens
ucauuguauucag

SEQ ID NO: 601115 - RNA, 22 nt, Homo sapiens
ucauugucccucuucacucccc

SEQ ID NO: 601116 - RNA, 19 nt, Homo sapiens
ucauugucgcucagcaaua

SEQ ID NO: 601117 - RNA, 20 nt, Homo sapiens
ucauuuagugacuuaauucu

SEQ ID NO: 601118 - RNA, 21 nt, Homo sapiens
ucauuuauucuucuuuuccaa

SEQ ID NO: 601119 - RNA, 12 nt, Homo sapiens
ucauuucacugu

SEQ ID NO: 601120 - RNA, 13 nt, Homo sapiens
ucauuucaucuca

SEQ ID NO: 601121 - RNA, 14 nt, Homo sapiens
ucauuucauuccau

SEQ ID NO: 601122 - RNA, 17 nt, Homo sapiens
ucauuuccugcccuucc

SEQ ID NO: 601123 - RNA, 14 nt, Homo sapiens
ucauuucugccaug

SEQ ID NO: 601124 - RNA, 22 nt, Homo sapiens
ucauuucuggaaagugcaauua

SEQ ID NO: 601125 - RNA, 13 nt, Homo sapiens
ucauuugagauaa

SEQ ID NO: 601126 - RNA, 19 nt, Homo sapiens
ucauuuguuuacauuugau

SEQ ID NO: 601127 - RNA, 21 nt, Homo sapiens
ucauuuuacucuuaugaucaa

SEQ ID NO: 601128 - RNA, 15 nt, Homo sapiens
ucauuuuauucuuau

SEQ ID NO: 601129 - RNA, 14 nt, Homo sapiens
ucauuuuauugcua

SEQ ID NO: 601130 - RNA, 21 nt, Homo sapiens
ucauuuugugaauacuaugua

SEQ ID NO: 601131 - RNA, 14 nt, Homo sapiens
ucauuuuguucuga

SEQ ID NO: 601132 - RNA, 17 nt, Homo sapiens
ucauuuuuaaagccugg

SEQ ID NO: 601133 - RNA, 17 nt, Homo sapiens
ucauuuuuaacagcaug

SEQ ID NO: 601134 - RNA, 23 nt, Homo sapiens
ucauuuuuaacagcaugcugcuu

SEQ ID NO: 601135 - RNA, 21 nt, Homo sapiens
ucauuuuucacuguacauuau

SEQ ID NO: 601136 - RNA, 17 nt, Homo sapiens
ucauuuuuuucacugga

SEQ ID NO: 601137 - RNA, 18 nt, Homo sapiens
ucauuuuuuucacuggag

SEQ ID NO: 601138 - RNA, 23 nt, Homo sapiens
ucauuuuuuucacuggaguuaca

SEQ ID NO: 601139 - RNA, 20 nt, Homo sapiens
ucauuuuuuuuauauugccu

SEQ ID NO: 601140 - RNA, 17 nt, Homo sapiens
uccaaaaagcucugaaa

SEQ ID NO: 601141 - RNA, 20 nt, Homo sapiens
uccaaaaauagcccugcaaa

SEQ ID NO: 601142 - RNA, 14 nt, Homo sapiens
uccaaaacauuucu

SEQ ID NO: 601143 - RNA, 17 nt, Homo sapiens
uccaaaaccuuccucuu

SEQ ID NO: 601144 - RNA, 21 nt, Homo sapiens
uccaaaacuaauuuccucuga

SEQ ID NO: 601145 - RNA, 15 nt, Homo sapiens
uccaaaagcacuuac

SEQ ID NO: 601146 - RNA, 22 nt, Homo sapiens
uccaaaaggcccuuuucagggc

SEQ ID NO: 601147 - RNA, 21 nt, Homo sapiens
uccaaacagaccccuguucau

SEQ ID NO: 601148 - RNA, 14 nt, Homo sapiens
uccaaacauuucau

SEQ ID NO: 601149 - RNA, 17 nt, Homo sapiens
uccaaacauuucauccg

SEQ ID NO: 601150 - RNA, 12 nt, Homo sapiens
uccaaaccagac

SEQ ID NO: 601151 - RNA, 16 nt, Homo sapiens
uccaaaccaucagcug

SEQ ID NO: 601152 - RNA, 23 nt, Homo sapiens
uccaaagaguagaauugcauuga

SEQ ID NO: 601153 - RNA, 12 nt, Homo sapiens
uccaaagccaga

SEQ ID NO: 601154 - RNA, 19 nt, Homo sapiens
uccaaagcgagcaagagaa

SEQ ID NO: 601155 - RNA, 14 nt, Homo sapiens
uccaaaggaucuua

SEQ ID NO: 601156 - RNA, 19 nt, Homo sapiens
uccaaaggcauaagacccu

SEQ ID NO: 601157 - RNA, 19 nt, Homo sapiens
uccaaaguacacuguuuca

SEQ ID NO: 601158 - RNA, 21 nt, Homo sapiens
uccaaaguugccacagaugau

SEQ ID NO: 601159 - RNA, 16 nt, Homo sapiens
uccaaaugaacuugca

SEQ ID NO: 601160 - RNA, 20 nt, Homo sapiens
uccaaauggagaagcugcag

SEQ ID NO: 601161 - RNA, 23 nt, Homo sapiens
uccaaauuuauugugcauauucu

SEQ ID NO: 601162 - RNA, 16 nt, Homo sapiens
uccaacacaucucccu

SEQ ID NO: 601163 - RNA, 17 nt, Homo sapiens
uccaacaccaagcacag

SEQ ID NO: 601164 - RNA, 17 nt, Homo sapiens
uccaacaccacagacac

SEQ ID NO: 601165 - RNA, 19 nt, Homo sapiens
uccaacagugagucuguca

SEQ ID NO: 601166 - RNA, 20 nt, Homo sapiens
uccaacccauuuaaucacca

SEQ ID NO: 601167 - RNA, 16 nt, Homo sapiens
uccaaccuaaccccuu

SEQ ID NO: 601168 - RNA, 15 nt, Homo sapiens
uccaaccucagggac

SEQ ID NO: 601169 - RNA, 19 nt, Homo sapiens
uccaaccugccugugcaug

SEQ ID NO: 601170 - RNA, 22 nt, Homo sapiens
uccaaccuuuggaagucaugag

SEQ ID NO: 601171 - RNA, 14 nt, Homo sapiens
uccaacucccuuaa

SEQ ID NO: 601172 - RNA, 16 nt, Homo sapiens
uccaagaaagauccac

SEQ ID NO: 601173 - RNA, 21 nt, Homo sapiens
uccaagaaggccuucauggcc

SEQ ID NO: 601174 - RNA, 13 nt, Homo sapiens
uccaagaauuuga

SEQ ID NO: 601175 - RNA, 15 nt, Homo sapiens
uccaagaccccaaau

SEQ ID NO: 601176 - RNA, 16 nt, Homo sapiens
uccaagagguggguaa

SEQ ID NO: 601177 - RNA, 13 nt, Homo sapiens
uccaagauaugga

SEQ ID NO: 601178 - RNA, 19 nt, Homo sapiens
uccaagccuggcacccacc

SEQ ID NO: 601179 - RNA, 22 nt, Homo sapiens
uccaagcgcgguuacuauggcc

SEQ ID NO: 601180 - RNA, 18 nt, Homo sapiens
uccaaggcacacuguuaa

SEQ ID NO: 601181 - RNA, 12 nt, Homo sapiens
uccaaggcuuuu

SEQ ID NO: 601182 - RNA, 21 nt, Homo sapiens
uccaagggacccuuugccuuu

SEQ ID NO: 601183 - RNA, 14 nt, Homo sapiens
uccaaggguacuaa

SEQ ID NO: 601184 - RNA, 21 nt, Homo sapiens
uccaaguguuauaccaacuaa

SEQ ID NO: 601185 - RNA, 22 nt, Homo sapiens
uccaaguguuauaccaacuaaa

SEQ ID NO: 601186 - RNA, 12 nt, Homo sapiens
uccaauaugaug

SEQ ID NO: 601187 - RNA, 12 nt, Homo sapiens
uccaaucagaac

SEQ ID NO: 601188 - RNA, 15 nt, Homo sapiens
uccaaucaugaaaag

SEQ ID NO: 601189 - RNA, 13 nt, Homo sapiens
uccaaucucuggu

SEQ ID NO: 601190 - RNA, 16 nt, Homo sapiens
uccaaucuugagauug

SEQ ID NO: 601191 - RNA, 16 nt, Homo sapiens
uccaauggaacaguag

SEQ ID NO: 601192 - RNA, 18 nt, Homo sapiens
uccaauggaacaguagcu

SEQ ID NO: 601193 - RNA, 19 nt, Homo sapiens
uccaaugucugcugaggag

SEQ ID NO: 601194 - RNA, 19 nt, Homo sapiens
uccaaugugguuggucaaa

SEQ ID NO: 601195 - RNA, 19 nt, Homo sapiens
uccaauuauuugacuuuaa

SEQ ID NO: 601196 - RNA, 18 nt, Homo sapiens
uccaauuccuugcacaua

SEQ ID NO: 601197 - RNA, 19 nt, Homo sapiens
uccaauucgaaaacaaccg

SEQ ID NO: 601198 - RNA, 19 nt, Homo sapiens
uccaauuugacaaaaccca

SEQ ID NO: 601199 - RNA, 23 nt, Homo sapiens
uccaauuuuaauauuaacuuuua

SEQ ID NO: 601200 - RNA, 19 nt, Homo sapiens
uccaauuuuguugcaucau

SEQ ID NO: 601201 - RNA, 21 nt, Homo sapiens
uccacaaaauuagaaaggaca

SEQ ID NO: 601202 - RNA, 21 nt, Homo sapiens
uccacaaaugguggguacaaa

SEQ ID NO: 601203 - RNA, 12 nt, Homo sapiens
uccacaacacac

SEQ ID NO: 601204 - RNA, 20 nt, Homo sapiens
uccacaagauucccagagac

SEQ ID NO: 601205 - RNA, 15 nt, Homo sapiens
uccacaauagucaga

SEQ ID NO: 601206 - RNA, 13 nt, Homo sapiens
uccacaauucauu

SEQ ID NO: 601207 - RNA, 23 nt, Homo sapiens
uccacacauuuaaaacauuugaa

SEQ ID NO: 601208 - RNA, 12 nt, Homo sapiens
uccacaccaagc

SEQ ID NO: 601209 - RNA, 22 nt, Homo sapiens
uccacacccacuuuguccauuu

SEQ ID NO: 601210 - RNA, 15 nt, Homo sapiens
uccacaccugggcau

SEQ ID NO: 601211 - RNA, 14 nt, Homo sapiens
uccacacgcauuaa

SEQ ID NO: 601212 - RNA, 14 nt, Homo sapiens
uccacacuaccaca

SEQ ID NO: 601213 - RNA, 18 nt, Homo sapiens
uccacagaaauacaugaa

SEQ ID NO: 601214 - RNA, 17 nt, Homo sapiens
uccacagagauacacag

SEQ ID NO: 601215 - RNA, 22 nt, Homo sapiens
uccacagccccuuccucugcca

SEQ ID NO: 601216 - RNA, 20 nt, Homo sapiens
ugccuucaucuucacugcaa

SEQ ID NO: 601217 - RNA, 16 nt, Homo sapiens
ugccuuccacaauuca

SEQ ID NO: 601218 - RNA, 20 nt, Homo sapiens
ugccuuccucaguauccaca

SEQ ID NO: 601219 - RNA, 21 nt, Homo sapiens
ugccuucuaaauggcaugaca

SEQ ID NO: 601220 - RNA, 13 nt, Homo sapiens
ugccuucucagga

SEQ ID NO: 601221 - RNA, 14 nt, Homo sapiens
ugccuucucaggaa

SEQ ID NO: 601222 - RNA, 15 nt, Homo sapiens
ugccuucucaggaaa

SEQ ID NO: 601223 - RNA, 14 nt, Homo sapiens
ugccuucucaugau

SEQ ID NO: 601224 - RNA, 13 nt, Homo sapiens
ugccuucuuccag

SEQ ID NO: 601225 - RNA, 15 nt, Homo sapiens
ugccuugaagccacu

SEQ ID NO: 601226 - RNA, 22 nt, Homo sapiens
ugccuugucucuaguagugugg

SEQ ID NO: 601227 - RNA, 16 nt, Homo sapiens
ugccuuuaagccaaag

SEQ ID NO: 601228 - RNA, 18 nt, Homo sapiens
ugccuuuaagccaaagaa

SEQ ID NO: 601229 - RNA, 16 nt, Homo sapiens
ugccuuuaauuugcua

SEQ ID NO: 601230 - RNA, 18 nt, Homo sapiens
ugccuuucaaauuuagaa

SEQ ID NO: 601231 - RNA, 20 nt, Homo sapiens
ugccuuuucaucuaauguga

SEQ ID NO: 601232 - RNA, 13 nt, Homo sapiens
ugccuuuugcaac

SEQ ID NO: 601233 - RNA, 17 nt, Homo sapiens
ugccuuuugcaccccuc

SEQ ID NO: 601234 - RNA, 17 nt, Homo sapiens
ugccuuuugguuucacc

SEQ ID NO: 601235 - RNA, 22 nt, Homo sapiens
ugccuuuuuuucucugcauuua

SEQ ID NO: 601236 - RNA, 17 nt, Homo sapiens
ugcgaaguggcucucag

SEQ ID NO: 601237 - RNA, 21 nt, Homo sapiens
ugcgagacgcacacagcugag

SEQ ID NO: 601238 - RNA, 15 nt, Homo sapiens
ugcgagacucugaug

SEQ ID NO: 601239 - RNA, 14 nt, Homo sapiens
ugcgauaacugaga

SEQ ID NO: 601240 - RNA, 22 nt, Homo sapiens
ugcgcccagccugaaucauuuc

SEQ ID NO: 601241 - RNA, 17 nt, Homo sapiens
ugcgccccgccugaccu

SEQ ID NO: 601242 - RNA, 23 nt, Homo sapiens
ugcgcccuugaggggccccagcg

SEQ ID NO: 601243 - RNA, 21 nt, Homo sapiens
ugcgccgagaccgcagaggga

SEQ ID NO: 601244 - RNA, 22 nt, Homo sapiens
ugcgccuguacucccagcacuu

SEQ ID NO: 601245 - RNA, 17 nt, Homo sapiens
ugcgcgcgugcaugugu

SEQ ID NO: 601246 - RNA, 17 nt, Homo sapiens
ugcgcucucuuugcaac

SEQ ID NO: 601247 - RNA, 14 nt, Homo sapiens
ugcggaagccauag

SEQ ID NO: 601248 - RNA, 13 nt, Homo sapiens
ugcggaagcccag

SEQ ID NO: 601249 - RNA, 14 nt, Homo sapiens
ugcggaaugcauug

SEQ ID NO: 601250 - RNA, 19 nt, Homo sapiens
ugcggaggaaagcaagugu

SEQ ID NO: 601251 - RNA, 22 nt, Homo sapiens
ugcggcaaaaggaaagcugugu

SEQ ID NO: 601252 - RNA, 15 nt, Homo sapiens
ugcgggccagggucc

SEQ ID NO: 601253 - RNA, 18 nt, Homo sapiens
ugcgggugaacaaagcag

SEQ ID NO: 601254 - RNA, 16 nt, Homo sapiens
ugcgguagaugggagg

SEQ ID NO: 601255 - RNA, 13 nt, Homo sapiens
ugcgguuccucau

SEQ ID NO: 601256 - RNA, 15 nt, Homo sapiens
ugcguaaaguaauau

SEQ ID NO: 601257 - RNA, 11 nt, Homo sapiens
ugcgucccaug

SEQ ID NO: 601258 - RNA, 22 nt, Homo sapiens
ugcgucccaugaggucuucccg

SEQ ID NO: 601259 - RNA, 23 nt, Homo sapiens
ugcgucccuccgagcuugggaua

SEQ ID NO: 601260 - RNA, 14 nt, Homo sapiens
ugcgugaagaccaa

SEQ ID NO: 601261 - RNA, 13 nt, Homo sapiens
ugcgugcaugugc

SEQ ID NO: 601262 - RNA, 23 nt, Homo sapiens
ugcgugccaucacucaaccauaa

SEQ ID NO: 601263 - RNA, 17 nt, Homo sapiens
ugcgugcgagcacacac

SEQ ID NO: 601264 - RNA, 20 nt, Homo sapiens
ugcgugcucccgaugcugcu

SEQ ID NO: 601265 - RNA, 22 nt, Homo sapiens
ugcgugcucccgaugcugcuau

SEQ ID NO: 601266 - RNA, 17 nt, Homo sapiens
ugcgugguauaaucucc

SEQ ID NO: 601267 - RNA, 17 nt, Homo sapiens
ugcgugugcgugcaugu

SEQ ID NO: 601268 - RNA, 13 nt, Homo sapiens
ugcgugugugcaa

SEQ ID NO: 601269 - RNA, 21 nt, Homo sapiens
ugcguguguguucacguguuc

SEQ ID NO: 601270 - RNA, 23 nt, Homo sapiens
ugcguuacacccuuucuugacaa

SEQ ID NO: 601271 - RNA, 13 nt, Homo sapiens
ugcguuacuaauu

SEQ ID NO: 601272 - RNA, 17 nt, Homo sapiens
ugcguuuuauaucuucc

SEQ ID NO: 601273 - RNA, 21 nt, Homo sapiens
ugcuaaagaaaggaacuaagu

SEQ ID NO: 601274 - RNA, 22 nt, Homo sapiens
ugcuaaagcacuuugcacuuaa

SEQ ID NO: 601275 - RNA, 15 nt, Homo sapiens
ugcuaaagccaggau

SEQ ID NO: 601276 - RNA, 14 nt, Homo sapiens
ugcuaaaugcacug

SEQ ID NO: 601277 - RNA, 22 nt, Homo sapiens
ugcuaaaugcuacauacuccaa

SEQ ID NO: 601278 - RNA, 13 nt, Homo sapiens
ugcuaaaugugaa

SEQ ID NO: 601279 - RNA, 12 nt, Homo sapiens
ugcuaacaaugc

SEQ ID NO: 601280 - RNA, 20 nt, Homo sapiens
ugcuaacauaaaauccaaua

SEQ ID NO: 601281 - RNA, 15 nt, Homo sapiens
ugcuaacccccaaau

SEQ ID NO: 601282 - RNA, 17 nt, Homo sapiens
ugcuaaggcuccuccuu

SEQ ID NO: 601283 - RNA, 12 nt, Homo sapiens
ugcuaaguauuu

SEQ ID NO: 601284 - RNA, 18 nt, Homo sapiens
ugcuaagugcuuauuaca

SEQ ID NO: 601285 - RNA, 24 nt, Homo sapiens
ugcuaaguguaugaugucacacaa

SEQ ID NO: 601286 - RNA, 17 nt, Homo sapiens
ugcuaaugcuaugcaaa

SEQ ID NO: 601287 - RNA, 15 nt, Homo sapiens
ugcuaauucaaagcu

SEQ ID NO: 601288 - RNA, 11 nt, Homo sapiens
ugcuacaacau

SEQ ID NO: 601289 - RNA, 21 nt, Homo sapiens
ugcuacagcaauuucuaauuu

SEQ ID NO: 601290 - RNA, 20 nt, Homo sapiens
ugcuacaguuauuaaucugg

SEQ ID NO: 601291 - RNA, 12 nt, Homo sapiens
ugcuacauauau

SEQ ID NO: 601292 - RNA, 19 nt, Homo sapiens
ugcuacccaugacuuuaua

SEQ ID NO: 601293 - RNA, 19 nt, Homo sapiens
ugcuacguuccuauuguca

SEQ ID NO: 601294 - RNA, 20 nt, Homo sapiens
ugcuacuaagauacuccaua

SEQ ID NO: 601295 - RNA, 22 nt, Homo sapiens
ugcuacuucacugucaucuuca

SEQ ID NO: 601296 - RNA, 18 nt, Homo sapiens
ugcuagaaaaauguucuu

SEQ ID NO: 601297 - RNA, 12 nt, Homo sapiens
ugcuagaacaag

SEQ ID NO: 601298 - RNA, 20 nt, Homo sapiens
ugcuagaugugcaaaugcaa

SEQ ID NO: 601299 - RNA, 19 nt, Homo sapiens
ugcuagcagggcauggcac

SEQ ID NO: 601300 - RNA, 13 nt, Homo sapiens
ugcuagcaguaaa

SEQ ID NO: 601301 - RNA, 18 nt, Homo sapiens
ugcuagggaaacuucccg

SEQ ID NO: 601302 - RNA, 13 nt, Homo sapiens
ugcuagugcauuu

SEQ ID NO: 601303 - RNA, 14 nt, Homo sapiens
ugcuagugugaauu

SEQ ID NO: 601304 - RNA, 17 nt, Homo sapiens
ugcuauacacacacaca

SEQ ID NO: 601305 - RNA, 19 nt, Homo sapiens
ugcuauagagccuaccugu

SEQ ID NO: 601306 - RNA, 18 nt, Homo sapiens
ugcuauauaaauauguca

SEQ ID NO: 601307 - RNA, 15 nt, Homo sapiens
ugcuaucaccaauca

SEQ ID NO: 601308 - RNA, 16 nt, Homo sapiens
ugcuaucccacuguau

SEQ ID NO: 601309 - RNA, 14 nt, Homo sapiens
ugcuaugcaaaaaa

SEQ ID NO: 601310 - RNA, 11 nt, Homo sapiens
ugcuauggaag

SEQ ID NO: 601311 - RNA, 23 nt, Homo sapiens
ugcuaugguuuucuccaagagcu

SEQ ID NO: 601312 - RNA, 15 nt, Homo sapiens
ugcuauguugcccaa

SEQ ID NO: 601313 - RNA, 12 nt, Homo sapiens
ugcuauucuggc

SEQ ID NO: 601314 - RNA, 12 nt, Homo sapiens
ugcuauuugccu

SEQ ID NO: 601315 - RNA, 17 nt, Homo sapiens
ugcucaaaacacuucca

SEQ ID NO: 601316 - RNA, 15 nt, Homo sapiens
ugcucaaaaucuuuc

SEQ ID NO: 601317 - RNA, 17 nt, Homo sapiens
ugcucaaaaucuuucca

SEQ ID NO: 601318 - RNA, 20 nt, Homo sapiens
ugcucaaaaucuuuccaaau

SEQ ID NO: 601319 - RNA, 19 nt, Homo sapiens
ugcucaaggcaaccagagg

SEQ ID NO: 601320 - RNA, 15 nt, Homo sapiens
ugcucaauuccaaga

SEQ ID NO: 601321 - RNA, 13 nt, Homo sapiens
ugcucaccaagga

SEQ ID NO: 601322 - RNA, 20 nt, Homo sapiens
ugcucacugaccugccugua

SEQ ID NO: 601323 - RNA, 20 nt, Homo sapiens
ugcucacuugguccuaccua

SEQ ID NO: 601324 - RNA, 17 nt, Homo sapiens
ugcucagacccaacagc

SEQ ID NO: 601325 - RNA, 15 nt, Homo sapiens
ugcucaggaaaccac

SEQ ID NO: 601326 - RNA, 16 nt, Homo sapiens
ugcucaggaaaccaca

SEQ ID NO: 601327 - RNA, 14 nt, Homo sapiens
ugcucaggccuccc

SEQ ID NO: 601328 - RNA, 14 nt, Homo sapiens
ugcucagugccuuu

SEQ ID NO: 601329 - RNA, 17 nt, Homo sapiens
ugcucaguuggugcugc

SEQ ID NO: 601330 - RNA, 14 nt, Homo sapiens
ugcucauaugcaug

SEQ ID NO: 601331 - RNA, 11 nt, Homo sapiens
ugcucauguau

SEQ ID NO: 601332 - RNA, 20 nt, Homo sapiens
ugcucauuuucuuuaggaca

SEQ ID NO: 601333 - RNA, 22 nt, Homo sapiens
ugcuccaacccccgccaccuca

SEQ ID NO: 601334 - RNA, 19 nt, Homo sapiens
ugcuccaagggacaggugg

SEQ ID NO: 601335 - RNA, 14 nt, Homo sapiens
ugcuccacagggcc

SEQ ID NO: 601336 - RNA, 20 nt, Homo sapiens
ugcuccagauuagagccugu

SEQ ID NO: 601337 - RNA, 21 nt, Homo sapiens
ugcuccagcaacugcccuucc

SEQ ID NO: 601338 - RNA, 15 nt, Homo sapiens
ugcuccaucgcgcca

SEQ ID NO: 601339 - RNA, 22 nt, Homo sapiens
ugcuccaugacuggcugucugc

SEQ ID NO: 601340 - RNA, 17 nt, Homo sapiens
ugcucccaacccauuca

SEQ ID NO: 601341 - RNA, 20 nt, Homo sapiens
ugcucccacacuugugccag

SEQ ID NO: 601342 - RNA, 13 nt, Homo sapiens
ugcucccacagaa

SEQ ID NO: 601343 - RNA, 15 nt, Homo sapiens
ugcucccagccugcu

SEQ ID NO: 601344 - RNA, 14 nt, Homo sapiens
ugcuccccugccac

SEQ ID NO: 601345 - RNA, 14 nt, Homo sapiens
ugcuccccugugaa

SEQ ID NO: 601346 - RNA, 19 nt, Homo sapiens
ugcucccgaugcugcuaug

SEQ ID NO: 601347 - RNA, 21 nt, Homo sapiens
ugcucccuagccagaggcucu

SEQ ID NO: 601348 - RNA, 17 nt, Homo sapiens
ugcucccugacagcacc

SEQ ID NO: 601349 - RNA, 20 nt, Homo sapiens
ugcuccguaugccaagagga

SEQ ID NO: 601350 - RNA, 19 nt, Homo sapiens
ugcuccuccuccuguauuc

SEQ ID NO: 601351 - RNA, 22 nt, Homo sapiens
ugcuccucucgcacaaugcaug

SEQ ID NO: 601352 - RNA, 20 nt, Homo sapiens
ugcuccucugccuguccucu

SEQ ID NO: 601353 - RNA, 16 nt, Homo sapiens
ugcuccuguacuuguc

SEQ ID NO: 601354 - RNA, 14 nt, Homo sapiens
ugcuccuuacccug

SEQ ID NO: 601355 - RNA, 22 nt, Homo sapiens
ugcuccuuggcuuaccugaccu

SEQ ID NO: 601356 - RNA, 16 nt, Homo sapiens
ugcucuacugcuucag

SEQ ID NO: 601357 - RNA, 16 nt, Homo sapiens
ugcucuaugucugccu

SEQ ID NO: 601358 - RNA, 21 nt, Homo sapiens
ugcucuccccuccucggagga

SEQ ID NO: 601359 - RNA, 20 nt, Homo sapiens
ugcucucccgguucuuccag

SEQ ID NO: 601360 - RNA, 21 nt, Homo sapiens
ugcucucucacucccccauga

SEQ ID NO: 601361 - RNA, 23 nt, Homo sapiens
ugcucugagaauuguugagauac

SEQ ID NO: 601362 - RNA, 18 nt, Homo sapiens
ugcucugagcacagguga

SEQ ID NO: 601363 - RNA, 14 nt, Homo sapiens
ugcucugcuuuuag

SEQ ID NO: 601364 - RNA, 16 nt, Homo sapiens
ugcucuggaagaccug

SEQ ID NO: 601365 - RNA, 15 nt, Homo sapiens
ugcucuggugcacgc

SEQ ID NO: 601366 - RNA, 23 nt, Homo sapiens
ugcucugucccuauuauuugccc

SEQ ID NO: 601367 - RNA, 14 nt, Homo sapiens
ugcucugucuucca

SEQ ID NO: 601368 - RNA, 20 nt, Homo sapiens
ugcucuuaaaauaucuuccu

SEQ ID NO: 601369 - RNA, 19 nt, Homo sapiens
ugcucuuacuacagcuuca

SEQ ID NO: 601370 - RNA, 16 nt, Homo sapiens
ugcucuucagccauag

SEQ ID NO: 601371 - RNA, 14 nt, Homo sapiens
ugcucuugagucuu

SEQ ID NO: 601372 - RNA, 18 nt, Homo sapiens
ugcucuugggaagaccag

SEQ ID NO: 601373 - RNA, 23 nt, Homo sapiens
ugcucuuuaugaaugaaaaaaca

SEQ ID NO: 601374 - RNA, 18 nt, Homo sapiens
ugcucuuucaucucugcu

SEQ ID NO: 601375 - RNA, 16 nt, Homo sapiens
ugcucuuucucugcca

SEQ ID NO: 601376 - RNA, 15 nt, Homo sapiens
ugcugaaaacuacac

SEQ ID NO: 601377 - RNA, 22 nt, Homo sapiens
ugcugaaacaucauuacagauu

SEQ ID NO: 601378 - RNA, 13 nt, Homo sapiens
ugcugaaaccaua

SEQ ID NO: 601379 - RNA, 16 nt, Homo sapiens
ugcugaagacauucaa

SEQ ID NO: 601380 - RNA, 17 nt, Homo sapiens
ugcugaagacauucaaa

SEQ ID NO: 601381 - RNA, 20 nt, Homo sapiens
ugcugaagaggguugguaua

SEQ ID NO: 601382 - RNA, 16 nt, Homo sapiens
ugcugaauaaaugauu

SEQ ID NO: 601383 - RNA, 17 nt, Homo sapiens
ugcugaauguggacuca

SEQ ID NO: 601384 - RNA, 19 nt, Homo sapiens
ugcugaauuucaggcauuu

SEQ ID NO: 601385 - RNA, 22 nt, Homo sapiens
ugcugacaaccauuaaagucag

SEQ ID NO: 601386 - RNA, 19 nt, Homo sapiens
ugcugacaacuuagcucag

SEQ ID NO: 601387 - RNA, 14 nt, Homo sapiens
ugcugaccaauugu

SEQ ID NO: 601388 - RNA, 18 nt, Homo sapiens
ugcugaccagacagccuc

SEQ ID NO: 601389 - RNA, 21 nt, Homo sapiens
ugcugagauuggaaaagggca

SEQ ID NO: 601390 - RNA, 15 nt, Homo sapiens
ugcugagcauguacu

SEQ ID NO: 601391 - RNA, 15 nt, Homo sapiens
ugcugaggcccagug

SEQ ID NO: 601392 - RNA, 22 nt, Homo sapiens
ugcugaguaacaggugccuucc

SEQ ID NO: 601393 - RNA, 22 nt, Homo sapiens
ugcugaguuccggggugcaaug

SEQ ID NO: 601394 - RNA, 18 nt, Homo sapiens
ugcugcaaaaguucucaa

SEQ ID NO: 601395 - RNA, 15 nt, Homo sapiens
ugcugcaaacacuua

SEQ ID NO: 601396 - RNA, 20 nt, Homo sapiens
ugcugcaacaaaauguagaa

SEQ ID NO: 601397 - RNA, 15 nt, Homo sapiens
ugcugcacaaaagca

SEQ ID NO: 601398 - RNA, 23 nt, Homo sapiens
ugcugcacagaaauuuucaauuu

SEQ ID NO: 601399 - RNA, 15 nt, Homo sapiens
ugcugcagucaucua

SEQ ID NO: 601400 - RNA, 21 nt, Homo sapiens
ugcugcaucuccccucagauu

SEQ ID NO: 601401 - RNA, 14 nt, Homo sapiens
ugcugcaugaaaag

SEQ ID NO: 601402 - RNA, 17 nt, Homo sapiens
ugcugccaugacagagg

SEQ ID NO: 601403 - RNA, 15 nt, Homo sapiens
ugcugcccccagaaa

SEQ ID NO: 601404 - RNA, 22 nt, Homo sapiens
ugcugccccuugcaagccauaa

SEQ ID NO: 601405 - RNA, 21 nt, Homo sapiens
ugcugcccucagggacugcac

SEQ ID NO: 601406 - RNA, 20 nt, Homo sapiens
ugcugccuggccacugcucc

SEQ ID NO: 601407 - RNA, 11 nt, Homo sapiens
ugcugccuuaa

SEQ ID NO: 601408 - RNA, 15 nt, Homo sapiens
ugcugcgucagacca

SEQ ID NO: 601409 - RNA, 14 nt, Homo sapiens
ugcugcgugacaua

SEQ ID NO: 601410 - RNA, 14 nt, Homo sapiens
ugcugcuuagcuug

SEQ ID NO: 601411 - RNA, 19 nt, Homo sapiens
ugcugcuucuccauggcca

SEQ ID NO: 601412 - RNA, 16 nt, Homo sapiens
uggccuuacacugaaa

SEQ ID NO: 601413 - RNA, 15 nt, Homo sapiens
uggccuuaugaccag

SEQ ID NO: 601414 - RNA, 23 nt, Homo sapiens
uggccuuccccuccaaaaccucc

SEQ ID NO: 601415 - RNA, 20 nt, Homo sapiens
uggccuuccccuuuugccug

SEQ ID NO: 601416 - RNA, 19 nt, Homo sapiens
uggccuucugaacuccaua

SEQ ID NO: 601417 - RNA, 19 nt, Homo sapiens
uggccuugguaugugccag

SEQ ID NO: 601418 - RNA, 23 nt, Homo sapiens
uggccuugugucagagcugggag

SEQ ID NO: 601419 - RNA, 23 nt, Homo sapiens
uggcgacacucagggcagcugcc

SEQ ID NO: 601420 - RNA, 15 nt, Homo sapiens
uggcgaccaccaaag

SEQ ID NO: 601421 - RNA, 15 nt, Homo sapiens
uggcgcucucagcuu

SEQ ID NO: 601422 - RNA, 13 nt, Homo sapiens
uggcggccuuccg

SEQ ID NO: 601423 - RNA, 17 nt, Homo sapiens
uggcggcgcagagggaa

SEQ ID NO: 601424 - RNA, 21 nt, Homo sapiens
uggcggcuuccuguccacucu

SEQ ID NO: 601425 - RNA, 16 nt, Homo sapiens
uggcgggcaccuguag

SEQ ID NO: 601426 - RNA, 16 nt, Homo sapiens
uggcgucugucuucaa

SEQ ID NO: 601427 - RNA, 18 nt, Homo sapiens
uggcguggcagccucuug

SEQ ID NO: 601428 - RNA, 19 nt, Homo sapiens
uggcuaaacagauguaaug

SEQ ID NO: 601429 - RNA, 21 nt, Homo sapiens
uggcuaaagagcuuugugaua

SEQ ID NO: 601430 - RNA, 18 nt, Homo sapiens
uggcuacacacaaaccag

SEQ ID NO: 601431 - RNA, 22 nt, Homo sapiens
uggcuacacucaucugacucau

SEQ ID NO: 601432 - RNA, 12 nt, Homo sapiens
uggcuagccuuu

SEQ ID NO: 601433 - RNA, 19 nt, Homo sapiens
uggcuagguuaaaggccag

SEQ ID NO: 601434 - RNA, 19 nt, Homo sapiens
uggcuagugguggguacuc

SEQ ID NO: 601435 - RNA, 17 nt, Homo sapiens
uggcuaugaaaaugagc

SEQ ID NO: 601436 - RNA, 13 nt, Homo sapiens
uggcucacuacug

SEQ ID NO: 601437 - RNA, 20 nt, Homo sapiens
uggcucacuacugaacacau

SEQ ID NO: 601438 - RNA, 14 nt, Homo sapiens
uggcucagccuguc

SEQ ID NO: 601439 - RNA, 14 nt, Homo sapiens
uggcucaugccugu

SEQ ID NO: 601440 - RNA, 15 nt, Homo sapiens
uggcuccaacacugc

SEQ ID NO: 601441 - RNA, 21 nt, Homo sapiens
uggcucccugggcagugcucc

SEQ ID NO: 601442 - RNA, 15 nt, Homo sapiens
uggcuccgcaggggu

SEQ ID NO: 601443 - RNA, 14 nt, Homo sapiens
uggcuccuaucugu

SEQ ID NO: 601444 - RNA, 16 nt, Homo sapiens
uggcuccuaucugugu

SEQ ID NO: 601445 - RNA, 16 nt, Homo sapiens
uggcuccuccuaggaa

SEQ ID NO: 601446 - RNA, 22 nt, Homo sapiens
uggcuccuucacugaacaugcc

SEQ ID NO: 601447 - RNA, 15 nt, Homo sapiens
uggcuccuugcccuc

SEQ ID NO: 601448 - RNA, 19 nt, Homo sapiens
uggcucgggugcagaguuc

SEQ ID NO: 601449 - RNA, 11 nt, Homo sapiens
uggcucugauu

SEQ ID NO: 601450 - RNA, 20 nt, Homo sapiens
uggcucugcaugacaaacac

SEQ ID NO: 601451 - RNA, 15 nt, Homo sapiens
uggcucugggggacc

SEQ ID NO: 601452 - RNA, 23 nt, Homo sapiens
uggcucuggugugaaguuugcuu

SEQ ID NO: 601453 - RNA, 13 nt, Homo sapiens
uggcucuuucuau

SEQ ID NO: 601454 - RNA, 19 nt, Homo sapiens
uggcugagccuggcuggag

SEQ ID NO: 601455 - RNA, 20 nt, Homo sapiens
uggcugauuuauuucuacua

SEQ ID NO: 601456 - RNA, 12 nt, Homo sapiens
uggcugcaguga

SEQ ID NO: 601457 - RNA, 17 nt, Homo sapiens
uggcugcuagauuuuaa

SEQ ID NO: 601458 - RNA, 16 nt, Homo sapiens
uggcuggacuguagaa

SEQ ID NO: 601459 - RNA, 24 nt, Homo sapiens
uggcuggauuuguauuacacacag

SEQ ID NO: 601460 - RNA, 12 nt, Homo sapiens
uggcuggcacag

SEQ ID NO: 601461 - RNA, 16 nt, Homo sapiens
uggcuggccugagcaa

SEQ ID NO: 601462 - RNA, 22 nt, Homo sapiens
uggcuggcuuguuugauuucaa

SEQ ID NO: 601463 - RNA, 23 nt, Homo sapiens
uggcuggcuuguuugauuucaac

SEQ ID NO: 601464 - RNA, 20 nt, Homo sapiens
uggcugggaguccuuaccuc

SEQ ID NO: 601465 - RNA, 23 nt, Homo sapiens
uggcuggucuucacuuuccucag

SEQ ID NO: 601466 - RNA, 17 nt, Homo sapiens
uggcugguuucugagag

SEQ ID NO: 601467 - RNA, 23 nt, Homo sapiens
uggcugugcccagcaggcccagc

SEQ ID NO: 601468 - RNA, 16 nt, Homo sapiens
uggcuguggggacccc

SEQ ID NO: 601469 - RNA, 15 nt, Homo sapiens
guguggcagccacac

SEQ ID NO: 601470 - RNA, 14 nt, Homo sapiens
guguggcugaugau

SEQ ID NO: 601471 - RNA, 21 nt, Homo sapiens
guguggggcugccgaugggaa

SEQ ID NO: 601472 - RNA, 19 nt, Homo sapiens
guguggugagaucaugcca

SEQ ID NO: 601473 - RNA, 17 nt, Homo sapiens
guguguacacgggacug

SEQ ID NO: 601474 - RNA, 13 nt, Homo sapiens
guguguacugcac

SEQ ID NO: 601475 - RNA, 21 nt, Homo sapiens
guguguauauaguaugaaugc

SEQ ID NO: 601476 - RNA, 13 nt, Homo sapiens
guguguaugcuga

SEQ ID NO: 601477 - RNA, 15 nt, Homo sapiens
gugugucucguguca

SEQ ID NO: 601478 - RNA, 15 nt, Homo sapiens
gugugugacaauucu

SEQ ID NO: 601479 - RNA, 20 nt, Homo sapiens
guguguggccucccuggcuc

SEQ ID NO: 601480 - RNA, 14 nt, Homo sapiens
guguguguguauau

SEQ ID NO: 601481 - RNA, 15 nt, Homo sapiens
guguguguguguaau

SEQ ID NO: 601482 - RNA, 15 nt, Homo sapiens
guguguguguguaua

SEQ ID NO: 601483 - RNA, 22 nt, Homo sapiens
guguguuaaaugggacuggagu

SEQ ID NO: 601484 - RNA, 16 nt, Homo sapiens
guguguuuaacauuca

SEQ ID NO: 601485 - RNA, 14 nt, Homo sapiens
guguuaaaugugau

SEQ ID NO: 601486 - RNA, 19 nt, Homo sapiens
guguuacccacugccaugc

SEQ ID NO: 601487 - RNA, 17 nt, Homo sapiens
guguuacugcuuugcaa

SEQ ID NO: 601488 - RNA, 13 nt, Homo sapiens
guguuacuugcca

SEQ ID NO: 601489 - RNA, 14 nt, Homo sapiens
guguuagcacugau

SEQ ID NO: 601490 - RNA, 21 nt, Homo sapiens
guguuauuaaugacaaaggca

SEQ ID NO: 601491 - RNA, 21 nt, Homo sapiens
guguuauuguauuagguguca

SEQ ID NO: 601492 - RNA, 18 nt, Homo sapiens
guguucacaaacugugaa

SEQ ID NO: 601493 - RNA, 20 nt, Homo sapiens
guguucacaaaggcagagag

SEQ ID NO: 601494 - RNA, 16 nt, Homo sapiens
guguucaguaaacaaa

SEQ ID NO: 601495 - RNA, 15 nt, Homo sapiens
guguucauacauuug

SEQ ID NO: 601496 - RNA, 13 nt, Homo sapiens
guguucauuuuau

SEQ ID NO: 601497 - RNA, 18 nt, Homo sapiens
guguucccagagcacuuu

SEQ ID NO: 601498 - RNA, 20 nt, Homo sapiens
guguuccuagaaugcagcug

SEQ ID NO: 601499 - RNA, 15 nt, Homo sapiens
guguuccugaagcug

SEQ ID NO: 601500 - RNA, 16 nt, Homo sapiens
guguucgauggcucaa

SEQ ID NO: 601501 - RNA, 19 nt, Homo sapiens
guguucuacacucaucuua

SEQ ID NO: 601502 - RNA, 16 nt, Homo sapiens
guguugaagcacuguu

SEQ ID NO: 601503 - RNA, 12 nt, Homo sapiens
guguugacugcu

SEQ ID NO: 601504 - RNA, 14 nt, Homo sapiens
guguugacugcugc

SEQ ID NO: 601505 - RNA, 15 nt, Homo sapiens
guguugauuguauaa

SEQ ID NO: 601506 - RNA, 20 nt, Homo sapiens
guguugauuguauaaaugca

SEQ ID NO: 601507 - RNA, 20 nt, Homo sapiens
guguugcccucgugcccauc

SEQ ID NO: 601508 - RNA, 17 nt, Homo sapiens
guguuggggaaaccuuc

SEQ ID NO: 601509 - RNA, 23 nt, Homo sapiens
guguuggggaaaccuucaucuga

SEQ ID NO: 601510 - RNA, 21 nt, Homo sapiens
guguugugccccuucacucau

SEQ ID NO: 601511 - RNA, 17 nt, Homo sapiens
guguuuccacagccugc

SEQ ID NO: 601512 - RNA, 19 nt, Homo sapiens
guguuucuauugacuucaa

SEQ ID NO: 601513 - RNA, 23 nt, Homo sapiens
guguuucuguccuguaacuguua

SEQ ID NO: 601514 - RNA, 21 nt, Homo sapiens
guguuucuuuugacaccuuag

SEQ ID NO: 601515 - RNA, 19 nt, Homo sapiens
guguuuucccaaagcacuu

SEQ ID NO: 601516 - RNA, 13 nt, Homo sapiens
guguuuuccugaa

SEQ ID NO: 601517 - RNA, 20 nt, Homo sapiens
guguuuuguaaaggauauca

SEQ ID NO: 601518 - RNA, 15 nt, Homo sapiens
guguuuuuaaggaaa

SEQ ID NO: 601519 - RNA, 17 nt, Homo sapiens
guguuuuuuuaauuucu

SEQ ID NO: 601520 - RNA, 20 nt, Homo sapiens
guuaaaacuguacauuuaaa

SEQ ID NO: 601521 - RNA, 21 nt, Homo sapiens
guuaaaauugauuucuucuca

SEQ ID NO: 601522 - RNA, 17 nt, Homo sapiens
guuaaacauugaaguaa

SEQ ID NO: 601523 - RNA, 22 nt, Homo sapiens
guuaaacuguuagcacuguuga

SEQ ID NO: 601524 - RNA, 18 nt, Homo sapiens
guuaaagcagacagucac

SEQ ID NO: 601525 - RNA, 24 nt, Homo sapiens
guuaaagggcauuuuacuaaggca

SEQ ID NO: 601526 - RNA, 14 nt, Homo sapiens
guuaacaggauauu

SEQ ID NO: 601527 - RNA, 21 nt, Homo sapiens
guuaaccccugcgcucucuuu

SEQ ID NO: 601528 - RNA, 16 nt, Homo sapiens
guuaaccucaguguca

SEQ ID NO: 601529 - RNA, 18 nt, Homo sapiens
guuaagaacugugaaauu

SEQ ID NO: 601530 - RNA, 13 nt, Homo sapiens
guuaagcauggau

SEQ ID NO: 601531 - RNA, 21 nt, Homo sapiens
guuaaguauugugcacuguau

SEQ ID NO: 601532 - RNA, 24 nt, Homo sapiens
guuaaguugaaguaaaagcaagua

SEQ ID NO: 601533 - RNA, 20 nt, Homo sapiens
guuaauaaaccuuugcaaac

SEQ ID NO: 601534 - RNA, 19 nt, Homo sapiens
guuaauaaaucaagccaua

SEQ ID NO: 601535 - RNA, 24 nt, Homo sapiens
guuaauauuuauuaagugacuaua

SEQ ID NO: 601536 - RNA, 14 nt, Homo sapiens
guuaauguacaaaa

SEQ ID NO: 601537 - RNA, 16 nt, Homo sapiens
guuaauuauuuugaca

SEQ ID NO: 601538 - RNA, 19 nt, Homo sapiens
guuaauuguaauugcauga

SEQ ID NO: 601539 - RNA, 19 nt, Homo sapiens
guuaauuuuauugcaaagu

SEQ ID NO: 601540 - RNA, 22 nt, Homo sapiens
guuaauuuuuccuauauugcau

SEQ ID NO: 601541 - RNA, 14 nt, Homo sapiens
guuacaaagacaug

SEQ ID NO: 601542 - RNA, 17 nt, Homo sapiens
guuacaaguuugcuaaa

SEQ ID NO: 601543 - RNA, 17 nt, Homo sapiens
guuacaggaagucccuu

SEQ ID NO: 601544 - RNA, 19 nt, Homo sapiens
guuacauaguuaaaugugc

SEQ ID NO: 601545 - RNA, 21 nt, Homo sapiens
guuacaucacaguguuugcaa

SEQ ID NO: 601546 - RNA, 12 nt, Homo sapiens
guuaccaagaag

SEQ ID NO: 601547 - RNA, 15 nt, Homo sapiens
guuaccaaguaugaa

SEQ ID NO: 601548 - RNA, 17 nt, Homo sapiens
guuaccagagauuuacc

SEQ ID NO: 601549 - RNA, 16 nt, Homo sapiens
guuaccucugcaugga

SEQ ID NO: 601550 - RNA, 17 nt, Homo sapiens
guuaccucugcauggaa

SEQ ID NO: 601551 - RNA, 15 nt, Homo sapiens
guuaccugucuugcu

SEQ ID NO: 601552 - RNA, 21 nt, Homo sapiens
guuacuaagaugaaauugcca

SEQ ID NO: 601553 - RNA, 22 nt, Homo sapiens
guuacuaagaugaaauugccaa

SEQ ID NO: 601554 - RNA, 14 nt, Homo sapiens
guuacuagccucuc

SEQ ID NO: 601555 - RNA, 18 nt, Homo sapiens
guuacugaauauuaaaaa

SEQ ID NO: 601556 - RNA, 15 nt, Homo sapiens
guuacugaccagcaa

SEQ ID NO: 601557 - RNA, 15 nt, Homo sapiens
guuacuggugauguu

SEQ ID NO: 601558 - RNA, 17 nt, Homo sapiens
guuacuuagaaugccau

SEQ ID NO: 601559 - RNA, 12 nt, Homo sapiens
guuacuuuacag

SEQ ID NO: 601560 - RNA, 15 nt, Homo sapiens
guuacuuuuuuacac

SEQ ID NO: 601561 - RNA, 22 nt, Homo sapiens
guuagaagcaaugaauguauau

SEQ ID NO: 601562 - RNA, 22 nt, Homo sapiens
guuagacucaagggggugacag

SEQ ID NO: 601563 - RNA, 19 nt, Homo sapiens
guuagauauuaggucccau

SEQ ID NO: 601564 - RNA, 16 nt, Homo sapiens
guuagauucacuuuga

SEQ ID NO: 601565 - RNA, 11 nt, Homo sapiens
guuagauuuau

SEQ ID NO: 601566 - RNA, 11 nt, Homo sapiens
guuagccuuag

SEQ ID NO: 601567 - RNA, 15 nt, Homo sapiens
guuagcucauuugag

SEQ ID NO: 601568 - RNA, 17 nt, Homo sapiens
guuaggaaaauuucaca

SEQ ID NO: 601569 - RNA, 18 nt, Homo sapiens
guuaggaaauaaaaccuu

SEQ ID NO: 601570 - RNA, 15 nt, Homo sapiens
guuaggauagcauuu

SEQ ID NO: 601571 - RNA, 15 nt, Homo sapiens
guuaggguguguguu

SEQ ID NO: 601572 - RNA, 14 nt, Homo sapiens
guuagguccauuuu

SEQ ID NO: 601573 - RNA, 19 nt, Homo sapiens
guuagucaauccugucaua

SEQ ID NO: 601574 - RNA, 23 nt, Homo sapiens
guuagucuccccaccucuucccu

SEQ ID NO: 601575 - RNA, 15 nt, Homo sapiens
guuaguuaaaagccc

SEQ ID NO: 601576 - RNA, 22 nt, Homo sapiens
guuauaaaacuauguguucaau

SEQ ID NO: 601577 - RNA, 15 nt, Homo sapiens
guuauagaacuucau

SEQ ID NO: 601578 - RNA, 15 nt, Homo sapiens
guuauaucuaugcaa

SEQ ID NO: 601579 - RNA, 17 nt, Homo sapiens
guuaucuuagcuggaua

SEQ ID NO: 601580 - RNA, 14 nt, Homo sapiens
guuaugacagugaa

SEQ ID NO: 601581 - RNA, 14 nt, Homo sapiens
guuaugacuaugua

SEQ ID NO: 601582 - RNA, 16 nt, Homo sapiens
guuaugauauuguuua

SEQ ID NO: 601583 - RNA, 23 nt, Homo sapiens
guuaugauauuguuuaaaauuca

SEQ ID NO: 601584 - RNA, 11 nt, Homo sapiens
guuaugccaug

SEQ ID NO: 601585 - RNA, 22 nt, Homo sapiens
guuaugccguauaggaugucag

SEQ ID NO: 601586 - RNA, 22 nt, Homo sapiens
guuaugcuccugcugauccaga

SEQ ID NO: 601587 - RNA, 18 nt, Homo sapiens
guuaugggcacaugccuu

SEQ ID NO: 601588 - RNA, 22 nt, Homo sapiens
guuauuaguccaaaugugauca

SEQ ID NO: 601589 - RNA, 24 nt, Homo sapiens
guuauucacaaccucaccaaacua

SEQ ID NO: 601590 - RNA, 17 nt, Homo sapiens
guuauuuaugcacugug

SEQ ID NO: 601591 - RNA, 22 nt, Homo sapiens
guuauuuauuuccuuagugcca

SEQ ID NO: 601592 - RNA, 17 nt, Homo sapiens
uggcuguguuugcagcc

SEQ ID NO: 601593 - RNA, 14 nt, Homo sapiens
uggcuuaaaaagca

SEQ ID NO: 601594 - RNA, 20 nt, Homo sapiens
uggcuuaagugagcagaaca

SEQ ID NO: 601595 - RNA, 18 nt, Homo sapiens
uggcuuagaaaguccaau

SEQ ID NO: 601596 - RNA, 23 nt, Homo sapiens
uggcuucaggcuaagaagagauu

SEQ ID NO: 601597 - RNA, 13 nt, Homo sapiens
uggcuucagggga

SEQ ID NO: 601598 - RNA, 22 nt, Homo sapiens
uggcuuccagguaucuccagga

SEQ ID NO: 601599 - RNA, 14 nt, Homo sapiens
uggcuuccuuggcu

SEQ ID NO: 601600 - RNA, 17 nt, Homo sapiens
uggcuucgucauuugca

SEQ ID NO: 601601 - RNA, 15 nt, Homo sapiens
uggcuucucuccuca

SEQ ID NO: 601602 - RNA, 20 nt, Homo sapiens
uggcuucugcuucaaacccu

SEQ ID NO: 601603 - RNA, 18 nt, Homo sapiens
uggcuucugggaccugug

SEQ ID NO: 601604 - RNA, 14 nt, Homo sapiens
uggcuucugugaug

SEQ ID NO: 601605 - RNA, 21 nt, Homo sapiens
uggcuucugugcacuagccug

SEQ ID NO: 601606 - RNA, 16 nt, Homo sapiens
uggcuugacaugugca

SEQ ID NO: 601607 - RNA, 20 nt, Homo sapiens
uggcuugagaugauaagaga

SEQ ID NO: 601608 - RNA, 17 nt, Homo sapiens
uggcuuggcaucugugu

SEQ ID NO: 601609 - RNA, 19 nt, Homo sapiens
uggcuuggggcaacagauu

SEQ ID NO: 601610 - RNA, 14 nt, Homo sapiens
uggcuuguucauca

SEQ ID NO: 601611 - RNA, 15 nt, Homo sapiens
uggcuuuaugugcaa

SEQ ID NO: 601612 - RNA, 17 nt, Homo sapiens
uggcuuuaugugcaaaa

SEQ ID NO: 601613 - RNA, 16 nt, Homo sapiens
uggcuuucagagccag

SEQ ID NO: 601614 - RNA, 16 nt, Homo sapiens
uggcuuucccuuccag

SEQ ID NO: 601615 - RNA, 16 nt, Homo sapiens
uggcuuucuggcugcu

SEQ ID NO: 601616 - RNA, 15 nt, Homo sapiens
uggcuuuuucuccuu

SEQ ID NO: 601617 - RNA, 13 nt, Homo sapiens
ugggaaaaaccac

SEQ ID NO: 601618 - RNA, 15 nt, Homo sapiens
ugggaaaaccagacu

SEQ ID NO: 601619 - RNA, 21 nt, Homo sapiens
ugggaaagcgcggacgugcug

SEQ ID NO: 601620 - RNA, 15 nt, Homo sapiens
ugggaacacaucugg

SEQ ID NO: 601621 - RNA, 16 nt, Homo sapiens
ugggaacaggcugugu

SEQ ID NO: 601622 - RNA, 23 nt, Homo sapiens
ugggaacaguaaagaaagcagaa

SEQ ID NO: 601623 - RNA, 12 nt, Homo sapiens
ugggaaccaagc

SEQ ID NO: 601624 - RNA, 20 nt, Homo sapiens
ugggaagacauuucugcaca

SEQ ID NO: 601625 - RNA, 18 nt, Homo sapiens
ugggaagaccagcuuugc

SEQ ID NO: 601626 - RNA, 12 nt, Homo sapiens
ugggaagccaua

SEQ ID NO: 601627 - RNA, 23 nt, Homo sapiens
ugggaagccauauucacaccuca

SEQ ID NO: 601628 - RNA, 16 nt, Homo sapiens
ugggaagccgugcucg

SEQ ID NO: 601629 - RNA, 18 nt, Homo sapiens
ugggaaggaaacaaccau

SEQ ID NO: 601630 - RNA, 19 nt, Homo sapiens
ugggaaggcuaaguucagu

SEQ ID NO: 601631 - RNA, 14 nt, Homo sapiens
ugggaaggcuuuca

SEQ ID NO: 601632 - RNA, 21 nt, Homo sapiens
ugggaaggggagcacaauuuc

SEQ ID NO: 601633 - RNA, 16 nt, Homo sapiens
ugggaaggggaggacc

SEQ ID NO: 601634 - RNA, 17 nt, Homo sapiens
ugggaaggggaggaccc

SEQ ID NO: 601635 - RNA, 22 nt, Homo sapiens
ugggaaggguccaucucagaga

SEQ ID NO: 601636 - RNA, 12 nt, Homo sapiens
ugggaagugaag

SEQ ID NO: 601637 - RNA, 21 nt, Homo sapiens
ugggaauagggagacagggua

SEQ ID NO: 601638 - RNA, 19 nt, Homo sapiens
ugggaaucaacagcauauu

SEQ ID NO: 601639 - RNA, 14 nt, Homo sapiens
ugggaaugcaauau

SEQ ID NO: 601640 - RNA, 19 nt, Homo sapiens
ugggaauuuggagugacca

SEQ ID NO: 601641 - RNA, 16 nt, Homo sapiens
ugggacaaaggacauu

SEQ ID NO: 601642 - RNA, 17 nt, Homo sapiens
ugggacacaacacagau

SEQ ID NO: 601643 - RNA, 19 nt, Homo sapiens
ugggacacaacacagauaa

SEQ ID NO: 601644 - RNA, 13 nt, Homo sapiens
ugggacagaggag

SEQ ID NO: 601645 - RNA, 15 nt, Homo sapiens
ugggacauggcacag

SEQ ID NO: 601646 - RNA, 13 nt, Homo sapiens
ugggaccacagac

SEQ ID NO: 601647 - RNA, 16 nt, Homo sapiens
ugggaccacagacuca

SEQ ID NO: 601648 - RNA, 12 nt, Homo sapiens
ugggaccccaaa

SEQ ID NO: 601649 - RNA, 21 nt, Homo sapiens
ugggacccuucagccacuaca

SEQ ID NO: 601650 - RNA, 19 nt, Homo sapiens
ugggaccgugcgagcugcc

SEQ ID NO: 601651 - RNA, 15 nt, Homo sapiens
ugggacguggcucag

SEQ ID NO: 601652 - RNA, 15 nt, Homo sapiens
ugggacuacaggugu

SEQ ID NO: 601653 - RNA, 15 nt, Homo sapiens
ugggacucaggauau

SEQ ID NO: 601654 - RNA, 23 nt, Homo sapiens
ugggacucggagacuauggccuc

SEQ ID NO: 601655 - RNA, 20 nt, Homo sapiens
ugggacugagaaggcucacg

SEQ ID NO: 601656 - RNA, 22 nt, Homo sapiens
ugggacuggacagcuuugcucc

SEQ ID NO: 601657 - RNA, 14 nt, Homo sapiens
ugggacuuauguau

SEQ ID NO: 601658 - RNA, 15 nt, Homo sapiens
ugggagacaugugac

SEQ ID NO: 601659 - RNA, 21 nt, Homo sapiens
ugggagaccuguuggccugug

SEQ ID NO: 601660 - RNA, 17 nt, Homo sapiens
ugggagacucuuugaaa

SEQ ID NO: 601661 - RNA, 20 nt, Homo sapiens
ugggagacugaagacucagc

SEQ ID NO: 601662 - RNA, 16 nt, Homo sapiens
ugggagauacagccau

SEQ ID NO: 601663 - RNA, 13 nt, Homo sapiens
ugggagcaaaaaa

SEQ ID NO: 601664 - RNA, 20 nt, Homo sapiens
ugggagccaggcccagaaag

SEQ ID NO: 601665 - RNA, 22 nt, Homo sapiens
ugggagccaguccuccacucga

SEQ ID NO: 601666 - RNA, 22 nt, Homo sapiens
ugggagccgggacccucaggug

SEQ ID NO: 601667 - RNA, 15 nt, Homo sapiens
ugggagccugaggca

SEQ ID NO: 601668 - RNA, 12 nt, Homo sapiens
ugggagcuuucc

SEQ ID NO: 601669 - RNA, 17 nt, Homo sapiens
ugggaggcagaaaccua

SEQ ID NO: 601670 - RNA, 22 nt, Homo sapiens
ugggaggccccacccuucuccc

SEQ ID NO: 601671 - RNA, 21 nt, Homo sapiens
ugggaggcugaggcagcagac

SEQ ID NO: 601672 - RNA, 13 nt, Homo sapiens
ugggaggcuguga

SEQ ID NO: 601673 - RNA, 17 nt, Homo sapiens
ugggagggaaaagggaa

SEQ ID NO: 601674 - RNA, 16 nt, Homo sapiens
ugggagguggaagaag

SEQ ID NO: 601675 - RNA, 17 nt, Homo sapiens
ugggagucacacagugu

SEQ ID NO: 601676 - RNA, 21 nt, Homo sapiens
ugggaguuauaggucauggga

SEQ ID NO: 601677 - RNA, 13 nt, Homo sapiens
ugggauaaacauc

SEQ ID NO: 601678 - RNA, 18 nt, Homo sapiens
ugggauagagaauguucc

SEQ ID NO: 601679 - RNA, 20 nt, Homo sapiens
ugggauagagaauguuccag

SEQ ID NO: 601680 - RNA, 17 nt, Homo sapiens
ugggauaguguucugcu

SEQ ID NO: 601681 - RNA, 14 nt, Homo sapiens
ugggaucauugcau

SEQ ID NO: 601682 - RNA, 16 nt, Homo sapiens
ugggauccacacugag

SEQ ID NO: 601683 - RNA, 18 nt, Homo sapiens
ugggauccacuucuuggu

SEQ ID NO: 601684 - RNA, 14 nt, Homo sapiens
ugggaucuggcaca

SEQ ID NO: 601685 - RNA, 19 nt, Homo sapiens
ugggaucuuucugggagcu

SEQ ID NO: 601686 - RNA, 16 nt, Homo sapiens
ugggaugagagggccc

SEQ ID NO: 601687 - RNA, 22 nt, Homo sapiens
ugggaugagagggcccagaaga

SEQ ID NO: 601688 - RNA, 18 nt, Homo sapiens
ugggaugcagugauguga

SEQ ID NO: 601689 - RNA, 21 nt, Homo sapiens
ugggauggacaggaaagggca

SEQ ID NO: 601690 - RNA, 15 nt, Homo sapiens
ugggauuacagaucu

SEQ ID NO: 601691 - RNA, 13 nt, Homo sapiens
ugggauuacaggc

SEQ ID NO: 601692 - RNA, 23 nt, Homo sapiens
ugggauuacaggcaugagccauu

SEQ ID NO: 601693 - RNA, 13 nt, Homo sapiens
ugggauuacaggg

SEQ ID NO: 601694 - RNA, 15 nt, Homo sapiens
ugggauuacagggau

SEQ ID NO: 601695 - RNA, 14 nt, Homo sapiens
ugggauuccugacc

SEQ ID NO: 601696 - RNA, 14 nt, Homo sapiens
ugggauuugagaua

SEQ ID NO: 601697 - RNA, 16 nt, Homo sapiens
ugggauuugcugugua

SEQ ID NO: 601698 - RNA, 22 nt, Homo sapiens
ugggcaagagaugggacaagca

SEQ ID NO: 601699 - RNA, 17 nt, Homo sapiens
ugggcacacacacccgc

SEQ ID NO: 601700 - RNA, 14 nt, Homo sapiens
ugggcacaguggac

SEQ ID NO: 601701 - RNA, 19 nt, Homo sapiens
ugggcacaguggacucagc

SEQ ID NO: 601702 - RNA, 12 nt, Homo sapiens
ugggcaccucag

SEQ ID NO: 601703 - RNA, 22 nt, Homo sapiens
ugggcacucccuugguggcaag

SEQ ID NO: 601704 - RNA, 23 nt, Homo sapiens
ugggcacucccuugguggcaaga

SEQ ID NO: 601705 - RNA, 13 nt, Homo sapiens
ugggcacugggau

SEQ ID NO: 601706 - RNA, 16 nt, Homo sapiens
ugggcacuucaucuga

SEQ ID NO: 601707 - RNA, 14 nt, Homo sapiens
ugggcagagcccaa

SEQ ID NO: 601708 - RNA, 16 nt, Homo sapiens
ugggcaggaccucaga

SEQ ID NO: 601709 - RNA, 22 nt, Homo sapiens
ugggcagggucuguuuggacug

SEQ ID NO: 601710 - RNA, 14 nt, Homo sapiens
ugggcagguaguuu

SEQ ID NO: 601711 - RNA, 17 nt, Homo sapiens
ugggcagugagugccau

SEQ ID NO: 601712 - RNA, 13 nt, Homo sapiens
ugggcaucauuuu

SEQ ID NO: 601713 - RNA, 18 nt, Homo sapiens
ugggcauucuuguuucaa

SEQ ID NO: 601714 - RNA, 20 nt, Homo sapiens
ugggcauuucacgaacuguu

SEQ ID NO: 601715 - RNA, 23 nt, Homo sapiens
guuauuugaaaauuugauuuuga

SEQ ID NO: 601716 - RNA, 16 nt, Homo sapiens
guucaaagacugugaa

SEQ ID NO: 601717 - RNA, 13 nt, Homo sapiens
guucaaagcacag

SEQ ID NO: 601718 - RNA, 18 nt, Homo sapiens
guucaagacuuagcuccu

SEQ ID NO: 601719 - RNA, 12 nt, Homo sapiens
guucaagcaauu

SEQ ID NO: 601720 - RNA, 16 nt, Homo sapiens
guucaagcacacugga

SEQ ID NO: 601721 - RNA, 14 nt, Homo sapiens
guucaauacaguga

SEQ ID NO: 601722 - RNA, 15 nt, Homo sapiens
guucaauacagugaa

SEQ ID NO: 601723 - RNA, 14 nt, Homo sapiens
guucaccugaauca

SEQ ID NO: 601724 - RNA, 21 nt, Homo sapiens
guucacggcgauucuccccau

SEQ ID NO: 601725 - RNA, 16 nt, Homo sapiens
guucacuuucuaucuu

SEQ ID NO: 601726 - RNA, 22 nt, Homo sapiens
guucagaaagcaauaacuuugu

SEQ ID NO: 601727 - RNA, 19 nt, Homo sapiens
guucagagaucguuccuau

SEQ ID NO: 601728 - RNA, 17 nt, Homo sapiens
guucauauuaagacaua

SEQ ID NO: 601729 - RNA, 19 nt, Homo sapiens
guucauauuggacugauaa

SEQ ID NO: 601730 - RNA, 15 nt, Homo sapiens
guucaugcuuuguac

SEQ ID NO: 601731 - RNA, 21 nt, Homo sapiens
guucauggauuacuucucuau

SEQ ID NO: 601732 - RNA, 16 nt, Homo sapiens
guucauguuugcuuca

SEQ ID NO: 601733 - RNA, 20 nt, Homo sapiens
guucauguuuguaaauuaau

SEQ ID NO: 601734 - RNA, 16 nt, Homo sapiens
guucauuauguaugaa

SEQ ID NO: 601735 - RNA, 18 nt, Homo sapiens
guucauuauuuugugguu

SEQ ID NO: 601736 - RNA, 17 nt, Homo sapiens
guucauugaagcuuugu

SEQ ID NO: 601737 - RNA, 17 nt, Homo sapiens
guucauuuugaguauuu

SEQ ID NO: 601738 - RNA, 20 nt, Homo sapiens
guuccaaauucaguuucaua

SEQ ID NO: 601739 - RNA, 23 nt, Homo sapiens
guuccagugaugaaaacauucaa

SEQ ID NO: 601740 - RNA, 22 nt, Homo sapiens
guuccauuuuuccucuguucac

SEQ ID NO: 601741 - RNA, 20 nt, Homo sapiens
guucccaagcgucaucugug

SEQ ID NO: 601742 - RNA, 15 nt, Homo sapiens
guucccacuccuuca

SEQ ID NO: 601743 - RNA, 20 nt, Homo sapiens
guuccccacugacagccucc

SEQ ID NO: 601744 - RNA, 14 nt, Homo sapiens
guucccccaaccuc

SEQ ID NO: 601745 - RNA, 14 nt, Homo sapiens
guucccccacugau

SEQ ID NO: 601746 - RNA, 15 nt, Homo sapiens
guucccccagcaagc

SEQ ID NO: 601747 - RNA, 21 nt, Homo sapiens
guuccccuaguucuacaugaa

SEQ ID NO: 601748 - RNA, 13 nt, Homo sapiens
guuccccucugcu

SEQ ID NO: 601749 - RNA, 13 nt, Homo sapiens
guucccuuccuca

SEQ ID NO: 601750 - RNA, 16 nt, Homo sapiens
guucccuuggccucag

SEQ ID NO: 601751 - RNA, 21 nt, Homo sapiens
guucccuuguaaagacagagu

SEQ ID NO: 601752 - RNA, 15 nt, Homo sapiens
guuccgagaagaaca

SEQ ID NO: 601753 - RNA, 14 nt, Homo sapiens
guuccuacuaggca

SEQ ID NO: 601754 - RNA, 20 nt, Homo sapiens
guuccucaucugagaggcuc

SEQ ID NO: 601755 - RNA, 19 nt, Homo sapiens
guuccugaaaauugcaaua

SEQ ID NO: 601756 - RNA, 17 nt, Homo sapiens
guuccugcuccaugacu

SEQ ID NO: 601757 - RNA, 16 nt, Homo sapiens
guuccuggcugaugau

SEQ ID NO: 601758 - RNA, 24 nt, Homo sapiens
guuccugugcagaugcugcugaag

SEQ ID NO: 601759 - RNA, 16 nt, Homo sapiens
guuccuuacugcagaa

SEQ ID NO: 601760 - RNA, 14 nt, Homo sapiens
guuccuugagcacc

SEQ ID NO: 601761 - RNA, 23 nt, Homo sapiens
guuccuugguuguauaaagcaaa

SEQ ID NO: 601762 - RNA, 11 nt, Homo sapiens
guuccuuucag

SEQ ID NO: 601763 - RNA, 19 nt, Homo sapiens
guuccuuuugcaaacaauu

SEQ ID NO: 601764 - RNA, 19 nt, Homo sapiens
guucgauguuagcguuuac

SEQ ID NO: 601765 - RNA, 16 nt, Homo sapiens
guucgcucgugcagua

SEQ ID NO: 601766 - RNA, 23 nt, Homo sapiens
guucuaaggggaccuacagacag

SEQ ID NO: 601767 - RNA, 21 nt, Homo sapiens
guucuaccucaggcagcucaa

SEQ ID NO: 601768 - RNA, 22 nt, Homo sapiens
guucuacugagaaaagccucuc

SEQ ID NO: 601769 - RNA, 16 nt, Homo sapiens
guucuauccccaagcu

SEQ ID NO: 601770 - RNA, 19 nt, Homo sapiens
guucucaaaguuaauucac

SEQ ID NO: 601771 - RNA, 23 nt, Homo sapiens
guucucaaaguuaauucaccuau

SEQ ID NO: 601772 - RNA, 23 nt, Homo sapiens
guucucagagccaaguccucccu

SEQ ID NO: 601773 - RNA, 20 nt, Homo sapiens
guucucauggguggcacuca

SEQ ID NO: 601774 - RNA, 15 nt, Homo sapiens
guucucauuucucag

SEQ ID NO: 601775 - RNA, 17 nt, Homo sapiens
guucuccucugaccugc

SEQ ID NO: 601776 - RNA, 18 nt, Homo sapiens
guucuccugccaccaaga

SEQ ID NO: 601777 - RNA, 18 nt, Homo sapiens
guucucgaacuccugacc

SEQ ID NO: 601778 - RNA, 13 nt, Homo sapiens
guucucuauacuc

SEQ ID NO: 601779 - RNA, 16 nt, Homo sapiens
guucucuauugcugcu

SEQ ID NO: 601780 - RNA, 16 nt, Homo sapiens
guucucuucauccauu

SEQ ID NO: 601781 - RNA, 16 nt, Homo sapiens
guucucuuuaagccag

SEQ ID NO: 601782 - RNA, 15 nt, Homo sapiens
guucugcccauggga

SEQ ID NO: 601783 - RNA, 21 nt, Homo sapiens
guucugcugaaucaaaucucu

SEQ ID NO: 601784 - RNA, 21 nt, Homo sapiens
guucuggauaccauuauaugu

SEQ ID NO: 601785 - RNA, 16 nt, Homo sapiens
guucuggccaccccag

SEQ ID NO: 601786 - RNA, 16 nt, Homo sapiens
guucuguccucaagua

SEQ ID NO: 601787 - RNA, 20 nt, Homo sapiens
guucugugauacagaacucu

SEQ ID NO: 601788 - RNA, 16 nt, Homo sapiens
guucuguuuggcacuu

SEQ ID NO: 601789 - RNA, 21 nt, Homo sapiens
guucuuaacuuugaaccauaa

SEQ ID NO: 601790 - RNA, 23 nt, Homo sapiens
guucuucccuuuuacauacugcu

SEQ ID NO: 601791 - RNA, 17 nt, Homo sapiens
guucuucuggggugcua

SEQ ID NO: 601792 - RNA, 15 nt, Homo sapiens
guucuucuuccugaa

SEQ ID NO: 601793 - RNA, 21 nt, Homo sapiens
guucuuuaauguuguccagga

SEQ ID NO: 601794 - RNA, 15 nt, Homo sapiens
guucuuugauuugua

SEQ ID NO: 601795 - RNA, 18 nt, Homo sapiens
guucuuuucuccuuuacc

SEQ ID NO: 601796 - RNA, 18 nt, Homo sapiens
guugaaccguuucuuuaa

SEQ ID NO: 601797 - RNA, 14 nt, Homo sapiens
guugaagacuuugu

SEQ ID NO: 601798 - RNA, 19 nt, Homo sapiens
guugaagccaugucuacau

SEQ ID NO: 601799 - RNA, 17 nt, Homo sapiens
guugaauguugcaaugu

SEQ ID NO: 601800 - RNA, 23 nt, Homo sapiens
guugaauuucccacauacccucc

SEQ ID NO: 601801 - RNA, 23 nt, Homo sapiens
guugacgccuaacugaauuugaa

SEQ ID NO: 601802 - RNA, 14 nt, Homo sapiens
guugacugcugcuc

SEQ ID NO: 601803 - RNA, 19 nt, Homo sapiens
guugacuuauaguacauga

SEQ ID NO: 601804 - RNA, 19 nt, Homo sapiens
guugagaguugcuggugua

SEQ ID NO: 601805 - RNA, 17 nt, Homo sapiens
guugagaugccuguuga

SEQ ID NO: 601806 - RNA, 18 nt, Homo sapiens
guugagaugccuguugaa

SEQ ID NO: 601807 - RNA, 18 nt, Homo sapiens
guugagccccaaguccug

SEQ ID NO: 601808 - RNA, 12 nt, Homo sapiens
guugaguguuca

SEQ ID NO: 601809 - RNA, 23 nt, Homo sapiens
guugauacaaaccacugugaaca

SEQ ID NO: 601810 - RNA, 15 nt, Homo sapiens
guugauacuuguucc

SEQ ID NO: 601811 - RNA, 22 nt, Homo sapiens
guugaucucuuagaagccaugg

SEQ ID NO: 601812 - RNA, 22 nt, Homo sapiens
guugauggaaaauaaacaucag

SEQ ID NO: 601813 - RNA, 14 nt, Homo sapiens
guugcacugauauu

SEQ ID NO: 601814 - RNA, 22 nt, Homo sapiens
guugcagcccuugugaugugau

SEQ ID NO: 601815 - RNA, 23 nt, Homo sapiens
guugcagcccuugugaugugauu

SEQ ID NO: 601816 - RNA, 15 nt, Homo sapiens
guugcaguaagccaa

SEQ ID NO: 601817 - RNA, 15 nt, Homo sapiens
guugcagucacugug

SEQ ID NO: 601818 - RNA, 18 nt, Homo sapiens
guugcagugaauucauau

SEQ ID NO: 601819 - RNA, 21 nt, Homo sapiens
guugcagugagccgagaucac

SEQ ID NO: 601820 - RNA, 16 nt, Homo sapiens
guugcaucauguugaa

SEQ ID NO: 601821 - RNA, 19 nt, Homo sapiens
guugcaugccuauguacuc

SEQ ID NO: 601822 - RNA, 15 nt, Homo sapiens
guugcauuccuuugu

SEQ ID NO: 601823 - RNA, 12 nt, Homo sapiens
guugcauugcuu

SEQ ID NO: 601824 - RNA, 20 nt, Homo sapiens
guugcauuuaugaugcaguu

SEQ ID NO: 601825 - RNA, 22 nt, Homo sapiens
guugcccuagcccagacucuga

SEQ ID NO: 601826 - RNA, 13 nt, Homo sapiens
guugccgcagcgg

SEQ ID NO: 601827 - RNA, 16 nt, Homo sapiens
guugccucucuugccc

SEQ ID NO: 601828 - RNA, 16 nt, Homo sapiens
guugcuauaauaaaga

SEQ ID NO: 601829 - RNA, 22 nt, Homo sapiens
guugcucaaaucuauucagaca

SEQ ID NO: 601830 - RNA, 19 nt, Homo sapiens
guugcucacagcuguaaua

SEQ ID NO: 601831 - RNA, 15 nt, Homo sapiens
guugcugcaucuccc

SEQ ID NO: 601832 - RNA, 16 nt, Homo sapiens
guugcugcuacugucu

SEQ ID NO: 601833 - RNA, 18 nt, Homo sapiens
guugcuggcaguacuguu

SEQ ID NO: 601834 - RNA, 20 nt, Homo sapiens
guugcugggauuacaggugu

SEQ ID NO: 601835 - RNA, 15 nt, Homo sapiens
guugcuuucuuaucc

SEQ ID NO: 601836 - RNA, 16 nt, Homo sapiens
guugcuuuuacuucuc

SEQ ID NO: 601837 - RNA, 18 nt, Homo sapiens
ugggcauuuucccagaug

SEQ ID NO: 601838 - RNA, 13 nt, Homo sapiens
ugggccacagccc

SEQ ID NO: 601839 - RNA, 17 nt, Homo sapiens
ugggccacuguaggggu

SEQ ID NO: 601840 - RNA, 15 nt, Homo sapiens
ugggccagagcucaa

SEQ ID NO: 601841 - RNA, 13 nt, Homo sapiens
ugggccagggucu

SEQ ID NO: 601842 - RNA, 14 nt, Homo sapiens
ugggccauguccaa

SEQ ID NO: 601843 - RNA, 17 nt, Homo sapiens
ugggccauguccaaaga

SEQ ID NO: 601844 - RNA, 18 nt, Homo sapiens
ugggccauguccaaagag

SEQ ID NO: 601845 - RNA, 17 nt, Homo sapiens
ugggccauuaaaaacua

SEQ ID NO: 601846 - RNA, 21 nt, Homo sapiens
ugggcccucccuuuaccuuca

SEQ ID NO: 601847 - RNA, 22 nt, Homo sapiens
ugggccgggaggcagugcugau

SEQ ID NO: 601848 - RNA, 15 nt, Homo sapiens
ugggccucaguucaa

SEQ ID NO: 601849 - RNA, 17 nt, Homo sapiens
ugggccucugacucuga

SEQ ID NO: 601850 - RNA, 23 nt, Homo sapiens
ugggcgauuugggggcucgggga

SEQ ID NO: 601851 - RNA, 22 nt, Homo sapiens
ugggcgcuguuuucucagcucc

SEQ ID NO: 601852 - RNA, 21 nt, Homo sapiens
ugggcgugugugacacugaug

SEQ ID NO: 601853 - RNA, 19 nt, Homo sapiens
ugggcuaaugaagaucaua

SEQ ID NO: 601854 - RNA, 13 nt, Homo sapiens
ugggcuacuggca

SEQ ID NO: 601855 - RNA, 14 nt, Homo sapiens
ugggcuauggacac

SEQ ID NO: 601856 - RNA, 19 nt, Homo sapiens
ugggcuauuuggacucagg

SEQ ID NO: 601857 - RNA, 22 nt, Homo sapiens
ugggcuccggaggacucaccac

SEQ ID NO: 601858 - RNA, 20 nt, Homo sapiens
ugggcuccuggggcaauggg

SEQ ID NO: 601859 - RNA, 17 nt, Homo sapiens
ugggcucgcacugccca

SEQ ID NO: 601860 - RNA, 23 nt, Homo sapiens
ugggcucugugcagucacuggag

SEQ ID NO: 601861 - RNA, 18 nt, Homo sapiens
ugggcugaccgugucucu

SEQ ID NO: 601862 - RNA, 15 nt, Homo sapiens
ugggcugagugcagc

SEQ ID NO: 601863 - RNA, 19 nt, Homo sapiens
ugggcugccugcuguguua

SEQ ID NO: 601864 - RNA, 14 nt, Homo sapiens
ugggcugcuggcca

SEQ ID NO: 601865 - RNA, 18 nt, Homo sapiens
ugggcuggggcugcuccc

SEQ ID NO: 601866 - RNA, 23 nt, Homo sapiens
ugggcuguaacguggcacuggua

SEQ ID NO: 601867 - RNA, 16 nt, Homo sapiens
ugggcugugggcugca

SEQ ID NO: 601868 - RNA, 13 nt, Homo sapiens
ugggcuugaccag

SEQ ID NO: 601869 - RNA, 23 nt, Homo sapiens
ugggcuuguaccacuuuugcaaa

SEQ ID NO: 601870 - RNA, 13 nt, Homo sapiens
uggggaaggggag

SEQ ID NO: 601871 - RNA, 16 nt, Homo sapiens
uggggaaggguuugaa

SEQ ID NO: 601872 - RNA, 23 nt, Homo sapiens
uggggaaugcucccagcugugcu

SEQ ID NO: 601873 - RNA, 16 nt, Homo sapiens
uggggacauugcucuc

SEQ ID NO: 601874 - RNA, 14 nt, Homo sapiens
uggggacuccucaa

SEQ ID NO: 601875 - RNA, 15 nt, Homo sapiens
uggggagaaagggag

SEQ ID NO: 601876 - RNA, 17 nt, Homo sapiens
uggggagacaaaucuca

SEQ ID NO: 601877 - RNA, 17 nt, Homo sapiens
uggggagacuucuuggc

SEQ ID NO: 601878 - RNA, 16 nt, Homo sapiens
uggggagcacuugucc

SEQ ID NO: 601879 - RNA, 17 nt, Homo sapiens
uggggagcccgucucag

SEQ ID NO: 601880 - RNA, 18 nt, Homo sapiens
uggggagccugagccaca

SEQ ID NO: 601881 - RNA, 22 nt, Homo sapiens
uggggaggggaauauacacauu

SEQ ID NO: 601882 - RNA, 20 nt, Homo sapiens
uggggauagaggaaagggau

SEQ ID NO: 601883 - RNA, 22 nt, Homo sapiens
uggggaucccacucuucuugca

SEQ ID NO: 601884 - RNA, 20 nt, Homo sapiens
uggggauuuaaaaacauucg

SEQ ID NO: 601885 - RNA, 19 nt, Homo sapiens
uggggcaggcugggccaug

SEQ ID NO: 601886 - RNA, 14 nt, Homo sapiens
uggggcaugaccuc

SEQ ID NO: 601887 - RNA, 15 nt, Homo sapiens
uggggcaugaccuca

SEQ ID NO: 601888 - RNA, 17 nt, Homo sapiens
uggggcauggcaaauca

SEQ ID NO: 601889 - RNA, 21 nt, Homo sapiens
uggggccaaacccaccugcua

SEQ ID NO: 601890 - RNA, 12 nt, Homo sapiens
uggggccaccaa

SEQ ID NO: 601891 - RNA, 13 nt, Homo sapiens
uggggccagucag

SEQ ID NO: 601892 - RNA, 17 nt, Homo sapiens
uggggccccaucuugau

SEQ ID NO: 601893 - RNA, 10 nt, Homo sapiens
uggggcuccu

SEQ ID NO: 601894 - RNA, 12 nt, Homo sapiens
uggggcucucuc

SEQ ID NO: 601895 - RNA, 22 nt, Homo sapiens
uggggcuggccucccaaaugag

SEQ ID NO: 601896 - RNA, 15 nt, Homo sapiens
uggggcuggccugca

SEQ ID NO: 601897 - RNA, 23 nt, Homo sapiens
ugggggaaaguguugaccacaga

SEQ ID NO: 601898 - RNA, 19 nt, Homo sapiens
guuuauuuaucagugacag

SEQ ID NO: 601899 - RNA, 22 nt, Homo sapiens
guuuauuucaggcauuggauau

SEQ ID NO: 601900 - RNA, 21 nt, Homo sapiens
guuuauuuuuuuaaaacacaa

SEQ ID NO: 601901 - RNA, 17 nt, Homo sapiens
guuucaaaauagucauu

SEQ ID NO: 601902 - RNA, 18 nt, Homo sapiens
guuucaaagggauugcuu

SEQ ID NO: 601903 - RNA, 19 nt, Homo sapiens
guuucaagacugacauuuu

SEQ ID NO: 601904 - RNA, 17 nt, Homo sapiens
guuucaaguuauucaaa

SEQ ID NO: 601905 - RNA, 18 nt, Homo sapiens
guuucacacuagucacau

SEQ ID NO: 601906 - RNA, 18 nt, Homo sapiens
guuucacagccuauaacc

SEQ ID NO: 601907 - RNA, 19 nt, Homo sapiens
guuucaccaugcuggucag

SEQ ID NO: 601908 - RNA, 19 nt, Homo sapiens
guuucaccauguuggccag

SEQ ID NO: 601909 - RNA, 19 nt, Homo sapiens
guuucacccuuaacccaag

SEQ ID NO: 601910 - RNA, 17 nt, Homo sapiens
guuucaccguguuagcc

SEQ ID NO: 601911 - RNA, 19 nt, Homo sapiens
guuucacuguguuagccag

SEQ ID NO: 601912 - RNA, 23 nt, Homo sapiens
guuucagaagcauucaggcacug

SEQ ID NO: 601913 - RNA, 14 nt, Homo sapiens
guuucagaugugca

SEQ ID NO: 601914 - RNA, 17 nt, Homo sapiens
guuucccguauugacag

SEQ ID NO: 601915 - RNA, 16 nt, Homo sapiens
guuucccuuucacugg

SEQ ID NO: 601916 - RNA, 14 nt, Homo sapiens
guuuccguucacau

SEQ ID NO: 601917 - RNA, 16 nt, Homo sapiens
guuuccucaagucuca

SEQ ID NO: 601918 - RNA, 14 nt, Homo sapiens
guuuccugacuccu

SEQ ID NO: 601919 - RNA, 22 nt, Homo sapiens
guuuccugccugcggaccagau

SEQ ID NO: 601920 - RNA, 21 nt, Homo sapiens
guuuccuuuuggaacauuucu

SEQ ID NO: 601921 - RNA, 20 nt, Homo sapiens
guuucgaaguugaugcaauc

SEQ ID NO: 601922 - RNA, 19 nt, Homo sapiens
guuucgauuuuugaucaau

SEQ ID NO: 601923 - RNA, 19 nt, Homo sapiens
guuucguguauaugccuca

SEQ ID NO: 601924 - RNA, 21 nt, Homo sapiens
guuucuaagcauguagccagu

SEQ ID NO: 601925 - RNA, 20 nt, Homo sapiens
guuucuacuuccccauuuca

SEQ ID NO: 601926 - RNA, 19 nt, Homo sapiens
guuucucccccugccaguc

SEQ ID NO: 601927 - RNA, 15 nt, Homo sapiens
guuucuccugagcua

SEQ ID NO: 601928 - RNA, 19 nt, Homo sapiens
guuucuccuuaguuggcug

SEQ ID NO: 601929 - RNA, 21 nt, Homo sapiens
guuucuccuuuugaccaaaua

SEQ ID NO: 601930 - RNA, 22 nt, Homo sapiens
guuucucuugaagaacugacua

SEQ ID NO: 601931 - RNA, 22 nt, Homo sapiens
guuucugagagagugccaugau

SEQ ID NO: 601932 - RNA, 23 nt, Homo sapiens
guuucugagcauaaugcucccau

SEQ ID NO: 601933 - RNA, 17 nt, Homo sapiens
guuucugauaccacugc

SEQ ID NO: 601934 - RNA, 23 nt, Homo sapiens
guuucuggauuucauacuguaac

SEQ ID NO: 601935 - RNA, 16 nt, Homo sapiens
guuucuggcagccagu

SEQ ID NO: 601936 - RNA, 19 nt, Homo sapiens
guuucugguauucacagaa

SEQ ID NO: 601937 - RNA, 22 nt, Homo sapiens
guuucuguauacaacccuggca

SEQ ID NO: 601938 - RNA, 17 nt, Homo sapiens
guuucugucaagcauau

SEQ ID NO: 601939 - RNA, 14 nt, Homo sapiens
guuucuguccugua

SEQ ID NO: 601940 - RNA, 13 nt, Homo sapiens
guuucuguucucc

SEQ ID NO: 601941 - RNA, 16 nt, Homo sapiens
guuucuguuucuugcu

SEQ ID NO: 601942 - RNA, 16 nt, Homo sapiens
guuucuuaaauggaau

SEQ ID NO: 601943 - RNA, 16 nt, Homo sapiens
guuucuuagauaugau

SEQ ID NO: 601944 - RNA, 18 nt, Homo sapiens
guuucuuccccaaccccu

SEQ ID NO: 601945 - RNA, 15 nt, Homo sapiens
guuucuugacaagcu

SEQ ID NO: 601946 - RNA, 24 nt, Homo sapiens
guuucuugccugaacuccugccau

SEQ ID NO: 601947 - RNA, 15 nt, Homo sapiens
guuucuugggguccc

SEQ ID NO: 601948 - RNA, 22 nt, Homo sapiens
guuucuuuccccaaaaauugac

SEQ ID NO: 601949 - RNA, 22 nt, Homo sapiens
guuucuuuguuuucgauuuuga

SEQ ID NO: 601950 - RNA, 16 nt, Homo sapiens
guuucuuuuugcucgc

SEQ ID NO: 601951 - RNA, 17 nt, Homo sapiens
guuugaagacacagccu

SEQ ID NO: 601952 - RNA, 20 nt, Homo sapiens
guuugaagacacagccuccc

SEQ ID NO: 601953 - RNA, 20 nt, Homo sapiens
guuugaaggaggugagggau

SEQ ID NO: 601954 - RNA, 20 nt, Homo sapiens
guuugaauggagauucugau

SEQ ID NO: 601955 - RNA, 10 nt, Homo sapiens
guuugacaac

SEQ ID NO: 601956 - RNA, 20 nt, Homo sapiens
guuugaguuuuuccucccag

SEQ ID NO: 601957 - RNA, 23 nt, Homo sapiens
guuugaucccuguuacccagaga

SEQ ID NO: 601958 - RNA, 15 nt, Homo sapiens
guuugauuacuguuu

SEQ ID NO: 601959 - RNA, 18 nt, Homo sapiens
ugguaaagccucauuuga

SEQ ID NO: 601960 - RNA, 19 nt, Homo sapiens
ugguaaagccucauuugaa

SEQ ID NO: 601961 - RNA, 15 nt, Homo sapiens
ugguaaauuaguauu

SEQ ID NO: 601962 - RNA, 13 nt, Homo sapiens
ugguaaccgagcc

SEQ ID NO: 601963 - RNA, 15 nt, Homo sapiens
ugguaacguggcucc

SEQ ID NO: 601964 - RNA, 22 nt, Homo sapiens
ugguaacugcuuucuguuccaa

SEQ ID NO: 601965 - RNA, 17 nt, Homo sapiens
ugguaacuguagucauc

SEQ ID NO: 601966 - RNA, 23 nt, Homo sapiens
ugguaacuuuuuuuuaaagcuca

SEQ ID NO: 601967 - RNA, 22 nt, Homo sapiens
ugguaagagacagaauguaucu

SEQ ID NO: 601968 - RNA, 16 nt, Homo sapiens
ugguaaggccucugga

SEQ ID NO: 601969 - RNA, 14 nt, Homo sapiens
ugguaaguugagau

SEQ ID NO: 601970 - RNA, 21 nt, Homo sapiens
ugguaauauaguuauugcaca

SEQ ID NO: 601971 - RNA, 20 nt, Homo sapiens
ugguaauauugacuuguaua

SEQ ID NO: 601972 - RNA, 15 nt, Homo sapiens
ugguaaucaguugga

SEQ ID NO: 601973 - RNA, 16 nt, Homo sapiens
ugguaccuauuugacu

SEQ ID NO: 601974 - RNA, 13 nt, Homo sapiens
ugguacugcugag

SEQ ID NO: 601975 - RNA, 15 nt, Homo sapiens
ugguagaaaggcagu

SEQ ID NO: 601976 - RNA, 21 nt, Homo sapiens
ugguagaacuaaacaauaagc

SEQ ID NO: 601977 - RNA, 19 nt, Homo sapiens
ugguagacuuggacaucuc

SEQ ID NO: 601978 - RNA, 12 nt, Homo sapiens
ugguagcacuug

SEQ ID NO: 601979 - RNA, 17 nt, Homo sapiens
ugguaggauaucuuggc

SEQ ID NO: 601980 - RNA, 15 nt, Homo sapiens
ugguaggcauuuccu

SEQ ID NO: 601981 - RNA, 20 nt, Homo sapiens
ugguaguggaauagugaaua

SEQ ID NO: 601982 - RNA, 16 nt, Homo sapiens
ugguaguuaugugaag

SEQ ID NO: 601983 - RNA, 22 nt, Homo sapiens
ugguauaaacguccuacuguau

SEQ ID NO: 601984 - RNA, 14 nt, Homo sapiens
ugguaucacugaac

SEQ ID NO: 601985 - RNA, 14 nt, Homo sapiens
ugguauccaaguua

SEQ ID NO: 601986 - RNA, 23 nt, Homo sapiens
ugguauccuacugagcauuugca

SEQ ID NO: 601987 - RNA, 17 nt, Homo sapiens
ugguauuucuaauucca

SEQ ID NO: 601988 - RNA, 18 nt, Homo sapiens
ugguauuuucaaccauaa

SEQ ID NO: 601989 - RNA, 15 nt, Homo sapiens
uggucaacacuuaag

SEQ ID NO: 601990 - RNA, 15 nt, Homo sapiens
uggucaagugaugaa

SEQ ID NO: 601991 - RNA, 23 nt, Homo sapiens
uggucacaugaugugcauagaga

SEQ ID NO: 601992 - RNA, 21 nt, Homo sapiens
uggucacccuggggcugcuua

SEQ ID NO: 601993 - RNA, 20 nt, Homo sapiens
uggucacccuucaacgcucc

SEQ ID NO: 601994 - RNA, 17 nt, Homo sapiens
uggucaggcuggucuca

SEQ ID NO: 601995 - RNA, 15 nt, Homo sapiens
uggucauacggguca

SEQ ID NO: 601996 - RNA, 13 nt, Homo sapiens
uggucauccaaac

SEQ ID NO: 601997 - RNA, 17 nt, Homo sapiens
uggucauggacagauag

SEQ ID NO: 601998 - RNA, 14 nt, Homo sapiens
uggucauugaggga

SEQ ID NO: 601999 - RNA, 12 nt, Homo sapiens
ugguccaugcag

SEQ ID NO: 602000 - RNA, 13 nt, Homo sapiens
uggucccaagaca

SEQ ID NO: 602001 - RNA, 19 nt, Homo sapiens
uggucccagaguggcugca

SEQ ID NO: 602002 - RNA, 17 nt, Homo sapiens
ugguccccagcauugca

SEQ ID NO: 602003 - RNA, 22 nt, Homo sapiens
ugguccccucccccauccccac

SEQ ID NO: 602004 - RNA, 21 nt, Homo sapiens
uggucccggggccagcacuuc

SEQ ID NO: 602005 - RNA, 14 nt, Homo sapiens
ugguccgaucuuug

SEQ ID NO: 602006 - RNA, 14 nt, Homo sapiens
ugguccuaagcacc

SEQ ID NO: 602007 - RNA, 21 nt, Homo sapiens
ugguccuaagcaccugccuca

SEQ ID NO: 602008 - RNA, 16 nt, Homo sapiens
ugguccuccacuuugc

SEQ ID NO: 602009 - RNA, 14 nt, Homo sapiens
ugguccuucccuga

SEQ ID NO: 602010 - RNA, 20 nt, Homo sapiens
uggucguuuucaacagaauu

SEQ ID NO: 602011 - RNA, 20 nt, Homo sapiens
uggucuaagguucagccuga

SEQ ID NO: 602012 - RNA, 20 nt, Homo sapiens
uggucucaaacuuguggccu

SEQ ID NO: 602013 - RNA, 14 nt, Homo sapiens
uggucucuucacca

SEQ ID NO: 602014 - RNA, 18 nt, Homo sapiens
uggucugggcaccaccuc

SEQ ID NO: 602015 - RNA, 17 nt, Homo sapiens
uggucuguuugacuuua

SEQ ID NO: 602016 - RNA, 21 nt, Homo sapiens
uggucuucaagacgacagcuc

SEQ ID NO: 602017 - RNA, 17 nt, Homo sapiens
uggucuugaacuccuga

SEQ ID NO: 602018 - RNA, 16 nt, Homo sapiens
uggugaaaauguacug

SEQ ID NO: 602019 - RNA, 15 nt, Homo sapiens
guuuugcaagugcug

SEQ ID NO: 602020 - RNA, 15 nt, Homo sapiens
guuuuguauucucug

SEQ ID NO: 602021 - RNA, 13 nt, Homo sapiens
guuuuguuucauc

SEQ ID NO: 602022 - RNA, 19 nt, Homo sapiens
guuuuuaaaaaacugcuga

SEQ ID NO: 602023 - RNA, 13 nt, Homo sapiens
guuuuuacuguga

SEQ ID NO: 602024 - RNA, 23 nt, Homo sapiens
guuuuuauggcuuuugugcauua

SEQ ID NO: 602025 - RNA, 19 nt, Homo sapiens
guuuuuccacuacugcuac

SEQ ID NO: 602026 - RNA, 18 nt, Homo sapiens
guuuuucguuuugggguu

SEQ ID NO: 602027 - RNA, 19 nt, Homo sapiens
guuuuucuuguuguuauuc

SEQ ID NO: 602028 - RNA, 16 nt, Homo sapiens
guuuuuuauuaugcau

SEQ ID NO: 602029 - RNA, 18 nt, Homo sapiens
guuuuuuuacaacauuca

SEQ ID NO: 602030 - RNA, 22 nt, Homo sapiens
guuuuuuuucagccacuaagaa

SEQ ID NO: 602031 - RNA, 22 nt, Homo sapiens
guuuuuuuuuucuuuuuugcca

SEQ ID NO: 602032 - RNA, 23 nt, Homo sapiens
uaaaaaaaaaaaaaaaagugaug

SEQ ID NO: 602033 - RNA, 21 nt, Homo sapiens
uaaaaaaaaaacuucauucua

SEQ ID NO: 602034 - RNA, 19 nt, Homo sapiens
uaaaaaaaaaaggaugaaa

SEQ ID NO: 602035 - RNA, 19 nt, Homo sapiens
uaaaaaaaaagucagagac

SEQ ID NO: 602036 - RNA, 23 nt, Homo sapiens
uaaaaaaaaauuguaucucauua

SEQ ID NO: 602037 - RNA, 17 nt, Homo sapiens
uaaaaaaauuacuguga

SEQ ID NO: 602038 - RNA, 15 nt, Homo sapiens
uaaaaaaauuaguga

SEQ ID NO: 602039 - RNA, 22 nt, Homo sapiens
uaaaaaacauaaauuucuuuaa

SEQ ID NO: 602040 - RNA, 14 nt, Homo sapiens
uaaaaaagagacau

SEQ ID NO: 602041 - RNA, 13 nt, Homo sapiens
uaaaaaagcaaau

SEQ ID NO: 602042 - RNA, 17 nt, Homo sapiens
uaaaaaauaaugguguc

SEQ ID NO: 602043 - RNA, 22 nt, Homo sapiens
uaaaaacaacaaaaacaaacaa

SEQ ID NO: 602044 - RNA, 20 nt, Homo sapiens
uaaaaacaccaaaaagggau

SEQ ID NO: 602045 - RNA, 19 nt, Homo sapiens
uaaaaaccccaaacuguug

SEQ ID NO: 602046 - RNA, 13 nt, Homo sapiens
uaaaaaccgaaua

SEQ ID NO: 602047 - RNA, 15 nt, Homo sapiens
uaaaaaccgaauaaa

SEQ ID NO: 602048 - RNA, 21 nt, Homo sapiens
uaaaaaccugcuuggugugua

SEQ ID NO: 602049 - RNA, 17 nt, Homo sapiens
uaaaaacucuucagugc

SEQ ID NO: 602050 - RNA, 17 nt, Homo sapiens
uaaaaacugagugacuc

SEQ ID NO: 602051 - RNA, 13 nt, Homo sapiens
uaaaaacuggccc

SEQ ID NO: 602052 - RNA, 13 nt, Homo sapiens
uaaaaacuuguac

SEQ ID NO: 602053 - RNA, 15 nt, Homo sapiens
uaaaaacuuguacua

SEQ ID NO: 602054 - RNA, 20 nt, Homo sapiens
uaaaaagcucacugcugauc

SEQ ID NO: 602055 - RNA, 14 nt, Homo sapiens
uaaaaagcuuccau

SEQ ID NO: 602056 - RNA, 21 nt, Homo sapiens
uaaaaaggaaauuagucuuuu

SEQ ID NO: 602057 - RNA, 17 nt, Homo sapiens
uaaaaaggaaguacugc

SEQ ID NO: 602058 - RNA, 23 nt, Homo sapiens
uaaaaaggaaguggggacagauu

SEQ ID NO: 602059 - RNA, 22 nt, Homo sapiens
uaaaaaggaccagccuaaugua

SEQ ID NO: 602060 - RNA, 22 nt, Homo sapiens
uaaaaagggcagggcaucuccu

SEQ ID NO: 602061 - RNA, 12 nt, Homo sapiens
uaaaaaguaaug

SEQ ID NO: 602062 - RNA, 23 nt, Homo sapiens
uaaaaagugaacuuuuguaauuu

SEQ ID NO: 602063 - RNA, 18 nt, Homo sapiens
uaaaaagugacacagcag

SEQ ID NO: 602064 - RNA, 19 nt, Homo sapiens
uaaaaagugacacagcagc

SEQ ID NO: 602065 - RNA, 14 nt, Homo sapiens
uaaaaagugcuaua

SEQ ID NO: 602066 - RNA, 15 nt, Homo sapiens
uaaaaagugggcaaa

SEQ ID NO: 602067 - RNA, 20 nt, Homo sapiens
uaaaaaguuaagcugcuaua

SEQ ID NO: 602068 - RNA, 12 nt, Homo sapiens
uaaaaaguucag

SEQ ID NO: 602069 - RNA, 19 nt, Homo sapiens
uaaaaaguuucuaaagugu

SEQ ID NO: 602070 - RNA, 14 nt, Homo sapiens
uaaaaauaaauuca

SEQ ID NO: 602071 - RNA, 22 nt, Homo sapiens
uaaaaauauaaauuguacauuu

SEQ ID NO: 602072 - RNA, 16 nt, Homo sapiens
uaaaaauaugucauca

SEQ ID NO: 602073 - RNA, 18 nt, Homo sapiens
uaaaaaucacuuucauaa

SEQ ID NO: 602074 - RNA, 18 nt, Homo sapiens
uaaaaaucauaguacucu

SEQ ID NO: 602075 - RNA, 14 nt, Homo sapiens
uaaaaaucauguga

SEQ ID NO: 602076 - RNA, 17 nt, Homo sapiens
uaaaaaugagugcuuaa

SEQ ID NO: 602077 - RNA, 23 nt, Homo sapiens
uaaaaauggcaggggguggaauu

SEQ ID NO: 602078 - RNA, 18 nt, Homo sapiens
uaaaaauggccauuugcu

SEQ ID NO: 602079 - RNA, 19 nt, Homo sapiens
uaaaaauggccauuugcuu

SEQ ID NO: 602080 - RNA, 13 nt, Homo sapiens
uaaaaauguccug

SEQ ID NO: 602081 - RNA, 16 nt, Homo sapiens
uaaaaauguccugccu

SEQ ID NO: 602082 - RNA, 17 nt, Homo sapiens
uaaaaaugucucagcaa

SEQ ID NO: 602083 - RNA, 18 nt, Homo sapiens
ugguugccucucuugccc

SEQ ID NO: 602084 - RNA, 15 nt, Homo sapiens
ugguuggucaaauca

SEQ ID NO: 602085 - RNA, 20 nt, Homo sapiens
ugguuuaaaugauacaguau

SEQ ID NO: 602086 - RNA, 19 nt, Homo sapiens
ugguuuauauaaggcagua

SEQ ID NO: 602087 - RNA, 15 nt, Homo sapiens
ugguuuccacauuua

SEQ ID NO: 602088 - RNA, 17 nt, Homo sapiens
ugguuuccauuuacuaa

SEQ ID NO: 602089 - RNA, 18 nt, Homo sapiens
ugguuucccaagagcuac

SEQ ID NO: 602090 - RNA, 17 nt, Homo sapiens
ugguuucuuagauauga

SEQ ID NO: 602091 - RNA, 16 nt, Homo sapiens
ugguuugaaagaugca

SEQ ID NO: 602092 - RNA, 13 nt, Homo sapiens
ugguuugacucag

SEQ ID NO: 602093 - RNA, 17 nt, Homo sapiens
ugguuugccaugucgcu

SEQ ID NO: 602094 - RNA, 21 nt, Homo sapiens
ugguuugccugaggcuguaac

SEQ ID NO: 602095 - RNA, 12 nt, Homo sapiens
ugguuugggauc

SEQ ID NO: 602096 - RNA, 14 nt, Homo sapiens
ugguuuuccagaag

SEQ ID NO: 602097 - RNA, 20 nt, Homo sapiens
ugguuuugacucaccugaaa

SEQ ID NO: 602098 - RNA, 15 nt, Homo sapiens
ugguuuugugcacau

SEQ ID NO: 602099 - RNA, 18 nt, Homo sapiens
ugguuuuucaguuuucag

SEQ ID NO: 602100 - RNA, 19 nt, Homo sapiens
ugguuuuuggcucuuucag

SEQ ID NO: 602101 - RNA, 12 nt, Homo sapiens
uguaaaaacuga

SEQ ID NO: 602102 - RNA, 13 nt, Homo sapiens
uguaaaaauguua

SEQ ID NO: 602103 - RNA, 18 nt, Homo sapiens
uguaaaacuauauucuca

SEQ ID NO: 602104 - RNA, 22 nt, Homo sapiens
uguaaaaggcucagaucuuaau

SEQ ID NO: 602105 - RNA, 17 nt, Homo sapiens
uguaaaaguuauacuca

SEQ ID NO: 602106 - RNA, 20 nt, Homo sapiens
uguaaaauacauguaccuau

SEQ ID NO: 602107 - RNA, 21 nt, Homo sapiens
uguaaaauauuuaugagaaag

SEQ ID NO: 602108 - RNA, 12 nt, Homo sapiens
uguaaaauccac

SEQ ID NO: 602109 - RNA, 14 nt, Homo sapiens
uguaaaaucuugca

SEQ ID NO: 602110 - RNA, 22 nt, Homo sapiens
uguaaaaugcuuuucacuuucu

SEQ ID NO: 602111 - RNA, 22 nt, Homo sapiens
uguaaaauggaggccauugugu

SEQ ID NO: 602112 - RNA, 15 nt, Homo sapiens
uguaaaauuauuuca

SEQ ID NO: 602113 - RNA, 21 nt, Homo sapiens
uguaaaauuuauuuauauucc

SEQ ID NO: 602114 - RNA, 14 nt, Homo sapiens
uguaaacaaaccac

SEQ ID NO: 602115 - RNA, 15 nt, Homo sapiens
uguaaacaaaccaca

SEQ ID NO: 602116 - RNA, 18 nt, Homo sapiens
uguaaacaaaccacagca

SEQ ID NO: 602117 - RNA, 12 nt, Homo sapiens
uguaaaccaaag

SEQ ID NO: 602118 - RNA, 21 nt, Homo sapiens
uguaaaccuagaguuuuauca

SEQ ID NO: 602119 - RNA, 21 nt, Homo sapiens
uguaaacucuaucagcauugu

SEQ ID NO: 602120 - RNA, 12 nt, Homo sapiens
uguaaacugcca

SEQ ID NO: 602121 - RNA, 13 nt, Homo sapiens
uguaaacugccau

SEQ ID NO: 602122 - RNA, 15 nt, Homo sapiens
uguaaacugugcacc

SEQ ID NO: 602123 - RNA, 13 nt, Homo sapiens
uguaaacugugua

SEQ ID NO: 602124 - RNA, 18 nt, Homo sapiens
uguaaagaaaaccauaau

SEQ ID NO: 602125 - RNA, 19 nt, Homo sapiens
uguaaagacagagugaauu

SEQ ID NO: 602126 - RNA, 13 nt, Homo sapiens
uguaaagcuuaaa

SEQ ID NO: 602127 - RNA, 13 nt, Homo sapiens
uguaaagcuuuaa

SEQ ID NO: 602128 - RNA, 15 nt, Homo sapiens
uguaaaggauauuaa

SEQ ID NO: 602129 - RNA, 17 nt, Homo sapiens
uguaaaguagaauaagc

SEQ ID NO: 602130 - RNA, 18 nt, Homo sapiens
uguaaaguugguuggaua

SEQ ID NO: 602131 - RNA, 19 nt, Homo sapiens
uguaaaguugguuggauaa

SEQ ID NO: 602132 - RNA, 23 nt, Homo sapiens
uguaaauagaugaccuuuuugca

SEQ ID NO: 602133 - RNA, 13 nt, Homo sapiens
uguaaauaugcaa

SEQ ID NO: 602134 - RNA, 14 nt, Homo sapiens
uguaaauaugcaaa

SEQ ID NO: 602135 - RNA, 15 nt, Homo sapiens
uguaaaucugccaca

SEQ ID NO: 602136 - RNA, 15 nt, Homo sapiens
uguaaaugaaguaca

SEQ ID NO: 602137 - RNA, 20 nt, Homo sapiens
uguaaaugcucgugugauuu

SEQ ID NO: 602138 - RNA, 20 nt, Homo sapiens
uguaaauguguuagcacuga

SEQ ID NO: 602139 - RNA, 22 nt, Homo sapiens
uguaaauugcaaauaaaccacu

SEQ ID NO: 602140 - RNA, 19 nt, Homo sapiens
uguaacaauuauguuuuca

SEQ ID NO: 602141 - RNA, 13 nt, Homo sapiens
uaaaaguuacuua

SEQ ID NO: 602142 - RNA, 12 nt, Homo sapiens
uaaaaguucuuu

SEQ ID NO: 602143 - RNA, 20 nt, Homo sapiens
uaaaaguucuuuuugcucua

SEQ ID NO: 602144 - RNA, 19 nt, Homo sapiens
uaaaaguuuauuguuugau

SEQ ID NO: 602145 - RNA, 21 nt, Homo sapiens
uaaaaguuuuuuauuaugcau

SEQ ID NO: 602146 - RNA, 22 nt, Homo sapiens
uaaaaguuuuuuauuaugcauu

SEQ ID NO: 602147 - RNA, 14 nt, Homo sapiens
uaaaauaaaacaca

SEQ ID NO: 602148 - RNA, 16 nt, Homo sapiens
uaaaauaaaagacuau

SEQ ID NO: 602149 - RNA, 18 nt, Homo sapiens
uaaaauaaacuucuuaac

SEQ ID NO: 602150 - RNA, 23 nt, Homo sapiens
uaaaauaaaguauauauagaauc

SEQ ID NO: 602151 - RNA, 17 nt, Homo sapiens
uaaaauaacuaguacaa

SEQ ID NO: 602152 - RNA, 14 nt, Homo sapiens
uaaaauaagagauc

SEQ ID NO: 602153 - RNA, 17 nt, Homo sapiens
uaaaauaagcucaguga

SEQ ID NO: 602154 - RNA, 16 nt, Homo sapiens
uaaaauaauaacaauc

SEQ ID NO: 602155 - RNA, 19 nt, Homo sapiens
uaaaauaauuuucauucau

SEQ ID NO: 602156 - RNA, 17 nt, Homo sapiens
uaaaauaccuagaccua

SEQ ID NO: 602157 - RNA, 22 nt, Homo sapiens
uaaaauacuaaacuacauuuua

SEQ ID NO: 602158 - RNA, 21 nt, Homo sapiens
uaaaauagaaauaagugguua

SEQ ID NO: 602159 - RNA, 21 nt, Homo sapiens
uaaaauauuuuagauaauucu

SEQ ID NO: 602160 - RNA, 23 nt, Homo sapiens
uaaaauauuuuagauguuauuau

SEQ ID NO: 602161 - RNA, 20 nt, Homo sapiens
uaaaauauuuuuaugugcaa

SEQ ID NO: 602162 - RNA, 22 nt, Homo sapiens
uaaaauauuuuuaugugcaaua

SEQ ID NO: 602163 - RNA, 23 nt, Homo sapiens
uaaaauauuuuuaugugcaauaa

SEQ ID NO: 602164 - RNA, 13 nt, Homo sapiens
uaaaauccaagcg

SEQ ID NO: 602165 - RNA, 16 nt, Homo sapiens
uaaaaucccuccuuca

SEQ ID NO: 602166 - RNA, 12 nt, Homo sapiens
uaaaaucuguaa

SEQ ID NO: 602167 - RNA, 23 nt, Homo sapiens
uaaaaugaauaauuuauuauuaa

SEQ ID NO: 602168 - RNA, 17 nt, Homo sapiens
uaaaaugacaagcacua

SEQ ID NO: 602169 - RNA, 12 nt, Homo sapiens
uaaaaugacuau

SEQ ID NO: 602170 - RNA, 18 nt, Homo sapiens
uaaaaugauaaacaaguc

SEQ ID NO: 602171 - RNA, 22 nt, Homo sapiens
uaaaaugcugcuuuguccaggu

SEQ ID NO: 602172 - RNA, 12 nt, Homo sapiens
uaaaaugcuuuu

SEQ ID NO: 602173 - RNA, 23 nt, Homo sapiens
uaaaauggcaguuugaagucaaa

SEQ ID NO: 602174 - RNA, 14 nt, Homo sapiens
uaaaaugucuagcu

SEQ ID NO: 602175 - RNA, 23 nt, Homo sapiens
uaaaauuaaguuguaucauuuca

SEQ ID NO: 602176 - RNA, 15 nt, Homo sapiens
uaaaauuacauucua

SEQ ID NO: 602177 - RNA, 18 nt, Homo sapiens
uaaaauuagaugaacuca

SEQ ID NO: 602178 - RNA, 15 nt, Homo sapiens
uaaaauuagcuugag

SEQ ID NO: 602179 - RNA, 18 nt, Homo sapiens
uaaaauuaucaauaucua

SEQ ID NO: 602180 - RNA, 15 nt, Homo sapiens
uaaaauuaugccaua

SEQ ID NO: 602181 - RNA, 18 nt, Homo sapiens
uaaaauuauuacuaauga

SEQ ID NO: 602182 - RNA, 23 nt, Homo sapiens
uaaaauuauuacuaaugaugcuu

SEQ ID NO: 602183 - RNA, 19 nt, Homo sapiens
uaaaauucagaugcuguua

SEQ ID NO: 602184 - RNA, 13 nt, Homo sapiens
uaaaauucuguca

SEQ ID NO: 602185 - RNA, 15 nt, Homo sapiens
uaaaauuugucuuaa

SEQ ID NO: 602186 - RNA, 16 nt, Homo sapiens
uaaaauuuugagauua

SEQ ID NO: 602187 - RNA, 16 nt, Homo sapiens
uaaacaaagcaguaua

SEQ ID NO: 602188 - RNA, 15 nt, Homo sapiens
uaaacaaauucauau

SEQ ID NO: 602189 - RNA, 14 nt, Homo sapiens
uaaacaagaaaucu

SEQ ID NO: 602190 - RNA, 19 nt, Homo sapiens
uaaacaagaaaucugacaa

SEQ ID NO: 602191 - RNA, 22 nt, Homo sapiens
uaaacaagaaaucugacaauag

SEQ ID NO: 602192 - RNA, 19 nt, Homo sapiens
uaaacacaaaguguauaca

SEQ ID NO: 602193 - RNA, 22 nt, Homo sapiens
uaaacacaaauagaacauucca

SEQ ID NO: 602194 - RNA, 19 nt, Homo sapiens
uaaacacacuauggcauga

SEQ ID NO: 602195 - RNA, 21 nt, Homo sapiens
uaaacaccauagggacccauu

SEQ ID NO: 602196 - RNA, 16 nt, Homo sapiens
uaaacaccauuauuca

SEQ ID NO: 602197 - RNA, 23 nt, Homo sapiens
uaaacacccaugaaucaaagaca

SEQ ID NO: 602198 - RNA, 11 nt, Homo sapiens
uaaacacuuuc

SEQ ID NO: 602199 - RNA, 12 nt, Homo sapiens
uaaacagggucu

SEQ ID NO: 602200 - RNA, 20 nt, Homo sapiens
uaaacagugagccugaauuu

SEQ ID NO: 602201 - RNA, 17 nt, Homo sapiens
uaaacaguggaauauaa

SEQ ID NO: 602202 - RNA, 19 nt, Homo sapiens
uaaacaucacaugagacaa

SEQ ID NO: 602203 - RNA, 19 nt, Homo sapiens
uaaacaucuccccucucac

SEQ ID NO: 602204 - RNA, 23 nt, Homo sapiens
uaaacaucuccccucucaccuca

SEQ ID NO: 602205 - RNA, 22 nt, Homo sapiens
uaaacauuaauuuugugcauuc

SEQ ID NO: 602206 - RNA, 16 nt, Homo sapiens
uguacgcuuugcucaa

SEQ ID NO: 602207 - RNA, 21 nt, Homo sapiens
uguacuaacaaagccaaauuc

SEQ ID NO: 602208 - RNA, 15 nt, Homo sapiens
uguacuaagcaguaa

SEQ ID NO: 602209 - RNA, 17 nt, Homo sapiens
uguacuaauacagggag

SEQ ID NO: 602210 - RNA, 13 nt, Homo sapiens
uguacuaaucuga

SEQ ID NO: 602211 - RNA, 14 nt, Homo sapiens
uguacuaaucugag

SEQ ID NO: 602212 - RNA, 23 nt, Homo sapiens
uguacucuacgccaaagugcagc

SEQ ID NO: 602213 - RNA, 12 nt, Homo sapiens
uguacugauaua

SEQ ID NO: 602214 - RNA, 10 nt, Homo sapiens
uguacugcaa

SEQ ID NO: 602215 - RNA, 23 nt, Homo sapiens
uguacuguucugugucuuucaca

SEQ ID NO: 602216 - RNA, 15 nt, Homo sapiens
uguacuuaauccuuu

SEQ ID NO: 602217 - RNA, 16 nt, Homo sapiens
uguacuucacugucag

SEQ ID NO: 602218 - RNA, 15 nt, Homo sapiens
uguacuuccugugua

SEQ ID NO: 602219 - RNA, 15 nt, Homo sapiens
uguacuugccuuauu

SEQ ID NO: 602220 - RNA, 18 nt, Homo sapiens
uguacuugccuuauuaga

SEQ ID NO: 602221 - RNA, 23 nt, Homo sapiens
uguagaaaaaaaaauucacauga

SEQ ID NO: 602222 - RNA, 17 nt, Homo sapiens
uguagaacacuaauuca

SEQ ID NO: 602223 - RNA, 21 nt, Homo sapiens
uguagaacucagcaguugaca

SEQ ID NO: 602224 - RNA, 20 nt, Homo sapiens
uguagaagaaagagcaacaa

SEQ ID NO: 602225 - RNA, 21 nt, Homo sapiens
uguagaagacaaaauguucac

SEQ ID NO: 602226 - RNA, 17 nt, Homo sapiens
uguagaagccacuauua

SEQ ID NO: 602227 - RNA, 22 nt, Homo sapiens
uguagacuguggcuagugacaa

SEQ ID NO: 602228 - RNA, 12 nt, Homo sapiens
uguagacugugu

SEQ ID NO: 602229 - RNA, 22 nt, Homo sapiens
uguagacuuuugacacuuuuaa

SEQ ID NO: 602230 - RNA, 15 nt, Homo sapiens
uguagagaaaagcac

SEQ ID NO: 602231 - RNA, 17 nt, Homo sapiens
uguagagagaacaggug

SEQ ID NO: 602232 - RNA, 20 nt, Homo sapiens
uguagagauggggucucaca

SEQ ID NO: 602233 - RNA, 16 nt, Homo sapiens
uguagagcaagccagu

SEQ ID NO: 602234 - RNA, 19 nt, Homo sapiens
uguagauaaacucagaaau

SEQ ID NO: 602235 - RNA, 17 nt, Homo sapiens
uguagauggcggugaug

SEQ ID NO: 602236 - RNA, 20 nt, Homo sapiens
uguagaugggggaacuguga

SEQ ID NO: 602237 - RNA, 15 nt, Homo sapiens
uguagcauuucuuga

SEQ ID NO: 602238 - RNA, 12 nt, Homo sapiens
uguagccauccu

SEQ ID NO: 602239 - RNA, 17 nt, Homo sapiens
uguagccccagugacag

SEQ ID NO: 602240 - RNA, 17 nt, Homo sapiens
uguagcuccucaacuca

SEQ ID NO: 602241 - RNA, 17 nt, Homo sapiens
uguagcuguaagggcag

SEQ ID NO: 602242 - RNA, 15 nt, Homo sapiens
uguagcugugucaug

SEQ ID NO: 602243 - RNA, 16 nt, Homo sapiens
uguagcuuuauccuua

SEQ ID NO: 602244 - RNA, 14 nt, Homo sapiens
uguaggaacaagca

SEQ ID NO: 602245 - RNA, 19 nt, Homo sapiens
uguaggaaccaauucuuga

SEQ ID NO: 602246 - RNA, 12 nt, Homo sapiens
uguaggccucag

SEQ ID NO: 602247 - RNA, 21 nt, Homo sapiens
uguagggcacccaaaacucaa

SEQ ID NO: 602248 - RNA, 22 nt, Homo sapiens
uguaggucauugcaccuaucuc

SEQ ID NO: 602249 - RNA, 16 nt, Homo sapiens
uguaggugucugccuu

SEQ ID NO: 602250 - RNA, 13 nt, Homo sapiens
uguaguacuccuu

SEQ ID NO: 602251 - RNA, 21 nt, Homo sapiens
uguagucccagcuacuuggga

SEQ ID NO: 602252 - RNA, 16 nt, Homo sapiens
uguaguccgugcugac

SEQ ID NO: 602253 - RNA, 14 nt, Homo sapiens
uguaguuacugugg

SEQ ID NO: 602254 - RNA, 14 nt, Homo sapiens
uguaguucucagga

SEQ ID NO: 602255 - RNA, 17 nt, Homo sapiens
uguaguucuugugcaug

SEQ ID NO: 602256 - RNA, 13 nt, Homo sapiens
uguaguuucuuga

SEQ ID NO: 602257 - RNA, 21 nt, Homo sapiens
uguaguuuuucuucaacauca

SEQ ID NO: 602258 - RNA, 16 nt, Homo sapiens
uguauaaaauagacaa

SEQ ID NO: 602259 - RNA, 15 nt, Homo sapiens
uguauaagcuacuca

SEQ ID NO: 602260 - RNA, 21 nt, Homo sapiens
uguauaauuugaggugaaauu

SEQ ID NO: 602261 - RNA, 15 nt, Homo sapiens
uguauacauacaugu

SEQ ID NO: 602262 - RNA, 15 nt, Homo sapiens
uguauaccagccuac

SEQ ID NO: 602263 - RNA, 23 nt, Homo sapiens
uaaagccacuguaugauucucuu

SEQ ID NO: 602264 - RNA, 14 nt, Homo sapiens
uaaagccuccucau

SEQ ID NO: 602265 - RNA, 15 nt, Homo sapiens
uaaagcuacaacaaa

SEQ ID NO: 602266 - RNA, 18 nt, Homo sapiens
uaaagcucaucagcuauc

SEQ ID NO: 602267 - RNA, 16 nt, Homo sapiens
uaaagcuuaaacugaa

SEQ ID NO: 602268 - RNA, 19 nt, Homo sapiens
uaaaggaaaaucacaucuc

SEQ ID NO: 602269 - RNA, 23 nt, Homo sapiens
uaaaggaagcaaguuuucuucca

SEQ ID NO: 602270 - RNA, 16 nt, Homo sapiens
uaaaggaauuccccaa

SEQ ID NO: 602271 - RNA, 23 nt, Homo sapiens
uaaaggaguaagaaccuugccug

SEQ ID NO: 602272 - RNA, 13 nt, Homo sapiens
uaaaggauauuaa

SEQ ID NO: 602273 - RNA, 23 nt, Homo sapiens
uaaaggcaaugguuugugucaaa

SEQ ID NO: 602274 - RNA, 12 nt, Homo sapiens
uaaaggcagcug

SEQ ID NO: 602275 - RNA, 17 nt, Homo sapiens
uaaaggccacaggagac

SEQ ID NO: 602276 - RNA, 17 nt, Homo sapiens
uaaaggcuaaaagggaa

SEQ ID NO: 602277 - RNA, 16 nt, Homo sapiens
uaaagggaaaacccuc

SEQ ID NO: 602278 - RNA, 23 nt, Homo sapiens
uaaagggaccaucugcugcaguu

SEQ ID NO: 602279 - RNA, 16 nt, Homo sapiens
uaaaggggagauacuc

SEQ ID NO: 602280 - RNA, 14 nt, Homo sapiens
uaaaggguaugaaa

SEQ ID NO: 602281 - RNA, 15 nt, Homo sapiens
uaaagguuaccuguu

SEQ ID NO: 602282 - RNA, 21 nt, Homo sapiens
uaaagguuaugaaacauauca

SEQ ID NO: 602283 - RNA, 11 nt, Homo sapiens
uaaagguuuau

SEQ ID NO: 602284 - RNA, 22 nt, Homo sapiens
uaaagguuuuuaaauuguuuca

SEQ ID NO: 602285 - RNA, 17 nt, Homo sapiens
uaaaguaaauacaugca

SEQ ID NO: 602286 - RNA, 14 nt, Homo sapiens
uaaaguaagacauc

SEQ ID NO: 602287 - RNA, 15 nt, Homo sapiens
uaaaguacauaacaa

SEQ ID NO: 602288 - RNA, 11 nt, Homo sapiens
uaaaguaccac

SEQ ID NO: 602289 - RNA, 22 nt, Homo sapiens
uaaaguaccacacauauugcac

SEQ ID NO: 602290 - RNA, 16 nt, Homo sapiens
uaaaguacccugugcu

SEQ ID NO: 602291 - RNA, 18 nt, Homo sapiens
uaaaguaguccugugaau

SEQ ID NO: 602292 - RNA, 13 nt, Homo sapiens
uaaaguaguuccu

SEQ ID NO: 602293 - RNA, 18 nt, Homo sapiens
uaaaguauaauguuuauu

SEQ ID NO: 602294 - RNA, 16 nt, Homo sapiens
uaaaguaugcauuauu

SEQ ID NO: 602295 - RNA, 15 nt, Homo sapiens
uaaaguauuccaccu

SEQ ID NO: 602296 - RNA, 16 nt, Homo sapiens
uaaagucaaaugccaa

SEQ ID NO: 602297 - RNA, 22 nt, Homo sapiens
uaaagucaaggacgaauuugca

SEQ ID NO: 602298 - RNA, 15 nt, Homo sapiens
uaaagucacuaguga

SEQ ID NO: 602299 - RNA, 14 nt, Homo sapiens
uaaagucugaauca

SEQ ID NO: 602300 - RNA, 13 nt, Homo sapiens
uaaagugaaggaa

SEQ ID NO: 602301 - RNA, 15 nt, Homo sapiens
uaaagugacuuucua

SEQ ID NO: 602302 - RNA, 20 nt, Homo sapiens
uaaagugagaaaacugugac

SEQ ID NO: 602303 - RNA, 18 nt, Homo sapiens
uaaaguuaaaagaaugua

SEQ ID NO: 602304 - RNA, 17 nt, Homo sapiens
uaaaguuacuugaauuu

SEQ ID NO: 602305 - RNA, 16 nt, Homo sapiens
uaaauaaaaauaugua

SEQ ID NO: 602306 - RNA, 14 nt, Homo sapiens
uaaauaaaacugaa

SEQ ID NO: 602307 - RNA, 16 nt, Homo sapiens
uaaauaaaauuuguug

SEQ ID NO: 602308 - RNA, 19 nt, Homo sapiens
uaaauaaacacacuauggc

SEQ ID NO: 602309 - RNA, 23 nt, Homo sapiens
uaaauaaacacacuauggcauga

SEQ ID NO: 602310 - RNA, 24 nt, Homo sapiens
uaaauaaacagauguauuaugcug

SEQ ID NO: 602311 - RNA, 21 nt, Homo sapiens
uaaauaacuggaaaacagaac

SEQ ID NO: 602312 - RNA, 19 nt, Homo sapiens
uaaauaagcaaaaugccaa

SEQ ID NO: 602313 - RNA, 23 nt, Homo sapiens
uaaauaagcuuuuaaacaaguca

SEQ ID NO: 602314 - RNA, 12 nt, Homo sapiens
uaaauacagaca

SEQ ID NO: 602315 - RNA, 13 nt, Homo sapiens
uaaauacagguag

SEQ ID NO: 602316 - RNA, 15 nt, Homo sapiens
uaaauacagucuucc

SEQ ID NO: 602317 - RNA, 21 nt, Homo sapiens
uaaauacauauggauguuacu

SEQ ID NO: 602318 - RNA, 16 nt, Homo sapiens
uaaauaccauucacua

SEQ ID NO: 602319 - RNA, 13 nt, Homo sapiens
uaaauacugucaa

SEQ ID NO: 602320 - RNA, 21 nt, Homo sapiens
uaaauacuugcaguugugaua

SEQ ID NO: 602321 - RNA, 18 nt, Homo sapiens
uaaauagaacaaccugca

SEQ ID NO: 602322 - RNA, 19 nt, Homo sapiens
uaaauagaccucucaauuu

SEQ ID NO: 602323 - RNA, 16 nt, Homo sapiens
uaaauagagcaaccua

SEQ ID NO: 602324 - RNA, 15 nt, Homo sapiens
uaaauagaguuugcu

SEQ ID NO: 602325 - RNA, 17 nt, Homo sapiens
uaaauagcuauauccau

SEQ ID NO: 602326 - RNA, 23 nt, Homo sapiens
uaaauagugucauauaaacucau

SEQ ID NO: 602327 - RNA, 13 nt, Homo sapiens
uaaauaguucuuc

SEQ ID NO: 602328 - RNA, 15 nt, Homo sapiens
uaaauauaucuaccc

SEQ ID NO: 602329 - RNA, 18 nt, Homo sapiens
uaaauauccacaguacuc

SEQ ID NO: 602330 - RNA, 22 nt, Homo sapiens
uaaauaucccagagaacaauca

SEQ ID NO: 602331 - RNA, 15 nt, Homo sapiens
ugucacagggccaac

SEQ ID NO: 602332 - RNA, 16 nt, Homo sapiens
ugucacagugcuacaa

SEQ ID NO: 602333 - RNA, 19 nt, Homo sapiens
ugucacauagagugaucuu

SEQ ID NO: 602334 - RNA, 12 nt, Homo sapiens
ugucacaucucu

SEQ ID NO: 602335 - RNA, 22 nt, Homo sapiens
ugucaccaagcuaggugcuauu

SEQ ID NO: 602336 - RNA, 20 nt, Homo sapiens
ugucaccaugacuuccucac

SEQ ID NO: 602337 - RNA, 22 nt, Homo sapiens
ugucacccugcaggacuugcca

SEQ ID NO: 602338 - RNA, 20 nt, Homo sapiens
ugucaccggucagugccuuu

SEQ ID NO: 602339 - RNA, 20 nt, Homo sapiens
ugucaccugcucacagggau

SEQ ID NO: 602340 - RNA, 21 nt, Homo sapiens
ugucaccuggcugcuaggcca

SEQ ID NO: 602341 - RNA, 16 nt, Homo sapiens
ugucacuaaacaagaa

SEQ ID NO: 602342 - RNA, 23 nt, Homo sapiens
ugucacuaaacaagaaaucugac

SEQ ID NO: 602343 - RNA, 22 nt, Homo sapiens
ugucacucuguaguuacugugg

SEQ ID NO: 602344 - RNA, 18 nt, Homo sapiens
ugucacuguuccuuguca

SEQ ID NO: 602345 - RNA, 23 nt, Homo sapiens
ugucacuucgcgugcccucgcug

SEQ ID NO: 602346 - RNA, 17 nt, Homo sapiens
ugucagaagcugggaac

SEQ ID NO: 602347 - RNA, 20 nt, Homo sapiens
ugucagagcugggaguagca

SEQ ID NO: 602348 - RNA, 19 nt, Homo sapiens
ugucagaugagaacaaagc

SEQ ID NO: 602349 - RNA, 17 nt, Homo sapiens
ugucagauuaccaguua

SEQ ID NO: 602350 - RNA, 13 nt, Homo sapiens
ugucagcaaaaag

SEQ ID NO: 602351 - RNA, 20 nt, Homo sapiens
ugucagcuacuaaugauguu

SEQ ID NO: 602352 - RNA, 13 nt, Homo sapiens
ugucaggaaguaa

SEQ ID NO: 602353 - RNA, 16 nt, Homo sapiens
ugucaggcuacaaggu

SEQ ID NO: 602354 - RNA, 18 nt, Homo sapiens
ugucagggguuucuucaa

SEQ ID NO: 602355 - RNA, 21 nt, Homo sapiens
ugucagggucuuucugaugac

SEQ ID NO: 602356 - RNA, 14 nt, Homo sapiens
ugucagucagggac

SEQ ID NO: 602357 - RNA, 12 nt, Homo sapiens
ugucaguucucu

SEQ ID NO: 602358 - RNA, 13 nt, Homo sapiens
ugucaguucuugg

SEQ ID NO: 602359 - RNA, 16 nt, Homo sapiens
ugucaguuucauggag

SEQ ID NO: 602360 - RNA, 16 nt, Homo sapiens
ugucauaaauuacaca

SEQ ID NO: 602361 - RNA, 20 nt, Homo sapiens
ugucauagaaagugccagaa

SEQ ID NO: 602362 - RNA, 14 nt, Homo sapiens
ugucauagacuccu

SEQ ID NO: 602363 - RNA, 18 nt, Homo sapiens
ugucauagacuccuuugc

SEQ ID NO: 602364 - RNA, 17 nt, Homo sapiens
ugucauauaagauucau

SEQ ID NO: 602365 - RNA, 17 nt, Homo sapiens
ugucauauucgauguac

SEQ ID NO: 602366 - RNA, 15 nt, Homo sapiens
ugucaucugugcacu

SEQ ID NO: 602367 - RNA, 21 nt, Homo sapiens
ugucaucuuccuggaagcaga

SEQ ID NO: 602368 - RNA, 20 nt, Homo sapiens
ugucaugacggggacagagu

SEQ ID NO: 602369 - RNA, 17 nt, Homo sapiens
ugucauuacauagaaca

SEQ ID NO: 602370 - RNA, 20 nt, Homo sapiens
ugucauucagaaaccugaag

SEQ ID NO: 602371 - RNA, 12 nt, Homo sapiens
ugucauuccaga

SEQ ID NO: 602372 - RNA, 14 nt, Homo sapiens
ugucauuccagagu

SEQ ID NO: 602373 - RNA, 18 nt, Homo sapiens
ugucauucgcucccacau

SEQ ID NO: 602374 - RNA, 20 nt, Homo sapiens
ugucauucgcucccacauuc

SEQ ID NO: 602375 - RNA, 21 nt, Homo sapiens
ugucauucuguuagauacuaa

SEQ ID NO: 602376 - RNA, 17 nt, Homo sapiens
ugucauugauacaugca

SEQ ID NO: 602377 - RNA, 18 nt, Homo sapiens
ugucauugucuacuccua

SEQ ID NO: 602378 - RNA, 14 nt, Homo sapiens
ugucauuuccucua

SEQ ID NO: 602379 - RNA, 22 nt, Homo sapiens
uguccaaacucagugcuguuuc

SEQ ID NO: 602380 - RNA, 17 nt, Homo sapiens
uguccaaagaggcugcc

SEQ ID NO: 602381 - RNA, 15 nt, Homo sapiens
uguccacaucugccu

SEQ ID NO: 602382 - RNA, 20 nt, Homo sapiens
uguccacaugaccuccauuu

SEQ ID NO: 602383 - RNA, 19 nt, Homo sapiens
uguccagcuuauagucuuc

SEQ ID NO: 602384 - RNA, 16 nt, Homo sapiens
uguccaggguccucua

SEQ ID NO: 602385 - RNA, 23 nt, Homo sapiens
uaaauugcuuuuguugugacuuu

SEQ ID NO: 602386 - RNA, 11 nt, Homo sapiens
uaaauugugaa

SEQ ID NO: 602387 - RNA, 13 nt, Homo sapiens
uaaauugugaaag

SEQ ID NO: 602388 - RNA, 16 nt, Homo sapiens
uaaauuuaaugcugcc

SEQ ID NO: 602389 - RNA, 15 nt, Homo sapiens
uaaauuucccaguua

SEQ ID NO: 602390 - RNA, 18 nt, Homo sapiens
uaaauuucuuaugugaca

SEQ ID NO: 602391 - RNA, 17 nt, Homo sapiens
uaaauuuggacugucua

SEQ ID NO: 602392 - RNA, 21 nt, Homo sapiens
uaaauuuuauaacagaauuaa

SEQ ID NO: 602393 - RNA, 18 nt, Homo sapiens
uaaauuuuauuccaaaau

SEQ ID NO: 602394 - RNA, 17 nt, Homo sapiens
uaaauuuuuauuacuua

SEQ ID NO: 602395 - RNA, 22 nt, Homo sapiens
uaaauuuuuuuuuuuuacuuga

SEQ ID NO: 602396 - RNA, 15 nt, Homo sapiens
uaacaaaacacucgg

SEQ ID NO: 602397 - RNA, 18 nt, Homo sapiens
uaacaaaauguaugucug

SEQ ID NO: 602398 - RNA, 17 nt, Homo sapiens
uaacaaacaucacucug

SEQ ID NO: 602399 - RNA, 15 nt, Homo sapiens
uaacaaacgcauuaa

SEQ ID NO: 602400 - RNA, 16 nt, Homo sapiens
uaacaaagaacaagca

SEQ ID NO: 602401 - RNA, 17 nt, Homo sapiens
uaacaaagaacaagcau

SEQ ID NO: 602402 - RNA, 19 nt, Homo sapiens
uaacaaagcccuuauucuc

SEQ ID NO: 602403 - RNA, 21 nt, Homo sapiens
uaacaaagcccuuauucucuu

SEQ ID NO: 602404 - RNA, 18 nt, Homo sapiens
uaacaacaauaacacugu

SEQ ID NO: 602405 - RNA, 20 nt, Homo sapiens
uaacaacaauaacacugucu

SEQ ID NO: 602406 - RNA, 13 nt, Homo sapiens
uaacaacuguggu

SEQ ID NO: 602407 - RNA, 13 nt, Homo sapiens
uaacaacuuugaa

SEQ ID NO: 602408 - RNA, 23 nt, Homo sapiens
uaacaagaccucagugccuuccu

SEQ ID NO: 602409 - RNA, 21 nt, Homo sapiens
uaacaaggugucuuuuccacu

SEQ ID NO: 602410 - RNA, 18 nt, Homo sapiens
uaacaagucgaugaacua

SEQ ID NO: 602411 - RNA, 12 nt, Homo sapiens
uaacaaucuuua

SEQ ID NO: 602412 - RNA, 11 nt, Homo sapiens
uaacaaugaag

SEQ ID NO: 602413 - RNA, 18 nt, Homo sapiens
uaacaauuguguagccuu

SEQ ID NO: 602414 - RNA, 22 nt, Homo sapiens
uaacacauagcgccgugcugua

SEQ ID NO: 602415 - RNA, 21 nt, Homo sapiens
uaacacauuaaauguggaagg

SEQ ID NO: 602416 - RNA, 21 nt, Homo sapiens
uaacacauuuuuuaacuaaua

SEQ ID NO: 602417 - RNA, 18 nt, Homo sapiens
uaacaccuucauccagau

SEQ ID NO: 602418 - RNA, 17 nt, Homo sapiens
uaacacgcugccugguc

SEQ ID NO: 602419 - RNA, 17 nt, Homo sapiens
uaacacuguuaagagag

SEQ ID NO: 602420 - RNA, 15 nt, Homo sapiens
uaacagaauacauag

SEQ ID NO: 602421 - RNA, 16 nt, Homo sapiens
uaacagacuuguuuaa

SEQ ID NO: 602422 - RNA, 10 nt, Homo sapiens
uaacagagag

SEQ ID NO: 602423 - RNA, 22 nt, Homo sapiens
uaacagauggaaaaacugaggc

SEQ ID NO: 602424 - RNA, 23 nt, Homo sapiens
uaacagcuggggacaacugcggu

SEQ ID NO: 602425 - RNA, 16 nt, Homo sapiens
uaacaggaaaauuuua

SEQ ID NO: 602426 - RNA, 18 nt, Homo sapiens
uaacaggucuccucuuaa

SEQ ID NO: 602427 - RNA, 20 nt, Homo sapiens
uaacaggugcgguuccucau

SEQ ID NO: 602428 - RNA, 16 nt, Homo sapiens
uaacaguggacaaagu

SEQ ID NO: 602429 - RNA, 14 nt, Homo sapiens
uaacaguucacuuu

SEQ ID NO: 602430 - RNA, 21 nt, Homo sapiens
uaacaguucauguuugcuuca

SEQ ID NO: 602431 - RNA, 18 nt, Homo sapiens
uaacaguugugaugacua

SEQ ID NO: 602432 - RNA, 14 nt, Homo sapiens
uaacauagauuuaa

SEQ ID NO: 602433 - RNA, 13 nt, Homo sapiens
uaacauauucuaa

SEQ ID NO: 602434 - RNA, 18 nt, Homo sapiens
uaacaucaacaacacagc

SEQ ID NO: 602435 - RNA, 19 nt, Homo sapiens
uaacaucaacaacacagca

SEQ ID NO: 602436 - RNA, 20 nt, Homo sapiens
uaacaucagcaggaaugcuc

SEQ ID NO: 602437 - RNA, 22 nt, Homo sapiens
uaacaucuaaaaauagacuuaa

SEQ ID NO: 602438 - RNA, 22 nt, Homo sapiens
uaacaugaaaaacacggcagcu

SEQ ID NO: 602439 - RNA, 20 nt, Homo sapiens
uaacaugcccuguucagcua

SEQ ID NO: 602440 - RNA, 21 nt, Homo sapiens
uaacauguaauuaaguacuau

SEQ ID NO: 602441 - RNA, 15 nt, Homo sapiens
uaacauguauacaaa

SEQ ID NO: 602442 - RNA, 13 nt, Homo sapiens
uaacaugugaaaa

SEQ ID NO: 602443 - RNA, 17 nt, Homo sapiens
uaacauguuaucaaauc

SEQ ID NO: 602444 - RNA, 18 nt, Homo sapiens
uaacauuaucuaguucau

SEQ ID NO: 602445 - RNA, 12 nt, Homo sapiens
uaacauucccac

SEQ ID NO: 602446 - RNA, 17 nt, Homo sapiens
uaacauucccacugcca

SEQ ID NO: 602447 - RNA, 15 nt, Homo sapiens
uaacauuuaaauucc

SEQ ID NO: 602448 - RNA, 17 nt, Homo sapiens
uaacauuucauuguaca

SEQ ID NO: 602449 - RNA, 13 nt, Homo sapiens
uaacauuugccuu

SEQ ID NO: 602450 - RNA, 19 nt, Homo sapiens
uaaccaaagucacaaauca

SEQ ID NO: 602451 - RNA, 18 nt, Homo sapiens
uaaccacuggucaugccc

SEQ ID NO: 602452 - RNA, 19 nt, Homo sapiens
uaaccagacacauacucau

SEQ ID NO: 602453 - RNA, 12 nt, Homo sapiens
uaaccaguauuu

SEQ ID NO: 602454 - RNA, 22 nt, Homo sapiens
ugucugaggaguaaguguacaa

SEQ ID NO: 602455 - RNA, 21 nt, Homo sapiens
ugucugaguaagcccucagga

SEQ ID NO: 602456 - RNA, 20 nt, Homo sapiens
ugucugauguggcaaaaggc

SEQ ID NO: 602457 - RNA, 16 nt, Homo sapiens
ugucugcccuagggag

SEQ ID NO: 602458 - RNA, 13 nt, Homo sapiens
ugucugccuuaaa

SEQ ID NO: 602459 - RNA, 15 nt, Homo sapiens
ugucugccuucacaa

SEQ ID NO: 602460 - RNA, 17 nt, Homo sapiens
ugucugcucaguaauuu

SEQ ID NO: 602461 - RNA, 14 nt, Homo sapiens
ugucugcuguagaa

SEQ ID NO: 602462 - RNA, 19 nt, Homo sapiens
ugucugcuuucuccauugu

SEQ ID NO: 602463 - RNA, 14 nt, Homo sapiens
ugucuggccagaaa

SEQ ID NO: 602464 - RNA, 22 nt, Homo sapiens
ugucuggcccgcaauacuguag

SEQ ID NO: 602465 - RNA, 21 nt, Homo sapiens
ugucuguaaugacaaauaagu

SEQ ID NO: 602466 - RNA, 17 nt, Homo sapiens
ugucugucagcugugaa

SEQ ID NO: 602467 - RNA, 14 nt, Homo sapiens
ugucugugccaugg

SEQ ID NO: 602468 - RNA, 21 nt, Homo sapiens
ugucugugcccuccaaagagc

SEQ ID NO: 602469 - RNA, 16 nt, Homo sapiens
ugucugugggcuucag

SEQ ID NO: 602470 - RNA, 14 nt, Homo sapiens
ugucugugugcaag

SEQ ID NO: 602471 - RNA, 15 nt, Homo sapiens
ugucuguuaacuuaa

SEQ ID NO: 602472 - RNA, 16 nt, Homo sapiens
ugucuguuuguuguau

SEQ ID NO: 602473 - RNA, 12 nt, Homo sapiens
ugucuuaccaga

SEQ ID NO: 602474 - RNA, 13 nt, Homo sapiens
ugucuuagucaaa

SEQ ID NO: 602475 - RNA, 14 nt, Homo sapiens
ugucuucuacagau

SEQ ID NO: 602476 - RNA, 13 nt, Homo sapiens
ugucuucugggca

SEQ ID NO: 602477 - RNA, 21 nt, Homo sapiens
ugucuugaaaguggcaccaga

SEQ ID NO: 602478 - RNA, 21 nt, Homo sapiens
ugucuuguuucccagauuuca

SEQ ID NO: 602479 - RNA, 19 nt, Homo sapiens
ugucuuuauaaucuacucc

SEQ ID NO: 602480 - RNA, 15 nt, Homo sapiens
ugucuuucaaugaca

SEQ ID NO: 602481 - RNA, 18 nt, Homo sapiens
ugucuuuguucugugauu

SEQ ID NO: 602482 - RNA, 18 nt, Homo sapiens
ugucuuuguuguagugaa

SEQ ID NO: 602483 - RNA, 21 nt, Homo sapiens
ugugaaagacaauaaaacacu

SEQ ID NO: 602484 - RNA, 15 nt, Homo sapiens
ugugaaagugacucu

SEQ ID NO: 602485 - RNA, 15 nt, Homo sapiens
ugugaacagcuugcu

SEQ ID NO: 602486 - RNA, 14 nt, Homo sapiens
ugugaacguguaug

SEQ ID NO: 602487 - RNA, 16 nt, Homo sapiens
ugugaacugggcauuu

SEQ ID NO: 602488 - RNA, 14 nt, Homo sapiens
ugugaaguacauau

SEQ ID NO: 602489 - RNA, 16 nt, Homo sapiens
ugugaaguggaaaugu

SEQ ID NO: 602490 - RNA, 22 nt, Homo sapiens
ugugaauaaaaacccuguaugg

SEQ ID NO: 602491 - RNA, 14 nt, Homo sapiens
ugugaauacuggaa

SEQ ID NO: 602492 - RNA, 14 nt, Homo sapiens
ugugaaugaucucu

SEQ ID NO: 602493 - RNA, 16 nt, Homo sapiens
ugugaauuauugacac

SEQ ID NO: 602494 - RNA, 20 nt, Homo sapiens
ugugaauuauugacacugaa

SEQ ID NO: 602495 - RNA, 22 nt, Homo sapiens
ugugaauuguuuuuguacaguu

SEQ ID NO: 602496 - RNA, 21 nt, Homo sapiens
ugugacaauaaguuugaaccu

SEQ ID NO: 602497 - RNA, 15 nt, Homo sapiens
ugugacacaucaagc

SEQ ID NO: 602498 - RNA, 22 nt, Homo sapiens
ugugacauuauaugcacuagca

SEQ ID NO: 602499 - RNA, 11 nt, Homo sapiens
ugugacauuua

SEQ ID NO: 602500 - RNA, 20 nt, Homo sapiens
ugugaccagucugacccuua

SEQ ID NO: 602501 - RNA, 15 nt, Homo sapiens
ugugaccauucugcc

SEQ ID NO: 602502 - RNA, 15 nt, Homo sapiens
ugugaccauuuauaa

SEQ ID NO: 602503 - RNA, 18 nt, Homo sapiens
ugugaccccaccuugacg

SEQ ID NO: 602504 - RNA, 19 nt, Homo sapiens
ugugacccucucacuuugg

SEQ ID NO: 602505 - RNA, 20 nt, Homo sapiens
ugugacgcacagcacuccug

SEQ ID NO: 602506 - RNA, 17 nt, Homo sapiens
ugugacugccaggauaa

SEQ ID NO: 602507 - RNA, 17 nt, Homo sapiens
uaacuggccagccauau

SEQ ID NO: 602508 - RNA, 23 nt, Homo sapiens
uaacuggggauauaauacuauau

SEQ ID NO: 602509 - RNA, 14 nt, Homo sapiens
uaacugucacccau

SEQ ID NO: 602510 - RNA, 13 nt, Homo sapiens
uaacugugaauaa

SEQ ID NO: 602511 - RNA, 18 nt, Homo sapiens
uaacugugccaguucuuu

SEQ ID NO: 602512 - RNA, 23 nt, Homo sapiens
uaacuguuaaggagcuucaggga

SEQ ID NO: 602513 - RNA, 13 nt, Homo sapiens
uaacuguuacagu

SEQ ID NO: 602514 - RNA, 15 nt, Homo sapiens
uaacuuaacugaaau

SEQ ID NO: 602515 - RNA, 14 nt, Homo sapiens
uaacuuacuuccaa

SEQ ID NO: 602516 - RNA, 16 nt, Homo sapiens
uaacuuagguggcaag

SEQ ID NO: 602517 - RNA, 13 nt, Homo sapiens
uaacuuauuuucc

SEQ ID NO: 602518 - RNA, 20 nt, Homo sapiens
uaacuucaaggcccauaucu

SEQ ID NO: 602519 - RNA, 18 nt, Homo sapiens
uaacuuggccauguucuc

SEQ ID NO: 602520 - RNA, 21 nt, Homo sapiens
uaacuuuaaaacuguauuuaa

SEQ ID NO: 602521 - RNA, 20 nt, Homo sapiens
uaacuuuaaggugaaugaaa

SEQ ID NO: 602522 - RNA, 16 nt, Homo sapiens
uaacuuuaaguuucag

SEQ ID NO: 602523 - RNA, 14 nt, Homo sapiens
uaacuuucauacca

SEQ ID NO: 602524 - RNA, 20 nt, Homo sapiens
uaacuuucauaccacuugaa

SEQ ID NO: 602525 - RNA, 17 nt, Homo sapiens
uaacuuuucaccaauga

SEQ ID NO: 602526 - RNA, 19 nt, Homo sapiens
uaacuuuucggucuuuccc

SEQ ID NO: 602527 - RNA, 22 nt, Homo sapiens
uaacuuuugaugacuucaguga

SEQ ID NO: 602528 - RNA, 17 nt, Homo sapiens
uaacuuuuguaagacaa

SEQ ID NO: 602529 - RNA, 19 nt, Homo sapiens
uaagaaaaaaagcacaaag

SEQ ID NO: 602530 - RNA, 23 nt, Homo sapiens
uaagaaaaaauucuuucacuuga

SEQ ID NO: 602531 - RNA, 14 nt, Homo sapiens
uaagaaaacuaaga

SEQ ID NO: 602532 - RNA, 20 nt, Homo sapiens
uaagaaaauacaauaaacua

SEQ ID NO: 602533 - RNA, 16 nt, Homo sapiens
uaagaaaauacauaag

SEQ ID NO: 602534 - RNA, 17 nt, Homo sapiens
uaagaaacccucuguca

SEQ ID NO: 602535 - RNA, 16 nt, Homo sapiens
uaagaaagcacuauua

SEQ ID NO: 602536 - RNA, 14 nt, Homo sapiens
uaagaaagugcgag

SEQ ID NO: 602537 - RNA, 19 nt, Homo sapiens
uaagaaauacucaugugca

SEQ ID NO: 602538 - RNA, 12 nt, Homo sapiens
uaagaaauucca

SEQ ID NO: 602539 - RNA, 16 nt, Homo sapiens
uaagaaauuucuaguu

SEQ ID NO: 602540 - RNA, 22 nt, Homo sapiens
uaagaacagaucaggaauucua

SEQ ID NO: 602541 - RNA, 14 nt, Homo sapiens
uaagaaccaaaaaa

SEQ ID NO: 602542 - RNA, 19 nt, Homo sapiens
uaagaaccuugccugaaca

SEQ ID NO: 602543 - RNA, 14 nt, Homo sapiens
uaagaacugcuuuc

SEQ ID NO: 602544 - RNA, 13 nt, Homo sapiens
uaagaacugugca

SEQ ID NO: 602545 - RNA, 22 nt, Homo sapiens
uaagaagaaauacccacuaaca

SEQ ID NO: 602546 - RNA, 15 nt, Homo sapiens
uaagaagacaugaca

SEQ ID NO: 602547 - RNA, 18 nt, Homo sapiens
uaagaagagacugggaag

SEQ ID NO: 602548 - RNA, 12 nt, Homo sapiens
uaagaaggugcg

SEQ ID NO: 602549 - RNA, 19 nt, Homo sapiens
uaagaaguccuaucucaua

SEQ ID NO: 602550 - RNA, 14 nt, Homo sapiens
uaagaagucuauaa

SEQ ID NO: 602551 - RNA, 14 nt, Homo sapiens
uaagaagugccaag

SEQ ID NO: 602552 - RNA, 17 nt, Homo sapiens
uaagaauaguucuaaaa

SEQ ID NO: 602553 - RNA, 20 nt, Homo sapiens
uaagaaucuuagauaacuuc

SEQ ID NO: 602554 - RNA, 20 nt, Homo sapiens
uaagaaucuuuguuagauau

SEQ ID NO: 602555 - RNA, 21 nt, Homo sapiens
uaagaaugaaguucugcuaca

SEQ ID NO: 602556 - RNA, 17 nt, Homo sapiens
uaagaauuagacaucuu

SEQ ID NO: 602557 - RNA, 19 nt, Homo sapiens
uaagaauucaaacuggggc

SEQ ID NO: 602558 - RNA, 20 nt, Homo sapiens
uaagaauuguuuuugaauuu

SEQ ID NO: 602559 - RNA, 14 nt, Homo sapiens
uaagaauuucacaa

SEQ ID NO: 602560 - RNA, 22 nt, Homo sapiens
uaagacaacaaagagaagcaga

SEQ ID NO: 602561 - RNA, 14 nt, Homo sapiens
uaagacagcauuga

SEQ ID NO: 602562 - RNA, 17 nt, Homo sapiens
uaagacauaaauuacuu

SEQ ID NO: 602563 - RNA, 21 nt, Homo sapiens
uaagacauacuccuuccauca

SEQ ID NO: 602564 - RNA, 19 nt, Homo sapiens
uaagacauuuguauauugu

SEQ ID NO: 602565 - RNA, 15 nt, Homo sapiens
uaagaccacuacagu

SEQ ID NO: 602566 - RNA, 18 nt, Homo sapiens
uaagaccauaacagccaa

SEQ ID NO: 602567 - RNA, 14 nt, Homo sapiens
uaagacuacuauac

SEQ ID NO: 602568 - RNA, 13 nt, Homo sapiens
uaagacucugcca

SEQ ID NO: 602569 - RNA, 19 nt, Homo sapiens
uaagacugauaauuuuaca

SEQ ID NO: 602570 - RNA, 15 nt, Homo sapiens
uaagacuuacuugca

SEQ ID NO: 602571 - RNA, 16 nt, Homo sapiens
uaagacuuaguacuau

SEQ ID NO: 602572 - RNA, 15 nt, Homo sapiens
uaagagacaacuauc

SEQ ID NO: 602573 - RNA, 19 nt, Homo sapiens
uaagagacacuccaaaccu

SEQ ID NO: 602574 - RNA, 17 nt, Homo sapiens
uaagagccauuuagggg

SEQ ID NO: 602575 - RNA, 18 nt, Homo sapiens
uaagagcuuaagaaccau

SEQ ID NO: 602576 - RNA, 19 nt, Homo sapiens
uaagaggugaucucuggga

SEQ ID NO: 602577 - RNA, 17 nt, Homo sapiens
uaagaguaaaauuccuc

SEQ ID NO: 602578 - RNA, 24 nt, Homo sapiens
uaagaguagcaaguucuagagaag

SEQ ID NO: 602579 - RNA, 13 nt, Homo sapiens
ugugcuggggucu

SEQ ID NO: 602580 - RNA, 16 nt, Homo sapiens
ugugcuggucauggaa

SEQ ID NO: 602581 - RNA, 22 nt, Homo sapiens
ugugcugucuccaugcuggaua

SEQ ID NO: 602582 - RNA, 16 nt, Homo sapiens
ugugcuucagugccau

SEQ ID NO: 602583 - RNA, 14 nt, Homo sapiens
ugugcuuguuuaca

SEQ ID NO: 602584 - RNA, 21 nt, Homo sapiens
uguggaacauaaaaaggacau

SEQ ID NO: 602585 - RNA, 16 nt, Homo sapiens
uguggaagagcauuag

SEQ ID NO: 602586 - RNA, 15 nt, Homo sapiens
uguggacgugcacug

SEQ ID NO: 602587 - RNA, 17 nt, Homo sapiens
uguggacgugcacugac

SEQ ID NO: 602588 - RNA, 17 nt, Homo sapiens
uguggacuucaucucaa

SEQ ID NO: 602589 - RNA, 19 nt, Homo sapiens
uguggagaucagaaaguga

SEQ ID NO: 602590 - RNA, 16 nt, Homo sapiens
uguggagcagagcucu

SEQ ID NO: 602591 - RNA, 20 nt, Homo sapiens
uguggaggcuaucaacaaag

SEQ ID NO: 602592 - RNA, 22 nt, Homo sapiens
uguggauaaggcuuaggugcca

SEQ ID NO: 602593 - RNA, 18 nt, Homo sapiens
uguggaugauaaaacaca

SEQ ID NO: 602594 - RNA, 18 nt, Homo sapiens
uguggaugcuccagggca

SEQ ID NO: 602595 - RNA, 16 nt, Homo sapiens
uguggauggucauugc

SEQ ID NO: 602596 - RNA, 15 nt, Homo sapiens
uguggaugucuuccu

SEQ ID NO: 602597 - RNA, 20 nt, Homo sapiens
uguggauuuucuacuguaag

SEQ ID NO: 602598 - RNA, 21 nt, Homo sapiens
uguggcacucagggagcauuu

SEQ ID NO: 602599 - RNA, 12 nt, Homo sapiens
uguggcacuugg

SEQ ID NO: 602600 - RNA, 15 nt, Homo sapiens
uguggcagcucuccc

SEQ ID NO: 602601 - RNA, 13 nt, Homo sapiens
uguggcagugguu

SEQ ID NO: 602602 - RNA, 19 nt, Homo sapiens
uguggccaacugcaaaaaa

SEQ ID NO: 602603 - RNA, 15 nt, Homo sapiens
uguggcccaagacaa

SEQ ID NO: 602604 - RNA, 23 nt, Homo sapiens
uguggcccagggaagccaaaaga

SEQ ID NO: 602605 - RNA, 13 nt, Homo sapiens
uguggccccaaga

SEQ ID NO: 602606 - RNA, 14 nt, Homo sapiens
uguggcccugccau

SEQ ID NO: 602607 - RNA, 23 nt, Homo sapiens
uguggcccuucuguccaccagac

SEQ ID NO: 602608 - RNA, 15 nt, Homo sapiens
uguggccucaagcaa

SEQ ID NO: 602609 - RNA, 18 nt, Homo sapiens
uguggccuguguccagca

SEQ ID NO: 602610 - RNA, 14 nt, Homo sapiens
uguggcugcaucuu

SEQ ID NO: 602611 - RNA, 18 nt, Homo sapiens
uguggcuuauggauucau

SEQ ID NO: 602612 - RNA, 12 nt, Homo sapiens
uguggcuucuag

SEQ ID NO: 602613 - RNA, 10 nt, Homo sapiens
ugugggaccg

SEQ ID NO: 602614 - RNA, 22 nt, Homo sapiens
ugugggacugacauuucucaau

SEQ ID NO: 602615 - RNA, 17 nt, Homo sapiens
ugugggagccugcaaac

SEQ ID NO: 602616 - RNA, 18 nt, Homo sapiens
ugugggcgcauacuacag

SEQ ID NO: 602617 - RNA, 22 nt, Homo sapiens
ugugggcuggugccccacagcu

SEQ ID NO: 602618 - RNA, 18 nt, Homo sapiens
uguggggaagaguggucu

SEQ ID NO: 602619 - RNA, 15 nt, Homo sapiens
uguggggaggcugca

SEQ ID NO: 602620 - RNA, 21 nt, Homo sapiens
ugugggucccgcacucugccc

SEQ ID NO: 602621 - RNA, 19 nt, Homo sapiens
ugugggugucagucaggga

SEQ ID NO: 602622 - RNA, 13 nt, Homo sapiens
uguggguguccug

SEQ ID NO: 602623 - RNA, 16 nt, Homo sapiens
ugugguacaaucucaa

SEQ ID NO: 602624 - RNA, 14 nt, Homo sapiens
ugugguagcucaca

SEQ ID NO: 602625 - RNA, 19 nt, Homo sapiens
uguggucacagccaugaag

SEQ ID NO: 602626 - RNA, 22 nt, Homo sapiens
uguggugacaggcccaguggaa

SEQ ID NO: 602627 - RNA, 19 nt, Homo sapiens
ugugguuacuaguacaggu

SEQ ID NO: 602628 - RNA, 16 nt, Homo sapiens
ugugguuauguuccca

SEQ ID NO: 602629 - RNA, 17 nt, Homo sapiens
uacccaucuaguacuug

SEQ ID NO: 602630 - RNA, 16 nt, Homo sapiens
uaccccacugggccag

SEQ ID NO: 602631 - RNA, 17 nt, Homo sapiens
uaccccagucccaggga

SEQ ID NO: 602632 - RNA, 18 nt, Homo sapiens
uacccccuccucucugcc

SEQ ID NO: 602633 - RNA, 13 nt, Homo sapiens
uaccccucuucca

SEQ ID NO: 602634 - RNA, 22 nt, Homo sapiens
uaccccugcuaaggaguucuca

SEQ ID NO: 602635 - RNA, 19 nt, Homo sapiens
uaccccugcucccauuccu

SEQ ID NO: 602636 - RNA, 22 nt, Homo sapiens
uaccccuuggaaaugucugcug

SEQ ID NO: 602637 - RNA, 16 nt, Homo sapiens
uaccccuuugcacuug

SEQ ID NO: 602638 - RNA, 14 nt, Homo sapiens
uacccuaaagggag

SEQ ID NO: 602639 - RNA, 16 nt, Homo sapiens
uacccuauacauccac

SEQ ID NO: 602640 - RNA, 15 nt, Homo sapiens
uacccuaugacuuua

SEQ ID NO: 602641 - RNA, 11 nt, Homo sapiens
uacccucucag

SEQ ID NO: 602642 - RNA, 19 nt, Homo sapiens
uacccugagauacuuccca

SEQ ID NO: 602643 - RNA, 21 nt, Homo sapiens
uacccugagauacuucccaaa

SEQ ID NO: 602644 - RNA, 19 nt, Homo sapiens
uacccuggagcaagaccug

SEQ ID NO: 602645 - RNA, 15 nt, Homo sapiens
uacccuguccuuugc

SEQ ID NO: 602646 - RNA, 20 nt, Homo sapiens
uacccuguccuuugcaauug

SEQ ID NO: 602647 - RNA, 15 nt, Homo sapiens
uacccugugucagag

SEQ ID NO: 602648 - RNA, 20 nt, Homo sapiens
uacccuuacucugccagagu

SEQ ID NO: 602649 - RNA, 20 nt, Homo sapiens
uacccuuggcaguguggcag

SEQ ID NO: 602650 - RNA, 23 nt, Homo sapiens
uacccuugugagagcccauuccc

SEQ ID NO: 602651 - RNA, 14 nt, Homo sapiens
uacccuuucauuca

SEQ ID NO: 602652 - RNA, 17 nt, Homo sapiens
uaccuacaagaacaaug

SEQ ID NO: 602653 - RNA, 18 nt, Homo sapiens
uaccuagaauagucucac

SEQ ID NO: 602654 - RNA, 19 nt, Homo sapiens
uaccuaugucaacaguaua

SEQ ID NO: 602655 - RNA, 17 nt, Homo sapiens
uaccucaaagggcaguu

SEQ ID NO: 602656 - RNA, 21 nt, Homo sapiens
uaccucaaccaaugccaaaaa

SEQ ID NO: 602657 - RNA, 22 nt, Homo sapiens
uaccucaaccaaugccaaaaaa

SEQ ID NO: 602658 - RNA, 17 nt, Homo sapiens
uaccucaagggggacug

SEQ ID NO: 602659 - RNA, 23 nt, Homo sapiens
uaccucacagagugcauugugag

SEQ ID NO: 602660 - RNA, 13 nt, Homo sapiens
uaccucaccuggg

SEQ ID NO: 602661 - RNA, 13 nt, Homo sapiens
uaccucagccuag

SEQ ID NO: 602662 - RNA, 15 nt, Homo sapiens
uaccuccacccugca

SEQ ID NO: 602663 - RNA, 17 nt, Homo sapiens
uaccuccacccugcauu

SEQ ID NO: 602664 - RNA, 22 nt, Homo sapiens
uaccuccacccugcauuuuccu

SEQ ID NO: 602665 - RNA, 17 nt, Homo sapiens
uaccuccacucucugcc

SEQ ID NO: 602666 - RNA, 20 nt, Homo sapiens
uaccuccuccucuggacaaa

SEQ ID NO: 602667 - RNA, 20 nt, Homo sapiens
uaccuccuuguguugcacug

SEQ ID NO: 602668 - RNA, 15 nt, Homo sapiens
uaccucgaguuuuaa

SEQ ID NO: 602669 - RNA, 17 nt, Homo sapiens
uaccucuaaguacauau

SEQ ID NO: 602670 - RNA, 17 nt, Homo sapiens
uaccucugauaccucaa

SEQ ID NO: 602671 - RNA, 16 nt, Homo sapiens
uaccucuuaacaauuu

SEQ ID NO: 602672 - RNA, 16 nt, Homo sapiens
uaccucuuucaggguu

SEQ ID NO: 602673 - RNA, 15 nt, Homo sapiens
uaccugagauggagg

SEQ ID NO: 602674 - RNA, 14 nt, Homo sapiens
uaccugauggaccu

SEQ ID NO: 602675 - RNA, 20 nt, Homo sapiens
uaccugcuguggaugcuuca

SEQ ID NO: 602676 - RNA, 15 nt, Homo sapiens
uaccuggaccugucc

SEQ ID NO: 602677 - RNA, 18 nt, Homo sapiens
uaccuggcucugcuucca

SEQ ID NO: 602678 - RNA, 13 nt, Homo sapiens
uaccugggcauuc

SEQ ID NO: 602679 - RNA, 18 nt, Homo sapiens
uaccuggggccaaaccca

SEQ ID NO: 602680 - RNA, 14 nt, Homo sapiens
uaccugggugauua

SEQ ID NO: 602681 - RNA, 14 nt, Homo sapiens
uaccugguuuacuu

SEQ ID NO: 602682 - RNA, 16 nt, Homo sapiens
uaccuguagugagaaa

SEQ ID NO: 602683 - RNA, 11 nt, Homo sapiens
uaccugucaau

SEQ ID NO: 602684 - RNA, 21 nt, Homo sapiens
uaccugucuucuggcucucuc

SEQ ID NO: 602685 - RNA, 22 nt, Homo sapiens
uaccuuauucuacaucauuaac

SEQ ID NO: 602686 - RNA, 22 nt, Homo sapiens
uaccuucaggcagccaguguga

SEQ ID NO: 602687 - RNA, 16 nt, Homo sapiens
uaccuucuuguugaua

SEQ ID NO: 602688 - RNA, 14 nt, Homo sapiens
uaccuucuuucacu

SEQ ID NO: 602689 - RNA, 20 nt, Homo sapiens
uaccuugaacucuuagugau

SEQ ID NO: 602690 - RNA, 17 nt, Homo sapiens
uaccuugagccaguaau

SEQ ID NO: 602691 - RNA, 21 nt, Homo sapiens
uaccuugguucccccacugau

SEQ ID NO: 602692 - RNA, 23 nt, Homo sapiens
uaccuuuguaacggcucuuagca

SEQ ID NO: 602693 - RNA, 19 nt, Homo sapiens
uaccuuuuuauuugcaugu

SEQ ID NO: 602694 - RNA, 12 nt, Homo sapiens
uacggacacugu

SEQ ID NO: 602695 - RNA, 21 nt, Homo sapiens
uacggauugcugcaaaccaca

SEQ ID NO: 602696 - RNA, 22 nt, Homo sapiens
uacggccaugagacugaucccu

SEQ ID NO: 602697 - RNA, 14 nt, Homo sapiens
uacgggcugcucua

SEQ ID NO: 602698 - RNA, 15 nt, Homo sapiens
uacgggcugcucuac

SEQ ID NO: 602699 - RNA, 14 nt, Homo sapiens
uacgggggcuguga

SEQ ID NO: 602700 - RNA, 16 nt, Homo sapiens
uacguauaaauaucag

SEQ ID NO: 602701 - RNA, 12 nt, Homo sapiens
uacgucugggag

SEQ ID NO: 602702 - RNA, 19 nt, Homo sapiens
uacgugaccucugcaagac

SEQ ID NO: 602703 - RNA, 11 nt, Homo sapiens
uacgugcaaua

SEQ ID NO: 602704 - RNA, 12 nt, Homo sapiens
uacguugugcau

SEQ ID NO: 602705 - RNA, 16 nt, Homo sapiens
uacguugugcauuugg

SEQ ID NO: 602706 - RNA, 16 nt, Homo sapiens
uacguuugauacaaca

SEQ ID NO: 602707 - RNA, 22 nt, Homo sapiens
uacguuuuacaauguaacuaua

SEQ ID NO: 602708 - RNA, 16 nt, Homo sapiens
uacuaaaacacugaaa

SEQ ID NO: 602709 - RNA, 17 nt, Homo sapiens
uacuaaaacacugaaaa

SEQ ID NO: 602710 - RNA, 14 nt, Homo sapiens
uacuaaaacauaca

SEQ ID NO: 602711 - RNA, 18 nt, Homo sapiens
uuaccaccgucugucuca

SEQ ID NO: 602712 - RNA, 23 nt, Homo sapiens
uuaccagagccucuuugcuggag

SEQ ID NO: 602713 - RNA, 22 nt, Homo sapiens
uuaccagaugcugacuggcacu

SEQ ID NO: 602714 - RNA, 21 nt, Homo sapiens
uuaccaggcaccaaaagaagu

SEQ ID NO: 602715 - RNA, 17 nt, Homo sapiens
uuaccaugcucaaugaa

SEQ ID NO: 602716 - RNA, 16 nt, Homo sapiens
uuacccaaugggaccg

SEQ ID NO: 602717 - RNA, 13 nt, Homo sapiens
uuacccacugcca

SEQ ID NO: 602718 - RNA, 22 nt, Homo sapiens
uuaccccuuuucggccccaugu

SEQ ID NO: 602719 - RNA, 22 nt, Homo sapiens
uuacccuuuggccccacuuuga

SEQ ID NO: 602720 - RNA, 18 nt, Homo sapiens
uuaccuaaaacugcugaa

SEQ ID NO: 602721 - RNA, 16 nt, Homo sapiens
uuaccuaguuugcacu

SEQ ID NO: 602722 - RNA, 14 nt, Homo sapiens
uuaccugaccucuu

SEQ ID NO: 602723 - RNA, 22 nt, Homo sapiens
uuaccugggcauucuuguuuca

SEQ ID NO: 602724 - RNA, 14 nt, Homo sapiens
uuaccuggggaucc

SEQ ID NO: 602725 - RNA, 20 nt, Homo sapiens
uuaccuguuuucgcaccuac

SEQ ID NO: 602726 - RNA, 16 nt, Homo sapiens
uuaccuuaaacugugu

SEQ ID NO: 602727 - RNA, 15 nt, Homo sapiens
uuaccuuguggaugc

SEQ ID NO: 602728 - RNA, 15 nt, Homo sapiens
uuaccuuuucuauaa

SEQ ID NO: 602729 - RNA, 14 nt, Homo sapiens
uuacgaaaccaaaa

SEQ ID NO: 602730 - RNA, 15 nt, Homo sapiens
uuacgagcagggaug

SEQ ID NO: 602731 - RNA, 22 nt, Homo sapiens
uuacguccacaccgagcccagu

SEQ ID NO: 602732 - RNA, 21 nt, Homo sapiens
uuacguggagagugcacugac

SEQ ID NO: 602733 - RNA, 12 nt, Homo sapiens
uuacuaaauccu

SEQ ID NO: 602734 - RNA, 16 nt, Homo sapiens
uuacuaagcuuugcca

SEQ ID NO: 602735 - RNA, 22 nt, Homo sapiens
uuacuaaggaguaaucugugua

SEQ ID NO: 602736 - RNA, 13 nt, Homo sapiens
uuacuaaugaugc

SEQ ID NO: 602737 - RNA, 21 nt, Homo sapiens
uuacuauaaaaaucaugugau

SEQ ID NO: 602738 - RNA, 16 nt, Homo sapiens
uuacuaucauaauuca

SEQ ID NO: 602739 - RNA, 15 nt, Homo sapiens
uuacuaucauucuca

SEQ ID NO: 602740 - RNA, 18 nt, Homo sapiens
uuacuauugcaaaaggga

SEQ ID NO: 602741 - RNA, 21 nt, Homo sapiens
uuacuauuuauugcugaauga

SEQ ID NO: 602742 - RNA, 16 nt, Homo sapiens
uuacucaugacuccuu

SEQ ID NO: 602743 - RNA, 21 nt, Homo sapiens
uuacucaugugcagguuuuga

SEQ ID NO: 602744 - RNA, 14 nt, Homo sapiens
uuacucucacaccu

SEQ ID NO: 602745 - RNA, 11 nt, Homo sapiens
uuacucugaag

SEQ ID NO: 602746 - RNA, 16 nt, Homo sapiens
uuacucuuaugaucaa

SEQ ID NO: 602747 - RNA, 22 nt, Homo sapiens
uuacugaaaaaugcaaauugca

SEQ ID NO: 602748 - RNA, 23 nt, Homo sapiens
uuacugaacaaucaaagcacuug

SEQ ID NO: 602749 - RNA, 18 nt, Homo sapiens
uuacugaaguucagugau

SEQ ID NO: 602750 - RNA, 14 nt, Homo sapiens
uuacugaccagcaa

SEQ ID NO: 602751 - RNA, 20 nt, Homo sapiens
uacucauuaaaaauaauaga

SEQ ID NO: 602752 - RNA, 18 nt, Homo sapiens
uacuccacugcccuggca

SEQ ID NO: 602753 - RNA, 22 nt, Homo sapiens
uacuccgcggagugaucaugga

SEQ ID NO: 602754 - RNA, 17 nt, Homo sapiens
uacuccuggcucaagcc

SEQ ID NO: 602755 - RNA, 18 nt, Homo sapiens
uacuccuuuuaagcagug

SEQ ID NO: 602756 - RNA, 15 nt, Homo sapiens
uacucgauagccuga

SEQ ID NO: 602757 - RNA, 20 nt, Homo sapiens
uacucgggaggcugaggcag

SEQ ID NO: 602758 - RNA, 23 nt, Homo sapiens
uacucuaaacaauaguucacucc

SEQ ID NO: 602759 - RNA, 17 nt, Homo sapiens
uacucuaaagcuucuau

SEQ ID NO: 602760 - RNA, 15 nt, Homo sapiens
uacucucaugcugca

SEQ ID NO: 602761 - RNA, 14 nt, Homo sapiens
uacucuccaaccug

SEQ ID NO: 602762 - RNA, 16 nt, Homo sapiens
uacucuuaugaucaau

SEQ ID NO: 602763 - RNA, 14 nt, Homo sapiens
uacugaaaacaauu

SEQ ID NO: 602764 - RNA, 15 nt, Homo sapiens
uacugaaagaucucu

SEQ ID NO: 602765 - RNA, 17 nt, Homo sapiens
uacugaacccugccucu

SEQ ID NO: 602766 - RNA, 13 nt, Homo sapiens
uacugaaucuuca

SEQ ID NO: 602767 - RNA, 22 nt, Homo sapiens
uacugaaucuucaagaccaaag

SEQ ID NO: 602768 - RNA, 12 nt, Homo sapiens
uacugacugaga

SEQ ID NO: 602769 - RNA, 15 nt, Homo sapiens
uacugacuguagcca

SEQ ID NO: 602770 - RNA, 22 nt, Homo sapiens
uacugaggugcuauguucuuag

SEQ ID NO: 602771 - RNA, 18 nt, Homo sapiens
uacugaguagggggagca

SEQ ID NO: 602772 - RNA, 19 nt, Homo sapiens
uacugauccucgcaugaug

SEQ ID NO: 602773 - RNA, 13 nt, Homo sapiens
uacugaugugaua

SEQ ID NO: 602774 - RNA, 16 nt, Homo sapiens
uacugauucacugcau

SEQ ID NO: 602775 - RNA, 17 nt, Homo sapiens
uacugauuuuugugauu

SEQ ID NO: 602776 - RNA, 15 nt, Homo sapiens
uacugcaaauuuugu

SEQ ID NO: 602777 - RNA, 20 nt, Homo sapiens
uacugcacuaccaaauucau

SEQ ID NO: 602778 - RNA, 21 nt, Homo sapiens
uacugcacuuucccccuuccc

SEQ ID NO: 602779 - RNA, 14 nt, Homo sapiens
uacugcccaaauag

SEQ ID NO: 602780 - RNA, 18 nt, Homo sapiens
uacugcccaaggauaggu

SEQ ID NO: 602781 - RNA, 18 nt, Homo sapiens
uacugccucggaucucuc

SEQ ID NO: 602782 - RNA, 17 nt, Homo sapiens
uacugcuaccacaacua

SEQ ID NO: 602783 - RNA, 19 nt, Homo sapiens
uacugcuggaguccagugc

SEQ ID NO: 602784 - RNA, 14 nt, Homo sapiens
uacugcuguaaaua

SEQ ID NO: 602785 - RNA, 16 nt, Homo sapiens
uacugcuuacuguugc

SEQ ID NO: 602786 - RNA, 19 nt, Homo sapiens
uacugcuucuuuucacuuc

SEQ ID NO: 602787 - RNA, 18 nt, Homo sapiens
uacugcuugaccaaagag

SEQ ID NO: 602788 - RNA, 22 nt, Homo sapiens
uacuggacacacuaaacucugg

SEQ ID NO: 602789 - RNA, 12 nt, Homo sapiens
uacuggacucag

SEQ ID NO: 602790 - RNA, 16 nt, Homo sapiens
uacuggacuucuauca

SEQ ID NO: 602791 - RNA, 18 nt, Homo sapiens
uacuggaguuagaucucu

SEQ ID NO: 602792 - RNA, 14 nt, Homo sapiens
uacuggcaauuugu

SEQ ID NO: 602793 - RNA, 15 nt, Homo sapiens
uacuggccaguguca

SEQ ID NO: 602794 - RNA, 22 nt, Homo sapiens
uacugggacaccauuaccaaaa

SEQ ID NO: 602795 - RNA, 14 nt, Homo sapiens
uacuggguucuuag

SEQ ID NO: 602796 - RNA, 14 nt, Homo sapiens
uacugguugcaugg

SEQ ID NO: 602797 - RNA, 22 nt, Homo sapiens
uacuguaaauauuuuucacaua

SEQ ID NO: 602798 - RNA, 16 nt, Homo sapiens
uacuguaaaugcauug

SEQ ID NO: 602799 - RNA, 18 nt, Homo sapiens
uacuguaauuugugauac

SEQ ID NO: 602800 - RNA, 14 nt, Homo sapiens
uacuguacacggac

SEQ ID NO: 602801 - RNA, 15 nt, Homo sapiens
uacuguacauacaaa

SEQ ID NO: 602802 - RNA, 17 nt, Homo sapiens
uacuguagcugaugaaa

SEQ ID NO: 602803 - RNA, 21 nt, Homo sapiens
uacuguaggcacacuuugcac

SEQ ID NO: 602804 - RNA, 15 nt, Homo sapiens
uacuguaugccuuca

SEQ ID NO: 602805 - RNA, 20 nt, Homo sapiens
uacugucaguuguacuucug

SEQ ID NO: 602806 - RNA, 12 nt, Homo sapiens
uacuguccuguu

SEQ ID NO: 602807 - RNA, 19 nt, Homo sapiens
uacuguguguuuucccaaa

SEQ ID NO: 602808 - RNA, 20 nt, Homo sapiens
uacuuaaaaauagucuucca

SEQ ID NO: 602809 - RNA, 14 nt, Homo sapiens
uacuuaaacuucca

SEQ ID NO: 602810 - RNA, 23 nt, Homo sapiens
uacuuaaauuugaaucugaguga

SEQ ID NO: 602811 - RNA, 15 nt, Homo sapiens
uacuuaacauuucau

SEQ ID NO: 602812 - RNA, 14 nt, Homo sapiens
uacuuaagugcugc

SEQ ID NO: 602813 - RNA, 13 nt, Homo sapiens
uacuuaaugcaca

SEQ ID NO: 602814 - RNA, 14 nt, Homo sapiens
uacuuaaugcauau

SEQ ID NO: 602815 - RNA, 19 nt, Homo sapiens
uacuuacauuuccauuuau

SEQ ID NO: 602816 - RNA, 17 nt, Homo sapiens
uacuuagagcagugaag

SEQ ID NO: 602817 - RNA, 19 nt, Homo sapiens
uacuuauauccacacugca

SEQ ID NO: 602818 - RNA, 14 nt, Homo sapiens
uacuucacuucaaa

SEQ ID NO: 602819 - RNA, 17 nt, Homo sapiens
uacuucaggggcacuuc

SEQ ID NO: 602820 - RNA, 11 nt, Homo sapiens
uacuucauuaa

SEQ ID NO: 602821 - RNA, 22 nt, Homo sapiens
uacuuccaccuccaccacaucu

SEQ ID NO: 602822 - RNA, 16 nt, Homo sapiens
uacuuccccauuucag

SEQ ID NO: 602823 - RNA, 18 nt, Homo sapiens
uacuuccccuucuugcca

SEQ ID NO: 602824 - RNA, 14 nt, Homo sapiens
uacuucuccacugu

SEQ ID NO: 602825 - RNA, 14 nt, Homo sapiens
uacuucugcuccau

SEQ ID NO: 602826 - RNA, 22 nt, Homo sapiens
uacuugaaacagucacuaucau

SEQ ID NO: 602827 - RNA, 19 nt, Homo sapiens
uacuugaaauaccagugaa

SEQ ID NO: 602828 - RNA, 15 nt, Homo sapiens
uacuugcuucucuag

SEQ ID NO: 602829 - RNA, 16 nt, Homo sapiens
uacuuggaacuaggcu

SEQ ID NO: 602830 - RNA, 19 nt, Homo sapiens
uacuugggagaccuguaau

SEQ ID NO: 602831 - RNA, 9 nt, Homo sapiens
uacuuguca

SEQ ID NO: 602832 - RNA, 19 nt, Homo sapiens
uacuugucauagacuccuu

SEQ ID NO: 602833 - RNA, 15 nt, Homo sapiens
uacuuguucauuugg

SEQ ID NO: 602834 - RNA, 15 nt, Homo sapiens
uacuuuaaaauuaca

SEQ ID NO: 602835 - RNA, 17 nt, Homo sapiens
uuagcucauuugagaua

SEQ ID NO: 602836 - RNA, 17 nt, Homo sapiens
uuagcugggaagaccaa

SEQ ID NO: 602837 - RNA, 17 nt, Homo sapiens
uuagcuuauugauccca

SEQ ID NO: 602838 - RNA, 18 nt, Homo sapiens
uuagcuuugggugccuuu

SEQ ID NO: 602839 - RNA, 17 nt, Homo sapiens
uuaggaaagaauaaaga

SEQ ID NO: 602840 - RNA, 23 nt, Homo sapiens
uuaggaagaaaugcccaaaagag

SEQ ID NO: 602841 - RNA, 14 nt, Homo sapiens
uuaggaaucaauga

SEQ ID NO: 602842 - RNA, 12 nt, Homo sapiens
uuaggaguacug

SEQ ID NO: 602843 - RNA, 17 nt, Homo sapiens
uuaggagugguucucau

SEQ ID NO: 602844 - RNA, 20 nt, Homo sapiens
uuaggauaaccuugugccuu

SEQ ID NO: 602845 - RNA, 21 nt, Homo sapiens
uuaggauaaccuugugccuug

SEQ ID NO: 602846 - RNA, 21 nt, Homo sapiens
uuaggaugcggcuuucucugc

SEQ ID NO: 602847 - RNA, 17 nt, Homo sapiens
uuaggaugucuguaaua

SEQ ID NO: 602848 - RNA, 23 nt, Homo sapiens
uuaggauuuaacagucauuuaaa

SEQ ID NO: 602849 - RNA, 22 nt, Homo sapiens
uuaggcaaaguacaaaauugcc

SEQ ID NO: 602850 - RNA, 20 nt, Homo sapiens
uuaggcagugguuucuuaga

SEQ ID NO: 602851 - RNA, 16 nt, Homo sapiens
uuagggacacuuucac

SEQ ID NO: 602852 - RNA, 12 nt, Homo sapiens
uuagggggaaaa

SEQ ID NO: 602853 - RNA, 16 nt, Homo sapiens
uuagggugaagcauua

SEQ ID NO: 602854 - RNA, 20 nt, Homo sapiens
uuaggguucugccucuccag

SEQ ID NO: 602855 - RNA, 13 nt, Homo sapiens
uuagguagcuuua

SEQ ID NO: 602856 - RNA, 21 nt, Homo sapiens
uuaggugcuucuucacuucag

SEQ ID NO: 602857 - RNA, 23 nt, Homo sapiens
uuagguggugguagagaagcaag

SEQ ID NO: 602858 - RNA, 21 nt, Homo sapiens
uuaggugucuguccuuuauga

SEQ ID NO: 602859 - RNA, 16 nt, Homo sapiens
uuaggugugaggucca

SEQ ID NO: 602860 - RNA, 15 nt, Homo sapiens
uuagguugaaacaua

SEQ ID NO: 602861 - RNA, 22 nt, Homo sapiens
uuaguaaaggaaccauuccuuu

SEQ ID NO: 602862 - RNA, 17 nt, Homo sapiens
uuaguaacauagacaaa

SEQ ID NO: 602863 - RNA, 16 nt, Homo sapiens
uuaguaauuucuugcu

SEQ ID NO: 602864 - RNA, 19 nt, Homo sapiens
uuaguacacagcaccagaa

SEQ ID NO: 602865 - RNA, 16 nt, Homo sapiens
uuaguagagacagggu

SEQ ID NO: 602866 - RNA, 20 nt, Homo sapiens
uuaguagucaaaaacaaagc

SEQ ID NO: 602867 - RNA, 22 nt, Homo sapiens
uuaguaguuuuuacaaaacugc

SEQ ID NO: 602868 - RNA, 17 nt, Homo sapiens
uuaguauccacaggaua

SEQ ID NO: 602869 - RNA, 16 nt, Homo sapiens
uuaguauuguuguccu

SEQ ID NO: 602870 - RNA, 10 nt, Homo sapiens
uuagucaauc

SEQ ID NO: 602871 - RNA, 19 nt, Homo sapiens
uuagucaauccugucauau

SEQ ID NO: 602872 - RNA, 16 nt, Homo sapiens
uuagucacugcugcua

SEQ ID NO: 602873 - RNA, 19 nt, Homo sapiens
uagaaauguaaacugccau

SEQ ID NO: 602874 - RNA, 19 nt, Homo sapiens
uagaaauguauccugauaa

SEQ ID NO: 602875 - RNA, 22 nt, Homo sapiens
uagaaauguuuagguuacuaaa

SEQ ID NO: 602876 - RNA, 13 nt, Homo sapiens
uagaaauugaaca

SEQ ID NO: 602877 - RNA, 13 nt, Homo sapiens
uagaaauuuuaca

SEQ ID NO: 602878 - RNA, 17 nt, Homo sapiens
uagaacacugcauuaga

SEQ ID NO: 602879 - RNA, 22 nt, Homo sapiens
uagaacauaaagcaaauagaca

SEQ ID NO: 602880 - RNA, 22 nt, Homo sapiens
uagaaccucucguaguccauca

SEQ ID NO: 602881 - RNA, 18 nt, Homo sapiens
uagaacuagccaaaccag

SEQ ID NO: 602882 - RNA, 19 nt, Homo sapiens
uagaacuaucauuuuuaca

SEQ ID NO: 602883 - RNA, 21 nt, Homo sapiens
uagaacuaucugcauuaucua

SEQ ID NO: 602884 - RNA, 19 nt, Homo sapiens
uagaagaaccaaauaccuc

SEQ ID NO: 602885 - RNA, 21 nt, Homo sapiens
uagaagaagcccauaucacau

SEQ ID NO: 602886 - RNA, 19 nt, Homo sapiens
uagaagauccacauccucu

SEQ ID NO: 602887 - RNA, 22 nt, Homo sapiens
uagaagauccacauccucuaca

SEQ ID NO: 602888 - RNA, 20 nt, Homo sapiens
uagaagauuuuaugcugcug

SEQ ID NO: 602889 - RNA, 11 nt, Homo sapiens
uagaagccaag

SEQ ID NO: 602890 - RNA, 20 nt, Homo sapiens
uagaagccaagggaaagggg

SEQ ID NO: 602891 - RNA, 21 nt, Homo sapiens
uagaagccacuauuacuggga

SEQ ID NO: 602892 - RNA, 20 nt, Homo sapiens
uagaagccaguacagagaaa

SEQ ID NO: 602893 - RNA, 18 nt, Homo sapiens
uagaagccccugucgccc

SEQ ID NO: 602894 - RNA, 21 nt, Homo sapiens
uagaagcuaauguaggacugu

SEQ ID NO: 602895 - RNA, 23 nt, Homo sapiens
uagaaggacucaguauuauuuca

SEQ ID NO: 602896 - RNA, 21 nt, Homo sapiens
uagaaggcacaauaugggcac

SEQ ID NO: 602897 - RNA, 22 nt, Homo sapiens
uagaagggccaguccugccugg

SEQ ID NO: 602898 - RNA, 18 nt, Homo sapiens
uagaaggggaggacacug

SEQ ID NO: 602899 - RNA, 23 nt, Homo sapiens
uagaaggggaggacacugguggu

SEQ ID NO: 602900 - RNA, 20 nt, Homo sapiens
uagaaggguaccuugaacac

SEQ ID NO: 602901 - RNA, 17 nt, Homo sapiens
uagaagguggggaccug

SEQ ID NO: 602902 - RNA, 14 nt, Homo sapiens
uagaagucauaugu

SEQ ID NO: 602903 - RNA, 21 nt, Homo sapiens
uagaaguucaguuuuuacuga

SEQ ID NO: 602904 - RNA, 22 nt, Homo sapiens
uagaaguucuaguguuuucaau

SEQ ID NO: 602905 - RNA, 20 nt, Homo sapiens
uagaauaauacuagucuuau

SEQ ID NO: 602906 - RNA, 23 nt, Homo sapiens
uagaauaauauugugucauagaa

SEQ ID NO: 602907 - RNA, 11 nt, Homo sapiens
uagaauaccac

SEQ ID NO: 602908 - RNA, 14 nt, Homo sapiens
uagaaucucuucau

SEQ ID NO: 602909 - RNA, 14 nt, Homo sapiens
uagaaugcauguaa

SEQ ID NO: 602910 - RNA, 11 nt, Homo sapiens
uagaauggugc

SEQ ID NO: 602911 - RNA, 18 nt, Homo sapiens
uagaauuauaacuguaaa

SEQ ID NO: 602912 - RNA, 18 nt, Homo sapiens
uagaauuaucaagcuuuu

SEQ ID NO: 602913 - RNA, 17 nt, Homo sapiens
uagaauugcaggucucu

SEQ ID NO: 602914 - RNA, 12 nt, Homo sapiens
uagaauugggaa

SEQ ID NO: 602915 - RNA, 16 nt, Homo sapiens
uagaauuguguguuaa

SEQ ID NO: 602916 - RNA, 14 nt, Homo sapiens
uagacaaaguacau

SEQ ID NO: 602917 - RNA, 16 nt, Homo sapiens
uagacaagcuugucca

SEQ ID NO: 602918 - RNA, 15 nt, Homo sapiens
uagacaauuugcaca

SEQ ID NO: 602919 - RNA, 21 nt, Homo sapiens
uagacacgcacggcagccaca

SEQ ID NO: 602920 - RNA, 12 nt, Homo sapiens
uagacacuggac

SEQ ID NO: 602921 - RNA, 17 nt, Homo sapiens
uagacagaaaccaagcc

SEQ ID NO: 602922 - RNA, 19 nt, Homo sapiens
uagacagguguuacuuaca

SEQ ID NO: 602923 - RNA, 19 nt, Homo sapiens
uagacaucuucagauuuaa

SEQ ID NO: 602924 - RNA, 11 nt, Homo sapiens
uagacauguag

SEQ ID NO: 602925 - RNA, 22 nt, Homo sapiens
uagacaugucuagccacugauc

SEQ ID NO: 602926 - RNA, 15 nt, Homo sapiens
uagaccaaaucuugu

SEQ ID NO: 602927 - RNA, 18 nt, Homo sapiens
uagaccaccuaauaucaa

SEQ ID NO: 602928 - RNA, 14 nt, Homo sapiens
uagaccccauacaa

SEQ ID NO: 602929 - RNA, 17 nt, Homo sapiens
uagaccuaggccucagc

SEQ ID NO: 602930 - RNA, 14 nt, Homo sapiens
uagacuaaggccau

SEQ ID NO: 602931 - RNA, 15 nt, Homo sapiens
uagacuacaguucug

SEQ ID NO: 602932 - RNA, 14 nt, Homo sapiens
uagacuacauuuag

SEQ ID NO: 602933 - RNA, 14 nt, Homo sapiens
uagacuagcaaucu

SEQ ID NO: 602934 - RNA, 23 nt, Homo sapiens
uagacuauaagcagaagcacaua

SEQ ID NO: 602935 - RNA, 15 nt, Homo sapiens
uagacuauuugcuua

SEQ ID NO: 602936 - RNA, 20 nt, Homo sapiens
uagacucaugguguguuaca

SEQ ID NO: 602937 - RNA, 17 nt, Homo sapiens
uagacuuacugcaguua

SEQ ID NO: 602938 - RNA, 15 nt, Homo sapiens
uagacuuauugccaa

SEQ ID NO: 602939 - RNA, 21 nt, Homo sapiens
uagacuucugaguaauuaaua

SEQ ID NO: 602940 - RNA, 22 nt, Homo sapiens
uagacuuggacccaaaaaauca

SEQ ID NO: 602941 - RNA, 19 nt, Homo sapiens
uagagaaauuugccaauuu

SEQ ID NO: 602942 - RNA, 12 nt, Homo sapiens
uagagaagcaag

SEQ ID NO: 602943 - RNA, 15 nt, Homo sapiens
uagagagagaacuuu

SEQ ID NO: 602944 - RNA, 16 nt, Homo sapiens
uagagagagaacuuuu

SEQ ID NO: 602945 - RNA, 16 nt, Homo sapiens
uagagagagcuguauu

SEQ ID NO: 602946 - RNA, 20 nt, Homo sapiens
uagagauagcuacaguguaa

SEQ ID NO: 602947 - RNA, 20 nt, Homo sapiens
uagagauauucuuauuucac

SEQ ID NO: 602948 - RNA, 19 nt, Homo sapiens
uagagcauaccaguacuca

SEQ ID NO: 602949 - RNA, 20 nt, Homo sapiens
uagagccaaauucauccucu

SEQ ID NO: 602950 - RNA, 22 nt, Homo sapiens
uagagccauuagagcacagcuu

SEQ ID NO: 602951 - RNA, 20 nt, Homo sapiens
uagagcuagaugugucuuac

SEQ ID NO: 602952 - RNA, 18 nt, Homo sapiens
uagagcucuauuucucua

SEQ ID NO: 602953 - RNA, 15 nt, Homo sapiens
uagagcugagcacuu

SEQ ID NO: 602954 - RNA, 13 nt, Homo sapiens
uagagcugggaau

SEQ ID NO: 602955 - RNA, 18 nt, Homo sapiens
uagagcugggaaucuuuu

SEQ ID NO: 602956 - RNA, 21 nt, Homo sapiens
uagaggacuucuggcagggaa

SEQ ID NO: 602957 - RNA, 18 nt, Homo sapiens
uagaggauagggagaaua

SEQ ID NO: 602958 - RNA, 21 nt, Homo sapiens
uuaucccauuuagugugaaua

SEQ ID NO: 602959 - RNA, 23 nt, Homo sapiens
uuaucccccgcaaagacaucaaa

SEQ ID NO: 602960 - RNA, 20 nt, Homo sapiens
uuauccuauaagaugacaau

SEQ ID NO: 602961 - RNA, 16 nt, Homo sapiens
uuauccuguaguacaa

SEQ ID NO: 602962 - RNA, 17 nt, Homo sapiens
uuauccuguauucuugu

SEQ ID NO: 602963 - RNA, 21 nt, Homo sapiens
uuauccuuaggaaaaugcuuc

SEQ ID NO: 602964 - RNA, 22 nt, Homo sapiens
uuaucgaacacauucagugaua

SEQ ID NO: 602965 - RNA, 13 nt, Homo sapiens
uuaucucaggggu

SEQ ID NO: 602966 - RNA, 20 nt, Homo sapiens
uuaucucugaggcauggugu

SEQ ID NO: 602967 - RNA, 11 nt, Homo sapiens
uuaucugcuag

SEQ ID NO: 602968 - RNA, 12 nt, Homo sapiens
uuaucugucaca

SEQ ID NO: 602969 - RNA, 18 nt, Homo sapiens
uuaucuugaguugcagcu

SEQ ID NO: 602970 - RNA, 13 nt, Homo sapiens
uuaucuugcuuca

SEQ ID NO: 602971 - RNA, 15 nt, Homo sapiens
uuaugaauugucuaa

SEQ ID NO: 602972 - RNA, 21 nt, Homo sapiens
uuaugaauugucuaaaguuac

SEQ ID NO: 602973 - RNA, 22 nt, Homo sapiens
uuaugacuguuuuuguaguggu

SEQ ID NO: 602974 - RNA, 14 nt, Homo sapiens
uuaugacuugcuac

SEQ ID NO: 602975 - RNA, 15 nt, Homo sapiens
uuaugagaaacugca

SEQ ID NO: 602976 - RNA, 11 nt, Homo sapiens
uuaugagacag

SEQ ID NO: 602977 - RNA, 15 nt, Homo sapiens
uuaugauauucuauc

SEQ ID NO: 602978 - RNA, 12 nt, Homo sapiens
uuaugaugcuaa

SEQ ID NO: 602979 - RNA, 13 nt, Homo sapiens
uuaugaugcuaug

SEQ ID NO: 602980 - RNA, 13 nt, Homo sapiens
uuaugauguaauc

SEQ ID NO: 602981 - RNA, 18 nt, Homo sapiens
uuaugauugcauuguaug

SEQ ID NO: 602982 - RNA, 14 nt, Homo sapiens
uuaugcaaauggag

SEQ ID NO: 602983 - RNA, 14 nt, Homo sapiens
uuaugcaaccauaa

SEQ ID NO: 602984 - RNA, 14 nt, Homo sapiens
uuaugccaaagugu

SEQ ID NO: 602985 - RNA, 21 nt, Homo sapiens
uuaugccuucacuuuacaaau

SEQ ID NO: 602986 - RNA, 14 nt, Homo sapiens
uuaugcuacacaga

SEQ ID NO: 602987 - RNA, 16 nt, Homo sapiens
uuaugcuccugcugau

SEQ ID NO: 602988 - RNA, 20 nt, Homo sapiens
uuaugcucuuaaugauuuac

SEQ ID NO: 602989 - RNA, 11 nt, Homo sapiens
uuaugcugcug

SEQ ID NO: 602990 - RNA, 22 nt, Homo sapiens
uuauggcaagugauaucaccuc

SEQ ID NO: 602991 - RNA, 14 nt, Homo sapiens
uuauguaacaucca

SEQ ID NO: 602992 - RNA, 13 nt, Homo sapiens
uuauguaacuuga

SEQ ID NO: 602993 - RNA, 13 nt, Homo sapiens
uuauguaaucuca

SEQ ID NO: 602994 - RNA, 14 nt, Homo sapiens
uuauguaaucucac

SEQ ID NO: 602995 - RNA, 19 nt, Homo sapiens
uagaugcacguggggccca

SEQ ID NO: 602996 - RNA, 17 nt, Homo sapiens
uagaugcaugacuugug

SEQ ID NO: 602997 - RNA, 19 nt, Homo sapiens
uagaugcauuaguguugaa

SEQ ID NO: 602998 - RNA, 17 nt, Homo sapiens
uagaugcugacuguacu

SEQ ID NO: 602999 - RNA, 16 nt, Homo sapiens
uagauggaauuuggaa

SEQ ID NO: 603000 - RNA, 16 nt, Homo sapiens
uagaugguuugagccu

SEQ ID NO: 603001 - RNA, 19 nt, Homo sapiens
uagauguauaaaucuuucu

SEQ ID NO: 603002 - RNA, 12 nt, Homo sapiens
uagaugugauua

SEQ ID NO: 603003 - RNA, 16 nt, Homo sapiens
uagaugugugccacua

SEQ ID NO: 603004 - RNA, 18 nt, Homo sapiens
uagauguguuauuacuuc

SEQ ID NO: 603005 - RNA, 19 nt, Homo sapiens
uagauguguuauuacuucc

SEQ ID NO: 603006 - RNA, 17 nt, Homo sapiens
uagauuaagaaauagac

SEQ ID NO: 603007 - RNA, 16 nt, Homo sapiens
uagauuacugauguga

SEQ ID NO: 603008 - RNA, 18 nt, Homo sapiens
uagauuacugaugugaua

SEQ ID NO: 603009 - RNA, 21 nt, Homo sapiens
uagauuauuccaagccuuauu

SEQ ID NO: 603010 - RNA, 13 nt, Homo sapiens
uagauugcucaaa

SEQ ID NO: 603011 - RNA, 11 nt, Homo sapiens
uagauugugag

SEQ ID NO: 603012 - RNA, 18 nt, Homo sapiens
uagauuguuuugccacuu

SEQ ID NO: 603013 - RNA, 15 nt, Homo sapiens
uagauuuaagugaau

SEQ ID NO: 603014 - RNA, 19 nt, Homo sapiens
uagauuuacagaacaaagu

SEQ ID NO: 603015 - RNA, 17 nt, Homo sapiens
uagauuuccacacgcca

SEQ ID NO: 603016 - RNA, 13 nt, Homo sapiens
uagauuugcagcu

SEQ ID NO: 603017 - RNA, 19 nt, Homo sapiens
uagauuuggacaaacaaga

SEQ ID NO: 603018 - RNA, 20 nt, Homo sapiens
uagauuuggaggcuaccuca

SEQ ID NO: 603019 - RNA, 19 nt, Homo sapiens
uagauuuguaguugcauau

SEQ ID NO: 603020 - RNA, 13 nt, Homo sapiens
uagauuuuguaau

SEQ ID NO: 603021 - RNA, 20 nt, Homo sapiens
uagcaaaauacaugacauuu

SEQ ID NO: 603022 - RNA, 15 nt, Homo sapiens
uagcaaacuuuucac

SEQ ID NO: 603023 - RNA, 19 nt, Homo sapiens
uagcaaauggcagaaccaa

SEQ ID NO: 603024 - RNA, 20 nt, Homo sapiens
uagcaaccuucugcauucau

SEQ ID NO: 603025 - RNA, 22 nt, Homo sapiens
uagcaacugcuggggagacaaa

SEQ ID NO: 603026 - RNA, 20 nt, Homo sapiens
uagcaagauauugaucaaau

SEQ ID NO: 603027 - RNA, 20 nt, Homo sapiens
uagcaagcugccgaaccaaa

SEQ ID NO: 603028 - RNA, 21 nt, Homo sapiens
uagcaaguguguguuugccaa

SEQ ID NO: 603029 - RNA, 16 nt, Homo sapiens
uagcaauaacauacau

SEQ ID NO: 603030 - RNA, 14 nt, Homo sapiens
uagcaauauaucag

SEQ ID NO: 603031 - RNA, 13 nt, Homo sapiens
uagcaauuccagg

SEQ ID NO: 603032 - RNA, 16 nt, Homo sapiens
uagcaauugacuguca

SEQ ID NO: 603033 - RNA, 16 nt, Homo sapiens
uagcacagguuagggu

SEQ ID NO: 603034 - RNA, 22 nt, Homo sapiens
uagcacggccaccucucagggc

SEQ ID NO: 603035 - RNA, 22 nt, Homo sapiens
uagcacugaggguggcacucaa

SEQ ID NO: 603036 - RNA, 20 nt, Homo sapiens
uagcacuuucuacaauguga

SEQ ID NO: 603037 - RNA, 13 nt, Homo sapiens
uagcagaaaucua

SEQ ID NO: 603038 - RNA, 18 nt, Homo sapiens
uagcagaaugugcuucuc

SEQ ID NO: 603039 - RNA, 20 nt, Homo sapiens
uagcagaguuaaaucucaaa

SEQ ID NO: 603040 - RNA, 22 nt, Homo sapiens
uagcagcaccguucugugcaca

SEQ ID NO: 603041 - RNA, 21 nt, Homo sapiens
uagcagcaggcucaggcacau

SEQ ID NO: 603042 - RNA, 22 nt, Homo sapiens
uagcagcaggcucaggcacaua

SEQ ID NO: 603043 - RNA, 17 nt, Homo sapiens
uagcagccacacuuccu

SEQ ID NO: 603044 - RNA, 17 nt, Homo sapiens
uagcaggcaaugcugua

SEQ ID NO: 603045 - RNA, 17 nt, Homo sapiens
uagcaggucaaaaaccu

SEQ ID NO: 603046 - RNA, 21 nt, Homo sapiens
uagcaguaaauacuugcaguu

SEQ ID NO: 603047 - RNA, 14 nt, Homo sapiens
uagcauaacuguag

SEQ ID NO: 603048 - RNA, 15 nt, Homo sapiens
uagcauagauuugca

SEQ ID NO: 603049 - RNA, 12 nt, Homo sapiens
uagcaucagagg

SEQ ID NO: 603050 - RNA, 13 nt, Homo sapiens
uagcaucucagga

SEQ ID NO: 603051 - RNA, 21 nt, Homo sapiens
uagcaucuguaacagcauuaa

SEQ ID NO: 603052 - RNA, 13 nt, Homo sapiens
uagcaugaggcca

SEQ ID NO: 603053 - RNA, 14 nt, Homo sapiens
uagcaugugacucc

SEQ ID NO: 603054 - RNA, 14 nt, Homo sapiens
uagcauguuccucc

SEQ ID NO: 603055 - RNA, 16 nt, Homo sapiens
uagcauuaacuaaucu

SEQ ID NO: 603056 - RNA, 15 nt, Homo sapiens
uagcauuaugcaauu

SEQ ID NO: 603057 - RNA, 16 nt, Homo sapiens
uagcauugagugcuuu

SEQ ID NO: 603058 - RNA, 22 nt, Homo sapiens
uagcauuguuccacacauuuaa

SEQ ID NO: 603059 - RNA, 19 nt, Homo sapiens
uagcauuucccaacacaaa

SEQ ID NO: 603060 - RNA, 15 nt, Homo sapiens
uagcauuugccacuu

SEQ ID NO: 603061 - RNA, 20 nt, Homo sapiens
uagccaaaccaggacccugu

SEQ ID NO: 603062 - RNA, 15 nt, Homo sapiens
uagccaaguguggua

SEQ ID NO: 603063 - RNA, 17 nt, Homo sapiens
uagccagaggcucuaau

SEQ ID NO: 603064 - RNA, 19 nt, Homo sapiens
uagccagaggcucuaaugu

SEQ ID NO: 603065 - RNA, 23 nt, Homo sapiens
uagccagaggcucuaauguacaa

SEQ ID NO: 603066 - RNA, 17 nt, Homo sapiens
uagccagcacuuguaua

SEQ ID NO: 603067 - RNA, 19 nt, Homo sapiens
uagccagcugugcacuuuc

SEQ ID NO: 603068 - RNA, 14 nt, Homo sapiens
uagccaggcucucu

SEQ ID NO: 603069 - RNA, 16 nt, Homo sapiens
uagccaucuaaugcuu

SEQ ID NO: 603070 - RNA, 17 nt, Homo sapiens
uagccaugauuuguccc

SEQ ID NO: 603071 - RNA, 22 nt, Homo sapiens
uagccauguaaucagauuuauu

SEQ ID NO: 603072 - RNA, 16 nt, Homo sapiens
uagcccuaaaaugaca

SEQ ID NO: 603073 - RNA, 23 nt, Homo sapiens
uagcccucccccucaaccucacc

SEQ ID NO: 603074 - RNA, 23 nt, Homo sapiens
uagcccuggguuuaaugucaaau

SEQ ID NO: 603075 - RNA, 14 nt, Homo sapiens
uagcccugucugcu

SEQ ID NO: 603076 - RNA, 16 nt, Homo sapiens
uagccucuccaggaau

SEQ ID NO: 603077 - RNA, 22 nt, Homo sapiens
uagccugcagaaguaagccuca

SEQ ID NO: 603078 - RNA, 18 nt, Homo sapiens
uagccugggcucacugug

SEQ ID NO: 603079 - RNA, 12 nt, Homo sapiens
uagccugugcug

SEQ ID NO: 603080 - RNA, 23 nt, Homo sapiens
uagccuguucuuuuaccacugac

SEQ ID NO: 603081 - RNA, 16 nt, Homo sapiens
uagccuuccucugauu

SEQ ID NO: 603082 - RNA, 16 nt, Homo sapiens
uagccuuuuuguauaa

SEQ ID NO: 603083 - RNA, 23 nt, Homo sapiens
uucaagcaaaaugcuuacagggc

SEQ ID NO: 603084 - RNA, 12 nt, Homo sapiens
uucaagccauuc

SEQ ID NO: 603085 - RNA, 16 nt, Homo sapiens
uucaagccugugaaua

SEQ ID NO: 603086 - RNA, 14 nt, Homo sapiens
uucaagcuauuuaa

SEQ ID NO: 603087 - RNA, 13 nt, Homo sapiens
uucaagcucucug

SEQ ID NO: 603088 - RNA, 18 nt, Homo sapiens
uucaagcuuucaaauccu

SEQ ID NO: 603089 - RNA, 23 nt, Homo sapiens
uucaaggcauuucuaucacauau

SEQ ID NO: 603090 - RNA, 18 nt, Homo sapiens
uucaagggacccaugagu

SEQ ID NO: 603091 - RNA, 14 nt, Homo sapiens
uucaaguaccaaaa

SEQ ID NO: 603092 - RNA, 19 nt, Homo sapiens
uucaagugauaggauaaag

SEQ ID NO: 603093 - RNA, 22 nt, Homo sapiens
uucaaguuaaagugaauaacca

SEQ ID NO: 603094 - RNA, 12 nt, Homo sapiens
uucaaguuuaca

SEQ ID NO: 603095 - RNA, 14 nt, Homo sapiens
uucaaguuugucac

SEQ ID NO: 603096 - RNA, 19 nt, Homo sapiens
uucaaguuuuaaaguucau

SEQ ID NO: 603097 - RNA, 22 nt, Homo sapiens
uucaauaaacuuuuuuugucug

SEQ ID NO: 603098 - RNA, 15 nt, Homo sapiens
uucaauaaagcauuu

SEQ ID NO: 603099 - RNA, 13 nt, Homo sapiens
uucaauacaggcu

SEQ ID NO: 603100 - RNA, 16 nt, Homo sapiens
uucaaucauaauaccu

SEQ ID NO: 603101 - RNA, 17 nt, Homo sapiens
uucaaucauuuauucau

SEQ ID NO: 603102 - RNA, 14 nt, Homo sapiens
uucaaucuguaaac

SEQ ID NO: 603103 - RNA, 12 nt, Homo sapiens
uucaaugaaaua

SEQ ID NO: 603104 - RNA, 18 nt, Homo sapiens
uucaaugaaauaaaagca

SEQ ID NO: 603105 - RNA, 18 nt, Homo sapiens
uucaaugcaaaguacaug

SEQ ID NO: 603106 - RNA, 22 nt, Homo sapiens
uucaaugguugggacaauggca

SEQ ID NO: 603107 - RNA, 14 nt, Homo sapiens
uucaauugacaaau

SEQ ID NO: 603108 - RNA, 21 nt, Homo sapiens
uucaauuuauuugaaugauuu

SEQ ID NO: 603109 - RNA, 10 nt, Homo sapiens
uucacaagcu

SEQ ID NO: 603110 - RNA, 17 nt, Homo sapiens
uucacacaaagacuccu

SEQ ID NO: 603111 - RNA, 19 nt, Homo sapiens
uucacaccgcugcacucaa

SEQ ID NO: 603112 - RNA, 16 nt, Homo sapiens
uucacacugaccaaga

SEQ ID NO: 603113 - RNA, 11 nt, Homo sapiens
uucacacugca

SEQ ID NO: 603114 - RNA, 12 nt, Homo sapiens
uucacacuuuuu

SEQ ID NO: 603115 - RNA, 19 nt, Homo sapiens
uucacagaauagcacaaac

SEQ ID NO: 603116 - RNA, 19 nt, Homo sapiens
uucacagacugauuggaau

SEQ ID NO: 603117 - RNA, 18 nt, Homo sapiens
ugcaugaaguaauaugca

SEQ ID NO: 603118 - RNA, 15 nt, Homo sapiens
ugcaugaccugauca

SEQ ID NO: 603119 - RNA, 11 nt, Homo sapiens
ugcaugccaaa

SEQ ID NO: 603120 - RNA, 22 nt, Homo sapiens
ugcaugcugcccagccacucca

SEQ ID NO: 603121 - RNA, 11 nt, Homo sapiens
ugcaugggcuc

SEQ ID NO: 603122 - RNA, 21 nt, Homo sapiens
ugcauguaccauuugcauggc

SEQ ID NO: 603123 - RNA, 19 nt, Homo sapiens
ugcaugucgcacaauguuu

SEQ ID NO: 603124 - RNA, 11 nt, Homo sapiens
ugcauguguau

SEQ ID NO: 603125 - RNA, 20 nt, Homo sapiens
ugcaugugugugcucagggg

SEQ ID NO: 603126 - RNA, 17 nt, Homo sapiens
ugcauguuaagugccau

SEQ ID NO: 603127 - RNA, 22 nt, Homo sapiens
ugcauguuaagugccauuacua

SEQ ID NO: 603128 - RNA, 18 nt, Homo sapiens
ugcauguucauugcaaac

SEQ ID NO: 603129 - RNA, 13 nt, Homo sapiens
ugcauuccagaac

SEQ ID NO: 603130 - RNA, 12 nt, Homo sapiens
ugcauuccagcc

SEQ ID NO: 603131 - RNA, 22 nt, Homo sapiens
ugcauuccuuacuugcacuguu

SEQ ID NO: 603132 - RNA, 22 nt, Homo sapiens
ugcauuccuuuuucuucacuua

SEQ ID NO: 603133 - RNA, 13 nt, Homo sapiens
ugcauucucucau

SEQ ID NO: 603134 - RNA, 13 nt, Homo sapiens
ugcauucuggcca

SEQ ID NO: 603135 - RNA, 17 nt, Homo sapiens
ugcauucuucugagcac

SEQ ID NO: 603136 - RNA, 20 nt, Homo sapiens
ugcauuuaaaacagacacug

SEQ ID NO: 603137 - RNA, 23 nt, Homo sapiens
ugcauuuaaauacagucuuccau

SEQ ID NO: 603138 - RNA, 11 nt, Homo sapiens
ugcauuuacuu

SEQ ID NO: 603139 - RNA, 15 nt, Homo sapiens
ugcauuuacuuuuaa

SEQ ID NO: 603140 - RNA, 13 nt, Homo sapiens
ugcauuuauagca

SEQ ID NO: 603141 - RNA, 20 nt, Homo sapiens
ugcauuuauggucaacacuu

SEQ ID NO: 603142 - RNA, 13 nt, Homo sapiens
ugcauuugccuug

SEQ ID NO: 603143 - RNA, 19 nt, Homo sapiens
ugcauuuguaauucaugaa

SEQ ID NO: 603144 - RNA, 18 nt, Homo sapiens
ugcauuuuauagaauagu

SEQ ID NO: 603145 - RNA, 23 nt, Homo sapiens
ugcauuuucacaaauuauacuuu

SEQ ID NO: 603146 - RNA, 19 nt, Homo sapiens
ugcauuuucccagauacuu

SEQ ID NO: 603147 - RNA, 20 nt, Homo sapiens
ugcauuuuucacuuugcucu

SEQ ID NO: 603148 - RNA, 16 nt, Homo sapiens
ugcauuuuugugaaau

SEQ ID NO: 603149 - RNA, 17 nt, Homo sapiens
ugcauuuuuuauuuagu

SEQ ID NO: 603150 - RNA, 13 nt, Homo sapiens
ugccaaaccuacu

SEQ ID NO: 603151 - RNA, 22 nt, Homo sapiens
ugccaaagcuuuacuacugugg

SEQ ID NO: 603152 - RNA, 18 nt, Homo sapiens
ugccaaagggaaauauca

SEQ ID NO: 603153 - RNA, 21 nt, Homo sapiens
ugccaaagugucuacaugugc

SEQ ID NO: 603154 - RNA, 22 nt, Homo sapiens
ugccaaaugaauaagacaacaa

SEQ ID NO: 603155 - RNA, 19 nt, Homo sapiens
ugccaaaugcguaugccac

SEQ ID NO: 603156 - RNA, 20 nt, Homo sapiens
ugccaaccuggaauggagac

SEQ ID NO: 603157 - RNA, 15 nt, Homo sapiens
ugccaacuucccaca

SEQ ID NO: 603158 - RNA, 18 nt, Homo sapiens
ugccaacuugauguucca

SEQ ID NO: 603159 - RNA, 18 nt, Homo sapiens
ugccaagaaaguauuugg

SEQ ID NO: 603160 - RNA, 17 nt, Homo sapiens
ugccaagacagugaagu

SEQ ID NO: 603161 - RNA, 13 nt, Homo sapiens
ugccaagacuccu

SEQ ID NO: 603162 - RNA, 17 nt, Homo sapiens
ugccaagcagugcacau

SEQ ID NO: 603163 - RNA, 15 nt, Homo sapiens
ugccaaggcaaaaaa

SEQ ID NO: 603164 - RNA, 15 nt, Homo sapiens
ugccaauagugucau

SEQ ID NO: 603165 - RNA, 17 nt, Homo sapiens
ugccaauagugucaucc

SEQ ID NO: 603166 - RNA, 23 nt, Homo sapiens
ugccacagcuuuugcaacuuaau

SEQ ID NO: 603167 - RNA, 16 nt, Homo sapiens
ugccaccaacuuacaa

SEQ ID NO: 603168 - RNA, 18 nt, Homo sapiens
ugccaccacgcccagcua

SEQ ID NO: 603169 - RNA, 17 nt, Homo sapiens
ugccaccagcauccaca

SEQ ID NO: 603170 - RNA, 11 nt, Homo sapiens
ugccacccaca

SEQ ID NO: 603171 - RNA, 23 nt, Homo sapiens
ugccaccccucuucugcuccuua

SEQ ID NO: 603172 - RNA, 15 nt, Homo sapiens
ugccacccuaccugu

SEQ ID NO: 603173 - RNA, 20 nt, Homo sapiens
ugccacccugccccuugcca

SEQ ID NO: 603174 - RNA, 19 nt, Homo sapiens
ugccaccgccuucccugac

SEQ ID NO: 603175 - RNA, 16 nt, Homo sapiens
ugccaccggaggucac

SEQ ID NO: 603176 - RNA, 22 nt, Homo sapiens
ugccacgcuuugaugagcauuu

SEQ ID NO: 603177 - RNA, 11 nt, Homo sapiens
ugccacuaauu

SEQ ID NO: 603178 - RNA, 18 nt, Homo sapiens
ugccacucagagacuuca

SEQ ID NO: 603179 - RNA, 14 nt, Homo sapiens
ugccacucauuccu

SEQ ID NO: 603180 - RNA, 14 nt, Homo sapiens
ugccacugccuucg

SEQ ID NO: 603181 - RNA, 16 nt, Homo sapiens
ugccacuguguacugu

SEQ ID NO: 603182 - RNA, 18 nt, Homo sapiens
ugccacuuaauguauguu

SEQ ID NO: 603183 - RNA, 20 nt, Homo sapiens
ugccagaauacuggguucuu

SEQ ID NO: 603184 - RNA, 17 nt, Homo sapiens
ugccagacauugcucuc

SEQ ID NO: 603185 - RNA, 21 nt, Homo sapiens
ugccagacccacugaaaugac

SEQ ID NO: 603186 - RNA, 21 nt, Homo sapiens
ugccagaggccccaggucacc

SEQ ID NO: 603187 - RNA, 17 nt, Homo sapiens
ugccagaggcuggacca

SEQ ID NO: 603188 - RNA, 19 nt, Homo sapiens
ugccagaugauuguucaaa

SEQ ID NO: 603189 - RNA, 17 nt, Homo sapiens
ugccagaugcaauacaa

SEQ ID NO: 603190 - RNA, 18 nt, Homo sapiens
ugccagcaaugacaucuc

SEQ ID NO: 603191 - RNA, 17 nt, Homo sapiens
ugccagcuacucaggag

SEQ ID NO: 603192 - RNA, 20 nt, Homo sapiens
ugccagcuuaucucaggggu

SEQ ID NO: 603193 - RNA, 13 nt, Homo sapiens
ugccaggacaaug

SEQ ID NO: 603194 - RNA, 23 nt, Homo sapiens
ugccaggaccccaggucaggggc

SEQ ID NO: 603195 - RNA, 21 nt, Homo sapiens
ugccaggcguuggugccacuu

SEQ ID NO: 603196 - RNA, 18 nt, Homo sapiens
ugccaggcuguaagcauu

SEQ ID NO: 603197 - RNA, 22 nt, Homo sapiens
ugccaggcuugcagucucccag

SEQ ID NO: 603198 - RNA, 16 nt, Homo sapiens
ugccagggcagggucu

SEQ ID NO: 603199 - RNA, 17 nt, Homo sapiens
ugccagggccaugucag

SEQ ID NO: 603200 - RNA, 18 nt, Homo sapiens
ugccagggccaugucaga

SEQ ID NO: 603201 - RNA, 15 nt, Homo sapiens
ugccagggcuggaag

SEQ ID NO: 603202 - RNA, 18 nt, Homo sapiens
ugccaggggcaguuuuag

SEQ ID NO: 603203 - RNA, 14 nt, Homo sapiens
ugccauagcaagau

SEQ ID NO: 603204 - RNA, 13 nt, Homo sapiens
ugccauagcauaa

SEQ ID NO: 603205 - RNA, 22 nt, Homo sapiens
ugccaucaccgcugggugguuu

SEQ ID NO: 603206 - RNA, 23 nt, Homo sapiens
ugccauccucccaaggggcccaa

SEQ ID NO: 603207 - RNA, 13 nt, Homo sapiens
ugccaucuuuauc

SEQ ID NO: 603208 - RNA, 15 nt, Homo sapiens
ugccaugacauuuca

SEQ ID NO: 603209 - RNA, 23 nt, Homo sapiens
ugccaugccagcuuaucucaggg

SEQ ID NO: 603210 - RNA, 20 nt, Homo sapiens
ugccaugccaggaaccuguc

SEQ ID NO: 603211 - RNA, 23 nt, Homo sapiens
ugccauggaggcaugccaaaugu

SEQ ID NO: 603212 - RNA, 12 nt, Homo sapiens
ugccauggugau

SEQ ID NO: 603213 - RNA, 20 nt, Homo sapiens
ugccauguaaaggccuuuaa

SEQ ID NO: 603214 - RNA, 14 nt, Homo sapiens
ugccauguuuagau

SEQ ID NO: 603215 - RNA, 18 nt, Homo sapiens
ugccauguuuagauucca

SEQ ID NO: 603216 - RNA, 14 nt, Homo sapiens
ugccauuacauugc

SEQ ID NO: 603217 - RNA, 15 nt, Homo sapiens
ugccauuacuacugu

SEQ ID NO: 603218 - RNA, 22 nt, Homo sapiens
ugccauuaugcaaauggagaua

SEQ ID NO: 603219 - RNA, 23 nt, Homo sapiens
ugccauuauuuaauaaaugacaa

SEQ ID NO: 603220 - RNA, 17 nt, Homo sapiens
ugccauuccucuacugc

SEQ ID NO: 603221 - RNA, 14 nt, Homo sapiens
ugccauugcacucc

SEQ ID NO: 603222 - RNA, 17 nt, Homo sapiens
ugccauugcacuccagc

SEQ ID NO: 603223 - RNA, 19 nt, Homo sapiens
ugcccaaacaccagucacc

SEQ ID NO: 603224 - RNA, 18 nt, Homo sapiens
ugcccaacccuaucccag

SEQ ID NO: 603225 - RNA, 21 nt, Homo sapiens
ugcccaaccugcucuccucuu

SEQ ID NO: 603226 - RNA, 14 nt, Homo sapiens
ugcccaagucccag

SEQ ID NO: 603227 - RNA, 18 nt, Homo sapiens
ugcccaaugagacucuag

SEQ ID NO: 603228 - RNA, 22 nt, Homo sapiens
ugcccaauuagggccuagccuu

SEQ ID NO: 603229 - RNA, 18 nt, Homo sapiens
ugcccacacggcagguag

SEQ ID NO: 603230 - RNA, 20 nt, Homo sapiens
ugcccacauuaagcacugug

SEQ ID NO: 603231 - RNA, 12 nt, Homo sapiens
ugcccaccaaag

SEQ ID NO: 603232 - RNA, 17 nt, Homo sapiens
ugcccacccgucuucaa

SEQ ID NO: 603233 - RNA, 12 nt, Homo sapiens
ugcccaccuccu

SEQ ID NO: 603234 - RNA, 16 nt, Homo sapiens
ugcccacgcagaggac

SEQ ID NO: 603235 - RNA, 14 nt, Homo sapiens
ugcccacucuccac

SEQ ID NO: 603236 - RNA, 15 nt, Homo sapiens
ugcccagaacuuccc

SEQ ID NO: 603237 - RNA, 21 nt, Homo sapiens
ugcccagacacagacuggcaa

SEQ ID NO: 603238 - RNA, 21 nt, Homo sapiens
ugcccaggcuagagugcaaug

SEQ ID NO: 603239 - RNA, 18 nt, Homo sapiens
ugcccaggcuggagugua

SEQ ID NO: 603240 - RNA, 17 nt, Homo sapiens
ugcccaggcuggucuca

SEQ ID NO: 603241 - RNA, 15 nt, Homo sapiens
ugcccagggaguccu

SEQ ID NO: 603242 - RNA, 15 nt, Homo sapiens
ugcccagggcucagc

SEQ ID NO: 603243 - RNA, 22 nt, Homo sapiens
ugcccagggcugcgucugcaaa

SEQ ID NO: 603244 - RNA, 13 nt, Homo sapiens
ugcccaggggcuu

SEQ ID NO: 603245 - RNA, 18 nt, Homo sapiens
ugcccagugaccagucac

SEQ ID NO: 603246 - RNA, 22 nt, Homo sapiens
ugcccaguguuguuuguaaaua

SEQ ID NO: 603247 - RNA, 20 nt, Homo sapiens
ugcccaucagccauuugcca

SEQ ID NO: 603248 - RNA, 18 nt, Homo sapiens
ugcccauccugacugaaa

SEQ ID NO: 603249 - RNA, 20 nt, Homo sapiens
ugcccauccugccauccuca

SEQ ID NO: 603250 - RNA, 14 nt, Homo sapiens
ugcccaugggcuau

SEQ ID NO: 603251 - RNA, 15 nt, Homo sapiens
ugcccauuugugauc

SEQ ID NO: 603252 - RNA, 21 nt, Homo sapiens
ugccccacaaaacuucagugu

SEQ ID NO: 603253 - RNA, 22 nt, Homo sapiens
ugccccacccaguuucuggaaa

SEQ ID NO: 603254 - RNA, 20 nt, Homo sapiens
ugccccaccccauccagcca

SEQ ID NO: 603255 - RNA, 14 nt, Homo sapiens
ugccccaccuuuau

SEQ ID NO: 603256 - RNA, 14 nt, Homo sapiens
ugccccacugaauu

SEQ ID NO: 603257 - RNA, 17 nt, Homo sapiens
ugccccaugccugucca

SEQ ID NO: 603258 - RNA, 18 nt, Homo sapiens
ugcccccauucucccagu

SEQ ID NO: 603259 - RNA, 19 nt, Homo sapiens
ugccccccagccucuggca

SEQ ID NO: 603260 - RNA, 16 nt, Homo sapiens
ugccccccuugccaga

SEQ ID NO: 603261 - RNA, 17 nt, Homo sapiens
ugccccccuugccagac

SEQ ID NO: 603262 - RNA, 19 nt, Homo sapiens
ugcccccuccaguccccca

SEQ ID NO: 603263 - RNA, 14 nt, Homo sapiens
ugcccccuccccca

SEQ ID NO: 603264 - RNA, 21 nt, Homo sapiens
ugcccccucccccaugggcug

SEQ ID NO: 603265 - RNA, 20 nt, Homo sapiens
ugcccccugcugccaugugg

SEQ ID NO: 603266 - RNA, 15 nt, Homo sapiens
ugccccgacacccag

SEQ ID NO: 603267 - RNA, 15 nt, Homo sapiens
ugccccgucaccauc

SEQ ID NO: 603268 - RNA, 19 nt, Homo sapiens
ugccccuacugcaaauggc

SEQ ID NO: 603269 - RNA, 18 nt, Homo sapiens
ugccccucagggggccag

SEQ ID NO: 603270 - RNA, 14 nt, Homo sapiens
ugccccucucacca

SEQ ID NO: 603271 - RNA, 15 nt, Homo sapiens
ugccccucuguucuc

SEQ ID NO: 603272 - RNA, 14 nt, Homo sapiens
ugccccuuugcccg

SEQ ID NO: 603273 - RNA, 15 nt, Homo sapiens
ugcccgaaaccagag

SEQ ID NO: 603274 - RNA, 17 nt, Homo sapiens
ugcccgaauuuguaauu

SEQ ID NO: 603275 - RNA, 18 nt, Homo sapiens
ugcccggcaggguccuag

SEQ ID NO: 603276 - RNA, 15 nt, Homo sapiens
ugcccggccaaguaa

SEQ ID NO: 603277 - RNA, 19 nt, Homo sapiens
ugcccguguaguccccaac

SEQ ID NO: 603278 - RNA, 20 nt, Homo sapiens
ugcccuagaucaacagauca

SEQ ID NO: 603279 - RNA, 13 nt, Homo sapiens
ugcccucauggcc

SEQ ID NO: 603280 - RNA, 13 nt, Homo sapiens
ugcccuccagaag

SEQ ID NO: 603281 - RNA, 14 nt, Homo sapiens
ugcccuccaucuca

SEQ ID NO: 603282 - RNA, 20 nt, Homo sapiens
ugcccuccccagagcacugg

SEQ ID NO: 603283 - RNA, 17 nt, Homo sapiens
ugcccucccgcaccuuc

SEQ ID NO: 603284 - RNA, 15 nt, Homo sapiens
ugcccucccucagcc

SEQ ID NO: 603285 - RNA, 19 nt, Homo sapiens
ugcccucccuguuucucca

SEQ ID NO: 603286 - RNA, 16 nt, Homo sapiens
ugcccuccuaucccca

SEQ ID NO: 603287 - RNA, 13 nt, Homo sapiens
ugcccucucccca

SEQ ID NO: 603288 - RNA, 18 nt, Homo sapiens
ugcccucucugaaccuca

SEQ ID NO: 603289 - RNA, 15 nt, Homo sapiens
ugcccugagacagac

SEQ ID NO: 603290 - RNA, 19 nt, Homo sapiens
ugcccugcuacuaacuuuu

SEQ ID NO: 603291 - RNA, 18 nt, Homo sapiens
ugcccuggagaugucaca

SEQ ID NO: 603292 - RNA, 14 nt, Homo sapiens
ugcccugggccaaa

SEQ ID NO: 603293 - RNA, 18 nt, Homo sapiens
ugcccugugcaugccaug

SEQ ID NO: 603294 - RNA, 14 nt, Homo sapiens
ugcccuguguggcu

SEQ ID NO: 603295 - RNA, 18 nt, Homo sapiens
ugcccuguucucuucaca

SEQ ID NO: 603296 - RNA, 13 nt, Homo sapiens
ugcccuuccccuu

SEQ ID NO: 603297 - RNA, 18 nt, Homo sapiens
ugcccuucucaagacuuu

SEQ ID NO: 603298 - RNA, 18 nt, Homo sapiens
ugcccuuggcaccaccag

SEQ ID NO: 603299 - RNA, 19 nt, Homo sapiens
ugcccuuggcaccaccagg

SEQ ID NO: 603300 - RNA, 20 nt, Homo sapiens
ugcccuugggguaagccaga

SEQ ID NO: 603301 - RNA, 16 nt, Homo sapiens
ugcccuuguugucucu

SEQ ID NO: 603302 - RNA, 17 nt, Homo sapiens
ugcccuuuaacuuucag

SEQ ID NO: 603303 - RNA, 11 nt, Homo sapiens
ugcccuuugag

SEQ ID NO: 603304 - RNA, 14 nt, Homo sapiens
ugcccuuugggguc

SEQ ID NO: 603305 - RNA, 16 nt, Homo sapiens
ugccgaacauuaggaa

SEQ ID NO: 603306 - RNA, 21 nt, Homo sapiens
ugccgacucccccaaccaagg

SEQ ID NO: 603307 - RNA, 16 nt, Homo sapiens
ugccgagccuaaugaa

SEQ ID NO: 603308 - RNA, 20 nt, Homo sapiens
ugccgcagggagggcugugg

SEQ ID NO: 603309 - RNA, 20 nt, Homo sapiens
ugccgcccuccacaccucua

SEQ ID NO: 603310 - RNA, 14 nt, Homo sapiens
ugccgcuaccuccc

SEQ ID NO: 603311 - RNA, 19 nt, Homo sapiens
ugccggguucuagucuccu

SEQ ID NO: 603312 - RNA, 17 nt, Homo sapiens
ugccguaacaacugugg

SEQ ID NO: 603313 - RNA, 16 nt, Homo sapiens
ugccgucaccaccacc

SEQ ID NO: 603314 - RNA, 16 nt, Homo sapiens
ugccguugcuccggcc

SEQ ID NO: 603315 - RNA, 14 nt, Homo sapiens
ugccguuucuuuca

SEQ ID NO: 603316 - RNA, 23 nt, Homo sapiens
ugccuaaaucccaagaaauggaa

SEQ ID NO: 603317 - RNA, 13 nt, Homo sapiens
ugccuaaguauuc

SEQ ID NO: 603318 - RNA, 20 nt, Homo sapiens
ugccuaaguccaguguuucu

SEQ ID NO: 603319 - RNA, 16 nt, Homo sapiens
ugccuacacacacagc

SEQ ID NO: 603320 - RNA, 20 nt, Homo sapiens
ugccuacacacacagccuau

SEQ ID NO: 603321 - RNA, 19 nt, Homo sapiens
ugccuacgauugaaaugaa

SEQ ID NO: 603322 - RNA, 21 nt, Homo sapiens
ugccuacuaucaaacuagcug

SEQ ID NO: 603323 - RNA, 19 nt, Homo sapiens
ugccuauaauacuugcaac

SEQ ID NO: 603324 - RNA, 17 nt, Homo sapiens
ugccucaccacacccag

SEQ ID NO: 603325 - RNA, 21 nt, Homo sapiens
ugccucagacguugccugaga

SEQ ID NO: 603326 - RNA, 22 nt, Homo sapiens
ugccucagccaggcccugagau

SEQ ID NO: 603327 - RNA, 18 nt, Homo sapiens
ugccucagccaguggcac

SEQ ID NO: 603328 - RNA, 20 nt, Homo sapiens
ugccucagccaguggcacag

SEQ ID NO: 603329 - RNA, 14 nt, Homo sapiens
ugccucagccuccc

SEQ ID NO: 603330 - RNA, 14 nt, Homo sapiens
ugccucauuucccu

SEQ ID NO: 603331 - RNA, 15 nt, Homo sapiens
ugccuccaccaccac

SEQ ID NO: 603332 - RNA, 13 nt, Homo sapiens
ugccuccagcauu

SEQ ID NO: 603333 - RNA, 16 nt, Homo sapiens
ugccuccagugcaguc

SEQ ID NO: 603334 - RNA, 20 nt, Homo sapiens
ugccucccggguucaagcaa

SEQ ID NO: 603335 - RNA, 20 nt, Homo sapiens
ugccuccucagaggacaguu

SEQ ID NO: 603336 - RNA, 15 nt, Homo sapiens
ugccuccuuguauua

SEQ ID NO: 603337 - RNA, 17 nt, Homo sapiens
ugccucucgguggccag

SEQ ID NO: 603338 - RNA, 18 nt, Homo sapiens
ugccucucucauccacuu

SEQ ID NO: 603339 - RNA, 15 nt, Homo sapiens
ugccucugugcacag

SEQ ID NO: 603340 - RNA, 19 nt, Homo sapiens
ugccucuucuacuuguaaa

SEQ ID NO: 603341 - RNA, 15 nt, Homo sapiens
ugccugaaaguaaua

SEQ ID NO: 603342 - RNA, 14 nt, Homo sapiens
ugccugccacugag

SEQ ID NO: 603343 - RNA, 13 nt, Homo sapiens
ugccugccagcuu

SEQ ID NO: 603344 - RNA, 23 nt, Homo sapiens
ugccugccccaaacaaauaugca

SEQ ID NO: 603345 - RNA, 21 nt, Homo sapiens
ugccugcuuuugaugaugucu

SEQ ID NO: 603346 - RNA, 14 nt, Homo sapiens
ugccuggacacugu

SEQ ID NO: 603347 - RNA, 23 nt, Homo sapiens
ugccuggccaugcugucccugca

SEQ ID NO: 603348 - RNA, 18 nt, Homo sapiens
ugccuggcccauucuuga

SEQ ID NO: 603349 - RNA, 21 nt, Homo sapiens
ugccugggaagcccacccaga

SEQ ID NO: 603350 - RNA, 20 nt, Homo sapiens
ugccuggggucugagcauga

SEQ ID NO: 603351 - RNA, 16 nt, Homo sapiens
ugccuguaacuugaga

SEQ ID NO: 603352 - RNA, 14 nt, Homo sapiens
ugccuguaaucuca

SEQ ID NO: 603353 - RNA, 16 nt, Homo sapiens
ugccugucccagagag

SEQ ID NO: 603354 - RNA, 11 nt, Homo sapiens
ugccugugacu

SEQ ID NO: 603355 - RNA, 11 nt, Homo sapiens
ugccugugauu

SEQ ID NO: 603356 - RNA, 22 nt, Homo sapiens
ugccugugcagcgggugcugcu

SEQ ID NO: 603357 - RNA, 14 nt, Homo sapiens
ugccuuaaaccuga

SEQ ID NO: 603358 - RNA, 19 nt, Homo sapiens
ugccuuaaccagucucuca

SEQ ID NO: 603359 - RNA, 15 nt, Homo sapiens
ugccuuagcauguga

SEQ ID NO: 603360 - RNA, 15 nt, Homo sapiens
ugccuuagucucagu

SEQ ID NO: 603361 - RNA, 13 nt, Homo sapiens
ugccuucacccau

SEQ ID NO: 603362 - RNA, 16 nt, Homo sapiens
ugccuucacuuuacaa

SEQ ID NO: 603363 - RNA, 22 nt, Homo sapiens
ugccuucagaggauaaauauca

SEQ ID NO: 603364 - RNA, 22 nt, Homo sapiens
acuugggugacggcagucgaug

SEQ ID NO: 603365 - RNA, 16 nt, Homo sapiens
acuuggguugaacuau

SEQ ID NO: 603366 - RNA, 20 nt, Homo sapiens
acuugguuuguggugcacag

SEQ ID NO: 603367 - RNA, 22 nt, Homo sapiens
acuugguuuguuauaucaggga

SEQ ID NO: 603368 - RNA, 22 nt, Homo sapiens
acuugguuuuuggcucuuucag

SEQ ID NO: 603369 - RNA, 17 nt, Homo sapiens
acuuguaaauguaauaa

SEQ ID NO: 603370 - RNA, 15 nt, Homo sapiens
acuuguacaccaaug

SEQ ID NO: 603371 - RNA, 15 nt, Homo sapiens
ugcagucugggugcu

SEQ ID NO: 603372 - RNA, 15 nt, Homo sapiens
ugcagugaauucaua

SEQ ID NO: 603373 - RNA, 17 nt, Homo sapiens
ugcagugacagcuugag

SEQ ID NO: 603374 - RNA, 17 nt, Homo sapiens
ugcagugagcccagauc

SEQ ID NO: 603375 - RNA, 17 nt, Homo sapiens
ugcaguggcgugaucuc

SEQ ID NO: 603376 - RNA, 17 nt, Homo sapiens
ugcaguggugugaucuc

SEQ ID NO: 603377 - RNA, 13 nt, Homo sapiens
ugcaguuaccaca

SEQ ID NO: 603378 - RNA, 18 nt, Homo sapiens
ugcaguucagcaccaccc

SEQ ID NO: 603379 - RNA, 14 nt, Homo sapiens
ugcaguuccaucag

SEQ ID NO: 603380 - RNA, 20 nt, Homo sapiens
ugcaguuccugaguaccuuc

SEQ ID NO: 603381 - RNA, 15 nt, Homo sapiens
ugcaguucuacucag

SEQ ID NO: 603382 - RNA, 16 nt, Homo sapiens
ugcaguugacagcagg

SEQ ID NO: 603383 - RNA, 15 nt, Homo sapiens
ugcaguugcagugaa

SEQ ID NO: 603384 - RNA, 15 nt, Homo sapiens
ugcaguuucauguau

SEQ ID NO: 603385 - RNA, 15 nt, Homo sapiens
ugcaguuucuaagca

SEQ ID NO: 603386 - RNA, 15 nt, Homo sapiens
ugcaguuucuucauc

SEQ ID NO: 603387 - RNA, 13 nt, Homo sapiens
ugcaguuuggccc

SEQ ID NO: 603388 - RNA, 14 nt, Homo sapiens
ugcaguuuuacuaa

SEQ ID NO: 603389 - RNA, 21 nt, Homo sapiens
ugcaguuuugccuaauggcaa

SEQ ID NO: 603390 - RNA, 22 nt, Homo sapiens
ugcaguuuuugccuggguccca

SEQ ID NO: 603391 - RNA, 13 nt, Homo sapiens
ugcauaaagccaa

SEQ ID NO: 603392 - RNA, 14 nt, Homo sapiens
ugcauaaccuuuac

SEQ ID NO: 603393 - RNA, 18 nt, Homo sapiens
ugcauaacgucugccuuc

SEQ ID NO: 603394 - RNA, 22 nt, Homo sapiens
ugcauaauguuucuggauuuca

SEQ ID NO: 603395 - RNA, 18 nt, Homo sapiens
ugcauacagagacagaua

SEQ ID NO: 603396 - RNA, 20 nt, Homo sapiens
ugcauacagccuuugccauc

SEQ ID NO: 603397 - RNA, 21 nt, Homo sapiens
ugcauacuuucccucauccau

SEQ ID NO: 603398 - RNA, 17 nt, Homo sapiens
ugcauagcaagugaaag

SEQ ID NO: 603399 - RNA, 17 nt, Homo sapiens
ugcauagugcugggaug

SEQ ID NO: 603400 - RNA, 14 nt, Homo sapiens
ugcauauagauuua

SEQ ID NO: 603401 - RNA, 14 nt, Homo sapiens
ugcauauauuuuag

SEQ ID NO: 603402 - RNA, 19 nt, Homo sapiens
ugcauauuuagcuuugcac

SEQ ID NO: 603403 - RNA, 20 nt, Homo sapiens
ugcauauuuuuaaacaaaga

SEQ ID NO: 603404 - RNA, 21 nt, Homo sapiens
ugcaucacggauggugcaugg

SEQ ID NO: 603405 - RNA, 14 nt, Homo sapiens
ugcaucauguugaa

SEQ ID NO: 603406 - RNA, 16 nt, Homo sapiens
ugcaucuuguuucaua

SEQ ID NO: 603407 - RNA, 19 nt, Homo sapiens
ugcaugaaaaacauuccac

SEQ ID NO: 603408 - RNA, 17 nt, Homo sapiens
ugcaugaaguaauaugc

SEQ ID NO: 603409 - RNA, 20 nt, Homo sapiens
gagaacagcauaugauuucu

SEQ ID NO: 603410 - RNA, 12 nt, Homo sapiens
gagaaccaggcu

SEQ ID NO: 603411 - RNA, 20 nt, Homo sapiens
gagaaccagugcagacucaa

SEQ ID NO: 603412 - RNA, 15 nt, Homo sapiens
gagaaccucagauca

SEQ ID NO: 603413 - RNA, 13 nt, Homo sapiens
gagaacuaaauaa

SEQ ID NO: 603414 - RNA, 14 nt, Homo sapiens
gagaacucuuucau

SEQ ID NO: 603415 - RNA, 12 nt, Homo sapiens
gagaagaaccau

SEQ ID NO: 603416 - RNA, 19 nt, Homo sapiens
gagaagaaguggcugccac

SEQ ID NO: 603417 - RNA, 18 nt, Homo sapiens
gagaagaaugacuaugca

SEQ ID NO: 603418 - RNA, 21 nt, Homo sapiens
gagaagaggcugcugcagaca

SEQ ID NO: 603419 - RNA, 16 nt, Homo sapiens
gagaagcaauggguca

SEQ ID NO: 603420 - RNA, 22 nt, Homo sapiens
gagaagcaccagcaauucucuu

SEQ ID NO: 603421 - RNA, 15 nt, Homo sapiens
gagaagcucacccaa

SEQ ID NO: 603422 - RNA, 17 nt, Homo sapiens
gagaagcucacccaaua

SEQ ID NO: 603423 - RNA, 20 nt, Homo sapiens
gagaagcucugaagaacucu

SEQ ID NO: 603424 - RNA, 14 nt, Homo sapiens
gagaagcugcugac

SEQ ID NO: 603425 - RNA, 13 nt, Homo sapiens
gagaagcuggaag

SEQ ID NO: 603426 - RNA, 12 nt, Homo sapiens
gagaagcuguag

SEQ ID NO: 603427 - RNA, 18 nt, Homo sapiens
gagaaggaaaagacugaa

SEQ ID NO: 603428 - RNA, 20 nt, Homo sapiens
gagaaggcgggguauuccca

SEQ ID NO: 603429 - RNA, 19 nt, Homo sapiens
gagaagggggucucuguua

SEQ ID NO: 603430 - RNA, 12 nt, Homo sapiens
gagaaggugcuu

SEQ ID NO: 603431 - RNA, 18 nt, Homo sapiens
gagaaguacuuuaccuga

SEQ ID NO: 603432 - RNA, 18 nt, Homo sapiens
gagaaguggcuugacaau

SEQ ID NO: 603433 - RNA, 21 nt, Homo sapiens
gagaaguuuguagccagguac

SEQ ID NO: 603434 - RNA, 22 nt, Homo sapiens
gagaauaaaacguuaguuaauc

SEQ ID NO: 603435 - RNA, 20 nt, Homo sapiens
gagaauaaaauuccuaucuc

SEQ ID NO: 603436 - RNA, 17 nt, Homo sapiens
gagaauacuuugcuuca

SEQ ID NO: 603437 - RNA, 13 nt, Homo sapiens
gagaaucacuuca

SEQ ID NO: 603438 - RNA, 21 nt, Homo sapiens
gagaaucccaaauuugauuga

SEQ ID NO: 603439 - RNA, 15 nt, Homo sapiens
uuucuaagacucacu

SEQ ID NO: 603440 - RNA, 19 nt, Homo sapiens
uuucuaauggaaugugaga

SEQ ID NO: 603441 - RNA, 14 nt, Homo sapiens
uuucuacacugagg

SEQ ID NO: 603442 - RNA, 15 nt, Homo sapiens
uuucuaccagcucau

SEQ ID NO: 603443 - RNA, 20 nt, Homo sapiens
uuucuacuuccccugggaug

SEQ ID NO: 603444 - RNA, 15 nt, Homo sapiens
uuucuagaagcacau

SEQ ID NO: 603445 - RNA, 22 nt, Homo sapiens
uuucuagauaaggaagagucuc

SEQ ID NO: 603446 - RNA, 12 nt, Homo sapiens
uuucuagccuua

SEQ ID NO: 603447 - RNA, 20 nt, Homo sapiens
uuucuauagaaaaaguaaaa

SEQ ID NO: 603448 - RNA, 13 nt, Homo sapiens
uuucuauauucuc

SEQ ID NO: 603449 - RNA, 18 nt, Homo sapiens
uuucuaugacacaugcaa

SEQ ID NO: 603450 - RNA, 14 nt, Homo sapiens
uuucuaugugacaa

SEQ ID NO: 603451 - RNA, 15 nt, Homo sapiens
uuucuauuauggaaa

SEQ ID NO: 603452 - RNA, 16 nt, Homo sapiens
uuucuauuucacuaau

SEQ ID NO: 603453 - RNA, 11 nt, Homo sapiens
uuucucaaaaa

SEQ ID NO: 603454 - RNA, 14 nt, Homo sapiens
uuucucaaaugcac

SEQ ID NO: 603455 - RNA, 19 nt, Homo sapiens
uuucucagugcacaugcaa

SEQ ID NO: 603456 - RNA, 23 nt, Homo sapiens
uuucuccaaagaagauaugcaaa

SEQ ID NO: 603457 - RNA, 16 nt, Homo sapiens
uuucuccaggaccaau

SEQ ID NO: 603458 - RNA, 20 nt, Homo sapiens
uuucuccuugauaucauuca

SEQ ID NO: 603459 - RNA, 19 nt, Homo sapiens
aaagauucucaucacucaa

SEQ ID NO: 603460 - RNA, 19 nt, Homo sapiens
aaagauugauagaaaucag

SEQ ID NO: 603461 - RNA, 18 nt, Homo sapiens
aaagauugcagcauuuau

SEQ ID NO: 603462 - RNA, 11 nt, Homo sapiens
aaagcaaaaua

SEQ ID NO: 603463 - RNA, 16 nt, Homo sapiens
aaagcaaaauugcaau

SEQ ID NO: 603464 - RNA, 14 nt, Homo sapiens
aaagcaagacccua

SEQ ID NO: 603465 - RNA, 20 nt, Homo sapiens
aaagcaagacuguugcucaa

SEQ ID NO: 603466 - RNA, 14 nt, Homo sapiens
aaagcaaguguuca

SEQ ID NO: 603467 - RNA, 23 nt, Homo sapiens
aaagcaauucugacuguccagga

SEQ ID NO: 603468 - RNA, 12 nt, Homo sapiens
aaagcacagugu

SEQ ID NO: 603469 - RNA, 21 nt, Homo sapiens
aaagcacccuguaucacagac

SEQ ID NO: 603470 - RNA, 23 nt, Homo sapiens
aaagcacgugucucagacugcau

SEQ ID NO: 603471 - RNA, 20 nt, Homo sapiens
aaagcacugaccugucaugc

SEQ ID NO: 603472 - RNA, 23 nt, Homo sapiens
aaagcacuuggacucuugcucuu

SEQ ID NO: 603473 - RNA, 9 nt, Homo sapiens
aaagcagag

SEQ ID NO: 603474 - RNA, 20 nt, Homo sapiens
aaagcagaugagcuguggac

SEQ ID NO: 603475 - RNA, 22 nt, Homo sapiens
aaagcagccacgaggugcaaca

SEQ ID NO: 603476 - RNA, 19 nt, Homo sapiens
aaagcagcccucugccucc

SEQ ID NO: 603477 - RNA, 21 nt, Homo sapiens
aaagcagcucaagaacacaug

SEQ ID NO: 603478 - RNA, 17 nt, Homo sapiens
aaagcauaacaaaaaga

SEQ ID NO: 603479 - RNA, 23 nt, Homo sapiens
aaagcauaugcagccaaccaaga

SEQ ID NO: 603480 - RNA, 16 nt, Homo sapiens
aaagcaucaccucagg

SEQ ID NO: 603481 - RNA, 14 nt, Homo sapiens
aaagcauccaugug

SEQ ID NO: 603482 - RNA, 17 nt, Homo sapiens
aaagcaucuaucucauc

SEQ ID NO: 603483 - RNA, 12 nt, Homo sapiens
aaagcaucucau

SEQ ID NO: 603484 - RNA, 14 nt, Homo sapiens
aaagcaugcauauc

SEQ ID NO: 603485 - RNA, 13 nt, Homo sapiens
aaagcaugucuca

SEQ ID NO: 603486 - RNA, 21 nt, Homo sapiens
aaagcaugucucugcuuccau

SEQ ID NO: 603487 - RNA, 18 nt, Homo sapiens
aaagcauucaauuuauuc

SEQ ID NO: 603488 - RNA, 23 nt, Homo sapiens
aaagccaaggucuggagaagcuc

SEQ ID NO: 603489 - RNA, 13 nt, Homo sapiens
aaagccacacucu

SEQ ID NO: 603490 - RNA, 13 nt, Homo sapiens
aaagccacaucuu

SEQ ID NO: 603491 - RNA, 16 nt, Homo sapiens
aaagccacaucuugcu

SEQ ID NO: 603492 - RNA, 14 nt, Homo sapiens
aaagccaccacauu

SEQ ID NO: 603493 - RNA, 12 nt, Homo sapiens
aaagccacuucu

SEQ ID NO: 603494 - RNA, 18 nt, Homo sapiens
aaagccacuuuuccaaau

SEQ ID NO: 603495 - RNA, 22 nt, Homo sapiens
aaagccagguuccacagaggac

SEQ ID NO: 603496 - RNA, 14 nt, Homo sapiens
aaagcccacaggcc

SEQ ID NO: 603497 - RNA, 15 nt, Homo sapiens
aaagcccgccugaca

SEQ ID NO: 603498 - RNA, 18 nt, Homo sapiens
aaagcccugccucugugu

SEQ ID NO: 603499 - RNA, 20 nt, Homo sapiens
aaagcccugguaaaagggau

SEQ ID NO: 603500 - RNA, 15 nt, Homo sapiens
aaagcccuuccaugu

SEQ ID NO: 603501 - RNA, 23 nt, Homo sapiens
aaagccuacccuauucuauccau

SEQ ID NO: 603502 - RNA, 18 nt, Homo sapiens
aaagccucagaaagggau

SEQ ID NO: 603503 - RNA, 13 nt, Homo sapiens
aaagccuccucau

SEQ ID NO: 603504 - RNA, 21 nt, Homo sapiens
aaagccucgggccacaugggu

SEQ ID NO: 603505 - RNA, 12 nt, Homo sapiens
aaagccucugau

SEQ ID NO: 603506 - RNA, 14 nt, Homo sapiens
aaagccucuggaaa

SEQ ID NO: 603507 - RNA, 13 nt, Homo sapiens
aaagccuguccca

SEQ ID NO: 603508 - RNA, 16 nt, Homo sapiens
aaagccuuaagcaaau

SEQ ID NO: 603509 - RNA, 17 nt, Homo sapiens
aaagccuuuuccagaag

SEQ ID NO: 603510 - RNA, 23 nt, Homo sapiens
aaagccuuuuccagaagaucuga

SEQ ID NO: 603511 - RNA, 21 nt, Homo sapiens
aaagccuuuuuuuaggccaca

SEQ ID NO: 603512 - RNA, 21 nt, Homo sapiens
aaagcggacaucagcugguca

SEQ ID NO: 603513 - RNA, 18 nt, Homo sapiens
aaagcggggcuucaucug

SEQ ID NO: 603514 - RNA, 18 nt, Homo sapiens
aaagcuaaugugcaggga

SEQ ID NO: 603515 - RNA, 22 nt, Homo sapiens
aaagcuaguguaccuccucuca

SEQ ID NO: 603516 - RNA, 17 nt, Homo sapiens
aaagcuauauaagacaa

SEQ ID NO: 603517 - RNA, 15 nt, Homo sapiens
aaagcucacuguagc

SEQ ID NO: 603518 - RNA, 20 nt, Homo sapiens
aaagcucuauuaagauuucc

SEQ ID NO: 603519 - RNA, 15 nt, Homo sapiens
aaagcucuucauuuc

SEQ ID NO: 603520 - RNA, 23 nt, Homo sapiens
aaagcugagaagaaugaaaaugc

SEQ ID NO: 603521 - RNA, 12 nt, Homo sapiens
aaagcugaugag

SEQ ID NO: 603522 - RNA, 18 nt, Homo sapiens
aaagcugauuacugucaa

SEQ ID NO: 603523 - RNA, 22 nt, Homo sapiens
aaagcugauuacugucaauaaa

SEQ ID NO: 603524 - RNA, 12 nt, Homo sapiens
aaagcugccauu

SEQ ID NO: 603525 - RNA, 16 nt, Homo sapiens
aaagcugccugugcca

SEQ ID NO: 603526 - RNA, 17 nt, Homo sapiens
aaagcugccugugccau

SEQ ID NO: 603527 - RNA, 13 nt, Homo sapiens
aaagcugcucagg

SEQ ID NO: 603528 - RNA, 18 nt, Homo sapiens
aaagcugggaaccagcau

SEQ ID NO: 603529 - RNA, 21 nt, Homo sapiens
aaagcuggugucugauuuugg

SEQ ID NO: 603530 - RNA, 18 nt, Homo sapiens
aaagcuguuaaacuguua

SEQ ID NO: 603531 - RNA, 23 nt, Homo sapiens
aaagcuguuuauuuauucacugu

SEQ ID NO: 603532 - RNA, 19 nt, Homo sapiens
agcuaauuuauagcaagau

SEQ ID NO: 603533 - RNA, 21 nt, Homo sapiens
agcuacagucuaaaauugcuu

SEQ ID NO: 603534 - RNA, 11 nt, Homo sapiens
agcuacagugu

SEQ ID NO: 603535 - RNA, 13 nt, Homo sapiens
agcuacauuccuc

SEQ ID NO: 603536 - RNA, 21 nt, Homo sapiens
agcuaccucaaacuuccaguc

SEQ ID NO: 603537 - RNA, 21 nt, Homo sapiens
agcuaccucacuaugcugcuu

SEQ ID NO: 603538 - RNA, 19 nt, Homo sapiens
agcuaccuguggugauguu

SEQ ID NO: 603539 - RNA, 16 nt, Homo sapiens
agcuacuagagauauu

SEQ ID NO: 603540 - RNA, 14 nt, Homo sapiens
agcuacucucccca

SEQ ID NO: 603541 - RNA, 21 nt, Homo sapiens
agcuacucuccccacgagggc

SEQ ID NO: 603542 - RNA, 17 nt, Homo sapiens
agcuacucucuugccag

SEQ ID NO: 603543 - RNA, 17 nt, Homo sapiens
agcuacuguaacuuuuu

SEQ ID NO: 603544 - RNA, 21 nt, Homo sapiens
agcuagaagugggccaggaca

SEQ ID NO: 603545 - RNA, 14 nt, Homo sapiens
agcuagaauaccac

SEQ ID NO: 603546 - RNA, 16 nt, Homo sapiens
agcuagaugugucuua

SEQ ID NO: 603547 - RNA, 15 nt, Homo sapiens
agcuaggugcuauuu

SEQ ID NO: 603548 - RNA, 15 nt, Homo sapiens
agcuagugagcaaaa

SEQ ID NO: 603549 - RNA, 13 nt, Homo sapiens
agcuaguggcucu

SEQ ID NO: 603550 - RNA, 17 nt, Homo sapiens
agcuaguggcuucaaaa

SEQ ID NO: 603551 - RNA, 17 nt, Homo sapiens
agcuaguucccaugacu

SEQ ID NO: 603552 - RNA, 14 nt, Homo sapiens
agcuauaacuaagc

SEQ ID NO: 603553 - RNA, 18 nt, Homo sapiens
agcuauacuuacacugua

SEQ ID NO: 603554 - RNA, 14 nt, Homo sapiens
agcuauauccaugu

SEQ ID NO: 603555 - RNA, 15 nt, Homo sapiens
agcuauccacagcuu

SEQ ID NO: 603556 - RNA, 17 nt, Homo sapiens
agcuauccacagcuuac

SEQ ID NO: 603557 - RNA, 18 nt, Homo sapiens
agcuaucuugaaaauguu

SEQ ID NO: 603558 - RNA, 23 nt, Homo sapiens
agcuaugaaaacagcuaucucac

SEQ ID NO: 603559 - RNA, 20 nt, Homo sapiens
agcuaugaucgcgccacuac

SEQ ID NO: 603560 - RNA, 17 nt, Homo sapiens
agcuaugcuguaucugu

SEQ ID NO: 603561 - RNA, 23 nt, Homo sapiens
agcuauucucuuaaaaugacaaa

SEQ ID NO: 603562 - RNA, 20 nt, Homo sapiens
agcuauuuaagaaaaguauc

SEQ ID NO: 603563 - RNA, 16 nt, Homo sapiens
agcuauuuaucuguag

SEQ ID NO: 603564 - RNA, 20 nt, Homo sapiens
agcuauuuaucuguaguaaa

SEQ ID NO: 603565 - RNA, 16 nt, Homo sapiens
agcuauuuuaagccau

SEQ ID NO: 603566 - RNA, 20 nt, Homo sapiens
agcuauuuugugaagccaug

SEQ ID NO: 603567 - RNA, 22 nt, Homo sapiens
agcucaaucugcaaacaugcca

SEQ ID NO: 603568 - RNA, 20 nt, Homo sapiens
agcucaauuguuaaugugau

SEQ ID NO: 603569 - RNA, 15 nt, Homo sapiens
agcucaccacugugc

SEQ ID NO: 603570 - RNA, 23 nt, Homo sapiens
agcucaccaucuucacuacaaac

SEQ ID NO: 603571 - RNA, 19 nt, Homo sapiens
agcucagaaacgaaaucua

SEQ ID NO: 603572 - RNA, 16 nt, Homo sapiens
agcucagccacuguga

SEQ ID NO: 603573 - RNA, 16 nt, Homo sapiens
agcucagcgccagccu

SEQ ID NO: 603574 - RNA, 18 nt, Homo sapiens
agcucaggacugccauug

SEQ ID NO: 603575 - RNA, 15 nt, Homo sapiens
agcucaggcacacuu

SEQ ID NO: 603576 - RNA, 16 nt, Homo sapiens
agcucaggcacacuuc

SEQ ID NO: 603577 - RNA, 16 nt, Homo sapiens
agcucaguuacggggu

SEQ ID NO: 603578 - RNA, 14 nt, Homo sapiens
agcuccaucaauga

SEQ ID NO: 603579 - RNA, 14 nt, Homo sapiens
agcuccaugugcau

SEQ ID NO: 603580 - RNA, 20 nt, Homo sapiens
agcucccaccccacucaggg

SEQ ID NO: 603581 - RNA, 19 nt, Homo sapiens
agcuccccagaucucccac

SEQ ID NO: 603582 - RNA, 23 nt, Homo sapiens
agcuccccccaagaugagcugca

SEQ ID NO: 603583 - RNA, 20 nt, Homo sapiens
agcucccgaggaagcacagc

SEQ ID NO: 603584 - RNA, 16 nt, Homo sapiens
agcucccgggcacauc

SEQ ID NO: 603585 - RNA, 15 nt, Homo sapiens
agcucccggggacga

SEQ ID NO: 603586 - RNA, 15 nt, Homo sapiens
agcuccgaccucucu

SEQ ID NO: 603587 - RNA, 17 nt, Homo sapiens
agcuccgccucccgggu

SEQ ID NO: 603588 - RNA, 16 nt, Homo sapiens
agcuccuaguuugugg

SEQ ID NO: 603589 - RNA, 21 nt, Homo sapiens
agcuccucccacaaugcugaa

SEQ ID NO: 603590 - RNA, 22 nt, Homo sapiens
agcuccuccucggaaccgcuca

SEQ ID NO: 603591 - RNA, 19 nt, Homo sapiens
agcuccucuauauuuccac

SEQ ID NO: 603592 - RNA, 18 nt, Homo sapiens
agcuccucucacucuuca

SEQ ID NO: 603593 - RNA, 19 nt, Homo sapiens
agcuccuuguuuuugccaa

SEQ ID NO: 603594 - RNA, 21 nt, Homo sapiens
agcuccuuguuuuugccaaag

SEQ ID NO: 603595 - RNA, 15 nt, Homo sapiens
agcucucacaugcac

SEQ ID NO: 603596 - RNA, 18 nt, Homo sapiens
agcucucacaugcacagg

SEQ ID NO: 603597 - RNA, 15 nt, Homo sapiens
agcucucccagugaa

SEQ ID NO: 603598 - RNA, 18 nt, Homo sapiens
agcucucccuuguuuacu

SEQ ID NO: 603599 - RNA, 21 nt, Homo sapiens
agcucucgggacuagcugccu

SEQ ID NO: 603600 - RNA, 12 nt, Homo sapiens
agcucucucuac

SEQ ID NO: 603601 - RNA, 18 nt, Homo sapiens
agcucucugauuccccaa

SEQ ID NO: 603602 - RNA, 18 nt, Homo sapiens
agcucugaacaaacacug

SEQ ID NO: 603603 - RNA, 16 nt, Homo sapiens
agcucugacauucuga

SEQ ID NO: 603604 - RNA, 14 nt, Homo sapiens
agcucuggaugaag

SEQ ID NO: 603605 - RNA, 19 nt, Homo sapiens
agcucuggcuuagacacca

SEQ ID NO: 603606 - RNA, 20 nt, Homo sapiens
agcucuggggugggcaguuu

SEQ ID NO: 603607 - RNA, 17 nt, Homo sapiens
agcucuguaucugccau

SEQ ID NO: 603608 - RNA, 19 nt, Homo sapiens
agcucuucucccagaugua

SEQ ID NO: 603609 - RNA, 20 nt, Homo sapiens
agcucuuggcuccacuggga

SEQ ID NO: 603610 - RNA, 18 nt, Homo sapiens
agcugaaaagagcuuugu

SEQ ID NO: 603611 - RNA, 15 nt, Homo sapiens
agcugaaaugcugca

SEQ ID NO: 603612 - RNA, 18 nt, Homo sapiens
agcugaacaauaggcugu

SEQ ID NO: 603613 - RNA, 20 nt, Homo sapiens
agcugaacagccaaaugcau

SEQ ID NO: 603614 - RNA, 12 nt, Homo sapiens
agcugaacccau

SEQ ID NO: 603615 - RNA, 13 nt, Homo sapiens
agcugaacccugc

SEQ ID NO: 603616 - RNA, 22 nt, Homo sapiens
agcugaagaacuuggcacacuc

SEQ ID NO: 603617 - RNA, 13 nt, Homo sapiens
agcugaaugccuc

SEQ ID NO: 603618 - RNA, 17 nt, Homo sapiens
agcugacauugccaaaa

SEQ ID NO: 603619 - RNA, 18 nt, Homo sapiens
agcugagaauguggaaua

SEQ ID NO: 603620 - RNA, 22 nt, Homo sapiens
agcugagcacuuuugaaaagcu

SEQ ID NO: 603621 - RNA, 15 nt, Homo sapiens
agcugaggacacacc

SEQ ID NO: 603622 - RNA, 18 nt, Homo sapiens
agcugagggacguggugc

SEQ ID NO: 603623 - RNA, 22 nt, Homo sapiens
agcugagggcccuguggagucc

SEQ ID NO: 603624 - RNA, 14 nt, Homo sapiens
agcugagugaaaaa

SEQ ID NO: 603625 - RNA, 14 nt, Homo sapiens
agcugauacuuuga

SEQ ID NO: 603626 - RNA, 11 nt, Homo sapiens
agcugaucagu

SEQ ID NO: 603627 - RNA, 18 nt, Homo sapiens
agcugauuuuaacaauaa

SEQ ID NO: 603628 - RNA, 14 nt, Homo sapiens
agcugcaacggaau

SEQ ID NO: 603629 - RNA, 16 nt, Homo sapiens
agcugcacagcaaaag

SEQ ID NO: 603630 - RNA, 14 nt, Homo sapiens
agcugcacaugugc

SEQ ID NO: 603631 - RNA, 15 nt, Homo sapiens
agcugcacauuccug

SEQ ID NO: 603632 - RNA, 13 nt, Homo sapiens
agcugcaccugau

SEQ ID NO: 603633 - RNA, 13 nt, Homo sapiens
agcugcaccugcc

SEQ ID NO: 603634 - RNA, 12 nt, Homo sapiens
agcugcacugau

SEQ ID NO: 603635 - RNA, 17 nt, Homo sapiens
agcugcagaccaugcca

SEQ ID NO: 603636 - RNA, 23 nt, Homo sapiens
agcugcagguuuguaaugcaaaa

SEQ ID NO: 603637 - RNA, 21 nt, Homo sapiens
agcugccaaauaagauuccca

SEQ ID NO: 603638 - RNA, 14 nt, Homo sapiens
agcugccaugucag

SEQ ID NO: 603639 - RNA, 14 nt, Homo sapiens
agcugccucacuuc

SEQ ID NO: 603640 - RNA, 16 nt, Homo sapiens
agcugccucacuuccu

SEQ ID NO: 603641 - RNA, 13 nt, Homo sapiens
agcugccucugcu

SEQ ID NO: 603642 - RNA, 15 nt, Homo sapiens
agcugccucugggcc

SEQ ID NO: 603643 - RNA, 20 nt, Homo sapiens
agcugccucuucucuugaca

SEQ ID NO: 603644 - RNA, 18 nt, Homo sapiens
agcugccuggggcccaag

SEQ ID NO: 603645 - RNA, 19 nt, Homo sapiens
agcugccugugccaugccc

SEQ ID NO: 603646 - RNA, 18 nt, Homo sapiens
aggagaugaccagugccu

SEQ ID NO: 603647 - RNA, 19 nt, Homo sapiens
aggagaugccacuucucac

SEQ ID NO: 603648 - RNA, 22 nt, Homo sapiens
aggagauuccuucauaaaacuc

SEQ ID NO: 603649 - RNA, 17 nt, Homo sapiens
aggagcacaggucccac

SEQ ID NO: 603650 - RNA, 15 nt, Homo sapiens
aggagcagaaaaccc

SEQ ID NO: 603651 - RNA, 11 nt, Homo sapiens
aggagcaggca

SEQ ID NO: 603652 - RNA, 16 nt, Homo sapiens
aggagcagugugaccu

SEQ ID NO: 603653 - RNA, 19 nt, Homo sapiens
aggagccaccaguucucau

SEQ ID NO: 603654 - RNA, 15 nt, Homo sapiens
aggagcccacagugc

SEQ ID NO: 603655 - RNA, 19 nt, Homo sapiens
aggagcccacagugccugu

SEQ ID NO: 603656 - RNA, 16 nt, Homo sapiens
aggagcccagccagaa

SEQ ID NO: 603657 - RNA, 15 nt, Homo sapiens
agaucguuguuuaca

SEQ ID NO: 603658 - RNA, 21 nt, Homo sapiens
agaucuaaggaugucacaggg

SEQ ID NO: 603659 - RNA, 20 nt, Homo sapiens
aggcugagaaucagacugac

SEQ ID NO: 603660 - RNA, 17 nt, Homo sapiens
aggcugagccugcucau

SEQ ID NO: 603661 - RNA, 16 nt, Homo sapiens
aggcugagcugcaucc

SEQ ID NO: 603662 - RNA, 17 nt, Homo sapiens
aggcugaggcaggagaa

SEQ ID NO: 603663 - RNA, 21 nt, Homo sapiens
aggcugagugcauaggugaca

SEQ ID NO: 603664 - RNA, 14 nt, Homo sapiens
aggcugaguguccg

SEQ ID NO: 603665 - RNA, 12 nt, Homo sapiens
aggcugcaguga

SEQ ID NO: 603666 - RNA, 13 nt, Homo sapiens
aggcugcagugag

SEQ ID NO: 603667 - RNA, 17 nt, Homo sapiens
aggcugccugugugcau

SEQ ID NO: 603668 - RNA, 18 nt, Homo sapiens
aggcugcgacugaugaag

SEQ ID NO: 603669 - RNA, 20 nt, Homo sapiens
aggcugcuagaggugcucau

SEQ ID NO: 603670 - RNA, 17 nt, Homo sapiens
aggcugcuagauguagg

SEQ ID NO: 603671 - RNA, 22 nt, Homo sapiens
aggcuggaaaugguuucacuug

SEQ ID NO: 603672 - RNA, 22 nt, Homo sapiens
aggucagggagugcuggcucac

SEQ ID NO: 603673 - RNA, 19 nt, Homo sapiens
aggucauacaugcauacaa

SEQ ID NO: 603674 - RNA, 19 nt, Homo sapiens
aggucauugcaccuaucuc

SEQ ID NO: 603675 - RNA, 12 nt, Homo sapiens
agguccacagag

SEQ ID NO: 603676 - RNA, 22 nt, Homo sapiens
agguccacggucuguucuugaa

SEQ ID NO: 603677 - RNA, 18 nt, Homo sapiens
aggucccaccuccauuug

SEQ ID NO: 603678 - RNA, 19 nt, Homo sapiens
aggucccagcgagccacag

SEQ ID NO: 603679 - RNA, 14 nt, Homo sapiens
aggucccaucaauu

SEQ ID NO: 603680 - RNA, 18 nt, Homo sapiens
agguccuaaagaugcuga

SEQ ID NO: 603681 - RNA, 12 nt, Homo sapiens
agguccuagucg

SEQ ID NO: 603682 - RNA, 20 nt, Homo sapiens
agguccuccaucccaacagc

SEQ ID NO: 603683 - RNA, 20 nt, Homo sapiens
agguccucuacuuaaugaga

SEQ ID NO: 603684 - RNA, 23 nt, Homo sapiens
agguccucuacuuaaugagauag

SEQ ID NO: 603685 - RNA, 19 nt, Homo sapiens
agguccucugucagucaca

SEQ ID NO: 603686 - RNA, 15 nt, Homo sapiens
aggucggcacuugga

SEQ ID NO: 603687 - RNA, 15 nt, Homo sapiens
auaaaugccuuccac

SEQ ID NO: 603688 - RNA, 14 nt, Homo sapiens
auaaauggacaaau

SEQ ID NO: 603689 - RNA, 16 nt, Homo sapiens
auaaauggaccauccu

SEQ ID NO: 603690 - RNA, 15 nt, Homo sapiens
auaaauggccagugc

SEQ ID NO: 603691 - RNA, 15 nt, Homo sapiens
auaaauggguguaua

SEQ ID NO: 603692 - RNA, 19 nt, Homo sapiens
auaaauguaaauauguaca

SEQ ID NO: 603693 - RNA, 12 nt, Homo sapiens
auaaauguaucu

SEQ ID NO: 603694 - RNA, 14 nt, Homo sapiens
auaaaugucacugc

SEQ ID NO: 603695 - RNA, 17 nt, Homo sapiens
auaaaugucacugccaa

SEQ ID NO: 603696 - RNA, 19 nt, Homo sapiens
auaaauguuuuauuucuag

SEQ ID NO: 603697 - RNA, 14 nt, Homo sapiens
auaaauuauggcau

SEQ ID NO: 603698 - RNA, 12 nt, Homo sapiens
auaaauucccaa

SEQ ID NO: 603699 - RNA, 15 nt, Homo sapiens
auaaauugacauaac

SEQ ID NO: 603700 - RNA, 12 nt, Homo sapiens
auaaauugugaa

SEQ ID NO: 603701 - RNA, 15 nt, Homo sapiens
auaaauuucccaguu

SEQ ID NO: 603702 - RNA, 13 nt, Homo sapiens
auaaauuugcacu

SEQ ID NO: 603703 - RNA, 18 nt, Homo sapiens
auaaauuuuauuccaaaa

SEQ ID NO: 603704 - RNA, 14 nt, Homo sapiens
auaacaaaacacuc

SEQ ID NO: 603705 - RNA, 14 nt, Homo sapiens
auaacaacuuugaa

SEQ ID NO: 603706 - RNA, 16 nt, Homo sapiens
auaacaagaguuuuaa

SEQ ID NO: 603707 - RNA, 17 nt, Homo sapiens
auaacaaggagauuucu

SEQ ID NO: 603708 - RNA, 12 nt, Homo sapiens
auaacagaauua

SEQ ID NO: 603709 - RNA, 13 nt, Homo sapiens
auaacagaauuaa

SEQ ID NO: 603710 - RNA, 23 nt, Homo sapiens
auaauuccuauauccugugacug

SEQ ID NO: 603711 - RNA, 16 nt, Homo sapiens
auaauucuacuuugag

SEQ ID NO: 603712 - RNA, 16 nt, Homo sapiens
auaauucucucacaaa

SEQ ID NO: 603713 - RNA, 13 nt, Homo sapiens
auaauugaaacuu

SEQ ID NO: 603714 - RNA, 23 nt, Homo sapiens
auaauugcuuuuucacagucacu

SEQ ID NO: 603715 - RNA, 20 nt, Homo sapiens
auaauuguuucauucauccu

SEQ ID NO: 603716 - RNA, 16 nt, Homo sapiens
auaauuuaccuaagau

SEQ ID NO: 603717 - RNA, 20 nt, Homo sapiens
auaauuuagaccccauacaa

SEQ ID NO: 603718 - RNA, 14 nt, Homo sapiens
auaauuugcacuga

SEQ ID NO: 603719 - RNA, 15 nt, Homo sapiens
auaauuuucauucau

SEQ ID NO: 603720 - RNA, 12 nt, Homo sapiens
auaauuuugccu

SEQ ID NO: 603721 - RNA, 14 nt, Homo sapiens
auaauuuuguaaga

SEQ ID NO: 603722 - RNA, 18 nt, Homo sapiens
auaauuuuugugagguau

SEQ ID NO: 603723 - RNA, 17 nt, Homo sapiens
auacaaaaaaaauuuag

SEQ ID NO: 603724 - RNA, 17 nt, Homo sapiens
auacaaaccuaccaaaa

SEQ ID NO: 603725 - RNA, 20 nt, Homo sapiens
auacaaacuacagaguuuau

SEQ ID NO: 603726 - RNA, 12 nt, Homo sapiens
auacaaagugau

SEQ ID NO: 603727 - RNA, 13 nt, Homo sapiens
auacaaagugaug

SEQ ID NO: 603728 - RNA, 18 nt, Homo sapiens
auacaaaucaaagauuug

SEQ ID NO: 603729 - RNA, 24 nt, Homo sapiens
auacaaaucaaagauuugucacau

SEQ ID NO: 603730 - RNA, 14 nt, Homo sapiens
auacaaaucaucca

SEQ ID NO: 603731 - RNA, 23 nt, Homo sapiens
auacaaaucauccauccuugcca

SEQ ID NO: 603732 - RNA, 16 nt, Homo sapiens
auacaaauucuacuuu

SEQ ID NO: 603733 - RNA, 15 nt, Homo sapiens
auacaacacaaagag

SEQ ID NO: 603734 - RNA, 23 nt, Homo sapiens
auagugcugcaauaaacauaugu

SEQ ID NO: 603735 - RNA, 22 nt, Homo sapiens
auaguggaggguugagauguag

SEQ ID NO: 603736 - RNA, 15 nt, Homo sapiens
auaguggaucacuca

SEQ ID NO: 603737 - RNA, 21 nt, Homo sapiens
auagugggcaccccacugcaa

SEQ ID NO: 603738 - RNA, 22 nt, Homo sapiens
auaguggguacaucaaguccau

SEQ ID NO: 603739 - RNA, 19 nt, Homo sapiens
auagugguaugacauugga

SEQ ID NO: 603740 - RNA, 15 nt, Homo sapiens
auaguguauuuugca

SEQ ID NO: 603741 - RNA, 13 nt, Homo sapiens
auaguguccaggc

SEQ ID NO: 603742 - RNA, 18 nt, Homo sapiens
auagugugagaacuucca

SEQ ID NO: 603743 - RNA, 17 nt, Homo sapiens
auaguguucugcuccug

SEQ ID NO: 603744 - RNA, 19 nt, Homo sapiens
auaguuacugcugcacuuu

SEQ ID NO: 603745 - RNA, 13 nt, Homo sapiens
auaguuacugugu

SEQ ID NO: 603746 - RNA, 18 nt, Homo sapiens
auaguucaguagaauuac

SEQ ID NO: 603747 - RNA, 15 nt, Homo sapiens
auaguugcuugccug

SEQ ID NO: 603748 - RNA, 20 nt, Homo sapiens
auaguuuaaacugcauuaua

SEQ ID NO: 603749 - RNA, 18 nt, Homo sapiens
auaguuucaccacuccuc

SEQ ID NO: 603750 - RNA, 23 nt, Homo sapiens
auaguuuuucagucuauggguuu

SEQ ID NO: 603751 - RNA, 19 nt, Homo sapiens
auaguuuuucauuguacca

SEQ ID NO: 603752 - RNA, 20 nt, Homo sapiens
auauaaaaauaaugucauag

SEQ ID NO: 603753 - RNA, 13 nt, Homo sapiens
auauaaacuuuau

SEQ ID NO: 603754 - RNA, 19 nt, Homo sapiens
auauaaaguaguccuguga

SEQ ID NO: 603755 - RNA, 13 nt, Homo sapiens
auauaacuaucuc

SEQ ID NO: 603756 - RNA, 22 nt, Homo sapiens
auauaaggaaagugauccaaaa

SEQ ID NO: 603757 - RNA, 20 nt, Homo sapiens
auauaauaacuuuauugcau

SEQ ID NO: 603758 - RNA, 11 nt, Homo sapiens
auauaauacug

SEQ ID NO: 603759 - RNA, 13 nt, Homo sapiens
auauaauacugua

SEQ ID NO: 603760 - RNA, 14 nt, Homo sapiens
auauaauaugcaca

SEQ ID NO: 603761 - RNA, 16 nt, Homo sapiens
aucaaauguuacaguu

SEQ ID NO: 603762 - RNA, 18 nt, Homo sapiens
aucaaauuugccaccacu

SEQ ID NO: 603763 - RNA, 21 nt, Homo sapiens
aucaacacgagaauacaggag

SEQ ID NO: 603764 - RNA, 20 nt, Homo sapiens
aucaacagaagcauuuguau

SEQ ID NO: 603765 - RNA, 11 nt, Homo sapiens
aucaacaugac

SEQ ID NO: 603766 - RNA, 12 nt, Homo sapiens
aucaacaugacu

SEQ ID NO: 603767 - RNA, 14 nt, Homo sapiens
aucaacaugcuuua

SEQ ID NO: 603768 - RNA, 21 nt, Homo sapiens
aucaaccaacugcacaaucag

SEQ ID NO: 603769 - RNA, 18 nt, Homo sapiens
aucaaccccagacacugg

SEQ ID NO: 603770 - RNA, 16 nt, Homo sapiens
aucaacgaguacuuca

SEQ ID NO: 603771 - RNA, 16 nt, Homo sapiens
aucaacugaauugcaa

SEQ ID NO: 603772 - RNA, 19 nt, Homo sapiens
aucaacuuauuauaugacu

SEQ ID NO: 603773 - RNA, 18 nt, Homo sapiens
aucaagaaaaacaucuuu

SEQ ID NO: 603774 - RNA, 12 nt, Homo sapiens
aucaagacuauc

SEQ ID NO: 603775 - RNA, 19 nt, Homo sapiens
aucaagacuaucuacaaaa

SEQ ID NO: 603776 - RNA, 16 nt, Homo sapiens
aucaagagaaacuuca

SEQ ID NO: 603777 - RNA, 18 nt, Homo sapiens
aucaagauauauguguau

SEQ ID NO: 603778 - RNA, 12 nt, Homo sapiens
aucaagccaguu

SEQ ID NO: 603779 - RNA, 17 nt, Homo sapiens
aucaagccaugugcuuu

SEQ ID NO: 603780 - RNA, 17 nt, Homo sapiens
aucaagcccuuuacuug

SEQ ID NO: 603781 - RNA, 15 nt, Homo sapiens
aucaagcugugagac

SEQ ID NO: 603782 - RNA, 22 nt, Homo sapiens
aucaagcuuuuaaaaacuagag

SEQ ID NO: 603783 - RNA, 16 nt, Homo sapiens
aucaaggaaagccagg

SEQ ID NO: 603784 - RNA, 14 nt, Homo sapiens
aucaagggcuuuau

SEQ ID NO: 603785 - RNA, 13 nt, Homo sapiens
aucaagguucagc

SEQ ID NO: 603786 - RNA, 14 nt, Homo sapiens
aucaaguccuacaa

SEQ ID NO: 603787 - RNA, 19 nt, Homo sapiens
aucaagugacuucugccca

SEQ ID NO: 603788 - RNA, 13 nt, Homo sapiens
aucaagugcaguc

SEQ ID NO: 603789 - RNA, 21 nt, Homo sapiens
aucaagugugcuuuagcuuga

SEQ ID NO: 603790 - RNA, 18 nt, Homo sapiens
aucaaguguguguguguu

SEQ ID NO: 603791 - RNA, 19 nt, Homo sapiens
aucaauaaaggacaggcug

SEQ ID NO: 603792 - RNA, 20 nt, Homo sapiens
auguccccaaaguaccacac

SEQ ID NO: 603793 - RNA, 15 nt, Homo sapiens
auguccucagcauuu

SEQ ID NO: 603794 - RNA, 16 nt, Homo sapiens
auguccugacuuugcc

SEQ ID NO: 603795 - RNA, 13 nt, Homo sapiens
auguccuggacac

SEQ ID NO: 603796 - RNA, 17 nt, Homo sapiens
auguccuguggugacag

SEQ ID NO: 603797 - RNA, 22 nt, Homo sapiens
augucuaccuggcagauacuca

SEQ ID NO: 603798 - RNA, 14 nt, Homo sapiens
augucuauguagcu

SEQ ID NO: 603799 - RNA, 19 nt, Homo sapiens
augucuauguagcugaaaa

SEQ ID NO: 603800 - RNA, 13 nt, Homo sapiens
augucucauguca

SEQ ID NO: 603801 - RNA, 22 nt, Homo sapiens
augucuccacuuucacccgcag

SEQ ID NO: 603802 - RNA, 18 nt, Homo sapiens
augucucggucacaucag

SEQ ID NO: 603803 - RNA, 21 nt, Homo sapiens
augucucucagaauucuucag

SEQ ID NO: 603804 - RNA, 19 nt, Homo sapiens
augucucucuugagcuaca

SEQ ID NO: 603805 - RNA, 19 nt, Homo sapiens
augucucuggggcagaucc

SEQ ID NO: 603806 - RNA, 17 nt, Homo sapiens
augucucuuguagaaga

SEQ ID NO: 603807 - RNA, 18 nt, Homo sapiens
augucugccauguugccc

SEQ ID NO: 603808 - RNA, 16 nt, Homo sapiens
augucuguuaacuuaa

SEQ ID NO: 603809 - RNA, 23 nt, Homo sapiens
augucuguuucaaugaccuguau

SEQ ID NO: 603810 - RNA, 15 nt, Homo sapiens
augucuuaaugcaaa

SEQ ID NO: 603811 - RNA, 16 nt, Homo sapiens
augucuucacucuaua

SEQ ID NO: 603812 - RNA, 21 nt, Homo sapiens
augucuucacucuauacuuaa

SEQ ID NO: 603813 - RNA, 18 nt, Homo sapiens
augucuucauucccaagg

SEQ ID NO: 603814 - RNA, 21 nt, Homo sapiens
augucuuccuuggagggggga

SEQ ID NO: 603815 - RNA, 12 nt, Homo sapiens
augucuucuccc

SEQ ID NO: 603816 - RNA, 14 nt, Homo sapiens
augucuucucccac

SEQ ID NO: 603817 - RNA, 12 nt, Homo sapiens
augucuuuccac

SEQ ID NO: 603818 - RNA, 23 nt, Homo sapiens
augucuuuuuacuacaaacuaca

SEQ ID NO: 603819 - RNA, 17 nt, Homo sapiens
augugaaacacaugcca

SEQ ID NO: 603820 - RNA, 20 nt, Homo sapiens
augugaaacggaagcucaua

SEQ ID NO: 603821 - RNA, 21 nt, Homo sapiens
augugaagccaauucagacag

SEQ ID NO: 603822 - RNA, 11 nt, Homo sapiens
augugaagggu

SEQ ID NO: 603823 - RNA, 16 nt, Homo sapiens
augugaauacucuucc

SEQ ID NO: 603824 - RNA, 19 nt, Homo sapiens
augugaauacucuucccac

SEQ ID NO: 603825 - RNA, 16 nt, Homo sapiens
augugaccauucugcc

SEQ ID NO: 603826 - RNA, 23 nt, Homo sapiens
augugacuuaaagucagaauagu

SEQ ID NO: 603827 - RNA, 15 nt, Homo sapiens
augugagcaugucac

SEQ ID NO: 603828 - RNA, 13 nt, Homo sapiens
augugaggauuuu

SEQ ID NO: 603829 - RNA, 12 nt, Homo sapiens
augugagugugu

SEQ ID NO: 603830 - RNA, 13 nt, Homo sapiens
augugaugcccuc

SEQ ID NO: 603831 - RNA, 21 nt, Homo sapiens
augugauggacacuccaggga

SEQ ID NO: 603832 - RNA, 16 nt, Homo sapiens
augugauuagugucuc

SEQ ID NO: 603833 - RNA, 14 nt, Homo sapiens
augugcaacauucu

SEQ ID NO: 603834 - RNA, 16 nt, Homo sapiens
augugcaaccacugcu

SEQ ID NO: 603835 - RNA, 17 nt, Homo sapiens
augugcaaguguaugca

SEQ ID NO: 603836 - RNA, 15 nt, Homo sapiens
augugcaguacuuaa

SEQ ID NO: 603837 - RNA, 15 nt, Homo sapiens
augugcagucacugg

SEQ ID NO: 603838 - RNA, 13 nt, Homo sapiens
augugcauuucac

SEQ ID NO: 603839 - RNA, 13 nt, Homo sapiens
augugcccuccug

SEQ ID NO: 603840 - RNA, 19 nt, Homo sapiens
augugcggcugaacugaga

SEQ ID NO: 603841 - RNA, 18 nt, Homo sapiens
augugcuauacacacaca

SEQ ID NO: 603842 - RNA, 12 nt, Homo sapiens
augugcuauuaa

SEQ ID NO: 603843 - RNA, 13 nt, Homo sapiens
augugcucaugca

SEQ ID NO: 603844 - RNA, 12 nt, Homo sapiens
augugcucuuaa

SEQ ID NO: 603845 - RNA, 23 nt, Homo sapiens
augugcuggacacuguccaugaa

SEQ ID NO: 603846 - RNA, 18 nt, Homo sapiens
augugcugguauccacag

SEQ ID NO: 603847 - RNA, 13 nt, Homo sapiens
augugcuggucac

SEQ ID NO: 603848 - RNA, 13 nt, Homo sapiens
augugcugucacg

SEQ ID NO: 603849 - RNA, 13 nt, Homo sapiens
augugcuuuucuc

SEQ ID NO: 603850 - RNA, 19 nt, Homo sapiens
auguggacgugcacugaca

SEQ ID NO: 603851 - RNA, 21 nt, Homo sapiens
auguggacuaaauaucuguca

SEQ ID NO: 603852 - RNA, 12 nt, Homo sapiens
auguggauuugg

SEQ ID NO: 603853 - RNA, 18 nt, Homo sapiens
auguggcaaagugcugua

SEQ ID NO: 603854 - RNA, 22 nt, Homo sapiens
auguggccuaaaaaugcaacuu

SEQ ID NO: 603855 - RNA, 15 nt, Homo sapiens
auguggccuccaugu

SEQ ID NO: 603856 - RNA, 16 nt, Homo sapiens
auguggccuccaugug

SEQ ID NO: 603857 - RNA, 17 nt, Homo sapiens
auguggcucagugccuu

SEQ ID NO: 603858 - RNA, 15 nt, Homo sapiens
augugggaacagcuc

SEQ ID NO: 603859 - RNA, 21 nt, Homo sapiens
augugggguccccaucauccc

SEQ ID NO: 603860 - RNA, 21 nt, Homo sapiens
auguggguagucauucuuaca

SEQ ID NO: 603861 - RNA, 17 nt, Homo sapiens
augugggugucagucag

SEQ ID NO: 603862 - RNA, 15 nt, Homo sapiens
auguggguuuuacac

SEQ ID NO: 603863 - RNA, 14 nt, Homo sapiens
augugguagccuca

SEQ ID NO: 603864 - RNA, 13 nt, Homo sapiens
auguggucucagg

SEQ ID NO: 603865 - RNA, 22 nt, Homo sapiens
auguguaagaacaacuaccuga

SEQ ID NO: 603866 - RNA, 14 nt, Homo sapiens
auguguaaggugaa

SEQ ID NO: 603867 - RNA, 13 nt, Homo sapiens
auguguaccucag

SEQ ID NO: 603868 - RNA, 22 nt, Homo sapiens
auguguacuucaccucuuggcu

SEQ ID NO: 603869 - RNA, 20 nt, Homo sapiens
auguguagccuucuccccaa

SEQ ID NO: 603870 - RNA, 15 nt, Homo sapiens
augugucacuugugc

SEQ ID NO: 603871 - RNA, 19 nt, Homo sapiens
augugucauuggaagccau

SEQ ID NO: 603872 - RNA, 18 nt, Homo sapiens
auguguccccucacucug

SEQ ID NO: 603873 - RNA, 21 nt, Homo sapiens
auguguccccucacucuguca

SEQ ID NO: 603874 - RNA, 20 nt, Homo sapiens
augugugagaauaaacuaga

SEQ ID NO: 603875 - RNA, 18 nt, Homo sapiens
auuaagaaagacuaucua

SEQ ID NO: 603876 - RNA, 16 nt, Homo sapiens
auuaagaaauacucau

SEQ ID NO: 603877 - RNA, 13 nt, Homo sapiens
auuaagaaugcca

SEQ ID NO: 603878 - RNA, 18 nt, Homo sapiens
auuaagacuuacuugcau

SEQ ID NO: 603879 - RNA, 21 nt, Homo sapiens
auuaagcagaaauccugcaau

SEQ ID NO: 603880 - RNA, 19 nt, Homo sapiens
auuaagcccaauuaauucc

SEQ ID NO: 603881 - RNA, 23 nt, Homo sapiens
auuaagguauuucgaaacugcca

SEQ ID NO: 603882 - RNA, 16 nt, Homo sapiens
auuaagguguggcuuu

SEQ ID NO: 603883 - RNA, 21 nt, Homo sapiens
auuaaguaaucuuuuuacagu

SEQ ID NO: 603884 - RNA, 16 nt, Homo sapiens
auuaauaaagcauucu

SEQ ID NO: 603885 - RNA, 19 nt, Homo sapiens
auuaauacucugcagugau

SEQ ID NO: 603886 - RNA, 21 nt, Homo sapiens
auuaauaguuauuauuuacug

SEQ ID NO: 603887 - RNA, 17 nt, Homo sapiens
auuaauaguuugucuau

SEQ ID NO: 603888 - RNA, 24 nt, Homo sapiens
auuaauauauaguccagacacuua

SEQ ID NO: 603889 - RNA, 18 nt, Homo sapiens
auuaauaucaacucugaa

SEQ ID NO: 603890 - RNA, 17 nt, Homo sapiens
auuaaucauacaaacuc

SEQ ID NO: 603891 - RNA, 17 nt, Homo sapiens
auuaaucaucuauaaag

SEQ ID NO: 603892 - RNA, 18 nt, Homo sapiens
auuaaucuggaauaugca

SEQ ID NO: 603893 - RNA, 19 nt, Homo sapiens
auuaaucuggaauaugcaa

SEQ ID NO: 603894 - RNA, 19 nt, Homo sapiens
auuaaucuuaguguaugau

SEQ ID NO: 603895 - RNA, 17 nt, Homo sapiens
auuaaugacguauacau

SEQ ID NO: 603896 - RNA, 19 nt, Homo sapiens
auuaaugauaaacucagau

SEQ ID NO: 603897 - RNA, 22 nt, Homo sapiens
auuaaugccuuuaaaguaugaa

SEQ ID NO: 603898 - RNA, 11 nt, Homo sapiens
auuaauggaaa

SEQ ID NO: 603899 - RNA, 21 nt, Homo sapiens
auuaauuacuucacuauacaa

SEQ ID NO: 603900 - RNA, 18 nt, Homo sapiens
auuaauucauccaauacc

SEQ ID NO: 603901 - RNA, 21 nt, Homo sapiens
auuaauuugugaauuugcaac

SEQ ID NO: 603902 - RNA, 22 nt, Homo sapiens
auuaauuugugaauuugcaaca

SEQ ID NO: 603903 - RNA, 18 nt, Homo sapiens
auuaauuuuuaaggaugu

SEQ ID NO: 603904 - RNA, 22 nt, Homo sapiens
auuaauuuuuaaggauguugcc

SEQ ID NO: 603905 - RNA, 15 nt, Homo sapiens
auuacaaaacucaga

SEQ ID NO: 603906 - RNA, 19 nt, Homo sapiens
auuacaaggcuuuaucuca

SEQ ID NO: 603907 - RNA, 20 nt, Homo sapiens
auuacaauguguaauggaaa

SEQ ID NO: 603908 - RNA, 17 nt, Homo sapiens
auuacaauugcaguuuu

SEQ ID NO: 603909 - RNA, 13 nt, Homo sapiens
auuacacucugua

SEQ ID NO: 603910 - RNA, 13 nt, Homo sapiens
auuacagccuuau

SEQ ID NO: 603911 - RNA, 17 nt, Homo sapiens
auuacaggcgugagcca

SEQ ID NO: 603912 - RNA, 18 nt, Homo sapiens
auuacaggcgugagccac

SEQ ID NO: 603913 - RNA, 21 nt, Homo sapiens
auuacaggcgugauccaccac

SEQ ID NO: 603914 - RNA, 14 nt, Homo sapiens
auuacagugcaguu

SEQ ID NO: 603915 - RNA, 18 nt, Homo sapiens
auuacauaaucuguacaa

SEQ ID NO: 603916 - RNA, 14 nt, Homo sapiens
auuacaucuuucac

SEQ ID NO: 603917 - RNA, 16 nt, Homo sapiens
auuacauggcaguguu

SEQ ID NO: 603918 - RNA, 13 nt, Homo sapiens
augaugcacuuau

SEQ ID NO: 603919 - RNA, 15 nt, Homo sapiens
augaugcauacaguu

SEQ ID NO: 603920 - RNA, 18 nt, Homo sapiens
augaugcccuccccucag

SEQ ID NO: 603921 - RNA, 22 nt, Homo sapiens
augaugccgaacauuaggaauu

SEQ ID NO: 603922 - RNA, 21 nt, Homo sapiens
augaugcuaugguuugccauu

SEQ ID NO: 603923 - RNA, 15 nt, Homo sapiens
augaugcugucugaa

SEQ ID NO: 603924 - RNA, 14 nt, Homo sapiens
augauggaugccaa

SEQ ID NO: 603925 - RNA, 20 nt, Homo sapiens
augauggccuuacacugaaa

SEQ ID NO: 603926 - RNA, 14 nt, Homo sapiens
augaugugggcuca

SEQ ID NO: 603927 - RNA, 13 nt, Homo sapiens
augaugugucuuc

SEQ ID NO: 603928 - RNA, 22 nt, Homo sapiens
augaugugugaguguaauucca

SEQ ID NO: 603929 - RNA, 21 nt, Homo sapiens
augauuggauuauucauuuaa

SEQ ID NO: 603930 - RNA, 13 nt, Homo sapiens
augauuguucaaa

SEQ ID NO: 603931 - RNA, 20 nt, Homo sapiens
augauuguucaaagcacaga

SEQ ID NO: 603932 - RNA, 14 nt, Homo sapiens
augauuuacauaaa

SEQ ID NO: 603933 - RNA, 18 nt, Homo sapiens
augauuuagggaagcagg

SEQ ID NO: 603934 - RNA, 19 nt, Homo sapiens
augauuucaugcuaucucu

SEQ ID NO: 603935 - RNA, 18 nt, Homo sapiens
augauuuuccucccuggu

SEQ ID NO: 603936 - RNA, 20 nt, Homo sapiens
augauuuuuaaaaguugcua

SEQ ID NO: 603937 - RNA, 17 nt, Homo sapiens
augauuuuuuaugauca

SEQ ID NO: 603938 - RNA, 16 nt, Homo sapiens
augcaaaagucuuccu

SEQ ID NO: 603939 - RNA, 21 nt, Homo sapiens
augcaaaaguucugacuugac

SEQ ID NO: 603940 - RNA, 16 nt, Homo sapiens
augcaaacugcuuuau

SEQ ID NO: 603941 - RNA, 15 nt, Homo sapiens
augcaaagaugaacc

SEQ ID NO: 603942 - RNA, 17 nt, Homo sapiens
augcaaagcacucucug

SEQ ID NO: 603943 - RNA, 15 nt, Homo sapiens
augcaaaguaaaaaa

SEQ ID NO: 603944 - RNA, 22 nt, Homo sapiens
augcaaaguaaaaaaauaugaa

SEQ ID NO: 603945 - RNA, 17 nt, Homo sapiens
augcaaaguacauguau

SEQ ID NO: 603946 - RNA, 16 nt, Homo sapiens
augcaaaguagcaauu

SEQ ID NO: 603947 - RNA, 15 nt, Homo sapiens
augcaaaucaauuac

SEQ ID NO: 603948 - RNA, 14 nt, Homo sapiens
augcaaaugcucaa

SEQ ID NO: 603949 - RNA, 15 nt, Homo sapiens
augcaaaugcucaaa

SEQ ID NO: 603950 - RNA, 16 nt, Homo sapiens
augcaaaugucuucca

SEQ ID NO: 603951 - RNA, 15 nt, Homo sapiens
augcaaauuucauga

SEQ ID NO: 603952 - RNA, 16 nt, Homo sapiens
augcaacagaagugac

SEQ ID NO: 603953 - RNA, 16 nt, Homo sapiens
auuacauggcuguggu

SEQ ID NO: 603954 - RNA, 18 nt, Homo sapiens
auuacauggggucuagaa

SEQ ID NO: 603955 - RNA, 21 nt, Homo sapiens
auuaccaaaauauauauuaau

SEQ ID NO: 603956 - RNA, 17 nt, Homo sapiens
auuaccauauaauguaa

SEQ ID NO: 603957 - RNA, 21 nt, Homo sapiens
auuacccccucauuguuuauu

SEQ ID NO: 603958 - RNA, 19 nt, Homo sapiens
auuacccccuccuucagac

SEQ ID NO: 603959 - RNA, 16 nt, Homo sapiens
auuaccuccugagaaa

SEQ ID NO: 603960 - RNA, 19 nt, Homo sapiens
auuacgugcaauacuucaa

SEQ ID NO: 603961 - RNA, 15 nt, Homo sapiens
auuacuaucauggca

SEQ ID NO: 603962 - RNA, 18 nt, Homo sapiens
auuacugaaaaugauucc

SEQ ID NO: 603963 - RNA, 18 nt, Homo sapiens
auuacuguuccagauucc

SEQ ID NO: 603964 - RNA, 19 nt, Homo sapiens
auuacuguugcauuuacuu

SEQ ID NO: 603965 - RNA, 15 nt, Homo sapiens
auuacuuguguuacu

SEQ ID NO: 603966 - RNA, 20 nt, Homo sapiens
auuacuuuuucauucuuuua

SEQ ID NO: 603967 - RNA, 19 nt, Homo sapiens
auuagaaaaaaauuacuaa

SEQ ID NO: 603968 - RNA, 13 nt, Homo sapiens
auuagaaugcaug

SEQ ID NO: 603969 - RNA, 17 nt, Homo sapiens
auuagaaugcauguaag

SEQ ID NO: 603970 - RNA, 21 nt, Homo sapiens
auuagagagcaucugcaacaa

SEQ ID NO: 603971 - RNA, 13 nt, Homo sapiens
auuagaugaacuc

SEQ ID NO: 603972 - RNA, 15 nt, Homo sapiens
auuagaugcacuuaa

SEQ ID NO: 603973 - RNA, 22 nt, Homo sapiens
auuagauguuucaacugugcuc

SEQ ID NO: 603974 - RNA, 22 nt, Homo sapiens
auuagauuuggaggcuaccuca

SEQ ID NO: 603975 - RNA, 22 nt, Homo sapiens
auuagcaaguuacagugaugcu

SEQ ID NO: 603976 - RNA, 16 nt, Homo sapiens
auuagcaauacuggaa

SEQ ID NO: 603977 - RNA, 19 nt, Homo sapiens
auuagcaauugacugucac

SEQ ID NO: 603978 - RNA, 18 nt, Homo sapiens
auuagcauuuugcuaaau

SEQ ID NO: 603979 - RNA, 18 nt, Homo sapiens
auuagccgggcauggugg

SEQ ID NO: 603980 - RNA, 20 nt, Homo sapiens
auuagccuugaacaaccaga

SEQ ID NO: 603981 - RNA, 15 nt, Homo sapiens
auuagcucuggacca

SEQ ID NO: 603982 - RNA, 15 nt, Homo sapiens
auuagcuuuuucuca

SEQ ID NO: 603983 - RNA, 16 nt, Homo sapiens
auuaggaaauucugau

SEQ ID NO: 603984 - RNA, 17 nt, Homo sapiens
auuaggaauuguuuaua

SEQ ID NO: 603985 - RNA, 17 nt, Homo sapiens
auuaggcaaaguacaaa

SEQ ID NO: 603986 - RNA, 23 nt, Homo sapiens
auuaggcuuuuaagaaacacagg

SEQ ID NO: 603987 - RNA, 13 nt, Homo sapiens
auuagggacacuu

SEQ ID NO: 603988 - RNA, 17 nt, Homo sapiens
auuagggacacuuucac

SEQ ID NO: 603989 - RNA, 23 nt, Homo sapiens
auuagggcaaggugugguagcuc

SEQ ID NO: 603990 - RNA, 18 nt, Homo sapiens
auuaggucccucacucca

SEQ ID NO: 603991 - RNA, 20 nt, Homo sapiens
auuagucucagugaagacua

SEQ ID NO: 603992 - RNA, 21 nt, Homo sapiens
auuagugccguuaucauggag

SEQ ID NO: 603993 - RNA, 23 nt, Homo sapiens
auuagugguuuaucagcaaaaaa

SEQ ID NO: 603994 - RNA, 23 nt, Homo sapiens
auuaguuaaugagccaucacuag

SEQ ID NO: 603995 - RNA, 16 nt, Homo sapiens
auuaguuuaccucauc

SEQ ID NO: 603996 - RNA, 19 nt, Homo sapiens
auuauaaagccuucagagg

SEQ ID NO: 603997 - RNA, 19 nt, Homo sapiens
auuauaaaugacaaccuga

SEQ ID NO: 603998 - RNA, 12 nt, Homo sapiens
auuauaacuuaa

SEQ ID NO: 603999 - RNA, 18 nt, Homo sapiens
auuauaaugauuacuaau

SEQ ID NO: 604000 - RNA, 18 nt, Homo sapiens
auuauaauuaguuccuca

SEQ ID NO: 604001 - RNA, 12 nt, Homo sapiens
auuauacagaua

SEQ ID NO: 604002 - RNA, 23 nt, Homo sapiens
auuauacccccugcaaagcccag

SEQ ID NO: 604003 - RNA, 23 nt, Homo sapiens
auuauacgcuggcaacacagagg

SEQ ID NO: 604004 - RNA, 18 nt, Homo sapiens
auuauaggccaaacuggc

SEQ ID NO: 604005 - RNA, 15 nt, Homo sapiens
auuauauaacuguau

SEQ ID NO: 604006 - RNA, 15 nt, Homo sapiens
auuauauagcacaua

SEQ ID NO: 604007 - RNA, 15 nt, Homo sapiens
auuauaucugugaau

SEQ ID NO: 604008 - RNA, 23 nt, Homo sapiens
auuauaugaaguuuaaauucuag

SEQ ID NO: 604009 - RNA, 18 nt, Homo sapiens
auuauauucacagacuga

SEQ ID NO: 604010 - RNA, 13 nt, Homo sapiens
auuauauuugaca

SEQ ID NO: 604011 - RNA, 14 nt, Homo sapiens
auuauauuugacau

SEQ ID NO: 604012 - RNA, 13 nt, Homo sapiens
auuaucaaaaagc

SEQ ID NO: 604013 - RNA, 19 nt, Homo sapiens
auuaucaaugggauaugau

SEQ ID NO: 604014 - RNA, 20 nt, Homo sapiens
auuaucacagugaaugcacu

SEQ ID NO: 604015 - RNA, 23 nt, Homo sapiens
auuaucaggaaauguuuucuuaa

SEQ ID NO: 604016 - RNA, 21 nt, Homo sapiens
auuaucauaugaacuugucag

SEQ ID NO: 604017 - RNA, 13 nt, Homo sapiens
auuaucaugcaaa

SEQ ID NO: 604018 - RNA, 18 nt, Homo sapiens
auuaucgggaacaguguu

SEQ ID NO: 604019 - RNA, 21 nt, Homo sapiens
auuaucgggagcagugucuuc

SEQ ID NO: 604020 - RNA, 17 nt, Homo sapiens
auuaucucuuugaucua

SEQ ID NO: 604021 - RNA, 22 nt, Homo sapiens
auuaugaagugacucucacaag

SEQ ID NO: 604022 - RNA, 11 nt, Homo sapiens
auuauggcauu

SEQ ID NO: 604023 - RNA, 19 nt, Homo sapiens
auuauguaauauauuguac

SEQ ID NO: 604024 - RNA, 18 nt, Homo sapiens
auuauguccacuguguau

SEQ ID NO: 604025 - RNA, 13 nt, Homo sapiens
auuauguccugug

SEQ ID NO: 604026 - RNA, 16 nt, Homo sapiens
auuaugugacuuaaag

SEQ ID NO: 604027 - RNA, 18 nt, Homo sapiens
auuauguuugccacuuug

SEQ ID NO: 604028 - RNA, 19 nt, Homo sapiens
auuauguuuucaacacuuu

SEQ ID NO: 604029 - RNA, 21 nt, Homo sapiens
auuuuacuuuguugaguauua

SEQ ID NO: 604030 - RNA, 21 nt, Homo sapiens
auuuuacuuuuuccuggcuca

SEQ ID NO: 604031 - RNA, 14 nt, Homo sapiens
auuuuagacuuacc

SEQ ID NO: 604032 - RNA, 21 nt, Homo sapiens
auuuuagccguacuuugcuaa

SEQ ID NO: 604033 - RNA, 17 nt, Homo sapiens
auuuuagggcuguagac

SEQ ID NO: 604034 - RNA, 23 nt, Homo sapiens
auuuuagggcuguagacuuacuu

SEQ ID NO: 604035 - RNA, 22 nt, Homo sapiens
auuuuagucagauuuugcccaa

SEQ ID NO: 604036 - RNA, 14 nt, Homo sapiens
auuuuauacugaca

SEQ ID NO: 604037 - RNA, 14 nt, Homo sapiens
auuuuauacuugcc

SEQ ID NO: 604038 - RNA, 21 nt, Homo sapiens
auuuuauaggcauaccuccua

SEQ ID NO: 604039 - RNA, 23 nt, Homo sapiens
auuuuauaguguguugugcuuuc

SEQ ID NO: 604040 - RNA, 15 nt, Homo sapiens
auuuuauaugaagau

SEQ ID NO: 604041 - RNA, 15 nt, Homo sapiens
auuuuaucugugaau

SEQ ID NO: 604042 - RNA, 15 nt, Homo sapiens
auuuuaucuguggag

SEQ ID NO: 604043 - RNA, 21 nt, Homo sapiens
auuuuaugcugcuguuuacaa

SEQ ID NO: 604044 - RNA, 15 nt, Homo sapiens
auuuuauuaugcaug

SEQ ID NO: 604045 - RNA, 18 nt, Homo sapiens
auuuuauugcuagccauc

SEQ ID NO: 604046 - RNA, 21 nt, Homo sapiens
auuuuauuuugcugaguuguu

SEQ ID NO: 604047 - RNA, 23 nt, Homo sapiens
auuuuauuuuuguaucuuaaaaa

SEQ ID NO: 604048 - RNA, 16 nt, Homo sapiens
auuuucaaagacuuaa

SEQ ID NO: 604049 - RNA, 22 nt, Homo sapiens
auuuucaagagucuaauagucu

SEQ ID NO: 604050 - RNA, 22 nt, Homo sapiens
auuuucaaggccuucaguuuau

SEQ ID NO: 604051 - RNA, 18 nt, Homo sapiens
auuuucaagucuguguuc

SEQ ID NO: 604052 - RNA, 23 nt, Homo sapiens
auuuucaaugauguuagccugau

SEQ ID NO: 604053 - RNA, 21 nt, Homo sapiens
auuuucaauuuggagcauuaa

SEQ ID NO: 604054 - RNA, 13 nt, Homo sapiens
auuuucacacaua

SEQ ID NO: 604055 - RNA, 22 nt, Homo sapiens
auuuucacugcugcuccucuuu

SEQ ID NO: 604056 - RNA, 18 nt, Homo sapiens
auuuucaguaacccagcu

SEQ ID NO: 604057 - RNA, 12 nt, Homo sapiens
auuuucaguaua

SEQ ID NO: 604058 - RNA, 20 nt, Homo sapiens
auuuucagucaaaacuuuaa

SEQ ID NO: 604059 - RNA, 15 nt, Homo sapiens
auuuucauucauuca

SEQ ID NO: 604060 - RNA, 18 nt, Homo sapiens
auuuucauuuguacaagg

SEQ ID NO: 604061 - RNA, 23 nt, Homo sapiens
auuuuccauaaagguaacaaagg

SEQ ID NO: 604062 - RNA, 22 nt, Homo sapiens
auuuucccccacuacugcagca

SEQ ID NO: 604063 - RNA, 16 nt, Homo sapiens
auuuuccuccaggcaa

SEQ ID NO: 604064 - RNA, 14 nt, Homo sapiens
auuuuccucuuguc

SEQ ID NO: 604065 - RNA, 21 nt, Homo sapiens
auuuuccuggugccaauuuca

SEQ ID NO: 604066 - RNA, 21 nt, Homo sapiens
auuuuccuguugucaagaaua

SEQ ID NO: 604067 - RNA, 17 nt, Homo sapiens
auuuucgcugucgugac

SEQ ID NO: 604068 - RNA, 14 nt, Homo sapiens
auuuucuacuguaa

SEQ ID NO: 604069 - RNA, 21 nt, Homo sapiens
auuuucuagauuuucuacuuu

SEQ ID NO: 604070 - RNA, 17 nt, Homo sapiens
auuuucuccccuuggca

SEQ ID NO: 604071 - RNA, 20 nt, Homo sapiens
auuuucuccuugguuugcua

SEQ ID NO: 604072 - RNA, 13 nt, Homo sapiens
auuuucucuccau

SEQ ID NO: 604073 - RNA, 14 nt, Homo sapiens
auuuucugcauuau

SEQ ID NO: 604074 - RNA, 19 nt, Homo sapiens
auuuucuggaauacaugaa

SEQ ID NO: 604075 - RNA, 16 nt, Homo sapiens
auuuucuucucugcac

SEQ ID NO: 604076 - RNA, 20 nt, Homo sapiens
auuuucuucucugcacuuau

SEQ ID NO: 604077 - RNA, 22 nt, Homo sapiens
auuuucuuuuauuaucaguuaa

SEQ ID NO: 604078 - RNA, 21 nt, Homo sapiens
auuuugaaauauaguaaacac

SEQ ID NO: 604079 - RNA, 15 nt, Homo sapiens
auuuugaagucagag

SEQ ID NO: 604080 - RNA, 16 nt, Homo sapiens
auuuugaguauuccau

SEQ ID NO: 604081 - RNA, 12 nt, Homo sapiens
auuuugauucag

SEQ ID NO: 604082 - RNA, 20 nt, Homo sapiens
auuuugccauaaagucaaau

SEQ ID NO: 604083 - RNA, 17 nt, Homo sapiens
auuuugggaaguugcau

SEQ ID NO: 604084 - RNA, 17 nt, Homo sapiens
auuuugggccuguuccu

SEQ ID NO: 604085 - RNA, 17 nt, Homo sapiens
auuuugguuagggauau

SEQ ID NO: 604086 - RNA, 16 nt, Homo sapiens
auuuuguaaaaguggc

SEQ ID NO: 604087 - RNA, 16 nt, Homo sapiens
auuuuguaaaauguau

SEQ ID NO: 604088 - RNA, 19 nt, Homo sapiens
auuuuguaacgaagacaca

SEQ ID NO: 604089 - RNA, 20 nt, Homo sapiens
auuuuguaauguaucaaaua

SEQ ID NO: 604090 - RNA, 17 nt, Homo sapiens
auuuuguagaugugauu

SEQ ID NO: 604091 - RNA, 14 nt, Homo sapiens
auuuuguaugaaaa

SEQ ID NO: 604092 - RNA, 18 nt, Homo sapiens
auuuugugaauacuaugu

SEQ ID NO: 604093 - RNA, 23 nt, Homo sapiens
auuuugugaauugugacauaaua

SEQ ID NO: 604094 - RNA, 16 nt, Homo sapiens
auuuuguuaaaaucua

SEQ ID NO: 604095 - RNA, 12 nt, Homo sapiens
auuuuguuacaa

SEQ ID NO: 604096 - RNA, 23 nt, Homo sapiens
auuuuguucuuuuuucuuaccac

SEQ ID NO: 604097 - RNA, 12 nt, Homo sapiens
auuuuguugcau

SEQ ID NO: 604098 - RNA, 18 nt, Homo sapiens
auuuuguuuucuguggag

SEQ ID NO: 604099 - RNA, 19 nt, Homo sapiens
auuuuguuuuugucuuaaa

SEQ ID NO: 604100 - RNA, 16 nt, Homo sapiens
auuuuuaacaccaugg

SEQ ID NO: 604101 - RNA, 16 nt, Homo sapiens
auuuuuaacacuuaaa

SEQ ID NO: 604102 - RNA, 14 nt, Homo sapiens
auuuuuaaucagca

SEQ ID NO: 604103 - RNA, 21 nt, Homo sapiens
auuuuuaauuuaaaaaagcaa

SEQ ID NO: 604104 - RNA, 14 nt, Homo sapiens
auuuuuacacaacu

SEQ ID NO: 604105 - RNA, 16 nt, Homo sapiens
auuuuuaccuguuuaa

SEQ ID NO: 604106 - RNA, 12 nt, Homo sapiens
auuuuuacuuca

SEQ ID NO: 604107 - RNA, 22 nt, Homo sapiens
auuuuuauaaaaaugagugcuu

SEQ ID NO: 604108 - RNA, 21 nt, Homo sapiens
auuuuuauacaaaccuaccaa

SEQ ID NO: 604109 - RNA, 17 nt, Homo sapiens
auuuuuauagacaaaua

SEQ ID NO: 604110 - RNA, 14 nt, Homo sapiens
auuuuuauccauuu

SEQ ID NO: 604111 - RNA, 13 nt, Homo sapiens
auuuuuaugcaga

SEQ ID NO: 604112 - RNA, 15 nt, Homo sapiens
auuuuuccaacuacu

SEQ ID NO: 604113 - RNA, 14 nt, Homo sapiens
auuuuuccacuuaa

SEQ ID NO: 604114 - RNA, 15 nt, Homo sapiens
auuuuuccacuuaaa

SEQ ID NO: 604115 - RNA, 15 nt, Homo sapiens
auuuuugacauuaau

SEQ ID NO: 604116 - RNA, 15 nt, Homo sapiens
auuuuugcaacuauu

SEQ ID NO: 604117 - RNA, 21 nt, Homo sapiens
auuuuuggacuggcagacuca

SEQ ID NO: 604118 - RNA, 19 nt, Homo sapiens
auuuuuggugggaauccaa

SEQ ID NO: 604119 - RNA, 17 nt, Homo sapiens
auuuuugugagccucuu

SEQ ID NO: 604120 - RNA, 13 nt, Homo sapiens
auuuuugugcaca

SEQ ID NO: 604121 - RNA, 19 nt, Homo sapiens
auuuuuguggaagcacuug

SEQ ID NO: 604122 - RNA, 15 nt, Homo sapiens
auuuuuguguaggug

SEQ ID NO: 604123 - RNA, 17 nt, Homo sapiens
auuuuuguuagcaaaga

SEQ ID NO: 604124 - RNA, 23 nt, Homo sapiens
auuuuuguuuuuguaaugcacug

SEQ ID NO: 604125 - RNA, 16 nt, Homo sapiens
auuuuuuaaaacugaa

SEQ ID NO: 604126 - RNA, 20 nt, Homo sapiens
auuuuuuaauccuaccucaa

SEQ ID NO: 604127 - RNA, 21 nt, Homo sapiens
auuuuuuagaugaccaaaacu

SEQ ID NO: 604128 - RNA, 19 nt, Homo sapiens
auuuuuucgugcacucugc

SEQ ID NO: 604129 - RNA, 16 nt, Homo sapiens
auuuuuugaaaguuaa

SEQ ID NO: 604130 - RNA, 18 nt, Homo sapiens
auuuuuugguagcuugua

SEQ ID NO: 604131 - RNA, 14 nt, Homo sapiens
auuuuuugucuguu

SEQ ID NO: 604132 - RNA, 16 nt, Homo sapiens
auuuuuuuaaauuuca

SEQ ID NO: 604133 - RNA, 17 nt, Homo sapiens
auuuuuuuaagcuauca

SEQ ID NO: 604134 - RNA, 16 nt, Homo sapiens
auuuuuuuaauagugc

SEQ ID NO: 604135 - RNA, 18 nt, Homo sapiens
auuuuuuugugaucuguu

SEQ ID NO: 604136 - RNA, 22 nt, Homo sapiens
auuuuuuuuaaagaagagugac

SEQ ID NO: 604137 - RNA, 19 nt, Homo sapiens
auuuuuuuucagcagacua

SEQ ID NO: 604138 - RNA, 18 nt, Homo sapiens
auuuuuuuuccuugccug

SEQ ID NO: 604139 - RNA, 19 nt, Homo sapiens
auuuuuuuugagaccgagu

SEQ ID NO: 604140 - RNA, 14 nt, Homo sapiens
caaaaaaccacaaa

SEQ ID NO: 604141 - RNA, 13 nt, Homo sapiens
caaaaaaccucac

SEQ ID NO: 604142 - RNA, 13 nt, Homo sapiens
caaaaaacuacuu

SEQ ID NO: 604143 - RNA, 22 nt, Homo sapiens
caaaaaauaagcugauuaauaa

SEQ ID NO: 604144 - RNA, 14 nt, Homo sapiens
caaaaaauugcaca

SEQ ID NO: 604145 - RNA, 14 nt, Homo sapiens
caaaaacaauguaa

SEQ ID NO: 604146 - RNA, 20 nt, Homo sapiens
caaaaacaauugcaacagaa

SEQ ID NO: 604147 - RNA, 14 nt, Homo sapiens
caaaaacagaauuu

SEQ ID NO: 604148 - RNA, 13 nt, Homo sapiens
caaaaacauuuca

SEQ ID NO: 604149 - RNA, 14 nt, Homo sapiens
caaaaacuacacau

SEQ ID NO: 604150 - RNA, 12 nt, Homo sapiens
caaaaacuuugg

SEQ ID NO: 604151 - RNA, 13 nt, Homo sapiens
caaaaagacauua

SEQ ID NO: 604152 - RNA, 20 nt, Homo sapiens
caaaaucaugccauugcacu

SEQ ID NO: 604153 - RNA, 21 nt, Homo sapiens
caaaaucauuuuauaugucaa

SEQ ID NO: 604154 - RNA, 22 nt, Homo sapiens
caaaaucugauuagaaguauaa

SEQ ID NO: 604155 - RNA, 21 nt, Homo sapiens
caaaaucuuguuaaugucauu

SEQ ID NO: 604156 - RNA, 20 nt, Homo sapiens
caaaaugaacacaucuugag

SEQ ID NO: 604157 - RNA, 20 nt, Homo sapiens
caaaaugacuguagaacuua

SEQ ID NO: 604158 - RNA, 15 nt, Homo sapiens
caaaaugacuuugaa

SEQ ID NO: 604159 - RNA, 17 nt, Homo sapiens
caaaaugagacuuucua

SEQ ID NO: 604160 - RNA, 18 nt, Homo sapiens
caaaaugauacuuacuga

SEQ ID NO: 604161 - RNA, 19 nt, Homo sapiens
caaaaugauacuuacugaa

SEQ ID NO: 604162 - RNA, 23 nt, Homo sapiens
caaaaugccaagggggugacugg

SEQ ID NO: 604163 - RNA, 11 nt, Homo sapiens
caaaaugcuca

SEQ ID NO: 604164 - RNA, 23 nt, Homo sapiens
caaaaugggagaaaacgccagug

SEQ ID NO: 604165 - RNA, 21 nt, Homo sapiens
caaaauggucaguauuaucua

SEQ ID NO: 604166 - RNA, 18 nt, Homo sapiens
caaaauguagaauauuca

SEQ ID NO: 604167 - RNA, 16 nt, Homo sapiens
caaaaugucuguuuua

SEQ ID NO: 604168 - RNA, 19 nt, Homo sapiens
caaaauugcaaaucuugaa

SEQ ID NO: 604169 - RNA, 20 nt, Homo sapiens
caaaauuggaagcugucaua

SEQ ID NO: 604170 - RNA, 15 nt, Homo sapiens
caaaauuguuuacca

SEQ ID NO: 604171 - RNA, 19 nt, Homo sapiens
caaaauuguuuaccauaga

SEQ ID NO: 604172 - RNA, 21 nt, Homo sapiens
caaaauuguuuucacuuguau

SEQ ID NO: 604173 - RNA, 16 nt, Homo sapiens
caaaauuuuacaguaa

SEQ ID NO: 604174 - RNA, 20 nt, Homo sapiens
caaaauuuuguaaauaugca

SEQ ID NO: 604175 - RNA, 20 nt, Homo sapiens
caaacaaaaaacugccuuug

SEQ ID NO: 604176 - RNA, 11 nt, Homo sapiens
caaacaaaagc

SEQ ID NO: 604177 - RNA, 14 nt, Homo sapiens
caaacaaccugccc

SEQ ID NO: 604178 - RNA, 19 nt, Homo sapiens
caaacaagaaacauuucag

SEQ ID NO: 604179 - RNA, 17 nt, Homo sapiens
caaacaauaugcuccug

SEQ ID NO: 604180 - RNA, 12 nt, Homo sapiens
caaacaaugaaa

SEQ ID NO: 604181 - RNA, 12 nt, Homo sapiens
caaacacaaaac

SEQ ID NO: 604182 - RNA, 15 nt, Homo sapiens
caaacacagcucucu

SEQ ID NO: 604183 - RNA, 23 nt, Homo sapiens
caaacaccacuuuacuuguguua

SEQ ID NO: 604184 - RNA, 14 nt, Homo sapiens
caaacaccagucac

SEQ ID NO: 604185 - RNA, 17 nt, Homo sapiens
caaacacuccacccucc

SEQ ID NO: 604186 - RNA, 23 nt, Homo sapiens
caaacacugcagaacagcaucau

SEQ ID NO: 604187 - RNA, 17 nt, Homo sapiens
caaacagaacaggguca

SEQ ID NO: 604188 - RNA, 17 nt, Homo sapiens
caaacagaacugcaguc

SEQ ID NO: 604189 - RNA, 19 nt, Homo sapiens
caaacagccccucuggaca

SEQ ID NO: 604190 - RNA, 13 nt, Homo sapiens
caaacaggcaguu

SEQ ID NO: 604191 - RNA, 22 nt, Homo sapiens
caaacaggcaguuggccagaga

SEQ ID NO: 604192 - RNA, 22 nt, Homo sapiens
caaacauauccuuucaagacag

SEQ ID NO: 604193 - RNA, 19 nt, Homo sapiens
caaacaucauuuuacucuu

SEQ ID NO: 604194 - RNA, 20 nt, Homo sapiens
caaacauccuacaagacaca

SEQ ID NO: 604195 - RNA, 13 nt, Homo sapiens
caaacaugcaaga

SEQ ID NO: 604196 - RNA, 19 nt, Homo sapiens
caaacaugcggugccauga

SEQ ID NO: 604197 - RNA, 15 nt, Homo sapiens
caaacauuauuccaa

SEQ ID NO: 604198 - RNA, 15 nt, Homo sapiens
caaacauuucauccg

SEQ ID NO: 604199 - RNA, 21 nt, Homo sapiens
caaacauuucuaacucuauua

SEQ ID NO: 604200 - RNA, 18 nt, Homo sapiens
caaacauuugccaaguga

SEQ ID NO: 604201 - RNA, 20 nt, Homo sapiens
caaacauuuugaaagucugu

SEQ ID NO: 604202 - RNA, 23 nt, Homo sapiens
caaaccaaccgcacaugcagaug

SEQ ID NO: 604203 - RNA, 17 nt, Homo sapiens
caaacccuggugguauu

SEQ ID NO: 604204 - RNA, 15 nt, Homo sapiens
caaaccgagugcaau

SEQ ID NO: 604205 - RNA, 16 nt, Homo sapiens
caaaccgagugcaaug

SEQ ID NO: 604206 - RNA, 22 nt, Homo sapiens
caaaccgccggccacacugguc

SEQ ID NO: 604207 - RNA, 15 nt, Homo sapiens
caaaccuacugccca

SEQ ID NO: 604208 - RNA, 12 nt, Homo sapiens
caaaccucugcc

SEQ ID NO: 604209 - RNA, 16 nt, Homo sapiens
caaaccugaguaucag

SEQ ID NO: 604210 - RNA, 12 nt, Homo sapiens
caaaccugugua

SEQ ID NO: 604211 - RNA, 20 nt, Homo sapiens
auucaccuguaaaacuuuau

SEQ ID NO: 604212 - RNA, 22 nt, Homo sapiens
auucaccuuccagugucucgga

SEQ ID NO: 604213 - RNA, 22 nt, Homo sapiens
auucacugugcacuuugcucaa

SEQ ID NO: 604214 - RNA, 21 nt, Homo sapiens
auucacuguuuguuacuaugu

SEQ ID NO: 604215 - RNA, 21 nt, Homo sapiens
auucacuuuguuuaugcauau

SEQ ID NO: 604216 - RNA, 17 nt, Homo sapiens
auucagaaaacuucaag

SEQ ID NO: 604217 - RNA, 16 nt, Homo sapiens
auucagaaagucauag

SEQ ID NO: 604218 - RNA, 19 nt, Homo sapiens
auucagaacugagggcucu

SEQ ID NO: 604219 - RNA, 18 nt, Homo sapiens
auucagacagagacuuua

SEQ ID NO: 604220 - RNA, 23 nt, Homo sapiens
auucagagcuaauaagugcuuuc

SEQ ID NO: 604221 - RNA, 17 nt, Homo sapiens
auucagaguccuugcaa

SEQ ID NO: 604222 - RNA, 13 nt, Homo sapiens
auucaggacacag

SEQ ID NO: 604223 - RNA, 21 nt, Homo sapiens
auucaggacuuaacggcucca

SEQ ID NO: 604224 - RNA, 16 nt, Homo sapiens
auucaggauuacaugc

SEQ ID NO: 604225 - RNA, 16 nt, Homo sapiens
auucaggcacugagaa

SEQ ID NO: 604226 - RNA, 18 nt, Homo sapiens
auucaggcagcacugaca

SEQ ID NO: 604227 - RNA, 17 nt, Homo sapiens
auucaggccagcccagc

SEQ ID NO: 604228 - RNA, 15 nt, Homo sapiens
auucagguaauacaa

SEQ ID NO: 604229 - RNA, 16 nt, Homo sapiens
auucagguauguugcc

SEQ ID NO: 604230 - RNA, 12 nt, Homo sapiens
auucaguacaac

SEQ ID NO: 604231 - RNA, 13 nt, Homo sapiens
auucaguauuaaa

SEQ ID NO: 604232 - RNA, 20 nt, Homo sapiens
auucaguuguuuugcauaac

SEQ ID NO: 604233 - RNA, 16 nt, Homo sapiens
auucaguuuucaggau

SEQ ID NO: 604234 - RNA, 21 nt, Homo sapiens
auucauaaaaacugcuuacuu

SEQ ID NO: 604235 - RNA, 16 nt, Homo sapiens
auucauaaaucacaaa

SEQ ID NO: 604236 - RNA, 18 nt, Homo sapiens
auucauaggaagguguuu

SEQ ID NO: 604237 - RNA, 17 nt, Homo sapiens
auucauaggcagcaucu

SEQ ID NO: 604238 - RNA, 13 nt, Homo sapiens
auucauaugcaga

SEQ ID NO: 604239 - RNA, 12 nt, Homo sapiens
auucaugacaac

SEQ ID NO: 604240 - RNA, 15 nt, Homo sapiens
auucauguaacaguu

SEQ ID NO: 604241 - RNA, 17 nt, Homo sapiens
auucauguaacucucca

SEQ ID NO: 604242 - RNA, 21 nt, Homo sapiens
auucaugugagaaagcuaaaa

SEQ ID NO: 604243 - RNA, 21 nt, Homo sapiens
auucauuaccuguuuauucuc

SEQ ID NO: 604244 - RNA, 23 nt, Homo sapiens
auucauuaccuguuuauucucug

SEQ ID NO: 604245 - RNA, 12 nt, Homo sapiens
auucauucucau

SEQ ID NO: 604246 - RNA, 18 nt, Homo sapiens
auucauuggcagcucaaa

SEQ ID NO: 604247 - RNA, 14 nt, Homo sapiens
auucauugugauuu

SEQ ID NO: 604248 - RNA, 15 nt, Homo sapiens
auucauuguggucau

SEQ ID NO: 604249 - RNA, 14 nt, Homo sapiens
auucauuuccugcc

SEQ ID NO: 604250 - RNA, 20 nt, Homo sapiens
auucauuuccugcccuuccu

SEQ ID NO: 604251 - RNA, 17 nt, Homo sapiens
auucauuuggugacugu

SEQ ID NO: 604252 - RNA, 18 nt, Homo sapiens
auucauuuucaucacugg

SEQ ID NO: 604253 - RNA, 13 nt, Homo sapiens
auuccaaaaacau

SEQ ID NO: 604254 - RNA, 17 nt, Homo sapiens
auuccaaaugucuuuua

SEQ ID NO: 604255 - RNA, 16 nt, Homo sapiens
auuccaacauuucuca

SEQ ID NO: 604256 - RNA, 13 nt, Homo sapiens
auuccaacuugaa

SEQ ID NO: 604257 - RNA, 14 nt, Homo sapiens
auuccacuccacuc

SEQ ID NO: 604258 - RNA, 19 nt, Homo sapiens
auuccagaaugcuguacau

SEQ ID NO: 604259 - RNA, 16 nt, Homo sapiens
auuccaggaaaacugg

SEQ ID NO: 604260 - RNA, 19 nt, Homo sapiens
auuccaggaaaacugggac

SEQ ID NO: 604261 - RNA, 20 nt, Homo sapiens
auuccaggggucguuugcuu

SEQ ID NO: 604262 - RNA, 12 nt, Homo sapiens
auuccaguauca

SEQ ID NO: 604263 - RNA, 14 nt, Homo sapiens
auuccagucuacuu

SEQ ID NO: 604264 - RNA, 12 nt, Homo sapiens
auuccagugcag

SEQ ID NO: 604265 - RNA, 18 nt, Homo sapiens
auuccaguggacccugga

SEQ ID NO: 604266 - RNA, 18 nt, Homo sapiens
auuccaugacgacauaca

SEQ ID NO: 604267 - RNA, 13 nt, Homo sapiens
auuccauguuuca

SEQ ID NO: 604268 - RNA, 20 nt, Homo sapiens
auucccaagguuacuggaua

SEQ ID NO: 604269 - RNA, 20 nt, Homo sapiens
auucccaccauucuaccuga

SEQ ID NO: 604270 - RNA, 13 nt, Homo sapiens
auucccacugccg

SEQ ID NO: 604271 - RNA, 23 nt, Homo sapiens
auucccaucacaacauuccucag

SEQ ID NO: 604272 - RNA, 16 nt, Homo sapiens
auuccccacccugaaa

SEQ ID NO: 604273 - RNA, 22 nt, Homo sapiens
auucccugauuuaauaugcaaa

SEQ ID NO: 604274 - RNA, 21 nt, Homo sapiens
auucccugcccaaacccuuaa

SEQ ID NO: 604275 - RNA, 14 nt, Homo sapiens
auucccugcuaaau

SEQ ID NO: 604276 - RNA, 14 nt, Homo sapiens
auucccugucccca

SEQ ID NO: 604277 - RNA, 16 nt, Homo sapiens
auucccuucagggauu

SEQ ID NO: 604278 - RNA, 18 nt, Homo sapiens
auuccggugccuccugaa

SEQ ID NO: 604279 - RNA, 20 nt, Homo sapiens
auuccgucaccacgacuggc

SEQ ID NO: 604280 - RNA, 18 nt, Homo sapiens
auuccuaacuagaauuag

SEQ ID NO: 604281 - RNA, 19 nt, Homo sapiens
auuccuaagaggaguuuau

SEQ ID NO: 604282 - RNA, 20 nt, Homo sapiens
auuccuacagcacuacuggg

SEQ ID NO: 604283 - RNA, 20 nt, Homo sapiens
auuccuacucccucuuccaa

SEQ ID NO: 604284 - RNA, 16 nt, Homo sapiens
auuccuauauguagcu

SEQ ID NO: 604285 - RNA, 15 nt, Homo sapiens
caacaagaauauugu

SEQ ID NO: 604286 - RNA, 23 nt, Homo sapiens
caacaagccucaaagucccuuga

SEQ ID NO: 604287 - RNA, 15 nt, Homo sapiens
caacaagucuugaaa

SEQ ID NO: 604288 - RNA, 17 nt, Homo sapiens
caacaauacaugcugcu

SEQ ID NO: 604289 - RNA, 19 nt, Homo sapiens
caacaauacaugcugcuaa

SEQ ID NO: 604290 - RNA, 17 nt, Homo sapiens
caacaauccaucucuca

SEQ ID NO: 604291 - RNA, 16 nt, Homo sapiens
caacaauccuauggaa

SEQ ID NO: 604292 - RNA, 23 nt, Homo sapiens
caacaauccuucuauucuagccu

SEQ ID NO: 604293 - RNA, 19 nt, Homo sapiens
caacaauggggugggccca

SEQ ID NO: 604294 - RNA, 18 nt, Homo sapiens
caacaauuuauccauuca

SEQ ID NO: 604295 - RNA, 13 nt, Homo sapiens
caacacacacugu

SEQ ID NO: 604296 - RNA, 21 nt, Homo sapiens
caacacaguugggacccaaaa

SEQ ID NO: 604297 - RNA, 20 nt, Homo sapiens
caacacaugucuagcuuuca

SEQ ID NO: 604298 - RNA, 20 nt, Homo sapiens
caacaccagccccacuucug

SEQ ID NO: 604299 - RNA, 22 nt, Homo sapiens
caacaccuauauauccaagaag

SEQ ID NO: 604300 - RNA, 22 nt, Homo sapiens
caacaccucugcacaagcugca

SEQ ID NO: 604301 - RNA, 18 nt, Homo sapiens
caacaccuuccuccugca

SEQ ID NO: 604302 - RNA, 15 nt, Homo sapiens
caacacuauauaaau

SEQ ID NO: 604303 - RNA, 17 nt, Homo sapiens
caacacugcuguccaca

SEQ ID NO: 604304 - RNA, 17 nt, Homo sapiens
caacacugggaaacaga

SEQ ID NO: 604305 - RNA, 18 nt, Homo sapiens
caacagaaacaugccaga

SEQ ID NO: 604306 - RNA, 15 nt, Homo sapiens
caacagaaaccagaa

SEQ ID NO: 604307 - RNA, 23 nt, Homo sapiens
caacagaaaccagaaaagcaaua

SEQ ID NO: 604308 - RNA, 21 nt, Homo sapiens
caacagaagcaaaaauucaca

SEQ ID NO: 604309 - RNA, 14 nt, Homo sapiens
caacagacaaguga

SEQ ID NO: 604310 - RNA, 21 nt, Homo sapiens
caacagagcaagacuccaucu

SEQ ID NO: 604311 - RNA, 16 nt, Homo sapiens
caacagagcacuugag

SEQ ID NO: 604312 - RNA, 14 nt, Homo sapiens
caacagcaaaggaa

SEQ ID NO: 604313 - RNA, 13 nt, Homo sapiens
caacagcagugag

SEQ ID NO: 604314 - RNA, 20 nt, Homo sapiens
caacagccugacaacauuuc

SEQ ID NO: 604315 - RNA, 20 nt, Homo sapiens
caacagcuaggaaauaucau

SEQ ID NO: 604316 - RNA, 15 nt, Homo sapiens
caacaggaaacuggg

SEQ ID NO: 604317 - RNA, 16 nt, Homo sapiens
caacaggaaacuggga

SEQ ID NO: 604318 - RNA, 16 nt, Homo sapiens
caacaggccauuguga

SEQ ID NO: 604319 - RNA, 18 nt, Homo sapiens
caacaggguagauuucuc

SEQ ID NO: 604320 - RNA, 22 nt, Homo sapiens
caacagguggcaggaccaggac

SEQ ID NO: 604321 - RNA, 15 nt, Homo sapiens
caacaguucugagcu

SEQ ID NO: 604322 - RNA, 12 nt, Homo sapiens
caacauaacuga

SEQ ID NO: 604323 - RNA, 21 nt, Homo sapiens
caacauaaggagaauguaucu

SEQ ID NO: 604324 - RNA, 15 nt, Homo sapiens
caacauaccaagacc

SEQ ID NO: 604325 - RNA, 16 nt, Homo sapiens
caacaucaauccuuua

SEQ ID NO: 604326 - RNA, 14 nt, Homo sapiens
caacaucccauugc

SEQ ID NO: 604327 - RNA, 21 nt, Homo sapiens
caacaucgugaaaccccaucu

SEQ ID NO: 604328 - RNA, 24 nt, Homo sapiens
caacaucgugaaaccccaucucua

SEQ ID NO: 604329 - RNA, 18 nt, Homo sapiens
caacaugacauccagaga

SEQ ID NO: 604330 - RNA, 17 nt, Homo sapiens
caacaugcgaccgugac

SEQ ID NO: 604331 - RNA, 15 nt, Homo sapiens
caacaugcuccaaau

SEQ ID NO: 604332 - RNA, 21 nt, Homo sapiens
caacauggcaaaaccccaucu

SEQ ID NO: 604333 - RNA, 15 nt, Homo sapiens
caacauggggaccag

SEQ ID NO: 604334 - RNA, 23 nt, Homo sapiens
caacauggucuaauuauuuacuc

SEQ ID NO: 604335 - RNA, 21 nt, Homo sapiens
caacauggugaaaccccaucu

SEQ ID NO: 604336 - RNA, 21 nt, Homo sapiens
caacauggugaaacuccaucu

SEQ ID NO: 604337 - RNA, 20 nt, Homo sapiens
caacauguuacugaccagca

SEQ ID NO: 604338 - RNA, 15 nt, Homo sapiens
caacauuaaacacaa

SEQ ID NO: 604339 - RNA, 14 nt, Homo sapiens
caacauuaccaaaa

SEQ ID NO: 604340 - RNA, 13 nt, Homo sapiens
caacauuguacaa

SEQ ID NO: 604341 - RNA, 11 nt, Homo sapiens
caacauugugu

SEQ ID NO: 604342 - RNA, 15 nt, Homo sapiens
caaccaagaggauuu

SEQ ID NO: 604343 - RNA, 22 nt, Homo sapiens
caaccaagaggauuucuucaaa

SEQ ID NO: 604344 - RNA, 20 nt, Homo sapiens
caaccaauuccaaguuuuaa

SEQ ID NO: 604345 - RNA, 18 nt, Homo sapiens
caaccaauuuacacugcc

SEQ ID NO: 604346 - RNA, 13 nt, Homo sapiens
caaccacaauuca

SEQ ID NO: 604347 - RNA, 12 nt, Homo sapiens
caaccacugcuu

SEQ ID NO: 604348 - RNA, 19 nt, Homo sapiens
caaguauaacaacuuugaa

SEQ ID NO: 604349 - RNA, 14 nt, Homo sapiens
caaguauaugugaa

SEQ ID NO: 604350 - RNA, 18 nt, Homo sapiens
caaguauccaaccaacuu

SEQ ID NO: 604351 - RNA, 21 nt, Homo sapiens
caaguauguugagaguugcug

SEQ ID NO: 604352 - RNA, 23 nt, Homo sapiens
caaguauuaauaguucaguguau

SEQ ID NO: 604353 - RNA, 17 nt, Homo sapiens
caaguauuacaaccaua

SEQ ID NO: 604354 - RNA, 15 nt, Homo sapiens
caagucaacacucuu

SEQ ID NO: 604355 - RNA, 22 nt, Homo sapiens
caagucacccagccagaaggaa

SEQ ID NO: 604356 - RNA, 18 nt, Homo sapiens
caagucaugugcauuucc

SEQ ID NO: 604357 - RNA, 22 nt, Homo sapiens
caaguccagauuuacacuggga

SEQ ID NO: 604358 - RNA, 23 nt, Homo sapiens
caaguccagauuuacacugggag

SEQ ID NO: 604359 - RNA, 22 nt, Homo sapiens
caaguccauguuauucucucac

SEQ ID NO: 604360 - RNA, 17 nt, Homo sapiens
caaguccuuaccucuuc

SEQ ID NO: 604361 - RNA, 21 nt, Homo sapiens
caaguccuugaccucuauaaa

SEQ ID NO: 604362 - RNA, 14 nt, Homo sapiens
caagucugacucuc

SEQ ID NO: 604363 - RNA, 12 nt, Homo sapiens
caagugaagguu

SEQ ID NO: 604364 - RNA, 22 nt, Homo sapiens
caagugcccaacugcagaccaa

SEQ ID NO: 604365 - RNA, 22 nt, Homo sapiens
caagugcuaaccuuuucaccuc

SEQ ID NO: 604366 - RNA, 15 nt, Homo sapiens
caagugcuacucuca

SEQ ID NO: 604367 - RNA, 11 nt, Homo sapiens
caagugcugca

SEQ ID NO: 604368 - RNA, 14 nt, Homo sapiens
caagugcugucuug

SEQ ID NO: 604369 - RNA, 20 nt, Homo sapiens
caaguggacuuggagcugca

SEQ ID NO: 604370 - RNA, 19 nt, Homo sapiens
caaguggcaugugcuguga

SEQ ID NO: 604371 - RNA, 11 nt, Homo sapiens
caaguggcucc

SEQ ID NO: 604372 - RNA, 22 nt, Homo sapiens
caaguggcugggugcccucuca

SEQ ID NO: 604373 - RNA, 23 nt, Homo sapiens
caaguggcugugacaucuacgua

SEQ ID NO: 604374 - RNA, 14 nt, Homo sapiens
caagugggugaaug

SEQ ID NO: 604375 - RNA, 20 nt, Homo sapiens
caagugguuuccuggugcuu

SEQ ID NO: 604376 - RNA, 15 nt, Homo sapiens
caaguguaucuccuu

SEQ ID NO: 604377 - RNA, 22 nt, Homo sapiens
caaguguuaaggcaacauuccu

SEQ ID NO: 604378 - RNA, 12 nt, Homo sapiens
caaguguucacu

SEQ ID NO: 604379 - RNA, 13 nt, Homo sapiens
caaguuacaguga

SEQ ID NO: 604380 - RNA, 16 nt, Homo sapiens
caaguuagcucaggag

SEQ ID NO: 604381 - RNA, 23 nt, Homo sapiens
caaguuauaaaucaaugucacuu

SEQ ID NO: 604382 - RNA, 13 nt, Homo sapiens
caaguuauauuga

SEQ ID NO: 604383 - RNA, 14 nt, Homo sapiens
caaguuauguucuu

SEQ ID NO: 604384 - RNA, 14 nt, Homo sapiens
caaguucaauccua

SEQ ID NO: 604385 - RNA, 17 nt, Homo sapiens
caaguuccgucagucca

SEQ ID NO: 604386 - RNA, 22 nt, Homo sapiens
caaguucuaggccccccagaaa

SEQ ID NO: 604387 - RNA, 21 nt, Homo sapiens
caaguucuuaguugcuguaug

SEQ ID NO: 604388 - RNA, 14 nt, Homo sapiens
caaguucuucaccu

SEQ ID NO: 604389 - RNA, 14 nt, Homo sapiens
caaguugcagugag

SEQ ID NO: 604390 - RNA, 16 nt, Homo sapiens
caaguuguguuugaua

SEQ ID NO: 604391 - RNA, 19 nt, Homo sapiens
caaguuucugauaccacug

SEQ ID NO: 604392 - RNA, 20 nt, Homo sapiens
caaguuucugauaccacugc

SEQ ID NO: 604393 - RNA, 23 nt, Homo sapiens
caaguuucugauaccacugcacu

SEQ ID NO: 604394 - RNA, 19 nt, Homo sapiens
caaguuugaccagugcagu

SEQ ID NO: 604395 - RNA, 12 nt, Homo sapiens
caaguuugucac

SEQ ID NO: 604396 - RNA, 18 nt, Homo sapiens
caaguuuuauaauccuua

SEQ ID NO: 604397 - RNA, 21 nt, Homo sapiens
caaguuuuucugucaagaaga

SEQ ID NO: 604398 - RNA, 16 nt, Homo sapiens
caauaaaaacauugcc

SEQ ID NO: 604399 - RNA, 20 nt, Homo sapiens
caauaaaaaguucagaguuc

SEQ ID NO: 604400 - RNA, 18 nt, Homo sapiens
caauaaaaccuggguguc

SEQ ID NO: 604401 - RNA, 14 nt, Homo sapiens
caauaaaaccuuug

SEQ ID NO: 604402 - RNA, 14 nt, Homo sapiens
caauaaaacugaug

SEQ ID NO: 604403 - RNA, 15 nt, Homo sapiens
caauaaaacugaugu

SEQ ID NO: 604404 - RNA, 19 nt, Homo sapiens
caauaaaaguuuucuccaa

SEQ ID NO: 604405 - RNA, 18 nt, Homo sapiens
caauaaacuccuacuaaa

SEQ ID NO: 604406 - RNA, 15 nt, Homo sapiens
caauaaacuuagagg

SEQ ID NO: 604407 - RNA, 15 nt, Homo sapiens
caauaaagcaaugug

SEQ ID NO: 604408 - RNA, 17 nt, Homo sapiens
caauaaagcacugagca

SEQ ID NO: 604409 - RNA, 19 nt, Homo sapiens
caauaaagcagcguuucua

SEQ ID NO: 604410 - RNA, 19 nt, Homo sapiens
caauaaaggcagcugccuc

SEQ ID NO: 604411 - RNA, 22 nt, Homo sapiens
caauaaagggagaauggugcug

SEQ ID NO: 604412 - RNA, 14 nt, Homo sapiens
caauaaauguuugu

SEQ ID NO: 604413 - RNA, 12 nt, Homo sapiens
caauaaauucau

SEQ ID NO: 604414 - RNA, 13 nt, Homo sapiens
caauaacaaacug

SEQ ID NO: 604415 - RNA, 14 nt, Homo sapiens
caauaacacuaaaa

SEQ ID NO: 604416 - RNA, 14 nt, Homo sapiens
caauaacacugucu

SEQ ID NO: 604417 - RNA, 15 nt, Homo sapiens
caauaacacugucuc

SEQ ID NO: 604418 - RNA, 16 nt, Homo sapiens
caauaacacugucucc

SEQ ID NO: 604419 - RNA, 13 nt, Homo sapiens
caauaacauuccc

SEQ ID NO: 604420 - RNA, 16 nt, Homo sapiens
caauaacuauuuuucc

SEQ ID NO: 604421 - RNA, 19 nt, Homo sapiens
caauaacuuuucaccaaug

SEQ ID NO: 604422 - RNA, 21 nt, Homo sapiens
caauaagaaaugaacaaaaga

SEQ ID NO: 604423 - RNA, 15 nt, Homo sapiens
caauaagcaaaaaca

SEQ ID NO: 604424 - RNA, 16 nt, Homo sapiens
caauaauaaauccuca

SEQ ID NO: 604425 - RNA, 12 nt, Homo sapiens
caauaauaucaa

SEQ ID NO: 604426 - RNA, 18 nt, Homo sapiens
caauaaugagagcucaga

SEQ ID NO: 604427 - RNA, 14 nt, Homo sapiens
caauaauuucaggu

SEQ ID NO: 604428 - RNA, 16 nt, Homo sapiens
caauacaacuuuacca

SEQ ID NO: 604429 - RNA, 19 nt, Homo sapiens
caauacgccuuuaaagguu

SEQ ID NO: 604430 - RNA, 18 nt, Homo sapiens
caauacucaaaagagaga

SEQ ID NO: 604431 - RNA, 12 nt, Homo sapiens
caauacugagcc

SEQ ID NO: 604432 - RNA, 15 nt, Homo sapiens
caauacuguuuccau

SEQ ID NO: 604433 - RNA, 20 nt, Homo sapiens
caauacuguuuccauuuuaa

SEQ ID NO: 604434 - RNA, 15 nt, Homo sapiens
caauacuuaccuaau

SEQ ID NO: 604435 - RNA, 15 nt, Homo sapiens
caauagagacuguag

SEQ ID NO: 604436 - RNA, 22 nt, Homo sapiens
caauaggugagagaauguauuu

SEQ ID NO: 604437 - RNA, 14 nt, Homo sapiens
caauaguaaaagau

SEQ ID NO: 604438 - RNA, 17 nt, Homo sapiens
caauagugaaaugccac

SEQ ID NO: 604439 - RNA, 21 nt, Homo sapiens
caauagugaaaugccacaccu

SEQ ID NO: 604440 - RNA, 18 nt, Homo sapiens
caauagugcaacaucucu

SEQ ID NO: 604441 - RNA, 14 nt, Homo sapiens
caauaguuugcaua

SEQ ID NO: 604442 - RNA, 18 nt, Homo sapiens
caauauacauaauacaug

SEQ ID NO: 604443 - RNA, 16 nt, Homo sapiens
caauauauugaacuuu

SEQ ID NO: 604444 - RNA, 14 nt, Homo sapiens
caauaucaugucuu

SEQ ID NO: 604445 - RNA, 14 nt, Homo sapiens
caauaucuugccag

SEQ ID NO: 604446 - RNA, 18 nt, Homo sapiens
caauauguggucaauuaa

SEQ ID NO: 604447 - RNA, 21 nt, Homo sapiens
caauauuaaauacagacacua

SEQ ID NO: 604448 - RNA, 13 nt, Homo sapiens
caauauugccaug

SEQ ID NO: 604449 - RNA, 19 nt, Homo sapiens
caauauugccugugcuucu

SEQ ID NO: 604450 - RNA, 18 nt, Homo sapiens
caauauuucuucacaaag

SEQ ID NO: 604451 - RNA, 13 nt, Homo sapiens
caauauuuugccu

SEQ ID NO: 604452 - RNA, 21 nt, Homo sapiens
caauauuuuuauaucaugcaa

SEQ ID NO: 604453 - RNA, 22 nt, Homo sapiens
caauauuuuuauaucaugcaaa

SEQ ID NO: 604454 - RNA, 10 nt, Homo sapiens
caaucacaaa

SEQ ID NO: 604455 - RNA, 14 nt, Homo sapiens
caaucacaguguua

SEQ ID NO: 604456 - RNA, 12 nt, Homo sapiens
caaucacuugag

SEQ ID NO: 604457 - RNA, 20 nt, Homo sapiens
caaucagaugacaacaaaga

SEQ ID NO: 604458 - RNA, 15 nt, Homo sapiens
caaucagaugccuca

SEQ ID NO: 604459 - RNA, 15 nt, Homo sapiens
caaucagcagucuag

SEQ ID NO: 604460 - RNA, 17 nt, Homo sapiens
caaucauaauaccugcu

SEQ ID NO: 604461 - RNA, 18 nt, Homo sapiens
caauccagcuauguuaua

SEQ ID NO: 604462 - RNA, 20 nt, Homo sapiens
caaucccacguacuuauaaa

SEQ ID NO: 604463 - RNA, 18 nt, Homo sapiens
caauccgaaguaugaggg

SEQ ID NO: 604464 - RNA, 23 nt, Homo sapiens
caauccuaagcaaaaagaacaaa

SEQ ID NO: 604465 - RNA, 13 nt, Homo sapiens
caauccuaucaca

SEQ ID NO: 604466 - RNA, 15 nt, Homo sapiens
caauccugucauaua

SEQ ID NO: 604467 - RNA, 16 nt, Homo sapiens
caauccugucauauaa

SEQ ID NO: 604468 - RNA, 18 nt, Homo sapiens
caaucuauguuugcacuu

SEQ ID NO: 604469 - RNA, 14 nt, Homo sapiens
caaucuauucugua

SEQ ID NO: 604470 - RNA, 16 nt, Homo sapiens
caaucucgcaguacau

SEQ ID NO: 604471 - RNA, 18 nt, Homo sapiens
caaucucugccauaucag

SEQ ID NO: 604472 - RNA, 16 nt, Homo sapiens
caaucuggagauacua

SEQ ID NO: 604473 - RNA, 12 nt, Homo sapiens
caaucuguaaac

SEQ ID NO: 604474 - RNA, 23 nt, Homo sapiens
caaucuguaucuuugacaauucu

SEQ ID NO: 604475 - RNA, 12 nt, Homo sapiens
caaucuguguuc

SEQ ID NO: 604476 - RNA, 17 nt, Homo sapiens
caaucuuauguuuccaa

SEQ ID NO: 604477 - RNA, 19 nt, Homo sapiens
caaucuuauugucaacacu

SEQ ID NO: 604478 - RNA, 14 nt, Homo sapiens
caaucuucauuuaa

SEQ ID NO: 604479 - RNA, 16 nt, Homo sapiens
caaucuucuacuuuaa

SEQ ID NO: 604480 - RNA, 13 nt, Homo sapiens
caaucuugcccua

SEQ ID NO: 604481 - RNA, 18 nt, Homo sapiens
caaucuuguuacugcuga

SEQ ID NO: 604482 - RNA, 15 nt, Homo sapiens
caaucuuugccuuua

SEQ ID NO: 604483 - RNA, 19 nt, Homo sapiens
caaugaaaaauguaauuua

SEQ ID NO: 604484 - RNA, 23 nt, Homo sapiens
caaugaaauacuccagcaccugu

SEQ ID NO: 604485 - RNA, 20 nt, Homo sapiens
caaugaaauauugcuguaua

SEQ ID NO: 604486 - RNA, 12 nt, Homo sapiens
caaugaagggaa

SEQ ID NO: 604487 - RNA, 18 nt, Homo sapiens
caaugaagggaagugcau

SEQ ID NO: 604488 - RNA, 15 nt, Homo sapiens
caaugacacagucuu

SEQ ID NO: 604489 - RNA, 17 nt, Homo sapiens
caaugacacccaugcca

SEQ ID NO: 604490 - RNA, 13 nt, Homo sapiens
caaugacaucuca

SEQ ID NO: 604491 - RNA, 14 nt, Homo sapiens
caaugacaucucag

SEQ ID NO: 604492 - RNA, 15 nt, Homo sapiens
caaugacaucucagg

SEQ ID NO: 604493 - RNA, 17 nt, Homo sapiens
caaugacaucucagggg

SEQ ID NO: 604494 - RNA, 21 nt, Homo sapiens
caaugacaucucaggggccag

SEQ ID NO: 604495 - RNA, 22 nt, Homo sapiens
caaugacaucucaggggccaga

SEQ ID NO: 604496 - RNA, 13 nt, Homo sapiens
caaugaccuguau

SEQ ID NO: 604497 - RNA, 19 nt, Homo sapiens
caaugacgugccuaccucu

SEQ ID NO: 604498 - RNA, 19 nt, Homo sapiens
caaugacuucccugcucca

SEQ ID NO: 604499 - RNA, 21 nt, Homo sapiens
caaugagauuccaguuuacaa

SEQ ID NO: 604500 - RNA, 17 nt, Homo sapiens
caaugaguaacaggaaa

SEQ ID NO: 604501 - RNA, 15 nt, Homo sapiens
caaugaguuugggca

SEQ ID NO: 604502 - RNA, 21 nt, Homo sapiens
caaugauacccaacaguuuau

SEQ ID NO: 604503 - RNA, 15 nt, Homo sapiens
caaugcaaaguacau

SEQ ID NO: 604504 - RNA, 18 nt, Homo sapiens
caaugcaaaguacaugua

SEQ ID NO: 604505 - RNA, 20 nt, Homo sapiens
caaugcaaccaacuauccaa

SEQ ID NO: 604506 - RNA, 21 nt, Homo sapiens
caaugcaguacaggacauaua

SEQ ID NO: 604507 - RNA, 23 nt, Homo sapiens
caaugcaucacguaccccacugg

SEQ ID NO: 604508 - RNA, 21 nt, Homo sapiens
caaugccaacaaagcuuacaa

SEQ ID NO: 604509 - RNA, 15 nt, Homo sapiens
caaugccaaucuuca

SEQ ID NO: 604510 - RNA, 14 nt, Homo sapiens
caaugccauuucag

SEQ ID NO: 604511 - RNA, 23 nt, Homo sapiens
caaugccuugacaacagacugaa

SEQ ID NO: 604512 - RNA, 21 nt, Homo sapiens
caaugcucuggagugugcauu

SEQ ID NO: 604513 - RNA, 18 nt, Homo sapiens
caaugcuggcuuucuccc

SEQ ID NO: 604514 - RNA, 20 nt, Homo sapiens
caaugcuuauacccagugag

SEQ ID NO: 604515 - RNA, 22 nt, Homo sapiens
caauggcacuguugcaaacuca

SEQ ID NO: 604516 - RNA, 17 nt, Homo sapiens
caauggcuuguucauca

SEQ ID NO: 604517 - RNA, 22 nt, Homo sapiens
caaugggaccgugccccaccuc

SEQ ID NO: 604518 - RNA, 16 nt, Homo sapiens
caaugggaggcuguga

SEQ ID NO: 604519 - RNA, 15 nt, Homo sapiens
caauggggccaguca

SEQ ID NO: 604520 - RNA, 21 nt, Homo sapiens
caauggggccagucaggccca

SEQ ID NO: 604521 - RNA, 19 nt, Homo sapiens
caauggguuuauagacauu

SEQ ID NO: 604522 - RNA, 23 nt, Homo sapiens
caauggugucaguauccaggcuu

SEQ ID NO: 604523 - RNA, 17 nt, Homo sapiens
caauguaaggagccuuu

SEQ ID NO: 604524 - RNA, 19 nt, Homo sapiens
cacugcugugagugcgccu

SEQ ID NO: 604525 - RNA, 16 nt, Homo sapiens
cacugcuucuugggag

SEQ ID NO: 604526 - RNA, 12 nt, Homo sapiens
cacugcuuuaaa

SEQ ID NO: 604527 - RNA, 20 nt, Homo sapiens
cacugcuuuaaacugcauuu

SEQ ID NO: 604528 - RNA, 21 nt, Homo sapiens
cacuggaauauaaaacaguca

SEQ ID NO: 604529 - RNA, 16 nt, Homo sapiens
cacuggacucaccucc

SEQ ID NO: 604530 - RNA, 17 nt, Homo sapiens
cacuggauauguuguua

SEQ ID NO: 604531 - RNA, 23 nt, Homo sapiens
cacuggaugucaaacaguaauaa

SEQ ID NO: 604532 - RNA, 14 nt, Homo sapiens
cacuggcucuccaa

SEQ ID NO: 604533 - RNA, 15 nt, Homo sapiens
cacugggaaacagag

SEQ ID NO: 604534 - RNA, 17 nt, Homo sapiens
cacugggagaggugcca

SEQ ID NO: 604535 - RNA, 17 nt, Homo sapiens
cacugggaggagucuau

SEQ ID NO: 604536 - RNA, 23 nt, Homo sapiens
cacugggaugagccgcugugagc

SEQ ID NO: 604537 - RNA, 17 nt, Homo sapiens
cacugggucucacuccu

SEQ ID NO: 604538 - RNA, 22 nt, Homo sapiens
cacugggugguggccugguccc

SEQ ID NO: 604539 - RNA, 19 nt, Homo sapiens
cacugguauuaacuuuaua

SEQ ID NO: 604540 - RNA, 15 nt, Homo sapiens
cacuggucacaggca

SEQ ID NO: 604541 - RNA, 22 nt, Homo sapiens
cacuggugggccauuagauuug

SEQ ID NO: 604542 - RNA, 21 nt, Homo sapiens
cacugguuuggucaguuacaa

SEQ ID NO: 604543 - RNA, 13 nt, Homo sapiens
cacuguacugcau

SEQ ID NO: 604544 - RNA, 14 nt, Homo sapiens
cacuguacuuguag

SEQ ID NO: 604545 - RNA, 23 nt, Homo sapiens
cacuguacuuguagaguggugcu

SEQ ID NO: 604546 - RNA, 11 nt, Homo sapiens
cacuguagcua

SEQ ID NO: 604547 - RNA, 14 nt, Homo sapiens
cacuguaguucucu

SEQ ID NO: 604548 - RNA, 17 nt, Homo sapiens
cacuguaugauuuauaa

SEQ ID NO: 604549 - RNA, 15 nt, Homo sapiens
cacuguauguuauag

SEQ ID NO: 604550 - RNA, 15 nt, Homo sapiens
cacuguauguuuacu

SEQ ID NO: 604551 - RNA, 16 nt, Homo sapiens
cacugucacccuccac

SEQ ID NO: 604552 - RNA, 14 nt, Homo sapiens
cacugucacuuugc

SEQ ID NO: 604553 - RNA, 13 nt, Homo sapiens
cacugucaucuuc

SEQ ID NO: 604554 - RNA, 12 nt, Homo sapiens
cacuguccagua

SEQ ID NO: 604555 - RNA, 16 nt, Homo sapiens
cacuguccaguauucu

SEQ ID NO: 604556 - RNA, 23 nt, Homo sapiens
cacuguccugggcgcccuggaag

SEQ ID NO: 604557 - RNA, 21 nt, Homo sapiens
cacuguccuugaacccaacag

SEQ ID NO: 604558 - RNA, 16 nt, Homo sapiens
cacugucuugccagau

SEQ ID NO: 604559 - RNA, 18 nt, Homo sapiens
cacugucuugccagauua

SEQ ID NO: 604560 - RNA, 22 nt, Homo sapiens
cacugugaaggguacagauuag

SEQ ID NO: 604561 - RNA, 15 nt, Homo sapiens
cacugugccccacaa

SEQ ID NO: 604562 - RNA, 15 nt, Homo sapiens
cacuguguguugaca

SEQ ID NO: 604563 - RNA, 15 nt, Homo sapiens
cacuguguuacugcu

SEQ ID NO: 604564 - RNA, 13 nt, Homo sapiens
cacuguucaauac

SEQ ID NO: 604565 - RNA, 19 nt, Homo sapiens
cacuguuuguuacuaugua

SEQ ID NO: 604566 - RNA, 15 nt, Homo sapiens
cacuuaaacucagcu

SEQ ID NO: 604567 - RNA, 15 nt, Homo sapiens
cacuuaaccauucca

SEQ ID NO: 604568 - RNA, 16 nt, Homo sapiens
cacuuaaggggccaag

SEQ ID NO: 604569 - RNA, 13 nt, Homo sapiens
cacuuaauagcaa

SEQ ID NO: 604570 - RNA, 20 nt, Homo sapiens
cacuuaaugauacauguuuc

SEQ ID NO: 604571 - RNA, 18 nt, Homo sapiens
cacuuacacuuuaugcac

SEQ ID NO: 604572 - RNA, 17 nt, Homo sapiens
cacuuaguagagugauu

SEQ ID NO: 604573 - RNA, 19 nt, Homo sapiens
cacuuaguaguuuuuacaa

SEQ ID NO: 604574 - RNA, 20 nt, Homo sapiens
cacuuaguauugcagccaaa

SEQ ID NO: 604575 - RNA, 18 nt, Homo sapiens
cacuuagucuguacuuca

SEQ ID NO: 604576 - RNA, 22 nt, Homo sapiens
cacuuauguuauacaauacaga

SEQ ID NO: 604577 - RNA, 14 nt, Homo sapiens
cacuucaccaagga

SEQ ID NO: 604578 - RNA, 15 nt, Homo sapiens
cacuucaccaaggaa

SEQ ID NO: 604579 - RNA, 13 nt, Homo sapiens
cacuucagaauuc

SEQ ID NO: 604580 - RNA, 14 nt, Homo sapiens
cacuucagaucuga

SEQ ID NO: 604581 - RNA, 18 nt, Homo sapiens
cacuucauauagcauuga

SEQ ID NO: 604582 - RNA, 14 nt, Homo sapiens
cacuuccagagcca

SEQ ID NO: 604583 - RNA, 12 nt, Homo sapiens
cacuuccagggg

SEQ ID NO: 604584 - RNA, 12 nt, Homo sapiens
cacuuccagucc

SEQ ID NO: 604585 - RNA, 14 nt, Homo sapiens
cacuuccaugagaa

SEQ ID NO: 604586 - RNA, 19 nt, Homo sapiens
cacuucccaucuccaggga

SEQ ID NO: 604587 - RNA, 20 nt, Homo sapiens
cacuuccguagacuguuuag

SEQ ID NO: 604588 - RNA, 16 nt, Homo sapiens
cacuuccucuucuuca

SEQ ID NO: 604589 - RNA, 13 nt, Homo sapiens
cacuuccuugccc

SEQ ID NO: 604590 - RNA, 22 nt, Homo sapiens
cacuuccuugcccccauuucac

SEQ ID NO: 604591 - RNA, 22 nt, Homo sapiens
cacuucgcgugcccucgcugcu

SEQ ID NO: 604592 - RNA, 18 nt, Homo sapiens
cacuucuaaaugcauauc

SEQ ID NO: 604593 - RNA, 17 nt, Homo sapiens
cacuucuggcuucagcc

SEQ ID NO: 604594 - RNA, 15 nt, Homo sapiens
cacuucuguaugcau

SEQ ID NO: 604595 - RNA, 21 nt, Homo sapiens
cacuucuuguuccccacugac

SEQ ID NO: 604596 - RNA, 19 nt, Homo sapiens
cacuugaaggaagaagucu

SEQ ID NO: 604597 - RNA, 18 nt, Homo sapiens
cacuugaaugugucacua

SEQ ID NO: 604598 - RNA, 13 nt, Homo sapiens
cacuugagaggau

SEQ ID NO: 604599 - RNA, 17 nt, Homo sapiens
cacuugccauugccagg

SEQ ID NO: 604600 - RNA, 17 nt, Homo sapiens
cacuugcccuguucucu

SEQ ID NO: 604601 - RNA, 16 nt, Homo sapiens
caagagggauaaaaca

SEQ ID NO: 604602 - RNA, 21 nt, Homo sapiens
caagaggggguggaggggugu

SEQ ID NO: 604603 - RNA, 22 nt, Homo sapiens
caagaguacagaagcuuuagca

SEQ ID NO: 604604 - RNA, 19 nt, Homo sapiens
caagaguccugaagaucaa

SEQ ID NO: 604605 - RNA, 17 nt, Homo sapiens
caagaguucagugcuca

SEQ ID NO: 604606 - RNA, 21 nt, Homo sapiens
caagaguuuauuuccaaauaa

SEQ ID NO: 604607 - RNA, 14 nt, Homo sapiens
caagaguuuuaaca

SEQ ID NO: 604608 - RNA, 17 nt, Homo sapiens
caagauaggaguucucu

SEQ ID NO: 604609 - RNA, 20 nt, Homo sapiens
caagaucgcaccauugcacu

SEQ ID NO: 604610 - RNA, 20 nt, Homo sapiens
caagaucgcgccacugcacu

SEQ ID NO: 604611 - RNA, 16 nt, Homo sapiens
caagaucuuucaggaa

SEQ ID NO: 604612 - RNA, 12 nt, Homo sapiens
caagaugagcug

SEQ ID NO: 604613 - RNA, 21 nt, Homo sapiens
caagauggcgaccaccaaagu

SEQ ID NO: 604614 - RNA, 13 nt, Homo sapiens
caagaugguccau

SEQ ID NO: 604615 - RNA, 21 nt, Homo sapiens
caagaugugaauuauugacac

SEQ ID NO: 604616 - RNA, 13 nt, Homo sapiens
caagauguguucu

SEQ ID NO: 604617 - RNA, 20 nt, Homo sapiens
caagauuaucuuauuccccu

SEQ ID NO: 604618 - RNA, 14 nt, Homo sapiens
caagauuaugugac

SEQ ID NO: 604619 - RNA, 19 nt, Homo sapiens
caagauuaugugacuugca

SEQ ID NO: 604620 - RNA, 22 nt, Homo sapiens
caagauuggucucccauaugca

SEQ ID NO: 604621 - RNA, 22 nt, Homo sapiens
caagauuguaaguaaauugccu

SEQ ID NO: 604622 - RNA, 17 nt, Homo sapiens
caagauuugaccaaauc

SEQ ID NO: 604623 - RNA, 15 nt, Homo sapiens
caagcaaauguuuaa

SEQ ID NO: 604624 - RNA, 17 nt, Homo sapiens
caagcaacagacucuca

SEQ ID NO: 604625 - RNA, 15 nt, Homo sapiens
caagcaacugagauu

SEQ ID NO: 604626 - RNA, 20 nt, Homo sapiens
caagcaauccaugaucuaua

SEQ ID NO: 604627 - RNA, 15 nt, Homo sapiens
caagcacauguaaua

SEQ ID NO: 604628 - RNA, 20 nt, Homo sapiens
caagcacgaggccucagguc

SEQ ID NO: 604629 - RNA, 22 nt, Homo sapiens
caagcacuuuauauuuuccucu

SEQ ID NO: 604630 - RNA, 18 nt, Homo sapiens
caagcagccgcagcgcag

SEQ ID NO: 604631 - RNA, 14 nt, Homo sapiens
caagcagcguggaa

SEQ ID NO: 604632 - RNA, 13 nt, Homo sapiens
caagcaguucucc

SEQ ID NO: 604633 - RNA, 12 nt, Homo sapiens
caagcauuucau

SEQ ID NO: 604634 - RNA, 21 nt, Homo sapiens
caagccagcccccuccagcuc

SEQ ID NO: 604635 - RNA, 24 nt, Homo sapiens
caagccagcccccuccagcucaug

SEQ ID NO: 604636 - RNA, 14 nt, Homo sapiens
caagccauuccaaa

SEQ ID NO: 604637 - RNA, 18 nt, Homo sapiens
caagcccaauacagccau

SEQ ID NO: 604638 - RNA, 17 nt, Homo sapiens
caagcccaguaacugca

SEQ ID NO: 604639 - RNA, 15 nt, Homo sapiens
caagccuacaugaca

SEQ ID NO: 604640 - RNA, 20 nt, Homo sapiens
caagccuagcccuucucuca

SEQ ID NO: 604641 - RNA, 13 nt, Homo sapiens
caagccugaucca

SEQ ID NO: 604642 - RNA, 16 nt, Homo sapiens
caagccugccuaggaa

SEQ ID NO: 604643 - RNA, 16 nt, Homo sapiens
caagcgauucuccugc

SEQ ID NO: 604644 - RNA, 20 nt, Homo sapiens
caagcgcuguaaacccugac

SEQ ID NO: 604645 - RNA, 14 nt, Homo sapiens
caagcuaacugcuu

SEQ ID NO: 604646 - RNA, 15 nt, Homo sapiens
caagcuaaucugccu

SEQ ID NO: 604647 - RNA, 23 nt, Homo sapiens
caagcuagaaggccacaugucac

SEQ ID NO: 604648 - RNA, 14 nt, Homo sapiens
caagcuaggugcua

SEQ ID NO: 604649 - RNA, 18 nt, Homo sapiens
caagcuauccuugcaccu

SEQ ID NO: 604650 - RNA, 17 nt, Homo sapiens
caagcucccugccccaa

SEQ ID NO: 604651 - RNA, 16 nt, Homo sapiens
caagcuccucgugaua

SEQ ID NO: 604652 - RNA, 19 nt, Homo sapiens
caagcuccuggucuugaga

SEQ ID NO: 604653 - RNA, 17 nt, Homo sapiens
caagcugagugacugua

SEQ ID NO: 604654 - RNA, 12 nt, Homo sapiens
caagcugccucc

SEQ ID NO: 604655 - RNA, 22 nt, Homo sapiens
caagcugcucugagccacagug

SEQ ID NO: 604656 - RNA, 19 nt, Homo sapiens
caagcugcuuaaguucuua

SEQ ID NO: 604657 - RNA, 17 nt, Homo sapiens
cacuugccugugcuaca

SEQ ID NO: 604658 - RNA, 13 nt, Homo sapiens
cacuugcucaaaa

SEQ ID NO: 604659 - RNA, 13 nt, Homo sapiens
cacuuggaugcag

SEQ ID NO: 604660 - RNA, 21 nt, Homo sapiens
cacuugggagcugcugggcua

SEQ ID NO: 604661 - RNA, 22 nt, Homo sapiens
cacuuguuguugaacauggcua

SEQ ID NO: 604662 - RNA, 22 nt, Homo sapiens
cacuuguuguuuuacuaaagaa

SEQ ID NO: 604663 - RNA, 16 nt, Homo sapiens
cacuuuaaaaccaguu

SEQ ID NO: 604664 - RNA, 21 nt, Homo sapiens
cacuuuaauuaccaaccuguu

SEQ ID NO: 604665 - RNA, 21 nt, Homo sapiens
cacuuuauauuuuccucuuag

SEQ ID NO: 604666 - RNA, 14 nt, Homo sapiens
cacuuuauggaaga

SEQ ID NO: 604667 - RNA, 23 nt, Homo sapiens
cacuuucccuagaaagccauauu

SEQ ID NO: 604668 - RNA, 17 nt, Homo sapiens
cacuuugagaagcugag

SEQ ID NO: 604669 - RNA, 23 nt, Homo sapiens
cacuuuggacauggcucacaaac

SEQ ID NO: 604670 - RNA, 19 nt, Homo sapiens
cacuuuggacuucucugaa

SEQ ID NO: 604671 - RNA, 20 nt, Homo sapiens
cacuuuggcuucuccuguga

SEQ ID NO: 604672 - RNA, 18 nt, Homo sapiens
cacuuugucuaacucaga

SEQ ID NO: 604673 - RNA, 16 nt, Homo sapiens
cacuuuuaauaaacuu

SEQ ID NO: 604674 - RNA, 15 nt, Homo sapiens
cacuuuucaaaagaa

SEQ ID NO: 604675 - RNA, 23 nt, Homo sapiens
cacuuuugaagaggccuaaguca

SEQ ID NO: 604676 - RNA, 19 nt, Homo sapiens
cacuuuuuccauuucuuca

SEQ ID NO: 604677 - RNA, 21 nt, Homo sapiens
cacuuuuuuuauaagcaaaaa

SEQ ID NO: 604678 - RNA, 19 nt, Homo sapiens
cagaaaaaaauaacuauuu

SEQ ID NO: 604679 - RNA, 14 nt, Homo sapiens
cagaaaaaugucau

SEQ ID NO: 604680 - RNA, 14 nt, Homo sapiens
cagaaaacaaaaaa

SEQ ID NO: 604681 - RNA, 18 nt, Homo sapiens
cagaaacacucaaguuga

SEQ ID NO: 604682 - RNA, 15 nt, Homo sapiens
cagaaacagugugca

SEQ ID NO: 604683 - RNA, 21 nt, Homo sapiens
cagaaaccuuccugcugagcc

SEQ ID NO: 604684 - RNA, 15 nt, Homo sapiens
cagaaacuacauuuc

SEQ ID NO: 604685 - RNA, 20 nt, Homo sapiens
cagaaagaauaaaauaggaa

SEQ ID NO: 604686 - RNA, 19 nt, Homo sapiens
cagaaagccaacauguggc

SEQ ID NO: 604687 - RNA, 22 nt, Homo sapiens
cagaaagggauugcuuugcauu

SEQ ID NO: 604688 - RNA, 19 nt, Homo sapiens
cagaaaguggccaugccac

SEQ ID NO: 604689 - RNA, 19 nt, Homo sapiens
cagaaauaaagagcuguua

SEQ ID NO: 604690 - RNA, 23 nt, Homo sapiens
cagaaauaacagcuggggacaac

SEQ ID NO: 604691 - RNA, 22 nt, Homo sapiens
cagaaauacagucuuccacaaa

SEQ ID NO: 604692 - RNA, 19 nt, Homo sapiens
cagaaaucuagaagacugu

SEQ ID NO: 604693 - RNA, 20 nt, Homo sapiens
cagaaaugauuacuaaggaa

SEQ ID NO: 604694 - RNA, 17 nt, Homo sapiens
cagaaaugcauuuguaa

SEQ ID NO: 604695 - RNA, 18 nt, Homo sapiens
cagaaaugcccccauucu

SEQ ID NO: 604696 - RNA, 12 nt, Homo sapiens
cagaaaugcugc

SEQ ID NO: 604697 - RNA, 22 nt, Homo sapiens
cagaaaugcugccugccugucu

SEQ ID NO: 604698 - RNA, 18 nt, Homo sapiens
cagaaauuaaaugaauuu

SEQ ID NO: 604699 - RNA, 19 nt, Homo sapiens
cagaaauuccaacuccuga

SEQ ID NO: 604700 - RNA, 22 nt, Homo sapiens
cagaaauugaaaaugaccaaaa

SEQ ID NO: 604701 - RNA, 23 nt, Homo sapiens
cagacaccucccccuacccauau

SEQ ID NO: 604702 - RNA, 21 nt, Homo sapiens
cagacaccuccuucuuccuag

SEQ ID NO: 604703 - RNA, 15 nt, Homo sapiens
cagacacgauugaga

SEQ ID NO: 604704 - RNA, 16 nt, Homo sapiens
cagacacuaaguuaua

SEQ ID NO: 604705 - RNA, 20 nt, Homo sapiens
cagacacuacaugaugacuc

SEQ ID NO: 604706 - RNA, 20 nt, Homo sapiens
cagacacuggcauggauaua

SEQ ID NO: 604707 - RNA, 18 nt, Homo sapiens
cagacagaagucuccuca

SEQ ID NO: 604708 - RNA, 19 nt, Homo sapiens
cagacagaagucuccucaa

SEQ ID NO: 604709 - RNA, 22 nt, Homo sapiens
cagacaggaggaaucaugucag

SEQ ID NO: 604710 - RNA, 18 nt, Homo sapiens
cagacauacaaacauaag

SEQ ID NO: 604711 - RNA, 22 nt, Homo sapiens
cagacaucgguguucuucuucc

SEQ ID NO: 604712 - RNA, 22 nt, Homo sapiens
cagacaucuccagugugccaga

SEQ ID NO: 604713 - RNA, 18 nt, Homo sapiens
cagacaucucuggagcca

SEQ ID NO: 604714 - RNA, 12 nt, Homo sapiens
cagacauuccaa

SEQ ID NO: 604715 - RNA, 15 nt, Homo sapiens
cagaccaacuacccc

SEQ ID NO: 604716 - RNA, 12 nt, Homo sapiens
cagaccacugau

SEQ ID NO: 604717 - RNA, 21 nt, Homo sapiens
cagaccagaccccaaaccagc

SEQ ID NO: 604718 - RNA, 14 nt, Homo sapiens
cagaccaguacugg

SEQ ID NO: 604719 - RNA, 16 nt, Homo sapiens
cagaccaguacuggga

SEQ ID NO: 604720 - RNA, 19 nt, Homo sapiens
cagaccauucaggacacag

SEQ ID NO: 604721 - RNA, 22 nt, Homo sapiens
cagacccacugaaaugaccaag

SEQ ID NO: 604722 - RNA, 15 nt, Homo sapiens
cagacccagucccac

SEQ ID NO: 604723 - RNA, 18 nt, Homo sapiens
cagaccccacgcugacca

SEQ ID NO: 604724 - RNA, 20 nt, Homo sapiens
cagacccccacucucauucc

SEQ ID NO: 604725 - RNA, 14 nt, Homo sapiens
cagacccccagugu

SEQ ID NO: 604726 - RNA, 23 nt, Homo sapiens
cagacccccccauuucccgcaca

SEQ ID NO: 604727 - RNA, 17 nt, Homo sapiens
cagacccccuccacggu

SEQ ID NO: 604728 - RNA, 15 nt, Homo sapiens
cagacccugaaccca

SEQ ID NO: 604729 - RNA, 17 nt, Homo sapiens
cagaccuacugcacuga

SEQ ID NO: 604730 - RNA, 13 nt, Homo sapiens
cagaccucaugcc

SEQ ID NO: 604731 - RNA, 16 nt, Homo sapiens
cagaccucuucuaaga

SEQ ID NO: 604732 - RNA, 19 nt, Homo sapiens
cagaccugguucccacuga

SEQ ID NO: 604733 - RNA, 17 nt, Homo sapiens
cagacggaaaugaaauu

SEQ ID NO: 604734 - RNA, 21 nt, Homo sapiens
cagacgggcacacagacugga

SEQ ID NO: 604735 - RNA, 17 nt, Homo sapiens
cagacgggucugagacu

SEQ ID NO: 604736 - RNA, 20 nt, Homo sapiens
cagacgggucugagacugaa

SEQ ID NO: 604737 - RNA, 19 nt, Homo sapiens
cagacuaagaaauauucca

SEQ ID NO: 604738 - RNA, 13 nt, Homo sapiens
cagacucaaggag

SEQ ID NO: 604739 - RNA, 17 nt, Homo sapiens
cagacucacauccugac

SEQ ID NO: 604740 - RNA, 15 nt, Homo sapiens
cagacucacugggaa

SEQ ID NO: 604741 - RNA, 12 nt, Homo sapiens
cagacuccaaaa

SEQ ID NO: 604742 - RNA, 13 nt, Homo sapiens
cagacuccaaaag

SEQ ID NO: 604743 - RNA, 15 nt, Homo sapiens
cagacuccaaaaggc

SEQ ID NO: 604744 - RNA, 17 nt, Homo sapiens
cagacucgcuagcacuc

SEQ ID NO: 604745 - RNA, 15 nt, Homo sapiens
cagacucgggaccaa

SEQ ID NO: 604746 - RNA, 20 nt, Homo sapiens
cagacucuagugcuacauga

SEQ ID NO: 604747 - RNA, 13 nt, Homo sapiens
cagacucuuggcu

SEQ ID NO: 604748 - RNA, 19 nt, Homo sapiens
cagacugacccccaucuga

SEQ ID NO: 604749 - RNA, 13 nt, Homo sapiens
cagacuggcaaua

SEQ ID NO: 604750 - RNA, 15 nt, Homo sapiens
cagacuggcaauaaa

SEQ ID NO: 604751 - RNA, 19 nt, Homo sapiens
cagacuggcaauaaacucc

SEQ ID NO: 604752 - RNA, 20 nt, Homo sapiens
cagacuggcaauaaacuccu

SEQ ID NO: 604753 - RNA, 16 nt, Homo sapiens
cagacugucaagaaga

SEQ ID NO: 604754 - RNA, 16 nt, Homo sapiens
cagacugugucuuauu

SEQ ID NO: 604755 - RNA, 21 nt, Homo sapiens
cagacugugucuuauucuccc

SEQ ID NO: 604756 - RNA, 21 nt, Homo sapiens
cagacuguuagaaaauggaca

SEQ ID NO: 604757 - RNA, 15 nt, Homo sapiens
cagacuuccuugaga

SEQ ID NO: 604758 - RNA, 13 nt, Homo sapiens
cagacuuggagua

SEQ ID NO: 604759 - RNA, 23 nt, Homo sapiens
cagacuuggaguaaaacuguaua

SEQ ID NO: 604760 - RNA, 21 nt, Homo sapiens
cagacuugguccuaagcaccu

SEQ ID NO: 604761 - RNA, 18 nt, Homo sapiens
cagacuuuaaaauucuaa

SEQ ID NO: 604762 - RNA, 16 nt, Homo sapiens
cagacuuugcugcauu

SEQ ID NO: 604763 - RNA, 19 nt, Homo sapiens
cagacuuuguguucauuuc

SEQ ID NO: 604764 - RNA, 17 nt, Homo sapiens
cagagaaaaaugcuccc

SEQ ID NO: 604765 - RNA, 18 nt, Homo sapiens
cagagaaacuuaagcaaa

SEQ ID NO: 604766 - RNA, 18 nt, Homo sapiens
cagagaaagaaaaggcaa

SEQ ID NO: 604767 - RNA, 17 nt, Homo sapiens
cagagaaagaagagaca

SEQ ID NO: 604768 - RNA, 16 nt, Homo sapiens
cagagaaagaaguccu

SEQ ID NO: 604769 - RNA, 20 nt, Homo sapiens
cagagaaaggguaauuuccu

SEQ ID NO: 604770 - RNA, 16 nt, Homo sapiens
cagagaaauacuuuca

SEQ ID NO: 604771 - RNA, 19 nt, Homo sapiens
cagagaaauacuuucaggc

SEQ ID NO: 604772 - RNA, 22 nt, Homo sapiens
cagagaaccuuuagaauaucuu

SEQ ID NO: 604773 - RNA, 19 nt, Homo sapiens
cagagaacugccuuaaaaa

SEQ ID NO: 604774 - RNA, 13 nt, Homo sapiens
cagagaagccagg

SEQ ID NO: 604775 - RNA, 22 nt, Homo sapiens
cagagaagcggauuuccaggga

SEQ ID NO: 604776 - RNA, 21 nt, Homo sapiens
cagagaaggaaaagacugaau

SEQ ID NO: 604777 - RNA, 17 nt, Homo sapiens
cagagacacuguugaua

SEQ ID NO: 604778 - RNA, 18 nt, Homo sapiens
cagagacagauaccucca

SEQ ID NO: 604779 - RNA, 18 nt, Homo sapiens
cagagacaggcccaagag

SEQ ID NO: 604780 - RNA, 19 nt, Homo sapiens
cagagaccacaccacuaac

SEQ ID NO: 604781 - RNA, 14 nt, Homo sapiens
cagagacccaacag

SEQ ID NO: 604782 - RNA, 18 nt, Homo sapiens
cagagacccaagcugccu

SEQ ID NO: 604783 - RNA, 16 nt, Homo sapiens
cagagacuaucugauu

SEQ ID NO: 604784 - RNA, 16 nt, Homo sapiens
cagagacugaauagau

SEQ ID NO: 604785 - RNA, 21 nt, Homo sapiens
cagagacugggaugggaacac

SEQ ID NO: 604786 - RNA, 17 nt, Homo sapiens
cagagagacagacuuga

SEQ ID NO: 604787 - RNA, 16 nt, Homo sapiens
cagagagagcucugca

SEQ ID NO: 604788 - RNA, 15 nt, Homo sapiens
cagagagcagcuuca

SEQ ID NO: 604789 - RNA, 19 nt, Homo sapiens
cagagaggcacucagugag

SEQ ID NO: 604790 - RNA, 16 nt, Homo sapiens
cagagauaaaccaaua

SEQ ID NO: 604791 - RNA, 16 nt, Homo sapiens
cagagauaaagaccuu

SEQ ID NO: 604792 - RNA, 14 nt, Homo sapiens
cagagaugacuguc

SEQ ID NO: 604793 - RNA, 19 nt, Homo sapiens
cagagaugccuccaccgcu

SEQ ID NO: 604794 - RNA, 13 nt, Homo sapiens
cagagauuugaga

SEQ ID NO: 604795 - RNA, 20 nt, Homo sapiens
cagagcaagacuccaucuca

SEQ ID NO: 604796 - RNA, 13 nt, Homo sapiens
cagagcaagugag

SEQ ID NO: 604797 - RNA, 16 nt, Homo sapiens
cagagcacacuuauuu

SEQ ID NO: 604798 - RNA, 12 nt, Homo sapiens
cagagcacagau

SEQ ID NO: 604799 - RNA, 17 nt, Homo sapiens
cagagcacccccugcuc

SEQ ID NO: 604800 - RNA, 21 nt, Homo sapiens
cagagcaccuuugcacaggau

SEQ ID NO: 604801 - RNA, 11 nt, Homo sapiens
cagagcacugg

SEQ ID NO: 604802 - RNA, 18 nt, Homo sapiens
cagagcacuuugcaacuc

SEQ ID NO: 604803 - RNA, 21 nt, Homo sapiens
cagagcagcuuggcccaggga

SEQ ID NO: 604804 - RNA, 18 nt, Homo sapiens
cagagcaggaagcauuca

SEQ ID NO: 604805 - RNA, 19 nt, Homo sapiens
cagagcaggcaauuucacc

SEQ ID NO: 604806 - RNA, 15 nt, Homo sapiens
cagagcaggggcucc

SEQ ID NO: 604807 - RNA, 19 nt, Homo sapiens
cagagcauuuaagagugaa

SEQ ID NO: 604808 - RNA, 16 nt, Homo sapiens
cagagcauuucaauua

SEQ ID NO: 604809 - RNA, 23 nt, Homo sapiens
cagagcauuuccaacaccacaga

SEQ ID NO: 604810 - RNA, 14 nt, Homo sapiens
cagagccagucuca

SEQ ID NO: 604811 - RNA, 21 nt, Homo sapiens
cagagccggccgccuucuccc

SEQ ID NO: 604812 - RNA, 14 nt, Homo sapiens
cagagccucuggcc

SEQ ID NO: 604813 - RNA, 19 nt, Homo sapiens
cagagccucugggggaaaa

SEQ ID NO: 604814 - RNA, 20 nt, Homo sapiens
cagagcgagacuccgucuca

SEQ ID NO: 604815 - RNA, 20 nt, Homo sapiens
cagagcgagagucugucuca

SEQ ID NO: 604816 - RNA, 20 nt, Homo sapiens
cagagcgagauuccgucuca

SEQ ID NO: 604817 - RNA, 20 nt, Homo sapiens
cagagcgagauuccgucuua

SEQ ID NO: 604818 - RNA, 20 nt, Homo sapiens
cagagcgaggaaaggauuuu

SEQ ID NO: 604819 - RNA, 18 nt, Homo sapiens
cagagcgauggagcaguc

SEQ ID NO: 604820 - RNA, 20 nt, Homo sapiens
cagagcgcaagcugggagca

SEQ ID NO: 604821 - RNA, 20 nt, Homo sapiens
cagagcgccaggaagccaga

SEQ ID NO: 604822 - RNA, 21 nt, Homo sapiens
cagagcgccaggaagccagag

SEQ ID NO: 604823 - RNA, 18 nt, Homo sapiens
cagcagcacaaacauugc

SEQ ID NO: 604824 - RNA, 12 nt, Homo sapiens
cagcagcacugu

SEQ ID NO: 604825 - RNA, 20 nt, Homo sapiens
cagcagccagcucucagcca

SEQ ID NO: 604826 - RNA, 16 nt, Homo sapiens
cagcagcccuaaggau

SEQ ID NO: 604827 - RNA, 23 nt, Homo sapiens
cagcagcccuaaggaucucucag

SEQ ID NO: 604828 - RNA, 17 nt, Homo sapiens
cagcagcccugccccac

SEQ ID NO: 604829 - RNA, 12 nt, Homo sapiens
cagcagcucaua

SEQ ID NO: 604830 - RNA, 17 nt, Homo sapiens
cagcagcugaacagcca

SEQ ID NO: 604831 - RNA, 22 nt, Homo sapiens
cagcagcuucaccagagcauuu

SEQ ID NO: 604832 - RNA, 17 nt, Homo sapiens
cagcaggagcucugacu

SEQ ID NO: 604833 - RNA, 19 nt, Homo sapiens
cagcaggcucaggcacaua

SEQ ID NO: 604834 - RNA, 19 nt, Homo sapiens
cagcaggcuccuggcugug

SEQ ID NO: 604835 - RNA, 17 nt, Homo sapiens
cagcaggggggcugugc

SEQ ID NO: 604836 - RNA, 15 nt, Homo sapiens
cagcaggugcucaau

SEQ ID NO: 604837 - RNA, 13 nt, Homo sapiens
cagcaggugcuga

SEQ ID NO: 604838 - RNA, 14 nt, Homo sapiens
cagcagugaguaau

SEQ ID NO: 604839 - RNA, 14 nt, Homo sapiens
cagcagugaucuca

SEQ ID NO: 604840 - RNA, 14 nt, Homo sapiens
cagcagugccuugu

SEQ ID NO: 604841 - RNA, 11 nt, Homo sapiens
cagcagugggg

SEQ ID NO: 604842 - RNA, 20 nt, Homo sapiens
cagcaguugaucagacugaa

SEQ ID NO: 604843 - RNA, 20 nt, Homo sapiens
cagcauacauuuucuggugg

SEQ ID NO: 604844 - RNA, 14 nt, Homo sapiens
cagcauacuucaaa

SEQ ID NO: 604845 - RNA, 24 nt, Homo sapiens
cagcauagggucacuuugccauua

SEQ ID NO: 604846 - RNA, 21 nt, Homo sapiens
cagcaucgugaucacugagcc

SEQ ID NO: 604847 - RNA, 14 nt, Homo sapiens
cagcaucuuuaaca

SEQ ID NO: 604848 - RNA, 12 nt, Homo sapiens
cagcaugaauaa

SEQ ID NO: 604849 - RNA, 19 nt, Homo sapiens
cagcaugagugcugagaua

SEQ ID NO: 604850 - RNA, 15 nt, Homo sapiens
cagcauuaccacagc

SEQ ID NO: 604851 - RNA, 23 nt, Homo sapiens
cagcauuagagaaaugaauuaua

SEQ ID NO: 604852 - RNA, 16 nt, Homo sapiens
cagcauuauucuucag

SEQ ID NO: 604853 - RNA, 16 nt, Homo sapiens
cagcauuccaugacca

SEQ ID NO: 604854 - RNA, 14 nt, Homo sapiens
cagcauuuccacac

SEQ ID NO: 604855 - RNA, 16 nt, Homo sapiens
cagcauuugauuaaca

SEQ ID NO: 604856 - RNA, 16 nt, Homo sapiens
cagccaacgagacaca

SEQ ID NO: 604857 - RNA, 14 nt, Homo sapiens
cagccaacugcccc

SEQ ID NO: 604858 - RNA, 14 nt, Homo sapiens
cagccaaguuuuau

SEQ ID NO: 604859 - RNA, 22 nt, Homo sapiens
cagccaaguuuuauaauccuua

SEQ ID NO: 604860 - RNA, 22 nt, Homo sapiens
cagccacacugugggacucuuc

SEQ ID NO: 604861 - RNA, 22 nt, Homo sapiens
cagccacaguguuaugcucugu

SEQ ID NO: 604862 - RNA, 13 nt, Homo sapiens
cagccacauucua

SEQ ID NO: 604863 - RNA, 19 nt, Homo sapiens
cagccaccacccucaggug

SEQ ID NO: 604864 - RNA, 20 nt, Homo sapiens
cagccaccagggaguggcca

SEQ ID NO: 604865 - RNA, 15 nt, Homo sapiens
cagccaccccugcca

SEQ ID NO: 604866 - RNA, 15 nt, Homo sapiens
cagccacccugaguu

SEQ ID NO: 604867 - RNA, 15 nt, Homo sapiens
cagccacgcugauaa

SEQ ID NO: 604868 - RNA, 13 nt, Homo sapiens
cagccacuucugc

SEQ ID NO: 604869 - RNA, 15 nt, Homo sapiens
cagccacuucugcag

SEQ ID NO: 604870 - RNA, 15 nt, Homo sapiens
cagccagagcugugc

SEQ ID NO: 604871 - RNA, 21 nt, Homo sapiens
cagccagaggguagggcacaa

SEQ ID NO: 604872 - RNA, 18 nt, Homo sapiens
cagccagcccauggcccc

SEQ ID NO: 604873 - RNA, 19 nt, Homo sapiens
cagccaggacaucucugcc

SEQ ID NO: 604874 - RNA, 13 nt, Homo sapiens
cagccaggagugc

SEQ ID NO: 604875 - RNA, 16 nt, Homo sapiens
cagccaggcccugaga

SEQ ID NO: 604876 - RNA, 14 nt, Homo sapiens
cagccaggccgaga

SEQ ID NO: 604877 - RNA, 12 nt, Homo sapiens
cagccaggcuau

SEQ ID NO: 604878 - RNA, 13 nt, Homo sapiens
cagccagggccag

SEQ ID NO: 604879 - RNA, 23 nt, Homo sapiens
cagccagugccauuccacuccac

SEQ ID NO: 604880 - RNA, 21 nt, Homo sapiens
cagccaguuuuacugugauuc

SEQ ID NO: 604881 - RNA, 18 nt, Homo sapiens
cagccauaagaaagcacu

SEQ ID NO: 604882 - RNA, 18 nt, Homo sapiens
cagccaucaagagacuga

SEQ ID NO: 604883 - RNA, 17 nt, Homo sapiens
cagccaucguccuggga

SEQ ID NO: 604884 - RNA, 23 nt, Homo sapiens
cagccauuguggaagacagugug

SEQ ID NO: 604885 - RNA, 13 nt, Homo sapiens
cagccauuugcca

SEQ ID NO: 604886 - RNA, 16 nt, Homo sapiens
cagcccaaaacccagg

SEQ ID NO: 604887 - RNA, 18 nt, Homo sapiens
cagcccaaccuucacauc

SEQ ID NO: 604888 - RNA, 17 nt, Homo sapiens
cagcccaaucugccaga

SEQ ID NO: 604889 - RNA, 20 nt, Homo sapiens
cagcccacagagccugaauu

SEQ ID NO: 604890 - RNA, 19 nt, Homo sapiens
cagcccaccucaacccaga

SEQ ID NO: 604891 - RNA, 17 nt, Homo sapiens
cagcccagagacuuugu

SEQ ID NO: 604892 - RNA, 16 nt, Homo sapiens
cagcccaggacucuaa

SEQ ID NO: 604893 - RNA, 13 nt, Homo sapiens
cagcccaucucaa

SEQ ID NO: 604894 - RNA, 11 nt, Homo sapiens
cagcccauucu

SEQ ID NO: 604895 - RNA, 17 nt, Homo sapiens
cagccccaacuccaggg

SEQ ID NO: 604896 - RNA, 18 nt, Homo sapiens
cagccccaacuccagggg

SEQ ID NO: 604897 - RNA, 15 nt, Homo sapiens
cagccccaagcuggg

SEQ ID NO: 604898 - RNA, 21 nt, Homo sapiens
cagccccagagugcuuuaaaa

SEQ ID NO: 604899 - RNA, 17 nt, Homo sapiens
cagccccgaugauucuu

SEQ ID NO: 604900 - RNA, 15 nt, Homo sapiens
cagccccgccuguca

SEQ ID NO: 604901 - RNA, 17 nt, Homo sapiens
cagccccgccugucaca

SEQ ID NO: 604902 - RNA, 23 nt, Homo sapiens
cagccccuagaaacccaagcucc

SEQ ID NO: 604903 - RNA, 16 nt, Homo sapiens
cagccccugaucucug

SEQ ID NO: 604904 - RNA, 21 nt, Homo sapiens
cagccccuuauuugcacuuca

SEQ ID NO: 604905 - RNA, 14 nt, Homo sapiens
cagcccggcugcug

SEQ ID NO: 604906 - RNA, 19 nt, Homo sapiens
cagcccgugcacccuggaa

SEQ ID NO: 604907 - RNA, 21 nt, Homo sapiens
cagcccuacaacaaccugaag

SEQ ID NO: 604908 - RNA, 13 nt, Homo sapiens
cagcccuauggau

SEQ ID NO: 604909 - RNA, 13 nt, Homo sapiens
cagcccuccccau

SEQ ID NO: 604910 - RNA, 18 nt, Homo sapiens
cagcccuccuuaucaaag

SEQ ID NO: 604911 - RNA, 18 nt, Homo sapiens
cagcccugccgggcacau

SEQ ID NO: 604912 - RNA, 12 nt, Homo sapiens
cagcccuggugg

SEQ ID NO: 604913 - RNA, 15 nt, Homo sapiens
cagcccuuauggcca

SEQ ID NO: 604914 - RNA, 18 nt, Homo sapiens
cagccgccuuaagcugau

SEQ ID NO: 604915 - RNA, 15 nt, Homo sapiens
cagccguauuuuaca

SEQ ID NO: 604916 - RNA, 13 nt, Homo sapiens
cagccuagcacag

SEQ ID NO: 604917 - RNA, 16 nt, Homo sapiens
cagccuaugagcaucc

SEQ ID NO: 604918 - RNA, 13 nt, Homo sapiens
cagccucaagucu

SEQ ID NO: 604919 - RNA, 15 nt, Homo sapiens
cagccucagugccac

SEQ ID NO: 604920 - RNA, 14 nt, Homo sapiens
cagccucccaagua

SEQ ID NO: 604921 - RNA, 18 nt, Homo sapiens
cagccucccauccagggc

SEQ ID NO: 604922 - RNA, 23 nt, Homo sapiens
cagccuccccaguagcugggauu

SEQ ID NO: 604923 - RNA, 15 nt, Homo sapiens
cagccucccuuugau

SEQ ID NO: 604924 - RNA, 17 nt, Homo sapiens
cagccuccuccugacca

SEQ ID NO: 604925 - RNA, 22 nt, Homo sapiens
cagccuccuuuguguguauuca

SEQ ID NO: 604926 - RNA, 15 nt, Homo sapiens
cagccucugaaguug

SEQ ID NO: 604927 - RNA, 22 nt, Homo sapiens
cagccugagcaacagagugaga

SEQ ID NO: 604928 - RNA, 20 nt, Homo sapiens
cagccugcucuagugggaca

SEQ ID NO: 604929 - RNA, 21 nt, Homo sapiens
cagccuggccaacauggugaa

SEQ ID NO: 604930 - RNA, 21 nt, Homo sapiens
cagccuggccaguauggugaa

SEQ ID NO: 604931 - RNA, 18 nt, Homo sapiens
cagccuggccaucuggau

SEQ ID NO: 604932 - RNA, 17 nt, Homo sapiens
cagccuggccccugugc

SEQ ID NO: 604933 - RNA, 20 nt, Homo sapiens
cagccugggcaacacgguga

SEQ ID NO: 604934 - RNA, 18 nt, Homo sapiens
cagccugggcaacagagc

SEQ ID NO: 604935 - RNA, 20 nt, Homo sapiens
cagccuguaaacggugcuau

SEQ ID NO: 604936 - RNA, 18 nt, Homo sapiens
cagccugucccauggaca

SEQ ID NO: 604937 - RNA, 22 nt, Homo sapiens
cagccugugguuacagugcaga

SEQ ID NO: 604938 - RNA, 16 nt, Homo sapiens
cagccuuaugauuaaa

SEQ ID NO: 604939 - RNA, 12 nt, Homo sapiens
cagccuugcaca

SEQ ID NO: 604940 - RNA, 18 nt, Homo sapiens
cagccuugcacacccacu

SEQ ID NO: 604941 - RNA, 24 nt, Homo sapiens
cagccuuggagucuguucuaggga

SEQ ID NO: 604942 - RNA, 15 nt, Homo sapiens
cagccuuguuccuca

SEQ ID NO: 604943 - RNA, 21 nt, Homo sapiens
cagccuuucguucugcugacc

SEQ ID NO: 604944 - RNA, 12 nt, Homo sapiens
cagcgacacaga

SEQ ID NO: 604945 - RNA, 18 nt, Homo sapiens
cagcgaccucggugggcc

SEQ ID NO: 604946 - RNA, 13 nt, Homo sapiens
cagcgagaaggag

SEQ ID NO: 604947 - RNA, 13 nt, Homo sapiens
cagcgagccacag

SEQ ID NO: 604948 - RNA, 22 nt, Homo sapiens
cagcgaggugggagaggccuca

SEQ ID NO: 604949 - RNA, 17 nt, Homo sapiens
cagcgauguaugcagcu

SEQ ID NO: 604950 - RNA, 16 nt, Homo sapiens
cagcgauucccugugu

SEQ ID NO: 604951 - RNA, 22 nt, Homo sapiens
cagcgcccccaucugucuucag

SEQ ID NO: 604952 - RNA, 15 nt, Homo sapiens
cagcggcaaucuuuu

SEQ ID NO: 604953 - RNA, 18 nt, Homo sapiens
cagcggcccugucaucca

SEQ ID NO: 604954 - RNA, 16 nt, Homo sapiens
cagcggcucugguccu

SEQ ID NO: 604955 - RNA, 22 nt, Homo sapiens
cagcguuuuuaccuaggcacca

SEQ ID NO: 604956 - RNA, 23 nt, Homo sapiens
cagcuacauuccucagcugccaa

SEQ ID NO: 604957 - RNA, 21 nt, Homo sapiens
cagcuaccucuucuauggacu

SEQ ID NO: 604958 - RNA, 22 nt, Homo sapiens
cagcuacgugggaggcugaggc

SEQ ID NO: 604959 - RNA, 24 nt, Homo sapiens
cagcuacucaggaggcugaggcag

SEQ ID NO: 604960 - RNA, 14 nt, Homo sapiens
cagcuacugcaaau

SEQ ID NO: 604961 - RNA, 24 nt, Homo sapiens
cagcuacuuggaaggcugaggcag

SEQ ID NO: 604962 - RNA, 14 nt, Homo sapiens
cagcuagugccuuu

SEQ ID NO: 604963 - RNA, 17 nt, Homo sapiens
cagcuaucugcacucua

SEQ ID NO: 604964 - RNA, 20 nt, Homo sapiens
cagcuaucugucaucucucu

SEQ ID NO: 604965 - RNA, 20 nt, Homo sapiens
cagcuauguagcaaagggaa

SEQ ID NO: 604966 - RNA, 23 nt, Homo sapiens
cagcuauuuucaacauaacugaa

SEQ ID NO: 604967 - RNA, 23 nt, Homo sapiens
cagcucaacggaagaggcugcug

SEQ ID NO: 604968 - RNA, 11 nt, Homo sapiens
cagcucacuca

SEQ ID NO: 604969 - RNA, 17 nt, Homo sapiens
cagcucacucaucaaug

SEQ ID NO: 604970 - RNA, 12 nt, Homo sapiens
cagcucagcuca

SEQ ID NO: 604971 - RNA, 20 nt, Homo sapiens
cagcuccucccuuguucucu

SEQ ID NO: 604972 - RNA, 18 nt, Homo sapiens
cagcuccugccaggguga

SEQ ID NO: 604973 - RNA, 11 nt, Homo sapiens
cagcuccuugg

SEQ ID NO: 604974 - RNA, 20 nt, Homo sapiens
cagcuccuuuauuauaauca

SEQ ID NO: 604975 - RNA, 23 nt, Homo sapiens
cagcucuccccucagagugcaag

SEQ ID NO: 604976 - RNA, 16 nt, Homo sapiens
cagcucugggaacuga

SEQ ID NO: 604977 - RNA, 21 nt, Homo sapiens
cagcucuguaucugccaugug

SEQ ID NO: 604978 - RNA, 15 nt, Homo sapiens
cagcugaguuaugau

SEQ ID NO: 604979 - RNA, 20 nt, Homo sapiens
cagcugaugaacuguggugc

SEQ ID NO: 604980 - RNA, 16 nt, Homo sapiens
cagcugcaccagcagg

SEQ ID NO: 604981 - RNA, 14 nt, Homo sapiens
cagcugcaccugcc

SEQ ID NO: 604982 - RNA, 15 nt, Homo sapiens
cagcugcaccugcca

SEQ ID NO: 604983 - RNA, 20 nt, Homo sapiens
cagcugcagaccaugccaga

SEQ ID NO: 604984 - RNA, 17 nt, Homo sapiens
cagcugcagcugaucca

SEQ ID NO: 604985 - RNA, 18 nt, Homo sapiens
cagcugccagagaagcau

SEQ ID NO: 604986 - RNA, 16 nt, Homo sapiens
cagcugccucugcucc

SEQ ID NO: 604987 - RNA, 19 nt, Homo sapiens
cagcugccuuggacugugu

SEQ ID NO: 604988 - RNA, 16 nt, Homo sapiens
cagcugcgcuugcuuu

SEQ ID NO: 604989 - RNA, 17 nt, Homo sapiens
cagcugcucccaaauaa

SEQ ID NO: 604990 - RNA, 15 nt, Homo sapiens
cagcugcucccacac

SEQ ID NO: 604991 - RNA, 21 nt, Homo sapiens
cagcugcucccuggcauucaa

SEQ ID NO: 604992 - RNA, 12 nt, Homo sapiens
cagcugcuccua

SEQ ID NO: 604993 - RNA, 12 nt, Homo sapiens
cagcugcugacu

SEQ ID NO: 604994 - RNA, 22 nt, Homo sapiens
cagcuggccgggagccugauca

SEQ ID NO: 604995 - RNA, 14 nt, Homo sapiens
cagcuggcucugac

SEQ ID NO: 604996 - RNA, 17 nt, Homo sapiens
cagcugggaagcccuuu

SEQ ID NO: 604997 - RNA, 16 nt, Homo sapiens
cagcugggcaaagcca

SEQ ID NO: 604998 - RNA, 14 nt, Homo sapiens
cagcugggccucug

SEQ ID NO: 604999 - RNA, 15 nt, Homo sapiens
cagcuggucuuuucu

SEQ ID NO: 605000 - RNA, 22 nt, Homo sapiens
cagcuggugucggcaucauacu

SEQ ID NO: 605001 - RNA, 16 nt, Homo sapiens
cagcugguugcuccau

SEQ ID NO: 605002 - RNA, 20 nt, Homo sapiens
cagcuguaaucccagcacuu

SEQ ID NO: 605003 - RNA, 21 nt, Homo sapiens
cagcuguauuuuggcuuucuc

SEQ ID NO: 605004 - RNA, 15 nt, Homo sapiens
cagcuguguggugcu

SEQ ID NO: 605005 - RNA, 16 nt, Homo sapiens
cagcuguuacuuucuu

SEQ ID NO: 605006 - RNA, 20 nt, Homo sapiens
cagcuguuuaugcauagaua

SEQ ID NO: 605007 - RNA, 21 nt, Homo sapiens
cagcuuaagaguccaacucac

SEQ ID NO: 605008 - RNA, 18 nt, Homo sapiens
cagcuuauagucuuccag

SEQ ID NO: 605009 - RNA, 13 nt, Homo sapiens
cagcuuauauuca

SEQ ID NO: 605010 - RNA, 12 nt, Homo sapiens
cagcuuaucucu

SEQ ID NO: 605011 - RNA, 20 nt, Homo sapiens
cagcuucaccagagcauuuc

SEQ ID NO: 605012 - RNA, 21 nt, Homo sapiens
cagcuucaccagagcauuucc

SEQ ID NO: 605013 - RNA, 19 nt, Homo sapiens
cagcuucucucuccagggu

SEQ ID NO: 605014 - RNA, 21 nt, Homo sapiens
cagcuucugauaaacacaauc

SEQ ID NO: 605015 - RNA, 13 nt, Homo sapiens
cagcuucugggac

SEQ ID NO: 605016 - RNA, 21 nt, Homo sapiens
cagcuugaaaccuucacuuag

SEQ ID NO: 605017 - RNA, 16 nt, Homo sapiens
cagcuugcucuucagu

SEQ ID NO: 605018 - RNA, 19 nt, Homo sapiens
cagcuuguggcaagugaau

SEQ ID NO: 605019 - RNA, 16 nt, Homo sapiens
cagcuuucugggaugu

SEQ ID NO: 605020 - RNA, 16 nt, Homo sapiens
cagcuuucugugcaga

SEQ ID NO: 605021 - RNA, 14 nt, Homo sapiens
cagcuuuugcaacu

SEQ ID NO: 605022 - RNA, 21 nt, Homo sapiens
cagcuuuuuauucccugccca

SEQ ID NO: 605023 - RNA, 18 nt, Homo sapiens
caggaaaaaaaauucugu

SEQ ID NO: 605024 - RNA, 21 nt, Homo sapiens
caggaaaauguauccagagga

SEQ ID NO: 605025 - RNA, 19 nt, Homo sapiens
caggaaacaugaagcauaa

SEQ ID NO: 605026 - RNA, 19 nt, Homo sapiens
caggaaacauucagugaaa

SEQ ID NO: 605027 - RNA, 22 nt, Homo sapiens
caggaaaccuuggccucugcua

SEQ ID NO: 605028 - RNA, 16 nt, Homo sapiens
caggaaagaagcauuu

SEQ ID NO: 605029 - RNA, 21 nt, Homo sapiens
caggaaagcuggugucugauu

SEQ ID NO: 605030 - RNA, 23 nt, Homo sapiens
caggaaaggccccaaucuugccc

SEQ ID NO: 605031 - RNA, 20 nt, Homo sapiens
caggaaaguuuacccaugaa

SEQ ID NO: 605032 - RNA, 22 nt, Homo sapiens
caggaaauuagauaaauaaaaa

SEQ ID NO: 605033 - RNA, 13 nt, Homo sapiens
caggaacaaacag

SEQ ID NO: 605034 - RNA, 20 nt, Homo sapiens
caggaacagcaaaugcaaaa

SEQ ID NO: 605035 - RNA, 13 nt, Homo sapiens
caggaacauacag

SEQ ID NO: 605036 - RNA, 18 nt, Homo sapiens
caggaacauacagacaca

SEQ ID NO: 605037 - RNA, 20 nt, Homo sapiens
caggaacccuccuccuguca

SEQ ID NO: 605038 - RNA, 14 nt, Homo sapiens
caggaacuugcaca

SEQ ID NO: 605039 - RNA, 23 nt, Homo sapiens
caggaacuugcacaaaaucacac

SEQ ID NO: 605040 - RNA, 19 nt, Homo sapiens
caggaagaagagaugcacu

SEQ ID NO: 605041 - RNA, 22 nt, Homo sapiens
caggaagaccaaggccucggca

SEQ ID NO: 605042 - RNA, 17 nt, Homo sapiens
caggaagcucucuuaaa

SEQ ID NO: 605043 - RNA, 16 nt, Homo sapiens
caggaaggacuaugaa

SEQ ID NO: 605044 - RNA, 17 nt, Homo sapiens
caggaagggagaacuug

SEQ ID NO: 605045 - RNA, 20 nt, Homo sapiens
caggaagggagaacuugaaa

SEQ ID NO: 605046 - RNA, 21 nt, Homo sapiens
caggaagggcaggaaggagag

SEQ ID NO: 605047 - RNA, 15 nt, Homo sapiens
caggaagguagaaau

SEQ ID NO: 605048 - RNA, 16 nt, Homo sapiens
caggaaggucuucaau

SEQ ID NO: 605049 - RNA, 15 nt, Homo sapiens
caggaaguacuucca

SEQ ID NO: 605050 - RNA, 21 nt, Homo sapiens
caggaauaggcauuugccuaa

SEQ ID NO: 605051 - RNA, 16 nt, Homo sapiens
caggaauaugacacaa

SEQ ID NO: 605052 - RNA, 13 nt, Homo sapiens
caggaaucugauu

SEQ ID NO: 605053 - RNA, 13 nt, Homo sapiens
caggaaugcucug

SEQ ID NO: 605054 - RNA, 16 nt, Homo sapiens
caggaauuacacugug

SEQ ID NO: 605055 - RNA, 20 nt, Homo sapiens
caggacaacuuuacaaaaca

SEQ ID NO: 605056 - RNA, 18 nt, Homo sapiens
caggacacacauggugag

SEQ ID NO: 605057 - RNA, 21 nt, Homo sapiens
caggacacggggcaguggcaa

SEQ ID NO: 605058 - RNA, 18 nt, Homo sapiens
caggacagucagcucucu

SEQ ID NO: 605059 - RNA, 19 nt, Homo sapiens
caggacagucagcucucuc

SEQ ID NO: 605060 - RNA, 12 nt, Homo sapiens
caggaccaauaa

SEQ ID NO: 605061 - RNA, 12 nt, Homo sapiens
caggaccagcug

SEQ ID NO: 605062 - RNA, 16 nt, Homo sapiens
caggacccugggacca

SEQ ID NO: 605063 - RNA, 15 nt, Homo sapiens
caggaccuacuagga

SEQ ID NO: 605064 - RNA, 19 nt, Homo sapiens
caggaccucccuuccgacc

SEQ ID NO: 605065 - RNA, 14 nt, Homo sapiens
caggacgcccucac

SEQ ID NO: 605066 - RNA, 14 nt, Homo sapiens
caggacuccaucuc

SEQ ID NO: 605067 - RNA, 22 nt, Homo sapiens
caggacucugccuccucuucaa

SEQ ID NO: 605068 - RNA, 12 nt, Homo sapiens
caggacuguuga

SEQ ID NO: 605069 - RNA, 19 nt, Homo sapiens
caggacuuagaauagugcc

SEQ ID NO: 605070 - RNA, 14 nt, Homo sapiens
caggagaagaacaa

SEQ ID NO: 605071 - RNA, 15 nt, Homo sapiens
caggagaagcucagc

SEQ ID NO: 605072 - RNA, 18 nt, Homo sapiens
caggagaaucacuggaac

SEQ ID NO: 605073 - RNA, 17 nt, Homo sapiens
caggagacaaaagagca

SEQ ID NO: 605074 - RNA, 15 nt, Homo sapiens
caggagacauuacua

SEQ ID NO: 605075 - RNA, 18 nt, Homo sapiens
caggagaccuggcacugg

SEQ ID NO: 605076 - RNA, 22 nt, Homo sapiens
caggagaccuggcacuggaugc

SEQ ID NO: 605077 - RNA, 19 nt, Homo sapiens
caggagacuccaaggagcu

SEQ ID NO: 605078 - RNA, 21 nt, Homo sapiens
caggagacuuuacauggaugc

SEQ ID NO: 605079 - RNA, 19 nt, Homo sapiens
caggagauggguccagggg

SEQ ID NO: 605080 - RNA, 23 nt, Homo sapiens
caggagcaaauguuucugcagua

SEQ ID NO: 605081 - RNA, 17 nt, Homo sapiens
caggagcaggcacgggu

SEQ ID NO: 605082 - RNA, 21 nt, Homo sapiens
caggagcauguaugucugcag

SEQ ID NO: 605083 - RNA, 17 nt, Homo sapiens
caggagcugccauguca

SEQ ID NO: 605084 - RNA, 16 nt, Homo sapiens
caggaggaauacugaa

SEQ ID NO: 605085 - RNA, 18 nt, Homo sapiens
caggaggagaugaccagu

SEQ ID NO: 605086 - RNA, 18 nt, Homo sapiens
caggaggaucacuugagg

SEQ ID NO: 605087 - RNA, 20 nt, Homo sapiens
caggaggcagacaaugaccc

SEQ ID NO: 605088 - RNA, 22 nt, Homo sapiens
caggaggccaauaaaaaguuca

SEQ ID NO: 605089 - RNA, 20 nt, Homo sapiens
caggaggcccccaucuauga

SEQ ID NO: 605090 - RNA, 18 nt, Homo sapiens
caggagggcacuggagcu

SEQ ID NO: 605091 - RNA, 13 nt, Homo sapiens
caggaggggaaac

SEQ ID NO: 605092 - RNA, 21 nt, Homo sapiens
caggagggugacgcccagcuc

SEQ ID NO: 605093 - RNA, 22 nt, Homo sapiens
caggagguggaggcugcaguga

SEQ ID NO: 605094 - RNA, 22 nt, Homo sapiens
caggagguggagguugcaguga

SEQ ID NO: 605095 - RNA, 20 nt, Homo sapiens
caggaguaucuuaccuguaa

SEQ ID NO: 605096 - RNA, 20 nt, Homo sapiens
caggagucucugccacccac

SEQ ID NO: 605097 - RNA, 17 nt, Homo sapiens
caggaguggaaggugag

SEQ ID NO: 605098 - RNA, 22 nt, Homo sapiens
caggaguguaguuggaucucua

SEQ ID NO: 605099 - RNA, 17 nt, Homo sapiens
caggaguucaagaccag

SEQ ID NO: 605100 - RNA, 16 nt, Homo sapiens
caggaguuuugggaau

SEQ ID NO: 605101 - RNA, 19 nt, Homo sapiens
caggauaauauauuugcag

SEQ ID NO: 605102 - RNA, 23 nt, Homo sapiens
caggaucagaugacucucuccaa

SEQ ID NO: 605103 - RNA, 14 nt, Homo sapiens
caggauccagugac

SEQ ID NO: 605104 - RNA, 13 nt, Homo sapiens
caggaugaguuac

SEQ ID NO: 605105 - RNA, 19 nt, Homo sapiens
caggaugaguuacuugaaa

SEQ ID NO: 605106 - RNA, 17 nt, Homo sapiens
caggaugcagcacugcg

SEQ ID NO: 605107 - RNA, 12 nt, Homo sapiens
caggaugcuaau

SEQ ID NO: 605108 - RNA, 20 nt, Homo sapiens
caggauggucucgaucuccu

SEQ ID NO: 605109 - RNA, 20 nt, Homo sapiens
caggauggucucgaucucuu

SEQ ID NO: 605110 - RNA, 19 nt, Homo sapiens
caggaugguggacuacaaa

SEQ ID NO: 605111 - RNA, 14 nt, Homo sapiens
caggauugaaggug

SEQ ID NO: 605112 - RNA, 18 nt, Homo sapiens
caggauuuguuguucuga

SEQ ID NO: 605113 - RNA, 19 nt, Homo sapiens
caggcaaagacugcaguau

SEQ ID NO: 605114 - RNA, 17 nt, Homo sapiens
caggcaaagugcugcug

SEQ ID NO: 605115 - RNA, 14 nt, Homo sapiens
caggcaacgcacaa

SEQ ID NO: 605116 - RNA, 14 nt, Homo sapiens
caggcaacugaggc

SEQ ID NO: 605117 - RNA, 14 nt, Homo sapiens
caggcaaucuugcc

SEQ ID NO: 605118 - RNA, 20 nt, Homo sapiens
caggcacacacagccccuau

SEQ ID NO: 605119 - RNA, 17 nt, Homo sapiens
caggcacacaggucuca

SEQ ID NO: 605120 - RNA, 18 nt, Homo sapiens
caggcaccaccaggagca

SEQ ID NO: 605121 - RNA, 23 nt, Homo sapiens
caggcacgaacccaccugcugag

SEQ ID NO: 605122 - RNA, 12 nt, Homo sapiens
caggcacgugcc

SEQ ID NO: 605123 - RNA, 12 nt, Homo sapiens
caggcacuccaa

SEQ ID NO: 605124 - RNA, 19 nt, Homo sapiens
caggcacucuccugucuga

SEQ ID NO: 605125 - RNA, 19 nt, Homo sapiens
caggcagacuacacaggau

SEQ ID NO: 605126 - RNA, 22 nt, Homo sapiens
caggcagacuacacaggaugag

SEQ ID NO: 605127 - RNA, 18 nt, Homo sapiens
caggcagagaaucauacu

SEQ ID NO: 605128 - RNA, 19 nt, Homo sapiens
caggcagaucccacuugca

SEQ ID NO: 605129 - RNA, 20 nt, Homo sapiens
caggcagaucugugccccau

SEQ ID NO: 605130 - RNA, 16 nt, Homo sapiens
caggcagcagacugac

SEQ ID NO: 605131 - RNA, 21 nt, Homo sapiens
caggcagccaccaguggaccu

SEQ ID NO: 605132 - RNA, 23 nt, Homo sapiens
caggcagccagugugacacugcu

SEQ ID NO: 605133 - RNA, 18 nt, Homo sapiens
caggcagcgauggucuca

SEQ ID NO: 605134 - RNA, 15 nt, Homo sapiens
caggcagggugcagu

SEQ ID NO: 605135 - RNA, 18 nt, Homo sapiens
caggcagguuugccagug

SEQ ID NO: 605136 - RNA, 19 nt, Homo sapiens
caggcaguuaggugcugaa

SEQ ID NO: 605137 - RNA, 22 nt, Homo sapiens
caggcauuuguucacugaaggu

SEQ ID NO: 605138 - RNA, 14 nt, Homo sapiens
caggccaccaggau

SEQ ID NO: 605139 - RNA, 21 nt, Homo sapiens
caggccacccccauggaagca

SEQ ID NO: 605140 - RNA, 17 nt, Homo sapiens
caggccacuggggacag

SEQ ID NO: 605141 - RNA, 16 nt, Homo sapiens
caggccagagggcagu

SEQ ID NO: 605142 - RNA, 19 nt, Homo sapiens
caggccagcaauaaaaacu

SEQ ID NO: 605143 - RNA, 15 nt, Homo sapiens
caggccaggccagcu

SEQ ID NO: 605144 - RNA, 17 nt, Homo sapiens
caggccaggugcagugg

SEQ ID NO: 605145 - RNA, 13 nt, Homo sapiens
caggccagguggg

SEQ ID NO: 605146 - RNA, 15 nt, Homo sapiens
caggccauacuuuac

SEQ ID NO: 605147 - RNA, 20 nt, Homo sapiens
caggcccugcuccugcagca

SEQ ID NO: 605148 - RNA, 18 nt, Homo sapiens
caggccuaagacauguga

SEQ ID NO: 605149 - RNA, 16 nt, Homo sapiens
caggccucaccauucc

SEQ ID NO: 605150 - RNA, 17 nt, Homo sapiens
caggccucacuggcuca

SEQ ID NO: 605151 - RNA, 18 nt, Homo sapiens
caggccuccgucuuccca

SEQ ID NO: 605152 - RNA, 22 nt, Homo sapiens
caggccugaacccguccauuca

SEQ ID NO: 605153 - RNA, 14 nt, Homo sapiens
caggccugaccuca

SEQ ID NO: 605154 - RNA, 21 nt, Homo sapiens
caggccugcagacagaccuca

SEQ ID NO: 605155 - RNA, 16 nt, Homo sapiens
caggccuuacaucugg

SEQ ID NO: 605156 - RNA, 18 nt, Homo sapiens
caggccuuaccgcucugu

SEQ ID NO: 605157 - RNA, 19 nt, Homo sapiens
caggccuuaccgcucuguu

SEQ ID NO: 605158 - RNA, 13 nt, Homo sapiens
caggccuuaggga

SEQ ID NO: 605159 - RNA, 17 nt, Homo sapiens
caggccuugcugacucu

SEQ ID NO: 605160 - RNA, 14 nt, Homo sapiens
caggcgaugugcaa

SEQ ID NO: 605161 - RNA, 16 nt, Homo sapiens
caggcgaugugcaagu

SEQ ID NO: 605162 - RNA, 17 nt, Homo sapiens
caggcgcaguggcucau

SEQ ID NO: 605163 - RNA, 17 nt, Homo sapiens
caggcggcccucagugc

SEQ ID NO: 605164 - RNA, 14 nt, Homo sapiens
caggcuaaaugcac

SEQ ID NO: 605165 - RNA, 20 nt, Homo sapiens
caggcuacaaucuucauuua

SEQ ID NO: 605166 - RNA, 15 nt, Homo sapiens
caggcuagagugcaa

SEQ ID NO: 605167 - RNA, 15 nt, Homo sapiens
caggcuaugguugcc

SEQ ID NO: 605168 - RNA, 18 nt, Homo sapiens
caggcuaugguugccacc

SEQ ID NO: 605169 - RNA, 13 nt, Homo sapiens
caggcuccgcccu

SEQ ID NO: 605170 - RNA, 11 nt, Homo sapiens
caggcucucug

SEQ ID NO: 605171 - RNA, 20 nt, Homo sapiens
caggcucugggcacagugcu

SEQ ID NO: 605172 - RNA, 20 nt, Homo sapiens
caggcucuugacuacuugga

SEQ ID NO: 605173 - RNA, 22 nt, Homo sapiens
caggcugaccaggcgcccggga

SEQ ID NO: 605174 - RNA, 20 nt, Homo sapiens
caggcugcagucccuggaaa

SEQ ID NO: 605175 - RNA, 22 nt, Homo sapiens
caggcugccucggacuccaugg

SEQ ID NO: 605176 - RNA, 22 nt, Homo sapiens
caggcugcgucccuccgagcuu

SEQ ID NO: 605177 - RNA, 19 nt, Homo sapiens
caggcugcuggagugcagu

SEQ ID NO: 605178 - RNA, 12 nt, Homo sapiens
caggcuggagcu

SEQ ID NO: 605179 - RNA, 17 nt, Homo sapiens
caggcuggagugcagua

SEQ ID NO: 605180 - RNA, 20 nt, Homo sapiens
caggcuggagugcaguggca

SEQ ID NO: 605181 - RNA, 14 nt, Homo sapiens
caggcugggccaug

SEQ ID NO: 605182 - RNA, 22 nt, Homo sapiens
caggcugggccauguccaaaga

SEQ ID NO: 605183 - RNA, 23 nt, Homo sapiens
caggcugggccauguccaaagag

SEQ ID NO: 605184 - RNA, 17 nt, Homo sapiens
caggcugggcccugcau

SEQ ID NO: 605185 - RNA, 23 nt, Homo sapiens
caggcuguuggaaaauccagaac

SEQ ID NO: 605186 - RNA, 14 nt, Homo sapiens
caggcuuaugaaua

SEQ ID NO: 605187 - RNA, 18 nt, Homo sapiens
cauaguggaucacucacc

SEQ ID NO: 605188 - RNA, 11 nt, Homo sapiens
cauaguguacc

SEQ ID NO: 605189 - RNA, 17 nt, Homo sapiens
cauaguuuaaacugcau

SEQ ID NO: 605190 - RNA, 18 nt, Homo sapiens
cauaguuuaaacugcauu

SEQ ID NO: 605191 - RNA, 19 nt, Homo sapiens
cauauaaaagcuaugguga

SEQ ID NO: 605192 - RNA, 18 nt, Homo sapiens
cauauaaagguuaugaaa

SEQ ID NO: 605193 - RNA, 21 nt, Homo sapiens
cauauaaaucucaaugaauuc

SEQ ID NO: 605194 - RNA, 23 nt, Homo sapiens
cauauaacaauucaguaacaaag

SEQ ID NO: 605195 - RNA, 14 nt, Homo sapiens
cauauaaguuugaa

SEQ ID NO: 605196 - RNA, 16 nt, Homo sapiens
cauauaauguaaaaag

SEQ ID NO: 605197 - RNA, 13 nt, Homo sapiens
cauauaauguugu

SEQ ID NO: 605198 - RNA, 19 nt, Homo sapiens
cauauaauguuguuauuua

SEQ ID NO: 605199 - RNA, 12 nt, Homo sapiens
cauauaccagca

SEQ ID NO: 605200 - RNA, 16 nt, Homo sapiens
cauauaccagcaauau

SEQ ID NO: 605201 - RNA, 16 nt, Homo sapiens
cauauaccaucuccag

SEQ ID NO: 605202 - RNA, 21 nt, Homo sapiens
cauauaggccagaguugcaaa

SEQ ID NO: 605203 - RNA, 19 nt, Homo sapiens
cauauaggugauguuugcu

SEQ ID NO: 605204 - RNA, 20 nt, Homo sapiens
cauauauaagguaugugcua

SEQ ID NO: 605205 - RNA, 20 nt, Homo sapiens
cauauauacaggcauaaaau

SEQ ID NO: 605206 - RNA, 18 nt, Homo sapiens
cauauauauaguuaugca

SEQ ID NO: 605207 - RNA, 21 nt, Homo sapiens
cauauauauauacacauacau

SEQ ID NO: 605208 - RNA, 15 nt, Homo sapiens
cauauauauauguau

SEQ ID NO: 605209 - RNA, 14 nt, Homo sapiens
cauauauaugucag

SEQ ID NO: 605210 - RNA, 18 nt, Homo sapiens
cauauauaugucaggcaa

SEQ ID NO: 605211 - RNA, 13 nt, Homo sapiens
cauauaugcaaua

SEQ ID NO: 605212 - RNA, 14 nt, Homo sapiens
cauauaugcaauau

SEQ ID NO: 605213 - RNA, 19 nt, Homo sapiens
cauauauuuaauaugucaa

SEQ ID NO: 605214 - RNA, 19 nt, Homo sapiens
cauauauuuuuaccaucug

SEQ ID NO: 605215 - RNA, 19 nt, Homo sapiens
cauauccaggcaccaggac

SEQ ID NO: 605216 - RNA, 13 nt, Homo sapiens
cauauccuuucaa

SEQ ID NO: 605217 - RNA, 20 nt, Homo sapiens
cauaucguaaagcuguucaa

SEQ ID NO: 605218 - RNA, 14 nt, Homo sapiens
cauaucucuugccc

SEQ ID NO: 605219 - RNA, 19 nt, Homo sapiens
cauaucuggcucaacaucu

SEQ ID NO: 605220 - RNA, 13 nt, Homo sapiens
cauaucuugccuu

SEQ ID NO: 605221 - RNA, 13 nt, Homo sapiens
cauaucuuuauua

SEQ ID NO: 605222 - RNA, 11 nt, Homo sapiens
cauaugaacug

SEQ ID NO: 605223 - RNA, 16 nt, Homo sapiens
cauaugacuugaucuu

SEQ ID NO: 605224 - RNA, 16 nt, Homo sapiens
cauaugcagugauaua

SEQ ID NO: 605225 - RNA, 15 nt, Homo sapiens
cauaugcaugccagg

SEQ ID NO: 605226 - RNA, 16 nt, Homo sapiens
cauaugcuuuaagaau

SEQ ID NO: 605227 - RNA, 20 nt, Homo sapiens
cauauggagcucaugucagc

SEQ ID NO: 605228 - RNA, 11 nt, Homo sapiens
cauaugucacg

SEQ ID NO: 605229 - RNA, 20 nt, Homo sapiens
cauauguccauccauauaua

SEQ ID NO: 605230 - RNA, 23 nt, Homo sapiens
cauauguccauccauauauauuc

SEQ ID NO: 605231 - RNA, 15 nt, Homo sapiens
cauauuagugcagcc

SEQ ID NO: 605232 - RNA, 16 nt, Homo sapiens
cauauucaaugcaagu

SEQ ID NO: 605233 - RNA, 17 nt, Homo sapiens
cauauucaaugcaagua

SEQ ID NO: 605234 - RNA, 14 nt, Homo sapiens
cauauucauaugca

SEQ ID NO: 605235 - RNA, 18 nt, Homo sapiens
cauauucgauguacuuua

SEQ ID NO: 605236 - RNA, 23 nt, Homo sapiens
cauauucuaaguuagacucuucc

SEQ ID NO: 605237 - RNA, 22 nt, Homo sapiens
cauauucuuccccgaaucacac

SEQ ID NO: 605238 - RNA, 21 nt, Homo sapiens
cauauugcaggauucuguaau

SEQ ID NO: 605239 - RNA, 21 nt, Homo sapiens
cauauuggacugauaaucucu

SEQ ID NO: 605240 - RNA, 16 nt, Homo sapiens
cauauuggucacguca

SEQ ID NO: 605241 - RNA, 16 nt, Homo sapiens
cauauugugccaauau

SEQ ID NO: 605242 - RNA, 18 nt, Homo sapiens
cauauugugccaauaugu

SEQ ID NO: 605243 - RNA, 19 nt, Homo sapiens
cauauuguuugaucuacuu

SEQ ID NO: 605244 - RNA, 15 nt, Homo sapiens
cauauuuaacaugua

SEQ ID NO: 605245 - RNA, 13 nt, Homo sapiens
cauauuuacuucu

SEQ ID NO: 605246 - RNA, 15 nt, Homo sapiens
cauauuuauauugua

SEQ ID NO: 605247 - RNA, 16 nt, Homo sapiens
cauauuucauccagga

SEQ ID NO: 605248 - RNA, 13 nt, Homo sapiens
cauauuucuuugg

SEQ ID NO: 605249 - RNA, 22 nt, Homo sapiens
cauauuuguuuaugguaaaaaa

SEQ ID NO: 605250 - RNA, 18 nt, Homo sapiens
cauauuuuacugaucucu

SEQ ID NO: 605251 - RNA, 23 nt, Homo sapiens
cauauuuugguuuguguauccau

SEQ ID NO: 605252 - RNA, 19 nt, Homo sapiens
cauauuuuuuuuacuguca

SEQ ID NO: 605253 - RNA, 20 nt, Homo sapiens
caucaaaaaagauagaucua

SEQ ID NO: 605254 - RNA, 14 nt, Homo sapiens
caucaaaaagaaca

SEQ ID NO: 605255 - RNA, 21 nt, Homo sapiens
caucaaagcucacaccaaauu

SEQ ID NO: 605256 - RNA, 17 nt, Homo sapiens
caucaaagugguaaaua

SEQ ID NO: 605257 - RNA, 19 nt, Homo sapiens
caucaaauaaacucaaagu

SEQ ID NO: 605258 - RNA, 17 nt, Homo sapiens
caucaacaacacagcaa

SEQ ID NO: 605259 - RNA, 13 nt, Homo sapiens
caucaacuuaaaa

SEQ ID NO: 605260 - RNA, 17 nt, Homo sapiens
caucaagagacugaguc

SEQ ID NO: 605261 - RNA, 21 nt, Homo sapiens
caucaagaugagagaacugga

SEQ ID NO: 605262 - RNA, 16 nt, Homo sapiens
caucaaguugugccaa

SEQ ID NO: 605263 - RNA, 21 nt, Homo sapiens
caucaauucuuagaauaucua

SEQ ID NO: 605264 - RNA, 15 nt, Homo sapiens
caucacaacauuccu

SEQ ID NO: 605265 - RNA, 17 nt, Homo sapiens
caucacacucaaggaca

SEQ ID NO: 605266 - RNA, 12 nt, Homo sapiens
caucacacuggg

SEQ ID NO: 605267 - RNA, 16 nt, Homo sapiens
caucacaggacacggg

SEQ ID NO: 605268 - RNA, 21 nt, Homo sapiens
caucacccucuuccugugauc

SEQ ID NO: 605269 - RNA, 22 nt, Homo sapiens
caucaccuugauaaugggauga

SEQ ID NO: 605270 - RNA, 17 nt, Homo sapiens
caucacgcuacccagcu

SEQ ID NO: 605271 - RNA, 15 nt, Homo sapiens
caucacguaccccac

SEQ ID NO: 605272 - RNA, 20 nt, Homo sapiens
caucacuagccaugauaacu

SEQ ID NO: 605273 - RNA, 18 nt, Homo sapiens
caucacuccucugucaua

SEQ ID NO: 605274 - RNA, 14 nt, Homo sapiens
caucacucuuuaca

SEQ ID NO: 605275 - RNA, 17 nt, Homo sapiens
caucacuggacugcaug

SEQ ID NO: 605276 - RNA, 21 nt, Homo sapiens
caucacuggggcugggagcag

SEQ ID NO: 605277 - RNA, 20 nt, Homo sapiens
caucacuggguguugaucuu

SEQ ID NO: 605278 - RNA, 13 nt, Homo sapiens
caucacuuuguga

SEQ ID NO: 605279 - RNA, 14 nt, Homo sapiens
caucacuuugugaa

SEQ ID NO: 605280 - RNA, 20 nt, Homo sapiens
caucacuuugugaauuaaca

SEQ ID NO: 605281 - RNA, 19 nt, Homo sapiens
caucagacugucaagaaga

SEQ ID NO: 605282 - RNA, 14 nt, Homo sapiens
caucagagaggcaa

SEQ ID NO: 605283 - RNA, 18 nt, Homo sapiens
caucagagccagucucac

SEQ ID NO: 605284 - RNA, 23 nt, Homo sapiens
caucagagccagucucaccuuca

SEQ ID NO: 605285 - RNA, 14 nt, Homo sapiens
caucagcaagacuu

SEQ ID NO: 605286 - RNA, 16 nt, Homo sapiens
caucagcccaucucaa

SEQ ID NO: 605287 - RNA, 20 nt, Homo sapiens
caucagcugccacaacacca

SEQ ID NO: 605288 - RNA, 20 nt, Homo sapiens
caucaggcccgcuaggucca

SEQ ID NO: 605289 - RNA, 16 nt, Homo sapiens
caucaggcuguuauua

SEQ ID NO: 605290 - RNA, 11 nt, Homo sapiens
caucaguccau

SEQ ID NO: 605291 - RNA, 18 nt, Homo sapiens
caucagucuccaacaugu

SEQ ID NO: 605292 - RNA, 18 nt, Homo sapiens
caucagugucuguuucag

SEQ ID NO: 605293 - RNA, 12 nt, Homo sapiens
caucaguucccc

SEQ ID NO: 605294 - RNA, 15 nt, Homo sapiens
caucauaacccauga

SEQ ID NO: 605295 - RNA, 22 nt, Homo sapiens
caucauaacucacuaacaggga

SEQ ID NO: 605296 - RNA, 17 nt, Homo sapiens
caucauaagaauagcug

SEQ ID NO: 605297 - RNA, 14 nt, Homo sapiens
caucauaauggacu

SEQ ID NO: 605298 - RNA, 16 nt, Homo sapiens
caucauaugccugacc

SEQ ID NO: 605299 - RNA, 16 nt, Homo sapiens
caucauauuguaugua

SEQ ID NO: 605300 - RNA, 13 nt, Homo sapiens
caucaucacugua

SEQ ID NO: 605301 - RNA, 18 nt, Homo sapiens
caucauccuccauugcuc

SEQ ID NO: 605302 - RNA, 13 nt, Homo sapiens
caucaucuauggc

SEQ ID NO: 605303 - RNA, 19 nt, Homo sapiens
caucaucuuaccugugcuu

SEQ ID NO: 605304 - RNA, 22 nt, Homo sapiens
caucauggaggucauacaugca

SEQ ID NO: 605305 - RNA, 15 nt, Homo sapiens
caucauguugaauaa

SEQ ID NO: 605306 - RNA, 16 nt, Homo sapiens
caucauuaaccaguaa

SEQ ID NO: 605307 - RNA, 13 nt, Homo sapiens
caucauuacccuu

SEQ ID NO: 605308 - RNA, 15 nt, Homo sapiens
caucauuacugccau

SEQ ID NO: 605309 - RNA, 17 nt, Homo sapiens
caucauucucugucuca

SEQ ID NO: 605310 - RNA, 14 nt, Homo sapiens
caucauuuuacucu

SEQ ID NO: 605311 - RNA, 22 nt, Homo sapiens
caucauuuuacucuuaugauca

SEQ ID NO: 605312 - RNA, 11 nt, Homo sapiens
cauccaaauaa

SEQ ID NO: 605313 - RNA, 16 nt, Homo sapiens
cauccacccgcugccc

SEQ ID NO: 605314 - RNA, 16 nt, Homo sapiens
cauccaccucaucacu

SEQ ID NO: 605315 - RNA, 22 nt, Homo sapiens
cauccaccuucccuucuacaag

SEQ ID NO: 605316 - RNA, 16 nt, Homo sapiens
cauccacuagugcaaa

SEQ ID NO: 605317 - RNA, 15 nt, Homo sapiens
cauccagagaugacu

SEQ ID NO: 605318 - RNA, 22 nt, Homo sapiens
cauccagcucuacgugauuugg

SEQ ID NO: 605319 - RNA, 14 nt, Homo sapiens
cauccagugacaaa

SEQ ID NO: 605320 - RNA, 17 nt, Homo sapiens
cauccagugacaaacca

SEQ ID NO: 605321 - RNA, 13 nt, Homo sapiens
cauccaugcacuu

SEQ ID NO: 605322 - RNA, 24 nt, Homo sapiens
cauccauguuccgagaagaacaga

SEQ ID NO: 605323 - RNA, 22 nt, Homo sapiens
cauccauuuguuuucacacuga

SEQ ID NO: 605324 - RNA, 13 nt, Homo sapiens
caucccaccagcc

SEQ ID NO: 605325 - RNA, 16 nt, Homo sapiens
caucccacugcucccc

SEQ ID NO: 605326 - RNA, 17 nt, Homo sapiens
caucccagcugcuccca

SEQ ID NO: 605327 - RNA, 15 nt, Homo sapiens
caucccagcuugccc

SEQ ID NO: 605328 - RNA, 17 nt, Homo sapiens
caucccauuuucauccu

SEQ ID NO: 605329 - RNA, 18 nt, Homo sapiens
cauccccaccugcugcag

SEQ ID NO: 605330 - RNA, 13 nt, Homo sapiens
caucccuaccacu

SEQ ID NO: 605331 - RNA, 14 nt, Homo sapiens
cauccgcaauguug

SEQ ID NO: 605332 - RNA, 21 nt, Homo sapiens
cauccgguggccuauuccagg

SEQ ID NO: 605333 - RNA, 14 nt, Homo sapiens
cauccgguuuaguc

SEQ ID NO: 605334 - RNA, 17 nt, Homo sapiens
cauccuccacaauagca

SEQ ID NO: 605335 - RNA, 15 nt, Homo sapiens
cauccucucacugca

SEQ ID NO: 605336 - RNA, 17 nt, Homo sapiens
cauccugaccuugcaca

SEQ ID NO: 605337 - RNA, 22 nt, Homo sapiens
cauccugcucaggaaaccacaa

SEQ ID NO: 605338 - RNA, 18 nt, Homo sapiens
cauccuggccuggcacau

SEQ ID NO: 605339 - RNA, 15 nt, Homo sapiens
cauccugguuuccac

SEQ ID NO: 605340 - RNA, 17 nt, Homo sapiens
cauccugucaccaugac

SEQ ID NO: 605341 - RNA, 15 nt, Homo sapiens
cauccugugaagucc

SEQ ID NO: 605342 - RNA, 14 nt, Homo sapiens
cauccuguuugaaa

SEQ ID NO: 605343 - RNA, 18 nt, Homo sapiens
cauccuuuacaccaacuc

SEQ ID NO: 605344 - RNA, 21 nt, Homo sapiens
caucgauauguauaucauucu

SEQ ID NO: 605345 - RNA, 21 nt, Homo sapiens
caucgauuuucuauuauggaa

SEQ ID NO: 605346 - RNA, 15 nt, Homo sapiens
caucgcgaugucgca

SEQ ID NO: 605347 - RNA, 22 nt, Homo sapiens
caucgcuuuauuggcugagaua

SEQ ID NO: 605348 - RNA, 18 nt, Homo sapiens
caucgugaucacugagcc

SEQ ID NO: 605349 - RNA, 13 nt, Homo sapiens
caucguucaucca

SEQ ID NO: 605350 - RNA, 14 nt, Homo sapiens
caucguuugcaaau

SEQ ID NO: 605351 - RNA, 15 nt, Homo sapiens
caucuaauguauuau

SEQ ID NO: 605352 - RNA, 18 nt, Homo sapiens
caucuaauguauuaugag

SEQ ID NO: 605353 - RNA, 14 nt, Homo sapiens
caucuacaaucagu

SEQ ID NO: 605354 - RNA, 21 nt, Homo sapiens
caucuacccugcugaccuccc

SEQ ID NO: 605355 - RNA, 23 nt, Homo sapiens
caucuacucuaaagaaaaaugcc

SEQ ID NO: 605356 - RNA, 22 nt, Homo sapiens
caucuacugaaugaccucucua

SEQ ID NO: 605357 - RNA, 14 nt, Homo sapiens
caucuaucugguga

SEQ ID NO: 605358 - RNA, 15 nt, Homo sapiens
caucuauuauuacac

SEQ ID NO: 605359 - RNA, 17 nt, Homo sapiens
caucuauucaagcacuu

SEQ ID NO: 605360 - RNA, 21 nt, Homo sapiens
caucuauuuccucugugcaaa

SEQ ID NO: 605361 - RNA, 23 nt, Homo sapiens
caucucaaaaaaaaacaacuauu

SEQ ID NO: 605362 - RNA, 21 nt, Homo sapiens
caucucaaaaauaaugcauaa

SEQ ID NO: 605363 - RNA, 17 nt, Homo sapiens
caucucaaagaaggcau

SEQ ID NO: 605364 - RNA, 21 nt, Homo sapiens
caucucaaagaaggcauuugc

SEQ ID NO: 605365 - RNA, 18 nt, Homo sapiens
caucucaacaaccugaau

SEQ ID NO: 605366 - RNA, 20 nt, Homo sapiens
caucucaacaauauaugucc

SEQ ID NO: 605367 - RNA, 21 nt, Homo sapiens
caucucaacaauauauguccu

SEQ ID NO: 605368 - RNA, 22 nt, Homo sapiens
caucucaacaauauauguccua

SEQ ID NO: 605369 - RNA, 23 nt, Homo sapiens
caucucagcgccagcucuaccag

SEQ ID NO: 605370 - RNA, 15 nt, Homo sapiens
caucucaggggccag

SEQ ID NO: 605371 - RNA, 13 nt, Homo sapiens
caucucagugcag

SEQ ID NO: 605372 - RNA, 13 nt, Homo sapiens
caucuccagcuau

SEQ ID NO: 605373 - RNA, 15 nt, Homo sapiens
caucuccagcuauuu

SEQ ID NO: 605374 - RNA, 19 nt, Homo sapiens
caucuccccucagauucca

SEQ ID NO: 605375 - RNA, 16 nt, Homo sapiens
caucucccucccacau

SEQ ID NO: 605376 - RNA, 13 nt, Homo sapiens
caucuccugagua

SEQ ID NO: 605377 - RNA, 15 nt, Homo sapiens
caucuccugauuucu

SEQ ID NO: 605378 - RNA, 19 nt, Homo sapiens
caucuccuucaaauacuuu

SEQ ID NO: 605379 - RNA, 15 nt, Homo sapiens
caucucggagcaucc

SEQ ID NO: 605380 - RNA, 13 nt, Homo sapiens
caucucuauuuag

SEQ ID NO: 605381 - RNA, 14 nt, Homo sapiens
caucucucccacuu

SEQ ID NO: 605382 - RNA, 23 nt, Homo sapiens
caucucucccuccccugccauuu

SEQ ID NO: 605383 - RNA, 15 nt, Homo sapiens
caucucugccuggaa

SEQ ID NO: 605384 - RNA, 17 nt, Homo sapiens
caucucuuuugagcuaa

SEQ ID NO: 605385 - RNA, 14 nt, Homo sapiens
caucugaccagcag

SEQ ID NO: 605386 - RNA, 14 nt, Homo sapiens
caucugacucacaa

SEQ ID NO: 605387 - RNA, 23 nt, Homo sapiens
caucugacucacaagaagaccag

SEQ ID NO: 605388 - RNA, 20 nt, Homo sapiens
caucugccagaccuuaauaa

SEQ ID NO: 605389 - RNA, 13 nt, Homo sapiens
caucugcuuacaa

SEQ ID NO: 605390 - RNA, 17 nt, Homo sapiens
caucuggauuuucacac

SEQ ID NO: 605391 - RNA, 22 nt, Homo sapiens
caucuggccuaauguuccagau

SEQ ID NO: 605392 - RNA, 16 nt, Homo sapiens
caucuggcucagcaua

SEQ ID NO: 605393 - RNA, 13 nt, Homo sapiens
caucugggaaaga

SEQ ID NO: 605394 - RNA, 23 nt, Homo sapiens
caucugggcaaaacccacagaag

SEQ ID NO: 605395 - RNA, 23 nt, Homo sapiens
caucuguagauacuagcuaucua

SEQ ID NO: 605396 - RNA, 18 nt, Homo sapiens
caucugugaauaagccau

SEQ ID NO: 605397 - RNA, 18 nt, Homo sapiens
caucuguggaaugauuca

SEQ ID NO: 605398 - RNA, 18 nt, Homo sapiens
caucuuacuguaccuguu

SEQ ID NO: 605399 - RNA, 16 nt, Homo sapiens
caucuucacugcaauu

SEQ ID NO: 605400 - RNA, 19 nt, Homo sapiens
caucuuccaccucaccucu

SEQ ID NO: 605401 - RNA, 15 nt, Homo sapiens
caucuuccucugcag

SEQ ID NO: 605402 - RNA, 18 nt, Homo sapiens
caucuuccuggaagcaga

SEQ ID NO: 605403 - RNA, 17 nt, Homo sapiens
caucuucucauuuugca

SEQ ID NO: 605404 - RNA, 15 nt, Homo sapiens
caucuucuccaucug

SEQ ID NO: 605405 - RNA, 18 nt, Homo sapiens
caucuugagccacaguca

SEQ ID NO: 605406 - RNA, 14 nt, Homo sapiens
caucuugaguauuu

SEQ ID NO: 605407 - RNA, 11 nt, Homo sapiens
caucuugaugg

SEQ ID NO: 605408 - RNA, 21 nt, Homo sapiens
caucuugcuaugagguuugcu

SEQ ID NO: 605409 - RNA, 15 nt, Homo sapiens
caucuugcucugcau

SEQ ID NO: 605410 - RNA, 19 nt, Homo sapiens
caucuuggucacauacaau

SEQ ID NO: 605411 - RNA, 23 nt, Homo sapiens
caucuuggucagauuugaacucu

SEQ ID NO: 605412 - RNA, 11 nt, Homo sapiens
caucuuuacaa

SEQ ID NO: 605413 - RNA, 21 nt, Homo sapiens
caucuuuccaauccagaggaa

SEQ ID NO: 605414 - RNA, 13 nt, Homo sapiens
caucuuuccugcc

SEQ ID NO: 605415 - RNA, 14 nt, Homo sapiens
caucuuugauacuu

SEQ ID NO: 605416 - RNA, 13 nt, Homo sapiens
caucuuugcuuau

SEQ ID NO: 605417 - RNA, 18 nt, Homo sapiens
caucuuuuacauucugca

SEQ ID NO: 605418 - RNA, 15 nt, Homo sapiens
caucuuuucuaauca

SEQ ID NO: 605419 - RNA, 15 nt, Homo sapiens
caucuuuucuacuuc

SEQ ID NO: 605420 - RNA, 23 nt, Homo sapiens
caucuuuuuuugguucuuugguc

SEQ ID NO: 605421 - RNA, 18 nt, Homo sapiens
caugaaaaaaaugauccc

SEQ ID NO: 605422 - RNA, 19 nt, Homo sapiens
caugaaaaacaggugacau

SEQ ID NO: 605423 - RNA, 20 nt, Homo sapiens
caugaaaaauauugcugaac

SEQ ID NO: 605424 - RNA, 18 nt, Homo sapiens
caugaaaauaaacuugaa

SEQ ID NO: 605425 - RNA, 15 nt, Homo sapiens
caugaaacagaguuu

SEQ ID NO: 605426 - RNA, 17 nt, Homo sapiens
caugaaacauguucuca

SEQ ID NO: 605427 - RNA, 15 nt, Homo sapiens
caugaaacauuucag

SEQ ID NO: 605428 - RNA, 16 nt, Homo sapiens
caugaaacuguacaua

SEQ ID NO: 605429 - RNA, 18 nt, Homo sapiens
caugaaaguggacaagga

SEQ ID NO: 605430 - RNA, 21 nt, Homo sapiens
caugaaauaaaauauaucuua

SEQ ID NO: 605431 - RNA, 14 nt, Homo sapiens
caugaaauaugcau

SEQ ID NO: 605432 - RNA, 19 nt, Homo sapiens
caugaaauggauacuuaua

SEQ ID NO: 605433 - RNA, 23 nt, Homo sapiens
caugaacaucuuuaggagacuaa

SEQ ID NO: 605434 - RNA, 13 nt, Homo sapiens
caugaacccaaaa

SEQ ID NO: 605435 - RNA, 21 nt, Homo sapiens
caugaacccucuugccauccu

SEQ ID NO: 605436 - RNA, 17 nt, Homo sapiens
caugaacggcaauaugg

SEQ ID NO: 605437 - RNA, 13 nt, Homo sapiens
caugaagcacuga

SEQ ID NO: 605438 - RNA, 12 nt, Homo sapiens
caugaagccuug

SEQ ID NO: 605439 - RNA, 16 nt, Homo sapiens
caugaagcgaaacaca

SEQ ID NO: 605440 - RNA, 19 nt, Homo sapiens
caugaagcuucaugcacuu

SEQ ID NO: 605441 - RNA, 20 nt, Homo sapiens
caugaaggagcagcauugac

SEQ ID NO: 605442 - RNA, 18 nt, Homo sapiens
caugaaggauaaaagccc

SEQ ID NO: 605443 - RNA, 19 nt, Homo sapiens
caugaauauuucauaucua

SEQ ID NO: 605444 - RNA, 23 nt, Homo sapiens
caugaauauuucauaucuauaaa

SEQ ID NO: 605445 - RNA, 14 nt, Homo sapiens
caugaaugaaaaua

SEQ ID NO: 605446 - RNA, 16 nt, Homo sapiens
caugaauuccuuaaaa

SEQ ID NO: 605447 - RNA, 16 nt, Homo sapiens
caugacaaaccuuaug

SEQ ID NO: 605448 - RNA, 16 nt, Homo sapiens
caugacacucuaguga

SEQ ID NO: 605449 - RNA, 18 nt, Homo sapiens
caugacacucuagugacu

SEQ ID NO: 605450 - RNA, 21 nt, Homo sapiens
caugacauccagagaugacua

SEQ ID NO: 605451 - RNA, 14 nt, Homo sapiens
caugaccacugccc

SEQ ID NO: 605452 - RNA, 12 nt, Homo sapiens
caugaccagaaa

SEQ ID NO: 605453 - RNA, 16 nt, Homo sapiens
caugacccagccugaa

SEQ ID NO: 605454 - RNA, 21 nt, Homo sapiens
caugacucuuuauugucugua

SEQ ID NO: 605455 - RNA, 17 nt, Homo sapiens
caugacuuauuaugcau

SEQ ID NO: 605456 - RNA, 18 nt, Homo sapiens
caugacuuauuaugcaua

SEQ ID NO: 605457 - RNA, 23 nt, Homo sapiens
caugacuuuauauggaugauuca

SEQ ID NO: 605458 - RNA, 18 nt, Homo sapiens
caugagaaagaauuugag

SEQ ID NO: 605459 - RNA, 22 nt, Homo sapiens
caugagcuauuuccauuccaga

SEQ ID NO: 605460 - RNA, 14 nt, Homo sapiens
caugagcucggggu

SEQ ID NO: 605461 - RNA, 18 nt, Homo sapiens
caugaggaaacuacugaa

SEQ ID NO: 605462 - RNA, 17 nt, Homo sapiens
caugaggaaucugggag

SEQ ID NO: 605463 - RNA, 15 nt, Homo sapiens
caugaggaccaggug

SEQ ID NO: 605464 - RNA, 19 nt, Homo sapiens
caugaggacucuauucuuu

SEQ ID NO: 605465 - RNA, 18 nt, Homo sapiens
caugaggccaccaguaaa

SEQ ID NO: 605466 - RNA, 19 nt, Homo sapiens
caugaggccaucucaggag

SEQ ID NO: 605467 - RNA, 16 nt, Homo sapiens
caugauacaaauucca

SEQ ID NO: 605468 - RNA, 13 nt, Homo sapiens
caugauacauuuu

SEQ ID NO: 605469 - RNA, 14 nt, Homo sapiens
caugaucaguguau

SEQ ID NO: 605470 - RNA, 14 nt, Homo sapiens
caugaucaucacaa

SEQ ID NO: 605471 - RNA, 22 nt, Homo sapiens
caugaucccuguguugucucua

SEQ ID NO: 605472 - RNA, 17 nt, Homo sapiens
caugaugaaaccccauc

SEQ ID NO: 605473 - RNA, 13 nt, Homo sapiens
caugaugacucaa

SEQ ID NO: 605474 - RNA, 22 nt, Homo sapiens
caugaugagucugaaggcauuu

SEQ ID NO: 605475 - RNA, 13 nt, Homo sapiens
caugaugaucugc

SEQ ID NO: 605476 - RNA, 15 nt, Homo sapiens
caugaugcuaaaggc

SEQ ID NO: 605477 - RNA, 19 nt, Homo sapiens
caugaugcuagccagcaaa

SEQ ID NO: 605478 - RNA, 23 nt, Homo sapiens
caugauggcaccacugcacucca

SEQ ID NO: 605479 - RNA, 19 nt, Homo sapiens
caugauggccuuacacuga

SEQ ID NO: 605480 - RNA, 21 nt, Homo sapiens
caugauggccuuacacugaaa

SEQ ID NO: 605481 - RNA, 20 nt, Homo sapiens
caugauuggcuuaaagugaa

SEQ ID NO: 605482 - RNA, 15 nt, Homo sapiens
caugauuguuuacag

SEQ ID NO: 605483 - RNA, 15 nt, Homo sapiens
caugauuuauauaug

SEQ ID NO: 605484 - RNA, 16 nt, Homo sapiens
caugauuuccuugaau

SEQ ID NO: 605485 - RNA, 22 nt, Homo sapiens
caugauuuuuuuuuuucagucc

SEQ ID NO: 605486 - RNA, 23 nt, Homo sapiens
caugcaaacugcuuuauuuuccc

SEQ ID NO: 605487 - RNA, 18 nt, Homo sapiens
caugcaagcuuggucaaa

SEQ ID NO: 605488 - RNA, 17 nt, Homo sapiens
caugcaauaaugugcaa

SEQ ID NO: 605489 - RNA, 13 nt, Homo sapiens
caugcaaugacau

SEQ ID NO: 605490 - RNA, 14 nt, Homo sapiens
caugcacacacaca

SEQ ID NO: 605491 - RNA, 13 nt, Homo sapiens
caugcacaugccu

SEQ ID NO: 605492 - RNA, 18 nt, Homo sapiens
caugcacccucauacaca

SEQ ID NO: 605493 - RNA, 20 nt, Homo sapiens
caugcaccucagggccaagc

SEQ ID NO: 605494 - RNA, 17 nt, Homo sapiens
caugcacuuuaauugaa

SEQ ID NO: 605495 - RNA, 20 nt, Homo sapiens
caugcagaagccugagcuca

SEQ ID NO: 605496 - RNA, 19 nt, Homo sapiens
caugcagauucagugcaau

SEQ ID NO: 605497 - RNA, 21 nt, Homo sapiens
caugcagcaaggggacaucuu

SEQ ID NO: 605498 - RNA, 22 nt, Homo sapiens
caugcagcaaggggacaucuua

SEQ ID NO: 605499 - RNA, 18 nt, Homo sapiens
caugcagugccggcugcc

SEQ ID NO: 605500 - RNA, 22 nt, Homo sapiens
caugcaguugcagugaauucau

SEQ ID NO: 605501 - RNA, 16 nt, Homo sapiens
caugcauaaaugcgau

SEQ ID NO: 605502 - RNA, 21 nt, Homo sapiens
caugcauuuuaccaucacaca

SEQ ID NO: 605503 - RNA, 21 nt, Homo sapiens
caugcauuuugcagcagugag

SEQ ID NO: 605504 - RNA, 18 nt, Homo sapiens
caugccacugcacucuag

SEQ ID NO: 605505 - RNA, 23 nt, Homo sapiens
caugccagaaggaaucuucucau

SEQ ID NO: 605506 - RNA, 15 nt, Homo sapiens
caugccauugcacuc

SEQ ID NO: 605507 - RNA, 15 nt, Homo sapiens
caugcccacagauca

SEQ ID NO: 605508 - RNA, 14 nt, Homo sapiens
caugcccagccaau

SEQ ID NO: 605509 - RNA, 13 nt, Homo sapiens
caugcccucaauc

SEQ ID NO: 605510 - RNA, 16 nt, Homo sapiens
caugcccuguguggcu

SEQ ID NO: 605511 - RNA, 15 nt, Homo sapiens
caugccucagugaag

SEQ ID NO: 605512 - RNA, 23 nt, Homo sapiens
caugccuggagacauaucacuca

SEQ ID NO: 605513 - RNA, 16 nt, Homo sapiens
caugccuggucuuucc

SEQ ID NO: 605514 - RNA, 13 nt, Homo sapiens
caugcgcacucuc

SEQ ID NO: 605515 - RNA, 19 nt, Homo sapiens
caugcgccaccaugcccua

SEQ ID NO: 605516 - RNA, 18 nt, Homo sapiens
caugcgguagccagcaca

SEQ ID NO: 605517 - RNA, 17 nt, Homo sapiens
caugcguauaugugcgu

SEQ ID NO: 605518 - RNA, 18 nt, Homo sapiens
caugcgugugucagggau

SEQ ID NO: 605519 - RNA, 16 nt, Homo sapiens
caugcuacacacugca

SEQ ID NO: 605520 - RNA, 21 nt, Homo sapiens
caugcuacuuuuuuuuaguuc

SEQ ID NO: 605521 - RNA, 12 nt, Homo sapiens
caugcucaacua

SEQ ID NO: 605522 - RNA, 14 nt, Homo sapiens
caugcucaaugaaa

SEQ ID NO: 605523 - RNA, 22 nt, Homo sapiens
caugcucaggcuacuauagguc

SEQ ID NO: 605524 - RNA, 17 nt, Homo sapiens
caugcugaaaacuacac

SEQ ID NO: 605525 - RNA, 13 nt, Homo sapiens
caugcugcuacaa

SEQ ID NO: 605526 - RNA, 19 nt, Homo sapiens
caugcuuagaaaguuccaa

SEQ ID NO: 605527 - RNA, 20 nt, Homo sapiens
caugcuuugcugcuaugaaa

SEQ ID NO: 605528 - RNA, 21 nt, Homo sapiens
caugcuuuucugccacuccau

SEQ ID NO: 605529 - RNA, 14 nt, Homo sapiens
caugcuuuugccac

SEQ ID NO: 605530 - RNA, 18 nt, Homo sapiens
cauggaaacgcaaaugag

SEQ ID NO: 605531 - RNA, 17 nt, Homo sapiens
cauggaaagacugggac

SEQ ID NO: 605532 - RNA, 14 nt, Homo sapiens
cauggaagcgcaca

SEQ ID NO: 605533 - RNA, 17 nt, Homo sapiens
cauggaauaaaccauuu

SEQ ID NO: 605534 - RNA, 16 nt, Homo sapiens
cauggaaucgaagugu

SEQ ID NO: 605535 - RNA, 13 nt, Homo sapiens
cauggacaagguc

SEQ ID NO: 605536 - RNA, 13 nt, Homo sapiens
cauggacacucca

SEQ ID NO: 605537 - RNA, 17 nt, Homo sapiens
cauggacacuccagugc

SEQ ID NO: 605538 - RNA, 13 nt, Homo sapiens
cauggacacuuug

SEQ ID NO: 605539 - RNA, 21 nt, Homo sapiens
cauggagaccucaugccaugg

SEQ ID NO: 605540 - RNA, 20 nt, Homo sapiens
cauggagacguggugggacu

SEQ ID NO: 605541 - RNA, 21 nt, Homo sapiens
cauggagacguggugggacuc

SEQ ID NO: 605542 - RNA, 17 nt, Homo sapiens
cauggagauguaaaaug

SEQ ID NO: 605543 - RNA, 16 nt, Homo sapiens
cauggagcaugggacu

SEQ ID NO: 605544 - RNA, 20 nt, Homo sapiens
cauggaguuaacaucaugaa

SEQ ID NO: 605545 - RNA, 17 nt, Homo sapiens
cauggauaaauugcaca

SEQ ID NO: 605546 - RNA, 15 nt, Homo sapiens
cauggauaacacauu

SEQ ID NO: 605547 - RNA, 18 nt, Homo sapiens
cauggauaacuacauuac

SEQ ID NO: 605548 - RNA, 11 nt, Homo sapiens
cauggaucucu

SEQ ID NO: 605549 - RNA, 16 nt, Homo sapiens
cauggaucugaucugu

SEQ ID NO: 605550 - RNA, 21 nt, Homo sapiens
cauggauuacuucucuauaaa

SEQ ID NO: 605551 - RNA, 21 nt, Homo sapiens
cauggcaaaucaggggccaga

SEQ ID NO: 605552 - RNA, 21 nt, Homo sapiens
cauggccagguggccacucca

SEQ ID NO: 605553 - RNA, 18 nt, Homo sapiens
cauggcguaaugggccug

SEQ ID NO: 605554 - RNA, 15 nt, Homo sapiens
cauggcuaaauacaa

SEQ ID NO: 605555 - RNA, 18 nt, Homo sapiens
cauggcuaaauacaaugg

SEQ ID NO: 605556 - RNA, 21 nt, Homo sapiens
cauggcucacaaacaguuguu

SEQ ID NO: 605557 - RNA, 14 nt, Homo sapiens
cauggcugaaguca

SEQ ID NO: 605558 - RNA, 23 nt, Homo sapiens
cauggcugggauuuaaagccuuu

SEQ ID NO: 605559 - RNA, 19 nt, Homo sapiens
caugggaaccucauaugca

SEQ ID NO: 605560 - RNA, 20 nt, Homo sapiens
caugggaaggggaggacccc

SEQ ID NO: 605561 - RNA, 13 nt, Homo sapiens
caugggacagggg

SEQ ID NO: 605562 - RNA, 13 nt, Homo sapiens
caugggaccuccu

SEQ ID NO: 605563 - RNA, 23 nt, Homo sapiens
caugggagggggcuugaagccaa

SEQ ID NO: 605564 - RNA, 18 nt, Homo sapiens
caugggaucuugagggac

SEQ ID NO: 605565 - RNA, 18 nt, Homo sapiens
cauggguaaaaauauuuc

SEQ ID NO: 605566 - RNA, 14 nt, Homo sapiens
cauggguacagagg

SEQ ID NO: 605567 - RNA, 19 nt, Homo sapiens
cauggguggcacucagucu

SEQ ID NO: 605568 - RNA, 16 nt, Homo sapiens
caugguacuaguguuu

SEQ ID NO: 605569 - RNA, 18 nt, Homo sapiens
cauggucccaaaauguca

SEQ ID NO: 605570 - RNA, 17 nt, Homo sapiens
cauggucccaggcuucc

SEQ ID NO: 605571 - RNA, 21 nt, Homo sapiens
cauggucuuugcuaggccucu

SEQ ID NO: 605572 - RNA, 13 nt, Homo sapiens
cauggugagcucu

SEQ ID NO: 605573 - RNA, 14 nt, Homo sapiens
cauggugauaugca

SEQ ID NO: 605574 - RNA, 13 nt, Homo sapiens
cauggugccccua

SEQ ID NO: 605575 - RNA, 19 nt, Homo sapiens
cauggugccccuagcuuua

SEQ ID NO: 605576 - RNA, 13 nt, Homo sapiens
caugguggcacac

SEQ ID NO: 605577 - RNA, 17 nt, Homo sapiens
caugguggguccauggg

SEQ ID NO: 605578 - RNA, 18 nt, Homo sapiens
cauggugugaguccaaag

SEQ ID NO: 605579 - RNA, 20 nt, Homo sapiens
cauggugugaguccaaagaa

SEQ ID NO: 605580 - RNA, 20 nt, Homo sapiens
caugguuacaaucauugcug

SEQ ID NO: 605581 - RNA, 16 nt, Homo sapiens
caugguuuugaaaugc

SEQ ID NO: 605582 - RNA, 15 nt, Homo sapiens
cauguaaaacaguua

SEQ ID NO: 605583 - RNA, 17 nt, Homo sapiens
cauguaaacugugcacc

SEQ ID NO: 605584 - RNA, 16 nt, Homo sapiens
cauguaaauugcaaau

SEQ ID NO: 605585 - RNA, 20 nt, Homo sapiens
cauguaacuauuucuucaga

SEQ ID NO: 605586 - RNA, 17 nt, Homo sapiens
cauguaagccaagucau

SEQ ID NO: 605587 - RNA, 22 nt, Homo sapiens
cauguaaggucuucuugugucc

SEQ ID NO: 605588 - RNA, 14 nt, Homo sapiens
cauguaauccuuuu

SEQ ID NO: 605589 - RNA, 19 nt, Homo sapiens
cauguaauuaaguacuaug

SEQ ID NO: 605590 - RNA, 16 nt, Homo sapiens
cauguacauacccugg

SEQ ID NO: 605591 - RNA, 15 nt, Homo sapiens
cauguaccaucaaua

SEQ ID NO: 605592 - RNA, 18 nt, Homo sapiens
cauguaccucugauuaau

SEQ ID NO: 605593 - RNA, 12 nt, Homo sapiens
cauguacuugaa

SEQ ID NO: 605594 - RNA, 19 nt, Homo sapiens
cauguagguguuuguucau

SEQ ID NO: 605595 - RNA, 17 nt, Homo sapiens
cauguauguuaugauau

SEQ ID NO: 605596 - RNA, 13 nt, Homo sapiens
cauguauucccuu

SEQ ID NO: 605597 - RNA, 14 nt, Homo sapiens
cauguauugcacau

SEQ ID NO: 605598 - RNA, 15 nt, Homo sapiens
cauguauugcacauu

SEQ ID NO: 605599 - RNA, 21 nt, Homo sapiens
caugucaccucagcugauauu

SEQ ID NO: 605600 - RNA, 22 nt, Homo sapiens
cauguccauacacuuuguugca

SEQ ID NO: 605601 - RNA, 16 nt, Homo sapiens
caugucgccucugcau

SEQ ID NO: 605602 - RNA, 14 nt, Homo sapiens
caugucugcauuuc

SEQ ID NO: 605603 - RNA, 15 nt, Homo sapiens
caugucuugucauac

SEQ ID NO: 605604 - RNA, 15 nt, Homo sapiens
caugucuugugcaua

SEQ ID NO: 605605 - RNA, 19 nt, Homo sapiens
caugugacuccugaaggga

SEQ ID NO: 605606 - RNA, 19 nt, Homo sapiens
caugugacuggcaguauua

SEQ ID NO: 605607 - RNA, 22 nt, Homo sapiens
caugugcgcgcgugcaugugug

SEQ ID NO: 605608 - RNA, 18 nt, Homo sapiens
caugugcugauguuuaca

SEQ ID NO: 605609 - RNA, 15 nt, Homo sapiens
caugugcugccugca

SEQ ID NO: 605610 - RNA, 19 nt, Homo sapiens
cauguggaagcacuuuaag

SEQ ID NO: 605611 - RNA, 19 nt, Homo sapiens
cauguggccuuuaucucaa

SEQ ID NO: 605612 - RNA, 16 nt, Homo sapiens
cauguggcuuuuuuaa

SEQ ID NO: 605613 - RNA, 19 nt, Homo sapiens
cauguggugggacagggac

SEQ ID NO: 605614 - RNA, 17 nt, Homo sapiens
cauguguacauucugcc

SEQ ID NO: 605615 - RNA, 14 nt, Homo sapiens
cauguguaccucag

SEQ ID NO: 605616 - RNA, 14 nt, Homo sapiens
cauguguauacaua

SEQ ID NO: 605617 - RNA, 12 nt, Homo sapiens
caugugugcaaa

SEQ ID NO: 605618 - RNA, 23 nt, Homo sapiens
caugugugcgagugugugcaugu

SEQ ID NO: 605619 - RNA, 15 nt, Homo sapiens
caugugugcuaauau

SEQ ID NO: 605620 - RNA, 21 nt, Homo sapiens
cauguguggcccugucugcuu

SEQ ID NO: 605621 - RNA, 14 nt, Homo sapiens
caugugugugcaag

SEQ ID NO: 605622 - RNA, 23 nt, Homo sapiens
caugugugugcaagugugugcau

SEQ ID NO: 605623 - RNA, 16 nt, Homo sapiens
cauguguuugcauaaa

SEQ ID NO: 605624 - RNA, 22 nt, Homo sapiens
cauguuaagauaacuuacugua

SEQ ID NO: 605625 - RNA, 20 nt, Homo sapiens
cauguuaagugccauuacua

SEQ ID NO: 605626 - RNA, 17 nt, Homo sapiens
cauguuacucaguguua

SEQ ID NO: 605627 - RNA, 14 nt, Homo sapiens
cauguuaguuaccu

SEQ ID NO: 605628 - RNA, 23 nt, Homo sapiens
cauguuauucucucacaguguac

SEQ ID NO: 605629 - RNA, 18 nt, Homo sapiens
cauguuauuuauaguguu

SEQ ID NO: 605630 - RNA, 16 nt, Homo sapiens
cauguuccucaaaagc

SEQ ID NO: 605631 - RNA, 13 nt, Homo sapiens
cauguucugugac

SEQ ID NO: 605632 - RNA, 22 nt, Homo sapiens
cauguuggccaggcuggucuca

SEQ ID NO: 605633 - RNA, 16 nt, Homo sapiens
cauguuguaaugcugc

SEQ ID NO: 605634 - RNA, 17 nt, Homo sapiens
cauguuguaaugcugca

SEQ ID NO: 605635 - RNA, 16 nt, Homo sapiens
cauguuguacauuuca

SEQ ID NO: 605636 - RNA, 12 nt, Homo sapiens
cauguugucaau

SEQ ID NO: 605637 - RNA, 21 nt, Homo sapiens
cauguuguugaggcugucaca

SEQ ID NO: 605638 - RNA, 16 nt, Homo sapiens
cauguuuaaauagccu

SEQ ID NO: 605639 - RNA, 18 nt, Homo sapiens
cauguuuagauuccagga

SEQ ID NO: 605640 - RNA, 21 nt, Homo sapiens
cauguuucauugccugaauaa

SEQ ID NO: 605641 - RNA, 12 nt, Homo sapiens
cauguuuccauc

SEQ ID NO: 605642 - RNA, 15 nt, Homo sapiens
cauguuugcaccugu

SEQ ID NO: 605643 - RNA, 11 nt, Homo sapiens
cauguuugcag

SEQ ID NO: 605644 - RNA, 13 nt, Homo sapiens
cauguuuuaggga

SEQ ID NO: 605645 - RNA, 22 nt, Homo sapiens
cauguuuugauuuguagcacug

SEQ ID NO: 605646 - RNA, 23 nt, Homo sapiens
cauguuuugauuuguagcacuga

SEQ ID NO: 605647 - RNA, 22 nt, Homo sapiens
cauguuuuuggggacacugaca

SEQ ID NO: 605648 - RNA, 18 nt, Homo sapiens
cauuaaaacaaauccaua

SEQ ID NO: 605649 - RNA, 14 nt, Homo sapiens
cauuaaacaaauaa

SEQ ID NO: 605650 - RNA, 17 nt, Homo sapiens
cauuaaaccugucucca

SEQ ID NO: 605651 - RNA, 22 nt, Homo sapiens
cauuaaagaugaccuacagugc

SEQ ID NO: 605652 - RNA, 20 nt, Homo sapiens
cauuaaauauaauaugcaca

SEQ ID NO: 605653 - RNA, 17 nt, Homo sapiens
cauuaacaaaagcaauu

SEQ ID NO: 605654 - RNA, 16 nt, Homo sapiens
cauuaacucccuccac

SEQ ID NO: 605655 - RNA, 15 nt, Homo sapiens
cauuaacugcacaaa

SEQ ID NO: 605656 - RNA, 15 nt, Homo sapiens
cauuaagugaaagga

SEQ ID NO: 605657 - RNA, 14 nt, Homo sapiens
cauuaauacaaaga

SEQ ID NO: 605658 - RNA, 21 nt, Homo sapiens
cauuaauagcugccuucaagg

SEQ ID NO: 605659 - RNA, 16 nt, Homo sapiens
cauuaaucaccaaagu

SEQ ID NO: 605660 - RNA, 14 nt, Homo sapiens
cauuaaucuaagaa

SEQ ID NO: 605661 - RNA, 13 nt, Homo sapiens
cauuaaugcaaug

SEQ ID NO: 605662 - RNA, 19 nt, Homo sapiens
cauuaauuuaaaugauuua

SEQ ID NO: 605663 - RNA, 16 nt, Homo sapiens
cauuacaauugcaguu

SEQ ID NO: 605664 - RNA, 13 nt, Homo sapiens
cauuacauggcug

SEQ ID NO: 605665 - RNA, 12 nt, Homo sapiens
cauuaccauuca

SEQ ID NO: 605666 - RNA, 16 nt, Homo sapiens
cauuacccacgugaca

SEQ ID NO: 605667 - RNA, 19 nt, Homo sapiens
cauuaccgcguuguaaaau

SEQ ID NO: 605668 - RNA, 12 nt, Homo sapiens
cauuacuacugu

SEQ ID NO: 605669 - RNA, 15 nt, Homo sapiens
cauuacuauucacug

SEQ ID NO: 605670 - RNA, 18 nt, Homo sapiens
cauuacuauucacugaug

SEQ ID NO: 605671 - RNA, 17 nt, Homo sapiens
cauuacugguaaagccu

SEQ ID NO: 605672 - RNA, 23 nt, Homo sapiens
cauuagauuuggaggcuaccuca

SEQ ID NO: 605673 - RNA, 22 nt, Homo sapiens
cauuagcagaagcaugcacaaa

SEQ ID NO: 605674 - RNA, 15 nt, Homo sapiens
cauuagcccaagaga

SEQ ID NO: 605675 - RNA, 15 nt, Homo sapiens
cauuguagcucuuug

SEQ ID NO: 605676 - RNA, 12 nt, Homo sapiens
cauuguauccuc

SEQ ID NO: 605677 - RNA, 19 nt, Homo sapiens
cauuguauguggucaugga

SEQ ID NO: 605678 - RNA, 18 nt, Homo sapiens
cauuguccugugaaauau

SEQ ID NO: 605679 - RNA, 19 nt, Homo sapiens
cauugucgcucagcaauag

SEQ ID NO: 605680 - RNA, 15 nt, Homo sapiens
cauugugauguauau

SEQ ID NO: 605681 - RNA, 17 nt, Homo sapiens
cauuguggcuccuaucu

SEQ ID NO: 605682 - RNA, 22 nt, Homo sapiens
cauuguguucucuauugcugcu

SEQ ID NO: 605683 - RNA, 20 nt, Homo sapiens
cauuguuaagaaaguauuug

SEQ ID NO: 605684 - RNA, 17 nt, Homo sapiens
cauuguuaccucuauau

SEQ ID NO: 605685 - RNA, 18 nt, Homo sapiens
cauuguuauaaagacaca

SEQ ID NO: 605686 - RNA, 20 nt, Homo sapiens
cauuguucuggaaaucucca

SEQ ID NO: 605687 - RNA, 17 nt, Homo sapiens
cauuguuggaguguaaa

SEQ ID NO: 605688 - RNA, 22 nt, Homo sapiens
cauuguuggaguguaaaccaaa

SEQ ID NO: 605689 - RNA, 13 nt, Homo sapiens
cauuguugucuuc

SEQ ID NO: 605690 - RNA, 23 nt, Homo sapiens
cauuuaaaaagcucacugcugau

SEQ ID NO: 605691 - RNA, 18 nt, Homo sapiens
cauuuaaaaagguuuaaa

SEQ ID NO: 605692 - RNA, 19 nt, Homo sapiens
cauuuaaaacauuaaaaua

SEQ ID NO: 605693 - RNA, 16 nt, Homo sapiens
cauuuaaaauucaauu

SEQ ID NO: 605694 - RNA, 18 nt, Homo sapiens
cauuuaagacacauugac

SEQ ID NO: 605695 - RNA, 17 nt, Homo sapiens
cauuuaauaaagaugag

SEQ ID NO: 605696 - RNA, 20 nt, Homo sapiens
cauuuaauacagcaguguca

SEQ ID NO: 605697 - RNA, 15 nt, Homo sapiens
cauuuaauagacuua

SEQ ID NO: 605698 - RNA, 17 nt, Homo sapiens
cauuuaauaucuuugau

SEQ ID NO: 605699 - RNA, 23 nt, Homo sapiens
cauuuacuuaacagaacagucac

SEQ ID NO: 605700 - RNA, 13 nt, Homo sapiens
cauuuagcacaau

SEQ ID NO: 605701 - RNA, 15 nt, Homo sapiens
cauuuagucauguga

SEQ ID NO: 605702 - RNA, 17 nt, Homo sapiens
cauuuagucuugccagg

SEQ ID NO: 605703 - RNA, 19 nt, Homo sapiens
cauuuauaugaauuuccac

SEQ ID NO: 605704 - RNA, 14 nt, Homo sapiens
cauuuaucaccucu

SEQ ID NO: 605705 - RNA, 12 nt, Homo sapiens
cauuuaugcaca

SEQ ID NO: 605706 - RNA, 14 nt, Homo sapiens
cauuuauggcauga

SEQ ID NO: 605707 - RNA, 20 nt, Homo sapiens
cauuuaugguguaguucuga

SEQ ID NO: 605708 - RNA, 19 nt, Homo sapiens
cauuuauuucucuggcaaa

SEQ ID NO: 605709 - RNA, 17 nt, Homo sapiens
cauuuauuuuuauaucu

SEQ ID NO: 605710 - RNA, 21 nt, Homo sapiens
cauuucaaauacaucuuugau

SEQ ID NO: 605711 - RNA, 17 nt, Homo sapiens
cauuucaauuccuguga

SEQ ID NO: 605712 - RNA, 16 nt, Homo sapiens
cauuucacacagugaa

SEQ ID NO: 605713 - RNA, 15 nt, Homo sapiens
cauuucacagccuuu

SEQ ID NO: 605714 - RNA, 14 nt, Homo sapiens
cauuucaccuguga

SEQ ID NO: 605715 - RNA, 20 nt, Homo sapiens
cauuucacgaacuguucaca

SEQ ID NO: 605716 - RNA, 15 nt, Homo sapiens
cauuucacucucaaa

SEQ ID NO: 605717 - RNA, 14 nt, Homo sapiens
cauuucagcuugaa

SEQ ID NO: 605718 - RNA, 13 nt, Homo sapiens
cauuucaguauca

SEQ ID NO: 605719 - RNA, 18 nt, Homo sapiens
cauuucauacaacagaaa

SEQ ID NO: 605720 - RNA, 12 nt, Homo sapiens
cauuucaugucc

SEQ ID NO: 605721 - RNA, 22 nt, Homo sapiens
cauuucauuaagguuccaguua

SEQ ID NO: 605722 - RNA, 13 nt, Homo sapiens
cauuucauuccau

SEQ ID NO: 605723 - RNA, 16 nt, Homo sapiens
cauuuccaaauucaca

SEQ ID NO: 605724 - RNA, 17 nt, Homo sapiens
cauuuccaaauucacaa

SEQ ID NO: 605725 - RNA, 18 nt, Homo sapiens
cauuuccaacaccacaga

SEQ ID NO: 605726 - RNA, 16 nt, Homo sapiens
cauuuccuaugcaaau

SEQ ID NO: 605727 - RNA, 15 nt, Homo sapiens
cauuuccucuguucu

SEQ ID NO: 605728 - RNA, 12 nt, Homo sapiens
cauuucuaacau

SEQ ID NO: 605729 - RNA, 18 nt, Homo sapiens
cauuucuagcagugauga

SEQ ID NO: 605730 - RNA, 21 nt, Homo sapiens
cauuucuauacuuuacaggaa

SEQ ID NO: 605731 - RNA, 22 nt, Homo sapiens
cauuucuauuucuccuccaugg

SEQ ID NO: 605732 - RNA, 23 nt, Homo sapiens
cauuucucaaaugcacaucucau

SEQ ID NO: 605733 - RNA, 22 nt, Homo sapiens
cauuucucaaucagugcaguga

SEQ ID NO: 605734 - RNA, 23 nt, Homo sapiens
cauuucucaucaguaguucacau

SEQ ID NO: 605735 - RNA, 20 nt, Homo sapiens
cauuucugagaucaaaacgg

SEQ ID NO: 605736 - RNA, 13 nt, Homo sapiens
cauuucuguggau

SEQ ID NO: 605737 - RNA, 17 nt, Homo sapiens
cauuucuugauguugcu

SEQ ID NO: 605738 - RNA, 16 nt, Homo sapiens
cauuugaacacauuau

SEQ ID NO: 605739 - RNA, 16 nt, Homo sapiens
cauuugaagcagugau

SEQ ID NO: 605740 - RNA, 23 nt, Homo sapiens
cauuugaaugugugaauucaaua

SEQ ID NO: 605741 - RNA, 19 nt, Homo sapiens
cauuugacccuugcuguga

SEQ ID NO: 605742 - RNA, 20 nt, Homo sapiens
cauuugaguugcccaucuug

SEQ ID NO: 605743 - RNA, 22 nt, Homo sapiens
cauuugauuuguucaugaauau

SEQ ID NO: 605744 - RNA, 14 nt, Homo sapiens
cauuugcauuugcu

SEQ ID NO: 605745 - RNA, 15 nt, Homo sapiens
cauuugcauuugcuc

SEQ ID NO: 605746 - RNA, 15 nt, Homo sapiens
cauuugccaagugag

SEQ ID NO: 605747 - RNA, 22 nt, Homo sapiens
cauuugccaauuuuccuacucu

SEQ ID NO: 605748 - RNA, 17 nt, Homo sapiens
cauuugccaucacccca

SEQ ID NO: 605749 - RNA, 12 nt, Homo sapiens
cauuugccuugu

SEQ ID NO: 605750 - RNA, 23 nt, Homo sapiens
cauuugcuaaguguaugauguca

SEQ ID NO: 605751 - RNA, 11 nt, Homo sapiens
cauuugcugaa

SEQ ID NO: 605752 - RNA, 21 nt, Homo sapiens
cauuugcugaauagcuacuau

SEQ ID NO: 605753 - RNA, 23 nt, Homo sapiens
cauuugcuuacuuugcauuugug

SEQ ID NO: 605754 - RNA, 14 nt, Homo sapiens
cauuugcuuugucc

SEQ ID NO: 605755 - RNA, 14 nt, Homo sapiens
cauuuggaaccaaa

SEQ ID NO: 605756 - RNA, 13 nt, Homo sapiens
cauuuggaaugaa

SEQ ID NO: 605757 - RNA, 22 nt, Homo sapiens
cauuuggagagggggccuggga

SEQ ID NO: 605758 - RNA, 18 nt, Homo sapiens
cauuuggccuugugcggu

SEQ ID NO: 605759 - RNA, 11 nt, Homo sapiens
cauuuggucuc

SEQ ID NO: 605760 - RNA, 21 nt, Homo sapiens
cauuuguagcuuugcccauug

SEQ ID NO: 605761 - RNA, 17 nt, Homo sapiens
cauuuguauuacugcuu

SEQ ID NO: 605762 - RNA, 16 nt, Homo sapiens
cauuugugcguaugca

SEQ ID NO: 605763 - RNA, 17 nt, Homo sapiens
cauuugugugugugcaa

SEQ ID NO: 605764 - RNA, 19 nt, Homo sapiens
cauuugugugugugcaagu

SEQ ID NO: 605765 - RNA, 21 nt, Homo sapiens
cauuuguuggaaugaauuaaa

SEQ ID NO: 605766 - RNA, 14 nt, Homo sapiens
cauuuguuuugcuu

SEQ ID NO: 605767 - RNA, 18 nt, Homo sapiens
cauuuuaagugcuucaca

SEQ ID NO: 605768 - RNA, 19 nt, Homo sapiens
cauuuuaauuuuaaccaaa

SEQ ID NO: 605769 - RNA, 19 nt, Homo sapiens
cauuuuacaggugcgaaug

SEQ ID NO: 605770 - RNA, 22 nt, Homo sapiens
cauuuuacccuuggcucaaucc

SEQ ID NO: 605771 - RNA, 20 nt, Homo sapiens
cauuuuaggaaucaccaaug

SEQ ID NO: 605772 - RNA, 15 nt, Homo sapiens
cauuuuauaaauuca

SEQ ID NO: 605773 - RNA, 16 nt, Homo sapiens
cauuuuauucuuuaag

SEQ ID NO: 605774 - RNA, 20 nt, Homo sapiens
cauuuuauuuuuucuugcaa

SEQ ID NO: 605775 - RNA, 21 nt, Homo sapiens
cauuuuauuuuuucuugcaaa

SEQ ID NO: 605776 - RNA, 14 nt, Homo sapiens
cauuuucaccccac

SEQ ID NO: 605777 - RNA, 15 nt, Homo sapiens
cauuuucauugauga

SEQ ID NO: 605778 - RNA, 18 nt, Homo sapiens
cauuuuccuguucaguga

SEQ ID NO: 605779 - RNA, 17 nt, Homo sapiens
cauuuuccuguuuacug

SEQ ID NO: 605780 - RNA, 19 nt, Homo sapiens
cauuuucuuguggagcaau

SEQ ID NO: 605781 - RNA, 15 nt, Homo sapiens
cauuuugacacaaaa

SEQ ID NO: 605782 - RNA, 18 nt, Homo sapiens
cauuuugcccuuccauag

SEQ ID NO: 605783 - RNA, 15 nt, Homo sapiens
cauuuuggucucuau

SEQ ID NO: 605784 - RNA, 17 nt, Homo sapiens
cauuuugugaauuguga

SEQ ID NO: 605785 - RNA, 13 nt, Homo sapiens
cauuuuguggaau

SEQ ID NO: 605786 - RNA, 15 nt, Homo sapiens
cauuuuguucuacau

SEQ ID NO: 605787 - RNA, 21 nt, Homo sapiens
cauuuuguugcuuuugugaac

SEQ ID NO: 605788 - RNA, 17 nt, Homo sapiens
cauuuuuaaguauuuca

SEQ ID NO: 605789 - RNA, 22 nt, Homo sapiens
cauuuuuagaaaucacaacaaa

SEQ ID NO: 605790 - RNA, 18 nt, Homo sapiens
cauuuuuaucccauugag

SEQ ID NO: 605791 - RNA, 17 nt, Homo sapiens
cauuuuuauguuauuac

SEQ ID NO: 605792 - RNA, 16 nt, Homo sapiens
cauuuuucacuguaca

SEQ ID NO: 605793 - RNA, 14 nt, Homo sapiens
cauuuuucugggag

SEQ ID NO: 605794 - RNA, 11 nt, Homo sapiens
cauuuuugcug

SEQ ID NO: 605795 - RNA, 14 nt, Homo sapiens
cauuuuugugagcc

SEQ ID NO: 605796 - RNA, 17 nt, Homo sapiens
cauuuuugugccauuau

SEQ ID NO: 605797 - RNA, 15 nt, Homo sapiens
cauuuuuuaaaugca

SEQ ID NO: 605798 - RNA, 19 nt, Homo sapiens
cauuuuuucagucauauaa

SEQ ID NO: 605799 - RNA, 17 nt, Homo sapiens
cauuuuuucccagugag

SEQ ID NO: 605800 - RNA, 15 nt, Homo sapiens
cauuuuuuguucugu

SEQ ID NO: 605801 - RNA, 23 nt, Homo sapiens
cauuuuuuucacuggaguuacau

SEQ ID NO: 605802 - RNA, 15 nt, Homo sapiens
ccaaaaaacuacuuc

SEQ ID NO: 605803 - RNA, 20 nt, Homo sapiens
ccaaaaagggauccguacau

SEQ ID NO: 605804 - RNA, 15 nt, Homo sapiens
ccaaaaauuacugau

SEQ ID NO: 605805 - RNA, 21 nt, Homo sapiens
ccaaaaauuuugugacauucc

SEQ ID NO: 605806 - RNA, 14 nt, Homo sapiens
ccaaaaccaaugcu

SEQ ID NO: 605807 - RNA, 19 nt, Homo sapiens
ccaaaaccuuccucuucca

SEQ ID NO: 605808 - RNA, 18 nt, Homo sapiens
ccaaaacguugaauugau

SEQ ID NO: 605809 - RNA, 16 nt, Homo sapiens
ccaaaagaaacugaca

SEQ ID NO: 605810 - RNA, 16 nt, Homo sapiens
ccaaaagcugcucagg

SEQ ID NO: 605811 - RNA, 13 nt, Homo sapiens
ccaaaauccgacu

SEQ ID NO: 605812 - RNA, 15 nt, Homo sapiens
ccaaaaucucuuaaa

SEQ ID NO: 605813 - RNA, 22 nt, Homo sapiens
ccaaaaucugauuagaaguaua

SEQ ID NO: 605814 - RNA, 13 nt, Homo sapiens
ccaaaauguuaau

SEQ ID NO: 605815 - RNA, 21 nt, Homo sapiens
ccaaaauuaguuuguguuacu

SEQ ID NO: 605816 - RNA, 12 nt, Homo sapiens
ccaaacaccagu

SEQ ID NO: 605817 - RNA, 14 nt, Homo sapiens
ccaaacaccaguca

SEQ ID NO: 605818 - RNA, 21 nt, Homo sapiens
ccaaacacuguaagcuuuuaa

SEQ ID NO: 605819 - RNA, 18 nt, Homo sapiens
ccaaacagcuguauuuau

SEQ ID NO: 605820 - RNA, 17 nt, Homo sapiens
ccaaaccaaauuuuaau

SEQ ID NO: 605821 - RNA, 14 nt, Homo sapiens
ccaaaccacuccac

SEQ ID NO: 605822 - RNA, 22 nt, Homo sapiens
ccaaaccuuuuguucuguaaaa

SEQ ID NO: 605823 - RNA, 18 nt, Homo sapiens
ccaaacucauaacagucu

SEQ ID NO: 605824 - RNA, 17 nt, Homo sapiens
ccaaacuuuaaaaugcg

SEQ ID NO: 605825 - RNA, 14 nt, Homo sapiens
ccaaagaaccaaag

SEQ ID NO: 605826 - RNA, 15 nt, Homo sapiens
ccaaagaaccaaaga

SEQ ID NO: 605827 - RNA, 21 nt, Homo sapiens
ccaaagacagucuucuaauuc

SEQ ID NO: 605828 - RNA, 17 nt, Homo sapiens
ccaaagaccaauauuca

SEQ ID NO: 605829 - RNA, 21 nt, Homo sapiens
ccaaagagccuuuccaaagag

SEQ ID NO: 605830 - RNA, 23 nt, Homo sapiens
ccaaagauguuugaaaaugcucu

SEQ ID NO: 605831 - RNA, 11 nt, Homo sapiens
ccaaagcacuu

SEQ ID NO: 605832 - RNA, 12 nt, Homo sapiens
ccaaagcacuuu

SEQ ID NO: 605833 - RNA, 19 nt, Homo sapiens
ccaaagcagacagcuccac

SEQ ID NO: 605834 - RNA, 20 nt, Homo sapiens
ccaaagcccuuauguuuaau

SEQ ID NO: 605835 - RNA, 17 nt, Homo sapiens
ccaaagcuuucauguaa

SEQ ID NO: 605836 - RNA, 19 nt, Homo sapiens
ccaaaggaauaaccuuucu

SEQ ID NO: 605837 - RNA, 22 nt, Homo sapiens
ccaaaggggcugcuggggcaug

SEQ ID NO: 605838 - RNA, 14 nt, Homo sapiens
ccaaaguaaauguc

SEQ ID NO: 605839 - RNA, 18 nt, Homo sapiens
ccaaaguaacugaauuau

SEQ ID NO: 605840 - RNA, 16 nt, Homo sapiens
ccaaaguacagaauuu

SEQ ID NO: 605841 - RNA, 20 nt, Homo sapiens
ccaaaguaucaggacgagaa

SEQ ID NO: 605842 - RNA, 21 nt, Homo sapiens
ccaaaguccucugcuccagca

SEQ ID NO: 605843 - RNA, 15 nt, Homo sapiens
ccaaagugcugggau

SEQ ID NO: 605844 - RNA, 16 nt, Homo sapiens
ccaaagugucuuuuga

SEQ ID NO: 605845 - RNA, 13 nt, Homo sapiens
ccaaaguguuaau

SEQ ID NO: 605846 - RNA, 18 nt, Homo sapiens
ccaaaguuugcucaagga

SEQ ID NO: 605847 - RNA, 19 nt, Homo sapiens
ccaaaguuugcucaaggag

SEQ ID NO: 605848 - RNA, 18 nt, Homo sapiens
ccaaaguuuucaaacugc

SEQ ID NO: 605849 - RNA, 21 nt, Homo sapiens
ccaaauaaaacuugagcccac

SEQ ID NO: 605850 - RNA, 13 nt, Homo sapiens
ccaaauauaacca

SEQ ID NO: 605851 - RNA, 14 nt, Homo sapiens
ccaaauaugagaug

SEQ ID NO: 605852 - RNA, 14 nt, Homo sapiens
ccaaauaugcacuu

SEQ ID NO: 605853 - RNA, 16 nt, Homo sapiens
ccaaauaugcacuuuc

SEQ ID NO: 605854 - RNA, 20 nt, Homo sapiens
ccaaaucaauaagaagguag

SEQ ID NO: 605855 - RNA, 16 nt, Homo sapiens
ccaaauccacaagcca

SEQ ID NO: 605856 - RNA, 12 nt, Homo sapiens
ccaaaucugccu

SEQ ID NO: 605857 - RNA, 15 nt, Homo sapiens
ccaaaugcagggagg

SEQ ID NO: 605858 - RNA, 15 nt, Homo sapiens
ccaaauggcugcuuu

SEQ ID NO: 605859 - RNA, 12 nt, Homo sapiens
ccaaauguucau

SEQ ID NO: 605860 - RNA, 14 nt, Homo sapiens
ccaaauguuuauaa

SEQ ID NO: 605861 - RNA, 15 nt, Homo sapiens
ccaaauuaacaucag

SEQ ID NO: 605862 - RNA, 18 nt, Homo sapiens
ccaaauugaacucacugc

SEQ ID NO: 605863 - RNA, 12 nt, Homo sapiens
ccaaauuuccag

SEQ ID NO: 605864 - RNA, 12 nt, Homo sapiens
ccaacaaaaaga

SEQ ID NO: 605865 - RNA, 17 nt, Homo sapiens
ccaacaaaaagaacaaa

SEQ ID NO: 605866 - RNA, 13 nt, Homo sapiens
ccaacaacucugc

SEQ ID NO: 605867 - RNA, 12 nt, Homo sapiens
ccaacaccacag

SEQ ID NO: 605868 - RNA, 21 nt, Homo sapiens
ccaacacugcugcuccagugc

SEQ ID NO: 605869 - RNA, 18 nt, Homo sapiens
ccaacagcagugaucuca

SEQ ID NO: 605870 - RNA, 15 nt, Homo sapiens
ccaacauuaaaacuc

SEQ ID NO: 605871 - RNA, 13 nt, Homo sapiens
ccaaccaaggaag

SEQ ID NO: 605872 - RNA, 18 nt, Homo sapiens
ccaaccagguugcaguag

SEQ ID NO: 605873 - RNA, 13 nt, Homo sapiens
ccaaccaguuuga

SEQ ID NO: 605874 - RNA, 13 nt, Homo sapiens
ccaaccccguguc

SEQ ID NO: 605875 - RNA, 10 nt, Homo sapiens
ccaaccucag

SEQ ID NO: 605876 - RNA, 13 nt, Homo sapiens
ccaaccucaggga

SEQ ID NO: 605877 - RNA, 15 nt, Homo sapiens
ccaaccuggacuugu

SEQ ID NO: 605878 - RNA, 22 nt, Homo sapiens
ccaaccuggaguauaauauuca

SEQ ID NO: 605879 - RNA, 21 nt, Homo sapiens
ccaaccuucuugucauugaaa

SEQ ID NO: 605880 - RNA, 15 nt, Homo sapiens
ccaacgacaaagcca

SEQ ID NO: 605881 - RNA, 19 nt, Homo sapiens
ccaacgcaccccugcacua

SEQ ID NO: 605882 - RNA, 15 nt, Homo sapiens
ccaacggcaacagca

SEQ ID NO: 605883 - RNA, 14 nt, Homo sapiens
ccaacguccccucc

SEQ ID NO: 605884 - RNA, 13 nt, Homo sapiens
ccaacuaacaguc

SEQ ID NO: 605885 - RNA, 21 nt, Homo sapiens
ccaacuaaugccuuacucuuc

SEQ ID NO: 605886 - RNA, 12 nt, Homo sapiens
ccaacuaggcag

SEQ ID NO: 605887 - RNA, 15 nt, Homo sapiens
ccaacucugcacucc

SEQ ID NO: 605888 - RNA, 23 nt, Homo sapiens
ccaacugaagccuucuucugcca

SEQ ID NO: 605889 - RNA, 20 nt, Homo sapiens
ccaacugcaaaaaaagccuc

SEQ ID NO: 605890 - RNA, 16 nt, Homo sapiens
ccaacugcagaccaac

SEQ ID NO: 605891 - RNA, 23 nt, Homo sapiens
ccaacugcuguucauguuacuca

SEQ ID NO: 605892 - RNA, 19 nt, Homo sapiens
ccaacuggaaauuccagga

SEQ ID NO: 605893 - RNA, 21 nt, Homo sapiens
ccaacuuccuguugauguuca

SEQ ID NO: 605894 - RNA, 21 nt, Homo sapiens
ccaacuugagggcccagagca

SEQ ID NO: 605895 - RNA, 20 nt, Homo sapiens
ccaacuugaugucaagcaau

SEQ ID NO: 605896 - RNA, 23 nt, Homo sapiens
ccaacuuguaaauacaccaccuc

SEQ ID NO: 605897 - RNA, 20 nt, Homo sapiens
ccaacuuuccccacguuaaa

SEQ ID NO: 605898 - RNA, 16 nt, Homo sapiens
ccaacuuuguuuucca

SEQ ID NO: 605899 - RNA, 13 nt, Homo sapiens
ccaacuuuugcau

SEQ ID NO: 605900 - RNA, 23 nt, Homo sapiens
ccaagaaaaucacaucacuaccu

SEQ ID NO: 605901 - RNA, 19 nt, Homo sapiens
ccaagaaagcucacuguag

SEQ ID NO: 605902 - RNA, 13 nt, Homo sapiens
ccaagaacugcag

SEQ ID NO: 605903 - RNA, 14 nt, Homo sapiens
ccaagaacugcaga

SEQ ID NO: 605904 - RNA, 13 nt, Homo sapiens
ccaagaacugcau

SEQ ID NO: 605905 - RNA, 15 nt, Homo sapiens
ccaagaaggagaccu

SEQ ID NO: 605906 - RNA, 20 nt, Homo sapiens
ccaagaauauugcaaaauac

SEQ ID NO: 605907 - RNA, 22 nt, Homo sapiens
ccaagacaaaaagccacaauga

SEQ ID NO: 605908 - RNA, 18 nt, Homo sapiens
ccaagacagugcugagau

SEQ ID NO: 605909 - RNA, 18 nt, Homo sapiens
ccaagacaugacauucuu

SEQ ID NO: 605910 - RNA, 21 nt, Homo sapiens
ccaagagcauaacuguucuca

SEQ ID NO: 605911 - RNA, 15 nt, Homo sapiens
ccaagaggauuucuu

SEQ ID NO: 605912 - RNA, 14 nt, Homo sapiens
ccaagaugagcugc

SEQ ID NO: 605913 - RNA, 19 nt, Homo sapiens
ccaagaugucaaaacaaga

SEQ ID NO: 605914 - RNA, 22 nt, Homo sapiens
ccaagauuaugugacuugcaau

SEQ ID NO: 605915 - RNA, 23 nt, Homo sapiens
ccaagauuaugugacuugcaaua

SEQ ID NO: 605916 - RNA, 19 nt, Homo sapiens
ccaagauuguccuuuucuc

SEQ ID NO: 605917 - RNA, 21 nt, Homo sapiens
ccaagcaaaccaauggugauc

SEQ ID NO: 605918 - RNA, 16 nt, Homo sapiens
ccaagcacagagccug

SEQ ID NO: 605919 - RNA, 13 nt, Homo sapiens
ccaagcacuucac

SEQ ID NO: 605920 - RNA, 18 nt, Homo sapiens
ccaagcaggaaccccagg

SEQ ID NO: 605921 - RNA, 16 nt, Homo sapiens
ccaagccccuguaaau

SEQ ID NO: 605922 - RNA, 22 nt, Homo sapiens
ccaagcucccugccccaaauaa

SEQ ID NO: 605923 - RNA, 18 nt, Homo sapiens
ccaagcuggccacuauca

SEQ ID NO: 605924 - RNA, 22 nt, Homo sapiens
ccaaggaacucuacuucaguca

SEQ ID NO: 605925 - RNA, 22 nt, Homo sapiens
ccaaggaaucagcaggaugugu

SEQ ID NO: 605926 - RNA, 16 nt, Homo sapiens
ccaaggaccucucuca

SEQ ID NO: 605927 - RNA, 13 nt, Homo sapiens
ccaaggagaccaa

SEQ ID NO: 605928 - RNA, 19 nt, Homo sapiens
ccaaggaggaaaaacagac

SEQ ID NO: 605929 - RNA, 15 nt, Homo sapiens
ccaaggaggggccag

SEQ ID NO: 605930 - RNA, 21 nt, Homo sapiens
ccaaggaggguguaauggagc

SEQ ID NO: 605931 - RNA, 16 nt, Homo sapiens
ccaaggauauuuacag

SEQ ID NO: 605932 - RNA, 15 nt, Homo sapiens
ccaaggaugaccaca

SEQ ID NO: 605933 - RNA, 15 nt, Homo sapiens
ccaaggaugcuguca

SEQ ID NO: 605934 - RNA, 21 nt, Homo sapiens
ccaaggccacggagcaguuca

SEQ ID NO: 605935 - RNA, 21 nt, Homo sapiens
ccaaggccuucuccuccccac

SEQ ID NO: 605936 - RNA, 18 nt, Homo sapiens
ccaaggccuuuccuacau

SEQ ID NO: 605937 - RNA, 17 nt, Homo sapiens
ccaagggaaaggggugc

SEQ ID NO: 605938 - RNA, 22 nt, Homo sapiens
ccaagggacccuuugccuuucu

SEQ ID NO: 605939 - RNA, 22 nt, Homo sapiens
ccaagggcugaguguccagcac

SEQ ID NO: 605940 - RNA, 14 nt, Homo sapiens
ccaaggucacucuu

SEQ ID NO: 605941 - RNA, 11 nt, Homo sapiens
ccaagguccug

SEQ ID NO: 605942 - RNA, 18 nt, Homo sapiens
ccaaggugaauagcacag

SEQ ID NO: 605943 - RNA, 19 nt, Homo sapiens
ccaaggugaauagcacagg

SEQ ID NO: 605944 - RNA, 17 nt, Homo sapiens
ccaaggugcacauuuuc

SEQ ID NO: 605945 - RNA, 12 nt, Homo sapiens
ccaaggugggca

SEQ ID NO: 605946 - RNA, 19 nt, Homo sapiens
ccaaggugggcagaucacu

SEQ ID NO: 605947 - RNA, 22 nt, Homo sapiens
ccaaguaaacaggguaccucaa

SEQ ID NO: 605948 - RNA, 22 nt, Homo sapiens
ccaaguccagauuuacacuggg

SEQ ID NO: 605949 - RNA, 15 nt, Homo sapiens
ccaagugaguugaau

SEQ ID NO: 605950 - RNA, 12 nt, Homo sapiens
ccaagugcaaua

SEQ ID NO: 605951 - RNA, 16 nt, Homo sapiens
ccaagugccaauauuu

SEQ ID NO: 605952 - RNA, 17 nt, Homo sapiens
ccaagugccuaugcaaa

SEQ ID NO: 605953 - RNA, 15 nt, Homo sapiens
ccaagugugaacaaa

SEQ ID NO: 605954 - RNA, 17 nt, Homo sapiens
ccaagugugaugcauug

SEQ ID NO: 605955 - RNA, 22 nt, Homo sapiens
ccaaguuaccuacaagaacaau

SEQ ID NO: 605956 - RNA, 19 nt, Homo sapiens
ccaaguuaucaucucacca

SEQ ID NO: 605957 - RNA, 14 nt, Homo sapiens
ccaaguuccacugc

SEQ ID NO: 605958 - RNA, 18 nt, Homo sapiens
ccaaguugaagacuuugu

SEQ ID NO: 605959 - RNA, 21 nt, Homo sapiens
ccaaguugagauuuuaauucu

SEQ ID NO: 605960 - RNA, 16 nt, Homo sapiens
ccaaguuuccauagca

SEQ ID NO: 605961 - RNA, 13 nt, Homo sapiens
ccaauaaaacuga

SEQ ID NO: 605962 - RNA, 19 nt, Homo sapiens
ccaauagggcugagcucuc

SEQ ID NO: 605963 - RNA, 18 nt, Homo sapiens
ccaauagugucauccuca

SEQ ID NO: 605964 - RNA, 16 nt, Homo sapiens
ccaauauaacuaucuc

SEQ ID NO: 605965 - RNA, 16 nt, Homo sapiens
ccaauauuuaccagac

SEQ ID NO: 605966 - RNA, 17 nt, Homo sapiens
ccaauauuuaccagacc

SEQ ID NO: 605967 - RNA, 19 nt, Homo sapiens
ccaauauuucucagacauc

SEQ ID NO: 605968 - RNA, 20 nt, Homo sapiens
ccaauauuucucagacaucg

SEQ ID NO: 605969 - RNA, 14 nt, Homo sapiens
ccaaucauuuuaau

SEQ ID NO: 605970 - RNA, 19 nt, Homo sapiens
ccaaucccaccaacccuca

SEQ ID NO: 605971 - RNA, 18 nt, Homo sapiens
ccaaucccagcuaccuca

SEQ ID NO: 605972 - RNA, 16 nt, Homo sapiens
ccaauccccagacuca

SEQ ID NO: 605973 - RNA, 21 nt, Homo sapiens
ccaauccuuaaauaugugaaa

SEQ ID NO: 605974 - RNA, 12 nt, Homo sapiens
ccaaucuugccc

SEQ ID NO: 605975 - RNA, 15 nt, Homo sapiens
ccaaugaaauacuga

SEQ ID NO: 605976 - RNA, 18 nt, Homo sapiens
ccaaugagacucuagggu

SEQ ID NO: 605977 - RNA, 20 nt, Homo sapiens
ccaaugagggaauccauuga

SEQ ID NO: 605978 - RNA, 11 nt, Homo sapiens
ccaaugccugu

SEQ ID NO: 605979 - RNA, 17 nt, Homo sapiens
ccaaugccugugaagca

SEQ ID NO: 605980 - RNA, 22 nt, Homo sapiens
ccaaugcuuucucaugucucaa

SEQ ID NO: 605981 - RNA, 16 nt, Homo sapiens
ccaauggaaaccucac

SEQ ID NO: 605982 - RNA, 22 nt, Homo sapiens
ccaaugggaugaggucacuuuu

SEQ ID NO: 605983 - RNA, 19 nt, Homo sapiens
ccaaugggccuccagagac

SEQ ID NO: 605984 - RNA, 15 nt, Homo sapiens
ccaauggugcuuccc

SEQ ID NO: 605985 - RNA, 13 nt, Homo sapiens
ccaauguauuuau

SEQ ID NO: 605986 - RNA, 20 nt, Homo sapiens
ccaauguccugaaacaugaa

SEQ ID NO: 605987 - RNA, 21 nt, Homo sapiens
ccaauguccugaaacaugaac

SEQ ID NO: 605988 - RNA, 20 nt, Homo sapiens
ccaauuacagggugacucac

SEQ ID NO: 605989 - RNA, 14 nt, Homo sapiens
ccaauuauuugacu

SEQ ID NO: 605990 - RNA, 18 nt, Homo sapiens
ccaauucaccaacacagu

SEQ ID NO: 605991 - RNA, 17 nt, Homo sapiens
ccaauuccaaagccaga

SEQ ID NO: 605992 - RNA, 18 nt, Homo sapiens
ccaauuccaaagccagac

SEQ ID NO: 605993 - RNA, 23 nt, Homo sapiens
ccaauucuaaauccgacuugaau

SEQ ID NO: 605994 - RNA, 14 nt, Homo sapiens
ccaauucugaaaua

SEQ ID NO: 605995 - RNA, 12 nt, Homo sapiens
ccaauugaugua

SEQ ID NO: 605996 - RNA, 19 nt, Homo sapiens
ccaauugcuggaguacuua

SEQ ID NO: 605997 - RNA, 18 nt, Homo sapiens
ccaauugggaaugcaaua

SEQ ID NO: 605998 - RNA, 22 nt, Homo sapiens
ccaauuugguaaaaaugcugcu

SEQ ID NO: 605999 - RNA, 23 nt, Homo sapiens
ccaauuuucuggaauacaugaaa

SEQ ID NO: 606000 - RNA, 20 nt, Homo sapiens
ccaauuuuuuaagugaaaau

SEQ ID NO: 606001 - RNA, 13 nt, Homo sapiens
ccacaaccaaaaa

SEQ ID NO: 606002 - RNA, 14 nt, Homo sapiens
ccacaaccaaaaaa

SEQ ID NO: 606003 - RNA, 21 nt, Homo sapiens
ccacaacuauauuaucaugca

SEQ ID NO: 606004 - RNA, 16 nt, Homo sapiens
ccacaagagugaauuu

SEQ ID NO: 606005 - RNA, 15 nt, Homo sapiens
ccacaagcaccugcu

SEQ ID NO: 606006 - RNA, 22 nt, Homo sapiens
ccacaaggccugaggagcagug

SEQ ID NO: 606007 - RNA, 18 nt, Homo sapiens
ccacaaguuaguagcaaa

SEQ ID NO: 606008 - RNA, 21 nt, Homo sapiens
ccacaauagcagacaguguuu

SEQ ID NO: 606009 - RNA, 18 nt, Homo sapiens
ccacaaucugggacuuuc

SEQ ID NO: 606010 - RNA, 19 nt, Homo sapiens
ccacaaucugggacuuuca

SEQ ID NO: 606011 - RNA, 18 nt, Homo sapiens
ccacaaugcugaugaaaa

SEQ ID NO: 606012 - RNA, 15 nt, Homo sapiens
ccacaauguuuauaa

SEQ ID NO: 606013 - RNA, 14 nt, Homo sapiens
ccacacacagagga

SEQ ID NO: 606014 - RNA, 12 nt, Homo sapiens
ccacacauauug

SEQ ID NO: 606015 - RNA, 14 nt, Homo sapiens
ccacacauauugca

SEQ ID NO: 606016 - RNA, 23 nt, Homo sapiens
ccacacauuuaaaacauuugaag

SEQ ID NO: 606017 - RNA, 13 nt, Homo sapiens
ccacaccaucucc

SEQ ID NO: 606018 - RNA, 15 nt, Homo sapiens
ccacacccacuuugu

SEQ ID NO: 606019 - RNA, 11 nt, Homo sapiens
ccacaccucag

SEQ ID NO: 606020 - RNA, 16 nt, Homo sapiens
ccacacuagaauucau

SEQ ID NO: 606021 - RNA, 19 nt, Homo sapiens
ccacagaaagcuccuucca

SEQ ID NO: 606022 - RNA, 22 nt, Homo sapiens
ccacagaaagcuccuuccagac

SEQ ID NO: 606023 - RNA, 14 nt, Homo sapiens
ccacagaagccagg

SEQ ID NO: 606024 - RNA, 21 nt, Homo sapiens
ccacagaccuacugcacugag

SEQ ID NO: 606025 - RNA, 19 nt, Homo sapiens
ccacagaccugcucuggac

SEQ ID NO: 606026 - RNA, 19 nt, Homo sapiens
ccacagacgggcacacaga

SEQ ID NO: 606027 - RNA, 23 nt, Homo sapiens
ccacagagaaguuuguagccagg

SEQ ID NO: 606028 - RNA, 18 nt, Homo sapiens
ccacagaugauacuucca

SEQ ID NO: 606029 - RNA, 16 nt, Homo sapiens
ccacagcaaccccagg

SEQ ID NO: 606030 - RNA, 19 nt, Homo sapiens
ccacagcaaccccaggcug

SEQ ID NO: 606031 - RNA, 20 nt, Homo sapiens
ccacagcagcugaacagcca

SEQ ID NO: 606032 - RNA, 23 nt, Homo sapiens
ccacagcaucauuuugcauucaa

SEQ ID NO: 606033 - RNA, 18 nt, Homo sapiens
ccacagccaggccgagag

SEQ ID NO: 606034 - RNA, 14 nt, Homo sapiens
ccacagcccuguca

SEQ ID NO: 606035 - RNA, 19 nt, Homo sapiens
ccacagccugcaagucagu

SEQ ID NO: 606036 - RNA, 17 nt, Homo sapiens
ccacagcuggcucugac

SEQ ID NO: 606037 - RNA, 19 nt, Homo sapiens
ccacagcugggcaggguga

SEQ ID NO: 606038 - RNA, 13 nt, Homo sapiens
ccacagcugugca

SEQ ID NO: 606039 - RNA, 15 nt, Homo sapiens
ccacagguacagagc

SEQ ID NO: 606040 - RNA, 22 nt, Homo sapiens
ccacagucccauuccuccacuc

SEQ ID NO: 606041 - RNA, 15 nt, Homo sapiens
ccacauaaaugcucc

SEQ ID NO: 606042 - RNA, 15 nt, Homo sapiens
ccacauaagaaggca

SEQ ID NO: 606043 - RNA, 22 nt, Homo sapiens
ccacauauuuuagacacuuccc

SEQ ID NO: 606044 - RNA, 14 nt, Homo sapiens
ccaccccaagagaa

SEQ ID NO: 606045 - RNA, 13 nt, Homo sapiens
ccaccccacacuu

SEQ ID NO: 606046 - RNA, 14 nt, Homo sapiens
ccacccccaaacac

SEQ ID NO: 606047 - RNA, 14 nt, Homo sapiens
ccacccccagcuca

SEQ ID NO: 606048 - RNA, 14 nt, Homo sapiens
ccacccccauggaa

SEQ ID NO: 606049 - RNA, 15 nt, Homo sapiens
ccacccgggggagcc

SEQ ID NO: 606050 - RNA, 14 nt, Homo sapiens
ccacccguccuccc

SEQ ID NO: 606051 - RNA, 13 nt, Homo sapiens
ccacccuggagac

SEQ ID NO: 606052 - RNA, 21 nt, Homo sapiens
ccaccgagccacgcagugccu

SEQ ID NO: 606053 - RNA, 21 nt, Homo sapiens
ccaccgcauaugcaugccagg

SEQ ID NO: 606054 - RNA, 19 nt, Homo sapiens
ccaccgccuucccugacac

SEQ ID NO: 606055 - RNA, 17 nt, Homo sapiens
ccaccguucagucauuu

SEQ ID NO: 606056 - RNA, 21 nt, Homo sapiens
ccaccucccugccuccaggaa

SEQ ID NO: 606057 - RNA, 13 nt, Homo sapiens
ccaccucucaggg

SEQ ID NO: 606058 - RNA, 16 nt, Homo sapiens
ccaccucuccuuuggc

SEQ ID NO: 606059 - RNA, 21 nt, Homo sapiens
ccaccucuggccaaauaugca

SEQ ID NO: 606060 - RNA, 19 nt, Homo sapiens
ccaccucuguggcauugaa

SEQ ID NO: 606061 - RNA, 17 nt, Homo sapiens
ccaccucuugugcaagg

SEQ ID NO: 606062 - RNA, 16 nt, Homo sapiens
ccaccugacauguccu

SEQ ID NO: 606063 - RNA, 23 nt, Homo sapiens
ccaccugccgcaugcucccuccu

SEQ ID NO: 606064 - RNA, 16 nt, Homo sapiens
ccaccugccugcaucu

SEQ ID NO: 606065 - RNA, 19 nt, Homo sapiens
ccaccuggacacaacacca

SEQ ID NO: 606066 - RNA, 14 nt, Homo sapiens
ccaccugucccacu

SEQ ID NO: 606067 - RNA, 15 nt, Homo sapiens
ccaccugucugauuu

SEQ ID NO: 606068 - RNA, 15 nt, Homo sapiens
ccaccugugcccuca

SEQ ID NO: 606069 - RNA, 17 nt, Homo sapiens
ccaccuugaccauaaau

SEQ ID NO: 606070 - RNA, 21 nt, Homo sapiens
ccaccuugaucccaauccuua

SEQ ID NO: 606071 - RNA, 21 nt, Homo sapiens
ccaccuugccacccauucuuc

SEQ ID NO: 606072 - RNA, 22 nt, Homo sapiens
ccacgagcuguuuacuagggau

SEQ ID NO: 606073 - RNA, 21 nt, Homo sapiens
ccacgagggucaggacuguga

SEQ ID NO: 606074 - RNA, 16 nt, Homo sapiens
ccacgagggugccgug

SEQ ID NO: 606075 - RNA, 22 nt, Homo sapiens
ccacgagguuaaagaagcugca

SEQ ID NO: 606076 - RNA, 23 nt, Homo sapiens
ccacgcagcacccuucucggaga

SEQ ID NO: 606077 - RNA, 21 nt, Homo sapiens
ccacgcauacacacaugcccu

SEQ ID NO: 606078 - RNA, 21 nt, Homo sapiens
ccacgccaguugccucuugaa

SEQ ID NO: 606079 - RNA, 16 nt, Homo sapiens
ccacggagcaguucag

SEQ ID NO: 606080 - RNA, 23 nt, Homo sapiens
ccacggagggaggcaccaugcaa

SEQ ID NO: 606081 - RNA, 19 nt, Homo sapiens
ccacgugauuuccagugag

SEQ ID NO: 606082 - RNA, 18 nt, Homo sapiens
ccacguggggcucacuuu

SEQ ID NO: 606083 - RNA, 19 nt, Homo sapiens
ccacguggguccucuucaa

SEQ ID NO: 606084 - RNA, 20 nt, Homo sapiens
ccacgugugcuguggccagg

SEQ ID NO: 606085 - RNA, 19 nt, Homo sapiens
ccacguucucacacccacc

SEQ ID NO: 606086 - RNA, 17 nt, Homo sapiens
ccacuaaaaauauuguu

SEQ ID NO: 606087 - RNA, 17 nt, Homo sapiens
ccacuaacuccugagaa

SEQ ID NO: 606088 - RNA, 12 nt, Homo sapiens
ccacuacugcua

SEQ ID NO: 606089 - RNA, 15 nt, Homo sapiens
ccacuacuguagaaa

SEQ ID NO: 606090 - RNA, 20 nt, Homo sapiens
ccacuaggguccaccaggag

SEQ ID NO: 606091 - RNA, 18 nt, Homo sapiens
ccacuagugcaaaucaua

SEQ ID NO: 606092 - RNA, 18 nt, Homo sapiens
ccacuaucugggugcaug

SEQ ID NO: 606093 - RNA, 16 nt, Homo sapiens
ccacucaccagcccua

SEQ ID NO: 606094 - RNA, 17 nt, Homo sapiens
ccacucagcucaccucu

SEQ ID NO: 606095 - RNA, 18 nt, Homo sapiens
ccacucaggccacagugg

SEQ ID NO: 606096 - RNA, 18 nt, Homo sapiens
ccacuccaaaaaucagug

SEQ ID NO: 606097 - RNA, 23 nt, Homo sapiens
ccacucccagauggcucuuucua

SEQ ID NO: 606098 - RNA, 15 nt, Homo sapiens
ccacucccaucuccu

SEQ ID NO: 606099 - RNA, 15 nt, Homo sapiens
ccacucccugggaca

SEQ ID NO: 606100 - RNA, 14 nt, Homo sapiens
ccacuccuguacac

SEQ ID NO: 606101 - RNA, 16 nt, Homo sapiens
ccacuccuuccuucag

SEQ ID NO: 606102 - RNA, 17 nt, Homo sapiens
ccacucucccaccuccu

SEQ ID NO: 606103 - RNA, 22 nt, Homo sapiens
ccacucuggagcauuucucauc

SEQ ID NO: 606104 - RNA, 22 nt, Homo sapiens
ccacugaauugacaugacccuc

SEQ ID NO: 606105 - RNA, 14 nt, Homo sapiens
ccacugauaucaug

SEQ ID NO: 606106 - RNA, 20 nt, Homo sapiens
ccacugcaccugaccugcug

SEQ ID NO: 606107 - RNA, 21 nt, Homo sapiens
ccacugcccccugcugccaug

SEQ ID NO: 606108 - RNA, 22 nt, Homo sapiens
ccacugccuucgcuucuugccu

SEQ ID NO: 606109 - RNA, 18 nt, Homo sapiens
ccacugcguuguccacaa

SEQ ID NO: 606110 - RNA, 19 nt, Homo sapiens
ccacugcguuguccacaag

SEQ ID NO: 606111 - RNA, 19 nt, Homo sapiens
ccacugcuaugccauuucu

SEQ ID NO: 606112 - RNA, 15 nt, Homo sapiens
ccacugcugagcugg

SEQ ID NO: 606113 - RNA, 19 nt, Homo sapiens
ccacugcugcccccagaaa

SEQ ID NO: 606114 - RNA, 20 nt, Homo sapiens
ccacugggcucuggaccuca

SEQ ID NO: 606115 - RNA, 13 nt, Homo sapiens
ccacuggggacuu

SEQ ID NO: 606116 - RNA, 14 nt, Homo sapiens
ccacuggucaugcc

SEQ ID NO: 606117 - RNA, 22 nt, Homo sapiens
ccacuggucuguagggauuuuu

SEQ ID NO: 606118 - RNA, 12 nt, Homo sapiens
ccacugucugcc

SEQ ID NO: 606119 - RNA, 18 nt, Homo sapiens
ccacuguggcacuggcca

SEQ ID NO: 606120 - RNA, 16 nt, Homo sapiens
ccacuguguacugugg

SEQ ID NO: 606121 - RNA, 20 nt, Homo sapiens
ccacuuaaggaccuuuuuaa

SEQ ID NO: 606122 - RNA, 15 nt, Homo sapiens
ccacuuagcaugugu

SEQ ID NO: 606123 - RNA, 17 nt, Homo sapiens
ccacuucaucaaaauca

SEQ ID NO: 606124 - RNA, 15 nt, Homo sapiens
ccacuucauccccuc

SEQ ID NO: 606125 - RNA, 16 nt, Homo sapiens
ccacuucccacuugca

SEQ ID NO: 606126 - RNA, 21 nt, Homo sapiens
ccacuuccuuuuaacugccaa

SEQ ID NO: 606127 - RNA, 18 nt, Homo sapiens
ccacuucuccaugcugca

SEQ ID NO: 606128 - RNA, 16 nt, Homo sapiens
ccacuugaagcacuua

SEQ ID NO: 606129 - RNA, 16 nt, Homo sapiens
ccacuugggaggguca

SEQ ID NO: 606130 - RNA, 14 nt, Homo sapiens
ccacuuguucugua

SEQ ID NO: 606131 - RNA, 13 nt, Homo sapiens
ccacuuugacucc

SEQ ID NO: 606132 - RNA, 16 nt, Homo sapiens
ccacuuugaguaccaa

SEQ ID NO: 606133 - RNA, 14 nt, Homo sapiens
ccacuuugcagcua

SEQ ID NO: 606134 - RNA, 18 nt, Homo sapiens
ccacuuuugaagucuucc

SEQ ID NO: 606135 - RNA, 20 nt, Homo sapiens
ccagaaaaccucuccugacc

SEQ ID NO: 606136 - RNA, 15 nt, Homo sapiens
ccagaaaaggcauuu

SEQ ID NO: 606137 - RNA, 19 nt, Homo sapiens
ccagaaaccacaagcaaaa

SEQ ID NO: 606138 - RNA, 14 nt, Homo sapiens
ccagaaacuuuaag

SEQ ID NO: 606139 - RNA, 22 nt, Homo sapiens
ccagaaacuuuccaucccaaag

SEQ ID NO: 606140 - RNA, 15 nt, Homo sapiens
ccagaaagcugccag

SEQ ID NO: 606141 - RNA, 15 nt, Homo sapiens
ccagaaaucaaaaag

SEQ ID NO: 606142 - RNA, 23 nt, Homo sapiens
ccccgcuugguggccugggaucu

SEQ ID NO: 606143 - RNA, 21 nt, Homo sapiens
ccccgggaugcaccgguuauu

SEQ ID NO: 606144 - RNA, 17 nt, Homo sapiens
ccccgguugcuggucag

SEQ ID NO: 606145 - RNA, 23 nt, Homo sapiens
ccccguaccaccaugcacuguaa

SEQ ID NO: 606146 - RNA, 21 nt, Homo sapiens
ccccgucgaggggcucucagc

SEQ ID NO: 606147 - RNA, 22 nt, Homo sapiens
ccccgucucuauaccaaccaaa

SEQ ID NO: 606148 - RNA, 16 nt, Homo sapiens
ccccuaaaccaaaaac

SEQ ID NO: 606149 - RNA, 15 nt, Homo sapiens
ccccuacacugugaa

SEQ ID NO: 606150 - RNA, 14 nt, Homo sapiens
ccccuacagaauuu

SEQ ID NO: 606151 - RNA, 13 nt, Homo sapiens
ccccucaaacugc

SEQ ID NO: 606152 - RNA, 18 nt, Homo sapiens
ccccucaacacccugcuu

SEQ ID NO: 606153 - RNA, 15 nt, Homo sapiens
ccccucacucuguca

SEQ ID NO: 606154 - RNA, 18 nt, Homo sapiens
ccccucacucuguuuccu

SEQ ID NO: 606155 - RNA, 15 nt, Homo sapiens
ccccucagagugcaa

SEQ ID NO: 606156 - RNA, 15 nt, Homo sapiens
ccccucagauuccac

SEQ ID NO: 606157 - RNA, 21 nt, Homo sapiens
ccccucagauuccaccuagag

SEQ ID NO: 606158 - RNA, 23 nt, Homo sapiens
ccccucagccuugggaccgugcc

SEQ ID NO: 606159 - RNA, 18 nt, Homo sapiens
ccccucagggggccagcu

SEQ ID NO: 606160 - RNA, 15 nt, Homo sapiens
ccccuccaggaauga

SEQ ID NO: 606161 - RNA, 16 nt, Homo sapiens
ccccuccggccugggc

SEQ ID NO: 606162 - RNA, 15 nt, Homo sapiens
ccccuccuccaggga

SEQ ID NO: 606163 - RNA, 14 nt, Homo sapiens
ccccuccuggcaau

SEQ ID NO: 606164 - RNA, 21 nt, Homo sapiens
ccccucguugcccagcacugu

SEQ ID NO: 606165 - RNA, 14 nt, Homo sapiens
ccccucucaccaaa

SEQ ID NO: 606166 - RNA, 14 nt, Homo sapiens
ccccucucaccuca

SEQ ID NO: 606167 - RNA, 19 nt, Homo sapiens
ccccucuggugucuuugau

SEQ ID NO: 606168 - RNA, 20 nt, Homo sapiens
ccccucuuagcuuacaggaa

SEQ ID NO: 606169 - RNA, 22 nt, Homo sapiens
ccccugagcaaugucugugcua

SEQ ID NO: 606170 - RNA, 16 nt, Homo sapiens
ccccugcacuaggcag

SEQ ID NO: 606171 - RNA, 20 nt, Homo sapiens
ccccugcugucucucugggc

SEQ ID NO: 606172 - RNA, 12 nt, Homo sapiens
ccccuggccuca

SEQ ID NO: 606173 - RNA, 15 nt, Homo sapiens
ccccuggcucugggc

SEQ ID NO: 606174 - RNA, 16 nt, Homo sapiens
ccccugggaacaggcc

SEQ ID NO: 606175 - RNA, 16 nt, Homo sapiens
ccccuggggcuguauu

SEQ ID NO: 606176 - RNA, 18 nt, Homo sapiens
ccccugguaaaccaagcc

SEQ ID NO: 606177 - RNA, 16 nt, Homo sapiens
ccccugguaagcagag

SEQ ID NO: 606178 - RNA, 20 nt, Homo sapiens
ccccuguggccaacugcaaa

SEQ ID NO: 606179 - RNA, 16 nt, Homo sapiens
ccccugugucauccca

SEQ ID NO: 606180 - RNA, 14 nt, Homo sapiens
ccccuguugugugg

SEQ ID NO: 606181 - RNA, 23 nt, Homo sapiens
ccccuuagccaguuguauauuau

SEQ ID NO: 606182 - RNA, 16 nt, Homo sapiens
ccccuuauuugcacuu

SEQ ID NO: 606183 - RNA, 12 nt, Homo sapiens
ccccuucauccg

SEQ ID NO: 606184 - RNA, 18 nt, Homo sapiens
ccccuucugacugagcaa

SEQ ID NO: 606185 - RNA, 14 nt, Homo sapiens
ccccuucuguguca

SEQ ID NO: 606186 - RNA, 14 nt, Homo sapiens
ccccuuggcuguga

SEQ ID NO: 606187 - RNA, 14 nt, Homo sapiens
ccccuugggugacc

SEQ ID NO: 606188 - RNA, 20 nt, Homo sapiens
ccccuugguacugaaaauga

SEQ ID NO: 606189 - RNA, 14 nt, Homo sapiens
ccccuuguccuuuc

SEQ ID NO: 606190 - RNA, 14 nt, Homo sapiens
ccccuuuccccacg

SEQ ID NO: 606191 - RNA, 20 nt, Homo sapiens
ccccuuuucugcauuuugcu

SEQ ID NO: 606192 - RNA, 12 nt, Homo sapiens
cccgaagccacc

SEQ ID NO: 606193 - RNA, 13 nt, Homo sapiens
cccgacagccugg

SEQ ID NO: 606194 - RNA, 12 nt, Homo sapiens
cccgagucaauu

SEQ ID NO: 606195 - RNA, 15 nt, Homo sapiens
cccgcaucaagguca

SEQ ID NO: 606196 - RNA, 21 nt, Homo sapiens
cccgccaccucagggcacgca

SEQ ID NO: 606197 - RNA, 20 nt, Homo sapiens
cccgccccagcccucaguca

SEQ ID NO: 606198 - RNA, 14 nt, Homo sapiens
cccgccuccaguca

SEQ ID NO: 606199 - RNA, 18 nt, Homo sapiens
cccggaagcgccaggcug

SEQ ID NO: 606200 - RNA, 17 nt, Homo sapiens
cccggagcuaacacugg

SEQ ID NO: 606201 - RNA, 23 nt, Homo sapiens
cccgggacgcagggguugcagug

SEQ ID NO: 606202 - RNA, 17 nt, Homo sapiens
cccggggccagcacuuc

SEQ ID NO: 606203 - RNA, 21 nt, Homo sapiens
cccggggcggcaggaaggggg

SEQ ID NO: 606204 - RNA, 22 nt, Homo sapiens
cccggggcuggcggcuacucag

SEQ ID NO: 606205 - RNA, 24 nt, Homo sapiens
cccggggggacgacgaugacaaug

SEQ ID NO: 606206 - RNA, 18 nt, Homo sapiens
cccggugguuugccaugu

SEQ ID NO: 606207 - RNA, 16 nt, Homo sapiens
cccgucauguuccuca

SEQ ID NO: 606208 - RNA, 15 nt, Homo sapiens
cccgucgugcuuccu

SEQ ID NO: 606209 - RNA, 17 nt, Homo sapiens
cccuaaaucuugacuac

SEQ ID NO: 606210 - RNA, 18 nt, Homo sapiens
cccuaagcagaccacuga

SEQ ID NO: 606211 - RNA, 21 nt, Homo sapiens
cccuaaggugagugugcagua

SEQ ID NO: 606212 - RNA, 21 nt, Homo sapiens
cccuaaucacaugugcugcaa

SEQ ID NO: 606213 - RNA, 15 nt, Homo sapiens
cccuacaaugcucau

SEQ ID NO: 606214 - RNA, 14 nt, Homo sapiens
cccuaccugucaac

SEQ ID NO: 606215 - RNA, 16 nt, Homo sapiens
cccuacuuucuggaag

SEQ ID NO: 606216 - RNA, 20 nt, Homo sapiens
cccuagaugcacguggggcc

SEQ ID NO: 606217 - RNA, 17 nt, Homo sapiens
cccuaggauacccagau

SEQ ID NO: 606218 - RNA, 13 nt, Homo sapiens
cccuauacacuag

SEQ ID NO: 606219 - RNA, 19 nt, Homo sapiens
cccuaugugggugggacca

SEQ ID NO: 606220 - RNA, 22 nt, Homo sapiens
cccuauuagggaguuaugcaaa

SEQ ID NO: 606221 - RNA, 20 nt, Homo sapiens
cccucaaaugacccaaagac

SEQ ID NO: 606222 - RNA, 16 nt, Homo sapiens
cccucaacugaagggg

SEQ ID NO: 606223 - RNA, 16 nt, Homo sapiens
cccucaccagccuugg

SEQ ID NO: 606224 - RNA, 15 nt, Homo sapiens
cccucaccucugaua

SEQ ID NO: 606225 - RNA, 21 nt, Homo sapiens
cccucaccuguagcagccagu

SEQ ID NO: 606226 - RNA, 13 nt, Homo sapiens
cccucagacuuca

SEQ ID NO: 606227 - RNA, 14 nt, Homo sapiens
cccucagagugcaa

SEQ ID NO: 606228 - RNA, 16 nt, Homo sapiens
cccucagucuucucau

SEQ ID NO: 606229 - RNA, 19 nt, Homo sapiens
cccucagucuucucaugaa

SEQ ID NO: 606230 - RNA, 13 nt, Homo sapiens
cccucaucauagc

SEQ ID NO: 606231 - RNA, 19 nt, Homo sapiens
cccucauccuuuuacuuuu

SEQ ID NO: 606232 - RNA, 17 nt, Homo sapiens
cccucaucuaugaggaa

SEQ ID NO: 606233 - RNA, 11 nt, Homo sapiens
cccucaugcaa

SEQ ID NO: 606234 - RNA, 18 nt, Homo sapiens
cccuccaaaaccuccauu

SEQ ID NO: 606235 - RNA, 22 nt, Homo sapiens
cccuccaaaaccuccauucccc

SEQ ID NO: 606236 - RNA, 16 nt, Homo sapiens
cccuccaaaagcacuu

SEQ ID NO: 606237 - RNA, 16 nt, Homo sapiens
cccuccaaaccuccag

SEQ ID NO: 606238 - RNA, 13 nt, Homo sapiens
cccuccaauccca

SEQ ID NO: 606239 - RNA, 20 nt, Homo sapiens
cccuccacaaagcaaaggca

SEQ ID NO: 606240 - RNA, 22 nt, Homo sapiens
cccuccaccgccacuaugggcc

SEQ ID NO: 606241 - RNA, 15 nt, Homo sapiens
cccuccaccuuccau

SEQ ID NO: 606242 - RNA, 14 nt, Homo sapiens
cccuccacugucac

SEQ ID NO: 606243 - RNA, 16 nt, Homo sapiens
cccuccagacaaugcc

SEQ ID NO: 606244 - RNA, 15 nt, Homo sapiens
cccuccaguguauga

SEQ ID NO: 606245 - RNA, 18 nt, Homo sapiens
cccuccaucucagccauu

SEQ ID NO: 606246 - RNA, 17 nt, Homo sapiens
cccucccagcugcacuu

SEQ ID NO: 606247 - RNA, 13 nt, Homo sapiens
cccucccauggca

SEQ ID NO: 606248 - RNA, 13 nt, Homo sapiens
cccuccccaugca

SEQ ID NO: 606249 - RNA, 15 nt, Homo sapiens
cccuccccugccauu

SEQ ID NO: 606250 - RNA, 21 nt, Homo sapiens
cccuugugagagcccauuccc

SEQ ID NO: 606251 - RNA, 22 nt, Homo sapiens
cccuuguggcacagaugcccac

SEQ ID NO: 606252 - RNA, 15 nt, Homo sapiens
cccuuguugcacugc

SEQ ID NO: 606253 - RNA, 15 nt, Homo sapiens
cccuuuaacucauga

SEQ ID NO: 606254 - RNA, 12 nt, Homo sapiens
cccuuuccuaaa

SEQ ID NO: 606255 - RNA, 19 nt, Homo sapiens
cccuuuccuacucucagga

SEQ ID NO: 606256 - RNA, 15 nt, Homo sapiens
cccuuugccaacaga

SEQ ID NO: 606257 - RNA, 14 nt, Homo sapiens
cccuuugggagcaa

SEQ ID NO: 606258 - RNA, 13 nt, Homo sapiens
cccuuuuacauac

SEQ ID NO: 606259 - RNA, 22 nt, Homo sapiens
cccuuuuaguuugaucagacag

SEQ ID NO: 606260 - RNA, 20 nt, Homo sapiens
cccuuuucauauacuuauuu

SEQ ID NO: 606261 - RNA, 22 nt, Homo sapiens
cccuuuucuggggaauuacuuu

SEQ ID NO: 606262 - RNA, 23 nt, Homo sapiens
cccuuuugggccuagaauucuga

SEQ ID NO: 606263 - RNA, 14 nt, Homo sapiens
cccuuuuucaauga

SEQ ID NO: 606264 - RNA, 17 nt, Homo sapiens
ccuacagaggucucugc

SEQ ID NO: 606265 - RNA, 15 nt, Homo sapiens
ccuacagggccacaa

SEQ ID NO: 606266 - RNA, 22 nt, Homo sapiens
ccuacagugcuguguacccugg

SEQ ID NO: 606267 - RNA, 14 nt, Homo sapiens
ccuacauuaucuca

SEQ ID NO: 606268 - RNA, 15 nt, Homo sapiens
ccuacauuaucucac

SEQ ID NO: 606269 - RNA, 20 nt, Homo sapiens
ccuacauuaucucacuuagu

SEQ ID NO: 606270 - RNA, 15 nt, Homo sapiens
ccuaccaggacagaa

SEQ ID NO: 606271 - RNA, 16 nt, Homo sapiens
ccuaccaguugcccua

SEQ ID NO: 606272 - RNA, 15 nt, Homo sapiens
ccuaccaucagggac

SEQ ID NO: 606273 - RNA, 21 nt, Homo sapiens
ccuacccccuaagagccauuu

SEQ ID NO: 606274 - RNA, 15 nt, Homo sapiens
ccuaccccucuucca

SEQ ID NO: 606275 - RNA, 21 nt, Homo sapiens
ccuaccuuagaaaacaaguau

SEQ ID NO: 606276 - RNA, 15 nt, Homo sapiens
ccuaccuucauuuca

SEQ ID NO: 606277 - RNA, 22 nt, Homo sapiens
ccucucagauucuuaucuggca

SEQ ID NO: 606278 - RNA, 20 nt, Homo sapiens
ccucucagggccacuggcag

SEQ ID NO: 606279 - RNA, 16 nt, Homo sapiens
ccucucaugacuugca

SEQ ID NO: 606280 - RNA, 18 nt, Homo sapiens
ccucucauugucuuguua

SEQ ID NO: 606281 - RNA, 20 nt, Homo sapiens
ccucuccaggaaugccuccu

SEQ ID NO: 606282 - RNA, 20 nt, Homo sapiens
ccucucccaguccauuucca

SEQ ID NO: 606283 - RNA, 15 nt, Homo sapiens
ccucucccucugguc

SEQ ID NO: 606284 - RNA, 14 nt, Homo sapiens
ccucuccuucccac

SEQ ID NO: 606285 - RNA, 20 nt, Homo sapiens
ccucucgcacaaugcaugug

SEQ ID NO: 606286 - RNA, 16 nt, Homo sapiens
ccucucucacacauca

SEQ ID NO: 606287 - RNA, 13 nt, Homo sapiens
cgaucaguggugu

SEQ ID NO: 606288 - RNA, 21 nt, Homo sapiens
cgaucaguggugucugugaag

SEQ ID NO: 606289 - RNA, 13 nt, Homo sapiens
cgaucuccugacc

SEQ ID NO: 606290 - RNA, 15 nt, Homo sapiens
cgaucucuccuggcc

SEQ ID NO: 606291 - RNA, 12 nt, Homo sapiens
cgaugacuguga

SEQ ID NO: 606292 - RNA, 19 nt, Homo sapiens
cgaugauacuguuucuugc

SEQ ID NO: 606293 - RNA, 23 nt, Homo sapiens
cggauuugcucaggccugggaau

SEQ ID NO: 606294 - RNA, 13 nt, Homo sapiens
cggcaaaagccca

SEQ ID NO: 606295 - RNA, 17 nt, Homo sapiens
cggcaaccccaguucug

SEQ ID NO: 606296 - RNA, 23 nt, Homo sapiens
cggcaacugccuuccugccucuc

SEQ ID NO: 606297 - RNA, 16 nt, Homo sapiens
cggcacgggcugggga

SEQ ID NO: 606298 - RNA, 12 nt, Homo sapiens
cgugucagcuca

SEQ ID NO: 606299 - RNA, 16 nt, Homo sapiens
cgugugcgugcaugug

SEQ ID NO: 606300 - RNA, 19 nt, Homo sapiens
cguguggacacagauccca

SEQ ID NO: 606301 - RNA, 10 nt, Homo sapiens
cuacauauau

SEQ ID NO: 606302 - RNA, 13 nt, Homo sapiens
cuacaugaugacu

SEQ ID NO: 606303 - RNA, 19 nt, Homo sapiens
cuacauggaguauauguca

SEQ ID NO: 606304 - RNA, 18 nt, Homo sapiens
cuacauuucuacuaugau

SEQ ID NO: 606305 - RNA, 14 nt, Homo sapiens
cuaccaaaacaguu

SEQ ID NO: 606306 - RNA, 17 nt, Homo sapiens
cuaccaaauaauuucau

SEQ ID NO: 606307 - RNA, 13 nt, Homo sapiens
cuaccacaaggaa

SEQ ID NO: 606308 - RNA, 15 nt, Homo sapiens
cuaccacagugucug

SEQ ID NO: 606309 - RNA, 19 nt, Homo sapiens
cuaccagucuauuuccacu

SEQ ID NO: 606310 - RNA, 19 nt, Homo sapiens
cuaccauaagugacaccaa

SEQ ID NO: 606311 - RNA, 17 nt, Homo sapiens
cuaccaucugauguuuc

SEQ ID NO: 606312 - RNA, 17 nt, Homo sapiens
cuacccaugacuuuaua

SEQ ID NO: 606313 - RNA, 9 nt, Homo sapiens
cuaccccag

SEQ ID NO: 606314 - RNA, 17 nt, Homo sapiens
cuaccccuuucuucucg

SEQ ID NO: 606315 - RNA, 22 nt, Homo sapiens
cuacccgcccgcguccaacccc

SEQ ID NO: 606316 - RNA, 23 nt, Homo sapiens
cuacccggcccagagaccccuuc

SEQ ID NO: 606317 - RNA, 16 nt, Homo sapiens
cuacccuaaagggaga

SEQ ID NO: 606318 - RNA, 18 nt, Homo sapiens
cuacccuuaauaacauac

SEQ ID NO: 606319 - RNA, 16 nt, Homo sapiens
cuaccucaaacuucca

SEQ ID NO: 606320 - RNA, 21 nt, Homo sapiens
cuaccucaaccaaugccaaaa

SEQ ID NO: 606321 - RNA, 16 nt, Homo sapiens
cuaccucaccugggca

SEQ ID NO: 606322 - RNA, 14 nt, Homo sapiens
cuaccucagccucc

SEQ ID NO: 606323 - RNA, 16 nt, Homo sapiens
cuaccucaucucugaa

SEQ ID NO: 606324 - RNA, 21 nt, Homo sapiens
cuaccuccccaagacuuuacu

SEQ ID NO: 606325 - RNA, 20 nt, Homo sapiens
cuaccugagcauucaggcag

SEQ ID NO: 606326 - RNA, 16 nt, Homo sapiens
cuaccugagcuaaaua

SEQ ID NO: 606327 - RNA, 20 nt, Homo sapiens
cuaccugcugcugcuauuau

SEQ ID NO: 606328 - RNA, 22 nt, Homo sapiens
cuaccuguaggaucagggucua

SEQ ID NO: 606329 - RNA, 16 nt, Homo sapiens
cuaccuuaaacuuaag

SEQ ID NO: 606330 - RNA, 13 nt, Homo sapiens
cuaccuucagggu

SEQ ID NO: 606331 - RNA, 14 nt, Homo sapiens
cuacgccaaagugc

SEQ ID NO: 606332 - RNA, 19 nt, Homo sapiens
cuacggggaaaaugcauuu

SEQ ID NO: 606333 - RNA, 15 nt, Homo sapiens
cuacggguaggucua

SEQ ID NO: 606334 - RNA, 16 nt, Homo sapiens
cuacgguuaugaaggc

SEQ ID NO: 606335 - RNA, 23 nt, Homo sapiens
cuacgugauuuggcugcacuuga

SEQ ID NO: 606336 - RNA, 14 nt, Homo sapiens
cuacuaaaaacaca

SEQ ID NO: 606337 - RNA, 20 nt, Homo sapiens
cuacuacaaacuucaaagag

SEQ ID NO: 606338 - RNA, 15 nt, Homo sapiens
cuacuagggaaaaau

SEQ ID NO: 606339 - RNA, 13 nt, Homo sapiens
cuacuaucacuga

SEQ ID NO: 606340 - RNA, 19 nt, Homo sapiens
cuacucaagaggcugaggc

SEQ ID NO: 606341 - RNA, 19 nt, Homo sapiens
cuacucaggaggcugaggc

SEQ ID NO: 606342 - RNA, 12 nt, Homo sapiens
cuacucauucag

SEQ ID NO: 606343 - RNA, 19 nt, Homo sapiens
cuacuccccuuucuuccaa

SEQ ID NO: 606344 - RNA, 15 nt, Homo sapiens
cuacucccucuucac

SEQ ID NO: 606345 - RNA, 21 nt, Homo sapiens
cuacuccucugcagugccuug

SEQ ID NO: 606346 - RNA, 23 nt, Homo sapiens
cuacucuguuccuucacauccug

SEQ ID NO: 606347 - RNA, 16 nt, Homo sapiens
cuacucuucagggucu

SEQ ID NO: 606348 - RNA, 21 nt, Homo sapiens
cuacugaacaguccaucuucu

SEQ ID NO: 606349 - RNA, 21 nt, Homo sapiens
cuacugacauaucuacacuuc

SEQ ID NO: 606350 - RNA, 20 nt, Homo sapiens
cuacugacggaguccugugu

SEQ ID NO: 606351 - RNA, 16 nt, Homo sapiens
cuacugacuacccucu

SEQ ID NO: 606352 - RNA, 19 nt, Homo sapiens
cuacugaguagggggagca

SEQ ID NO: 606353 - RNA, 13 nt, Homo sapiens
cuacugauacuuu

SEQ ID NO: 606354 - RNA, 13 nt, Homo sapiens
cuacugaugcugu

SEQ ID NO: 606355 - RNA, 18 nt, Homo sapiens
cuacugcaaauggcaguu

SEQ ID NO: 606356 - RNA, 17 nt, Homo sapiens
cuacugcagcaccucca

SEQ ID NO: 606357 - RNA, 15 nt, Homo sapiens
cuacugccacugugu

SEQ ID NO: 606358 - RNA, 17 nt, Homo sapiens
cuacugcuaauguugau

SEQ ID NO: 606359 - RNA, 15 nt, Homo sapiens
cuacuggaauggugu

SEQ ID NO: 606360 - RNA, 22 nt, Homo sapiens
cuacuggaaugguguuuuguca

SEQ ID NO: 606361 - RNA, 13 nt, Homo sapiens
cuacuggcagcuc

SEQ ID NO: 606362 - RNA, 13 nt, Homo sapiens
cuacuggcauuaa

SEQ ID NO: 606363 - RNA, 17 nt, Homo sapiens
cuacuggggaucagagu

SEQ ID NO: 606364 - RNA, 19 nt, Homo sapiens
cuacugggugucauuucau

SEQ ID NO: 606365 - RNA, 15 nt, Homo sapiens
cuacugucucacuga

SEQ ID NO: 606366 - RNA, 23 nt, Homo sapiens
cuacugugucuuggaaucuagcc

SEQ ID NO: 606367 - RNA, 18 nt, Homo sapiens
cuacuguuacucuaaaua

SEQ ID NO: 606368 - RNA, 20 nt, Homo sapiens
cuacuguuccuuucagauga

SEQ ID NO: 606369 - RNA, 15 nt, Homo sapiens
cuacuucauagcucc

SEQ ID NO: 606370 - RNA, 17 nt, Homo sapiens
cuacuuccccauuucag

SEQ ID NO: 606371 - RNA, 23 nt, Homo sapiens
cuacuuccccugggaugcugacc

SEQ ID NO: 606372 - RNA, 23 nt, Homo sapiens
cuacuucuccccuccucuugccu

SEQ ID NO: 606373 - RNA, 23 nt, Homo sapiens
cuacuucugaaacugcagcagug

SEQ ID NO: 606374 - RNA, 17 nt, Homo sapiens
cuacuucuuuugcucuu

SEQ ID NO: 606375 - RNA, 23 nt, Homo sapiens
cuacuugccugggaaacauagca

SEQ ID NO: 606376 - RNA, 14 nt, Homo sapiens
cuacuugggagcac

SEQ ID NO: 606377 - RNA, 20 nt, Homo sapiens
cuacuuuaauauaaacccau

SEQ ID NO: 606378 - RNA, 21 nt, Homo sapiens
cuacuuuaauauaaacccaua

SEQ ID NO: 606379 - RNA, 18 nt, Homo sapiens
cuacuuugauaugacugu

SEQ ID NO: 606380 - RNA, 15 nt, Homo sapiens
cuacuuuguggcaau

SEQ ID NO: 606381 - RNA, 18 nt, Homo sapiens
cuagaaacccaagcuccu

SEQ ID NO: 606382 - RNA, 14 nt, Homo sapiens
cuagaaacucuggc

SEQ ID NO: 606383 - RNA, 18 nt, Homo sapiens
cuagaaagagaaacaguu

SEQ ID NO: 606384 - RNA, 20 nt, Homo sapiens
cuagaaauaagcccaacaga

SEQ ID NO: 606385 - RNA, 17 nt, Homo sapiens
cuagaaauagguuaaac

SEQ ID NO: 606386 - RNA, 13 nt, Homo sapiens
cuagaaaucuguu

SEQ ID NO: 606387 - RNA, 19 nt, Homo sapiens
cuagaacaguaaaagccuu

SEQ ID NO: 606388 - RNA, 19 nt, Homo sapiens
cuagaacucuccaucuuau

SEQ ID NO: 606389 - RNA, 23 nt, Homo sapiens
cuagaagaaaagcccauuuucaa

SEQ ID NO: 606390 - RNA, 12 nt, Homo sapiens
cuagaagccaag

SEQ ID NO: 606391 - RNA, 18 nt, Homo sapiens
cuagaaggccacauguca

SEQ ID NO: 606392 - RNA, 13 nt, Homo sapiens
cuagaagugugaa

SEQ ID NO: 606393 - RNA, 24 nt, Homo sapiens
cuagaauauuuaaaacaucauuac

SEQ ID NO: 606394 - RNA, 16 nt, Homo sapiens
cuagaaucuucuuaca

SEQ ID NO: 606395 - RNA, 12 nt, Homo sapiens
cuagacauauuu

SEQ ID NO: 606396 - RNA, 22 nt, Homo sapiens
cuagaccaguuugcaugauucu

SEQ ID NO: 606397 - RNA, 13 nt, Homo sapiens
cuagacugccagg

SEQ ID NO: 606398 - RNA, 19 nt, Homo sapiens
cuagacugccagggagacc

SEQ ID NO: 606399 - RNA, 21 nt, Homo sapiens
cuagacuucccaacagccuua

SEQ ID NO: 606400 - RNA, 22 nt, Homo sapiens
cuagacuucccaacagccuuag

SEQ ID NO: 606401 - RNA, 18 nt, Homo sapiens
cuagacuucugaguaauu

SEQ ID NO: 606402 - RNA, 23 nt, Homo sapiens
cuagagaagaggcuggugcugug

SEQ ID NO: 606403 - RNA, 18 nt, Homo sapiens
cuagagaaggcauuucau

SEQ ID NO: 606404 - RNA, 19 nt, Homo sapiens
cuagagauaaaacagaauc

SEQ ID NO: 606405 - RNA, 14 nt, Homo sapiens
cuagagaugacuga

SEQ ID NO: 606406 - RNA, 17 nt, Homo sapiens
cuagagcuagauguguc

SEQ ID NO: 606407 - RNA, 18 nt, Homo sapiens
cuagagcuagaugugucu

SEQ ID NO: 606408 - RNA, 20 nt, Homo sapiens
cuagagcugacagcuuuguu

SEQ ID NO: 606409 - RNA, 18 nt, Homo sapiens
cuagagucucacugcugg

SEQ ID NO: 606410 - RNA, 20 nt, Homo sapiens
cuagagugcagggauuacag

SEQ ID NO: 606411 - RNA, 14 nt, Homo sapiens
cuagaguguagccu

SEQ ID NO: 606412 - RNA, 14 nt, Homo sapiens
cuagauacucgugu

SEQ ID NO: 606413 - RNA, 13 nt, Homo sapiens
cuagauacuggaa

SEQ ID NO: 606414 - RNA, 13 nt, Homo sapiens
cuagauacuguau

SEQ ID NO: 606415 - RNA, 15 nt, Homo sapiens
cuagauccacacaca

SEQ ID NO: 606416 - RNA, 16 nt, Homo sapiens
cuagaugcaucacugg

SEQ ID NO: 606417 - RNA, 20 nt, Homo sapiens
cuagcaacccuaacaguaag

SEQ ID NO: 606418 - RNA, 19 nt, Homo sapiens
cuagcagaggaaaguguaa

SEQ ID NO: 606419 - RNA, 13 nt, Homo sapiens
cuagcagcaccgu

SEQ ID NO: 606420 - RNA, 21 nt, Homo sapiens
cuagcaguaaaagauaaauuu

SEQ ID NO: 606421 - RNA, 18 nt, Homo sapiens
cuagcauucuaguuucau

SEQ ID NO: 606422 - RNA, 12 nt, Homo sapiens
cuagcauuguaa

SEQ ID NO: 606423 - RNA, 20 nt, Homo sapiens
cucugauuuccuucugcuau

SEQ ID NO: 606424 - RNA, 23 nt, Homo sapiens
cucugcaaaggaaauaccaguuc

SEQ ID NO: 606425 - RNA, 22 nt, Homo sapiens
cucugcacaagcugcacccuca

SEQ ID NO: 606426 - RNA, 15 nt, Homo sapiens
cucugcaccuuugca

SEQ ID NO: 606427 - RNA, 16 nt, Homo sapiens
cucugcaccuuugcac

SEQ ID NO: 606428 - RNA, 16 nt, Homo sapiens
cucugcacuacugaca

SEQ ID NO: 606429 - RNA, 20 nt, Homo sapiens
cucugcagcccucagauuau

SEQ ID NO: 606430 - RNA, 20 nt, Homo sapiens
cucugcauuaucugagguca

SEQ ID NO: 606431 - RNA, 20 nt, Homo sapiens
cucuugugaauuauucugau

SEQ ID NO: 606432 - RNA, 23 nt, Homo sapiens
cucuuguguuugacacuaagaaa

SEQ ID NO: 606433 - RNA, 13 nt, Homo sapiens
cucuuuaacacau

SEQ ID NO: 606434 - RNA, 14 nt, Homo sapiens
cucuuuaacugugu

SEQ ID NO: 606435 - RNA, 21 nt, Homo sapiens
cucuuuacugagcaguaggua

SEQ ID NO: 606436 - RNA, 14 nt, Homo sapiens
cucuuuaguguucu

SEQ ID NO: 606437 - RNA, 14 nt, Homo sapiens
cucuuucagugcuu

SEQ ID NO: 606438 - RNA, 15 nt, Homo sapiens
cucuuuccacuuugu

SEQ ID NO: 606439 - RNA, 22 nt, Homo sapiens
cucuuucccuuccccugugguc

SEQ ID NO: 606440 - RNA, 14 nt, Homo sapiens
cugaauugaaucua

SEQ ID NO: 606441 - RNA, 20 nt, Homo sapiens
cugaauuuuggggauuuuca

SEQ ID NO: 606442 - RNA, 13 nt, Homo sapiens
cugacaagcacug

SEQ ID NO: 606443 - RNA, 16 nt, Homo sapiens
cugacaaugaagggaa

SEQ ID NO: 606444 - RNA, 17 nt, Homo sapiens
cugacaaugaagggaaa

SEQ ID NO: 606445 - RNA, 19 nt, Homo sapiens
cugacacaccaggcgcuaa

SEQ ID NO: 606446 - RNA, 18 nt, Homo sapiens
cugacacagugcucgacc

SEQ ID NO: 606447 - RNA, 20 nt, Homo sapiens
cugacaccgucccucaguga

SEQ ID NO: 606448 - RNA, 16 nt, Homo sapiens
cugacacuacuaaagc

SEQ ID NO: 606449 - RNA, 18 nt, Homo sapiens
cugacagaaggacucagg

SEQ ID NO: 606450 - RNA, 18 nt, Homo sapiens
cugcagaagucccaagac

SEQ ID NO: 606451 - RNA, 13 nt, Homo sapiens
cugcagaaugacu

SEQ ID NO: 606452 - RNA, 16 nt, Homo sapiens
cugcagaccauccaga

SEQ ID NO: 606453 - RNA, 19 nt, Homo sapiens
cugcagaccucacugucag

SEQ ID NO: 606454 - RNA, 18 nt, Homo sapiens
cugcagagagaagccugu

SEQ ID NO: 606455 - RNA, 16 nt, Homo sapiens
cugcagagcagcagca

SEQ ID NO: 606456 - RNA, 20 nt, Homo sapiens
cugcagagcagcagcaccuu

SEQ ID NO: 606457 - RNA, 11 nt, Homo sapiens
cugcagagccc

SEQ ID NO: 606458 - RNA, 19 nt, Homo sapiens
cugcagagcugacccagag

SEQ ID NO: 606459 - RNA, 23 nt, Homo sapiens
cugcagaggggaaaccaguguag

SEQ ID NO: 606460 - RNA, 18 nt, Homo sapiens
cugcagauagcccaggag

SEQ ID NO: 606461 - RNA, 19 nt, Homo sapiens
cugcagaugaucagggauc

SEQ ID NO: 606462 - RNA, 21 nt, Homo sapiens
cugcagaugccacccuagcca

SEQ ID NO: 606463 - RNA, 12 nt, Homo sapiens
cugccuguaacu

SEQ ID NO: 606464 - RNA, 17 nt, Homo sapiens
cugccugucccagagag

SEQ ID NO: 606465 - RNA, 19 nt, Homo sapiens
cugccuguuauaacucugc

SEQ ID NO: 606466 - RNA, 18 nt, Homo sapiens
cugccuuacccugguaau

SEQ ID NO: 606467 - RNA, 21 nt, Homo sapiens
cugccuucaccuccucuuuca

SEQ ID NO: 606468 - RNA, 18 nt, Homo sapiens
cugccuugaagccacuga

SEQ ID NO: 606469 - RNA, 13 nt, Homo sapiens
cugccuugcaccu

SEQ ID NO: 606470 - RNA, 16 nt, Homo sapiens
cugccuugguucuggc

SEQ ID NO: 606471 - RNA, 19 nt, Homo sapiens
cugccuuuagccuggacca

SEQ ID NO: 606472 - RNA, 21 nt, Homo sapiens
cugccuuucaagcggugccua

SEQ ID NO: 606473 - RNA, 17 nt, Homo sapiens
cugccuuuucaucuaau

SEQ ID NO: 606474 - RNA, 16 nt, Homo sapiens
cugcgaaauccagaac

SEQ ID NO: 606475 - RNA, 22 nt, Homo sapiens
cugcgcugguugaaaaauggca

SEQ ID NO: 606476 - RNA, 18 nt, Homo sapiens
cuggagacuaaagauugc

SEQ ID NO: 606477 - RNA, 17 nt, Homo sapiens
cuggagcaaaagucauu

SEQ ID NO: 606478 - RNA, 18 nt, Homo sapiens
cuggagcaagugcucagc

SEQ ID NO: 606479 - RNA, 16 nt, Homo sapiens
cuggagcaauguugcu

SEQ ID NO: 606480 - RNA, 16 nt, Homo sapiens
cuggagccaaguccag

SEQ ID NO: 606481 - RNA, 22 nt, Homo sapiens
cuggagccagagagaacaacag

SEQ ID NO: 606482 - RNA, 16 nt, Homo sapiens
cuggagcccacaaccu

SEQ ID NO: 606483 - RNA, 21 nt, Homo sapiens
cuggagcccuaaccccuucca

SEQ ID NO: 606484 - RNA, 15 nt, Homo sapiens
cuggagcccuguugg

SEQ ID NO: 606485 - RNA, 17 nt, Homo sapiens
cuggagccuccacugcc

SEQ ID NO: 606486 - RNA, 15 nt, Homo sapiens
cuggaggaacacaga

SEQ ID NO: 606487 - RNA, 12 nt, Homo sapiens
cuggaggaccag

SEQ ID NO: 606488 - RNA, 23 nt, Homo sapiens
cuggaggaccagauugcucugcc

SEQ ID NO: 606489 - RNA, 17 nt, Homo sapiens
cuggaggccuuccagcu

SEQ ID NO: 606490 - RNA, 13 nt, Homo sapiens
cuggaggcucugu

SEQ ID NO: 606491 - RNA, 21 nt, Homo sapiens
cuggagggacuuuuaaucagu

SEQ ID NO: 606492 - RNA, 19 nt, Homo sapiens
cuggagggagaacccaaag

SEQ ID NO: 606493 - RNA, 17 nt, Homo sapiens
cuggaggugcugcucua

SEQ ID NO: 606494 - RNA, 20 nt, Homo sapiens
cuggaguacaauggcgugau

SEQ ID NO: 606495 - RNA, 15 nt, Homo sapiens
cuggagugauuuaua

SEQ ID NO: 606496 - RNA, 15 nt, Homo sapiens
cuggagugcaauggu

SEQ ID NO: 606497 - RNA, 20 nt, Homo sapiens
cuggagugcaguggcacaau

SEQ ID NO: 606498 - RNA, 20 nt, Homo sapiens
cuggagugcaguggugcaau

SEQ ID NO: 606499 - RNA, 20 nt, Homo sapiens
cuggagugcaguggugugau

SEQ ID NO: 606500 - RNA, 22 nt, Homo sapiens
cuggaguggaaaagcuuaaaaa

SEQ ID NO: 606501 - RNA, 16 nt, Homo sapiens
cuggaucacagcugcu

SEQ ID NO: 606502 - RNA, 14 nt, Homo sapiens
cuggaucagggaau

SEQ ID NO: 606503 - RNA, 19 nt, Homo sapiens
cuggauccagcacugguga

SEQ ID NO: 606504 - RNA, 13 nt, Homo sapiens
cuggaucuaccug

SEQ ID NO: 606505 - RNA, 17 nt, Homo sapiens
cuggaugaaauaacucc

SEQ ID NO: 606506 - RNA, 15 nt, Homo sapiens
cuggaugcccaggaa

SEQ ID NO: 606507 - RNA, 18 nt, Homo sapiens
cuggauguacuuaagagu

SEQ ID NO: 606508 - RNA, 20 nt, Homo sapiens
cuggauuacaggcaugugcc

SEQ ID NO: 606509 - RNA, 17 nt, Homo sapiens
cuggauuucauacugua

SEQ ID NO: 606510 - RNA, 22 nt, Homo sapiens
cuggcaacagagcgagauucca

SEQ ID NO: 606511 - RNA, 15 nt, Homo sapiens
cuggcaagaaugugu

SEQ ID NO: 606512 - RNA, 18 nt, Homo sapiens
cuggcaagauaaacacuu

SEQ ID NO: 606513 - RNA, 22 nt, Homo sapiens
cuggcaauaaacuccuacuaaa

SEQ ID NO: 606514 - RNA, 21 nt, Homo sapiens
cuggcaauacgacgugggaau

SEQ ID NO: 606515 - RNA, 13 nt, Homo sapiens
cuggcaaucaaua

SEQ ID NO: 606516 - RNA, 21 nt, Homo sapiens
cuggcaaugaaaaauucucag

SEQ ID NO: 606517 - RNA, 19 nt, Homo sapiens
cuggcaauguuuauuucau

SEQ ID NO: 606518 - RNA, 13 nt, Homo sapiens
cuggcacacuccc

SEQ ID NO: 606519 - RNA, 17 nt, Homo sapiens
cuggcacuauaauguaa

SEQ ID NO: 606520 - RNA, 19 nt, Homo sapiens
cuggcacuuagcccaagag

SEQ ID NO: 606521 - RNA, 15 nt, Homo sapiens
cuggcaggaccugcc

SEQ ID NO: 606522 - RNA, 21 nt, Homo sapiens
cuggcagggcccagugacaag

SEQ ID NO: 606523 - RNA, 21 nt, Homo sapiens
cuggcaguaaccuagugaauu

SEQ ID NO: 606524 - RNA, 22 nt, Homo sapiens
cuggcaguaaccuagugaauuu

SEQ ID NO: 606525 - RNA, 14 nt, Homo sapiens
cuggcaguacuguu

SEQ ID NO: 606526 - RNA, 22 nt, Homo sapiens
cuggcaguugaacagagggaga

SEQ ID NO: 606527 - RNA, 14 nt, Homo sapiens
cuggcaucacguca

SEQ ID NO: 606528 - RNA, 12 nt, Homo sapiens
cuggccaaaagc

SEQ ID NO: 606529 - RNA, 15 nt, Homo sapiens
cuggccaaggugucc

SEQ ID NO: 606530 - RNA, 19 nt, Homo sapiens
cuggccacugaaaagcuuu

SEQ ID NO: 606531 - RNA, 23 nt, Homo sapiens
cuggccagacaagaagacuguca

SEQ ID NO: 606532 - RNA, 20 nt, Homo sapiens
cuggcccuccccacaaugcc

SEQ ID NO: 606533 - RNA, 19 nt, Homo sapiens
cuggccgcuccucccucag

SEQ ID NO: 606534 - RNA, 18 nt, Homo sapiens
cuggccuauguggucuaa

SEQ ID NO: 606535 - RNA, 22 nt, Homo sapiens
cuggccucacauuucucugugu

SEQ ID NO: 606536 - RNA, 22 nt, Homo sapiens
cuggccucagccgacugcacag

SEQ ID NO: 606537 - RNA, 17 nt, Homo sapiens
cuggccuccagccuuug

SEQ ID NO: 606538 - RNA, 20 nt, Homo sapiens
cuggccuccagccuuugcuc

SEQ ID NO: 606539 - RNA, 17 nt, Homo sapiens
cuggccugaacugagga

SEQ ID NO: 606540 - RNA, 20 nt, Homo sapiens
cuggccuugguaugugccag

SEQ ID NO: 606541 - RNA, 18 nt, Homo sapiens
cuggccuugugucacugg

SEQ ID NO: 606542 - RNA, 16 nt, Homo sapiens
cuggcgacugccccug

SEQ ID NO: 606543 - RNA, 18 nt, Homo sapiens
cuggcgcaucauaugcag

SEQ ID NO: 606544 - RNA, 15 nt, Homo sapiens
cuggcggcugugcau

SEQ ID NO: 606545 - RNA, 21 nt, Homo sapiens
cuggcuaauuuuuuguacuuu

SEQ ID NO: 606546 - RNA, 16 nt, Homo sapiens
cuggcuacugagucau

SEQ ID NO: 606547 - RNA, 17 nt, Homo sapiens
cuggcuagcauuccuca

SEQ ID NO: 606548 - RNA, 20 nt, Homo sapiens
cuggcuagguuaaaggccag

SEQ ID NO: 606549 - RNA, 18 nt, Homo sapiens
cuggcucaagcccugaau

SEQ ID NO: 606550 - RNA, 13 nt, Homo sapiens
cuggcucccaugu

SEQ ID NO: 606551 - RNA, 12 nt, Homo sapiens
cuggcuccuugc

SEQ ID NO: 606552 - RNA, 15 nt, Homo sapiens
cuggcucuaccuucc

SEQ ID NO: 606553 - RNA, 15 nt, Homo sapiens
cuggcucuguuugau

SEQ ID NO: 606554 - RNA, 19 nt, Homo sapiens
cuggcugaccccaaagagc

SEQ ID NO: 606555 - RNA, 18 nt, Homo sapiens
cuggcugagguuccucug

SEQ ID NO: 606556 - RNA, 12 nt, Homo sapiens
cuggcugaugau

SEQ ID NO: 606557 - RNA, 15 nt, Homo sapiens
cuggcugaugaucca

SEQ ID NO: 606558 - RNA, 20 nt, Homo sapiens
cuggcugcuaggccagagcc

SEQ ID NO: 606559 - RNA, 13 nt, Homo sapiens
cuggcuggcacag

SEQ ID NO: 606560 - RNA, 21 nt, Homo sapiens
cuggcugggaguccuuaccuc

SEQ ID NO: 606561 - RNA, 19 nt, Homo sapiens
cuggcuggugacagaacau

SEQ ID NO: 606562 - RNA, 23 nt, Homo sapiens
cuggcugguggagaacucaaggc

SEQ ID NO: 606563 - RNA, 22 nt, Homo sapiens
cuggcuguccaaccagacuuug

SEQ ID NO: 606564 - RNA, 20 nt, Homo sapiens
cuggcuguuccccugcucug

SEQ ID NO: 606565 - RNA, 16 nt, Homo sapiens
cuggcuuagacaccac

SEQ ID NO: 606566 - RNA, 21 nt, Homo sapiens
cugggaaauugaagugucuuc

SEQ ID NO: 606567 - RNA, 16 nt, Homo sapiens
cugggaacacaucugg

SEQ ID NO: 606568 - RNA, 18 nt, Homo sapiens
cugggaacaugacccagc

SEQ ID NO: 606569 - RNA, 22 nt, Homo sapiens
cugggaaccucccagaggucca

SEQ ID NO: 606570 - RNA, 13 nt, Homo sapiens
cugggaacucaaa

SEQ ID NO: 606571 - RNA, 16 nt, Homo sapiens
cugggaacuuccucag

SEQ ID NO: 606572 - RNA, 20 nt, Homo sapiens
cugggaagcucccaccccac

SEQ ID NO: 606573 - RNA, 16 nt, Homo sapiens
cugggaauggggacac

SEQ ID NO: 606574 - RNA, 18 nt, Homo sapiens
cugggacaccauuaccaa

SEQ ID NO: 606575 - RNA, 23 nt, Homo sapiens
cugggacacuucccugggccuca

SEQ ID NO: 606576 - RNA, 17 nt, Homo sapiens
cugggacagcccaggaa

SEQ ID NO: 606577 - RNA, 16 nt, Homo sapiens
cugggaccaacccugg

SEQ ID NO: 606578 - RNA, 13 nt, Homo sapiens
cugggaccacaga

SEQ ID NO: 606579 - RNA, 13 nt, Homo sapiens
cugggacugagaa

SEQ ID NO: 606580 - RNA, 18 nt, Homo sapiens
cugggacuucuuacccaa

SEQ ID NO: 606581 - RNA, 13 nt, Homo sapiens
cugggacuuucac

SEQ ID NO: 606582 - RNA, 15 nt, Homo sapiens
cugggagagucucac

SEQ ID NO: 606583 - RNA, 18 nt, Homo sapiens
cugggagcacaggcacug

SEQ ID NO: 606584 - RNA, 19 nt, Homo sapiens
gcaaugaagggaagugcau

SEQ ID NO: 606585 - RNA, 21 nt, Homo sapiens
gcaaugaaugaugcuuuucug

SEQ ID NO: 606586 - RNA, 14 nt, Homo sapiens
gcaaugccaucagc

SEQ ID NO: 606587 - RNA, 12 nt, Homo sapiens
gcaauggaagaa

SEQ ID NO: 606588 - RNA, 23 nt, Homo sapiens
gcaaugguuugugucaaaacugg

SEQ ID NO: 606589 - RNA, 14 nt, Homo sapiens
gcaauuacagcaaa

SEQ ID NO: 606590 - RNA, 19 nt, Homo sapiens
gcaauuagauuaguauuuu

SEQ ID NO: 606591 - RNA, 22 nt, Homo sapiens
gcaauuccgcauuuaauucaug

SEQ ID NO: 606592 - RNA, 14 nt, Homo sapiens
gcaauugacuguca

SEQ ID NO: 606593 - RNA, 12 nt, Homo sapiens
gcaauugcucau

SEQ ID NO: 606594 - RNA, 16 nt, Homo sapiens
gcaauuucacugaugu

SEQ ID NO: 606595 - RNA, 23 nt, Homo sapiens
gcaauuuuaguguauuaaucaua

SEQ ID NO: 606596 - RNA, 17 nt, Homo sapiens
gcaauuuuguguaaauu

SEQ ID NO: 606597 - RNA, 14 nt, Homo sapiens
gcacaaaacuacuu

SEQ ID NO: 606598 - RNA, 21 nt, Homo sapiens
gcacaaaagcagauacuugag

SEQ ID NO: 606599 - RNA, 19 nt, Homo sapiens
gcacaacaguucucuucua

SEQ ID NO: 606600 - RNA, 14 nt, Homo sapiens
gcacaagccacaag

SEQ ID NO: 606601 - RNA, 22 nt, Homo sapiens
gcacaagccacaagucuuccag

SEQ ID NO: 606602 - RNA, 13 nt, Homo sapiens
gcacaaggccuug

SEQ ID NO: 606603 - RNA, 23 nt, Homo sapiens
gcacaauaacuaguaauaccaaa

SEQ ID NO: 606604 - RNA, 15 nt, Homo sapiens
gcacaaucaguuuau

SEQ ID NO: 606605 - RNA, 21 nt, Homo sapiens
gcacaauguggauuuggggac

SEQ ID NO: 606606 - RNA, 22 nt, Homo sapiens
gcacaauuucccuucauacucc

SEQ ID NO: 606607 - RNA, 20 nt, Homo sapiens
gcacacacacacgcuuucuu

SEQ ID NO: 606608 - RNA, 20 nt, Homo sapiens
gcacacaccaccaugcucaa

SEQ ID NO: 606609 - RNA, 14 nt, Homo sapiens
gcacacagggcagu

SEQ ID NO: 606610 - RNA, 19 nt, Homo sapiens
gcacacagggcaguccuua

SEQ ID NO: 606611 - RNA, 22 nt, Homo sapiens
gcacacccuccagagacaacag

SEQ ID NO: 606612 - RNA, 23 nt, Homo sapiens
gcacaccuuagguugacauucag

SEQ ID NO: 606613 - RNA, 21 nt, Homo sapiens
gcacacuagccucuccaggaa

SEQ ID NO: 606614 - RNA, 22 nt, Homo sapiens
gcacacuaguuuaugcuaccua

SEQ ID NO: 606615 - RNA, 22 nt, Homo sapiens
gcacacugccagucucacugug

SEQ ID NO: 606616 - RNA, 12 nt, Homo sapiens
gcacacuggaau

SEQ ID NO: 606617 - RNA, 18 nt, Homo sapiens
gcacacugugauuuugcc

SEQ ID NO: 606618 - RNA, 18 nt, Homo sapiens
gcacacuuccaccauagc

SEQ ID NO: 606619 - RNA, 17 nt, Homo sapiens
gcacagaaauuuucaau

SEQ ID NO: 606620 - RNA, 17 nt, Homo sapiens
gcacagagggaagccau

SEQ ID NO: 606621 - RNA, 21 nt, Homo sapiens
gcacagaucugcuugaucaau

SEQ ID NO: 606622 - RNA, 22 nt, Homo sapiens
gcacagaucugcuugaucaauu

SEQ ID NO: 606623 - RNA, 16 nt, Homo sapiens
gcacagccucagaaua

SEQ ID NO: 606624 - RNA, 18 nt, Homo sapiens
gcacagccucagaauaaa

SEQ ID NO: 606625 - RNA, 17 nt, Homo sapiens
gcacagcuccugccagg

SEQ ID NO: 606626 - RNA, 14 nt, Homo sapiens
gcacagcugcauua

SEQ ID NO: 606627 - RNA, 15 nt, Homo sapiens
gcacaggagcugcca

SEQ ID NO: 606628 - RNA, 21 nt, Homo sapiens
gcacaggcgcaucccaggccu

SEQ ID NO: 606629 - RNA, 20 nt, Homo sapiens
gcacaggcuggagugcagug

SEQ ID NO: 606630 - RNA, 21 nt, Homo sapiens
gcacagggagugcacauaucc

SEQ ID NO: 606631 - RNA, 14 nt, Homo sapiens
gcacaggggcccau

SEQ ID NO: 606632 - RNA, 17 nt, Homo sapiens
gcacagggucucuacca

SEQ ID NO: 606633 - RNA, 13 nt, Homo sapiens
gcacaggugacaa

SEQ ID NO: 606634 - RNA, 16 nt, Homo sapiens
gcacaguacuguuuca

SEQ ID NO: 606635 - RNA, 19 nt, Homo sapiens
gcacaguagagcaaaucua

SEQ ID NO: 606636 - RNA, 16 nt, Homo sapiens
gcacagucugaugaca

SEQ ID NO: 606637 - RNA, 12 nt, Homo sapiens
gcaggugucaua

SEQ ID NO: 606638 - RNA, 18 nt, Homo sapiens
gcagguguguauuuacuu

SEQ ID NO: 606639 - RNA, 22 nt, Homo sapiens
gcagguuccuuaucugucacac

SEQ ID NO: 606640 - RNA, 20 nt, Homo sapiens
gcaguaccaaaguaacugaa

SEQ ID NO: 606641 - RNA, 17 nt, Homo sapiens
gcaguacuuuaccuccu

SEQ ID NO: 606642 - RNA, 18 nt, Homo sapiens
gcaguauagaaaaguuaa

SEQ ID NO: 606643 - RNA, 14 nt, Homo sapiens
gcaguauagacaau

SEQ ID NO: 606644 - RNA, 19 nt, Homo sapiens
gcaguauguuuguuucauu

SEQ ID NO: 606645 - RNA, 12 nt, Homo sapiens
gcagucacugga

SEQ ID NO: 606646 - RNA, 13 nt, Homo sapiens
gcagucacuggag

SEQ ID NO: 606647 - RNA, 15 nt, Homo sapiens
gcagucacuguggug

SEQ ID NO: 606648 - RNA, 13 nt, Homo sapiens
gcagucauaucaa

SEQ ID NO: 606649 - RNA, 23 nt, Homo sapiens
gcaguccaggccucucucugcuc

SEQ ID NO: 606650 - RNA, 16 nt, Homo sapiens
gcagucccacacugug

SEQ ID NO: 606651 - RNA, 19 nt, Homo sapiens
gcagucccaguauucucag

SEQ ID NO: 606652 - RNA, 12 nt, Homo sapiens
gcaguccuuugu

SEQ ID NO: 606653 - RNA, 17 nt, Homo sapiens
gcagucgugccuguguc

SEQ ID NO: 606654 - RNA, 15 nt, Homo sapiens
gcagugacagaacua

SEQ ID NO: 606655 - RNA, 18 nt, Homo sapiens
gcagugacgugcaccugu

SEQ ID NO: 606656 - RNA, 21 nt, Homo sapiens
gcagugagccgagaucaugcc

SEQ ID NO: 606657 - RNA, 15 nt, Homo sapiens
gcagugagcugagau

SEQ ID NO: 606658 - RNA, 15 nt, Homo sapiens
gcagugaucucaggg

SEQ ID NO: 606659 - RNA, 22 nt, Homo sapiens
gcagugaugacuugcuguccag

SEQ ID NO: 606660 - RNA, 19 nt, Homo sapiens
gcagugaugcaaucuuggc

SEQ ID NO: 606661 - RNA, 15 nt, Homo sapiens
gcagugcaugugaag

SEQ ID NO: 606662 - RNA, 11 nt, Homo sapiens
gcagugcugau

SEQ ID NO: 606663 - RNA, 20 nt, Homo sapiens
gcaguggacucagaaagcca

SEQ ID NO: 606664 - RNA, 18 nt, Homo sapiens
gcaguggcaucugagugg

SEQ ID NO: 606665 - RNA, 16 nt, Homo sapiens
gcaguggcgugaucuc

SEQ ID NO: 606666 - RNA, 17 nt, Homo sapiens
gcaguggcgugaucucg

SEQ ID NO: 606667 - RNA, 16 nt, Homo sapiens
gcaguggcucaugccu

SEQ ID NO: 606668 - RNA, 17 nt, Homo sapiens
gcaguggcugugccacc

SEQ ID NO: 606669 - RNA, 21 nt, Homo sapiens
gcagugggguugggaccucag

SEQ ID NO: 606670 - RNA, 16 nt, Homo sapiens
gcagugugaauagccu

SEQ ID NO: 606671 - RNA, 12 nt, Homo sapiens
gcaguuagcuca

SEQ ID NO: 606672 - RNA, 17 nt, Homo sapiens
gcaguuagcucauuuga

SEQ ID NO: 606673 - RNA, 18 nt, Homo sapiens
gcaguuaguauagcuuua

SEQ ID NO: 606674 - RNA, 23 nt, Homo sapiens
gcaguucagcuccuuccaccaca

SEQ ID NO: 606675 - RNA, 13 nt, Homo sapiens
gcaguucuacuca

SEQ ID NO: 606676 - RNA, 19 nt, Homo sapiens
gcaguucucgcagauguua

SEQ ID NO: 606677 - RNA, 14 nt, Homo sapiens
gcaguuggacucuc

SEQ ID NO: 606678 - RNA, 18 nt, Homo sapiens
gcaguuggccaggcucuu

SEQ ID NO: 606679 - RNA, 18 nt, Homo sapiens
gcaguuucaaguaccaaa

SEQ ID NO: 606680 - RNA, 19 nt, Homo sapiens
gcaguuucaaguaccaaaa

SEQ ID NO: 606681 - RNA, 20 nt, Homo sapiens
gcaguuucauguauguauau

SEQ ID NO: 606682 - RNA, 23 nt, Homo sapiens
gcaguuucugacacuuguuguug

SEQ ID NO: 606683 - RNA, 18 nt, Homo sapiens
gcaguuucugcuauugug

SEQ ID NO: 606684 - RNA, 22 nt, Homo sapiens
gcaguuugaagucaaaugucac

SEQ ID NO: 606685 - RNA, 18 nt, Homo sapiens
gcaguuuggagucacugu

SEQ ID NO: 606686 - RNA, 13 nt, Homo sapiens
gcaguuuuuccca

SEQ ID NO: 606687 - RNA, 14 nt, Homo sapiens
gcauaaaagacuuu

SEQ ID NO: 606688 - RNA, 12 nt, Homo sapiens
gcauaaagccaa

SEQ ID NO: 606689 - RNA, 14 nt, Homo sapiens
gcauaaagccaaau

SEQ ID NO: 606690 - RNA, 22 nt, Homo sapiens
gcauaaauccauccauccaaag

SEQ ID NO: 606691 - RNA, 22 nt, Homo sapiens
gcauaacgucugccuucuuucc

SEQ ID NO: 606692 - RNA, 16 nt, Homo sapiens
gcauaaguuucuggga

SEQ ID NO: 606693 - RNA, 18 nt, Homo sapiens
gcauaauaaaaaggcaau

SEQ ID NO: 606694 - RNA, 14 nt, Homo sapiens
gcauaauagucaau

SEQ ID NO: 606695 - RNA, 19 nt, Homo sapiens
gcauaauaugaagccuuug

SEQ ID NO: 606696 - RNA, 16 nt, Homo sapiens
gcauacacacaugccc

SEQ ID NO: 606697 - RNA, 21 nt, Homo sapiens
gcauacuguguauguuuuaua

SEQ ID NO: 606698 - RNA, 22 nt, Homo sapiens
gcauagaaggaaguguguuugc

SEQ ID NO: 606699 - RNA, 14 nt, Homo sapiens
gcauagauugauca

SEQ ID NO: 606700 - RNA, 14 nt, Homo sapiens
gcauagccauggaa

SEQ ID NO: 606701 - RNA, 23 nt, Homo sapiens
gcauagcuguuuuagcugaggga

SEQ ID NO: 606702 - RNA, 20 nt, Homo sapiens
gcauaguauuccauggugua

SEQ ID NO: 606703 - RNA, 21 nt, Homo sapiens
gccugcaaaaaugaaauccag

SEQ ID NO: 606704 - RNA, 15 nt, Homo sapiens
gccugcaaaccuucc

SEQ ID NO: 606705 - RNA, 21 nt, Homo sapiens
gccugcagcaggaguggugca

SEQ ID NO: 606706 - RNA, 15 nt, Homo sapiens
gccugcccagacuga

SEQ ID NO: 606707 - RNA, 18 nt, Homo sapiens
gccugccccccucaucuc

SEQ ID NO: 606708 - RNA, 21 nt, Homo sapiens
gccugccccugcugcuuggga

SEQ ID NO: 606709 - RNA, 14 nt, Homo sapiens
gccugccucuucuc

SEQ ID NO: 606710 - RNA, 15 nt, Homo sapiens
gccugccuggugugc

SEQ ID NO: 606711 - RNA, 21 nt, Homo sapiens
gccugcgcccugacaugcuaa

SEQ ID NO: 606712 - RNA, 14 nt, Homo sapiens
gccugcugcacuuc

SEQ ID NO: 606713 - RNA, 14 nt, Homo sapiens
gccugcuuugaaua

SEQ ID NO: 606714 - RNA, 15 nt, Homo sapiens
gccugcuuugaauaa

SEQ ID NO: 606715 - RNA, 19 nt, Homo sapiens
gccuggacacuguaccgac

SEQ ID NO: 606716 - RNA, 22 nt, Homo sapiens
gccuggacacuguaccgacuuu

SEQ ID NO: 606717 - RNA, 22 nt, Homo sapiens
gccuggacuagagggaccucuc

SEQ ID NO: 606718 - RNA, 14 nt, Homo sapiens
gccuggagacauau

SEQ ID NO: 606719 - RNA, 16 nt, Homo sapiens
gccuggagacauauca

SEQ ID NO: 606720 - RNA, 17 nt, Homo sapiens
gccuggagcaagugcuc

SEQ ID NO: 606721 - RNA, 20 nt, Homo sapiens
gccuggaguguaugacugca

SEQ ID NO: 606722 - RNA, 19 nt, Homo sapiens
gccuggaugaggcacuucu

SEQ ID NO: 606723 - RNA, 17 nt, Homo sapiens
gccuggaugggggugca

SEQ ID NO: 606724 - RNA, 20 nt, Homo sapiens
gccuggauucauuuccugcc

SEQ ID NO: 606725 - RNA, 15 nt, Homo sapiens
gccuggauuccagca

SEQ ID NO: 606726 - RNA, 13 nt, Homo sapiens
gccuggcacagac

SEQ ID NO: 606727 - RNA, 21 nt, Homo sapiens
gccuggcagaacugagcuccu

SEQ ID NO: 606728 - RNA, 20 nt, Homo sapiens
gccuggcagccgugccuuca

SEQ ID NO: 606729 - RNA, 18 nt, Homo sapiens
gccuggccaacaugguga

SEQ ID NO: 606730 - RNA, 15 nt, Homo sapiens
gccuggccaccagcc

SEQ ID NO: 606731 - RNA, 20 nt, Homo sapiens
gccuggccaggagcucuuca

SEQ ID NO: 606732 - RNA, 13 nt, Homo sapiens
gccuggccagucc

SEQ ID NO: 606733 - RNA, 15 nt, Homo sapiens
gccugggagcccaga

SEQ ID NO: 606734 - RNA, 15 nt, Homo sapiens
gccugggaugcagug

SEQ ID NO: 606735 - RNA, 15 nt, Homo sapiens
gccugggauggggcu

SEQ ID NO: 606736 - RNA, 17 nt, Homo sapiens
gccugggauggggcuuc

SEQ ID NO: 606737 - RNA, 18 nt, Homo sapiens
gccuggggauguaaccaa

SEQ ID NO: 606738 - RNA, 20 nt, Homo sapiens
gccuggggauguaaccaagc

SEQ ID NO: 606739 - RNA, 18 nt, Homo sapiens
gccugggggcagccucuc

SEQ ID NO: 606740 - RNA, 16 nt, Homo sapiens
gccugggggcagugac

SEQ ID NO: 606741 - RNA, 23 nt, Homo sapiens
gccuguaaacuuuaucacuuaaa

SEQ ID NO: 606742 - RNA, 13 nt, Homo sapiens
gccuguaauccca

SEQ ID NO: 606743 - RNA, 23 nt, Homo sapiens
gccuguaaucccaacacuuugag

SEQ ID NO: 606744 - RNA, 19 nt, Homo sapiens
gccuguaaucccagcacuu

SEQ ID NO: 606745 - RNA, 19 nt, Homo sapiens
gccuguaaucucagcacuu

SEQ ID NO: 606746 - RNA, 21 nt, Homo sapiens
gccuguaaucucagcacuuug

SEQ ID NO: 606747 - RNA, 19 nt, Homo sapiens
gccuguagucccagcuacu

SEQ ID NO: 606748 - RNA, 22 nt, Homo sapiens
gccuguagucccagcuacucag

SEQ ID NO: 606749 - RNA, 10 nt, Homo sapiens
gccugucauu

SEQ ID NO: 606750 - RNA, 19 nt, Homo sapiens
gccugucucuagcuguucu

SEQ ID NO: 606751 - RNA, 16 nt, Homo sapiens
gccugucugagacuca

SEQ ID NO: 606752 - RNA, 12 nt, Homo sapiens
gccugugaagca

SEQ ID NO: 606753 - RNA, 15 nt, Homo sapiens
gccugugaagcaguc

SEQ ID NO: 606754 - RNA, 15 nt, Homo sapiens
gccugugcugugacu

SEQ ID NO: 606755 - RNA, 12 nt, Homo sapiens
gccuguggaaug

SEQ ID NO: 606756 - RNA, 21 nt, Homo sapiens
gccuguggaggaacuuuucaa

SEQ ID NO: 606757 - RNA, 20 nt, Homo sapiens
gccugugggcgcauacuaca

SEQ ID NO: 606758 - RNA, 15 nt, Homo sapiens
gccuguggugcuuga

SEQ ID NO: 606759 - RNA, 11 nt, Homo sapiens
gccuguuaaau

SEQ ID NO: 606760 - RNA, 14 nt, Homo sapiens
gccuguuaaauaua

SEQ ID NO: 606761 - RNA, 13 nt, Homo sapiens
gccuguugcugaa

SEQ ID NO: 606762 - RNA, 23 nt, Homo sapiens
gccuguuggcaggcccacucccc

SEQ ID NO: 606763 - RNA, 19 nt, Homo sapiens
gccuguugggaaaaguuua

SEQ ID NO: 606764 - RNA, 22 nt, Homo sapiens
gccuuaaaaggggcccaagccc

SEQ ID NO: 606765 - RNA, 22 nt, Homo sapiens
gccuuaaauuuuugucauuuua

SEQ ID NO: 606766 - RNA, 16 nt, Homo sapiens
gcagacugauuggccu

SEQ ID NO: 606767 - RNA, 16 nt, Homo sapiens
gcagagaaaauuguga

SEQ ID NO: 606768 - RNA, 23 nt, Homo sapiens
gcagagaaaauugugaaagugac

SEQ ID NO: 606769 - RNA, 21 nt, Homo sapiens
gcagagaacuggaaagacaua

SEQ ID NO: 606770 - RNA, 15 nt, Homo sapiens
gcagagacugaaaau

SEQ ID NO: 606771 - RNA, 23 nt, Homo sapiens
gcagagcaccuuugcacaggaug

SEQ ID NO: 606772 - RNA, 17 nt, Homo sapiens
gcagagcauucagacuc

SEQ ID NO: 606773 - RNA, 16 nt, Homo sapiens
gcagagccaggaagau

SEQ ID NO: 606774 - RNA, 15 nt, Homo sapiens
gcagagcccaccagc

SEQ ID NO: 606775 - RNA, 22 nt, Homo sapiens
gcagaggagcugaguuggcaga

SEQ ID NO: 606776 - RNA, 15 nt, Homo sapiens
gcagaggcaacacug

SEQ ID NO: 606777 - RNA, 15 nt, Homo sapiens
gcagaggucagacua

SEQ ID NO: 606778 - RNA, 21 nt, Homo sapiens
gcagaggucagacuaagaaau

SEQ ID NO: 606779 - RNA, 13 nt, Homo sapiens
gcagaggugcaag

SEQ ID NO: 606780 - RNA, 17 nt, Homo sapiens
gcagagguguaggggug

SEQ ID NO: 606781 - RNA, 22 nt, Homo sapiens
gcagagguuugcugacagguga

SEQ ID NO: 606782 - RNA, 12 nt, Homo sapiens
gcagagugaaug

SEQ ID NO: 606783 - RNA, 16 nt, Homo sapiens
gcagaguucuccugga

SEQ ID NO: 606784 - RNA, 17 nt, Homo sapiens
gcagaguuugccuuccu

SEQ ID NO: 606785 - RNA, 14 nt, Homo sapiens
gcagauaacaaaau

SEQ ID NO: 606786 - RNA, 21 nt, Homo sapiens
gcagauaagaaggugcgaggg

SEQ ID NO: 606787 - RNA, 14 nt, Homo sapiens
gcagauaggagcug

SEQ ID NO: 606788 - RNA, 19 nt, Homo sapiens
gcagauaggagcugcaggg

SEQ ID NO: 606789 - RNA, 21 nt, Homo sapiens
gcagauaucugcaugugucau

SEQ ID NO: 606790 - RNA, 18 nt, Homo sapiens
gcagaucacgaacucauu

SEQ ID NO: 606791 - RNA, 13 nt, Homo sapiens
gcagauccagagg

SEQ ID NO: 606792 - RNA, 19 nt, Homo sapiens
gcagaugccacccuagcca

SEQ ID NO: 606793 - RNA, 18 nt, Homo sapiens
gcagaugcuguugugaag

SEQ ID NO: 606794 - RNA, 14 nt, Homo sapiens
gcagauuaaaagca

SEQ ID NO: 606795 - RNA, 10 nt, Homo sapiens
gcagauucca

SEQ ID NO: 606796 - RNA, 21 nt, Homo sapiens
gcagauugaaaaggacaccuu

SEQ ID NO: 606797 - RNA, 15 nt, Homo sapiens
gcagcaaauuuucag

SEQ ID NO: 606798 - RNA, 22 nt, Homo sapiens
gcagcacaugcgggcucgccca

SEQ ID NO: 606799 - RNA, 18 nt, Homo sapiens
gcagcaccaaccacagca

SEQ ID NO: 606800 - RNA, 20 nt, Homo sapiens
gcagcaccaccacacaguca

SEQ ID NO: 606801 - RNA, 11 nt, Homo sapiens
gcagcacuccc

SEQ ID NO: 606802 - RNA, 16 nt, Homo sapiens
gcagcagccagcacca

SEQ ID NO: 606803 - RNA, 17 nt, Homo sapiens
gcagcauacacagauga

SEQ ID NO: 606804 - RNA, 18 nt, Homo sapiens
gcagcauagcaagacaca

SEQ ID NO: 606805 - RNA, 15 nt, Homo sapiens
gcagcauuccaugac

SEQ ID NO: 606806 - RNA, 17 nt, Homo sapiens
gcagcauuuuauuuacc

SEQ ID NO: 606807 - RNA, 14 nt, Homo sapiens
gcagccaacccggc

SEQ ID NO: 606808 - RNA, 22 nt, Homo sapiens
gcagccaacccggcacugcccu

SEQ ID NO: 606809 - RNA, 16 nt, Homo sapiens
gcagccacaaccaaaa

SEQ ID NO: 606810 - RNA, 19 nt, Homo sapiens
gcagccacgaggugcaaca

SEQ ID NO: 606811 - RNA, 17 nt, Homo sapiens
gcagccaggagugcccc

SEQ ID NO: 606812 - RNA, 14 nt, Homo sapiens
gcagccagggccag

SEQ ID NO: 606813 - RNA, 15 nt, Homo sapiens
gcagccagucucaga

SEQ ID NO: 606814 - RNA, 14 nt, Homo sapiens
gcagcccagagacu

SEQ ID NO: 606815 - RNA, 14 nt, Homo sapiens
gcagcccaugccca

SEQ ID NO: 606816 - RNA, 23 nt, Homo sapiens
gcagcccaugcccaccugcccau

SEQ ID NO: 606817 - RNA, 20 nt, Homo sapiens
gcagcccuaaggaucucuca

SEQ ID NO: 606818 - RNA, 17 nt, Homo sapiens
gcagccguuuuccucau

SEQ ID NO: 606819 - RNA, 20 nt, Homo sapiens
gcagccuccgucauccaugc

SEQ ID NO: 606820 - RNA, 13 nt, Homo sapiens
gcagccugugaag

SEQ ID NO: 606821 - RNA, 22 nt, Homo sapiens
gcagccuugggggggcugccuu

SEQ ID NO: 606822 - RNA, 17 nt, Homo sapiens
gcagcgccaggcugacc

SEQ ID NO: 606823 - RNA, 15 nt, Homo sapiens
gcagcgcgcuccuga

SEQ ID NO: 606824 - RNA, 18 nt, Homo sapiens
gcagcggaggcgugcguu

SEQ ID NO: 606825 - RNA, 23 nt, Homo sapiens
gcagcguugcuuggugcacagau

SEQ ID NO: 606826 - RNA, 20 nt, Homo sapiens
gcagcuaaaggaagugaauc

SEQ ID NO: 606827 - RNA, 15 nt, Homo sapiens
gcagcuagcucuuug

SEQ ID NO: 606828 - RNA, 15 nt, Homo sapiens
gcagcuagugccuuu

SEQ ID NO: 606829 - RNA, 14 nt, Homo sapiens
gcagcucaacgaga

SEQ ID NO: 606830 - RNA, 22 nt, Homo sapiens
gcagcucaagaacacaugugca

SEQ ID NO: 606831 - RNA, 18 nt, Homo sapiens
gcagcucacggaacugga

SEQ ID NO: 606832 - RNA, 21 nt, Homo sapiens
gcagcuccauccucuugacuc

SEQ ID NO: 606833 - RNA, 23 nt, Homo sapiens
gcgucucccucgcagagcccuuc

SEQ ID NO: 606834 - RNA, 19 nt, Homo sapiens
gcgucuucaucucccugcc

SEQ ID NO: 606835 - RNA, 11 nt, Homo sapiens
gcgucuugccc

SEQ ID NO: 606836 - RNA, 19 nt, Homo sapiens
gcgugaaucuguaucuugc

SEQ ID NO: 606837 - RNA, 22 nt, Homo sapiens
gcgugaucucggcucacugcaa

SEQ ID NO: 606838 - RNA, 19 nt, Homo sapiens
gcgugccuguagugccagc

SEQ ID NO: 606839 - RNA, 16 nt, Homo sapiens
gcgugcgagcacacac

SEQ ID NO: 606840 - RNA, 17 nt, Homo sapiens
gcgugggcgcuugcacc

SEQ ID NO: 606841 - RNA, 16 nt, Homo sapiens
gcgugggggcacugac

SEQ ID NO: 606842 - RNA, 17 nt, Homo sapiens
gcgugggggcacugacc

SEQ ID NO: 606843 - RNA, 18 nt, Homo sapiens
gcgugucccucucggaag

SEQ ID NO: 606844 - RNA, 22 nt, Homo sapiens
gcgugugccaggcagauccucu

SEQ ID NO: 606845 - RNA, 16 nt, Homo sapiens
gcguguguccaugugu

SEQ ID NO: 606846 - RNA, 23 nt, Homo sapiens
gcguguguccaugugugugcaag

SEQ ID NO: 606847 - RNA, 19 nt, Homo sapiens
gcguuaugugcaguacuua

SEQ ID NO: 606848 - RNA, 12 nt, Homo sapiens
gcguucaaagag

SEQ ID NO: 606849 - RNA, 20 nt, Homo sapiens
gcguuugugcauaucugccu

SEQ ID NO: 606850 - RNA, 17 nt, Homo sapiens
gcuaaacugaugacuua

SEQ ID NO: 606851 - RNA, 16 nt, Homo sapiens
gcuaaaggaagugaau

SEQ ID NO: 606852 - RNA, 17 nt, Homo sapiens
gcuaaaggacaguggau

SEQ ID NO: 606853 - RNA, 22 nt, Homo sapiens
gcuaaauccucauguuacucag

SEQ ID NO: 606854 - RNA, 16 nt, Homo sapiens
gcuaaaugcacugacc

SEQ ID NO: 606855 - RNA, 17 nt, Homo sapiens
gcuaaaugcagggaaac

SEQ ID NO: 606856 - RNA, 12 nt, Homo sapiens
gcuaaauuccac

SEQ ID NO: 606857 - RNA, 15 nt, Homo sapiens
gcuaacccccaaaua

SEQ ID NO: 606858 - RNA, 12 nt, Homo sapiens
gcuaaccucucu

SEQ ID NO: 606859 - RNA, 19 nt, Homo sapiens
gcuaaggcccccaaacaua

SEQ ID NO: 606860 - RNA, 18 nt, Homo sapiens
gcuaaugaacucuuucaa

SEQ ID NO: 606861 - RNA, 21 nt, Homo sapiens
gcuaauugcuggcuggcugcc

SEQ ID NO: 606862 - RNA, 19 nt, Homo sapiens
gcuaauuguacuaaucuga

SEQ ID NO: 606863 - RNA, 20 nt, Homo sapiens
gcuaauuguacuaaucugag

SEQ ID NO: 606864 - RNA, 18 nt, Homo sapiens
gcuaauugugcacaucuc

SEQ ID NO: 606865 - RNA, 16 nt, Homo sapiens
gcuaauuuuugcaaau

SEQ ID NO: 606866 - RNA, 17 nt, Homo sapiens
gcuacaaucccaaagcg

SEQ ID NO: 606867 - RNA, 19 nt, Homo sapiens
gcuacaaucuucauuuaau

SEQ ID NO: 606868 - RNA, 13 nt, Homo sapiens
gcuacagccucuu

SEQ ID NO: 606869 - RNA, 16 nt, Homo sapiens
gcuacaguaaccaaaa

SEQ ID NO: 606870 - RNA, 23 nt, Homo sapiens
gcuacaguuauuaaucuggacau

SEQ ID NO: 606871 - RNA, 15 nt, Homo sapiens
gcuacauauaugcaa

SEQ ID NO: 606872 - RNA, 13 nt, Homo sapiens
gcuaccaggaaag

SEQ ID NO: 606873 - RNA, 18 nt, Homo sapiens
gcuaccccucaaacugca

SEQ ID NO: 606874 - RNA, 17 nt, Homo sapiens
gcuaccuacauacaauu

SEQ ID NO: 606875 - RNA, 15 nt, Homo sapiens
gcuaccucaaccaau

SEQ ID NO: 606876 - RNA, 19 nt, Homo sapiens
gcuaccucacuaugcugcu

SEQ ID NO: 606877 - RNA, 12 nt, Homo sapiens
gcuaccugaugg

SEQ ID NO: 606878 - RNA, 22 nt, Homo sapiens
gcuacuacgguugaucuugcaa

SEQ ID NO: 606879 - RNA, 18 nt, Homo sapiens
gcuacucagaagccugag

SEQ ID NO: 606880 - RNA, 17 nt, Homo sapiens
gcuacugaaccagccac

SEQ ID NO: 606881 - RNA, 22 nt, Homo sapiens
gcuacugacuauggcuaccaaa

SEQ ID NO: 606882 - RNA, 21 nt, Homo sapiens
gcuacugaugaaaucugcuag

SEQ ID NO: 606883 - RNA, 21 nt, Homo sapiens
gcuacugcacguaacacuccu

SEQ ID NO: 606884 - RNA, 12 nt, Homo sapiens
gcuacugccaag

SEQ ID NO: 606885 - RNA, 13 nt, Homo sapiens
gcuacugccaagg

SEQ ID NO: 606886 - RNA, 23 nt, Homo sapiens
gcuacuggaaugguguuuuguca

SEQ ID NO: 606887 - RNA, 15 nt, Homo sapiens
gcuacuucugaaacu

SEQ ID NO: 606888 - RNA, 15 nt, Homo sapiens
gcuagaaauaagccc

SEQ ID NO: 606889 - RNA, 16 nt, Homo sapiens
gcuagacagaaaccaa

SEQ ID NO: 606890 - RNA, 18 nt, Homo sapiens
gcuagagcugacagcuuu

SEQ ID NO: 606891 - RNA, 15 nt, Homo sapiens
ggcugguuaccacca

SEQ ID NO: 606892 - RNA, 22 nt, Homo sapiens
ggcuguaaauccuagacuugaa

SEQ ID NO: 606893 - RNA, 23 nt, Homo sapiens
ggcuguaaauccuagacuugaaa

SEQ ID NO: 606894 - RNA, 17 nt, Homo sapiens
ggcugucaucugugcac

SEQ ID NO: 606895 - RNA, 16 nt, Homo sapiens
ggcugucccgugcaug

SEQ ID NO: 606896 - RNA, 15 nt, Homo sapiens
ggcuguccuccuucc

SEQ ID NO: 606897 - RNA, 16 nt, Homo sapiens
ggcugucugugccaug

SEQ ID NO: 606898 - RNA, 10 nt, Homo sapiens
ggcugugagg

SEQ ID NO: 606899 - RNA, 11 nt, Homo sapiens
ggcugugccaa

SEQ ID NO: 606900 - RNA, 17 nt, Homo sapiens
ggcuguguugggugguu

SEQ ID NO: 606901 - RNA, 14 nt, Homo sapiens
ggcuguugagaugc

SEQ ID NO: 606902 - RNA, 21 nt, Homo sapiens
ggcuuagaaaguccaauucca

SEQ ID NO: 606903 - RNA, 16 nt, Homo sapiens
ggcuuaggacuuucca

SEQ ID NO: 606904 - RNA, 22 nt, Homo sapiens
ggcuucaaagugugugugugca

SEQ ID NO: 606905 - RNA, 15 nt, Homo sapiens
ggcuucaaguggcag

SEQ ID NO: 606906 - RNA, 18 nt, Homo sapiens
ggcuucacagccacaccu

SEQ ID NO: 606907 - RNA, 19 nt, Homo sapiens
ggcuucacagccacaccug

SEQ ID NO: 606908 - RNA, 23 nt, Homo sapiens
ggcuucagcccccaccaggggaa

SEQ ID NO: 606909 - RNA, 21 nt, Homo sapiens
ggcuucauugagaaacuggga

SEQ ID NO: 606910 - RNA, 16 nt, Homo sapiens
ggcuuccauccuguca

SEQ ID NO: 606911 - RNA, 21 nt, Homo sapiens
ggcuuccauuugugugugugc

SEQ ID NO: 606912 - RNA, 16 nt, Homo sapiens
ggcuucccuaaacugc

SEQ ID NO: 606913 - RNA, 20 nt, Homo sapiens
ggcuucccuaaacugcagcc

SEQ ID NO: 606914 - RNA, 12 nt, Homo sapiens
ggcuuccuccuc

SEQ ID NO: 606915 - RNA, 14 nt, Homo sapiens
ggcuuccugugcua

SEQ ID NO: 606916 - RNA, 19 nt, Homo sapiens
ggcuucucuugagucacac

SEQ ID NO: 606917 - RNA, 11 nt, Homo sapiens
ggcuucuuauu

SEQ ID NO: 606918 - RNA, 20 nt, Homo sapiens
ggcuugaccaggcuuggccu

SEQ ID NO: 606919 - RNA, 16 nt, Homo sapiens
ggcuugauauuuucca

SEQ ID NO: 606920 - RNA, 14 nt, Homo sapiens
ggcuugcaugccaa

SEQ ID NO: 606921 - RNA, 19 nt, Homo sapiens
ggcuugccucaaguuccau

SEQ ID NO: 606922 - RNA, 15 nt, Homo sapiens
ggcuuuaucucaggg

SEQ ID NO: 606923 - RNA, 18 nt, Homo sapiens
ggcuuucaaaauaaggau

SEQ ID NO: 606924 - RNA, 21 nt, Homo sapiens
ggcuuucucccucacccaagu

SEQ ID NO: 606925 - RNA, 12 nt, Homo sapiens
ggcuuuggccag

SEQ ID NO: 606926 - RNA, 14 nt, Homo sapiens
ggcuuugggguccu

SEQ ID NO: 606927 - RNA, 15 nt, Homo sapiens
ggcuuugggguccua

SEQ ID NO: 606928 - RNA, 16 nt, Homo sapiens
ggcuuuguugcuggaa

SEQ ID NO: 606929 - RNA, 21 nt, Homo sapiens
ggcuuuguugcuuccguucau

SEQ ID NO: 606930 - RNA, 14 nt, Homo sapiens
ggcuuuuccaggaa

SEQ ID NO: 606931 - RNA, 13 nt, Homo sapiens
ggcuuuugugcau

SEQ ID NO: 606932 - RNA, 16 nt, Homo sapiens
gggaaaaggggcuccu

SEQ ID NO: 606933 - RNA, 20 nt, Homo sapiens
gggaaaaugacuuuauugcu

SEQ ID NO: 606934 - RNA, 13 nt, Homo sapiens
gggaaaaugugaa

SEQ ID NO: 606935 - RNA, 12 nt, Homo sapiens
gggaaacaauga

SEQ ID NO: 606936 - RNA, 22 nt, Homo sapiens
gggaaaccaguguagccuugcc

SEQ ID NO: 606937 - RNA, 16 nt, Homo sapiens
gggccauguccaaaga

SEQ ID NO: 606938 - RNA, 21 nt, Homo sapiens
gggcccagcugggcucugcca

SEQ ID NO: 606939 - RNA, 16 nt, Homo sapiens
gggcccaggaccagcu

SEQ ID NO: 606940 - RNA, 12 nt, Homo sapiens
gggcccaggacu

SEQ ID NO: 606941 - RNA, 21 nt, Homo sapiens
gggcccaggccucagcccagg

SEQ ID NO: 606942 - RNA, 20 nt, Homo sapiens
gggcccaugggauugcacag

SEQ ID NO: 606943 - RNA, 18 nt, Homo sapiens
gggccccgaaugucacug

SEQ ID NO: 606944 - RNA, 14 nt, Homo sapiens
gggcccucuugcca

SEQ ID NO: 606945 - RNA, 15 nt, Homo sapiens
gggcccuuucaucuu

SEQ ID NO: 606946 - RNA, 13 nt, Homo sapiens
gggccgcucugau

SEQ ID NO: 606947 - RNA, 14 nt, Homo sapiens
gggccgcucugauu

SEQ ID NO: 606948 - RNA, 20 nt, Homo sapiens
gggccgggaggcagugcuga

SEQ ID NO: 606949 - RNA, 14 nt, Homo sapiens
gggccguggcacag

SEQ ID NO: 606950 - RNA, 13 nt, Homo sapiens
gggccuaugcaga

SEQ ID NO: 606951 - RNA, 18 nt, Homo sapiens
gggccucaaucuaaggcc

SEQ ID NO: 606952 - RNA, 17 nt, Homo sapiens
gggccugauggugcuca

SEQ ID NO: 606953 - RNA, 23 nt, Homo sapiens
gggccugauuuaucuagcugucc

SEQ ID NO: 606954 - RNA, 17 nt, Homo sapiens
gggccugggacuuccau

SEQ ID NO: 606955 - RNA, 15 nt, Homo sapiens
gggccuggggcuccu

SEQ ID NO: 606956 - RNA, 22 nt, Homo sapiens
gggccuuaucgggcuccagcca

SEQ ID NO: 606957 - RNA, 24 nt, Homo sapiens
gggccuuucuccuccccaccugua

SEQ ID NO: 606958 - RNA, 16 nt, Homo sapiens
gggcgcaggcccagug

SEQ ID NO: 606959 - RNA, 18 nt, Homo sapiens
gggcgcauacuacaguaa

SEQ ID NO: 606960 - RNA, 21 nt, Homo sapiens
gggcgccaccgccacccgcag

SEQ ID NO: 606961 - RNA, 23 nt, Homo sapiens
gggcggauucagcgaagucucau

SEQ ID NO: 606962 - RNA, 12 nt, Homo sapiens
gggcggucacag

SEQ ID NO: 606963 - RNA, 21 nt, Homo sapiens
gggcgugaaccaccaugccca

SEQ ID NO: 606964 - RNA, 17 nt, Homo sapiens
gggcguugggagccuag

SEQ ID NO: 606965 - RNA, 17 nt, Homo sapiens
gggcucaagcuucccaa

SEQ ID NO: 606966 - RNA, 18 nt, Homo sapiens
gggcucagggagcugaga

SEQ ID NO: 606967 - RNA, 17 nt, Homo sapiens
gggcucagggcaguggc

SEQ ID NO: 606968 - RNA, 16 nt, Homo sapiens
gggcucccaggggucu

SEQ ID NO: 606969 - RNA, 17 nt, Homo sapiens
gggcuccuccagggugu

SEQ ID NO: 606970 - RNA, 18 nt, Homo sapiens
gggcucuagggacugcca

SEQ ID NO: 606971 - RNA, 12 nt, Homo sapiens
gggcucuucccc

SEQ ID NO: 606972 - RNA, 19 nt, Homo sapiens
gggcugaagacgccacucc

SEQ ID NO: 606973 - RNA, 14 nt, Homo sapiens
gggcugagacugga

SEQ ID NO: 606974 - RNA, 23 nt, Homo sapiens
gggcugcaugaccuaccaggaca

SEQ ID NO: 606975 - RNA, 18 nt, Homo sapiens
gggcugcugggagccucu

SEQ ID NO: 606976 - RNA, 17 nt, Homo sapiens
gggcuggguaccaaugc

SEQ ID NO: 606977 - RNA, 13 nt, Homo sapiens
gggcuguauuuau

SEQ ID NO: 606978 - RNA, 13 nt, Homo sapiens
gggcugucuuacc

SEQ ID NO: 606979 - RNA, 19 nt, Homo sapiens
gggcugugucguagccaag

SEQ ID NO: 606980 - RNA, 19 nt, Homo sapiens
gggcuguugagaugccugu

SEQ ID NO: 606981 - RNA, 14 nt, Homo sapiens
gggcuuagugugag

SEQ ID NO: 606982 - RNA, 20 nt, Homo sapiens
gggcuucugcguccaccagg

SEQ ID NO: 606983 - RNA, 21 nt, Homo sapiens
gggcuugugauuuccauuucu

SEQ ID NO: 606984 - RNA, 18 nt, Homo sapiens
ggggaagaaacacuuucu

SEQ ID NO: 606985 - RNA, 15 nt, Homo sapiens
ggggaagaggacugu

SEQ ID NO: 606986 - RNA, 18 nt, Homo sapiens
ggggaagaguggucuuga

SEQ ID NO: 606987 - RNA, 17 nt, Homo sapiens
ggggacaagggauuuga

SEQ ID NO: 606988 - RNA, 15 nt, Homo sapiens
ggggacacggugucc

SEQ ID NO: 606989 - RNA, 15 nt, Homo sapiens
ggggacagaggcccu

SEQ ID NO: 606990 - RNA, 14 nt, Homo sapiens
ggggacuaacccaa

SEQ ID NO: 606991 - RNA, 17 nt, Homo sapiens
ggggacuaacccaaugc

SEQ ID NO: 606992 - RNA, 22 nt, Homo sapiens
ggggacuguuccuuauuucucu

SEQ ID NO: 606993 - RNA, 12 nt, Homo sapiens
ggggagacaaau

SEQ ID NO: 606994 - RNA, 22 nt, Homo sapiens
ggggagagauggcacaccagau

SEQ ID NO: 606995 - RNA, 19 nt, Homo sapiens
ggggaggaggaacgggcag

SEQ ID NO: 606996 - RNA, 16 nt, Homo sapiens
ggggaggggccucccc

SEQ ID NO: 606997 - RNA, 19 nt, Homo sapiens
ggggaugacaugcacucag

SEQ ID NO: 606998 - RNA, 13 nt, Homo sapiens
ggggaugucccag

SEQ ID NO: 606999 - RNA, 15 nt, Homo sapiens
ggggcacagcugucu

SEQ ID NO: 607000 - RNA, 18 nt, Homo sapiens
ggggcaggcugggccaug

SEQ ID NO: 607001 - RNA, 13 nt, Homo sapiens
ggggccacuuuca

SEQ ID NO: 607002 - RNA, 11 nt, Homo sapiens
ggggccagugg

SEQ ID NO: 607003 - RNA, 19 nt, Homo sapiens
ggggccuagggagccgcac

SEQ ID NO: 607004 - RNA, 13 nt, Homo sapiens
ggggccuccagaa

SEQ ID NO: 607005 - RNA, 21 nt, Homo sapiens
ggggccuuccuguguggccug

SEQ ID NO: 607006 - RNA, 21 nt, Homo sapiens
ggggcucucagggaacagcag

SEQ ID NO: 607007 - RNA, 18 nt, Homo sapiens
ggggcucuucaucugccu

SEQ ID NO: 607008 - RNA, 18 nt, Homo sapiens
ggggcuuaggaaccuucu

SEQ ID NO: 607009 - RNA, 10 nt, Homo sapiens
ggggcuuccu

SEQ ID NO: 607010 - RNA, 22 nt, Homo sapiens
ggggcuuccucuagagucucac

SEQ ID NO: 607011 - RNA, 17 nt, Homo sapiens
ggggcuucuagcugacu

SEQ ID NO: 607012 - RNA, 21 nt, Homo sapiens
ggggcuuguccugugcuugcu

SEQ ID NO: 607013 - RNA, 17 nt, Homo sapiens
gggggaaaaguuaguca

SEQ ID NO: 607014 - RNA, 12 nt, Homo sapiens
gggggaaggugg

SEQ ID NO: 607015 - RNA, 23 nt, Homo sapiens
gggggcaacuggccauuugccaa

SEQ ID NO: 607016 - RNA, 15 nt, Homo sapiens
gcucagcauuuccac

SEQ ID NO: 607017 - RNA, 14 nt, Homo sapiens
gcucagccuugcac

SEQ ID NO: 607018 - RNA, 14 nt, Homo sapiens
gcucagcgccagcc

SEQ ID NO: 607019 - RNA, 22 nt, Homo sapiens
gcucagcuucuccugugugauu

SEQ ID NO: 607020 - RNA, 13 nt, Homo sapiens
gcucaggcagcuc

SEQ ID NO: 607021 - RNA, 20 nt, Homo sapiens
gcucaggcuggagugcagug

SEQ ID NO: 607022 - RNA, 20 nt, Homo sapiens
gcucagguuuugagaagcca

SEQ ID NO: 607023 - RNA, 22 nt, Homo sapiens
gcucaguaaacgggaacaugcc

SEQ ID NO: 607024 - RNA, 13 nt, Homo sapiens
gcucagugccuuc

SEQ ID NO: 607025 - RNA, 14 nt, Homo sapiens
gcucauaagcaaua

SEQ ID NO: 607026 - RNA, 13 nt, Homo sapiens
gcucaucauucuc

SEQ ID NO: 607027 - RNA, 17 nt, Homo sapiens
gcucauccucacugccg

SEQ ID NO: 607028 - RNA, 15 nt, Homo sapiens
gcucaugagcgucug

SEQ ID NO: 607029 - RNA, 23 nt, Homo sapiens
gcucaugccucagcccgccuuca

SEQ ID NO: 607030 - RNA, 20 nt, Homo sapiens
gcucaugucuauaaucccag

SEQ ID NO: 607031 - RNA, 15 nt, Homo sapiens
gcucauuugagauaa

SEQ ID NO: 607032 - RNA, 16 nt, Homo sapiens
gcucauuuugacaaag

SEQ ID NO: 607033 - RNA, 17 nt, Homo sapiens
gcucauuuuuucuuaca

SEQ ID NO: 607034 - RNA, 20 nt, Homo sapiens
gcuccaaaggaaauccaaaa

SEQ ID NO: 607035 - RNA, 22 nt, Homo sapiens
gcuccaacacuuugagcauuuu

SEQ ID NO: 607036 - RNA, 21 nt, Homo sapiens
gcuccaacccccgccaccuca

SEQ ID NO: 607037 - RNA, 20 nt, Homo sapiens
gcuccaagauguucuccuga

SEQ ID NO: 607038 - RNA, 14 nt, Homo sapiens
gcuccaccaagggg

SEQ ID NO: 607039 - RNA, 21 nt, Homo sapiens
gcuccaccuuccaaaggaccu

SEQ ID NO: 607040 - RNA, 19 nt, Homo sapiens
gcuccagaugcagggcagu

SEQ ID NO: 607041 - RNA, 18 nt, Homo sapiens
gcuccagauucugaugca

SEQ ID NO: 607042 - RNA, 17 nt, Homo sapiens
gcuccagcaacugcccu

SEQ ID NO: 607043 - RNA, 19 nt, Homo sapiens
gcuccagcaagcccagggc

SEQ ID NO: 607044 - RNA, 17 nt, Homo sapiens
gcuccaggaugcauucu

SEQ ID NO: 607045 - RNA, 20 nt, Homo sapiens
gcuccauagacaucaguauu

SEQ ID NO: 607046 - RNA, 15 nt, Homo sapiens
gcuccaucaaugagg

SEQ ID NO: 607047 - RNA, 19 nt, Homo sapiens
gcuccaucccaaccaggca

SEQ ID NO: 607048 - RNA, 22 nt, Homo sapiens
gcuccaucccaaccaggcaccu

SEQ ID NO: 607049 - RNA, 13 nt, Homo sapiens
gcuccauguagaa

SEQ ID NO: 607050 - RNA, 13 nt, Homo sapiens
gcuccauguauau

SEQ ID NO: 607051 - RNA, 16 nt, Homo sapiens
gcuccauuaauccagg

SEQ ID NO: 607052 - RNA, 13 nt, Homo sapiens
gcucccagggugg

SEQ ID NO: 607053 - RNA, 15 nt, Homo sapiens
gcucccauccucacc

SEQ ID NO: 607054 - RNA, 12 nt, Homo sapiens
gcucccaugacc

SEQ ID NO: 607055 - RNA, 14 nt, Homo sapiens
gcucccauucacuc

SEQ ID NO: 607056 - RNA, 23 nt, Homo sapiens
gcucccccucccccacugccaua

SEQ ID NO: 607057 - RNA, 14 nt, Homo sapiens
gcuccccucuggaa

SEQ ID NO: 607058 - RNA, 22 nt, Homo sapiens
gcucccgagcuacucucuugcc

SEQ ID NO: 607059 - RNA, 18 nt, Homo sapiens
gcucccgcccgugguguu

SEQ ID NO: 607060 - RNA, 16 nt, Homo sapiens
gcucccuagacugcau

SEQ ID NO: 607061 - RNA, 17 nt, Homo sapiens
gcucccuaggagaccaa

SEQ ID NO: 607062 - RNA, 16 nt, Homo sapiens
gcucccuuccugccac

SEQ ID NO: 607063 - RNA, 19 nt, Homo sapiens
gcucccuugauggggucca

SEQ ID NO: 607064 - RNA, 16 nt, Homo sapiens
gcucccuuucucagga

SEQ ID NO: 607065 - RNA, 21 nt, Homo sapiens
gcuccgagggcggccagggac

SEQ ID NO: 607066 - RNA, 20 nt, Homo sapiens
gcuccggaggggacccagcu

SEQ ID NO: 607067 - RNA, 17 nt, Homo sapiens
gcuccgggucacugcug

SEQ ID NO: 607068 - RNA, 17 nt, Homo sapiens
gcuccuacauccagcuc

SEQ ID NO: 607069 - RNA, 13 nt, Homo sapiens
gcuccuaccagca

SEQ ID NO: 607070 - RNA, 13 nt, Homo sapiens
gcuccuccagggu

SEQ ID NO: 607071 - RNA, 17 nt, Homo sapiens
gcuccuccugcccucca

SEQ ID NO: 607072 - RNA, 11 nt, Homo sapiens
gcuccugaugg

SEQ ID NO: 607073 - RNA, 14 nt, Homo sapiens
gcuggagugcagug

SEQ ID NO: 607074 - RNA, 20 nt, Homo sapiens
gcuggagugcaguggcauga

SEQ ID NO: 607075 - RNA, 13 nt, Homo sapiens
gcuggaucaggaa

SEQ ID NO: 607076 - RNA, 22 nt, Homo sapiens
gcuggauugccuuguaugcaaa

SEQ ID NO: 607077 - RNA, 18 nt, Homo sapiens
gcuggcaaccacuaagaa

SEQ ID NO: 607078 - RNA, 19 nt, Homo sapiens
gcuggcaccauggugacug

SEQ ID NO: 607079 - RNA, 13 nt, Homo sapiens
gcuggcacugagc

SEQ ID NO: 607080 - RNA, 22 nt, Homo sapiens
gcuggcagaaagggaacagaaa

SEQ ID NO: 607081 - RNA, 17 nt, Homo sapiens
gcuggccaaauagcaaa

SEQ ID NO: 607082 - RNA, 22 nt, Homo sapiens
gcuggccucacccaccccugca

SEQ ID NO: 607083 - RNA, 17 nt, Homo sapiens
gcuggccucucuagcac

SEQ ID NO: 607084 - RNA, 16 nt, Homo sapiens
gcuggccugggguccc

SEQ ID NO: 607085 - RNA, 22 nt, Homo sapiens
gcuggccugucucccuagggaa

SEQ ID NO: 607086 - RNA, 17 nt, Homo sapiens
gcuggcucacaguacag

SEQ ID NO: 607087 - RNA, 11 nt, Homo sapiens
gcuggcugugc

SEQ ID NO: 607088 - RNA, 23 nt, Homo sapiens
gcugggaaaaaaguuuugaugaa

SEQ ID NO: 607089 - RNA, 19 nt, Homo sapiens
gcugggaaauucaugugga

SEQ ID NO: 607090 - RNA, 23 nt, Homo sapiens
gcugggacccuuaggauggggcu

SEQ ID NO: 607091 - RNA, 16 nt, Homo sapiens
gcugggacuacaggug

SEQ ID NO: 607092 - RNA, 20 nt, Homo sapiens
gcugggacuucuuacccaaa

SEQ ID NO: 607093 - RNA, 20 nt, Homo sapiens
gcugggaguagcauggacuc

SEQ ID NO: 607094 - RNA, 17 nt, Homo sapiens
gcugggauuacaggugu

SEQ ID NO: 607095 - RNA, 18 nt, Homo sapiens
gcugggcaugguggcgca

SEQ ID NO: 607096 - RNA, 19 nt, Homo sapiens
gcugggccauguccaaaga

SEQ ID NO: 607097 - RNA, 14 nt, Homo sapiens
gcugggccccaccu

SEQ ID NO: 607098 - RNA, 22 nt, Homo sapiens
gcugggcccccagccuggccag

SEQ ID NO: 607099 - RNA, 14 nt, Homo sapiens
gcugggcucugcca

SEQ ID NO: 607100 - RNA, 17 nt, Homo sapiens
gcugggcugagugacac

SEQ ID NO: 607101 - RNA, 14 nt, Homo sapiens
gcuggggagacaaa

SEQ ID NO: 607102 - RNA, 14 nt, Homo sapiens
gcuggggagggaga

SEQ ID NO: 607103 - RNA, 23 nt, Homo sapiens
gcugggggagagaaacacugcug

SEQ ID NO: 607104 - RNA, 21 nt, Homo sapiens
gcugggguacacagugagagu

SEQ ID NO: 607105 - RNA, 22 nt, Homo sapiens
gcugggucagggccagacugga

SEQ ID NO: 607106 - RNA, 20 nt, Homo sapiens
gcugggugaccgacuacccc

SEQ ID NO: 607107 - RNA, 12 nt, Homo sapiens
gcugggugggcc

SEQ ID NO: 607108 - RNA, 19 nt, Homo sapiens
gcuggucacucugcccucu

SEQ ID NO: 607109 - RNA, 22 nt, Homo sapiens
gcuggucccggggccagcacuu

SEQ ID NO: 607110 - RNA, 20 nt, Homo sapiens
gcuggucucaaacuccugac

SEQ ID NO: 607111 - RNA, 15 nt, Homo sapiens
gcuggucuuaaacuc

SEQ ID NO: 607112 - RNA, 13 nt, Homo sapiens
gcuggucuugggg

SEQ ID NO: 607113 - RNA, 22 nt, Homo sapiens
gcuggucuuggugaacacacau

SEQ ID NO: 607114 - RNA, 16 nt, Homo sapiens
gcuggugccccacuga

SEQ ID NO: 607115 - RNA, 16 nt, Homo sapiens
gcugguggguggccca

SEQ ID NO: 607116 - RNA, 21 nt, Homo sapiens
gcuggugucugagcuucagua

SEQ ID NO: 607117 - RNA, 21 nt, Homo sapiens
gcugguuucuuucaugcuccu

SEQ ID NO: 607118 - RNA, 20 nt, Homo sapiens
gcugguuuuccuaaaugcag

SEQ ID NO: 607119 - RNA, 22 nt, Homo sapiens
gcuguaaauccuagacuugaaa

SEQ ID NO: 607120 - RNA, 17 nt, Homo sapiens
gcuguaaggcaugaagg

SEQ ID NO: 607121 - RNA, 20 nt, Homo sapiens
gcuguacccuuccaccuccu

SEQ ID NO: 607122 - RNA, 13 nt, Homo sapiens
gcuguagaugaca

SEQ ID NO: 607123 - RNA, 14 nt, Homo sapiens
gcuguagaugacaa

SEQ ID NO: 607124 - RNA, 18 nt, Homo sapiens
gcuguagaugacuacuug

SEQ ID NO: 607125 - RNA, 17 nt, Homo sapiens
gcuguaguaccccaaga

SEQ ID NO: 607126 - RNA, 18 nt, Homo sapiens
gcuguauugcccccaugg

SEQ ID NO: 607127 - RNA, 22 nt, Homo sapiens
ggccuuuccugugccaaccuga

SEQ ID NO: 607128 - RNA, 19 nt, Homo sapiens
ggccuuucucuggcuuccu

SEQ ID NO: 607129 - RNA, 13 nt, Homo sapiens
ggccuuuucugug

SEQ ID NO: 607130 - RNA, 23 nt, Homo sapiens
ggcgaacccugggccauccucac

SEQ ID NO: 607131 - RNA, 13 nt, Homo sapiens
ggcgacaguuuuc

SEQ ID NO: 607132 - RNA, 15 nt, Homo sapiens
ggcgaccaccaaagu

SEQ ID NO: 607133 - RNA, 17 nt, Homo sapiens
ggcgaggagagggcgcu

SEQ ID NO: 607134 - RNA, 20 nt, Homo sapiens
ggcgaggccucucucaggag

SEQ ID NO: 607135 - RNA, 15 nt, Homo sapiens
ggcgcaucauaugca

SEQ ID NO: 607136 - RNA, 22 nt, Homo sapiens
ggcgccaggggcgggggaccua

SEQ ID NO: 607137 - RNA, 13 nt, Homo sapiens
ggcgcugacucug

SEQ ID NO: 607138 - RNA, 14 nt, Homo sapiens
ggcgucaccaucca

SEQ ID NO: 607139 - RNA, 16 nt, Homo sapiens
ggcgucccuuccaacc

SEQ ID NO: 607140 - RNA, 12 nt, Homo sapiens
ggcgugaucuug

SEQ ID NO: 607141 - RNA, 14 nt, Homo sapiens
ggcgugugugacac

SEQ ID NO: 607142 - RNA, 13 nt, Homo sapiens
ggcguuacugcuu

SEQ ID NO: 607143 - RNA, 23 nt, Homo sapiens
ggcguuuggacccaguucaguga

SEQ ID NO: 607144 - RNA, 15 nt, Homo sapiens
ggcuaaaaagcaaca

SEQ ID NO: 607145 - RNA, 13 nt, Homo sapiens
ggcuaaauacaau

SEQ ID NO: 607146 - RNA, 13 nt, Homo sapiens
ggcuaaauggaag

SEQ ID NO: 607147 - RNA, 14 nt, Homo sapiens
ggcuaacacgguga

SEQ ID NO: 607148 - RNA, 17 nt, Homo sapiens
ggcuaaccuggaccugg

SEQ ID NO: 607149 - RNA, 21 nt, Homo sapiens
ggcuaagaugagauuugccag

SEQ ID NO: 607150 - RNA, 15 nt, Homo sapiens
ggcuaagcacuuuau

SEQ ID NO: 607151 - RNA, 14 nt, Homo sapiens
ggcuaaucuuucau

SEQ ID NO: 607152 - RNA, 17 nt, Homo sapiens
ggcuacaaucuucauuu

SEQ ID NO: 607153 - RNA, 20 nt, Homo sapiens
ggcuacaaucuucauuuaau

SEQ ID NO: 607154 - RNA, 20 nt, Homo sapiens
ggcuacacucaucugacuca

SEQ ID NO: 607155 - RNA, 17 nt, Homo sapiens
ggcuacccuaaagggag

SEQ ID NO: 607156 - RNA, 16 nt, Homo sapiens
ggcuacugacuacccu

SEQ ID NO: 607157 - RNA, 11 nt, Homo sapiens
ggcuacuugag

SEQ ID NO: 607158 - RNA, 14 nt, Homo sapiens
ggcuagagugcaau

SEQ ID NO: 607159 - RNA, 15 nt, Homo sapiens
ggcuagagugcaaug

SEQ ID NO: 607160 - RNA, 16 nt, Homo sapiens
ggcuagguccagaucc

SEQ ID NO: 607161 - RNA, 17 nt, Homo sapiens
ggcuaguagaacuggau

SEQ ID NO: 607162 - RNA, 16 nt, Homo sapiens
ggcuaucaacuuaaua

SEQ ID NO: 607163 - RNA, 16 nt, Homo sapiens
ggcuaugacaugagca

SEQ ID NO: 607164 - RNA, 12 nt, Homo sapiens
ggcuaugccuug

SEQ ID NO: 607165 - RNA, 22 nt, Homo sapiens
ggcuauuguccccuaaaccaaa

SEQ ID NO: 607166 - RNA, 15 nt, Homo sapiens
ggcucacaccuguaa

SEQ ID NO: 607167 - RNA, 13 nt, Homo sapiens
ggcucagccagca

SEQ ID NO: 607168 - RNA, 12 nt, Homo sapiens
ggcucaggguug

SEQ ID NO: 607169 - RNA, 21 nt, Homo sapiens
ggcucaggguuggccauuugc

SEQ ID NO: 607170 - RNA, 23 nt, Homo sapiens
ggcucagguuuugagaagccauc

SEQ ID NO: 607171 - RNA, 16 nt, Homo sapiens
ggcucagucucaggag

SEQ ID NO: 607172 - RNA, 16 nt, Homo sapiens
ggcucaugaccuggaa

SEQ ID NO: 607173 - RNA, 15 nt, Homo sapiens
ggcuccaaaucugcc

SEQ ID NO: 607174 - RNA, 17 nt, Homo sapiens
guguauauuuauucaua

SEQ ID NO: 607175 - RNA, 13 nt, Homo sapiens
guguauccaugca

SEQ ID NO: 607176 - RNA, 19 nt, Homo sapiens
guguaugagagggcccugc

SEQ ID NO: 607177 - RNA, 14 nt, Homo sapiens
guguauguuuuaua

SEQ ID NO: 607178 - RNA, 20 nt, Homo sapiens
guguauucuagugaaugaau

SEQ ID NO: 607179 - RNA, 16 nt, Homo sapiens
gugucaaaagccagau

SEQ ID NO: 607180 - RNA, 21 nt, Homo sapiens
gugucacccauuggugaccug

SEQ ID NO: 607181 - RNA, 22 nt, Homo sapiens
gugucacccugugggugucucc

SEQ ID NO: 607182 - RNA, 22 nt, Homo sapiens
gugucacuacucacagucucuu

SEQ ID NO: 607183 - RNA, 11 nt, Homo sapiens
gugucacuggc

SEQ ID NO: 607184 - RNA, 15 nt, Homo sapiens
gugucacuugugcuu

SEQ ID NO: 607185 - RNA, 16 nt, Homo sapiens
gugucagucagggaca

SEQ ID NO: 607186 - RNA, 18 nt, Homo sapiens
gugucauaacuucauaga

SEQ ID NO: 607187 - RNA, 12 nt, Homo sapiens
gugucauagaau

SEQ ID NO: 607188 - RNA, 22 nt, Homo sapiens
gugucauaugacugauuacuca

SEQ ID NO: 607189 - RNA, 15 nt, Homo sapiens
gugucauuucauucc

SEQ ID NO: 607190 - RNA, 23 nt, Homo sapiens
guguccaccauccccagcuggug

SEQ ID NO: 607191 - RNA, 20 nt, Homo sapiens
guguccaggguccucuagcc

SEQ ID NO: 607192 - RNA, 21 nt, Homo sapiens
guguccauuuugcaaacccaa

SEQ ID NO: 607193 - RNA, 16 nt, Homo sapiens
guguccccuccacugu

SEQ ID NO: 607194 - RNA, 23 nt, Homo sapiens
guguccccugacagggccagugc

SEQ ID NO: 607195 - RNA, 20 nt, Homo sapiens
guguccccugaccuguccag

SEQ ID NO: 607196 - RNA, 20 nt, Homo sapiens
guguccguccacccuuccau

SEQ ID NO: 607197 - RNA, 22 nt, Homo sapiens
guguccuggggaauacuggcca

SEQ ID NO: 607198 - RNA, 21 nt, Homo sapiens
guguccuguccuuucuugcag

SEQ ID NO: 607199 - RNA, 23 nt, Homo sapiens
gugucucagggugcagaggucag

SEQ ID NO: 607200 - RNA, 20 nt, Homo sapiens
gugucucgcgcgacugagaa

SEQ ID NO: 607201 - RNA, 18 nt, Homo sapiens
gugucucugaggacguca

SEQ ID NO: 607202 - RNA, 23 nt, Homo sapiens
gugucugcacccaggggugggga

SEQ ID NO: 607203 - RNA, 17 nt, Homo sapiens
gugucuggcaguuuaua

SEQ ID NO: 607204 - RNA, 14 nt, Homo sapiens
guuaccucugcaug

SEQ ID NO: 607205 - RNA, 14 nt, Homo sapiens
guuacgaagacaaa

SEQ ID NO: 607206 - RNA, 12 nt, Homo sapiens
guuacgugaaga

SEQ ID NO: 607207 - RNA, 13 nt, Homo sapiens
guuacuaguacag

SEQ ID NO: 607208 - RNA, 14 nt, Homo sapiens
guuacuaguacagg

SEQ ID NO: 607209 - RNA, 13 nt, Homo sapiens
guuacucaugacu

SEQ ID NO: 607210 - RNA, 11 nt, Homo sapiens
guuacugcuga

SEQ ID NO: 607211 - RNA, 17 nt, Homo sapiens
guuacuuaccacagacu

SEQ ID NO: 607212 - RNA, 19 nt, Homo sapiens
guuagaaaaaggacucugc

SEQ ID NO: 607213 - RNA, 16 nt, Homo sapiens
guuagaaaaauagcug

SEQ ID NO: 607214 - RNA, 16 nt, Homo sapiens
guuagaacuagccaaa

SEQ ID NO: 607215 - RNA, 22 nt, Homo sapiens
guuagagagcuuuucacuguga

SEQ ID NO: 607216 - RNA, 19 nt, Homo sapiens
guuagcauauggugcuuaa

SEQ ID NO: 607217 - RNA, 20 nt, Homo sapiens
guuaggaggugcagacacuu

SEQ ID NO: 607218 - RNA, 18 nt, Homo sapiens
guuagggugugugccaca

SEQ ID NO: 607219 - RNA, 14 nt, Homo sapiens
guuaguagcccuuc

SEQ ID NO: 607220 - RNA, 15 nt, Homo sapiens
guuaguaucaucaga

SEQ ID NO: 607221 - RNA, 24 nt, Homo sapiens
guuagucaauccugucauauaaua

SEQ ID NO: 607222 - RNA, 21 nt, Homo sapiens
guuaguugugaaagaaagcug

SEQ ID NO: 607223 - RNA, 19 nt, Homo sapiens
guuauaaaucaaugucacu

SEQ ID NO: 607224 - RNA, 20 nt, Homo sapiens
guuauaaaucaaugucacuu

SEQ ID NO: 607225 - RNA, 20 nt, Homo sapiens
guuauaagcagcaagacaaa

SEQ ID NO: 607226 - RNA, 14 nt, Homo sapiens
guuauagacugcca

SEQ ID NO: 607227 - RNA, 15 nt, Homo sapiens
guuauagacugccau

SEQ ID NO: 607228 - RNA, 14 nt, Homo sapiens
guuauagcuucagg

SEQ ID NO: 607229 - RNA, 18 nt, Homo sapiens
guuauaucauauguauau

SEQ ID NO: 607230 - RNA, 22 nt, Homo sapiens
guuaucacuucauuuaucuuaa

SEQ ID NO: 607231 - RNA, 21 nt, Homo sapiens
guuauccuuucauuaggcaaa

SEQ ID NO: 607232 - RNA, 20 nt, Homo sapiens
guuaucugucugcauuuuaa

SEQ ID NO: 607233 - RNA, 15 nt, Homo sapiens
guucuccuuccucag

SEQ ID NO: 607234 - RNA, 17 nt, Homo sapiens
guucucuauugcugcuc

SEQ ID NO: 607235 - RNA, 16 nt, Homo sapiens
guucucugguuucacc

SEQ ID NO: 607236 - RNA, 23 nt, Homo sapiens
guucugacauuaacaguuuucca

SEQ ID NO: 607237 - RNA, 15 nt, Homo sapiens
guucugagcaccgug

SEQ ID NO: 607238 - RNA, 14 nt, Homo sapiens
guucugaguguuuu

SEQ ID NO: 607239 - RNA, 11 nt, Homo sapiens
guucugcagcc

SEQ ID NO: 607240 - RNA, 15 nt, Homo sapiens
guucugucugugucu

SEQ ID NO: 607241 - RNA, 14 nt, Homo sapiens
guucugugcacaaa

SEQ ID NO: 607242 - RNA, 18 nt, Homo sapiens
guucuguggucacaguga

SEQ ID NO: 607243 - RNA, 18 nt, Homo sapiens
guucuguuaacugaauac

SEQ ID NO: 607244 - RNA, 15 nt, Homo sapiens
guucuguuggaugac

SEQ ID NO: 607245 - RNA, 18 nt, Homo sapiens
guucuuacagcacaucac

SEQ ID NO: 607246 - RNA, 11 nt, Homo sapiens
guucuuaccug

SEQ ID NO: 607247 - RNA, 17 nt, Homo sapiens
guucuuaguuugcaguu

SEQ ID NO: 607248 - RNA, 18 nt, Homo sapiens
guucuucaccuccugcca

SEQ ID NO: 607249 - RNA, 15 nt, Homo sapiens
guucuucagggccag

SEQ ID NO: 607250 - RNA, 19 nt, Homo sapiens
guucuucagggccaguccu

SEQ ID NO: 607251 - RNA, 16 nt, Homo sapiens
guucuucuucauugaa

SEQ ID NO: 607252 - RNA, 23 nt, Homo sapiens
guucuugugcauguuuacuuuau

SEQ ID NO: 607253 - RNA, 12 nt, Homo sapiens
guucuuguucuu

SEQ ID NO: 607254 - RNA, 18 nt, Homo sapiens
guucuuuaaaggcaucua

SEQ ID NO: 607255 - RNA, 12 nt, Homo sapiens
guucuuuccucc

SEQ ID NO: 607256 - RNA, 21 nt, Homo sapiens
guugaaaauguguuugcugcc

SEQ ID NO: 607257 - RNA, 20 nt, Homo sapiens
guugaaacacacgugcugug

SEQ ID NO: 607258 - RNA, 16 nt, Homo sapiens
guugaaaccaccguga

SEQ ID NO: 607259 - RNA, 22 nt, Homo sapiens
guugaaaccaccgugaaccaga

SEQ ID NO: 607260 - RNA, 18 nt, Homo sapiens
guuucgaguaaacuugaa

SEQ ID NO: 607261 - RNA, 21 nt, Homo sapiens
guuucguaacacagcauugua

SEQ ID NO: 607262 - RNA, 21 nt, Homo sapiens
guuucgugaaguauacuguau

SEQ ID NO: 607263 - RNA, 13 nt, Homo sapiens
guuucguguauau

SEQ ID NO: 607264 - RNA, 19 nt, Homo sapiens
guuucuaagcauguagcca

SEQ ID NO: 607265 - RNA, 17 nt, Homo sapiens
guuucuaggcaccucag

SEQ ID NO: 607266 - RNA, 20 nt, Homo sapiens
guuucuauucuaaguaauuc

SEQ ID NO: 607267 - RNA, 12 nt, Homo sapiens
guuucucuucac

SEQ ID NO: 607268 - RNA, 23 nt, Homo sapiens
guuucucuuggguauaaaggcua

SEQ ID NO: 607269 - RNA, 20 nt, Homo sapiens
guuucugauaccacugcacu

SEQ ID NO: 607270 - RNA, 14 nt, Homo sapiens
guuucugcagcccu

SEQ ID NO: 607271 - RNA, 23 nt, Homo sapiens
guuucuggcagccaguaccuccu

SEQ ID NO: 607272 - RNA, 14 nt, Homo sapiens
guuucuggcucuug

SEQ ID NO: 607273 - RNA, 15 nt, Homo sapiens
guuucuuagauauga

SEQ ID NO: 607274 - RNA, 15 nt, Homo sapiens
guuucuugugggcua

SEQ ID NO: 607275 - RNA, 18 nt, Homo sapiens
guuugaaaauaugccugc

SEQ ID NO: 607276 - RNA, 21 nt, Homo sapiens
guuugaaaauauuuuguugcc

SEQ ID NO: 607277 - RNA, 22 nt, Homo sapiens
guuugaagaugccgcauuugga

SEQ ID NO: 607278 - RNA, 18 nt, Homo sapiens
guuugaagauuauaugaa

SEQ ID NO: 607279 - RNA, 18 nt, Homo sapiens
guuugacacgaagccuua

SEQ ID NO: 607280 - RNA, 15 nt, Homo sapiens
guuugacaugugaag

SEQ ID NO: 607281 - RNA, 18 nt, Homo sapiens
guuugaccucauuuguaa

SEQ ID NO: 607282 - RNA, 18 nt, Homo sapiens
guuugagcuuagugaaau

SEQ ID NO: 607283 - RNA, 13 nt, Homo sapiens
guuugcacuuccu

SEQ ID NO: 607284 - RNA, 16 nt, Homo sapiens
guuugccaaauaaaaa

SEQ ID NO: 607285 - RNA, 21 nt, Homo sapiens
guuugcuauugacaagucauu

SEQ ID NO: 607286 - RNA, 16 nt, Homo sapiens
guuugcucaauuccaa

SEQ ID NO: 607287 - RNA, 23 nt, Homo sapiens
guuugcucuuuuaagcagucuca

SEQ ID NO: 607288 - RNA, 17 nt, Homo sapiens
guuugcugacaggugau

SEQ ID NO: 607289 - RNA, 21 nt, Homo sapiens
guuugcugccauggacauaaa

SEQ ID NO: 607290 - RNA, 16 nt, Homo sapiens
guuugcuucuugccau

SEQ ID NO: 607291 - RNA, 17 nt, Homo sapiens
guuuggaauaaagucaa

SEQ ID NO: 607292 - RNA, 17 nt, Homo sapiens
guuuggacuguuuucaa

SEQ ID NO: 607293 - RNA, 16 nt, Homo sapiens
guuuggagucacugua

SEQ ID NO: 607294 - RNA, 17 nt, Homo sapiens
guuuggagucacuguag

SEQ ID NO: 607295 - RNA, 22 nt, Homo sapiens
guuuggauugauaucgugaaau

SEQ ID NO: 607296 - RNA, 20 nt, Homo sapiens
guuuggcaaugcuaauucaa

SEQ ID NO: 607297 - RNA, 21 nt, Homo sapiens
guuuggcuagguaucauucaa

SEQ ID NO: 607298 - RNA, 15 nt, Homo sapiens
guuuggucagacuau

SEQ ID NO: 607299 - RNA, 15 nt, Homo sapiens
guuuguaaaauccac

SEQ ID NO: 607300 - RNA, 18 nt, Homo sapiens
guuuguaauacuuuacaa

SEQ ID NO: 607301 - RNA, 22 nt, Homo sapiens
guuugucccagcgauggugccu

SEQ ID NO: 607302 - RNA, 18 nt, Homo sapiens
guuugucuguuuguuuca

SEQ ID NO: 607303 - RNA, 18 nt, Homo sapiens
guuugugcauaucugccu

SEQ ID NO: 607304 - RNA, 14 nt, Homo sapiens
guuuguggccucag

SEQ ID NO: 607305 - RNA, 20 nt, Homo sapiens
guuugugucuguugcuugua

SEQ ID NO: 607306 - RNA, 20 nt, Homo sapiens
guuuguuccuacagccccuu

SEQ ID NO: 607307 - RNA, 23 nt, Homo sapiens
guuuguucuguucugggggacag

SEQ ID NO: 607308 - RNA, 17 nt, Homo sapiens
guuuguuucauauauac

SEQ ID NO: 607309 - RNA, 17 nt, Homo sapiens
guuuguuuuuuugccac

SEQ ID NO: 607310 - RNA, 14 nt, Homo sapiens
guuuuaaauugaua

SEQ ID NO: 607311 - RNA, 12 nt, Homo sapiens
guuuuaacugua

SEQ ID NO: 607312 - RNA, 14 nt, Homo sapiens
guuuuaauuccaau

SEQ ID NO: 607313 - RNA, 14 nt, Homo sapiens
guuuuacgcaagga

SEQ ID NO: 607314 - RNA, 19 nt, Homo sapiens
guuuuacugugaaacuggc

SEQ ID NO: 607315 - RNA, 21 nt, Homo sapiens
guuuuauucugacuuccucug

SEQ ID NO: 607316 - RNA, 13 nt, Homo sapiens
guuuuauuuugaa

SEQ ID NO: 607317 - RNA, 19 nt, Homo sapiens
guuuucaagaugguguuau

SEQ ID NO: 607318 - RNA, 16 nt, Homo sapiens
guuuucaauaacaaag

SEQ ID NO: 607319 - RNA, 15 nt, Homo sapiens
guuuucacuugucuc

SEQ ID NO: 607320 - RNA, 16 nt, Homo sapiens
guuuucaggaugagau

SEQ ID NO: 607321 - RNA, 22 nt, Homo sapiens
guuuucagugcugugucauucc

SEQ ID NO: 607322 - RNA, 12 nt, Homo sapiens
guuuucagugga

SEQ ID NO: 607323 - RNA, 19 nt, Homo sapiens
guuuucaguggacuaucuu

SEQ ID NO: 607324 - RNA, 15 nt, Homo sapiens
guuuuccacugugcu

SEQ ID NO: 607325 - RNA, 17 nt, Homo sapiens
guuuuccaguucaucga

SEQ ID NO: 607326 - RNA, 17 nt, Homo sapiens
guuuuccccacauucua

SEQ ID NO: 607327 - RNA, 19 nt, Homo sapiens
guuuuccuaaaugcaguga

SEQ ID NO: 607328 - RNA, 20 nt, Homo sapiens
guuuuccucccuucugcuac

SEQ ID NO: 607329 - RNA, 20 nt, Homo sapiens
guuuucgcuggggauggaau

SEQ ID NO: 607330 - RNA, 15 nt, Homo sapiens
guuuucuagaauuua

SEQ ID NO: 607331 - RNA, 22 nt, Homo sapiens
guuuucuccuugauaucauuca

SEQ ID NO: 607332 - RNA, 23 nt, Homo sapiens
guuuucuccuugauaucauucag

SEQ ID NO: 607333 - RNA, 12 nt, Homo sapiens
guuuucucugaa

SEQ ID NO: 607334 - RNA, 14 nt, Homo sapiens
guuuucuucauuca

SEQ ID NO: 607335 - RNA, 18 nt, Homo sapiens
guuuucuugaacauacuu

SEQ ID NO: 607336 - RNA, 15 nt, Homo sapiens
guuuucuuucucacc

SEQ ID NO: 607337 - RNA, 17 nt, Homo sapiens
guuuucuuucucaccca

SEQ ID NO: 607338 - RNA, 18 nt, Homo sapiens
guuuugaagcuguugcua

SEQ ID NO: 607339 - RNA, 23 nt, Homo sapiens
guuuugaaggcaaaauugcaaau

SEQ ID NO: 607340 - RNA, 23 nt, Homo sapiens
guuuugauauuuauuuuuugcca

SEQ ID NO: 607341 - RNA, 20 nt, Homo sapiens
guuuugauuuguagcacuga

SEQ ID NO: 607342 - RNA, 21 nt, Homo sapiens
guuuugcauuuuuugaauauu

SEQ ID NO: 607343 - RNA, 12 nt, Homo sapiens
guuuugccucac

SEQ ID NO: 607344 - RNA, 15 nt, Homo sapiens
guuuugcuacauucu

SEQ ID NO: 607345 - RNA, 17 nt, Homo sapiens
guuuuggaagcucugaa

SEQ ID NO: 607346 - RNA, 18 nt, Homo sapiens
guuuuguaccaacacaca

SEQ ID NO: 607347 - RNA, 16 nt, Homo sapiens
guuuugucaaacugua

SEQ ID NO: 607348 - RNA, 17 nt, Homo sapiens
guuuugugagaacuaau

SEQ ID NO: 607349 - RNA, 22 nt, Homo sapiens
guuuuuaaaaaggucauauauu

SEQ ID NO: 607350 - RNA, 16 nt, Homo sapiens
guuuuuaaaacccagu

SEQ ID NO: 607351 - RNA, 18 nt, Homo sapiens
guuuuuaaaaguuucaau

SEQ ID NO: 607352 - RNA, 14 nt, Homo sapiens
guuuuuaaacuaau

SEQ ID NO: 607353 - RNA, 22 nt, Homo sapiens
guuuuuaaauagaguuugcuau

SEQ ID NO: 607354 - RNA, 15 nt, Homo sapiens
guuuuuaagcuguuu

SEQ ID NO: 607355 - RNA, 18 nt, Homo sapiens
guuuuuagagcuuccaaa

SEQ ID NO: 607356 - RNA, 19 nt, Homo sapiens
guuuuuagagcuuccaaau

SEQ ID NO: 607357 - RNA, 21 nt, Homo sapiens
uaauauuaccaacuacauugg

SEQ ID NO: 607358 - RNA, 22 nt, Homo sapiens
uaauauuucugaaaaccuacca

SEQ ID NO: 607359 - RNA, 16 nt, Homo sapiens
uaauauuuuauucuca

SEQ ID NO: 607360 - RNA, 23 nt, Homo sapiens
uaaucaaaagaaccagacugugu

SEQ ID NO: 607361 - RNA, 22 nt, Homo sapiens
uaaucaaaauugucucuucuga

SEQ ID NO: 607362 - RNA, 21 nt, Homo sapiens
uaaucaagaaaaacaucuuug

SEQ ID NO: 607363 - RNA, 15 nt, Homo sapiens
uaaucacuacuguau

SEQ ID NO: 607364 - RNA, 16 nt, Homo sapiens
uaaucacugcauuuca

SEQ ID NO: 607365 - RNA, 18 nt, Homo sapiens
uaaucagcauuaacaugg

SEQ ID NO: 607366 - RNA, 14 nt, Homo sapiens
uaaucaucaaguaa

SEQ ID NO: 607367 - RNA, 13 nt, Homo sapiens
uaaucaugcucau

SEQ ID NO: 607368 - RNA, 18 nt, Homo sapiens
uaauccaauauuuugccu

SEQ ID NO: 607369 - RNA, 12 nt, Homo sapiens
uaauccaggcac

SEQ ID NO: 607370 - RNA, 17 nt, Homo sapiens
uaaucccaacacuuuga

SEQ ID NO: 607371 - RNA, 15 nt, Homo sapiens
uaaucccagcacuuu

SEQ ID NO: 607372 - RNA, 17 nt, Homo sapiens
uaaucccagcacuuugg

SEQ ID NO: 607373 - RNA, 12 nt, Homo sapiens
uaauuugcacug

SEQ ID NO: 607374 - RNA, 22 nt, Homo sapiens
uaauuuguaguauaauucuugg

SEQ ID NO: 607375 - RNA, 19 nt, Homo sapiens
uaauuugugucuguguuua

SEQ ID NO: 607376 - RNA, 15 nt, Homo sapiens
uaauuuuaguuucau

SEQ ID NO: 607377 - RNA, 13 nt, Homo sapiens
uaauuuucgcuua

SEQ ID NO: 607378 - RNA, 19 nt, Homo sapiens
uaauuuucuagauuuucua

SEQ ID NO: 607379 - RNA, 14 nt, Homo sapiens
uaauuuucuuucac

SEQ ID NO: 607380 - RNA, 16 nt, Homo sapiens
uaauuuucuuuccgac

SEQ ID NO: 607381 - RNA, 13 nt, Homo sapiens
uaauuuugagaua

SEQ ID NO: 607382 - RNA, 15 nt, Homo sapiens
uaauuuuggauuuug

SEQ ID NO: 607383 - RNA, 15 nt, Homo sapiens
uaauuuuuaaagguu

SEQ ID NO: 607384 - RNA, 20 nt, Homo sapiens
uaauuuuuauuuuugcugag

SEQ ID NO: 607385 - RNA, 13 nt, Homo sapiens
uaauuuuuccaua

SEQ ID NO: 607386 - RNA, 19 nt, Homo sapiens
uaauuuuuccuauauugca

SEQ ID NO: 607387 - RNA, 18 nt, Homo sapiens
uaauuuuuuuaaccaaag

SEQ ID NO: 607388 - RNA, 20 nt, Homo sapiens
uacaaaaauuagccgggcau

SEQ ID NO: 607389 - RNA, 17 nt, Homo sapiens
uacaaaaauuagcugug

SEQ ID NO: 607390 - RNA, 22 nt, Homo sapiens
uacaaaacugcuuugugcauau

SEQ ID NO: 607391 - RNA, 18 nt, Homo sapiens
uacaaaacuuccaggcua

SEQ ID NO: 607392 - RNA, 15 nt, Homo sapiens
uacaaaauccagcua

SEQ ID NO: 607393 - RNA, 12 nt, Homo sapiens
uacaaacuacaa

SEQ ID NO: 607394 - RNA, 16 nt, Homo sapiens
uacaaagaacaugaac

SEQ ID NO: 607395 - RNA, 13 nt, Homo sapiens
uacaaaguacaga

SEQ ID NO: 607396 - RNA, 14 nt, Homo sapiens
uacaaaguauuugc

SEQ ID NO: 607397 - RNA, 14 nt, Homo sapiens
uacaaaguuucaaa

SEQ ID NO: 607398 - RNA, 23 nt, Homo sapiens
uacaaaucauccauccuugccaa

SEQ ID NO: 607399 - RNA, 22 nt, Homo sapiens
uacaaaugaggaaaccaagaua

SEQ ID NO: 607400 - RNA, 15 nt, Homo sapiens
uacaaauguaagcaa

SEQ ID NO: 607401 - RNA, 14 nt, Homo sapiens
uacaaauuuauuga

SEQ ID NO: 607402 - RNA, 20 nt, Homo sapiens
uacaaauuuggccuuaagaa

SEQ ID NO: 607403 - RNA, 21 nt, Homo sapiens
uacaaauuuucacugcugcuc

SEQ ID NO: 607404 - RNA, 12 nt, Homo sapiens
uacaacaaugaa

SEQ ID NO: 607405 - RNA, 13 nt, Homo sapiens
uacaacagaauuu

SEQ ID NO: 607406 - RNA, 12 nt, Homo sapiens
uacaacagcugc

SEQ ID NO: 607407 - RNA, 18 nt, Homo sapiens
uacaacagugcauuuaca

SEQ ID NO: 607408 - RNA, 21 nt, Homo sapiens
uacaacauaaucuaguuuaca

SEQ ID NO: 607409 - RNA, 16 nt, Homo sapiens
uacaacauuaaggaau

SEQ ID NO: 607410 - RNA, 21 nt, Homo sapiens
uacaaccauauaaaugaaggc

SEQ ID NO: 607411 - RNA, 13 nt, Homo sapiens
uacaaccccagcc

SEQ ID NO: 607412 - RNA, 14 nt, Homo sapiens
uacaaccuacaugu

SEQ ID NO: 607413 - RNA, 20 nt, Homo sapiens
uacaacuggacucauuauca

SEQ ID NO: 607414 - RNA, 17 nt, Homo sapiens
uacaacuguaaagcaaa

SEQ ID NO: 607415 - RNA, 11 nt, Homo sapiens
uacaacuuuac

SEQ ID NO: 607416 - RNA, 14 nt, Homo sapiens
uacaagaaagcaau

SEQ ID NO: 607417 - RNA, 13 nt, Homo sapiens
uacaagacacagu

SEQ ID NO: 607418 - RNA, 16 nt, Homo sapiens
uacaagaucuuuccaa

SEQ ID NO: 607419 - RNA, 14 nt, Homo sapiens
uacaagcauaacau

SEQ ID NO: 607420 - RNA, 19 nt, Homo sapiens
uacaagcuaagaguuuaca

SEQ ID NO: 607421 - RNA, 23 nt, Homo sapiens
uacaaggacauucacugcugauu

SEQ ID NO: 607422 - RNA, 21 nt, Homo sapiens
uacaaguaauauuauuacuuu

SEQ ID NO: 607423 - RNA, 14 nt, Homo sapiens
uacaaguauuacaa

SEQ ID NO: 607424 - RNA, 12 nt, Homo sapiens
uacaagucaaaa

SEQ ID NO: 607425 - RNA, 16 nt, Homo sapiens
uacaagucagcuccag

SEQ ID NO: 607426 - RNA, 23 nt, Homo sapiens
uacaaguuguuauuguugaacau

SEQ ID NO: 607427 - RNA, 17 nt, Homo sapiens
uacaaguuucagacagg

SEQ ID NO: 607428 - RNA, 15 nt, Homo sapiens
uacaauaaagcaaug

SEQ ID NO: 607429 - RNA, 16 nt, Homo sapiens
uacaauaaagcaaugu

SEQ ID NO: 607430 - RNA, 15 nt, Homo sapiens
uacaauacaauguac

SEQ ID NO: 607431 - RNA, 20 nt, Homo sapiens
uacaauaggugcuuauucuc

SEQ ID NO: 607432 - RNA, 23 nt, Homo sapiens
uacaaucaggagugguggaaccu

SEQ ID NO: 607433 - RNA, 18 nt, Homo sapiens
uacaaucaugaacagcuc

SEQ ID NO: 607434 - RNA, 19 nt, Homo sapiens
uacaaucaugaacagcucu

SEQ ID NO: 607435 - RNA, 16 nt, Homo sapiens
uacaaucucaaauucu

SEQ ID NO: 607436 - RNA, 16 nt, Homo sapiens
uacaaucuucauuuaa

SEQ ID NO: 607437 - RNA, 22 nt, Homo sapiens
uacaaugaaagcccucaugugc

SEQ ID NO: 607438 - RNA, 18 nt, Homo sapiens
uacaauggcgugaucucg

SEQ ID NO: 607439 - RNA, 20 nt, Homo sapiens
uacaaugugaacuuuauuaa

SEQ ID NO: 607440 - RNA, 17 nt, Homo sapiens
uacaauuaaaaugacaa

SEQ ID NO: 607441 - RNA, 13 nt, Homo sapiens
uacaauucauugu

SEQ ID NO: 607442 - RNA, 17 nt, Homo sapiens
uacaauugaaaugacua

SEQ ID NO: 607443 - RNA, 13 nt, Homo sapiens
uacaauugucauu

SEQ ID NO: 607444 - RNA, 12 nt, Homo sapiens
uacaauuucacu

SEQ ID NO: 607445 - RNA, 20 nt, Homo sapiens
uacaauuucacuuagucugu

SEQ ID NO: 607446 - RNA, 19 nt, Homo sapiens
uacaauuuccauauagucu

SEQ ID NO: 607447 - RNA, 19 nt, Homo sapiens
uacaauuuucucccaggaa

SEQ ID NO: 607448 - RNA, 19 nt, Homo sapiens
uacacaaggaaggcauuug

SEQ ID NO: 607449 - RNA, 14 nt, Homo sapiens
uacacaauaagcaa

SEQ ID NO: 607450 - RNA, 23 nt, Homo sapiens
uacacaauccuccaagaauuuga

SEQ ID NO: 607451 - RNA, 19 nt, Homo sapiens
uacacacacacgcacacaa

SEQ ID NO: 607452 - RNA, 15 nt, Homo sapiens
uacacacauauacau

SEQ ID NO: 607453 - RNA, 19 nt, Homo sapiens
uacacacauauacauauau

SEQ ID NO: 607454 - RNA, 18 nt, Homo sapiens
uacacacuuuuuaagaaa

SEQ ID NO: 607455 - RNA, 18 nt, Homo sapiens
uacacagaaaugcugcug

SEQ ID NO: 607456 - RNA, 11 nt, Homo sapiens
uacacagagaa

SEQ ID NO: 607457 - RNA, 20 nt, Homo sapiens
uacacagagaaauacaaaau

SEQ ID NO: 607458 - RNA, 20 nt, Homo sapiens
uacacagcuuuaugauauca

SEQ ID NO: 607459 - RNA, 20 nt, Homo sapiens
uacacaguucugguguuccu

SEQ ID NO: 607460 - RNA, 13 nt, Homo sapiens
uacacauacauac

SEQ ID NO: 607461 - RNA, 17 nt, Homo sapiens
uacacauuagauuuuau

SEQ ID NO: 607462 - RNA, 22 nt, Homo sapiens
uacaccaaugcccaacugccug

SEQ ID NO: 607463 - RNA, 21 nt, Homo sapiens
uacaccagcaauuuagacaaa

SEQ ID NO: 607464 - RNA, 18 nt, Homo sapiens
uacaccauuaucuuggaa

SEQ ID NO: 607465 - RNA, 18 nt, Homo sapiens
uacaccucgucaagagca

SEQ ID NO: 607466 - RNA, 22 nt, Homo sapiens
uacaccucgucaagagcaugca

SEQ ID NO: 607467 - RNA, 19 nt, Homo sapiens
uacaccugcggggccaccc

SEQ ID NO: 607468 - RNA, 23 nt, Homo sapiens
uacacuaagcgaauguguacaaa

SEQ ID NO: 607469 - RNA, 12 nt, Homo sapiens
uacacuaugaag

SEQ ID NO: 607470 - RNA, 20 nt, Homo sapiens
uacacugcacuuuguuuaga

SEQ ID NO: 607471 - RNA, 17 nt, Homo sapiens
uacacugugaacuuggg

SEQ ID NO: 607472 - RNA, 21 nt, Homo sapiens
uacacuguguaaauacccaua

SEQ ID NO: 607473 - RNA, 20 nt, Homo sapiens
uacacuuauuuuacuaguuu

SEQ ID NO: 607474 - RNA, 20 nt, Homo sapiens
uacacuuuuuggaagugaaa

SEQ ID NO: 607475 - RNA, 20 nt, Homo sapiens
uacagaaaagacucugacca

SEQ ID NO: 607476 - RNA, 13 nt, Homo sapiens
uacagaaaugacu

SEQ ID NO: 607477 - RNA, 21 nt, Homo sapiens
uacagaaaugauuacuaagga

SEQ ID NO: 607478 - RNA, 14 nt, Homo sapiens
uacagaacucuuaa

SEQ ID NO: 607479 - RNA, 19 nt, Homo sapiens
uacagaaucaaaugcaauu

SEQ ID NO: 607480 - RNA, 20 nt, Homo sapiens
uacagaaucaaaugcaauuu

SEQ ID NO: 607481 - RNA, 22 nt, Homo sapiens
uacagacaagguucugcccuua

SEQ ID NO: 607482 - RNA, 13 nt, Homo sapiens
uccuccacuuugc

SEQ ID NO: 607483 - RNA, 18 nt, Homo sapiens
uccuccagaauggagcug

SEQ ID NO: 607484 - RNA, 22 nt, Homo sapiens
uccuccauaaauuauggcauuu

SEQ ID NO: 607485 - RNA, 17 nt, Homo sapiens
uccuccauuuuccuccc

SEQ ID NO: 607486 - RNA, 14 nt, Homo sapiens
uccucccacaaccc

SEQ ID NO: 607487 - RNA, 11 nt, Homo sapiens
uccuccccaaa

SEQ ID NO: 607488 - RNA, 19 nt, Homo sapiens
uccuccccaccuguagcug

SEQ ID NO: 607489 - RNA, 13 nt, Homo sapiens
uccuccccagcgc

SEQ ID NO: 607490 - RNA, 15 nt, Homo sapiens
uccucccuacuucca

SEQ ID NO: 607491 - RNA, 20 nt, Homo sapiens
uccucccucauucaucuugc

SEQ ID NO: 607492 - RNA, 12 nt, Homo sapiens
uccuccguccac

SEQ ID NO: 607493 - RNA, 14 nt, Homo sapiens
uccuccuacuguau

SEQ ID NO: 607494 - RNA, 10 nt, Homo sapiens
uccuccucag

SEQ ID NO: 607495 - RNA, 14 nt, Homo sapiens
uccuccugccucag

SEQ ID NO: 607496 - RNA, 19 nt, Homo sapiens
uccuccugcuucaugggaa

SEQ ID NO: 607497 - RNA, 23 nt, Homo sapiens
uccuccuguucugaaaccuuagu

SEQ ID NO: 607498 - RNA, 14 nt, Homo sapiens
uccuccuugcccag

SEQ ID NO: 607499 - RNA, 19 nt, Homo sapiens
uccuccuuugcucuuggga

SEQ ID NO: 607500 - RNA, 21 nt, Homo sapiens
uccucgaauuuuaucugugga

SEQ ID NO: 607501 - RNA, 14 nt, Homo sapiens
uccucgcugccaga

SEQ ID NO: 607502 - RNA, 17 nt, Homo sapiens
uccucguuccuuucucc

SEQ ID NO: 607503 - RNA, 19 nt, Homo sapiens
uccucuaacucacugccua

SEQ ID NO: 607504 - RNA, 14 nt, Homo sapiens
uccucuaaugaaga

SEQ ID NO: 607505 - RNA, 22 nt, Homo sapiens
uccucuagcaggccuaagacau

SEQ ID NO: 607506 - RNA, 22 nt, Homo sapiens
uccucuaguaagaugcacugaa

SEQ ID NO: 607507 - RNA, 14 nt, Homo sapiens
uccucucaucauuu

SEQ ID NO: 607508 - RNA, 20 nt, Homo sapiens
uccucucauugucuuguuau

SEQ ID NO: 607509 - RNA, 14 nt, Homo sapiens
uccucuccaccaga

SEQ ID NO: 607510 - RNA, 13 nt, Homo sapiens
uccucuccacugc

SEQ ID NO: 607511 - RNA, 16 nt, Homo sapiens
uccucucccaagucca

SEQ ID NO: 607512 - RNA, 22 nt, Homo sapiens
uccucucccccuccuccaggga

SEQ ID NO: 607513 - RNA, 13 nt, Homo sapiens
uccucuccgugcu

SEQ ID NO: 607514 - RNA, 21 nt, Homo sapiens
uccucuccuacccacuggucu

SEQ ID NO: 607515 - RNA, 22 nt, Homo sapiens
uccucuccuacccacuggucug

SEQ ID NO: 607516 - RNA, 14 nt, Homo sapiens
uccucuccuacucg

SEQ ID NO: 607517 - RNA, 11 nt, Homo sapiens
uccucucugcu

SEQ ID NO: 607518 - RNA, 21 nt, Homo sapiens
uccucucugugucccugcugc

SEQ ID NO: 607519 - RNA, 18 nt, Homo sapiens
uccucugaggcuggaucc

SEQ ID NO: 607520 - RNA, 23 nt, Homo sapiens
uccucugcaguuuugacauuuag

SEQ ID NO: 607521 - RNA, 21 nt, Homo sapiens
uccucugccacucccugcugu

SEQ ID NO: 607522 - RNA, 23 nt, Homo sapiens
uccucuguucacaaacuaccucu

SEQ ID NO: 607523 - RNA, 22 nt, Homo sapiens
uccucuguucuaucccacccaa

SEQ ID NO: 607524 - RNA, 21 nt, Homo sapiens
uccucuugccucucucaggag

SEQ ID NO: 607525 - RNA, 14 nt, Homo sapiens
uccucuugcucaaa

SEQ ID NO: 607526 - RNA, 20 nt, Homo sapiens
uccucuugguggguguggcc

SEQ ID NO: 607527 - RNA, 14 nt, Homo sapiens
uccucuuugugaua

SEQ ID NO: 607528 - RNA, 17 nt, Homo sapiens
uccugaaaaaugcucaa

SEQ ID NO: 607529 - RNA, 22 nt, Homo sapiens
uccugaaaaaugcucaaucuca

SEQ ID NO: 607530 - RNA, 16 nt, Homo sapiens
uccugaaaauugcaau

SEQ ID NO: 607531 - RNA, 13 nt, Homo sapiens
uccugaaagccaa

SEQ ID NO: 607532 - RNA, 16 nt, Homo sapiens
uccugaaccgacugac

SEQ ID NO: 607533 - RNA, 19 nt, Homo sapiens
uccugaacucuucugcaaa

SEQ ID NO: 607534 - RNA, 18 nt, Homo sapiens
uccugaagccucugcccu

SEQ ID NO: 607535 - RNA, 22 nt, Homo sapiens
uccugaaggaaaauaaacugac

SEQ ID NO: 607536 - RNA, 14 nt, Homo sapiens
uccugaauccuuuu

SEQ ID NO: 607537 - RNA, 14 nt, Homo sapiens
uccugacacauucu

SEQ ID NO: 607538 - RNA, 19 nt, Homo sapiens
uccugacagaaggacucag

SEQ ID NO: 607539 - RNA, 12 nt, Homo sapiens
uccugaccucaa

SEQ ID NO: 607540 - RNA, 18 nt, Homo sapiens
uccugaccucaaguaauc

SEQ ID NO: 607541 - RNA, 13 nt, Homo sapiens
uccugaccucagg

SEQ ID NO: 607542 - RNA, 19 nt, Homo sapiens
uccugaccuugugauccac

SEQ ID NO: 607543 - RNA, 13 nt, Homo sapiens
uccugacugaaag

SEQ ID NO: 607544 - RNA, 20 nt, Homo sapiens
uccugacugaaaguaggggg

SEQ ID NO: 607545 - RNA, 21 nt, Homo sapiens
uccugagaaagcccaccuggg

SEQ ID NO: 607546 - RNA, 18 nt, Homo sapiens
uccugagagcugcaugug

SEQ ID NO: 607547 - RNA, 18 nt, Homo sapiens
uccugauccugacacauu

SEQ ID NO: 607548 - RNA, 13 nt, Homo sapiens
uccugaucuguga

SEQ ID NO: 607549 - RNA, 15 nt, Homo sapiens
uccugaucugugaua

SEQ ID NO: 607550 - RNA, 16 nt, Homo sapiens
uccugauuucucugaa

SEQ ID NO: 607551 - RNA, 16 nt, Homo sapiens
uccugcaaaccucaca

SEQ ID NO: 607552 - RNA, 13 nt, Homo sapiens
uccugcacacagg

SEQ ID NO: 607553 - RNA, 12 nt, Homo sapiens
uccugcacucua

SEQ ID NO: 607554 - RNA, 19 nt, Homo sapiens
uccugcagaaguacuccua

SEQ ID NO: 607555 - RNA, 21 nt, Homo sapiens
uccugcagucccacacugugc

SEQ ID NO: 607556 - RNA, 21 nt, Homo sapiens
uccugcauagucuguuccuuu

SEQ ID NO: 607557 - RNA, 15 nt, Homo sapiens
uccugccacugccgc

SEQ ID NO: 607558 - RNA, 23 nt, Homo sapiens
uccugccagggugagcaggguca

SEQ ID NO: 607559 - RNA, 16 nt, Homo sapiens
uccugccauagucuua

SEQ ID NO: 607560 - RNA, 16 nt, Homo sapiens
uccugcccaagcacuu

SEQ ID NO: 607561 - RNA, 20 nt, Homo sapiens
uccugcccccagucuggguu

SEQ ID NO: 607562 - RNA, 14 nt, Homo sapiens
uccugccuggccag

SEQ ID NO: 607563 - RNA, 15 nt, Homo sapiens
uccugcgcauggugc

SEQ ID NO: 607564 - RNA, 23 nt, Homo sapiens
uccugcucucuggaggacgguca

SEQ ID NO: 607565 - RNA, 13 nt, Homo sapiens
uccugcucucuuc

SEQ ID NO: 607566 - RNA, 14 nt, Homo sapiens
uccugcugauccag

SEQ ID NO: 607567 - RNA, 21 nt, Homo sapiens
uccugcugccuuuucuggagu

SEQ ID NO: 607568 - RNA, 21 nt, Homo sapiens
uccugcugcuguaacugcuga

SEQ ID NO: 607569 - RNA, 13 nt, Homo sapiens
uccuggaaccaau

SEQ ID NO: 607570 - RNA, 17 nt, Homo sapiens
uccuggaaucaguauuu

SEQ ID NO: 607571 - RNA, 22 nt, Homo sapiens
uccuggacaaccuggacccaga

SEQ ID NO: 607572 - RNA, 22 nt, Homo sapiens
uccuggacaaggcuaacauccc

SEQ ID NO: 607573 - RNA, 20 nt, Homo sapiens
uccuggaggucagcauuuga

SEQ ID NO: 607574 - RNA, 18 nt, Homo sapiens
uccuggagugauaugauc

SEQ ID NO: 607575 - RNA, 15 nt, Homo sapiens
uccuggauucacuca

SEQ ID NO: 607576 - RNA, 17 nt, Homo sapiens
uccuggcacucucaugu

SEQ ID NO: 607577 - RNA, 22 nt, Homo sapiens
uccuggcaucaguagcaucugu

SEQ ID NO: 607578 - RNA, 21 nt, Homo sapiens
uccuggccaggauaauauauu

SEQ ID NO: 607579 - RNA, 13 nt, Homo sapiens
uccuggccugaga

SEQ ID NO: 607580 - RNA, 15 nt, Homo sapiens
uccuggccuggcaca

SEQ ID NO: 607581 - RNA, 15 nt, Homo sapiens
uccuggccuggccau

SEQ ID NO: 607582 - RNA, 18 nt, Homo sapiens
uccuggcuccuucacuga

SEQ ID NO: 607583 - RNA, 19 nt, Homo sapiens
uccuggcugcacucuugaa

SEQ ID NO: 607584 - RNA, 13 nt, Homo sapiens
uccugggacccuu

SEQ ID NO: 607585 - RNA, 23 nt, Homo sapiens
ugccacagccuccccugccaggg

SEQ ID NO: 607586 - RNA, 14 nt, Homo sapiens
ugccacagcucaac

SEQ ID NO: 607587 - RNA, 19 nt, Homo sapiens
ugccaccaggcacugccug

SEQ ID NO: 607588 - RNA, 18 nt, Homo sapiens
ugccaccccacaguggga

SEQ ID NO: 607589 - RNA, 21 nt, Homo sapiens
ugccacccugccccuugccau

SEQ ID NO: 607590 - RNA, 20 nt, Homo sapiens
ugccaccgugggggaacuga

SEQ ID NO: 607591 - RNA, 21 nt, Homo sapiens
ugccacgccgcccuaaaagca

SEQ ID NO: 607592 - RNA, 14 nt, Homo sapiens
ugccacgcuuugau

SEQ ID NO: 607593 - RNA, 13 nt, Homo sapiens
ugccacugcacac

SEQ ID NO: 607594 - RNA, 12 nt, Homo sapiens
ugccacugcacu

SEQ ID NO: 607595 - RNA, 14 nt, Homo sapiens
ugccacugccucuu

SEQ ID NO: 607596 - RNA, 17 nt, Homo sapiens
ugccacuucaccaagga

SEQ ID NO: 607597 - RNA, 17 nt, Homo sapiens
ugccacuugacauuccu

SEQ ID NO: 607598 - RNA, 18 nt, Homo sapiens
ugccagaaaaaaauaacu

SEQ ID NO: 607599 - RNA, 17 nt, Homo sapiens
ugccagacacugagcuu

SEQ ID NO: 607600 - RNA, 12 nt, Homo sapiens
ugccagacaugu

SEQ ID NO: 607601 - RNA, 18 nt, Homo sapiens
ugccagacauugcucuca

SEQ ID NO: 607602 - RNA, 18 nt, Homo sapiens
ugccagacuuaaaucaca

SEQ ID NO: 607603 - RNA, 15 nt, Homo sapiens
ugccagcaacugaau

SEQ ID NO: 607604 - RNA, 18 nt, Homo sapiens
ugccagccccuuugccau

SEQ ID NO: 607605 - RNA, 19 nt, Homo sapiens
ugccagccccuuugccaua

SEQ ID NO: 607606 - RNA, 17 nt, Homo sapiens
ugccagccgugaugcuc

SEQ ID NO: 607607 - RNA, 12 nt, Homo sapiens
ugccagccucag

SEQ ID NO: 607608 - RNA, 22 nt, Homo sapiens
ugccagccuccuugcugacccc

SEQ ID NO: 607609 - RNA, 22 nt, Homo sapiens
ugccagcucucugauuccccaa

SEQ ID NO: 607610 - RNA, 19 nt, Homo sapiens
ugccagcuuaucucagggg

SEQ ID NO: 607611 - RNA, 16 nt, Homo sapiens
ugccaggcaacuuuua

SEQ ID NO: 607612 - RNA, 22 nt, Homo sapiens
ugccaggcugaauuacagugaa

SEQ ID NO: 607613 - RNA, 20 nt, Homo sapiens
ugccaggcuguaagcauucu

SEQ ID NO: 607614 - RNA, 14 nt, Homo sapiens
ugccaggcuugcag

SEQ ID NO: 607615 - RNA, 20 nt, Homo sapiens
ugccagucucuucugauuaa

SEQ ID NO: 607616 - RNA, 13 nt, Homo sapiens
ugccaguggcuua

SEQ ID NO: 607617 - RNA, 15 nt, Homo sapiens
ugccauaucagugaa

SEQ ID NO: 607618 - RNA, 24 nt, Homo sapiens
ugccauaucagugaaccuuuagaa

SEQ ID NO: 607619 - RNA, 14 nt, Homo sapiens
ugccaucaccgcug

SEQ ID NO: 607620 - RNA, 17 nt, Homo sapiens
ugccauccagccagaac

SEQ ID NO: 607621 - RNA, 17 nt, Homo sapiens
ugccaucgcugugaugc

SEQ ID NO: 607622 - RNA, 17 nt, Homo sapiens
ugccaugacugagaagg

SEQ ID NO: 607623 - RNA, 12 nt, Homo sapiens
ugccaugaucug

SEQ ID NO: 607624 - RNA, 12 nt, Homo sapiens
ugccauggauuu

SEQ ID NO: 607625 - RNA, 12 nt, Homo sapiens
ugccaugucaca

SEQ ID NO: 607626 - RNA, 13 nt, Homo sapiens
ugccaugugaaga

SEQ ID NO: 607627 - RNA, 17 nt, Homo sapiens
ugccauguuugcucuaa

SEQ ID NO: 607628 - RNA, 16 nt, Homo sapiens
ugccauguuuugccac

SEQ ID NO: 607629 - RNA, 18 nt, Homo sapiens
ugccauuaaaacauuacc

SEQ ID NO: 607630 - RNA, 11 nt, Homo sapiens
ugccauuccac

SEQ ID NO: 607631 - RNA, 20 nt, Homo sapiens
ugccauuccacagccccuuc

SEQ ID NO: 607632 - RNA, 19 nt, Homo sapiens
ugcccaaaagaggugucau

SEQ ID NO: 607633 - RNA, 16 nt, Homo sapiens
ugcccaagcacuucac

SEQ ID NO: 607634 - RNA, 21 nt, Homo sapiens
ugcccacuuccccuuccccaa

SEQ ID NO: 607635 - RNA, 18 nt, Homo sapiens
ugcccagaauaaguuauu

SEQ ID NO: 607636 - RNA, 11 nt, Homo sapiens
ugcccagacaa

SEQ ID NO: 607637 - RNA, 14 nt, Homo sapiens
ugcccagacaagau

SEQ ID NO: 607638 - RNA, 20 nt, Homo sapiens
ugcccagacacagacuggca

SEQ ID NO: 607639 - RNA, 22 nt, Homo sapiens
ugcccagacacagacuggcaau

SEQ ID NO: 607640 - RNA, 17 nt, Homo sapiens
ugcccagacuacagggc

SEQ ID NO: 607641 - RNA, 19 nt, Homo sapiens
ugcccagacugaugagcac

SEQ ID NO: 607642 - RNA, 23 nt, Homo sapiens
ugcccagaggcuccaucguccau

SEQ ID NO: 607643 - RNA, 12 nt, Homo sapiens
ugcccagaucaa

SEQ ID NO: 607644 - RNA, 15 nt, Homo sapiens
ugcccaggacugcau

SEQ ID NO: 607645 - RNA, 20 nt, Homo sapiens
ugcccaggcuagagugcaau

SEQ ID NO: 607646 - RNA, 16 nt, Homo sapiens
ugcccaggcuggagua

SEQ ID NO: 607647 - RNA, 20 nt, Homo sapiens
ugcccaggcuggagugcagu

SEQ ID NO: 607648 - RNA, 20 nt, Homo sapiens
ugcccaggcuggaguguagu

SEQ ID NO: 607649 - RNA, 15 nt, Homo sapiens
ugcccagggugcagu

SEQ ID NO: 607650 - RNA, 21 nt, Homo sapiens
ugcccaucagccauuugccau

SEQ ID NO: 607651 - RNA, 18 nt, Homo sapiens
ugccccaaguccucauuu

SEQ ID NO: 607652 - RNA, 23 nt, Homo sapiens
ugccccacaaaacuucagugugg

SEQ ID NO: 607653 - RNA, 16 nt, Homo sapiens
ugccccaccccaucca

SEQ ID NO: 607654 - RNA, 15 nt, Homo sapiens
ugccccagagcuguu

SEQ ID NO: 607655 - RNA, 18 nt, Homo sapiens
ugccccaggccugaaaga

SEQ ID NO: 607656 - RNA, 20 nt, Homo sapiens
ugccccagggaguccagggu

SEQ ID NO: 607657 - RNA, 21 nt, Homo sapiens
ugccccaguggggauccugcc

SEQ ID NO: 607658 - RNA, 18 nt, Homo sapiens
ugcccccagccccggggu

SEQ ID NO: 607659 - RNA, 16 nt, Homo sapiens
ugcccccauucuccca

SEQ ID NO: 607660 - RNA, 14 nt, Homo sapiens
ugccccccaugagg

SEQ ID NO: 607661 - RNA, 20 nt, Homo sapiens
ugcccccgcggguucuagac

SEQ ID NO: 607662 - RNA, 13 nt, Homo sapiens
ugcccccuccagu

SEQ ID NO: 607663 - RNA, 21 nt, Homo sapiens
ugcccccucuggugucuuuga

SEQ ID NO: 607664 - RNA, 13 nt, Homo sapiens
ugcccccuuucag

SEQ ID NO: 607665 - RNA, 18 nt, Homo sapiens
ugccccgcuauuccucac

SEQ ID NO: 607666 - RNA, 16 nt, Homo sapiens
ugccccggaccuaccu

SEQ ID NO: 607667 - RNA, 15 nt, Homo sapiens
ugccccucucucagu

SEQ ID NO: 607668 - RNA, 17 nt, Homo sapiens
ugccccuggaccaguac

SEQ ID NO: 607669 - RNA, 19 nt, Homo sapiens
ugccccuggaccugggaac

SEQ ID NO: 607670 - RNA, 22 nt, Homo sapiens
ugcccggggcagcugccagaga

SEQ ID NO: 607671 - RNA, 13 nt, Homo sapiens
ugcccuaaacccu

SEQ ID NO: 607672 - RNA, 13 nt, Homo sapiens
ugcccuaagugau

SEQ ID NO: 607673 - RNA, 14 nt, Homo sapiens
ugcccuagaucaac

SEQ ID NO: 607674 - RNA, 16 nt, Homo sapiens
ugcccuagcccagacu

SEQ ID NO: 607675 - RNA, 21 nt, Homo sapiens
ugcccuagcgcucucuuccag

SEQ ID NO: 607676 - RNA, 21 nt, Homo sapiens
ugcccucauaaaccaaugugg

SEQ ID NO: 607677 - RNA, 18 nt, Homo sapiens
ugcccuccaucucagcca

SEQ ID NO: 607678 - RNA, 21 nt, Homo sapiens
ugcccuccccagagcacuggg

SEQ ID NO: 607679 - RNA, 15 nt, Homo sapiens
ugcccucuagagccu

SEQ ID NO: 607680 - RNA, 11 nt, Homo sapiens
ugcccucucag

SEQ ID NO: 607681 - RNA, 17 nt, Homo sapiens
ugcccucucccaaaaaa

SEQ ID NO: 607682 - RNA, 15 nt, Homo sapiens
ugcccucugcucugc

SEQ ID NO: 607683 - RNA, 20 nt, Homo sapiens
ugcccucuuguggugcauug

SEQ ID NO: 607684 - RNA, 17 nt, Homo sapiens
ugcccugaacccacugc

SEQ ID NO: 607685 - RNA, 23 nt, Homo sapiens
ugcccugaguggaucuccaagga

SEQ ID NO: 607686 - RNA, 13 nt, Homo sapiens
ugcccugccucag

SEQ ID NO: 607687 - RNA, 23 nt, Homo sapiens
ugcccugcgaaguggcucucagg

SEQ ID NO: 607688 - RNA, 17 nt, Homo sapiens
ugcccuggauccaucag

SEQ ID NO: 607689 - RNA, 17 nt, Homo sapiens
ugcccuguaaccugacu

SEQ ID NO: 607690 - RNA, 19 nt, Homo sapiens
ugcccugugccgcacucug

SEQ ID NO: 607691 - RNA, 18 nt, Homo sapiens
ugcccuguguacauauaa

SEQ ID NO: 607692 - RNA, 23 nt, Homo sapiens
ugcccuguuguguauagaugcaa

SEQ ID NO: 607693 - RNA, 15 nt, Homo sapiens
ugcccuucacuguca

SEQ ID NO: 607694 - RNA, 19 nt, Homo sapiens
ugcccuuccccucccgaca

SEQ ID NO: 607695 - RNA, 20 nt, Homo sapiens
ugcccuuuggaaagccauug

SEQ ID NO: 607696 - RNA, 13 nt, Homo sapiens
ugcccuuuuccag

SEQ ID NO: 607697 - RNA, 22 nt, Homo sapiens
ugccgaaccaaaagaauuugca

SEQ ID NO: 607698 - RNA, 14 nt, Homo sapiens
ugccgccuacugga

SEQ ID NO: 607699 - RNA, 13 nt, Homo sapiens
ugccgcuaccucc

SEQ ID NO: 607700 - RNA, 14 nt, Homo sapiens
ugccggaucugggc

SEQ ID NO: 607701 - RNA, 15 nt, Homo sapiens
ugccggaugugcuuu

SEQ ID NO: 607702 - RNA, 19 nt, Homo sapiens
ugccggccggggcugagac

SEQ ID NO: 607703 - RNA, 19 nt, Homo sapiens
ugccggcucuuuccuugcu

SEQ ID NO: 607704 - RNA, 16 nt, Homo sapiens
ugccguccucaggugg

SEQ ID NO: 607705 - RNA, 20 nt, Homo sapiens
ugccgugugagugugacagg

SEQ ID NO: 607706 - RNA, 17 nt, Homo sapiens
ugccuaaaauuguauga

SEQ ID NO: 607707 - RNA, 20 nt, Homo sapiens
ugccuaaauuuaaugcugcc

SEQ ID NO: 607708 - RNA, 13 nt, Homo sapiens
uacucugccagag

SEQ ID NO: 607709 - RNA, 21 nt, Homo sapiens
uacucuguccauuuauccaca

SEQ ID NO: 607710 - RNA, 18 nt, Homo sapiens
uacucuugaaauguagaa

SEQ ID NO: 607711 - RNA, 16 nt, Homo sapiens
uacucuugaauacaag

SEQ ID NO: 607712 - RNA, 16 nt, Homo sapiens
uacucuugaugugaag

SEQ ID NO: 607713 - RNA, 17 nt, Homo sapiens
uacucuugucauuuuua

SEQ ID NO: 607714 - RNA, 15 nt, Homo sapiens
uacucuuuguagcaa

SEQ ID NO: 607715 - RNA, 14 nt, Homo sapiens
uacugaaaauccaa

SEQ ID NO: 607716 - RNA, 17 nt, Homo sapiens
uacugaaccacucuccc

SEQ ID NO: 607717 - RNA, 18 nt, Homo sapiens
uacugaaggaaaaacaca

SEQ ID NO: 607718 - RNA, 16 nt, Homo sapiens
uacugaaugucauuga

SEQ ID NO: 607719 - RNA, 18 nt, Homo sapiens
uacugacacuuccugucc

SEQ ID NO: 607720 - RNA, 19 nt, Homo sapiens
uacugaugaaaucugcuag

SEQ ID NO: 607721 - RNA, 14 nt, Homo sapiens
uacugauucacugc

SEQ ID NO: 607722 - RNA, 21 nt, Homo sapiens
uacugcaaagucgccagucac

SEQ ID NO: 607723 - RNA, 23 nt, Homo sapiens
uacugcaaaugcuauauugcacu

SEQ ID NO: 607724 - RNA, 22 nt, Homo sapiens
uacugcacccagcagugucacu

SEQ ID NO: 607725 - RNA, 17 nt, Homo sapiens
uacugcacguaacacuc

SEQ ID NO: 607726 - RNA, 13 nt, Homo sapiens
uacugcacugagu

SEQ ID NO: 607727 - RNA, 17 nt, Homo sapiens
uacugccaaccuggaau

SEQ ID NO: 607728 - RNA, 17 nt, Homo sapiens
uacugccaucuuuauca

SEQ ID NO: 607729 - RNA, 13 nt, Homo sapiens
uacugccauguac

SEQ ID NO: 607730 - RNA, 16 nt, Homo sapiens
uacugcccaggccuau

SEQ ID NO: 607731 - RNA, 22 nt, Homo sapiens
uacugcucaucauuccuugaga

SEQ ID NO: 607732 - RNA, 19 nt, Homo sapiens
uacugcugagucagacugu

SEQ ID NO: 607733 - RNA, 16 nt, Homo sapiens
uacugcuugcuuucca

SEQ ID NO: 607734 - RNA, 15 nt, Homo sapiens
uacugcuuuucauua

SEQ ID NO: 607735 - RNA, 23 nt, Homo sapiens
uacuggaaaaaaauacaaaaagc

SEQ ID NO: 607736 - RNA, 16 nt, Homo sapiens
uacuggaaauguagca

SEQ ID NO: 607737 - RNA, 22 nt, Homo sapiens
uacuggaagcugcagaucuuug

SEQ ID NO: 607738 - RNA, 23 nt, Homo sapiens
uacuggaaugguguuuugucaga

SEQ ID NO: 607739 - RNA, 21 nt, Homo sapiens
uacuggacacacuaaacucug

SEQ ID NO: 607740 - RNA, 14 nt, Homo sapiens
uacuggacucagga

SEQ ID NO: 607741 - RNA, 17 nt, Homo sapiens
uacuggccgagcugcug

SEQ ID NO: 607742 - RNA, 21 nt, Homo sapiens
uacugggacugugcucagaga

SEQ ID NO: 607743 - RNA, 21 nt, Homo sapiens
uacugggguuuuucuaagaaa

SEQ ID NO: 607744 - RNA, 23 nt, Homo sapiens
uacugggugucauuucauuccau

SEQ ID NO: 607745 - RNA, 18 nt, Homo sapiens
uacuggucuuguggaauu

SEQ ID NO: 607746 - RNA, 22 nt, Homo sapiens
uacuguacccucgcaugacugu

SEQ ID NO: 607747 - RNA, 11 nt, Homo sapiens
uacuguacuuu

SEQ ID NO: 607748 - RNA, 19 nt, Homo sapiens
uacuguaggaacaagcaug

SEQ ID NO: 607749 - RNA, 15 nt, Homo sapiens
uacuguauauauaau

SEQ ID NO: 607750 - RNA, 14 nt, Homo sapiens
uacuguaugccuuc

SEQ ID NO: 607751 - RNA, 14 nt, Homo sapiens
uacuguauguaaua

SEQ ID NO: 607752 - RNA, 19 nt, Homo sapiens
uacugucaaacaauaaagg

SEQ ID NO: 607753 - RNA, 23 nt, Homo sapiens
uacugucaaacaauaaagggaga

SEQ ID NO: 607754 - RNA, 22 nt, Homo sapiens
uacugucugggauuaagggcaa

SEQ ID NO: 607755 - RNA, 23 nt, Homo sapiens
uacugucuuagaagaaauuaaua

SEQ ID NO: 607756 - RNA, 19 nt, Homo sapiens
uacugugaaacuggcacug

SEQ ID NO: 607757 - RNA, 12 nt, Homo sapiens
uacugugcaguu

SEQ ID NO: 607758 - RNA, 15 nt, Homo sapiens
uacuguggugaucug

SEQ ID NO: 607759 - RNA, 20 nt, Homo sapiens
uacuguugguuaaaugacaa

SEQ ID NO: 607760 - RNA, 17 nt, Homo sapiens
uacuguuucuugcacug

SEQ ID NO: 607761 - RNA, 18 nt, Homo sapiens
uacuguuucuugcacuga

SEQ ID NO: 607762 - RNA, 20 nt, Homo sapiens
uacuguuugauauaccaaau

SEQ ID NO: 607763 - RNA, 15 nt, Homo sapiens
uacuguuuuaauugu

SEQ ID NO: 607764 - RNA, 19 nt, Homo sapiens
uacuuaaaaauagucuucc

SEQ ID NO: 607765 - RNA, 15 nt, Homo sapiens
uacuuaaacuuccac

SEQ ID NO: 607766 - RNA, 14 nt, Homo sapiens
uacuuaacauuuca

SEQ ID NO: 607767 - RNA, 19 nt, Homo sapiens
uacuuaagagugcugugua

SEQ ID NO: 607768 - RNA, 23 nt, Homo sapiens
uacuuaagcaaaagucagucuua

SEQ ID NO: 607769 - RNA, 22 nt, Homo sapiens
uacuuaaguugucgaacaguag

SEQ ID NO: 607770 - RNA, 13 nt, Homo sapiens
uacuuaaucucac

SEQ ID NO: 607771 - RNA, 19 nt, Homo sapiens
uacuuaauuccuuucucau

SEQ ID NO: 607772 - RNA, 15 nt, Homo sapiens
uacuuacauuuccau

SEQ ID NO: 607773 - RNA, 14 nt, Homo sapiens
uacuuacuccccac

SEQ ID NO: 607774 - RNA, 19 nt, Homo sapiens
uacuuacuccccacugaug

SEQ ID NO: 607775 - RNA, 14 nt, Homo sapiens
uacuuagauacuaa

SEQ ID NO: 607776 - RNA, 18 nt, Homo sapiens
uacuuagguuauuuugcu

SEQ ID NO: 607777 - RNA, 22 nt, Homo sapiens
uacuuagugguaugucucuuua

SEQ ID NO: 607778 - RNA, 15 nt, Homo sapiens
uacuuaucuuaugcc

SEQ ID NO: 607779 - RNA, 17 nt, Homo sapiens
uacuucaaaagccauaa

SEQ ID NO: 607780 - RNA, 22 nt, Homo sapiens
uacuucaacacuucauguauug

SEQ ID NO: 607781 - RNA, 13 nt, Homo sapiens
uacuucaguauua

SEQ ID NO: 607782 - RNA, 22 nt, Homo sapiens
uacuucagugcaccuacugcuu

SEQ ID NO: 607783 - RNA, 17 nt, Homo sapiens
uacuucauggacuucca

SEQ ID NO: 607784 - RNA, 22 nt, Homo sapiens
uacuucauuuucucaaagggca

SEQ ID NO: 607785 - RNA, 23 nt, Homo sapiens
uacuucucacuaauuuguaggaa

SEQ ID NO: 607786 - RNA, 20 nt, Homo sapiens
uacuucugcauguucauugc

SEQ ID NO: 607787 - RNA, 21 nt, Homo sapiens
uacuugaaacagucacuauca

SEQ ID NO: 607788 - RNA, 14 nt, Homo sapiens
uacuugaaauacca

SEQ ID NO: 607789 - RNA, 23 nt, Homo sapiens
uacuugaaggauggaugagucag

SEQ ID NO: 607790 - RNA, 20 nt, Homo sapiens
uacuugaccucugugaccaa

SEQ ID NO: 607791 - RNA, 20 nt, Homo sapiens
uacuugagaggcugaggcaa

SEQ ID NO: 607792 - RNA, 23 nt, Homo sapiens
uacuugagugguguguguuauca

SEQ ID NO: 607793 - RNA, 15 nt, Homo sapiens
uacuugcacucuuua

SEQ ID NO: 607794 - RNA, 17 nt, Homo sapiens
uacuugcaguugugaua

SEQ ID NO: 607795 - RNA, 20 nt, Homo sapiens
uacuugcauacaccacugca

SEQ ID NO: 607796 - RNA, 23 nt, Homo sapiens
uacuugcuuuaccuuuucagggc

SEQ ID NO: 607797 - RNA, 12 nt, Homo sapiens
uacuugucauau

SEQ ID NO: 607798 - RNA, 12 nt, Homo sapiens
uacuugugcacu

SEQ ID NO: 607799 - RNA, 21 nt, Homo sapiens
uacuuguuugguuugguauua

SEQ ID NO: 607800 - RNA, 17 nt, Homo sapiens
uacuuuaaaguagugau

SEQ ID NO: 607801 - RNA, 12 nt, Homo sapiens
uacuuuaccucc

SEQ ID NO: 607802 - RNA, 15 nt, Homo sapiens
uacuuuaccuccuau

SEQ ID NO: 607803 - RNA, 16 nt, Homo sapiens
uacuuuaugaugcuau

SEQ ID NO: 607804 - RNA, 22 nt, Homo sapiens
uacuuucuguguugaagcacug

SEQ ID NO: 607805 - RNA, 18 nt, Homo sapiens
uacuuugaaaacaauuca

SEQ ID NO: 607806 - RNA, 21 nt, Homo sapiens
uacuuugaagucauaccaaug

SEQ ID NO: 607807 - RNA, 14 nt, Homo sapiens
uacuuugacagugu

SEQ ID NO: 607808 - RNA, 17 nt, Homo sapiens
uacuuugacuuuuugca

SEQ ID NO: 607809 - RNA, 16 nt, Homo sapiens
uacuuugauaucugau

SEQ ID NO: 607810 - RNA, 17 nt, Homo sapiens
uacuuugguagcuggga

SEQ ID NO: 607811 - RNA, 17 nt, Homo sapiens
uacuuuguaucaaucca

SEQ ID NO: 607812 - RNA, 17 nt, Homo sapiens
uacuuuguccuaagaga

SEQ ID NO: 607813 - RNA, 15 nt, Homo sapiens
uacuuuguuaggauu

SEQ ID NO: 607814 - RNA, 18 nt, Homo sapiens
uacuuuuaugcaaccaua

SEQ ID NO: 607815 - RNA, 18 nt, Homo sapiens
uacuuuucuuacucugaa

SEQ ID NO: 607816 - RNA, 19 nt, Homo sapiens
uacuuuugacccaugugca

SEQ ID NO: 607817 - RNA, 13 nt, Homo sapiens
uacuuuugcuuca

SEQ ID NO: 607818 - RNA, 22 nt, Homo sapiens
uacuuuuucugguguguuaaca

SEQ ID NO: 607819 - RNA, 19 nt, Homo sapiens
uagaaaaaaacaugaauuu

SEQ ID NO: 607820 - RNA, 18 nt, Homo sapiens
uagaaaaacaucccaaga

SEQ ID NO: 607821 - RNA, 21 nt, Homo sapiens
uagaaaaggcagcuaaaggaa

SEQ ID NO: 607822 - RNA, 16 nt, Homo sapiens
uagaaaagggaacuga

SEQ ID NO: 607823 - RNA, 18 nt, Homo sapiens
uagaaaaguauguucuaa

SEQ ID NO: 607824 - RNA, 17 nt, Homo sapiens
uagaaaauaaccuuuua

SEQ ID NO: 607825 - RNA, 14 nt, Homo sapiens
uagaaaaugcaguc

SEQ ID NO: 607826 - RNA, 13 nt, Homo sapiens
uagaaaaugugac

SEQ ID NO: 607827 - RNA, 19 nt, Homo sapiens
uagaaaauuagacugugau

SEQ ID NO: 607828 - RNA, 21 nt, Homo sapiens
uagagguguaacacuugucaa

SEQ ID NO: 607829 - RNA, 16 nt, Homo sapiens
uagagguuauuucugc

SEQ ID NO: 607830 - RNA, 21 nt, Homo sapiens
uagagguuuuaaagugauuaa

SEQ ID NO: 607831 - RNA, 15 nt, Homo sapiens
uagaguaacaguaaa

SEQ ID NO: 607832 - RNA, 20 nt, Homo sapiens
uagagucggccaccacagau

SEQ ID NO: 607833 - RNA, 21 nt, Homo sapiens
uagagucuuaaagcauuucag

SEQ ID NO: 607834 - RNA, 18 nt, Homo sapiens
uagaguguagacuguggc

SEQ ID NO: 607835 - RNA, 15 nt, Homo sapiens
uagcucucccaguga

SEQ ID NO: 607836 - RNA, 17 nt, Homo sapiens
uagcucuggaccagccu

SEQ ID NO: 607837 - RNA, 21 nt, Homo sapiens
uagcucugguauauaauccau

SEQ ID NO: 607838 - RNA, 12 nt, Homo sapiens
uagcucuuucag

SEQ ID NO: 607839 - RNA, 18 nt, Homo sapiens
uagcucuuugggccucuc

SEQ ID NO: 607840 - RNA, 13 nt, Homo sapiens
uagcugacuugca

SEQ ID NO: 607841 - RNA, 14 nt, Homo sapiens
uagcugacuugcac

SEQ ID NO: 607842 - RNA, 23 nt, Homo sapiens
uauuaauaugaguuacugaaggu

SEQ ID NO: 607843 - RNA, 13 nt, Homo sapiens
ucacaucucugcc

SEQ ID NO: 607844 - RNA, 13 nt, Homo sapiens
ucacaucugucac

SEQ ID NO: 607845 - RNA, 14 nt, Homo sapiens
ucacaucugucacg

SEQ ID NO: 607846 - RNA, 19 nt, Homo sapiens
ucacaugaauuauuacagu

SEQ ID NO: 607847 - RNA, 15 nt, Homo sapiens
ucacaugaugcauac

SEQ ID NO: 607848 - RNA, 16 nt, Homo sapiens
ucacaugugcugcaaa

SEQ ID NO: 607849 - RNA, 18 nt, Homo sapiens
ucacauuccucugcccuu

SEQ ID NO: 607850 - RNA, 17 nt, Homo sapiens
ucacauuggagucacug

SEQ ID NO: 607851 - RNA, 19 nt, Homo sapiens
ucacauuguuugcugcuau

SEQ ID NO: 607852 - RNA, 23 nt, Homo sapiens
ucacauuuuaagugcuucacauu

SEQ ID NO: 607853 - RNA, 17 nt, Homo sapiens
ucaccaaaauagucuuc

SEQ ID NO: 607854 - RNA, 19 nt, Homo sapiens
ucaccaaaucagcugcuac

SEQ ID NO: 607855 - RNA, 23 nt, Homo sapiens
ucaccaacacaguugggacccaa

SEQ ID NO: 607856 - RNA, 21 nt, Homo sapiens
ucaccaagcaggaaagggagg

SEQ ID NO: 607857 - RNA, 23 nt, Homo sapiens
ucaccaaggcagugcaugcaugu

SEQ ID NO: 607858 - RNA, 21 nt, Homo sapiens
ucaccaaucauaguguaccca

SEQ ID NO: 607859 - RNA, 18 nt, Homo sapiens
ucaccaaugagccuuagu

SEQ ID NO: 607860 - RNA, 18 nt, Homo sapiens
ucaccaccaccccuacca

SEQ ID NO: 607861 - RNA, 20 nt, Homo sapiens
ucaccacccugcucauccac

SEQ ID NO: 607862 - RNA, 23 nt, Homo sapiens
ucaccacugaaacccugcacuua

SEQ ID NO: 607863 - RNA, 16 nt, Homo sapiens
ucaccagaaccaguua

SEQ ID NO: 607864 - RNA, 14 nt, Homo sapiens
ucaccagagcauuu

SEQ ID NO: 607865 - RNA, 15 nt, Homo sapiens
ucaccagauuugcua

SEQ ID NO: 607866 - RNA, 18 nt, Homo sapiens
ucaccagccccacugcca

SEQ ID NO: 607867 - RNA, 16 nt, Homo sapiens
ucaccagcccuagcug

SEQ ID NO: 607868 - RNA, 21 nt, Homo sapiens
ucaccaggagcccggcuucca

SEQ ID NO: 607869 - RNA, 12 nt, Homo sapiens
ucaccagugucc

SEQ ID NO: 607870 - RNA, 15 nt, Homo sapiens
ucaccaugacuuccu

SEQ ID NO: 607871 - RNA, 23 nt, Homo sapiens
ucaccaugaugugaagaguuuca

SEQ ID NO: 607872 - RNA, 22 nt, Homo sapiens
ucaccauggcccccucaucaua

SEQ ID NO: 607873 - RNA, 18 nt, Homo sapiens
ucaccauguuagccuuag

SEQ ID NO: 607874 - RNA, 16 nt, Homo sapiens
ucaccauguuggucag

SEQ ID NO: 607875 - RNA, 17 nt, Homo sapiens
ucaccauuggacagucu

SEQ ID NO: 607876 - RNA, 22 nt, Homo sapiens
ucaccauuucuuggcauuggaa

SEQ ID NO: 607877 - RNA, 23 nt, Homo sapiens
ucaccauuucuuggcauuggaau

SEQ ID NO: 607878 - RNA, 19 nt, Homo sapiens
ucacccaaaagaauuauca

SEQ ID NO: 607879 - RNA, 23 nt, Homo sapiens
ucacccaaugcaucacguacccc

SEQ ID NO: 607880 - RNA, 22 nt, Homo sapiens
ucacccacaucuaaugucucuu

SEQ ID NO: 607881 - RNA, 22 nt, Homo sapiens
ucacccaccccugcacaguuga

SEQ ID NO: 607882 - RNA, 19 nt, Homo sapiens
ucacccaucaaaagcacca

SEQ ID NO: 607883 - RNA, 13 nt, Homo sapiens
ucacccauggaac

SEQ ID NO: 607884 - RNA, 17 nt, Homo sapiens
ucacccgacccgugcac

SEQ ID NO: 607885 - RNA, 18 nt, Homo sapiens
ucacccuaccaacuuuac

SEQ ID NO: 607886 - RNA, 15 nt, Homo sapiens
ucacccuauauauaa

SEQ ID NO: 607887 - RNA, 20 nt, Homo sapiens
ucacccugccuuaucuugca

SEQ ID NO: 607888 - RNA, 15 nt, Homo sapiens
ucacccuuaacccaa

SEQ ID NO: 607889 - RNA, 15 nt, Homo sapiens
ucacccuucugggca

SEQ ID NO: 607890 - RNA, 14 nt, Homo sapiens
ucaccggagcuuuc

SEQ ID NO: 607891 - RNA, 17 nt, Homo sapiens
ucaccguccucacccau

SEQ ID NO: 607892 - RNA, 13 nt, Homo sapiens
ucaccguggaccu

SEQ ID NO: 607893 - RNA, 18 nt, Homo sapiens
ucaccuaagucucuguga

SEQ ID NO: 607894 - RNA, 19 nt, Homo sapiens
ucaccuaagucucugugaa

SEQ ID NO: 607895 - RNA, 19 nt, Homo sapiens
ucaccuagaacgugcaucc

SEQ ID NO: 607896 - RNA, 16 nt, Homo sapiens
ucaccuagcaacauau

SEQ ID NO: 607897 - RNA, 21 nt, Homo sapiens
ucaccucaaccuccgccuccc

SEQ ID NO: 607898 - RNA, 14 nt, Homo sapiens
ucaccucacugaaa

SEQ ID NO: 607899 - RNA, 12 nt, Homo sapiens
ucaccucaggcc

SEQ ID NO: 607900 - RNA, 15 nt, Homo sapiens
ucaccuccucuguga

SEQ ID NO: 607901 - RNA, 15 nt, Homo sapiens
ucaccucugccucaa

SEQ ID NO: 607902 - RNA, 15 nt, Homo sapiens
ucaccucuuccacuc

SEQ ID NO: 607903 - RNA, 16 nt, Homo sapiens
ucaccucuugccuucu

SEQ ID NO: 607904 - RNA, 19 nt, Homo sapiens
ucaccucuuuguucuuccu

SEQ ID NO: 607905 - RNA, 18 nt, Homo sapiens
ucaccugagaagauuuua

SEQ ID NO: 607906 - RNA, 18 nt, Homo sapiens
ucaccuguaaaacuuuau

SEQ ID NO: 607907 - RNA, 17 nt, Homo sapiens
ucaccuguuacuugaaa

SEQ ID NO: 607908 - RNA, 15 nt, Homo sapiens
ucaccuguuauguau

SEQ ID NO: 607909 - RNA, 16 nt, Homo sapiens
ucaccuguuggcuaca

SEQ ID NO: 607910 - RNA, 16 nt, Homo sapiens
ucaccuuccaugucag

SEQ ID NO: 607911 - RNA, 14 nt, Homo sapiens
ucaccuucugggca

SEQ ID NO: 607912 - RNA, 13 nt, Homo sapiens
ucaccuugcacuc

SEQ ID NO: 607913 - RNA, 17 nt, Homo sapiens
ucaccuugguguuucuc

SEQ ID NO: 607914 - RNA, 19 nt, Homo sapiens
ucaccuuuccucucccuca

SEQ ID NO: 607915 - RNA, 21 nt, Homo sapiens
ucaccuuuugaccauaacugu

SEQ ID NO: 607916 - RNA, 13 nt, Homo sapiens
ucacgacucuucc

SEQ ID NO: 607917 - RNA, 15 nt, Homo sapiens
ucacgcaggagccau

SEQ ID NO: 607918 - RNA, 14 nt, Homo sapiens
ucacgccacugcac

SEQ ID NO: 607919 - RNA, 16 nt, Homo sapiens
ucacgcccccaggaau

SEQ ID NO: 607920 - RNA, 20 nt, Homo sapiens
ucacggcugcgcacuguguc

SEQ ID NO: 607921 - RNA, 22 nt, Homo sapiens
ucacuaaaaauuuuuacaaaac

SEQ ID NO: 607922 - RNA, 20 nt, Homo sapiens
ucacuaaaacacacaggugc

SEQ ID NO: 607923 - RNA, 15 nt, Homo sapiens
ucacuaaacuuuauu

SEQ ID NO: 607924 - RNA, 14 nt, Homo sapiens
ucacuaaggacuua

SEQ ID NO: 607925 - RNA, 17 nt, Homo sapiens
ucacuaauacuaauuca

SEQ ID NO: 607926 - RNA, 14 nt, Homo sapiens
ucacuaaugcucaa

SEQ ID NO: 607927 - RNA, 20 nt, Homo sapiens
ucacuacagggagaaaaucc

SEQ ID NO: 607928 - RNA, 10 nt, Homo sapiens
ucacuacuga

SEQ ID NO: 607929 - RNA, 20 nt, Homo sapiens
ucacuagaagaaaagcccau

SEQ ID NO: 607930 - RNA, 19 nt, Homo sapiens
ucacuagaguucuuugaac

SEQ ID NO: 607931 - RNA, 15 nt, Homo sapiens
ucacuaggaggucau

SEQ ID NO: 607932 - RNA, 18 nt, Homo sapiens
ucacuaggaggucaucaa

SEQ ID NO: 607933 - RNA, 19 nt, Homo sapiens
ucacuaggaugcagaugga

SEQ ID NO: 607934 - RNA, 14 nt, Homo sapiens
ucacucaaccuuau

SEQ ID NO: 607935 - RNA, 14 nt, Homo sapiens
ucacucaccaucug

SEQ ID NO: 607936 - RNA, 17 nt, Homo sapiens
ucacucaccaucuggaa

SEQ ID NO: 607937 - RNA, 17 nt, Homo sapiens
ucacucacucacuccaa

SEQ ID NO: 607938 - RNA, 15 nt, Homo sapiens
ucacucacucauucc

SEQ ID NO: 607939 - RNA, 13 nt, Homo sapiens
ucacucagaggaa

SEQ ID NO: 607940 - RNA, 16 nt, Homo sapiens
ucacucaggacagccc

SEQ ID NO: 607941 - RNA, 21 nt, Homo sapiens
ucacucaugcaaacugcuuua

SEQ ID NO: 607942 - RNA, 13 nt, Homo sapiens
ucacucauugaca

SEQ ID NO: 607943 - RNA, 16 nt, Homo sapiens
ucacuccucugucaua

SEQ ID NO: 607944 - RNA, 17 nt, Homo sapiens
ucacuccucugucauau

SEQ ID NO: 607945 - RNA, 22 nt, Homo sapiens
ucacucugggcggcuccccaua

SEQ ID NO: 607946 - RNA, 23 nt, Homo sapiens
ucacucuguaguuacugugguca

SEQ ID NO: 607947 - RNA, 12 nt, Homo sapiens
ucacucuguugc

SEQ ID NO: 607948 - RNA, 14 nt, Homo sapiens
ucacucuguugccu

SEQ ID NO: 607949 - RNA, 15 nt, Homo sapiens
ucacucuucuguaaa

SEQ ID NO: 607950 - RNA, 22 nt, Homo sapiens
ucacugacucaagacacugaga

SEQ ID NO: 607951 - RNA, 18 nt, Homo sapiens
ucacugagaagauuguga

SEQ ID NO: 607952 - RNA, 12 nt, Homo sapiens
ucacugagcucc

SEQ ID NO: 607953 - RNA, 13 nt, Homo sapiens
ucacugcauuugg

SEQ ID NO: 607954 - RNA, 16 nt, Homo sapiens
ucacugcccaccaaag

SEQ ID NO: 607955 - RNA, 13 nt, Homo sapiens
ucacugccccacu

SEQ ID NO: 607956 - RNA, 14 nt, Homo sapiens
ucacugccuuggcc

SEQ ID NO: 607957 - RNA, 20 nt, Homo sapiens
ucacugcucccccgugugua

SEQ ID NO: 607958 - RNA, 12 nt, Homo sapiens
ucacugcugcuc

SEQ ID NO: 607959 - RNA, 18 nt, Homo sapiens
ucacugcuugaugaagca

SEQ ID NO: 607960 - RNA, 19 nt, Homo sapiens
ucagcaaaagaugcuucuc

SEQ ID NO: 607961 - RNA, 18 nt, Homo sapiens
ucagcaacaagacugcca

SEQ ID NO: 607962 - RNA, 15 nt, Homo sapiens
ucagcaagacauaaa

SEQ ID NO: 607963 - RNA, 22 nt, Homo sapiens
ucagcaauacauagaacugaaa

SEQ ID NO: 607964 - RNA, 20 nt, Homo sapiens
ucagcacaggccauggugca

SEQ ID NO: 607965 - RNA, 19 nt, Homo sapiens
ucagcacugucccuugccu

SEQ ID NO: 607966 - RNA, 21 nt, Homo sapiens
ucagcacugucccuugccuca

SEQ ID NO: 607967 - RNA, 14 nt, Homo sapiens
ucagcacuguuaca

SEQ ID NO: 607968 - RNA, 14 nt, Homo sapiens
ucagcacuguuuca

SEQ ID NO: 607969 - RNA, 18 nt, Homo sapiens
ucagcagaugccagugaa

SEQ ID NO: 607970 - RNA, 15 nt, Homo sapiens
ucagcagcccuccuc

SEQ ID NO: 607971 - RNA, 17 nt, Homo sapiens
ucagcaggaaugcucug

SEQ ID NO: 607972 - RNA, 19 nt, Homo sapiens
ucagcaguccacaaagcau

SEQ ID NO: 607973 - RNA, 22 nt, Homo sapiens
ucagcagucuaguucuuuucau

SEQ ID NO: 607974 - RNA, 14 nt, Homo sapiens
ucagcagugaugcu

SEQ ID NO: 607975 - RNA, 13 nt, Homo sapiens
ucagcaucuguga

SEQ ID NO: 607976 - RNA, 15 nt, Homo sapiens
ucagcaucugugaug

SEQ ID NO: 607977 - RNA, 21 nt, Homo sapiens
ucagcaugccugaacuacaua

SEQ ID NO: 607978 - RNA, 22 nt, Homo sapiens
ucagcauuagagaaaugaauua

SEQ ID NO: 607979 - RNA, 16 nt, Homo sapiens
ucagcauuggccucug

SEQ ID NO: 607980 - RNA, 21 nt, Homo sapiens
ucagcauugugacuuggagau

SEQ ID NO: 607981 - RNA, 21 nt, Homo sapiens
ucagccaauccgauugccuua

SEQ ID NO: 607982 - RNA, 10 nt, Homo sapiens
ucagccacua

SEQ ID NO: 607983 - RNA, 14 nt, Homo sapiens
ucagccacugugau

SEQ ID NO: 607984 - RNA, 17 nt, Homo sapiens
ucagccaggacagucag

SEQ ID NO: 607985 - RNA, 16 nt, Homo sapiens
ucagccaggcugcuaa

SEQ ID NO: 607986 - RNA, 21 nt, Homo sapiens
ucagccaguggcuagcgcaag

SEQ ID NO: 607987 - RNA, 14 nt, Homo sapiens
ucagccauucacug

SEQ ID NO: 607988 - RNA, 14 nt, Homo sapiens
ucagccauuugcca

SEQ ID NO: 607989 - RNA, 14 nt, Homo sapiens
ucagcccaucucaa

SEQ ID NO: 607990 - RNA, 14 nt, Homo sapiens
ucagccccacagga

SEQ ID NO: 607991 - RNA, 15 nt, Homo sapiens
ucagccccucuugcc

SEQ ID NO: 607992 - RNA, 18 nt, Homo sapiens
ucagccccuucauggaag

SEQ ID NO: 607993 - RNA, 20 nt, Homo sapiens
ucagccccuuuaaaucacca

SEQ ID NO: 607994 - RNA, 17 nt, Homo sapiens
ucagcccguuucagaag

SEQ ID NO: 607995 - RNA, 13 nt, Homo sapiens
ucagcccucagaa

SEQ ID NO: 607996 - RNA, 15 nt, Homo sapiens
ucagcccugccaggu

SEQ ID NO: 607997 - RNA, 14 nt, Homo sapiens
ucagccucccaaag

SEQ ID NO: 607998 - RNA, 13 nt, Homo sapiens
ucagccucccaca

SEQ ID NO: 607999 - RNA, 21 nt, Homo sapiens
ucagccucuucucugcacguu

SEQ ID NO: 608000 - RNA, 14 nt, Homo sapiens
ucagccuugcacac

SEQ ID NO: 608001 - RNA, 21 nt, Homo sapiens
ucagcgugacaauauacuuca

SEQ ID NO: 608002 - RNA, 22 nt, Homo sapiens
ucagcgugacaauauacuucac

SEQ ID NO: 608003 - RNA, 14 nt, Homo sapiens
ucagcuaacauucc

SEQ ID NO: 608004 - RNA, 18 nt, Homo sapiens
ucagcuaacauuccaugu

SEQ ID NO: 608005 - RNA, 19 nt, Homo sapiens
ucagcuccagaauaccuuc

SEQ ID NO: 608006 - RNA, 14 nt, Homo sapiens
ucagcuccuuccac

SEQ ID NO: 608007 - RNA, 17 nt, Homo sapiens
ucagcucucugggaccu

SEQ ID NO: 608008 - RNA, 13 nt, Homo sapiens
ucagcucugggcc

SEQ ID NO: 608009 - RNA, 12 nt, Homo sapiens
ucagcugccuca

SEQ ID NO: 608010 - RNA, 16 nt, Homo sapiens
ucagcugucaccugcu

SEQ ID NO: 608011 - RNA, 23 nt, Homo sapiens
ucagcuucuaaucccagcacuuu

SEQ ID NO: 608012 - RNA, 18 nt, Homo sapiens
ucagcuuucccugccaca

SEQ ID NO: 608013 - RNA, 21 nt, Homo sapiens
ucaggaaacgagacuuuccau

SEQ ID NO: 608014 - RNA, 22 nt, Homo sapiens
ucaggaagaaaucacagaauca

SEQ ID NO: 608015 - RNA, 17 nt, Homo sapiens
ucaggaauacauuugga

SEQ ID NO: 608016 - RNA, 19 nt, Homo sapiens
ucaggacaagggcucagag

SEQ ID NO: 608017 - RNA, 20 nt, Homo sapiens
ucaggaccuuuuggucuuca

SEQ ID NO: 608018 - RNA, 15 nt, Homo sapiens
ucaggacugccauug

SEQ ID NO: 608019 - RNA, 17 nt, Homo sapiens
ucaggagagugugcaac

SEQ ID NO: 608020 - RNA, 23 nt, Homo sapiens
ucaggagcaggggcauugcugau

SEQ ID NO: 608021 - RNA, 22 nt, Homo sapiens
ucaggaggucaucugaccuuca

SEQ ID NO: 608022 - RNA, 21 nt, Homo sapiens
ucaggagucugccacuuguca

SEQ ID NO: 608023 - RNA, 18 nt, Homo sapiens
ucaggaguuccuaaccag

SEQ ID NO: 608024 - RNA, 18 nt, Homo sapiens
ucaggaguucgaaaccag

SEQ ID NO: 608025 - RNA, 18 nt, Homo sapiens
ucaggaguucgagaccag

SEQ ID NO: 608026 - RNA, 16 nt, Homo sapiens
ucaggauacucuguca

SEQ ID NO: 608027 - RNA, 19 nt, Homo sapiens
ucaggaucaagaaaguguu

SEQ ID NO: 608028 - RNA, 16 nt, Homo sapiens
ucaggaugcacauuuc

SEQ ID NO: 608029 - RNA, 14 nt, Homo sapiens
ucaggauguucucc

SEQ ID NO: 608030 - RNA, 19 nt, Homo sapiens
ucaggauugcuaggagcuc

SEQ ID NO: 608031 - RNA, 13 nt, Homo sapiens
ucaggcacacagc

SEQ ID NO: 608032 - RNA, 11 nt, Homo sapiens
ucaggcagcuc

SEQ ID NO: 608033 - RNA, 17 nt, Homo sapiens
ucaggccaacaagccaa

SEQ ID NO: 608034 - RNA, 14 nt, Homo sapiens
ucaggccacauaau

SEQ ID NO: 608035 - RNA, 15 nt, Homo sapiens
ucaggccagccuguc

SEQ ID NO: 608036 - RNA, 20 nt, Homo sapiens
ucaggccagccugucccuga

SEQ ID NO: 608037 - RNA, 18 nt, Homo sapiens
ucaggccaggugcagugg

SEQ ID NO: 608038 - RNA, 17 nt, Homo sapiens
ucaggccuucuuugguu

SEQ ID NO: 608039 - RNA, 22 nt, Homo sapiens
ucaggcgcaguggcucaugccu

SEQ ID NO: 608040 - RNA, 17 nt, Homo sapiens
ucagggaaaaggaguag

SEQ ID NO: 608041 - RNA, 14 nt, Homo sapiens
ucagggacagagcc

SEQ ID NO: 608042 - RNA, 16 nt, Homo sapiens
ucagggagaggucacc

SEQ ID NO: 608043 - RNA, 15 nt, Homo sapiens
ucagggagcauuuau

SEQ ID NO: 608044 - RNA, 21 nt, Homo sapiens
ucagggauuuuucuaccuuca

SEQ ID NO: 608045 - RNA, 18 nt, Homo sapiens
ucagggcagggcucugau

SEQ ID NO: 608046 - RNA, 15 nt, Homo sapiens
ucagggccaugccug

SEQ ID NO: 608047 - RNA, 19 nt, Homo sapiens
ucagggcccaagucccugu

SEQ ID NO: 608048 - RNA, 24 nt, Homo sapiens
ucagggcccaucccuucucugcag

SEQ ID NO: 608049 - RNA, 16 nt, Homo sapiens
ucagggccccugggga

SEQ ID NO: 608050 - RNA, 16 nt, Homo sapiens
ucaggggacacuggcc

SEQ ID NO: 608051 - RNA, 13 nt, Homo sapiens
ucaggggccucuc

SEQ ID NO: 608052 - RNA, 22 nt, Homo sapiens
ucaggggcuuugggcccaagaa

SEQ ID NO: 608053 - RNA, 17 nt, Homo sapiens
ucagggggagucuuugc

SEQ ID NO: 608054 - RNA, 12 nt, Homo sapiens
ucagggggccag

SEQ ID NO: 608055 - RNA, 21 nt, Homo sapiens
ucagggggucuggaaagaagg

SEQ ID NO: 608056 - RNA, 16 nt, Homo sapiens
ucaggguaccuggggc

SEQ ID NO: 608057 - RNA, 13 nt, Homo sapiens
ucaggguccagug

SEQ ID NO: 608058 - RNA, 18 nt, Homo sapiens
ucaggguuggugugcuga

SEQ ID NO: 608059 - RNA, 21 nt, Homo sapiens
ucaggguuuuuagauuaaaca

SEQ ID NO: 608060 - RNA, 16 nt, Homo sapiens
ucagguaacacuacag

SEQ ID NO: 608061 - RNA, 22 nt, Homo sapiens
ucagguagaagguugacacagu

SEQ ID NO: 608062 - RNA, 15 nt, Homo sapiens
ucagguagaccauau

SEQ ID NO: 608063 - RNA, 17 nt, Homo sapiens
ucagguagacuuuuaau

SEQ ID NO: 608064 - RNA, 17 nt, Homo sapiens
ucagguaguacugggaa

SEQ ID NO: 608065 - RNA, 12 nt, Homo sapiens
ucagguauuugu

SEQ ID NO: 608066 - RNA, 12 nt, Homo sapiens
ucaggucacaag

SEQ ID NO: 608067 - RNA, 20 nt, Homo sapiens
ucaggucagcugggagccag

SEQ ID NO: 608068 - RNA, 13 nt, Homo sapiens
ucaggucccacua

SEQ ID NO: 608069 - RNA, 16 nt, Homo sapiens
ucaggugaacacuuag

SEQ ID NO: 608070 - RNA, 22 nt, Homo sapiens
ucaggugagcgcggggcuggga

SEQ ID NO: 608071 - RNA, 14 nt, Homo sapiens
ucagguggaaaaac

SEQ ID NO: 608072 - RNA, 16 nt, Homo sapiens
ucagguguugccaaau

SEQ ID NO: 608073 - RNA, 12 nt, Homo sapiens
ucagguucucau

SEQ ID NO: 608074 - RNA, 20 nt, Homo sapiens
ucagguuguaguaaagaaau

SEQ ID NO: 608075 - RNA, 20 nt, Homo sapiens
uccugggagaaccucaggcu

SEQ ID NO: 608076 - RNA, 21 nt, Homo sapiens
uccugggagcccccaccacaa

SEQ ID NO: 608077 - RNA, 20 nt, Homo sapiens
uccuggggaauucacuucuc

SEQ ID NO: 608078 - RNA, 15 nt, Homo sapiens
uccuggggacuuccu

SEQ ID NO: 608079 - RNA, 14 nt, Homo sapiens
uccugggggaccuu

SEQ ID NO: 608080 - RNA, 14 nt, Homo sapiens
uccuggugugaagg

SEQ ID NO: 608081 - RNA, 23 nt, Homo sapiens
uccuggugugaagguccugcuau

SEQ ID NO: 608082 - RNA, 23 nt, Homo sapiens
uccugguuaaauuugaauuucag

SEQ ID NO: 608083 - RNA, 15 nt, Homo sapiens
uccugguuuccacug

SEQ ID NO: 608084 - RNA, 18 nt, Homo sapiens
uccuguaacuacaaugau

SEQ ID NO: 608085 - RNA, 21 nt, Homo sapiens
uccuguaagugcuuaaucaua

SEQ ID NO: 608086 - RNA, 22 nt, Homo sapiens
uccuguacauugugggauguuc

SEQ ID NO: 608087 - RNA, 14 nt, Homo sapiens
uccuguagcacgcu

SEQ ID NO: 608088 - RNA, 13 nt, Homo sapiens
uccuguauaagca

SEQ ID NO: 608089 - RNA, 14 nt, Homo sapiens
uccuguauucuaca

SEQ ID NO: 608090 - RNA, 18 nt, Homo sapiens
uccuguauucuucaacca

SEQ ID NO: 608091 - RNA, 20 nt, Homo sapiens
uccuguauuuaacaaaaagu

SEQ ID NO: 608092 - RNA, 15 nt, Homo sapiens
uccugucaccaugac

SEQ ID NO: 608093 - RNA, 10 nt, Homo sapiens
uccugucagu

SEQ ID NO: 608094 - RNA, 14 nt, Homo sapiens
uccugucauauaau

SEQ ID NO: 608095 - RNA, 15 nt, Homo sapiens
uccccagagcacugg

SEQ ID NO: 608096 - RNA, 13 nt, Homo sapiens
uccccagccugcu

SEQ ID NO: 608097 - RNA, 18 nt, Homo sapiens
uccccagccugcucccua

SEQ ID NO: 608098 - RNA, 19 nt, Homo sapiens
uccccagcugguggcccug

SEQ ID NO: 608099 - RNA, 17 nt, Homo sapiens
uccccagucccagacaa

SEQ ID NO: 608100 - RNA, 18 nt, Homo sapiens
uccccauccccaccagcu

SEQ ID NO: 608101 - RNA, 15 nt, Homo sapiens
ucccccaaacauguu

SEQ ID NO: 608102 - RNA, 13 nt, Homo sapiens
ucccccaacagau

SEQ ID NO: 608103 - RNA, 22 nt, Homo sapiens
ucccccacagccacuacugacu

SEQ ID NO: 608104 - RNA, 23 nt, Homo sapiens
ucccccaccagcuaaggacauuu

SEQ ID NO: 608105 - RNA, 23 nt, Homo sapiens
ucccccaccgguccagcuggccu

SEQ ID NO: 608106 - RNA, 18 nt, Homo sapiens
ucccccaccuauccccau

SEQ ID NO: 608107 - RNA, 17 nt, Homo sapiens
ucccccagcccugucau

SEQ ID NO: 608108 - RNA, 14 nt, Homo sapiens
uccccccauguugu

SEQ ID NO: 608109 - RNA, 21 nt, Homo sapiens
uccccccugcugcccagugca

SEQ ID NO: 608110 - RNA, 17 nt, Homo sapiens
ucccccgacacugcugc

SEQ ID NO: 608111 - RNA, 19 nt, Homo sapiens
ucccccgcaaagacaucaa

SEQ ID NO: 608112 - RNA, 15 nt, Homo sapiens
ucccccgccacuccu

SEQ ID NO: 608113 - RNA, 16 nt, Homo sapiens
ucccccgccacuccug

SEQ ID NO: 608114 - RNA, 17 nt, Homo sapiens
ucccccuaaaccaacug

SEQ ID NO: 608115 - RNA, 14 nt, Homo sapiens
ucccccuacccaua

SEQ ID NO: 608116 - RNA, 22 nt, Homo sapiens
ucccccuauuuauugacuuuga

SEQ ID NO: 608117 - RNA, 14 nt, Homo sapiens
ucccccucuuucac

SEQ ID NO: 608118 - RNA, 15 nt, Homo sapiens
ucccccugcaacuuc

SEQ ID NO: 608119 - RNA, 16 nt, Homo sapiens
ucccccugcccugugc

SEQ ID NO: 608120 - RNA, 13 nt, Homo sapiens
ucccccugccucc

SEQ ID NO: 608121 - RNA, 17 nt, Homo sapiens
ucccccugcuugucuuc

SEQ ID NO: 608122 - RNA, 22 nt, Homo sapiens
ucccccuguagacuagugccgu

SEQ ID NO: 608123 - RNA, 15 nt, Homo sapiens
ucccccuucacaaag

SEQ ID NO: 608124 - RNA, 18 nt, Homo sapiens
ucccccuuugugcacauu

SEQ ID NO: 608125 - RNA, 13 nt, Homo sapiens
uccccgagaacuu

SEQ ID NO: 608126 - RNA, 20 nt, Homo sapiens
uccccgagggcgaaggccau

SEQ ID NO: 608127 - RNA, 21 nt, Homo sapiens
uccccgugccaaaaaucuuuu

SEQ ID NO: 608128 - RNA, 14 nt, Homo sapiens
uccccuacucccuc

SEQ ID NO: 608129 - RNA, 21 nt, Homo sapiens
uccccucgugugacucucuug

SEQ ID NO: 608130 - RNA, 15 nt, Homo sapiens
uccccucuguuuaca

SEQ ID NO: 608131 - RNA, 20 nt, Homo sapiens
uccccucuguuuacaucucc

SEQ ID NO: 608132 - RNA, 19 nt, Homo sapiens
uccccugaagaauccccca

SEQ ID NO: 608133 - RNA, 23 nt, Homo sapiens
uccccugcccuuccuccugaugg

SEQ ID NO: 608134 - RNA, 22 nt, Homo sapiens
uccccugcugaagguggggauu

SEQ ID NO: 608135 - RNA, 20 nt, Homo sapiens
uccccuggggagucugggca

SEQ ID NO: 608136 - RNA, 21 nt, Homo sapiens
uccccuguagcagucacugac

SEQ ID NO: 608137 - RNA, 12 nt, Homo sapiens
uccccuguguca

SEQ ID NO: 608138 - RNA, 15 nt, Homo sapiens
uccccuuccacugag

SEQ ID NO: 608139 - RNA, 24 nt, Homo sapiens
uccccuuccuggacacacucucau

SEQ ID NO: 608140 - RNA, 17 nt, Homo sapiens
uccccuucuucccgccc

SEQ ID NO: 608141 - RNA, 13 nt, Homo sapiens
uccccuugguucu

SEQ ID NO: 608142 - RNA, 14 nt, Homo sapiens
uccccuuuguccug

SEQ ID NO: 608143 - RNA, 21 nt, Homo sapiens
uccccuuuguguagaaagcca

SEQ ID NO: 608144 - RNA, 17 nt, Homo sapiens
ucccgaagccugagcuc

SEQ ID NO: 608145 - RNA, 14 nt, Homo sapiens
ucccgaauccacag

SEQ ID NO: 608146 - RNA, 21 nt, Homo sapiens
ucccgacagcccaucaccucu

SEQ ID NO: 608147 - RNA, 14 nt, Homo sapiens
ucccgagcuacucu

SEQ ID NO: 608148 - RNA, 19 nt, Homo sapiens
ucccgagcuacucucuugc

SEQ ID NO: 608149 - RNA, 16 nt, Homo sapiens
ucccgaggcuacagca

SEQ ID NO: 608150 - RNA, 20 nt, Homo sapiens
ucccgaguugcugggauuac

SEQ ID NO: 608151 - RNA, 14 nt, Homo sapiens
ucccgcagggcuga

SEQ ID NO: 608152 - RNA, 22 nt, Homo sapiens
ucccgcugcacacagacggccu

SEQ ID NO: 608153 - RNA, 22 nt, Homo sapiens
ucccggcuccccucccagggga

SEQ ID NO: 608154 - RNA, 22 nt, Homo sapiens
ucccgggggccccaccucggca

SEQ ID NO: 608155 - RNA, 23 nt, Homo sapiens
ucccguaccucuucccaugacug

SEQ ID NO: 608156 - RNA, 13 nt, Homo sapiens
ucccuacauguau

SEQ ID NO: 608157 - RNA, 13 nt, Homo sapiens
ucccuacauuccc

SEQ ID NO: 608158 - RNA, 19 nt, Homo sapiens
ucccuaccaaaaauugcca

SEQ ID NO: 608159 - RNA, 21 nt, Homo sapiens
ucccuagauagcuauuaagau

SEQ ID NO: 608160 - RNA, 22 nt, Homo sapiens
ucccuagauagcuauuaagaua

SEQ ID NO: 608161 - RNA, 13 nt, Homo sapiens
ucccuagcccuuc

SEQ ID NO: 608162 - RNA, 16 nt, Homo sapiens
ucccuaggaaacucac

SEQ ID NO: 608163 - RNA, 22 nt, Homo sapiens
ucccuaggaaacucacacuccc

SEQ ID NO: 608164 - RNA, 23 nt, Homo sapiens
ucccuaguguagagcaagccagu

SEQ ID NO: 608165 - RNA, 23 nt, Homo sapiens
ucccucacaccgcgucuggugac

SEQ ID NO: 608166 - RNA, 14 nt, Homo sapiens
ucccucagcucucu

SEQ ID NO: 608167 - RNA, 16 nt, Homo sapiens
ucccuccaaucuugag

SEQ ID NO: 608168 - RNA, 17 nt, Homo sapiens
ucccuccaaucuugaga

SEQ ID NO: 608169 - RNA, 22 nt, Homo sapiens
ucccuccccagaaacagugugc

SEQ ID NO: 608170 - RNA, 19 nt, Homo sapiens
ucccuccgagcuugggaua

SEQ ID NO: 608171 - RNA, 14 nt, Homo sapiens
ucccuccugcuuug

SEQ ID NO: 608172 - RNA, 18 nt, Homo sapiens
ucccucgacauuuucucc

SEQ ID NO: 608173 - RNA, 21 nt, Homo sapiens
ucccucuccacucuucucucc

SEQ ID NO: 608174 - RNA, 22 nt, Homo sapiens
ucccucugauuuccuucugcua

SEQ ID NO: 608175 - RNA, 18 nt, Homo sapiens
ucccucugccuucaggcu

SEQ ID NO: 608176 - RNA, 20 nt, Homo sapiens
ucccucuguuagguccauuu

SEQ ID NO: 608177 - RNA, 16 nt, Homo sapiens
ucccucuuugagggag

SEQ ID NO: 608178 - RNA, 22 nt, Homo sapiens
ucccucuuuggcuccccuguac

SEQ ID NO: 608179 - RNA, 19 nt, Homo sapiens
ucccugaaaacccagagag

SEQ ID NO: 608180 - RNA, 23 nt, Homo sapiens
ucccugaaacaucucaacaaccu

SEQ ID NO: 608181 - RNA, 17 nt, Homo sapiens
ucccugaaaccuaguac

SEQ ID NO: 608182 - RNA, 15 nt, Homo sapiens
ucccugacauuuagu

SEQ ID NO: 608183 - RNA, 23 nt, Homo sapiens
ucccugacucuuagccccagacu

SEQ ID NO: 608184 - RNA, 13 nt, Homo sapiens
ucccugaucccau

SEQ ID NO: 608185 - RNA, 23 nt, Homo sapiens
ucccugcacuaaagccagccuga

SEQ ID NO: 608186 - RNA, 23 nt, Homo sapiens
ucccugcagaugccacccuagcc

SEQ ID NO: 608187 - RNA, 17 nt, Homo sapiens
ucccugcagccaccaga

SEQ ID NO: 608188 - RNA, 12 nt, Homo sapiens
ucccugccacau

SEQ ID NO: 608189 - RNA, 14 nt, Homo sapiens
ucccugccaccagg

SEQ ID NO: 608190 - RNA, 21 nt, Homo sapiens
ucccugccugugacuuucaag

SEQ ID NO: 608191 - RNA, 19 nt, Homo sapiens
ucccugcgccugugaugcu

SEQ ID NO: 608192 - RNA, 18 nt, Homo sapiens
ucccugcgcuucaucuca

SEQ ID NO: 608193 - RNA, 14 nt, Homo sapiens
ucccugcuguguga

SEQ ID NO: 608194 - RNA, 16 nt, Homo sapiens
ucccugcuugcacacu

SEQ ID NO: 608195 - RNA, 17 nt, Homo sapiens
ucccuggaaccuucuag

SEQ ID NO: 608196 - RNA, 21 nt, Homo sapiens
ucccuggcucccaugaccaua

SEQ ID NO: 608197 - RNA, 20 nt, Homo sapiens
ucccugggaagccugugcca

SEQ ID NO: 608198 - RNA, 17 nt, Homo sapiens
ucccugggcagugcucc

SEQ ID NO: 608199 - RNA, 21 nt, Homo sapiens
ugccuucuuauugcuuuuaug

SEQ ID NO: 608200 - RNA, 19 nt, Homo sapiens
ugccuugaguccccagggg

SEQ ID NO: 608201 - RNA, 16 nt, Homo sapiens
ugccuugcacacaggu

SEQ ID NO: 608202 - RNA, 13 nt, Homo sapiens
ugccuugcaccuc

SEQ ID NO: 608203 - RNA, 21 nt, Homo sapiens
ugccuuggaugagaagugucu

SEQ ID NO: 608204 - RNA, 16 nt, Homo sapiens
ugccuuggcuucaggg

SEQ ID NO: 608205 - RNA, 16 nt, Homo sapiens
ugccuuggcuuugcca

SEQ ID NO: 608206 - RNA, 21 nt, Homo sapiens
ugccuuguccaggaacugccu

SEQ ID NO: 608207 - RNA, 16 nt, Homo sapiens
ugccuuuaaaguauga

SEQ ID NO: 608208 - RNA, 15 nt, Homo sapiens
ugccuuuaaauauaa

SEQ ID NO: 608209 - RNA, 18 nt, Homo sapiens
ugccuuuaucucagccau

SEQ ID NO: 608210 - RNA, 15 nt, Homo sapiens
ugccuuugugguggg

SEQ ID NO: 608211 - RNA, 17 nt, Homo sapiens
ugccuuuuccccaggga

SEQ ID NO: 608212 - RNA, 14 nt, Homo sapiens
ugccuuuugggcau

SEQ ID NO: 608213 - RNA, 21 nt, Homo sapiens
ugcgaaugacaguagcauuau

SEQ ID NO: 608214 - RNA, 13 nt, Homo sapiens
ugcgacugaugaa

SEQ ID NO: 608215 - RNA, 15 nt, Homo sapiens
ugcgagagaaaggga

SEQ ID NO: 608216 - RNA, 16 nt, Homo sapiens
ugcgagagaaagggag

SEQ ID NO: 608217 - RNA, 22 nt, Homo sapiens
ugcgagagaaagggagugcaug

SEQ ID NO: 608218 - RNA, 11 nt, Homo sapiens
ugcgagcugcc

SEQ ID NO: 608219 - RNA, 12 nt, Homo sapiens
ugcgcacugugu

SEQ ID NO: 608220 - RNA, 22 nt, Homo sapiens
ugcgcagacccugccacucuca

SEQ ID NO: 608221 - RNA, 22 nt, Homo sapiens
ugcgccaguccugcuaccuccc

SEQ ID NO: 608222 - RNA, 11 nt, Homo sapiens
ugcgcccuuca

SEQ ID NO: 608223 - RNA, 19 nt, Homo sapiens
ugcgccucaccagaaccag

SEQ ID NO: 608224 - RNA, 14 nt, Homo sapiens
ugcgcgucaucucu

SEQ ID NO: 608225 - RNA, 14 nt, Homo sapiens
ugcgcucugccauu

SEQ ID NO: 608226 - RNA, 15 nt, Homo sapiens
ugcgcucugccauuc

SEQ ID NO: 608227 - RNA, 13 nt, Homo sapiens
ugcgcuuaaucca

SEQ ID NO: 608228 - RNA, 17 nt, Homo sapiens
ugcgcuuuauugcccau

SEQ ID NO: 608229 - RNA, 19 nt, Homo sapiens
ugcggaggaaggaggaccc

SEQ ID NO: 608230 - RNA, 16 nt, Homo sapiens
ugcggaucuucauggc

SEQ ID NO: 608231 - RNA, 13 nt, Homo sapiens
ugcggccauucaa

SEQ ID NO: 608232 - RNA, 21 nt, Homo sapiens
ugcggcucuggcccacugagc

SEQ ID NO: 608233 - RNA, 17 nt, Homo sapiens
ugcggugccaugaaggg

SEQ ID NO: 608234 - RNA, 21 nt, Homo sapiens
ugcguagaauugcaggucucu

SEQ ID NO: 608235 - RNA, 14 nt, Homo sapiens
ugcgugcaugugca

SEQ ID NO: 608236 - RNA, 14 nt, Homo sapiens
ugcguggacaguca

SEQ ID NO: 608237 - RNA, 13 nt, Homo sapiens
ugcgugggggcca

SEQ ID NO: 608238 - RNA, 15 nt, Homo sapiens
ugcgugugucaggga

SEQ ID NO: 608239 - RNA, 14 nt, Homo sapiens
ugcgugugugcaag

SEQ ID NO: 608240 - RNA, 14 nt, Homo sapiens
ugcguucacuccaa

SEQ ID NO: 608241 - RNA, 20 nt, Homo sapiens
ugcuaaagggagaaaugcca

SEQ ID NO: 608242 - RNA, 21 nt, Homo sapiens
ugcuaaaugcuacauacucca

SEQ ID NO: 608243 - RNA, 23 nt, Homo sapiens
ugcuaaauggucgcccaggagac

SEQ ID NO: 608244 - RNA, 12 nt, Homo sapiens
ugcuaaccugga

SEQ ID NO: 608245 - RNA, 23 nt, Homo sapiens
ugcuaacugugcuccucacuucc

SEQ ID NO: 608246 - RNA, 23 nt, Homo sapiens
ugcuaauaugaacagaaaugcau

SEQ ID NO: 608247 - RNA, 20 nt, Homo sapiens
ugcuaaugcaauuagcauua

SEQ ID NO: 608248 - RNA, 18 nt, Homo sapiens
ugcuaauguugaucagca

SEQ ID NO: 608249 - RNA, 12 nt, Homo sapiens
ugcuaauguugc

SEQ ID NO: 608250 - RNA, 13 nt, Homo sapiens
ugcuacaguauau

SEQ ID NO: 608251 - RNA, 16 nt, Homo sapiens
ugcuacauauaugcaa

SEQ ID NO: 608252 - RNA, 17 nt, Homo sapiens
ugcuacauauaugcaau

SEQ ID NO: 608253 - RNA, 17 nt, Homo sapiens
ugcuaccaggaugcuaa

SEQ ID NO: 608254 - RNA, 22 nt, Homo sapiens
ugcuacgcuccagcugauccag

SEQ ID NO: 608255 - RNA, 12 nt, Homo sapiens
ugcuacugcacu

SEQ ID NO: 608256 - RNA, 17 nt, Homo sapiens
ugcuacuuaauuccuuu

SEQ ID NO: 608257 - RNA, 12 nt, Homo sapiens
ugcuacuugacc

SEQ ID NO: 608258 - RNA, 15 nt, Homo sapiens
ugcuagaagcuguaa

SEQ ID NO: 608259 - RNA, 20 nt, Homo sapiens
ugcuagacaagcuuguccau

SEQ ID NO: 608260 - RNA, 12 nt, Homo sapiens
ugcuagauuucu

SEQ ID NO: 608261 - RNA, 22 nt, Homo sapiens
ugcuagcaaauggcagaaccaa

SEQ ID NO: 608262 - RNA, 13 nt, Homo sapiens
ugcuagcuguaga

SEQ ID NO: 608263 - RNA, 17 nt, Homo sapiens
ugcuagggaaacuuccc

SEQ ID NO: 608264 - RNA, 19 nt, Homo sapiens
ugcuauaauauauaaugaa

SEQ ID NO: 608265 - RNA, 16 nt, Homo sapiens
ugcuauaguauuugau

SEQ ID NO: 608266 - RNA, 19 nt, Homo sapiens
ugcuauauaaacuuuaaca

SEQ ID NO: 608267 - RNA, 11 nt, Homo sapiens
ugcuauauucc

SEQ ID NO: 608268 - RNA, 18 nt, Homo sapiens
ugcuauauugcacuguga

SEQ ID NO: 608269 - RNA, 16 nt, Homo sapiens
ugcuaucgccaucaca

SEQ ID NO: 608270 - RNA, 12 nt, Homo sapiens
ugcuaucugggc

SEQ ID NO: 608271 - RNA, 13 nt, Homo sapiens
ugcuaugccauuu

SEQ ID NO: 608272 - RNA, 21 nt, Homo sapiens
ugcuaugcuaaaccuccugcc

SEQ ID NO: 608273 - RNA, 13 nt, Homo sapiens
ugcuauguucugg

SEQ ID NO: 608274 - RNA, 15 nt, Homo sapiens
ugcuauucuggcaau

SEQ ID NO: 608275 - RNA, 16 nt, Homo sapiens
ugcuauugacaaguca

SEQ ID NO: 608276 - RNA, 22 nt, Homo sapiens
ugcucaaccccccucccagaca

SEQ ID NO: 608277 - RNA, 21 nt, Homo sapiens
ugcucaaggaagggacaagac

SEQ ID NO: 608278 - RNA, 19 nt, Homo sapiens
ugcucaauaaaguacaaga

SEQ ID NO: 608279 - RNA, 18 nt, Homo sapiens
ugcucaauuaaacauuac

SEQ ID NO: 608280 - RNA, 20 nt, Homo sapiens
ugcucaccuuuaucaccuca

SEQ ID NO: 608281 - RNA, 14 nt, Homo sapiens
ugcucacucccuca

SEQ ID NO: 608282 - RNA, 23 nt, Homo sapiens
ugcucagaaauuuucugaucuca

SEQ ID NO: 608283 - RNA, 20 nt, Homo sapiens
ugcucagagaaggaaaagac

SEQ ID NO: 608284 - RNA, 23 nt, Homo sapiens
ugcucagcuacuucuccugcacu

SEQ ID NO: 608285 - RNA, 11 nt, Homo sapiens
ugcucaggaaa

SEQ ID NO: 608286 - RNA, 21 nt, Homo sapiens
ugcucaggcugcagcuggaca

SEQ ID NO: 608287 - RNA, 16 nt, Homo sapiens
ugcucagggaaaagca

SEQ ID NO: 608288 - RNA, 13 nt, Homo sapiens
ugcucagugcuug

SEQ ID NO: 608289 - RNA, 19 nt, Homo sapiens
ugcucaguuggugcugcuu

SEQ ID NO: 608290 - RNA, 20 nt, Homo sapiens
ugcucaguuggugcugcuuu

SEQ ID NO: 608291 - RNA, 23 nt, Homo sapiens
ugcucaugcccugccaagcagca

SEQ ID NO: 608292 - RNA, 15 nt, Homo sapiens
ugcuccaagacuuua

SEQ ID NO: 608293 - RNA, 18 nt, Homo sapiens
ugcuccagcaacugcccu

SEQ ID NO: 608294 - RNA, 22 nt, Homo sapiens
ugcuccaggagguuugcaggga

SEQ ID NO: 608295 - RNA, 11 nt, Homo sapiens
ugcuccaggga

SEQ ID NO: 608296 - RNA, 14 nt, Homo sapiens
ugcuccagugcagg

SEQ ID NO: 608297 - RNA, 18 nt, Homo sapiens
ugcuccagugcaggagac

SEQ ID NO: 608298 - RNA, 13 nt, Homo sapiens
ugcucccacacuu

SEQ ID NO: 608299 - RNA, 22 nt, Homo sapiens
ugcucccaccccagaaaucacu

SEQ ID NO: 608300 - RNA, 21 nt, Homo sapiens
ugcucccagcagcccuaagga

SEQ ID NO: 608301 - RNA, 18 nt, Homo sapiens
ugcucccccugguggugg

SEQ ID NO: 608302 - RNA, 20 nt, Homo sapiens
ugcuccccuaaagccucaaa

SEQ ID NO: 608303 - RNA, 16 nt, Homo sapiens
ugcucccuagccagag

SEQ ID NO: 608304 - RNA, 12 nt, Homo sapiens
ugcuccggccug

SEQ ID NO: 608305 - RNA, 15 nt, Homo sapiens
ugcuccuacauccag

SEQ ID NO: 608306 - RNA, 21 nt, Homo sapiens
ugcuccucaccccuguaggga

SEQ ID NO: 608307 - RNA, 13 nt, Homo sapiens
ugcuccucagggg

SEQ ID NO: 608308 - RNA, 13 nt, Homo sapiens
ugcuccuccgggu

SEQ ID NO: 608309 - RNA, 16 nt, Homo sapiens
ugcuccuccuacccuu

SEQ ID NO: 608310 - RNA, 14 nt, Homo sapiens
ugcuccucugccug

SEQ ID NO: 608311 - RNA, 17 nt, Homo sapiens
ugcuccugaagcccuau

SEQ ID NO: 608312 - RNA, 13 nt, Homo sapiens
ugcuccugcugau

SEQ ID NO: 608313 - RNA, 19 nt, Homo sapiens
ugcuccuugggcccuuuga

SEQ ID NO: 608314 - RNA, 16 nt, Homo sapiens
ugcucggcuugaucac

SEQ ID NO: 608315 - RNA, 20 nt, Homo sapiens
ugcucggcuugaucacagcu

SEQ ID NO: 608316 - RNA, 18 nt, Homo sapiens
ugcucguuuucgcugggg

SEQ ID NO: 608317 - RNA, 20 nt, Homo sapiens
ugcucuacugcuucaggaag

SEQ ID NO: 608318 - RNA, 13 nt, Homo sapiens
ugcucugagccac

SEQ ID NO: 608319 - RNA, 12 nt, Homo sapiens
ugcucugccauc

SEQ ID NO: 608320 - RNA, 14 nt, Homo sapiens
ugcucugccccacc

SEQ ID NO: 608321 - RNA, 19 nt, Homo sapiens
ugcucugccccaccuugcc

SEQ ID NO: 608322 - RNA, 11 nt, Homo sapiens
ugcucugcuau

SEQ ID NO: 608323 - RNA, 18 nt, Homo sapiens
ugcucugcuggucuucaa

SEQ ID NO: 608324 - RNA, 14 nt, Homo sapiens
ugcucugcugugag

SEQ ID NO: 608325 - RNA, 18 nt, Homo sapiens
ugcucuggaaaaugugac

SEQ ID NO: 608326 - RNA, 19 nt, Homo sapiens
ugcucuggaggaaguucuc

SEQ ID NO: 608327 - RNA, 17 nt, Homo sapiens
ugcucuggcuugcccca

SEQ ID NO: 608328 - RNA, 21 nt, Homo sapiens
ugcucugguuagaaaaaggac

SEQ ID NO: 608329 - RNA, 23 nt, Homo sapiens
ugcucugguuguuucuguuccaa

SEQ ID NO: 608330 - RNA, 17 nt, Homo sapiens
ugcucugugacaaggcu

SEQ ID NO: 608331 - RNA, 12 nt, Homo sapiens
ugcucuguggcu

SEQ ID NO: 608332 - RNA, 14 nt, Homo sapiens
ugcucuguuaccca

SEQ ID NO: 608333 - RNA, 17 nt, Homo sapiens
ugcucuucccaguucag

SEQ ID NO: 608334 - RNA, 23 nt, Homo sapiens
ugcucuugaaccugugcucauuu

SEQ ID NO: 608335 - RNA, 19 nt, Homo sapiens
ugcucuugagucuuugcag

SEQ ID NO: 608336 - RNA, 16 nt, Homo sapiens
ugcucuuggcugaccc

SEQ ID NO: 608337 - RNA, 17 nt, Homo sapiens
ugcucuuuugugaugaa

SEQ ID NO: 608338 - RNA, 14 nt, Homo sapiens
ugcugaaacugugg

SEQ ID NO: 608339 - RNA, 19 nt, Homo sapiens
ugcugaaauaaaaugauaa

SEQ ID NO: 608340 - RNA, 22 nt, Homo sapiens
ugcugaaggacagaacauugcc

SEQ ID NO: 608341 - RNA, 22 nt, Homo sapiens
ugcugaaggagggucaccgcau

SEQ ID NO: 608342 - RNA, 22 nt, Homo sapiens
ugcugaaucaaaucucuuccac

SEQ ID NO: 608343 - RNA, 23 nt, Homo sapiens
ugcugaaucccaucaggcuguua

SEQ ID NO: 608344 - RNA, 18 nt, Homo sapiens
ugcugacaacuuagcuca

SEQ ID NO: 608345 - RNA, 16 nt, Homo sapiens
ugcugaccaugcagcc

SEQ ID NO: 608346 - RNA, 21 nt, Homo sapiens
ugcugacuacuacucugccaa

SEQ ID NO: 608347 - RNA, 17 nt, Homo sapiens
ugcugaggcucugaccc

SEQ ID NO: 608348 - RNA, 18 nt, Homo sapiens
ugcugagucagacuguca

SEQ ID NO: 608349 - RNA, 23 nt, Homo sapiens
ugcugagugcaccacuucaagug

SEQ ID NO: 608350 - RNA, 22 nt, Homo sapiens
ugcugaguuuucuauuuuugca

SEQ ID NO: 608351 - RNA, 21 nt, Homo sapiens
ugcugauaaauauaaccauca

SEQ ID NO: 608352 - RNA, 12 nt, Homo sapiens
ugcugauccaga

SEQ ID NO: 608353 - RNA, 14 nt, Homo sapiens
ugcugauccagaug

SEQ ID NO: 608354 - RNA, 14 nt, Homo sapiens
ugcugaugaucaaa

SEQ ID NO: 608355 - RNA, 16 nt, Homo sapiens
ugcugauggcuugaca

SEQ ID NO: 608356 - RNA, 22 nt, Homo sapiens
ugcugauguauuucaagucucu

SEQ ID NO: 608357 - RNA, 15 nt, Homo sapiens
ugcugauuuggugac

SEQ ID NO: 608358 - RNA, 17 nt, Homo sapiens
ugcugcaaauacuguau

SEQ ID NO: 608359 - RNA, 13 nt, Homo sapiens
ugcugcaccugug

SEQ ID NO: 608360 - RNA, 14 nt, Homo sapiens
ugcugcacuuccug

SEQ ID NO: 608361 - RNA, 16 nt, Homo sapiens
ugcugcagcgcuuguu

SEQ ID NO: 608362 - RNA, 18 nt, Homo sapiens
ugcugcaggcguacaggu

SEQ ID NO: 608363 - RNA, 12 nt, Homo sapiens
ugcugcaucuua

SEQ ID NO: 608364 - RNA, 20 nt, Homo sapiens
ugcugcaugaaaaacauucc

SEQ ID NO: 608365 - RNA, 13 nt, Homo sapiens
ugcugccaugugg

SEQ ID NO: 608366 - RNA, 18 nt, Homo sapiens
ugcugcccagcgcugggg

SEQ ID NO: 608367 - RNA, 17 nt, Homo sapiens
ugcugcccauguuucaa

SEQ ID NO: 608368 - RNA, 10 nt, Homo sapiens
ugcugcuaug

SEQ ID NO: 608369 - RNA, 17 nt, Homo sapiens
ugcugcuccagugcagg

SEQ ID NO: 608370 - RNA, 23 nt, Homo sapiens
ugcugcugcgcccuuaccuuccc

SEQ ID NO: 608371 - RNA, 12 nt, Homo sapiens
ugcugcugcuuc

SEQ ID NO: 608372 - RNA, 19 nt, Homo sapiens
ugcugcuggaucacagcug

SEQ ID NO: 608373 - RNA, 14 nt, Homo sapiens
ugcugcuguuuaca

SEQ ID NO: 608374 - RNA, 19 nt, Homo sapiens
ugcugcuuuuggugcucuc

SEQ ID NO: 608375 - RNA, 15 nt, Homo sapiens
ugcuggaaaccaagu

SEQ ID NO: 608376 - RNA, 15 nt, Homo sapiens
ugcuggaagcccagc

SEQ ID NO: 608377 - RNA, 22 nt, Homo sapiens
ugcuggagagguuaaggugcaa

SEQ ID NO: 608378 - RNA, 23 nt, Homo sapiens
ugcuggagggaagaucuugaugg

SEQ ID NO: 608379 - RNA, 17 nt, Homo sapiens
ugcuggagucgggacua

SEQ ID NO: 608380 - RNA, 22 nt, Homo sapiens
ugcuggagucuccugaggacac

SEQ ID NO: 608381 - RNA, 14 nt, Homo sapiens
ugcuggagugcagu

SEQ ID NO: 608382 - RNA, 13 nt, Homo sapiens
ugcuggcauuugc

SEQ ID NO: 608383 - RNA, 15 nt, Homo sapiens
ugcuggcauuugcac

SEQ ID NO: 608384 - RNA, 22 nt, Homo sapiens
ugcuggcauuugcaccuaccuc

SEQ ID NO: 608385 - RNA, 20 nt, Homo sapiens
ugcuggccaaauagcaaaga

SEQ ID NO: 608386 - RNA, 19 nt, Homo sapiens
ugcuggcucugagaaucac

SEQ ID NO: 608387 - RNA, 17 nt, Homo sapiens
ugcugggagcagaacag

SEQ ID NO: 608388 - RNA, 18 nt, Homo sapiens
ugcugggcucuccaccuc

SEQ ID NO: 608389 - RNA, 18 nt, Homo sapiens
ugcugggcugagugacac

SEQ ID NO: 608390 - RNA, 21 nt, Homo sapiens
ugcuggggagucccugccaca

SEQ ID NO: 608391 - RNA, 20 nt, Homo sapiens
ugcugggggcacagcugucu

SEQ ID NO: 608392 - RNA, 19 nt, Homo sapiens
ugcugggugccuccuugcc

SEQ ID NO: 608393 - RNA, 23 nt, Homo sapiens
ugcuggucccggggccagcacuu

SEQ ID NO: 608394 - RNA, 23 nt, Homo sapiens
ugcuggucuucaauuaccaagaa

SEQ ID NO: 608395 - RNA, 18 nt, Homo sapiens
ugcugguggguuagcuaa

SEQ ID NO: 608396 - RNA, 13 nt, Homo sapiens
ugcuguacaugac

SEQ ID NO: 608397 - RNA, 13 nt, Homo sapiens
ugcuguagcuuau

SEQ ID NO: 608398 - RNA, 19 nt, Homo sapiens
ugcuguaugugagcuguaa

SEQ ID NO: 608399 - RNA, 23 nt, Homo sapiens
ugcuguauugcccccaugggguc

SEQ ID NO: 608400 - RNA, 16 nt, Homo sapiens
ugcugucaacuuccca

SEQ ID NO: 608401 - RNA, 16 nt, Homo sapiens
ugcugucacaaccaag

SEQ ID NO: 608402 - RNA, 16 nt, Homo sapiens
ugcugucccugucagg

SEQ ID NO: 608403 - RNA, 19 nt, Homo sapiens
ugcugucuucaucaucuua

SEQ ID NO: 608404 - RNA, 13 nt, Homo sapiens
ugcugucuuccaa

SEQ ID NO: 608405 - RNA, 13 nt, Homo sapiens
ugcugugcacauu

SEQ ID NO: 608406 - RNA, 20 nt, Homo sapiens
ugcugugccucgcauccuau

SEQ ID NO: 608407 - RNA, 16 nt, Homo sapiens
ugcugugggugcagcu

SEQ ID NO: 608408 - RNA, 19 nt, Homo sapiens
ugcugugggugcagcuguc

SEQ ID NO: 608409 - RNA, 14 nt, Homo sapiens
ugcuguuaaccaaa

SEQ ID NO: 608410 - RNA, 16 nt, Homo sapiens
ugcuguucuucacuuc

SEQ ID NO: 608411 - RNA, 22 nt, Homo sapiens
ugcuguuguaaacaacguguau

SEQ ID NO: 608412 - RNA, 22 nt, Homo sapiens
ugcuguugucccucugcuacgu

SEQ ID NO: 608413 - RNA, 17 nt, Homo sapiens
ugcuguuuauacuugag

SEQ ID NO: 608414 - RNA, 16 nt, Homo sapiens
ugcuguuuuaaacauu

SEQ ID NO: 608415 - RNA, 21 nt, Homo sapiens
ugcuuaaaauuaauaaaucau

SEQ ID NO: 608416 - RNA, 15 nt, Homo sapiens
ugcuuaaaauuguga

SEQ ID NO: 608417 - RNA, 13 nt, Homo sapiens
ugcuuacuuugca

SEQ ID NO: 608418 - RNA, 19 nt, Homo sapiens
ugcuuagacauaacaaaac

SEQ ID NO: 608419 - RNA, 22 nt, Homo sapiens
ugcuuagaugagggugacuguc

SEQ ID NO: 608420 - RNA, 21 nt, Homo sapiens
ugcuuaggcacucauggguaa

SEQ ID NO: 608421 - RNA, 16 nt, Homo sapiens
ugcuuaguauugacaa

SEQ ID NO: 608422 - RNA, 19 nt, Homo sapiens
ugcuuagucccucaugcaa

SEQ ID NO: 608423 - RNA, 13 nt, Homo sapiens
ugcuuauacacug

SEQ ID NO: 608424 - RNA, 20 nt, Homo sapiens
ugcuuaucugaaaugcuuga

SEQ ID NO: 608425 - RNA, 16 nt, Homo sapiens
ugcuuaugacaucacu

SEQ ID NO: 608426 - RNA, 19 nt, Homo sapiens
ugcuuauuaaaugagcgac

SEQ ID NO: 608427 - RNA, 21 nt, Homo sapiens
ugcuuauuaaaugagcgacuu

SEQ ID NO: 608428 - RNA, 22 nt, Homo sapiens
ugcuucaaguguugcucuugga

SEQ ID NO: 608429 - RNA, 22 nt, Homo sapiens
ugcuucacaguagagccagcuu

SEQ ID NO: 608430 - RNA, 23 nt, Homo sapiens
ugcuucagacauguaauguuguu

SEQ ID NO: 608431 - RNA, 13 nt, Homo sapiens
ugcuucaguccac

SEQ ID NO: 608432 - RNA, 20 nt, Homo sapiens
ugcuucagugccauugcagc

SEQ ID NO: 608433 - RNA, 14 nt, Homo sapiens
ugcuucaugcucag

SEQ ID NO: 608434 - RNA, 18 nt, Homo sapiens
ugcuucaugugaacaucc

SEQ ID NO: 608435 - RNA, 18 nt, Homo sapiens
ugcuucccauccuacccu

SEQ ID NO: 608436 - RNA, 23 nt, Homo sapiens
ugcuuccccuuuugccaaucuca

SEQ ID NO: 608437 - RNA, 21 nt, Homo sapiens
ugcuuccgugcugaacuuuag

SEQ ID NO: 608438 - RNA, 14 nt, Homo sapiens
ugcuuccuccucag

SEQ ID NO: 608439 - RNA, 16 nt, Homo sapiens
ugcuucgucaauggcu

SEQ ID NO: 608440 - RNA, 15 nt, Homo sapiens
ugcuucucaccacgg

SEQ ID NO: 608441 - RNA, 17 nt, Homo sapiens
ugcuucucccauuuccu

SEQ ID NO: 608442 - RNA, 18 nt, Homo sapiens
ugcuucucuagcucucua

SEQ ID NO: 608443 - RNA, 14 nt, Homo sapiens
ugcuugaacccaag

SEQ ID NO: 608444 - RNA, 18 nt, Homo sapiens
ugcuugaacccaagaggu

SEQ ID NO: 608445 - RNA, 19 nt, Homo sapiens
ugcuugaacccagaaggca

SEQ ID NO: 608446 - RNA, 19 nt, Homo sapiens
ugcuugaauugcaaggcua

SEQ ID NO: 608447 - RNA, 21 nt, Homo sapiens
ugcuugacauaccuaccagua

SEQ ID NO: 608448 - RNA, 19 nt, Homo sapiens
ugcuugacaugguuuccaa

SEQ ID NO: 608449 - RNA, 17 nt, Homo sapiens
ugcuugcaauguaguca

SEQ ID NO: 608450 - RNA, 18 nt, Homo sapiens
ugcuugcaauguagucaa

SEQ ID NO: 608451 - RNA, 15 nt, Homo sapiens
ugcuugcuuuugccu

SEQ ID NO: 608452 - RNA, 18 nt, Homo sapiens
ugcuuggaagccagguac

SEQ ID NO: 608453 - RNA, 15 nt, Homo sapiens
ugcuuggugcacaga

SEQ ID NO: 608454 - RNA, 15 nt, Homo sapiens
ugcuuguacuaagcc

SEQ ID NO: 608455 - RNA, 14 nt, Homo sapiens
ugcuuguuauuaga

SEQ ID NO: 608456 - RNA, 20 nt, Homo sapiens
ugcuuguuuacaaagcaucu

SEQ ID NO: 608457 - RNA, 17 nt, Homo sapiens
ugcuuuaaaaaaauaca

SEQ ID NO: 608458 - RNA, 24 nt, Homo sapiens
ugcuuuaaauggaaacagacucau

SEQ ID NO: 608459 - RNA, 18 nt, Homo sapiens
ugcuuuaacagcugauaa

SEQ ID NO: 608460 - RNA, 21 nt, Homo sapiens
ugcuuuaauagguagcauuga

SEQ ID NO: 608461 - RNA, 22 nt, Homo sapiens
ugcuuuauuuucccuacuugca

SEQ ID NO: 608462 - RNA, 15 nt, Homo sapiens
ugcuuucaauuacaa

SEQ ID NO: 608463 - RNA, 14 nt, Homo sapiens
ugcuuucagcacuc

SEQ ID NO: 608464 - RNA, 16 nt, Homo sapiens
ugcuuuccagacuuug

SEQ ID NO: 608465 - RNA, 21 nt, Homo sapiens
ugcuuuccuucuuugggauag

SEQ ID NO: 608466 - RNA, 12 nt, Homo sapiens
ugcuuucugcuc

SEQ ID NO: 608467 - RNA, 15 nt, Homo sapiens
ugcuuucuguuccaa

SEQ ID NO: 608468 - RNA, 19 nt, Homo sapiens
ugcuuucuuaucccaguga

SEQ ID NO: 608469 - RNA, 17 nt, Homo sapiens
ugcuuugaaacuugccu

SEQ ID NO: 608470 - RNA, 18 nt, Homo sapiens
ugcuuugaauaaaugugu

SEQ ID NO: 608471 - RNA, 15 nt, Homo sapiens
ugcuuugcaaagacc

SEQ ID NO: 608472 - RNA, 16 nt, Homo sapiens
ugcuuugucuggccuc

SEQ ID NO: 608473 - RNA, 18 nt, Homo sapiens
ugcuuuuagcaaccauaa

SEQ ID NO: 608474 - RNA, 15 nt, Homo sapiens
ugcuuuucauuagca

SEQ ID NO: 608475 - RNA, 18 nt, Homo sapiens
ugcuuuugaaaucuguau

SEQ ID NO: 608476 - RNA, 21 nt, Homo sapiens
ugcuuuuuaaagaaugcucuu

SEQ ID NO: 608477 - RNA, 20 nt, Homo sapiens
uggaaaaaaagacugaugaa

SEQ ID NO: 608478 - RNA, 16 nt, Homo sapiens
uggaaaaaaaggaaga

SEQ ID NO: 608479 - RNA, 16 nt, Homo sapiens
uggaaaaaacucugaa

SEQ ID NO: 608480 - RNA, 16 nt, Homo sapiens
uggaaaaagucacauu

SEQ ID NO: 608481 - RNA, 19 nt, Homo sapiens
uggaaaaaugguugaugga

SEQ ID NO: 608482 - RNA, 14 nt, Homo sapiens
uggaaaacacuuuc

SEQ ID NO: 608483 - RNA, 18 nt, Homo sapiens
uggaaaacagaacacuua

SEQ ID NO: 608484 - RNA, 13 nt, Homo sapiens
uggaaaagcaaaa

SEQ ID NO: 608485 - RNA, 20 nt, Homo sapiens
uggaaaauaaacaucaguuu

SEQ ID NO: 608486 - RNA, 14 nt, Homo sapiens
uggaaaauggugau

SEQ ID NO: 608487 - RNA, 18 nt, Homo sapiens
uggaaaauggugauuuaa

SEQ ID NO: 608488 - RNA, 14 nt, Homo sapiens
uggaaaaugugcaa

SEQ ID NO: 608489 - RNA, 16 nt, Homo sapiens
uggaaacaacauauua

SEQ ID NO: 608490 - RNA, 12 nt, Homo sapiens
uggaaacagcau

SEQ ID NO: 608491 - RNA, 17 nt, Homo sapiens
uggaaacagcaugaaua

SEQ ID NO: 608492 - RNA, 15 nt, Homo sapiens
uggaaacauuuacaa

SEQ ID NO: 608493 - RNA, 15 nt, Homo sapiens
uggaaaccguguaaa

SEQ ID NO: 608494 - RNA, 12 nt, Homo sapiens
uggaaacugccc

SEQ ID NO: 608495 - RNA, 17 nt, Homo sapiens
uggaaagaaucuaauag

SEQ ID NO: 608496 - RNA, 18 nt, Homo sapiens
uggaaagcaucaccucag

SEQ ID NO: 608497 - RNA, 20 nt, Homo sapiens
uggaaagccucugcugccau

SEQ ID NO: 608498 - RNA, 14 nt, Homo sapiens
uggaaagcugcuuc

SEQ ID NO: 608499 - RNA, 22 nt, Homo sapiens
uggaaaggcucagucucaggag

SEQ ID NO: 608500 - RNA, 15 nt, Homo sapiens
uggaaaggggggagc

SEQ ID NO: 608501 - RNA, 23 nt, Homo sapiens
uggaaagguucuaaggggaccua

SEQ ID NO: 608502 - RNA, 17 nt, Homo sapiens
uggaaauaaacugugca

SEQ ID NO: 608503 - RNA, 21 nt, Homo sapiens
uggaaauaaagucagauggaa

SEQ ID NO: 608504 - RNA, 23 nt, Homo sapiens
uggaaauauuugucuucucaggc

SEQ ID NO: 608505 - RNA, 21 nt, Homo sapiens
uggaaaucugccaugagcaca

SEQ ID NO: 608506 - RNA, 18 nt, Homo sapiens
uggaaaugaccaggccaa

SEQ ID NO: 608507 - RNA, 15 nt, Homo sapiens
uggaaauguauuuua

SEQ ID NO: 608508 - RNA, 21 nt, Homo sapiens
uggaaauuccaggaaccaaaa

SEQ ID NO: 608509 - RNA, 20 nt, Homo sapiens
uggaaauucugcugcuucuc

SEQ ID NO: 608510 - RNA, 15 nt, Homo sapiens
uggaacaacuuguag

SEQ ID NO: 608511 - RNA, 13 nt, Homo sapiens
uggaacaagcaca

SEQ ID NO: 608512 - RNA, 14 nt, Homo sapiens
uggaacaagcacag

SEQ ID NO: 608513 - RNA, 17 nt, Homo sapiens
uggaacaagcacagaug

SEQ ID NO: 608514 - RNA, 20 nt, Homo sapiens
uggaacaccuuggggucccu

SEQ ID NO: 608515 - RNA, 20 nt, Homo sapiens
uggaacacuggaacauucca

SEQ ID NO: 608516 - RNA, 21 nt, Homo sapiens
uggaacagcauuacccuccuc

SEQ ID NO: 608517 - RNA, 13 nt, Homo sapiens
uggaacagggaug

SEQ ID NO: 608518 - RNA, 13 nt, Homo sapiens
uggaacagugucu

SEQ ID NO: 608519 - RNA, 18 nt, Homo sapiens
uggaacauuggaauguuc

SEQ ID NO: 608520 - RNA, 21 nt, Homo sapiens
uggaaccaaucccgugaaaga

SEQ ID NO: 608521 - RNA, 16 nt, Homo sapiens
uggaaccugcaaaaaa

SEQ ID NO: 608522 - RNA, 14 nt, Homo sapiens
uggaaccuugcugu

SEQ ID NO: 608523 - RNA, 15 nt, Homo sapiens
uggaacuaaagcaaa

SEQ ID NO: 608524 - RNA, 23 nt, Homo sapiens
uggaacuacauuaguacacagca

SEQ ID NO: 608525 - RNA, 13 nt, Homo sapiens
uggaacugcauca

SEQ ID NO: 608526 - RNA, 16 nt, Homo sapiens
uggaacuuacauacau

SEQ ID NO: 608527 - RNA, 16 nt, Homo sapiens
uggaacuuagccauuu

SEQ ID NO: 608528 - RNA, 22 nt, Homo sapiens
uggaacuuuagugaaacauaau

SEQ ID NO: 608529 - RNA, 17 nt, Homo sapiens
uggaagaagcacugaug

SEQ ID NO: 608530 - RNA, 17 nt, Homo sapiens
uggaagacaauacuccc

SEQ ID NO: 608531 - RNA, 23 nt, Homo sapiens
uggaagaggaacagcacugggga

SEQ ID NO: 608532 - RNA, 12 nt, Homo sapiens
uggaagauggca

SEQ ID NO: 608533 - RNA, 13 nt, Homo sapiens
uggaagauuggaa

SEQ ID NO: 608534 - RNA, 11 nt, Homo sapiens
uggaagcaaag

SEQ ID NO: 608535 - RNA, 14 nt, Homo sapiens
uggaagcacauguu

SEQ ID NO: 608536 - RNA, 13 nt, Homo sapiens
uggaagcacuugc

SEQ ID NO: 608537 - RNA, 19 nt, Homo sapiens
uggaagcauuuguuucuac

SEQ ID NO: 608538 - RNA, 15 nt, Homo sapiens
uggaagcucugaagu

SEQ ID NO: 608539 - RNA, 17 nt, Homo sapiens
uggaagcucuucuuccc

SEQ ID NO: 608540 - RNA, 18 nt, Homo sapiens
uggaagcugucauaaaaa

SEQ ID NO: 608541 - RNA, 16 nt, Homo sapiens
uggaaggcuuccacua

SEQ ID NO: 608542 - RNA, 12 nt, Homo sapiens
uggaagggucaa

SEQ ID NO: 608543 - RNA, 14 nt, Homo sapiens
uggaaggugcuacu

SEQ ID NO: 608544 - RNA, 16 nt, Homo sapiens
uggaaguaaagccuca

SEQ ID NO: 608545 - RNA, 14 nt, Homo sapiens
uggaagucaucuca

SEQ ID NO: 608546 - RNA, 15 nt, Homo sapiens
uggaagucaucucau

SEQ ID NO: 608547 - RNA, 16 nt, Homo sapiens
uggaagucuccaugaa

SEQ ID NO: 608548 - RNA, 21 nt, Homo sapiens
uggaaguggaguugacucugg

SEQ ID NO: 608549 - RNA, 20 nt, Homo sapiens
uggaauaaagucacagaauu

SEQ ID NO: 608550 - RNA, 20 nt, Homo sapiens
uggaauaaaguugcagauga

SEQ ID NO: 608551 - RNA, 14 nt, Homo sapiens
uggaauaacaugua

SEQ ID NO: 608552 - RNA, 20 nt, Homo sapiens
uggaauaacucuguggcauu

SEQ ID NO: 608553 - RNA, 21 nt, Homo sapiens
uggaauauaaggaaagcaaua

SEQ ID NO: 608554 - RNA, 22 nt, Homo sapiens
uggaauauaaggaaagcaauaa

SEQ ID NO: 608555 - RNA, 21 nt, Homo sapiens
uggaauauuguccauugucca

SEQ ID NO: 608556 - RNA, 16 nt, Homo sapiens
uggaauauugugauuc

SEQ ID NO: 608557 - RNA, 12 nt, Homo sapiens
uggaaucaaauc

SEQ ID NO: 608558 - RNA, 19 nt, Homo sapiens
uggaaucagaauuggaauc

SEQ ID NO: 608559 - RNA, 13 nt, Homo sapiens
uggaaucagugaa

SEQ ID NO: 608560 - RNA, 22 nt, Homo sapiens
uggaaucauacugccuacuguu

SEQ ID NO: 608561 - RNA, 11 nt, Homo sapiens
uggaaucucau

SEQ ID NO: 608562 - RNA, 21 nt, Homo sapiens
uggaaucugagggaagauuua

SEQ ID NO: 608563 - RNA, 16 nt, Homo sapiens
uggaaucuucaccuca

SEQ ID NO: 608564 - RNA, 17 nt, Homo sapiens
uggaaugaagguaauau

SEQ ID NO: 608565 - RNA, 14 nt, Homo sapiens
ugggggacacccgg

SEQ ID NO: 608566 - RNA, 20 nt, Homo sapiens
ugggggacccaggugggacu

SEQ ID NO: 608567 - RNA, 19 nt, Homo sapiens
ugggggacccaucuuccac

SEQ ID NO: 608568 - RNA, 21 nt, Homo sapiens
ugggggacugggagucagagc

SEQ ID NO: 608569 - RNA, 19 nt, Homo sapiens
ugggggagaaaaaaucacu

SEQ ID NO: 608570 - RNA, 14 nt, Homo sapiens
ugggggaugcuuca

SEQ ID NO: 608571 - RNA, 17 nt, Homo sapiens
ugggggcacagcugucu

SEQ ID NO: 608572 - RNA, 23 nt, Homo sapiens
ugggggcgcccucucugcuccuu

SEQ ID NO: 608573 - RNA, 16 nt, Homo sapiens
ugggggcuugcaagua

SEQ ID NO: 608574 - RNA, 15 nt, Homo sapiens
ugggguaauacuucc

SEQ ID NO: 608575 - RNA, 18 nt, Homo sapiens
ugggguaguuguguuuca

SEQ ID NO: 608576 - RNA, 12 nt, Homo sapiens
uggggucacuca

SEQ ID NO: 608577 - RNA, 13 nt, Homo sapiens
uggggucaggaac

SEQ ID NO: 608578 - RNA, 12 nt, Homo sapiens
uggggucuguaa

SEQ ID NO: 608579 - RNA, 21 nt, Homo sapiens
uggggucuuuuuaugcauuug

SEQ ID NO: 608580 - RNA, 19 nt, Homo sapiens
ugggguggcgggaauccua

SEQ ID NO: 608581 - RNA, 19 nt, Homo sapiens
ugggguucucuacaggccu

SEQ ID NO: 608582 - RNA, 19 nt, Homo sapiens
ugggguugcaaccacugca

SEQ ID NO: 608583 - RNA, 18 nt, Homo sapiens
ugggguuucuggggucca

SEQ ID NO: 608584 - RNA, 16 nt, Homo sapiens
uggguacaucaagucc

SEQ ID NO: 608585 - RNA, 18 nt, Homo sapiens
uggguagucauucuuaca

SEQ ID NO: 608586 - RNA, 16 nt, Homo sapiens
uggguauuuaauaaga

SEQ ID NO: 608587 - RNA, 22 nt, Homo sapiens
ugggucaaagugguacaggaag

SEQ ID NO: 608588 - RNA, 22 nt, Homo sapiens
ugggucaggaggaaaagacuaa

SEQ ID NO: 608589 - RNA, 22 nt, Homo sapiens
ugggucagggggagucuuugca

SEQ ID NO: 608590 - RNA, 20 nt, Homo sapiens
ugggucccggggugcauuug

SEQ ID NO: 608591 - RNA, 22 nt, Homo sapiens
uggguccuaauuaccagucuuu

SEQ ID NO: 608592 - RNA, 18 nt, Homo sapiens
uggguccugaagcccucu

SEQ ID NO: 608593 - RNA, 14 nt, Homo sapiens
uggguccuuuucag

SEQ ID NO: 608594 - RNA, 22 nt, Homo sapiens
ugggucuaccucaucucugaaa

SEQ ID NO: 608595 - RNA, 17 nt, Homo sapiens
ugggucuaggacacagu

SEQ ID NO: 608596 - RNA, 14 nt, Homo sapiens
ugggucuauguucc

SEQ ID NO: 608597 - RNA, 21 nt, Homo sapiens
ugggucucagcugcugacacg

SEQ ID NO: 608598 - RNA, 18 nt, Homo sapiens
ugggucuuuguacauuuu

SEQ ID NO: 608599 - RNA, 21 nt, Homo sapiens
ugggugcaggaaagguucaca

SEQ ID NO: 608600 - RNA, 17 nt, Homo sapiens
ugggugcaugaucuuga

SEQ ID NO: 608601 - RNA, 18 nt, Homo sapiens
ugggugccagcauacauu

SEQ ID NO: 608602 - RNA, 14 nt, Homo sapiens
uggguggaaagugc

SEQ ID NO: 608603 - RNA, 20 nt, Homo sapiens
uggguggggcugcuccucca

SEQ ID NO: 608604 - RNA, 23 nt, Homo sapiens
uggguguagccagguauggcucu

SEQ ID NO: 608605 - RNA, 23 nt, Homo sapiens
uggguuaggguguguguucaccu

SEQ ID NO: 608606 - RNA, 13 nt, Homo sapiens
uggguuauccucc

SEQ ID NO: 608607 - RNA, 17 nt, Homo sapiens
uggguuauuuuuauuaa

SEQ ID NO: 608608 - RNA, 11 nt, Homo sapiens
uggguucaagc

SEQ ID NO: 608609 - RNA, 16 nt, Homo sapiens
uggguugaaagccaag

SEQ ID NO: 608610 - RNA, 21 nt, Homo sapiens
uggguuuaacaagcugucuac

SEQ ID NO: 608611 - RNA, 13 nt, Homo sapiens
uggguuugcccag

SEQ ID NO: 608612 - RNA, 20 nt, Homo sapiens
uggguuuugggucuuugaac

SEQ ID NO: 608613 - RNA, 17 nt, Homo sapiens
uggguuuugugccuuug

SEQ ID NO: 608614 - RNA, 20 nt, Homo sapiens
ugguaaaacucacugugauc

SEQ ID NO: 608615 - RNA, 15 nt, Homo sapiens
ugguaaaaguauuug

SEQ ID NO: 608616 - RNA, 14 nt, Homo sapiens
ugguaaaauacuuc

SEQ ID NO: 608617 - RNA, 23 nt, Homo sapiens
ugguaaacaguuuggaaaagugg

SEQ ID NO: 608618 - RNA, 22 nt, Homo sapiens
ugguaaaccagaucugucucca

SEQ ID NO: 608619 - RNA, 17 nt, Homo sapiens
ugguaaauuaguauuua

SEQ ID NO: 608620 - RNA, 19 nt, Homo sapiens
ugguaacuguagucaucuu

SEQ ID NO: 608621 - RNA, 17 nt, Homo sapiens
ugguaagaugacucuga

SEQ ID NO: 608622 - RNA, 15 nt, Homo sapiens
ugguaauaacaaacg

SEQ ID NO: 608623 - RNA, 16 nt, Homo sapiens
ugguaauauguuacaa

SEQ ID NO: 608624 - RNA, 19 nt, Homo sapiens
ugguaaucauaugugucuu

SEQ ID NO: 608625 - RNA, 16 nt, Homo sapiens
ugguacacaguucugg

SEQ ID NO: 608626 - RNA, 19 nt, Homo sapiens
ugguaccagaggaugguga

SEQ ID NO: 608627 - RNA, 19 nt, Homo sapiens
ugguaccuauuugacuuac

SEQ ID NO: 608628 - RNA, 19 nt, Homo sapiens
ugguaccuuucuagccuua

SEQ ID NO: 608629 - RNA, 21 nt, Homo sapiens
ugguaccuuucuagccuuaga

SEQ ID NO: 608630 - RNA, 20 nt, Homo sapiens
ugguacuccacauauuucag

SEQ ID NO: 608631 - RNA, 17 nt, Homo sapiens
ugguacugaaaaugaga

SEQ ID NO: 608632 - RNA, 18 nt, Homo sapiens
ugguacuguagcagggga

SEQ ID NO: 608633 - RNA, 23 nt, Homo sapiens
ugguacuuagaguuucuguuuga

SEQ ID NO: 608634 - RNA, 13 nt, Homo sapiens
ugguagagauuca

SEQ ID NO: 608635 - RNA, 19 nt, Homo sapiens
ugguaguggaauagugaau

SEQ ID NO: 608636 - RNA, 21 nt, Homo sapiens
ugguauaaacguccuacugua

SEQ ID NO: 608637 - RNA, 22 nt, Homo sapiens
ugguaucauuuucuagcaauaa

SEQ ID NO: 608638 - RNA, 22 nt, Homo sapiens
ugguauccugugacauguaaca

SEQ ID NO: 608639 - RNA, 19 nt, Homo sapiens
ugguaugguuguauacaca

SEQ ID NO: 608640 - RNA, 15 nt, Homo sapiens
ugguauuaauacugc

SEQ ID NO: 608641 - RNA, 17 nt, Homo sapiens
ugguauucacagaaagc

SEQ ID NO: 608642 - RNA, 15 nt, Homo sapiens
ugguauugcagagaa

SEQ ID NO: 608643 - RNA, 20 nt, Homo sapiens
ugguauuguaaaacauucac

SEQ ID NO: 608644 - RNA, 21 nt, Homo sapiens
uggucaagauuuugaaugcuu

SEQ ID NO: 608645 - RNA, 21 nt, Homo sapiens
uggucaaguaguuugacucag

SEQ ID NO: 608646 - RNA, 15 nt, Homo sapiens
uggucacacacugau

SEQ ID NO: 608647 - RNA, 14 nt, Homo sapiens
uggucacacucuca

SEQ ID NO: 608648 - RNA, 19 nt, Homo sapiens
uggucacagccaugaaguc

SEQ ID NO: 608649 - RNA, 22 nt, Homo sapiens
uggucaccaaaucagcugcuac

SEQ ID NO: 608650 - RNA, 16 nt, Homo sapiens
uggucagcccuaggau

SEQ ID NO: 608651 - RNA, 20 nt, Homo sapiens
uggucagugguggucuucaa

SEQ ID NO: 608652 - RNA, 23 nt, Homo sapiens
uggucauagcccagaucagcucc

SEQ ID NO: 608653 - RNA, 22 nt, Homo sapiens
uggucaugugguacuugaggga

SEQ ID NO: 608654 - RNA, 13 nt, Homo sapiens
ugguccacugugu

SEQ ID NO: 608655 - RNA, 11 nt, Homo sapiens
ugguccagaau

SEQ ID NO: 608656 - RNA, 18 nt, Homo sapiens
uggucccaagacagugag

SEQ ID NO: 608657 - RNA, 21 nt, Homo sapiens
uggucccaggaagcagggaga

SEQ ID NO: 608658 - RNA, 23 nt, Homo sapiens
ugguccccucucuucguccugau

SEQ ID NO: 608659 - RNA, 21 nt, Homo sapiens
uggucccucuucucuccucag

SEQ ID NO: 608660 - RNA, 22 nt, Homo sapiens
uggucccugccuuaggccuacc

SEQ ID NO: 608661 - RNA, 15 nt, Homo sapiens
ugguccuccacuuug

SEQ ID NO: 608662 - RNA, 16 nt, Homo sapiens
ugguccuggcugcacu

SEQ ID NO: 608663 - RNA, 18 nt, Homo sapiens
ugguccuggcugcacucu

SEQ ID NO: 608664 - RNA, 19 nt, Homo sapiens
ugguccuggcugcacucuu

SEQ ID NO: 608665 - RNA, 16 nt, Homo sapiens
uggucgagugacacac

SEQ ID NO: 608666 - RNA, 15 nt, Homo sapiens
uggucgggaagggag

SEQ ID NO: 608667 - RNA, 22 nt, Homo sapiens
uggucuaagguucagccugaaa

SEQ ID NO: 608668 - RNA, 19 nt, Homo sapiens
uggucuaauuauuuacuca

SEQ ID NO: 608669 - RNA, 23 nt, Homo sapiens
uggucuauuuucugcagaaauuu

SEQ ID NO: 608670 - RNA, 23 nt, Homo sapiens
uggucucaaacucccgaccucag

SEQ ID NO: 608671 - RNA, 22 nt, Homo sapiens
uggucucaaacuccugaccuca

SEQ ID NO: 608672 - RNA, 21 nt, Homo sapiens
uggucugauggaacuguguau

SEQ ID NO: 608673 - RNA, 19 nt, Homo sapiens
uggucugcauuagucucau

SEQ ID NO: 608674 - RNA, 20 nt, Homo sapiens
uggucugcugaguaacaggu

SEQ ID NO: 608675 - RNA, 13 nt, Homo sapiens
uggucuggcaaua

SEQ ID NO: 608676 - RNA, 19 nt, Homo sapiens
uggucuuucugaauugcac

SEQ ID NO: 608677 - RNA, 13 nt, Homo sapiens
uggucuuugcucc

SEQ ID NO: 608678 - RNA, 20 nt, Homo sapiens
uggucuuuucuccuacucuu

SEQ ID NO: 608679 - RNA, 18 nt, Homo sapiens
uggugacaccucaccuca

SEQ ID NO: 608680 - RNA, 19 nt, Homo sapiens
uggugacaggugugagucu

SEQ ID NO: 608681 - RNA, 17 nt, Homo sapiens
uggugacugaaacauuc

SEQ ID NO: 608682 - RNA, 13 nt, Homo sapiens
uggugacugggaa

SEQ ID NO: 608683 - RNA, 16 nt, Homo sapiens
uggugagaaaccaacu

SEQ ID NO: 608684 - RNA, 13 nt, Homo sapiens
uggugaggcaaua

SEQ ID NO: 608685 - RNA, 14 nt, Homo sapiens
uggugauccucuau

SEQ ID NO: 608686 - RNA, 15 nt, Homo sapiens
uggugaugugccugu

SEQ ID NO: 608687 - RNA, 17 nt, Homo sapiens
uggugauugucauguaa

SEQ ID NO: 608688 - RNA, 17 nt, Homo sapiens
uggugcaaacacagcuc

SEQ ID NO: 608689 - RNA, 17 nt, Homo sapiens
uggugcaaucacagcuc

SEQ ID NO: 608690 - RNA, 15 nt, Homo sapiens
uggugcacuucuuac

SEQ ID NO: 608691 - RNA, 23 nt, Homo sapiens
uggugcagugccgcucuguagag

SEQ ID NO: 608692 - RNA, 14 nt, Homo sapiens
uggugccaaacaaa

SEQ ID NO: 608693 - RNA, 22 nt, Homo sapiens
uggugcccagcacaugugcugc

SEQ ID NO: 608694 - RNA, 15 nt, Homo sapiens
uggugccccacagcu

SEQ ID NO: 608695 - RNA, 12 nt, Homo sapiens
uggugcccugga

SEQ ID NO: 608696 - RNA, 15 nt, Homo sapiens
uggugcuacagggaa

SEQ ID NO: 608697 - RNA, 15 nt, Homo sapiens
ugguggaggagcuga

SEQ ID NO: 608698 - RNA, 16 nt, Homo sapiens
ugguggaucuguccaa

SEQ ID NO: 608699 - RNA, 24 nt, Homo sapiens
ugguggcacaggaguguccucuuc

SEQ ID NO: 608700 - RNA, 18 nt, Homo sapiens
ugguggcagauuuuacaa

SEQ ID NO: 608701 - RNA, 16 nt, Homo sapiens
ugguggcugugucucu

SEQ ID NO: 608702 - RNA, 14 nt, Homo sapiens
uggugggcauguga

SEQ ID NO: 608703 - RNA, 19 nt, Homo sapiens
uggugggcccccaaugaca

SEQ ID NO: 608704 - RNA, 13 nt, Homo sapiens
ugguggggguucu

SEQ ID NO: 608705 - RNA, 20 nt, Homo sapiens
ugguggguacaaaaagucaa

SEQ ID NO: 608706 - RNA, 22 nt, Homo sapiens
uggugguauuuuuauagccaua

SEQ ID NO: 608707 - RNA, 16 nt, Homo sapiens
ugguggucuuacugag

SEQ ID NO: 608708 - RNA, 20 nt, Homo sapiens
uggugguggaaggguagaga

SEQ ID NO: 608709 - RNA, 22 nt, Homo sapiens
uggugucacccuggauaggcaa

SEQ ID NO: 608710 - RNA, 14 nt, Homo sapiens
ugguguccagucuu

SEQ ID NO: 608711 - RNA, 21 nt, Homo sapiens
uggugucccgguaccuuccau

SEQ ID NO: 608712 - RNA, 17 nt, Homo sapiens
uggugucuccuuuacua

SEQ ID NO: 608713 - RNA, 18 nt, Homo sapiens
uggugugagccacugugu

SEQ ID NO: 608714 - RNA, 13 nt, Homo sapiens
uggugugaucucg

SEQ ID NO: 608715 - RNA, 14 nt, Homo sapiens
uggugugcucucuu

SEQ ID NO: 608716 - RNA, 14 nt, Homo sapiens
ugguguguuacaca

SEQ ID NO: 608717 - RNA, 21 nt, Homo sapiens
ugguguuacauuaaagcccug

SEQ ID NO: 608718 - RNA, 21 nt, Homo sapiens
ugguguucaaaaaaacacuag

SEQ ID NO: 608719 - RNA, 21 nt, Homo sapiens
ugguguucaccaaaaccaaac

SEQ ID NO: 608720 - RNA, 23 nt, Homo sapiens
ugguuaaaaguagucauggauaa

SEQ ID NO: 608721 - RNA, 18 nt, Homo sapiens
ugguuaagagaucccuua

SEQ ID NO: 608722 - RNA, 14 nt, Homo sapiens
ugguuacaguuuga

SEQ ID NO: 608723 - RNA, 12 nt, Homo sapiens
ugguuacauuua

SEQ ID NO: 608724 - RNA, 17 nt, Homo sapiens
ugguuacucacaccugu

SEQ ID NO: 608725 - RNA, 19 nt, Homo sapiens
ugguuaguuaaaagcccau

SEQ ID NO: 608726 - RNA, 13 nt, Homo sapiens
ugguuaugguguu

SEQ ID NO: 608727 - RNA, 17 nt, Homo sapiens
ugguuaugugcauuauu

SEQ ID NO: 608728 - RNA, 16 nt, Homo sapiens
ugguuauucauuauuc

SEQ ID NO: 608729 - RNA, 19 nt, Homo sapiens
ugguuauucuaagcccuuu

SEQ ID NO: 608730 - RNA, 13 nt, Homo sapiens
ugguuauuuagaa

SEQ ID NO: 608731 - RNA, 13 nt, Homo sapiens
ugguuccaaagac

SEQ ID NO: 608732 - RNA, 18 nt, Homo sapiens
ugguuccaugcagccuug

SEQ ID NO: 608733 - RNA, 20 nt, Homo sapiens
ugguuccugugauacauuuc

SEQ ID NO: 608734 - RNA, 16 nt, Homo sapiens
ugguucuccuuccuca

SEQ ID NO: 608735 - RNA, 22 nt, Homo sapiens
ugguucugaaauaaacuucacu

SEQ ID NO: 608736 - RNA, 17 nt, Homo sapiens
ugguucuuaguucucac

SEQ ID NO: 608737 - RNA, 12 nt, Homo sapiens
ugguucuuucag

SEQ ID NO: 608738 - RNA, 14 nt, Homo sapiens
ugguugacauugua

SEQ ID NO: 608739 - RNA, 20 nt, Homo sapiens
ugguugaguguugcucucua

SEQ ID NO: 608740 - RNA, 16 nt, Homo sapiens
ugguugaugccaaaaa

SEQ ID NO: 608741 - RNA, 17 nt, Homo sapiens
ugguugccucucuugcc

SEQ ID NO: 608742 - RNA, 20 nt, Homo sapiens
ugguugguuuugacuucaga

SEQ ID NO: 608743 - RNA, 15 nt, Homo sapiens
ugguuucacugagag

SEQ ID NO: 608744 - RNA, 16 nt, Homo sapiens
ugguuucucucuacag

SEQ ID NO: 608745 - RNA, 13 nt, Homo sapiens
ugguuugccaugu

SEQ ID NO: 608746 - RNA, 17 nt, Homo sapiens
ugguuuguaaaauccac

SEQ ID NO: 608747 - RNA, 15 nt, Homo sapiens
ugguuugugugauca

SEQ ID NO: 608748 - RNA, 16 nt, Homo sapiens
ugguuuuaaaagagaa

SEQ ID NO: 608749 - RNA, 17 nt, Homo sapiens
ugguuuuaauacuugau

SEQ ID NO: 608750 - RNA, 13 nt, Homo sapiens
ugguuuucuugcc

SEQ ID NO: 608751 - RNA, 11 nt, Homo sapiens
ugguuuugcuc

SEQ ID NO: 608752 - RNA, 22 nt, Homo sapiens
ugguuuuuaaaaaacugcugac

SEQ ID NO: 608753 - RNA, 16 nt, Homo sapiens
ugguuuuuacauucaa

SEQ ID NO: 608754 - RNA, 12 nt, Homo sapiens
ugguuuuuacug

SEQ ID NO: 608755 - RNA, 18 nt, Homo sapiens
ugguuuuuuuuuuuaccc

SEQ ID NO: 608756 - RNA, 21 nt, Homo sapiens
uguaaaaaugaaagugacuuu

SEQ ID NO: 608757 - RNA, 14 nt, Homo sapiens
uguaaaacauucac

SEQ ID NO: 608758 - RNA, 23 nt, Homo sapiens
uguaaaaugucuguuaacuuaau

SEQ ID NO: 608759 - RNA, 17 nt, Homo sapiens
uguaaacaagcaauaau

SEQ ID NO: 608760 - RNA, 16 nt, Homo sapiens
uguaaacccucaaggg

SEQ ID NO: 608761 - RNA, 13 nt, Homo sapiens
uguaaacuuuauc

SEQ ID NO: 608762 - RNA, 18 nt, Homo sapiens
uguaaagaauuuagcugu

SEQ ID NO: 608763 - RNA, 21 nt, Homo sapiens
uguaaaguagaauaagccuuc

SEQ ID NO: 608764 - RNA, 22 nt, Homo sapiens
uguaaauaagcccagugcugcu

SEQ ID NO: 608765 - RNA, 22 nt, Homo sapiens
uguaaauagagcaaccuauaua

SEQ ID NO: 608766 - RNA, 15 nt, Homo sapiens
uguaaauagugauuu

SEQ ID NO: 608767 - RNA, 21 nt, Homo sapiens
uguaaauaucccagagaacaa

SEQ ID NO: 608768 - RNA, 15 nt, Homo sapiens
uguaaauaugcaaau

SEQ ID NO: 608769 - RNA, 16 nt, Homo sapiens
uguaaauccauaguca

SEQ ID NO: 608770 - RNA, 16 nt, Homo sapiens
uguaaaugcauuggaa

SEQ ID NO: 608771 - RNA, 12 nt, Homo sapiens
uguaaauguguu

SEQ ID NO: 608772 - RNA, 19 nt, Homo sapiens
uguaaauguguuagcacug

SEQ ID NO: 608773 - RNA, 19 nt, Homo sapiens
uguaaauguugugcuguua

SEQ ID NO: 608774 - RNA, 16 nt, Homo sapiens
uguaaauuauuguaaa

SEQ ID NO: 608775 - RNA, 15 nt, Homo sapiens
uguaaauuuacugag

SEQ ID NO: 608776 - RNA, 21 nt, Homo sapiens
uguaacaagaaaguggucugu

SEQ ID NO: 608777 - RNA, 23 nt, Homo sapiens
uguaacacagcugagagacuuuu

SEQ ID NO: 608778 - RNA, 19 nt, Homo sapiens
uguaacacuguuuauugaa

SEQ ID NO: 608779 - RNA, 15 nt, Homo sapiens
uguaacacuugucaa

SEQ ID NO: 608780 - RNA, 19 nt, Homo sapiens
uguaacauagaguauauaa

SEQ ID NO: 608781 - RNA, 16 nt, Homo sapiens
uguaacaugaagcaaa

SEQ ID NO: 608782 - RNA, 17 nt, Homo sapiens
uguaacccucacccaca

SEQ ID NO: 608783 - RNA, 16 nt, Homo sapiens
uguaaccgauaugcac

SEQ ID NO: 608784 - RNA, 17 nt, Homo sapiens
uguaacugugugagauu

SEQ ID NO: 608785 - RNA, 16 nt, Homo sapiens
uguaagaaauacugua

SEQ ID NO: 608786 - RNA, 15 nt, Homo sapiens
uguaagaacuguaca

SEQ ID NO: 608787 - RNA, 15 nt, Homo sapiens
uguaagaagagccau

SEQ ID NO: 608788 - RNA, 19 nt, Homo sapiens
uguaagacauuuguauauu

SEQ ID NO: 608789 - RNA, 15 nt, Homo sapiens
uguaagacucauucc

SEQ ID NO: 608790 - RNA, 14 nt, Homo sapiens
uguaagagugauuu

SEQ ID NO: 608791 - RNA, 16 nt, Homo sapiens
uguaagccuaguugcu

SEQ ID NO: 608792 - RNA, 19 nt, Homo sapiens
uguaagccuaguugcugaa

SEQ ID NO: 608793 - RNA, 15 nt, Homo sapiens
uguaaggacagaaua

SEQ ID NO: 608794 - RNA, 13 nt, Homo sapiens
uguaagucaucua

SEQ ID NO: 608795 - RNA, 18 nt, Homo sapiens
uguaagugagagagacaa

SEQ ID NO: 608796 - RNA, 14 nt, Homo sapiens
uguaagugcugcua

SEQ ID NO: 608797 - RNA, 23 nt, Homo sapiens
uguaauaauugcucauaagcaau

SEQ ID NO: 608798 - RNA, 14 nt, Homo sapiens
uguaauacuggaau

SEQ ID NO: 608799 - RNA, 16 nt, Homo sapiens
uguaauagugaacaua

SEQ ID NO: 608800 - RNA, 18 nt, Homo sapiens
uguaauagugaacauaug

SEQ ID NO: 608801 - RNA, 14 nt, Homo sapiens
uguaauaugcacaa

SEQ ID NO: 608802 - RNA, 19 nt, Homo sapiens
uguaauauuucuucaaaua

SEQ ID NO: 608803 - RNA, 17 nt, Homo sapiens
uguaaucacauuccuua

SEQ ID NO: 608804 - RNA, 13 nt, Homo sapiens
uguaaucccagca

SEQ ID NO: 608805 - RNA, 23 nt, Homo sapiens
uguaaucgaguaaggcacaccca

SEQ ID NO: 608806 - RNA, 17 nt, Homo sapiens
uguaaucucagcacuuu

SEQ ID NO: 608807 - RNA, 20 nt, Homo sapiens
uguaauggagcaucaagcca

SEQ ID NO: 608808 - RNA, 19 nt, Homo sapiens
uguaaugucagacuuugcu

SEQ ID NO: 608809 - RNA, 21 nt, Homo sapiens
uguaauuuaaaaagugcuaua

SEQ ID NO: 608810 - RNA, 15 nt, Homo sapiens
uguaauuuaugcaag

SEQ ID NO: 608811 - RNA, 20 nt, Homo sapiens
uguaauuugugauacaaugc

SEQ ID NO: 608812 - RNA, 23 nt, Homo sapiens
uguaauuuuaaauaaaagugauc

SEQ ID NO: 608813 - RNA, 20 nt, Homo sapiens
uguaauuuuguccucucugu

SEQ ID NO: 608814 - RNA, 16 nt, Homo sapiens
uguacaaaacaguuug

SEQ ID NO: 608815 - RNA, 18 nt, Homo sapiens
uguacaaaauaacucucc

SEQ ID NO: 608816 - RNA, 13 nt, Homo sapiens
uguacaacugcac

SEQ ID NO: 608817 - RNA, 13 nt, Homo sapiens
uguacaauaaagc

SEQ ID NO: 608818 - RNA, 14 nt, Homo sapiens
uguacaauaaagca

SEQ ID NO: 608819 - RNA, 16 nt, Homo sapiens
uguacaauuuuaguca

SEQ ID NO: 608820 - RNA, 18 nt, Homo sapiens
uguacacaucuauucuca

SEQ ID NO: 608821 - RNA, 17 nt, Homo sapiens
uguacaccccaggacag

SEQ ID NO: 608822 - RNA, 21 nt, Homo sapiens
uguacaccccaggacaguuua

SEQ ID NO: 608823 - RNA, 19 nt, Homo sapiens
uguacacuaccaaacacuc

SEQ ID NO: 608824 - RNA, 22 nt, Homo sapiens
uguacacugacuugagaccagu

SEQ ID NO: 608825 - RNA, 17 nt, Homo sapiens
uguacacugauuccuuu

SEQ ID NO: 608826 - RNA, 15 nt, Homo sapiens
uguacagacauacau

SEQ ID NO: 608827 - RNA, 14 nt, Homo sapiens
uguacagagacucu

SEQ ID NO: 608828 - RNA, 23 nt, Homo sapiens
uguacaggaaggugccuggccau

SEQ ID NO: 608829 - RNA, 21 nt, Homo sapiens
uguacaguagauuuuccaaau

SEQ ID NO: 608830 - RNA, 16 nt, Homo sapiens
uguacagucuuguauu

SEQ ID NO: 608831 - RNA, 11 nt, Homo sapiens
uguacagugaa

SEQ ID NO: 608832 - RNA, 18 nt, Homo sapiens
uguacagugucugugcca

SEQ ID NO: 608833 - RNA, 22 nt, Homo sapiens
uguacaguuuuuauugcuuguu

SEQ ID NO: 608834 - RNA, 16 nt, Homo sapiens
uguacauaaacuguca

SEQ ID NO: 608835 - RNA, 21 nt, Homo sapiens
uguacauaaacugucacucua

SEQ ID NO: 608836 - RNA, 22 nt, Homo sapiens
uguacauaugugugugugggua

SEQ ID NO: 608837 - RNA, 17 nt, Homo sapiens
uguacauggaauaacau

SEQ ID NO: 608838 - RNA, 18 nt, Homo sapiens
uguacauguaacauuaaa

SEQ ID NO: 608839 - RNA, 19 nt, Homo sapiens
uguacauguucuugucaua

SEQ ID NO: 608840 - RNA, 23 nt, Homo sapiens
uguacauguucuugucauaaaau

SEQ ID NO: 608841 - RNA, 15 nt, Homo sapiens
uguacauugugggau

SEQ ID NO: 608842 - RNA, 17 nt, Homo sapiens
uguaccaaaagaucucu

SEQ ID NO: 608843 - RNA, 20 nt, Homo sapiens
uguaccacuuuugcaaauaa

SEQ ID NO: 608844 - RNA, 16 nt, Homo sapiens
uguaccauuugcaugg

SEQ ID NO: 608845 - RNA, 15 nt, Homo sapiens
uguacccgagcacau

SEQ ID NO: 608846 - RNA, 19 nt, Homo sapiens
uguaccuaggauauguuaa

SEQ ID NO: 608847 - RNA, 14 nt, Homo sapiens
uguaccugugcacg

SEQ ID NO: 608848 - RNA, 13 nt, Homo sapiens
uguaccuguguac

SEQ ID NO: 608849 - RNA, 14 nt, Homo sapiens
uguaccuugcugug

SEQ ID NO: 608850 - RNA, 22 nt, Homo sapiens
uguacgaaucgaauacaaauca

SEQ ID NO: 608851 - RNA, 14 nt, Homo sapiens
uguacggacacugu

SEQ ID NO: 608852 - RNA, 17 nt, Homo sapiens
uguacuaaaccaccuca

SEQ ID NO: 608853 - RNA, 14 nt, Homo sapiens
uguacuaacaaagc

SEQ ID NO: 608854 - RNA, 15 nt, Homo sapiens
uguacuagugccauu

SEQ ID NO: 608855 - RNA, 18 nt, Homo sapiens
uguacuagugccauugga

SEQ ID NO: 608856 - RNA, 19 nt, Homo sapiens
uguacuauguuaauaacuu

SEQ ID NO: 608857 - RNA, 18 nt, Homo sapiens
uguacucaauggauuuga

SEQ ID NO: 608858 - RNA, 18 nt, Homo sapiens
uguacucuuuagaucucc

SEQ ID NO: 608859 - RNA, 17 nt, Homo sapiens
uguacugcacaaggaca

SEQ ID NO: 608860 - RNA, 22 nt, Homo sapiens
uguacuggucagcuugcucaga

SEQ ID NO: 608861 - RNA, 21 nt, Homo sapiens
uguacuguaauagugugauua

SEQ ID NO: 608862 - RNA, 22 nt, Homo sapiens
uguacuguuuuuaauguucaca

SEQ ID NO: 608863 - RNA, 15 nt, Homo sapiens
uguacuuaaaccucc

SEQ ID NO: 608864 - RNA, 21 nt, Homo sapiens
uguacuuccaccuccaccaca

SEQ ID NO: 608865 - RNA, 10 nt, Homo sapiens
uguacuugug

SEQ ID NO: 608866 - RNA, 16 nt, Homo sapiens
uguacuugugguucuc

SEQ ID NO: 608867 - RNA, 21 nt, Homo sapiens
uguacuuuucugguuccaaac

SEQ ID NO: 608868 - RNA, 12 nt, Homo sapiens
uguagaaacugg

SEQ ID NO: 608869 - RNA, 20 nt, Homo sapiens
uguagaagaggaaguuuuaa

SEQ ID NO: 608870 - RNA, 13 nt, Homo sapiens
uguagaaggccag

SEQ ID NO: 608871 - RNA, 16 nt, Homo sapiens
uguagaauaaaugaag

SEQ ID NO: 608872 - RNA, 20 nt, Homo sapiens
uguagaaucucuucaugcuu

SEQ ID NO: 608873 - RNA, 19 nt, Homo sapiens
uguagaccaccuaauauca

SEQ ID NO: 608874 - RNA, 21 nt, Homo sapiens
uguagacucuaagauacacug

SEQ ID NO: 608875 - RNA, 18 nt, Homo sapiens
uguagacuuacuuuccua

SEQ ID NO: 608876 - RNA, 22 nt, Homo sapiens
uguagagacgguguuuugccau

SEQ ID NO: 608877 - RNA, 16 nt, Homo sapiens
uguagagcuucuggca

SEQ ID NO: 608878 - RNA, 17 nt, Homo sapiens
uguagaggguagcugug

SEQ ID NO: 608879 - RNA, 10 nt, Homo sapiens
uguagagugg

SEQ ID NO: 608880 - RNA, 18 nt, Homo sapiens
uguagauaguaugcacua

SEQ ID NO: 608881 - RNA, 12 nt, Homo sapiens
uguagauauugu

SEQ ID NO: 608882 - RNA, 22 nt, Homo sapiens
uguagaugggggaacugugaau

SEQ ID NO: 608883 - RNA, 14 nt, Homo sapiens
uguagaugugauua

SEQ ID NO: 608884 - RNA, 12 nt, Homo sapiens
uguagcacuuac

SEQ ID NO: 608885 - RNA, 15 nt, Homo sapiens
uguagcagucacuga

SEQ ID NO: 608886 - RNA, 13 nt, Homo sapiens
uguagcagugaga

SEQ ID NO: 608887 - RNA, 22 nt, Homo sapiens
uguagcaucuucuggagucucc

SEQ ID NO: 608888 - RNA, 22 nt, Homo sapiens
uguagcauuucuugauguugcu

SEQ ID NO: 608889 - RNA, 13 nt, Homo sapiens
uguagccagguac

SEQ ID NO: 608890 - RNA, 16 nt, Homo sapiens
uguagccaguuaagga

SEQ ID NO: 608891 - RNA, 15 nt, Homo sapiens
uguagccauccuguu

SEQ ID NO: 608892 - RNA, 20 nt, Homo sapiens
uguagcuuuaaaaccacagc

SEQ ID NO: 608893 - RNA, 20 nt, Homo sapiens
uguaggaaucugccuuccag

SEQ ID NO: 608894 - RNA, 13 nt, Homo sapiens
uguaggacuguau

SEQ ID NO: 608895 - RNA, 18 nt, Homo sapiens
uguaggcacagagcugca

SEQ ID NO: 608896 - RNA, 18 nt, Homo sapiens
uguaggcagggaaccuua

SEQ ID NO: 608897 - RNA, 13 nt, Homo sapiens
uguagggaacucu

SEQ ID NO: 608898 - RNA, 15 nt, Homo sapiens
uguagguaauauugu

SEQ ID NO: 608899 - RNA, 14 nt, Homo sapiens
uguaguaauugaca

SEQ ID NO: 608900 - RNA, 14 nt, Homo sapiens
uguaguagucucau

SEQ ID NO: 608901 - RNA, 18 nt, Homo sapiens
uguaguauuuuugccaaa

SEQ ID NO: 608902 - RNA, 18 nt, Homo sapiens
uguaguccuagccacuca

SEQ ID NO: 608903 - RNA, 18 nt, Homo sapiens
uguaguguauuaaucucu

SEQ ID NO: 608904 - RNA, 15 nt, Homo sapiens
uguaguuacuguggu

SEQ ID NO: 608905 - RNA, 16 nt, Homo sapiens
uguaguucugaguccu

SEQ ID NO: 608906 - RNA, 18 nt, Homo sapiens
uguaguucugccaggcaa

SEQ ID NO: 608907 - RNA, 18 nt, Homo sapiens
uguaguuguugguuuauu

SEQ ID NO: 608908 - RNA, 19 nt, Homo sapiens
uguauaagaagauacacug

SEQ ID NO: 608909 - RNA, 15 nt, Homo sapiens
uguauaauacuuugu

SEQ ID NO: 608910 - RNA, 14 nt, Homo sapiens
uguauacacauaau

SEQ ID NO: 608911 - RNA, 16 nt, Homo sapiens
uguauacacauauaua

SEQ ID NO: 608912 - RNA, 19 nt, Homo sapiens
uguauacuauaguaccagu

SEQ ID NO: 608913 - RNA, 17 nt, Homo sapiens
uguauacuccugucacc

SEQ ID NO: 608914 - RNA, 23 nt, Homo sapiens
uguauacugaguuggaagugauu

SEQ ID NO: 608915 - RNA, 11 nt, Homo sapiens
uguauaguguu

SEQ ID NO: 608916 - RNA, 18 nt, Homo sapiens
uguauaguugcuugccug

SEQ ID NO: 608917 - RNA, 17 nt, Homo sapiens
uguauauacauuucaua

SEQ ID NO: 608918 - RNA, 22 nt, Homo sapiens
uguauauauuauuauaaucuua

SEQ ID NO: 608919 - RNA, 11 nt, Homo sapiens
uguauauccaa

SEQ ID NO: 608920 - RNA, 22 nt, Homo sapiens
uguauauccauauaacaauuca

SEQ ID NO: 608921 - RNA, 20 nt, Homo sapiens
uguauaugcauucuuuucag

SEQ ID NO: 608922 - RNA, 14 nt, Homo sapiens
uguauauguauuau

SEQ ID NO: 608923 - RNA, 17 nt, Homo sapiens
uguauauuuguacaaaa

SEQ ID NO: 608924 - RNA, 19 nt, Homo sapiens
uguauauuuugaugagcuu

SEQ ID NO: 608925 - RNA, 18 nt, Homo sapiens
uguaucaaaugugacauu

SEQ ID NO: 608926 - RNA, 22 nt, Homo sapiens
uguaucaauccaggcuacaauc

SEQ ID NO: 608927 - RNA, 17 nt, Homo sapiens
uguaucauuugaacaac

SEQ ID NO: 608928 - RNA, 20 nt, Homo sapiens
uguaucauuuuugugcacag

SEQ ID NO: 608929 - RNA, 17 nt, Homo sapiens
uguauccagaagccagu

SEQ ID NO: 608930 - RNA, 13 nt, Homo sapiens
uguauccugauaa

SEQ ID NO: 608931 - RNA, 23 nt, Homo sapiens
uguaucuacaauacauauaucua

SEQ ID NO: 608932 - RNA, 14 nt, Homo sapiens
uguaucuugccuaa

SEQ ID NO: 608933 - RNA, 18 nt, Homo sapiens
uguaugacuucugcugaa

SEQ ID NO: 608934 - RNA, 22 nt, Homo sapiens
uguaugagacaggaaaaaccaa

SEQ ID NO: 608935 - RNA, 20 nt, Homo sapiens
uguaugagagggcccugccu

SEQ ID NO: 608936 - RNA, 20 nt, Homo sapiens
uguaugaugucacacaagcu

SEQ ID NO: 608937 - RNA, 15 nt, Homo sapiens
uguaugcacgugugc

SEQ ID NO: 608938 - RNA, 22 nt, Homo sapiens
uguaugcacgugugcacacaca

SEQ ID NO: 608939 - RNA, 11 nt, Homo sapiens
uguaugcauca

SEQ ID NO: 608940 - RNA, 14 nt, Homo sapiens
uguauguguggcug

SEQ ID NO: 608941 - RNA, 17 nt, Homo sapiens
uguauguuccucuauga

SEQ ID NO: 608942 - RNA, 18 nt, Homo sapiens
uguauguugugaauuaug

SEQ ID NO: 608943 - RNA, 22 nt, Homo sapiens
uguauguuuacauaucaccuca

SEQ ID NO: 608944 - RNA, 23 nt, Homo sapiens
uguauguuuacauaucaccucau

SEQ ID NO: 608945 - RNA, 21 nt, Homo sapiens
uguauuaaaaauaaacaagca

SEQ ID NO: 608946 - RNA, 16 nt, Homo sapiens
uguauuaaaagauucc

SEQ ID NO: 608947 - RNA, 22 nt, Homo sapiens
uguauuaaaagauuccagucuu

SEQ ID NO: 608948 - RNA, 15 nt, Homo sapiens
uguauuaaugcuaua

SEQ ID NO: 608949 - RNA, 23 nt, Homo sapiens
uguauuaauguguuaagugcagg

SEQ ID NO: 608950 - RNA, 18 nt, Homo sapiens
uguauuacagcuuucaca

SEQ ID NO: 608951 - RNA, 21 nt, Homo sapiens
uguauuauaauaagcaaaaag

SEQ ID NO: 608952 - RNA, 19 nt, Homo sapiens
uguauucaccccacaccca

SEQ ID NO: 608953 - RNA, 16 nt, Homo sapiens
uguauucagaggcagu

SEQ ID NO: 608954 - RNA, 16 nt, Homo sapiens
uguauucccuuguauu

SEQ ID NO: 608955 - RNA, 20 nt, Homo sapiens
uguauugaaguccuccagac

SEQ ID NO: 608956 - RNA, 13 nt, Homo sapiens
uguauuguucuaa

SEQ ID NO: 608957 - RNA, 15 nt, Homo sapiens
uguauuuaacugccu

SEQ ID NO: 608958 - RNA, 15 nt, Homo sapiens
uguauuuauaauuua

SEQ ID NO: 608959 - RNA, 16 nt, Homo sapiens
uguauuucaagaccuc

SEQ ID NO: 608960 - RNA, 22 nt, Homo sapiens
uguauuugcugccagacacuga

SEQ ID NO: 608961 - RNA, 17 nt, Homo sapiens
uguauuuuauuacaucu

SEQ ID NO: 608962 - RNA, 16 nt, Homo sapiens
uguauuuucagcucaa

SEQ ID NO: 608963 - RNA, 18 nt, Homo sapiens
uguauuuuuaaugggggu

SEQ ID NO: 608964 - RNA, 17 nt, Homo sapiens
ugucaaaacuacugaca

SEQ ID NO: 608965 - RNA, 14 nt, Homo sapiens
ugucaaaagccaga

SEQ ID NO: 608966 - RNA, 17 nt, Homo sapiens
ugucaaagaaggugcug

SEQ ID NO: 608967 - RNA, 22 nt, Homo sapiens
ugucaaauggagcugaauuuga

SEQ ID NO: 608968 - RNA, 18 nt, Homo sapiens
ugucaacauugugaugua

SEQ ID NO: 608969 - RNA, 18 nt, Homo sapiens
ugucaagcuuacuacagu

SEQ ID NO: 608970 - RNA, 14 nt, Homo sapiens
ugucaaguacaagc

SEQ ID NO: 608971 - RNA, 12 nt, Homo sapiens
ugucaaugcagg

SEQ ID NO: 608972 - RNA, 20 nt, Homo sapiens
ugucaaugugaacguccaca

SEQ ID NO: 608973 - RNA, 21 nt, Homo sapiens
ugucacaaauaaacauaauaa

SEQ ID NO: 608974 - RNA, 13 nt, Homo sapiens
ugucacaaccaag

SEQ ID NO: 608975 - RNA, 14 nt, Homo sapiens
ugucacacacugga

SEQ ID NO: 608976 - RNA, 19 nt, Homo sapiens
ugucacacgauaaagggau

SEQ ID NO: 608977 - RNA, 20 nt, Homo sapiens
ugucacagaagcagcuaaac

SEQ ID NO: 608978 - RNA, 12 nt, Homo sapiens
ugucacagggac

SEQ ID NO: 608979 - RNA, 23 nt, Homo sapiens
ugucaccaacugaaguggcuaaa

SEQ ID NO: 608980 - RNA, 14 nt, Homo sapiens
ugucaccaugccca

SEQ ID NO: 608981 - RNA, 15 nt, Homo sapiens
ugucacccaaagccu

SEQ ID NO: 608982 - RNA, 16 nt, Homo sapiens
ugucacccaaagccug

SEQ ID NO: 608983 - RNA, 19 nt, Homo sapiens
ugucaccguggaccuuccu

SEQ ID NO: 608984 - RNA, 11 nt, Homo sapiens
ugucacuaaac

SEQ ID NO: 608985 - RNA, 16 nt, Homo sapiens
ugucacuaaacucuca

SEQ ID NO: 608986 - RNA, 18 nt, Homo sapiens
ugucacuaaacucucauu

SEQ ID NO: 608987 - RNA, 13 nt, Homo sapiens
ugucacugccaac

SEQ ID NO: 608988 - RNA, 20 nt, Homo sapiens
ugucacuggcagagcacagc

SEQ ID NO: 608989 - RNA, 22 nt, Homo sapiens
ugucacuucuucaccucuucca

SEQ ID NO: 608990 - RNA, 21 nt, Homo sapiens
ugucacuugaccaauacugac

SEQ ID NO: 608991 - RNA, 22 nt, Homo sapiens
ugugccccauguccaaguccaa

SEQ ID NO: 608992 - RNA, 18 nt, Homo sapiens
ugugccugcucagcagcc

SEQ ID NO: 608993 - RNA, 21 nt, Homo sapiens
ugugccugggaucgugcauuu

SEQ ID NO: 608994 - RNA, 23 nt, Homo sapiens
ugugccugucuguuacacuggag

SEQ ID NO: 608995 - RNA, 17 nt, Homo sapiens
ugugcgccugagugagu

SEQ ID NO: 608996 - RNA, 15 nt, Homo sapiens
ugugcgucucucuuu

SEQ ID NO: 608997 - RNA, 14 nt, Homo sapiens
ugugcuacaauuca

SEQ ID NO: 608998 - RNA, 19 nt, Homo sapiens
ugugcucauuuugcaauuu

SEQ ID NO: 608999 - RNA, 16 nt, Homo sapiens
ugugcuccccugccac

SEQ ID NO: 609000 - RNA, 22 nt, Homo sapiens
ugugcugaauacgcuaagccug

SEQ ID NO: 609001 - RNA, 21 nt, Homo sapiens
ugugcugacucuggccuuaca

SEQ ID NO: 609002 - RNA, 11 nt, Homo sapiens
ugugcugccau

SEQ ID NO: 609003 - RNA, 12 nt, Homo sapiens
ugugcugcucaa

SEQ ID NO: 609004 - RNA, 15 nt, Homo sapiens
ugugcuggacacugu

SEQ ID NO: 609005 - RNA, 22 nt, Homo sapiens
ugugcuggacacuguccaugaa

SEQ ID NO: 609006 - RNA, 18 nt, Homo sapiens
ugugcugggauuacaggc

SEQ ID NO: 609007 - RNA, 18 nt, Homo sapiens
ugugcuggucauggaaug

SEQ ID NO: 609008 - RNA, 16 nt, Homo sapiens
ugugcuggugaacacu

SEQ ID NO: 609009 - RNA, 20 nt, Homo sapiens
ugugcuggugaacacuguga

SEQ ID NO: 609010 - RNA, 12 nt, Homo sapiens
ugugcugugacu

SEQ ID NO: 609011 - RNA, 20 nt, Homo sapiens
ugugcuucagugccauugca

SEQ ID NO: 609012 - RNA, 22 nt, Homo sapiens
ugugcuuuuugggaccaucacu

SEQ ID NO: 609013 - RNA, 14 nt, Homo sapiens
uguggaaaauggag

SEQ ID NO: 609014 - RNA, 19 nt, Homo sapiens
uguggaauugacucaaaaa

SEQ ID NO: 609015 - RNA, 14 nt, Homo sapiens
uguggacacagauc

SEQ ID NO: 609016 - RNA, 17 nt, Homo sapiens
uguggacuaaauaucug

SEQ ID NO: 609017 - RNA, 20 nt, Homo sapiens
uguggagagagaggcuucaa

SEQ ID NO: 609018 - RNA, 22 nt, Homo sapiens
uguggagagcuuauacagagcc

SEQ ID NO: 609019 - RNA, 17 nt, Homo sapiens
uguggagccccagcaua

SEQ ID NO: 609020 - RNA, 21 nt, Homo sapiens
uguggagcgccagcucugccc

SEQ ID NO: 609021 - RNA, 21 nt, Homo sapiens
uguggaucaaccaucgcuuua

SEQ ID NO: 609022 - RNA, 12 nt, Homo sapiens
uguggaugcuag

SEQ ID NO: 609023 - RNA, 18 nt, Homo sapiens
uguggcacuugggcauuu

SEQ ID NO: 609024 - RNA, 15 nt, Homo sapiens
uguggcagugguuuu

SEQ ID NO: 609025 - RNA, 17 nt, Homo sapiens
uguggcaucuugccaag

SEQ ID NO: 609026 - RNA, 17 nt, Homo sapiens
uguggccaacugcaaaa

SEQ ID NO: 609027 - RNA, 15 nt, Homo sapiens
uguggccacaaucca

SEQ ID NO: 609028 - RNA, 14 nt, Homo sapiens
uguggcccaagaca

SEQ ID NO: 609029 - RNA, 15 nt, Homo sapiens
uguggccccuuuuac

SEQ ID NO: 609030 - RNA, 18 nt, Homo sapiens
uguggcccuccaguguau

SEQ ID NO: 609031 - RNA, 20 nt, Homo sapiens
uguggccgccaccugaggug

SEQ ID NO: 609032 - RNA, 17 nt, Homo sapiens
uguggcucacgugugug

SEQ ID NO: 609033 - RNA, 17 nt, Homo sapiens
uguggcugcuagcacuu

SEQ ID NO: 609034 - RNA, 14 nt, Homo sapiens
ugugggcugugagu

SEQ ID NO: 609035 - RNA, 18 nt, Homo sapiens
ugugggcugugggcugca

SEQ ID NO: 609036 - RNA, 14 nt, Homo sapiens
ugugggcuugacca

SEQ ID NO: 609037 - RNA, 18 nt, Homo sapiens
uguggggugggcacauug

SEQ ID NO: 609038 - RNA, 15 nt, Homo sapiens
uguggguauguguuu

SEQ ID NO: 609039 - RNA, 17 nt, Homo sapiens
ugugggucaaaccaaga

SEQ ID NO: 609040 - RNA, 15 nt, Homo sapiens
ugugggucucuggaa

SEQ ID NO: 609041 - RNA, 14 nt, Homo sapiens
ugugggugggacca

SEQ ID NO: 609042 - RNA, 18 nt, Homo sapiens
ugugggugggaccacaga

SEQ ID NO: 609043 - RNA, 22 nt, Homo sapiens
ugugggugggaccacagacuca

SEQ ID NO: 609044 - RNA, 16 nt, Homo sapiens
ugugggugucagucag

SEQ ID NO: 609045 - RNA, 23 nt, Homo sapiens
uguggguucuccuguucucucug

SEQ ID NO: 609046 - RNA, 20 nt, Homo sapiens
uguggguuucucugugcucu

SEQ ID NO: 609047 - RNA, 13 nt, Homo sapiens
ugugguagccuca

SEQ ID NO: 609048 - RNA, 21 nt, Homo sapiens
uguggucaauccgaaguauga

SEQ ID NO: 609049 - RNA, 11 nt, Homo sapiens
uguggucacag

SEQ ID NO: 609050 - RNA, 18 nt, Homo sapiens
uguggucagcagaugcca

SEQ ID NO: 609051 - RNA, 14 nt, Homo sapiens
uguggugaggggcu

SEQ ID NO: 609052 - RNA, 19 nt, Homo sapiens
uguggugucuguguuccaa

SEQ ID NO: 609053 - RNA, 16 nt, Homo sapiens
ugugguuacaguuuga

SEQ ID NO: 609054 - RNA, 14 nt, Homo sapiens
ugugguuacuuccu

SEQ ID NO: 609055 - RNA, 19 nt, Homo sapiens
ugugguuccaugcagccuu

SEQ ID NO: 609056 - RNA, 13 nt, Homo sapiens
ugugguuguaaau

SEQ ID NO: 609057 - RNA, 18 nt, Homo sapiens
ugugguuugguuggggcu

SEQ ID NO: 609058 - RNA, 15 nt, Homo sapiens
uguguaaauuucuca

SEQ ID NO: 609059 - RNA, 22 nt, Homo sapiens
uguguaacuguaaaacauugaa

SEQ ID NO: 609060 - RNA, 19 nt, Homo sapiens
uguguaagaaauacagacu

SEQ ID NO: 609061 - RNA, 16 nt, Homo sapiens
uguguaauugauuuau

SEQ ID NO: 609062 - RNA, 13 nt, Homo sapiens
uguguacaaagug

SEQ ID NO: 609063 - RNA, 15 nt, Homo sapiens
uguguacauugaggu

SEQ ID NO: 609064 - RNA, 12 nt, Homo sapiens
uguguacccugg

SEQ ID NO: 609065 - RNA, 20 nt, Homo sapiens
uguguaccugugacuaaaca

SEQ ID NO: 609066 - RNA, 16 nt, Homo sapiens
uguguacugcaguugg

SEQ ID NO: 609067 - RNA, 14 nt, Homo sapiens
uguguacuggucag

SEQ ID NO: 609068 - RNA, 12 nt, Homo sapiens
uguguacugugg

SEQ ID NO: 609069 - RNA, 18 nt, Homo sapiens
uguguagcucucacaugc

SEQ ID NO: 609070 - RNA, 19 nt, Homo sapiens
uguguaugcugaugaucaa

SEQ ID NO: 609071 - RNA, 14 nt, Homo sapiens
uguguaugggggaa

SEQ ID NO: 609072 - RNA, 13 nt, Homo sapiens
uguguaugugcau

SEQ ID NO: 609073 - RNA, 18 nt, Homo sapiens
uguguauuuaacagggag

SEQ ID NO: 609074 - RNA, 21 nt, Homo sapiens
uguguauuuacgcuuugauuc

SEQ ID NO: 609075 - RNA, 22 nt, Homo sapiens
uguguauuuguauuaauaaagc

SEQ ID NO: 609076 - RNA, 14 nt, Homo sapiens
ugugucaaaacugg

SEQ ID NO: 609077 - RNA, 23 nt, Homo sapiens
ugugucagaaaaaggaaaccaca

SEQ ID NO: 609078 - RNA, 14 nt, Homo sapiens
uguguccaagacac

SEQ ID NO: 609079 - RNA, 19 nt, Homo sapiens
uguguccaugugugugcaa

SEQ ID NO: 609080 - RNA, 14 nt, Homo sapiens
ugugucccaugacc

SEQ ID NO: 609081 - RNA, 15 nt, Homo sapiens
uguguccucagggag

SEQ ID NO: 609082 - RNA, 21 nt, Homo sapiens
uguguccucuuccaccacaga

SEQ ID NO: 609083 - RNA, 13 nt, Homo sapiens
uguguccugauga

SEQ ID NO: 609084 - RNA, 12 nt, Homo sapiens
uguguccugggg

SEQ ID NO: 609085 - RNA, 21 nt, Homo sapiens
uguguccuguccuuucuugca

SEQ ID NO: 609086 - RNA, 22 nt, Homo sapiens
ugugucugccccuaugugacag

SEQ ID NO: 609087 - RNA, 13 nt, Homo sapiens
ugugucuuuccag

SEQ ID NO: 609088 - RNA, 21 nt, Homo sapiens
ugugugaaacaauguugucca

SEQ ID NO: 609089 - RNA, 14 nt, Homo sapiens
ugugugaacgugua

SEQ ID NO: 609090 - RNA, 13 nt, Homo sapiens
ugugugacauucc

SEQ ID NO: 609091 - RNA, 23 nt, Homo sapiens
ugugugacuuugggcaagccaag

SEQ ID NO: 609092 - RNA, 17 nt, Homo sapiens
ugugugagugugugcaa

SEQ ID NO: 609093 - RNA, 21 nt, Homo sapiens
ugugugagugugugcaaguau

SEQ ID NO: 609094 - RNA, 13 nt, Homo sapiens
ugugugcaagugu

SEQ ID NO: 609095 - RNA, 20 nt, Homo sapiens
ugugugcagggggugggugu

SEQ ID NO: 609096 - RNA, 14 nt, Homo sapiens
ugugugcaucaugu

SEQ ID NO: 609097 - RNA, 15 nt, Homo sapiens
ugugugcaugugugc

SEQ ID NO: 609098 - RNA, 14 nt, Homo sapiens
ugugugccacucag

SEQ ID NO: 609099 - RNA, 17 nt, Homo sapiens
ugugugccaugucacag

SEQ ID NO: 609100 - RNA, 19 nt, Homo sapiens
ugugugccuuuguuuccca

SEQ ID NO: 609101 - RNA, 17 nt, Homo sapiens
ugugugcgugugcgugc

SEQ ID NO: 609102 - RNA, 20 nt, Homo sapiens
ugugugcuucugcucauuac

SEQ ID NO: 609103 - RNA, 14 nt, Homo sapiens
uguguggacuguga

SEQ ID NO: 609104 - RNA, 20 nt, Homo sapiens
uguguggcaaugggauuugg

SEQ ID NO: 609105 - RNA, 15 nt, Homo sapiens
uguguggcaguucuc

SEQ ID NO: 609106 - RNA, 14 nt, Homo sapiens
ugugugggcuguga

SEQ ID NO: 609107 - RNA, 14 nt, Homo sapiens
uguguguaccugug

SEQ ID NO: 609108 - RNA, 12 nt, Homo sapiens
uguguguagcca

SEQ ID NO: 609109 - RNA, 13 nt, Homo sapiens
uguguguagccaa

SEQ ID NO: 609110 - RNA, 16 nt, Homo sapiens
uguguguauguauaca

SEQ ID NO: 609111 - RNA, 14 nt, Homo sapiens
ugugugugaacugg

SEQ ID NO: 609112 - RNA, 15 nt, Homo sapiens
ugugugugcaagugu

SEQ ID NO: 609113 - RNA, 12 nt, Homo sapiens
ugugugugcaug

SEQ ID NO: 609114 - RNA, 13 nt, Homo sapiens
ugugugugccaug

SEQ ID NO: 609115 - RNA, 22 nt, Homo sapiens
uggggucucucucccuaccucc

SEQ ID NO: 609116 - RNA, 22 nt, Homo sapiens
uggggucugugaucacccucuc

SEQ ID NO: 609117 - RNA, 18 nt, Homo sapiens
ugggguggggauagggag

SEQ ID NO: 609118 - RNA, 17 nt, Homo sapiens
ugggguuucaccaucuu

SEQ ID NO: 609119 - RNA, 17 nt, Homo sapiens
ugggguuugaagcugac

SEQ ID NO: 609120 - RNA, 22 nt, Homo sapiens
uggguaauaaccaagauggagu

SEQ ID NO: 609121 - RNA, 22 nt, Homo sapiens
uggguauauacccaaaggaaua

SEQ ID NO: 609122 - RNA, 21 nt, Homo sapiens
uggguaucgcugagacuaagu

SEQ ID NO: 609123 - RNA, 15 nt, Homo sapiens
aaaagcccacgucag

SEQ ID NO: 609124 - RNA, 20 nt, Homo sapiens
aaaagcccagcaucacugau

SEQ ID NO: 609125 - RNA, 15 nt, Homo sapiens
aaaagcccccaguua

SEQ ID NO: 609126 - RNA, 16 nt, Homo sapiens
aaaagcccccaguuaa

SEQ ID NO: 609127 - RNA, 16 nt, Homo sapiens
aaaagcgacccauuca

SEQ ID NO: 609128 - RNA, 14 nt, Homo sapiens
aaaagcguauuuaa

SEQ ID NO: 609129 - RNA, 17 nt, Homo sapiens
aaaagcucagaugacau

SEQ ID NO: 609130 - RNA, 13 nt, Homo sapiens
aaaagcugggcag

SEQ ID NO: 609131 - RNA, 22 nt, Homo sapiens
aaaagcuuaaaaaaauuacugu

SEQ ID NO: 609132 - RNA, 21 nt, Homo sapiens
aaaagcuuuaaaugucugcau

SEQ ID NO: 609133 - RNA, 10 nt, Homo sapiens
aaaagcuuuu

SEQ ID NO: 609134 - RNA, 13 nt, Homo sapiens
aaaaggaaauuug

SEQ ID NO: 609135 - RNA, 17 nt, Homo sapiens
aaaaggcauaugcaaua

SEQ ID NO: 609136 - RNA, 13 nt, Homo sapiens
aaaaggcccucug

SEQ ID NO: 609137 - RNA, 21 nt, Homo sapiens
aaaagggauccguacauucaa

SEQ ID NO: 609138 - RNA, 18 nt, Homo sapiens
aaaagggcagggcaucuc

SEQ ID NO: 609139 - RNA, 15 nt, Homo sapiens
aaaagggccaggugc

SEQ ID NO: 609140 - RNA, 13 nt, Homo sapiens
aaaaggggcuccu

SEQ ID NO: 609141 - RNA, 21 nt, Homo sapiens
aaaaggggcuccuugcuccac

SEQ ID NO: 609142 - RNA, 20 nt, Homo sapiens
aaaaggucauagcugagauu

SEQ ID NO: 609143 - RNA, 20 nt, Homo sapiens
aaaaggucuguuaaugucau

SEQ ID NO: 609144 - RNA, 13 nt, Homo sapiens
aaaaguaacacag

SEQ ID NO: 609145 - RNA, 23 nt, Homo sapiens
aaaaguaaccugaacuaaucuga

SEQ ID NO: 609146 - RNA, 15 nt, Homo sapiens
aaaaguaagcccuug

SEQ ID NO: 609147 - RNA, 18 nt, Homo sapiens
aaaaguaaugaagaaaau

SEQ ID NO: 609148 - RNA, 16 nt, Homo sapiens
aaaaguauuauucucu

SEQ ID NO: 609149 - RNA, 18 nt, Homo sapiens
aaaagucagagacagaua

SEQ ID NO: 609150 - RNA, 23 nt, Homo sapiens
aaaagucagagacagauaccucc

SEQ ID NO: 609151 - RNA, 16 nt, Homo sapiens
aaaagucagcgugaca

SEQ ID NO: 609152 - RNA, 14 nt, Homo sapiens
aaaagucaguauca

SEQ ID NO: 609153 - RNA, 16 nt, Homo sapiens
aaaagucccucccugc

SEQ ID NO: 609154 - RNA, 19 nt, Homo sapiens
aaaaguccuugauuuagca

SEQ ID NO: 609155 - RNA, 14 nt, Homo sapiens
aaaagucuucacuc

SEQ ID NO: 609156 - RNA, 17 nt, Homo sapiens
aaaagugaaccaucuca

SEQ ID NO: 609157 - RNA, 13 nt, Homo sapiens
aaaagugaaucuu

SEQ ID NO: 609158 - RNA, 12 nt, Homo sapiens
aaaagugcuaua

SEQ ID NO: 609159 - RNA, 22 nt, Homo sapiens
aaaaguggcauuuccuggucag

SEQ ID NO: 609160 - RNA, 13 nt, Homo sapiens
aaaagugggcaaa

SEQ ID NO: 609161 - RNA, 22 nt, Homo sapiens
aaaaguuggucaggcgcagugg

SEQ ID NO: 609162 - RNA, 19 nt, Homo sapiens
aaaaguugguguugacaua

SEQ ID NO: 609163 - RNA, 21 nt, Homo sapiens
aaaaguugguguugacauaca

SEQ ID NO: 609164 - RNA, 23 nt, Homo sapiens
aaaaguuuagccccugaaagcca

SEQ ID NO: 609165 - RNA, 17 nt, Homo sapiens
aaaauaaaacacauuua

SEQ ID NO: 609166 - RNA, 14 nt, Homo sapiens
aaaauaaaagacua

SEQ ID NO: 609167 - RNA, 18 nt, Homo sapiens
aaaauaaaagaucuugaa

SEQ ID NO: 609168 - RNA, 19 nt, Homo sapiens
aaaauaaaagaucuugaau

SEQ ID NO: 609169 - RNA, 23 nt, Homo sapiens
aaaauaaaauguuucauuaugca

SEQ ID NO: 609170 - RNA, 12 nt, Homo sapiens
aaaauaaagcug

SEQ ID NO: 609171 - RNA, 12 nt, Homo sapiens
aaaauaaauuca

SEQ ID NO: 609172 - RNA, 14 nt, Homo sapiens
aaaauaaauuugca

SEQ ID NO: 609173 - RNA, 16 nt, Homo sapiens
aaaauaagaaaauaac

SEQ ID NO: 609174 - RNA, 14 nt, Homo sapiens
aaaauaauuguucc

SEQ ID NO: 609175 - RNA, 16 nt, Homo sapiens
aaaauacagcuaugaa

SEQ ID NO: 609176 - RNA, 17 nt, Homo sapiens
aaaauacaugcaucuca

SEQ ID NO: 609177 - RNA, 12 nt, Homo sapiens
aaaauaccaaau

SEQ ID NO: 609178 - RNA, 16 nt, Homo sapiens
aaaauaccaaucacaa

SEQ ID NO: 609179 - RNA, 10 nt, Homo sapiens
aaaauacuug

SEQ ID NO: 609180 - RNA, 20 nt, Homo sapiens
aaaauagaaauauagccaaa

SEQ ID NO: 609181 - RNA, 14 nt, Homo sapiens
aaaauagacaugua

SEQ ID NO: 609182 - RNA, 15 nt, Homo sapiens
aaaauagacauguag

SEQ ID NO: 609183 - RNA, 22 nt, Homo sapiens
aaaauagauccaaucaguuuau

SEQ ID NO: 609184 - RNA, 13 nt, Homo sapiens
aaaauagcaacac

SEQ ID NO: 609185 - RNA, 20 nt, Homo sapiens
aaaauagcuaaauaccucaa

SEQ ID NO: 609186 - RNA, 18 nt, Homo sapiens
aaaauaggauugcuucaa

SEQ ID NO: 609187 - RNA, 13 nt, Homo sapiens
aaaauaguaaugu

SEQ ID NO: 609188 - RNA, 19 nt, Homo sapiens
aaaauaguacacacauaua

SEQ ID NO: 609189 - RNA, 23 nt, Homo sapiens
aaaauagucauuuuuagcacugg

SEQ ID NO: 609190 - RNA, 22 nt, Homo sapiens
aaaauaguguaagaacuguaca

SEQ ID NO: 609191 - RNA, 18 nt, Homo sapiens
aaaauaguuaagacauga

SEQ ID NO: 609192 - RNA, 17 nt, Homo sapiens
aaaauauaaguggugcu

SEQ ID NO: 609193 - RNA, 12 nt, Homo sapiens
aaaauauaucau

SEQ ID NO: 609194 - RNA, 13 nt, Homo sapiens
aaaauauauguau

SEQ ID NO: 609195 - RNA, 21 nt, Homo sapiens
aaaauauauuucagauaucag

SEQ ID NO: 609196 - RNA, 10 nt, Homo sapiens
aaaauaugcc

SEQ ID NO: 609197 - RNA, 14 nt, Homo sapiens
aaaauauggcuaua

SEQ ID NO: 609198 - RNA, 19 nt, Homo sapiens
aaaauauguauuuaccaaa

SEQ ID NO: 609199 - RNA, 17 nt, Homo sapiens
aaaauauuuuuucugua

SEQ ID NO: 609200 - RNA, 14 nt, Homo sapiens
aaaaucaacaugac

SEQ ID NO: 609201 - RNA, 14 nt, Homo sapiens
aaaaucaaguucua

SEQ ID NO: 609202 - RNA, 18 nt, Homo sapiens
aaaaucacaggacauuaa

SEQ ID NO: 609203 - RNA, 20 nt, Homo sapiens
aaaaucacucacaagcaauc

SEQ ID NO: 609204 - RNA, 16 nt, Homo sapiens
aaaaucacuucagauc

SEQ ID NO: 609205 - RNA, 17 nt, Homo sapiens
aaaaucauucuacugaa

SEQ ID NO: 609206 - RNA, 13 nt, Homo sapiens
aaaauccaaggca

SEQ ID NO: 609207 - RNA, 19 nt, Homo sapiens
aaaauccaugaacaauuua

SEQ ID NO: 609208 - RNA, 14 nt, Homo sapiens
aaaaucccaugaga

SEQ ID NO: 609209 - RNA, 22 nt, Homo sapiens
aaaauccuaagacacaaaugca

SEQ ID NO: 609210 - RNA, 23 nt, Homo sapiens
aaaauccuuuuggcauguuccca

SEQ ID NO: 609211 - RNA, 22 nt, Homo sapiens
aaaaucuauauuugucuuccga

SEQ ID NO: 609212 - RNA, 13 nt, Homo sapiens
aaaaucuccaucu

SEQ ID NO: 609213 - RNA, 15 nt, Homo sapiens
aaaaucuccaucuca

SEQ ID NO: 609214 - RNA, 16 nt, Homo sapiens
aaaaucuccaucucaa

SEQ ID NO: 609215 - RNA, 21 nt, Homo sapiens
aaaaucucccagugacaacau

SEQ ID NO: 609216 - RNA, 12 nt, Homo sapiens
aaaaucugucca

SEQ ID NO: 609217 - RNA, 14 nt, Homo sapiens
aaaaucuguucuaa

SEQ ID NO: 609218 - RNA, 19 nt, Homo sapiens
aaaaugaaagcaugucuca

SEQ ID NO: 609219 - RNA, 21 nt, Homo sapiens
aaaaugacaauaucaaucaca

SEQ ID NO: 609220 - RNA, 13 nt, Homo sapiens
aaaaugacuuuau

SEQ ID NO: 609221 - RNA, 12 nt, Homo sapiens
aaaaugagacaa

SEQ ID NO: 609222 - RNA, 20 nt, Homo sapiens
aaaaugagacuuacugggug

SEQ ID NO: 609223 - RNA, 16 nt, Homo sapiens
aaaaugagacuuucua

SEQ ID NO: 609224 - RNA, 18 nt, Homo sapiens
aaaaugagagcuguaacu

SEQ ID NO: 609225 - RNA, 13 nt, Homo sapiens
aaaaugagugcuu

SEQ ID NO: 609226 - RNA, 19 nt, Homo sapiens
aaaaugaguugugaugaau

SEQ ID NO: 609227 - RNA, 19 nt, Homo sapiens
aaaaugauuggccccaguc

SEQ ID NO: 609228 - RNA, 14 nt, Homo sapiens
aaaaugcaaaagca

SEQ ID NO: 609229 - RNA, 17 nt, Homo sapiens
aaaaugcaaaagcacau

SEQ ID NO: 609230 - RNA, 20 nt, Homo sapiens
aaaaugcaauguaagcauac

SEQ ID NO: 609231 - RNA, 14 nt, Homo sapiens
aaaaugccaugaaa

SEQ ID NO: 609232 - RNA, 22 nt, Homo sapiens
aaaaugccucaauucacauaga

SEQ ID NO: 609233 - RNA, 24 nt, Homo sapiens
aaaaugcucaaucucagcuaacau

SEQ ID NO: 609234 - RNA, 16 nt, Homo sapiens
aaaaugcugcuuuguc

SEQ ID NO: 609235 - RNA, 16 nt, Homo sapiens
aaaauggaaaagagag

SEQ ID NO: 609236 - RNA, 20 nt, Homo sapiens
aaaauggaagcaaagacaaa

SEQ ID NO: 609237 - RNA, 23 nt, Homo sapiens
aaaauggacaaaauccaugaaca

SEQ ID NO: 609238 - RNA, 14 nt, Homo sapiens
aaaauggagccaug

SEQ ID NO: 609239 - RNA, 21 nt, Homo sapiens
aaaauggcaaagaauucaaac

SEQ ID NO: 609240 - RNA, 20 nt, Homo sapiens
aaaauggcaccuucccccuu

SEQ ID NO: 609241 - RNA, 18 nt, Homo sapiens
aaaauggcagugguggcc

SEQ ID NO: 609242 - RNA, 16 nt, Homo sapiens
aaaauggccauuugcu

SEQ ID NO: 609243 - RNA, 19 nt, Homo sapiens
aaaaugguggucuucucca

SEQ ID NO: 609244 - RNA, 17 nt, Homo sapiens
aaaaugguuuguccuga

SEQ ID NO: 609245 - RNA, 16 nt, Homo sapiens
aaaauguaauuacuua

SEQ ID NO: 609246 - RNA, 16 nt, Homo sapiens
aaagaagauaaacaca

SEQ ID NO: 609247 - RNA, 20 nt, Homo sapiens
aaagaagauaaacacaaaau

SEQ ID NO: 609248 - RNA, 17 nt, Homo sapiens
aaagaaggaagugaaga

SEQ ID NO: 609249 - RNA, 12 nt, Homo sapiens
aaagaaguacuu

SEQ ID NO: 609250 - RNA, 22 nt, Homo sapiens
aaagaaguccgcuggcacccau

SEQ ID NO: 609251 - RNA, 14 nt, Homo sapiens
aaagaauacagaaa

SEQ ID NO: 609252 - RNA, 14 nt, Homo sapiens
aaagaaucagucuu

SEQ ID NO: 609253 - RNA, 23 nt, Homo sapiens
aaagaaucccaauguuugacaaa

SEQ ID NO: 609254 - RNA, 22 nt, Homo sapiens
aaagaauccuuagaugccuaaa

SEQ ID NO: 609255 - RNA, 17 nt, Homo sapiens
aaagaauguuacugccu

SEQ ID NO: 609256 - RNA, 21 nt, Homo sapiens
aaagaauguuacugccuuaau

SEQ ID NO: 609257 - RNA, 15 nt, Homo sapiens
aaagaauuccaaagc

SEQ ID NO: 609258 - RNA, 16 nt, Homo sapiens
aaagaauuuuaccauu

SEQ ID NO: 609259 - RNA, 21 nt, Homo sapiens
aaagacaauaaaacacuuuug

SEQ ID NO: 609260 - RNA, 15 nt, Homo sapiens
aaagacacaugcacg

SEQ ID NO: 609261 - RNA, 22 nt, Homo sapiens
aaagacagucgagaagccaggg

SEQ ID NO: 609262 - RNA, 12 nt, Homo sapiens
aaagacaucaaa

SEQ ID NO: 609263 - RNA, 14 nt, Homo sapiens
aaagaccaggccaa

SEQ ID NO: 609264 - RNA, 20 nt, Homo sapiens
aaagaccagggcuuuuccca

SEQ ID NO: 609265 - RNA, 12 nt, Homo sapiens
aaagaccaguuu

SEQ ID NO: 609266 - RNA, 19 nt, Homo sapiens
aaagacccaacuugccaaa

SEQ ID NO: 609267 - RNA, 22 nt, Homo sapiens
aaagacggauggcaggauccaa

SEQ ID NO: 609268 - RNA, 21 nt, Homo sapiens
aaagacguucuuuugcauaaa

SEQ ID NO: 609269 - RNA, 14 nt, Homo sapiens
aaagacuaacuuga

SEQ ID NO: 609270 - RNA, 19 nt, Homo sapiens
aaagacuguacaaaguaga

SEQ ID NO: 609271 - RNA, 21 nt, Homo sapiens
aaagacuguagaagaaagagc

SEQ ID NO: 609272 - RNA, 18 nt, Homo sapiens
aaagacugugcugagaag

SEQ ID NO: 609273 - RNA, 16 nt, Homo sapiens
aaagacuuccuugcag

SEQ ID NO: 609274 - RNA, 23 nt, Homo sapiens
aaagacuuuuaugugagauuucc

SEQ ID NO: 609275 - RNA, 22 nt, Homo sapiens
aaagacuuuuuuuuaacacuuu

SEQ ID NO: 609276 - RNA, 22 nt, Homo sapiens
aaagagaacaccuccagcuuuu

SEQ ID NO: 609277 - RNA, 23 nt, Homo sapiens
aaagagaagcaaacaaugguguc

SEQ ID NO: 609278 - RNA, 13 nt, Homo sapiens
aaagagaagccaa

SEQ ID NO: 609279 - RNA, 17 nt, Homo sapiens
aaagagagcucuaacca

SEQ ID NO: 609280 - RNA, 15 nt, Homo sapiens
aaagagauaguucua

SEQ ID NO: 609281 - RNA, 21 nt, Homo sapiens
aaagagcaacaauccaucucu

SEQ ID NO: 609282 - RNA, 18 nt, Homo sapiens
aaagagcuuugugauaua

SEQ ID NO: 609283 - RNA, 14 nt, Homo sapiens
aaagaggaagcaaa

SEQ ID NO: 609284 - RNA, 20 nt, Homo sapiens
aaagaggcugccccucucac

SEQ ID NO: 609285 - RNA, 16 nt, Homo sapiens
aaagagggacaggcug

SEQ ID NO: 609286 - RNA, 14 nt, Homo sapiens
aaagauacagggga

SEQ ID NO: 609287 - RNA, 20 nt, Homo sapiens
aaagauaggaggaaccacaa

SEQ ID NO: 609288 - RNA, 21 nt, Homo sapiens
aaagauaguugauucuugccu

SEQ ID NO: 609289 - RNA, 16 nt, Homo sapiens
aaagauccagccucau

SEQ ID NO: 609290 - RNA, 23 nt, Homo sapiens
aaagaucguuuaaaaacaaagga

SEQ ID NO: 609291 - RNA, 14 nt, Homo sapiens
aaagaucuucuuua

SEQ ID NO: 609292 - RNA, 21 nt, Homo sapiens
aaagaucuugaauagucucau

SEQ ID NO: 609293 - RNA, 20 nt, Homo sapiens
aaagaugaucuacucagaaa

SEQ ID NO: 609294 - RNA, 14 nt, Homo sapiens
aaagaugauuucuc

SEQ ID NO: 609295 - RNA, 15 nt, Homo sapiens
aaagaugauuucuca

SEQ ID NO: 609296 - RNA, 17 nt, Homo sapiens
aaagaugccacauucaa

SEQ ID NO: 609297 - RNA, 15 nt, Homo sapiens
aaagaugcccacuga

SEQ ID NO: 609298 - RNA, 15 nt, Homo sapiens
aaagauggaugugcu

SEQ ID NO: 609299 - RNA, 23 nt, Homo sapiens
aaagauggccauauuaccccuuu

SEQ ID NO: 609300 - RNA, 21 nt, Homo sapiens
aaagauucgucaacuuucuua

SEQ ID NO: 609301 - RNA, 15 nt, Homo sapiens
aaagauucugucuua

SEQ ID NO: 609302 - RNA, 15 nt, Homo sapiens
aaagauuuggaaaac

SEQ ID NO: 609303 - RNA, 9 nt, Homo sapiens
aaagcaaaa

SEQ ID NO: 609304 - RNA, 21 nt, Homo sapiens
aaagcaaaggcagucccggga

SEQ ID NO: 609305 - RNA, 23 nt, Homo sapiens
aaagcaauauuuuggaguauguu

SEQ ID NO: 609306 - RNA, 12 nt, Homo sapiens
aaagcacacuca

SEQ ID NO: 609307 - RNA, 21 nt, Homo sapiens
aaagcacacucauccccucac

SEQ ID NO: 609308 - RNA, 19 nt, Homo sapiens
aaagcacauguauugacaa

SEQ ID NO: 609309 - RNA, 21 nt, Homo sapiens
aaagcaccagcaggcacguua

SEQ ID NO: 609310 - RNA, 15 nt, Homo sapiens
aaagcaccuuagcug

SEQ ID NO: 609311 - RNA, 15 nt, Homo sapiens
aaagcacuacaauca

SEQ ID NO: 609312 - RNA, 16 nt, Homo sapiens
aaagcagacagucaca

SEQ ID NO: 609313 - RNA, 14 nt, Homo sapiens
aaagcagauacuug

SEQ ID NO: 609314 - RNA, 21 nt, Homo sapiens
aaagcaggauuauuaagugau

SEQ ID NO: 609315 - RNA, 23 nt, Homo sapiens
aaagcaguauauaauaacuuuau

SEQ ID NO: 609316 - RNA, 13 nt, Homo sapiens
aaagcaguauuug

SEQ ID NO: 609317 - RNA, 22 nt, Homo sapiens
aaagcaguuacuaauaugccua

SEQ ID NO: 609318 - RNA, 13 nt, Homo sapiens
aaagcauaaagcu

SEQ ID NO: 609319 - RNA, 23 nt, Homo sapiens
aaagcauacaagauucuuccuuu

SEQ ID NO: 609320 - RNA, 20 nt, Homo sapiens
aaagcaucaauacaaccagc

SEQ ID NO: 609321 - RNA, 21 nt, Homo sapiens
aaagcaucaauacaaccagcc

SEQ ID NO: 609322 - RNA, 22 nt, Homo sapiens
aaagcauccauguguggacuca

SEQ ID NO: 609323 - RNA, 12 nt, Homo sapiens
aaagcaugauau

SEQ ID NO: 609324 - RNA, 20 nt, Homo sapiens
aaagcauguggcauguucau

SEQ ID NO: 609325 - RNA, 10 nt, Homo sapiens
aaagcauucu

SEQ ID NO: 609326 - RNA, 15 nt, Homo sapiens
aaagcauugagaucu

SEQ ID NO: 609327 - RNA, 15 nt, Homo sapiens
aaagccaagcacuuu

SEQ ID NO: 609328 - RNA, 14 nt, Homo sapiens
aaagccaaggaguc

SEQ ID NO: 609329 - RNA, 21 nt, Homo sapiens
aaagccaagggcaacagauca

SEQ ID NO: 609330 - RNA, 22 nt, Homo sapiens
aaagccacacucugggcuccag

SEQ ID NO: 609331 - RNA, 19 nt, Homo sapiens
aaagccacaucuugcucug

SEQ ID NO: 609332 - RNA, 17 nt, Homo sapiens
aaagccaccacauuuag

SEQ ID NO: 609333 - RNA, 19 nt, Homo sapiens
aaagccaccucucccucaa

SEQ ID NO: 609334 - RNA, 17 nt, Homo sapiens
aaagccaccuuguuaca

SEQ ID NO: 609335 - RNA, 12 nt, Homo sapiens
aaagccagaacc

SEQ ID NO: 609336 - RNA, 17 nt, Homo sapiens
aaagccagccaagcuuu

SEQ ID NO: 609337 - RNA, 22 nt, Homo sapiens
aaagccaggccugacgcauucu

SEQ ID NO: 609338 - RNA, 18 nt, Homo sapiens
aaagccccaaaugguggu

SEQ ID NO: 609339 - RNA, 17 nt, Homo sapiens
aaagccuagaagagcuu

SEQ ID NO: 609340 - RNA, 12 nt, Homo sapiens
aaagccuagaca

SEQ ID NO: 609341 - RNA, 17 nt, Homo sapiens
aaagccuccucaucccg

SEQ ID NO: 609342 - RNA, 20 nt, Homo sapiens
aaagccugccucuuccagga

SEQ ID NO: 609343 - RNA, 18 nt, Homo sapiens
aaagccugguuuuucuca

SEQ ID NO: 609344 - RNA, 13 nt, Homo sapiens
aaagccuuaggga

SEQ ID NO: 609345 - RNA, 21 nt, Homo sapiens
aaagccuucacuucaaagaag

SEQ ID NO: 609346 - RNA, 22 nt, Homo sapiens
aaagccuucagaggguuuggac

SEQ ID NO: 609347 - RNA, 22 nt, Homo sapiens
aaagcggccgaugggagucucc

SEQ ID NO: 609348 - RNA, 21 nt, Homo sapiens
aaagcguuucuuuacuucuca

SEQ ID NO: 609349 - RNA, 22 nt, Homo sapiens
aaagcuacugggccuccucuca

SEQ ID NO: 609350 - RNA, 17 nt, Homo sapiens
aaagcuagauaugccuu

SEQ ID NO: 609351 - RNA, 17 nt, Homo sapiens
aaagcuaguguaccucc

SEQ ID NO: 609352 - RNA, 19 nt, Homo sapiens
aaagcuaguguaccuccuc

SEQ ID NO: 609353 - RNA, 18 nt, Homo sapiens
aaagcuaucuucauguaa

SEQ ID NO: 609354 - RNA, 16 nt, Homo sapiens
aaagcucauaauggaa

SEQ ID NO: 609355 - RNA, 17 nt, Homo sapiens
aaagcugaugaggcugg

SEQ ID NO: 609356 - RNA, 17 nt, Homo sapiens
aaagcugauuacuguca

SEQ ID NO: 609357 - RNA, 11 nt, Homo sapiens
aaagcugccau

SEQ ID NO: 609358 - RNA, 13 nt, Homo sapiens
aaagcugccauuu

SEQ ID NO: 609359 - RNA, 12 nt, Homo sapiens
aaagcugcucag

SEQ ID NO: 609360 - RNA, 17 nt, Homo sapiens
aaagcugcuugcuguaa

SEQ ID NO: 609361 - RNA, 21 nt, Homo sapiens
aaagcuguguguuuggaagac

SEQ ID NO: 609362 - RNA, 23 nt, Homo sapiens
aaagcuucaaauuaaaacagcug

SEQ ID NO: 609363 - RNA, 21 nt, Homo sapiens
aaagcuucccucucagcugcu

SEQ ID NO: 609364 - RNA, 22 nt, Homo sapiens
aaagcuuccgggaaaacagcua

SEQ ID NO: 609365 - RNA, 23 nt, Homo sapiens
aaagcuugucugaucguucaaag

SEQ ID NO: 609366 - RNA, 21 nt, Homo sapiens
aaagcuuguggccccuuuuac

SEQ ID NO: 609367 - RNA, 17 nt, Homo sapiens
aagauaucagagcucuu

SEQ ID NO: 609368 - RNA, 13 nt, Homo sapiens
aagauaucccuaa

SEQ ID NO: 609369 - RNA, 13 nt, Homo sapiens
aagauauggacac

SEQ ID NO: 609370 - RNA, 16 nt, Homo sapiens
aagauauuguacauaa

SEQ ID NO: 609371 - RNA, 23 nt, Homo sapiens
aagaucaaaagcuuauucaucug

SEQ ID NO: 609372 - RNA, 22 nt, Homo sapiens
aagaucaaaauaaaaagugaca

SEQ ID NO: 609373 - RNA, 20 nt, Homo sapiens
aagaucaagaaaugucucug

SEQ ID NO: 609374 - RNA, 14 nt, Homo sapiens
aagaucaauauaca

SEQ ID NO: 609375 - RNA, 22 nt, Homo sapiens
aagauccacauccucuacaggu

SEQ ID NO: 609376 - RNA, 21 nt, Homo sapiens
aagauccacccucaaauguca

SEQ ID NO: 609377 - RNA, 19 nt, Homo sapiens
aagauccagccucauaccu

SEQ ID NO: 609378 - RNA, 15 nt, Homo sapiens
aagaucucugucaca

SEQ ID NO: 609379 - RNA, 21 nt, Homo sapiens
aagaucuguaaguaacuucac

SEQ ID NO: 609380 - RNA, 12 nt, Homo sapiens
aagaucuguuaa

SEQ ID NO: 609381 - RNA, 15 nt, Homo sapiens
aagaucuguuuugaa

SEQ ID NO: 609382 - RNA, 20 nt, Homo sapiens
aagaucuugaauagucucau

SEQ ID NO: 609383 - RNA, 24 nt, Homo sapiens
aagaucuuucaggacucuaccuca

SEQ ID NO: 609384 - RNA, 23 nt, Homo sapiens
aagaugaccuuugucucaccuca

SEQ ID NO: 609385 - RNA, 21 nt, Homo sapiens
aagaugacgaguaacuccccu

SEQ ID NO: 609386 - RNA, 15 nt, Homo sapiens
aagaugacucugaga

SEQ ID NO: 609387 - RNA, 14 nt, Homo sapiens
aagaugacuucuuu

SEQ ID NO: 609388 - RNA, 23 nt, Homo sapiens
aagaugagauuugccagcacagg

SEQ ID NO: 609389 - RNA, 14 nt, Homo sapiens
aagaugaucaucuc

SEQ ID NO: 609390 - RNA, 17 nt, Homo sapiens
aagaugaucauuugccc

SEQ ID NO: 609391 - RNA, 22 nt, Homo sapiens
aagaugauggaaacgcacuuac

SEQ ID NO: 609392 - RNA, 13 nt, Homo sapiens
aagaugcacugaa

SEQ ID NO: 609393 - RNA, 14 nt, Homo sapiens
aagaugcacugaaa

SEQ ID NO: 609394 - RNA, 12 nt, Homo sapiens
aagaugcagugg

SEQ ID NO: 609395 - RNA, 13 nt, Homo sapiens
aagaugcccucau

SEQ ID NO: 609396 - RNA, 12 nt, Homo sapiens
aagaugcuccug

SEQ ID NO: 609397 - RNA, 22 nt, Homo sapiens
aagaugcuucucacugccaugc

SEQ ID NO: 609398 - RNA, 17 nt, Homo sapiens
aagauggauuugaaaau

SEQ ID NO: 609399 - RNA, 22 nt, Homo sapiens
aagaugguauauuugguacugu

SEQ ID NO: 609400 - RNA, 20 nt, Homo sapiens
aagaugguguggguguccug

SEQ ID NO: 609401 - RNA, 18 nt, Homo sapiens
aagauguacagaacacau

SEQ ID NO: 609402 - RNA, 23 nt, Homo sapiens
aagauguaugcuuugaaugcaaa

SEQ ID NO: 609403 - RNA, 20 nt, Homo sapiens
aagauucauauuuacuucuu

SEQ ID NO: 609404 - RNA, 21 nt, Homo sapiens
aagauucauauuuacuucuua

SEQ ID NO: 609405 - RNA, 16 nt, Homo sapiens
aagauuccaaaaagca

SEQ ID NO: 609406 - RNA, 18 nt, Homo sapiens
aagauuccaaaaagcaca

SEQ ID NO: 609407 - RNA, 23 nt, Homo sapiens
aagauuccugguuaaauuugaau

SEQ ID NO: 609408 - RNA, 22 nt, Homo sapiens
aagauucucuauuggcucccuu

SEQ ID NO: 609409 - RNA, 15 nt, Homo sapiens
aagauucugucuuau

SEQ ID NO: 609410 - RNA, 13 nt, Homo sapiens
aagauugauacuu

SEQ ID NO: 609411 - RNA, 17 nt, Homo sapiens
aagauugcagcauuuau

SEQ ID NO: 609412 - RNA, 17 nt, Homo sapiens
aagauugcgguuuacag

SEQ ID NO: 609413 - RNA, 19 nt, Homo sapiens
aagauuguacuuagccagu

SEQ ID NO: 609414 - RNA, 14 nt, Homo sapiens
aagauuguugauag

SEQ ID NO: 609415 - RNA, 22 nt, Homo sapiens
aagauuuagaaaaaaguuuaca

SEQ ID NO: 609416 - RNA, 23 nt, Homo sapiens
aagauuuuccauuguauccucuu

SEQ ID NO: 609417 - RNA, 17 nt, Homo sapiens
aagauuuuccucuugug

SEQ ID NO: 609418 - RNA, 20 nt, Homo sapiens
aagauuuucuccacaguguu

SEQ ID NO: 609419 - RNA, 19 nt, Homo sapiens
aagauuuugaaugcuuccu

SEQ ID NO: 609420 - RNA, 17 nt, Homo sapiens
aagcaaaagucagucuu

SEQ ID NO: 609421 - RNA, 20 nt, Homo sapiens
aagcaaauaaaugccuucca

SEQ ID NO: 609422 - RNA, 21 nt, Homo sapiens
aagcaaauagacacagucaua

SEQ ID NO: 609423 - RNA, 19 nt, Homo sapiens
aagcaaaucguauaccuua

SEQ ID NO: 609424 - RNA, 17 nt, Homo sapiens
aagcaacagacucucac

SEQ ID NO: 609425 - RNA, 17 nt, Homo sapiens
aagcaacagauggauag

SEQ ID NO: 609426 - RNA, 23 nt, Homo sapiens
aagcaacagauggauagucuguc

SEQ ID NO: 609427 - RNA, 18 nt, Homo sapiens
aagcaacaucgucugcuu

SEQ ID NO: 609428 - RNA, 22 nt, Homo sapiens
aagcaacuacaacuucuccuua

SEQ ID NO: 609429 - RNA, 19 nt, Homo sapiens
aagcaacuguuaugaaaua

SEQ ID NO: 609430 - RNA, 18 nt, Homo sapiens
aagcaacuugcuucuaaa

SEQ ID NO: 609431 - RNA, 20 nt, Homo sapiens
aagcaagacuguugcucaaa

SEQ ID NO: 609432 - RNA, 17 nt, Homo sapiens
aagcaagcccuggccag

SEQ ID NO: 609433 - RNA, 19 nt, Homo sapiens
aagcaaguguucacaacag

SEQ ID NO: 609434 - RNA, 17 nt, Homo sapiens
aagcaaguucgucuguu

SEQ ID NO: 609435 - RNA, 21 nt, Homo sapiens
aagcaaguuucaucagucaau

SEQ ID NO: 609436 - RNA, 14 nt, Homo sapiens
aagcaauaacuuug

SEQ ID NO: 609437 - RNA, 19 nt, Homo sapiens
aagcaauaauggucccauc

SEQ ID NO: 609438 - RNA, 14 nt, Homo sapiens
aagcaauccaugau

SEQ ID NO: 609439 - RNA, 12 nt, Homo sapiens
aagcaauguggu

SEQ ID NO: 609440 - RNA, 16 nt, Homo sapiens
aagcaauucugacugu

SEQ ID NO: 609441 - RNA, 15 nt, Homo sapiens
aagcacaaaguucuc

SEQ ID NO: 609442 - RNA, 22 nt, Homo sapiens
aagcacaaaguucucagagcuc

SEQ ID NO: 609443 - RNA, 13 nt, Homo sapiens
aagcacaacugaa

SEQ ID NO: 609444 - RNA, 17 nt, Homo sapiens
aagcacaccuacagagc

SEQ ID NO: 609445 - RNA, 23 nt, Homo sapiens
aagcacacuaaaccaaguuauuu

SEQ ID NO: 609446 - RNA, 14 nt, Homo sapiens
aagcacacuuuucc

SEQ ID NO: 609447 - RNA, 13 nt, Homo sapiens
aagcacagcaccc

SEQ ID NO: 609448 - RNA, 14 nt, Homo sapiens
aagcacagcccuua

SEQ ID NO: 609449 - RNA, 16 nt, Homo sapiens
aagcacagccucagaa

SEQ ID NO: 609450 - RNA, 22 nt, Homo sapiens
aagcacauaacuggauuuugaa

SEQ ID NO: 609451 - RNA, 13 nt, Homo sapiens
aagcacaucugca

SEQ ID NO: 609452 - RNA, 14 nt, Homo sapiens
aagcacaugaucau

SEQ ID NO: 609453 - RNA, 12 nt, Homo sapiens
aagcaccaggac

SEQ ID NO: 609454 - RNA, 19 nt, Homo sapiens
aagcaccugcaugugcugu

SEQ ID NO: 609455 - RNA, 14 nt, Homo sapiens
aagcaccugccuca

SEQ ID NO: 609456 - RNA, 15 nt, Homo sapiens
aagcaccugcucaac

SEQ ID NO: 609457 - RNA, 22 nt, Homo sapiens
aagcacgugucucagacugcau

SEQ ID NO: 609458 - RNA, 19 nt, Homo sapiens
aagcacuacaccuugccuu

SEQ ID NO: 609459 - RNA, 22 nt, Homo sapiens
aagcacugaaaaacaacaacac

SEQ ID NO: 609460 - RNA, 12 nt, Homo sapiens
aagcacugugga

SEQ ID NO: 609461 - RNA, 23 nt, Homo sapiens
aagcacuguuggagcuacugcaa

SEQ ID NO: 609462 - RNA, 16 nt, Homo sapiens
aagcacuuugcacuua

SEQ ID NO: 609463 - RNA, 17 nt, Homo sapiens
aagcacuuugcacuuaa

SEQ ID NO: 609464 - RNA, 15 nt, Homo sapiens
aagcagaagcacaua

SEQ ID NO: 609465 - RNA, 20 nt, Homo sapiens
aagcagacuuuucagaagau

SEQ ID NO: 609466 - RNA, 14 nt, Homo sapiens
aagcagauacuuga

SEQ ID NO: 609467 - RNA, 19 nt, Homo sapiens
aagcagauuuauuuuugaa

SEQ ID NO: 609468 - RNA, 16 nt, Homo sapiens
aagcagcaacagcaaa

SEQ ID NO: 609469 - RNA, 12 nt, Homo sapiens
aagcagcacugu

SEQ ID NO: 609470 - RNA, 15 nt, Homo sapiens
aagcagcacugugag

SEQ ID NO: 609471 - RNA, 19 nt, Homo sapiens
aagcagccuguuuucacuc

SEQ ID NO: 609472 - RNA, 22 nt, Homo sapiens
aagcagcgaccgcccccuccuc

SEQ ID NO: 609473 - RNA, 15 nt, Homo sapiens
aagcagcucaagaac

SEQ ID NO: 609474 - RNA, 19 nt, Homo sapiens
aagcaggacuaaaugucua

SEQ ID NO: 609475 - RNA, 23 nt, Homo sapiens
aagcagggcuauauuucagugac

SEQ ID NO: 609476 - RNA, 19 nt, Homo sapiens
aagcagguggcaucucuaa

SEQ ID NO: 609477 - RNA, 19 nt, Homo sapiens
aagcaguaagcuaucuuca

SEQ ID NO: 609478 - RNA, 16 nt, Homo sapiens
aagcaguagacaaucc

SEQ ID NO: 609479 - RNA, 23 nt, Homo sapiens
aagcagucagcccuuauggccaa

SEQ ID NO: 609480 - RNA, 19 nt, Homo sapiens
aagcagucuugcucuguua

SEQ ID NO: 609481 - RNA, 21 nt, Homo sapiens
aagcagucuuucuauccuguu

SEQ ID NO: 609482 - RNA, 16 nt, Homo sapiens
aagcaguucucacaau

SEQ ID NO: 609483 - RNA, 12 nt, Homo sapiens
aagcaguucucc

SEQ ID NO: 609484 - RNA, 23 nt, Homo sapiens
aagcaguuggggcccucuugcca

SEQ ID NO: 609485 - RNA, 20 nt, Homo sapiens
aagcauaaaaauuagccaag

SEQ ID NO: 609486 - RNA, 16 nt, Homo sapiens
aagcauacaacuggac

SEQ ID NO: 609487 - RNA, 14 nt, Homo sapiens
aagcauagugaaca

SEQ ID NO: 609488 - RNA, 21 nt, Homo sapiens
aagucaaggacgaauuugcac

SEQ ID NO: 609489 - RNA, 19 nt, Homo sapiens
aagucaaguuuguggcuua

SEQ ID NO: 609490 - RNA, 15 nt, Homo sapiens
aagucaccuccuuaa

SEQ ID NO: 609491 - RNA, 14 nt, Homo sapiens
aagucacugacccu

SEQ ID NO: 609492 - RNA, 23 nt, Homo sapiens
aagucacugcacagugcaucuca

SEQ ID NO: 609493 - RNA, 13 nt, Homo sapiens
aagucacuuuuau

SEQ ID NO: 609494 - RNA, 22 nt, Homo sapiens
aagucagaggagauguggucaa

SEQ ID NO: 609495 - RNA, 22 nt, Homo sapiens
aagucagcuacucuaguucugu

SEQ ID NO: 609496 - RNA, 13 nt, Homo sapiens
aagucagcuuuca

SEQ ID NO: 609497 - RNA, 13 nt, Homo sapiens
aagucaguaucau

SEQ ID NO: 609498 - RNA, 16 nt, Homo sapiens
aagucauaccaaugaa

SEQ ID NO: 609499 - RNA, 13 nt, Homo sapiens
aagucauagccau

SEQ ID NO: 609500 - RNA, 22 nt, Homo sapiens
aagucaucuguuuaauuuacac

SEQ ID NO: 609501 - RNA, 21 nt, Homo sapiens
aagucaucuuuacuuucccaa

SEQ ID NO: 609502 - RNA, 18 nt, Homo sapiens
aaguccaaccugccugug

SEQ ID NO: 609503 - RNA, 14 nt, Homo sapiens
aaguccaauuccaa

SEQ ID NO: 609504 - RNA, 17 nt, Homo sapiens
aaguccaauuccaaagc

SEQ ID NO: 609505 - RNA, 14 nt, Homo sapiens
aaguccacuguccu

SEQ ID NO: 609506 - RNA, 16 nt, Homo sapiens
aaguccacuuuacuca

SEQ ID NO: 609507 - RNA, 22 nt, Homo sapiens
aaguccagauuuacacugggag

SEQ ID NO: 609508 - RNA, 16 nt, Homo sapiens
aaguccaucugacaaa

SEQ ID NO: 609509 - RNA, 23 nt, Homo sapiens
aaguccccgagggcgaaggccau

SEQ ID NO: 609510 - RNA, 21 nt, Homo sapiens
aaguccccguggagguucugu

SEQ ID NO: 609511 - RNA, 15 nt, Homo sapiens
aaguccccucuacuu

SEQ ID NO: 609512 - RNA, 16 nt, Homo sapiens
aaguccccucuacuuu

SEQ ID NO: 609513 - RNA, 18 nt, Homo sapiens
aaguccgcuggcacccau

SEQ ID NO: 609514 - RNA, 17 nt, Homo sapiens
aaguccggcggaauuca

SEQ ID NO: 609515 - RNA, 20 nt, Homo sapiens
aaguccuaguuguucagcau

SEQ ID NO: 609516 - RNA, 21 nt, Homo sapiens
aaguccuccagacaacccuca

SEQ ID NO: 609517 - RNA, 16 nt, Homo sapiens
aaguccuucaccucac

SEQ ID NO: 609518 - RNA, 17 nt, Homo sapiens
aaguccuucaccucacu

SEQ ID NO: 609519 - RNA, 13 nt, Homo sapiens
aaguccuuuaugu

SEQ ID NO: 609520 - RNA, 17 nt, Homo sapiens
aaguccuuucuaaguau

SEQ ID NO: 609521 - RNA, 17 nt, Homo sapiens
aagucuagagucucaga

SEQ ID NO: 609522 - RNA, 13 nt, Homo sapiens
aagucuccaugaa

SEQ ID NO: 609523 - RNA, 22 nt, Homo sapiens
aagucuccugucuuauggucca

SEQ ID NO: 609524 - RNA, 16 nt, Homo sapiens
aagucugacucuccac

SEQ ID NO: 609525 - RNA, 14 nt, Homo sapiens
aagucugucugucu

SEQ ID NO: 609526 - RNA, 14 nt, Homo sapiens
aagucugucuugcc

SEQ ID NO: 609527 - RNA, 14 nt, Homo sapiens
aagucuuccauaga

SEQ ID NO: 609528 - RNA, 23 nt, Homo sapiens
aagucuucucccguccauuccag

SEQ ID NO: 609529 - RNA, 16 nt, Homo sapiens
aagugaaaaaagcaaa

SEQ ID NO: 609530 - RNA, 19 nt, Homo sapiens
aagugaaaaaagcaaauag

SEQ ID NO: 609531 - RNA, 13 nt, Homo sapiens
aagugaaagugag

SEQ ID NO: 609532 - RNA, 22 nt, Homo sapiens
aagugaaccaucucagaccuuu

SEQ ID NO: 609533 - RNA, 13 nt, Homo sapiens
aagugaaggagaa

SEQ ID NO: 609534 - RNA, 13 nt, Homo sapiens
aagugacucucac

SEQ ID NO: 609535 - RNA, 22 nt, Homo sapiens
aagugagacccugucucaaaaa

SEQ ID NO: 609536 - RNA, 19 nt, Homo sapiens
aagugagacuccgucacaa

SEQ ID NO: 609537 - RNA, 22 nt, Homo sapiens
aagugagagagacaagaagcaa

SEQ ID NO: 609538 - RNA, 11 nt, Homo sapiens
aagugagccaa

SEQ ID NO: 609539 - RNA, 23 nt, Homo sapiens
aagugaggugugucacaaugaga

SEQ ID NO: 609540 - RNA, 15 nt, Homo sapiens
aagugauacuaucca

SEQ ID NO: 609541 - RNA, 17 nt, Homo sapiens
aagugauacuauccagu

SEQ ID NO: 609542 - RNA, 16 nt, Homo sapiens
aagugauccacccacc

SEQ ID NO: 609543 - RNA, 20 nt, Homo sapiens
aagugauccacccaccucgg

SEQ ID NO: 609544 - RNA, 21 nt, Homo sapiens
aagugauccuuccaccucagu

SEQ ID NO: 609545 - RNA, 20 nt, Homo sapiens
aagugaucuucccacaccag

SEQ ID NO: 609546 - RNA, 20 nt, Homo sapiens
aagugauucuuccaccucag

SEQ ID NO: 609547 - RNA, 18 nt, Homo sapiens
aagugauuucagcacauu

SEQ ID NO: 609548 - RNA, 15 nt, Homo sapiens
aagugcaagacugaa

SEQ ID NO: 609549 - RNA, 12 nt, Homo sapiens
aagugcagucag

SEQ ID NO: 609550 - RNA, 15 nt, Homo sapiens
aagugcauauuuauc

SEQ ID NO: 609551 - RNA, 18 nt, Homo sapiens
aagugcauuuguaauuca

SEQ ID NO: 609552 - RNA, 17 nt, Homo sapiens
aagugccacucauuccu

SEQ ID NO: 609553 - RNA, 21 nt, Homo sapiens
aagugccauuacuacuguaca

SEQ ID NO: 609554 - RNA, 21 nt, Homo sapiens
aagugcccucucugaaccuca

SEQ ID NO: 609555 - RNA, 10 nt, Homo sapiens
aagugccuua

SEQ ID NO: 609556 - RNA, 16 nt, Homo sapiens
aagugcgaguccucca

SEQ ID NO: 609557 - RNA, 18 nt, Homo sapiens
aagugcgugaauguaugu

SEQ ID NO: 609558 - RNA, 22 nt, Homo sapiens
aagugcuacucucacucagccu

SEQ ID NO: 609559 - RNA, 18 nt, Homo sapiens
aagugcuggcaaccacua

SEQ ID NO: 609560 - RNA, 20 nt, Homo sapiens
aagugcugggauuacaggca

SEQ ID NO: 609561 - RNA, 14 nt, Homo sapiens
aaguggacucaggg

SEQ ID NO: 609562 - RNA, 20 nt, Homo sapiens
aaguggacuuguuaccuuaa

SEQ ID NO: 609563 - RNA, 14 nt, Homo sapiens
aaguggccaugcca

SEQ ID NO: 609564 - RNA, 18 nt, Homo sapiens
aaguggccccacauagcc

SEQ ID NO: 609565 - RNA, 20 nt, Homo sapiens
aaguggcuacugacuacccu

SEQ ID NO: 609566 - RNA, 14 nt, Homo sapiens
aaguggcugugaca

SEQ ID NO: 609567 - RNA, 18 nt, Homo sapiens
aagugggcugugacuccc

SEQ ID NO: 609568 - RNA, 14 nt, Homo sapiens
aagugguacaggaa

SEQ ID NO: 609569 - RNA, 14 nt, Homo sapiens
aagugguuacuuug

SEQ ID NO: 609570 - RNA, 12 nt, Homo sapiens
aaguguaacaau

SEQ ID NO: 609571 - RNA, 19 nt, Homo sapiens
aaguguaauauaauugugu

SEQ ID NO: 609572 - RNA, 19 nt, Homo sapiens
aaguguacaaauuuauuga

SEQ ID NO: 609573 - RNA, 14 nt, Homo sapiens
aaguguacauaugu

SEQ ID NO: 609574 - RNA, 18 nt, Homo sapiens
aaguguagggcaagggug

SEQ ID NO: 609575 - RNA, 17 nt, Homo sapiens
aaguguaguugacugaa

SEQ ID NO: 609576 - RNA, 17 nt, Homo sapiens
aaguguaugaugucaca

SEQ ID NO: 609577 - RNA, 21 nt, Homo sapiens
aaguguaugcacgugugcaca

SEQ ID NO: 609578 - RNA, 15 nt, Homo sapiens
aagugucuuuugaca

SEQ ID NO: 609579 - RNA, 14 nt, Homo sapiens
aagugugagaagac

SEQ ID NO: 609580 - RNA, 20 nt, Homo sapiens
aaguguguaugugcauuaaa

SEQ ID NO: 609581 - RNA, 13 nt, Homo sapiens
aagugugucuucc

SEQ ID NO: 609582 - RNA, 15 nt, Homo sapiens
aaguguuucuguuau

SEQ ID NO: 609583 - RNA, 12 nt, Homo sapiens
aaguguuuucuc

SEQ ID NO: 609584 - RNA, 20 nt, Homo sapiens
aaguguuuucucagaacagc

SEQ ID NO: 609585 - RNA, 22 nt, Homo sapiens
aaguguuuuuuauugaaugcuu

SEQ ID NO: 609586 - RNA, 23 nt, Homo sapiens
aaguuaaaaguguugauuacaua

SEQ ID NO: 609587 - RNA, 15 nt, Homo sapiens
aaguuaaagugaaua

SEQ ID NO: 609588 - RNA, 15 nt, Homo sapiens
aaguuaacucuucaa

SEQ ID NO: 609589 - RNA, 20 nt, Homo sapiens
aaguuaauucaccuauguua

SEQ ID NO: 609590 - RNA, 17 nt, Homo sapiens
aaguuacauguuugcac

SEQ ID NO: 609591 - RNA, 23 nt, Homo sapiens
aaguuaggguuuaggcaucauuu

SEQ ID NO: 609592 - RNA, 21 nt, Homo sapiens
aaguuagucaauccugucaua

SEQ ID NO: 609593 - RNA, 16 nt, Homo sapiens
aaguuauacucacaaa

SEQ ID NO: 609594 - RNA, 21 nt, Homo sapiens
aaguuauaguauaucuggaca

SEQ ID NO: 609595 - RNA, 22 nt, Homo sapiens
aaguuaucaucucaccacacca

SEQ ID NO: 609596 - RNA, 15 nt, Homo sapiens
aaguuaugcuaauau

SEQ ID NO: 609597 - RNA, 15 nt, Homo sapiens
aaguuauuacugucu

SEQ ID NO: 609598 - RNA, 16 nt, Homo sapiens
aaguuauucucuucac

SEQ ID NO: 609599 - RNA, 16 nt, Homo sapiens
aaguuauugauguuuu

SEQ ID NO: 609600 - RNA, 17 nt, Homo sapiens
aaguucaacuuccagaa

SEQ ID NO: 609601 - RNA, 15 nt, Homo sapiens
aaguucagaucuuaa

SEQ ID NO: 609602 - RNA, 20 nt, Homo sapiens
aaguucaggcagcacaucaa

SEQ ID NO: 609603 - RNA, 20 nt, Homo sapiens
aaguucaggcucugagacac

SEQ ID NO: 609604 - RNA, 20 nt, Homo sapiens
aaguucaugcagcuguggca

SEQ ID NO: 609605 - RNA, 20 nt, Homo sapiens
aaguuccccaucccugucau

SEQ ID NO: 609606 - RNA, 16 nt, Homo sapiens
aaguuccccugugaca

SEQ ID NO: 609607 - RNA, 22 nt, Homo sapiens
aaguucgaagcuccgugaguga

SEQ ID NO: 609608 - RNA, 15 nt, Homo sapiens
aaguucuucuaagcu

SEQ ID NO: 609609 - RNA, 12 nt, Homo sapiens
aaguugacuuau

SEQ ID NO: 609610 - RNA, 20 nt, Homo sapiens
aauccacaacuuguaccaag

SEQ ID NO: 609611 - RNA, 21 nt, Homo sapiens
aauccacagcuauauccugau

SEQ ID NO: 609612 - RNA, 20 nt, Homo sapiens
aauccacuaugacaucuaag

SEQ ID NO: 609613 - RNA, 12 nt, Homo sapiens
aauccacucugc

SEQ ID NO: 609614 - RNA, 17 nt, Homo sapiens
aauccagacucuuucga

SEQ ID NO: 609615 - RNA, 19 nt, Homo sapiens
aauccagcuacgaauauag

SEQ ID NO: 609616 - RNA, 11 nt, Homo sapiens
aauccagcucc

SEQ ID NO: 609617 - RNA, 21 nt, Homo sapiens
aauccaggcuacaaucuucau

SEQ ID NO: 609618 - RNA, 20 nt, Homo sapiens
aauccaguaggauccaguga

SEQ ID NO: 609619 - RNA, 20 nt, Homo sapiens
aauccaugaaccaagaccau

SEQ ID NO: 609620 - RNA, 22 nt, Homo sapiens
aauccauuaucgagcagcauuu

SEQ ID NO: 609621 - RNA, 22 nt, Homo sapiens
aaucccaacguuuuacauaaaa

SEQ ID NO: 609622 - RNA, 18 nt, Homo sapiens
aaucccagcaauuuggag

SEQ ID NO: 609623 - RNA, 14 nt, Homo sapiens
aaucccagcacuuu

SEQ ID NO: 609624 - RNA, 16 nt, Homo sapiens
aaucccagcuacucaa

SEQ ID NO: 609625 - RNA, 20 nt, Homo sapiens
aaucccaguacgauuugcag

SEQ ID NO: 609626 - RNA, 18 nt, Homo sapiens
aaucccaguuacucagga

SEQ ID NO: 609627 - RNA, 19 nt, Homo sapiens
aaucccaucaggcuguuau

SEQ ID NO: 609628 - RNA, 16 nt, Homo sapiens
aaucccaucucuacaa

SEQ ID NO: 609629 - RNA, 16 nt, Homo sapiens
aaucccugccacuggg

SEQ ID NO: 609630 - RNA, 17 nt, Homo sapiens
aaucccugccacugggc

SEQ ID NO: 609631 - RNA, 22 nt, Homo sapiens
aaucccuguaggcgugcuagca

SEQ ID NO: 609632 - RNA, 21 nt, Homo sapiens
aauccgaaaacuuccauugua

SEQ ID NO: 609633 - RNA, 22 nt, Homo sapiens
aauccuaaaagagaucugggca

SEQ ID NO: 609634 - RNA, 17 nt, Homo sapiens
aauccuaaauaauguua

SEQ ID NO: 609635 - RNA, 20 nt, Homo sapiens
aauccuaagacacaaaugca

SEQ ID NO: 609636 - RNA, 15 nt, Homo sapiens
aauccuaagcaaaaa

SEQ ID NO: 609637 - RNA, 21 nt, Homo sapiens
aauccuaucacagucuacuga

SEQ ID NO: 609638 - RNA, 20 nt, Homo sapiens
aauccuauuuaucagacucu

SEQ ID NO: 609639 - RNA, 20 nt, Homo sapiens
aauccucaacacuauuguaa

SEQ ID NO: 609640 - RNA, 15 nt, Homo sapiens
aauccugcaaugaaa

SEQ ID NO: 609641 - RNA, 18 nt, Homo sapiens
aauccugccucuccccaa

SEQ ID NO: 609642 - RNA, 21 nt, Homo sapiens
aauccuggaaggacacaguga

SEQ ID NO: 609643 - RNA, 16 nt, Homo sapiens
aauccuguauauuuag

SEQ ID NO: 609644 - RNA, 23 nt, Homo sapiens
aauccuuuacauucaacuuuucu

SEQ ID NO: 609645 - RNA, 15 nt, Homo sapiens
aauccuuuacuguua

SEQ ID NO: 609646 - RNA, 22 nt, Homo sapiens
aauccuuucugccccccagggc

SEQ ID NO: 609647 - RNA, 22 nt, Homo sapiens
aaucgaugaauguaaacucggg

SEQ ID NO: 609648 - RNA, 13 nt, Homo sapiens
aaucuaaccacuu

SEQ ID NO: 609649 - RNA, 17 nt, Homo sapiens
aaucuaaggauaaugaa

SEQ ID NO: 609650 - RNA, 13 nt, Homo sapiens
aaucuaaucucuu

SEQ ID NO: 609651 - RNA, 18 nt, Homo sapiens
aaucuagaaaaucagauc

SEQ ID NO: 609652 - RNA, 21 nt, Homo sapiens
aaucuauaguucacugacaca

SEQ ID NO: 609653 - RNA, 18 nt, Homo sapiens
aaucucaaauaacuaaaa

SEQ ID NO: 609654 - RNA, 18 nt, Homo sapiens
aaucucaagauucuacuu

SEQ ID NO: 609655 - RNA, 18 nt, Homo sapiens
aaucucaccccaucccac

SEQ ID NO: 609656 - RNA, 20 nt, Homo sapiens
aaucucacccucuccuccag

SEQ ID NO: 609657 - RNA, 23 nt, Homo sapiens
aaucuccagcuucaacaguacuu

SEQ ID NO: 609658 - RNA, 14 nt, Homo sapiens
aaucuccucagaca

SEQ ID NO: 609659 - RNA, 15 nt, Homo sapiens
aaucuccugcugauu

SEQ ID NO: 609660 - RNA, 22 nt, Homo sapiens
aaucucuaauagaggcauuacu

SEQ ID NO: 609661 - RNA, 14 nt, Homo sapiens
aaucugaacucuca

SEQ ID NO: 609662 - RNA, 22 nt, Homo sapiens
aaucugaagauugcgguuuaca

SEQ ID NO: 609663 - RNA, 21 nt, Homo sapiens
aaucugaauaaauaauucuuc

SEQ ID NO: 609664 - RNA, 19 nt, Homo sapiens
aaucugaccguucuauugu

SEQ ID NO: 609665 - RNA, 17 nt, Homo sapiens
aaucugagaaacucuac

SEQ ID NO: 609666 - RNA, 13 nt, Homo sapiens
aaucugagcugca

SEQ ID NO: 609667 - RNA, 22 nt, Homo sapiens
aaucugaggccuccucucucag

SEQ ID NO: 609668 - RNA, 15 nt, Homo sapiens
aaucugaguauauau

SEQ ID NO: 609669 - RNA, 23 nt, Homo sapiens
aaucugcauccuuuucaaaaccu

SEQ ID NO: 609670 - RNA, 14 nt, Homo sapiens
aaucugccagacuu

SEQ ID NO: 609671 - RNA, 21 nt, Homo sapiens
aaucugccuagaaaaccucuc

SEQ ID NO: 609672 - RNA, 13 nt, Homo sapiens
aaucugccuucca

SEQ ID NO: 609673 - RNA, 14 nt, Homo sapiens
aaucugccuuccag

SEQ ID NO: 609674 - RNA, 20 nt, Homo sapiens
aaucugcugcauagcucuau

SEQ ID NO: 609675 - RNA, 19 nt, Homo sapiens
aaucuguaaucagcaauaa

SEQ ID NO: 609676 - RNA, 17 nt, Homo sapiens
aaucuguacauguucuu

SEQ ID NO: 609677 - RNA, 20 nt, Homo sapiens
aaucuguauauguuguaaua

SEQ ID NO: 609678 - RNA, 20 nt, Homo sapiens
aaucugugccugcacugaga

SEQ ID NO: 609679 - RNA, 17 nt, Homo sapiens
aaucuguguaacuguaa

SEQ ID NO: 609680 - RNA, 20 nt, Homo sapiens
aaucuguguucgauggcuca

SEQ ID NO: 609681 - RNA, 16 nt, Homo sapiens
aaucuuacaacaggcu

SEQ ID NO: 609682 - RNA, 17 nt, Homo sapiens
aaucuuaccagaugcua

SEQ ID NO: 609683 - RNA, 19 nt, Homo sapiens
aaucuuaccagaugcuacu

SEQ ID NO: 609684 - RNA, 13 nt, Homo sapiens
aaucuuauuguca

SEQ ID NO: 609685 - RNA, 21 nt, Homo sapiens
aaucuucucaucuuuuaucua

SEQ ID NO: 609686 - RNA, 15 nt, Homo sapiens
aaucuugaacuuuau

SEQ ID NO: 609687 - RNA, 23 nt, Homo sapiens
aaucuuggcuucuuaaaaacugu

SEQ ID NO: 609688 - RNA, 18 nt, Homo sapiens
aaucuuuaggcuuucaaa

SEQ ID NO: 609689 - RNA, 19 nt, Homo sapiens
aaucuuuggguaacuucaa

SEQ ID NO: 609690 - RNA, 19 nt, Homo sapiens
aaucuuuuaaaaauucaaa

SEQ ID NO: 609691 - RNA, 21 nt, Homo sapiens
aaugaaaaaaaguacauguau

SEQ ID NO: 609692 - RNA, 22 nt, Homo sapiens
aaugaaaaaggauaaugcaaaa

SEQ ID NO: 609693 - RNA, 15 nt, Homo sapiens
aaugaaaacaaugca

SEQ ID NO: 609694 - RNA, 21 nt, Homo sapiens
aaugaaacaagcuuacaaaga

SEQ ID NO: 609695 - RNA, 13 nt, Homo sapiens
aaugaaacuuuaa

SEQ ID NO: 609696 - RNA, 24 nt, Homo sapiens
aaugaaagcauguggcauguucau

SEQ ID NO: 609697 - RNA, 15 nt, Homo sapiens
aaugaaauaaaagca

SEQ ID NO: 609698 - RNA, 14 nt, Homo sapiens
aaugaaauacugag

SEQ ID NO: 609699 - RNA, 15 nt, Homo sapiens
aaugaaauacugaga

SEQ ID NO: 609700 - RNA, 18 nt, Homo sapiens
aaugaaauccagugagca

SEQ ID NO: 609701 - RNA, 14 nt, Homo sapiens
aaugaaauuccucc

SEQ ID NO: 609702 - RNA, 12 nt, Homo sapiens
aaugaacaucuc

SEQ ID NO: 609703 - RNA, 13 nt, Homo sapiens
aaugaacaucucu

SEQ ID NO: 609704 - RNA, 13 nt, Homo sapiens
aaugaaccuucug

SEQ ID NO: 609705 - RNA, 22 nt, Homo sapiens
aaugaagacuacauuugugaac

SEQ ID NO: 609706 - RNA, 17 nt, Homo sapiens
aaugaagaucauauacg

SEQ ID NO: 609707 - RNA, 14 nt, Homo sapiens
aaugaaggugccau

SEQ ID NO: 609708 - RNA, 16 nt, Homo sapiens
aaugaauaaacugaau

SEQ ID NO: 609709 - RNA, 15 nt, Homo sapiens
aaugaauaagcuuuc

SEQ ID NO: 609710 - RNA, 15 nt, Homo sapiens
aaugaaucuucacaa

SEQ ID NO: 609711 - RNA, 15 nt, Homo sapiens
aaugaauggacucaa

SEQ ID NO: 609712 - RNA, 19 nt, Homo sapiens
aaugaauguaaucuaauag

SEQ ID NO: 609713 - RNA, 19 nt, Homo sapiens
aaugaauuauaacaguuau

SEQ ID NO: 609714 - RNA, 22 nt, Homo sapiens
aaugaauuuuguuuggacuucu

SEQ ID NO: 609715 - RNA, 14 nt, Homo sapiens
aaugacaagcacua

SEQ ID NO: 609716 - RNA, 12 nt, Homo sapiens
aaugacaauauc

SEQ ID NO: 609717 - RNA, 15 nt, Homo sapiens
aaugacaaugaugau

SEQ ID NO: 609718 - RNA, 12 nt, Homo sapiens
aaugacacuuuc

SEQ ID NO: 609719 - RNA, 22 nt, Homo sapiens
aaugacagauucugacauuuau

SEQ ID NO: 609720 - RNA, 14 nt, Homo sapiens
aaugacaucucagg

SEQ ID NO: 609721 - RNA, 15 nt, Homo sapiens
aaugacaucucaggg

SEQ ID NO: 609722 - RNA, 23 nt, Homo sapiens
aaugaccaacgaaauuguuacaa

SEQ ID NO: 609723 - RNA, 16 nt, Homo sapiens
aaugaccaauauuaua

SEQ ID NO: 609724 - RNA, 21 nt, Homo sapiens
aaugaccagcagcagcuuuca

SEQ ID NO: 609725 - RNA, 17 nt, Homo sapiens
aaugacccaaagaccaa

SEQ ID NO: 609726 - RNA, 17 nt, Homo sapiens
aaugacgugccuaccuc

SEQ ID NO: 609727 - RNA, 19 nt, Homo sapiens
aaugacuaaaaaacaaaga

SEQ ID NO: 609728 - RNA, 23 nt, Homo sapiens
aaugacugaaagaagaacagcug

SEQ ID NO: 609729 - RNA, 22 nt, Homo sapiens
aaugacugccggucauuugaau

SEQ ID NO: 609730 - RNA, 11 nt, Homo sapiens
aaugacugcuu

SEQ ID NO: 609731 - RNA, 17 nt, Homo sapiens
aauguaacaugaagcaa

SEQ ID NO: 609732 - RNA, 23 nt, Homo sapiens
aauguaagaucguucucugccuc

SEQ ID NO: 609733 - RNA, 16 nt, Homo sapiens
aauguaauacuggaau

SEQ ID NO: 609734 - RNA, 17 nt, Homo sapiens
aauguaccgaugauacu

SEQ ID NO: 609735 - RNA, 18 nt, Homo sapiens
aauguagugaagggaugu

SEQ ID NO: 609736 - RNA, 22 nt, Homo sapiens
aauguauaauuaacuuaacuga

SEQ ID NO: 609737 - RNA, 12 nt, Homo sapiens
aauguauaccag

SEQ ID NO: 609738 - RNA, 11 nt, Homo sapiens
aauguauauau

SEQ ID NO: 609739 - RNA, 23 nt, Homo sapiens
aauguauauuugcugcaaagaga

SEQ ID NO: 609740 - RNA, 17 nt, Homo sapiens
aauguaucaaauacauu

SEQ ID NO: 609741 - RNA, 16 nt, Homo sapiens
aauguaucauagaaau

SEQ ID NO: 609742 - RNA, 15 nt, Homo sapiens
aauguauguacaaua

SEQ ID NO: 609743 - RNA, 23 nt, Homo sapiens
aauguaugugcacugucacuuug

SEQ ID NO: 609744 - RNA, 15 nt, Homo sapiens
aauguauuaugagcc

SEQ ID NO: 609745 - RNA, 13 nt, Homo sapiens
aauguauugaacu

SEQ ID NO: 609746 - RNA, 20 nt, Homo sapiens
aauguauuuguuugcaauuu

SEQ ID NO: 609747 - RNA, 21 nt, Homo sapiens
aauguauuuguuugcaauuuu

SEQ ID NO: 609748 - RNA, 19 nt, Homo sapiens
aauguauuuuaagugaauu

SEQ ID NO: 609749 - RNA, 16 nt, Homo sapiens
aaugucacugccaacg

SEQ ID NO: 609750 - RNA, 11 nt, Homo sapiens
aaugucacugg

SEQ ID NO: 609751 - RNA, 15 nt, Homo sapiens
aaugucagggccagg

SEQ ID NO: 609752 - RNA, 16 nt, Homo sapiens
aaugucaggguucugc

SEQ ID NO: 609753 - RNA, 19 nt, Homo sapiens
aaugucauugccauacagc

SEQ ID NO: 609754 - RNA, 17 nt, Homo sapiens
aaugucauugcuaaaaa

SEQ ID NO: 609755 - RNA, 13 nt, Homo sapiens
aauguccauuuau

SEQ ID NO: 609756 - RNA, 20 nt, Homo sapiens
aauguccuuguggucuuugc

SEQ ID NO: 609757 - RNA, 17 nt, Homo sapiens
aauguccuuucauuugu

SEQ ID NO: 609758 - RNA, 15 nt, Homo sapiens
aauguccuuuuauga

SEQ ID NO: 609759 - RNA, 19 nt, Homo sapiens
aaugucucggucacaucag

SEQ ID NO: 609760 - RNA, 17 nt, Homo sapiens
aaugucuggucugucca

SEQ ID NO: 609761 - RNA, 22 nt, Homo sapiens
aaugucuuacuccuggcuuuaa

SEQ ID NO: 609762 - RNA, 19 nt, Homo sapiens
aaugucuucaagacuuuuc

SEQ ID NO: 609763 - RNA, 23 nt, Homo sapiens
aaugucuugcuguugacauauuu

SEQ ID NO: 609764 - RNA, 20 nt, Homo sapiens
aaugucuuuugaauauuccc

SEQ ID NO: 609765 - RNA, 14 nt, Homo sapiens
aaugugaacacugg

SEQ ID NO: 609766 - RNA, 14 nt, Homo sapiens
aaugugacauugau

SEQ ID NO: 609767 - RNA, 14 nt, Homo sapiens
aaugugaguuauca

SEQ ID NO: 609768 - RNA, 15 nt, Homo sapiens
aaugugaugcuuuca

SEQ ID NO: 609769 - RNA, 23 nt, Homo sapiens
aaugugauucaccucuucuuucc

SEQ ID NO: 609770 - RNA, 18 nt, Homo sapiens
aaugugauuuccggguga

SEQ ID NO: 609771 - RNA, 17 nt, Homo sapiens
aaugugcaaccacugcu

SEQ ID NO: 609772 - RNA, 13 nt, Homo sapiens
aaugugcacucuc

SEQ ID NO: 609773 - RNA, 17 nt, Homo sapiens
aauguggaagucaguac

SEQ ID NO: 609774 - RNA, 23 nt, Homo sapiens
aauguggaagucaguacgaucaa

SEQ ID NO: 609775 - RNA, 18 nt, Homo sapiens
aauguggacucaaucccu

SEQ ID NO: 609776 - RNA, 20 nt, Homo sapiens
aauguggccgaggacuuuga

SEQ ID NO: 609777 - RNA, 18 nt, Homo sapiens
aaugugggaagaaacaaa

SEQ ID NO: 609778 - RNA, 15 nt, Homo sapiens
aauguguccacaguu

SEQ ID NO: 609779 - RNA, 18 nt, Homo sapiens
aaugugugaauucaauac

SEQ ID NO: 609780 - RNA, 15 nt, Homo sapiens
aaugugugcuuuauu

SEQ ID NO: 609781 - RNA, 16 nt, Homo sapiens
aauguguucuuuucuc

SEQ ID NO: 609782 - RNA, 22 nt, Homo sapiens
aauguguuuuucccccaugaaa

SEQ ID NO: 609783 - RNA, 16 nt, Homo sapiens
aauguuaacuacauau

SEQ ID NO: 609784 - RNA, 18 nt, Homo sapiens
aauguuaauguuauauca

SEQ ID NO: 609785 - RNA, 20 nt, Homo sapiens
aauguuaauugggcagguga

SEQ ID NO: 609786 - RNA, 18 nt, Homo sapiens
aauguuacugaucaugca

SEQ ID NO: 609787 - RNA, 20 nt, Homo sapiens
aauguuagauuccucuugcc

SEQ ID NO: 609788 - RNA, 18 nt, Homo sapiens
aauguuagguuacuguau

SEQ ID NO: 609789 - RNA, 14 nt, Homo sapiens
aauguuaugacuau

SEQ ID NO: 609790 - RNA, 21 nt, Homo sapiens
aauguuauuauuacucuacac

SEQ ID NO: 609791 - RNA, 22 nt, Homo sapiens
aauguuauuuuuuaauuauuau

SEQ ID NO: 609792 - RNA, 13 nt, Homo sapiens
aauguucauccca

SEQ ID NO: 609793 - RNA, 13 nt, Homo sapiens
aauguuccugaaa

SEQ ID NO: 609794 - RNA, 14 nt, Homo sapiens
aauguuccugaaaa

SEQ ID NO: 609795 - RNA, 20 nt, Homo sapiens
aauguucuauuuaacaacug

SEQ ID NO: 609796 - RNA, 21 nt, Homo sapiens
aauguucuauuuaacaacugg

SEQ ID NO: 609797 - RNA, 22 nt, Homo sapiens
aauguucuauuuaacaacuggg

SEQ ID NO: 609798 - RNA, 13 nt, Homo sapiens
aauguucugacau

SEQ ID NO: 609799 - RNA, 22 nt, Homo sapiens
aauguucuuugugugauuaaau

SEQ ID NO: 609800 - RNA, 16 nt, Homo sapiens
aauguugacaggcaaa

SEQ ID NO: 609801 - RNA, 15 nt, Homo sapiens
aauguugcaauguga

SEQ ID NO: 609802 - RNA, 17 nt, Homo sapiens
aauguugcccacauuaa

SEQ ID NO: 609803 - RNA, 22 nt, Homo sapiens
aauguuggaguggaacauuggg

SEQ ID NO: 609804 - RNA, 15 nt, Homo sapiens
aauguuguaauucau

SEQ ID NO: 609805 - RNA, 16 nt, Homo sapiens
aauguuguacuugaaa

SEQ ID NO: 609806 - RNA, 14 nt, Homo sapiens
aauguuuacagugg

SEQ ID NO: 609807 - RNA, 17 nt, Homo sapiens
aauguuuacaguggaau

SEQ ID NO: 609808 - RNA, 18 nt, Homo sapiens
aauguuuacaguggaauu

SEQ ID NO: 609809 - RNA, 21 nt, Homo sapiens
aauguuuaugccacagaauuu

SEQ ID NO: 609810 - RNA, 17 nt, Homo sapiens
aauguuuauuuagcucu

SEQ ID NO: 609811 - RNA, 15 nt, Homo sapiens
aauguuucuacagau

SEQ ID NO: 609812 - RNA, 14 nt, Homo sapiens
aauguuucuagucu

SEQ ID NO: 609813 - RNA, 14 nt, Homo sapiens
aauguuugcauaaa

SEQ ID NO: 609814 - RNA, 15 nt, Homo sapiens
aauguuuguucauua

SEQ ID NO: 609815 - RNA, 22 nt, Homo sapiens
aauguuuuaaaguuuaaugccu

SEQ ID NO: 609816 - RNA, 21 nt, Homo sapiens
aauguuuuacauuccauuuca

SEQ ID NO: 609817 - RNA, 22 nt, Homo sapiens
aauguuuuacugugaaacuggc

SEQ ID NO: 609818 - RNA, 13 nt, Homo sapiens
aauguuuuauuuc

SEQ ID NO: 609819 - RNA, 22 nt, Homo sapiens
aauguuuucuagucacuuccuc

SEQ ID NO: 609820 - RNA, 17 nt, Homo sapiens
aauguuuucuuugcaaa

SEQ ID NO: 609821 - RNA, 18 nt, Homo sapiens
aauuaaaacacuuucaaa

SEQ ID NO: 609822 - RNA, 18 nt, Homo sapiens
aauuaaaauggaugccuu

SEQ ID NO: 609823 - RNA, 23 nt, Homo sapiens
aauuaaacuguuaacuuauucaa

SEQ ID NO: 609824 - RNA, 18 nt, Homo sapiens
aauuaaaguggaccaaua

SEQ ID NO: 609825 - RNA, 21 nt, Homo sapiens
aauuaaauaaacuguuuucaa

SEQ ID NO: 609826 - RNA, 22 nt, Homo sapiens
aauuaaauauauguauguaaaa

SEQ ID NO: 609827 - RNA, 13 nt, Homo sapiens
aauuaaaugccuu

SEQ ID NO: 609828 - RNA, 18 nt, Homo sapiens
aauuaaauggaucacuga

SEQ ID NO: 609829 - RNA, 15 nt, Homo sapiens
aauuaagauuaugug

SEQ ID NO: 609830 - RNA, 16 nt, Homo sapiens
aauuaagauuauguga

SEQ ID NO: 609831 - RNA, 18 nt, Homo sapiens
aauuaaguccuacuuuac

SEQ ID NO: 609832 - RNA, 14 nt, Homo sapiens
aauuaauacagagu

SEQ ID NO: 609833 - RNA, 15 nt, Homo sapiens
aauuacaacagugag

SEQ ID NO: 609834 - RNA, 14 nt, Homo sapiens
aauuacaagcugua

SEQ ID NO: 609835 - RNA, 15 nt, Homo sapiens
aauuacagcaaaaag

SEQ ID NO: 609836 - RNA, 19 nt, Homo sapiens
aauuacagggugacucaca

SEQ ID NO: 609837 - RNA, 22 nt, Homo sapiens
aauuacguucuuacaagcuuaa

SEQ ID NO: 609838 - RNA, 14 nt, Homo sapiens
aauuacugcuauaa

SEQ ID NO: 609839 - RNA, 17 nt, Homo sapiens
aauuacuuguguuacuu

SEQ ID NO: 609840 - RNA, 17 nt, Homo sapiens
aauuacuuuuucauucu

SEQ ID NO: 609841 - RNA, 18 nt, Homo sapiens
aauuagaauauccaugac

SEQ ID NO: 609842 - RNA, 13 nt, Homo sapiens
aauuagaccuagg

SEQ ID NO: 609843 - RNA, 16 nt, Homo sapiens
aauuagauccauuaau

SEQ ID NO: 609844 - RNA, 13 nt, Homo sapiens
aauuagaugaacu

SEQ ID NO: 609845 - RNA, 14 nt, Homo sapiens
aauuagaugaacuc

SEQ ID NO: 609846 - RNA, 12 nt, Homo sapiens
aauuagcaauug

SEQ ID NO: 609847 - RNA, 23 nt, Homo sapiens
aauuagcaauugacugucacugu

SEQ ID NO: 609848 - RNA, 19 nt, Homo sapiens
aauuaggagaggcagagau

SEQ ID NO: 609849 - RNA, 15 nt, Homo sapiens
aauuaguaacaugug

SEQ ID NO: 609850 - RNA, 15 nt, Homo sapiens
aauuaguaagccaug

SEQ ID NO: 609851 - RNA, 13 nt, Homo sapiens
aauuaguauuuau

SEQ ID NO: 609852 - RNA, 15 nt, Homo sapiens
aauuaguucuccuau

SEQ ID NO: 609853 - RNA, 20 nt, Homo sapiens
accauguacaugaagaagcu

SEQ ID NO: 609854 - RNA, 15 nt, Homo sapiens
accauguauucccuu

SEQ ID NO: 609855 - RNA, 17 nt, Homo sapiens
accaugucagcaaaaag

SEQ ID NO: 609856 - RNA, 18 nt, Homo sapiens
accaugucuuucucucuc

SEQ ID NO: 609857 - RNA, 11 nt, Homo sapiens
accauguggau

SEQ ID NO: 609858 - RNA, 23 nt, Homo sapiens
accauguuggccaggcuguucuc

SEQ ID NO: 609859 - RNA, 13 nt, Homo sapiens
accauucaaauga

SEQ ID NO: 609860 - RNA, 19 nt, Homo sapiens
accauucaggacacaggga

SEQ ID NO: 609861 - RNA, 22 nt, Homo sapiens
accauuccauuuccaagcacuu

SEQ ID NO: 609862 - RNA, 16 nt, Homo sapiens
accauucccuagucau

SEQ ID NO: 609863 - RNA, 18 nt, Homo sapiens
accauucuccugccucag

SEQ ID NO: 609864 - RNA, 21 nt, Homo sapiens
accauuuaaagaaagaaugca

SEQ ID NO: 609865 - RNA, 14 nt, Homo sapiens
accauuuacaugca

SEQ ID NO: 609866 - RNA, 23 nt, Homo sapiens
accauuuuacauuucuauuucau

SEQ ID NO: 609867 - RNA, 16 nt, Homo sapiens
accauuuuaguuuuaa

SEQ ID NO: 609868 - RNA, 18 nt, Homo sapiens
acccaaaaaaucaucuca

SEQ ID NO: 609869 - RNA, 22 nt, Homo sapiens
acccaaaacacaggaagucagu

SEQ ID NO: 609870 - RNA, 16 nt, Homo sapiens
acccaaaacucaagca

SEQ ID NO: 609871 - RNA, 13 nt, Homo sapiens
acccaaacacuuc

SEQ ID NO: 609872 - RNA, 18 nt, Homo sapiens
acccaaagcaaaacauca

SEQ ID NO: 609873 - RNA, 16 nt, Homo sapiens
acccaaagcacaugcu

SEQ ID NO: 609874 - RNA, 13 nt, Homo sapiens
acccaaagccugu

SEQ ID NO: 609875 - RNA, 14 nt, Homo sapiens
acccaaaguguucu

SEQ ID NO: 609876 - RNA, 17 nt, Homo sapiens
acccaacuugccaaaau

SEQ ID NO: 609877 - RNA, 21 nt, Homo sapiens
acccaagagaacucaccuuau

SEQ ID NO: 609878 - RNA, 13 nt, Homo sapiens
acccaagggcaga

SEQ ID NO: 609879 - RNA, 23 nt, Homo sapiens
acccaagucugaacguggaauuc

SEQ ID NO: 609880 - RNA, 20 nt, Homo sapiens
acccaagugaagguucccaa

SEQ ID NO: 609881 - RNA, 18 nt, Homo sapiens
acccaagugcugcacaaa

SEQ ID NO: 609882 - RNA, 16 nt, Homo sapiens
acccaaucagaugccu

SEQ ID NO: 609883 - RNA, 14 nt, Homo sapiens
acccaaugggaccg

SEQ ID NO: 609884 - RNA, 19 nt, Homo sapiens
acccacaacgaaugaauga

SEQ ID NO: 609885 - RNA, 13 nt, Homo sapiens
acccacaauaaac

SEQ ID NO: 609886 - RNA, 16 nt, Homo sapiens
acccacaauaaacucg

SEQ ID NO: 609887 - RNA, 16 nt, Homo sapiens
acccacacagcugccc

SEQ ID NO: 609888 - RNA, 18 nt, Homo sapiens
acccacagccccugcugg

SEQ ID NO: 609889 - RNA, 20 nt, Homo sapiens
acccaccagaaauuccagua

SEQ ID NO: 609890 - RNA, 20 nt, Homo sapiens
acccaccauggaccagccca

SEQ ID NO: 609891 - RNA, 12 nt, Homo sapiens
acccacccagga

SEQ ID NO: 609892 - RNA, 21 nt, Homo sapiens
acccacccucugguccuucug

SEQ ID NO: 609893 - RNA, 16 nt, Homo sapiens
acccaccuugaccaua

SEQ ID NO: 609894 - RNA, 14 nt, Homo sapiens
acccacuaacaaag

SEQ ID NO: 609895 - RNA, 23 nt, Homo sapiens
acccacucggauggaccaaccug

SEQ ID NO: 609896 - RNA, 20 nt, Homo sapiens
acccacuggucugcuuaaag

SEQ ID NO: 609897 - RNA, 15 nt, Homo sapiens
acccagaaaucauuu

SEQ ID NO: 609898 - RNA, 19 nt, Homo sapiens
acccagaaggcagagguug

SEQ ID NO: 609899 - RNA, 15 nt, Homo sapiens
acccagacaaccaaa

SEQ ID NO: 609900 - RNA, 15 nt, Homo sapiens
acccagagguggaug

SEQ ID NO: 609901 - RNA, 23 nt, Homo sapiens
acccagaugcaagacacugugcc

SEQ ID NO: 609902 - RNA, 19 nt, Homo sapiens
acccagauuuccuaacucu

SEQ ID NO: 609903 - RNA, 13 nt, Homo sapiens
acccagcaaagag

SEQ ID NO: 609904 - RNA, 15 nt, Homo sapiens
acccagcaccuugca

SEQ ID NO: 609905 - RNA, 15 nt, Homo sapiens
acccagccucugaga

SEQ ID NO: 609906 - RNA, 15 nt, Homo sapiens
acccagcguggccca

SEQ ID NO: 609907 - RNA, 23 nt, Homo sapiens
acccagcugcagaccaugccaga

SEQ ID NO: 609908 - RNA, 13 nt, Homo sapiens
acccagcuggucc

SEQ ID NO: 609909 - RNA, 20 nt, Homo sapiens
acccaggcuggagugcggug

SEQ ID NO: 609910 - RNA, 21 nt, Homo sapiens
acccaggggacagcuggugca

SEQ ID NO: 609911 - RNA, 21 nt, Homo sapiens
acccagguauuacacaagcca

SEQ ID NO: 609912 - RNA, 11 nt, Homo sapiens
acccaggugau

SEQ ID NO: 609913 - RNA, 17 nt, Homo sapiens
acccaguauuacugcug

SEQ ID NO: 609914 - RNA, 14 nt, Homo sapiens
acccaguauuccau

SEQ ID NO: 609915 - RNA, 14 nt, Homo sapiens
acccagucccacac

SEQ ID NO: 609916 - RNA, 17 nt, Homo sapiens
acccagugacugacauu

SEQ ID NO: 609917 - RNA, 16 nt, Homo sapiens
acccaguuagcucuca

SEQ ID NO: 609918 - RNA, 15 nt, Homo sapiens
acccaguucagugag

SEQ ID NO: 609919 - RNA, 19 nt, Homo sapiens
acccauauuucauccagga

SEQ ID NO: 609920 - RNA, 22 nt, Homo sapiens
acccauccuaccaaugcaugca

SEQ ID NO: 609921 - RNA, 23 nt, Homo sapiens
acccaucggguaagaugcuccug

SEQ ID NO: 609922 - RNA, 13 nt, Homo sapiens
acccaugacuuua

SEQ ID NO: 609923 - RNA, 18 nt, Homo sapiens
acccaugagauucauuca

SEQ ID NO: 609924 - RNA, 18 nt, Homo sapiens
acccaugggaagggucca

SEQ ID NO: 609925 - RNA, 16 nt, Homo sapiens
acccauuaaauuaaga

SEQ ID NO: 609926 - RNA, 18 nt, Homo sapiens
acccauucuacacagagc

SEQ ID NO: 609927 - RNA, 16 nt, Homo sapiens
acccauuucaaugugu

SEQ ID NO: 609928 - RNA, 21 nt, Homo sapiens
acccauuucuacuuuuugcac

SEQ ID NO: 609929 - RNA, 18 nt, Homo sapiens
accccaaacuguugauua

SEQ ID NO: 609930 - RNA, 20 nt, Homo sapiens
accccaacaauugugugaau

SEQ ID NO: 609931 - RNA, 18 nt, Homo sapiens
accccaacuuggcagcuu

SEQ ID NO: 609932 - RNA, 21 nt, Homo sapiens
accccaagcggccuuuuccaa

SEQ ID NO: 609933 - RNA, 20 nt, Homo sapiens
accccacaccccagcccacc

SEQ ID NO: 609934 - RNA, 12 nt, Homo sapiens
accccacagacu

SEQ ID NO: 609935 - RNA, 16 nt, Homo sapiens
accccagaaacugaac

SEQ ID NO: 609936 - RNA, 19 nt, Homo sapiens
accccagaaaucacuguga

SEQ ID NO: 609937 - RNA, 15 nt, Homo sapiens
accccagacacuggu

SEQ ID NO: 609938 - RNA, 20 nt, Homo sapiens
accccagguaagauguuaau

SEQ ID NO: 609939 - RNA, 22 nt, Homo sapiens
accccagugggaacugugcaaa

SEQ ID NO: 609940 - RNA, 15 nt, Homo sapiens
accccauaccccuua

SEQ ID NO: 609941 - RNA, 17 nt, Homo sapiens
accccauuuguggucac

SEQ ID NO: 609942 - RNA, 17 nt, Homo sapiens
acccccaccauccaggu

SEQ ID NO: 609943 - RNA, 13 nt, Homo sapiens
acccccagcacuu

SEQ ID NO: 609944 - RNA, 14 nt, Homo sapiens
acccccagccaggc

SEQ ID NO: 609945 - RNA, 14 nt, Homo sapiens
acccccagcucaau

SEQ ID NO: 609946 - RNA, 15 nt, Homo sapiens
acccccaggcaucug

SEQ ID NO: 609947 - RNA, 23 nt, Homo sapiens
acccccaggucuuccugcuuucc

SEQ ID NO: 609948 - RNA, 15 nt, Homo sapiens
acccccaguccucac

SEQ ID NO: 609949 - RNA, 16 nt, Homo sapiens
acccccaucucuacua

SEQ ID NO: 609950 - RNA, 13 nt, Homo sapiens
acccccaucuuua

SEQ ID NO: 609951 - RNA, 16 nt, Homo sapiens
acccccaucuuuacaa

SEQ ID NO: 609952 - RNA, 18 nt, Homo sapiens
acccccaugaccacugcc

SEQ ID NO: 609953 - RNA, 20 nt, Homo sapiens
acccccauucucaucugcac

SEQ ID NO: 609954 - RNA, 17 nt, Homo sapiens
acccccccacaaggaac

SEQ ID NO: 609955 - RNA, 17 nt, Homo sapiens
acccccgcuuugguucu

SEQ ID NO: 609956 - RNA, 19 nt, Homo sapiens
acccccugugagcagggau

SEQ ID NO: 609957 - RNA, 17 nt, Homo sapiens
accccgagggcugagga

SEQ ID NO: 609958 - RNA, 23 nt, Homo sapiens
accccgauauauuuuagcauuuu

SEQ ID NO: 609959 - RNA, 21 nt, Homo sapiens
accccggggugcccacaggcc

SEQ ID NO: 609960 - RNA, 23 nt, Homo sapiens
accccggugugccuguggaggaa

SEQ ID NO: 609961 - RNA, 14 nt, Homo sapiens
accccguagcucca

SEQ ID NO: 609962 - RNA, 19 nt, Homo sapiens
accccuagaaaggagagaa

SEQ ID NO: 609963 - RNA, 23 nt, Homo sapiens
accccuaguugagagcaccuugc

SEQ ID NO: 609964 - RNA, 16 nt, Homo sapiens
accccucaacaccucu

SEQ ID NO: 609965 - RNA, 15 nt, Homo sapiens
accccucauccaaag

SEQ ID NO: 609966 - RNA, 23 nt, Homo sapiens
accccucccucccucuuucccac

SEQ ID NO: 609967 - RNA, 18 nt, Homo sapiens
accccucuuccagcuucu

SEQ ID NO: 609968 - RNA, 20 nt, Homo sapiens
accccugagauccggcaaca

SEQ ID NO: 609969 - RNA, 13 nt, Homo sapiens
accccugcucagu

SEQ ID NO: 609970 - RNA, 17 nt, Homo sapiens
accccugcucuacccau

SEQ ID NO: 609971 - RNA, 19 nt, Homo sapiens
accccugucucccaaaaau

SEQ ID NO: 609972 - RNA, 18 nt, Homo sapiens
accccuuagccucccuga

SEQ ID NO: 609973 - RNA, 21 nt, Homo sapiens
accccuuccagaucacugcca

SEQ ID NO: 609974 - RNA, 20 nt, Homo sapiens
accccuugccggugaaggau

SEQ ID NO: 609975 - RNA, 21 nt, Homo sapiens
acgcacacccugccccuggug

SEQ ID NO: 609976 - RNA, 16 nt, Homo sapiens
acgcacagugcaguug

SEQ ID NO: 609977 - RNA, 18 nt, Homo sapiens
acgcacgcucgcugccau

SEQ ID NO: 609978 - RNA, 22 nt, Homo sapiens
acgcacgcucgcugccaucacc

SEQ ID NO: 609979 - RNA, 21 nt, Homo sapiens
acgcaggccacccgggcugcc

SEQ ID NO: 609980 - RNA, 15 nt, Homo sapiens
acgcaugcaguguug

SEQ ID NO: 609981 - RNA, 19 nt, Homo sapiens
acgccacucauuucaucuc

SEQ ID NO: 609982 - RNA, 20 nt, Homo sapiens
acgccacucauuucaucuca

SEQ ID NO: 609983 - RNA, 15 nt, Homo sapiens
acgccacugcacucc

SEQ ID NO: 609984 - RNA, 20 nt, Homo sapiens
acgcccaugugugagugugu

SEQ ID NO: 609985 - RNA, 23 nt, Homo sapiens
acgccccacacuuuguacagacc

SEQ ID NO: 609986 - RNA, 20 nt, Homo sapiens
acgccccgaaccucaccuga

SEQ ID NO: 609987 - RNA, 15 nt, Homo sapiens
acgccgcccuaaaag

SEQ ID NO: 609988 - RNA, 15 nt, Homo sapiens
acgccuaugauccca

SEQ ID NO: 609989 - RNA, 15 nt, Homo sapiens
acgccuccuggccag

SEQ ID NO: 609990 - RNA, 16 nt, Homo sapiens
acgccuguaauccuag

SEQ ID NO: 609991 - RNA, 16 nt, Homo sapiens
acgcgacuuccacaaa

SEQ ID NO: 609992 - RNA, 21 nt, Homo sapiens
acgcguauuuacagccagugg

SEQ ID NO: 609993 - RNA, 16 nt, Homo sapiens
acgcucaucucuggaa

SEQ ID NO: 609994 - RNA, 20 nt, Homo sapiens
acgcucccccgcagucccca

SEQ ID NO: 609995 - RNA, 14 nt, Homo sapiens
acgcugguggugcu

SEQ ID NO: 609996 - RNA, 17 nt, Homo sapiens
acgcuuaagucaucauu

SEQ ID NO: 609997 - RNA, 23 nt, Homo sapiens
acgcuuguuugccugaaaguaau

SEQ ID NO: 609998 - RNA, 16 nt, Homo sapiens
acggaccaaagcaaga

SEQ ID NO: 609999 - RNA, 14 nt, Homo sapiens
acggacucccgggc

SEQ ID NO: 610000 - RNA, 20 nt, Homo sapiens
acggacugaggugccugcuc

SEQ ID NO: 610001 - RNA, 22 nt, Homo sapiens
acggaguccuguguuugugagu

SEQ ID NO: 610002 - RNA, 23 nt, Homo sapiens
acggaugauuggauuauucauuu

SEQ ID NO: 610003 - RNA, 16 nt, Homo sapiens
acggaugguugaauga

SEQ ID NO: 610004 - RNA, 13 nt, Homo sapiens
acggcaccucggg

SEQ ID NO: 610005 - RNA, 15 nt, Homo sapiens
acggcagcuguagcu

SEQ ID NO: 610006 - RNA, 14 nt, Homo sapiens
acggccacaucaaa

SEQ ID NO: 610007 - RNA, 16 nt, Homo sapiens
acggccaccacugcag

SEQ ID NO: 610008 - RNA, 21 nt, Homo sapiens
acggcccucaucuaugaggaa

SEQ ID NO: 610009 - RNA, 20 nt, Homo sapiens
acggccuguacggacacugu

SEQ ID NO: 610010 - RNA, 16 nt, Homo sapiens
acggcgcccccagugu

SEQ ID NO: 610011 - RNA, 13 nt, Homo sapiens
acggcggcuccag

SEQ ID NO: 610012 - RNA, 17 nt, Homo sapiens
acggcugccccuuccac

SEQ ID NO: 610013 - RNA, 17 nt, Homo sapiens
acgggcaaucaugagca

SEQ ID NO: 610014 - RNA, 14 nt, Homo sapiens
acggggagaaauaa

SEQ ID NO: 610015 - RNA, 17 nt, Homo sapiens
acggggcucagcaaugc

SEQ ID NO: 610016 - RNA, 23 nt, Homo sapiens
acggggcugacuccugcucucug

SEQ ID NO: 610017 - RNA, 19 nt, Homo sapiens
acgggguuggcuguuccag

SEQ ID NO: 610018 - RNA, 18 nt, Homo sapiens
acggucaguccaugucuc

SEQ ID NO: 610019 - RNA, 15 nt, Homo sapiens
acggugacucugucc

SEQ ID NO: 610020 - RNA, 17 nt, Homo sapiens
acggugcccauccugcc

SEQ ID NO: 610021 - RNA, 19 nt, Homo sapiens
acggugcucacucccaagg

SEQ ID NO: 610022 - RNA, 23 nt, Homo sapiens
acgguggcaguaggggaaccuag

SEQ ID NO: 610023 - RNA, 14 nt, Homo sapiens
acggugggcauuug

SEQ ID NO: 610024 - RNA, 14 nt, Homo sapiens
acgguuaacuguaa

SEQ ID NO: 610025 - RNA, 21 nt, Homo sapiens
acguacaaaauccagcuauga

SEQ ID NO: 610026 - RNA, 21 nt, Homo sapiens
acguacuacggagaaacucau

SEQ ID NO: 610027 - RNA, 23 nt, Homo sapiens
acguagacugauggaacagaaua

SEQ ID NO: 610028 - RNA, 19 nt, Homo sapiens
acguagcuaguaagcauuu

SEQ ID NO: 610029 - RNA, 19 nt, Homo sapiens
acgucacguuggucuugaa

SEQ ID NO: 610030 - RNA, 21 nt, Homo sapiens
acguccaguguacagugaauc

SEQ ID NO: 610031 - RNA, 15 nt, Homo sapiens
acguccccacccacg

SEQ ID NO: 610032 - RNA, 23 nt, Homo sapiens
acgucgcccgcugagcugagugg

SEQ ID NO: 610033 - RNA, 13 nt, Homo sapiens
acgucuugcuauu

SEQ ID NO: 610034 - RNA, 21 nt, Homo sapiens
acgugaaauuugccucugucc

SEQ ID NO: 610035 - RNA, 17 nt, Homo sapiens
acgugaggcccauucuu

SEQ ID NO: 610036 - RNA, 17 nt, Homo sapiens
acgugauuuccagugag

SEQ ID NO: 610037 - RNA, 19 nt, Homo sapiens
acgugcagccacacacaga

SEQ ID NO: 610038 - RNA, 18 nt, Homo sapiens
acgugcaggacagcucuu

SEQ ID NO: 610039 - RNA, 14 nt, Homo sapiens
acgugccguuuaaa

SEQ ID NO: 610040 - RNA, 16 nt, Homo sapiens
acgugccuaccucuua

SEQ ID NO: 610041 - RNA, 14 nt, Homo sapiens
acgugccugugguc

SEQ ID NO: 610042 - RNA, 16 nt, Homo sapiens
acguggaaaugucucg

SEQ ID NO: 610043 - RNA, 17 nt, Homo sapiens
acguggagauagugcca

SEQ ID NO: 610044 - RNA, 18 nt, Homo sapiens
acgugggagucugugcau

SEQ ID NO: 610045 - RNA, 19 nt, Homo sapiens
acgugggagucugugcauu

SEQ ID NO: 610046 - RNA, 14 nt, Homo sapiens
acgugucaaugugu

SEQ ID NO: 610047 - RNA, 12 nt, Homo sapiens
acguguggaauu

SEQ ID NO: 610048 - RNA, 13 nt, Homo sapiens
acguuaugaugac

SEQ ID NO: 610049 - RNA, 22 nt, Homo sapiens
acguugaggacuuuucgaccaa

SEQ ID NO: 610050 - RNA, 13 nt, Homo sapiens
acguugugcauuu

SEQ ID NO: 610051 - RNA, 13 nt, Homo sapiens
acguuuaagccaa

SEQ ID NO: 610052 - RNA, 16 nt, Homo sapiens
acguuugcucauuuaa

SEQ ID NO: 610053 - RNA, 14 nt, Homo sapiens
acguuuuguaaaug

SEQ ID NO: 610054 - RNA, 16 nt, Homo sapiens
acuaaaaaaaagauga

SEQ ID NO: 610055 - RNA, 16 nt, Homo sapiens
acuaaaaaaaugcaaa

SEQ ID NO: 610056 - RNA, 13 nt, Homo sapiens
acuaaaaagaauu

SEQ ID NO: 610057 - RNA, 13 nt, Homo sapiens
acuaaaaagccau

SEQ ID NO: 610058 - RNA, 16 nt, Homo sapiens
acuaaaaauacaaaaa

SEQ ID NO: 610059 - RNA, 22 nt, Homo sapiens
acuaaaaauauagcaaaugcag

SEQ ID NO: 610060 - RNA, 17 nt, Homo sapiens
acuaaaacacacaggug

SEQ ID NO: 610061 - RNA, 17 nt, Homo sapiens
acuaaaacugcauuucc

SEQ ID NO: 610062 - RNA, 18 nt, Homo sapiens
acuaaaacuggaaaugua

SEQ ID NO: 610063 - RNA, 20 nt, Homo sapiens
acuaaaauuuuaggcacucu

SEQ ID NO: 610064 - RNA, 17 nt, Homo sapiens
acuaaacugcugcaaaa

SEQ ID NO: 610065 - RNA, 14 nt, Homo sapiens
acuaaagauaucag

SEQ ID NO: 610066 - RNA, 22 nt, Homo sapiens
acuaaagcagagcuaguaaugc

SEQ ID NO: 610067 - RNA, 18 nt, Homo sapiens
acuaaagcauucaauuua

SEQ ID NO: 610068 - RNA, 11 nt, Homo sapiens
acuaaagccag

SEQ ID NO: 610069 - RNA, 20 nt, Homo sapiens
acuaaagcuauguuacaugg

SEQ ID NO: 610070 - RNA, 20 nt, Homo sapiens
acuaaagcucccagcuccuu

SEQ ID NO: 610071 - RNA, 13 nt, Homo sapiens
acuaaaggcaucc

SEQ ID NO: 610072 - RNA, 17 nt, Homo sapiens
acuaaaggugcacugcu

SEQ ID NO: 610073 - RNA, 14 nt, Homo sapiens
acuaaaguuuuaca

SEQ ID NO: 610074 - RNA, 17 nt, Homo sapiens
acuaaauaugugacuga

SEQ ID NO: 610075 - RNA, 13 nt, Homo sapiens
acuaaaugaacua

SEQ ID NO: 610076 - RNA, 14 nt, Homo sapiens
acuaaaugaacuaa

SEQ ID NO: 610077 - RNA, 13 nt, Homo sapiens
acuaacacuggcu

SEQ ID NO: 610078 - RNA, 16 nt, Homo sapiens
acuaacaggccaaaga

SEQ ID NO: 610079 - RNA, 14 nt, Homo sapiens
acuaaccaucugaa

SEQ ID NO: 610080 - RNA, 16 nt, Homo sapiens
acuaacccaaugccug

SEQ ID NO: 610081 - RNA, 21 nt, Homo sapiens
acuaacccaaugccugugaag

SEQ ID NO: 610082 - RNA, 20 nt, Homo sapiens
acuaacgaaauaucaaaguc

SEQ ID NO: 610083 - RNA, 21 nt, Homo sapiens
acuaagaaaaaaagcacaaag

SEQ ID NO: 610084 - RNA, 18 nt, Homo sapiens
acuaagaucuguuaaaaa

SEQ ID NO: 610085 - RNA, 13 nt, Homo sapiens
acuaagauguuca

SEQ ID NO: 610086 - RNA, 17 nt, Homo sapiens
acuaagcacaugaaaaa

SEQ ID NO: 610087 - RNA, 19 nt, Homo sapiens
acuaagcauagcaaacaga

SEQ ID NO: 610088 - RNA, 12 nt, Homo sapiens
acuaagccagga

SEQ ID NO: 610089 - RNA, 21 nt, Homo sapiens
acuaaggaagauuacucagua

SEQ ID NO: 610090 - RNA, 19 nt, Homo sapiens
acuaaggcagcuaagacau

SEQ ID NO: 610091 - RNA, 19 nt, Homo sapiens
acuaauaaacuguguaguu

SEQ ID NO: 610092 - RNA, 16 nt, Homo sapiens
acuaauacuacugugu

SEQ ID NO: 610093 - RNA, 18 nt, Homo sapiens
acuaauagaaaaguaugu

SEQ ID NO: 610094 - RNA, 11 nt, Homo sapiens
acuaaucauga

SEQ ID NO: 610095 - RNA, 16 nt, Homo sapiens
acuaaugccucuucau

SEQ ID NO: 610096 - RNA, 17 nt, Homo sapiens
acuaauggaaauauuau

SEQ ID NO: 610097 - RNA, 12 nt, Homo sapiens
acugcucaagaa

SEQ ID NO: 610098 - RNA, 22 nt, Homo sapiens
acugcucaagaacuacgggcug

SEQ ID NO: 610099 - RNA, 20 nt, Homo sapiens
acugcucauuuggaucccag

SEQ ID NO: 610100 - RNA, 19 nt, Homo sapiens
acugcugcccagccuccaa

SEQ ID NO: 610101 - RNA, 19 nt, Homo sapiens
acugcugcuccagugcagg

SEQ ID NO: 610102 - RNA, 14 nt, Homo sapiens
acugcugucuucca

SEQ ID NO: 610103 - RNA, 23 nt, Homo sapiens
acugcuuaaauuccaaguccuga

SEQ ID NO: 610104 - RNA, 23 nt, Homo sapiens
acugcuucaggaaggacauggac

SEQ ID NO: 610105 - RNA, 14 nt, Homo sapiens
acugcuucauguga

SEQ ID NO: 610106 - RNA, 16 nt, Homo sapiens
acugcuugaccaaaga

SEQ ID NO: 610107 - RNA, 21 nt, Homo sapiens
acugcuuuuccucaagcaaua

SEQ ID NO: 610108 - RNA, 18 nt, Homo sapiens
acuggaaaaguguaauag

SEQ ID NO: 610109 - RNA, 21 nt, Homo sapiens
acuggaaauguauauuuugua

SEQ ID NO: 610110 - RNA, 14 nt, Homo sapiens
acuggaacauucca

SEQ ID NO: 610111 - RNA, 15 nt, Homo sapiens
acuggaagacacuuc

SEQ ID NO: 610112 - RNA, 20 nt, Homo sapiens
acuggacaaagaauuccaaa

SEQ ID NO: 610113 - RNA, 22 nt, Homo sapiens
acuggacaaagaauuccaaagc

SEQ ID NO: 610114 - RNA, 15 nt, Homo sapiens
acuggacaacacuga

SEQ ID NO: 610115 - RNA, 12 nt, Homo sapiens
acuggaccgcug

SEQ ID NO: 610116 - RNA, 19 nt, Homo sapiens
acuggaccgcugacugcac

SEQ ID NO: 610117 - RNA, 13 nt, Homo sapiens
acuggaccuggug

SEQ ID NO: 610118 - RNA, 15 nt, Homo sapiens
acuggagcaucugac

SEQ ID NO: 610119 - RNA, 17 nt, Homo sapiens
acuggagcucaucugca

SEQ ID NO: 610120 - RNA, 16 nt, Homo sapiens
acuggaguuagaucuc

SEQ ID NO: 610121 - RNA, 14 nt, Homo sapiens
acuggauauguugu

SEQ ID NO: 610122 - RNA, 16 nt, Homo sapiens
acuggaugucaaacag

SEQ ID NO: 610123 - RNA, 22 nt, Homo sapiens
acuggauuggccaaacaucaga

SEQ ID NO: 610124 - RNA, 18 nt, Homo sapiens
acuggauuuuugcucugc

SEQ ID NO: 610125 - RNA, 23 nt, Homo sapiens
acuggcaaagcagaaugugauau

SEQ ID NO: 610126 - RNA, 18 nt, Homo sapiens
acuggcaaccugcuuuca

SEQ ID NO: 610127 - RNA, 13 nt, Homo sapiens
acuggcagcaucu

SEQ ID NO: 610128 - RNA, 15 nt, Homo sapiens
acuggcagcuccucu

SEQ ID NO: 610129 - RNA, 21 nt, Homo sapiens
acuggcaguaaccuagugaau

SEQ ID NO: 610130 - RNA, 18 nt, Homo sapiens
acuggcaucugacacaaa

SEQ ID NO: 610131 - RNA, 15 nt, Homo sapiens
acuggcaugggagac

SEQ ID NO: 610132 - RNA, 14 nt, Homo sapiens
acuggccagccaau

SEQ ID NO: 610133 - RNA, 22 nt, Homo sapiens
acuggccagggccacgcuccag

SEQ ID NO: 610134 - RNA, 19 nt, Homo sapiens
acuggccccuacuuugugg

SEQ ID NO: 610135 - RNA, 17 nt, Homo sapiens
acuggcguucaccuccc

SEQ ID NO: 610136 - RNA, 18 nt, Homo sapiens
acuggcugucugccugua

SEQ ID NO: 610137 - RNA, 16 nt, Homo sapiens
acugggacagcccagg

SEQ ID NO: 610138 - RNA, 18 nt, Homo sapiens
acugggcagguuccuggg

SEQ ID NO: 610139 - RNA, 18 nt, Homo sapiens
acuggggagcacaggugu

SEQ ID NO: 610140 - RNA, 18 nt, Homo sapiens
acuggggagucuuugugg

SEQ ID NO: 610141 - RNA, 23 nt, Homo sapiens
acuggggccuccagaacucacug

SEQ ID NO: 610142 - RNA, 15 nt, Homo sapiens
acugggucaugugca

SEQ ID NO: 610143 - RNA, 17 nt, Homo sapiens
acugggucugacaugaa

SEQ ID NO: 610144 - RNA, 20 nt, Homo sapiens
acugggugcgucuccaguca

SEQ ID NO: 610145 - RNA, 16 nt, Homo sapiens
acugggugucauuuca

SEQ ID NO: 610146 - RNA, 17 nt, Homo sapiens
acugguaaaaagaucca

SEQ ID NO: 610147 - RNA, 15 nt, Homo sapiens
acugguaaagccuca

SEQ ID NO: 610148 - RNA, 21 nt, Homo sapiens
acugguaaagccucauuugaa

SEQ ID NO: 610149 - RNA, 17 nt, Homo sapiens
acugguacucaagccag

SEQ ID NO: 610150 - RNA, 23 nt, Homo sapiens
acugguauguguggaugaugcug

SEQ ID NO: 610151 - RNA, 22 nt, Homo sapiens
acugguauuguuuacguuugau

SEQ ID NO: 610152 - RNA, 11 nt, Homo sapiens
acuggucacag

SEQ ID NO: 610153 - RNA, 18 nt, Homo sapiens
acuggucaccuugcacuc

SEQ ID NO: 610154 - RNA, 12 nt, Homo sapiens
acuggucagggc

SEQ ID NO: 610155 - RNA, 22 nt, Homo sapiens
acugguccagcucugacauccc

SEQ ID NO: 610156 - RNA, 22 nt, Homo sapiens
acuggugcaauuacagcaaaaa

SEQ ID NO: 610157 - RNA, 16 nt, Homo sapiens
acuggugcacuucuua

SEQ ID NO: 610158 - RNA, 19 nt, Homo sapiens
acuggugucacccuggaua

SEQ ID NO: 610159 - RNA, 13 nt, Homo sapiens
acuggugugcucu

SEQ ID NO: 610160 - RNA, 24 nt, Homo sapiens
acugguuaaaaaacaaauguucau

SEQ ID NO: 610161 - RNA, 15 nt, Homo sapiens
acugguucaccugaa

SEQ ID NO: 610162 - RNA, 18 nt, Homo sapiens
acugguugguuuugccau

SEQ ID NO: 610163 - RNA, 20 nt, Homo sapiens
acugguuuggucaguuacaa

SEQ ID NO: 610164 - RNA, 21 nt, Homo sapiens
acuguaaacucuaucagcauu

SEQ ID NO: 610165 - RNA, 14 nt, Homo sapiens
acuguaaaugcauu

SEQ ID NO: 610166 - RNA, 23 nt, Homo sapiens
acuguaacguuuucuuucacaca

SEQ ID NO: 610167 - RNA, 17 nt, Homo sapiens
acuguaacugacugccu

SEQ ID NO: 610168 - RNA, 16 nt, Homo sapiens
acuguaacugcucaga

SEQ ID NO: 610169 - RNA, 22 nt, Homo sapiens
acuguaacugcucagagcuuua

SEQ ID NO: 610170 - RNA, 16 nt, Homo sapiens
acuguaauuugugaua

SEQ ID NO: 610171 - RNA, 12 nt, Homo sapiens
acuguacauaaa

SEQ ID NO: 610172 - RNA, 12 nt, Homo sapiens
acuguacaugaa

SEQ ID NO: 610173 - RNA, 13 nt, Homo sapiens
acuguacuccucc

SEQ ID NO: 610174 - RNA, 12 nt, Homo sapiens
acuguacugugu

SEQ ID NO: 610175 - RNA, 19 nt, Homo sapiens
acuguagcaagaugcaaau

SEQ ID NO: 610176 - RNA, 23 nt, Homo sapiens
acuguagccacagcugcuguucu

SEQ ID NO: 610177 - RNA, 17 nt, Homo sapiens
acuguagcgaccccaga

SEQ ID NO: 610178 - RNA, 18 nt, Homo sapiens
acuguaguucacuguaga

SEQ ID NO: 610179 - RNA, 13 nt, Homo sapiens
acuguaguuuuga

SEQ ID NO: 610180 - RNA, 12 nt, Homo sapiens
acuguauacauu

SEQ ID NO: 610181 - RNA, 15 nt, Homo sapiens
acuguauacauuaca

SEQ ID NO: 610182 - RNA, 19 nt, Homo sapiens
acuguauauaaacuccuua

SEQ ID NO: 610183 - RNA, 22 nt, Homo sapiens
acuguauauucaggacuugaaa

SEQ ID NO: 610184 - RNA, 21 nt, Homo sapiens
acuguauauuuguaugauauu

SEQ ID NO: 610185 - RNA, 17 nt, Homo sapiens
acuguaucaagucaugg

SEQ ID NO: 610186 - RNA, 22 nt, Homo sapiens
acuguauguuuacuucucacca

SEQ ID NO: 610187 - RNA, 16 nt, Homo sapiens
acuguauuucuaagaa

SEQ ID NO: 610188 - RNA, 17 nt, Homo sapiens
acugucaaguacaagca

SEQ ID NO: 610189 - RNA, 21 nt, Homo sapiens
acugucacguggcuucaucag

SEQ ID NO: 610190 - RNA, 18 nt, Homo sapiens
acugucacuguuucucug

SEQ ID NO: 610191 - RNA, 17 nt, Homo sapiens
acugucacuuugcucug

SEQ ID NO: 610192 - RNA, 17 nt, Homo sapiens
acugucaggaaguaaaa

SEQ ID NO: 610193 - RNA, 16 nt, Homo sapiens
acugucagggucuuuc

SEQ ID NO: 610194 - RNA, 13 nt, Homo sapiens
acugucaguucuc

SEQ ID NO: 610195 - RNA, 15 nt, Homo sapiens
acugucaguuguacu

SEQ ID NO: 610196 - RNA, 14 nt, Homo sapiens
acugucauagaaau

SEQ ID NO: 610197 - RNA, 14 nt, Homo sapiens
acugucaucuucaa

SEQ ID NO: 610198 - RNA, 18 nt, Homo sapiens
acuguccaagugccacau

SEQ ID NO: 610199 - RNA, 20 nt, Homo sapiens
acuguccagcuuauagucuu

SEQ ID NO: 610200 - RNA, 12 nt, Homo sapiens
acuguccagggc

SEQ ID NO: 610201 - RNA, 23 nt, Homo sapiens
acuguccggccccgagucacuca

SEQ ID NO: 610202 - RNA, 21 nt, Homo sapiens
acuguccuaccaguugcccua

SEQ ID NO: 610203 - RNA, 22 nt, Homo sapiens
acuguccuggaaccugucucca

SEQ ID NO: 610204 - RNA, 19 nt, Homo sapiens
acugucuccuuucucuuau

SEQ ID NO: 610205 - RNA, 16 nt, Homo sapiens
acugucucucuucuca

SEQ ID NO: 610206 - RNA, 18 nt, Homo sapiens
acugucuuaaagagagag

SEQ ID NO: 610207 - RNA, 12 nt, Homo sapiens
acugucuuucag

SEQ ID NO: 610208 - RNA, 15 nt, Homo sapiens
acugugaaaccuuua

SEQ ID NO: 610209 - RNA, 13 nt, Homo sapiens
acugugaaacugg

SEQ ID NO: 610210 - RNA, 22 nt, Homo sapiens
acugugaagagaaccauaucaa

SEQ ID NO: 610211 - RNA, 15 nt, Homo sapiens
acugugaagcauuua

SEQ ID NO: 610212 - RNA, 12 nt, Homo sapiens
acugugacagac

SEQ ID NO: 610213 - RNA, 23 nt, Homo sapiens
acugugagaggugacacuguugg

SEQ ID NO: 610214 - RNA, 19 nt, Homo sapiens
acugugauuagaucacauc

SEQ ID NO: 610215 - RNA, 18 nt, Homo sapiens
acugugcacuuugcucaa

SEQ ID NO: 610216 - RNA, 20 nt, Homo sapiens
acugugcagacccaguccca

SEQ ID NO: 610217 - RNA, 14 nt, Homo sapiens
acugugccacaaug

SEQ ID NO: 610218 - RNA, 19 nt, Homo sapiens
acugugcccugggagcucu

SEQ ID NO: 610219 - RNA, 13 nt, Homo sapiens
agaaaucaggccu

SEQ ID NO: 610220 - RNA, 19 nt, Homo sapiens
agaaauccuaguaugccaa

SEQ ID NO: 610221 - RNA, 13 nt, Homo sapiens
agaaaucuagaag

SEQ ID NO: 610222 - RNA, 22 nt, Homo sapiens
agaaaucuagaauuuuuacuua

SEQ ID NO: 610223 - RNA, 12 nt, Homo sapiens
agaaaugaauua

SEQ ID NO: 610224 - RNA, 12 nt, Homo sapiens
agaaaugauuca

SEQ ID NO: 610225 - RNA, 15 nt, Homo sapiens
agaaaugcaaaucga

SEQ ID NO: 610226 - RNA, 11 nt, Homo sapiens
agaaaugccag

SEQ ID NO: 610227 - RNA, 13 nt, Homo sapiens
agaaaugcugaaa

SEQ ID NO: 610228 - RNA, 13 nt, Homo sapiens
agaaaugcugcug

SEQ ID NO: 610229 - RNA, 20 nt, Homo sapiens
agaaauggacuggagcucau

SEQ ID NO: 610230 - RNA, 20 nt, Homo sapiens
agaaauggauguaagccugg

SEQ ID NO: 610231 - RNA, 18 nt, Homo sapiens
agaaauggcgucugcucu

SEQ ID NO: 610232 - RNA, 20 nt, Homo sapiens
agaaaugguuuccucuggau

SEQ ID NO: 610233 - RNA, 12 nt, Homo sapiens
agaaaugucuaa

SEQ ID NO: 610234 - RNA, 23 nt, Homo sapiens
agaaauguuaaagguucacaggg

SEQ ID NO: 610235 - RNA, 19 nt, Homo sapiens
agaaauguuguucauuauu

SEQ ID NO: 610236 - RNA, 19 nt, Homo sapiens
agaaauuaacaaaugugcu

SEQ ID NO: 610237 - RNA, 22 nt, Homo sapiens
agaaauuaacaaaugugcugcu

SEQ ID NO: 610238 - RNA, 23 nt, Homo sapiens
agaaauuaacaaaugugcugcuu

SEQ ID NO: 610239 - RNA, 17 nt, Homo sapiens
agaaauuaccuguggau

SEQ ID NO: 610240 - RNA, 14 nt, Homo sapiens
agaaauuagcugug

SEQ ID NO: 610241 - RNA, 19 nt, Homo sapiens
agaaauucuaaauaaugca

SEQ ID NO: 610242 - RNA, 15 nt, Homo sapiens
agaaauugcaauaac

SEQ ID NO: 610243 - RNA, 21 nt, Homo sapiens
agaaauuggaagaagcacuga

SEQ ID NO: 610244 - RNA, 22 nt, Homo sapiens
agaaauuuagagucaauuugcu

SEQ ID NO: 610245 - RNA, 20 nt, Homo sapiens
agaaauuugcaacucacuga

SEQ ID NO: 610246 - RNA, 19 nt, Homo sapiens
agaaauuugccaauuuacu

SEQ ID NO: 610247 - RNA, 21 nt, Homo sapiens
agaaauuuuaaaauaauagaa

SEQ ID NO: 610248 - RNA, 20 nt, Homo sapiens
agaaauuuugccugccauuu

SEQ ID NO: 610249 - RNA, 22 nt, Homo sapiens
agaacaaaaagaaaucuugucu

SEQ ID NO: 610250 - RNA, 23 nt, Homo sapiens
agaacaaaaagaaaucuugucuu

SEQ ID NO: 610251 - RNA, 20 nt, Homo sapiens
agaacaaaagcgacccauuc

SEQ ID NO: 610252 - RNA, 15 nt, Homo sapiens
agaacaaacaccucc

SEQ ID NO: 610253 - RNA, 16 nt, Homo sapiens
agaacaaacucugaaa

SEQ ID NO: 610254 - RNA, 12 nt, Homo sapiens
agaacaaaugug

SEQ ID NO: 610255 - RNA, 13 nt, Homo sapiens
agaacaacauauc

SEQ ID NO: 610256 - RNA, 14 nt, Homo sapiens
agaacaauauaguc

SEQ ID NO: 610257 - RNA, 15 nt, Homo sapiens
agaacaaugcuauaa

SEQ ID NO: 610258 - RNA, 23 nt, Homo sapiens
agaacaaugggaggcugugauuu

SEQ ID NO: 610259 - RNA, 10 nt, Homo sapiens
agaacacagg

SEQ ID NO: 610260 - RNA, 13 nt, Homo sapiens
agaacaccugccu

SEQ ID NO: 610261 - RNA, 16 nt, Homo sapiens
agaacagaggcauuua

SEQ ID NO: 610262 - RNA, 20 nt, Homo sapiens
agaacagggcuauuugaaga

SEQ ID NO: 610263 - RNA, 13 nt, Homo sapiens
agaacagggucau

SEQ ID NO: 610264 - RNA, 19 nt, Homo sapiens
agaacaguaacugccauca

SEQ ID NO: 610265 - RNA, 14 nt, Homo sapiens
agaacaguaugaau

SEQ ID NO: 610266 - RNA, 20 nt, Homo sapiens
agaacagucccucacaccug

SEQ ID NO: 610267 - RNA, 16 nt, Homo sapiens
agaacaguuucaucag

SEQ ID NO: 610268 - RNA, 20 nt, Homo sapiens
agaacauaaaaaauaaagua

SEQ ID NO: 610269 - RNA, 15 nt, Homo sapiens
agaacaucaagauac

SEQ ID NO: 610270 - RNA, 20 nt, Homo sapiens
agaacaucauuacuuaugau

SEQ ID NO: 610271 - RNA, 16 nt, Homo sapiens
agaacaugcacauuua

SEQ ID NO: 610272 - RNA, 17 nt, Homo sapiens
agaacauggacuuguau

SEQ ID NO: 610273 - RNA, 21 nt, Homo sapiens
agaacauuuauaucaguuuca

SEQ ID NO: 610274 - RNA, 12 nt, Homo sapiens
agaacauuuuaa

SEQ ID NO: 610275 - RNA, 16 nt, Homo sapiens
agaacauuuuaauuca

SEQ ID NO: 610276 - RNA, 10 nt, Homo sapiens
agaaccaaaa

SEQ ID NO: 610277 - RNA, 16 nt, Homo sapiens
agaaccaaaacuucca

SEQ ID NO: 610278 - RNA, 17 nt, Homo sapiens
agaaccacaaacaauuc

SEQ ID NO: 610279 - RNA, 23 nt, Homo sapiens
agaaccacauauuuuagacacuu

SEQ ID NO: 610280 - RNA, 19 nt, Homo sapiens
agaaccccugaaguauuuu

SEQ ID NO: 610281 - RNA, 15 nt, Homo sapiens
agaacccugcaaaug

SEQ ID NO: 610282 - RNA, 15 nt, Homo sapiens
agaacccugcuguuu

SEQ ID NO: 610283 - RNA, 14 nt, Homo sapiens
agaaccgagcaaag

SEQ ID NO: 610284 - RNA, 16 nt, Homo sapiens
agaaccgagcaaagau

SEQ ID NO: 610285 - RNA, 11 nt, Homo sapiens
agaaccucagg

SEQ ID NO: 610286 - RNA, 13 nt, Homo sapiens
agaaccuggaaaa

SEQ ID NO: 610287 - RNA, 19 nt, Homo sapiens
agaaccuggauguacuuaa

SEQ ID NO: 610288 - RNA, 21 nt, Homo sapiens
agaaccugucuccuacuuuga

SEQ ID NO: 610289 - RNA, 23 nt, Homo sapiens
agaaccugucuccuacuuugaaa

SEQ ID NO: 610290 - RNA, 19 nt, Homo sapiens
agaacgcgacuuccacaaa

SEQ ID NO: 610291 - RNA, 16 nt, Homo sapiens
agaacguggcucugcu

SEQ ID NO: 610292 - RNA, 16 nt, Homo sapiens
agaacuacagcucuua

SEQ ID NO: 610293 - RNA, 16 nt, Homo sapiens
agaacuauaugugaau

SEQ ID NO: 610294 - RNA, 17 nt, Homo sapiens
agaacuauaugugaauc

SEQ ID NO: 610295 - RNA, 15 nt, Homo sapiens
agaacuaucugcauu

SEQ ID NO: 610296 - RNA, 21 nt, Homo sapiens
agaacuauugugcucagagac

SEQ ID NO: 610297 - RNA, 16 nt, Homo sapiens
agaacucacagaaaua

SEQ ID NO: 610298 - RNA, 15 nt, Homo sapiens
agaacucacuggggc

SEQ ID NO: 610299 - RNA, 18 nt, Homo sapiens
agaacucgcgcucaguaa

SEQ ID NO: 610300 - RNA, 12 nt, Homo sapiens
agaacucuccau

SEQ ID NO: 610301 - RNA, 22 nt, Homo sapiens
agaacucuccaucuuauuuuca

SEQ ID NO: 610302 - RNA, 23 nt, Homo sapiens
agaacugaagccacuuggcccag

SEQ ID NO: 610303 - RNA, 19 nt, Homo sapiens
agaacugaaggcauaugca

SEQ ID NO: 610304 - RNA, 13 nt, Homo sapiens
agaacugcacuuu

SEQ ID NO: 610305 - RNA, 13 nt, Homo sapiens
agaacugcagaua

SEQ ID NO: 610306 - RNA, 14 nt, Homo sapiens
agaacugcagucag

SEQ ID NO: 610307 - RNA, 23 nt, Homo sapiens
agaacuggaaagacauagccaac

SEQ ID NO: 610308 - RNA, 20 nt, Homo sapiens
agaacuggaacuacguagcu

SEQ ID NO: 610309 - RNA, 15 nt, Homo sapiens
agaacuguccacauc

SEQ ID NO: 610310 - RNA, 15 nt, Homo sapiens
agaacuucagaaaga

SEQ ID NO: 610311 - RNA, 19 nt, Homo sapiens
agaacuucugccucuaagc

SEQ ID NO: 610312 - RNA, 14 nt, Homo sapiens
agaacuugaccccc

SEQ ID NO: 610313 - RNA, 15 nt, Homo sapiens
agaacuugauuugca

SEQ ID NO: 610314 - RNA, 16 nt, Homo sapiens
agaacuugauuugcau

SEQ ID NO: 610315 - RNA, 19 nt, Homo sapiens
agaacuugcagcugauguu

SEQ ID NO: 610316 - RNA, 17 nt, Homo sapiens
agaacuuucugauucac

SEQ ID NO: 610317 - RNA, 15 nt, Homo sapiens
agaagaaacuuugcc

SEQ ID NO: 610318 - RNA, 20 nt, Homo sapiens
agaagaaccauuuacaugca

SEQ ID NO: 610319 - RNA, 18 nt, Homo sapiens
agaagaauaucgauauaa

SEQ ID NO: 610320 - RNA, 19 nt, Homo sapiens
agaagacaacauuucucaa

SEQ ID NO: 610321 - RNA, 13 nt, Homo sapiens
agaagacacugca

SEQ ID NO: 610322 - RNA, 22 nt, Homo sapiens
agaagacagcagcaagugugcu

SEQ ID NO: 610323 - RNA, 20 nt, Homo sapiens
agaagacauccugagcagug

SEQ ID NO: 610324 - RNA, 22 nt, Homo sapiens
agaagacauggaugaucuggga

SEQ ID NO: 610325 - RNA, 14 nt, Homo sapiens
agaagacucugacc

SEQ ID NO: 610326 - RNA, 23 nt, Homo sapiens
agaagacugucagcuuccaaaca

SEQ ID NO: 610327 - RNA, 18 nt, Homo sapiens
agaagagaaaugcugcua

SEQ ID NO: 610328 - RNA, 14 nt, Homo sapiens
agaagagacugcua

SEQ ID NO: 610329 - RNA, 13 nt, Homo sapiens
agaagaggcugcu

SEQ ID NO: 610330 - RNA, 15 nt, Homo sapiens
agaagauagauccaa

SEQ ID NO: 610331 - RNA, 18 nt, Homo sapiens
agaagauagaugcacuua

SEQ ID NO: 610332 - RNA, 18 nt, Homo sapiens
agaagauagggaacacuc

SEQ ID NO: 610333 - RNA, 19 nt, Homo sapiens
agaagauccaagaggcccu

SEQ ID NO: 610334 - RNA, 22 nt, Homo sapiens
agaagauccaagaggcccugca

SEQ ID NO: 610335 - RNA, 22 nt, Homo sapiens
agaagauggcacuuauaaccaa

SEQ ID NO: 610336 - RNA, 23 nt, Homo sapiens
agaagauuacguuuuacaaugua

SEQ ID NO: 610337 - RNA, 13 nt, Homo sapiens
agaagcaaaaauu

SEQ ID NO: 610338 - RNA, 14 nt, Homo sapiens
agaagcaagccaga

SEQ ID NO: 610339 - RNA, 16 nt, Homo sapiens
agaagcaaucuuugaa

SEQ ID NO: 610340 - RNA, 16 nt, Homo sapiens
agaagcagaaacuggc

SEQ ID NO: 610341 - RNA, 21 nt, Homo sapiens
agcucagagaggcuagaugau

SEQ ID NO: 610342 - RNA, 20 nt, Homo sapiens
agcucagcaacaaggcugca

SEQ ID NO: 610343 - RNA, 18 nt, Homo sapiens
agcucagcauuuccacac

SEQ ID NO: 610344 - RNA, 19 nt, Homo sapiens
agcucagcauuuccacacc

SEQ ID NO: 610345 - RNA, 15 nt, Homo sapiens
agcucagcccacccc

SEQ ID NO: 610346 - RNA, 23 nt, Homo sapiens
agcucagcgccagccugucccau

SEQ ID NO: 610347 - RNA, 19 nt, Homo sapiens
agcucagggcccaucccuu

SEQ ID NO: 610348 - RNA, 20 nt, Homo sapiens
agcucaguaauuccuguuac

SEQ ID NO: 610349 - RNA, 14 nt, Homo sapiens
agcucauaaagaau

SEQ ID NO: 610350 - RNA, 17 nt, Homo sapiens
agcucauccccuuggcu

SEQ ID NO: 610351 - RNA, 15 nt, Homo sapiens
agcucaugacacugu

SEQ ID NO: 610352 - RNA, 22 nt, Homo sapiens
agcucaugcauuucaagcagcu

SEQ ID NO: 610353 - RNA, 23 nt, Homo sapiens
agcucauuugagauaaagucaaa

SEQ ID NO: 610354 - RNA, 15 nt, Homo sapiens
agcuccaauuucaag

SEQ ID NO: 610355 - RNA, 17 nt, Homo sapiens
agcuccaauuucaagag

SEQ ID NO: 610356 - RNA, 13 nt, Homo sapiens
agcuccagcuuua

SEQ ID NO: 610357 - RNA, 16 nt, Homo sapiens
agcuccccggcacugc

SEQ ID NO: 610358 - RNA, 17 nt, Homo sapiens
agcuccccucacucugu

SEQ ID NO: 610359 - RNA, 18 nt, Homo sapiens
agcucccgagcuacucuc

SEQ ID NO: 610360 - RNA, 19 nt, Homo sapiens
agcucccgaggaagcacag

SEQ ID NO: 610361 - RNA, 22 nt, Homo sapiens
agcucccggggacgacgcugac

SEQ ID NO: 610362 - RNA, 22 nt, Homo sapiens
agcuccggcagaagcagcugca

SEQ ID NO: 610363 - RNA, 15 nt, Homo sapiens
agcuccggccugucc

SEQ ID NO: 610364 - RNA, 20 nt, Homo sapiens
agcuccuauuucaaggagaa

SEQ ID NO: 610365 - RNA, 23 nt, Homo sapiens
agcuccucagcggcuccagcuca

SEQ ID NO: 610366 - RNA, 18 nt, Homo sapiens
agcuccuggccaggauaa

SEQ ID NO: 610367 - RNA, 22 nt, Homo sapiens
agcuccuggccaggauaauaua

SEQ ID NO: 610368 - RNA, 16 nt, Homo sapiens
agcuccuugaguaaaa

SEQ ID NO: 610369 - RNA, 21 nt, Homo sapiens
agcuccuuggagcaggcaaaa

SEQ ID NO: 610370 - RNA, 19 nt, Homo sapiens
agcuccuuuauuauaauca

SEQ ID NO: 610371 - RNA, 23 nt, Homo sapiens
agcuccuuuauuauaaucaaagc

SEQ ID NO: 610372 - RNA, 19 nt, Homo sapiens
agcuccuuucaugcuccau

SEQ ID NO: 610373 - RNA, 16 nt, Homo sapiens
agcucgcauuugucaa

SEQ ID NO: 610374 - RNA, 23 nt, Homo sapiens
agcucguucucugggccuucuca

SEQ ID NO: 610375 - RNA, 15 nt, Homo sapiens
agcucuaaagaccau

SEQ ID NO: 610376 - RNA, 10 nt, Homo sapiens
agcucuaccg

SEQ ID NO: 610377 - RNA, 19 nt, Homo sapiens
agcucucaauuuuauguau

SEQ ID NO: 610378 - RNA, 20 nt, Homo sapiens
agcucucccaacucuugcac

SEQ ID NO: 610379 - RNA, 19 nt, Homo sapiens
agcucuccccaaacuugcu

SEQ ID NO: 610380 - RNA, 22 nt, Homo sapiens
agcucuccccucagagugcaag

SEQ ID NO: 610381 - RNA, 23 nt, Homo sapiens
agcucuccccucagagugcaagc

SEQ ID NO: 610382 - RNA, 23 nt, Homo sapiens
agcucugaaaccaguguuaggga

SEQ ID NO: 610383 - RNA, 13 nt, Homo sapiens
agcucugaaguca

SEQ ID NO: 610384 - RNA, 23 nt, Homo sapiens
agcucugaggggaggcaccucca

SEQ ID NO: 610385 - RNA, 19 nt, Homo sapiens
agcucuggaggugcugcuc

SEQ ID NO: 610386 - RNA, 15 nt, Homo sapiens
agcucuggaugaagg

SEQ ID NO: 610387 - RNA, 22 nt, Homo sapiens
agcucuggccacaacagggcau

SEQ ID NO: 610388 - RNA, 17 nt, Homo sapiens
agcucuucaacaugaca

SEQ ID NO: 610389 - RNA, 11 nt, Homo sapiens
agcucuuccau

SEQ ID NO: 610390 - RNA, 14 nt, Homo sapiens
agcugaaaagcaua

SEQ ID NO: 610391 - RNA, 20 nt, Homo sapiens
agcugaaaagggcacuccca

SEQ ID NO: 610392 - RNA, 17 nt, Homo sapiens
agcugaaaugcaggaag

SEQ ID NO: 610393 - RNA, 18 nt, Homo sapiens
agcugaaaugcugcauuu

SEQ ID NO: 610394 - RNA, 20 nt, Homo sapiens
agcugaacacauuugcccaa

SEQ ID NO: 610395 - RNA, 18 nt, Homo sapiens
agcugaauuaucuauaca

SEQ ID NO: 610396 - RNA, 22 nt, Homo sapiens
agcugaccccgagaagugcucu

SEQ ID NO: 610397 - RNA, 23 nt, Homo sapiens
agcugagaccagggucuuaccuc

SEQ ID NO: 610398 - RNA, 20 nt, Homo sapiens
agcugagaucgugcuacugc

SEQ ID NO: 610399 - RNA, 15 nt, Homo sapiens
agcugagauuccugg

SEQ ID NO: 610400 - RNA, 18 nt, Homo sapiens
agcugagcugugacauug

SEQ ID NO: 610401 - RNA, 13 nt, Homo sapiens
agcugagcuuuaa

SEQ ID NO: 610402 - RNA, 17 nt, Homo sapiens
agcugaggaaucuaauu

SEQ ID NO: 610403 - RNA, 21 nt, Homo sapiens
agcugagggagggagccaugg

SEQ ID NO: 610404 - RNA, 13 nt, Homo sapiens
agcugagugcuga

SEQ ID NO: 610405 - RNA, 15 nt, Homo sapiens
agcugagugcugaaa

SEQ ID NO: 610406 - RNA, 14 nt, Homo sapiens
agcugaguguagug

SEQ ID NO: 610407 - RNA, 19 nt, Homo sapiens
agcugauccagagcacaga

SEQ ID NO: 610408 - RNA, 13 nt, Homo sapiens
agcugauccugcg

SEQ ID NO: 610409 - RNA, 12 nt, Homo sapiens
agcugauucacu

SEQ ID NO: 610410 - RNA, 16 nt, Homo sapiens
agcugauuccagaaca

SEQ ID NO: 610411 - RNA, 21 nt, Homo sapiens
agcugcaaauugccugcaaaa

SEQ ID NO: 610412 - RNA, 14 nt, Homo sapiens
agcugcaaguguau

SEQ ID NO: 610413 - RNA, 14 nt, Homo sapiens
agcugcaauaggaa

SEQ ID NO: 610414 - RNA, 14 nt, Homo sapiens
agcugcacauuccu

SEQ ID NO: 610415 - RNA, 15 nt, Homo sapiens
agcugcaccugccag

SEQ ID NO: 610416 - RNA, 18 nt, Homo sapiens
agcugcagaaugacucca

SEQ ID NO: 610417 - RNA, 17 nt, Homo sapiens
agcugcagaucuuugcu

SEQ ID NO: 610418 - RNA, 18 nt, Homo sapiens
agcugcaggggugccugg

SEQ ID NO: 610419 - RNA, 14 nt, Homo sapiens
agcugccaagcacu

SEQ ID NO: 610420 - RNA, 11 nt, Homo sapiens
agcugccauuu

SEQ ID NO: 610421 - RNA, 13 nt, Homo sapiens
agcugccugguau

SEQ ID NO: 610422 - RNA, 22 nt, Homo sapiens
agcugccuuggcucagacaugu

SEQ ID NO: 610423 - RNA, 21 nt, Homo sapiens
agcugcguuuuuuuauaguag

SEQ ID NO: 610424 - RNA, 20 nt, Homo sapiens
agcugcucagcaaccuuuca

SEQ ID NO: 610425 - RNA, 11 nt, Homo sapiens
agcugcucagg

SEQ ID NO: 610426 - RNA, 23 nt, Homo sapiens
agcugcugacacgcagccugcuc

SEQ ID NO: 610427 - RNA, 18 nt, Homo sapiens
agcugcugcuggaucaca

SEQ ID NO: 610428 - RNA, 20 nt, Homo sapiens
agcugcuguccuuuuaggaa

SEQ ID NO: 610429 - RNA, 19 nt, Homo sapiens
agcugcugucuucuggaca

SEQ ID NO: 610430 - RNA, 16 nt, Homo sapiens
agcugcugugccugau

SEQ ID NO: 610431 - RNA, 19 nt, Homo sapiens
agcugcugugccugaugug

SEQ ID NO: 610432 - RNA, 15 nt, Homo sapiens
agcugcuuuacuuaa

SEQ ID NO: 610433 - RNA, 15 nt, Homo sapiens
agcuggaaaaccucc

SEQ ID NO: 610434 - RNA, 13 nt, Homo sapiens
agcuggaaccaug

SEQ ID NO: 610435 - RNA, 14 nt, Homo sapiens
agcuggaagcacau

SEQ ID NO: 610436 - RNA, 17 nt, Homo sapiens
agcuggacugcagggga

SEQ ID NO: 610437 - RNA, 17 nt, Homo sapiens
agcuggagaugaggcca

SEQ ID NO: 610438 - RNA, 18 nt, Homo sapiens
agcuggagggagggguga

SEQ ID NO: 610439 - RNA, 16 nt, Homo sapiens
agcuggagugcugcuu

SEQ ID NO: 610440 - RNA, 20 nt, Homo sapiens
agcuggcaccuuaguugcau

SEQ ID NO: 610441 - RNA, 21 nt, Homo sapiens
agcuggcagacucgggaccaa

SEQ ID NO: 610442 - RNA, 16 nt, Homo sapiens
agcuggccucucuagc

SEQ ID NO: 610443 - RNA, 13 nt, Homo sapiens
agcuggccugaga

SEQ ID NO: 610444 - RNA, 18 nt, Homo sapiens
agcuggccuggacaguau

SEQ ID NO: 610445 - RNA, 16 nt, Homo sapiens
agcuggccuggaccau

SEQ ID NO: 610446 - RNA, 19 nt, Homo sapiens
agcuggccuucugcuucug

SEQ ID NO: 610447 - RNA, 14 nt, Homo sapiens
agcuggccuuugua

SEQ ID NO: 610448 - RNA, 23 nt, Homo sapiens
agcuggcucuccaccuuguuaca

SEQ ID NO: 610449 - RNA, 16 nt, Homo sapiens
agcugggaagaccaau

SEQ ID NO: 610450 - RNA, 17 nt, Homo sapiens
agcugggagggaaccug

SEQ ID NO: 610451 - RNA, 17 nt, Homo sapiens
agcugggauaaucacau

SEQ ID NO: 610452 - RNA, 18 nt, Homo sapiens
agcugggccccaccuacu

SEQ ID NO: 610453 - RNA, 17 nt, Homo sapiens
agcugggccccaugcuc

SEQ ID NO: 610454 - RNA, 16 nt, Homo sapiens
agcuggggcuuauggg

SEQ ID NO: 610455 - RNA, 16 nt, Homo sapiens
agcugggggaagaagg

SEQ ID NO: 610456 - RNA, 17 nt, Homo sapiens
agcugggggccaugagc

SEQ ID NO: 610457 - RNA, 16 nt, Homo sapiens
agcuggggucugggca

SEQ ID NO: 610458 - RNA, 18 nt, Homo sapiens
agcugguaaacuauuugu

SEQ ID NO: 610459 - RNA, 12 nt, Homo sapiens
agcuggugacag

SEQ ID NO: 610460 - RNA, 15 nt, Homo sapiens
agcugguggcaauaa

SEQ ID NO: 610461 - RNA, 19 nt, Homo sapiens
agcugguggcccugugccu

SEQ ID NO: 610462 - RNA, 22 nt, Homo sapiens
agcuguaaucccagcacuuuga

SEQ ID NO: 610463 - RNA, 14 nt, Homo sapiens
aggcaggcauuccu

SEQ ID NO: 610464 - RNA, 21 nt, Homo sapiens
aggcagggcucucccgugcau

SEQ ID NO: 610465 - RNA, 13 nt, Homo sapiens
aggcaggggacaa

SEQ ID NO: 610466 - RNA, 18 nt, Homo sapiens
aggcagguccacagagag

SEQ ID NO: 610467 - RNA, 16 nt, Homo sapiens
aggcaggugccuccag

SEQ ID NO: 610468 - RNA, 15 nt, Homo sapiens
aggcagucauaucaa

SEQ ID NO: 610469 - RNA, 12 nt, Homo sapiens
aggcaguggcaa

SEQ ID NO: 610470 - RNA, 22 nt, Homo sapiens
aggcauaaagacuaauuagcaa

SEQ ID NO: 610471 - RNA, 19 nt, Homo sapiens
aggcauaagaaaacuaaga

SEQ ID NO: 610472 - RNA, 16 nt, Homo sapiens
aggcauagaggcuucu

SEQ ID NO: 610473 - RNA, 19 nt, Homo sapiens
aggcauaggccugggugcu

SEQ ID NO: 610474 - RNA, 16 nt, Homo sapiens
aggcauaggucucuuu

SEQ ID NO: 610475 - RNA, 20 nt, Homo sapiens
aggcaucauacuaaacuuca

SEQ ID NO: 610476 - RNA, 17 nt, Homo sapiens
aggcaucucuguacuuu

SEQ ID NO: 610477 - RNA, 18 nt, Homo sapiens
aggcaucugccucuggaa

SEQ ID NO: 610478 - RNA, 20 nt, Homo sapiens
aggcaucugccucuggaaaa

SEQ ID NO: 610479 - RNA, 23 nt, Homo sapiens
aggcaugagcuacuaugcccaac

SEQ ID NO: 610480 - RNA, 22 nt, Homo sapiens
aggcaugagggaucacagggcc

SEQ ID NO: 610481 - RNA, 20 nt, Homo sapiens
aggcauuaauguuucuaucu

SEQ ID NO: 610482 - RNA, 11 nt, Homo sapiens
aggcauucucu

SEQ ID NO: 610483 - RNA, 18 nt, Homo sapiens
aggcauugagacuucaag

SEQ ID NO: 610484 - RNA, 17 nt, Homo sapiens
aggcauuuccugcugaa

SEQ ID NO: 610485 - RNA, 17 nt, Homo sapiens
aggccaacagcaagugu

SEQ ID NO: 610486 - RNA, 15 nt, Homo sapiens
aggccaacagcaccu

SEQ ID NO: 610487 - RNA, 18 nt, Homo sapiens
aggccaagaauauugcaa

SEQ ID NO: 610488 - RNA, 23 nt, Homo sapiens
aggccaagcauuucuagcaguga

SEQ ID NO: 610489 - RNA, 13 nt, Homo sapiens
aggccaaggcagg

SEQ ID NO: 610490 - RNA, 18 nt, Homo sapiens
aggccaauaaaaaguuca

SEQ ID NO: 610491 - RNA, 16 nt, Homo sapiens
aggccacaccaucucc

SEQ ID NO: 610492 - RNA, 20 nt, Homo sapiens
aggccacuugaugaccccca

SEQ ID NO: 610493 - RNA, 14 nt, Homo sapiens
aggccagagugcug

SEQ ID NO: 610494 - RNA, 17 nt, Homo sapiens
aggccagccugucccug

SEQ ID NO: 610495 - RNA, 17 nt, Homo sapiens
aggccagcuucgugcug

SEQ ID NO: 610496 - RNA, 14 nt, Homo sapiens
aggccagggacuca

SEQ ID NO: 610497 - RNA, 11 nt, Homo sapiens
aggccagguga

SEQ ID NO: 610498 - RNA, 17 nt, Homo sapiens
aggccaggugggcggac

SEQ ID NO: 610499 - RNA, 22 nt, Homo sapiens
aggccaucuguaaauaucccag

SEQ ID NO: 610500 - RNA, 21 nt, Homo sapiens
aggccauugggauauucugaa

SEQ ID NO: 610501 - RNA, 19 nt, Homo sapiens
aggccauugugaaccaaug

SEQ ID NO: 610502 - RNA, 17 nt, Homo sapiens
aggcccaaaugauggau

SEQ ID NO: 610503 - RNA, 14 nt, Homo sapiens
aggcccaacuguga

SEQ ID NO: 610504 - RNA, 20 nt, Homo sapiens
aggcccaagagcagagucug

SEQ ID NO: 610505 - RNA, 12 nt, Homo sapiens
aggcccaccauc

SEQ ID NO: 610506 - RNA, 17 nt, Homo sapiens
aggcccccacuugccuc

SEQ ID NO: 610507 - RNA, 16 nt, Homo sapiens
aggcccuccaugggcu

SEQ ID NO: 610508 - RNA, 12 nt, Homo sapiens
aggcccucgcug

SEQ ID NO: 610509 - RNA, 18 nt, Homo sapiens
aggcccugccauuggccu

SEQ ID NO: 610510 - RNA, 17 nt, Homo sapiens
aggcccugcccaaugag

SEQ ID NO: 610511 - RNA, 19 nt, Homo sapiens
aggcccugcuccugcagca

SEQ ID NO: 610512 - RNA, 20 nt, Homo sapiens
aggcccuguccuaagcacuu

SEQ ID NO: 610513 - RNA, 19 nt, Homo sapiens
aggcccuuauuuucaagaa

SEQ ID NO: 610514 - RNA, 13 nt, Homo sapiens
aggcccuuuucag

SEQ ID NO: 610515 - RNA, 21 nt, Homo sapiens
aggccgagagcagacaccagc

SEQ ID NO: 610516 - RNA, 22 nt, Homo sapiens
aggccgagagcagacaccagca

SEQ ID NO: 610517 - RNA, 20 nt, Homo sapiens
aggccgaggaauccucagag

SEQ ID NO: 610518 - RNA, 19 nt, Homo sapiens
aggccgggcgcaguggcuc

SEQ ID NO: 610519 - RNA, 14 nt, Homo sapiens
aggccgugccuugu

SEQ ID NO: 610520 - RNA, 18 nt, Homo sapiens
aggccgugugucugucag

SEQ ID NO: 610521 - RNA, 22 nt, Homo sapiens
aggccuauaaccccagcucccu

SEQ ID NO: 610522 - RNA, 16 nt, Homo sapiens
aggccucaagaacaaa

SEQ ID NO: 610523 - RNA, 14 nt, Homo sapiens
aggccucacuggcu

SEQ ID NO: 610524 - RNA, 12 nt, Homo sapiens
aggccuccgucu

SEQ ID NO: 610525 - RNA, 22 nt, Homo sapiens
aggccucuuguugagugccagc

SEQ ID NO: 610526 - RNA, 21 nt, Homo sapiens
aggccugaacccguccauuca

SEQ ID NO: 610527 - RNA, 17 nt, Homo sapiens
aggccugacccacgggg

SEQ ID NO: 610528 - RNA, 18 nt, Homo sapiens
aggccugacccacggggc

SEQ ID NO: 610529 - RNA, 14 nt, Homo sapiens
aggccugcccuccc

SEQ ID NO: 610530 - RNA, 21 nt, Homo sapiens
aggccugccucccacuucacu

SEQ ID NO: 610531 - RNA, 17 nt, Homo sapiens
aggccugcugccagugc

SEQ ID NO: 610532 - RNA, 14 nt, Homo sapiens
aggccuggacuuuc

SEQ ID NO: 610533 - RNA, 15 nt, Homo sapiens
aggccuggauaauau

SEQ ID NO: 610534 - RNA, 12 nt, Homo sapiens
aggccuguccaa

SEQ ID NO: 610535 - RNA, 12 nt, Homo sapiens
aggccugugcuc

SEQ ID NO: 610536 - RNA, 16 nt, Homo sapiens
aggccuuccagcugcu

SEQ ID NO: 610537 - RNA, 16 nt, Homo sapiens
aggccuuuuuugccag

SEQ ID NO: 610538 - RNA, 22 nt, Homo sapiens
aggccuuuuuugccagacucua

SEQ ID NO: 610539 - RNA, 21 nt, Homo sapiens
aggcgagccugacucuguuga

SEQ ID NO: 610540 - RNA, 21 nt, Homo sapiens
aggcgcaguggcucaugccug

SEQ ID NO: 610541 - RNA, 21 nt, Homo sapiens
aggcgccccuucccccuccaa

SEQ ID NO: 610542 - RNA, 23 nt, Homo sapiens
aggcgcccuuggcuucugugaug

SEQ ID NO: 610543 - RNA, 17 nt, Homo sapiens
aggcgccgcacuuccuu

SEQ ID NO: 610544 - RNA, 16 nt, Homo sapiens
aggcgcuguucuugcu

SEQ ID NO: 610545 - RNA, 18 nt, Homo sapiens
aggcgucugcugucucau

SEQ ID NO: 610546 - RNA, 21 nt, Homo sapiens
aggcgugccccccuccuccag

SEQ ID NO: 610547 - RNA, 14 nt, Homo sapiens
aggcguucuucgag

SEQ ID NO: 610548 - RNA, 22 nt, Homo sapiens
aggcuaaaacaccuuggcuugu

SEQ ID NO: 610549 - RNA, 18 nt, Homo sapiens
aggcuaaaugagauacac

SEQ ID NO: 610550 - RNA, 14 nt, Homo sapiens
aggcuaagcacuuu

SEQ ID NO: 610551 - RNA, 19 nt, Homo sapiens
aggcuacauauacauaguu

SEQ ID NO: 610552 - RNA, 19 nt, Homo sapiens
aggcuacuaccuagggcac

SEQ ID NO: 610553 - RNA, 20 nt, Homo sapiens
aggcuacuauagguccagaa

SEQ ID NO: 610554 - RNA, 22 nt, Homo sapiens
aggcuacuauagguccagaagu

SEQ ID NO: 610555 - RNA, 13 nt, Homo sapiens
aggcuacuugagc

SEQ ID NO: 610556 - RNA, 23 nt, Homo sapiens
aggcuagaagugugaagugcaga

SEQ ID NO: 610557 - RNA, 20 nt, Homo sapiens
aggcuauguaaacaaaccac

SEQ ID NO: 610558 - RNA, 19 nt, Homo sapiens
aggcuauuauuuauuguau

SEQ ID NO: 610559 - RNA, 17 nt, Homo sapiens
aggcucaauauuccuga

SEQ ID NO: 610560 - RNA, 17 nt, Homo sapiens
aggcucacgaagggcau

SEQ ID NO: 610561 - RNA, 22 nt, Homo sapiens
aggcuccagagggcacucugcu

SEQ ID NO: 610562 - RNA, 12 nt, Homo sapiens
aggcucuaaugu

SEQ ID NO: 610563 - RNA, 17 nt, Homo sapiens
aggcucuaauguacaau

SEQ ID NO: 610564 - RNA, 18 nt, Homo sapiens
aggcucuaauguacaaua

SEQ ID NO: 610565 - RNA, 19 nt, Homo sapiens
aggcucuaauguacaauaa

SEQ ID NO: 610566 - RNA, 20 nt, Homo sapiens
aggcucucccucucucucau

SEQ ID NO: 610567 - RNA, 16 nt, Homo sapiens
aggcucugaaauggaa

SEQ ID NO: 610568 - RNA, 23 nt, Homo sapiens
aggcucuggacagaugaauaccu

SEQ ID NO: 610569 - RNA, 17 nt, Homo sapiens
aggcucuggagccagag

SEQ ID NO: 610570 - RNA, 19 nt, Homo sapiens
aggcucugggcucagggcu

SEQ ID NO: 610571 - RNA, 13 nt, Homo sapiens
aggcucuuagcag

SEQ ID NO: 610572 - RNA, 16 nt, Homo sapiens
aggcugaccaagagag

SEQ ID NO: 610573 - RNA, 15 nt, Homo sapiens
aggcugacuucagag

SEQ ID NO: 610574 - RNA, 15 nt, Homo sapiens
aggcugacuuuugca

SEQ ID NO: 610575 - RNA, 18 nt, Homo sapiens
aggcugagaacucguuca

SEQ ID NO: 610576 - RNA, 13 nt, Homo sapiens
aggcugagcugca

SEQ ID NO: 610577 - RNA, 18 nt, Homo sapiens
aggcugaggcaggaggau

SEQ ID NO: 610578 - RNA, 17 nt, Homo sapiens
aggcugaggcaggugga

SEQ ID NO: 610579 - RNA, 19 nt, Homo sapiens
aggcugaggggaggaucac

SEQ ID NO: 610580 - RNA, 15 nt, Homo sapiens
aggcugcacagcuca

SEQ ID NO: 610581 - RNA, 20 nt, Homo sapiens
aggcugcagcgagcuaugau

SEQ ID NO: 610582 - RNA, 15 nt, Homo sapiens
aggcugcaugcucug

SEQ ID NO: 610583 - RNA, 18 nt, Homo sapiens
aggcugcccacucuccau

SEQ ID NO: 610584 - RNA, 22 nt, Homo sapiens
aggcugcccccauccagccacg

SEQ ID NO: 610585 - RNA, 21 nt, Homo sapiens
agguugcaguagcaguggaug

SEQ ID NO: 610586 - RNA, 15 nt, Homo sapiens
agguuggagcagugc

SEQ ID NO: 610587 - RNA, 19 nt, Homo sapiens
agguuggagcccagggcau

SEQ ID NO: 610588 - RNA, 19 nt, Homo sapiens
agguuggugaauuucacaa

SEQ ID NO: 610589 - RNA, 21 nt, Homo sapiens
agguuggugacugaaacauuc

SEQ ID NO: 610590 - RNA, 19 nt, Homo sapiens
agguugucuccaggccaug

SEQ ID NO: 610591 - RNA, 17 nt, Homo sapiens
agguuucccccugucuc

SEQ ID NO: 610592 - RNA, 17 nt, Homo sapiens
agguuuccuaggucuga

SEQ ID NO: 610593 - RNA, 21 nt, Homo sapiens
agguuucuugaauaucugccc

SEQ ID NO: 610594 - RNA, 20 nt, Homo sapiens
agguuugauucaacacuuaa

SEQ ID NO: 610595 - RNA, 15 nt, Homo sapiens
agguuugccagcauu

SEQ ID NO: 610596 - RNA, 22 nt, Homo sapiens
agguuuguccuggucaugcaca

SEQ ID NO: 610597 - RNA, 17 nt, Homo sapiens
agguuuuacacuugcau

SEQ ID NO: 610598 - RNA, 15 nt, Homo sapiens
agguuuuuacuguga

SEQ ID NO: 610599 - RNA, 15 nt, Homo sapiens
aguaaaaagguggua

SEQ ID NO: 610600 - RNA, 22 nt, Homo sapiens
aguaaaacucccccccacccaa

SEQ ID NO: 610601 - RNA, 13 nt, Homo sapiens
aguaaaacuguau

SEQ ID NO: 610602 - RNA, 14 nt, Homo sapiens
aguaaaagaugaag

SEQ ID NO: 610603 - RNA, 14 nt, Homo sapiens
aguaaaagugcuuu

SEQ ID NO: 610604 - RNA, 17 nt, Homo sapiens
aguaaaagugcuuucca

SEQ ID NO: 610605 - RNA, 19 nt, Homo sapiens
aguaaaauuauacugugug

SEQ ID NO: 610606 - RNA, 12 nt, Homo sapiens
aguaaacacuug

SEQ ID NO: 610607 - RNA, 19 nt, Homo sapiens
aguaaacgggaacaugccc

SEQ ID NO: 610608 - RNA, 15 nt, Homo sapiens
aguaaagacuauucu

SEQ ID NO: 610609 - RNA, 13 nt, Homo sapiens
aguaaagccucaa

SEQ ID NO: 610610 - RNA, 19 nt, Homo sapiens
aguaaagguuaauuaugau

SEQ ID NO: 610611 - RNA, 22 nt, Homo sapiens
aguaaaguaccuuuauguuaug

SEQ ID NO: 610612 - RNA, 16 nt, Homo sapiens
aguaaauaacuggaaa

SEQ ID NO: 610613 - RNA, 20 nt, Homo sapiens
aguaaauacaguagaagcuc

SEQ ID NO: 610614 - RNA, 14 nt, Homo sapiens
aguaaaugcgugcu

SEQ ID NO: 610615 - RNA, 19 nt, Homo sapiens
aguaacaggaaaccacuua

SEQ ID NO: 610616 - RNA, 13 nt, Homo sapiens
aguaacauuaacu

SEQ ID NO: 610617 - RNA, 13 nt, Homo sapiens
aguaacauuugcc

SEQ ID NO: 610618 - RNA, 21 nt, Homo sapiens
aguaacauuugcuguuuuaaa

SEQ ID NO: 610619 - RNA, 16 nt, Homo sapiens
aguaaccauuugcacu

SEQ ID NO: 610620 - RNA, 15 nt, Homo sapiens
aguaaccauuuuccu

SEQ ID NO: 610621 - RNA, 15 nt, Homo sapiens
aguaacugaaccauu

SEQ ID NO: 610622 - RNA, 16 nt, Homo sapiens
aguaacugaaccauuc

SEQ ID NO: 610623 - RNA, 17 nt, Homo sapiens
aguaacugcacacuauu

SEQ ID NO: 610624 - RNA, 23 nt, Homo sapiens
aguaacugguuaaaaaacaaaug

SEQ ID NO: 610625 - RNA, 18 nt, Homo sapiens
aguaacuucacauuaaaa

SEQ ID NO: 610626 - RNA, 19 nt, Homo sapiens
aguaacuuggcuuucauua

SEQ ID NO: 610627 - RNA, 11 nt, Homo sapiens
aguaagagcuu

SEQ ID NO: 610628 - RNA, 21 nt, Homo sapiens
aguaaguaccacucaggccaa

SEQ ID NO: 610629 - RNA, 13 nt, Homo sapiens
aguaaguacgugu

SEQ ID NO: 610630 - RNA, 17 nt, Homo sapiens
aguaauacaucaaagag

SEQ ID NO: 610631 - RNA, 20 nt, Homo sapiens
aguaauagauuguuuugcca

SEQ ID NO: 610632 - RNA, 14 nt, Homo sapiens
aguaauaugcacac

SEQ ID NO: 610633 - RNA, 19 nt, Homo sapiens
aguaaucuguauaauacuu

SEQ ID NO: 610634 - RNA, 15 nt, Homo sapiens
aguaaugagcaugau

SEQ ID NO: 610635 - RNA, 16 nt, Homo sapiens
aguaaugauacugugu

SEQ ID NO: 610636 - RNA, 22 nt, Homo sapiens
aguaaugcaagcaaaguaucaa

SEQ ID NO: 610637 - RNA, 16 nt, Homo sapiens
aguaaugccacacauu

SEQ ID NO: 610638 - RNA, 16 nt, Homo sapiens
aguaauguuaauucuu

SEQ ID NO: 610639 - RNA, 14 nt, Homo sapiens
aguaauuguaauac

SEQ ID NO: 610640 - RNA, 22 nt, Homo sapiens
aguacaaagguugcagugcuga

SEQ ID NO: 610641 - RNA, 15 nt, Homo sapiens
aguacacagauaccu

SEQ ID NO: 610642 - RNA, 20 nt, Homo sapiens
aguacagcaugugccuuaau

SEQ ID NO: 610643 - RNA, 22 nt, Homo sapiens
aguacaugauaaaugauagaca

SEQ ID NO: 610644 - RNA, 18 nt, Homo sapiens
aguacauuguuaccucua

SEQ ID NO: 610645 - RNA, 21 nt, Homo sapiens
aguaccaaagaaauuauaaac

SEQ ID NO: 610646 - RNA, 15 nt, Homo sapiens
aguaccaaugcucuu

SEQ ID NO: 610647 - RNA, 19 nt, Homo sapiens
aguaccacacauauugcac

SEQ ID NO: 610648 - RNA, 22 nt, Homo sapiens
aguaccaccccucucuccccac

SEQ ID NO: 610649 - RNA, 24 nt, Homo sapiens
aguaccaguauaagcaucugccau

SEQ ID NO: 610650 - RNA, 10 nt, Homo sapiens
aguaccccau

SEQ ID NO: 610651 - RNA, 21 nt, Homo sapiens
aguaccccugguaaaccaagc

SEQ ID NO: 610652 - RNA, 11 nt, Homo sapiens
aguaccugcug

SEQ ID NO: 610653 - RNA, 14 nt, Homo sapiens
aguaccuguaguga

SEQ ID NO: 610654 - RNA, 21 nt, Homo sapiens
aguacgucccagcggccucag

SEQ ID NO: 610655 - RNA, 21 nt, Homo sapiens
aguacguguuauuuuuuucaa

SEQ ID NO: 610656 - RNA, 18 nt, Homo sapiens
aguacuaagggaacaauc

SEQ ID NO: 610657 - RNA, 19 nt, Homo sapiens
aguacuagaugcaucacug

SEQ ID NO: 610658 - RNA, 15 nt, Homo sapiens
aguacuggagugaaa

SEQ ID NO: 610659 - RNA, 14 nt, Homo sapiens
aguacuggcauggu

SEQ ID NO: 610660 - RNA, 13 nt, Homo sapiens
aguacuguacagg

SEQ ID NO: 610661 - RNA, 11 nt, Homo sapiens
aguacuugaaa

SEQ ID NO: 610662 - RNA, 14 nt, Homo sapiens
aguagaaccaguga

SEQ ID NO: 610663 - RNA, 16 nt, Homo sapiens
aguagaagauuugaug

SEQ ID NO: 610664 - RNA, 22 nt, Homo sapiens
aguagaagauuuuaugcugcug

SEQ ID NO: 610665 - RNA, 14 nt, Homo sapiens
aguagaagcucaca

SEQ ID NO: 610666 - RNA, 16 nt, Homo sapiens
aguagaaguuacuuaa

SEQ ID NO: 610667 - RNA, 16 nt, Homo sapiens
aguagaauaagccuuc

SEQ ID NO: 610668 - RNA, 20 nt, Homo sapiens
aguagaauacgcagaacuac

SEQ ID NO: 610669 - RNA, 19 nt, Homo sapiens
aguagaauauggacuugga

SEQ ID NO: 610670 - RNA, 18 nt, Homo sapiens
aguagauauugauuacua

SEQ ID NO: 610671 - RNA, 16 nt, Homo sapiens
aguagcauacauuuau

SEQ ID NO: 610672 - RNA, 20 nt, Homo sapiens
aguagccgcugggguguuaa

SEQ ID NO: 610673 - RNA, 22 nt, Homo sapiens
aguagccuaacacacuccaaga

SEQ ID NO: 610674 - RNA, 17 nt, Homo sapiens
aguagcugaaaugcaag

SEQ ID NO: 610675 - RNA, 17 nt, Homo sapiens
aguagcugcccuuccug

SEQ ID NO: 610676 - RNA, 22 nt, Homo sapiens
aguagcugggaccacaggcaug

SEQ ID NO: 610677 - RNA, 18 nt, Homo sapiens
aguaggacaaacgggcuc

SEQ ID NO: 610678 - RNA, 18 nt, Homo sapiens
aguagggauaaagucauc

SEQ ID NO: 610679 - RNA, 13 nt, Homo sapiens
aguagggggagca

SEQ ID NO: 610680 - RNA, 18 nt, Homo sapiens
aguaggugugacuugaac

SEQ ID NO: 610681 - RNA, 13 nt, Homo sapiens
aguaguacuugaa

SEQ ID NO: 610682 - RNA, 16 nt, Homo sapiens
aguaguaugaugauac

SEQ ID NO: 610683 - RNA, 16 nt, Homo sapiens
aguagucccugcacag

SEQ ID NO: 610684 - RNA, 17 nt, Homo sapiens
aguaguccuuggcauag

SEQ ID NO: 610685 - RNA, 16 nt, Homo sapiens
aguaguguacauuacc

SEQ ID NO: 610686 - RNA, 18 nt, Homo sapiens
aguaguguggccugugcc

SEQ ID NO: 610687 - RNA, 16 nt, Homo sapiens
aguauaaacaaaguua

SEQ ID NO: 610688 - RNA, 16 nt, Homo sapiens
aguauaaagcuaugua

SEQ ID NO: 610689 - RNA, 22 nt, Homo sapiens
aguauaaauaaaaugagcaaaa

SEQ ID NO: 610690 - RNA, 12 nt, Homo sapiens
aguauaacaguu

SEQ ID NO: 610691 - RNA, 18 nt, Homo sapiens
aguauaagcaucugccau

SEQ ID NO: 610692 - RNA, 17 nt, Homo sapiens
aguauaauguuuauuaa

SEQ ID NO: 610693 - RNA, 12 nt, Homo sapiens
aguauagcuuua

SEQ ID NO: 610694 - RNA, 15 nt, Homo sapiens
aguauauaguauauu

SEQ ID NO: 610695 - RNA, 20 nt, Homo sapiens
aguauaucucuagaugcaaa

SEQ ID NO: 610696 - RNA, 14 nt, Homo sapiens
aguauaugucaugc

SEQ ID NO: 610697 - RNA, 15 nt, Homo sapiens
aguauauguucagca

SEQ ID NO: 610698 - RNA, 14 nt, Homo sapiens
aguauauucuuucc

SEQ ID NO: 610699 - RNA, 17 nt, Homo sapiens
aguauauugauaaccuu

SEQ ID NO: 610700 - RNA, 21 nt, Homo sapiens
aguaucagaauacuugcacuc

SEQ ID NO: 610701 - RNA, 23 nt, Homo sapiens
aguaucaggucugaccccagugg

SEQ ID NO: 610702 - RNA, 13 nt, Homo sapiens
aguaucaugaagc

SEQ ID NO: 610703 - RNA, 18 nt, Homo sapiens
aguaucaugaagccuaaa

SEQ ID NO: 610704 - RNA, 21 nt, Homo sapiens
aguaucaugcccugugcaacc

SEQ ID NO: 610705 - RNA, 12 nt, Homo sapiens
aguauccacaau

SEQ ID NO: 610706 - RNA, 19 nt, Homo sapiens
aguaucuaacaaaaccaau

SEQ ID NO: 610707 - RNA, 14 nt, Homo sapiens
aguucagacuguua

SEQ ID NO: 610708 - RNA, 19 nt, Homo sapiens
aguucagcuccuuccacca

SEQ ID NO: 610709 - RNA, 22 nt, Homo sapiens
aguucaguagaauuaccauuaa

SEQ ID NO: 610710 - RNA, 13 nt, Homo sapiens
aguucagugcuca

SEQ ID NO: 610711 - RNA, 17 nt, Homo sapiens
aguucagugcucauacg

SEQ ID NO: 610712 - RNA, 16 nt, Homo sapiens
aguucauauguaccau

SEQ ID NO: 610713 - RNA, 14 nt, Homo sapiens
aguucaucaccauu

SEQ ID NO: 610714 - RNA, 13 nt, Homo sapiens
aguuccacugcug

SEQ ID NO: 610715 - RNA, 17 nt, Homo sapiens
aguucccaccaucugau

SEQ ID NO: 610716 - RNA, 18 nt, Homo sapiens
aguucccagacagcuuuu

SEQ ID NO: 610717 - RNA, 17 nt, Homo sapiens
aguucccuuggccucag

SEQ ID NO: 610718 - RNA, 22 nt, Homo sapiens
aguuccgccucccggguucaca

SEQ ID NO: 610719 - RNA, 22 nt, Homo sapiens
aguuccgggagcggauggagaa

SEQ ID NO: 610720 - RNA, 15 nt, Homo sapiens
aguuccgucuucccu

SEQ ID NO: 610721 - RNA, 16 nt, Homo sapiens
aguuccugcucucugc

SEQ ID NO: 610722 - RNA, 17 nt, Homo sapiens
aguuccuggcccaucaa

SEQ ID NO: 610723 - RNA, 15 nt, Homo sapiens
aguuccuucugcucc

SEQ ID NO: 610724 - RNA, 15 nt, Homo sapiens
aguuccuugccuuaa

SEQ ID NO: 610725 - RNA, 16 nt, Homo sapiens
aguuccuugccuuaau

SEQ ID NO: 610726 - RNA, 15 nt, Homo sapiens
aguucguauacuucg

SEQ ID NO: 610727 - RNA, 23 nt, Homo sapiens
aguucucaucccucugucagggu

SEQ ID NO: 610728 - RNA, 21 nt, Homo sapiens
aguucucauggguggcacuca

SEQ ID NO: 610729 - RNA, 15 nt, Homo sapiens
aguucucccagggag

SEQ ID NO: 610730 - RNA, 15 nt, Homo sapiens
aguucuccuucccug

SEQ ID NO: 610731 - RNA, 20 nt, Homo sapiens
aguucuccuucccugcagag

SEQ ID NO: 610732 - RNA, 20 nt, Homo sapiens
aguucucuugcuuucacauu

SEQ ID NO: 610733 - RNA, 15 nt, Homo sapiens
aguucugcaaaauac

SEQ ID NO: 610734 - RNA, 22 nt, Homo sapiens
aguucuggaagggacuuuagag

SEQ ID NO: 610735 - RNA, 20 nt, Homo sapiens
aguucuggugaauguucaau

SEQ ID NO: 610736 - RNA, 18 nt, Homo sapiens
aguugaagggaggggcug

SEQ ID NO: 610737 - RNA, 17 nt, Homo sapiens
aguugaagggaggugaa

SEQ ID NO: 610738 - RNA, 14 nt, Homo sapiens
aguugaggacuucu

SEQ ID NO: 610739 - RNA, 16 nt, Homo sapiens
aguugauucuugccuu

SEQ ID NO: 610740 - RNA, 13 nt, Homo sapiens
aguugcaacuuaa

SEQ ID NO: 610741 - RNA, 20 nt, Homo sapiens
aguugcaacuuaaguauauu

SEQ ID NO: 610742 - RNA, 18 nt, Homo sapiens
aguugccaagacaaauca

SEQ ID NO: 610743 - RNA, 22 nt, Homo sapiens
aguugccaucugcgugacaaua

SEQ ID NO: 610744 - RNA, 11 nt, Homo sapiens
aguugccugau

SEQ ID NO: 610745 - RNA, 17 nt, Homo sapiens
aguugcugaugaacucu

SEQ ID NO: 610746 - RNA, 22 nt, Homo sapiens
aguugcuuuaaaguaccuguag

SEQ ID NO: 610747 - RNA, 15 nt, Homo sapiens
aguugcuuugcccaa

SEQ ID NO: 610748 - RNA, 17 nt, Homo sapiens
aguuggacuuguuuuaa

SEQ ID NO: 610749 - RNA, 15 nt, Homo sapiens
aguuggaucucuaca

SEQ ID NO: 610750 - RNA, 21 nt, Homo sapiens
aguuggcauuuguuauccucu

SEQ ID NO: 610751 - RNA, 11 nt, Homo sapiens
aguugggaugc

SEQ ID NO: 610752 - RNA, 17 nt, Homo sapiens
aguugggcucgcacugc

SEQ ID NO: 610753 - RNA, 14 nt, Homo sapiens
aguugggcuuucac

SEQ ID NO: 610754 - RNA, 23 nt, Homo sapiens
aguugggggagggaagaccagaa

SEQ ID NO: 610755 - RNA, 14 nt, Homo sapiens
aguuggugcugcuu

SEQ ID NO: 610756 - RNA, 15 nt, Homo sapiens
aguuguaacaaauac

SEQ ID NO: 610757 - RNA, 22 nt, Homo sapiens
aguuguauucagcguacuugaa

SEQ ID NO: 610758 - RNA, 14 nt, Homo sapiens
aguuguccgugaua

SEQ ID NO: 610759 - RNA, 16 nt, Homo sapiens
aguugucuuuugccau

SEQ ID NO: 610760 - RNA, 15 nt, Homo sapiens
aguuguuaauaaaag

SEQ ID NO: 610761 - RNA, 18 nt, Homo sapiens
aguuguuaugccaugauu

SEQ ID NO: 610762 - RNA, 18 nt, Homo sapiens
aguuguugaaagcugaaa

SEQ ID NO: 610763 - RNA, 15 nt, Homo sapiens
aguuguugacuguga

SEQ ID NO: 610764 - RNA, 16 nt, Homo sapiens
aguuguugacugugau

SEQ ID NO: 610765 - RNA, 23 nt, Homo sapiens
aguuguuggcaagguagcaauac

SEQ ID NO: 610766 - RNA, 15 nt, Homo sapiens
aguuguuugcuucuu

SEQ ID NO: 610767 - RNA, 20 nt, Homo sapiens
aguuguuuguuuuugcuugu

SEQ ID NO: 610768 - RNA, 19 nt, Homo sapiens
aguuguuuuauauguugcu

SEQ ID NO: 610769 - RNA, 16 nt, Homo sapiens
aguuguuuugcuucuu

SEQ ID NO: 610770 - RNA, 17 nt, Homo sapiens
aguuuaacauuagcuaa

SEQ ID NO: 610771 - RNA, 18 nt, Homo sapiens
aguuuaauagauguuacu

SEQ ID NO: 610772 - RNA, 17 nt, Homo sapiens
aguuuacccaugaagau

SEQ ID NO: 610773 - RNA, 15 nt, Homo sapiens
aguuuaccucaucca

SEQ ID NO: 610774 - RNA, 12 nt, Homo sapiens
aguuuaccucuu

SEQ ID NO: 610775 - RNA, 20 nt, Homo sapiens
aguuuauaaaugugaacuua

SEQ ID NO: 610776 - RNA, 15 nt, Homo sapiens
aguuuauaagacugg

SEQ ID NO: 610777 - RNA, 15 nt, Homo sapiens
aguuuauacuucucu

SEQ ID NO: 610778 - RNA, 19 nt, Homo sapiens
aguuuauacuucucuauua

SEQ ID NO: 610779 - RNA, 17 nt, Homo sapiens
aguuuauauacaauuau

SEQ ID NO: 610780 - RNA, 14 nt, Homo sapiens
aguuuaugauggaa

SEQ ID NO: 610781 - RNA, 14 nt, Homo sapiens
aguuuaugauuuaa

SEQ ID NO: 610782 - RNA, 17 nt, Homo sapiens
aguuuauugacaauaau

SEQ ID NO: 610783 - RNA, 20 nt, Homo sapiens
aguuuauuuuuauacuuuca

SEQ ID NO: 610784 - RNA, 18 nt, Homo sapiens
aguuucaaacuuacuauu

SEQ ID NO: 610785 - RNA, 21 nt, Homo sapiens
aguuucagagaaauacuuuca

SEQ ID NO: 610786 - RNA, 16 nt, Homo sapiens
aguuucagagugugga

SEQ ID NO: 610787 - RNA, 21 nt, Homo sapiens
aguuucagauuugccauucaa

SEQ ID NO: 610788 - RNA, 14 nt, Homo sapiens
aguuucaucaguca

SEQ ID NO: 610789 - RNA, 21 nt, Homo sapiens
aguuucauguacaagaugaag

SEQ ID NO: 610790 - RNA, 20 nt, Homo sapiens
aguuucauuuaugauacaaa

SEQ ID NO: 610791 - RNA, 12 nt, Homo sapiens
aguuucuaagca

SEQ ID NO: 610792 - RNA, 14 nt, Homo sapiens
aguuucucaaagau

SEQ ID NO: 610793 - RNA, 18 nt, Homo sapiens
aguuugaauuuguauuaa

SEQ ID NO: 610794 - RNA, 13 nt, Homo sapiens
aguuugagacagg

SEQ ID NO: 610795 - RNA, 13 nt, Homo sapiens
aguuugcaaaaaa

SEQ ID NO: 610796 - RNA, 17 nt, Homo sapiens
aguuugcaaugucacaa

SEQ ID NO: 610797 - RNA, 21 nt, Homo sapiens
aguuugcuuauguaaucucac

SEQ ID NO: 610798 - RNA, 18 nt, Homo sapiens
aguuugcuucuacaugau

SEQ ID NO: 610799 - RNA, 19 nt, Homo sapiens
aguuugcuuuguaugcacu

SEQ ID NO: 610800 - RNA, 23 nt, Homo sapiens
aguuugcuuuuugcguacacaga

SEQ ID NO: 610801 - RNA, 19 nt, Homo sapiens
aguuuggcuuuuuucacau

SEQ ID NO: 610802 - RNA, 16 nt, Homo sapiens
aguuuggguaaaauac

SEQ ID NO: 610803 - RNA, 17 nt, Homo sapiens
aguuugucagacuuuaa

SEQ ID NO: 610804 - RNA, 19 nt, Homo sapiens
aguuuguccuacaauagaa

SEQ ID NO: 610805 - RNA, 19 nt, Homo sapiens
aguuuguggcaucuugcca

SEQ ID NO: 610806 - RNA, 22 nt, Homo sapiens
aguuuguguguauuuguauuaa

SEQ ID NO: 610807 - RNA, 23 nt, Homo sapiens
aguuuguguguauuuguauuaau

SEQ ID NO: 610808 - RNA, 14 nt, Homo sapiens
aguuuuaacugugg

SEQ ID NO: 610809 - RNA, 15 nt, Homo sapiens
aguuuuacagcaagg

SEQ ID NO: 610810 - RNA, 17 nt, Homo sapiens
aguuuuacuaaaacacu

SEQ ID NO: 610811 - RNA, 23 nt, Homo sapiens
aguuuuacuaaaacacugaaaaa

SEQ ID NO: 610812 - RNA, 17 nt, Homo sapiens
aguuuucauaguaucca

SEQ ID NO: 610813 - RNA, 23 nt, Homo sapiens
aguuuuccuucucaucugugauu

SEQ ID NO: 610814 - RNA, 17 nt, Homo sapiens
aguuuucuaaacucaau

SEQ ID NO: 610815 - RNA, 20 nt, Homo sapiens
aguuuucuagagacuugaag

SEQ ID NO: 610816 - RNA, 19 nt, Homo sapiens
aguuuucugaccagcuuuu

SEQ ID NO: 610817 - RNA, 22 nt, Homo sapiens
aguuuugaguguauacaugugu

SEQ ID NO: 610818 - RNA, 13 nt, Homo sapiens
aguuuugaugcug

SEQ ID NO: 610819 - RNA, 20 nt, Homo sapiens
aguuuugccuaauggcaaaa

SEQ ID NO: 610820 - RNA, 15 nt, Homo sapiens
aguuuuggcauaaua

SEQ ID NO: 610821 - RNA, 16 nt, Homo sapiens
aguuuuguauucaaua

SEQ ID NO: 610822 - RNA, 17 nt, Homo sapiens
aguuuuuauagcuauca

SEQ ID NO: 610823 - RNA, 13 nt, Homo sapiens
aguuuuucccaag

SEQ ID NO: 610824 - RNA, 21 nt, Homo sapiens
aguuuuucccucagugaaggc

SEQ ID NO: 610825 - RNA, 15 nt, Homo sapiens
aguuuuuguuucaca

SEQ ID NO: 610826 - RNA, 21 nt, Homo sapiens
aguuuuuuauuaugcauuaua

SEQ ID NO: 610827 - RNA, 17 nt, Homo sapiens
aguuuuuuuuuuuccag

SEQ ID NO: 610828 - RNA, 14 nt, Homo sapiens
auaaaaaacucaca

SEQ ID NO: 610829 - RNA, 23 nt, Homo sapiens
augacuucuuuacuaacacuggc

SEQ ID NO: 610830 - RNA, 22 nt, Homo sapiens
augacuugguuuauggccuuaa

SEQ ID NO: 610831 - RNA, 19 nt, Homo sapiens
augacuuuauccugagucc

SEQ ID NO: 610832 - RNA, 17 nt, Homo sapiens
augagaaaagaaauuag

SEQ ID NO: 610833 - RNA, 13 nt, Homo sapiens
augagaagacaug

SEQ ID NO: 610834 - RNA, 14 nt, Homo sapiens
augagaaucaugca

SEQ ID NO: 610835 - RNA, 13 nt, Homo sapiens
augagacauuagg

SEQ ID NO: 610836 - RNA, 17 nt, Homo sapiens
augagaccacuguuauc

SEQ ID NO: 610837 - RNA, 14 nt, Homo sapiens
augagagaacugga

SEQ ID NO: 610838 - RNA, 18 nt, Homo sapiens
augagagggaugaggcaa

SEQ ID NO: 610839 - RNA, 16 nt, Homo sapiens
augagaguuccuucuc

SEQ ID NO: 610840 - RNA, 23 nt, Homo sapiens
augagaguuucuguuaaucaugu

SEQ ID NO: 610841 - RNA, 18 nt, Homo sapiens
augagaugauacauccaa

SEQ ID NO: 610842 - RNA, 19 nt, Homo sapiens
augagauguuaaauacuuu

SEQ ID NO: 610843 - RNA, 18 nt, Homo sapiens
augagauguuauuacugu

SEQ ID NO: 610844 - RNA, 13 nt, Homo sapiens
augagauuggcau

SEQ ID NO: 610845 - RNA, 14 nt, Homo sapiens
augagcacaucucu

SEQ ID NO: 610846 - RNA, 16 nt, Homo sapiens
augagcacaucucucu

SEQ ID NO: 610847 - RNA, 14 nt, Homo sapiens
augagcaccuccag

SEQ ID NO: 610848 - RNA, 18 nt, Homo sapiens
augagcauccucucucac

SEQ ID NO: 610849 - RNA, 15 nt, Homo sapiens
augagcauuacuauu

SEQ ID NO: 610850 - RNA, 14 nt, Homo sapiens
augagccacugcac

SEQ ID NO: 610851 - RNA, 16 nt, Homo sapiens
augagccacugugcuu

SEQ ID NO: 610852 - RNA, 20 nt, Homo sapiens
augagccauauuaauugccu

SEQ ID NO: 610853 - RNA, 17 nt, Homo sapiens
augagccaucacuagaa

SEQ ID NO: 610854 - RNA, 19 nt, Homo sapiens
augagccaucacuagaaga

SEQ ID NO: 610855 - RNA, 13 nt, Homo sapiens
augagccaugaga

SEQ ID NO: 610856 - RNA, 17 nt, Homo sapiens
augagcccuggcuccca

SEQ ID NO: 610857 - RNA, 16 nt, Homo sapiens
augagcgccaccucuu

SEQ ID NO: 610858 - RNA, 23 nt, Homo sapiens
augagcgucacugcccaccaaag

SEQ ID NO: 610859 - RNA, 14 nt, Homo sapiens
augagcuauuucca

SEQ ID NO: 610860 - RNA, 19 nt, Homo sapiens
augagcucugaacaaacac

SEQ ID NO: 610861 - RNA, 16 nt, Homo sapiens
augagcugacaucuca

SEQ ID NO: 610862 - RNA, 18 nt, Homo sapiens
augagcugcugugcccag

SEQ ID NO: 610863 - RNA, 17 nt, Homo sapiens
augagcugucugggaag

SEQ ID NO: 610864 - RNA, 22 nt, Homo sapiens
augagcuucaauauaagaagca

SEQ ID NO: 610865 - RNA, 17 nt, Homo sapiens
augaggaaacuacugaa

SEQ ID NO: 610866 - RNA, 18 nt, Homo sapiens
augaggaaggacuugacu

SEQ ID NO: 610867 - RNA, 14 nt, Homo sapiens
augaggaauccaaa

SEQ ID NO: 610868 - RNA, 19 nt, Homo sapiens
augaggaauguacuuuuaa

SEQ ID NO: 610869 - RNA, 22 nt, Homo sapiens
augaggacaagagggacaaggu

SEQ ID NO: 610870 - RNA, 18 nt, Homo sapiens
augaggacagaccacaga

SEQ ID NO: 610871 - RNA, 19 nt, Homo sapiens
augaggacgugucuguuau

SEQ ID NO: 610872 - RNA, 22 nt, Homo sapiens
augaggacuugugucucugugc

SEQ ID NO: 610873 - RNA, 23 nt, Homo sapiens
augaggcaacccgugcucagcug

SEQ ID NO: 610874 - RNA, 16 nt, Homo sapiens
augaggggccacugac

SEQ ID NO: 610875 - RNA, 18 nt, Homo sapiens
augaggggccacugaccc

SEQ ID NO: 610876 - RNA, 24 nt, Homo sapiens
augaggucuguuuaaaguggcaau

SEQ ID NO: 610877 - RNA, 14 nt, Homo sapiens
augaggugcucaau

SEQ ID NO: 610878 - RNA, 13 nt, Homo sapiens
augaggugcuuug

SEQ ID NO: 610879 - RNA, 17 nt, Homo sapiens
augaguaaaaacuagaa

SEQ ID NO: 610880 - RNA, 20 nt, Homo sapiens
augaguaaacugagacuuaa

SEQ ID NO: 610881 - RNA, 21 nt, Homo sapiens
augaguaauacaucaaagagu

SEQ ID NO: 610882 - RNA, 18 nt, Homo sapiens
augagucaaugugcagug

SEQ ID NO: 610883 - RNA, 21 nt, Homo sapiens
augaguuacuuagaaugccau

SEQ ID NO: 610884 - RNA, 22 nt, Homo sapiens
augaguuacuugaaauuugccu

SEQ ID NO: 610885 - RNA, 18 nt, Homo sapiens
augaguuuuucaguuuug

SEQ ID NO: 610886 - RNA, 14 nt, Homo sapiens
augauaaacaaguc

SEQ ID NO: 610887 - RNA, 16 nt, Homo sapiens
augauaacugcaauuu

SEQ ID NO: 610888 - RNA, 13 nt, Homo sapiens
augauacaaugaa

SEQ ID NO: 610889 - RNA, 14 nt, Homo sapiens
augauacuuacuga

SEQ ID NO: 610890 - RNA, 13 nt, Homo sapiens
augauacuuccaa

SEQ ID NO: 610891 - RNA, 22 nt, Homo sapiens
augauacuuggaugcagcucuu

SEQ ID NO: 610892 - RNA, 15 nt, Homo sapiens
augauagaugacaaa

SEQ ID NO: 610893 - RNA, 19 nt, Homo sapiens
augauagcaaauggccuca

SEQ ID NO: 610894 - RNA, 23 nt, Homo sapiens
augauaguccaauuuuuacucag

SEQ ID NO: 610895 - RNA, 14 nt, Homo sapiens
augauauacuauga

SEQ ID NO: 610896 - RNA, 13 nt, Homo sapiens
augaucaccaagc

SEQ ID NO: 610897 - RNA, 23 nt, Homo sapiens
augaucaccauguuagccuuaga

SEQ ID NO: 610898 - RNA, 15 nt, Homo sapiens
augaucagacauaca

SEQ ID NO: 610899 - RNA, 18 nt, Homo sapiens
augaucagcaucugugau

SEQ ID NO: 610900 - RNA, 16 nt, Homo sapiens
augaucagccuugcaa

SEQ ID NO: 610901 - RNA, 12 nt, Homo sapiens
augaucagggau

SEQ ID NO: 610902 - RNA, 19 nt, Homo sapiens
augaucaguccaacugaac

SEQ ID NO: 610903 - RNA, 22 nt, Homo sapiens
augaucaucacaaucaucauca

SEQ ID NO: 610904 - RNA, 14 nt, Homo sapiens
augaucauuugccc

SEQ ID NO: 610905 - RNA, 15 nt, Homo sapiens
augauccagaacagu

SEQ ID NO: 610906 - RNA, 18 nt, Homo sapiens
augauccagaacaguggc

SEQ ID NO: 610907 - RNA, 13 nt, Homo sapiens
augaucccaguca

SEQ ID NO: 610908 - RNA, 20 nt, Homo sapiens
augaucccuguguugucucu

SEQ ID NO: 610909 - RNA, 20 nt, Homo sapiens
augauccucaugguucccaa

SEQ ID NO: 610910 - RNA, 22 nt, Homo sapiens
augaucgcgccacuacacucca

SEQ ID NO: 610911 - RNA, 22 nt, Homo sapiens
augaucgcuuucuacacuguau

SEQ ID NO: 610912 - RNA, 20 nt, Homo sapiens
augaucuauacacauaagca

SEQ ID NO: 610913 - RNA, 21 nt, Homo sapiens
augaugaaaacuaaggauuuu

SEQ ID NO: 610914 - RNA, 17 nt, Homo sapiens
augaugaagaccaaaga

SEQ ID NO: 610915 - RNA, 17 nt, Homo sapiens
augaugacguccucuca

SEQ ID NO: 610916 - RNA, 15 nt, Homo sapiens
augaugacucaaggc

SEQ ID NO: 610917 - RNA, 19 nt, Homo sapiens
augaugacugcuuaacucc

SEQ ID NO: 610918 - RNA, 23 nt, Homo sapiens
augaugagccauauuaauugccu

SEQ ID NO: 610919 - RNA, 16 nt, Homo sapiens
augaugauaaugauga

SEQ ID NO: 610920 - RNA, 13 nt, Homo sapiens
augaugcccuccc

SEQ ID NO: 610921 - RNA, 18 nt, Homo sapiens
augaugcuaaucuugucc

SEQ ID NO: 610922 - RNA, 20 nt, Homo sapiens
augauggcagccauagugca

SEQ ID NO: 610923 - RNA, 21 nt, Homo sapiens
augauggccuuacacugaaaa

SEQ ID NO: 610924 - RNA, 16 nt, Homo sapiens
augauggugacaugau

SEQ ID NO: 610925 - RNA, 22 nt, Homo sapiens
augauguagauuacugaaaaau

SEQ ID NO: 610926 - RNA, 17 nt, Homo sapiens
augauguauuguugcuu

SEQ ID NO: 610927 - RNA, 17 nt, Homo sapiens
augaugucggucuugca

SEQ ID NO: 610928 - RNA, 17 nt, Homo sapiens
augaugugaguauuuag

SEQ ID NO: 610929 - RNA, 14 nt, Homo sapiens
augaugugcaaaac

SEQ ID NO: 610930 - RNA, 15 nt, Homo sapiens
augauuaaacuuccu

SEQ ID NO: 610931 - RNA, 17 nt, Homo sapiens
augauuauauagcacau

SEQ ID NO: 610932 - RNA, 19 nt, Homo sapiens
augauucaaauugcugcuu

SEQ ID NO: 610933 - RNA, 13 nt, Homo sapiens
augauucaagcca

SEQ ID NO: 610934 - RNA, 19 nt, Homo sapiens
augauucaagccauuccaa

SEQ ID NO: 610935 - RNA, 20 nt, Homo sapiens
augauucaagccauuccaaa

SEQ ID NO: 610936 - RNA, 22 nt, Homo sapiens
augauucagaaauuuucauuca

SEQ ID NO: 610937 - RNA, 17 nt, Homo sapiens
augauucuaguacauaa

SEQ ID NO: 610938 - RNA, 17 nt, Homo sapiens
augauugcuagccagca

SEQ ID NO: 610939 - RNA, 18 nt, Homo sapiens
augauuuaccuauacauu

SEQ ID NO: 610940 - RNA, 13 nt, Homo sapiens
augauuuacucau

SEQ ID NO: 610941 - RNA, 18 nt, Homo sapiens
augauuuagguacgucaa

SEQ ID NO: 610942 - RNA, 19 nt, Homo sapiens
augauuuagugaucaaauu

SEQ ID NO: 610943 - RNA, 17 nt, Homo sapiens
augauuucagaauuuag

SEQ ID NO: 610944 - RNA, 13 nt, Homo sapiens
augauuucucaaa

SEQ ID NO: 610945 - RNA, 21 nt, Homo sapiens
augauuuuguaaaaguggcau

SEQ ID NO: 610946 - RNA, 19 nt, Homo sapiens
augauuuuuuuuucauaca

SEQ ID NO: 610947 - RNA, 18 nt, Homo sapiens
augcaaaguagcaauuuc

SEQ ID NO: 610948 - RNA, 18 nt, Homo sapiens
augcaaaugaguucagga

SEQ ID NO: 610949 - RNA, 22 nt, Homo sapiens
augcaaccgggcccucucucug

SEQ ID NO: 610950 - RNA, 12 nt, Homo sapiens
auggcugagaug

SEQ ID NO: 610951 - RNA, 18 nt, Homo sapiens
auggcugaguuuauuagu

SEQ ID NO: 610952 - RNA, 23 nt, Homo sapiens
auggcugaguuuauuaguacaug

SEQ ID NO: 610953 - RNA, 17 nt, Homo sapiens
auggcugugccucugcc

SEQ ID NO: 610954 - RNA, 18 nt, Homo sapiens
auggcuucggacaaaaua

SEQ ID NO: 610955 - RNA, 23 nt, Homo sapiens
auggcuugccuaagacuugccca

SEQ ID NO: 610956 - RNA, 17 nt, Homo sapiens
augggaaccccuucauc

SEQ ID NO: 610957 - RNA, 20 nt, Homo sapiens
augggaaccuaguacucucu

SEQ ID NO: 610958 - RNA, 15 nt, Homo sapiens
augggaaggguccau

SEQ ID NO: 610959 - RNA, 18 nt, Homo sapiens
augggacacccaacacuu

SEQ ID NO: 610960 - RNA, 19 nt, Homo sapiens
augggacacccaacacuuu

SEQ ID NO: 610961 - RNA, 18 nt, Homo sapiens
augggacuaaaugaacua

SEQ ID NO: 610962 - RNA, 19 nt, Homo sapiens
augggagaauugcacacag

SEQ ID NO: 610963 - RNA, 19 nt, Homo sapiens
augggagcaugcuuaccuu

SEQ ID NO: 610964 - RNA, 18 nt, Homo sapiens
augggagcugaggccaca

SEQ ID NO: 610965 - RNA, 17 nt, Homo sapiens
augggagcuuaacuuua

SEQ ID NO: 610966 - RNA, 19 nt, Homo sapiens
augggagcuuaacuuuaua

SEQ ID NO: 610967 - RNA, 22 nt, Homo sapiens
augggaggagaggacaagggaa

SEQ ID NO: 610968 - RNA, 15 nt, Homo sapiens
augggaugcacucuc

SEQ ID NO: 610969 - RNA, 19 nt, Homo sapiens
augggccuuuaagaaccuu

SEQ ID NO: 610970 - RNA, 20 nt, Homo sapiens
augggcucuuccaacaagga

SEQ ID NO: 610971 - RNA, 17 nt, Homo sapiens
augggcugagcuagccu

SEQ ID NO: 610972 - RNA, 16 nt, Homo sapiens
auggggacacagauca

SEQ ID NO: 610973 - RNA, 21 nt, Homo sapiens
auggggacacagaucauggua

SEQ ID NO: 610974 - RNA, 17 nt, Homo sapiens
auggggaggcagcagag

SEQ ID NO: 610975 - RNA, 15 nt, Homo sapiens
auggggauagaggaa

SEQ ID NO: 610976 - RNA, 14 nt, Homo sapiens
auggggaucugggg

SEQ ID NO: 610977 - RNA, 13 nt, Homo sapiens
auggggcuguuga

SEQ ID NO: 610978 - RNA, 14 nt, Homo sapiens
augggggaugcuuc

SEQ ID NO: 610979 - RNA, 14 nt, Homo sapiens
auggggguguagua

SEQ ID NO: 610980 - RNA, 18 nt, Homo sapiens
auggggugggagacuuuc

SEQ ID NO: 610981 - RNA, 18 nt, Homo sapiens
auggggugggguagggcu

SEQ ID NO: 610982 - RNA, 14 nt, Homo sapiens
auggguacaaugaa

SEQ ID NO: 610983 - RNA, 18 nt, Homo sapiens
augggucccccucagcaa

SEQ ID NO: 610984 - RNA, 16 nt, Homo sapiens
augggucccucagucu

SEQ ID NO: 610985 - RNA, 18 nt, Homo sapiens
auggguggugaauucuga

SEQ ID NO: 610986 - RNA, 22 nt, Homo sapiens
auggguuauauaaagacugccu

SEQ ID NO: 610987 - RNA, 14 nt, Homo sapiens
auggguuccagagg

SEQ ID NO: 610988 - RNA, 14 nt, Homo sapiens
augguaaaccagau

SEQ ID NO: 610989 - RNA, 23 nt, Homo sapiens
augguaaccgagccagcagcuga

SEQ ID NO: 610990 - RNA, 14 nt, Homo sapiens
augguagagcaaua

SEQ ID NO: 610991 - RNA, 11 nt, Homo sapiens
augguagucac

SEQ ID NO: 610992 - RNA, 21 nt, Homo sapiens
augguaugcuggccagcaccc

SEQ ID NO: 610993 - RNA, 20 nt, Homo sapiens
augguauggaacucucucca

SEQ ID NO: 610994 - RNA, 16 nt, Homo sapiens
auggucauugcaggaa

SEQ ID NO: 610995 - RNA, 14 nt, Homo sapiens
augguccagaaacu

SEQ ID NO: 610996 - RNA, 23 nt, Homo sapiens
auggucccaggcuucccaaaagu

SEQ ID NO: 610997 - RNA, 19 nt, Homo sapiens
auggucccuuaaggcacag

SEQ ID NO: 610998 - RNA, 15 nt, Homo sapiens
augguccucuuacca

SEQ ID NO: 610999 - RNA, 20 nt, Homo sapiens
augguccuggggcucugugc

SEQ ID NO: 611000 - RNA, 19 nt, Homo sapiens
auggugaaacccugucucu

SEQ ID NO: 611001 - RNA, 19 nt, Homo sapiens
auggugaaaccucaucucu

SEQ ID NO: 611002 - RNA, 20 nt, Homo sapiens
auggugaaaccucaucucua

SEQ ID NO: 611003 - RNA, 21 nt, Homo sapiens
auggugagagauaagaucuau

SEQ ID NO: 611004 - RNA, 22 nt, Homo sapiens
auggugaugggguaaucuauaa

SEQ ID NO: 611005 - RNA, 19 nt, Homo sapiens
auggugcaaucacagcuca

SEQ ID NO: 611006 - RNA, 20 nt, Homo sapiens
auggugcucacgacucuucc

SEQ ID NO: 611007 - RNA, 23 nt, Homo sapiens
augguggagggccacaugggagg

SEQ ID NO: 611008 - RNA, 18 nt, Homo sapiens
augguggguacaaaaagu

SEQ ID NO: 611009 - RNA, 17 nt, Homo sapiens
auggugguaacugauaa

SEQ ID NO: 611010 - RNA, 15 nt, Homo sapiens
auggugugaguccaa

SEQ ID NO: 611011 - RNA, 16 nt, Homo sapiens
auggugugaguccaaa

SEQ ID NO: 611012 - RNA, 14 nt, Homo sapiens
augguguguuaaag

SEQ ID NO: 611013 - RNA, 14 nt, Homo sapiens
augguuaaaaucac

SEQ ID NO: 611014 - RNA, 22 nt, Homo sapiens
augguuacuaggcuuaauaccu

SEQ ID NO: 611015 - RNA, 16 nt, Homo sapiens
augguuacucuuguca

SEQ ID NO: 611016 - RNA, 15 nt, Homo sapiens
augguugauggaaaa

SEQ ID NO: 611017 - RNA, 16 nt, Homo sapiens
augguugccaccccaa

SEQ ID NO: 611018 - RNA, 18 nt, Homo sapiens
augguuggaaaacacuuu

SEQ ID NO: 611019 - RNA, 14 nt, Homo sapiens
augguuuaacauau

SEQ ID NO: 611020 - RNA, 13 nt, Homo sapiens
augguuucuccag

SEQ ID NO: 611021 - RNA, 19 nt, Homo sapiens
augguuuuacucaugugca

SEQ ID NO: 611022 - RNA, 22 nt, Homo sapiens
auguaaaaagaucuacauacaa

SEQ ID NO: 611023 - RNA, 17 nt, Homo sapiens
auguaaacaaaccacag

SEQ ID NO: 611024 - RNA, 20 nt, Homo sapiens
auguaaacauaauucuugua

SEQ ID NO: 611025 - RNA, 17 nt, Homo sapiens
auguaaacccucaaggg

SEQ ID NO: 611026 - RNA, 13 nt, Homo sapiens
auguaaacugcca

SEQ ID NO: 611027 - RNA, 14 nt, Homo sapiens
auguaaacugugca

SEQ ID NO: 611028 - RNA, 15 nt, Homo sapiens
auguaaacugugcac

SEQ ID NO: 611029 - RNA, 16 nt, Homo sapiens
auguaaacugugcacc

SEQ ID NO: 611030 - RNA, 15 nt, Homo sapiens
auguaaagcacauca

SEQ ID NO: 611031 - RNA, 13 nt, Homo sapiens
auguaaaguaaga

SEQ ID NO: 611032 - RNA, 16 nt, Homo sapiens
auguaaauagugauuu

SEQ ID NO: 611033 - RNA, 13 nt, Homo sapiens
auguaacaugaag

SEQ ID NO: 611034 - RNA, 17 nt, Homo sapiens
auguaacuauaaucucu

SEQ ID NO: 611035 - RNA, 12 nt, Homo sapiens
auguaagcacuc

SEQ ID NO: 611036 - RNA, 17 nt, Homo sapiens
auguaauagugacagca

SEQ ID NO: 611037 - RNA, 19 nt, Homo sapiens
auguaauauauuguacaaa

SEQ ID NO: 611038 - RNA, 23 nt, Homo sapiens
auguaauauauuguacaaaugua

SEQ ID NO: 611039 - RNA, 14 nt, Homo sapiens
auguaauucuacca

SEQ ID NO: 611040 - RNA, 21 nt, Homo sapiens
auguaauugaauaaaguugaa

SEQ ID NO: 611041 - RNA, 23 nt, Homo sapiens
auguacagacauacauuuaugca

SEQ ID NO: 611042 - RNA, 12 nt, Homo sapiens
auguacagcucu

SEQ ID NO: 611043 - RNA, 18 nt, Homo sapiens
auguacaucagccugaaa

SEQ ID NO: 611044 - RNA, 16 nt, Homo sapiens
auguacccgagcacau

SEQ ID NO: 611045 - RNA, 22 nt, Homo sapiens
auguaccuccccugccuugcug

SEQ ID NO: 611046 - RNA, 23 nt, Homo sapiens
auguaccuucuuucacucuguca

SEQ ID NO: 611047 - RNA, 23 nt, Homo sapiens
auguagaauaggcagggggcccu

SEQ ID NO: 611048 - RNA, 21 nt, Homo sapiens
auguagaauauucagacaaaa

SEQ ID NO: 611049 - RNA, 15 nt, Homo sapiens
auguagcacauaaac

SEQ ID NO: 611050 - RNA, 21 nt, Homo sapiens
auguagccagcugugcacuuu

SEQ ID NO: 611051 - RNA, 15 nt, Homo sapiens
auguaggaguguuua

SEQ ID NO: 611052 - RNA, 20 nt, Homo sapiens
auguaguuuuuauauguugu

SEQ ID NO: 611053 - RNA, 13 nt, Homo sapiens
auguauaaauguu

SEQ ID NO: 611054 - RNA, 24 nt, Homo sapiens
auguauaauuaacuuaacugaaga

SEQ ID NO: 611055 - RNA, 23 nt, Homo sapiens
auguauauaagccaguucacuua

SEQ ID NO: 611056 - RNA, 16 nt, Homo sapiens
auguauauuugcugca

SEQ ID NO: 611057 - RNA, 16 nt, Homo sapiens
auguaucaauggagca

SEQ ID NO: 611058 - RNA, 15 nt, Homo sapiens
auguauccagaggaa

SEQ ID NO: 611059 - RNA, 19 nt, Homo sapiens
auguaucucaguaccccau

SEQ ID NO: 611060 - RNA, 15 nt, Homo sapiens
auguaugacuuaaua

SEQ ID NO: 611061 - RNA, 22 nt, Homo sapiens
auguaugcaaaccucaucuuuc

SEQ ID NO: 611062 - RNA, 21 nt, Homo sapiens
auguaugcuuugaaugcaaaa

SEQ ID NO: 611063 - RNA, 13 nt, Homo sapiens
auguauguacaau

SEQ ID NO: 611064 - RNA, 14 nt, Homo sapiens
auguauguauuuau

SEQ ID NO: 611065 - RNA, 21 nt, Homo sapiens
auguauuuauauuuugugcua

SEQ ID NO: 611066 - RNA, 18 nt, Homo sapiens
auguauuugaacacuugg

SEQ ID NO: 611067 - RNA, 18 nt, Homo sapiens
auguauuuucaguuacaa

SEQ ID NO: 611068 - RNA, 14 nt, Homo sapiens
auguauuuucauag

SEQ ID NO: 611069 - RNA, 21 nt, Homo sapiens
auguauuuuccuaaugugauc

SEQ ID NO: 611070 - RNA, 16 nt, Homo sapiens
auguauuuuucuugcu

SEQ ID NO: 611071 - RNA, 18 nt, Homo sapiens
auucaaaguguuguguuc

SEQ ID NO: 611072 - RNA, 21 nt, Homo sapiens
auucaaaguuaaaagcaaaca

SEQ ID NO: 611073 - RNA, 16 nt, Homo sapiens
auucaaaucacaugga

SEQ ID NO: 611074 - RNA, 14 nt, Homo sapiens
auucaaauuguuaa

SEQ ID NO: 611075 - RNA, 16 nt, Homo sapiens
auucaacccagcaauc

SEQ ID NO: 611076 - RNA, 12 nt, Homo sapiens
auucaacuaccu

SEQ ID NO: 611077 - RNA, 21 nt, Homo sapiens
auucaacucuccaauguucua

SEQ ID NO: 611078 - RNA, 17 nt, Homo sapiens
auucaagcaaacaucaa

SEQ ID NO: 611079 - RNA, 13 nt, Homo sapiens
auucaauacaggc

SEQ ID NO: 611080 - RNA, 14 nt, Homo sapiens
auucaaugcaagua

SEQ ID NO: 611081 - RNA, 15 nt, Homo sapiens
auucaauuuauuuga

SEQ ID NO: 611082 - RNA, 16 nt, Homo sapiens
auucaauuuggcaaaa

SEQ ID NO: 611083 - RNA, 17 nt, Homo sapiens
auucacaaaauuuccac

SEQ ID NO: 611084 - RNA, 15 nt, Homo sapiens
auucacaaauagcca

SEQ ID NO: 611085 - RNA, 15 nt, Homo sapiens
auucacaaaugggau

SEQ ID NO: 611086 - RNA, 14 nt, Homo sapiens
auucacacaaagac

SEQ ID NO: 611087 - RNA, 13 nt, Homo sapiens
auucacaccucac

SEQ ID NO: 611088 - RNA, 20 nt, Homo sapiens
auucacagaaccuacuguuc

SEQ ID NO: 611089 - RNA, 13 nt, Homo sapiens
auucacagaauag

SEQ ID NO: 611090 - RNA, 14 nt, Homo sapiens
auucacaguaauau

SEQ ID NO: 611091 - RNA, 23 nt, Homo sapiens
auucaccuugguguuucucucug

SEQ ID NO: 611092 - RNA, 15 nt, Homo sapiens
auucacuagaccaga

SEQ ID NO: 611093 - RNA, 18 nt, Homo sapiens
auucacuagaccagaagu

SEQ ID NO: 611094 - RNA, 22 nt, Homo sapiens
auucacuauggggggaggugua

SEQ ID NO: 611095 - RNA, 23 nt, Homo sapiens
auucacuccugccccugcccaca

SEQ ID NO: 611096 - RNA, 14 nt, Homo sapiens
auucacuuacugac

SEQ ID NO: 611097 - RNA, 23 nt, Homo sapiens
auucacuuauggcagaggaauau

SEQ ID NO: 611098 - RNA, 20 nt, Homo sapiens
auucagaaauucuccaggau

SEQ ID NO: 611099 - RNA, 23 nt, Homo sapiens
auucagagacugcccuucucacg

SEQ ID NO: 611100 - RNA, 16 nt, Homo sapiens
auucagagagcagcuu

SEQ ID NO: 611101 - RNA, 19 nt, Homo sapiens
auucagagcaaguuccuga

SEQ ID NO: 611102 - RNA, 23 nt, Homo sapiens
auucagaucaaaaugccuuucag

SEQ ID NO: 611103 - RNA, 22 nt, Homo sapiens
auucagaugaauagauggaauu

SEQ ID NO: 611104 - RNA, 16 nt, Homo sapiens
auucagcacacacaaa

SEQ ID NO: 611105 - RNA, 13 nt, Homo sapiens
auucagcaugggu

SEQ ID NO: 611106 - RNA, 19 nt, Homo sapiens
auucagcauggguccuuga

SEQ ID NO: 611107 - RNA, 17 nt, Homo sapiens
auucagcauuauuccuc

SEQ ID NO: 611108 - RNA, 18 nt, Homo sapiens
auucagcgaagucucaug

SEQ ID NO: 611109 - RNA, 21 nt, Homo sapiens
auucaggcagcacugacaaua

SEQ ID NO: 611110 - RNA, 23 nt, Homo sapiens
auucagguaauacaaacuauaua

SEQ ID NO: 611111 - RNA, 18 nt, Homo sapiens
auucagugcaccugccuc

SEQ ID NO: 611112 - RNA, 15 nt, Homo sapiens
auucaguggucuuau

SEQ ID NO: 611113 - RNA, 18 nt, Homo sapiens
auucauaaaucacaaaua

SEQ ID NO: 611114 - RNA, 21 nt, Homo sapiens
auucauaggcaguaauguucc

SEQ ID NO: 611115 - RNA, 22 nt, Homo sapiens
auucauauaggccagaguugca

SEQ ID NO: 611116 - RNA, 17 nt, Homo sapiens
auucauauuuacuucuu

SEQ ID NO: 611117 - RNA, 22 nt, Homo sapiens
auucauauuuacuucuuauaca

SEQ ID NO: 611118 - RNA, 23 nt, Homo sapiens
auucaugaaaacuguuuuuacua

SEQ ID NO: 611119 - RNA, 22 nt, Homo sapiens
auucaugaaaauaaauguacau

SEQ ID NO: 611120 - RNA, 16 nt, Homo sapiens
auucauguaacucucc

SEQ ID NO: 611121 - RNA, 21 nt, Homo sapiens
auucaugugguuucuaugcaa

SEQ ID NO: 611122 - RNA, 19 nt, Homo sapiens
auucauucugcauugcuag

SEQ ID NO: 611123 - RNA, 17 nt, Homo sapiens
auucauuguggucauag

SEQ ID NO: 611124 - RNA, 19 nt, Homo sapiens
auucauuguguuaccugua

SEQ ID NO: 611125 - RNA, 21 nt, Homo sapiens
auucauuguguuaccuguaga

SEQ ID NO: 611126 - RNA, 15 nt, Homo sapiens
auucauuuuacucag

SEQ ID NO: 611127 - RNA, 20 nt, Homo sapiens
auucauuuucaucacuggga

SEQ ID NO: 611128 - RNA, 19 nt, Homo sapiens
auucauuuucuagauacaa

SEQ ID NO: 611129 - RNA, 16 nt, Homo sapiens
auuccaaaauccaaaa

SEQ ID NO: 611130 - RNA, 21 nt, Homo sapiens
auuccaaacacauacaggaag

SEQ ID NO: 611131 - RNA, 12 nt, Homo sapiens
auuccaaagcaa

SEQ ID NO: 611132 - RNA, 21 nt, Homo sapiens
auuccaaauauguaugcaccu

SEQ ID NO: 611133 - RNA, 17 nt, Homo sapiens
auuccaaauggugugaa

SEQ ID NO: 611134 - RNA, 18 nt, Homo sapiens
auuccaacauuucucacu

SEQ ID NO: 611135 - RNA, 15 nt, Homo sapiens
auuccaacuccugau

SEQ ID NO: 611136 - RNA, 14 nt, Homo sapiens
auuccaacuucaau

SEQ ID NO: 611137 - RNA, 11 nt, Homo sapiens
auuccaaggaa

SEQ ID NO: 611138 - RNA, 14 nt, Homo sapiens
auuccacacuacca

SEQ ID NO: 611139 - RNA, 15 nt, Homo sapiens
auuccaccuagagcu

SEQ ID NO: 611140 - RNA, 19 nt, Homo sapiens
auuccaccuagagcuagau

SEQ ID NO: 611141 - RNA, 16 nt, Homo sapiens
auuccaccuucccaug

SEQ ID NO: 611142 - RNA, 15 nt, Homo sapiens
auuccacuccacuca

SEQ ID NO: 611143 - RNA, 16 nt, Homo sapiens
auuccacuccacucag

SEQ ID NO: 611144 - RNA, 17 nt, Homo sapiens
auuccacuccacucagg

SEQ ID NO: 611145 - RNA, 18 nt, Homo sapiens
auuccacuccacucaggu

SEQ ID NO: 611146 - RNA, 13 nt, Homo sapiens
auuccagccaggg

SEQ ID NO: 611147 - RNA, 17 nt, Homo sapiens
auuccaggaaaacuggg

SEQ ID NO: 611148 - RNA, 15 nt, Homo sapiens
auuccaggagauugg

SEQ ID NO: 611149 - RNA, 15 nt, Homo sapiens
auuccaggagcugcg

SEQ ID NO: 611150 - RNA, 17 nt, Homo sapiens
auuccaggcgaugugca

SEQ ID NO: 611151 - RNA, 16 nt, Homo sapiens
auuccagucuacuuga

SEQ ID NO: 611152 - RNA, 21 nt, Homo sapiens
auuccagucugaagugccuac

SEQ ID NO: 611153 - RNA, 17 nt, Homo sapiens
auuccagugcuagaaaa

SEQ ID NO: 611154 - RNA, 15 nt, Homo sapiens
auuccaugagcugcu

SEQ ID NO: 611155 - RNA, 22 nt, Homo sapiens
auuccauguccauacuaugaca

SEQ ID NO: 611156 - RNA, 21 nt, Homo sapiens
auuccauuucuggacaugacg

SEQ ID NO: 611157 - RNA, 13 nt, Homo sapiens
auucccaccaagg

SEQ ID NO: 611158 - RNA, 11 nt, Homo sapiens
auucccacugc

SEQ ID NO: 611159 - RNA, 17 nt, Homo sapiens
auucccauuuugcaaaa

SEQ ID NO: 611160 - RNA, 13 nt, Homo sapiens
auuccccuaggcu

SEQ ID NO: 611161 - RNA, 12 nt, Homo sapiens
auucccuccuga

SEQ ID NO: 611162 - RNA, 19 nt, Homo sapiens
auucccucuccugcccaga

SEQ ID NO: 611163 - RNA, 14 nt, Homo sapiens
auucccugucacua

SEQ ID NO: 611164 - RNA, 14 nt, Homo sapiens
auucccuuaacucu

SEQ ID NO: 611165 - RNA, 12 nt, Homo sapiens
auucccuuguau

SEQ ID NO: 611166 - RNA, 19 nt, Homo sapiens
auuccguugucuguggaug

SEQ ID NO: 611167 - RNA, 13 nt, Homo sapiens
auuccuagcaaau

SEQ ID NO: 611168 - RNA, 16 nt, Homo sapiens
auuccuagcaaauuuc

SEQ ID NO: 611169 - RNA, 19 nt, Homo sapiens
auuccuauauaguuuauug

SEQ ID NO: 611170 - RNA, 20 nt, Homo sapiens
auuccuauauaguuuauuga

SEQ ID NO: 611171 - RNA, 15 nt, Homo sapiens
auuccuaugauggau

SEQ ID NO: 611172 - RNA, 20 nt, Homo sapiens
auuccuauuggaaacagaga

SEQ ID NO: 611173 - RNA, 21 nt, Homo sapiens
auuccucaaaaaauugcacau

SEQ ID NO: 611174 - RNA, 11 nt, Homo sapiens
auuccucagau

SEQ ID NO: 611175 - RNA, 15 nt, Homo sapiens
auuccucuugccucu

SEQ ID NO: 611176 - RNA, 14 nt, Homo sapiens
auuccugaagggaa

SEQ ID NO: 611177 - RNA, 16 nt, Homo sapiens
auuccugaugaccaau

SEQ ID NO: 611178 - RNA, 21 nt, Homo sapiens
auuccugguuugacucaguuc

SEQ ID NO: 611179 - RNA, 21 nt, Homo sapiens
auuccugucccuuuguuacca

SEQ ID NO: 611180 - RNA, 17 nt, Homo sapiens
auuccuguuugucuaca

SEQ ID NO: 611181 - RNA, 14 nt, Homo sapiens
auuccuuacuguaa

SEQ ID NO: 611182 - RNA, 17 nt, Homo sapiens
auuccuuacuugcacug

SEQ ID NO: 611183 - RNA, 18 nt, Homo sapiens
auuccuuagauaccuuga

SEQ ID NO: 611184 - RNA, 14 nt, Homo sapiens
auuccuuagucuca

SEQ ID NO: 611185 - RNA, 21 nt, Homo sapiens
auuccuucgaaaggccuucag

SEQ ID NO: 611186 - RNA, 19 nt, Homo sapiens
auuccuucucccaucucuu

SEQ ID NO: 611187 - RNA, 15 nt, Homo sapiens
auuccuucuguagug

SEQ ID NO: 611188 - RNA, 21 nt, Homo sapiens
auuccuugaggacagaccuua

SEQ ID NO: 611189 - RNA, 16 nt, Homo sapiens
auuccuuuauggcaaa

SEQ ID NO: 611190 - RNA, 23 nt, Homo sapiens
auuccuuugucuucaaacuguga

SEQ ID NO: 611191 - RNA, 18 nt, Homo sapiens
auuccuuuuucuaugaaa

SEQ ID NO: 611192 - RNA, 19 nt, Homo sapiens
auuccuuuuucuucacuua

SEQ ID NO: 611193 - RNA, 16 nt, Homo sapiens
auuuauuuaagcauca

SEQ ID NO: 611194 - RNA, 17 nt, Homo sapiens
auuuauuuacagaugaa

SEQ ID NO: 611195 - RNA, 15 nt, Homo sapiens
auuuauuuuguauga

SEQ ID NO: 611196 - RNA, 15 nt, Homo sapiens
auuuauuuuuugcca

SEQ ID NO: 611197 - RNA, 17 nt, Homo sapiens
auuuauuuuuuuacuuc

SEQ ID NO: 611198 - RNA, 13 nt, Homo sapiens
auuucaaaacaca

SEQ ID NO: 611199 - RNA, 16 nt, Homo sapiens
auuucaaaccauuuac

SEQ ID NO: 611200 - RNA, 19 nt, Homo sapiens
auuucaaaugugcugucaa

SEQ ID NO: 611201 - RNA, 22 nt, Homo sapiens
auuucaaauuguuuucagugaa

SEQ ID NO: 611202 - RNA, 12 nt, Homo sapiens
auuucaagacua

SEQ ID NO: 611203 - RNA, 15 nt, Homo sapiens
auuucaagucucuca

SEQ ID NO: 611204 - RNA, 18 nt, Homo sapiens
auuucaaugucagccuuu

SEQ ID NO: 611205 - RNA, 16 nt, Homo sapiens
auuucaauuccuggcc

SEQ ID NO: 611206 - RNA, 14 nt, Homo sapiens
auuucaauuccugu

SEQ ID NO: 611207 - RNA, 14 nt, Homo sapiens
auuucacaagcuau

SEQ ID NO: 611208 - RNA, 16 nt, Homo sapiens
auuucacaagcuauuc

SEQ ID NO: 611209 - RNA, 14 nt, Homo sapiens
auuucaccacugaa

SEQ ID NO: 611210 - RNA, 18 nt, Homo sapiens
auuucagauaaacaacaa

SEQ ID NO: 611211 - RNA, 22 nt, Homo sapiens
auuucagauaaacaacaaauaa

SEQ ID NO: 611212 - RNA, 12 nt, Homo sapiens
auuucagcacau

SEQ ID NO: 611213 - RNA, 19 nt, Homo sapiens
auuucaggaagacugacag

SEQ ID NO: 611214 - RNA, 11 nt, Homo sapiens
auuucagggug

SEQ ID NO: 611215 - RNA, 22 nt, Homo sapiens
auuucauacaacagaaaccaga

SEQ ID NO: 611216 - RNA, 23 nt, Homo sapiens
auuucauacaacagaaaccagaa

SEQ ID NO: 611217 - RNA, 14 nt, Homo sapiens
auuucauacuguaa

SEQ ID NO: 611218 - RNA, 15 nt, Homo sapiens
auuucauaguuucaa

SEQ ID NO: 611219 - RNA, 15 nt, Homo sapiens
auuucauccuugaau

SEQ ID NO: 611220 - RNA, 22 nt, Homo sapiens
auuucauuaucauaugaacuug

SEQ ID NO: 611221 - RNA, 17 nt, Homo sapiens
auuucauuguaugaugu

SEQ ID NO: 611222 - RNA, 15 nt, Homo sapiens
auuucauuucagcca

SEQ ID NO: 611223 - RNA, 23 nt, Homo sapiens
auuucauuuccauuuaagcaauu

SEQ ID NO: 611224 - RNA, 23 nt, Homo sapiens
auuuccaaaacuuuaaugaacua

SEQ ID NO: 611225 - RNA, 23 nt, Homo sapiens
auuuccaagcacuuucaguccaa

SEQ ID NO: 611226 - RNA, 18 nt, Homo sapiens
auuuccaaguaagaguac

SEQ ID NO: 611227 - RNA, 23 nt, Homo sapiens
auuuccaccaggccgugccuugu

SEQ ID NO: 611228 - RNA, 13 nt, Homo sapiens
auuuccacuauuu

SEQ ID NO: 611229 - RNA, 18 nt, Homo sapiens
auuuccagaaauacaauu

SEQ ID NO: 611230 - RNA, 14 nt, Homo sapiens
auuuccauauucug

SEQ ID NO: 611231 - RNA, 17 nt, Homo sapiens
auuucccaacacaaaga

SEQ ID NO: 611232 - RNA, 23 nt, Homo sapiens
auuucccccuaaaccaacugaag

SEQ ID NO: 611233 - RNA, 17 nt, Homo sapiens
auuucccuguguggaug

SEQ ID NO: 611234 - RNA, 14 nt, Homo sapiens
auuuccgggugauu

SEQ ID NO: 611235 - RNA, 15 nt, Homo sapiens
auuuccuaaggcaug

SEQ ID NO: 611236 - RNA, 16 nt, Homo sapiens
auuuccuaaugucaga

SEQ ID NO: 611237 - RNA, 19 nt, Homo sapiens
auuuccucagcuuaucucu

SEQ ID NO: 611238 - RNA, 23 nt, Homo sapiens
auuuccucuaguaucacuuuugc

SEQ ID NO: 611239 - RNA, 15 nt, Homo sapiens
auuuccuguacaauc

SEQ ID NO: 611240 - RNA, 14 nt, Homo sapiens
auuuccuguucccu

SEQ ID NO: 611241 - RNA, 17 nt, Homo sapiens
auuuccuugacuucuuu

SEQ ID NO: 611242 - RNA, 13 nt, Homo sapiens
auuuccuuuaugu

SEQ ID NO: 611243 - RNA, 19 nt, Homo sapiens
auuuccuuuuugacacuga

SEQ ID NO: 611244 - RNA, 13 nt, Homo sapiens
auuucgucaugac

SEQ ID NO: 611245 - RNA, 18 nt, Homo sapiens
auuucuaaaucuccaaaa

SEQ ID NO: 611246 - RNA, 14 nt, Homo sapiens
auuucuacacugag

SEQ ID NO: 611247 - RNA, 11 nt, Homo sapiens
auuucuacugu

SEQ ID NO: 611248 - RNA, 12 nt, Homo sapiens
auuucuagacag

SEQ ID NO: 611249 - RNA, 16 nt, Homo sapiens
auuucuauagccaaaa

SEQ ID NO: 611250 - RNA, 21 nt, Homo sapiens
auuucucaaaugcacaucuca

SEQ ID NO: 611251 - RNA, 14 nt, Homo sapiens
auuucucacugaga

SEQ ID NO: 611252 - RNA, 20 nt, Homo sapiens
auuucucccagcucuagaca

SEQ ID NO: 611253 - RNA, 23 nt, Homo sapiens
auuucucccuguuauaagcagca

SEQ ID NO: 611254 - RNA, 19 nt, Homo sapiens
auuucuccuccaugggaga

SEQ ID NO: 611255 - RNA, 22 nt, Homo sapiens
auuucuccugggaaaccugccu

SEQ ID NO: 611256 - RNA, 14 nt, Homo sapiens
auuucucuacuugu

SEQ ID NO: 611257 - RNA, 13 nt, Homo sapiens
auuucucucugac

SEQ ID NO: 611258 - RNA, 16 nt, Homo sapiens
auuucucucugacccu

SEQ ID NO: 611259 - RNA, 16 nt, Homo sapiens
auuucugauacugcug

SEQ ID NO: 611260 - RNA, 16 nt, Homo sapiens
auuucugccaggcaug

SEQ ID NO: 611261 - RNA, 23 nt, Homo sapiens
auuucugcuaaauaucaccuagc

SEQ ID NO: 611262 - RNA, 22 nt, Homo sapiens
auuucugcuuucuucuuuagca

SEQ ID NO: 611263 - RNA, 19 nt, Homo sapiens
auuucuggaaaacugccuu

SEQ ID NO: 611264 - RNA, 22 nt, Homo sapiens
auuucugucucuaaccauucaa

SEQ ID NO: 611265 - RNA, 23 nt, Homo sapiens
auuucuguggauggcaucaaaca

SEQ ID NO: 611266 - RNA, 20 nt, Homo sapiens
auuucuuauaccuucugaca

SEQ ID NO: 611267 - RNA, 18 nt, Homo sapiens
auuucuucccgcacaaau

SEQ ID NO: 611268 - RNA, 16 nt, Homo sapiens
auuucuucuacugcua

SEQ ID NO: 611269 - RNA, 20 nt, Homo sapiens
auuucuucucucuguucccu

SEQ ID NO: 611270 - RNA, 20 nt, Homo sapiens
auuucuuuucuacacauuga

SEQ ID NO: 611271 - RNA, 17 nt, Homo sapiens
auuucuuuucuggccaa

SEQ ID NO: 611272 - RNA, 19 nt, Homo sapiens
auuugaagcaucacauaaa

SEQ ID NO: 611273 - RNA, 21 nt, Homo sapiens
auuugaaugugguuacuuccu

SEQ ID NO: 611274 - RNA, 21 nt, Homo sapiens
auuugaauuauuucugucaca

SEQ ID NO: 611275 - RNA, 16 nt, Homo sapiens
auuugaauucuugauc

SEQ ID NO: 611276 - RNA, 18 nt, Homo sapiens
auuugacauacaaaaagg

SEQ ID NO: 611277 - RNA, 18 nt, Homo sapiens
auuugacguuguugucau

SEQ ID NO: 611278 - RNA, 17 nt, Homo sapiens
auuugacugugcaugac

SEQ ID NO: 611279 - RNA, 17 nt, Homo sapiens
auuugagagcuaacuau

SEQ ID NO: 611280 - RNA, 21 nt, Homo sapiens
auuugagcaugcacagcugcu

SEQ ID NO: 611281 - RNA, 13 nt, Homo sapiens
auuugagugcucu

SEQ ID NO: 611282 - RNA, 16 nt, Homo sapiens
auuugauacauaauaa

SEQ ID NO: 611283 - RNA, 14 nt, Homo sapiens
auuugaugcauguc

SEQ ID NO: 611284 - RNA, 12 nt, Homo sapiens
auuugcaacuca

SEQ ID NO: 611285 - RNA, 21 nt, Homo sapiens
auuugcaacucacugauucuc

SEQ ID NO: 611286 - RNA, 14 nt, Homo sapiens
auuugcaagacaua

SEQ ID NO: 611287 - RNA, 16 nt, Homo sapiens
auuugcaccuuugucu

SEQ ID NO: 611288 - RNA, 21 nt, Homo sapiens
auuugcagguauuauaccauu

SEQ ID NO: 611289 - RNA, 22 nt, Homo sapiens
auuugcauauugaaaagcacag

SEQ ID NO: 611290 - RNA, 16 nt, Homo sapiens
auuugcauuaaauuca

SEQ ID NO: 611291 - RNA, 18 nt, Homo sapiens
auuugccaggggcaucca

SEQ ID NO: 611292 - RNA, 18 nt, Homo sapiens
auuugcuacugucauuuc

SEQ ID NO: 611293 - RNA, 15 nt, Homo sapiens
auuugcuagauuucu

SEQ ID NO: 611294 - RNA, 12 nt, Homo sapiens
auuugcugaaua

SEQ ID NO: 611295 - RNA, 16 nt, Homo sapiens
auuugcugaauacaga

SEQ ID NO: 611296 - RNA, 21 nt, Homo sapiens
auuugcuguucacccacaucu

SEQ ID NO: 611297 - RNA, 15 nt, Homo sapiens
auuuggaaugaagga

SEQ ID NO: 611298 - RNA, 19 nt, Homo sapiens
auuuggaauugaacucucu

SEQ ID NO: 611299 - RNA, 14 nt, Homo sapiens
auuuggagccugcc

SEQ ID NO: 611300 - RNA, 19 nt, Homo sapiens
auuuggaggagugaacauc

SEQ ID NO: 611301 - RNA, 14 nt, Homo sapiens
auuuggagugacca

SEQ ID NO: 611302 - RNA, 17 nt, Homo sapiens
auuugggaaagaaaaag

SEQ ID NO: 611303 - RNA, 15 nt, Homo sapiens
auuugggaaccaagc

SEQ ID NO: 611304 - RNA, 15 nt, Homo sapiens
auuugggcagacccu

SEQ ID NO: 611305 - RNA, 17 nt, Homo sapiens
auuugggcugaauguau

SEQ ID NO: 611306 - RNA, 14 nt, Homo sapiens
auuuggggaccaaa

SEQ ID NO: 611307 - RNA, 20 nt, Homo sapiens
auuugguaaaaaugcugcuc

SEQ ID NO: 611308 - RNA, 23 nt, Homo sapiens
auuuggugacuguguaacuuucu

SEQ ID NO: 611309 - RNA, 22 nt, Homo sapiens
auuugguggacgagaaggugcu

SEQ ID NO: 611310 - RNA, 22 nt, Homo sapiens
auuuguaaaucugccacaaaaa

SEQ ID NO: 611311 - RNA, 18 nt, Homo sapiens
auuuguaauagccaaaaa

SEQ ID NO: 611312 - RNA, 21 nt, Homo sapiens
auuuguaauuccuuacuguaa

SEQ ID NO: 611313 - RNA, 16 nt, Homo sapiens
auuuguagcacugagg

SEQ ID NO: 611314 - RNA, 21 nt, Homo sapiens
auuuguauaacgguuuaauuc

SEQ ID NO: 611315 - RNA, 19 nt, Homo sapiens
caccuagagcuagaugugu

SEQ ID NO: 611316 - RNA, 18 nt, Homo sapiens
caccuauauauccaagaa

SEQ ID NO: 611317 - RNA, 23 nt, Homo sapiens
caccuaugagugagaauaugugg

SEQ ID NO: 611318 - RNA, 14 nt, Homo sapiens
caccuauugaauua

SEQ ID NO: 611319 - RNA, 17 nt, Homo sapiens
caccucccauuacuuug

SEQ ID NO: 611320 - RNA, 23 nt, Homo sapiens
caccuccgccagauccugcagaa

SEQ ID NO: 611321 - RNA, 17 nt, Homo sapiens
caccuccucugugauuu

SEQ ID NO: 611322 - RNA, 14 nt, Homo sapiens
caccuccuggagaa

SEQ ID NO: 611323 - RNA, 19 nt, Homo sapiens
caccucggcacacacugug

SEQ ID NO: 611324 - RNA, 22 nt, Homo sapiens
caccucucuccuuugcugaggc

SEQ ID NO: 611325 - RNA, 18 nt, Homo sapiens
caccucucuguaguuuau

SEQ ID NO: 611326 - RNA, 23 nt, Homo sapiens
caccucugauggcugaagaaugu

SEQ ID NO: 611327 - RNA, 14 nt, Homo sapiens
caccucugcaccuu

SEQ ID NO: 611328 - RNA, 19 nt, Homo sapiens
caccucugccuuacaaaau

SEQ ID NO: 611329 - RNA, 13 nt, Homo sapiens
caccucuguucau

SEQ ID NO: 611330 - RNA, 14 nt, Homo sapiens
caccucuguucauu

SEQ ID NO: 611331 - RNA, 22 nt, Homo sapiens
caccucuugauuaucuaaacua

SEQ ID NO: 611332 - RNA, 13 nt, Homo sapiens
caccugaaucagc

SEQ ID NO: 611333 - RNA, 18 nt, Homo sapiens
caccugacacaccaggcg

SEQ ID NO: 611334 - RNA, 17 nt, Homo sapiens
caccugacagcuuuauc

SEQ ID NO: 611335 - RNA, 14 nt, Homo sapiens
caccugacaugucc

SEQ ID NO: 611336 - RNA, 13 nt, Homo sapiens
caccugagaagau

SEQ ID NO: 611337 - RNA, 22 nt, Homo sapiens
caccugccugcaucugugaaaa

SEQ ID NO: 611338 - RNA, 20 nt, Homo sapiens
caccugcgcuucugcuggag

SEQ ID NO: 611339 - RNA, 23 nt, Homo sapiens
caccugcucuucuaccauuugaa

SEQ ID NO: 611340 - RNA, 19 nt, Homo sapiens
caccugcugcgcuugguag

SEQ ID NO: 611341 - RNA, 22 nt, Homo sapiens
caccugcuggaaaccacacuuc

SEQ ID NO: 611342 - RNA, 13 nt, Homo sapiens
caccuggcugcua

SEQ ID NO: 611343 - RNA, 19 nt, Homo sapiens
caccugggacccugcacag

SEQ ID NO: 611344 - RNA, 21 nt, Homo sapiens
caccugggagaaggucuccaa

SEQ ID NO: 611345 - RNA, 20 nt, Homo sapiens
caccugggccgggcuguaga

SEQ ID NO: 611346 - RNA, 14 nt, Homo sapiens
caccuguacauucu

SEQ ID NO: 611347 - RNA, 17 nt, Homo sapiens
caccuguggcugacgaa

SEQ ID NO: 611348 - RNA, 19 nt, Homo sapiens
caccuguucucacucccug

SEQ ID NO: 611349 - RNA, 12 nt, Homo sapiens
caccuguuggcu

SEQ ID NO: 611350 - RNA, 19 nt, Homo sapiens
caccuuaauaugcugcaac

SEQ ID NO: 611351 - RNA, 13 nt, Homo sapiens
caccuuacaacuc

SEQ ID NO: 611352 - RNA, 13 nt, Homo sapiens
caccuucaccucg

SEQ ID NO: 611353 - RNA, 16 nt, Homo sapiens
caccuucagacuuugc

SEQ ID NO: 611354 - RNA, 18 nt, Homo sapiens
caccuucuaccaccaggg

SEQ ID NO: 611355 - RNA, 12 nt, Homo sapiens
caccuugcacuc

SEQ ID NO: 611356 - RNA, 16 nt, Homo sapiens
caccuugcccuuuacg

SEQ ID NO: 611357 - RNA, 19 nt, Homo sapiens
caccuuggaccucagugac

SEQ ID NO: 611358 - RNA, 20 nt, Homo sapiens
caccuuggaggaggaugcca

SEQ ID NO: 611359 - RNA, 20 nt, Homo sapiens
caccuuggcuuguuauugcc

SEQ ID NO: 611360 - RNA, 13 nt, Homo sapiens
caccuugucacau

SEQ ID NO: 611361 - RNA, 16 nt, Homo sapiens
caccuugucauguacc

SEQ ID NO: 611362 - RNA, 18 nt, Homo sapiens
caccuuguuacacauuau

SEQ ID NO: 611363 - RNA, 20 nt, Homo sapiens
caccuuugucuggaugcaca

SEQ ID NO: 611364 - RNA, 20 nt, Homo sapiens
cacgaaagaaauguaccuuc

SEQ ID NO: 611365 - RNA, 16 nt, Homo sapiens
cacgaacucauuaaca

SEQ ID NO: 611366 - RNA, 13 nt, Homo sapiens
cacgaacuggccu

SEQ ID NO: 611367 - RNA, 18 nt, Homo sapiens
cacgaauuccaucuugua

SEQ ID NO: 611368 - RNA, 19 nt, Homo sapiens
cacgacugcccggcagggu

SEQ ID NO: 611369 - RNA, 22 nt, Homo sapiens
cacgacuggucaccuugcacuc

SEQ ID NO: 611370 - RNA, 16 nt, Homo sapiens
cacgagaucaagagau

SEQ ID NO: 611371 - RNA, 14 nt, Homo sapiens
cacgagcaaaccca

SEQ ID NO: 611372 - RNA, 20 nt, Homo sapiens
cacgaguuuggauguuguaa

SEQ ID NO: 611373 - RNA, 21 nt, Homo sapiens
cacgaucucggcucacugcac

SEQ ID NO: 611374 - RNA, 20 nt, Homo sapiens
cacgaugcauuuaauaaaga

SEQ ID NO: 611375 - RNA, 18 nt, Homo sapiens
cacgcagcuggugacugg

SEQ ID NO: 611376 - RNA, 20 nt, Homo sapiens
cacgcagugcggauccggga

SEQ ID NO: 611377 - RNA, 18 nt, Homo sapiens
cacgcaugugugcugcag

SEQ ID NO: 611378 - RNA, 17 nt, Homo sapiens
cacgccgucagcugaga

SEQ ID NO: 611379 - RNA, 13 nt, Homo sapiens
cacgccuguaauc

SEQ ID NO: 611380 - RNA, 22 nt, Homo sapiens
cacgccuguaaucccagcacuu

SEQ ID NO: 611381 - RNA, 14 nt, Homo sapiens
cacgcgaaaaccuu

SEQ ID NO: 611382 - RNA, 13 nt, Homo sapiens
cacgcucgcugcc

SEQ ID NO: 611383 - RNA, 19 nt, Homo sapiens
cacgcuguuuguuucauau

SEQ ID NO: 611384 - RNA, 20 nt, Homo sapiens
cacgcuucaaggauauacug

SEQ ID NO: 611385 - RNA, 21 nt, Homo sapiens
cacgcuucaaggauauacugc

SEQ ID NO: 611386 - RNA, 22 nt, Homo sapiens
cacggagggggacggggcucag

SEQ ID NO: 611387 - RNA, 17 nt, Homo sapiens
cacggauccauguagca

SEQ ID NO: 611388 - RNA, 20 nt, Homo sapiens
cacggccacaucaaagaggc

SEQ ID NO: 611389 - RNA, 17 nt, Homo sapiens
cacggcguuuuuuuaca

SEQ ID NO: 611390 - RNA, 17 nt, Homo sapiens
cacggcucucaccagug

SEQ ID NO: 611391 - RNA, 17 nt, Homo sapiens
cacgggcaaucaugagc

SEQ ID NO: 611392 - RNA, 12 nt, Homo sapiens
cacggggcacag

SEQ ID NO: 611393 - RNA, 16 nt, Homo sapiens
cacgguggcucaggcc

SEQ ID NO: 611394 - RNA, 20 nt, Homo sapiens
cacguaaccuaugucagaca

SEQ ID NO: 611395 - RNA, 16 nt, Homo sapiens
cacguauguuauacaa

SEQ ID NO: 611396 - RNA, 23 nt, Homo sapiens
cacgucaugucucuaaacugcgg

SEQ ID NO: 611397 - RNA, 13 nt, Homo sapiens
cacgucugccagg

SEQ ID NO: 611398 - RNA, 19 nt, Homo sapiens
cacguggaggaaugcuccc

SEQ ID NO: 611399 - RNA, 20 nt, Homo sapiens
cacgugggcaaacaggcagu

SEQ ID NO: 611400 - RNA, 14 nt, Homo sapiens
cacguguccgucca

SEQ ID NO: 611401 - RNA, 15 nt, Homo sapiens
cacgugucuauaaug

SEQ ID NO: 611402 - RNA, 18 nt, Homo sapiens
cacgugugcacacacacc

SEQ ID NO: 611403 - RNA, 21 nt, Homo sapiens
cacguguucccgacauaacau

SEQ ID NO: 611404 - RNA, 14 nt, Homo sapiens
cacguuaccauuua

SEQ ID NO: 611405 - RNA, 14 nt, Homo sapiens
cacuaaaaacugau

SEQ ID NO: 611406 - RNA, 14 nt, Homo sapiens
cacuaaacuuuauu

SEQ ID NO: 611407 - RNA, 17 nt, Homo sapiens
cacuaaagauguuagua

SEQ ID NO: 611408 - RNA, 17 nt, Homo sapiens
cacuaaagccagccuga

SEQ ID NO: 611409 - RNA, 13 nt, Homo sapiens
cacuaaagcuuca

SEQ ID NO: 611410 - RNA, 19 nt, Homo sapiens
cacuaaaguuacaaacaga

SEQ ID NO: 611411 - RNA, 18 nt, Homo sapiens
cacuaaauaagcuuccac

SEQ ID NO: 611412 - RNA, 20 nt, Homo sapiens
cacuaagaauucaaacuggg

SEQ ID NO: 611413 - RNA, 13 nt, Homo sapiens
cacuaaugcuuua

SEQ ID NO: 611414 - RNA, 11 nt, Homo sapiens
cacuaauuccu

SEQ ID NO: 611415 - RNA, 19 nt, Homo sapiens
cacuacacuccagccugag

SEQ ID NO: 611416 - RNA, 15 nt, Homo sapiens
cacuacaugaugacu

SEQ ID NO: 611417 - RNA, 14 nt, Homo sapiens
cacuacugcuaaau

SEQ ID NO: 611418 - RNA, 19 nt, Homo sapiens
cacuacugggugucauuuc

SEQ ID NO: 611419 - RNA, 15 nt, Homo sapiens
cacuacuuuguauca

SEQ ID NO: 611420 - RNA, 18 nt, Homo sapiens
cacuagagaccaaaaagg

SEQ ID NO: 611421 - RNA, 19 nt, Homo sapiens
cacuagaggaaaccaguuu

SEQ ID NO: 611422 - RNA, 22 nt, Homo sapiens
cacuagcauuuucuugaaccaa

SEQ ID NO: 611423 - RNA, 14 nt, Homo sapiens
cacuagccagacac

SEQ ID NO: 611424 - RNA, 15 nt, Homo sapiens
cacuagugacaguuu

SEQ ID NO: 611425 - RNA, 17 nt, Homo sapiens
cacuaucacgagccuuu

SEQ ID NO: 611426 - RNA, 22 nt, Homo sapiens
cacuaugaggaauaauuauuua

SEQ ID NO: 611427 - RNA, 21 nt, Homo sapiens
cacuaugauaaaguuguaaau

SEQ ID NO: 611428 - RNA, 19 nt, Homo sapiens
cacuauggggggaggugua

SEQ ID NO: 611429 - RNA, 17 nt, Homo sapiens
cacuauguggagcucag

SEQ ID NO: 611430 - RNA, 16 nt, Homo sapiens
cacuauucucugccuu

SEQ ID NO: 611431 - RNA, 18 nt, Homo sapiens
cacuauucuuaagcacuu

SEQ ID NO: 611432 - RNA, 14 nt, Homo sapiens
cacuauuuacauac

SEQ ID NO: 611433 - RNA, 21 nt, Homo sapiens
cacuauuuccaaaagcacaug

SEQ ID NO: 611434 - RNA, 21 nt, Homo sapiens
cacucaauaaauugcaacaua

SEQ ID NO: 611435 - RNA, 12 nt, Homo sapiens
cacucacuccag

SEQ ID NO: 611436 - RNA, 22 nt, Homo sapiens
cacucacucucccccuccucuu

SEQ ID NO: 611437 - RNA, 13 nt, Homo sapiens
cacuucaaauuca

SEQ ID NO: 611438 - RNA, 14 nt, Homo sapiens
cacuucaaauucaa

SEQ ID NO: 611439 - RNA, 22 nt, Homo sapiens
cacuucaccaaggaagucucag

SEQ ID NO: 611440 - RNA, 20 nt, Homo sapiens
cacuucauccccucccagau

SEQ ID NO: 611441 - RNA, 12 nt, Homo sapiens
cacuucaucuga

SEQ ID NO: 611442 - RNA, 12 nt, Homo sapiens
cacuuccagugu

SEQ ID NO: 611443 - RNA, 16 nt, Homo sapiens
cacuuccaucacaaga

SEQ ID NO: 611444 - RNA, 16 nt, Homo sapiens
cacuucccuacaugga

SEQ ID NO: 611445 - RNA, 17 nt, Homo sapiens
cacuucccuacauggag

SEQ ID NO: 611446 - RNA, 15 nt, Homo sapiens
cacuucccucaucuc

SEQ ID NO: 611447 - RNA, 19 nt, Homo sapiens
cacuucccugggccucaac

SEQ ID NO: 611448 - RNA, 19 nt, Homo sapiens
cacuuccuuuuaccugccc

SEQ ID NO: 611449 - RNA, 18 nt, Homo sapiens
cacuucggcucucuggac

SEQ ID NO: 611450 - RNA, 14 nt, Homo sapiens
cacuucucucagga

SEQ ID NO: 611451 - RNA, 15 nt, Homo sapiens
cacuucucucaggau

SEQ ID NO: 611452 - RNA, 21 nt, Homo sapiens
cacuucuggauauagcuaggu

SEQ ID NO: 611453 - RNA, 23 nt, Homo sapiens
cacuucugggucaugcacugagg

SEQ ID NO: 611454 - RNA, 20 nt, Homo sapiens
cacuucuuugcagagccuuu

SEQ ID NO: 611455 - RNA, 13 nt, Homo sapiens
cacuugaagcacu

SEQ ID NO: 611456 - RNA, 14 nt, Homo sapiens
cacuugaagcacuu

SEQ ID NO: 611457 - RNA, 15 nt, Homo sapiens
cacuugaugauacaa

SEQ ID NO: 611458 - RNA, 15 nt, Homo sapiens
cacuugaugugccau

SEQ ID NO: 611459 - RNA, 18 nt, Homo sapiens
cacuugcacgcccaugug

SEQ ID NO: 611460 - RNA, 14 nt, Homo sapiens
cacuugcagccucc

SEQ ID NO: 611461 - RNA, 20 nt, Homo sapiens
cacuugcagucuuguagcua

SEQ ID NO: 611462 - RNA, 15 nt, Homo sapiens
cacuugcaugaauua

SEQ ID NO: 611463 - RNA, 16 nt, Homo sapiens
cacuugccaugcagga

SEQ ID NO: 611464 - RNA, 15 nt, Homo sapiens
cacuuggcauacaaa

SEQ ID NO: 611465 - RNA, 13 nt, Homo sapiens
cacuugguguacu

SEQ ID NO: 611466 - RNA, 22 nt, Homo sapiens
cacuuguaagaaaaugagacaa

SEQ ID NO: 611467 - RNA, 16 nt, Homo sapiens
cacuugucaaagaagg

SEQ ID NO: 611468 - RNA, 12 nt, Homo sapiens
cacuugugcacc

SEQ ID NO: 611469 - RNA, 13 nt, Homo sapiens
cacuugugccagc

SEQ ID NO: 611470 - RNA, 22 nt, Homo sapiens
cacuuguucuguacuuguaaaa

SEQ ID NO: 611471 - RNA, 17 nt, Homo sapiens
cacuuuaaaacacucuu

SEQ ID NO: 611472 - RNA, 16 nt, Homo sapiens
cacuuuauaaauauca

SEQ ID NO: 611473 - RNA, 15 nt, Homo sapiens
cacuuucucuucaau

SEQ ID NO: 611474 - RNA, 14 nt, Homo sapiens
cacuuugcucuggg

SEQ ID NO: 611475 - RNA, 15 nt, Homo sapiens
cacuuuggaaucaga

SEQ ID NO: 611476 - RNA, 18 nt, Homo sapiens
cacuuuggacuucucuga

SEQ ID NO: 611477 - RNA, 21 nt, Homo sapiens
cacuuugggaggccaaggugg

SEQ ID NO: 611478 - RNA, 20 nt, Homo sapiens
cacuuugggaggcugaggcg

SEQ ID NO: 611479 - RNA, 16 nt, Homo sapiens
cacuuuucauaucauu

SEQ ID NO: 611480 - RNA, 23 nt, Homo sapiens
cacuuuuuuuauaagcaaaaacg

SEQ ID NO: 611481 - RNA, 16 nt, Homo sapiens
cacuuuuuuucuauau

SEQ ID NO: 611482 - RNA, 16 nt, Homo sapiens
cagaaaaacucuggga

SEQ ID NO: 611483 - RNA, 21 nt, Homo sapiens
cagaaaaaguuucuuaaggaa

SEQ ID NO: 611484 - RNA, 20 nt, Homo sapiens
cagaaaaaugaaaagcaaua

SEQ ID NO: 611485 - RNA, 17 nt, Homo sapiens
cagaaaacaacaaaaga

SEQ ID NO: 611486 - RNA, 13 nt, Homo sapiens
cagaaaacagaga

SEQ ID NO: 611487 - RNA, 17 nt, Homo sapiens
cagaaaagcaauacugu

SEQ ID NO: 611488 - RNA, 16 nt, Homo sapiens
cagaaaagcaccugcc

SEQ ID NO: 611489 - RNA, 13 nt, Homo sapiens
cagaaaagugaca

SEQ ID NO: 611490 - RNA, 20 nt, Homo sapiens
cagaaaagugauuaguacua

SEQ ID NO: 611491 - RNA, 22 nt, Homo sapiens
cagaaacagaggagagucccag

SEQ ID NO: 611492 - RNA, 20 nt, Homo sapiens
cagaaaccaguuaugugaau

SEQ ID NO: 611493 - RNA, 13 nt, Homo sapiens
cagaaacuacuga

SEQ ID NO: 611494 - RNA, 21 nt, Homo sapiens
cagaaacuagaaaugugaaug

SEQ ID NO: 611495 - RNA, 20 nt, Homo sapiens
cagaaacuccagacuuguag

SEQ ID NO: 611496 - RNA, 20 nt, Homo sapiens
cagaaacuugugaaguggaa

SEQ ID NO: 611497 - RNA, 21 nt, Homo sapiens
cagaaagaacuuuaaagcuca

SEQ ID NO: 611498 - RNA, 12 nt, Homo sapiens
cagaaagcacuc

SEQ ID NO: 611499 - RNA, 19 nt, Homo sapiens
cagaaaggagaacuaucca

SEQ ID NO: 611500 - RNA, 13 nt, Homo sapiens
cagaaaggugcag

SEQ ID NO: 611501 - RNA, 19 nt, Homo sapiens
cagaaaguaagcauuucca

SEQ ID NO: 611502 - RNA, 20 nt, Homo sapiens
cagaaagugauaagugcagg

SEQ ID NO: 611503 - RNA, 23 nt, Homo sapiens
cagaaagugauaagugcagggag

SEQ ID NO: 611504 - RNA, 20 nt, Homo sapiens
cagaaagugccuuuaucuca

SEQ ID NO: 611505 - RNA, 16 nt, Homo sapiens
cagaaauacugcucug

SEQ ID NO: 611506 - RNA, 16 nt, Homo sapiens
cagaaaucacagucaa

SEQ ID NO: 611507 - RNA, 16 nt, Homo sapiens
cagaaaucacugugaa

SEQ ID NO: 611508 - RNA, 16 nt, Homo sapiens
cagaaauccugcaaug

SEQ ID NO: 611509 - RNA, 19 nt, Homo sapiens
cagaaauccugcaaugaaa

SEQ ID NO: 611510 - RNA, 21 nt, Homo sapiens
cagaaaucuagaagacuguca

SEQ ID NO: 611511 - RNA, 21 nt, Homo sapiens
cagaaaugcccccauucuccc

SEQ ID NO: 611512 - RNA, 13 nt, Homo sapiens
cagaaaugcuguc

SEQ ID NO: 611513 - RNA, 14 nt, Homo sapiens
cagaaauguguuau

SEQ ID NO: 611514 - RNA, 14 nt, Homo sapiens
cagaaauuguauau

SEQ ID NO: 611515 - RNA, 15 nt, Homo sapiens
cagaaauuuaauuca

SEQ ID NO: 611516 - RNA, 18 nt, Homo sapiens
cagaaauuuaauucaugu

SEQ ID NO: 611517 - RNA, 22 nt, Homo sapiens
cagaaauuuaucuuucaaagag

SEQ ID NO: 611518 - RNA, 19 nt, Homo sapiens
cagaaauuuucugaucuca

SEQ ID NO: 611519 - RNA, 19 nt, Homo sapiens
cagaacaaacaaggcauuc

SEQ ID NO: 611520 - RNA, 20 nt, Homo sapiens
cagaacaaauuguuuacaua

SEQ ID NO: 611521 - RNA, 21 nt, Homo sapiens
cagaacacagcaauuccucag

SEQ ID NO: 611522 - RNA, 19 nt, Homo sapiens
cagaacacugcagucagau

SEQ ID NO: 611523 - RNA, 19 nt, Homo sapiens
cagaacacuuauguuauac

SEQ ID NO: 611524 - RNA, 12 nt, Homo sapiens
cagaacagaaua

SEQ ID NO: 611525 - RNA, 11 nt, Homo sapiens
cagaacagagg

SEQ ID NO: 611526 - RNA, 18 nt, Homo sapiens
cagaacagcaucauguca

SEQ ID NO: 611527 - RNA, 23 nt, Homo sapiens
cagaacagccucccgaaugaagc

SEQ ID NO: 611528 - RNA, 22 nt, Homo sapiens
cagaacagggucauguuugcag

SEQ ID NO: 611529 - RNA, 22 nt, Homo sapiens
cagaacagugguggcaacauuc

SEQ ID NO: 611530 - RNA, 12 nt, Homo sapiens
cagaaccaaagc

SEQ ID NO: 611531 - RNA, 17 nt, Homo sapiens
cagaaccccuacaugaa

SEQ ID NO: 611532 - RNA, 17 nt, Homo sapiens
cagaacguauuuagcca

SEQ ID NO: 611533 - RNA, 18 nt, Homo sapiens
cagaacuaaauuuuucau

SEQ ID NO: 611534 - RNA, 12 nt, Homo sapiens
cagaacuacuuc

SEQ ID NO: 611535 - RNA, 18 nt, Homo sapiens
cagaacucaaaugagccc

SEQ ID NO: 611536 - RNA, 18 nt, Homo sapiens
cagaacucccauuacaac

SEQ ID NO: 611537 - RNA, 22 nt, Homo sapiens
cagaacugcagucagcaugaau

SEQ ID NO: 611538 - RNA, 16 nt, Homo sapiens
cagaacugcccccacu

SEQ ID NO: 611539 - RNA, 18 nt, Homo sapiens
cagaacuucccugauuga

SEQ ID NO: 611540 - RNA, 15 nt, Homo sapiens
cagaacuugaagggu

SEQ ID NO: 611541 - RNA, 14 nt, Homo sapiens
cagaagaacugugu

SEQ ID NO: 611542 - RNA, 21 nt, Homo sapiens
cagaagaagugggagcagcuu

SEQ ID NO: 611543 - RNA, 19 nt, Homo sapiens
cagaagagaaaggacucag

SEQ ID NO: 611544 - RNA, 15 nt, Homo sapiens
cagaagaugugauga

SEQ ID NO: 611545 - RNA, 23 nt, Homo sapiens
cagaagaugugaugaauuauccu

SEQ ID NO: 611546 - RNA, 21 nt, Homo sapiens
cagaagcagguucuugauguc

SEQ ID NO: 611547 - RNA, 13 nt, Homo sapiens
cagaagcuuaaaa

SEQ ID NO: 611548 - RNA, 21 nt, Homo sapiens
cagaagcuuggcaugaccuca

SEQ ID NO: 611549 - RNA, 23 nt, Homo sapiens
cagaaggaucgugucugcugacu

SEQ ID NO: 611550 - RNA, 20 nt, Homo sapiens
cagaaggauuaccugaggca

SEQ ID NO: 611551 - RNA, 16 nt, Homo sapiens
cagaaggcaaaaagac

SEQ ID NO: 611552 - RNA, 23 nt, Homo sapiens
cagaaggcagagguugcagugag

SEQ ID NO: 611553 - RNA, 17 nt, Homo sapiens
cagaaggccccagagag

SEQ ID NO: 611554 - RNA, 19 nt, Homo sapiens
cagaaggggcugcuugcuu

SEQ ID NO: 611555 - RNA, 14 nt, Homo sapiens
cagaagguauuccu

SEQ ID NO: 611556 - RNA, 17 nt, Homo sapiens
cagaaggugguuugaca

SEQ ID NO: 611557 - RNA, 15 nt, Homo sapiens
cagaaguaagccuca

SEQ ID NO: 611558 - RNA, 19 nt, Homo sapiens
cagaaguauuucuguggau

SEQ ID NO: 611559 - RNA, 16 nt, Homo sapiens
cagccacgaggugcaa

SEQ ID NO: 611560 - RNA, 17 nt, Homo sapiens
cagccacgaggugcaac

SEQ ID NO: 611561 - RNA, 18 nt, Homo sapiens
cagccacgggggacugac

SEQ ID NO: 611562 - RNA, 20 nt, Homo sapiens
cagccagaggguagggcaca

SEQ ID NO: 611563 - RNA, 15 nt, Homo sapiens
cagccagauggcccc

SEQ ID NO: 611564 - RNA, 13 nt, Homo sapiens
cagccagcauuac

SEQ ID NO: 611565 - RNA, 13 nt, Homo sapiens
cagccaggugcau

SEQ ID NO: 611566 - RNA, 22 nt, Homo sapiens
cagccagucucagagaccagca

SEQ ID NO: 611567 - RNA, 23 nt, Homo sapiens
cagccagucucagagaccagcac

SEQ ID NO: 611568 - RNA, 19 nt, Homo sapiens
cagccagugaggaugacag

SEQ ID NO: 611569 - RNA, 15 nt, Homo sapiens
cagccagugccauuc

SEQ ID NO: 611570 - RNA, 20 nt, Homo sapiens
cagccauaagaaagcacuau

SEQ ID NO: 611571 - RNA, 14 nt, Homo sapiens
cagccauacaaaua

SEQ ID NO: 611572 - RNA, 15 nt, Homo sapiens
cagccaucaaauagu

SEQ ID NO: 611573 - RNA, 15 nt, Homo sapiens
cagccaucagacaac

SEQ ID NO: 611574 - RNA, 17 nt, Homo sapiens
cagccaugcaaugccaa

SEQ ID NO: 611575 - RNA, 15 nt, Homo sapiens
cagccaugccagcug

SEQ ID NO: 611576 - RNA, 18 nt, Homo sapiens
cagccaugccucaugcca

SEQ ID NO: 611577 - RNA, 14 nt, Homo sapiens
cagccauucuucag

SEQ ID NO: 611578 - RNA, 15 nt, Homo sapiens
cagccauucuucagg

SEQ ID NO: 611579 - RNA, 21 nt, Homo sapiens
cagcccaaacuguauacauua

SEQ ID NO: 611580 - RNA, 14 nt, Homo sapiens
cagcccaaccuuca

SEQ ID NO: 611581 - RNA, 21 nt, Homo sapiens
cagcccaagaggacugagacu

SEQ ID NO: 611582 - RNA, 21 nt, Homo sapiens
cagcccaaguagguuauuugu

SEQ ID NO: 611583 - RNA, 21 nt, Homo sapiens
cagcccagaaccacagaugug

SEQ ID NO: 611584 - RNA, 22 nt, Homo sapiens
cagcccagaccucugacacauu

SEQ ID NO: 611585 - RNA, 16 nt, Homo sapiens
cagcccaucaccucua

SEQ ID NO: 611586 - RNA, 15 nt, Homo sapiens
cagcccauggcuuua

SEQ ID NO: 611587 - RNA, 13 nt, Homo sapiens
cagcccauugcug

SEQ ID NO: 611588 - RNA, 21 nt, Homo sapiens
cagcccauuggccgagcuccu

SEQ ID NO: 611589 - RNA, 14 nt, Homo sapiens
cagcccccaccuca

SEQ ID NO: 611590 - RNA, 19 nt, Homo sapiens
cagcccccaggccagguga

SEQ ID NO: 611591 - RNA, 17 nt, Homo sapiens
cagccccggcaagccac

SEQ ID NO: 611592 - RNA, 16 nt, Homo sapiens
cagccccucuaccucc

SEQ ID NO: 611593 - RNA, 20 nt, Homo sapiens
cagccccucuaccuccugga

SEQ ID NO: 611594 - RNA, 12 nt, Homo sapiens
cagccccugacc

SEQ ID NO: 611595 - RNA, 16 nt, Homo sapiens
cagcccggcacuccag

SEQ ID NO: 611596 - RNA, 13 nt, Homo sapiens
cagcccgucuucu

SEQ ID NO: 611597 - RNA, 13 nt, Homo sapiens
cagcccgugcacc

SEQ ID NO: 611598 - RNA, 19 nt, Homo sapiens
cagcccucagcaaugugcc

SEQ ID NO: 611599 - RNA, 16 nt, Homo sapiens
cagcccugacuggugc

SEQ ID NO: 611600 - RNA, 15 nt, Homo sapiens
cagcccuugugaugu

SEQ ID NO: 611601 - RNA, 16 nt, Homo sapiens
cagccgaaaagcuuuu

SEQ ID NO: 611602 - RNA, 20 nt, Homo sapiens
cagccggcuaugaaagggag

SEQ ID NO: 611603 - RNA, 21 nt, Homo sapiens
cagccgucccgcguucaagac

SEQ ID NO: 611604 - RNA, 19 nt, Homo sapiens
cagccuaguuaucaagggg

SEQ ID NO: 611605 - RNA, 13 nt, Homo sapiens
cagccucagaaua

SEQ ID NO: 611606 - RNA, 12 nt, Homo sapiens
cagccuccaaag

SEQ ID NO: 611607 - RNA, 14 nt, Homo sapiens
cagccucccagugu

SEQ ID NO: 611608 - RNA, 16 nt, Homo sapiens
cagccuccccgugcca

SEQ ID NO: 611609 - RNA, 19 nt, Homo sapiens
cagccuccccgugccaaaa

SEQ ID NO: 611610 - RNA, 13 nt, Homo sapiens
cagccucccugag

SEQ ID NO: 611611 - RNA, 17 nt, Homo sapiens
cagccucccuuugauga

SEQ ID NO: 611612 - RNA, 18 nt, Homo sapiens
cagccuccgccauuccaa

SEQ ID NO: 611613 - RNA, 19 nt, Homo sapiens
cagccucuagcaccaggac

SEQ ID NO: 611614 - RNA, 19 nt, Homo sapiens
cagccucucgaagugcuga

SEQ ID NO: 611615 - RNA, 15 nt, Homo sapiens
cagccucucugcuau

SEQ ID NO: 611616 - RNA, 13 nt, Homo sapiens
cagccucuugccc

SEQ ID NO: 611617 - RNA, 19 nt, Homo sapiens
cagccugaccaacaucgug

SEQ ID NO: 611618 - RNA, 19 nt, Homo sapiens
cagccugcagcaagugcuu

SEQ ID NO: 611619 - RNA, 23 nt, Homo sapiens
cagccugcucccuagccagaggc

SEQ ID NO: 611620 - RNA, 20 nt, Homo sapiens
cagccuggccccugugcacc

SEQ ID NO: 611621 - RNA, 18 nt, Homo sapiens
cagccuggcgacaagagu

SEQ ID NO: 611622 - RNA, 19 nt, Homo sapiens
cagccugggcaacagagca

SEQ ID NO: 611623 - RNA, 20 nt, Homo sapiens
cagccugggcaacagagcaa

SEQ ID NO: 611624 - RNA, 18 nt, Homo sapiens
cagccugggcaaugugau

SEQ ID NO: 611625 - RNA, 17 nt, Homo sapiens
cagccugggcccaucuc

SEQ ID NO: 611626 - RNA, 17 nt, Homo sapiens
cagccuggggcucucug

SEQ ID NO: 611627 - RNA, 22 nt, Homo sapiens
cagccuggggggucguggcaga

SEQ ID NO: 611628 - RNA, 20 nt, Homo sapiens
cagccugggugacagagcaa

SEQ ID NO: 611629 - RNA, 13 nt, Homo sapiens
cagccuguagcuc

SEQ ID NO: 611630 - RNA, 20 nt, Homo sapiens
cagccugugguuacagugca

SEQ ID NO: 611631 - RNA, 13 nt, Homo sapiens
cagccuguugccc

SEQ ID NO: 611632 - RNA, 17 nt, Homo sapiens
cagccuguuuucacuca

SEQ ID NO: 611633 - RNA, 24 nt, Homo sapiens
cagccuuaugauuaaacuuccuuc

SEQ ID NO: 611634 - RNA, 13 nt, Homo sapiens
cagccuugaacuc

SEQ ID NO: 611635 - RNA, 17 nt, Homo sapiens
cagccuugcacacccac

SEQ ID NO: 611636 - RNA, 17 nt, Homo sapiens
cagccuugcaucaaggg

SEQ ID NO: 611637 - RNA, 22 nt, Homo sapiens
cagccuuuccaagucacuagaa

SEQ ID NO: 611638 - RNA, 18 nt, Homo sapiens
cagcgaaugaaugcugua

SEQ ID NO: 611639 - RNA, 13 nt, Homo sapiens
cagcgcaccuguu

SEQ ID NO: 611640 - RNA, 15 nt, Homo sapiens
cagcgccagccucag

SEQ ID NO: 611641 - RNA, 17 nt, Homo sapiens
cagcgccuuuccugcca

SEQ ID NO: 611642 - RNA, 15 nt, Homo sapiens
cagcgcuguauuuac

SEQ ID NO: 611643 - RNA, 22 nt, Homo sapiens
cagcggcccugucauccagcuc

SEQ ID NO: 611644 - RNA, 18 nt, Homo sapiens
cagcgucacucuaccuaa

SEQ ID NO: 611645 - RNA, 15 nt, Homo sapiens
cagcgucaguuucac

SEQ ID NO: 611646 - RNA, 15 nt, Homo sapiens
cagcgucccagucuc

SEQ ID NO: 611647 - RNA, 20 nt, Homo sapiens
cagcgugcuggcgacacuca

SEQ ID NO: 611648 - RNA, 13 nt, Homo sapiens
cagcuaaauuuuc

SEQ ID NO: 611649 - RNA, 19 nt, Homo sapiens
cagcuaaggacauuuccca

SEQ ID NO: 611650 - RNA, 22 nt, Homo sapiens
cagcuacccaggaggcugaggu

SEQ ID NO: 611651 - RNA, 18 nt, Homo sapiens
cagcuaccucaaccaaug

SEQ ID NO: 611652 - RNA, 23 nt, Homo sapiens
cagcuaccucaaccaaugccaaa

SEQ ID NO: 611653 - RNA, 21 nt, Homo sapiens
cagcuaucacguugaaccacg

SEQ ID NO: 611654 - RNA, 14 nt, Homo sapiens
cagcuaucagcucu

SEQ ID NO: 611655 - RNA, 13 nt, Homo sapiens
cagcuauccagug

SEQ ID NO: 611656 - RNA, 14 nt, Homo sapiens
cagcuauccaguga

SEQ ID NO: 611657 - RNA, 21 nt, Homo sapiens
cagcuauuuagaagcaucauc

SEQ ID NO: 611658 - RNA, 20 nt, Homo sapiens
cagcuauuuugugaagccau

SEQ ID NO: 611659 - RNA, 13 nt, Homo sapiens
cagcucaccucaa

SEQ ID NO: 611660 - RNA, 16 nt, Homo sapiens
cagcucagaacccagg

SEQ ID NO: 611661 - RNA, 17 nt, Homo sapiens
cagcucagcgccagccu

SEQ ID NO: 611662 - RNA, 20 nt, Homo sapiens
cagcucagcucuuuggauca

SEQ ID NO: 611663 - RNA, 22 nt, Homo sapiens
cagcucagcuucuuccuagguc

SEQ ID NO: 611664 - RNA, 16 nt, Homo sapiens
cagcucaugacacugu

SEQ ID NO: 611665 - RNA, 20 nt, Homo sapiens
cagcuccagaauaccuucuu

SEQ ID NO: 611666 - RNA, 23 nt, Homo sapiens
cagcucccgaagccugagcucau

SEQ ID NO: 611667 - RNA, 16 nt, Homo sapiens
cagcucccgcuguggc

SEQ ID NO: 611668 - RNA, 16 nt, Homo sapiens
cagcucccuucucugu

SEQ ID NO: 611669 - RNA, 17 nt, Homo sapiens
cagcuccuaggaaaaug

SEQ ID NO: 611670 - RNA, 17 nt, Homo sapiens
cagcuccugaguagcug

SEQ ID NO: 611671 - RNA, 17 nt, Homo sapiens
cagcuccuuccaccaca

SEQ ID NO: 611672 - RNA, 19 nt, Homo sapiens
cagcuccuuucaugcucca

SEQ ID NO: 611673 - RNA, 19 nt, Homo sapiens
cagcucgggcccucuguga

SEQ ID NO: 611674 - RNA, 19 nt, Homo sapiens
cagcucuaccaguucucgu

SEQ ID NO: 611675 - RNA, 19 nt, Homo sapiens
cagcucucuccuuucaggg

SEQ ID NO: 611676 - RNA, 15 nt, Homo sapiens
cagcucugcaagaau

SEQ ID NO: 611677 - RNA, 21 nt, Homo sapiens
cagcucugcauuaucugaggu

SEQ ID NO: 611678 - RNA, 23 nt, Homo sapiens
cagcucuggaugaaggcaaaaac

SEQ ID NO: 611679 - RNA, 14 nt, Homo sapiens
cagcucugggccau

SEQ ID NO: 611680 - RNA, 18 nt, Homo sapiens
cagcucuguaucugccau

SEQ ID NO: 611681 - RNA, 18 nt, Homo sapiens
caguguuuauccuuucau

SEQ ID NO: 611682 - RNA, 19 nt, Homo sapiens
caguguuucugugaauaga

SEQ ID NO: 611683 - RNA, 19 nt, Homo sapiens
caguuaaagauuauuguga

SEQ ID NO: 611684 - RNA, 16 nt, Homo sapiens
caguuaacuauugcau

SEQ ID NO: 611685 - RNA, 20 nt, Homo sapiens
caguuaauaaaccuuugcaa

SEQ ID NO: 611686 - RNA, 18 nt, Homo sapiens
caguuaauacuccagaga

SEQ ID NO: 611687 - RNA, 17 nt, Homo sapiens
caguuaaugccacaaaa

SEQ ID NO: 611688 - RNA, 15 nt, Homo sapiens
caguuacaaaguaau

SEQ ID NO: 611689 - RNA, 20 nt, Homo sapiens
caguuacagagaauuucuaa

SEQ ID NO: 611690 - RNA, 20 nt, Homo sapiens
caguuaccacagcaacugac

SEQ ID NO: 611691 - RNA, 16 nt, Homo sapiens
caguuacuccaguaua

SEQ ID NO: 611692 - RNA, 19 nt, Homo sapiens
caguuacuggggucaccca

SEQ ID NO: 611693 - RNA, 23 nt, Homo sapiens
caguuagaagagguagugugaau

SEQ ID NO: 611694 - RNA, 14 nt, Homo sapiens
caguuagcucucaa

SEQ ID NO: 611695 - RNA, 19 nt, Homo sapiens
caguuauguuuuauacucu

SEQ ID NO: 611696 - RNA, 16 nt, Homo sapiens
caguuauuaaucugga

SEQ ID NO: 611697 - RNA, 15 nt, Homo sapiens
caguucaaauccuca

SEQ ID NO: 611698 - RNA, 14 nt, Homo sapiens
caguucaagcuaua

SEQ ID NO: 611699 - RNA, 23 nt, Homo sapiens
caguucacuucuuugcagagccu

SEQ ID NO: 611700 - RNA, 17 nt, Homo sapiens
caguucagguaugugug

SEQ ID NO: 611701 - RNA, 12 nt, Homo sapiens
caguucagugag

SEQ ID NO: 611702 - RNA, 20 nt, Homo sapiens
caguucauuauuuugugguu

SEQ ID NO: 611703 - RNA, 18 nt, Homo sapiens
caguucccccaaccucag

SEQ ID NO: 611704 - RNA, 17 nt, Homo sapiens
caguuccccgagaacuu

SEQ ID NO: 611705 - RNA, 14 nt, Homo sapiens
caguuccuguggcu

SEQ ID NO: 611706 - RNA, 13 nt, Homo sapiens
caguucuaaccuc

SEQ ID NO: 611707 - RNA, 12 nt, Homo sapiens
caguucuacuca

SEQ ID NO: 611708 - RNA, 16 nt, Homo sapiens
caguucucccagggag

SEQ ID NO: 611709 - RNA, 20 nt, Homo sapiens
caguucugagcaccguguca

SEQ ID NO: 611710 - RNA, 14 nt, Homo sapiens
caguucugucauau

SEQ ID NO: 611711 - RNA, 17 nt, Homo sapiens
caguucuuggugcucug

SEQ ID NO: 611712 - RNA, 19 nt, Homo sapiens
caguucuuugguaagcauu

SEQ ID NO: 611713 - RNA, 17 nt, Homo sapiens
caguugaaaacuuguaa

SEQ ID NO: 611714 - RNA, 14 nt, Homo sapiens
caguugaacagagg

SEQ ID NO: 611715 - RNA, 14 nt, Homo sapiens
caguugacuuuaag

SEQ ID NO: 611716 - RNA, 14 nt, Homo sapiens
caguugcagaauug

SEQ ID NO: 611717 - RNA, 14 nt, Homo sapiens
caguugcuuugcag

SEQ ID NO: 611718 - RNA, 19 nt, Homo sapiens
caguuggacucucagggau

SEQ ID NO: 611719 - RNA, 22 nt, Homo sapiens
caguuggauuuauucugccaaa

SEQ ID NO: 611720 - RNA, 14 nt, Homo sapiens
caguuggcuucuaa

SEQ ID NO: 611721 - RNA, 24 nt, Homo sapiens
caguugguuaucugaauaguguca

SEQ ID NO: 611722 - RNA, 19 nt, Homo sapiens
caguuguccuuaaauuugu

SEQ ID NO: 611723 - RNA, 19 nt, Homo sapiens
caguuguuuguuuuugcuu

SEQ ID NO: 611724 - RNA, 14 nt, Homo sapiens
caguuuacaucuug

SEQ ID NO: 611725 - RNA, 17 nt, Homo sapiens
caguuuauacccuaguu

SEQ ID NO: 611726 - RNA, 18 nt, Homo sapiens
caguuuauauuguggaau

SEQ ID NO: 611727 - RNA, 12 nt, Homo sapiens
caguuucaggag

SEQ ID NO: 611728 - RNA, 12 nt, Homo sapiens
caguuucugaca

SEQ ID NO: 611729 - RNA, 15 nt, Homo sapiens
caguuugcaccuguc

SEQ ID NO: 611730 - RNA, 19 nt, Homo sapiens
caguuugguguguccuccg

SEQ ID NO: 611731 - RNA, 23 nt, Homo sapiens
caguuuuaaaaaaaacaauucca

SEQ ID NO: 611732 - RNA, 23 nt, Homo sapiens
caguuuuaccucuucucucucag

SEQ ID NO: 611733 - RNA, 14 nt, Homo sapiens
caguuuuccaugaa

SEQ ID NO: 611734 - RNA, 21 nt, Homo sapiens
caguuuuccaugguguauuca

SEQ ID NO: 611735 - RNA, 12 nt, Homo sapiens
caguuuugacau

SEQ ID NO: 611736 - RNA, 12 nt, Homo sapiens
caguuuuugccu

SEQ ID NO: 611737 - RNA, 22 nt, Homo sapiens
cauaaaaaauaaaguaccacac

SEQ ID NO: 611738 - RNA, 13 nt, Homo sapiens
cauaaaaaccaaa

SEQ ID NO: 611739 - RNA, 22 nt, Homo sapiens
cauaaaaaccaaacccagacaa

SEQ ID NO: 611740 - RNA, 17 nt, Homo sapiens
cauaaaaaggaacaaga

SEQ ID NO: 611741 - RNA, 21 nt, Homo sapiens
cauaaaaaggaacaagacuga

SEQ ID NO: 611742 - RNA, 17 nt, Homo sapiens
cauaaaacaaaaccaag

SEQ ID NO: 611743 - RNA, 18 nt, Homo sapiens
cauaaaaccaaguuuuac

SEQ ID NO: 611744 - RNA, 15 nt, Homo sapiens
cauaaaaguaaagga

SEQ ID NO: 611745 - RNA, 20 nt, Homo sapiens
cauaaaauccaauauuguaa

SEQ ID NO: 611746 - RNA, 14 nt, Homo sapiens
cauaaaaucuguga

SEQ ID NO: 611747 - RNA, 19 nt, Homo sapiens
cauaaaauugcaguuucau

SEQ ID NO: 611748 - RNA, 21 nt, Homo sapiens
cauaaacaacuuaauguucug

SEQ ID NO: 611749 - RNA, 17 nt, Homo sapiens
cauaaacacccaugaau

SEQ ID NO: 611750 - RNA, 18 nt, Homo sapiens
cauaaacugucacucuag

SEQ ID NO: 611751 - RNA, 15 nt, Homo sapiens
cauaaagaauucaca

SEQ ID NO: 611752 - RNA, 15 nt, Homo sapiens
cauaaagacuaagua

SEQ ID NO: 611753 - RNA, 14 nt, Homo sapiens
cauaaagacugugc

SEQ ID NO: 611754 - RNA, 18 nt, Homo sapiens
cauaaagacugugcugag

SEQ ID NO: 611755 - RNA, 20 nt, Homo sapiens
cauaaagauguuaaauggaa

SEQ ID NO: 611756 - RNA, 21 nt, Homo sapiens
cauaaagauguuaaauggaau

SEQ ID NO: 611757 - RNA, 18 nt, Homo sapiens
cauaaagccaaauuucca

SEQ ID NO: 611758 - RNA, 20 nt, Homo sapiens
cauaaagccuuuaaaaccag

SEQ ID NO: 611759 - RNA, 15 nt, Homo sapiens
cauaaagucagugcc

SEQ ID NO: 611760 - RNA, 16 nt, Homo sapiens
cauaaauaaaggugua

SEQ ID NO: 611761 - RNA, 13 nt, Homo sapiens
cauaaaucacaaa

SEQ ID NO: 611762 - RNA, 22 nt, Homo sapiens
cauaaauuacuuuuucauucuu

SEQ ID NO: 611763 - RNA, 22 nt, Homo sapiens
cauaaauuagaggucuccaaaa

SEQ ID NO: 611764 - RNA, 21 nt, Homo sapiens
cauaacaccgucccagggcuc

SEQ ID NO: 611765 - RNA, 22 nt, Homo sapiens
cauaacagucuuacugcaggca

SEQ ID NO: 611766 - RNA, 20 nt, Homo sapiens
cauaaccucucugugccauc

SEQ ID NO: 611767 - RNA, 15 nt, Homo sapiens
cauaaccugucucac

SEQ ID NO: 611768 - RNA, 19 nt, Homo sapiens
cauaacuaguggcucucag

SEQ ID NO: 611769 - RNA, 20 nt, Homo sapiens
cauaacugaaaaugugcuau

SEQ ID NO: 611770 - RNA, 14 nt, Homo sapiens
cauaacuguucuca

SEQ ID NO: 611771 - RNA, 14 nt, Homo sapiens
cauaacuugcugaa

SEQ ID NO: 611772 - RNA, 21 nt, Homo sapiens
cauaacuuggccauguucucc

SEQ ID NO: 611773 - RNA, 19 nt, Homo sapiens
cauaagacacuuagauuaa

SEQ ID NO: 611774 - RNA, 17 nt, Homo sapiens
cauaagauaaaugugcu

SEQ ID NO: 611775 - RNA, 11 nt, Homo sapiens
cauaagccuac

SEQ ID NO: 611776 - RNA, 22 nt, Homo sapiens
cauaaggccggacgcaucucaa

SEQ ID NO: 611777 - RNA, 18 nt, Homo sapiens
cauaaguuaacuuccaau

SEQ ID NO: 611778 - RNA, 13 nt, Homo sapiens
cauaauaauagca

SEQ ID NO: 611779 - RNA, 22 nt, Homo sapiens
cauaauagucaauuucuacuuc

SEQ ID NO: 611780 - RNA, 12 nt, Homo sapiens
cauaaucuguac

SEQ ID NO: 611781 - RNA, 15 nt, Homo sapiens
cauaaucuguacaau

SEQ ID NO: 611782 - RNA, 15 nt, Homo sapiens
cauaaugcacuuuag

SEQ ID NO: 611783 - RNA, 23 nt, Homo sapiens
cauaaugguuuuguuagauuuau

SEQ ID NO: 611784 - RNA, 16 nt, Homo sapiens
cauaauguuacauuau

SEQ ID NO: 611785 - RNA, 18 nt, Homo sapiens
cauaauguuacauuauua

SEQ ID NO: 611786 - RNA, 21 nt, Homo sapiens
cauaauguuacauuauuauca

SEQ ID NO: 611787 - RNA, 16 nt, Homo sapiens
cauaauucagcacuua

SEQ ID NO: 611788 - RNA, 19 nt, Homo sapiens
cauaauuccuacagcacua

SEQ ID NO: 611789 - RNA, 22 nt, Homo sapiens
cauaauugugauuagacagaac

SEQ ID NO: 611790 - RNA, 17 nt, Homo sapiens
cauaauuuaaaagcaca

SEQ ID NO: 611791 - RNA, 19 nt, Homo sapiens
cauaauuuguacauaugua

SEQ ID NO: 611792 - RNA, 21 nt, Homo sapiens
cauaauuuucuucaugcaaug

SEQ ID NO: 611793 - RNA, 18 nt, Homo sapiens
cauacaaagagguguaca

SEQ ID NO: 611794 - RNA, 13 nt, Homo sapiens
cauacaacagaaa

SEQ ID NO: 611795 - RNA, 13 nt, Homo sapiens
cauacaacuggac

SEQ ID NO: 611796 - RNA, 18 nt, Homo sapiens
cauacaaguauccaguca

SEQ ID NO: 611797 - RNA, 18 nt, Homo sapiens
cauacaauuccaaacaca

SEQ ID NO: 611798 - RNA, 19 nt, Homo sapiens
cauacacacacaaaccauu

SEQ ID NO: 611799 - RNA, 15 nt, Homo sapiens
cauacacagaaacca

SEQ ID NO: 611800 - RNA, 13 nt, Homo sapiens
cauacaccagcau

SEQ ID NO: 611801 - RNA, 13 nt, Homo sapiens
cauacacuuuguu

SEQ ID NO: 611802 - RNA, 19 nt, Homo sapiens
cauacagagacagauauac

SEQ ID NO: 611803 - RNA, 16 nt, Homo sapiens
caugcuacaguuauua

SEQ ID NO: 611804 - RNA, 18 nt, Homo sapiens
caugcugaaaacuacaca

SEQ ID NO: 611805 - RNA, 19 nt, Homo sapiens
caugcugaaaacuacacaa

SEQ ID NO: 611806 - RNA, 23 nt, Homo sapiens
caugcugaaagucuucaugguga

SEQ ID NO: 611807 - RNA, 13 nt, Homo sapiens
caugcugcaaagg

SEQ ID NO: 611808 - RNA, 17 nt, Homo sapiens
caugcugcuuugccaag

SEQ ID NO: 611809 - RNA, 17 nt, Homo sapiens
caugcugggauuuccaa

SEQ ID NO: 611810 - RNA, 13 nt, Homo sapiens
caugcuggggcaa

SEQ ID NO: 611811 - RNA, 14 nt, Homo sapiens
caugcuggggcaag

SEQ ID NO: 611812 - RNA, 19 nt, Homo sapiens
caugcuguugcugcuacug

SEQ ID NO: 611813 - RNA, 21 nt, Homo sapiens
caugcuuccuccuuugcucuu

SEQ ID NO: 611814 - RNA, 17 nt, Homo sapiens
caugcuugacauaccua

SEQ ID NO: 611815 - RNA, 23 nt, Homo sapiens
caugcuugcauaagagcuuaaga

SEQ ID NO: 611816 - RNA, 17 nt, Homo sapiens
cauggaaaacagaguau

SEQ ID NO: 611817 - RNA, 21 nt, Homo sapiens
cauggaacagcauuacccucc

SEQ ID NO: 611818 - RNA, 14 nt, Homo sapiens
cauggaauaguuuu

SEQ ID NO: 611819 - RNA, 14 nt, Homo sapiens
cauggaaucucuuc

SEQ ID NO: 611820 - RNA, 13 nt, Homo sapiens
cauggaauuaccu

SEQ ID NO: 611821 - RNA, 19 nt, Homo sapiens
cauggagaacagcaugaca

SEQ ID NO: 611822 - RNA, 20 nt, Homo sapiens
cauggagaaucugcugcaua

SEQ ID NO: 611823 - RNA, 13 nt, Homo sapiens
cauggagcuauaa

SEQ ID NO: 611824 - RNA, 16 nt, Homo sapiens
cauggaggcaugccaa

SEQ ID NO: 611825 - RNA, 17 nt, Homo sapiens
cauggaguauagugcaa

SEQ ID NO: 611826 - RNA, 20 nt, Homo sapiens
cauggauuacuucucuauaa

SEQ ID NO: 611827 - RNA, 17 nt, Homo sapiens
cauggcaaaucaggggc

SEQ ID NO: 611828 - RNA, 17 nt, Homo sapiens
cauggcaagucacaugc

SEQ ID NO: 611829 - RNA, 16 nt, Homo sapiens
cauggcaauugcacuc

SEQ ID NO: 611830 - RNA, 13 nt, Homo sapiens
cauggcacaggcc

SEQ ID NO: 611831 - RNA, 19 nt, Homo sapiens
cauggcaccuuuugcacau

SEQ ID NO: 611832 - RNA, 23 nt, Homo sapiens
cauggcaccuuuugcacauaaca

SEQ ID NO: 611833 - RNA, 23 nt, Homo sapiens
cauggcagaguuuguguguuguc

SEQ ID NO: 611834 - RNA, 24 nt, Homo sapiens
cauggcaucuucaauaugaaucua

SEQ ID NO: 611835 - RNA, 19 nt, Homo sapiens
cauggccaccccgugccac

SEQ ID NO: 611836 - RNA, 20 nt, Homo sapiens
cauggccccaguccaugcuu

SEQ ID NO: 611837 - RNA, 23 nt, Homo sapiens
cauggccgcuucuagagccucga

SEQ ID NO: 611838 - RNA, 22 nt, Homo sapiens
cauggccuugaaacaguuccau

SEQ ID NO: 611839 - RNA, 23 nt, Homo sapiens
cauggcucuggcacaguguaauc

SEQ ID NO: 611840 - RNA, 19 nt, Homo sapiens
cauggcugaaguuggccac

SEQ ID NO: 611841 - RNA, 17 nt, Homo sapiens
cauggcuguguuugcag

SEQ ID NO: 611842 - RNA, 20 nt, Homo sapiens
caugggaaaaaccacugcua

SEQ ID NO: 611843 - RNA, 14 nt, Homo sapiens
caugggaaggggag

SEQ ID NO: 611844 - RNA, 19 nt, Homo sapiens
caugggacuaaaugaacua

SEQ ID NO: 611845 - RNA, 20 nt, Homo sapiens
caugggauggggaugaagua

SEQ ID NO: 611846 - RNA, 20 nt, Homo sapiens
caugggauugcacagagcug

SEQ ID NO: 611847 - RNA, 21 nt, Homo sapiens
caugggcaccaaccugcauuu

SEQ ID NO: 611848 - RNA, 18 nt, Homo sapiens
cauggguuggcagggugg

SEQ ID NO: 611849 - RNA, 20 nt, Homo sapiens
caugguaaaaccccaucucu

SEQ ID NO: 611850 - RNA, 23 nt, Homo sapiens
caugguagucacuaacauauaua

SEQ ID NO: 611851 - RNA, 15 nt, Homo sapiens
cauggucacaguccu

SEQ ID NO: 611852 - RNA, 20 nt, Homo sapiens
cauggugaaaccccgucucu

SEQ ID NO: 611853 - RNA, 23 nt, Homo sapiens
cauggugagccuagcccugggac

SEQ ID NO: 611854 - RNA, 20 nt, Homo sapiens
caugguguggccaucacuca

SEQ ID NO: 611855 - RNA, 18 nt, Homo sapiens
caugguuaccugaccuaa

SEQ ID NO: 611856 - RNA, 16 nt, Homo sapiens
caugguucaccaugca

SEQ ID NO: 611857 - RNA, 16 nt, Homo sapiens
cauguaaacugugcac

SEQ ID NO: 611858 - RNA, 19 nt, Homo sapiens
cauguaaagaaaaaaacuu

SEQ ID NO: 611859 - RNA, 14 nt, Homo sapiens
cauguaaauugcaa

SEQ ID NO: 611860 - RNA, 19 nt, Homo sapiens
cauguaacauacauauucc

SEQ ID NO: 611861 - RNA, 16 nt, Homo sapiens
cauguaauaagcacuu

SEQ ID NO: 611862 - RNA, 17 nt, Homo sapiens
cauguaaucagauuuau

SEQ ID NO: 611863 - RNA, 13 nt, Homo sapiens
cauguaauccuuu

SEQ ID NO: 611864 - RNA, 15 nt, Homo sapiens
cauguaaugugguca

SEQ ID NO: 611865 - RNA, 15 nt, Homo sapiens
cauguaauugcagau

SEQ ID NO: 611866 - RNA, 17 nt, Homo sapiens
cauguacagacauacau

SEQ ID NO: 611867 - RNA, 17 nt, Homo sapiens
cauguacauacccuggc

SEQ ID NO: 611868 - RNA, 12 nt, Homo sapiens
cauguacaugaa

SEQ ID NO: 611869 - RNA, 19 nt, Homo sapiens
cauguacccaaaguguucu

SEQ ID NO: 611870 - RNA, 20 nt, Homo sapiens
cauguaccucagaucucucu

SEQ ID NO: 611871 - RNA, 17 nt, Homo sapiens
cauguagagaaaagcac

SEQ ID NO: 611872 - RNA, 18 nt, Homo sapiens
cauguagccaguuaagga

SEQ ID NO: 611873 - RNA, 21 nt, Homo sapiens
cauguagcccccuggccucug

SEQ ID NO: 611874 - RNA, 16 nt, Homo sapiens
cauguaggaguguuua

SEQ ID NO: 611875 - RNA, 20 nt, Homo sapiens
cauguaucuuuugaacuggc

SEQ ID NO: 611876 - RNA, 22 nt, Homo sapiens
cauguauggaaucccacuguau

SEQ ID NO: 611877 - RNA, 18 nt, Homo sapiens
cauguauuagcucacuga

SEQ ID NO: 611878 - RNA, 20 nt, Homo sapiens
cauguauugugccaaucugu

SEQ ID NO: 611879 - RNA, 21 nt, Homo sapiens
cauguauuuuuaauauaugca

SEQ ID NO: 611880 - RNA, 14 nt, Homo sapiens
caugucacaauaca

SEQ ID NO: 611881 - RNA, 13 nt, Homo sapiens
caugucaccucag

SEQ ID NO: 611882 - RNA, 15 nt, Homo sapiens
caugucaccuggcug

SEQ ID NO: 611883 - RNA, 14 nt, Homo sapiens
caugucagacacag

SEQ ID NO: 611884 - RNA, 19 nt, Homo sapiens
caugucauuucagaaguua

SEQ ID NO: 611885 - RNA, 20 nt, Homo sapiens
caugucccaaaccagacacc

SEQ ID NO: 611886 - RNA, 17 nt, Homo sapiens
cauguccuaauucuucu

SEQ ID NO: 611887 - RNA, 15 nt, Homo sapiens
caugucucaauagua

SEQ ID NO: 611888 - RNA, 21 nt, Homo sapiens
caugucuccuggacucagggu

SEQ ID NO: 611889 - RNA, 18 nt, Homo sapiens
caugucugcuggguguga

SEQ ID NO: 611890 - RNA, 17 nt, Homo sapiens
caugucuuaaaugcuca

SEQ ID NO: 611891 - RNA, 20 nt, Homo sapiens
caugucuuuucuuccacugc

SEQ ID NO: 611892 - RNA, 22 nt, Homo sapiens
caugugaaacucuacccugaag

SEQ ID NO: 611893 - RNA, 17 nt, Homo sapiens
caugugaagcuauuuga

SEQ ID NO: 611894 - RNA, 13 nt, Homo sapiens
caugugacauuua

SEQ ID NO: 611895 - RNA, 21 nt, Homo sapiens
caugugacauuuauauauuga

SEQ ID NO: 611896 - RNA, 17 nt, Homo sapiens
caugugagcaugucacu

SEQ ID NO: 611897 - RNA, 17 nt, Homo sapiens
caugugagccaccgcug

SEQ ID NO: 611898 - RNA, 19 nt, Homo sapiens
caugugcaaaugugcuggu

SEQ ID NO: 611899 - RNA, 16 nt, Homo sapiens
caugugcagcuauuua

SEQ ID NO: 611900 - RNA, 19 nt, Homo sapiens
caugugcagucacuggugu

SEQ ID NO: 611901 - RNA, 14 nt, Homo sapiens
caugugcauauaaa

SEQ ID NO: 611902 - RNA, 17 nt, Homo sapiens
caugugccagggcaaug

SEQ ID NO: 611903 - RNA, 18 nt, Homo sapiens
caugugcccccucuacca

SEQ ID NO: 611904 - RNA, 16 nt, Homo sapiens
caugugccgaaugugc

SEQ ID NO: 611905 - RNA, 18 nt, Homo sapiens
caugugccgaaugugcag

SEQ ID NO: 611906 - RNA, 13 nt, Homo sapiens
caugugccuuuag

SEQ ID NO: 611907 - RNA, 21 nt, Homo sapiens
caugugcguccauauuuaaca

SEQ ID NO: 611908 - RNA, 15 nt, Homo sapiens
caugugcugugacca

SEQ ID NO: 611909 - RNA, 16 nt, Homo sapiens
cauguggaagcacuuu

SEQ ID NO: 611910 - RNA, 15 nt, Homo sapiens
cauguggacuggugc

SEQ ID NO: 611911 - RNA, 23 nt, Homo sapiens
cauguggacuggugcaaguugag

SEQ ID NO: 611912 - RNA, 20 nt, Homo sapiens
cauguggcauguucaucgua

SEQ ID NO: 611913 - RNA, 18 nt, Homo sapiens
cauguggcccuccagugu

SEQ ID NO: 611914 - RNA, 22 nt, Homo sapiens
cauguggccugcccagccucaa

SEQ ID NO: 611915 - RNA, 23 nt, Homo sapiens
cauguggcuccucccagcccaua

SEQ ID NO: 611916 - RNA, 15 nt, Homo sapiens
caugugguacuugag

SEQ ID NO: 611917 - RNA, 16 nt, Homo sapiens
caugugguacuugagg

SEQ ID NO: 611918 - RNA, 14 nt, Homo sapiens
cauguguaaagguu

SEQ ID NO: 611919 - RNA, 17 nt, Homo sapiens
cauguguauuaaugucu

SEQ ID NO: 611920 - RNA, 18 nt, Homo sapiens
caugugugagugugugca

SEQ ID NO: 611921 - RNA, 21 nt, Homo sapiens
caugugugagugugugcaagu

SEQ ID NO: 611922 - RNA, 21 nt, Homo sapiens
caugugugcgagugugugcau

SEQ ID NO: 611923 - RNA, 12 nt, Homo sapiens
cauguguggaag

SEQ ID NO: 611924 - RNA, 15 nt, Homo sapiens
ccccuccacugucac

SEQ ID NO: 611925 - RNA, 21 nt, Homo sapiens
ccccucccaucauuacccuuc

SEQ ID NO: 611926 - RNA, 15 nt, Homo sapiens
ccccuccccagugcc

SEQ ID NO: 611927 - RNA, 21 nt, Homo sapiens
ccccucccucccucuuuccca

SEQ ID NO: 611928 - RNA, 16 nt, Homo sapiens
ccccucccucgugggc

SEQ ID NO: 611929 - RNA, 19 nt, Homo sapiens
ccccuccucucugccgcaa

SEQ ID NO: 611930 - RNA, 16 nt, Homo sapiens
ccccuccuugggcacu

SEQ ID NO: 611931 - RNA, 19 nt, Homo sapiens
ccccucggccccagcacau

SEQ ID NO: 611932 - RNA, 14 nt, Homo sapiens
ccccucuaccuccu

SEQ ID NO: 611933 - RNA, 22 nt, Homo sapiens
ccccucuccugcccaagcacuu

SEQ ID NO: 611934 - RNA, 18 nt, Homo sapiens
ccccucucugcuccagac

SEQ ID NO: 611935 - RNA, 17 nt, Homo sapiens
ccccucuucaaagcaga

SEQ ID NO: 611936 - RNA, 15 nt, Homo sapiens
ccccucuucugcuaa

SEQ ID NO: 611937 - RNA, 14 nt, Homo sapiens
ccccugaaagccau

SEQ ID NO: 611938 - RNA, 22 nt, Homo sapiens
ccccugaaguauuuuuuaaucc

SEQ ID NO: 611939 - RNA, 16 nt, Homo sapiens
ccccugagccacagaa

SEQ ID NO: 611940 - RNA, 14 nt, Homo sapiens
ccccugcacaguug

SEQ ID NO: 611941 - RNA, 18 nt, Homo sapiens
ccccugcuccaccagcag

SEQ ID NO: 611942 - RNA, 17 nt, Homo sapiens
ccccuggacugggaggu

SEQ ID NO: 611943 - RNA, 18 nt, Homo sapiens
ccccuggaucuaccagca

SEQ ID NO: 611944 - RNA, 19 nt, Homo sapiens
ccccuggaucuaccagcau

SEQ ID NO: 611945 - RNA, 15 nt, Homo sapiens
ccccuggcagcacag

SEQ ID NO: 611946 - RNA, 23 nt, Homo sapiens
ccccuggggcuucuccugaccca

SEQ ID NO: 611947 - RNA, 22 nt, Homo sapiens
ccccuguagagugggagcugag

SEQ ID NO: 611948 - RNA, 13 nt, Homo sapiens
ccccugucuggaa

SEQ ID NO: 611949 - RNA, 21 nt, Homo sapiens
ccccuguuguguggacuuuga

SEQ ID NO: 611950 - RNA, 16 nt, Homo sapiens
ccccuugcaagccaua

SEQ ID NO: 611951 - RNA, 20 nt, Homo sapiens
ccccuugguauaacugauuu

SEQ ID NO: 611952 - RNA, 23 nt, Homo sapiens
ccccuuuacuauaagacuauaaa

SEQ ID NO: 611953 - RNA, 12 nt, Homo sapiens
ccccuuugcccu

SEQ ID NO: 611954 - RNA, 13 nt, Homo sapiens
cccgaaaccagag

SEQ ID NO: 611955 - RNA, 17 nt, Homo sapiens
cccgaaacuaagccagg

SEQ ID NO: 611956 - RNA, 16 nt, Homo sapiens
cccgacuccucaaaag

SEQ ID NO: 611957 - RNA, 14 nt, Homo sapiens
cccgacuuccugac

SEQ ID NO: 611958 - RNA, 17 nt, Homo sapiens
cccgagggcgccaugca

SEQ ID NO: 611959 - RNA, 17 nt, Homo sapiens
cccgccgggcaguguca

SEQ ID NO: 611960 - RNA, 18 nt, Homo sapiens
cccgcggccugcaccgac

SEQ ID NO: 611961 - RNA, 15 nt, Homo sapiens
cccgcggugcucugg

SEQ ID NO: 611962 - RNA, 19 nt, Homo sapiens
cccgcguggcauccuguga

SEQ ID NO: 611963 - RNA, 19 nt, Homo sapiens
cccggagguugggugggcc

SEQ ID NO: 611964 - RNA, 18 nt, Homo sapiens
cccggaguaaucaggcag

SEQ ID NO: 611965 - RNA, 23 nt, Homo sapiens
cccgggagguggagguugcagug

SEQ ID NO: 611966 - RNA, 21 nt, Homo sapiens
cccgggccagggcugccccua

SEQ ID NO: 611967 - RNA, 19 nt, Homo sapiens
cccgggcugccugggcugu

SEQ ID NO: 611968 - RNA, 14 nt, Homo sapiens
cccggggagcugca

SEQ ID NO: 611969 - RNA, 17 nt, Homo sapiens
cccggggcccaggacuc

SEQ ID NO: 611970 - RNA, 16 nt, Homo sapiens
cccgggggugaagggg

SEQ ID NO: 611971 - RNA, 21 nt, Homo sapiens
cccgggguggccacaccacag

SEQ ID NO: 611972 - RNA, 19 nt, Homo sapiens
cccggguggggcugcagaa

SEQ ID NO: 611973 - RNA, 22 nt, Homo sapiens
cccguaggcagccucucugcua

SEQ ID NO: 611974 - RNA, 22 nt, Homo sapiens
cccgucucuauaccaaccaaac

SEQ ID NO: 611975 - RNA, 15 nt, Homo sapiens
cccguggcauuucaa

SEQ ID NO: 611976 - RNA, 19 nt, Homo sapiens
cccguggcuuggcaucugu

SEQ ID NO: 611977 - RNA, 22 nt, Homo sapiens
cccgugugaauguagcuuccac

SEQ ID NO: 611978 - RNA, 20 nt, Homo sapiens
cccguguguauuucuaagaa

SEQ ID NO: 611979 - RNA, 23 nt, Homo sapiens
cccguuucauuuagucaugugac

SEQ ID NO: 611980 - RNA, 14 nt, Homo sapiens
cccguuucuugccc

SEQ ID NO: 611981 - RNA, 14 nt, Homo sapiens
cccuaaaccaaaaa

SEQ ID NO: 611982 - RNA, 20 nt, Homo sapiens
cccuaaagacuaacuugaaa

SEQ ID NO: 611983 - RNA, 19 nt, Homo sapiens
cccuaaagcaaaucugcca

SEQ ID NO: 611984 - RNA, 12 nt, Homo sapiens
cccuaaagggag

SEQ ID NO: 611985 - RNA, 18 nt, Homo sapiens
cccuaagcgcacauucau

SEQ ID NO: 611986 - RNA, 19 nt, Homo sapiens
cccuaauuuaugugcuaua

SEQ ID NO: 611987 - RNA, 13 nt, Homo sapiens
cccuacaccaagu

SEQ ID NO: 611988 - RNA, 15 nt, Homo sapiens
cccuacacugugaag

SEQ ID NO: 611989 - RNA, 22 nt, Homo sapiens
cccuacucccugcagaugccac

SEQ ID NO: 611990 - RNA, 16 nt, Homo sapiens
cccuagccaauucaca

SEQ ID NO: 611991 - RNA, 21 nt, Homo sapiens
cccuaggacuuauucccgcug

SEQ ID NO: 611992 - RNA, 14 nt, Homo sapiens
cccuaggagaccaa

SEQ ID NO: 611993 - RNA, 16 nt, Homo sapiens
cccuauccacccagcc

SEQ ID NO: 611994 - RNA, 15 nt, Homo sapiens
cccuaucccagagac

SEQ ID NO: 611995 - RNA, 22 nt, Homo sapiens
cccuaugaaaaauguguuccau

SEQ ID NO: 611996 - RNA, 23 nt, Homo sapiens
cccuaugugggugggaccacaga

SEQ ID NO: 611997 - RNA, 15 nt, Homo sapiens
cccuauuauuugccc

SEQ ID NO: 611998 - RNA, 14 nt, Homo sapiens
cccuauucuaucca

SEQ ID NO: 611999 - RNA, 19 nt, Homo sapiens
cccuauuucuaugucauuu

SEQ ID NO: 612000 - RNA, 15 nt, Homo sapiens
cccuauuuuugcaau

SEQ ID NO: 612001 - RNA, 16 nt, Homo sapiens
cccucaacccuugaga

SEQ ID NO: 612002 - RNA, 21 nt, Homo sapiens
cccucaaucccagcuacucaa

SEQ ID NO: 612003 - RNA, 22 nt, Homo sapiens
cccucacagagacccaccuuca

SEQ ID NO: 612004 - RNA, 12 nt, Homo sapiens
cccucacaggag

SEQ ID NO: 612005 - RNA, 15 nt, Homo sapiens
cccucacccaaaaga

SEQ ID NO: 612006 - RNA, 15 nt, Homo sapiens
cccucacugagccuc

SEQ ID NO: 612007 - RNA, 12 nt, Homo sapiens
cccucacuggcu

SEQ ID NO: 612008 - RNA, 15 nt, Homo sapiens
cccucacuguugaau

SEQ ID NO: 612009 - RNA, 15 nt, Homo sapiens
cccucacuuguccuc

SEQ ID NO: 612010 - RNA, 16 nt, Homo sapiens
cccucagaaccauuua

SEQ ID NO: 612011 - RNA, 19 nt, Homo sapiens
cccucagacaucuccagug

SEQ ID NO: 612012 - RNA, 15 nt, Homo sapiens
cccucagauuccacc

SEQ ID NO: 612013 - RNA, 16 nt, Homo sapiens
cccucagauuccaccu

SEQ ID NO: 612014 - RNA, 16 nt, Homo sapiens
cccucagauuugauga

SEQ ID NO: 612015 - RNA, 11 nt, Homo sapiens
cccucagcacu

SEQ ID NO: 612016 - RNA, 23 nt, Homo sapiens
cccucagucacccccacuuccca

SEQ ID NO: 612017 - RNA, 15 nt, Homo sapiens
cccucauugcugucu

SEQ ID NO: 612018 - RNA, 22 nt, Homo sapiens
cccucauuuaaacccaaucaga

SEQ ID NO: 612019 - RNA, 15 nt, Homo sapiens
cccuccaaaagcacu

SEQ ID NO: 612020 - RNA, 18 nt, Homo sapiens
cccuccaaaccuccagcc

SEQ ID NO: 612021 - RNA, 10 nt, Homo sapiens
cccuccaaag

SEQ ID NO: 612022 - RNA, 15 nt, Homo sapiens
cccuccacaaagcaa

SEQ ID NO: 612023 - RNA, 22 nt, Homo sapiens
cccuccacaaagcaaaggcagu

SEQ ID NO: 612024 - RNA, 16 nt, Homo sapiens
cccuccacaccagugg

SEQ ID NO: 612025 - RNA, 14 nt, Homo sapiens
cccuccaccucuca

SEQ ID NO: 612026 - RNA, 23 nt, Homo sapiens
cccuccacgugauuuccagugag

SEQ ID NO: 612027 - RNA, 17 nt, Homo sapiens
cccucccacacuuccca

SEQ ID NO: 612028 - RNA, 14 nt, Homo sapiens
cccucccagcccau

SEQ ID NO: 612029 - RNA, 22 nt, Homo sapiens
cccucccagcccauugcugcca

SEQ ID NO: 612030 - RNA, 18 nt, Homo sapiens
cccucccagcugcacuuu

SEQ ID NO: 612031 - RNA, 14 nt, Homo sapiens
cccucccagucuca

SEQ ID NO: 612032 - RNA, 21 nt, Homo sapiens
cccucccuguauaagacacuu

SEQ ID NO: 612033 - RNA, 13 nt, Homo sapiens
cccucccuucaca

SEQ ID NO: 612034 - RNA, 14 nt, Homo sapiens
cccuccuacccugc

SEQ ID NO: 612035 - RNA, 23 nt, Homo sapiens
cccuccugcccaggacugcauug

SEQ ID NO: 612036 - RNA, 18 nt, Homo sapiens
cccuccuggagcauccca

SEQ ID NO: 612037 - RNA, 13 nt, Homo sapiens
cccuccugugacu

SEQ ID NO: 612038 - RNA, 18 nt, Homo sapiens
cccuccuuaucaaaggac

SEQ ID NO: 612039 - RNA, 17 nt, Homo sapiens
cccuccuugggcacuuu

SEQ ID NO: 612040 - RNA, 16 nt, Homo sapiens
cccucgacauuuucuc

SEQ ID NO: 612041 - RNA, 12 nt, Homo sapiens
cccucggagccu

SEQ ID NO: 612042 - RNA, 23 nt, Homo sapiens
cccucgugcccaucaagugcagu

SEQ ID NO: 612043 - RNA, 17 nt, Homo sapiens
cccucgugcgcaucuca

SEQ ID NO: 612044 - RNA, 16 nt, Homo sapiens
cccucuaucaugguga

SEQ ID NO: 612045 - RNA, 18 nt, Homo sapiens
cccucuccaacugccuaa

SEQ ID NO: 612046 - RNA, 16 nt, Homo sapiens
ccucagccucugcaac

SEQ ID NO: 612047 - RNA, 18 nt, Homo sapiens
ccucagcugcacauuccu

SEQ ID NO: 612048 - RNA, 18 nt, Homo sapiens
ccucagcugcucccacac

SEQ ID NO: 612049 - RNA, 23 nt, Homo sapiens
ccucaggacaaggccuugcucac

SEQ ID NO: 612050 - RNA, 22 nt, Homo sapiens
ccucaggaccuuuuggucuuca

SEQ ID NO: 612051 - RNA, 14 nt, Homo sapiens
ccucaggcagcuca

SEQ ID NO: 612052 - RNA, 14 nt, Homo sapiens
ccucaggcaggugg

SEQ ID NO: 612053 - RNA, 23 nt, Homo sapiens
ccucagggacagagacaccugca

SEQ ID NO: 612054 - RNA, 18 nt, Homo sapiens
ccucagggagcagggaag

SEQ ID NO: 612055 - RNA, 15 nt, Homo sapiens
ccucagggguuucau

SEQ ID NO: 612056 - RNA, 21 nt, Homo sapiens
ccucaggguggggggugacag

SEQ ID NO: 612057 - RNA, 18 nt, Homo sapiens
ccucagguaguacuggga

SEQ ID NO: 612058 - RNA, 12 nt, Homo sapiens
ccucaggugccu

SEQ ID NO: 612059 - RNA, 15 nt, Homo sapiens
ccucaggugcugucc

SEQ ID NO: 612060 - RNA, 20 nt, Homo sapiens
ccucagguggccccaguuca

SEQ ID NO: 612061 - RNA, 20 nt, Homo sapiens
ccucaggugugccuguugcu

SEQ ID NO: 612062 - RNA, 17 nt, Homo sapiens
ccucaguagucccugca

SEQ ID NO: 612063 - RNA, 13 nt, Homo sapiens
ccucaguauauuu

SEQ ID NO: 612064 - RNA, 16 nt, Homo sapiens
ccucagucccaacucc

SEQ ID NO: 612065 - RNA, 22 nt, Homo sapiens
ccucagucuggcaaugggacuc

SEQ ID NO: 612066 - RNA, 12 nt, Homo sapiens
ccucaguuuccu

SEQ ID NO: 612067 - RNA, 20 nt, Homo sapiens
ccucaguuuccucaucugca

SEQ ID NO: 612068 - RNA, 16 nt, Homo sapiens
ccucauagguaugauu

SEQ ID NO: 612069 - RNA, 12 nt, Homo sapiens
ccucauccuuuc

SEQ ID NO: 612070 - RNA, 16 nt, Homo sapiens
ccucauggauugccac

SEQ ID NO: 612071 - RNA, 14 nt, Homo sapiens
ccucauguucucuu

SEQ ID NO: 612072 - RNA, 21 nt, Homo sapiens
ccucauuccggccacaucauu

SEQ ID NO: 612073 - RNA, 13 nt, Homo sapiens
ccucauuccugaa

SEQ ID NO: 612074 - RNA, 19 nt, Homo sapiens
ccucauuccuucccagaga

SEQ ID NO: 612075 - RNA, 22 nt, Homo sapiens
ccucauucuacuaaugugaugc

SEQ ID NO: 612076 - RNA, 18 nt, Homo sapiens
ccucauuuuuauaaccug

SEQ ID NO: 612077 - RNA, 16 nt, Homo sapiens
ccuccaaaagcacuua

SEQ ID NO: 612078 - RNA, 21 nt, Homo sapiens
ccuccaacaacgacacauuca

SEQ ID NO: 612079 - RNA, 13 nt, Homo sapiens
ccuccaacccugc

SEQ ID NO: 612080 - RNA, 12 nt, Homo sapiens
ccuccaagcaca

SEQ ID NO: 612081 - RNA, 17 nt, Homo sapiens
ccuccaagccuggcacc

SEQ ID NO: 612082 - RNA, 22 nt, Homo sapiens
ccuccaaggaggggcuguaaaa

SEQ ID NO: 612083 - RNA, 17 nt, Homo sapiens
ccuccaccacaucugcc

SEQ ID NO: 612084 - RNA, 18 nt, Homo sapiens
ccuccaccagauguccac

SEQ ID NO: 612085 - RNA, 12 nt, Homo sapiens
ccuccaccagcc

SEQ ID NO: 612086 - RNA, 17 nt, Homo sapiens
ccuccaccuccuaggcu

SEQ ID NO: 612087 - RNA, 13 nt, Homo sapiens
ccuccaccugaua

SEQ ID NO: 612088 - RNA, 13 nt, Homo sapiens
ccuccacgccauu

SEQ ID NO: 612089 - RNA, 19 nt, Homo sapiens
ccuccacuccagcucugag

SEQ ID NO: 612090 - RNA, 12 nt, Homo sapiens
ccuccacugacu

SEQ ID NO: 612091 - RNA, 13 nt, Homo sapiens
ccuccacuuggaa

SEQ ID NO: 612092 - RNA, 12 nt, Homo sapiens
ccuccacuuugc

SEQ ID NO: 612093 - RNA, 16 nt, Homo sapiens
ccuccagaagcugcuc

SEQ ID NO: 612094 - RNA, 22 nt, Homo sapiens
ccuccagcccgggagccuagga

SEQ ID NO: 612095 - RNA, 16 nt, Homo sapiens
ccuccagcuucuggua

SEQ ID NO: 612096 - RNA, 18 nt, Homo sapiens
ccuccaggggucuugggu

SEQ ID NO: 612097 - RNA, 18 nt, Homo sapiens
ccuccagggugauuuuau

SEQ ID NO: 612098 - RNA, 18 nt, Homo sapiens
ccuccaggguggcagcaa

SEQ ID NO: 612099 - RNA, 20 nt, Homo sapiens
ccuccaggguggcagcaaca

SEQ ID NO: 612100 - RNA, 20 nt, Homo sapiens
ccuccaugaacaucauggac

SEQ ID NO: 612101 - RNA, 21 nt, Homo sapiens
ccuccaugugggugcuaggga

SEQ ID NO: 612102 - RNA, 13 nt, Homo sapiens
ccuccauugcaca

SEQ ID NO: 612103 - RNA, 12 nt, Homo sapiens
ccuccauuugca

SEQ ID NO: 612104 - RNA, 20 nt, Homo sapiens
ccucccaaagugcuaguauu

SEQ ID NO: 612105 - RNA, 20 nt, Homo sapiens
ccucccaaagugcugggauu

SEQ ID NO: 612106 - RNA, 21 nt, Homo sapiens
ccucccaaagugcugggauua

SEQ ID NO: 612107 - RNA, 14 nt, Homo sapiens
ccucccaccagagc

SEQ ID NO: 612108 - RNA, 20 nt, Homo sapiens
ccucccagaaaaacuggcuc

SEQ ID NO: 612109 - RNA, 20 nt, Homo sapiens
ccucccagaguauugggauu

SEQ ID NO: 612110 - RNA, 22 nt, Homo sapiens
ccucccagauggcuucggaggg

SEQ ID NO: 612111 - RNA, 17 nt, Homo sapiens
ccucccagcugcacuuu

SEQ ID NO: 612112 - RNA, 22 nt, Homo sapiens
ccucccaggaacugggccaacu

SEQ ID NO: 612113 - RNA, 14 nt, Homo sapiens
ccucccaggcucaa

SEQ ID NO: 612114 - RNA, 15 nt, Homo sapiens
ccuccccaccuguag

SEQ ID NO: 612115 - RNA, 22 nt, Homo sapiens
ccuccccagggaagacccugac

SEQ ID NO: 612116 - RNA, 17 nt, Homo sapiens
ccuccccagugccucuc

SEQ ID NO: 612117 - RNA, 18 nt, Homo sapiens
ccuccccaguucuacuga

SEQ ID NO: 612118 - RNA, 16 nt, Homo sapiens
ccuccccaugggcaca

SEQ ID NO: 612119 - RNA, 16 nt, Homo sapiens
ccucccccaguguccc

SEQ ID NO: 612120 - RNA, 15 nt, Homo sapiens
ccucccccaugggcu

SEQ ID NO: 612121 - RNA, 22 nt, Homo sapiens
ccuccccuuuucuauguugcua

SEQ ID NO: 612122 - RNA, 15 nt, Homo sapiens
ccucccggguucaca

SEQ ID NO: 612123 - RNA, 15 nt, Homo sapiens
ccucccucaccaaca

SEQ ID NO: 612124 - RNA, 15 nt, Homo sapiens
ccucccucacuugug

SEQ ID NO: 612125 - RNA, 19 nt, Homo sapiens
ccucccuccacuccucuca

SEQ ID NO: 612126 - RNA, 15 nt, Homo sapiens
ccucccucccagcgc

SEQ ID NO: 612127 - RNA, 18 nt, Homo sapiens
ccucccuggcucccauga

SEQ ID NO: 612128 - RNA, 15 nt, Homo sapiens
ccucccuggucccuu

SEQ ID NO: 612129 - RNA, 17 nt, Homo sapiens
ccucccuuggguucuga

SEQ ID NO: 612130 - RNA, 16 nt, Homo sapiens
ccuccgaccacuucca

SEQ ID NO: 612131 - RNA, 14 nt, Homo sapiens
ccuccgaccucucu

SEQ ID NO: 612132 - RNA, 15 nt, Homo sapiens
ccuccgcccugccac

SEQ ID NO: 612133 - RNA, 20 nt, Homo sapiens
ccuccgccuuccggguucaa

SEQ ID NO: 612134 - RNA, 20 nt, Homo sapiens
ccuccuacccuuccagugcc

SEQ ID NO: 612135 - RNA, 12 nt, Homo sapiens
ccuccuaccuuu

SEQ ID NO: 612136 - RNA, 21 nt, Homo sapiens
ccuccuagaggugggcagcug

SEQ ID NO: 612137 - RNA, 21 nt, Homo sapiens
ccuccuagcucucccagugaa

SEQ ID NO: 612138 - RNA, 21 nt, Homo sapiens
ccuccucagcgagaggcagca

SEQ ID NO: 612139 - RNA, 12 nt, Homo sapiens
ccuccucagggg

SEQ ID NO: 612140 - RNA, 16 nt, Homo sapiens
ccuccucaucagugug

SEQ ID NO: 612141 - RNA, 16 nt, Homo sapiens
ccuccuccaucaccug

SEQ ID NO: 612142 - RNA, 14 nt, Homo sapiens
ccuccucuagcugu

SEQ ID NO: 612143 - RNA, 19 nt, Homo sapiens
ccuccucuucugacgugcc

SEQ ID NO: 612144 - RNA, 15 nt, Homo sapiens
ccuccugaaagccug

SEQ ID NO: 612145 - RNA, 19 nt, Homo sapiens
ccuccugaaccgcacagcu

SEQ ID NO: 612146 - RNA, 15 nt, Homo sapiens
ccuccugauggccaa

SEQ ID NO: 612147 - RNA, 19 nt, Homo sapiens
ccuccugcccuccaucuca

SEQ ID NO: 612148 - RNA, 13 nt, Homo sapiens
ccuccugcugcag

SEQ ID NO: 612149 - RNA, 22 nt, Homo sapiens
ccuccugggaacacaucuggcu

SEQ ID NO: 612150 - RNA, 14 nt, Homo sapiens
ccuccuggguucaa

SEQ ID NO: 612151 - RNA, 21 nt, Homo sapiens
ccuccugucaguggagcaguu

SEQ ID NO: 612152 - RNA, 18 nt, Homo sapiens
ccuccugucuaauuugca

SEQ ID NO: 612153 - RNA, 19 nt, Homo sapiens
ccuccugucuaauuugcac

SEQ ID NO: 612154 - RNA, 17 nt, Homo sapiens
ccuccuugccuugggac

SEQ ID NO: 612155 - RNA, 14 nt, Homo sapiens
ccuccuugugccuu

SEQ ID NO: 612156 - RNA, 14 nt, Homo sapiens
ccuccuuuucccaa

SEQ ID NO: 612157 - RNA, 14 nt, Homo sapiens
ccucgaaaaccauc

SEQ ID NO: 612158 - RNA, 16 nt, Homo sapiens
ccucgcacacagggcu

SEQ ID NO: 612159 - RNA, 13 nt, Homo sapiens
ccucgcaugacug

SEQ ID NO: 612160 - RNA, 14 nt, Homo sapiens
ccucgcaugacugu

SEQ ID NO: 612161 - RNA, 23 nt, Homo sapiens
ccucgcaugucucccuccagucc

SEQ ID NO: 612162 - RNA, 16 nt, Homo sapiens
ccucgcccuccacaaa

SEQ ID NO: 612163 - RNA, 18 nt, Homo sapiens
ccucgcgacaucuucuca

SEQ ID NO: 612164 - RNA, 19 nt, Homo sapiens
ccucgcugccagaugauug

SEQ ID NO: 612165 - RNA, 15 nt, Homo sapiens
ccucgcuggacucuc

SEQ ID NO: 612166 - RNA, 13 nt, Homo sapiens
ccucggcacacac

SEQ ID NO: 612167 - RNA, 18 nt, Homo sapiens
ccucggccucccaaagug

SEQ ID NO: 612168 - RNA, 19 nt, Homo sapiens
ccucggccucccaaagugc

SEQ ID NO: 612169 - RNA, 17 nt, Homo sapiens
ccuguuugucuacauau

SEQ ID NO: 612170 - RNA, 20 nt, Homo sapiens
ccuguuuguggaacaaaagu

SEQ ID NO: 612171 - RNA, 13 nt, Homo sapiens
ccuguuuucacuc

SEQ ID NO: 612172 - RNA, 18 nt, Homo sapiens
ccuguuuucgcaccuacc

SEQ ID NO: 612173 - RNA, 17 nt, Homo sapiens
ccuguuuucucccucuc

SEQ ID NO: 612174 - RNA, 15 nt, Homo sapiens
ccuguuuuuuugcuu

SEQ ID NO: 612175 - RNA, 15 nt, Homo sapiens
ccuuaaaacaauucu

SEQ ID NO: 612176 - RNA, 17 nt, Homo sapiens
ccuuaaagaaaauugca

SEQ ID NO: 612177 - RNA, 20 nt, Homo sapiens
ccuuaaauuaaacaauuuau

SEQ ID NO: 612178 - RNA, 15 nt, Homo sapiens
ccuuaacgcuagaga

SEQ ID NO: 612179 - RNA, 21 nt, Homo sapiens
ccuuaagaauuuuugaaguga

SEQ ID NO: 612180 - RNA, 22 nt, Homo sapiens
ccuuaagcaaauuuuguauuau

SEQ ID NO: 612181 - RNA, 21 nt, Homo sapiens
ccuuaagcagaacaaaugugu

SEQ ID NO: 612182 - RNA, 21 nt, Homo sapiens
ccuuaagccaauauuuacuca

SEQ ID NO: 612183 - RNA, 17 nt, Homo sapiens
ccuuaaggucuccaaac

SEQ ID NO: 612184 - RNA, 15 nt, Homo sapiens
ccuuaauaaauaugu

SEQ ID NO: 612185 - RNA, 19 nt, Homo sapiens
ccuuaauuauuaacaaagu

SEQ ID NO: 612186 - RNA, 18 nt, Homo sapiens
ccuuaauuuccuuuuuga

SEQ ID NO: 612187 - RNA, 20 nt, Homo sapiens
ccuuacaacucggggacaaa

SEQ ID NO: 612188 - RNA, 14 nt, Homo sapiens
ccuuacacugaaaa

SEQ ID NO: 612189 - RNA, 20 nt, Homo sapiens
ccuuacagaacuacuucuua

SEQ ID NO: 612190 - RNA, 21 nt, Homo sapiens
ccuuacaguaaaguauagaaa

SEQ ID NO: 612191 - RNA, 14 nt, Homo sapiens
ccuuacaucuggcu

SEQ ID NO: 612192 - RNA, 14 nt, Homo sapiens
ccuuaccgcucugu

SEQ ID NO: 612193 - RNA, 15 nt, Homo sapiens
ccuuaccucuggaac

SEQ ID NO: 612194 - RNA, 22 nt, Homo sapiens
ccuuacgcuuugucacacaaaa

SEQ ID NO: 612195 - RNA, 23 nt, Homo sapiens
ccuuagaaauguaaacugccaua

SEQ ID NO: 612196 - RNA, 15 nt, Homo sapiens
ccuuaggaaaaacau

SEQ ID NO: 612197 - RNA, 23 nt, Homo sapiens
ccuuaggucgcgcucuugcacac

SEQ ID NO: 612198 - RNA, 15 nt, Homo sapiens
ccuuagucucaaggg

SEQ ID NO: 612199 - RNA, 22 nt, Homo sapiens
ccuuaguuacccugaucuggac

SEQ ID NO: 612200 - RNA, 19 nt, Homo sapiens
ccuuaucaagugucuucca

SEQ ID NO: 612201 - RNA, 19 nt, Homo sapiens
ccuuaugauuaaacuuccu

SEQ ID NO: 612202 - RNA, 15 nt, Homo sapiens
ccuuauuaguuacaa

SEQ ID NO: 612203 - RNA, 20 nt, Homo sapiens
ccuuauuuuuguaugccuuu

SEQ ID NO: 612204 - RNA, 23 nt, Homo sapiens
ccuucaagggcaaggagaggcca

SEQ ID NO: 612205 - RNA, 18 nt, Homo sapiens
ccuucaagguggcagcug

SEQ ID NO: 612206 - RNA, 19 nt, Homo sapiens
ccuucaaguuagcucagga

SEQ ID NO: 612207 - RNA, 20 nt, Homo sapiens
ccuucacaaagcccaaggga

SEQ ID NO: 612208 - RNA, 16 nt, Homo sapiens
ccuucacaaucuguca

SEQ ID NO: 612209 - RNA, 20 nt, Homo sapiens
ccuucacagggguacagaaa

SEQ ID NO: 612210 - RNA, 22 nt, Homo sapiens
ccuucacuuccaucacaagaaa

SEQ ID NO: 612211 - RNA, 21 nt, Homo sapiens
ccuucacuuuucugaguucuu

SEQ ID NO: 612212 - RNA, 13 nt, Homo sapiens
ccuucagaagcua

SEQ ID NO: 612213 - RNA, 16 nt, Homo sapiens
ccuucagaaugcuccu

SEQ ID NO: 612214 - RNA, 16 nt, Homo sapiens
ccuucagacacccuca

SEQ ID NO: 612215 - RNA, 15 nt, Homo sapiens
ccuucagcaccugac

SEQ ID NO: 612216 - RNA, 21 nt, Homo sapiens
ccuucagcaugccugaacuac

SEQ ID NO: 612217 - RNA, 12 nt, Homo sapiens
ccuucagccuua

SEQ ID NO: 612218 - RNA, 17 nt, Homo sapiens
ccuucagcuccagggaa

SEQ ID NO: 612219 - RNA, 18 nt, Homo sapiens
ccuucagucuuaauacuu

SEQ ID NO: 612220 - RNA, 16 nt, Homo sapiens
ccuucaucugggacaa

SEQ ID NO: 612221 - RNA, 17 nt, Homo sapiens
ccuucaugaucaucaca

SEQ ID NO: 612222 - RNA, 22 nt, Homo sapiens
ccuucaugaucaucacaaucau

SEQ ID NO: 612223 - RNA, 23 nt, Homo sapiens
ccuucaugcuuuuuucccagaau

SEQ ID NO: 612224 - RNA, 20 nt, Homo sapiens
ccuucauuaaugaugaucuu

SEQ ID NO: 612225 - RNA, 19 nt, Homo sapiens
ccuucauuuuuaagacugu

SEQ ID NO: 612226 - RNA, 14 nt, Homo sapiens
ccuuccacauguac

SEQ ID NO: 612227 - RNA, 13 nt, Homo sapiens
ccuuccaccucag

SEQ ID NO: 612228 - RNA, 17 nt, Homo sapiens
ccuuccagcuccuguaa

SEQ ID NO: 612229 - RNA, 14 nt, Homo sapiens
ccuuccagcugcug

SEQ ID NO: 612230 - RNA, 22 nt, Homo sapiens
ccuucccagcaguuugcugcca

SEQ ID NO: 612231 - RNA, 14 nt, Homo sapiens
ccuuccccauuucc

SEQ ID NO: 612232 - RNA, 15 nt, Homo sapiens
ccuucccccugcaaa

SEQ ID NO: 612233 - RNA, 17 nt, Homo sapiens
ccuucccccugcaaaaa

SEQ ID NO: 612234 - RNA, 15 nt, Homo sapiens
ccuucccgggcugca

SEQ ID NO: 612235 - RNA, 18 nt, Homo sapiens
ccuucccucucaugacuu

SEQ ID NO: 612236 - RNA, 20 nt, Homo sapiens
ccuucccuugccacuuugca

SEQ ID NO: 612237 - RNA, 14 nt, Homo sapiens
ccuuccucacuucc

SEQ ID NO: 612238 - RNA, 23 nt, Homo sapiens
ccuuccucgguggcucuggggua

SEQ ID NO: 612239 - RNA, 14 nt, Homo sapiens
ccuuccuggccuga

SEQ ID NO: 612240 - RNA, 19 nt, Homo sapiens
ccuuccugucccaccucuu

SEQ ID NO: 612241 - RNA, 22 nt, Homo sapiens
ccuuccuguccugccuccucau

SEQ ID NO: 612242 - RNA, 16 nt, Homo sapiens
ccuuccuuaugucucc

SEQ ID NO: 612243 - RNA, 13 nt, Homo sapiens
ccuuccuugccua

SEQ ID NO: 612244 - RNA, 15 nt, Homo sapiens
ccuucgaaaggccuu

SEQ ID NO: 612245 - RNA, 20 nt, Homo sapiens
ccuucggagccaacaagacc

SEQ ID NO: 612246 - RNA, 15 nt, Homo sapiens
ccuucuacauuugag

SEQ ID NO: 612247 - RNA, 15 nt, Homo sapiens
ccuucuaccuugaau

SEQ ID NO: 612248 - RNA, 18 nt, Homo sapiens
ccuucuccacacccacuu

SEQ ID NO: 612249 - RNA, 16 nt, Homo sapiens
ccuucucucacugugu

SEQ ID NO: 612250 - RNA, 20 nt, Homo sapiens
ccuucucugcuccaccacau

SEQ ID NO: 612251 - RNA, 17 nt, Homo sapiens
ccuucucuuaguuauug

SEQ ID NO: 612252 - RNA, 22 nt, Homo sapiens
ccuucucuuccuucacuuugca

SEQ ID NO: 612253 - RNA, 18 nt, Homo sapiens
ccuucucuucucuuugcu

SEQ ID NO: 612254 - RNA, 19 nt, Homo sapiens
ccuucucuuuaaugccuag

SEQ ID NO: 612255 - RNA, 16 nt, Homo sapiens
ccuucugccaacgccu

SEQ ID NO: 612256 - RNA, 20 nt, Homo sapiens
ccuucuggccucugcugaau

SEQ ID NO: 612257 - RNA, 21 nt, Homo sapiens
ccuucuucccucggggagcca

SEQ ID NO: 612258 - RNA, 13 nt, Homo sapiens
ccuucuucugcca

SEQ ID NO: 612259 - RNA, 15 nt, Homo sapiens
ccuugaaacaguucc

SEQ ID NO: 612260 - RNA, 15 nt, Homo sapiens
ccuugaaaguaggau

SEQ ID NO: 612261 - RNA, 19 nt, Homo sapiens
ccuugaagaaaaugacuuu

SEQ ID NO: 612262 - RNA, 13 nt, Homo sapiens
ccuugaagcaaua

SEQ ID NO: 612263 - RNA, 19 nt, Homo sapiens
ccuugaaggucacucuucc

SEQ ID NO: 612264 - RNA, 20 nt, Homo sapiens
ccuugaauccagaacacaac

SEQ ID NO: 612265 - RNA, 14 nt, Homo sapiens
ccuugaccaagaag

SEQ ID NO: 612266 - RNA, 22 nt, Homo sapiens
ccuugacguuucuucuuucuag

SEQ ID NO: 612267 - RNA, 17 nt, Homo sapiens
ccuugagagacccagcu

SEQ ID NO: 612268 - RNA, 17 nt, Homo sapiens
ccuugagggugggccag

SEQ ID NO: 612269 - RNA, 17 nt, Homo sapiens
ccuugagucagaaaaca

SEQ ID NO: 612270 - RNA, 14 nt, Homo sapiens
ccuugagucuguca

SEQ ID NO: 612271 - RNA, 22 nt, Homo sapiens
ccuugauauaaaaaaucuuuag

SEQ ID NO: 612272 - RNA, 17 nt, Homo sapiens
ccuugaucgacuucuug

SEQ ID NO: 612273 - RNA, 13 nt, Homo sapiens
ccuugaugcacag

SEQ ID NO: 612274 - RNA, 22 nt, Homo sapiens
ccuugauggagauauuuacaug

SEQ ID NO: 612275 - RNA, 13 nt, Homo sapiens
ccuugcaagccau

SEQ ID NO: 612276 - RNA, 15 nt, Homo sapiens
ccuugcaagccauaa

SEQ ID NO: 612277 - RNA, 12 nt, Homo sapiens
ccuugcacacag

SEQ ID NO: 612278 - RNA, 13 nt, Homo sapiens
ccuugcacaccca

SEQ ID NO: 612279 - RNA, 13 nt, Homo sapiens
ccuugcaccugca

SEQ ID NO: 612280 - RNA, 13 nt, Homo sapiens
ccuugcagauauc

SEQ ID NO: 612281 - RNA, 22 nt, Homo sapiens
ccuugcaggagugacucaagaa

SEQ ID NO: 612282 - RNA, 23 nt, Homo sapiens
ccuugcaguuuuacuaaaacacu

SEQ ID NO: 612283 - RNA, 20 nt, Homo sapiens
ccuugcaucaagggcuuuau

SEQ ID NO: 612284 - RNA, 15 nt, Homo sapiens
ccuugccagacaugu

SEQ ID NO: 612285 - RNA, 13 nt, Homo sapiens
ccuugcccagaga

SEQ ID NO: 612286 - RNA, 16 nt, Homo sapiens
ccuugcccaucagcca

SEQ ID NO: 612287 - RNA, 15 nt, Homo sapiens
ccuugcccucaagca

SEQ ID NO: 612288 - RNA, 18 nt, Homo sapiens
ccuugcccugaccuccca

SEQ ID NO: 612289 - RNA, 16 nt, Homo sapiens
ccuugcccuuggagcu

SEQ ID NO: 612290 - RNA, 12 nt, Homo sapiens
ccuugccuuaau

SEQ ID NO: 612291 - RNA, 17 nt, Homo sapiens
cgucuccggaauccuug

SEQ ID NO: 612292 - RNA, 20 nt, Homo sapiens
cgucucucccucccuugcca

SEQ ID NO: 612293 - RNA, 14 nt, Homo sapiens
cgucugacucuggg

SEQ ID NO: 612294 - RNA, 12 nt, Homo sapiens
cgucugugacau

SEQ ID NO: 612295 - RNA, 22 nt, Homo sapiens
cgucuucacuuccccacaggcu

SEQ ID NO: 612296 - RNA, 12 nt, Homo sapiens
cgucuuuaguuu

SEQ ID NO: 612297 - RNA, 16 nt, Homo sapiens
cgugaaagcagaugag

SEQ ID NO: 612298 - RNA, 14 nt, Homo sapiens
cgugacaacacaaa

SEQ ID NO: 612299 - RNA, 18 nt, Homo sapiens
cgugagagaaucugccug

SEQ ID NO: 612300 - RNA, 17 nt, Homo sapiens
cgugagcagcuuuggaa

SEQ ID NO: 612301 - RNA, 21 nt, Homo sapiens
cgugagcuccggaauagaugu

SEQ ID NO: 612302 - RNA, 20 nt, Homo sapiens
cgugagggggggguggguga

SEQ ID NO: 612303 - RNA, 23 nt, Homo sapiens
cgugagugugugagcgcuucugc

SEQ ID NO: 612304 - RNA, 13 nt, Homo sapiens
cgugauaaugcag

SEQ ID NO: 612305 - RNA, 17 nt, Homo sapiens
cgugaucacugagccau

SEQ ID NO: 612306 - RNA, 19 nt, Homo sapiens
cgugauuuggcugcacuug

SEQ ID NO: 612307 - RNA, 21 nt, Homo sapiens
cgugcaaacaaccugaaucuu

SEQ ID NO: 612308 - RNA, 12 nt, Homo sapiens
cgugcacucugc

SEQ ID NO: 612309 - RNA, 17 nt, Homo sapiens
cgugcaggacagcucuu

SEQ ID NO: 612310 - RNA, 13 nt, Homo sapiens
cgugcaugugcac

SEQ ID NO: 612311 - RNA, 20 nt, Homo sapiens
cgugcccaucaagugcaguc

SEQ ID NO: 612312 - RNA, 13 nt, Homo sapiens
cgugcccggccaa

SEQ ID NO: 612313 - RNA, 19 nt, Homo sapiens
cgugccugaucugcacauu

SEQ ID NO: 612314 - RNA, 22 nt, Homo sapiens
cgugcucugugggucuccccca

SEQ ID NO: 612315 - RNA, 22 nt, Homo sapiens
cgugcugcucaaggaccaagag

SEQ ID NO: 612316 - RNA, 16 nt, Homo sapiens
cguggaaagggugcug

SEQ ID NO: 612317 - RNA, 20 nt, Homo sapiens
cguggaauucaccuguguuu

SEQ ID NO: 612318 - RNA, 19 nt, Homo sapiens
cguggagagggacuggcag

SEQ ID NO: 612319 - RNA, 14 nt, Homo sapiens
cguggagagugcac

SEQ ID NO: 612320 - RNA, 21 nt, Homo sapiens
cguggcaaaaugaacacaucu

SEQ ID NO: 612321 - RNA, 19 nt, Homo sapiens
cgugguagugcaagcugaa

SEQ ID NO: 612322 - RNA, 19 nt, Homo sapiens
cgugguaugaaaugucuga

SEQ ID NO: 612323 - RNA, 18 nt, Homo sapiens
cguggugaccuuucacga

SEQ ID NO: 612324 - RNA, 20 nt, Homo sapiens
cgugguuacucacaccugua

SEQ ID NO: 612325 - RNA, 19 nt, Homo sapiens
cgugguuuuuacauucaau

SEQ ID NO: 612326 - RNA, 17 nt, Homo sapiens
cguguauaguaucugua

SEQ ID NO: 612327 - RNA, 15 nt, Homo sapiens
cgugugacuacuccc

SEQ ID NO: 612328 - RNA, 17 nt, Homo sapiens
cgugugcacaugcgcac

SEQ ID NO: 612329 - RNA, 23 nt, Homo sapiens
cguguguauguguauguguguga

SEQ ID NO: 612330 - RNA, 22 nt, Homo sapiens
cguguguauuagaaugcaugua

SEQ ID NO: 612331 - RNA, 14 nt, Homo sapiens
cgugugucugucag

SEQ ID NO: 612332 - RNA, 21 nt, Homo sapiens
cguguuuuuuuccuucaccga

SEQ ID NO: 612333 - RNA, 21 nt, Homo sapiens
cguuacuaaaaguacauuaaa

SEQ ID NO: 612334 - RNA, 13 nt, Homo sapiens
cguuaucauggag

SEQ ID NO: 612335 - RNA, 20 nt, Homo sapiens
cguuaucauggagaacagca

SEQ ID NO: 612336 - RNA, 14 nt, Homo sapiens
cguuaugugcagua

SEQ ID NO: 612337 - RNA, 13 nt, Homo sapiens
cguucacucccaa

SEQ ID NO: 612338 - RNA, 15 nt, Homo sapiens
cguucaucaccugcu

SEQ ID NO: 612339 - RNA, 14 nt, Homo sapiens
cguucgcauggcag

SEQ ID NO: 612340 - RNA, 18 nt, Homo sapiens
cguugaauugaugaugca

SEQ ID NO: 612341 - RNA, 17 nt, Homo sapiens
cguugcccccagacuuc

SEQ ID NO: 612342 - RNA, 22 nt, Homo sapiens
cguuggucuugaacuccugacc

SEQ ID NO: 612343 - RNA, 12 nt, Homo sapiens
cguuucuacuaa

SEQ ID NO: 612344 - RNA, 22 nt, Homo sapiens
cguuucuccaccuagacuguaa

SEQ ID NO: 612345 - RNA, 16 nt, Homo sapiens
cguuucugguggucug

SEQ ID NO: 612346 - RNA, 22 nt, Homo sapiens
cguuuguccuuuuucacuuuga

SEQ ID NO: 612347 - RNA, 15 nt, Homo sapiens
cguuuguugugauau

SEQ ID NO: 612348 - RNA, 15 nt, Homo sapiens
cguuuugguuuucaa

SEQ ID NO: 612349 - RNA, 13 nt, Homo sapiens
cguuuuguacugu

SEQ ID NO: 612350 - RNA, 13 nt, Homo sapiens
cguuuuugcaaua

SEQ ID NO: 612351 - RNA, 21 nt, Homo sapiens
cuaaaaaaaaugcauauuaau

SEQ ID NO: 612352 - RNA, 14 nt, Homo sapiens
cuaaaaaacagagg

SEQ ID NO: 612353 - RNA, 18 nt, Homo sapiens
cuaaaaaacagaggccau

SEQ ID NO: 612354 - RNA, 14 nt, Homo sapiens
cuaaaaacuuagaa

SEQ ID NO: 612355 - RNA, 22 nt, Homo sapiens
cuaaaaaggucuguuaauguca

SEQ ID NO: 612356 - RNA, 15 nt, Homo sapiens
cuaaaaaucugagaa

SEQ ID NO: 612357 - RNA, 12 nt, Homo sapiens
cuaaaacauucc

SEQ ID NO: 612358 - RNA, 12 nt, Homo sapiens
cuaaaacugcuc

SEQ ID NO: 612359 - RNA, 18 nt, Homo sapiens
cuaaaagaaaaaggaacu

SEQ ID NO: 612360 - RNA, 18 nt, Homo sapiens
cuaaaagcacacucaucc

SEQ ID NO: 612361 - RNA, 20 nt, Homo sapiens
cuaaaaucccuggaucacga

SEQ ID NO: 612362 - RNA, 19 nt, Homo sapiens
cuaaaaucuaaaauuucau

SEQ ID NO: 612363 - RNA, 22 nt, Homo sapiens
cuaaaaugacaagccuucuuaa

SEQ ID NO: 612364 - RNA, 23 nt, Homo sapiens
cuaaaaugacaagccuucuuaaa

SEQ ID NO: 612365 - RNA, 22 nt, Homo sapiens
cuaaaaugauuuuaucugugaa

SEQ ID NO: 612366 - RNA, 23 nt, Homo sapiens
cuaaaaugauuuuaucugugaau

SEQ ID NO: 612367 - RNA, 15 nt, Homo sapiens
cuaaaauuagaugaa

SEQ ID NO: 612368 - RNA, 19 nt, Homo sapiens
cuaaaauuagaugaacuca

SEQ ID NO: 612369 - RNA, 21 nt, Homo sapiens
cuaaaauugcuucuuuaccaa

SEQ ID NO: 612370 - RNA, 14 nt, Homo sapiens
cuaaacagauauaa

SEQ ID NO: 612371 - RNA, 16 nt, Homo sapiens
cuaaacagauguaaug

SEQ ID NO: 612372 - RNA, 18 nt, Homo sapiens
cuaaacuccaggauuuau

SEQ ID NO: 612373 - RNA, 20 nt, Homo sapiens
cuaaacuccaggggggacaa

SEQ ID NO: 612374 - RNA, 14 nt, Homo sapiens
cuaaacucucauuu

SEQ ID NO: 612375 - RNA, 10 nt, Homo sapiens
cuaaacugua

SEQ ID NO: 612376 - RNA, 17 nt, Homo sapiens
cuaaacuuuccaaaacc

SEQ ID NO: 612377 - RNA, 18 nt, Homo sapiens
cuaaagaagauaaacaca

SEQ ID NO: 612378 - RNA, 24 nt, Homo sapiens
cuaaagaaucuaauucuguugauu

SEQ ID NO: 612379 - RNA, 21 nt, Homo sapiens
cuaaagaauguguucuaaaac

SEQ ID NO: 612380 - RNA, 15 nt, Homo sapiens
cuaaagagcccuugc

SEQ ID NO: 612381 - RNA, 21 nt, Homo sapiens
cuaaagagcugcacagcaaaa

SEQ ID NO: 612382 - RNA, 23 nt, Homo sapiens
cuaaagaguuauucaaaugaagg

SEQ ID NO: 612383 - RNA, 19 nt, Homo sapiens
cuaaagccucaaaacaaag

SEQ ID NO: 612384 - RNA, 18 nt, Homo sapiens
cuaaagcuauguuacaug

SEQ ID NO: 612385 - RNA, 20 nt, Homo sapiens
cuaaaggauccagagagcag

SEQ ID NO: 612386 - RNA, 18 nt, Homo sapiens
cuaaagggagaaaugcca

SEQ ID NO: 612387 - RNA, 14 nt, Homo sapiens
cuaaaggugcacug

SEQ ID NO: 612388 - RNA, 21 nt, Homo sapiens
cuaaagguggugaggcaauaa

SEQ ID NO: 612389 - RNA, 16 nt, Homo sapiens
cuaaagguguuuugua

SEQ ID NO: 612390 - RNA, 14 nt, Homo sapiens
cuaaaguaguuuaa

SEQ ID NO: 612391 - RNA, 19 nt, Homo sapiens
cuaaaguccagacuaugga

SEQ ID NO: 612392 - RNA, 21 nt, Homo sapiens
cuaaaguguauuuuuuuacua

SEQ ID NO: 612393 - RNA, 12 nt, Homo sapiens
cuaaaguuuuag

SEQ ID NO: 612394 - RNA, 20 nt, Homo sapiens
cuaaauaaaaaaaugaauau

SEQ ID NO: 612395 - RNA, 21 nt, Homo sapiens
cuaaauaaugaauaaacugaa

SEQ ID NO: 612396 - RNA, 21 nt, Homo sapiens
cuaaauaauguuaucugugua

SEQ ID NO: 612397 - RNA, 18 nt, Homo sapiens
cuaaauaugugacugaca

SEQ ID NO: 612398 - RNA, 14 nt, Homo sapiens
cuaaauauuuccau

SEQ ID NO: 612399 - RNA, 14 nt, Homo sapiens
cuaaaucaaaccag

SEQ ID NO: 612400 - RNA, 18 nt, Homo sapiens
cuaaaucugccuuuucau

SEQ ID NO: 612401 - RNA, 17 nt, Homo sapiens
cuaaaucuucagcauag

SEQ ID NO: 612402 - RNA, 16 nt, Homo sapiens
cuaaaugaacuaauga

SEQ ID NO: 612403 - RNA, 18 nt, Homo sapiens
cuaaaugaauguuuacac

SEQ ID NO: 612404 - RNA, 18 nt, Homo sapiens
cuaaaugccccauauuaa

SEQ ID NO: 612405 - RNA, 11 nt, Homo sapiens
cuaaaugccuu

SEQ ID NO: 612406 - RNA, 22 nt, Homo sapiens
cuaaaugugaaugaugauccua

SEQ ID NO: 612407 - RNA, 20 nt, Homo sapiens
cuaaauuacagugcaguuua

SEQ ID NO: 612408 - RNA, 17 nt, Homo sapiens
cuaaauuauaucuguga

SEQ ID NO: 612409 - RNA, 22 nt, Homo sapiens
cuaaauuuaagcuuaagccaua

SEQ ID NO: 612410 - RNA, 17 nt, Homo sapiens
cuaaauuuaaugcugcc

SEQ ID NO: 612411 - RNA, 20 nt, Homo sapiens
cuaaauuuucugaaacugca

SEQ ID NO: 612412 - RNA, 20 nt, Homo sapiens
cugaauguauugaacuugga

SEQ ID NO: 612413 - RNA, 18 nt, Homo sapiens
cugaaugucccaacccag

SEQ ID NO: 612414 - RNA, 21 nt, Homo sapiens
cugaauguuuaaagaucauga

SEQ ID NO: 612415 - RNA, 17 nt, Homo sapiens
cugaauuaugauggucu

SEQ ID NO: 612416 - RNA, 22 nt, Homo sapiens
cugaauuaugauggucugcauu

SEQ ID NO: 612417 - RNA, 16 nt, Homo sapiens
cugaauuaugcuucca

SEQ ID NO: 612418 - RNA, 20 nt, Homo sapiens
cugaauuccagcaaaagagc

SEQ ID NO: 612419 - RNA, 11 nt, Homo sapiens
cugaauucugg

SEQ ID NO: 612420 - RNA, 14 nt, Homo sapiens
cugaauucuggaau

SEQ ID NO: 612421 - RNA, 14 nt, Homo sapiens
cugaauuggcagga

SEQ ID NO: 612422 - RNA, 20 nt, Homo sapiens
cugaauuuggccugcacuaa

SEQ ID NO: 612423 - RNA, 22 nt, Homo sapiens
cugaauuuguaagcaacuugcu

SEQ ID NO: 612424 - RNA, 20 nt, Homo sapiens
cugaauuuuaaauguucaca

SEQ ID NO: 612425 - RNA, 16 nt, Homo sapiens
cugacaacaugcuagg

SEQ ID NO: 612426 - RNA, 15 nt, Homo sapiens
cugacaauaaaaaca

SEQ ID NO: 612427 - RNA, 14 nt, Homo sapiens
cugacaauauacaa

SEQ ID NO: 612428 - RNA, 21 nt, Homo sapiens
cugacaaucaguuaaacacac

SEQ ID NO: 612429 - RNA, 15 nt, Homo sapiens
cugacagcagccugu

SEQ ID NO: 612430 - RNA, 15 nt, Homo sapiens
cugacagcuagacac

SEQ ID NO: 612431 - RNA, 11 nt, Homo sapiens
cugacagcuuc

SEQ ID NO: 612432 - RNA, 21 nt, Homo sapiens
cugacaguuguuuugcuucuu

SEQ ID NO: 612433 - RNA, 16 nt, Homo sapiens
cugacaguuuguggca

SEQ ID NO: 612434 - RNA, 16 nt, Homo sapiens
cugacauaugcuaacc

SEQ ID NO: 612435 - RNA, 11 nt, Homo sapiens
cugacaugucc

SEQ ID NO: 612436 - RNA, 21 nt, Homo sapiens
cugacauuuuuuccuaaggaa

SEQ ID NO: 612437 - RNA, 17 nt, Homo sapiens
cugaccaagauacuuaa

SEQ ID NO: 612438 - RNA, 20 nt, Homo sapiens
cugaccaauauuguacaguu

SEQ ID NO: 612439 - RNA, 20 nt, Homo sapiens
cugaccaauugugcugccau

SEQ ID NO: 612440 - RNA, 14 nt, Homo sapiens
cugaccacagaauu

SEQ ID NO: 612441 - RNA, 17 nt, Homo sapiens
cugaccacagcacagcc

SEQ ID NO: 612442 - RNA, 12 nt, Homo sapiens
cugaccacagcc

SEQ ID NO: 612443 - RNA, 14 nt, Homo sapiens
cugaccaggcccaa

SEQ ID NO: 612444 - RNA, 18 nt, Homo sapiens
cugacccaagagaacuca

SEQ ID NO: 612445 - RNA, 13 nt, Homo sapiens
cugaccccagugc

SEQ ID NO: 612446 - RNA, 23 nt, Homo sapiens
cugaccccucuccucaagggaag

SEQ ID NO: 612447 - RNA, 19 nt, Homo sapiens
cugacccugcuucaaauau

SEQ ID NO: 612448 - RNA, 11 nt, Homo sapiens
cugacccugua

SEQ ID NO: 612449 - RNA, 17 nt, Homo sapiens
cugaccuaccucaaagg

SEQ ID NO: 612450 - RNA, 16 nt, Homo sapiens
cugaccucuugcugcc

SEQ ID NO: 612451 - RNA, 18 nt, Homo sapiens
cugaccuggcuggugaca

SEQ ID NO: 612452 - RNA, 20 nt, Homo sapiens
cugacggaguccuguguuug

SEQ ID NO: 612453 - RNA, 14 nt, Homo sapiens
cugacggugcaguc

SEQ ID NO: 612454 - RNA, 19 nt, Homo sapiens
cugacuaaagguuaccugu

SEQ ID NO: 612455 - RNA, 19 nt, Homo sapiens
cugacucuaagaauucucu

SEQ ID NO: 612456 - RNA, 18 nt, Homo sapiens
cugacucuccuccuugag

SEQ ID NO: 612457 - RNA, 19 nt, Homo sapiens
cugacugcaugaugagucu

SEQ ID NO: 612458 - RNA, 18 nt, Homo sapiens
cugacugccaauaacauu

SEQ ID NO: 612459 - RNA, 20 nt, Homo sapiens
cugacuggauucauucucau

SEQ ID NO: 612460 - RNA, 16 nt, Homo sapiens
cugacuguacuccucc

SEQ ID NO: 612461 - RNA, 15 nt, Homo sapiens
cugacugugcccaag

SEQ ID NO: 612462 - RNA, 14 nt, Homo sapiens
cugacuucucugaa

SEQ ID NO: 612463 - RNA, 14 nt, Homo sapiens
cugacuuugcuugc

SEQ ID NO: 612464 - RNA, 19 nt, Homo sapiens
cugacuuuuaaugucauuu

SEQ ID NO: 612465 - RNA, 18 nt, Homo sapiens
cugacuuuugcagaugga

SEQ ID NO: 612466 - RNA, 23 nt, Homo sapiens
cugagaaaaaaagugagagaccu

SEQ ID NO: 612467 - RNA, 22 nt, Homo sapiens
cugagaaaaguauucucaaaga

SEQ ID NO: 612468 - RNA, 12 nt, Homo sapiens
cugagaaagccc

SEQ ID NO: 612469 - RNA, 15 nt, Homo sapiens
cugagaaaguacaaa

SEQ ID NO: 612470 - RNA, 20 nt, Homo sapiens
cugagaaauagguaucaaaa

SEQ ID NO: 612471 - RNA, 14 nt, Homo sapiens
cugagaaaugaugg

SEQ ID NO: 612472 - RNA, 21 nt, Homo sapiens
cugagaaauguuaaagguuca

SEQ ID NO: 612473 - RNA, 19 nt, Homo sapiens
cugagaaauuucugugcuu

SEQ ID NO: 612474 - RNA, 21 nt, Homo sapiens
cugagaacuggacaguggcag

SEQ ID NO: 612475 - RNA, 21 nt, Homo sapiens
cugagaagcaguauaagccuu

SEQ ID NO: 612476 - RNA, 13 nt, Homo sapiens
cugagaaggcuca

SEQ ID NO: 612477 - RNA, 20 nt, Homo sapiens
cugagaagucaaacauuuca

SEQ ID NO: 612478 - RNA, 16 nt, Homo sapiens
cugagaaucagacuga

SEQ ID NO: 612479 - RNA, 12 nt, Homo sapiens
cugagaauucca

SEQ ID NO: 612480 - RNA, 14 nt, Homo sapiens
cugagaauuguuga

SEQ ID NO: 612481 - RNA, 15 nt, Homo sapiens
cugagacagggugcu

SEQ ID NO: 612482 - RNA, 20 nt, Homo sapiens
cugagacaucccugauucuc

SEQ ID NO: 612483 - RNA, 22 nt, Homo sapiens
cugagaccacaguuuaccucag

SEQ ID NO: 612484 - RNA, 20 nt, Homo sapiens
cugagacccuuuucucagga

SEQ ID NO: 612485 - RNA, 17 nt, Homo sapiens
cugagacuaaguuguag

SEQ ID NO: 612486 - RNA, 22 nt, Homo sapiens
cugagacuuaagggaacugaau

SEQ ID NO: 612487 - RNA, 16 nt, Homo sapiens
cugagagcaguuacug

SEQ ID NO: 612488 - RNA, 20 nt, Homo sapiens
cugagagucugaaagacaga

SEQ ID NO: 612489 - RNA, 19 nt, Homo sapiens
cugagauacaagucaucca

SEQ ID NO: 612490 - RNA, 17 nt, Homo sapiens
cugagaugcaggugaug

SEQ ID NO: 612491 - RNA, 19 nt, Homo sapiens
cugagauuuuuuuguguau

SEQ ID NO: 612492 - RNA, 19 nt, Homo sapiens
cugagcaaugucugugcua

SEQ ID NO: 612493 - RNA, 18 nt, Homo sapiens
cugagcacccaagccagg

SEQ ID NO: 612494 - RNA, 22 nt, Homo sapiens
cugagcagaagcuggaggcaca

SEQ ID NO: 612495 - RNA, 19 nt, Homo sapiens
cugagcagaauacuggucu

SEQ ID NO: 612496 - RNA, 16 nt, Homo sapiens
cugagcagccucugga

SEQ ID NO: 612497 - RNA, 17 nt, Homo sapiens
cugagcagugccagcuu

SEQ ID NO: 612498 - RNA, 21 nt, Homo sapiens
cugagcagugccagcuuucuu

SEQ ID NO: 612499 - RNA, 17 nt, Homo sapiens
cugagccagcccuccuu

SEQ ID NO: 612500 - RNA, 15 nt, Homo sapiens
cugagccagucccag

SEQ ID NO: 612501 - RNA, 19 nt, Homo sapiens
cugagccauuugcugcauu

SEQ ID NO: 612502 - RNA, 18 nt, Homo sapiens
cugagcccccacauucuc

SEQ ID NO: 612503 - RNA, 17 nt, Homo sapiens
cugagccccuaccccac

SEQ ID NO: 612504 - RNA, 18 nt, Homo sapiens
cugagcccucucacucca

SEQ ID NO: 612505 - RNA, 13 nt, Homo sapiens
cugagcccuggca

SEQ ID NO: 612506 - RNA, 18 nt, Homo sapiens
cugagccuacagaugaac

SEQ ID NO: 612507 - RNA, 14 nt, Homo sapiens
cugagccucagucu

SEQ ID NO: 612508 - RNA, 18 nt, Homo sapiens
cugagccuggucccacga

SEQ ID NO: 612509 - RNA, 20 nt, Homo sapiens
cugagcgggaggcagaguuu

SEQ ID NO: 612510 - RNA, 21 nt, Homo sapiens
cugagcuaucuccuaacuuug

SEQ ID NO: 612511 - RNA, 17 nt, Homo sapiens
cugagcucgguggaccc

SEQ ID NO: 612512 - RNA, 20 nt, Homo sapiens
cugagcugccuguaacuuga

SEQ ID NO: 612513 - RNA, 12 nt, Homo sapiens
cugagcugugau

SEQ ID NO: 612514 - RNA, 20 nt, Homo sapiens
cugagcuuuguccugaagga

SEQ ID NO: 612515 - RNA, 22 nt, Homo sapiens
cugaggaagcacagcagcaucu

SEQ ID NO: 612516 - RNA, 20 nt, Homo sapiens
cugaggaaucuaauucagac

SEQ ID NO: 612517 - RNA, 22 nt, Homo sapiens
cugaggaauuucaccuguaaac

SEQ ID NO: 612518 - RNA, 17 nt, Homo sapiens
cugaggacaaaguggag

SEQ ID NO: 612519 - RNA, 13 nt, Homo sapiens
cugaggacugugg

SEQ ID NO: 612520 - RNA, 18 nt, Homo sapiens
cugaggagauacugaaca

SEQ ID NO: 612521 - RNA, 20 nt, Homo sapiens
cugaggaggaggacacagca

SEQ ID NO: 612522 - RNA, 22 nt, Homo sapiens
cugaggcacucaucuacugaau

SEQ ID NO: 612523 - RNA, 14 nt, Homo sapiens
cugaggcauggugu

SEQ ID NO: 612524 - RNA, 20 nt, Homo sapiens
cugaggccacacucagcaca

SEQ ID NO: 612525 - RNA, 22 nt, Homo sapiens
cugaggccacacucagcacaag

SEQ ID NO: 612526 - RNA, 17 nt, Homo sapiens
cugaggcccagugcaua

SEQ ID NO: 612527 - RNA, 23 nt, Homo sapiens
cugaggcccucacugagccucaa

SEQ ID NO: 612528 - RNA, 22 nt, Homo sapiens
cugaggccuccagcuucaggca

SEQ ID NO: 612529 - RNA, 19 nt, Homo sapiens
cugaggccuggacuuuccu

SEQ ID NO: 612530 - RNA, 22 nt, Homo sapiens
cugaggcgcugcuuugucaaaa

SEQ ID NO: 612531 - RNA, 16 nt, Homo sapiens
cugagggaaagugcau

SEQ ID NO: 612532 - RNA, 17 nt, Homo sapiens
cugagggaaagugcaua

SEQ ID NO: 612533 - RNA, 17 nt, Homo sapiens
cuggccuuugcucuuac

SEQ ID NO: 612534 - RNA, 17 nt, Homo sapiens
cuggcgacacucagggc

SEQ ID NO: 612535 - RNA, 22 nt, Homo sapiens
cuggcgagccucugguuuuccu

SEQ ID NO: 612536 - RNA, 17 nt, Homo sapiens
cuggcgcauauuaagca

SEQ ID NO: 612537 - RNA, 23 nt, Homo sapiens
cuggcuaaagauaauugcuauuu

SEQ ID NO: 612538 - RNA, 15 nt, Homo sapiens
cuggcuagcauuccu

SEQ ID NO: 612539 - RNA, 12 nt, Homo sapiens
cuggcucuccaa

SEQ ID NO: 612540 - RNA, 11 nt, Homo sapiens
cuggcucucuc

SEQ ID NO: 612541 - RNA, 12 nt, Homo sapiens
cuggcucugaga

SEQ ID NO: 612542 - RNA, 22 nt, Homo sapiens
cuggcucuugaggcauuuccag

SEQ ID NO: 612543 - RNA, 19 nt, Homo sapiens
cuggcugaacccugugcug

SEQ ID NO: 612544 - RNA, 18 nt, Homo sapiens
cuggcugagcugaaccca

SEQ ID NO: 612545 - RNA, 14 nt, Homo sapiens
cuggcugagguucc

SEQ ID NO: 612546 - RNA, 12 nt, Homo sapiens
cuggcugcuagg

SEQ ID NO: 612547 - RNA, 18 nt, Homo sapiens
cuggcuggaaaaagguga

SEQ ID NO: 612548 - RNA, 18 nt, Homo sapiens
cuggcuguggucagcaga

SEQ ID NO: 612549 - RNA, 19 nt, Homo sapiens
cugggaaaauccacuauga

SEQ ID NO: 612550 - RNA, 14 nt, Homo sapiens
cugggaaaugcaga

SEQ ID NO: 612551 - RNA, 13 nt, Homo sapiens
cugggaaccagca

SEQ ID NO: 612552 - RNA, 19 nt, Homo sapiens
cugggacaucuuaguguuu

SEQ ID NO: 612553 - RNA, 15 nt, Homo sapiens
cugggaccuccuuag

SEQ ID NO: 612554 - RNA, 13 nt, Homo sapiens
cugggacuauggc

SEQ ID NO: 612555 - RNA, 21 nt, Homo sapiens
cugggacucccagcagagccc

SEQ ID NO: 612556 - RNA, 19 nt, Homo sapiens
cugggacugugcucagaga

SEQ ID NO: 612557 - RNA, 15 nt, Homo sapiens
cugggagacuuugaa

SEQ ID NO: 612558 - RNA, 16 nt, Homo sapiens
cugggagcagcucugu

SEQ ID NO: 612559 - RNA, 20 nt, Homo sapiens
cugggagccacgccuaugcc

SEQ ID NO: 612560 - RNA, 17 nt, Homo sapiens
cugggaggcggagagua

SEQ ID NO: 612561 - RNA, 16 nt, Homo sapiens
cugggagucacacagu

SEQ ID NO: 612562 - RNA, 15 nt, Homo sapiens
cugggaguguccuua

SEQ ID NO: 612563 - RNA, 16 nt, Homo sapiens
cugggauccaguguau

SEQ ID NO: 612564 - RNA, 15 nt, Homo sapiens
cugggaucuggcaca

SEQ ID NO: 612565 - RNA, 17 nt, Homo sapiens
cugggaucuggugguca

SEQ ID NO: 612566 - RNA, 13 nt, Homo sapiens
cugggaugccugu

SEQ ID NO: 612567 - RNA, 16 nt, Homo sapiens
cugggaugggcuccca

SEQ ID NO: 612568 - RNA, 21 nt, Homo sapiens
cugggauguuuugagggucuu

SEQ ID NO: 612569 - RNA, 22 nt, Homo sapiens
cugggauuacaauugugagcca

SEQ ID NO: 612570 - RNA, 15 nt, Homo sapiens
cugggauuacaggca

SEQ ID NO: 612571 - RNA, 23 nt, Homo sapiens
cugggauuacaggcgugagccac

SEQ ID NO: 612572 - RNA, 23 nt, Homo sapiens
cugggauuacagguguaagccac

SEQ ID NO: 612573 - RNA, 22 nt, Homo sapiens
cugggauuucucccucucagug

SEQ ID NO: 612574 - RNA, 16 nt, Homo sapiens
cugggcaaagccacaa

SEQ ID NO: 612575 - RNA, 20 nt, Homo sapiens
cugggcaagagaugggacaa

SEQ ID NO: 612576 - RNA, 14 nt, Homo sapiens
cugggcaccaccuc

SEQ ID NO: 612577 - RNA, 16 nt, Homo sapiens
cugggcagaaugaagu

SEQ ID NO: 612578 - RNA, 21 nt, Homo sapiens
cugggcagcaccucuggucag

SEQ ID NO: 612579 - RNA, 17 nt, Homo sapiens
cugggcagccuuuccag

SEQ ID NO: 612580 - RNA, 14 nt, Homo sapiens
cugggcagcuccuc

SEQ ID NO: 612581 - RNA, 17 nt, Homo sapiens
cugggcagcugggcaga

SEQ ID NO: 612582 - RNA, 20 nt, Homo sapiens
cugggcagcuucuguuggca

SEQ ID NO: 612583 - RNA, 22 nt, Homo sapiens
cugggcauauccaccaccuccc

SEQ ID NO: 612584 - RNA, 19 nt, Homo sapiens
cugggcauucucaauacuu

SEQ ID NO: 612585 - RNA, 18 nt, Homo sapiens
cugggccaaaaccaaugc

SEQ ID NO: 612586 - RNA, 18 nt, Homo sapiens
cugggccauguccaaaga

SEQ ID NO: 612587 - RNA, 16 nt, Homo sapiens
cugggcccaagacaga

SEQ ID NO: 612588 - RNA, 16 nt, Homo sapiens
cugggccccaccaccu

SEQ ID NO: 612589 - RNA, 19 nt, Homo sapiens
cugggcccuugugcuccuc

SEQ ID NO: 612590 - RNA, 21 nt, Homo sapiens
cugggccugcuagucugucag

SEQ ID NO: 612591 - RNA, 15 nt, Homo sapiens
cugggccuucucacc

SEQ ID NO: 612592 - RNA, 14 nt, Homo sapiens
cugggcucaaguga

SEQ ID NO: 612593 - RNA, 13 nt, Homo sapiens
cugggcucacuca

SEQ ID NO: 612594 - RNA, 20 nt, Homo sapiens
cugggcucccucaaaugaca

SEQ ID NO: 612595 - RNA, 18 nt, Homo sapiens
cugggcucccuugugcgu

SEQ ID NO: 612596 - RNA, 17 nt, Homo sapiens
cugggcuccuccagggu

SEQ ID NO: 612597 - RNA, 15 nt, Homo sapiens
cugggcucugccacc

SEQ ID NO: 612598 - RNA, 17 nt, Homo sapiens
cugggcugagugacaca

SEQ ID NO: 612599 - RNA, 22 nt, Homo sapiens
cugggcugcuacccagaaauca

SEQ ID NO: 612600 - RNA, 14 nt, Homo sapiens
cugggcuggacugg

SEQ ID NO: 612601 - RNA, 17 nt, Homo sapiens
cugggcugggaaaaacu

SEQ ID NO: 612602 - RNA, 23 nt, Homo sapiens
cugggcuguaacguggcacuggu

SEQ ID NO: 612603 - RNA, 21 nt, Homo sapiens
cugggcugucugucaccagcu

SEQ ID NO: 612604 - RNA, 17 nt, Homo sapiens
cugggcuuccugagcca

SEQ ID NO: 612605 - RNA, 19 nt, Homo sapiens
cuggggaaacaacauuuau

SEQ ID NO: 612606 - RNA, 22 nt, Homo sapiens
cuggggaaacauaacuccaucu

SEQ ID NO: 612607 - RNA, 14 nt, Homo sapiens
cuggggaaggggag

SEQ ID NO: 612608 - RNA, 15 nt, Homo sapiens
cuggggaauuacuuu

SEQ ID NO: 612609 - RNA, 18 nt, Homo sapiens
cuggggacaacugcggug

SEQ ID NO: 612610 - RNA, 19 nt, Homo sapiens
cuggggacagcuuccucac

SEQ ID NO: 612611 - RNA, 17 nt, Homo sapiens
cuggggaccuggcacug

SEQ ID NO: 612612 - RNA, 15 nt, Homo sapiens
cuggggacuuccuca

SEQ ID NO: 612613 - RNA, 19 nt, Homo sapiens
cuggggagacaaaucucag

SEQ ID NO: 612614 - RNA, 22 nt, Homo sapiens
cuggggauaguccuuccuggca

SEQ ID NO: 612615 - RNA, 21 nt, Homo sapiens
cuggggaucuucccacaggag

SEQ ID NO: 612616 - RNA, 15 nt, Homo sapiens
cuggggcaucagcca

SEQ ID NO: 612617 - RNA, 15 nt, Homo sapiens
cuggggccuguugaa

SEQ ID NO: 612618 - RNA, 14 nt, Homo sapiens
cuggggcucaagca

SEQ ID NO: 612619 - RNA, 22 nt, Homo sapiens
cugggggaggggacauugaaca

SEQ ID NO: 612620 - RNA, 16 nt, Homo sapiens
cugggggcagcugucc

SEQ ID NO: 612621 - RNA, 14 nt, Homo sapiens
cuggggggcucuca

SEQ ID NO: 612622 - RNA, 20 nt, Homo sapiens
cuggggucacccucuccagc

SEQ ID NO: 612623 - RNA, 19 nt, Homo sapiens
cuggggucccucugaagag

SEQ ID NO: 612624 - RNA, 21 nt, Homo sapiens
cuggggucuccuauacucuau

SEQ ID NO: 612625 - RNA, 21 nt, Homo sapiens
cugggguggggucaugcccuc

SEQ ID NO: 612626 - RNA, 18 nt, Homo sapiens
cugggguuuacugaggug

SEQ ID NO: 612627 - RNA, 23 nt, Homo sapiens
cuggguacugaaagccuuaggga

SEQ ID NO: 612628 - RNA, 18 nt, Homo sapiens
cuggguauguuccuaagg

SEQ ID NO: 612629 - RNA, 22 nt, Homo sapiens
cuggguccgccuuaaucuggaa

SEQ ID NO: 612630 - RNA, 21 nt, Homo sapiens
cugggucucgcuuuguugccc

SEQ ID NO: 612631 - RNA, 23 nt, Homo sapiens
cugggucucgcuuuguugcccag

SEQ ID NO: 612632 - RNA, 14 nt, Homo sapiens
cugggugaccucac

SEQ ID NO: 612633 - RNA, 19 nt, Homo sapiens
cugggugagcucuuccagg

SEQ ID NO: 612634 - RNA, 15 nt, Homo sapiens
cuggguguugaccac

SEQ ID NO: 612635 - RNA, 21 nt, Homo sapiens
cuggguuaggguguguguuca

SEQ ID NO: 612636 - RNA, 21 nt, Homo sapiens
cuggguucaacucugcuccca

SEQ ID NO: 612637 - RNA, 15 nt, Homo sapiens
cuggguucuuuggaa

SEQ ID NO: 612638 - RNA, 19 nt, Homo sapiens
cuggguugagggaugcugg

SEQ ID NO: 612639 - RNA, 16 nt, Homo sapiens
cuggguuggugcacag

SEQ ID NO: 612640 - RNA, 22 nt, Homo sapiens
cuggguuuuguauucucugagc

SEQ ID NO: 612641 - RNA, 15 nt, Homo sapiens
cugguaaaaagaucc

SEQ ID NO: 612642 - RNA, 21 nt, Homo sapiens
cugguaaaaagauccagggau

SEQ ID NO: 612643 - RNA, 22 nt, Homo sapiens
cugguaaaauuaagcacacuaa

SEQ ID NO: 612644 - RNA, 15 nt, Homo sapiens
cugguaacauagguu

SEQ ID NO: 612645 - RNA, 20 nt, Homo sapiens
cugguaccgagccccugaac

SEQ ID NO: 612646 - RNA, 16 nt, Homo sapiens
cugguagaaaggcagu

SEQ ID NO: 612647 - RNA, 20 nt, Homo sapiens
cugguagaaaggcaguucag

SEQ ID NO: 612648 - RNA, 15 nt, Homo sapiens
cugguauauacauau

SEQ ID NO: 612649 - RNA, 16 nt, Homo sapiens
cugguauguguggaug

SEQ ID NO: 612650 - RNA, 23 nt, Homo sapiens
cugguauuaacuuuauacacuug

SEQ ID NO: 612651 - RNA, 16 nt, Homo sapiens
cugguauuguucucac

SEQ ID NO: 612652 - RNA, 20 nt, Homo sapiens
cugguauuguuuacguuuga

SEQ ID NO: 612653 - RNA, 16 nt, Homo sapiens
cuggucagcauguacu

SEQ ID NO: 612654 - RNA, 16 nt, Homo sapiens
cuuaaagcauuugcaa

SEQ ID NO: 612655 - RNA, 16 nt, Homo sapiens
cuuaaaggcuguggua

SEQ ID NO: 612656 - RNA, 19 nt, Homo sapiens
cuuaaauaaacucaaugag

SEQ ID NO: 612657 - RNA, 13 nt, Homo sapiens
cuuaaauaaucuc

SEQ ID NO: 612658 - RNA, 22 nt, Homo sapiens
cuuaaauauauauuucuaauau

SEQ ID NO: 612659 - RNA, 15 nt, Homo sapiens
cuuaaaucuuuucaa

SEQ ID NO: 612660 - RNA, 22 nt, Homo sapiens
cuuaaaugaucugccucuaaaa

SEQ ID NO: 612661 - RNA, 17 nt, Homo sapiens
cuuaaauguuuauacug

SEQ ID NO: 612662 - RNA, 21 nt, Homo sapiens
cuuaaauuaagauuaugugag

SEQ ID NO: 612663 - RNA, 17 nt, Homo sapiens
cuuaaauuucaaaccau

SEQ ID NO: 612664 - RNA, 24 nt, Homo sapiens
cuuaaauuugaaucugagugaauu

SEQ ID NO: 612665 - RNA, 15 nt, Homo sapiens
cuuaacaagacuuuu

SEQ ID NO: 612666 - RNA, 14 nt, Homo sapiens
cuuaacaguuguau

SEQ ID NO: 612667 - RNA, 12 nt, Homo sapiens
cuuaacaucccu

SEQ ID NO: 612668 - RNA, 14 nt, Homo sapiens
cuuaacauucugua

SEQ ID NO: 612669 - RNA, 19 nt, Homo sapiens
cuuaaccuuccaugucucc

SEQ ID NO: 612670 - RNA, 14 nt, Homo sapiens
cuuaaccuuuccag

SEQ ID NO: 612671 - RNA, 12 nt, Homo sapiens
cuuaacuaugag

SEQ ID NO: 612672 - RNA, 21 nt, Homo sapiens
cuuaacuggucuccuugcuuc

SEQ ID NO: 612673 - RNA, 12 nt, Homo sapiens
cuuaacugucac

SEQ ID NO: 612674 - RNA, 19 nt, Homo sapiens
cuuaacuuugaaccauaaa

SEQ ID NO: 612675 - RNA, 22 nt, Homo sapiens
cuuaagcaaaggggacagcugu

SEQ ID NO: 612676 - RNA, 21 nt, Homo sapiens
cuuaagccagcacucacacca

SEQ ID NO: 612677 - RNA, 16 nt, Homo sapiens
cuuaagccuuuugcuc

SEQ ID NO: 612678 - RNA, 13 nt, Homo sapiens
cuuaagcugggau

SEQ ID NO: 612679 - RNA, 20 nt, Homo sapiens
cuuaagcuuccgccgucuca

SEQ ID NO: 612680 - RNA, 17 nt, Homo sapiens
cuuaaggagguguuccu

SEQ ID NO: 612681 - RNA, 21 nt, Homo sapiens
cuuaagggaacugaaucacuu

SEQ ID NO: 612682 - RNA, 23 nt, Homo sapiens
cuuaaggggggcagggagugaug

SEQ ID NO: 612683 - RNA, 22 nt, Homo sapiens
cuuaagucucagacugauuucu

SEQ ID NO: 612684 - RNA, 13 nt, Homo sapiens
cuuaauaaagguu

SEQ ID NO: 612685 - RNA, 20 nt, Homo sapiens
cuuaauaaauauuacaguga

SEQ ID NO: 612686 - RNA, 15 nt, Homo sapiens
cuuaauaacauacaa

SEQ ID NO: 612687 - RNA, 23 nt, Homo sapiens
cuuaauaacauacaaugaccaca

SEQ ID NO: 612688 - RNA, 15 nt, Homo sapiens
cuuaauaccaaacau

SEQ ID NO: 612689 - RNA, 17 nt, Homo sapiens
cuuaauaccaaacaugc

SEQ ID NO: 612690 - RNA, 18 nt, Homo sapiens
cuuaauacuaccuugaaa

SEQ ID NO: 612691 - RNA, 14 nt, Homo sapiens
cuuaauagacuucu

SEQ ID NO: 612692 - RNA, 22 nt, Homo sapiens
cuuaauaguaggguaaguuguu

SEQ ID NO: 612693 - RNA, 14 nt, Homo sapiens
cuuaaucacuacug

SEQ ID NO: 612694 - RNA, 16 nt, Homo sapiens
cuuaaucucacauuca

SEQ ID NO: 612695 - RNA, 14 nt, Homo sapiens
cuuaaugacaacac

SEQ ID NO: 612696 - RNA, 15 nt, Homo sapiens
cuuaaugacauuccc

SEQ ID NO: 612697 - RNA, 22 nt, Homo sapiens
cuuaaugcagacucuucuuaag

SEQ ID NO: 612698 - RNA, 22 nt, Homo sapiens
cuuaauggcucaugaccuggaa

SEQ ID NO: 612699 - RNA, 16 nt, Homo sapiens
cuuaaugguagcaacu

SEQ ID NO: 612700 - RNA, 23 nt, Homo sapiens
cuuaaugguaggucaaguaauaa

SEQ ID NO: 612701 - RNA, 16 nt, Homo sapiens
cuuaauguuucuuaga

SEQ ID NO: 612702 - RNA, 13 nt, Homo sapiens
cuuaauucucugc

SEQ ID NO: 612703 - RNA, 23 nt, Homo sapiens
cuuaauugaaaugaaaauuuaau

SEQ ID NO: 612704 - RNA, 20 nt, Homo sapiens
cuuaauuuaauugcuuugaa

SEQ ID NO: 612705 - RNA, 14 nt, Homo sapiens
cuuaauuucugccu

SEQ ID NO: 612706 - RNA, 14 nt, Homo sapiens
cuuaauuugcacag

SEQ ID NO: 612707 - RNA, 17 nt, Homo sapiens
cuuaauuuucaguauaa

SEQ ID NO: 612708 - RNA, 18 nt, Homo sapiens
cuuacaauugcacugcug

SEQ ID NO: 612709 - RNA, 21 nt, Homo sapiens
cuuacacuacauuagaacacu

SEQ ID NO: 612710 - RNA, 15 nt, Homo sapiens
cuuacaucaguagca

SEQ ID NO: 612711 - RNA, 11 nt, Homo sapiens
cuuacaucugg

SEQ ID NO: 612712 - RNA, 21 nt, Homo sapiens
cuuacauuuacaaacugaaga

SEQ ID NO: 612713 - RNA, 14 nt, Homo sapiens
cuuaccaauugaug

SEQ ID NO: 612714 - RNA, 18 nt, Homo sapiens
cuuaccacuaaauccuug

SEQ ID NO: 612715 - RNA, 13 nt, Homo sapiens
cuuaccuguucag

SEQ ID NO: 612716 - RNA, 18 nt, Homo sapiens
cuuacuagaccuguaacu

SEQ ID NO: 612717 - RNA, 16 nt, Homo sapiens
cuuacuccuggcuuua

SEQ ID NO: 612718 - RNA, 15 nt, Homo sapiens
cuuacuggcaaacau

SEQ ID NO: 612719 - RNA, 20 nt, Homo sapiens
cuuacuuuaccucucuguca

SEQ ID NO: 612720 - RNA, 14 nt, Homo sapiens
cuuacuuugcuuga

SEQ ID NO: 612721 - RNA, 22 nt, Homo sapiens
cuuagaaaauucaagcauuuag

SEQ ID NO: 612722 - RNA, 22 nt, Homo sapiens
cuuagaaaugaaggcagaaaaa

SEQ ID NO: 612723 - RNA, 14 nt, Homo sapiens
cuuagaaauuguaa

SEQ ID NO: 612724 - RNA, 19 nt, Homo sapiens
cuuagaagccaugggaccu

SEQ ID NO: 612725 - RNA, 13 nt, Homo sapiens
cuuagaauccaaa

SEQ ID NO: 612726 - RNA, 16 nt, Homo sapiens
cuuagacuucgacuca

SEQ ID NO: 612727 - RNA, 22 nt, Homo sapiens
cuuagagaggacaauacugggg

SEQ ID NO: 612728 - RNA, 15 nt, Homo sapiens
cuuagaguguagcug

SEQ ID NO: 612729 - RNA, 23 nt, Homo sapiens
cuuagauauuaaaauuuggugcu

SEQ ID NO: 612730 - RNA, 14 nt, Homo sapiens
cuuagauguuaaau

SEQ ID NO: 612731 - RNA, 19 nt, Homo sapiens
cuuagauguuccaguaauc

SEQ ID NO: 612732 - RNA, 23 nt, Homo sapiens
cuuagauuagcucuggaccagcc

SEQ ID NO: 612733 - RNA, 18 nt, Homo sapiens
cuuagcaacucagagaaa

SEQ ID NO: 612734 - RNA, 18 nt, Homo sapiens
cuuagcacacucacagau

SEQ ID NO: 612735 - RNA, 13 nt, Homo sapiens
cuuagcauguccc

SEQ ID NO: 612736 - RNA, 20 nt, Homo sapiens
cuuagcaugugacuccugaa

SEQ ID NO: 612737 - RNA, 17 nt, Homo sapiens
cuuagccauugaaaugu

SEQ ID NO: 612738 - RNA, 22 nt, Homo sapiens
cuuagccauuuuucaaagcaau

SEQ ID NO: 612739 - RNA, 18 nt, Homo sapiens
cuuagcccaagaggucug

SEQ ID NO: 612740 - RNA, 15 nt, Homo sapiens
cuuagccccagacuc

SEQ ID NO: 612741 - RNA, 18 nt, Homo sapiens
cuuagcccuguguccuga

SEQ ID NO: 612742 - RNA, 21 nt, Homo sapiens
cuuagcuaguuuuauucuugg

SEQ ID NO: 612743 - RNA, 21 nt, Homo sapiens
cuuagcuucuauuauagccac

SEQ ID NO: 612744 - RNA, 18 nt, Homo sapiens
cuuaggccuggaggccaa

SEQ ID NO: 612745 - RNA, 23 nt, Homo sapiens
cuuaggccuuccucucuccagau

SEQ ID NO: 612746 - RNA, 23 nt, Homo sapiens
cuuagggcagauuuucaugcaaa

SEQ ID NO: 612747 - RNA, 21 nt, Homo sapiens
cuuaggugcuucuucacuuca

SEQ ID NO: 612748 - RNA, 13 nt, Homo sapiens
cuuaguaagugcu

SEQ ID NO: 612749 - RNA, 16 nt, Homo sapiens
cuuaguaagugcuuuu

SEQ ID NO: 612750 - RNA, 14 nt, Homo sapiens
cuuaguauugugau

SEQ ID NO: 612751 - RNA, 15 nt, Homo sapiens
cuuagucaugguguu

SEQ ID NO: 612752 - RNA, 22 nt, Homo sapiens
cuuaguccuacccugaaccuau

SEQ ID NO: 612753 - RNA, 22 nt, Homo sapiens
cuuagucuguuuucuaaagcca

SEQ ID NO: 612754 - RNA, 18 nt, Homo sapiens
cuuagugaaauuacuucu

SEQ ID NO: 612755 - RNA, 16 nt, Homo sapiens
cuuagugaucauuuaa

SEQ ID NO: 612756 - RNA, 15 nt, Homo sapiens
cuuagugucacuuac

SEQ ID NO: 612757 - RNA, 17 nt, Homo sapiens
cuuagugugagcaucuu

SEQ ID NO: 612758 - RNA, 16 nt, Homo sapiens
cuuaguuauugcugaa

SEQ ID NO: 612759 - RNA, 14 nt, Homo sapiens
cuuaguugaaauga

SEQ ID NO: 612760 - RNA, 16 nt, Homo sapiens
cuuauaaaaaucuuaa

SEQ ID NO: 612761 - RNA, 15 nt, Homo sapiens
cuuauacauuugaua

SEQ ID NO: 612762 - RNA, 23 nt, Homo sapiens
cuuauacgaguaauaugccugcu

SEQ ID NO: 612763 - RNA, 14 nt, Homo sapiens
cuuauacuguacaa

SEQ ID NO: 612764 - RNA, 17 nt, Homo sapiens
cuuauacuguauaugau

SEQ ID NO: 612765 - RNA, 17 nt, Homo sapiens
cuuauauacuaauauca

SEQ ID NO: 612766 - RNA, 20 nt, Homo sapiens
cuuauaucauguaccucaga

SEQ ID NO: 612767 - RNA, 19 nt, Homo sapiens
cuuauauggaaauucugcu

SEQ ID NO: 612768 - RNA, 18 nt, Homo sapiens
cuuauauuauuccaaagu

SEQ ID NO: 612769 - RNA, 20 nt, Homo sapiens
cuuauauuuaaaacuugccu

SEQ ID NO: 612770 - RNA, 12 nt, Homo sapiens
cuuaucaaagga

SEQ ID NO: 612771 - RNA, 16 nt, Homo sapiens
cuuauccacuuugacu

SEQ ID NO: 612772 - RNA, 21 nt, Homo sapiens
cuuauccuccaccgucuuucu

SEQ ID NO: 612773 - RNA, 18 nt, Homo sapiens
cuuaucuccaagaccaga

SEQ ID NO: 612774 - RNA, 18 nt, Homo sapiens
cuuaucuuucuaaaacug

SEQ ID NO: 612775 - RNA, 20 nt, Homo sapiens
gaagucuucuccuccaugaa

SEQ ID NO: 612776 - RNA, 16 nt, Homo sapiens
gaagugagggcucacu

SEQ ID NO: 612777 - RNA, 22 nt, Homo sapiens
gaagugcaucugucagccagac

SEQ ID NO: 612778 - RNA, 10 nt, Homo sapiens
gaagugcucu

SEQ ID NO: 612779 - RNA, 12 nt, Homo sapiens
gaagugcucuaa

SEQ ID NO: 612780 - RNA, 19 nt, Homo sapiens
gaagugcuggcaaccacua

SEQ ID NO: 612781 - RNA, 22 nt, Homo sapiens
gaaguggagagggugucaucua

SEQ ID NO: 612782 - RNA, 15 nt, Homo sapiens
gaaguggcagugaaa

SEQ ID NO: 612783 - RNA, 18 nt, Homo sapiens
gaaguggcccucccucag

SEQ ID NO: 612784 - RNA, 18 nt, Homo sapiens
gaagugguucuaugucca

SEQ ID NO: 612785 - RNA, 13 nt, Homo sapiens
gaaguguugcaug

SEQ ID NO: 612786 - RNA, 21 nt, Homo sapiens
gaaguucauuuggagagucaa

SEQ ID NO: 612787 - RNA, 19 nt, Homo sapiens
gaaguuccaguguucucuc

SEQ ID NO: 612788 - RNA, 14 nt, Homo sapiens
gaaguucuaggaaa

SEQ ID NO: 612789 - RNA, 15 nt, Homo sapiens
gaaguucuaggaaau

SEQ ID NO: 612790 - RNA, 17 nt, Homo sapiens
gaaguuugaccaucacc

SEQ ID NO: 612791 - RNA, 21 nt, Homo sapiens
gaaguuuuaaauuuugacaag

SEQ ID NO: 612792 - RNA, 21 nt, Homo sapiens
gaaguuuuaugcgugugacag

SEQ ID NO: 612793 - RNA, 16 nt, Homo sapiens
gaauaaaccauuuuua

SEQ ID NO: 612794 - RNA, 22 nt, Homo sapiens
gaauaaagccacuguaugauuc

SEQ ID NO: 612795 - RNA, 17 nt, Homo sapiens
gaauaaaggcaguuuuc

SEQ ID NO: 612796 - RNA, 14 nt, Homo sapiens
gaauaaauaccucu

SEQ ID NO: 612797 - RNA, 15 nt, Homo sapiens
gaauaaaugucuugc

SEQ ID NO: 612798 - RNA, 19 nt, Homo sapiens
gaauaacauuuaaauucca

SEQ ID NO: 612799 - RNA, 20 nt, Homo sapiens
gaauaacauuuaaauuccac

SEQ ID NO: 612800 - RNA, 21 nt, Homo sapiens
gaauaacucuuacagcuuugc

SEQ ID NO: 612801 - RNA, 13 nt, Homo sapiens
gaauaacuugaag

SEQ ID NO: 612802 - RNA, 12 nt, Homo sapiens
gaauaagccuuc

SEQ ID NO: 612803 - RNA, 19 nt, Homo sapiens
gaauaaggcuuuuucuucc

SEQ ID NO: 612804 - RNA, 22 nt, Homo sapiens
gaauaauaagcuacuugccuug

SEQ ID NO: 612805 - RNA, 14 nt, Homo sapiens
gaauaauaccuaag

SEQ ID NO: 612806 - RNA, 19 nt, Homo sapiens
gaauaauagaugaugguaa

SEQ ID NO: 612807 - RNA, 12 nt, Homo sapiens
gaauaaucucau

SEQ ID NO: 612808 - RNA, 22 nt, Homo sapiens
gaauaaugcuaccaggaugcua

SEQ ID NO: 612809 - RNA, 16 nt, Homo sapiens
gaauaauuucuauuaa

SEQ ID NO: 612810 - RNA, 14 nt, Homo sapiens
gaauacaaagugau

SEQ ID NO: 612811 - RNA, 17 nt, Homo sapiens
gaauacaacauugccaa

SEQ ID NO: 612812 - RNA, 20 nt, Homo sapiens
gaauacauuaacggugcuaa

SEQ ID NO: 612813 - RNA, 14 nt, Homo sapiens
gaauaccaguguua

SEQ ID NO: 612814 - RNA, 24 nt, Homo sapiens
gaauacuggccaugccuggagaca

SEQ ID NO: 612815 - RNA, 14 nt, Homo sapiens
gaauacuuaacuca

SEQ ID NO: 612816 - RNA, 22 nt, Homo sapiens
gaauacuuggaccucagccaac

SEQ ID NO: 612817 - RNA, 18 nt, Homo sapiens
gaauagcaaggugcucac

SEQ ID NO: 612818 - RNA, 22 nt, Homo sapiens
gaauagccuggccaccagccau

SEQ ID NO: 612819 - RNA, 13 nt, Homo sapiens
gaauagcuuccaa

SEQ ID NO: 612820 - RNA, 13 nt, Homo sapiens
gaauagcuuuaau

SEQ ID NO: 612821 - RNA, 14 nt, Homo sapiens
gaauaguacagaca

SEQ ID NO: 612822 - RNA, 17 nt, Homo sapiens
gaauauaaaacagucau

SEQ ID NO: 612823 - RNA, 18 nt, Homo sapiens
gaauauaaggaaagcaau

SEQ ID NO: 612824 - RNA, 21 nt, Homo sapiens
gaauauaauacuguauuugag

SEQ ID NO: 612825 - RNA, 20 nt, Homo sapiens
gaauauaauuucaaaccaca

SEQ ID NO: 612826 - RNA, 16 nt, Homo sapiens
gaauaugaaugucaca

SEQ ID NO: 612827 - RNA, 18 nt, Homo sapiens
gaauauggaacauaugca

SEQ ID NO: 612828 - RNA, 19 nt, Homo sapiens
gaauauggaacauaugcac

SEQ ID NO: 612829 - RNA, 19 nt, Homo sapiens
gaauauggugggcacagaa

SEQ ID NO: 612830 - RNA, 17 nt, Homo sapiens
gaauauguuaaugcaaa

SEQ ID NO: 612831 - RNA, 18 nt, Homo sapiens
gaauauuaaagcucuuca

SEQ ID NO: 612832 - RNA, 18 nt, Homo sapiens
gaauauucaaaauuccaa

SEQ ID NO: 612833 - RNA, 15 nt, Homo sapiens
gaauauugcaaaaua

SEQ ID NO: 612834 - RNA, 18 nt, Homo sapiens
gaauauuuauaggccagg

SEQ ID NO: 612835 - RNA, 18 nt, Homo sapiens
gaauauuuauuaccucug

SEQ ID NO: 612836 - RNA, 13 nt, Homo sapiens
gaaucaaagacau

SEQ ID NO: 612837 - RNA, 15 nt, Homo sapiens
gaaucaacagaugau

SEQ ID NO: 612838 - RNA, 18 nt, Homo sapiens
gaaucaagcacacuguau

SEQ ID NO: 612839 - RNA, 13 nt, Homo sapiens
gaaucaagcuaga

SEQ ID NO: 612840 - RNA, 23 nt, Homo sapiens
gaaucaagguaagcucaggauau

SEQ ID NO: 612841 - RNA, 16 nt, Homo sapiens
gaaucaauucaauuug

SEQ ID NO: 612842 - RNA, 22 nt, Homo sapiens
gaaucacuguuuagaacacaca

SEQ ID NO: 612843 - RNA, 18 nt, Homo sapiens
gaaucacuuaagccugga

SEQ ID NO: 612844 - RNA, 17 nt, Homo sapiens
gaaucagacugacaguu

SEQ ID NO: 612845 - RNA, 17 nt, Homo sapiens
gaaucagaucauuucaa

SEQ ID NO: 612846 - RNA, 15 nt, Homo sapiens
gaaucagguugcaaa

SEQ ID NO: 612847 - RNA, 23 nt, Homo sapiens
gaaucagugaagaugccagugaa

SEQ ID NO: 612848 - RNA, 20 nt, Homo sapiens
gaaucauacuuaacauuuca

SEQ ID NO: 612849 - RNA, 19 nt, Homo sapiens
gaaucauauucauaugcag

SEQ ID NO: 612850 - RNA, 14 nt, Homo sapiens
gaaucauuaucuua

SEQ ID NO: 612851 - RNA, 13 nt, Homo sapiens
gaaucauuuuagc

SEQ ID NO: 612852 - RNA, 15 nt, Homo sapiens
gaauccaagccucca

SEQ ID NO: 612853 - RNA, 14 nt, Homo sapiens
gaauccaauacugc

SEQ ID NO: 612854 - RNA, 13 nt, Homo sapiens
gaaucccaagacc

SEQ ID NO: 612855 - RNA, 13 nt, Homo sapiens
gaaucccuagucc

SEQ ID NO: 612856 - RNA, 17 nt, Homo sapiens
gaauccuccuccagggu

SEQ ID NO: 612857 - RNA, 20 nt, Homo sapiens
gaauccuuggugugguuucu

SEQ ID NO: 612858 - RNA, 22 nt, Homo sapiens
gaaucuaaaccuuacaugugua

SEQ ID NO: 612859 - RNA, 21 nt, Homo sapiens
gaaucuaacgggcauucacaa

SEQ ID NO: 612860 - RNA, 19 nt, Homo sapiens
gaaucuacaaaaaacaaca

SEQ ID NO: 612861 - RNA, 15 nt, Homo sapiens
gaaucucugugccuu

SEQ ID NO: 612862 - RNA, 20 nt, Homo sapiens
gaaucucuucacuacccuga

SEQ ID NO: 612863 - RNA, 20 nt, Homo sapiens
gaaucucuuuuugcuuucga

SEQ ID NO: 612864 - RNA, 23 nt, Homo sapiens
gaaucuggaccccaucugugaau

SEQ ID NO: 612865 - RNA, 22 nt, Homo sapiens
gaaucuggcaggaaucuaucca

SEQ ID NO: 612866 - RNA, 19 nt, Homo sapiens
gaaucugguguuggggaaa

SEQ ID NO: 612867 - RNA, 17 nt, Homo sapiens
gaaucugugugcauauu

SEQ ID NO: 612868 - RNA, 22 nt, Homo sapiens
gaaucuguuaccagaggacaaa

SEQ ID NO: 612869 - RNA, 19 nt, Homo sapiens
gaaucuguuucucugcugu

SEQ ID NO: 612870 - RNA, 22 nt, Homo sapiens
gaaucuucaagaccaaagcaga

SEQ ID NO: 612871 - RNA, 15 nt, Homo sapiens
gaaucuucaccucag

SEQ ID NO: 612872 - RNA, 14 nt, Homo sapiens
gaaugaacacuccc

SEQ ID NO: 612873 - RNA, 22 nt, Homo sapiens
gaaugaacuaugucgaugcaca

SEQ ID NO: 612874 - RNA, 21 nt, Homo sapiens
gaaugaagcguugccauugaa

SEQ ID NO: 612875 - RNA, 15 nt, Homo sapiens
gaaugacacuguuca

SEQ ID NO: 612876 - RNA, 18 nt, Homo sapiens
gaaugaccagccugucca

SEQ ID NO: 612877 - RNA, 15 nt, Homo sapiens
gaaugacuuacuuuc

SEQ ID NO: 612878 - RNA, 14 nt, Homo sapiens
gaaugagaagaaug

SEQ ID NO: 612879 - RNA, 21 nt, Homo sapiens
gaaugagaagaggcugcugca

SEQ ID NO: 612880 - RNA, 18 nt, Homo sapiens
gaaugagaguuccuucuc

SEQ ID NO: 612881 - RNA, 17 nt, Homo sapiens
gaaugaggcaauuucaa

SEQ ID NO: 612882 - RNA, 22 nt, Homo sapiens
gaaugauuuagguacgucaaag

SEQ ID NO: 612883 - RNA, 18 nt, Homo sapiens
gaaugcaacuccauuuac

SEQ ID NO: 612884 - RNA, 14 nt, Homo sapiens
gaaugcagggacaa

SEQ ID NO: 612885 - RNA, 15 nt, Homo sapiens
gaaugcagggacaaa

SEQ ID NO: 612886 - RNA, 11 nt, Homo sapiens
gaaugcagugg

SEQ ID NO: 612887 - RNA, 16 nt, Homo sapiens
gaaugccuccuguggg

SEQ ID NO: 612888 - RNA, 18 nt, Homo sapiens
gaaugccugucaguuuca

SEQ ID NO: 612889 - RNA, 14 nt, Homo sapiens
gaaugcuauguucu

SEQ ID NO: 612890 - RNA, 18 nt, Homo sapiens
gaaugcuccauuaaucca

SEQ ID NO: 612891 - RNA, 13 nt, Homo sapiens
gaauggcaauaaa

SEQ ID NO: 612892 - RNA, 14 nt, Homo sapiens
gaauggcagcugcc

SEQ ID NO: 612893 - RNA, 20 nt, Homo sapiens
gaauggcauuugcaauaaaa

SEQ ID NO: 612894 - RNA, 20 nt, Homo sapiens
gaaugggcuugaaacauuau

SEQ ID NO: 612895 - RNA, 18 nt, Homo sapiens
gaauggucaagugaugaa

SEQ ID NO: 612896 - RNA, 11 nt, Homo sapiens
gaaugguggag

SEQ ID NO: 612897 - RNA, 22 nt, Homo sapiens
gacggcaccaucuggaaggaca

SEQ ID NO: 612898 - RNA, 14 nt, Homo sapiens
gacgggacugcgga

SEQ ID NO: 612899 - RNA, 15 nt, Homo sapiens
gacggggacugggga

SEQ ID NO: 612900 - RNA, 17 nt, Homo sapiens
gacgguaaguguucuca

SEQ ID NO: 612901 - RNA, 23 nt, Homo sapiens
gacgguaccaauucagugucugu

SEQ ID NO: 612902 - RNA, 13 nt, Homo sapiens
gacggucagucca

SEQ ID NO: 612903 - RNA, 16 nt, Homo sapiens
gacggucccacacugg

SEQ ID NO: 612904 - RNA, 17 nt, Homo sapiens
gacgugaggcccauucu

SEQ ID NO: 612905 - RNA, 18 nt, Homo sapiens
gacguguacagcacagaa

SEQ ID NO: 612906 - RNA, 23 nt, Homo sapiens
gacguuccaccuggggcuucccu

SEQ ID NO: 612907 - RNA, 18 nt, Homo sapiens
gacguuggaaggaaaucu

SEQ ID NO: 612908 - RNA, 20 nt, Homo sapiens
gacuaaagauugcagcauuu

SEQ ID NO: 612909 - RNA, 22 nt, Homo sapiens
gacuaaagauugcagcauuuau

SEQ ID NO: 612910 - RNA, 19 nt, Homo sapiens
gacuaaaugaaaucuugca

SEQ ID NO: 612911 - RNA, 12 nt, Homo sapiens
gacuaacccaau

SEQ ID NO: 612912 - RNA, 16 nt, Homo sapiens
gacuaauggaaauauu

SEQ ID NO: 612913 - RNA, 13 nt, Homo sapiens
gacuacagacauu

SEQ ID NO: 612914 - RNA, 12 nt, Homo sapiens
gacuacaggugu

SEQ ID NO: 612915 - RNA, 17 nt, Homo sapiens
gacuacauguuacuaag

SEQ ID NO: 612916 - RNA, 19 nt, Homo sapiens
gacuacuauacaaacuaca

SEQ ID NO: 612917 - RNA, 14 nt, Homo sapiens
gacuacugcuccug

SEQ ID NO: 612918 - RNA, 18 nt, Homo sapiens
gacuagagcuuucuuuca

SEQ ID NO: 612919 - RNA, 16 nt, Homo sapiens
gacuagaggcagggag

SEQ ID NO: 612920 - RNA, 23 nt, Homo sapiens
gacuagcaaaggaaaauugcacu

SEQ ID NO: 612921 - RNA, 21 nt, Homo sapiens
gacuagccaggaaguacuucc

SEQ ID NO: 612922 - RNA, 15 nt, Homo sapiens
gacuaguagauuucu

SEQ ID NO: 612923 - RNA, 20 nt, Homo sapiens
gacuaucuuacuauuucaca

SEQ ID NO: 612924 - RNA, 16 nt, Homo sapiens
gacuauggagugcacc

SEQ ID NO: 612925 - RNA, 17 nt, Homo sapiens
gacuauggcuaccaaaa

SEQ ID NO: 612926 - RNA, 15 nt, Homo sapiens
gacuauguagcaaua

SEQ ID NO: 612927 - RNA, 18 nt, Homo sapiens
gacuauguuucuauucua

SEQ ID NO: 612928 - RNA, 14 nt, Homo sapiens
gacuauucuaauga

SEQ ID NO: 612929 - RNA, 18 nt, Homo sapiens
gacuauuugcuuauuuaa

SEQ ID NO: 612930 - RNA, 14 nt, Homo sapiens
gacucacaagaaga

SEQ ID NO: 612931 - RNA, 17 nt, Homo sapiens
gacucacaagaagacca

SEQ ID NO: 612932 - RNA, 16 nt, Homo sapiens
gacucacccuccacaa

SEQ ID NO: 612933 - RNA, 20 nt, Homo sapiens
gacucaccuguucucacucc

SEQ ID NO: 612934 - RNA, 12 nt, Homo sapiens
gacucacucugu

SEQ ID NO: 612935 - RNA, 15 nt, Homo sapiens
gacucaggacauccc

SEQ ID NO: 612936 - RNA, 16 nt, Homo sapiens
gacucaggacaucccc

SEQ ID NO: 612937 - RNA, 21 nt, Homo sapiens
gacucagggccaugccugccc

SEQ ID NO: 612938 - RNA, 11 nt, Homo sapiens
gacucaucccc

SEQ ID NO: 612939 - RNA, 16 nt, Homo sapiens
gacuccaaccucaggg

SEQ ID NO: 612940 - RNA, 21 nt, Homo sapiens
gacuccacacagcguuugcca

SEQ ID NO: 612941 - RNA, 20 nt, Homo sapiens
gacuccaccuuggaccucag

SEQ ID NO: 612942 - RNA, 22 nt, Homo sapiens
gacuccaccuuggaccucagug

SEQ ID NO: 612943 - RNA, 22 nt, Homo sapiens
gacuccacgcuguccuuuggga

SEQ ID NO: 612944 - RNA, 20 nt, Homo sapiens
gacuccauagcuccuuccca

SEQ ID NO: 612945 - RNA, 14 nt, Homo sapiens
gacuccaucucuca

SEQ ID NO: 612946 - RNA, 13 nt, Homo sapiens
gacucccacaaca

SEQ ID NO: 612947 - RNA, 18 nt, Homo sapiens
gacucccccaaccaagga

SEQ ID NO: 612948 - RNA, 13 nt, Homo sapiens
gacuccucaaaag

SEQ ID NO: 612949 - RNA, 16 nt, Homo sapiens
gacuccucuaagccac

SEQ ID NO: 612950 - RNA, 23 nt, Homo sapiens
gacuccucugggccuggggugca

SEQ ID NO: 612951 - RNA, 15 nt, Homo sapiens
gacuccugaagggaa

SEQ ID NO: 612952 - RNA, 22 nt, Homo sapiens
gacuccuuagagacaucaaaau

SEQ ID NO: 612953 - RNA, 18 nt, Homo sapiens
gacuccuuuccaauagaa

SEQ ID NO: 612954 - RNA, 16 nt, Homo sapiens
gacucgagagugggca

SEQ ID NO: 612955 - RNA, 14 nt, Homo sapiens
gacucgcuagcacu

SEQ ID NO: 612956 - RNA, 15 nt, Homo sapiens
gacucgcuagcacuc

SEQ ID NO: 612957 - RNA, 14 nt, Homo sapiens
gacucgcuagucag

SEQ ID NO: 612958 - RNA, 19 nt, Homo sapiens
gacucuccaaauagcauua

SEQ ID NO: 612959 - RNA, 13 nt, Homo sapiens
gacucugaacaau

SEQ ID NO: 612960 - RNA, 19 nt, Homo sapiens
gacucugcagagucacuca

SEQ ID NO: 612961 - RNA, 21 nt, Homo sapiens
gacucugccauuaaaacauua

SEQ ID NO: 612962 - RNA, 17 nt, Homo sapiens
gacucugcuuaaacaaa

SEQ ID NO: 612963 - RNA, 21 nt, Homo sapiens
gacucuggggaggugaacugg

SEQ ID NO: 612964 - RNA, 12 nt, Homo sapiens
gacucugucaca

SEQ ID NO: 612965 - RNA, 16 nt, Homo sapiens
gacucugucuaccugg

SEQ ID NO: 612966 - RNA, 20 nt, Homo sapiens
gacucuuagccccagacucu

SEQ ID NO: 612967 - RNA, 18 nt, Homo sapiens
gacucuucacuccaaaaa

SEQ ID NO: 612968 - RNA, 15 nt, Homo sapiens
gacucuugcucuuuc

SEQ ID NO: 612969 - RNA, 16 nt, Homo sapiens
gacucuuguacuugau

SEQ ID NO: 612970 - RNA, 22 nt, Homo sapiens
gacucuuuaauaaauugcuuac

SEQ ID NO: 612971 - RNA, 23 nt, Homo sapiens
gacucuuuugagugguaaucaua

SEQ ID NO: 612972 - RNA, 20 nt, Homo sapiens
gacugaagugaacuaugaag

SEQ ID NO: 612973 - RNA, 14 nt, Homo sapiens
gacugaauucugcc

SEQ ID NO: 612974 - RNA, 15 nt, Homo sapiens
gacugaauucugccu

SEQ ID NO: 612975 - RNA, 13 nt, Homo sapiens
gacugacauuuag

SEQ ID NO: 612976 - RNA, 17 nt, Homo sapiens
gacugaccauauugugc

SEQ ID NO: 612977 - RNA, 17 nt, Homo sapiens
gacugaccaugcacuau

SEQ ID NO: 612978 - RNA, 16 nt, Homo sapiens
gacugacccccaucug

SEQ ID NO: 612979 - RNA, 16 nt, Homo sapiens
gacugagaaccgugac

SEQ ID NO: 612980 - RNA, 20 nt, Homo sapiens
gacugagaaccgugacauca

SEQ ID NO: 612981 - RNA, 22 nt, Homo sapiens
gacugaguacguugugcauuug

SEQ ID NO: 612982 - RNA, 13 nt, Homo sapiens
gacugaguccucg

SEQ ID NO: 612983 - RNA, 18 nt, Homo sapiens
gacugaugagcacaucuc

SEQ ID NO: 612984 - RNA, 15 nt, Homo sapiens
gacugcacaggugac

SEQ ID NO: 612985 - RNA, 17 nt, Homo sapiens
gacugcagugcuguaaa

SEQ ID NO: 612986 - RNA, 20 nt, Homo sapiens
gacugccacccacacgcccu

SEQ ID NO: 612987 - RNA, 18 nt, Homo sapiens
gacugccaugcuagacaa

SEQ ID NO: 612988 - RNA, 12 nt, Homo sapiens
gacugcugugaa

SEQ ID NO: 612989 - RNA, 18 nt, Homo sapiens
gacuggacccccuggaag

SEQ ID NO: 612990 - RNA, 13 nt, Homo sapiens
gacuggagcucau

SEQ ID NO: 612991 - RNA, 17 nt, Homo sapiens
gacuggagcucaucugc

SEQ ID NO: 612992 - RNA, 15 nt, Homo sapiens
gacuggaggugggca

SEQ ID NO: 612993 - RNA, 19 nt, Homo sapiens
gacuggaguucaguggugc

SEQ ID NO: 612994 - RNA, 20 nt, Homo sapiens
gacuggaguucaguggugca

SEQ ID NO: 612995 - RNA, 12 nt, Homo sapiens
gacuggcaauaa

SEQ ID NO: 612996 - RNA, 23 nt, Homo sapiens
gacuggcaauaaacuccuacuaa

SEQ ID NO: 612997 - RNA, 23 nt, Homo sapiens
gacugggacagcccaggaaacaa

SEQ ID NO: 612998 - RNA, 17 nt, Homo sapiens
gacugggggacugggag

SEQ ID NO: 612999 - RNA, 13 nt, Homo sapiens
gacugguacucaa

SEQ ID NO: 613000 - RNA, 19 nt, Homo sapiens
gacuggucaccuugcacuc

SEQ ID NO: 613001 - RNA, 20 nt, Homo sapiens
gacuggucaccuugcacucc

SEQ ID NO: 613002 - RNA, 12 nt, Homo sapiens
gacugguugguu

SEQ ID NO: 613003 - RNA, 18 nt, Homo sapiens
gacugguugguuuugcca

SEQ ID NO: 613004 - RNA, 16 nt, Homo sapiens
gacugguuuucugcca

SEQ ID NO: 613005 - RNA, 19 nt, Homo sapiens
gacugucuagccacucccu

SEQ ID NO: 613006 - RNA, 11 nt, Homo sapiens
gacugucuaua

SEQ ID NO: 613007 - RNA, 11 nt, Homo sapiens
gacugugccug

SEQ ID NO: 613008 - RNA, 20 nt, Homo sapiens
gacuguggcugcuagcacuu

SEQ ID NO: 613009 - RNA, 12 nt, Homo sapiens
gacuguguuucc

SEQ ID NO: 613010 - RNA, 17 nt, Homo sapiens
gacuguugccacuuaac

SEQ ID NO: 613011 - RNA, 16 nt, Homo sapiens
gacuguuuuuuucaca

SEQ ID NO: 613012 - RNA, 23 nt, Homo sapiens
gacuuacuaugggauggggucca

SEQ ID NO: 613013 - RNA, 13 nt, Homo sapiens
gacuuacugggug

SEQ ID NO: 613014 - RNA, 14 nt, Homo sapiens
gacuuacuugcauu

SEQ ID NO: 613015 - RNA, 23 nt, Homo sapiens
gacuuacuuuccugugguuuuau

SEQ ID NO: 613016 - RNA, 18 nt, Homo sapiens
gacuuaggaaccuaccag

SEQ ID NO: 613017 - RNA, 22 nt, Homo sapiens
gacuuauacuugccuucugaua

SEQ ID NO: 613018 - RNA, 16 nt, Homo sapiens
gacuuauuaugcauaa

SEQ ID NO: 613019 - RNA, 15 nt, Homo sapiens
gagcacucucacccc

SEQ ID NO: 613020 - RNA, 21 nt, Homo sapiens
gagcacuggguugacuuucag

SEQ ID NO: 613021 - RNA, 23 nt, Homo sapiens
gagcacuuuugaaaagcuugucc

SEQ ID NO: 613022 - RNA, 24 nt, Homo sapiens
gagcacuuuugaaaagcuugucca

SEQ ID NO: 613023 - RNA, 15 nt, Homo sapiens
gagcagaagcuggag

SEQ ID NO: 613024 - RNA, 21 nt, Homo sapiens
gagcagaauguuguacuugaa

SEQ ID NO: 613025 - RNA, 17 nt, Homo sapiens
gagcagagccuacagaa

SEQ ID NO: 613026 - RNA, 23 nt, Homo sapiens
gagcagagcucuccccuccugcu

SEQ ID NO: 613027 - RNA, 17 nt, Homo sapiens
gagcagcaagaagcagc

SEQ ID NO: 613028 - RNA, 14 nt, Homo sapiens
gagcagcagcacca

SEQ ID NO: 613029 - RNA, 22 nt, Homo sapiens
gagcagcagcaccuuucucuga

SEQ ID NO: 613030 - RNA, 22 nt, Homo sapiens
gagcagcuuuaaacucagggac

SEQ ID NO: 613031 - RNA, 18 nt, Homo sapiens
gagcaggaccuacuagga

SEQ ID NO: 613032 - RNA, 18 nt, Homo sapiens
gagcagggagaagccaga

SEQ ID NO: 613033 - RNA, 18 nt, Homo sapiens
gagcaguagguaggcuca

SEQ ID NO: 613034 - RNA, 15 nt, Homo sapiens
gagcagucagggugg

SEQ ID NO: 613035 - RNA, 17 nt, Homo sapiens
gagcaguccugccucag

SEQ ID NO: 613036 - RNA, 19 nt, Homo sapiens
gagcaguggcugguccagg

SEQ ID NO: 613037 - RNA, 19 nt, Homo sapiens
gagcaguuagcucauuuga

SEQ ID NO: 613038 - RNA, 22 nt, Homo sapiens
gagcauccucucucacauggaa

SEQ ID NO: 613039 - RNA, 15 nt, Homo sapiens
gagcaucggagggag

SEQ ID NO: 613040 - RNA, 14 nt, Homo sapiens
gagcaugcacaugc

SEQ ID NO: 613041 - RNA, 23 nt, Homo sapiens
gagcaugcucaguuggugcugcu

SEQ ID NO: 613042 - RNA, 15 nt, Homo sapiens
gagcaugcuuaccuu

SEQ ID NO: 613043 - RNA, 17 nt, Homo sapiens
gagcaugggacuguucu

SEQ ID NO: 613044 - RNA, 21 nt, Homo sapiens
gagcauuggccccugagccca

SEQ ID NO: 613045 - RNA, 16 nt, Homo sapiens
gagccaaaaugacuuu

SEQ ID NO: 613046 - RNA, 22 nt, Homo sapiens
gagccaacaacucugauuaacu

SEQ ID NO: 613047 - RNA, 12 nt, Homo sapiens
gagccaaccucg

SEQ ID NO: 613048 - RNA, 15 nt, Homo sapiens
gagccaccaguucuc

SEQ ID NO: 613049 - RNA, 17 nt, Homo sapiens
gagccacgcagugccug

SEQ ID NO: 613050 - RNA, 18 nt, Homo sapiens
gagccagcccuccuugac

SEQ ID NO: 613051 - RNA, 17 nt, Homo sapiens
gagccaggacaugaaga

SEQ ID NO: 613052 - RNA, 17 nt, Homo sapiens
gagccagugagggcagu

SEQ ID NO: 613053 - RNA, 20 nt, Homo sapiens
gagccaugauuuucuaaaaa

SEQ ID NO: 613054 - RNA, 16 nt, Homo sapiens
gagcccacugcaguua

SEQ ID NO: 613055 - RNA, 22 nt, Homo sapiens
gagcccagaucaccaccugaac

SEQ ID NO: 613056 - RNA, 21 nt, Homo sapiens
gagcccagaucgcaccacugc

SEQ ID NO: 613057 - RNA, 21 nt, Homo sapiens
gagcccaggaguucaagacca

SEQ ID NO: 613058 - RNA, 24 nt, Homo sapiens
gagcccagggcaucuugcuggcua

SEQ ID NO: 613059 - RNA, 14 nt, Homo sapiens
gagccccacacgga

SEQ ID NO: 613060 - RNA, 14 nt, Homo sapiens
gagccccacgcugu

SEQ ID NO: 613061 - RNA, 16 nt, Homo sapiens
gagcccccacauucuc

SEQ ID NO: 613062 - RNA, 15 nt, Homo sapiens
gagcccccacccggg

SEQ ID NO: 613063 - RNA, 20 nt, Homo sapiens
gagcccccacccgggagcag

SEQ ID NO: 613064 - RNA, 13 nt, Homo sapiens
gagcccucaggag

SEQ ID NO: 613065 - RNA, 16 nt, Homo sapiens
gagccgcgucccggca

SEQ ID NO: 613066 - RNA, 13 nt, Homo sapiens
gagccgguggugc

SEQ ID NO: 613067 - RNA, 16 nt, Homo sapiens
gagccuagaacauccc

SEQ ID NO: 613068 - RNA, 20 nt, Homo sapiens
gagccuccaugccuggccca

SEQ ID NO: 613069 - RNA, 20 nt, Homo sapiens
gagccucccugcagccacca

SEQ ID NO: 613070 - RNA, 15 nt, Homo sapiens
gagccuccucagggg

SEQ ID NO: 613071 - RNA, 16 nt, Homo sapiens
gagccuccugugccug

SEQ ID NO: 613072 - RNA, 20 nt, Homo sapiens
gagccucgccccuccagugu

SEQ ID NO: 613073 - RNA, 15 nt, Homo sapiens
gagccugaacaugcc

SEQ ID NO: 613074 - RNA, 16 nt, Homo sapiens
gagccugcugcauggg

SEQ ID NO: 613075 - RNA, 12 nt, Homo sapiens
gagccuggagaa

SEQ ID NO: 613076 - RNA, 22 nt, Homo sapiens
gagccuggcuggagagcugcua

SEQ ID NO: 613077 - RNA, 15 nt, Homo sapiens
gagccugggccagga

SEQ ID NO: 613078 - RNA, 23 nt, Homo sapiens
gagccugggguguccuacaguga

SEQ ID NO: 613079 - RNA, 19 nt, Homo sapiens
gagccugugccuuccuccc

SEQ ID NO: 613080 - RNA, 13 nt, Homo sapiens
gagccuuugccuu

SEQ ID NO: 613081 - RNA, 16 nt, Homo sapiens
gagccuuuggccagaa

SEQ ID NO: 613082 - RNA, 13 nt, Homo sapiens
gagcgaaacucca

SEQ ID NO: 613083 - RNA, 19 nt, Homo sapiens
gagcgagauuccgucucaa

SEQ ID NO: 613084 - RNA, 16 nt, Homo sapiens
gagcgaggucagagga

SEQ ID NO: 613085 - RNA, 18 nt, Homo sapiens
gagcggcugcccgacuca

SEQ ID NO: 613086 - RNA, 21 nt, Homo sapiens
gagcgucacugcccaccaaag

SEQ ID NO: 613087 - RNA, 22 nt, Homo sapiens
gagcgucacugcccaccaaagg

SEQ ID NO: 613088 - RNA, 16 nt, Homo sapiens
gagcguucucuguccu

SEQ ID NO: 613089 - RNA, 16 nt, Homo sapiens
gagcuaaacuccuucc

SEQ ID NO: 613090 - RNA, 17 nt, Homo sapiens
gagcuaauuuacuggac

SEQ ID NO: 613091 - RNA, 12 nt, Homo sapiens
gagcuacaguag

SEQ ID NO: 613092 - RNA, 14 nt, Homo sapiens
gagcuacugaugaa

SEQ ID NO: 613093 - RNA, 19 nt, Homo sapiens
gagcuagaugugucuuacc

SEQ ID NO: 613094 - RNA, 17 nt, Homo sapiens
gagcuauggcccagaaa

SEQ ID NO: 613095 - RNA, 19 nt, Homo sapiens
gagcuauuuuccucuggcc

SEQ ID NO: 613096 - RNA, 20 nt, Homo sapiens
gagcucaagugaucuuccca

SEQ ID NO: 613097 - RNA, 11 nt, Homo sapiens
gagcucaccag

SEQ ID NO: 613098 - RNA, 10 nt, Homo sapiens
gagcucaggc

SEQ ID NO: 613099 - RNA, 21 nt, Homo sapiens
gagcucaggucccaggccagc

SEQ ID NO: 613100 - RNA, 15 nt, Homo sapiens
gagcucccaccuccc

SEQ ID NO: 613101 - RNA, 17 nt, Homo sapiens
gagcuccccagaucucc

SEQ ID NO: 613102 - RNA, 21 nt, Homo sapiens
gagcuccccagaucucccacu

SEQ ID NO: 613103 - RNA, 20 nt, Homo sapiens
gagcucgggguccaccagug

SEQ ID NO: 613104 - RNA, 15 nt, Homo sapiens
gagcucugcgccagg

SEQ ID NO: 613105 - RNA, 21 nt, Homo sapiens
gagcucuucgguuucugagca

SEQ ID NO: 613106 - RNA, 22 nt, Homo sapiens
gagcugaacccauuuugaguga

SEQ ID NO: 613107 - RNA, 16 nt, Homo sapiens
gagcugaagaccuaaa

SEQ ID NO: 613108 - RNA, 23 nt, Homo sapiens
gagcugaauguuuguuucagugc

SEQ ID NO: 613109 - RNA, 21 nt, Homo sapiens
gagcugaauuaccuuucacuu

SEQ ID NO: 613110 - RNA, 14 nt, Homo sapiens
gagcugagaucacg

SEQ ID NO: 613111 - RNA, 21 nt, Homo sapiens
gagcugaguggccagccagug

SEQ ID NO: 613112 - RNA, 21 nt, Homo sapiens
gagcugauacuuugacagugu

SEQ ID NO: 613113 - RNA, 14 nt, Homo sapiens
gagcugccauguca

SEQ ID NO: 613114 - RNA, 15 nt, Homo sapiens
gagcugccaugucag

SEQ ID NO: 613115 - RNA, 22 nt, Homo sapiens
gagcuggccucucuagcacaau

SEQ ID NO: 613116 - RNA, 18 nt, Homo sapiens
gagcugggagacaaagga

SEQ ID NO: 613117 - RNA, 21 nt, Homo sapiens
gagcuggggcugccagccuga

SEQ ID NO: 613118 - RNA, 20 nt, Homo sapiens
gagcugggggaagaagggau

SEQ ID NO: 613119 - RNA, 14 nt, Homo sapiens
gagcugggggccau

SEQ ID NO: 613120 - RNA, 16 nt, Homo sapiens
gagcugggggccauga

SEQ ID NO: 613121 - RNA, 23 nt, Homo sapiens
gagcuggggugcacuggggaccc

SEQ ID NO: 613122 - RNA, 14 nt, Homo sapiens
gagcuguuacugaa

SEQ ID NO: 613123 - RNA, 18 nt, Homo sapiens
gagcuuaaacagaagcag

SEQ ID NO: 613124 - RNA, 18 nt, Homo sapiens
gagcuucauauaccagca

SEQ ID NO: 613125 - RNA, 13 nt, Homo sapiens
gagcuugauuaaa

SEQ ID NO: 613126 - RNA, 13 nt, Homo sapiens
gagcuugcaguga

SEQ ID NO: 613127 - RNA, 16 nt, Homo sapiens
gagcuuggcagcugaa

SEQ ID NO: 613128 - RNA, 13 nt, Homo sapiens
gagcuuggccaga

SEQ ID NO: 613129 - RNA, 23 nt, Homo sapiens
gagcuuggcguuuggacccaguu

SEQ ID NO: 613130 - RNA, 17 nt, Homo sapiens
gagcuuucucaaugucu

SEQ ID NO: 613131 - RNA, 18 nt, Homo sapiens
gagcuuugguaaucucug

SEQ ID NO: 613132 - RNA, 20 nt, Homo sapiens
gagcuuuuaaaaauguccug

SEQ ID NO: 613133 - RNA, 15 nt, Homo sapiens
gagcuuuucuggaau

SEQ ID NO: 613134 - RNA, 22 nt, Homo sapiens
gaggaaaaguaaggugcaguuc

SEQ ID NO: 613135 - RNA, 20 nt, Homo sapiens
gaggaaaagugcaaguccau

SEQ ID NO: 613136 - RNA, 14 nt, Homo sapiens
gaggaaaccuagca

SEQ ID NO: 613137 - RNA, 13 nt, Homo sapiens
gaggaaacuugca

SEQ ID NO: 613138 - RNA, 12 nt, Homo sapiens
gaggaacauuca

SEQ ID NO: 613139 - RNA, 17 nt, Homo sapiens
gaggaacuguccagaga

SEQ ID NO: 613140 - RNA, 14 nt, Homo sapiens
gauccagacuguaa

SEQ ID NO: 613141 - RNA, 19 nt, Homo sapiens
gauccagauccagacugua

SEQ ID NO: 613142 - RNA, 21 nt, Homo sapiens
gauccagauguuaugcuccug

SEQ ID NO: 613143 - RNA, 22 nt, Homo sapiens
gauccagucuggaaaacagaaa

SEQ ID NO: 613144 - RNA, 22 nt, Homo sapiens
gauccaucuuaacugaggcuca

SEQ ID NO: 613145 - RNA, 18 nt, Homo sapiens
gaucccacuucacuguga

SEQ ID NO: 613146 - RNA, 19 nt, Homo sapiens
gaucccaggggaguguuca

SEQ ID NO: 613147 - RNA, 20 nt, Homo sapiens
gauccccaaaacaggccagg

SEQ ID NO: 613148 - RNA, 17 nt, Homo sapiens
gaucccgcccugaccca

SEQ ID NO: 613149 - RNA, 15 nt, Homo sapiens
gaucccguguugcca

SEQ ID NO: 613150 - RNA, 14 nt, Homo sapiens
gauccgagucuacc

SEQ ID NO: 613151 - RNA, 15 nt, Homo sapiens
gauccgcuccagcgu

SEQ ID NO: 613152 - RNA, 19 nt, Homo sapiens
gauccgggagacugacacg

SEQ ID NO: 613153 - RNA, 18 nt, Homo sapiens
gauccuaguaauugccua

SEQ ID NO: 613154 - RNA, 19 nt, Homo sapiens
gauccucaugguucccaag

SEQ ID NO: 613155 - RNA, 22 nt, Homo sapiens
gauccugcacucuaacacucga

SEQ ID NO: 613156 - RNA, 17 nt, Homo sapiens
gauccuguugggaaaga

SEQ ID NO: 613157 - RNA, 22 nt, Homo sapiens
gauccuuauuuaaagcuuucaa

SEQ ID NO: 613158 - RNA, 20 nt, Homo sapiens
gauccuucaaagagucauau

SEQ ID NO: 613159 - RNA, 16 nt, Homo sapiens
gauccuuccaccucag

SEQ ID NO: 613160 - RNA, 22 nt, Homo sapiens
gauccuuccaccucagucuccc

SEQ ID NO: 613161 - RNA, 18 nt, Homo sapiens
gaucgaguguagcuguga

SEQ ID NO: 613162 - RNA, 20 nt, Homo sapiens
gaucgcaccauugcacucca

SEQ ID NO: 613163 - RNA, 12 nt, Homo sapiens
gaucgcaccuuu

SEQ ID NO: 613164 - RNA, 14 nt, Homo sapiens
gaucggacucugcc

SEQ ID NO: 613165 - RNA, 20 nt, Homo sapiens
gaucuaagccuuuccauaag

SEQ ID NO: 613166 - RNA, 12 nt, Homo sapiens
gaucuacaccca

SEQ ID NO: 613167 - RNA, 10 nt, Homo sapiens
gaucuaccug

SEQ ID NO: 613168 - RNA, 21 nt, Homo sapiens
gaucuacuucauagcuccuug

SEQ ID NO: 613169 - RNA, 23 nt, Homo sapiens
gaucuacuuuuugaacuuuucau

SEQ ID NO: 613170 - RNA, 22 nt, Homo sapiens
gaucuaguucucaaucacugcu

SEQ ID NO: 613171 - RNA, 16 nt, Homo sapiens
gaucucagagcauuuc

SEQ ID NO: 613172 - RNA, 15 nt, Homo sapiens
gaucuccugaccucg

SEQ ID NO: 613173 - RNA, 14 nt, Homo sapiens
gaucuccuguccau

SEQ ID NO: 613174 - RNA, 15 nt, Homo sapiens
gaucugaacccagcu

SEQ ID NO: 613175 - RNA, 20 nt, Homo sapiens
gaucugagcucccaccuccc

SEQ ID NO: 613176 - RNA, 11 nt, Homo sapiens
gaucugaugaa

SEQ ID NO: 613177 - RNA, 19 nt, Homo sapiens
gaucugaugaaaaggucag

SEQ ID NO: 613178 - RNA, 18 nt, Homo sapiens
gaucugcaguuuuugccu

SEQ ID NO: 613179 - RNA, 15 nt, Homo sapiens
gaucuggcacacucc

SEQ ID NO: 613180 - RNA, 19 nt, Homo sapiens
gaucuggcacacucccucu

SEQ ID NO: 613181 - RNA, 19 nt, Homo sapiens
gaucuggcccuugcuuacc

SEQ ID NO: 613182 - RNA, 22 nt, Homo sapiens
gaucuggggaggcaggcauucc

SEQ ID NO: 613183 - RNA, 21 nt, Homo sapiens
gaucuggucuaguuaaccuag

SEQ ID NO: 613184 - RNA, 12 nt, Homo sapiens
gaucuguagaag

SEQ ID NO: 613185 - RNA, 14 nt, Homo sapiens
gaucuguccaccuc

SEQ ID NO: 613186 - RNA, 13 nt, Homo sapiens
gaucugugauagu

SEQ ID NO: 613187 - RNA, 20 nt, Homo sapiens
gaucuguguuuuauugacau

SEQ ID NO: 613188 - RNA, 16 nt, Homo sapiens
gaucuuaaagcauucc

SEQ ID NO: 613189 - RNA, 16 nt, Homo sapiens
gaucuugcauucccag

SEQ ID NO: 613190 - RNA, 21 nt, Homo sapiens
gaucuugccugucuggcucag

SEQ ID NO: 613191 - RNA, 19 nt, Homo sapiens
gaucuuuccaaauacccaa

SEQ ID NO: 613192 - RNA, 17 nt, Homo sapiens
gaucuuucuuuccaaaa

SEQ ID NO: 613193 - RNA, 22 nt, Homo sapiens
gaugaaagaggggugggaucca

SEQ ID NO: 613194 - RNA, 18 nt, Homo sapiens
gaugaaaguacauuggga

SEQ ID NO: 613195 - RNA, 17 nt, Homo sapiens
gaugaaauuauuuguca

SEQ ID NO: 613196 - RNA, 20 nt, Homo sapiens
gaugaaauuuucuagacuuu

SEQ ID NO: 613197 - RNA, 16 nt, Homo sapiens
gaugaacuguggugcc

SEQ ID NO: 613198 - RNA, 17 nt, Homo sapiens
gaugaacuguggugcca

SEQ ID NO: 613199 - RNA, 18 nt, Homo sapiens
gaugaacuuugucauuau

SEQ ID NO: 613200 - RNA, 23 nt, Homo sapiens
gaugaagcugagcuuuugaugcc

SEQ ID NO: 613201 - RNA, 21 nt, Homo sapiens
gaugaaguuuuacauuguuga

SEQ ID NO: 613202 - RNA, 20 nt, Homo sapiens
gaugaauagaugugaucacu

SEQ ID NO: 613203 - RNA, 15 nt, Homo sapiens
gaugaaucauauuca

SEQ ID NO: 613204 - RNA, 17 nt, Homo sapiens
gaugaauguaugugcac

SEQ ID NO: 613205 - RNA, 18 nt, Homo sapiens
gaugaccagaacaagguu

SEQ ID NO: 613206 - RNA, 15 nt, Homo sapiens
gaugacccucugacc

SEQ ID NO: 613207 - RNA, 18 nt, Homo sapiens
gaugacccuuuucaugau

SEQ ID NO: 613208 - RNA, 21 nt, Homo sapiens
gaugacgauucuuaacaauaa

SEQ ID NO: 613209 - RNA, 16 nt, Homo sapiens
gaugacucaaggccaa

SEQ ID NO: 613210 - RNA, 15 nt, Homo sapiens
gaugacucucuccaa

SEQ ID NO: 613211 - RNA, 15 nt, Homo sapiens
gaugacugcugugaa

SEQ ID NO: 613212 - RNA, 16 nt, Homo sapiens
gaugacugcugugaaa

SEQ ID NO: 613213 - RNA, 14 nt, Homo sapiens
gaugacuguugaug

SEQ ID NO: 613214 - RNA, 18 nt, Homo sapiens
gaugacuuaccuguucag

SEQ ID NO: 613215 - RNA, 17 nt, Homo sapiens
gaugacuuugagauuau

SEQ ID NO: 613216 - RNA, 14 nt, Homo sapiens
gaugagagggaaaa

SEQ ID NO: 613217 - RNA, 15 nt, Homo sapiens
gaugagaugacagau

SEQ ID NO: 613218 - RNA, 21 nt, Homo sapiens
gaugagauuggcauggcuuua

SEQ ID NO: 613219 - RNA, 17 nt, Homo sapiens
gaugagcaagacauacu

SEQ ID NO: 613220 - RNA, 18 nt, Homo sapiens
gaugagcaagacauacuu

SEQ ID NO: 613221 - RNA, 13 nt, Homo sapiens
gaugaggggccac

SEQ ID NO: 613222 - RNA, 14 nt, Homo sapiens
gaugaggggugcug

SEQ ID NO: 613223 - RNA, 15 nt, Homo sapiens
gaugaggucugauaa

SEQ ID NO: 613224 - RNA, 13 nt, Homo sapiens
gaugaggugcuuu

SEQ ID NO: 613225 - RNA, 16 nt, Homo sapiens
gaugauacacuaugaa

SEQ ID NO: 613226 - RNA, 21 nt, Homo sapiens
gaugaucaaaaccugugccag

SEQ ID NO: 613227 - RNA, 14 nt, Homo sapiens
gaugaucagggauc

SEQ ID NO: 613228 - RNA, 17 nt, Homo sapiens
gaugaucagggauccaa

SEQ ID NO: 613229 - RNA, 12 nt, Homo sapiens
gaugaucuucag

SEQ ID NO: 613230 - RNA, 18 nt, Homo sapiens
gaugaugacguccucuca

SEQ ID NO: 613231 - RNA, 16 nt, Homo sapiens
gaugauggaugccaau

SEQ ID NO: 613232 - RNA, 18 nt, Homo sapiens
gaugaugucggucuugca

SEQ ID NO: 613233 - RNA, 18 nt, Homo sapiens
gaugauucuuaacacagc

SEQ ID NO: 613234 - RNA, 23 nt, Homo sapiens
gaugauuuguauguuaaagugac

SEQ ID NO: 613235 - RNA, 23 nt, Homo sapiens
gaugauuuuguaaaaguggcauu

SEQ ID NO: 613236 - RNA, 14 nt, Homo sapiens
gaugcaagugcaac

SEQ ID NO: 613237 - RNA, 18 nt, Homo sapiens
gaugcaauauaagcauaa

SEQ ID NO: 613238 - RNA, 21 nt, Homo sapiens
gaugcacucucagaccaagca

SEQ ID NO: 613239 - RNA, 17 nt, Homo sapiens
gaugcacuuauucaaua

SEQ ID NO: 613240 - RNA, 17 nt, Homo sapiens
gaugcagcuacuggaau

SEQ ID NO: 613241 - RNA, 21 nt, Homo sapiens
gaugcaucacacucaaggaca

SEQ ID NO: 613242 - RNA, 12 nt, Homo sapiens
gaugcauuuaau

SEQ ID NO: 613243 - RNA, 20 nt, Homo sapiens
gaugccaaccagacaccucc

SEQ ID NO: 613244 - RNA, 16 nt, Homo sapiens
gaugccaacuucccac

SEQ ID NO: 613245 - RNA, 13 nt, Homo sapiens
gaugccauagcau

SEQ ID NO: 613246 - RNA, 22 nt, Homo sapiens
gaugccgagguaaaaguucuuu

SEQ ID NO: 613247 - RNA, 18 nt, Homo sapiens
gaugccguucccugaaca

SEQ ID NO: 613248 - RNA, 12 nt, Homo sapiens
gaugccucagag

SEQ ID NO: 613249 - RNA, 13 nt, Homo sapiens
gaugccuguugaa

SEQ ID NO: 613250 - RNA, 16 nt, Homo sapiens
gaugcggccauucaag

SEQ ID NO: 613251 - RNA, 15 nt, Homo sapiens
gaugcguauucugug

SEQ ID NO: 613252 - RNA, 15 nt, Homo sapiens
gaugcguucacucca

SEQ ID NO: 613253 - RNA, 12 nt, Homo sapiens
gaugcuaugaaa

SEQ ID NO: 613254 - RNA, 22 nt, Homo sapiens
gaugcucccuugauggggucca

SEQ ID NO: 613255 - RNA, 18 nt, Homo sapiens
gaugcucuggcuugcccc

SEQ ID NO: 613256 - RNA, 15 nt, Homo sapiens
gaugcugagcuguga

SEQ ID NO: 613257 - RNA, 16 nt, Homo sapiens
gaugcugagcugugau

SEQ ID NO: 613258 - RNA, 17 nt, Homo sapiens
gaugcugaugcuguuaa

SEQ ID NO: 613259 - RNA, 16 nt, Homo sapiens
gaugcugccauuuaac

SEQ ID NO: 613260 - RNA, 14 nt, Homo sapiens
gaugcuguuugaca

SEQ ID NO: 613261 - RNA, 17 nt, Homo sapiens
gaugcuuguucuuuggc

SEQ ID NO: 613262 - RNA, 20 nt, Homo sapiens
gccuucauaagccuaccaau

SEQ ID NO: 613263 - RNA, 14 nt, Homo sapiens
gccuucauucugca

SEQ ID NO: 613264 - RNA, 12 nt, Homo sapiens
gccuuccagguc

SEQ ID NO: 613265 - RNA, 17 nt, Homo sapiens
gccuuccggguucaagu

SEQ ID NO: 613266 - RNA, 16 nt, Homo sapiens
gccuuccucugcagcu

SEQ ID NO: 613267 - RNA, 23 nt, Homo sapiens
gccuuccuuucuccaggaccaau

SEQ ID NO: 613268 - RNA, 22 nt, Homo sapiens
gccuucgcauggcuggccuucc

SEQ ID NO: 613269 - RNA, 17 nt, Homo sapiens
gccuucucaccacagag

SEQ ID NO: 613270 - RNA, 19 nt, Homo sapiens
gccuucugauaguauuccu

SEQ ID NO: 613271 - RNA, 21 nt, Homo sapiens
gccuucugccaacgccuccug

SEQ ID NO: 613272 - RNA, 16 nt, Homo sapiens
gccuugagcccuggcu

SEQ ID NO: 613273 - RNA, 17 nt, Homo sapiens
gccuugaucagugacag

SEQ ID NO: 613274 - RNA, 18 nt, Homo sapiens
gccuugcacacagguguu

SEQ ID NO: 613275 - RNA, 23 nt, Homo sapiens
gccuugccuaaauuuaaugcugc

SEQ ID NO: 613276 - RNA, 17 nt, Homo sapiens
gccuugcggaagccaua

SEQ ID NO: 613277 - RNA, 14 nt, Homo sapiens
gccuugcuuguuaa

SEQ ID NO: 613278 - RNA, 16 nt, Homo sapiens
gccuuggaaccagccc

SEQ ID NO: 613279 - RNA, 18 nt, Homo sapiens
gccuugggcuccugauga

SEQ ID NO: 613280 - RNA, 14 nt, Homo sapiens
gccuuguaccucaa

SEQ ID NO: 613281 - RNA, 22 nt, Homo sapiens
gccuugugcgguuguguucuca

SEQ ID NO: 613282 - RNA, 13 nt, Homo sapiens
gccuuguggcacu

SEQ ID NO: 613283 - RNA, 20 nt, Homo sapiens
gccuugugugaacucaccaa

SEQ ID NO: 613284 - RNA, 22 nt, Homo sapiens
gccuuguucaauaauuacugua

SEQ ID NO: 613285 - RNA, 12 nt, Homo sapiens
gccuuguuucau

SEQ ID NO: 613286 - RNA, 22 nt, Homo sapiens
gccuuguuugaguuuuuccucc

SEQ ID NO: 613287 - RNA, 17 nt, Homo sapiens
gccuuuaucucagccau

SEQ ID NO: 613288 - RNA, 15 nt, Homo sapiens
gccuuucacuuuuag

SEQ ID NO: 613289 - RNA, 20 nt, Homo sapiens
gccuuuccaagucacuagaa

SEQ ID NO: 613290 - RNA, 19 nt, Homo sapiens
gccuuuccaaugaaggaaa

SEQ ID NO: 613291 - RNA, 15 nt, Homo sapiens
gccuuuccucaaaac

SEQ ID NO: 613292 - RNA, 16 nt, Homo sapiens
gccuuuccucggucuc

SEQ ID NO: 613293 - RNA, 20 nt, Homo sapiens
gccuuugaauaaaaaugcac

SEQ ID NO: 613294 - RNA, 18 nt, Homo sapiens
gccuuugcaaaucagugu

SEQ ID NO: 613295 - RNA, 19 nt, Homo sapiens
gccuuuuccaaaugcccaa

SEQ ID NO: 613296 - RNA, 22 nt, Homo sapiens
gccuuuucuggucccucuucuc

SEQ ID NO: 613297 - RNA, 18 nt, Homo sapiens
gccuuuucugugccagac

SEQ ID NO: 613298 - RNA, 18 nt, Homo sapiens
gccuuuugcuacgugccu

SEQ ID NO: 613299 - RNA, 15 nt, Homo sapiens
gccuuuugugugaug

SEQ ID NO: 613300 - RNA, 20 nt, Homo sapiens
gccuuuuuguauaaaauaga

SEQ ID NO: 613301 - RNA, 20 nt, Homo sapiens
gccuuuuuuuauagcuggaa

SEQ ID NO: 613302 - RNA, 17 nt, Homo sapiens
gcgaaaaaaucagugaa

SEQ ID NO: 613303 - RNA, 20 nt, Homo sapiens
gcgaaaccucaucucuacua

SEQ ID NO: 613304 - RNA, 18 nt, Homo sapiens
gcgaaggggcccuggucc

SEQ ID NO: 613305 - RNA, 12 nt, Homo sapiens
gcgaaugugcag

SEQ ID NO: 613306 - RNA, 17 nt, Homo sapiens
gcgacccauucagagac

SEQ ID NO: 613307 - RNA, 11 nt, Homo sapiens
gcgacugagaa

SEQ ID NO: 613308 - RNA, 19 nt, Homo sapiens
gcgagacuccgucucaaaa

SEQ ID NO: 613309 - RNA, 13 nt, Homo sapiens
gcgagacugagag

SEQ ID NO: 613310 - RNA, 16 nt, Homo sapiens
gcgagagaaagggagu

SEQ ID NO: 613311 - RNA, 13 nt, Homo sapiens
gcgagcagucagc

SEQ ID NO: 613312 - RNA, 15 nt, Homo sapiens
gcgagcccucaggug

SEQ ID NO: 613313 - RNA, 17 nt, Homo sapiens
gcgagcugcucugcuau

SEQ ID NO: 613314 - RNA, 21 nt, Homo sapiens
gcgaggucagaggagggcaug

SEQ ID NO: 613315 - RNA, 11 nt, Homo sapiens
gcgaguguuuc

SEQ ID NO: 613316 - RNA, 23 nt, Homo sapiens
gcgauccucuugggcucuccuag

SEQ ID NO: 613317 - RNA, 15 nt, Homo sapiens
gcgauguaugcagcu

SEQ ID NO: 613318 - RNA, 14 nt, Homo sapiens
gcgaugugcaagug

SEQ ID NO: 613319 - RNA, 20 nt, Homo sapiens
gcgcaauugaaggaucaucu

SEQ ID NO: 613320 - RNA, 20 nt, Homo sapiens
gcgcagggacauggggcaag

SEQ ID NO: 613321 - RNA, 23 nt, Homo sapiens
gcgcaggguggugguauucuguc

SEQ ID NO: 613322 - RNA, 20 nt, Homo sapiens
gcgcaguguuuugcaagugc

SEQ ID NO: 613323 - RNA, 12 nt, Homo sapiens
gcgcauggugca

SEQ ID NO: 613324 - RNA, 15 nt, Homo sapiens
gcgccacccgggcaa

SEQ ID NO: 613325 - RNA, 20 nt, Homo sapiens
gcgccacccgggcaaggguc

SEQ ID NO: 613326 - RNA, 15 nt, Homo sapiens
gcgccacugcacucc

SEQ ID NO: 613327 - RNA, 23 nt, Homo sapiens
gcgcccugcaccugacagcuuua

SEQ ID NO: 613328 - RNA, 20 nt, Homo sapiens
gcgccgcaaaccacacugga

SEQ ID NO: 613329 - RNA, 24 nt, Homo sapiens
gcgccuccaccccgacugcucagu

SEQ ID NO: 613330 - RNA, 15 nt, Homo sapiens
gcgccuccagagguc

SEQ ID NO: 613331 - RNA, 20 nt, Homo sapiens
gcgccugcugccugcugaga

SEQ ID NO: 613332 - RNA, 18 nt, Homo sapiens
gcgccuugcugauggcuu

SEQ ID NO: 613333 - RNA, 14 nt, Homo sapiens
gcgcgacugagaac

SEQ ID NO: 613334 - RNA, 15 nt, Homo sapiens
gcgcggccacagggg

SEQ ID NO: 613335 - RNA, 23 nt, Homo sapiens
gcgcuagugccuugcccacaggu

SEQ ID NO: 613336 - RNA, 18 nt, Homo sapiens
gcgcucauucuauuuuau

SEQ ID NO: 613337 - RNA, 17 nt, Homo sapiens
gcgcucgccacgcucag

SEQ ID NO: 613338 - RNA, 19 nt, Homo sapiens
gcgcucggcuccaccccag

SEQ ID NO: 613339 - RNA, 17 nt, Homo sapiens
gcgcuguucuugcucca

SEQ ID NO: 613340 - RNA, 14 nt, Homo sapiens
gcgcuucaucucau

SEQ ID NO: 613341 - RNA, 15 nt, Homo sapiens
gcgcuuggcaucaca

SEQ ID NO: 613342 - RNA, 14 nt, Homo sapiens
gcggaaacaggugu

SEQ ID NO: 613343 - RNA, 13 nt, Homo sapiens
gcggaggcugugu

SEQ ID NO: 613344 - RNA, 17 nt, Homo sapiens
gcggagguugcaaugag

SEQ ID NO: 613345 - RNA, 16 nt, Homo sapiens
gcggcagcauggagcu

SEQ ID NO: 613346 - RNA, 12 nt, Homo sapiens
gcggccacugcg

SEQ ID NO: 613347 - RNA, 13 nt, Homo sapiens
gcggcccagaccc

SEQ ID NO: 613348 - RNA, 15 nt, Homo sapiens
gcggcccagacccac

SEQ ID NO: 613349 - RNA, 12 nt, Homo sapiens
gcggccucaggg

SEQ ID NO: 613350 - RNA, 15 nt, Homo sapiens
gcggcgucccuucca

SEQ ID NO: 613351 - RNA, 22 nt, Homo sapiens
gcgggaaaauaaaccacugguc

SEQ ID NO: 613352 - RNA, 15 nt, Homo sapiens
gcgggaggcagaguu

SEQ ID NO: 613353 - RNA, 13 nt, Homo sapiens
gcgggaggcggug

SEQ ID NO: 613354 - RNA, 18 nt, Homo sapiens
gcgggccagccaggcggg

SEQ ID NO: 613355 - RNA, 22 nt, Homo sapiens
gcgggcucagagcuuugucacu

SEQ ID NO: 613356 - RNA, 15 nt, Homo sapiens
gcggggaucugauga

SEQ ID NO: 613357 - RNA, 18 nt, Homo sapiens
gcgggggggggggcggug

SEQ ID NO: 613358 - RNA, 15 nt, Homo sapiens
gcgggugauggccag

SEQ ID NO: 613359 - RNA, 24 nt, Homo sapiens
gcgguggccacagcgugcuggcga

SEQ ID NO: 613360 - RNA, 19 nt, Homo sapiens
gcggugugugugccauguc

SEQ ID NO: 613361 - RNA, 22 nt, Homo sapiens
gcguaagaugauggauuugauu

SEQ ID NO: 613362 - RNA, 17 nt, Homo sapiens
gcguaguccgcuuucuc

SEQ ID NO: 613363 - RNA, 22 nt, Homo sapiens
gcguauguucguugcagcacug

SEQ ID NO: 613364 - RNA, 20 nt, Homo sapiens
gcgucaagucuaaaccaaga

SEQ ID NO: 613365 - RNA, 18 nt, Homo sapiens
gcgucaugcuuguguuau

SEQ ID NO: 613366 - RNA, 21 nt, Homo sapiens
gcguccaccaggccucacugg

SEQ ID NO: 613367 - RNA, 20 nt, Homo sapiens
gcguccauauuuaacaugua

SEQ ID NO: 613368 - RNA, 19 nt, Homo sapiens
gcgucugccccacccucaa

SEQ ID NO: 613369 - RNA, 21 nt, Homo sapiens
gcgugcucccgaugcugcuau

SEQ ID NO: 613370 - RNA, 23 nt, Homo sapiens
gcguggcggagcugcugcugcuc

SEQ ID NO: 613371 - RNA, 20 nt, Homo sapiens
gcgugggucucuggggaccc

SEQ ID NO: 613372 - RNA, 19 nt, Homo sapiens
gcgugguggcgggcaccua

SEQ ID NO: 613373 - RNA, 13 nt, Homo sapiens
gcgugugcguuuc

SEQ ID NO: 613374 - RNA, 13 nt, Homo sapiens
gcgugugugcaag

SEQ ID NO: 613375 - RNA, 14 nt, Homo sapiens
gcgugugugcaagu

SEQ ID NO: 613376 - RNA, 15 nt, Homo sapiens
gcgugugugcaagug

SEQ ID NO: 613377 - RNA, 15 nt, Homo sapiens
gcguuaugugcagua

SEQ ID NO: 613378 - RNA, 14 nt, Homo sapiens
gcguucaccucccu

SEQ ID NO: 613379 - RNA, 15 nt, Homo sapiens
gcguugacuacugcu

SEQ ID NO: 613380 - RNA, 15 nt, Homo sapiens
gcguuguuacaggaa

SEQ ID NO: 613381 - RNA, 19 nt, Homo sapiens
gcguuguugcauguuugaa

SEQ ID NO: 613382 - RNA, 13 nt, Homo sapiens
gcguuugcgggaa

SEQ ID NO: 613383 - RNA, 14 nt, Homo sapiens
gcguuuucauuugu

SEQ ID NO: 613384 - RNA, 16 nt, Homo sapiens
gcugucaagcaccugc

SEQ ID NO: 613385 - RNA, 22 nt, Homo sapiens
gcugucacuugucgggggccca

SEQ ID NO: 613386 - RNA, 21 nt, Homo sapiens
gcugucccaggcaugcagcug

SEQ ID NO: 613387 - RNA, 15 nt, Homo sapiens
gcuguccucuccccc

SEQ ID NO: 613388 - RNA, 18 nt, Homo sapiens
gcuguccugaucugugau

SEQ ID NO: 613389 - RNA, 13 nt, Homo sapiens
gcuguccuuuuag

SEQ ID NO: 613390 - RNA, 18 nt, Homo sapiens
gcugucuaaaaugcagug

SEQ ID NO: 613391 - RNA, 19 nt, Homo sapiens
gcugucuaaaaugcagugg

SEQ ID NO: 613392 - RNA, 23 nt, Homo sapiens
gcugucucaucacauaaaaggcu

SEQ ID NO: 613393 - RNA, 14 nt, Homo sapiens
gcugucuccaugcu

SEQ ID NO: 613394 - RNA, 18 nt, Homo sapiens
gcugucucucccuuccag

SEQ ID NO: 613395 - RNA, 22 nt, Homo sapiens
gcugucucuccuaccugucuuc

SEQ ID NO: 613396 - RNA, 18 nt, Homo sapiens
gcugucuggggccuuuau

SEQ ID NO: 613397 - RNA, 12 nt, Homo sapiens
gcugucugugaa

SEQ ID NO: 613398 - RNA, 23 nt, Homo sapiens
gcugucuuagugcaaaaaacaua

SEQ ID NO: 613399 - RNA, 14 nt, Homo sapiens
gcugucuucuggac

SEQ ID NO: 613400 - RNA, 17 nt, Homo sapiens
gcugugaaagaaccaaa

SEQ ID NO: 613401 - RNA, 23 nt, Homo sapiens
gcugugaaauccauauauaugaa

SEQ ID NO: 613402 - RNA, 23 nt, Homo sapiens
gcugugaccauuuauaauguuag

SEQ ID NO: 613403 - RNA, 22 nt, Homo sapiens
gcugugagccccugguccugag

SEQ ID NO: 613404 - RNA, 21 nt, Homo sapiens
gcugugcauagugguuggcac

SEQ ID NO: 613405 - RNA, 17 nt, Homo sapiens
gcugugccaccaagcau

SEQ ID NO: 613406 - RNA, 13 nt, Homo sapiens
gcugugccccuga

SEQ ID NO: 613407 - RNA, 19 nt, Homo sapiens
gcuguggaggauugcuauc

SEQ ID NO: 613408 - RNA, 19 nt, Homo sapiens
gcugugggccaaaaucaug

SEQ ID NO: 613409 - RNA, 22 nt, Homo sapiens
gcugugggugcagcugucacag

SEQ ID NO: 613410 - RNA, 20 nt, Homo sapiens
gcugugguuccuaagccugu

SEQ ID NO: 613411 - RNA, 18 nt, Homo sapiens
gcuguguuuccaucucaa

SEQ ID NO: 613412 - RNA, 23 nt, Homo sapiens
gcuguguuugcagccugcucuag

SEQ ID NO: 613413 - RNA, 10 nt, Homo sapiens
gcuguuauac

SEQ ID NO: 613414 - RNA, 15 nt, Homo sapiens
gcuguuccuguucag

SEQ ID NO: 613415 - RNA, 22 nt, Homo sapiens
gcuguucucgaacuccugaccu

SEQ ID NO: 613416 - RNA, 12 nt, Homo sapiens
gcuguucuugcu

SEQ ID NO: 613417 - RNA, 22 nt, Homo sapiens
gcuguugacaucagccugcuuc

SEQ ID NO: 613418 - RNA, 18 nt, Homo sapiens
gcuguugaugaggccucu

SEQ ID NO: 613419 - RNA, 13 nt, Homo sapiens
gcuguugcauggg

SEQ ID NO: 613420 - RNA, 14 nt, Homo sapiens
gcuguugcauuuag

SEQ ID NO: 613421 - RNA, 18 nt, Homo sapiens
gcuguuugccaagcugaa

SEQ ID NO: 613422 - RNA, 15 nt, Homo sapiens
gcuguuuguagugaa

SEQ ID NO: 613423 - RNA, 22 nt, Homo sapiens
gcuguuuguuucauauauacag

SEQ ID NO: 613424 - RNA, 14 nt, Homo sapiens
gcuguuuuagcuga

SEQ ID NO: 613425 - RNA, 22 nt, Homo sapiens
gcuguuuuccucccuucugcua

SEQ ID NO: 613426 - RNA, 21 nt, Homo sapiens
gcuguuuugauuuguacugaa

SEQ ID NO: 613427 - RNA, 16 nt, Homo sapiens
gcuuaaaaucugugaa

SEQ ID NO: 613428 - RNA, 19 nt, Homo sapiens
gcuuaaacccauacaaugu

SEQ ID NO: 613429 - RNA, 21 nt, Homo sapiens
gcuuaaacuugacccaggugg

SEQ ID NO: 613430 - RNA, 15 nt, Homo sapiens
gcuuaaagcuugauu

SEQ ID NO: 613431 - RNA, 23 nt, Homo sapiens
gcuuaacacaguggguggugagu

SEQ ID NO: 613432 - RNA, 20 nt, Homo sapiens
gcuuaaccuuuccaguuuau

SEQ ID NO: 613433 - RNA, 21 nt, Homo sapiens
gcuuaacuccccacugccugu

SEQ ID NO: 613434 - RNA, 20 nt, Homo sapiens
gcuuaagucaucauuacuug

SEQ ID NO: 613435 - RNA, 22 nt, Homo sapiens
gcuuaaucaacagaaguaucaa

SEQ ID NO: 613436 - RNA, 14 nt, Homo sapiens
gcuuaauguuuauu

SEQ ID NO: 613437 - RNA, 20 nt, Homo sapiens
gcuuacacugaggacugugg

SEQ ID NO: 613438 - RNA, 19 nt, Homo sapiens
gcuuacagggcuaggcagu

SEQ ID NO: 613439 - RNA, 21 nt, Homo sapiens
gcuuaccagaagcuuccauag

SEQ ID NO: 613440 - RNA, 22 nt, Homo sapiens
gcuuaccauuaaaguucucaau

SEQ ID NO: 613441 - RNA, 19 nt, Homo sapiens
gcuuaccuaucuguggaaa

SEQ ID NO: 613442 - RNA, 14 nt, Homo sapiens
gcuuacuacaguga

SEQ ID NO: 613443 - RNA, 19 nt, Homo sapiens
gcuuagaaugcaucucauc

SEQ ID NO: 613444 - RNA, 17 nt, Homo sapiens
gcuuaggagacagauca

SEQ ID NO: 613445 - RNA, 18 nt, Homo sapiens
gcuuaggaugugugcaug

SEQ ID NO: 613446 - RNA, 15 nt, Homo sapiens
gcuuaguauuucuca

SEQ ID NO: 613447 - RNA, 17 nt, Homo sapiens
gcuuauaaacacauuga

SEQ ID NO: 613448 - RNA, 23 nt, Homo sapiens
gcuuaugaaaccuguacauaugu

SEQ ID NO: 613449 - RNA, 13 nt, Homo sapiens
gcuuaugaauaua

SEQ ID NO: 613450 - RNA, 20 nt, Homo sapiens
gcuuauucaucuguuuuucu

SEQ ID NO: 613451 - RNA, 19 nt, Homo sapiens
gcuucaacauucuuugcaa

SEQ ID NO: 613452 - RNA, 19 nt, Homo sapiens
gcuucacauagcaugucaa

SEQ ID NO: 613453 - RNA, 21 nt, Homo sapiens
gcuucaccagagcauuuccaa

SEQ ID NO: 613454 - RNA, 17 nt, Homo sapiens
gcuucaccagucugucu

SEQ ID NO: 613455 - RNA, 12 nt, Homo sapiens
gcuucacucucc

SEQ ID NO: 613456 - RNA, 11 nt, Homo sapiens
gcuucacuggu

SEQ ID NO: 613457 - RNA, 22 nt, Homo sapiens
gcuucacugguugaguguugcu

SEQ ID NO: 613458 - RNA, 13 nt, Homo sapiens
gcuucagccugag

SEQ ID NO: 613459 - RNA, 21 nt, Homo sapiens
gcuucagggagcucgcauucu

SEQ ID NO: 613460 - RNA, 18 nt, Homo sapiens
gcuucagugacaaacaua

SEQ ID NO: 613461 - RNA, 20 nt, Homo sapiens
gcuucagugacaaacauauc

SEQ ID NO: 613462 - RNA, 15 nt, Homo sapiens
gcuucaguugcauau

SEQ ID NO: 613463 - RNA, 20 nt, Homo sapiens
gcuucauaaaugaagcagcu

SEQ ID NO: 613464 - RNA, 18 nt, Homo sapiens
gcuucauuugugucaaug

SEQ ID NO: 613465 - RNA, 18 nt, Homo sapiens
gcuuccacaaaauuagaa

SEQ ID NO: 613466 - RNA, 15 nt, Homo sapiens
gcuuccaugauucua

SEQ ID NO: 613467 - RNA, 22 nt, Homo sapiens
gcuuccauuugugugugugcaa

SEQ ID NO: 613468 - RNA, 20 nt, Homo sapiens
gcuucccaaguagcugcaac

SEQ ID NO: 613469 - RNA, 23 nt, Homo sapiens
gcuuccccuuuugccaaucucaa

SEQ ID NO: 613470 - RNA, 23 nt, Homo sapiens
gcuucccuaaacugcagccucuc

SEQ ID NO: 613471 - RNA, 15 nt, Homo sapiens
gcuucccugacucau

SEQ ID NO: 613472 - RNA, 14 nt, Homo sapiens
gcuucgaaguauuc

SEQ ID NO: 613473 - RNA, 15 nt, Homo sapiens
gcuucgacuacugcu

SEQ ID NO: 613474 - RNA, 20 nt, Homo sapiens
gcuucuaaucccagcacuuu

SEQ ID NO: 613475 - RNA, 18 nt, Homo sapiens
gcuucuacggccaugaga

SEQ ID NO: 613476 - RNA, 14 nt, Homo sapiens
gcuucuaggugccc

SEQ ID NO: 613477 - RNA, 21 nt, Homo sapiens
gcuucucaauagaguguuguu

SEQ ID NO: 613478 - RNA, 19 nt, Homo sapiens
gcuucuccgcccauucuga

SEQ ID NO: 613479 - RNA, 20 nt, Homo sapiens
gcuucucuacagacuccaaa

SEQ ID NO: 613480 - RNA, 17 nt, Homo sapiens
gcuucucucuccagggu

SEQ ID NO: 613481 - RNA, 23 nt, Homo sapiens
gcuucucuucuuuauugcacuag

SEQ ID NO: 613482 - RNA, 15 nt, Homo sapiens
gcuucucuugccuaa

SEQ ID NO: 613483 - RNA, 20 nt, Homo sapiens
gcuucugaaugcugcuacuu

SEQ ID NO: 613484 - RNA, 17 nt, Homo sapiens
gcuucuggaaacuacca

SEQ ID NO: 613485 - RNA, 23 nt, Homo sapiens
gcuucuggaauuuguucaaguuu

SEQ ID NO: 613486 - RNA, 16 nt, Homo sapiens
gcuucuguaaucaaua

SEQ ID NO: 613487 - RNA, 18 nt, Homo sapiens
gcuucuguaguacuccuu

SEQ ID NO: 613488 - RNA, 15 nt, Homo sapiens
gcuucuguccaggac

SEQ ID NO: 613489 - RNA, 12 nt, Homo sapiens
gcuucugugaug

SEQ ID NO: 613490 - RNA, 12 nt, Homo sapiens
gcuucuguggug

SEQ ID NO: 613491 - RNA, 22 nt, Homo sapiens
gcuucuguguuuggaacagcua

SEQ ID NO: 613492 - RNA, 23 nt, Homo sapiens
gcuucuuauucgggugugagucu

SEQ ID NO: 613493 - RNA, 14 nt, Homo sapiens
gcuucuugccucug

SEQ ID NO: 613494 - RNA, 15 nt, Homo sapiens
gcuucuuggaccuug

SEQ ID NO: 613495 - RNA, 18 nt, Homo sapiens
gcuucuuugccucccuca

SEQ ID NO: 613496 - RNA, 23 nt, Homo sapiens
gcuucuuuucacuucagagcaca

SEQ ID NO: 613497 - RNA, 19 nt, Homo sapiens
gcuugaaaaggugaccuug

SEQ ID NO: 613498 - RNA, 13 nt, Homo sapiens
gcuugaagccaaa

SEQ ID NO: 613499 - RNA, 21 nt, Homo sapiens
gcuugaagguuuguccacauu

SEQ ID NO: 613500 - RNA, 18 nt, Homo sapiens
gcuugaaugugagugugu

SEQ ID NO: 613501 - RNA, 15 nt, Homo sapiens
gcuugagcccaggag

SEQ ID NO: 613502 - RNA, 14 nt, Homo sapiens
gcuugcacacuucc

SEQ ID NO: 613503 - RNA, 16 nt, Homo sapiens
gcuugcagccaggaga

SEQ ID NO: 613504 - RNA, 13 nt, Homo sapiens
gcuugcagucucc

SEQ ID NO: 613505 - RNA, 19 nt, Homo sapiens
ggagcugccugcagcacau

SEQ ID NO: 613506 - RNA, 12 nt, Homo sapiens
ggagcuggugac

SEQ ID NO: 613507 - RNA, 19 nt, Homo sapiens
ggagcuucuuguuuccuug

SEQ ID NO: 613508 - RNA, 22 nt, Homo sapiens
ggaggaaaaggccccugcaaug

SEQ ID NO: 613509 - RNA, 17 nt, Homo sapiens
ggaggaacacugcacuc

SEQ ID NO: 613510 - RNA, 16 nt, Homo sapiens
ggaggaaguuggcuga

SEQ ID NO: 613511 - RNA, 23 nt, Homo sapiens
ggaggacaagcaauaacucucua

SEQ ID NO: 613512 - RNA, 19 nt, Homo sapiens
ggaggacacuggugguucu

SEQ ID NO: 613513 - RNA, 19 nt, Homo sapiens
ggaggacaggcaggccaga

SEQ ID NO: 613514 - RNA, 16 nt, Homo sapiens
ggaggagggaggcgcu

SEQ ID NO: 613515 - RNA, 20 nt, Homo sapiens
ggaggauggcuugcgcucag

SEQ ID NO: 613516 - RNA, 20 nt, Homo sapiens
ggaggcagagguugcaguga

SEQ ID NO: 613517 - RNA, 17 nt, Homo sapiens
ggaggccaccucuccaa

SEQ ID NO: 613518 - RNA, 13 nt, Homo sapiens
ggaggccacgucc

SEQ ID NO: 613519 - RNA, 18 nt, Homo sapiens
ggaggccacgugcagcug

SEQ ID NO: 613520 - RNA, 14 nt, Homo sapiens
ggaggccauugugu

SEQ ID NO: 613521 - RNA, 21 nt, Homo sapiens
ggaggcccaaaugauggauca

SEQ ID NO: 613522 - RNA, 16 nt, Homo sapiens
ggaggccuauuccugc

SEQ ID NO: 613523 - RNA, 14 nt, Homo sapiens
ggaggccuuucauc

SEQ ID NO: 613524 - RNA, 20 nt, Homo sapiens
ggaggcggagguugcaguga

SEQ ID NO: 613525 - RNA, 16 nt, Homo sapiens
ggaggcucaggugauc

SEQ ID NO: 613526 - RNA, 14 nt, Homo sapiens
ggaggcucuguucu

SEQ ID NO: 613527 - RNA, 15 nt, Homo sapiens
ggaggcugaggcaag

SEQ ID NO: 613528 - RNA, 21 nt, Homo sapiens
ggaggcugcacuggagccaca

SEQ ID NO: 613529 - RNA, 20 nt, Homo sapiens
ggaggcugcagugagccaag

SEQ ID NO: 613530 - RNA, 17 nt, Homo sapiens
ggaggcugcgugccagu

SEQ ID NO: 613531 - RNA, 14 nt, Homo sapiens
ggaggcuggccaag

SEQ ID NO: 613532 - RNA, 18 nt, Homo sapiens
ggaggcuggggccccauc

SEQ ID NO: 613533 - RNA, 11 nt, Homo sapiens
ggaggcuuccu

SEQ ID NO: 613534 - RNA, 13 nt, Homo sapiens
ggaggcuucugau

SEQ ID NO: 613535 - RNA, 21 nt, Homo sapiens
ggaggcuugccccacccaaca

SEQ ID NO: 613536 - RNA, 17 nt, Homo sapiens
ggagggagagguggcag

SEQ ID NO: 613537 - RNA, 13 nt, Homo sapiens
ggagggguggugu

SEQ ID NO: 613538 - RNA, 23 nt, Homo sapiens
ggagggguuuuggugauacccaa

SEQ ID NO: 613539 - RNA, 17 nt, Homo sapiens
ggagguaguuaagggau

SEQ ID NO: 613540 - RNA, 19 nt, Homo sapiens
ggaggucauacaugcauac

SEQ ID NO: 613541 - RNA, 19 nt, Homo sapiens
ggagguggaggcugcagug

SEQ ID NO: 613542 - RNA, 19 nt, Homo sapiens
ggagguggagguugcagug

SEQ ID NO: 613543 - RNA, 20 nt, Homo sapiens
ggaggugggggccuccucag

SEQ ID NO: 613544 - RNA, 14 nt, Homo sapiens
ggagguugcaguga

SEQ ID NO: 613545 - RNA, 13 nt, Homo sapiens
ggaguaaaauuca

SEQ ID NO: 613546 - RNA, 16 nt, Homo sapiens
ggaguaaguguacaau

SEQ ID NO: 613547 - RNA, 13 nt, Homo sapiens
ggaguaaucugug

SEQ ID NO: 613548 - RNA, 22 nt, Homo sapiens
ggaguaaucuguguacaaagaa

SEQ ID NO: 613549 - RNA, 13 nt, Homo sapiens
ggaguaugcaaaa

SEQ ID NO: 613550 - RNA, 14 nt, Homo sapiens
ggagucacacagug

SEQ ID NO: 613551 - RNA, 19 nt, Homo sapiens
ggagucagaaacuguuucu

SEQ ID NO: 613552 - RNA, 17 nt, Homo sapiens
ggaguccaggcugcuag

SEQ ID NO: 613553 - RNA, 16 nt, Homo sapiens
ggaguccucuagagag

SEQ ID NO: 613554 - RNA, 13 nt, Homo sapiens
ggagucucaggag

SEQ ID NO: 613555 - RNA, 16 nt, Homo sapiens
ggagucuuuucuguua

SEQ ID NO: 613556 - RNA, 17 nt, Homo sapiens
ggagugaagaggggcag

SEQ ID NO: 613557 - RNA, 20 nt, Homo sapiens
ggagugacggucccacacug

SEQ ID NO: 613558 - RNA, 21 nt, Homo sapiens
ggagugagugaucacugguau

SEQ ID NO: 613559 - RNA, 17 nt, Homo sapiens
ggagugcaguggcacaa

SEQ ID NO: 613560 - RNA, 22 nt, Homo sapiens
ggagugccaggaccagccugua

SEQ ID NO: 613561 - RNA, 16 nt, Homo sapiens
ggaguggaaggugagg

SEQ ID NO: 613562 - RNA, 15 nt, Homo sapiens
ggagugguugcuaua

SEQ ID NO: 613563 - RNA, 18 nt, Homo sapiens
ggaguguaugagugugag

SEQ ID NO: 613564 - RNA, 20 nt, Homo sapiens
ggaguguccucuucccucuc

SEQ ID NO: 613565 - RNA, 20 nt, Homo sapiens
ggagugucggauccugugag

SEQ ID NO: 613566 - RNA, 14 nt, Homo sapiens
ggagugucuggaau

SEQ ID NO: 613567 - RNA, 13 nt, Homo sapiens
ggagugugccccu

SEQ ID NO: 613568 - RNA, 15 nt, Homo sapiens
ggaguguucuguggg

SEQ ID NO: 613569 - RNA, 15 nt, Homo sapiens
ggaguucagcugcuu

SEQ ID NO: 613570 - RNA, 18 nt, Homo sapiens
ggaguugaaacugcuaua

SEQ ID NO: 613571 - RNA, 23 nt, Homo sapiens
ggaguugaggucuuucuccucag

SEQ ID NO: 613572 - RNA, 20 nt, Homo sapiens
ggauaaccccaggcacuguu

SEQ ID NO: 613573 - RNA, 16 nt, Homo sapiens
ggauaacucacuggaa

SEQ ID NO: 613574 - RNA, 16 nt, Homo sapiens
ggauaauuccccaaga

SEQ ID NO: 613575 - RNA, 20 nt, Homo sapiens
ggauacaauguauaagcuac

SEQ ID NO: 613576 - RNA, 14 nt, Homo sapiens
ggauacagugccca

SEQ ID NO: 613577 - RNA, 15 nt, Homo sapiens
ggauacgacacaugc

SEQ ID NO: 613578 - RNA, 21 nt, Homo sapiens
ggauacgacaguacacuguca

SEQ ID NO: 613579 - RNA, 19 nt, Homo sapiens
ggauacugcaaaggcuugu

SEQ ID NO: 613580 - RNA, 13 nt, Homo sapiens
ggauacuggcaca

SEQ ID NO: 613581 - RNA, 18 nt, Homo sapiens
ggauacuguaacacuuua

SEQ ID NO: 613582 - RNA, 15 nt, Homo sapiens
ggauacuucauuaaa

SEQ ID NO: 613583 - RNA, 14 nt, Homo sapiens
ggauagaagccaac

SEQ ID NO: 613584 - RNA, 16 nt, Homo sapiens
ggauagaggaaaggga

SEQ ID NO: 613585 - RNA, 20 nt, Homo sapiens
ggauaguccaaagacuuaac

SEQ ID NO: 613586 - RNA, 16 nt, Homo sapiens
ggauauccuuucacuc

SEQ ID NO: 613587 - RNA, 17 nt, Homo sapiens
ggauauugggucucagc

SEQ ID NO: 613588 - RNA, 17 nt, Homo sapiens
ggauauuuuuuacuuua

SEQ ID NO: 613589 - RNA, 22 nt, Homo sapiens
ggaucacucaccauucccagau

SEQ ID NO: 613590 - RNA, 20 nt, Homo sapiens
ggauccaauuuuaauauuaa

SEQ ID NO: 613591 - RNA, 15 nt, Homo sapiens
ggauccacacugaga

SEQ ID NO: 613592 - RNA, 15 nt, Homo sapiens
ggauccaggcauuuc

SEQ ID NO: 613593 - RNA, 17 nt, Homo sapiens
ggaucccguguugccau

SEQ ID NO: 613594 - RNA, 21 nt, Homo sapiens
ggaucccugcccuucucaaga

SEQ ID NO: 613595 - RNA, 20 nt, Homo sapiens
ggaucgaggcauggggcaug

SEQ ID NO: 613596 - RNA, 14 nt, Homo sapiens
ggaucgcaccuuuu

SEQ ID NO: 613597 - RNA, 17 nt, Homo sapiens
ggaucuaccagcauaaa

SEQ ID NO: 613598 - RNA, 14 nt, Homo sapiens
ggaucucaagccag

SEQ ID NO: 613599 - RNA, 19 nt, Homo sapiens
ggaucuccaaggaccaggu

SEQ ID NO: 613600 - RNA, 17 nt, Homo sapiens
ggaucucuuaagacagc

SEQ ID NO: 613601 - RNA, 13 nt, Homo sapiens
ggaucuucccaca

SEQ ID NO: 613602 - RNA, 15 nt, Homo sapiens
ggaucuugaaugugg

SEQ ID NO: 613603 - RNA, 18 nt, Homo sapiens
ggaucuuggagaauguga

SEQ ID NO: 613604 - RNA, 20 nt, Homo sapiens
ggaugaggcacuucugucaa

SEQ ID NO: 613605 - RNA, 20 nt, Homo sapiens
ggaugauuauuuucuguucu

SEQ ID NO: 613606 - RNA, 22 nt, Homo sapiens
ggaugauuauuuucuguucuau

SEQ ID NO: 613607 - RNA, 23 nt, Homo sapiens
ggaugccaaccggucacccagga

SEQ ID NO: 613608 - RNA, 15 nt, Homo sapiens
ggaugcgcagugccu

SEQ ID NO: 613609 - RNA, 23 nt, Homo sapiens
ggauggaacacggccacaucaaa

SEQ ID NO: 613610 - RNA, 17 nt, Homo sapiens
ggauggaugcagaucca

SEQ ID NO: 613611 - RNA, 14 nt, Homo sapiens
ggauggcaccagag

SEQ ID NO: 613612 - RNA, 21 nt, Homo sapiens
ggaugggcagcuaagcagucu

SEQ ID NO: 613613 - RNA, 14 nt, Homo sapiens
ggaugggggggcca

SEQ ID NO: 613614 - RNA, 20 nt, Homo sapiens
ggaugguccucuuaccaaca

SEQ ID NO: 613615 - RNA, 14 nt, Homo sapiens
ggaugguugaauga

SEQ ID NO: 613616 - RNA, 19 nt, Homo sapiens
ggauguaguuuaguuacua

SEQ ID NO: 613617 - RNA, 18 nt, Homo sapiens
ggauguccuacuaucacu

SEQ ID NO: 613618 - RNA, 19 nt, Homo sapiens
ggauguccuacuaucacug

SEQ ID NO: 613619 - RNA, 21 nt, Homo sapiens
ggauguuaugaacagcugugu

SEQ ID NO: 613620 - RNA, 10 nt, Homo sapiens
ggauguugcc

SEQ ID NO: 613621 - RNA, 13 nt, Homo sapiens
ggauguugcucag

SEQ ID NO: 613622 - RNA, 18 nt, Homo sapiens
ggauguugcuuuugcacc

SEQ ID NO: 613623 - RNA, 19 nt, Homo sapiens
ggauguugcuuuugcaccu

SEQ ID NO: 613624 - RNA, 16 nt, Homo sapiens
ggauuacaggcuugag

SEQ ID NO: 613625 - RNA, 20 nt, Homo sapiens
ggauuacagguguaagccac

SEQ ID NO: 613626 - RNA, 15 nt, Homo sapiens
ggauuacugguguga

SEQ ID NO: 613627 - RNA, 20 nt, Homo sapiens
gggaguauguugucauaaca

SEQ ID NO: 613628 - RNA, 18 nt, Homo sapiens
gggaguauugaauggugg

SEQ ID NO: 613629 - RNA, 16 nt, Homo sapiens
gggagucagagcccug

SEQ ID NO: 613630 - RNA, 14 nt, Homo sapiens
gggaguggguggca

SEQ ID NO: 613631 - RNA, 12 nt, Homo sapiens
gggagugucuaa

SEQ ID NO: 613632 - RNA, 14 nt, Homo sapiens
gggaguuaugcaaa

SEQ ID NO: 613633 - RNA, 23 nt, Homo sapiens
gggauaaguaaguuugauuucau

SEQ ID NO: 613634 - RNA, 20 nt, Homo sapiens
gggauaauagacacaucaaa

SEQ ID NO: 613635 - RNA, 23 nt, Homo sapiens
gggauacuuagugguaugucucu

SEQ ID NO: 613636 - RNA, 15 nt, Homo sapiens
gggaucacuaaggga

SEQ ID NO: 613637 - RNA, 12 nt, Homo sapiens
gggaucauuuga

SEQ ID NO: 613638 - RNA, 17 nt, Homo sapiens
gggauccguacauucaa

SEQ ID NO: 613639 - RNA, 16 nt, Homo sapiens
gggaucuugcauuccc

SEQ ID NO: 613640 - RNA, 19 nt, Homo sapiens
gggaugagccgcugugagc

SEQ ID NO: 613641 - RNA, 18 nt, Homo sapiens
gggaugcccccaggcagc

SEQ ID NO: 613642 - RNA, 23 nt, Homo sapiens
gggauggcuggggcucucuccau

SEQ ID NO: 613643 - RNA, 12 nt, Homo sapiens
gggaugggcucu

SEQ ID NO: 613644 - RNA, 22 nt, Homo sapiens
gggauguccuacuaucacugaa

SEQ ID NO: 613645 - RNA, 17 nt, Homo sapiens
gggaugugacaugccca

SEQ ID NO: 613646 - RNA, 22 nt, Homo sapiens
gggauguucagcacugucccuu

SEQ ID NO: 613647 - RNA, 23 nt, Homo sapiens
gggauuauaggcaugagccacug

SEQ ID NO: 613648 - RNA, 19 nt, Homo sapiens
gggauuggagggaagacag

SEQ ID NO: 613649 - RNA, 23 nt, Homo sapiens
gggauuuuuggcuacacacaaac

SEQ ID NO: 613650 - RNA, 21 nt, Homo sapiens
gggcaacaauacaugcugcua

SEQ ID NO: 613651 - RNA, 17 nt, Homo sapiens
gggcaacgacgguuuca

SEQ ID NO: 613652 - RNA, 14 nt, Homo sapiens
gggcaagccaagug

SEQ ID NO: 613653 - RNA, 23 nt, Homo sapiens
gggcaagggguucccuugagggc

SEQ ID NO: 613654 - RNA, 21 nt, Homo sapiens
gggcaaggugugguagcucac

SEQ ID NO: 613655 - RNA, 21 nt, Homo sapiens
gggcacaaacugcagcuguga

SEQ ID NO: 613656 - RNA, 21 nt, Homo sapiens
gggcaccuuccgacaucccag

SEQ ID NO: 613657 - RNA, 22 nt, Homo sapiens
gggcacugaccaggcccaagga

SEQ ID NO: 613658 - RNA, 13 nt, Homo sapiens
gggcacugguggc

SEQ ID NO: 613659 - RNA, 15 nt, Homo sapiens
gggcagagccaggaa

SEQ ID NO: 613660 - RNA, 15 nt, Homo sapiens
gggcagaucaccaga

SEQ ID NO: 613661 - RNA, 15 nt, Homo sapiens
gggcagcauagcaag

SEQ ID NO: 613662 - RNA, 17 nt, Homo sapiens
gggcagcauagcaagac

SEQ ID NO: 613663 - RNA, 17 nt, Homo sapiens
gggcagcgccaggcuga

SEQ ID NO: 613664 - RNA, 14 nt, Homo sapiens
gggcagcuugcccc

SEQ ID NO: 613665 - RNA, 13 nt, Homo sapiens
gggcaggcucucu

SEQ ID NO: 613666 - RNA, 23 nt, Homo sapiens
gggcagggaggcaacacugcugu

SEQ ID NO: 613667 - RNA, 22 nt, Homo sapiens
gggcaggggugcuuccuccuca

SEQ ID NO: 613668 - RNA, 13 nt, Homo sapiens
gggcagggugacc

SEQ ID NO: 613669 - RNA, 18 nt, Homo sapiens
gggcagggugagaagcua

SEQ ID NO: 613670 - RNA, 13 nt, Homo sapiens
gggcaguugacag

SEQ ID NO: 613671 - RNA, 22 nt, Homo sapiens
gggcauagaucagaagacuaca

SEQ ID NO: 613672 - RNA, 12 nt, Homo sapiens
gggcaucagggc

SEQ ID NO: 613673 - RNA, 22 nt, Homo sapiens
gggcaucggcaggagagugugu

SEQ ID NO: 613674 - RNA, 16 nt, Homo sapiens
gggcaugagcugcugu

SEQ ID NO: 613675 - RNA, 21 nt, Homo sapiens
gggcaugagcugcugugccca

SEQ ID NO: 613676 - RNA, 22 nt, Homo sapiens
gggcauuuagggagcagaugac

SEQ ID NO: 613677 - RNA, 15 nt, Homo sapiens
gggccaaagaaccaa

SEQ ID NO: 613678 - RNA, 18 nt, Homo sapiens
gggccaaagaaccaaaga

SEQ ID NO: 613679 - RNA, 13 nt, Homo sapiens
gggccaagcccag

SEQ ID NO: 613680 - RNA, 20 nt, Homo sapiens
gggccacccaaauguguaca

SEQ ID NO: 613681 - RNA, 10 nt, Homo sapiens
gggccagcug

SEQ ID NO: 613682 - RNA, 20 nt, Homo sapiens
gggccaguccuccugggagc

SEQ ID NO: 613683 - RNA, 12 nt, Homo sapiens
gggccagugaug

SEQ ID NO: 613684 - RNA, 17 nt, Homo sapiens
gggccauguccaaagag

SEQ ID NO: 613685 - RNA, 20 nt, Homo sapiens
gggcccaagcaaggggccua

SEQ ID NO: 613686 - RNA, 14 nt, Homo sapiens
gggcccaccuggcc

SEQ ID NO: 613687 - RNA, 18 nt, Homo sapiens
gggcccagaccacugucu

SEQ ID NO: 613688 - RNA, 19 nt, Homo sapiens
gggcccagccaggagcaga

SEQ ID NO: 613689 - RNA, 15 nt, Homo sapiens
gggcccagcccagag

SEQ ID NO: 613690 - RNA, 23 nt, Homo sapiens
gggcccaucucccugcuuugguc

SEQ ID NO: 613691 - RNA, 15 nt, Homo sapiens
gggccccaccaccua

SEQ ID NO: 613692 - RNA, 23 nt, Homo sapiens
gggccccccaaaucccagggaag

SEQ ID NO: 613693 - RNA, 22 nt, Homo sapiens
gggcccggcgaggguaugucag

SEQ ID NO: 613694 - RNA, 23 nt, Homo sapiens
gggcccucccagcccauugcugc

SEQ ID NO: 613695 - RNA, 22 nt, Homo sapiens
gggcccucuuucccugcgagac

SEQ ID NO: 613696 - RNA, 22 nt, Homo sapiens
gggccgaauccccucccuguca

SEQ ID NO: 613697 - RNA, 15 nt, Homo sapiens
gggccggaaggaaug

SEQ ID NO: 613698 - RNA, 16 nt, Homo sapiens
gggccggaaggaaugu

SEQ ID NO: 613699 - RNA, 14 nt, Homo sapiens
gggccuacacccgu

SEQ ID NO: 613700 - RNA, 13 nt, Homo sapiens
gggccuacugcca

SEQ ID NO: 613701 - RNA, 13 nt, Homo sapiens
gggccuccagaga

SEQ ID NO: 613702 - RNA, 22 nt, Homo sapiens
gggccuccagagaccccaggaa

SEQ ID NO: 613703 - RNA, 16 nt, Homo sapiens
gggccucgggaccuca

SEQ ID NO: 613704 - RNA, 14 nt, Homo sapiens
gggccucugcauuu

SEQ ID NO: 613705 - RNA, 16 nt, Homo sapiens
gggccucuuuuugccc

SEQ ID NO: 613706 - RNA, 20 nt, Homo sapiens
gggccugagagaauuggcuc

SEQ ID NO: 613707 - RNA, 15 nt, Homo sapiens
gggccuggacaccca

SEQ ID NO: 613708 - RNA, 20 nt, Homo sapiens
gggccuggcaggacuccaga

SEQ ID NO: 613709 - RNA, 21 nt, Homo sapiens
gggccugggacuuccaugccu

SEQ ID NO: 613710 - RNA, 18 nt, Homo sapiens
gggccuggggccugagag

SEQ ID NO: 613711 - RNA, 18 nt, Homo sapiens
gggccuggguguguguga

SEQ ID NO: 613712 - RNA, 16 nt, Homo sapiens
gggccugucgugccag

SEQ ID NO: 613713 - RNA, 19 nt, Homo sapiens
gggccuugcggaagccaua

SEQ ID NO: 613714 - RNA, 23 nt, Homo sapiens
gggccuugucucucacugcauuu

SEQ ID NO: 613715 - RNA, 21 nt, Homo sapiens
gggccuuuucugugccagaca

SEQ ID NO: 613716 - RNA, 19 nt, Homo sapiens
gggcgucaggggugcacag

SEQ ID NO: 613717 - RNA, 17 nt, Homo sapiens
gggcgugggcgcuugca

SEQ ID NO: 613718 - RNA, 17 nt, Homo sapiens
gggcguucucccaaaga

SEQ ID NO: 613719 - RNA, 13 nt, Homo sapiens
gggcuaccaggaa

SEQ ID NO: 613720 - RNA, 19 nt, Homo sapiens
gggcuacugccacugugug

SEQ ID NO: 613721 - RNA, 16 nt, Homo sapiens
gggcuagugacuugug

SEQ ID NO: 613722 - RNA, 21 nt, Homo sapiens
gggcucaaacuucuaaggggu

SEQ ID NO: 613723 - RNA, 22 nt, Homo sapiens
gggcucaaggaaaggggguccc

SEQ ID NO: 613724 - RNA, 22 nt, Homo sapiens
gggcucacucagccacccugag

SEQ ID NO: 613725 - RNA, 14 nt, Homo sapiens
gggcucagccuggu

SEQ ID NO: 613726 - RNA, 11 nt, Homo sapiens
gggcucaggaa

SEQ ID NO: 613727 - RNA, 17 nt, Homo sapiens
gggcuccaaaucugccu

SEQ ID NO: 613728 - RNA, 18 nt, Homo sapiens
gggcucgguggcccaggu

SEQ ID NO: 613729 - RNA, 15 nt, Homo sapiens
gggcucuaccucucu

SEQ ID NO: 613730 - RNA, 23 nt, Homo sapiens
gggcucuaugccugcacugggaa

SEQ ID NO: 613731 - RNA, 14 nt, Homo sapiens
gggcucuguauaua

SEQ ID NO: 613732 - RNA, 14 nt, Homo sapiens
gggcugagcuggga

SEQ ID NO: 613733 - RNA, 23 nt, Homo sapiens
gggcugaguggucugacaccaaa

SEQ ID NO: 613734 - RNA, 14 nt, Homo sapiens
gggcugcacgggau

SEQ ID NO: 613735 - RNA, 15 nt, Homo sapiens
gggcugccaccagcc

SEQ ID NO: 613736 - RNA, 20 nt, Homo sapiens
gggcugcccacaaggcuugu

SEQ ID NO: 613737 - RNA, 14 nt, Homo sapiens
gggcugcccucucc

SEQ ID NO: 613738 - RNA, 15 nt, Homo sapiens
gggcugcccuggugc

SEQ ID NO: 613739 - RNA, 17 nt, Homo sapiens
gggcugcgccugcugca

SEQ ID NO: 613740 - RNA, 14 nt, Homo sapiens
gggcugcuccccaa

SEQ ID NO: 613741 - RNA, 19 nt, Homo sapiens
gggcugcugggagccucuc

SEQ ID NO: 613742 - RNA, 17 nt, Homo sapiens
gggcuggaaucucauga

SEQ ID NO: 613743 - RNA, 14 nt, Homo sapiens
gggcuggcacguga

SEQ ID NO: 613744 - RNA, 17 nt, Homo sapiens
gggcuggcacgugacag

SEQ ID NO: 613745 - RNA, 16 nt, Homo sapiens
gggcuggcacugacug

SEQ ID NO: 613746 - RNA, 23 nt, Homo sapiens
gggcugggggagagaaacacugc

SEQ ID NO: 613747 - RNA, 20 nt, Homo sapiens
gggcugucaucugugcacug

SEQ ID NO: 613748 - RNA, 21 nt, Homo sapiens
gugcuaauuuguuuuggauau

SEQ ID NO: 613749 - RNA, 19 nt, Homo sapiens
gugcuacucucacucagcc

SEQ ID NO: 613750 - RNA, 15 nt, Homo sapiens
gugcuaggauuacag

SEQ ID NO: 613751 - RNA, 17 nt, Homo sapiens
gugcucagagaccugaa

SEQ ID NO: 613752 - RNA, 19 nt, Homo sapiens
gugcucccgaugcugcuau

SEQ ID NO: 613753 - RNA, 15 nt, Homo sapiens
gugcuccgugccucc

SEQ ID NO: 613754 - RNA, 22 nt, Homo sapiens
gugcuccucucgcacaaugcau

SEQ ID NO: 613755 - RNA, 23 nt, Homo sapiens
gugcuccugugggagaucuucac

SEQ ID NO: 613756 - RNA, 14 nt, Homo sapiens
gugcucgagacaca

SEQ ID NO: 613757 - RNA, 24 nt, Homo sapiens
gugcucugccucagacguugccug

SEQ ID NO: 613758 - RNA, 22 nt, Homo sapiens
gugcucuuguuuugucuugaaa

SEQ ID NO: 613759 - RNA, 18 nt, Homo sapiens
gugcugaaggaauggaag

SEQ ID NO: 613760 - RNA, 19 nt, Homo sapiens
gugcugauucaaaccaaag

SEQ ID NO: 613761 - RNA, 16 nt, Homo sapiens
gugcugccaguccucu

SEQ ID NO: 613762 - RNA, 13 nt, Homo sapiens
gugcugcuuuaau

SEQ ID NO: 613763 - RNA, 14 nt, Homo sapiens
gugcuggacacugu

SEQ ID NO: 613764 - RNA, 21 nt, Homo sapiens
gugcugggauuacagguguga

SEQ ID NO: 613765 - RNA, 15 nt, Homo sapiens
gugcugggcacugcu

SEQ ID NO: 613766 - RNA, 19 nt, Homo sapiens
gugcugggugagcucuucc

SEQ ID NO: 613767 - RNA, 18 nt, Homo sapiens
gugcugugggcagcaccc

SEQ ID NO: 613768 - RNA, 18 nt, Homo sapiens
gugcuuaaaaaucauuga

SEQ ID NO: 613769 - RNA, 22 nt, Homo sapiens
gugcuucagaguuuguguguau

SEQ ID NO: 613770 - RNA, 15 nt, Homo sapiens
gugcuucagccugag

SEQ ID NO: 613771 - RNA, 20 nt, Homo sapiens
gugcuucgagugacugaccc

SEQ ID NO: 613772 - RNA, 21 nt, Homo sapiens
gugcuucucuucuuuauugca

SEQ ID NO: 613773 - RNA, 15 nt, Homo sapiens
gugcuugucauggaa

SEQ ID NO: 613774 - RNA, 15 nt, Homo sapiens
gugcuugucauucca

SEQ ID NO: 613775 - RNA, 16 nt, Homo sapiens
gugcuugucauuccag

SEQ ID NO: 613776 - RNA, 20 nt, Homo sapiens
gugcuuuaggauuuauugca

SEQ ID NO: 613777 - RNA, 20 nt, Homo sapiens
gugcuuuucacuacuuugua

SEQ ID NO: 613778 - RNA, 17 nt, Homo sapiens
gugcuuuuugggaccau

SEQ ID NO: 613779 - RNA, 15 nt, Homo sapiens
guggaaaauggugau

SEQ ID NO: 613780 - RNA, 20 nt, Homo sapiens
guggaaaugagguuggggga

SEQ ID NO: 613781 - RNA, 15 nt, Homo sapiens
guggaacaagcacag

SEQ ID NO: 613782 - RNA, 18 nt, Homo sapiens
guggaacccccaucucua

SEQ ID NO: 613783 - RNA, 20 nt, Homo sapiens
guggaaggcaucagucccua

SEQ ID NO: 613784 - RNA, 16 nt, Homo sapiens
guggaaugagugugca

SEQ ID NO: 613785 - RNA, 17 nt, Homo sapiens
guggaccacugcaugag

SEQ ID NO: 613786 - RNA, 21 nt, Homo sapiens
guggaccacugcaugagcuuu

SEQ ID NO: 613787 - RNA, 23 nt, Homo sapiens
guggacccugucuucugggcaca

SEQ ID NO: 613788 - RNA, 15 nt, Homo sapiens
guggaccuggacaaa

SEQ ID NO: 613789 - RNA, 16 nt, Homo sapiens
guggacgugcacugac

SEQ ID NO: 613790 - RNA, 16 nt, Homo sapiens
guggacuucaucucaa

SEQ ID NO: 613791 - RNA, 21 nt, Homo sapiens
guggacuugggaacaggcugu

SEQ ID NO: 613792 - RNA, 21 nt, Homo sapiens
guggagaagacauucugguga

SEQ ID NO: 613793 - RNA, 20 nt, Homo sapiens
guggagacacugagucagaa

SEQ ID NO: 613794 - RNA, 20 nt, Homo sapiens
guggagccaauccacuccuu

SEQ ID NO: 613795 - RNA, 15 nt, Homo sapiens
guggaggauugcuau

SEQ ID NO: 613796 - RNA, 19 nt, Homo sapiens
guggagggugaccacaccu

SEQ ID NO: 613797 - RNA, 19 nt, Homo sapiens
guggaguuggggcugccau

SEQ ID NO: 613798 - RNA, 20 nt, Homo sapiens
guggauaugacccacacugc

SEQ ID NO: 613799 - RNA, 12 nt, Homo sapiens
guggaucacuug

SEQ ID NO: 613800 - RNA, 12 nt, Homo sapiens
guggaugcugcu

SEQ ID NO: 613801 - RNA, 23 nt, Homo sapiens
guggcaaaaauaaugacauguag

SEQ ID NO: 613802 - RNA, 16 nt, Homo sapiens
guggcaccaaccuugc

SEQ ID NO: 613803 - RNA, 20 nt, Homo sapiens
guggcacucaacucugagcc

SEQ ID NO: 613804 - RNA, 22 nt, Homo sapiens
guggcagaagugucacccugug

SEQ ID NO: 613805 - RNA, 21 nt, Homo sapiens
guggcaucccaguggccucaa

SEQ ID NO: 613806 - RNA, 19 nt, Homo sapiens
guggcauccgaaggugucu

SEQ ID NO: 613807 - RNA, 22 nt, Homo sapiens
guggcaucucuaauuggaagaa

SEQ ID NO: 613808 - RNA, 18 nt, Homo sapiens
guggcauguuuugugcau

SEQ ID NO: 613809 - RNA, 17 nt, Homo sapiens
guggcauuaaacauuug

SEQ ID NO: 613810 - RNA, 18 nt, Homo sapiens
guggccacguucagggag

SEQ ID NO: 613811 - RNA, 22 nt, Homo sapiens
guggccaggccuuacaucuggc

SEQ ID NO: 613812 - RNA, 23 nt, Homo sapiens
guggccaugccucagcccugacc

SEQ ID NO: 613813 - RNA, 18 nt, Homo sapiens
guggcccagggaagccaa

SEQ ID NO: 613814 - RNA, 15 nt, Homo sapiens
guggccccaacacaa

SEQ ID NO: 613815 - RNA, 15 nt, Homo sapiens
guggcccguggccug

SEQ ID NO: 613816 - RNA, 20 nt, Homo sapiens
guggcccuccaguguaugag

SEQ ID NO: 613817 - RNA, 16 nt, Homo sapiens
guggccuauuccagga

SEQ ID NO: 613818 - RNA, 12 nt, Homo sapiens
guggccucagaa

SEQ ID NO: 613819 - RNA, 20 nt, Homo sapiens
guggccugccuucaccccac

SEQ ID NO: 613820 - RNA, 16 nt, Homo sapiens
guggccuguuucugca

SEQ ID NO: 613821 - RNA, 14 nt, Homo sapiens
guggcgacucuaua

SEQ ID NO: 613822 - RNA, 14 nt, Homo sapiens
guggcgacucugca

SEQ ID NO: 613823 - RNA, 13 nt, Homo sapiens
guggcgugaucuc

SEQ ID NO: 613824 - RNA, 22 nt, Homo sapiens
guggcguuguugcauguuugaa

SEQ ID NO: 613825 - RNA, 24 nt, Homo sapiens
guggcucacuacugaacacaugug

SEQ ID NO: 613826 - RNA, 15 nt, Homo sapiens
guggcucagccagca

SEQ ID NO: 613827 - RNA, 18 nt, Homo sapiens
guggcugcaggggucuca

SEQ ID NO: 613828 - RNA, 19 nt, Homo sapiens
guggcugugccaccaagca

SEQ ID NO: 613829 - RNA, 23 nt, Homo sapiens
guggcuuagaaaguccaauucca

SEQ ID NO: 613830 - RNA, 18 nt, Homo sapiens
guggcuucuaguuugcaa

SEQ ID NO: 613831 - RNA, 22 nt, Homo sapiens
guggcuucuuuugaacuguuag

SEQ ID NO: 613832 - RNA, 18 nt, Homo sapiens
guggcuuggccucaagag

SEQ ID NO: 613833 - RNA, 16 nt, Homo sapiens
guggcuuuuuguucag

SEQ ID NO: 613834 - RNA, 14 nt, Homo sapiens
gugggaacggcuga

SEQ ID NO: 613835 - RNA, 15 nt, Homo sapiens
gugggaacugugcaa

SEQ ID NO: 613836 - RNA, 17 nt, Homo sapiens
gugggaccacagacuca

SEQ ID NO: 613837 - RNA, 15 nt, Homo sapiens
gugggagaaggcagu

SEQ ID NO: 613838 - RNA, 20 nt, Homo sapiens
gugggagcagcuucuugggc

SEQ ID NO: 613839 - RNA, 19 nt, Homo sapiens
gugggaggcggugcacuca

SEQ ID NO: 613840 - RNA, 22 nt, Homo sapiens
gugggaucauccagaggagcug

SEQ ID NO: 613841 - RNA, 17 nt, Homo sapiens
gugggauccucccucau

SEQ ID NO: 613842 - RNA, 23 nt, Homo sapiens
gugggccagggcugcccugagaa

SEQ ID NO: 613843 - RNA, 18 nt, Homo sapiens
gugggccaugaaccaaau

SEQ ID NO: 613844 - RNA, 13 nt, Homo sapiens
gugggccugugaa

SEQ ID NO: 613845 - RNA, 21 nt, Homo sapiens
gugggcgcaaaggugccucau

SEQ ID NO: 613846 - RNA, 22 nt, Homo sapiens
gugggcgcuugcaccacuuccg

SEQ ID NO: 613847 - RNA, 15 nt, Homo sapiens
gugggcugauggccu

SEQ ID NO: 613848 - RNA, 20 nt, Homo sapiens
guggggacagauucgcagca

SEQ ID NO: 613849 - RNA, 18 nt, Homo sapiens
guggggcaggagugccag

SEQ ID NO: 613850 - RNA, 21 nt, Homo sapiens
gugggguauagaaaaaggaau

SEQ ID NO: 613851 - RNA, 23 nt, Homo sapiens
guggguaacgugagaagauagaa

SEQ ID NO: 613852 - RNA, 12 nt, Homo sapiens
guggguaaucca

SEQ ID NO: 613853 - RNA, 19 nt, Homo sapiens
gugggucuaccucaucucu

SEQ ID NO: 613854 - RNA, 19 nt, Homo sapiens
gugggucuguguggcagga

SEQ ID NO: 613855 - RNA, 16 nt, Homo sapiens
gugggugcagcuguca

SEQ ID NO: 613856 - RNA, 22 nt, Homo sapiens
gugggugcuagggacaugggaa

SEQ ID NO: 613857 - RNA, 21 nt, Homo sapiens
guggguggcuucuaguuugca

SEQ ID NO: 613858 - RNA, 12 nt, Homo sapiens
guggguggugga

SEQ ID NO: 613859 - RNA, 21 nt, Homo sapiens
guggguuauccuccucuccau

SEQ ID NO: 613860 - RNA, 22 nt, Homo sapiens
gugguauccugugacauguaac

SEQ ID NO: 613861 - RNA, 20 nt, Homo sapiens
gugguauggcuaauaccugu

SEQ ID NO: 613862 - RNA, 20 nt, Homo sapiens
gugguauguaauuuaugcaa

SEQ ID NO: 613863 - RNA, 14 nt, Homo sapiens
guggucccugagga

SEQ ID NO: 613864 - RNA, 20 nt, Homo sapiens
guggucugggcaccaccucu

SEQ ID NO: 613865 - RNA, 12 nt, Homo sapiens
guggugccacau

SEQ ID NO: 613866 - RNA, 23 nt, Homo sapiens
gugguggcaggcaccuguagucc

SEQ ID NO: 613867 - RNA, 16 nt, Homo sapiens
gugguggcgugcauau

SEQ ID NO: 613868 - RNA, 16 nt, Homo sapiens
guucaucaacagugag

SEQ ID NO: 613869 - RNA, 21 nt, Homo sapiens
guucauuuagauaauuugaaa

SEQ ID NO: 613870 - RNA, 16 nt, Homo sapiens
guuccaagacauuguc

SEQ ID NO: 613871 - RNA, 15 nt, Homo sapiens
guuccagacauucuc

SEQ ID NO: 613872 - RNA, 15 nt, Homo sapiens
guuccaggcccucca

SEQ ID NO: 613873 - RNA, 21 nt, Homo sapiens
guuccaggguggccccagggc

SEQ ID NO: 613874 - RNA, 24 nt, Homo sapiens
guuccauaugugggugucagucag

SEQ ID NO: 613875 - RNA, 13 nt, Homo sapiens
guucccauuauua

SEQ ID NO: 613876 - RNA, 17 nt, Homo sapiens
guucccauuucagcuga

SEQ ID NO: 613877 - RNA, 13 nt, Homo sapiens
guuccccacugac

SEQ ID NO: 613878 - RNA, 15 nt, Homo sapiens
guucccccuguuuca

SEQ ID NO: 613879 - RNA, 18 nt, Homo sapiens
guuccccgauaccaugcu

SEQ ID NO: 613880 - RNA, 15 nt, Homo sapiens
guuccccuucaguac

SEQ ID NO: 613881 - RNA, 18 nt, Homo sapiens
guucccugggcugaaacu

SEQ ID NO: 613882 - RNA, 22 nt, Homo sapiens
guucccuuggccucagaauuca

SEQ ID NO: 613883 - RNA, 16 nt, Homo sapiens
guuccgccacuccagu

SEQ ID NO: 613884 - RNA, 23 nt, Homo sapiens
guuccuaacuggaaucagcucag

SEQ ID NO: 613885 - RNA, 19 nt, Homo sapiens
guuccuccucuccuacucg

SEQ ID NO: 613886 - RNA, 16 nt, Homo sapiens
guuccuuaucugucac

SEQ ID NO: 613887 - RNA, 20 nt, Homo sapiens
guuccuuuuaacggaugguu

SEQ ID NO: 613888 - RNA, 13 nt, Homo sapiens
guucgaagcuccg

SEQ ID NO: 613889 - RNA, 15 nt, Homo sapiens
guucgagaccagccu

SEQ ID NO: 613890 - RNA, 15 nt, Homo sapiens
guucgcauggcagcc

SEQ ID NO: 613891 - RNA, 16 nt, Homo sapiens
guucuaacauguaauu

SEQ ID NO: 613892 - RNA, 17 nt, Homo sapiens
guucuacacucaucuua

SEQ ID NO: 613893 - RNA, 12 nt, Homo sapiens
guucuacaugag

SEQ ID NO: 613894 - RNA, 15 nt, Homo sapiens
guucuauuuguauau

SEQ ID NO: 613895 - RNA, 13 nt, Homo sapiens
guucucaugaacu

SEQ ID NO: 613896 - RNA, 22 nt, Homo sapiens
guucucauuuuuaucccauuga

SEQ ID NO: 613897 - RNA, 20 nt, Homo sapiens
guucucuaggccuucaggac

SEQ ID NO: 613898 - RNA, 17 nt, Homo sapiens
guucugagauucaauau

SEQ ID NO: 613899 - RNA, 21 nt, Homo sapiens
guucugagggguguccgagag

SEQ ID NO: 613900 - RNA, 20 nt, Homo sapiens
guucugaguaaguguguuca

SEQ ID NO: 613901 - RNA, 20 nt, Homo sapiens
guucugcaaauuaauguaua

SEQ ID NO: 613902 - RNA, 14 nt, Homo sapiens
guucugcacacagc

SEQ ID NO: 613903 - RNA, 15 nt, Homo sapiens
guucugcugaccaaa

SEQ ID NO: 613904 - RNA, 19 nt, Homo sapiens
guucuggguguugaccacu

SEQ ID NO: 613905 - RNA, 15 nt, Homo sapiens
guucuguuaggaguu

SEQ ID NO: 613906 - RNA, 21 nt, Homo sapiens
guucuuacacaggcuucauca

SEQ ID NO: 613907 - RNA, 12 nt, Homo sapiens
guucuugcucca

SEQ ID NO: 613908 - RNA, 15 nt, Homo sapiens
guucuuggaccaguu

SEQ ID NO: 613909 - RNA, 23 nt, Homo sapiens
guucuuuggaaaguacacucugc

SEQ ID NO: 613910 - RNA, 18 nt, Homo sapiens
guucuuugucacagggac

SEQ ID NO: 613911 - RNA, 17 nt, Homo sapiens
guucuuugucucaaaau

SEQ ID NO: 613912 - RNA, 20 nt, Homo sapiens
guucuuuucuccuuuaccag

SEQ ID NO: 613913 - RNA, 21 nt, Homo sapiens
guucuuuugacugaagucuga

SEQ ID NO: 613914 - RNA, 23 nt, Homo sapiens
guugaaaacuuaaggaagcaaau

SEQ ID NO: 613915 - RNA, 21 nt, Homo sapiens
guugaaaagacaauagcccaa

SEQ ID NO: 613916 - RNA, 14 nt, Homo sapiens
guugaaaagcacac

SEQ ID NO: 613917 - RNA, 14 nt, Homo sapiens
guugaaacugcuau

SEQ ID NO: 613918 - RNA, 15 nt, Homo sapiens
guugaaagaucaaaa

SEQ ID NO: 613919 - RNA, 12 nt, Homo sapiens
guugaaagccaa

SEQ ID NO: 613920 - RNA, 13 nt, Homo sapiens
guugaaauggcau

SEQ ID NO: 613921 - RNA, 23 nt, Homo sapiens
guugaaccacgugaaacugcugu

SEQ ID NO: 613922 - RNA, 13 nt, Homo sapiens
guugaagcacugu

SEQ ID NO: 613923 - RNA, 14 nt, Homo sapiens
guugaaggugccau

SEQ ID NO: 613924 - RNA, 22 nt, Homo sapiens
guugaauccacccaaaucuauu

SEQ ID NO: 613925 - RNA, 15 nt, Homo sapiens
guugacaacugugac

SEQ ID NO: 613926 - RNA, 12 nt, Homo sapiens
guugacauucag

SEQ ID NO: 613927 - RNA, 21 nt, Homo sapiens
guugacugugauuagaucaca

SEQ ID NO: 613928 - RNA, 21 nt, Homo sapiens
guugacuuauuaggacuuuga

SEQ ID NO: 613929 - RNA, 14 nt, Homo sapiens
guugagaugccugu

SEQ ID NO: 613930 - RNA, 20 nt, Homo sapiens
guugagccaggccucucuca

SEQ ID NO: 613931 - RNA, 22 nt, Homo sapiens
guugagcuucauauaccagcaa

SEQ ID NO: 613932 - RNA, 16 nt, Homo sapiens
guugaggcugucacag

SEQ ID NO: 613933 - RNA, 21 nt, Homo sapiens
guugagggcccuucacuucca

SEQ ID NO: 613934 - RNA, 16 nt, Homo sapiens
guugagugcacugacu

SEQ ID NO: 613935 - RNA, 19 nt, Homo sapiens
guugauucagcucugcaag

SEQ ID NO: 613936 - RNA, 21 nt, Homo sapiens
guugauuguauaaaugcaaua

SEQ ID NO: 613937 - RNA, 18 nt, Homo sapiens
guugauuuuaaugaaugc

SEQ ID NO: 613938 - RNA, 11 nt, Homo sapiens
guugauuuucu

SEQ ID NO: 613939 - RNA, 20 nt, Homo sapiens
guugcaaauacauggauaac

SEQ ID NO: 613940 - RNA, 16 nt, Homo sapiens
guugcaagaugugaau

SEQ ID NO: 613941 - RNA, 21 nt, Homo sapiens
guugcauuuaugaugcaguuu

SEQ ID NO: 613942 - RNA, 14 nt, Homo sapiens
guugcauuugucaa

SEQ ID NO: 613943 - RNA, 21 nt, Homo sapiens
guugccaaagagaaacaaaaa

SEQ ID NO: 613944 - RNA, 20 nt, Homo sapiens
guugccacaccaaucagaga

SEQ ID NO: 613945 - RNA, 21 nt, Homo sapiens
guugcccgaaacuaagccagg

SEQ ID NO: 613946 - RNA, 22 nt, Homo sapiens
guugccucccccgccuccaguc

SEQ ID NO: 613947 - RNA, 15 nt, Homo sapiens
guugccucucuuuga

SEQ ID NO: 613948 - RNA, 12 nt, Homo sapiens
guugcuauaaua

SEQ ID NO: 613949 - RNA, 14 nt, Homo sapiens
guugcuauacaugu

SEQ ID NO: 613950 - RNA, 18 nt, Homo sapiens
guugcugacuacuacucu

SEQ ID NO: 613951 - RNA, 15 nt, Homo sapiens
guugcugauguuuau

SEQ ID NO: 613952 - RNA, 15 nt, Homo sapiens
guugcugcugugaau

SEQ ID NO: 613953 - RNA, 16 nt, Homo sapiens
guugcuggcaguacug

SEQ ID NO: 613954 - RNA, 19 nt, Homo sapiens
guugcugggauuacaggug

SEQ ID NO: 613955 - RNA, 12 nt, Homo sapiens
guugcuucaggc

SEQ ID NO: 613956 - RNA, 18 nt, Homo sapiens
guugcuuuugugaacuuu

SEQ ID NO: 613957 - RNA, 15 nt, Homo sapiens
guugcuuuuuuucca

SEQ ID NO: 613958 - RNA, 16 nt, Homo sapiens
guuggaaaaugugcaa

SEQ ID NO: 613959 - RNA, 23 nt, Homo sapiens
guuggacaaaccgagugcaauga

SEQ ID NO: 613960 - RNA, 15 nt, Homo sapiens
guuggacagacacug

SEQ ID NO: 613961 - RNA, 16 nt, Homo sapiens
guuggacagacacugu

SEQ ID NO: 613962 - RNA, 22 nt, Homo sapiens
guuggacccgcucuggaccaac

SEQ ID NO: 613963 - RNA, 12 nt, Homo sapiens
guuggcacuuau

SEQ ID NO: 613964 - RNA, 13 nt, Homo sapiens
guuggcuuucccu

SEQ ID NO: 613965 - RNA, 13 nt, Homo sapiens
guugggcuuucac

SEQ ID NO: 613966 - RNA, 20 nt, Homo sapiens
guugggucucacucucuggg

SEQ ID NO: 613967 - RNA, 17 nt, Homo sapiens
guuggguucacuugcca

SEQ ID NO: 613968 - RNA, 19 nt, Homo sapiens
guuggucaggcuggucuca

SEQ ID NO: 613969 - RNA, 16 nt, Homo sapiens
guuggugaauuucaca

SEQ ID NO: 613970 - RNA, 15 nt, Homo sapiens
guuggugacaccuca

SEQ ID NO: 613971 - RNA, 20 nt, Homo sapiens
guuggugacugaaacauuca

SEQ ID NO: 613972 - RNA, 21 nt, Homo sapiens
guugguuguuuuuuccuuugc

SEQ ID NO: 613973 - RNA, 12 nt, Homo sapiens
guugguuugugu

SEQ ID NO: 613974 - RNA, 18 nt, Homo sapiens
guuguaacaauagcacaa

SEQ ID NO: 613975 - RNA, 16 nt, Homo sapiens
guuguacacagucugu

SEQ ID NO: 613976 - RNA, 12 nt, Homo sapiens
guuguaccaaaa

SEQ ID NO: 613977 - RNA, 14 nt, Homo sapiens
guuguagaagacaa

SEQ ID NO: 613978 - RNA, 18 nt, Homo sapiens
guuguaggguuacagaga

SEQ ID NO: 613979 - RNA, 21 nt, Homo sapiens
guuguauucauuguggucaua

SEQ ID NO: 613980 - RNA, 13 nt, Homo sapiens
guugucaaaaagu

SEQ ID NO: 613981 - RNA, 18 nt, Homo sapiens
guugucaacaaaccaagc

SEQ ID NO: 613982 - RNA, 21 nt, Homo sapiens
guugucccaaugaaauacuga

SEQ ID NO: 613983 - RNA, 14 nt, Homo sapiens
guuguccugcccug

SEQ ID NO: 613984 - RNA, 15 nt, Homo sapiens
guugucgaacaguag

SEQ ID NO: 613985 - RNA, 17 nt, Homo sapiens
guugucuccacuuguau

SEQ ID NO: 613986 - RNA, 19 nt, Homo sapiens
guugucucuagagcaggga

SEQ ID NO: 613987 - RNA, 21 nt, Homo sapiens
guugucugaagucacugcaca

SEQ ID NO: 613988 - RNA, 18 nt, Homo sapiens
guugugaugaaucaauga

SEQ ID NO: 613989 - RNA, 14 nt, Homo sapiens
guuguguugacaca

SEQ ID NO: 613990 - RNA, 22 nt, Homo sapiens
uaaacauugaagacccugucuc

SEQ ID NO: 613991 - RNA, 22 nt, Homo sapiens
uaaacauuuuuagagaaguaaa

SEQ ID NO: 613992 - RNA, 12 nt, Homo sapiens
uaaaccaaaaac

SEQ ID NO: 613993 - RNA, 20 nt, Homo sapiens
uaaaccaaacccagccacug

SEQ ID NO: 613994 - RNA, 16 nt, Homo sapiens
uaaaccaagugaucaa

SEQ ID NO: 613995 - RNA, 22 nt, Homo sapiens
uaaaccaaugagcuguaucugu

SEQ ID NO: 613996 - RNA, 17 nt, Homo sapiens
uaaaccaucaucuugcc

SEQ ID NO: 613997 - RNA, 14 nt, Homo sapiens
uaaacccauacaau

SEQ ID NO: 613998 - RNA, 19 nt, Homo sapiens
uaaaccguuuuuaacacau

SEQ ID NO: 613999 - RNA, 15 nt, Homo sapiens
uaaaccuuacaugug

SEQ ID NO: 614000 - RNA, 20 nt, Homo sapiens
uaaaccuucagaagcuauuu

SEQ ID NO: 614001 - RNA, 21 nt, Homo sapiens
uaaaccuuugguaaucuucaa

SEQ ID NO: 614002 - RNA, 16 nt, Homo sapiens
uaaacgagauaaugua

SEQ ID NO: 614003 - RNA, 22 nt, Homo sapiens
uaaacggcucagacaggcagau

SEQ ID NO: 614004 - RNA, 18 nt, Homo sapiens
uaaacguguaaauugcac

SEQ ID NO: 614005 - RNA, 19 nt, Homo sapiens
uaaacguguaaauugcaca

SEQ ID NO: 614006 - RNA, 23 nt, Homo sapiens
uaaacguuaaaaacaguuuucca

SEQ ID NO: 614007 - RNA, 22 nt, Homo sapiens
uaaacuaaaaaaaaaaaggccg

SEQ ID NO: 614008 - RNA, 14 nt, Homo sapiens
uaaacuaaauuacu

SEQ ID NO: 614009 - RNA, 19 nt, Homo sapiens
uaaacuaauauuuguuuca

SEQ ID NO: 614010 - RNA, 11 nt, Homo sapiens
uaaacuagcac

SEQ ID NO: 614011 - RNA, 17 nt, Homo sapiens
uaaacuaucuuggugaa

SEQ ID NO: 614012 - RNA, 18 nt, Homo sapiens
uaaacuauuagaguauuu

SEQ ID NO: 614013 - RNA, 17 nt, Homo sapiens
uaaacuauuuguggcaa

SEQ ID NO: 614014 - RNA, 19 nt, Homo sapiens
uaaacucaaaacucuugaa

SEQ ID NO: 614015 - RNA, 21 nt, Homo sapiens
uaaacucaaccuaacacauua

SEQ ID NO: 614016 - RNA, 22 nt, Homo sapiens
uaaacucaagacaaugcaccua

SEQ ID NO: 614017 - RNA, 21 nt, Homo sapiens
uaaacucagggacagagccau

SEQ ID NO: 614018 - RNA, 12 nt, Homo sapiens
uaaacuccuuaa

SEQ ID NO: 614019 - RNA, 14 nt, Homo sapiens
uaaacucucuagcu

SEQ ID NO: 614020 - RNA, 23 nt, Homo sapiens
uaaacuggaauccuuucacccgc

SEQ ID NO: 614021 - RNA, 14 nt, Homo sapiens
uaaacuguacaugu

SEQ ID NO: 614022 - RNA, 21 nt, Homo sapiens
uaaacuguuagcacuguugau

SEQ ID NO: 614023 - RNA, 12 nt, Homo sapiens
uaaacuucuuaa

SEQ ID NO: 614024 - RNA, 18 nt, Homo sapiens
uaaacuugacccaggugg

SEQ ID NO: 614025 - RNA, 20 nt, Homo sapiens
uaaacuuggaaucaagguaa

SEQ ID NO: 614026 - RNA, 22 nt, Homo sapiens
uaaacuuggauucucuaaccuu

SEQ ID NO: 614027 - RNA, 23 nt, Homo sapiens
uaaagaaaaaugcaaucaggauu

SEQ ID NO: 614028 - RNA, 16 nt, Homo sapiens
uaaagaaaagaugaaa

SEQ ID NO: 614029 - RNA, 20 nt, Homo sapiens
uaaagaaagaaugcauucca

SEQ ID NO: 614030 - RNA, 20 nt, Homo sapiens
uaaagaaauauauaugauau

SEQ ID NO: 614031 - RNA, 21 nt, Homo sapiens
uaaagaagauaaacacaaaau

SEQ ID NO: 614032 - RNA, 10 nt, Homo sapiens
uaaagacaga

SEQ ID NO: 614033 - RNA, 14 nt, Homo sapiens
uaaagacagaguga

SEQ ID NO: 614034 - RNA, 14 nt, Homo sapiens
uaaagacagggucu

SEQ ID NO: 614035 - RNA, 20 nt, Homo sapiens
uaaagacccaacuugccaaa

SEQ ID NO: 614036 - RNA, 21 nt, Homo sapiens
uaaagacugguuuucugccaa

SEQ ID NO: 614037 - RNA, 12 nt, Homo sapiens
uaaagacuguag

SEQ ID NO: 614038 - RNA, 15 nt, Homo sapiens
uaaagagaacucugg

SEQ ID NO: 614039 - RNA, 19 nt, Homo sapiens
uaaagagagaauguagaua

SEQ ID NO: 614040 - RNA, 17 nt, Homo sapiens
uaaagagaguuugccac

SEQ ID NO: 614041 - RNA, 23 nt, Homo sapiens
uaaagagccuucacugguucugc

SEQ ID NO: 614042 - RNA, 19 nt, Homo sapiens
uaaagagcugcacagcaaa

SEQ ID NO: 614043 - RNA, 14 nt, Homo sapiens
uaaagagcuguuau

SEQ ID NO: 614044 - RNA, 18 nt, Homo sapiens
uaaagagcuuugugauau

SEQ ID NO: 614045 - RNA, 16 nt, Homo sapiens
uaaagauaaaauaucc

SEQ ID NO: 614046 - RNA, 17 nt, Homo sapiens
uaaagauguuuauuuca

SEQ ID NO: 614047 - RNA, 15 nt, Homo sapiens
uaaagauuucuagua

SEQ ID NO: 614048 - RNA, 16 nt, Homo sapiens
uaaagauuuucugcuu

SEQ ID NO: 614049 - RNA, 16 nt, Homo sapiens
uaaagcaaaauaguau

SEQ ID NO: 614050 - RNA, 16 nt, Homo sapiens
uaaagcaaacaugcaa

SEQ ID NO: 614051 - RNA, 18 nt, Homo sapiens
uaaagcaaagugagucau

SEQ ID NO: 614052 - RNA, 15 nt, Homo sapiens
uaaagcaauguggua

SEQ ID NO: 614053 - RNA, 17 nt, Homo sapiens
uaaagcagacagucaca

SEQ ID NO: 614054 - RNA, 19 nt, Homo sapiens
uaaagcaguagacaauccc

SEQ ID NO: 614055 - RNA, 16 nt, Homo sapiens
uaaagcauuacaguau

SEQ ID NO: 614056 - RNA, 17 nt, Homo sapiens
uaaagcauucaauuuau

SEQ ID NO: 614057 - RNA, 17 nt, Homo sapiens
uaaagccuacccuauuc

SEQ ID NO: 614058 - RNA, 18 nt, Homo sapiens
uaaagccuacccuauucu

SEQ ID NO: 614059 - RNA, 11 nt, Homo sapiens
uaaagccucaa

SEQ ID NO: 614060 - RNA, 23 nt, Homo sapiens
uaaagccuucagaggguuuggac

SEQ ID NO: 614061 - RNA, 16 nt, Homo sapiens
uaaagcucuucauuuc

SEQ ID NO: 614062 - RNA, 14 nt, Homo sapiens
uaaagcugaaauuu

SEQ ID NO: 614063 - RNA, 22 nt, Homo sapiens
uaaagcugccggcacagaacuu

SEQ ID NO: 614064 - RNA, 17 nt, Homo sapiens
uaaagcuuaacacuuga

SEQ ID NO: 614065 - RNA, 21 nt, Homo sapiens
uaaagcuuucagguguuacag

SEQ ID NO: 614066 - RNA, 17 nt, Homo sapiens
uaaaggaaccauuccuu

SEQ ID NO: 614067 - RNA, 13 nt, Homo sapiens
uaaaggauaucaa

SEQ ID NO: 614068 - RNA, 22 nt, Homo sapiens
uaaaggcaaugguuugugucaa

SEQ ID NO: 614069 - RNA, 21 nt, Homo sapiens
uaaaggcagcugccucugcuc

SEQ ID NO: 614070 - RNA, 16 nt, Homo sapiens
uaaaggcauuucaaag

SEQ ID NO: 614071 - RNA, 18 nt, Homo sapiens
uaaaggcccccacuucuc

SEQ ID NO: 614072 - RNA, 17 nt, Homo sapiens
uaaagggagaaaugcca

SEQ ID NO: 614073 - RNA, 20 nt, Homo sapiens
uaaagggcagggcccacgug

SEQ ID NO: 614074 - RNA, 16 nt, Homo sapiens
uaaagggucuuaugaa

SEQ ID NO: 614075 - RNA, 20 nt, Homo sapiens
uaaagguuaugaaacauauc

SEQ ID NO: 614076 - RNA, 20 nt, Homo sapiens
uaaaguaaauacaugcauau

SEQ ID NO: 614077 - RNA, 22 nt, Homo sapiens
uaaaguaaauuauuaagcagac

SEQ ID NO: 614078 - RNA, 16 nt, Homo sapiens
uaaaguaaggccuuua

SEQ ID NO: 614079 - RNA, 15 nt, Homo sapiens
uaaaguaauuguaau

SEQ ID NO: 614080 - RNA, 17 nt, Homo sapiens
uaaaguacaagagcuua

SEQ ID NO: 614081 - RNA, 20 nt, Homo sapiens
uaaaguacauuauuuaugaa

SEQ ID NO: 614082 - RNA, 13 nt, Homo sapiens
uaaaguaccacac

SEQ ID NO: 614083 - RNA, 17 nt, Homo sapiens
uaaaguaccacacauau

SEQ ID NO: 614084 - RNA, 21 nt, Homo sapiens
uaaaguaccacacauauugca

SEQ ID NO: 614085 - RNA, 14 nt, Homo sapiens
uaaaguacuggagu

SEQ ID NO: 614086 - RNA, 16 nt, Homo sapiens
uaaaguauauauuuau

SEQ ID NO: 614087 - RNA, 21 nt, Homo sapiens
uaaaguauuauuuauuugaau

SEQ ID NO: 614088 - RNA, 22 nt, Homo sapiens
uaaaguauucaacaauuucaau

SEQ ID NO: 614089 - RNA, 19 nt, Homo sapiens
uaaagucacaucccuguaa

SEQ ID NO: 614090 - RNA, 18 nt, Homo sapiens
uaaagucacuuccagugu

SEQ ID NO: 614091 - RNA, 16 nt, Homo sapiens
uaaaguccguauuucu

SEQ ID NO: 614092 - RNA, 20 nt, Homo sapiens
uaaagugaauaaccacuuaa

SEQ ID NO: 614093 - RNA, 21 nt, Homo sapiens
uaaagugaauaaccacuuaaa

SEQ ID NO: 614094 - RNA, 18 nt, Homo sapiens
uaaagugccuaccccagc

SEQ ID NO: 614095 - RNA, 17 nt, Homo sapiens
uaaaguggaaguaugua

SEQ ID NO: 614096 - RNA, 14 nt, Homo sapiens
uaaagugguuuugu

SEQ ID NO: 614097 - RNA, 22 nt, Homo sapiens
uaaaguucaauuucaacaugua

SEQ ID NO: 614098 - RNA, 15 nt, Homo sapiens
uaaaguuccugucau

SEQ ID NO: 614099 - RNA, 15 nt, Homo sapiens
uaaaguugauaaaga

SEQ ID NO: 614100 - RNA, 16 nt, Homo sapiens
uaaaguugguauuaau

SEQ ID NO: 614101 - RNA, 20 nt, Homo sapiens
uaaaguugguucacuucaaa

SEQ ID NO: 614102 - RNA, 19 nt, Homo sapiens
uaaaguuguuugugccuuu

SEQ ID NO: 614103 - RNA, 19 nt, Homo sapiens
uaaaguuuguucacuuaaa

SEQ ID NO: 614104 - RNA, 15 nt, Homo sapiens
uaaauaaaagcuaga

SEQ ID NO: 614105 - RNA, 22 nt, Homo sapiens
uaaauaaaagcuagauacugga

SEQ ID NO: 614106 - RNA, 18 nt, Homo sapiens
uaaauaaaguaucaugca

SEQ ID NO: 614107 - RNA, 19 nt, Homo sapiens
uaaauaaccucuggcccuu

SEQ ID NO: 614108 - RNA, 18 nt, Homo sapiens
uaaauaagagauuuggag

SEQ ID NO: 614109 - RNA, 21 nt, Homo sapiens
uaaauaagcccagugcugcug

SEQ ID NO: 614110 - RNA, 23 nt, Homo sapiens
uaaauaauagacauacagagaua

SEQ ID NO: 614111 - RNA, 13 nt, Homo sapiens
uaauaaaacuauu

SEQ ID NO: 614112 - RNA, 15 nt, Homo sapiens
uaauaaaacugcaca

SEQ ID NO: 614113 - RNA, 19 nt, Homo sapiens
uaauaaagaaauauuuacc

SEQ ID NO: 614114 - RNA, 22 nt, Homo sapiens
uaauaaagaugaguugguucuc

SEQ ID NO: 614115 - RNA, 19 nt, Homo sapiens
uaauaaaggucuuugcaca

SEQ ID NO: 614116 - RNA, 24 nt, Homo sapiens
uaauaaaggucuuugcacauguga

SEQ ID NO: 614117 - RNA, 14 nt, Homo sapiens
uaauaaagguuuaa

SEQ ID NO: 614118 - RNA, 17 nt, Homo sapiens
uaauaaauugacauaac

SEQ ID NO: 614119 - RNA, 21 nt, Homo sapiens
uaauaaauugcuuacugauau

SEQ ID NO: 614120 - RNA, 14 nt, Homo sapiens
uaauaacagcuccu

SEQ ID NO: 614121 - RNA, 21 nt, Homo sapiens
uaauaagcaaagggagcacug

SEQ ID NO: 614122 - RNA, 14 nt, Homo sapiens
uaauaaguacugug

SEQ ID NO: 614123 - RNA, 13 nt, Homo sapiens
uaauaagugcuuu

SEQ ID NO: 614124 - RNA, 14 nt, Homo sapiens
uaauaaucaaugca

SEQ ID NO: 614125 - RNA, 23 nt, Homo sapiens
uaauaaugauggucaacaauaag

SEQ ID NO: 614126 - RNA, 20 nt, Homo sapiens
uaauaaugugcaaaucugac

SEQ ID NO: 614127 - RNA, 14 nt, Homo sapiens
uaauaauuauucau

SEQ ID NO: 614128 - RNA, 22 nt, Homo sapiens
uaauaauuggagaagauuuaug

SEQ ID NO: 614129 - RNA, 18 nt, Homo sapiens
uaauacaguuuucuauuc

SEQ ID NO: 614130 - RNA, 14 nt, Homo sapiens
uaauacaucaaaga

SEQ ID NO: 614131 - RNA, 15 nt, Homo sapiens
uaauacaucaaagag

SEQ ID NO: 614132 - RNA, 11 nt, Homo sapiens
uaauaccaaag

SEQ ID NO: 614133 - RNA, 15 nt, Homo sapiens
uaauacuccagagac

SEQ ID NO: 614134 - RNA, 20 nt, Homo sapiens
uaauacugaaggacacagca

SEQ ID NO: 614135 - RNA, 12 nt, Homo sapiens
uaauacuugcaa

SEQ ID NO: 614136 - RNA, 16 nt, Homo sapiens
uaauagacacaucaaa

SEQ ID NO: 614137 - RNA, 18 nt, Homo sapiens
uaauagauguuacucaaa

SEQ ID NO: 614138 - RNA, 18 nt, Homo sapiens
uaauagcaaacauuucua

SEQ ID NO: 614139 - RNA, 22 nt, Homo sapiens
uaauagccuaauacaacaugua

SEQ ID NO: 614140 - RNA, 17 nt, Homo sapiens
uaauagcuacagugcau

SEQ ID NO: 614141 - RNA, 16 nt, Homo sapiens
uaauagcuauacauua

SEQ ID NO: 614142 - RNA, 13 nt, Homo sapiens
uaauagcugcuag

SEQ ID NO: 614143 - RNA, 16 nt, Homo sapiens
uaauagcuuuugauua

SEQ ID NO: 614144 - RNA, 16 nt, Homo sapiens
uaauaggcaucuccag

SEQ ID NO: 614145 - RNA, 20 nt, Homo sapiens
uaauagggagaaaccaagag

SEQ ID NO: 614146 - RNA, 14 nt, Homo sapiens
uaauaguccaauau

SEQ ID NO: 614147 - RNA, 16 nt, Homo sapiens
uaauagucuuugccag

SEQ ID NO: 614148 - RNA, 13 nt, Homo sapiens
uaauagugaacau

SEQ ID NO: 614149 - RNA, 16 nt, Homo sapiens
uaauagugacauauau

SEQ ID NO: 614150 - RNA, 17 nt, Homo sapiens
uaauaguucaguguaug

SEQ ID NO: 614151 - RNA, 22 nt, Homo sapiens
uaauaguucuauccuuuugccu

SEQ ID NO: 614152 - RNA, 18 nt, Homo sapiens
uaauaguuuugauccuaa

SEQ ID NO: 614153 - RNA, 17 nt, Homo sapiens
uaauauaaaguguaaua

SEQ ID NO: 614154 - RNA, 20 nt, Homo sapiens
uaauauaguuauugcacaag

SEQ ID NO: 614155 - RNA, 19 nt, Homo sapiens
uaauauauggaccuagcuu

SEQ ID NO: 614156 - RNA, 18 nt, Homo sapiens
uaauauauuugcagauaa

SEQ ID NO: 614157 - RNA, 17 nt, Homo sapiens
uaauauccaagacuuag

SEQ ID NO: 614158 - RNA, 18 nt, Homo sapiens
uaauaucccuacauguau

SEQ ID NO: 614159 - RNA, 23 nt, Homo sapiens
uaauauccuguaauaaagcucuu

SEQ ID NO: 614160 - RNA, 20 nt, Homo sapiens
uaauaugaguaauacaucaa

SEQ ID NO: 614161 - RNA, 23 nt, Homo sapiens
uaauaugaguaauacaucaaaga

SEQ ID NO: 614162 - RNA, 21 nt, Homo sapiens
uaauaugaugccacuuugcag

SEQ ID NO: 614163 - RNA, 19 nt, Homo sapiens
uaauaugucaaaaagggcu

SEQ ID NO: 614164 - RNA, 17 nt, Homo sapiens
uaauaugucaccuggca

SEQ ID NO: 614165 - RNA, 16 nt, Homo sapiens
uaauauuaacuaaaua

SEQ ID NO: 614166 - RNA, 15 nt, Homo sapiens
uaauauuaccaacua

SEQ ID NO: 614167 - RNA, 16 nt, Homo sapiens
uaauauugacuuguau

SEQ ID NO: 614168 - RNA, 22 nt, Homo sapiens
uaauauugauaagcuauugucu

SEQ ID NO: 614169 - RNA, 15 nt, Homo sapiens
uaauauugcagucaa

SEQ ID NO: 614170 - RNA, 18 nt, Homo sapiens
uaauauuguaaauacugg

SEQ ID NO: 614171 - RNA, 19 nt, Homo sapiens
uaauauugugucauagaau

SEQ ID NO: 614172 - RNA, 18 nt, Homo sapiens
uaauauuuuaaauugcuu

SEQ ID NO: 614173 - RNA, 17 nt, Homo sapiens
uaauauuuuacauacac

SEQ ID NO: 614174 - RNA, 21 nt, Homo sapiens
uaauauuuuauucucauuuaa

SEQ ID NO: 614175 - RNA, 15 nt, Homo sapiens
uaaucaaugcaauau

SEQ ID NO: 614176 - RNA, 13 nt, Homo sapiens
uaaucacaguguu

SEQ ID NO: 614177 - RNA, 14 nt, Homo sapiens
uaaucacaguguug

SEQ ID NO: 614178 - RNA, 14 nt, Homo sapiens
uaaucacuacugua

SEQ ID NO: 614179 - RNA, 16 nt, Homo sapiens
uaaucacucuaauuaa

SEQ ID NO: 614180 - RNA, 21 nt, Homo sapiens
uaaucagcaagaauuugaucg

SEQ ID NO: 614181 - RNA, 17 nt, Homo sapiens
uaaucaguaaauaccuu

SEQ ID NO: 614182 - RNA, 17 nt, Homo sapiens
uaaucaucaaguaauac

SEQ ID NO: 614183 - RNA, 18 nt, Homo sapiens
uaaucaucaaguaauaca

SEQ ID NO: 614184 - RNA, 20 nt, Homo sapiens
uaaucaucaaguaauacaaa

SEQ ID NO: 614185 - RNA, 23 nt, Homo sapiens
uaaucaucaaguaauacaaacua

SEQ ID NO: 614186 - RNA, 20 nt, Homo sapiens
uaaucauuguaugugcuuca

SEQ ID NO: 614187 - RNA, 18 nt, Homo sapiens
uaauccaauccacuaaca

SEQ ID NO: 614188 - RNA, 19 nt, Homo sapiens
uaauccaaugaguguuaca

SEQ ID NO: 614189 - RNA, 17 nt, Homo sapiens
uaauccaucacuagcca

SEQ ID NO: 614190 - RNA, 17 nt, Homo sapiens
uaaucccaacacugugg

SEQ ID NO: 614191 - RNA, 13 nt, Homo sapiens
uaaucccagcacu

SEQ ID NO: 614192 - RNA, 20 nt, Homo sapiens
uaaucccagcuacucgagag

SEQ ID NO: 614193 - RNA, 16 nt, Homo sapiens
uaaucccaguuacuca

SEQ ID NO: 614194 - RNA, 19 nt, Homo sapiens
uaaucccuuugucugucaa

SEQ ID NO: 614195 - RNA, 13 nt, Homo sapiens
uaauccuaucugg

SEQ ID NO: 614196 - RNA, 21 nt, Homo sapiens
uaaucguguccugaaaauccu

SEQ ID NO: 614197 - RNA, 22 nt, Homo sapiens
uaaucuagagaaggcauuucau

SEQ ID NO: 614198 - RNA, 17 nt, Homo sapiens
uaaucucacauucauua

SEQ ID NO: 614199 - RNA, 15 nt, Homo sapiens
uaaucugaacugacc

SEQ ID NO: 614200 - RNA, 15 nt, Homo sapiens
uaaucugauguuaac

SEQ ID NO: 614201 - RNA, 16 nt, Homo sapiens
uaaucuggacuccucu

SEQ ID NO: 614202 - RNA, 22 nt, Homo sapiens
uaaucuggacuccucuguccag

SEQ ID NO: 614203 - RNA, 15 nt, Homo sapiens
uaaucuggugacaaa

SEQ ID NO: 614204 - RNA, 16 nt, Homo sapiens
uaaucuguacaaugaa

SEQ ID NO: 614205 - RNA, 13 nt, Homo sapiens
uaaucuguagggc

SEQ ID NO: 614206 - RNA, 21 nt, Homo sapiens
uaaucugucaaaacacugugg

SEQ ID NO: 614207 - RNA, 21 nt, Homo sapiens
uaaucuuaaauuuauuagaua

SEQ ID NO: 614208 - RNA, 14 nt, Homo sapiens
uaaucuucagguga

SEQ ID NO: 614209 - RNA, 19 nt, Homo sapiens
uaaucuucuuaugcaauuu

SEQ ID NO: 614210 - RNA, 18 nt, Homo sapiens
uaaucuuguguagucuuc

SEQ ID NO: 614211 - RNA, 15 nt, Homo sapiens
uaaucuuuaaacugg

SEQ ID NO: 614212 - RNA, 19 nt, Homo sapiens
uaaugaaaaacuaugucag

SEQ ID NO: 614213 - RNA, 15 nt, Homo sapiens
uaaugaaaacauuaa

SEQ ID NO: 614214 - RNA, 14 nt, Homo sapiens
uaaugaaacaaaga

SEQ ID NO: 614215 - RNA, 22 nt, Homo sapiens
uaaugaaauaauguacaucugg

SEQ ID NO: 614216 - RNA, 16 nt, Homo sapiens
uaaugaaauacaucau

SEQ ID NO: 614217 - RNA, 17 nt, Homo sapiens
uaaugaacuaacugaca

SEQ ID NO: 614218 - RNA, 20 nt, Homo sapiens
uaaugaaggggaagagauua

SEQ ID NO: 614219 - RNA, 17 nt, Homo sapiens
uaaugaauacauuucca

SEQ ID NO: 614220 - RNA, 14 nt, Homo sapiens
uaaugacauguagc

SEQ ID NO: 614221 - RNA, 17 nt, Homo sapiens
uaaugaccaguuguuau

SEQ ID NO: 614222 - RNA, 14 nt, Homo sapiens
uaaugaccaugaaa

SEQ ID NO: 614223 - RNA, 15 nt, Homo sapiens
uaaugagaagauaua

SEQ ID NO: 614224 - RNA, 16 nt, Homo sapiens
uaaugagaauuccuua

SEQ ID NO: 614225 - RNA, 15 nt, Homo sapiens
uaaugagacaugaau

SEQ ID NO: 614226 - RNA, 15 nt, Homo sapiens
uaaugagagugcacu

SEQ ID NO: 614227 - RNA, 17 nt, Homo sapiens
uaaugagagugcacugc

SEQ ID NO: 614228 - RNA, 17 nt, Homo sapiens
uaaugaguauguaaaac

SEQ ID NO: 614229 - RNA, 16 nt, Homo sapiens
uaaugagugaauugaa

SEQ ID NO: 614230 - RNA, 23 nt, Homo sapiens
uaaugaguuaagcugaagaguuu

SEQ ID NO: 614231 - RNA, 20 nt, Homo sapiens
uaaugauaaaauacuaaacu

SEQ ID NO: 614232 - RNA, 21 nt, Homo sapiens
uaaugauacauguuuccaauu

SEQ ID NO: 614233 - RNA, 22 nt, Homo sapiens
uauggaagcaaccagcaaauua

SEQ ID NO: 614234 - RNA, 14 nt, Homo sapiens
uauggaauuuugca

SEQ ID NO: 614235 - RNA, 23 nt, Homo sapiens
uauggacaaaauuaauacauucu

SEQ ID NO: 614236 - RNA, 17 nt, Homo sapiens
uauggagugcaccaaag

SEQ ID NO: 614237 - RNA, 18 nt, Homo sapiens
uauggagugcaccaaaga

SEQ ID NO: 614238 - RNA, 13 nt, Homo sapiens
uauggcaaccauu

SEQ ID NO: 614239 - RNA, 14 nt, Homo sapiens
uauggcaagugaua

SEQ ID NO: 614240 - RNA, 18 nt, Homo sapiens
uauggcagaggugcaaga

SEQ ID NO: 614241 - RNA, 14 nt, Homo sapiens
uauggcccaggcag

SEQ ID NO: 614242 - RNA, 13 nt, Homo sapiens
uauggcuagacag

SEQ ID NO: 614243 - RNA, 16 nt, Homo sapiens
uauggcuauucuugaa

SEQ ID NO: 614244 - RNA, 16 nt, Homo sapiens
uaugggcgugaaccac

SEQ ID NO: 614245 - RNA, 19 nt, Homo sapiens
uauggguacggcaaccaca

SEQ ID NO: 614246 - RNA, 16 nt, Homo sapiens
uauggguugcauuugg

SEQ ID NO: 614247 - RNA, 16 nt, Homo sapiens
uauggugagaugcagc

SEQ ID NO: 614248 - RNA, 15 nt, Homo sapiens
uauggugcuguauau

SEQ ID NO: 614249 - RNA, 23 nt, Homo sapiens
uaugguguuccuagaaugcagcu

SEQ ID NO: 614250 - RNA, 15 nt, Homo sapiens
uaugguugacacuag

SEQ ID NO: 614251 - RNA, 16 nt, Homo sapiens
uauguaaaguauguaa

SEQ ID NO: 614252 - RNA, 18 nt, Homo sapiens
uauguaacaaaccugcac

SEQ ID NO: 614253 - RNA, 23 nt, Homo sapiens
uauguaacagucaaauaucauuu

SEQ ID NO: 614254 - RNA, 16 nt, Homo sapiens
uauguaagagcaccuu

SEQ ID NO: 614255 - RNA, 15 nt, Homo sapiens
uauguaauacuuaaa

SEQ ID NO: 614256 - RNA, 17 nt, Homo sapiens
uauguaauggaacuuag

SEQ ID NO: 614257 - RNA, 15 nt, Homo sapiens
uauguacaaguguug

SEQ ID NO: 614258 - RNA, 18 nt, Homo sapiens
uauguacuauccccaaac

SEQ ID NO: 614259 - RNA, 13 nt, Homo sapiens
uauguagcacaua

SEQ ID NO: 614260 - RNA, 12 nt, Homo sapiens
uauguaguauua

SEQ ID NO: 614261 - RNA, 13 nt, Homo sapiens
uauguauauacau

SEQ ID NO: 614262 - RNA, 14 nt, Homo sapiens
uauguauguaaaaa

SEQ ID NO: 614263 - RNA, 16 nt, Homo sapiens
uauguauuaagccaaa

SEQ ID NO: 614264 - RNA, 20 nt, Homo sapiens
uaugucaauuuguauaucau

SEQ ID NO: 614265 - RNA, 21 nt, Homo sapiens
uaugucaggcaaagugcugcu

SEQ ID NO: 614266 - RNA, 13 nt, Homo sapiens
uauguccagucau

SEQ ID NO: 614267 - RNA, 16 nt, Homo sapiens
uaugucccaagagcca

SEQ ID NO: 614268 - RNA, 14 nt, Homo sapiens
uaugucguaaguca

SEQ ID NO: 614269 - RNA, 13 nt, Homo sapiens
uaugucugccuuc

SEQ ID NO: 614270 - RNA, 13 nt, Homo sapiens
uaugucugcugaa

SEQ ID NO: 614271 - RNA, 22 nt, Homo sapiens
uaugugaaaaaaaugagacuua

SEQ ID NO: 614272 - RNA, 23 nt, Homo sapiens
uaugugaaagacaauaaaacacu

SEQ ID NO: 614273 - RNA, 20 nt, Homo sapiens
uaugugacugugacuuucaa

SEQ ID NO: 614274 - RNA, 15 nt, Homo sapiens
uaugugacuugcaau

SEQ ID NO: 614275 - RNA, 18 nt, Homo sapiens
uaugugacuugcaauaaa

SEQ ID NO: 614276 - RNA, 18 nt, Homo sapiens
uaugugagaaaucagaau

SEQ ID NO: 614277 - RNA, 23 nt, Homo sapiens
uaugugaguguguccaagugugu

SEQ ID NO: 614278 - RNA, 9 nt, Homo sapiens
uaugugcaa

SEQ ID NO: 614279 - RNA, 11 nt, Homo sapiens
uaugugcaaaa

SEQ ID NO: 614280 - RNA, 20 nt, Homo sapiens
uaugugcaaaggugugcuuc

SEQ ID NO: 614281 - RNA, 11 nt, Homo sapiens
uaugugcaaua

SEQ ID NO: 614282 - RNA, 16 nt, Homo sapiens
uaugugggugggacca

SEQ ID NO: 614283 - RNA, 19 nt, Homo sapiens
uaugugggugggaccacag

SEQ ID NO: 614284 - RNA, 19 nt, Homo sapiens
uauguggguuuuacacuaa

SEQ ID NO: 614285 - RNA, 20 nt, Homo sapiens
uauguguaaaagcuuacaca

SEQ ID NO: 614286 - RNA, 19 nt, Homo sapiens
uaugugucagccaugacca

SEQ ID NO: 614287 - RNA, 20 nt, Homo sapiens
uauguguggaugaugcugcc

SEQ ID NO: 614288 - RNA, 15 nt, Homo sapiens
uauguguuacauuau

SEQ ID NO: 614289 - RNA, 15 nt, Homo sapiens
uauguguucaaugaa

SEQ ID NO: 614290 - RNA, 19 nt, Homo sapiens
uauguuaaagcaucagaga

SEQ ID NO: 614291 - RNA, 21 nt, Homo sapiens
uauguuauagaacuucaugga

SEQ ID NO: 614292 - RNA, 18 nt, Homo sapiens
uauguucaguuuguacaa

SEQ ID NO: 614293 - RNA, 17 nt, Homo sapiens
uauguucugucuuccca

SEQ ID NO: 614294 - RNA, 13 nt, Homo sapiens
uauguugaucauu

SEQ ID NO: 614295 - RNA, 17 nt, Homo sapiens
uauguuuccuaacugug

SEQ ID NO: 614296 - RNA, 13 nt, Homo sapiens
uauguuugcugau

SEQ ID NO: 614297 - RNA, 13 nt, Homo sapiens
uauguuuggcugc

SEQ ID NO: 614298 - RNA, 21 nt, Homo sapiens
uauguuuuuagaggcuuuucc

SEQ ID NO: 614299 - RNA, 21 nt, Homo sapiens
uauuaaaaauaaacaagcauu

SEQ ID NO: 614300 - RNA, 18 nt, Homo sapiens
uauuaaaaguuaagcaaa

SEQ ID NO: 614301 - RNA, 21 nt, Homo sapiens
uauuaaaauuuggugcuuaua

SEQ ID NO: 614302 - RNA, 16 nt, Homo sapiens
uauuaaacuugucaga

SEQ ID NO: 614303 - RNA, 18 nt, Homo sapiens
uauuaaagguaugcauuu

SEQ ID NO: 614304 - RNA, 14 nt, Homo sapiens
uauuaacuacugaa

SEQ ID NO: 614305 - RNA, 12 nt, Homo sapiens
uauuaagacuua

SEQ ID NO: 614306 - RNA, 22 nt, Homo sapiens
uauuaauaaagcauucuuuaac

SEQ ID NO: 614307 - RNA, 20 nt, Homo sapiens
uauuaauaguucaguguaug

SEQ ID NO: 614308 - RNA, 20 nt, Homo sapiens
uauuaauauauaguccagac

SEQ ID NO: 614309 - RNA, 21 nt, Homo sapiens
uauuaaucauacaaacucuca

SEQ ID NO: 614310 - RNA, 19 nt, Homo sapiens
uauuaauguuuacagugga

SEQ ID NO: 614311 - RNA, 14 nt, Homo sapiens
uauuaauucuucac

SEQ ID NO: 614312 - RNA, 18 nt, Homo sapiens
uauuaauucuucaccugu

SEQ ID NO: 614313 - RNA, 20 nt, Homo sapiens
uauuaauuguuuugcacuuu

SEQ ID NO: 614314 - RNA, 24 nt, Homo sapiens
uauuaauuuuuaaggauguugcca

SEQ ID NO: 614315 - RNA, 12 nt, Homo sapiens
uauuaccagcaa

SEQ ID NO: 614316 - RNA, 14 nt, Homo sapiens
uauuacgugcaaua

SEQ ID NO: 614317 - RNA, 20 nt, Homo sapiens
uauuacugggacugugcuca

SEQ ID NO: 614318 - RNA, 14 nt, Homo sapiens
uauuagaaugcaug

SEQ ID NO: 614319 - RNA, 23 nt, Homo sapiens
uauuagcucacugaaucuucacg

SEQ ID NO: 614320 - RNA, 17 nt, Homo sapiens
uauuaggaaauucugau

SEQ ID NO: 614321 - RNA, 18 nt, Homo sapiens
uauuagguccauucauua

SEQ ID NO: 614322 - RNA, 21 nt, Homo sapiens
uauuauaauuggaagugcagu

SEQ ID NO: 614323 - RNA, 18 nt, Homo sapiens
uauuauagaauugcacau

SEQ ID NO: 614324 - RNA, 22 nt, Homo sapiens
uauuauaucagcuuuucugaug

SEQ ID NO: 614325 - RNA, 14 nt, Homo sapiens
uauuauauuugaca

SEQ ID NO: 614326 - RNA, 14 nt, Homo sapiens
uauuaugagcuaca

SEQ ID NO: 614327 - RNA, 16 nt, Homo sapiens
uauuauguuccucaag

SEQ ID NO: 614328 - RNA, 15 nt, Homo sapiens
uauuauuaccagcau

SEQ ID NO: 614329 - RNA, 20 nt, Homo sapiens
uauuauucaaaccaauuucu

SEQ ID NO: 614330 - RNA, 18 nt, Homo sapiens
uauuauucuucauaacaa

SEQ ID NO: 614331 - RNA, 12 nt, Homo sapiens
uauuauugaacu

SEQ ID NO: 614332 - RNA, 19 nt, Homo sapiens
uauuauugaagauuuacca

SEQ ID NO: 614333 - RNA, 16 nt, Homo sapiens
uauuauugagcucuau

SEQ ID NO: 614334 - RNA, 21 nt, Homo sapiens
uauuauuuacaucacuuugug

SEQ ID NO: 614335 - RNA, 22 nt, Homo sapiens
uauuauuugcuuuucauguaga

SEQ ID NO: 614336 - RNA, 20 nt, Homo sapiens
uauuauuuguguuuccuaaa

SEQ ID NO: 614337 - RNA, 19 nt, Homo sapiens
uauucagacaaaauggaua

SEQ ID NO: 614338 - RNA, 21 nt, Homo sapiens
uauucagauauaaaacaguuu

SEQ ID NO: 614339 - RNA, 23 nt, Homo sapiens
uauucagauauaaaacaguuuug

SEQ ID NO: 614340 - RNA, 15 nt, Homo sapiens
uauucaggcacugag

SEQ ID NO: 614341 - RNA, 15 nt, Homo sapiens
uauucauauauauac

SEQ ID NO: 614342 - RNA, 10 nt, Homo sapiens
uauucauugg

SEQ ID NO: 614343 - RNA, 22 nt, Homo sapiens
uauuccauggcuaacuggcgag

SEQ ID NO: 614344 - RNA, 17 nt, Homo sapiens
uauuccuauagcauuua

SEQ ID NO: 614345 - RNA, 13 nt, Homo sapiens
uauuccugcauuu

SEQ ID NO: 614346 - RNA, 14 nt, Homo sapiens
uauuccuguuucca

SEQ ID NO: 614347 - RNA, 15 nt, Homo sapiens
uauucuagccugcau

SEQ ID NO: 614348 - RNA, 14 nt, Homo sapiens
uauucuauuuacaa

SEQ ID NO: 614349 - RNA, 19 nt, Homo sapiens
uauucucacuccaccaccc

SEQ ID NO: 614350 - RNA, 19 nt, Homo sapiens
uauucucuaaaagcuuuaa

SEQ ID NO: 614351 - RNA, 15 nt, Homo sapiens
uauucucugcaauuu

SEQ ID NO: 614352 - RNA, 17 nt, Homo sapiens
uauucucuucacuccca

SEQ ID NO: 614353 - RNA, 18 nt, Homo sapiens
uauucucuuccucaucca

SEQ ID NO: 614354 - RNA, 17 nt, Homo sapiens
uauucugauuccacuuu

SEQ ID NO: 614355 - RNA, 22 nt, Homo sapiens
ucaaugugucuuucuaagaaau

SEQ ID NO: 614356 - RNA, 14 nt, Homo sapiens
ucaauuaauugauu

SEQ ID NO: 614357 - RNA, 16 nt, Homo sapiens
ucaauuacaacaguga

SEQ ID NO: 614358 - RNA, 17 nt, Homo sapiens
ucaauuagggaugcuca

SEQ ID NO: 614359 - RNA, 18 nt, Homo sapiens
ucaauuagggaugcucaa

SEQ ID NO: 614360 - RNA, 19 nt, Homo sapiens
ucaauuagggaugcucaaa

SEQ ID NO: 614361 - RNA, 18 nt, Homo sapiens
ucaauuauuuaugaacug

SEQ ID NO: 614362 - RNA, 20 nt, Homo sapiens
ucaauuccaccugcaaucaa

SEQ ID NO: 614363 - RNA, 21 nt, Homo sapiens
ucaauucuauuacgugcaaua

SEQ ID NO: 614364 - RNA, 15 nt, Homo sapiens
ucaauuuaaauaacc

SEQ ID NO: 614365 - RNA, 16 nt, Homo sapiens
ucaauuuaauuuugca

SEQ ID NO: 614366 - RNA, 17 nt, Homo sapiens
ucaauuucaacauggac

SEQ ID NO: 614367 - RNA, 19 nt, Homo sapiens
ucaauuucucugaggacac

SEQ ID NO: 614368 - RNA, 18 nt, Homo sapiens
ucaauuucuugguauuau

SEQ ID NO: 614369 - RNA, 20 nt, Homo sapiens
ucaauuuggcaaaacaaaau

SEQ ID NO: 614370 - RNA, 22 nt, Homo sapiens
ucaauuuggcaaaacaaaaugu

SEQ ID NO: 614371 - RNA, 18 nt, Homo sapiens
ucaauuuguaauugcuua

SEQ ID NO: 614372 - RNA, 18 nt, Homo sapiens
ucaauuuuaaacauaucc

SEQ ID NO: 614373 - RNA, 16 nt, Homo sapiens
ucaauuuuucccagua

SEQ ID NO: 614374 - RNA, 14 nt, Homo sapiens
ucacaaaaauuuga

SEQ ID NO: 614375 - RNA, 15 nt, Homo sapiens
ucacaaaaauuugaa

SEQ ID NO: 614376 - RNA, 23 nt, Homo sapiens
ucacaaaacacuucgagcacugu

SEQ ID NO: 614377 - RNA, 23 nt, Homo sapiens
ucacaaaguagaggaauccaugu

SEQ ID NO: 614378 - RNA, 17 nt, Homo sapiens
ucacaaauaaacauaau

SEQ ID NO: 614379 - RNA, 23 nt, Homo sapiens
ucacaaaugaucgcuaucuagca

SEQ ID NO: 614380 - RNA, 14 nt, Homo sapiens
ucacaacagaucaa

SEQ ID NO: 614381 - RNA, 19 nt, Homo sapiens
ucacaaccacucauucaaa

SEQ ID NO: 614382 - RNA, 22 nt, Homo sapiens
ucacaaccucaccaaacuagua

SEQ ID NO: 614383 - RNA, 19 nt, Homo sapiens
ucacaaccugaaccuagga

SEQ ID NO: 614384 - RNA, 16 nt, Homo sapiens
ucacaagaagaccaga

SEQ ID NO: 614385 - RNA, 18 nt, Homo sapiens
ucacaagaagaccagacu

SEQ ID NO: 614386 - RNA, 20 nt, Homo sapiens
ucacaagcaugaagugcugu

SEQ ID NO: 614387 - RNA, 16 nt, Homo sapiens
ucacaagggcucucaa

SEQ ID NO: 614388 - RNA, 15 nt, Homo sapiens
ucacaaggucaggag

SEQ ID NO: 614389 - RNA, 20 nt, Homo sapiens
ucacaauaaaugccacuuca

SEQ ID NO: 614390 - RNA, 22 nt, Homo sapiens
ucacaaucaucaucauucucau

SEQ ID NO: 614391 - RNA, 21 nt, Homo sapiens
ucacaauuuacgaaaccaaaa

SEQ ID NO: 614392 - RNA, 11 nt, Homo sapiens
ucacacacagg

SEQ ID NO: 614393 - RNA, 13 nt, Homo sapiens
ucacacaccagca

SEQ ID NO: 614394 - RNA, 17 nt, Homo sapiens
ucacacagauagaccuu

SEQ ID NO: 614395 - RNA, 18 nt, Homo sapiens
ucacacagggcucuuuga

SEQ ID NO: 614396 - RNA, 11 nt, Homo sapiens
ucacacagugu

SEQ ID NO: 614397 - RNA, 12 nt, Homo sapiens
ucacacauucca

SEQ ID NO: 614398 - RNA, 15 nt, Homo sapiens
ucacaccaacagugu

SEQ ID NO: 614399 - RNA, 13 nt, Homo sapiens
ucacaccaaggaa

SEQ ID NO: 614400 - RNA, 19 nt, Homo sapiens
ucacaccauucuccugccu

SEQ ID NO: 614401 - RNA, 22 nt, Homo sapiens
ucacaccugggcaaacuuucuu

SEQ ID NO: 614402 - RNA, 12 nt, Homo sapiens
ucacaccuguaa

SEQ ID NO: 614403 - RNA, 17 nt, Homo sapiens
ucacacgauaaagggau

SEQ ID NO: 614404 - RNA, 18 nt, Homo sapiens
ucacacuaugugcaaaaa

SEQ ID NO: 614405 - RNA, 21 nt, Homo sapiens
ucacacugaaucagcugcuga

SEQ ID NO: 614406 - RNA, 16 nt, Homo sapiens
ucacacugauacauaa

SEQ ID NO: 614407 - RNA, 16 nt, Homo sapiens
ucacacuuacugcaaa

SEQ ID NO: 614408 - RNA, 14 nt, Homo sapiens
ucacagaacugcag

SEQ ID NO: 614409 - RNA, 13 nt, Homo sapiens
ucacagacuggca

SEQ ID NO: 614410 - RNA, 15 nt, Homo sapiens
ucacagagugcauug

SEQ ID NO: 614411 - RNA, 19 nt, Homo sapiens
ucacagaugaagacaucag

SEQ ID NO: 614412 - RNA, 20 nt, Homo sapiens
ucacagcagugcauaggcca

SEQ ID NO: 614413 - RNA, 22 nt, Homo sapiens
ucacagcccugcuuaccagaua

SEQ ID NO: 614414 - RNA, 15 nt, Homo sapiens
ucacagcucacugca

SEQ ID NO: 614415 - RNA, 23 nt, Homo sapiens
ucacagcucccuagguaggcacc

SEQ ID NO: 614416 - RNA, 16 nt, Homo sapiens
ucacagcuccucccac

SEQ ID NO: 614417 - RNA, 11 nt, Homo sapiens
ucacagcugcu

SEQ ID NO: 614418 - RNA, 18 nt, Homo sapiens
ucacagcuguaauaacaa

SEQ ID NO: 614419 - RNA, 22 nt, Homo sapiens
ucacaggcuucugagcacagcu

SEQ ID NO: 614420 - RNA, 18 nt, Homo sapiens
ucacaguacagcaugugc

SEQ ID NO: 614421 - RNA, 14 nt, Homo sapiens
ucacaguccugucc

SEQ ID NO: 614422 - RNA, 16 nt, Homo sapiens
ucacagugaacacuca

SEQ ID NO: 614423 - RNA, 15 nt, Homo sapiens
ucacaguuccucgcc

SEQ ID NO: 614424 - RNA, 15 nt, Homo sapiens
ucacaguuucaggcu

SEQ ID NO: 614425 - RNA, 23 nt, Homo sapiens
ucacauacccacccuuacuuccu

SEQ ID NO: 614426 - RNA, 17 nt, Homo sapiens
ucacauagagugaucuu

SEQ ID NO: 614427 - RNA, 15 nt, Homo sapiens
ucacauagcacagaa

SEQ ID NO: 614428 - RNA, 22 nt, Homo sapiens
ucacauccuaccccuuugcacu

SEQ ID NO: 614429 - RNA, 14 nt, Homo sapiens
ucacauccuguguu

SEQ ID NO: 614430 - RNA, 15 nt, Homo sapiens
ucacaucucaaggag

SEQ ID NO: 614431 - RNA, 16 nt, Homo sapiens
ucacaucugcaucuua

SEQ ID NO: 614432 - RNA, 19 nt, Homo sapiens
ucacaugaggaauguacuu

SEQ ID NO: 614433 - RNA, 22 nt, Homo sapiens
ucacaugcguaaacgacacucu

SEQ ID NO: 614434 - RNA, 17 nt, Homo sapiens
ucacauuaucaucugaa

SEQ ID NO: 614435 - RNA, 23 nt, Homo sapiens
ucacauucuguuuaucaagccau

SEQ ID NO: 614436 - RNA, 19 nt, Homo sapiens
ucacauugcacucaucaua

SEQ ID NO: 614437 - RNA, 22 nt, Homo sapiens
ucacauuguacuuaaaccuccu

SEQ ID NO: 614438 - RNA, 22 nt, Homo sapiens
ucacauugugugaauacuggaa

SEQ ID NO: 614439 - RNA, 21 nt, Homo sapiens
ucacauuguuugcugcuauug

SEQ ID NO: 614440 - RNA, 19 nt, Homo sapiens
ucacauuuaccauaauuua

SEQ ID NO: 614441 - RNA, 18 nt, Homo sapiens
ucacauuuuccuuuucaa

SEQ ID NO: 614442 - RNA, 21 nt, Homo sapiens
ucacauuuuuaaaagaacaau

SEQ ID NO: 614443 - RNA, 14 nt, Homo sapiens
ucaccaacuugcca

SEQ ID NO: 614444 - RNA, 21 nt, Homo sapiens
ucaccaagcuaggugcuauuu

SEQ ID NO: 614445 - RNA, 17 nt, Homo sapiens
ucaccaaggcagugcau

SEQ ID NO: 614446 - RNA, 16 nt, Homo sapiens
ucaccacaaaggaccc

SEQ ID NO: 614447 - RNA, 20 nt, Homo sapiens
ucaccacguggggcucacuu

SEQ ID NO: 614448 - RNA, 21 nt, Homo sapiens
ucaccagaauauuucuuucau

SEQ ID NO: 614449 - RNA, 16 nt, Homo sapiens
ucaccagagacuuuag

SEQ ID NO: 614450 - RNA, 18 nt, Homo sapiens
ucaccagagcauuuccaa

SEQ ID NO: 614451 - RNA, 19 nt, Homo sapiens
ucaccaguguccccuccac

SEQ ID NO: 614452 - RNA, 16 nt, Homo sapiens
ucaccaguuuccaggu

SEQ ID NO: 614453 - RNA, 21 nt, Homo sapiens
ucaccaugaagcgaaacacag

SEQ ID NO: 614454 - RNA, 18 nt, Homo sapiens
ucaccaugcccagcuaau

SEQ ID NO: 614455 - RNA, 14 nt, Homo sapiens
ucaccauggccuua

SEQ ID NO: 614456 - RNA, 12 nt, Homo sapiens
ucaccauguugg

SEQ ID NO: 614457 - RNA, 19 nt, Homo sapiens
ucaccauugugaagcaccu

SEQ ID NO: 614458 - RNA, 23 nt, Homo sapiens
ucaccauuuggcaaugccaucau

SEQ ID NO: 614459 - RNA, 14 nt, Homo sapiens
ucacccaaacacuu

SEQ ID NO: 614460 - RNA, 22 nt, Homo sapiens
ucacccaccucuggguccuugg

SEQ ID NO: 614461 - RNA, 13 nt, Homo sapiens
ucacccacuccua

SEQ ID NO: 614462 - RNA, 13 nt, Homo sapiens
ucacccaggcaau

SEQ ID NO: 614463 - RNA, 19 nt, Homo sapiens
ucacccaggcuggaguaca

SEQ ID NO: 614464 - RNA, 16 nt, Homo sapiens
ucacccaucaaaagca

SEQ ID NO: 614465 - RNA, 18 nt, Homo sapiens
ucaccccacucagcucac

SEQ ID NO: 614466 - RNA, 14 nt, Homo sapiens
ucaccccagaggac

SEQ ID NO: 614467 - RNA, 23 nt, Homo sapiens
ucaccccagccucauugugccaa

SEQ ID NO: 614468 - RNA, 20 nt, Homo sapiens
ucaccccagcgagcucucaa

SEQ ID NO: 614469 - RNA, 14 nt, Homo sapiens
ucaccccugcacuu

SEQ ID NO: 614470 - RNA, 22 nt, Homo sapiens
ucacccuccacaaagcaaaggc

SEQ ID NO: 614471 - RNA, 12 nt, Homo sapiens
ucacccugugac

SEQ ID NO: 614472 - RNA, 16 nt, Homo sapiens
ucacccuuaacccaag

SEQ ID NO: 614473 - RNA, 14 nt, Homo sapiens
ucacccuucugggc

SEQ ID NO: 614474 - RNA, 16 nt, Homo sapiens
ucaccgcauggacaag

SEQ ID NO: 614475 - RNA, 14 nt, Homo sapiens
ucaccgugagcagc

SEQ ID NO: 614476 - RNA, 17 nt, Homo sapiens
ucauaauucagcacuua

SEQ ID NO: 614477 - RNA, 22 nt, Homo sapiens
ucauacacaagucuaacaguua

SEQ ID NO: 614478 - RNA, 13 nt, Homo sapiens
ucauaccauggag

SEQ ID NO: 614479 - RNA, 20 nt, Homo sapiens
ucauaccuacaucagacaaa

SEQ ID NO: 614480 - RNA, 11 nt, Homo sapiens
ucauaccuuau

SEQ ID NO: 614481 - RNA, 14 nt, Homo sapiens
ucauacuacugaaa

SEQ ID NO: 614482 - RNA, 22 nt, Homo sapiens
ucauacuccuuuuaagcaguga

SEQ ID NO: 614483 - RNA, 15 nt, Homo sapiens
ucauacugucuggga

SEQ ID NO: 614484 - RNA, 17 nt, Homo sapiens
ucauagagacggagauc

SEQ ID NO: 614485 - RNA, 21 nt, Homo sapiens
ucauagaugcaggaggcucag

SEQ ID NO: 614486 - RNA, 20 nt, Homo sapiens
ucauagcaccuaacaacauu

SEQ ID NO: 614487 - RNA, 13 nt, Homo sapiens
ucauagccaaagc

SEQ ID NO: 614488 - RNA, 17 nt, Homo sapiens
ucauagcccucagacau

SEQ ID NO: 614489 - RNA, 15 nt, Homo sapiens
ucauagcgaguuuuc

SEQ ID NO: 614490 - RNA, 22 nt, Homo sapiens
ucauagcuaauuuuugcaaaua

SEQ ID NO: 614491 - RNA, 16 nt, Homo sapiens
ucauaggcaguaaugu

SEQ ID NO: 614492 - RNA, 20 nt, Homo sapiens
ucauaguggauuaaugcauu

SEQ ID NO: 614493 - RNA, 20 nt, Homo sapiens
ucauauaccagcaauauauc

SEQ ID NO: 614494 - RNA, 15 nt, Homo sapiens
ucauauacugccaug

SEQ ID NO: 614495 - RNA, 20 nt, Homo sapiens
ucauauauuuuuaccaucug

SEQ ID NO: 614496 - RNA, 16 nt, Homo sapiens
ucauaucucuugcccu

SEQ ID NO: 614497 - RNA, 17 nt, Homo sapiens
ucauaucuuuuaauugu

SEQ ID NO: 614498 - RNA, 12 nt, Homo sapiens
ucauaugcagaa

SEQ ID NO: 614499 - RNA, 21 nt, Homo sapiens
ucauaugcagaacguauuuag

SEQ ID NO: 614500 - RNA, 18 nt, Homo sapiens
ucauauggcccaguguca

SEQ ID NO: 614501 - RNA, 19 nt, Homo sapiens
ucauaugucaccuuugcua

SEQ ID NO: 614502 - RNA, 15 nt, Homo sapiens
ucauauucauaugca

SEQ ID NO: 614503 - RNA, 15 nt, Homo sapiens
ucauauuguucaaua

SEQ ID NO: 614504 - RNA, 14 nt, Homo sapiens
ucauauuuuguaua

SEQ ID NO: 614505 - RNA, 14 nt, Homo sapiens
ucaucaaacauugg

SEQ ID NO: 614506 - RNA, 20 nt, Homo sapiens
ucaucaaacauuugccaagu

SEQ ID NO: 614507 - RNA, 19 nt, Homo sapiens
ucaucaacuaccauucuau

SEQ ID NO: 614508 - RNA, 22 nt, Homo sapiens
ucaucaacuuauuauaugacua

SEQ ID NO: 614509 - RNA, 18 nt, Homo sapiens
ucaucaagcaggaauuau

SEQ ID NO: 614510 - RNA, 14 nt, Homo sapiens
ucaucaaguaauac

SEQ ID NO: 614511 - RNA, 15 nt, Homo sapiens
ucaucaaucaaauaa

SEQ ID NO: 614512 - RNA, 20 nt, Homo sapiens
ucaucaauggggccagucag

SEQ ID NO: 614513 - RNA, 12 nt, Homo sapiens
ucaucagagccu

SEQ ID NO: 614514 - RNA, 23 nt, Homo sapiens
ucaucagcuaucguuaguguauu

SEQ ID NO: 614515 - RNA, 13 nt, Homo sapiens
ucaucaggaugaa

SEQ ID NO: 614516 - RNA, 18 nt, Homo sapiens
ucaucaggugcauagcaa

SEQ ID NO: 614517 - RNA, 22 nt, Homo sapiens
ucaucaguaguucacauacaaa

SEQ ID NO: 614518 - RNA, 23 nt, Homo sapiens
ucaucagucauuauuagcuuuua

SEQ ID NO: 614519 - RNA, 22 nt, Homo sapiens
ucaucaguccauugcucuugag

SEQ ID NO: 614520 - RNA, 13 nt, Homo sapiens
ucaucagugugua

SEQ ID NO: 614521 - RNA, 20 nt, Homo sapiens
ucaucaucgucgucugucaa

SEQ ID NO: 614522 - RNA, 13 nt, Homo sapiens
ucaucaugauaag

SEQ ID NO: 614523 - RNA, 21 nt, Homo sapiens
ucaucauuuuuauacaggaca

SEQ ID NO: 614524 - RNA, 13 nt, Homo sapiens
ucauccaccccau

SEQ ID NO: 614525 - RNA, 16 nt, Homo sapiens
ucauccacuagugcaa

SEQ ID NO: 614526 - RNA, 15 nt, Homo sapiens
ucauccacuuuccaa

SEQ ID NO: 614527 - RNA, 20 nt, Homo sapiens
ucauccaggcccaacuguga

SEQ ID NO: 614528 - RNA, 18 nt, Homo sapiens
ucauccauccuugccaau

SEQ ID NO: 614529 - RNA, 21 nt, Homo sapiens
ucaucccgagcaccuccacau

SEQ ID NO: 614530 - RNA, 19 nt, Homo sapiens
ucauccuaaaaaguuccau

SEQ ID NO: 614531 - RNA, 17 nt, Homo sapiens
ucauccuccauugcucc

SEQ ID NO: 614532 - RNA, 23 nt, Homo sapiens
ucauccuggcacgcccuacucca

SEQ ID NO: 614533 - RNA, 19 nt, Homo sapiens
ucaucuaauucucugugga

SEQ ID NO: 614534 - RNA, 19 nt, Homo sapiens
ucaucuacccccaaaagaa

SEQ ID NO: 614535 - RNA, 15 nt, Homo sapiens
ucaucuagaugaggu

SEQ ID NO: 614536 - RNA, 20 nt, Homo sapiens
ucaucuauucaagcacuuac

SEQ ID NO: 614537 - RNA, 20 nt, Homo sapiens
ucaucucaccacaccacagg

SEQ ID NO: 614538 - RNA, 13 nt, Homo sapiens
ucaucucauucca

SEQ ID NO: 614539 - RNA, 14 nt, Homo sapiens
ucaucuccugaccc

SEQ ID NO: 614540 - RNA, 19 nt, Homo sapiens
ucaucuccugacccuccca

SEQ ID NO: 614541 - RNA, 20 nt, Homo sapiens
ucaucucucacacauuccag

SEQ ID NO: 614542 - RNA, 20 nt, Homo sapiens
ucaucucugguuuucuugcc

SEQ ID NO: 614543 - RNA, 21 nt, Homo sapiens
ucaucugaaggggcaaauucu

SEQ ID NO: 614544 - RNA, 13 nt, Homo sapiens
ucaucugcaaagg

SEQ ID NO: 614545 - RNA, 13 nt, Homo sapiens
ucaucugggcaaa

SEQ ID NO: 614546 - RNA, 13 nt, Homo sapiens
ucaucuguagaua

SEQ ID NO: 614547 - RNA, 15 nt, Homo sapiens
ucaucugucuuucac

SEQ ID NO: 614548 - RNA, 23 nt, Homo sapiens
ucaucugugauucccuccugcua

SEQ ID NO: 614549 - RNA, 13 nt, Homo sapiens
ucaucuguuguuu

SEQ ID NO: 614550 - RNA, 15 nt, Homo sapiens
ucaucuucacagauu

SEQ ID NO: 614551 - RNA, 19 nt, Homo sapiens
ucaucuucuagaaucucgu

SEQ ID NO: 614552 - RNA, 20 nt, Homo sapiens
ucaucuuggaacugcauucu

SEQ ID NO: 614553 - RNA, 13 nt, Homo sapiens
ucaucuuugccau

SEQ ID NO: 614554 - RNA, 14 nt, Homo sapiens
ucaucuuuguggau

SEQ ID NO: 614555 - RNA, 14 nt, Homo sapiens
ucaugaaauaugca

SEQ ID NO: 614556 - RNA, 13 nt, Homo sapiens
ucaugaagcacau

SEQ ID NO: 614557 - RNA, 23 nt, Homo sapiens
ucaugaauauauuaaucagcauu

SEQ ID NO: 614558 - RNA, 16 nt, Homo sapiens
ucaugaauuccuuaaa

SEQ ID NO: 614559 - RNA, 13 nt, Homo sapiens
ucaugacacuguu

SEQ ID NO: 614560 - RNA, 16 nt, Homo sapiens
ucaugacauguuauau

SEQ ID NO: 614561 - RNA, 16 nt, Homo sapiens
ucaugagccugcugga

SEQ ID NO: 614562 - RNA, 18 nt, Homo sapiens
ucaugagccugcuggaag

SEQ ID NO: 614563 - RNA, 19 nt, Homo sapiens
ucaugagcguuagacugac

SEQ ID NO: 614564 - RNA, 15 nt, Homo sapiens
ucaugagcuugaaca

SEQ ID NO: 614565 - RNA, 14 nt, Homo sapiens
ucaugaucaucaca

SEQ ID NO: 614566 - RNA, 22 nt, Homo sapiens
ucaugaugguccuaaauaaagu

SEQ ID NO: 614567 - RNA, 16 nt, Homo sapiens
ucaugcaaaugcugua

SEQ ID NO: 614568 - RNA, 15 nt, Homo sapiens
ucaugcacacagaua

SEQ ID NO: 614569 - RNA, 13 nt, Homo sapiens
ucaugcacugagg

SEQ ID NO: 614570 - RNA, 22 nt, Homo sapiens
ucaugcauuucaagcagcugaa

SEQ ID NO: 614571 - RNA, 23 nt, Homo sapiens
ucaugccaccauggccagccaac

SEQ ID NO: 614572 - RNA, 20 nt, Homo sapiens
ucaugccccuggcugggacg

SEQ ID NO: 614573 - RNA, 10 nt, Homo sapiens
ucaugcccuc

SEQ ID NO: 614574 - RNA, 23 nt, Homo sapiens
ucaugccuguaaucucagcacuu

SEQ ID NO: 614575 - RNA, 20 nt, Homo sapiens
ucaugcguuuuauaucuucc

SEQ ID NO: 614576 - RNA, 17 nt, Homo sapiens
ucaugcuugacauaccu

SEQ ID NO: 614577 - RNA, 17 nt, Homo sapiens
ucaugcuuuugcuugca

SEQ ID NO: 614578 - RNA, 20 nt, Homo sapiens
ucaugcuuuugcuugcaaug

SEQ ID NO: 614579 - RNA, 20 nt, Homo sapiens
ucauggacagauagacagug

SEQ ID NO: 614580 - RNA, 20 nt, Homo sapiens
ucauggagaaucugcugcau

SEQ ID NO: 614581 - RNA, 17 nt, Homo sapiens
ucauggcagcuaagcca

SEQ ID NO: 614582 - RNA, 11 nt, Homo sapiens
ucauggcauau

SEQ ID NO: 614583 - RNA, 23 nt, Homo sapiens
ucaugggaaugauagcccagaac

SEQ ID NO: 614584 - RNA, 11 nt, Homo sapiens
ucaugggaccu

SEQ ID NO: 614585 - RNA, 19 nt, Homo sapiens
ucaugggagggggcuugaa

SEQ ID NO: 614586 - RNA, 16 nt, Homo sapiens
ucaugguacuacccca

SEQ ID NO: 614587 - RNA, 18 nt, Homo sapiens
ucaugguggguucagggg

SEQ ID NO: 614588 - RNA, 14 nt, Homo sapiens
ucauguaccaucaa

SEQ ID NO: 614589 - RNA, 17 nt, Homo sapiens
ucaugucccagaacuua

SEQ ID NO: 614590 - RNA, 23 nt, Homo sapiens
ucaugucuauaaucccagcacuu

SEQ ID NO: 614591 - RNA, 15 nt, Homo sapiens
ucaugucuugugcau

SEQ ID NO: 614592 - RNA, 14 nt, Homo sapiens
ucaugugaacccgg

SEQ ID NO: 614593 - RNA, 20 nt, Homo sapiens
ucaugugagaaagcuaaaau

SEQ ID NO: 614594 - RNA, 17 nt, Homo sapiens
ucauguggcuguagauc

SEQ ID NO: 614595 - RNA, 16 nt, Homo sapiens
ucaugugggucuucca

SEQ ID NO: 614596 - RNA, 19 nt, Homo sapiens
ucauguguaauaugcacaa

SEQ ID NO: 614597 - RNA, 13 nt, Homo sapiens
ucaugugugcaug

SEQ ID NO: 614598 - RNA, 15 nt, Homo sapiens
uccccucagauucca

SEQ ID NO: 614599 - RNA, 22 nt, Homo sapiens
uccccucagggauacgacacau

SEQ ID NO: 614600 - RNA, 19 nt, Homo sapiens
uccccuccaaaaccuccau

SEQ ID NO: 614601 - RNA, 16 nt, Homo sapiens
uccccuccacauccca

SEQ ID NO: 614602 - RNA, 22 nt, Homo sapiens
uccccuccacugucacauugua

SEQ ID NO: 614603 - RNA, 14 nt, Homo sapiens
uccccucccagaug

SEQ ID NO: 614604 - RNA, 16 nt, Homo sapiens
uccccucccccaagau

SEQ ID NO: 614605 - RNA, 23 nt, Homo sapiens
uccccuccuugccuccuguguaa

SEQ ID NO: 614606 - RNA, 15 nt, Homo sapiens
uccccucucaccuca

SEQ ID NO: 614607 - RNA, 16 nt, Homo sapiens
uccccucucagaacau

SEQ ID NO: 614608 - RNA, 17 nt, Homo sapiens
uccccugaggauggccu

SEQ ID NO: 614609 - RNA, 19 nt, Homo sapiens
uccccugaugcccagguca

SEQ ID NO: 614610 - RNA, 21 nt, Homo sapiens
uccccugcugaggcagugugg

SEQ ID NO: 614611 - RNA, 22 nt, Homo sapiens
uccccuggggacgccaaggagg

SEQ ID NO: 614612 - RNA, 19 nt, Homo sapiens
uccccuguccugauggcac

SEQ ID NO: 614613 - RNA, 16 nt, Homo sapiens
uccccuguugugugga

SEQ ID NO: 614614 - RNA, 14 nt, Homo sapiens
uccccuguuugcau

SEQ ID NO: 614615 - RNA, 23 nt, Homo sapiens
uccccuguuugcaugagaaaagu

SEQ ID NO: 614616 - RNA, 19 nt, Homo sapiens
uccccuuccuaaauaucca

SEQ ID NO: 614617 - RNA, 19 nt, Homo sapiens
uccccuugcagccugguca

SEQ ID NO: 614618 - RNA, 22 nt, Homo sapiens
uccccuugcccagggcucagcc

SEQ ID NO: 614619 - RNA, 15 nt, Homo sapiens
uccccuuucacaggu

SEQ ID NO: 614620 - RNA, 20 nt, Homo sapiens
uccccuuuucuauguugcua

SEQ ID NO: 614621 - RNA, 20 nt, Homo sapiens
ucccgccaacgcaucacugg

SEQ ID NO: 614622 - RNA, 21 nt, Homo sapiens
ucccgcccucaagaaucuccc

SEQ ID NO: 614623 - RNA, 19 nt, Homo sapiens
ucccgccuuccuccuccac

SEQ ID NO: 614624 - RNA, 17 nt, Homo sapiens
ucccgcuuagccugccu

SEQ ID NO: 614625 - RNA, 24 nt, Homo sapiens
ucccggaagcucacagugacauua

SEQ ID NO: 614626 - RNA, 20 nt, Homo sapiens
ucccggauuuuuguuaauau

SEQ ID NO: 614627 - RNA, 19 nt, Homo sapiens
ucccggcgucccuaccucc

SEQ ID NO: 614628 - RNA, 16 nt, Homo sapiens
ucccggguguguacac

SEQ ID NO: 614629 - RNA, 16 nt, Homo sapiens
ucccgguucaccuugc

SEQ ID NO: 614630 - RNA, 16 nt, Homo sapiens
ucccguaucacagugu

SEQ ID NO: 614631 - RNA, 15 nt, Homo sapiens
ucccgucgugcaguc

SEQ ID NO: 614632 - RNA, 14 nt, Homo sapiens
ucccuaaacugcag

SEQ ID NO: 614633 - RNA, 14 nt, Homo sapiens
ucccuaaugcucac

SEQ ID NO: 614634 - RNA, 20 nt, Homo sapiens
ucccuagccagaggcucuaa

SEQ ID NO: 614635 - RNA, 22 nt, Homo sapiens
ucccuagccagcacuuguauau

SEQ ID NO: 614636 - RNA, 14 nt, Homo sapiens
ucccuagugccuuc

SEQ ID NO: 614637 - RNA, 10 nt, Homo sapiens
ucccuaucua

SEQ ID NO: 614638 - RNA, 17 nt, Homo sapiens
ucccucagcucucuggg

SEQ ID NO: 614639 - RNA, 20 nt, Homo sapiens
ucccucaggucccuugguca

SEQ ID NO: 614640 - RNA, 11 nt, Homo sapiens
ucccucaguga

SEQ ID NO: 614641 - RNA, 15 nt, Homo sapiens
ucccucaucuguccc

SEQ ID NO: 614642 - RNA, 13 nt, Homo sapiens
ucccuccaccagc

SEQ ID NO: 614643 - RNA, 13 nt, Homo sapiens
ucccuccaccuca

SEQ ID NO: 614644 - RNA, 21 nt, Homo sapiens
ucccucccagaaaaacuggcu

SEQ ID NO: 614645 - RNA, 13 nt, Homo sapiens
ucccucccagcgc

SEQ ID NO: 614646 - RNA, 20 nt, Homo sapiens
ucccuccccaguucauugca

SEQ ID NO: 614647 - RNA, 16 nt, Homo sapiens
ucccuccccugccauu

SEQ ID NO: 614648 - RNA, 15 nt, Homo sapiens
ucccuccucaggggc

SEQ ID NO: 614649 - RNA, 23 nt, Homo sapiens
ucccucggcguuagucccuagcc

SEQ ID NO: 614650 - RNA, 14 nt, Homo sapiens
ucccucucaugacu

SEQ ID NO: 614651 - RNA, 19 nt, Homo sapiens
ucccucucccaguccauuu

SEQ ID NO: 614652 - RNA, 17 nt, Homo sapiens
ucccucucuuccgggag

SEQ ID NO: 614653 - RNA, 17 nt, Homo sapiens
ucccucuguuaggucca

SEQ ID NO: 614654 - RNA, 14 nt, Homo sapiens
ucccucuucucucc

SEQ ID NO: 614655 - RNA, 18 nt, Homo sapiens
ucccugaagagacaggca

SEQ ID NO: 614656 - RNA, 12 nt, Homo sapiens
ucccugacagca

SEQ ID NO: 614657 - RNA, 14 nt, Homo sapiens
ucccugacuccucc

SEQ ID NO: 614658 - RNA, 15 nt, Homo sapiens
ucccugacuguaaau

SEQ ID NO: 614659 - RNA, 16 nt, Homo sapiens
ucccugacuguaaaug

SEQ ID NO: 614660 - RNA, 16 nt, Homo sapiens
ucccugcaaacauggg

SEQ ID NO: 614661 - RNA, 17 nt, Homo sapiens
ucccugcagaugccacc

SEQ ID NO: 614662 - RNA, 22 nt, Homo sapiens
ucccugcccaccuccuggagaa

SEQ ID NO: 614663 - RNA, 20 nt, Homo sapiens
ucccugcgcuucaucucaug

SEQ ID NO: 614664 - RNA, 12 nt, Homo sapiens
ucccugcucagu

SEQ ID NO: 614665 - RNA, 15 nt, Homo sapiens
ucccugcucuugcag

SEQ ID NO: 614666 - RNA, 11 nt, Homo sapiens
ucccugggaag

SEQ ID NO: 614667 - RNA, 14 nt, Homo sapiens
ucccugggccucag

SEQ ID NO: 614668 - RNA, 10 nt, Homo sapiens
ucccuggucg

SEQ ID NO: 614669 - RNA, 20 nt, Homo sapiens
ucccuggugccucugugcac

SEQ ID NO: 614670 - RNA, 23 nt, Homo sapiens
ucccuggugccucugugcacagu

SEQ ID NO: 614671 - RNA, 21 nt, Homo sapiens
ucccuguaaacguuaaaaaca

SEQ ID NO: 614672 - RNA, 20 nt, Homo sapiens
ucccugucaggacacaugga

SEQ ID NO: 614673 - RNA, 19 nt, Homo sapiens
ucccugucauagagcugca

SEQ ID NO: 614674 - RNA, 23 nt, Homo sapiens
ucccugucauuuuuaacagcaug

SEQ ID NO: 614675 - RNA, 21 nt, Homo sapiens
ucccuguccuccucggaucac

SEQ ID NO: 614676 - RNA, 16 nt, Homo sapiens
ucccuguccuugcccu

SEQ ID NO: 614677 - RNA, 16 nt, Homo sapiens
ucccuguguggaugcu

SEQ ID NO: 614678 - RNA, 17 nt, Homo sapiens
ucccuguuaucugcuag

SEQ ID NO: 614679 - RNA, 19 nt, Homo sapiens
ucccuguuaucugcuagau

SEQ ID NO: 614680 - RNA, 16 nt, Homo sapiens
ucccuguucugguauu

SEQ ID NO: 614681 - RNA, 20 nt, Homo sapiens
ucccuguucugguauuuccc

SEQ ID NO: 614682 - RNA, 16 nt, Homo sapiens
ucccuuaaagauuuuc

SEQ ID NO: 614683 - RNA, 19 nt, Homo sapiens
ucccuuaauuuaagucauu

SEQ ID NO: 614684 - RNA, 23 nt, Homo sapiens
ucccuuaauuuaagucauuuuca

SEQ ID NO: 614685 - RNA, 16 nt, Homo sapiens
ucccuuccaugcccug

SEQ ID NO: 614686 - RNA, 21 nt, Homo sapiens
ucccuuccgacccucugggaa

SEQ ID NO: 614687 - RNA, 15 nt, Homo sapiens
ucccuuccuccauug

SEQ ID NO: 614688 - RNA, 18 nt, Homo sapiens
ucccuuccucuuccugcc

SEQ ID NO: 614689 - RNA, 17 nt, Homo sapiens
ucccuucucguguuugc

SEQ ID NO: 614690 - RNA, 19 nt, Homo sapiens
ucccuucucuuaauuuaau

SEQ ID NO: 614691 - RNA, 18 nt, Homo sapiens
ucccuucuuggugcuuac

SEQ ID NO: 614692 - RNA, 18 nt, Homo sapiens
ucccuucuuucaggaaua

SEQ ID NO: 614693 - RNA, 13 nt, Homo sapiens
ucccuugaaauuu

SEQ ID NO: 614694 - RNA, 23 nt, Homo sapiens
ucccuugauggucucaagcuaug

SEQ ID NO: 614695 - RNA, 20 nt, Homo sapiens
ucccuugcuguaugcugauc

SEQ ID NO: 614696 - RNA, 23 nt, Homo sapiens
ucccuugcuguaugcugaucauc

SEQ ID NO: 614697 - RNA, 18 nt, Homo sapiens
ucccuugcuuagccugug

SEQ ID NO: 614698 - RNA, 18 nt, Homo sapiens
ucccuugggaagggcagg

SEQ ID NO: 614699 - RNA, 18 nt, Homo sapiens
ucccuuggggaagggugg

SEQ ID NO: 614700 - RNA, 19 nt, Homo sapiens
ucccuuggggccuaugcag

SEQ ID NO: 614701 - RNA, 20 nt, Homo sapiens
ucccuuggucuuuucuugcc

SEQ ID NO: 614702 - RNA, 15 nt, Homo sapiens
ucccuuguccugcuu

SEQ ID NO: 614703 - RNA, 14 nt, Homo sapiens
ucccuuguccuuga

SEQ ID NO: 614704 - RNA, 23 nt, Homo sapiens
ucccuuuaccuucauauguguaa

SEQ ID NO: 614705 - RNA, 18 nt, Homo sapiens
ucccuuuccuacucucag

SEQ ID NO: 614706 - RNA, 20 nt, Homo sapiens
ucccuuugccuuaaaccuga

SEQ ID NO: 614707 - RNA, 22 nt, Homo sapiens
ucccuuugucugucaaucacag

SEQ ID NO: 614708 - RNA, 19 nt, Homo sapiens
ucccuuuguugcacacuca

SEQ ID NO: 614709 - RNA, 12 nt, Homo sapiens
ucccuuuuacau

SEQ ID NO: 614710 - RNA, 21 nt, Homo sapiens
ucccuuuugcuagagcugaca

SEQ ID NO: 614711 - RNA, 23 nt, Homo sapiens
ucccuuuuuauaucccauuuuua

SEQ ID NO: 614712 - RNA, 19 nt, Homo sapiens
ucccuuuuuauuugcagaa

SEQ ID NO: 614713 - RNA, 19 nt, Homo sapiens
ucccuuuuucaaugaauuu

SEQ ID NO: 614714 - RNA, 15 nt, Homo sapiens
uccgaagucuuccau

SEQ ID NO: 614715 - RNA, 14 nt, Homo sapiens
uccgaccucucuca

SEQ ID NO: 614716 - RNA, 16 nt, Homo sapiens
uccgacugcuagggag

SEQ ID NO: 614717 - RNA, 19 nt, Homo sapiens
uccgagaggugggccaguc

SEQ ID NO: 614718 - RNA, 13 nt, Homo sapiens
uccgaggccagua

SEQ ID NO: 614719 - RNA, 18 nt, Homo sapiens
ugaaaauaauuguuccaa

SEQ ID NO: 614720 - RNA, 21 nt, Homo sapiens
ugaaaauaguguaagaacugu

SEQ ID NO: 614721 - RNA, 14 nt, Homo sapiens
ugaaaauauagcua

SEQ ID NO: 614722 - RNA, 13 nt, Homo sapiens
ugaaaaucauauu

SEQ ID NO: 614723 - RNA, 14 nt, Homo sapiens
ugaaaaucuaauau

SEQ ID NO: 614724 - RNA, 17 nt, Homo sapiens
ugaaaaucuccaucuca

SEQ ID NO: 614725 - RNA, 14 nt, Homo sapiens
ugaaaaugaaagga

SEQ ID NO: 614726 - RNA, 16 nt, Homo sapiens
ugaaaaugaauaucua

SEQ ID NO: 614727 - RNA, 15 nt, Homo sapiens
ugaaaaugaccaaaa

SEQ ID NO: 614728 - RNA, 14 nt, Homo sapiens
ugaaaauguacuga

SEQ ID NO: 614729 - RNA, 17 nt, Homo sapiens
ugaaaauguccaggaaa

SEQ ID NO: 614730 - RNA, 21 nt, Homo sapiens
ugaaaauguguuguugcugug

SEQ ID NO: 614731 - RNA, 20 nt, Homo sapiens
ugaaaauguuuaugccacag

SEQ ID NO: 614732 - RNA, 20 nt, Homo sapiens
ugaaaauucuggaaggaaug

SEQ ID NO: 614733 - RNA, 20 nt, Homo sapiens
ugaaaauugggcaugccauu

SEQ ID NO: 614734 - RNA, 17 nt, Homo sapiens
ugaaacaaauaaucaca

SEQ ID NO: 614735 - RNA, 14 nt, Homo sapiens
ugaaacacaccagg

SEQ ID NO: 614736 - RNA, 18 nt, Homo sapiens
ugaaacacgaaacuuguu

SEQ ID NO: 614737 - RNA, 12 nt, Homo sapiens
ugaaacauaucu

SEQ ID NO: 614738 - RNA, 20 nt, Homo sapiens
ugaaacaucucaacaaccug

SEQ ID NO: 614739 - RNA, 19 nt, Homo sapiens
ugaaacaugaacccaaaaa

SEQ ID NO: 614740 - RNA, 16 nt, Homo sapiens
ugaaacauguucucaa

SEQ ID NO: 614741 - RNA, 15 nt, Homo sapiens
ugaaaccccgucucu

SEQ ID NO: 614742 - RNA, 20 nt, Homo sapiens
ugaaacccuccaaaucucca

SEQ ID NO: 614743 - RNA, 18 nt, Homo sapiens
ugaaacccuugagcucaa

SEQ ID NO: 614744 - RNA, 22 nt, Homo sapiens
ugaaacccuugagcucaaguga

SEQ ID NO: 614745 - RNA, 18 nt, Homo sapiens
ugaaaccuacacacuguc

SEQ ID NO: 614746 - RNA, 20 nt, Homo sapiens
ugaaacgacucaaaaugaca

SEQ ID NO: 614747 - RNA, 17 nt, Homo sapiens
ugaaacgucauguguuu

SEQ ID NO: 614748 - RNA, 20 nt, Homo sapiens
ugaaacgucuaggaaaucua

SEQ ID NO: 614749 - RNA, 23 nt, Homo sapiens
ugaaacuaacagauaagcaagag

SEQ ID NO: 614750 - RNA, 14 nt, Homo sapiens
ugaaacugcacauu

SEQ ID NO: 614751 - RNA, 15 nt, Homo sapiens
ugaaacuuauaguua

SEQ ID NO: 614752 - RNA, 23 nt, Homo sapiens
ugaaacuuguuuauuauguacaa

SEQ ID NO: 614753 - RNA, 23 nt, Homo sapiens
ugaaagaaccaaaagagaucaca

SEQ ID NO: 614754 - RNA, 16 nt, Homo sapiens
ugaaagagaguaccau

SEQ ID NO: 614755 - RNA, 13 nt, Homo sapiens
ugaaagaugcagu

SEQ ID NO: 614756 - RNA, 14 nt, Homo sapiens
ugaaagccacaaug

SEQ ID NO: 614757 - RNA, 20 nt, Homo sapiens
ugaaagccucacguauuuca

SEQ ID NO: 614758 - RNA, 20 nt, Homo sapiens
ugaaagcugauuacugucaa

SEQ ID NO: 614759 - RNA, 20 nt, Homo sapiens
ugaaaggaacacuggcuuga

SEQ ID NO: 614760 - RNA, 22 nt, Homo sapiens
ugaaaggaagcuccacugucac

SEQ ID NO: 614761 - RNA, 16 nt, Homo sapiens
ugaaaggauguggaag

SEQ ID NO: 614762 - RNA, 20 nt, Homo sapiens
ugaaaggggggaaccaguga

SEQ ID NO: 614763 - RNA, 19 nt, Homo sapiens
ugaaaguccagcacuggaa

SEQ ID NO: 614764 - RNA, 19 nt, Homo sapiens
ugaaagucuucauggugau

SEQ ID NO: 614765 - RNA, 22 nt, Homo sapiens
ugaaagugacucucacuaaaga

SEQ ID NO: 614766 - RNA, 19 nt, Homo sapiens
ugaaaguuuucuaaacuca

SEQ ID NO: 614767 - RNA, 23 nt, Homo sapiens
ugaaaguuuucuaaacucaauaa

SEQ ID NO: 614768 - RNA, 20 nt, Homo sapiens
ugaaauaaaaugauaaacaa

SEQ ID NO: 614769 - RNA, 16 nt, Homo sapiens
ugaaauaaacagucua

SEQ ID NO: 614770 - RNA, 12 nt, Homo sapiens
ugaaauaagaaa

SEQ ID NO: 614771 - RNA, 14 nt, Homo sapiens
ugaaauaauuugug

SEQ ID NO: 614772 - RNA, 23 nt, Homo sapiens
ugaaauaccaaccugaagacacc

SEQ ID NO: 614773 - RNA, 13 nt, Homo sapiens
ugaaauaccagug

SEQ ID NO: 614774 - RNA, 23 nt, Homo sapiens
ugaaauaccagugaaccaaagag

SEQ ID NO: 614775 - RNA, 18 nt, Homo sapiens
ugaaauauauaacaacaa

SEQ ID NO: 614776 - RNA, 14 nt, Homo sapiens
ugaaaucaaugugu

SEQ ID NO: 614777 - RNA, 18 nt, Homo sapiens
ugaaaucaauguguacaa

SEQ ID NO: 614778 - RNA, 18 nt, Homo sapiens
ugaaaucccaucucuaca

SEQ ID NO: 614779 - RNA, 19 nt, Homo sapiens
ugaaaucugcuagaaaguu

SEQ ID NO: 614780 - RNA, 21 nt, Homo sapiens
ugaaaugaccaagacagguuc

SEQ ID NO: 614781 - RNA, 20 nt, Homo sapiens
ugaaaugagcaccuccauua

SEQ ID NO: 614782 - RNA, 19 nt, Homo sapiens
ugaaauggagaacaguuuc

SEQ ID NO: 614783 - RNA, 23 nt, Homo sapiens
ugaaaugggauuguuuuuuacuc

SEQ ID NO: 614784 - RNA, 23 nt, Homo sapiens
ugaaaugggggcaggaaagccac

SEQ ID NO: 614785 - RNA, 17 nt, Homo sapiens
ugaaauguuugcauaaa

SEQ ID NO: 614786 - RNA, 15 nt, Homo sapiens
ugaaauuaagcauuu

SEQ ID NO: 614787 - RNA, 22 nt, Homo sapiens
ugaaauuaauuugugaauuugc

SEQ ID NO: 614788 - RNA, 18 nt, Homo sapiens
ugaaauuaguuuaccuca

SEQ ID NO: 614789 - RNA, 20 nt, Homo sapiens
ugaaauuauauauauacaca

SEQ ID NO: 614790 - RNA, 19 nt, Homo sapiens
ugaaauuauuugucauuca

SEQ ID NO: 614791 - RNA, 17 nt, Homo sapiens
ugaaauuguagugcaaa

SEQ ID NO: 614792 - RNA, 21 nt, Homo sapiens
ugaaauuguagugcaaaaugg

SEQ ID NO: 614793 - RNA, 15 nt, Homo sapiens
ugaaauuguaucuca

SEQ ID NO: 614794 - RNA, 15 nt, Homo sapiens
ugaaauuuauucaca

SEQ ID NO: 614795 - RNA, 20 nt, Homo sapiens
ugaaauuuuaaccuaugaua

SEQ ID NO: 614796 - RNA, 20 nt, Homo sapiens
ugaaauuuucuuaaccccua

SEQ ID NO: 614797 - RNA, 22 nt, Homo sapiens
ugaacaaaaauugagacauuua

SEQ ID NO: 614798 - RNA, 22 nt, Homo sapiens
ugaacaaaaccuacgcacauac

SEQ ID NO: 614799 - RNA, 21 nt, Homo sapiens
ugaacaaaauguaaagccagc

SEQ ID NO: 614800 - RNA, 15 nt, Homo sapiens
ugaacaaacuaaagg

SEQ ID NO: 614801 - RNA, 23 nt, Homo sapiens
ugaacaaacuaugaucacaguga

SEQ ID NO: 614802 - RNA, 11 nt, Homo sapiens
ugaacaaagca

SEQ ID NO: 614803 - RNA, 17 nt, Homo sapiens
ugaacaaagcagccacg

SEQ ID NO: 614804 - RNA, 16 nt, Homo sapiens
ugaacaaauggccuuu

SEQ ID NO: 614805 - RNA, 20 nt, Homo sapiens
ugaacacaauugauacuuca

SEQ ID NO: 614806 - RNA, 17 nt, Homo sapiens
ugaacacacccugaaga

SEQ ID NO: 614807 - RNA, 14 nt, Homo sapiens
ugaacacagugucu

SEQ ID NO: 614808 - RNA, 17 nt, Homo sapiens
ugaacacauuugcccaa

SEQ ID NO: 614809 - RNA, 17 nt, Homo sapiens
ugaacacuagccagaca

SEQ ID NO: 614810 - RNA, 23 nt, Homo sapiens
ugaacacucuacuacaugugacu

SEQ ID NO: 614811 - RNA, 13 nt, Homo sapiens
ugaacacuggggg

SEQ ID NO: 614812 - RNA, 19 nt, Homo sapiens
ugaacacuuauaagugaag

SEQ ID NO: 614813 - RNA, 11 nt, Homo sapiens
ugaacagaauu

SEQ ID NO: 614814 - RNA, 11 nt, Homo sapiens
ugaacagccaa

SEQ ID NO: 614815 - RNA, 14 nt, Homo sapiens
ugaacaggcaugca

SEQ ID NO: 614816 - RNA, 23 nt, Homo sapiens
ugaacagguucucuuccuggcau

SEQ ID NO: 614817 - RNA, 18 nt, Homo sapiens
ugaacaguguauaggaag

SEQ ID NO: 614818 - RNA, 18 nt, Homo sapiens
ugaacauaaguaaucacu

SEQ ID NO: 614819 - RNA, 11 nt, Homo sapiens
ugaacauaugu

SEQ ID NO: 614820 - RNA, 14 nt, Homo sapiens
ugaacauauguaau

SEQ ID NO: 614821 - RNA, 21 nt, Homo sapiens
ugaacauauguccauccauau

SEQ ID NO: 614822 - RNA, 11 nt, Homo sapiens
ugaacaucucu

SEQ ID NO: 614823 - RNA, 12 nt, Homo sapiens
ugaacaucucuu

SEQ ID NO: 614824 - RNA, 20 nt, Homo sapiens
ugaacaugcaguucauuauu

SEQ ID NO: 614825 - RNA, 18 nt, Homo sapiens
ugaacaugugaaguuaua

SEQ ID NO: 614826 - RNA, 15 nt, Homo sapiens
ugaacauugcauaua

SEQ ID NO: 614827 - RNA, 21 nt, Homo sapiens
ugaaccauucccuagucauuu

SEQ ID NO: 614828 - RNA, 19 nt, Homo sapiens
ugaaccccuggccagcucu

SEQ ID NO: 614829 - RNA, 16 nt, Homo sapiens
ugaacccugccucuug

SEQ ID NO: 614830 - RNA, 14 nt, Homo sapiens
ugaaccgcacagcu

SEQ ID NO: 614831 - RNA, 16 nt, Homo sapiens
ugaaccgcacagcuca

SEQ ID NO: 614832 - RNA, 15 nt, Homo sapiens
ugaaccgucugugga

SEQ ID NO: 614833 - RNA, 15 nt, Homo sapiens
ugaaccuagauugca

SEQ ID NO: 614834 - RNA, 24 nt, Homo sapiens
ugaaccucaguuuccucaucugca

SEQ ID NO: 614835 - RNA, 16 nt, Homo sapiens
ugaaccuucugcaaca

SEQ ID NO: 614836 - RNA, 16 nt, Homo sapiens
ugaacgacuguauauu

SEQ ID NO: 614837 - RNA, 14 nt, Homo sapiens
ugaacgcugugaug

SEQ ID NO: 614838 - RNA, 19 nt, Homo sapiens
ugaacguguauguaccuag

SEQ ID NO: 614839 - RNA, 14 nt, Homo sapiens
ugaacuacacugca

SEQ ID NO: 614840 - RNA, 21 nt, Homo sapiens
ugaggcccagugcauaugcaa

SEQ ID NO: 614841 - RNA, 17 nt, Homo sapiens
ugaggccuagacucugu

SEQ ID NO: 614842 - RNA, 18 nt, Homo sapiens
ugaggccuagacucuguc

SEQ ID NO: 614843 - RNA, 13 nt, Homo sapiens
ugaggcugacaca

SEQ ID NO: 614844 - RNA, 16 nt, Homo sapiens
ugaggcugacacagcc

SEQ ID NO: 614845 - RNA, 16 nt, Homo sapiens
ugaggcuguuccuuga

SEQ ID NO: 614846 - RNA, 17 nt, Homo sapiens
ugaggcuugacagaguc

SEQ ID NO: 614847 - RNA, 19 nt, Homo sapiens
ugagggaagaggaucucca

SEQ ID NO: 614848 - RNA, 13 nt, Homo sapiens
ugagggacguggu

SEQ ID NO: 614849 - RNA, 16 nt, Homo sapiens
ugagggaugcuggaac

SEQ ID NO: 614850 - RNA, 21 nt, Homo sapiens
ugagggcaagagggggaccug

SEQ ID NO: 614851 - RNA, 19 nt, Homo sapiens
ugagggcagcuuugcaaaa

SEQ ID NO: 614852 - RNA, 20 nt, Homo sapiens
ugagggcagcuuugcaaaau

SEQ ID NO: 614853 - RNA, 13 nt, Homo sapiens
ugaggggaggcac

SEQ ID NO: 614854 - RNA, 17 nt, Homo sapiens
ugaggggcuggcacuga

SEQ ID NO: 614855 - RNA, 12 nt, Homo sapiens
ugagggugcuga

SEQ ID NO: 614856 - RNA, 18 nt, Homo sapiens
ugagggugcugacuggcu

SEQ ID NO: 614857 - RNA, 12 nt, Homo sapiens
ugaggguggaag

SEQ ID NO: 614858 - RNA, 13 nt, Homo sapiens
ugagguaucuucu

SEQ ID NO: 614859 - RNA, 17 nt, Homo sapiens
ugaggucaacacaggua

SEQ ID NO: 614860 - RNA, 16 nt, Homo sapiens
ugaggucucuugaggg

SEQ ID NO: 614861 - RNA, 20 nt, Homo sapiens
ugaggugacugcagucugau

SEQ ID NO: 614862 - RNA, 16 nt, Homo sapiens
ugaggugcauuuucuc

SEQ ID NO: 614863 - RNA, 19 nt, Homo sapiens
ugaggugccugcucaggug

SEQ ID NO: 614864 - RNA, 18 nt, Homo sapiens
ugaggugugaaagcccag

SEQ ID NO: 614865 - RNA, 16 nt, Homo sapiens
ugagguuuagaugugc

SEQ ID NO: 614866 - RNA, 15 nt, Homo sapiens
ugaguaaaacacaua

SEQ ID NO: 614867 - RNA, 18 nt, Homo sapiens
ugaguaauacaucaaaga

SEQ ID NO: 614868 - RNA, 13 nt, Homo sapiens
ugaguaauggcug

SEQ ID NO: 614869 - RNA, 16 nt, Homo sapiens
ugaguaaugguuacua

SEQ ID NO: 614870 - RNA, 16 nt, Homo sapiens
ugaguacguugugcau

SEQ ID NO: 614871 - RNA, 17 nt, Homo sapiens
ugaguacguugugcauu

SEQ ID NO: 614872 - RNA, 18 nt, Homo sapiens
ugaguacguugugcauuu

SEQ ID NO: 614873 - RNA, 15 nt, Homo sapiens
ugaguagccuaugaa

SEQ ID NO: 614874 - RNA, 17 nt, Homo sapiens
ugaguagcucuccugac

SEQ ID NO: 614875 - RNA, 15 nt, Homo sapiens
ugaguaucacuuuaa

SEQ ID NO: 614876 - RNA, 19 nt, Homo sapiens
ugaguauggcuaucuauac

SEQ ID NO: 614877 - RNA, 24 nt, Homo sapiens
ugaguauuccaugagcugcucauu

SEQ ID NO: 614878 - RNA, 18 nt, Homo sapiens
ugaguauuccuagcaaau

SEQ ID NO: 614879 - RNA, 23 nt, Homo sapiens
ugagucaaaagccugggugagaa

SEQ ID NO: 614880 - RNA, 18 nt, Homo sapiens
ugagucaaucagccuuua

SEQ ID NO: 614881 - RNA, 13 nt, Homo sapiens
ugagucagugcuc

SEQ ID NO: 614882 - RNA, 14 nt, Homo sapiens
ugagucaugaucuc

SEQ ID NO: 614883 - RNA, 22 nt, Homo sapiens
ugaguccaagaggguccuuuag

SEQ ID NO: 614884 - RNA, 15 nt, Homo sapiens
ugagucggaagcucc

SEQ ID NO: 614885 - RNA, 13 nt, Homo sapiens
ugagucugucaca

SEQ ID NO: 614886 - RNA, 14 nt, Homo sapiens
ugagucugugccac

SEQ ID NO: 614887 - RNA, 22 nt, Homo sapiens
ugagucuuuauuuuuuguuacc

SEQ ID NO: 614888 - RNA, 18 nt, Homo sapiens
ugagugcacugacuguga

SEQ ID NO: 614889 - RNA, 17 nt, Homo sapiens
ugagugccaugcuuuuu

SEQ ID NO: 614890 - RNA, 18 nt, Homo sapiens
ugagugcuugucauggaa

SEQ ID NO: 614891 - RNA, 22 nt, Homo sapiens
ugaguggaguugaggugucaga

SEQ ID NO: 614892 - RNA, 16 nt, Homo sapiens
ugaguggcagccaugc

SEQ ID NO: 614893 - RNA, 15 nt, Homo sapiens
ugaguggugccaaac

SEQ ID NO: 614894 - RNA, 22 nt, Homo sapiens
ugagugguucaagcacacugga

SEQ ID NO: 614895 - RNA, 17 nt, Homo sapiens
ugagugucuuagcauau

SEQ ID NO: 614896 - RNA, 19 nt, Homo sapiens
ugaguguguccaagugugu

SEQ ID NO: 614897 - RNA, 13 nt, Homo sapiens
ugagugugugagc

SEQ ID NO: 614898 - RNA, 14 nt, Homo sapiens
ugagugugugcaag

SEQ ID NO: 614899 - RNA, 15 nt, Homo sapiens
ugagugugugcaagu

SEQ ID NO: 614900 - RNA, 20 nt, Homo sapiens
ugaguuacuuagaaugccau

SEQ ID NO: 614901 - RNA, 22 nt, Homo sapiens
ugaguuacuuccuaucaagcca

SEQ ID NO: 614902 - RNA, 17 nt, Homo sapiens
ugaguuagacucaaggg

SEQ ID NO: 614903 - RNA, 19 nt, Homo sapiens
ugaguuaugaguuauucau

SEQ ID NO: 614904 - RNA, 16 nt, Homo sapiens
ugaguuauuuugcuaa

SEQ ID NO: 614905 - RNA, 23 nt, Homo sapiens
ugaguuccucugcaguuuugaca

SEQ ID NO: 614906 - RNA, 15 nt, Homo sapiens
ugaguugcacauuaa

SEQ ID NO: 614907 - RNA, 15 nt, Homo sapiens
ugaguugccaagaca

SEQ ID NO: 614908 - RNA, 18 nt, Homo sapiens
ugaguugcuuuucagcug

SEQ ID NO: 614909 - RNA, 14 nt, Homo sapiens
ugaguugugaugaa

SEQ ID NO: 614910 - RNA, 22 nt, Homo sapiens
ugaguuucuggcucuugaggca

SEQ ID NO: 614911 - RNA, 16 nt, Homo sapiens
ugaguuuuguucacaa

SEQ ID NO: 614912 - RNA, 20 nt, Homo sapiens
ugaguuuuugauagcuuuau

SEQ ID NO: 614913 - RNA, 14 nt, Homo sapiens
ugauaaaauacuaa

SEQ ID NO: 614914 - RNA, 14 nt, Homo sapiens
ugauaaacaguuuc

SEQ ID NO: 614915 - RNA, 14 nt, Homo sapiens
ugauaaacauuaaa

SEQ ID NO: 614916 - RNA, 21 nt, Homo sapiens
ugauaaacauuaaacacugua

SEQ ID NO: 614917 - RNA, 13 nt, Homo sapiens
ugauaaagaggca

SEQ ID NO: 614918 - RNA, 21 nt, Homo sapiens
ugauaaagcuuaacacuugac

SEQ ID NO: 614919 - RNA, 13 nt, Homo sapiens
ugauaaaguaaua

SEQ ID NO: 614920 - RNA, 18 nt, Homo sapiens
ugauaaaugauagacaau

SEQ ID NO: 614921 - RNA, 14 nt, Homo sapiens
ugauaaggcucuga

SEQ ID NO: 614922 - RNA, 16 nt, Homo sapiens
ugauaagugacaaaag

SEQ ID NO: 614923 - RNA, 13 nt, Homo sapiens
ugauaagugcagg

SEQ ID NO: 614924 - RNA, 15 nt, Homo sapiens
ugauaauaugcaaau

SEQ ID NO: 614925 - RNA, 14 nt, Homo sapiens
ugauacaacauuaa

SEQ ID NO: 614926 - RNA, 23 nt, Homo sapiens
ugauacaacauuaaggaauuuga

SEQ ID NO: 614927 - RNA, 23 nt, Homo sapiens
ugauacauguuuccaauuauccu

SEQ ID NO: 614928 - RNA, 15 nt, Homo sapiens
ugauaccacugcacu

SEQ ID NO: 614929 - RNA, 16 nt, Homo sapiens
ugauaccuucaaugaa

SEQ ID NO: 614930 - RNA, 20 nt, Homo sapiens
ugauacuggaggaacacuug

SEQ ID NO: 614931 - RNA, 17 nt, Homo sapiens
ugauacuggagucuuau

SEQ ID NO: 614932 - RNA, 20 nt, Homo sapiens
ugauacuuccaagugauaau

SEQ ID NO: 614933 - RNA, 18 nt, Homo sapiens
ugauacuuguuccagaug

SEQ ID NO: 614934 - RNA, 19 nt, Homo sapiens
ugauacuuguuccagaugg

SEQ ID NO: 614935 - RNA, 12 nt, Homo sapiens
ugauacuuuuaa

SEQ ID NO: 614936 - RNA, 20 nt, Homo sapiens
ugauagauuucuacacugag

SEQ ID NO: 614937 - RNA, 17 nt, Homo sapiens
ugauagcagaaugugcu

SEQ ID NO: 614938 - RNA, 16 nt, Homo sapiens
ugauagcagauaucac

SEQ ID NO: 614939 - RNA, 11 nt, Homo sapiens
ugauagcuuua

SEQ ID NO: 614940 - RNA, 22 nt, Homo sapiens
ugauaguucacccccugagauc

SEQ ID NO: 614941 - RNA, 21 nt, Homo sapiens
ugauauauaaaugugauugca

SEQ ID NO: 614942 - RNA, 19 nt, Homo sapiens
ugauauaucaugagugaau

SEQ ID NO: 614943 - RNA, 14 nt, Homo sapiens
ugauauaugcaugu

SEQ ID NO: 614944 - RNA, 14 nt, Homo sapiens
ugauauaugccuau

SEQ ID NO: 614945 - RNA, 14 nt, Homo sapiens
ugauauauugcugu

SEQ ID NO: 614946 - RNA, 15 nt, Homo sapiens
ugauauauuucagcu

SEQ ID NO: 614947 - RNA, 14 nt, Homo sapiens
ugauaucaugggga

SEQ ID NO: 614948 - RNA, 14 nt, Homo sapiens
ugauauccaugcca

SEQ ID NO: 614949 - RNA, 21 nt, Homo sapiens
ugauaucuauauauguaucua

SEQ ID NO: 614950 - RNA, 12 nt, Homo sapiens
ugauaucugauc

SEQ ID NO: 614951 - RNA, 13 nt, Homo sapiens
ugauaugacuguu

SEQ ID NO: 614952 - RNA, 17 nt, Homo sapiens
ugauaugcaagugcaaa

SEQ ID NO: 614953 - RNA, 19 nt, Homo sapiens
ugauauguauccaucagga

SEQ ID NO: 614954 - RNA, 19 nt, Homo sapiens
ugauauuauggcaagugau

SEQ ID NO: 614955 - RNA, 15 nt, Homo sapiens
ugauauucaaccuca

SEQ ID NO: 614956 - RNA, 15 nt, Homo sapiens
ugauauucuaucugu

SEQ ID NO: 614957 - RNA, 16 nt, Homo sapiens
ugauauucuaucugua

SEQ ID NO: 614958 - RNA, 14 nt, Homo sapiens
ugauauuggcuuaa

SEQ ID NO: 614959 - RNA, 20 nt, Homo sapiens
ugauauuuauuuuuugccau

SEQ ID NO: 614960 - RNA, 19 nt, Homo sapiens
ugauauuuucacacuggua

SEQ ID NO: 614961 - RNA, 15 nt, Homo sapiens
ugauauuuuccaaau

SEQ ID NO: 614962 - RNA, 15 nt, Homo sapiens
ugaucaaaaacuauu

SEQ ID NO: 614963 - RNA, 20 nt, Homo sapiens
ugcauccauuugaacacauu

SEQ ID NO: 614964 - RNA, 19 nt, Homo sapiens
ugcauccccuuggcuguga

SEQ ID NO: 614965 - RNA, 21 nt, Homo sapiens
ugcaucccugaaacaucucaa

SEQ ID NO: 614966 - RNA, 18 nt, Homo sapiens
ugcaucccugcagcucaa

SEQ ID NO: 614967 - RNA, 14 nt, Homo sapiens
ugcaucccugguga

SEQ ID NO: 614968 - RNA, 18 nt, Homo sapiens
ugcauccguaguucccug

SEQ ID NO: 614969 - RNA, 16 nt, Homo sapiens
ugcauccucacugugg

SEQ ID NO: 614970 - RNA, 16 nt, Homo sapiens
ugcauccuuugcacug

SEQ ID NO: 614971 - RNA, 16 nt, Homo sapiens
ugcaucuccccucaga

SEQ ID NO: 614972 - RNA, 16 nt, Homo sapiens
ugcaucugaccagcag

SEQ ID NO: 614973 - RNA, 12 nt, Homo sapiens
ugcaucugaccc

SEQ ID NO: 614974 - RNA, 13 nt, Homo sapiens
ugcaucugacccc

SEQ ID NO: 614975 - RNA, 18 nt, Homo sapiens
ugcaucuggguagcugua

SEQ ID NO: 614976 - RNA, 16 nt, Homo sapiens
ugcaucuuaacaugcu

SEQ ID NO: 614977 - RNA, 16 nt, Homo sapiens
ugcaugacaaaccuua

SEQ ID NO: 614978 - RNA, 19 nt, Homo sapiens
ugcaugaccuaccaggaca

SEQ ID NO: 614979 - RNA, 21 nt, Homo sapiens
ugcaugaccugaucauuacau

SEQ ID NO: 614980 - RNA, 16 nt, Homo sapiens
ugcaugauaucuucaa

SEQ ID NO: 614981 - RNA, 23 nt, Homo sapiens
ugcaugaugagucugaaggcauu

SEQ ID NO: 614982 - RNA, 21 nt, Homo sapiens
ugcauggauguuuuagccauu

SEQ ID NO: 614983 - RNA, 20 nt, Homo sapiens
ugcauggauuucuuugaaaa

SEQ ID NO: 614984 - RNA, 18 nt, Homo sapiens
ugcaugggcuaaugaaga

SEQ ID NO: 614985 - RNA, 19 nt, Homo sapiens
ugcauguaccauuugcaug

SEQ ID NO: 614986 - RNA, 14 nt, Homo sapiens
ugcauguacuugaa

SEQ ID NO: 614987 - RNA, 16 nt, Homo sapiens
ugcauguauguauaca

SEQ ID NO: 614988 - RNA, 17 nt, Homo sapiens
ugcauguauuagcucac

SEQ ID NO: 614989 - RNA, 12 nt, Homo sapiens
ugcaugucuuaa

SEQ ID NO: 614990 - RNA, 20 nt, Homo sapiens
ugcaugucuuaaaugcucau

SEQ ID NO: 614991 - RNA, 23 nt, Homo sapiens
ugcauguggcuucucugucucug

SEQ ID NO: 614992 - RNA, 15 nt, Homo sapiens
ugcaugugugugaug

SEQ ID NO: 614993 - RNA, 21 nt, Homo sapiens
ugcauguuacauaagauaaau

SEQ ID NO: 614994 - RNA, 14 nt, Homo sapiens
ugcauuauaucaaa

SEQ ID NO: 614995 - RNA, 22 nt, Homo sapiens
ugcauucauuuuuauagcaaca

SEQ ID NO: 614996 - RNA, 16 nt, Homo sapiens
ugcauuccagaacaaa

SEQ ID NO: 614997 - RNA, 16 nt, Homo sapiens
ugcauucccagugguc

SEQ ID NO: 614998 - RNA, 18 nt, Homo sapiens
ugcauuccuuacuugcac

SEQ ID NO: 614999 - RNA, 15 nt, Homo sapiens
ugcauugaaaugcaa

SEQ ID NO: 615000 - RNA, 18 nt, Homo sapiens
ugcauugagaacugcaua

SEQ ID NO: 615001 - RNA, 14 nt, Homo sapiens
ugcauuguauuuag

SEQ ID NO: 615002 - RNA, 19 nt, Homo sapiens
ugcauuuauaugcgcuuaa

SEQ ID NO: 615003 - RNA, 18 nt, Homo sapiens
ugcauuuaugaugcaguu

SEQ ID NO: 615004 - RNA, 22 nt, Homo sapiens
ugcauuuauggucaacacuuaa

SEQ ID NO: 615005 - RNA, 18 nt, Homo sapiens
ugcauuucaccugugaca

SEQ ID NO: 615006 - RNA, 16 nt, Homo sapiens
ugcauuuccuguguuu

SEQ ID NO: 615007 - RNA, 13 nt, Homo sapiens
ugcauuugcacua

SEQ ID NO: 615008 - RNA, 14 nt, Homo sapiens
ugcauuugcacuau

SEQ ID NO: 615009 - RNA, 20 nt, Homo sapiens
ugcauuuggauugggguccc

SEQ ID NO: 615010 - RNA, 14 nt, Homo sapiens
ugcauuuguaaaaa

SEQ ID NO: 615011 - RNA, 23 nt, Homo sapiens
ugcauuugucaaagcauugagau

SEQ ID NO: 615012 - RNA, 17 nt, Homo sapiens
ugcauuuuuaaauacaa

SEQ ID NO: 615013 - RNA, 16 nt, Homo sapiens
ugccaaaaacaaaaaa

SEQ ID NO: 615014 - RNA, 19 nt, Homo sapiens
ugccaaaaaggauacauaa

SEQ ID NO: 615015 - RNA, 10 nt, Homo sapiens
ugccaaaaau

SEQ ID NO: 615016 - RNA, 14 nt, Homo sapiens
ugccaaaaccaaga

SEQ ID NO: 615017 - RNA, 15 nt, Homo sapiens
ugccaaacagccaca

SEQ ID NO: 615018 - RNA, 18 nt, Homo sapiens
ugccaaaggaugugauau

SEQ ID NO: 615019 - RNA, 19 nt, Homo sapiens
ugccaaauagccccagacu

SEQ ID NO: 615020 - RNA, 16 nt, Homo sapiens
ugccaaauauguccug

SEQ ID NO: 615021 - RNA, 18 nt, Homo sapiens
ugccaacaccuucuuggc

SEQ ID NO: 615022 - RNA, 12 nt, Homo sapiens
ugccaaccaguu

SEQ ID NO: 615023 - RNA, 15 nt, Homo sapiens
ugccaaccggucacc

SEQ ID NO: 615024 - RNA, 16 nt, Homo sapiens
ugccaagaaaguauuu

SEQ ID NO: 615025 - RNA, 17 nt, Homo sapiens
ugccaagccuucuguga

SEQ ID NO: 615026 - RNA, 17 nt, Homo sapiens
ugccaaggcaagaucua

SEQ ID NO: 615027 - RNA, 19 nt, Homo sapiens
ugccaagggcaggaccaau

SEQ ID NO: 615028 - RNA, 20 nt, Homo sapiens
ugccaagggggugacuggaa

SEQ ID NO: 615029 - RNA, 18 nt, Homo sapiens
ugccaagggguuaaugaa

SEQ ID NO: 615030 - RNA, 16 nt, Homo sapiens
ugccacacggcucuca

SEQ ID NO: 615031 - RNA, 17 nt, Homo sapiens
ugccacagcucaacucg

SEQ ID NO: 615032 - RNA, 21 nt, Homo sapiens
ugccacaggaggggaaguagg

SEQ ID NO: 615033 - RNA, 22 nt, Homo sapiens
ugccacauggugucucccaaca

SEQ ID NO: 615034 - RNA, 13 nt, Homo sapiens
ugccaccagucac

SEQ ID NO: 615035 - RNA, 17 nt, Homo sapiens
ugccaccccaacccaau

SEQ ID NO: 615036 - RNA, 19 nt, Homo sapiens
ugccaccccaugugccuuu

SEQ ID NO: 615037 - RNA, 17 nt, Homo sapiens
ugccaccccuaaacucc

SEQ ID NO: 615038 - RNA, 23 nt, Homo sapiens
ugccacccucacacacacagcug

SEQ ID NO: 615039 - RNA, 24 nt, Homo sapiens
ugccaccucugacgcaccacugcc

SEQ ID NO: 615040 - RNA, 18 nt, Homo sapiens
ugccacgcacuuccucuc

SEQ ID NO: 615041 - RNA, 16 nt, Homo sapiens
ugccacuaaacuacau

SEQ ID NO: 615042 - RNA, 17 nt, Homo sapiens
ugccacuacacuccagc

SEQ ID NO: 615043 - RNA, 17 nt, Homo sapiens
ugccacucccugagcuu

SEQ ID NO: 615044 - RNA, 18 nt, Homo sapiens
ugccacuggaagggcaga

SEQ ID NO: 615045 - RNA, 18 nt, Homo sapiens
ugccacugugugccuucu

SEQ ID NO: 615046 - RNA, 22 nt, Homo sapiens
ugccacuuccuuuuaacugcca

SEQ ID NO: 615047 - RNA, 19 nt, Homo sapiens
ugccacuuuacccaccuag

SEQ ID NO: 615048 - RNA, 19 nt, Homo sapiens
ugccacuuugcagcuaaaa

SEQ ID NO: 615049 - RNA, 18 nt, Homo sapiens
ugccagaaagcauaaaau

SEQ ID NO: 615050 - RNA, 22 nt, Homo sapiens
ugccagacaaauaggagugagu

SEQ ID NO: 615051 - RNA, 12 nt, Homo sapiens
ugccagacauug

SEQ ID NO: 615052 - RNA, 22 nt, Homo sapiens
ugccagauuaccgacacuguca

SEQ ID NO: 615053 - RNA, 14 nt, Homo sapiens
ugccagcaaauaaa

SEQ ID NO: 615054 - RNA, 21 nt, Homo sapiens
ugccagcauuuagacccugca

SEQ ID NO: 615055 - RNA, 16 nt, Homo sapiens
ugccagcuuaucucag

SEQ ID NO: 615056 - RNA, 23 nt, Homo sapiens
ugccaggagggcacagcagggga

SEQ ID NO: 615057 - RNA, 19 nt, Homo sapiens
ugccaggccagagggcagu

SEQ ID NO: 615058 - RNA, 18 nt, Homo sapiens
ugccagggacugacaaaa

SEQ ID NO: 615059 - RNA, 22 nt, Homo sapiens
ugccagggcuggaagcuuucau

SEQ ID NO: 615060 - RNA, 21 nt, Homo sapiens
ugccaggggcuucccacuuug

SEQ ID NO: 615061 - RNA, 22 nt, Homo sapiens
ugccaggggcuucccacuuugg

SEQ ID NO: 615062 - RNA, 21 nt, Homo sapiens
ugccagguggcucagugccac

SEQ ID NO: 615063 - RNA, 12 nt, Homo sapiens
ugccagucccag

SEQ ID NO: 615064 - RNA, 11 nt, Homo sapiens
ugccagugaaa

SEQ ID NO: 615065 - RNA, 15 nt, Homo sapiens
ugccagugacagaca

SEQ ID NO: 615066 - RNA, 16 nt, Homo sapiens
ugccagugccucucac

SEQ ID NO: 615067 - RNA, 16 nt, Homo sapiens
ugccauaaaacauuaa

SEQ ID NO: 615068 - RNA, 18 nt, Homo sapiens
ugccauagcugacuacaa

SEQ ID NO: 615069 - RNA, 22 nt, Homo sapiens
ugccaucuguacauauuacugu

SEQ ID NO: 615070 - RNA, 20 nt, Homo sapiens
ugccaucugugauaugccau

SEQ ID NO: 615071 - RNA, 12 nt, Homo sapiens
ugccaucuucag

SEQ ID NO: 615072 - RNA, 12 nt, Homo sapiens
ugccaugaaaau

SEQ ID NO: 615073 - RNA, 13 nt, Homo sapiens
ugccaugcuuuuu

SEQ ID NO: 615074 - RNA, 15 nt, Homo sapiens
ugccauggaucugau

SEQ ID NO: 615075 - RNA, 11 nt, Homo sapiens
ugccaugucac

SEQ ID NO: 615076 - RNA, 12 nt, Homo sapiens
ugccaugugaag

SEQ ID NO: 615077 - RNA, 17 nt, Homo sapiens
ugccauguuuuugccaa

SEQ ID NO: 615078 - RNA, 21 nt, Homo sapiens
ugccauuaaaagcauugucca

SEQ ID NO: 615079 - RNA, 17 nt, Homo sapiens
ugccauuacuacuguac

SEQ ID NO: 615080 - RNA, 18 nt, Homo sapiens
ugccauuauauuugcauu

SEQ ID NO: 615081 - RNA, 20 nt, Homo sapiens
ugccauuauauuugcauuau

SEQ ID NO: 615082 - RNA, 18 nt, Homo sapiens
ugccauucaacucggaaa

SEQ ID NO: 615083 - RNA, 20 nt, Homo sapiens
ugccauuggacuauggagug

SEQ ID NO: 615084 - RNA, 22 nt, Homo sapiens
ugcccaaaagccauguauuuca

SEQ ID NO: 615085 - RNA, 21 nt, Homo sapiens
ugcugggcugacggugcaguc

SEQ ID NO: 615086 - RNA, 20 nt, Homo sapiens
ugcuggggcugaacaugccu

SEQ ID NO: 615087 - RNA, 20 nt, Homo sapiens
ugcugggguacacagugaga

SEQ ID NO: 615088 - RNA, 14 nt, Homo sapiens
ugcugguagcacuu

SEQ ID NO: 615089 - RNA, 20 nt, Homo sapiens
ugcuggucagagagaccuca

SEQ ID NO: 615090 - RNA, 21 nt, Homo sapiens
ugcuguaauauuguaaauacu

SEQ ID NO: 615091 - RNA, 11 nt, Homo sapiens
ugcuguagaag

SEQ ID NO: 615092 - RNA, 14 nt, Homo sapiens
ugcuguaugcugau

SEQ ID NO: 615093 - RNA, 21 nt, Homo sapiens
ugcuguaugcugaucaucgcc

SEQ ID NO: 615094 - RNA, 14 nt, Homo sapiens
ugcuguaugucucg

SEQ ID NO: 615095 - RNA, 17 nt, Homo sapiens
ugcugucaagcaccugc

SEQ ID NO: 615096 - RNA, 17 nt, Homo sapiens
ugcugucacaaccaaga

SEQ ID NO: 615097 - RNA, 19 nt, Homo sapiens
ugcuguccacaugaccucc

SEQ ID NO: 615098 - RNA, 16 nt, Homo sapiens
ugcuguccaggcagcu

SEQ ID NO: 615099 - RNA, 15 nt, Homo sapiens
ugcugucccuauaca

SEQ ID NO: 615100 - RNA, 15 nt, Homo sapiens
ugcugucuugcccca

SEQ ID NO: 615101 - RNA, 20 nt, Homo sapiens
ugcugugacuagaaccauaa

SEQ ID NO: 615102 - RNA, 14 nt, Homo sapiens
ugcugugacuuccu

SEQ ID NO: 615103 - RNA, 14 nt, Homo sapiens
ugcugugauuccac

SEQ ID NO: 615104 - RNA, 22 nt, Homo sapiens
ugcuguggcccccuguccccaa

SEQ ID NO: 615105 - RNA, 15 nt, Homo sapiens
ugcuguguccucuag

SEQ ID NO: 615106 - RNA, 19 nt, Homo sapiens
ugcugugucuccucucaga

SEQ ID NO: 615107 - RNA, 20 nt, Homo sapiens
ugcugugugacccugggcaa

SEQ ID NO: 615108 - RNA, 20 nt, Homo sapiens
ugcuguuaaaauaagaacaa

SEQ ID NO: 615109 - RNA, 20 nt, Homo sapiens
ugcuguuuuuuuugcugcua

SEQ ID NO: 615110 - RNA, 21 nt, Homo sapiens
ugcuuaaacccuuuagugcuu

SEQ ID NO: 615111 - RNA, 23 nt, Homo sapiens
ugcuuaaacccuuuagugcuuug

SEQ ID NO: 615112 - RNA, 18 nt, Homo sapiens
ugcuuaaacuugacccag

SEQ ID NO: 615113 - RNA, 20 nt, Homo sapiens
ugcuuaacuccccacugccu

SEQ ID NO: 615114 - RNA, 21 nt, Homo sapiens
ugcuuaauaaauuguguuucc

SEQ ID NO: 615115 - RNA, 14 nt, Homo sapiens
ugcuuaaucuugcu

SEQ ID NO: 615116 - RNA, 13 nt, Homo sapiens
ugcuuacaaaguc

SEQ ID NO: 615117 - RNA, 19 nt, Homo sapiens
ugcuuacccuucaccuuug

SEQ ID NO: 615118 - RNA, 17 nt, Homo sapiens
ugcuuaccuacuuucuu

SEQ ID NO: 615119 - RNA, 19 nt, Homo sapiens
ugcuuaccucucagccuua

SEQ ID NO: 615120 - RNA, 20 nt, Homo sapiens
ugcuuaccucucagccuuag

SEQ ID NO: 615121 - RNA, 16 nt, Homo sapiens
ugcuuaccugaucuca

SEQ ID NO: 615122 - RNA, 19 nt, Homo sapiens
ugcuuaccuuuuccuauuc

SEQ ID NO: 615123 - RNA, 23 nt, Homo sapiens
ugcuuacuaagcuuugccagcug

SEQ ID NO: 615124 - RNA, 20 nt, Homo sapiens
ugcuuaggcuguauauucaa

SEQ ID NO: 615125 - RNA, 17 nt, Homo sapiens
ugcuuaugaaaccugua

SEQ ID NO: 615126 - RNA, 19 nt, Homo sapiens
ugcuucaaaaacauucuua

SEQ ID NO: 615127 - RNA, 13 nt, Homo sapiens
ugcuucaaauuca

SEQ ID NO: 615128 - RNA, 17 nt, Homo sapiens
ugcuucagacauguaau

SEQ ID NO: 615129 - RNA, 13 nt, Homo sapiens
ugcuucagaguuu

SEQ ID NO: 615130 - RNA, 21 nt, Homo sapiens
ugcuucaggaaggacauggac

SEQ ID NO: 615131 - RNA, 23 nt, Homo sapiens
ugcuucaggaaggacauggacaa

SEQ ID NO: 615132 - RNA, 13 nt, Homo sapiens
ugcuucaucugcu

SEQ ID NO: 615133 - RNA, 16 nt, Homo sapiens
ugcuucauuccaaucu

SEQ ID NO: 615134 - RNA, 21 nt, Homo sapiens
ugcuucccagaggagcagcuc

SEQ ID NO: 615135 - RNA, 22 nt, Homo sapiens
ugcuucccagaggagcagcucu

SEQ ID NO: 615136 - RNA, 17 nt, Homo sapiens
ugcuucccccaccccuc

SEQ ID NO: 615137 - RNA, 22 nt, Homo sapiens
ugcuucccgagugagcauggaa

SEQ ID NO: 615138 - RNA, 23 nt, Homo sapiens
ugcuucccggcgucccuaccucc

SEQ ID NO: 615139 - RNA, 17 nt, Homo sapiens
ugcuuccgcugcuugaa

SEQ ID NO: 615140 - RNA, 22 nt, Homo sapiens
ugcuuccucccaacaagcagcu

SEQ ID NO: 615141 - RNA, 23 nt, Homo sapiens
ugcuuccuccuuugcucuuggga

SEQ ID NO: 615142 - RNA, 14 nt, Homo sapiens
ugcuuccugucuua

SEQ ID NO: 615143 - RNA, 20 nt, Homo sapiens
ugcuuccugucuuauccucc

SEQ ID NO: 615144 - RNA, 14 nt, Homo sapiens
ugcuucgaaguauu

SEQ ID NO: 615145 - RNA, 14 nt, Homo sapiens
ugcuucgacuacug

SEQ ID NO: 615146 - RNA, 20 nt, Homo sapiens
ugcuucucaucccaaccucu

SEQ ID NO: 615147 - RNA, 19 nt, Homo sapiens
ugcuucuccaagcuuucag

SEQ ID NO: 615148 - RNA, 15 nt, Homo sapiens
ugcuucucccgggga

SEQ ID NO: 615149 - RNA, 22 nt, Homo sapiens
ugcuucucuucuuuauugcacu

SEQ ID NO: 615150 - RNA, 23 nt, Homo sapiens
ugcuucucuucuuuauugcacua

SEQ ID NO: 615151 - RNA, 22 nt, Homo sapiens
ugcuucuuuccuuuccauugua

SEQ ID NO: 615152 - RNA, 17 nt, Homo sapiens
ugcuugaaaccaaagau

SEQ ID NO: 615153 - RNA, 13 nt, Homo sapiens
ugcuugauuccag

SEQ ID NO: 615154 - RNA, 16 nt, Homo sapiens
ugcuugcccgcuccca

SEQ ID NO: 615155 - RNA, 23 nt, Homo sapiens
ugcuugggaccagaaguguuuca

SEQ ID NO: 615156 - RNA, 16 nt, Homo sapiens
ugcuuguacauaaugc

SEQ ID NO: 615157 - RNA, 15 nt, Homo sapiens
ugcuugucauauucg

SEQ ID NO: 615158 - RNA, 15 nt, Homo sapiens
ugcuuguuauauuaa

SEQ ID NO: 615159 - RNA, 23 nt, Homo sapiens
ugcuuguugggauuccugaccca

SEQ ID NO: 615160 - RNA, 14 nt, Homo sapiens
ugcuuuaggcucac

SEQ ID NO: 615161 - RNA, 21 nt, Homo sapiens
ugcuuuagucacuaauugcuu

SEQ ID NO: 615162 - RNA, 14 nt, Homo sapiens
ugcuuuauacacug

SEQ ID NO: 615163 - RNA, 13 nt, Homo sapiens
ugcuuucaucuaa

SEQ ID NO: 615164 - RNA, 15 nt, Homo sapiens
ugcuuucugguggug

SEQ ID NO: 615165 - RNA, 19 nt, Homo sapiens
ugcuuucuuguugcugcau

SEQ ID NO: 615166 - RNA, 21 nt, Homo sapiens
ugcuuugaaacuugccugggg

SEQ ID NO: 615167 - RNA, 14 nt, Homo sapiens
ugcuuugaagcagu

SEQ ID NO: 615168 - RNA, 23 nt, Homo sapiens
ugcuuugccaaguugcugucacu

SEQ ID NO: 615169 - RNA, 12 nt, Homo sapiens
ugcuuugcccaa

SEQ ID NO: 615170 - RNA, 18 nt, Homo sapiens
ugcuuugcucuacaaaua

SEQ ID NO: 615171 - RNA, 12 nt, Homo sapiens
ugcuuugcugac

SEQ ID NO: 615172 - RNA, 16 nt, Homo sapiens
ugcuuugcugaccaaa

SEQ ID NO: 615173 - RNA, 14 nt, Homo sapiens
ugcuuugcugcuau

SEQ ID NO: 615174 - RNA, 17 nt, Homo sapiens
ugcuuugcugcuaugaa

SEQ ID NO: 615175 - RNA, 18 nt, Homo sapiens
ugcuuugguuccuaagga

SEQ ID NO: 615176 - RNA, 13 nt, Homo sapiens
ugcuuugugauuu

SEQ ID NO: 615177 - RNA, 22 nt, Homo sapiens
ugcuuuguuuuaauaaacagua

SEQ ID NO: 615178 - RNA, 15 nt, Homo sapiens
ugcuuuuacuucucu

SEQ ID NO: 615179 - RNA, 14 nt, Homo sapiens
ugcuuuucaggguu

SEQ ID NO: 615180 - RNA, 16 nt, Homo sapiens
ugcuuuucccauugcc

SEQ ID NO: 615181 - RNA, 23 nt, Homo sapiens
ugcuuuugcccauuuugaaucac

SEQ ID NO: 615182 - RNA, 23 nt, Homo sapiens
uggaaaaaaacaaaaacagaauu

SEQ ID NO: 615183 - RNA, 15 nt, Homo sapiens
uggaaaaaacucuga

SEQ ID NO: 615184 - RNA, 17 nt, Homo sapiens
uggaaaaaccauuugaa

SEQ ID NO: 615185 - RNA, 17 nt, Homo sapiens
uggaaaagaagaaacuu

SEQ ID NO: 615186 - RNA, 21 nt, Homo sapiens
uggaaaagaagaaacuuugcc

SEQ ID NO: 615187 - RNA, 22 nt, Homo sapiens
uggaaaagcaaaacuguagggg

SEQ ID NO: 615188 - RNA, 19 nt, Homo sapiens
uggaaaagcaacauucaua

SEQ ID NO: 615189 - RNA, 17 nt, Homo sapiens
uggaaaauaguuugcaa

SEQ ID NO: 615190 - RNA, 14 nt, Homo sapiens
uggaaaaugcaaug

SEQ ID NO: 615191 - RNA, 21 nt, Homo sapiens
uggaaaauucucuuaaucacu

SEQ ID NO: 615192 - RNA, 14 nt, Homo sapiens
uggaaacagaugaa

SEQ ID NO: 615193 - RNA, 15 nt, Homo sapiens
uggaaacagcaugaa

SEQ ID NO: 615194 - RNA, 18 nt, Homo sapiens
uggaaacagcaugaauaa

SEQ ID NO: 615195 - RNA, 20 nt, Homo sapiens
uggaaacgcaaaugaguauu

SEQ ID NO: 615196 - RNA, 13 nt, Homo sapiens
uggaaacuaagac

SEQ ID NO: 615197 - RNA, 17 nt, Homo sapiens
uggaaagacauagccaa

SEQ ID NO: 615198 - RNA, 14 nt, Homo sapiens
uggaaagcugauga

SEQ ID NO: 615199 - RNA, 18 nt, Homo sapiens
uggaaauaaaccauugga

SEQ ID NO: 615200 - RNA, 14 nt, Homo sapiens
uggaaauaaaguca

SEQ ID NO: 615201 - RNA, 21 nt, Homo sapiens
uggaaauagaaagaagccaua

SEQ ID NO: 615202 - RNA, 18 nt, Homo sapiens
uggaaaucugaacauucu

SEQ ID NO: 615203 - RNA, 12 nt, Homo sapiens
uggaaaucuguu

SEQ ID NO: 615204 - RNA, 13 nt, Homo sapiens
uggaaaugaccag

SEQ ID NO: 615205 - RNA, 13 nt, Homo sapiens
uggaaaugccauu

SEQ ID NO: 615206 - RNA, 20 nt, Homo sapiens
uguguuuuauugacaucucu

SEQ ID NO: 615207 - RNA, 18 nt, Homo sapiens
uguguuuuuaacauguca

SEQ ID NO: 615208 - RNA, 20 nt, Homo sapiens
uguguuuuuaacaugucaau

SEQ ID NO: 615209 - RNA, 21 nt, Homo sapiens
uguguuuuuaauaaagacagg

SEQ ID NO: 615210 - RNA, 16 nt, Homo sapiens
uguguuuuuucggaca

SEQ ID NO: 615211 - RNA, 15 nt, Homo sapiens
uguuaaaaccaaacu

SEQ ID NO: 615212 - RNA, 20 nt, Homo sapiens
uguuaaaauaagaacaaaga

SEQ ID NO: 615213 - RNA, 12 nt, Homo sapiens
uguuaacacuca

SEQ ID NO: 615214 - RNA, 13 nt, Homo sapiens
uguuaacacucau

SEQ ID NO: 615215 - RNA, 13 nt, Homo sapiens
uguuaacauuagc

SEQ ID NO: 615216 - RNA, 19 nt, Homo sapiens
uguuaacauuagcaaauau

SEQ ID NO: 615217 - RNA, 15 nt, Homo sapiens
uguuaagacuugaca

SEQ ID NO: 615218 - RNA, 13 nt, Homo sapiens
uguuaagugcagg

SEQ ID NO: 615219 - RNA, 22 nt, Homo sapiens
uguuaaugaagauggacauuuu

SEQ ID NO: 615220 - RNA, 19 nt, Homo sapiens
uguuaauuuacuuucugca

SEQ ID NO: 615221 - RNA, 13 nt, Homo sapiens
uguuaauuuagag

SEQ ID NO: 615222 - RNA, 19 nt, Homo sapiens
uguuaauuuuuuuuacuau

SEQ ID NO: 615223 - RNA, 22 nt, Homo sapiens
uguuaauuuuuuuuacuauaaa

SEQ ID NO: 615224 - RNA, 20 nt, Homo sapiens
uguuacaaaaagacaaaaau

SEQ ID NO: 615225 - RNA, 19 nt, Homo sapiens
uguuacacagcccaagagg

SEQ ID NO: 615226 - RNA, 20 nt, Homo sapiens
uguuacagcuuucugugcag

SEQ ID NO: 615227 - RNA, 12 nt, Homo sapiens
uguuaccuuaaa

SEQ ID NO: 615228 - RNA, 20 nt, Homo sapiens
uguuacugcuuugcaaagac

SEQ ID NO: 615229 - RNA, 22 nt, Homo sapiens
uguuacugguagaaaggcaguu

SEQ ID NO: 615230 - RNA, 20 nt, Homo sapiens
uguuacuugaaauaccagug

SEQ ID NO: 615231 - RNA, 21 nt, Homo sapiens
uguuagauauuaggucccauc

SEQ ID NO: 615232 - RNA, 14 nt, Homo sapiens
uguuagauuccucu

SEQ ID NO: 615233 - RNA, 18 nt, Homo sapiens
uguuagcagacccagcuu

SEQ ID NO: 615234 - RNA, 18 nt, Homo sapiens
uguuaggaagggacugca

SEQ ID NO: 615235 - RNA, 20 nt, Homo sapiens
uguuagggagaugaguugca

SEQ ID NO: 615236 - RNA, 14 nt, Homo sapiens
uguuagguucacac

SEQ ID NO: 615237 - RNA, 19 nt, Homo sapiens
uguuagugugugugcaugu

SEQ ID NO: 615238 - RNA, 16 nt, Homo sapiens
uguuauagaacuucau

SEQ ID NO: 615239 - RNA, 23 nt, Homo sapiens
uguuauauagggaucaaccagcu

SEQ ID NO: 615240 - RNA, 18 nt, Homo sapiens
uguuaucaaccaacugca

SEQ ID NO: 615241 - RNA, 20 nt, Homo sapiens
uguuaucagucauaacuaaa

SEQ ID NO: 615242 - RNA, 13 nt, Homo sapiens
uguuaucugcuag

SEQ ID NO: 615243 - RNA, 18 nt, Homo sapiens
uguuaucuuccacuggaa

SEQ ID NO: 615244 - RNA, 18 nt, Homo sapiens
uguuaugauauuguuuaa

SEQ ID NO: 615245 - RNA, 18 nt, Homo sapiens
uguuaugcuccugcugau

SEQ ID NO: 615246 - RNA, 17 nt, Homo sapiens
uguuaugugcaaguuua

SEQ ID NO: 615247 - RNA, 14 nt, Homo sapiens
uguuauucauuugg

SEQ ID NO: 615248 - RNA, 12 nt, Homo sapiens
uguuauuuacac

SEQ ID NO: 615249 - RNA, 22 nt, Homo sapiens
uguuauuuucuguugaaguuua

SEQ ID NO: 615250 - RNA, 18 nt, Homo sapiens
uguucaaaccucugccgc

SEQ ID NO: 615251 - RNA, 12 nt, Homo sapiens
uguucaaagcac

SEQ ID NO: 615252 - RNA, 14 nt, Homo sapiens
uguucaauacugua

SEQ ID NO: 615253 - RNA, 14 nt, Homo sapiens
uguucaaugcuaga

SEQ ID NO: 615254 - RNA, 21 nt, Homo sapiens
uguucacaaacuaccucugga

SEQ ID NO: 615255 - RNA, 15 nt, Homo sapiens
uguucacccacaucu

SEQ ID NO: 615256 - RNA, 15 nt, Homo sapiens
uguucaccuucaaaa

SEQ ID NO: 615257 - RNA, 19 nt, Homo sapiens
uguucacggugacacaggu

SEQ ID NO: 615258 - RNA, 18 nt, Homo sapiens
uguucagaauggauuuau

SEQ ID NO: 615259 - RNA, 18 nt, Homo sapiens
uguucauagcaacauuau

SEQ ID NO: 615260 - RNA, 21 nt, Homo sapiens
uguucauccucauugccuccu

SEQ ID NO: 615261 - RNA, 16 nt, Homo sapiens
uguucauggacuauuc

SEQ ID NO: 615262 - RNA, 15 nt, Homo sapiens
uguucauguuacuca

SEQ ID NO: 615263 - RNA, 20 nt, Homo sapiens
uguucauuuuagugacugua

SEQ ID NO: 615264 - RNA, 17 nt, Homo sapiens
uguuccaauuugacaaa

SEQ ID NO: 615265 - RNA, 23 nt, Homo sapiens
uguuccaauuugacaaaacccac

SEQ ID NO: 615266 - RNA, 22 nt, Homo sapiens
uguuccagauccuucaaagagu

SEQ ID NO: 615267 - RNA, 20 nt, Homo sapiens
uguuccauuugaaccaguga

SEQ ID NO: 615268 - RNA, 18 nt, Homo sapiens
uguucccauuuuugcuua

SEQ ID NO: 615269 - RNA, 16 nt, Homo sapiens
uguucccgauggucuc

SEQ ID NO: 615270 - RNA, 14 nt, Homo sapiens
uguucccugacucc

SEQ ID NO: 615271 - RNA, 15 nt, Homo sapiens
uguucccuguucugg

SEQ ID NO: 615272 - RNA, 19 nt, Homo sapiens
uguuccuaaaauggugaua

SEQ ID NO: 615273 - RNA, 15 nt, Homo sapiens
uguuccuagaaugca

SEQ ID NO: 615274 - RNA, 20 nt, Homo sapiens
uguuccucuaguaguauauu

SEQ ID NO: 615275 - RNA, 17 nt, Homo sapiens
uguuccuggcugaugau

SEQ ID NO: 615276 - RNA, 14 nt, Homo sapiens
uguuccuuaccaag

SEQ ID NO: 615277 - RNA, 19 nt, Homo sapiens
uguuccuugucacugguag

SEQ ID NO: 615278 - RNA, 20 nt, Homo sapiens
uguuccuuuaagguacugaa

SEQ ID NO: 615279 - RNA, 22 nt, Homo sapiens
uguucuaaagguggugaggcaa

SEQ ID NO: 615280 - RNA, 15 nt, Homo sapiens
uguucuaaguauuug

SEQ ID NO: 615281 - RNA, 13 nt, Homo sapiens
uguucuacacuca

SEQ ID NO: 615282 - RNA, 21 nt, Homo sapiens
uguucuacaugaggacucaua

SEQ ID NO: 615283 - RNA, 16 nt, Homo sapiens
uguucuauuugugcuu

SEQ ID NO: 615284 - RNA, 14 nt, Homo sapiens
uguucuccaacucc

SEQ ID NO: 615285 - RNA, 20 nt, Homo sapiens
uguucugacccugcuucaaa

SEQ ID NO: 615286 - RNA, 18 nt, Homo sapiens
uguucugcagucaucucc

SEQ ID NO: 615287 - RNA, 22 nt, Homo sapiens
uguucugcuacccacugccaga

SEQ ID NO: 615288 - RNA, 15 nt, Homo sapiens
uguucugggggacag

SEQ ID NO: 615289 - RNA, 17 nt, Homo sapiens
uguucuggguccauaca

SEQ ID NO: 615290 - RNA, 13 nt, Homo sapiens
uguucugucccag

SEQ ID NO: 615291 - RNA, 16 nt, Homo sapiens
uguucuguugauccca

SEQ ID NO: 615292 - RNA, 19 nt, Homo sapiens
uguucuucuucauauucua

SEQ ID NO: 615293 - RNA, 13 nt, Homo sapiens
uguucuugcuacc

SEQ ID NO: 615294 - RNA, 12 nt, Homo sapiens
uguucuuuggaa

SEQ ID NO: 615295 - RNA, 17 nt, Homo sapiens
uguugaaaauguucaga

SEQ ID NO: 615296 - RNA, 18 nt, Homo sapiens
uguugaaggaacuugucu

SEQ ID NO: 615297 - RNA, 15 nt, Homo sapiens
uguugaagucucagg

SEQ ID NO: 615298 - RNA, 18 nt, Homo sapiens
uguugaaucugagcugca

SEQ ID NO: 615299 - RNA, 19 nt, Homo sapiens
uguugacaaaauuuucuca

SEQ ID NO: 615300 - RNA, 19 nt, Homo sapiens
uguugacaucaacauggca

SEQ ID NO: 615301 - RNA, 13 nt, Homo sapiens
uguugacugcugc

SEQ ID NO: 615302 - RNA, 16 nt, Homo sapiens
uguugaggcugucaca

SEQ ID NO: 615303 - RNA, 16 nt, Homo sapiens
uguugaggugcaagga

SEQ ID NO: 615304 - RNA, 15 nt, Homo sapiens
uguugagugcacuga

SEQ ID NO: 615305 - RNA, 13 nt, Homo sapiens
uguugagugccag

SEQ ID NO: 615306 - RNA, 16 nt, Homo sapiens
uguugauaaaugacac

SEQ ID NO: 615307 - RNA, 19 nt, Homo sapiens
uguugauaauuucagggaa

SEQ ID NO: 615308 - RNA, 18 nt, Homo sapiens
uguugaugaaguauacuu

SEQ ID NO: 615309 - RNA, 13 nt, Homo sapiens
uguugauguaucu

SEQ ID NO: 615310 - RNA, 15 nt, Homo sapiens
uguugauuuccucug

SEQ ID NO: 615311 - RNA, 16 nt, Homo sapiens
uguugcaaacuaugca

SEQ ID NO: 615312 - RNA, 21 nt, Homo sapiens
uguugcaggcuguaaggcaug

SEQ ID NO: 615313 - RNA, 16 nt, Homo sapiens
uguugcagguucaugg

SEQ ID NO: 615314 - RNA, 21 nt, Homo sapiens
uguugcaugggcuaaugaaga

SEQ ID NO: 615315 - RNA, 11 nt, Homo sapiens
uguugccaaau

SEQ ID NO: 615316 - RNA, 22 nt, Homo sapiens
uguugcccacauuaagcacugu

SEQ ID NO: 615317 - RNA, 20 nt, Homo sapiens
uguugcccaggcuggagugc

SEQ ID NO: 615318 - RNA, 21 nt, Homo sapiens
uguugcccaggcuggucucaa

SEQ ID NO: 615319 - RNA, 20 nt, Homo sapiens
uguugcucucuaguuuccag

SEQ ID NO: 615320 - RNA, 13 nt, Homo sapiens
uguugcugcaucu

SEQ ID NO: 615321 - RNA, 12 nt, Homo sapiens
uguugcuuuaac

SEQ ID NO: 615322 - RNA, 17 nt, Homo sapiens
uguuggaaaaugugcaa

SEQ ID NO: 615323 - RNA, 18 nt, Homo sapiens
uguuggaaaaugugcaau

SEQ ID NO: 615324 - RNA, 19 nt, Homo sapiens
uguuggaaaaugugcaaua

SEQ ID NO: 615325 - RNA, 19 nt, Homo sapiens
uguuggaaauguaguauag

SEQ ID NO: 615326 - RNA, 18 nt, Homo sapiens
uguuggaguguaaaccaa

SEQ ID NO: 615327 - RNA, 13 nt, Homo sapiens
uguuggcaaaaga

SEQ ID NO: 615328 - RNA, 23 nt, Homo sapiens
uuacaaaacaugauuguuuacag

SEQ ID NO: 615329 - RNA, 14 nt, Homo sapiens
uuacaaaauacagg

SEQ ID NO: 615330 - RNA, 23 nt, Homo sapiens
uuacaaacauggaaaacagagua

SEQ ID NO: 615331 - RNA, 24 nt, Homo sapiens
uuacaaagggccaucguucaucca

SEQ ID NO: 615332 - RNA, 22 nt, Homo sapiens
uuacaaauagguagagucauuc

SEQ ID NO: 615333 - RNA, 15 nt, Homo sapiens
uuacaacagugagaa

SEQ ID NO: 615334 - RNA, 22 nt, Homo sapiens
uuacaaugaucaccgacugaaa

SEQ ID NO: 615335 - RNA, 14 nt, Homo sapiens
uuacacaaagggaa

SEQ ID NO: 615336 - RNA, 13 nt, Homo sapiens
uuacacaucucag

SEQ ID NO: 615337 - RNA, 16 nt, Homo sapiens
uuacacaugugcugau

SEQ ID NO: 615338 - RNA, 16 nt, Homo sapiens
uuacaccaacuccuaa

SEQ ID NO: 615339 - RNA, 18 nt, Homo sapiens
uuacacccuuucuugaca

SEQ ID NO: 615340 - RNA, 19 nt, Homo sapiens
uuacacccuuucuugacaa

SEQ ID NO: 615341 - RNA, 18 nt, Homo sapiens
uuacacugaggacugugg

SEQ ID NO: 615342 - RNA, 20 nt, Homo sapiens
uuacacuuuuuggaagugaa

SEQ ID NO: 615343 - RNA, 22 nt, Homo sapiens
uuacacuuuuuggaagugaaaa

SEQ ID NO: 615344 - RNA, 19 nt, Homo sapiens
uuacagaaaagacucugac

SEQ ID NO: 615345 - RNA, 14 nt, Homo sapiens
uuacagaacuacuu

SEQ ID NO: 615346 - RNA, 14 nt, Homo sapiens
uuacagaaugggag

SEQ ID NO: 615347 - RNA, 13 nt, Homo sapiens
uuacagacaggaa

SEQ ID NO: 615348 - RNA, 20 nt, Homo sapiens
uuacagacuagcaggcuacu

SEQ ID NO: 615349 - RNA, 22 nt, Homo sapiens
uuacagacugaugccagacaaa

SEQ ID NO: 615350 - RNA, 18 nt, Homo sapiens
uuacagagaggauacauu

SEQ ID NO: 615351 - RNA, 13 nt, Homo sapiens
uuacagaguaucu

SEQ ID NO: 615352 - RNA, 13 nt, Homo sapiens
uuacagcaaaaag

SEQ ID NO: 615353 - RNA, 15 nt, Homo sapiens
uuacagcacuacucu

SEQ ID NO: 615354 - RNA, 12 nt, Homo sapiens
uuacagccuuau

SEQ ID NO: 615355 - RNA, 11 nt, Homo sapiens
uuacagcugcc

SEQ ID NO: 615356 - RNA, 24 nt, Homo sapiens
uuacagcugccugcaguacuuuac

SEQ ID NO: 615357 - RNA, 14 nt, Homo sapiens
uuacagcuuucaca

SEQ ID NO: 615358 - RNA, 17 nt, Homo sapiens
uuacaggcgugauccac

SEQ ID NO: 615359 - RNA, 18 nt, Homo sapiens
uuacagggagcugggaca

SEQ ID NO: 615360 - RNA, 21 nt, Homo sapiens
uuacaguggaauugugaauaa

SEQ ID NO: 615361 - RNA, 14 nt, Homo sapiens
uuacaguggcaaaa

SEQ ID NO: 615362 - RNA, 11 nt, Homo sapiens
uuacaguucug

SEQ ID NO: 615363 - RNA, 15 nt, Homo sapiens
uuacaguugcaucag

SEQ ID NO: 615364 - RNA, 15 nt, Homo sapiens
uuacauaaagacugu

SEQ ID NO: 615365 - RNA, 18 nt, Homo sapiens
uuacauaaucuguacaau

SEQ ID NO: 615366 - RNA, 12 nt, Homo sapiens
uuacauacaaau

SEQ ID NO: 615367 - RNA, 17 nt, Homo sapiens
uuacaucacuuugugaa

SEQ ID NO: 615368 - RNA, 15 nt, Homo sapiens
uuacauccucugaua

SEQ ID NO: 615369 - RNA, 14 nt, Homo sapiens
uuacaucuguaaag

SEQ ID NO: 615370 - RNA, 16 nt, Homo sapiens
uuacaugaaacuacuc

SEQ ID NO: 615371 - RNA, 22 nt, Homo sapiens
uuacauguaguaguacuugaaa

SEQ ID NO: 615372 - RNA, 14 nt, Homo sapiens
uuacauuguucaau

SEQ ID NO: 615373 - RNA, 19 nt, Homo sapiens
uuacauuuacaaacugaag

SEQ ID NO: 615374 - RNA, 16 nt, Homo sapiens
uuacauuuuggucucu

SEQ ID NO: 615375 - RNA, 21 nt, Homo sapiens
uuacauuuuuugggcagcaau

SEQ ID NO: 615376 - RNA, 17 nt, Homo sapiens
uuaccaaaaccauccau

SEQ ID NO: 615377 - RNA, 15 nt, Homo sapiens
uuaccaaaauucacu

SEQ ID NO: 615378 - RNA, 16 nt, Homo sapiens
uuaccaaaauucacua

SEQ ID NO: 615379 - RNA, 21 nt, Homo sapiens
uuaccaaagagauauugauau

SEQ ID NO: 615380 - RNA, 15 nt, Homo sapiens
uuaccaaagcaucaa

SEQ ID NO: 615381 - RNA, 13 nt, Homo sapiens
uuaccaacuacau

SEQ ID NO: 615382 - RNA, 19 nt, Homo sapiens
uuaccaacuuucuguaaac

SEQ ID NO: 615383 - RNA, 19 nt, Homo sapiens
uuaccaaggaugaaagagg

SEQ ID NO: 615384 - RNA, 20 nt, Homo sapiens
uuaccaaggaugaaagagga

SEQ ID NO: 615385 - RNA, 17 nt, Homo sapiens
uuaccacaaugagcaau

SEQ ID NO: 615386 - RNA, 15 nt, Homo sapiens
uuaccacuaacuccu

SEQ ID NO: 615387 - RNA, 17 nt, Homo sapiens
uuaccagaagcuuccau

SEQ ID NO: 615388 - RNA, 19 nt, Homo sapiens
uuaccagauccuuuuccag

SEQ ID NO: 615389 - RNA, 14 nt, Homo sapiens
uuaccagcaagaau

SEQ ID NO: 615390 - RNA, 22 nt, Homo sapiens
uuaccauagaaagaugacaaaa

SEQ ID NO: 615391 - RNA, 14 nt, Homo sapiens
uuaccaugcucaau

SEQ ID NO: 615392 - RNA, 22 nt, Homo sapiens
uuaccauuuguaauaaaguaua

SEQ ID NO: 615393 - RNA, 21 nt, Homo sapiens
uuacccaaauauaaccauuua

SEQ ID NO: 615394 - RNA, 16 nt, Homo sapiens
uuacccaguauuccau

SEQ ID NO: 615395 - RNA, 16 nt, Homo sapiens
uuaccccauaccccuu

SEQ ID NO: 615396 - RNA, 15 nt, Homo sapiens
uuacccuugaucuua

SEQ ID NO: 615397 - RNA, 17 nt, Homo sapiens
uuaccgaguaucuguaa

SEQ ID NO: 615398 - RNA, 17 nt, Homo sapiens
uuaccguucaccaguug

SEQ ID NO: 615399 - RNA, 14 nt, Homo sapiens
uuaccuaaacagau

SEQ ID NO: 615400 - RNA, 17 nt, Homo sapiens
uuaccuaguuugcacua

SEQ ID NO: 615401 - RNA, 17 nt, Homo sapiens
uuaccucuauauaccaa

SEQ ID NO: 615402 - RNA, 20 nt, Homo sapiens
uuaccucuauauaccaaagc

SEQ ID NO: 615403 - RNA, 15 nt, Homo sapiens
uuaccugagagauuu

SEQ ID NO: 615404 - RNA, 12 nt, Homo sapiens
uuaccuuucaua

SEQ ID NO: 615405 - RNA, 14 nt, Homo sapiens
uuacgcccaucuca

SEQ ID NO: 615406 - RNA, 23 nt, Homo sapiens
uuacggauuuauuauauaaauau

SEQ ID NO: 615407 - RNA, 21 nt, Homo sapiens
uuacuaagaugaaauugccaa

SEQ ID NO: 615408 - RNA, 23 nt, Homo sapiens
uuacuaagcuuugccagcugcug

SEQ ID NO: 615409 - RNA, 16 nt, Homo sapiens
uuacuaaggaagauua

SEQ ID NO: 615410 - RNA, 23 nt, Homo sapiens
uuacuaaguggacuggugucaua

SEQ ID NO: 615411 - RNA, 13 nt, Homo sapiens
uuacuaaucuuuc

SEQ ID NO: 615412 - RNA, 12 nt, Homo sapiens
uuacuacuguac

SEQ ID NO: 615413 - RNA, 23 nt, Homo sapiens
uuacuaguacagguuuugcccug

SEQ ID NO: 615414 - RNA, 23 nt, Homo sapiens
uuacuauagcaaaguaguacuuc

SEQ ID NO: 615415 - RNA, 16 nt, Homo sapiens
uuacuaucauggcaua

SEQ ID NO: 615416 - RNA, 18 nt, Homo sapiens
uuacuaugugccaguucc

SEQ ID NO: 615417 - RNA, 15 nt, Homo sapiens
uuacuauucacugau

SEQ ID NO: 615418 - RNA, 16 nt, Homo sapiens
uuacuauuuacuuuau

SEQ ID NO: 615419 - RNA, 22 nt, Homo sapiens
uuacuauuuauugcugaaugac

SEQ ID NO: 615420 - RNA, 23 nt, Homo sapiens
uuacuauuuauugcugaaugacu

SEQ ID NO: 615421 - RNA, 23 nt, Homo sapiens
uuacucaaggaauuugcauuuag

SEQ ID NO: 615422 - RNA, 20 nt, Homo sapiens
uuacucaucgggcccaggga

SEQ ID NO: 615423 - RNA, 18 nt, Homo sapiens
uuacucucuugcaccaaa

SEQ ID NO: 615424 - RNA, 15 nt, Homo sapiens
uuacucugucuccca

SEQ ID NO: 615425 - RNA, 12 nt, Homo sapiens
uuacugaaguua

SEQ ID NO: 615426 - RNA, 20 nt, Homo sapiens
uuacugaggaaauauuucca

SEQ ID NO: 615427 - RNA, 14 nt, Homo sapiens
uuacugauacuaca

SEQ ID NO: 615428 - RNA, 15 nt, Homo sapiens
uuacugaugugauau

SEQ ID NO: 615429 - RNA, 15 nt, Homo sapiens
uuacugauucaauua

SEQ ID NO: 615430 - RNA, 15 nt, Homo sapiens
uuacugcucugagaa

SEQ ID NO: 615431 - RNA, 17 nt, Homo sapiens
uuacugcuuaaauucca

SEQ ID NO: 615432 - RNA, 12 nt, Homo sapiens
uuacugcuugac

SEQ ID NO: 615433 - RNA, 16 nt, Homo sapiens
uuacugcuugaccaaa

SEQ ID NO: 615434 - RNA, 23 nt, Homo sapiens
uuacuggaauuaaaaauauauau

SEQ ID NO: 615435 - RNA, 22 nt, Homo sapiens
uuacuggacaaagaauuccaaa

SEQ ID NO: 615436 - RNA, 14 nt, Homo sapiens
uuacuggcacaagu

SEQ ID NO: 615437 - RNA, 23 nt, Homo sapiens
uuacuguacccucgcaugacugu

SEQ ID NO: 615438 - RNA, 12 nt, Homo sapiens
uuacugugaauu

SEQ ID NO: 615439 - RNA, 12 nt, Homo sapiens
uuacuguuuaca

SEQ ID NO: 615440 - RNA, 18 nt, Homo sapiens
uuacuguuuuauguugau

SEQ ID NO: 615441 - RNA, 20 nt, Homo sapiens
uuacuuaugaugaugaaggg

SEQ ID NO: 615442 - RNA, 24 nt, Homo sapiens
uuacuucucacuaauuuguaggaa

SEQ ID NO: 615443 - RNA, 23 nt, Homo sapiens
uuacuucucuauaaaaaauaugu

SEQ ID NO: 615444 - RNA, 23 nt, Homo sapiens
uuacuuuaaaauaaaaaaguaac

SEQ ID NO: 615445 - RNA, 21 nt, Homo sapiens
uuacuuugauaucugaucaaa

SEQ ID NO: 615446 - RNA, 17 nt, Homo sapiens
uuacuuuuaccacuauu

SEQ ID NO: 615447 - RNA, 16 nt, Homo sapiens
uuacuuuuccagucug

SEQ ID NO: 615448 - RNA, 23 nt, Homo sapiens
uuacuuuuuccuggcucaucucu

SEQ ID NO: 615449 - RNA, 20 nt, Homo sapiens
uuacuuuuuugguacuauaa

SEQ ID NO: 615450 - RNA, 17 nt, Homo sapiens
uuauuuuuguaucuuaa

SEQ ID NO: 615451 - RNA, 13 nt, Homo sapiens
uucaaaaaaguca

SEQ ID NO: 615452 - RNA, 12 nt, Homo sapiens
uucaaaagaagu

SEQ ID NO: 615453 - RNA, 13 nt, Homo sapiens
uucaaaauaguca

SEQ ID NO: 615454 - RNA, 14 nt, Homo sapiens
uucaaaaugcagau

SEQ ID NO: 615455 - RNA, 24 nt, Homo sapiens
uucaaacagaacugcagucagcau

SEQ ID NO: 615456 - RNA, 13 nt, Homo sapiens
uucaaacauauau

SEQ ID NO: 615457 - RNA, 14 nt, Homo sapiens
uucaaacuacugua

SEQ ID NO: 615458 - RNA, 18 nt, Homo sapiens
uucaaacugcaugauuca

SEQ ID NO: 615459 - RNA, 22 nt, Homo sapiens
uucaaacugcugcauacuuuga

SEQ ID NO: 615460 - RNA, 22 nt, Homo sapiens
uucaaacugugaagcauuuaca

SEQ ID NO: 615461 - RNA, 12 nt, Homo sapiens
uucaaacuuaaa

SEQ ID NO: 615462 - RNA, 14 nt, Homo sapiens
uucaaagucucaau

SEQ ID NO: 615463 - RNA, 21 nt, Homo sapiens
uucaaauccucccuacuucca

SEQ ID NO: 615464 - RNA, 21 nt, Homo sapiens
uucaaaugcagaauacuugac

SEQ ID NO: 615465 - RNA, 21 nt, Homo sapiens
uucaaauggacaaacugccag

SEQ ID NO: 615466 - RNA, 22 nt, Homo sapiens
uucaaaugugcugucaaaacaa

SEQ ID NO: 615467 - RNA, 13 nt, Homo sapiens
uucaaauuauucu

SEQ ID NO: 615468 - RNA, 20 nt, Homo sapiens
uucaaauucuucugaacuca

SEQ ID NO: 615469 - RNA, 19 nt, Homo sapiens
uucaacaaagaaacaaaga

SEQ ID NO: 615470 - RNA, 20 nt, Homo sapiens
uucaacaaccggccaccaga

SEQ ID NO: 615471 - RNA, 22 nt, Homo sapiens
uucaacaaugucuuuuuuccca

SEQ ID NO: 615472 - RNA, 18 nt, Homo sapiens
uucaacaugacauccaga

SEQ ID NO: 615473 - RNA, 17 nt, Homo sapiens
uucaacauguacaggaa

SEQ ID NO: 615474 - RNA, 11 nt, Homo sapiens
uucaaccacug

SEQ ID NO: 615475 - RNA, 15 nt, Homo sapiens
uucaaccacuguaaa

SEQ ID NO: 615476 - RNA, 18 nt, Homo sapiens
uucaacccagccaugcaa

SEQ ID NO: 615477 - RNA, 13 nt, Homo sapiens
uucaacccagugg

SEQ ID NO: 615478 - RNA, 20 nt, Homo sapiens
uucaaccugguggcaccaga

SEQ ID NO: 615479 - RNA, 11 nt, Homo sapiens
uucaacuggag

SEQ ID NO: 615480 - RNA, 15 nt, Homo sapiens
uucaagaaagcuuca

SEQ ID NO: 615481 - RNA, 13 nt, Homo sapiens
uucaagacagaaa

SEQ ID NO: 615482 - RNA, 15 nt, Homo sapiens
uucaagagugagcua

SEQ ID NO: 615483 - RNA, 14 nt, Homo sapiens
uucaagauuguuga

SEQ ID NO: 615484 - RNA, 13 nt, Homo sapiens
uucaagcaauucu

SEQ ID NO: 615485 - RNA, 23 nt, Homo sapiens
uucaaggacuagaaccuaucuuu

SEQ ID NO: 615486 - RNA, 21 nt, Homo sapiens
uucaaggcauuucuaucacau

SEQ ID NO: 615487 - RNA, 16 nt, Homo sapiens
uucaaggcccucagag

SEQ ID NO: 615488 - RNA, 19 nt, Homo sapiens
uucaaggccuucaguuuau

SEQ ID NO: 615489 - RNA, 20 nt, Homo sapiens
uucaaguauaacaacuuuga

SEQ ID NO: 615490 - RNA, 17 nt, Homo sapiens
uucaagucugacucucc

SEQ ID NO: 615491 - RNA, 19 nt, Homo sapiens
uucaaguguacauguguga

SEQ ID NO: 615492 - RNA, 16 nt, Homo sapiens
uucaaguuaaagugaa

SEQ ID NO: 615493 - RNA, 16 nt, Homo sapiens
uucaaguuccacuucu

SEQ ID NO: 615494 - RNA, 18 nt, Homo sapiens
uucaauaacaaagcacau

SEQ ID NO: 615495 - RNA, 13 nt, Homo sapiens
uucaauaauguga

SEQ ID NO: 615496 - RNA, 14 nt, Homo sapiens
uucaauacagugaa

SEQ ID NO: 615497 - RNA, 19 nt, Homo sapiens
uucaauaugcaagcagcuu

SEQ ID NO: 615498 - RNA, 21 nt, Homo sapiens
uucaaugcuagaacaacgccu

SEQ ID NO: 615499 - RNA, 18 nt, Homo sapiens
uucaaugggcucuuccaa

SEQ ID NO: 615500 - RNA, 12 nt, Homo sapiens
uucaaugugacu

SEQ ID NO: 615501 - RNA, 14 nt, Homo sapiens
uucaauuauacuaa

SEQ ID NO: 615502 - RNA, 20 nt, Homo sapiens
uucaauuauacuaaaccuca

SEQ ID NO: 615503 - RNA, 15 nt, Homo sapiens
uucaauucucaaaag

SEQ ID NO: 615504 - RNA, 16 nt, Homo sapiens
uucaauuuauuacuga

SEQ ID NO: 615505 - RNA, 22 nt, Homo sapiens
uucacaaauagccauugaacaa

SEQ ID NO: 615506 - RNA, 14 nt, Homo sapiens
uucacaaaugggau

SEQ ID NO: 615507 - RNA, 18 nt, Homo sapiens
uucacaaccucaccaaac

SEQ ID NO: 615508 - RNA, 18 nt, Homo sapiens
uucacacaaagacuccuu

SEQ ID NO: 615509 - RNA, 13 nt, Homo sapiens
uucacacagugaa

SEQ ID NO: 615510 - RNA, 23 nt, Homo sapiens
uucacacagugaaacgcaauuuu

SEQ ID NO: 615511 - RNA, 13 nt, Homo sapiens
uucacaccagcua

SEQ ID NO: 615512 - RNA, 23 nt, Homo sapiens
uucacaccucacgcucuggacau

SEQ ID NO: 615513 - RNA, 14 nt, Homo sapiens
uucacacuaagaaa

SEQ ID NO: 615514 - RNA, 13 nt, Homo sapiens
uucacacuaugga

SEQ ID NO: 615515 - RNA, 13 nt, Homo sapiens
uucacagccuuuc

SEQ ID NO: 615516 - RNA, 16 nt, Homo sapiens
uucacaucuaaccuca

SEQ ID NO: 615517 - RNA, 16 nt, Homo sapiens
uucacaugagcuauuu

SEQ ID NO: 615518 - RNA, 19 nt, Homo sapiens
uucacaugagcuauuucca

SEQ ID NO: 615519 - RNA, 19 nt, Homo sapiens
uucacaugaugcacuucaa

SEQ ID NO: 615520 - RNA, 14 nt, Homo sapiens
uucacauugaucau

SEQ ID NO: 615521 - RNA, 16 nt, Homo sapiens
uucaccaagugcaaua

SEQ ID NO: 615522 - RNA, 15 nt, Homo sapiens
uucaccagagcauuu

SEQ ID NO: 615523 - RNA, 17 nt, Homo sapiens
uucaccagagcauuucc

SEQ ID NO: 615524 - RNA, 18 nt, Homo sapiens
uucaccagagcauuucca

SEQ ID NO: 615525 - RNA, 17 nt, Homo sapiens
uucaccccugcacuuca

SEQ ID NO: 615526 - RNA, 15 nt, Homo sapiens
uucaccucacugaaa

SEQ ID NO: 615527 - RNA, 16 nt, Homo sapiens
uucaccuccaacugga

SEQ ID NO: 615528 - RNA, 20 nt, Homo sapiens
uucaccuuccagugucucgg

SEQ ID NO: 615529 - RNA, 13 nt, Homo sapiens
uucaccuuucuag

SEQ ID NO: 615530 - RNA, 19 nt, Homo sapiens
uucacgaaguguugcaugg

SEQ ID NO: 615531 - RNA, 19 nt, Homo sapiens
uucacgcuuuuguuuucau

SEQ ID NO: 615532 - RNA, 23 nt, Homo sapiens
uucacguggccuccgcagugucu

SEQ ID NO: 615533 - RNA, 20 nt, Homo sapiens
uucacuaaugaucacauucu

SEQ ID NO: 615534 - RNA, 15 nt, Homo sapiens
uucacuauaauguga

SEQ ID NO: 615535 - RNA, 18 nt, Homo sapiens
uucacuccccuaucccau

SEQ ID NO: 615536 - RNA, 21 nt, Homo sapiens
uucacucuuuagaaauaaugg

SEQ ID NO: 615537 - RNA, 18 nt, Homo sapiens
uucacugagcuccccaga

SEQ ID NO: 615538 - RNA, 14 nt, Homo sapiens
uucacugccuuccu

SEQ ID NO: 615539 - RNA, 16 nt, Homo sapiens
uucacugcgaagaccc

SEQ ID NO: 615540 - RNA, 14 nt, Homo sapiens
uucacugguguaca

SEQ ID NO: 615541 - RNA, 20 nt, Homo sapiens
uucacuguagaaugauuuca

SEQ ID NO: 615542 - RNA, 17 nt, Homo sapiens
uucacugugagugaaaa

SEQ ID NO: 615543 - RNA, 14 nt, Homo sapiens
uucacuguuucacu

SEQ ID NO: 615544 - RNA, 22 nt, Homo sapiens
uucacuuuucugaguucuugaa

SEQ ID NO: 615545 - RNA, 15 nt, Homo sapiens
uucagaaagcuucaa

SEQ ID NO: 615546 - RNA, 19 nt, Homo sapiens
uucagaaagcuucaaauua

SEQ ID NO: 615547 - RNA, 18 nt, Homo sapiens
uucagaaccauccauagu

SEQ ID NO: 615548 - RNA, 23 nt, Homo sapiens
uucagaacuauuuaaaauaaaga

SEQ ID NO: 615549 - RNA, 14 nt, Homo sapiens
uucagaagacacug

SEQ ID NO: 615550 - RNA, 17 nt, Homo sapiens
uucagaagagaugggcu

SEQ ID NO: 615551 - RNA, 18 nt, Homo sapiens
uucagaagccuaauucca

SEQ ID NO: 615552 - RNA, 22 nt, Homo sapiens
uucagaaucucucuacucagau

SEQ ID NO: 615553 - RNA, 23 nt, Homo sapiens
uucagaauguacggaaagaugau

SEQ ID NO: 615554 - RNA, 20 nt, Homo sapiens
uucagaccaugaaugaaugu

SEQ ID NO: 615555 - RNA, 23 nt, Homo sapiens
uucagaccccaaaggagucagag

SEQ ID NO: 615556 - RNA, 13 nt, Homo sapiens
uucagacuuuaaa

SEQ ID NO: 615557 - RNA, 15 nt, Homo sapiens
uucagagagcuggua

SEQ ID NO: 615558 - RNA, 15 nt, Homo sapiens
uucagagccagugaa

SEQ ID NO: 615559 - RNA, 21 nt, Homo sapiens
uucagagcuaauaagugcuuu

SEQ ID NO: 615560 - RNA, 20 nt, Homo sapiens
uucagaggcucagauuguaa

SEQ ID NO: 615561 - RNA, 21 nt, Homo sapiens
uucagaggguaacuuaacaga

SEQ ID NO: 615562 - RNA, 23 nt, Homo sapiens
uucagaggguaaguaaacagauu

SEQ ID NO: 615563 - RNA, 23 nt, Homo sapiens
uucagauauaaaagacugaccaa

SEQ ID NO: 615564 - RNA, 21 nt, Homo sapiens
uucagauuaagaguugccaaa

SEQ ID NO: 615565 - RNA, 18 nt, Homo sapiens
uucagcaacugucuuauu

SEQ ID NO: 615566 - RNA, 19 nt, Homo sapiens
uucagcacccccacccacc

SEQ ID NO: 615567 - RNA, 15 nt, Homo sapiens
uucagcagacuauga

SEQ ID NO: 615568 - RNA, 22 nt, Homo sapiens
uucagcaguaacaggaaaccac

SEQ ID NO: 615569 - RNA, 20 nt, Homo sapiens
uucagcauuauuccuccagg

SEQ ID NO: 615570 - RNA, 19 nt, Homo sapiens
uucagcccccaccagggga

SEQ ID NO: 615571 - RNA, 14 nt, Homo sapiens
uucagccccuccuc

SEQ ID NO: 615572 - RNA, 19 nt, Homo sapiens
uuccucucuggauacugca

SEQ ID NO: 615573 - RNA, 12 nt, Homo sapiens
uuccucucuuaa

SEQ ID NO: 615574 - RNA, 23 nt, Homo sapiens
uuccucugcaguuuugacauuua

SEQ ID NO: 615575 - RNA, 18 nt, Homo sapiens
uuccucugggcagcgcua

SEQ ID NO: 615576 - RNA, 14 nt, Homo sapiens
uuccucuugccucu

SEQ ID NO: 615577 - RNA, 22 nt, Homo sapiens
uuccucuugugauuucuuuaaa

SEQ ID NO: 615578 - RNA, 13 nt, Homo sapiens
uuccugaagggaa

SEQ ID NO: 615579 - RNA, 21 nt, Homo sapiens
uuccugaagggggacacucca

SEQ ID NO: 615580 - RNA, 15 nt, Homo sapiens
uuccugaaugaaaua

SEQ ID NO: 615581 - RNA, 23 nt, Homo sapiens
uuccugagugcguggaucugggu

SEQ ID NO: 615582 - RNA, 16 nt, Homo sapiens
uuccugauacauuaaa

SEQ ID NO: 615583 - RNA, 16 nt, Homo sapiens
uuccugaucacuaugc

SEQ ID NO: 615584 - RNA, 17 nt, Homo sapiens
uuccugcagccccagaa

SEQ ID NO: 615585 - RNA, 14 nt, Homo sapiens
uuccugccaccagu

SEQ ID NO: 615586 - RNA, 13 nt, Homo sapiens
uuccugccacugc

SEQ ID NO: 615587 - RNA, 21 nt, Homo sapiens
uuccugcccuugaacccccuc

SEQ ID NO: 615588 - RNA, 23 nt, Homo sapiens
uuccugcgcauggugcagugccg

SEQ ID NO: 615589 - RNA, 20 nt, Homo sapiens
uuccuggaaacagcaugaau

SEQ ID NO: 615590 - RNA, 20 nt, Homo sapiens
uuccuggaggucagcauuug

SEQ ID NO: 615591 - RNA, 16 nt, Homo sapiens
uuccuggcagcugcug

SEQ ID NO: 615592 - RNA, 19 nt, Homo sapiens
uuccuggccucuucugggc

SEQ ID NO: 615593 - RNA, 22 nt, Homo sapiens
uuccuggccuucugaacuccau

SEQ ID NO: 615594 - RNA, 16 nt, Homo sapiens
uuccuggcucacacau

SEQ ID NO: 615595 - RNA, 20 nt, Homo sapiens
uuccuggcuccuucacugaa

SEQ ID NO: 615596 - RNA, 18 nt, Homo sapiens
uuccuggcugaugaucca

SEQ ID NO: 615597 - RNA, 19 nt, Homo sapiens
uuccugguguagcacuuaa

SEQ ID NO: 615598 - RNA, 18 nt, Homo sapiens
uuccugguuaagcaggca

SEQ ID NO: 615599 - RNA, 22 nt, Homo sapiens
uuccuguaacacaagccacaga

SEQ ID NO: 615600 - RNA, 16 nt, Homo sapiens
uuccugucuuauccuc

SEQ ID NO: 615601 - RNA, 20 nt, Homo sapiens
uuccugucuuauccuccacc

SEQ ID NO: 615602 - RNA, 11 nt, Homo sapiens
uuccugugauu

SEQ ID NO: 615603 - RNA, 14 nt, Homo sapiens
uuccuguuacuuua

SEQ ID NO: 615604 - RNA, 15 nt, Homo sapiens
uuccuguucuauuaa

SEQ ID NO: 615605 - RNA, 20 nt, Homo sapiens
uuccuguugucuacaccaau

SEQ ID NO: 615606 - RNA, 13 nt, Homo sapiens
uuccuguuuccau

SEQ ID NO: 615607 - RNA, 21 nt, Homo sapiens
uuccuguuuccauccaguucc

SEQ ID NO: 615608 - RNA, 15 nt, Homo sapiens
uuccuuaaacugugu

SEQ ID NO: 615609 - RNA, 21 nt, Homo sapiens
uuccuuaaauuuuuagccauu

SEQ ID NO: 615610 - RNA, 17 nt, Homo sapiens
uuccuuaccauaccacu

SEQ ID NO: 615611 - RNA, 13 nt, Homo sapiens
uuccuuacuugca

SEQ ID NO: 615612 - RNA, 19 nt, Homo sapiens
uuccuuaguuuucuaguaa

SEQ ID NO: 615613 - RNA, 16 nt, Homo sapiens
uuccuuaucacugaca

SEQ ID NO: 615614 - RNA, 15 nt, Homo sapiens
uuccuuaucugucac

SEQ ID NO: 615615 - RNA, 12 nt, Homo sapiens
uuccuucacugc

SEQ ID NO: 615616 - RNA, 19 nt, Homo sapiens
uuccuucauuuccaccagg

SEQ ID NO: 615617 - RNA, 15 nt, Homo sapiens
uuccuuccacaguua

SEQ ID NO: 615618 - RNA, 16 nt, Homo sapiens
uuccuucccugggaag

SEQ ID NO: 615619 - RNA, 13 nt, Homo sapiens
uuccuucucccau

SEQ ID NO: 615620 - RNA, 14 nt, Homo sapiens
uuccuucucugggu

SEQ ID NO: 615621 - RNA, 14 nt, Homo sapiens
uuccuucugaccac

SEQ ID NO: 615622 - RNA, 22 nt, Homo sapiens
uuccuucuguacuaaaguauug

SEQ ID NO: 615623 - RNA, 12 nt, Homo sapiens
uuccuugcucuc

SEQ ID NO: 615624 - RNA, 21 nt, Homo sapiens
uuccuuuaugaugacugcuua

SEQ ID NO: 615625 - RNA, 17 nt, Homo sapiens
uuccuuuaugugaauuu

SEQ ID NO: 615626 - RNA, 17 nt, Homo sapiens
uuccuuuccugaucacu

SEQ ID NO: 615627 - RNA, 15 nt, Homo sapiens
uuccuuucuugucuu

SEQ ID NO: 615628 - RNA, 21 nt, Homo sapiens
uuccuuuugcaaacaauuuua

SEQ ID NO: 615629 - RNA, 18 nt, Homo sapiens
uuccuuuuucuucacuua

SEQ ID NO: 615630 - RNA, 15 nt, Homo sapiens
uuccuuuuuucccau

SEQ ID NO: 615631 - RNA, 22 nt, Homo sapiens
uucgaaacuccauugagucauu

SEQ ID NO: 615632 - RNA, 18 nt, Homo sapiens
uucgaaggagcaguguga

SEQ ID NO: 615633 - RNA, 16 nt, Homo sapiens
uucgaaugacacuguu

SEQ ID NO: 615634 - RNA, 21 nt, Homo sapiens
uucgaccucgucuuucuccau

SEQ ID NO: 615635 - RNA, 14 nt, Homo sapiens
uucgacuacugcuc

SEQ ID NO: 615636 - RNA, 20 nt, Homo sapiens
uucgacuugcauuuuugcag

SEQ ID NO: 615637 - RNA, 20 nt, Homo sapiens
uucgagaccagucuggccaa

SEQ ID NO: 615638 - RNA, 15 nt, Homo sapiens
uucgaguccaggaca

SEQ ID NO: 615639 - RNA, 23 nt, Homo sapiens
uucgauacaccgggccuggagaa

SEQ ID NO: 615640 - RNA, 13 nt, Homo sapiens
uucgcacacugug

SEQ ID NO: 615641 - RNA, 23 nt, Homo sapiens
uucgcaccuaccaucagggacag

SEQ ID NO: 615642 - RNA, 14 nt, Homo sapiens
uucgcccucugaaa

SEQ ID NO: 615643 - RNA, 14 nt, Homo sapiens
uucggauuugccau

SEQ ID NO: 615644 - RNA, 21 nt, Homo sapiens
uucgggcaguccugugugagg

SEQ ID NO: 615645 - RNA, 22 nt, Homo sapiens
uucggugguaaaaguaccacac

SEQ ID NO: 615646 - RNA, 14 nt, Homo sapiens
uucguaagaaggaa

SEQ ID NO: 615647 - RNA, 18 nt, Homo sapiens
uucguccuaacauaacac

SEQ ID NO: 615648 - RNA, 20 nt, Homo sapiens
uucgucuucgcccucugaaa

SEQ ID NO: 615649 - RNA, 19 nt, Homo sapiens
uucgugaaguauacuguau

SEQ ID NO: 615650 - RNA, 21 nt, Homo sapiens
uucgugguuuuuacauucaau

SEQ ID NO: 615651 - RNA, 17 nt, Homo sapiens
uucguguuugauuccau

SEQ ID NO: 615652 - RNA, 14 nt, Homo sapiens
uucguuuaccaaau

SEQ ID NO: 615653 - RNA, 17 nt, Homo sapiens
uucuaaaaacacacaca

SEQ ID NO: 615654 - RNA, 19 nt, Homo sapiens
uucuaaacugcaucuggau

SEQ ID NO: 615655 - RNA, 16 nt, Homo sapiens
uucuaaaggcuaccuu

SEQ ID NO: 615656 - RNA, 19 nt, Homo sapiens
uucuaaauccgacuugaau

SEQ ID NO: 615657 - RNA, 14 nt, Homo sapiens
uucuaaaugcauau

SEQ ID NO: 615658 - RNA, 21 nt, Homo sapiens
uucuaaccuugaaugcugcca

SEQ ID NO: 615659 - RNA, 22 nt, Homo sapiens
uucuaacgaguggaccauuauc

SEQ ID NO: 615660 - RNA, 21 nt, Homo sapiens
uucuaacuagaaaucugccaa

SEQ ID NO: 615661 - RNA, 12 nt, Homo sapiens
uucuaacuuaag

SEQ ID NO: 615662 - RNA, 16 nt, Homo sapiens
uucuaagaaccaaaaa

SEQ ID NO: 615663 - RNA, 12 nt, Homo sapiens
uucuaaguauuu

SEQ ID NO: 615664 - RNA, 23 nt, Homo sapiens
uucuaauccuaucuggggagcuc

SEQ ID NO: 615665 - RNA, 14 nt, Homo sapiens
uucuaaugucuuca

SEQ ID NO: 615666 - RNA, 13 nt, Homo sapiens
uucuaaugugcau

SEQ ID NO: 615667 - RNA, 15 nt, Homo sapiens
uucuaaugugugaau

SEQ ID NO: 615668 - RNA, 22 nt, Homo sapiens
uucuaauuugcauugugucaga

SEQ ID NO: 615669 - RNA, 15 nt, Homo sapiens
uucuacaguguccua

SEQ ID NO: 615670 - RNA, 16 nt, Homo sapiens
uucuacuaugaucaga

SEQ ID NO: 615671 - RNA, 23 nt, Homo sapiens
uucuacuucuggaagucaucuca

SEQ ID NO: 615672 - RNA, 12 nt, Homo sapiens
uucuacuuuaag

SEQ ID NO: 615673 - RNA, 22 nt, Homo sapiens
uucuacuuuaauauaaacccau

SEQ ID NO: 615674 - RNA, 15 nt, Homo sapiens
uucuagaacaccugc

SEQ ID NO: 615675 - RNA, 17 nt, Homo sapiens
uucuagccuuagacaaa

SEQ ID NO: 615676 - RNA, 14 nt, Homo sapiens
uucuagccuuuuaa

SEQ ID NO: 615677 - RNA, 11 nt, Homo sapiens
uucuaggcauc

SEQ ID NO: 615678 - RNA, 14 nt, Homo sapiens
uucuaggggugccu

SEQ ID NO: 615679 - RNA, 21 nt, Homo sapiens
uucuaggugcccgaguagcau

SEQ ID NO: 615680 - RNA, 18 nt, Homo sapiens
uucuagguggcaggacaa

SEQ ID NO: 615681 - RNA, 20 nt, Homo sapiens
uucuagucucucuggggcca

SEQ ID NO: 615682 - RNA, 14 nt, Homo sapiens
uucuaguuaccaca

SEQ ID NO: 615683 - RNA, 24 nt, Homo sapiens
uucuaguuuugucaaacuguagaa

SEQ ID NO: 615684 - RNA, 15 nt, Homo sapiens
uucuauccuguucuu

SEQ ID NO: 615685 - RNA, 15 nt, Homo sapiens
uucuaugcauuaaga

SEQ ID NO: 615686 - RNA, 22 nt, Homo sapiens
uucuaugguugacauuguauau

SEQ ID NO: 615687 - RNA, 22 nt, Homo sapiens
uucuauguugguuucaguggcu

SEQ ID NO: 615688 - RNA, 21 nt, Homo sapiens
uucuauuaaaauuuagcccua

SEQ ID NO: 615689 - RNA, 17 nt, Homo sapiens
uucuauuacgugcaaua

SEQ ID NO: 615690 - RNA, 22 nt, Homo sapiens
uucuauuacgugcaauacuuca

SEQ ID NO: 615691 - RNA, 15 nt, Homo sapiens
uucuauucuaaguaa

SEQ ID NO: 615692 - RNA, 15 nt, Homo sapiens
uucuauugacuucaa

SEQ ID NO: 615693 - RNA, 18 nt, Homo sapiens
uucuauugggauauccuu

SEQ ID NO: 615694 - RNA, 19 nt, Homo sapiens
uuuuaacacuucuagaucu

SEQ ID NO: 615695 - RNA, 13 nt, Homo sapiens
uuuuaaccaguuc

SEQ ID NO: 615696 - RNA, 17 nt, Homo sapiens
uuuuaaccccauuugca

SEQ ID NO: 615697 - RNA, 23 nt, Homo sapiens
uuuuaaccucuagagucacugau

SEQ ID NO: 615698 - RNA, 20 nt, Homo sapiens
uuuuaaccugccaacauacu

SEQ ID NO: 615699 - RNA, 13 nt, Homo sapiens
uuuuaacucuaga

SEQ ID NO: 615700 - RNA, 23 nt, Homo sapiens
uuuuaacuucuuucuauuugacu

SEQ ID NO: 615701 - RNA, 13 nt, Homo sapiens
uuuuaacuuuuaa

SEQ ID NO: 615702 - RNA, 15 nt, Homo sapiens
uuuuaagaacuucau

SEQ ID NO: 615703 - RNA, 15 nt, Homo sapiens
uuuuaaggauguugc

SEQ ID NO: 615704 - RNA, 20 nt, Homo sapiens
uuuuaaggcuaaaacuuaac

SEQ ID NO: 615705 - RNA, 12 nt, Homo sapiens
uuuuaaguauuu

SEQ ID NO: 615706 - RNA, 20 nt, Homo sapiens
uuuuaaguuucucugcagaa

SEQ ID NO: 615707 - RNA, 22 nt, Homo sapiens
uuuuaaguuugaaacuaacuca

SEQ ID NO: 615708 - RNA, 13 nt, Homo sapiens
uuuuaauguacaa

SEQ ID NO: 615709 - RNA, 21 nt, Homo sapiens
uuuuaauguuuauuauuuaca

SEQ ID NO: 615710 - RNA, 19 nt, Homo sapiens
uuuuaauuacugcuauaaa

SEQ ID NO: 615711 - RNA, 18 nt, Homo sapiens
uuuuaauuaugggaauaa

SEQ ID NO: 615712 - RNA, 15 nt, Homo sapiens
uuuuaauuugaugaa

SEQ ID NO: 615713 - RNA, 22 nt, Homo sapiens
uuuuacaaaacugcuuugugca

SEQ ID NO: 615714 - RNA, 18 nt, Homo sapiens
uuuuacaaguaacaaaaa

SEQ ID NO: 615715 - RNA, 22 nt, Homo sapiens
uuuuacagagaggauacauuua

SEQ ID NO: 615716 - RNA, 23 nt, Homo sapiens
uuuuacauuuguuguacaaucag

SEQ ID NO: 615717 - RNA, 21 nt, Homo sapiens
uuuuaccaaagcaucaauaca

SEQ ID NO: 615718 - RNA, 21 nt, Homo sapiens
uuuuaccaucacacauguuca

SEQ ID NO: 615719 - RNA, 20 nt, Homo sapiens
uuuuacccagacucaaggag

SEQ ID NO: 615720 - RNA, 12 nt, Homo sapiens
uuuuacuuucag

SEQ ID NO: 615721 - RNA, 20 nt, Homo sapiens
uuuuagaaauuugguuucaa

SEQ ID NO: 615722 - RNA, 12 nt, Homo sapiens
uuuuagcccagu

SEQ ID NO: 615723 - RNA, 21 nt, Homo sapiens
uuuuaggaaaagugaaucuug

SEQ ID NO: 615724 - RNA, 16 nt, Homo sapiens
uuuuagggcuguagac

SEQ ID NO: 615725 - RNA, 23 nt, Homo sapiens
uuuuagguagaaaaacauauucu

SEQ ID NO: 615726 - RNA, 18 nt, Homo sapiens
uuuuaguagagacagggu

SEQ ID NO: 615727 - RNA, 22 nt, Homo sapiens
uuuuaguauaaguacauuauug

SEQ ID NO: 615728 - RNA, 15 nt, Homo sapiens
uuuuagucauucugc

SEQ ID NO: 615729 - RNA, 20 nt, Homo sapiens
uuuuagugacuguaauuaau

SEQ ID NO: 615730 - RNA, 14 nt, Homo sapiens
uuuuaguucucuag

SEQ ID NO: 615731 - RNA, 20 nt, Homo sapiens
uuuuauaaauaucaugcaca

SEQ ID NO: 615732 - RNA, 20 nt, Homo sapiens
uuuuauaagacuacuauaca

SEQ ID NO: 615733 - RNA, 14 nt, Homo sapiens
uuuuaucaguagaa

SEQ ID NO: 615734 - RNA, 11 nt, Homo sapiens
uuuuaucucca

SEQ ID NO: 615735 - RNA, 15 nt, Homo sapiens
uuuuaucuugcacuu

SEQ ID NO: 615736 - RNA, 16 nt, Homo sapiens
uuuuaucuugcacuua

SEQ ID NO: 615737 - RNA, 15 nt, Homo sapiens
uuuuaugaucaaggu

SEQ ID NO: 615738 - RNA, 18 nt, Homo sapiens
uuuuaugauuugucucug

SEQ ID NO: 615739 - RNA, 12 nt, Homo sapiens
uuuuauuugacu

SEQ ID NO: 615740 - RNA, 14 nt, Homo sapiens
uuuuauuugcuuau

SEQ ID NO: 615741 - RNA, 13 nt, Homo sapiens
uuuucaaaacaca

SEQ ID NO: 615742 - RNA, 21 nt, Homo sapiens
uuuucaaagauguguugcuau

SEQ ID NO: 615743 - RNA, 14 nt, Homo sapiens
uuuucaagaugcuu

SEQ ID NO: 615744 - RNA, 13 nt, Homo sapiens
uuuucaaggcauu

SEQ ID NO: 615745 - RNA, 22 nt, Homo sapiens
uuuucaaugugugugagguguu

SEQ ID NO: 615746 - RNA, 19 nt, Homo sapiens
uuuucaauuugagauucua

SEQ ID NO: 615747 - RNA, 16 nt, Homo sapiens
uuuucacacugguaaa

SEQ ID NO: 615748 - RNA, 17 nt, Homo sapiens
uuuucagaguugcuuua

SEQ ID NO: 615749 - RNA, 15 nt, Homo sapiens
uuuucagauccugaa

SEQ ID NO: 615750 - RNA, 14 nt, Homo sapiens
uuuucagcaaagaa

SEQ ID NO: 615751 - RNA, 21 nt, Homo sapiens
uuuucagcacccccacccacc

SEQ ID NO: 615752 - RNA, 15 nt, Homo sapiens
uuuucagccaugugg

SEQ ID NO: 615753 - RNA, 17 nt, Homo sapiens
uuuucaggaauacauuu

SEQ ID NO: 615754 - RNA, 15 nt, Homo sapiens
uuuucaucacuggga

SEQ ID NO: 615755 - RNA, 22 nt, Homo sapiens
uuuucaucccguaucacagugu

SEQ ID NO: 615756 - RNA, 13 nt, Homo sapiens
uuuucaugcaaaa

SEQ ID NO: 615757 - RNA, 19 nt, Homo sapiens
uuuucauguagaacucagc

SEQ ID NO: 615758 - RNA, 16 nt, Homo sapiens
uuuucauuuagugcua

SEQ ID NO: 615759 - RNA, 14 nt, Homo sapiens
uuuuccaacuacua

SEQ ID NO: 615760 - RNA, 18 nt, Homo sapiens
uuuuccagaagauuucac

SEQ ID NO: 615761 - RNA, 16 nt, Homo sapiens
uuuucccaaagcacuu

SEQ ID NO: 615762 - RNA, 23 nt, Homo sapiens
uuuucccaagagcauaacuguuc

SEQ ID NO: 615763 - RNA, 14 nt, Homo sapiens
uuuucccaguauuu

SEQ ID NO: 615764 - RNA, 19 nt, Homo sapiens
uuuuccccaaccacagaga

SEQ ID NO: 615765 - RNA, 16 nt, Homo sapiens
uuuuccccacauucua

SEQ ID NO: 615766 - RNA, 19 nt, Homo sapiens
uuuucccuccauaaguuua

SEQ ID NO: 615767 - RNA, 18 nt, Homo sapiens
uuuuccuaaggaaggaaa

SEQ ID NO: 615768 - RNA, 12 nt, Homo sapiens
uuuuccuauaau

SEQ ID NO: 615769 - RNA, 22 nt, Homo sapiens
uuuuccuaugcuauugacaaua

SEQ ID NO: 615770 - RNA, 15 nt, Homo sapiens
uuuuccuccaggcaa

SEQ ID NO: 615771 - RNA, 14 nt, Homo sapiens
uuuuccugccaggc

SEQ ID NO: 615772 - RNA, 19 nt, Homo sapiens
uuuuccugcuuucaggaaa

SEQ ID NO: 615773 - RNA, 18 nt, Homo sapiens
uuuuccuggcucaucucu

SEQ ID NO: 615774 - RNA, 20 nt, Homo sapiens
uuuuccuuuuuugucuauga

SEQ ID NO: 615775 - RNA, 22 nt, Homo sapiens
uuuucgcaccuaccaucaggga

SEQ ID NO: 615776 - RNA, 23 nt, Homo sapiens
uuuucggccccauguaucucagu

SEQ ID NO: 615777 - RNA, 21 nt, Homo sapiens
uuuucuaagaaagaaauugua

SEQ ID NO: 615778 - RNA, 18 nt, Homo sapiens
uuuucuaagaaccaaaaa

SEQ ID NO: 615779 - RNA, 14 nt, Homo sapiens
uuuucuaauuugca

SEQ ID NO: 615780 - RNA, 16 nt, Homo sapiens
uuuucuauuauggaaa

SEQ ID NO: 615781 - RNA, 18 nt, Homo sapiens
uuuucuauuucacuaauc

SEQ ID NO: 615782 - RNA, 17 nt, Homo sapiens
uuuucucaaagggcaua

SEQ ID NO: 615783 - RNA, 21 nt, Homo sapiens
uuuucuccagaccccaugccu

SEQ ID NO: 615784 - RNA, 17 nt, Homo sapiens
uuuucuccuugccuucg

SEQ ID NO: 615785 - RNA, 12 nt, Homo sapiens
uuuucucuaaaa

SEQ ID NO: 615786 - RNA, 16 nt, Homo sapiens
uuuucucugugcuuca

SEQ ID NO: 615787 - RNA, 21 nt, Homo sapiens
uuuucucuguguuuguuccua

SEQ ID NO: 615788 - RNA, 18 nt, Homo sapiens
uuuucucuuguaccauag

SEQ ID NO: 615789 - RNA, 12 nt, Homo sapiens
uuuucugccacu

SEQ ID NO: 615790 - RNA, 22 nt, Homo sapiens
uuuucugcuaaaaaguccuuga

SEQ ID NO: 615791 - RNA, 19 nt, Homo sapiens
uuuucuggaauacaugaaa

SEQ ID NO: 615792 - RNA, 21 nt, Homo sapiens
uuuucuggccaaaagcaguaa

SEQ ID NO: 615793 - RNA, 20 nt, Homo sapiens
uuuucugugauaacucugca

SEQ ID NO: 615794 - RNA, 21 nt, Homo sapiens
uuuucuguugccccauccacc

SEQ ID NO: 615795 - RNA, 10 nt, Homo sapiens
uuuucuuaua

SEQ ID NO: 615796 - RNA, 13 nt, Homo sapiens
uuuucuucauuca

SEQ ID NO: 615797 - RNA, 18 nt, Homo sapiens
uuuugaaaaagcgaaaaa

SEQ ID NO: 615798 - RNA, 16 nt, Homo sapiens
uuuugaaaagaacaaa

SEQ ID NO: 615799 - RNA, 20 nt, Homo sapiens
uuuugaagcuuuaagcaaau

SEQ ID NO: 615800 - RNA, 12 nt, Homo sapiens
uuuugaaggcaa

SEQ ID NO: 615801 - RNA, 22 nt, Homo sapiens
uuuugaauagcaauuagugaua

SEQ ID NO: 615802 - RNA, 15 nt, Homo sapiens
uuuugacacuuuuaa

SEQ ID NO: 615803 - RNA, 23 nt, Homo sapiens
uuuugaccaaauaaaguaccauu

SEQ ID NO: 615804 - RNA, 15 nt, Homo sapiens
uuuugaccauaacug

SEQ ID NO: 615805 - RNA, 13 nt, Homo sapiens
uuuugagcacaaa

SEQ ID NO: 615806 - RNA, 15 nt, Homo sapiens
uuuugagcacaaaau

SEQ ID NO: 615807 - RNA, 21 nt, Homo sapiens
uuuugaggaauuaucauggga

SEQ ID NO: 615808 - RNA, 20 nt, Homo sapiens
uuuugaggccuuuuuugcca

SEQ ID NO: 615809 - RNA, 20 nt, Homo sapiens
uuuugagggguucuucuggg

SEQ ID NO: 615810 - RNA, 15 nt, Homo sapiens
uuuugaguaauucaa

SEQ ID NO: 615811 - RNA, 22 nt, Homo sapiens
uuuugaguuucauguugguuua

SEQ ID NO: 615812 - RNA, 22 nt, Homo sapiens
uuuugcacauaacaugcuuuag

SEQ ID NO: 615813 - RNA, 14 nt, Homo sapiens
uuuugcagaaaaaa

SEQ ID NO: 615814 - RNA, 12 nt, Homo sapiens
uuuugcauaaaa

SEQ ID NO: 615815 - RNA, 13 nt, Homo sapiens
uuuugccacuuag

SEQ ID NO: 615816 - RNA, 11 nt, Homo sapiens
aaaaauaccau

SEQ ID NO: 615817 - RNA, 10 nt, Homo sapiens
aaaaauacuu

SEQ ID NO: 615818 - RNA, 15 nt, Homo sapiens
aaaaauaggugugau

SEQ ID NO: 615819 - RNA, 22 nt, Homo sapiens
aaaaauauaaaguacaucucua

SEQ ID NO: 615820 - RNA, 22 nt, Homo sapiens
aaaaauauaaccauuacauguu

SEQ ID NO: 615821 - RNA, 20 nt, Homo sapiens
aaaaauauauuuaauggcaa

SEQ ID NO: 615822 - RNA, 23 nt, Homo sapiens
aaaaauauuguuucugcauucau

SEQ ID NO: 615823 - RNA, 21 nt, Homo sapiens
aaaaauauuuauaaaacuucu

SEQ ID NO: 615824 - RNA, 14 nt, Homo sapiens
aaaaaucugagaaa

SEQ ID NO: 615825 - RNA, 17 nt, Homo sapiens
aaaaaucugagaaacuc

SEQ ID NO: 615826 - RNA, 12 nt, Homo sapiens
aaaaaugaauua

SEQ ID NO: 615827 - RNA, 21 nt, Homo sapiens
aaaaaugagcauacaucuuaa

SEQ ID NO: 615828 - RNA, 17 nt, Homo sapiens
aaaaaugaugggacaau

SEQ ID NO: 615829 - RNA, 13 nt, Homo sapiens
aaaaaugcugcuc

SEQ ID NO: 615830 - RNA, 23 nt, Homo sapiens
aaaaauggauacuggugcaguca

SEQ ID NO: 615831 - RNA, 20 nt, Homo sapiens
aaaaauguauaugcacuuau

SEQ ID NO: 615832 - RNA, 15 nt, Homo sapiens
aaaaauguguuccau

SEQ ID NO: 615833 - RNA, 14 nt, Homo sapiens
aaaaauuaucuaua

SEQ ID NO: 615834 - RNA, 21 nt, Homo sapiens
aaaaauuguaucucauuacuu

SEQ ID NO: 615835 - RNA, 14 nt, Homo sapiens
aaaaauuuacuuga

SEQ ID NO: 615836 - RNA, 18 nt, Homo sapiens
aaaaauuugaacacuggc

SEQ ID NO: 615837 - RNA, 21 nt, Homo sapiens
aaaaauuuugugacauuccuu

SEQ ID NO: 615838 - RNA, 15 nt, Homo sapiens
aaaacaaaauaccac

SEQ ID NO: 615839 - RNA, 17 nt, Homo sapiens
aaaacaaaggccuaauu

SEQ ID NO: 615840 - RNA, 13 nt, Homo sapiens
aaaacaaccaaca

SEQ ID NO: 615841 - RNA, 16 nt, Homo sapiens
aaaacaagauggagau

SEQ ID NO: 615842 - RNA, 22 nt, Homo sapiens
aaaacaagcaaugggcaaugga

SEQ ID NO: 615843 - RNA, 16 nt, Homo sapiens
aaaacaagcauucaca

SEQ ID NO: 615844 - RNA, 16 nt, Homo sapiens
aaaacaaguacugguu

SEQ ID NO: 615845 - RNA, 17 nt, Homo sapiens
aaaacaauucugugaca

SEQ ID NO: 615846 - RNA, 12 nt, Homo sapiens
aaaacacaaaac

SEQ ID NO: 615847 - RNA, 22 nt, Homo sapiens
aaaacacacacaaagcacauug

SEQ ID NO: 615848 - RNA, 13 nt, Homo sapiens
aaaacacagguuu

SEQ ID NO: 615849 - RNA, 21 nt, Homo sapiens
aaaacacccaaaaauaucucc

SEQ ID NO: 615850 - RNA, 13 nt, Homo sapiens
aaaacacugugca

SEQ ID NO: 615851 - RNA, 13 nt, Homo sapiens
aaaacacuuccau

SEQ ID NO: 615852 - RNA, 13 nt, Homo sapiens
aaaacagaaagca

SEQ ID NO: 615853 - RNA, 23 nt, Homo sapiens
aaaacagaacaucauuagaacaa

SEQ ID NO: 615854 - RNA, 18 nt, Homo sapiens
aaaacagagaugugauaa

SEQ ID NO: 615855 - RNA, 21 nt, Homo sapiens
aaaacagauuuuagacuuacc

SEQ ID NO: 615856 - RNA, 18 nt, Homo sapiens
aaaacagggaauacauug

SEQ ID NO: 615857 - RNA, 13 nt, Homo sapiens
aaaacagggccac

SEQ ID NO: 615858 - RNA, 18 nt, Homo sapiens
aaaacaugauuguuuaca

SEQ ID NO: 615859 - RNA, 10 nt, Homo sapiens
aaaacauuca

SEQ ID NO: 615860 - RNA, 11 nt, Homo sapiens
aaaacauuccc

SEQ ID NO: 615861 - RNA, 13 nt, Homo sapiens
aaaacauuggcau

SEQ ID NO: 615862 - RNA, 11 nt, Homo sapiens
aaaacauuucu

SEQ ID NO: 615863 - RNA, 23 nt, Homo sapiens
aaaaccaacaaaaagaacaaauc

SEQ ID NO: 615864 - RNA, 16 nt, Homo sapiens
aaaaccaauagcuuua

SEQ ID NO: 615865 - RNA, 17 nt, Homo sapiens
aaaaccacuagaacucu

SEQ ID NO: 615866 - RNA, 17 nt, Homo sapiens
aaaacccucagcacugu

SEQ ID NO: 615867 - RNA, 21 nt, Homo sapiens
aaaaccgcaaggguagacugg

SEQ ID NO: 615868 - RNA, 22 nt, Homo sapiens
aaaaccuacacacauaccuuca

SEQ ID NO: 615869 - RNA, 22 nt, Homo sapiens
aaaaccuacgcacauaccuuca

SEQ ID NO: 615870 - RNA, 15 nt, Homo sapiens
aaaaccuaggauuug

SEQ ID NO: 615871 - RNA, 16 nt, Homo sapiens
aaaaccucuaugcaau

SEQ ID NO: 615872 - RNA, 23 nt, Homo sapiens
aaaaccugaagacugaggacaaa

SEQ ID NO: 615873 - RNA, 16 nt, Homo sapiens
aaaaccugggugucag

SEQ ID NO: 615874 - RNA, 19 nt, Homo sapiens
aaaacgcacaagccagacc

SEQ ID NO: 615875 - RNA, 15 nt, Homo sapiens
aaaacgcauccaaga

SEQ ID NO: 615876 - RNA, 15 nt, Homo sapiens
aaaacgcaugugcag

SEQ ID NO: 615877 - RNA, 21 nt, Homo sapiens
aaaacgcgucugccugggccg

SEQ ID NO: 615878 - RNA, 15 nt, Homo sapiens
aaaacuaaacugcug

SEQ ID NO: 615879 - RNA, 14 nt, Homo sapiens
aaaacuaaccaucu

SEQ ID NO: 615880 - RNA, 13 nt, Homo sapiens
aaaacuaagcaca

SEQ ID NO: 615881 - RNA, 19 nt, Homo sapiens
aaaacuaauguacuguaca

SEQ ID NO: 615882 - RNA, 18 nt, Homo sapiens
aaaacuacacaaauuaua

SEQ ID NO: 615883 - RNA, 16 nt, Homo sapiens
aaaacuagcauuacau

SEQ ID NO: 615884 - RNA, 15 nt, Homo sapiens
aaaacucacugugau

SEQ ID NO: 615885 - RNA, 19 nt, Homo sapiens
aaaacucaguaagaauuau

SEQ ID NO: 615886 - RNA, 13 nt, Homo sapiens
aaaacucauuucc

SEQ ID NO: 615887 - RNA, 21 nt, Homo sapiens
aaaacuccacagucaauauua

SEQ ID NO: 615888 - RNA, 11 nt, Homo sapiens
aaaacucuccu

SEQ ID NO: 615889 - RNA, 13 nt, Homo sapiens
aaaacucuggguc

SEQ ID NO: 615890 - RNA, 20 nt, Homo sapiens
aaaacucuugugguaccuag

SEQ ID NO: 615891 - RNA, 14 nt, Homo sapiens
aaaacugacagagg

SEQ ID NO: 615892 - RNA, 11 nt, Homo sapiens
aaaacugacuc

SEQ ID NO: 615893 - RNA, 11 nt, Homo sapiens
aaaacugagug

SEQ ID NO: 615894 - RNA, 11 nt, Homo sapiens
aaaacugccuc

SEQ ID NO: 615895 - RNA, 20 nt, Homo sapiens
aaaacugccuuuuaucugcc

SEQ ID NO: 615896 - RNA, 18 nt, Homo sapiens
aaaacugcuuugugcaua

SEQ ID NO: 615897 - RNA, 18 nt, Homo sapiens
aaaacuguguaaaccaca

SEQ ID NO: 615898 - RNA, 20 nt, Homo sapiens
aaaacuguucuuuugcaaua

SEQ ID NO: 615899 - RNA, 14 nt, Homo sapiens
aaaacuuaacauuc

SEQ ID NO: 615900 - RNA, 18 nt, Homo sapiens
aaaacuuaaggaagcaaa

SEQ ID NO: 615901 - RNA, 12 nt, Homo sapiens
aaaacuuaucac

SEQ ID NO: 615902 - RNA, 12 nt, Homo sapiens
aaaacuuccuuu

SEQ ID NO: 615903 - RNA, 17 nt, Homo sapiens
aaaacuugcugccugaa

SEQ ID NO: 615904 - RNA, 15 nt, Homo sapiens
aaaacuuggaccacu

SEQ ID NO: 615905 - RNA, 14 nt, Homo sapiens
aaaacuuguagaau

SEQ ID NO: 615906 - RNA, 17 nt, Homo sapiens
aaaacuuuaaugaacua

SEQ ID NO: 615907 - RNA, 20 nt, Homo sapiens
aaaacuuuccugacuuacaa

SEQ ID NO: 615908 - RNA, 18 nt, Homo sapiens
aaaacuuuucuaauacuc

SEQ ID NO: 615909 - RNA, 17 nt, Homo sapiens
aaaagaaacuuaccaau

SEQ ID NO: 615910 - RNA, 12 nt, Homo sapiens
aaaagaaaucca

SEQ ID NO: 615911 - RNA, 11 nt, Homo sapiens
aaaagaacaau

SEQ ID NO: 615912 - RNA, 15 nt, Homo sapiens
aaaagaacaaugaca

SEQ ID NO: 615913 - RNA, 13 nt, Homo sapiens
aaaagaacauaaa

SEQ ID NO: 615914 - RNA, 23 nt, Homo sapiens
aaaagaaucccuguucauuguaa

SEQ ID NO: 615915 - RNA, 15 nt, Homo sapiens
aaaagacacagaaca

SEQ ID NO: 615916 - RNA, 15 nt, Homo sapiens
aaaagaccaguccau

SEQ ID NO: 615917 - RNA, 15 nt, Homo sapiens
aaaagacugaaucua

SEQ ID NO: 615918 - RNA, 14 nt, Homo sapiens
aaaagacugaccaa

SEQ ID NO: 615919 - RNA, 21 nt, Homo sapiens
aaaagacugguuuguuugcuu

SEQ ID NO: 615920 - RNA, 22 nt, Homo sapiens
aaaagacugguuuguuugcuua

SEQ ID NO: 615921 - RNA, 22 nt, Homo sapiens
aaaagacuuuuuuuuaacacuu

SEQ ID NO: 615922 - RNA, 17 nt, Homo sapiens
aaaagagagaucuugau

SEQ ID NO: 615923 - RNA, 17 nt, Homo sapiens
aaaagagcuauugccaa

SEQ ID NO: 615924 - RNA, 21 nt, Homo sapiens
aaaagagucaacaguaucugu

SEQ ID NO: 615925 - RNA, 14 nt, Homo sapiens
aaaagauuauagaa

SEQ ID NO: 615926 - RNA, 22 nt, Homo sapiens
aaaagauucccacccaauucaa

SEQ ID NO: 615927 - RNA, 18 nt, Homo sapiens
aaaagauuuguuuuguca

SEQ ID NO: 615928 - RNA, 13 nt, Homo sapiens
aaaagcaaaauca

SEQ ID NO: 615929 - RNA, 14 nt, Homo sapiens
aaaagcaaguucgu

SEQ ID NO: 615930 - RNA, 21 nt, Homo sapiens
aaaagcaauucugacugucca

SEQ ID NO: 615931 - RNA, 18 nt, Homo sapiens
aaaagcacacucaucccc

SEQ ID NO: 615932 - RNA, 20 nt, Homo sapiens
aaaagcacauguauugacaa

SEQ ID NO: 615933 - RNA, 14 nt, Homo sapiens
aaaagcagcuacca

SEQ ID NO: 615934 - RNA, 19 nt, Homo sapiens
aaaagcaugaaacauuuca

SEQ ID NO: 615935 - RNA, 14 nt, Homo sapiens
aaaagcaugcauau

SEQ ID NO: 615936 - RNA, 16 nt, Homo sapiens
aaaagcaugcauauca

SEQ ID NO: 615937 - RNA, 17 nt, Homo sapiens
aaaagcauguuaugugu

SEQ ID NO: 615938 - RNA, 11 nt, Homo sapiens
aaaagccaaaa

SEQ ID NO: 615939 - RNA, 13 nt, Homo sapiens
aacuucagugugg

SEQ ID NO: 615940 - RNA, 12 nt, Homo sapiens
aacuuccaguca

SEQ ID NO: 615941 - RNA, 20 nt, Homo sapiens
aacuuccuacguauccugca

SEQ ID NO: 615942 - RNA, 12 nt, Homo sapiens
aacuuccuucuc

SEQ ID NO: 615943 - RNA, 16 nt, Homo sapiens
aacuugaacuccagga

SEQ ID NO: 615944 - RNA, 23 nt, Homo sapiens
aacuugaauuaauccacacauca

SEQ ID NO: 615945 - RNA, 14 nt, Homo sapiens
aacuugacccccuu

SEQ ID NO: 615946 - RNA, 23 nt, Homo sapiens
aacuugcacaaaaucacacagcc

SEQ ID NO: 615947 - RNA, 20 nt, Homo sapiens
aacuugcacgacgccugcca

SEQ ID NO: 615948 - RNA, 16 nt, Homo sapiens
aacuugcuacuuauca

SEQ ID NO: 615949 - RNA, 19 nt, Homo sapiens
aacuugcugcugugccugc

SEQ ID NO: 615950 - RNA, 19 nt, Homo sapiens
aacuugcuucuaaaugccc

SEQ ID NO: 615951 - RNA, 14 nt, Homo sapiens
aacuuggacaugaa

SEQ ID NO: 615952 - RNA, 19 nt, Homo sapiens
aacuuggauguaccugccc

SEQ ID NO: 615953 - RNA, 15 nt, Homo sapiens
aacuuggcacacucu

SEQ ID NO: 615954 - RNA, 19 nt, Homo sapiens
aacuuggucuggcuuuaag

SEQ ID NO: 615955 - RNA, 21 nt, Homo sapiens
aacuugguuuguggugcacag

SEQ ID NO: 615956 - RNA, 18 nt, Homo sapiens
aacuuguauuaaagacag

SEQ ID NO: 615957 - RNA, 18 nt, Homo sapiens
aacuuguggccucaagca

SEQ ID NO: 615958 - RNA, 22 nt, Homo sapiens
aacuuguuugguaguuagccau

SEQ ID NO: 615959 - RNA, 15 nt, Homo sapiens
aacuuuaaugaacua

SEQ ID NO: 615960 - RNA, 20 nt, Homo sapiens
aacuuuagacuucccacugu

SEQ ID NO: 615961 - RNA, 15 nt, Homo sapiens
aacuuuaguuugccu

SEQ ID NO: 615962 - RNA, 14 nt, Homo sapiens
aacuuuaucacuua

SEQ ID NO: 615963 - RNA, 13 nt, Homo sapiens
aacuuucuuucac

SEQ ID NO: 615964 - RNA, 15 nt, Homo sapiens
aacuuugcaucucag

SEQ ID NO: 615965 - RNA, 18 nt, Homo sapiens
aacuuuguauuaaugugu

SEQ ID NO: 615966 - RNA, 22 nt, Homo sapiens
aacuuuguggaugucuuccuug

SEQ ID NO: 615967 - RNA, 23 nt, Homo sapiens
aacuuuguuuagcccaaaaccaa

SEQ ID NO: 615968 - RNA, 18 nt, Homo sapiens
aacuuuuagguuguuacc

SEQ ID NO: 615969 - RNA, 21 nt, Homo sapiens
aacuuuuccuuucauacgucu

SEQ ID NO: 615970 - RNA, 17 nt, Homo sapiens
aacuuuucgacauauuu

SEQ ID NO: 615971 - RNA, 18 nt, Homo sapiens
aacuuuugguaucuacuu

SEQ ID NO: 615972 - RNA, 19 nt, Homo sapiens
aacuuuuuccagcaaaaug

SEQ ID NO: 615973 - RNA, 17 nt, Homo sapiens
aacuuuuuguuacagau

SEQ ID NO: 615974 - RNA, 18 nt, Homo sapiens
aacuuuuuugaggccuuu

SEQ ID NO: 615975 - RNA, 15 nt, Homo sapiens
aagaaaaaaagggag

SEQ ID NO: 615976 - RNA, 14 nt, Homo sapiens
aagaaaaaaucugc

SEQ ID NO: 615977 - RNA, 18 nt, Homo sapiens
aagaaaaacaucuuuggc

SEQ ID NO: 615978 - RNA, 22 nt, Homo sapiens
aagaaaaaugagcauacaucuu

SEQ ID NO: 615979 - RNA, 14 nt, Homo sapiens
aagaaaacuuccau

SEQ ID NO: 615980 - RNA, 14 nt, Homo sapiens
aagaaaagaccuuu

SEQ ID NO: 615981 - RNA, 15 nt, Homo sapiens
aagaaaagacuuuug

SEQ ID NO: 615982 - RNA, 15 nt, Homo sapiens
aagaaaagcauucaa

SEQ ID NO: 615983 - RNA, 15 nt, Homo sapiens
aagaaaagcugccau

SEQ ID NO: 615984 - RNA, 19 nt, Homo sapiens
aagaaaagugggccagugu

SEQ ID NO: 615985 - RNA, 13 nt, Homo sapiens
aagaaaaucacuu

SEQ ID NO: 615986 - RNA, 14 nt, Homo sapiens
aagaaaauccauua

SEQ ID NO: 615987 - RNA, 13 nt, Homo sapiens
aagaaaauggauu

SEQ ID NO: 615988 - RNA, 21 nt, Homo sapiens
aagaaacacagcaacaaugac

SEQ ID NO: 615989 - RNA, 12 nt, Homo sapiens
aagaaacaugau

SEQ ID NO: 615990 - RNA, 23 nt, Homo sapiens
aagaaacuaaacagaaaacuccc

SEQ ID NO: 615991 - RNA, 23 nt, Homo sapiens
aagaaagagcaacaauccaucuc

SEQ ID NO: 615992 - RNA, 14 nt, Homo sapiens
aagaaagauuacuu

SEQ ID NO: 615993 - RNA, 14 nt, Homo sapiens
aagaaagcugagaa

SEQ ID NO: 615994 - RNA, 16 nt, Homo sapiens
aagaaagcugagaaga

SEQ ID NO: 615995 - RNA, 18 nt, Homo sapiens
aagaaaggccagcaaauu

SEQ ID NO: 615996 - RNA, 12 nt, Homo sapiens
aagaaaguguau

SEQ ID NO: 615997 - RNA, 17 nt, Homo sapiens
aagaaaguguuggcuaa

SEQ ID NO: 615998 - RNA, 13 nt, Homo sapiens
aagaaauccaaau

SEQ ID NO: 615999 - RNA, 16 nt, Homo sapiens
aagaaauccaaauuuc

SEQ ID NO: 616000 - RNA, 19 nt, Homo sapiens
aagaaauccaaauuucuca

SEQ ID NO: 616001 - RNA, 18 nt, Homo sapiens
aagaaauccaguuuccca

SEQ ID NO: 616002 - RNA, 21 nt, Homo sapiens
aagaaauccugugugucgcuu

SEQ ID NO: 616003 - RNA, 20 nt, Homo sapiens
aagaaaugauggaaguucau

SEQ ID NO: 616004 - RNA, 16 nt, Homo sapiens
aagaaauggcuaugaa

SEQ ID NO: 616005 - RNA, 12 nt, Homo sapiens
aagaaauuccug

SEQ ID NO: 616006 - RNA, 17 nt, Homo sapiens
aagaaauuccuguagca

SEQ ID NO: 616007 - RNA, 14 nt, Homo sapiens
aagaacaacagaaa

SEQ ID NO: 616008 - RNA, 20 nt, Homo sapiens
aagaacaaugccagggccca

SEQ ID NO: 616009 - RNA, 11 nt, Homo sapiens
aagaacacagg

SEQ ID NO: 616010 - RNA, 18 nt, Homo sapiens
aagaacacuacugcuaaa

SEQ ID NO: 616011 - RNA, 17 nt, Homo sapiens
aagaacaguaacugcca

SEQ ID NO: 616012 - RNA, 17 nt, Homo sapiens
aagaacauucuaccaaa

SEQ ID NO: 616013 - RNA, 19 nt, Homo sapiens
aagaacauuuugccugauu

SEQ ID NO: 616014 - RNA, 12 nt, Homo sapiens
aagaaccagaga

SEQ ID NO: 616015 - RNA, 22 nt, Homo sapiens
aagaaccagagaggcucugaga

SEQ ID NO: 616016 - RNA, 19 nt, Homo sapiens
aagaaccccucugucuuca

SEQ ID NO: 616017 - RNA, 13 nt, Homo sapiens
aagaaccucucac

SEQ ID NO: 616018 - RNA, 13 nt, Homo sapiens
aagaaccuugccu

SEQ ID NO: 616019 - RNA, 14 nt, Homo sapiens
aagaacuaagccaa

SEQ ID NO: 616020 - RNA, 14 nt, Homo sapiens
aagaacucucugga

SEQ ID NO: 616021 - RNA, 23 nt, Homo sapiens
aagaacuucaugggccuuccaua

SEQ ID NO: 616022 - RNA, 12 nt, Homo sapiens
aagaacuucauu

SEQ ID NO: 616023 - RNA, 21 nt, Homo sapiens
aagaacuuggcacacucucca

SEQ ID NO: 616024 - RNA, 20 nt, Homo sapiens
aagaagaaacgucuaugugu

SEQ ID NO: 616025 - RNA, 19 nt, Homo sapiens
aagaagaaguaaaacuauu

SEQ ID NO: 616026 - RNA, 20 nt, Homo sapiens
aagaagaauuggccaucuua

SEQ ID NO: 616027 - RNA, 18 nt, Homo sapiens
aagaagacucaguaugcu

SEQ ID NO: 616028 - RNA, 13 nt, Homo sapiens
aagaagagaagcu

SEQ ID NO: 616029 - RNA, 13 nt, Homo sapiens
aagaagagacugc

SEQ ID NO: 616030 - RNA, 16 nt, Homo sapiens
aagaagauaaacacaa

SEQ ID NO: 616031 - RNA, 14 nt, Homo sapiens
aagaagauaugcaa

SEQ ID NO: 616032 - RNA, 14 nt, Homo sapiens
aagaagaugagccu

SEQ ID NO: 616033 - RNA, 17 nt, Homo sapiens
aagaagauguccgugag

SEQ ID NO: 616034 - RNA, 18 nt, Homo sapiens
aagaagccaggugcaaaa

SEQ ID NO: 616035 - RNA, 18 nt, Homo sapiens
aagaagcccauaucacau

SEQ ID NO: 616036 - RNA, 13 nt, Homo sapiens
aagaagcucucca

SEQ ID NO: 616037 - RNA, 11 nt, Homo sapiens
aagaaggcauu

SEQ ID NO: 616038 - RNA, 14 nt, Homo sapiens
aagaaguuacuuuu

SEQ ID NO: 616039 - RNA, 21 nt, Homo sapiens
aagaaguuguuugaggcaaau

SEQ ID NO: 616040 - RNA, 21 nt, Homo sapiens
aagaauaaggcuuuuucuucc

SEQ ID NO: 616041 - RNA, 13 nt, Homo sapiens
aagaauaauucaa

SEQ ID NO: 616042 - RNA, 16 nt, Homo sapiens
aagaauagcauuguaa

SEQ ID NO: 616043 - RNA, 13 nt, Homo sapiens
aagaauauuguau

SEQ ID NO: 616044 - RNA, 14 nt, Homo sapiens
aagaaucaccucaa

SEQ ID NO: 616045 - RNA, 21 nt, Homo sapiens
aagaaucagaaacaggugcau

SEQ ID NO: 616046 - RNA, 14 nt, Homo sapiens
aagaaucagucuug

SEQ ID NO: 616047 - RNA, 23 nt, Homo sapiens
aagaaucuaaaccuuacaugugu

SEQ ID NO: 616048 - RNA, 23 nt, Homo sapiens
aagaaugagacugaacuguguga

SEQ ID NO: 616049 - RNA, 13 nt, Homo sapiens
aagaaugaucagc

SEQ ID NO: 616050 - RNA, 15 nt, Homo sapiens
aagaaugaugcuaug

SEQ ID NO: 616051 - RNA, 17 nt, Homo sapiens
aagaauguuaugugcaa

SEQ ID NO: 616052 - RNA, 22 nt, Homo sapiens
aagaauguuucuggaauucuuc

SEQ ID NO: 616053 - RNA, 23 nt, Homo sapiens
aagaauuaaucaagacucuugaa

SEQ ID NO: 616054 - RNA, 20 nt, Homo sapiens
aagaauucucucuucuggaa

SEQ ID NO: 616055 - RNA, 17 nt, Homo sapiens
aagaauugaacccagga

SEQ ID NO: 616056 - RNA, 13 nt, Homo sapiens
aagaauuggccag

SEQ ID NO: 616057 - RNA, 16 nt, Homo sapiens
aagaauuggccaucuu

SEQ ID NO: 616058 - RNA, 16 nt, Homo sapiens
aagaauugucuugcaa

SEQ ID NO: 616059 - RNA, 19 nt, Homo sapiens
aagaauuuaagaaacuuau

SEQ ID NO: 616060 - RNA, 16 nt, Homo sapiens
aagaauuugcauacuu

SEQ ID NO: 616061 - RNA, 18 nt, Homo sapiens
aagaauuuuaccauucag

SEQ ID NO: 616062 - RNA, 14 nt, Homo sapiens
aagcugggagcaca

SEQ ID NO: 616063 - RNA, 21 nt, Homo sapiens
aagcugggauaaucacauuau

SEQ ID NO: 616064 - RNA, 22 nt, Homo sapiens
aagcugguaaacuauuugucuu

SEQ ID NO: 616065 - RNA, 21 nt, Homo sapiens
aagcuguacucagagcagagc

SEQ ID NO: 616066 - RNA, 18 nt, Homo sapiens
aagcugucaccucuugau

SEQ ID NO: 616067 - RNA, 22 nt, Homo sapiens
aagcuguguccuugcaccugca

SEQ ID NO: 616068 - RNA, 12 nt, Homo sapiens
aagcuguugcua

SEQ ID NO: 616069 - RNA, 15 nt, Homo sapiens
aagcuguugcuauuu

SEQ ID NO: 616070 - RNA, 16 nt, Homo sapiens
aagcuuaacacuugac

SEQ ID NO: 616071 - RNA, 19 nt, Homo sapiens
aagcuuaauggauuguuaa

SEQ ID NO: 616072 - RNA, 18 nt, Homo sapiens
aagcuucaaaaagccacu

SEQ ID NO: 616073 - RNA, 15 nt, Homo sapiens
aagcuucaugcacuu

SEQ ID NO: 616074 - RNA, 16 nt, Homo sapiens
aagcuuccauaguggu

SEQ ID NO: 616075 - RNA, 20 nt, Homo sapiens
aagcuuggauuaaauacaua

SEQ ID NO: 616076 - RNA, 17 nt, Homo sapiens
aagcuuggucaaacuuu

SEQ ID NO: 616077 - RNA, 19 nt, Homo sapiens
aagcuuguccaucacucua

SEQ ID NO: 616078 - RNA, 15 nt, Homo sapiens
aagcuuuaaaugucu

SEQ ID NO: 616079 - RNA, 16 nt, Homo sapiens
aagcuuuaucuuugug

SEQ ID NO: 616080 - RNA, 21 nt, Homo sapiens
aagcuuuauuaccaguggcgu

SEQ ID NO: 616081 - RNA, 18 nt, Homo sapiens
aagcuuucuguugauguu

SEQ ID NO: 616082 - RNA, 21 nt, Homo sapiens
aagcuuucuguugauguuaac

SEQ ID NO: 616083 - RNA, 14 nt, Homo sapiens
aagcuuuggacaag

SEQ ID NO: 616084 - RNA, 14 nt, Homo sapiens
aaggaaaagcaaga

SEQ ID NO: 616085 - RNA, 19 nt, Homo sapiens
aaggaaaauuaauccucac

SEQ ID NO: 616086 - RNA, 19 nt, Homo sapiens
aaggaaaccgcugccuuua

SEQ ID NO: 616087 - RNA, 22 nt, Homo sapiens
aaggaaacuguacuacaucuag

SEQ ID NO: 616088 - RNA, 19 nt, Homo sapiens
aaggaaagaaaacaucuuu

SEQ ID NO: 616089 - RNA, 17 nt, Homo sapiens
aaggaaauaacauugca

SEQ ID NO: 616090 - RNA, 21 nt, Homo sapiens
aaggaaauaguaccuucaaua

SEQ ID NO: 616091 - RNA, 12 nt, Homo sapiens
aaggaaaucaaa

SEQ ID NO: 616092 - RNA, 13 nt, Homo sapiens
aaggaacacuggc

SEQ ID NO: 616093 - RNA, 22 nt, Homo sapiens
aaggaacauuccuuagucucaa

SEQ ID NO: 616094 - RNA, 12 nt, Homo sapiens
aaggaaccagaa

SEQ ID NO: 616095 - RNA, 17 nt, Homo sapiens
aaggaaccuuccuuccu

SEQ ID NO: 616096 - RNA, 21 nt, Homo sapiens
aaggaacguauaucacauaau

SEQ ID NO: 616097 - RNA, 15 nt, Homo sapiens
aaggaacuaagucag

SEQ ID NO: 616098 - RNA, 18 nt, Homo sapiens
aaggaagaagaguauuaa

SEQ ID NO: 616099 - RNA, 14 nt, Homo sapiens
aaggaagacuugaa

SEQ ID NO: 616100 - RNA, 15 nt, Homo sapiens
aaggaagauuugacg

SEQ ID NO: 616101 - RNA, 12 nt, Homo sapiens
aaggaagcucca

SEQ ID NO: 616102 - RNA, 23 nt, Homo sapiens
aaggaagggacaagacaaaacca

SEQ ID NO: 616103 - RNA, 19 nt, Homo sapiens
aaggaaucaaauuuugcca

SEQ ID NO: 616104 - RNA, 14 nt, Homo sapiens
aaggaaucacguua

SEQ ID NO: 616105 - RNA, 18 nt, Homo sapiens
aaggacagcccuccuuga

SEQ ID NO: 616106 - RNA, 13 nt, Homo sapiens
aaggaccaauagc

SEQ ID NO: 616107 - RNA, 21 nt, Homo sapiens
aaggaccuaaauucguagcaa

SEQ ID NO: 616108 - RNA, 22 nt, Homo sapiens
aaggacuccauuggaucugcaa

SEQ ID NO: 616109 - RNA, 19 nt, Homo sapiens
aaggacucugcuucagucc

SEQ ID NO: 616110 - RNA, 16 nt, Homo sapiens
aaggacugucccagac

SEQ ID NO: 616111 - RNA, 14 nt, Homo sapiens
aaggacuucaggaa

SEQ ID NO: 616112 - RNA, 15 nt, Homo sapiens
aaggacuuugcagcc

SEQ ID NO: 616113 - RNA, 23 nt, Homo sapiens
aaggagacugaggggcuuuguaa

SEQ ID NO: 616114 - RNA, 19 nt, Homo sapiens
aaggagagagugagugcau

SEQ ID NO: 616115 - RNA, 15 nt, Homo sapiens
aaggagcagcauuga

SEQ ID NO: 616116 - RNA, 15 nt, Homo sapiens
aaggaggccugggga

SEQ ID NO: 616117 - RNA, 15 nt, Homo sapiens
aaggagggucucuug

SEQ ID NO: 616118 - RNA, 17 nt, Homo sapiens
aaggaguaaucugugua

SEQ ID NO: 616119 - RNA, 11 nt, Homo sapiens
aaggagucaaa

SEQ ID NO: 616120 - RNA, 15 nt, Homo sapiens
aaggagucacugaga

SEQ ID NO: 616121 - RNA, 13 nt, Homo sapiens
aaggaguucucuu

SEQ ID NO: 616122 - RNA, 21 nt, Homo sapiens
aaggaguuuugcaaagugcaa

SEQ ID NO: 616123 - RNA, 19 nt, Homo sapiens
aaggauaaagccacuucug

SEQ ID NO: 616124 - RNA, 15 nt, Homo sapiens
aaggauagugcgaug

SEQ ID NO: 616125 - RNA, 15 nt, Homo sapiens
aaggauaugauuaau

SEQ ID NO: 616126 - RNA, 17 nt, Homo sapiens
aaggauaugcaguaugc

SEQ ID NO: 616127 - RNA, 23 nt, Homo sapiens
aaggauauuuaagaaaauacaau

SEQ ID NO: 616128 - RNA, 20 nt, Homo sapiens
aaggauccucuccacuccau

SEQ ID NO: 616129 - RNA, 21 nt, Homo sapiens
aaggaucuaggagaagggucu

SEQ ID NO: 616130 - RNA, 21 nt, Homo sapiens
aaggaugcggcaggugcucug

SEQ ID NO: 616131 - RNA, 13 nt, Homo sapiens
aaggauggaccac

SEQ ID NO: 616132 - RNA, 23 nt, Homo sapiens
aaggauggagccagcucugcauu

SEQ ID NO: 616133 - RNA, 12 nt, Homo sapiens
aaggaugugauu

SEQ ID NO: 616134 - RNA, 11 nt, Homo sapiens
aaggauguuuu

SEQ ID NO: 616135 - RNA, 16 nt, Homo sapiens
aaggauuacucuccau

SEQ ID NO: 616136 - RNA, 21 nt, Homo sapiens
aaggauuguacacgcugauga

SEQ ID NO: 616137 - RNA, 16 nt, Homo sapiens
aaggauuuuaccaaag

SEQ ID NO: 616138 - RNA, 22 nt, Homo sapiens
aaggcaaggucaccugccucuu

SEQ ID NO: 616139 - RNA, 20 nt, Homo sapiens
aaggcaauuuuaguguauua

SEQ ID NO: 616140 - RNA, 14 nt, Homo sapiens
aaggcagaggcugg

SEQ ID NO: 616141 - RNA, 23 nt, Homo sapiens
aaggcagcugccucugcucccuc

SEQ ID NO: 616142 - RNA, 16 nt, Homo sapiens
aaggcaggacagagaa

SEQ ID NO: 616143 - RNA, 21 nt, Homo sapiens
aaggcagggccugauuuaucu

SEQ ID NO: 616144 - RNA, 23 nt, Homo sapiens
aaggcaguaguuuucaaaacaca

SEQ ID NO: 616145 - RNA, 13 nt, Homo sapiens
aaggcaguccaga

SEQ ID NO: 616146 - RNA, 15 nt, Homo sapiens
aaggcaucgucaugc

SEQ ID NO: 616147 - RNA, 20 nt, Homo sapiens
aaggcaugcuuguggaugac

SEQ ID NO: 616148 - RNA, 23 nt, Homo sapiens
aaggcauguggccuuuaucucaa

SEQ ID NO: 616149 - RNA, 14 nt, Homo sapiens
aaggcauuccucau

SEQ ID NO: 616150 - RNA, 13 nt, Homo sapiens
aaggcauuucaua

SEQ ID NO: 616151 - RNA, 17 nt, Homo sapiens
aaggccaauaauaaaga

SEQ ID NO: 616152 - RNA, 18 nt, Homo sapiens
aaggccagaaacuccuuu

SEQ ID NO: 616153 - RNA, 17 nt, Homo sapiens
aaggccccaagguuuac

SEQ ID NO: 616154 - RNA, 15 nt, Homo sapiens
aaggccccucugugg

SEQ ID NO: 616155 - RNA, 16 nt, Homo sapiens
aaggcccugcugaguc

SEQ ID NO: 616156 - RNA, 17 nt, Homo sapiens
aaggcccuuuucagggc

SEQ ID NO: 616157 - RNA, 15 nt, Homo sapiens
aaggccgggugacac

SEQ ID NO: 616158 - RNA, 23 nt, Homo sapiens
aaggccucccugucuaaaauccc

SEQ ID NO: 616159 - RNA, 16 nt, Homo sapiens
aaggccugguguuucu

SEQ ID NO: 616160 - RNA, 17 nt, Homo sapiens
aaggccuuaauggacau

SEQ ID NO: 616161 - RNA, 13 nt, Homo sapiens
aaggccuuuagua

SEQ ID NO: 616162 - RNA, 20 nt, Homo sapiens
aaggcgggaggauugcuuga

SEQ ID NO: 616163 - RNA, 21 nt, Homo sapiens
aaggcuauguaaacaaaccac

SEQ ID NO: 616164 - RNA, 17 nt, Homo sapiens
aaggcucagucucagga

SEQ ID NO: 616165 - RNA, 23 nt, Homo sapiens
aaggcucccggaauuccgucacc

SEQ ID NO: 616166 - RNA, 12 nt, Homo sapiens
aaggcugaccaa

SEQ ID NO: 616167 - RNA, 17 nt, Homo sapiens
aaggcugaccaagagag

SEQ ID NO: 616168 - RNA, 20 nt, Homo sapiens
aaggcugagacagugaauuu

SEQ ID NO: 616169 - RNA, 20 nt, Homo sapiens
aaggcuggauggcaccucag

SEQ ID NO: 616170 - RNA, 19 nt, Homo sapiens
aaggcuguacgacacgggu

SEQ ID NO: 616171 - RNA, 22 nt, Homo sapiens
aaggcuucuccgcccauucuga

SEQ ID NO: 616172 - RNA, 21 nt, Homo sapiens
aaggcuucucuccacaguguu

SEQ ID NO: 616173 - RNA, 15 nt, Homo sapiens
aaggcuugaagcugu

SEQ ID NO: 616174 - RNA, 14 nt, Homo sapiens
aaggcuuugaguua

SEQ ID NO: 616175 - RNA, 23 nt, Homo sapiens
aagggaaccauguauaugagcuu

SEQ ID NO: 616176 - RNA, 13 nt, Homo sapiens
aagggaacuucca

SEQ ID NO: 616177 - RNA, 17 nt, Homo sapiens
aagggaaggcaaaggca

SEQ ID NO: 616178 - RNA, 17 nt, Homo sapiens
aagggaauacugugcau

SEQ ID NO: 616179 - RNA, 23 nt, Homo sapiens
aagggaauacugugcauaagcca

SEQ ID NO: 616180 - RNA, 18 nt, Homo sapiens
aagggaauugcucagaga

SEQ ID NO: 616181 - RNA, 22 nt, Homo sapiens
aagggacagcaagugagcagag

SEQ ID NO: 616182 - RNA, 17 nt, Homo sapiens
aagggacuaggaaauuc

SEQ ID NO: 616183 - RNA, 21 nt, Homo sapiens
aagggagaacuugaaacagau

SEQ ID NO: 616184 - RNA, 14 nt, Homo sapiens
aauaauucuuccuc

SEQ ID NO: 616185 - RNA, 20 nt, Homo sapiens
aauaauuggagaagauuuau

SEQ ID NO: 616186 - RNA, 15 nt, Homo sapiens
aauaauuuauuacaa

SEQ ID NO: 616187 - RNA, 15 nt, Homo sapiens
aauacaaguuucuga

SEQ ID NO: 616188 - RNA, 22 nt, Homo sapiens
aauacagaaguccccucuacuu

SEQ ID NO: 616189 - RNA, 21 nt, Homo sapiens
aauacagacuacuucuucccc

SEQ ID NO: 616190 - RNA, 20 nt, Homo sapiens
aauacagaucaucuuggaac

SEQ ID NO: 616191 - RNA, 13 nt, Homo sapiens
aauacagcuauga

SEQ ID NO: 616192 - RNA, 14 nt, Homo sapiens
aauacagcuaugaa

SEQ ID NO: 616193 - RNA, 22 nt, Homo sapiens
aauacaggaggcagacaaugac

SEQ ID NO: 616194 - RNA, 14 nt, Homo sapiens
aauacaguaucuca

SEQ ID NO: 616195 - RNA, 21 nt, Homo sapiens
aauacagucuuccauuugcaa

SEQ ID NO: 616196 - RNA, 20 nt, Homo sapiens
aauacagugagcucuagcaa

SEQ ID NO: 616197 - RNA, 22 nt, Homo sapiens
aauacauuguuguaagagugau

SEQ ID NO: 616198 - RNA, 21 nt, Homo sapiens
aauacauuugauuuguucaug

SEQ ID NO: 616199 - RNA, 18 nt, Homo sapiens
aauaccacagcucagcca

SEQ ID NO: 616200 - RNA, 14 nt, Homo sapiens
aauacccauauguc

SEQ ID NO: 616201 - RNA, 10 nt, Homo sapiens
aauaccucac

SEQ ID NO: 616202 - RNA, 16 nt, Homo sapiens
aauaccuucugaacua

SEQ ID NO: 616203 - RNA, 20 nt, Homo sapiens
aauaccuuuucucacaaaaa

SEQ ID NO: 616204 - RNA, 17 nt, Homo sapiens
aauacgaaaaucccaug

SEQ ID NO: 616205 - RNA, 22 nt, Homo sapiens
aauacgguaccuggcaauguuu

SEQ ID NO: 616206 - RNA, 23 nt, Homo sapiens
aauacuacugugugugcauugaa

SEQ ID NO: 616207 - RNA, 18 nt, Homo sapiens
aauacuauuauuugcuac

SEQ ID NO: 616208 - RNA, 14 nt, Homo sapiens
aauacucaacauua

SEQ ID NO: 616209 - RNA, 12 nt, Homo sapiens
aauacucugcag

SEQ ID NO: 616210 - RNA, 22 nt, Homo sapiens
aauacugaaggacacagcagug

SEQ ID NO: 616211 - RNA, 23 nt, Homo sapiens
aauacugaaggacacagcagugg

SEQ ID NO: 616212 - RNA, 19 nt, Homo sapiens
aauacugccggucacccag

SEQ ID NO: 616213 - RNA, 23 nt, Homo sapiens
aauacugcuugaccguacucuca

SEQ ID NO: 616214 - RNA, 21 nt, Homo sapiens
aauacuggacucaggaacuuu

SEQ ID NO: 616215 - RNA, 16 nt, Homo sapiens
aauacuggucucaggc

SEQ ID NO: 616216 - RNA, 19 nt, Homo sapiens
aauacuggugcacuucuua

SEQ ID NO: 616217 - RNA, 20 nt, Homo sapiens
aauacugugcauaagccauu

SEQ ID NO: 616218 - RNA, 21 nt, Homo sapiens
aauacuuacuauaauuugacu

SEQ ID NO: 616219 - RNA, 20 nt, Homo sapiens
aauacuuauuuucagugcau

SEQ ID NO: 616220 - RNA, 17 nt, Homo sapiens
aauacuucaccuuuccu

SEQ ID NO: 616221 - RNA, 21 nt, Homo sapiens
aauacuugaacucuguucccc

SEQ ID NO: 616222 - RNA, 19 nt, Homo sapiens
aauacuugaccucugugac

SEQ ID NO: 616223 - RNA, 17 nt, Homo sapiens
aauacuuuaugaugcua

SEQ ID NO: 616224 - RNA, 18 nt, Homo sapiens
aauacuuuugcugaugcu

SEQ ID NO: 616225 - RNA, 18 nt, Homo sapiens
aauacuuuuuacaauuaa

SEQ ID NO: 616226 - RNA, 21 nt, Homo sapiens
aauacuuuuuucuaguuucag

SEQ ID NO: 616227 - RNA, 21 nt, Homo sapiens
aauagaaacuacccaucucaa

SEQ ID NO: 616228 - RNA, 12 nt, Homo sapiens
aauagaaagcca

SEQ ID NO: 616229 - RNA, 22 nt, Homo sapiens
aauagaaggauguacauuucca

SEQ ID NO: 616230 - RNA, 14 nt, Homo sapiens
aauagaaguuuucc

SEQ ID NO: 616231 - RNA, 16 nt, Homo sapiens
aauagacaauuugcac

SEQ ID NO: 616232 - RNA, 14 nt, Homo sapiens
aauagacacaucaa

SEQ ID NO: 616233 - RNA, 15 nt, Homo sapiens
aauagacacaucaaa

SEQ ID NO: 616234 - RNA, 19 nt, Homo sapiens
aauagaccuaacugaauac

SEQ ID NO: 616235 - RNA, 17 nt, Homo sapiens
aauagacugagucagau

SEQ ID NO: 616236 - RNA, 19 nt, Homo sapiens
aauagacuuaauacaugca

SEQ ID NO: 616237 - RNA, 22 nt, Homo sapiens
aauagacuucucuuacauuuuc

SEQ ID NO: 616238 - RNA, 22 nt, Homo sapiens
aauagauacaaaugucuaucaa

SEQ ID NO: 616239 - RNA, 10 nt, Homo sapiens
aauagaucuc

SEQ ID NO: 616240 - RNA, 21 nt, Homo sapiens
aauagaucuuuauaaccugau

SEQ ID NO: 616241 - RNA, 14 nt, Homo sapiens
aauagaucuuuuca

SEQ ID NO: 616242 - RNA, 13 nt, Homo sapiens
aauagaugauggu

SEQ ID NO: 616243 - RNA, 18 nt, Homo sapiens
aauagauuguuuugccac

SEQ ID NO: 616244 - RNA, 17 nt, Homo sapiens
aauagcaccccuacuca

SEQ ID NO: 616245 - RNA, 20 nt, Homo sapiens
aauagcauuguaaaagcauu

SEQ ID NO: 616246 - RNA, 18 nt, Homo sapiens
aauagcauuugccacuua

SEQ ID NO: 616247 - RNA, 17 nt, Homo sapiens
aauagccacauuuggaa

SEQ ID NO: 616248 - RNA, 21 nt, Homo sapiens
aauagccuaauacaacaugua

SEQ ID NO: 616249 - RNA, 15 nt, Homo sapiens
aauagccucccugua

SEQ ID NO: 616250 - RNA, 18 nt, Homo sapiens
aauagcuauauccaugua

SEQ ID NO: 616251 - RNA, 15 nt, Homo sapiens
aauagcuauggaauc

SEQ ID NO: 616252 - RNA, 14 nt, Homo sapiens
aauagcucuuucag

SEQ ID NO: 616253 - RNA, 18 nt, Homo sapiens
aauagcuguaguuuuccc

SEQ ID NO: 616254 - RNA, 14 nt, Homo sapiens
aauaggaauaagcu

SEQ ID NO: 616255 - RNA, 14 nt, Homo sapiens
aauaggcaucucca

SEQ ID NO: 616256 - RNA, 20 nt, Homo sapiens
aauaggcggggcacgguggc

SEQ ID NO: 616257 - RNA, 23 nt, Homo sapiens
aauaggcggggcacgguggcuca

SEQ ID NO: 616258 - RNA, 19 nt, Homo sapiens
aauaggcuauuaaaaaagu

SEQ ID NO: 616259 - RNA, 12 nt, Homo sapiens
aauagggagaaa

SEQ ID NO: 616260 - RNA, 16 nt, Homo sapiens
aauaggucaucaugaa

SEQ ID NO: 616261 - RNA, 23 nt, Homo sapiens
aauaguaaaagauaacaagaucu

SEQ ID NO: 616262 - RNA, 14 nt, Homo sapiens
aauaguaaaugcuu

SEQ ID NO: 616263 - RNA, 17 nt, Homo sapiens
aauaguaaugugaugcu

SEQ ID NO: 616264 - RNA, 22 nt, Homo sapiens
aauaguacagacagaaggugcu

SEQ ID NO: 616265 - RNA, 14 nt, Homo sapiens
aauaguaggucucc

SEQ ID NO: 616266 - RNA, 12 nt, Homo sapiens
aauaguauuuau

SEQ ID NO: 616267 - RNA, 13 nt, Homo sapiens
aauagucaauuuc

SEQ ID NO: 616268 - RNA, 14 nt, Homo sapiens
aauagucauuccaa

SEQ ID NO: 616269 - RNA, 21 nt, Homo sapiens
aauagucuaaggccauggcau

SEQ ID NO: 616270 - RNA, 16 nt, Homo sapiens
aauagucuuccacaaa

SEQ ID NO: 616271 - RNA, 14 nt, Homo sapiens
aauagucuucucaa

SEQ ID NO: 616272 - RNA, 21 nt, Homo sapiens
aauagugaauacuuacuauaa

SEQ ID NO: 616273 - RNA, 16 nt, Homo sapiens
aauagugucauccuca

SEQ ID NO: 616274 - RNA, 15 nt, Homo sapiens
aauaguguucugcaa

SEQ ID NO: 616275 - RNA, 22 nt, Homo sapiens
aauaguguuggaaaaugugcaa

SEQ ID NO: 616276 - RNA, 19 nt, Homo sapiens
aauaguuuugauccuaaau

SEQ ID NO: 616277 - RNA, 23 nt, Homo sapiens
aauauaaaacuguacuucacugu

SEQ ID NO: 616278 - RNA, 16 nt, Homo sapiens
aauauaaaaguaaaua

SEQ ID NO: 616279 - RNA, 21 nt, Homo sapiens
aauauaaacugaaaaauguca

SEQ ID NO: 616280 - RNA, 20 nt, Homo sapiens
aauauaaaguugguucacuu

SEQ ID NO: 616281 - RNA, 15 nt, Homo sapiens
aauauaaauucacuu

SEQ ID NO: 616282 - RNA, 14 nt, Homo sapiens
aauauaaauuguac

SEQ ID NO: 616283 - RNA, 16 nt, Homo sapiens
aauauaagaccucugg

SEQ ID NO: 616284 - RNA, 14 nt, Homo sapiens
aauauaagaucuga

SEQ ID NO: 616285 - RNA, 13 nt, Homo sapiens
aauauaagcauaa

SEQ ID NO: 616286 - RNA, 13 nt, Homo sapiens
aauauaauacugu

SEQ ID NO: 616287 - RNA, 15 nt, Homo sapiens
aauauaauacuguau

SEQ ID NO: 616288 - RNA, 12 nt, Homo sapiens
aauauacauuca

SEQ ID NO: 616289 - RNA, 14 nt, Homo sapiens
aauauacauucaaa

SEQ ID NO: 616290 - RNA, 18 nt, Homo sapiens
aauauacauucaaacuua

SEQ ID NO: 616291 - RNA, 22 nt, Homo sapiens
aauauagagggcuuaugauuca

SEQ ID NO: 616292 - RNA, 19 nt, Homo sapiens
aauauagccuuuaaaucau

SEQ ID NO: 616293 - RNA, 15 nt, Homo sapiens
aauauagcuguacaa

SEQ ID NO: 616294 - RNA, 20 nt, Homo sapiens
aauauaggauagacacugga

SEQ ID NO: 616295 - RNA, 21 nt, Homo sapiens
aauauaggauagacacuggac

SEQ ID NO: 616296 - RNA, 19 nt, Homo sapiens
aauauaggcacauuaccau

SEQ ID NO: 616297 - RNA, 17 nt, Homo sapiens
aauauaguuauugcaca

SEQ ID NO: 616298 - RNA, 15 nt, Homo sapiens
aauauauaguccaga

SEQ ID NO: 616299 - RNA, 21 nt, Homo sapiens
aauauauaguggguacaucaa

SEQ ID NO: 616300 - RNA, 13 nt, Homo sapiens
aauauaucuggaa

SEQ ID NO: 616301 - RNA, 15 nt, Homo sapiens
aauauauuaaucagc

SEQ ID NO: 616302 - RNA, 23 nt, Homo sapiens
aauauauuuuaaguaucagaggu

SEQ ID NO: 616303 - RNA, 20 nt, Homo sapiens
aauaucaaauaaaauaucau

SEQ ID NO: 616304 - RNA, 17 nt, Homo sapiens
aauaucaagcagugaaa

SEQ ID NO: 616305 - RNA, 17 nt, Homo sapiens
aauuguagugcaaaaug

SEQ ID NO: 616306 - RNA, 14 nt, Homo sapiens
aauuguauaaguca

SEQ ID NO: 616307 - RNA, 20 nt, Homo sapiens
aauuguauaagucaagcaca

SEQ ID NO: 616308 - RNA, 23 nt, Homo sapiens
aauugucagaucguucauugccu

SEQ ID NO: 616309 - RNA, 21 nt, Homo sapiens
aauugucauugauacaugcau

SEQ ID NO: 616310 - RNA, 21 nt, Homo sapiens
aauugucauuuauaaaaccau

SEQ ID NO: 616311 - RNA, 20 nt, Homo sapiens
aauugucuaaaguuacuacu

SEQ ID NO: 616312 - RNA, 13 nt, Homo sapiens
aauugucuugcaa

SEQ ID NO: 616313 - RNA, 20 nt, Homo sapiens
aauugucuuuguucugugau

SEQ ID NO: 616314 - RNA, 13 nt, Homo sapiens
aauugugacauaa

SEQ ID NO: 616315 - RNA, 19 nt, Homo sapiens
aauugugaucagaccauaa

SEQ ID NO: 616316 - RNA, 23 nt, Homo sapiens
aauugugugugaugugaagccaa

SEQ ID NO: 616317 - RNA, 23 nt, Homo sapiens
aauuguguguuaaugucuucacu

SEQ ID NO: 616318 - RNA, 12 nt, Homo sapiens
aauuguguuucc

SEQ ID NO: 616319 - RNA, 17 nt, Homo sapiens
aauuguuaaacuugcag

SEQ ID NO: 616320 - RNA, 17 nt, Homo sapiens
aauuguucaucgcugcu

SEQ ID NO: 616321 - RNA, 14 nt, Homo sapiens
aauuguucucuuaa

SEQ ID NO: 616322 - RNA, 11 nt, Homo sapiens
aauuguugcua

SEQ ID NO: 616323 - RNA, 21 nt, Homo sapiens
aauuguuucuugacaagcuga

SEQ ID NO: 616324 - RNA, 16 nt, Homo sapiens
aauuguuuguacagua

SEQ ID NO: 616325 - RNA, 17 nt, Homo sapiens
aauuguuuuaccagcuc

SEQ ID NO: 616326 - RNA, 23 nt, Homo sapiens
aauuuaaaaauaagaaaauacau

SEQ ID NO: 616327 - RNA, 16 nt, Homo sapiens
aauuuaaaauaauuau

SEQ ID NO: 616328 - RNA, 16 nt, Homo sapiens
aauuuaaacucugaag

SEQ ID NO: 616329 - RNA, 19 nt, Homo sapiens
aauuuaaagggaaaacccu

SEQ ID NO: 616330 - RNA, 19 nt, Homo sapiens
aauuuaaaggguguacuua

SEQ ID NO: 616331 - RNA, 22 nt, Homo sapiens
aauuuaaauaauagacauacag

SEQ ID NO: 616332 - RNA, 16 nt, Homo sapiens
aauuuaacauguguau

SEQ ID NO: 616333 - RNA, 15 nt, Homo sapiens
aauuuaacugcuuaa

SEQ ID NO: 616334 - RNA, 19 nt, Homo sapiens
aauuuaccugguacuaaac

SEQ ID NO: 616335 - RNA, 19 nt, Homo sapiens
aauuuagacaaagccuuaa

SEQ ID NO: 616336 - RNA, 21 nt, Homo sapiens
aauuuaggaccaauaccuccu

SEQ ID NO: 616337 - RNA, 21 nt, Homo sapiens
aauuuauauuuuuaaagcaag

SEQ ID NO: 616338 - RNA, 14 nt, Homo sapiens
aauuuauccauuca

SEQ ID NO: 616339 - RNA, 22 nt, Homo sapiens
aauuuaucuuuaccaaaaacca

SEQ ID NO: 616340 - RNA, 18 nt, Homo sapiens
aauuuauuaaaaugauug

SEQ ID NO: 616341 - RNA, 19 nt, Homo sapiens
aauuuauuaacuaaucaag

SEQ ID NO: 616342 - RNA, 12 nt, Homo sapiens
aauuuauuacaa

SEQ ID NO: 616343 - RNA, 19 nt, Homo sapiens
aauuuauuacaagcauaac

SEQ ID NO: 616344 - RNA, 17 nt, Homo sapiens
aauuuauuuauauuccg

SEQ ID NO: 616345 - RNA, 22 nt, Homo sapiens
aauuuauuuauuaagauggauu

SEQ ID NO: 616346 - RNA, 15 nt, Homo sapiens
aauuucaaaccacac

SEQ ID NO: 616347 - RNA, 18 nt, Homo sapiens
aauuucaauuucucccuu

SEQ ID NO: 616348 - RNA, 16 nt, Homo sapiens
aauuucacaagcuauu

SEQ ID NO: 616349 - RNA, 23 nt, Homo sapiens
aauuucacauuaauauuugcuga

SEQ ID NO: 616350 - RNA, 20 nt, Homo sapiens
aauuucaccaccaaaugcca

SEQ ID NO: 616351 - RNA, 15 nt, Homo sapiens
aauuucacugaugua

SEQ ID NO: 616352 - RNA, 20 nt, Homo sapiens
aauuucaguaaacaaugaau

SEQ ID NO: 616353 - RNA, 20 nt, Homo sapiens
aauuucauacccaugucaga

SEQ ID NO: 616354 - RNA, 20 nt, Homo sapiens
aauuucauuaucaucaagca

SEQ ID NO: 616355 - RNA, 23 nt, Homo sapiens
aauuucauuuccauuuaagcaau

SEQ ID NO: 616356 - RNA, 12 nt, Homo sapiens
aauuuccagggu

SEQ ID NO: 616357 - RNA, 23 nt, Homo sapiens
aauuuccaggguugcuugaucau

SEQ ID NO: 616358 - RNA, 15 nt, Homo sapiens
aauuuccaguaccuu

SEQ ID NO: 616359 - RNA, 21 nt, Homo sapiens
aauuucccaguuaaagauuau

SEQ ID NO: 616360 - RNA, 19 nt, Homo sapiens
aauuucccccuaaaccaac

SEQ ID NO: 616361 - RNA, 21 nt, Homo sapiens
aauuuccuuuuugacacugaa

SEQ ID NO: 616362 - RNA, 14 nt, Homo sapiens
aauuucgccuuaaa

SEQ ID NO: 616363 - RNA, 19 nt, Homo sapiens
aauuucuaaaaaacagagg

SEQ ID NO: 616364 - RNA, 15 nt, Homo sapiens
aauuucuagacagua

SEQ ID NO: 616365 - RNA, 22 nt, Homo sapiens
aauuucuccaguggauucccag

SEQ ID NO: 616366 - RNA, 23 nt, Homo sapiens
aauuucugaacaccauagguaga

SEQ ID NO: 616367 - RNA, 16 nt, Homo sapiens
aauuucugccauuuca

SEQ ID NO: 616368 - RNA, 17 nt, Homo sapiens
aauuucuggaaaacugc

SEQ ID NO: 616369 - RNA, 17 nt, Homo sapiens
aauuucuuaugugacau

SEQ ID NO: 616370 - RNA, 14 nt, Homo sapiens
aauuugaaauuuag

SEQ ID NO: 616371 - RNA, 18 nt, Homo sapiens
aauuugacaaaacccacu

SEQ ID NO: 616372 - RNA, 12 nt, Homo sapiens
aauuugaugaaa

SEQ ID NO: 616373 - RNA, 15 nt, Homo sapiens
aauuugaugcgaucu

SEQ ID NO: 616374 - RNA, 17 nt, Homo sapiens
aauuugauugcuuugcu

SEQ ID NO: 616375 - RNA, 19 nt, Homo sapiens
aauuugauugcuuugcugc

SEQ ID NO: 616376 - RNA, 12 nt, Homo sapiens
aauuugccugua

SEQ ID NO: 616377 - RNA, 22 nt, Homo sapiens
aauuuggaucuggaucuguuaa

SEQ ID NO: 616378 - RNA, 20 nt, Homo sapiens
aauuuggccuuaagaacugu

SEQ ID NO: 616379 - RNA, 17 nt, Homo sapiens
aauuugggcuuggacca

SEQ ID NO: 616380 - RNA, 17 nt, Homo sapiens
aauuuggggaaauccau

SEQ ID NO: 616381 - RNA, 20 nt, Homo sapiens
aauuugggugagcugcaccu

SEQ ID NO: 616382 - RNA, 21 nt, Homo sapiens
aauuugguaaauuaguauuua

SEQ ID NO: 616383 - RNA, 22 nt, Homo sapiens
aauuuguauaauaaagcuuuca

SEQ ID NO: 616384 - RNA, 16 nt, Homo sapiens
aauuugugccacuuua

SEQ ID NO: 616385 - RNA, 22 nt, Homo sapiens
aauuuguugaacccugccacau

SEQ ID NO: 616386 - RNA, 17 nt, Homo sapiens
aauuuuaaaaaagggag

SEQ ID NO: 616387 - RNA, 18 nt, Homo sapiens
aauuuuaaaaagcagcug

SEQ ID NO: 616388 - RNA, 14 nt, Homo sapiens
aauuuuaaauguuc

SEQ ID NO: 616389 - RNA, 13 nt, Homo sapiens
aauuuuaaccuau

SEQ ID NO: 616390 - RNA, 13 nt, Homo sapiens
aauuuuaauugaa

SEQ ID NO: 616391 - RNA, 13 nt, Homo sapiens
aauuuuacaguaa

SEQ ID NO: 616392 - RNA, 20 nt, Homo sapiens
aauuuuacuccauaaacaga

SEQ ID NO: 616393 - RNA, 13 nt, Homo sapiens
aauuuuacuucca

SEQ ID NO: 616394 - RNA, 19 nt, Homo sapiens
aauuuuagaacaguccagc

SEQ ID NO: 616395 - RNA, 17 nt, Homo sapiens
aauuuuagugugccuuc

SEQ ID NO: 616396 - RNA, 20 nt, Homo sapiens
aauuuuauaacagaauuaaa

SEQ ID NO: 616397 - RNA, 17 nt, Homo sapiens
aauuuuauaugcacagu

SEQ ID NO: 616398 - RNA, 15 nt, Homo sapiens
aauuuuaucaugcca

SEQ ID NO: 616399 - RNA, 22 nt, Homo sapiens
aauuuuauugacacaguaccau

SEQ ID NO: 616400 - RNA, 17 nt, Homo sapiens
aauuuucacuucugucu

SEQ ID NO: 616401 - RNA, 15 nt, Homo sapiens
aauuuucagcauuaa

SEQ ID NO: 616402 - RNA, 15 nt, Homo sapiens
aauuuucaguauaau

SEQ ID NO: 616403 - RNA, 18 nt, Homo sapiens
aauuuucuaaaagcuuuc

SEQ ID NO: 616404 - RNA, 24 nt, Homo sapiens
aauuuucugaucucagagcauuuc

SEQ ID NO: 616405 - RNA, 13 nt, Homo sapiens
aauuuucuuccaa

SEQ ID NO: 616406 - RNA, 20 nt, Homo sapiens
aauuuucuugguucuuucag

SEQ ID NO: 616407 - RNA, 21 nt, Homo sapiens
aauuuugccauaaagucaaau

SEQ ID NO: 616408 - RNA, 14 nt, Homo sapiens
aauuuugggggaaa

SEQ ID NO: 616409 - RNA, 23 nt, Homo sapiens
aauuuuguguguaccugugacua

SEQ ID NO: 616410 - RNA, 18 nt, Homo sapiens
aauuuuuaagcugcaaau

SEQ ID NO: 616411 - RNA, 16 nt, Homo sapiens
aauuuuuagccauuuc

SEQ ID NO: 616412 - RNA, 17 nt, Homo sapiens
aauuuuuccugcauguu

SEQ ID NO: 616413 - RNA, 18 nt, Homo sapiens
aauuuuucugugcucaau

SEQ ID NO: 616414 - RNA, 22 nt, Homo sapiens
aauuuuucugugcucaaugugu

SEQ ID NO: 616415 - RNA, 15 nt, Homo sapiens
aauuuuugucucaga

SEQ ID NO: 616416 - RNA, 16 nt, Homo sapiens
aauuuuuugacuugaa

SEQ ID NO: 616417 - RNA, 17 nt, Homo sapiens
aauuuuuugacuugaag

SEQ ID NO: 616418 - RNA, 16 nt, Homo sapiens
aauuuuuugguacaaa

SEQ ID NO: 616419 - RNA, 18 nt, Homo sapiens
acaaaaaacaacaaauaa

SEQ ID NO: 616420 - RNA, 13 nt, Homo sapiens
acaaaaaaccaca

SEQ ID NO: 616421 - RNA, 13 nt, Homo sapiens
acaaaaaacccaa

SEQ ID NO: 616422 - RNA, 13 nt, Homo sapiens
acaaaaaauacuu

SEQ ID NO: 616423 - RNA, 15 nt, Homo sapiens
acaaaaaauacuuua

SEQ ID NO: 616424 - RNA, 19 nt, Homo sapiens
acaaaaaaugcagaacuua

SEQ ID NO: 616425 - RNA, 22 nt, Homo sapiens
acaaaaacaagcaaugggcaau

SEQ ID NO: 616426 - RNA, 15 nt, Homo sapiens
accuaccacaguguc

SEQ ID NO: 616427 - RNA, 20 nt, Homo sapiens
accuaccaccccuuccuguc

SEQ ID NO: 616428 - RNA, 16 nt, Homo sapiens
accuaccaugcugcuu

SEQ ID NO: 616429 - RNA, 17 nt, Homo sapiens
accuaccuuacuauuua

SEQ ID NO: 616430 - RNA, 19 nt, Homo sapiens
accuacgcacauaccuuca

SEQ ID NO: 616431 - RNA, 14 nt, Homo sapiens
accuacgugccacu

SEQ ID NO: 616432 - RNA, 14 nt, Homo sapiens
accuacugcacuga

SEQ ID NO: 616433 - RNA, 19 nt, Homo sapiens
accuacugcuuacuguugc

SEQ ID NO: 616434 - RNA, 19 nt, Homo sapiens
accuagaaaggaacugcaa

SEQ ID NO: 616435 - RNA, 17 nt, Homo sapiens
accuagaccuaaacggc

SEQ ID NO: 616436 - RNA, 14 nt, Homo sapiens
accuagacuguaaa

SEQ ID NO: 616437 - RNA, 23 nt, Homo sapiens
accuagauugcaccauugcacuc

SEQ ID NO: 616438 - RNA, 16 nt, Homo sapiens
accuagcagccucaaa

SEQ ID NO: 616439 - RNA, 18 nt, Homo sapiens
accuagcagccucaaaac

SEQ ID NO: 616440 - RNA, 17 nt, Homo sapiens
accuagcaggcuguucc

SEQ ID NO: 616441 - RNA, 15 nt, Homo sapiens
accuagccacuuaau

SEQ ID NO: 616442 - RNA, 22 nt, Homo sapiens
accuagcugugcccccucuggu

SEQ ID NO: 616443 - RNA, 11 nt, Homo sapiens
accuagcuuua

SEQ ID NO: 616444 - RNA, 16 nt, Homo sapiens
accuaggccucagcug

SEQ ID NO: 616445 - RNA, 16 nt, Homo sapiens
accuaguagaguguaa

SEQ ID NO: 616446 - RNA, 19 nt, Homo sapiens
accuaguccccagccugcu

SEQ ID NO: 616447 - RNA, 14 nt, Homo sapiens
accuaguuugcacu

SEQ ID NO: 616448 - RNA, 15 nt, Homo sapiens
accuaguuugcacua

SEQ ID NO: 616449 - RNA, 14 nt, Homo sapiens
accuauacauuaua

SEQ ID NO: 616450 - RNA, 12 nt, Homo sapiens
accuauaccaau

SEQ ID NO: 616451 - RNA, 14 nt, Homo sapiens
accuauaccaauau

SEQ ID NO: 616452 - RNA, 12 nt, Homo sapiens
accuauacugaa

SEQ ID NO: 616453 - RNA, 14 nt, Homo sapiens
accuauauugauuu

SEQ ID NO: 616454 - RNA, 14 nt, Homo sapiens
accuaucucaggga

SEQ ID NO: 616455 - RNA, 16 nt, Homo sapiens
accuaugcaaagauga

SEQ ID NO: 616456 - RNA, 21 nt, Homo sapiens
accuaugucagacacuacaug

SEQ ID NO: 616457 - RNA, 19 nt, Homo sapiens
accuauuuccagaaauaca

SEQ ID NO: 616458 - RNA, 15 nt, Homo sapiens
accuauuucugauga

SEQ ID NO: 616459 - RNA, 17 nt, Homo sapiens
accuauuugacuuacca

SEQ ID NO: 616460 - RNA, 21 nt, Homo sapiens
accuauuuuugaaggcauaaa

SEQ ID NO: 616461 - RNA, 15 nt, Homo sapiens
accuauuuuuuucuc

SEQ ID NO: 616462 - RNA, 12 nt, Homo sapiens
accucaaaaagu

SEQ ID NO: 616463 - RNA, 19 nt, Homo sapiens
accucaaaggcucucacua

SEQ ID NO: 616464 - RNA, 13 nt, Homo sapiens
accucaccaagga

SEQ ID NO: 616465 - RNA, 16 nt, Homo sapiens
accucaccaguuucca

SEQ ID NO: 616466 - RNA, 17 nt, Homo sapiens
accucacgacuggucac

SEQ ID NO: 616467 - RNA, 17 nt, Homo sapiens
accucacgcucuggaca

SEQ ID NO: 616468 - RNA, 22 nt, Homo sapiens
accucacuuuaggcagcuguaa

SEQ ID NO: 616469 - RNA, 16 nt, Homo sapiens
accucagaaagucacc

SEQ ID NO: 616470 - RNA, 16 nt, Homo sapiens
accucaggcagcucaa

SEQ ID NO: 616471 - RNA, 20 nt, Homo sapiens
accucaggugagaagcagag

SEQ ID NO: 616472 - RNA, 18 nt, Homo sapiens
accucaguuauuacaugu

SEQ ID NO: 616473 - RNA, 15 nt, Homo sapiens
accucaucucuacua

SEQ ID NO: 616474 - RNA, 12 nt, Homo sapiens
accucaucuuuc

SEQ ID NO: 616475 - RNA, 14 nt, Homo sapiens
accucaugccaugg

SEQ ID NO: 616476 - RNA, 12 nt, Homo sapiens
accuccaaagcu

SEQ ID NO: 616477 - RNA, 19 nt, Homo sapiens
accuccaacccugccguca

SEQ ID NO: 616478 - RNA, 20 nt, Homo sapiens
accuccaaggaccucucuca

SEQ ID NO: 616479 - RNA, 12 nt, Homo sapiens
accuccacaccc

SEQ ID NO: 616480 - RNA, 20 nt, Homo sapiens
accuccaccacaucugccag

SEQ ID NO: 616481 - RNA, 18 nt, Homo sapiens
accuccagugucaggguc

SEQ ID NO: 616482 - RNA, 13 nt, Homo sapiens
accuccauuuccc

SEQ ID NO: 616483 - RNA, 19 nt, Homo sapiens
accuccauuucccaaaguc

SEQ ID NO: 616484 - RNA, 12 nt, Homo sapiens
accucccaguga

SEQ ID NO: 616485 - RNA, 20 nt, Homo sapiens
accucccgcccucaccugca

SEQ ID NO: 616486 - RNA, 15 nt, Homo sapiens
accucccuaccaaaa

SEQ ID NO: 616487 - RNA, 21 nt, Homo sapiens
accucccuaccaaaaauugcc

SEQ ID NO: 616488 - RNA, 14 nt, Homo sapiens
accucccuccucag

SEQ ID NO: 616489 - RNA, 11 nt, Homo sapiens
accucccugac

SEQ ID NO: 616490 - RNA, 20 nt, Homo sapiens
accucccugcucagugcuug

SEQ ID NO: 616491 - RNA, 23 nt, Homo sapiens
accuccuauccuuggagagcagc

SEQ ID NO: 616492 - RNA, 11 nt, Homo sapiens
accuccucaug

SEQ ID NO: 616493 - RNA, 19 nt, Homo sapiens
accuccucccuaaugcuca

SEQ ID NO: 616494 - RNA, 13 nt, Homo sapiens
accuccucuccac

SEQ ID NO: 616495 - RNA, 11 nt, Homo sapiens
accuccuguca

SEQ ID NO: 616496 - RNA, 18 nt, Homo sapiens
accuccuuuucucuuuca

SEQ ID NO: 616497 - RNA, 19 nt, Homo sapiens
accucgagcagaugaugcc

SEQ ID NO: 616498 - RNA, 20 nt, Homo sapiens
accucgcucgaugacuguga

SEQ ID NO: 616499 - RNA, 15 nt, Homo sapiens
accucggagggaugg

SEQ ID NO: 616500 - RNA, 19 nt, Homo sapiens
accucggcacacacugugc

SEQ ID NO: 616501 - RNA, 22 nt, Homo sapiens
accucgggaaacuuagaucauc

SEQ ID NO: 616502 - RNA, 13 nt, Homo sapiens
accucuacugucu

SEQ ID NO: 616503 - RNA, 16 nt, Homo sapiens
accucugacacauuag

SEQ ID NO: 616504 - RNA, 23 nt, Homo sapiens
accucugacgcaccacugccaau

SEQ ID NO: 616505 - RNA, 14 nt, Homo sapiens
accucugagcacau

SEQ ID NO: 616506 - RNA, 13 nt, Homo sapiens
accucugcucuga

SEQ ID NO: 616507 - RNA, 21 nt, Homo sapiens
accucugcucugaggcuucca

SEQ ID NO: 616508 - RNA, 22 nt, Homo sapiens
accucuggccaaauaugcacuu

SEQ ID NO: 616509 - RNA, 15 nt, Homo sapiens
accucuggugauggu

SEQ ID NO: 616510 - RNA, 19 nt, Homo sapiens
accucuguauagaaaucua

SEQ ID NO: 616511 - RNA, 14 nt, Homo sapiens
accucuucucuucc

SEQ ID NO: 616512 - RNA, 15 nt, Homo sapiens
accucuuucaggguu

SEQ ID NO: 616513 - RNA, 21 nt, Homo sapiens
accucuuuuguuguccuugcc

SEQ ID NO: 616514 - RNA, 21 nt, Homo sapiens
accucuuuuuucuaucugcca

SEQ ID NO: 616515 - RNA, 20 nt, Homo sapiens
accugaaaaaaaguuuacaa

SEQ ID NO: 616516 - RNA, 18 nt, Homo sapiens
accugaaaacacugugca

SEQ ID NO: 616517 - RNA, 18 nt, Homo sapiens
accugaaagaagcccagg

SEQ ID NO: 616518 - RNA, 22 nt, Homo sapiens
accugaaauaaaauucauuagu

SEQ ID NO: 616519 - RNA, 21 nt, Homo sapiens
accugaacacaucgugaugau

SEQ ID NO: 616520 - RNA, 16 nt, Homo sapiens
accugaagacugagga

SEQ ID NO: 616521 - RNA, 15 nt, Homo sapiens
accugaaugucccaa

SEQ ID NO: 616522 - RNA, 18 nt, Homo sapiens
accugaccccagugaaug

SEQ ID NO: 616523 - RNA, 22 nt, Homo sapiens
accugaccucuugcugccagcu

SEQ ID NO: 616524 - RNA, 21 nt, Homo sapiens
accugacggcuggggacccac

SEQ ID NO: 616525 - RNA, 23 nt, Homo sapiens
accugagggggcccaucccugcc

SEQ ID NO: 616526 - RNA, 18 nt, Homo sapiens
accugaguacccauggga

SEQ ID NO: 616527 - RNA, 22 nt, Homo sapiens
accugauggaaguaaagccuca

SEQ ID NO: 616528 - RNA, 21 nt, Homo sapiens
accugauguaccugaugcuau

SEQ ID NO: 616529 - RNA, 13 nt, Homo sapiens
accugauuuacua

SEQ ID NO: 616530 - RNA, 15 nt, Homo sapiens
accugcacaccuacg

SEQ ID NO: 616531 - RNA, 17 nt, Homo sapiens
accugcagcccauggug

SEQ ID NO: 616532 - RNA, 13 nt, Homo sapiens
accugcaguuccu

SEQ ID NO: 616533 - RNA, 21 nt, Homo sapiens
accugccagccgguucugcua

SEQ ID NO: 616534 - RNA, 19 nt, Homo sapiens
accugccaggcaggggugg

SEQ ID NO: 616535 - RNA, 16 nt, Homo sapiens
accugccccugccuga

SEQ ID NO: 616536 - RNA, 16 nt, Homo sapiens
accugcccugggccac

SEQ ID NO: 616537 - RNA, 18 nt, Homo sapiens
accugccucugaccccag

SEQ ID NO: 616538 - RNA, 16 nt, Homo sapiens
accugcgucauuucag

SEQ ID NO: 616539 - RNA, 14 nt, Homo sapiens
accugcucacaggg

SEQ ID NO: 616540 - RNA, 19 nt, Homo sapiens
accugcucuccucuugcca

SEQ ID NO: 616541 - RNA, 15 nt, Homo sapiens
accugcucucuccuc

SEQ ID NO: 616542 - RNA, 16 nt, Homo sapiens
accugcugaagggcag

SEQ ID NO: 616543 - RNA, 23 nt, Homo sapiens
accugcugcagggacagcccuga

SEQ ID NO: 616544 - RNA, 21 nt, Homo sapiens
accugcugcguccccacuccc

SEQ ID NO: 616545 - RNA, 14 nt, Homo sapiens
accugcugugauac

SEQ ID NO: 616546 - RNA, 14 nt, Homo sapiens
accugcugugauga

SEQ ID NO: 616547 - RNA, 15 nt, Homo sapiens
accugcuuccuucag

SEQ ID NO: 616548 - RNA, 14 nt, Homo sapiens
accuggaauguguc

SEQ ID NO: 616549 - RNA, 15 nt, Homo sapiens
acucagcucuuggcu

SEQ ID NO: 616550 - RNA, 18 nt, Homo sapiens
acucagcucuuggcucca

SEQ ID NO: 616551 - RNA, 17 nt, Homo sapiens
acucagcuguccugcag

SEQ ID NO: 616552 - RNA, 13 nt, Homo sapiens
acucaggacaucc

SEQ ID NO: 616553 - RNA, 16 nt, Homo sapiens
acucaggccacagugg

SEQ ID NO: 616554 - RNA, 18 nt, Homo sapiens
acucagggacagagccau

SEQ ID NO: 616555 - RNA, 17 nt, Homo sapiens
acucagggagcauuuaa

SEQ ID NO: 616556 - RNA, 18 nt, Homo sapiens
acucaguccacuguugag

SEQ ID NO: 616557 - RNA, 16 nt, Homo sapiens
acucagugauacucau

SEQ ID NO: 616558 - RNA, 22 nt, Homo sapiens
acucagugauacucaugaccau

SEQ ID NO: 616559 - RNA, 13 nt, Homo sapiens
acucagugcaaac

SEQ ID NO: 616560 - RNA, 20 nt, Homo sapiens
acucaucaccccucuucccc

SEQ ID NO: 616561 - RNA, 13 nt, Homo sapiens
acucaucagagca

SEQ ID NO: 616562 - RNA, 18 nt, Homo sapiens
acucaucuuagugccuga

SEQ ID NO: 616563 - RNA, 20 nt, Homo sapiens
acucaucuuagugccugaga

SEQ ID NO: 616564 - RNA, 15 nt, Homo sapiens
acucaugaagcauac

SEQ ID NO: 616565 - RNA, 15 nt, Homo sapiens
acucaugaaugaaaa

SEQ ID NO: 616566 - RNA, 15 nt, Homo sapiens
acucaugaucaagau

SEQ ID NO: 616567 - RNA, 12 nt, Homo sapiens
acucaugaucuu

SEQ ID NO: 616568 - RNA, 21 nt, Homo sapiens
acucaugcugguggcauuguu

SEQ ID NO: 616569 - RNA, 18 nt, Homo sapiens
acucaugguguguuacac

SEQ ID NO: 616570 - RNA, 17 nt, Homo sapiens
acucauguggacuggga

SEQ ID NO: 616571 - RNA, 19 nt, Homo sapiens
acucauuagugacuucaaa

SEQ ID NO: 616572 - RNA, 15 nt, Homo sapiens
acucauuaucacagu

SEQ ID NO: 616573 - RNA, 13 nt, Homo sapiens
acucauugcugag

SEQ ID NO: 616574 - RNA, 15 nt, Homo sapiens
acucauuuaucuccu

SEQ ID NO: 616575 - RNA, 16 nt, Homo sapiens
acucauuucaucucau

SEQ ID NO: 616576 - RNA, 16 nt, Homo sapiens
acuccaaaauguuggu

SEQ ID NO: 616577 - RNA, 20 nt, Homo sapiens
acuccaccaucacucacuca

SEQ ID NO: 616578 - RNA, 19 nt, Homo sapiens
acuccaccuuggaccucag

SEQ ID NO: 616579 - RNA, 20 nt, Homo sapiens
acuccaccuuggaccucagu

SEQ ID NO: 616580 - RNA, 17 nt, Homo sapiens
acuccacuccacacucu

SEQ ID NO: 616581 - RNA, 12 nt, Homo sapiens
acuccagccaaa

SEQ ID NO: 616582 - RNA, 13 nt, Homo sapiens
acuccagccaaag

SEQ ID NO: 616583 - RNA, 18 nt, Homo sapiens
acuccagccugggugaca

SEQ ID NO: 616584 - RNA, 22 nt, Homo sapiens
acuccagcuugggcaacagagc

SEQ ID NO: 616585 - RNA, 18 nt, Homo sapiens
acuccaggcccaaggcuc

SEQ ID NO: 616586 - RNA, 21 nt, Homo sapiens
acuccagucuggcaacagagc

SEQ ID NO: 616587 - RNA, 19 nt, Homo sapiens
acuccagugcccaccagcc

SEQ ID NO: 616588 - RNA, 23 nt, Homo sapiens
acuccagugcccaucagccuugu

SEQ ID NO: 616589 - RNA, 13 nt, Homo sapiens
acuccagugguga

SEQ ID NO: 616590 - RNA, 14 nt, Homo sapiens
acuccaucauucau

SEQ ID NO: 616591 - RNA, 15 nt, Homo sapiens
acuccaucgccaucu

SEQ ID NO: 616592 - RNA, 18 nt, Homo sapiens
acuccaucgugugugccu

SEQ ID NO: 616593 - RNA, 11 nt, Homo sapiens
acuccaucucu

SEQ ID NO: 616594 - RNA, 17 nt, Homo sapiens
acuccaucucuacugaa

SEQ ID NO: 616595 - RNA, 14 nt, Homo sapiens
acuccaucucuuaa

SEQ ID NO: 616596 - RNA, 12 nt, Homo sapiens
acuccaugagaa

SEQ ID NO: 616597 - RNA, 19 nt, Homo sapiens
acuccaugcuuagucacug

SEQ ID NO: 616598 - RNA, 20 nt, Homo sapiens
acucccacgccuguccuccu

SEQ ID NO: 616599 - RNA, 21 nt, Homo sapiens
acucccagauggcucuuucua

SEQ ID NO: 616600 - RNA, 14 nt, Homo sapiens
acucccagcacuuu

SEQ ID NO: 616601 - RNA, 17 nt, Homo sapiens
acuccccagagcugugc

SEQ ID NO: 616602 - RNA, 17 nt, Homo sapiens
acucccccaaccaagga

SEQ ID NO: 616603 - RNA, 14 nt, Homo sapiens
acucccccacccau

SEQ ID NO: 616604 - RNA, 17 nt, Homo sapiens
acuccccuuucuuccaa

SEQ ID NO: 616605 - RNA, 14 nt, Homo sapiens
acucccgaccucag

SEQ ID NO: 616606 - RNA, 16 nt, Homo sapiens
acucccuccaccagcc

SEQ ID NO: 616607 - RNA, 20 nt, Homo sapiens
acucccuccucaccucugga

SEQ ID NO: 616608 - RNA, 14 nt, Homo sapiens
acucccucuuccaa

SEQ ID NO: 616609 - RNA, 13 nt, Homo sapiens
acucccugccuac

SEQ ID NO: 616610 - RNA, 22 nt, Homo sapiens
acucccugccuacacacacagc

SEQ ID NO: 616611 - RNA, 19 nt, Homo sapiens
acucccugcugugugacuu

SEQ ID NO: 616612 - RNA, 17 nt, Homo sapiens
acucccuugguggcaag

SEQ ID NO: 616613 - RNA, 20 nt, Homo sapiens
acuccgagagcaugcuuaau

SEQ ID NO: 616614 - RNA, 13 nt, Homo sapiens
acuccgugugccu

SEQ ID NO: 616615 - RNA, 15 nt, Homo sapiens
acuccguuccuggca

SEQ ID NO: 616616 - RNA, 23 nt, Homo sapiens
acuccuagauuuuguugaccuca

SEQ ID NO: 616617 - RNA, 14 nt, Homo sapiens
acuccuagcugacu

SEQ ID NO: 616618 - RNA, 22 nt, Homo sapiens
acuccucaaaagcaaaugagau

SEQ ID NO: 616619 - RNA, 22 nt, Homo sapiens
acuccuccagccaccacccaca

SEQ ID NO: 616620 - RNA, 18 nt, Homo sapiens
acuccucucaacugccuc

SEQ ID NO: 616621 - RNA, 20 nt, Homo sapiens
acuccucuccgcaguuccug

SEQ ID NO: 616622 - RNA, 19 nt, Homo sapiens
acuccucuccuucaaagaa

SEQ ID NO: 616623 - RNA, 20 nt, Homo sapiens
acuccugaagggaaggcaaa

SEQ ID NO: 616624 - RNA, 13 nt, Homo sapiens
acuccugcaaaau

SEQ ID NO: 616625 - RNA, 12 nt, Homo sapiens
acuccuucagga

SEQ ID NO: 616626 - RNA, 22 nt, Homo sapiens
acuccuuccuucaggacucugc

SEQ ID NO: 616627 - RNA, 23 nt, Homo sapiens
acuccuuucucuaaaacugccuu

SEQ ID NO: 616628 - RNA, 19 nt, Homo sapiens
acuccuuuuccacuuuaaa

SEQ ID NO: 616629 - RNA, 13 nt, Homo sapiens
acucgaugcacug

SEQ ID NO: 616630 - RNA, 17 nt, Homo sapiens
acucgcacaaccaugac

SEQ ID NO: 616631 - RNA, 17 nt, Homo sapiens
acucgcaggaccaaggg

SEQ ID NO: 616632 - RNA, 21 nt, Homo sapiens
acucgcuugagaugggaaagc

SEQ ID NO: 616633 - RNA, 14 nt, Homo sapiens
acucgggggugcug

SEQ ID NO: 616634 - RNA, 21 nt, Homo sapiens
acucuaaagaaaaaugccugu

SEQ ID NO: 616635 - RNA, 21 nt, Homo sapiens
acucuaaucaguccuuauuau

SEQ ID NO: 616636 - RNA, 14 nt, Homo sapiens
acucuacuaaugcc

SEQ ID NO: 616637 - RNA, 17 nt, Homo sapiens
acucuacucaacccauu

SEQ ID NO: 616638 - RNA, 21 nt, Homo sapiens
acucuaggggucaggcuccau

SEQ ID NO: 616639 - RNA, 15 nt, Homo sapiens
acucuaggguccagu

SEQ ID NO: 616640 - RNA, 20 nt, Homo sapiens
acucuaggguccaguggaug

SEQ ID NO: 616641 - RNA, 19 nt, Homo sapiens
acucuauacuuaaucucac

SEQ ID NO: 616642 - RNA, 21 nt, Homo sapiens
acucuauacuuaaucucacau

SEQ ID NO: 616643 - RNA, 15 nt, Homo sapiens
acucuauuguuaccu

SEQ ID NO: 616644 - RNA, 14 nt, Homo sapiens
acucucacaugugg

SEQ ID NO: 616645 - RNA, 15 nt, Homo sapiens
acucucaccuuccaa

SEQ ID NO: 616646 - RNA, 18 nt, Homo sapiens
acucucacuccacccaga

SEQ ID NO: 616647 - RNA, 23 nt, Homo sapiens
acucucauuccccagguggcuga

SEQ ID NO: 616648 - RNA, 13 nt, Homo sapiens
acucuccaaauag

SEQ ID NO: 616649 - RNA, 16 nt, Homo sapiens
acucuccaauguucua

SEQ ID NO: 616650 - RNA, 13 nt, Homo sapiens
acucuccugccuc

SEQ ID NO: 616651 - RNA, 15 nt, Homo sapiens
acucucucacccacc

SEQ ID NO: 616652 - RNA, 19 nt, Homo sapiens
acucucucccuggucucug

SEQ ID NO: 616653 - RNA, 12 nt, Homo sapiens
acucucuugcac

SEQ ID NO: 616654 - RNA, 22 nt, Homo sapiens
acucucuuuguaaaaauuuugu

SEQ ID NO: 616655 - RNA, 14 nt, Homo sapiens
acucugaaagaccu

SEQ ID NO: 616656 - RNA, 18 nt, Homo sapiens
acucugaaaucucagaau

SEQ ID NO: 616657 - RNA, 11 nt, Homo sapiens
acucugaagac

SEQ ID NO: 616658 - RNA, 17 nt, Homo sapiens
acucugagaucuaagga

SEQ ID NO: 616659 - RNA, 15 nt, Homo sapiens
acucugcacuacucc

SEQ ID NO: 616660 - RNA, 19 nt, Homo sapiens
acucugccagccacaucca

SEQ ID NO: 616661 - RNA, 14 nt, Homo sapiens
acucugccauuaaa

SEQ ID NO: 616662 - RNA, 22 nt, Homo sapiens
acucugcccagaccacacguag

SEQ ID NO: 616663 - RNA, 19 nt, Homo sapiens
acucugccuacagaacuuc

SEQ ID NO: 616664 - RNA, 17 nt, Homo sapiens
acucugccucuguauau

SEQ ID NO: 616665 - RNA, 19 nt, Homo sapiens
acucugcggauagcauuug

SEQ ID NO: 616666 - RNA, 16 nt, Homo sapiens
acucugcggcccgggc

SEQ ID NO: 616667 - RNA, 23 nt, Homo sapiens
acucuggccaggaacucuaaggu

SEQ ID NO: 616668 - RNA, 16 nt, Homo sapiens
acucuggccuccaaaa

SEQ ID NO: 616669 - RNA, 19 nt, Homo sapiens
acucuggcugcucccugac

SEQ ID NO: 616670 - RNA, 19 nt, Homo sapiens
acucugggcugccauguga

SEQ ID NO: 616671 - RNA, 16 nt, Homo sapiens
acuucucuugccuuaa

SEQ ID NO: 616672 - RNA, 19 nt, Homo sapiens
acuucugaaaccucugggu

SEQ ID NO: 616673 - RNA, 17 nt, Homo sapiens
acuucugaccacacuuc

SEQ ID NO: 616674 - RNA, 16 nt, Homo sapiens
acuucugccucuaagc

SEQ ID NO: 616675 - RNA, 13 nt, Homo sapiens
acuucugcucugg

SEQ ID NO: 616676 - RNA, 12 nt, Homo sapiens
acuucuggauau

SEQ ID NO: 616677 - RNA, 17 nt, Homo sapiens
acuucugggcucugcca

SEQ ID NO: 616678 - RNA, 16 nt, Homo sapiens
acuucuguaugcauca

SEQ ID NO: 616679 - RNA, 22 nt, Homo sapiens
acuucugucuguugaggcauca

SEQ ID NO: 616680 - RNA, 12 nt, Homo sapiens
acuucuguuacu

SEQ ID NO: 616681 - RNA, 23 nt, Homo sapiens
acuucuuaaaaguugugauucca

SEQ ID NO: 616682 - RNA, 19 nt, Homo sapiens
acuucuuauacauuugaua

SEQ ID NO: 616683 - RNA, 13 nt, Homo sapiens
acuucuuccuuuc

SEQ ID NO: 616684 - RNA, 17 nt, Homo sapiens
acuucuugcuucaguca

SEQ ID NO: 616685 - RNA, 19 nt, Homo sapiens
acuugaaaagaaaaccaca

SEQ ID NO: 616686 - RNA, 13 nt, Homo sapiens
acuugaaaccugg

SEQ ID NO: 616687 - RNA, 23 nt, Homo sapiens
acuugaaaccugggcaugguggc

SEQ ID NO: 616688 - RNA, 21 nt, Homo sapiens
acuugaaagaaauggugaaug

SEQ ID NO: 616689 - RNA, 17 nt, Homo sapiens
acuugaaauaccaguga

SEQ ID NO: 616690 - RNA, 13 nt, Homo sapiens
acuugaagcacuu

SEQ ID NO: 616691 - RNA, 16 nt, Homo sapiens
acuugaauauguagcu

SEQ ID NO: 616692 - RNA, 16 nt, Homo sapiens
acuugaaugguuaaua

SEQ ID NO: 616693 - RNA, 13 nt, Homo sapiens
acuugaauuucaa

SEQ ID NO: 616694 - RNA, 12 nt, Homo sapiens
acuugaccaaua

SEQ ID NO: 616695 - RNA, 15 nt, Homo sapiens
acuugaccucuguga

SEQ ID NO: 616696 - RNA, 22 nt, Homo sapiens
acuugacugggugagacccaaa

SEQ ID NO: 616697 - RNA, 13 nt, Homo sapiens
acuugagaaaaua

SEQ ID NO: 616698 - RNA, 14 nt, Homo sapiens
acuugagauguaug

SEQ ID NO: 616699 - RNA, 15 nt, Homo sapiens
acuugaggccaguga

SEQ ID NO: 616700 - RNA, 20 nt, Homo sapiens
acuugaguaaaucuaaagaa

SEQ ID NO: 616701 - RNA, 19 nt, Homo sapiens
acuugaucgugcagcugcu

SEQ ID NO: 616702 - RNA, 19 nt, Homo sapiens
acuugcaacuaaggacaaa

SEQ ID NO: 616703 - RNA, 14 nt, Homo sapiens
acuugcaagccuca

SEQ ID NO: 616704 - RNA, 20 nt, Homo sapiens
acuugcaauaaaguuauuca

SEQ ID NO: 616705 - RNA, 10 nt, Homo sapiens
acuugcacug

SEQ ID NO: 616706 - RNA, 19 nt, Homo sapiens
acuugcagaggagcccagu

SEQ ID NO: 616707 - RNA, 14 nt, Homo sapiens
acuugcaucacuua

SEQ ID NO: 616708 - RNA, 12 nt, Homo sapiens
acuugccaagaa

SEQ ID NO: 616709 - RNA, 15 nt, Homo sapiens
acuugccacauggug

SEQ ID NO: 616710 - RNA, 15 nt, Homo sapiens
acuugccaugcagga

SEQ ID NO: 616711 - RNA, 14 nt, Homo sapiens
acuugccauugcca

SEQ ID NO: 616712 - RNA, 14 nt, Homo sapiens
acuugccucugcac

SEQ ID NO: 616713 - RNA, 21 nt, Homo sapiens
acuugccugugcuacaauuca

SEQ ID NO: 616714 - RNA, 14 nt, Homo sapiens
acuugccuucugau

SEQ ID NO: 616715 - RNA, 14 nt, Homo sapiens
acuugcguccugca

SEQ ID NO: 616716 - RNA, 23 nt, Homo sapiens
acuugcguggacagucaggguuc

SEQ ID NO: 616717 - RNA, 19 nt, Homo sapiens
acuugcuaaagcacuuugc

SEQ ID NO: 616718 - RNA, 23 nt, Homo sapiens
acuugcugcugagugcaccacuu

SEQ ID NO: 616719 - RNA, 22 nt, Homo sapiens
acuugcugugugaccucaggcc

SEQ ID NO: 616720 - RNA, 16 nt, Homo sapiens
acuugcuucucuagcu

SEQ ID NO: 616721 - RNA, 16 nt, Homo sapiens
acuugcuuuaugccuu

SEQ ID NO: 616722 - RNA, 19 nt, Homo sapiens
acuuggaguaaaacuguau

SEQ ID NO: 616723 - RNA, 14 nt, Homo sapiens
acuuggcacuccug

SEQ ID NO: 616724 - RNA, 19 nt, Homo sapiens
acuuggcuggggaggacca

SEQ ID NO: 616725 - RNA, 21 nt, Homo sapiens
acuugggagcugcugggcuag

SEQ ID NO: 616726 - RNA, 22 nt, Homo sapiens
acuugggggaggaggaacaaau

SEQ ID NO: 616727 - RNA, 19 nt, Homo sapiens
acuugggggccauccugcc

SEQ ID NO: 616728 - RNA, 21 nt, Homo sapiens
acuugguaagaugacucugag

SEQ ID NO: 616729 - RNA, 22 nt, Homo sapiens
acuugguaagaugacucugaga

SEQ ID NO: 616730 - RNA, 16 nt, Homo sapiens
acuuguauugcuaaaa

SEQ ID NO: 616731 - RNA, 16 nt, Homo sapiens
acuugucacccaaagc

SEQ ID NO: 616732 - RNA, 18 nt, Homo sapiens
acuugucauagacuccuu

SEQ ID NO: 616733 - RNA, 14 nt, Homo sapiens
acuugucauaucac

SEQ ID NO: 616734 - RNA, 18 nt, Homo sapiens
acuuguccuuuuguacca

SEQ ID NO: 616735 - RNA, 11 nt, Homo sapiens
acuugugcacu

SEQ ID NO: 616736 - RNA, 13 nt, Homo sapiens
acuuguguuacuu

SEQ ID NO: 616737 - RNA, 19 nt, Homo sapiens
acuuguguuauauagccaa

SEQ ID NO: 616738 - RNA, 18 nt, Homo sapiens
acuuguucuguacuugua

SEQ ID NO: 616739 - RNA, 17 nt, Homo sapiens
acuuguuugucuuccau

SEQ ID NO: 616740 - RNA, 15 nt, Homo sapiens
acuuguuuuaugcuc

SEQ ID NO: 616741 - RNA, 19 nt, Homo sapiens
acuuuaaaacuguauuuaa

SEQ ID NO: 616742 - RNA, 14 nt, Homo sapiens
acuuuaacagucua

SEQ ID NO: 616743 - RNA, 12 nt, Homo sapiens
acuuuaaccaau

SEQ ID NO: 616744 - RNA, 15 nt, Homo sapiens
acuuuaacucaggag

SEQ ID NO: 616745 - RNA, 16 nt, Homo sapiens
acuuuaacugacuuaa

SEQ ID NO: 616746 - RNA, 22 nt, Homo sapiens
acuuuaagaacaaacucugaaa

SEQ ID NO: 616747 - RNA, 22 nt, Homo sapiens
acuuuaaggaagggauacauga

SEQ ID NO: 616748 - RNA, 20 nt, Homo sapiens
acuuuaaggugaaugaaaga

SEQ ID NO: 616749 - RNA, 15 nt, Homo sapiens
acuuuaagugaaaga

SEQ ID NO: 616750 - RNA, 22 nt, Homo sapiens
acuuuaauccuuccacuaucau

SEQ ID NO: 616751 - RNA, 17 nt, Homo sapiens
acuuuaauucucuuacu

SEQ ID NO: 616752 - RNA, 22 nt, Homo sapiens
acuuuaauugaagaacugcacu

SEQ ID NO: 616753 - RNA, 14 nt, Homo sapiens
acuuuacaaaccau

SEQ ID NO: 616754 - RNA, 13 nt, Homo sapiens
acuuuaccaugcu

SEQ ID NO: 616755 - RNA, 16 nt, Homo sapiens
acuuuaccaugcucaa

SEQ ID NO: 616756 - RNA, 17 nt, Homo sapiens
acuuuaccaugcucaau

SEQ ID NO: 616757 - RNA, 13 nt, Homo sapiens
acuuuaccugaaa

SEQ ID NO: 616758 - RNA, 12 nt, Homo sapiens
acuuuaccuuuu

SEQ ID NO: 616759 - RNA, 13 nt, Homo sapiens
acuuuagacauuu

SEQ ID NO: 616760 - RNA, 14 nt, Homo sapiens
acuuuagaugcuga

SEQ ID NO: 616761 - RNA, 12 nt, Homo sapiens
acuuuagugaaa

SEQ ID NO: 616762 - RNA, 17 nt, Homo sapiens
acuuuauauaaggcauu

SEQ ID NO: 616763 - RNA, 15 nt, Homo sapiens
acuuuaucauaugcu

SEQ ID NO: 616764 - RNA, 16 nt, Homo sapiens
acuuuaugaugcuaug

SEQ ID NO: 616765 - RNA, 17 nt, Homo sapiens
acuuuauuuaaaugcau

SEQ ID NO: 616766 - RNA, 20 nt, Homo sapiens
acuuuauuuauacacugucu

SEQ ID NO: 616767 - RNA, 22 nt, Homo sapiens
acuuuauuucugaucuauacaa

SEQ ID NO: 616768 - RNA, 14 nt, Homo sapiens
acuuuauuuugcuu

SEQ ID NO: 616769 - RNA, 15 nt, Homo sapiens
acuuucaaacauaua

SEQ ID NO: 616770 - RNA, 17 nt, Homo sapiens
acuuucaaccuugccag

SEQ ID NO: 616771 - RNA, 16 nt, Homo sapiens
acuuucacacuaagaa

SEQ ID NO: 616772 - RNA, 14 nt, Homo sapiens
acuuucagugcuuu

SEQ ID NO: 616773 - RNA, 21 nt, Homo sapiens
acuuucauccugguuuccacu

SEQ ID NO: 616774 - RNA, 13 nt, Homo sapiens
acuuucaucuuaa

SEQ ID NO: 616775 - RNA, 14 nt, Homo sapiens
acuuuccaaaaccu

SEQ ID NO: 616776 - RNA, 22 nt, Homo sapiens
acuuuccauagggccuccuuag

SEQ ID NO: 616777 - RNA, 18 nt, Homo sapiens
acuuuccaucccaaaggc

SEQ ID NO: 616778 - RNA, 23 nt, Homo sapiens
acuuucccagaaaaaaaaaaacu

SEQ ID NO: 616779 - RNA, 20 nt, Homo sapiens
acuuucccuagaaagccaua

SEQ ID NO: 616780 - RNA, 14 nt, Homo sapiens
acuuucugauuacu

SEQ ID NO: 616781 - RNA, 20 nt, Homo sapiens
acuuucugauuggugauuca

SEQ ID NO: 616782 - RNA, 21 nt, Homo sapiens
acuuucuguguugaagcacug

SEQ ID NO: 616783 - RNA, 17 nt, Homo sapiens
acuuugaaaacaauuca

SEQ ID NO: 616784 - RNA, 13 nt, Homo sapiens
acuuugaagacca

SEQ ID NO: 616785 - RNA, 13 nt, Homo sapiens
acuuugaccuaaa

SEQ ID NO: 616786 - RNA, 13 nt, Homo sapiens
acuuugaccucug

SEQ ID NO: 616787 - RNA, 23 nt, Homo sapiens
acuuugacuuucuucugaauauu

SEQ ID NO: 616788 - RNA, 18 nt, Homo sapiens
acuuugagcacacuuuac

SEQ ID NO: 616789 - RNA, 15 nt, Homo sapiens
acuuugagcugagug

SEQ ID NO: 616790 - RNA, 14 nt, Homo sapiens
acuuugaguaccaa

SEQ ID NO: 616791 - RNA, 15 nt, Homo sapiens
acuuugcacagcucu

SEQ ID NO: 616792 - RNA, 13 nt, Homo sapiens
acuuugcacuuaa

SEQ ID NO: 616793 - RNA, 19 nt, Homo sapiens
acuuugcccccuugcccau

SEQ ID NO: 616794 - RNA, 15 nt, Homo sapiens
agaauuuguccaaua

SEQ ID NO: 616795 - RNA, 22 nt, Homo sapiens
agaauuuguugcuaauuugcca

SEQ ID NO: 616796 - RNA, 23 nt, Homo sapiens
agaauuuuaguguuaaugacucu

SEQ ID NO: 616797 - RNA, 21 nt, Homo sapiens
agaauuuuguuucaaagggau

SEQ ID NO: 616798 - RNA, 22 nt, Homo sapiens
agaauuuuuacuuagauacuaa

SEQ ID NO: 616799 - RNA, 23 nt, Homo sapiens
agacaaacuccugaaaugccaag

SEQ ID NO: 616800 - RNA, 18 nt, Homo sapiens
agacaaagugacauuccu

SEQ ID NO: 616801 - RNA, 20 nt, Homo sapiens
agacaaauuagccauuucac

SEQ ID NO: 616802 - RNA, 16 nt, Homo sapiens
agacaacagaagucau

SEQ ID NO: 616803 - RNA, 23 nt, Homo sapiens
agacaacagcccaggcaucuccu

SEQ ID NO: 616804 - RNA, 18 nt, Homo sapiens
agacaagauauuguacau

SEQ ID NO: 616805 - RNA, 16 nt, Homo sapiens
agacaagguucugccc

SEQ ID NO: 616806 - RNA, 16 nt, Homo sapiens
agacaauagcccaaag

SEQ ID NO: 616807 - RNA, 19 nt, Homo sapiens
agacaauguuuucuucaac

SEQ ID NO: 616808 - RNA, 14 nt, Homo sapiens
agacacagacuggc

SEQ ID NO: 616809 - RNA, 17 nt, Homo sapiens
agacacauuuacacuag

SEQ ID NO: 616810 - RNA, 12 nt, Homo sapiens
agacaccaaauu

SEQ ID NO: 616811 - RNA, 18 nt, Homo sapiens
agacaccaaguuccguca

SEQ ID NO: 616812 - RNA, 16 nt, Homo sapiens
agacacccucuccuua

SEQ ID NO: 616813 - RNA, 18 nt, Homo sapiens
agacaccuguucacagaa

SEQ ID NO: 616814 - RNA, 21 nt, Homo sapiens
agacaccuuggacauccuccu

SEQ ID NO: 616815 - RNA, 17 nt, Homo sapiens
agacacuacaugaugac

SEQ ID NO: 616816 - RNA, 21 nt, Homo sapiens
agacacuacaugaugacucaa

SEQ ID NO: 616817 - RNA, 16 nt, Homo sapiens
agacacugagaucugu

SEQ ID NO: 616818 - RNA, 21 nt, Homo sapiens
agacagaaccccuacaugaaa

SEQ ID NO: 616819 - RNA, 14 nt, Homo sapiens
agacagaagccugg

SEQ ID NO: 616820 - RNA, 14 nt, Homo sapiens
agacagaagcuuaa

SEQ ID NO: 616821 - RNA, 18 nt, Homo sapiens
agacagacaacacuggga

SEQ ID NO: 616822 - RNA, 19 nt, Homo sapiens
agacagagcgagacucuug

SEQ ID NO: 616823 - RNA, 22 nt, Homo sapiens
agacagauggacacugccaaga

SEQ ID NO: 616824 - RNA, 23 nt, Homo sapiens
agacagauggacacugccaagag

SEQ ID NO: 616825 - RNA, 19 nt, Homo sapiens
agacagauuuaaagcacau

SEQ ID NO: 616826 - RNA, 24 nt, Homo sapiens
agacaggaaaguuccagaaacuuu

SEQ ID NO: 616827 - RNA, 16 nt, Homo sapiens
agacaggacagaaugu

SEQ ID NO: 616828 - RNA, 14 nt, Homo sapiens
agacaggagacaug

SEQ ID NO: 616829 - RNA, 20 nt, Homo sapiens
agacaggaugguuacucuug

SEQ ID NO: 616830 - RNA, 15 nt, Homo sapiens
agacaggcagagauc

SEQ ID NO: 616831 - RNA, 19 nt, Homo sapiens
agacaggccccgugaggca

SEQ ID NO: 616832 - RNA, 16 nt, Homo sapiens
agacaggcucuuagca

SEQ ID NO: 616833 - RNA, 20 nt, Homo sapiens
agacagggucucacucuguc

SEQ ID NO: 616834 - RNA, 19 nt, Homo sapiens
agacaguauuuugacaaaa

SEQ ID NO: 616835 - RNA, 22 nt, Homo sapiens
agacaguauuuugacaaaauac

SEQ ID NO: 616836 - RNA, 17 nt, Homo sapiens
agacaguccaagcccug

SEQ ID NO: 616837 - RNA, 19 nt, Homo sapiens
agacagucgagaagccagg

SEQ ID NO: 616838 - RNA, 16 nt, Homo sapiens
agacagugacuguaca

SEQ ID NO: 616839 - RNA, 19 nt, Homo sapiens
agacauacuccuuccauca

SEQ ID NO: 616840 - RNA, 16 nt, Homo sapiens
agacauaucacucaau

SEQ ID NO: 616841 - RNA, 14 nt, Homo sapiens
agacaucaccauca

SEQ ID NO: 616842 - RNA, 22 nt, Homo sapiens
agacauccauaaagaagcaaua

SEQ ID NO: 616843 - RNA, 23 nt, Homo sapiens
agacaucccugauucucucucca

SEQ ID NO: 616844 - RNA, 17 nt, Homo sapiens
agacauccugagcagug

SEQ ID NO: 616845 - RNA, 14 nt, Homo sapiens
agacaucucuggag

SEQ ID NO: 616846 - RNA, 19 nt, Homo sapiens
agacaucugccauucccaa

SEQ ID NO: 616847 - RNA, 21 nt, Homo sapiens
agacaugauuuccuugaaugu

SEQ ID NO: 616848 - RNA, 21 nt, Homo sapiens
agacauggaugaucugggaga

SEQ ID NO: 616849 - RNA, 19 nt, Homo sapiens
agacaugugaggaggaaaa

SEQ ID NO: 616850 - RNA, 14 nt, Homo sapiens
agacauguuucaag

SEQ ID NO: 616851 - RNA, 23 nt, Homo sapiens
agacauuaacucauuagacugga

SEQ ID NO: 616852 - RNA, 12 nt, Homo sapiens
agacauuccaag

SEQ ID NO: 616853 - RNA, 19 nt, Homo sapiens
agacauuccugcgcauggu

SEQ ID NO: 616854 - RNA, 21 nt, Homo sapiens
agacauucucgcuucccugaa

SEQ ID NO: 616855 - RNA, 18 nt, Homo sapiens
agacauuucugcacaugg

SEQ ID NO: 616856 - RNA, 15 nt, Homo sapiens
agacauuugcugaac

SEQ ID NO: 616857 - RNA, 15 nt, Homo sapiens
agaccaaccuuccau

SEQ ID NO: 616858 - RNA, 22 nt, Homo sapiens
agaccaacguuacucagggcuc

SEQ ID NO: 616859 - RNA, 22 nt, Homo sapiens
agaccaagacuuuugucugauc

SEQ ID NO: 616860 - RNA, 17 nt, Homo sapiens
agaccaaguccuggcua

SEQ ID NO: 616861 - RNA, 21 nt, Homo sapiens
agaccaaguuaucaucucacc

SEQ ID NO: 616862 - RNA, 21 nt, Homo sapiens
agaccacaaaaauugacucaa

SEQ ID NO: 616863 - RNA, 13 nt, Homo sapiens
agaccacauccac

SEQ ID NO: 616864 - RNA, 17 nt, Homo sapiens
agaccaccaggguccca

SEQ ID NO: 616865 - RNA, 18 nt, Homo sapiens
agaccaccagggucccag

SEQ ID NO: 616866 - RNA, 14 nt, Homo sapiens
agaccagaagugga

SEQ ID NO: 616867 - RNA, 22 nt, Homo sapiens
agaccagccaaggguccucacc

SEQ ID NO: 616868 - RNA, 19 nt, Homo sapiens
agaccagggugguugggac

SEQ ID NO: 616869 - RNA, 23 nt, Homo sapiens
agaccaguggucuggaaacagcu

SEQ ID NO: 616870 - RNA, 19 nt, Homo sapiens
agaccaguugggagcacug

SEQ ID NO: 616871 - RNA, 14 nt, Homo sapiens
agaccauaauguua

SEQ ID NO: 616872 - RNA, 16 nt, Homo sapiens
agaccaucccugaaga

SEQ ID NO: 616873 - RNA, 17 nt, Homo sapiens
agaccauccuggacuga

SEQ ID NO: 616874 - RNA, 15 nt, Homo sapiens
agaccauuuguauua

SEQ ID NO: 616875 - RNA, 19 nt, Homo sapiens
agaccauuuguauuaccau

SEQ ID NO: 616876 - RNA, 17 nt, Homo sapiens
agacccaacaggugcug

SEQ ID NO: 616877 - RNA, 16 nt, Homo sapiens
agacccaaggcucacu

SEQ ID NO: 616878 - RNA, 22 nt, Homo sapiens
agacccacugaaaugaccaaga

SEQ ID NO: 616879 - RNA, 16 nt, Homo sapiens
agacccauaccuuucc

SEQ ID NO: 616880 - RNA, 13 nt, Homo sapiens
agaccccaugccu

SEQ ID NO: 616881 - RNA, 16 nt, Homo sapiens
agacccccagcacuug

SEQ ID NO: 616882 - RNA, 20 nt, Homo sapiens
agaccccucucccagcuauu

SEQ ID NO: 616883 - RNA, 19 nt, Homo sapiens
agaccccuuguugcacugc

SEQ ID NO: 616884 - RNA, 16 nt, Homo sapiens
agacccguagaugcca

SEQ ID NO: 616885 - RNA, 18 nt, Homo sapiens
agacccguagaugccagg

SEQ ID NO: 616886 - RNA, 23 nt, Homo sapiens
agacccuugacaccugcugagaa

SEQ ID NO: 616887 - RNA, 20 nt, Homo sapiens
agaccgggguucaagccaug

SEQ ID NO: 616888 - RNA, 23 nt, Homo sapiens
agaccguucgcauggcagccauc

SEQ ID NO: 616889 - RNA, 16 nt, Homo sapiens
agaccuacugcacuga

SEQ ID NO: 616890 - RNA, 12 nt, Homo sapiens
agaccucaaggg

SEQ ID NO: 616891 - RNA, 22 nt, Homo sapiens
agaccucagugccuuccuguuu

SEQ ID NO: 616892 - RNA, 16 nt, Homo sapiens
agaccucaugccaugg

SEQ ID NO: 616893 - RNA, 17 nt, Homo sapiens
agaccugaagugugcac

SEQ ID NO: 616894 - RNA, 15 nt, Homo sapiens
agaccugacaagcac

SEQ ID NO: 616895 - RNA, 21 nt, Homo sapiens
agaccugagaauguaucccca

SEQ ID NO: 616896 - RNA, 21 nt, Homo sapiens
agaccuggagcggcuauucca

SEQ ID NO: 616897 - RNA, 21 nt, Homo sapiens
agaccuggcacuggaugcaga

SEQ ID NO: 616898 - RNA, 20 nt, Homo sapiens
agaccuguguuacuaaaaaa

SEQ ID NO: 616899 - RNA, 19 nt, Homo sapiens
agaccuuccauaaugcuac

SEQ ID NO: 616900 - RNA, 16 nt, Homo sapiens
agaccuucguaucccc

SEQ ID NO: 616901 - RNA, 18 nt, Homo sapiens
agaccuuuucacaaugga

SEQ ID NO: 616902 - RNA, 14 nt, Homo sapiens
agacggcagccgcc

SEQ ID NO: 616903 - RNA, 21 nt, Homo sapiens
agacggggucucccuguguua

SEQ ID NO: 616904 - RNA, 16 nt, Homo sapiens
agacguccuccgucca

SEQ ID NO: 616905 - RNA, 20 nt, Homo sapiens
agacuaacaggagaaugcac

SEQ ID NO: 616906 - RNA, 18 nt, Homo sapiens
agacuaauucuaaugugg

SEQ ID NO: 616907 - RNA, 19 nt, Homo sapiens
agacuagauguaguauuuu

SEQ ID NO: 616908 - RNA, 13 nt, Homo sapiens
agacuagcaggcu

SEQ ID NO: 616909 - RNA, 13 nt, Homo sapiens
agacuagugccgu

SEQ ID NO: 616910 - RNA, 22 nt, Homo sapiens
agacuauaagcagaagcacaua

SEQ ID NO: 616911 - RNA, 21 nt, Homo sapiens
agacuaucuuacuauuucaca

SEQ ID NO: 616912 - RNA, 20 nt, Homo sapiens
agacuaugauauaacaugug

SEQ ID NO: 616913 - RNA, 12 nt, Homo sapiens
agacuaugauuu

SEQ ID NO: 616914 - RNA, 18 nt, Homo sapiens
aggaacuugucucuucau

SEQ ID NO: 616915 - RNA, 21 nt, Homo sapiens
aggaagaaagaagacaaacuu

SEQ ID NO: 616916 - RNA, 15 nt, Homo sapiens
aggaagaaaugucag

SEQ ID NO: 616917 - RNA, 16 nt, Homo sapiens
aggaagaaaugucaga

SEQ ID NO: 616918 - RNA, 14 nt, Homo sapiens
aggaagacuugaag

SEQ ID NO: 616919 - RNA, 14 nt, Homo sapiens
aggaagauauacau

SEQ ID NO: 616920 - RNA, 11 nt, Homo sapiens
aggaagcaagc

SEQ ID NO: 616921 - RNA, 18 nt, Homo sapiens
aggaagcaccccaugcca

SEQ ID NO: 616922 - RNA, 22 nt, Homo sapiens
aggaagcuccacugucacccuc

SEQ ID NO: 616923 - RNA, 12 nt, Homo sapiens
aggaagcucucu

SEQ ID NO: 616924 - RNA, 15 nt, Homo sapiens
aggaaggacaugggu

SEQ ID NO: 616925 - RNA, 16 nt, Homo sapiens
aggaaggacuguccca

SEQ ID NO: 616926 - RNA, 16 nt, Homo sapiens
aggaagggacaagaca

SEQ ID NO: 616927 - RNA, 14 nt, Homo sapiens
aggaagggaucuga

SEQ ID NO: 616928 - RNA, 20 nt, Homo sapiens
aggaagggguuuucccauga

SEQ ID NO: 616929 - RNA, 21 nt, Homo sapiens
aggaagguaugugucagccau

SEQ ID NO: 616930 - RNA, 22 nt, Homo sapiens
aggaaggugccuggccauguca

SEQ ID NO: 616931 - RNA, 15 nt, Homo sapiens
aggaagguggugcuu

SEQ ID NO: 616932 - RNA, 13 nt, Homo sapiens
aggaaguacugca

SEQ ID NO: 616933 - RNA, 16 nt, Homo sapiens
aggaaguagaagucau

SEQ ID NO: 616934 - RNA, 19 nt, Homo sapiens
aggaaguggcugucccugu

SEQ ID NO: 616935 - RNA, 15 nt, Homo sapiens
aggaauaaaaccauc

SEQ ID NO: 616936 - RNA, 14 nt, Homo sapiens
aggaauacauuugg

SEQ ID NO: 616937 - RNA, 21 nt, Homo sapiens
aggaauaguggacauggucac

SEQ ID NO: 616938 - RNA, 23 nt, Homo sapiens
aggaauaguugagccccaagucc

SEQ ID NO: 616939 - RNA, 21 nt, Homo sapiens
aggaauauuugcaagacauag

SEQ ID NO: 616940 - RNA, 23 nt, Homo sapiens
aggaaucacuggggaugguggca

SEQ ID NO: 616941 - RNA, 22 nt, Homo sapiens
aggaaucggaauccugucgauu

SEQ ID NO: 616942 - RNA, 22 nt, Homo sapiens
aggaaucuguuucucugcuguc

SEQ ID NO: 616943 - RNA, 14 nt, Homo sapiens
aggaaugacaauaa

SEQ ID NO: 616944 - RNA, 17 nt, Homo sapiens
aggaaugacuuacuuuc

SEQ ID NO: 616945 - RNA, 17 nt, Homo sapiens
aggaauggcugcaccuu

SEQ ID NO: 616946 - RNA, 22 nt, Homo sapiens
aggaaugugaccuuuaauucag

SEQ ID NO: 616947 - RNA, 18 nt, Homo sapiens
aggaauguguccaagaca

SEQ ID NO: 616948 - RNA, 16 nt, Homo sapiens
aggaauucuauaguaa

SEQ ID NO: 616949 - RNA, 20 nt, Homo sapiens
aggaauuggccgcugucacu

SEQ ID NO: 616950 - RNA, 14 nt, Homo sapiens
aggaauugguuuca

SEQ ID NO: 616951 - RNA, 14 nt, Homo sapiens
aggaauuucaagaa

SEQ ID NO: 616952 - RNA, 19 nt, Homo sapiens
aggaauuucaccuguaaac

SEQ ID NO: 616953 - RNA, 15 nt, Homo sapiens
aggaauuucugcucu

SEQ ID NO: 616954 - RNA, 19 nt, Homo sapiens
aggaauuucuuaacuucuu

SEQ ID NO: 616955 - RNA, 17 nt, Homo sapiens
aggaauuuguacuucuu

SEQ ID NO: 616956 - RNA, 15 nt, Homo sapiens
aggacaagggaaaug

SEQ ID NO: 616957 - RNA, 16 nt, Homo sapiens
aggacaauacuggggu

SEQ ID NO: 616958 - RNA, 12 nt, Homo sapiens
aggacacagcac

SEQ ID NO: 616959 - RNA, 14 nt, Homo sapiens
aggacacagcagug

SEQ ID NO: 616960 - RNA, 12 nt, Homo sapiens
aggacacaguga

SEQ ID NO: 616961 - RNA, 23 nt, Homo sapiens
aggacacagugaugaauguacua

SEQ ID NO: 616962 - RNA, 17 nt, Homo sapiens
aggacaccacuaggugg

SEQ ID NO: 616963 - RNA, 23 nt, Homo sapiens
aggacacuggugguucuacugac

SEQ ID NO: 616964 - RNA, 13 nt, Homo sapiens
aggacacuuccug

SEQ ID NO: 616965 - RNA, 15 nt, Homo sapiens
aggacagacagcagg

SEQ ID NO: 616966 - RNA, 12 nt, Homo sapiens
aggacagcugcc

SEQ ID NO: 616967 - RNA, 15 nt, Homo sapiens
aggacauacugcaug

SEQ ID NO: 616968 - RNA, 17 nt, Homo sapiens
aggacaucaaaguggua

SEQ ID NO: 616969 - RNA, 23 nt, Homo sapiens
aggacaucucugcccucuucuca

SEQ ID NO: 616970 - RNA, 15 nt, Homo sapiens
aggacaugaacagac

SEQ ID NO: 616971 - RNA, 22 nt, Homo sapiens
aggacaugauacugaugccaug

SEQ ID NO: 616972 - RNA, 19 nt, Homo sapiens
aggacaugggacuugcgug

SEQ ID NO: 616973 - RNA, 14 nt, Homo sapiens
aggaccaauagcau

SEQ ID NO: 616974 - RNA, 13 nt, Homo sapiens
aggaccacuccug

SEQ ID NO: 616975 - RNA, 14 nt, Homo sapiens
aggacccaggacag

SEQ ID NO: 616976 - RNA, 16 nt, Homo sapiens
aggaccgccugcccug

SEQ ID NO: 616977 - RNA, 22 nt, Homo sapiens
aggaccuacuguucggacaaaa

SEQ ID NO: 616978 - RNA, 19 nt, Homo sapiens
aggaccucucucaaugcca

SEQ ID NO: 616979 - RNA, 21 nt, Homo sapiens
aggaccugaagguauuggccu

SEQ ID NO: 616980 - RNA, 15 nt, Homo sapiens
aggacgaauuugcac

SEQ ID NO: 616981 - RNA, 20 nt, Homo sapiens
aggacgugcagacaggcugg

SEQ ID NO: 616982 - RNA, 21 nt, Homo sapiens
aggacuacaaccaauuuacac

SEQ ID NO: 616983 - RNA, 16 nt, Homo sapiens
aggacucaccacugcc

SEQ ID NO: 616984 - RNA, 23 nt, Homo sapiens
aggacucacccuccacaaagcaa

SEQ ID NO: 616985 - RNA, 13 nt, Homo sapiens
aggacucagcaca

SEQ ID NO: 616986 - RNA, 22 nt, Homo sapiens
aggacuccauuucuuucuucca

SEQ ID NO: 616987 - RNA, 12 nt, Homo sapiens
aggacucuggca

SEQ ID NO: 616988 - RNA, 12 nt, Homo sapiens
aggacugaacaa

SEQ ID NO: 616989 - RNA, 14 nt, Homo sapiens
aggacugaacucca

SEQ ID NO: 616990 - RNA, 15 nt, Homo sapiens
aggacugacuuugcc

SEQ ID NO: 616991 - RNA, 13 nt, Homo sapiens
aggacugcagcuc

SEQ ID NO: 616992 - RNA, 23 nt, Homo sapiens
aggacugcauuguuuucuagccc

SEQ ID NO: 616993 - RNA, 14 nt, Homo sapiens
aggacuguaaucuu

SEQ ID NO: 616994 - RNA, 13 nt, Homo sapiens
aggacuguagaaa

SEQ ID NO: 616995 - RNA, 10 nt, Homo sapiens
aggacugugu

SEQ ID NO: 616996 - RNA, 21 nt, Homo sapiens
aggacuuccauuugcuuuguc

SEQ ID NO: 616997 - RNA, 15 nt, Homo sapiens
aggacuugaaagcau

SEQ ID NO: 616998 - RNA, 19 nt, Homo sapiens
aggacuugcuaaagcacuu

SEQ ID NO: 616999 - RNA, 15 nt, Homo sapiens
aggagaaacacaucu

SEQ ID NO: 617000 - RNA, 17 nt, Homo sapiens
aggagaaaggggcccca

SEQ ID NO: 617001 - RNA, 21 nt, Homo sapiens
aggagaaaugauaagugacaa

SEQ ID NO: 617002 - RNA, 15 nt, Homo sapiens
aggagaacaguagga

SEQ ID NO: 617003 - RNA, 13 nt, Homo sapiens
aggagaacaugag

SEQ ID NO: 617004 - RNA, 17 nt, Homo sapiens
aggagaagaagguuucu

SEQ ID NO: 617005 - RNA, 18 nt, Homo sapiens
aggagaagcacagcuccu

SEQ ID NO: 617006 - RNA, 21 nt, Homo sapiens
aggagaaggacauuuuacugc

SEQ ID NO: 617007 - RNA, 15 nt, Homo sapiens
aggagaagggucuca

SEQ ID NO: 617008 - RNA, 13 nt, Homo sapiens
aggagaaggugcc

SEQ ID NO: 617009 - RNA, 16 nt, Homo sapiens
aggagaaucacuggaa

SEQ ID NO: 617010 - RNA, 17 nt, Homo sapiens
aggagaaucacuggaac

SEQ ID NO: 617011 - RNA, 17 nt, Homo sapiens
aggagaaucacuugcac

SEQ ID NO: 617012 - RNA, 20 nt, Homo sapiens
aggagacaggucaguaguca

SEQ ID NO: 617013 - RNA, 12 nt, Homo sapiens
aggagacauaua

SEQ ID NO: 617014 - RNA, 22 nt, Homo sapiens
aggagaccauuuguauuaccau

SEQ ID NO: 617015 - RNA, 20 nt, Homo sapiens
aggagaccuggcacuggaug

SEQ ID NO: 617016 - RNA, 22 nt, Homo sapiens
aggagacucaccucugccucaa

SEQ ID NO: 617017 - RNA, 21 nt, Homo sapiens
aggagacuuuacauggaugcc

SEQ ID NO: 617018 - RNA, 13 nt, Homo sapiens
aggagagagcagc

SEQ ID NO: 617019 - RNA, 15 nt, Homo sapiens
aggagagagccagga

SEQ ID NO: 617020 - RNA, 15 nt, Homo sapiens
aggagagagucccag

SEQ ID NO: 617021 - RNA, 16 nt, Homo sapiens
aggagagccacugggc

SEQ ID NO: 617022 - RNA, 20 nt, Homo sapiens
aggagagcuagcagcaggga

SEQ ID NO: 617023 - RNA, 23 nt, Homo sapiens
aggagaggcaacaggaggcauuc

SEQ ID NO: 617024 - RNA, 21 nt, Homo sapiens
aggagaggcgggagaacugaa

SEQ ID NO: 617025 - RNA, 13 nt, Homo sapiens
aggagaguggcag

SEQ ID NO: 617026 - RNA, 13 nt, Homo sapiens
aggagauacugaa

SEQ ID NO: 617027 - RNA, 14 nt, Homo sapiens
aggagauacugaac

SEQ ID NO: 617028 - RNA, 20 nt, Homo sapiens
aggagauggaaguugcagug

SEQ ID NO: 617029 - RNA, 16 nt, Homo sapiens
aggagcaaaguuaaaa

SEQ ID NO: 617030 - RNA, 22 nt, Homo sapiens
aggagcaaauguuucugcagua

SEQ ID NO: 617031 - RNA, 13 nt, Homo sapiens
aggagcaacagcu

SEQ ID NO: 617032 - RNA, 16 nt, Homo sapiens
aggagcacagguccca

SEQ ID NO: 617033 - RNA, 12 nt, Homo sapiens
aggagccaaaca

SEQ ID NO: 617034 - RNA, 21 nt, Homo sapiens
aggagccauugcucuccuaga

SEQ ID NO: 617035 - RNA, 15 nt, Homo sapiens
aggagcccuucucuu

SEQ ID NO: 617036 - RNA, 14 nt, Homo sapiens
aggagccuuuccag

SEQ ID NO: 617037 - RNA, 18 nt, Homo sapiens
agggcccaucaggcagug

SEQ ID NO: 617038 - RNA, 23 nt, Homo sapiens
agggccccaauguauguguggcu

SEQ ID NO: 617039 - RNA, 16 nt, Homo sapiens
agggccccagcacuaa

SEQ ID NO: 617040 - RNA, 17 nt, Homo sapiens
agggccccugaccuccc

SEQ ID NO: 617041 - RNA, 23 nt, Homo sapiens
agggcccucccagcccauugcug

SEQ ID NO: 617042 - RNA, 19 nt, Homo sapiens
agggccggcggcucugagc

SEQ ID NO: 617043 - RNA, 19 nt, Homo sapiens
agggccgugugacacucuc

SEQ ID NO: 617044 - RNA, 20 nt, Homo sapiens
agggccguugcccccagacu

SEQ ID NO: 617045 - RNA, 15 nt, Homo sapiens
agggccugcaugggg

SEQ ID NO: 617046 - RNA, 15 nt, Homo sapiens
agggcgaaggccauu

SEQ ID NO: 617047 - RNA, 21 nt, Homo sapiens
agggcggccagggacccaaag

SEQ ID NO: 617048 - RNA, 18 nt, Homo sapiens
agggcgugugguuucccu

SEQ ID NO: 617049 - RNA, 17 nt, Homo sapiens
agggcucacucagccac

SEQ ID NO: 617050 - RNA, 15 nt, Homo sapiens
agggcucagggcagu

SEQ ID NO: 617051 - RNA, 22 nt, Homo sapiens
agggcucugcaggccacuguga

SEQ ID NO: 617052 - RNA, 14 nt, Homo sapiens
agggcucuuugaug

SEQ ID NO: 617053 - RNA, 19 nt, Homo sapiens
agggcugcagucacauuga

SEQ ID NO: 617054 - RNA, 14 nt, Homo sapiens
agggcugcccugag

SEQ ID NO: 617055 - RNA, 16 nt, Homo sapiens
agggcuuccucuuccg

SEQ ID NO: 617056 - RNA, 22 nt, Homo sapiens
aggggaaaagaaaaucuuuuaa

SEQ ID NO: 617057 - RNA, 16 nt, Homo sapiens
aggggaaccccggggu

SEQ ID NO: 617058 - RNA, 15 nt, Homo sapiens
aggggacacuucccu

SEQ ID NO: 617059 - RNA, 20 nt, Homo sapiens
aggggacucagcccugaggu

SEQ ID NO: 617060 - RNA, 22 nt, Homo sapiens
aggggagaaagcuuauggcugg

SEQ ID NO: 617061 - RNA, 14 nt, Homo sapiens
aggggagaguccag

SEQ ID NO: 617062 - RNA, 23 nt, Homo sapiens
aggggagcaaaaucgaugcagug

SEQ ID NO: 617063 - RNA, 17 nt, Homo sapiens
aggggaggaucacugga

SEQ ID NO: 617064 - RNA, 21 nt, Homo sapiens
aggggagggagaaguuucugu

SEQ ID NO: 617065 - RNA, 17 nt, Homo sapiens
aggggaucccaccccau

SEQ ID NO: 617066 - RNA, 18 nt, Homo sapiens
aggggcaacuguaugaaa

SEQ ID NO: 617067 - RNA, 18 nt, Homo sapiens
aggggcagggagagcgcc

SEQ ID NO: 617068 - RNA, 22 nt, Homo sapiens
aggggcagguguuucuuuccug

SEQ ID NO: 617069 - RNA, 14 nt, Homo sapiens
aggggccacugacc

SEQ ID NO: 617070 - RNA, 23 nt, Homo sapiens
aggggcccaaauucuuucagugg

SEQ ID NO: 617071 - RNA, 11 nt, Homo sapiens
aggggccucag

SEQ ID NO: 617072 - RNA, 20 nt, Homo sapiens
aggggccuuagggcacuggg

SEQ ID NO: 617073 - RNA, 17 nt, Homo sapiens
aggggcuccagcaccuu

SEQ ID NO: 617074 - RNA, 12 nt, Homo sapiens
aggggcucucag

SEQ ID NO: 617075 - RNA, 14 nt, Homo sapiens
aggggcuggcacug

SEQ ID NO: 617076 - RNA, 21 nt, Homo sapiens
aggggcuguggccgucuccuc

SEQ ID NO: 617077 - RNA, 13 nt, Homo sapiens
aggggcuguguuu

SEQ ID NO: 617078 - RNA, 23 nt, Homo sapiens
aggggcuguugaauuucccacau

SEQ ID NO: 617079 - RNA, 17 nt, Homo sapiens
agggggaagaagaagag

SEQ ID NO: 617080 - RNA, 18 nt, Homo sapiens
agggggagaauggguguu

SEQ ID NO: 617081 - RNA, 22 nt, Homo sapiens
agggggcaagaaguagcagugu

SEQ ID NO: 617082 - RNA, 20 nt, Homo sapiens
agggggccaggcgguggcuu

SEQ ID NO: 617083 - RNA, 15 nt, Homo sapiens
aggggggagggucuu

SEQ ID NO: 617084 - RNA, 16 nt, Homo sapiens
agggggucucuguuaa

SEQ ID NO: 617085 - RNA, 17 nt, Homo sapiens
aggggguuugggggcuu

SEQ ID NO: 617086 - RNA, 13 nt, Homo sapiens
agggguauguucc

SEQ ID NO: 617087 - RNA, 15 nt, Homo sapiens
agggguauguucccu

SEQ ID NO: 617088 - RNA, 16 nt, Homo sapiens
aggggucagggaccaa

SEQ ID NO: 617089 - RNA, 21 nt, Homo sapiens
agggguccagcccagcacugg

SEQ ID NO: 617090 - RNA, 18 nt, Homo sapiens
aggggucuggacaugugg

SEQ ID NO: 617091 - RNA, 23 nt, Homo sapiens
aggggugcccccaggcucucaug

SEQ ID NO: 617092 - RNA, 21 nt, Homo sapiens
agggguggcugggucuucaag

SEQ ID NO: 617093 - RNA, 18 nt, Homo sapiens
aggggugggccugugaau

SEQ ID NO: 617094 - RNA, 22 nt, Homo sapiens
agggguggggguggaggcuucc

SEQ ID NO: 617095 - RNA, 16 nt, Homo sapiens
aggggugguguggugu

SEQ ID NO: 617096 - RNA, 18 nt, Homo sapiens
agggguuauagcuucagg

SEQ ID NO: 617097 - RNA, 22 nt, Homo sapiens
agggguucuucuggggugcuaa

SEQ ID NO: 617098 - RNA, 17 nt, Homo sapiens
agggguucuugagccag

SEQ ID NO: 617099 - RNA, 18 nt, Homo sapiens
agggguucuugagccagc

SEQ ID NO: 617100 - RNA, 15 nt, Homo sapiens
agggguuucagaauu

SEQ ID NO: 617101 - RNA, 19 nt, Homo sapiens
aggguaacuggggggccac

SEQ ID NO: 617102 - RNA, 17 nt, Homo sapiens
aggguaccgucuucucc

SEQ ID NO: 617103 - RNA, 16 nt, Homo sapiens
aggguaccuugaacac

SEQ ID NO: 617104 - RNA, 21 nt, Homo sapiens
aggguaccuugaacacugggg

SEQ ID NO: 617105 - RNA, 16 nt, Homo sapiens
aggguagggcacaaag

SEQ ID NO: 617106 - RNA, 14 nt, Homo sapiens
aggguagugcuaag

SEQ ID NO: 617107 - RNA, 16 nt, Homo sapiens
aggguaugaaagugcc

SEQ ID NO: 617108 - RNA, 18 nt, Homo sapiens
aggguaugggaagccaua

SEQ ID NO: 617109 - RNA, 21 nt, Homo sapiens
aggguaugucagugucacugg

SEQ ID NO: 617110 - RNA, 18 nt, Homo sapiens
aggguccacgccucugcu

SEQ ID NO: 617111 - RNA, 13 nt, Homo sapiens
aggguccagugga

SEQ ID NO: 617112 - RNA, 15 nt, Homo sapiens
agggucccgguguau

SEQ ID NO: 617113 - RNA, 20 nt, Homo sapiens
aggguccuuuaguaccugaa

SEQ ID NO: 617114 - RNA, 13 nt, Homo sapiens
agggucucuucag

SEQ ID NO: 617115 - RNA, 19 nt, Homo sapiens
agggucugagacucccuuu

SEQ ID NO: 617116 - RNA, 23 nt, Homo sapiens
agggucugugugaaugugggcac

SEQ ID NO: 617117 - RNA, 19 nt, Homo sapiens
agggucuucuuacaugcau

SEQ ID NO: 617118 - RNA, 22 nt, Homo sapiens
agggucuugcuauauugcccag

SEQ ID NO: 617119 - RNA, 22 nt, Homo sapiens
agggucuuuuacccugugucag

SEQ ID NO: 617120 - RNA, 19 nt, Homo sapiens
agggucuuuucaucuggga

SEQ ID NO: 617121 - RNA, 23 nt, Homo sapiens
agggugacccugaagugagcaca

SEQ ID NO: 617122 - RNA, 19 nt, Homo sapiens
agggugacgccugagacag

SEQ ID NO: 617123 - RNA, 18 nt, Homo sapiens
agggugacugaugauaca

SEQ ID NO: 617124 - RNA, 11 nt, Homo sapiens
agggugacugu

SEQ ID NO: 617125 - RNA, 19 nt, Homo sapiens
agggugaggcugacacagc

SEQ ID NO: 617126 - RNA, 20 nt, Homo sapiens
agggugaguguuuccacuca

SEQ ID NO: 617127 - RNA, 20 nt, Homo sapiens
agggugcagcccucuugccc

SEQ ID NO: 617128 - RNA, 19 nt, Homo sapiens
aggguggagaugaggugcu

SEQ ID NO: 617129 - RNA, 15 nt, Homo sapiens
aggguggaugacagg

SEQ ID NO: 617130 - RNA, 16 nt, Homo sapiens
aggguggcagaacuug

SEQ ID NO: 617131 - RNA, 22 nt, Homo sapiens
aggguggcugccagcccacugc

SEQ ID NO: 617132 - RNA, 17 nt, Homo sapiens
agggugggaagggauaa

SEQ ID NO: 617133 - RNA, 20 nt, Homo sapiens
agggugggggccaccugccu

SEQ ID NO: 617134 - RNA, 22 nt, Homo sapiens
aggguggguuuaauaacauauu

SEQ ID NO: 617135 - RNA, 17 nt, Homo sapiens
aggguguguacugcaca

SEQ ID NO: 617136 - RNA, 13 nt, Homo sapiens
aggguuacuaugc

SEQ ID NO: 617137 - RNA, 18 nt, Homo sapiens
aggguuccgccacuccag

SEQ ID NO: 617138 - RNA, 20 nt, Homo sapiens
aggguugggcccagaucugg

SEQ ID NO: 617139 - RNA, 15 nt, Homo sapiens
agguaaaaacccagc

SEQ ID NO: 617140 - RNA, 14 nt, Homo sapiens
agguaaaacagggc

SEQ ID NO: 617141 - RNA, 13 nt, Homo sapiens
agguaacuacugc

SEQ ID NO: 617142 - RNA, 15 nt, Homo sapiens
agguaacucuuugca

SEQ ID NO: 617143 - RNA, 13 nt, Homo sapiens
agguaaggccuuu

SEQ ID NO: 617144 - RNA, 20 nt, Homo sapiens
agguaauguuccugaaaauu

SEQ ID NO: 617145 - RNA, 21 nt, Homo sapiens
agguaauucucccuaaggaau

SEQ ID NO: 617146 - RNA, 19 nt, Homo sapiens
agguacagcgggcugugcc

SEQ ID NO: 617147 - RNA, 23 nt, Homo sapiens
agguacaucguuugcaaauguca

SEQ ID NO: 617148 - RNA, 20 nt, Homo sapiens
agguaccagcugcgcuugcu

SEQ ID NO: 617149 - RNA, 19 nt, Homo sapiens
agguaccaguuguauuuaa

SEQ ID NO: 617150 - RNA, 19 nt, Homo sapiens
agguacuucaggggcacuu

SEQ ID NO: 617151 - RNA, 22 nt, Homo sapiens
agguacuucaggggcacuucau

SEQ ID NO: 617152 - RNA, 19 nt, Homo sapiens
agguagaaauaucugaaaa

SEQ ID NO: 617153 - RNA, 14 nt, Homo sapiens
agguagacuuugcu

SEQ ID NO: 617154 - RNA, 14 nt, Homo sapiens
agguagaugaacua

SEQ ID NO: 617155 - RNA, 16 nt, Homo sapiens
agguagcucggcacca

SEQ ID NO: 617156 - RNA, 16 nt, Homo sapiens
agguaggaagcacuga

SEQ ID NO: 617157 - RNA, 19 nt, Homo sapiens
agguaggggcccacuucac

SEQ ID NO: 617158 - RNA, 14 nt, Homo sapiens
aguaugagggaaaa

SEQ ID NO: 617159 - RNA, 19 nt, Homo sapiens
aguaugagucaaugugcag

SEQ ID NO: 617160 - RNA, 12 nt, Homo sapiens
aguaugcaaaag

SEQ ID NO: 617161 - RNA, 16 nt, Homo sapiens
aguaugcuuagauuaa

SEQ ID NO: 617162 - RNA, 17 nt, Homo sapiens
aguaugguaaucuuuac

SEQ ID NO: 617163 - RNA, 16 nt, Homo sapiens
aguaugguauuacaaa

SEQ ID NO: 617164 - RNA, 19 nt, Homo sapiens
aguauguuuguacaguaug

SEQ ID NO: 617165 - RNA, 14 nt, Homo sapiens
aguauucaaucaag

SEQ ID NO: 617166 - RNA, 17 nt, Homo sapiens
aguauucauucugcauu

SEQ ID NO: 617167 - RNA, 22 nt, Homo sapiens
aguauucauucugcauugcuag

SEQ ID NO: 617168 - RNA, 23 nt, Homo sapiens
aguauuccuuuauacacagugga

SEQ ID NO: 617169 - RNA, 21 nt, Homo sapiens
aguauuccuuuccugaucacu

SEQ ID NO: 617170 - RNA, 20 nt, Homo sapiens
aguauucuaaaguuuugcaa

SEQ ID NO: 617171 - RNA, 13 nt, Homo sapiens
aguauucugccau

SEQ ID NO: 617172 - RNA, 16 nt, Homo sapiens
aguauucugccaucau

SEQ ID NO: 617173 - RNA, 16 nt, Homo sapiens
aguauucuugucaaaa

SEQ ID NO: 617174 - RNA, 19 nt, Homo sapiens
aguauugcuguuagcaagu

SEQ ID NO: 617175 - RNA, 16 nt, Homo sapiens
aguauugguguaugua

SEQ ID NO: 617176 - RNA, 13 nt, Homo sapiens
aguauugugauau

SEQ ID NO: 617177 - RNA, 21 nt, Homo sapiens
aguauuguuuggaggagcaaa

SEQ ID NO: 617178 - RNA, 17 nt, Homo sapiens
aguauuguuuguaauca

SEQ ID NO: 617179 - RNA, 17 nt, Homo sapiens
aguauuuacacuaugau

SEQ ID NO: 617180 - RNA, 16 nt, Homo sapiens
aguauuuagaagccaa

SEQ ID NO: 617181 - RNA, 20 nt, Homo sapiens
aguauuuagaagccaacuau

SEQ ID NO: 617182 - RNA, 17 nt, Homo sapiens
aguauuuaggaaauggg

SEQ ID NO: 617183 - RNA, 19 nt, Homo sapiens
aguauuuaggauaaccuug

SEQ ID NO: 617184 - RNA, 23 nt, Homo sapiens
aguauuuauugcaggaugguguc

SEQ ID NO: 617185 - RNA, 18 nt, Homo sapiens
aguauuucaugcugggaa

SEQ ID NO: 617186 - RNA, 23 nt, Homo sapiens
aguauuuccuuccacuguagcua

SEQ ID NO: 617187 - RNA, 14 nt, Homo sapiens
aguauuucucagga

SEQ ID NO: 617188 - RNA, 15 nt, Homo sapiens
aguauuucuguggau

SEQ ID NO: 617189 - RNA, 12 nt, Homo sapiens
aguauuuggacu

SEQ ID NO: 617190 - RNA, 17 nt, Homo sapiens
aguauuuggggucauau

SEQ ID NO: 617191 - RNA, 21 nt, Homo sapiens
aguauuuuguguccuccagga

SEQ ID NO: 617192 - RNA, 17 nt, Homo sapiens
aguauuuuuaacacuua

SEQ ID NO: 617193 - RNA, 15 nt, Homo sapiens
aguauuuuugccaaa

SEQ ID NO: 617194 - RNA, 15 nt, Homo sapiens
aguauuuuuucaagu

SEQ ID NO: 617195 - RNA, 16 nt, Homo sapiens
agucaaaagagagaag

SEQ ID NO: 617196 - RNA, 16 nt, Homo sapiens
agucaaaucugggcuc

SEQ ID NO: 617197 - RNA, 17 nt, Homo sapiens
agucaaccaauguagaa

SEQ ID NO: 617198 - RNA, 18 nt, Homo sapiens
agucaagaucaacauucc

SEQ ID NO: 617199 - RNA, 22 nt, Homo sapiens
agucaagcuguugaagucucag

SEQ ID NO: 617200 - RNA, 19 nt, Homo sapiens
agucaaggacgaauuugca

SEQ ID NO: 617201 - RNA, 21 nt, Homo sapiens
agucaagucaccaugcugaau

SEQ ID NO: 617202 - RNA, 16 nt, Homo sapiens
agucaauccugucaua

SEQ ID NO: 617203 - RNA, 14 nt, Homo sapiens
agucaauguacuug

SEQ ID NO: 617204 - RNA, 13 nt, Homo sapiens
agucaaugugcag

SEQ ID NO: 617205 - RNA, 12 nt, Homo sapiens
agucacacagug

SEQ ID NO: 617206 - RNA, 14 nt, Homo sapiens
agucacaguuuuug

SEQ ID NO: 617207 - RNA, 14 nt, Homo sapiens
agucacaucucuuc

SEQ ID NO: 617208 - RNA, 21 nt, Homo sapiens
agucacaugcguaaacgacac

SEQ ID NO: 617209 - RNA, 14 nt, Homo sapiens
agucaccacccagc

SEQ ID NO: 617210 - RNA, 16 nt, Homo sapiens
agucaccuuucugggc

SEQ ID NO: 617211 - RNA, 21 nt, Homo sapiens
agucacggcugcgcacugugu

SEQ ID NO: 617212 - RNA, 19 nt, Homo sapiens
agucacugacccugugcag

SEQ ID NO: 617213 - RNA, 15 nt, Homo sapiens
agucacuuccagugu

SEQ ID NO: 617214 - RNA, 19 nt, Homo sapiens
agucacuugggagcugcug

SEQ ID NO: 617215 - RNA, 21 nt, Homo sapiens
agucacuuugccagagccuga

SEQ ID NO: 617216 - RNA, 13 nt, Homo sapiens
agucagacacgau

SEQ ID NO: 617217 - RNA, 21 nt, Homo sapiens
agucagacugacacuacuaaa

SEQ ID NO: 617218 - RNA, 19 nt, Homo sapiens
agucagcccuuauggccaa

SEQ ID NO: 617219 - RNA, 13 nt, Homo sapiens
agucagcucucuc

SEQ ID NO: 617220 - RNA, 21 nt, Homo sapiens
agucaggaauggcugcaccuu

SEQ ID NO: 617221 - RNA, 23 nt, Homo sapiens
agucaggggucaggugucaggcc

SEQ ID NO: 617222 - RNA, 23 nt, Homo sapiens
agucaggguggagaugaggugcu

SEQ ID NO: 617223 - RNA, 22 nt, Homo sapiens
agucaggguucacuugggcucu

SEQ ID NO: 617224 - RNA, 19 nt, Homo sapiens
agucaguggcuuugcauag

SEQ ID NO: 617225 - RNA, 15 nt, Homo sapiens
agucauacuaguagu

SEQ ID NO: 617226 - RNA, 20 nt, Homo sapiens
agucauauacauuaguuuua

SEQ ID NO: 617227 - RNA, 15 nt, Homo sapiens
agucauauaccuaua

SEQ ID NO: 617228 - RNA, 16 nt, Homo sapiens
agucaucucauuccac

SEQ ID NO: 617229 - RNA, 23 nt, Homo sapiens
agucaucuugcuaccaguauuua

SEQ ID NO: 617230 - RNA, 14 nt, Homo sapiens
agucaugaugaauc

SEQ ID NO: 617231 - RNA, 17 nt, Homo sapiens
agucauggcaccaaagc

SEQ ID NO: 617232 - RNA, 12 nt, Homo sapiens
agucaugguguu

SEQ ID NO: 617233 - RNA, 13 nt, Homo sapiens
agucaugguguug

SEQ ID NO: 617234 - RNA, 12 nt, Homo sapiens
agucauuaccac

SEQ ID NO: 617235 - RNA, 13 nt, Homo sapiens
agucauucuagga

SEQ ID NO: 617236 - RNA, 21 nt, Homo sapiens
agucauugucgcucagcaaua

SEQ ID NO: 617237 - RNA, 19 nt, Homo sapiens
agucauuugcugagcaugu

SEQ ID NO: 617238 - RNA, 23 nt, Homo sapiens
agucauuuuucuggaguggaaaa

SEQ ID NO: 617239 - RNA, 17 nt, Homo sapiens
aguccaaaccacuccac

SEQ ID NO: 617240 - RNA, 13 nt, Homo sapiens
aguccaacugaac

SEQ ID NO: 617241 - RNA, 20 nt, Homo sapiens
aguccaauuccaaagccaga

SEQ ID NO: 617242 - RNA, 21 nt, Homo sapiens
aguccacaccacuguugccuu

SEQ ID NO: 617243 - RNA, 17 nt, Homo sapiens
aguccaccucccauuac

SEQ ID NO: 617244 - RNA, 16 nt, Homo sapiens
aguccacggaccccca

SEQ ID NO: 617245 - RNA, 15 nt, Homo sapiens
aguccacuguggcac

SEQ ID NO: 617246 - RNA, 20 nt, Homo sapiens
aguccagagcuggaucucuc

SEQ ID NO: 617247 - RNA, 17 nt, Homo sapiens
aguccagauauuucaca

SEQ ID NO: 617248 - RNA, 20 nt, Homo sapiens
aguccagauuuacacuggga

SEQ ID NO: 617249 - RNA, 12 nt, Homo sapiens
aguccagcacug

SEQ ID NO: 617250 - RNA, 20 nt, Homo sapiens
aguccaggccucucucugcu

SEQ ID NO: 617251 - RNA, 16 nt, Homo sapiens
aguccagguccauuua

SEQ ID NO: 617252 - RNA, 19 nt, Homo sapiens
agucccaaaugucaucagg

SEQ ID NO: 617253 - RNA, 15 nt, Homo sapiens
agucccacacugugc

SEQ ID NO: 617254 - RNA, 16 nt, Homo sapiens
agucccacacuguggc

SEQ ID NO: 617255 - RNA, 15 nt, Homo sapiens
agucccagcuacuca

SEQ ID NO: 617256 - RNA, 16 nt, Homo sapiens
agucccaguauucuca

SEQ ID NO: 617257 - RNA, 12 nt, Homo sapiens
agucccauuccu

SEQ ID NO: 617258 - RNA, 20 nt, Homo sapiens
aguccccagccugcucccua

SEQ ID NO: 617259 - RNA, 15 nt, Homo sapiens
agucccccacccacc

SEQ ID NO: 617260 - RNA, 20 nt, Homo sapiens
aguccccccagcucuaagca

SEQ ID NO: 617261 - RNA, 15 nt, Homo sapiens
aguccccucucucug

SEQ ID NO: 617262 - RNA, 21 nt, Homo sapiens
agucccgggggccugcccugc

SEQ ID NO: 617263 - RNA, 17 nt, Homo sapiens
aguccuacaagcuaaaa

SEQ ID NO: 617264 - RNA, 22 nt, Homo sapiens
aguccuagaauguuucauuugc

SEQ ID NO: 617265 - RNA, 17 nt, Homo sapiens
aguccuauucuauugca

SEQ ID NO: 617266 - RNA, 16 nt, Homo sapiens
aguccucacuguccug

SEQ ID NO: 617267 - RNA, 22 nt, Homo sapiens
aguccuccagacaacccucaga

SEQ ID NO: 617268 - RNA, 19 nt, Homo sapiens
aguccucguagccaucucu

SEQ ID NO: 617269 - RNA, 12 nt, Homo sapiens
aguccucuagca

SEQ ID NO: 617270 - RNA, 13 nt, Homo sapiens
aguccucugcucc

SEQ ID NO: 617271 - RNA, 23 nt, Homo sapiens
aguccucuggauggcaccagagg

SEQ ID NO: 617272 - RNA, 18 nt, Homo sapiens
aguccugacacuauucau

SEQ ID NO: 617273 - RNA, 15 nt, Homo sapiens
aguccugagacuuuu

SEQ ID NO: 617274 - RNA, 19 nt, Homo sapiens
aguccugcccaaugccuug

SEQ ID NO: 617275 - RNA, 22 nt, Homo sapiens
aguccugcuaccucccuugccu

SEQ ID NO: 617276 - RNA, 18 nt, Homo sapiens
aguccugcuccagaauuu

SEQ ID NO: 617277 - RNA, 20 nt, Homo sapiens
aguccugcuggaucuugccu

SEQ ID NO: 617278 - RNA, 20 nt, Homo sapiens
aguccuggaagccagcuuuc

SEQ ID NO: 617279 - RNA, 22 nt, Homo sapiens
aguccugguccuggcugcacuc

SEQ ID NO: 617280 - RNA, 17 nt, Homo sapiens
auaaaaaccauggaacu

SEQ ID NO: 617281 - RNA, 19 nt, Homo sapiens
auaaaaacucauccauggc

SEQ ID NO: 617282 - RNA, 14 nt, Homo sapiens
auaaaaacugcuua

SEQ ID NO: 617283 - RNA, 18 nt, Homo sapiens
auaaaaaguucagaguuc

SEQ ID NO: 617284 - RNA, 23 nt, Homo sapiens
auaaaaaguuucacaggucaaua

SEQ ID NO: 617285 - RNA, 12 nt, Homo sapiens
auaaaaauaccu

SEQ ID NO: 617286 - RNA, 20 nt, Homo sapiens
auaaaaaucauucuacugaa

SEQ ID NO: 617287 - RNA, 21 nt, Homo sapiens
auaaaaaucauucuacugaac

SEQ ID NO: 617288 - RNA, 18 nt, Homo sapiens
auaaaaauugacaaugau

SEQ ID NO: 617289 - RNA, 14 nt, Homo sapiens
auaaaacagucaug

SEQ ID NO: 617290 - RNA, 12 nt, Homo sapiens
auaaaacauagc

SEQ ID NO: 617291 - RNA, 21 nt, Homo sapiens
auaaaaccaucaaaaauauuc

SEQ ID NO: 617292 - RNA, 16 nt, Homo sapiens
auaaaacccaauacuu

SEQ ID NO: 617293 - RNA, 22 nt, Homo sapiens
auaaaacguuaguuaaucccuu

SEQ ID NO: 617294 - RNA, 12 nt, Homo sapiens
auaaaacuauua

SEQ ID NO: 617295 - RNA, 14 nt, Homo sapiens
auaaaacugaaucu

SEQ ID NO: 617296 - RNA, 12 nt, Homo sapiens
auaaaacugugu

SEQ ID NO: 617297 - RNA, 13 nt, Homo sapiens
auaaaacugugua

SEQ ID NO: 617298 - RNA, 13 nt, Homo sapiens
auaaaagacuuuu

SEQ ID NO: 617299 - RNA, 15 nt, Homo sapiens
auaaaagaucuugaa

SEQ ID NO: 617300 - RNA, 23 nt, Homo sapiens
auaaaagaucuugaauagucuca

SEQ ID NO: 617301 - RNA, 15 nt, Homo sapiens
auaaaagaugauuuc

SEQ ID NO: 617302 - RNA, 17 nt, Homo sapiens
auaaaagcauugucucu

SEQ ID NO: 617303 - RNA, 22 nt, Homo sapiens
auaaaagcucagaugacauuuc

SEQ ID NO: 617304 - RNA, 15 nt, Homo sapiens
auaaaaggaagccaa

SEQ ID NO: 617305 - RNA, 22 nt, Homo sapiens
auaaaagugaagugaaucugau

SEQ ID NO: 617306 - RNA, 17 nt, Homo sapiens
auaaaaguugcguuuaa

SEQ ID NO: 617307 - RNA, 21 nt, Homo sapiens
auaaaauaauuauaaauauca

SEQ ID NO: 617308 - RNA, 15 nt, Homo sapiens
auaaaaucagaguug

SEQ ID NO: 617309 - RNA, 17 nt, Homo sapiens
auaaaaugaacaucucu

SEQ ID NO: 617310 - RNA, 18 nt, Homo sapiens
auaaaaugaaccugauca

SEQ ID NO: 617311 - RNA, 17 nt, Homo sapiens
auaaaaugauccugcca

SEQ ID NO: 617312 - RNA, 11 nt, Homo sapiens
auaaaaugcaa

SEQ ID NO: 617313 - RNA, 12 nt, Homo sapiens
auaaaaugguca

SEQ ID NO: 617314 - RNA, 21 nt, Homo sapiens
auaaaauguugaaaagucaaa

SEQ ID NO: 617315 - RNA, 16 nt, Homo sapiens
auaaaauuaugccaua

SEQ ID NO: 617316 - RNA, 16 nt, Homo sapiens
auaaaauuccuaucuc

SEQ ID NO: 617317 - RNA, 23 nt, Homo sapiens
auaaaauuggcaccaugugccau

SEQ ID NO: 617318 - RNA, 20 nt, Homo sapiens
auaaacaaaguuacuaggua

SEQ ID NO: 617319 - RNA, 21 nt, Homo sapiens
auaaacaacuuaauguucuga

SEQ ID NO: 617320 - RNA, 22 nt, Homo sapiens
auaaacaacuuaauguucugaa

SEQ ID NO: 617321 - RNA, 18 nt, Homo sapiens
auaaacaccaacccagga

SEQ ID NO: 617322 - RNA, 14 nt, Homo sapiens
auaaacacccauga

SEQ ID NO: 617323 - RNA, 20 nt, Homo sapiens
auaaacacccaugaaucaaa

SEQ ID NO: 617324 - RNA, 22 nt, Homo sapiens
auaaacacccaugaaucaaaga

SEQ ID NO: 617325 - RNA, 17 nt, Homo sapiens
auaaacagucuaaagaa

SEQ ID NO: 617326 - RNA, 20 nt, Homo sapiens
auaaacaucacaugagacaa

SEQ ID NO: 617327 - RNA, 15 nt, Homo sapiens
auaaacauccuucaa

SEQ ID NO: 617328 - RNA, 23 nt, Homo sapiens
auaaacauuaauuuugugcauuc

SEQ ID NO: 617329 - RNA, 18 nt, Homo sapiens
auaaacauuccuguugau

SEQ ID NO: 617330 - RNA, 16 nt, Homo sapiens
auaaaccaaaggaaaa

SEQ ID NO: 617331 - RNA, 21 nt, Homo sapiens
auaaaccaguugaaucauuga

SEQ ID NO: 617332 - RNA, 20 nt, Homo sapiens
auaaaccguuuuuaacacau

SEQ ID NO: 617333 - RNA, 16 nt, Homo sapiens
auaaaccuggagauau

SEQ ID NO: 617334 - RNA, 21 nt, Homo sapiens
auaaaccugggcucagccuga

SEQ ID NO: 617335 - RNA, 22 nt, Homo sapiens
auaaacuagauauuagguccau

SEQ ID NO: 617336 - RNA, 16 nt, Homo sapiens
auaaacuauaaacuua

SEQ ID NO: 617337 - RNA, 17 nt, Homo sapiens
auaaacuauacacuuaa

SEQ ID NO: 617338 - RNA, 16 nt, Homo sapiens
auaaacucaaugagcu

SEQ ID NO: 617339 - RNA, 16 nt, Homo sapiens
auaaacucauuuaucu

SEQ ID NO: 617340 - RNA, 23 nt, Homo sapiens
auaaacuccuacuaaaucccucc

SEQ ID NO: 617341 - RNA, 18 nt, Homo sapiens
auaaacugacuaaacuua

SEQ ID NO: 617342 - RNA, 20 nt, Homo sapiens
auaaacugacuaaacuuaca

SEQ ID NO: 617343 - RNA, 23 nt, Homo sapiens
auaaacugagaggucacaaagaa

SEQ ID NO: 617344 - RNA, 14 nt, Homo sapiens
auaaagaauacuau

SEQ ID NO: 617345 - RNA, 16 nt, Homo sapiens
auaaagauaauacugu

SEQ ID NO: 617346 - RNA, 14 nt, Homo sapiens
auaaagaugaucua

SEQ ID NO: 617347 - RNA, 13 nt, Homo sapiens
auaaagauguuau

SEQ ID NO: 617348 - RNA, 19 nt, Homo sapiens
auaaagcaaaaguagccau

SEQ ID NO: 617349 - RNA, 14 nt, Homo sapiens
auaaagcaaugugg

SEQ ID NO: 617350 - RNA, 15 nt, Homo sapiens
auaaagcaauguggu

SEQ ID NO: 617351 - RNA, 17 nt, Homo sapiens
auaaagcaaugugguag

SEQ ID NO: 617352 - RNA, 15 nt, Homo sapiens
auaaagcacugagca

SEQ ID NO: 617353 - RNA, 15 nt, Homo sapiens
auaaagcagccucau

SEQ ID NO: 617354 - RNA, 14 nt, Homo sapiens
auaaagcagcguuu

SEQ ID NO: 617355 - RNA, 18 nt, Homo sapiens
auaaagccaaauuuccag

SEQ ID NO: 617356 - RNA, 22 nt, Homo sapiens
auaaagccaaauuuccaguuua

SEQ ID NO: 617357 - RNA, 20 nt, Homo sapiens
auaaagccuguauucucaaa

SEQ ID NO: 617358 - RNA, 21 nt, Homo sapiens
auaaagcuuucagguguuaca

SEQ ID NO: 617359 - RNA, 18 nt, Homo sapiens
auaaagcuuuuccugcau

SEQ ID NO: 617360 - RNA, 14 nt, Homo sapiens
auaaaggaugugau

SEQ ID NO: 617361 - RNA, 15 nt, Homo sapiens
auaaaggcagcugcc

SEQ ID NO: 617362 - RNA, 19 nt, Homo sapiens
auaaaggcagcugccucug

SEQ ID NO: 617363 - RNA, 22 nt, Homo sapiens
auaaaggucuuugcacauguga

SEQ ID NO: 617364 - RNA, 14 nt, Homo sapiens
auaaaguaccacac

SEQ ID NO: 617365 - RNA, 20 nt, Homo sapiens
auaaaguaccacacauauug

SEQ ID NO: 617366 - RNA, 18 nt, Homo sapiens
auaaaguaguccugugaa

SEQ ID NO: 617367 - RNA, 19 nt, Homo sapiens
auaaaguauuccaccuuaa

SEQ ID NO: 617368 - RNA, 14 nt, Homo sapiens
auaaagucacuucc

SEQ ID NO: 617369 - RNA, 18 nt, Homo sapiens
auaaagucuuacugugcu

SEQ ID NO: 617370 - RNA, 15 nt, Homo sapiens
auaaaguuacuugaa

SEQ ID NO: 617371 - RNA, 14 nt, Homo sapiens
auaaaguuccuuaa

SEQ ID NO: 617372 - RNA, 19 nt, Homo sapiens
auaaauagaaagaguucua

SEQ ID NO: 617373 - RNA, 19 nt, Homo sapiens
auaaauagagcaaccagua

SEQ ID NO: 617374 - RNA, 14 nt, Homo sapiens
auaaauauacucaa

SEQ ID NO: 617375 - RNA, 15 nt, Homo sapiens
auaaauauacucaag

SEQ ID NO: 617376 - RNA, 20 nt, Homo sapiens
auaaauauacucaaguuuca

SEQ ID NO: 617377 - RNA, 19 nt, Homo sapiens
auaaauauaucuaccccag

SEQ ID NO: 617378 - RNA, 17 nt, Homo sapiens
auaaauauuacagugaa

SEQ ID NO: 617379 - RNA, 15 nt, Homo sapiens
auaaauauuauuaga

SEQ ID NO: 617380 - RNA, 17 nt, Homo sapiens
auaaaucauuaagacaa

SEQ ID NO: 617381 - RNA, 22 nt, Homo sapiens
auaaauccauccauccaaaggc

SEQ ID NO: 617382 - RNA, 16 nt, Homo sapiens
auaaauccuugaauca

SEQ ID NO: 617383 - RNA, 18 nt, Homo sapiens
auaaaugaagaaagggag

SEQ ID NO: 617384 - RNA, 16 nt, Homo sapiens
auaaaugagcaaauau

SEQ ID NO: 617385 - RNA, 20 nt, Homo sapiens
auaaauggccagugcugcuu

SEQ ID NO: 617386 - RNA, 16 nt, Homo sapiens
auaaauguaccagaga

SEQ ID NO: 617387 - RNA, 14 nt, Homo sapiens
auaaaugugaacuu

SEQ ID NO: 617388 - RNA, 13 nt, Homo sapiens
auaaauguuuaaa

SEQ ID NO: 617389 - RNA, 20 nt, Homo sapiens
auaaauuacuaucuguugaa

SEQ ID NO: 617390 - RNA, 17 nt, Homo sapiens
auaaauucagauauauu

SEQ ID NO: 617391 - RNA, 22 nt, Homo sapiens
auaaauucuauaggaacauaug

SEQ ID NO: 617392 - RNA, 14 nt, Homo sapiens
auaaauugcucaaa

SEQ ID NO: 617393 - RNA, 18 nt, Homo sapiens
auaaauugcuccuugaca

SEQ ID NO: 617394 - RNA, 21 nt, Homo sapiens
auaaauugggauaaacaucac

SEQ ID NO: 617395 - RNA, 16 nt, Homo sapiens
auaaauuugcacuguu

SEQ ID NO: 617396 - RNA, 18 nt, Homo sapiens
auaaauuuuuauuacuua

SEQ ID NO: 617397 - RNA, 18 nt, Homo sapiens
auaacaaagcacauaacu

SEQ ID NO: 617398 - RNA, 15 nt, Homo sapiens
auaacaaugacacua

SEQ ID NO: 617399 - RNA, 22 nt, Homo sapiens
auaacacagagagacagacuug

SEQ ID NO: 617400 - RNA, 15 nt, Homo sapiens
auaacauacaugaga

SEQ ID NO: 617401 - RNA, 22 nt, Homo sapiens
auaacauuuaaagagauuuccc

SEQ ID NO: 617402 - RNA, 15 nt, Homo sapiens
augcugaaacaucau

SEQ ID NO: 617403 - RNA, 22 nt, Homo sapiens
augcugaaacaucauuacagau

SEQ ID NO: 617404 - RNA, 22 nt, Homo sapiens
augcugagguuaugaacaaagu

SEQ ID NO: 617405 - RNA, 16 nt, Homo sapiens
augcugcaaaggagaa

SEQ ID NO: 617406 - RNA, 15 nt, Homo sapiens
augcugcacagaaau

SEQ ID NO: 617407 - RNA, 19 nt, Homo sapiens
augcugcaggaaaagcaaa

SEQ ID NO: 617408 - RNA, 10 nt, Homo sapiens
augcugcuau

SEQ ID NO: 617409 - RNA, 18 nt, Homo sapiens
augcugcucauccaaagu

SEQ ID NO: 617410 - RNA, 13 nt, Homo sapiens
augcuggaaccag

SEQ ID NO: 617411 - RNA, 19 nt, Homo sapiens
augcuggaaccugcaaaaa

SEQ ID NO: 617412 - RNA, 15 nt, Homo sapiens
augcuggcauuugca

SEQ ID NO: 617413 - RNA, 23 nt, Homo sapiens
augcuggcauuugcaccuaccuc

SEQ ID NO: 617414 - RNA, 20 nt, Homo sapiens
augcuggcuuguacauagua

SEQ ID NO: 617415 - RNA, 18 nt, Homo sapiens
augcugggaaugagacau

SEQ ID NO: 617416 - RNA, 14 nt, Homo sapiens
augcuguaacuuaa

SEQ ID NO: 617417 - RNA, 20 nt, Homo sapiens
augcugucaagcaccugcau

SEQ ID NO: 617418 - RNA, 19 nt, Homo sapiens
augcugugagcauuaaaua

SEQ ID NO: 617419 - RNA, 13 nt, Homo sapiens
augcuguugugaa

SEQ ID NO: 617420 - RNA, 18 nt, Homo sapiens
augcuguuugacaaaguu

SEQ ID NO: 617421 - RNA, 20 nt, Homo sapiens
augcuguuugacaaaguuac

SEQ ID NO: 617422 - RNA, 18 nt, Homo sapiens
augcuguuuguagugaaa

SEQ ID NO: 617423 - RNA, 19 nt, Homo sapiens
augcuguuuuauauguaga

SEQ ID NO: 617424 - RNA, 14 nt, Homo sapiens
augcuuacaaaguc

SEQ ID NO: 617425 - RNA, 13 nt, Homo sapiens
augcuuacuccac

SEQ ID NO: 617426 - RNA, 13 nt, Homo sapiens
augcuuagaaagu

SEQ ID NO: 617427 - RNA, 12 nt, Homo sapiens
augcuucuagcc

SEQ ID NO: 617428 - RNA, 18 nt, Homo sapiens
augcuuguauuuuacuuu

SEQ ID NO: 617429 - RNA, 17 nt, Homo sapiens
augcuuucccugaggaa

SEQ ID NO: 617430 - RNA, 21 nt, Homo sapiens
augcuuugaaagcuuauuuga

SEQ ID NO: 617431 - RNA, 21 nt, Homo sapiens
augcuuugggucauaaaucag

SEQ ID NO: 617432 - RNA, 15 nt, Homo sapiens
augcuuuuauagcug

SEQ ID NO: 617433 - RNA, 14 nt, Homo sapiens
augcuuuugcugcu

SEQ ID NO: 617434 - RNA, 22 nt, Homo sapiens
auggaaaaaagccuucacuuca

SEQ ID NO: 617435 - RNA, 17 nt, Homo sapiens
auggaaaaacugaggcu

SEQ ID NO: 617436 - RNA, 20 nt, Homo sapiens
auggaaaaucagcugcucag

SEQ ID NO: 617437 - RNA, 16 nt, Homo sapiens
auggaaacagacucau

SEQ ID NO: 617438 - RNA, 19 nt, Homo sapiens
auggaaacagacucauacc

SEQ ID NO: 617439 - RNA, 20 nt, Homo sapiens
auggaaagaaucuaauagag

SEQ ID NO: 617440 - RNA, 21 nt, Homo sapiens
auggaaaucacauuuacaaaa

SEQ ID NO: 617441 - RNA, 18 nt, Homo sapiens
auggaaauguuuacagau

SEQ ID NO: 617442 - RNA, 21 nt, Homo sapiens
auggaaauucugcucagauag

SEQ ID NO: 617443 - RNA, 20 nt, Homo sapiens
auggaacacacuuggaugca

SEQ ID NO: 617444 - RNA, 16 nt, Homo sapiens
auggaacacggccaca

SEQ ID NO: 617445 - RNA, 20 nt, Homo sapiens
auggaacagcauuacccucc

SEQ ID NO: 617446 - RNA, 14 nt, Homo sapiens
auggaaccucagga

SEQ ID NO: 617447 - RNA, 15 nt, Homo sapiens
auggaacucagagau

SEQ ID NO: 617448 - RNA, 14 nt, Homo sapiens
auggaacuguuggc

SEQ ID NO: 617449 - RNA, 16 nt, Homo sapiens
auggaacuuagccauu

SEQ ID NO: 617450 - RNA, 18 nt, Homo sapiens
auggaagcaaagacaaaa

SEQ ID NO: 617451 - RNA, 21 nt, Homo sapiens
auggaaggaagaaaagcugcc

SEQ ID NO: 617452 - RNA, 14 nt, Homo sapiens
auggaaggugcuac

SEQ ID NO: 617453 - RNA, 14 nt, Homo sapiens
auggaauaacuauc

SEQ ID NO: 617454 - RNA, 14 nt, Homo sapiens
auggaauuacaugu

SEQ ID NO: 617455 - RNA, 20 nt, Homo sapiens
auggacaaaauuaauacauu

SEQ ID NO: 617456 - RNA, 20 nt, Homo sapiens
auggacaagcagugucuguc

SEQ ID NO: 617457 - RNA, 14 nt, Homo sapiens
auggacacacaguc

SEQ ID NO: 617458 - RNA, 23 nt, Homo sapiens
auggacaccccuuauccaggacu

SEQ ID NO: 617459 - RNA, 19 nt, Homo sapiens
auggacaguggagaugaag

SEQ ID NO: 617460 - RNA, 23 nt, Homo sapiens
auggacaugugucccagccacag

SEQ ID NO: 617461 - RNA, 19 nt, Homo sapiens
auggaccaggaagcccuga

SEQ ID NO: 617462 - RNA, 23 nt, Homo sapiens
auggaccuccguggccaaaaagu

SEQ ID NO: 617463 - RNA, 20 nt, Homo sapiens
auggacucaggauccaguga

SEQ ID NO: 617464 - RNA, 23 nt, Homo sapiens
auggacuggagcucaucugcaaa

SEQ ID NO: 617465 - RNA, 11 nt, Homo sapiens
auggacugggg

SEQ ID NO: 617466 - RNA, 13 nt, Homo sapiens
auggagaacccag

SEQ ID NO: 617467 - RNA, 18 nt, Homo sapiens
auggagaaucugcugcau

SEQ ID NO: 617468 - RNA, 13 nt, Homo sapiens
auggagaccucau

SEQ ID NO: 617469 - RNA, 23 nt, Homo sapiens
auggagacguggugggacuccag

SEQ ID NO: 617470 - RNA, 16 nt, Homo sapiens
auggagaucagagguu

SEQ ID NO: 617471 - RNA, 21 nt, Homo sapiens
auggagauguugugugcaaug

SEQ ID NO: 617472 - RNA, 17 nt, Homo sapiens
auggagcaggacucuau

SEQ ID NO: 617473 - RNA, 18 nt, Homo sapiens
auggagccaugacaagaa

SEQ ID NO: 617474 - RNA, 17 nt, Homo sapiens
auggaggaauuucuuga

SEQ ID NO: 617475 - RNA, 17 nt, Homo sapiens
auggaggacuccaggca

SEQ ID NO: 617476 - RNA, 21 nt, Homo sapiens
auggaggaucucuaaagagca

SEQ ID NO: 617477 - RNA, 14 nt, Homo sapiens
auggaggcccuccu

SEQ ID NO: 617478 - RNA, 18 nt, Homo sapiens
auggagggaaugcucaga

SEQ ID NO: 617479 - RNA, 14 nt, Homo sapiens
auggaggucauaca

SEQ ID NO: 617480 - RNA, 17 nt, Homo sapiens
auggagugcaccaaaga

SEQ ID NO: 617481 - RNA, 13 nt, Homo sapiens
auggauacauaaa

SEQ ID NO: 617482 - RNA, 14 nt, Homo sapiens
auggauagucuguc

SEQ ID NO: 617483 - RNA, 15 nt, Homo sapiens
auggauauuauuaga

SEQ ID NO: 617484 - RNA, 14 nt, Homo sapiens
auggauauuucuca

SEQ ID NO: 617485 - RNA, 18 nt, Homo sapiens
auggaucuuaaagcauuc

SEQ ID NO: 617486 - RNA, 19 nt, Homo sapiens
auggaugaaacuauaacuu

SEQ ID NO: 617487 - RNA, 17 nt, Homo sapiens
auggaugauucagaaau

SEQ ID NO: 617488 - RNA, 16 nt, Homo sapiens
auggauuaaagacuua

SEQ ID NO: 617489 - RNA, 17 nt, Homo sapiens
auggauuguggaaaaug

SEQ ID NO: 617490 - RNA, 18 nt, Homo sapiens
auggauuuaugacauuac

SEQ ID NO: 617491 - RNA, 16 nt, Homo sapiens
auggauuucuuugaaa

SEQ ID NO: 617492 - RNA, 16 nt, Homo sapiens
auggauuugaugcugu

SEQ ID NO: 617493 - RNA, 22 nt, Homo sapiens
auggauuuugggagugacucaa

SEQ ID NO: 617494 - RNA, 15 nt, Homo sapiens
auggcaccgagacaa

SEQ ID NO: 617495 - RNA, 14 nt, Homo sapiens
auggcaccucugcc

SEQ ID NO: 617496 - RNA, 16 nt, Homo sapiens
auggcaccuuuugcac

SEQ ID NO: 617497 - RNA, 12 nt, Homo sapiens
auggcacuggca

SEQ ID NO: 617498 - RNA, 14 nt, Homo sapiens
auggcagaagggaa

SEQ ID NO: 617499 - RNA, 12 nt, Homo sapiens
auggcagacucu

SEQ ID NO: 617500 - RNA, 12 nt, Homo sapiens
auggcagcagug

SEQ ID NO: 617501 - RNA, 18 nt, Homo sapiens
auggcaggacuccuggca

SEQ ID NO: 617502 - RNA, 22 nt, Homo sapiens
auggcagggccucaucucaccu

SEQ ID NO: 617503 - RNA, 22 nt, Homo sapiens
auggcauaggcugacuuuugca

SEQ ID NO: 617504 - RNA, 16 nt, Homo sapiens
auggcaucagcacuuu

SEQ ID NO: 617505 - RNA, 23 nt, Homo sapiens
auggcaugaaucgggcuaagguc

SEQ ID NO: 617506 - RNA, 14 nt, Homo sapiens
auggcauugaacug

SEQ ID NO: 617507 - RNA, 19 nt, Homo sapiens
auggccaauaacuuuucac

SEQ ID NO: 617508 - RNA, 13 nt, Homo sapiens
auggccagccaac

SEQ ID NO: 617509 - RNA, 20 nt, Homo sapiens
auggccagugugaucccaag

SEQ ID NO: 617510 - RNA, 23 nt, Homo sapiens
auggcccaugggagccaggccca

SEQ ID NO: 617511 - RNA, 22 nt, Homo sapiens
auggccccuccacuggggaaug

SEQ ID NO: 617512 - RNA, 17 nt, Homo sapiens
auggccccuccuugcaa

SEQ ID NO: 617513 - RNA, 22 nt, Homo sapiens
auggccugagaugcaggugaug

SEQ ID NO: 617514 - RNA, 23 nt, Homo sapiens
auggccuugaaacaguuccauuu

SEQ ID NO: 617515 - RNA, 15 nt, Homo sapiens
auggcgcgaucucag

SEQ ID NO: 617516 - RNA, 13 nt, Homo sapiens
auggcgucugcuc

SEQ ID NO: 617517 - RNA, 15 nt, Homo sapiens
auggcuaauaccugu

SEQ ID NO: 617518 - RNA, 16 nt, Homo sapiens
auggcuaccaaaaaga

SEQ ID NO: 617519 - RNA, 19 nt, Homo sapiens
auggcuagccuuucuugua

SEQ ID NO: 617520 - RNA, 15 nt, Homo sapiens
auggcuauauggcaa

SEQ ID NO: 617521 - RNA, 17 nt, Homo sapiens
auggcucaaucuauccu

SEQ ID NO: 617522 - RNA, 15 nt, Homo sapiens
auggcucaugaccug

SEQ ID NO: 617523 - RNA, 14 nt, Homo sapiens
auggcuccagaaau

SEQ ID NO: 617524 - RNA, 13 nt, Homo sapiens
auuacuacuccuu

SEQ ID NO: 617525 - RNA, 14 nt, Homo sapiens
auuacuacuguaca

SEQ ID NO: 617526 - RNA, 15 nt, Homo sapiens
auuacuagauauuaa

SEQ ID NO: 617527 - RNA, 13 nt, Homo sapiens
auuacuaucauaa

SEQ ID NO: 617528 - RNA, 16 nt, Homo sapiens
auuacuaucauaauuc

SEQ ID NO: 617529 - RNA, 23 nt, Homo sapiens
auuacuaucauaauucagcacuu

SEQ ID NO: 617530 - RNA, 14 nt, Homo sapiens
auuacugauuuugu

SEQ ID NO: 617531 - RNA, 19 nt, Homo sapiens
auuacugcccacuugucaa

SEQ ID NO: 617532 - RNA, 20 nt, Homo sapiens
auuacugguauuaguuaaaa

SEQ ID NO: 617533 - RNA, 18 nt, Homo sapiens
auuacuguugcauuuacu

SEQ ID NO: 617534 - RNA, 21 nt, Homo sapiens
auuacuguugcauuuacuuuu

SEQ ID NO: 617535 - RNA, 21 nt, Homo sapiens
auuacuguuuugggccuccau

SEQ ID NO: 617536 - RNA, 16 nt, Homo sapiens
auuacuuguguuacuu

SEQ ID NO: 617537 - RNA, 20 nt, Homo sapiens
auuacuuucugccgcuguca

SEQ ID NO: 617538 - RNA, 11 nt, Homo sapiens
auuacuuugau

SEQ ID NO: 617539 - RNA, 21 nt, Homo sapiens
auuacuuugauaucugaucaa

SEQ ID NO: 617540 - RNA, 21 nt, Homo sapiens
auuagaaaaguuaacauuuau

SEQ ID NO: 617541 - RNA, 19 nt, Homo sapiens
auuagaaaauuuuauggac

SEQ ID NO: 617542 - RNA, 14 nt, Homo sapiens
auuagaagacauuu

SEQ ID NO: 617543 - RNA, 22 nt, Homo sapiens
auuagaagccugcagaauccag

SEQ ID NO: 617544 - RNA, 17 nt, Homo sapiens
auuagacagaacaccua

SEQ ID NO: 617545 - RNA, 13 nt, Homo sapiens
auuagagcuuaaa

SEQ ID NO: 617546 - RNA, 19 nt, Homo sapiens
auuagauugcaaagcaaug

SEQ ID NO: 617547 - RNA, 23 nt, Homo sapiens
auuagauuuggaggcuaccucac

SEQ ID NO: 617548 - RNA, 23 nt, Homo sapiens
auuagcauggccccaguccaugc

SEQ ID NO: 617549 - RNA, 13 nt, Homo sapiens
auuagccaaggau

SEQ ID NO: 617550 - RNA, 17 nt, Homo sapiens
auuagccaaguguggua

SEQ ID NO: 617551 - RNA, 23 nt, Homo sapiens
auuagccaagugugguagagugu

SEQ ID NO: 617552 - RNA, 20 nt, Homo sapiens
auuagccauuucacucucaa

SEQ ID NO: 617553 - RNA, 18 nt, Homo sapiens
auuagccggguguggcac

SEQ ID NO: 617554 - RNA, 18 nt, Homo sapiens
auuagccggucauggugg

SEQ ID NO: 617555 - RNA, 16 nt, Homo sapiens
auuagcucuggaccag

SEQ ID NO: 617556 - RNA, 19 nt, Homo sapiens
auuagcugaguguagugac

SEQ ID NO: 617557 - RNA, 17 nt, Homo sapiens
auuagcuggcgcauauu

SEQ ID NO: 617558 - RNA, 18 nt, Homo sapiens
auuagcugggaagaccaa

SEQ ID NO: 617559 - RNA, 18 nt, Homo sapiens
auuagcugggcauggugg

SEQ ID NO: 617560 - RNA, 15 nt, Homo sapiens
auuaggacuguauaa

SEQ ID NO: 617561 - RNA, 18 nt, Homo sapiens
auuaggcuguaacuacuu

SEQ ID NO: 617562 - RNA, 16 nt, Homo sapiens
auuagggacacuuuca

SEQ ID NO: 617563 - RNA, 15 nt, Homo sapiens
auuagggaugcucaa

SEQ ID NO: 617564 - RNA, 15 nt, Homo sapiens
auuagguagacuuug

SEQ ID NO: 617565 - RNA, 12 nt, Homo sapiens
auuaggucuuaa

SEQ ID NO: 617566 - RNA, 16 nt, Homo sapiens
auuaggugaagggaug

SEQ ID NO: 617567 - RNA, 19 nt, Homo sapiens
auuagguguucaggccagu

SEQ ID NO: 617568 - RNA, 18 nt, Homo sapiens
auuaguaaaagugcuuuc

SEQ ID NO: 617569 - RNA, 18 nt, Homo sapiens
auuaguacuuauguugca

SEQ ID NO: 617570 - RNA, 18 nt, Homo sapiens
auuaguaugguucaagau

SEQ ID NO: 617571 - RNA, 13 nt, Homo sapiens
auuagucuaucaa

SEQ ID NO: 617572 - RNA, 21 nt, Homo sapiens
auuagucuuuuguaauaucaa

SEQ ID NO: 617573 - RNA, 14 nt, Homo sapiens
auuagugcagccaa

SEQ ID NO: 617574 - RNA, 13 nt, Homo sapiens
auuaguuaaucuc

SEQ ID NO: 617575 - RNA, 17 nt, Homo sapiens
auuaguuggcuuucaua

SEQ ID NO: 617576 - RNA, 18 nt, Homo sapiens
auuaguugucuuuccaug

SEQ ID NO: 617577 - RNA, 16 nt, Homo sapiens
auuauaaauaaauaga

SEQ ID NO: 617578 - RNA, 14 nt, Homo sapiens
auuauaacuguaaa

SEQ ID NO: 617579 - RNA, 12 nt, Homo sapiens
auuauaccagug

SEQ ID NO: 617580 - RNA, 13 nt, Homo sapiens
auuauagaaugga

SEQ ID NO: 617581 - RNA, 21 nt, Homo sapiens
auuauagaauucuguacuuga

SEQ ID NO: 617582 - RNA, 23 nt, Homo sapiens
auuauauaaagguggugggcaaa

SEQ ID NO: 617583 - RNA, 20 nt, Homo sapiens
auuauauauuccgcacucaa

SEQ ID NO: 617584 - RNA, 16 nt, Homo sapiens
auuauaugcacuagca

SEQ ID NO: 617585 - RNA, 14 nt, Homo sapiens
auuauauguucaga

SEQ ID NO: 617586 - RNA, 16 nt, Homo sapiens
auuauauuguccaggc

SEQ ID NO: 617587 - RNA, 17 nt, Homo sapiens
auuauauuugugcuaua

SEQ ID NO: 617588 - RNA, 14 nt, Homo sapiens
auuaucaagcuuuu

SEQ ID NO: 617589 - RNA, 17 nt, Homo sapiens
auuaucacaucaagcau

SEQ ID NO: 617590 - RNA, 16 nt, Homo sapiens
auuaucacgcagauca

SEQ ID NO: 617591 - RNA, 17 nt, Homo sapiens
auuaucacgcagaucac

SEQ ID NO: 617592 - RNA, 20 nt, Homo sapiens
auuaucacuuuaaagcccuu

SEQ ID NO: 617593 - RNA, 17 nt, Homo sapiens
auuaucaugguauuuga

SEQ ID NO: 617594 - RNA, 17 nt, Homo sapiens
auuauccuguaguacaa

SEQ ID NO: 617595 - RNA, 16 nt, Homo sapiens
auuauccuucuacuug

SEQ ID NO: 617596 - RNA, 20 nt, Homo sapiens
auuauccuuuauuuuauuga

SEQ ID NO: 617597 - RNA, 17 nt, Homo sapiens
auuaucgggagcagugu

SEQ ID NO: 617598 - RNA, 19 nt, Homo sapiens
auuaucuaaaaucugcuag

SEQ ID NO: 617599 - RNA, 18 nt, Homo sapiens
auuaucuagauacuguau

SEQ ID NO: 617600 - RNA, 13 nt, Homo sapiens
auuaucucacuua

SEQ ID NO: 617601 - RNA, 15 nt, Homo sapiens
auuaucugugucaaa

SEQ ID NO: 617602 - RNA, 15 nt, Homo sapiens
auuaugaaaguagua

SEQ ID NO: 617603 - RNA, 20 nt, Homo sapiens
auuaugaguaguguggaauu

SEQ ID NO: 617604 - RNA, 17 nt, Homo sapiens
auuaugauugcauugua

SEQ ID NO: 617605 - RNA, 20 nt, Homo sapiens
auuaugcauuauaucaaauc

SEQ ID NO: 617606 - RNA, 18 nt, Homo sapiens
auuaugccauagcaagau

SEQ ID NO: 617607 - RNA, 13 nt, Homo sapiens
auuaugcuuugaa

SEQ ID NO: 617608 - RNA, 21 nt, Homo sapiens
auuauggaaaacuguguugcc

SEQ ID NO: 617609 - RNA, 19 nt, Homo sapiens
auuauggggacuuugguuu

SEQ ID NO: 617610 - RNA, 13 nt, Homo sapiens
auuaugugacuug

SEQ ID NO: 617611 - RNA, 16 nt, Homo sapiens
auuaugugacuugcaa

SEQ ID NO: 617612 - RNA, 17 nt, Homo sapiens
auuaugugacuugcaau

SEQ ID NO: 617613 - RNA, 19 nt, Homo sapiens
auuauuacucuacacugaa

SEQ ID NO: 617614 - RNA, 17 nt, Homo sapiens
auuauuagacucuaaaa

SEQ ID NO: 617615 - RNA, 14 nt, Homo sapiens
auuauuauccuccu

SEQ ID NO: 617616 - RNA, 15 nt, Homo sapiens
auuauuauucaaaaa

SEQ ID NO: 617617 - RNA, 18 nt, Homo sapiens
auuauuccaaaccaaauu

SEQ ID NO: 617618 - RNA, 16 nt, Homo sapiens
auuauuccccuaggcu

SEQ ID NO: 617619 - RNA, 23 nt, Homo sapiens
auuauuccuccaggaaggagcaa

SEQ ID NO: 617620 - RNA, 11 nt, Homo sapiens
auuauucugau

SEQ ID NO: 617621 - RNA, 21 nt, Homo sapiens
auuauucugauuccacuuuua

SEQ ID NO: 617622 - RNA, 22 nt, Homo sapiens
auuauucuuguaguuuaccucu

SEQ ID NO: 617623 - RNA, 13 nt, Homo sapiens
auuauugacacug

SEQ ID NO: 617624 - RNA, 17 nt, Homo sapiens
auuauuuaaacucgcuc

SEQ ID NO: 617625 - RNA, 15 nt, Homo sapiens
auuauuuacugacau

SEQ ID NO: 617626 - RNA, 19 nt, Homo sapiens
auuauuuauucagcuucau

SEQ ID NO: 617627 - RNA, 17 nt, Homo sapiens
auuauuucaacuaaugu

SEQ ID NO: 617628 - RNA, 22 nt, Homo sapiens
auuauuuccaguguucuaugaa

SEQ ID NO: 617629 - RNA, 14 nt, Homo sapiens
auuauuugcauguu

SEQ ID NO: 617630 - RNA, 22 nt, Homo sapiens
auuauuugcuauggcaggauaa

SEQ ID NO: 617631 - RNA, 20 nt, Homo sapiens
auuauuuggagccugccaag

SEQ ID NO: 617632 - RNA, 23 nt, Homo sapiens
auuauuugggagggaaaagggaa

SEQ ID NO: 617633 - RNA, 16 nt, Homo sapiens
auuauuuuacaaucaa

SEQ ID NO: 617634 - RNA, 17 nt, Homo sapiens
auuauuuuacaaucaac

SEQ ID NO: 617635 - RNA, 16 nt, Homo sapiens
auuauuuucacuguag

SEQ ID NO: 617636 - RNA, 20 nt, Homo sapiens
auuauuuucucuuaacaaga

SEQ ID NO: 617637 - RNA, 15 nt, Homo sapiens
auuauuuucugcuac

SEQ ID NO: 617638 - RNA, 16 nt, Homo sapiens
auuauuuucugucaga

SEQ ID NO: 617639 - RNA, 19 nt, Homo sapiens
auuauuuuuuauacuguau

SEQ ID NO: 617640 - RNA, 18 nt, Homo sapiens
auuauuuuuucugugguc

SEQ ID NO: 617641 - RNA, 16 nt, Homo sapiens
auucaaaaauuaucua

SEQ ID NO: 617642 - RNA, 20 nt, Homo sapiens
auucaaaagguuauauacca

SEQ ID NO: 617643 - RNA, 13 nt, Homo sapiens
auucaaaauauaa

SEQ ID NO: 617644 - RNA, 21 nt, Homo sapiens
auucaaagcauggacauuuag

SEQ ID NO: 617645 - RNA, 13 nt, Homo sapiens
auucaaagcugcu

SEQ ID NO: 617646 - RNA, 17 nt, Homo sapiens
auuguguuccugaagaa

SEQ ID NO: 617647 - RNA, 12 nt, Homo sapiens
auuguguucucu

SEQ ID NO: 617648 - RNA, 22 nt, Homo sapiens
auuguguucucuauugcugcuc

SEQ ID NO: 617649 - RNA, 16 nt, Homo sapiens
auuguuaaaauaacua

SEQ ID NO: 617650 - RNA, 18 nt, Homo sapiens
auuguuacauaguuaaau

SEQ ID NO: 617651 - RNA, 14 nt, Homo sapiens
auuguucaaagcca

SEQ ID NO: 617652 - RNA, 16 nt, Homo sapiens
auuguucaucaugaca

SEQ ID NO: 617653 - RNA, 15 nt, Homo sapiens
auuguuccaagacau

SEQ ID NO: 617654 - RNA, 21 nt, Homo sapiens
auuguucuuauccucaauuca

SEQ ID NO: 617655 - RNA, 19 nt, Homo sapiens
auuguugauuuuguucaca

SEQ ID NO: 617656 - RNA, 21 nt, Homo sapiens
auuguuggaguguaaaccaaa

SEQ ID NO: 617657 - RNA, 19 nt, Homo sapiens
auuguuguaagagugauuu

SEQ ID NO: 617658 - RNA, 13 nt, Homo sapiens
auuguuguugcca

SEQ ID NO: 617659 - RNA, 15 nt, Homo sapiens
auuguuguugccaaa

SEQ ID NO: 617660 - RNA, 18 nt, Homo sapiens
auuguuuaagccagagug

SEQ ID NO: 617661 - RNA, 19 nt, Homo sapiens
auuguuucaagacugacau

SEQ ID NO: 617662 - RNA, 20 nt, Homo sapiens
auuguuugugacccugagaa

SEQ ID NO: 617663 - RNA, 14 nt, Homo sapiens
auuguuuucagugu

SEQ ID NO: 617664 - RNA, 18 nt, Homo sapiens
auuguuuugaccccuuac

SEQ ID NO: 617665 - RNA, 17 nt, Homo sapiens
auuguuuugccacuuag

SEQ ID NO: 617666 - RNA, 16 nt, Homo sapiens
auuguuuuugaauuua

SEQ ID NO: 617667 - RNA, 19 nt, Homo sapiens
auuuaaaaaaaaagucaga

SEQ ID NO: 617668 - RNA, 21 nt, Homo sapiens
auuuaaaacagacacuggcau

SEQ ID NO: 617669 - RNA, 18 nt, Homo sapiens
auuuaaaacaucauuacu

SEQ ID NO: 617670 - RNA, 14 nt, Homo sapiens
auuuaaaacuugcc

SEQ ID NO: 617671 - RNA, 18 nt, Homo sapiens
auuuaaaagcaucucagc

SEQ ID NO: 617672 - RNA, 20 nt, Homo sapiens
auuuaaaaggacugcugauu

SEQ ID NO: 617673 - RNA, 17 nt, Homo sapiens
auuuaaaauugcuaugu

SEQ ID NO: 617674 - RNA, 18 nt, Homo sapiens
auuuaaacaccuccucau

SEQ ID NO: 617675 - RNA, 14 nt, Homo sapiens
auuuaaacucugcc

SEQ ID NO: 617676 - RNA, 21 nt, Homo sapiens
auuuaaagaaaauaaacacca

SEQ ID NO: 617677 - RNA, 23 nt, Homo sapiens
auuuaaagaaaauaaacaccauu

SEQ ID NO: 617678 - RNA, 15 nt, Homo sapiens
auuuaaagacaaaga

SEQ ID NO: 617679 - RNA, 13 nt, Homo sapiens
auuuaaagcacau

SEQ ID NO: 617680 - RNA, 22 nt, Homo sapiens
auuuaaaggggagauacucucc

SEQ ID NO: 617681 - RNA, 18 nt, Homo sapiens
auuuaaaguaaggccuuu

SEQ ID NO: 617682 - RNA, 13 nt, Homo sapiens
auuuaaaugggaa

SEQ ID NO: 617683 - RNA, 15 nt, Homo sapiens
auuuaaauguaacuu

SEQ ID NO: 617684 - RNA, 22 nt, Homo sapiens
auuuaaauguuaugacuaugua

SEQ ID NO: 617685 - RNA, 17 nt, Homo sapiens
auuuaaauuccacagau

SEQ ID NO: 617686 - RNA, 20 nt, Homo sapiens
auuuaacaaaaagugcuuca

SEQ ID NO: 617687 - RNA, 11 nt, Homo sapiens
auuuaacuuaa

SEQ ID NO: 617688 - RNA, 20 nt, Homo sapiens
auuuaacuuacacugaucaa

SEQ ID NO: 617689 - RNA, 15 nt, Homo sapiens
auuuaagaaacuuau

SEQ ID NO: 617690 - RNA, 15 nt, Homo sapiens
auuuaagacuaugau

SEQ ID NO: 617691 - RNA, 13 nt, Homo sapiens
auuuaaggcaaaa

SEQ ID NO: 617692 - RNA, 16 nt, Homo sapiens
auuuaagguacuuaaa

SEQ ID NO: 617693 - RNA, 20 nt, Homo sapiens
auuuaaguauggaauauuca

SEQ ID NO: 617694 - RNA, 13 nt, Homo sapiens
auuuaaguuaaau

SEQ ID NO: 617695 - RNA, 16 nt, Homo sapiens
auuuaauauaaaccuc

SEQ ID NO: 617696 - RNA, 14 nt, Homo sapiens
auuuaauaugucaa

SEQ ID NO: 617697 - RNA, 17 nt, Homo sapiens
auuuaaucaccacucaa

SEQ ID NO: 617698 - RNA, 19 nt, Homo sapiens
auuuaaugaauacuugcua

SEQ ID NO: 617699 - RNA, 13 nt, Homo sapiens
auuuaaugcugcc

SEQ ID NO: 617700 - RNA, 17 nt, Homo sapiens
auuuaauggcaaugcaa

SEQ ID NO: 617701 - RNA, 13 nt, Homo sapiens
auuuaaugucauu

SEQ ID NO: 617702 - RNA, 16 nt, Homo sapiens
auuuaauucaccucag

SEQ ID NO: 617703 - RNA, 19 nt, Homo sapiens
auuuaauuucuucauguga

SEQ ID NO: 617704 - RNA, 16 nt, Homo sapiens
auuuacaaagugugua

SEQ ID NO: 617705 - RNA, 18 nt, Homo sapiens
auuuacagccucacuuga

SEQ ID NO: 617706 - RNA, 20 nt, Homo sapiens
auuuacauacucugcuuaga

SEQ ID NO: 617707 - RNA, 17 nt, Homo sapiens
auuuaccagcagcccug

SEQ ID NO: 617708 - RNA, 14 nt, Homo sapiens
auuuaccagcuuaa

SEQ ID NO: 617709 - RNA, 17 nt, Homo sapiens
auuuaccuauacauuau

SEQ ID NO: 617710 - RNA, 20 nt, Homo sapiens
auuuacucugcuccaaagua

SEQ ID NO: 617711 - RNA, 19 nt, Homo sapiens
auuuacugacauauaucua

SEQ ID NO: 617712 - RNA, 22 nt, Homo sapiens
auuuacugcucuagaaaguaua

SEQ ID NO: 617713 - RNA, 16 nt, Homo sapiens
auuuacuuaagacuua

SEQ ID NO: 617714 - RNA, 21 nt, Homo sapiens
auuuacuuagcagaaccacau

SEQ ID NO: 617715 - RNA, 12 nt, Homo sapiens
auuuagaacuug

SEQ ID NO: 617716 - RNA, 21 nt, Homo sapiens
auuuagaauauguuaaugcaa

SEQ ID NO: 617717 - RNA, 18 nt, Homo sapiens
auuuagaccccauacaag

SEQ ID NO: 617718 - RNA, 17 nt, Homo sapiens
auuuagacucaucuuac

SEQ ID NO: 617719 - RNA, 21 nt, Homo sapiens
auuuagacucaucuuacugua

SEQ ID NO: 617720 - RNA, 14 nt, Homo sapiens
auuuagagccauua

SEQ ID NO: 617721 - RNA, 17 nt, Homo sapiens
auuuagauauaacacua

SEQ ID NO: 617722 - RNA, 18 nt, Homo sapiens
auuuagauauaacacuau

SEQ ID NO: 617723 - RNA, 16 nt, Homo sapiens
auuuagauaugcaaaa

SEQ ID NO: 617724 - RNA, 22 nt, Homo sapiens
auuuagauccugguuucauaac

SEQ ID NO: 617725 - RNA, 21 nt, Homo sapiens
auuuaggaaaugggcagugaa

SEQ ID NO: 617726 - RNA, 18 nt, Homo sapiens
auuuaggaccaauaccuc

SEQ ID NO: 617727 - RNA, 18 nt, Homo sapiens
auuuaguaaagcuuuucu

SEQ ID NO: 617728 - RNA, 22 nt, Homo sapiens
auuuaguagaaaggucauccaa

SEQ ID NO: 617729 - RNA, 17 nt, Homo sapiens
auuuagucacaccaucu

SEQ ID NO: 617730 - RNA, 17 nt, Homo sapiens
auuuagugaauggcauu

SEQ ID NO: 617731 - RNA, 14 nt, Homo sapiens
auuuagugacuuaa

SEQ ID NO: 617732 - RNA, 19 nt, Homo sapiens
auuuauaaaacuucucaag

SEQ ID NO: 617733 - RNA, 21 nt, Homo sapiens
auuuauaaaacuucucaagau

SEQ ID NO: 617734 - RNA, 20 nt, Homo sapiens
auuuauaauaaaucaguaua

SEQ ID NO: 617735 - RNA, 19 nt, Homo sapiens
auuuauaauguuaguagaa

SEQ ID NO: 617736 - RNA, 14 nt, Homo sapiens
auuuauacagcaga

SEQ ID NO: 617737 - RNA, 23 nt, Homo sapiens
auuuauauaaaauguuuaaucuc

SEQ ID NO: 617738 - RNA, 13 nt, Homo sapiens
auuuauaucuaau

SEQ ID NO: 617739 - RNA, 23 nt, Homo sapiens
auuuauauguaaacaagcaauaa

SEQ ID NO: 617740 - RNA, 13 nt, Homo sapiens
auuuauauuucaa

SEQ ID NO: 617741 - RNA, 14 nt, Homo sapiens
auuuaucagugaca

SEQ ID NO: 617742 - RNA, 22 nt, Homo sapiens
auuuauccuauaagaugacaau

SEQ ID NO: 617743 - RNA, 22 nt, Homo sapiens
auuuaucguauagguugaugaa

SEQ ID NO: 617744 - RNA, 22 nt, Homo sapiens
auuuaucuauaauuuaccuaag

SEQ ID NO: 617745 - RNA, 17 nt, Homo sapiens
auuuaucugagcaauaa

SEQ ID NO: 617746 - RNA, 15 nt, Homo sapiens
auuuaucugugcaaa

SEQ ID NO: 617747 - RNA, 19 nt, Homo sapiens
auuuaucugugcaaauccu

SEQ ID NO: 617748 - RNA, 17 nt, Homo sapiens
auuuaucuuuaccaaaa

SEQ ID NO: 617749 - RNA, 12 nt, Homo sapiens
auuuaucuuuag

SEQ ID NO: 617750 - RNA, 16 nt, Homo sapiens
auuuaugaccuaaguc

SEQ ID NO: 617751 - RNA, 19 nt, Homo sapiens
auuuaugagaaaguucuca

SEQ ID NO: 617752 - RNA, 21 nt, Homo sapiens
auuuaugagaaauauuugaag

SEQ ID NO: 617753 - RNA, 17 nt, Homo sapiens
auuuaugaugcaguuuc

SEQ ID NO: 617754 - RNA, 15 nt, Homo sapiens
auuuaugcaacucau

SEQ ID NO: 617755 - RNA, 20 nt, Homo sapiens
auuuauggucaacacuuaag

SEQ ID NO: 617756 - RNA, 18 nt, Homo sapiens
auuuauguggauuuugca

SEQ ID NO: 617757 - RNA, 16 nt, Homo sapiens
auuuauuaacuaauca

SEQ ID NO: 617758 - RNA, 14 nt, Homo sapiens
auuuauuaccucug

SEQ ID NO: 617759 - RNA, 17 nt, Homo sapiens
auuuauuaccucugaua

SEQ ID NO: 617760 - RNA, 13 nt, Homo sapiens
auuuauuacugaa

SEQ ID NO: 617761 - RNA, 15 nt, Homo sapiens
auuuauuauuaacau

SEQ ID NO: 617762 - RNA, 14 nt, Homo sapiens
auuuauuauuucaa

SEQ ID NO: 617763 - RNA, 12 nt, Homo sapiens
auuuauucacau

SEQ ID NO: 617764 - RNA, 14 nt, Homo sapiens
auuuauucugaaga

SEQ ID NO: 617765 - RNA, 16 nt, Homo sapiens
auuuauucugccaaac

SEQ ID NO: 617766 - RNA, 19 nt, Homo sapiens
auuuauucuucuuuuccaa

SEQ ID NO: 617767 - RNA, 22 nt, Homo sapiens
auuuauugguuuugcagaagaa

SEQ ID NO: 617768 - RNA, 15 nt, Homo sapiens
auuuuugcucugccc

SEQ ID NO: 617769 - RNA, 15 nt, Homo sapiens
auuuuugcuuagcuc

SEQ ID NO: 617770 - RNA, 22 nt, Homo sapiens
auuuuugcuuguuucugauuaa

SEQ ID NO: 617771 - RNA, 18 nt, Homo sapiens
auuuuugguauuuaugua

SEQ ID NO: 617772 - RNA, 19 nt, Homo sapiens
auuuuugugaaaaugucaa

SEQ ID NO: 617773 - RNA, 14 nt, Homo sapiens
auuuuugugcacau

SEQ ID NO: 617774 - RNA, 21 nt, Homo sapiens
auuuuuguuagcaaagauuaa

SEQ ID NO: 617775 - RNA, 20 nt, Homo sapiens
auuuuuuaagguaacaaaua

SEQ ID NO: 617776 - RNA, 12 nt, Homo sapiens
auuuuuuaaucc

SEQ ID NO: 617777 - RNA, 21 nt, Homo sapiens
auuuuuuacagcugccugcag

SEQ ID NO: 617778 - RNA, 14 nt, Homo sapiens
auuuuuuauacugu

SEQ ID NO: 617779 - RNA, 22 nt, Homo sapiens
auuuuuuauuucuaaguauuua

SEQ ID NO: 617780 - RNA, 23 nt, Homo sapiens
auuuuuucucuguaaacuuccaa

SEQ ID NO: 617781 - RNA, 14 nt, Homo sapiens
auuuuuugccauuu

SEQ ID NO: 617782 - RNA, 14 nt, Homo sapiens
auuuuuugcuacuu

SEQ ID NO: 617783 - RNA, 15 nt, Homo sapiens
auuuuuugguacaaa

SEQ ID NO: 617784 - RNA, 14 nt, Homo sapiens
auuuuuugugauca

SEQ ID NO: 617785 - RNA, 15 nt, Homo sapiens
auuuuuuuaaucguc

SEQ ID NO: 617786 - RNA, 14 nt, Homo sapiens
auuuuuuugcaagu

SEQ ID NO: 617787 - RNA, 21 nt, Homo sapiens
auuuuuuuuuuuaagcucaaa

SEQ ID NO: 617788 - RNA, 20 nt, Homo sapiens
auuuuuuuuuuuuacuugaa

SEQ ID NO: 617789 - RNA, 19 nt, Homo sapiens
caaaaaaaaaaaaaugcac

SEQ ID NO: 617790 - RNA, 16 nt, Homo sapiens
caaaaaaacaaaaaag

SEQ ID NO: 617791 - RNA, 21 nt, Homo sapiens
caaaaaaaccucuaugcaauc

SEQ ID NO: 617792 - RNA, 15 nt, Homo sapiens
caaaaaacccaagaa

SEQ ID NO: 617793 - RNA, 16 nt, Homo sapiens
caaaaaacuacuucuu

SEQ ID NO: 617794 - RNA, 14 nt, Homo sapiens
caaaaaaucugacc

SEQ ID NO: 617795 - RNA, 17 nt, Homo sapiens
caaaaaaucugaccaaa

SEQ ID NO: 617796 - RNA, 20 nt, Homo sapiens
caaaaacaaaaaaccacaaa

SEQ ID NO: 617797 - RNA, 23 nt, Homo sapiens
caaaaacauguaugugcauuuca

SEQ ID NO: 617798 - RNA, 12 nt, Homo sapiens
caaaaacauuuc

SEQ ID NO: 617799 - RNA, 18 nt, Homo sapiens
caaaaaccauguugcguu

SEQ ID NO: 617800 - RNA, 15 nt, Homo sapiens
caaaaacuguacugu

SEQ ID NO: 617801 - RNA, 13 nt, Homo sapiens
caaaaacuuugga

SEQ ID NO: 617802 - RNA, 19 nt, Homo sapiens
caaaaagagacccacaaua

SEQ ID NO: 617803 - RNA, 21 nt, Homo sapiens
caaaaagagacccacaauaaa

SEQ ID NO: 617804 - RNA, 18 nt, Homo sapiens
caaaaagccacaaugaac

SEQ ID NO: 617805 - RNA, 15 nt, Homo sapiens
caaaaagcuucccca

SEQ ID NO: 617806 - RNA, 16 nt, Homo sapiens
caaaaaggcauaugca

SEQ ID NO: 617807 - RNA, 13 nt, Homo sapiens
caaaaaguuccau

SEQ ID NO: 617808 - RNA, 17 nt, Homo sapiens
caaaaauaaacgaacuc

SEQ ID NO: 617809 - RNA, 17 nt, Homo sapiens
caaaaauagacaacugu

SEQ ID NO: 617810 - RNA, 20 nt, Homo sapiens
caaaaauauaaccauuacau

SEQ ID NO: 617811 - RNA, 22 nt, Homo sapiens
caaaaaucuguguaacuguaaa

SEQ ID NO: 617812 - RNA, 22 nt, Homo sapiens
caaaaaugaacugaaguuucac

SEQ ID NO: 617813 - RNA, 19 nt, Homo sapiens
caaaaauggauauuauuag

SEQ ID NO: 617814 - RNA, 18 nt, Homo sapiens
caaaaauguaaugaucau

SEQ ID NO: 617815 - RNA, 17 nt, Homo sapiens
caaaaauguccagccac

SEQ ID NO: 617816 - RNA, 23 nt, Homo sapiens
caaaaauguuguauuggcuauga

SEQ ID NO: 617817 - RNA, 15 nt, Homo sapiens
caaaaauuagcugug

SEQ ID NO: 617818 - RNA, 14 nt, Homo sapiens
caaaaauuaucuau

SEQ ID NO: 617819 - RNA, 18 nt, Homo sapiens
caaaaauucacaaauggg

SEQ ID NO: 617820 - RNA, 11 nt, Homo sapiens
caaaaauugac

SEQ ID NO: 617821 - RNA, 17 nt, Homo sapiens
caaaaauugucccuuaa

SEQ ID NO: 617822 - RNA, 14 nt, Homo sapiens
caaaacaaaaagau

SEQ ID NO: 617823 - RNA, 17 nt, Homo sapiens
caaaacaaguuggaugc

SEQ ID NO: 617824 - RNA, 16 nt, Homo sapiens
caaaacaaucucucaa

SEQ ID NO: 617825 - RNA, 11 nt, Homo sapiens
caaaacacagg

SEQ ID NO: 617826 - RNA, 18 nt, Homo sapiens
caaaacagagaugugaua

SEQ ID NO: 617827 - RNA, 15 nt, Homo sapiens
caaaacaguaaaaau

SEQ ID NO: 617828 - RNA, 17 nt, Homo sapiens
caaaacaguaauuuccu

SEQ ID NO: 617829 - RNA, 18 nt, Homo sapiens
caaaacaucucugcaguu

SEQ ID NO: 617830 - RNA, 15 nt, Homo sapiens
caaaacccacagaag

SEQ ID NO: 617831 - RNA, 12 nt, Homo sapiens
caaaacccaggg

SEQ ID NO: 617832 - RNA, 16 nt, Homo sapiens
caaaaccucaaaccag

SEQ ID NO: 617833 - RNA, 12 nt, Homo sapiens
caaaaccugcuu

SEQ ID NO: 617834 - RNA, 19 nt, Homo sapiens
caaaacggaugaguuauua

SEQ ID NO: 617835 - RNA, 23 nt, Homo sapiens
caaaacguugaauugaugaugca

SEQ ID NO: 617836 - RNA, 14 nt, Homo sapiens
caaaacuacaaauc

SEQ ID NO: 617837 - RNA, 14 nt, Homo sapiens
caaaacuacugaca

SEQ ID NO: 617838 - RNA, 13 nt, Homo sapiens
caaaacucaguag

SEQ ID NO: 617839 - RNA, 22 nt, Homo sapiens
caaaacucuccuacacuuccau

SEQ ID NO: 617840 - RNA, 16 nt, Homo sapiens
caaaacugacaguaaa

SEQ ID NO: 617841 - RNA, 13 nt, Homo sapiens
caaaacugccuca

SEQ ID NO: 617842 - RNA, 13 nt, Homo sapiens
caaaacuguccag

SEQ ID NO: 617843 - RNA, 13 nt, Homo sapiens
caaaacuuaggca

SEQ ID NO: 617844 - RNA, 14 nt, Homo sapiens
caaaacuucagugu

SEQ ID NO: 617845 - RNA, 14 nt, Homo sapiens
caaaacuuuggcac

SEQ ID NO: 617846 - RNA, 16 nt, Homo sapiens
caaaagaaagaaccac

SEQ ID NO: 617847 - RNA, 12 nt, Homo sapiens
caaaagcacuua

SEQ ID NO: 617848 - RNA, 20 nt, Homo sapiens
caaaagcaguaaauuugcua

SEQ ID NO: 617849 - RNA, 18 nt, Homo sapiens
caaaagccauguauuuca

SEQ ID NO: 617850 - RNA, 13 nt, Homo sapiens
caaaagcccaaug

SEQ ID NO: 617851 - RNA, 20 nt, Homo sapiens
caaaagcugcucagggaaaa

SEQ ID NO: 617852 - RNA, 20 nt, Homo sapiens
caaaagcuguaaauuacuau

SEQ ID NO: 617853 - RNA, 15 nt, Homo sapiens
caaaagcuuuuuacu

SEQ ID NO: 617854 - RNA, 20 nt, Homo sapiens
caaaaggcccuuuucagggc

SEQ ID NO: 617855 - RNA, 18 nt, Homo sapiens
caaaagggcagcugugau

SEQ ID NO: 617856 - RNA, 17 nt, Homo sapiens
caaaagggccauguuuc

SEQ ID NO: 617857 - RNA, 11 nt, Homo sapiens
caaaaguagag

SEQ ID NO: 617858 - RNA, 22 nt, Homo sapiens
caaaaguggggcuaaaugaagu

SEQ ID NO: 617859 - RNA, 14 nt, Homo sapiens
caaaaguucccuga

SEQ ID NO: 617860 - RNA, 21 nt, Homo sapiens
caaaaguuucuuacucaagga

SEQ ID NO: 617861 - RNA, 18 nt, Homo sapiens
caaaauacagcuaugaag

SEQ ID NO: 617862 - RNA, 12 nt, Homo sapiens
caaaauaccuuc

SEQ ID NO: 617863 - RNA, 17 nt, Homo sapiens
caaaauagucuucucaa

SEQ ID NO: 617864 - RNA, 23 nt, Homo sapiens
caaaauagucuucucaaauuaga

SEQ ID NO: 617865 - RNA, 15 nt, Homo sapiens
caaaauaguuuuaaa

SEQ ID NO: 617866 - RNA, 15 nt, Homo sapiens
caaaauauacauuca

SEQ ID NO: 617867 - RNA, 12 nt, Homo sapiens
caaaauauguca

SEQ ID NO: 617868 - RNA, 17 nt, Homo sapiens
caaaauauuuaagugaa

SEQ ID NO: 617869 - RNA, 21 nt, Homo sapiens
caaaauauuuggaaugaagga

SEQ ID NO: 617870 - RNA, 16 nt, Homo sapiens
caaaauauuuuuugca

SEQ ID NO: 617871 - RNA, 13 nt, Homo sapiens
caaaaucaauuaa

SEQ ID NO: 617872 - RNA, 16 nt, Homo sapiens
caaaaucacacagcca

SEQ ID NO: 617873 - RNA, 20 nt, Homo sapiens
caaaaucaugugacaauaau

SEQ ID NO: 617874 - RNA, 22 nt, Homo sapiens
caaaauccaaaaagcucugaaa

SEQ ID NO: 617875 - RNA, 23 nt, Homo sapiens
caaaauccaugugaccauucugc

SEQ ID NO: 617876 - RNA, 19 nt, Homo sapiens
caaaaucuuguuaauguca

SEQ ID NO: 617877 - RNA, 18 nt, Homo sapiens
caaaaugaauucugggaa

SEQ ID NO: 617878 - RNA, 16 nt, Homo sapiens
caaaaugauacuuacu

SEQ ID NO: 617879 - RNA, 14 nt, Homo sapiens
caaaaugcucaagg

SEQ ID NO: 617880 - RNA, 21 nt, Homo sapiens
caaaauggacguacugguuua

SEQ ID NO: 617881 - RNA, 17 nt, Homo sapiens
caaaauggauacauaaa

SEQ ID NO: 617882 - RNA, 17 nt, Homo sapiens
caaaauguaaagccagc

SEQ ID NO: 617883 - RNA, 13 nt, Homo sapiens
caaaauguuuaua

SEQ ID NO: 617884 - RNA, 18 nt, Homo sapiens
caaaauucuuaaguaugu

SEQ ID NO: 617885 - RNA, 16 nt, Homo sapiens
caaaauuguuuaccau

SEQ ID NO: 617886 - RNA, 12 nt, Homo sapiens
caaaauuugcaa

SEQ ID NO: 617887 - RNA, 17 nt, Homo sapiens
caaaauuugggggaaaa

SEQ ID NO: 617888 - RNA, 19 nt, Homo sapiens
caaaauuuuacaguaauaa

SEQ ID NO: 617889 - RNA, 22 nt, Homo sapiens
caaaauuuuguaaauaugcaaa

SEQ ID NO: 617890 - RNA, 22 nt, Homo sapiens
caaacaaugcauaggauuccaa

SEQ ID NO: 617891 - RNA, 19 nt, Homo sapiens
cagaaguccccucuacuuu

SEQ ID NO: 617892 - RNA, 16 nt, Homo sapiens
cagaaguuaguuugua

SEQ ID NO: 617893 - RNA, 16 nt, Homo sapiens
cagaaguuugagauca

SEQ ID NO: 617894 - RNA, 23 nt, Homo sapiens
cagaauaaaagaugauuucucaa

SEQ ID NO: 617895 - RNA, 13 nt, Homo sapiens
cagaauaauacaa

SEQ ID NO: 617896 - RNA, 21 nt, Homo sapiens
cagaauaaugaauggacucaa

SEQ ID NO: 617897 - RNA, 16 nt, Homo sapiens
cagaauacuugcacuc

SEQ ID NO: 617898 - RNA, 23 nt, Homo sapiens
cagaauauuaauaaaacuuuaug

SEQ ID NO: 617899 - RNA, 21 nt, Homo sapiens
cagaaucaagcuuuugcuuga

SEQ ID NO: 617900 - RNA, 20 nt, Homo sapiens
cagaaucauaugauucugcu

SEQ ID NO: 617901 - RNA, 12 nt, Homo sapiens
cagaauccagcu

SEQ ID NO: 617902 - RNA, 20 nt, Homo sapiens
cagaauccugaugguaucaa

SEQ ID NO: 617903 - RNA, 23 nt, Homo sapiens
cagaaucucauagguugccaaua

SEQ ID NO: 617904 - RNA, 22 nt, Homo sapiens
cagaaugaaucuaugcuggaua

SEQ ID NO: 617905 - RNA, 12 nt, Homo sapiens
cagaaugaauuc

SEQ ID NO: 617906 - RNA, 14 nt, Homo sapiens
cagaaugacuccac

SEQ ID NO: 617907 - RNA, 22 nt, Homo sapiens
cagaaugcugcaggacuugaga

SEQ ID NO: 617908 - RNA, 13 nt, Homo sapiens
cagaauggcauuu

SEQ ID NO: 617909 - RNA, 15 nt, Homo sapiens
cagaauggcauuugc

SEQ ID NO: 617910 - RNA, 16 nt, Homo sapiens
cagaauggcauuugca

SEQ ID NO: 617911 - RNA, 21 nt, Homo sapiens
cagaaugggggcuuucgggga

SEQ ID NO: 617912 - RNA, 15 nt, Homo sapiens
cagaauguaaagguu

SEQ ID NO: 617913 - RNA, 12 nt, Homo sapiens
cagaauguaucu

SEQ ID NO: 617914 - RNA, 18 nt, Homo sapiens
cagaauguaucugugaag

SEQ ID NO: 617915 - RNA, 11 nt, Homo sapiens
cagaaugucac

SEQ ID NO: 617916 - RNA, 17 nt, Homo sapiens
cagaaugugauauccua

SEQ ID NO: 617917 - RNA, 13 nt, Homo sapiens
cagaauguguuau

SEQ ID NO: 617918 - RNA, 21 nt, Homo sapiens
cagaauuauccauuacgugca

SEQ ID NO: 617919 - RNA, 22 nt, Homo sapiens
cagaauucaaaagugauuaucu

SEQ ID NO: 617920 - RNA, 18 nt, Homo sapiens
cagaauucggugugcugc

SEQ ID NO: 617921 - RNA, 18 nt, Homo sapiens
cagaauugacugcaguug

SEQ ID NO: 617922 - RNA, 18 nt, Homo sapiens
cagaauuuaagcaagaaa

SEQ ID NO: 617923 - RNA, 18 nt, Homo sapiens
cagaauuuggaaauccua

SEQ ID NO: 617924 - RNA, 17 nt, Homo sapiens
cagaauuuuuaacaaaa

SEQ ID NO: 617925 - RNA, 13 nt, Homo sapiens
cagacaaaccuug

SEQ ID NO: 617926 - RNA, 12 nt, Homo sapiens
cagacaacacug

SEQ ID NO: 617927 - RNA, 16 nt, Homo sapiens
cagacaacacugggaa

SEQ ID NO: 617928 - RNA, 21 nt, Homo sapiens
cagacaacacugggaaacaga

SEQ ID NO: 617929 - RNA, 13 nt, Homo sapiens
cagacaagcacua

SEQ ID NO: 617930 - RNA, 22 nt, Homo sapiens
cagacacacacacgcacgcaca

SEQ ID NO: 617931 - RNA, 15 nt, Homo sapiens
cagacacacccagug

SEQ ID NO: 617932 - RNA, 14 nt, Homo sapiens
cagacacagacugg

SEQ ID NO: 617933 - RNA, 16 nt, Homo sapiens
cagacacagacuggca

SEQ ID NO: 617934 - RNA, 14 nt, Homo sapiens
cagacaccuggacu

SEQ ID NO: 617935 - RNA, 20 nt, Homo sapiens
cagacacgauugagaacuga

SEQ ID NO: 617936 - RNA, 14 nt, Homo sapiens
cagacacucugacu

SEQ ID NO: 617937 - RNA, 14 nt, Homo sapiens
cagacacugagcuu

SEQ ID NO: 617938 - RNA, 17 nt, Homo sapiens
cagacagcaguccuuca

SEQ ID NO: 617939 - RNA, 23 nt, Homo sapiens
cagacagcuuacagaaugggaga

SEQ ID NO: 617940 - RNA, 17 nt, Homo sapiens
cagacauguggugggac

SEQ ID NO: 617941 - RNA, 19 nt, Homo sapiens
cagaccaacccugggaccu

SEQ ID NO: 617942 - RNA, 16 nt, Homo sapiens
cagaccaaccuuccau

SEQ ID NO: 617943 - RNA, 14 nt, Homo sapiens
cagaccacuugcca

SEQ ID NO: 617944 - RNA, 17 nt, Homo sapiens
cagaccaguacugggaa

SEQ ID NO: 617945 - RNA, 17 nt, Homo sapiens
cagaccaugaaguaaau

SEQ ID NO: 617946 - RNA, 23 nt, Homo sapiens
cagacccagcuuagaguucuucu

SEQ ID NO: 617947 - RNA, 13 nt, Homo sapiens
cagacccagugag

SEQ ID NO: 617948 - RNA, 15 nt, Homo sapiens
cagaccccaaaccag

SEQ ID NO: 617949 - RNA, 16 nt, Homo sapiens
cagaccccaugccuua

SEQ ID NO: 617950 - RNA, 20 nt, Homo sapiens
cagaccccgggucuccuugg

SEQ ID NO: 617951 - RNA, 21 nt, Homo sapiens
cagaccccuccccucguguca

SEQ ID NO: 617952 - RNA, 14 nt, Homo sapiens
cagacccugaaccc

SEQ ID NO: 617953 - RNA, 15 nt, Homo sapiens
cagaccgccagugac

SEQ ID NO: 617954 - RNA, 13 nt, Homo sapiens
cagaccucaaggg

SEQ ID NO: 617955 - RNA, 20 nt, Homo sapiens
cagaccugugugugccucca

SEQ ID NO: 617956 - RNA, 23 nt, Homo sapiens
cagaccuugggggaagacuuuaa

SEQ ID NO: 617957 - RNA, 15 nt, Homo sapiens
cagacgauuguucuu

SEQ ID NO: 617958 - RNA, 16 nt, Homo sapiens
cagacgauuguucuua

SEQ ID NO: 617959 - RNA, 20 nt, Homo sapiens
cagacgggaaugccuagguc

SEQ ID NO: 617960 - RNA, 16 nt, Homo sapiens
cagacggugugcacca

SEQ ID NO: 617961 - RNA, 13 nt, Homo sapiens
cagacguugccug

SEQ ID NO: 617962 - RNA, 20 nt, Homo sapiens
cagacuacacaggaugaggu

SEQ ID NO: 617963 - RNA, 21 nt, Homo sapiens
cagacuacuucuuccccagau

SEQ ID NO: 617964 - RNA, 21 nt, Homo sapiens
cagacuagaaguuccuaguga

SEQ ID NO: 617965 - RNA, 19 nt, Homo sapiens
cagacuaucguaaccuggu

SEQ ID NO: 617966 - RNA, 21 nt, Homo sapiens
cagacuaugaauauuauagua

SEQ ID NO: 617967 - RNA, 22 nt, Homo sapiens
cagacuauggauguguucucua

SEQ ID NO: 617968 - RNA, 16 nt, Homo sapiens
cagacucagacuccau

SEQ ID NO: 617969 - RNA, 20 nt, Homo sapiens
cagacucccacucaguacug

SEQ ID NO: 617970 - RNA, 15 nt, Homo sapiens
cagacuccugugcaa

SEQ ID NO: 617971 - RNA, 18 nt, Homo sapiens
cagacuccugugcaacuu

SEQ ID NO: 617972 - RNA, 19 nt, Homo sapiens
cagacucgcuagcacucaa

SEQ ID NO: 617973 - RNA, 16 nt, Homo sapiens
cagacucuggucuucu

SEQ ID NO: 617974 - RNA, 21 nt, Homo sapiens
cagacugaaacgccuugcacg

SEQ ID NO: 617975 - RNA, 19 nt, Homo sapiens
cagacugacaguuuacaga

SEQ ID NO: 617976 - RNA, 17 nt, Homo sapiens
cagacugaugagcacau

SEQ ID NO: 617977 - RNA, 15 nt, Homo sapiens
cagacugaugccaga

SEQ ID NO: 617978 - RNA, 19 nt, Homo sapiens
cagacugcagacauucuca

SEQ ID NO: 617979 - RNA, 20 nt, Homo sapiens
cagacuggauuuuugcucug

SEQ ID NO: 617980 - RNA, 12 nt, Homo sapiens
cagacuggcaau

SEQ ID NO: 617981 - RNA, 18 nt, Homo sapiens
cagacuggcaauaaacuc

SEQ ID NO: 617982 - RNA, 21 nt, Homo sapiens
cagacuggcaauaaacuccua

SEQ ID NO: 617983 - RNA, 22 nt, Homo sapiens
cagacuggcaauaaacuccuac

SEQ ID NO: 617984 - RNA, 18 nt, Homo sapiens
cagacuguaggauuugaa

SEQ ID NO: 617985 - RNA, 13 nt, Homo sapiens
cagacuuaaauca

SEQ ID NO: 617986 - RNA, 14 nt, Homo sapiens
cagacuucccugaa

SEQ ID NO: 617987 - RNA, 14 nt, Homo sapiens
cagacuugaauaca

SEQ ID NO: 617988 - RNA, 21 nt, Homo sapiens
cagacuugaaugcuaguuaua

SEQ ID NO: 617989 - RNA, 21 nt, Homo sapiens
cagacuugccaggcucccuuu

SEQ ID NO: 617990 - RNA, 16 nt, Homo sapiens
cagagaaaagacauaa

SEQ ID NO: 617991 - RNA, 15 nt, Homo sapiens
cagagaaaaugaauu

SEQ ID NO: 617992 - RNA, 18 nt, Homo sapiens
cagagaaagaaagggaaa

SEQ ID NO: 617993 - RNA, 17 nt, Homo sapiens
cagagaaauacuuucag

SEQ ID NO: 617994 - RNA, 15 nt, Homo sapiens
cagagaaccaaaggg

SEQ ID NO: 617995 - RNA, 17 nt, Homo sapiens
cagagaaccagugcaga

SEQ ID NO: 617996 - RNA, 20 nt, Homo sapiens
cagagaacugcagaccucac

SEQ ID NO: 617997 - RNA, 20 nt, Homo sapiens
cagagaacuggaaagacaua

SEQ ID NO: 617998 - RNA, 18 nt, Homo sapiens
cagagaagcggauuucca

SEQ ID NO: 617999 - RNA, 20 nt, Homo sapiens
cagagaaucauacuuagcaa

SEQ ID NO: 618000 - RNA, 14 nt, Homo sapiens
cagagacaccugca

SEQ ID NO: 618001 - RNA, 22 nt, Homo sapiens
cagagacacuaacgacuucagg

SEQ ID NO: 618002 - RNA, 16 nt, Homo sapiens
cagagacagauaccuc

SEQ ID NO: 618003 - RNA, 16 nt, Homo sapiens
cagagacaggaaaauc

SEQ ID NO: 618004 - RNA, 22 nt, Homo sapiens
cagagaccagcacucagccuca

SEQ ID NO: 618005 - RNA, 23 nt, Homo sapiens
cagagacugcagggguccacugu

SEQ ID NO: 618006 - RNA, 19 nt, Homo sapiens
cagagagaccucauccugc

SEQ ID NO: 618007 - RNA, 15 nt, Homo sapiens
cagagagaggcauuu

SEQ ID NO: 618008 - RNA, 15 nt, Homo sapiens
cagagagcaacucug

SEQ ID NO: 618009 - RNA, 18 nt, Homo sapiens
cagagaggaggggaccaa

SEQ ID NO: 618010 - RNA, 15 nt, Homo sapiens
cagagaggcaagguu

SEQ ID NO: 618011 - RNA, 20 nt, Homo sapiens
cagagaggccuuuuguuuaa

SEQ ID NO: 618012 - RNA, 20 nt, Homo sapiens
cagagagguggggauccugc

SEQ ID NO: 618013 - RNA, 16 nt, Homo sapiens
cagcucuucaacauga

SEQ ID NO: 618014 - RNA, 16 nt, Homo sapiens
cagcucuucacagucc

SEQ ID NO: 618015 - RNA, 19 nt, Homo sapiens
cagcucuuccgaaaaccag

SEQ ID NO: 618016 - RNA, 13 nt, Homo sapiens
cagcugacuaaac

SEQ ID NO: 618017 - RNA, 24 nt, Homo sapiens
cagcugacuuuucuguccgagcuu

SEQ ID NO: 618018 - RNA, 15 nt, Homo sapiens
cagcugaggacacac

SEQ ID NO: 618019 - RNA, 18 nt, Homo sapiens
cagcugcucccacacuug

SEQ ID NO: 618020 - RNA, 19 nt, Homo sapiens
cagcuggaagggucaacau

SEQ ID NO: 618021 - RNA, 21 nt, Homo sapiens
cagcuggaagggucaacaucu

SEQ ID NO: 618022 - RNA, 22 nt, Homo sapiens
cagcuggcgaacccugggccau

SEQ ID NO: 618023 - RNA, 22 nt, Homo sapiens
cagcugggagacacagcaagac

SEQ ID NO: 618024 - RNA, 14 nt, Homo sapiens
cagcugggcagggu

SEQ ID NO: 618025 - RNA, 11 nt, Homo sapiens
cagcugggcuc

SEQ ID NO: 618026 - RNA, 18 nt, Homo sapiens
cagcuggggaaaucaaaa

SEQ ID NO: 618027 - RNA, 17 nt, Homo sapiens
cagcugguccuguggau

SEQ ID NO: 618028 - RNA, 17 nt, Homo sapiens
cagcugguucgugguuu

SEQ ID NO: 618029 - RNA, 22 nt, Homo sapiens
cagcuguaagaagagacuggga

SEQ ID NO: 618030 - RNA, 11 nt, Homo sapiens
cagcugucaca

SEQ ID NO: 618031 - RNA, 22 nt, Homo sapiens
cagcugucagaacacuccaagc

SEQ ID NO: 618032 - RNA, 21 nt, Homo sapiens
cagcugugcacuuucuucucu

SEQ ID NO: 618033 - RNA, 17 nt, Homo sapiens
cagcugugcugggugag

SEQ ID NO: 618034 - RNA, 12 nt, Homo sapiens
cagcugugcugu

SEQ ID NO: 618035 - RNA, 13 nt, Homo sapiens
cagcugugcugua

SEQ ID NO: 618036 - RNA, 16 nt, Homo sapiens
cagcuguggcuucuag

SEQ ID NO: 618037 - RNA, 18 nt, Homo sapiens
cagcugugggacaauuau

SEQ ID NO: 618038 - RNA, 19 nt, Homo sapiens
cagcuguuacuuucuuuca

SEQ ID NO: 618039 - RNA, 13 nt, Homo sapiens
cagcuguuuaugc

SEQ ID NO: 618040 - RNA, 13 nt, Homo sapiens
cagcuuaaaccca

SEQ ID NO: 618041 - RNA, 19 nt, Homo sapiens
cagcuuagaaugcaucuca

SEQ ID NO: 618042 - RNA, 20 nt, Homo sapiens
cagcuuagaaugcaucucau

SEQ ID NO: 618043 - RNA, 17 nt, Homo sapiens
cagcuuauauucaucca

SEQ ID NO: 618044 - RNA, 13 nt, Homo sapiens
cagcuuaucucag

SEQ ID NO: 618045 - RNA, 22 nt, Homo sapiens
cagcuuaucucaggggugugcg

SEQ ID NO: 618046 - RNA, 16 nt, Homo sapiens
cagcuucaacuuuucu

SEQ ID NO: 618047 - RNA, 15 nt, Homo sapiens
cagcuucacucgaca

SEQ ID NO: 618048 - RNA, 12 nt, Homo sapiens
cagcuucaugaa

SEQ ID NO: 618049 - RNA, 14 nt, Homo sapiens
cagcuuccaaacau

SEQ ID NO: 618050 - RNA, 19 nt, Homo sapiens
cagcuucccaaguagcugg

SEQ ID NO: 618051 - RNA, 22 nt, Homo sapiens
cagcuucuaaucccagcacuuu

SEQ ID NO: 618052 - RNA, 20 nt, Homo sapiens
cagcuucucuacagacucca

SEQ ID NO: 618053 - RNA, 21 nt, Homo sapiens
cagcuucucuacagacuccaa

SEQ ID NO: 618054 - RNA, 17 nt, Homo sapiens
cagcuucucuccacuga

SEQ ID NO: 618055 - RNA, 15 nt, Homo sapiens
cagcuucuuuugcca

SEQ ID NO: 618056 - RNA, 22 nt, Homo sapiens
cagcuugaaccugcuuccuggc

SEQ ID NO: 618057 - RNA, 13 nt, Homo sapiens
cagcuugccaaau

SEQ ID NO: 618058 - RNA, 17 nt, Homo sapiens
cagcuuucaagugccuu

SEQ ID NO: 618059 - RNA, 18 nt, Homo sapiens
cagcuuucugugcagaga

SEQ ID NO: 618060 - RNA, 14 nt, Homo sapiens
cagcuuugcaguga

SEQ ID NO: 618061 - RNA, 19 nt, Homo sapiens
cagcuuuuguuguuuauau

SEQ ID NO: 618062 - RNA, 14 nt, Homo sapiens
caggaaaaaaacuu

SEQ ID NO: 618063 - RNA, 13 nt, Homo sapiens
caggaaacauuca

SEQ ID NO: 618064 - RNA, 23 nt, Homo sapiens
caggaaaccacaaccuugcagua

SEQ ID NO: 618065 - RNA, 19 nt, Homo sapiens
caggaaacgagacuuucca

SEQ ID NO: 618066 - RNA, 17 nt, Homo sapiens
caggaaacuaauuuccu

SEQ ID NO: 618067 - RNA, 14 nt, Homo sapiens
caggaaacuagcuu

SEQ ID NO: 618068 - RNA, 21 nt, Homo sapiens
caggaaacuccacaucugccu

SEQ ID NO: 618069 - RNA, 20 nt, Homo sapiens
caggaaagcuggugucugau

SEQ ID NO: 618070 - RNA, 18 nt, Homo sapiens
caggaaagggagggaaua

SEQ ID NO: 618071 - RNA, 12 nt, Homo sapiens
caggaaauuacu

SEQ ID NO: 618072 - RNA, 17 nt, Homo sapiens
caggaacaaacagggcu

SEQ ID NO: 618073 - RNA, 22 nt, Homo sapiens
caggaacaauaaaaugucuucu

SEQ ID NO: 618074 - RNA, 14 nt, Homo sapiens
caggaagaggccca

SEQ ID NO: 618075 - RNA, 18 nt, Homo sapiens
caggaagaguucuauccc

SEQ ID NO: 618076 - RNA, 19 nt, Homo sapiens
caggaagaucccccagaaa

SEQ ID NO: 618077 - RNA, 13 nt, Homo sapiens
caggaagcucucu

SEQ ID NO: 618078 - RNA, 20 nt, Homo sapiens
caggaaggaacaaagacagg

SEQ ID NO: 618079 - RNA, 15 nt, Homo sapiens
caggaaggaccccac

SEQ ID NO: 618080 - RNA, 19 nt, Homo sapiens
caggaagggagaacuugaa

SEQ ID NO: 618081 - RNA, 22 nt, Homo sapiens
caggaaggggaaacacagcuga

SEQ ID NO: 618082 - RNA, 21 nt, Homo sapiens
caggaagggugggaagggaua

SEQ ID NO: 618083 - RNA, 18 nt, Homo sapiens
caggaagucuucagggaa

SEQ ID NO: 618084 - RNA, 18 nt, Homo sapiens
caggaagugucuagagga

SEQ ID NO: 618085 - RNA, 19 nt, Homo sapiens
caggaauccccaacaugca

SEQ ID NO: 618086 - RNA, 19 nt, Homo sapiens
caggaauggcuugccuaag

SEQ ID NO: 618087 - RNA, 22 nt, Homo sapiens
caggaauuugagaguucacaga

SEQ ID NO: 618088 - RNA, 16 nt, Homo sapiens
caggacagaaagaucu

SEQ ID NO: 618089 - RNA, 15 nt, Homo sapiens
caggacagguggugc

SEQ ID NO: 618090 - RNA, 19 nt, Homo sapiens
caggacagucaaggugaua

SEQ ID NO: 618091 - RNA, 11 nt, Homo sapiens
caggacauaua

SEQ ID NO: 618092 - RNA, 12 nt, Homo sapiens
caggacaucucu

SEQ ID NO: 618093 - RNA, 14 nt, Homo sapiens
caggacccugcuga

SEQ ID NO: 618094 - RNA, 20 nt, Homo sapiens
caggacccugggaccacaga

SEQ ID NO: 618095 - RNA, 19 nt, Homo sapiens
caggacuccaucucuuaaa

SEQ ID NO: 618096 - RNA, 20 nt, Homo sapiens
caggacuccaucucuuaaaa

SEQ ID NO: 618097 - RNA, 14 nt, Homo sapiens
caggacuccuggca

SEQ ID NO: 618098 - RNA, 19 nt, Homo sapiens
caggacucugacgucucuu

SEQ ID NO: 618099 - RNA, 18 nt, Homo sapiens
caggacugccauuggacu

SEQ ID NO: 618100 - RNA, 15 nt, Homo sapiens
caggacugugccuga

SEQ ID NO: 618101 - RNA, 20 nt, Homo sapiens
caggacuugagaagaccuca

SEQ ID NO: 618102 - RNA, 23 nt, Homo sapiens
caggagaaucacuugaacccagg

SEQ ID NO: 618103 - RNA, 18 nt, Homo sapiens
caggagacagaccacuug

SEQ ID NO: 618104 - RNA, 13 nt, Homo sapiens
caggagacauaua

SEQ ID NO: 618105 - RNA, 13 nt, Homo sapiens
caggagacugggc

SEQ ID NO: 618106 - RNA, 21 nt, Homo sapiens
caggagagaaugcccagugac

SEQ ID NO: 618107 - RNA, 19 nt, Homo sapiens
caggagagacagugaggcu

SEQ ID NO: 618108 - RNA, 22 nt, Homo sapiens
caggagaggggcagaacagccg

SEQ ID NO: 618109 - RNA, 18 nt, Homo sapiens
caggagagucacuugaac

SEQ ID NO: 618110 - RNA, 21 nt, Homo sapiens
caggagauuccagucuacuug

SEQ ID NO: 618111 - RNA, 16 nt, Homo sapiens
caggagcaacagccua

SEQ ID NO: 618112 - RNA, 15 nt, Homo sapiens
caggagcaaucacag

SEQ ID NO: 618113 - RNA, 17 nt, Homo sapiens
caggagcauggggauaa

SEQ ID NO: 618114 - RNA, 22 nt, Homo sapiens
caggagcucaggaagaagagau

SEQ ID NO: 618115 - RNA, 18 nt, Homo sapiens
caggagcugauggcagcu

SEQ ID NO: 618116 - RNA, 17 nt, Homo sapiens
caggaggaucacuugag

SEQ ID NO: 618117 - RNA, 20 nt, Homo sapiens
caggaggcagagguugcagu

SEQ ID NO: 618118 - RNA, 13 nt, Homo sapiens
caggaggccaaua

SEQ ID NO: 618119 - RNA, 20 nt, Homo sapiens
caggaggcggagguugcagu

SEQ ID NO: 618120 - RNA, 15 nt, Homo sapiens
caggaggcugaggca

SEQ ID NO: 618121 - RNA, 23 nt, Homo sapiens
caggagggcagaccacauugcuu

SEQ ID NO: 618122 - RNA, 15 nt, Homo sapiens
caggagguuguggau

SEQ ID NO: 618123 - RNA, 20 nt, Homo sapiens
caggagguuguggaugcucc

SEQ ID NO: 618124 - RNA, 13 nt, Homo sapiens
caggagugacuca

SEQ ID NO: 618125 - RNA, 12 nt, Homo sapiens
caggagugccag

SEQ ID NO: 618126 - RNA, 20 nt, Homo sapiens
caggagugccaggaccagcc

SEQ ID NO: 618127 - RNA, 19 nt, Homo sapiens
caggaguucgagaccagcc

SEQ ID NO: 618128 - RNA, 22 nt, Homo sapiens
caggaguuugaggcugcagcga

SEQ ID NO: 618129 - RNA, 21 nt, Homo sapiens
caggaguuuuaaguccagcuu

SEQ ID NO: 618130 - RNA, 15 nt, Homo sapiens
caggauacucuguca

SEQ ID NO: 618131 - RNA, 17 nt, Homo sapiens
caggauauccuuaucag

SEQ ID NO: 618132 - RNA, 23 nt, Homo sapiens
caggauauggcuuaggaaugacu

SEQ ID NO: 618133 - RNA, 23 nt, Homo sapiens
caggaucacaagaaucaccucaa

SEQ ID NO: 618134 - RNA, 16 nt, Homo sapiens
caguccaagaccccaa

SEQ ID NO: 618135 - RNA, 22 nt, Homo sapiens
caguccaggaugcuaacaucua

SEQ ID NO: 618136 - RNA, 21 nt, Homo sapiens
caguccaucccagagggaccg

SEQ ID NO: 618137 - RNA, 13 nt, Homo sapiens
caguccauuuccu

SEQ ID NO: 618138 - RNA, 16 nt, Homo sapiens
cagucccacacugugc

SEQ ID NO: 618139 - RNA, 15 nt, Homo sapiens
cagucccaguauucu

SEQ ID NO: 618140 - RNA, 12 nt, Homo sapiens
cagucccggggg

SEQ ID NO: 618141 - RNA, 18 nt, Homo sapiens
cagucccgucgugcaguc

SEQ ID NO: 618142 - RNA, 12 nt, Homo sapiens
caguccuacuca

SEQ ID NO: 618143 - RNA, 15 nt, Homo sapiens
caguccucacugucc

SEQ ID NO: 618144 - RNA, 14 nt, Homo sapiens
caguccugcuccag

SEQ ID NO: 618145 - RNA, 23 nt, Homo sapiens
caguccugggagaaccucaggcu

SEQ ID NO: 618146 - RNA, 15 nt, Homo sapiens
caguccugugugagg

SEQ ID NO: 618147 - RNA, 12 nt, Homo sapiens
caguccuuccac

SEQ ID NO: 618148 - RNA, 21 nt, Homo sapiens
cagucgaugcguucacuccaa

SEQ ID NO: 618149 - RNA, 14 nt, Homo sapiens
cagucgcccggggc

SEQ ID NO: 618150 - RNA, 16 nt, Homo sapiens
cagucggcugaacucu

SEQ ID NO: 618151 - RNA, 20 nt, Homo sapiens
cagucucauuuugacagcau

SEQ ID NO: 618152 - RNA, 16 nt, Homo sapiens
cagucuccccacucca

SEQ ID NO: 618153 - RNA, 19 nt, Homo sapiens
cagucuggccacugucaag

SEQ ID NO: 618154 - RNA, 20 nt, Homo sapiens
cagucuguacagaaugcuau

SEQ ID NO: 618155 - RNA, 21 nt, Homo sapiens
cagucuuauuuccaaguaaga

SEQ ID NO: 618156 - RNA, 17 nt, Homo sapiens
cagucuuccuuguggaa

SEQ ID NO: 618157 - RNA, 19 nt, Homo sapiens
cagucuucucucacuuuga

SEQ ID NO: 618158 - RNA, 18 nt, Homo sapiens
cagucuugcaacagugcc

SEQ ID NO: 618159 - RNA, 14 nt, Homo sapiens
cagucuugccuagg

SEQ ID NO: 618160 - RNA, 12 nt, Homo sapiens
cagucuuucuau

SEQ ID NO: 618161 - RNA, 14 nt, Homo sapiens
cagucuuugcucag

SEQ ID NO: 618162 - RNA, 15 nt, Homo sapiens
cagugaacauuccca

SEQ ID NO: 618163 - RNA, 17 nt, Homo sapiens
cagugaagacuaugaaa

SEQ ID NO: 618164 - RNA, 18 nt, Homo sapiens
cagugaaggucuuuguua

SEQ ID NO: 618165 - RNA, 21 nt, Homo sapiens
cagugaaggucuuuguuauga

SEQ ID NO: 618166 - RNA, 20 nt, Homo sapiens
cagugaaguaaaauugagug

SEQ ID NO: 618167 - RNA, 15 nt, Homo sapiens
cagugaaguacaccu

SEQ ID NO: 618168 - RNA, 16 nt, Homo sapiens
cagugacaaagacucc

SEQ ID NO: 618169 - RNA, 19 nt, Homo sapiens
cagugacaacaucgcaaua

SEQ ID NO: 618170 - RNA, 16 nt, Homo sapiens
cagugacaaggcccug

SEQ ID NO: 618171 - RNA, 15 nt, Homo sapiens
cagugaccccugacc

SEQ ID NO: 618172 - RNA, 19 nt, Homo sapiens
cagugaccccugaccucac

SEQ ID NO: 618173 - RNA, 23 nt, Homo sapiens
cagugaccccugaccucacugug

SEQ ID NO: 618174 - RNA, 23 nt, Homo sapiens
cagugacugggggaggaccugcu

SEQ ID NO: 618175 - RNA, 17 nt, Homo sapiens
cagugacuuugagcuga

SEQ ID NO: 618176 - RNA, 15 nt, Homo sapiens
cagugagaagcugag

SEQ ID NO: 618177 - RNA, 14 nt, Homo sapiens
cagugagauaucau

SEQ ID NO: 618178 - RNA, 16 nt, Homo sapiens
cagugagaugagggau

SEQ ID NO: 618179 - RNA, 14 nt, Homo sapiens
cagugagccaagau

SEQ ID NO: 618180 - RNA, 19 nt, Homo sapiens
cagugagccgagaucacac

SEQ ID NO: 618181 - RNA, 17 nt, Homo sapiens
cagugagccgagaucau

SEQ ID NO: 618182 - RNA, 21 nt, Homo sapiens
cagugagccgagauugcacca

SEQ ID NO: 618183 - RNA, 22 nt, Homo sapiens
cagugagccgcaucuucuccau

SEQ ID NO: 618184 - RNA, 19 nt, Homo sapiens
cagugagcugagauugugc

SEQ ID NO: 618185 - RNA, 23 nt, Homo sapiens
cagugaggaacccugaucucuca

SEQ ID NO: 618186 - RNA, 11 nt, Homo sapiens
cagugaucuca

SEQ ID NO: 618187 - RNA, 23 nt, Homo sapiens
cagugaugcugugcuaugaauuu

SEQ ID NO: 618188 - RNA, 13 nt, Homo sapiens
cagugcaaaccac

SEQ ID NO: 618189 - RNA, 19 nt, Homo sapiens
cagugcaaauuguaucuua

SEQ ID NO: 618190 - RNA, 22 nt, Homo sapiens
cagugcacauuucauaguuuca

SEQ ID NO: 618191 - RNA, 12 nt, Homo sapiens
cagugcacugaa

SEQ ID NO: 618192 - RNA, 16 nt, Homo sapiens
cagugcacuguauaua

SEQ ID NO: 618193 - RNA, 10 nt, Homo sapiens
cagugcaguu

SEQ ID NO: 618194 - RNA, 13 nt, Homo sapiens
cagugcaguuucu

SEQ ID NO: 618195 - RNA, 14 nt, Homo sapiens
cagugcaguuucuu

SEQ ID NO: 618196 - RNA, 13 nt, Homo sapiens
cagugcauuugcc

SEQ ID NO: 618197 - RNA, 22 nt, Homo sapiens
cagugcauuuuguuucuguaua

SEQ ID NO: 618198 - RNA, 18 nt, Homo sapiens
cagugccaugacugagaa

SEQ ID NO: 618199 - RNA, 19 nt, Homo sapiens
cagugcccaugaaugggac

SEQ ID NO: 618200 - RNA, 23 nt, Homo sapiens
cagugccccagggaguccagggu

SEQ ID NO: 618201 - RNA, 14 nt, Homo sapiens
cagugcccucacag

SEQ ID NO: 618202 - RNA, 16 nt, Homo sapiens
cagugcccucauuuua

SEQ ID NO: 618203 - RNA, 22 nt, Homo sapiens
cagugccgcucuguagagggua

SEQ ID NO: 618204 - RNA, 10 nt, Homo sapiens
cagugccugu

SEQ ID NO: 618205 - RNA, 15 nt, Homo sapiens
cagugccuuccauaa

SEQ ID NO: 618206 - RNA, 23 nt, Homo sapiens
cagugcuaaaauucagaugcugu

SEQ ID NO: 618207 - RNA, 13 nt, Homo sapiens
cagugcucauuca

SEQ ID NO: 618208 - RNA, 17 nt, Homo sapiens
cagugcucauucaucac

SEQ ID NO: 618209 - RNA, 14 nt, Homo sapiens
cagugcugcuguaa

SEQ ID NO: 618210 - RNA, 16 nt, Homo sapiens
cagugcugcuguaaau

SEQ ID NO: 618211 - RNA, 23 nt, Homo sapiens
cagugcugcuguaaauacaggaa

SEQ ID NO: 618212 - RNA, 16 nt, Homo sapiens
cagugcuguaaacuua

SEQ ID NO: 618213 - RNA, 22 nt, Homo sapiens
cagugcugugucauuccaaaua

SEQ ID NO: 618214 - RNA, 15 nt, Homo sapiens
caguggaauugugaa

SEQ ID NO: 618215 - RNA, 21 nt, Homo sapiens
caguggacccuggaccauucc

SEQ ID NO: 618216 - RNA, 19 nt, Homo sapiens
caguggagaagacauucug

SEQ ID NO: 618217 - RNA, 19 nt, Homo sapiens
caguggccacguucaggga

SEQ ID NO: 618218 - RNA, 23 nt, Homo sapiens
caguggcccauaaguguaaaaua

SEQ ID NO: 618219 - RNA, 15 nt, Homo sapiens
caguggcgugaucuc

SEQ ID NO: 618220 - RNA, 16 nt, Homo sapiens
caguggcgugaucucg

SEQ ID NO: 618221 - RNA, 14 nt, Homo sapiens
caguggcuaccuac

SEQ ID NO: 618222 - RNA, 17 nt, Homo sapiens
caguggcuggugcccau

SEQ ID NO: 618223 - RNA, 14 nt, Homo sapiens
caguggcuuugcau

SEQ ID NO: 618224 - RNA, 21 nt, Homo sapiens
cagugggaaacaaacugucua

SEQ ID NO: 618225 - RNA, 16 nt, Homo sapiens
cagugggagcccugac

SEQ ID NO: 618226 - RNA, 21 nt, Homo sapiens
cagugggcguugggagccuag

SEQ ID NO: 618227 - RNA, 19 nt, Homo sapiens
caguggggccuguggaaug

SEQ ID NO: 618228 - RNA, 18 nt, Homo sapiens
cagugguaaaaguauuug

SEQ ID NO: 618229 - RNA, 21 nt, Homo sapiens
cagugguagagucauguuugc

SEQ ID NO: 618230 - RNA, 16 nt, Homo sapiens
cagugguauccuguga

SEQ ID NO: 618231 - RNA, 17 nt, Homo sapiens
cagugguauccugugac

SEQ ID NO: 618232 - RNA, 18 nt, Homo sapiens
caguggugauguaaaaau

SEQ ID NO: 618233 - RNA, 21 nt, Homo sapiens
cagugguucguuuaccaaaua

SEQ ID NO: 618234 - RNA, 19 nt, Homo sapiens
cagugguugaugaaagcca

SEQ ID NO: 618235 - RNA, 19 nt, Homo sapiens
cagugguuuuauacugaag

SEQ ID NO: 618236 - RNA, 13 nt, Homo sapiens
caguguacaugga

SEQ ID NO: 618237 - RNA, 19 nt, Homo sapiens
caguguagcccacacuuga

SEQ ID NO: 618238 - RNA, 21 nt, Homo sapiens
caguguagcccacacuugaga

SEQ ID NO: 618239 - RNA, 14 nt, Homo sapiens
cagugucacucugu

SEQ ID NO: 618240 - RNA, 20 nt, Homo sapiens
cagugucacugaguccuuga

SEQ ID NO: 618241 - RNA, 21 nt, Homo sapiens
caguguccccuccacugucac

SEQ ID NO: 618242 - RNA, 17 nt, Homo sapiens
cagugucccuuuugcua

SEQ ID NO: 618243 - RNA, 19 nt, Homo sapiens
caguguccugugcuuucug

SEQ ID NO: 618244 - RNA, 15 nt, Homo sapiens
cagugucuuccauaa

SEQ ID NO: 618245 - RNA, 14 nt, Homo sapiens
cagugugacaucua

SEQ ID NO: 618246 - RNA, 11 nt, Homo sapiens
cagugugcaua

SEQ ID NO: 618247 - RNA, 21 nt, Homo sapiens
caguguggccaggcugccugg

SEQ ID NO: 618248 - RNA, 21 nt, Homo sapiens
caguguguaaauaauuugcac

SEQ ID NO: 618249 - RNA, 20 nt, Homo sapiens
cagugugugugggugaaaug

SEQ ID NO: 618250 - RNA, 21 nt, Homo sapiens
caguguguguuuaacauucac

SEQ ID NO: 618251 - RNA, 19 nt, Homo sapiens
caguguuacuguguuuauc

SEQ ID NO: 618252 - RNA, 17 nt, Homo sapiens
caguguuauuaaugaca

SEQ ID NO: 618253 - RNA, 20 nt, Homo sapiens
caguguuauuaaugacaaag

SEQ ID NO: 618254 - RNA, 20 nt, Homo sapiens
caguguucuaugaacaacuc

SEQ ID NO: 618255 - RNA, 11 nt, Homo sapiens
caguguugccc

SEQ ID NO: 618256 - RNA, 18 nt, Homo sapiens
caucagcaagacuuuaua

SEQ ID NO: 618257 - RNA, 19 nt, Homo sapiens
caucagcagagaacuggaa

SEQ ID NO: 618258 - RNA, 20 nt, Homo sapiens
caucagcaggaaugcucuga

SEQ ID NO: 618259 - RNA, 18 nt, Homo sapiens
caucagccauuugccauc

SEQ ID NO: 618260 - RNA, 15 nt, Homo sapiens
caucagcccaucuca

SEQ ID NO: 618261 - RNA, 23 nt, Homo sapiens
caucagccccacaggacuuugau

SEQ ID NO: 618262 - RNA, 13 nt, Homo sapiens
caucagccugcuu

SEQ ID NO: 618263 - RNA, 15 nt, Homo sapiens
caucaggaaacagga

SEQ ID NO: 618264 - RNA, 13 nt, Homo sapiens
caucaggacucug

SEQ ID NO: 618265 - RNA, 18 nt, Homo sapiens
caucaggccuguuuuaga

SEQ ID NO: 618266 - RNA, 12 nt, Homo sapiens
caucagggacag

SEQ ID NO: 618267 - RNA, 23 nt, Homo sapiens
caucaggguaggggagcauucug

SEQ ID NO: 618268 - RNA, 15 nt, Homo sapiens
caucagucaacaacu

SEQ ID NO: 618269 - RNA, 17 nt, Homo sapiens
caucagugcucccucac

SEQ ID NO: 618270 - RNA, 22 nt, Homo sapiens
caucaguguccucuugcucaaa

SEQ ID NO: 618271 - RNA, 22 nt, Homo sapiens
caucaguguggcuucuaugagc

SEQ ID NO: 618272 - RNA, 15 nt, Homo sapiens
caucaguuacagaga

SEQ ID NO: 618273 - RNA, 21 nt, Homo sapiens
caucaucacgacacauuugcc

SEQ ID NO: 618274 - RNA, 11 nt, Homo sapiens
caucaucccag

SEQ ID NO: 618275 - RNA, 19 nt, Homo sapiens
caucauccuccauugcucc

SEQ ID NO: 618276 - RNA, 17 nt, Homo sapiens
caucaucuccugccuuc

SEQ ID NO: 618277 - RNA, 19 nt, Homo sapiens
caucaucuccugccuuccu

SEQ ID NO: 618278 - RNA, 22 nt, Homo sapiens
caucaugcggugggugcugcca

SEQ ID NO: 618279 - RNA, 21 nt, Homo sapiens
caucauggauucauuacagcu

SEQ ID NO: 618280 - RNA, 12 nt, Homo sapiens
caucauguugaa

SEQ ID NO: 618281 - RNA, 20 nt, Homo sapiens
caucauuacccuucccugca

SEQ ID NO: 618282 - RNA, 23 nt, Homo sapiens
caucauuacugguaaagccucau

SEQ ID NO: 618283 - RNA, 15 nt, Homo sapiens
caucauuagaacaaa

SEQ ID NO: 618284 - RNA, 13 nt, Homo sapiens
caucauuccuuga

SEQ ID NO: 618285 - RNA, 14 nt, Homo sapiens
caucauuucugucu

SEQ ID NO: 618286 - RNA, 18 nt, Homo sapiens
caucauuuugacagcauc

SEQ ID NO: 618287 - RNA, 21 nt, Homo sapiens
caucauuuugagaaugcugac

SEQ ID NO: 618288 - RNA, 22 nt, Homo sapiens
caucauuuuugaugacuaccuc

SEQ ID NO: 618289 - RNA, 10 nt, Homo sapiens
cauccaaagu

SEQ ID NO: 618290 - RNA, 18 nt, Homo sapiens
cauccaaggagaaacaga

SEQ ID NO: 618291 - RNA, 21 nt, Homo sapiens
cauccaaggagaaacagagac

SEQ ID NO: 618292 - RNA, 16 nt, Homo sapiens
cauccaaggcuguuac

SEQ ID NO: 618293 - RNA, 23 nt, Homo sapiens
cauccaaggcuguuaccauuuua

SEQ ID NO: 618294 - RNA, 13 nt, Homo sapiens
cauccaauguaug

SEQ ID NO: 618295 - RNA, 19 nt, Homo sapiens
cauccaauuuaucaaggaa

SEQ ID NO: 618296 - RNA, 13 nt, Homo sapiens
cauccacuuucca

SEQ ID NO: 618297 - RNA, 18 nt, Homo sapiens
cauccagaguaagugaug

SEQ ID NO: 618298 - RNA, 16 nt, Homo sapiens
cauccagcugccccuc

SEQ ID NO: 618299 - RNA, 17 nt, Homo sapiens
cauccaggcccaacugu

SEQ ID NO: 618300 - RNA, 13 nt, Homo sapiens
cauccagugacaa

SEQ ID NO: 618301 - RNA, 16 nt, Homo sapiens
cauccauaacugaaca

SEQ ID NO: 618302 - RNA, 15 nt, Homo sapiens
cauccauaauuguga

SEQ ID NO: 618303 - RNA, 20 nt, Homo sapiens
cauccauauauauucaucag

SEQ ID NO: 618304 - RNA, 16 nt, Homo sapiens
cauccaucaucaugug

SEQ ID NO: 618305 - RNA, 17 nt, Homo sapiens
caucccaacagccaaga

SEQ ID NO: 618306 - RNA, 23 nt, Homo sapiens
caucccaagaaaaucacaucacu

SEQ ID NO: 618307 - RNA, 13 nt, Homo sapiens
caucccacagugg

SEQ ID NO: 618308 - RNA, 14 nt, Homo sapiens
caucccauguauuu

SEQ ID NO: 618309 - RNA, 22 nt, Homo sapiens
cauccccaacugcgacugugac

SEQ ID NO: 618310 - RNA, 14 nt, Homo sapiens
cauccccacagcug

SEQ ID NO: 618311 - RNA, 21 nt, Homo sapiens
cauccccucaacacccugcuu

SEQ ID NO: 618312 - RNA, 15 nt, Homo sapiens
cauccccuuuccucc

SEQ ID NO: 618313 - RNA, 19 nt, Homo sapiens
caucccucgggugugcuau

SEQ ID NO: 618314 - RNA, 18 nt, Homo sapiens
caucccugaaacaucuca

SEQ ID NO: 618315 - RNA, 18 nt, Homo sapiens
caucccugaugucugucu

SEQ ID NO: 618316 - RNA, 15 nt, Homo sapiens
caucccugcagcuca

SEQ ID NO: 618317 - RNA, 19 nt, Homo sapiens
caucccuuauuaguuacaa

SEQ ID NO: 618318 - RNA, 16 nt, Homo sapiens
caucccuuuuuuuaca

SEQ ID NO: 618319 - RNA, 19 nt, Homo sapiens
cauccgguuugccauguug

SEQ ID NO: 618320 - RNA, 15 nt, Homo sapiens
cauccuaacaugaca

SEQ ID NO: 618321 - RNA, 20 nt, Homo sapiens
cauccuaugcuuaauaaaag

SEQ ID NO: 618322 - RNA, 14 nt, Homo sapiens
cauccucacaguga

SEQ ID NO: 618323 - RNA, 15 nt, Homo sapiens
cauccucacugccgu

SEQ ID NO: 618324 - RNA, 22 nt, Homo sapiens
cauccucacugccguccucagg

SEQ ID NO: 618325 - RNA, 14 nt, Homo sapiens
cauccucacugugg

SEQ ID NO: 618326 - RNA, 14 nt, Homo sapiens
cauccuccacugac

SEQ ID NO: 618327 - RNA, 15 nt, Homo sapiens
cauccuccauugcuc

SEQ ID NO: 618328 - RNA, 16 nt, Homo sapiens
cauccuccauugcucc

SEQ ID NO: 618329 - RNA, 22 nt, Homo sapiens
cauccucugauagcuguuucaa

SEQ ID NO: 618330 - RNA, 18 nt, Homo sapiens
cauccucuuaccagaucc

SEQ ID NO: 618331 - RNA, 14 nt, Homo sapiens
cauccugacugaaa

SEQ ID NO: 618332 - RNA, 22 nt, Homo sapiens
cauccugagcagugccagcuuu

SEQ ID NO: 618333 - RNA, 15 nt, Homo sapiens
cauccugcucaggaa

SEQ ID NO: 618334 - RNA, 20 nt, Homo sapiens
cauccuggccaacaugguga

SEQ ID NO: 618335 - RNA, 17 nt, Homo sapiens
cauccuggccuggcaca

SEQ ID NO: 618336 - RNA, 13 nt, Homo sapiens
cauccugucacca

SEQ ID NO: 618337 - RNA, 13 nt, Homo sapiens
cauccugugccac

SEQ ID NO: 618338 - RNA, 21 nt, Homo sapiens
cauccuguguuaucugugguu

SEQ ID NO: 618339 - RNA, 14 nt, Homo sapiens
cauccuuguaauac

SEQ ID NO: 618340 - RNA, 22 nt, Homo sapiens
cauccuuuacaccaacuccuaa

SEQ ID NO: 618341 - RNA, 22 nt, Homo sapiens
cauccuuucccucucccagucc

SEQ ID NO: 618342 - RNA, 18 nt, Homo sapiens
cauccuuuucaaaaccua

SEQ ID NO: 618343 - RNA, 18 nt, Homo sapiens
caucgauauguauaucau

SEQ ID NO: 618344 - RNA, 17 nt, Homo sapiens
caucgggggugaaucuu

SEQ ID NO: 618345 - RNA, 20 nt, Homo sapiens
caucggguaagaugcuccug

SEQ ID NO: 618346 - RNA, 15 nt, Homo sapiens
caucguccugggacu

SEQ ID NO: 618347 - RNA, 22 nt, Homo sapiens
caucguguuugcaaagguuaaa

SEQ ID NO: 618348 - RNA, 23 nt, Homo sapiens
caucguugcaaccacugcaauau

SEQ ID NO: 618349 - RNA, 22 nt, Homo sapiens
caucuaaauauuuccauauucu

SEQ ID NO: 618350 - RNA, 17 nt, Homo sapiens
caucuacccugcugacc

SEQ ID NO: 618351 - RNA, 22 nt, Homo sapiens
caucuacuuuuuuuuuaauuaa

SEQ ID NO: 618352 - RNA, 20 nt, Homo sapiens
caucuagaugaggugcuuug

SEQ ID NO: 618353 - RNA, 19 nt, Homo sapiens
caucuauaaagaagaacuu

SEQ ID NO: 618354 - RNA, 22 nt, Homo sapiens
caucuauaaagaagaacuugca

SEQ ID NO: 618355 - RNA, 16 nt, Homo sapiens
caucuauauauauaug

SEQ ID NO: 618356 - RNA, 16 nt, Homo sapiens
caucuauuauuacaca

SEQ ID NO: 618357 - RNA, 18 nt, Homo sapiens
caucuauucaagcacuua

SEQ ID NO: 618358 - RNA, 20 nt, Homo sapiens
caucuauuuccucugugcaa

SEQ ID NO: 618359 - RNA, 22 nt, Homo sapiens
caucucaaggggcccagccucc

SEQ ID NO: 618360 - RNA, 12 nt, Homo sapiens
caucucagccua

SEQ ID NO: 618361 - RNA, 16 nt, Homo sapiens
caucucagugaagaau

SEQ ID NO: 618362 - RNA, 13 nt, Homo sapiens
caucucauuccaa

SEQ ID NO: 618363 - RNA, 16 nt, Homo sapiens
caucuccagugugcca

SEQ ID NO: 618364 - RNA, 18 nt, Homo sapiens
caucuccagugugccaga

SEQ ID NO: 618365 - RNA, 18 nt, Homo sapiens
caucuccccucagauucc

SEQ ID NO: 618366 - RNA, 19 nt, Homo sapiens
caucuccccucucaccuca

SEQ ID NO: 618367 - RNA, 23 nt, Homo sapiens
caucucuaacauaugauacugau

SEQ ID NO: 618368 - RNA, 20 nt, Homo sapiens
caucucuacugaaaguacaa

SEQ ID NO: 618369 - RNA, 21 nt, Homo sapiens
caucucuauuaaaauacaaaa

SEQ ID NO: 618370 - RNA, 17 nt, Homo sapiens
caucucugcaguuuuuc

SEQ ID NO: 618371 - RNA, 14 nt, Homo sapiens
caucucuuguauau

SEQ ID NO: 618372 - RNA, 17 nt, Homo sapiens
caucugaaacccacaga

SEQ ID NO: 618373 - RNA, 11 nt, Homo sapiens
caucugacccc

SEQ ID NO: 618374 - RNA, 12 nt, Homo sapiens
caucugacucac

SEQ ID NO: 618375 - RNA, 15 nt, Homo sapiens
caucugacucacaag

SEQ ID NO: 618376 - RNA, 21 nt, Homo sapiens
caucugagugggcccagcaca

SEQ ID NO: 618377 - RNA, 14 nt, Homo sapiens
caucugcacuccug

SEQ ID NO: 618378 - RNA, 13 nt, Homo sapiens
cccacuucuggca

SEQ ID NO: 618379 - RNA, 17 nt, Homo sapiens
cccacuucugugccacc

SEQ ID NO: 618380 - RNA, 11 nt, Homo sapiens
cccacuuugaa

SEQ ID NO: 618381 - RNA, 12 nt, Homo sapiens
cccacuuugaag

SEQ ID NO: 618382 - RNA, 15 nt, Homo sapiens
cccacuuugaagggc

SEQ ID NO: 618383 - RNA, 22 nt, Homo sapiens
cccagaaagugauaagugcagg

SEQ ID NO: 618384 - RNA, 13 nt, Homo sapiens
cccagaaccacag

SEQ ID NO: 618385 - RNA, 23 nt, Homo sapiens
cccagaaggcagagguugcagug

SEQ ID NO: 618386 - RNA, 19 nt, Homo sapiens
cccagaaguccagaagggu

SEQ ID NO: 618387 - RNA, 16 nt, Homo sapiens
cccagacaaccaaaac

SEQ ID NO: 618388 - RNA, 14 nt, Homo sapiens
cccagacaaggaga

SEQ ID NO: 618389 - RNA, 22 nt, Homo sapiens
cccagacacagacuggcaauaa

SEQ ID NO: 618390 - RNA, 23 nt, Homo sapiens
cccagacacuggcguuacugcuu

SEQ ID NO: 618391 - RNA, 16 nt, Homo sapiens
cccagaccgccaguga

SEQ ID NO: 618392 - RNA, 14 nt, Homo sapiens
cccagacucagcuc

SEQ ID NO: 618393 - RNA, 24 nt, Homo sapiens
cccagacucuuuuuuugagugaca

SEQ ID NO: 618394 - RNA, 20 nt, Homo sapiens
cccagacugaugagcacauc

SEQ ID NO: 618395 - RNA, 14 nt, Homo sapiens
cccagagaccccuu

SEQ ID NO: 618396 - RNA, 23 nt, Homo sapiens
cccagagcgaggaaaggauuuua

SEQ ID NO: 618397 - RNA, 21 nt, Homo sapiens
cccagaggcucagcacuuugg

SEQ ID NO: 618398 - RNA, 15 nt, Homo sapiens
cccagagguggaugu

SEQ ID NO: 618399 - RNA, 16 nt, Homo sapiens
cccagagucaucugau

SEQ ID NO: 618400 - RNA, 18 nt, Homo sapiens
cccagagugcugggauua

SEQ ID NO: 618401 - RNA, 22 nt, Homo sapiens
cccagagugcugggauuacaau

SEQ ID NO: 618402 - RNA, 21 nt, Homo sapiens
cccagagugugaaacuuccua

SEQ ID NO: 618403 - RNA, 16 nt, Homo sapiens
cccagauacaugguga

SEQ ID NO: 618404 - RNA, 15 nt, Homo sapiens
cccagauagguggug

SEQ ID NO: 618405 - RNA, 20 nt, Homo sapiens
cccagaucaaauucuauuaa

SEQ ID NO: 618406 - RNA, 18 nt, Homo sapiens
cccagaucacacaucauc

SEQ ID NO: 618407 - RNA, 12 nt, Homo sapiens
cccagauccuca

SEQ ID NO: 618408 - RNA, 15 nt, Homo sapiens
cccagaucugguccc

SEQ ID NO: 618409 - RNA, 22 nt, Homo sapiens
cccagaugcucuccccuccucg

SEQ ID NO: 618410 - RNA, 21 nt, Homo sapiens
cccagauguugcaucccugaa

SEQ ID NO: 618411 - RNA, 23 nt, Homo sapiens
cccagauguuuuacgucugggag

SEQ ID NO: 618412 - RNA, 13 nt, Homo sapiens
cccagcaauagag

SEQ ID NO: 618413 - RNA, 13 nt, Homo sapiens
cccagcaccucau

SEQ ID NO: 618414 - RNA, 13 nt, Homo sapiens
cccagcacuuugg

SEQ ID NO: 618415 - RNA, 21 nt, Homo sapiens
cccagcagagguuugcugaca

SEQ ID NO: 618416 - RNA, 20 nt, Homo sapiens
cccagcagugucacucugua

SEQ ID NO: 618417 - RNA, 14 nt, Homo sapiens
cccagcaugcaggu

SEQ ID NO: 618418 - RNA, 15 nt, Homo sapiens
cccagccaacugccc

SEQ ID NO: 618419 - RNA, 17 nt, Homo sapiens
cccagccacaacugcca

SEQ ID NO: 618420 - RNA, 18 nt, Homo sapiens
cccagccacgacugccau

SEQ ID NO: 618421 - RNA, 18 nt, Homo sapiens
cccagccauccagggggc

SEQ ID NO: 618422 - RNA, 14 nt, Homo sapiens
cccagccaugccag

SEQ ID NO: 618423 - RNA, 15 nt, Homo sapiens
cccagcccagagcca

SEQ ID NO: 618424 - RNA, 19 nt, Homo sapiens
cccagccccacuccucugc

SEQ ID NO: 618425 - RNA, 16 nt, Homo sapiens
cccagccccaggccug

SEQ ID NO: 618426 - RNA, 18 nt, Homo sapiens
cccagccccuccacguga

SEQ ID NO: 618427 - RNA, 12 nt, Homo sapiens
cccagccuauga

SEQ ID NO: 618428 - RNA, 19 nt, Homo sapiens
cccagccuccccgugccaa

SEQ ID NO: 618429 - RNA, 13 nt, Homo sapiens
cccagcggcacca

SEQ ID NO: 618430 - RNA, 17 nt, Homo sapiens
cccagcgguucacacag

SEQ ID NO: 618431 - RNA, 13 nt, Homo sapiens
cccagcuacuuga

SEQ ID NO: 618432 - RNA, 17 nt, Homo sapiens
cccagcuccccaagaaa

SEQ ID NO: 618433 - RNA, 21 nt, Homo sapiens
cccagcuccggccuguccucc

SEQ ID NO: 618434 - RNA, 21 nt, Homo sapiens
cccagcuccuuucaugcucca

SEQ ID NO: 618435 - RNA, 15 nt, Homo sapiens
cccagcugcacuuua

SEQ ID NO: 618436 - RNA, 18 nt, Homo sapiens
cccagcugggcucugcca

SEQ ID NO: 618437 - RNA, 17 nt, Homo sapiens
cccagcuguagccaugg

SEQ ID NO: 618438 - RNA, 13 nt, Homo sapiens
cccagcugugcug

SEQ ID NO: 618439 - RNA, 15 nt, Homo sapiens
cccagcugugcugug

SEQ ID NO: 618440 - RNA, 19 nt, Homo sapiens
cccagcuuugcugccugag

SEQ ID NO: 618441 - RNA, 23 nt, Homo sapiens
cccagcuuuuagaaaaugcaguc

SEQ ID NO: 618442 - RNA, 21 nt, Homo sapiens
cccaggaaagguuuuccuuau

SEQ ID NO: 618443 - RNA, 17 nt, Homo sapiens
cccaggaaugcaagugg

SEQ ID NO: 618444 - RNA, 14 nt, Homo sapiens
cccaggacucuggc

SEQ ID NO: 618445 - RNA, 13 nt, Homo sapiens
cccaggacuguug

SEQ ID NO: 618446 - RNA, 18 nt, Homo sapiens
cccaggagcaacagccua

SEQ ID NO: 618447 - RNA, 21 nt, Homo sapiens
cccaggagcagcggggcagug

SEQ ID NO: 618448 - RNA, 17 nt, Homo sapiens
cccaggcaaacuugcac

SEQ ID NO: 618449 - RNA, 13 nt, Homo sapiens
cccaggcagccuc

SEQ ID NO: 618450 - RNA, 19 nt, Homo sapiens
cccaggcaguaccauucag

SEQ ID NO: 618451 - RNA, 17 nt, Homo sapiens
cccaggccuccagccuc

SEQ ID NO: 618452 - RNA, 20 nt, Homo sapiens
cccaggccugggaugcagug

SEQ ID NO: 618453 - RNA, 21 nt, Homo sapiens
cccaggccuguacagauguau

SEQ ID NO: 618454 - RNA, 19 nt, Homo sapiens
cccaggcuagagugcaaug

SEQ ID NO: 618455 - RNA, 19 nt, Homo sapiens
cccaggcugcacugcagug

SEQ ID NO: 618456 - RNA, 20 nt, Homo sapiens
cccaggcugcuggagugcag

SEQ ID NO: 618457 - RNA, 17 nt, Homo sapiens
cccaggcuggacugcaa

SEQ ID NO: 618458 - RNA, 20 nt, Homo sapiens
cccaggcuggacugcaauga

SEQ ID NO: 618459 - RNA, 19 nt, Homo sapiens
cccaggcuggagugcaaug

SEQ ID NO: 618460 - RNA, 19 nt, Homo sapiens
cccaggcuggagugcagug

SEQ ID NO: 618461 - RNA, 20 nt, Homo sapiens
cccaggcuggagugcaguga

SEQ ID NO: 618462 - RNA, 17 nt, Homo sapiens
cccaggcugggaacuca

SEQ ID NO: 618463 - RNA, 16 nt, Homo sapiens
cccaggcuggucuuga

SEQ ID NO: 618464 - RNA, 15 nt, Homo sapiens
cccagggaugcucuu

SEQ ID NO: 618465 - RNA, 17 nt, Homo sapiens
cccagggcacuacauaa

SEQ ID NO: 618466 - RNA, 21 nt, Homo sapiens
cccagggccuccugggggacc

SEQ ID NO: 618467 - RNA, 12 nt, Homo sapiens
cccagggggaga

SEQ ID NO: 618468 - RNA, 18 nt, Homo sapiens
cccaggucccuuguccca

SEQ ID NO: 618469 - RNA, 21 nt, Homo sapiens
cccaggucuuccugcuuucca

SEQ ID NO: 618470 - RNA, 18 nt, Homo sapiens
cccagguggcugacccag

SEQ ID NO: 618471 - RNA, 20 nt, Homo sapiens
cccagguugcugugggugca

SEQ ID NO: 618472 - RNA, 17 nt, Homo sapiens
cccaguaccuccaagca

SEQ ID NO: 618473 - RNA, 13 nt, Homo sapiens
cccaguauucuca

SEQ ID NO: 618474 - RNA, 11 nt, Homo sapiens
cccaguauuuu

SEQ ID NO: 618475 - RNA, 19 nt, Homo sapiens
cccaguauuuuuauacgga

SEQ ID NO: 618476 - RNA, 18 nt, Homo sapiens
cccaguccaccugaggaa

SEQ ID NO: 618477 - RNA, 18 nt, Homo sapiens
cccagugaaugauuuaga

SEQ ID NO: 618478 - RNA, 17 nt, Homo sapiens
cccagugacaacaucgc

SEQ ID NO: 618479 - RNA, 10 nt, Homo sapiens
cccagugcac

SEQ ID NO: 618480 - RNA, 17 nt, Homo sapiens
cccagugcugcuguaaa

SEQ ID NO: 618481 - RNA, 22 nt, Homo sapiens
cccagugcuucuccaacacuga

SEQ ID NO: 618482 - RNA, 19 nt, Homo sapiens
cccagugggaacugugcaa

SEQ ID NO: 618483 - RNA, 20 nt, Homo sapiens
cccagugugcaagggcagug

SEQ ID NO: 618484 - RNA, 13 nt, Homo sapiens
cccaguguuccau

SEQ ID NO: 618485 - RNA, 19 nt, Homo sapiens
cccaguuacuuuuuuacac

SEQ ID NO: 618486 - RNA, 19 nt, Homo sapiens
cccaguucauugcacuuug

SEQ ID NO: 618487 - RNA, 12 nt, Homo sapiens
cccaguucugcu

SEQ ID NO: 618488 - RNA, 18 nt, Homo sapiens
cccauaaucauguaaaug

SEQ ID NO: 618489 - RNA, 13 nt, Homo sapiens
cccauacucagcc

SEQ ID NO: 618490 - RNA, 17 nt, Homo sapiens
cccauaucugugaaaug

SEQ ID NO: 618491 - RNA, 15 nt, Homo sapiens
cccauaucuguucaa

SEQ ID NO: 618492 - RNA, 17 nt, Homo sapiens
cccaucaauucuuagaa

SEQ ID NO: 618493 - RNA, 20 nt, Homo sapiens
cccaucagacugucaagaag

SEQ ID NO: 618494 - RNA, 12 nt, Homo sapiens
cccaucauccca

SEQ ID NO: 618495 - RNA, 15 nt, Homo sapiens
cccauccagccagac

SEQ ID NO: 618496 - RNA, 21 nt, Homo sapiens
cccauccaggucuugacucau

SEQ ID NO: 618497 - RNA, 14 nt, Homo sapiens
cccauccagugucu

SEQ ID NO: 618498 - RNA, 23 nt, Homo sapiens
cccauccauuaggccagcaacgc

SEQ ID NO: 618499 - RNA, 22 nt, Homo sapiens
cccaucccacacccuggaggau

SEQ ID NO: 618500 - RNA, 18 nt, Homo sapiens
cccucuccccacugcuca

SEQ ID NO: 618501 - RNA, 16 nt, Homo sapiens
cccucucucaguguca

SEQ ID NO: 618502 - RNA, 21 nt, Homo sapiens
cccucucugcuccuucacugu

SEQ ID NO: 618503 - RNA, 14 nt, Homo sapiens
cccucucuugcacc

SEQ ID NO: 618504 - RNA, 22 nt, Homo sapiens
cccucugauuuccuucugcuau

SEQ ID NO: 618505 - RNA, 21 nt, Homo sapiens
cccucugcuuuuaacucuaga

SEQ ID NO: 618506 - RNA, 17 nt, Homo sapiens
cccucuggcuccagcug

SEQ ID NO: 618507 - RNA, 14 nt, Homo sapiens
cccucugggaaccu

SEQ ID NO: 618508 - RNA, 10 nt, Homo sapiens
cccucuguag

SEQ ID NO: 618509 - RNA, 13 nt, Homo sapiens
cccucugucuuca

SEQ ID NO: 618510 - RNA, 22 nt, Homo sapiens
cccucugugcuucgacuacugc

SEQ ID NO: 618511 - RNA, 23 nt, Homo sapiens
cccucuguggccugucucuauua

SEQ ID NO: 618512 - RNA, 23 nt, Homo sapiens
cccucuuccagcuucuuuugcca

SEQ ID NO: 618513 - RNA, 16 nt, Homo sapiens
cccucuuccugugauc

SEQ ID NO: 618514 - RNA, 18 nt, Homo sapiens
cccucuucucuuuugccc

SEQ ID NO: 618515 - RNA, 11 nt, Homo sapiens
cccucuugcca

SEQ ID NO: 618516 - RNA, 14 nt, Homo sapiens
cccucuuucaucuc

SEQ ID NO: 618517 - RNA, 15 nt, Homo sapiens
cccucuuugagggag

SEQ ID NO: 618518 - RNA, 17 nt, Homo sapiens
cccugaaccgcacccca

SEQ ID NO: 618519 - RNA, 18 nt, Homo sapiens
cccugacagggccagugc

SEQ ID NO: 618520 - RNA, 18 nt, Homo sapiens
cccugacaucaucauucu

SEQ ID NO: 618521 - RNA, 21 nt, Homo sapiens
cccugacaucuggaaucugga

SEQ ID NO: 618522 - RNA, 19 nt, Homo sapiens
cccugaccucacugugacc

SEQ ID NO: 618523 - RNA, 22 nt, Homo sapiens
cccugaccugugagcccagcug

SEQ ID NO: 618524 - RNA, 15 nt, Homo sapiens
cccugacgugcagcc

SEQ ID NO: 618525 - RNA, 15 nt, Homo sapiens
cccugacucaucauu

SEQ ID NO: 618526 - RNA, 22 nt, Homo sapiens
cccugacucucugugaccugcc

SEQ ID NO: 618527 - RNA, 21 nt, Homo sapiens
cccugaggauggccuggauuc

SEQ ID NO: 618528 - RNA, 16 nt, Homo sapiens
cccugagucaccagga

SEQ ID NO: 618529 - RNA, 16 nt, Homo sapiens
cccugaguucauccag

SEQ ID NO: 618530 - RNA, 20 nt, Homo sapiens
cccugaguugggcagccagg

SEQ ID NO: 618531 - RNA, 21 nt, Homo sapiens
cccugaguugggcagccagga

SEQ ID NO: 618532 - RNA, 17 nt, Homo sapiens
cccugauacaggcaugg

SEQ ID NO: 618533 - RNA, 19 nt, Homo sapiens
cccugaugugacauuccau

SEQ ID NO: 618534 - RNA, 19 nt, Homo sapiens
cccugauuuaauaugcaaa

SEQ ID NO: 618535 - RNA, 20 nt, Homo sapiens
cccugcaaacagaacagggu

SEQ ID NO: 618536 - RNA, 12 nt, Homo sapiens
cccugcaaagcc

SEQ ID NO: 618537 - RNA, 19 nt, Homo sapiens
cccugcaacuucuauccuu

SEQ ID NO: 618538 - RNA, 14 nt, Homo sapiens
cccugcacaaagcc

SEQ ID NO: 618539 - RNA, 14 nt, Homo sapiens
cccugcacagugac

SEQ ID NO: 618540 - RNA, 20 nt, Homo sapiens
cccugcacucccuccuggag

SEQ ID NO: 618541 - RNA, 17 nt, Homo sapiens
cccugcagagcacaaac

SEQ ID NO: 618542 - RNA, 23 nt, Homo sapiens
cccugcagaugccacccuagcca

SEQ ID NO: 618543 - RNA, 18 nt, Homo sapiens
cccugcagggccaagcac

SEQ ID NO: 618544 - RNA, 12 nt, Homo sapiens
cccugcaugcug

SEQ ID NO: 618545 - RNA, 14 nt, Homo sapiens
cccugccacugggc

SEQ ID NO: 618546 - RNA, 23 nt, Homo sapiens
cccugcccaccaagaagcacugg

SEQ ID NO: 618547 - RNA, 17 nt, Homo sapiens
cccugcccuuggcacca

SEQ ID NO: 618548 - RNA, 16 nt, Homo sapiens
cccugccucagccagg

SEQ ID NO: 618549 - RNA, 16 nt, Homo sapiens
cccugcgccuccagag

SEQ ID NO: 618550 - RNA, 21 nt, Homo sapiens
cccugcgggugaacaaagcag

SEQ ID NO: 618551 - RNA, 19 nt, Homo sapiens
cccugcuaaggaguucuca

SEQ ID NO: 618552 - RNA, 20 nt, Homo sapiens
cccugcucugggcacuggga

SEQ ID NO: 618553 - RNA, 19 nt, Homo sapiens
cccugcuugcacuuuguaa

SEQ ID NO: 618554 - RNA, 13 nt, Homo sapiens
cccugcuuucuau

SEQ ID NO: 618555 - RNA, 22 nt, Homo sapiens
cccugcuuuuugcuucuugagu

SEQ ID NO: 618556 - RNA, 18 nt, Homo sapiens
cccuggaaggacauccau

SEQ ID NO: 618557 - RNA, 19 nt, Homo sapiens
cccuggagaugucacagau

SEQ ID NO: 618558 - RNA, 14 nt, Homo sapiens
cccuggagugcagu

SEQ ID NO: 618559 - RNA, 20 nt, Homo sapiens
cccuggaucuaccagcauaa

SEQ ID NO: 618560 - RNA, 17 nt, Homo sapiens
cccuggcaugauggaca

SEQ ID NO: 618561 - RNA, 15 nt, Homo sapiens
cccuggccaucucaa

SEQ ID NO: 618562 - RNA, 17 nt, Homo sapiens
cccuggcuaacagucua

SEQ ID NO: 618563 - RNA, 20 nt, Homo sapiens
cccuggcugaccccaaagag

SEQ ID NO: 618564 - RNA, 21 nt, Homo sapiens
cccuggcugaccccaaagagc

SEQ ID NO: 618565 - RNA, 20 nt, Homo sapiens
cccugggcagugagugccau

SEQ ID NO: 618566 - RNA, 15 nt, Homo sapiens
cccugggccaacaga

SEQ ID NO: 618567 - RNA, 15 nt, Homo sapiens
cccugggccaggcag

SEQ ID NO: 618568 - RNA, 16 nt, Homo sapiens
cccugggcuuugucau

SEQ ID NO: 618569 - RNA, 22 nt, Homo sapiens
cccuggggcacuuucauccuca

SEQ ID NO: 618570 - RNA, 22 nt, Homo sapiens
cccuggggcuucuccugaccca

SEQ ID NO: 618571 - RNA, 19 nt, Homo sapiens
cccugggguuugaagcuga

SEQ ID NO: 618572 - RNA, 19 nt, Homo sapiens
cccugguccccucccccau

SEQ ID NO: 618573 - RNA, 20 nt, Homo sapiens
cccuggugccucugugcaca

SEQ ID NO: 618574 - RNA, 21 nt, Homo sapiens
cccuggugccucugugcacag

SEQ ID NO: 618575 - RNA, 16 nt, Homo sapiens
cccuggugucaggcag

SEQ ID NO: 618576 - RNA, 19 nt, Homo sapiens
cccuguaaccugacugguu

SEQ ID NO: 618577 - RNA, 17 nt, Homo sapiens
cccuguaccugugcacg

SEQ ID NO: 618578 - RNA, 13 nt, Homo sapiens
cccugucaggaca

SEQ ID NO: 618579 - RNA, 16 nt, Homo sapiens
cccuguccugaugguc

SEQ ID NO: 618580 - RNA, 20 nt, Homo sapiens
cccugucucggggcuugccc

SEQ ID NO: 618581 - RNA, 22 nt, Homo sapiens
cccugucuguuugccacaccca

SEQ ID NO: 618582 - RNA, 14 nt, Homo sapiens
cccugucuuccaca

SEQ ID NO: 618583 - RNA, 21 nt, Homo sapiens
cccugugacccucucacuuac

SEQ ID NO: 618584 - RNA, 19 nt, Homo sapiens
cccugugcuccgugccucc

SEQ ID NO: 618585 - RNA, 14 nt, Homo sapiens
cccuguggcacuca

SEQ ID NO: 618586 - RNA, 20 nt, Homo sapiens
cccuguggccaacugcaaaa

SEQ ID NO: 618587 - RNA, 18 nt, Homo sapiens
cccuguggggccugaugg

SEQ ID NO: 618588 - RNA, 12 nt, Homo sapiens
cccugugggugu

SEQ ID NO: 618589 - RNA, 15 nt, Homo sapiens
cccuguguagcucuc

SEQ ID NO: 618590 - RNA, 16 nt, Homo sapiens
cccugugucugucaca

SEQ ID NO: 618591 - RNA, 21 nt, Homo sapiens
cccugugugugugugugcuga

SEQ ID NO: 618592 - RNA, 18 nt, Homo sapiens
cccuuaacugcauccagc

SEQ ID NO: 618593 - RNA, 13 nt, Homo sapiens
cccuuaaggacaa

SEQ ID NO: 618594 - RNA, 19 nt, Homo sapiens
cccuuaaugaaauacauca

SEQ ID NO: 618595 - RNA, 18 nt, Homo sapiens
cccuuacagccucugacu

SEQ ID NO: 618596 - RNA, 20 nt, Homo sapiens
cccuuaggucgcgcucuugc

SEQ ID NO: 618597 - RNA, 16 nt, Homo sapiens
cccuuauccuucuccc

SEQ ID NO: 618598 - RNA, 23 nt, Homo sapiens
cccuucaaggccuccccaaucca

SEQ ID NO: 618599 - RNA, 22 nt, Homo sapiens
cccuucaccgcuccccacagcu

SEQ ID NO: 618600 - RNA, 16 nt, Homo sapiens
cccuucagguguuacu

SEQ ID NO: 618601 - RNA, 14 nt, Homo sapiens
cccuuccagaccca

SEQ ID NO: 618602 - RNA, 14 nt, Homo sapiens
cccuuccagugccc

SEQ ID NO: 618603 - RNA, 21 nt, Homo sapiens
cccuuccaugucgccucugca

SEQ ID NO: 618604 - RNA, 19 nt, Homo sapiens
cccuuccccugcugaccuu

SEQ ID NO: 618605 - RNA, 15 nt, Homo sapiens
cccuucccugcacua

SEQ ID NO: 618606 - RNA, 19 nt, Homo sapiens
cccuuccugaagaagaucc

SEQ ID NO: 618607 - RNA, 14 nt, Homo sapiens
cccuuccuguuuca

SEQ ID NO: 618608 - RNA, 15 nt, Homo sapiens
cccuucugcucagcu

SEQ ID NO: 618609 - RNA, 21 nt, Homo sapiens
cccuucuucacacagacacua

SEQ ID NO: 618610 - RNA, 12 nt, Homo sapiens
cccuucuugcca

SEQ ID NO: 618611 - RNA, 20 nt, Homo sapiens
cccuugagcucaagugaucu

SEQ ID NO: 618612 - RNA, 15 nt, Homo sapiens
cccuugcaagccaua

SEQ ID NO: 618613 - RNA, 21 nt, Homo sapiens
cccuugcaaucuucuacuuua

SEQ ID NO: 618614 - RNA, 16 nt, Homo sapiens
cccuuggagccaaugg

SEQ ID NO: 618615 - RNA, 23 nt, Homo sapiens
cccuuggagggagagguggcagg

SEQ ID NO: 618616 - RNA, 18 nt, Homo sapiens
cccuuggccuccauuucu

SEQ ID NO: 618617 - RNA, 15 nt, Homo sapiens
cccuuggcugugagg

SEQ ID NO: 618618 - RNA, 15 nt, Homo sapiens
cccuuguccuugaaa

SEQ ID NO: 618619 - RNA, 14 nt, Homo sapiens
cccuuguugcacug

SEQ ID NO: 618620 - RNA, 14 nt, Homo sapiens
cccuuuaaagccuu

SEQ ID NO: 618621 - RNA, 18 nt, Homo sapiens
ccucgggacaucaaaaac

SEQ ID NO: 618622 - RNA, 17 nt, Homo sapiens
ccucgggugugcuaugg

SEQ ID NO: 618623 - RNA, 22 nt, Homo sapiens
ccucgugcccaucaagugcagu

SEQ ID NO: 618624 - RNA, 22 nt, Homo sapiens
ccucguuauuguuguugccaaa

SEQ ID NO: 618625 - RNA, 18 nt, Homo sapiens
ccucuaagccacucuucc

SEQ ID NO: 618626 - RNA, 13 nt, Homo sapiens
ccucuaagguugg

SEQ ID NO: 618627 - RNA, 12 nt, Homo sapiens
ccucuaaugaga

SEQ ID NO: 618628 - RNA, 15 nt, Homo sapiens
ccucuacaauuugcc

SEQ ID NO: 618629 - RNA, 13 nt, Homo sapiens
ccucuaccucucu

SEQ ID NO: 618630 - RNA, 21 nt, Homo sapiens
ccucuacuguugcacagccag

SEQ ID NO: 618631 - RNA, 14 nt, Homo sapiens
ccucuagaagccaa

SEQ ID NO: 618632 - RNA, 15 nt, Homo sapiens
ccucuagaagccaag

SEQ ID NO: 618633 - RNA, 16 nt, Homo sapiens
ccucuagagucacuga

SEQ ID NO: 618634 - RNA, 14 nt, Homo sapiens
ccucuaguaguaua

SEQ ID NO: 618635 - RNA, 21 nt, Homo sapiens
ccucuauauaccaaagcacau

SEQ ID NO: 618636 - RNA, 19 nt, Homo sapiens
ccucucaacucucuuugua

SEQ ID NO: 618637 - RNA, 13 nt, Homo sapiens
ccucucacuuugg

SEQ ID NO: 618638 - RNA, 20 nt, Homo sapiens
ccucucagagugacagucau

SEQ ID NO: 618639 - RNA, 13 nt, Homo sapiens
ccucucaugacuu

SEQ ID NO: 618640 - RNA, 19 nt, Homo sapiens
ccucuccaagggcuucugc

SEQ ID NO: 618641 - RNA, 14 nt, Homo sapiens
ccucuccacccucc

SEQ ID NO: 618642 - RNA, 15 nt, Homo sapiens
ccucuccaggcauuu

SEQ ID NO: 618643 - RNA, 19 nt, Homo sapiens
ccucuccaggcauuuagcc

SEQ ID NO: 618644 - RNA, 22 nt, Homo sapiens
ccucucccaaaaaacuacuucu

SEQ ID NO: 618645 - RNA, 18 nt, Homo sapiens
ccucucccaaguccacac

SEQ ID NO: 618646 - RNA, 12 nt, Homo sapiens
ccucuccugucc

SEQ ID NO: 618647 - RNA, 22 nt, Homo sapiens
ccucucuaagccacagcuucuu

SEQ ID NO: 618648 - RNA, 23 nt, Homo sapiens
ccucucuagcacaauuugcacua

SEQ ID NO: 618649 - RNA, 21 nt, Homo sapiens
ccucucuaggccuguugccuc

SEQ ID NO: 618650 - RNA, 22 nt, Homo sapiens
ccucucucacauggaacgcuuu

SEQ ID NO: 618651 - RNA, 21 nt, Homo sapiens
ccucucucauccacuuuccaa

SEQ ID NO: 618652 - RNA, 16 nt, Homo sapiens
ccucucucccuagugc

SEQ ID NO: 618653 - RNA, 21 nt, Homo sapiens
ccucucucucccaggucccag

SEQ ID NO: 618654 - RNA, 23 nt, Homo sapiens
ccucucugcagacuucccagcua

SEQ ID NO: 618655 - RNA, 17 nt, Homo sapiens
ccucucuuaaaugcaag

SEQ ID NO: 618656 - RNA, 16 nt, Homo sapiens
ccucucuuauagaaua

SEQ ID NO: 618657 - RNA, 18 nt, Homo sapiens
ccucucuuuaugcuugcu

SEQ ID NO: 618658 - RNA, 23 nt, Homo sapiens
ccucugcaaaggaaauaccaguu

SEQ ID NO: 618659 - RNA, 17 nt, Homo sapiens
ccucugcacuacugaca

SEQ ID NO: 618660 - RNA, 15 nt, Homo sapiens
ccucugcagcacuuu

SEQ ID NO: 618661 - RNA, 19 nt, Homo sapiens
ccucugcaguuuugacauu

SEQ ID NO: 618662 - RNA, 20 nt, Homo sapiens
ccucugccucccggguucaa

SEQ ID NO: 618663 - RNA, 16 nt, Homo sapiens
ccucugcuacuagcca

SEQ ID NO: 618664 - RNA, 16 nt, Homo sapiens
ccucugcuacuccauc

SEQ ID NO: 618665 - RNA, 10 nt, Homo sapiens
ccucugcucu

SEQ ID NO: 618666 - RNA, 13 nt, Homo sapiens
ccucugcucugag

SEQ ID NO: 618667 - RNA, 19 nt, Homo sapiens
ccucuggacagccagugac

SEQ ID NO: 618668 - RNA, 22 nt, Homo sapiens
ccucuggcuucccuaaacugca

SEQ ID NO: 618669 - RNA, 16 nt, Homo sapiens
ccucuggguuccagca

SEQ ID NO: 618670 - RNA, 22 nt, Homo sapiens
ccucugguuuuccucugcuccu

SEQ ID NO: 618671 - RNA, 20 nt, Homo sapiens
ccucugucauaugcagaauu

SEQ ID NO: 618672 - RNA, 14 nt, Homo sapiens
ccucuguccaggca

SEQ ID NO: 618673 - RNA, 22 nt, Homo sapiens
ccucugucuaggacugcagugu

SEQ ID NO: 618674 - RNA, 18 nt, Homo sapiens
ccucugucucauccuccu

SEQ ID NO: 618675 - RNA, 16 nt, Homo sapiens
ccucugugcaaaggga

SEQ ID NO: 618676 - RNA, 18 nt, Homo sapiens
ccucuguucauuucacac

SEQ ID NO: 618677 - RNA, 16 nt, Homo sapiens
ccucuguuuuccagaa

SEQ ID NO: 618678 - RNA, 13 nt, Homo sapiens
ccucuuaucucau

SEQ ID NO: 618679 - RNA, 19 nt, Homo sapiens
ccucuuauugggauaucau

SEQ ID NO: 618680 - RNA, 20 nt, Homo sapiens
ccucuuauugggauaucauu

SEQ ID NO: 618681 - RNA, 17 nt, Homo sapiens
ccucuucaccuuauuca

SEQ ID NO: 618682 - RNA, 16 nt, Homo sapiens
ccucuuccaccacaga

SEQ ID NO: 618683 - RNA, 16 nt, Homo sapiens
ccucuuccccuugccc

SEQ ID NO: 618684 - RNA, 16 nt, Homo sapiens
ccucuucccugaccuc

SEQ ID NO: 618685 - RNA, 21 nt, Homo sapiens
ccucuuccuccucgcugccag

SEQ ID NO: 618686 - RNA, 21 nt, Homo sapiens
ccucuucugggcuacugccac

SEQ ID NO: 618687 - RNA, 21 nt, Homo sapiens
ccucuugacccugcacccucc

SEQ ID NO: 618688 - RNA, 17 nt, Homo sapiens
ccucuugacuuccccac

SEQ ID NO: 618689 - RNA, 17 nt, Homo sapiens
ccucuugcugccagcua

SEQ ID NO: 618690 - RNA, 22 nt, Homo sapiens
ccucuuggccugaucagaccac

SEQ ID NO: 618691 - RNA, 14 nt, Homo sapiens
ccucuuuaaaaaca

SEQ ID NO: 618692 - RNA, 21 nt, Homo sapiens
ccucuuucuccagcagcugau

SEQ ID NO: 618693 - RNA, 18 nt, Homo sapiens
ccucuuugugauaauucu

SEQ ID NO: 618694 - RNA, 20 nt, Homo sapiens
ccucuuuguuuaucucugag

SEQ ID NO: 618695 - RNA, 18 nt, Homo sapiens
ccucuuuucccucucuag

SEQ ID NO: 618696 - RNA, 15 nt, Homo sapiens
ccucuuuucucugug

SEQ ID NO: 618697 - RNA, 20 nt, Homo sapiens
ccucuuuuguuguccuugcc

SEQ ID NO: 618698 - RNA, 20 nt, Homo sapiens
ccucuuuuuucuaucugcca

SEQ ID NO: 618699 - RNA, 15 nt, Homo sapiens
ccugaaaauucugua

SEQ ID NO: 618700 - RNA, 18 nt, Homo sapiens
ccugaaacagccaugucc

SEQ ID NO: 618701 - RNA, 14 nt, Homo sapiens
ccugaaacaucuca

SEQ ID NO: 618702 - RNA, 23 nt, Homo sapiens
ccugaaacaucucaacaaccuga

SEQ ID NO: 618703 - RNA, 13 nt, Homo sapiens
ccugaaacaugaa

SEQ ID NO: 618704 - RNA, 22 nt, Homo sapiens
ccugaaacccgcccucaggggc

SEQ ID NO: 618705 - RNA, 20 nt, Homo sapiens
ccugaaacuuacacacaaaa

SEQ ID NO: 618706 - RNA, 20 nt, Homo sapiens
ccugaaauuuauucacauau

SEQ ID NO: 618707 - RNA, 16 nt, Homo sapiens
ccugaacauccuuccu

SEQ ID NO: 618708 - RNA, 18 nt, Homo sapiens
ccugaaccuggagcacuu

SEQ ID NO: 618709 - RNA, 19 nt, Homo sapiens
ccugaagaaucccccaugg

SEQ ID NO: 618710 - RNA, 18 nt, Homo sapiens
ccugaagaucaagccagu

SEQ ID NO: 618711 - RNA, 11 nt, Homo sapiens
ccugaagggaa

SEQ ID NO: 618712 - RNA, 20 nt, Homo sapiens
ccugaaguguggcugcaucu

SEQ ID NO: 618713 - RNA, 23 nt, Homo sapiens
ccugaauauuuguuauguagaua

SEQ ID NO: 618714 - RNA, 19 nt, Homo sapiens
ccugaauuaucuauuucau

SEQ ID NO: 618715 - RNA, 12 nt, Homo sapiens
ccugacaccccc

SEQ ID NO: 618716 - RNA, 22 nt, Homo sapiens
ccugacagaaggugccacuuua

SEQ ID NO: 618717 - RNA, 16 nt, Homo sapiens
ccugacagggccagug

SEQ ID NO: 618718 - RNA, 13 nt, Homo sapiens
ccugacauguccu

SEQ ID NO: 618719 - RNA, 17 nt, Homo sapiens
ccugacccuacuucuuu

SEQ ID NO: 618720 - RNA, 22 nt, Homo sapiens
ccugaccucaaguaauccaccu

SEQ ID NO: 618721 - RNA, 22 nt, Homo sapiens
ccugaccucaggugauccaccc

SEQ ID NO: 618722 - RNA, 23 nt, Homo sapiens
ccugacgcgcgcccgcagggugg

SEQ ID NO: 618723 - RNA, 18 nt, Homo sapiens
ccugacggcuggggaccc

SEQ ID NO: 618724 - RNA, 20 nt, Homo sapiens
ccugacggcuggggacccac

SEQ ID NO: 618725 - RNA, 22 nt, Homo sapiens
ccugacggcuggggacccaccc

SEQ ID NO: 618726 - RNA, 18 nt, Homo sapiens
ccugacgugcagccacac

SEQ ID NO: 618727 - RNA, 18 nt, Homo sapiens
ccugacuccuccaaggaa

SEQ ID NO: 618728 - RNA, 18 nt, Homo sapiens
ccugagaagaaguggcug

SEQ ID NO: 618729 - RNA, 23 nt, Homo sapiens
ccugagagauuuaacauuaucua

SEQ ID NO: 618730 - RNA, 15 nt, Homo sapiens
ccugagagucagggu

SEQ ID NO: 618731 - RNA, 13 nt, Homo sapiens
ccugagaugauuu

SEQ ID NO: 618732 - RNA, 19 nt, Homo sapiens
ccugagcagaauacugguc

SEQ ID NO: 618733 - RNA, 15 nt, Homo sapiens
ccugagccacaaaaa

SEQ ID NO: 618734 - RNA, 19 nt, Homo sapiens
ccugagcugggagggaacc

SEQ ID NO: 618735 - RNA, 17 nt, Homo sapiens
ccugagcuggggaagcc

SEQ ID NO: 618736 - RNA, 19 nt, Homo sapiens
ccugaggaggaggacacag

SEQ ID NO: 618737 - RNA, 15 nt, Homo sapiens
ccugagguacagaga

SEQ ID NO: 618738 - RNA, 23 nt, Homo sapiens
ccugagguacagagaagagugag

SEQ ID NO: 618739 - RNA, 14 nt, Homo sapiens
ccugagucccuuaa

SEQ ID NO: 618740 - RNA, 12 nt, Homo sapiens
ccugagugaucc

SEQ ID NO: 618741 - RNA, 22 nt, Homo sapiens
ccugaguuugggagagugguga

SEQ ID NO: 618742 - RNA, 16 nt, Homo sapiens
ccuugcggaagccaua

SEQ ID NO: 618743 - RNA, 17 nt, Homo sapiens
ccuugcggaagccauag

SEQ ID NO: 618744 - RNA, 14 nt, Homo sapiens
ccuugcugacucuc

SEQ ID NO: 618745 - RNA, 12 nt, Homo sapiens
ccuugcugcacc

SEQ ID NO: 618746 - RNA, 23 nt, Homo sapiens
ccuugcuggacggggacugggga

SEQ ID NO: 618747 - RNA, 18 nt, Homo sapiens
ccuuggaccguaucacug

SEQ ID NO: 618748 - RNA, 21 nt, Homo sapiens
ccuuggagaggagaguggcag

SEQ ID NO: 618749 - RNA, 23 nt, Homo sapiens
ccuuggccucccaaagugcuagu

SEQ ID NO: 618750 - RNA, 20 nt, Homo sapiens
ccuuggccuccccugcugaa

SEQ ID NO: 618751 - RNA, 16 nt, Homo sapiens
ccuuggcugacaugaa

SEQ ID NO: 618752 - RNA, 19 nt, Homo sapiens
ccuugggagguuuuauucu

SEQ ID NO: 618753 - RNA, 15 nt, Homo sapiens
ccuugggaugaucuu

SEQ ID NO: 618754 - RNA, 23 nt, Homo sapiens
ccuugggcacuuuuuaauucacc

SEQ ID NO: 618755 - RNA, 21 nt, Homo sapiens
ccuugggccuuucagucccaa

SEQ ID NO: 618756 - RNA, 20 nt, Homo sapiens
ccuugggcuauuuggacuca

SEQ ID NO: 618757 - RNA, 16 nt, Homo sapiens
ccuugggcugcuccuc

SEQ ID NO: 618758 - RNA, 19 nt, Homo sapiens
ccuugguggggagcacaga

SEQ ID NO: 618759 - RNA, 22 nt, Homo sapiens
ccuugguuccuaacuggaauca

SEQ ID NO: 618760 - RNA, 19 nt, Homo sapiens
ccuuguaauucuaaaugaa

SEQ ID NO: 618761 - RNA, 14 nt, Homo sapiens
ccuuguauaguguc

SEQ ID NO: 618762 - RNA, 23 nt, Homo sapiens
ccuuguaucuauuuguggugaau

SEQ ID NO: 618763 - RNA, 18 nt, Homo sapiens
ccuugucccagccaguga

SEQ ID NO: 618764 - RNA, 20 nt, Homo sapiens
ccuugucucucacugcauuu

SEQ ID NO: 618765 - RNA, 12 nt, Homo sapiens
ccuugugaucca

SEQ ID NO: 618766 - RNA, 12 nt, Homo sapiens
ccuugugccuug

SEQ ID NO: 618767 - RNA, 16 nt, Homo sapiens
ccuugugcguggguga

SEQ ID NO: 618768 - RNA, 22 nt, Homo sapiens
ccuuguggcugagaacuggaca

SEQ ID NO: 618769 - RNA, 21 nt, Homo sapiens
ccuuguguacaguuauuuaug

SEQ ID NO: 618770 - RNA, 22 nt, Homo sapiens
ccuuguucccuaggggacacuu

SEQ ID NO: 618771 - RNA, 20 nt, Homo sapiens
ccuuguuguguuucuaucuc

SEQ ID NO: 618772 - RNA, 17 nt, Homo sapiens
ccuuguuuuugccaaag

SEQ ID NO: 618773 - RNA, 13 nt, Homo sapiens
ccuuuaaucugca

SEQ ID NO: 618774 - RNA, 12 nt, Homo sapiens
ccuuuacuauca

SEQ ID NO: 618775 - RNA, 24 nt, Homo sapiens
ccuuuagaggguaccgucuucucc

SEQ ID NO: 618776 - RNA, 17 nt, Homo sapiens
ccuuuaguaccugaaaa

SEQ ID NO: 618777 - RNA, 21 nt, Homo sapiens
ccuuuaucaccucauucugaa

SEQ ID NO: 618778 - RNA, 19 nt, Homo sapiens
ccuuuauguggaaaacaga

SEQ ID NO: 618779 - RNA, 20 nt, Homo sapiens
ccuuuauuaaaaacugagug

SEQ ID NO: 618780 - RNA, 16 nt, Homo sapiens
ccuuucaaauuucaca

SEQ ID NO: 618781 - RNA, 17 nt, Homo sapiens
ccuuucacuaaaacaca

SEQ ID NO: 618782 - RNA, 18 nt, Homo sapiens
ccuuucagggccagggcu

SEQ ID NO: 618783 - RNA, 15 nt, Homo sapiens
ccuuucauuaggcaa

SEQ ID NO: 618784 - RNA, 18 nt, Homo sapiens
ccuuucauuaggcaaagu

SEQ ID NO: 618785 - RNA, 22 nt, Homo sapiens
ccuuuccaaaugcccagcuuaa

SEQ ID NO: 618786 - RNA, 18 nt, Homo sapiens
ccuuuccaagucacuaga

SEQ ID NO: 618787 - RNA, 19 nt, Homo sapiens
ccuuuccaagucacuagaa

SEQ ID NO: 618788 - RNA, 13 nt, Homo sapiens
ccuuuccaauaga

SEQ ID NO: 618789 - RNA, 23 nt, Homo sapiens
ccuuucccucucccaguccauuu

SEQ ID NO: 618790 - RNA, 13 nt, Homo sapiens
ccuuuccucaaaa

SEQ ID NO: 618791 - RNA, 14 nt, Homo sapiens
ccuuuccucaaaac

SEQ ID NO: 618792 - RNA, 19 nt, Homo sapiens
ccuuuccuccccaccuucc

SEQ ID NO: 618793 - RNA, 16 nt, Homo sapiens
ccuuuccuucacugcc

SEQ ID NO: 618794 - RNA, 13 nt, Homo sapiens
ccuuuccuuccag

SEQ ID NO: 618795 - RNA, 17 nt, Homo sapiens
ccuuucgagcucugcag

SEQ ID NO: 618796 - RNA, 12 nt, Homo sapiens
ccuuucuaaucc

SEQ ID NO: 618797 - RNA, 20 nt, Homo sapiens
ccuuucuccaggaccaauaa

SEQ ID NO: 618798 - RNA, 18 nt, Homo sapiens
ccuuucucccagugaaau

SEQ ID NO: 618799 - RNA, 22 nt, Homo sapiens
ccuuucuccuccccaccuguag

SEQ ID NO: 618800 - RNA, 19 nt, Homo sapiens
ccuuucuggguaacaagcc

SEQ ID NO: 618801 - RNA, 18 nt, Homo sapiens
ccuuucuguugccaguca

SEQ ID NO: 618802 - RNA, 21 nt, Homo sapiens
ccuuucuguugccagucagca

SEQ ID NO: 618803 - RNA, 15 nt, Homo sapiens
ccuuucuuacauuag

SEQ ID NO: 618804 - RNA, 18 nt, Homo sapiens
ccuuucuuauuaauuuca

SEQ ID NO: 618805 - RNA, 16 nt, Homo sapiens
ccuuucuugaauuagc

SEQ ID NO: 618806 - RNA, 12 nt, Homo sapiens
ccuuucuugucu

SEQ ID NO: 618807 - RNA, 17 nt, Homo sapiens
ccuuugaagccucagcu

SEQ ID NO: 618808 - RNA, 17 nt, Homo sapiens
ccuuugauucuccagua

SEQ ID NO: 618809 - RNA, 13 nt, Homo sapiens
ccuuugccuucca

SEQ ID NO: 618810 - RNA, 15 nt, Homo sapiens
ccuuugcuaaugcua

SEQ ID NO: 618811 - RNA, 20 nt, Homo sapiens
ccuuugcucugaggucccuu

SEQ ID NO: 618812 - RNA, 17 nt, Homo sapiens
ccuuugcuucaaauuca

SEQ ID NO: 618813 - RNA, 14 nt, Homo sapiens
ccuuuggaaagcca

SEQ ID NO: 618814 - RNA, 19 nt, Homo sapiens
ccuuuggccccacuuugaa

SEQ ID NO: 618815 - RNA, 18 nt, Homo sapiens
ccuuugggaggcugaggc

SEQ ID NO: 618816 - RNA, 22 nt, Homo sapiens
ccuuuggggagcaggaggccaa

SEQ ID NO: 618817 - RNA, 14 nt, Homo sapiens
ccuuugucaucauu

SEQ ID NO: 618818 - RNA, 15 nt, Homo sapiens
ccuuuguguggcucc

SEQ ID NO: 618819 - RNA, 20 nt, Homo sapiens
ccuuuguguggcuccuggua

SEQ ID NO: 618820 - RNA, 18 nt, Homo sapiens
ccuuugugugugugguuc

SEQ ID NO: 618821 - RNA, 14 nt, Homo sapiens
ccuuuuaaaaaccu

SEQ ID NO: 618822 - RNA, 14 nt, Homo sapiens
ccuuuuaaaacacu

SEQ ID NO: 618823 - RNA, 14 nt, Homo sapiens
ccuuuuaacaccuu

SEQ ID NO: 618824 - RNA, 13 nt, Homo sapiens
ccuuuuaagggug

SEQ ID NO: 618825 - RNA, 13 nt, Homo sapiens
ccuuuucaugauu

SEQ ID NO: 618826 - RNA, 13 nt, Homo sapiens
ccuuuuccacuuu

SEQ ID NO: 618827 - RNA, 18 nt, Homo sapiens
ccuuuuccaugacugugg

SEQ ID NO: 618828 - RNA, 16 nt, Homo sapiens
ccuuuucuauguugcu

SEQ ID NO: 618829 - RNA, 17 nt, Homo sapiens
ccuuuucuccuugccuu

SEQ ID NO: 618830 - RNA, 20 nt, Homo sapiens
ccuuuugacagcugugcugu

SEQ ID NO: 618831 - RNA, 13 nt, Homo sapiens
ccuuuugaccaaa

SEQ ID NO: 618832 - RNA, 18 nt, Homo sapiens
ccuuuugaccaaauaaag

SEQ ID NO: 618833 - RNA, 11 nt, Homo sapiens
ccuuuugcaac

SEQ ID NO: 618834 - RNA, 22 nt, Homo sapiens
ccuuuugcacauaacaugcuuu

SEQ ID NO: 618835 - RNA, 16 nt, Homo sapiens
ccuuuuggcacugaga

SEQ ID NO: 618836 - RNA, 14 nt, Homo sapiens
ccuuuugugugaug

SEQ ID NO: 618837 - RNA, 13 nt, Homo sapiens
ccuuuuguuaaaa

SEQ ID NO: 618838 - RNA, 21 nt, Homo sapiens
ccuuuuuaaaaagcaccuauu

SEQ ID NO: 618839 - RNA, 13 nt, Homo sapiens
ccuuuuucaauga

SEQ ID NO: 618840 - RNA, 13 nt, Homo sapiens
ccuuuuucacuuu

SEQ ID NO: 618841 - RNA, 17 nt, Homo sapiens
ccuuuuuccauaguguu

SEQ ID NO: 618842 - RNA, 22 nt, Homo sapiens
ccuuuuucuucacuuacaagaa

SEQ ID NO: 618843 - RNA, 20 nt, Homo sapiens
ccuuuuugaaaguugccuuu

SEQ ID NO: 618844 - RNA, 14 nt, Homo sapiens
ccuuuuugguacuu

SEQ ID NO: 618845 - RNA, 13 nt, Homo sapiens
ccuuuuuguacug

SEQ ID NO: 618846 - RNA, 14 nt, Homo sapiens
ccuuuuuguacuga

SEQ ID NO: 618847 - RNA, 13 nt, Homo sapiens
ccuuuuuucccau

SEQ ID NO: 618848 - RNA, 16 nt, Homo sapiens
ccuuuuuugcaugugc

SEQ ID NO: 618849 - RNA, 16 nt, Homo sapiens
ccuuuuuuguuauuau

SEQ ID NO: 618850 - RNA, 15 nt, Homo sapiens
ccuuuuuuucccaaa

SEQ ID NO: 618851 - RNA, 15 nt, Homo sapiens
cgaaaaggauaugca

SEQ ID NO: 618852 - RNA, 17 nt, Homo sapiens
cgaaaaggauaugcagu

SEQ ID NO: 618853 - RNA, 16 nt, Homo sapiens
cgaaacaacaacgaga

SEQ ID NO: 618854 - RNA, 21 nt, Homo sapiens
cgaaaccgguggggcugguuc

SEQ ID NO: 618855 - RNA, 19 nt, Homo sapiens
cgaaacuccauugagucau

SEQ ID NO: 618856 - RNA, 15 nt, Homo sapiens
cgaaacuuguuauug

SEQ ID NO: 618857 - RNA, 22 nt, Homo sapiens
cgaaauuaaaucugaauaaaua

SEQ ID NO: 618858 - RNA, 14 nt, Homo sapiens
cgaacaauucauau

SEQ ID NO: 618859 - RNA, 16 nt, Homo sapiens
cgaagccuuaagccau

SEQ ID NO: 618860 - RNA, 12 nt, Homo sapiens
cgaagucuuccc

SEQ ID NO: 618861 - RNA, 19 nt, Homo sapiens
cgaaguguuuauguaauag

SEQ ID NO: 618862 - RNA, 21 nt, Homo sapiens
cgaaucacacagacaguuucu

SEQ ID NO: 618863 - RNA, 18 nt, Homo sapiens
cgaauguuagauuccucu

SEQ ID NO: 618864 - RNA, 21 nt, Homo sapiens
cucggcacacacugugcccca

SEQ ID NO: 618865 - RNA, 13 nt, Homo sapiens
cucgggaaacaca

SEQ ID NO: 618866 - RNA, 21 nt, Homo sapiens
cucgggaaacuuagaucauca

SEQ ID NO: 618867 - RNA, 17 nt, Homo sapiens
cucgggggccuguggug

SEQ ID NO: 618868 - RNA, 14 nt, Homo sapiens
cucgggguaaaaag

SEQ ID NO: 618869 - RNA, 16 nt, Homo sapiens
cucggucacaucaggc

SEQ ID NO: 618870 - RNA, 18 nt, Homo sapiens
cucgguggcccagguggu

SEQ ID NO: 618871 - RNA, 20 nt, Homo sapiens
cucguauaugucucaggucc

SEQ ID NO: 618872 - RNA, 17 nt, Homo sapiens
cucgucagccaccuggg

SEQ ID NO: 618873 - RNA, 14 nt, Homo sapiens
cucguccacagggg

SEQ ID NO: 618874 - RNA, 11 nt, Homo sapiens
cucguccuccc

SEQ ID NO: 618875 - RNA, 17 nt, Homo sapiens
cucgucuuccuuguuaa

SEQ ID NO: 618876 - RNA, 11 nt, Homo sapiens
cucgugcagua

SEQ ID NO: 618877 - RNA, 15 nt, Homo sapiens
cucgugugauuuccu

SEQ ID NO: 618878 - RNA, 12 nt, Homo sapiens
cucgugugcaac

SEQ ID NO: 618879 - RNA, 23 nt, Homo sapiens
cucguuuuaagaaacuagcagau

SEQ ID NO: 618880 - RNA, 18 nt, Homo sapiens
cucuaaaacccuguguuc

SEQ ID NO: 618881 - RNA, 14 nt, Homo sapiens
cucuaaacugcggu

SEQ ID NO: 618882 - RNA, 20 nt, Homo sapiens
cucuaaagaaaaaugccugu

SEQ ID NO: 618883 - RNA, 23 nt, Homo sapiens
cucuaaccagauggaacacugga

SEQ ID NO: 618884 - RNA, 13 nt, Homo sapiens
cucuaaccauuca

SEQ ID NO: 618885 - RNA, 16 nt, Homo sapiens
cucuaacccuguggaa

SEQ ID NO: 618886 - RNA, 20 nt, Homo sapiens
cucuaacucagaaacaucag

SEQ ID NO: 618887 - RNA, 17 nt, Homo sapiens
cucuaagaauucucucu

SEQ ID NO: 618888 - RNA, 22 nt, Homo sapiens
cucuaagauaucuuugcugcuu

SEQ ID NO: 618889 - RNA, 22 nt, Homo sapiens
cucuaagccacucuuccaaagg

SEQ ID NO: 618890 - RNA, 15 nt, Homo sapiens
cucuaagcgugcuga

SEQ ID NO: 618891 - RNA, 17 nt, Homo sapiens
cucuaagguaacauuua

SEQ ID NO: 618892 - RNA, 22 nt, Homo sapiens
cucuaauguacaauaaagcaau

SEQ ID NO: 618893 - RNA, 23 nt, Homo sapiens
cucuaauguacaauaaagcaaug

SEQ ID NO: 618894 - RNA, 18 nt, Homo sapiens
cucuaauuagucuaucaa

SEQ ID NO: 618895 - RNA, 19 nt, Homo sapiens
cucuaauuagucuaucaaa

SEQ ID NO: 618896 - RNA, 14 nt, Homo sapiens
cucuacacugugaa

SEQ ID NO: 618897 - RNA, 13 nt, Homo sapiens
cucuacagacucc

SEQ ID NO: 618898 - RNA, 14 nt, Homo sapiens
cucuacagugccaa

SEQ ID NO: 618899 - RNA, 12 nt, Homo sapiens
cucuaccagucu

SEQ ID NO: 618900 - RNA, 20 nt, Homo sapiens
cucuacccauccccugaugc

SEQ ID NO: 618901 - RNA, 17 nt, Homo sapiens
cucuaccccugcuccca

SEQ ID NO: 618902 - RNA, 22 nt, Homo sapiens
cucuacccucuuagaaaaacca

SEQ ID NO: 618903 - RNA, 11 nt, Homo sapiens
cucuaccuaau

SEQ ID NO: 618904 - RNA, 14 nt, Homo sapiens
cucuacgccaaagu

SEQ ID NO: 618905 - RNA, 14 nt, Homo sapiens
cucuacgugcuccu

SEQ ID NO: 618906 - RNA, 15 nt, Homo sapiens
cucuacgugcuccuc

SEQ ID NO: 618907 - RNA, 17 nt, Homo sapiens
cucuacuaaaaauacaa

SEQ ID NO: 618908 - RNA, 19 nt, Homo sapiens
cucuacuaaaaauacaaaa

SEQ ID NO: 618909 - RNA, 20 nt, Homo sapiens
cucuacuaaaaauacaaaaa

SEQ ID NO: 618910 - RNA, 16 nt, Homo sapiens
cucuacuacaugugac

SEQ ID NO: 618911 - RNA, 18 nt, Homo sapiens
cucuacuccuaccucagc

SEQ ID NO: 618912 - RNA, 16 nt, Homo sapiens
cucuacugaaugucau

SEQ ID NO: 618913 - RNA, 19 nt, Homo sapiens
cucuagacaagauauugua

SEQ ID NO: 618914 - RNA, 17 nt, Homo sapiens
cucuagagucacugaua

SEQ ID NO: 618915 - RNA, 20 nt, Homo sapiens
cucuagcaggccuaagacau

SEQ ID NO: 618916 - RNA, 22 nt, Homo sapiens
cucuagccugggugacagagcg

SEQ ID NO: 618917 - RNA, 23 nt, Homo sapiens
cucuagcugggggugggccaggc

SEQ ID NO: 618918 - RNA, 17 nt, Homo sapiens
cucuaggccuguugccu

SEQ ID NO: 618919 - RNA, 21 nt, Homo sapiens
cucuagguacgaugacagugu

SEQ ID NO: 618920 - RNA, 19 nt, Homo sapiens
cucuaguaagaugcacuga

SEQ ID NO: 618921 - RNA, 14 nt, Homo sapiens
cucuagugaaugua

SEQ ID NO: 618922 - RNA, 20 nt, Homo sapiens
cucuagugacuuccugguga

SEQ ID NO: 618923 - RNA, 18 nt, Homo sapiens
cucuagugucuuuugccu

SEQ ID NO: 618924 - RNA, 21 nt, Homo sapiens
cucuaguuucuuccuguagua

SEQ ID NO: 618925 - RNA, 19 nt, Homo sapiens
cucuauaaaaaauauguau

SEQ ID NO: 618926 - RNA, 22 nt, Homo sapiens
cucuauacaaaaugauuuugaa

SEQ ID NO: 618927 - RNA, 21 nt, Homo sapiens
cucuauagacucuaggacaua

SEQ ID NO: 618928 - RNA, 15 nt, Homo sapiens
cucuauuuagcauga

SEQ ID NO: 618929 - RNA, 16 nt, Homo sapiens
cucucaacuucaucag

SEQ ID NO: 618930 - RNA, 15 nt, Homo sapiens
cucucaauaugcuua

SEQ ID NO: 618931 - RNA, 19 nt, Homo sapiens
cucucacugcauuugguca

SEQ ID NO: 618932 - RNA, 12 nt, Homo sapiens
cucucacuuugg

SEQ ID NO: 618933 - RNA, 14 nt, Homo sapiens
cucucagaacauac

SEQ ID NO: 618934 - RNA, 20 nt, Homo sapiens
cucucagccagcuguuuaag

SEQ ID NO: 618935 - RNA, 12 nt, Homo sapiens
cucucagccuua

SEQ ID NO: 618936 - RNA, 21 nt, Homo sapiens
cucucaggagagugugcaacu

SEQ ID NO: 618937 - RNA, 18 nt, Homo sapiens
cucucagggaaagccucu

SEQ ID NO: 618938 - RNA, 22 nt, Homo sapiens
cucucagggaaagccucuggca

SEQ ID NO: 618939 - RNA, 21 nt, Homo sapiens
cucucagucucugagcaguga

SEQ ID NO: 618940 - RNA, 16 nt, Homo sapiens
cucucaguguuuugga

SEQ ID NO: 618941 - RNA, 13 nt, Homo sapiens
cucuccaaacagu

SEQ ID NO: 618942 - RNA, 15 nt, Homo sapiens
cucuccaagugccag

SEQ ID NO: 618943 - RNA, 13 nt, Homo sapiens
cucuccagccauu

SEQ ID NO: 618944 - RNA, 22 nt, Homo sapiens
cucuccauaucuccuuccccua

SEQ ID NO: 618945 - RNA, 13 nt, Homo sapiens
cucuccauggcca

SEQ ID NO: 618946 - RNA, 20 nt, Homo sapiens
cucucccaaaaaacuacuuc

SEQ ID NO: 618947 - RNA, 21 nt, Homo sapiens
cucucccaaaaaacuacuucu

SEQ ID NO: 618948 - RNA, 20 nt, Homo sapiens
cucucccaacucuugcacag

SEQ ID NO: 618949 - RNA, 14 nt, Homo sapiens
cucucccaguccau

SEQ ID NO: 618950 - RNA, 13 nt, Homo sapiens
cucucccauccag

SEQ ID NO: 618951 - RNA, 13 nt, Homo sapiens
cucucccuaggcu

SEQ ID NO: 618952 - RNA, 18 nt, Homo sapiens
cucuccuacucacuuaaa

SEQ ID NO: 618953 - RNA, 16 nt, Homo sapiens
cucuccugacuuuuaa

SEQ ID NO: 618954 - RNA, 14 nt, Homo sapiens
cucuccugcaaaag

SEQ ID NO: 618955 - RNA, 23 nt, Homo sapiens
cucuccugccugcccugccucag

SEQ ID NO: 618956 - RNA, 17 nt, Homo sapiens
cucuccuggcccuggaa

SEQ ID NO: 618957 - RNA, 16 nt, Homo sapiens
cucuccuuuggccauu

SEQ ID NO: 618958 - RNA, 20 nt, Homo sapiens
cucuccuuuuucucuucaca

SEQ ID NO: 618959 - RNA, 18 nt, Homo sapiens
cucucgacaguauccaca

SEQ ID NO: 618960 - RNA, 18 nt, Homo sapiens
cucucgccuguaaucuca

SEQ ID NO: 618961 - RNA, 18 nt, Homo sapiens
cucucuaccagucuauuu

SEQ ID NO: 618962 - RNA, 21 nt, Homo sapiens
cucucuaccagucuauuucca

SEQ ID NO: 618963 - RNA, 20 nt, Homo sapiens
cucucucagcuaucacauca

SEQ ID NO: 618964 - RNA, 14 nt, Homo sapiens
cucucucauccacu

SEQ ID NO: 618965 - RNA, 14 nt, Homo sapiens
cucucucgaccuuc

SEQ ID NO: 618966 - RNA, 13 nt, Homo sapiens
cucucucucugaa

SEQ ID NO: 618967 - RNA, 15 nt, Homo sapiens
cucucucugcuccca

SEQ ID NO: 618968 - RNA, 14 nt, Homo sapiens
cucucugccaagau

SEQ ID NO: 618969 - RNA, 16 nt, Homo sapiens
cucucugccugggaug

SEQ ID NO: 618970 - RNA, 17 nt, Homo sapiens
cucucugccuguaaaug

SEQ ID NO: 618971 - RNA, 17 nt, Homo sapiens
cucucuggauacugcaa

SEQ ID NO: 618972 - RNA, 15 nt, Homo sapiens
cucucuguggugaga

SEQ ID NO: 618973 - RNA, 22 nt, Homo sapiens
cucucuucugcugucucuccua

SEQ ID NO: 618974 - RNA, 23 nt, Homo sapiens
cucucuugcaggaaggacuauga

SEQ ID NO: 618975 - RNA, 11 nt, Homo sapiens
cucucuugccc

SEQ ID NO: 618976 - RNA, 14 nt, Homo sapiens
cucugaaaccagug

SEQ ID NO: 618977 - RNA, 21 nt, Homo sapiens
cucugaaagaccuaugagcaa

SEQ ID NO: 618978 - RNA, 19 nt, Homo sapiens
cucugaacugcaacacugg

SEQ ID NO: 618979 - RNA, 17 nt, Homo sapiens
cucugaacuugccuuaa

SEQ ID NO: 618980 - RNA, 16 nt, Homo sapiens
cucugaagcauguuuc

SEQ ID NO: 618981 - RNA, 18 nt, Homo sapiens
cucugaagcauguuucau

SEQ ID NO: 618982 - RNA, 13 nt, Homo sapiens
cucugaagccaca

SEQ ID NO: 618983 - RNA, 19 nt, Homo sapiens
cucugaagcuaauuguacu

SEQ ID NO: 618984 - RNA, 19 nt, Homo sapiens
cucugaagucacaucacag

SEQ ID NO: 618985 - RNA, 14 nt, Homo sapiens
cucugaaucuguac

SEQ ID NO: 618986 - RNA, 22 nt, Homo sapiens
cugagggaggaccuggggcaca

SEQ ID NO: 618987 - RNA, 16 nt, Homo sapiens
cugagggcagacuggg

SEQ ID NO: 618988 - RNA, 20 nt, Homo sapiens
cugaggggaggcaccuccag

SEQ ID NO: 618989 - RNA, 18 nt, Homo sapiens
cugaggggauaccauaaa

SEQ ID NO: 618990 - RNA, 16 nt, Homo sapiens
cugaggggcaucugcc

SEQ ID NO: 618991 - RNA, 11 nt, Homo sapiens
cugaggggugu

SEQ ID NO: 618992 - RNA, 17 nt, Homo sapiens
cugaggguguuucuucc

SEQ ID NO: 618993 - RNA, 21 nt, Homo sapiens
cugagguauaaagacaaguau

SEQ ID NO: 618994 - RNA, 20 nt, Homo sapiens
cugaggugggaggaucucuu

SEQ ID NO: 618995 - RNA, 17 nt, Homo sapiens
cugagguuggauuugcu

SEQ ID NO: 618996 - RNA, 21 nt, Homo sapiens
cugagguuuagaugugcaacc

SEQ ID NO: 618997 - RNA, 19 nt, Homo sapiens
cugagguuugccagcauuu

SEQ ID NO: 618998 - RNA, 17 nt, Homo sapiens
cugagguuuugaaagaa

SEQ ID NO: 618999 - RNA, 18 nt, Homo sapiens
cugaguaagcccucagga

SEQ ID NO: 619000 - RNA, 17 nt, Homo sapiens
cugaguaaucgcuuaaa

SEQ ID NO: 619001 - RNA, 16 nt, Homo sapiens
cugaguagggggagca

SEQ ID NO: 619002 - RNA, 19 nt, Homo sapiens
cugaguagugacacacaga

SEQ ID NO: 619003 - RNA, 18 nt, Homo sapiens
cugaguauguaacuugca

SEQ ID NO: 619004 - RNA, 17 nt, Homo sapiens
cugagucagacugucag

SEQ ID NO: 619005 - RNA, 18 nt, Homo sapiens
cugagucccuccaugcaa

SEQ ID NO: 619006 - RNA, 18 nt, Homo sapiens
cugagucuggaccuccau

SEQ ID NO: 619007 - RNA, 19 nt, Homo sapiens
cugagucuuuucauugcua

SEQ ID NO: 619008 - RNA, 17 nt, Homo sapiens
cugagugacugcagcuu

SEQ ID NO: 619009 - RNA, 21 nt, Homo sapiens
cugagugccagcccuggcaga

SEQ ID NO: 619010 - RNA, 13 nt, Homo sapiens
cugagugcugaaa

SEQ ID NO: 619011 - RNA, 19 nt, Homo sapiens
cugagugggagaaggcagu

SEQ ID NO: 619012 - RNA, 13 nt, Homo sapiens
cugaguggggcca

SEQ ID NO: 619013 - RNA, 15 nt, Homo sapiens
cugaguggugccaaa

SEQ ID NO: 619014 - RNA, 16 nt, Homo sapiens
cugaguggugccaaac

SEQ ID NO: 619015 - RNA, 21 nt, Homo sapiens
cugaguguccagcacaccugc

SEQ ID NO: 619016 - RNA, 13 nt, Homo sapiens
cugaguucuuaga

SEQ ID NO: 619017 - RNA, 18 nt, Homo sapiens
cugaguugccaagacaaa

SEQ ID NO: 619018 - RNA, 19 nt, Homo sapiens
cugaguuucuggcucuuga

SEQ ID NO: 619019 - RNA, 16 nt, Homo sapiens
cugaguuuugaugcug

SEQ ID NO: 619020 - RNA, 19 nt, Homo sapiens
cugauaagcuaacaccaga

SEQ ID NO: 619021 - RNA, 19 nt, Homo sapiens
cugauaauaugcaaaugaa

SEQ ID NO: 619022 - RNA, 14 nt, Homo sapiens
cugauaaugcucac

SEQ ID NO: 619023 - RNA, 15 nt, Homo sapiens
cugauaaugcucacu

SEQ ID NO: 619024 - RNA, 14 nt, Homo sapiens
cugauaccacugca

SEQ ID NO: 619025 - RNA, 12 nt, Homo sapiens
cugauacugcug

SEQ ID NO: 619026 - RNA, 18 nt, Homo sapiens
cugauagcucugccuuac

SEQ ID NO: 619027 - RNA, 13 nt, Homo sapiens
cugauaguuuuau

SEQ ID NO: 619028 - RNA, 12 nt, Homo sapiens
cugauaugaguu

SEQ ID NO: 619029 - RNA, 20 nt, Homo sapiens
cugauaugcaaguaagaaau

SEQ ID NO: 619030 - RNA, 19 nt, Homo sapiens
cugauauucaaauggacaa

SEQ ID NO: 619031 - RNA, 21 nt, Homo sapiens
cugauauugccgcacuagggg

SEQ ID NO: 619032 - RNA, 14 nt, Homo sapiens
cugaucaugcauug

SEQ ID NO: 619033 - RNA, 16 nt, Homo sapiens
cugaucauuacauggc

SEQ ID NO: 619034 - RNA, 14 nt, Homo sapiens
cugauccagccuuu

SEQ ID NO: 619035 - RNA, 18 nt, Homo sapiens
cugaucuagcacuccuca

SEQ ID NO: 619036 - RNA, 16 nt, Homo sapiens
cugaucuagugcagua

SEQ ID NO: 619037 - RNA, 17 nt, Homo sapiens
cugaucugcacauuuca

SEQ ID NO: 619038 - RNA, 17 nt, Homo sapiens
cugaucugcggaucuca

SEQ ID NO: 619039 - RNA, 24 nt, Homo sapiens
cugaucugcggaucucagcuuuga

SEQ ID NO: 619040 - RNA, 18 nt, Homo sapiens
cugaucugcuagugcugu

SEQ ID NO: 619041 - RNA, 12 nt, Homo sapiens
cugaucugugau

SEQ ID NO: 619042 - RNA, 13 nt, Homo sapiens
cugaucugugaua

SEQ ID NO: 619043 - RNA, 20 nt, Homo sapiens
cugaucuucccaccucacag

SEQ ID NO: 619044 - RNA, 15 nt, Homo sapiens
cugaugacuugcuua

SEQ ID NO: 619045 - RNA, 15 nt, Homo sapiens
cugaugagcacaucu

SEQ ID NO: 619046 - RNA, 15 nt, Homo sapiens
cugaugagcacgguu

SEQ ID NO: 619047 - RNA, 15 nt, Homo sapiens
cugaugauacaugca

SEQ ID NO: 619048 - RNA, 12 nt, Homo sapiens
cugaugaucaaa

SEQ ID NO: 619049 - RNA, 18 nt, Homo sapiens
cugaugccccugacauca

SEQ ID NO: 619050 - RNA, 17 nt, Homo sapiens
cugauggaaaaugcaaa

SEQ ID NO: 619051 - RNA, 16 nt, Homo sapiens
cugauggaacagaaua

SEQ ID NO: 619052 - RNA, 19 nt, Homo sapiens
cugauggaaguaaagccuc

SEQ ID NO: 619053 - RNA, 13 nt, Homo sapiens
cugauggccaagg

SEQ ID NO: 619054 - RNA, 14 nt, Homo sapiens
cugauggcuugaca

SEQ ID NO: 619055 - RNA, 21 nt, Homo sapiens
cugauggcuugacaugugcaa

SEQ ID NO: 619056 - RNA, 15 nt, Homo sapiens
cugaugggaaaacug

SEQ ID NO: 619057 - RNA, 19 nt, Homo sapiens
cugauguaccugaugcuau

SEQ ID NO: 619058 - RNA, 19 nt, Homo sapiens
cugaugucccagugcucac

SEQ ID NO: 619059 - RNA, 18 nt, Homo sapiens
cugauguuacuagccucu

SEQ ID NO: 619060 - RNA, 13 nt, Homo sapiens
cugauguuuauaa

SEQ ID NO: 619061 - RNA, 21 nt, Homo sapiens
cugauguuuauaaacugagag

SEQ ID NO: 619062 - RNA, 13 nt, Homo sapiens
cugauuccagaac

SEQ ID NO: 619063 - RNA, 20 nt, Homo sapiens
cugauucuuaugauuacuau

SEQ ID NO: 619064 - RNA, 14 nt, Homo sapiens
cugauuugaugaua

SEQ ID NO: 619065 - RNA, 18 nt, Homo sapiens
cugauuuguauucuguga

SEQ ID NO: 619066 - RNA, 19 nt, Homo sapiens
cugauuuuggccaucagga

SEQ ID NO: 619067 - RNA, 19 nt, Homo sapiens
cugcaaaaaugaaauccag

SEQ ID NO: 619068 - RNA, 16 nt, Homo sapiens
cugcaaaacacuaaag

SEQ ID NO: 619069 - RNA, 20 nt, Homo sapiens
cugcaaaaugucuuaaugca

SEQ ID NO: 619070 - RNA, 22 nt, Homo sapiens
cugcaaaaugucuuaaugcaaa

SEQ ID NO: 619071 - RNA, 18 nt, Homo sapiens
cugcaaaccuuccuggga

SEQ ID NO: 619072 - RNA, 14 nt, Homo sapiens
cugcaacaaaaagu

SEQ ID NO: 619073 - RNA, 22 nt, Homo sapiens
cugcaaccaacuacaaccaagc

SEQ ID NO: 619074 - RNA, 21 nt, Homo sapiens
cugcaacuggagccaagaaga

SEQ ID NO: 619075 - RNA, 15 nt, Homo sapiens
cugcaagauggacac

SEQ ID NO: 619076 - RNA, 16 nt, Homo sapiens
cugcaagcacaucugc

SEQ ID NO: 619077 - RNA, 19 nt, Homo sapiens
cugcaaggauucagcauua

SEQ ID NO: 619078 - RNA, 19 nt, Homo sapiens
cugcaaguguaucuccuuu

SEQ ID NO: 619079 - RNA, 22 nt, Homo sapiens
cugcaaucccagcuacuuggaa

SEQ ID NO: 619080 - RNA, 21 nt, Homo sapiens
cugcaauguaaauaguauaaa

SEQ ID NO: 619081 - RNA, 20 nt, Homo sapiens
cugcaauuuuaauugauuau

SEQ ID NO: 619082 - RNA, 20 nt, Homo sapiens
cugcacaaaagcagauacuu

SEQ ID NO: 619083 - RNA, 14 nt, Homo sapiens
cugcacaaacaaua

SEQ ID NO: 619084 - RNA, 17 nt, Homo sapiens
cugcacaaacaauaugu

SEQ ID NO: 619085 - RNA, 21 nt, Homo sapiens
cugcacaaagcccuuccaugu

SEQ ID NO: 619086 - RNA, 15 nt, Homo sapiens
cugcacacaggacag

SEQ ID NO: 619087 - RNA, 16 nt, Homo sapiens
cugcacagcaaaagaa

SEQ ID NO: 619088 - RNA, 18 nt, Homo sapiens
cugcacagugacuucuga

SEQ ID NO: 619089 - RNA, 12 nt, Homo sapiens
cugcacaugugc

SEQ ID NO: 619090 - RNA, 16 nt, Homo sapiens
cugcacaugugccaca

SEQ ID NO: 619091 - RNA, 12 nt, Homo sapiens
cugcacauuccu

SEQ ID NO: 619092 - RNA, 13 nt, Homo sapiens
cugcacauuccug

SEQ ID NO: 619093 - RNA, 17 nt, Homo sapiens
cugcaccacaccuggca

SEQ ID NO: 619094 - RNA, 15 nt, Homo sapiens
cugcaccccaagaga

SEQ ID NO: 619095 - RNA, 15 nt, Homo sapiens
cugcacccucgauga

SEQ ID NO: 619096 - RNA, 22 nt, Homo sapiens
cugcaccgacccgaggcccaga

SEQ ID NO: 619097 - RNA, 13 nt, Homo sapiens
cugcaccgucuca

SEQ ID NO: 619098 - RNA, 16 nt, Homo sapiens
cugcaccuaaagccua

SEQ ID NO: 619099 - RNA, 18 nt, Homo sapiens
cugcaccugaccugcuga

SEQ ID NO: 619100 - RNA, 20 nt, Homo sapiens
cugcaccugggcagcuccuc

SEQ ID NO: 619101 - RNA, 19 nt, Homo sapiens
cugcaccuuuuugcaugau

SEQ ID NO: 619102 - RNA, 15 nt, Homo sapiens
cugcacguaacacuc

SEQ ID NO: 619103 - RNA, 23 nt, Homo sapiens
cugcacuaauuugauguuuacag

SEQ ID NO: 619104 - RNA, 16 nt, Homo sapiens
cugcacuacuaugaga

SEQ ID NO: 619105 - RNA, 20 nt, Homo sapiens
cugcacuccagccuggggga

SEQ ID NO: 619106 - RNA, 18 nt, Homo sapiens
cugcacugaucacccaau

SEQ ID NO: 619107 - RNA, 16 nt, Homo sapiens
cugcacuuauacccau

SEQ ID NO: 619108 - RNA, 16 nt, Homo sapiens
cugccuuagccucuug

SEQ ID NO: 619109 - RNA, 12 nt, Homo sapiens
cugccuucacaa

SEQ ID NO: 619110 - RNA, 19 nt, Homo sapiens
cugccuucacaaaugucau

SEQ ID NO: 619111 - RNA, 20 nt, Homo sapiens
cugccuuccacaauucacua

SEQ ID NO: 619112 - RNA, 12 nt, Homo sapiens
cugccuuccucu

SEQ ID NO: 619113 - RNA, 22 nt, Homo sapiens
cugccuucgcaccuugcugugu

SEQ ID NO: 619114 - RNA, 18 nt, Homo sapiens
cugccuugauuagacucc

SEQ ID NO: 619115 - RNA, 16 nt, Homo sapiens
cugccuuggacaccau

SEQ ID NO: 619116 - RNA, 18 nt, Homo sapiens
cugccuugguucuggcca

SEQ ID NO: 619117 - RNA, 14 nt, Homo sapiens
cugccuuguguaca

SEQ ID NO: 619118 - RNA, 18 nt, Homo sapiens
cugccuuuaagccaaaga

SEQ ID NO: 619119 - RNA, 16 nt, Homo sapiens
cugccuuuaugagauu

SEQ ID NO: 619120 - RNA, 23 nt, Homo sapiens
cugccuuuuaucugcccagaauu

SEQ ID NO: 619121 - RNA, 19 nt, Homo sapiens
cugcgcucucuuugcaacu

SEQ ID NO: 619122 - RNA, 20 nt, Homo sapiens
cugcggcucagccuugcaca

SEQ ID NO: 619123 - RNA, 23 nt, Homo sapiens
cugcggcucuggcccacugagcc

SEQ ID NO: 619124 - RNA, 14 nt, Homo sapiens
cugcggcuguguag

SEQ ID NO: 619125 - RNA, 17 nt, Homo sapiens
cugcguacuccacuggu

SEQ ID NO: 619126 - RNA, 21 nt, Homo sapiens
cugcguccuccucaccucaug

SEQ ID NO: 619127 - RNA, 14 nt, Homo sapiens
cugcuaaauaucac

SEQ ID NO: 619128 - RNA, 17 nt, Homo sapiens
cugcuaauagcugcuag

SEQ ID NO: 619129 - RNA, 14 nt, Homo sapiens
cugcuaccaaaaca

SEQ ID NO: 619130 - RNA, 13 nt, Homo sapiens
cugcuaggccaga

SEQ ID NO: 619131 - RNA, 17 nt, Homo sapiens
cugcuaggcgcugggga

SEQ ID NO: 619132 - RNA, 24 nt, Homo sapiens
cugcuauauauuuuaagccuucau

SEQ ID NO: 619133 - RNA, 22 nt, Homo sapiens
cugcuauaugccuuaagccaau

SEQ ID NO: 619134 - RNA, 24 nt, Homo sapiens
cugcuauaugccuuaagccaauau

SEQ ID NO: 619135 - RNA, 17 nt, Homo sapiens
cugcuaucccacuguau

SEQ ID NO: 619136 - RNA, 14 nt, Homo sapiens
cugcuaugccauuu

SEQ ID NO: 619137 - RNA, 16 nt, Homo sapiens
cugcuaugccauuucu

SEQ ID NO: 619138 - RNA, 20 nt, Homo sapiens
cugcuauuugaaguguaauu

SEQ ID NO: 619139 - RNA, 15 nt, Homo sapiens
cugcucauccaaagu

SEQ ID NO: 619140 - RNA, 17 nt, Homo sapiens
cugcucauuacaguucu

SEQ ID NO: 619141 - RNA, 14 nt, Homo sapiens
cugcuccaccagca

SEQ ID NO: 619142 - RNA, 16 nt, Homo sapiens
cugcuccacguucucu

SEQ ID NO: 619143 - RNA, 20 nt, Homo sapiens
cugcuccaggagguuugcag

SEQ ID NO: 619144 - RNA, 17 nt, Homo sapiens
cugcuccagguucacuu

SEQ ID NO: 619145 - RNA, 15 nt, Homo sapiens
cugcuccagugcagg

SEQ ID NO: 619146 - RNA, 20 nt, Homo sapiens
cugcucccacacuugugcca

SEQ ID NO: 619147 - RNA, 21 nt, Homo sapiens
cugcucccacacuugugccag

SEQ ID NO: 619148 - RNA, 14 nt, Homo sapiens
cugcucccuagcca

SEQ ID NO: 619149 - RNA, 15 nt, Homo sapiens
cugcucccuagccag

SEQ ID NO: 619150 - RNA, 22 nt, Homo sapiens
cugcucccugacagcaccugaa

SEQ ID NO: 619151 - RNA, 13 nt, Homo sapiens
cugcucccuggca

SEQ ID NO: 619152 - RNA, 16 nt, Homo sapiens
cugcuccguuggucag

SEQ ID NO: 619153 - RNA, 13 nt, Homo sapiens
cugcuccuacauc

SEQ ID NO: 619154 - RNA, 22 nt, Homo sapiens
cugcuccuacauccagcuccuc

SEQ ID NO: 619155 - RNA, 21 nt, Homo sapiens
cugcucuagugggacagccca

SEQ ID NO: 619156 - RNA, 14 nt, Homo sapiens
cugcucucuucagg

SEQ ID NO: 619157 - RNA, 23 nt, Homo sapiens
cugcucugaauauuuuguaauaa

SEQ ID NO: 619158 - RNA, 15 nt, Homo sapiens
cugcucugaccuucc

SEQ ID NO: 619159 - RNA, 17 nt, Homo sapiens
cugcucugaggcuucca

SEQ ID NO: 619160 - RNA, 14 nt, Homo sapiens
cugcucugccugga

SEQ ID NO: 619161 - RNA, 21 nt, Homo sapiens
cugcucugcuccugaagcccu

SEQ ID NO: 619162 - RNA, 15 nt, Homo sapiens
cugcucugggcacug

SEQ ID NO: 619163 - RNA, 17 nt, Homo sapiens
cugcucuuguucuacug

SEQ ID NO: 619164 - RNA, 15 nt, Homo sapiens
cugcucuuucucugc

SEQ ID NO: 619165 - RNA, 22 nt, Homo sapiens
cugcucuuucucugccagugac

SEQ ID NO: 619166 - RNA, 16 nt, Homo sapiens
cugcugaacacagugu

SEQ ID NO: 619167 - RNA, 21 nt, Homo sapiens
cugcugaaggcagucauauca

SEQ ID NO: 619168 - RNA, 12 nt, Homo sapiens
cugcugaccaaa

SEQ ID NO: 619169 - RNA, 23 nt, Homo sapiens
cugcugaccaauugugcugccau

SEQ ID NO: 619170 - RNA, 22 nt, Homo sapiens
cugcugaccucccagugacccc

SEQ ID NO: 619171 - RNA, 22 nt, Homo sapiens
cugcugacugccaauaacauuc

SEQ ID NO: 619172 - RNA, 13 nt, Homo sapiens
cugcugacuguuu

SEQ ID NO: 619173 - RNA, 13 nt, Homo sapiens
cugcugcaaaagu

SEQ ID NO: 619174 - RNA, 19 nt, Homo sapiens
cugcugccacagacugugg

SEQ ID NO: 619175 - RNA, 15 nt, Homo sapiens
cugcugcccagugca

SEQ ID NO: 619176 - RNA, 21 nt, Homo sapiens
cugcugcccccaccccgggga

SEQ ID NO: 619177 - RNA, 15 nt, Homo sapiens
cugcugcuaccagcg

SEQ ID NO: 619178 - RNA, 16 nt, Homo sapiens
cugcuggaaaugcuga

SEQ ID NO: 619179 - RNA, 21 nt, Homo sapiens
cugcuggagugaaggggccaa

SEQ ID NO: 619180 - RNA, 21 nt, Homo sapiens
cugcuggagugcaguggcaca

SEQ ID NO: 619181 - RNA, 23 nt, Homo sapiens
cugcuggagugcaguggcacaau

SEQ ID NO: 619182 - RNA, 21 nt, Homo sapiens
cugcuggcucccuuacuuuac

SEQ ID NO: 619183 - RNA, 15 nt, Homo sapiens
cugcugggacugaga

SEQ ID NO: 619184 - RNA, 19 nt, Homo sapiens
cugcugggcgucuguucuu

SEQ ID NO: 619185 - RNA, 21 nt, Homo sapiens
cugcuggggagacaaaucuca

SEQ ID NO: 619186 - RNA, 20 nt, Homo sapiens
cugcugggugccuccuugcc

SEQ ID NO: 619187 - RNA, 11 nt, Homo sapiens
cugcugugaau

SEQ ID NO: 619188 - RNA, 14 nt, Homo sapiens
cugcugugaugacu

SEQ ID NO: 619189 - RNA, 19 nt, Homo sapiens
cugcugugauuccacuaca

SEQ ID NO: 619190 - RNA, 13 nt, Homo sapiens
cugcugugccuga

SEQ ID NO: 619191 - RNA, 13 nt, Homo sapiens
cugcuguuuccag

SEQ ID NO: 619192 - RNA, 16 nt, Homo sapiens
cugcuuaaacaaagca

SEQ ID NO: 619193 - RNA, 20 nt, Homo sapiens
cugcuuaaauuucuccagug

SEQ ID NO: 619194 - RNA, 19 nt, Homo sapiens
cugcuuacccaucuucaaa

SEQ ID NO: 619195 - RNA, 12 nt, Homo sapiens
cugcuuacuguu

SEQ ID NO: 619196 - RNA, 16 nt, Homo sapiens
cugcuuagacauaaca

SEQ ID NO: 619197 - RNA, 18 nt, Homo sapiens
cugcuuagacauaacaaa

SEQ ID NO: 619198 - RNA, 19 nt, Homo sapiens
cugcuuaguagcuuuggaa

SEQ ID NO: 619199 - RNA, 13 nt, Homo sapiens
cugcuucauggga

SEQ ID NO: 619200 - RNA, 23 nt, Homo sapiens
cugcuuccugucccacuacugua

SEQ ID NO: 619201 - RNA, 20 nt, Homo sapiens
cugcuucuacggccaugaga

SEQ ID NO: 619202 - RNA, 20 nt, Homo sapiens
cugcuucuagaaacucuggc

SEQ ID NO: 619203 - RNA, 18 nt, Homo sapiens
cugcuucuccaagcuuuc

SEQ ID NO: 619204 - RNA, 22 nt, Homo sapiens
cugcuucuguguguggugagca

SEQ ID NO: 619205 - RNA, 23 nt, Homo sapiens
cugcuucuuggagcuuuggaaua

SEQ ID NO: 619206 - RNA, 15 nt, Homo sapiens
cugcuuggucuuuca

SEQ ID NO: 619207 - RNA, 16 nt, Homo sapiens
cugcuuguuggcucca

SEQ ID NO: 619208 - RNA, 13 nt, Homo sapiens
cugcuuucacucu

SEQ ID NO: 619209 - RNA, 17 nt, Homo sapiens
cugcuuuccagacuuug

SEQ ID NO: 619210 - RNA, 14 nt, Homo sapiens
cugcuuucuuguug

SEQ ID NO: 619211 - RNA, 17 nt, Homo sapiens
cugcuuucuuguugcug

SEQ ID NO: 619212 - RNA, 16 nt, Homo sapiens
cugcuuugucaaaagg

SEQ ID NO: 619213 - RNA, 16 nt, Homo sapiens
cuggaaaaagacugau

SEQ ID NO: 619214 - RNA, 15 nt, Homo sapiens
cuggaaaaaggugaa

SEQ ID NO: 619215 - RNA, 18 nt, Homo sapiens
cuggaaaaauuccagaag

SEQ ID NO: 619216 - RNA, 17 nt, Homo sapiens
cuggaaaacagaaacca

SEQ ID NO: 619217 - RNA, 16 nt, Homo sapiens
cuggaaaacccaaagu

SEQ ID NO: 619218 - RNA, 23 nt, Homo sapiens
cuggaaaagugauguauuuucau

SEQ ID NO: 619219 - RNA, 15 nt, Homo sapiens
cuggaaaaugugacc

SEQ ID NO: 619220 - RNA, 20 nt, Homo sapiens
cuggaaaccacacuucuuga

SEQ ID NO: 619221 - RNA, 16 nt, Homo sapiens
cuggaaagacauagcc

SEQ ID NO: 619222 - RNA, 22 nt, Homo sapiens
cuggaaauuccaggaaccaaaa

SEQ ID NO: 619223 - RNA, 13 nt, Homo sapiens
cuggaacauucca

SEQ ID NO: 619224 - RNA, 15 nt, Homo sapiens
cuggaacauuccagu

SEQ ID NO: 619225 - RNA, 13 nt, Homo sapiens
cuggaaccuugcu

SEQ ID NO: 619226 - RNA, 15 nt, Homo sapiens
cuggaacuuuaguga

SEQ ID NO: 619227 - RNA, 17 nt, Homo sapiens
cuggaacuuuagugaaa

SEQ ID NO: 619228 - RNA, 17 nt, Homo sapiens
cuggaagacacuucaga

SEQ ID NO: 619229 - RNA, 17 nt, Homo sapiens
cuggaagaccugaaaga

SEQ ID NO: 619230 - RNA, 20 nt, Homo sapiens
cuguggagggagggcagcug

SEQ ID NO: 619231 - RNA, 23 nt, Homo sapiens
cuguggauagcccauagcuauuu

SEQ ID NO: 619232 - RNA, 13 nt, Homo sapiens
cuguggaugcuuc

SEQ ID NO: 619233 - RNA, 19 nt, Homo sapiens
cuguggauggcaucaaaca

SEQ ID NO: 619234 - RNA, 16 nt, Homo sapiens
cuguggcaucuuugcc

SEQ ID NO: 619235 - RNA, 10 nt, Homo sapiens
cuguggcauu

SEQ ID NO: 619236 - RNA, 20 nt, Homo sapiens
cuguggcccccuguccccaa

SEQ ID NO: 619237 - RNA, 16 nt, Homo sapiens
cuguggccugucucua

SEQ ID NO: 619238 - RNA, 19 nt, Homo sapiens
cuguggccugucucuauua

SEQ ID NO: 619239 - RNA, 17 nt, Homo sapiens
cuguggccuguguccca

SEQ ID NO: 619240 - RNA, 18 nt, Homo sapiens
cugugggcuucagcacuu

SEQ ID NO: 619241 - RNA, 16 nt, Homo sapiens
cugugggggugagggu

SEQ ID NO: 619242 - RNA, 19 nt, Homo sapiens
cugugguacugauggacuu

SEQ ID NO: 619243 - RNA, 16 nt, Homo sapiens
cuguggucacuuguac

SEQ ID NO: 619244 - RNA, 21 nt, Homo sapiens
cuguggugcccucugacaagg

SEQ ID NO: 619245 - RNA, 13 nt, Homo sapiens
cugugguggagaa

SEQ ID NO: 619246 - RNA, 15 nt, Homo sapiens
cuguguaacuuucuc

SEQ ID NO: 619247 - RNA, 19 nt, Homo sapiens
cuguguacacaugggaguu

SEQ ID NO: 619248 - RNA, 23 nt, Homo sapiens
cuguguagcucucacaugcacag

SEQ ID NO: 619249 - RNA, 14 nt, Homo sapiens
cuguguaggcauuu

SEQ ID NO: 619250 - RNA, 21 nt, Homo sapiens
cuguguauuuaacugccuugu

SEQ ID NO: 619251 - RNA, 19 nt, Homo sapiens
cuguguccuugcaccugca

SEQ ID NO: 619252 - RNA, 21 nt, Homo sapiens
cugugugaacuaacaugcaaa

SEQ ID NO: 619253 - RNA, 16 nt, Homo sapiens
cugugugcaagugugu

SEQ ID NO: 619254 - RNA, 15 nt, Homo sapiens
cuguguggacuguga

SEQ ID NO: 619255 - RNA, 19 nt, Homo sapiens
cuguguggacuucaucuca

SEQ ID NO: 619256 - RNA, 17 nt, Homo sapiens
cugugugucuguccuga

SEQ ID NO: 619257 - RNA, 20 nt, Homo sapiens
cuguguguguguguguaugu

SEQ ID NO: 619258 - RNA, 17 nt, Homo sapiens
cuguguuaggaugcggc

SEQ ID NO: 619259 - RNA, 18 nt, Homo sapiens
cuguguuuaaccuguugc

SEQ ID NO: 619260 - RNA, 15 nt, Homo sapiens
cuguguuuccaucuc

SEQ ID NO: 619261 - RNA, 23 nt, Homo sapiens
cuguguuucguguauaugccuca

SEQ ID NO: 619262 - RNA, 14 nt, Homo sapiens
cuguguuuguccug

SEQ ID NO: 619263 - RNA, 19 nt, Homo sapiens
cuguuaaaaaaauaaaaua

SEQ ID NO: 619264 - RNA, 16 nt, Homo sapiens
cuguuaaagauguugc

SEQ ID NO: 619265 - RNA, 23 nt, Homo sapiens
cuguuaaauuuguaaacaaucua

SEQ ID NO: 619266 - RNA, 22 nt, Homo sapiens
cuguuaaccaaagggcagaaua

SEQ ID NO: 619267 - RNA, 13 nt, Homo sapiens
cuguuaacugaau

SEQ ID NO: 619268 - RNA, 18 nt, Homo sapiens
cuguuacacuuuuuggaa

SEQ ID NO: 619269 - RNA, 18 nt, Homo sapiens
cuguuaccagagccucuu

SEQ ID NO: 619270 - RNA, 15 nt, Homo sapiens
cuguuaccagaggac

SEQ ID NO: 619271 - RNA, 13 nt, Homo sapiens
cuguuacccaggc

SEQ ID NO: 619272 - RNA, 19 nt, Homo sapiens
cuguuacugaaauugguau

SEQ ID NO: 619273 - RNA, 22 nt, Homo sapiens
cuguuauuagcugggaagacca

SEQ ID NO: 619274 - RNA, 23 nt, Homo sapiens
cuguuauuagcugggaagaccaa

SEQ ID NO: 619275 - RNA, 16 nt, Homo sapiens
cuguucacacugcaga

SEQ ID NO: 619276 - RNA, 15 nt, Homo sapiens
cuguucacuuuucaa

SEQ ID NO: 619277 - RNA, 18 nt, Homo sapiens
cuguucccuguucuggua

SEQ ID NO: 619278 - RNA, 16 nt, Homo sapiens
cuguucccuuccucac

SEQ ID NO: 619279 - RNA, 15 nt, Homo sapiens
cuguucccuugcagg

SEQ ID NO: 619280 - RNA, 22 nt, Homo sapiens
cuguuccuggaggucagcauuu

SEQ ID NO: 619281 - RNA, 21 nt, Homo sapiens
cuguuccuuucagaugaccuu

SEQ ID NO: 619282 - RNA, 18 nt, Homo sapiens
cuguucuauacgagugac

SEQ ID NO: 619283 - RNA, 21 nt, Homo sapiens
cuguucucugcugagggccaa

SEQ ID NO: 619284 - RNA, 13 nt, Homo sapiens
cuguucugcugaa

SEQ ID NO: 619285 - RNA, 16 nt, Homo sapiens
cuguucugggggacag

SEQ ID NO: 619286 - RNA, 15 nt, Homo sapiens
cuguucuguguugca

SEQ ID NO: 619287 - RNA, 19 nt, Homo sapiens
cuguucuguuggaugacuu

SEQ ID NO: 619288 - RNA, 22 nt, Homo sapiens
cuguucuguuuggcacuuguau

SEQ ID NO: 619289 - RNA, 12 nt, Homo sapiens
cuguucuuccuc

SEQ ID NO: 619290 - RNA, 11 nt, Homo sapiens
cuguucuugcu

SEQ ID NO: 619291 - RNA, 16 nt, Homo sapiens
cuguucuuuaguagca

SEQ ID NO: 619292 - RNA, 14 nt, Homo sapiens
cuguugacauauuu

SEQ ID NO: 619293 - RNA, 11 nt, Homo sapiens
cuguugagaug

SEQ ID NO: 619294 - RNA, 18 nt, Homo sapiens
cuguugaucccacuucac

SEQ ID NO: 619295 - RNA, 21 nt, Homo sapiens
cuguugauuaucuucagccca

SEQ ID NO: 619296 - RNA, 21 nt, Homo sapiens
cuguugauuucuuuccagagg

SEQ ID NO: 619297 - RNA, 20 nt, Homo sapiens
cuguugcaaagguagggacu

SEQ ID NO: 619298 - RNA, 15 nt, Homo sapiens
cuguugcauuuacuu

SEQ ID NO: 619299 - RNA, 12 nt, Homo sapiens
cuguugcuauuu

SEQ ID NO: 619300 - RNA, 21 nt, Homo sapiens
cuguugcugaaaccauacagc

SEQ ID NO: 619301 - RNA, 19 nt, Homo sapiens
cuguugcuugucuugauua

SEQ ID NO: 619302 - RNA, 18 nt, Homo sapiens
cuguugcuuuacaguuac

SEQ ID NO: 619303 - RNA, 14 nt, Homo sapiens
cuguuggaugacuu

SEQ ID NO: 619304 - RNA, 14 nt, Homo sapiens
cuguuggauucaga

SEQ ID NO: 619305 - RNA, 17 nt, Homo sapiens
cuguuggcaaggugaca

SEQ ID NO: 619306 - RNA, 15 nt, Homo sapiens
cuguuggcagagcuu

SEQ ID NO: 619307 - RNA, 16 nt, Homo sapiens
cuguuggggacagugc

SEQ ID NO: 619308 - RNA, 15 nt, Homo sapiens
cuguuguacuaugga

SEQ ID NO: 619309 - RNA, 17 nt, Homo sapiens
cuguuguagaagacaaa

SEQ ID NO: 619310 - RNA, 21 nt, Homo sapiens
cuguuguuuggacuguaacau

SEQ ID NO: 619311 - RNA, 14 nt, Homo sapiens
cuguuuaacauuuc

SEQ ID NO: 619312 - RNA, 17 nt, Homo sapiens
cuguuuaucaagccaua

SEQ ID NO: 619313 - RNA, 17 nt, Homo sapiens
cuguuucaacagaugac

SEQ ID NO: 619314 - RNA, 18 nt, Homo sapiens
cuguuucaaugaccugua

SEQ ID NO: 619315 - RNA, 23 nt, Homo sapiens
cuguuucagcuaaaugcagggaa

SEQ ID NO: 619316 - RNA, 15 nt, Homo sapiens
cuguuuccugggcac

SEQ ID NO: 619317 - RNA, 19 nt, Homo sapiens
cuguuugccacacccaggu

SEQ ID NO: 619318 - RNA, 17 nt, Homo sapiens
cuguuugcguacuugua

SEQ ID NO: 619319 - RNA, 21 nt, Homo sapiens
cuguuugcugugcguggaaug

SEQ ID NO: 619320 - RNA, 15 nt, Homo sapiens
cuguuugcuguggaa

SEQ ID NO: 619321 - RNA, 17 nt, Homo sapiens
cuguuugguguguccca

SEQ ID NO: 619322 - RNA, 19 nt, Homo sapiens
cuguuuguauauuugcaaa

SEQ ID NO: 619323 - RNA, 23 nt, Homo sapiens
cuguuuguugccccauuccuaag

SEQ ID NO: 619324 - RNA, 22 nt, Homo sapiens
cuguuuuagauaucccuuacuc

SEQ ID NO: 619325 - RNA, 17 nt, Homo sapiens
cuguuuucuuuggggaa

SEQ ID NO: 619326 - RNA, 19 nt, Homo sapiens
cuguuuuguaagugcugcu

SEQ ID NO: 619327 - RNA, 22 nt, Homo sapiens
cuguuuuguaagugcugcuaua

SEQ ID NO: 619328 - RNA, 14 nt, Homo sapiens
cuguuuuguuguuu

SEQ ID NO: 619329 - RNA, 18 nt, Homo sapiens
cuguuuuuaauguucaca

SEQ ID NO: 619330 - RNA, 19 nt, Homo sapiens
cuguuuuugucuacacucu

SEQ ID NO: 619331 - RNA, 15 nt, Homo sapiens
cuguuuuuuccugag

SEQ ID NO: 619332 - RNA, 14 nt, Homo sapiens
cuuaaaaaaaccau

SEQ ID NO: 619333 - RNA, 16 nt, Homo sapiens
cuuaaaaaaugaauua

SEQ ID NO: 619334 - RNA, 13 nt, Homo sapiens
cuuaaaaacugug

SEQ ID NO: 619335 - RNA, 19 nt, Homo sapiens
cuuaaaacaauucugugac

SEQ ID NO: 619336 - RNA, 13 nt, Homo sapiens
cuuaaaacagaaa

SEQ ID NO: 619337 - RNA, 22 nt, Homo sapiens
cuuaaaacagaaaggugcagga

SEQ ID NO: 619338 - RNA, 22 nt, Homo sapiens
cuuaaaacuaaauguaauuuau

SEQ ID NO: 619339 - RNA, 15 nt, Homo sapiens
cuuaaaaucugugaa

SEQ ID NO: 619340 - RNA, 13 nt, Homo sapiens
cuuaaaaugaaag

SEQ ID NO: 619341 - RNA, 18 nt, Homo sapiens
cuuaaaaugauucucuac

SEQ ID NO: 619342 - RNA, 14 nt, Homo sapiens
cuuaaacaauguau

SEQ ID NO: 619343 - RNA, 20 nt, Homo sapiens
cuuaaacagcagauuucaga

SEQ ID NO: 619344 - RNA, 20 nt, Homo sapiens
cuuaaacccauacaauguau

SEQ ID NO: 619345 - RNA, 21 nt, Homo sapiens
cuuaaacccuuuagugcuuug

SEQ ID NO: 619346 - RNA, 23 nt, Homo sapiens
cuuaaaccgccaaggcuggggga

SEQ ID NO: 619347 - RNA, 13 nt, Homo sapiens
cuuaaacucuguu

SEQ ID NO: 619348 - RNA, 23 nt, Homo sapiens
cuuaaacuguguggacugugaug

SEQ ID NO: 619349 - RNA, 17 nt, Homo sapiens
cuuaaagaaaauugcau

SEQ ID NO: 619350 - RNA, 20 nt, Homo sapiens
cuuaaagaauaauacuuaga

SEQ ID NO: 619351 - RNA, 20 nt, Homo sapiens
cuuaaagauuuucugcuuga

SEQ ID NO: 619352 - RNA, 22 nt, Homo sapiens
cuucucucuguucccuuccuca

SEQ ID NO: 619353 - RNA, 15 nt, Homo sapiens
cuucucuuccuguaa

SEQ ID NO: 619354 - RNA, 21 nt, Homo sapiens
cuucugaaaacauucacuugu

SEQ ID NO: 619355 - RNA, 15 nt, Homo sapiens
cuucugaaugcugcu

SEQ ID NO: 619356 - RNA, 21 nt, Homo sapiens
cuucugaccacagcaucauuu

SEQ ID NO: 619357 - RNA, 19 nt, Homo sapiens
cuucugacuuacugucagu

SEQ ID NO: 619358 - RNA, 21 nt, Homo sapiens
cuucugagaucuguugauuga

SEQ ID NO: 619359 - RNA, 17 nt, Homo sapiens
cuucugagcagaaaugg

SEQ ID NO: 619360 - RNA, 19 nt, Homo sapiens
cuucugaggcgcugcuuug

SEQ ID NO: 619361 - RNA, 15 nt, Homo sapiens
cuucugauacgugua

SEQ ID NO: 619362 - RNA, 15 nt, Homo sapiens
cuucugaugucauau

SEQ ID NO: 619363 - RNA, 14 nt, Homo sapiens
cuucugcaacaucu

SEQ ID NO: 619364 - RNA, 10 nt, Homo sapiens
cuucugccau

SEQ ID NO: 619365 - RNA, 13 nt, Homo sapiens
cuucugccccgga

SEQ ID NO: 619366 - RNA, 15 nt, Homo sapiens
cuucugccuucucag

SEQ ID NO: 619367 - RNA, 19 nt, Homo sapiens
cuucugccuugagucccca

SEQ ID NO: 619368 - RNA, 12 nt, Homo sapiens
cuucugcuacug

SEQ ID NO: 619369 - RNA, 13 nt, Homo sapiens
cuucugcuccuua

SEQ ID NO: 619370 - RNA, 18 nt, Homo sapiens
cuucuggagaaagcucau

SEQ ID NO: 619371 - RNA, 16 nt, Homo sapiens
cuucuggagucuccag

SEQ ID NO: 619372 - RNA, 19 nt, Homo sapiens
cuucuggagucuccagugg

SEQ ID NO: 619373 - RNA, 17 nt, Homo sapiens
cuucuggcaugggacag

SEQ ID NO: 619374 - RNA, 22 nt, Homo sapiens
cuucuggccucccacagacuca

SEQ ID NO: 619375 - RNA, 16 nt, Homo sapiens
cuucugggaacuuccu

SEQ ID NO: 619376 - RNA, 14 nt, Homo sapiens
cuucuguccaggac

SEQ ID NO: 619377 - RNA, 16 nt, Homo sapiens
cuucugucuccagggc

SEQ ID NO: 619378 - RNA, 22 nt, Homo sapiens
cuucuguggaccacugcaugag

SEQ ID NO: 619379 - RNA, 12 nt, Homo sapiens
cuucugugugac

SEQ ID NO: 619380 - RNA, 12 nt, Homo sapiens
cuucuguguuca

SEQ ID NO: 619381 - RNA, 23 nt, Homo sapiens
cuucuuaaaauucaaacauauuc

SEQ ID NO: 619382 - RNA, 11 nt, Homo sapiens
cuucuuaacau

SEQ ID NO: 619383 - RNA, 15 nt, Homo sapiens
cuucuuacccaaagc

SEQ ID NO: 619384 - RNA, 14 nt, Homo sapiens
cuucuuacuauuaa

SEQ ID NO: 619385 - RNA, 12 nt, Homo sapiens
cuucuuacugau

SEQ ID NO: 619386 - RNA, 21 nt, Homo sapiens
cuucuuagcuauugcucugag

SEQ ID NO: 619387 - RNA, 22 nt, Homo sapiens
cuucuuauggaauugauuugca

SEQ ID NO: 619388 - RNA, 14 nt, Homo sapiens
cuucuuauuaauca

SEQ ID NO: 619389 - RNA, 23 nt, Homo sapiens
cuucuucacuuacccauuagcca

SEQ ID NO: 619390 - RNA, 16 nt, Homo sapiens
cuucuucccagcacua

SEQ ID NO: 619391 - RNA, 18 nt, Homo sapiens
cuucuucccucccuaucu

SEQ ID NO: 619392 - RNA, 12 nt, Homo sapiens
cuucuucuaguu

SEQ ID NO: 619393 - RNA, 15 nt, Homo sapiens
cuucuucuuccaaau

SEQ ID NO: 619394 - RNA, 16 nt, Homo sapiens
cuucuugaaacagccu

SEQ ID NO: 619395 - RNA, 11 nt, Homo sapiens
cuucuugccuc

SEQ ID NO: 619396 - RNA, 20 nt, Homo sapiens
cuucuugccucugugcugug

SEQ ID NO: 619397 - RNA, 17 nt, Homo sapiens
cuucuuggggauucaaa

SEQ ID NO: 619398 - RNA, 18 nt, Homo sapiens
cuucuuggucaagaaagg

SEQ ID NO: 619399 - RNA, 17 nt, Homo sapiens
cuucuugguuuucucuc

SEQ ID NO: 619400 - RNA, 21 nt, Homo sapiens
cuucuuguucugagauucaau

SEQ ID NO: 619401 - RNA, 16 nt, Homo sapiens
cuucuuuaccaaggau

SEQ ID NO: 619402 - RNA, 17 nt, Homo sapiens
cuucuuuagcaagauau

SEQ ID NO: 619403 - RNA, 20 nt, Homo sapiens
cuucuuuauacaaugaccac

SEQ ID NO: 619404 - RNA, 16 nt, Homo sapiens
cuucuuuauugcacua

SEQ ID NO: 619405 - RNA, 13 nt, Homo sapiens
cuucuuugcugca

SEQ ID NO: 619406 - RNA, 14 nt, Homo sapiens
cuucuuugcugcug

SEQ ID NO: 619407 - RNA, 20 nt, Homo sapiens
cuucuuuuaguuguaucucu

SEQ ID NO: 619408 - RNA, 14 nt, Homo sapiens
cuucuuuuccaauu

SEQ ID NO: 619409 - RNA, 15 nt, Homo sapiens
cuucuuuugaacugu

SEQ ID NO: 619410 - RNA, 15 nt, Homo sapiens
cuucuuuugauacug

SEQ ID NO: 619411 - RNA, 13 nt, Homo sapiens
cuugaaaguuuuc

SEQ ID NO: 619412 - RNA, 23 nt, Homo sapiens
cuugaaauaccagugaaccaaag

SEQ ID NO: 619413 - RNA, 23 nt, Homo sapiens
cuugaaaucuaauauuucuagua

SEQ ID NO: 619414 - RNA, 13 nt, Homo sapiens
cuugaacacuggg

SEQ ID NO: 619415 - RNA, 14 nt, Homo sapiens
cuugaacacugggg

SEQ ID NO: 619416 - RNA, 17 nt, Homo sapiens
cuugaaccacaguucua

SEQ ID NO: 619417 - RNA, 13 nt, Homo sapiens
cuugaacccaaga

SEQ ID NO: 619418 - RNA, 22 nt, Homo sapiens
cuugaacccccucccuguccca

SEQ ID NO: 619419 - RNA, 18 nt, Homo sapiens
cuugaaccgucuguggag

SEQ ID NO: 619420 - RNA, 15 nt, Homo sapiens
cuugaaccuaugaag

SEQ ID NO: 619421 - RNA, 17 nt, Homo sapiens
cuugaacucuguucccc

SEQ ID NO: 619422 - RNA, 20 nt, Homo sapiens
cuugaacucuugaccucagg

SEQ ID NO: 619423 - RNA, 21 nt, Homo sapiens
cuugaacugaggcccugugau

SEQ ID NO: 619424 - RNA, 19 nt, Homo sapiens
cuugaagacaacucugaaa

SEQ ID NO: 619425 - RNA, 21 nt, Homo sapiens
cuugaagguuuguccacauuc

SEQ ID NO: 619426 - RNA, 18 nt, Homo sapiens
cuugaauagaaguuuucc

SEQ ID NO: 619427 - RNA, 14 nt, Homo sapiens
cuugaauagucuca

SEQ ID NO: 619428 - RNA, 13 nt, Homo sapiens
cuugaaucaaagc

SEQ ID NO: 619429 - RNA, 17 nt, Homo sapiens
cuugaaugcugccagug

SEQ ID NO: 619430 - RNA, 17 nt, Homo sapiens
cuugaauguaguauuca

SEQ ID NO: 619431 - RNA, 23 nt, Homo sapiens
cuugaauguuuguauacauguua

SEQ ID NO: 619432 - RNA, 22 nt, Homo sapiens
cuugaauuccauggaauuucua

SEQ ID NO: 619433 - RNA, 19 nt, Homo sapiens
cuugaauuccugaccucag

SEQ ID NO: 619434 - RNA, 12 nt, Homo sapiens
cuugacaugugc

SEQ ID NO: 619435 - RNA, 15 nt, Homo sapiens
cuugaccuguuucuc

SEQ ID NO: 619436 - RNA, 14 nt, Homo sapiens
cuugacuuccugcc

SEQ ID NO: 619437 - RNA, 20 nt, Homo sapiens
cuugagaccuaaucucugua

SEQ ID NO: 619438 - RNA, 20 nt, Homo sapiens
cuugagcaagaugauguaau

SEQ ID NO: 619439 - RNA, 20 nt, Homo sapiens
cuugagcaauaaaguggaaa

SEQ ID NO: 619440 - RNA, 15 nt, Homo sapiens
cuugagccaguaauu

SEQ ID NO: 619441 - RNA, 20 nt, Homo sapiens
cuugagccgggccccugggc

SEQ ID NO: 619442 - RNA, 22 nt, Homo sapiens
cuugagcgugaaucuguaucuu

SEQ ID NO: 619443 - RNA, 15 nt, Homo sapiens
cuugagcuacuucaa

SEQ ID NO: 619444 - RNA, 18 nt, Homo sapiens
cuugagcuuggcagcuga

SEQ ID NO: 619445 - RNA, 16 nt, Homo sapiens
cuugaggcaacucauc

SEQ ID NO: 619446 - RNA, 12 nt, Homo sapiens
cuugagguggga

SEQ ID NO: 619447 - RNA, 21 nt, Homo sapiens
cuugagguggugccuucucac

SEQ ID NO: 619448 - RNA, 17 nt, Homo sapiens
cuugaguagacuuggac

SEQ ID NO: 619449 - RNA, 21 nt, Homo sapiens
cuugaguagauccaguauuug

SEQ ID NO: 619450 - RNA, 12 nt, Homo sapiens
cuugagugcucu

SEQ ID NO: 619451 - RNA, 19 nt, Homo sapiens
cuugaguuccucugcaguu

SEQ ID NO: 619452 - RNA, 20 nt, Homo sapiens
cuugaguugccugaugcuca

SEQ ID NO: 619453 - RNA, 16 nt, Homo sapiens
cuugauaauacuugac

SEQ ID NO: 619454 - RNA, 13 nt, Homo sapiens
cuugauauuuucc

SEQ ID NO: 619455 - RNA, 13 nt, Homo sapiens
cuugaugauacaa

SEQ ID NO: 619456 - RNA, 18 nt, Homo sapiens
cuugauggaaauugacca

SEQ ID NO: 619457 - RNA, 21 nt, Homo sapiens
cuugauuccugguuugacuca

SEQ ID NO: 619458 - RNA, 18 nt, Homo sapiens
cuugauugguucuuccaa

SEQ ID NO: 619459 - RNA, 15 nt, Homo sapiens
cuugauuuaaucacc

SEQ ID NO: 619460 - RNA, 23 nt, Homo sapiens
cuugcaaaguaucccuacuguaa

SEQ ID NO: 619461 - RNA, 18 nt, Homo sapiens
cuugcaacuaaggacaaa

SEQ ID NO: 619462 - RNA, 12 nt, Homo sapiens
cuugcaagccau

SEQ ID NO: 619463 - RNA, 18 nt, Homo sapiens
cuugcaauguagucaaua

SEQ ID NO: 619464 - RNA, 12 nt, Homo sapiens
cuugcacaaaca

SEQ ID NO: 619465 - RNA, 17 nt, Homo sapiens
cuugcacgcccaugugu

SEQ ID NO: 619466 - RNA, 15 nt, Homo sapiens
cuugcacggcugcuc

SEQ ID NO: 619467 - RNA, 11 nt, Homo sapiens
cuugcagagau

SEQ ID NO: 619468 - RNA, 23 nt, Homo sapiens
cuugcagauuuucuuaaggaauu

SEQ ID NO: 619469 - RNA, 21 nt, Homo sapiens
cuugcaggagugacucaagaa

SEQ ID NO: 619470 - RNA, 22 nt, Homo sapiens
cuugcauccaugcccagccaau

SEQ ID NO: 619471 - RNA, 19 nt, Homo sapiens
cuugcaugaauuacuguau

SEQ ID NO: 619472 - RNA, 20 nt, Homo sapiens
cuugcaugcuugcauaagag

SEQ ID NO: 619473 - RNA, 15 nt, Homo sapiens
cuugcauguacuuga

SEQ ID NO: 619474 - RNA, 23 nt, Homo sapiens
cuugccaagcagugcacauuuca

SEQ ID NO: 619475 - RNA, 17 nt, Homo sapiens
gaauguauguaaugugu

SEQ ID NO: 619476 - RNA, 14 nt, Homo sapiens
gaauguaugugcac

SEQ ID NO: 619477 - RNA, 20 nt, Homo sapiens
gaauguauugaacuuggaaa

SEQ ID NO: 619478 - RNA, 17 nt, Homo sapiens
gaaugucccaacccaga

SEQ ID NO: 619479 - RNA, 17 nt, Homo sapiens
gaaugugauauuugaag

SEQ ID NO: 619480 - RNA, 21 nt, Homo sapiens
gaaugugcucaugcauugcuu

SEQ ID NO: 619481 - RNA, 18 nt, Homo sapiens
gaauguggaauaccuaag

SEQ ID NO: 619482 - RNA, 15 nt, Homo sapiens
gaauguggucucagg

SEQ ID NO: 619483 - RNA, 17 nt, Homo sapiens
gaaugugguuacuuccu

SEQ ID NO: 619484 - RNA, 19 nt, Homo sapiens
gaauguguuauuugucaca

SEQ ID NO: 619485 - RNA, 18 nt, Homo sapiens
gaauguuaugugcaaguu

SEQ ID NO: 619486 - RNA, 16 nt, Homo sapiens
gaauguuggcaaauca

SEQ ID NO: 619487 - RNA, 22 nt, Homo sapiens
gaauguuggcaaaucacuucaa

SEQ ID NO: 619488 - RNA, 17 nt, Homo sapiens
gaauuaaaaaagcauac

SEQ ID NO: 619489 - RNA, 17 nt, Homo sapiens
gaauuaaaauaaaacac

SEQ ID NO: 619490 - RNA, 21 nt, Homo sapiens
gaauuaacaauaaaaguguga

SEQ ID NO: 619491 - RNA, 15 nt, Homo sapiens
gaauuaacagagauu

SEQ ID NO: 619492 - RNA, 19 nt, Homo sapiens
gaauuaaccuggugcugga

SEQ ID NO: 619493 - RNA, 21 nt, Homo sapiens
gaauuaagaauugguugccau

SEQ ID NO: 619494 - RNA, 13 nt, Homo sapiens
gaauuaagcagaa

SEQ ID NO: 619495 - RNA, 20 nt, Homo sapiens
gaauuacaguacacaucccc

SEQ ID NO: 619496 - RNA, 15 nt, Homo sapiens
gaauuacgugcucug

SEQ ID NO: 619497 - RNA, 12 nt, Homo sapiens
gaauuacuugug

SEQ ID NO: 619498 - RNA, 18 nt, Homo sapiens
gaauuacuuguguuacuu

SEQ ID NO: 619499 - RNA, 14 nt, Homo sapiens
gaauuagaagccau

SEQ ID NO: 619500 - RNA, 16 nt, Homo sapiens
gaauuaggaagaccaa

SEQ ID NO: 619501 - RNA, 20 nt, Homo sapiens
gaauuauaauuaguuccuca

SEQ ID NO: 619502 - RNA, 20 nt, Homo sapiens
gaauuaugucguaagucacu

SEQ ID NO: 619503 - RNA, 15 nt, Homo sapiens
gaauuauuacagugu

SEQ ID NO: 619504 - RNA, 20 nt, Homo sapiens
gaauuauuguagacaugccc

SEQ ID NO: 619505 - RNA, 20 nt, Homo sapiens
gaauuauuuaaacaaaaacu

SEQ ID NO: 619506 - RNA, 21 nt, Homo sapiens
gaauuauuuugaaugucacaa

SEQ ID NO: 619507 - RNA, 14 nt, Homo sapiens
gaauucaaaaguga

SEQ ID NO: 619508 - RNA, 16 nt, Homo sapiens
gaauucaaacuggggc

SEQ ID NO: 619509 - RNA, 13 nt, Homo sapiens
gaauucagcacca

SEQ ID NO: 619510 - RNA, 20 nt, Homo sapiens
gaauucaguugcuuugccca

SEQ ID NO: 619511 - RNA, 15 nt, Homo sapiens
gaauucaugugagaa

SEQ ID NO: 619512 - RNA, 17 nt, Homo sapiens
gaauuccaucuuguaaa

SEQ ID NO: 619513 - RNA, 19 nt, Homo sapiens
gaauucccuuucauuugaa

SEQ ID NO: 619514 - RNA, 13 nt, Homo sapiens
gaauuccuaacuu

SEQ ID NO: 619515 - RNA, 16 nt, Homo sapiens
gaauuccuucuaagau

SEQ ID NO: 619516 - RNA, 18 nt, Homo sapiens
gaauucuaacaagucaua

SEQ ID NO: 619517 - RNA, 19 nt, Homo sapiens
gaauucuaagcuggugccc

SEQ ID NO: 619518 - RNA, 21 nt, Homo sapiens
gaauucugggaauccacagcu

SEQ ID NO: 619519 - RNA, 23 nt, Homo sapiens
gaauucuuacauguuuucuuugc

SEQ ID NO: 619520 - RNA, 13 nt, Homo sapiens
gaauucuugaguu

SEQ ID NO: 619521 - RNA, 16 nt, Homo sapiens
gaauugaacgacugua

SEQ ID NO: 619522 - RNA, 14 nt, Homo sapiens
gaauugaccaaaua

SEQ ID NO: 619523 - RNA, 14 nt, Homo sapiens
gaauugaugaugca

SEQ ID NO: 619524 - RNA, 17 nt, Homo sapiens
gaauugaugaugcaguu

SEQ ID NO: 619525 - RNA, 13 nt, Homo sapiens
gaauugauuagga

SEQ ID NO: 619526 - RNA, 11 nt, Homo sapiens
gaauugcacau

SEQ ID NO: 619527 - RNA, 15 nt, Homo sapiens
gaauugccagucuuu

SEQ ID NO: 619528 - RNA, 18 nt, Homo sapiens
gaauuggccgcugucacu

SEQ ID NO: 619529 - RNA, 20 nt, Homo sapiens
gaauuguacaagagucccuu

SEQ ID NO: 619530 - RNA, 20 nt, Homo sapiens
gaauugugaauaaguuuuca

SEQ ID NO: 619531 - RNA, 19 nt, Homo sapiens
gaauuguuuuuguacaguu

SEQ ID NO: 619532 - RNA, 15 nt, Homo sapiens
gaauuuaaggcccaa

SEQ ID NO: 619533 - RNA, 15 nt, Homo sapiens
gaauuuagaaauauu

SEQ ID NO: 619534 - RNA, 19 nt, Homo sapiens
gaauuuauuuaaguucaca

SEQ ID NO: 619535 - RNA, 20 nt, Homo sapiens
gaauuucuaaaaaacagagg

SEQ ID NO: 619536 - RNA, 13 nt, Homo sapiens
gaauuucuaagaa

SEQ ID NO: 619537 - RNA, 22 nt, Homo sapiens
gaauuucuaagcgccuauuguu

SEQ ID NO: 619538 - RNA, 22 nt, Homo sapiens
gaauuucuagacaguauugcca

SEQ ID NO: 619539 - RNA, 15 nt, Homo sapiens
gaauuucuuugucau

SEQ ID NO: 619540 - RNA, 13 nt, Homo sapiens
gaauuugcuaaua

SEQ ID NO: 619541 - RNA, 14 nt, Homo sapiens
gaauuuggaaaucc

SEQ ID NO: 619542 - RNA, 15 nt, Homo sapiens
gaauuugggccucuu

SEQ ID NO: 619543 - RNA, 15 nt, Homo sapiens
gaauuuguaagcaac

SEQ ID NO: 619544 - RNA, 23 nt, Homo sapiens
gaauuuguauaauaaagcuuuca

SEQ ID NO: 619545 - RNA, 20 nt, Homo sapiens
gaauuuguauuaaaaagccu

SEQ ID NO: 619546 - RNA, 14 nt, Homo sapiens
gaauuuguccaauu

SEQ ID NO: 619547 - RNA, 13 nt, Homo sapiens
gaauuuuaguccu

SEQ ID NO: 619548 - RNA, 21 nt, Homo sapiens
gaauuuuauauucuaagccag

SEQ ID NO: 619549 - RNA, 20 nt, Homo sapiens
gaauuuucucuaacuucaag

SEQ ID NO: 619550 - RNA, 20 nt, Homo sapiens
gaauuuuugcuaugcuguaa

SEQ ID NO: 619551 - RNA, 23 nt, Homo sapiens
gaauuuuuuuuuuuaagcucaaa

SEQ ID NO: 619552 - RNA, 23 nt, Homo sapiens
gacaaaaagccuuuuccagaaga

SEQ ID NO: 619553 - RNA, 10 nt, Homo sapiens
gacaaaaaua

SEQ ID NO: 619554 - RNA, 12 nt, Homo sapiens
gacaaaaauauu

SEQ ID NO: 619555 - RNA, 17 nt, Homo sapiens
gacaaaaauauuuacac

SEQ ID NO: 619556 - RNA, 19 nt, Homo sapiens
gacaaaauggauacauaaa

SEQ ID NO: 619557 - RNA, 18 nt, Homo sapiens
gacaaaccauaacugaca

SEQ ID NO: 619558 - RNA, 19 nt, Homo sapiens
gacaaaccuuauggaaaag

SEQ ID NO: 619559 - RNA, 13 nt, Homo sapiens
gacaaacuccuga

SEQ ID NO: 619560 - RNA, 19 nt, Homo sapiens
gacaaacuccugaaaugcc

SEQ ID NO: 619561 - RNA, 16 nt, Homo sapiens
gacaaagacucacucu

SEQ ID NO: 619562 - RNA, 21 nt, Homo sapiens
gacaaagccaaacucugccag

SEQ ID NO: 619563 - RNA, 21 nt, Homo sapiens
gacaaagggccagcagucuac

SEQ ID NO: 619564 - RNA, 17 nt, Homo sapiens
gacaaagguuuuccucu

SEQ ID NO: 619565 - RNA, 21 nt, Homo sapiens
gacaaagguuuuccucuucua

SEQ ID NO: 619566 - RNA, 22 nt, Homo sapiens
gacaaauauuccuuugcauauu

SEQ ID NO: 619567 - RNA, 21 nt, Homo sapiens
gacaaauauuuuagaagcuaa

SEQ ID NO: 619568 - RNA, 21 nt, Homo sapiens
gacaaaucaacagaagcauuu

SEQ ID NO: 619569 - RNA, 13 nt, Homo sapiens
gacaaauucuguu

SEQ ID NO: 619570 - RNA, 14 nt, Homo sapiens
gacaacaccuuccu

SEQ ID NO: 619571 - RNA, 13 nt, Homo sapiens
gacaacaucgcaa

SEQ ID NO: 619572 - RNA, 11 nt, Homo sapiens
gacaacauguu

SEQ ID NO: 619573 - RNA, 21 nt, Homo sapiens
gacaacauuucucaaaugcac

SEQ ID NO: 619574 - RNA, 13 nt, Homo sapiens
gacaaccaaaaca

SEQ ID NO: 619575 - RNA, 19 nt, Homo sapiens
gacaaccaaaacauauuca

SEQ ID NO: 619576 - RNA, 23 nt, Homo sapiens
gacaaccaacggccgacugccug

SEQ ID NO: 619577 - RNA, 18 nt, Homo sapiens
gacaaccuggacccagau

SEQ ID NO: 619578 - RNA, 16 nt, Homo sapiens
gacaacgaugaugcuu

SEQ ID NO: 619579 - RNA, 15 nt, Homo sapiens
gacaacucaaugaaa

SEQ ID NO: 619580 - RNA, 16 nt, Homo sapiens
gacaacugugacugua

SEQ ID NO: 619581 - RNA, 17 nt, Homo sapiens
gacaagaauaauucaau

SEQ ID NO: 619582 - RNA, 21 nt, Homo sapiens
gacaagaauaauucaauuuua

SEQ ID NO: 619583 - RNA, 13 nt, Homo sapiens
gacaagacaaaac

SEQ ID NO: 619584 - RNA, 14 nt, Homo sapiens
gacaagacgcugcc

SEQ ID NO: 619585 - RNA, 22 nt, Homo sapiens
gacaagccaacuuguaaauaca

SEQ ID NO: 619586 - RNA, 22 nt, Homo sapiens
gacaagcugacuuggcacuuaa

SEQ ID NO: 619587 - RNA, 17 nt, Homo sapiens
gacaaggccccagagac

SEQ ID NO: 619588 - RNA, 22 nt, Homo sapiens
gacaaggcuacgcugacaauca

SEQ ID NO: 619589 - RNA, 19 nt, Homo sapiens
gacaaggucgagacauucc

SEQ ID NO: 619590 - RNA, 14 nt, Homo sapiens
gacaaggugcuaac

SEQ ID NO: 619591 - RNA, 20 nt, Homo sapiens
gacaagguucccaagacaau

SEQ ID NO: 619592 - RNA, 14 nt, Homo sapiens
gacaauacuggggu

SEQ ID NO: 619593 - RNA, 13 nt, Homo sapiens
gacaauaugugcc

SEQ ID NO: 619594 - RNA, 14 nt, Homo sapiens
gacaaucauuugag

SEQ ID NO: 619595 - RNA, 12 nt, Homo sapiens
gacaaugaaggg

SEQ ID NO: 619596 - RNA, 14 nt, Homo sapiens
gacaaugaagggaa

SEQ ID NO: 619597 - RNA, 22 nt, Homo sapiens
gacuuauuaugcauaaagccaa

SEQ ID NO: 619598 - RNA, 13 nt, Homo sapiens
gacuuauugccaa

SEQ ID NO: 619599 - RNA, 21 nt, Homo sapiens
gacuucaccuaacuagagaca

SEQ ID NO: 619600 - RNA, 13 nt, Homo sapiens
gacuucagugugu

SEQ ID NO: 619601 - RNA, 17 nt, Homo sapiens
gacuuccacaaaccugg

SEQ ID NO: 619602 - RNA, 17 nt, Homo sapiens
gacuucccagggcaaga

SEQ ID NO: 619603 - RNA, 23 nt, Homo sapiens
gacuuccuugcaggagugacuca

SEQ ID NO: 619604 - RNA, 20 nt, Homo sapiens
gacuucuagcugucugugaa

SEQ ID NO: 619605 - RNA, 13 nt, Homo sapiens
gacuucucuuaca

SEQ ID NO: 619606 - RNA, 17 nt, Homo sapiens
gacuucugccuggagac

SEQ ID NO: 619607 - RNA, 20 nt, Homo sapiens
gacuucugcugaaggacaga

SEQ ID NO: 619608 - RNA, 21 nt, Homo sapiens
gacuucuugcuggucuaguca

SEQ ID NO: 619609 - RNA, 20 nt, Homo sapiens
gacuucuuuacuaacacugg

SEQ ID NO: 619610 - RNA, 19 nt, Homo sapiens
gacuucuuuuacucaugau

SEQ ID NO: 619611 - RNA, 17 nt, Homo sapiens
gacuugaaaccagaaga

SEQ ID NO: 619612 - RNA, 21 nt, Homo sapiens
gacuugaaaguuuuccaguau

SEQ ID NO: 619613 - RNA, 16 nt, Homo sapiens
gacuugaaauacuacu

SEQ ID NO: 619614 - RNA, 16 nt, Homo sapiens
gacuugaaauucucau

SEQ ID NO: 619615 - RNA, 23 nt, Homo sapiens
gacuugaaauucucaucagucca

SEQ ID NO: 619616 - RNA, 16 nt, Homo sapiens
gacuugaagcacagag

SEQ ID NO: 619617 - RNA, 15 nt, Homo sapiens
gacuugaaugcugcc

SEQ ID NO: 619618 - RNA, 16 nt, Homo sapiens
gacuugagccacuccu

SEQ ID NO: 619619 - RNA, 18 nt, Homo sapiens
gacuugauuagugccuuc

SEQ ID NO: 619620 - RNA, 22 nt, Homo sapiens
gacuugcacagggauucucaca

SEQ ID NO: 619621 - RNA, 19 nt, Homo sapiens
gacuugcccucucccuucc

SEQ ID NO: 619622 - RNA, 20 nt, Homo sapiens
gacuuggaguaaaacuguau

SEQ ID NO: 619623 - RNA, 18 nt, Homo sapiens
gacuuggauucuuuccau

SEQ ID NO: 619624 - RNA, 23 nt, Homo sapiens
gacuuggcaggugccuguugaau

SEQ ID NO: 619625 - RNA, 20 nt, Homo sapiens
gacuuggcuggggaggacca

SEQ ID NO: 619626 - RNA, 16 nt, Homo sapiens
gacuugucaagccugu

SEQ ID NO: 619627 - RNA, 17 nt, Homo sapiens
gacuuguccagugcucc

SEQ ID NO: 619628 - RNA, 16 nt, Homo sapiens
gacuuuaaaccaccua

SEQ ID NO: 619629 - RNA, 15 nt, Homo sapiens
gacuuuaagugaaag

SEQ ID NO: 619630 - RNA, 19 nt, Homo sapiens
gacuuuacgcccaucucag

SEQ ID NO: 619631 - RNA, 23 nt, Homo sapiens
gacuuuagaaauaaauguaccug

SEQ ID NO: 619632 - RNA, 17 nt, Homo sapiens
gacuuuauguugaaaua

SEQ ID NO: 619633 - RNA, 15 nt, Homo sapiens
gacuuuauugcaucu

SEQ ID NO: 619634 - RNA, 23 nt, Homo sapiens
gacuuucuaauuagagagcaucu

SEQ ID NO: 619635 - RNA, 15 nt, Homo sapiens
gacuuucuguuacua

SEQ ID NO: 619636 - RNA, 12 nt, Homo sapiens
gacuuugaacug

SEQ ID NO: 619637 - RNA, 20 nt, Homo sapiens
gacuuugagcugagugcuga

SEQ ID NO: 619638 - RNA, 21 nt, Homo sapiens
gacuuugagcugagugcugaa

SEQ ID NO: 619639 - RNA, 19 nt, Homo sapiens
gacuuugcccccuugccca

SEQ ID NO: 619640 - RNA, 19 nt, Homo sapiens
gacuuuggaaaacuacuuu

SEQ ID NO: 619641 - RNA, 17 nt, Homo sapiens
gacuuugguuugaccca

SEQ ID NO: 619642 - RNA, 13 nt, Homo sapiens
gacuuuguguuca

SEQ ID NO: 619643 - RNA, 18 nt, Homo sapiens
gacuuuguguucauuuca

SEQ ID NO: 619644 - RNA, 14 nt, Homo sapiens
gacuuuuaaucagu

SEQ ID NO: 619645 - RNA, 15 nt, Homo sapiens
gacuuuugcuuuaug

SEQ ID NO: 619646 - RNA, 18 nt, Homo sapiens
gacuuuuucaaagauuua

SEQ ID NO: 619647 - RNA, 19 nt, Homo sapiens
gagaaaaaagaaguguccg

SEQ ID NO: 619648 - RNA, 17 nt, Homo sapiens
gagaaaagaaaccagag

SEQ ID NO: 619649 - RNA, 16 nt, Homo sapiens
gagaaaauuccuagaa

SEQ ID NO: 619650 - RNA, 23 nt, Homo sapiens
gagaaaccagggagccccuuuga

SEQ ID NO: 619651 - RNA, 11 nt, Homo sapiens
gagaaacugag

SEQ ID NO: 619652 - RNA, 21 nt, Homo sapiens
gagaaacuuugaucucugcuu

SEQ ID NO: 619653 - RNA, 23 nt, Homo sapiens
gagaaagccgggggaggggcccu

SEQ ID NO: 619654 - RNA, 23 nt, Homo sapiens
gagaaaggauugauuugaacuua

SEQ ID NO: 619655 - RNA, 11 nt, Homo sapiens
gagaaagggag

SEQ ID NO: 619656 - RNA, 20 nt, Homo sapiens
gagaaagugaaaaugccacu

SEQ ID NO: 619657 - RNA, 20 nt, Homo sapiens
gagaaauaaaaagccuguca

SEQ ID NO: 619658 - RNA, 22 nt, Homo sapiens
gagaaauccuuccuaaacccaa

SEQ ID NO: 619659 - RNA, 21 nt, Homo sapiens
gagaaaugauaagugacaaaa

SEQ ID NO: 619660 - RNA, 12 nt, Homo sapiens
gagaaaugccag

SEQ ID NO: 619661 - RNA, 23 nt, Homo sapiens
gagaaaugcugcuagaaggaauu

SEQ ID NO: 619662 - RNA, 18 nt, Homo sapiens
gagaacaaagcuguuaaa

SEQ ID NO: 619663 - RNA, 22 nt, Homo sapiens
gagaacaacaggcaggggccca

SEQ ID NO: 619664 - RNA, 19 nt, Homo sapiens
gagaacaagaaagggccag

SEQ ID NO: 619665 - RNA, 20 nt, Homo sapiens
gagaacaccaaggcccagag

SEQ ID NO: 619666 - RNA, 19 nt, Homo sapiens
gagaacugcauauguuucg

SEQ ID NO: 619667 - RNA, 18 nt, Homo sapiens
gagaagacccacgugcua

SEQ ID NO: 619668 - RNA, 17 nt, Homo sapiens
gagaagaggcugcugca

SEQ ID NO: 619669 - RNA, 15 nt, Homo sapiens
gagaagauagggaac

SEQ ID NO: 619670 - RNA, 14 nt, Homo sapiens
gagaagcacagcuc

SEQ ID NO: 619671 - RNA, 16 nt, Homo sapiens
gagaagcacagcuccu

SEQ ID NO: 619672 - RNA, 17 nt, Homo sapiens
gagaagcaucauuuccc

SEQ ID NO: 619673 - RNA, 19 nt, Homo sapiens
gagaagccaggaggccugc

SEQ ID NO: 619674 - RNA, 13 nt, Homo sapiens
gagaaggaugggu

SEQ ID NO: 619675 - RNA, 13 nt, Homo sapiens
gagaaggaugguu

SEQ ID NO: 619676 - RNA, 14 nt, Homo sapiens
gagaaggcugugag

SEQ ID NO: 619677 - RNA, 18 nt, Homo sapiens
gagaagucagcuacucua

SEQ ID NO: 619678 - RNA, 21 nt, Homo sapiens
gagaagugccccugcugccuc

SEQ ID NO: 619679 - RNA, 14 nt, Homo sapiens
gagaaguuaagcaa

SEQ ID NO: 619680 - RNA, 20 nt, Homo sapiens
gagaauauacaugaagaaua

SEQ ID NO: 619681 - RNA, 13 nt, Homo sapiens
gagaaucacugga

SEQ ID NO: 619682 - RNA, 14 nt, Homo sapiens
gagaaucacuggaa

SEQ ID NO: 619683 - RNA, 16 nt, Homo sapiens
gagaauccauccaaag

SEQ ID NO: 619684 - RNA, 15 nt, Homo sapiens
gagaaucugcugcau

SEQ ID NO: 619685 - RNA, 22 nt, Homo sapiens
gagaaugggaugugugaugcaa

SEQ ID NO: 619686 - RNA, 19 nt, Homo sapiens
gagaaugugagaagccagc

SEQ ID NO: 619687 - RNA, 18 nt, Homo sapiens
gagaauuccuccuggcag

SEQ ID NO: 619688 - RNA, 19 nt, Homo sapiens
gagaauucucgaacugcau

SEQ ID NO: 619689 - RNA, 21 nt, Homo sapiens
gagacaaaaucuuaaaugcca

SEQ ID NO: 619690 - RNA, 15 nt, Homo sapiens
gagacaaagacucac

SEQ ID NO: 619691 - RNA, 17 nt, Homo sapiens
gagacaagaucuugaac

SEQ ID NO: 619692 - RNA, 19 nt, Homo sapiens
gagacaagggcaucaucua

SEQ ID NO: 619693 - RNA, 15 nt, Homo sapiens
gagacaaggugcuaa

SEQ ID NO: 619694 - RNA, 13 nt, Homo sapiens
gagacagaagcag

SEQ ID NO: 619695 - RNA, 18 nt, Homo sapiens
gagacaggaaaaaccaac

SEQ ID NO: 619696 - RNA, 15 nt, Homo sapiens
gagacaggcccaaga

SEQ ID NO: 619697 - RNA, 16 nt, Homo sapiens
gagacaggcccaagag

SEQ ID NO: 619698 - RNA, 24 nt, Homo sapiens
gagacaggguuuggcugugucuaa

SEQ ID NO: 619699 - RNA, 14 nt, Homo sapiens
gagacagugaggcu

SEQ ID NO: 619700 - RNA, 17 nt, Homo sapiens
gagacaugagaaaggga

SEQ ID NO: 619701 - RNA, 15 nt, Homo sapiens
gagacauuacuauag

SEQ ID NO: 619702 - RNA, 22 nt, Homo sapiens
gagaccaagacucugaaaucuc

SEQ ID NO: 619703 - RNA, 21 nt, Homo sapiens
gagaccacacugcacacagug

SEQ ID NO: 619704 - RNA, 20 nt, Homo sapiens
gagaccauguugacuuuccu

SEQ ID NO: 619705 - RNA, 20 nt, Homo sapiens
gagacccaacagcagugauc

SEQ ID NO: 619706 - RNA, 18 nt, Homo sapiens
gagacccacaauaaacuc

SEQ ID NO: 619707 - RNA, 18 nt, Homo sapiens
gagacccagcugcagacc

SEQ ID NO: 619708 - RNA, 11 nt, Homo sapiens
gagaccccagg

SEQ ID NO: 619709 - RNA, 13 nt, Homo sapiens
gagaccccaggaa

SEQ ID NO: 619710 - RNA, 20 nt, Homo sapiens
gagaccccuuccuuuccucu

SEQ ID NO: 619711 - RNA, 19 nt, Homo sapiens
gagaccccuuguugcacug

SEQ ID NO: 619712 - RNA, 20 nt, Homo sapiens
gagaccccuuguugcacugc

SEQ ID NO: 619713 - RNA, 18 nt, Homo sapiens
gagacccguagaugccag

SEQ ID NO: 619714 - RNA, 17 nt, Homo sapiens
gagacggaguuucacuc

SEQ ID NO: 619715 - RNA, 23 nt, Homo sapiens
gagacggggucucccuguguuac

SEQ ID NO: 619716 - RNA, 18 nt, Homo sapiens
gagacgguguuuugccau

SEQ ID NO: 619717 - RNA, 13 nt, Homo sapiens
gagacuaauucua

SEQ ID NO: 619718 - RNA, 16 nt, Homo sapiens
gaggugucuuaagccu

SEQ ID NO: 619719 - RNA, 17 nt, Homo sapiens
gaggugugaaagcccag

SEQ ID NO: 619720 - RNA, 20 nt, Homo sapiens
gaggugugacuaacuaugca

SEQ ID NO: 619721 - RNA, 14 nt, Homo sapiens
gagguuaggaguag

SEQ ID NO: 619722 - RNA, 19 nt, Homo sapiens
gagguucugggccucugaa

SEQ ID NO: 619723 - RNA, 14 nt, Homo sapiens
gagguugaagccaa

SEQ ID NO: 619724 - RNA, 19 nt, Homo sapiens
gagguuguggagaaaaaga

SEQ ID NO: 619725 - RNA, 19 nt, Homo sapiens
gagguuuggggucugccac

SEQ ID NO: 619726 - RNA, 23 nt, Homo sapiens
gagguuuuuuugucaacauugug

SEQ ID NO: 619727 - RNA, 15 nt, Homo sapiens
gaguaaaauucaguu

SEQ ID NO: 619728 - RNA, 14 nt, Homo sapiens
gaguaaacuugaaa

SEQ ID NO: 619729 - RNA, 16 nt, Homo sapiens
gaguaacagggcagaa

SEQ ID NO: 619730 - RNA, 19 nt, Homo sapiens
gaguaacauuugcuguuuu

SEQ ID NO: 619731 - RNA, 14 nt, Homo sapiens
gaguaaguguacaa

SEQ ID NO: 619732 - RNA, 21 nt, Homo sapiens
gaguaauauagugacuaugaa

SEQ ID NO: 619733 - RNA, 23 nt, Homo sapiens
gaguaaucaauacagacaagguu

SEQ ID NO: 619734 - RNA, 23 nt, Homo sapiens
gaguaaugauguaacagugcaag

SEQ ID NO: 619735 - RNA, 18 nt, Homo sapiens
gaguacagaaaaguugua

SEQ ID NO: 619736 - RNA, 23 nt, Homo sapiens
gaguaccuccagucacacucccc

SEQ ID NO: 619737 - RNA, 14 nt, Homo sapiens
gaguagggggagca

SEQ ID NO: 619738 - RNA, 12 nt, Homo sapiens
gaguaucacuuu

SEQ ID NO: 619739 - RNA, 19 nt, Homo sapiens
gaguauguuaagcucuuua

SEQ ID NO: 619740 - RNA, 22 nt, Homo sapiens
gaguauuccaugagcugcucau

SEQ ID NO: 619741 - RNA, 16 nt, Homo sapiens
gaguauuuauugucag

SEQ ID NO: 619742 - RNA, 20 nt, Homo sapiens
gagucaacucuggccaggaa

SEQ ID NO: 619743 - RNA, 18 nt, Homo sapiens
gagucaacuggcuggcca

SEQ ID NO: 619744 - RNA, 22 nt, Homo sapiens
gagucaauccccucauucagga

SEQ ID NO: 619745 - RNA, 16 nt, Homo sapiens
gagucaaugugcagug

SEQ ID NO: 619746 - RNA, 13 nt, Homo sapiens
gagucacugagac

SEQ ID NO: 619747 - RNA, 17 nt, Homo sapiens
gagucacugagaccaag

SEQ ID NO: 619748 - RNA, 19 nt, Homo sapiens
gagucacugccaagucaua

SEQ ID NO: 619749 - RNA, 22 nt, Homo sapiens
gagucagaucuuucuccuugaa

SEQ ID NO: 619750 - RNA, 21 nt, Homo sapiens
gagucaggaguuuuacugccu

SEQ ID NO: 619751 - RNA, 14 nt, Homo sapiens
gagucaggggcucu

SEQ ID NO: 619752 - RNA, 22 nt, Homo sapiens
gagucaucuauucaagcacuua

SEQ ID NO: 619753 - RNA, 14 nt, Homo sapiens
gaguccaaagaagg

SEQ ID NO: 619754 - RNA, 20 nt, Homo sapiens
gaguccacugcuccauuuau

SEQ ID NO: 619755 - RNA, 17 nt, Homo sapiens
gagucccuauaguuuca

SEQ ID NO: 619756 - RNA, 21 nt, Homo sapiens
gaguccgcccaucccugacca

SEQ ID NO: 619757 - RNA, 20 nt, Homo sapiens
gaguccucguagccaucucu

SEQ ID NO: 619758 - RNA, 20 nt, Homo sapiens
gagucgcaucucagugcagg

SEQ ID NO: 619759 - RNA, 16 nt, Homo sapiens
gagucggaguggacac

SEQ ID NO: 619760 - RNA, 17 nt, Homo sapiens
gagucggccaccacaga

SEQ ID NO: 619761 - RNA, 22 nt, Homo sapiens
gagucuaggcuaagcacuuuau

SEQ ID NO: 619762 - RNA, 13 nt, Homo sapiens
gagucucaagggu

SEQ ID NO: 619763 - RNA, 11 nt, Homo sapiens
gagucucugau

SEQ ID NO: 619764 - RNA, 18 nt, Homo sapiens
gagucucuucuccacugg

SEQ ID NO: 619765 - RNA, 23 nt, Homo sapiens
gagucugaauagucuucagagau

SEQ ID NO: 619766 - RNA, 16 nt, Homo sapiens
gagucuggguccaggc

SEQ ID NO: 619767 - RNA, 12 nt, Homo sapiens
gagucugucaca

SEQ ID NO: 619768 - RNA, 17 nt, Homo sapiens
gagucuuugcaccaaag

SEQ ID NO: 619769 - RNA, 22 nt, Homo sapiens
gagugaaaaaucuuaaguacca

SEQ ID NO: 619770 - RNA, 19 nt, Homo sapiens
gagugaaacuccgucucaa

SEQ ID NO: 619771 - RNA, 15 nt, Homo sapiens
gagugaaccuaccuu

SEQ ID NO: 619772 - RNA, 12 nt, Homo sapiens
gagugaauuuca

SEQ ID NO: 619773 - RNA, 17 nt, Homo sapiens
gagugaauuugaccuag

SEQ ID NO: 619774 - RNA, 15 nt, Homo sapiens
gagugacagcuuucu

SEQ ID NO: 619775 - RNA, 22 nt, Homo sapiens
gagugacggucccacacuggug

SEQ ID NO: 619776 - RNA, 20 nt, Homo sapiens
gagugacuacacacaguacg

SEQ ID NO: 619777 - RNA, 18 nt, Homo sapiens
gagugacucgaggguugg

SEQ ID NO: 619778 - RNA, 19 nt, Homo sapiens
gagugagaccauguuucaa

SEQ ID NO: 619779 - RNA, 20 nt, Homo sapiens
gagugagacuccaccucaaa

SEQ ID NO: 619780 - RNA, 18 nt, Homo sapiens
gagugagagacauuaacu

SEQ ID NO: 619781 - RNA, 16 nt, Homo sapiens
gagugagucagugaug

SEQ ID NO: 619782 - RNA, 16 nt, Homo sapiens
gagugcaccaaagaga

SEQ ID NO: 619783 - RNA, 17 nt, Homo sapiens
gagugcacugacuguga

SEQ ID NO: 619784 - RNA, 16 nt, Homo sapiens
gagugcaguggcacaa

SEQ ID NO: 619785 - RNA, 15 nt, Homo sapiens
gagugcgccucacca

SEQ ID NO: 619786 - RNA, 16 nt, Homo sapiens
gagugcucaccgccuc

SEQ ID NO: 619787 - RNA, 20 nt, Homo sapiens
gagugcugauucaaaccaaa

SEQ ID NO: 619788 - RNA, 13 nt, Homo sapiens
gagugcugggauu

SEQ ID NO: 619789 - RNA, 13 nt, Homo sapiens
gaguggaaaagcu

SEQ ID NO: 619790 - RNA, 14 nt, Homo sapiens
gaguggggaugaca

SEQ ID NO: 619791 - RNA, 15 nt, Homo sapiens
gaguggggggacaga

SEQ ID NO: 619792 - RNA, 17 nt, Homo sapiens
gaguggucgagugacac

SEQ ID NO: 619793 - RNA, 13 nt, Homo sapiens
gaguggugacagg

SEQ ID NO: 619794 - RNA, 23 nt, Homo sapiens
gagugguuuccaauguguucaau

SEQ ID NO: 619795 - RNA, 13 nt, Homo sapiens
gaguguagcugua

SEQ ID NO: 619796 - RNA, 15 nt, Homo sapiens
gagugucacaucucu

SEQ ID NO: 619797 - RNA, 12 nt, Homo sapiens
gagugugacagg

SEQ ID NO: 619798 - RNA, 14 nt, Homo sapiens
gagugugugcaugu

SEQ ID NO: 619799 - RNA, 16 nt, Homo sapiens
gaguuaaaacauuucu

SEQ ID NO: 619800 - RNA, 15 nt, Homo sapiens
gaguuaaaucucaaa

SEQ ID NO: 619801 - RNA, 14 nt, Homo sapiens
gaguuacaguucug

SEQ ID NO: 619802 - RNA, 18 nt, Homo sapiens
gaguuaggcuauucacaa

SEQ ID NO: 619803 - RNA, 18 nt, Homo sapiens
gaguuaucuucuuuauua

SEQ ID NO: 619804 - RNA, 22 nt, Homo sapiens
gaguuauggugaacccacaacu

SEQ ID NO: 619805 - RNA, 20 nt, Homo sapiens
gaguuauucaaaugaaggug

SEQ ID NO: 619806 - RNA, 13 nt, Homo sapiens
gaguucucugaug

SEQ ID NO: 619807 - RNA, 14 nt, Homo sapiens
gaguugacucggug

SEQ ID NO: 619808 - RNA, 22 nt, Homo sapiens
gaguugauuuccucccucugcc

SEQ ID NO: 619809 - RNA, 20 nt, Homo sapiens
gaguugcaacuuaaguauau

SEQ ID NO: 619810 - RNA, 18 nt, Homo sapiens
gaguuggaacugcauucu

SEQ ID NO: 619811 - RNA, 12 nt, Homo sapiens
gaguuggaauca

SEQ ID NO: 619812 - RNA, 19 nt, Homo sapiens
gaguuguugaaagcugaaa

SEQ ID NO: 619813 - RNA, 23 nt, Homo sapiens
gaguuucccuuccuuaugucucc

SEQ ID NO: 619814 - RNA, 21 nt, Homo sapiens
gaguuucuccuuuugaccaaa

SEQ ID NO: 619815 - RNA, 22 nt, Homo sapiens
gaguuucuccuuuugaccaaau

SEQ ID NO: 619816 - RNA, 22 nt, Homo sapiens
gaguuugccuguucuaugccuu

SEQ ID NO: 619817 - RNA, 20 nt, Homo sapiens
gaguuuguguguauuuguau

SEQ ID NO: 619818 - RNA, 13 nt, Homo sapiens
gaguuuucagugg

SEQ ID NO: 619819 - RNA, 19 nt, Homo sapiens
gaguuuucuauuucacuaa

SEQ ID NO: 619820 - RNA, 16 nt, Homo sapiens
gauaaaaagauggccu

SEQ ID NO: 619821 - RNA, 13 nt, Homo sapiens
gauaaaacagaau

SEQ ID NO: 619822 - RNA, 13 nt, Homo sapiens
gauaaaagcaauu

SEQ ID NO: 619823 - RNA, 16 nt, Homo sapiens
gauaaagcaguauuug

SEQ ID NO: 619824 - RNA, 20 nt, Homo sapiens
gauaaaguaauaaugugcaa

SEQ ID NO: 619825 - RNA, 20 nt, Homo sapiens
gauaaagucaaaugccaaac

SEQ ID NO: 619826 - RNA, 14 nt, Homo sapiens
gauaaaucauuuca

SEQ ID NO: 619827 - RNA, 14 nt, Homo sapiens
gauaaaugacuguu

SEQ ID NO: 619828 - RNA, 17 nt, Homo sapiens
gauaaaugauagacaau

SEQ ID NO: 619829 - RNA, 16 nt, Homo sapiens
gauaaauuccacugga

SEQ ID NO: 619830 - RNA, 23 nt, Homo sapiens
gauaacacaaguaaaacuguggu

SEQ ID NO: 619831 - RNA, 17 nt, Homo sapiens
gauaacagccucuugcc

SEQ ID NO: 619832 - RNA, 18 nt, Homo sapiens
gauaacaguuacuccagu

SEQ ID NO: 619833 - RNA, 22 nt, Homo sapiens
gauaacaugcuuuggguggaau

SEQ ID NO: 619834 - RNA, 17 nt, Homo sapiens
gauaaccuugugccuug

SEQ ID NO: 619835 - RNA, 18 nt, Homo sapiens
gauaacuggccagccaua

SEQ ID NO: 619836 - RNA, 19 nt, Homo sapiens
gauaagaaaugaucuuuac

SEQ ID NO: 619837 - RNA, 21 nt, Homo sapiens
gauaagcacauuaaaguuaau

SEQ ID NO: 619838 - RNA, 14 nt, Homo sapiens
gauaaggcucugaa

SEQ ID NO: 619839 - RNA, 19 nt, Homo sapiens
gauaauaaaggcauuucaa

SEQ ID NO: 619840 - RNA, 15 nt, Homo sapiens
gcaaauaaagccuuu

SEQ ID NO: 619841 - RNA, 13 nt, Homo sapiens
gcaaauaauggaa

SEQ ID NO: 619842 - RNA, 15 nt, Homo sapiens
gcaaauacacuccag

SEQ ID NO: 619843 - RNA, 13 nt, Homo sapiens
gcaaauacuguau

SEQ ID NO: 619844 - RNA, 15 nt, Homo sapiens
gcaaauauugucaua

SEQ ID NO: 619845 - RNA, 16 nt, Homo sapiens
gcaaaucaggggccag

SEQ ID NO: 619846 - RNA, 21 nt, Homo sapiens
gcaaauccuugauacugcuca

SEQ ID NO: 619847 - RNA, 18 nt, Homo sapiens
gcaaaugcagaaccacaa

SEQ ID NO: 619848 - RNA, 14 nt, Homo sapiens
gcaaaugcuguauu

SEQ ID NO: 619849 - RNA, 15 nt, Homo sapiens
gcaaauguacuucuc

SEQ ID NO: 619850 - RNA, 14 nt, Homo sapiens
gcaaauuguuucag

SEQ ID NO: 619851 - RNA, 22 nt, Homo sapiens
gcaacagcaaaucacgaccacu

SEQ ID NO: 619852 - RNA, 15 nt, Homo sapiens
gcaacagcacuggcu

SEQ ID NO: 619853 - RNA, 13 nt, Homo sapiens
gcaacagugccau

SEQ ID NO: 619854 - RNA, 11 nt, Homo sapiens
gcaacaucucu

SEQ ID NO: 619855 - RNA, 20 nt, Homo sapiens
gcaaccaacugccccagggg

SEQ ID NO: 619856 - RNA, 10 nt, Homo sapiens
gcaaccagua

SEQ ID NO: 619857 - RNA, 13 nt, Homo sapiens
gcaaccccaguuc

SEQ ID NO: 619858 - RNA, 18 nt, Homo sapiens
gcaaccuccacauguuca

SEQ ID NO: 619859 - RNA, 22 nt, Homo sapiens
gcaaccuccacauguucaacua

SEQ ID NO: 619860 - RNA, 19 nt, Homo sapiens
gcaaccucuucaugagcuu

SEQ ID NO: 619861 - RNA, 16 nt, Homo sapiens
gcaacggggaggccaa

SEQ ID NO: 619862 - RNA, 15 nt, Homo sapiens
gcaacuaaggacaaa

SEQ ID NO: 619863 - RNA, 23 nt, Homo sapiens
gcaacuaggaaaaucacuugcca

SEQ ID NO: 619864 - RNA, 15 nt, Homo sapiens
gcaacuaggccuuca

SEQ ID NO: 619865 - RNA, 20 nt, Homo sapiens
gcaacuagggcuagucuucc

SEQ ID NO: 619866 - RNA, 23 nt, Homo sapiens
gcaacuauuuccaccuccuccca

SEQ ID NO: 619867 - RNA, 16 nt, Homo sapiens
gcaacucugagaucua

SEQ ID NO: 619868 - RNA, 14 nt, Homo sapiens
gcaacucuguaaau

SEQ ID NO: 619869 - RNA, 15 nt, Homo sapiens
gcaacugaggcagac

SEQ ID NO: 619870 - RNA, 22 nt, Homo sapiens
gcaacugaggcagacagcagcu

SEQ ID NO: 619871 - RNA, 17 nt, Homo sapiens
gcaacugccuuccugcc

SEQ ID NO: 619872 - RNA, 18 nt, Homo sapiens
gcaacuggccauuugcca

SEQ ID NO: 619873 - RNA, 15 nt, Homo sapiens
gcaacuguaugaaaa

SEQ ID NO: 619874 - RNA, 23 nt, Homo sapiens
gcaacuuaagcugggauaaucac

SEQ ID NO: 619875 - RNA, 16 nt, Homo sapiens
gcaagaaggaaggagg

SEQ ID NO: 619876 - RNA, 21 nt, Homo sapiens
gcaagaaguagcagugucugu

SEQ ID NO: 619877 - RNA, 17 nt, Homo sapiens
gcaagacuguugcucaa

SEQ ID NO: 619878 - RNA, 18 nt, Homo sapiens
gcaagagcugaaaaacuu

SEQ ID NO: 619879 - RNA, 15 nt, Homo sapiens
gcaagcacaucugca

SEQ ID NO: 619880 - RNA, 13 nt, Homo sapiens
gcaagcagggaaa

SEQ ID NO: 619881 - RNA, 15 nt, Homo sapiens
gcaagcuaacugcuu

SEQ ID NO: 619882 - RNA, 20 nt, Homo sapiens
gcaagcucuaucaccaagga

SEQ ID NO: 619883 - RNA, 21 nt, Homo sapiens
gcaaggaccuaaaacaucuca

SEQ ID NO: 619884 - RNA, 17 nt, Homo sapiens
gcaaggacggccuucaa

SEQ ID NO: 619885 - RNA, 20 nt, Homo sapiens
gcaagguuauaugcacuuuc

SEQ ID NO: 619886 - RNA, 23 nt, Homo sapiens
gcaaguaaaaaggcuaaauggaa

SEQ ID NO: 619887 - RNA, 17 nt, Homo sapiens
gcaaguacgcaagaaau

SEQ ID NO: 619888 - RNA, 13 nt, Homo sapiens
gcaagugcaaaag

SEQ ID NO: 619889 - RNA, 15 nt, Homo sapiens
gcaaguguaucuccu

SEQ ID NO: 619890 - RNA, 15 nt, Homo sapiens
gcaagugugugcaca

SEQ ID NO: 619891 - RNA, 18 nt, Homo sapiens
gcaagugugugcaugugu

SEQ ID NO: 619892 - RNA, 20 nt, Homo sapiens
gcaaguguguguuugccaau

SEQ ID NO: 619893 - RNA, 15 nt, Homo sapiens
gcaaguuaaagaaaa

SEQ ID NO: 619894 - RNA, 14 nt, Homo sapiens
gcaaguuagaacua

SEQ ID NO: 619895 - RNA, 16 nt, Homo sapiens
gcaaguuuccaucauc

SEQ ID NO: 619896 - RNA, 18 nt, Homo sapiens
gcaauaaaaaucauagua

SEQ ID NO: 619897 - RNA, 16 nt, Homo sapiens
gcaauaaaauguauuu

SEQ ID NO: 619898 - RNA, 14 nt, Homo sapiens
gcaauaaauaccag

SEQ ID NO: 619899 - RNA, 17 nt, Homo sapiens
gcaauaaauaccagaca

SEQ ID NO: 619900 - RNA, 22 nt, Homo sapiens
gcaauacgggagugacccagcu

SEQ ID NO: 619901 - RNA, 15 nt, Homo sapiens
gcaauacuguaggaa

SEQ ID NO: 619902 - RNA, 21 nt, Homo sapiens
gcaauauccaaauaaugagua

SEQ ID NO: 619903 - RNA, 15 nt, Homo sapiens
gcaaucaugagcaag

SEQ ID NO: 619904 - RNA, 21 nt, Homo sapiens
gcaaucccagcuacuuggaag

SEQ ID NO: 619905 - RNA, 15 nt, Homo sapiens
gcaaucuacuggaaa

SEQ ID NO: 619906 - RNA, 20 nt, Homo sapiens
gcaaucucauuacuggguau

SEQ ID NO: 619907 - RNA, 22 nt, Homo sapiens
gcaaugccaaucuucaguauuu

SEQ ID NO: 619908 - RNA, 13 nt, Homo sapiens
gcaaugccauuuc

SEQ ID NO: 619909 - RNA, 18 nt, Homo sapiens
gcaaugcuaauucaaugc

SEQ ID NO: 619910 - RNA, 16 nt, Homo sapiens
gcaaugguuuguguca

SEQ ID NO: 619911 - RNA, 18 nt, Homo sapiens
gcaaugguuugugucaaa

SEQ ID NO: 619912 - RNA, 22 nt, Homo sapiens
gcaauguugguuucacugagag

SEQ ID NO: 619913 - RNA, 22 nt, Homo sapiens
gcaauuaaaacuaugugcuauc

SEQ ID NO: 619914 - RNA, 14 nt, Homo sapiens
gcaauuaaagugau

SEQ ID NO: 619915 - RNA, 23 nt, Homo sapiens
gcaauuauagaguaucacuccca

SEQ ID NO: 619916 - RNA, 19 nt, Homo sapiens
gcaauuccucugaacaaaa

SEQ ID NO: 619917 - RNA, 21 nt, Homo sapiens
gcaauugaaggaucaucugaa

SEQ ID NO: 619918 - RNA, 21 nt, Homo sapiens
gcaauugaauuaaauuaggaa

SEQ ID NO: 619919 - RNA, 18 nt, Homo sapiens
gcaauugcacucaugugg

SEQ ID NO: 619920 - RNA, 16 nt, Homo sapiens
gcaauuucuacuacag

SEQ ID NO: 619921 - RNA, 17 nt, Homo sapiens
gcaauuuucgaacauuc

SEQ ID NO: 619922 - RNA, 18 nt, Homo sapiens
gcaauuuucgaacauucu

SEQ ID NO: 619923 - RNA, 17 nt, Homo sapiens
gcaauuuuguaaauuga

SEQ ID NO: 619924 - RNA, 20 nt, Homo sapiens
gcaauuuuucaagagcuccu

SEQ ID NO: 619925 - RNA, 21 nt, Homo sapiens
gcaauuuuucaagagcuccuu

SEQ ID NO: 619926 - RNA, 20 nt, Homo sapiens
gcacaaaagcagauacuuga

SEQ ID NO: 619927 - RNA, 14 nt, Homo sapiens
gcacaaaagggacu

SEQ ID NO: 619928 - RNA, 14 nt, Homo sapiens
gcacaaacaauaug

SEQ ID NO: 619929 - RNA, 17 nt, Homo sapiens
gcacaaacugcagcugu

SEQ ID NO: 619930 - RNA, 20 nt, Homo sapiens
gcacaaagauggauguaaug

SEQ ID NO: 619931 - RNA, 13 nt, Homo sapiens
gcacaaauuccac

SEQ ID NO: 619932 - RNA, 18 nt, Homo sapiens
gcacaacgcaccagacac

SEQ ID NO: 619933 - RNA, 13 nt, Homo sapiens
gcacaacucccuu

SEQ ID NO: 619934 - RNA, 23 nt, Homo sapiens
gcacaagaauugaguaucacuuu

SEQ ID NO: 619935 - RNA, 16 nt, Homo sapiens
gcacaagggcacguga

SEQ ID NO: 619936 - RNA, 12 nt, Homo sapiens
gcacaaguacuu

SEQ ID NO: 619937 - RNA, 21 nt, Homo sapiens
gcacaauuuaauauauucaag

SEQ ID NO: 619938 - RNA, 18 nt, Homo sapiens
gcacaauuugcacuaaau

SEQ ID NO: 619939 - RNA, 22 nt, Homo sapiens
gcacaauuuuaauucaaaagau

SEQ ID NO: 619940 - RNA, 19 nt, Homo sapiens
gcacacaauaagcauucaa

SEQ ID NO: 619941 - RNA, 15 nt, Homo sapiens
gcacacacaaaccua

SEQ ID NO: 619942 - RNA, 15 nt, Homo sapiens
gcacacacacauaca

SEQ ID NO: 619943 - RNA, 23 nt, Homo sapiens
gcacacacaccacacauacacac

SEQ ID NO: 619944 - RNA, 13 nt, Homo sapiens
gcacacacugugc

SEQ ID NO: 619945 - RNA, 15 nt, Homo sapiens
gcacaccagugcaag

SEQ ID NO: 619946 - RNA, 17 nt, Homo sapiens
gcacacccuccagagac

SEQ ID NO: 619947 - RNA, 21 nt, Homo sapiens
gcacaccucugcaccuuugca

SEQ ID NO: 619948 - RNA, 17 nt, Homo sapiens
gcacacgccuguauucc

SEQ ID NO: 619949 - RNA, 20 nt, Homo sapiens
gcacacgccuguauucccac

SEQ ID NO: 619950 - RNA, 20 nt, Homo sapiens
gcacacuagccucuccagga

SEQ ID NO: 619951 - RNA, 13 nt, Homo sapiens
gcacagaauuugu

SEQ ID NO: 619952 - RNA, 16 nt, Homo sapiens
gcacagaccaguuuca

SEQ ID NO: 619953 - RNA, 16 nt, Homo sapiens
gcacagaucugcuuga

SEQ ID NO: 619954 - RNA, 18 nt, Homo sapiens
gcacagaugcccacguau

SEQ ID NO: 619955 - RNA, 13 nt, Homo sapiens
gcacagauggauu

SEQ ID NO: 619956 - RNA, 17 nt, Homo sapiens
gcacagcacccauggga

SEQ ID NO: 619957 - RNA, 11 nt, Homo sapiens
gcacagccacc

SEQ ID NO: 619958 - RNA, 15 nt, Homo sapiens
gcacagcuaauucua

SEQ ID NO: 619959 - RNA, 22 nt, Homo sapiens
gcacaggugacagaucauagga

SEQ ID NO: 619960 - RNA, 21 nt, Homo sapiens
gcacaguaucuuuucuuucaa

SEQ ID NO: 619961 - RNA, 14 nt, Homo sapiens
gcacagucacccau

SEQ ID NO: 619962 - RNA, 16 nt, Homo sapiens
gcugagcaaucugacc

SEQ ID NO: 619963 - RNA, 15 nt, Homo sapiens
gcugagccucagucu

SEQ ID NO: 619964 - RNA, 18 nt, Homo sapiens
gcugaggccuaugcagac

SEQ ID NO: 619965 - RNA, 22 nt, Homo sapiens
gcugaggccuuaucauucauuc

SEQ ID NO: 619966 - RNA, 23 nt, Homo sapiens
gcugaggcggguggaucaccuga

SEQ ID NO: 619967 - RNA, 18 nt, Homo sapiens
gcugagggacguggugcc

SEQ ID NO: 619968 - RNA, 21 nt, Homo sapiens
gcugaggggaggaucacugga

SEQ ID NO: 619969 - RNA, 20 nt, Homo sapiens
gcugagguuuagaugugcaa

SEQ ID NO: 619970 - RNA, 13 nt, Homo sapiens
gcugagguuuuga

SEQ ID NO: 619971 - RNA, 19 nt, Homo sapiens
gcugaguagggacucaggg

SEQ ID NO: 619972 - RNA, 16 nt, Homo sapiens
gcugagucaaucaaua

SEQ ID NO: 619973 - RNA, 20 nt, Homo sapiens
gcugaguccagagcuugugc

SEQ ID NO: 619974 - RNA, 12 nt, Homo sapiens
gcugagugacac

SEQ ID NO: 619975 - RNA, 18 nt, Homo sapiens
gcugagugacugcagcuu

SEQ ID NO: 619976 - RNA, 12 nt, Homo sapiens
gcugagugcagc

SEQ ID NO: 619977 - RNA, 20 nt, Homo sapiens
gcugagugcauaggugacag

SEQ ID NO: 619978 - RNA, 20 nt, Homo sapiens
gcugagugggagaaggcagu

SEQ ID NO: 619979 - RNA, 18 nt, Homo sapiens
gcugaguuccggggugca

SEQ ID NO: 619980 - RNA, 21 nt, Homo sapiens
gcugaguuccggggugcaaug

SEQ ID NO: 619981 - RNA, 18 nt, Homo sapiens
gcugauaaauauaaccau

SEQ ID NO: 619982 - RNA, 18 nt, Homo sapiens
gcugauaauaugcaaaug

SEQ ID NO: 619983 - RNA, 21 nt, Homo sapiens
gcugaucaguuuuuucaccug

SEQ ID NO: 619984 - RNA, 19 nt, Homo sapiens
gcugauccagagcacagau

SEQ ID NO: 619985 - RNA, 17 nt, Homo sapiens
gcugaugagaaucaugc

SEQ ID NO: 619986 - RNA, 17 nt, Homo sapiens
gcugaugaugucucuug

SEQ ID NO: 619987 - RNA, 14 nt, Homo sapiens
gcugauguuuacaa

SEQ ID NO: 619988 - RNA, 13 nt, Homo sapiens
gcugauuacugaa

SEQ ID NO: 619989 - RNA, 20 nt, Homo sapiens
gcugauuauuuaugaccuga

SEQ ID NO: 619990 - RNA, 15 nt, Homo sapiens
gcugauuuuaacaau

SEQ ID NO: 619991 - RNA, 21 nt, Homo sapiens
gcugcaacggaauuaggaaga

SEQ ID NO: 619992 - RNA, 13 nt, Homo sapiens
gcugcacauuccu

SEQ ID NO: 619993 - RNA, 16 nt, Homo sapiens
gcugcaccugauuagu

SEQ ID NO: 619994 - RNA, 16 nt, Homo sapiens
gcugcagucacauuga

SEQ ID NO: 619995 - RNA, 15 nt, Homo sapiens
gcugcauaguauucc

SEQ ID NO: 619996 - RNA, 18 nt, Homo sapiens
gcugcaucccccccaccu

SEQ ID NO: 619997 - RNA, 18 nt, Homo sapiens
gcugcaucuccccucaga

SEQ ID NO: 619998 - RNA, 19 nt, Homo sapiens
gcugcaucuccccucagau

SEQ ID NO: 619999 - RNA, 16 nt, Homo sapiens
gcugcaucuuacagaa

SEQ ID NO: 620000 - RNA, 18 nt, Homo sapiens
gcugcauuuuacacaugu

SEQ ID NO: 620001 - RNA, 14 nt, Homo sapiens
gcugccaaaaccac

SEQ ID NO: 620002 - RNA, 16 nt, Homo sapiens
gcugccagggcuuccu

SEQ ID NO: 620003 - RNA, 19 nt, Homo sapiens
gcugccauauuguagcuca

SEQ ID NO: 620004 - RNA, 24 nt, Homo sapiens
gcugccauuucccuucuggacacu

SEQ ID NO: 620005 - RNA, 13 nt, Homo sapiens
gcugcccacuguu

SEQ ID NO: 620006 - RNA, 22 nt, Homo sapiens
gcugccccaaccugcugaaggg

SEQ ID NO: 620007 - RNA, 20 nt, Homo sapiens
gcugccccuugcaagccaua

SEQ ID NO: 620008 - RNA, 14 nt, Homo sapiens
gcugcccucaggga

SEQ ID NO: 620009 - RNA, 15 nt, Homo sapiens
gcugccuaccagggg

SEQ ID NO: 620010 - RNA, 16 nt, Homo sapiens
gcugccucuaccugac

SEQ ID NO: 620011 - RNA, 19 nt, Homo sapiens
gcugccucuaccugacacu

SEQ ID NO: 620012 - RNA, 11 nt, Homo sapiens
gcugccucuug

SEQ ID NO: 620013 - RNA, 20 nt, Homo sapiens
gcugccucuugaaugcaggg

SEQ ID NO: 620014 - RNA, 12 nt, Homo sapiens
gcugccucuugg

SEQ ID NO: 620015 - RNA, 15 nt, Homo sapiens
gcugccugacacuga

SEQ ID NO: 620016 - RNA, 18 nt, Homo sapiens
gcugccuguccccaugcu

SEQ ID NO: 620017 - RNA, 17 nt, Homo sapiens
gcugccuuggcucagac

SEQ ID NO: 620018 - RNA, 14 nt, Homo sapiens
gcugcgacugauga

SEQ ID NO: 620019 - RNA, 16 nt, Homo sapiens
gcugcgcacugugucc

SEQ ID NO: 620020 - RNA, 23 nt, Homo sapiens
gcugcgucagaccaguacuggga

SEQ ID NO: 620021 - RNA, 13 nt, Homo sapiens
gcugcgugccauc

SEQ ID NO: 620022 - RNA, 19 nt, Homo sapiens
gcugcgugccaucacucaa

SEQ ID NO: 620023 - RNA, 23 nt, Homo sapiens
gcugcuaaagggagaaaugccag

SEQ ID NO: 620024 - RNA, 14 nt, Homo sapiens
gcugcucuauugua

SEQ ID NO: 620025 - RNA, 23 nt, Homo sapiens
gcugcucuuagugcccgccuagg

SEQ ID NO: 620026 - RNA, 12 nt, Homo sapiens
gcugcugccagg

SEQ ID NO: 620027 - RNA, 21 nt, Homo sapiens
gcugcugccuuguuucaccuu

SEQ ID NO: 620028 - RNA, 15 nt, Homo sapiens
gcugcugcugcucca

SEQ ID NO: 620029 - RNA, 23 nt, Homo sapiens
gcugcugcuuagcuugcaccuug

SEQ ID NO: 620030 - RNA, 12 nt, Homo sapiens
gcugcugucaca

SEQ ID NO: 620031 - RNA, 15 nt, Homo sapiens
gcugcuuaauaccaa

SEQ ID NO: 620032 - RNA, 14 nt, Homo sapiens
gcugcuucugcaaa

SEQ ID NO: 620033 - RNA, 18 nt, Homo sapiens
gcugcuucugcugccuag

SEQ ID NO: 620034 - RNA, 23 nt, Homo sapiens
gcugcuuucuuguugcugcaucu

SEQ ID NO: 620035 - RNA, 21 nt, Homo sapiens
gcugcuuuguccaggugagaa

SEQ ID NO: 620036 - RNA, 20 nt, Homo sapiens
gcuggaaaagggucuuggga

SEQ ID NO: 620037 - RNA, 18 nt, Homo sapiens
gcuggaaccugcaaaaaa

SEQ ID NO: 620038 - RNA, 12 nt, Homo sapiens
gcuggaagcaca

SEQ ID NO: 620039 - RNA, 15 nt, Homo sapiens
gcuggaaggggucca

SEQ ID NO: 620040 - RNA, 19 nt, Homo sapiens
gcuggaauuacaaaacuca

SEQ ID NO: 620041 - RNA, 19 nt, Homo sapiens
gcuggaauucuaacaaguc

SEQ ID NO: 620042 - RNA, 21 nt, Homo sapiens
gcuggacgugcgcgaugccug

SEQ ID NO: 620043 - RNA, 16 nt, Homo sapiens
gcuggagaggaaccca

SEQ ID NO: 620044 - RNA, 21 nt, Homo sapiens
gcuggagauaacagccucuug

SEQ ID NO: 620045 - RNA, 21 nt, Homo sapiens
gcuggagcggggaucugauga

SEQ ID NO: 620046 - RNA, 19 nt, Homo sapiens
gcuggagcugccucucuca

SEQ ID NO: 620047 - RNA, 20 nt, Homo sapiens
gcuggaguacaguggcacga

SEQ ID NO: 620048 - RNA, 13 nt, Homo sapiens
gcuggagugcaau

SEQ ID NO: 620049 - RNA, 19 nt, Homo sapiens
gcuggagugcaguggcaca

SEQ ID NO: 620050 - RNA, 17 nt, Homo sapiens
gcuggauacuggacaca

SEQ ID NO: 620051 - RNA, 16 nt, Homo sapiens
gcuggaugggacucca

SEQ ID NO: 620052 - RNA, 12 nt, Homo sapiens
gcuggauuugua

SEQ ID NO: 620053 - RNA, 18 nt, Homo sapiens
gcuggcaagauaaacacu

SEQ ID NO: 620054 - RNA, 23 nt, Homo sapiens
gcuggcaccuuaguugcaugacc

SEQ ID NO: 620055 - RNA, 19 nt, Homo sapiens
gcuggcccgucauguuccu

SEQ ID NO: 620056 - RNA, 12 nt, Homo sapiens
gcuggcccugug

SEQ ID NO: 620057 - RNA, 14 nt, Homo sapiens
gcuggccugacugg

SEQ ID NO: 620058 - RNA, 18 nt, Homo sapiens
gcuggcgucugucuucaa

SEQ ID NO: 620059 - RNA, 13 nt, Homo sapiens
gcuggcuuucaga

SEQ ID NO: 620060 - RNA, 19 nt, Homo sapiens
gcugggaaccagcaucuca

SEQ ID NO: 620061 - RNA, 23 nt, Homo sapiens
gcugggacguggcucagccagca

SEQ ID NO: 620062 - RNA, 22 nt, Homo sapiens
gcugggagguugggaggcugug

SEQ ID NO: 620063 - RNA, 16 nt, Homo sapiens
gcugggcagaccccuc

SEQ ID NO: 620064 - RNA, 13 nt, Homo sapiens
gcugggccauguc

SEQ ID NO: 620065 - RNA, 17 nt, Homo sapiens
gcugggccauguccaaa

SEQ ID NO: 620066 - RNA, 18 nt, Homo sapiens
gcugggccauguccaaag

SEQ ID NO: 620067 - RNA, 23 nt, Homo sapiens
gcugggcgcagcggcucacgccu

SEQ ID NO: 620068 - RNA, 20 nt, Homo sapiens
gcugggcuagaaagaccacu

SEQ ID NO: 620069 - RNA, 21 nt, Homo sapiens
gcuggguaagagcacagguua

SEQ ID NO: 620070 - RNA, 22 nt, Homo sapiens
gcugguauucucucuaugcaaa

SEQ ID NO: 620071 - RNA, 18 nt, Homo sapiens
gcuggucucaaacuccug

SEQ ID NO: 620072 - RNA, 19 nt, Homo sapiens
gcuggucucugcugaaggu

SEQ ID NO: 620073 - RNA, 17 nt, Homo sapiens
gcuggugaacacuguga

SEQ ID NO: 620074 - RNA, 15 nt, Homo sapiens
gcugguggugcugca

SEQ ID NO: 620075 - RNA, 12 nt, Homo sapiens
gcuggugucuag

SEQ ID NO: 620076 - RNA, 17 nt, Homo sapiens
gcugguugagguuucaa

SEQ ID NO: 620077 - RNA, 13 nt, Homo sapiens
gcuguaaggcaug

SEQ ID NO: 620078 - RNA, 15 nt, Homo sapiens
gcuguacccuugaga

SEQ ID NO: 620079 - RNA, 15 nt, Homo sapiens
gcuguacgagugugu

SEQ ID NO: 620080 - RNA, 16 nt, Homo sapiens
gcuguagaccaccuaa

SEQ ID NO: 620081 - RNA, 14 nt, Homo sapiens
gcuguauagcuccu

SEQ ID NO: 620082 - RNA, 23 nt, Homo sapiens
gcuguauauaggggucaauguga

SEQ ID NO: 620083 - RNA, 13 nt, Homo sapiens
gcuguaugugagc

SEQ ID NO: 620084 - RNA, 17 nt, Homo sapiens
ggacagaguagccaggu

SEQ ID NO: 620085 - RNA, 17 nt, Homo sapiens
ggacagaugaaugccgu

SEQ ID NO: 620086 - RNA, 20 nt, Homo sapiens
ggacagaugaaugccgugga

SEQ ID NO: 620087 - RNA, 14 nt, Homo sapiens
ggacaggauccagg

SEQ ID NO: 620088 - RNA, 15 nt, Homo sapiens
ggacaggcaggccag

SEQ ID NO: 620089 - RNA, 16 nt, Homo sapiens
ggacaguaucccacau

SEQ ID NO: 620090 - RNA, 17 nt, Homo sapiens
ggacaguccugggagaa

SEQ ID NO: 620091 - RNA, 9 nt, Homo sapiens
ggacauaug

SEQ ID NO: 620092 - RNA, 19 nt, Homo sapiens
ggacaugcuuuucugccac

SEQ ID NO: 620093 - RNA, 18 nt, Homo sapiens
ggacauugaaagugaaau

SEQ ID NO: 620094 - RNA, 20 nt, Homo sapiens
ggacauuguaugcagggagc

SEQ ID NO: 620095 - RNA, 19 nt, Homo sapiens
ggacauuuuuucagucaua

SEQ ID NO: 620096 - RNA, 17 nt, Homo sapiens
ggaccaaaaaaccucac

SEQ ID NO: 620097 - RNA, 17 nt, Homo sapiens
ggaccaaugaggugagg

SEQ ID NO: 620098 - RNA, 21 nt, Homo sapiens
ggaccaccguucagucauuuu

SEQ ID NO: 620099 - RNA, 12 nt, Homo sapiens
ggaccacugcau

SEQ ID NO: 620100 - RNA, 17 nt, Homo sapiens
ggaccagaaguguuuca

SEQ ID NO: 620101 - RNA, 17 nt, Homo sapiens
ggaccagcccauuggcc

SEQ ID NO: 620102 - RNA, 19 nt, Homo sapiens
ggaccaucgcugccugcca

SEQ ID NO: 620103 - RNA, 19 nt, Homo sapiens
ggaccauugaccucagcug

SEQ ID NO: 620104 - RNA, 20 nt, Homo sapiens
ggacccaccccaacucuccc

SEQ ID NO: 620105 - RNA, 15 nt, Homo sapiens
ggacccagggccuga

SEQ ID NO: 620106 - RNA, 15 nt, Homo sapiens
ggacccaucuuccac

SEQ ID NO: 620107 - RNA, 21 nt, Homo sapiens
ggaccccacuccccucacaca

SEQ ID NO: 620108 - RNA, 14 nt, Homo sapiens
ggaccccagggugg

SEQ ID NO: 620109 - RNA, 19 nt, Homo sapiens
ggaccccugagcuugcaga

SEQ ID NO: 620110 - RNA, 17 nt, Homo sapiens
ggaccccuguccaggau

SEQ ID NO: 620111 - RNA, 14 nt, Homo sapiens
ggacccuguccaau

SEQ ID NO: 620112 - RNA, 12 nt, Homo sapiens
ggaccuaccucc

SEQ ID NO: 620113 - RNA, 13 nt, Homo sapiens
ggaccucaggggc

SEQ ID NO: 620114 - RNA, 12 nt, Homo sapiens
ggaccucaggug

SEQ ID NO: 620115 - RNA, 15 nt, Homo sapiens
ggaccucgugccacc

SEQ ID NO: 620116 - RNA, 13 nt, Homo sapiens
ggaccucugcucu

SEQ ID NO: 620117 - RNA, 20 nt, Homo sapiens
ggaccugagccugguccugg

SEQ ID NO: 620118 - RNA, 15 nt, Homo sapiens
ggaccugcucaucau

SEQ ID NO: 620119 - RNA, 18 nt, Homo sapiens
ggaccuggcgugcucaga

SEQ ID NO: 620120 - RNA, 23 nt, Homo sapiens
ggaccuggggcacaguccaggaa

SEQ ID NO: 620121 - RNA, 22 nt, Homo sapiens
ggacgauagcuuggagggaugg

SEQ ID NO: 620122 - RNA, 23 nt, Homo sapiens
ggacgcacgcucgcugccaucac

SEQ ID NO: 620123 - RNA, 20 nt, Homo sapiens
ggacggcccugccugccucu

SEQ ID NO: 620124 - RNA, 21 nt, Homo sapiens
ggacggcucugaccugagcua

SEQ ID NO: 620125 - RNA, 12 nt, Homo sapiens
ggacgggaugag

SEQ ID NO: 620126 - RNA, 17 nt, Homo sapiens
ggacgguuuugcuuuau

SEQ ID NO: 620127 - RNA, 19 nt, Homo sapiens
ggacuagagggaccucucc

SEQ ID NO: 620128 - RNA, 23 nt, Homo sapiens
ggacuauggagugcaccaaagag

SEQ ID NO: 620129 - RNA, 23 nt, Homo sapiens
ggacucagguugucugaagucac

SEQ ID NO: 620130 - RNA, 13 nt, Homo sapiens
ggacuccaucucu

SEQ ID NO: 620131 - RNA, 22 nt, Homo sapiens
ggacuccauuucuuucuuccau

SEQ ID NO: 620132 - RNA, 16 nt, Homo sapiens
ggacucucagggauuc

SEQ ID NO: 620133 - RNA, 16 nt, Homo sapiens
ggacucugcaucccag

SEQ ID NO: 620134 - RNA, 21 nt, Homo sapiens
ggacucugcaucccagcaccu

SEQ ID NO: 620135 - RNA, 14 nt, Homo sapiens
ggacucuugcucuu

SEQ ID NO: 620136 - RNA, 15 nt, Homo sapiens
ggacugaaaagggaa

SEQ ID NO: 620137 - RNA, 14 nt, Homo sapiens
ggacugauaaucuc

SEQ ID NO: 620138 - RNA, 13 nt, Homo sapiens
ggacugcagcucc

SEQ ID NO: 620139 - RNA, 22 nt, Homo sapiens
ggacugcagcucccgaagccug

SEQ ID NO: 620140 - RNA, 20 nt, Homo sapiens
ggacugcauggggaggcagc

SEQ ID NO: 620141 - RNA, 20 nt, Homo sapiens
ggacugccuugucucuagua

SEQ ID NO: 620142 - RNA, 20 nt, Homo sapiens
ggacuggaaggggaagggac

SEQ ID NO: 620143 - RNA, 21 nt, Homo sapiens
ggacuggacgugcucagacau

SEQ ID NO: 620144 - RNA, 10 nt, Homo sapiens
ggacugggag

SEQ ID NO: 620145 - RNA, 20 nt, Homo sapiens
ggacuggggagcacaggugu

SEQ ID NO: 620146 - RNA, 22 nt, Homo sapiens
ggacuggugucauaaacuuucu

SEQ ID NO: 620147 - RNA, 18 nt, Homo sapiens
ggacuggugugcucucuu

SEQ ID NO: 620148 - RNA, 15 nt, Homo sapiens
ggacuguaagggauu

SEQ ID NO: 620149 - RNA, 22 nt, Homo sapiens
ggacugugcucacuaccugggu

SEQ ID NO: 620150 - RNA, 13 nt, Homo sapiens
ggacuuccuugcu

SEQ ID NO: 620151 - RNA, 16 nt, Homo sapiens
ggacuuggagagcaaa

SEQ ID NO: 620152 - RNA, 14 nt, Homo sapiens
ggacuuugagcaca

SEQ ID NO: 620153 - RNA, 17 nt, Homo sapiens
ggacuuuugaaaagcuu

SEQ ID NO: 620154 - RNA, 16 nt, Homo sapiens
ggagaaaauaacaaga

SEQ ID NO: 620155 - RNA, 21 nt, Homo sapiens
ggagaaacaaaauccucagga

SEQ ID NO: 620156 - RNA, 17 nt, Homo sapiens
ggagaaacgggugagcu

SEQ ID NO: 620157 - RNA, 22 nt, Homo sapiens
ggagaaauaugguacucauuaa

SEQ ID NO: 620158 - RNA, 23 nt, Homo sapiens
ggagaaccucaggcuuccuuggc

SEQ ID NO: 620159 - RNA, 22 nt, Homo sapiens
ggagaagaggcagauucaauuu

SEQ ID NO: 620160 - RNA, 23 nt, Homo sapiens
ggagaagccccuacccugugagc

SEQ ID NO: 620161 - RNA, 17 nt, Homo sapiens
ggagaaguagcuaguag

SEQ ID NO: 620162 - RNA, 22 nt, Homo sapiens
ggagaauaaaauuccuaucuca

SEQ ID NO: 620163 - RNA, 16 nt, Homo sapiens
ggagaaucgcuuaaac

SEQ ID NO: 620164 - RNA, 24 nt, Homo sapiens
ggagaauuauauagguugugcaaa

SEQ ID NO: 620165 - RNA, 19 nt, Homo sapiens
ggagacacuggccccucaa

SEQ ID NO: 620166 - RNA, 20 nt, Homo sapiens
ggagaccccuuguugcacug

SEQ ID NO: 620167 - RNA, 12 nt, Homo sapiens
ggagacuguccc

SEQ ID NO: 620168 - RNA, 16 nt, Homo sapiens
ggagacuuuacaugga

SEQ ID NO: 620169 - RNA, 17 nt, Homo sapiens
ggagagaaacacugcug

SEQ ID NO: 620170 - RNA, 15 nt, Homo sapiens
ggagagaagugagca

SEQ ID NO: 620171 - RNA, 23 nt, Homo sapiens
ggagagccacugggccccugucc

SEQ ID NO: 620172 - RNA, 15 nt, Homo sapiens
ggagagcccagccau

SEQ ID NO: 620173 - RNA, 22 nt, Homo sapiens
ggagaggcggccucgugccaug

SEQ ID NO: 620174 - RNA, 13 nt, Homo sapiens
ggagaggggcaca

SEQ ID NO: 620175 - RNA, 14 nt, Homo sapiens
ggagaggggggcca

SEQ ID NO: 620176 - RNA, 19 nt, Homo sapiens
ggagaguugaccguuuuca

SEQ ID NO: 620177 - RNA, 21 nt, Homo sapiens
ggagauaacagccucuugccc

SEQ ID NO: 620178 - RNA, 13 nt, Homo sapiens
ggagauacugaac

SEQ ID NO: 620179 - RNA, 19 nt, Homo sapiens
ggagaucagagcaacagcu

SEQ ID NO: 620180 - RNA, 17 nt, Homo sapiens
ggagauuuacaacuggg

SEQ ID NO: 620181 - RNA, 19 nt, Homo sapiens
ggagcaaaaggcagcucac

SEQ ID NO: 620182 - RNA, 16 nt, Homo sapiens
ggagcacagucaguga

SEQ ID NO: 620183 - RNA, 14 nt, Homo sapiens
ggagcaccaaagga

SEQ ID NO: 620184 - RNA, 13 nt, Homo sapiens
ggagcacuggguu

SEQ ID NO: 620185 - RNA, 16 nt, Homo sapiens
ggagcacuuguccacg

SEQ ID NO: 620186 - RNA, 19 nt, Homo sapiens
ggagcagaguguucccuga

SEQ ID NO: 620187 - RNA, 15 nt, Homo sapiens
ggagcagcagccagc

SEQ ID NO: 620188 - RNA, 16 nt, Homo sapiens
ggagcagcaucucuga

SEQ ID NO: 620189 - RNA, 21 nt, Homo sapiens
ggagcagcuauuuuaagccau

SEQ ID NO: 620190 - RNA, 21 nt, Homo sapiens
ggagcaggaccuacuaggaga

SEQ ID NO: 620191 - RNA, 23 nt, Homo sapiens
ggagcagugcuuuucacuacuuu

SEQ ID NO: 620192 - RNA, 15 nt, Homo sapiens
ggagcaucugacuca

SEQ ID NO: 620193 - RNA, 16 nt, Homo sapiens
ggagccaaguccagau

SEQ ID NO: 620194 - RNA, 17 nt, Homo sapiens
ggagccagggccucucc

SEQ ID NO: 620195 - RNA, 13 nt, Homo sapiens
ggagcccagugaa

SEQ ID NO: 620196 - RNA, 22 nt, Homo sapiens
ggagccccaggggacaagggau

SEQ ID NO: 620197 - RNA, 19 nt, Homo sapiens
ggagccccauccuguguua

SEQ ID NO: 620198 - RNA, 19 nt, Homo sapiens
ggagccuaggaccacucag

SEQ ID NO: 620199 - RNA, 15 nt, Homo sapiens
ggagcuaacacuggc

SEQ ID NO: 620200 - RNA, 12 nt, Homo sapiens
ggagcucagagc

SEQ ID NO: 620201 - RNA, 12 nt, Homo sapiens
ggagcucaguua

SEQ ID NO: 620202 - RNA, 12 nt, Homo sapiens
ggagcucuccau

SEQ ID NO: 620203 - RNA, 19 nt, Homo sapiens
ggagcucuggggacagcuu

SEQ ID NO: 620204 - RNA, 13 nt, Homo sapiens
ggagcugcaaauu

SEQ ID NO: 620205 - RNA, 12 nt, Homo sapiens
ggagcugccaca

SEQ ID NO: 620206 - RNA, 22 nt, Homo sapiens
ggccugggugugugugagcuca

SEQ ID NO: 620207 - RNA, 24 nt, Homo sapiens
ggccuguccacccugccaagacuc

SEQ ID NO: 620208 - RNA, 20 nt, Homo sapiens
ggccuguccaccugugcugc

SEQ ID NO: 620209 - RNA, 21 nt, Homo sapiens
ggccuuaucuccaagaccaga

SEQ ID NO: 620210 - RNA, 18 nt, Homo sapiens
ggccuucaggacucuaga

SEQ ID NO: 620211 - RNA, 18 nt, Homo sapiens
ggccuucugggaacucuc

SEQ ID NO: 620212 - RNA, 16 nt, Homo sapiens
ggccuugcuaccucaa

SEQ ID NO: 620213 - RNA, 20 nt, Homo sapiens
ggccuugguggagcagccag

SEQ ID NO: 620214 - RNA, 13 nt, Homo sapiens
ggccuuguaagac

SEQ ID NO: 620215 - RNA, 15 nt, Homo sapiens
ggccuugugugucag

SEQ ID NO: 620216 - RNA, 12 nt, Homo sapiens
ggccuuuacuag

SEQ ID NO: 620217 - RNA, 14 nt, Homo sapiens
ggccuuuuuugcca

SEQ ID NO: 620218 - RNA, 20 nt, Homo sapiens
ggcgacagagcgagacuccg

SEQ ID NO: 620219 - RNA, 14 nt, Homo sapiens
ggcgaccaccaaag

SEQ ID NO: 620220 - RNA, 21 nt, Homo sapiens
ggcgagagguggagugucaca

SEQ ID NO: 620221 - RNA, 16 nt, Homo sapiens
ggcgagccugacucug

SEQ ID NO: 620222 - RNA, 19 nt, Homo sapiens
ggcgagucacccuccucac

SEQ ID NO: 620223 - RNA, 14 nt, Homo sapiens
ggcgcaguggcuca

SEQ ID NO: 620224 - RNA, 20 nt, Homo sapiens
ggcgccccugccaccucccu

SEQ ID NO: 620225 - RNA, 22 nt, Homo sapiens
ggcgccccugccaccucccuga

SEQ ID NO: 620226 - RNA, 15 nt, Homo sapiens
ggcgcccgggaucca

SEQ ID NO: 620227 - RNA, 20 nt, Homo sapiens
ggcgcccgggauccagcuca

SEQ ID NO: 620228 - RNA, 23 nt, Homo sapiens
ggcgcguuugugcauaucugccu

SEQ ID NO: 620229 - RNA, 17 nt, Homo sapiens
ggcggagcuugcaguga

SEQ ID NO: 620230 - RNA, 20 nt, Homo sapiens
ggcggagguugcaaugagcc

SEQ ID NO: 620231 - RNA, 15 nt, Homo sapiens
ggcggcccacaccca

SEQ ID NO: 620232 - RNA, 18 nt, Homo sapiens
ggcggccugcaguggugu

SEQ ID NO: 620233 - RNA, 17 nt, Homo sapiens
ggcggcuccagcagggu

SEQ ID NO: 620234 - RNA, 20 nt, Homo sapiens
ggcggcuccauccguggcug

SEQ ID NO: 620235 - RNA, 18 nt, Homo sapiens
ggcgggguuagagccaag

SEQ ID NO: 620236 - RNA, 22 nt, Homo sapiens
ggcggugggcacccacccuggg

SEQ ID NO: 620237 - RNA, 14 nt, Homo sapiens
ggcggugugugugc

SEQ ID NO: 620238 - RNA, 19 nt, Homo sapiens
ggcggugugugugccaugu

SEQ ID NO: 620239 - RNA, 15 nt, Homo sapiens
ggcguccauguuuau

SEQ ID NO: 620240 - RNA, 15 nt, Homo sapiens
ggcgucugucuucaa

SEQ ID NO: 620241 - RNA, 13 nt, Homo sapiens
ggcgucuugccca

SEQ ID NO: 620242 - RNA, 17 nt, Homo sapiens
ggcguggcccguggccu

SEQ ID NO: 620243 - RNA, 22 nt, Homo sapiens
ggcgugguagcgggcgccugua

SEQ ID NO: 620244 - RNA, 22 nt, Homo sapiens
ggcuaacagucuagugcaaaag

SEQ ID NO: 620245 - RNA, 13 nt, Homo sapiens
ggcuaacauccca

SEQ ID NO: 620246 - RNA, 20 nt, Homo sapiens
ggcuaagucaagaucaacau

SEQ ID NO: 620247 - RNA, 22 nt, Homo sapiens
ggcuacaauuuucucccaggaa

SEQ ID NO: 620248 - RNA, 23 nt, Homo sapiens
ggcuaccucaccugggcagggau

SEQ ID NO: 620249 - RNA, 19 nt, Homo sapiens
ggcuacuauagguccagaa

SEQ ID NO: 620250 - RNA, 15 nt, Homo sapiens
ggcuacucuggaaug

SEQ ID NO: 620251 - RNA, 12 nt, Homo sapiens
ggcuacugccac

SEQ ID NO: 620252 - RNA, 20 nt, Homo sapiens
ggcuagagugcaauggugca

SEQ ID NO: 620253 - RNA, 22 nt, Homo sapiens
ggcuagguggguugaaagccaa

SEQ ID NO: 620254 - RNA, 15 nt, Homo sapiens
ggcuaguggggugaa

SEQ ID NO: 620255 - RNA, 14 nt, Homo sapiens
ggcuauagcacaca

SEQ ID NO: 620256 - RNA, 17 nt, Homo sapiens
ggcuauggaggguccuc

SEQ ID NO: 620257 - RNA, 20 nt, Homo sapiens
ggcuauggaggguccuccuc

SEQ ID NO: 620258 - RNA, 20 nt, Homo sapiens
ggcucaagcaguucucccac

SEQ ID NO: 620259 - RNA, 21 nt, Homo sapiens
ggcucagagggggacugcugc

SEQ ID NO: 620260 - RNA, 19 nt, Homo sapiens
ggcucagauuguaauaugu

SEQ ID NO: 620261 - RNA, 20 nt, Homo sapiens
ggcucaggggagcaagcuua

SEQ ID NO: 620262 - RNA, 21 nt, Homo sapiens
ggcucaggggagcaagcuuac

SEQ ID NO: 620263 - RNA, 14 nt, Homo sapiens
ggcucagugccacc

SEQ ID NO: 620264 - RNA, 16 nt, Homo sapiens
ggcuccaaaucugccu

SEQ ID NO: 620265 - RNA, 16 nt, Homo sapiens
ggcuccaacacugcug

SEQ ID NO: 620266 - RNA, 20 nt, Homo sapiens
ggcuccagaugcagggcagu

SEQ ID NO: 620267 - RNA, 16 nt, Homo sapiens
ggcuccagccaucuca

SEQ ID NO: 620268 - RNA, 22 nt, Homo sapiens
ggcuccauccguggcugcaggg

SEQ ID NO: 620269 - RNA, 13 nt, Homo sapiens
ggcucccaugacc

SEQ ID NO: 620270 - RNA, 14 nt, Homo sapiens
ggcucccaugacca

SEQ ID NO: 620271 - RNA, 21 nt, Homo sapiens
ggcucccuccuggagcauccc

SEQ ID NO: 620272 - RNA, 19 nt, Homo sapiens
ggcuccggaggacucacca

SEQ ID NO: 620273 - RNA, 18 nt, Homo sapiens
ggcuccuaccagcaaaca

SEQ ID NO: 620274 - RNA, 23 nt, Homo sapiens
ggcuccucgcccccaccagugua

SEQ ID NO: 620275 - RNA, 16 nt, Homo sapiens
ggcuccuggggcaaug

SEQ ID NO: 620276 - RNA, 17 nt, Homo sapiens
ggcuccuucccaucgcu

SEQ ID NO: 620277 - RNA, 21 nt, Homo sapiens
ggcucgagagggcugguccuu

SEQ ID NO: 620278 - RNA, 22 nt, Homo sapiens
ggcucgcccauacccgugacag

SEQ ID NO: 620279 - RNA, 15 nt, Homo sapiens
ggcucuaauguacaa

SEQ ID NO: 620280 - RNA, 20 nt, Homo sapiens
ggcucucagcucagcgccag

SEQ ID NO: 620281 - RNA, 17 nt, Homo sapiens
ggcucucauggggucca

SEQ ID NO: 620282 - RNA, 20 nt, Homo sapiens
ggcucuccucgcagguguuc

SEQ ID NO: 620283 - RNA, 11 nt, Homo sapiens
ggcucucucac

SEQ ID NO: 620284 - RNA, 21 nt, Homo sapiens
ggcucugcaaugggcacuggg

SEQ ID NO: 620285 - RNA, 19 nt, Homo sapiens
ggcucugcuucuccaagga

SEQ ID NO: 620286 - RNA, 19 nt, Homo sapiens
ggcucugucuacccagugc

SEQ ID NO: 620287 - RNA, 17 nt, Homo sapiens
ggcucuguuugugggac

SEQ ID NO: 620288 - RNA, 20 nt, Homo sapiens
ggcucuuaugugugccuuug

SEQ ID NO: 620289 - RNA, 14 nt, Homo sapiens
ggcucuuuccuugc

SEQ ID NO: 620290 - RNA, 15 nt, Homo sapiens
ggcugaacuuggaga

SEQ ID NO: 620291 - RNA, 19 nt, Homo sapiens
ggcugaaggaaaccagugc

SEQ ID NO: 620292 - RNA, 19 nt, Homo sapiens
ggcugacagacucacuggg

SEQ ID NO: 620293 - RNA, 18 nt, Homo sapiens
ggcugacaugaagcuguu

SEQ ID NO: 620294 - RNA, 21 nt, Homo sapiens
ggcugacuucucugaaucaga

SEQ ID NO: 620295 - RNA, 19 nt, Homo sapiens
ggcugagccauugagugcu

SEQ ID NO: 620296 - RNA, 14 nt, Homo sapiens
ggcugagcucuuau

SEQ ID NO: 620297 - RNA, 13 nt, Homo sapiens
ggcugagcugaac

SEQ ID NO: 620298 - RNA, 14 nt, Homo sapiens
ggcugagugacaca

SEQ ID NO: 620299 - RNA, 16 nt, Homo sapiens
ggcugauagcucugcc

SEQ ID NO: 620300 - RNA, 21 nt, Homo sapiens
ggcugauuauuaaaguccuuu

SEQ ID NO: 620301 - RNA, 14 nt, Homo sapiens
ggcugcacaggcug

SEQ ID NO: 620302 - RNA, 16 nt, Homo sapiens
ggcugcacauugccug

SEQ ID NO: 620303 - RNA, 16 nt, Homo sapiens
ggcugcaggggucuca

SEQ ID NO: 620304 - RNA, 11 nt, Homo sapiens
ggcugcaguga

SEQ ID NO: 620305 - RNA, 13 nt, Homo sapiens
ggcugcaugaccu

SEQ ID NO: 620306 - RNA, 11 nt, Homo sapiens
ggcugccauag

SEQ ID NO: 620307 - RNA, 19 nt, Homo sapiens
ggcugccccaaccugcuga

SEQ ID NO: 620308 - RNA, 18 nt, Homo sapiens
ggcugccccucucaccaa

SEQ ID NO: 620309 - RNA, 17 nt, Homo sapiens
ggcugccugacacugag

SEQ ID NO: 620310 - RNA, 21 nt, Homo sapiens
ggcugccugccccugcugcuu

SEQ ID NO: 620311 - RNA, 17 nt, Homo sapiens
ggcugccugcuguguua

SEQ ID NO: 620312 - RNA, 14 nt, Homo sapiens
ggcugccugugugc

SEQ ID NO: 620313 - RNA, 16 nt, Homo sapiens
ggcugcgcacuguguc

SEQ ID NO: 620314 - RNA, 18 nt, Homo sapiens
ggcugcuccccaacaccu

SEQ ID NO: 620315 - RNA, 14 nt, Homo sapiens
ggcugcugcaguga

SEQ ID NO: 620316 - RNA, 15 nt, Homo sapiens
ggcugcuggggcaug

SEQ ID NO: 620317 - RNA, 13 nt, Homo sapiens
ggcugcugugaac

SEQ ID NO: 620318 - RNA, 16 nt, Homo sapiens
ggcugcuuuguucaau

SEQ ID NO: 620319 - RNA, 16 nt, Homo sapiens
ggcuggaaggggucca

SEQ ID NO: 620320 - RNA, 15 nt, Homo sapiens
ggcuggagacuggac

SEQ ID NO: 620321 - RNA, 19 nt, Homo sapiens
ggcuggaguacaauggcgu

SEQ ID NO: 620322 - RNA, 20 nt, Homo sapiens
ggcuggagugcagugaugca

SEQ ID NO: 620323 - RNA, 20 nt, Homo sapiens
ggcuggagugcaguggcaca

SEQ ID NO: 620324 - RNA, 20 nt, Homo sapiens
ggcuggagugcaguggcgca

SEQ ID NO: 620325 - RNA, 19 nt, Homo sapiens
ggcuggagugcaguggcgu

SEQ ID NO: 620326 - RNA, 20 nt, Homo sapiens
ggcuggagugcaguggugca

SEQ ID NO: 620327 - RNA, 23 nt, Homo sapiens
gguaccucucaacauuaccaaaa

SEQ ID NO: 620328 - RNA, 20 nt, Homo sapiens
gguaccuucaggcagccagu

SEQ ID NO: 620329 - RNA, 19 nt, Homo sapiens
gguaccuuucuagccuuag

SEQ ID NO: 620330 - RNA, 16 nt, Homo sapiens
gguacuacaaccaauu

SEQ ID NO: 620331 - RNA, 14 nt, Homo sapiens
gguacuuaaagcuu

SEQ ID NO: 620332 - RNA, 20 nt, Homo sapiens
gguacuucaggggcacuuca

SEQ ID NO: 620333 - RNA, 19 nt, Homo sapiens
gguacuugagggaugcccg

SEQ ID NO: 620334 - RNA, 13 nt, Homo sapiens
gguagacugaggg

SEQ ID NO: 620335 - RNA, 14 nt, Homo sapiens
gguagacugaggga

SEQ ID NO: 620336 - RNA, 12 nt, Homo sapiens
gguagcauucuu

SEQ ID NO: 620337 - RNA, 11 nt, Homo sapiens
gguagccagca

SEQ ID NO: 620338 - RNA, 20 nt, Homo sapiens
gguagccagcacacagggca

SEQ ID NO: 620339 - RNA, 13 nt, Homo sapiens
gguagcugagggg

SEQ ID NO: 620340 - RNA, 23 nt, Homo sapiens
gguaggcucacuucucuuucccu

SEQ ID NO: 620341 - RNA, 20 nt, Homo sapiens
gguagggaauaaaauccuaa

SEQ ID NO: 620342 - RNA, 15 nt, Homo sapiens
gguagguagugauua

SEQ ID NO: 620343 - RNA, 20 nt, Homo sapiens
gguaguacuccugcaaaauu

SEQ ID NO: 620344 - RNA, 13 nt, Homo sapiens
gguaguacuggga

SEQ ID NO: 620345 - RNA, 15 nt, Homo sapiens
gguagucagauuuca

SEQ ID NO: 620346 - RNA, 17 nt, Homo sapiens
gguaguccccuguugau

SEQ ID NO: 620347 - RNA, 16 nt, Homo sapiens
gguagugaaacagcuu

SEQ ID NO: 620348 - RNA, 18 nt, Homo sapiens
gguaguuagccaucuaau

SEQ ID NO: 620349 - RNA, 22 nt, Homo sapiens
gguauaugcacaaaacuacuuu

SEQ ID NO: 620350 - RNA, 16 nt, Homo sapiens
gguaugauaagcuuua

SEQ ID NO: 620351 - RNA, 22 nt, Homo sapiens
gguaugucauucgcuacuauga

SEQ ID NO: 620352 - RNA, 19 nt, Homo sapiens
gguauuauucuguuuugca

SEQ ID NO: 620353 - RNA, 21 nt, Homo sapiens
gguauuuguggaaacugucau

SEQ ID NO: 620354 - RNA, 15 nt, Homo sapiens
ggucaaaggcucaaa

SEQ ID NO: 620355 - RNA, 18 nt, Homo sapiens
ggucacaguaccuugaau

SEQ ID NO: 620356 - RNA, 20 nt, Homo sapiens
ggucacaguccuauguacag

SEQ ID NO: 620357 - RNA, 11 nt, Homo sapiens
ggucacaguga

SEQ ID NO: 620358 - RNA, 15 nt, Homo sapiens
ggucacauucaggaa

SEQ ID NO: 620359 - RNA, 16 nt, Homo sapiens
ggucacccaaccugac

SEQ ID NO: 620360 - RNA, 17 nt, Homo sapiens
ggucacccucuccagca

SEQ ID NO: 620361 - RNA, 14 nt, Homo sapiens
ggucacccugugac

SEQ ID NO: 620362 - RNA, 18 nt, Homo sapiens
ggucacccuucaacgcuc

SEQ ID NO: 620363 - RNA, 19 nt, Homo sapiens
ggucaccgcggacgugcug

SEQ ID NO: 620364 - RNA, 12 nt, Homo sapiens
ggucagcauuug

SEQ ID NO: 620365 - RNA, 23 nt, Homo sapiens
ggucagcgacuggaugcucgcca

SEQ ID NO: 620366 - RNA, 22 nt, Homo sapiens
ggucaggaacaguggcugggug

SEQ ID NO: 620367 - RNA, 19 nt, Homo sapiens
ggucaggaugcacauuucu

SEQ ID NO: 620368 - RNA, 14 nt, Homo sapiens
ggucagguccccau

SEQ ID NO: 620369 - RNA, 18 nt, Homo sapiens
ggucaucaaacauuugcc

SEQ ID NO: 620370 - RNA, 17 nt, Homo sapiens
ggucauccaaacucaaa

SEQ ID NO: 620371 - RNA, 15 nt, Homo sapiens
ggucaugcacugagg

SEQ ID NO: 620372 - RNA, 19 nt, Homo sapiens
ggucaugugggucuuccag

SEQ ID NO: 620373 - RNA, 23 nt, Homo sapiens
ggucauuaaauagauuuuugaag

SEQ ID NO: 620374 - RNA, 17 nt, Homo sapiens
ggucauuauuucagugu

SEQ ID NO: 620375 - RNA, 13 nt, Homo sapiens
ggucauugugaau

SEQ ID NO: 620376 - RNA, 16 nt, Homo sapiens
gguccagacccacucc

SEQ ID NO: 620377 - RNA, 16 nt, Homo sapiens
gguccagcggggguca

SEQ ID NO: 620378 - RNA, 19 nt, Homo sapiens
gguccaggguugcuaggaa

SEQ ID NO: 620379 - RNA, 12 nt, Homo sapiens
gguccauaacag

SEQ ID NO: 620380 - RNA, 15 nt, Homo sapiens
gguccauucucugag

SEQ ID NO: 620381 - RNA, 17 nt, Homo sapiens
ggucccaccuccauuug

SEQ ID NO: 620382 - RNA, 22 nt, Homo sapiens
ggucccagccugguuugcaaag

SEQ ID NO: 620383 - RNA, 18 nt, Homo sapiens
ggucccaggcuucccaaa

SEQ ID NO: 620384 - RNA, 23 nt, Homo sapiens
gguccccccacagcuccaggaca

SEQ ID NO: 620385 - RNA, 16 nt, Homo sapiens
ggucccccgacugccu

SEQ ID NO: 620386 - RNA, 14 nt, Homo sapiens
ggucccugcucccc

SEQ ID NO: 620387 - RNA, 23 nt, Homo sapiens
ggucccuucccgacccagccagc

SEQ ID NO: 620388 - RNA, 17 nt, Homo sapiens
ggucccuuggucaggag

SEQ ID NO: 620389 - RNA, 17 nt, Homo sapiens
gguccuaaagaugcuga

SEQ ID NO: 620390 - RNA, 21 nt, Homo sapiens
gguccucuacuuaaugagaua

SEQ ID NO: 620391 - RNA, 18 nt, Homo sapiens
gguccucuagcccacucc

SEQ ID NO: 620392 - RNA, 15 nt, Homo sapiens
gguccucuggggccu

SEQ ID NO: 620393 - RNA, 23 nt, Homo sapiens
gguccugcagccugcaggaccuc

SEQ ID NO: 620394 - RNA, 22 nt, Homo sapiens
gguccuggccuugugucacugg

SEQ ID NO: 620395 - RNA, 13 nt, Homo sapiens
gguccuggugccc

SEQ ID NO: 620396 - RNA, 20 nt, Homo sapiens
gguccuucccucucaugacu

SEQ ID NO: 620397 - RNA, 21 nt, Homo sapiens
gguccuucccucucaugacuu

SEQ ID NO: 620398 - RNA, 16 nt, Homo sapiens
ggucuaagguucagcc

SEQ ID NO: 620399 - RNA, 17 nt, Homo sapiens
ggucuaauuauuuacuc

SEQ ID NO: 620400 - RNA, 21 nt, Homo sapiens
ggucuagucacgcaugcagug

SEQ ID NO: 620401 - RNA, 22 nt, Homo sapiens
ggucucacucugucgcucaggc

SEQ ID NO: 620402 - RNA, 19 nt, Homo sapiens
ggucuccaagggagggugc

SEQ ID NO: 620403 - RNA, 14 nt, Homo sapiens
ggucucccaaacgc

SEQ ID NO: 620404 - RNA, 23 nt, Homo sapiens
ggucuccccuccugcacacaggg

SEQ ID NO: 620405 - RNA, 17 nt, Homo sapiens
ggucucuagugcuguga

SEQ ID NO: 620406 - RNA, 18 nt, Homo sapiens
ggucucucucccuaccuc

SEQ ID NO: 620407 - RNA, 15 nt, Homo sapiens
ggucugaauucugga

SEQ ID NO: 620408 - RNA, 23 nt, Homo sapiens
ggucugaauucuggaaucacaaa

SEQ ID NO: 620409 - RNA, 23 nt, Homo sapiens
ggucugacaccaaaacaugccgc

SEQ ID NO: 620410 - RNA, 22 nt, Homo sapiens
ggucugggcugggcaccugacu

SEQ ID NO: 620411 - RNA, 16 nt, Homo sapiens
ggucuguaacugccca

SEQ ID NO: 620412 - RNA, 23 nt, Homo sapiens
ggucuguuguaggguugccagau

SEQ ID NO: 620413 - RNA, 21 nt, Homo sapiens
ggucuuagcucuuucucuauu

SEQ ID NO: 620414 - RNA, 15 nt, Homo sapiens
ggucuuaucuguuca

SEQ ID NO: 620415 - RNA, 22 nt, Homo sapiens
ggucuuccagcgaggugggaga

SEQ ID NO: 620416 - RNA, 20 nt, Homo sapiens
ggucuuucugaauugcacau

SEQ ID NO: 620417 - RNA, 12 nt, Homo sapiens
ggucuuugcucc

SEQ ID NO: 620418 - RNA, 14 nt, Homo sapiens
ggucuuugcuccag

SEQ ID NO: 620419 - RNA, 17 nt, Homo sapiens
ggucuuuucuccuacuc

SEQ ID NO: 620420 - RNA, 19 nt, Homo sapiens
ggucuuuucuccuacucuu

SEQ ID NO: 620421 - RNA, 20 nt, Homo sapiens
ggugaaaccccaucucuauu

SEQ ID NO: 620422 - RNA, 18 nt, Homo sapiens
ggugaaaccucaucucua

SEQ ID NO: 620423 - RNA, 19 nt, Homo sapiens
ggugaaaccucaucucuac

SEQ ID NO: 620424 - RNA, 22 nt, Homo sapiens
ggugaaagcuacugaaauaagc

SEQ ID NO: 620425 - RNA, 14 nt, Homo sapiens
ggugaaagugcagu

SEQ ID NO: 620426 - RNA, 20 nt, Homo sapiens
ggugaacaaagcagccacga

SEQ ID NO: 620427 - RNA, 15 nt, Homo sapiens
ggugaacacugugac

SEQ ID NO: 620428 - RNA, 20 nt, Homo sapiens
ggugaaccuuaguaccuaaa

SEQ ID NO: 620429 - RNA, 23 nt, Homo sapiens
ggugaaggaugcggcaggugcuc

SEQ ID NO: 620430 - RNA, 15 nt, Homo sapiens
ggugaauuucacaag

SEQ ID NO: 620431 - RNA, 14 nt, Homo sapiens
ggugacagagcaag

SEQ ID NO: 620432 - RNA, 21 nt, Homo sapiens
ggugacagggccgugagcaug

SEQ ID NO: 620433 - RNA, 21 nt, Homo sapiens
ggugacagugccuucucuauu

SEQ ID NO: 620434 - RNA, 21 nt, Homo sapiens
ggugaccaccgauuccagcug

SEQ ID NO: 620435 - RNA, 17 nt, Homo sapiens
ggugagacacugcacag

SEQ ID NO: 620436 - RNA, 19 nt, Homo sapiens
ggugagacacugcacagaa

SEQ ID NO: 620437 - RNA, 16 nt, Homo sapiens
ggugagagaaguacaa

SEQ ID NO: 620438 - RNA, 14 nt, Homo sapiens
ggugagaugcagcu

SEQ ID NO: 620439 - RNA, 15 nt, Homo sapiens
ggugagaugcagcug

SEQ ID NO: 620440 - RNA, 15 nt, Homo sapiens
ggugagugcuuguca

SEQ ID NO: 620441 - RNA, 14 nt, Homo sapiens
ggugaguggaugaa

SEQ ID NO: 620442 - RNA, 14 nt, Homo sapiens
ggugauacccaagu

SEQ ID NO: 620443 - RNA, 18 nt, Homo sapiens
ggugauccacccaguuac

SEQ ID NO: 620444 - RNA, 21 nt, Homo sapiens
ggugaugcucuggcuugcccc

SEQ ID NO: 620445 - RNA, 16 nt, Homo sapiens
ggugcaaagacucuga

SEQ ID NO: 620446 - RNA, 17 nt, Homo sapiens
ggugcaaagacucugag

SEQ ID NO: 620447 - RNA, 18 nt, Homo sapiens
ggugcaaauccuacugaa

SEQ ID NO: 620448 - RNA, 15 nt, Homo sapiens
guggugggcagguga

SEQ ID NO: 620449 - RNA, 19 nt, Homo sapiens
gugguuuaucagcaaaaaa

SEQ ID NO: 620450 - RNA, 15 nt, Homo sapiens
gugguuugagacacu

SEQ ID NO: 620451 - RNA, 22 nt, Homo sapiens
gugguuuuccagaagugaugaa

SEQ ID NO: 620452 - RNA, 16 nt, Homo sapiens
gugguuuuucagcucc

SEQ ID NO: 620453 - RNA, 16 nt, Homo sapiens
gugguuuuugcaaaug

SEQ ID NO: 620454 - RNA, 20 nt, Homo sapiens
guguaaauaauuugcacuga

SEQ ID NO: 620455 - RNA, 19 nt, Homo sapiens
guguaaauauaugucugau

SEQ ID NO: 620456 - RNA, 12 nt, Homo sapiens
guguaacuuuca

SEQ ID NO: 620457 - RNA, 15 nt, Homo sapiens
guguaauuggcccaa

SEQ ID NO: 620458 - RNA, 19 nt, Homo sapiens
guguacaccugcggggcca

SEQ ID NO: 620459 - RNA, 22 nt, Homo sapiens
guguacacggaggucucuguaa

SEQ ID NO: 620460 - RNA, 17 nt, Homo sapiens
guguacagagagauauu

SEQ ID NO: 620461 - RNA, 20 nt, Homo sapiens
guguacagugaaaagucucc

SEQ ID NO: 620462 - RNA, 17 nt, Homo sapiens
guguagagcaagccagu

SEQ ID NO: 620463 - RNA, 22 nt, Homo sapiens
guguauaaaaaccaugcuggua

SEQ ID NO: 620464 - RNA, 16 nt, Homo sapiens
guguaucaugguguuc

SEQ ID NO: 620465 - RNA, 22 nt, Homo sapiens
guguauccaugcaccuaccuua

SEQ ID NO: 620466 - RNA, 21 nt, Homo sapiens
guguaugugcgugugugcaag

SEQ ID NO: 620467 - RNA, 14 nt, Homo sapiens
guguauuaaucucu

SEQ ID NO: 620468 - RNA, 17 nt, Homo sapiens
guguauugaaguccucc

SEQ ID NO: 620469 - RNA, 14 nt, Homo sapiens
gugucaaaagccag

SEQ ID NO: 620470 - RNA, 20 nt, Homo sapiens
gugucaacuaaaugagauua

SEQ ID NO: 620471 - RNA, 19 nt, Homo sapiens
gugucaacugagagucaua

SEQ ID NO: 620472 - RNA, 17 nt, Homo sapiens
gugucacaguuucaggc

SEQ ID NO: 620473 - RNA, 18 nt, Homo sapiens
gugucaccaauuccacca

SEQ ID NO: 620474 - RNA, 14 nt, Homo sapiens
gugucacccugcag

SEQ ID NO: 620475 - RNA, 15 nt, Homo sapiens
gugucaccugugcuu

SEQ ID NO: 620476 - RNA, 13 nt, Homo sapiens
gugucacuggcuu

SEQ ID NO: 620477 - RNA, 14 nt, Homo sapiens
gugucagagcuggg

SEQ ID NO: 620478 - RNA, 22 nt, Homo sapiens
gugucagagcugggaguagcau

SEQ ID NO: 620479 - RNA, 13 nt, Homo sapiens
gugucagggauga

SEQ ID NO: 620480 - RNA, 12 nt, Homo sapiens
gugucaggugac

SEQ ID NO: 620481 - RNA, 20 nt, Homo sapiens
gugucauauauggggggcca

SEQ ID NO: 620482 - RNA, 13 nt, Homo sapiens
gugucaucaggag

SEQ ID NO: 620483 - RNA, 19 nt, Homo sapiens
guguccagcugaguuucuc

SEQ ID NO: 620484 - RNA, 17 nt, Homo sapiens
guguccaggguccucua

SEQ ID NO: 620485 - RNA, 17 nt, Homo sapiens
guguccaugccuuccau

SEQ ID NO: 620486 - RNA, 19 nt, Homo sapiens
guguccaugugugugcaag

SEQ ID NO: 620487 - RNA, 23 nt, Homo sapiens
guguccccccuugaagcaauaac

SEQ ID NO: 620488 - RNA, 20 nt, Homo sapiens
gugucccuggaugugaagcu

SEQ ID NO: 620489 - RNA, 12 nt, Homo sapiens
guguccugacca

SEQ ID NO: 620490 - RNA, 20 nt, Homo sapiens
guguccuggggacuuccuca

SEQ ID NO: 620491 - RNA, 21 nt, Homo sapiens
gugucuacagacaagcauuuu

SEQ ID NO: 620492 - RNA, 19 nt, Homo sapiens
gugucuagagucaugugag

SEQ ID NO: 620493 - RNA, 20 nt, Homo sapiens
gugucucccagaacuauucu

SEQ ID NO: 620494 - RNA, 21 nt, Homo sapiens
gugucugcugacuguuucauu

SEQ ID NO: 620495 - RNA, 18 nt, Homo sapiens
gugucuguaggugucucu

SEQ ID NO: 620496 - RNA, 20 nt, Homo sapiens
gugucuguccuuuaugaucc

SEQ ID NO: 620497 - RNA, 16 nt, Homo sapiens
gugucuguugcuugua

SEQ ID NO: 620498 - RNA, 20 nt, Homo sapiens
gugucuuuuaaacauuauuu

SEQ ID NO: 620499 - RNA, 15 nt, Homo sapiens
gugugaacguguaug

SEQ ID NO: 620500 - RNA, 17 nt, Homo sapiens
gugugaacguguaugua

SEQ ID NO: 620501 - RNA, 16 nt, Homo sapiens
gugugaagaaagccag

SEQ ID NO: 620502 - RNA, 16 nt, Homo sapiens
gugugacaucaguggc

SEQ ID NO: 620503 - RNA, 16 nt, Homo sapiens
gugugaccuccuguga

SEQ ID NO: 620504 - RNA, 17 nt, Homo sapiens
gugugagugugugcaag

SEQ ID NO: 620505 - RNA, 19 nt, Homo sapiens
gugugaugcaaaugcucaa

SEQ ID NO: 620506 - RNA, 23 nt, Homo sapiens
gugugauguuuggauugauaucg

SEQ ID NO: 620507 - RNA, 17 nt, Homo sapiens
gugugcaagugugugca

SEQ ID NO: 620508 - RNA, 18 nt, Homo sapiens
gugugcaagugugugcau

SEQ ID NO: 620509 - RNA, 20 nt, Homo sapiens
gugugcaagugugugcaugu

SEQ ID NO: 620510 - RNA, 18 nt, Homo sapiens
gugugccaagaguucgau

SEQ ID NO: 620511 - RNA, 20 nt, Homo sapiens
gugugccauagaguuuaaca

SEQ ID NO: 620512 - RNA, 20 nt, Homo sapiens
gugugccuccuagagugcag

SEQ ID NO: 620513 - RNA, 14 nt, Homo sapiens
gugugcgugcaugu

SEQ ID NO: 620514 - RNA, 19 nt, Homo sapiens
guguggccuccguccuguc

SEQ ID NO: 620515 - RNA, 13 nt, Homo sapiens
guguggcugugaa

SEQ ID NO: 620516 - RNA, 19 nt, Homo sapiens
gugugggcugugaguguaa

SEQ ID NO: 620517 - RNA, 19 nt, Homo sapiens
guguggggauuuucacuga

SEQ ID NO: 620518 - RNA, 14 nt, Homo sapiens
gugugggggguccu

SEQ ID NO: 620519 - RNA, 22 nt, Homo sapiens
guguggggugaggggagggagu

SEQ ID NO: 620520 - RNA, 21 nt, Homo sapiens
guguguaaauaauuugcacug

SEQ ID NO: 620521 - RNA, 15 nt, Homo sapiens
guguguaugugcauu

SEQ ID NO: 620522 - RNA, 21 nt, Homo sapiens
guguguaugugcgugugugca

SEQ ID NO: 620523 - RNA, 16 nt, Homo sapiens
guguguauuuguguaa

SEQ ID NO: 620524 - RNA, 12 nt, Homo sapiens
gugugucacaag

SEQ ID NO: 620525 - RNA, 15 nt, Homo sapiens
gugugucagggauga

SEQ ID NO: 620526 - RNA, 12 nt, Homo sapiens
guguguccaaaa

SEQ ID NO: 620527 - RNA, 19 nt, Homo sapiens
guguguccaaaacugccuc

SEQ ID NO: 620528 - RNA, 22 nt, Homo sapiens
guguguccaccugggcauaucc

SEQ ID NO: 620529 - RNA, 20 nt, Homo sapiens
guguguccaugugugugcaa

SEQ ID NO: 620530 - RNA, 20 nt, Homo sapiens
gugugugcaaguaugugagu

SEQ ID NO: 620531 - RNA, 16 nt, Homo sapiens
gugugugccaugucac

SEQ ID NO: 620532 - RNA, 13 nt, Homo sapiens
gugugugugauau

SEQ ID NO: 620533 - RNA, 14 nt, Homo sapiens
gugugugugcaagu

SEQ ID NO: 620534 - RNA, 15 nt, Homo sapiens
gugugugugcaagug

SEQ ID NO: 620535 - RNA, 14 nt, Homo sapiens
gugugugugcacac

SEQ ID NO: 620536 - RNA, 13 nt, Homo sapiens
gugugugugcaug

SEQ ID NO: 620537 - RNA, 14 nt, Homo sapiens
guguguugauccca

SEQ ID NO: 620538 - RNA, 19 nt, Homo sapiens
guguuaaggcaacauuccu

SEQ ID NO: 620539 - RNA, 15 nt, Homo sapiens
guguuaguucccaac

SEQ ID NO: 620540 - RNA, 15 nt, Homo sapiens
guguuauaccaacua

SEQ ID NO: 620541 - RNA, 21 nt, Homo sapiens
guguuaucagucauaacuaaa

SEQ ID NO: 620542 - RNA, 18 nt, Homo sapiens
guguucauauauggacau

SEQ ID NO: 620543 - RNA, 18 nt, Homo sapiens
guguucauccccuuccug

SEQ ID NO: 620544 - RNA, 16 nt, Homo sapiens
guguuccuagaaugca

SEQ ID NO: 620545 - RNA, 17 nt, Homo sapiens
guguugacacaccaguu

SEQ ID NO: 620546 - RNA, 14 nt, Homo sapiens
guguugaccacaga

SEQ ID NO: 620547 - RNA, 20 nt, Homo sapiens
guguuggaaaaugugcaaua

SEQ ID NO: 620548 - RNA, 16 nt, Homo sapiens
guguuggcacaugccu

SEQ ID NO: 620549 - RNA, 15 nt, Homo sapiens
guguugggauuacag

SEQ ID NO: 620550 - RNA, 24 nt, Homo sapiens
guguuggggaaaccuucaucugaa

SEQ ID NO: 620551 - RNA, 22 nt, Homo sapiens
guguuguaucaaagugugauau

SEQ ID NO: 620552 - RNA, 16 nt, Homo sapiens
guguuguggacacugc

SEQ ID NO: 620553 - RNA, 14 nt, Homo sapiens
guguuuaacauuca

SEQ ID NO: 620554 - RNA, 20 nt, Homo sapiens
guguuuaacauucacagccc

SEQ ID NO: 620555 - RNA, 14 nt, Homo sapiens
guguuuagaaauca

SEQ ID NO: 620556 - RNA, 15 nt, Homo sapiens
guguuuagaaaucau

SEQ ID NO: 620557 - RNA, 15 nt, Homo sapiens
guguuucccuuccuc

SEQ ID NO: 620558 - RNA, 17 nt, Homo sapiens
guguuucgugggaacaa

SEQ ID NO: 620559 - RNA, 22 nt, Homo sapiens
guguuugugauuguuugcucug

SEQ ID NO: 620560 - RNA, 22 nt, Homo sapiens
guguuuuaaacucuccuaguca

SEQ ID NO: 620561 - RNA, 19 nt, Homo sapiens
guguuuucaauuuuaaaca

SEQ ID NO: 620562 - RNA, 20 nt, Homo sapiens
guguuuucccaaagcacuuu

SEQ ID NO: 620563 - RNA, 18 nt, Homo sapiens
guguuuucucugaacaca

SEQ ID NO: 620564 - RNA, 16 nt, Homo sapiens
guguuuuuaacauguc

SEQ ID NO: 620565 - RNA, 22 nt, Homo sapiens
guguuuuugcuaucacacagug

SEQ ID NO: 620566 - RNA, 14 nt, Homo sapiens
guuaaaaaguucau

SEQ ID NO: 620567 - RNA, 13 nt, Homo sapiens
guuaaaagcaaaa

SEQ ID NO: 620568 - RNA, 23 nt, Homo sapiens
guuaaacacgugucuauaaugga

SEQ ID NO: 620569 - RNA, 15 nt, Homo sapiens
guuaaagaagcugca

SEQ ID NO: 620570 - RNA, 13 nt, Homo sapiens
guuuuacuuuuaa

SEQ ID NO: 620571 - RNA, 15 nt, Homo sapiens
guuuuagaaccagcc

SEQ ID NO: 620572 - RNA, 22 nt, Homo sapiens
guuuuagauaucccuuacucca

SEQ ID NO: 620573 - RNA, 21 nt, Homo sapiens
guuuuagcggucaauuugccu

SEQ ID NO: 620574 - RNA, 22 nt, Homo sapiens
guuuuaucuaacggcuacugaa

SEQ ID NO: 620575 - RNA, 18 nt, Homo sapiens
guuuucaaaagauggcuu

SEQ ID NO: 620576 - RNA, 14 nt, Homo sapiens
guuuucaagucaaa

SEQ ID NO: 620577 - RNA, 12 nt, Homo sapiens
guuuucaaugug

SEQ ID NO: 620578 - RNA, 16 nt, Homo sapiens
guuuucaccauucaaa

SEQ ID NO: 620579 - RNA, 18 nt, Homo sapiens
guuuucacucagcuuaau

SEQ ID NO: 620580 - RNA, 14 nt, Homo sapiens
guuuucacuuguau

SEQ ID NO: 620581 - RNA, 13 nt, Homo sapiens
guuuucauaauac

SEQ ID NO: 620582 - RNA, 20 nt, Homo sapiens
guuuucaucauuucagccaa

SEQ ID NO: 620583 - RNA, 18 nt, Homo sapiens
guuuucauuauguucaug

SEQ ID NO: 620584 - RNA, 18 nt, Homo sapiens
guuuuccaaauaacauca

SEQ ID NO: 620585 - RNA, 23 nt, Homo sapiens
guuuuccaguucaucgauuuucu

SEQ ID NO: 620586 - RNA, 16 nt, Homo sapiens
guuuuccugaaaucaa

SEQ ID NO: 620587 - RNA, 19 nt, Homo sapiens
guuuuccuucucaucugug

SEQ ID NO: 620588 - RNA, 23 nt, Homo sapiens
guuuucggcaggggccuugucuc

SEQ ID NO: 620589 - RNA, 18 nt, Homo sapiens
guuuucucaugaugccuu

SEQ ID NO: 620590 - RNA, 13 nt, Homo sapiens
guuuucugacuaa

SEQ ID NO: 620591 - RNA, 22 nt, Homo sapiens
guuuucuuaggcacugagggau

SEQ ID NO: 620592 - RNA, 16 nt, Homo sapiens
guuuucuugccaauga

SEQ ID NO: 620593 - RNA, 14 nt, Homo sapiens
guuuucuuucucac

SEQ ID NO: 620594 - RNA, 23 nt, Homo sapiens
guuuucuuucucacccaggcaau

SEQ ID NO: 620595 - RNA, 15 nt, Homo sapiens
guuuugaaaugauau

SEQ ID NO: 620596 - RNA, 13 nt, Homo sapiens
guuuugagacaaa

SEQ ID NO: 620597 - RNA, 15 nt, Homo sapiens
guuuugcuuaggcac

SEQ ID NO: 620598 - RNA, 23 nt, Homo sapiens
guuuuggaagcucugaagucaca

SEQ ID NO: 620599 - RNA, 19 nt, Homo sapiens
guuuuggggacucauuuca

SEQ ID NO: 620600 - RNA, 17 nt, Homo sapiens
guuuuguaagaugcugg

SEQ ID NO: 620601 - RNA, 15 nt, Homo sapiens
guuuuguaccaacac

SEQ ID NO: 620602 - RNA, 23 nt, Homo sapiens
guuuuguagagauggggucucac

SEQ ID NO: 620603 - RNA, 16 nt, Homo sapiens
guuuuguaugagcgaa

SEQ ID NO: 620604 - RNA, 19 nt, Homo sapiens
guuuugucagacuuccaaa

SEQ ID NO: 620605 - RNA, 14 nt, Homo sapiens
guuuugugccuuug

SEQ ID NO: 620606 - RNA, 15 nt, Homo sapiens
guuuuguguguauau

SEQ ID NO: 620607 - RNA, 15 nt, Homo sapiens
guuuuguuuccucug

SEQ ID NO: 620608 - RNA, 23 nt, Homo sapiens
guuuuguuuuuuuucagccacua

SEQ ID NO: 620609 - RNA, 17 nt, Homo sapiens
guuuuuaaaaaucuguu

SEQ ID NO: 620610 - RNA, 23 nt, Homo sapiens
guuuuuaaagaaaagcauucaag

SEQ ID NO: 620611 - RNA, 15 nt, Homo sapiens
guuuuuaacauguca

SEQ ID NO: 620612 - RNA, 17 nt, Homo sapiens
guuuuuaauguucacau

SEQ ID NO: 620613 - RNA, 15 nt, Homo sapiens
guuuuuagugcugac

SEQ ID NO: 620614 - RNA, 19 nt, Homo sapiens
guuuuuauaccagcuuaau

SEQ ID NO: 620615 - RNA, 22 nt, Homo sapiens
guuuuuauggcuuuugugcauu

SEQ ID NO: 620616 - RNA, 17 nt, Homo sapiens
guuuuucccucagugaa

SEQ ID NO: 620617 - RNA, 22 nt, Homo sapiens
guuuuucuucaacaucaauguu

SEQ ID NO: 620618 - RNA, 23 nt, Homo sapiens
guuuuuggaauuaugucugcuga

SEQ ID NO: 620619 - RNA, 21 nt, Homo sapiens
guuuuuggcucuuucagagag

SEQ ID NO: 620620 - RNA, 17 nt, Homo sapiens
guuuuuguuuuuuucca

SEQ ID NO: 620621 - RNA, 12 nt, Homo sapiens
guuuuuugccau

SEQ ID NO: 620622 - RNA, 23 nt, Homo sapiens
guuuuuuuagaagacaauuuuca

SEQ ID NO: 620623 - RNA, 12 nt, Homo sapiens
guuuuuuuccaa

SEQ ID NO: 620624 - RNA, 18 nt, Homo sapiens
guuuuuuuuaaucaucaa

SEQ ID NO: 620625 - RNA, 16 nt, Homo sapiens
guuuuuuuugcugcua

SEQ ID NO: 620626 - RNA, 23 nt, Homo sapiens
uaaaaaaaaaaaauggcuucaga

SEQ ID NO: 620627 - RNA, 18 nt, Homo sapiens
uaaaaaaaaaaggaugaa

SEQ ID NO: 620628 - RNA, 18 nt, Homo sapiens
uaaaaaaaaaauuacuuc

SEQ ID NO: 620629 - RNA, 16 nt, Homo sapiens
uaaaaaaaacaauucc

SEQ ID NO: 620630 - RNA, 22 nt, Homo sapiens
uaaaaaaaagaaucaccaaauc

SEQ ID NO: 620631 - RNA, 17 nt, Homo sapiens
uaaaaaaagaacauaaa

SEQ ID NO: 620632 - RNA, 16 nt, Homo sapiens
uaaaaaaauuagugag

SEQ ID NO: 620633 - RNA, 13 nt, Homo sapiens
uaaaaaaauucca

SEQ ID NO: 620634 - RNA, 14 nt, Homo sapiens
uaaaaaacauauau

SEQ ID NO: 620635 - RNA, 16 nt, Homo sapiens
uaaaaaacuucaugua

SEQ ID NO: 620636 - RNA, 16 nt, Homo sapiens
uaaaaaagaucuccaa

SEQ ID NO: 620637 - RNA, 13 nt, Homo sapiens
uaaaaaagcauac

SEQ ID NO: 620638 - RNA, 22 nt, Homo sapiens
uaaaaaagccugguuuuucuca

SEQ ID NO: 620639 - RNA, 13 nt, Homo sapiens
uaaaaaauacugu

SEQ ID NO: 620640 - RNA, 18 nt, Homo sapiens
uaaaaaauagacauguag

SEQ ID NO: 620641 - RNA, 15 nt, Homo sapiens
uaaaaaaucaugcca

SEQ ID NO: 620642 - RNA, 15 nt, Homo sapiens
uaaaaaauggagcuc

SEQ ID NO: 620643 - RNA, 20 nt, Homo sapiens
uaaaaaauuaaacuaaagau

SEQ ID NO: 620644 - RNA, 15 nt, Homo sapiens
uaaaaacaagaugga

SEQ ID NO: 620645 - RNA, 22 nt, Homo sapiens
uaaaaacagaaggaaauugaga

SEQ ID NO: 620646 - RNA, 13 nt, Homo sapiens
uaaaaaccaauga

SEQ ID NO: 620647 - RNA, 13 nt, Homo sapiens
uaaaaacugagug

SEQ ID NO: 620648 - RNA, 13 nt, Homo sapiens
uaaaaacuuuauu

SEQ ID NO: 620649 - RNA, 23 nt, Homo sapiens
uaaaaagaaauuuugccugccau

SEQ ID NO: 620650 - RNA, 16 nt, Homo sapiens
uaaaaagauugccaau

SEQ ID NO: 620651 - RNA, 19 nt, Homo sapiens
uaaaaagcaacaggccauu

SEQ ID NO: 620652 - RNA, 20 nt, Homo sapiens
uaaaaaggcaaucacauaaa

SEQ ID NO: 620653 - RNA, 12 nt, Homo sapiens
uaaaaaguucca

SEQ ID NO: 620654 - RNA, 14 nt, Homo sapiens
uaaaaaguucuuaa

SEQ ID NO: 620655 - RNA, 19 nt, Homo sapiens
uaaaaauaaaaaacauaua

SEQ ID NO: 620656 - RNA, 22 nt, Homo sapiens
uaaaaauaaaaaacauauacaa

SEQ ID NO: 620657 - RNA, 22 nt, Homo sapiens
uaaaaauaaagaaaucagccau

SEQ ID NO: 620658 - RNA, 16 nt, Homo sapiens
uaaaaauaaauucaaa

SEQ ID NO: 620659 - RNA, 13 nt, Homo sapiens
uaaaaauagacac

SEQ ID NO: 620660 - RNA, 16 nt, Homo sapiens
uaaaaauaugcuucua

SEQ ID NO: 620661 - RNA, 13 nt, Homo sapiens
uaaaaaucuccau

SEQ ID NO: 620662 - RNA, 16 nt, Homo sapiens
uaaaaaugaaaauucu

SEQ ID NO: 620663 - RNA, 16 nt, Homo sapiens
uaaaaaugagugcuua

SEQ ID NO: 620664 - RNA, 14 nt, Homo sapiens
uaaaaaugcaacuu

SEQ ID NO: 620665 - RNA, 14 nt, Homo sapiens
uaaaaaugcugcuc

SEQ ID NO: 620666 - RNA, 15 nt, Homo sapiens
uaaaaaugcugcucu

SEQ ID NO: 620667 - RNA, 18 nt, Homo sapiens
uaaaaauggauacuggug

SEQ ID NO: 620668 - RNA, 21 nt, Homo sapiens
uaaaaauggauagcucauuaa

SEQ ID NO: 620669 - RNA, 22 nt, Homo sapiens
uaaaaaugucuugcuguugaca

SEQ ID NO: 620670 - RNA, 16 nt, Homo sapiens
uaaaaauugacaauga

SEQ ID NO: 620671 - RNA, 17 nt, Homo sapiens
uaaaacaaaauuugacu

SEQ ID NO: 620672 - RNA, 11 nt, Homo sapiens
uaaaacacuua

SEQ ID NO: 620673 - RNA, 14 nt, Homo sapiens
uaaaacagaagccu

SEQ ID NO: 620674 - RNA, 16 nt, Homo sapiens
uaaaacagaaucuucu

SEQ ID NO: 620675 - RNA, 17 nt, Homo sapiens
uaaaacagcagaagauu

SEQ ID NO: 620676 - RNA, 15 nt, Homo sapiens
uaaaacaucucauca

SEQ ID NO: 620677 - RNA, 20 nt, Homo sapiens
uaaaacauugaauuguagua

SEQ ID NO: 620678 - RNA, 19 nt, Homo sapiens
uaaaacauuggcauuugaa

SEQ ID NO: 620679 - RNA, 23 nt, Homo sapiens
uaaaacauuuguuucccccacag

SEQ ID NO: 620680 - RNA, 22 nt, Homo sapiens
uaaaacauuuuuuagucuguaa

SEQ ID NO: 620681 - RNA, 22 nt, Homo sapiens
uaaaaccaucaaaaauauucca

SEQ ID NO: 620682 - RNA, 15 nt, Homo sapiens
uaaaacccaaaacag

SEQ ID NO: 620683 - RNA, 18 nt, Homo sapiens
uaaaacccaagugccuua

SEQ ID NO: 620684 - RNA, 15 nt, Homo sapiens
uaaaaccccaucucu

SEQ ID NO: 620685 - RNA, 19 nt, Homo sapiens
uaaaaccccaucucuacua

SEQ ID NO: 620686 - RNA, 12 nt, Homo sapiens
uaaaaccuuuca

SEQ ID NO: 620687 - RNA, 23 nt, Homo sapiens
uaaaacgcaugugcagcuauuua

SEQ ID NO: 620688 - RNA, 22 nt, Homo sapiens
uaaaacggauaccaaguugauu

SEQ ID NO: 620689 - RNA, 17 nt, Homo sapiens
uaaaacggugcugugag

SEQ ID NO: 620690 - RNA, 15 nt, Homo sapiens
uaaaacuaagcacaa

SEQ ID NO: 620691 - RNA, 16 nt, Homo sapiens
uaaaacuaagcacaaa

SEQ ID NO: 620692 - RNA, 20 nt, Homo sapiens
uaaauaaugaauaaacugaa

SEQ ID NO: 620693 - RNA, 19 nt, Homo sapiens
uaaauaauguuaucugugu

SEQ ID NO: 620694 - RNA, 14 nt, Homo sapiens
uaaauaauucuucc

SEQ ID NO: 620695 - RNA, 20 nt, Homo sapiens
uaaauaauuucuacucuguc

SEQ ID NO: 620696 - RNA, 23 nt, Homo sapiens
uaaauacacaacacacacacucu

SEQ ID NO: 620697 - RNA, 20 nt, Homo sapiens
uaaauacagcauacuucaaa

SEQ ID NO: 620698 - RNA, 15 nt, Homo sapiens
uaaauacaugcauau

SEQ ID NO: 620699 - RNA, 13 nt, Homo sapiens
uaaauacccauau

SEQ ID NO: 620700 - RNA, 17 nt, Homo sapiens
uaaauacuacugcucua

SEQ ID NO: 620701 - RNA, 15 nt, Homo sapiens
uaaauagaacuaucu

SEQ ID NO: 620702 - RNA, 13 nt, Homo sapiens
uaaauagaugaca

SEQ ID NO: 620703 - RNA, 12 nt, Homo sapiens
uaaauagugauu

SEQ ID NO: 620704 - RNA, 14 nt, Homo sapiens
uaaauagugcagaa

SEQ ID NO: 620705 - RNA, 16 nt, Homo sapiens
uaaauagugugauguu

SEQ ID NO: 620706 - RNA, 19 nt, Homo sapiens
uaaauauacucaaguuuca

SEQ ID NO: 620707 - RNA, 20 nt, Homo sapiens
uaaauauauauaaaccuaaa

SEQ ID NO: 620708 - RNA, 21 nt, Homo sapiens
uaaauauauauucaccuagca

SEQ ID NO: 620709 - RNA, 15 nt, Homo sapiens
uaaauauauauucua

SEQ ID NO: 620710 - RNA, 20 nt, Homo sapiens
uaaauauauauuucuaauau

SEQ ID NO: 620711 - RNA, 23 nt, Homo sapiens
uaaauaucccagagaacaaucac

SEQ ID NO: 620712 - RNA, 20 nt, Homo sapiens
uaaauauggacugcucagga

SEQ ID NO: 620713 - RNA, 15 nt, Homo sapiens
uaaauauuacaguga

SEQ ID NO: 620714 - RNA, 20 nt, Homo sapiens
uaaauauuauuagauuuauu

SEQ ID NO: 620715 - RNA, 18 nt, Homo sapiens
uaaauauuuauguagaug

SEQ ID NO: 620716 - RNA, 22 nt, Homo sapiens
uaaaucaaaccaggugcaauua

SEQ ID NO: 620717 - RNA, 15 nt, Homo sapiens
uaaaucaucccuuaa

SEQ ID NO: 620718 - RNA, 16 nt, Homo sapiens
uaaaucauuaagacaa

SEQ ID NO: 620719 - RNA, 19 nt, Homo sapiens
uaaaucauucuuacuaaaa

SEQ ID NO: 620720 - RNA, 15 nt, Homo sapiens
uaaaucauuucagua

SEQ ID NO: 620721 - RNA, 16 nt, Homo sapiens
uaaauccaauaucaug

SEQ ID NO: 620722 - RNA, 17 nt, Homo sapiens
uaaauccauccauccaa

SEQ ID NO: 620723 - RNA, 16 nt, Homo sapiens
uaaauccaugcaccua

SEQ ID NO: 620724 - RNA, 12 nt, Homo sapiens
uaaaucuaacaa

SEQ ID NO: 620725 - RNA, 18 nt, Homo sapiens
uaaaucuaauaauuauuc

SEQ ID NO: 620726 - RNA, 20 nt, Homo sapiens
uaaaucugugaugauccuca

SEQ ID NO: 620727 - RNA, 15 nt, Homo sapiens
uaaaucuuucucuca

SEQ ID NO: 620728 - RNA, 16 nt, Homo sapiens
uaaaucuuucucucac

SEQ ID NO: 620729 - RNA, 21 nt, Homo sapiens
uaaaucuuucuuuugauucuu

SEQ ID NO: 620730 - RNA, 15 nt, Homo sapiens
uaaaugaacuaauga

SEQ ID NO: 620731 - RNA, 13 nt, Homo sapiens
uaaaugacaauuu

SEQ ID NO: 620732 - RNA, 14 nt, Homo sapiens
uaaaugacacauuu

SEQ ID NO: 620733 - RNA, 17 nt, Homo sapiens
uaaaugagcaaauauca

SEQ ID NO: 620734 - RNA, 15 nt, Homo sapiens
uaaaugauacaguau

SEQ ID NO: 620735 - RNA, 17 nt, Homo sapiens
uaaaugauuauauucac

SEQ ID NO: 620736 - RNA, 18 nt, Homo sapiens
uaaaugauuauauucaca

SEQ ID NO: 620737 - RNA, 14 nt, Homo sapiens
uaaaugcaauaaga

SEQ ID NO: 620738 - RNA, 14 nt, Homo sapiens
uaaaugcaauauuc

SEQ ID NO: 620739 - RNA, 15 nt, Homo sapiens
uaaaugcacauuuca

SEQ ID NO: 620740 - RNA, 20 nt, Homo sapiens
uaaaugcagacaacaccuuc

SEQ ID NO: 620741 - RNA, 22 nt, Homo sapiens
uaaaugcagacaacaccuuccu

SEQ ID NO: 620742 - RNA, 21 nt, Homo sapiens
uaaaugccacuucaccaagga

SEQ ID NO: 620743 - RNA, 19 nt, Homo sapiens
uaaaugccaggccuggcaa

SEQ ID NO: 620744 - RNA, 12 nt, Homo sapiens
uaaaugcucaua

SEQ ID NO: 620745 - RNA, 18 nt, Homo sapiens
uaaauggcaucagcacuu

SEQ ID NO: 620746 - RNA, 16 nt, Homo sapiens
uaaauggcaugacaua

SEQ ID NO: 620747 - RNA, 19 nt, Homo sapiens
uaaauggcuuuugccacau

SEQ ID NO: 620748 - RNA, 17 nt, Homo sapiens
uaaaugggacuggaguc

SEQ ID NO: 620749 - RNA, 20 nt, Homo sapiens
uaaaugggagggcauuccau

SEQ ID NO: 620750 - RNA, 22 nt, Homo sapiens
uaaaugguaguaaucacaguug

SEQ ID NO: 620751 - RNA, 14 nt, Homo sapiens
uaaauguauacuau

SEQ ID NO: 620752 - RNA, 16 nt, Homo sapiens
uaaauguaucauagaa

SEQ ID NO: 620753 - RNA, 17 nt, Homo sapiens
uaaauguaucauagaaa

SEQ ID NO: 620754 - RNA, 20 nt, Homo sapiens
uaaauguaucuuauucacau

SEQ ID NO: 620755 - RNA, 22 nt, Homo sapiens
uaaauguauuuaauuaaaucuc

SEQ ID NO: 620756 - RNA, 15 nt, Homo sapiens
uaaaugucaguuaca

SEQ ID NO: 620757 - RNA, 12 nt, Homo sapiens
uaaaugugaaug

SEQ ID NO: 620758 - RNA, 11 nt, Homo sapiens
uaaaugugcag

SEQ ID NO: 620759 - RNA, 14 nt, Homo sapiens
uaaaugugcuuaug

SEQ ID NO: 620760 - RNA, 14 nt, Homo sapiens
uaaaugugugguau

SEQ ID NO: 620761 - RNA, 17 nt, Homo sapiens
uaaauguguuagcacug

SEQ ID NO: 620762 - RNA, 19 nt, Homo sapiens
uaaauguguuagcacugau

SEQ ID NO: 620763 - RNA, 18 nt, Homo sapiens
uaaauguucuaacagauc

SEQ ID NO: 620764 - RNA, 17 nt, Homo sapiens
uaaauuaagauccuaaa

SEQ ID NO: 620765 - RNA, 13 nt, Homo sapiens
uaaauuagcuuuu

SEQ ID NO: 620766 - RNA, 16 nt, Homo sapiens
uaaauuauggcauuuu

SEQ ID NO: 620767 - RNA, 22 nt, Homo sapiens
uaaauuauuuauuuauggagga

SEQ ID NO: 620768 - RNA, 13 nt, Homo sapiens
uaaauuccacacu

SEQ ID NO: 620769 - RNA, 15 nt, Homo sapiens
uaaauuccacagauu

SEQ ID NO: 620770 - RNA, 20 nt, Homo sapiens
uaaauuccagaggacucugc

SEQ ID NO: 620771 - RNA, 20 nt, Homo sapiens
uaaauucuauaggaacauau

SEQ ID NO: 620772 - RNA, 13 nt, Homo sapiens
uaaauugaacuaa

SEQ ID NO: 620773 - RNA, 19 nt, Homo sapiens
uaaauugacccuagccaga

SEQ ID NO: 620774 - RNA, 15 nt, Homo sapiens
uaaauugauguugcu

SEQ ID NO: 620775 - RNA, 12 nt, Homo sapiens
uaaauugcacac

SEQ ID NO: 620776 - RNA, 19 nt, Homo sapiens
uaaauugcuaauguugcug

SEQ ID NO: 620777 - RNA, 14 nt, Homo sapiens
uaaauuguguuucc

SEQ ID NO: 620778 - RNA, 20 nt, Homo sapiens
uaaauuguuuuuacugauga

SEQ ID NO: 620779 - RNA, 14 nt, Homo sapiens
uaaauuuaacucug

SEQ ID NO: 620780 - RNA, 14 nt, Homo sapiens
uaaauuugauuucc

SEQ ID NO: 620781 - RNA, 17 nt, Homo sapiens
uaaauuuguaaacaauc

SEQ ID NO: 620782 - RNA, 21 nt, Homo sapiens
uaaauuuuaaguacuuugcug

SEQ ID NO: 620783 - RNA, 19 nt, Homo sapiens
uaaauuuuagugugccuuc

SEQ ID NO: 620784 - RNA, 22 nt, Homo sapiens
uaaauuuuauaugcacaguaau

SEQ ID NO: 620785 - RNA, 15 nt, Homo sapiens
uaaauuuuauuccaa

SEQ ID NO: 620786 - RNA, 21 nt, Homo sapiens
uaaauuuucaugaaugugcug

SEQ ID NO: 620787 - RNA, 21 nt, Homo sapiens
uaaauuuugaaaacugugcaa

SEQ ID NO: 620788 - RNA, 22 nt, Homo sapiens
uaacaaaaauaaaaacucuuau

SEQ ID NO: 620789 - RNA, 19 nt, Homo sapiens
uaacaaacuacauguaauc

SEQ ID NO: 620790 - RNA, 14 nt, Homo sapiens
uaacaaacucugag

SEQ ID NO: 620791 - RNA, 14 nt, Homo sapiens
uaacaaagcacaua

SEQ ID NO: 620792 - RNA, 15 nt, Homo sapiens
uaacaaagcacauaa

SEQ ID NO: 620793 - RNA, 17 nt, Homo sapiens
uaacaaagcacauaacu

SEQ ID NO: 620794 - RNA, 19 nt, Homo sapiens
uaacaacaauaacacuguc

SEQ ID NO: 620795 - RNA, 22 nt, Homo sapiens
uaacaacccacaccgucuuccu

SEQ ID NO: 620796 - RNA, 20 nt, Homo sapiens
uaacaagucgaugaacuauu

SEQ ID NO: 620797 - RNA, 14 nt, Homo sapiens
uaacaaguggguga

SEQ ID NO: 620798 - RNA, 21 nt, Homo sapiens
uaacaauaacuacuguguucc

SEQ ID NO: 620799 - RNA, 16 nt, Homo sapiens
uaacaauccauucaca

SEQ ID NO: 620800 - RNA, 16 nt, Homo sapiens
uaacaaugccuauugu

SEQ ID NO: 620801 - RNA, 17 nt, Homo sapiens
uaacaauuauguuuuca

SEQ ID NO: 620802 - RNA, 13 nt, Homo sapiens
uaacacaacaaua

SEQ ID NO: 620803 - RNA, 14 nt, Homo sapiens
uaacacaagccaca

SEQ ID NO: 620804 - RNA, 19 nt, Homo sapiens
uaacacaaguccugugaau

SEQ ID NO: 620805 - RNA, 19 nt, Homo sapiens
uaacacagagagacagacu

SEQ ID NO: 620806 - RNA, 15 nt, Homo sapiens
uaacacaguguuuca

SEQ ID NO: 620807 - RNA, 23 nt, Homo sapiens
uaacaccagacagacaacacugg

SEQ ID NO: 620808 - RNA, 17 nt, Homo sapiens
uaacacuauacucuaaa

SEQ ID NO: 620809 - RNA, 15 nt, Homo sapiens
uaacacucaugaagc

SEQ ID NO: 620810 - RNA, 16 nt, Homo sapiens
uaacacuuuguauuac

SEQ ID NO: 620811 - RNA, 17 nt, Homo sapiens
uaacacuuuuugugaau

SEQ ID NO: 620812 - RNA, 19 nt, Homo sapiens
uaacagaauuaaaguagau

SEQ ID NO: 620813 - RNA, 15 nt, Homo sapiens
uaacagaugcaaugu

SEQ ID NO: 620814 - RNA, 18 nt, Homo sapiens
uacaauuuccauauaguc

SEQ ID NO: 620815 - RNA, 21 nt, Homo sapiens
uacaauuuccauauagucuau

SEQ ID NO: 620816 - RNA, 16 nt, Homo sapiens
uacaauuugacauaca

SEQ ID NO: 620817 - RNA, 23 nt, Homo sapiens
uacaauuuguuaauuccuaugaa

SEQ ID NO: 620818 - RNA, 18 nt, Homo sapiens
uacaauuuuuuaucaugc

SEQ ID NO: 620819 - RNA, 17 nt, Homo sapiens
uacacaaggaaggcauu

SEQ ID NO: 620820 - RNA, 18 nt, Homo sapiens
uacacaaggggcaaauga

SEQ ID NO: 620821 - RNA, 22 nt, Homo sapiens
uacacacacacacauacaguau

SEQ ID NO: 620822 - RNA, 17 nt, Homo sapiens
uacacacacaccuagcc

SEQ ID NO: 620823 - RNA, 14 nt, Homo sapiens
uacacacaguggau

SEQ ID NO: 620824 - RNA, 21 nt, Homo sapiens
uacacacccugcauaucauaa

SEQ ID NO: 620825 - RNA, 15 nt, Homo sapiens
uacacacgugagcaa

SEQ ID NO: 620826 - RNA, 15 nt, Homo sapiens
uacacacuguuguca

SEQ ID NO: 620827 - RNA, 18 nt, Homo sapiens
uacacagagaaauacaaa

SEQ ID NO: 620828 - RNA, 19 nt, Homo sapiens
uacacaguaagucauuuaa

SEQ ID NO: 620829 - RNA, 17 nt, Homo sapiens
uacacauacauacacau

SEQ ID NO: 620830 - RNA, 17 nt, Homo sapiens
uacacaucuauucucaa

SEQ ID NO: 620831 - RNA, 22 nt, Homo sapiens
uacacaugugcugauguuuaca

SEQ ID NO: 620832 - RNA, 14 nt, Homo sapiens
uacacauugcauuu

SEQ ID NO: 620833 - RNA, 18 nt, Homo sapiens
uacacccuuucuugacaa

SEQ ID NO: 620834 - RNA, 18 nt, Homo sapiens
uacaccuugcuaaccuaa

SEQ ID NO: 620835 - RNA, 14 nt, Homo sapiens
uacacguacuucua

SEQ ID NO: 620836 - RNA, 21 nt, Homo sapiens
uacacgugccuguagucccag

SEQ ID NO: 620837 - RNA, 16 nt, Homo sapiens
uacacguggaggaaug

SEQ ID NO: 620838 - RNA, 18 nt, Homo sapiens
uacacuaaaaaaaugcaa

SEQ ID NO: 620839 - RNA, 19 nt, Homo sapiens
uacacuaaaaaucugagaa

SEQ ID NO: 620840 - RNA, 18 nt, Homo sapiens
uacacuaaaguuacaaac

SEQ ID NO: 620841 - RNA, 18 nt, Homo sapiens
uacacuaggaaacguguu

SEQ ID NO: 620842 - RNA, 18 nt, Homo sapiens
uacacugaaaaugucaca

SEQ ID NO: 620843 - RNA, 16 nt, Homo sapiens
uacacugacuugagac

SEQ ID NO: 620844 - RNA, 15 nt, Homo sapiens
uacacugauacacuu

SEQ ID NO: 620845 - RNA, 13 nt, Homo sapiens
uacacugccaucu

SEQ ID NO: 620846 - RNA, 22 nt, Homo sapiens
uacacuguauguuauagaacuu

SEQ ID NO: 620847 - RNA, 12 nt, Homo sapiens
uacacugugaag

SEQ ID NO: 620848 - RNA, 21 nt, Homo sapiens
uacacuuggagcccgugcagu

SEQ ID NO: 620849 - RNA, 14 nt, Homo sapiens
uacacuugugcacc

SEQ ID NO: 620850 - RNA, 22 nt, Homo sapiens
uacacuuuaugccggaugugcu

SEQ ID NO: 620851 - RNA, 16 nt, Homo sapiens
uacacuuugaaguauu

SEQ ID NO: 620852 - RNA, 18 nt, Homo sapiens
uacagaaaagacucugac

SEQ ID NO: 620853 - RNA, 16 nt, Homo sapiens
uacagaaaagucauau

SEQ ID NO: 620854 - RNA, 20 nt, Homo sapiens
uacagaaauacugcucugaa

SEQ ID NO: 620855 - RNA, 21 nt, Homo sapiens
uacagaaauacugcucugaau

SEQ ID NO: 620856 - RNA, 15 nt, Homo sapiens
uacagaacuucagaa

SEQ ID NO: 620857 - RNA, 21 nt, Homo sapiens
uacagaauugacugcaguuga

SEQ ID NO: 620858 - RNA, 20 nt, Homo sapiens
uacagacaugagccacugca

SEQ ID NO: 620859 - RNA, 16 nt, Homo sapiens
uacagacuccaaaagg

SEQ ID NO: 620860 - RNA, 17 nt, Homo sapiens
uacagacugcagacauu

SEQ ID NO: 620861 - RNA, 20 nt, Homo sapiens
uacagagaaaaugaauuugg

SEQ ID NO: 620862 - RNA, 17 nt, Homo sapiens
uacagagaagugaauaa

SEQ ID NO: 620863 - RNA, 20 nt, Homo sapiens
uacagagauuacuuugcugc

SEQ ID NO: 620864 - RNA, 19 nt, Homo sapiens
uacagaguuuaugauuuaa

SEQ ID NO: 620865 - RNA, 19 nt, Homo sapiens
uacagauugcugcuucugc

SEQ ID NO: 620866 - RNA, 16 nt, Homo sapiens
uacagcagcacuguuc

SEQ ID NO: 620867 - RNA, 17 nt, Homo sapiens
uacagcagugucaucag

SEQ ID NO: 620868 - RNA, 16 nt, Homo sapiens
uacagccuauaguaaa

SEQ ID NO: 620869 - RNA, 16 nt, Homo sapiens
uacagcuaacccucac

SEQ ID NO: 620870 - RNA, 20 nt, Homo sapiens
uacagcuaacccucacaagc

SEQ ID NO: 620871 - RNA, 22 nt, Homo sapiens
uacagcuaaucagcauucucac

SEQ ID NO: 620872 - RNA, 20 nt, Homo sapiens
uacagcuaucgaacuucaca

SEQ ID NO: 620873 - RNA, 13 nt, Homo sapiens
uacagcuaugaag

SEQ ID NO: 620874 - RNA, 19 nt, Homo sapiens
uacagcuguauugucugaa

SEQ ID NO: 620875 - RNA, 20 nt, Homo sapiens
uacagcuuucugugcagaga

SEQ ID NO: 620876 - RNA, 13 nt, Homo sapiens
uacaggacuguaa

SEQ ID NO: 620877 - RNA, 14 nt, Homo sapiens
uacaggcgugagcc

SEQ ID NO: 620878 - RNA, 20 nt, Homo sapiens
uacagggacacuaucacuca

SEQ ID NO: 620879 - RNA, 20 nt, Homo sapiens
uacagggauuacugguguga

SEQ ID NO: 620880 - RNA, 23 nt, Homo sapiens
uacagggcaaaagggcagcugug

SEQ ID NO: 620881 - RNA, 23 nt, Homo sapiens
uacaggggggucggaagccuguc

SEQ ID NO: 620882 - RNA, 14 nt, Homo sapiens
uacaggugcgaaug

SEQ ID NO: 620883 - RNA, 22 nt, Homo sapiens
uacaggugugagccaccgugcc

SEQ ID NO: 620884 - RNA, 16 nt, Homo sapiens
uacaguaacugugacu

SEQ ID NO: 620885 - RNA, 15 nt, Homo sapiens
uacaguacacagaua

SEQ ID NO: 620886 - RNA, 14 nt, Homo sapiens
uacaguagcugcua

SEQ ID NO: 620887 - RNA, 16 nt, Homo sapiens
uacaguaucucagggc

SEQ ID NO: 620888 - RNA, 19 nt, Homo sapiens
uacaguauguuuuacaugu

SEQ ID NO: 620889 - RNA, 19 nt, Homo sapiens
uacagucaucugucuuuca

SEQ ID NO: 620890 - RNA, 18 nt, Homo sapiens
uacagucuuccauuugca

SEQ ID NO: 620891 - RNA, 16 nt, Homo sapiens
uacagucuuguauuaa

SEQ ID NO: 620892 - RNA, 20 nt, Homo sapiens
uacaguggaauugugaauaa

SEQ ID NO: 620893 - RNA, 23 nt, Homo sapiens
uacagugugugugggugaaaugg

SEQ ID NO: 620894 - RNA, 17 nt, Homo sapiens
uacaguguugauugauu

SEQ ID NO: 620895 - RNA, 17 nt, Homo sapiens
uacaguuacaguugaug

SEQ ID NO: 620896 - RNA, 17 nt, Homo sapiens
uacaguuagcagggaug

SEQ ID NO: 620897 - RNA, 23 nt, Homo sapiens
uacaguuaucauuaucaucauca

SEQ ID NO: 620898 - RNA, 21 nt, Homo sapiens
uacaguuauuaaucuggacau

SEQ ID NO: 620899 - RNA, 16 nt, Homo sapiens
uacaguucugucauau

SEQ ID NO: 620900 - RNA, 15 nt, Homo sapiens
uacaguugaauuuua

SEQ ID NO: 620901 - RNA, 20 nt, Homo sapiens
uacaguuugagacuuccaaa

SEQ ID NO: 620902 - RNA, 13 nt, Homo sapiens
uacauaaacugac

SEQ ID NO: 620903 - RNA, 16 nt, Homo sapiens
uacauaaacugucacu

SEQ ID NO: 620904 - RNA, 19 nt, Homo sapiens
uacauaaacugucacucua

SEQ ID NO: 620905 - RNA, 22 nt, Homo sapiens
uacauaaagacugugcugagaa

SEQ ID NO: 620906 - RNA, 19 nt, Homo sapiens
uacauaaguuccuauaccu

SEQ ID NO: 620907 - RNA, 22 nt, Homo sapiens
uacauaaucaaagcuaccugug

SEQ ID NO: 620908 - RNA, 17 nt, Homo sapiens
uacauaaugcgugcaua

SEQ ID NO: 620909 - RNA, 14 nt, Homo sapiens
uacauacaaauucu

SEQ ID NO: 620910 - RNA, 16 nt, Homo sapiens
uacauacacuguaugu

SEQ ID NO: 620911 - RNA, 23 nt, Homo sapiens
uacauacaggccauacuuuacaa

SEQ ID NO: 620912 - RNA, 17 nt, Homo sapiens
uacauacauacauauau

SEQ ID NO: 620913 - RNA, 20 nt, Homo sapiens
uacauacuggccucugugau

SEQ ID NO: 620914 - RNA, 21 nt, Homo sapiens
uacauacuggccucugugauu

SEQ ID NO: 620915 - RNA, 14 nt, Homo sapiens
uacauagagaauaa

SEQ ID NO: 620916 - RNA, 16 nt, Homo sapiens
uacauagcagacuuuc

SEQ ID NO: 620917 - RNA, 18 nt, Homo sapiens
uacauagucuguuccuuu

SEQ ID NO: 620918 - RNA, 22 nt, Homo sapiens
uacauauauauauacacauaca

SEQ ID NO: 620919 - RNA, 15 nt, Homo sapiens
uacauauauauguca

SEQ ID NO: 620920 - RNA, 15 nt, Homo sapiens
uacauauaucucugu

SEQ ID NO: 620921 - RNA, 19 nt, Homo sapiens
uacauauaucucugugucu

SEQ ID NO: 620922 - RNA, 12 nt, Homo sapiens
uacauaugcuga

SEQ ID NO: 620923 - RNA, 14 nt, Homo sapiens
uacauauuaucuca

SEQ ID NO: 620924 - RNA, 15 nt, Homo sapiens
uacauauuaucucau

SEQ ID NO: 620925 - RNA, 23 nt, Homo sapiens
uacauauuguggaauugacucaa

SEQ ID NO: 620926 - RNA, 21 nt, Homo sapiens
uacauauuucuuugccuuuau

SEQ ID NO: 620927 - RNA, 19 nt, Homo sapiens
uacaucaaugguguguuaa

SEQ ID NO: 620928 - RNA, 24 nt, Homo sapiens
uacaucaccuuuuugacuuuucca

SEQ ID NO: 620929 - RNA, 16 nt, Homo sapiens
uacaucacuuugugaa

SEQ ID NO: 620930 - RNA, 23 nt, Homo sapiens
uacaucagacucuagaaaaaagg

SEQ ID NO: 620931 - RNA, 18 nt, Homo sapiens
uacauccagucacuuugc

SEQ ID NO: 620932 - RNA, 19 nt, Homo sapiens
uacaucuaguuaaucauag

SEQ ID NO: 620933 - RNA, 14 nt, Homo sapiens
uacaucuuucacau

SEQ ID NO: 620934 - RNA, 13 nt, Homo sapiens
uacaugaagaaua

SEQ ID NO: 620935 - RNA, 15 nt, Homo sapiens
uauuuuuguaucuua

SEQ ID NO: 620936 - RNA, 14 nt, Homo sapiens
uauuuuugugcaca

SEQ ID NO: 620937 - RNA, 22 nt, Homo sapiens
uauuuuuguuucuuccaaagca

SEQ ID NO: 620938 - RNA, 17 nt, Homo sapiens
uauuuuuuaaguauuua

SEQ ID NO: 620939 - RNA, 18 nt, Homo sapiens
uauuuuuuacaauggcca

SEQ ID NO: 620940 - RNA, 18 nt, Homo sapiens
uauuuuuuagugaugaga

SEQ ID NO: 620941 - RNA, 17 nt, Homo sapiens
uauuuuuuauacuguau

SEQ ID NO: 620942 - RNA, 15 nt, Homo sapiens
uauuuuuucuacaca

SEQ ID NO: 620943 - RNA, 16 nt, Homo sapiens
uauuuuuucuaugaac

SEQ ID NO: 620944 - RNA, 12 nt, Homo sapiens
uauuuuuugcca

SEQ ID NO: 620945 - RNA, 21 nt, Homo sapiens
uauuuuuuuuuaauuuugaua

SEQ ID NO: 620946 - RNA, 17 nt, Homo sapiens
uauuuuuuuuuugccaa

SEQ ID NO: 620947 - RNA, 18 nt, Homo sapiens
ucaaaaaagauagaucua

SEQ ID NO: 620948 - RNA, 23 nt, Homo sapiens
ucaaaaaauugcacauaguagaa

SEQ ID NO: 620949 - RNA, 14 nt, Homo sapiens
ucaaaaacagcaga

SEQ ID NO: 620950 - RNA, 14 nt, Homo sapiens
ucaaaaacauucuu

SEQ ID NO: 620951 - RNA, 22 nt, Homo sapiens
ucaaaaagaacaacauaucuca

SEQ ID NO: 620952 - RNA, 12 nt, Homo sapiens
ucaaaaagggaa

SEQ ID NO: 620953 - RNA, 14 nt, Homo sapiens
ucaaaaaguuccau

SEQ ID NO: 620954 - RNA, 16 nt, Homo sapiens
ucaaaaauauuugcug

SEQ ID NO: 620955 - RNA, 19 nt, Homo sapiens
ucaaaaauccuaacauuca

SEQ ID NO: 620956 - RNA, 16 nt, Homo sapiens
ucaaaacaagacuccu

SEQ ID NO: 620957 - RNA, 16 nt, Homo sapiens
ucaaaacaaguacugg

SEQ ID NO: 620958 - RNA, 16 nt, Homo sapiens
ucaaaacacccaaaaa

SEQ ID NO: 620959 - RNA, 17 nt, Homo sapiens
ucaaaaccugugccagg

SEQ ID NO: 620960 - RNA, 20 nt, Homo sapiens
ucaaaacgcacaagccagac

SEQ ID NO: 620961 - RNA, 17 nt, Homo sapiens
ucaaaacucaaauguga

SEQ ID NO: 620962 - RNA, 12 nt, Homo sapiens
ucaaaagaucaa

SEQ ID NO: 620963 - RNA, 15 nt, Homo sapiens
ucaaaagauggcuua

SEQ ID NO: 620964 - RNA, 17 nt, Homo sapiens
ucaaaagccagauguga

SEQ ID NO: 620965 - RNA, 16 nt, Homo sapiens
ucaaaagguagauccu

SEQ ID NO: 620966 - RNA, 21 nt, Homo sapiens
ucaaaaguugguguugacaua

SEQ ID NO: 620967 - RNA, 17 nt, Homo sapiens
ucaaaauaaaaaguaau

SEQ ID NO: 620968 - RNA, 22 nt, Homo sapiens
ucaaaauaaaaagugacacagc

SEQ ID NO: 620969 - RNA, 22 nt, Homo sapiens
ucaaaauaaaaaugagguacuc

SEQ ID NO: 620970 - RNA, 18 nt, Homo sapiens
ucaaaauaaaggcgcuaa

SEQ ID NO: 620971 - RNA, 22 nt, Homo sapiens
ucaaaauagucauuuuuagcac

SEQ ID NO: 620972 - RNA, 20 nt, Homo sapiens
ucaaaauagucuaaggccau

SEQ ID NO: 620973 - RNA, 13 nt, Homo sapiens
ucaaaauauguca

SEQ ID NO: 620974 - RNA, 14 nt, Homo sapiens
ucaaaauaugucaa

SEQ ID NO: 620975 - RNA, 14 nt, Homo sapiens
ucaaaaucuuucca

SEQ ID NO: 620976 - RNA, 14 nt, Homo sapiens
ucaaaaugacaguu

SEQ ID NO: 620977 - RNA, 20 nt, Homo sapiens
ucaaaaugagucaggcaauu

SEQ ID NO: 620978 - RNA, 17 nt, Homo sapiens
ucaaaauggcagaacca

SEQ ID NO: 620979 - RNA, 14 nt, Homo sapiens
ucaaaauuacauau

SEQ ID NO: 620980 - RNA, 12 nt, Homo sapiens
ucaaaauuccaa

SEQ ID NO: 620981 - RNA, 19 nt, Homo sapiens
ucaaacaaccgguaaccaa

SEQ ID NO: 620982 - RNA, 20 nt, Homo sapiens
ucaaacaagaaacauuucag

SEQ ID NO: 620983 - RNA, 19 nt, Homo sapiens
ucaaacacaguuacacuug

SEQ ID NO: 620984 - RNA, 12 nt, Homo sapiens
ucaaacauauau

SEQ ID NO: 620985 - RNA, 14 nt, Homo sapiens
ucaaacauuucaaa

SEQ ID NO: 620986 - RNA, 14 nt, Homo sapiens
ucaaaccaggauuu

SEQ ID NO: 620987 - RNA, 22 nt, Homo sapiens
ucaaacucaccuugucucauga

SEQ ID NO: 620988 - RNA, 22 nt, Homo sapiens
ucaaacucccgaccucagguga

SEQ ID NO: 620989 - RNA, 22 nt, Homo sapiens
ucaaacugcaaauauugucaua

SEQ ID NO: 620990 - RNA, 23 nt, Homo sapiens
ucaaacugcaaauauugucauaa

SEQ ID NO: 620991 - RNA, 14 nt, Homo sapiens
ucaaagaaagugua

SEQ ID NO: 620992 - RNA, 14 nt, Homo sapiens
ucaaagaaguacuu

SEQ ID NO: 620993 - RNA, 21 nt, Homo sapiens
ucaaagaauuucuucagucca

SEQ ID NO: 620994 - RNA, 17 nt, Homo sapiens
ucaaagaggaaccagga

SEQ ID NO: 620995 - RNA, 12 nt, Homo sapiens
ucaaagcacuug

SEQ ID NO: 620996 - RNA, 17 nt, Homo sapiens
ucaaagcagaagucugg

SEQ ID NO: 620997 - RNA, 17 nt, Homo sapiens
ucaaagccacacucugg

SEQ ID NO: 620998 - RNA, 10 nt, Homo sapiens
ucaaagccag

SEQ ID NO: 620999 - RNA, 21 nt, Homo sapiens
ucaaagcuaaauuccacacua

SEQ ID NO: 621000 - RNA, 23 nt, Homo sapiens
ucaaagcucuauuaagauuucca

SEQ ID NO: 621001 - RNA, 21 nt, Homo sapiens
ucaaagcuuuuuccagaggcu

SEQ ID NO: 621002 - RNA, 15 nt, Homo sapiens
ucaaaggaagacuug

SEQ ID NO: 621003 - RNA, 22 nt, Homo sapiens
ucaaaggugauugugccaggcu

SEQ ID NO: 621004 - RNA, 15 nt, Homo sapiens
ucaaaguaaaacuug

SEQ ID NO: 621005 - RNA, 19 nt, Homo sapiens
ucaaagucaacauuugaga

SEQ ID NO: 621006 - RNA, 16 nt, Homo sapiens
ucaaagucauuaaaga

SEQ ID NO: 621007 - RNA, 14 nt, Homo sapiens
ucaaagucccuuga

SEQ ID NO: 621008 - RNA, 20 nt, Homo sapiens
ucaaaguguaaacaccauag

SEQ ID NO: 621009 - RNA, 20 nt, Homo sapiens
ucaaaguguuuucucugaac

SEQ ID NO: 621010 - RNA, 13 nt, Homo sapiens
ucaaauaaacuca

SEQ ID NO: 621011 - RNA, 13 nt, Homo sapiens
ucaaauacugugu

SEQ ID NO: 621012 - RNA, 19 nt, Homo sapiens
ucaaauacuuuaauaaaga

SEQ ID NO: 621013 - RNA, 22 nt, Homo sapiens
ucaaauauauuucaagcuauaa

SEQ ID NO: 621014 - RNA, 19 nt, Homo sapiens
ucaaauaucaguuacccac

SEQ ID NO: 621015 - RNA, 17 nt, Homo sapiens
ucaaaucccaaaccauu

SEQ ID NO: 621016 - RNA, 19 nt, Homo sapiens
ucaaauccuuauuguucag

SEQ ID NO: 621017 - RNA, 15 nt, Homo sapiens
ucaaaucguccagcg

SEQ ID NO: 621018 - RNA, 15 nt, Homo sapiens
ucaaaucgugguuua

SEQ ID NO: 621019 - RNA, 17 nt, Homo sapiens
ucaaaucuccugcugau

SEQ ID NO: 621020 - RNA, 19 nt, Homo sapiens
ucaaaucuccugcugauuu

SEQ ID NO: 621021 - RNA, 15 nt, Homo sapiens
ucaaaucugagggag

SEQ ID NO: 621022 - RNA, 14 nt, Homo sapiens
ucaaaugaacuuuu

SEQ ID NO: 621023 - RNA, 21 nt, Homo sapiens
ucaaaugaauaaugccuuugu

SEQ ID NO: 621024 - RNA, 16 nt, Homo sapiens
ucaaaugcacaucuca

SEQ ID NO: 621025 - RNA, 15 nt, Homo sapiens
ucaaaugucagagcu

SEQ ID NO: 621026 - RNA, 17 nt, Homo sapiens
ucaaaugugcauuuugu

SEQ ID NO: 621027 - RNA, 16 nt, Homo sapiens
ucaaauguuuccuuaa

SEQ ID NO: 621028 - RNA, 21 nt, Homo sapiens
ucaaauugggaaauccauucc

SEQ ID NO: 621029 - RNA, 14 nt, Homo sapiens
ucaaauuuaagaau

SEQ ID NO: 621030 - RNA, 19 nt, Homo sapiens
ucaaauuuagaaacuaauu

SEQ ID NO: 621031 - RNA, 23 nt, Homo sapiens
ucaaauuugccaccacuagagcu

SEQ ID NO: 621032 - RNA, 21 nt, Homo sapiens
ucaaauuuguaaaguuagccu

SEQ ID NO: 621033 - RNA, 18 nt, Homo sapiens
ucaaauuuuaucaugcca

SEQ ID NO: 621034 - RNA, 21 nt, Homo sapiens
ucaaauuuuggcgaaucucaa

SEQ ID NO: 621035 - RNA, 20 nt, Homo sapiens
ucaacaaccugaauguccca

SEQ ID NO: 621036 - RNA, 21 nt, Homo sapiens
ucaacaaguaacuuuguagaa

SEQ ID NO: 621037 - RNA, 15 nt, Homo sapiens
ucaacaaguaccuga

SEQ ID NO: 621038 - RNA, 18 nt, Homo sapiens
ucaacacagguagcacag

SEQ ID NO: 621039 - RNA, 22 nt, Homo sapiens
ucaacacccgccccccccaugu

SEQ ID NO: 621040 - RNA, 12 nt, Homo sapiens
ucaacacuuaag

SEQ ID NO: 621041 - RNA, 20 nt, Homo sapiens
ucaacagaaacuaaaugaac

SEQ ID NO: 621042 - RNA, 12 nt, Homo sapiens
ucaacagaauug

SEQ ID NO: 621043 - RNA, 22 nt, Homo sapiens
ucaacagaucugcauuuggcug

SEQ ID NO: 621044 - RNA, 16 nt, Homo sapiens
ucaacagcuaugcugg

SEQ ID NO: 621045 - RNA, 14 nt, Homo sapiens
ucaacaguauaagu

SEQ ID NO: 621046 - RNA, 22 nt, Homo sapiens
ucaacaucuuggucagauuuga

SEQ ID NO: 621047 - RNA, 21 nt, Homo sapiens
ucaacaugacauccagagaug

SEQ ID NO: 621048 - RNA, 16 nt, Homo sapiens
ucaacaugacuggugg

SEQ ID NO: 621049 - RNA, 15 nt, Homo sapiens
ucaacauuaccaaaa

SEQ ID NO: 621050 - RNA, 12 nt, Homo sapiens
ucaacauugcau

SEQ ID NO: 621051 - RNA, 18 nt, Homo sapiens
ucaaccaaugccaaaaaa

SEQ ID NO: 621052 - RNA, 14 nt, Homo sapiens
ucaacccagcaauc

SEQ ID NO: 621053 - RNA, 15 nt, Homo sapiens
ucaaccuccuggaca

SEQ ID NO: 621054 - RNA, 19 nt, Homo sapiens
ucaaccucuucuggcucaa

SEQ ID NO: 621055 - RNA, 21 nt, Homo sapiens
ucaaccugguggcaccagaug

SEQ ID NO: 621056 - RNA, 23 nt, Homo sapiens
ucaacucuccaauguucuauuaa

SEQ ID NO: 621057 - RNA, 19 nt, Homo sapiens
ucagaaucuccaucccuga

SEQ ID NO: 621058 - RNA, 12 nt, Homo sapiens
ucagaaucugug

SEQ ID NO: 621059 - RNA, 17 nt, Homo sapiens
ucagaauggauuuauca

SEQ ID NO: 621060 - RNA, 22 nt, Homo sapiens
ucagaaugggggcuuucgggga

SEQ ID NO: 621061 - RNA, 16 nt, Homo sapiens
ucagaauucggugugc

SEQ ID NO: 621062 - RNA, 18 nt, Homo sapiens
ucagaauucggugugcug

SEQ ID NO: 621063 - RNA, 17 nt, Homo sapiens
ucagaauucuucauccu

SEQ ID NO: 621064 - RNA, 22 nt, Homo sapiens
ucagaauuuaguguauccauaa

SEQ ID NO: 621065 - RNA, 22 nt, Homo sapiens
ucagaauuucuuugucauucaa

SEQ ID NO: 621066 - RNA, 20 nt, Homo sapiens
ucagacacccucuccuuaaa

SEQ ID NO: 621067 - RNA, 19 nt, Homo sapiens
ucagacacuacaugaugac

SEQ ID NO: 621068 - RNA, 22 nt, Homo sapiens
ucagacacugccgacaucagca

SEQ ID NO: 621069 - RNA, 20 nt, Homo sapiens
ucagacauuuauauauugga

SEQ ID NO: 621070 - RNA, 15 nt, Homo sapiens
ucagaccaguacugg

SEQ ID NO: 621071 - RNA, 16 nt, Homo sapiens
ucagaccaguacuggg

SEQ ID NO: 621072 - RNA, 18 nt, Homo sapiens
ucagaccaguacugggaa

SEQ ID NO: 621073 - RNA, 16 nt, Homo sapiens
ucagacuccugugcaa

SEQ ID NO: 621074 - RNA, 21 nt, Homo sapiens
ucagacugcugggacuggcca

SEQ ID NO: 621075 - RNA, 18 nt, Homo sapiens
ucagacuuucacaccauu

SEQ ID NO: 621076 - RNA, 19 nt, Homo sapiens
ucagagaaaggacugugga

SEQ ID NO: 621077 - RNA, 18 nt, Homo sapiens
ucagagaaccagugcaga

SEQ ID NO: 621078 - RNA, 16 nt, Homo sapiens
ucagagaacuuuccca

SEQ ID NO: 621079 - RNA, 17 nt, Homo sapiens
ucagagacagauaccuc

SEQ ID NO: 621080 - RNA, 16 nt, Homo sapiens
ucagagacuaucugau

SEQ ID NO: 621081 - RNA, 14 nt, Homo sapiens
ucagagaugaacau

SEQ ID NO: 621082 - RNA, 13 nt, Homo sapiens
ucagagcacuccc

SEQ ID NO: 621083 - RNA, 15 nt, Homo sapiens
ucagagcaggcucag

SEQ ID NO: 621084 - RNA, 15 nt, Homo sapiens
ucagagccaccccua

SEQ ID NO: 621085 - RNA, 21 nt, Homo sapiens
ucagagcuaauaagugcuuuc

SEQ ID NO: 621086 - RNA, 14 nt, Homo sapiens
ucagagcugggaaa

SEQ ID NO: 621087 - RNA, 17 nt, Homo sapiens
ucagaggcgcacuguga

SEQ ID NO: 621088 - RNA, 20 nt, Homo sapiens
ucagaggggacucugaccac

SEQ ID NO: 621089 - RNA, 18 nt, Homo sapiens
ucagaggguagccuugau

SEQ ID NO: 621090 - RNA, 22 nt, Homo sapiens
ucagagguuugcuuccucagua

SEQ ID NO: 621091 - RNA, 19 nt, Homo sapiens
ucagaguccucauuauaaa

SEQ ID NO: 621092 - RNA, 22 nt, Homo sapiens
ucagaguggucgagugacacac

SEQ ID NO: 621093 - RNA, 22 nt, Homo sapiens
ucagaguugcugcaaaccugac

SEQ ID NO: 621094 - RNA, 21 nt, Homo sapiens
ucagauacaugguugugaccu

SEQ ID NO: 621095 - RNA, 15 nt, Homo sapiens
ucagauagaaugaca

SEQ ID NO: 621096 - RNA, 16 nt, Homo sapiens
ucagauaggagugaau

SEQ ID NO: 621097 - RNA, 23 nt, Homo sapiens
ucagauauaaaagacugaccaau

SEQ ID NO: 621098 - RNA, 13 nt, Homo sapiens
ucagauaugauau

SEQ ID NO: 621099 - RNA, 15 nt, Homo sapiens
ucagaucaacaaauc

SEQ ID NO: 621100 - RNA, 23 nt, Homo sapiens
ucagaucccagcuucggcauuug

SEQ ID NO: 621101 - RNA, 18 nt, Homo sapiens
ucagauccuguuacuugc

SEQ ID NO: 621102 - RNA, 16 nt, Homo sapiens
ucagaucgaaauugga

SEQ ID NO: 621103 - RNA, 15 nt, Homo sapiens
ucagaucguucauug

SEQ ID NO: 621104 - RNA, 23 nt, Homo sapiens
ucagaucguucauugccuuucca

SEQ ID NO: 621105 - RNA, 20 nt, Homo sapiens
ucagaucugaacacaguuua

SEQ ID NO: 621106 - RNA, 14 nt, Homo sapiens
ucagaucugagguu

SEQ ID NO: 621107 - RNA, 22 nt, Homo sapiens
ucagaugaacaauuaugaacau

SEQ ID NO: 621108 - RNA, 23 nt, Homo sapiens
ucagaugaauuguuaauuaucua

SEQ ID NO: 621109 - RNA, 19 nt, Homo sapiens
ucagaugauggccauuucu

SEQ ID NO: 621110 - RNA, 14 nt, Homo sapiens
ucagaugauucuau

SEQ ID NO: 621111 - RNA, 23 nt, Homo sapiens
ucagaugauucuaugucucauga

SEQ ID NO: 621112 - RNA, 12 nt, Homo sapiens
ucagauggacaa

SEQ ID NO: 621113 - RNA, 19 nt, Homo sapiens
ucagauggagguucucaga

SEQ ID NO: 621114 - RNA, 22 nt, Homo sapiens
ucagauguuuuacgcaaggaag

SEQ ID NO: 621115 - RNA, 23 nt, Homo sapiens
ucagauuaccaguuauaggaaca

SEQ ID NO: 621116 - RNA, 14 nt, Homo sapiens
ucagauuccaccua

SEQ ID NO: 621117 - RNA, 19 nt, Homo sapiens
ucagauuuugcccaaccua

SEQ ID NO: 621118 - RNA, 11 nt, Homo sapiens
ucagcaaaaaa

SEQ ID NO: 621119 - RNA, 21 nt, Homo sapiens
ucagcaaacuaaccagcauuc

SEQ ID NO: 621120 - RNA, 13 nt, Homo sapiens
ucagcaaccugua

SEQ ID NO: 621121 - RNA, 16 nt, Homo sapiens
ucagcaacucgcuuua

SEQ ID NO: 621122 - RNA, 19 nt, Homo sapiens
ucagcaagacauaaagccu

SEQ ID NO: 621123 - RNA, 19 nt, Homo sapiens
ucagcaauacagacuacuu

SEQ ID NO: 621124 - RNA, 17 nt, Homo sapiens
ucagcaauacuaaggga

SEQ ID NO: 621125 - RNA, 16 nt, Homo sapiens
ucagcaauacucauca

SEQ ID NO: 621126 - RNA, 16 nt, Homo sapiens
ucagcaauauugccug

SEQ ID NO: 621127 - RNA, 21 nt, Homo sapiens
ucagcaauauugccugugcuu

SEQ ID NO: 621128 - RNA, 12 nt, Homo sapiens
ucagcaaugauu

SEQ ID NO: 621129 - RNA, 17 nt, Homo sapiens
ucagcaaugccauuuca

SEQ ID NO: 621130 - RNA, 15 nt, Homo sapiens
ucagcacaggaauuc

SEQ ID NO: 621131 - RNA, 19 nt, Homo sapiens
ucagcaccccuagcaugaa

SEQ ID NO: 621132 - RNA, 16 nt, Homo sapiens
ucagcaccuacagugu

SEQ ID NO: 621133 - RNA, 15 nt, Homo sapiens
ucagcagacacaggu

SEQ ID NO: 621134 - RNA, 15 nt, Homo sapiens
ucagcagagaacugg

SEQ ID NO: 621135 - RNA, 14 nt, Homo sapiens
ucagcagaggcagu

SEQ ID NO: 621136 - RNA, 14 nt, Homo sapiens
ucagcagaugccag

SEQ ID NO: 621137 - RNA, 23 nt, Homo sapiens
ucagcagggacuguaaacacaga

SEQ ID NO: 621138 - RNA, 16 nt, Homo sapiens
ucagcagugaaguaua

SEQ ID NO: 621139 - RNA, 16 nt, Homo sapiens
ucagcauagccugccu

SEQ ID NO: 621140 - RNA, 14 nt, Homo sapiens
ucagcaucugugau

SEQ ID NO: 621141 - RNA, 16 nt, Homo sapiens
ucagcaucugugaugg

SEQ ID NO: 621142 - RNA, 13 nt, Homo sapiens
ucagcaugcaucc

SEQ ID NO: 621143 - RNA, 13 nt, Homo sapiens
ucagcauggcauc

SEQ ID NO: 621144 - RNA, 20 nt, Homo sapiens
ucagcauuauuccuccagga

SEQ ID NO: 621145 - RNA, 18 nt, Homo sapiens
ucagcauucucacuccua

SEQ ID NO: 621146 - RNA, 21 nt, Homo sapiens
ucagcauuuagucuugccagg

SEQ ID NO: 621147 - RNA, 19 nt, Homo sapiens
ucagcauuuccacaccaag

SEQ ID NO: 621148 - RNA, 22 nt, Homo sapiens
ucagcauuucuuuucuggccaa

SEQ ID NO: 621149 - RNA, 15 nt, Homo sapiens
ucagcauuugaucug

SEQ ID NO: 621150 - RNA, 16 nt, Homo sapiens
ucagcauuuggaccaa

SEQ ID NO: 621151 - RNA, 22 nt, Homo sapiens
ucagccacuacaacagaauuuu

SEQ ID NO: 621152 - RNA, 10 nt, Homo sapiens
ucagccaggc

SEQ ID NO: 621153 - RNA, 18 nt, Homo sapiens
ucagccaggcccugagau

SEQ ID NO: 621154 - RNA, 16 nt, Homo sapiens
ucagccauaggugcag

SEQ ID NO: 621155 - RNA, 18 nt, Homo sapiens
ucagccauaggugcaguu

SEQ ID NO: 621156 - RNA, 13 nt, Homo sapiens
ucagcccaucuca

SEQ ID NO: 621157 - RNA, 16 nt, Homo sapiens
ucagccccacaggacu

SEQ ID NO: 621158 - RNA, 19 nt, Homo sapiens
ucagcccccaccucagguu

SEQ ID NO: 621159 - RNA, 17 nt, Homo sapiens
ucagcccucaguuccuu

SEQ ID NO: 621160 - RNA, 14 nt, Homo sapiens
ucagcccuggccaa

SEQ ID NO: 621161 - RNA, 19 nt, Homo sapiens
ucagccgcuucugacugcu

SEQ ID NO: 621162 - RNA, 23 nt, Homo sapiens
ucagccuacuuucacacuaagaa

SEQ ID NO: 621163 - RNA, 21 nt, Homo sapiens
ucagccuagagaccauguuga

SEQ ID NO: 621164 - RNA, 18 nt, Homo sapiens
ucagccuagccgaccuca

SEQ ID NO: 621165 - RNA, 18 nt, Homo sapiens
ucagccugaccaacaugg

SEQ ID NO: 621166 - RNA, 14 nt, Homo sapiens
ucagccuugcaaau

SEQ ID NO: 621167 - RNA, 14 nt, Homo sapiens
ucagcggcuccagc

SEQ ID NO: 621168 - RNA, 14 nt, Homo sapiens
ucagcucaccucaa

SEQ ID NO: 621169 - RNA, 14 nt, Homo sapiens
ucagcucagcuucu

SEQ ID NO: 621170 - RNA, 21 nt, Homo sapiens
ucagcucugaggauguauacc

SEQ ID NO: 621171 - RNA, 13 nt, Homo sapiens
ucagcucuuggcu

SEQ ID NO: 621172 - RNA, 21 nt, Homo sapiens
ucagcucuuuggaucagucuu

SEQ ID NO: 621173 - RNA, 15 nt, Homo sapiens
ucagcugaaccuggg

SEQ ID NO: 621174 - RNA, 17 nt, Homo sapiens
ucagcugagguuugcac

SEQ ID NO: 621175 - RNA, 19 nt, Homo sapiens
ucagcugcaagguacucug

SEQ ID NO: 621176 - RNA, 16 nt, Homo sapiens
ucagcugcacauuccu

SEQ ID NO: 621177 - RNA, 12 nt, Homo sapiens
ucagcugcaugg

SEQ ID NO: 621178 - RNA, 22 nt, Homo sapiens
ucagcugccugaaacagccaug

SEQ ID NO: 621179 - RNA, 22 nt, Homo sapiens
uccaaguaagaguacugggaga

SEQ ID NO: 621180 - RNA, 11 nt, Homo sapiens
uccaaguacau

SEQ ID NO: 621181 - RNA, 16 nt, Homo sapiens
uccaagucaacacucu

SEQ ID NO: 621182 - RNA, 14 nt, Homo sapiens
uccaaguguuauac

SEQ ID NO: 621183 - RNA, 21 nt, Homo sapiens
uccaaguuccccaucccuguc

SEQ ID NO: 621184 - RNA, 18 nt, Homo sapiens
uccaauaaagaguuccuu

SEQ ID NO: 621185 - RNA, 11 nt, Homo sapiens
uccaauacugc

SEQ ID NO: 621186 - RNA, 22 nt, Homo sapiens
uccaauagaaagaaacuaaaca

SEQ ID NO: 621187 - RNA, 23 nt, Homo sapiens
uccaauaucagugcucgagacac

SEQ ID NO: 621188 - RNA, 20 nt, Homo sapiens
uccaauauucgcugugucag

SEQ ID NO: 621189 - RNA, 17 nt, Homo sapiens
uccaauauuuucuuuaa

SEQ ID NO: 621190 - RNA, 16 nt, Homo sapiens
uccaauauuuugccuu

SEQ ID NO: 621191 - RNA, 18 nt, Homo sapiens
uccaaucaacagcaguga

SEQ ID NO: 621192 - RNA, 12 nt, Homo sapiens
uccaaugaagga

SEQ ID NO: 621193 - RNA, 15 nt, Homo sapiens
uccaauguagcucag

SEQ ID NO: 621194 - RNA, 17 nt, Homo sapiens
uccaauuccuugcacau

SEQ ID NO: 621195 - RNA, 12 nt, Homo sapiens
uccaauugaacu

SEQ ID NO: 621196 - RNA, 13 nt, Homo sapiens
uccaauuggugcu

SEQ ID NO: 621197 - RNA, 13 nt, Homo sapiens
uccaauuucaaga

SEQ ID NO: 621198 - RNA, 18 nt, Homo sapiens
uccaauuucacgcuuuua

SEQ ID NO: 621199 - RNA, 16 nt, Homo sapiens
uccaauuuguguaauu

SEQ ID NO: 621200 - RNA, 22 nt, Homo sapiens
uccaauuuuaauuuaguaaaug

SEQ ID NO: 621201 - RNA, 14 nt, Homo sapiens
uccacaacagaagu

SEQ ID NO: 621202 - RNA, 17 nt, Homo sapiens
uccacaagagugaauuu

SEQ ID NO: 621203 - RNA, 14 nt, Homo sapiens
uccacacccagcuc

SEQ ID NO: 621204 - RNA, 14 nt, Homo sapiens
uccacagaaauaca

SEQ ID NO: 621205 - RNA, 15 nt, Homo sapiens
uccacagauuaucaa

SEQ ID NO: 621206 - RNA, 10 nt, Homo sapiens
uccacagcaa

SEQ ID NO: 621207 - RNA, 15 nt, Homo sapiens
uccacaggauauuaa

SEQ ID NO: 621208 - RNA, 18 nt, Homo sapiens
uccacauauuucagugag

SEQ ID NO: 621209 - RNA, 13 nt, Homo sapiens
uccacaucugccu

SEQ ID NO: 621210 - RNA, 16 nt, Homo sapiens
uccacaucuuuacuca

SEQ ID NO: 621211 - RNA, 13 nt, Homo sapiens
uccacauguucaa

SEQ ID NO: 621212 - RNA, 19 nt, Homo sapiens
uccacauuauacauuugau

SEQ ID NO: 621213 - RNA, 17 nt, Homo sapiens
uccacccacaacaucua

SEQ ID NO: 621214 - RNA, 15 nt, Homo sapiens
uccacccagugcugc

SEQ ID NO: 621215 - RNA, 17 nt, Homo sapiens
uccaccccuuucuagac

SEQ ID NO: 621216 - RNA, 18 nt, Homo sapiens
uccacccucaaaugucag

SEQ ID NO: 621217 - RNA, 21 nt, Homo sapiens
uccaccgaccaacugcccuaa

SEQ ID NO: 621218 - RNA, 20 nt, Homo sapiens
uccaccuagagcuagaugug

SEQ ID NO: 621219 - RNA, 21 nt, Homo sapiens
uccaccuagagcuagaugugu

SEQ ID NO: 621220 - RNA, 22 nt, Homo sapiens
uccaccuccaccacaucugcca

SEQ ID NO: 621221 - RNA, 23 nt, Homo sapiens
uccaccuccaccacaucugccag

SEQ ID NO: 621222 - RNA, 19 nt, Homo sapiens
uccaccucgggcacauuuu

SEQ ID NO: 621223 - RNA, 17 nt, Homo sapiens
uccaccugaggaacugu

SEQ ID NO: 621224 - RNA, 17 nt, Homo sapiens
uccaccuuggaccucag

SEQ ID NO: 621225 - RNA, 21 nt, Homo sapiens
uccacgcaauggaacauuauu

SEQ ID NO: 621226 - RNA, 13 nt, Homo sapiens
uccacguaucuuu

SEQ ID NO: 621227 - RNA, 17 nt, Homo sapiens
uccacgucaacagaauu

SEQ ID NO: 621228 - RNA, 13 nt, Homo sapiens
uccacucacucca

SEQ ID NO: 621229 - RNA, 18 nt, Homo sapiens
uccacuccacacucuuga

SEQ ID NO: 621230 - RNA, 16 nt, Homo sapiens
uccacuccacucaggu

SEQ ID NO: 621231 - RNA, 17 nt, Homo sapiens
uccacuccacucagguu

SEQ ID NO: 621232 - RNA, 16 nt, Homo sapiens
uccacucccuuugcca

SEQ ID NO: 621233 - RNA, 17 nt, Homo sapiens
uccacuccuccuacugu

SEQ ID NO: 621234 - RNA, 17 nt, Homo sapiens
uccacucguguguuucu

SEQ ID NO: 621235 - RNA, 20 nt, Homo sapiens
uccacucuacuaaugccucu

SEQ ID NO: 621236 - RNA, 20 nt, Homo sapiens
uccacuggaaaaggugaaaa

SEQ ID NO: 621237 - RNA, 15 nt, Homo sapiens
uccacugucaggguu

SEQ ID NO: 621238 - RNA, 18 nt, Homo sapiens
uccacuguggcaaaugga

SEQ ID NO: 621239 - RNA, 14 nt, Homo sapiens
uccacuucuggcau

SEQ ID NO: 621240 - RNA, 14 nt, Homo sapiens
uccacuucuuccuu

SEQ ID NO: 621241 - RNA, 19 nt, Homo sapiens
uccacuucuuguuccccac

SEQ ID NO: 621242 - RNA, 16 nt, Homo sapiens
uccacuugaagcacuu

SEQ ID NO: 621243 - RNA, 22 nt, Homo sapiens
uccacuuguucuguacuuguaa

SEQ ID NO: 621244 - RNA, 15 nt, Homo sapiens
uccagaaacuuucca

SEQ ID NO: 621245 - RNA, 20 nt, Homo sapiens
uccagaaacuuuccauccca

SEQ ID NO: 621246 - RNA, 15 nt, Homo sapiens
uccagaaauaccugu

SEQ ID NO: 621247 - RNA, 22 nt, Homo sapiens
uccagaacaaauuguuuacaua

SEQ ID NO: 621248 - RNA, 23 nt, Homo sapiens
uccagaacaaauuguuuacauaa

SEQ ID NO: 621249 - RNA, 14 nt, Homo sapiens
uccagaacacggcu

SEQ ID NO: 621250 - RNA, 22 nt, Homo sapiens
uccagaaccgccgaaugaagca

SEQ ID NO: 621251 - RNA, 13 nt, Homo sapiens
uccagaagccagu

SEQ ID NO: 621252 - RNA, 16 nt, Homo sapiens
uccagaauaaaacgca

SEQ ID NO: 621253 - RNA, 16 nt, Homo sapiens
uccagaccaaccuucc

SEQ ID NO: 621254 - RNA, 18 nt, Homo sapiens
uccagaccauucaggaca

SEQ ID NO: 621255 - RNA, 18 nt, Homo sapiens
uccagacucacuugccau

SEQ ID NO: 621256 - RNA, 12 nt, Homo sapiens
uccagacuguaa

SEQ ID NO: 621257 - RNA, 16 nt, Homo sapiens
uccagagaccccagga

SEQ ID NO: 621258 - RNA, 18 nt, Homo sapiens
uccagagaccccaggaac

SEQ ID NO: 621259 - RNA, 20 nt, Homo sapiens
uccagagaccccaggaacaa

SEQ ID NO: 621260 - RNA, 13 nt, Homo sapiens
uccagagccagaa

SEQ ID NO: 621261 - RNA, 22 nt, Homo sapiens
uccagagcccaaggucagggag

SEQ ID NO: 621262 - RNA, 18 nt, Homo sapiens
uccagaggaauaaaaagg

SEQ ID NO: 621263 - RNA, 13 nt, Homo sapiens
uccagaggacucu

SEQ ID NO: 621264 - RNA, 14 nt, Homo sapiens
uccagaggcccuag

SEQ ID NO: 621265 - RNA, 23 nt, Homo sapiens
uccagagguauuccucucuuaaa

SEQ ID NO: 621266 - RNA, 15 nt, Homo sapiens
uccagaguaugcaac

SEQ ID NO: 621267 - RNA, 16 nt, Homo sapiens
uccagaguuguucucu

SEQ ID NO: 621268 - RNA, 21 nt, Homo sapiens
uccagaguuguuguuugccaa

SEQ ID NO: 621269 - RNA, 19 nt, Homo sapiens
uccagauaggaaaagaaga

SEQ ID NO: 621270 - RNA, 18 nt, Homo sapiens
uccagauauccacauaaa

SEQ ID NO: 621271 - RNA, 15 nt, Homo sapiens
uccagauauuucaca

SEQ ID NO: 621272 - RNA, 16 nt, Homo sapiens
uccagaucacugccac

SEQ ID NO: 621273 - RNA, 19 nt, Homo sapiens
uccagauccagacuguaag

SEQ ID NO: 621274 - RNA, 14 nt, Homo sapiens
uccagaugagucag

SEQ ID NO: 621275 - RNA, 12 nt, Homo sapiens
uccagauggcaa

SEQ ID NO: 621276 - RNA, 13 nt, Homo sapiens
uccagauguuaau

SEQ ID NO: 621277 - RNA, 23 nt, Homo sapiens
uccagauguuaauuuacuuucug

SEQ ID NO: 621278 - RNA, 23 nt, Homo sapiens
uccagcaaaagagcuauugccaa

SEQ ID NO: 621279 - RNA, 20 nt, Homo sapiens
uccagcaaaauggaagcaaa

SEQ ID NO: 621280 - RNA, 20 nt, Homo sapiens
uccagcaacugcccuuccag

SEQ ID NO: 621281 - RNA, 12 nt, Homo sapiens
uccagcaccugu

SEQ ID NO: 621282 - RNA, 21 nt, Homo sapiens
uccagccacuugacuggcaca

SEQ ID NO: 621283 - RNA, 19 nt, Homo sapiens
uccagccgcugcacaucac

SEQ ID NO: 621284 - RNA, 17 nt, Homo sapiens
uccagccucauaaagua

SEQ ID NO: 621285 - RNA, 20 nt, Homo sapiens
uccagccugggcaacagagc

SEQ ID NO: 621286 - RNA, 16 nt, Homo sapiens
uccagccugggggaca

SEQ ID NO: 621287 - RNA, 14 nt, Homo sapiens
uccagcuccuguaa

SEQ ID NO: 621288 - RNA, 14 nt, Homo sapiens
uccagcucugagac

SEQ ID NO: 621289 - RNA, 15 nt, Homo sapiens
uccagcugauccaga

SEQ ID NO: 621290 - RNA, 18 nt, Homo sapiens
uccagcugauccagaugu

SEQ ID NO: 621291 - RNA, 14 nt, Homo sapiens
uccagcugcugucu

SEQ ID NO: 621292 - RNA, 21 nt, Homo sapiens
uccagcuuagaaugcaucuca

SEQ ID NO: 621293 - RNA, 14 nt, Homo sapiens
uccagcuucaggca

SEQ ID NO: 621294 - RNA, 23 nt, Homo sapiens
uccagcuucugguacucuccuag

SEQ ID NO: 621295 - RNA, 15 nt, Homo sapiens
uccagcuuuaagggu

SEQ ID NO: 621296 - RNA, 19 nt, Homo sapiens
uccagcuuuuccucagggu

SEQ ID NO: 621297 - RNA, 14 nt, Homo sapiens
uccaggaaggcagc

SEQ ID NO: 621298 - RNA, 16 nt, Homo sapiens
uccaggaaggcagcug

SEQ ID NO: 621299 - RNA, 17 nt, Homo sapiens
uccaggaauuaaaucau

SEQ ID NO: 621300 - RNA, 20 nt, Homo sapiens
uccaggacagcaggcuuuga

SEQ ID NO: 621301 - RNA, 13 nt, Homo sapiens
uccaggacaugau

SEQ ID NO: 621302 - RNA, 21 nt, Homo sapiens
ucccaaucaaagaauuacagu

SEQ ID NO: 621303 - RNA, 19 nt, Homo sapiens
ucccaaucuuucuauauaa

SEQ ID NO: 621304 - RNA, 13 nt, Homo sapiens
ucccaaugaaaua

SEQ ID NO: 621305 - RNA, 12 nt, Homo sapiens
ucccaauuagcu

SEQ ID NO: 621306 - RNA, 18 nt, Homo sapiens
ucccacaacaacaaaagc

SEQ ID NO: 621307 - RNA, 17 nt, Homo sapiens
ucccacaaucugggacu

SEQ ID NO: 621308 - RNA, 23 nt, Homo sapiens
ucccacacagaauauacauuguc

SEQ ID NO: 621309 - RNA, 20 nt, Homo sapiens
ucccacacugaaaccaaaac

SEQ ID NO: 621310 - RNA, 11 nt, Homo sapiens
ucccacacugu

SEQ ID NO: 621311 - RNA, 19 nt, Homo sapiens
ucccacagagugcuggacu

SEQ ID NO: 621312 - RNA, 13 nt, Homo sapiens
ucccacagcacaa

SEQ ID NO: 621313 - RNA, 16 nt, Homo sapiens
ucccacagcacaaccg

SEQ ID NO: 621314 - RNA, 14 nt, Homo sapiens
ucccacauucugau

SEQ ID NO: 621315 - RNA, 17 nt, Homo sapiens
ucccacccacacagcug

SEQ ID NO: 621316 - RNA, 16 nt, Homo sapiens
ucccaccuacugcacu

SEQ ID NO: 621317 - RNA, 22 nt, Homo sapiens
ucccaccucuucucuuccugua

SEQ ID NO: 621318 - RNA, 19 nt, Homo sapiens
ucccaccugacauguccuu

SEQ ID NO: 621319 - RNA, 16 nt, Homo sapiens
ucccacuaaaguguca

SEQ ID NO: 621320 - RNA, 13 nt, Homo sapiens
ucccacuaucugg

SEQ ID NO: 621321 - RNA, 18 nt, Homo sapiens
ucccacucaguacuguac

SEQ ID NO: 621322 - RNA, 15 nt, Homo sapiens
ucccacuccuggccu

SEQ ID NO: 621323 - RNA, 17 nt, Homo sapiens
ucccacugacuguaugg

SEQ ID NO: 621324 - RNA, 19 nt, Homo sapiens
ucccacugcaacuugugaa

SEQ ID NO: 621325 - RNA, 21 nt, Homo sapiens
ucccacugcggggagacagaa

SEQ ID NO: 621326 - RNA, 20 nt, Homo sapiens
ucccacugcucccccaacac

SEQ ID NO: 621327 - RNA, 13 nt, Homo sapiens
ucccacuguauga

SEQ ID NO: 621328 - RNA, 18 nt, Homo sapiens
ucccacuuccuccuaccu

SEQ ID NO: 621329 - RNA, 14 nt, Homo sapiens
ucccagaaccuauu

SEQ ID NO: 621330 - RNA, 14 nt, Homo sapiens
ucccagacauucau

SEQ ID NO: 621331 - RNA, 18 nt, Homo sapiens
ucccagacggucaggaaa

SEQ ID NO: 621332 - RNA, 23 nt, Homo sapiens
ucccagacggucaggaaaacugu

SEQ ID NO: 621333 - RNA, 15 nt, Homo sapiens
ucccagaucagucag

SEQ ID NO: 621334 - RNA, 22 nt, Homo sapiens
ucccagauguaaauagaacaac

SEQ ID NO: 621335 - RNA, 17 nt, Homo sapiens
ucccagauguugcaucc

SEQ ID NO: 621336 - RNA, 23 nt, Homo sapiens
ucccagauguugcaucccugaaa

SEQ ID NO: 621337 - RNA, 18 nt, Homo sapiens
ucccagauguuggaccaa

SEQ ID NO: 621338 - RNA, 17 nt, Homo sapiens
ucccagcaagaccucau

SEQ ID NO: 621339 - RNA, 23 nt, Homo sapiens
ucccagcagcccuaaggaucucu

SEQ ID NO: 621340 - RNA, 13 nt, Homo sapiens
ucccagcaguggg

SEQ ID NO: 621341 - RNA, 12 nt, Homo sapiens
ucccagcccagc

SEQ ID NO: 621342 - RNA, 19 nt, Homo sapiens
ucccagcccuauggaugug

SEQ ID NO: 621343 - RNA, 21 nt, Homo sapiens
ucccagcccucaucccacuuc

SEQ ID NO: 621344 - RNA, 14 nt, Homo sapiens
ucccagcuacucag

SEQ ID NO: 621345 - RNA, 21 nt, Homo sapiens
ucccagcuccuuucaugcucc

SEQ ID NO: 621346 - RNA, 15 nt, Homo sapiens
ucccaggaacugggc

SEQ ID NO: 621347 - RNA, 16 nt, Homo sapiens
ucccaggcaugcagcu

SEQ ID NO: 621348 - RNA, 23 nt, Homo sapiens
ucccaggcugagccucagucucc

SEQ ID NO: 621349 - RNA, 18 nt, Homo sapiens
ucccaggcuggagugcag

SEQ ID NO: 621350 - RNA, 12 nt, Homo sapiens
ucccaggcuucc

SEQ ID NO: 621351 - RNA, 20 nt, Homo sapiens
ucccaggggagccagcugcu

SEQ ID NO: 621352 - RNA, 17 nt, Homo sapiens
ucccagguaauuuaaau

SEQ ID NO: 621353 - RNA, 14 nt, Homo sapiens
ucccagucacuccu

SEQ ID NO: 621354 - RNA, 13 nt, Homo sapiens
ucccaguccauuu

SEQ ID NO: 621355 - RNA, 17 nt, Homo sapiens
ucccaguccuccagacc

SEQ ID NO: 621356 - RNA, 22 nt, Homo sapiens
ucccagugaccccugaccucac

SEQ ID NO: 621357 - RNA, 13 nt, Homo sapiens
ucccagugaucac

SEQ ID NO: 621358 - RNA, 9 nt, Homo sapiens
ucccagugc

SEQ ID NO: 621359 - RNA, 14 nt, Homo sapiens
ucccaguggucaaa

SEQ ID NO: 621360 - RNA, 11 nt, Homo sapiens
ucccagugugc

SEQ ID NO: 621361 - RNA, 20 nt, Homo sapiens
ucccaguguuccauuugaac

SEQ ID NO: 621362 - RNA, 19 nt, Homo sapiens
ucccauaagcuaagccuua

SEQ ID NO: 621363 - RNA, 16 nt, Homo sapiens
ucccauagccaggaaa

SEQ ID NO: 621364 - RNA, 15 nt, Homo sapiens
ucccaucccacugcu

SEQ ID NO: 621365 - RNA, 13 nt, Homo sapiens
ucccauccuugau

SEQ ID NO: 621366 - RNA, 17 nt, Homo sapiens
ucccauccuugaugcaa

SEQ ID NO: 621367 - RNA, 18 nt, Homo sapiens
ucccaucuccccgcugaa

SEQ ID NO: 621368 - RNA, 18 nt, Homo sapiens
ucccaucugucaccaauu

SEQ ID NO: 621369 - RNA, 14 nt, Homo sapiens
ucccaucuuuacuc

SEQ ID NO: 621370 - RNA, 16 nt, Homo sapiens
ucccaugacucuugga

SEQ ID NO: 621371 - RNA, 17 nt, Homo sapiens
ucccauggacacuccag

SEQ ID NO: 621372 - RNA, 23 nt, Homo sapiens
ucccaugggcugaguggggagca

SEQ ID NO: 621373 - RNA, 16 nt, Homo sapiens
ucccauguugucaaua

SEQ ID NO: 621374 - RNA, 23 nt, Homo sapiens
ucccauuaccauguaauggcagu

SEQ ID NO: 621375 - RNA, 21 nt, Homo sapiens
ucccauucauauuaagacagu

SEQ ID NO: 621376 - RNA, 13 nt, Homo sapiens
ucccauugccaug

SEQ ID NO: 621377 - RNA, 16 nt, Homo sapiens
ucccauuggcaaaaga

SEQ ID NO: 621378 - RNA, 19 nt, Homo sapiens
ucccauuggcucccugugu

SEQ ID NO: 621379 - RNA, 22 nt, Homo sapiens
ucccauuucaauuccugugauu

SEQ ID NO: 621380 - RNA, 15 nt, Homo sapiens
ucccauuuucauccu

SEQ ID NO: 621381 - RNA, 22 nt, Homo sapiens
uccccaaaaauugacuuagaua

SEQ ID NO: 621382 - RNA, 17 nt, Homo sapiens
uccccaaaggcauccau

SEQ ID NO: 621383 - RNA, 14 nt, Homo sapiens
uccccaacaccugc

SEQ ID NO: 621384 - RNA, 15 nt, Homo sapiens
uccccaaccacagag

SEQ ID NO: 621385 - RNA, 20 nt, Homo sapiens
uccccaacucccugccauuu

SEQ ID NO: 621386 - RNA, 17 nt, Homo sapiens
uccccaauccaggccaa

SEQ ID NO: 621387 - RNA, 15 nt, Homo sapiens
uccccacaccucccu

SEQ ID NO: 621388 - RNA, 20 nt, Homo sapiens
uccccacaccucccuacucc

SEQ ID NO: 621389 - RNA, 19 nt, Homo sapiens
uccccacccaaacuuuauu

SEQ ID NO: 621390 - RNA, 18 nt, Homo sapiens
uccccacccugucuucca

SEQ ID NO: 621391 - RNA, 17 nt, Homo sapiens
uccccacgaacuggccu

SEQ ID NO: 621392 - RNA, 18 nt, Homo sapiens
uccccacuccacccuguu

SEQ ID NO: 621393 - RNA, 21 nt, Homo sapiens
uccccacucccgaaagccuuu

SEQ ID NO: 621394 - RNA, 13 nt, Homo sapiens
uccccacugccug

SEQ ID NO: 621395 - RNA, 15 nt, Homo sapiens
uccccacugcucauu

SEQ ID NO: 621396 - RNA, 22 nt, Homo sapiens
uccccacugcucucugugguga

SEQ ID NO: 621397 - RNA, 17 nt, Homo sapiens
uccccacugcugagcug

SEQ ID NO: 621398 - RNA, 20 nt, Homo sapiens
uccccacuuacagaucuauc

SEQ ID NO: 621399 - RNA, 13 nt, Homo sapiens
uccccagagcugu

SEQ ID NO: 621400 - RNA, 19 nt, Homo sapiens
uccccagccugcucccuag

SEQ ID NO: 621401 - RNA, 22 nt, Homo sapiens
uccccaggagcagcaucucuga

SEQ ID NO: 621402 - RNA, 15 nt, Homo sapiens
uccccaggcauuugc

SEQ ID NO: 621403 - RNA, 16 nt, Homo sapiens
uccccagguguguugg

SEQ ID NO: 621404 - RNA, 13 nt, Homo sapiens
uccccagucccag

SEQ ID NO: 621405 - RNA, 17 nt, Homo sapiens
uccccaucauuacuggu

SEQ ID NO: 621406 - RNA, 20 nt, Homo sapiens
uccccaucauuacugguaaa

SEQ ID NO: 621407 - RNA, 16 nt, Homo sapiens
uccccauccuccagcu

SEQ ID NO: 621408 - RNA, 12 nt, Homo sapiens
uccccauuucag

SEQ ID NO: 621409 - RNA, 19 nt, Homo sapiens
uccccauuuccacuguaua

SEQ ID NO: 621410 - RNA, 17 nt, Homo sapiens
ucccccagcagccuggg

SEQ ID NO: 621411 - RNA, 19 nt, Homo sapiens
ucccccauucgaacuuaac

SEQ ID NO: 621412 - RNA, 16 nt, Homo sapiens
ucccccucucacgcca

SEQ ID NO: 621413 - RNA, 17 nt, Homo sapiens
ucccccucucugcccug

SEQ ID NO: 621414 - RNA, 14 nt, Homo sapiens
ucccccucuuugca

SEQ ID NO: 621415 - RNA, 17 nt, Homo sapiens
uccccgagaacuuucug

SEQ ID NO: 621416 - RNA, 22 nt, Homo sapiens
uccccgccuccucccacuggga

SEQ ID NO: 621417 - RNA, 22 nt, Homo sapiens
uccccggcacugcagucugcag

SEQ ID NO: 621418 - RNA, 14 nt, Homo sapiens
uccccgggggagga

SEQ ID NO: 621419 - RNA, 14 nt, Homo sapiens
uccccgugccaaaa

SEQ ID NO: 621420 - RNA, 15 nt, Homo sapiens
uccccuaaaccaaaa

SEQ ID NO: 621421 - RNA, 16 nt, Homo sapiens
uccccuaaaccaaaaa

SEQ ID NO: 621422 - RNA, 14 nt, Homo sapiens
uccccuacucugcc

SEQ ID NO: 621423 - RNA, 14 nt, Homo sapiens
uccccucacucugu

SEQ ID NO: 621424 - RNA, 20 nt, Homo sapiens
ucuuguauacacauauauac

SEQ ID NO: 621425 - RNA, 16 nt, Homo sapiens
ucuuguuacugcugau

SEQ ID NO: 621426 - RNA, 18 nt, Homo sapiens
ucuuguuauugaaguguu

SEQ ID NO: 621427 - RNA, 17 nt, Homo sapiens
ucuuguuccccacugac

SEQ ID NO: 621428 - RNA, 16 nt, Homo sapiens
ucuuguugagugccag

SEQ ID NO: 621429 - RNA, 18 nt, Homo sapiens
ucuuguuguuauucagaa

SEQ ID NO: 621430 - RNA, 17 nt, Homo sapiens
ucuuguuuaacauauau

SEQ ID NO: 621431 - RNA, 20 nt, Homo sapiens
ucuuuaaacugguuguucug

SEQ ID NO: 621432 - RNA, 14 nt, Homo sapiens
ucuuuaaaggcauc

SEQ ID NO: 621433 - RNA, 15 nt, Homo sapiens
ucuuuaacuguguga

SEQ ID NO: 621434 - RNA, 13 nt, Homo sapiens
ucuuuaaggcaua

SEQ ID NO: 621435 - RNA, 18 nt, Homo sapiens
ucuuuaaguuuugauuaa

SEQ ID NO: 621436 - RNA, 18 nt, Homo sapiens
ucuuuaauuuuaacugau

SEQ ID NO: 621437 - RNA, 20 nt, Homo sapiens
ucuuuacaaaacuacaugag

SEQ ID NO: 621438 - RNA, 17 nt, Homo sapiens
ucuuuacaaagaaaaaa

SEQ ID NO: 621439 - RNA, 13 nt, Homo sapiens
ucuuuacagaaug

SEQ ID NO: 621440 - RNA, 19 nt, Homo sapiens
ucuuuagaaggacucagua

SEQ ID NO: 621441 - RNA, 14 nt, Homo sapiens
ucuuuagaugccaa

SEQ ID NO: 621442 - RNA, 16 nt, Homo sapiens
ucuuuagcaguguauu

SEQ ID NO: 621443 - RNA, 18 nt, Homo sapiens
ucuuuagcuauuacugga

SEQ ID NO: 621444 - RNA, 15 nt, Homo sapiens
ucuuuauacagauuu

SEQ ID NO: 621445 - RNA, 20 nt, Homo sapiens
ucuuuauauuuuuagccuaa

SEQ ID NO: 621446 - RNA, 19 nt, Homo sapiens
ucuuuaucaugaagcacau

SEQ ID NO: 621447 - RNA, 16 nt, Homo sapiens
ucuuuaucauugcuaa

SEQ ID NO: 621448 - RNA, 12 nt, Homo sapiens
ucuuuaugaucu

SEQ ID NO: 621449 - RNA, 14 nt, Homo sapiens
ucuuuauugcacua

SEQ ID NO: 621450 - RNA, 16 nt, Homo sapiens
ucuuuauuuuuugcca

SEQ ID NO: 621451 - RNA, 22 nt, Homo sapiens
ucuuucacacggcacauuugga

SEQ ID NO: 621452 - RNA, 21 nt, Homo sapiens
ucuuucaguggcuaccuacau

SEQ ID NO: 621453 - RNA, 18 nt, Homo sapiens
ucuuuccaaaacauuucu

SEQ ID NO: 621454 - RNA, 15 nt, Homo sapiens
ucuuuccacucugga

SEQ ID NO: 621455 - RNA, 15 nt, Homo sapiens
ucuuuccaggcuucc

SEQ ID NO: 621456 - RNA, 22 nt, Homo sapiens
ucuuuccaggcuucccugacuu

SEQ ID NO: 621457 - RNA, 17 nt, Homo sapiens
ucuuucccaauucacau

SEQ ID NO: 621458 - RNA, 15 nt, Homo sapiens
ucuuucccacuccua

SEQ ID NO: 621459 - RNA, 23 nt, Homo sapiens
ucuuuccccaaaaauugacuuag

SEQ ID NO: 621460 - RNA, 21 nt, Homo sapiens
ucuuuccgacacauuuaccaa

SEQ ID NO: 621461 - RNA, 16 nt, Homo sapiens
ucuuuccuaaagccaa

SEQ ID NO: 621462 - RNA, 16 nt, Homo sapiens
ucuuuccucuuucugc

SEQ ID NO: 621463 - RNA, 20 nt, Homo sapiens
ucuuuccugaaccaugugga

SEQ ID NO: 621464 - RNA, 14 nt, Homo sapiens
ucuuuccuggcacu

SEQ ID NO: 621465 - RNA, 22 nt, Homo sapiens
ucuuucggggugcuccuguggg

SEQ ID NO: 621466 - RNA, 21 nt, Homo sapiens
ucuuucuauuuaugcaacuca

SEQ ID NO: 621467 - RNA, 17 nt, Homo sapiens
ucuuucucuacuuugag

SEQ ID NO: 621468 - RNA, 15 nt, Homo sapiens
ucuuucucugaggac

SEQ ID NO: 621469 - RNA, 15 nt, Homo sapiens
ucuuucugccaacuu

SEQ ID NO: 621470 - RNA, 17 nt, Homo sapiens
ucuuucuggaaaggaaa

SEQ ID NO: 621471 - RNA, 19 nt, Homo sapiens
ucuuucugucugcuuuaaa

SEQ ID NO: 621472 - RNA, 13 nt, Homo sapiens
ucuuucuuucugc

SEQ ID NO: 621473 - RNA, 15 nt, Homo sapiens
ucuuugaagaaaaga

SEQ ID NO: 621474 - RNA, 17 nt, Homo sapiens
ucuuugaagagauuuca

SEQ ID NO: 621475 - RNA, 20 nt, Homo sapiens
ucuuugaagcgagcagucag

SEQ ID NO: 621476 - RNA, 14 nt, Homo sapiens
ucuuugacaacuaa

SEQ ID NO: 621477 - RNA, 17 nt, Homo sapiens
ucuuugacaucauucau

SEQ ID NO: 621478 - RNA, 21 nt, Homo sapiens
ucuuugacauuuggugguacu

SEQ ID NO: 621479 - RNA, 18 nt, Homo sapiens
ucuuugaucuggacagaa

SEQ ID NO: 621480 - RNA, 16 nt, Homo sapiens
ucuuugauuauuugca

SEQ ID NO: 621481 - RNA, 19 nt, Homo sapiens
ucuuugauuuguaccauuc

SEQ ID NO: 621482 - RNA, 17 nt, Homo sapiens
ucuuugcaccaaagaca

SEQ ID NO: 621483 - RNA, 20 nt, Homo sapiens
ucuuugcaccaaagacauca

SEQ ID NO: 621484 - RNA, 18 nt, Homo sapiens
ucuuugcagagccuuuua

SEQ ID NO: 621485 - RNA, 16 nt, Homo sapiens
ucuuugcucauggcaa

SEQ ID NO: 621486 - RNA, 22 nt, Homo sapiens
ucuuugcucauggcaacaguua

SEQ ID NO: 621487 - RNA, 12 nt, Homo sapiens
ucuuugcugcug

SEQ ID NO: 621488 - RNA, 16 nt, Homo sapiens
ucuuuggacaaccaug

SEQ ID NO: 621489 - RNA, 17 nt, Homo sapiens
ucuuuggaggugcugcu

SEQ ID NO: 621490 - RNA, 19 nt, Homo sapiens
ucuuuggaucagucuuugu

SEQ ID NO: 621491 - RNA, 22 nt, Homo sapiens
ucuuuggccccuggacuauggu

SEQ ID NO: 621492 - RNA, 16 nt, Homo sapiens
ucuuuggguccauuca

SEQ ID NO: 621493 - RNA, 19 nt, Homo sapiens
ucuuuguaaugucaccacc

SEQ ID NO: 621494 - RNA, 17 nt, Homo sapiens
ucuuugucuuaucuggc

SEQ ID NO: 621495 - RNA, 18 nt, Homo sapiens
ucuuugugauaauucuca

SEQ ID NO: 621496 - RNA, 23 nt, Homo sapiens
ucuuugugcaguguuaguauuca

SEQ ID NO: 621497 - RNA, 13 nt, Homo sapiens
ucuuugugugaca

SEQ ID NO: 621498 - RNA, 13 nt, Homo sapiens
ucuuugugugauu

SEQ ID NO: 621499 - RNA, 17 nt, Homo sapiens
ucuuuguugauguuuag

SEQ ID NO: 621500 - RNA, 22 nt, Homo sapiens
ucuuuuaaaauauccuguaacu

SEQ ID NO: 621501 - RNA, 16 nt, Homo sapiens
ucuuuuacauucugca

SEQ ID NO: 621502 - RNA, 18 nt, Homo sapiens
ucuuuuaggccaaggaaa

SEQ ID NO: 621503 - RNA, 14 nt, Homo sapiens
ucuuuucaaugugu

SEQ ID NO: 621504 - RNA, 19 nt, Homo sapiens
ucuuuucauaucucuugcc

SEQ ID NO: 621505 - RNA, 19 nt, Homo sapiens
ucuuuuccugaccaaucuu

SEQ ID NO: 621506 - RNA, 21 nt, Homo sapiens
ucuuuucuggaauguaaucaa

SEQ ID NO: 621507 - RNA, 13 nt, Homo sapiens
ucuuuuguucucu

SEQ ID NO: 621508 - RNA, 12 nt, Homo sapiens
ucuuuuuauuaa

SEQ ID NO: 621509 - RNA, 19 nt, Homo sapiens
ucuuuuuauuaacaguaua

SEQ ID NO: 621510 - RNA, 22 nt, Homo sapiens
ugaaaaaaaauuuuauaguguc

SEQ ID NO: 621511 - RNA, 19 nt, Homo sapiens
ugaaaaaaaguacauguau

SEQ ID NO: 621512 - RNA, 16 nt, Homo sapiens
ugaaaaaaaugcauuu

SEQ ID NO: 621513 - RNA, 17 nt, Homo sapiens
ugaaaaaauagauccaa

SEQ ID NO: 621514 - RNA, 15 nt, Homo sapiens
ugaaaaacaaaaugg

SEQ ID NO: 621515 - RNA, 19 nt, Homo sapiens
ugaaaaacagaaagcaucc

SEQ ID NO: 621516 - RNA, 23 nt, Homo sapiens
ugaaaaaguauaaauaaaaugag

SEQ ID NO: 621517 - RNA, 16 nt, Homo sapiens
ugaaaaauaugugcuu

SEQ ID NO: 621518 - RNA, 15 nt, Homo sapiens
ugaaaaauauugcua

SEQ ID NO: 621519 - RNA, 17 nt, Homo sapiens
ugaaaaauauugcuaaa

SEQ ID NO: 621520 - RNA, 18 nt, Homo sapiens
ugaaaaaucggcuuacca

SEQ ID NO: 621521 - RNA, 14 nt, Homo sapiens
ugaaaaaucuaagu

SEQ ID NO: 621522 - RNA, 12 nt, Homo sapiens
ugaaaaaugcuc

SEQ ID NO: 621523 - RNA, 19 nt, Homo sapiens
ugaaaaaugcucaaucuca

SEQ ID NO: 621524 - RNA, 19 nt, Homo sapiens
ugaaaaauggcaaagaauu

SEQ ID NO: 621525 - RNA, 22 nt, Homo sapiens
ugaaaaauguaaauacucauga

SEQ ID NO: 621526 - RNA, 13 nt, Homo sapiens
ugaaaacagauga

SEQ ID NO: 621527 - RNA, 17 nt, Homo sapiens
ugaaaacauaaucugca

SEQ ID NO: 621528 - RNA, 21 nt, Homo sapiens
ugaaaacauagcaucucagga

SEQ ID NO: 621529 - RNA, 11 nt, Homo sapiens
ugaaaaccaua

SEQ ID NO: 621530 - RNA, 22 nt, Homo sapiens
ugaaaacugugcaauguauuaa

SEQ ID NO: 621531 - RNA, 14 nt, Homo sapiens
ugaaaacuucaaag

SEQ ID NO: 621532 - RNA, 13 nt, Homo sapiens
ugaaaacuuguaa

SEQ ID NO: 621533 - RNA, 21 nt, Homo sapiens
ugaaaagaaaaccacagcagg

SEQ ID NO: 621534 - RNA, 17 nt, Homo sapiens
ugaaaagacucaguguu

SEQ ID NO: 621535 - RNA, 14 nt, Homo sapiens
ugaaaagaguaugu

SEQ ID NO: 621536 - RNA, 15 nt, Homo sapiens
ugaaaagcaauacaa

SEQ ID NO: 621537 - RNA, 20 nt, Homo sapiens
ugaaaagcacacacaauaaa

SEQ ID NO: 621538 - RNA, 12 nt, Homo sapiens
ugaaaagcacag

SEQ ID NO: 621539 - RNA, 17 nt, Homo sapiens
ugaaaagcacagccuca

SEQ ID NO: 621540 - RNA, 21 nt, Homo sapiens
ugaaaagcuagaauugagugu

SEQ ID NO: 621541 - RNA, 21 nt, Homo sapiens
ugaaaaggauauuaucuaccu

SEQ ID NO: 621542 - RNA, 23 nt, Homo sapiens
ugaaaaggauauuaucuaccugu

SEQ ID NO: 621543 - RNA, 20 nt, Homo sapiens
ugaaaaggugauugucacca

SEQ ID NO: 621544 - RNA, 12 nt, Homo sapiens
ugaaaagugaag

SEQ ID NO: 621545 - RNA, 16 nt, Homo sapiens
ugaaaauaauguugua

SEQ ID NO: 621546 - RNA, 14 nt, Homo sapiens
ugagaagccuucag

SEQ ID NO: 621547 - RNA, 18 nt, Homo sapiens
ugagaagccuucagcucc

SEQ ID NO: 621548 - RNA, 14 nt, Homo sapiens
ugagaaggcaaaag

SEQ ID NO: 621549 - RNA, 22 nt, Homo sapiens
ugagaaggcaaaagaaagaacc

SEQ ID NO: 621550 - RNA, 16 nt, Homo sapiens
ugagaagugcacuuua

SEQ ID NO: 621551 - RNA, 22 nt, Homo sapiens
ugagaauacauaaacaacgcau

SEQ ID NO: 621552 - RNA, 15 nt, Homo sapiens
ugagaaucagacuga

SEQ ID NO: 621553 - RNA, 19 nt, Homo sapiens
ugagaaugagggccaagaa

SEQ ID NO: 621554 - RNA, 11 nt, Homo sapiens
ugagacaaaga

SEQ ID NO: 621555 - RNA, 14 nt, Homo sapiens
ugagacaacaguac

SEQ ID NO: 621556 - RNA, 16 nt, Homo sapiens
ugagacaccugaugac

SEQ ID NO: 621557 - RNA, 16 nt, Homo sapiens
ugagacacugcacaga

SEQ ID NO: 621558 - RNA, 12 nt, Homo sapiens
ugagacagacua

SEQ ID NO: 621559 - RNA, 18 nt, Homo sapiens
ugagacaggaaaaaccaa

SEQ ID NO: 621560 - RNA, 15 nt, Homo sapiens
ugagacagggucuca

SEQ ID NO: 621561 - RNA, 14 nt, Homo sapiens
ugagacauuuacau

SEQ ID NO: 621562 - RNA, 15 nt, Homo sapiens
ugagaccaaccuggg

SEQ ID NO: 621563 - RNA, 15 nt, Homo sapiens
ugagaccacaggcuu

SEQ ID NO: 621564 - RNA, 17 nt, Homo sapiens
ugagaccacuguuauca

SEQ ID NO: 621565 - RNA, 16 nt, Homo sapiens
ugagacuaugcaaaag

SEQ ID NO: 621566 - RNA, 14 nt, Homo sapiens
ugagacucacagga

SEQ ID NO: 621567 - RNA, 23 nt, Homo sapiens
ugagagagggagggaacagugcc

SEQ ID NO: 621568 - RNA, 18 nt, Homo sapiens
ugagagaugcagaaauau

SEQ ID NO: 621569 - RNA, 17 nt, Homo sapiens
ugagagcacccacugaa

SEQ ID NO: 621570 - RNA, 22 nt, Homo sapiens
ugagagcauugggauaucuccu

SEQ ID NO: 621571 - RNA, 16 nt, Homo sapiens
ugagagcuuugcuuau

SEQ ID NO: 621572 - RNA, 20 nt, Homo sapiens
ugagaggagaacaguaggau

SEQ ID NO: 621573 - RNA, 22 nt, Homo sapiens
ugagaggcaggaauggggguca

SEQ ID NO: 621574 - RNA, 19 nt, Homo sapiens
ugagagggaaucgacugua

SEQ ID NO: 621575 - RNA, 23 nt, Homo sapiens
ugagagggagggcugcugccaca

SEQ ID NO: 621576 - RNA, 13 nt, Homo sapiens
ugagaggugacac

SEQ ID NO: 621577 - RNA, 23 nt, Homo sapiens
ugagaguacucacuuuucacuug

SEQ ID NO: 621578 - RNA, 13 nt, Homo sapiens
ugagagucagggu

SEQ ID NO: 621579 - RNA, 21 nt, Homo sapiens
ugagauacaagucauccaugc

SEQ ID NO: 621580 - RNA, 19 nt, Homo sapiens
ugagauacuuuacuaauaa

SEQ ID NO: 621581 - RNA, 17 nt, Homo sapiens
ugagauagcauugugaa

SEQ ID NO: 621582 - RNA, 21 nt, Homo sapiens
ugagauaguuuucauccauaa

SEQ ID NO: 621583 - RNA, 13 nt, Homo sapiens
ugagauauggacu

SEQ ID NO: 621584 - RNA, 16 nt, Homo sapiens
ugagaucacagccucc

SEQ ID NO: 621585 - RNA, 23 nt, Homo sapiens
ugagaucacuaaauaagcuucca

SEQ ID NO: 621586 - RNA, 20 nt, Homo sapiens
ugagaugauuuccaagccuc

SEQ ID NO: 621587 - RNA, 16 nt, Homo sapiens
ugagaugccuguugaa

SEQ ID NO: 621588 - RNA, 20 nt, Homo sapiens
ugagaugcuucuggcuccca

SEQ ID NO: 621589 - RNA, 17 nt, Homo sapiens
ugagauggagugagcug

SEQ ID NO: 621590 - RNA, 17 nt, Homo sapiens
ugagaugguauauccuu

SEQ ID NO: 621591 - RNA, 17 nt, Homo sapiens
ugagauguuauuacugu

SEQ ID NO: 621592 - RNA, 17 nt, Homo sapiens
ugagauucaauauugaa

SEQ ID NO: 621593 - RNA, 22 nt, Homo sapiens
ugagauucuucguguauagcug

SEQ ID NO: 621594 - RNA, 16 nt, Homo sapiens
ugagauuuugcaaucu

SEQ ID NO: 621595 - RNA, 14 nt, Homo sapiens
ugagcaaaggugau

SEQ ID NO: 621596 - RNA, 14 nt, Homo sapiens
ugagcaaauaucau

SEQ ID NO: 621597 - RNA, 13 nt, Homo sapiens
ugagcaaccagcu

SEQ ID NO: 621598 - RNA, 17 nt, Homo sapiens
ugagcaaccgcuucccu

SEQ ID NO: 621599 - RNA, 16 nt, Homo sapiens
ugagcaacucuugauu

SEQ ID NO: 621600 - RNA, 16 nt, Homo sapiens
ugagcaagacauacuu

SEQ ID NO: 621601 - RNA, 18 nt, Homo sapiens
ugagcaagacauacuuaa

SEQ ID NO: 621602 - RNA, 14 nt, Homo sapiens
ugagcaauggagug

SEQ ID NO: 621603 - RNA, 18 nt, Homo sapiens
ugagcacagcugcauuaa

SEQ ID NO: 621604 - RNA, 19 nt, Homo sapiens
ugagcacaucucucugccc

SEQ ID NO: 621605 - RNA, 16 nt, Homo sapiens
ugagcacccauuccaa

SEQ ID NO: 621606 - RNA, 15 nt, Homo sapiens
ugagcacuguuuaua

SEQ ID NO: 621607 - RNA, 22 nt, Homo sapiens
ugagcacuguuuauacacugug

SEQ ID NO: 621608 - RNA, 18 nt, Homo sapiens
ugagcagaaguggagcug

SEQ ID NO: 621609 - RNA, 20 nt, Homo sapiens
ugagcagggagaccaugccu

SEQ ID NO: 621610 - RNA, 19 nt, Homo sapiens
ugagcaguggacacgugag

SEQ ID NO: 621611 - RNA, 20 nt, Homo sapiens
ugagcauuacuauucacuga

SEQ ID NO: 621612 - RNA, 20 nt, Homo sapiens
ugagccaaaaugacuuugaa

SEQ ID NO: 621613 - RNA, 20 nt, Homo sapiens
ugagccaccgugcccggcca

SEQ ID NO: 621614 - RNA, 15 nt, Homo sapiens
ugagccacuccuucc

SEQ ID NO: 621615 - RNA, 22 nt, Homo sapiens
ugagccagccuugcaguaggca

SEQ ID NO: 621616 - RNA, 17 nt, Homo sapiens
ugagccaguaaucuuua

SEQ ID NO: 621617 - RNA, 15 nt, Homo sapiens
ugagccaugcuacag

SEQ ID NO: 621618 - RNA, 22 nt, Homo sapiens
ugagcccagaucaccaccugaa

SEQ ID NO: 621619 - RNA, 20 nt, Homo sapiens
ugagccccuggaggcacuga

SEQ ID NO: 621620 - RNA, 15 nt, Homo sapiens
ugagccuccaugccu

SEQ ID NO: 621621 - RNA, 20 nt, Homo sapiens
ugagccuuggcccacacuga

SEQ ID NO: 621622 - RNA, 18 nt, Homo sapiens
ugagcgaaauugucuuua

SEQ ID NO: 621623 - RNA, 18 nt, Homo sapiens
ugagcgacuuaaaaugau

SEQ ID NO: 621624 - RNA, 14 nt, Homo sapiens
ugagcgagugucca

SEQ ID NO: 621625 - RNA, 14 nt, Homo sapiens
ugagcuacuucaaa

SEQ ID NO: 621626 - RNA, 23 nt, Homo sapiens
ugagcuaugauuacaccacugca

SEQ ID NO: 621627 - RNA, 18 nt, Homo sapiens
ugagcuauugcuguucuc

SEQ ID NO: 621628 - RNA, 17 nt, Homo sapiens
ugagcuccccagaucuc

SEQ ID NO: 621629 - RNA, 18 nt, Homo sapiens
ugagcuccccagaucucc

SEQ ID NO: 621630 - RNA, 23 nt, Homo sapiens
ugagcuccuuguuuuugccaaag

SEQ ID NO: 621631 - RNA, 15 nt, Homo sapiens
ugagcucggggucca

SEQ ID NO: 621632 - RNA, 21 nt, Homo sapiens
ugagcugagacagauaagaga

SEQ ID NO: 621633 - RNA, 16 nt, Homo sapiens
ugagcugagugcugaa

SEQ ID NO: 621634 - RNA, 23 nt, Homo sapiens
ugagcugcaucccugcuccccac

SEQ ID NO: 621635 - RNA, 12 nt, Homo sapiens
ugagcugggaag

SEQ ID NO: 621636 - RNA, 18 nt, Homo sapiens
ugagcugggagcccggca

SEQ ID NO: 621637 - RNA, 20 nt, Homo sapiens
ugagcuggggacucagggac

SEQ ID NO: 621638 - RNA, 14 nt, Homo sapiens
ugagcuuagugaaa

SEQ ID NO: 621639 - RNA, 15 nt, Homo sapiens
ugagcuucaauauaa

SEQ ID NO: 621640 - RNA, 14 nt, Homo sapiens
ugagcuucugagac

SEQ ID NO: 621641 - RNA, 23 nt, Homo sapiens
ugagcuuggccagaagggggcca

SEQ ID NO: 621642 - RNA, 21 nt, Homo sapiens
ugaggaaauauuuccauuaac

SEQ ID NO: 621643 - RNA, 20 nt, Homo sapiens
ugaggaagaguuuauggcaa

SEQ ID NO: 621644 - RNA, 16 nt, Homo sapiens
ugaggaaggaacagca

SEQ ID NO: 621645 - RNA, 16 nt, Homo sapiens
ugaggaagucacuuua

SEQ ID NO: 621646 - RNA, 16 nt, Homo sapiens
ugaggaagugaacauu

SEQ ID NO: 621647 - RNA, 13 nt, Homo sapiens
ugaggaauccaaa

SEQ ID NO: 621648 - RNA, 13 nt, Homo sapiens
ugaggaauggagg

SEQ ID NO: 621649 - RNA, 18 nt, Homo sapiens
ugaggacagaccacagag

SEQ ID NO: 621650 - RNA, 12 nt, Homo sapiens
ugaggacugugg

SEQ ID NO: 621651 - RNA, 15 nt, Homo sapiens
ugaggacuucuugcu

SEQ ID NO: 621652 - RNA, 14 nt, Homo sapiens
ugaggagacuauga

SEQ ID NO: 621653 - RNA, 18 nt, Homo sapiens
ugaggagaugcggccaaa

SEQ ID NO: 621654 - RNA, 16 nt, Homo sapiens
ugaggagcugcacuga

SEQ ID NO: 621655 - RNA, 12 nt, Homo sapiens
ugaggaggacaa

SEQ ID NO: 621656 - RNA, 16 nt, Homo sapiens
ugaggaggaugucccu

SEQ ID NO: 621657 - RNA, 16 nt, Homo sapiens
ugaggagugaggaaua

SEQ ID NO: 621658 - RNA, 22 nt, Homo sapiens
ugaggaugacagugacacccag

SEQ ID NO: 621659 - RNA, 15 nt, Homo sapiens
ugaggaugagcugga

SEQ ID NO: 621660 - RNA, 18 nt, Homo sapiens
ugaggcaauuagacacuu

SEQ ID NO: 621661 - RNA, 22 nt, Homo sapiens
ugaggcagacagcagcucaggc

SEQ ID NO: 621662 - RNA, 22 nt, Homo sapiens
ugaggcaggagaauggcgugaa

SEQ ID NO: 621663 - RNA, 13 nt, Homo sapiens
ugaggcaugacua

SEQ ID NO: 621664 - RNA, 16 nt, Homo sapiens
ugaggcauuuccagac

SEQ ID NO: 621665 - RNA, 19 nt, Homo sapiens
ugaggccaucucaggagau

SEQ ID NO: 621666 - RNA, 11 nt, Homo sapiens
ugaggcccaag

SEQ ID NO: 621667 - RNA, 15 nt, Homo sapiens
ugaggcccagugcau

SEQ ID NO: 621668 - RNA, 20 nt, Homo sapiens
ugcaccccaaagcuuuccug

SEQ ID NO: 621669 - RNA, 18 nt, Homo sapiens
ugcaccccaauugggaau

SEQ ID NO: 621670 - RNA, 14 nt, Homo sapiens
ugcaccguccucag

SEQ ID NO: 621671 - RNA, 18 nt, Homo sapiens
ugcaccuacccacaugca

SEQ ID NO: 621672 - RNA, 12 nt, Homo sapiens
ugcaccuaccuu

SEQ ID NO: 621673 - RNA, 21 nt, Homo sapiens
ugcaccuacgggggcaucuga

SEQ ID NO: 621674 - RNA, 16 nt, Homo sapiens
ugcaccugccagccug

SEQ ID NO: 621675 - RNA, 18 nt, Homo sapiens
ugcaccuguacucaggag

SEQ ID NO: 621676 - RNA, 15 nt, Homo sapiens
ugcaccugugcauuu

SEQ ID NO: 621677 - RNA, 20 nt, Homo sapiens
ugcaccuuaccaacuuucug

SEQ ID NO: 621678 - RNA, 13 nt, Homo sapiens
ugcaccuuugcac

SEQ ID NO: 621679 - RNA, 19 nt, Homo sapiens
ugcacgaccgccccaguuc

SEQ ID NO: 621680 - RNA, 15 nt, Homo sapiens
ugcacguaacacucc

SEQ ID NO: 621681 - RNA, 17 nt, Homo sapiens
ugcacgucuugcuauuu

SEQ ID NO: 621682 - RNA, 17 nt, Homo sapiens
ugcacguggccucuuga

SEQ ID NO: 621683 - RNA, 12 nt, Homo sapiens
ugcacgugugca

SEQ ID NO: 621684 - RNA, 16 nt, Homo sapiens
ugcacguugcuucagg

SEQ ID NO: 621685 - RNA, 14 nt, Homo sapiens
ugcacuaaagccag

SEQ ID NO: 621686 - RNA, 19 nt, Homo sapiens
ugcacuaaagccagccuga

SEQ ID NO: 621687 - RNA, 15 nt, Homo sapiens
ugcacuagccuguga

SEQ ID NO: 621688 - RNA, 14 nt, Homo sapiens
ugcacuagugcaau

SEQ ID NO: 621689 - RNA, 16 nt, Homo sapiens
ugcacucauguggacu

SEQ ID NO: 621690 - RNA, 16 nt, Homo sapiens
ugcacuccagccuggg

SEQ ID NO: 621691 - RNA, 19 nt, Homo sapiens
ugcacuccagccugggcaa

SEQ ID NO: 621692 - RNA, 22 nt, Homo sapiens
ugcacuccagccugggggacag

SEQ ID NO: 621693 - RNA, 18 nt, Homo sapiens
ugcacuccucacacagaa

SEQ ID NO: 621694 - RNA, 18 nt, Homo sapiens
ugcacucuaaacugcaaa

SEQ ID NO: 621695 - RNA, 17 nt, Homo sapiens
ugcacucuuuaacacau

SEQ ID NO: 621696 - RNA, 15 nt, Homo sapiens
ugcacugacagccuu

SEQ ID NO: 621697 - RNA, 15 nt, Homo sapiens
ugcacugagggccac

SEQ ID NO: 621698 - RNA, 13 nt, Homo sapiens
ugcacugcauucc

SEQ ID NO: 621699 - RNA, 23 nt, Homo sapiens
ugcacugucugagaauuuccaaa

SEQ ID NO: 621700 - RNA, 23 nt, Homo sapiens
ugcacugugguuucagaugugca

SEQ ID NO: 621701 - RNA, 15 nt, Homo sapiens
ugcacuuauucaaua

SEQ ID NO: 621702 - RNA, 15 nt, Homo sapiens
ugcacuucaaauuca

SEQ ID NO: 621703 - RNA, 20 nt, Homo sapiens
ugcacuucuuacgacuuuuu

SEQ ID NO: 621704 - RNA, 15 nt, Homo sapiens
ugcacuugaacacug

SEQ ID NO: 621705 - RNA, 23 nt, Homo sapiens
ugcacuugcacgcccauguguga

SEQ ID NO: 621706 - RNA, 15 nt, Homo sapiens
ugcacuuguggcaac

SEQ ID NO: 621707 - RNA, 14 nt, Homo sapiens
ugcacuuugcucaa

SEQ ID NO: 621708 - RNA, 21 nt, Homo sapiens
ugcacuuuuagaaaugcauau

SEQ ID NO: 621709 - RNA, 15 nt, Homo sapiens
ugcagaacguauuua

SEQ ID NO: 621710 - RNA, 24 nt, Homo sapiens
ugcagaagcgcuccaguaucucca

SEQ ID NO: 621711 - RNA, 17 nt, Homo sapiens
ugcagaagucccaagac

SEQ ID NO: 621712 - RNA, 15 nt, Homo sapiens
ugcagaauggcauuu

SEQ ID NO: 621713 - RNA, 18 nt, Homo sapiens
ugcagaauggcauuugca

SEQ ID NO: 621714 - RNA, 14 nt, Homo sapiens
ugcagacaggccau

SEQ ID NO: 621715 - RNA, 18 nt, Homo sapiens
ugcagacaggcuggcauu

SEQ ID NO: 621716 - RNA, 12 nt, Homo sapiens
ugcagacuuccc

SEQ ID NO: 621717 - RNA, 13 nt, Homo sapiens
ugcagagcaauaa

SEQ ID NO: 621718 - RNA, 19 nt, Homo sapiens
ugcagaggucagacuaaga

SEQ ID NO: 621719 - RNA, 15 nt, Homo sapiens
ugcagagguccacaa

SEQ ID NO: 621720 - RNA, 12 nt, Homo sapiens
ugcagagucacu

SEQ ID NO: 621721 - RNA, 16 nt, Homo sapiens
ugcagaguccauuucc

SEQ ID NO: 621722 - RNA, 16 nt, Homo sapiens
ugcagcaaacacucca

SEQ ID NO: 621723 - RNA, 19 nt, Homo sapiens
ugcagcauuuuguauuugu

SEQ ID NO: 621724 - RNA, 16 nt, Homo sapiens
ugcagccaaaggggag

SEQ ID NO: 621725 - RNA, 13 nt, Homo sapiens
ugcagccacuggc

SEQ ID NO: 621726 - RNA, 14 nt, Homo sapiens
ugcagccagccaca

SEQ ID NO: 621727 - RNA, 17 nt, Homo sapiens
ugcagcccuugggcagu

SEQ ID NO: 621728 - RNA, 17 nt, Homo sapiens
ugcagcccuugugaugu

SEQ ID NO: 621729 - RNA, 18 nt, Homo sapiens
ugcagccuccccaggugu

SEQ ID NO: 621730 - RNA, 22 nt, Homo sapiens
ugcagcgacccuugguguuucc

SEQ ID NO: 621731 - RNA, 13 nt, Homo sapiens
ugcagcugucaca

SEQ ID NO: 621732 - RNA, 23 nt, Homo sapiens
ugcagcuucuaacugguaaaaag

SEQ ID NO: 621733 - RNA, 19 nt, Homo sapiens
ugcaggaaacauuucugac

SEQ ID NO: 621734 - RNA, 16 nt, Homo sapiens
ugcaggacaacucugu

SEQ ID NO: 621735 - RNA, 16 nt, Homo sapiens
ugcaggaccucaggug

SEQ ID NO: 621736 - RNA, 22 nt, Homo sapiens
ugcaggaccuugggcacaucug

SEQ ID NO: 621737 - RNA, 16 nt, Homo sapiens
ugcaggagugacucaa

SEQ ID NO: 621738 - RNA, 17 nt, Homo sapiens
ugcaggcaagugggaua

SEQ ID NO: 621739 - RNA, 19 nt, Homo sapiens
ugcaggccacugugagcgc

SEQ ID NO: 621740 - RNA, 22 nt, Homo sapiens
ugcaggccgugugucugucagc

SEQ ID NO: 621741 - RNA, 18 nt, Homo sapiens
ugcagggaagagggcagu

SEQ ID NO: 621742 - RNA, 19 nt, Homo sapiens
ugcagggaagagggcagua

SEQ ID NO: 621743 - RNA, 19 nt, Homo sapiens
ugcagggaaugcaauccuu

SEQ ID NO: 621744 - RNA, 12 nt, Homo sapiens
ugcagggagaca

SEQ ID NO: 621745 - RNA, 13 nt, Homo sapiens
ugcagggagcuca

SEQ ID NO: 621746 - RNA, 21 nt, Homo sapiens
ugcagggagcucaagcccuug

SEQ ID NO: 621747 - RNA, 18 nt, Homo sapiens
ugcagggauauugccuua

SEQ ID NO: 621748 - RNA, 12 nt, Homo sapiens
ugcagggcuccc

SEQ ID NO: 621749 - RNA, 20 nt, Homo sapiens
ugcaggguguguacugcaca

SEQ ID NO: 621750 - RNA, 20 nt, Homo sapiens
ugcagguuuguaaugcaaaa

SEQ ID NO: 621751 - RNA, 22 nt, Homo sapiens
ugcaguaaauuaucuugggaua

SEQ ID NO: 621752 - RNA, 19 nt, Homo sapiens
ugcaguacaagaaccucuc

SEQ ID NO: 621753 - RNA, 17 nt, Homo sapiens
ugcaguaugggaucuga

SEQ ID NO: 621754 - RNA, 14 nt, Homo sapiens
ugcagucacauuga

SEQ ID NO: 621755 - RNA, 14 nt, Homo sapiens
ugcagucaucuccc

SEQ ID NO: 621756 - RNA, 22 nt, Homo sapiens
ugcagucauuaugagaggcaau

SEQ ID NO: 621757 - RNA, 14 nt, Homo sapiens
ugcaguccuacuca

SEQ ID NO: 621758 - RNA, 17 nt, Homo sapiens
ugcaguccucaucucca

SEQ ID NO: 621759 - RNA, 20 nt, Homo sapiens
ugcagucggugguaccugag

SEQ ID NO: 621760 - RNA, 21 nt, Homo sapiens
ugcagucggugguaccugaga

SEQ ID NO: 621761 - RNA, 22 nt, Homo sapiens
ugcagucggugguaccugagau

SEQ ID NO: 621762 - RNA, 15 nt, Homo sapiens
ugcagucucccagau

SEQ ID NO: 621763 - RNA, 14 nt, Homo sapiens
ugcagugaauucau

SEQ ID NO: 621764 - RNA, 15 nt, Homo sapiens
ugcagugagcuauua

SEQ ID NO: 621765 - RNA, 16 nt, Homo sapiens
ugcagugaugcaauaa

SEQ ID NO: 621766 - RNA, 13 nt, Homo sapiens
ugcaguggcacaa

SEQ ID NO: 621767 - RNA, 17 nt, Homo sapiens
ugcaguggcacaaucuc

SEQ ID NO: 621768 - RNA, 18 nt, Homo sapiens
ugcaguggcgugaucucg

SEQ ID NO: 621769 - RNA, 18 nt, Homo sapiens
ugcaguggugugaucucg

SEQ ID NO: 621770 - RNA, 17 nt, Homo sapiens
ugcaguguggaguucac

SEQ ID NO: 621771 - RNA, 19 nt, Homo sapiens
ugcaguucaccugcacuua

SEQ ID NO: 621772 - RNA, 21 nt, Homo sapiens
ugcaguucaccugcacuuaag

SEQ ID NO: 621773 - RNA, 18 nt, Homo sapiens
ugcaguuccugaguaccu

SEQ ID NO: 621774 - RNA, 15 nt, Homo sapiens
ugcaguucugagcac

SEQ ID NO: 621775 - RNA, 16 nt, Homo sapiens
ugcaguuucauguaug

SEQ ID NO: 621776 - RNA, 17 nt, Homo sapiens
ugcaguuucuuuucaca

SEQ ID NO: 621777 - RNA, 13 nt, Homo sapiens
ugcaguuuugaca

SEQ ID NO: 621778 - RNA, 14 nt, Homo sapiens
ugcaguuuugacau

SEQ ID NO: 621779 - RNA, 22 nt, Homo sapiens
ugcauaaaugcgauccacagaa

SEQ ID NO: 621780 - RNA, 16 nt, Homo sapiens
ugcauaacgucugccu

SEQ ID NO: 621781 - RNA, 14 nt, Homo sapiens
ugcauaauaagcua

SEQ ID NO: 621782 - RNA, 23 nt, Homo sapiens
ugcauaccacuuuuguucuuggu

SEQ ID NO: 621783 - RNA, 18 nt, Homo sapiens
ugcauacuguugauacaa

SEQ ID NO: 621784 - RNA, 19 nt, Homo sapiens
ugcauacuuugacaaggaa

SEQ ID NO: 621785 - RNA, 21 nt, Homo sapiens
ugcauagcagaugguuuccac

SEQ ID NO: 621786 - RNA, 14 nt, Homo sapiens
ugcauaguauucca

SEQ ID NO: 621787 - RNA, 18 nt, Homo sapiens
ugcauauguaaagcacau

SEQ ID NO: 621788 - RNA, 15 nt, Homo sapiens
ugcauauuuagcuuu

SEQ ID NO: 621789 - RNA, 16 nt, Homo sapiens
ugcaucauguugaaua

SEQ ID NO: 621790 - RNA, 14 nt, Homo sapiens
ugccugcacuggaa

SEQ ID NO: 621791 - RNA, 22 nt, Homo sapiens
ugccugcagaggucugugcuga

SEQ ID NO: 621792 - RNA, 11 nt, Homo sapiens
ugccugccauu

SEQ ID NO: 621793 - RNA, 20 nt, Homo sapiens
ugccugccccccucaucuca

SEQ ID NO: 621794 - RNA, 15 nt, Homo sapiens
ugccugcgucuuccg

SEQ ID NO: 621795 - RNA, 15 nt, Homo sapiens
ugccugcuaauauga

SEQ ID NO: 621796 - RNA, 15 nt, Homo sapiens
ugccuggacacugua

SEQ ID NO: 621797 - RNA, 16 nt, Homo sapiens
ugccuggacacuguac

SEQ ID NO: 621798 - RNA, 17 nt, Homo sapiens
ugccuggcgagccucug

SEQ ID NO: 621799 - RNA, 11 nt, Homo sapiens
ugccugggaag

SEQ ID NO: 621800 - RNA, 22 nt, Homo sapiens
ugccugggccguggcacagcug

SEQ ID NO: 621801 - RNA, 19 nt, Homo sapiens
ugccugggccugugcagca

SEQ ID NO: 621802 - RNA, 22 nt, Homo sapiens
ugccuggggcccaaguugcagu

SEQ ID NO: 621803 - RNA, 22 nt, Homo sapiens
ugccuggggcggcaugaacccu

SEQ ID NO: 621804 - RNA, 23 nt, Homo sapiens
ugccuggguggccauccuaccca

SEQ ID NO: 621805 - RNA, 15 nt, Homo sapiens
ugccugguaccagag

SEQ ID NO: 621806 - RNA, 16 nt, Homo sapiens
ugccugguaccagagg

SEQ ID NO: 621807 - RNA, 11 nt, Homo sapiens
ugccuguguau

SEQ ID NO: 621808 - RNA, 20 nt, Homo sapiens
ugccuguuauaacucugcac

SEQ ID NO: 621809 - RNA, 20 nt, Homo sapiens
ugccuguucccauucuugca

SEQ ID NO: 621810 - RNA, 22 nt, Homo sapiens
ugccuguugcuuucuuccugca

SEQ ID NO: 621811 - RNA, 21 nt, Homo sapiens
ugccuuaaacacacauugcag

SEQ ID NO: 621812 - RNA, 16 nt, Homo sapiens
ugccuuaaacucuguu

SEQ ID NO: 621813 - RNA, 14 nt, Homo sapiens
ugccuuaagccagu

SEQ ID NO: 621814 - RNA, 18 nt, Homo sapiens
ugccuuagcaugugacuc

SEQ ID NO: 621815 - RNA, 17 nt, Homo sapiens
ugccuuagccucuugga

SEQ ID NO: 621816 - RNA, 14 nt, Homo sapiens
ugccuucacccaua

SEQ ID NO: 621817 - RNA, 23 nt, Homo sapiens
ugccuuccacgcugucuccagac

SEQ ID NO: 621818 - RNA, 16 nt, Homo sapiens
ugccuuccucucucua

SEQ ID NO: 621819 - RNA, 20 nt, Homo sapiens
ugccuuccucucucuaccag

SEQ ID NO: 621820 - RNA, 13 nt, Homo sapiens
ugccuuccucuga

SEQ ID NO: 621821 - RNA, 15 nt, Homo sapiens
ugccuuccugccucu

SEQ ID NO: 621822 - RNA, 18 nt, Homo sapiens
ugccuucuaggucacuuc

SEQ ID NO: 621823 - RNA, 13 nt, Homo sapiens
ugccuucuccuau

SEQ ID NO: 621824 - RNA, 21 nt, Homo sapiens
ugccuucuccuauuucuccaa

SEQ ID NO: 621825 - RNA, 16 nt, Homo sapiens
ugccuucuuauugcuu

SEQ ID NO: 621826 - RNA, 18 nt, Homo sapiens
ugccuuuaaaucugugau

SEQ ID NO: 621827 - RNA, 21 nt, Homo sapiens
ugccuuuagggguguguauuc

SEQ ID NO: 621828 - RNA, 20 nt, Homo sapiens
ugccuuucugguggcuuuuu

SEQ ID NO: 621829 - RNA, 17 nt, Homo sapiens
ugccuuucuucugcccu

SEQ ID NO: 621830 - RNA, 16 nt, Homo sapiens
ugccuuugaccaucuc

SEQ ID NO: 621831 - RNA, 17 nt, Homo sapiens
ugccuuuguaaguuauu

SEQ ID NO: 621832 - RNA, 18 nt, Homo sapiens
ugccuuuuuuaacuugag

SEQ ID NO: 621833 - RNA, 23 nt, Homo sapiens
ugccuuuuuuuuaaggagcaaaa

SEQ ID NO: 621834 - RNA, 12 nt, Homo sapiens
ugcgaaagggac

SEQ ID NO: 621835 - RNA, 18 nt, Homo sapiens
ugcgaaaguaaaaacacu

SEQ ID NO: 621836 - RNA, 16 nt, Homo sapiens
ugcgaaccuaugucua

SEQ ID NO: 621837 - RNA, 13 nt, Homo sapiens
ugcgaaugugcag

SEQ ID NO: 621838 - RNA, 19 nt, Homo sapiens
ugcgacagcuugugauucc

SEQ ID NO: 621839 - RNA, 17 nt, Homo sapiens
ugcgaccgugaccagga

SEQ ID NO: 621840 - RNA, 13 nt, Homo sapiens
ugcgagacucuga

SEQ ID NO: 621841 - RNA, 14 nt, Homo sapiens
ugcgagacucugau

SEQ ID NO: 621842 - RNA, 14 nt, Homo sapiens
ugcgaggacaucaa

SEQ ID NO: 621843 - RNA, 15 nt, Homo sapiens
ugcgaggacaucaaa

SEQ ID NO: 621844 - RNA, 17 nt, Homo sapiens
ugcgagggccacagccc

SEQ ID NO: 621845 - RNA, 13 nt, Homo sapiens
ugcgaggggccag

SEQ ID NO: 621846 - RNA, 16 nt, Homo sapiens
ugcgagugugugcaug

SEQ ID NO: 621847 - RNA, 16 nt, Homo sapiens
ugcgaugggggucacc

SEQ ID NO: 621848 - RNA, 15 nt, Homo sapiens
ugcgcaauguggcau

SEQ ID NO: 621849 - RNA, 17 nt, Homo sapiens
ugcgcccaguccuucca

SEQ ID NO: 621850 - RNA, 18 nt, Homo sapiens
ugcgcccaguccuuccac

SEQ ID NO: 621851 - RNA, 20 nt, Homo sapiens
ugcgcggaagugaccacaga

SEQ ID NO: 621852 - RNA, 15 nt, Homo sapiens
ugcgcucccaccuca

SEQ ID NO: 621853 - RNA, 11 nt, Homo sapiens
ugcgcugcuaa

SEQ ID NO: 621854 - RNA, 22 nt, Homo sapiens
ugcgcuuauuuggaaauuuuag

SEQ ID NO: 621855 - RNA, 20 nt, Homo sapiens
ugcggaccaaacuacuucau

SEQ ID NO: 621856 - RNA, 23 nt, Homo sapiens
ugcggacccuucccagcccucau

SEQ ID NO: 621857 - RNA, 14 nt, Homo sapiens
ugcggaguccaggc

SEQ ID NO: 621858 - RNA, 18 nt, Homo sapiens
ugcggccuuuggcuucac

SEQ ID NO: 621859 - RNA, 16 nt, Homo sapiens
ugcgggaucacugggg

SEQ ID NO: 621860 - RNA, 18 nt, Homo sapiens
ugcggggggcaccagagg

SEQ ID NO: 621861 - RNA, 22 nt, Homo sapiens
ugcggugccuccucuugacuuc

SEQ ID NO: 621862 - RNA, 15 nt, Homo sapiens
ugcguaggaggaguu

SEQ ID NO: 621863 - RNA, 21 nt, Homo sapiens
ugcgucaagucuaaaccaaga

SEQ ID NO: 621864 - RNA, 22 nt, Homo sapiens
ugcgucagaccaguacugggaa

SEQ ID NO: 621865 - RNA, 19 nt, Homo sapiens
ugcguccaccaggccucac

SEQ ID NO: 621866 - RNA, 16 nt, Homo sapiens
ugcgucggcccugggg

SEQ ID NO: 621867 - RNA, 13 nt, Homo sapiens
ugcgugaagacca

SEQ ID NO: 621868 - RNA, 22 nt, Homo sapiens
ugcgugaaguaggcauauauca

SEQ ID NO: 621869 - RNA, 18 nt, Homo sapiens
ugcgugcgagcacacaca

SEQ ID NO: 621870 - RNA, 16 nt, Homo sapiens
ugcguuuuauaucuuc

SEQ ID NO: 621871 - RNA, 16 nt, Homo sapiens
ugcuaaaagugcauuu

SEQ ID NO: 621872 - RNA, 18 nt, Homo sapiens
ugcuaaaagugcauuuaa

SEQ ID NO: 621873 - RNA, 17 nt, Homo sapiens
ugcuaacaaagacaaaa

SEQ ID NO: 621874 - RNA, 18 nt, Homo sapiens
ugcuaacaaagacaaaag

SEQ ID NO: 621875 - RNA, 16 nt, Homo sapiens
ugcuaacauagauuua

SEQ ID NO: 621876 - RNA, 22 nt, Homo sapiens
ugcuaacccccaaauacucuga

SEQ ID NO: 621877 - RNA, 22 nt, Homo sapiens
ugcuaagaagcgagcacugacc

SEQ ID NO: 621878 - RNA, 16 nt, Homo sapiens
ugcuaagacuaacuca

SEQ ID NO: 621879 - RNA, 15 nt, Homo sapiens
ugcuaaguauuuccc

SEQ ID NO: 621880 - RNA, 21 nt, Homo sapiens
ugcuaaucagggaggucauuu

SEQ ID NO: 621881 - RNA, 12 nt, Homo sapiens
ugcuaaucuugu

SEQ ID NO: 621882 - RNA, 14 nt, Homo sapiens
ugcuaaucuugucc

SEQ ID NO: 621883 - RNA, 22 nt, Homo sapiens
ugcuaaugcaaauuaaaacaua

SEQ ID NO: 621884 - RNA, 16 nt, Homo sapiens
ugcuaauguugaucag

SEQ ID NO: 621885 - RNA, 17 nt, Homo sapiens
ugcuaauucaaagcucu

SEQ ID NO: 621886 - RNA, 20 nt, Homo sapiens
ugcuacaaauacucuuagga

SEQ ID NO: 621887 - RNA, 14 nt, Homo sapiens
ugcuacaauucauu

SEQ ID NO: 621888 - RNA, 17 nt, Homo sapiens
ugcuaccaaaacaguua

SEQ ID NO: 621889 - RNA, 18 nt, Homo sapiens
ugcuaccacagcaacuau

SEQ ID NO: 621890 - RNA, 17 nt, Homo sapiens
ugcuaccucacuggggu

SEQ ID NO: 621891 - RNA, 24 nt, Homo sapiens
ugcuacugauuguuucauugcgaa

SEQ ID NO: 621892 - RNA, 22 nt, Homo sapiens
ugcuacuuuuuuuuaguucaau

SEQ ID NO: 621893 - RNA, 20 nt, Homo sapiens
ugcuagaaaagacauaauca

SEQ ID NO: 621894 - RNA, 16 nt, Homo sapiens
ugcuagaagacagaca

SEQ ID NO: 621895 - RNA, 19 nt, Homo sapiens
ugcuagacucuagacaaga

SEQ ID NO: 621896 - RNA, 16 nt, Homo sapiens
ugcuagaggugcucau

SEQ ID NO: 621897 - RNA, 17 nt, Homo sapiens
ugcuagagguugcagca

SEQ ID NO: 621898 - RNA, 12 nt, Homo sapiens
ugcuagccucug

SEQ ID NO: 621899 - RNA, 20 nt, Homo sapiens
ugcuaggacuccaaccucag

SEQ ID NO: 621900 - RNA, 17 nt, Homo sapiens
ugcuaggccagagccau

SEQ ID NO: 621901 - RNA, 20 nt, Homo sapiens
ugcuaggcgcuggggagacu

SEQ ID NO: 621902 - RNA, 14 nt, Homo sapiens
ugcuauaaguuuua

SEQ ID NO: 621903 - RNA, 12 nt, Homo sapiens
ugcuauaaucau

SEQ ID NO: 621904 - RNA, 15 nt, Homo sapiens
ugcuauaccuugacu

SEQ ID NO: 621905 - RNA, 21 nt, Homo sapiens
ugcuauaugccuuaagccaau

SEQ ID NO: 621906 - RNA, 16 nt, Homo sapiens
ugcuauccccaucucc

SEQ ID NO: 621907 - RNA, 22 nt, Homo sapiens
ugcuaucuggaggccuuccagc

SEQ ID NO: 621908 - RNA, 21 nt, Homo sapiens
ugcuaugaaauuggugggugg

SEQ ID NO: 621909 - RNA, 15 nt, Homo sapiens
ugcuaugaugauggu

SEQ ID NO: 621910 - RNA, 14 nt, Homo sapiens
ugcuaugugccuua

SEQ ID NO: 621911 - RNA, 15 nt, Homo sapiens
ugcuauguucugucu

SEQ ID NO: 621912 - RNA, 20 nt, Homo sapiens
uggaaaugguggugcuuuaa

SEQ ID NO: 621913 - RNA, 20 nt, Homo sapiens
uggaaaugguuucacuugcu

SEQ ID NO: 621914 - RNA, 21 nt, Homo sapiens
uggaaaugugaauaaguaaag

SEQ ID NO: 621915 - RNA, 20 nt, Homo sapiens
uggaaauuugggagagccau

SEQ ID NO: 621916 - RNA, 17 nt, Homo sapiens
uggaaauuuuguccauu

SEQ ID NO: 621917 - RNA, 20 nt, Homo sapiens
uggaacaagacagccuucac

SEQ ID NO: 621918 - RNA, 12 nt, Homo sapiens
uggaacacggcc

SEQ ID NO: 621919 - RNA, 21 nt, Homo sapiens
uggaacacuccucuacucuua

SEQ ID NO: 621920 - RNA, 16 nt, Homo sapiens
uggaacacuggaacau

SEQ ID NO: 621921 - RNA, 20 nt, Homo sapiens
uggaacacuucgaguuccca

SEQ ID NO: 621922 - RNA, 14 nt, Homo sapiens
uggaacacuuucag

SEQ ID NO: 621923 - RNA, 19 nt, Homo sapiens
uggaaccuuguuuuggaca

SEQ ID NO: 621924 - RNA, 20 nt, Homo sapiens
uggaacuauacccgggacca

SEQ ID NO: 621925 - RNA, 15 nt, Homo sapiens
uggaacucaaggaaa

SEQ ID NO: 621926 - RNA, 14 nt, Homo sapiens
uggaacucuacuca

SEQ ID NO: 621927 - RNA, 22 nt, Homo sapiens
uggaacuguccuucccucaaag

SEQ ID NO: 621928 - RNA, 18 nt, Homo sapiens
uggaacuugaacugauuc

SEQ ID NO: 621929 - RNA, 21 nt, Homo sapiens
uggaacuuuuauuacuggggu

SEQ ID NO: 621930 - RNA, 14 nt, Homo sapiens
uggaagaccuggac

SEQ ID NO: 621931 - RNA, 17 nt, Homo sapiens
uggaagaggaacagcac

SEQ ID NO: 621932 - RNA, 19 nt, Homo sapiens
uggaagaggcugagacauu

SEQ ID NO: 621933 - RNA, 13 nt, Homo sapiens
uggaagauucuau

SEQ ID NO: 621934 - RNA, 13 nt, Homo sapiens
uggaagcaaagac

SEQ ID NO: 621935 - RNA, 16 nt, Homo sapiens
uggaagcaaagacaaa

SEQ ID NO: 621936 - RNA, 12 nt, Homo sapiens
uggaagcacuug

SEQ ID NO: 621937 - RNA, 18 nt, Homo sapiens
uggaagcauccugugcug

SEQ ID NO: 621938 - RNA, 18 nt, Homo sapiens
uggaagcuaauuugcauu

SEQ ID NO: 621939 - RNA, 17 nt, Homo sapiens
uggaagcucugaaguca

SEQ ID NO: 621940 - RNA, 22 nt, Homo sapiens
uggaagcucugaagucacauca

SEQ ID NO: 621941 - RNA, 21 nt, Homo sapiens
uggaagcugagauuacucuga

SEQ ID NO: 621942 - RNA, 14 nt, Homo sapiens
uggaagcugucaua

SEQ ID NO: 621943 - RNA, 17 nt, Homo sapiens
uggaagcugucauaaaa

SEQ ID NO: 621944 - RNA, 16 nt, Homo sapiens
uggaaggacacaguga

SEQ ID NO: 621945 - RNA, 15 nt, Homo sapiens
uggaagggcguucua

SEQ ID NO: 621946 - RNA, 13 nt, Homo sapiens
uggaaggggccac

SEQ ID NO: 621947 - RNA, 13 nt, Homo sapiens
uggaaggggucca

SEQ ID NO: 621948 - RNA, 15 nt, Homo sapiens
uggaagggguccagc

SEQ ID NO: 621949 - RNA, 21 nt, Homo sapiens
uggaaguaaagauuaaaacca

SEQ ID NO: 621950 - RNA, 22 nt, Homo sapiens
uggaagucuccaugaagagcuu

SEQ ID NO: 621951 - RNA, 20 nt, Homo sapiens
uggaagugauuucagcacau

SEQ ID NO: 621952 - RNA, 22 nt, Homo sapiens
uggaagugcaucuacuugccag

SEQ ID NO: 621953 - RNA, 21 nt, Homo sapiens
uggaauaaacagugagcauau

SEQ ID NO: 621954 - RNA, 22 nt, Homo sapiens
uggaauaacuaucucacuucca

SEQ ID NO: 621955 - RNA, 16 nt, Homo sapiens
uggaauaccuaaggau

SEQ ID NO: 621956 - RNA, 21 nt, Homo sapiens
uggaauauaauuucaaaccac

SEQ ID NO: 621957 - RNA, 15 nt, Homo sapiens
uggaauaucacccaa

SEQ ID NO: 621958 - RNA, 20 nt, Homo sapiens
uggaauauuaaaaaacuuca

SEQ ID NO: 621959 - RNA, 17 nt, Homo sapiens
uggaauauuugcuuuau

SEQ ID NO: 621960 - RNA, 18 nt, Homo sapiens
uggaauauuugcuuuaua

SEQ ID NO: 621961 - RNA, 14 nt, Homo sapiens
uggaaucagcucag

SEQ ID NO: 621962 - RNA, 16 nt, Homo sapiens
uggaaucagcucagga

SEQ ID NO: 621963 - RNA, 17 nt, Homo sapiens
uggaauccaucugucuc

SEQ ID NO: 621964 - RNA, 22 nt, Homo sapiens
uggaaucuaacgggcauucaca

SEQ ID NO: 621965 - RNA, 21 nt, Homo sapiens
uggaaucuucuccaguaugaa

SEQ ID NO: 621966 - RNA, 19 nt, Homo sapiens
uggaaucuuuguaccaaaa

SEQ ID NO: 621967 - RNA, 14 nt, Homo sapiens
uggaaucuuuuaua

SEQ ID NO: 621968 - RNA, 16 nt, Homo sapiens
uggaaugaagguaaua

SEQ ID NO: 621969 - RNA, 15 nt, Homo sapiens
uggaaugauucacau

SEQ ID NO: 621970 - RNA, 23 nt, Homo sapiens
uggaaugcagggaagagggcagu

SEQ ID NO: 621971 - RNA, 14 nt, Homo sapiens
uggaaugcccuuca

SEQ ID NO: 621972 - RNA, 15 nt, Homo sapiens
uggaauggagauuca

SEQ ID NO: 621973 - RNA, 22 nt, Homo sapiens
uggaauggcaggugucauauga

SEQ ID NO: 621974 - RNA, 16 nt, Homo sapiens
uggaaugguaggauau

SEQ ID NO: 621975 - RNA, 14 nt, Homo sapiens
uggaauuagagggc

SEQ ID NO: 621976 - RNA, 21 nt, Homo sapiens
uggaauuauuuugaaugucac

SEQ ID NO: 621977 - RNA, 16 nt, Homo sapiens
uggaauucuacuggaa

SEQ ID NO: 621978 - RNA, 12 nt, Homo sapiens
uggaauuugcau

SEQ ID NO: 621979 - RNA, 15 nt, Homo sapiens
uggaauuuguucaag

SEQ ID NO: 621980 - RNA, 14 nt, Homo sapiens
uggaauuuugcaaa

SEQ ID NO: 621981 - RNA, 19 nt, Homo sapiens
uggacaaaccgagugcaau

SEQ ID NO: 621982 - RNA, 20 nt, Homo sapiens
uggacaaaccgagugcaaug

SEQ ID NO: 621983 - RNA, 23 nt, Homo sapiens
uggacaacacugauuccuggaga

SEQ ID NO: 621984 - RNA, 17 nt, Homo sapiens
uggacaacauuuuacua

SEQ ID NO: 621985 - RNA, 18 nt, Homo sapiens
uggacaacauuuuacuac

SEQ ID NO: 621986 - RNA, 17 nt, Homo sapiens
uggacaaggagugugac

SEQ ID NO: 621987 - RNA, 22 nt, Homo sapiens
uggacaagggcaggucuucaua

SEQ ID NO: 621988 - RNA, 22 nt, Homo sapiens
uggacaaucaugaaauaugcau

SEQ ID NO: 621989 - RNA, 21 nt, Homo sapiens
uggacacaauaggucuuucuc

SEQ ID NO: 621990 - RNA, 12 nt, Homo sapiens
uggacacagccc

SEQ ID NO: 621991 - RNA, 19 nt, Homo sapiens
uggacaccccugcuauaua

SEQ ID NO: 621992 - RNA, 22 nt, Homo sapiens
uggacacggaucugcugggcuc

SEQ ID NO: 621993 - RNA, 17 nt, Homo sapiens
uggacacgucggacagc

SEQ ID NO: 621994 - RNA, 11 nt, Homo sapiens
uggacacugag

SEQ ID NO: 621995 - RNA, 17 nt, Homo sapiens
uggacacugccaagagc

SEQ ID NO: 621996 - RNA, 12 nt, Homo sapiens
uggacacuugcg

SEQ ID NO: 621997 - RNA, 14 nt, Homo sapiens
uggacagacacugu

SEQ ID NO: 621998 - RNA, 17 nt, Homo sapiens
uggacagacacuguugc

SEQ ID NO: 621999 - RNA, 21 nt, Homo sapiens
uggacagacacuguugcaaag

SEQ ID NO: 622000 - RNA, 18 nt, Homo sapiens
uggacagaugaauaccuu

SEQ ID NO: 622001 - RNA, 17 nt, Homo sapiens
uggacagcaaaaccauu

SEQ ID NO: 622002 - RNA, 24 nt, Homo sapiens
uggacagcggcagugggccugcug

SEQ ID NO: 622003 - RNA, 19 nt, Homo sapiens
uggacagucaggguucacu

SEQ ID NO: 622004 - RNA, 17 nt, Homo sapiens
uggacauaagacagaca

SEQ ID NO: 622005 - RNA, 15 nt, Homo sapiens
uggacauccccagaa

SEQ ID NO: 622006 - RNA, 16 nt, Homo sapiens
uggacaucucucuggc

SEQ ID NO: 622007 - RNA, 21 nt, Homo sapiens
uggacaugugucccagccaca

SEQ ID NO: 622008 - RNA, 15 nt, Homo sapiens
uggaccaacccuguu

SEQ ID NO: 622009 - RNA, 21 nt, Homo sapiens
uggaccaauagggcugagcuc

SEQ ID NO: 622010 - RNA, 21 nt, Homo sapiens
uggaccaccguucagucauuu

SEQ ID NO: 622011 - RNA, 21 nt, Homo sapiens
uggaccacuuuguauacacuc

SEQ ID NO: 622012 - RNA, 15 nt, Homo sapiens
uggaccaguacuccc

SEQ ID NO: 622013 - RNA, 23 nt, Homo sapiens
uggaccagucccgucgugcaguc

SEQ ID NO: 622014 - RNA, 14 nt, Homo sapiens
uggaccaugccaga

SEQ ID NO: 622015 - RNA, 18 nt, Homo sapiens
uggacccaaaaaaucauc

SEQ ID NO: 622016 - RNA, 20 nt, Homo sapiens
uggacccuggugaccuccug

SEQ ID NO: 622017 - RNA, 16 nt, Homo sapiens
uggacggacaagacag

SEQ ID NO: 622018 - RNA, 14 nt, Homo sapiens
uggacgugcacuga

SEQ ID NO: 622019 - RNA, 21 nt, Homo sapiens
uggacuacacccaagccugau

SEQ ID NO: 622020 - RNA, 23 nt, Homo sapiens
uggacuauggagugcaccaaaga

SEQ ID NO: 622021 - RNA, 18 nt, Homo sapiens
uggacuauggugcuguau

SEQ ID NO: 622022 - RNA, 15 nt, Homo sapiens
uggacucaaucccua

SEQ ID NO: 622023 - RNA, 13 nt, Homo sapiens
uggacuccaccuu

SEQ ID NO: 622024 - RNA, 11 nt, Homo sapiens
uggacugcaag

SEQ ID NO: 622025 - RNA, 18 nt, Homo sapiens
uggacuggaggugggcau

SEQ ID NO: 622026 - RNA, 13 nt, Homo sapiens
uggacuuacaaaa

SEQ ID NO: 622027 - RNA, 15 nt, Homo sapiens
uggacuucagugugu

SEQ ID NO: 622028 - RNA, 15 nt, Homo sapiens
uggacuucaucucaa

SEQ ID NO: 622029 - RNA, 21 nt, Homo sapiens
uggacuucuuaguuguuucuc

SEQ ID NO: 622030 - RNA, 12 nt, Homo sapiens
uggacuuguaua

SEQ ID NO: 622031 - RNA, 22 nt, Homo sapiens
uggacuuguauauuuguacaaa

SEQ ID NO: 622032 - RNA, 21 nt, Homo sapiens
uggacuuuucguuaacauuga

SEQ ID NO: 622033 - RNA, 12 nt, Homo sapiens
uuaaaagcauuu

SEQ ID NO: 622034 - RNA, 14 nt, Homo sapiens
uuaaaaggggccca

SEQ ID NO: 622035 - RNA, 16 nt, Homo sapiens
uuaaaagucaguauca

SEQ ID NO: 622036 - RNA, 20 nt, Homo sapiens
uuaaaaguuugaaaagcaau

SEQ ID NO: 622037 - RNA, 19 nt, Homo sapiens
uuaaaauaaaaaagcaaaa

SEQ ID NO: 622038 - RNA, 15 nt, Homo sapiens
uuaaaauaaauuccu

SEQ ID NO: 622039 - RNA, 13 nt, Homo sapiens
uuaaaauaaugaa

SEQ ID NO: 622040 - RNA, 16 nt, Homo sapiens
uuaaaauauaugucua

SEQ ID NO: 622041 - RNA, 17 nt, Homo sapiens
uuaaaauauucuacaga

SEQ ID NO: 622042 - RNA, 23 nt, Homo sapiens
uuaaaauauuuuuaugugcaaua

SEQ ID NO: 622043 - RNA, 16 nt, Homo sapiens
uuaaaaucaugauccu

SEQ ID NO: 622044 - RNA, 14 nt, Homo sapiens
uuaaaaucugugaa

SEQ ID NO: 622045 - RNA, 15 nt, Homo sapiens
uuaaaaugacaagca

SEQ ID NO: 622046 - RNA, 19 nt, Homo sapiens
uuaaaaugauuugggaaaa

SEQ ID NO: 622047 - RNA, 14 nt, Homo sapiens
uuaaaaugcgaaau

SEQ ID NO: 622048 - RNA, 18 nt, Homo sapiens
uuaaaauggcuacacuca

SEQ ID NO: 622049 - RNA, 14 nt, Homo sapiens
uuaaaauguaaaac

SEQ ID NO: 622050 - RNA, 20 nt, Homo sapiens
uuaaaauguacacuggauau

SEQ ID NO: 622051 - RNA, 19 nt, Homo sapiens
uuaaaauuaucaauaucua

SEQ ID NO: 622052 - RNA, 13 nt, Homo sapiens
uuaaaauucaauu

SEQ ID NO: 622053 - RNA, 15 nt, Homo sapiens
uuaaaauugauuucu

SEQ ID NO: 622054 - RNA, 18 nt, Homo sapiens
uuaaaauuuuaccucucu

SEQ ID NO: 622055 - RNA, 21 nt, Homo sapiens
uuaaacaaaauagaagcugua

SEQ ID NO: 622056 - RNA, 14 nt, Homo sapiens
uuaaacacaaagug

SEQ ID NO: 622057 - RNA, 15 nt, Homo sapiens
uuaaacaccuccuca

SEQ ID NO: 622058 - RNA, 16 nt, Homo sapiens
uuaaacagaggugaug

SEQ ID NO: 622059 - RNA, 13 nt, Homo sapiens
uuaaacagcagau

SEQ ID NO: 622060 - RNA, 18 nt, Homo sapiens
uuaaacauugaaguaaug

SEQ ID NO: 622061 - RNA, 12 nt, Homo sapiens
uuaaaccaccua

SEQ ID NO: 622062 - RNA, 14 nt, Homo sapiens
uuaaacccacagcc

SEQ ID NO: 622063 - RNA, 22 nt, Homo sapiens
uuaaaccccgagauagugcugg

SEQ ID NO: 622064 - RNA, 18 nt, Homo sapiens
uuaaaccucucuucuacc

SEQ ID NO: 622065 - RNA, 22 nt, Homo sapiens
uuaaaccugucuccacugugcc

SEQ ID NO: 622066 - RNA, 18 nt, Homo sapiens
uuaaaccuuaagauacua

SEQ ID NO: 622067 - RNA, 19 nt, Homo sapiens
uuaaacuagcacaguaaaa

SEQ ID NO: 622068 - RNA, 14 nt, Homo sapiens
uuaaacucagggac

SEQ ID NO: 622069 - RNA, 21 nt, Homo sapiens
uuaaacucagggagcauuuau

SEQ ID NO: 622070 - RNA, 12 nt, Homo sapiens
uuaaacuugaaa

SEQ ID NO: 622071 - RNA, 11 nt, Homo sapiens
uuaaacuugua

SEQ ID NO: 622072 - RNA, 12 nt, Homo sapiens
uuaaacuuucaa

SEQ ID NO: 622073 - RNA, 14 nt, Homo sapiens
uuaaagaaagaaug

SEQ ID NO: 622074 - RNA, 20 nt, Homo sapiens
uuaaagaaagucgaauuaau

SEQ ID NO: 622075 - RNA, 12 nt, Homo sapiens
uuaaagacacuu

SEQ ID NO: 622076 - RNA, 21 nt, Homo sapiens
uuaaagacccaacuugccaaa

SEQ ID NO: 622077 - RNA, 16 nt, Homo sapiens
uuaaagaucaugacau

SEQ ID NO: 622078 - RNA, 15 nt, Homo sapiens
uuaaagcagacaguc

SEQ ID NO: 622079 - RNA, 18 nt, Homo sapiens
uuaaagcagacagucaca

SEQ ID NO: 622080 - RNA, 20 nt, Homo sapiens
uuaaagcaucuauaaggugc

SEQ ID NO: 622081 - RNA, 14 nt, Homo sapiens
uuaaagccuccuca

SEQ ID NO: 622082 - RNA, 20 nt, Homo sapiens
uuaaagccuuuagagccagc

SEQ ID NO: 622083 - RNA, 13 nt, Homo sapiens
uuaaagcucuuca

SEQ ID NO: 622084 - RNA, 23 nt, Homo sapiens
uuaaaggaaaaucacaucuccag

SEQ ID NO: 622085 - RNA, 18 nt, Homo sapiens
uuaaaggcaucuacacaa

SEQ ID NO: 622086 - RNA, 11 nt, Homo sapiens
uuaaaguauuu

SEQ ID NO: 622087 - RNA, 15 nt, Homo sapiens
uuaaaguucauugca

SEQ ID NO: 622088 - RNA, 17 nt, Homo sapiens
uuaaaguuuaaugccua

SEQ ID NO: 622089 - RNA, 16 nt, Homo sapiens
uuaaauaaacaugacc

SEQ ID NO: 622090 - RNA, 17 nt, Homo sapiens
uuaaauaaaucauaaaa

SEQ ID NO: 622091 - RNA, 23 nt, Homo sapiens
uuaaauaaaucauaaaacuugau

SEQ ID NO: 622092 - RNA, 18 nt, Homo sapiens
uuaaauaauagacauaca

SEQ ID NO: 622093 - RNA, 21 nt, Homo sapiens
uuaaauaauguacuuuuggcu

SEQ ID NO: 622094 - RNA, 17 nt, Homo sapiens
uuaaauacagucuucca

SEQ ID NO: 622095 - RNA, 20 nt, Homo sapiens
uuaaauauaaauauccccag

SEQ ID NO: 622096 - RNA, 20 nt, Homo sapiens
uuaaauauauaauguugcca

SEQ ID NO: 622097 - RNA, 23 nt, Homo sapiens
uuaaauauauuucuugcuauugu

SEQ ID NO: 622098 - RNA, 14 nt, Homo sapiens
uuaaauauuuccau

SEQ ID NO: 622099 - RNA, 16 nt, Homo sapiens
uuaaaucaaaagggag

SEQ ID NO: 622100 - RNA, 21 nt, Homo sapiens
uuaaaucaagagcuuacauaa

SEQ ID NO: 622101 - RNA, 13 nt, Homo sapiens
uuaaaucaagucc

SEQ ID NO: 622102 - RNA, 23 nt, Homo sapiens
uuaaaucaccauagggcugggga

SEQ ID NO: 622103 - RNA, 21 nt, Homo sapiens
uuaaaucacucuucuguaaau

SEQ ID NO: 622104 - RNA, 22 nt, Homo sapiens
uuaaaucucagagguagcagua

SEQ ID NO: 622105 - RNA, 14 nt, Homo sapiens
uuaaaugacaauuu

SEQ ID NO: 622106 - RNA, 22 nt, Homo sapiens
uuaaauggcuuuugccacauac

SEQ ID NO: 622107 - RNA, 12 nt, Homo sapiens
uuaaauguaguu

SEQ ID NO: 622108 - RNA, 14 nt, Homo sapiens
uuaaauguauacua

SEQ ID NO: 622109 - RNA, 15 nt, Homo sapiens
uuaaaugucaguuac

SEQ ID NO: 622110 - RNA, 19 nt, Homo sapiens
uuaaauguuuauacuguau

SEQ ID NO: 622111 - RNA, 15 nt, Homo sapiens
uuaaauuaagacuug

SEQ ID NO: 622112 - RNA, 15 nt, Homo sapiens
uuaaauuaauaucuu

SEQ ID NO: 622113 - RNA, 20 nt, Homo sapiens
uuaaauuaaugaacauaugu

SEQ ID NO: 622114 - RNA, 20 nt, Homo sapiens
uuaaauuaguucagccauug

SEQ ID NO: 622115 - RNA, 18 nt, Homo sapiens
uuaaauuccugguggaua

SEQ ID NO: 622116 - RNA, 17 nt, Homo sapiens
uuaaauuuggcucuaaa

SEQ ID NO: 622117 - RNA, 17 nt, Homo sapiens
uuaaauuuuuuguugac

SEQ ID NO: 622118 - RNA, 21 nt, Homo sapiens
uuaacaaaaaacggggagaaa

SEQ ID NO: 622119 - RNA, 15 nt, Homo sapiens
uuaacaaaauuagcu

SEQ ID NO: 622120 - RNA, 17 nt, Homo sapiens
uuaacaaaugugcugcu

SEQ ID NO: 622121 - RNA, 18 nt, Homo sapiens
uuaacaaccgacacuccu

SEQ ID NO: 622122 - RNA, 17 nt, Homo sapiens
uuaacaauaacuacugu

SEQ ID NO: 622123 - RNA, 17 nt, Homo sapiens
uuaacacuuaaauuucu

SEQ ID NO: 622124 - RNA, 21 nt, Homo sapiens
uuaacacuucuguaugcauca

SEQ ID NO: 622125 - RNA, 19 nt, Homo sapiens
uuaacagagauugaacucc

SEQ ID NO: 622126 - RNA, 21 nt, Homo sapiens
uuaacagagauugaacuccaa

SEQ ID NO: 622127 - RNA, 15 nt, Homo sapiens
uuaacagcaugcugc

SEQ ID NO: 622128 - RNA, 18 nt, Homo sapiens
uuaacaggauauuagaca

SEQ ID NO: 622129 - RNA, 14 nt, Homo sapiens
uuaacauaccuaag

SEQ ID NO: 622130 - RNA, 13 nt, Homo sapiens
uuaacauauauau

SEQ ID NO: 622131 - RNA, 12 nt, Homo sapiens
uuaacauauguc

SEQ ID NO: 622132 - RNA, 18 nt, Homo sapiens
uuaacaucuacaaucagu

SEQ ID NO: 622133 - RNA, 18 nt, Homo sapiens
uuaacaugggcucuucac

SEQ ID NO: 622134 - RNA, 16 nt, Homo sapiens
uuaacauguauacaaa

SEQ ID NO: 622135 - RNA, 13 nt, Homo sapiens
uuaacauguguua

SEQ ID NO: 622136 - RNA, 18 nt, Homo sapiens
uuaacauuaucuaguuca

SEQ ID NO: 622137 - RNA, 13 nt, Homo sapiens
uuaacauuugccu

SEQ ID NO: 622138 - RNA, 15 nt, Homo sapiens
uuaaccacaauacca

SEQ ID NO: 622139 - RNA, 21 nt, Homo sapiens
uuaaccaccgcauaugcaugc

SEQ ID NO: 622140 - RNA, 17 nt, Homo sapiens
uuaaccccauguccuca

SEQ ID NO: 622141 - RNA, 23 nt, Homo sapiens
uuaaccucugcuuuuaucucaga

SEQ ID NO: 622142 - RNA, 13 nt, Homo sapiens
uuaaccugcaaaa

SEQ ID NO: 622143 - RNA, 22 nt, Homo sapiens
uuaaccugccaacauacuuuaa

SEQ ID NO: 622144 - RNA, 13 nt, Homo sapiens
uuaacucccauua

SEQ ID NO: 622145 - RNA, 12 nt, Homo sapiens
uuaacugagcua

SEQ ID NO: 622146 - RNA, 21 nt, Homo sapiens
uuaacugagcuacuagagaua

SEQ ID NO: 622147 - RNA, 20 nt, Homo sapiens
uuaacugauuaaaaauaccu

SEQ ID NO: 622148 - RNA, 15 nt, Homo sapiens
uuaacugcauccagc

SEQ ID NO: 622149 - RNA, 17 nt, Homo sapiens
uuaacugcauuuuacca

SEQ ID NO: 622150 - RNA, 11 nt, Homo sapiens
uuaacugccaa

SEQ ID NO: 622151 - RNA, 15 nt, Homo sapiens
uuaacugccaagaaa

SEQ ID NO: 622152 - RNA, 19 nt, Homo sapiens
uuaacuggucuccuugcuu

SEQ ID NO: 622153 - RNA, 15 nt, Homo sapiens
uuaacuggugcacuu

SEQ ID NO: 622154 - RNA, 18 nt, Homo sapiens
uuaacuuacacugaucaa

SEQ ID NO: 622155 - RNA, 17 nt, Homo sapiens
uuaacuuuaccaugcuc

SEQ ID NO: 622156 - RNA, 19 nt, Homo sapiens
uuauacuguggcuaugcaa

SEQ ID NO: 622157 - RNA, 14 nt, Homo sapiens
uuauagucuuccag

SEQ ID NO: 622158 - RNA, 20 nt, Homo sapiens
uuauagugaauacugcuaca

SEQ ID NO: 622159 - RNA, 22 nt, Homo sapiens
uuauaguuucagauauauauca

SEQ ID NO: 622160 - RNA, 23 nt, Homo sapiens
uuauauaaagguggugggcaaaa

SEQ ID NO: 622161 - RNA, 14 nt, Homo sapiens
uuauauaauucaag

SEQ ID NO: 622162 - RNA, 16 nt, Homo sapiens
uuauauacaguacaca

SEQ ID NO: 622163 - RNA, 21 nt, Homo sapiens
uuauauauuuuucugagauuu

SEQ ID NO: 622164 - RNA, 16 nt, Homo sapiens
uuauaucauacaguuu

SEQ ID NO: 622165 - RNA, 17 nt, Homo sapiens
uuauaucauguaccuca

SEQ ID NO: 622166 - RNA, 19 nt, Homo sapiens
uuauauguagccuuuacug

SEQ ID NO: 622167 - RNA, 16 nt, Homo sapiens
uuauauguugcuauaa

SEQ ID NO: 622168 - RNA, 16 nt, Homo sapiens
uuauauuacacuacac

SEQ ID NO: 622169 - RNA, 16 nt, Homo sapiens
uuauauuauugauuca

SEQ ID NO: 622170 - RNA, 17 nt, Homo sapiens
uuauauucagaguaugu

SEQ ID NO: 622171 - RNA, 14 nt, Homo sapiens
uuauauucuaauag

SEQ ID NO: 622172 - RNA, 17 nt, Homo sapiens
uuauauuucuguguaca

SEQ ID NO: 622173 - RNA, 16 nt, Homo sapiens
uuauauuuguuuuaga

SEQ ID NO: 622174 - RNA, 19 nt, Homo sapiens
uuauauuuuaugaacauug

SEQ ID NO: 622175 - RNA, 18 nt, Homo sapiens
uuauauuuugugcuauca

SEQ ID NO: 622176 - RNA, 20 nt, Homo sapiens
uuaucaaacuucagcuguac

SEQ ID NO: 622177 - RNA, 20 nt, Homo sapiens
uuaucaaauuugccaugaca

SEQ ID NO: 622178 - RNA, 16 nt, Homo sapiens
uuaucaaccaacugca

SEQ ID NO: 622179 - RNA, 22 nt, Homo sapiens
uuaucaccgugggcucccugac

SEQ ID NO: 622180 - RNA, 19 nt, Homo sapiens
uuaucacgcagaucacuaa

SEQ ID NO: 622181 - RNA, 14 nt, Homo sapiens
uuaucagucauaac

SEQ ID NO: 622182 - RNA, 21 nt, Homo sapiens
uuaucaguuaaaaucacauuu

SEQ ID NO: 622183 - RNA, 21 nt, Homo sapiens
uuaucaugcaaaugcuguauu

SEQ ID NO: 622184 - RNA, 16 nt, Homo sapiens
uuaucaugcauguccu

SEQ ID NO: 622185 - RNA, 21 nt, Homo sapiens
uuaucaugcauguccuguaaa

SEQ ID NO: 622186 - RNA, 18 nt, Homo sapiens
uuaucauggagaacagca

SEQ ID NO: 622187 - RNA, 23 nt, Homo sapiens
uuaucauggagaacagcaugaca

SEQ ID NO: 622188 - RNA, 11 nt, Homo sapiens
uuauccaaauu

SEQ ID NO: 622189 - RNA, 16 nt, Homo sapiens
uuaucccuugacaaaa

SEQ ID NO: 622190 - RNA, 14 nt, Homo sapiens
uuauccugacauau

SEQ ID NO: 622191 - RNA, 17 nt, Homo sapiens
uuauccugcuagcugua

SEQ ID NO: 622192 - RNA, 16 nt, Homo sapiens
uuauccuucuacuugu

SEQ ID NO: 622193 - RNA, 18 nt, Homo sapiens
uuaucgggagcagugucu

SEQ ID NO: 622194 - RNA, 19 nt, Homo sapiens
uuaucuaacggcuacugaa

SEQ ID NO: 622195 - RNA, 18 nt, Homo sapiens
uuaucugucacaccugug

SEQ ID NO: 622196 - RNA, 12 nt, Homo sapiens
uuaucugugcaa

SEQ ID NO: 622197 - RNA, 20 nt, Homo sapiens
uuaucugugcgugaaacaca

SEQ ID NO: 622198 - RNA, 21 nt, Homo sapiens
uuaucugugucaaaagccaga

SEQ ID NO: 622199 - RNA, 13 nt, Homo sapiens
uuaucuuaugcca

SEQ ID NO: 622200 - RNA, 20 nt, Homo sapiens
uuaucuucuuccagauuucc

SEQ ID NO: 622201 - RNA, 23 nt, Homo sapiens
uuaucuuuuuaaaaacucuucag

SEQ ID NO: 622202 - RNA, 17 nt, Homo sapiens
uuaugaaaacuagcauu

SEQ ID NO: 622203 - RNA, 21 nt, Homo sapiens
uuaugaaaacuagcauuacau

SEQ ID NO: 622204 - RNA, 22 nt, Homo sapiens
uuaugaagcaagccccacuuau

SEQ ID NO: 622205 - RNA, 13 nt, Homo sapiens
uuaugacagugaa

SEQ ID NO: 622206 - RNA, 12 nt, Homo sapiens
uuaugacaugau

SEQ ID NO: 622207 - RNA, 23 nt, Homo sapiens
uuaugagaggcaaugauuguuaa

SEQ ID NO: 622208 - RNA, 11 nt, Homo sapiens
uuaugagauuu

SEQ ID NO: 622209 - RNA, 17 nt, Homo sapiens
uuaugaucaauuguuaa

SEQ ID NO: 622210 - RNA, 18 nt, Homo sapiens
uuaugaugccacuuuucu

SEQ ID NO: 622211 - RNA, 15 nt, Homo sapiens
uuaugcaaaagcagc

SEQ ID NO: 622212 - RNA, 16 nt, Homo sapiens
uuaugcaaauggagau

SEQ ID NO: 622213 - RNA, 16 nt, Homo sapiens
uuaugcauaaagucag

SEQ ID NO: 622214 - RNA, 22 nt, Homo sapiens
uuaugccacagaauuugcuaau

SEQ ID NO: 622215 - RNA, 13 nt, Homo sapiens
uuaugccaugauu

SEQ ID NO: 622216 - RNA, 13 nt, Homo sapiens
uuaugcugugaca

SEQ ID NO: 622217 - RNA, 16 nt, Homo sapiens
uuauggaaaacugugu

SEQ ID NO: 622218 - RNA, 16 nt, Homo sapiens
uuauggaacagggaug

SEQ ID NO: 622219 - RNA, 17 nt, Homo sapiens
uuauguaacauccagaa

SEQ ID NO: 622220 - RNA, 18 nt, Homo sapiens
uuauguaguaauugacau

SEQ ID NO: 622221 - RNA, 17 nt, Homo sapiens
uuauguauuuaugaccu

SEQ ID NO: 622222 - RNA, 21 nt, Homo sapiens
uuaugucuauuuaagccucau

SEQ ID NO: 622223 - RNA, 19 nt, Homo sapiens
uuaugucucuucugagcua

SEQ ID NO: 622224 - RNA, 19 nt, Homo sapiens
uuaugucucuugagcauca

SEQ ID NO: 622225 - RNA, 20 nt, Homo sapiens
uuaugucucuugagcaucaa

SEQ ID NO: 622226 - RNA, 11 nt, Homo sapiens
uuaugugcaau

SEQ ID NO: 622227 - RNA, 12 nt, Homo sapiens
uuaugugcaaua

SEQ ID NO: 622228 - RNA, 17 nt, Homo sapiens
uuauguuaaaaagaaau

SEQ ID NO: 622229 - RNA, 14 nt, Homo sapiens
uuauguuagcauug

SEQ ID NO: 622230 - RNA, 11 nt, Homo sapiens
uuauguuccca

SEQ ID NO: 622231 - RNA, 10 nt, Homo sapiens
uuauguuugc

SEQ ID NO: 622232 - RNA, 13 nt, Homo sapiens
uuauuaaaauucu

SEQ ID NO: 622233 - RNA, 16 nt, Homo sapiens
uuauuaaacguaugca

SEQ ID NO: 622234 - RNA, 14 nt, Homo sapiens
uuauuaaauacaaa

SEQ ID NO: 622235 - RNA, 18 nt, Homo sapiens
uuauuaaauauaaauauc

SEQ ID NO: 622236 - RNA, 19 nt, Homo sapiens
uuauuaagguaacuacugc

SEQ ID NO: 622237 - RNA, 23 nt, Homo sapiens
uuauuaaucauacaaacucucac

SEQ ID NO: 622238 - RNA, 15 nt, Homo sapiens
uuauuaauucuucac

SEQ ID NO: 622239 - RNA, 15 nt, Homo sapiens
uuauuaccucugaua

SEQ ID NO: 622240 - RNA, 15 nt, Homo sapiens
uuauuacuguuccca

SEQ ID NO: 622241 - RNA, 14 nt, Homo sapiens
uuauuacuugugca

SEQ ID NO: 622242 - RNA, 12 nt, Homo sapiens
uuauuauauucc

SEQ ID NO: 622243 - RNA, 12 nt, Homo sapiens
uuauuaugcucu

SEQ ID NO: 622244 - RNA, 17 nt, Homo sapiens
uuauuauggcacaucag

SEQ ID NO: 622245 - RNA, 10 nt, Homo sapiens
uuauuauucu

SEQ ID NO: 622246 - RNA, 13 nt, Homo sapiens
uuauuauucuuga

SEQ ID NO: 622247 - RNA, 18 nt, Homo sapiens
uuauucaagaaaaguaag

SEQ ID NO: 622248 - RNA, 23 nt, Homo sapiens
uuauucacauggaaauguacacc

SEQ ID NO: 622249 - RNA, 10 nt, Homo sapiens
uuauuccagu

SEQ ID NO: 622250 - RNA, 18 nt, Homo sapiens
uuauucccaguguuccau

SEQ ID NO: 622251 - RNA, 14 nt, Homo sapiens
uuauuccuccagga

SEQ ID NO: 622252 - RNA, 14 nt, Homo sapiens
uuauucugauucca

SEQ ID NO: 622253 - RNA, 15 nt, Homo sapiens
uuauucugauuccac

SEQ ID NO: 622254 - RNA, 23 nt, Homo sapiens
uuauugaaaggggacaccuguac

SEQ ID NO: 622255 - RNA, 20 nt, Homo sapiens
uuauugcaauaaaguauaau

SEQ ID NO: 622256 - RNA, 22 nt, Homo sapiens
uuauugguguaagguacuuuca

SEQ ID NO: 622257 - RNA, 20 nt, Homo sapiens
uuauugugacuucacuguau

SEQ ID NO: 622258 - RNA, 19 nt, Homo sapiens
uuauugugcuucagugcca

SEQ ID NO: 622259 - RNA, 23 nt, Homo sapiens
uuauuguuuauuuaucagugaca

SEQ ID NO: 622260 - RNA, 22 nt, Homo sapiens
uuauuuacaaauguuuugcuca

SEQ ID NO: 622261 - RNA, 23 nt, Homo sapiens
uuauuuacagcucuguaaccucc

SEQ ID NO: 622262 - RNA, 18 nt, Homo sapiens
uuauuuacaucacuuugu

SEQ ID NO: 622263 - RNA, 13 nt, Homo sapiens
uuauuuagauccc

SEQ ID NO: 622264 - RNA, 19 nt, Homo sapiens
uuauuuagggaacugcuug

SEQ ID NO: 622265 - RNA, 21 nt, Homo sapiens
uuauuuaugcacugugggaug

SEQ ID NO: 622266 - RNA, 14 nt, Homo sapiens
uuauuuaugcguaa

SEQ ID NO: 622267 - RNA, 12 nt, Homo sapiens
uuauuucacuuu

SEQ ID NO: 622268 - RNA, 16 nt, Homo sapiens
uuauuucaucauauua

SEQ ID NO: 622269 - RNA, 14 nt, Homo sapiens
uuauuucugaucua

SEQ ID NO: 622270 - RNA, 21 nt, Homo sapiens
uuauuugcuaaucaaagccag

SEQ ID NO: 622271 - RNA, 22 nt, Homo sapiens
uuauuugggagggaaaagggaa

SEQ ID NO: 622272 - RNA, 16 nt, Homo sapiens
uuauuugugggguaca

SEQ ID NO: 622273 - RNA, 15 nt, Homo sapiens
uuauuuuauggaaua

SEQ ID NO: 622274 - RNA, 16 nt, Homo sapiens
uuauuuugaaaauaau

SEQ ID NO: 622275 - RNA, 15 nt, Homo sapiens
uuauuuugcauucca

SEQ ID NO: 622276 - RNA, 18 nt, Homo sapiens
uuauuuuuaaaaagaaau

SEQ ID NO: 622277 - RNA, 14 nt, Homo sapiens
uuauuuuucacucu

SEQ ID NO: 622278 - RNA, 20 nt, Homo sapiens
uuauuuuugguuuccaaaga

SEQ ID NO: 622279 - RNA, 22 nt, Homo sapiens
uucuguggagggagggcagcug

SEQ ID NO: 622280 - RNA, 18 nt, Homo sapiens
uucugugggcugcugcag

SEQ ID NO: 622281 - RNA, 13 nt, Homo sapiens
uucuguguacuuu

SEQ ID NO: 622282 - RNA, 15 nt, Homo sapiens
uucuguuaacugaau

SEQ ID NO: 622283 - RNA, 17 nt, Homo sapiens
uucuguucucauuugau

SEQ ID NO: 622284 - RNA, 14 nt, Homo sapiens
uucuguugauccca

SEQ ID NO: 622285 - RNA, 21 nt, Homo sapiens
uucuguugaucccacuucacu

SEQ ID NO: 622286 - RNA, 22 nt, Homo sapiens
uucuguuguaauaguccaugga

SEQ ID NO: 622287 - RNA, 14 nt, Homo sapiens
uucuguuuggugug

SEQ ID NO: 622288 - RNA, 16 nt, Homo sapiens
uucuguuuuguuaaua

SEQ ID NO: 622289 - RNA, 17 nt, Homo sapiens
uucuguuuuguuaauau

SEQ ID NO: 622290 - RNA, 22 nt, Homo sapiens
uucuuaaaaguugugauuccag

SEQ ID NO: 622291 - RNA, 14 nt, Homo sapiens
uucuuaacaaccga

SEQ ID NO: 622292 - RNA, 16 nt, Homo sapiens
uucuuaaccuuugcua

SEQ ID NO: 622293 - RNA, 14 nt, Homo sapiens
uucuuaacuuugaa

SEQ ID NO: 622294 - RNA, 23 nt, Homo sapiens
uucuuaagacagagucuugcucu

SEQ ID NO: 622295 - RNA, 21 nt, Homo sapiens
uucuuaaggaagaagaguauu

SEQ ID NO: 622296 - RNA, 23 nt, Homo sapiens
uucuuaaugaaccuuagaaagac

SEQ ID NO: 622297 - RNA, 12 nt, Homo sapiens
uucuuaauguca

SEQ ID NO: 622298 - RNA, 18 nt, Homo sapiens
uucuuacacugugucauu

SEQ ID NO: 622299 - RNA, 14 nt, Homo sapiens
uucuuacauaugau

SEQ ID NO: 622300 - RNA, 18 nt, Homo sapiens
uucuuacccaauuuccca

SEQ ID NO: 622301 - RNA, 16 nt, Homo sapiens
uucuuacuaaaaagua

SEQ ID NO: 622302 - RNA, 13 nt, Homo sapiens
uucuuagaccucc

SEQ ID NO: 622303 - RNA, 16 nt, Homo sapiens
uucuuagaguguagcu

SEQ ID NO: 622304 - RNA, 13 nt, Homo sapiens
uucuuagauauga

SEQ ID NO: 622305 - RNA, 17 nt, Homo sapiens
uucuuagucacaaaaua

SEQ ID NO: 622306 - RNA, 15 nt, Homo sapiens
uucuuauuacuauua

SEQ ID NO: 622307 - RNA, 17 nt, Homo sapiens
uucuuauuuuuguacuu

SEQ ID NO: 622308 - RNA, 14 nt, Homo sapiens
uucuucagagugaa

SEQ ID NO: 622309 - RNA, 21 nt, Homo sapiens
uucuucagauacaaacugcag

SEQ ID NO: 622310 - RNA, 12 nt, Homo sapiens
uucuucagcucu

SEQ ID NO: 622311 - RNA, 18 nt, Homo sapiens
uucuucauccaacuucca

SEQ ID NO: 622312 - RNA, 14 nt, Homo sapiens
uucuucauugcagu

SEQ ID NO: 622313 - RNA, 20 nt, Homo sapiens
uucuuccaucaucacuguaa

SEQ ID NO: 622314 - RNA, 20 nt, Homo sapiens
uucuuccccuuacucucaca

SEQ ID NO: 622315 - RNA, 22 nt, Homo sapiens
uucuucccgcacaaauuccaca

SEQ ID NO: 622316 - RNA, 12 nt, Homo sapiens
uucuuccuccaa

SEQ ID NO: 622317 - RNA, 14 nt, Homo sapiens
uucuuccuuucccu

SEQ ID NO: 622318 - RNA, 13 nt, Homo sapiens
uucuucguguaua

SEQ ID NO: 622319 - RNA, 20 nt, Homo sapiens
uucuucuaagaagacauuuu

SEQ ID NO: 622320 - RNA, 19 nt, Homo sapiens
uucuucuaauuaacagcuc

SEQ ID NO: 622321 - RNA, 14 nt, Homo sapiens
uucuucuacugcua

SEQ ID NO: 622322 - RNA, 16 nt, Homo sapiens
uucuucuguauguuag

SEQ ID NO: 622323 - RNA, 16 nt, Homo sapiens
uucuucuguccugaga

SEQ ID NO: 622324 - RNA, 22 nt, Homo sapiens
uucuucuucagaagacacugca

SEQ ID NO: 622325 - RNA, 19 nt, Homo sapiens
uucuugaaauuuuaaccua

SEQ ID NO: 622326 - RNA, 15 nt, Homo sapiens
uucuugaggucuuga

SEQ ID NO: 622327 - RNA, 23 nt, Homo sapiens
uucuugaguugucuuuugccauu

SEQ ID NO: 622328 - RNA, 20 nt, Homo sapiens
uucuugauuaaagugauuga

SEQ ID NO: 622329 - RNA, 18 nt, Homo sapiens
uucuugccuugaguucca

SEQ ID NO: 622330 - RNA, 19 nt, Homo sapiens
uucuuggagcuuuggaaua

SEQ ID NO: 622331 - RNA, 19 nt, Homo sapiens
uucuugggguacucuugau

SEQ ID NO: 622332 - RNA, 18 nt, Homo sapiens
uucuuggggucccaggga

SEQ ID NO: 622333 - RNA, 16 nt, Homo sapiens
uucuugggucugcccu

SEQ ID NO: 622334 - RNA, 22 nt, Homo sapiens
uucuuggugcucuguguuccca

SEQ ID NO: 622335 - RNA, 21 nt, Homo sapiens
uucuuguaccacuucaucaaa

SEQ ID NO: 622336 - RNA, 20 nt, Homo sapiens
uucuuguauauuauggaaga

SEQ ID NO: 622337 - RNA, 14 nt, Homo sapiens
uucuuuaagaaccu

SEQ ID NO: 622338 - RNA, 21 nt, Homo sapiens
uucuuuaccaaaaccauccau

SEQ ID NO: 622339 - RNA, 13 nt, Homo sapiens
uucuuuaccucag

SEQ ID NO: 622340 - RNA, 16 nt, Homo sapiens
uucuuuagaugccaaa

SEQ ID NO: 622341 - RNA, 15 nt, Homo sapiens
uucuuuaucuugaca

SEQ ID NO: 622342 - RNA, 12 nt, Homo sapiens
uucuuucaggaa

SEQ ID NO: 622343 - RNA, 15 nt, Homo sapiens
uucuuuccacugaau

SEQ ID NO: 622344 - RNA, 23 nt, Homo sapiens
uucuuuccucuuccccuugcccu

SEQ ID NO: 622345 - RNA, 13 nt, Homo sapiens
uucuuucuuccau

SEQ ID NO: 622346 - RNA, 13 nt, Homo sapiens
uucuuugaaguuu

SEQ ID NO: 622347 - RNA, 16 nt, Homo sapiens
uucuuugcugcaguca

SEQ ID NO: 622348 - RNA, 20 nt, Homo sapiens
uucuuugggauugcuaugaa

SEQ ID NO: 622349 - RNA, 16 nt, Homo sapiens
uucuuuuauacugaca

SEQ ID NO: 622350 - RNA, 15 nt, Homo sapiens
uucuuuucuuuacaa

SEQ ID NO: 622351 - RNA, 15 nt, Homo sapiens
uucuuuugcaauaau

SEQ ID NO: 622352 - RNA, 13 nt, Homo sapiens
uucuuuugcucuu

SEQ ID NO: 622353 - RNA, 21 nt, Homo sapiens
uucuuuuggcaauacauuuga

SEQ ID NO: 622354 - RNA, 22 nt, Homo sapiens
uucuuuuguguuccuauggaaa

SEQ ID NO: 622355 - RNA, 13 nt, Homo sapiens
uucuuuuuccaca

SEQ ID NO: 622356 - RNA, 20 nt, Homo sapiens
uucuuuuuccacaaggaaua

SEQ ID NO: 622357 - RNA, 13 nt, Homo sapiens
uucuuuuugccaa

SEQ ID NO: 622358 - RNA, 20 nt, Homo sapiens
uugaaaaaaaacccuugauu

SEQ ID NO: 622359 - RNA, 19 nt, Homo sapiens
uugaaaaaugagagcugua

SEQ ID NO: 622360 - RNA, 13 nt, Homo sapiens
uugaaaacacuua

SEQ ID NO: 622361 - RNA, 15 nt, Homo sapiens
uugaaaacugugcaa

SEQ ID NO: 622362 - RNA, 14 nt, Homo sapiens
uugaaaagaacaaa

SEQ ID NO: 622363 - RNA, 21 nt, Homo sapiens
uugaaaaggcgguacuaguuc

SEQ ID NO: 622364 - RNA, 16 nt, Homo sapiens
uugaaaauaaugcugu

SEQ ID NO: 622365 - RNA, 13 nt, Homo sapiens
uugaaaaugggcu

SEQ ID NO: 622366 - RNA, 21 nt, Homo sapiens
uugaaaauguguuguugcugu

SEQ ID NO: 622367 - RNA, 12 nt, Homo sapiens
uugaaaauguuc

SEQ ID NO: 622368 - RNA, 22 nt, Homo sapiens
uugaaacagcagucccaguauu

SEQ ID NO: 622369 - RNA, 18 nt, Homo sapiens
uugaaacauagagaucua

SEQ ID NO: 622370 - RNA, 13 nt, Homo sapiens
uugaaacauaucu

SEQ ID NO: 622371 - RNA, 13 nt, Homo sapiens
uugaaaccaaaga

SEQ ID NO: 622372 - RNA, 13 nt, Homo sapiens
uugaaacuuugaa

SEQ ID NO: 622373 - RNA, 13 nt, Homo sapiens
uugaaagaauuag

SEQ ID NO: 622374 - RNA, 20 nt, Homo sapiens
uugaaaguuuuccaguauug

SEQ ID NO: 622375 - RNA, 16 nt, Homo sapiens
uugaaauagucugugu

SEQ ID NO: 622376 - RNA, 21 nt, Homo sapiens
uugaaaucaaugcaagaguga

SEQ ID NO: 622377 - RNA, 13 nt, Homo sapiens
uugaaauccagaa

SEQ ID NO: 622378 - RNA, 14 nt, Homo sapiens
uugaaauccaggaa

SEQ ID NO: 622379 - RNA, 23 nt, Homo sapiens
uugaaaugagaaacuuugaucuc

SEQ ID NO: 622380 - RNA, 20 nt, Homo sapiens
uugaaaugaguaaaaacuag

SEQ ID NO: 622381 - RNA, 20 nt, Homo sapiens
uugaaauuaagaaggcaaaa

SEQ ID NO: 622382 - RNA, 17 nt, Homo sapiens
uugaaauuguagugcaa

SEQ ID NO: 622383 - RNA, 15 nt, Homo sapiens
uugaacccaggagau

SEQ ID NO: 622384 - RNA, 17 nt, Homo sapiens
uugaacuauaacuguug

SEQ ID NO: 622385 - RNA, 16 nt, Homo sapiens
uugaacugauucacau

SEQ ID NO: 622386 - RNA, 15 nt, Homo sapiens
uugaacuggaagaaa

SEQ ID NO: 622387 - RNA, 12 nt, Homo sapiens
uugaacuuguca

SEQ ID NO: 622388 - RNA, 18 nt, Homo sapiens
uugaacuuuauaaaacau

SEQ ID NO: 622389 - RNA, 21 nt, Homo sapiens
uugaagaaaaagacacagaca

SEQ ID NO: 622390 - RNA, 19 nt, Homo sapiens
uugaagaaaggaaccuggg

SEQ ID NO: 622391 - RNA, 21 nt, Homo sapiens
uugaagaagagaaaauuugaa

SEQ ID NO: 622392 - RNA, 22 nt, Homo sapiens
uugaagacaauuugauacauaa

SEQ ID NO: 622393 - RNA, 19 nt, Homo sapiens
uugaagaggccuaagucaa

SEQ ID NO: 622394 - RNA, 17 nt, Homo sapiens
uugaagauaucuugaaa

SEQ ID NO: 622395 - RNA, 16 nt, Homo sapiens
uugaagcuguugcuau

SEQ ID NO: 622396 - RNA, 17 nt, Homo sapiens
uugaagcuuuaagcaaa

SEQ ID NO: 622397 - RNA, 23 nt, Homo sapiens
uugaaggccuuauucuacauuuc

SEQ ID NO: 622398 - RNA, 17 nt, Homo sapiens
uugaagguguaaauggg

SEQ ID NO: 622399 - RNA, 17 nt, Homo sapiens
uugaagguuuguccaca

SEQ ID NO: 622400 - RNA, 18 nt, Homo sapiens
uugaaguauucaaucaag

SEQ ID NO: 622401 - RNA, 19 nt, Homo sapiens
ucgcugucgugacuacaca

SEQ ID NO: 622402 - RNA, 13 nt, Homo sapiens
ucgcugugccaca

SEQ ID NO: 622403 - RNA, 22 nt, Homo sapiens
ucgcuguuggagcaaaccauua

SEQ ID NO: 622404 - RNA, 13 nt, Homo sapiens
ucgcuucuugccu

SEQ ID NO: 622405 - RNA, 14 nt, Homo sapiens
ucgcuucuugccuc

SEQ ID NO: 622406 - RNA, 15 nt, Homo sapiens
ucgcuugaaccuggg

SEQ ID NO: 622407 - RNA, 21 nt, Homo sapiens
ucgcuuucuaaaggaaaucaa

SEQ ID NO: 622408 - RNA, 19 nt, Homo sapiens
ucggaaacuauaaguaauu

SEQ ID NO: 622409 - RNA, 20 nt, Homo sapiens
ucggagaaacgggugagcug

SEQ ID NO: 622410 - RNA, 18 nt, Homo sapiens
ucggagacagugaucucc

SEQ ID NO: 622411 - RNA, 16 nt, Homo sapiens
ucggagagcagcagca

SEQ ID NO: 622412 - RNA, 15 nt, Homo sapiens
ucggagccaacaaga

SEQ ID NO: 622413 - RNA, 17 nt, Homo sapiens
ucggagcggcgucccuu

SEQ ID NO: 622414 - RNA, 16 nt, Homo sapiens
ucggagcuggcugugc

SEQ ID NO: 622415 - RNA, 13 nt, Homo sapiens
ucggaggacccug

SEQ ID NO: 622416 - RNA, 17 nt, Homo sapiens
ucggauacacacucgaa

SEQ ID NO: 622417 - RNA, 21 nt, Homo sapiens
ucggauacccuggagcaagac

SEQ ID NO: 622418 - RNA, 14 nt, Homo sapiens
ucggcacacacugu

SEQ ID NO: 622419 - RNA, 16 nt, Homo sapiens
ucggcacacacugugc

SEQ ID NO: 622420 - RNA, 16 nt, Homo sapiens
ucggcaggggccuugu

SEQ ID NO: 622421 - RNA, 21 nt, Homo sapiens
ucggcauuuaacuuacauuug

SEQ ID NO: 622422 - RNA, 14 nt, Homo sapiens
ucggccaccacaga

SEQ ID NO: 622423 - RNA, 19 nt, Homo sapiens
ucggcuccgggcaaauggc

SEQ ID NO: 622424 - RNA, 15 nt, Homo sapiens
ucggcugaccaugcu

SEQ ID NO: 622425 - RNA, 21 nt, Homo sapiens
ucggcuuuuugccaucuguga

SEQ ID NO: 622426 - RNA, 15 nt, Homo sapiens
ucggggaacuccugg

SEQ ID NO: 622427 - RNA, 13 nt, Homo sapiens
ucggggugcuccu

SEQ ID NO: 622428 - RNA, 20 nt, Homo sapiens
ucggucaccuguuggcuaca

SEQ ID NO: 622429 - RNA, 18 nt, Homo sapiens
ucguaguguuaaguuaua

SEQ ID NO: 622430 - RNA, 20 nt, Homo sapiens
ucguaucccgagucugggac

SEQ ID NO: 622431 - RNA, 13 nt, Homo sapiens
ucguccugggacu

SEQ ID NO: 622432 - RNA, 17 nt, Homo sapiens
ucgucuuuacuuccauc

SEQ ID NO: 622433 - RNA, 20 nt, Homo sapiens
ucgugcuucauaggugccac

SEQ ID NO: 622434 - RNA, 15 nt, Homo sapiens
ucguggacugugcug

SEQ ID NO: 622435 - RNA, 14 nt, Homo sapiens
ucguuaaaaacaga

SEQ ID NO: 622436 - RNA, 16 nt, Homo sapiens
ucguuaaaaacagauu

SEQ ID NO: 622437 - RNA, 20 nt, Homo sapiens
ucguuaauagauuauuucau

SEQ ID NO: 622438 - RNA, 14 nt, Homo sapiens
ucguuucucagaag

SEQ ID NO: 622439 - RNA, 20 nt, Homo sapiens
ucguuugugaacgcugugau

SEQ ID NO: 622440 - RNA, 23 nt, Homo sapiens
ucguuuucgcuggggauggaauu

SEQ ID NO: 622441 - RNA, 22 nt, Homo sapiens
ucguuuugcccgauuccguauu

SEQ ID NO: 622442 - RNA, 23 nt, Homo sapiens
ucguuuuucagcacccccaccca

SEQ ID NO: 622443 - RNA, 16 nt, Homo sapiens
ucguuuuuuuggucac

SEQ ID NO: 622444 - RNA, 13 nt, Homo sapiens
ucuaaaaacuuag

SEQ ID NO: 622445 - RNA, 13 nt, Homo sapiens
ucuaaaacauucc

SEQ ID NO: 622446 - RNA, 17 nt, Homo sapiens
ucuaaaacugccuucca

SEQ ID NO: 622447 - RNA, 20 nt, Homo sapiens
ucuaaaauaacuaguacaaa

SEQ ID NO: 622448 - RNA, 17 nt, Homo sapiens
ucuaaaauacaaaccca

SEQ ID NO: 622449 - RNA, 17 nt, Homo sapiens
ucuaaaaucccuuucaa

SEQ ID NO: 622450 - RNA, 15 nt, Homo sapiens
ucuaaaaucugcuag

SEQ ID NO: 622451 - RNA, 21 nt, Homo sapiens
ucuaaacagugggaguaccaa

SEQ ID NO: 622452 - RNA, 22 nt, Homo sapiens
ucuaaacagugggaguaccaaa

SEQ ID NO: 622453 - RNA, 12 nt, Homo sapiens
ucuaaaccuuac

SEQ ID NO: 622454 - RNA, 22 nt, Homo sapiens
ucuaaacuacaacgaacacaag

SEQ ID NO: 622455 - RNA, 20 nt, Homo sapiens
ucuaaagaauguguucuaaa

SEQ ID NO: 622456 - RNA, 23 nt, Homo sapiens
ucugagugggcccagcacauggc

SEQ ID NO: 622457 - RNA, 22 nt, Homo sapiens
ucugauaaacacaaucugcuag

SEQ ID NO: 622458 - RNA, 14 nt, Homo sapiens
ucugauaaugcuca

SEQ ID NO: 622459 - RNA, 19 nt, Homo sapiens
ucugaugucccagugcuca

SEQ ID NO: 622460 - RNA, 18 nt, Homo sapiens
ucugauguggcaaaaggc

SEQ ID NO: 622461 - RNA, 17 nt, Homo sapiens
ucugauguuacugagau

SEQ ID NO: 622462 - RNA, 21 nt, Homo sapiens
ucugauucgaaugacacuguu

SEQ ID NO: 622463 - RNA, 18 nt, Homo sapiens
ucugauuuccuaauguca

SEQ ID NO: 622464 - RNA, 14 nt, Homo sapiens
ucugauuuguccug

SEQ ID NO: 622465 - RNA, 14 nt, Homo sapiens
ucugcaaaggccug

SEQ ID NO: 622466 - RNA, 20 nt, Homo sapiens
ucugcaagaauuaaaacuga

SEQ ID NO: 622467 - RNA, 18 nt, Homo sapiens
ucugcaaggucuuugguu

SEQ ID NO: 622468 - RNA, 23 nt, Homo sapiens
ucugcaauaugaauucaagaaag

SEQ ID NO: 622469 - RNA, 17 nt, Homo sapiens
ucugcaccacaccuggc

SEQ ID NO: 622470 - RNA, 20 nt, Homo sapiens
ucugcacccagaacaguggu

SEQ ID NO: 622471 - RNA, 12 nt, Homo sapiens
ucugcacccagg

SEQ ID NO: 622472 - RNA, 19 nt, Homo sapiens
ucugcacguugcugaaggu

SEQ ID NO: 622473 - RNA, 13 nt, Homo sapiens
ucugcacuacucc

SEQ ID NO: 622474 - RNA, 15 nt, Homo sapiens
ucugcacuguucaaa

SEQ ID NO: 622475 - RNA, 19 nt, Homo sapiens
ucugcacuguucaaaccuc

SEQ ID NO: 622476 - RNA, 23 nt, Homo sapiens
ucugcacuuauaagaaagaucaa

SEQ ID NO: 622477 - RNA, 13 nt, Homo sapiens
ucugcagaguucu

SEQ ID NO: 622478 - RNA, 21 nt, Homo sapiens
ucugcagcccagccuagucag

SEQ ID NO: 622479 - RNA, 23 nt, Homo sapiens
ucugcagcccggcgccaccaucc

SEQ ID NO: 622480 - RNA, 23 nt, Homo sapiens
ucugcaggcuggggaggugcugg

SEQ ID NO: 622481 - RNA, 20 nt, Homo sapiens
ucugcagggagcaacucucc

SEQ ID NO: 622482 - RNA, 14 nt, Homo sapiens
ucugcaguagggga

SEQ ID NO: 622483 - RNA, 19 nt, Homo sapiens
ucugcaguccuacucaagc

SEQ ID NO: 622484 - RNA, 16 nt, Homo sapiens
ucugcagugaugcaau

SEQ ID NO: 622485 - RNA, 15 nt, Homo sapiens
ucugcaguuuugaca

SEQ ID NO: 622486 - RNA, 16 nt, Homo sapiens
ucugcauauuucugua

SEQ ID NO: 622487 - RNA, 15 nt, Homo sapiens
ucugcauccagagau

SEQ ID NO: 622488 - RNA, 12 nt, Homo sapiens
ucugcaucccag

SEQ ID NO: 622489 - RNA, 22 nt, Homo sapiens
ucugcauggaacagcauuaccc

SEQ ID NO: 622490 - RNA, 17 nt, Homo sapiens
ucugcaugucuacucag

SEQ ID NO: 622491 - RNA, 19 nt, Homo sapiens
ucugcauguuacauaagau

SEQ ID NO: 622492 - RNA, 11 nt, Homo sapiens
ucugcauuuac

SEQ ID NO: 622493 - RNA, 15 nt, Homo sapiens
ucugcauuuugcuau

SEQ ID NO: 622494 - RNA, 19 nt, Homo sapiens
ucugccaaaggaugugaua

SEQ ID NO: 622495 - RNA, 19 nt, Homo sapiens
ucugccacccacucaggau

SEQ ID NO: 622496 - RNA, 21 nt, Homo sapiens
ucugccacccacucaggauug

SEQ ID NO: 622497 - RNA, 16 nt, Homo sapiens
ucugccagaauacugg

SEQ ID NO: 622498 - RNA, 23 nt, Homo sapiens
ucugccagcgccaaaacaagcca

SEQ ID NO: 622499 - RNA, 18 nt, Homo sapiens
ucugccauuaaaacauua

SEQ ID NO: 622500 - RNA, 14 nt, Homo sapiens
ucugccauucaacu

SEQ ID NO: 622501 - RNA, 13 nt, Homo sapiens
ucugccauuucau

SEQ ID NO: 622502 - RNA, 20 nt, Homo sapiens
ucugcccagcuugggcccag

SEQ ID NO: 622503 - RNA, 16 nt, Homo sapiens
ucugccccacccucaa

SEQ ID NO: 622504 - RNA, 13 nt, Homo sapiens
ucugccccagaua

SEQ ID NO: 622505 - RNA, 16 nt, Homo sapiens
ucugccccagcccaga

SEQ ID NO: 622506 - RNA, 15 nt, Homo sapiens
ucugcccuagggaga

SEQ ID NO: 622507 - RNA, 20 nt, Homo sapiens
ucugcccugaacccacugcu

SEQ ID NO: 622508 - RNA, 22 nt, Homo sapiens
ucugcccugaacccacugcugc

SEQ ID NO: 622509 - RNA, 19 nt, Homo sapiens
ucugcccugccuacuuuua

SEQ ID NO: 622510 - RNA, 14 nt, Homo sapiens
ucugcccuuguucc

SEQ ID NO: 622511 - RNA, 20 nt, Homo sapiens
ucugccguuuucccacuuuc

SEQ ID NO: 622512 - RNA, 22 nt, Homo sapiens
ucugccuagaguguagccuaaa

SEQ ID NO: 622513 - RNA, 13 nt, Homo sapiens
ucugccuccuggu

SEQ ID NO: 622514 - RNA, 22 nt, Homo sapiens
aaauguguauuuuucaaggcau

SEQ ID NO: 622515 - RNA, 23 nt, Homo sapiens
aaauguguauuuuucaaggcauu

SEQ ID NO: 622516 - RNA, 17 nt, Homo sapiens
aaauguuacuucucuca

SEQ ID NO: 622517 - RNA, 22 nt, Homo sapiens
aaauguuauuuuuuaauuauua

SEQ ID NO: 622518 - RNA, 21 nt, Homo sapiens
aaauguucauggacuauucca

SEQ ID NO: 622519 - RNA, 17 nt, Homo sapiens
aaauguucuaacagauc

SEQ ID NO: 622520 - RNA, 17 nt, Homo sapiens
aaauguucuauuuaaca

SEQ ID NO: 622521 - RNA, 17 nt, Homo sapiens
aaauguuuauacuguau

SEQ ID NO: 622522 - RNA, 20 nt, Homo sapiens
aaauguuugaguauucugca

SEQ ID NO: 622523 - RNA, 14 nt, Homo sapiens
aaauguuuuacuca

SEQ ID NO: 622524 - RNA, 19 nt, Homo sapiens
aaauguuuugaaaugauau

SEQ ID NO: 622525 - RNA, 14 nt, Homo sapiens
aaauguuuugaugg

SEQ ID NO: 622526 - RNA, 14 nt, Homo sapiens
aaauuaaaaccaau

SEQ ID NO: 622527 - RNA, 15 nt, Homo sapiens
aaauuaaaaccugau

SEQ ID NO: 622528 - RNA, 16 nt, Homo sapiens
aaauuaaaaccugaua

SEQ ID NO: 622529 - RNA, 23 nt, Homo sapiens
aaauuaaagcccauaaggccaga

SEQ ID NO: 622530 - RNA, 17 nt, Homo sapiens
aaauuaacaguccuaac

SEQ ID NO: 622531 - RNA, 17 nt, Homo sapiens
aaauuaacuuacuucca

SEQ ID NO: 622532 - RNA, 17 nt, Homo sapiens
aaauuaagaaaucauuc

SEQ ID NO: 622533 - RNA, 17 nt, Homo sapiens
aaauuaauacugaagga

SEQ ID NO: 622534 - RNA, 15 nt, Homo sapiens
aaauuaauagcuuuu

SEQ ID NO: 622535 - RNA, 16 nt, Homo sapiens
aaauuacaauugucau

SEQ ID NO: 622536 - RNA, 15 nt, Homo sapiens
aaauuacacaauaaa

SEQ ID NO: 622537 - RNA, 14 nt, Homo sapiens
aaauuaccagauau

SEQ ID NO: 622538 - RNA, 13 nt, Homo sapiens
aaauuacugugua

SEQ ID NO: 622539 - RNA, 13 nt, Homo sapiens
aaauuagcuugag

SEQ ID NO: 622540 - RNA, 15 nt, Homo sapiens
aaauuaggacuguau

SEQ ID NO: 622541 - RNA, 20 nt, Homo sapiens
aaauuagguugaaacauauc

SEQ ID NO: 622542 - RNA, 22 nt, Homo sapiens
aaauuaguauagcuacuuugga

SEQ ID NO: 622543 - RNA, 12 nt, Homo sapiens
aaauuagucacu

SEQ ID NO: 622544 - RNA, 15 nt, Homo sapiens
aaauuagugaguaua

SEQ ID NO: 622545 - RNA, 24 nt, Homo sapiens
aaauuaguuuaccucauccaugca

SEQ ID NO: 622546 - RNA, 20 nt, Homo sapiens
aaauuaguuucaaauuuacc

SEQ ID NO: 622547 - RNA, 16 nt, Homo sapiens
aaauuauaaaccaagg

SEQ ID NO: 622548 - RNA, 16 nt, Homo sapiens
aaauuauaucucagua

SEQ ID NO: 622549 - RNA, 21 nt, Homo sapiens
aaauuaucuugauacauucaa

SEQ ID NO: 622550 - RNA, 17 nt, Homo sapiens
aaauuauguauguuuac

SEQ ID NO: 622551 - RNA, 23 nt, Homo sapiens
aaauuauguuuuaaacacaugcc

SEQ ID NO: 622552 - RNA, 21 nt, Homo sapiens
aaauuauuacuaaugaugcuu

SEQ ID NO: 622553 - RNA, 19 nt, Homo sapiens
aaauuauucagaacuauuu

SEQ ID NO: 622554 - RNA, 20 nt, Homo sapiens
aaauuauuugaaaacauaua

SEQ ID NO: 622555 - RNA, 21 nt, Homo sapiens
aaauuauuugaaaacauauaa

SEQ ID NO: 622556 - RNA, 21 nt, Homo sapiens
aaauuauuuuaaaaacuaaaa

SEQ ID NO: 622557 - RNA, 20 nt, Homo sapiens
aaauucaaaaccugcaguua

SEQ ID NO: 622558 - RNA, 17 nt, Homo sapiens
aaauucaaacauauucu

SEQ ID NO: 622559 - RNA, 17 nt, Homo sapiens
aaauucaaccacuguaa

SEQ ID NO: 622560 - RNA, 18 nt, Homo sapiens
aaauucaauuaggauuaa

SEQ ID NO: 622561 - RNA, 20 nt, Homo sapiens
aaauucacaagcuaacuucc

SEQ ID NO: 622562 - RNA, 19 nt, Homo sapiens
aaauucacuaaucuugaau

SEQ ID NO: 622563 - RNA, 20 nt, Homo sapiens
aaauucagaaagucauagau

SEQ ID NO: 622564 - RNA, 14 nt, Homo sapiens
aaauucagaacaag

SEQ ID NO: 622565 - RNA, 23 nt, Homo sapiens
aaauucagaacagccugccuguc

SEQ ID NO: 622566 - RNA, 11 nt, Homo sapiens
aaauucauccu

SEQ ID NO: 622567 - RNA, 17 nt, Homo sapiens
aaauucauuugcuugca

SEQ ID NO: 622568 - RNA, 19 nt, Homo sapiens
aaauuccacacuaccacau

SEQ ID NO: 622569 - RNA, 15 nt, Homo sapiens
aacaaauguauuuca

SEQ ID NO: 622570 - RNA, 16 nt, Homo sapiens
aacaaauguauuucaa

SEQ ID NO: 622571 - RNA, 15 nt, Homo sapiens
aacaaaugugcugcu

SEQ ID NO: 622572 - RNA, 15 nt, Homo sapiens
aacaaauugaugcaa

SEQ ID NO: 622573 - RNA, 19 nt, Homo sapiens
aacaaauugggaucugucu

SEQ ID NO: 622574 - RNA, 20 nt, Homo sapiens
aacaacaaagccaacaguca

SEQ ID NO: 622575 - RNA, 14 nt, Homo sapiens
aacaacaaauaauu

SEQ ID NO: 622576 - RNA, 23 nt, Homo sapiens
aacaacaacgagauaccaucuca

SEQ ID NO: 622577 - RNA, 12 nt, Homo sapiens
aacaacauaucu

SEQ ID NO: 622578 - RNA, 19 nt, Homo sapiens
aacaaccugaaugucccaa

SEQ ID NO: 622579 - RNA, 15 nt, Homo sapiens
aacaaccuggucaca

SEQ ID NO: 622580 - RNA, 21 nt, Homo sapiens
aacaacguguauagugccuaa

SEQ ID NO: 622581 - RNA, 13 nt, Homo sapiens
aacaacuaccuga

SEQ ID NO: 622582 - RNA, 21 nt, Homo sapiens
aacaacuauuuuucacauaau

SEQ ID NO: 622583 - RNA, 19 nt, Homo sapiens
aacaacuguggucaauccg

SEQ ID NO: 622584 - RNA, 14 nt, Homo sapiens
aacaagaguuuuaa

SEQ ID NO: 622585 - RNA, 12 nt, Homo sapiens
aacaagaucugc

SEQ ID NO: 622586 - RNA, 15 nt, Homo sapiens
aacaagccaaagagc

SEQ ID NO: 622587 - RNA, 23 nt, Homo sapiens
aacaagcccguuagccccaggga

SEQ ID NO: 622588 - RNA, 20 nt, Homo sapiens
aacaagcccuaacuucugua

SEQ ID NO: 622589 - RNA, 12 nt, Homo sapiens
aacaagcugugc

SEQ ID NO: 622590 - RNA, 14 nt, Homo sapiens
aacaaggugucuuu

SEQ ID NO: 622591 - RNA, 13 nt, Homo sapiens
aacaagucccugu

SEQ ID NO: 622592 - RNA, 16 nt, Homo sapiens
aacaagucccuguaau

SEQ ID NO: 622593 - RNA, 14 nt, Homo sapiens
aacaaguguaucuc

SEQ ID NO: 622594 - RNA, 18 nt, Homo sapiens
aacaaguuuuucugucaa

SEQ ID NO: 622595 - RNA, 20 nt, Homo sapiens
aacaauaaaaugucuucucc

SEQ ID NO: 622596 - RNA, 21 nt, Homo sapiens
aacaauauguuugcaaacuug

SEQ ID NO: 622597 - RNA, 21 nt, Homo sapiens
aacaaucuaagggucucucau

SEQ ID NO: 622598 - RNA, 13 nt, Homo sapiens
aacaaucucucaa

SEQ ID NO: 622599 - RNA, 13 nt, Homo sapiens
aacaaugacuuaa

SEQ ID NO: 622600 - RNA, 23 nt, Homo sapiens
aacaaugcaguacaggacauaua

SEQ ID NO: 622601 - RNA, 21 nt, Homo sapiens
aacaauguauaaagauuguac

SEQ ID NO: 622602 - RNA, 22 nt, Homo sapiens
aacaaugucugguuaguuaaaa

SEQ ID NO: 622603 - RNA, 18 nt, Homo sapiens
aacaauugaaguaaacuu

SEQ ID NO: 622604 - RNA, 13 nt, Homo sapiens
aacaauugcuuua

SEQ ID NO: 622605 - RNA, 17 nt, Homo sapiens
aacaauuuuuuccccaa

SEQ ID NO: 622606 - RNA, 22 nt, Homo sapiens
aacacaagagacuuaaaggaca

SEQ ID NO: 622607 - RNA, 13 nt, Homo sapiens
aacacaagcaaaa

SEQ ID NO: 622608 - RNA, 16 nt, Homo sapiens
aacacaagccacagaa

SEQ ID NO: 622609 - RNA, 13 nt, Homo sapiens
aacacacacuguu

SEQ ID NO: 622610 - RNA, 19 nt, Homo sapiens
aacacacacuguucugaaa

SEQ ID NO: 622611 - RNA, 12 nt, Homo sapiens
aacacacaugca

SEQ ID NO: 622612 - RNA, 14 nt, Homo sapiens
aacacacaugcaca

SEQ ID NO: 622613 - RNA, 17 nt, Homo sapiens
aacacacgauaccuguu

SEQ ID NO: 622614 - RNA, 22 nt, Homo sapiens
aacacacuuggaugcaggguuu

SEQ ID NO: 622615 - RNA, 18 nt, Homo sapiens
aacacagacaaagugcua

SEQ ID NO: 622616 - RNA, 22 nt, Homo sapiens
aacacagauccgcaagaguaaa

SEQ ID NO: 622617 - RNA, 13 nt, Homo sapiens
aacacaugccuua

SEQ ID NO: 622618 - RNA, 20 nt, Homo sapiens
aacacaugugcagucacugg

SEQ ID NO: 622619 - RNA, 21 nt, Homo sapiens
aacacaugugcagucacuggu

SEQ ID NO: 622620 - RNA, 17 nt, Homo sapiens
aacacauucuuauuaau

SEQ ID NO: 622621 - RNA, 15 nt, Homo sapiens
aacacauuugcccaa

SEQ ID NO: 622622 - RNA, 19 nt, Homo sapiens
aacacauuuuuuaacuaau

SEQ ID NO: 622623 - RNA, 17 nt, Homo sapiens
aacaccaaaaagggauc

SEQ ID NO: 622624 - RNA, 20 nt, Homo sapiens
aacaccacuaauuguguaca

SEQ ID NO: 622625 - RNA, 19 nt, Homo sapiens
aacacccgacuccucaaaa

SEQ ID NO: 622626 - RNA, 16 nt, Homo sapiens
aacccugucugagaug

SEQ ID NO: 622627 - RNA, 12 nt, Homo sapiens
aacccuguggaa

SEQ ID NO: 622628 - RNA, 15 nt, Homo sapiens
aacccuguguucaca

SEQ ID NO: 622629 - RNA, 15 nt, Homo sapiens
aacccuuaacugaca

SEQ ID NO: 622630 - RNA, 15 nt, Homo sapiens
aacccuugagaugau

SEQ ID NO: 622631 - RNA, 20 nt, Homo sapiens
aaccgacacuccuacaagau

SEQ ID NO: 622632 - RNA, 16 nt, Homo sapiens
aaccgcacaugcacac

SEQ ID NO: 622633 - RNA, 21 nt, Homo sapiens
aaccgcugccuuuaucuugaa

SEQ ID NO: 622634 - RNA, 23 nt, Homo sapiens
aaccuaacugcaauguggauguu

SEQ ID NO: 622635 - RNA, 19 nt, Homo sapiens
aaccuaaugcucucaggga

SEQ ID NO: 622636 - RNA, 20 nt, Homo sapiens
aaccuaccaccccuuccugu

SEQ ID NO: 622637 - RNA, 12 nt, Homo sapiens
aaccuaccuccc

SEQ ID NO: 622638 - RNA, 18 nt, Homo sapiens
aaccuagugcugauucac

SEQ ID NO: 622639 - RNA, 14 nt, Homo sapiens
aaccuaucuaugaa

SEQ ID NO: 622640 - RNA, 11 nt, Homo sapiens
aaccuaugaag

SEQ ID NO: 622641 - RNA, 23 nt, Homo sapiens
aaccuaugauauuuucugugccu

SEQ ID NO: 622642 - RNA, 17 nt, Homo sapiens
aaccuauguguccucua

SEQ ID NO: 622643 - RNA, 13 nt, Homo sapiens
aaccucaaaguga

SEQ ID NO: 622644 - RNA, 16 nt, Homo sapiens
aaccucaaagugacua

SEQ ID NO: 622645 - RNA, 19 nt, Homo sapiens
aaccucaguauuuauguaa

SEQ ID NO: 622646 - RNA, 23 nt, Homo sapiens
aaccucagugauuggcucugugg

SEQ ID NO: 622647 - RNA, 22 nt, Homo sapiens
aaccucaguuuccucaucugca

SEQ ID NO: 622648 - RNA, 12 nt, Homo sapiens
aaccucaucucu

SEQ ID NO: 622649 - RNA, 14 nt, Homo sapiens
aaccucaucuuucu

SEQ ID NO: 622650 - RNA, 15 nt, Homo sapiens
aaccucauuccccaa

SEQ ID NO: 622651 - RNA, 22 nt, Homo sapiens
aaccuccaaggaccucucucaa

SEQ ID NO: 622652 - RNA, 19 nt, Homo sapiens
aaccuccagugucaggguc

SEQ ID NO: 622653 - RNA, 14 nt, Homo sapiens
aaccuccauucuau

SEQ ID NO: 622654 - RNA, 15 nt, Homo sapiens
aaccucuagagucac

SEQ ID NO: 622655 - RNA, 22 nt, Homo sapiens
aaccucuagagucacugauaca

SEQ ID NO: 622656 - RNA, 20 nt, Homo sapiens
aaccucucgaacaguauuca

SEQ ID NO: 622657 - RNA, 20 nt, Homo sapiens
aaccucucuaagccacagcu

SEQ ID NO: 622658 - RNA, 22 nt, Homo sapiens
aaccucucugaucuugugcuca

SEQ ID NO: 622659 - RNA, 16 nt, Homo sapiens
aaccucucugugccau

SEQ ID NO: 622660 - RNA, 22 nt, Homo sapiens
aaccucugccgcccuccacacc

SEQ ID NO: 622661 - RNA, 17 nt, Homo sapiens
aaccugaagacugagga

SEQ ID NO: 622662 - RNA, 17 nt, Homo sapiens
aaccugaagaugaguaa

SEQ ID NO: 622663 - RNA, 21 nt, Homo sapiens
aaccugaauuaucuauuucau

SEQ ID NO: 622664 - RNA, 19 nt, Homo sapiens
aaccugacuuccucugcca

SEQ ID NO: 622665 - RNA, 12 nt, Homo sapiens
aaccugaguuua

SEQ ID NO: 622666 - RNA, 20 nt, Homo sapiens
aaccugaugccccuucccca

SEQ ID NO: 622667 - RNA, 17 nt, Homo sapiens
aaccugccugugcauga

SEQ ID NO: 622668 - RNA, 21 nt, Homo sapiens
aaccuggaaucuacaagccaa

SEQ ID NO: 622669 - RNA, 11 nt, Homo sapiens
aaccuggaccc

SEQ ID NO: 622670 - RNA, 16 nt, Homo sapiens
aaccuggagcacuuac

SEQ ID NO: 622671 - RNA, 18 nt, Homo sapiens
aaccuggaguauaauauu

SEQ ID NO: 622672 - RNA, 22 nt, Homo sapiens
aaccugggagccggaggcugca

SEQ ID NO: 622673 - RNA, 14 nt, Homo sapiens
aaccugucaugugc

SEQ ID NO: 622674 - RNA, 18 nt, Homo sapiens
aaccugucuccacugugc

SEQ ID NO: 622675 - RNA, 12 nt, Homo sapiens
aaccugugauga

SEQ ID NO: 622676 - RNA, 23 nt, Homo sapiens
aaccugugcucauuuugcaauuu

SEQ ID NO: 622677 - RNA, 17 nt, Homo sapiens
aaccuuaaauauauaau

SEQ ID NO: 622678 - RNA, 18 nt, Homo sapiens
aaccuuauuguaccucuc

SEQ ID NO: 622679 - RNA, 15 nt, Homo sapiens
aaccuucaacccagu

SEQ ID NO: 622680 - RNA, 19 nt, Homo sapiens
aaccuucacaucugucacg

SEQ ID NO: 622681 - RNA, 16 nt, Homo sapiens
aaccuuccaugucucc

SEQ ID NO: 622682 - RNA, 22 nt, Homo sapiens
aaccuugaaaaaaaacagugga

SEQ ID NO: 622683 - RNA, 19 nt, Homo sapiens
aaccuugucccagccagug

SEQ ID NO: 622684 - RNA, 16 nt, Homo sapiens
aaccuuuaaucugcac

SEQ ID NO: 622685 - RNA, 12 nt, Homo sapiens
aaccuuuacacu

SEQ ID NO: 622686 - RNA, 21 nt, Homo sapiens
aaccuuuagaauaucuuuuca

SEQ ID NO: 622687 - RNA, 15 nt, Homo sapiens
aaguuccacuucuug

SEQ ID NO: 622688 - RNA, 22 nt, Homo sapiens
aaguuccaguguucucucuuau

SEQ ID NO: 622689 - RNA, 21 nt, Homo sapiens
aaguuccccaucccugucauu

SEQ ID NO: 622690 - RNA, 23 nt, Homo sapiens
aaguuccccaucccugucauuuu

SEQ ID NO: 622691 - RNA, 22 nt, Homo sapiens
aaguucccuacuuccugugacu

SEQ ID NO: 622692 - RNA, 22 nt, Homo sapiens
aaguucccuaugaaaaaugugu

SEQ ID NO: 622693 - RNA, 15 nt, Homo sapiens
aaguucuaaguucau

SEQ ID NO: 622694 - RNA, 21 nt, Homo sapiens
aaguucucaauguucuuuucc

SEQ ID NO: 622695 - RNA, 15 nt, Homo sapiens
aaguucugacuugac

SEQ ID NO: 622696 - RNA, 18 nt, Homo sapiens
aaguucuuggaccaguuu

SEQ ID NO: 622697 - RNA, 23 nt, Homo sapiens
aaguugaauuuucuuuccagcca

SEQ ID NO: 622698 - RNA, 14 nt, Homo sapiens
aaguugaugcaauc

SEQ ID NO: 622699 - RNA, 21 nt, Homo sapiens
aaguugcugcuugugaucuca

SEQ ID NO: 622700 - RNA, 20 nt, Homo sapiens
aaguugggcgguuucaggga

SEQ ID NO: 622701 - RNA, 23 nt, Homo sapiens
aaguuggugcuuuugagaaccaa

SEQ ID NO: 622702 - RNA, 16 nt, Homo sapiens
aaguuguaccaaaaca

SEQ ID NO: 622703 - RNA, 14 nt, Homo sapiens
aaguugugccaaau

SEQ ID NO: 622704 - RNA, 16 nt, Homo sapiens
aaguuuaaucagagga

SEQ ID NO: 622705 - RNA, 15 nt, Homo sapiens
aaguuuacacuucau

SEQ ID NO: 622706 - RNA, 14 nt, Homo sapiens
aaguuuacuucucu

SEQ ID NO: 622707 - RNA, 20 nt, Homo sapiens
aaguuuauuuuuucuacaca

SEQ ID NO: 622708 - RNA, 11 nt, Homo sapiens
aaguuucacau

SEQ ID NO: 622709 - RNA, 13 nt, Homo sapiens
aaguuucacccaa

SEQ ID NO: 622710 - RNA, 16 nt, Homo sapiens
aaguuucagauuugcc

SEQ ID NO: 622711 - RNA, 17 nt, Homo sapiens
aaguuucaucagucaau

SEQ ID NO: 622712 - RNA, 22 nt, Homo sapiens
aaguuucccuucucccagucca

SEQ ID NO: 622713 - RNA, 18 nt, Homo sapiens
aaguuucugcagcagaug

SEQ ID NO: 622714 - RNA, 14 nt, Homo sapiens
aaguuucuuaagga

SEQ ID NO: 622715 - RNA, 15 nt, Homo sapiens
aaguuugaagcacaa

SEQ ID NO: 622716 - RNA, 22 nt, Homo sapiens
aaguuugacacaaacucacaca

SEQ ID NO: 622717 - RNA, 15 nt, Homo sapiens
aaguuugucuucaug

SEQ ID NO: 622718 - RNA, 13 nt, Homo sapiens
aaguuuucaggac

SEQ ID NO: 622719 - RNA, 18 nt, Homo sapiens
aauaaaaaagcucuuuua

SEQ ID NO: 622720 - RNA, 16 nt, Homo sapiens
aauaaaaacucuuaua

SEQ ID NO: 622721 - RNA, 13 nt, Homo sapiens
aauaaaaacugac

SEQ ID NO: 622722 - RNA, 20 nt, Homo sapiens
aauaaaaagauggacaagaa

SEQ ID NO: 622723 - RNA, 16 nt, Homo sapiens
aauaaaaaggcaauca

SEQ ID NO: 622724 - RNA, 20 nt, Homo sapiens
aauaaaaagugacacagcag

SEQ ID NO: 622725 - RNA, 17 nt, Homo sapiens
aauaaaaagugccuaaa

SEQ ID NO: 622726 - RNA, 17 nt, Homo sapiens
aauaaaaaguucagagu

SEQ ID NO: 622727 - RNA, 22 nt, Homo sapiens
aauaaaaaucaacucaucauuu

SEQ ID NO: 622728 - RNA, 14 nt, Homo sapiens
aauaaaaccuguua

SEQ ID NO: 622729 - RNA, 12 nt, Homo sapiens
aauaaaacugaa

SEQ ID NO: 622730 - RNA, 18 nt, Homo sapiens
aauaaaagaugauuucuc

SEQ ID NO: 622731 - RNA, 14 nt, Homo sapiens
aauaaaauaucaua

SEQ ID NO: 622732 - RNA, 20 nt, Homo sapiens
aauaaaauaugagagcaaua

SEQ ID NO: 622733 - RNA, 16 nt, Homo sapiens
aauaaaaugagcaaaa

SEQ ID NO: 622734 - RNA, 17 nt, Homo sapiens
aauacuuuuuaaaaggu

SEQ ID NO: 622735 - RNA, 22 nt, Homo sapiens
aauacuuuuuuuuuaaagccac

SEQ ID NO: 622736 - RNA, 20 nt, Homo sapiens
aauagaaauaaauuccuaaa

SEQ ID NO: 622737 - RNA, 15 nt, Homo sapiens
aauagaacaaccugc

SEQ ID NO: 622738 - RNA, 14 nt, Homo sapiens
aauagaacacugcc

SEQ ID NO: 622739 - RNA, 15 nt, Homo sapiens
aauagaacacugccu

SEQ ID NO: 622740 - RNA, 19 nt, Homo sapiens
aauagaacuaucugcauua

SEQ ID NO: 622741 - RNA, 11 nt, Homo sapiens
aauagacauac

SEQ ID NO: 622742 - RNA, 22 nt, Homo sapiens
aauagacuuaaaucucauugcu

SEQ ID NO: 622743 - RNA, 14 nt, Homo sapiens
aauagagccaacug

SEQ ID NO: 622744 - RNA, 16 nt, Homo sapiens
aauagaggggcauuca

SEQ ID NO: 622745 - RNA, 19 nt, Homo sapiens
aauagaucaguauuucacu

SEQ ID NO: 622746 - RNA, 21 nt, Homo sapiens
aauagauggauuuguaucaau

SEQ ID NO: 622747 - RNA, 22 nt, Homo sapiens
aauagauuguuuugccacuuag

SEQ ID NO: 622748 - RNA, 23 nt, Homo sapiens
aauagcauacaucaauggugugu

SEQ ID NO: 622749 - RNA, 14 nt, Homo sapiens
aauagccauaugca

SEQ ID NO: 622750 - RNA, 14 nt, Homo sapiens
aauagcuacuggaa

SEQ ID NO: 622751 - RNA, 21 nt, Homo sapiens
aauagcuccgaccuccaugau

SEQ ID NO: 622752 - RNA, 22 nt, Homo sapiens
aauagcugccuucaaggacugu

SEQ ID NO: 622753 - RNA, 22 nt, Homo sapiens
aauagcugcuaggguaggaaag

SEQ ID NO: 622754 - RNA, 12 nt, Homo sapiens
aauaggaccaga

SEQ ID NO: 622755 - RNA, 14 nt, Homo sapiens
aauaggcauuugau

SEQ ID NO: 622756 - RNA, 20 nt, Homo sapiens
aauagguagguuaguagccc

SEQ ID NO: 622757 - RNA, 19 nt, Homo sapiens
aauaggugcuuauucucaa

SEQ ID NO: 622758 - RNA, 14 nt, Homo sapiens
aauaguauuugcau

SEQ ID NO: 622759 - RNA, 9 nt, Homo sapiens
aauagucau

SEQ ID NO: 622760 - RNA, 12 nt, Homo sapiens
aauagucauucc

SEQ ID NO: 622761 - RNA, 18 nt, Homo sapiens
aauagucauuccaaauau

SEQ ID NO: 622762 - RNA, 21 nt, Homo sapiens
aauaguccaccucccauuacu

SEQ ID NO: 622763 - RNA, 23 nt, Homo sapiens
aauaguccaccucccauuacuuu

SEQ ID NO: 622764 - RNA, 15 nt, Homo sapiens
aauagucucacuguc

SEQ ID NO: 622765 - RNA, 15 nt, Homo sapiens
aauagucuuugccag

SEQ ID NO: 622766 - RNA, 13 nt, Homo sapiens
aauagugccacaa

SEQ ID NO: 622767 - RNA, 22 nt, Homo sapiens
aauagugccuaaagugcugcag

SEQ ID NO: 622768 - RNA, 16 nt, Homo sapiens
aauaguucaguagaau

SEQ ID NO: 622769 - RNA, 21 nt, Homo sapiens
aauaguucaguagaauuacca

SEQ ID NO: 622770 - RNA, 21 nt, Homo sapiens
aauaguucuauccuuuugccu

SEQ ID NO: 622771 - RNA, 14 nt, Homo sapiens
aauaguuuacaugu

SEQ ID NO: 622772 - RNA, 16 nt, Homo sapiens
aauaguuuacauguag

SEQ ID NO: 622773 - RNA, 16 nt, Homo sapiens
aauauaaaacagucau

SEQ ID NO: 622774 - RNA, 20 nt, Homo sapiens
aauauaagaaaaguaaugaa

SEQ ID NO: 622775 - RNA, 21 nt, Homo sapiens
aauauaaugaugcugucugaa

SEQ ID NO: 622776 - RNA, 22 nt, Homo sapiens
aauauaauuguaccaaccucau

SEQ ID NO: 622777 - RNA, 20 nt, Homo sapiens
aauauacgaaaagccagcuu

SEQ ID NO: 622778 - RNA, 14 nt, Homo sapiens
aauauacuaugaaa

SEQ ID NO: 622779 - RNA, 13 nt, Homo sapiens
aauauagugcaau

SEQ ID NO: 622780 - RNA, 15 nt, Homo sapiens
aauauauaaccagug

SEQ ID NO: 622781 - RNA, 14 nt, Homo sapiens
aauauauaagcuca

SEQ ID NO: 622782 - RNA, 21 nt, Homo sapiens
aauauauaguccagacacuua

SEQ ID NO: 622783 - RNA, 23 nt, Homo sapiens
aauauauauuaagugugccaaau

SEQ ID NO: 622784 - RNA, 22 nt, Homo sapiens
aauauaugucuauauacacaga

SEQ ID NO: 622785 - RNA, 20 nt, Homo sapiens
aauauauuuaucuucuucac

SEQ ID NO: 622786 - RNA, 18 nt, Homo sapiens
aauauauuucaagcuaua

SEQ ID NO: 622787 - RNA, 16 nt, Homo sapiens
aauauauuucuugcua

SEQ ID NO: 622788 - RNA, 18 nt, Homo sapiens
aauaucaacucucacucc

SEQ ID NO: 622789 - RNA, 20 nt, Homo sapiens
aauaucagaaguauaucugu

SEQ ID NO: 622790 - RNA, 23 nt, Homo sapiens
aauaucagugcucgagacacagu

SEQ ID NO: 622791 - RNA, 17 nt, Homo sapiens
aauauccacaguacuca

SEQ ID NO: 622792 - RNA, 21 nt, Homo sapiens
aauauccagugagcucuuuag

SEQ ID NO: 622793 - RNA, 15 nt, Homo sapiens
aauaucccaacauuc

SEQ ID NO: 622794 - RNA, 16 nt, Homo sapiens
aauaucccaacauucu

SEQ ID NO: 622795 - RNA, 18 nt, Homo sapiens
aauaucuaaacaucuuug

SEQ ID NO: 622796 - RNA, 15 nt, Homo sapiens
aauaucuggcacugu

SEQ ID NO: 622797 - RNA, 20 nt, Homo sapiens
aauaucuggcacuguuaaua

SEQ ID NO: 622798 - RNA, 17 nt, Homo sapiens
aauaucuugcuuucaaa

SEQ ID NO: 622799 - RNA, 20 nt, Homo sapiens
aauaucuuuuuuggaacuaa

SEQ ID NO: 622800 - RNA, 22 nt, Homo sapiens
aauaugaaaaucuccaucucaa

SEQ ID NO: 622801 - RNA, 23 nt, Homo sapiens
aauaugaaccuauuuucauuugu

SEQ ID NO: 622802 - RNA, 20 nt, Homo sapiens
aauaugacggaagaacauag

SEQ ID NO: 622803 - RNA, 21 nt, Homo sapiens
aauaugagaugcguuguuaca

SEQ ID NO: 622804 - RNA, 17 nt, Homo sapiens
aauaugaguuacugaag

SEQ ID NO: 622805 - RNA, 14 nt, Homo sapiens
aauaugaugccacu

SEQ ID NO: 622806 - RNA, 16 nt, Homo sapiens
aauaugcaagcagcuu

SEQ ID NO: 622807 - RNA, 21 nt, Homo sapiens
aauaugcacuuucccuagaaa

SEQ ID NO: 622808 - RNA, 14 nt, Homo sapiens
aauauggaacauau

SEQ ID NO: 622809 - RNA, 18 nt, Homo sapiens
aauauggaacauaugcac

SEQ ID NO: 622810 - RNA, 14 nt, Homo sapiens
aauaugggcacuuu

SEQ ID NO: 622811 - RNA, 17 nt, Homo sapiens
aauaugggcucaaguca

SEQ ID NO: 622812 - RNA, 18 nt, Homo sapiens
aacaugccugcaccugca

SEQ ID NO: 622813 - RNA, 20 nt, Homo sapiens
aacaugcugaaaacuacaca

SEQ ID NO: 622814 - RNA, 18 nt, Homo sapiens
aacauggcaauugcacuc

SEQ ID NO: 622815 - RNA, 18 nt, Homo sapiens
aacauggcuaaauacaau

SEQ ID NO: 622816 - RNA, 23 nt, Homo sapiens
aacauggcugaacgcguguguac

SEQ ID NO: 622817 - RNA, 22 nt, Homo sapiens
aacauggugaaaccucaucucu

SEQ ID NO: 622818 - RNA, 22 nt, Homo sapiens
aacauggugaaacuccaucucu

SEQ ID NO: 622819 - RNA, 21 nt, Homo sapiens
aacaugguuacaaucauugcu

SEQ ID NO: 622820 - RNA, 19 nt, Homo sapiens
aacauguaauuaaguacua

SEQ ID NO: 622821 - RNA, 16 nt, Homo sapiens
aacauguaauugcaga

SEQ ID NO: 622822 - RNA, 12 nt, Homo sapiens
aacauguacaaa

SEQ ID NO: 622823 - RNA, 17 nt, Homo sapiens
aacauguccuaauucuu

SEQ ID NO: 622824 - RNA, 12 nt, Homo sapiens
aacaugugaaaa

SEQ ID NO: 622825 - RNA, 18 nt, Homo sapiens
aacaugugacuaauugga

SEQ ID NO: 622826 - RNA, 21 nt, Homo sapiens
aacaugugaggcauucgggga

SEQ ID NO: 622827 - RNA, 19 nt, Homo sapiens
aacauguuguacauuucac

SEQ ID NO: 622828 - RNA, 18 nt, Homo sapiens
aacauuaaggaauuugau

SEQ ID NO: 622829 - RNA, 13 nt, Homo sapiens
aacauuaugccuu

SEQ ID NO: 622830 - RNA, 20 nt, Homo sapiens
aacauuauuagcacuucccg

SEQ ID NO: 622831 - RNA, 17 nt, Homo sapiens
aacauuauucaucucuc

SEQ ID NO: 622832 - RNA, 12 nt, Homo sapiens
aacauuauucca

SEQ ID NO: 622833 - RNA, 21 nt, Homo sapiens
aacauuauuuguaauagccaa

SEQ ID NO: 622834 - RNA, 17 nt, Homo sapiens
aacauucacagcccaga

SEQ ID NO: 622835 - RNA, 12 nt, Homo sapiens
aacauucaggaa

SEQ ID NO: 622836 - RNA, 15 nt, Homo sapiens
aacauucauagucuu

SEQ ID NO: 622837 - RNA, 13 nt, Homo sapiens
aacauucccacug

SEQ ID NO: 622838 - RNA, 21 nt, Homo sapiens
aacauuccuguugaugggaaa

SEQ ID NO: 622839 - RNA, 14 nt, Homo sapiens
aacauugaccaaga

SEQ ID NO: 622840 - RNA, 17 nt, Homo sapiens
aacauugacuucuuggu

SEQ ID NO: 622841 - RNA, 12 nt, Homo sapiens
aacauugccauu

SEQ ID NO: 622842 - RNA, 12 nt, Homo sapiens
aacauugcugcc

SEQ ID NO: 622843 - RNA, 15 nt, Homo sapiens
aacauuggcauuuga

SEQ ID NO: 622844 - RNA, 22 nt, Homo sapiens
aacauuuaaauaaaacuuucca

SEQ ID NO: 622845 - RNA, 15 nt, Homo sapiens
aacauuuaaauucca

SEQ ID NO: 622846 - RNA, 16 nt, Homo sapiens
aacauuuaaauuccac

SEQ ID NO: 622847 - RNA, 15 nt, Homo sapiens
aacauuucauuguac

SEQ ID NO: 622848 - RNA, 19 nt, Homo sapiens
aacauuucuuaaacacaaa

SEQ ID NO: 622849 - RNA, 13 nt, Homo sapiens
aacauuugccaag

SEQ ID NO: 622850 - RNA, 22 nt, Homo sapiens
aacauuugccaagugaguugaa

SEQ ID NO: 622851 - RNA, 17 nt, Homo sapiens
aacauuugccuugcaga

SEQ ID NO: 622852 - RNA, 21 nt, Homo sapiens
aacauuuuauuuuuaaaauau

SEQ ID NO: 622853 - RNA, 14 nt, Homo sapiens
aacauuuugacuaa

SEQ ID NO: 622854 - RNA, 22 nt, Homo sapiens
aaccaacaaaaagaacaaauca

SEQ ID NO: 622855 - RNA, 21 nt, Homo sapiens
aaccaacauuaaaacucauaa

SEQ ID NO: 622856 - RNA, 20 nt, Homo sapiens
aaccaagcauuuuggaauga

SEQ ID NO: 622857 - RNA, 14 nt, Homo sapiens
aaccaauaaaggaa

SEQ ID NO: 622858 - RNA, 10 nt, Homo sapiens
aaccacagag

SEQ ID NO: 622859 - RNA, 23 nt, Homo sapiens
aaccacauaguucguuuaccuuc

SEQ ID NO: 622860 - RNA, 15 nt, Homo sapiens
aaccacaugucccag

SEQ ID NO: 622861 - RNA, 23 nt, Homo sapiens
aaccacgccucuugaccaggcug

SEQ ID NO: 622862 - RNA, 22 nt, Homo sapiens
aaccacuaagaauucaaacugg

SEQ ID NO: 622863 - RNA, 17 nt, Homo sapiens
aaccacuccacuggccu

SEQ ID NO: 622864 - RNA, 21 nt, Homo sapiens
aaccacugcuaugccauuucu

SEQ ID NO: 622865 - RNA, 22 nt, Homo sapiens
aaccacuucagcugacuuuucu

SEQ ID NO: 622866 - RNA, 18 nt, Homo sapiens
aaccacuucauucuugaa

SEQ ID NO: 622867 - RNA, 19 nt, Homo sapiens
aaccacuugccucuuucuc

SEQ ID NO: 622868 - RNA, 21 nt, Homo sapiens
aaccagaacaguaugaauuug

SEQ ID NO: 622869 - RNA, 14 nt, Homo sapiens
aaccagacaccucc

SEQ ID NO: 622870 - RNA, 19 nt, Homo sapiens
aaccagacucuugccuguu

SEQ ID NO: 622871 - RNA, 20 nt, Homo sapiens
aaccagacucuugccuguuu

SEQ ID NO: 622872 - RNA, 17 nt, Homo sapiens
aaccagagaaucuuaag

SEQ ID NO: 622873 - RNA, 13 nt, Homo sapiens
aaccagagaggcu

SEQ ID NO: 622874 - RNA, 17 nt, Homo sapiens
aaccagagccacaggcc

SEQ ID NO: 622875 - RNA, 14 nt, Homo sapiens
aaucaacaccuuaa

SEQ ID NO: 622876 - RNA, 21 nt, Homo sapiens
aaucaacccugcaaucacuuu

SEQ ID NO: 622877 - RNA, 20 nt, Homo sapiens
aaucaagaaaaacaucuuug

SEQ ID NO: 622878 - RNA, 20 nt, Homo sapiens
aaucaagcuagaaggccaca

SEQ ID NO: 622879 - RNA, 22 nt, Homo sapiens
aaucaaggaaaggcucauuuaa

SEQ ID NO: 622880 - RNA, 22 nt, Homo sapiens
aaucaaguauuugggaagugaa

SEQ ID NO: 622881 - RNA, 16 nt, Homo sapiens
aaucaauggugcaaaa

SEQ ID NO: 622882 - RNA, 20 nt, Homo sapiens
aaucaauguguacaagugga

SEQ ID NO: 622883 - RNA, 19 nt, Homo sapiens
aaucacaaaccaagccaug

SEQ ID NO: 622884 - RNA, 20 nt, Homo sapiens
aaucacaaggcaacugugag

SEQ ID NO: 622885 - RNA, 16 nt, Homo sapiens
aaucacaucacuaccu

SEQ ID NO: 622886 - RNA, 13 nt, Homo sapiens
aaucaccaaagua

SEQ ID NO: 622887 - RNA, 21 nt, Homo sapiens
aaucaccaauaaauaagugca

SEQ ID NO: 622888 - RNA, 18 nt, Homo sapiens
aaucaccauguaagcacu

SEQ ID NO: 622889 - RNA, 12 nt, Homo sapiens
aaucacucacaa

SEQ ID NO: 622890 - RNA, 19 nt, Homo sapiens
aaucacucacaagcaaucc

SEQ ID NO: 622891 - RNA, 14 nt, Homo sapiens
aaucacugucaaua

SEQ ID NO: 622892 - RNA, 19 nt, Homo sapiens
aaucacuucuccaaucagu

SEQ ID NO: 622893 - RNA, 14 nt, Homo sapiens
aaucacuugcacuc

SEQ ID NO: 622894 - RNA, 18 nt, Homo sapiens
aaucacuuuaagaucuuu

SEQ ID NO: 622895 - RNA, 14 nt, Homo sapiens
aaucagaaaucaua

SEQ ID NO: 622896 - RNA, 20 nt, Homo sapiens
aaucagacugacaguuuaca

SEQ ID NO: 622897 - RNA, 18 nt, Homo sapiens
aaucagaguguacaaauu

SEQ ID NO: 622898 - RNA, 14 nt, Homo sapiens
aaucagaucauuuc

SEQ ID NO: 622899 - RNA, 20 nt, Homo sapiens
aaucagauucuucucucuca

SEQ ID NO: 622900 - RNA, 14 nt, Homo sapiens
aaucagcauucuca

SEQ ID NO: 622901 - RNA, 16 nt, Homo sapiens
aaucagccacauucua

SEQ ID NO: 622902 - RNA, 23 nt, Homo sapiens
aaucagccauaagaaagcacuau

SEQ ID NO: 622903 - RNA, 18 nt, Homo sapiens
aaucagcgauguauauaa

SEQ ID NO: 622904 - RNA, 13 nt, Homo sapiens
aaucagcugcuca

SEQ ID NO: 622905 - RNA, 18 nt, Homo sapiens
aaucaggaauauuuucca

SEQ ID NO: 622906 - RNA, 22 nt, Homo sapiens
aaucaggacagguggugcaaau

SEQ ID NO: 622907 - RNA, 18 nt, Homo sapiens
aaucagggaaaaugcgca

SEQ ID NO: 622908 - RNA, 20 nt, Homo sapiens
aaucagugaagccaaaggga

SEQ ID NO: 622909 - RNA, 22 nt, Homo sapiens
aaucaguuuauccugacauauu

SEQ ID NO: 622910 - RNA, 19 nt, Homo sapiens
aaucauacaaacucucacc

SEQ ID NO: 622911 - RNA, 19 nt, Homo sapiens
aaucauauucauaugcaga

SEQ ID NO: 622912 - RNA, 13 nt, Homo sapiens
aaucaucaaguaa

SEQ ID NO: 622913 - RNA, 18 nt, Homo sapiens
aaucaucaaguaauacaa

SEQ ID NO: 622914 - RNA, 14 nt, Homo sapiens
aaucauccaucacu

SEQ ID NO: 622915 - RNA, 23 nt, Homo sapiens
aaucaucuauaaagaagaacuug

SEQ ID NO: 622916 - RNA, 21 nt, Homo sapiens
aaucaugaaauaugcaucuca

SEQ ID NO: 622917 - RNA, 18 nt, Homo sapiens
aaucaugagcaagugaac

SEQ ID NO: 622918 - RNA, 16 nt, Homo sapiens
aaucaugccauugcac

SEQ ID NO: 622919 - RNA, 16 nt, Homo sapiens
aaucaugcucauguau

SEQ ID NO: 622920 - RNA, 20 nt, Homo sapiens
aaucauggauuauguugaca

SEQ ID NO: 622921 - RNA, 15 nt, Homo sapiens
aaucauuauguuucc

SEQ ID NO: 622922 - RNA, 23 nt, Homo sapiens
aaucauugauugucagcuacuaa

SEQ ID NO: 622923 - RNA, 11 nt, Homo sapiens
aaucauuuccc

SEQ ID NO: 622924 - RNA, 15 nt, Homo sapiens
aaucauuuguucaaa

SEQ ID NO: 622925 - RNA, 20 nt, Homo sapiens
aaucauuuugaguuugccuc

SEQ ID NO: 622926 - RNA, 23 nt, Homo sapiens
aaucauuuugaguuugccucagu

SEQ ID NO: 622927 - RNA, 16 nt, Homo sapiens
aaucauuuugccucuu

SEQ ID NO: 622928 - RNA, 15 nt, Homo sapiens
aauccaaauuucuca

SEQ ID NO: 622929 - RNA, 16 nt, Homo sapiens
aauccaauaucauguc

SEQ ID NO: 622930 - RNA, 19 nt, Homo sapiens
aauccaauggguuuuuccc

SEQ ID NO: 622931 - RNA, 15 nt, Homo sapiens
aauccacaagccauu

SEQ ID NO: 622932 - RNA, 17 nt, Homo sapiens
aauccagcaucuauacg

SEQ ID NO: 622933 - RNA, 12 nt, Homo sapiens
aauccaguauua

SEQ ID NO: 622934 - RNA, 19 nt, Homo sapiens
aauccagugagcacuagaa

SEQ ID NO: 622935 - RNA, 21 nt, Homo sapiens
aauccauccaaaguucccuau

SEQ ID NO: 622936 - RNA, 13 nt, Homo sapiens
aauccauccugcu

SEQ ID NO: 622937 - RNA, 15 nt, Homo sapiens
aauccauccugcuca

SEQ ID NO: 622938 - RNA, 11 nt, Homo sapiens
aauccaugcuu

SEQ ID NO: 622939 - RNA, 20 nt, Homo sapiens
aauccaugugaccauucugc

SEQ ID NO: 622940 - RNA, 17 nt, Homo sapiens
aauccauuauccuuuau

SEQ ID NO: 622941 - RNA, 14 nt, Homo sapiens
aauccauuccucuu

SEQ ID NO: 622942 - RNA, 18 nt, Homo sapiens
aauccauuuuacacagca

SEQ ID NO: 622943 - RNA, 14 nt, Homo sapiens
aaucccaaaccauu

SEQ ID NO: 622944 - RNA, 17 nt, Homo sapiens
aaucccaauucuguccc

SEQ ID NO: 622945 - RNA, 19 nt, Homo sapiens
aaucccaggaaagaggcau

SEQ ID NO: 622946 - RNA, 11 nt, Homo sapiens
aauccccagac

SEQ ID NO: 622947 - RNA, 16 nt, Homo sapiens
aaucccccagcacuuc

SEQ ID NO: 622948 - RNA, 16 nt, Homo sapiens
aaucccggugcuugca

SEQ ID NO: 622949 - RNA, 14 nt, Homo sapiens
aaucccuccuucau

SEQ ID NO: 622950 - RNA, 21 nt, Homo sapiens
aaucccucuccacucuucucu

SEQ ID NO: 622951 - RNA, 13 nt, Homo sapiens
aauccgaagggaa

SEQ ID NO: 622952 - RNA, 14 nt, Homo sapiens
aauccgaaguauga

SEQ ID NO: 622953 - RNA, 13 nt, Homo sapiens
aauccuagcacuu

SEQ ID NO: 622954 - RNA, 16 nt, Homo sapiens
aauccuagcacuuugg

SEQ ID NO: 622955 - RNA, 17 nt, Homo sapiens
acagagggcaggcacuc

SEQ ID NO: 622956 - RNA, 16 nt, Homo sapiens
acagagggcugcauuc

SEQ ID NO: 622957 - RNA, 21 nt, Homo sapiens
acagaggggcucgguggccca

SEQ ID NO: 622958 - RNA, 15 nt, Homo sapiens
acagagggucccauu

SEQ ID NO: 622959 - RNA, 18 nt, Homo sapiens
acagagggugaaagggac

SEQ ID NO: 622960 - RNA, 15 nt, Homo sapiens
acagaguaucagauc

SEQ ID NO: 622961 - RNA, 13 nt, Homo sapiens
acagagucuugcu

SEQ ID NO: 622962 - RNA, 20 nt, Homo sapiens
acagagucuugcucugucuc

SEQ ID NO: 622963 - RNA, 16 nt, Homo sapiens
acagagugaauuucag

SEQ ID NO: 622964 - RNA, 17 nt, Homo sapiens
acagagugcauugugag

SEQ ID NO: 622965 - RNA, 18 nt, Homo sapiens
acagaguggggagcuccu

SEQ ID NO: 622966 - RNA, 21 nt, Homo sapiens
acagaguggucuuucuggaga

SEQ ID NO: 622967 - RNA, 14 nt, Homo sapiens
acagaguuguuaca

SEQ ID NO: 622968 - RNA, 13 nt, Homo sapiens
acagauaccucca

SEQ ID NO: 622969 - RNA, 17 nt, Homo sapiens
acagauagacagugcug

SEQ ID NO: 622970 - RNA, 22 nt, Homo sapiens
acagauagaugcagguccauuc

SEQ ID NO: 622971 - RNA, 18 nt, Homo sapiens
acagaucaagcugugaga

SEQ ID NO: 622972 - RNA, 16 nt, Homo sapiens
acagaucacuccugga

SEQ ID NO: 622973 - RNA, 18 nt, Homo sapiens
acagauccccaagccugg

SEQ ID NO: 622974 - RNA, 21 nt, Homo sapiens
acagaucuuuacucuugagaa

SEQ ID NO: 622975 - RNA, 12 nt, Homo sapiens
acagaugaaggu

SEQ ID NO: 622976 - RNA, 16 nt, Homo sapiens
acagauggacacugcc

SEQ ID NO: 622977 - RNA, 19 nt, Homo sapiens
acagauggauagucugucc

SEQ ID NO: 622978 - RNA, 20 nt, Homo sapiens
acagauggggaaacugaggc

SEQ ID NO: 622979 - RNA, 19 nt, Homo sapiens
acagauggggucugugacu

SEQ ID NO: 622980 - RNA, 20 nt, Homo sapiens
acagauggggucugugacug

SEQ ID NO: 622981 - RNA, 22 nt, Homo sapiens
acagauucacuuuguuuaugca

SEQ ID NO: 622982 - RNA, 23 nt, Homo sapiens
acagauuggccagaaaccuuccu

SEQ ID NO: 622983 - RNA, 18 nt, Homo sapiens
acagcaaaacuccaucuc

SEQ ID NO: 622984 - RNA, 19 nt, Homo sapiens
acagcaaaacuccaucuca

SEQ ID NO: 622985 - RNA, 21 nt, Homo sapiens
acagcaaccucuucaugagcu

SEQ ID NO: 622986 - RNA, 22 nt, Homo sapiens
acagcaaccucuucaugagcuu

SEQ ID NO: 622987 - RNA, 19 nt, Homo sapiens
acagcaagacuccgucuca

SEQ ID NO: 622988 - RNA, 17 nt, Homo sapiens
acagcaaggauggagcu

SEQ ID NO: 622989 - RNA, 19 nt, Homo sapiens
acagcacgggggccaagga

SEQ ID NO: 622990 - RNA, 16 nt, Homo sapiens
acagcacuacugggug

SEQ ID NO: 622991 - RNA, 15 nt, Homo sapiens
acagcagcacuguuc

SEQ ID NO: 622992 - RNA, 20 nt, Homo sapiens
acagcagcacuguucugucc

SEQ ID NO: 622993 - RNA, 17 nt, Homo sapiens
acagcagccccugcaca

SEQ ID NO: 622994 - RNA, 20 nt, Homo sapiens
acagcagggucuugcuguaa

SEQ ID NO: 622995 - RNA, 12 nt, Homo sapiens
acagcagguggg

SEQ ID NO: 622996 - RNA, 16 nt, Homo sapiens
acagcaucauuuugca

SEQ ID NO: 622997 - RNA, 18 nt, Homo sapiens
acagcaugaauaaaacac

SEQ ID NO: 622998 - RNA, 13 nt, Homo sapiens
acagcauguguau

SEQ ID NO: 622999 - RNA, 23 nt, Homo sapiens
acagcauuaacugucuuaaagag

SEQ ID NO: 623000 - RNA, 15 nt, Homo sapiens
acagcauucuuguca

SEQ ID NO: 623001 - RNA, 12 nt, Homo sapiens
acagccagugac

SEQ ID NO: 623002 - RNA, 23 nt, Homo sapiens
acagccagugggagauguuagac

SEQ ID NO: 623003 - RNA, 22 nt, Homo sapiens
acagccauaaaaaggaacaaga

SEQ ID NO: 623004 - RNA, 17 nt, Homo sapiens
acagcccagaaccacag

SEQ ID NO: 623005 - RNA, 23 nt, Homo sapiens
acagcccaggacaccuuucucug

SEQ ID NO: 623006 - RNA, 17 nt, Homo sapiens
acagcccaggcaucucc

SEQ ID NO: 623007 - RNA, 19 nt, Homo sapiens
acagcccaggcaucuccuu

SEQ ID NO: 623008 - RNA, 13 nt, Homo sapiens
acagcccaucacc

SEQ ID NO: 623009 - RNA, 19 nt, Homo sapiens
acagccccucuggacacag

SEQ ID NO: 623010 - RNA, 22 nt, Homo sapiens
acagccccuuccucugccaggu

SEQ ID NO: 623011 - RNA, 18 nt, Homo sapiens
acagcccuuaugcgguua

SEQ ID NO: 623012 - RNA, 17 nt, Homo sapiens
acagccguguguucaaa

SEQ ID NO: 623013 - RNA, 15 nt, Homo sapiens
acagccucagaauaa

SEQ ID NO: 623014 - RNA, 18 nt, Homo sapiens
acagccucagaauaaaag

SEQ ID NO: 623015 - RNA, 19 nt, Homo sapiens
acagccucagaauaaaaga

SEQ ID NO: 623016 - RNA, 21 nt, Homo sapiens
acagccucccacccccaucuc

SEQ ID NO: 623017 - RNA, 23 nt, Homo sapiens
acagccucccacccccaucucuc

SEQ ID NO: 623018 - RNA, 18 nt, Homo sapiens
acagccucugaaaaccaa

SEQ ID NO: 623019 - RNA, 14 nt, Homo sapiens
acagccucuugccc

SEQ ID NO: 623020 - RNA, 23 nt, Homo sapiens
acagccucuuuccuaacuuccuu

SEQ ID NO: 623021 - RNA, 18 nt, Homo sapiens
acagccuggcacagggca

SEQ ID NO: 623022 - RNA, 23 nt, Homo sapiens
acagccuuauuuuuguaugccuu

SEQ ID NO: 623023 - RNA, 23 nt, Homo sapiens
acagccuuucguucugcugacca

SEQ ID NO: 623024 - RNA, 19 nt, Homo sapiens
acagcgaagacugcuaaau

SEQ ID NO: 623025 - RNA, 12 nt, Homo sapiens
acagcgauuccc

SEQ ID NO: 623026 - RNA, 21 nt, Homo sapiens
acagcguggaugucgaugacu

SEQ ID NO: 623027 - RNA, 21 nt, Homo sapiens
acagcuacucuccccacgagg

SEQ ID NO: 623028 - RNA, 19 nt, Homo sapiens
acagcuaucgaacuucaca

SEQ ID NO: 623029 - RNA, 21 nt, Homo sapiens
acagcuauuauauaaauauau

SEQ ID NO: 623030 - RNA, 19 nt, Homo sapiens
acagcucagagaugaaacu

SEQ ID NO: 623031 - RNA, 14 nt, Homo sapiens
acagcuccaggaca

SEQ ID NO: 623032 - RNA, 20 nt, Homo sapiens
acagcucgggcccucuguga

SEQ ID NO: 623033 - RNA, 23 nt, Homo sapiens
acagcugcucaauaaaguacaag

SEQ ID NO: 623034 - RNA, 20 nt, Homo sapiens
acagcugggcaaagccacaa

SEQ ID NO: 623035 - RNA, 15 nt, Homo sapiens
acagcuguaauaaca

SEQ ID NO: 623036 - RNA, 21 nt, Homo sapiens
acagcuguaaucccagcacuu

SEQ ID NO: 623037 - RNA, 22 nt, Homo sapiens
acagcuguaguaccccaagaag

SEQ ID NO: 623038 - RNA, 22 nt, Homo sapiens
acagcugugucugccaaacaca

SEQ ID NO: 623039 - RNA, 15 nt, Homo sapiens
acagcuuaaucaaaa

SEQ ID NO: 623040 - RNA, 14 nt, Homo sapiens
acagcuuucacagu

SEQ ID NO: 623041 - RNA, 16 nt, Homo sapiens
acagcuuucugugcag

SEQ ID NO: 623042 - RNA, 15 nt, Homo sapiens
caauguauguacaau

SEQ ID NO: 623043 - RNA, 11 nt, Homo sapiens
caaugucuucc

SEQ ID NO: 623044 - RNA, 21 nt, Homo sapiens
caaugugaaaccaucacagcu

SEQ ID NO: 623045 - RNA, 16 nt, Homo sapiens
caaugugggaucucag

SEQ ID NO: 623046 - RNA, 12 nt, Homo sapiens
caauguguacaa

SEQ ID NO: 623047 - RNA, 15 nt, Homo sapiens
caauguuagccucaa

SEQ ID NO: 623048 - RNA, 16 nt, Homo sapiens
caauguuaucaaccaa

SEQ ID NO: 623049 - RNA, 15 nt, Homo sapiens
caauguucauagcaa

SEQ ID NO: 623050 - RNA, 19 nt, Homo sapiens
caauguugguuucacugag

SEQ ID NO: 623051 - RNA, 20 nt, Homo sapiens
caauguugguuucacugaga

SEQ ID NO: 623052 - RNA, 21 nt, Homo sapiens
caauguuuaugcaaggaagga

SEQ ID NO: 623053 - RNA, 10 nt, Homo sapiens
caauguuuca

SEQ ID NO: 623054 - RNA, 18 nt, Homo sapiens
caauguuuuaaacagagu

SEQ ID NO: 623055 - RNA, 18 nt, Homo sapiens
caauguuuuuaaaaaucu

SEQ ID NO: 623056 - RNA, 17 nt, Homo sapiens
caauuaaaaacaugaau

SEQ ID NO: 623057 - RNA, 19 nt, Homo sapiens
caauuaaaccgcaugugau

SEQ ID NO: 623058 - RNA, 17 nt, Homo sapiens
caauuaacauaugucac

SEQ ID NO: 623059 - RNA, 23 nt, Homo sapiens
caauuaacaucgugggucacuac

SEQ ID NO: 623060 - RNA, 13 nt, Homo sapiens
caauuaaucauuu

SEQ ID NO: 623061 - RNA, 18 nt, Homo sapiens
caauuaauucaucccuua

SEQ ID NO: 623062 - RNA, 17 nt, Homo sapiens
caauuacagcaaaaagg

SEQ ID NO: 623063 - RNA, 15 nt, Homo sapiens
caauuacuauucccu

SEQ ID NO: 623064 - RNA, 20 nt, Homo sapiens
caauuagacaaacagcauca

SEQ ID NO: 623065 - RNA, 18 nt, Homo sapiens
caauuauacuaaaccuca

SEQ ID NO: 623066 - RNA, 22 nt, Homo sapiens
caauuauagaguaucacuccca

SEQ ID NO: 623067 - RNA, 18 nt, Homo sapiens
caauuauauuuauauuuc

SEQ ID NO: 623068 - RNA, 17 nt, Homo sapiens
caauuaucaucuuuuga

SEQ ID NO: 623069 - RNA, 17 nt, Homo sapiens
caauuaugaacauccaa

SEQ ID NO: 623070 - RNA, 13 nt, Homo sapiens
caauuaugucucu

SEQ ID NO: 623071 - RNA, 14 nt, Homo sapiens
caauuaugugcaaa

SEQ ID NO: 623072 - RNA, 21 nt, Homo sapiens
caauucaaaacauugugccau

SEQ ID NO: 623073 - RNA, 16 nt, Homo sapiens
caauucaauagagaaa

SEQ ID NO: 623074 - RNA, 20 nt, Homo sapiens
caauucagauugucuugcaa

SEQ ID NO: 623075 - RNA, 22 nt, Homo sapiens
caauucauauauuugaagugga

SEQ ID NO: 623076 - RNA, 21 nt, Homo sapiens
caauucauggauaugagggug

SEQ ID NO: 623077 - RNA, 20 nt, Homo sapiens
caauuccaaaggaaucucca

SEQ ID NO: 623078 - RNA, 18 nt, Homo sapiens
caauuccaccaagacagu

SEQ ID NO: 623079 - RNA, 20 nt, Homo sapiens
caauuccaccaagacagugc

SEQ ID NO: 623080 - RNA, 20 nt, Homo sapiens
caauucccccuuaaacuucc

SEQ ID NO: 623081 - RNA, 21 nt, Homo sapiens
caauucccccuuaaacuucca

SEQ ID NO: 623082 - RNA, 14 nt, Homo sapiens
caauuccucugaua

SEQ ID NO: 623083 - RNA, 21 nt, Homo sapiens
caauucuauuacgugcaauac

SEQ ID NO: 623084 - RNA, 13 nt, Homo sapiens
caauucuccugcc

SEQ ID NO: 623085 - RNA, 23 nt, Homo sapiens
caauucugggugcgagugugaga

SEQ ID NO: 623086 - RNA, 19 nt, Homo sapiens
caauucuuagaauaucuaa

SEQ ID NO: 623087 - RNA, 16 nt, Homo sapiens
caauugaaaugcauug

SEQ ID NO: 623088 - RNA, 19 nt, Homo sapiens
caauugaccuucucccuca

SEQ ID NO: 623089 - RNA, 23 nt, Homo sapiens
caauugagaaaaauauauacuaa

SEQ ID NO: 623090 - RNA, 18 nt, Homo sapiens
caauuggcccaacacugu

SEQ ID NO: 623091 - RNA, 17 nt, Homo sapiens
caauugggcagaugugu

SEQ ID NO: 623092 - RNA, 23 nt, Homo sapiens
caauugguaaaacucacugugau

SEQ ID NO: 623093 - RNA, 15 nt, Homo sapiens
caauugugcugccau

SEQ ID NO: 623094 - RNA, 20 nt, Homo sapiens
caauugugcugccauuugau

SEQ ID NO: 623095 - RNA, 17 nt, Homo sapiens
caauuuaaaauuauuca

SEQ ID NO: 623096 - RNA, 17 nt, Homo sapiens
caauuuaacauguguau

SEQ ID NO: 623097 - RNA, 11 nt, Homo sapiens
caauuuaguuc

SEQ ID NO: 623098 - RNA, 16 nt, Homo sapiens
caauuuauuacugaaa
